United States Patent 7,655,785 (BIOINFORMATICALLY DETECTABLE GROUP OF NOVEL REGULATORY OLIGONUCLEOTIDES AND USES THEREOF) - sequence listing, part 32

SEQ ID NO: 1309742 - RNA, 20 nt, Homo sapiens
uguuaccugaaaacacugug

SEQ ID NO: 1309743 - RNA, 23 nt, Homo sapiens
uguuaccugaaaacacugugcac

SEQ ID NO: 1309744 - RNA, 20 nt, Homo sapiens
uguuacugcuuugcaaagac

SEQ ID NO: 1309745 - RNA, 20 nt, Homo sapiens
uguuacuuuuucuuguauuc

SEQ ID NO: 1309746 - RNA, 14 nt, Homo sapiens
uguuagguucacac

SEQ ID NO: 1309747 - RNA, 17 nt, Homo sapiens
uguuagugguuacccag

SEQ ID NO: 1309748 - RNA, 15 nt, Homo sapiens
uguuaucagucaaua

SEQ ID NO: 1309749 - RNA, 23 nt, Homo sapiens
uguuauuauauuccguagguaga

SEQ ID NO: 1309750 - RNA, 14 nt, Homo sapiens
uguuauucuugccc

SEQ ID NO: 1309751 - RNA, 21 nt, Homo sapiens
uguuauugccucuacuuugau

SEQ ID NO: 1309752 - RNA, 22 nt, Homo sapiens
uuaagagaauauuuuaaguauu

SEQ ID NO: 1309753 - RNA, 23 nt, Homo sapiens
uuaagaggacauaaugggguccu

SEQ ID NO: 1309754 - RNA, 17 nt, Homo sapiens
uuaaggaacaucucugc

SEQ ID NO: 1309755 - RNA, 22 nt, Homo sapiens
uuaaguccuuaaugaagagcca

SEQ ID NO: 1309756 - RNA, 21 nt, Homo sapiens
uuaagucuuaucaagcagcca

SEQ ID NO: 1309757 - RNA, 22 nt, Homo sapiens
uuaauaguaccuaaaauugcaa

SEQ ID NO: 1309758 - RNA, 23 nt, Homo sapiens
uuaauauaguugguacacaacua

SEQ ID NO: 1309759 - RNA, 14 nt, Homo sapiens
uuaaucaaaccacu

SEQ ID NO: 1309760 - RNA, 15 nt, Homo sapiens
uuaaucaccacucaa

SEQ ID NO: 1309761 - RNA, 12 nt, Homo sapiens
uuaauccagcug

SEQ ID NO: 1309762 - RNA, 20 nt, Homo sapiens
uuaaucuaccuugcagugua

SEQ ID NO: 1309763 - RNA, 17 nt, Homo sapiens
uuaaugcuuauaagaca

SEQ ID NO: 1309764 - RNA, 18 nt, Homo sapiens
uuaaugugcugagcauuu

SEQ ID NO: 1309765 - RNA, 14 nt, Homo sapiens
uuaauuuagcuuag

SEQ ID NO: 1309766 - RNA, 17 nt, Homo sapiens
uuaauuuucaacucaau

SEQ ID NO: 1309767 - RNA, 17 nt, Homo sapiens
uuaauuuuuaaugcuua

SEQ ID NO: 1309768 - RNA, 16 nt, Homo sapiens
uuacaaccugauguca

SEQ ID NO: 1309769 - RNA, 18 nt, Homo sapiens
uuacaauuuacaaagugu

SEQ ID NO: 1309770 - RNA, 19 nt, Homo sapiens
uuacacagaaaugcugcug

SEQ ID NO: 1309771 - RNA, 14 nt, Homo sapiens
uuacauaaagugag

SEQ ID NO: 1309772 - RNA, 22 nt, Homo sapiens
uuacaucaugcuggaaccugca

SEQ ID NO: 1309773 - RNA, 15 nt, Homo sapiens
uuacaucuacaaaca

SEQ ID NO: 1309774 - RNA, 14 nt, Homo sapiens
uuacauuguugagc

SEQ ID NO: 1309775 - RNA, 14 nt, Homo sapiens
uuacauuuuaguua

SEQ ID NO: 1309776 - RNA, 20 nt, Homo sapiens
uuaccaucacugaguuuucc

SEQ ID NO: 1309777 - RNA, 17 nt, Homo sapiens
uuaccauucaacugaac

SEQ ID NO: 1309778 - RNA, 19 nt, Homo sapiens
uuacccacacacagauaaa

SEQ ID NO: 1309779 - RNA, 13 nt, Homo sapiens
uuacccacugcca

SEQ ID NO: 1309780 - RNA, 17 nt, Homo sapiens
uuacccugaggucacug

SEQ ID NO: 1309781 - RNA, 22 nt, Homo sapiens
uuaccugaaauaaaauucauua

SEQ ID NO: 1309782 - RNA, 19 nt, Homo sapiens
uuaccugucauuuugcacu

SEQ ID NO: 1309783 - RNA, 18 nt, Homo sapiens
uuaccuguucaguacucu

SEQ ID NO: 1309784 - RNA, 14 nt, Homo sapiens
uuacuaaaaacaca

SEQ ID NO: 1309785 - RNA, 11 nt, Homo sapiens
uuacucugaag

SEQ ID NO: 1309786 - RNA, 16 nt, Homo sapiens
uuacugcuugaccaaa

SEQ ID NO: 1309787 - RNA, 18 nt, Homo sapiens
uuacugcuugaccaaaga

SEQ ID NO: 1309788 - RNA, 22 nt, Homo sapiens
uuacuggacaaagaauuccaaa

SEQ ID NO: 1309789 - RNA, 16 nt, Homo sapiens
uuacuguaaaggcaag

SEQ ID NO: 1309790 - RNA, 21 nt, Homo sapiens
uuacugugcaccuagagcuuu

SEQ ID NO: 1309791 - RNA, 12 nt, Homo sapiens
uuacuuaucccu

SEQ ID NO: 1309792 - RNA, 22 nt, Homo sapiens
uuacuuuagauggcaagcaugu

SEQ ID NO: 1309793 - RNA, 21 nt, Homo sapiens
uuagaaacuaagagaaugaua

SEQ ID NO: 1309794 - RNA, 15 nt, Homo sapiens
uuagacccugcauuu

SEQ ID NO: 1309795 - RNA, 13 nt, Homo sapiens
uuagagaaugaga

SEQ ID NO: 1309796 - RNA, 22 nt, Homo sapiens
uuagagacaguugggugagaac

SEQ ID NO: 1309797 - RNA, 17 nt, Homo sapiens
uuagagugucuuuccac

SEQ ID NO: 1309798 - RNA, 17 nt, Homo sapiens
uuagaguuagacuguug

SEQ ID NO: 1309799 - RNA, 12 nt, Homo sapiens
uuagauugugag

SEQ ID NO: 1309800 - RNA, 15 nt, Homo sapiens
uuagcagcagccuuu

SEQ ID NO: 1309801 - RNA, 15 nt, Homo sapiens
uuagcccaaaaccaa

SEQ ID NO: 1309802 - RNA, 19 nt, Homo sapiens
uuagccuaaauguuaacua

SEQ ID NO: 1309803 - RNA, 10 nt, Homo sapiens
uuagccuuua

SEQ ID NO: 1309804 - RNA, 20 nt, Homo sapiens
uuagcuaguuuuauucuugg

SEQ ID NO: 1309805 - RNA, 12 nt, Homo sapiens
uuagcuucagga

SEQ ID NO: 1309806 - RNA, 15 nt, Homo sapiens
uuaggcuauucacaa

SEQ ID NO: 1309807 - RNA, 20 nt, Homo sapiens
uuaggguucugccucuccag

SEQ ID NO: 1309808 - RNA, 15 nt, Homo sapiens
uuagugauggagcuu

SEQ ID NO: 1309809 - RNA, 14 nt, Homo sapiens
uuagugcagccaag

SEQ ID NO: 1309810 - RNA, 13 nt, Homo sapiens
uuaguuauacucc

SEQ ID NO: 1309811 - RNA, 15 nt, Homo sapiens
uuaguuauacuccuc

SEQ ID NO: 1309812 - RNA, 16 nt, Homo sapiens
uuauaaaauuaagcaa

SEQ ID NO: 1309813 - RNA, 18 nt, Homo sapiens
uuauaauuggugcauagc

SEQ ID NO: 1309814 - RNA, 13 nt, Homo sapiens
uuauacugcugua

SEQ ID NO: 1309815 - RNA, 12 nt, Homo sapiens
uuauacuguaua

SEQ ID NO: 1309816 - RNA, 13 nt, Homo sapiens
uuauagaucauuu

SEQ ID NO: 1309817 - RNA, 12 nt, Homo sapiens
uuauauguugcu

SEQ ID NO: 1309818 - RNA, 21 nt, Homo sapiens
uuaucaacuuccuaaauauua

SEQ ID NO: 1309819 - RNA, 12 nt, Homo sapiens
uuaucaccucau

SEQ ID NO: 1309820 - RNA, 14 nt, Homo sapiens
uuaucagcaaaaaa

SEQ ID NO: 1309821 - RNA, 19 nt, Homo sapiens
uuaucaugcaaaugcugua

SEQ ID NO: 1309822 - RNA, 23 nt, Homo sapiens
uuaucgggcuccagccaucucau

SEQ ID NO: 1309823 - RNA, 15 nt, Homo sapiens
uuaucuaagaauaca

SEQ ID NO: 1309824 - RNA, 21 nt, Homo sapiens
uuaugaauauaaugaaugaga

SEQ ID NO: 1309825 - RNA, 15 nt, Homo sapiens
uuaugagaaacugca

SEQ ID NO: 1309826 - RNA, 23 nt, Homo sapiens
uuaugccauagcaagauugcuua

SEQ ID NO: 1309827 - RNA, 20 nt, Homo sapiens
uuaugguaccagaugcagcu

SEQ ID NO: 1309828 - RNA, 14 nt, Homo sapiens
uuauggugcauuac

SEQ ID NO: 1309829 - RNA, 13 nt, Homo sapiens
uuauguacaacug

SEQ ID NO: 1309830 - RNA, 18 nt, Homo sapiens
uuauguaguaauugacau

SEQ ID NO: 1309831 - RNA, 23 nt, Homo sapiens
uuauguauaaaauguaacacuga

SEQ ID NO: 1309832 - RNA, 20 nt, Homo sapiens
uuauguauuuucuuccaccc

SEQ ID NO: 1309833 - RNA, 22 nt, Homo sapiens
uuauuaaaagaugucucugcaa

SEQ ID NO: 1309834 - RNA, 14 nt, Homo sapiens
uuauuaaaucaaaa

SEQ ID NO: 1309835 - RNA, 19 nt, Homo sapiens
uuauuacauggggucuaga

SEQ ID NO: 1309836 - RNA, 14 nt, Homo sapiens
uuauuacauguaau

SEQ ID NO: 1309837 - RNA, 19 nt, Homo sapiens
uuauuacauguaauuugau

SEQ ID NO: 1309838 - RNA, 12 nt, Homo sapiens
uuauuaccucug

SEQ ID NO: 1309839 - RNA, 19 nt, Homo sapiens
uuauuagagugucuuucca

SEQ ID NO: 1309840 - RNA, 15 nt, Homo sapiens
uuauucccuuucaca

SEQ ID NO: 1309841 - RNA, 19 nt, Homo sapiens
uuauugucucugugacuga

SEQ ID NO: 1309842 - RNA, 13 nt, Homo sapiens
uuauuuccacuua

SEQ ID NO: 1309843 - RNA, 14 nt, Homo sapiens
uuauuuccugcuua

SEQ ID NO: 1309844 - RNA, 18 nt, Homo sapiens
uuauuuuggaacuaugaa

SEQ ID NO: 1309845 - RNA, 23 nt, Homo sapiens
uuauuuuugcugaaacccaauga

SEQ ID NO: 1309846 - RNA, 15 nt, Homo sapiens
uucaaaaaccacguu

SEQ ID NO: 1309847 - RNA, 17 nt, Homo sapiens
uucaaaaaccacguucu

SEQ ID NO: 1309848 - RNA, 20 nt, Homo sapiens
uucaacaacaccagaacugu

SEQ ID NO: 1309849 - RNA, 20 nt, Homo sapiens
uucaacaaccggccaccaga

SEQ ID NO: 1309850 - RNA, 23 nt, Homo sapiens
uucaacauggucuaauuauuuac

SEQ ID NO: 1309851 - RNA, 13 nt, Homo sapiens
uucaagcauuuag

SEQ ID NO: 1309852 - RNA, 15 nt, Homo sapiens
uucaagccauuccaa

SEQ ID NO: 1309853 - RNA, 19 nt, Homo sapiens
uucaaggguuguuggaaaa

SEQ ID NO: 1309854 - RNA, 22 nt, Homo sapiens
uucaagguuuguucaacaucua

SEQ ID NO: 1309855 - RNA, 15 nt, Homo sapiens
uucaaguacuguaac

SEQ ID NO: 1309856 - RNA, 19 nt, Homo sapiens
uucaaguuuucagcuuuaa

SEQ ID NO: 1309857 - RNA, 11 nt, Homo sapiens
uucaauuccau

SEQ ID NO: 1309858 - RNA, 21 nt, Homo sapiens
uucacaaaccagagaccaaau

SEQ ID NO: 1309859 - RNA, 21 nt, Homo sapiens
uucacagagauggaugcaugu

SEQ ID NO: 1309860 - RNA, 19 nt, Homo sapiens
uucacaucagaacagacaa

SEQ ID NO: 1309861 - RNA, 17 nt, Homo sapiens
uucaccacaugugcaca

SEQ ID NO: 1309862 - RNA, 18 nt, Homo sapiens
uucaccacaugugcacau

SEQ ID NO: 1309863 - RNA, 12 nt, Homo sapiens
uucaccaugaug

SEQ ID NO: 1309864 - RNA, 20 nt, Homo sapiens
uucaccuccugacaguauua

SEQ ID NO: 1309865 - RNA, 19 nt, Homo sapiens
uucaccugcccugugcaug

SEQ ID NO: 1309866 - RNA, 23 nt, Homo sapiens
uucaccuuaaugcauauuccccu

SEQ ID NO: 1309867 - RNA, 20 nt, Homo sapiens
uucaccuuccagugucucgg

SEQ ID NO: 1309868 - RNA, 17 nt, Homo sapiens
uucagacacuucaugga

SEQ ID NO: 1309869 - RNA, 23 nt, Homo sapiens
uucagacucccauuccugaagaa

SEQ ID NO: 1309870 - RNA, 21 nt, Homo sapiens
uucagcauccgcaggugcugg

SEQ ID NO: 1309871 - RNA, 22 nt, Homo sapiens
uucagcauuauugaaauuguaa

SEQ ID NO: 1309872 - RNA, 18 nt, Homo sapiens
uucagcauuguacuugaa

SEQ ID NO: 1309873 - RNA, 12 nt, Homo sapiens
uucagccuuaau

SEQ ID NO: 1309874 - RNA, 19 nt, Homo sapiens
uucaguagaagaacuuaaa

SEQ ID NO: 1309875 - RNA, 21 nt, Homo sapiens
uucaguauguugucaaagaga

SEQ ID NO: 1309876 - RNA, 19 nt, Homo sapiens
uucaguugccauugacaga

SEQ ID NO: 1309877 - RNA, 13 nt, Homo sapiens
uucaucacacugg

SEQ ID NO: 1309878 - RNA, 22 nt, Homo sapiens
uucaucagacuccugugcaacu

SEQ ID NO: 1309879 - RNA, 19 nt, Homo sapiens
uucaugcaggugaaaccca

SEQ ID NO: 1309880 - RNA, 20 nt, Homo sapiens
uucauuuaggaugcuuucau

SEQ ID NO: 1309881 - RNA, 19 nt, Homo sapiens
uuccaaaggcguauguauu

SEQ ID NO: 1309882 - RNA, 19 nt, Homo sapiens
uuccaaauaauuugaacag

SEQ ID NO: 1309883 - RNA, 16 nt, Homo sapiens
uuccaauuauuugacu

SEQ ID NO: 1309884 - RNA, 18 nt, Homo sapiens
uuccacuaucauucccau

SEQ ID NO: 1309885 - RNA, 23 nt, Homo sapiens
uccucuuucaaagguagccauca

SEQ ID NO: 1309886 - RNA, 16 nt, Homo sapiens
uccucuuucaaccuca

SEQ ID NO: 1309887 - RNA, 15 nt, Homo sapiens
uccugaaacuauauu

SEQ ID NO: 1309888 - RNA, 23 nt, Homo sapiens
uccugauacuuucuguucuccag

SEQ ID NO: 1309889 - RNA, 18 nt, Homo sapiens
uccugcccagcacaggaa

SEQ ID NO: 1309890 - RNA, 16 nt, Homo sapiens
uccugcuuauucauaa

SEQ ID NO: 1309891 - RNA, 13 nt, Homo sapiens
uccugggcccucu

SEQ ID NO: 1309892 - RNA, 21 nt, Homo sapiens
uccuggggaggauacugaggc

SEQ ID NO: 1309893 - RNA, 17 nt, Homo sapiens
uccuguacuuuuuccag

SEQ ID NO: 1309894 - RNA, 14 nt, Homo sapiens
uccuguccagcucc

SEQ ID NO: 1309895 - RNA, 15 nt, Homo sapiens
uccugugucaaucca

SEQ ID NO: 1309896 - RNA, 20 nt, Homo sapiens
uccugugucuugcaauggca

SEQ ID NO: 1309897 - RNA, 22 nt, Homo sapiens
uccugugugugcgccuacagga

SEQ ID NO: 1309898 - RNA, 17 nt, Homo sapiens
uccuguucuuucuuaca

SEQ ID NO: 1309899 - RNA, 16 nt, Homo sapiens
uccuuaaaaaucacac

SEQ ID NO: 1309900 - RNA, 21 nt, Homo sapiens
uccuuaaaaaucacacuguaa

SEQ ID NO: 1309901 - RNA, 20 nt, Homo sapiens
uccuuaaauaugugaaagga

SEQ ID NO: 1309902 - RNA, 21 nt, Homo sapiens
uccuuaacacugagcugucau

SEQ ID NO: 1309903 - RNA, 12 nt, Homo sapiens
uccuuacauuuu

SEQ ID NO: 1309904 - RNA, 20 nt, Homo sapiens
uccuuaguuaucaguccugu

SEQ ID NO: 1309905 - RNA, 18 nt, Homo sapiens
uccuuauuguuaaaaaca

SEQ ID NO: 1309906 - RNA, 18 nt, Homo sapiens
uccuuccaguguccuuag

SEQ ID NO: 1309907 - RNA, 17 nt, Homo sapiens
uccuuccugaaacuaua

SEQ ID NO: 1309908 - RNA, 16 nt, Homo sapiens
uccuucucaucuguga

SEQ ID NO: 1309909 - RNA, 17 nt, Homo sapiens
uccuugauacugcucau

SEQ ID NO: 1309910 - RNA, 13 nt, Homo sapiens
uccuuguuccuag

SEQ ID NO: 1309911 - RNA, 22 nt, Homo sapiens
uccuuuaagagcucuggugaua

SEQ ID NO: 1309912 - RNA, 17 nt, Homo sapiens
uccuuuagcgcccaguu

SEQ ID NO: 1309913 - RNA, 14 nt, Homo sapiens
uccuuucaccacau

SEQ ID NO: 1309914 - RNA, 15 nt, Homo sapiens
aauuaaccuuacuaa

SEQ ID NO: 1309915 - RNA, 13 nt, Homo sapiens
aauuaauguagcu

SEQ ID NO: 1309916 - RNA, 19 nt, Homo sapiens
aauuacccuuucauucagc

SEQ ID NO: 1309917 - RNA, 14 nt, Homo sapiens
aauuaccuugccaa

SEQ ID NO: 1309918 - RNA, 14 nt, Homo sapiens
aauuagccaggugu

SEQ ID NO: 1309919 - RNA, 13 nt, Homo sapiens
aauucaaacuggg

SEQ ID NO: 1309920 - RNA, 14 nt, Homo sapiens
aauucaauccugcc

SEQ ID NO: 1309921 - RNA, 20 nt, Homo sapiens
aauucagaaugaucugcaag

SEQ ID NO: 1309922 - RNA, 14 nt, Homo sapiens
aauuccaaagcaaa

SEQ ID NO: 1309923 - RNA, 22 nt, Homo sapiens
aauuccaaagcaaaaccagaac

SEQ ID NO: 1309924 - RNA, 22 nt, Homo sapiens
aauuccacaccuuuuauugaca

SEQ ID NO: 1309925 - RNA, 20 nt, Homo sapiens
aauucccuuuuaacccagug

SEQ ID NO: 1309926 - RNA, 21 nt, Homo sapiens
aauucccuuuuaacccagugu

SEQ ID NO: 1309927 - RNA, 15 nt, Homo sapiens
aauucuaaaccaauc

SEQ ID NO: 1309928 - RNA, 20 nt, Homo sapiens
aauucucauuugucacacac

SEQ ID NO: 1309929 - RNA, 13 nt, Homo sapiens
aauucuugccaaa

SEQ ID NO: 1309930 - RNA, 13 nt, Homo sapiens
aauugauuugcau

SEQ ID NO: 1309931 - RNA, 15 nt, Homo sapiens
aauugcaacuucuaa

SEQ ID NO: 1309932 - RNA, 11 nt, Homo sapiens
aauugccugua

SEQ ID NO: 1309933 - RNA, 20 nt, Homo sapiens
aauugcugcaccaaugcacu

SEQ ID NO: 1309934 - RNA, 19 nt, Homo sapiens
aauugggggagcugcaguc

SEQ ID NO: 1309935 - RNA, 19 nt, Homo sapiens
aauuguauuacaaauccaa

SEQ ID NO: 1309936 - RNA, 17 nt, Homo sapiens
aauugugcuuuguauca

SEQ ID NO: 1309937 - RNA, 23 nt, Homo sapiens
aauugugugugaugugaagccaa

SEQ ID NO: 1309938 - RNA, 13 nt, Homo sapiens
aauuuaaaagcag

SEQ ID NO: 1309939 - RNA, 18 nt, Homo sapiens
aauuuaaaaggugucaac

SEQ ID NO: 1309940 - RNA, 17 nt, Homo sapiens
aauuuagauauuuucca

SEQ ID NO: 1309941 - RNA, 18 nt, Homo sapiens
aauuuaggacacauuuag

SEQ ID NO: 1309942 - RNA, 19 nt, Homo sapiens
aauuucccccuaaaccaac

SEQ ID NO: 1309943 - RNA, 23 nt, Homo sapiens
aauuucuacuacaggcauugaga

SEQ ID NO: 1309944 - RNA, 21 nt, Homo sapiens
aauuucuaguucacagacaua

SEQ ID NO: 1309945 - RNA, 22 nt, Homo sapiens
aauuugcaccaguuuuauccau

SEQ ID NO: 1309946 - RNA, 14 nt, Homo sapiens
aauuugcugccaaa

SEQ ID NO: 1309947 - RNA, 21 nt, Homo sapiens
aauuugcuggaacacaaagac

SEQ ID NO: 1309948 - RNA, 16 nt, Homo sapiens
aauuuggguucugccu

SEQ ID NO: 1309949 - RNA, 18 nt, Homo sapiens
aauuugugccacuuuaau

SEQ ID NO: 1309950 - RNA, 21 nt, Homo sapiens
aauuuguucacauuacaugaa

SEQ ID NO: 1309951 - RNA, 15 nt, Homo sapiens
aauuuucagcauuaa

SEQ ID NO: 1309952 - RNA, 20 nt, Homo sapiens
aauuuucugaaacugcauaa

SEQ ID NO: 1309953 - RNA, 19 nt, Homo sapiens
aauuuuuaaggauguugcc

SEQ ID NO: 1309954 - RNA, 15 nt, Homo sapiens
aauuuuuaaugcuua

SEQ ID NO: 1309955 - RNA, 21 nt, Homo sapiens
aauuuuucucuaacucagaaa

SEQ ID NO: 1309956 - RNA, 16 nt, Homo sapiens
aauuuuuugguacaaa

SEQ ID NO: 1309957 - RNA, 22 nt, Homo sapiens
aauuuuuuuaaccaaaggugaa

SEQ ID NO: 1309958 - RNA, 12 nt, Homo sapiens
acaaaaaugcug

SEQ ID NO: 1309959 - RNA, 20 nt, Homo sapiens
acaaaauaaccaauccugga

SEQ ID NO: 1309960 - RNA, 21 nt, Homo sapiens
acagucaguucucauuauuca

SEQ ID NO: 1309961 - RNA, 18 nt, Homo sapiens
acaguccuggacuccugc

SEQ ID NO: 1309962 - RNA, 18 nt, Homo sapiens
acagugaaggcuguccuu

SEQ ID NO: 1309963 - RNA, 19 nt, Homo sapiens
acagugauauacuuacuca

SEQ ID NO: 1309964 - RNA, 14 nt, Homo sapiens
acagugcccagggc

SEQ ID NO: 1309965 - RNA, 18 nt, Homo sapiens
acagugcuugauacagga

SEQ ID NO: 1309966 - RNA, 23 nt, Homo sapiens
acaguucaauucucauuugucac

SEQ ID NO: 1309967 - RNA, 16 nt, Homo sapiens
acaguucugucauaug

SEQ ID NO: 1309968 - RNA, 21 nt, Homo sapiens
acaguucuuugggccagacau

SEQ ID NO: 1309969 - RNA, 13 nt, Homo sapiens
acauaaagguaaa

SEQ ID NO: 1309970 - RNA, 14 nt, Homo sapiens
acauaauucacucu

SEQ ID NO: 1309971 - RNA, 11 nt, Homo sapiens
acauacugcug

SEQ ID NO: 1309972 - RNA, 19 nt, Homo sapiens
acauacuugaagggccaga

SEQ ID NO: 1309973 - RNA, 22 nt, Homo sapiens
acauaguagguacccaauucaa

SEQ ID NO: 1309974 - RNA, 16 nt, Homo sapiens
acauaguuaaaugugc

SEQ ID NO: 1309975 - RNA, 15 nt, Homo sapiens
acauaguuguauaua

SEQ ID NO: 1309976 - RNA, 23 nt, Homo sapiens
acauauccacaaaugacugcaaa

SEQ ID NO: 1309977 - RNA, 14 nt, Homo sapiens
acaucaaggcucuu

SEQ ID NO: 1309978 - RNA, 16 nt, Homo sapiens
acaucacaccugcccu

SEQ ID NO: 1309979 - RNA, 16 nt, Homo sapiens
acaucagcuaguggcu

SEQ ID NO: 1309980 - RNA, 19 nt, Homo sapiens
acaucaggagacugggcuc

SEQ ID NO: 1309981 - RNA, 16 nt, Homo sapiens
acaucaguuacucuga

SEQ ID NO: 1309982 - RNA, 20 nt, Homo sapiens
acaucaucaaggcacugccu

SEQ ID NO: 1309983 - RNA, 17 nt, Homo sapiens
acauccaaaauaguuaa

SEQ ID NO: 1309984 - RNA, 16 nt, Homo sapiens
acauccauugucucuu

SEQ ID NO: 1309985 - RNA, 18 nt, Homo sapiens
acauccauugucucuuca

SEQ ID NO: 1309986 - RNA, 20 nt, Homo sapiens
acauccuccacugacuuccu

SEQ ID NO: 1309987 - RNA, 15 nt, Homo sapiens
acauccugcagcuua

SEQ ID NO: 1309988 - RNA, 17 nt, Homo sapiens
acauccugugccuccau

SEQ ID NO: 1309989 - RNA, 23 nt, Homo sapiens
acaucucuuccuccgaggccagu

SEQ ID NO: 1309990 - RNA, 15 nt, Homo sapiens
acaucugcauuuuca

SEQ ID NO: 1309991 - RNA, 19 nt, Homo sapiens
acaucuugcucugcugaca

SEQ ID NO: 1309992 - RNA, 19 nt, Homo sapiens
acaugagaaggaacuucca

SEQ ID NO: 1309993 - RNA, 13 nt, Homo sapiens
acaugcacucagc

SEQ ID NO: 1309994 - RNA, 18 nt, Homo sapiens
acaugcuauguucugucu

SEQ ID NO: 1309995 - RNA, 21 nt, Homo sapiens
acaugcugaagccaaagccaa

SEQ ID NO: 1309996 - RNA, 22 nt, Homo sapiens
acauggagaaaaccaaaaugau

SEQ ID NO: 1309997 - RNA, 10 nt, Homo sapiens
acaugggagc

SEQ ID NO: 1309998 - RNA, 13 nt, Homo sapiens
acauguaugugca

SEQ ID NO: 1309999 - RNA, 18 nt, Homo sapiens
acauguaugugcauuuca

SEQ ID NO: 1310000 - RNA, 16 nt, Homo sapiens
acaugugcacaugcac

SEQ ID NO: 1310001 - RNA, 18 nt, Homo sapiens
acauguuguacauuucac

SEQ ID NO: 1310002 - RNA, 21 nt, Homo sapiens
acauguuuguuucuguagaaa

SEQ ID NO: 1310003 - RNA, 17 nt, Homo sapiens
acauuaagaaaaucaua

SEQ ID NO: 1310004 - RNA, 13 nt, Homo sapiens
acauuaucucacu

SEQ ID NO: 1310005 - RNA, 23 nt, Homo sapiens
acauuauuuuauuauaacaucca

SEQ ID NO: 1310006 - RNA, 14 nt, Homo sapiens
acauucccacugcc

SEQ ID NO: 1310007 - RNA, 20 nt, Homo sapiens
acauuccucagaaaccaaag

SEQ ID NO: 1310008 - RNA, 19 nt, Homo sapiens
acauucucgcuucccugaa

SEQ ID NO: 1310009 - RNA, 14 nt, Homo sapiens
acauugauucaugu

SEQ ID NO: 1310010 - RNA, 13 nt, Homo sapiens
acauugugaaaag

SEQ ID NO: 1310011 - RNA, 22 nt, Homo sapiens
acauuguuuuguguaacauauu

SEQ ID NO: 1310012 - RNA, 15 nt, Homo sapiens
acauuuaagagacag

SEQ ID NO: 1310013 - RNA, 15 nt, Homo sapiens
acauuuagaugcacu

SEQ ID NO: 1310014 - RNA, 14 nt, Homo sapiens
acauuuucauugau

SEQ ID NO: 1310015 - RNA, 15 nt, Homo sapiens
acauuuuuuaccaaa

SEQ ID NO: 1310016 - RNA, 13 nt, Homo sapiens
accaaaacauuga

SEQ ID NO: 1310017 - RNA, 17 nt, Homo sapiens
accaaaaugauacuuac

SEQ ID NO: 1310018 - RNA, 12 nt, Homo sapiens
accaaaggugaa

SEQ ID NO: 1310019 - RNA, 12 nt, Homo sapiens
accaaaguccag

SEQ ID NO: 1310020 - RNA, 23 nt, Homo sapiens
accaacaggcuaccaacuuguau

SEQ ID NO: 1310021 - RNA, 16 nt, Homo sapiens
accaacugaaggcuaa

SEQ ID NO: 1310022 - RNA, 19 nt, Homo sapiens
accaagcugugcccugacc

SEQ ID NO: 1310023 - RNA, 15 nt, Homo sapiens
accaauaaagccuuc

SEQ ID NO: 1310024 - RNA, 17 nt, Homo sapiens
accaauaaagccuucaa

SEQ ID NO: 1310025 - RNA, 15 nt, Homo sapiens
accaauuaauguagc

SEQ ID NO: 1310026 - RNA, 16 nt, Homo sapiens
accaauuaauguagcu

SEQ ID NO: 1310027 - RNA, 15 nt, Homo sapiens
accacaugugcacau

SEQ ID NO: 1310028 - RNA, 18 nt, Homo sapiens
accacaugugcacaugca

SEQ ID NO: 1310029 - RNA, 15 nt, Homo sapiens
accaccaccaucacc

SEQ ID NO: 1310030 - RNA, 14 nt, Homo sapiens
accaccaguuaacg

SEQ ID NO: 1310031 - RNA, 21 nt, Homo sapiens
accacgugagaucauucacuc

SEQ ID NO: 1310032 - RNA, 11 nt, Homo sapiens
accacugaccc

SEQ ID NO: 1310033 - RNA, 15 nt, Homo sapiens
accacugacccaaau

SEQ ID NO: 1310034 - RNA, 15 nt, Homo sapiens
accagacacccagga

SEQ ID NO: 1310035 - RNA, 19 nt, Homo sapiens
accagagaccaaaugucac

SEQ ID NO: 1310036 - RNA, 22 nt, Homo sapiens
accagaggccucuuuuccugaa

SEQ ID NO: 1310037 - RNA, 20 nt, Homo sapiens
accagaugucgcccuacuca

SEQ ID NO: 1310038 - RNA, 17 nt, Homo sapiens
accagcacggugacucu

SEQ ID NO: 1310039 - RNA, 19 nt, Homo sapiens
accagcaucccuugaccag

SEQ ID NO: 1310040 - RNA, 22 nt, Homo sapiens
accagccugggcaacaugaugu

SEQ ID NO: 1310041 - RNA, 23 nt, Homo sapiens
accagcuucauguggcuucccuu

SEQ ID NO: 1310042 - RNA, 19 nt, Homo sapiens
accaggauagagacuggaa

SEQ ID NO: 1310043 - RNA, 18 nt, Homo sapiens
accaggcaaagcaaguga

SEQ ID NO: 1310044 - RNA, 20 nt, Homo sapiens
accaggguugaccccagagg

SEQ ID NO: 1310045 - RNA, 13 nt, Homo sapiens
accaguaugacag

SEQ ID NO: 1310046 - RNA, 13 nt, Homo sapiens
accagugcugcug

SEQ ID NO: 1310047 - RNA, 16 nt, Homo sapiens
accaguuaacguauua

SEQ ID NO: 1310048 - RNA, 20 nt, Homo sapiens
accaugauuaaccacuucag

SEQ ID NO: 1310049 - RNA, 24 nt, Homo sapiens
accaugauuaaccacuucagcuga

SEQ ID NO: 1310050 - RNA, 16 nt, Homo sapiens
accaugcgacacuggg

SEQ ID NO: 1310051 - RNA, 23 nt, Homo sapiens
accauggaguuaacaucaugaau

SEQ ID NO: 1310052 - RNA, 17 nt, Homo sapiens
accaugucagcaaaaag

SEQ ID NO: 1310053 - RNA, 20 nt, Homo sapiens
accauuaaccagaucuaguc

SEQ ID NO: 1310054 - RNA, 22 nt, Homo sapiens
ugauacauccaaagcagacagc

SEQ ID NO: 1310055 - RNA, 14 nt, Homo sapiens
ugauagaaaugcca

SEQ ID NO: 1310056 - RNA, 21 nt, Homo sapiens
ugauauagaacagugcuugcc

SEQ ID NO: 1310057 - RNA, 17 nt, Homo sapiens
ugauauauaaaugugau

SEQ ID NO: 1310058 - RNA, 12 nt, Homo sapiens
ugauaugcauuu

SEQ ID NO: 1310059 - RNA, 19 nt, Homo sapiens
ugauaugugaaugcucaua

SEQ ID NO: 1310060 - RNA, 18 nt, Homo sapiens
ugaucaaagccacacucu

SEQ ID NO: 1310061 - RNA, 18 nt, Homo sapiens
ugaucacggcucacugca

SEQ ID NO: 1310062 - RNA, 18 nt, Homo sapiens
ugaucagaucugacauga

SEQ ID NO: 1310063 - RNA, 20 nt, Homo sapiens
ugaucagcgccgcaccagcc

SEQ ID NO: 1310064 - RNA, 17 nt, Homo sapiens
ugaucaguggacagucu

SEQ ID NO: 1310065 - RNA, 22 nt, Homo sapiens
ugauccaagcaagacugagggg

SEQ ID NO: 1310066 - RNA, 16 nt, Homo sapiens
ugaucccgugugccac

SEQ ID NO: 1310067 - RNA, 14 nt, Homo sapiens
ugauccugugaagu

SEQ ID NO: 1310068 - RNA, 13 nt, Homo sapiens
ugaucugcaagaa

SEQ ID NO: 1310069 - RNA, 14 nt, Homo sapiens
ugaucuuugcagac

SEQ ID NO: 1310070 - RNA, 13 nt, Homo sapiens
ugaugaucuuugc

SEQ ID NO: 1310071 - RNA, 15 nt, Homo sapiens
ugaugccuuggucag

SEQ ID NO: 1310072 - RNA, 20 nt, Homo sapiens
ugaugcugccggcacagcug

SEQ ID NO: 1310073 - RNA, 21 nt, Homo sapiens
ugaugcugggauuuacacuug

SEQ ID NO: 1310074 - RNA, 23 nt, Homo sapiens
ugauggacaaacaccaaucucuc

SEQ ID NO: 1310075 - RNA, 19 nt, Homo sapiens
ugauggcucauuuacacuc

SEQ ID NO: 1310076 - RNA, 14 nt, Homo sapiens
ugaugggccugaac

SEQ ID NO: 1310077 - RNA, 22 nt, Homo sapiens
ugauggucaucgagauggagcu

SEQ ID NO: 1310078 - RNA, 14 nt, Homo sapiens
ugauguuacuguau

SEQ ID NO: 1310079 - RNA, 17 nt, Homo sapiens
ugauguuggcugggaac

SEQ ID NO: 1310080 - RNA, 15 nt, Homo sapiens
ugauuacugcucuau

SEQ ID NO: 1310081 - RNA, 13 nt, Homo sapiens
ugauucaagccau

SEQ ID NO: 1310082 - RNA, 19 nt, Homo sapiens
ugauucauacauuaucuca

SEQ ID NO: 1310083 - RNA, 15 nt, Homo sapiens
ugauucaugucucac

SEQ ID NO: 1310084 - RNA, 22 nt, Homo sapiens
ugauucuccugccucagccucc

SEQ ID NO: 1310085 - RNA, 18 nt, Homo sapiens
ugauuggccccacugacg

SEQ ID NO: 1310086 - RNA, 17 nt, Homo sapiens
ugauuguggaauggaga

SEQ ID NO: 1310087 - RNA, 17 nt, Homo sapiens
ugauuuauuugcuucuu

SEQ ID NO: 1310088 - RNA, 16 nt, Homo sapiens
ugauuuggugaccaac

SEQ ID NO: 1310089 - RNA, 16 nt, Homo sapiens
ugauuuugacaugggg

SEQ ID NO: 1310090 - RNA, 15 nt, Homo sapiens
ugauuuuuuuccaca

SEQ ID NO: 1310091 - RNA, 16 nt, Homo sapiens
ugcaaaaggacucuca

SEQ ID NO: 1310092 - RNA, 22 nt, Homo sapiens
ugcaaaaggacucucaggacca

SEQ ID NO: 1310093 - RNA, 15 nt, Homo sapiens
ugcaaaggacagauc

SEQ ID NO: 1310094 - RNA, 13 nt, Homo sapiens
ugcaaaguacugu

SEQ ID NO: 1310095 - RNA, 15 nt, Homo sapiens
ugcaaaguacuguaa

SEQ ID NO: 1310096 - RNA, 18 nt, Homo sapiens
ugcaaauccuaugugauu

SEQ ID NO: 1310097 - RNA, 19 nt, Homo sapiens
ugcaacagggggcaaagau

SEQ ID NO: 1310098 - RNA, 15 nt, Homo sapiens
ugcaaccacugcuuc

SEQ ID NO: 1310099 - RNA, 22 nt, Homo sapiens
ugcaaccuaccuguugagcauc

SEQ ID NO: 1310100 - RNA, 18 nt, Homo sapiens
ugcaaccucugcuuccca

SEQ ID NO: 1310101 - RNA, 20 nt, Homo sapiens
ugcaacuucuaaacacaaau

SEQ ID NO: 1310102 - RNA, 14 nt, Homo sapiens
ugcaacuucugccu

SEQ ID NO: 1310103 - RNA, 22 nt, Homo sapiens
ugcaagaacucaucacuguggc

SEQ ID NO: 1310104 - RNA, 22 nt, Homo sapiens
ugcaagccccucuuucuguccc

SEQ ID NO: 1310105 - RNA, 18 nt, Homo sapiens
ugcaaggccgcuucgcca

SEQ ID NO: 1310106 - RNA, 16 nt, Homo sapiens
ugcaaguauacuaggg

SEQ ID NO: 1310107 - RNA, 16 nt, Homo sapiens
ugcaauauaacauucu

SEQ ID NO: 1310108 - RNA, 13 nt, Homo sapiens
ugcaaugucugag

SEQ ID NO: 1310109 - RNA, 18 nt, Homo sapiens
ugcacaaacucaccaucu

SEQ ID NO: 1310110 - RNA, 19 nt, Homo sapiens
ugcacaacauuacagggaa

SEQ ID NO: 1310111 - RNA, 13 nt, Homo sapiens
ugcacacaccaga

SEQ ID NO: 1310112 - RNA, 13 nt, Homo sapiens
ugcacacuuugcc

SEQ ID NO: 1310113 - RNA, 14 nt, Homo sapiens
ugcacacuuugcca

SEQ ID NO: 1310114 - RNA, 17 nt, Homo sapiens
ugcacagggauucucac

SEQ ID NO: 1310115 - RNA, 22 nt, Homo sapiens
ugcacagugaagugcuggcaac

SEQ ID NO: 1310116 - RNA, 15 nt, Homo sapiens
ugcacaucuagugag

SEQ ID NO: 1310117 - RNA, 11 nt, Homo sapiens
ugcacauuguu

SEQ ID NO: 1310118 - RNA, 14 nt, Homo sapiens
ugcaccaccaagcc

SEQ ID NO: 1310119 - RNA, 17 nt, Homo sapiens
ugcaccaccacacccgg

SEQ ID NO: 1310120 - RNA, 17 nt, Homo sapiens
ugcaccccuccccauuc

SEQ ID NO: 1310121 - RNA, 14 nt, Homo sapiens
ugcacccuggaagg

SEQ ID NO: 1310122 - RNA, 12 nt, Homo sapiens
ugcaccuugcca

SEQ ID NO: 1310123 - RNA, 13 nt, Homo sapiens
ugcacgguacaaa

SEQ ID NO: 1310124 - RNA, 19 nt, Homo sapiens
ugcacuacagcccuggccu

SEQ ID NO: 1310125 - RNA, 15 nt, Homo sapiens
ugcacucacuccuga

SEQ ID NO: 1310126 - RNA, 16 nt, Homo sapiens
ugcacuccagccuggg

SEQ ID NO: 1310127 - RNA, 15 nt, Homo sapiens
ugcacugugaaggac

SEQ ID NO: 1310128 - RNA, 14 nt, Homo sapiens
ugcacuuacuugcu

SEQ ID NO: 1310129 - RNA, 15 nt, Homo sapiens
ugcagaauguugauu

SEQ ID NO: 1310130 - RNA, 19 nt, Homo sapiens
ugcagaauugagagugauu

SEQ ID NO: 1310131 - RNA, 23 nt, Homo sapiens
ugcagacaggaaucuuaaggugu

SEQ ID NO: 1310132 - RNA, 12 nt, Homo sapiens
ugcagacaugag

SEQ ID NO: 1310133 - RNA, 20 nt, Homo sapiens
ugcagacucuacagaggcca

SEQ ID NO: 1310134 - RNA, 12 nt, Homo sapiens
ugcagacuuccc

SEQ ID NO: 1310135 - RNA, 13 nt, Homo sapiens
ugcagaguacugg

SEQ ID NO: 1310136 - RNA, 15 nt, Homo sapiens
ugcagaugaggacua

SEQ ID NO: 1310137 - RNA, 21 nt, Homo sapiens
ugcagauuagcuaggggacag

SEQ ID NO: 1310138 - RNA, 20 nt, Homo sapiens
ugcaggacuugagaagaccu

SEQ ID NO: 1310139 - RNA, 16 nt, Homo sapiens
ugcaggcaucacagcu

SEQ ID NO: 1310140 - RNA, 16 nt, Homo sapiens
ugcaggggucucaugu

SEQ ID NO: 1310141 - RNA, 17 nt, Homo sapiens
ugcagguucauggauua

SEQ ID NO: 1310142 - RNA, 17 nt, Homo sapiens
ugcaguaugggaucuga

SEQ ID NO: 1310143 - RNA, 19 nt, Homo sapiens
ugcagucaucuugaccaag

SEQ ID NO: 1310144 - RNA, 20 nt, Homo sapiens
ugcagugaauuuucauuucu

SEQ ID NO: 1310145 - RNA, 15 nt, Homo sapiens
ugcauagcagcugcu

SEQ ID NO: 1310146 - RNA, 21 nt, Homo sapiens
ugcauauauuaucaucaaaug

SEQ ID NO: 1310147 - RNA, 22 nt, Homo sapiens
ugcauaugugugugugugcaua

SEQ ID NO: 1310148 - RNA, 15 nt, Homo sapiens
ugcaucauccuugca

SEQ ID NO: 1310149 - RNA, 16 nt, Homo sapiens
ugcauccaaaccugua

SEQ ID NO: 1310150 - RNA, 14 nt, Homo sapiens
ugcaucuacuugcc

SEQ ID NO: 1310151 - RNA, 15 nt, Homo sapiens
ugcaucugaccagca

SEQ ID NO: 1310152 - RNA, 17 nt, Homo sapiens
ugcauguaaacacgccu

SEQ ID NO: 1310153 - RNA, 15 nt, Homo sapiens
ugcaugugacucuga

SEQ ID NO: 1310154 - RNA, 16 nt, Homo sapiens
ugcaugugacucugaa

SEQ ID NO: 1310155 - RNA, 19 nt, Homo sapiens
ugcauguuggcccagaccu

SEQ ID NO: 1310156 - RNA, 11 nt, Homo sapiens
ugcauuucaac

SEQ ID NO: 1310157 - RNA, 19 nt, Homo sapiens
ugccaaaaaggauacauaa

SEQ ID NO: 1310158 - RNA, 21 nt, Homo sapiens
ugccaacaauccuagugcuuu

SEQ ID NO: 1310159 - RNA, 21 nt, Homo sapiens
ugccaaccggucacccaggag

SEQ ID NO: 1310160 - RNA, 19 nt, Homo sapiens
ugccaacuucuucagagcu

SEQ ID NO: 1310161 - RNA, 19 nt, Homo sapiens
ugccaagcacugugcucag

SEQ ID NO: 1310162 - RNA, 17 nt, Homo sapiens
ugccaagcucaggacca

SEQ ID NO: 1310163 - RNA, 22 nt, Homo sapiens
ugccacaaugcaguucugagca

SEQ ID NO: 1310164 - RNA, 19 nt, Homo sapiens
ugccacacccuccccauuc

SEQ ID NO: 1310165 - RNA, 14 nt, Homo sapiens
ugccacccacaucu

SEQ ID NO: 1310166 - RNA, 17 nt, Homo sapiens
ugccacccacaucuucc

SEQ ID NO: 1310167 - RNA, 21 nt, Homo sapiens
ugccacgccgcccuaaaagca

SEQ ID NO: 1310168 - RNA, 18 nt, Homo sapiens
ugccagauccucuucuca

SEQ ID NO: 1310169 - RNA, 19 nt, Homo sapiens
ugccagcuuaucucagggg

SEQ ID NO: 1310170 - RNA, 18 nt, Homo sapiens
ugccauauucuguuggcc

SEQ ID NO: 1310171 - RNA, 22 nt, Homo sapiens
ugccaucaucucuuuaccuggg

SEQ ID NO: 1310172 - RNA, 19 nt, Homo sapiens
ugccauccucaaacacugc

SEQ ID NO: 1310173 - RNA, 14 nt, Homo sapiens
ugccauugcacucc

SEQ ID NO: 1310174 - RNA, 13 nt, Homo sapiens
ugcccacaggccg

SEQ ID NO: 1310175 - RNA, 13 nt, Homo sapiens
ugcccaccagauc

SEQ ID NO: 1310176 - RNA, 19 nt, Homo sapiens
ugcccacgcuggagugcag

SEQ ID NO: 1310177 - RNA, 20 nt, Homo sapiens
ugcccaggcuggaguggagu

SEQ ID NO: 1310178 - RNA, 22 nt, Homo sapiens
ugcccagucgaccccaaaggaa

SEQ ID NO: 1310179 - RNA, 14 nt, Homo sapiens
ugcccaugggcuau

SEQ ID NO: 1310180 - RNA, 17 nt, Homo sapiens
ugcccguaaacacgccu

SEQ ID NO: 1310181 - RNA, 21 nt, Homo sapiens
ugcccguaaacacgccugcaa

SEQ ID NO: 1310182 - RNA, 15 nt, Homo sapiens
ugcccucagauuccg

SEQ ID NO: 1310183 - RNA, 15 nt, Homo sapiens
ugcccugaacccacu

SEQ ID NO: 1310184 - RNA, 21 nt, Homo sapiens
ugcccugcccuuggcacccaa

SEQ ID NO: 1310185 - RNA, 16 nt, Homo sapiens
ucugaaacugcauaag

SEQ ID NO: 1310186 - RNA, 22 nt, Homo sapiens
ucugaaucgagauguccauagu

SEQ ID NO: 1310187 - RNA, 13 nt, Homo sapiens
ucugacacacagc

SEQ ID NO: 1310188 - RNA, 14 nt, Homo sapiens
ucugacacacagcu

SEQ ID NO: 1310189 - RNA, 15 nt, Homo sapiens
ucugacacuaccuua

SEQ ID NO: 1310190 - RNA, 22 nt, Homo sapiens
ucugaccaguuuaaccugaugc

SEQ ID NO: 1310191 - RNA, 17 nt, Homo sapiens
ucugagaaggugagaua

SEQ ID NO: 1310192 - RNA, 23 nt, Homo sapiens
ucugagcagugcuugaaugaagu

SEQ ID NO: 1310193 - RNA, 14 nt, Homo sapiens
ucugagcugugcag

SEQ ID NO: 1310194 - RNA, 13 nt, Homo sapiens
ucugaggucauua

SEQ ID NO: 1310195 - RNA, 20 nt, Homo sapiens
ucugaguaagaaacagaauc

SEQ ID NO: 1310196 - RNA, 14 nt, Homo sapiens
ucugauaaugcuca

SEQ ID NO: 1310197 - RNA, 15 nt, Homo sapiens
ucugauaaugcucac

SEQ ID NO: 1310198 - RNA, 13 nt, Homo sapiens
ucugauaccucaa

SEQ ID NO: 1310199 - RNA, 14 nt, Homo sapiens
ucugauaccuucug

SEQ ID NO: 1310200 - RNA, 14 nt, Homo sapiens
ucugcaaaccaaca

SEQ ID NO: 1310201 - RNA, 14 nt, Homo sapiens
ucugcaaaccaaua

SEQ ID NO: 1310202 - RNA, 18 nt, Homo sapiens
ucugcaacagggggcaaa

SEQ ID NO: 1310203 - RNA, 23 nt, Homo sapiens
ucugcaccccccugggcugagag

SEQ ID NO: 1310204 - RNA, 19 nt, Homo sapiens
ucugcauccagagauucau

SEQ ID NO: 1310205 - RNA, 22 nt, Homo sapiens
ucugcauggaacagcauuaccc

SEQ ID NO: 1310206 - RNA, 17 nt, Homo sapiens
ucugcaugucuacucag

SEQ ID NO: 1310207 - RNA, 22 nt, Homo sapiens
ucugcaugucuacucagcauuu

SEQ ID NO: 1310208 - RNA, 21 nt, Homo sapiens
ucugcauuucgguggcuaguc

SEQ ID NO: 1310209 - RNA, 14 nt, Homo sapiens
ucugccaaacauua

SEQ ID NO: 1310210 - RNA, 22 nt, Homo sapiens
ucugccccaguugguguucaaa

SEQ ID NO: 1310211 - RNA, 20 nt, Homo sapiens
ucugcccccuuuacuccucg

SEQ ID NO: 1310212 - RNA, 14 nt, Homo sapiens
ucugccgcuaccuc

SEQ ID NO: 1310213 - RNA, 14 nt, Homo sapiens
ucugccucugacac

SEQ ID NO: 1310214 - RNA, 15 nt, Homo sapiens
ucugccugaaccugg

SEQ ID NO: 1310215 - RNA, 19 nt, Homo sapiens
ucugcuccaccuugugacc

SEQ ID NO: 1310216 - RNA, 17 nt, Homo sapiens
ucugcugaagacuugcc

SEQ ID NO: 1310217 - RNA, 20 nt, Homo sapiens
ucugcuuucacucuuuagaa

SEQ ID NO: 1310218 - RNA, 18 nt, Homo sapiens
ucuggaaugguuuacaga

SEQ ID NO: 1310219 - RNA, 22 nt, Homo sapiens
gggugauuuuaugaucaguguu

SEQ ID NO: 1310220 - RNA, 13 nt, Homo sapiens
gggugcagucccc

SEQ ID NO: 1310221 - RNA, 17 nt, Homo sapiens
gggugccgcgagccagg

SEQ ID NO: 1310222 - RNA, 18 nt, Homo sapiens
gggugccgcgagccaggc

SEQ ID NO: 1310223 - RNA, 14 nt, Homo sapiens
gggugcuuccuugu

SEQ ID NO: 1310224 - RNA, 18 nt, Homo sapiens
ggguggugagaaccggag

SEQ ID NO: 1310225 - RNA, 21 nt, Homo sapiens
ggguuaguuuacaaucagcca

SEQ ID NO: 1310226 - RNA, 13 nt, Homo sapiens
ggguucacugcaa

SEQ ID NO: 1310227 - RNA, 21 nt, Homo sapiens
ggguucuugagccagccaggc

SEQ ID NO: 1310228 - RNA, 20 nt, Homo sapiens
ggguuucaccauauugccca

SEQ ID NO: 1310229 - RNA, 13 nt, Homo sapiens
gguaaaacaaaac

SEQ ID NO: 1310230 - RNA, 19 nt, Homo sapiens
gguaaaagcaucacaugaa

SEQ ID NO: 1310231 - RNA, 16 nt, Homo sapiens
gguaaaugacauagac

SEQ ID NO: 1310232 - RNA, 13 nt, Homo sapiens
gguacaaaaccac

SEQ ID NO: 1310233 - RNA, 12 nt, Homo sapiens
gguacacagugg

SEQ ID NO: 1310234 - RNA, 14 nt, Homo sapiens
gguacagguauauu

SEQ ID NO: 1310235 - RNA, 23 nt, Homo sapiens
gguacuauaaaagcuuucugcca

SEQ ID NO: 1310236 - RNA, 16 nt, Homo sapiens
gguagugaaacagcuu

SEQ ID NO: 1310237 - RNA, 15 nt, Homo sapiens
gguauagacaauaaa

SEQ ID NO: 1310238 - RNA, 18 nt, Homo sapiens
gguauaguucaugucugc

SEQ ID NO: 1310239 - RNA, 17 nt, Homo sapiens
gguauccugggggaccc

SEQ ID NO: 1310240 - RNA, 18 nt, Homo sapiens
ggucaacagaugacaaca

SEQ ID NO: 1310241 - RNA, 21 nt, Homo sapiens
ggucagaaacaggaccgggug

SEQ ID NO: 1310242 - RNA, 16 nt, Homo sapiens
gguccaccccauguca

SEQ ID NO: 1310243 - RNA, 19 nt, Homo sapiens
gguccucugucagucacag

SEQ ID NO: 1310244 - RNA, 17 nt, Homo sapiens
gguccugaaaguaacuc

SEQ ID NO: 1310245 - RNA, 22 nt, Homo sapiens
ggucucauagguugagcaauuu

SEQ ID NO: 1310246 - RNA, 22 nt, Homo sapiens
ggucucugauagguagcauuuu

SEQ ID NO: 1310247 - RNA, 22 nt, Homo sapiens
ggucugaaauuugugauggaau

SEQ ID NO: 1310248 - RNA, 13 nt, Homo sapiens
ggugaaacccagu

SEQ ID NO: 1310249 - RNA, 12 nt, Homo sapiens
ggugacacucua

SEQ ID NO: 1310250 - RNA, 21 nt, Homo sapiens
ggugacacucuauaagauucc

SEQ ID NO: 1310251 - RNA, 17 nt, Homo sapiens
ggugcaguaucaugccc

SEQ ID NO: 1310252 - RNA, 19 nt, Homo sapiens
ggugcaguaucaugcccug

SEQ ID NO: 1310253 - RNA, 13 nt, Homo sapiens
ggugcauagcaga

SEQ ID NO: 1310254 - RNA, 12 nt, Homo sapiens
ggugccugccau

SEQ ID NO: 1310255 - RNA, 13 nt, Homo sapiens
gguggaugccugg

SEQ ID NO: 1310256 - RNA, 19 nt, Homo sapiens
gguggccgcugaguggcag

SEQ ID NO: 1310257 - RNA, 22 nt, Homo sapiens
gguggccucuccuuguggccug

SEQ ID NO: 1310258 - RNA, 15 nt, Homo sapiens
gguggcgcgcaccug

SEQ ID NO: 1310259 - RNA, 20 nt, Homo sapiens
ggugggcuucccaguggcug

SEQ ID NO: 1310260 - RNA, 16 nt, Homo sapiens
gguuauaaauucaaag

SEQ ID NO: 1310261 - RNA, 14 nt, Homo sapiens
gguucucacuguug

SEQ ID NO: 1310262 - RNA, 18 nt, Homo sapiens
gguucucucucucugucu

SEQ ID NO: 1310263 - RNA, 21 nt, Homo sapiens
gguugaacucugguggcacag

SEQ ID NO: 1310264 - RNA, 16 nt, Homo sapiens
gguugguuuaaugcaa

SEQ ID NO: 1310265 - RNA, 18 nt, Homo sapiens
gguuuagaggaccaguga

SEQ ID NO: 1310266 - RNA, 19 nt, Homo sapiens
gguuucacuauguugccua

SEQ ID NO: 1310267 - RNA, 19 nt, Homo sapiens
gguuugaagcugcugucuc

SEQ ID NO: 1310268 - RNA, 14 nt, Homo sapiens
gguuuuacauuuua

SEQ ID NO: 1310269 - RNA, 21 nt, Homo sapiens
gguuuuauaaggcugauguca

SEQ ID NO: 1310270 - RNA, 16 nt, Homo sapiens
guaaaaggccaaaccu

SEQ ID NO: 1310271 - RNA, 20 nt, Homo sapiens
guaaaaucuagaagcuuaag

SEQ ID NO: 1310272 - RNA, 15 nt, Homo sapiens
guaaaauguucucuu

SEQ ID NO: 1310273 - RNA, 14 nt, Homo sapiens
guaaacaaaccaca

SEQ ID NO: 1310274 - RNA, 11 nt, Homo sapiens
guaaacauacu

SEQ ID NO: 1310275 - RNA, 14 nt, Homo sapiens
guaaagcuguucaa

SEQ ID NO: 1310276 - RNA, 20 nt, Homo sapiens
guaaagggcgcaaagggcau

SEQ ID NO: 1310277 - RNA, 17 nt, Homo sapiens
guaaaggggcccagaaa

SEQ ID NO: 1310278 - RNA, 18 nt, Homo sapiens
guaaauauuaaguguuua

SEQ ID NO: 1310279 - RNA, 14 nt, Homo sapiens
guaaaucuauauga

SEQ ID NO: 1310280 - RNA, 13 nt, Homo sapiens
guaaaugugcauu

SEQ ID NO: 1310281 - RNA, 15 nt, Homo sapiens
guaaauguuuagguu

SEQ ID NO: 1310282 - RNA, 20 nt, Homo sapiens
guaaauugaaucaguauaaa

SEQ ID NO: 1310283 - RNA, 21 nt, Homo sapiens
guaacauagcugagguaaaaa

SEQ ID NO: 1310284 - RNA, 13 nt, Homo sapiens
guaacauauuuau

SEQ ID NO: 1310285 - RNA, 18 nt, Homo sapiens
guaaccuuauacuacuaa

SEQ ID NO: 1310286 - RNA, 17 nt, Homo sapiens
guaacuccccucaggga

SEQ ID NO: 1310287 - RNA, 16 nt, Homo sapiens
guaacuggcaguuuuc

SEQ ID NO: 1310288 - RNA, 13 nt, Homo sapiens
guaacuuacuuag

SEQ ID NO: 1310289 - RNA, 20 nt, Homo sapiens
guaagaaaccuacugcccag

SEQ ID NO: 1310290 - RNA, 21 nt, Homo sapiens
guaagacauuaguaacauaau

SEQ ID NO: 1310291 - RNA, 17 nt, Homo sapiens
guaaguauaaaugaauu

SEQ ID NO: 1310292 - RNA, 21 nt, Homo sapiens
guaaguggcuucucugugaau

SEQ ID NO: 1310293 - RNA, 16 nt, Homo sapiens
guaauacaucaaagag

SEQ ID NO: 1310294 - RNA, 15 nt, Homo sapiens
guaaucaaagccacu

SEQ ID NO: 1310295 - RNA, 15 nt, Homo sapiens
guaaucagauuuauu

SEQ ID NO: 1310296 - RNA, 20 nt, Homo sapiens
guaaucccagcuacuuggga

SEQ ID NO: 1310297 - RNA, 18 nt, Homo sapiens
guaauccuagcacuuugg

SEQ ID NO: 1310298 - RNA, 21 nt, Homo sapiens
guaauuuuaguuauacuccuc

SEQ ID NO: 1310299 - RNA, 22 nt, Homo sapiens
guaauuuuguucuaguuuucag

SEQ ID NO: 1310300 - RNA, 16 nt, Homo sapiens
guacaacguguccuca

SEQ ID NO: 1310301 - RNA, 24 nt, Homo sapiens
guacaauaaaaacauugccuuuga

SEQ ID NO: 1310302 - RNA, 21 nt, Homo sapiens
guacacauuuuguaauuaccu

SEQ ID NO: 1310303 - RNA, 15 nt, Homo sapiens
guacacuuucaagua

SEQ ID NO: 1310304 - RNA, 12 nt, Homo sapiens
guacaucuggcc

SEQ ID NO: 1310305 - RNA, 15 nt, Homo sapiens
guaccaaaaauagac

SEQ ID NO: 1310306 - RNA, 12 nt, Homo sapiens
guaccaccaaaa

SEQ ID NO: 1310307 - RNA, 18 nt, Homo sapiens
guacccaauagcugccca

SEQ ID NO: 1310308 - RNA, 19 nt, Homo sapiens
guaccuaaaauugcaacuu

SEQ ID NO: 1310309 - RNA, 23 nt, Homo sapiens
guaccuaaaauugcaacuucuaa

SEQ ID NO: 1310310 - RNA, 18 nt, Homo sapiens
guaccuccucucaguguu

SEQ ID NO: 1310311 - RNA, 21 nt, Homo sapiens
guaccuucaaacuagggccaa

SEQ ID NO: 1310312 - RNA, 13 nt, Homo sapiens
guacuaaagccaa

SEQ ID NO: 1310313 - RNA, 20 nt, Homo sapiens
guacuccagccugggugaca

SEQ ID NO: 1310314 - RNA, 14 nt, Homo sapiens
guacuguacuauau

SEQ ID NO: 1310315 - RNA, 14 nt, Homo sapiens
guacuuacaucagg

SEQ ID NO: 1310316 - RNA, 12 nt, Homo sapiens
guacuucuugaa

SEQ ID NO: 1310317 - RNA, 22 nt, Homo sapiens
guacuuugaguauaacaucaag

SEQ ID NO: 1310318 - RNA, 15 nt, Homo sapiens
guacuuuuuccagac

SEQ ID NO: 1310319 - RNA, 23 nt, Homo sapiens
guagaaaaagcaguaacugacaa

SEQ ID NO: 1310320 - RNA, 18 nt, Homo sapiens
guagaauauucagacaaa

SEQ ID NO: 1310321 - RNA, 16 nt, Homo sapiens
guagaaugaaccacug

SEQ ID NO: 1310322 - RNA, 21 nt, Homo sapiens
guagagcuggggccacccugg

SEQ ID NO: 1310323 - RNA, 22 nt, Homo sapiens
guagauaccaaaugaaacacuu

SEQ ID NO: 1310324 - RNA, 12 nt, Homo sapiens
guagaugggagg

SEQ ID NO: 1310325 - RNA, 17 nt, Homo sapiens
guagcaggccauggcuc

SEQ ID NO: 1310326 - RNA, 16 nt, Homo sapiens
guagcauuuuccagca

SEQ ID NO: 1310327 - RNA, 12 nt, Homo sapiens
guagcugagacu

SEQ ID NO: 1310328 - RNA, 20 nt, Homo sapiens
guaggaggaacagauuugag

SEQ ID NO: 1310329 - RNA, 17 nt, Homo sapiens
guaggggcccacuucac

SEQ ID NO: 1310330 - RNA, 17 nt, Homo sapiens
guagguagauaccaaau

SEQ ID NO: 1310331 - RNA, 15 nt, Homo sapiens
guaguugacaauucu

SEQ ID NO: 1310332 - RNA, 15 nt, Homo sapiens
guaguuuggagacaa

SEQ ID NO: 1310333 - RNA, 20 nt, Homo sapiens
guauacuuccuuaugcuucu

SEQ ID NO: 1310334 - RNA, 21 nt, Homo sapiens
guauauaaauuuucccaaaac

SEQ ID NO: 1310335 - RNA, 18 nt, Homo sapiens
guauauaacgcaggccuu

SEQ ID NO: 1310336 - RNA, 15 nt, Homo sapiens
guauauauaauacug

SEQ ID NO: 1310337 - RNA, 16 nt, Homo sapiens
guauauauaauacuga

SEQ ID NO: 1310338 - RNA, 15 nt, Homo sapiens
guauauguugcaaaa

SEQ ID NO: 1310339 - RNA, 23 nt, Homo sapiens
guauauuugugauagcacuuucu

SEQ ID NO: 1310340 - RNA, 15 nt, Homo sapiens
guaucaaaugugaca

SEQ ID NO: 1310341 - RNA, 21 nt, Homo sapiens
guaucaaaugugacauuauau

SEQ ID NO: 1310342 - RNA, 22 nt, Homo sapiens
guaucaagcccugaaaauaugg

SEQ ID NO: 1310343 - RNA, 15 nt, Homo sapiens
guaucaguucugcug

SEQ ID NO: 1310344 - RNA, 20 nt, Homo sapiens
guaucaugcccugugcaacc

SEQ ID NO: 1310345 - RNA, 16 nt, Homo sapiens
ggcacugccaugcagg

SEQ ID NO: 1310346 - RNA, 11 nt, Homo sapiens
ggcacuggguc

SEQ ID NO: 1310347 - RNA, 12 nt, Homo sapiens
ggcagauccagg

SEQ ID NO: 1310348 - RNA, 16 nt, Homo sapiens
ggcagcccuauuucag

SEQ ID NO: 1310349 - RNA, 16 nt, Homo sapiens
ggcaggcucccaggga

SEQ ID NO: 1310350 - RNA, 21 nt, Homo sapiens
ggcagggaauggggacggugu

SEQ ID NO: 1310351 - RNA, 21 nt, Homo sapiens
ggcaggggcuucuagcugacu

SEQ ID NO: 1310352 - RNA, 19 nt, Homo sapiens
ggcagucacugaauuccau

SEQ ID NO: 1310353 - RNA, 21 nt, Homo sapiens
ggcagugguguggagaagcca

SEQ ID NO: 1310354 - RNA, 14 nt, Homo sapiens
ggcauagaugcagg

SEQ ID NO: 1310355 - RNA, 16 nt, Homo sapiens
ggcaucuggaaagggg

SEQ ID NO: 1310356 - RNA, 17 nt, Homo sapiens
ggcaugaaugagaccca

SEQ ID NO: 1310357 - RNA, 22 nt, Homo sapiens
ggcaugaaugagacccagcuga

SEQ ID NO: 1310358 - RNA, 21 nt, Homo sapiens
ggcaugagcuacuaugcccaa

SEQ ID NO: 1310359 - RNA, 19 nt, Homo sapiens
ggcaugauccaagcaagac

SEQ ID NO: 1310360 - RNA, 20 nt, Homo sapiens
ggcaugguaguauacaaaaa

SEQ ID NO: 1310361 - RNA, 23 nt, Homo sapiens
ggcauguuuugcccaccagauca

SEQ ID NO: 1310362 - RNA, 15 nt, Homo sapiens
ggcauuucacaaaac

SEQ ID NO: 1310363 - RNA, 21 nt, Homo sapiens
ggcauuuucuucucacauuua

SEQ ID NO: 1310364 - RNA, 15 nt, Homo sapiens
ggccaaaccucuguu

SEQ ID NO: 1310365 - RNA, 16 nt, Homo sapiens
ggccaagggccagaca

SEQ ID NO: 1310366 - RNA, 15 nt, Homo sapiens
ggccacacauccugc

SEQ ID NO: 1310367 - RNA, 12 nt, Homo sapiens
ggccagcacuuc

SEQ ID NO: 1310368 - RNA, 13 nt, Homo sapiens
ggccagccaguga

SEQ ID NO: 1310369 - RNA, 17 nt, Homo sapiens
ggccaggcuggucucaa

SEQ ID NO: 1310370 - RNA, 22 nt, Homo sapiens
ggccagguaugcauggaaaaug

SEQ ID NO: 1310371 - RNA, 19 nt, Homo sapiens
ggccaguuugaagacuaca

SEQ ID NO: 1310372 - RNA, 23 nt, Homo sapiens
ggccaugauggcaacagaucugg

SEQ ID NO: 1310373 - RNA, 13 nt, Homo sapiens
ggccaugccucag

SEQ ID NO: 1310374 - RNA, 16 nt, Homo sapiens
ggccauggcucauggg

SEQ ID NO: 1310375 - RNA, 18 nt, Homo sapiens
ggccauugugaaccaaug

SEQ ID NO: 1310376 - RNA, 11 nt, Homo sapiens
ggcccagaccu

SEQ ID NO: 1310377 - RNA, 13 nt, Homo sapiens
ggcccaggugagu

SEQ ID NO: 1310378 - RNA, 18 nt, Homo sapiens
ggcccaucucuucuggcc

SEQ ID NO: 1310379 - RNA, 14 nt, Homo sapiens
ggccccacauugca

SEQ ID NO: 1310380 - RNA, 17 nt, Homo sapiens
ggccccauuuacccaac

SEQ ID NO: 1310381 - RNA, 16 nt, Homo sapiens
ggccccugcccggcug

SEQ ID NO: 1310382 - RNA, 23 nt, Homo sapiens
ggcccguccggcaguucugggug

SEQ ID NO: 1310383 - RNA, 14 nt, Homo sapiens
ggcccuccugcugg

SEQ ID NO: 1310384 - RNA, 20 nt, Homo sapiens
ggcccugccaugcucuccaa

SEQ ID NO: 1310385 - RNA, 13 nt, Homo sapiens
ggcccugcugagu

SEQ ID NO: 1310386 - RNA, 21 nt, Homo sapiens
ggcccugucugugugcugagc

SEQ ID NO: 1310387 - RNA, 18 nt, Homo sapiens
ggcccugugcgucucagu

SEQ ID NO: 1310388 - RNA, 23 nt, Homo sapiens
ggcccuucccacaggacauuucu

SEQ ID NO: 1310389 - RNA, 17 nt, Homo sapiens
ggccgcccugcggguga

SEQ ID NO: 1310390 - RNA, 17 nt, Homo sapiens
ggccgcuucgccauugc

SEQ ID NO: 1310391 - RNA, 19 nt, Homo sapiens
ggccgggcgcgguggcuca

SEQ ID NO: 1310392 - RNA, 23 nt, Homo sapiens
ggccgggcugcgccugcugcacu

SEQ ID NO: 1310393 - RNA, 22 nt, Homo sapiens
ggccucacccaccccugcacag

SEQ ID NO: 1310394 - RNA, 20 nt, Homo sapiens
ggccucaucucugccugaca

SEQ ID NO: 1310395 - RNA, 15 nt, Homo sapiens
ggccuccauccucau

SEQ ID NO: 1310396 - RNA, 14 nt, Homo sapiens
ggccugcuccagac

SEQ ID NO: 1310397 - RNA, 18 nt, Homo sapiens
ggccugcuccagaccuga

SEQ ID NO: 1310398 - RNA, 16 nt, Homo sapiens
ggccuggccagaugca

SEQ ID NO: 1310399 - RNA, 18 nt, Homo sapiens
ggccuggugucuccucau

SEQ ID NO: 1310400 - RNA, 21 nt, Homo sapiens
ggccuguugaagaugcuugua

SEQ ID NO: 1310401 - RNA, 14 nt, Homo sapiens
ggccuuaaccauga

SEQ ID NO: 1310402 - RNA, 22 nt, Homo sapiens
ggccuucaguuuauuuccacua

SEQ ID NO: 1310403 - RNA, 12 nt, Homo sapiens
ggcgcaaagggc

SEQ ID NO: 1310404 - RNA, 18 nt, Homo sapiens
ggcgcaaagggcaugggu

SEQ ID NO: 1310405 - RNA, 20 nt, Homo sapiens
ggcgccgcaaaccacacugg

SEQ ID NO: 1310406 - RNA, 20 nt, Homo sapiens
ggcggcuccauccguggcug

SEQ ID NO: 1310407 - RNA, 22 nt, Homo sapiens
ggcggugggcacccacccuggg

SEQ ID NO: 1310408 - RNA, 22 nt, Homo sapiens
ggcguuacugcuugaccaaaga

SEQ ID NO: 1310409 - RNA, 23 nt, Homo sapiens
ggcuaagacccaaacauaugcac

SEQ ID NO: 1310410 - RNA, 16 nt, Homo sapiens
ggcuaagaguguccua

SEQ ID NO: 1310411 - RNA, 12 nt, Homo sapiens
ggcuaagugauc

SEQ ID NO: 1310412 - RNA, 14 nt, Homo sapiens
ggcuacacagggau

SEQ ID NO: 1310413 - RNA, 17 nt, Homo sapiens
ggcuaccccacccaagu

SEQ ID NO: 1310414 - RNA, 22 nt, Homo sapiens
ggcuauuguccccuaaaccaaa

SEQ ID NO: 1310415 - RNA, 20 nt, Homo sapiens
ggcucaagcuguccucccac

SEQ ID NO: 1310416 - RNA, 15 nt, Homo sapiens
ggcucacgccuguaa

SEQ ID NO: 1310417 - RNA, 19 nt, Homo sapiens
ggcucacuguagucucgac

SEQ ID NO: 1310418 - RNA, 17 nt, Homo sapiens
ggcucagacauguuuuc

SEQ ID NO: 1310419 - RNA, 18 nt, Homo sapiens
ggcucagugcaaccucug

SEQ ID NO: 1310420 - RNA, 13 nt, Homo sapiens
ggcuccacuggga

SEQ ID NO: 1310421 - RNA, 21 nt, Homo sapiens
ggcuccccuccucggcuuccu

SEQ ID NO: 1310422 - RNA, 16 nt, Homo sapiens
ggcucuucucauuuca

SEQ ID NO: 1310423 - RNA, 16 nt, Homo sapiens
ggcugaggcuggcaca

SEQ ID NO: 1310424 - RNA, 18 nt, Homo sapiens
ggcugcacccacccagga

SEQ ID NO: 1310425 - RNA, 22 nt, Homo sapiens
ggcugccgagacagacccucug

SEQ ID NO: 1310426 - RNA, 18 nt, Homo sapiens
ggcugcgagagaaaggga

SEQ ID NO: 1310427 - RNA, 22 nt, Homo sapiens
ggcugcuaacaagucaccaaaa

SEQ ID NO: 1310428 - RNA, 16 nt, Homo sapiens
ggcuggagcccaggga

SEQ ID NO: 1310429 - RNA, 19 nt, Homo sapiens
ggcugggaacucaccuggg

SEQ ID NO: 1310430 - RNA, 20 nt, Homo sapiens
ggcugguggcccaggaccau

SEQ ID NO: 1310431 - RNA, 16 nt, Homo sapiens
ggcugguugugcugca

SEQ ID NO: 1310432 - RNA, 17 nt, Homo sapiens
ggcuguccauguauuca

SEQ ID NO: 1310433 - RNA, 20 nt, Homo sapiens
ggcugugagaggaucaucug

SEQ ID NO: 1310434 - RNA, 19 nt, Homo sapiens
ggcuguguuuccaucucaa

SEQ ID NO: 1310435 - RNA, 16 nt, Homo sapiens
gggaagacauugcaau

SEQ ID NO: 1310436 - RNA, 21 nt, Homo sapiens
gggaauauuugaaucuugucu

SEQ ID NO: 1310437 - RNA, 12 nt, Homo sapiens
gggaaugccuga

SEQ ID NO: 1310438 - RNA, 22 nt, Homo sapiens
gggacaguaauaagaauggaaa

SEQ ID NO: 1310439 - RNA, 16 nt, Homo sapiens
gggaccccuucccaca

SEQ ID NO: 1310440 - RNA, 18 nt, Homo sapiens
gggacugaaaaccucucc

SEQ ID NO: 1310441 - RNA, 19 nt, Homo sapiens
gggagaagcuccucucccc

SEQ ID NO: 1310442 - RNA, 21 nt, Homo sapiens
gggagauucaagggacccaug

SEQ ID NO: 1310443 - RNA, 16 nt, Homo sapiens
gggagcaggcgguggg

SEQ ID NO: 1310444 - RNA, 20 nt, Homo sapiens
gggaggcggagguuccagug

SEQ ID NO: 1310445 - RNA, 18 nt, Homo sapiens
gggauccagcucaucccc

SEQ ID NO: 1310446 - RNA, 12 nt, Homo sapiens
gggaugagcaug

SEQ ID NO: 1310447 - RNA, 18 nt, Homo sapiens
gggauuucuuugcuguaa

SEQ ID NO: 1310448 - RNA, 15 nt, Homo sapiens
gggcaauccagacag

SEQ ID NO: 1310449 - RNA, 21 nt, Homo sapiens
gggcaugaaugagacccagcu

SEQ ID NO: 1310450 - RNA, 12 nt, Homo sapiens
gggccagcacuu

SEQ ID NO: 1310451 - RNA, 13 nt, Homo sapiens
gggcccacaaagg

SEQ ID NO: 1310452 - RNA, 22 nt, Homo sapiens
gggcccggcccgcgccacagga

SEQ ID NO: 1310453 - RNA, 16 nt, Homo sapiens
gggccugcuccagacc

SEQ ID NO: 1310454 - RNA, 21 nt, Homo sapiens
gggcggggcuccugagggagc

SEQ ID NO: 1310455 - RNA, 15 nt, Homo sapiens
gggcuccagccaucu

SEQ ID NO: 1310456 - RNA, 22 nt, Homo sapiens
gggcucccccauaguucacuga

SEQ ID NO: 1310457 - RNA, 21 nt, Homo sapiens
gggcucccguggccuguagaa

SEQ ID NO: 1310458 - RNA, 17 nt, Homo sapiens
gggcuccuccagggugu

SEQ ID NO: 1310459 - RNA, 15 nt, Homo sapiens
gggcuccuugcucca

SEQ ID NO: 1310460 - RNA, 14 nt, Homo sapiens
gggcucgugcccug

SEQ ID NO: 1310461 - RNA, 18 nt, Homo sapiens
gggcucuaaugugucucu

SEQ ID NO: 1310462 - RNA, 23 nt, Homo sapiens
gggcuggaggcccaggcugggaa

SEQ ID NO: 1310463 - RNA, 16 nt, Homo sapiens
gggcuggcacugacug

SEQ ID NO: 1310464 - RNA, 23 nt, Homo sapiens
gggcuggcccagggcugcaaugc

SEQ ID NO: 1310465 - RNA, 19 nt, Homo sapiens
gcuucagcagcacccaugu

SEQ ID NO: 1310466 - RNA, 23 nt, Homo sapiens
gcuucaggaaccucgaguacugu

SEQ ID NO: 1310467 - RNA, 13 nt, Homo sapiens
gcuucagugcugc

SEQ ID NO: 1310468 - RNA, 18 nt, Homo sapiens
gcuucaguggcagcugcu

SEQ ID NO: 1310469 - RNA, 16 nt, Homo sapiens
gcuucauuuccugugu

SEQ ID NO: 1310470 - RNA, 15 nt, Homo sapiens
gcuuccaugauucua

SEQ ID NO: 1310471 - RNA, 22 nt, Homo sapiens
gcuucccgaguaccagugacac

SEQ ID NO: 1310472 - RNA, 19 nt, Homo sapiens
gcuucccuaaucuaugguc

SEQ ID NO: 1310473 - RNA, 12 nt, Homo sapiens
gcuuccuaacug

SEQ ID NO: 1310474 - RNA, 14 nt, Homo sapiens
gcuuccuaacugcu

SEQ ID NO: 1310475 - RNA, 16 nt, Homo sapiens
gcuucuauguuucaua

SEQ ID NO: 1310476 - RNA, 18 nt, Homo sapiens
gcuucucugacuucugcc

SEQ ID NO: 1310477 - RNA, 20 nt, Homo sapiens
gcuucugcuuauucaguccu

SEQ ID NO: 1310478 - RNA, 13 nt, Homo sapiens
gcuugaccaaaga

SEQ ID NO: 1310479 - RNA, 19 nt, Homo sapiens
gcuuggguucacagugcau

SEQ ID NO: 1310480 - RNA, 22 nt, Homo sapiens
gcuuguccccuccucacucccu

SEQ ID NO: 1310481 - RNA, 14 nt, Homo sapiens
gcuuuaacuauauc

SEQ ID NO: 1310482 - RNA, 20 nt, Homo sapiens
gcuuucauguaaacugugca

SEQ ID NO: 1310483 - RNA, 19 nt, Homo sapiens
gcuuuccguggcacugcau

SEQ ID NO: 1310484 - RNA, 20 nt, Homo sapiens
gcuuuccugccuccuugaaa

SEQ ID NO: 1310485 - RNA, 12 nt, Homo sapiens
gcuuucugccac

SEQ ID NO: 1310486 - RNA, 15 nt, Homo sapiens
gcuuugaaaauucag

SEQ ID NO: 1310487 - RNA, 17 nt, Homo sapiens
gcuuugaguuaacucac

SEQ ID NO: 1310488 - RNA, 16 nt, Homo sapiens
gcuuuggauuugacau

SEQ ID NO: 1310489 - RNA, 11 nt, Homo sapiens
gcuuuugccau

SEQ ID NO: 1310490 - RNA, 23 nt, Homo sapiens
ggaaaagaaagaagagaagggga

SEQ ID NO: 1310491 - RNA, 17 nt, Homo sapiens
ggaaaauuucacauuaa

SEQ ID NO: 1310492 - RNA, 20 nt, Homo sapiens
ggaaaccucccuuuacagca

SEQ ID NO: 1310493 - RNA, 16 nt, Homo sapiens
ggaaagaaguucacau

SEQ ID NO: 1310494 - RNA, 22 nt, Homo sapiens
ggaaagaugguguggguguccu

SEQ ID NO: 1310495 - RNA, 21 nt, Homo sapiens
ggaaagggagacgcccuuuca

SEQ ID NO: 1310496 - RNA, 20 nt, Homo sapiens
ggaaagucgugucugucaga

SEQ ID NO: 1310497 - RNA, 20 nt, Homo sapiens
ggaaagugauuuuuuuccac

SEQ ID NO: 1310498 - RNA, 20 nt, Homo sapiens
ggaacaaaguaacagccuuu

SEQ ID NO: 1310499 - RNA, 21 nt, Homo sapiens
ggaacaaaguaacagccuuuc

SEQ ID NO: 1310500 - RNA, 15 nt, Homo sapiens
ggaacacccccauga

SEQ ID NO: 1310501 - RNA, 23 nt, Homo sapiens
ggaacacggccacaucaaagagg

SEQ ID NO: 1310502 - RNA, 21 nt, Homo sapiens
ggaacacuagacaagccagaa

SEQ ID NO: 1310503 - RNA, 21 nt, Homo sapiens
ggaacagugaaucagucccau

SEQ ID NO: 1310504 - RNA, 20 nt, Homo sapiens
ggaaccacaccacaucuaag

SEQ ID NO: 1310505 - RNA, 16 nt, Homo sapiens
ggaacccagacucaga

SEQ ID NO: 1310506 - RNA, 20 nt, Homo sapiens
ggaaccucagccuggccaga

SEQ ID NO: 1310507 - RNA, 21 nt, Homo sapiens
ggaaccucagccuggccagac

SEQ ID NO: 1310508 - RNA, 23 nt, Homo sapiens
ggaacugcguuaugaagagcuaa

SEQ ID NO: 1310509 - RNA, 14 nt, Homo sapiens
ggaacuuagccauu

SEQ ID NO: 1310510 - RNA, 9 nt, Homo sapiens
ggaacuuua

SEQ ID NO: 1310511 - RNA, 18 nt, Homo sapiens
ggaagaaagaauguuacu

SEQ ID NO: 1310512 - RNA, 15 nt, Homo sapiens
ggaagacaaugugaa

SEQ ID NO: 1310513 - RNA, 16 nt, Homo sapiens
ggaagacauugcaaug

SEQ ID NO: 1310514 - RNA, 17 nt, Homo sapiens
ggaagagggugauugcu

SEQ ID NO: 1310515 - RNA, 21 nt, Homo sapiens
ggaagcuccgcuuucuaccca

SEQ ID NO: 1310516 - RNA, 22 nt, Homo sapiens
ggacaaggagugugaccacuga

SEQ ID NO: 1310517 - RNA, 12 nt, Homo sapiens
ggacaagugauc

SEQ ID NO: 1310518 - RNA, 15 nt, Homo sapiens
ggacaauaugugcca

SEQ ID NO: 1310519 - RNA, 21 nt, Homo sapiens
ggacacuuccguagacuguuu

SEQ ID NO: 1310520 - RNA, 17 nt, Homo sapiens
ggacaggauguguuugc

SEQ ID NO: 1310521 - RNA, 22 nt, Homo sapiens
ggacaggauguguuugcuuucu

SEQ ID NO: 1310522 - RNA, 22 nt, Homo sapiens
ggacaucagcuggucaaacaaa

SEQ ID NO: 1310523 - RNA, 19 nt, Homo sapiens
ggacaugcuucagugcugc

SEQ ID NO: 1310524 - RNA, 18 nt, Homo sapiens
ggacauugcggacagcca

SEQ ID NO: 1310525 - RNA, 11 nt, Homo sapiens
ggaccaggugc

SEQ ID NO: 1310526 - RNA, 12 nt, Homo sapiens
ggaccagugagu

SEQ ID NO: 1310527 - RNA, 15 nt, Homo sapiens
ggacccagcacugac

SEQ ID NO: 1310528 - RNA, 17 nt, Homo sapiens
ggaccuccaagccacug

SEQ ID NO: 1310529 - RNA, 20 nt, Homo sapiens
ggaccuccaagccacugagc

SEQ ID NO: 1310530 - RNA, 21 nt, Homo sapiens
ggaccucuucuggagauggaa

SEQ ID NO: 1310531 - RNA, 19 nt, Homo sapiens
ggaccuggcaacccaggaa

SEQ ID NO: 1310532 - RNA, 20 nt, Homo sapiens
ggacuaauccaauaccucuu

SEQ ID NO: 1310533 - RNA, 17 nt, Homo sapiens
ggacuacaggcacccac

SEQ ID NO: 1310534 - RNA, 19 nt, Homo sapiens
ggacuagagggaccucucc

SEQ ID NO: 1310535 - RNA, 23 nt, Homo sapiens
ggacucaggcgggacagugcugc

SEQ ID NO: 1310536 - RNA, 22 nt, Homo sapiens
ggacuccaucucucauccucca

SEQ ID NO: 1310537 - RNA, 16 nt, Homo sapiens
ggacucucagccucuu

SEQ ID NO: 1310538 - RNA, 16 nt, Homo sapiens
ggacugagccagaccu

SEQ ID NO: 1310539 - RNA, 21 nt, Homo sapiens
ggacuuccccggagggcugcg

SEQ ID NO: 1310540 - RNA, 15 nt, Homo sapiens
ggacuucugccugaa

SEQ ID NO: 1310541 - RNA, 15 nt, Homo sapiens
ggacuuggaagcucc

SEQ ID NO: 1310542 - RNA, 18 nt, Homo sapiens
ggagaccuggacacaggc

SEQ ID NO: 1310543 - RNA, 17 nt, Homo sapiens
ggagaccuggcacugga

SEQ ID NO: 1310544 - RNA, 12 nt, Homo sapiens
ggagcacugggu

SEQ ID NO: 1310545 - RNA, 16 nt, Homo sapiens
ggagcagaugcaauga

SEQ ID NO: 1310546 - RNA, 13 nt, Homo sapiens
ggagccacugcca

SEQ ID NO: 1310547 - RNA, 17 nt, Homo sapiens
ggagcccagaaaaccuc

SEQ ID NO: 1310548 - RNA, 14 nt, Homo sapiens
ggagcuagccagag

SEQ ID NO: 1310549 - RNA, 11 nt, Homo sapiens
ggagcugcuau

SEQ ID NO: 1310550 - RNA, 16 nt, Homo sapiens
ggaggaacagauuuga

SEQ ID NO: 1310551 - RNA, 13 nt, Homo sapiens
ggaggacagggag

SEQ ID NO: 1310552 - RNA, 15 nt, Homo sapiens
ggaggcaacgccaga

SEQ ID NO: 1310553 - RNA, 20 nt, Homo sapiens
ggaggcagagguugcaguga

SEQ ID NO: 1310554 - RNA, 16 nt, Homo sapiens
ggaggugaagguugcu

SEQ ID NO: 1310555 - RNA, 14 nt, Homo sapiens
ggagucacacagug

SEQ ID NO: 1310556 - RNA, 21 nt, Homo sapiens
ggagucccaaaugucaucagg

SEQ ID NO: 1310557 - RNA, 15 nt, Homo sapiens
ggaguggccacuaag

SEQ ID NO: 1310558 - RNA, 18 nt, Homo sapiens
ggaguguggccacguggg

SEQ ID NO: 1310559 - RNA, 18 nt, Homo sapiens
ggaguuaggcuauucaca

SEQ ID NO: 1310560 - RNA, 18 nt, Homo sapiens
ggaguucucccaccaccu

SEQ ID NO: 1310561 - RNA, 18 nt, Homo sapiens
ggauaaauugccauaaua

SEQ ID NO: 1310562 - RNA, 20 nt, Homo sapiens
ggauaacacuggcuucaggc

SEQ ID NO: 1310563 - RNA, 18 nt, Homo sapiens
ggauaaugcccaugguac

SEQ ID NO: 1310564 - RNA, 18 nt, Homo sapiens
ggauacuguaacacuuua

SEQ ID NO: 1310565 - RNA, 17 nt, Homo sapiens
ggauaucaaaagcaaau

SEQ ID NO: 1310566 - RNA, 15 nt, Homo sapiens
ggauauuccaaaaua

SEQ ID NO: 1310567 - RNA, 11 nt, Homo sapiens
ggaucagccag

SEQ ID NO: 1310568 - RNA, 19 nt, Homo sapiens
ggauccccccacagccccu

SEQ ID NO: 1310569 - RNA, 22 nt, Homo sapiens
ggaucugcccccuuuacuccuc

SEQ ID NO: 1310570 - RNA, 21 nt, Homo sapiens
ggaugauacuuggaugcagcu

SEQ ID NO: 1310571 - RNA, 18 nt, Homo sapiens
ggauggccaaacccaaga

SEQ ID NO: 1310572 - RNA, 15 nt, Homo sapiens
ggauggccguggaug

SEQ ID NO: 1310573 - RNA, 20 nt, Homo sapiens
ggauggcuggcucugcaccu

SEQ ID NO: 1310574 - RNA, 15 nt, Homo sapiens
ggauggugugccuuc

SEQ ID NO: 1310575 - RNA, 18 nt, Homo sapiens
ggauguggacuuggaugc

SEQ ID NO: 1310576 - RNA, 16 nt, Homo sapiens
ggauuacaggcuugag

SEQ ID NO: 1310577 - RNA, 23 nt, Homo sapiens
ggauuccccaucucaggccagag

SEQ ID NO: 1310578 - RNA, 17 nt, Homo sapiens
ggcaaaauaaagugaca

SEQ ID NO: 1310579 - RNA, 14 nt, Homo sapiens
ggcaaaaugucauu

SEQ ID NO: 1310580 - RNA, 14 nt, Homo sapiens
ggcaaacaggcagu

SEQ ID NO: 1310581 - RNA, 17 nt, Homo sapiens
ggcaaaggguccagaag

SEQ ID NO: 1310582 - RNA, 11 nt, Homo sapiens
gcgcaucucaa

SEQ ID NO: 1310583 - RNA, 20 nt, Homo sapiens
gcgccaggcugaccacagca

SEQ ID NO: 1310584 - RNA, 18 nt, Homo sapiens
gcgccuccgacuggcugg

SEQ ID NO: 1310585 - RNA, 19 nt, Homo sapiens
gcgcuauugcacuccaguc

SEQ ID NO: 1310586 - RNA, 16 nt, Homo sapiens
gcgcugggcacuuccc

SEQ ID NO: 1310587 - RNA, 20 nt, Homo sapiens
gcgcuguuuucucagcucca

SEQ ID NO: 1310588 - RNA, 22 nt, Homo sapiens
gcggaccccucgucaucaggug

SEQ ID NO: 1310589 - RNA, 16 nt, Homo sapiens
gcggagguuccaguga

SEQ ID NO: 1310590 - RNA, 16 nt, Homo sapiens
gcggcagcauggagcu

SEQ ID NO: 1310591 - RNA, 19 nt, Homo sapiens
gcggcaggaagggggccga

SEQ ID NO: 1310592 - RNA, 16 nt, Homo sapiens
gcggcauuaaagccau

SEQ ID NO: 1310593 - RNA, 21 nt, Homo sapiens
gcgguagccagcacacagggc

SEQ ID NO: 1310594 - RNA, 13 nt, Homo sapiens
gcggugcacucac

SEQ ID NO: 1310595 - RNA, 18 nt, Homo sapiens
gcguacgcuggugcugag

SEQ ID NO: 1310596 - RNA, 22 nt, Homo sapiens
gcgugaaggccgagaagcaaga

SEQ ID NO: 1310597 - RNA, 16 nt, Homo sapiens
gcgugaccagcaguac

SEQ ID NO: 1310598 - RNA, 12 nt, Homo sapiens
gcgugcacacac

SEQ ID NO: 1310599 - RNA, 19 nt, Homo sapiens
gcguuacugcuugaccaaa

SEQ ID NO: 1310600 - RNA, 23 nt, Homo sapiens
gcguuuggacccaguucagugag

SEQ ID NO: 1310601 - RNA, 14 nt, Homo sapiens
gcuaaaaagcaaca

SEQ ID NO: 1310602 - RNA, 17 nt, Homo sapiens
gcuaaagaauccauaaa

SEQ ID NO: 1310603 - RNA, 22 nt, Homo sapiens
gcuaagacccaaacauaugcac

SEQ ID NO: 1310604 - RNA, 20 nt, Homo sapiens
gcuaagaugggaugugccga

SEQ ID NO: 1310605 - RNA, 21 nt, Homo sapiens
gcuaauugcuggcuggcugcc

SEQ ID NO: 1310606 - RNA, 18 nt, Homo sapiens
gcuacaaaauaaagcugu

SEQ ID NO: 1310607 - RNA, 14 nt, Homo sapiens
gcuacacugacacu

SEQ ID NO: 1310608 - RNA, 12 nt, Homo sapiens
gcuacagggcca

SEQ ID NO: 1310609 - RNA, 13 nt, Homo sapiens
gcuacagggccaa

SEQ ID NO: 1310610 - RNA, 11 nt, Homo sapiens
gcuaccaacuu

SEQ ID NO: 1310611 - RNA, 19 nt, Homo sapiens
gcuaccauuuuacauuucu

SEQ ID NO: 1310612 - RNA, 20 nt, Homo sapiens
gcuacucuguuccuucacau

SEQ ID NO: 1310613 - RNA, 23 nt, Homo sapiens
gcuacugccgucagugcugugcu

SEQ ID NO: 1310614 - RNA, 20 nt, Homo sapiens
gcuagaguuuccuuauccag

SEQ ID NO: 1310615 - RNA, 13 nt, Homo sapiens
gcuagggugguca

SEQ ID NO: 1310616 - RNA, 15 nt, Homo sapiens
gcuaguguaccuccu

SEQ ID NO: 1310617 - RNA, 19 nt, Homo sapiens
gcuaguguaccuccucuca

SEQ ID NO: 1310618 - RNA, 22 nt, Homo sapiens
gcuauagacccgaggaaacuca

SEQ ID NO: 1310619 - RNA, 18 nt, Homo sapiens
gcucaaagaguggcuuga

SEQ ID NO: 1310620 - RNA, 17 nt, Homo sapiens
gcucaaaggcacaguga

SEQ ID NO: 1310621 - RNA, 21 nt, Homo sapiens
gcucaagcgauccucccaccu

SEQ ID NO: 1310622 - RNA, 21 nt, Homo sapiens
gcucaagcuguccucccaccu

SEQ ID NO: 1310623 - RNA, 18 nt, Homo sapiens
gcucacauaucugucauu

SEQ ID NO: 1310624 - RNA, 18 nt, Homo sapiens
gcucaccagccccagugc

SEQ ID NO: 1310625 - RNA, 17 nt, Homo sapiens
gcucacuacucagugau

SEQ ID NO: 1310626 - RNA, 13 nt, Homo sapiens
gcucacuguucua

SEQ ID NO: 1310627 - RNA, 16 nt, Homo sapiens
gcucagaacuugcugc

SEQ ID NO: 1310628 - RNA, 14 nt, Homo sapiens
gcucagacugguug

SEQ ID NO: 1310629 - RNA, 19 nt, Homo sapiens
gcucagcggggacagcucc

SEQ ID NO: 1310630 - RNA, 22 nt, Homo sapiens
gcucagcuucuccugugugauu

SEQ ID NO: 1310631 - RNA, 18 nt, Homo sapiens
gcucaggaccaggcaaug

SEQ ID NO: 1310632 - RNA, 22 nt, Homo sapiens
gcucagggcuaaacgggcauug

SEQ ID NO: 1310633 - RNA, 19 nt, Homo sapiens
gcucaucagaaacucaaaa

SEQ ID NO: 1310634 - RNA, 20 nt, Homo sapiens
gcucaucagaaacucaaaag

SEQ ID NO: 1310635 - RNA, 19 nt, Homo sapiens
gcucauuuacacucagcug

SEQ ID NO: 1310636 - RNA, 11 nt, Homo sapiens
gcuccacugaa

SEQ ID NO: 1310637 - RNA, 13 nt, Homo sapiens
gcuccacugggau

SEQ ID NO: 1310638 - RNA, 18 nt, Homo sapiens
gcuccagaagauagcuuc

SEQ ID NO: 1310639 - RNA, 19 nt, Homo sapiens
gcuccauuuuuagugaaau

SEQ ID NO: 1310640 - RNA, 15 nt, Homo sapiens
gcucccaagggaugg

SEQ ID NO: 1310641 - RNA, 21 nt, Homo sapiens
gcucccccauaguucacugac

SEQ ID NO: 1310642 - RNA, 22 nt, Homo sapiens
gcucccucuauuuauguuugca

SEQ ID NO: 1310643 - RNA, 18 nt, Homo sapiens
gcucccugacagcaccug

SEQ ID NO: 1310644 - RNA, 21 nt, Homo sapiens
gcuccgugcuuguuugcucac

SEQ ID NO: 1310645 - RNA, 12 nt, Homo sapiens
gcuccucacuca

SEQ ID NO: 1310646 - RNA, 12 nt, Homo sapiens
gcuccucaucca

SEQ ID NO: 1310647 - RNA, 15 nt, Homo sapiens
gcuccuccagggugu

SEQ ID NO: 1310648 - RNA, 18 nt, Homo sapiens
gcuccucccucugaccca

SEQ ID NO: 1310649 - RNA, 20 nt, Homo sapiens
gcuccucuccccagcccaga

SEQ ID NO: 1310650 - RNA, 21 nt, Homo sapiens
gcuccucuccccagcccagag

SEQ ID NO: 1310651 - RNA, 15 nt, Homo sapiens
gcucgagcaguccug

SEQ ID NO: 1310652 - RNA, 19 nt, Homo sapiens
gcucgagucacauucugcu

SEQ ID NO: 1310653 - RNA, 16 nt, Homo sapiens
gcucgcuuugagugac

SEQ ID NO: 1310654 - RNA, 18 nt, Homo sapiens
gcucuccugugcauugua

SEQ ID NO: 1310655 - RNA, 16 nt, Homo sapiens
gcucucucuucuuauu

SEQ ID NO: 1310656 - RNA, 17 nt, Homo sapiens
gcucugcuucaauguag

SEQ ID NO: 1310657 - RNA, 14 nt, Homo sapiens
gcucugcuugacaa

SEQ ID NO: 1310658 - RNA, 17 nt, Homo sapiens
gcucugggauagcugac

SEQ ID NO: 1310659 - RNA, 12 nt, Homo sapiens
gcucuggugaua

SEQ ID NO: 1310660 - RNA, 19 nt, Homo sapiens
gcugaacccucagccuuga

SEQ ID NO: 1310661 - RNA, 14 nt, Homo sapiens
gcugaagcagguuc

SEQ ID NO: 1310662 - RNA, 20 nt, Homo sapiens
gcugacggcgcaagaccagc

SEQ ID NO: 1310663 - RNA, 14 nt, Homo sapiens
gcugagcgccagga

SEQ ID NO: 1310664 - RNA, 16 nt, Homo sapiens
gcugaggccacacuca

SEQ ID NO: 1310665 - RNA, 21 nt, Homo sapiens
gcugaggcuggcacaggacau

SEQ ID NO: 1310666 - RNA, 18 nt, Homo sapiens
gcugagguaaaaacugaa

SEQ ID NO: 1310667 - RNA, 14 nt, Homo sapiens
gcugagucugcaga

SEQ ID NO: 1310668 - RNA, 22 nt, Homo sapiens
gcugauacaaauugcagacugu

SEQ ID NO: 1310669 - RNA, 13 nt, Homo sapiens
gcugcaaaggaca

SEQ ID NO: 1310670 - RNA, 17 nt, Homo sapiens
gcugcagguuggaacua

SEQ ID NO: 1310671 - RNA, 18 nt, Homo sapiens
gcugccaaacacccaugc

SEQ ID NO: 1310672 - RNA, 21 nt, Homo sapiens
gcugccugccgguaaacacgc

SEQ ID NO: 1310673 - RNA, 17 nt, Homo sapiens
gcugccuuggcucagac

SEQ ID NO: 1310674 - RNA, 15 nt, Homo sapiens
gcugcuggacaguau

SEQ ID NO: 1310675 - RNA, 17 nt, Homo sapiens
gcugcuucuauguuuca

SEQ ID NO: 1310676 - RNA, 17 nt, Homo sapiens
gcugcuuucuccuuuca

SEQ ID NO: 1310677 - RNA, 18 nt, Homo sapiens
gcuggaaaccucaugcca

SEQ ID NO: 1310678 - RNA, 21 nt, Homo sapiens
gcuggaacagauucacacugu

SEQ ID NO: 1310679 - RNA, 19 nt, Homo sapiens
gcuggagccuggugcccua

SEQ ID NO: 1310680 - RNA, 20 nt, Homo sapiens
gcuggaguacaguggugcca

SEQ ID NO: 1310681 - RNA, 17 nt, Homo sapiens
gcuggagucaugugccu

SEQ ID NO: 1310682 - RNA, 20 nt, Homo sapiens
gcuggagugcagugguguga

SEQ ID NO: 1310683 - RNA, 18 nt, Homo sapiens
gcuggcaaccacuaagaa

SEQ ID NO: 1310684 - RNA, 22 nt, Homo sapiens
gcuggcagaugcuuuacaguca

SEQ ID NO: 1310685 - RNA, 14 nt, Homo sapiens
gcuggcgugcagug

SEQ ID NO: 1310686 - RNA, 20 nt, Homo sapiens
gcugggauuacaggugugca

SEQ ID NO: 1310687 - RNA, 16 nt, Homo sapiens
gcugggauuuacacuu

SEQ ID NO: 1310688 - RNA, 15 nt, Homo sapiens
gcugggcucgccaca

SEQ ID NO: 1310689 - RNA, 15 nt, Homo sapiens
gcugggcuucagugg

SEQ ID NO: 1310690 - RNA, 22 nt, Homo sapiens
gcugguauguuggggcccugug

SEQ ID NO: 1310691 - RNA, 14 nt, Homo sapiens
gcuguauagcuccu

SEQ ID NO: 1310692 - RNA, 23 nt, Homo sapiens
gcuguauuuugaaaaugcuuuag

SEQ ID NO: 1310693 - RNA, 18 nt, Homo sapiens
gcugucaugagugaugcc

SEQ ID NO: 1310694 - RNA, 14 nt, Homo sapiens
ccgugucaagcugc

SEQ ID NO: 1310695 - RNA, 18 nt, Homo sapiens
ccguucugugcacaaaac

SEQ ID NO: 1310696 - RNA, 14 nt, Homo sapiens
ccuaaaaacacaga

SEQ ID NO: 1310697 - RNA, 23 nt, Homo sapiens
ccuaaaacauaagaucacugcca

SEQ ID NO: 1310698 - RNA, 17 nt, Homo sapiens
ccuaaacauaugaauua

SEQ ID NO: 1310699 - RNA, 16 nt, Homo sapiens
ccuaaacccuguuccu

SEQ ID NO: 1310700 - RNA, 22 nt, Homo sapiens
ccuaagcgggggugaaagagga

SEQ ID NO: 1310701 - RNA, 15 nt, Homo sapiens
ccuaauaacgugaaa

SEQ ID NO: 1310702 - RNA, 20 nt, Homo sapiens
ccuaaugcucaccuuuauca

SEQ ID NO: 1310703 - RNA, 14 nt, Homo sapiens
ccuaauuaccugua

SEQ ID NO: 1310704 - RNA, 13 nt, Homo sapiens
ccuacccccugaa

SEQ ID NO: 1310705 - RNA, 17 nt, Homo sapiens
ccuacccugccccaauu

SEQ ID NO: 1310706 - RNA, 22 nt, Homo sapiens
ccuacccugccucccuugacuu

SEQ ID NO: 1310707 - RNA, 14 nt, Homo sapiens
ccuacguuaaccca

SEQ ID NO: 1310708 - RNA, 21 nt, Homo sapiens
ccuagacucggggugcuuccu

SEQ ID NO: 1310709 - RNA, 16 nt, Homo sapiens
ccuagcacaugcuuca

SEQ ID NO: 1310710 - RNA, 23 nt, Homo sapiens
ccuagcaggcacaggacaccugg

SEQ ID NO: 1310711 - RNA, 14 nt, Homo sapiens
ccuagcccucauuu

SEQ ID NO: 1310712 - RNA, 18 nt, Homo sapiens
ccuagcggaguuccagca

SEQ ID NO: 1310713 - RNA, 17 nt, Homo sapiens
ccuaggaguauccucau

SEQ ID NO: 1310714 - RNA, 15 nt, Homo sapiens
ccuaggcauuugcug

SEQ ID NO: 1310715 - RNA, 23 nt, Homo sapiens
ccuagggaauggucccagcacga

SEQ ID NO: 1310716 - RNA, 13 nt, Homo sapiens
ccuaucagaauuu

SEQ ID NO: 1310717 - RNA, 15 nt, Homo sapiens
ccuaugaaauuucaa

SEQ ID NO: 1310718 - RNA, 14 nt, Homo sapiens
ccuauguaugccau

SEQ ID NO: 1310719 - RNA, 22 nt, Homo sapiens
ccuauguuguaauuuuacuuuu

SEQ ID NO: 1310720 - RNA, 14 nt, Homo sapiens
ccuauuucuuaaac

SEQ ID NO: 1310721 - RNA, 17 nt, Homo sapiens
ccucaaaaaaagccuuu

SEQ ID NO: 1310722 - RNA, 13 nt, Homo sapiens
ccucaaacacugc

SEQ ID NO: 1310723 - RNA, 21 nt, Homo sapiens
ccucaaacgaaucauuggcua

SEQ ID NO: 1310724 - RNA, 16 nt, Homo sapiens
ccucaagugauccucc

SEQ ID NO: 1310725 - RNA, 14 nt, Homo sapiens
ccucacaagcauga

SEQ ID NO: 1310726 - RNA, 22 nt, Homo sapiens
ccucacagcacuaguauuucau

SEQ ID NO: 1310727 - RNA, 18 nt, Homo sapiens
ccucacaggccccaggaa

SEQ ID NO: 1310728 - RNA, 12 nt, Homo sapiens
ccucagauuccg

SEQ ID NO: 1310729 - RNA, 21 nt, Homo sapiens
ccucagauuccgcaccaauaa

SEQ ID NO: 1310730 - RNA, 22 nt, Homo sapiens
ccucagccucccaaagugcugg

SEQ ID NO: 1310731 - RNA, 19 nt, Homo sapiens
ccucagccuggccagacac

SEQ ID NO: 1310732 - RNA, 15 nt, Homo sapiens
ccucagccuugccag

SEQ ID NO: 1310733 - RNA, 13 nt, Homo sapiens
ccucaggugaucc

SEQ ID NO: 1310734 - RNA, 12 nt, Homo sapiens
ccucaggugcua

SEQ ID NO: 1310735 - RNA, 17 nt, Homo sapiens
ccucagugagcccaucu

SEQ ID NO: 1310736 - RNA, 16 nt, Homo sapiens
ccucaucucugccuga

SEQ ID NO: 1310737 - RNA, 19 nt, Homo sapiens
ccucaucucugccugacaa

SEQ ID NO: 1310738 - RNA, 20 nt, Homo sapiens
ccucaugcccccucagugag

SEQ ID NO: 1310739 - RNA, 20 nt, Homo sapiens
ccucauuagcauuuugcuaa

SEQ ID NO: 1310740 - RNA, 19 nt, Homo sapiens
ccucauuugggguagcuag

SEQ ID NO: 1310741 - RNA, 14 nt, Homo sapiens
ccuccaacaccaag

SEQ ID NO: 1310742 - RNA, 15 nt, Homo sapiens
ccuccaagccacuga

SEQ ID NO: 1310743 - RNA, 15 nt, Homo sapiens
ccuccaauguacaac

SEQ ID NO: 1310744 - RNA, 21 nt, Homo sapiens
ccuccagggcuggacugaggc

SEQ ID NO: 1310745 - RNA, 18 nt, Homo sapiens
ccuccagggugauuuuau

SEQ ID NO: 1310746 - RNA, 14 nt, Homo sapiens
ccucccgggcucaa

SEQ ID NO: 1310747 - RNA, 16 nt, Homo sapiens
ccucccugacuuuucu

SEQ ID NO: 1310748 - RNA, 22 nt, Homo sapiens
cauugcuguuguccaacuauuu

SEQ ID NO: 1310749 - RNA, 16 nt, Homo sapiens
cauuggccgacaucac

SEQ ID NO: 1310750 - RNA, 17 nt, Homo sapiens
cauuggccgacaucaca

SEQ ID NO: 1310751 - RNA, 15 nt, Homo sapiens
cauugugaggguuaa

SEQ ID NO: 1310752 - RNA, 15 nt, Homo sapiens
cauugugauguauau

SEQ ID NO: 1310753 - RNA, 18 nt, Homo sapiens
cauuuaaaaaaaaucccu

SEQ ID NO: 1310754 - RNA, 16 nt, Homo sapiens
cauuuagaacuuuccu

SEQ ID NO: 1310755 - RNA, 16 nt, Homo sapiens
cauuuagcuguauuca

SEQ ID NO: 1310756 - RNA, 22 nt, Homo sapiens
cauuuaguuugauuauucagug

SEQ ID NO: 1310757 - RNA, 13 nt, Homo sapiens
cauuuauagcaua

SEQ ID NO: 1310758 - RNA, 20 nt, Homo sapiens
cauuuauuuugagaagcucu

SEQ ID NO: 1310759 - RNA, 15 nt, Homo sapiens
cauuucauauucuuu

SEQ ID NO: 1310760 - RNA, 16 nt, Homo sapiens
cauuuccaaauucaca

SEQ ID NO: 1310761 - RNA, 15 nt, Homo sapiens
cauuuccaagcacuu

SEQ ID NO: 1310762 - RNA, 15 nt, Homo sapiens
cauuuccaugcauaa

SEQ ID NO: 1310763 - RNA, 17 nt, Homo sapiens
cauuuccaugcauaaau

SEQ ID NO: 1310764 - RNA, 16 nt, Homo sapiens
cauuuccuggucagug

SEQ ID NO: 1310765 - RNA, 19 nt, Homo sapiens
cauuugauaaaauccaaaa

SEQ ID NO: 1310766 - RNA, 23 nt, Homo sapiens
cauuugauaugugaaugcucaua

SEQ ID NO: 1310767 - RNA, 15 nt, Homo sapiens
cauuugccugucaug

SEQ ID NO: 1310768 - RNA, 20 nt, Homo sapiens
cauuuguggugauauagaau

SEQ ID NO: 1310769 - RNA, 16 nt, Homo sapiens
cauuuguuaaaauaca

SEQ ID NO: 1310770 - RNA, 18 nt, Homo sapiens
cauuuuacuguuguacaa

SEQ ID NO: 1310771 - RNA, 20 nt, Homo sapiens
cauuuuauuuuuucuugcaa

SEQ ID NO: 1310772 - RNA, 22 nt, Homo sapiens
cauuuuauuuuuucuugcaaau

SEQ ID NO: 1310773 - RNA, 15 nt, Homo sapiens
cauuuugcacuguaa

SEQ ID NO: 1310774 - RNA, 16 nt, Homo sapiens
cauuuuuaaucugugu

SEQ ID NO: 1310775 - RNA, 17 nt, Homo sapiens
cauuuuuacguacuuga

SEQ ID NO: 1310776 - RNA, 16 nt, Homo sapiens
cauuuuucaaagcaau

SEQ ID NO: 1310777 - RNA, 19 nt, Homo sapiens
cauuuuucaaagcaauuga

SEQ ID NO: 1310778 - RNA, 17 nt, Homo sapiens
cauuuuuuaaaaaagca

SEQ ID NO: 1310779 - RNA, 16 nt, Homo sapiens
ccaaaaaugcacccaa

SEQ ID NO: 1310780 - RNA, 17 nt, Homo sapiens
ccaaaccuucaggaaau

SEQ ID NO: 1310781 - RNA, 16 nt, Homo sapiens
ccaaacuacgaccuca

SEQ ID NO: 1310782 - RNA, 15 nt, Homo sapiens
ccaaacugugaugaa

SEQ ID NO: 1310783 - RNA, 21 nt, Homo sapiens
ccaaagagaagggcacuguaa

SEQ ID NO: 1310784 - RNA, 22 nt, Homo sapiens
ccaaagaguagaauugcauuga

SEQ ID NO: 1310785 - RNA, 19 nt, Homo sapiens
ccaaagcagacagcuccac

SEQ ID NO: 1310786 - RNA, 11 nt, Homo sapiens
ccaaagggaua

SEQ ID NO: 1310787 - RNA, 16 nt, Homo sapiens
ccaaaguccaggacac

SEQ ID NO: 1310788 - RNA, 17 nt, Homo sapiens
ccaaagugcugggauua

SEQ ID NO: 1310789 - RNA, 14 nt, Homo sapiens
ccaaauaauuccac

SEQ ID NO: 1310790 - RNA, 20 nt, Homo sapiens
ccaaaugcucucucuucuua

SEQ ID NO: 1310791 - RNA, 16 nt, Homo sapiens
ccaaaugucaucaggu

SEQ ID NO: 1310792 - RNA, 18 nt, Homo sapiens
ccaaccuggggggcagug

SEQ ID NO: 1310793 - RNA, 21 nt, Homo sapiens
ccaacuagcucuauguuuaca

SEQ ID NO: 1310794 - RNA, 16 nt, Homo sapiens
ccaacuccucaugucu

SEQ ID NO: 1310795 - RNA, 17 nt, Homo sapiens
ccaagaauagcaucugu

SEQ ID NO: 1310796 - RNA, 23 nt, Homo sapiens
ccaagaccucagggcacaaagau

SEQ ID NO: 1310797 - RNA, 20 nt, Homo sapiens
ccaagaggagcacacuuugg

SEQ ID NO: 1310798 - RNA, 18 nt, Homo sapiens
ccaagagucugaugauuu

SEQ ID NO: 1310799 - RNA, 13 nt, Homo sapiens
ccaagaugccuga

SEQ ID NO: 1310800 - RNA, 17 nt, Homo sapiens
ccaagccagcugccuag

SEQ ID NO: 1310801 - RNA, 19 nt, Homo sapiens
ccaagcugugcccugacca

SEQ ID NO: 1310802 - RNA, 15 nt, Homo sapiens
ccaaggaaaccacag

SEQ ID NO: 1310803 - RNA, 19 nt, Homo sapiens
ccaaggaaacgcuaccucu

SEQ ID NO: 1310804 - RNA, 23 nt, Homo sapiens
ccaaggagggcagaucacuucag

SEQ ID NO: 1310805 - RNA, 19 nt, Homo sapiens
ccaaggagggugagugcaa

SEQ ID NO: 1310806 - RNA, 18 nt, Homo sapiens
ccaaggcagcgaccccag

SEQ ID NO: 1310807 - RNA, 17 nt, Homo sapiens
ccaagggccagacagac

SEQ ID NO: 1310808 - RNA, 15 nt, Homo sapiens
ccaaggggaaucaga

SEQ ID NO: 1310809 - RNA, 22 nt, Homo sapiens
ccaaggugucauuuauguguca

SEQ ID NO: 1310810 - RNA, 22 nt, Homo sapiens
ccaaguucuuucuccaucccuc

SEQ ID NO: 1310811 - RNA, 14 nt, Homo sapiens
ccaaguuuauauac

SEQ ID NO: 1310812 - RNA, 13 nt, Homo sapiens
ccaauaaagccuu

SEQ ID NO: 1310813 - RNA, 17 nt, Homo sapiens
ccaauagacgccaguag

SEQ ID NO: 1310814 - RNA, 17 nt, Homo sapiens
ccaauauuuaccagacc

SEQ ID NO: 1310815 - RNA, 14 nt, Homo sapiens
ccaauuauguuaaa

SEQ ID NO: 1310816 - RNA, 16 nt, Homo sapiens
ccaauuccuugcacau

SEQ ID NO: 1310817 - RNA, 15 nt, Homo sapiens
ccaauuucagacucc

SEQ ID NO: 1310818 - RNA, 17 nt, Homo sapiens
ccaauuucagacuccca

SEQ ID NO: 1310819 - RNA, 22 nt, Homo sapiens
ccacaaacuguaauacaaugau

SEQ ID NO: 1310820 - RNA, 14 nt, Homo sapiens
ccacaccaagcagc

SEQ ID NO: 1310821 - RNA, 22 nt, Homo sapiens
ccacacccuggaggauuucauc

SEQ ID NO: 1310822 - RNA, 12 nt, Homo sapiens
ccacacucagca

SEQ ID NO: 1310823 - RNA, 16 nt, Homo sapiens
ccacagcaaccccagg

SEQ ID NO: 1310824 - RNA, 23 nt, Homo sapiens
ccacaggccgcccugcgggugaa

SEQ ID NO: 1310825 - RNA, 20 nt, Homo sapiens
ccacagggcuuguuuuccaa

SEQ ID NO: 1310826 - RNA, 21 nt, Homo sapiens
ccacauccuccacguucugcu

SEQ ID NO: 1310827 - RNA, 15 nt, Homo sapiens
ccacauugcacuucu

SEQ ID NO: 1310828 - RNA, 16 nt, Homo sapiens
ccaccaccucaccagu

SEQ ID NO: 1310829 - RNA, 23 nt, Homo sapiens
ccaccaggagggaguggcagcua

SEQ ID NO: 1310830 - RNA, 15 nt, Homo sapiens
ccaccaucaccagac

SEQ ID NO: 1310831 - RNA, 17 nt, Homo sapiens
ccaccuccccagccuuu

SEQ ID NO: 1310832 - RNA, 21 nt, Homo sapiens
ccaccucccugccuccaggaa

SEQ ID NO: 1310833 - RNA, 19 nt, Homo sapiens
ccaccugcuggagugaagg

SEQ ID NO: 1310834 - RNA, 20 nt, Homo sapiens
ccaccuguugaucuaagggg

SEQ ID NO: 1310835 - RNA, 15 nt, Homo sapiens
ccacgaggugcaaca

SEQ ID NO: 1310836 - RNA, 16 nt, Homo sapiens
ccacggagcaguucag

SEQ ID NO: 1310837 - RNA, 19 nt, Homo sapiens
cccaccugucaaacaaagc

SEQ ID NO: 1310838 - RNA, 16 nt, Homo sapiens
cccacugcucugguua

SEQ ID NO: 1310839 - RNA, 15 nt, Homo sapiens
cccacuucugccaua

SEQ ID NO: 1310840 - RNA, 22 nt, Homo sapiens
cccagaaagucucucauucuag

SEQ ID NO: 1310841 - RNA, 16 nt, Homo sapiens
cccagacggcuccacu

SEQ ID NO: 1310842 - RNA, 12 nt, Homo sapiens
cccagacugucu

SEQ ID NO: 1310843 - RNA, 18 nt, Homo sapiens
cccagagacauacuugaa

SEQ ID NO: 1310844 - RNA, 19 nt, Homo sapiens
cccagagacauacuugaag

SEQ ID NO: 1310845 - RNA, 15 nt, Homo sapiens
cccagagcacccaga

SEQ ID NO: 1310846 - RNA, 19 nt, Homo sapiens
cccagauuccccuguguca

SEQ ID NO: 1310847 - RNA, 11 nt, Homo sapiens
cccagcacuga

SEQ ID NO: 1310848 - RNA, 13 nt, Homo sapiens
cccagcacuuugg

SEQ ID NO: 1310849 - RNA, 20 nt, Homo sapiens
cccagccaaacccugucuga

SEQ ID NO: 1310850 - RNA, 22 nt, Homo sapiens
cccagccccucucccugugcug

SEQ ID NO: 1310851 - RNA, 18 nt, Homo sapiens
cccagccccuuggaugug

SEQ ID NO: 1310852 - RNA, 15 nt, Homo sapiens
cccagccucccugaa

SEQ ID NO: 1310853 - RNA, 13 nt, Homo sapiens
cccaggaccagcu

SEQ ID NO: 1310854 - RNA, 18 nt, Homo sapiens
cccaggacccugaagggg

SEQ ID NO: 1310855 - RNA, 15 nt, Homo sapiens
cccaggaccuggcug

SEQ ID NO: 1310856 - RNA, 19 nt, Homo sapiens
cccaggcuggcgugcagug

SEQ ID NO: 1310857 - RNA, 19 nt, Homo sapiens
cccaggguggagugcagug

SEQ ID NO: 1310858 - RNA, 15 nt, Homo sapiens
cccagguacauccau

SEQ ID NO: 1310859 - RNA, 12 nt, Homo sapiens
cccaguaaaauu

SEQ ID NO: 1310860 - RNA, 17 nt, Homo sapiens
cccagucuggaugugga

SEQ ID NO: 1310861 - RNA, 16 nt, Homo sapiens
cccauaauaaguuccu

SEQ ID NO: 1310862 - RNA, 12 nt, Homo sapiens
cccauacugguu

SEQ ID NO: 1310863 - RNA, 15 nt, Homo sapiens
cccauagauacucuc

SEQ ID NO: 1310864 - RNA, 16 nt, Homo sapiens
cccauaguucacugac

SEQ ID NO: 1310865 - RNA, 15 nt, Homo sapiens
cccauaucugugaaa

SEQ ID NO: 1310866 - RNA, 23 nt, Homo sapiens
cccauaucugugaaaugcuggca

SEQ ID NO: 1310867 - RNA, 14 nt, Homo sapiens
cccaucauacccuu

SEQ ID NO: 1310868 - RNA, 22 nt, Homo sapiens
cccaucccacacccuggaggau

SEQ ID NO: 1310869 - RNA, 16 nt, Homo sapiens
cccaucuucgggacca

SEQ ID NO: 1310870 - RNA, 15 nt, Homo sapiens
cccauucuacacaga

SEQ ID NO: 1310871 - RNA, 19 nt, Homo sapiens
cccauucuacacagagcag

SEQ ID NO: 1310872 - RNA, 15 nt, Homo sapiens
cccauuucuauuuau

SEQ ID NO: 1310873 - RNA, 20 nt, Homo sapiens
ccccaacaaaccauccagug

SEQ ID NO: 1310874 - RNA, 20 nt, Homo sapiens
ccccaacuacccccagcugu

SEQ ID NO: 1310875 - RNA, 14 nt, Homo sapiens
ccccacagcucuuu

SEQ ID NO: 1310876 - RNA, 22 nt, Homo sapiens
ccccacuggggaaauaacagcu

SEQ ID NO: 1310877 - RNA, 11 nt, Homo sapiens
ccccagcacuu

SEQ ID NO: 1310878 - RNA, 17 nt, Homo sapiens
ccccaugacauugcauu

SEQ ID NO: 1310879 - RNA, 14 nt, Homo sapiens
cccccagcuaagaa

SEQ ID NO: 1310880 - RNA, 23 nt, Homo sapiens
ccccccagcuaauacccagagca

SEQ ID NO: 1310881 - RNA, 13 nt, Homo sapiens
cccccgccaaaag

SEQ ID NO: 1310882 - RNA, 21 nt, Homo sapiens
cccccgugaggaugucacuca

SEQ ID NO: 1310883 - RNA, 23 nt, Homo sapiens
cccccgugaggaugucacucaga

SEQ ID NO: 1310884 - RNA, 15 nt, Homo sapiens
cccccugaguuuccu

SEQ ID NO: 1310885 - RNA, 16 nt, Homo sapiens
cccccuuguuguaaaa

SEQ ID NO: 1310886 - RNA, 22 nt, Homo sapiens
ccccgucacgugcgcugggcac

SEQ ID NO: 1310887 - RNA, 21 nt, Homo sapiens
gacaagaauuguuaccuguca

SEQ ID NO: 1310888 - RNA, 24 nt, Homo sapiens
gacaagagggaauaguauagacaa

SEQ ID NO: 1310889 - RNA, 18 nt, Homo sapiens
gacaaggaaaaaauaaca

SEQ ID NO: 1310890 - RNA, 16 nt, Homo sapiens
gacacaggcccggcuc

SEQ ID NO: 1310891 - RNA, 17 nt, Homo sapiens
gacaccugcagccuuug

SEQ ID NO: 1310892 - RNA, 21 nt, Homo sapiens
gacacucacacggacacucaa

SEQ ID NO: 1310893 - RNA, 22 nt, Homo sapiens
gacacuuaauacuaccuugaaa

SEQ ID NO: 1310894 - RNA, 15 nt, Homo sapiens
gacacuuacccaagg

SEQ ID NO: 1310895 - RNA, 18 nt, Homo sapiens
gacagacaacacugggaa

SEQ ID NO: 1310896 - RNA, 15 nt, Homo sapiens
gacagacccucugcc

SEQ ID NO: 1310897 - RNA, 15 nt, Homo sapiens
gacagagcaagugag

SEQ ID NO: 1310898 - RNA, 15 nt, Homo sapiens
gacagaggaugagcu

SEQ ID NO: 1310899 - RNA, 16 nt, Homo sapiens
gacagagggcucaccu

SEQ ID NO: 1310900 - RNA, 17 nt, Homo sapiens
gacagaugggcauaugu

SEQ ID NO: 1310901 - RNA, 22 nt, Homo sapiens
gacagccagagccugucuuuca

SEQ ID NO: 1310902 - RNA, 16 nt, Homo sapiens
gacagcugugugacau

SEQ ID NO: 1310903 - RNA, 13 nt, Homo sapiens
gacagcuucucau

SEQ ID NO: 1310904 - RNA, 20 nt, Homo sapiens
gacagguggaaaaacugaga

SEQ ID NO: 1310905 - RNA, 14 nt, Homo sapiens
gacagugaacauuc

SEQ ID NO: 1310906 - RNA, 17 nt, Homo sapiens
gacaguggggaaggcau

SEQ ID NO: 1310907 - RNA, 22 nt, Homo sapiens
gacaguuuguggcaucuugcca

SEQ ID NO: 1310908 - RNA, 21 nt, Homo sapiens
gacauaggacucaaaguuuca

SEQ ID NO: 1310909 - RNA, 23 nt, Homo sapiens
gacauauuucaugggaauauuca

SEQ ID NO: 1310910 - RNA, 18 nt, Homo sapiens
gacaugcuucagugcugc

SEQ ID NO: 1310911 - RNA, 14 nt, Homo sapiens
gacauuacagauga

SEQ ID NO: 1310912 - RNA, 13 nt, Homo sapiens
gacauucaugccu

SEQ ID NO: 1310913 - RNA, 13 nt, Homo sapiens
gaccacaacuauu

SEQ ID NO: 1310914 - RNA, 22 nt, Homo sapiens
gaccacaacuauuuucagaugu

SEQ ID NO: 1310915 - RNA, 17 nt, Homo sapiens
gaccacagcacagccaa

SEQ ID NO: 1310916 - RNA, 21 nt, Homo sapiens
gaccacgcuuucuagcuguug

SEQ ID NO: 1310917 - RNA, 11 nt, Homo sapiens
gaccacuuaau

SEQ ID NO: 1310918 - RNA, 17 nt, Homo sapiens
gaccagcccaccccugu

SEQ ID NO: 1310919 - RNA, 17 nt, Homo sapiens
gaccaggauuugcacag

SEQ ID NO: 1310920 - RNA, 20 nt, Homo sapiens
gaccaggcaaagcaagugau

SEQ ID NO: 1310921 - RNA, 17 nt, Homo sapiens
gaccaggccugggccag

SEQ ID NO: 1310922 - RNA, 14 nt, Homo sapiens
gaccauaaccacug

SEQ ID NO: 1310923 - RNA, 14 nt, Homo sapiens
gacccaaguagcug

SEQ ID NO: 1310924 - RNA, 16 nt, Homo sapiens
gacccacgaaacugcc

SEQ ID NO: 1310925 - RNA, 13 nt, Homo sapiens
gacccagcacuga

SEQ ID NO: 1310926 - RNA, 18 nt, Homo sapiens
gacccauugcuguugucc

SEQ ID NO: 1310927 - RNA, 19 nt, Homo sapiens
gaccccagaggauugcugc

SEQ ID NO: 1310928 - RNA, 23 nt, Homo sapiens
gacccccagcacuuggggguuca

SEQ ID NO: 1310929 - RNA, 17 nt, Homo sapiens
gaccccgcccagcauug

SEQ ID NO: 1310930 - RNA, 18 nt, Homo sapiens
gaccccugacucaucauu

SEQ ID NO: 1310931 - RNA, 17 nt, Homo sapiens
gaccuauggcagagcau

SEQ ID NO: 1310932 - RNA, 12 nt, Homo sapiens
gaccucacagua

SEQ ID NO: 1310933 - RNA, 16 nt, Homo sapiens
gaccucaccuagaaau

SEQ ID NO: 1310934 - RNA, 11 nt, Homo sapiens
gaccucaggug

SEQ ID NO: 1310935 - RNA, 22 nt, Homo sapiens
gaccucaggugauccacccacc

SEQ ID NO: 1310936 - RNA, 17 nt, Homo sapiens
gaccucaggugcuaggg

SEQ ID NO: 1310937 - RNA, 22 nt, Homo sapiens
gaccuccaagccacugagcaau

SEQ ID NO: 1310938 - RNA, 17 nt, Homo sapiens
gaccucugagaccaaaa

SEQ ID NO: 1310939 - RNA, 18 nt, Homo sapiens
gaccucugccugaaguca

SEQ ID NO: 1310940 - RNA, 14 nt, Homo sapiens
gaccugauccugga

SEQ ID NO: 1310941 - RNA, 15 nt, Homo sapiens
gaccugauccuggag

SEQ ID NO: 1310942 - RNA, 12 nt, Homo sapiens
gaccuggcacug

SEQ ID NO: 1310943 - RNA, 16 nt, Homo sapiens
gaccugguccacaggg

SEQ ID NO: 1310944 - RNA, 17 nt, Homo sapiens
gaccuggugcugccucu

SEQ ID NO: 1310945 - RNA, 18 nt, Homo sapiens
gaccuuaggccuuccucu

SEQ ID NO: 1310946 - RNA, 19 nt, Homo sapiens
gacgaggggugucuugggc

SEQ ID NO: 1310947 - RNA, 16 nt, Homo sapiens
gacgaguaacuccccu

SEQ ID NO: 1310948 - RNA, 20 nt, Homo sapiens
gacggaggccuacucuucca

SEQ ID NO: 1310949 - RNA, 18 nt, Homo sapiens
gacggcaaccucugagcc

SEQ ID NO: 1310950 - RNA, 23 nt, Homo sapiens
gacgggcaaaauaaagugacaga

SEQ ID NO: 1310951 - RNA, 14 nt, Homo sapiens
gacggucaguccau

SEQ ID NO: 1310952 - RNA, 15 nt, Homo sapiens
gacguagcugcaaag

SEQ ID NO: 1310953 - RNA, 19 nt, Homo sapiens
gacuaauccaauaccucuu

SEQ ID NO: 1310954 - RNA, 14 nt, Homo sapiens
gacuacagcuguua

SEQ ID NO: 1310955 - RNA, 17 nt, Homo sapiens
gacuacaggcacccacc

SEQ ID NO: 1310956 - RNA, 12 nt, Homo sapiens
gacuacaggugu

SEQ ID NO: 1310957 - RNA, 17 nt, Homo sapiens
gacucaaaaauagggaa

SEQ ID NO: 1310958 - RNA, 12 nt, Homo sapiens
gacucaaugcac

SEQ ID NO: 1310959 - RNA, 15 nt, Homo sapiens
gacucaggacauccc

SEQ ID NO: 1310960 - RNA, 12 nt, Homo sapiens
gacuccaucucu

SEQ ID NO: 1310961 - RNA, 23 nt, Homo sapiens
gacucugaccccagcauucucag

SEQ ID NO: 1310962 - RNA, 19 nt, Homo sapiens
gacucuggaagauuuucau

SEQ ID NO: 1310963 - RNA, 19 nt, Homo sapiens
gacucuggguccuuccuga

SEQ ID NO: 1310964 - RNA, 17 nt, Homo sapiens
gacucuuuaugcuugca

SEQ ID NO: 1310965 - RNA, 18 nt, Homo sapiens
gacucuuuaugcuugcaa

SEQ ID NO: 1310966 - RNA, 19 nt, Homo sapiens
gacucuuuaugcuugcaaa

SEQ ID NO: 1310967 - RNA, 20 nt, Homo sapiens
gacucuuucugagugccuuc

SEQ ID NO: 1310968 - RNA, 17 nt, Homo sapiens
gacucuuuggacacuca

SEQ ID NO: 1310969 - RNA, 21 nt, Homo sapiens
gacugaacauuaguugcacua

SEQ ID NO: 1310970 - RNA, 14 nt, Homo sapiens
gacugaagccaaag

SEQ ID NO: 1310971 - RNA, 19 nt, Homo sapiens
gacugcucagaacuugcug

SEQ ID NO: 1310972 - RNA, 16 nt, Homo sapiens
gacuggacugugggcc

SEQ ID NO: 1310973 - RNA, 15 nt, Homo sapiens
gacuggguuacauau

SEQ ID NO: 1310974 - RNA, 16 nt, Homo sapiens
gacuguaaaugcucca

SEQ ID NO: 1310975 - RNA, 22 nt, Homo sapiens
gacuguucaagagcacacuugg

SEQ ID NO: 1310976 - RNA, 21 nt, Homo sapiens
gacuuaacgugcucaugggcu

SEQ ID NO: 1310977 - RNA, 23 nt, Homo sapiens
gacuuauguaaucaaagccacuu

SEQ ID NO: 1310978 - RNA, 18 nt, Homo sapiens
gacuuauuuaaacucugu

SEQ ID NO: 1310979 - RNA, 16 nt, Homo sapiens
gacuucacagugaagu

SEQ ID NO: 1310980 - RNA, 23 nt, Homo sapiens
gacuucacuaaaaugaccaggau

SEQ ID NO: 1310981 - RNA, 21 nt, Homo sapiens
gaaacuuugaggauaacuuuu

SEQ ID NO: 1310982 - RNA, 16 nt, Homo sapiens
gaaagaaaauuuaaua

SEQ ID NO: 1310983 - RNA, 15 nt, Homo sapiens
gaaagacugaagaaa

SEQ ID NO: 1310984 - RNA, 22 nt, Homo sapiens
gaaagcacaggugggcuuccca

SEQ ID NO: 1310985 - RNA, 14 nt, Homo sapiens
gaaaggaacauuuu

SEQ ID NO: 1310986 - RNA, 20 nt, Homo sapiens
gaaaggauugauuugaacuu

SEQ ID NO: 1310987 - RNA, 16 nt, Homo sapiens
gaaaggcauucucuga

SEQ ID NO: 1310988 - RNA, 17 nt, Homo sapiens
gaaaggggauggaguga

SEQ ID NO: 1310989 - RNA, 15 nt, Homo sapiens
gaaagugaccauguu

SEQ ID NO: 1310990 - RNA, 17 nt, Homo sapiens
gaaaguggaaauggaga

SEQ ID NO: 1310991 - RNA, 19 nt, Homo sapiens
gaaauaaaggaugugauug

SEQ ID NO: 1310992 - RNA, 18 nt, Homo sapiens
gaaauaaauucugauucu

SEQ ID NO: 1310993 - RNA, 13 nt, Homo sapiens
gaaauaaccacug

SEQ ID NO: 1310994 - RNA, 21 nt, Homo sapiens
gaaauaguacuuacaaaugac

SEQ ID NO: 1310995 - RNA, 14 nt, Homo sapiens
gaaauauuauagag

SEQ ID NO: 1310996 - RNA, 19 nt, Homo sapiens
gaaaucuggcuucuggcca

SEQ ID NO: 1310997 - RNA, 14 nt, Homo sapiens
gaaaugcagaguca

SEQ ID NO: 1310998 - RNA, 13 nt, Homo sapiens
gaaauuaaccaua

SEQ ID NO: 1310999 - RNA, 21 nt, Homo sapiens
gaaauuacuggaaggcuucca

SEQ ID NO: 1311000 - RNA, 23 nt, Homo sapiens
gaaauuuauuuccuaguucugua

SEQ ID NO: 1311001 - RNA, 23 nt, Homo sapiens
gaacaaaaacaaaacaccaggga

SEQ ID NO: 1311002 - RNA, 13 nt, Homo sapiens
gaacaaaguaaca

SEQ ID NO: 1311003 - RNA, 22 nt, Homo sapiens
gaacaaaguaacagccuuucaa

SEQ ID NO: 1311004 - RNA, 17 nt, Homo sapiens
gaacaagcaaacccaga

SEQ ID NO: 1311005 - RNA, 19 nt, Homo sapiens
gaacacccucuaaauggga

SEQ ID NO: 1311006 - RNA, 17 nt, Homo sapiens
gaacacugaaacuguau

SEQ ID NO: 1311007 - RNA, 11 nt, Homo sapiens
gaacacuguga

SEQ ID NO: 1311008 - RNA, 19 nt, Homo sapiens
gaacagacaaucacagcaa

SEQ ID NO: 1311009 - RNA, 21 nt, Homo sapiens
gaacagcauuacccuccucuc

SEQ ID NO: 1311010 - RNA, 17 nt, Homo sapiens
gaacagccacuccccuc

SEQ ID NO: 1311011 - RNA, 14 nt, Homo sapiens
gaacaguaugaauu

SEQ ID NO: 1311012 - RNA, 16 nt, Homo sapiens
gaacaucaucaaggca

SEQ ID NO: 1311013 - RNA, 21 nt, Homo sapiens
gaacauccuccacugacuucc

SEQ ID NO: 1311014 - RNA, 16 nt, Homo sapiens
gaacauuuuuuaccaa

SEQ ID NO: 1311015 - RNA, 21 nt, Homo sapiens
gaaccaaaucuggaagccaaa

SEQ ID NO: 1311016 - RNA, 21 nt, Homo sapiens
gaaccacaccacaucuaagcc

SEQ ID NO: 1311017 - RNA, 15 nt, Homo sapiens
gaaccaggaggacaa

SEQ ID NO: 1311018 - RNA, 12 nt, Homo sapiens
gaacccugagca

SEQ ID NO: 1311019 - RNA, 13 nt, Homo sapiens
gaaccguuuugaa

SEQ ID NO: 1311020 - RNA, 19 nt, Homo sapiens
gaaccucagccuggccaga

SEQ ID NO: 1311021 - RNA, 17 nt, Homo sapiens
gaaccuccucugugaag

SEQ ID NO: 1311022 - RNA, 15 nt, Homo sapiens
gaaccuggaacuugg

SEQ ID NO: 1311023 - RNA, 21 nt, Homo sapiens
gaaccuucuggccucccacag

SEQ ID NO: 1311024 - RNA, 17 nt, Homo sapiens
gaacgguaaauuucugu

SEQ ID NO: 1311025 - RNA, 15 nt, Homo sapiens
gaacuaagcaucuuu

SEQ ID NO: 1311026 - RNA, 19 nt, Homo sapiens
gaacuccuaaccucaagug

SEQ ID NO: 1311027 - RNA, 12 nt, Homo sapiens
gaacucugagca

SEQ ID NO: 1311028 - RNA, 19 nt, Homo sapiens
gaacucugguggcacagga

SEQ ID NO: 1311029 - RNA, 18 nt, Homo sapiens
gaacugagaccuccagaa

SEQ ID NO: 1311030 - RNA, 17 nt, Homo sapiens
gaacugcacgguacaaa

SEQ ID NO: 1311031 - RNA, 15 nt, Homo sapiens
gaacugcaugcugcu

SEQ ID NO: 1311032 - RNA, 20 nt, Homo sapiens
gaacuggacccuguugcuaa

SEQ ID NO: 1311033 - RNA, 16 nt, Homo sapiens
gaacuggguacuugug

SEQ ID NO: 1311034 - RNA, 17 nt, Homo sapiens
gaacuuaaccuugcaaa

SEQ ID NO: 1311035 - RNA, 14 nt, Homo sapiens
gaacuuugagcuac

SEQ ID NO: 1311036 - RNA, 23 nt, Homo sapiens
gaagaagauaugugaagaaaaau

SEQ ID NO: 1311037 - RNA, 17 nt, Homo sapiens
gaagaaucuguuuccca

SEQ ID NO: 1311038 - RNA, 13 nt, Homo sapiens
gaagacaauguga

SEQ ID NO: 1311039 - RNA, 19 nt, Homo sapiens
gaagacugcccuacuauag

SEQ ID NO: 1311040 - RNA, 14 nt, Homo sapiens
gaagagacacucag

SEQ ID NO: 1311041 - RNA, 21 nt, Homo sapiens
gaagauagccagagagcccau

SEQ ID NO: 1311042 - RNA, 14 nt, Homo sapiens
gaagauaguaacug

SEQ ID NO: 1311043 - RNA, 23 nt, Homo sapiens
gaagaugacgaguaacuccccuc

SEQ ID NO: 1311044 - RNA, 21 nt, Homo sapiens
gaagaugauggcucauuuaca

SEQ ID NO: 1311045 - RNA, 23 nt, Homo sapiens
gaagauuguuggugaauuuucaa

SEQ ID NO: 1311046 - RNA, 17 nt, Homo sapiens
gaagcaaagaagggaau

SEQ ID NO: 1311047 - RNA, 18 nt, Homo sapiens
gaagcaaguuuucuucca

SEQ ID NO: 1311048 - RNA, 18 nt, Homo sapiens
gaagcaggcuacacugac

SEQ ID NO: 1311049 - RNA, 17 nt, Homo sapiens
gaagccugaugcugaca

SEQ ID NO: 1311050 - RNA, 18 nt, Homo sapiens
gaagcggucacagaucac

SEQ ID NO: 1311051 - RNA, 12 nt, Homo sapiens
gaagcugaccuu

SEQ ID NO: 1311052 - RNA, 13 nt, Homo sapiens
gaagcugcuccgu

SEQ ID NO: 1311053 - RNA, 20 nt, Homo sapiens
gaagcuuuggugagaaccug

SEQ ID NO: 1311054 - RNA, 18 nt, Homo sapiens
gaaggaaucauauuccuu

SEQ ID NO: 1311055 - RNA, 18 nt, Homo sapiens
gaaggacccugugcccuc

SEQ ID NO: 1311056 - RNA, 23 nt, Homo sapiens
gaaggaggcuggcuuguccccuc

SEQ ID NO: 1311057 - RNA, 13 nt, Homo sapiens
gaaggaucaucug

SEQ ID NO: 1311058 - RNA, 14 nt, Homo sapiens
gaaggcaaacccau

SEQ ID NO: 1311059 - RNA, 14 nt, Homo sapiens
gaaggcaaugccau

SEQ ID NO: 1311060 - RNA, 18 nt, Homo sapiens
gaaggccgagaagcaaga

SEQ ID NO: 1311061 - RNA, 18 nt, Homo sapiens
gaaggcuaaaaagcaaca

SEQ ID NO: 1311062 - RNA, 19 nt, Homo sapiens
gaagggaauuuauugccuc

SEQ ID NO: 1311063 - RNA, 23 nt, Homo sapiens
gaaguaacaaaagaagugacauc

SEQ ID NO: 1311064 - RNA, 14 nt, Homo sapiens
gaaguaagccucau

SEQ ID NO: 1311065 - RNA, 14 nt, Homo sapiens
gaagucacacagua

SEQ ID NO: 1311066 - RNA, 14 nt, Homo sapiens
gaagugccaucuca

SEQ ID NO: 1311067 - RNA, 19 nt, Homo sapiens
gaagugcuggcaaccacua

SEQ ID NO: 1311068 - RNA, 19 nt, Homo sapiens
gaaguucuagccacagcag

SEQ ID NO: 1311069 - RNA, 20 nt, Homo sapiens
gaaguugcagugagcugaua

SEQ ID NO: 1311070 - RNA, 19 nt, Homo sapiens
gaaguuuuguuuuaguuuu

SEQ ID NO: 1311071 - RNA, 15 nt, Homo sapiens
cugagacagcuuguc

SEQ ID NO: 1311072 - RNA, 22 nt, Homo sapiens
cugagcaaacuauuugcgacuc

SEQ ID NO: 1311073 - RNA, 12 nt, Homo sapiens
cugagcacagau

SEQ ID NO: 1311074 - RNA, 15 nt, Homo sapiens
cugagcaccguguca

SEQ ID NO: 1311075 - RNA, 13 nt, Homo sapiens
cugagccuagcua

SEQ ID NO: 1311076 - RNA, 22 nt, Homo sapiens
cugagcgaagcuauaggcucuu

SEQ ID NO: 1311077 - RNA, 16 nt, Homo sapiens
cugagcugcuucacua

SEQ ID NO: 1311078 - RNA, 13 nt, Homo sapiens
cugagcugugcag

SEQ ID NO: 1311079 - RNA, 22 nt, Homo sapiens
cugagcuuggcguuuggaccca

SEQ ID NO: 1311080 - RNA, 14 nt, Homo sapiens
cugaggcagggaag

SEQ ID NO: 1311081 - RNA, 21 nt, Homo sapiens
cugaggccccucuccaagagg

SEQ ID NO: 1311082 - RNA, 15 nt, Homo sapiens
cugagggagcuccaa

SEQ ID NO: 1311083 - RNA, 17 nt, Homo sapiens
cugaggguguuucuucc

SEQ ID NO: 1311084 - RNA, 15 nt, Homo sapiens
cugagguaaaaacug

SEQ ID NO: 1311085 - RNA, 20 nt, Homo sapiens
cugaggugggaggaucucuu

SEQ ID NO: 1311086 - RNA, 14 nt, Homo sapiens
cugagguuaugaac

SEQ ID NO: 1311087 - RNA, 18 nt, Homo sapiens
cugaguggcaggggacag

SEQ ID NO: 1311088 - RNA, 18 nt, Homo sapiens
cugagugggggaucacag

SEQ ID NO: 1311089 - RNA, 17 nt, Homo sapiens
cugaguguuuaauuuca

SEQ ID NO: 1311090 - RNA, 19 nt, Homo sapiens
cugaguuucuggcucuuga

SEQ ID NO: 1311091 - RNA, 14 nt, Homo sapiens
cugauaaugcucac

SEQ ID NO: 1311092 - RNA, 21 nt, Homo sapiens
cugaucauccacugugccaug

SEQ ID NO: 1311093 - RNA, 17 nt, Homo sapiens
cugaucccagccaagga

SEQ ID NO: 1311094 - RNA, 15 nt, Homo sapiens
cugaugagcacgguu

SEQ ID NO: 1311095 - RNA, 15 nt, Homo sapiens
cugaugcaggauuug

SEQ ID NO: 1311096 - RNA, 14 nt, Homo sapiens
cugaugcagucacg

SEQ ID NO: 1311097 - RNA, 19 nt, Homo sapiens
cugauggagcucagaauuc

SEQ ID NO: 1311098 - RNA, 15 nt, Homo sapiens
cugaugggaaaacug

SEQ ID NO: 1311099 - RNA, 20 nt, Homo sapiens
cugauuaacugaggcaucca

SEQ ID NO: 1311100 - RNA, 19 nt, Homo sapiens
cugauuuagccaugugaaa

SEQ ID NO: 1311101 - RNA, 14 nt, Homo sapiens
cugcaaacgcugcc

SEQ ID NO: 1311102 - RNA, 16 nt, Homo sapiens
cugcaaguaaguauga

SEQ ID NO: 1311103 - RNA, 13 nt, Homo sapiens
cugcacagugaag

SEQ ID NO: 1311104 - RNA, 15 nt, Homo sapiens
cugcaccuguaggau

SEQ ID NO: 1311105 - RNA, 15 nt, Homo sapiens
cugcagaaacagugc

SEQ ID NO: 1311106 - RNA, 12 nt, Homo sapiens
cugcagccagcu

SEQ ID NO: 1311107 - RNA, 23 nt, Homo sapiens
cugcagcccugagaaagcccugu

SEQ ID NO: 1311108 - RNA, 21 nt, Homo sapiens
cugcagcuuauuggcuuaaaa

SEQ ID NO: 1311109 - RNA, 18 nt, Homo sapiens
cugcaggccaggccagcu

SEQ ID NO: 1311110 - RNA, 20 nt, Homo sapiens
cugcaguaugggaucugaua

SEQ ID NO: 1311111 - RNA, 17 nt, Homo sapiens
cugcaguggacaguccc

SEQ ID NO: 1311112 - RNA, 19 nt, Homo sapiens
cugcaguggacagucccca

SEQ ID NO: 1311113 - RNA, 21 nt, Homo sapiens
cugcauaaaauagagugcauu

SEQ ID NO: 1311114 - RNA, 17 nt, Homo sapiens
cugcauccagagauuca

SEQ ID NO: 1311115 - RNA, 14 nt, Homo sapiens
cugcaucccugcuc

SEQ ID NO: 1311116 - RNA, 23 nt, Homo sapiens
cugcaugcugcuggacaguauca

SEQ ID NO: 1311117 - RNA, 15 nt, Homo sapiens
cugcauuuagcugua

SEQ ID NO: 1311118 - RNA, 16 nt, Homo sapiens
cugcauuuagcuguau

SEQ ID NO: 1311119 - RNA, 22 nt, Homo sapiens
cugccaauaaauccugucuuau

SEQ ID NO: 1311120 - RNA, 20 nt, Homo sapiens
cugccagagaagucugguca

SEQ ID NO: 1311121 - RNA, 13 nt, Homo sapiens
cugccauguacua

SEQ ID NO: 1311122 - RNA, 20 nt, Homo sapiens
cugcccaccugucaaacaaa

SEQ ID NO: 1311123 - RNA, 20 nt, Homo sapiens
cugccccaaacaaauaugca

SEQ ID NO: 1311124 - RNA, 23 nt, Homo sapiens
cugccccaucuccccucagcucg

SEQ ID NO: 1311125 - RNA, 16 nt, Homo sapiens
cugcccccaauccaug

SEQ ID NO: 1311126 - RNA, 17 nt, Homo sapiens
cugcccugaacccacug

SEQ ID NO: 1311127 - RNA, 20 nt, Homo sapiens
cugccuccauuucucuggga

SEQ ID NO: 1311128 - RNA, 22 nt, Homo sapiens
cuugagaggguggaauauccaa

SEQ ID NO: 1311129 - RNA, 16 nt, Homo sapiens
cuugauagaaaugcca

SEQ ID NO: 1311130 - RNA, 23 nt, Homo sapiens
cuugaucaacaucuuuucuugcc

SEQ ID NO: 1311131 - RNA, 18 nt, Homo sapiens
cuugaucuguauauacaa

SEQ ID NO: 1311132 - RNA, 15 nt, Homo sapiens
cuugauuuaaucacc

SEQ ID NO: 1311133 - RNA, 22 nt, Homo sapiens
cuugcaaauaccuccucccuaa

SEQ ID NO: 1311134 - RNA, 19 nt, Homo sapiens
cuugcaaccuaccuguuga

SEQ ID NO: 1311135 - RNA, 12 nt, Homo sapiens
cuugccagagau

SEQ ID NO: 1311136 - RNA, 21 nt, Homo sapiens
cuugccagccagaagccucug

SEQ ID NO: 1311137 - RNA, 16 nt, Homo sapiens
cuugcccccauuucac

SEQ ID NO: 1311138 - RNA, 17 nt, Homo sapiens
cuugcucacaucuuggc

SEQ ID NO: 1311139 - RNA, 13 nt, Homo sapiens
cuuggacuugucc

SEQ ID NO: 1311140 - RNA, 20 nt, Homo sapiens
cuuggaggacccagcacuga

SEQ ID NO: 1311141 - RNA, 13 nt, Homo sapiens
cuuggaugugaug

SEQ ID NO: 1311142 - RNA, 16 nt, Homo sapiens
cuuggauucucuaacc

SEQ ID NO: 1311143 - RNA, 16 nt, Homo sapiens
cuuggcaccagacacc

SEQ ID NO: 1311144 - RNA, 20 nt, Homo sapiens
cuuggcacccaagaccucag

SEQ ID NO: 1311145 - RNA, 22 nt, Homo sapiens
cuuggccggauguccucagggc

SEQ ID NO: 1311146 - RNA, 13 nt, Homo sapiens
cuuggcucugaga

SEQ ID NO: 1311147 - RNA, 15 nt, Homo sapiens
cuuggcugugcccuc

SEQ ID NO: 1311148 - RNA, 15 nt, Homo sapiens
cuugggggugugaug

SEQ ID NO: 1311149 - RNA, 16 nt, Homo sapiens
cuuggguucacagugc

SEQ ID NO: 1311150 - RNA, 23 nt, Homo sapiens
cuugguaauuguacuaaagccaa

SEQ ID NO: 1311151 - RNA, 14 nt, Homo sapiens
cuuguaaaugugac

SEQ ID NO: 1311152 - RNA, 16 nt, Homo sapiens
cuuguacuacacagaa

SEQ ID NO: 1311153 - RNA, 13 nt, Homo sapiens
cuuguaggaucua

SEQ ID NO: 1311154 - RNA, 23 nt, Homo sapiens
cuugucccacucaagccaagcag

SEQ ID NO: 1311155 - RNA, 15 nt, Homo sapiens
cuugugagaaaagaa

SEQ ID NO: 1311156 - RNA, 23 nt, Homo sapiens
cuuguggauggaaauguagugcu

SEQ ID NO: 1311157 - RNA, 15 nt, Homo sapiens
cuuguguuaugaagc

SEQ ID NO: 1311158 - RNA, 15 nt, Homo sapiens
cuuguuacccaugaa

SEQ ID NO: 1311159 - RNA, 21 nt, Homo sapiens
cuuguuauuuaacccauuugu

SEQ ID NO: 1311160 - RNA, 16 nt, Homo sapiens
cuuguuccccacugac

SEQ ID NO: 1311161 - RNA, 15 nt, Homo sapiens
cuuuaaagugacuaa

SEQ ID NO: 1311162 - RNA, 14 nt, Homo sapiens
cuuuaagccugcau

SEQ ID NO: 1311163 - RNA, 19 nt, Homo sapiens
cuuuaauggcccccaaaau

SEQ ID NO: 1311164 - RNA, 16 nt, Homo sapiens
cuuuacauggaugcca

SEQ ID NO: 1311165 - RNA, 23 nt, Homo sapiens
cuuuacgaggagucucacugggc

SEQ ID NO: 1311166 - RNA, 13 nt, Homo sapiens
cuuuacuccucac

SEQ ID NO: 1311167 - RNA, 23 nt, Homo sapiens
cuuuacuguaaaggcaagccagc

SEQ ID NO: 1311168 - RNA, 21 nt, Homo sapiens
cuuuagaaagcugacauugcc

SEQ ID NO: 1311169 - RNA, 14 nt, Homo sapiens
cuuuaggcuuucag

SEQ ID NO: 1311170 - RNA, 13 nt, Homo sapiens
cuuuagucugcaa

SEQ ID NO: 1311171 - RNA, 17 nt, Homo sapiens
cuuuaucaccucauucu

SEQ ID NO: 1311172 - RNA, 18 nt, Homo sapiens
cuuuaugcugaaacagaa

SEQ ID NO: 1311173 - RNA, 15 nt, Homo sapiens
cuuuauuauggaaaa

SEQ ID NO: 1311174 - RNA, 23 nt, Homo sapiens
cuuuauuuuuuucuguguacugu

SEQ ID NO: 1311175 - RNA, 14 nt, Homo sapiens
cuuucaaacauguu

SEQ ID NO: 1311176 - RNA, 19 nt, Homo sapiens
cuuucaccacaugugcaca

SEQ ID NO: 1311177 - RNA, 15 nt, Homo sapiens
cuuucagacuugcca

SEQ ID NO: 1311178 - RNA, 18 nt, Homo sapiens
cuuucaugaguuuuuccc

SEQ ID NO: 1311179 - RNA, 13 nt, Homo sapiens
cuuucaugugugc

SEQ ID NO: 1311180 - RNA, 14 nt, Homo sapiens
cuuuccacauucag

SEQ ID NO: 1311181 - RNA, 19 nt, Homo sapiens
cuuuccaugggaccacaac

SEQ ID NO: 1311182 - RNA, 22 nt, Homo sapiens
cuuucccccacacccagaucac

SEQ ID NO: 1311183 - RNA, 14 nt, Homo sapiens
cuuucuacccagcg

SEQ ID NO: 1311184 - RNA, 17 nt, Homo sapiens
cuuucucuuaacagcug

SEQ ID NO: 1311185 - RNA, 23 nt, Homo sapiens
cuuucugauaacuagauggugcu

SEQ ID NO: 1311186 - RNA, 18 nt, Homo sapiens
cuuucuuauccuagcaca

SEQ ID NO: 1311187 - RNA, 19 nt, Homo sapiens
cuuucuucauuaagauuuu

SEQ ID NO: 1311188 - RNA, 22 nt, Homo sapiens
cuuucuuuagaauuuuuaccca

SEQ ID NO: 1311189 - RNA, 22 nt, Homo sapiens
cuuucuuuuuuaaaaauggaaa

SEQ ID NO: 1311190 - RNA, 23 nt, Homo sapiens
cuuugaagauaguaacuguagau

SEQ ID NO: 1311191 - RNA, 14 nt, Homo sapiens
cuuugaaugugagg

SEQ ID NO: 1311192 - RNA, 18 nt, Homo sapiens
cuuugaccccagcagcuu

SEQ ID NO: 1311193 - RNA, 16 nt, Homo sapiens
cuuugagugacugggu

SEQ ID NO: 1311194 - RNA, 13 nt, Homo sapiens
cuuugcaaagacc

SEQ ID NO: 1311195 - RNA, 21 nt, Homo sapiens
cuuugccuccagaagcacugg

SEQ ID NO: 1311196 - RNA, 20 nt, Homo sapiens
cuuugcugcagaacugaaga

SEQ ID NO: 1311197 - RNA, 11 nt, Homo sapiens
cuuugcugcug

SEQ ID NO: 1311198 - RNA, 15 nt, Homo sapiens
cuuuggaacuuuaau

SEQ ID NO: 1311199 - RNA, 16 nt, Homo sapiens
cuuuggagaucaagga

SEQ ID NO: 1311200 - RNA, 14 nt, Homo sapiens
cuuuggagcacugu

SEQ ID NO: 1311201 - RNA, 22 nt, Homo sapiens
cuuuggcaaauaaaccuccuaa

SEQ ID NO: 1311202 - RNA, 13 nt, Homo sapiens
cuuuguacacgaa

SEQ ID NO: 1311203 - RNA, 15 nt, Homo sapiens
cuuuguacuuugugc

SEQ ID NO: 1311204 - RNA, 12 nt, Homo sapiens
cuuugucugucg

SEQ ID NO: 1311205 - RNA, 13 nt, Homo sapiens
cuuuuaagacaaa

SEQ ID NO: 1311206 - RNA, 18 nt, Homo sapiens
cuuuuacaacugccucga

SEQ ID NO: 1311207 - RNA, 16 nt, Homo sapiens
cuuuuacauacugcug

SEQ ID NO: 1311208 - RNA, 17 nt, Homo sapiens
cuuuuagaaauacugca

SEQ ID NO: 1311209 - RNA, 21 nt, Homo sapiens
cuuuuagaaauacugcaagaa

SEQ ID NO: 1311210 - RNA, 13 nt, Homo sapiens
cuuuucaccuuua

SEQ ID NO: 1311211 - RNA, 19 nt, Homo sapiens
cuuuucucagcuggaugau

SEQ ID NO: 1311212 - RNA, 17 nt, Homo sapiens
cuuuugacaaaggcaag

SEQ ID NO: 1311213 - RNA, 19 nt, Homo sapiens
cuuuugcacaucuagugag

SEQ ID NO: 1311214 - RNA, 18 nt, Homo sapiens
uaauuuuaguuauacucc

SEQ ID NO: 1311215 - RNA, 14 nt, Homo sapiens
uaauuuuuacaugg

SEQ ID NO: 1311216 - RNA, 15 nt, Homo sapiens
uaauuuuuacaugga

SEQ ID NO: 1311217 - RNA, 19 nt, Homo sapiens
uaauuuuuugcacacuguu

SEQ ID NO: 1311218 - RNA, 20 nt, Homo sapiens
uacaaaaccacuggaaaguu

SEQ ID NO: 1311219 - RNA, 18 nt, Homo sapiens
uacaaaacuacaugagaa

SEQ ID NO: 1311220 - RNA, 22 nt, Homo sapiens
uacaaagcccuuguccccauga

SEQ ID NO: 1311221 - RNA, 16 nt, Homo sapiens
uacaaagguuccauuc

SEQ ID NO: 1311222 - RNA, 15 nt, Homo sapiens
uacaaaugcauuucu

SEQ ID NO: 1311223 - RNA, 17 nt, Homo sapiens
uacaacagugcauuuac

SEQ ID NO: 1311224 - RNA, 18 nt, Homo sapiens
uacaacagugcauuuaca

SEQ ID NO: 1311225 - RNA, 21 nt, Homo sapiens
uacaaccaauggaaugugaug

SEQ ID NO: 1311226 - RNA, 15 nt, Homo sapiens
uacaagguuauguag

SEQ ID NO: 1311227 - RNA, 18 nt, Homo sapiens
uacaagguuauguagaga

SEQ ID NO: 1311228 - RNA, 19 nt, Homo sapiens
uacaaucagccacauucua

SEQ ID NO: 1311229 - RNA, 20 nt, Homo sapiens
uacaaucagccacauucuag

SEQ ID NO: 1311230 - RNA, 17 nt, Homo sapiens
uacaauugaaaugacua

SEQ ID NO: 1311231 - RNA, 13 nt, Homo sapiens
uacaauugugagc

SEQ ID NO: 1311232 - RNA, 11 nt, Homo sapiens
uacacagagaa

SEQ ID NO: 1311233 - RNA, 20 nt, Homo sapiens
uacacgaagaccauccaucc

SEQ ID NO: 1311234 - RNA, 16 nt, Homo sapiens
uacagaaaagucauau

SEQ ID NO: 1311235 - RNA, 14 nt, Homo sapiens
uacagaacucuuaa

SEQ ID NO: 1311236 - RNA, 14 nt, Homo sapiens
uacagaagugaaag

SEQ ID NO: 1311237 - RNA, 12 nt, Homo sapiens
uacagccuuccg

SEQ ID NO: 1311238 - RNA, 21 nt, Homo sapiens
uacagcuggguggcacugcca

SEQ ID NO: 1311239 - RNA, 19 nt, Homo sapiens
uacagcuuaaaguaugcua

SEQ ID NO: 1311240 - RNA, 15 nt, Homo sapiens
uacaggauauuccaa

SEQ ID NO: 1311241 - RNA, 21 nt, Homo sapiens
uacaggugauucguuggaaaa

SEQ ID NO: 1311242 - RNA, 13 nt, Homo sapiens
uacaggugugaac

SEQ ID NO: 1311243 - RNA, 16 nt, Homo sapiens
uacaggugugagucac

SEQ ID NO: 1311244 - RNA, 17 nt, Homo sapiens
uacaggugugagucacc

SEQ ID NO: 1311245 - RNA, 21 nt, Homo sapiens
uacaguaaaguauagaaauau

SEQ ID NO: 1311246 - RNA, 16 nt, Homo sapiens
uacauacacuguaugu

SEQ ID NO: 1311247 - RNA, 17 nt, Homo sapiens
uacauagccaccuguca

SEQ ID NO: 1311248 - RNA, 19 nt, Homo sapiens
uacaucauuuuaacagcug

SEQ ID NO: 1311249 - RNA, 13 nt, Homo sapiens
uacauccaaagca

SEQ ID NO: 1311250 - RNA, 11 nt, Homo sapiens
uacaugcaucu

SEQ ID NO: 1311251 - RNA, 19 nt, Homo sapiens
uacauuuuaguuacugaag

SEQ ID NO: 1311252 - RNA, 20 nt, Homo sapiens
uaccacaugccaagcacugu

SEQ ID NO: 1311253 - RNA, 17 nt, Homo sapiens
uaccaguauaagcaucu

SEQ ID NO: 1311254 - RNA, 21 nt, Homo sapiens
uaccaguauaauugaguuuuc

SEQ ID NO: 1311255 - RNA, 13 nt, Homo sapiens
uaccagugaauuu

SEQ ID NO: 1311256 - RNA, 14 nt, Homo sapiens
uacccaacucugua

SEQ ID NO: 1311257 - RNA, 15 nt, Homo sapiens
uacccagggccugca

SEQ ID NO: 1311258 - RNA, 20 nt, Homo sapiens
uacccaggguggagugcagu

SEQ ID NO: 1311259 - RNA, 13 nt, Homo sapiens
uacccaugaccug

SEQ ID NO: 1311260 - RNA, 22 nt, Homo sapiens
uacccauuuuuuaaaaaagcaa

SEQ ID NO: 1311261 - RNA, 20 nt, Homo sapiens
uacccccugaaagugacaga

SEQ ID NO: 1311262 - RNA, 14 nt, Homo sapiens
uacccuuucauuca

SEQ ID NO: 1311263 - RNA, 15 nt, Homo sapiens
uaccgagagccaaac

SEQ ID NO: 1311264 - RNA, 21 nt, Homo sapiens
uaccgagccccugaacugcug

SEQ ID NO: 1311265 - RNA, 13 nt, Homo sapiens
uaccuauuugacu

SEQ ID NO: 1311266 - RNA, 13 nt, Homo sapiens
uaccucaaccaau

SEQ ID NO: 1311267 - RNA, 21 nt, Homo sapiens
uaccucaaccaaugccaaaaa

SEQ ID NO: 1311268 - RNA, 19 nt, Homo sapiens
uaccucacagagugcauug

SEQ ID NO: 1311269 - RNA, 14 nt, Homo sapiens
uaccucagcauuua

SEQ ID NO: 1311270 - RNA, 20 nt, Homo sapiens
uaccuccuccucuggacaaa

SEQ ID NO: 1311271 - RNA, 17 nt, Homo sapiens
uaccuccugucucuggc

SEQ ID NO: 1311272 - RNA, 18 nt, Homo sapiens
uaccuccugucuuuacaa

SEQ ID NO: 1311273 - RNA, 17 nt, Homo sapiens
uaccucugauaccucaa

SEQ ID NO: 1311274 - RNA, 14 nt, Homo sapiens
uaccugacacuccc

SEQ ID NO: 1311275 - RNA, 21 nt, Homo sapiens
uaccugcccccaauccaugaa

SEQ ID NO: 1311276 - RNA, 17 nt, Homo sapiens
uaccugucauuuugcac

SEQ ID NO: 1311277 - RNA, 23 nt, Homo sapiens
uaccugucauuuugcacuguaaa

SEQ ID NO: 1311278 - RNA, 19 nt, Homo sapiens
uaccuucuggcugugcuac

SEQ ID NO: 1311279 - RNA, 15 nt, Homo sapiens
uaccuuguauaucau

SEQ ID NO: 1311280 - RNA, 13 nt, Homo sapiens
uacgccaggggaa

SEQ ID NO: 1311281 - RNA, 15 nt, Homo sapiens
uacgcugcucucaua

SEQ ID NO: 1311282 - RNA, 14 nt, Homo sapiens
uacguccuuuggac

SEQ ID NO: 1311283 - RNA, 13 nt, Homo sapiens
uacuaaagccaaa

SEQ ID NO: 1311284 - RNA, 19 nt, Homo sapiens
uacuaacauuuucauugau

SEQ ID NO: 1311285 - RNA, 24 nt, Homo sapiens
uacuaacauuuucauugaugagca

SEQ ID NO: 1311286 - RNA, 21 nt, Homo sapiens
uacuagcaucuuagugccuuu

SEQ ID NO: 1311287 - RNA, 16 nt, Homo sapiens
uacuagggagccauuu

SEQ ID NO: 1311288 - RNA, 22 nt, Homo sapiens
uacuaguuuuaguuuucucuua

SEQ ID NO: 1311289 - RNA, 13 nt, Homo sapiens
uacuauaaaagcu

SEQ ID NO: 1311290 - RNA, 19 nt, Homo sapiens
uacuauauuuauacuguau

SEQ ID NO: 1311291 - RNA, 15 nt, Homo sapiens
uacuauugcauuuua

SEQ ID NO: 1311292 - RNA, 20 nt, Homo sapiens
uacucagcauuugauuaaca

SEQ ID NO: 1311293 - RNA, 22 nt, Homo sapiens
uacuccacacauaaaaacuuag

SEQ ID NO: 1311294 - RNA, 15 nt, Homo sapiens
uacuccucggggaac

SEQ ID NO: 1311295 - RNA, 19 nt, Homo sapiens
uacucgggaggcugagaca

SEQ ID NO: 1311296 - RNA, 23 nt, Homo sapiens
uacucgggaggcugagacaggag

SEQ ID NO: 1311297 - RNA, 22 nt, Homo sapiens
uacucugaagggcaucaugcau

SEQ ID NO: 1311298 - RNA, 23 nt, Homo sapiens
uacucugcccucuagagccuuca

SEQ ID NO: 1311299 - RNA, 15 nt, Homo sapiens
uacucuuacauguau

SEQ ID NO: 1311300 - RNA, 21 nt, Homo sapiens
uacucuuagauggauucucca

SEQ ID NO: 1311301 - RNA, 19 nt, Homo sapiens
uacugcugagauacauaca

SEQ ID NO: 1311302 - RNA, 12 nt, Homo sapiens
uacugcuguaau

SEQ ID NO: 1311303 - RNA, 21 nt, Homo sapiens
uacugcuguuguugaaauuga

SEQ ID NO: 1311304 - RNA, 12 nt, Homo sapiens
uacuguauauau

SEQ ID NO: 1311305 - RNA, 16 nt, Homo sapiens
uacuuacugaacugug

SEQ ID NO: 1311306 - RNA, 16 nt, Homo sapiens
uacuucaagaucugaa

SEQ ID NO: 1311307 - RNA, 16 nt, Homo sapiens
uacuucauggugauag

SEQ ID NO: 1311308 - RNA, 18 nt, Homo sapiens
uacuugcuccauuuacaa

SEQ ID NO: 1311309 - RNA, 14 nt, Homo sapiens
uacuuguggacaca

SEQ ID NO: 1311310 - RNA, 17 nt, Homo sapiens
uacuuguggacacagcu

SEQ ID NO: 1311311 - RNA, 21 nt, Homo sapiens
uacuuugaagucauaccaaug

SEQ ID NO: 1311312 - RNA, 18 nt, Homo sapiens
uacuuuguaaauaggauu

SEQ ID NO: 1311313 - RNA, 12 nt, Homo sapiens
uagaaaaaccac

SEQ ID NO: 1311314 - RNA, 16 nt, Homo sapiens
uagaaaagcacuugaa

SEQ ID NO: 1311315 - RNA, 20 nt, Homo sapiens
uagaaaauaaaacugagcua

SEQ ID NO: 1311316 - RNA, 13 nt, Homo sapiens
uagaaagcauuug

SEQ ID NO: 1311317 - RNA, 20 nt, Homo sapiens
uagaaagcauuugaaugcau

SEQ ID NO: 1311318 - RNA, 13 nt, Homo sapiens
uagaaaggccuuu

SEQ ID NO: 1311319 - RNA, 14 nt, Homo sapiens
uagaaauuccccac

SEQ ID NO: 1311320 - RNA, 19 nt, Homo sapiens
uagaacuucauggaucaga

SEQ ID NO: 1311321 - RNA, 17 nt, Homo sapiens
uagaagugccaucucaa

SEQ ID NO: 1311322 - RNA, 23 nt, Homo sapiens
uagaaguugaaacucacuaguaa

SEQ ID NO: 1311323 - RNA, 20 nt, Homo sapiens
uagaauaaucuugcucacag

SEQ ID NO: 1311324 - RNA, 20 nt, Homo sapiens
uagaauauuuauuaccucug

SEQ ID NO: 1311325 - RNA, 17 nt, Homo sapiens
uagaaucugaguauaaa

SEQ ID NO: 1311326 - RNA, 16 nt, Homo sapiens
uagaaugaaccacugc

SEQ ID NO: 1311327 - RNA, 15 nt, Homo sapiens
uagaaugcaucucau

SEQ ID NO: 1311328 - RNA, 13 nt, Homo sapiens
uagacaauuugca

SEQ ID NO: 1311329 - RNA, 15 nt, Homo sapiens
uagacaauuugcaca

SEQ ID NO: 1311330 - RNA, 21 nt, Homo sapiens
uagacucggggugcuuccuug

SEQ ID NO: 1311331 - RNA, 15 nt, Homo sapiens
uagacuggcugaaaa

SEQ ID NO: 1311332 - RNA, 19 nt, Homo sapiens
uagacuuucuuaucacuua

SEQ ID NO: 1311333 - RNA, 20 nt, Homo sapiens
uagagacgguguuuugccau

SEQ ID NO: 1311334 - RNA, 15 nt, Homo sapiens
uagagaguuaugaac

SEQ ID NO: 1311335 - RNA, 12 nt, Homo sapiens
uagagcacugcc

SEQ ID NO: 1311336 - RNA, 14 nt, Homo sapiens
uagagcacugccac

SEQ ID NO: 1311337 - RNA, 16 nt, Homo sapiens
uagagcuuagcauauc

SEQ ID NO: 1311338 - RNA, 16 nt, Homo sapiens
uagaggaccagugagu

SEQ ID NO: 1311339 - RNA, 21 nt, Homo sapiens
uagaggggccccugauccuca

SEQ ID NO: 1311340 - RNA, 18 nt, Homo sapiens
aaaaauucuugcauauau

SEQ ID NO: 1311341 - RNA, 23 nt, Homo sapiens
aaaaauugcucuuggcugugaaa

SEQ ID NO: 1311342 - RNA, 12 nt, Homo sapiens
aaaaauugucau

SEQ ID NO: 1311343 - RNA, 13 nt, Homo sapiens
aaaaauugucauu

SEQ ID NO: 1311344 - RNA, 21 nt, Homo sapiens
aaaaauuuugugacauuccuu

SEQ ID NO: 1311345 - RNA, 16 nt, Homo sapiens
aaaacaagcauucaca

SEQ ID NO: 1311346 - RNA, 19 nt, Homo sapiens
aaaacaccuuguacuuuau

SEQ ID NO: 1311347 - RNA, 13 nt, Homo sapiens
aaaacacugugca

SEQ ID NO: 1311348 - RNA, 18 nt, Homo sapiens
aaaacagaggcacuuaau

SEQ ID NO: 1311349 - RNA, 17 nt, Homo sapiens
aaaacaucgucuaaacu

SEQ ID NO: 1311350 - RNA, 11 nt, Homo sapiens
aaaacauguau

SEQ ID NO: 1311351 - RNA, 16 nt, Homo sapiens
aaaacauguaugugca

SEQ ID NO: 1311352 - RNA, 13 nt, Homo sapiens
aaaacauuuuacu

SEQ ID NO: 1311353 - RNA, 20 nt, Homo sapiens
aaaaccacuggaaaguuuau

SEQ ID NO: 1311354 - RNA, 22 nt, Homo sapiens
aaaaccagaacaguaugaauuu

SEQ ID NO: 1311355 - RNA, 19 nt, Homo sapiens
aaaacccugcaccucuuug

SEQ ID NO: 1311356 - RNA, 19 nt, Homo sapiens
aaaacuacaaccaauggaa

SEQ ID NO: 1311357 - RNA, 17 nt, Homo sapiens
aaaacuugcugccugaa

SEQ ID NO: 1311358 - RNA, 23 nt, Homo sapiens
aaaacuuuucuaauacucuaccc

SEQ ID NO: 1311359 - RNA, 16 nt, Homo sapiens
aaaagaaaccacuucu

SEQ ID NO: 1311360 - RNA, 16 nt, Homo sapiens
aaaagaacaugcaguu

SEQ ID NO: 1311361 - RNA, 21 nt, Homo sapiens
aaaagacuucccuaacacuua

SEQ ID NO: 1311362 - RNA, 16 nt, Homo sapiens
aaaagcaacaggccau

SEQ ID NO: 1311363 - RNA, 21 nt, Homo sapiens
aaaagcaacaggccauuguga

SEQ ID NO: 1311364 - RNA, 12 nt, Homo sapiens
aaaagccaaaaa

SEQ ID NO: 1311365 - RNA, 21 nt, Homo sapiens
aaaagcccacaccuaacauua

SEQ ID NO: 1311366 - RNA, 14 nt, Homo sapiens
aaaagccuaccuaa

SEQ ID NO: 1311367 - RNA, 21 nt, Homo sapiens
aaaagcuuucugccaccccua

SEQ ID NO: 1311368 - RNA, 23 nt, Homo sapiens
aaaaggaucguuuuuuuuugcuu

SEQ ID NO: 1311369 - RNA, 14 nt, Homo sapiens
aaaagucaguauca

SEQ ID NO: 1311370 - RNA, 22 nt, Homo sapiens
aaaaguggcauuuccuggucag

SEQ ID NO: 1311371 - RNA, 19 nt, Homo sapiens
aaaaguucuuuuugcucua

SEQ ID NO: 1311372 - RNA, 12 nt, Homo sapiens
aaaauaaagcug

SEQ ID NO: 1311373 - RNA, 23 nt, Homo sapiens
aaaauaaccggauauauacauag

SEQ ID NO: 1311374 - RNA, 17 nt, Homo sapiens
aaaauacaugcaucuca

SEQ ID NO: 1311375 - RNA, 13 nt, Homo sapiens
aaaauacauuuau

SEQ ID NO: 1311376 - RNA, 17 nt, Homo sapiens
aaaauagaaaagcacuu

SEQ ID NO: 1311377 - RNA, 22 nt, Homo sapiens
aaaauagggaaguaacaguaac

SEQ ID NO: 1311378 - RNA, 21 nt, Homo sapiens
aaaauaguauuuuauuucuca

SEQ ID NO: 1311379 - RNA, 14 nt, Homo sapiens
aaaauauagcugua

SEQ ID NO: 1311380 - RNA, 19 nt, Homo sapiens
aaaauauguauuuaccaaa

SEQ ID NO: 1311381 - RNA, 19 nt, Homo sapiens
aaaaucagccugcuccagc

SEQ ID NO: 1311382 - RNA, 19 nt, Homo sapiens
aaaaucaugccauugcacu

SEQ ID NO: 1311383 - RNA, 16 nt, Homo sapiens
aaaauccuacuuucau

SEQ ID NO: 1311384 - RNA, 12 nt, Homo sapiens
aaaaucuagagg

SEQ ID NO: 1311385 - RNA, 21 nt, Homo sapiens
aaaaugaagaaaagagucuau

SEQ ID NO: 1311386 - RNA, 22 nt, Homo sapiens
aaaaugcagcagggaugcccug

SEQ ID NO: 1311387 - RNA, 19 nt, Homo sapiens
aaaauggagguggaaagac

SEQ ID NO: 1311388 - RNA, 21 nt, Homo sapiens
aaaauguaaugcaacuaccca

SEQ ID NO: 1311389 - RNA, 19 nt, Homo sapiens
aaaaugucauuguucuccc

SEQ ID NO: 1311390 - RNA, 11 nt, Homo sapiens
aaaauguucuc

SEQ ID NO: 1311391 - RNA, 12 nt, Homo sapiens
aaaauguucucu

SEQ ID NO: 1311392 - RNA, 19 nt, Homo sapiens
aaaauguuuugauggucuu

SEQ ID NO: 1311393 - RNA, 23 nt, Homo sapiens
aaaauuaaaaacuuaaguaccaa

SEQ ID NO: 1311394 - RNA, 16 nt, Homo sapiens
aaaauuaaaauggaug

SEQ ID NO: 1311395 - RNA, 17 nt, Homo sapiens
aaaauucaagcauuuag

SEQ ID NO: 1311396 - RNA, 14 nt, Homo sapiens
aaaauuugcugcca

SEQ ID NO: 1311397 - RNA, 19 nt, Homo sapiens
aaacaaaaaaugugcuguu

SEQ ID NO: 1311398 - RNA, 13 nt, Homo sapiens
aaacaaagccaga

SEQ ID NO: 1311399 - RNA, 12 nt, Homo sapiens
aaacaacagcuu

SEQ ID NO: 1311400 - RNA, 12 nt, Homo sapiens
aaacaacucuuu

SEQ ID NO: 1311401 - RNA, 15 nt, Homo sapiens
aaacaaugaaauauu

SEQ ID NO: 1311402 - RNA, 13 nt, Homo sapiens
aaacaauuuaaac

SEQ ID NO: 1311403 - RNA, 16 nt, Homo sapiens
aaacacagacauucug

SEQ ID NO: 1311404 - RNA, 22 nt, Homo sapiens
aaacaccguguuuucugacaca

SEQ ID NO: 1311405 - RNA, 23 nt, Homo sapiens
aaacaccguguuuucugacacag

SEQ ID NO: 1311406 - RNA, 23 nt, Homo sapiens
aaacacgccugcaaacgcugccu

SEQ ID NO: 1311407 - RNA, 19 nt, Homo sapiens
aaacacucaacaaacuuag

SEQ ID NO: 1311408 - RNA, 14 nt, Homo sapiens
aaacagaagccuga

SEQ ID NO: 1311409 - RNA, 15 nt, Homo sapiens
aaacagauaucuuca

SEQ ID NO: 1311410 - RNA, 20 nt, Homo sapiens
aaacagugcaaggaagggca

SEQ ID NO: 1311411 - RNA, 17 nt, Homo sapiens
aaacauaccaacauguu

SEQ ID NO: 1311412 - RNA, 14 nt, Homo sapiens
uuugucucauccca

SEQ ID NO: 1311413 - RNA, 15 nt, Homo sapiens
uuugugccaaccuau

SEQ ID NO: 1311414 - RNA, 22 nt, Homo sapiens
uuugugggaucagggcauugcc

SEQ ID NO: 1311415 - RNA, 15 nt, Homo sapiens
uuuguucaacaucua

SEQ ID NO: 1311416 - RNA, 23 nt, Homo sapiens
uuuguuccccuccuccacucucc

SEQ ID NO: 1311417 - RNA, 24 nt, Homo sapiens
uuuuaaaaaaauaaaacaguaucu

SEQ ID NO: 1311418 - RNA, 18 nt, Homo sapiens
uuuuaaaagucucacaaa

SEQ ID NO: 1311419 - RNA, 15 nt, Homo sapiens
uuuuaacaauuccca

SEQ ID NO: 1311420 - RNA, 20 nt, Homo sapiens
uuuuaaccugccaacauacu

SEQ ID NO: 1311421 - RNA, 16 nt, Homo sapiens
uuuuacauacugcugu

SEQ ID NO: 1311422 - RNA, 12 nt, Homo sapiens
uuuuacauuucu

SEQ ID NO: 1311423 - RNA, 19 nt, Homo sapiens
uuuuauaaaaaugagugcu

SEQ ID NO: 1311424 - RNA, 22 nt, Homo sapiens
uuuuauugcuucuuuuuggaga

SEQ ID NO: 1311425 - RNA, 13 nt, Homo sapiens
uuuucacagauug

SEQ ID NO: 1311426 - RNA, 21 nt, Homo sapiens
uuuucacucccauaccuuuaa

SEQ ID NO: 1311427 - RNA, 17 nt, Homo sapiens
uuuuccaacuuggcugc

SEQ ID NO: 1311428 - RNA, 19 nt, Homo sapiens
uuuuccagcuccucaucca

SEQ ID NO: 1311429 - RNA, 22 nt, Homo sapiens
uuuucccaacuccucaugucuu

SEQ ID NO: 1311430 - RNA, 16 nt, Homo sapiens
uuuuccuaugcuauug

SEQ ID NO: 1311431 - RNA, 13 nt, Homo sapiens
uuuuccuucucau

SEQ ID NO: 1311432 - RNA, 20 nt, Homo sapiens
uuuucgaauacgucagauug

SEQ ID NO: 1311433 - RNA, 21 nt, Homo sapiens
uuuucuaagaaagaaauugua

SEQ ID NO: 1311434 - RNA, 20 nt, Homo sapiens
uuuucucggagcauauaugu

SEQ ID NO: 1311435 - RNA, 17 nt, Homo sapiens
uuuucuuauugcgcugc

SEQ ID NO: 1311436 - RNA, 16 nt, Homo sapiens
uuuugaagacaucaaa

SEQ ID NO: 1311437 - RNA, 13 nt, Homo sapiens
uuuugagaacaaa

SEQ ID NO: 1311438 - RNA, 17 nt, Homo sapiens
uuuugccauuagccaag

SEQ ID NO: 1311439 - RNA, 19 nt, Homo sapiens
uuuugucuaugggacucaa

SEQ ID NO: 1311440 - RNA, 12 nt, Homo sapiens
uuuuguguccuc

SEQ ID NO: 1311441 - RNA, 15 nt, Homo sapiens
uuuugugugugucua

SEQ ID NO: 1311442 - RNA, 22 nt, Homo sapiens
uuuuuaagaaauuuugccuuua

SEQ ID NO: 1311443 - RNA, 14 nt, Homo sapiens
uuuuucaaagcaau

SEQ ID NO: 1311444 - RNA, 15 nt, Homo sapiens
uuuuucuaaugagga

SEQ ID NO: 1311445 - RNA, 23 nt, Homo sapiens
uuuuugacucugccuacuucuga

SEQ ID NO: 1311446 - RNA, 11 nt, Homo sapiens
uuuuugcagcu

SEQ ID NO: 1311447 - RNA, 23 nt, Homo sapiens
gacuucccuaacacuuaccccau

SEQ ID NO: 1311448 - RNA, 16 nt, Homo sapiens
gacuuccuacuugguc

SEQ ID NO: 1311449 - RNA, 19 nt, Homo sapiens
gacuucucuuuugcacauc

SEQ ID NO: 1311450 - RNA, 16 nt, Homo sapiens
gacuugucaagccugu

SEQ ID NO: 1311451 - RNA, 17 nt, Homo sapiens
gacuuuauguugaaaua

SEQ ID NO: 1311452 - RNA, 15 nt, Homo sapiens
gacuuuuaaugucau

SEQ ID NO: 1311453 - RNA, 15 nt, Homo sapiens
gacuuuucaccuuaa

SEQ ID NO: 1311454 - RNA, 20 nt, Homo sapiens
gagaaaaguugacaccugag

SEQ ID NO: 1311455 - RNA, 23 nt, Homo sapiens
gagaaaccagggagccccuuuga

SEQ ID NO: 1311456 - RNA, 22 nt, Homo sapiens
gagaaaccuuauuguaccucuc

SEQ ID NO: 1311457 - RNA, 23 nt, Homo sapiens
gagaaaggauugauuugaacuua

SEQ ID NO: 1311458 - RNA, 13 nt, Homo sapiens
gagaaaucuggcu

SEQ ID NO: 1311459 - RNA, 20 nt, Homo sapiens
gagaaauugaacuucaggga

SEQ ID NO: 1311460 - RNA, 14 nt, Homo sapiens
gagaacucugagca

SEQ ID NO: 1311461 - RNA, 13 nt, Homo sapiens
gagaauacaagau

SEQ ID NO: 1311462 - RNA, 15 nt, Homo sapiens
gagaaucaaaaugca

SEQ ID NO: 1311463 - RNA, 19 nt, Homo sapiens
gagaaugugccauguauaa

SEQ ID NO: 1311464 - RNA, 22 nt, Homo sapiens
gagaauguguuucaaaaccaug

SEQ ID NO: 1311465 - RNA, 16 nt, Homo sapiens
gagaauguuccagaca

SEQ ID NO: 1311466 - RNA, 16 nt, Homo sapiens
gagaauuuaaacaaug

SEQ ID NO: 1311467 - RNA, 15 nt, Homo sapiens
gagacaaagacucac

SEQ ID NO: 1311468 - RNA, 12 nt, Homo sapiens
gagacagucacc

SEQ ID NO: 1311469 - RNA, 17 nt, Homo sapiens
gagacuuuagucuuugg

SEQ ID NO: 1311470 - RNA, 13 nt, Homo sapiens
gagagcacagccc

SEQ ID NO: 1311471 - RNA, 19 nt, Homo sapiens
gagagcggggaugugacau

SEQ ID NO: 1311472 - RNA, 22 nt, Homo sapiens
gagagcucgcuuugagugacug

SEQ ID NO: 1311473 - RNA, 13 nt, Homo sapiens
gagagcuggccaa

SEQ ID NO: 1311474 - RNA, 18 nt, Homo sapiens
gagagggaacggaaauaa

SEQ ID NO: 1311475 - RNA, 16 nt, Homo sapiens
gagagucgcaucucag

SEQ ID NO: 1311476 - RNA, 16 nt, Homo sapiens
gagaguggaacagaag

SEQ ID NO: 1311477 - RNA, 19 nt, Homo sapiens
gagagugucuucacggcag

SEQ ID NO: 1311478 - RNA, 13 nt, Homo sapiens
gagauagucucau

SEQ ID NO: 1311479 - RNA, 17 nt, Homo sapiens
gagauaugggaacacug

SEQ ID NO: 1311480 - RNA, 14 nt, Homo sapiens
gagaucaugucuca

SEQ ID NO: 1311481 - RNA, 16 nt, Homo sapiens
gagauccugagucaug

SEQ ID NO: 1311482 - RNA, 20 nt, Homo sapiens
gagauggaaguugcagugag

SEQ ID NO: 1311483 - RNA, 13 nt, Homo sapiens
guauuaaagacag

SEQ ID NO: 1311484 - RNA, 12 nt, Homo sapiens
guauuaccaugu

SEQ ID NO: 1311485 - RNA, 15 nt, Homo sapiens
guauuaguugccaau

SEQ ID NO: 1311486 - RNA, 22 nt, Homo sapiens
guauucacacaccccucaaaaa

SEQ ID NO: 1311487 - RNA, 16 nt, Homo sapiens
guauucccacaccagg

SEQ ID NO: 1311488 - RNA, 24 nt, Homo sapiens
guauuguaaaaaauucacauaaua

SEQ ID NO: 1311489 - RNA, 23 nt, Homo sapiens
guauuuaaaaaaacaaucccaag

SEQ ID NO: 1311490 - RNA, 18 nt, Homo sapiens
guauuuuuucacuuguac

SEQ ID NO: 1311491 - RNA, 23 nt, Homo sapiens
guauuuuuuccacuacacaacug

SEQ ID NO: 1311492 - RNA, 13 nt, Homo sapiens
gucaaaaaucugu

SEQ ID NO: 1311493 - RNA, 19 nt, Homo sapiens
gucaaaauuugcugccaaa

SEQ ID NO: 1311494 - RNA, 23 nt, Homo sapiens
gucaagaagaaaaagguuugcau

SEQ ID NO: 1311495 - RNA, 20 nt, Homo sapiens
gucaagcaguagacaagcaa

SEQ ID NO: 1311496 - RNA, 20 nt, Homo sapiens
gucaagcuguugaagucuca

SEQ ID NO: 1311497 - RNA, 22 nt, Homo sapiens
gucaauauugguguacuguaau

SEQ ID NO: 1311498 - RNA, 15 nt, Homo sapiens
gucacagaagcagcu

SEQ ID NO: 1311499 - RNA, 18 nt, Homo sapiens
gucacagaagcagcuaaa

SEQ ID NO: 1311500 - RNA, 19 nt, Homo sapiens
gucacagaagcagcuaaac

SEQ ID NO: 1311501 - RNA, 13 nt, Homo sapiens
gucacagccaccc

SEQ ID NO: 1311502 - RNA, 12 nt, Homo sapiens
gucacagccgcg

SEQ ID NO: 1311503 - RNA, 17 nt, Homo sapiens
gucaccaaaagacacug

SEQ ID NO: 1311504 - RNA, 16 nt, Homo sapiens
gucaccacgacuggcc

SEQ ID NO: 1311505 - RNA, 13 nt, Homo sapiens
gucacgccugaaa

SEQ ID NO: 1311506 - RNA, 15 nt, Homo sapiens
gucacuucucacaau

SEQ ID NO: 1311507 - RNA, 18 nt, Homo sapiens
gucagaacagccagguag

SEQ ID NO: 1311508 - RNA, 17 nt, Homo sapiens
gucagaacccugccaug

SEQ ID NO: 1311509 - RNA, 15 nt, Homo sapiens
gucagagaugggcug

SEQ ID NO: 1311510 - RNA, 12 nt, Homo sapiens
gucagagcuaaa

SEQ ID NO: 1311511 - RNA, 12 nt, Homo sapiens
gucagcauguac

SEQ ID NO: 1311512 - RNA, 17 nt, Homo sapiens
gucaggcagggugcagu

SEQ ID NO: 1311513 - RNA, 22 nt, Homo sapiens
gucaggggcggggagggugaca

SEQ ID NO: 1311514 - RNA, 20 nt, Homo sapiens
gucaucugcaugucuacuca

SEQ ID NO: 1311515 - RNA, 13 nt, Homo sapiens
gucaucugugcac

SEQ ID NO: 1311516 - RNA, 14 nt, Homo sapiens
gucaucugugcacu

SEQ ID NO: 1311517 - RNA, 14 nt, Homo sapiens
gucaugcaaaggcu

SEQ ID NO: 1311518 - RNA, 11 nt, Homo sapiens
gucaugcccuc

SEQ ID NO: 1311519 - RNA, 20 nt, Homo sapiens
gucauugcagaguucuuauu

SEQ ID NO: 1311520 - RNA, 14 nt, Homo sapiens
gucauuguauguua

SEQ ID NO: 1311521 - RNA, 14 nt, Homo sapiens
gucauuguauucag

SEQ ID NO: 1311522 - RNA, 19 nt, Homo sapiens
gucauuugcugugaacuga

SEQ ID NO: 1311523 - RNA, 13 nt, Homo sapiens
guccaaaacugcc

SEQ ID NO: 1311524 - RNA, 18 nt, Homo sapiens
guccacacccaauuccac

SEQ ID NO: 1311525 - RNA, 13 nt, Homo sapiens
guccacacccagc

SEQ ID NO: 1311526 - RNA, 18 nt, Homo sapiens
guccacguguguguguga

SEQ ID NO: 1311527 - RNA, 21 nt, Homo sapiens
guccagacccugaagauuuca

SEQ ID NO: 1311528 - RNA, 21 nt, Homo sapiens
guccauugauuuuaaccaaug

SEQ ID NO: 1311529 - RNA, 16 nt, Homo sapiens
gucccaucucuacccc

SEQ ID NO: 1311530 - RNA, 23 nt, Homo sapiens
gucccaugugauuuaaacaaaca

SEQ ID NO: 1311531 - RNA, 16 nt, Homo sapiens
gucccccaaacauguu

SEQ ID NO: 1311532 - RNA, 19 nt, Homo sapiens
guccccuucucucaucucu

SEQ ID NO: 1311533 - RNA, 20 nt, Homo sapiens
gucccggggccagcacuucc

SEQ ID NO: 1311534 - RNA, 17 nt, Homo sapiens
gucccuaaaaacacaga

SEQ ID NO: 1311535 - RNA, 17 nt, Homo sapiens
gucccucacagcacuag

SEQ ID NO: 1311536 - RNA, 14 nt, Homo sapiens
guccuaccuauuau

SEQ ID NO: 1311537 - RNA, 18 nt, Homo sapiens
guccuacucugugucagg

SEQ ID NO: 1311538 - RNA, 19 nt, Homo sapiens
guccucagccuugccagag

SEQ ID NO: 1311539 - RNA, 18 nt, Homo sapiens
guccucauuuacuggauu

SEQ ID NO: 1311540 - RNA, 15 nt, Homo sapiens
guccuccaagccagc

SEQ ID NO: 1311541 - RNA, 15 nt, Homo sapiens
guccucuucugggcc

SEQ ID NO: 1311542 - RNA, 15 nt, Homo sapiens
guccugaaagccaca

SEQ ID NO: 1311543 - RNA, 16 nt, Homo sapiens
guccugaaagccacag

SEQ ID NO: 1311544 - RNA, 18 nt, Homo sapiens
guccugaaaguaacucau

SEQ ID NO: 1311545 - RNA, 19 nt, Homo sapiens
guccuggaaucacauucuu

SEQ ID NO: 1311546 - RNA, 15 nt, Homo sapiens
guccuggcuucaggc

SEQ ID NO: 1311547 - RNA, 14 nt, Homo sapiens
guccuuugugaaua

SEQ ID NO: 1311548 - RNA, 15 nt, Homo sapiens
guccuuugugaauau

SEQ ID NO: 1311549 - RNA, 18 nt, Homo sapiens
gucuaugggacucaaugc

SEQ ID NO: 1311550 - RNA, 22 nt, Homo sapiens
gucuauguucaaagacugugaa

SEQ ID NO: 1311551 - RNA, 17 nt, Homo sapiens
gucucacagauugcugc

SEQ ID NO: 1311552 - RNA, 15 nt, Homo sapiens
gucucacauggugcu

SEQ ID NO: 1311553 - RNA, 17 nt, Homo sapiens
gucucaccuacccauga

SEQ ID NO: 1311554 - RNA, 17 nt, Homo sapiens
gucucacuauguugccc

SEQ ID NO: 1311555 - RNA, 18 nt, Homo sapiens
gucucacugaacuagaag

SEQ ID NO: 1311556 - RNA, 13 nt, Homo sapiens
gucucaugugguc

SEQ ID NO: 1311557 - RNA, 16 nt, Homo sapiens
gucuccuuaacacuga

SEQ ID NO: 1311558 - RNA, 19 nt, Homo sapiens
gucucgccaagcaggacag

SEQ ID NO: 1311559 - RNA, 18 nt, Homo sapiens
gucucucauucuaggccu

SEQ ID NO: 1311560 - RNA, 12 nt, Homo sapiens
gucucucucuuu

SEQ ID NO: 1311561 - RNA, 12 nt, Homo sapiens
gucucucugucu

SEQ ID NO: 1311562 - RNA, 16 nt, Homo sapiens
gucucucugucucucu

SEQ ID NO: 1311563 - RNA, 18 nt, Homo sapiens
gucucuguugacuggcug

SEQ ID NO: 1311564 - RNA, 23 nt, Homo sapiens
gucucuucuuuagaacagggaaa

SEQ ID NO: 1311565 - RNA, 18 nt, Homo sapiens
gucugaugagaacucuga

SEQ ID NO: 1311566 - RNA, 22 nt, Homo sapiens
gucugcccugaacccacugcug

SEQ ID NO: 1311567 - RNA, 14 nt, Homo sapiens
gucugcccuuguca

SEQ ID NO: 1311568 - RNA, 16 nt, Homo sapiens
gucugggagucacaca

SEQ ID NO: 1311569 - RNA, 16 nt, Homo sapiens
gucugggcacagucag

SEQ ID NO: 1311570 - RNA, 22 nt, Homo sapiens
gucugugcauuucugguugcac

SEQ ID NO: 1311571 - RNA, 13 nt, Homo sapiens
gucuucuaaacuu

SEQ ID NO: 1311572 - RNA, 16 nt, Homo sapiens
gucuucucacaagcca

SEQ ID NO: 1311573 - RNA, 19 nt, Homo sapiens
gucuuuccuaaggcugcaa

SEQ ID NO: 1311574 - RNA, 17 nt, Homo sapiens
gucuuucuuacaaggaa

SEQ ID NO: 1311575 - RNA, 14 nt, Homo sapiens
gucuuugcagagaa

SEQ ID NO: 1311576 - RNA, 17 nt, Homo sapiens
gugaaccuuaguaccua

SEQ ID NO: 1311577 - RNA, 17 nt, Homo sapiens
gugaagaaaaauguauu

SEQ ID NO: 1311578 - RNA, 22 nt, Homo sapiens
gugaagaacuauuuuauucuaa

SEQ ID NO: 1311579 - RNA, 16 nt, Homo sapiens
gugaaguauacuguau

SEQ ID NO: 1311580 - RNA, 16 nt, Homo sapiens
gugaaugauucagugu

SEQ ID NO: 1311581 - RNA, 20 nt, Homo sapiens
gugaaugccagugugcugau

SEQ ID NO: 1311582 - RNA, 20 nt, Homo sapiens
gugaauuaagaagcuaagaa

SEQ ID NO: 1311583 - RNA, 23 nt, Homo sapiens
gugaauuuuucucuaacucagaa

SEQ ID NO: 1311584 - RNA, 22 nt, Homo sapiens
gugacauaauuuacaugcaaua

SEQ ID NO: 1311585 - RNA, 15 nt, Homo sapiens
gugacauuccuucuc

SEQ ID NO: 1311586 - RNA, 16 nt, Homo sapiens
gugacuaauggcauga

SEQ ID NO: 1311587 - RNA, 14 nt, Homo sapiens
gugagaccuggcag

SEQ ID NO: 1311588 - RNA, 18 nt, Homo sapiens
gugagaccuuggcgcuac

SEQ ID NO: 1311589 - RNA, 13 nt, Homo sapiens
gugagcucuggga

SEQ ID NO: 1311590 - RNA, 18 nt, Homo sapiens
gugaggagcugcugugug

SEQ ID NO: 1311591 - RNA, 14 nt, Homo sapiens
gugaucaaagccac

SEQ ID NO: 1311592 - RNA, 23 nt, Homo sapiens
gugauggggaggggcauugcuga

SEQ ID NO: 1311593 - RNA, 13 nt, Homo sapiens
gugauggggcaag

SEQ ID NO: 1311594 - RNA, 14 nt, Homo sapiens
gugauuuacauuuc

SEQ ID NO: 1311595 - RNA, 14 nt, Homo sapiens
gugcacucacuccu

SEQ ID NO: 1311596 - RNA, 21 nt, Homo sapiens
gugcagccaaguagccucucc

SEQ ID NO: 1311597 - RNA, 16 nt, Homo sapiens
gugcagccguuugaga

SEQ ID NO: 1311598 - RNA, 22 nt, Homo sapiens
gugcagcuccucagcggcucca

SEQ ID NO: 1311599 - RNA, 23 nt, Homo sapiens
gugcaguaucaugcccugugcaa

SEQ ID NO: 1311600 - RNA, 19 nt, Homo sapiens
gugcaguggugugaucuca

SEQ ID NO: 1311601 - RNA, 13 nt, Homo sapiens
gugccaucaucuc

SEQ ID NO: 1311602 - RNA, 16 nt, Homo sapiens
gugcuauggugcucug

SEQ ID NO: 1311603 - RNA, 21 nt, Homo sapiens
gugcucauucauuuaacagag

SEQ ID NO: 1311604 - RNA, 18 nt, Homo sapiens
gugcugggauuacaggca

SEQ ID NO: 1311605 - RNA, 19 nt, Homo sapiens
gugcugggauuacaggugu

SEQ ID NO: 1311606 - RNA, 12 nt, Homo sapiens
gugcuucugcuu

SEQ ID NO: 1311607 - RNA, 15 nt, Homo sapiens
guggaaacucauggc

SEQ ID NO: 1311608 - RNA, 17 nt, Homo sapiens
guggacaugcgugacca

SEQ ID NO: 1311609 - RNA, 15 nt, Homo sapiens
guggaugauguuucg

SEQ ID NO: 1311610 - RNA, 21 nt, Homo sapiens
guggcagcugcuuuugucuau

SEQ ID NO: 1311611 - RNA, 23 nt, Homo sapiens
guggccaaggagcugcuauagcc

SEQ ID NO: 1311612 - RNA, 22 nt, Homo sapiens
guggccaccaguaugacaguau

SEQ ID NO: 1311613 - RNA, 19 nt, Homo sapiens
uaaaaugaugauaguauaa

SEQ ID NO: 1311614 - RNA, 19 nt, Homo sapiens
uaaaaugccaugaugccuc

SEQ ID NO: 1311615 - RNA, 17 nt, Homo sapiens
uaaaauguacucuccuu

SEQ ID NO: 1311616 - RNA, 20 nt, Homo sapiens
uaaaauguugaaaagucaaa

SEQ ID NO: 1311617 - RNA, 20 nt, Homo sapiens
uaaaauuacauugagguucc

SEQ ID NO: 1311618 - RNA, 20 nt, Homo sapiens
uaaaauugccauauugcaca

SEQ ID NO: 1311619 - RNA, 22 nt, Homo sapiens
uaaaauuuuuuuagaaagcauu

SEQ ID NO: 1311620 - RNA, 15 nt, Homo sapiens
uaaacacaugcauac

SEQ ID NO: 1311621 - RNA, 23 nt, Homo sapiens
uaaacacauuuugguucuucuca

SEQ ID NO: 1311622 - RNA, 21 nt, Homo sapiens
uaaacaccauagggacccauu

SEQ ID NO: 1311623 - RNA, 18 nt, Homo sapiens
uaaacauuggacagugag

SEQ ID NO: 1311624 - RNA, 19 nt, Homo sapiens
uaaaccaaggacugagcac

SEQ ID NO: 1311625 - RNA, 22 nt, Homo sapiens
uaaaccucaguuauuacaugua

SEQ ID NO: 1311626 - RNA, 22 nt, Homo sapiens
uaaacguccauuaagcugagag

SEQ ID NO: 1311627 - RNA, 18 nt, Homo sapiens
uaaacguguuugugguca

SEQ ID NO: 1311628 - RNA, 23 nt, Homo sapiens
uaaacuccuuccuggccugagag

SEQ ID NO: 1311629 - RNA, 13 nt, Homo sapiens
uaaacugugcacc

SEQ ID NO: 1311630 - RNA, 20 nt, Homo sapiens
uaaagaaauauauaugauau

SEQ ID NO: 1311631 - RNA, 12 nt, Homo sapiens
uaaagaacuuuu

SEQ ID NO: 1311632 - RNA, 15 nt, Homo sapiens
uaaagaauaauacuu

SEQ ID NO: 1311633 - RNA, 12 nt, Homo sapiens
uaaagaauacuu

SEQ ID NO: 1311634 - RNA, 22 nt, Homo sapiens
uaaagagaaagcccgcuuuagu

SEQ ID NO: 1311635 - RNA, 19 nt, Homo sapiens
uaaagagagaugaaccaca

SEQ ID NO: 1311636 - RNA, 14 nt, Homo sapiens
uaaagaugauugaa

SEQ ID NO: 1311637 - RNA, 16 nt, Homo sapiens
uaaagcauaaaaaggu

SEQ ID NO: 1311638 - RNA, 22 nt, Homo sapiens
uaaagcuaccauuuuacauuuc

SEQ ID NO: 1311639 - RNA, 19 nt, Homo sapiens
uaaagcuguucucauuccu

SEQ ID NO: 1311640 - RNA, 18 nt, Homo sapiens
uaaaggcucgauuuugua

SEQ ID NO: 1311641 - RNA, 18 nt, Homo sapiens
uaaagggcgcaaagggca

SEQ ID NO: 1311642 - RNA, 19 nt, Homo sapiens
uaaagugacauaauuuaca

SEQ ID NO: 1311643 - RNA, 23 nt, Homo sapiens
uaaagugucaccccucacuguga

SEQ ID NO: 1311644 - RNA, 18 nt, Homo sapiens
uaaaguguuugaaagcuu

SEQ ID NO: 1311645 - RNA, 15 nt, Homo sapiens
uaaaguuaaguuugu

SEQ ID NO: 1311646 - RNA, 13 nt, Homo sapiens
uaaauaaauggaa

SEQ ID NO: 1311647 - RNA, 12 nt, Homo sapiens
uaaauagcucag

SEQ ID NO: 1311648 - RNA, 22 nt, Homo sapiens
uaaauaguuacuccagugccaa

SEQ ID NO: 1311649 - RNA, 17 nt, Homo sapiens
uaaauauuaaguguuua

SEQ ID NO: 1311650 - RNA, 17 nt, Homo sapiens
uaaaugaacugacuuca

SEQ ID NO: 1311651 - RNA, 17 nt, Homo sapiens
uaaaugcacagucaugu

SEQ ID NO: 1311652 - RNA, 12 nt, Homo sapiens
uaaaugugaaug

SEQ ID NO: 1311653 - RNA, 13 nt, Homo sapiens
uaaauuaccuugc

SEQ ID NO: 1311654 - RNA, 19 nt, Homo sapiens
uaaauucuuuggaacuuua

SEQ ID NO: 1311655 - RNA, 19 nt, Homo sapiens
uaaauugcuaauguugcug

SEQ ID NO: 1311656 - RNA, 15 nt, Homo sapiens
uaaauuggagaugca

SEQ ID NO: 1311657 - RNA, 14 nt, Homo sapiens
uaaauuuuagcaag

SEQ ID NO: 1311658 - RNA, 16 nt, Homo sapiens
uaaauuuuagcaaguu

SEQ ID NO: 1311659 - RNA, 14 nt, Homo sapiens
uaacaaacucugag

SEQ ID NO: 1311660 - RNA, 12 nt, Homo sapiens
uaacacacagcu

SEQ ID NO: 1311661 - RNA, 23 nt, Homo sapiens
uaacagauaauagcaacuuggga

SEQ ID NO: 1311662 - RNA, 19 nt, Homo sapiens
uaacaggaacaaaguaaca

SEQ ID NO: 1311663 - RNA, 16 nt, Homo sapiens
uaacaggugccuuccc

SEQ ID NO: 1311664 - RNA, 13 nt, Homo sapiens
uaacaucuugaau

SEQ ID NO: 1311665 - RNA, 20 nt, Homo sapiens
uaacauuccagccacuggcu

SEQ ID NO: 1311666 - RNA, 17 nt, Homo sapiens
uaaccagaugguugugu

SEQ ID NO: 1311667 - RNA, 23 nt, Homo sapiens
uaaccagaugguuguguaugggu

SEQ ID NO: 1311668 - RNA, 16 nt, Homo sapiens
uaaccaguauuuuugc

SEQ ID NO: 1311669 - RNA, 20 nt, Homo sapiens
uaaccaucacugguugcacu

SEQ ID NO: 1311670 - RNA, 16 nt, Homo sapiens
uaaccauggcacugag

SEQ ID NO: 1311671 - RNA, 21 nt, Homo sapiens
uaaccucaagugauccuccca

SEQ ID NO: 1311672 - RNA, 22 nt, Homo sapiens
uaaccucugagucaccaucuua

SEQ ID NO: 1311673 - RNA, 20 nt, Homo sapiens
uaaccugccaacauacuuua

SEQ ID NO: 1311674 - RNA, 17 nt, Homo sapiens
uaaccuuauacuacuaa

SEQ ID NO: 1311675 - RNA, 20 nt, Homo sapiens
uaacgauaaaagacagugaa

SEQ ID NO: 1311676 - RNA, 19 nt, Homo sapiens
uaacguauuaguugccaau

SEQ ID NO: 1311677 - RNA, 17 nt, Homo sapiens
uaacuagaauuuauuca

SEQ ID NO: 1311678 - RNA, 18 nt, Homo sapiens
uaacuagaggagaauuua

SEQ ID NO: 1311679 - RNA, 17 nt, Homo sapiens
uaacuauggaauuuuga

SEQ ID NO: 1311680 - RNA, 14 nt, Homo sapiens
uaacuauugcccag

SEQ ID NO: 1311681 - RNA, 14 nt, Homo sapiens
uaacuauuucuuca

SEQ ID NO: 1311682 - RNA, 15 nt, Homo sapiens
uaacucuagaauuug

SEQ ID NO: 1311683 - RNA, 16 nt, Homo sapiens
uaacugacaacuugaa

SEQ ID NO: 1311684 - RNA, 23 nt, Homo sapiens
uaacuggggauauaauacuauau

SEQ ID NO: 1311685 - RNA, 16 nt, Homo sapiens
uaacuuggcugcauuu

SEQ ID NO: 1311686 - RNA, 16 nt, Homo sapiens
uaacuuugacuuucuu

SEQ ID NO: 1311687 - RNA, 23 nt, Homo sapiens
uaagaaacauccauauugcacaa

SEQ ID NO: 1311688 - RNA, 16 nt, Homo sapiens
uaagaauuuacaguuc

SEQ ID NO: 1311689 - RNA, 16 nt, Homo sapiens
uaagaguuuacaguuu

SEQ ID NO: 1311690 - RNA, 19 nt, Homo sapiens
uaagaucucgguuugccaa

SEQ ID NO: 1311691 - RNA, 22 nt, Homo sapiens
uaagauguguuaggaaugucaa

SEQ ID NO: 1311692 - RNA, 16 nt, Homo sapiens
uaagauuccaaaaagc

SEQ ID NO: 1311693 - RNA, 21 nt, Homo sapiens
uaagauuccaaaaagcacaua

SEQ ID NO: 1311694 - RNA, 16 nt, Homo sapiens
uaagcagaccacugau

SEQ ID NO: 1311695 - RNA, 14 nt, Homo sapiens
uaagcauacuuugu

SEQ ID NO: 1311696 - RNA, 13 nt, Homo sapiens
uaagccagggauu

SEQ ID NO: 1311697 - RNA, 22 nt, Homo sapiens
uaaggaauuauagaccucuagu

SEQ ID NO: 1311698 - RNA, 14 nt, Homo sapiens
uaaggcguggagcu

SEQ ID NO: 1311699 - RNA, 15 nt, Homo sapiens
uaagguaaaaugcca

SEQ ID NO: 1311700 - RNA, 21 nt, Homo sapiens
uaagguauauaaauuuuccca

SEQ ID NO: 1311701 - RNA, 12 nt, Homo sapiens
uaaggucauuac

SEQ ID NO: 1311702 - RNA, 12 nt, Homo sapiens
uaagguucaaga

SEQ ID NO: 1311703 - RNA, 17 nt, Homo sapiens
uaagucaaccugccuga

SEQ ID NO: 1311704 - RNA, 22 nt, Homo sapiens
uaagucaaccugccugacauuu

SEQ ID NO: 1311705 - RNA, 19 nt, Homo sapiens
uaagugaugugcugaauuu

SEQ ID NO: 1311706 - RNA, 22 nt, Homo sapiens
uaagugcagcuugaauuucaaa

SEQ ID NO: 1311707 - RNA, 20 nt, Homo sapiens
uaaguuacaucuacaaacag

SEQ ID NO: 1311708 - RNA, 12 nt, Homo sapiens
uaaguucacagu

SEQ ID NO: 1311709 - RNA, 15 nt, Homo sapiens
uaaguuuccuuccag

SEQ ID NO: 1311710 - RNA, 22 nt, Homo sapiens
uaaguuuccuuccagcccagaa

SEQ ID NO: 1311711 - RNA, 21 nt, Homo sapiens
uaauaaaaccggucacugaug

SEQ ID NO: 1311712 - RNA, 16 nt, Homo sapiens
uaauaaaccaguucug

SEQ ID NO: 1311713 - RNA, 20 nt, Homo sapiens
uaauaaaggaacugcaucag

SEQ ID NO: 1311714 - RNA, 16 nt, Homo sapiens
uaauaaaugaguucaa

SEQ ID NO: 1311715 - RNA, 22 nt, Homo sapiens
uaauaauuuacagguucuuagg

SEQ ID NO: 1311716 - RNA, 23 nt, Homo sapiens
uaauacugguauuuuuacuuaau

SEQ ID NO: 1311717 - RNA, 15 nt, Homo sapiens
uaauagaaacauuga

SEQ ID NO: 1311718 - RNA, 17 nt, Homo sapiens
uaauaggcguaacuaau

SEQ ID NO: 1311719 - RNA, 18 nt, Homo sapiens
uaauaucuaaaguuauau

SEQ ID NO: 1311720 - RNA, 12 nt, Homo sapiens
uaauauugcaag

SEQ ID NO: 1311721 - RNA, 17 nt, Homo sapiens
uaaucaaaccacuguua

SEQ ID NO: 1311722 - RNA, 22 nt, Homo sapiens
uaaucaguuguuuaauaauuua

SEQ ID NO: 1311723 - RNA, 18 nt, Homo sapiens
uaauccaggcagauccag

SEQ ID NO: 1311724 - RNA, 14 nt, Homo sapiens
uaauccauucuuug

SEQ ID NO: 1311725 - RNA, 19 nt, Homo sapiens
uaaucccaguacucuggga

SEQ ID NO: 1311726 - RNA, 12 nt, Homo sapiens
uaauccuaaaca

SEQ ID NO: 1311727 - RNA, 18 nt, Homo sapiens
uaauccuaaacauaugaa

SEQ ID NO: 1311728 - RNA, 18 nt, Homo sapiens
uaaugaaaaacuauguca

SEQ ID NO: 1311729 - RNA, 15 nt, Homo sapiens
uaaugaaaacauuaa

SEQ ID NO: 1311730 - RNA, 14 nt, Homo sapiens
uaaugauggauuua

SEQ ID NO: 1311731 - RNA, 12 nt, Homo sapiens
uaaugcuuuuau

SEQ ID NO: 1311732 - RNA, 13 nt, Homo sapiens
uaaugcuuuuuga

SEQ ID NO: 1311733 - RNA, 19 nt, Homo sapiens
uaauguagcugcuagcuau

SEQ ID NO: 1311734 - RNA, 16 nt, Homo sapiens
uaaugucauuuaauaa

SEQ ID NO: 1311735 - RNA, 21 nt, Homo sapiens
uaauguucacauagugaaaua

SEQ ID NO: 1311736 - RNA, 15 nt, Homo sapiens
uaauguucugugaua

SEQ ID NO: 1311737 - RNA, 16 nt, Homo sapiens
uaauguugcuggauca

SEQ ID NO: 1311738 - RNA, 16 nt, Homo sapiens
uaauuaguaacaugug

SEQ ID NO: 1311739 - RNA, 14 nt, Homo sapiens
uaauuaguuccuca

SEQ ID NO: 1311740 - RNA, 12 nt, Homo sapiens
uaauucagccau

SEQ ID NO: 1311741 - RNA, 22 nt, Homo sapiens
uaauucuuagauacacuaaaaa

SEQ ID NO: 1311742 - RNA, 20 nt, Homo sapiens
aaaugucugggaagcccucc

SEQ ID NO: 1311743 - RNA, 22 nt, Homo sapiens
aaaugucuugcuguugacauau

SEQ ID NO: 1311744 - RNA, 23 nt, Homo sapiens
aaaugucuugcuguugacauauu

SEQ ID NO: 1311745 - RNA, 15 nt, Homo sapiens
aaaugucuugcuuga

SEQ ID NO: 1311746 - RNA, 13 nt, Homo sapiens
aaaugugaugaau

SEQ ID NO: 1311747 - RNA, 19 nt, Homo sapiens
aaaugugguuuuccugaaa

SEQ ID NO: 1311748 - RNA, 22 nt, Homo sapiens
aaauguuaacacucaugaagca

SEQ ID NO: 1311749 - RNA, 14 nt, Homo sapiens
aaauguuuugaugg

SEQ ID NO: 1311750 - RNA, 17 nt, Homo sapiens
aaauuaacuuacuucca

SEQ ID NO: 1311751 - RNA, 18 nt, Homo sapiens
aaauuacuggaaggcuuc

SEQ ID NO: 1311752 - RNA, 16 nt, Homo sapiens
aaauuagggagcucuu

SEQ ID NO: 1311753 - RNA, 14 nt, Homo sapiens
aaauuaugccauag

SEQ ID NO: 1311754 - RNA, 12 nt, Homo sapiens
aaauucaauauu

SEQ ID NO: 1311755 - RNA, 21 nt, Homo sapiens
aaauucauuaguuguuaguga

SEQ ID NO: 1311756 - RNA, 12 nt, Homo sapiens
aaauuccaagga

SEQ ID NO: 1311757 - RNA, 17 nt, Homo sapiens
aaauucccuuuaugcac

SEQ ID NO: 1311758 - RNA, 21 nt, Homo sapiens
aaauucuguuuuucuaggccu

SEQ ID NO: 1311759 - RNA, 15 nt, Homo sapiens
aaauugauguuacug

SEQ ID NO: 1311760 - RNA, 21 nt, Homo sapiens
aaauugcucuuggcugugaaa

SEQ ID NO: 1311761 - RNA, 14 nt, Homo sapiens
aaauuguauauuca

SEQ ID NO: 1311762 - RNA, 15 nt, Homo sapiens
aaauuguauuacaaa

SEQ ID NO: 1311763 - RNA, 14 nt, Homo sapiens
aaauuguauuauca

SEQ ID NO: 1311764 - RNA, 15 nt, Homo sapiens
aaauuguauuaucaa

SEQ ID NO: 1311765 - RNA, 20 nt, Homo sapiens
aaauuuuaggcaaccuucua

SEQ ID NO: 1311766 - RNA, 16 nt, Homo sapiens
aacaaagcagccacga

SEQ ID NO: 1311767 - RNA, 13 nt, Homo sapiens
aacaaauaugcaa

SEQ ID NO: 1311768 - RNA, 14 nt, Homo sapiens
aacaaauaugcaaa

SEQ ID NO: 1311769 - RNA, 22 nt, Homo sapiens
aacaacuccuagggccacugaa

SEQ ID NO: 1311770 - RNA, 16 nt, Homo sapiens
aacaagaacacucgga

SEQ ID NO: 1311771 - RNA, 20 nt, Homo sapiens
aacaagcccuaacuucugua

SEQ ID NO: 1311772 - RNA, 13 nt, Homo sapiens
aacaaucauguaa

SEQ ID NO: 1311773 - RNA, 13 nt, Homo sapiens
aacaaugcauuuu

SEQ ID NO: 1311774 - RNA, 20 nt, Homo sapiens
aacaaugcugauuuggugac

SEQ ID NO: 1311775 - RNA, 15 nt, Homo sapiens
aacacacagcuccca

SEQ ID NO: 1311776 - RNA, 13 nt, Homo sapiens
aacacagaggcag

SEQ ID NO: 1311777 - RNA, 18 nt, Homo sapiens
aacacaucacucauuuua

SEQ ID NO: 1311778 - RNA, 18 nt, Homo sapiens
aacaccaacauguuggga

SEQ ID NO: 1311779 - RNA, 23 nt, Homo sapiens
aacaccagacagacaacacuggg

SEQ ID NO: 1311780 - RNA, 18 nt, Homo sapiens
aacaccagggacacauuu

SEQ ID NO: 1311781 - RNA, 21 nt, Homo sapiens
aacaccguguuuucugacaca

SEQ ID NO: 1311782 - RNA, 15 nt, Homo sapiens
aacacgccacagccu

SEQ ID NO: 1311783 - RNA, 19 nt, Homo sapiens
aacacgugacacaaacaca

SEQ ID NO: 1311784 - RNA, 16 nt, Homo sapiens
aacacugaaacuguau

SEQ ID NO: 1311785 - RNA, 13 nt, Homo sapiens
aacacugcugcuc

SEQ ID NO: 1311786 - RNA, 19 nt, Homo sapiens
aacagccaaaaaggacuuu

SEQ ID NO: 1311787 - RNA, 16 nt, Homo sapiens
aacagccuuucaauuc

SEQ ID NO: 1311788 - RNA, 15 nt, Homo sapiens
aacaggccauuguga

SEQ ID NO: 1311789 - RNA, 14 nt, Homo sapiens
aacaggcugaaauu

SEQ ID NO: 1311790 - RNA, 20 nt, Homo sapiens
aacagggguucuuagucuca

SEQ ID NO: 1311791 - RNA, 18 nt, Homo sapiens
aacagguguuggugacaa

SEQ ID NO: 1311792 - RNA, 19 nt, Homo sapiens
aacagucauuaauuuucaa

SEQ ID NO: 1311793 - RNA, 19 nt, Homo sapiens
aacauauuuauauauguau

SEQ ID NO: 1311794 - RNA, 19 nt, Homo sapiens
aacaucaguuacucugaag

SEQ ID NO: 1311795 - RNA, 18 nt, Homo sapiens
aacauccauauugcacaa

SEQ ID NO: 1311796 - RNA, 20 nt, Homo sapiens
aacaucccugccagcucuuc

SEQ ID NO: 1311797 - RNA, 14 nt, Homo sapiens
aacaucucugggaa

SEQ ID NO: 1311798 - RNA, 21 nt, Homo sapiens
aacaucuuuuuaaccugcaaa

SEQ ID NO: 1311799 - RNA, 15 nt, Homo sapiens
aacaugauguacuaa

SEQ ID NO: 1311800 - RNA, 19 nt, Homo sapiens
aacauguaugugcauuuca

SEQ ID NO: 1311801 - RNA, 21 nt, Homo sapiens
aacauguuagaagcaaugaau

SEQ ID NO: 1311802 - RNA, 16 nt, Homo sapiens
aacauguugaagcucu

SEQ ID NO: 1311803 - RNA, 20 nt, Homo sapiens
aacauuaaaauuagcacuaa

SEQ ID NO: 1311804 - RNA, 16 nt, Homo sapiens
aacauuaguugcacua

SEQ ID NO: 1311805 - RNA, 20 nt, Homo sapiens
aacauuccucagaaaccaaa

SEQ ID NO: 1311806 - RNA, 20 nt, Homo sapiens
aacauuggacagugagguca

SEQ ID NO: 1311807 - RNA, 19 nt, Homo sapiens
aaccaaagcuuuauuucaa

SEQ ID NO: 1311808 - RNA, 20 nt, Homo sapiens
aaccaaaucuggaagccaaa

SEQ ID NO: 1311809 - RNA, 20 nt, Homo sapiens
aaccaauagacuguccugca

SEQ ID NO: 1311810 - RNA, 17 nt, Homo sapiens
aaccacacaaagacauu

SEQ ID NO: 1311811 - RNA, 22 nt, Homo sapiens
aaccacuaagaauucaaacugg

SEQ ID NO: 1311812 - RNA, 19 nt, Homo sapiens
aaccagaaaggugauucca

SEQ ID NO: 1311813 - RNA, 17 nt, Homo sapiens
aaccauccagugacaaa

SEQ ID NO: 1311814 - RNA, 11 nt, Homo sapiens
aacccaaugac

SEQ ID NO: 1311815 - RNA, 20 nt, Homo sapiens
aacccaggagauggaaguug

SEQ ID NO: 1311816 - RNA, 18 nt, Homo sapiens
aaccccaaaugcucucuc

SEQ ID NO: 1311817 - RNA, 14 nt, Homo sapiens
aacccggagagugc

SEQ ID NO: 1311818 - RNA, 22 nt, Homo sapiens
aacccucuccuguuuacugaaa

SEQ ID NO: 1311819 - RNA, 13 nt, Homo sapiens
aacccugccaugg

SEQ ID NO: 1311820 - RNA, 19 nt, Homo sapiens
aaccgcaggaagcugcucc

SEQ ID NO: 1311821 - RNA, 12 nt, Homo sapiens
aaccuaccuccc

SEQ ID NO: 1311822 - RNA, 22 nt, Homo sapiens
aaccuagccuuagaagucacac

SEQ ID NO: 1311823 - RNA, 16 nt, Homo sapiens
aaccuauccuguucuu

SEQ ID NO: 1311824 - RNA, 11 nt, Homo sapiens
aaccuaugaag

SEQ ID NO: 1311825 - RNA, 20 nt, Homo sapiens
aaccucagccuggccagaca

SEQ ID NO: 1311826 - RNA, 15 nt, Homo sapiens
aaccucgaguacugu

SEQ ID NO: 1311827 - RNA, 17 nt, Homo sapiens
aaccucuaccagcacau

SEQ ID NO: 1311828 - RNA, 12 nt, Homo sapiens
aaccugccuccc

SEQ ID NO: 1311829 - RNA, 18 nt, Homo sapiens
aaccuuauuguaccucuc

SEQ ID NO: 1311830 - RNA, 21 nt, Homo sapiens
aaccuuccauaaaaaaacaau

SEQ ID NO: 1311831 - RNA, 18 nt, Homo sapiens
aacguauuaguugccaau

SEQ ID NO: 1311832 - RNA, 15 nt, Homo sapiens
aacgucaucucaggg

SEQ ID NO: 1311833 - RNA, 14 nt, Homo sapiens
aacuaaacacguga

SEQ ID NO: 1311834 - RNA, 13 nt, Homo sapiens
aacuaacacagcc

SEQ ID NO: 1311835 - RNA, 22 nt, Homo sapiens
aacuaaggugcuaaaucugcga

SEQ ID NO: 1311836 - RNA, 12 nt, Homo sapiens
aacuacaucuug

SEQ ID NO: 1311837 - RNA, 15 nt, Homo sapiens
aacuacuggcaauuu

SEQ ID NO: 1311838 - RNA, 16 nt, Homo sapiens
aacuaguguugcuugg

SEQ ID NO: 1311839 - RNA, 22 nt, Homo sapiens
aacuauaacaccugccaccacu

SEQ ID NO: 1311840 - RNA, 24 nt, Homo sapiens
aacuauuaaggauguagcuuuuca

SEQ ID NO: 1311841 - RNA, 19 nt, Homo sapiens
aacuauuuuauucuaaaca

SEQ ID NO: 1311842 - RNA, 23 nt, Homo sapiens
aacucaaauggggccagauccag

SEQ ID NO: 1311843 - RNA, 14 nt, Homo sapiens
aacucacugagggu

SEQ ID NO: 1311844 - RNA, 15 nt, Homo sapiens
aacucuagccaaaug

SEQ ID NO: 1311845 - RNA, 24 nt, Homo sapiens
aacucuaucugucauacauccuag

SEQ ID NO: 1311846 - RNA, 23 nt, Homo sapiens
aacucugagcagugcuugaauga

SEQ ID NO: 1311847 - RNA, 22 nt, Homo sapiens
aacucugucuucaccugauuca

SEQ ID NO: 1311848 - RNA, 23 nt, Homo sapiens
aacucuucacucuucaaaugccu

SEQ ID NO: 1311849 - RNA, 14 nt, Homo sapiens
aacugaacucacuu

SEQ ID NO: 1311850 - RNA, 23 nt, Homo sapiens
aacugcauaagugaaaaucuuac

SEQ ID NO: 1311851 - RNA, 23 nt, Homo sapiens
aacuggaaggcugcuuucuccuu

SEQ ID NO: 1311852 - RNA, 23 nt, Homo sapiens
aacuggagccagcaaccagcaca

SEQ ID NO: 1311853 - RNA, 17 nt, Homo sapiens
aacuggcaguuuuccau

SEQ ID NO: 1311854 - RNA, 18 nt, Homo sapiens
aacugggccuguagcuca

SEQ ID NO: 1311855 - RNA, 22 nt, Homo sapiens
aacugggccuguagcucaagag

SEQ ID NO: 1311856 - RNA, 18 nt, Homo sapiens
aacuggggauauaauacu

SEQ ID NO: 1311857 - RNA, 21 nt, Homo sapiens
aacuguauuuauugugaugcc

SEQ ID NO: 1311858 - RNA, 17 nt, Homo sapiens
aacugugaagaucucac

SEQ ID NO: 1311859 - RNA, 13 nt, Homo sapiens
aacugugaugaag

SEQ ID NO: 1311860 - RNA, 13 nt, Homo sapiens
aacuuacuuccaa

SEQ ID NO: 1311861 - RNA, 14 nt, Homo sapiens
aacuuacuugccuc

SEQ ID NO: 1311862 - RNA, 21 nt, Homo sapiens
aacuuagccauuuuucaaagc

SEQ ID NO: 1311863 - RNA, 13 nt, Homo sapiens
aacuucgccagcc

SEQ ID NO: 1311864 - RNA, 20 nt, Homo sapiens
aacuucuacuucugcccuug

SEQ ID NO: 1311865 - RNA, 22 nt, Homo sapiens
aacuugcagaauugagagugau

SEQ ID NO: 1311866 - RNA, 22 nt, Homo sapiens
aacuuggcugcauuugccuguc

SEQ ID NO: 1311867 - RNA, 12 nt, Homo sapiens
aacuugggccac

SEQ ID NO: 1311868 - RNA, 19 nt, Homo sapiens
aacuugucucuucaucuaa

SEQ ID NO: 1311869 - RNA, 13 nt, Homo sapiens
aacuuugaggaua

SEQ ID NO: 1311870 - RNA, 16 nt, Homo sapiens
aacuuuuauuacuggg

SEQ ID NO: 1311871 - RNA, 15 nt, Homo sapiens
aagaaauaaccacug

SEQ ID NO: 1311872 - RNA, 17 nt, Homo sapiens
aagaacaguaacugcca

SEQ ID NO: 1311873 - RNA, 14 nt, Homo sapiens
aagaacaugcaguu

SEQ ID NO: 1311874 - RNA, 13 nt, Homo sapiens
aagaaccucucac

SEQ ID NO: 1311875 - RNA, 22 nt, Homo sapiens
aaguauguaccaaaacauugau

SEQ ID NO: 1311876 - RNA, 14 nt, Homo sapiens
aagucaaccugccu

SEQ ID NO: 1311877 - RNA, 12 nt, Homo sapiens
aagucacacagu

SEQ ID NO: 1311878 - RNA, 20 nt, Homo sapiens
aagucaccauucugcauuua

SEQ ID NO: 1311879 - RNA, 21 nt, Homo sapiens
aagucauggcccaaauccagu

SEQ ID NO: 1311880 - RNA, 22 nt, Homo sapiens
aaguccaggacacccagugggg

SEQ ID NO: 1311881 - RNA, 14 nt, Homo sapiens
aagucccuuuguga

SEQ ID NO: 1311882 - RNA, 13 nt, Homo sapiens
aaguccuuuguga

SEQ ID NO: 1311883 - RNA, 16 nt, Homo sapiens
aagucgugucugucag

SEQ ID NO: 1311884 - RNA, 19 nt, Homo sapiens
aagucucacagauugcugc

SEQ ID NO: 1311885 - RNA, 20 nt, Homo sapiens
aagugagacccugucucaaa

SEQ ID NO: 1311886 - RNA, 22 nt, Homo sapiens
aagugaggagaaugaaauguau

SEQ ID NO: 1311887 - RNA, 20 nt, Homo sapiens
aagugaguguuucuaugagu

SEQ ID NO: 1311888 - RNA, 19 nt, Homo sapiens
aagugauccucccaccuca

SEQ ID NO: 1311889 - RNA, 22 nt, Homo sapiens
aagugauuuuuuuccacaagau

SEQ ID NO: 1311890 - RNA, 13 nt, Homo sapiens
aagugccaucuca

SEQ ID NO: 1311891 - RNA, 14 nt, Homo sapiens
aagugcucacguua

SEQ ID NO: 1311892 - RNA, 21 nt, Homo sapiens
aagugcucuucagcacugucu

SEQ ID NO: 1311893 - RNA, 14 nt, Homo sapiens
aaguggacucaggg

SEQ ID NO: 1311894 - RNA, 16 nt, Homo sapiens
aaguguacaauaccac

SEQ ID NO: 1311895 - RNA, 19 nt, Homo sapiens
aaguucaacaacaccagaa

SEQ ID NO: 1311896 - RNA, 17 nt, Homo sapiens
aaguucaccuaucccau

SEQ ID NO: 1311897 - RNA, 16 nt, Homo sapiens
aaguuuauuacuuuau

SEQ ID NO: 1311898 - RNA, 18 nt, Homo sapiens
aauaaaaggaaucuuccu

SEQ ID NO: 1311899 - RNA, 19 nt, Homo sapiens
aauaaaaguuuuacaaagg

SEQ ID NO: 1311900 - RNA, 16 nt, Homo sapiens
aauaaaaucauguagu

SEQ ID NO: 1311901 - RNA, 21 nt, Homo sapiens
aauaaacgucagcuuccuucc

SEQ ID NO: 1311902 - RNA, 16 nt, Homo sapiens
aauaaagcuguucuca

SEQ ID NO: 1311903 - RNA, 13 nt, Homo sapiens
aauaaaggaagca

SEQ ID NO: 1311904 - RNA, 20 nt, Homo sapiens
aauaaaggaugugauugugg

SEQ ID NO: 1311905 - RNA, 18 nt, Homo sapiens
aauaaaguucuguacuca

SEQ ID NO: 1311906 - RNA, 15 nt, Homo sapiens
aauaaaucauagcaa

SEQ ID NO: 1311907 - RNA, 16 nt, Homo sapiens
aauaaaugaacugacu

SEQ ID NO: 1311908 - RNA, 23 nt, Homo sapiens
aauaaauucuuuggaacuuuaau

SEQ ID NO: 1311909 - RNA, 13 nt, Homo sapiens
aauaaccaauccu

SEQ ID NO: 1311910 - RNA, 15 nt, Homo sapiens
aauaagauauuuagu

SEQ ID NO: 1311911 - RNA, 22 nt, Homo sapiens
aauaagcacuccuugcagagag

SEQ ID NO: 1311912 - RNA, 14 nt, Homo sapiens
aauaagcaggaugu

SEQ ID NO: 1311913 - RNA, 16 nt, Homo sapiens
aauaauacaccagaga

SEQ ID NO: 1311914 - RNA, 23 nt, Homo sapiens
aauaauccucaguuuuugugaaa

SEQ ID NO: 1311915 - RNA, 16 nt, Homo sapiens
aauaaugucucuguga

SEQ ID NO: 1311916 - RNA, 22 nt, Homo sapiens
aauaaugugacgaaaguggaaa

SEQ ID NO: 1311917 - RNA, 19 nt, Homo sapiens
aauacaacagugcauuuac

SEQ ID NO: 1311918 - RNA, 17 nt, Homo sapiens
aauacaaugauccugua

SEQ ID NO: 1311919 - RNA, 20 nt, Homo sapiens
aauacagucuuccauuugca

SEQ ID NO: 1311920 - RNA, 21 nt, Homo sapiens
aauacagucuuccauuugcaa

SEQ ID NO: 1311921 - RNA, 14 nt, Homo sapiens
aauacaucaaagag

SEQ ID NO: 1311922 - RNA, 22 nt, Homo sapiens
aauacauguauuuaaaaaaaca

SEQ ID NO: 1311923 - RNA, 21 nt, Homo sapiens
aauacuaagaaaaauuuguau

SEQ ID NO: 1311924 - RNA, 20 nt, Homo sapiens
aauacuauauuuauacugua

SEQ ID NO: 1311925 - RNA, 18 nt, Homo sapiens
aauacuccacacauaaaa

SEQ ID NO: 1311926 - RNA, 15 nt, Homo sapiens
aauacuguacagggg

SEQ ID NO: 1311927 - RNA, 21 nt, Homo sapiens
aauacuugcuccauuuacaaa

SEQ ID NO: 1311928 - RNA, 16 nt, Homo sapiens
aauacuuuuccuuacc

SEQ ID NO: 1311929 - RNA, 18 nt, Homo sapiens
aauacuuuuuacaauuaa

SEQ ID NO: 1311930 - RNA, 15 nt, Homo sapiens
aauagaaacauugaa

SEQ ID NO: 1311931 - RNA, 13 nt, Homo sapiens
aauagaacuacaa

SEQ ID NO: 1311932 - RNA, 15 nt, Homo sapiens
aauagaauauagcau

SEQ ID NO: 1311933 - RNA, 21 nt, Homo sapiens
aauagaauauagcaucuuuca

SEQ ID NO: 1311934 - RNA, 16 nt, Homo sapiens
aauagacaauuugcac

SEQ ID NO: 1311935 - RNA, 15 nt, Homo sapiens
aauagcaacuugugu

SEQ ID NO: 1311936 - RNA, 17 nt, Homo sapiens
aauagcaccccuacuca

SEQ ID NO: 1311937 - RNA, 16 nt, Homo sapiens
aauagccacauuugga

SEQ ID NO: 1311938 - RNA, 21 nt, Homo sapiens
aauagcugggacuacaggugu

SEQ ID NO: 1311939 - RNA, 16 nt, Homo sapiens
aauagggaaguaacag

SEQ ID NO: 1311940 - RNA, 15 nt, Homo sapiens
aauaguguucugcaa

SEQ ID NO: 1311941 - RNA, 13 nt, Homo sapiens
aauauaauacugu

SEQ ID NO: 1311942 - RNA, 19 nt, Homo sapiens
aauauaauaugcacacagu

SEQ ID NO: 1311943 - RNA, 15 nt, Homo sapiens
aauauaccauuucaa

SEQ ID NO: 1311944 - RNA, 15 nt, Homo sapiens
aauauaguugguaca

SEQ ID NO: 1311945 - RNA, 21 nt, Homo sapiens
aauauaucacuuuugauacaa

SEQ ID NO: 1311946 - RNA, 23 nt, Homo sapiens
aauauaucacuuuugauacaaua

SEQ ID NO: 1311947 - RNA, 19 nt, Homo sapiens
aauaucauaaaaaugagug

SEQ ID NO: 1311948 - RNA, 22 nt, Homo sapiens
aauaucaucuuuuagacacagc

SEQ ID NO: 1311949 - RNA, 13 nt, Homo sapiens
aauauccuuugcc

SEQ ID NO: 1311950 - RNA, 12 nt, Homo sapiens
aauaucuuggcc

SEQ ID NO: 1311951 - RNA, 16 nt, Homo sapiens
aauaugaaucugcuca

SEQ ID NO: 1311952 - RNA, 16 nt, Homo sapiens
aauaugaguaauacau

SEQ ID NO: 1311953 - RNA, 13 nt, Homo sapiens
aauauuagccagu

SEQ ID NO: 1311954 - RNA, 15 nt, Homo sapiens
aauauuuaucugauu

SEQ ID NO: 1311955 - RNA, 20 nt, Homo sapiens
aauauuuauuauuuucaccu

SEQ ID NO: 1311956 - RNA, 18 nt, Homo sapiens
aauauuuugacccuuuau

SEQ ID NO: 1311957 - RNA, 16 nt, Homo sapiens
aaucaccacucaaaaa

SEQ ID NO: 1311958 - RNA, 16 nt, Homo sapiens
aaucaccagagaccaa

SEQ ID NO: 1311959 - RNA, 16 nt, Homo sapiens
aaucacuucugagaac

SEQ ID NO: 1311960 - RNA, 19 nt, Homo sapiens
aaucaggaauauuuuccaa

SEQ ID NO: 1311961 - RNA, 15 nt, Homo sapiens
aaucaugaaaagggg

SEQ ID NO: 1311962 - RNA, 21 nt, Homo sapiens
aaucaugaaauaugcaucuca

SEQ ID NO: 1311963 - RNA, 16 nt, Homo sapiens
aaucaugccauugcac

SEQ ID NO: 1311964 - RNA, 22 nt, Homo sapiens
aaucaugccauugcacuccagc

SEQ ID NO: 1311965 - RNA, 15 nt, Homo sapiens
aaucauggccucuug

SEQ ID NO: 1311966 - RNA, 16 nt, Homo sapiens
aauccaggcagaucca

SEQ ID NO: 1311967 - RNA, 12 nt, Homo sapiens
aauccaugaacc

SEQ ID NO: 1311968 - RNA, 20 nt, Homo sapiens
aauccccaauaauugcagaa

SEQ ID NO: 1311969 - RNA, 14 nt, Homo sapiens
aaucccggcuguca

SEQ ID NO: 1311970 - RNA, 13 nt, Homo sapiens
aauccuagcacuu

SEQ ID NO: 1311971 - RNA, 15 nt, Homo sapiens
aauccugcagugggg

SEQ ID NO: 1311972 - RNA, 20 nt, Homo sapiens
aauccuuuuaaaucuugaua

SEQ ID NO: 1311973 - RNA, 17 nt, Homo sapiens
aaucuaccucugaaaaa

SEQ ID NO: 1311974 - RNA, 21 nt, Homo sapiens
aaucuauaugauuucagaaau

SEQ ID NO: 1311975 - RNA, 19 nt, Homo sapiens
aaucucaaugaagccagcu

SEQ ID NO: 1311976 - RNA, 14 nt, Homo sapiens
aaucuuaugcucuc

SEQ ID NO: 1311977 - RNA, 16 nt, Homo sapiens
aaucuugauaccaccu

SEQ ID NO: 1311978 - RNA, 16 nt, Homo sapiens
aaucuugcucacagcu

SEQ ID NO: 1311979 - RNA, 14 nt, Homo sapiens
aaugaaaaaauuaa

SEQ ID NO: 1311980 - RNA, 14 nt, Homo sapiens
aaugaaccacugcc

SEQ ID NO: 1311981 - RNA, 21 nt, Homo sapiens
aaugacggcaaccucugagcc

SEQ ID NO: 1311982 - RNA, 19 nt, Homo sapiens
aaugacucaggacaucccc

SEQ ID NO: 1311983 - RNA, 12 nt, Homo sapiens
aaugacuuucaa

SEQ ID NO: 1311984 - RNA, 19 nt, Homo sapiens
aaugagcugguuugucaaa

SEQ ID NO: 1311985 - RNA, 10 nt, Homo sapiens
aaugagucag

SEQ ID NO: 1311986 - RNA, 14 nt, Homo sapiens
aaugagugcuuaaa

SEQ ID NO: 1311987 - RNA, 14 nt, Homo sapiens
aaugaucaacucau

SEQ ID NO: 1311988 - RNA, 20 nt, Homo sapiens
aaugaucaaguccuuuguga

SEQ ID NO: 1311989 - RNA, 18 nt, Homo sapiens
aaugcaaaauccugguga

SEQ ID NO: 1311990 - RNA, 18 nt, Homo sapiens
aaugcacaaaacuuugau

SEQ ID NO: 1311991 - RNA, 22 nt, Homo sapiens
aaugcacugacauuguuggcca

SEQ ID NO: 1311992 - RNA, 16 nt, Homo sapiens
aaugcagagucaauga

SEQ ID NO: 1311993 - RNA, 21 nt, Homo sapiens
aaugcauuguaucgauguuau

SEQ ID NO: 1311994 - RNA, 20 nt, Homo sapiens
aaugccugagugccuggcca

SEQ ID NO: 1311995 - RNA, 10 nt, Homo sapiens
aaugcucacc

SEQ ID NO: 1311996 - RNA, 13 nt, Homo sapiens
aaugcugagguua

SEQ ID NO: 1311997 - RNA, 16 nt, Homo sapiens
aaugcuggcauuugca

SEQ ID NO: 1311998 - RNA, 17 nt, Homo sapiens
aaugcuggcauuugcac

SEQ ID NO: 1311999 - RNA, 18 nt, Homo sapiens
aaugcugggacucagccu

SEQ ID NO: 1312000 - RNA, 20 nt, Homo sapiens
aauggacguuauccucucag

SEQ ID NO: 1312001 - RNA, 17 nt, Homo sapiens
aauggagcaucaagcca

SEQ ID NO: 1312002 - RNA, 14 nt, Homo sapiens
aauggcagcugcca

SEQ ID NO: 1312003 - RNA, 22 nt, Homo sapiens
aauggcccccaaaaucugucac

SEQ ID NO: 1312004 - RNA, 18 nt, Homo sapiens
aaugggcagcucaucucu

SEQ ID NO: 1312005 - RNA, 16 nt, Homo sapiens
aaugguuccauucucu

SEQ ID NO: 1312006 - RNA, 13 nt, Homo sapiens
aauguaaagccau

SEQ ID NO: 1312007 - RNA, 14 nt, Homo sapiens
aauguaacacugau

SEQ ID NO: 1312008 - RNA, 14 nt, Homo sapiens
aauguaagcauacu

SEQ ID NO: 1312009 - RNA, 13 nt, Homo sapiens
accauaaccacug

SEQ ID NO: 1312010 - RNA, 19 nt, Homo sapiens
accauauugcccagggugg

SEQ ID NO: 1312011 - RNA, 19 nt, Homo sapiens
accaucacugguugcacuu

SEQ ID NO: 1312012 - RNA, 16 nt, Homo sapiens
accaucggcaggcagu

SEQ ID NO: 1312013 - RNA, 11 nt, Homo sapiens
accaucugucu

SEQ ID NO: 1312014 - RNA, 23 nt, Homo sapiens
accaucugugcacgcaguggccu

SEQ ID NO: 1312015 - RNA, 14 nt, Homo sapiens
accaucuucuguac

SEQ ID NO: 1312016 - RNA, 17 nt, Homo sapiens
accaugcgacacuggga

SEQ ID NO: 1312017 - RNA, 16 nt, Homo sapiens
accauuaaauaaugca

SEQ ID NO: 1312018 - RNA, 14 nt, Homo sapiens
aggugggguuucac

SEQ ID NO: 1312019 - RNA, 20 nt, Homo sapiens
aggugggucccggcucugug

SEQ ID NO: 1312020 - RNA, 14 nt, Homo sapiens
aggugugguagcuc

SEQ ID NO: 1312021 - RNA, 15 nt, Homo sapiens
agguguuggugacaa

SEQ ID NO: 1312022 - RNA, 17 nt, Homo sapiens
agguuaaacugaagcaa

SEQ ID NO: 1312023 - RNA, 14 nt, Homo sapiens
agguucaagcgauu

SEQ ID NO: 1312024 - RNA, 17 nt, Homo sapiens
agguugaagucucuucc

SEQ ID NO: 1312025 - RNA, 16 nt, Homo sapiens
agguuggaacuaugca

SEQ ID NO: 1312026 - RNA, 20 nt, Homo sapiens
agguuggaacuaugcagugu

SEQ ID NO: 1312027 - RNA, 17 nt, Homo sapiens
agguuggauccaaggag

SEQ ID NO: 1312028 - RNA, 22 nt, Homo sapiens
agguuguagacguuguguaaug

SEQ ID NO: 1312029 - RNA, 17 nt, Homo sapiens
agguugugggcauugau

SEQ ID NO: 1312030 - RNA, 19 nt, Homo sapiens
agguuuagaggaccaguga

SEQ ID NO: 1312031 - RNA, 15 nt, Homo sapiens
agguuucaccaugau

SEQ ID NO: 1312032 - RNA, 22 nt, Homo sapiens
aguaacaugaggggacauuuug

SEQ ID NO: 1312033 - RNA, 22 nt, Homo sapiens
aguaaccuggguaaaugcagcg

SEQ ID NO: 1312034 - RNA, 15 nt, Homo sapiens
aguaagaaacaucca

SEQ ID NO: 1312035 - RNA, 23 nt, Homo sapiens
aguaagaauguuaaaaagugaaa

SEQ ID NO: 1312036 - RNA, 17 nt, Homo sapiens
aguaauacaucaaagag

SEQ ID NO: 1312037 - RNA, 23 nt, Homo sapiens
aguaauuuuaguuauacuccuca

SEQ ID NO: 1312038 - RNA, 16 nt, Homo sapiens
aguaccagcuuuggua

SEQ ID NO: 1312039 - RNA, 24 nt, Homo sapiens
aguaccaguauaagcaucugccau

SEQ ID NO: 1312040 - RNA, 13 nt, Homo sapiens
aguagacaagcaa

SEQ ID NO: 1312041 - RNA, 15 nt, Homo sapiens
aguagacaagcaauu

SEQ ID NO: 1312042 - RNA, 17 nt, Homo sapiens
aguagcugaaaugcaag

SEQ ID NO: 1312043 - RNA, 17 nt, Homo sapiens
aguagcugcuaccuucu

SEQ ID NO: 1312044 - RNA, 23 nt, Homo sapiens
aguagggccccugcacacucagu

SEQ ID NO: 1312045 - RNA, 15 nt, Homo sapiens
aguagucuugaugac

SEQ ID NO: 1312046 - RNA, 16 nt, Homo sapiens
aguauaaacaaaguua

SEQ ID NO: 1312047 - RNA, 19 nt, Homo sapiens
aguauaaaugaauuugcau

SEQ ID NO: 1312048 - RNA, 23 nt, Homo sapiens
aguauacaauaaagucuuaccuc

SEQ ID NO: 1312049 - RNA, 19 nt, Homo sapiens
aguauacuagggagccauu

SEQ ID NO: 1312050 - RNA, 12 nt, Homo sapiens
aguauccaguca

SEQ ID NO: 1312051 - RNA, 14 nt, Homo sapiens
aguaugggaucuga

SEQ ID NO: 1312052 - RNA, 21 nt, Homo sapiens
aguauuaaugaaaagcacaaa

SEQ ID NO: 1312053 - RNA, 18 nt, Homo sapiens
aguauugaauacuuacau

SEQ ID NO: 1312054 - RNA, 17 nt, Homo sapiens
aguauugucgguuaccu

SEQ ID NO: 1312055 - RNA, 21 nt, Homo sapiens
aguauuguuuccugagcauaa

SEQ ID NO: 1312056 - RNA, 22 nt, Homo sapiens
aguauuuauugcaggauggugu

SEQ ID NO: 1312057 - RNA, 21 nt, Homo sapiens
aguauuuuagugaacuugaaa

SEQ ID NO: 1312058 - RNA, 16 nt, Homo sapiens
agucaaaucugggcuc

SEQ ID NO: 1312059 - RNA, 21 nt, Homo sapiens
agucaaccugccugacauuug

SEQ ID NO: 1312060 - RNA, 13 nt, Homo sapiens
agucaauucugau

SEQ ID NO: 1312061 - RNA, 14 nt, Homo sapiens
agucacaucucuuc

SEQ ID NO: 1312062 - RNA, 14 nt, Homo sapiens
agucacccuuccac

SEQ ID NO: 1312063 - RNA, 23 nt, Homo sapiens
agucacuucggccagagcugaag

SEQ ID NO: 1312064 - RNA, 17 nt, Homo sapiens
agucagagcuugaagaa

SEQ ID NO: 1312065 - RNA, 18 nt, Homo sapiens
agucagcucuucaucugc

SEQ ID NO: 1312066 - RNA, 19 nt, Homo sapiens
agucaguucucauuauuca

SEQ ID NO: 1312067 - RNA, 22 nt, Homo sapiens
agucaucuaccugaguccugaa

SEQ ID NO: 1312068 - RNA, 23 nt, Homo sapiens
agucauggauuucucugcucaca

SEQ ID NO: 1312069 - RNA, 21 nt, Homo sapiens
aguccagccuggcaaggguuc

SEQ ID NO: 1312070 - RNA, 14 nt, Homo sapiens
aguccaggacaccc

SEQ ID NO: 1312071 - RNA, 20 nt, Homo sapiens
agucccauccucuugucagg

SEQ ID NO: 1312072 - RNA, 17 nt, Homo sapiens
agucccugucaccucuu

SEQ ID NO: 1312073 - RNA, 13 nt, Homo sapiens
aguccucauuuac

SEQ ID NO: 1312074 - RNA, 16 nt, Homo sapiens
aguccuucugccauuu

SEQ ID NO: 1312075 - RNA, 22 nt, Homo sapiens
agucgaccccaaaggaacacug

SEQ ID NO: 1312076 - RNA, 19 nt, Homo sapiens
agucgcaucucagugcagg

SEQ ID NO: 1312077 - RNA, 22 nt, Homo sapiens
agucgucuggcaucucccacac

SEQ ID NO: 1312078 - RNA, 18 nt, Homo sapiens
agucguggggugugcugg

SEQ ID NO: 1312079 - RNA, 14 nt, Homo sapiens
agucucagcacuau

SEQ ID NO: 1312080 - RNA, 20 nt, Homo sapiens
agucucuucuaagcaaaauu

SEQ ID NO: 1312081 - RNA, 23 nt, Homo sapiens
agucuguauggcaugacaacuac

SEQ ID NO: 1312082 - RNA, 15 nt, Homo sapiens
agucuguguucaaaa

SEQ ID NO: 1312083 - RNA, 17 nt, Homo sapiens
agucuuguggauggaaa

SEQ ID NO: 1312084 - RNA, 22 nt, Homo sapiens
agucuuuuguucgcauggucac

SEQ ID NO: 1312085 - RNA, 19 nt, Homo sapiens
agugaauaaaccaucaucu

SEQ ID NO: 1312086 - RNA, 15 nt, Homo sapiens
agugaauuguugaca

SEQ ID NO: 1312087 - RNA, 16 nt, Homo sapiens
agugacaaaccaucca

SEQ ID NO: 1312088 - RNA, 20 nt, Homo sapiens
agugacuguucaagagcaca

SEQ ID NO: 1312089 - RNA, 19 nt, Homo sapiens
agugagcccaucugcacag

SEQ ID NO: 1312090 - RNA, 23 nt, Homo sapiens
agugaggucacaguccacccacc

SEQ ID NO: 1312091 - RNA, 18 nt, Homo sapiens
agugagucugaaugucac

SEQ ID NO: 1312092 - RNA, 19 nt, Homo sapiens
agugauccucccaccucag

SEQ ID NO: 1312093 - RNA, 14 nt, Homo sapiens
agugauuacuguca

SEQ ID NO: 1312094 - RNA, 13 nt, Homo sapiens
agugcaaugggaa

SEQ ID NO: 1312095 - RNA, 21 nt, Homo sapiens
agugcacaacauuacagggaa

SEQ ID NO: 1312096 - RNA, 14 nt, Homo sapiens
agugcaguggugcg

SEQ ID NO: 1312097 - RNA, 20 nt, Homo sapiens
agugccaacaauccuagugc

SEQ ID NO: 1312098 - RNA, 17 nt, Homo sapiens
agugccuggccaaaggg

SEQ ID NO: 1312099 - RNA, 19 nt, Homo sapiens
agugccuggccaaagggau

SEQ ID NO: 1312100 - RNA, 18 nt, Homo sapiens
agugcggcacugcaaaga

SEQ ID NO: 1312101 - RNA, 17 nt, Homo sapiens
agugcugggauuacaau

SEQ ID NO: 1312102 - RNA, 17 nt, Homo sapiens
agugcuguccaugaugu

SEQ ID NO: 1312103 - RNA, 19 nt, Homo sapiens
agugcugugcugugcuaug

SEQ ID NO: 1312104 - RNA, 19 nt, Homo sapiens
aguggcauuuccuggucag

SEQ ID NO: 1312105 - RNA, 16 nt, Homo sapiens
aguggccucuuugucu

SEQ ID NO: 1312106 - RNA, 17 nt, Homo sapiens
aguggcucacaccugua

SEQ ID NO: 1312107 - RNA, 20 nt, Homo sapiens
agugggagcugaguggggga

SEQ ID NO: 1312108 - RNA, 14 nt, Homo sapiens
aguggggaaggcau

SEQ ID NO: 1312109 - RNA, 15 nt, Homo sapiens
agugggggaucacag

SEQ ID NO: 1312110 - RNA, 12 nt, Homo sapiens
aguggucuucaa

SEQ ID NO: 1312111 - RNA, 14 nt, Homo sapiens
aguggugccugcau

SEQ ID NO: 1312112 - RNA, 13 nt, Homo sapiens
aguguaacacugc

SEQ ID NO: 1312113 - RNA, 12 nt, Homo sapiens
aguguaccuccu

SEQ ID NO: 1312114 - RNA, 14 nt, Homo sapiens
agugucuuuugaca

SEQ ID NO: 1312115 - RNA, 14 nt, Homo sapiens
agugugaccacuga

SEQ ID NO: 1312116 - RNA, 23 nt, Homo sapiens
aguguggccacgugggcaaacag

SEQ ID NO: 1312117 - RNA, 23 nt, Homo sapiens
aguguuccccuuccacugagggc

SEQ ID NO: 1312118 - RNA, 22 nt, Homo sapiens
aguguugcccaggcuggucuca

SEQ ID NO: 1312119 - RNA, 23 nt, Homo sapiens
aguguugcccaggcuggucucaa

SEQ ID NO: 1312120 - RNA, 21 nt, Homo sapiens
aguguuucuaauaaacuugga

SEQ ID NO: 1312121 - RNA, 17 nt, Homo sapiens
aguguuugaaagcuuua

SEQ ID NO: 1312122 - RNA, 21 nt, Homo sapiens
aguguuuuggacuccaucucu

SEQ ID NO: 1312123 - RNA, 12 nt, Homo sapiens
aguuaagacaug

SEQ ID NO: 1312124 - RNA, 21 nt, Homo sapiens
aguuaaggggagcaacagagg

SEQ ID NO: 1312125 - RNA, 15 nt, Homo sapiens
aguuaauauagucac

SEQ ID NO: 1312126 - RNA, 16 nt, Homo sapiens
aguuacacagaaaugc

SEQ ID NO: 1312127 - RNA, 21 nt, Homo sapiens
aguuacacagaaaugcugcug

SEQ ID NO: 1312128 - RNA, 12 nt, Homo sapiens
aguuacuuuaga

SEQ ID NO: 1312129 - RNA, 11 nt, Homo sapiens
aguuagccaaa

SEQ ID NO: 1312130 - RNA, 12 nt, Homo sapiens
aguuagccaaac

SEQ ID NO: 1312131 - RNA, 15 nt, Homo sapiens
aguuaggagaaagaa

SEQ ID NO: 1312132 - RNA, 20 nt, Homo sapiens
aguuaggcuauucacaacca

SEQ ID NO: 1312133 - RNA, 15 nt, Homo sapiens
aguuaucuaagaaua

SEQ ID NO: 1312134 - RNA, 22 nt, Homo sapiens
auaucauuuauuuuuuacauua

SEQ ID NO: 1312135 - RNA, 19 nt, Homo sapiens
auauccuuugccucaagga

SEQ ID NO: 1312136 - RNA, 14 nt, Homo sapiens
auaucugccuuuau

SEQ ID NO: 1312137 - RNA, 19 nt, Homo sapiens
auaucuguguauuaucuca

SEQ ID NO: 1312138 - RNA, 15 nt, Homo sapiens
auaucuucaguuuaa

SEQ ID NO: 1312139 - RNA, 20 nt, Homo sapiens
auaugauauauaaaugugau

SEQ ID NO: 1312140 - RNA, 22 nt, Homo sapiens
auaugccuaaaugcacagucau

SEQ ID NO: 1312141 - RNA, 19 nt, Homo sapiens
auaugcugacagcucuuca

SEQ ID NO: 1312142 - RNA, 11 nt, Homo sapiens
auaugugccaa

SEQ ID NO: 1312143 - RNA, 20 nt, Homo sapiens
auauguuuaucaacucaaga

SEQ ID NO: 1312144 - RNA, 21 nt, Homo sapiens
auauguuuuaagaggcagggu

SEQ ID NO: 1312145 - RNA, 15 nt, Homo sapiens
auauuagugcagcca

SEQ ID NO: 1312146 - RNA, 15 nt, Homo sapiens
auauuaucaucaaau

SEQ ID NO: 1312147 - RNA, 13 nt, Homo sapiens
auauuaugagaug

SEQ ID NO: 1312148 - RNA, 13 nt, Homo sapiens
auauuauucucau

SEQ ID NO: 1312149 - RNA, 20 nt, Homo sapiens
auauucauguaccugugauc

SEQ ID NO: 1312150 - RNA, 12 nt, Homo sapiens
auauucuuucaa

SEQ ID NO: 1312151 - RNA, 16 nt, Homo sapiens
auauugcuucuucucc

SEQ ID NO: 1312152 - RNA, 22 nt, Homo sapiens
auauuguuccuuaucaccugcc

SEQ ID NO: 1312153 - RNA, 17 nt, Homo sapiens
auauuuaccagaccaca

SEQ ID NO: 1312154 - RNA, 22 nt, Homo sapiens
augaauccccaauaauugcaga

SEQ ID NO: 1312155 - RNA, 13 nt, Homo sapiens
augaaucugcuca

SEQ ID NO: 1312156 - RNA, 16 nt, Homo sapiens
augacacaacugcacu

SEQ ID NO: 1312157 - RNA, 19 nt, Homo sapiens
augacagcucuucuaagga

SEQ ID NO: 1312158 - RNA, 14 nt, Homo sapiens
augacugcaaaagu

SEQ ID NO: 1312159 - RNA, 18 nt, Homo sapiens
augacugccuugccuccu

SEQ ID NO: 1312160 - RNA, 17 nt, Homo sapiens
augacuuaccuguucag

SEQ ID NO: 1312161 - RNA, 11 nt, Homo sapiens
augacuuucaa

SEQ ID NO: 1312162 - RNA, 17 nt, Homo sapiens
augagaacaaacagauc

SEQ ID NO: 1312163 - RNA, 21 nt, Homo sapiens
augagaagaaaauggaaccag

SEQ ID NO: 1312164 - RNA, 13 nt, Homo sapiens
augagaagcagaa

SEQ ID NO: 1312165 - RNA, 13 nt, Homo sapiens
augagacuugccu

SEQ ID NO: 1312166 - RNA, 21 nt, Homo sapiens
augagaguuuuggaugcagug

SEQ ID NO: 1312167 - RNA, 18 nt, Homo sapiens
augagaugauacauccaa

SEQ ID NO: 1312168 - RNA, 13 nt, Homo sapiens
augagccaugaga

SEQ ID NO: 1312169 - RNA, 15 nt, Homo sapiens
augagcccucagaac

SEQ ID NO: 1312170 - RNA, 21 nt, Homo sapiens
augagccucagcauccuggca

SEQ ID NO: 1312171 - RNA, 20 nt, Homo sapiens
augagccuggcaagaaugug

SEQ ID NO: 1312172 - RNA, 19 nt, Homo sapiens
augaggaauguacuuuuaa

SEQ ID NO: 1312173 - RNA, 22 nt, Homo sapiens
augaggacaagagggacaaggu

SEQ ID NO: 1312174 - RNA, 21 nt, Homo sapiens
augagguuucuuugacuucaa

SEQ ID NO: 1312175 - RNA, 20 nt, Homo sapiens
augaguaauacaucaaagag

SEQ ID NO: 1312176 - RNA, 21 nt, Homo sapiens
augaguaauacaucaaagagu

SEQ ID NO: 1312177 - RNA, 14 nt, Homo sapiens
augauacuuacuga

SEQ ID NO: 1312178 - RNA, 20 nt, Homo sapiens
augaucacggcucacugcag

SEQ ID NO: 1312179 - RNA, 22 nt, Homo sapiens
augaucaguguuguugcucuag

SEQ ID NO: 1312180 - RNA, 22 nt, Homo sapiens
augaucaucacaaucaucauca

SEQ ID NO: 1312181 - RNA, 12 nt, Homo sapiens
augaucucagga

SEQ ID NO: 1312182 - RNA, 20 nt, Homo sapiens
augaucuuugcagacaggca

SEQ ID NO: 1312183 - RNA, 12 nt, Homo sapiens
augaugaucugg

SEQ ID NO: 1312184 - RNA, 14 nt, Homo sapiens
augauucaagccau

SEQ ID NO: 1312185 - RNA, 23 nt, Homo sapiens
augauucacccccaaacagugac

SEQ ID NO: 1312186 - RNA, 16 nt, Homo sapiens
augauuugcauaugaa

SEQ ID NO: 1312187 - RNA, 21 nt, Homo sapiens
augauuuuguaaaaguggcau

SEQ ID NO: 1312188 - RNA, 16 nt, Homo sapiens
augcaaagucaugcaa

SEQ ID NO: 1312189 - RNA, 19 nt, Homo sapiens
augcaaauccuaugugauu

SEQ ID NO: 1312190 - RNA, 18 nt, Homo sapiens
augcaauuggcauuaaca

SEQ ID NO: 1312191 - RNA, 17 nt, Homo sapiens
augcaauuuuucaagag

SEQ ID NO: 1312192 - RNA, 18 nt, Homo sapiens
augcaccuguagucucac

SEQ ID NO: 1312193 - RNA, 13 nt, Homo sapiens
augcagacaugag

SEQ ID NO: 1312194 - RNA, 13 nt, Homo sapiens
augcagcagggau

SEQ ID NO: 1312195 - RNA, 15 nt, Homo sapiens
augcagucuguccag

SEQ ID NO: 1312196 - RNA, 18 nt, Homo sapiens
augcagucuguccaggcu

SEQ ID NO: 1312197 - RNA, 18 nt, Homo sapiens
augcagugguaugaucac

SEQ ID NO: 1312198 - RNA, 18 nt, Homo sapiens
augccaaccggucaccca

SEQ ID NO: 1312199 - RNA, 21 nt, Homo sapiens
augccaaccggucacccagga

SEQ ID NO: 1312200 - RNA, 18 nt, Homo sapiens
augccagcuuaucucagg

SEQ ID NO: 1312201 - RNA, 12 nt, Homo sapiens
augccagugugc

SEQ ID NO: 1312202 - RNA, 21 nt, Homo sapiens
augcccaugguacuccaugca

SEQ ID NO: 1312203 - RNA, 15 nt, Homo sapiens
augcccccucaguga

SEQ ID NO: 1312204 - RNA, 19 nt, Homo sapiens
augccgagguaaaaguucu

SEQ ID NO: 1312205 - RNA, 22 nt, Homo sapiens
augccgauauacucuagaugaa

SEQ ID NO: 1312206 - RNA, 16 nt, Homo sapiens
augccugguauuuuca

SEQ ID NO: 1312207 - RNA, 15 nt, Homo sapiens
augccuguaauccca

SEQ ID NO: 1312208 - RNA, 14 nt, Homo sapiens
augccuguccugaa

SEQ ID NO: 1312209 - RNA, 12 nt, Homo sapiens
augccugugucu

SEQ ID NO: 1312210 - RNA, 21 nt, Homo sapiens
augcuacaagacgggcaaaau

SEQ ID NO: 1312211 - RNA, 20 nt, Homo sapiens
augcucaaaaucuuuccaaa

SEQ ID NO: 1312212 - RNA, 12 nt, Homo sapiens
augcucaagaaa

SEQ ID NO: 1312213 - RNA, 14 nt, Homo sapiens
augcucagaccagc

SEQ ID NO: 1312214 - RNA, 19 nt, Homo sapiens
augcucagaccagcucuuc

SEQ ID NO: 1312215 - RNA, 14 nt, Homo sapiens
augcucucuggucu

SEQ ID NO: 1312216 - RNA, 20 nt, Homo sapiens
augcugcaacaaaauguaga

SEQ ID NO: 1312217 - RNA, 18 nt, Homo sapiens
augcugcaggacuugaga

SEQ ID NO: 1312218 - RNA, 17 nt, Homo sapiens
augcugcuggacaguau

SEQ ID NO: 1312219 - RNA, 16 nt, Homo sapiens
augcuucagugcugcu

SEQ ID NO: 1312220 - RNA, 18 nt, Homo sapiens
augcuuuaagugcacaac

SEQ ID NO: 1312221 - RNA, 18 nt, Homo sapiens
auggaaaaauaaacacua

SEQ ID NO: 1312222 - RNA, 20 nt, Homo sapiens
auggaacagcauuacccucc

SEQ ID NO: 1312223 - RNA, 18 nt, Homo sapiens
auggaagccaacacauca

SEQ ID NO: 1312224 - RNA, 23 nt, Homo sapiens
auggaaguugcagugagcugaua

SEQ ID NO: 1312225 - RNA, 11 nt, Homo sapiens
auggacaugcu

SEQ ID NO: 1312226 - RNA, 23 nt, Homo sapiens
auggacaugcuucagugcugcuc

SEQ ID NO: 1312227 - RNA, 22 nt, Homo sapiens
auggacguuauccucucagauu

SEQ ID NO: 1312228 - RNA, 13 nt, Homo sapiens
auggauacauaaa

SEQ ID NO: 1312229 - RNA, 17 nt, Homo sapiens
auggaucaucaagguga

SEQ ID NO: 1312230 - RNA, 19 nt, Homo sapiens
auggaugaaacuauaacuu

SEQ ID NO: 1312231 - RNA, 21 nt, Homo sapiens
auggaugggggaacucagauc

SEQ ID NO: 1312232 - RNA, 22 nt, Homo sapiens
auggauucuccacucaguugca

SEQ ID NO: 1312233 - RNA, 14 nt, Homo sapiens
auggauuuccagcc

SEQ ID NO: 1312234 - RNA, 18 nt, Homo sapiens
auggcaguccagccagcu

SEQ ID NO: 1312235 - RNA, 13 nt, Homo sapiens
auggccagccaac

SEQ ID NO: 1312236 - RNA, 16 nt, Homo sapiens
auggcccgacauuucu

SEQ ID NO: 1312237 - RNA, 15 nt, Homo sapiens
augggacuuaacucc

SEQ ID NO: 1312238 - RNA, 15 nt, Homo sapiens
augggcagcucaucu

SEQ ID NO: 1312239 - RNA, 17 nt, Homo sapiens
augggggaacucagauc

SEQ ID NO: 1312240 - RNA, 11 nt, Homo sapiens
auggguucauc

SEQ ID NO: 1312241 - RNA, 15 nt, Homo sapiens
auggucacaagcaca

SEQ ID NO: 1312242 - RNA, 16 nt, Homo sapiens
auggugccccaggacc

SEQ ID NO: 1312243 - RNA, 18 nt, Homo sapiens
augguuuagucauugcag

SEQ ID NO: 1312244 - RNA, 14 nt, Homo sapiens
auguaaaaugcaaa

SEQ ID NO: 1312245 - RNA, 14 nt, Homo sapiens
auguaaaugugcau

SEQ ID NO: 1312246 - RNA, 13 nt, Homo sapiens
auguaacacugau

SEQ ID NO: 1312247 - RNA, 22 nt, Homo sapiens
auguaacacugaugauagguua

SEQ ID NO: 1312248 - RNA, 16 nt, Homo sapiens
auguaagaauucagaa

SEQ ID NO: 1312249 - RNA, 19 nt, Homo sapiens
auguaauggaacuuagcca

SEQ ID NO: 1312250 - RNA, 21 nt, Homo sapiens
auguaauggaacuuagccauu

SEQ ID NO: 1312251 - RNA, 23 nt, Homo sapiens
auguacaucuguuuguagccaca

SEQ ID NO: 1312252 - RNA, 11 nt, Homo sapiens
auguacaugag

SEQ ID NO: 1312253 - RNA, 20 nt, Homo sapiens
auguaguccgugcugacagc

SEQ ID NO: 1312254 - RNA, 12 nt, Homo sapiens
auguauacaaag

SEQ ID NO: 1312255 - RNA, 23 nt, Homo sapiens
augucaaagcaggggaguaugca

SEQ ID NO: 1312256 - RNA, 20 nt, Homo sapiens
augucaacagagcaaggaga

SEQ ID NO: 1312257 - RNA, 21 nt, Homo sapiens
augucaaggaaugaagaacaa

SEQ ID NO: 1312258 - RNA, 14 nt, Homo sapiens
augucacucagaug

SEQ ID NO: 1312259 - RNA, 19 nt, Homo sapiens
auguccucuuguugcugag

SEQ ID NO: 1312260 - RNA, 23 nt, Homo sapiens
augucuuaaugaaguuugaaugu

SEQ ID NO: 1312261 - RNA, 22 nt, Homo sapiens
augucuuugcugcagaacugaa

SEQ ID NO: 1312262 - RNA, 14 nt, Homo sapiens
augugaacaaccug

SEQ ID NO: 1312263 - RNA, 21 nt, Homo sapiens
augugaauuauuuccugcuua

SEQ ID NO: 1312264 - RNA, 15 nt, Homo sapiens
augugaggauguauc

SEQ ID NO: 1312265 - RNA, 22 nt, Homo sapiens
augugcgcgcgugcaugugugc

SEQ ID NO: 1312266 - RNA, 15 nt, Homo sapiens
augugcugagcauuu

SEQ ID NO: 1312267 - RNA, 21 nt, Homo sapiens
ccaacacugcugcuccagugc

SEQ ID NO: 1312268 - RNA, 21 nt, Homo sapiens
ccaacauggugaaacccugua

SEQ ID NO: 1312269 - RNA, 16 nt, Homo sapiens
ccaacucuuucucucu

SEQ ID NO: 1312270 - RNA, 18 nt, Homo sapiens
ccaacugaaggcuaaaaa

SEQ ID NO: 1312271 - RNA, 23 nt, Homo sapiens
ccaacuuacaaaaacacuucguu

SEQ ID NO: 1312272 - RNA, 12 nt, Homo sapiens
ccaagaccucag

SEQ ID NO: 1312273 - RNA, 21 nt, Homo sapiens
ccaagaugacacaacugcacu

SEQ ID NO: 1312274 - RNA, 15 nt, Homo sapiens
ccaagcaagacugag

SEQ ID NO: 1312275 - RNA, 22 nt, Homo sapiens
ccaagcaggaaaugaaaauguc

SEQ ID NO: 1312276 - RNA, 18 nt, Homo sapiens
ccaagcaggaaccccagg

SEQ ID NO: 1312277 - RNA, 13 nt, Homo sapiens
ccaagccugacca

SEQ ID NO: 1312278 - RNA, 23 nt, Homo sapiens
ccaagcugugcccugaccacccu

SEQ ID NO: 1312279 - RNA, 17 nt, Homo sapiens
ccaagcuucaacccuca

SEQ ID NO: 1312280 - RNA, 14 nt, Homo sapiens
ccaaggagggugag

SEQ ID NO: 1312281 - RNA, 20 nt, Homo sapiens
ccaaggagggugagugcaag

SEQ ID NO: 1312282 - RNA, 20 nt, Homo sapiens
ccaaggauagaagcugcagu

SEQ ID NO: 1312283 - RNA, 21 nt, Homo sapiens
ccaaggccacggagcaguuca

SEQ ID NO: 1312284 - RNA, 23 nt, Homo sapiens
ccaaggccucauccuggggagga

SEQ ID NO: 1312285 - RNA, 18 nt, Homo sapiens
ccaaggccuccugugacu

SEQ ID NO: 1312286 - RNA, 15 nt, Homo sapiens
ccaaggcugaugcag

SEQ ID NO: 1312287 - RNA, 13 nt, Homo sapiens
ccaaguagcugcu

SEQ ID NO: 1312288 - RNA, 20 nt, Homo sapiens
ccaagugggaaacaagaaca

SEQ ID NO: 1312289 - RNA, 18 nt, Homo sapiens
ccaaguugaagacuuugu

SEQ ID NO: 1312290 - RNA, 19 nt, Homo sapiens
ccaaguuuauauacaauua

SEQ ID NO: 1312291 - RNA, 20 nt, Homo sapiens
ccaauacggcaaaaccucau

SEQ ID NO: 1312292 - RNA, 21 nt, Homo sapiens
ccaauauuuaccagaccacaa

SEQ ID NO: 1312293 - RNA, 21 nt, Homo sapiens
ccaaucaccuuuccuguucca

SEQ ID NO: 1312294 - RNA, 18 nt, Homo sapiens
ccaaucccagcuaccuca

SEQ ID NO: 1312295 - RNA, 23 nt, Homo sapiens
ccaaucccuuuauuacccccucc

SEQ ID NO: 1312296 - RNA, 19 nt, Homo sapiens
ccaauccuagcccucauuu

SEQ ID NO: 1312297 - RNA, 21 nt, Homo sapiens
ccaauccuuaaauaugugaaa

SEQ ID NO: 1312298 - RNA, 16 nt, Homo sapiens
ccaauggaaugugaug

SEQ ID NO: 1312299 - RNA, 14 nt, Homo sapiens
ccaauuauuugacu

SEQ ID NO: 1312300 - RNA, 19 nt, Homo sapiens
ccaauugcuggaguacuua

SEQ ID NO: 1312301 - RNA, 22 nt, Homo sapiens
ccaauuuaaagaaaacuguuaa

SEQ ID NO: 1312302 - RNA, 16 nt, Homo sapiens
ccaauuugcaccaguu

SEQ ID NO: 1312303 - RNA, 15 nt, Homo sapiens
ccacaaagagauuau

SEQ ID NO: 1312304 - RNA, 17 nt, Homo sapiens
ccacaaagagauuauuu

SEQ ID NO: 1312305 - RNA, 16 nt, Homo sapiens
ccacaaccgaccagau

SEQ ID NO: 1312306 - RNA, 21 nt, Homo sapiens
ccacaacuauauuaucaugca

SEQ ID NO: 1312307 - RNA, 14 nt, Homo sapiens
ccacacucagcaca

SEQ ID NO: 1312308 - RNA, 13 nt, Homo sapiens
ccacacuggacuc

SEQ ID NO: 1312309 - RNA, 15 nt, Homo sapiens
ccacacuugguggga

SEQ ID NO: 1312310 - RNA, 21 nt, Homo sapiens
ccacagacucaaaugcucaga

SEQ ID NO: 1312311 - RNA, 15 nt, Homo sapiens
ccacaguugcucuau

SEQ ID NO: 1312312 - RNA, 23 nt, Homo sapiens
ccacaguugcucuaugcuuucca

SEQ ID NO: 1312313 - RNA, 17 nt, Homo sapiens
ccacauccacacagcca

SEQ ID NO: 1312314 - RNA, 12 nt, Homo sapiens
ccacaucuccug

SEQ ID NO: 1312315 - RNA, 17 nt, Homo sapiens
ccacaucuugcucugcu

SEQ ID NO: 1312316 - RNA, 14 nt, Homo sapiens
ccacaugugcacau

SEQ ID NO: 1312317 - RNA, 13 nt, Homo sapiens
ccacauugcacuu

SEQ ID NO: 1312318 - RNA, 23 nt, Homo sapiens
ccacauuuagauccugguuucau

SEQ ID NO: 1312319 - RNA, 13 nt, Homo sapiens
ccaccaaccaaga

SEQ ID NO: 1312320 - RNA, 13 nt, Homo sapiens
ccaccacuauaaa

SEQ ID NO: 1312321 - RNA, 22 nt, Homo sapiens
ccaccacuauaaaaugucuuca

SEQ ID NO: 1312322 - RNA, 19 nt, Homo sapiens
ccaccaggugccuuucaaa

SEQ ID NO: 1312323 - RNA, 18 nt, Homo sapiens
ccaccaguaugacaguau

SEQ ID NO: 1312324 - RNA, 16 nt, Homo sapiens
ccaccccaaauuaaaa

SEQ ID NO: 1312325 - RNA, 22 nt, Homo sapiens
ccacccucauucuacugaaaag

SEQ ID NO: 1312326 - RNA, 14 nt, Homo sapiens
ccaccugucccacu

SEQ ID NO: 1312327 - RNA, 13 nt, Homo sapiens
ccaccugucucag

SEQ ID NO: 1312328 - RNA, 21 nt, Homo sapiens
ccacgcggccccacauugcac

SEQ ID NO: 1312329 - RNA, 15 nt, Homo sapiens
ccacggccaggccag

SEQ ID NO: 1312330 - RNA, 16 nt, Homo sapiens
ccacgucaacagaauu

SEQ ID NO: 1312331 - RNA, 22 nt, Homo sapiens
ccacguccagcuggaaggguca

SEQ ID NO: 1312332 - RNA, 19 nt, Homo sapiens
ccacgugggcaaacaggca

SEQ ID NO: 1312333 - RNA, 21 nt, Homo sapiens
ccacgugggcaaacaggcagu

SEQ ID NO: 1312334 - RNA, 20 nt, Homo sapiens
ccacguugccucuacuuuau

SEQ ID NO: 1312335 - RNA, 18 nt, Homo sapiens
ccacuagacaaguccagc

SEQ ID NO: 1312336 - RNA, 18 nt, Homo sapiens
ccacuagugcaaaucaua

SEQ ID NO: 1312337 - RNA, 16 nt, Homo sapiens
ccacucucuaccagau

SEQ ID NO: 1312338 - RNA, 22 nt, Homo sapiens
ccacucugaaguaagagcaaug

SEQ ID NO: 1312339 - RNA, 12 nt, Homo sapiens
ccacugccugag

SEQ ID NO: 1312340 - RNA, 19 nt, Homo sapiens
ccacugggaccaacccugg

SEQ ID NO: 1312341 - RNA, 19 nt, Homo sapiens
ccacugugaagagaaccau

SEQ ID NO: 1312342 - RNA, 22 nt, Homo sapiens
ccacuuacagaucuaucuccuc

SEQ ID NO: 1312343 - RNA, 12 nt, Homo sapiens
ccacuucugcca

SEQ ID NO: 1312344 - RNA, 13 nt, Homo sapiens
ccagaagcacugg

SEQ ID NO: 1312345 - RNA, 20 nt, Homo sapiens
ccagaaucucauuacugcuu

SEQ ID NO: 1312346 - RNA, 19 nt, Homo sapiens
ccagaauguugcuuucuga

SEQ ID NO: 1312347 - RNA, 19 nt, Homo sapiens
ccagacaucaccaacuguc

SEQ ID NO: 1312348 - RNA, 11 nt, Homo sapiens
ccagacauucu

SEQ ID NO: 1312349 - RNA, 14 nt, Homo sapiens
ccagacggucagga

SEQ ID NO: 1312350 - RNA, 22 nt, Homo sapiens
ccagagccaggggggugaggag

SEQ ID NO: 1312351 - RNA, 14 nt, Homo sapiens
ccagagcccagcuc

SEQ ID NO: 1312352 - RNA, 17 nt, Homo sapiens
ccagagcccagcuccaa

SEQ ID NO: 1312353 - RNA, 15 nt, Homo sapiens
ccagagccucaguga

SEQ ID NO: 1312354 - RNA, 15 nt, Homo sapiens
ccagaggcaccucaa

SEQ ID NO: 1312355 - RNA, 17 nt, Homo sapiens
ccagaggccaacacugu

SEQ ID NO: 1312356 - RNA, 12 nt, Homo sapiens
ccagauccagcc

SEQ ID NO: 1312357 - RNA, 15 nt, Homo sapiens
ccagauggacuccag

SEQ ID NO: 1312358 - RNA, 23 nt, Homo sapiens
ccagaugggggaaagcacaggug

SEQ ID NO: 1312359 - RNA, 22 nt, Homo sapiens
ccagauuggauauggacucuuu

SEQ ID NO: 1312360 - RNA, 19 nt, Homo sapiens
ccagauuggcucacacuga

SEQ ID NO: 1312361 - RNA, 21 nt, Homo sapiens
ccagauuggcucacacugaga

SEQ ID NO: 1312362 - RNA, 23 nt, Homo sapiens
ccagauuggcucacacugagaau

SEQ ID NO: 1312363 - RNA, 16 nt, Homo sapiens
ccagcaaccagcacau

SEQ ID NO: 1312364 - RNA, 14 nt, Homo sapiens
ccagcacacagggc

SEQ ID NO: 1312365 - RNA, 19 nt, Homo sapiens
ccagcacccccagugcagc

SEQ ID NO: 1312366 - RNA, 16 nt, Homo sapiens
ccagcacuuugggagg

SEQ ID NO: 1312367 - RNA, 21 nt, Homo sapiens
ccagcagaaccagccucaaaa

SEQ ID NO: 1312368 - RNA, 19 nt, Homo sapiens
ccagcaucccuugaccagg

SEQ ID NO: 1312369 - RNA, 19 nt, Homo sapiens
ccagccagaggaugcauag

SEQ ID NO: 1312370 - RNA, 23 nt, Homo sapiens
ccagccccucucccugugcugug

SEQ ID NO: 1312371 - RNA, 16 nt, Homo sapiens
ccagccugccuggcag

SEQ ID NO: 1312372 - RNA, 19 nt, Homo sapiens
ccagccugccuguccucca

SEQ ID NO: 1312373 - RNA, 22 nt, Homo sapiens
ccagccugcuaauuccccagau

SEQ ID NO: 1312374 - RNA, 21 nt, Homo sapiens
ccagccugcuagcuagcucaa

SEQ ID NO: 1312375 - RNA, 12 nt, Homo sapiens
ccagccugcuuu

SEQ ID NO: 1312376 - RNA, 15 nt, Homo sapiens
ccagccugggugaca

SEQ ID NO: 1312377 - RNA, 16 nt, Homo sapiens
ccagcgagcucucaaa

SEQ ID NO: 1312378 - RNA, 18 nt, Homo sapiens
ccagcgugugacuacucc

SEQ ID NO: 1312379 - RNA, 21 nt, Homo sapiens
ccagcuccaaccugcaaagau

SEQ ID NO: 1312380 - RNA, 15 nt, Homo sapiens
ccagcuccucacuca

SEQ ID NO: 1312381 - RNA, 18 nt, Homo sapiens
ccagcuccucacucaccu

SEQ ID NO: 1312382 - RNA, 23 nt, Homo sapiens
ccagcugcgccugcgcugcagga

SEQ ID NO: 1312383 - RNA, 23 nt, Homo sapiens
ccagcugggucaggcagggugca

SEQ ID NO: 1312384 - RNA, 14 nt, Homo sapiens
ccagcuuaucucag

SEQ ID NO: 1312385 - RNA, 21 nt, Homo sapiens
ccaggacuauauuugggccug

SEQ ID NO: 1312386 - RNA, 18 nt, Homo sapiens
ccaggcaggucuugaacu

SEQ ID NO: 1312387 - RNA, 21 nt, Homo sapiens
ccaggccaccuccccagcauu

SEQ ID NO: 1312388 - RNA, 15 nt, Homo sapiens
ccaggccccaggaag

SEQ ID NO: 1312389 - RNA, 14 nt, Homo sapiens
ccaggccugccaag

SEQ ID NO: 1312390 - RNA, 15 nt, Homo sapiens
ccaggccugggaaug

SEQ ID NO: 1312391 - RNA, 19 nt, Homo sapiens
ccaggcugaccacagcaca

SEQ ID NO: 1312392 - RNA, 18 nt, Homo sapiens
ccaggcuggcgugcagug

SEQ ID NO: 1312393 - RNA, 19 nt, Homo sapiens
ccaggcuugucacuagcag

SEQ ID NO: 1312394 - RNA, 18 nt, Homo sapiens
ccagggaugauucaagcc

SEQ ID NO: 1312395 - RNA, 18 nt, Homo sapiens
ccagggcucuaauguguc

SEQ ID NO: 1312396 - RNA, 15 nt, Homo sapiens
ccagggcugcaaugc

SEQ ID NO: 1312397 - RNA, 10 nt, Homo sapiens
ccaggggaug

SEQ ID NO: 1312398 - RNA, 13 nt, Homo sapiens
ccagggucucacu

SEQ ID NO: 1312399 - RNA, 22 nt, Homo sapiens
ccucucagaugggcagcagcuu

SEQ ID NO: 1312400 - RNA, 16 nt, Homo sapiens
ccucucuuauagaaua

SEQ ID NO: 1312401 - RNA, 14 nt, Homo sapiens
ccucugaaaaccaa

SEQ ID NO: 1312402 - RNA, 12 nt, Homo sapiens
ccucugacucag

SEQ ID NO: 1312403 - RNA, 14 nt, Homo sapiens
ccucugcauuuaca

SEQ ID NO: 1312404 - RNA, 13 nt, Homo sapiens
ccucuggacaaag

SEQ ID NO: 1312405 - RNA, 19 nt, Homo sapiens
ccucugucagucacagcca

SEQ ID NO: 1312406 - RNA, 17 nt, Homo sapiens
ccucuucaccuuauuca

SEQ ID NO: 1312407 - RNA, 21 nt, Homo sapiens
ccucuucucuacucuagggaa

SEQ ID NO: 1312408 - RNA, 20 nt, Homo sapiens
ccucuuuguuucugcuucau

SEQ ID NO: 1312409 - RNA, 20 nt, Homo sapiens
ccugaagucacacagugagu

SEQ ID NO: 1312410 - RNA, 23 nt, Homo sapiens
ccugacaaggccagcacccaaag

SEQ ID NO: 1312411 - RNA, 21 nt, Homo sapiens
ccugagauucagaugucauuu

SEQ ID NO: 1312412 - RNA, 16 nt, Homo sapiens
ccugagauuucaucug

SEQ ID NO: 1312413 - RNA, 22 nt, Homo sapiens
ccugagguuugccagcauuuag

SEQ ID NO: 1312414 - RNA, 18 nt, Homo sapiens
ccugauguuuacaguguc

SEQ ID NO: 1312415 - RNA, 16 nt, Homo sapiens
ccugauuaacugaggc

SEQ ID NO: 1312416 - RNA, 12 nt, Homo sapiens
ccugauuuacua

SEQ ID NO: 1312417 - RNA, 17 nt, Homo sapiens
ccugcaaaaggacucuc

SEQ ID NO: 1312418 - RNA, 12 nt, Homo sapiens
ccugcacacuca

SEQ ID NO: 1312419 - RNA, 17 nt, Homo sapiens
ccugcagcccaugguga

SEQ ID NO: 1312420 - RNA, 15 nt, Homo sapiens
ccugcccaccuguca

SEQ ID NO: 1312421 - RNA, 22 nt, Homo sapiens
ccugccccaauucaauccugcc

SEQ ID NO: 1312422 - RNA, 17 nt, Homo sapiens
ccugcccguaaacacgc

SEQ ID NO: 1312423 - RNA, 17 nt, Homo sapiens
ccugcgaggagaaauca

SEQ ID NO: 1312424 - RNA, 23 nt, Homo sapiens
ccugcgggugaacaaagcagcca

SEQ ID NO: 1312425 - RNA, 20 nt, Homo sapiens
ccugcucacaguccucauuu

SEQ ID NO: 1312426 - RNA, 13 nt, Homo sapiens
ccugcuccagaag

SEQ ID NO: 1312427 - RNA, 10 nt, Homo sapiens
ccugcuggag

SEQ ID NO: 1312428 - RNA, 16 nt, Homo sapiens
ccuggacaugccuguc

SEQ ID NO: 1312429 - RNA, 14 nt, Homo sapiens
ccuggagauccucc

SEQ ID NO: 1312430 - RNA, 19 nt, Homo sapiens
ccuggagcccauccagucu

SEQ ID NO: 1312431 - RNA, 19 nt, Homo sapiens
ccuggaugggcuucacugg

SEQ ID NO: 1312432 - RNA, 12 nt, Homo sapiens
ccuggcacugga

SEQ ID NO: 1312433 - RNA, 16 nt, Homo sapiens
ccuggccaaagggaua

SEQ ID NO: 1312434 - RNA, 17 nt, Homo sapiens
cuagugaauguaaaaug

SEQ ID NO: 1312435 - RNA, 19 nt, Homo sapiens
cuagugaauguaaaaugca

SEQ ID NO: 1312436 - RNA, 22 nt, Homo sapiens
cuagugaauguaaaaugcaaaa

SEQ ID NO: 1312437 - RNA, 14 nt, Homo sapiens
cuaguguaccuccu

SEQ ID NO: 1312438 - RNA, 18 nt, Homo sapiens
cuaguguaccuccucuca

SEQ ID NO: 1312439 - RNA, 18 nt, Homo sapiens
cuaguguucuguuuguua

SEQ ID NO: 1312440 - RNA, 14 nt, Homo sapiens
cuaguguugcuugg

SEQ ID NO: 1312441 - RNA, 16 nt, Homo sapiens
cuaguucuguagaaau

SEQ ID NO: 1312442 - RNA, 14 nt, Homo sapiens
cuauaacuaagcau

SEQ ID NO: 1312443 - RNA, 17 nt, Homo sapiens
cuauaaggaagauuugg

SEQ ID NO: 1312444 - RNA, 19 nt, Homo sapiens
cuauaaucccagcacuuug

SEQ ID NO: 1312445 - RNA, 23 nt, Homo sapiens
cuauaguuauuaaguucuuuaaa

SEQ ID NO: 1312446 - RNA, 13 nt, Homo sapiens
cuauaugauuuca

SEQ ID NO: 1312447 - RNA, 13 nt, Homo sapiens
cuauaugcuuacu

SEQ ID NO: 1312448 - RNA, 16 nt, Homo sapiens
cuauaugcuuacugug

SEQ ID NO: 1312449 - RNA, 17 nt, Homo sapiens
cuauauuuauacuguau

SEQ ID NO: 1312450 - RNA, 18 nt, Homo sapiens
cuauauuuugucauauca

SEQ ID NO: 1312451 - RNA, 21 nt, Homo sapiens
cuaucaaccuaagcaacagaa

SEQ ID NO: 1312452 - RNA, 23 nt, Homo sapiens
cuaucagcauuuuacuacuuuaa

SEQ ID NO: 1312453 - RNA, 16 nt, Homo sapiens
cuaucauggugaaaag

SEQ ID NO: 1312454 - RNA, 19 nt, Homo sapiens
cuaucauggugaaaagcuc

SEQ ID NO: 1312455 - RNA, 15 nt, Homo sapiens
cuaucugucauacau

SEQ ID NO: 1312456 - RNA, 13 nt, Homo sapiens
cuaugaagacagg

SEQ ID NO: 1312457 - RNA, 18 nt, Homo sapiens
cuaugauaauuacaauac

SEQ ID NO: 1312458 - RNA, 22 nt, Homo sapiens
cuaugauucguguaauuacuua

SEQ ID NO: 1312459 - RNA, 15 nt, Homo sapiens
cuaugcagaggccug

SEQ ID NO: 1312460 - RNA, 17 nt, Homo sapiens
cuauggcugccugcauc

SEQ ID NO: 1312461 - RNA, 11 nt, Homo sapiens
cuaugggacuc

SEQ ID NO: 1312462 - RNA, 19 nt, Homo sapiens
cuauguugcccaggcaggu

SEQ ID NO: 1312463 - RNA, 13 nt, Homo sapiens
cuauuauccuucu

SEQ ID NO: 1312464 - RNA, 15 nt, Homo sapiens
cuauuccauucccuu

SEQ ID NO: 1312465 - RNA, 19 nt, Homo sapiens
cuauuggccucccaaaaga

SEQ ID NO: 1312466 - RNA, 19 nt, Homo sapiens
cuauuuauauguacaugag

SEQ ID NO: 1312467 - RNA, 17 nt, Homo sapiens
cuauuucuagagacaac

SEQ ID NO: 1312468 - RNA, 16 nt, Homo sapiens
cuauuuggaacccaag

SEQ ID NO: 1312469 - RNA, 15 nt, Homo sapiens
cuauuuuauucccuu

SEQ ID NO: 1312470 - RNA, 22 nt, Homo sapiens
cuauuuuuugacacuuccauug

SEQ ID NO: 1312471 - RNA, 22 nt, Homo sapiens
cucuccuuuuauguggucucuu

SEQ ID NO: 1312472 - RNA, 13 nt, Homo sapiens
cucucucucucuc

SEQ ID NO: 1312473 - RNA, 13 nt, Homo sapiens
cucucucuguggg

SEQ ID NO: 1312474 - RNA, 13 nt, Homo sapiens
cucucuggucuuu

SEQ ID NO: 1312475 - RNA, 15 nt, Homo sapiens
cucucugucucucug

SEQ ID NO: 1312476 - RNA, 18 nt, Homo sapiens
cucugacucagggcuccu

SEQ ID NO: 1312477 - RNA, 21 nt, Homo sapiens
cucugaggacacuaaccacgc

SEQ ID NO: 1312478 - RNA, 12 nt, Homo sapiens
cucugaugcuga

SEQ ID NO: 1312479 - RNA, 19 nt, Homo sapiens
cucugcaccguacugugga

SEQ ID NO: 1312480 - RNA, 22 nt, Homo sapiens
cucugcauccagagauucauuu

SEQ ID NO: 1312481 - RNA, 18 nt, Homo sapiens
cucugcauggaacagcau

SEQ ID NO: 1312482 - RNA, 24 nt, Homo sapiens
cucugcugccgccccacccagaug

SEQ ID NO: 1312483 - RNA, 23 nt, Homo sapiens
cucuggcugcucccugacagcac

SEQ ID NO: 1312484 - RNA, 13 nt, Homo sapiens
cucugguggcaca

SEQ ID NO: 1312485 - RNA, 10 nt, Homo sapiens
cucuguccag

SEQ ID NO: 1312486 - RNA, 17 nt, Homo sapiens
cucugucgugagugucu

SEQ ID NO: 1312487 - RNA, 20 nt, Homo sapiens
cucugugccccucaugcuga

SEQ ID NO: 1312488 - RNA, 20 nt, Homo sapiens
cucugugggauaucacauca

SEQ ID NO: 1312489 - RNA, 18 nt, Homo sapiens
cucugugggcuccaugua

SEQ ID NO: 1312490 - RNA, 14 nt, Homo sapiens
cucugugucaggug

SEQ ID NO: 1312491 - RNA, 18 nt, Homo sapiens
cucuuaagcuaagacuga

SEQ ID NO: 1312492 - RNA, 14 nt, Homo sapiens
cucuuagcaaaaac

SEQ ID NO: 1312493 - RNA, 14 nt, Homo sapiens
cucuucaaaugccu

SEQ ID NO: 1312494 - RNA, 20 nt, Homo sapiens
cucuucagcacugucuuguc

SEQ ID NO: 1312495 - RNA, 16 nt, Homo sapiens
cucuucaguuaauucu

SEQ ID NO: 1312496 - RNA, 20 nt, Homo sapiens
cucuucccggagaauccagc

SEQ ID NO: 1312497 - RNA, 17 nt, Homo sapiens
cucuucucaaagcuggg

SEQ ID NO: 1312498 - RNA, 16 nt, Homo sapiens
cucuucuugacaucaa

SEQ ID NO: 1312499 - RNA, 12 nt, Homo sapiens
cucuugaacccc

SEQ ID NO: 1312500 - RNA, 14 nt, Homo sapiens
cucuuggcagucac

SEQ ID NO: 1312501 - RNA, 21 nt, Homo sapiens
cucuuguauaugaugaucugg

SEQ ID NO: 1312502 - RNA, 17 nt, Homo sapiens
cucuuguuuucucucuc

SEQ ID NO: 1312503 - RNA, 18 nt, Homo sapiens
cucuuucuguauauacuu

SEQ ID NO: 1312504 - RNA, 13 nt, Homo sapiens
cucuuuugcacau

SEQ ID NO: 1312505 - RNA, 19 nt, Homo sapiens
cugaaaacacugugcacau

SEQ ID NO: 1312506 - RNA, 16 nt, Homo sapiens
cugaaacaacuuggaa

SEQ ID NO: 1312507 - RNA, 18 nt, Homo sapiens
cugaaaccuuaguuucaa

SEQ ID NO: 1312508 - RNA, 18 nt, Homo sapiens
cugaaacuuugaggauaa

SEQ ID NO: 1312509 - RNA, 18 nt, Homo sapiens
cugaacugagccuagcua

SEQ ID NO: 1312510 - RNA, 15 nt, Homo sapiens
cugaagaacaguaac

SEQ ID NO: 1312511 - RNA, 22 nt, Homo sapiens
cugaagaacaguaacugccauc

SEQ ID NO: 1312512 - RNA, 13 nt, Homo sapiens
cugaagcagguuc

SEQ ID NO: 1312513 - RNA, 16 nt, Homo sapiens
cugaagccaaagccaa

SEQ ID NO: 1312514 - RNA, 19 nt, Homo sapiens
cugaaggagccccauuccu

SEQ ID NO: 1312515 - RNA, 12 nt, Homo sapiens
cugacacaguca

SEQ ID NO: 1312516 - RNA, 13 nt, Homo sapiens
cugacaguagccu

SEQ ID NO: 1312517 - RNA, 22 nt, Homo sapiens
cugacagugugggacaggcucu

SEQ ID NO: 1312518 - RNA, 16 nt, Homo sapiens
cugacaguuuguggca

SEQ ID NO: 1312519 - RNA, 11 nt, Homo sapiens
cugacauugcc

SEQ ID NO: 1312520 - RNA, 23 nt, Homo sapiens
cugaccaaacagccaacuagccc

SEQ ID NO: 1312521 - RNA, 11 nt, Homo sapiens
cugacccugua

SEQ ID NO: 1312522 - RNA, 19 nt, Homo sapiens
cugacccuguaaaauggag

SEQ ID NO: 1312523 - RNA, 19 nt, Homo sapiens
cugacucucgugcauuuca

SEQ ID NO: 1312524 - RNA, 16 nt, Homo sapiens
cugacuuuuaauguca

SEQ ID NO: 1312525 - RNA, 17 nt, Homo sapiens
cugagaacacugugaaa

SEQ ID NO: 1312526 - RNA, 20 nt, Homo sapiens
cugagaauauaauacuguau

SEQ ID NO: 1312527 - RNA, 15 nt, Homo sapiens
cugagagaaccucac

SEQ ID NO: 1312528 - RNA, 15 nt, Homo sapiens
cugagagaguagcag

SEQ ID NO: 1312529 - RNA, 14 nt, Homo sapiens
cugagauacauaca

SEQ ID NO: 1312530 - RNA, 19 nt, Homo sapiens
cugagauacauacagaauu

SEQ ID NO: 1312531 - RNA, 14 nt, Homo sapiens
cugagauaccagcg

SEQ ID NO: 1312532 - RNA, 23 nt, Homo sapiens
cugagcagugcuugaaugaaguu

SEQ ID NO: 1312533 - RNA, 14 nt, Homo sapiens
cugagccaguuucc

SEQ ID NO: 1312534 - RNA, 18 nt, Homo sapiens
cugagcuguaucuugaug

SEQ ID NO: 1312535 - RNA, 22 nt, Homo sapiens
cugaggcaagagaauugcuuga

SEQ ID NO: 1312536 - RNA, 15 nt, Homo sapiens
cugaggcauccucug

SEQ ID NO: 1312537 - RNA, 20 nt, Homo sapiens
cugaggccacacucagcaca

SEQ ID NO: 1312538 - RNA, 22 nt, Homo sapiens
cugaggccacacucagcacaag

SEQ ID NO: 1312539 - RNA, 22 nt, Homo sapiens
cugaggccccucuccaagagga

SEQ ID NO: 1312540 - RNA, 15 nt, Homo sapiens
cugagggcaguucug

SEQ ID NO: 1312541 - RNA, 17 nt, Homo sapiens
cugaggguaucugacaa

SEQ ID NO: 1312542 - RNA, 14 nt, Homo sapiens
cugagguaaaaacu

SEQ ID NO: 1312543 - RNA, 12 nt, Homo sapiens
cugaguagaaag

SEQ ID NO: 1312544 - RNA, 15 nt, Homo sapiens
cugaguauaaauuua

SEQ ID NO: 1312545 - RNA, 18 nt, Homo sapiens
cugaguauaaauuuacuu

SEQ ID NO: 1312546 - RNA, 18 nt, Homo sapiens
cugagugaaauacuguac

SEQ ID NO: 1312547 - RNA, 21 nt, Homo sapiens
cugauaauuauuuuaaagggg

SEQ ID NO: 1312548 - RNA, 21 nt, Homo sapiens
cugauacaaauugcagacugu

SEQ ID NO: 1312549 - RNA, 18 nt, Homo sapiens
cugauccauaaagacaau

SEQ ID NO: 1312550 - RNA, 16 nt, Homo sapiens
cugauccucacacuuc

SEQ ID NO: 1312551 - RNA, 19 nt, Homo sapiens
cugaucuuauucuguggug

SEQ ID NO: 1312552 - RNA, 15 nt, Homo sapiens
cugaugcugccccuc

SEQ ID NO: 1312553 - RNA, 19 nt, Homo sapiens
cugauucccaagcucugcu

SEQ ID NO: 1312554 - RNA, 22 nt, Homo sapiens
cugauuuaggagaagccaggaa

SEQ ID NO: 1312555 - RNA, 15 nt, Homo sapiens
cugauuucugagcau

SEQ ID NO: 1312556 - RNA, 17 nt, Homo sapiens
cugcaaaggacagaucc

SEQ ID NO: 1312557 - RNA, 20 nt, Homo sapiens
cugcaacuuaaugcucugau

SEQ ID NO: 1312558 - RNA, 12 nt, Homo sapiens
cugcaagagcca

SEQ ID NO: 1312559 - RNA, 19 nt, Homo sapiens
cugcacaaacucaccaucu

SEQ ID NO: 1312560 - RNA, 18 nt, Homo sapiens
cugcacagcuuacacugu

SEQ ID NO: 1312561 - RNA, 22 nt, Homo sapiens
cugcacaguggggagcauggag

SEQ ID NO: 1312562 - RNA, 16 nt, Homo sapiens
cugcacccacccagga

SEQ ID NO: 1312563 - RNA, 19 nt, Homo sapiens
cugcaccccugcaguuuga

SEQ ID NO: 1312564 - RNA, 15 nt, Homo sapiens
cugcaccuugccagg

SEQ ID NO: 1312565 - RNA, 21 nt, Homo sapiens
cugcagaguuacuaacuucuc

SEQ ID NO: 1312566 - RNA, 20 nt, Homo sapiens
aggaauauagaaugaaagac

SEQ ID NO: 1312567 - RNA, 16 nt, Homo sapiens
aggaauccacucccag

SEQ ID NO: 1312568 - RNA, 12 nt, Homo sapiens
aggaaucucaga

SEQ ID NO: 1312569 - RNA, 17 nt, Homo sapiens
aggacaaggauguucac

SEQ ID NO: 1312570 - RNA, 21 nt, Homo sapiens
aggacaagggaaaugucaggg

SEQ ID NO: 1312571 - RNA, 14 nt, Homo sapiens
aggacacagaugaa

SEQ ID NO: 1312572 - RNA, 21 nt, Homo sapiens
aggacaugaaaaauugcuaug

SEQ ID NO: 1312573 - RNA, 23 nt, Homo sapiens
aggacaugcgguagccagcacac

SEQ ID NO: 1312574 - RNA, 20 nt, Homo sapiens
aggaccaggcaaugugacuu

SEQ ID NO: 1312575 - RNA, 11 nt, Homo sapiens
aggacccaagc

SEQ ID NO: 1312576 - RNA, 22 nt, Homo sapiens
aggacccugaaggggccaugau

SEQ ID NO: 1312577 - RNA, 14 nt, Homo sapiens
aggaccugccugua

SEQ ID NO: 1312578 - RNA, 17 nt, Homo sapiens
aggacuaauccaauacc

SEQ ID NO: 1312579 - RNA, 19 nt, Homo sapiens
gaccccaaaggaacacuga

SEQ ID NO: 1312580 - RNA, 13 nt, Homo sapiens
gaccccagcagcu

SEQ ID NO: 1312581 - RNA, 17 nt, Homo sapiens
gaccccagcauucucag

SEQ ID NO: 1312582 - RNA, 14 nt, Homo sapiens
gacccucuaaccuc

SEQ ID NO: 1312583 - RNA, 20 nt, Homo sapiens
gaccucaggugauccaccca

SEQ ID NO: 1312584 - RNA, 14 nt, Homo sapiens
gaccugacaccuuu

SEQ ID NO: 1312585 - RNA, 17 nt, Homo sapiens
gaccugacaccuuucau

SEQ ID NO: 1312586 - RNA, 12 nt, Homo sapiens
gaccugcuucua

SEQ ID NO: 1312587 - RNA, 17 nt, Homo sapiens
gaccuggaaucagugaa

SEQ ID NO: 1312588 - RNA, 23 nt, Homo sapiens
gaccuggcaaggacacagaugaa

SEQ ID NO: 1312589 - RNA, 16 nt, Homo sapiens
gaccuggcagcucugg

SEQ ID NO: 1312590 - RNA, 21 nt, Homo sapiens
gaccuguuuaugagaugcugg

SEQ ID NO: 1312591 - RNA, 17 nt, Homo sapiens
gaccuuaggccuuccuc

SEQ ID NO: 1312592 - RNA, 18 nt, Homo sapiens
gaccuuaugagaaacugc

SEQ ID NO: 1312593 - RNA, 14 nt, Homo sapiens
gaccuucagcucac

SEQ ID NO: 1312594 - RNA, 14 nt, Homo sapiens
gacgaaaguggaaa

SEQ ID NO: 1312595 - RNA, 22 nt, Homo sapiens
gacgcaaugggaggcagggaca

SEQ ID NO: 1312596 - RNA, 18 nt, Homo sapiens
gacggccggggacugccu

SEQ ID NO: 1312597 - RNA, 22 nt, Homo sapiens
gacggucaguccaugucucgga

SEQ ID NO: 1312598 - RNA, 18 nt, Homo sapiens
gacggugcccaagccaga

SEQ ID NO: 1312599 - RNA, 23 nt, Homo sapiens
gacggugggccuggcacacgccu

SEQ ID NO: 1312600 - RNA, 24 nt, Homo sapiens
gacggugucuuguucugucacuca

SEQ ID NO: 1312601 - RNA, 15 nt, Homo sapiens
gacguuguguaaugu

SEQ ID NO: 1312602 - RNA, 21 nt, Homo sapiens
gacuaagggcgcuugucccau

SEQ ID NO: 1312603 - RNA, 14 nt, Homo sapiens
gacuaauuucaaaa

SEQ ID NO: 1312604 - RNA, 16 nt, Homo sapiens
gacuagaugauggaug

SEQ ID NO: 1312605 - RNA, 15 nt, Homo sapiens
gacuauguagcaaua

SEQ ID NO: 1312606 - RNA, 14 nt, Homo sapiens
gacuauucuaauga

SEQ ID NO: 1312607 - RNA, 22 nt, Homo sapiens
gacucaaaaauagggaaguaac

SEQ ID NO: 1312608 - RNA, 16 nt, Homo sapiens
gacucaaucuacaggc

SEQ ID NO: 1312609 - RNA, 17 nt, Homo sapiens
gacucaaugcacugaca

SEQ ID NO: 1312610 - RNA, 16 nt, Homo sapiens
gacucaggacaucccc

SEQ ID NO: 1312611 - RNA, 13 nt, Homo sapiens
gacuccaguuaaa

SEQ ID NO: 1312612 - RNA, 14 nt, Homo sapiens
gacuccaucucuca

SEQ ID NO: 1312613 - RNA, 16 nt, Homo sapiens
gacuccuaacuacagg

SEQ ID NO: 1312614 - RNA, 14 nt, Homo sapiens
gacucgggccuuag

SEQ ID NO: 1312615 - RNA, 16 nt, Homo sapiens
gacucgguuucuccaa

SEQ ID NO: 1312616 - RNA, 12 nt, Homo sapiens
gacucugacccc

SEQ ID NO: 1312617 - RNA, 14 nt, Homo sapiens
gacugaagcaaaga

SEQ ID NO: 1312618 - RNA, 22 nt, Homo sapiens
gacugcacagcguccuguccac

SEQ ID NO: 1312619 - RNA, 17 nt, Homo sapiens
gacuggguuacauaugc

SEQ ID NO: 1312620 - RNA, 20 nt, Homo sapiens
gacuggguuuugugauugcc

SEQ ID NO: 1312621 - RNA, 12 nt, Homo sapiens
gacuuauguaau

SEQ ID NO: 1312622 - RNA, 16 nt, Homo sapiens
gacuucagccagguga

SEQ ID NO: 1312623 - RNA, 19 nt, Homo sapiens
gacuuccauuugcuuuguc

SEQ ID NO: 1312624 - RNA, 17 nt, Homo sapiens
gacuucugccuggagac

SEQ ID NO: 1312625 - RNA, 20 nt, Homo sapiens
gacuuguuuuaugcucaggg

SEQ ID NO: 1312626 - RNA, 19 nt, Homo sapiens
gacuuuacgcccaucucag

SEQ ID NO: 1312627 - RNA, 15 nt, Homo sapiens
gacuuuaggcuuuca

SEQ ID NO: 1312628 - RNA, 19 nt, Homo sapiens
gacuuuguccccacuuaca

SEQ ID NO: 1312629 - RNA, 20 nt, Homo sapiens
gagaaagggcggugaacucu

SEQ ID NO: 1312630 - RNA, 15 nt, Homo sapiens
gagaaauggaugugu

SEQ ID NO: 1312631 - RNA, 14 nt, Homo sapiens
gagaacaaccaaaa

SEQ ID NO: 1312632 - RNA, 13 nt, Homo sapiens
gagaacacuguga

SEQ ID NO: 1312633 - RNA, 12 nt, Homo sapiens
gagaacaggacu

SEQ ID NO: 1312634 - RNA, 15 nt, Homo sapiens
gagaaccucagauca

SEQ ID NO: 1312635 - RNA, 18 nt, Homo sapiens
gagaacucugagcagugc

SEQ ID NO: 1312636 - RNA, 22 nt, Homo sapiens
gagaagaaaacaucuauucucu

SEQ ID NO: 1312637 - RNA, 22 nt, Homo sapiens
gagaagaaaauggaaccaggcu

SEQ ID NO: 1312638 - RNA, 20 nt, Homo sapiens
gagaagccacaggccugaga

SEQ ID NO: 1312639 - RNA, 16 nt, Homo sapiens
gagaaggaaagugauu

SEQ ID NO: 1312640 - RNA, 23 nt, Homo sapiens
gagaaggcuauguaaacaaacca

SEQ ID NO: 1312641 - RNA, 14 nt, Homo sapiens
gagaaggugccugc

SEQ ID NO: 1312642 - RNA, 18 nt, Homo sapiens
gagaaucagaucauuuca

SEQ ID NO: 1312643 - RNA, 21 nt, Homo sapiens
gagaaucccaaauuugauuga

SEQ ID NO: 1312644 - RNA, 16 nt, Homo sapiens
gagaauguaagaacua

SEQ ID NO: 1312645 - RNA, 23 nt, Homo sapiens
gagaauguuagaggaucccucuc

SEQ ID NO: 1312646 - RNA, 15 nt, Homo sapiens
gagacacacacacag

SEQ ID NO: 1312647 - RNA, 19 nt, Homo sapiens
gagacagaguuuucacucu

SEQ ID NO: 1312648 - RNA, 22 nt, Homo sapiens
gagacagguggccuagcaggca

SEQ ID NO: 1312649 - RNA, 14 nt, Homo sapiens
gagacagugaggcu

SEQ ID NO: 1312650 - RNA, 14 nt, Homo sapiens
gagacauacuugaa

SEQ ID NO: 1312651 - RNA, 17 nt, Homo sapiens
gagacccaagcugccuc

SEQ ID NO: 1312652 - RNA, 21 nt, Homo sapiens
gagacuacaggugugugucca

SEQ ID NO: 1312653 - RNA, 19 nt, Homo sapiens
gagacuccuaggcaggaca

SEQ ID NO: 1312654 - RNA, 22 nt, Homo sapiens
gagacuccuaggcaggacaugc

SEQ ID NO: 1312655 - RNA, 19 nt, Homo sapiens
gagacucgagaacuuucau

SEQ ID NO: 1312656 - RNA, 13 nt, Homo sapiens
gagacucugucuc

SEQ ID NO: 1312657 - RNA, 13 nt, Homo sapiens
gagagaaagggag

SEQ ID NO: 1312658 - RNA, 13 nt, Homo sapiens
gagagaacuggag

SEQ ID NO: 1312659 - RNA, 15 nt, Homo sapiens
gagagcagaggucuc

SEQ ID NO: 1312660 - RNA, 11 nt, Homo sapiens
gagagccaaac

SEQ ID NO: 1312661 - RNA, 13 nt, Homo sapiens
gagagccaaacag

SEQ ID NO: 1312662 - RNA, 14 nt, Homo sapiens
gagagcccaugaga

SEQ ID NO: 1312663 - RNA, 14 nt, Homo sapiens
gagaggaucaucug

SEQ ID NO: 1312664 - RNA, 22 nt, Homo sapiens
gagaggcccucuggaguggcca

SEQ ID NO: 1312665 - RNA, 22 nt, Homo sapiens
gagagucgcaucucagugcagg

SEQ ID NO: 1312666 - RNA, 20 nt, Homo sapiens
gagaucaucacuuccuugcc

SEQ ID NO: 1312667 - RNA, 18 nt, Homo sapiens
gagaugaaccacauuaua

SEQ ID NO: 1312668 - RNA, 20 nt, Homo sapiens
gauuuccaaaagacuugaag

SEQ ID NO: 1312669 - RNA, 13 nt, Homo sapiens
gauuugcacagaa

SEQ ID NO: 1312670 - RNA, 15 nt, Homo sapiens
gauuuggugaccaac

SEQ ID NO: 1312671 - RNA, 22 nt, Homo sapiens
gauuuuuugcauuccugacaaa

SEQ ID NO: 1312672 - RNA, 20 nt, Homo sapiens
gcaaaaccucaucauuacua

SEQ ID NO: 1312673 - RNA, 21 nt, Homo sapiens
gcaaaacucuacuuaauccaa

SEQ ID NO: 1312674 - RNA, 18 nt, Homo sapiens
gcaaaauacaugacauuu

SEQ ID NO: 1312675 - RNA, 19 nt, Homo sapiens
gcaaaauacaugacauuua

SEQ ID NO: 1312676 - RNA, 16 nt, Homo sapiens
gcaaaauauaucacuu

SEQ ID NO: 1312677 - RNA, 17 nt, Homo sapiens
gcaaaauauaucacuuu

SEQ ID NO: 1312678 - RNA, 15 nt, Homo sapiens
gcaaacaaaauggac

SEQ ID NO: 1312679 - RNA, 23 nt, Homo sapiens
gcaaacccaaaaccucaugacag

SEQ ID NO: 1312680 - RNA, 11 nt, Homo sapiens
gcaaacccaga

SEQ ID NO: 1312681 - RNA, 21 nt, Homo sapiens
gcaaagaaucccuagacuuua

SEQ ID NO: 1312682 - RNA, 17 nt, Homo sapiens
gcaaagaucuguccuca

SEQ ID NO: 1312683 - RNA, 13 nt, Homo sapiens
gcaaaggacagau

SEQ ID NO: 1312684 - RNA, 17 nt, Homo sapiens
gcaaagggagcacuggg

SEQ ID NO: 1312685 - RNA, 20 nt, Homo sapiens
gcaaaguauuguaaauuaua

SEQ ID NO: 1312686 - RNA, 20 nt, Homo sapiens
gcaaauaaaugaacugacuu

SEQ ID NO: 1312687 - RNA, 23 nt, Homo sapiens
gcaaauaaaugaacugacuucaa

SEQ ID NO: 1312688 - RNA, 16 nt, Homo sapiens
gcaaauguuaugcaua

SEQ ID NO: 1312689 - RNA, 18 nt, Homo sapiens
gcaacaagaccaccacuu

SEQ ID NO: 1312690 - RNA, 21 nt, Homo sapiens
gcaacaagaccaccacuucga

SEQ ID NO: 1312691 - RNA, 13 nt, Homo sapiens
gcaaccacugcuu

SEQ ID NO: 1312692 - RNA, 14 nt, Homo sapiens
gcaaccucugucuc

SEQ ID NO: 1312693 - RNA, 23 nt, Homo sapiens
gcaacuuauguauuuucuuccac

SEQ ID NO: 1312694 - RNA, 18 nt, Homo sapiens
gcaagaagucaaaguaaa

SEQ ID NO: 1312695 - RNA, 15 nt, Homo sapiens
gcaagagaacauuuu

SEQ ID NO: 1312696 - RNA, 17 nt, Homo sapiens
gcaagagaauuacuuga

SEQ ID NO: 1312697 - RNA, 18 nt, Homo sapiens
gcaagauuuaaauccuuu

SEQ ID NO: 1312698 - RNA, 15 nt, Homo sapiens
gcaagcacaucugca

SEQ ID NO: 1312699 - RNA, 20 nt, Homo sapiens
gcaagccuguuccggugaug

SEQ ID NO: 1312700 - RNA, 16 nt, Homo sapiens
gcaaggaaacuaugua

SEQ ID NO: 1312701 - RNA, 13 nt, Homo sapiens
gcaaguaacauua

SEQ ID NO: 1312702 - RNA, 14 nt, Homo sapiens
gcaauaaugcagua

SEQ ID NO: 1312703 - RNA, 17 nt, Homo sapiens
gcaauacagacuacuuc

SEQ ID NO: 1312704 - RNA, 22 nt, Homo sapiens
gcaaugaauccccaauaauugc

SEQ ID NO: 1312705 - RNA, 15 nt, Homo sapiens
gcaauguacaccaga

SEQ ID NO: 1312706 - RNA, 17 nt, Homo sapiens
gcaauuacggggugacc

SEQ ID NO: 1312707 - RNA, 22 nt, Homo sapiens
gcaauuccgcauuuaauucaug

SEQ ID NO: 1312708 - RNA, 23 nt, Homo sapiens
gcaauugagggacugagccagac

SEQ ID NO: 1312709 - RNA, 20 nt, Homo sapiens
gcaauuuuucaagagcuccu

SEQ ID NO: 1312710 - RNA, 13 nt, Homo sapiens
gcacacacugugu

SEQ ID NO: 1312711 - RNA, 14 nt, Homo sapiens
gcacagaugccugg

SEQ ID NO: 1312712 - RNA, 21 nt, Homo sapiens
gcacauagugaaagauuacuu

SEQ ID NO: 1312713 - RNA, 17 nt, Homo sapiens
gcacaugcaccuaccca

SEQ ID NO: 1312714 - RNA, 15 nt, Homo sapiens
gcaccaauaaagccu

SEQ ID NO: 1312715 - RNA, 20 nt, Homo sapiens
gcaccacugcacuccagccu

SEQ ID NO: 1312716 - RNA, 22 nt, Homo sapiens
gcacccaggacuuccauuugcu

SEQ ID NO: 1312717 - RNA, 12 nt, Homo sapiens
gcaccccagugg

SEQ ID NO: 1312718 - RNA, 16 nt, Homo sapiens
gcaccguucugugcac

SEQ ID NO: 1312719 - RNA, 15 nt, Homo sapiens
gcaccuaauccaggc

SEQ ID NO: 1312720 - RNA, 21 nt, Homo sapiens
gcaccuaauccaggcagaucc

SEQ ID NO: 1312721 - RNA, 13 nt, Homo sapiens
gcaccuaccucac

SEQ ID NO: 1312722 - RNA, 17 nt, Homo sapiens
gcacggaucacgaugua

SEQ ID NO: 1312723 - RNA, 15 nt, Homo sapiens
gcacugacugggcau

SEQ ID NO: 1312724 - RNA, 17 nt, Homo sapiens
gcacugcccauggacag

SEQ ID NO: 1312725 - RNA, 22 nt, Homo sapiens
gcacuggguugacuuucaggua

SEQ ID NO: 1312726 - RNA, 22 nt, Homo sapiens
gcacuguucugggacuccaggu

SEQ ID NO: 1312727 - RNA, 16 nt, Homo sapiens
gcacuuaugauuucau

SEQ ID NO: 1312728 - RNA, 18 nt, Homo sapiens
gcacuuugggaggccaag

SEQ ID NO: 1312729 - RNA, 13 nt, Homo sapiens
gcagaacugaaga

SEQ ID NO: 1312730 - RNA, 13 nt, Homo sapiens
gcagaaugaaucu

SEQ ID NO: 1312731 - RNA, 17 nt, Homo sapiens
gcagaauugagagugau

SEQ ID NO: 1312732 - RNA, 18 nt, Homo sapiens
gcagaauugagagugauu

SEQ ID NO: 1312733 - RNA, 19 nt, Homo sapiens
gcagacauagaagagccaa

SEQ ID NO: 1312734 - RNA, 13 nt, Homo sapiens
gcagaccaccagc

SEQ ID NO: 1312735 - RNA, 14 nt, Homo sapiens
gcagaccacugaua

SEQ ID NO: 1312736 - RNA, 15 nt, Homo sapiens
gcagaccucuggauu

SEQ ID NO: 1312737 - RNA, 21 nt, Homo sapiens
gcagacucuacagaggccaug

SEQ ID NO: 1312738 - RNA, 23 nt, Homo sapiens
gcagagaccagcccaccccugug

SEQ ID NO: 1312739 - RNA, 14 nt, Homo sapiens
gcagaggccagagg

SEQ ID NO: 1312740 - RNA, 15 nt, Homo sapiens
gcagaggcuguggug

SEQ ID NO: 1312741 - RNA, 21 nt, Homo sapiens
gcagaggcuguggugagccaa

SEQ ID NO: 1312742 - RNA, 21 nt, Homo sapiens
gcagaguauuaaugaaaagca

SEQ ID NO: 1312743 - RNA, 22 nt, Homo sapiens
gcagagucugccccacaugugg

SEQ ID NO: 1312744 - RNA, 15 nt, Homo sapiens
gcagcaaauuuucag

SEQ ID NO: 1312745 - RNA, 21 nt, Homo sapiens
gcagcaaggaaagcucacgaa

SEQ ID NO: 1312746 - RNA, 20 nt, Homo sapiens
gcagcaccguucugugcaca

SEQ ID NO: 1312747 - RNA, 13 nt, Homo sapiens
gcagcauggagcu

SEQ ID NO: 1312748 - RNA, 18 nt, Homo sapiens
gcagccagaggcaccuca

SEQ ID NO: 1312749 - RNA, 21 nt, Homo sapiens
gcagccagaggcaccucaaga

SEQ ID NO: 1312750 - RNA, 19 nt, Homo sapiens
gcagcccuacaacaaccug

SEQ ID NO: 1312751 - RNA, 19 nt, Homo sapiens
gcagccugagcaacucuug

SEQ ID NO: 1312752 - RNA, 17 nt, Homo sapiens
gcagcgccuuucccaac

SEQ ID NO: 1312753 - RNA, 13 nt, Homo sapiens
gcagcucuuggga

SEQ ID NO: 1312754 - RNA, 18 nt, Homo sapiens
gcagcugcuacuagcucu

SEQ ID NO: 1312755 - RNA, 15 nt, Homo sapiens
uauuuaacuggugca

SEQ ID NO: 1312756 - RNA, 16 nt, Homo sapiens
uauuuaagcaacaucu

SEQ ID NO: 1312757 - RNA, 20 nt, Homo sapiens
uauuuagaaauagaacuaca

SEQ ID NO: 1312758 - RNA, 21 nt, Homo sapiens
uauuuagaaauagaacuacaa

SEQ ID NO: 1312759 - RNA, 12 nt, Homo sapiens
uauuuauagucg

SEQ ID NO: 1312760 - RNA, 20 nt, Homo sapiens
uauuuauccaaaauguguau

SEQ ID NO: 1312761 - RNA, 18 nt, Homo sapiens
uauuuauguuugcacuug

SEQ ID NO: 1312762 - RNA, 15 nt, Homo sapiens
uauuuauugugaugc

SEQ ID NO: 1312763 - RNA, 17 nt, Homo sapiens
uauuucaagcucugcaa

SEQ ID NO: 1312764 - RNA, 14 nt, Homo sapiens
uauuuccugcuuau

SEQ ID NO: 1312765 - RNA, 18 nt, Homo sapiens
uauuugacuuaccaugga

SEQ ID NO: 1312766 - RNA, 14 nt, Homo sapiens
uauuugcauaacaa

SEQ ID NO: 1312767 - RNA, 20 nt, Homo sapiens
uauuuguaauuuuacacaaa

SEQ ID NO: 1312768 - RNA, 22 nt, Homo sapiens
uauuuguuauggcagaugacaa

SEQ ID NO: 1312769 - RNA, 20 nt, Homo sapiens
uauuuguuuggugaauuugu

SEQ ID NO: 1312770 - RNA, 16 nt, Homo sapiens
uauuuuaaguauugca

SEQ ID NO: 1312771 - RNA, 14 nt, Homo sapiens
uauuuuagccuuua

SEQ ID NO: 1312772 - RNA, 13 nt, Homo sapiens
uauuuuaucucaa

SEQ ID NO: 1312773 - RNA, 12 nt, Homo sapiens
uauuuucuucca

SEQ ID NO: 1312774 - RNA, 17 nt, Homo sapiens
uauuuugagaagcucug

SEQ ID NO: 1312775 - RNA, 19 nt, Homo sapiens
uauuuugagaagcucugau

SEQ ID NO: 1312776 - RNA, 16 nt, Homo sapiens
uauuuuggaacuauga

SEQ ID NO: 1312777 - RNA, 19 nt, Homo sapiens
ucaaaaauccuaacauuca

SEQ ID NO: 1312778 - RNA, 18 nt, Homo sapiens
ucaaaauuucagcauuau

SEQ ID NO: 1312779 - RNA, 17 nt, Homo sapiens
ucaaacaaacucucuga

SEQ ID NO: 1312780 - RNA, 15 nt, Homo sapiens
ucaaacaaagccaga

SEQ ID NO: 1312781 - RNA, 16 nt, Homo sapiens
ucaaacccagucuugu

SEQ ID NO: 1312782 - RNA, 19 nt, Homo sapiens
ucaaacucuugaccucagg

SEQ ID NO: 1312783 - RNA, 17 nt, Homo sapiens
ucaaagagcuugaaaag

SEQ ID NO: 1312784 - RNA, 17 nt, Homo sapiens
ucaaagaggaaccagga

SEQ ID NO: 1312785 - RNA, 17 nt, Homo sapiens
ucaaagaugacuugaaa

SEQ ID NO: 1312786 - RNA, 17 nt, Homo sapiens
ucaaagccacacucugg

SEQ ID NO: 1312787 - RNA, 10 nt, Homo sapiens
ucaaagccag

SEQ ID NO: 1312788 - RNA, 15 nt, Homo sapiens
ucaaaguaaaacuug

SEQ ID NO: 1312789 - RNA, 16 nt, Homo sapiens
ucaaaguaaaacuugc

SEQ ID NO: 1312790 - RNA, 19 nt, Homo sapiens
ucaaauaucaguuacccac

SEQ ID NO: 1312791 - RNA, 15 nt, Homo sapiens
ucaaaucugagggag

SEQ ID NO: 1312792 - RNA, 18 nt, Homo sapiens
ucaaaugugacauuauau

SEQ ID NO: 1312793 - RNA, 14 nt, Homo sapiens
ucaaaugugugcuu

SEQ ID NO: 1312794 - RNA, 22 nt, Homo sapiens
ucaacagcauuuucaagcaguu

SEQ ID NO: 1312795 - RNA, 17 nt, Homo sapiens
ucaacagugaagacaga

SEQ ID NO: 1312796 - RNA, 18 nt, Homo sapiens
ucaacaucuaaaaaucaa

SEQ ID NO: 1312797 - RNA, 20 nt, Homo sapiens
ucaacaucuuuuacauucug

SEQ ID NO: 1312798 - RNA, 17 nt, Homo sapiens
ucaacauggcagaacca

SEQ ID NO: 1312799 - RNA, 17 nt, Homo sapiens
ucaaccaccuaggcaau

SEQ ID NO: 1312800 - RNA, 22 nt, Homo sapiens
ucaaccaccuaggcaaugaaga

SEQ ID NO: 1312801 - RNA, 22 nt, Homo sapiens
ucaacccuucuggaaacuguga

SEQ ID NO: 1312802 - RNA, 19 nt, Homo sapiens
ucaacucguuuuuauauua

SEQ ID NO: 1312803 - RNA, 17 nt, Homo sapiens
ucaacuuauuaacaauu

SEQ ID NO: 1312804 - RNA, 16 nt, Homo sapiens
ucaacuugcuuaucaa

SEQ ID NO: 1312805 - RNA, 16 nt, Homo sapiens
ucaacuuuuccuuuca

SEQ ID NO: 1312806 - RNA, 16 nt, Homo sapiens
ucaacuuuugaccaaa

SEQ ID NO: 1312807 - RNA, 18 nt, Homo sapiens
ucaacuuuuuauugccuu

SEQ ID NO: 1312808 - RNA, 19 nt, Homo sapiens
ucaacuuuuuauugccuuc

SEQ ID NO: 1312809 - RNA, 17 nt, Homo sapiens
ucaagaaauagcgcagu

SEQ ID NO: 1312810 - RNA, 19 nt, Homo sapiens
ucaagaacaugaugggccu

SEQ ID NO: 1312811 - RNA, 14 nt, Homo sapiens
ucaagcgauccucc

SEQ ID NO: 1312812 - RNA, 15 nt, Homo sapiens
ucaaggagcccagaa

SEQ ID NO: 1312813 - RNA, 21 nt, Homo sapiens
ucaaggcccauaucugugaaa

SEQ ID NO: 1312814 - RNA, 13 nt, Homo sapiens
ucaaggccuucag

SEQ ID NO: 1312815 - RNA, 16 nt, Homo sapiens
ucaaggcggugcuuga

SEQ ID NO: 1312816 - RNA, 18 nt, Homo sapiens
ucaagggguguucaguua

SEQ ID NO: 1312817 - RNA, 17 nt, Homo sapiens
ucaagguugguucaaca

SEQ ID NO: 1312818 - RNA, 18 nt, Homo sapiens
ucaagucagaacagccag

SEQ ID NO: 1312819 - RNA, 18 nt, Homo sapiens
ucaaguuaugaaauacuu

SEQ ID NO: 1312820 - RNA, 21 nt, Homo sapiens
ucaaguuuuggguauguuuaa

SEQ ID NO: 1312821 - RNA, 15 nt, Homo sapiens
ucaauaaaguauuua

SEQ ID NO: 1312822 - RNA, 18 nt, Homo sapiens
ucaauauccuuugccuca

SEQ ID NO: 1312823 - RNA, 21 nt, Homo sapiens
ucaauauugguguacuguaau

SEQ ID NO: 1312824 - RNA, 23 nt, Homo sapiens
ucaauguuuacuuuuuugguacu

SEQ ID NO: 1312825 - RNA, 15 nt, Homo sapiens
ucaauuccguagcca

SEQ ID NO: 1312826 - RNA, 20 nt, Homo sapiens
ucaauugugcuuuguaucag

SEQ ID NO: 1312827 - RNA, 23 nt, Homo sapiens
ucacaaacagccuacagccagaa

SEQ ID NO: 1312828 - RNA, 21 nt, Homo sapiens
ucacaagugaaaaacauccag

SEQ ID NO: 1312829 - RNA, 20 nt, Homo sapiens
ucacaauaccucaugcuuca

SEQ ID NO: 1312830 - RNA, 24 nt, Homo sapiens
ucacaaugucccuucagcaccuga

SEQ ID NO: 1312831 - RNA, 21 nt, Homo sapiens
ucacaauuccauuuccaguuc

SEQ ID NO: 1312832 - RNA, 17 nt, Homo sapiens
ucacacaccccucaaaa

SEQ ID NO: 1312833 - RNA, 17 nt, Homo sapiens
ucacacagauagaccuu

SEQ ID NO: 1312834 - RNA, 18 nt, Homo sapiens
ucacacgggggcagcuga

SEQ ID NO: 1312835 - RNA, 19 nt, Homo sapiens
ucacacgguuugaagccug

SEQ ID NO: 1312836 - RNA, 18 nt, Homo sapiens
ucacacuuacuguaagac

SEQ ID NO: 1312837 - RNA, 23 nt, Homo sapiens
ucacagaaggguguggcauuugg

SEQ ID NO: 1312838 - RNA, 17 nt, Homo sapiens
ucacaggccccaggaaa

SEQ ID NO: 1312839 - RNA, 16 nt, Homo sapiens
ucacagggacugaaaa

SEQ ID NO: 1312840 - RNA, 23 nt, Homo sapiens
ucacaguucuuugggccagacau

SEQ ID NO: 1312841 - RNA, 17 nt, Homo sapiens
ucacaucagaacagaca

SEQ ID NO: 1312842 - RNA, 22 nt, Homo sapiens
ucacaucagaacagacaaucac

SEQ ID NO: 1312843 - RNA, 13 nt, Homo sapiens
ucacaucuuggca

SEQ ID NO: 1312844 - RNA, 21 nt, Homo sapiens
ucacauggugcuacgccugca

SEQ ID NO: 1312845 - RNA, 18 nt, Homo sapiens
ucacauuuauucugcuca

SEQ ID NO: 1312846 - RNA, 19 nt, Homo sapiens
ucacauuuauucugcucac

SEQ ID NO: 1312847 - RNA, 11 nt, Homo sapiens
ucacauuugcg

SEQ ID NO: 1312848 - RNA, 15 nt, Homo sapiens
ucaccaagcccaguu

SEQ ID NO: 1312849 - RNA, 15 nt, Homo sapiens
ucaccagcugcaaag

SEQ ID NO: 1312850 - RNA, 16 nt, Homo sapiens
ucaccagcugcaaagu

SEQ ID NO: 1312851 - RNA, 16 nt, Homo sapiens
ucaccauaaaaaggaa

SEQ ID NO: 1312852 - RNA, 19 nt, Homo sapiens
ucaccauuuggcaaugcca

SEQ ID NO: 1312853 - RNA, 22 nt, Homo sapiens
ucacccaccccugcacaguuga

SEQ ID NO: 1312854 - RNA, 22 nt, Homo sapiens
ucacccauuuacacauauccac

SEQ ID NO: 1312855 - RNA, 20 nt, Homo sapiens
ucaccccagcgagcucucaa

SEQ ID NO: 1312856 - RNA, 17 nt, Homo sapiens
ucaccgaggacaugaaa

SEQ ID NO: 1312857 - RNA, 15 nt, Homo sapiens
ucaccuacuccagag

SEQ ID NO: 1312858 - RNA, 15 nt, Homo sapiens
ucaccucauucugaa

SEQ ID NO: 1312859 - RNA, 18 nt, Homo sapiens
ucaccugcccugugcaug

SEQ ID NO: 1312860 - RNA, 18 nt, Homo sapiens
ucaccugggcugaggcau

SEQ ID NO: 1312861 - RNA, 18 nt, Homo sapiens
ucaccuuggcaccagaca

SEQ ID NO: 1312862 - RNA, 22 nt, Homo sapiens
ucaccuuggcaccagacaccca

SEQ ID NO: 1312863 - RNA, 14 nt, Homo sapiens
ucacgccacugcac

SEQ ID NO: 1312864 - RNA, 18 nt, Homo sapiens
ucacgccucuguguucag

SEQ ID NO: 1312865 - RNA, 21 nt, Homo sapiens
ucacgccucuguguucaggau

SEQ ID NO: 1312866 - RNA, 15 nt, Homo sapiens
ucacggcucacugua

SEQ ID NO: 1312867 - RNA, 23 nt, Homo sapiens
ucacuaaagcaguagaaauaaua

SEQ ID NO: 1312868 - RNA, 22 nt, Homo sapiens
ucacuaggcccccacuugccuc

SEQ ID NO: 1312869 - RNA, 14 nt, Homo sapiens
ucacucugcugcug

SEQ ID NO: 1312870 - RNA, 14 nt, Homo sapiens
ucacugacaguuaa

SEQ ID NO: 1312871 - RNA, 15 nt, Homo sapiens
ucacugcagccucaa

SEQ ID NO: 1312872 - RNA, 21 nt, Homo sapiens
ucacugccagagauaaacuaa

SEQ ID NO: 1312873 - RNA, 13 nt, Homo sapiens
ucacuguccucca

SEQ ID NO: 1312874 - RNA, 14 nt, Homo sapiens
ucacuguccuccaa

SEQ ID NO: 1312875 - RNA, 16 nt, Homo sapiens
ucacugucuuuccuag

SEQ ID NO: 1312876 - RNA, 17 nt, Homo sapiens
ucacugucuuuccuaga

SEQ ID NO: 1312877 - RNA, 17 nt, Homo sapiens
ucacuguguuacugcuu

SEQ ID NO: 1312878 - RNA, 18 nt, Homo sapiens
ucacuugguccuaccuau

SEQ ID NO: 1312879 - RNA, 21 nt, Homo sapiens
ucacuuucauuuuugauagcu

SEQ ID NO: 1312880 - RNA, 12 nt, Homo sapiens
ucagaaagccaa

SEQ ID NO: 1312881 - RNA, 17 nt, Homo sapiens
ucagacuccugugcaac

SEQ ID NO: 1312882 - RNA, 19 nt, Homo sapiens
ucagacuccugugcaacuu

SEQ ID NO: 1312883 - RNA, 11 nt, Homo sapiens
ucagacuugcc

SEQ ID NO: 1312884 - RNA, 19 nt, Homo sapiens
ucagacuugucaagccugu

SEQ ID NO: 1312885 - RNA, 17 nt, Homo sapiens
ucagagaccauugcaau

SEQ ID NO: 1312886 - RNA, 15 nt, Homo sapiens
ucagagcuaaacucc

SEQ ID NO: 1312887 - RNA, 17 nt, Homo sapiens
ucagagcugacacagga

SEQ ID NO: 1312888 - RNA, 17 nt, Homo sapiens
ucagaggcgcacuguga

SEQ ID NO: 1312889 - RNA, 13 nt, Homo sapiens
ucauuacugcuuc

SEQ ID NO: 1312890 - RNA, 17 nt, Homo sapiens
ucauuagcauuuugcua

SEQ ID NO: 1312891 - RNA, 20 nt, Homo sapiens
ucauucccaacgugcaaagc

SEQ ID NO: 1312892 - RNA, 23 nt, Homo sapiens
ucauucccauuuuguuacauuuc

SEQ ID NO: 1312893 - RNA, 11 nt, Homo sapiens
ucauugcugag

SEQ ID NO: 1312894 - RNA, 17 nt, Homo sapiens
ucauugcugagccucug

SEQ ID NO: 1312895 - RNA, 18 nt, Homo sapiens
ucauuguucucccuccua

SEQ ID NO: 1312896 - RNA, 14 nt, Homo sapiens
ucauuuagugcccu

SEQ ID NO: 1312897 - RNA, 21 nt, Homo sapiens
ucauuuagugcccucuuuagc

SEQ ID NO: 1312898 - RNA, 21 nt, Homo sapiens
ucauuuccuauguaacugcau

SEQ ID NO: 1312899 - RNA, 15 nt, Homo sapiens
ucauuucuaggcaaa

SEQ ID NO: 1312900 - RNA, 23 nt, Homo sapiens
ucauuucuuaugaaucuuuccag

SEQ ID NO: 1312901 - RNA, 13 nt, Homo sapiens
uccaaaaaugcac

SEQ ID NO: 1312902 - RNA, 23 nt, Homo sapiens
uccaaaaaugcacccaacuagcu

SEQ ID NO: 1312903 - RNA, 15 nt, Homo sapiens
uccaaaauugcaaac

SEQ ID NO: 1312904 - RNA, 24 nt, Homo sapiens
uccaaacagggguucuuagucuca

SEQ ID NO: 1312905 - RNA, 12 nt, Homo sapiens
uccaaacauucu

SEQ ID NO: 1312906 - RNA, 17 nt, Homo sapiens
uccaaauaauuugaaca

SEQ ID NO: 1312907 - RNA, 21 nt, Homo sapiens
uccaaauaauuugaacagcuu

SEQ ID NO: 1312908 - RNA, 17 nt, Homo sapiens
uccaacaccaagcacag

SEQ ID NO: 1312909 - RNA, 21 nt, Homo sapiens
uccaacaccaagcacagcagc

SEQ ID NO: 1312910 - RNA, 16 nt, Homo sapiens
uccaacacugcugcuc

SEQ ID NO: 1312911 - RNA, 19 nt, Homo sapiens
uccaaccccccagcacuga

SEQ ID NO: 1312912 - RNA, 17 nt, Homo sapiens
uccaauguacaacuucc

SEQ ID NO: 1312913 - RNA, 12 nt, Homo sapiens
uccacaccaagc

SEQ ID NO: 1312914 - RNA, 12 nt, Homo sapiens
uccaccaagaaa

SEQ ID NO: 1312915 - RNA, 19 nt, Homo sapiens
uccacguucugcucaucau

SEQ ID NO: 1312916 - RNA, 16 nt, Homo sapiens
uccacuaggacuucaa

SEQ ID NO: 1312917 - RNA, 19 nt, Homo sapiens
uccacuaggguccaccagg

SEQ ID NO: 1312918 - RNA, 11 nt, Homo sapiens
uccacucccag

SEQ ID NO: 1312919 - RNA, 14 nt, Homo sapiens
uccacugugccaug

SEQ ID NO: 1312920 - RNA, 16 nt, Homo sapiens
uccacuuauaaaggaa

SEQ ID NO: 1312921 - RNA, 19 nt, Homo sapiens
uccagaaaacaaaacugca

SEQ ID NO: 1312922 - RNA, 14 nt, Homo sapiens
uccagaaauguacu

SEQ ID NO: 1312923 - RNA, 14 nt, Homo sapiens
uccagaagcacugg

SEQ ID NO: 1312924 - RNA, 17 nt, Homo sapiens
uccagagauuugcuuua

SEQ ID NO: 1312925 - RNA, 17 nt, Homo sapiens
uccagagggaauugcag

SEQ ID NO: 1312926 - RNA, 14 nt, Homo sapiens
uccagaucuugccu

SEQ ID NO: 1312927 - RNA, 12 nt, Homo sapiens
uccagauggcaa

SEQ ID NO: 1312928 - RNA, 14 nt, Homo sapiens
uccagcaaccuaua

SEQ ID NO: 1312929 - RNA, 15 nt, Homo sapiens
uccagcaaccuauaa

SEQ ID NO: 1312930 - RNA, 17 nt, Homo sapiens
uccagcaagaagggagu

SEQ ID NO: 1312931 - RNA, 20 nt, Homo sapiens
uccagcacccccagugcagc

SEQ ID NO: 1312932 - RNA, 19 nt, Homo sapiens
uccagcagaagacaaaaag

SEQ ID NO: 1312933 - RNA, 21 nt, Homo sapiens
uccagcauugcuggacucuga

SEQ ID NO: 1312934 - RNA, 17 nt, Homo sapiens
uccagcugcaagggagu

SEQ ID NO: 1312935 - RNA, 23 nt, Homo sapiens
uccagcuggaagggucaacaucu

SEQ ID NO: 1312936 - RNA, 20 nt, Homo sapiens
uccaggaggaguuagccaaa

SEQ ID NO: 1312937 - RNA, 23 nt, Homo sapiens
uccaggaggaguuagccaaacaa

SEQ ID NO: 1312938 - RNA, 14 nt, Homo sapiens
uccaggaggcccug

SEQ ID NO: 1312939 - RNA, 15 nt, Homo sapiens
uccaggcagauccag

SEQ ID NO: 1312940 - RNA, 18 nt, Homo sapiens
uccagggucccucugugu

SEQ ID NO: 1312941 - RNA, 21 nt, Homo sapiens
uccaggugguaagcaccagga

SEQ ID NO: 1312942 - RNA, 11 nt, Homo sapiens
uccagugcagg

SEQ ID NO: 1312943 - RNA, 13 nt, Homo sapiens
uccagugcaggag

SEQ ID NO: 1312944 - RNA, 17 nt, Homo sapiens
uccauaaaaaaacaauu

SEQ ID NO: 1312945 - RNA, 20 nt, Homo sapiens
uccauaaagacaaucacugc

SEQ ID NO: 1312946 - RNA, 19 nt, Homo sapiens
uccauaaugauggauuuaa

SEQ ID NO: 1312947 - RNA, 23 nt, Homo sapiens
uccauacgcguucuaggcauaca

SEQ ID NO: 1312948 - RNA, 21 nt, Homo sapiens
uccaucaguuagagcugacac

SEQ ID NO: 1312949 - RNA, 20 nt, Homo sapiens
uccauccuuuacguguuuaa

SEQ ID NO: 1312950 - RNA, 18 nt, Homo sapiens
uccuaucaccuauuucca

SEQ ID NO: 1312951 - RNA, 13 nt, Homo sapiens
uccuaugcuauug

SEQ ID NO: 1312952 - RNA, 15 nt, Homo sapiens
uccucaaacacugca

SEQ ID NO: 1312953 - RNA, 19 nt, Homo sapiens
uccucagccuugccagaga

SEQ ID NO: 1312954 - RNA, 22 nt, Homo sapiens
uccucaggcacacagcuacucu

SEQ ID NO: 1312955 - RNA, 20 nt, Homo sapiens
uccucaguuuuugugaaaag

SEQ ID NO: 1312956 - RNA, 21 nt, Homo sapiens
uccucauuagcauuuugcuaa

SEQ ID NO: 1312957 - RNA, 13 nt, Homo sapiens
uccuccacugacu

SEQ ID NO: 1312958 - RNA, 13 nt, Homo sapiens
uccuccagggacu

SEQ ID NO: 1312959 - RNA, 16 nt, Homo sapiens
uccucccacugucugc

SEQ ID NO: 1312960 - RNA, 20 nt, Homo sapiens
uccuccccccuccucugaaa

SEQ ID NO: 1312961 - RNA, 15 nt, Homo sapiens
uccucccugcaucug

SEQ ID NO: 1312962 - RNA, 16 nt, Homo sapiens
uccuccguccauauca

SEQ ID NO: 1312963 - RNA, 14 nt, Homo sapiens
uccuccguggcaca

SEQ ID NO: 1312964 - RNA, 15 nt, Homo sapiens
uccuccguggcacau

SEQ ID NO: 1312965 - RNA, 15 nt, Homo sapiens
uccuccuuccaugga

SEQ ID NO: 1312966 - RNA, 22 nt, Homo sapiens
uccucguggagcuuagcaggca

SEQ ID NO: 1312967 - RNA, 21 nt, Homo sapiens
uccucucaugucuuugcugca

SEQ ID NO: 1312968 - RNA, 18 nt, Homo sapiens
uccucucccaaguucuuu

SEQ ID NO: 1312969 - RNA, 13 nt, Homo sapiens
uccucugacucag

SEQ ID NO: 1312970 - RNA, 21 nt, Homo sapiens
uccucugucagucacagccac

SEQ ID NO: 1312971 - RNA, 24 nt, Homo sapiens
uccucuugcaguuguucuuuaauc

SEQ ID NO: 1312972 - RNA, 16 nt, Homo sapiens
uccucuuugguggcau

SEQ ID NO: 1312973 - RNA, 23 nt, Homo sapiens
uccugaaacuauauuuugucaua

SEQ ID NO: 1312974 - RNA, 13 nt, Homo sapiens
uccugaaagccac

SEQ ID NO: 1312975 - RNA, 22 nt, Homo sapiens
uccugaaaucaagucaucuaua

SEQ ID NO: 1312976 - RNA, 21 nt, Homo sapiens
uccugaaauuugagagacaaa

SEQ ID NO: 1312977 - RNA, 18 nt, Homo sapiens
uccugaagauagccagag

SEQ ID NO: 1312978 - RNA, 14 nt, Homo sapiens
uccugagggagcuc

SEQ ID NO: 1312979 - RNA, 18 nt, Homo sapiens
uccugaugcuuuugucua

SEQ ID NO: 1312980 - RNA, 21 nt, Homo sapiens
uccugccacuguguaacauag

SEQ ID NO: 1312981 - RNA, 23 nt, Homo sapiens
uccugcuacucuguuccuucaca

SEQ ID NO: 1312982 - RNA, 19 nt, Homo sapiens
uccugcugaacguuucccc

SEQ ID NO: 1312983 - RNA, 20 nt, Homo sapiens
uccuggaugucugaacuuug

SEQ ID NO: 1312984 - RNA, 15 nt, Homo sapiens
uccuggcccagguga

SEQ ID NO: 1312985 - RNA, 18 nt, Homo sapiens
uccuggcccaggugaguc

SEQ ID NO: 1312986 - RNA, 16 nt, Homo sapiens
uccugggagugagcug

SEQ ID NO: 1312987 - RNA, 23 nt, Homo sapiens
uccuguccagcuccaaccugcaa

SEQ ID NO: 1312988 - RNA, 14 nt, Homo sapiens
uccuguguccugaa

SEQ ID NO: 1312989 - RNA, 13 nt, Homo sapiens
uccuuauguuaag

SEQ ID NO: 1312990 - RNA, 15 nt, Homo sapiens
uccuuauuaauacaa

SEQ ID NO: 1312991 - RNA, 23 nt, Homo sapiens
uccuucaucaugaguucugcuga

SEQ ID NO: 1312992 - RNA, 11 nt, Homo sapiens
uccuuccucuc

SEQ ID NO: 1312993 - RNA, 21 nt, Homo sapiens
uccuuccuuguuacccaugaa

SEQ ID NO: 1312994 - RNA, 20 nt, Homo sapiens
uccuugacccugcuuuuugc

SEQ ID NO: 1312995 - RNA, 16 nt, Homo sapiens
uccuugaccugcauug

SEQ ID NO: 1312996 - RNA, 19 nt, Homo sapiens
uccuugagagaccaggcaa

SEQ ID NO: 1312997 - RNA, 18 nt, Homo sapiens
uccuugcccccauuucac

SEQ ID NO: 1312998 - RNA, 16 nt, Homo sapiens
uccuuggcuuuuacug

SEQ ID NO: 1312999 - RNA, 22 nt, Homo sapiens
uccuugggaggccccacugggg

SEQ ID NO: 1313000 - RNA, 18 nt, Homo sapiens
uccuuucacccgcuccua

SEQ ID NO: 1313001 - RNA, 20 nt, Homo sapiens
uccuuuggguauguuaaccu

SEQ ID NO: 1313002 - RNA, 23 nt, Homo sapiens
uccuuuuguagaaugaaccacug

SEQ ID NO: 1313003 - RNA, 17 nt, Homo sapiens
uccuuuuuugcaugugc

SEQ ID NO: 1313004 - RNA, 15 nt, Homo sapiens
ucgaacaauucauau

SEQ ID NO: 1313005 - RNA, 22 nt, Homo sapiens
ucgaauacgucagauuggacca

SEQ ID NO: 1313006 - RNA, 20 nt, Homo sapiens
ucgagaauguauggauuuac

SEQ ID NO: 1313007 - RNA, 15 nt, Homo sapiens
ucgagagcuggccaa

SEQ ID NO: 1313008 - RNA, 18 nt, Homo sapiens
ucgaugagaaauugaacu

SEQ ID NO: 1313009 - RNA, 18 nt, Homo sapiens
ucgcccuacucaccugag

SEQ ID NO: 1313010 - RNA, 15 nt, Homo sapiens
ucgccuuagcacuac

SEQ ID NO: 1313011 - RNA, 21 nt, Homo sapiens
ucucugcagggccgccaggga

SEQ ID NO: 1313012 - RNA, 22 nt, Homo sapiens
ucucugggaaucaacagcauau

SEQ ID NO: 1313013 - RNA, 22 nt, Homo sapiens
ucucugggcuucgggcuaugca

SEQ ID NO: 1313014 - RNA, 20 nt, Homo sapiens
ucucuggggcuguguuuuga

SEQ ID NO: 1313015 - RNA, 24 nt, Homo sapiens
ucucuguguaaucaucugaagaaa

SEQ ID NO: 1313016 - RNA, 16 nt, Homo sapiens
ucucuuauagaauauu

SEQ ID NO: 1313017 - RNA, 14 nt, Homo sapiens
ucucuucucaccuu

SEQ ID NO: 1313018 - RNA, 15 nt, Homo sapiens
ucucuucuucucaua

SEQ ID NO: 1313019 - RNA, 20 nt, Homo sapiens
ucucuuucacauuguuugcu

SEQ ID NO: 1313020 - RNA, 23 nt, Homo sapiens
ucugaaacugcauaagugaaaau

SEQ ID NO: 1313021 - RNA, 22 nt, Homo sapiens
ucugaaauuugugauggaauca

SEQ ID NO: 1313022 - RNA, 21 nt, Homo sapiens
ucugaagcagaugcaaagagg

SEQ ID NO: 1313023 - RNA, 18 nt, Homo sapiens
ucugacaaugcugagguu

SEQ ID NO: 1313024 - RNA, 18 nt, Homo sapiens
ucugacaugauuccuucc

SEQ ID NO: 1313025 - RNA, 15 nt, Homo sapiens
ucugacccacugcuu

SEQ ID NO: 1313026 - RNA, 17 nt, Homo sapiens
ucugagacagcuugucu

SEQ ID NO: 1313027 - RNA, 19 nt, Homo sapiens
ucugagcagugaaugauuc

SEQ ID NO: 1313028 - RNA, 23 nt, Homo sapiens
ucugagcagugaaugauucagug

SEQ ID NO: 1313029 - RNA, 13 nt, Homo sapiens
ucugagcugugca

SEQ ID NO: 1313030 - RNA, 13 nt, Homo sapiens
ucugcaaccucug

SEQ ID NO: 1313031 - RNA, 19 nt, Homo sapiens
ucugcagggccgccaggga

SEQ ID NO: 1313032 - RNA, 19 nt, Homo sapiens
ucugcaggugagcagacag

SEQ ID NO: 1313033 - RNA, 19 nt, Homo sapiens
ucugcauggaacagcauua

SEQ ID NO: 1313034 - RNA, 20 nt, Homo sapiens
ucugcccugaacccacugcu

SEQ ID NO: 1313035 - RNA, 21 nt, Homo sapiens
ucugcccuugccaacggagag

SEQ ID NO: 1313036 - RNA, 16 nt, Homo sapiens
ucugccucccuagcuu

SEQ ID NO: 1313037 - RNA, 22 nt, Homo sapiens
ucugccugcaccccugcaguuu

SEQ ID NO: 1313038 - RNA, 19 nt, Homo sapiens
ucugcgaucaucgucauuu

SEQ ID NO: 1313039 - RNA, 20 nt, Homo sapiens
ucugcucgccuuagcacuac

SEQ ID NO: 1313040 - RNA, 23 nt, Homo sapiens
ucugcuggaaacagacucgauuc

SEQ ID NO: 1313041 - RNA, 15 nt, Homo sapiens
ucuggaccuagggug

SEQ ID NO: 1313042 - RNA, 15 nt, Homo sapiens
ucuggauguggacuu

SEQ ID NO: 1313043 - RNA, 14 nt, Homo sapiens
ucuggccacugucc

SEQ ID NO: 1313044 - RNA, 20 nt, Homo sapiens
ucuggccuugaaaccaccuu

SEQ ID NO: 1313045 - RNA, 14 nt, Homo sapiens
ucuggcucuugagg

SEQ ID NO: 1313046 - RNA, 19 nt, Homo sapiens
ucuggcucuugaggcauuu

SEQ ID NO: 1313047 - RNA, 23 nt, Homo sapiens
ucuggcugcaacuuaaugcucug

SEQ ID NO: 1313048 - RNA, 18 nt, Homo sapiens
ucuggcugugcuaccuga

SEQ ID NO: 1313049 - RNA, 19 nt, Homo sapiens
ucugggaaucaacagcaua

SEQ ID NO: 1313050 - RNA, 15 nt, Homo sapiens
ucugggagaaaauca

SEQ ID NO: 1313051 - RNA, 17 nt, Homo sapiens
ucugggagucacacagu

SEQ ID NO: 1313052 - RNA, 18 nt, Homo sapiens
ucuggguacuucuugaag

SEQ ID NO: 1313053 - RNA, 18 nt, Homo sapiens
ucugggugauaaaauuau

SEQ ID NO: 1313054 - RNA, 16 nt, Homo sapiens
ucugguaagguuucua

SEQ ID NO: 1313055 - RNA, 17 nt, Homo sapiens
ucuggugccagauccuc

SEQ ID NO: 1313056 - RNA, 19 nt, Homo sapiens
ucuggugccagauccucuu

SEQ ID NO: 1313057 - RNA, 22 nt, Homo sapiens
ucuguaagaaaccuacugccca

SEQ ID NO: 1313058 - RNA, 20 nt, Homo sapiens
ucuguaaggacgccuugaug

SEQ ID NO: 1313059 - RNA, 23 nt, Homo sapiens
ucuguacaaaggggaaagaacau

SEQ ID NO: 1313060 - RNA, 14 nt, Homo sapiens
ucuguauguuuacg

SEQ ID NO: 1313061 - RNA, 15 nt, Homo sapiens
ucugucccacuuggc

SEQ ID NO: 1313062 - RNA, 17 nt, Homo sapiens
ucuguccccuucucuca

SEQ ID NO: 1313063 - RNA, 22 nt, Homo sapiens
ucugucuccucaguuaaguguu

SEQ ID NO: 1313064 - RNA, 23 nt, Homo sapiens
ucugucuugaugugucaucuaau

SEQ ID NO: 1313065 - RNA, 14 nt, Homo sapiens
ucugugaagcauuc

SEQ ID NO: 1313066 - RNA, 17 nt, Homo sapiens
ucugugggauaucacau

SEQ ID NO: 1313067 - RNA, 12 nt, Homo sapiens
ucugugugcuga

SEQ ID NO: 1313068 - RNA, 12 nt, Homo sapiens
ucugugugcugc

SEQ ID NO: 1313069 - RNA, 20 nt, Homo sapiens
ucugugugugugugugcaua

SEQ ID NO: 1313070 - RNA, 16 nt, Homo sapiens
ucuguguucaggauac

SEQ ID NO: 1313071 - RNA, 14 nt, Homo sapiens
ucuguuauguacua

SEQ ID NO: 1313072 - RNA, 13 nt, Homo sapiens
ucuguuccauguc

SEQ ID NO: 1313073 - RNA, 22 nt, Homo sapiens
ucuguuggcaggcuggccaguc

SEQ ID NO: 1313074 - RNA, 21 nt, Homo sapiens
ucuguuuccuggucagcaugu

SEQ ID NO: 1313075 - RNA, 22 nt, Homo sapiens
ucuguuugcacacccagcauag

SEQ ID NO: 1313076 - RNA, 11 nt, Homo sapiens
ucuuaacucac

SEQ ID NO: 1313077 - RNA, 23 nt, Homo sapiens
ucuuaauauaaauucacuuucau

SEQ ID NO: 1313078 - RNA, 24 nt, Homo sapiens
ucuuaauauaaauucacuuucauu

SEQ ID NO: 1313079 - RNA, 23 nt, Homo sapiens
ucuuaaugcagacaaacaaacau

SEQ ID NO: 1313080 - RNA, 14 nt, Homo sapiens
ucuuagugugccaa

SEQ ID NO: 1313081 - RNA, 19 nt, Homo sapiens
ucuucaccaacacuguccc

SEQ ID NO: 1313082 - RNA, 18 nt, Homo sapiens
ucuucaccugauucaacu

SEQ ID NO: 1313083 - RNA, 14 nt, Homo sapiens
ucuucagcacuguc

SEQ ID NO: 1313084 - RNA, 21 nt, Homo sapiens
ucuucauauucuaaaaccauu

SEQ ID NO: 1313085 - RNA, 15 nt, Homo sapiens
ucuucauguaccugc

SEQ ID NO: 1313086 - RNA, 22 nt, Homo sapiens
ucuucccucuccccauucggug

SEQ ID NO: 1313087 - RNA, 22 nt, Homo sapiens
ucuucccucucugcagacuucc

SEQ ID NO: 1313088 - RNA, 23 nt, Homo sapiens
ucuucccuuuuacauacugcugu

SEQ ID NO: 1313089 - RNA, 23 nt, Homo sapiens
ucuuccuccgaggccaguaccuu

SEQ ID NO: 1313090 - RNA, 23 nt, Homo sapiens
ucuuccugacauuugucagugau

SEQ ID NO: 1313091 - RNA, 16 nt, Homo sapiens
ucuuccugcacccaca

SEQ ID NO: 1313092 - RNA, 15 nt, Homo sapiens
ucuuccuguguccug

SEQ ID NO: 1313093 - RNA, 13 nt, Homo sapiens
ucuucuaagcaaa

SEQ ID NO: 1313094 - RNA, 17 nt, Homo sapiens
ucuucucaaagcuggga

SEQ ID NO: 1313095 - RNA, 22 nt, Homo sapiens
ucuucugaauauuuuaucuuuc

SEQ ID NO: 1313096 - RNA, 22 nt, Homo sapiens
ucuucuuuucuuuuuuuaaaca

SEQ ID NO: 1313097 - RNA, 20 nt, Homo sapiens
ucuugaaaaacuuacaaguc

SEQ ID NO: 1313098 - RNA, 13 nt, Homo sapiens
ucuugaaagcugu

SEQ ID NO: 1313099 - RNA, 20 nt, Homo sapiens
ucuugaaauuaagaaggcaa

SEQ ID NO: 1313100 - RNA, 22 nt, Homo sapiens
ucuugaccucaggugauccacc

SEQ ID NO: 1313101 - RNA, 22 nt, Homo sapiens
ucuugauguuuagaaaaguauu

SEQ ID NO: 1313102 - RNA, 18 nt, Homo sapiens
ucuugcaauaaaugaaga

SEQ ID NO: 1313103 - RNA, 18 nt, Homo sapiens
ucuugcuguugacauauu

SEQ ID NO: 1313104 - RNA, 16 nt, Homo sapiens
ucuuggccuaaaccuc

SEQ ID NO: 1313105 - RNA, 22 nt, Homo sapiens
ucuugggccaagccagcugccu

SEQ ID NO: 1313106 - RNA, 16 nt, Homo sapiens
ucuugguuugccuucc

SEQ ID NO: 1313107 - RNA, 17 nt, Homo sapiens
ucuuguauucaugaaaa

SEQ ID NO: 1313108 - RNA, 22 nt, Homo sapiens
ucuugucaagucagaacagcca

SEQ ID NO: 1313109 - RNA, 14 nt, Homo sapiens
ucuugucucaaugc

SEQ ID NO: 1313110 - RNA, 15 nt, Homo sapiens
ucuugugccucuaau

SEQ ID NO: 1313111 - RNA, 20 nt, Homo sapiens
ucuuuaaaaguauccagaga

SEQ ID NO: 1313112 - RNA, 13 nt, Homo sapiens
ucuuuaccugggg

SEQ ID NO: 1313113 - RNA, 12 nt, Homo sapiens
ucuuuacuccuc

SEQ ID NO: 1313114 - RNA, 15 nt, Homo sapiens
ucuuuagaacaggga

SEQ ID NO: 1313115 - RNA, 18 nt, Homo sapiens
ucuuucaacugcagugua

SEQ ID NO: 1313116 - RNA, 21 nt, Homo sapiens
ucuuucagacuugccauguga

SEQ ID NO: 1313117 - RNA, 14 nt, Homo sapiens
ucuuucccaauuca

SEQ ID NO: 1313118 - RNA, 20 nt, Homo sapiens
ucuuugagauaauacauucc

SEQ ID NO: 1313119 - RNA, 20 nt, Homo sapiens
ucuuugcagacaggcaagca

SEQ ID NO: 1313120 - RNA, 12 nt, Homo sapiens
ucuuugccaagu

SEQ ID NO: 1313121 - RNA, 17 nt, Homo sapiens
ucuuugccagucauuca

SEQ ID NO: 1313122 - RNA, 21 nt, Homo sapiens
ucuuugcugugggaccucaga

SEQ ID NO: 1313123 - RNA, 14 nt, Homo sapiens
ucuuuguucaagau

SEQ ID NO: 1313124 - RNA, 21 nt, Homo sapiens
ucuuuuaaaaagugugcuuaa

SEQ ID NO: 1313125 - RNA, 22 nt, Homo sapiens
ucuuuuaaagaaauaaccacug

SEQ ID NO: 1313126 - RNA, 20 nt, Homo sapiens
ucuuuuuaauaaaaaggcac

SEQ ID NO: 1313127 - RNA, 13 nt, Homo sapiens
ugaaaaaaagcuu

SEQ ID NO: 1313128 - RNA, 21 nt, Homo sapiens
ugaaaaacuggcaacauucca

SEQ ID NO: 1313129 - RNA, 15 nt, Homo sapiens
ugaaaacaaguccuu

SEQ ID NO: 1313130 - RNA, 16 nt, Homo sapiens
ugaaaacacugugcac

SEQ ID NO: 1313131 - RNA, 21 nt, Homo sapiens
ugaaaagagaaugaugcucaa

SEQ ID NO: 1313132 - RNA, 14 nt, Homo sapiens
ugaaaagguggugu

SEQ ID NO: 1313133 - RNA, 17 nt, Homo sapiens
ugaaaauaaaucaucuu

SEQ ID NO: 1313134 - RNA, 21 nt, Homo sapiens
ugaaacacuuucaggaccuuc

SEQ ID NO: 1313135 - RNA, 22 nt, Homo sapiens
ugaaacagcugccuuagcuuca

SEQ ID NO: 1313136 - RNA, 16 nt, Homo sapiens
ugaaacauuugcaaaa

SEQ ID NO: 1313137 - RNA, 15 nt, Homo sapiens
ugaaagaaaauaaca

SEQ ID NO: 1313138 - RNA, 16 nt, Homo sapiens
ugaaagugacagagac

SEQ ID NO: 1313139 - RNA, 13 nt, Homo sapiens
ugaaaguugccau

SEQ ID NO: 1313140 - RNA, 15 nt, Homo sapiens
ugaaauaaagaacca

SEQ ID NO: 1313141 - RNA, 19 nt, Homo sapiens
ugaaauaauguacaucugg

SEQ ID NO: 1313142 - RNA, 14 nt, Homo sapiens
ugaaauaugcaucu

SEQ ID NO: 1313143 - RNA, 13 nt, Homo sapiens
ugaaauaugugaa

SEQ ID NO: 1313144 - RNA, 17 nt, Homo sapiens
ugaaauauugcuguaua

SEQ ID NO: 1313145 - RNA, 20 nt, Homo sapiens
ugaaaugaggccuacucuaa

SEQ ID NO: 1313146 - RNA, 15 nt, Homo sapiens
ugaaaugcuggcauu

SEQ ID NO: 1313147 - RNA, 11 nt, Homo sapiens
ugaaauggagu

SEQ ID NO: 1313148 - RNA, 19 nt, Homo sapiens
ugaaauggugaaaugcaga

SEQ ID NO: 1313149 - RNA, 17 nt, Homo sapiens
ugaaauuaagaaggcaa

SEQ ID NO: 1313150 - RNA, 15 nt, Homo sapiens
ugaaauuauaaucug

SEQ ID NO: 1313151 - RNA, 15 nt, Homo sapiens
ugaaauucucaucag

SEQ ID NO: 1313152 - RNA, 19 nt, Homo sapiens
ugaaauucugaauuugcaa

SEQ ID NO: 1313153 - RNA, 22 nt, Homo sapiens
ugaaauuguaagugaaguaaaa

SEQ ID NO: 1313154 - RNA, 17 nt, Homo sapiens
ugaacaaccugcucaca

SEQ ID NO: 1313155 - RNA, 24 nt, Homo sapiens
ugaacaaccugcucacaguccuca

SEQ ID NO: 1313156 - RNA, 20 nt, Homo sapiens
ugaacacucuuuugcuuuau

SEQ ID NO: 1313157 - RNA, 19 nt, Homo sapiens
ugaacagcuugcugucacu

SEQ ID NO: 1313158 - RNA, 13 nt, Homo sapiens
ugaacagguguuu

SEQ ID NO: 1313159 - RNA, 18 nt, Homo sapiens
ugaacauuaguugcacua

SEQ ID NO: 1313160 - RNA, 22 nt, Homo sapiens
ugaaccaagaccauugaauucu

SEQ ID NO: 1313161 - RNA, 19 nt, Homo sapiens
ugaaccaaugcaagacgcc

SEQ ID NO: 1313162 - RNA, 15 nt, Homo sapiens
ugaacuaaccaaaua

SEQ ID NO: 1313163 - RNA, 15 nt, Homo sapiens
ugaacuaagcaucuu

SEQ ID NO: 1313164 - RNA, 14 nt, Homo sapiens
ugaacugagccuag

SEQ ID NO: 1313165 - RNA, 11 nt, Homo sapiens
ugaacugcugu

SEQ ID NO: 1313166 - RNA, 22 nt, Homo sapiens
ugaacuggguacuuguggacac

SEQ ID NO: 1313167 - RNA, 20 nt, Homo sapiens
ugaacuguggggugugcaca

SEQ ID NO: 1313168 - RNA, 13 nt, Homo sapiens
ugaacugugugua

SEQ ID NO: 1313169 - RNA, 22 nt, Homo sapiens
ugaagaacaguaacugccauca

SEQ ID NO: 1313170 - RNA, 21 nt, Homo sapiens
ugaagaauauaccauuucaaa

SEQ ID NO: 1313171 - RNA, 12 nt, Homo sapiens
ugaagacuugcc

SEQ ID NO: 1313172 - RNA, 17 nt, Homo sapiens
ugaagagauacagccuu

SEQ ID NO: 1313173 - RNA, 17 nt, Homo sapiens
ugaagagcuaauuuacu

SEQ ID NO: 1313174 - RNA, 17 nt, Homo sapiens
ugaagaggccuaaguca

SEQ ID NO: 1313175 - RNA, 18 nt, Homo sapiens
ugaagaucucacucugcc

SEQ ID NO: 1313176 - RNA, 22 nt, Homo sapiens
ugaagcaaggcgguggacuuga

SEQ ID NO: 1313177 - RNA, 15 nt, Homo sapiens
ugaagccaaagggac

SEQ ID NO: 1313178 - RNA, 13 nt, Homo sapiens
ugaagccacagca

SEQ ID NO: 1313179 - RNA, 18 nt, Homo sapiens
ugaagcugcugucucuag

SEQ ID NO: 1313180 - RNA, 17 nt, Homo sapiens
ugaaggcaaugccaucc

SEQ ID NO: 1313181 - RNA, 21 nt, Homo sapiens
ugaaggcaaugccauccucaa

SEQ ID NO: 1313182 - RNA, 13 nt, Homo sapiens
ugaaggggccaug

SEQ ID NO: 1313183 - RNA, 14 nt, Homo sapiens
ugaaggggccauga

SEQ ID NO: 1313184 - RNA, 17 nt, Homo sapiens
ugaaguaccaccaaaaa

SEQ ID NO: 1313185 - RNA, 16 nt, Homo sapiens
ugaauaauacaguauc

SEQ ID NO: 1313186 - RNA, 22 nt, Homo sapiens
ugaauaauacaguaucucaggg

SEQ ID NO: 1313187 - RNA, 20 nt, Homo sapiens
ugaauacucugcccucuaga

SEQ ID NO: 1313188 - RNA, 22 nt, Homo sapiens
ugaauauuuuucuguaguguga

SEQ ID NO: 1313189 - RNA, 18 nt, Homo sapiens
ugaaugagacccagcuga

SEQ ID NO: 1313190 - RNA, 14 nt, Homo sapiens
ugaaugucacugac

SEQ ID NO: 1313191 - RNA, 22 nt, Homo sapiens
ugaauguguaaugggaaugaga

SEQ ID NO: 1313192 - RNA, 15 nt, Homo sapiens
ugaauuauggaucag

SEQ ID NO: 1313193 - RNA, 19 nt, Homo sapiens
ugaauuguuacaucaugcu

SEQ ID NO: 1313194 - RNA, 15 nt, Homo sapiens
ugaauuucacaagcu

SEQ ID NO: 1313195 - RNA, 12 nt, Homo sapiens
ugacaaaccauc

SEQ ID NO: 1313196 - RNA, 15 nt, Homo sapiens
ugacaaagauuugca

SEQ ID NO: 1313197 - RNA, 15 nt, Homo sapiens
ugacaacuacuuuaa

SEQ ID NO: 1313198 - RNA, 20 nt, Homo sapiens
ugacaaugguguuauuugaa

SEQ ID NO: 1313199 - RNA, 23 nt, Homo sapiens
ugacacaguuaucaaaaaguauu

SEQ ID NO: 1313200 - RNA, 20 nt, Homo sapiens
ugacaccggggggcucccag

SEQ ID NO: 1313201 - RNA, 19 nt, Homo sapiens
ugacacucuauaagauucc

SEQ ID NO: 1313202 - RNA, 17 nt, Homo sapiens
ugacagaggaggaugua

SEQ ID NO: 1313203 - RNA, 23 nt, Homo sapiens
ugacagccagagccugucuuuca

SEQ ID NO: 1313204 - RNA, 22 nt, Homo sapiens
ugacaguuaauaaaccuuugca

SEQ ID NO: 1313205 - RNA, 19 nt, Homo sapiens
ugacauaauuuacaugcaa

SEQ ID NO: 1313206 - RNA, 17 nt, Homo sapiens
ugacauggaggcacuga

SEQ ID NO: 1313207 - RNA, 21 nt, Homo sapiens
ugacaugggggugccaggugc

SEQ ID NO: 1313208 - RNA, 16 nt, Homo sapiens
ugacauucaugccugg

SEQ ID NO: 1313209 - RNA, 14 nt, Homo sapiens
ugacauuccuucuc

SEQ ID NO: 1313210 - RNA, 22 nt, Homo sapiens
ugacauuuauuuuucucaugaa

SEQ ID NO: 1313211 - RNA, 17 nt, Homo sapiens
ugaccaggcgcccggga

SEQ ID NO: 1313212 - RNA, 21 nt, Homo sapiens
ugaccaguuuaaccugaugca

SEQ ID NO: 1313213 - RNA, 15 nt, Homo sapiens
ugaccauaaccacug

SEQ ID NO: 1313214 - RNA, 23 nt, Homo sapiens
ugaccauaaccacugaagggaau

SEQ ID NO: 1313215 - RNA, 14 nt, Homo sapiens
ugaccccagcagcu

SEQ ID NO: 1313216 - RNA, 19 nt, Homo sapiens
ugaccugaggaagcgugaa

SEQ ID NO: 1313217 - RNA, 17 nt, Homo sapiens
ugacgaacuuccauggc

SEQ ID NO: 1313218 - RNA, 15 nt, Homo sapiens
ugacggcaaccucug

SEQ ID NO: 1313219 - RNA, 15 nt, Homo sapiens
ugacucaggacaucc

SEQ ID NO: 1313220 - RNA, 16 nt, Homo sapiens
ugacuccuccaaggaa

SEQ ID NO: 1313221 - RNA, 21 nt, Homo sapiens
ugacuccuccaaggaaaggga

SEQ ID NO: 1313222 - RNA, 16 nt, Homo sapiens
ugacucuggguccuuc

SEQ ID NO: 1313223 - RNA, 19 nt, Homo sapiens
ugacuuauguaaucaaagc

SEQ ID NO: 1313224 - RNA, 16 nt, Homo sapiens
ugacuucaacugggau

SEQ ID NO: 1313225 - RNA, 19 nt, Homo sapiens
ugacuuuaauuuauguaac

SEQ ID NO: 1313226 - RNA, 17 nt, Homo sapiens
ugacuuucuagcuuccc

SEQ ID NO: 1313227 - RNA, 21 nt, Homo sapiens
ugacuuuuuaacuuaacucau

SEQ ID NO: 1313228 - RNA, 14 nt, Homo sapiens
ugagaaacaucuag

SEQ ID NO: 1313229 - RNA, 23 nt, Homo sapiens
ugagaaaccuuauuguaccucuc

SEQ ID NO: 1313230 - RNA, 20 nt, Homo sapiens
ugagaaauauggacacuuaa

SEQ ID NO: 1313231 - RNA, 23 nt, Homo sapiens
ugagaacacagccgauucaccug

SEQ ID NO: 1313232 - RNA, 15 nt, Homo sapiens
ugagaacacugugaa

SEQ ID NO: 1313233 - RNA, 14 nt, Homo sapiens
ugagaacugcauau

SEQ ID NO: 1313234 - RNA, 12 nt, Homo sapiens
ugagaagcucug

SEQ ID NO: 1313235 - RNA, 23 nt, Homo sapiens
ugagaauauaauacuguauuuga

SEQ ID NO: 1313236 - RNA, 23 nt, Homo sapiens
ugagacaggagaccuggcacugg

SEQ ID NO: 1313237 - RNA, 15 nt, Homo sapiens
ugagacagucuugcu

SEQ ID NO: 1313238 - RNA, 16 nt, Homo sapiens
ugagacccugucucaa

SEQ ID NO: 1313239 - RNA, 14 nt, Homo sapiens
ugagacuugccuuc

SEQ ID NO: 1313240 - RNA, 15 nt, Homo sapiens
ugagaggaucaucug

SEQ ID NO: 1313241 - RNA, 17 nt, Homo sapiens
ugagauaauacauuccg

SEQ ID NO: 1313242 - RNA, 18 nt, Homo sapiens
ugagauucccucaccugu

SEQ ID NO: 1313243 - RNA, 19 nt, Homo sapiens
ugagauuguccucauuucu

SEQ ID NO: 1313244 - RNA, 16 nt, Homo sapiens
ugagcaacucuugauu

SEQ ID NO: 1313245 - RNA, 16 nt, Homo sapiens
ugagcaagacauacuu

SEQ ID NO: 1313246 - RNA, 18 nt, Homo sapiens
ugagcagcuuuucucccc

SEQ ID NO: 1313247 - RNA, 14 nt, Homo sapiens
ugagcauggagcug

SEQ ID NO: 1313248 - RNA, 18 nt, Homo sapiens
ugagccaagaugacacaa

SEQ ID NO: 1313249 - RNA, 20 nt, Homo sapiens
ugagccagagacaaggucac

SEQ ID NO: 1313250 - RNA, 16 nt, Homo sapiens
ugagcucccaggugca

SEQ ID NO: 1313251 - RNA, 12 nt, Homo sapiens
ugagcugugcag

SEQ ID NO: 1313252 - RNA, 16 nt, Homo sapiens
ugagcuucuuuagcua

SEQ ID NO: 1313253 - RNA, 15 nt, Homo sapiens
ugaggaaacaacagc

SEQ ID NO: 1313254 - RNA, 15 nt, Homo sapiens
ugaggaacccuuaca

SEQ ID NO: 1313255 - RNA, 15 nt, Homo sapiens
ugaggaugucacuca

SEQ ID NO: 1313256 - RNA, 22 nt, Homo sapiens
ugaggcaggagaaucucuugaa

SEQ ID NO: 1313257 - RNA, 18 nt, Homo sapiens
ugaggcuggcacaggaca

SEQ ID NO: 1313258 - RNA, 22 nt, Homo sapiens
ugagggcaguucugaguguuua

SEQ ID NO: 1313259 - RNA, 15 nt, Homo sapiens
ugaggguuaaugaaa

SEQ ID NO: 1313260 - RNA, 16 nt, Homo sapiens
ugagguggacucucac

SEQ ID NO: 1313261 - RNA, 23 nt, Homo sapiens
ugaguagcucuccugacuuuuaa

SEQ ID NO: 1313262 - RNA, 16 nt, Homo sapiens
ugaguauaaauuuacu

SEQ ID NO: 1313263 - RNA, 18 nt, Homo sapiens
ugaguaucuuaaguacug

SEQ ID NO: 1313264 - RNA, 17 nt, Homo sapiens
ugagucagguuugagua

SEQ ID NO: 1313265 - RNA, 23 nt, Homo sapiens
ugagucgaagaguggacaaacag

SEQ ID NO: 1313266 - RNA, 11 nt, Homo sapiens
ugagugcaagg

SEQ ID NO: 1313267 - RNA, 14 nt, Homo sapiens
ugaguggucuucaa

SEQ ID NO: 1313268 - RNA, 14 nt, Homo sapiens
ugaguuguggugga

SEQ ID NO: 1313269 - RNA, 15 nt, Homo sapiens
ugaguuuguacaguc

SEQ ID NO: 1313270 - RNA, 20 nt, Homo sapiens
ugauacaagaagcacugaca

SEQ ID NO: 1313271 - RNA, 21 nt, Homo sapiens
ugauacuuacugaacugugug

SEQ ID NO: 1313272 - RNA, 12 nt, Homo sapiens
ugauagaagauu

SEQ ID NO: 1313273 - RNA, 23 nt, Homo sapiens
ugauagcacuuucuacaauguga

SEQ ID NO: 1313274 - RNA, 16 nt, Homo sapiens
ugauauacuuacucau

SEQ ID NO: 1313275 - RNA, 12 nt, Homo sapiens
ugauauugcagc

SEQ ID NO: 1313276 - RNA, 15 nt, Homo sapiens
ugauauugcagcuua

SEQ ID NO: 1313277 - RNA, 12 nt, Homo sapiens
ugauccauaaag

SEQ ID NO: 1313278 - RNA, 17 nt, Homo sapiens
ugaucgugcagcugcug

SEQ ID NO: 1313279 - RNA, 14 nt, Homo sapiens
ugaugagcacgguu

SEQ ID NO: 1313280 - RNA, 13 nt, Homo sapiens
ugaugcugggauu

SEQ ID NO: 1313281 - RNA, 23 nt, Homo sapiens
ugaugcugggauuuacacuugag

SEQ ID NO: 1313282 - RNA, 13 nt, Homo sapiens
ugauggagauuaa

SEQ ID NO: 1313283 - RNA, 21 nt, Homo sapiens
ugauggucuuaaggaacaucu

SEQ ID NO: 1313284 - RNA, 10 nt, Homo sapiens
ugauguggac

SEQ ID NO: 1313285 - RNA, 19 nt, Homo sapiens
ugaugugucaucuaauuaa

SEQ ID NO: 1313286 - RNA, 22 nt, Homo sapiens
ugauguuuacagugucugugug

SEQ ID NO: 1313287 - RNA, 21 nt, Homo sapiens
ugauuauccauauugagucaa

SEQ ID NO: 1313288 - RNA, 19 nt, Homo sapiens
ugauucauaguaacuucuu

SEQ ID NO: 1313289 - RNA, 13 nt, Homo sapiens
ugauuguuuacag

SEQ ID NO: 1313290 - RNA, 13 nt, Homo sapiens
ugauuuaaucacc

SEQ ID NO: 1313291 - RNA, 13 nt, Homo sapiens
ugauuuacauuuc

SEQ ID NO: 1313292 - RNA, 14 nt, Homo sapiens
ugauuuuacaauug

SEQ ID NO: 1313293 - RNA, 14 nt, Homo sapiens
ugauuuuguaaaag

SEQ ID NO: 1313294 - RNA, 21 nt, Homo sapiens
ugcaaaagaagugaaacuaua

SEQ ID NO: 1313295 - RNA, 20 nt, Homo sapiens
ugcaaaaguucugacuugac

SEQ ID NO: 1313296 - RNA, 16 nt, Homo sapiens
ugcaaaauccugguga

SEQ ID NO: 1313297 - RNA, 14 nt, Homo sapiens
ugcaaacgcugccu

SEQ ID NO: 1313298 - RNA, 21 nt, Homo sapiens
ugcaaaggacagauccaggga

SEQ ID NO: 1313299 - RNA, 14 nt, Homo sapiens
ugcaaaguacugua

SEQ ID NO: 1313300 - RNA, 20 nt, Homo sapiens
ugcaaaguacuguaagaaua

SEQ ID NO: 1313301 - RNA, 17 nt, Homo sapiens
ugcaaauccuaugugau

SEQ ID NO: 1313302 - RNA, 19 nt, Homo sapiens
ugcaaauccuaugugauuu

SEQ ID NO: 1313303 - RNA, 16 nt, Homo sapiens
ugcaacagggggcaaa

SEQ ID NO: 1313304 - RNA, 19 nt, Homo sapiens
ugcaacuucuaaacacaaa

SEQ ID NO: 1313305 - RNA, 19 nt, Homo sapiens
ugcaagaacucaucacugu

SEQ ID NO: 1313306 - RNA, 15 nt, Homo sapiens
ugcaagagugacagu

SEQ ID NO: 1313307 - RNA, 22 nt, Homo sapiens
ugcaagccccugcuccagaaga

SEQ ID NO: 1313308 - RNA, 20 nt, Homo sapiens
ugcaagguucaacuuauuaa

SEQ ID NO: 1313309 - RNA, 23 nt, Homo sapiens
ugcaauauguuuaucaacucaag

SEQ ID NO: 1313310 - RNA, 15 nt, Homo sapiens
ugcaauuuuucaaga

SEQ ID NO: 1313311 - RNA, 14 nt, Homo sapiens
ugcacaacaaagga

SEQ ID NO: 1313312 - RNA, 18 nt, Homo sapiens
ugcacagaagcacaugca

SEQ ID NO: 1313313 - RNA, 18 nt, Homo sapiens
ugcacaguggggagcaug

SEQ ID NO: 1313314 - RNA, 17 nt, Homo sapiens
ugcacaugcacgugugu

SEQ ID NO: 1313315 - RNA, 16 nt, Homo sapiens
ugcaccaagcaggaaa

SEQ ID NO: 1313316 - RNA, 17 nt, Homo sapiens
ugcaccaccaagccaag

SEQ ID NO: 1313317 - RNA, 23 nt, Homo sapiens
ugcacccagcccagauugucuua

SEQ ID NO: 1313318 - RNA, 18 nt, Homo sapiens
ugcaccccuccccauuca

SEQ ID NO: 1313319 - RNA, 14 nt, Homo sapiens
ugcacgugugugca

SEQ ID NO: 1313320 - RNA, 21 nt, Homo sapiens
ugcacuaccauugcuguucua

SEQ ID NO: 1313321 - RNA, 20 nt, Homo sapiens
ugcacuccagcuugggcaac

SEQ ID NO: 1313322 - RNA, 14 nt, Homo sapiens
ugcacugaaaugga

SEQ ID NO: 1313323 - RNA, 13 nt, Homo sapiens
ugcacuuacauaa

SEQ ID NO: 1313324 - RNA, 15 nt, Homo sapiens
ugcagaccugucacc

SEQ ID NO: 1313325 - RNA, 12 nt, Homo sapiens
ugcagagucaau

SEQ ID NO: 1313326 - RNA, 20 nt, Homo sapiens
ugcagcucuugggaccgugu

SEQ ID NO: 1313327 - RNA, 19 nt, Homo sapiens
ugcagcuugaauuucaaau

SEQ ID NO: 1313328 - RNA, 16 nt, Homo sapiens
ugcaggaccucaggug

SEQ ID NO: 1313329 - RNA, 22 nt, Homo sapiens
ugcaggacuugagaagaccuca

SEQ ID NO: 1313330 - RNA, 13 nt, Homo sapiens
ugcaggauuugaa

SEQ ID NO: 1313331 - RNA, 17 nt, Homo sapiens
ugcaggcaucacagcua

SEQ ID NO: 1313332 - RNA, 20 nt, Homo sapiens
ugcaggccaggccagcugcc

SEQ ID NO: 1313333 - RNA, 16 nt, Homo sapiens
ugcaguaugguacauu

SEQ ID NO: 1313334 - RNA, 17 nt, Homo sapiens
ugcaguaugguacauuu

SEQ ID NO: 1313335 - RNA, 18 nt, Homo sapiens
ugcagugguaugaucacg

SEQ ID NO: 1313336 - RNA, 21 nt, Homo sapiens
ugcaguucauccgcacuguaa

SEQ ID NO: 1313337 - RNA, 15 nt, Homo sapiens
ugcaguuguucuuua

SEQ ID NO: 1313338 - RNA, 21 nt, Homo sapiens
ugcauaagguuuuuaugcaug

SEQ ID NO: 1313339 - RNA, 20 nt, Homo sapiens
ugcauacuggccgagcugcu

SEQ ID NO: 1313340 - RNA, 17 nt, Homo sapiens
ugcauagcaagugaaag

SEQ ID NO: 1313341 - RNA, 20 nt, Homo sapiens
ugcauauauuaucaucaaau

SEQ ID NO: 1313342 - RNA, 20 nt, Homo sapiens
ugcauaugugugugugugca

SEQ ID NO: 1313343 - RNA, 19 nt, Homo sapiens
ugcaucguuucaucuucca

SEQ ID NO: 1313344 - RNA, 23 nt, Homo sapiens
ugcaugaauguaaucaacauucc

SEQ ID NO: 1313345 - RNA, 24 nt, Homo sapiens
ugcauguagucacuuuauaaguca

SEQ ID NO: 1313346 - RNA, 14 nt, Homo sapiens
ugcaugucuacuca

SEQ ID NO: 1313347 - RNA, 21 nt, Homo sapiens
ugcauguuuguuguauacuuc

SEQ ID NO: 1313348 - RNA, 15 nt, Homo sapiens
ugcauuuagcuguau

SEQ ID NO: 1313349 - RNA, 20 nt, Homo sapiens
ugcauuuggauugggguccc

SEQ ID NO: 1313350 - RNA, 13 nt, Homo sapiens
ugcauuuguguca

SEQ ID NO: 1313351 - RNA, 19 nt, Homo sapiens
ugccaaaugcguaugccac

SEQ ID NO: 1313352 - RNA, 16 nt, Homo sapiens
ugccaacauacuuuaa

SEQ ID NO: 1313353 - RNA, 15 nt, Homo sapiens
ugccaagacacagca

SEQ ID NO: 1313354 - RNA, 23 nt, Homo sapiens
ugccacagccuccccugccaggg

SEQ ID NO: 1313355 - RNA, 17 nt, Homo sapiens
ugccaccagcauccaca

SEQ ID NO: 1313356 - RNA, 20 nt, Homo sapiens
ugccaccauggccagccaac

SEQ ID NO: 1313357 - RNA, 17 nt, Homo sapiens
ugccaccuccuggaagg

SEQ ID NO: 1313358 - RNA, 14 nt, Homo sapiens
ugccacugccuucg

SEQ ID NO: 1313359 - RNA, 18 nt, Homo sapiens
ugccagagcagggggacc

SEQ ID NO: 1313360 - RNA, 14 nt, Homo sapiens
ugccagauccucuu

SEQ ID NO: 1313361 - RNA, 14 nt, Homo sapiens
ugccagggccaguc

SEQ ID NO: 1313362 - RNA, 22 nt, Homo sapiens
ugccagugagucugaaugucac

SEQ ID NO: 1313363 - RNA, 20 nt, Homo sapiens
ugccaguuguuaaaaugagc

SEQ ID NO: 1313364 - RNA, 16 nt, Homo sapiens
ugccauaaaacauuaa

SEQ ID NO: 1313365 - RNA, 16 nt, Homo sapiens
ugccauauugcacaug

SEQ ID NO: 1313366 - RNA, 22 nt, Homo sapiens
ugccauauugcacaugucuuaa

SEQ ID NO: 1313367 - RNA, 23 nt, Homo sapiens
ugccaucaagaugagagaacugg

SEQ ID NO: 1313368 - RNA, 20 nt, Homo sapiens
ugccauccucaaacacugca

SEQ ID NO: 1313369 - RNA, 15 nt, Homo sapiens
ugccaugccagcuua

SEQ ID NO: 1313370 - RNA, 22 nt, Homo sapiens
ugccauggaacuguuuccuuca

SEQ ID NO: 1313371 - RNA, 15 nt, Homo sapiens
ugcccaaaacuguca

SEQ ID NO: 1313372 - RNA, 18 nt, Homo sapiens
ugcccaccugucaaacaa

SEQ ID NO: 1313373 - RNA, 15 nt, Homo sapiens
ugcccaggcacugca

SEQ ID NO: 1313374 - RNA, 17 nt, Homo sapiens
ugcccaggcuggucuca

SEQ ID NO: 1313375 - RNA, 18 nt, Homo sapiens
ugccccacauguggccau

SEQ ID NO: 1313376 - RNA, 18 nt, Homo sapiens
ugccccagaaaaauaacu

SEQ ID NO: 1313377 - RNA, 14 nt, Homo sapiens
ugccccagccugcu

SEQ ID NO: 1313378 - RNA, 17 nt, Homo sapiens
ugcccccaauccaugaa

SEQ ID NO: 1313379 - RNA, 21 nt, Homo sapiens
ugccccucggccccagcacau

SEQ ID NO: 1313380 - RNA, 20 nt, Homo sapiens
ugccccucucugggccucag

SEQ ID NO: 1313381 - RNA, 16 nt, Homo sapiens
ugccccuggaugcacu

SEQ ID NO: 1313382 - RNA, 18 nt, Homo sapiens
ugcccggcaggguccuag

SEQ ID NO: 1313383 - RNA, 15 nt, Homo sapiens
ugcccucuagagccu

SEQ ID NO: 1313384 - RNA, 17 nt, Homo sapiens
ugcccuuaaacauugga

SEQ ID NO: 1313385 - RNA, 13 nt, Homo sapiens
ugcccuuuuccag

SEQ ID NO: 1313386 - RNA, 17 nt, Homo sapiens
ugccuaugaaauuucaa

SEQ ID NO: 1313387 - RNA, 22 nt, Homo sapiens
ugccucagccucccaaagugcu

SEQ ID NO: 1313388 - RNA, 17 nt, Homo sapiens
ugccuccaggagcugca

SEQ ID NO: 1313389 - RNA, 21 nt, Homo sapiens
ugccucccccuaaauuaauga

SEQ ID NO: 1313390 - RNA, 15 nt, Homo sapiens
ugccuccuacuccag

SEQ ID NO: 1313391 - RNA, 22 nt, Homo sapiens
ugccucucugcuccaccuugug

SEQ ID NO: 1313392 - RNA, 17 nt, Homo sapiens
ugccucugccucugaca

SEQ ID NO: 1313393 - RNA, 13 nt, Homo sapiens
ugccugacauuug

SEQ ID NO: 1313394 - RNA, 19 nt, Homo sapiens
ugccugcaggcaugaguca

SEQ ID NO: 1313395 - RNA, 23 nt, Homo sapiens
ugccugccccaaacaaauaugca

SEQ ID NO: 1313396 - RNA, 18 nt, Homo sapiens
ugccuggguugcugcugu

SEQ ID NO: 1313397 - RNA, 16 nt, Homo sapiens
ugccugguggcagcug

SEQ ID NO: 1313398 - RNA, 22 nt, Homo sapiens
ugccuuaccgagagccaaacag

SEQ ID NO: 1313399 - RNA, 16 nt, Homo sapiens
ugccuugccuccucag

SEQ ID NO: 1313400 - RNA, 16 nt, Homo sapiens
ugccuuggagaucaaa

SEQ ID NO: 1313401 - RNA, 18 nt, Homo sapiens
ugccuuucgaggccugaa

SEQ ID NO: 1313402 - RNA, 21 nt, Homo sapiens
ugcgaucuggguucacugcaa

SEQ ID NO: 1313403 - RNA, 22 nt, Homo sapiens
ugcgccaguccugcuaccuccc

SEQ ID NO: 1313404 - RNA, 16 nt, Homo sapiens
ugcgcuguaguaggca

SEQ ID NO: 1313405 - RNA, 17 nt, Homo sapiens
ugcggcauuaaagccau

SEQ ID NO: 1313406 - RNA, 18 nt, Homo sapiens
ugcgggugaacaaagcag

SEQ ID NO: 1313407 - RNA, 13 nt, Homo sapiens
ugcguacacagag

SEQ ID NO: 1313408 - RNA, 13 nt, Homo sapiens
ugcuaaaugugaa

SEQ ID NO: 1313409 - RNA, 21 nt, Homo sapiens
ugcuacagggcucacagaauu

SEQ ID NO: 1313410 - RNA, 15 nt, Homo sapiens
ugcuaccugagccaa

SEQ ID NO: 1313411 - RNA, 16 nt, Homo sapiens
ugcuaucgccaucaca

SEQ ID NO: 1313412 - RNA, 15 nt, Homo sapiens
ugcuauguucugucu

SEQ ID NO: 1313413 - RNA, 17 nt, Homo sapiens
ugcucaaaaucuuucca

SEQ ID NO: 1313414 - RNA, 20 nt, Homo sapiens
ugcucaaaaucuuuccaaau

SEQ ID NO: 1313415 - RNA, 19 nt, Homo sapiens
ugcucacauaucugucauu

SEQ ID NO: 1313416 - RNA, 16 nt, Homo sapiens
ugcucagggaaaagca

SEQ ID NO: 1313417 - RNA, 17 nt, Homo sapiens
ugcucagguacuuguaa

SEQ ID NO: 1313418 - RNA, 11 nt, Homo sapiens
ugcuccaggga

SEQ ID NO: 1313419 - RNA, 17 nt, Homo sapiens
ugcucccugacagcacc

SEQ ID NO: 1313420 - RNA, 19 nt, Homo sapiens
ugcucccugguucugauga

SEQ ID NO: 1313421 - RNA, 19 nt, Homo sapiens
ugcuccuugggcccuuuga

SEQ ID NO: 1313422 - RNA, 17 nt, Homo sapiens
ugcuccuuguuccuaga

SEQ ID NO: 1313423 - RNA, 20 nt, Homo sapiens
ugcucugcuugacaacaucu

SEQ ID NO: 1313424 - RNA, 18 nt, Homo sapiens
ugcucuugagucuuugca

SEQ ID NO: 1313425 - RNA, 23 nt, Homo sapiens
ugcucuuuaugaaugaaaaaaca

SEQ ID NO: 1313426 - RNA, 16 nt, Homo sapiens
ugcugaaacagaauac

SEQ ID NO: 1313427 - RNA, 17 nt, Homo sapiens
ugcugccaaacacccau

SEQ ID NO: 1313428 - RNA, 17 nt, Homo sapiens
ugcugcuccagugcagg

SEQ ID NO: 1313429 - RNA, 19 nt, Homo sapiens
ugcuggaaccugcaaaaaa

SEQ ID NO: 1313430 - RNA, 17 nt, Homo sapiens
ugcuggagaaaucuuga

SEQ ID NO: 1313431 - RNA, 17 nt, Homo sapiens
ugcuggagucaugugcc

SEQ ID NO: 1313432 - RNA, 21 nt, Homo sapiens
ugcuggagucaugugccucug

SEQ ID NO: 1313433 - RNA, 15 nt, Homo sapiens
ugcuggcauuugcac

SEQ ID NO: 1313434 - RNA, 17 nt, Homo sapiens
ugcuggugaaaacaauu

SEQ ID NO: 1313435 - RNA, 22 nt, Homo sapiens
ugcuguuuuuguucuacucuag

SEQ ID NO: 1313436 - RNA, 15 nt, Homo sapiens
ugcuuaacauugaca

SEQ ID NO: 1313437 - RNA, 19 nt, Homo sapiens
ugcuucagcucuucuugac

SEQ ID NO: 1313438 - RNA, 15 nt, Homo sapiens
ugcuucagugcugcu

SEQ ID NO: 1313439 - RNA, 22 nt, Homo sapiens
ugcuucccagguucaagcgauu

SEQ ID NO: 1313440 - RNA, 23 nt, Homo sapiens
ugcuuccccuuuugccaaucuca

SEQ ID NO: 1313441 - RNA, 21 nt, Homo sapiens
ugcuucucuaugauaauuaca

SEQ ID NO: 1313442 - RNA, 19 nt, Homo sapiens
ugcuucugcuuauucaguc

SEQ ID NO: 1313443 - RNA, 17 nt, Homo sapiens
ugcuugacaacaucuga

SEQ ID NO: 1313444 - RNA, 18 nt, Homo sapiens
ugcuuggagcugagcaaa

SEQ ID NO: 1313445 - RNA, 15 nt, Homo sapiens
ugcuugucaucugca

SEQ ID NO: 1313446 - RNA, 16 nt, Homo sapiens
ugcuuucacucuuuag

SEQ ID NO: 1313447 - RNA, 18 nt, Homo sapiens
ugcuuucuugucuuuaga

SEQ ID NO: 1313448 - RNA, 19 nt, Homo sapiens
ugcuuugcccagcauuuua

SEQ ID NO: 1313449 - RNA, 13 nt, Homo sapiens
ugcuuuguugcac

SEQ ID NO: 1313450 - RNA, 18 nt, Homo sapiens
ugcuuuuccaaacauucu

SEQ ID NO: 1313451 - RNA, 16 nt, Homo sapiens
ugcuuuucccauugcc

SEQ ID NO: 1313452 - RNA, 18 nt, Homo sapiens
ugcuuuuguuccaauguc

SEQ ID NO: 1313453 - RNA, 16 nt, Homo sapiens
uggaaaaagucacauu

SEQ ID NO: 1313454 - RNA, 12 nt, Homo sapiens
uggaaaaugcau

SEQ ID NO: 1313455 - RNA, 16 nt, Homo sapiens
uggaaaccucaugcca

SEQ ID NO: 1313456 - RNA, 18 nt, Homo sapiens
uggaaagacaagcucaag

SEQ ID NO: 1313457 - RNA, 19 nt, Homo sapiens
uggaacacaaagaccaaaa

SEQ ID NO: 1313458 - RNA, 15 nt, Homo sapiens
uggaacacggccaca

SEQ ID NO: 1313459 - RNA, 21 nt, Homo sapiens
uggaacagcauuacccuccuc

SEQ ID NO: 1313460 - RNA, 22 nt, Homo sapiens
uggaacaucaucaaggcacugc

SEQ ID NO: 1313461 - RNA, 17 nt, Homo sapiens
uggaacccaagccucau

SEQ ID NO: 1313462 - RNA, 16 nt, Homo sapiens
uggaacccccagaaua

SEQ ID NO: 1313463 - RNA, 20 nt, Homo sapiens
uggaaccucagccuggccag

SEQ ID NO: 1313464 - RNA, 21 nt, Homo sapiens
uggaacuuuuauuacuggggu

SEQ ID NO: 1313465 - RNA, 16 nt, Homo sapiens
uggaagauccugugag

SEQ ID NO: 1313466 - RNA, 15 nt, Homo sapiens
uggaagcacagcuuc

SEQ ID NO: 1313467 - RNA, 18 nt, Homo sapiens
uggaagcuaauuugcauu

SEQ ID NO: 1313468 - RNA, 13 nt, Homo sapiens
uggaaggacccug

SEQ ID NO: 1313469 - RNA, 20 nt, Homo sapiens
uggaaggcugcuuucuccuu

SEQ ID NO: 1313470 - RNA, 12 nt, Homo sapiens
uggaagggucaa

SEQ ID NO: 1313471 - RNA, 19 nt, Homo sapiens
uggaaguugcauggcauca

SEQ ID NO: 1313472 - RNA, 18 nt, Homo sapiens
uggaauaauccuaaacau

SEQ ID NO: 1313473 - RNA, 15 nt, Homo sapiens
uggaaucccacugua

SEQ ID NO: 1313474 - RNA, 17 nt, Homo sapiens
uggaaugaagguaauau

SEQ ID NO: 1313475 - RNA, 18 nt, Homo sapiens
uggaaugcacagggcaau

SEQ ID NO: 1313476 - RNA, 16 nt, Homo sapiens
uucuucaccucuucca

SEQ ID NO: 1313477 - RNA, 19 nt, Homo sapiens
uucuugaguugucuuuugc

SEQ ID NO: 1313478 - RNA, 22 nt, Homo sapiens
uucuuuaaaaaacaacuaugga

SEQ ID NO: 1313479 - RNA, 21 nt, Homo sapiens
uucuuuaaaauguaaagccau

SEQ ID NO: 1313480 - RNA, 21 nt, Homo sapiens
uucuuuagaauuuuuacccaa

SEQ ID NO: 1313481 - RNA, 22 nt, Homo sapiens
uucuuuagaauuuuuacccaau

SEQ ID NO: 1313482 - RNA, 17 nt, Homo sapiens
uucuuuaguacuuacau

SEQ ID NO: 1313483 - RNA, 13 nt, Homo sapiens
uucuuuucccuca

SEQ ID NO: 1313484 - RNA, 22 nt, Homo sapiens
uugaaaaacuaaaacagaaaaa

SEQ ID NO: 1313485 - RNA, 19 nt, Homo sapiens
uugaaaaaugagagcugua

SEQ ID NO: 1313486 - RNA, 18 nt, Homo sapiens
uugaaaccaagcuuucaa

SEQ ID NO: 1313487 - RNA, 17 nt, Homo sapiens
uugaaauuaaccauaga

SEQ ID NO: 1313488 - RNA, 19 nt, Homo sapiens
uugaacagcuugcugcuaa

SEQ ID NO: 1313489 - RNA, 12 nt, Homo sapiens
uugaacauggaa

SEQ ID NO: 1313490 - RNA, 21 nt, Homo sapiens
uugaacuaagcaucuuuauau

SEQ ID NO: 1313491 - RNA, 23 nt, Homo sapiens
uugaagaauuuguuuuagguaga

SEQ ID NO: 1313492 - RNA, 19 nt, Homo sapiens
uugaagaggccuaagucaa

SEQ ID NO: 1313493 - RNA, 16 nt, Homo sapiens
uugaagauaguaacug

SEQ ID NO: 1313494 - RNA, 21 nt, Homo sapiens
uugaagauaguaacuguagau

SEQ ID NO: 1313495 - RNA, 21 nt, Homo sapiens
uugaagaugcuuguauuuuac

SEQ ID NO: 1313496 - RNA, 16 nt, Homo sapiens
uugaaggaucaucuga

SEQ ID NO: 1313497 - RNA, 20 nt, Homo sapiens
uugaaggugcugacggccag

SEQ ID NO: 1313498 - RNA, 14 nt, Homo sapiens
uugaaguguucuga

SEQ ID NO: 1313499 - RNA, 23 nt, Homo sapiens
uugaaucuugucucaaugcucau

SEQ ID NO: 1313500 - RNA, 22 nt, Homo sapiens
uugaaugacauuuuagggacau

SEQ ID NO: 1313501 - RNA, 23 nt, Homo sapiens
uugaauguugguuuuaauacuug

SEQ ID NO: 1313502 - RNA, 13 nt, Homo sapiens
uugacaacccaaa

SEQ ID NO: 1313503 - RNA, 12 nt, Homo sapiens
uugaccucaggu

SEQ ID NO: 1313504 - RNA, 16 nt, Homo sapiens
uugacuggcuguguga

SEQ ID NO: 1313505 - RNA, 11 nt, Homo sapiens
uugacuuuguc

SEQ ID NO: 1313506 - RNA, 11 nt, Homo sapiens
uugagacagag

SEQ ID NO: 1313507 - RNA, 23 nt, Homo sapiens
uugagccaagcuucaacccucag

SEQ ID NO: 1313508 - RNA, 16 nt, Homo sapiens
uugaggcaguuccagg

SEQ ID NO: 1313509 - RNA, 19 nt, Homo sapiens
uugagguggacucucacca

SEQ ID NO: 1313510 - RNA, 21 nt, Homo sapiens
uugaguuugucgcucaugugu

SEQ ID NO: 1313511 - RNA, 23 nt, Homo sapiens
uugauaagagggcacacacugug

SEQ ID NO: 1313512 - RNA, 23 nt, Homo sapiens
uugauaagcuauugucuguaaua

SEQ ID NO: 1313513 - RNA, 12 nt, Homo sapiens
uugauacaguca

SEQ ID NO: 1313514 - RNA, 13 nt, Homo sapiens
uugauagcugucc

SEQ ID NO: 1313515 - RNA, 17 nt, Homo sapiens
uugauauaaucuuucaa

SEQ ID NO: 1313516 - RNA, 17 nt, Homo sapiens
uugauauuuuuucucuc

SEQ ID NO: 1313517 - RNA, 21 nt, Homo sapiens
uugaucuggaacccagacuca

SEQ ID NO: 1313518 - RNA, 22 nt, Homo sapiens
uugaucuggaacccagacucag

SEQ ID NO: 1313519 - RNA, 16 nt, Homo sapiens
uugaugcuacaggauu

SEQ ID NO: 1313520 - RNA, 12 nt, Homo sapiens
uugaugcuugua

SEQ ID NO: 1313521 - RNA, 14 nt, Homo sapiens
uugauucuccuuca

SEQ ID NO: 1313522 - RNA, 23 nt, Homo sapiens
uugauuuaaucaccacucaaaaa

SEQ ID NO: 1313523 - RNA, 14 nt, Homo sapiens
uugcaaccucgcug

SEQ ID NO: 1313524 - RNA, 17 nt, Homo sapiens
uugcacagaagcacaug

SEQ ID NO: 1313525 - RNA, 15 nt, Homo sapiens
uugcacagggauucu

SEQ ID NO: 1313526 - RNA, 21 nt, Homo sapiens
uugcacaugucuuaaugaagu

SEQ ID NO: 1313527 - RNA, 18 nt, Homo sapiens
uugcacuaucuuucagcu

SEQ ID NO: 1313528 - RNA, 16 nt, Homo sapiens
uugcacugaaauggaa

SEQ ID NO: 1313529 - RNA, 22 nt, Homo sapiens
uugcagaagcaaucgggauaaa

SEQ ID NO: 1313530 - RNA, 14 nt, Homo sapiens
uugcagacaggcaa

SEQ ID NO: 1313531 - RNA, 14 nt, Homo sapiens
uugcagauuaaaga

SEQ ID NO: 1313532 - RNA, 20 nt, Homo sapiens
uugcaggauggugucucuuc

SEQ ID NO: 1313533 - RNA, 18 nt, Homo sapiens
uugcauagcagcugcuac

SEQ ID NO: 1313534 - RNA, 14 nt, Homo sapiens
uugcauuucuguau

SEQ ID NO: 1313535 - RNA, 18 nt, Homo sapiens
cacugaugggcaaccccc

SEQ ID NO: 1313536 - RNA, 18 nt, Homo sapiens
cacugcaaguuuuaguua

SEQ ID NO: 1313537 - RNA, 19 nt, Homo sapiens
cacugcauaccaaccuggg

SEQ ID NO: 1313538 - RNA, 19 nt, Homo sapiens
cacugccagucucacugug

SEQ ID NO: 1313539 - RNA, 23 nt, Homo sapiens
cacugccaugcagggccucacac

SEQ ID NO: 1313540 - RNA, 14 nt, Homo sapiens
cacugccugaggcu

SEQ ID NO: 1313541 - RNA, 15 nt, Homo sapiens
cacugcuugaggaaa

SEQ ID NO: 1313542 - RNA, 23 nt, Homo sapiens
cacugcuugaggaaaacaagcau

SEQ ID NO: 1313543 - RNA, 19 nt, Homo sapiens
cacuggcuucaggcaaagc

SEQ ID NO: 1313544 - RNA, 15 nt, Homo sapiens
cacugggaaacagag

SEQ ID NO: 1313545 - RNA, 17 nt, Homo sapiens
cacuguaugauuuauaa

SEQ ID NO: 1313546 - RNA, 15 nt, Homo sapiens
cacuguauguuauag

SEQ ID NO: 1313547 - RNA, 13 nt, Homo sapiens
cacugugagcucc

SEQ ID NO: 1313548 - RNA, 23 nt, Homo sapiens
cacugugggaaggccagcugccc

SEQ ID NO: 1313549 - RNA, 14 nt, Homo sapiens
cacuguugcccagg

SEQ ID NO: 1313550 - RNA, 14 nt, Homo sapiens
cacuguuugucuca

SEQ ID NO: 1313551 - RNA, 14 nt, Homo sapiens
acuugcugccugaa

SEQ ID NO: 1313552 - RNA, 16 nt, Homo sapiens
acuuggacuuguccuc

SEQ ID NO: 1313553 - RNA, 20 nt, Homo sapiens
acuuggugggaccaugaaca

SEQ ID NO: 1313554 - RNA, 21 nt, Homo sapiens
acuugucauuucuacuuucag

SEQ ID NO: 1313555 - RNA, 18 nt, Homo sapiens
acuugugccaacacucaa

SEQ ID NO: 1313556 - RNA, 13 nt, Homo sapiens
acuugugcuauaa

SEQ ID NO: 1313557 - RNA, 14 nt, Homo sapiens
acuuguuugcacug

SEQ ID NO: 1313558 - RNA, 16 nt, Homo sapiens
acuuguuugcacugug

SEQ ID NO: 1313559 - RNA, 22 nt, Homo sapiens
acuuuaauccuuccacuaucau

SEQ ID NO: 1313560 - RNA, 19 nt, Homo sapiens
acuuuacugagacaaugua

SEQ ID NO: 1313561 - RNA, 16 nt, Homo sapiens
acuuuagaagcacagu

SEQ ID NO: 1313562 - RNA, 14 nt, Homo sapiens
acuuuagguucaca

SEQ ID NO: 1313563 - RNA, 18 nt, Homo sapiens
acuuucagguacuaaaua

SEQ ID NO: 1313564 - RNA, 20 nt, Homo sapiens
acuuucuuauccuagcacau

SEQ ID NO: 1313565 - RNA, 20 nt, Homo sapiens
acuuugcuugcucauaugca

SEQ ID NO: 1313566 - RNA, 20 nt, Homo sapiens
acuuuggaacacuacucuua

SEQ ID NO: 1313567 - RNA, 16 nt, Homo sapiens
acuuuuggaaggugac

SEQ ID NO: 1313568 - RNA, 13 nt, Homo sapiens
acuuuuuacauua

SEQ ID NO: 1313569 - RNA, 17 nt, Homo sapiens
acuuuuucuuguauuca

SEQ ID NO: 1313570 - RNA, 21 nt, Homo sapiens
acuuuuucuuguauucaugaa

SEQ ID NO: 1313571 - RNA, 17 nt, Homo sapiens
acuuuuugguacaggua

SEQ ID NO: 1313572 - RNA, 23 nt, Homo sapiens
agaaaaaaauucaugauacucau

SEQ ID NO: 1313573 - RNA, 15 nt, Homo sapiens
agaaaaacaaauuca

SEQ ID NO: 1313574 - RNA, 11 nt, Homo sapiens
agaaaaaccac

SEQ ID NO: 1313575 - RNA, 20 nt, Homo sapiens
agaaaaaggccgggugacac

SEQ ID NO: 1313576 - RNA, 12 nt, Homo sapiens
agaaaacaucua

SEQ ID NO: 1313577 - RNA, 11 nt, Homo sapiens
agaaaacuggg

SEQ ID NO: 1313578 - RNA, 14 nt, Homo sapiens
agaaaagugcauau

SEQ ID NO: 1313579 - RNA, 22 nt, Homo sapiens
agaaaauacuauuucaagucau

SEQ ID NO: 1313580 - RNA, 18 nt, Homo sapiens
agaaaauucaagcauuua

SEQ ID NO: 1313581 - RNA, 11 nt, Homo sapiens
agaaacucaau

SEQ ID NO: 1313582 - RNA, 13 nt, Homo sapiens
agaaacucaaugc

SEQ ID NO: 1313583 - RNA, 19 nt, Homo sapiens
agaaagaaguuauuuucca

SEQ ID NO: 1313584 - RNA, 15 nt, Homo sapiens
agaaagaucaaagac

SEQ ID NO: 1313585 - RNA, 14 nt, Homo sapiens
agaaaguacuucuu

SEQ ID NO: 1313586 - RNA, 21 nt, Homo sapiens
agaaauaaggacaagccuaac

SEQ ID NO: 1313587 - RNA, 20 nt, Homo sapiens
agaaauaauaugcauuguca

SEQ ID NO: 1313588 - RNA, 18 nt, Homo sapiens
agaaauauggacacuuaa

SEQ ID NO: 1313589 - RNA, 13 nt, Homo sapiens
agaaaugcugcug

SEQ ID NO: 1313590 - RNA, 18 nt, Homo sapiens
agaaaugguuguauuaga

SEQ ID NO: 1313591 - RNA, 22 nt, Homo sapiens
agaaauugacacaaguggaccu

SEQ ID NO: 1313592 - RNA, 18 nt, Homo sapiens
agaaauuuuucuaguaua

SEQ ID NO: 1313593 - RNA, 20 nt, Homo sapiens
agaacacccucuaaauggga

SEQ ID NO: 1313594 - RNA, 12 nt, Homo sapiens
agaacacuguga

SEQ ID NO: 1313595 - RNA, 21 nt, Homo sapiens
agaacagguguuggugacaau

SEQ ID NO: 1313596 - RNA, 17 nt, Homo sapiens
agaacaguaacugccau

SEQ ID NO: 1313597 - RNA, 23 nt, Homo sapiens
agaacauuuuaauucaucccaac

SEQ ID NO: 1313598 - RNA, 16 nt, Homo sapiens
agaacgaaccuuggcc

SEQ ID NO: 1313599 - RNA, 15 nt, Homo sapiens
agaacguggugaccu

SEQ ID NO: 1313600 - RNA, 23 nt, Homo sapiens
agaacguggugaccuuucacgaa

SEQ ID NO: 1313601 - RNA, 15 nt, Homo sapiens
agaacucacuggggc

SEQ ID NO: 1313602 - RNA, 18 nt, Homo sapiens
agaacucaucacuguggc

SEQ ID NO: 1313603 - RNA, 17 nt, Homo sapiens
agaacuuuauuuuggau

SEQ ID NO: 1313604 - RNA, 22 nt, Homo sapiens
agaacuuugcauagcagcugcu

SEQ ID NO: 1313605 - RNA, 18 nt, Homo sapiens
agaagacauauaaauuaa

SEQ ID NO: 1313606 - RNA, 21 nt, Homo sapiens
agaagaccccugacucaucau

SEQ ID NO: 1313607 - RNA, 23 nt, Homo sapiens
agaagacugcuccacccaugaug

SEQ ID NO: 1313608 - RNA, 22 nt, Homo sapiens
agaagauaugugaagaaaaaug

SEQ ID NO: 1313609 - RNA, 13 nt, Homo sapiens
agaagaucuguaa

SEQ ID NO: 1313610 - RNA, 23 nt, Homo sapiens
agaagccucugggucaguggucc

SEQ ID NO: 1313611 - RNA, 23 nt, Homo sapiens
agaagccugaugcugacauucac

SEQ ID NO: 1313612 - RNA, 13 nt, Homo sapiens
agaagcucuuacu

SEQ ID NO: 1313613 - RNA, 20 nt, Homo sapiens
agaagcugagcaccagggga

SEQ ID NO: 1313614 - RNA, 17 nt, Homo sapiens
agaaggauguacauuuc

SEQ ID NO: 1313615 - RNA, 14 nt, Homo sapiens
agaaggcaaaaaug

SEQ ID NO: 1313616 - RNA, 23 nt, Homo sapiens
agaaggcuauguaaacaaaccac

SEQ ID NO: 1313617 - RNA, 18 nt, Homo sapiens
agaagggaauccuccucc

SEQ ID NO: 1313618 - RNA, 20 nt, Homo sapiens
agaagggaauuuauugccuc

SEQ ID NO: 1313619 - RNA, 15 nt, Homo sapiens
agaagggcacuguaa

SEQ ID NO: 1313620 - RNA, 21 nt, Homo sapiens
agaagucauggcccaaaucca

SEQ ID NO: 1313621 - RNA, 18 nt, Homo sapiens
agaaguccuuauguuaag

SEQ ID NO: 1313622 - RNA, 15 nt, Homo sapiens
agaagugccaucuca

SEQ ID NO: 1313623 - RNA, 23 nt, Homo sapiens
agaagugccaucucaauugugcu

SEQ ID NO: 1313624 - RNA, 13 nt, Homo sapiens
agaaguuugcacu

SEQ ID NO: 1313625 - RNA, 16 nt, Homo sapiens
agaauacuccacacau

SEQ ID NO: 1313626 - RNA, 17 nt, Homo sapiens
agaauauaccauuucaa

SEQ ID NO: 1313627 - RNA, 22 nt, Homo sapiens
agaauaugaaugagaaugugcc

SEQ ID NO: 1313628 - RNA, 21 nt, Homo sapiens
agaauauuauaaagugcuuua

SEQ ID NO: 1313629 - RNA, 19 nt, Homo sapiens
agaauauuuauuaccucug

SEQ ID NO: 1313630 - RNA, 20 nt, Homo sapiens
agaauauuuuaaguauugca

SEQ ID NO: 1313631 - RNA, 13 nt, Homo sapiens
agaaucaaaugca

SEQ ID NO: 1313632 - RNA, 18 nt, Homo sapiens
agaaucacuugaacccgg

SEQ ID NO: 1313633 - RNA, 17 nt, Homo sapiens
agaaucuugguuugccu

SEQ ID NO: 1313634 - RNA, 16 nt, Homo sapiens
agaaugguauuugaau

SEQ ID NO: 1313635 - RNA, 19 nt, Homo sapiens
agaauguuaaaaagugaaa

SEQ ID NO: 1313636 - RNA, 20 nt, Homo sapiens
agaauuagaaacaacauagc

SEQ ID NO: 1313637 - RNA, 20 nt, Homo sapiens
agaauucauuccccagcucc

SEQ ID NO: 1313638 - RNA, 16 nt, Homo sapiens
agaauugguugccaua

SEQ ID NO: 1313639 - RNA, 12 nt, Homo sapiens
agaauuucacaa

SEQ ID NO: 1313640 - RNA, 12 nt, Homo sapiens
agacaaaaugga

SEQ ID NO: 1313641 - RNA, 20 nt, Homo sapiens
agacaaagacucacucuguc

SEQ ID NO: 1313642 - RNA, 13 nt, Homo sapiens
agacaagauuuau

SEQ ID NO: 1313643 - RNA, 21 nt, Homo sapiens
agacaagcucaaguguucaca

SEQ ID NO: 1313644 - RNA, 18 nt, Homo sapiens
agacaauaaagaacugaa

SEQ ID NO: 1313645 - RNA, 17 nt, Homo sapiens
agacaccuugacagggc

SEQ ID NO: 1313646 - RNA, 21 nt, Homo sapiens
agacaccuuggacauccuccu

SEQ ID NO: 1313647 - RNA, 22 nt, Homo sapiens
agacacggagcccagcccuccc

SEQ ID NO: 1313648 - RNA, 22 nt, Homo sapiens
agacacuaaaaacuguuaauca

SEQ ID NO: 1313649 - RNA, 20 nt, Homo sapiens
agacacucagaccagagaag

SEQ ID NO: 1313650 - RNA, 19 nt, Homo sapiens
agacacuggcguuacugcu

SEQ ID NO: 1313651 - RNA, 14 nt, Homo sapiens
cauagcaugacauu

SEQ ID NO: 1313652 - RNA, 18 nt, Homo sapiens
cauagcugagguaaaaac

SEQ ID NO: 1313653 - RNA, 21 nt, Homo sapiens
cauagcugugcuaugagguuu

SEQ ID NO: 1313654 - RNA, 21 nt, Homo sapiens
cauaguaugguggcuggguug

SEQ ID NO: 1313655 - RNA, 12 nt, Homo sapiens
cauagucccugc

SEQ ID NO: 1313656 - RNA, 20 nt, Homo sapiens
cauauacaauaauguaauuu

SEQ ID NO: 1313657 - RNA, 15 nt, Homo sapiens
cauauauguagcuuu

SEQ ID NO: 1313658 - RNA, 17 nt, Homo sapiens
cauauauuggcacugcu

SEQ ID NO: 1313659 - RNA, 23 nt, Homo sapiens
cauauauuugaaguggagccaua

SEQ ID NO: 1313660 - RNA, 10 nt, Homo sapiens
cauaugcaug

SEQ ID NO: 1313661 - RNA, 18 nt, Homo sapiens
cauaugugugugugugca

SEQ ID NO: 1313662 - RNA, 15 nt, Homo sapiens
cauauuagugcagcc

SEQ ID NO: 1313663 - RNA, 15 nt, Homo sapiens
cuguuaaauucucag

SEQ ID NO: 1313664 - RNA, 16 nt, Homo sapiens
cuguuauuaacagaua

SEQ ID NO: 1313665 - RNA, 23 nt, Homo sapiens
cuuguaaauagcucagguguccc

SEQ ID NO: 1313666 - RNA, 20 nt, Homo sapiens
cuugucauuucuacuuucag

SEQ ID NO: 1313667 - RNA, 16 nt, Homo sapiens
cuugucugucuaguua

SEQ ID NO: 1313668 - RNA, 20 nt, Homo sapiens
cuuguugagauccccguguu

SEQ ID NO: 1313669 - RNA, 18 nt, Homo sapiens
cuuguugcuuuguugcac

SEQ ID NO: 1313670 - RNA, 17 nt, Homo sapiens
cuuguuguuauugaugu

SEQ ID NO: 1313671 - RNA, 16 nt, Homo sapiens
cuuguuugcacugugu

SEQ ID NO: 1313672 - RNA, 16 nt, Homo sapiens
cuuguuuuaugcucag

SEQ ID NO: 1313673 - RNA, 21 nt, Homo sapiens
cuuguuuuuccacuacugcua

SEQ ID NO: 1313674 - RNA, 23 nt, Homo sapiens
cuuguuuuuccacuacugcuacc

SEQ ID NO: 1313675 - RNA, 18 nt, Homo sapiens
cuuuaaaauuuuuuuaga

SEQ ID NO: 1313676 - RNA, 15 nt, Homo sapiens
cuuuaaugcuuuuau

SEQ ID NO: 1313677 - RNA, 19 nt, Homo sapiens
cuuuaauucagguauguaa

SEQ ID NO: 1313678 - RNA, 18 nt, Homo sapiens
cuuuagaaagcugacauu

SEQ ID NO: 1313679 - RNA, 14 nt, Homo sapiens
cuuuagaacaggga

SEQ ID NO: 1313680 - RNA, 15 nt, Homo sapiens
cuuuagcgcccaguu

SEQ ID NO: 1313681 - RNA, 16 nt, Homo sapiens
cuuuagucugcaaaau

SEQ ID NO: 1313682 - RNA, 18 nt, Homo sapiens
cuuuagugucugagcuuc

SEQ ID NO: 1313683 - RNA, 16 nt, Homo sapiens
cuuuaguuccuacuuu

SEQ ID NO: 1313684 - RNA, 19 nt, Homo sapiens
cuuuaugaauguguaaugg

SEQ ID NO: 1313685 - RNA, 22 nt, Homo sapiens
cuuuauuauggaaaacauuuca

SEQ ID NO: 1313686 - RNA, 18 nt, Homo sapiens
cuuuauucuuuacuauua

SEQ ID NO: 1313687 - RNA, 16 nt, Homo sapiens
cuuucaaccucaguga

SEQ ID NO: 1313688 - RNA, 20 nt, Homo sapiens
cuuucaagcagucgugccug

SEQ ID NO: 1313689 - RNA, 21 nt, Homo sapiens
cuuucagacuugccaugugac

SEQ ID NO: 1313690 - RNA, 17 nt, Homo sapiens
cuuucauaaaaacacuc

SEQ ID NO: 1313691 - RNA, 23 nt, Homo sapiens
cuuucauaugguaggaaccaaca

SEQ ID NO: 1313692 - RNA, 23 nt, Homo sapiens
cuuucauuauagcagagaguuuu

SEQ ID NO: 1313693 - RNA, 13 nt, Homo sapiens
cuuuccacauuca

SEQ ID NO: 1313694 - RNA, 13 nt, Homo sapiens
cuuuccuccugag

SEQ ID NO: 1313695 - RNA, 13 nt, Homo sapiens
cuuuccuguucca

SEQ ID NO: 1313696 - RNA, 19 nt, Homo sapiens
cuuucugcuaucaaagagg

SEQ ID NO: 1313697 - RNA, 17 nt, Homo sapiens
cuuucuuacacaagagc

SEQ ID NO: 1313698 - RNA, 11 nt, Homo sapiens
cuuucuucccu

SEQ ID NO: 1313699 - RNA, 18 nt, Homo sapiens
cuuucuuuguauuuuccu

SEQ ID NO: 1313700 - RNA, 17 nt, Homo sapiens
cuuugacaaauuacaaa

SEQ ID NO: 1313701 - RNA, 17 nt, Homo sapiens
cuuugaucuucagggaa

SEQ ID NO: 1313702 - RNA, 20 nt, Homo sapiens
cuuugcagagaaccucagau

SEQ ID NO: 1313703 - RNA, 17 nt, Homo sapiens
cuuugccuucauucugc

SEQ ID NO: 1313704 - RNA, 22 nt, Homo sapiens
cuuuggacauagcgaauacaaa

SEQ ID NO: 1313705 - RNA, 18 nt, Homo sapiens
cuuuggcaaucagugcuc

SEQ ID NO: 1313706 - RNA, 22 nt, Homo sapiens
cuuuggcccgaaauagauccag

SEQ ID NO: 1313707 - RNA, 17 nt, Homo sapiens
cuuuggcuuugcaaaau

SEQ ID NO: 1313708 - RNA, 20 nt, Homo sapiens
cuuugggccagacaugccac

SEQ ID NO: 1313709 - RNA, 16 nt, Homo sapiens
cuuugguggcauggaa

SEQ ID NO: 1313710 - RNA, 14 nt, Homo sapiens
cuuuguaccaucug

SEQ ID NO: 1313711 - RNA, 23 nt, Homo sapiens
cuuugucccggggcuccacugaa

SEQ ID NO: 1313712 - RNA, 14 nt, Homo sapiens
cuuuguuaggauuu

SEQ ID NO: 1313713 - RNA, 11 nt, Homo sapiens
cuuuguugccc

SEQ ID NO: 1313714 - RNA, 21 nt, Homo sapiens
cuuuguuuagcccaaaaccaa

SEQ ID NO: 1313715 - RNA, 22 nt, Homo sapiens
cuuuuaaagaaauaaccacugc

SEQ ID NO: 1313716 - RNA, 14 nt, Homo sapiens
cuuuuaacccagug

SEQ ID NO: 1313717 - RNA, 15 nt, Homo sapiens
cuuuuaacccagugu

SEQ ID NO: 1313718 - RNA, 15 nt, Homo sapiens
cuuuuauuacugggg

SEQ ID NO: 1313719 - RNA, 18 nt, Homo sapiens
cuuuuauugacacagaaa

SEQ ID NO: 1313720 - RNA, 19 nt, Homo sapiens
cuuuucaauguuagccaca

SEQ ID NO: 1313721 - RNA, 18 nt, Homo sapiens
cuuuucauaaccuagccu

SEQ ID NO: 1313722 - RNA, 13 nt, Homo sapiens
cuuuuccaaacau

SEQ ID NO: 1313723 - RNA, 16 nt, Homo sapiens
cuuuuccacuccauug

SEQ ID NO: 1313724 - RNA, 17 nt, Homo sapiens
cuuuucccauugccaug

SEQ ID NO: 1313725 - RNA, 17 nt, Homo sapiens
cuuuuccucucaugucu

SEQ ID NO: 1313726 - RNA, 19 nt, Homo sapiens
cuuuuccugauaaagcaca

SEQ ID NO: 1313727 - RNA, 15 nt, Homo sapiens
cuuuucucaguuugg

SEQ ID NO: 1313728 - RNA, 23 nt, Homo sapiens
cuuuugaaaaauaaugacucuua

SEQ ID NO: 1313729 - RNA, 15 nt, Homo sapiens
cuuuugaacccagga

SEQ ID NO: 1313730 - RNA, 14 nt, Homo sapiens
cuuuugacauuuua

SEQ ID NO: 1313731 - RNA, 15 nt, Homo sapiens
cuuuugagacagagu

SEQ ID NO: 1313732 - RNA, 10 nt, Homo sapiens
cuuuugccau

SEQ ID NO: 1313733 - RNA, 22 nt, Homo sapiens
cuuuuguagaaugaaccacugc

SEQ ID NO: 1313734 - RNA, 16 nt, Homo sapiens
cuuuugugugugucua

SEQ ID NO: 1313735 - RNA, 20 nt, Homo sapiens
cuuuuuaagaugucuauuau

SEQ ID NO: 1313736 - RNA, 12 nt, Homo sapiens
cuuuuuacacuu

SEQ ID NO: 1313737 - RNA, 15 nt, Homo sapiens
cuuuuuacacuuuau

SEQ ID NO: 1313738 - RNA, 19 nt, Homo sapiens
cuuuuuacacuuuauggua

SEQ ID NO: 1313739 - RNA, 13 nt, Homo sapiens
cuuuuuacuauua

SEQ ID NO: 1313740 - RNA, 21 nt, Homo sapiens
cuuuuucauccaggccugcca

SEQ ID NO: 1313741 - RNA, 13 nt, Homo sapiens
cuuuuucuuugag

SEQ ID NO: 1313742 - RNA, 15 nt, Homo sapiens
cuuuuuggagagugc

SEQ ID NO: 1313743 - RNA, 17 nt, Homo sapiens
gaaaaaaaaauggaagc

SEQ ID NO: 1313744 - RNA, 12 nt, Homo sapiens
gaaaaacuugug

SEQ ID NO: 1313745 - RNA, 14 nt, Homo sapiens
gaaaaagacugggu

SEQ ID NO: 1313746 - RNA, 16 nt, Homo sapiens
gaaaaagccugugaaa

SEQ ID NO: 1313747 - RNA, 17 nt, Homo sapiens
gaaaaauaucuuggccu

SEQ ID NO: 1313748 - RNA, 18 nt, Homo sapiens
gaaaaauauuuauucauu

SEQ ID NO: 1313749 - RNA, 14 nt, Homo sapiens
gaaaaauuuguaua

SEQ ID NO: 1313750 - RNA, 14 nt, Homo sapiens
gaaaacacugugca

SEQ ID NO: 1313751 - RNA, 14 nt, Homo sapiens
gaaaacagaccuaa

SEQ ID NO: 1313752 - RNA, 20 nt, Homo sapiens
gaaaagagaaggaaagugau

SEQ ID NO: 1313753 - RNA, 22 nt, Homo sapiens
gaaaagcuaguguaccuccucu

SEQ ID NO: 1313754 - RNA, 20 nt, Homo sapiens
gaaaagugcauauuuaucca

SEQ ID NO: 1313755 - RNA, 12 nt, Homo sapiens
gaaaaucauauu

SEQ ID NO: 1313756 - RNA, 23 nt, Homo sapiens
gaaaaucaucaagaagggcugca

SEQ ID NO: 1313757 - RNA, 12 nt, Homo sapiens
gaaaaucuuaca

SEQ ID NO: 1313758 - RNA, 22 nt, Homo sapiens
gaaaaugcagcagggaugcccu

SEQ ID NO: 1313759 - RNA, 22 nt, Homo sapiens
gaaaaugcuaaagaauccauaa

SEQ ID NO: 1313760 - RNA, 14 nt, Homo sapiens
gaaaaugugucauu

SEQ ID NO: 1313761 - RNA, 14 nt, Homo sapiens
gaaacaaacuggag

SEQ ID NO: 1313762 - RNA, 13 nt, Homo sapiens
gaaacaacagcuu

SEQ ID NO: 1313763 - RNA, 13 nt, Homo sapiens
gaaacaacucuuu

SEQ ID NO: 1313764 - RNA, 12 nt, Homo sapiens
gaaacaacuugg

SEQ ID NO: 1313765 - RNA, 17 nt, Homo sapiens
gaaacagcugcccugug

SEQ ID NO: 1313766 - RNA, 17 nt, Homo sapiens
gaaaccuuauuguaccu

SEQ ID NO: 1313767 - RNA, 20 nt, Homo sapiens
gaaacuacugccuuuagaaa

SEQ ID NO: 1313768 - RNA, 14 nt, Homo sapiens
gaaacucaucucau

SEQ ID NO: 1313769 - RNA, 21 nt, Homo sapiens
gaaacugugaagaucucacuc

SEQ ID NO: 1313770 - RNA, 11 nt, Homo sapiens
gaaacuuuccu

SEQ ID NO: 1313771 - RNA, 15 nt, Homo sapiens
gaaagaaaauuuaau

SEQ ID NO: 1313772 - RNA, 23 nt, Homo sapiens
gaaagaaaguugcacggcugcug

SEQ ID NO: 1313773 - RNA, 14 nt, Homo sapiens
gaaagaaaugccca

SEQ ID NO: 1313774 - RNA, 15 nt, Homo sapiens
gaaagaacacuuccc

SEQ ID NO: 1313775 - RNA, 19 nt, Homo sapiens
gaaagaaguuauuuuccag

SEQ ID NO: 1313776 - RNA, 14 nt, Homo sapiens
gaaagaauguuacu

SEQ ID NO: 1313777 - RNA, 16 nt, Homo sapiens
gaaagacaagcucaag

SEQ ID NO: 1313778 - RNA, 17 nt, Homo sapiens
gaaagaggaagcuuucu

SEQ ID NO: 1313779 - RNA, 13 nt, Homo sapiens
gaaagaucaaaga

SEQ ID NO: 1313780 - RNA, 22 nt, Homo sapiens
gaaagaugguguggguguccug

SEQ ID NO: 1313781 - RNA, 14 nt, Homo sapiens
gaaagcauuugaau

SEQ ID NO: 1313782 - RNA, 18 nt, Homo sapiens
gaaagccaacauguggcu

SEQ ID NO: 1313783 - RNA, 22 nt, Homo sapiens
gaaagcuguggccagcuuguua

SEQ ID NO: 1313784 - RNA, 13 nt, Homo sapiens
gaaaguacuuugg

SEQ ID NO: 1313785 - RNA, 16 nt, Homo sapiens
gaaaguauaauuugcu

SEQ ID NO: 1313786 - RNA, 14 nt, Homo sapiens
gaaagucaaauuca

SEQ ID NO: 1313787 - RNA, 18 nt, Homo sapiens
gaaauaaaaggaagccaa

SEQ ID NO: 1313788 - RNA, 19 nt, Homo sapiens
gaaauaauuuuuagaaucu

SEQ ID NO: 1313789 - RNA, 19 nt, Homo sapiens
gaaauacuugaacuugccu

SEQ ID NO: 1313790 - RNA, 14 nt, Homo sapiens
gaaauagaacuaca

SEQ ID NO: 1313791 - RNA, 20 nt, Homo sapiens
gaaauagauccagugcugag

SEQ ID NO: 1313792 - RNA, 13 nt, Homo sapiens
gaaauagugacau

SEQ ID NO: 1313793 - RNA, 20 nt, Homo sapiens
gaaauauggaacuuacauug

SEQ ID NO: 1313794 - RNA, 20 nt, Homo sapiens
gaaaucaacuugcuuaucaa

SEQ ID NO: 1313795 - RNA, 20 nt, Homo sapiens
gaaaucuugaggacuuuguu

SEQ ID NO: 1313796 - RNA, 21 nt, Homo sapiens
gaaaugcccaucuaugucccu

SEQ ID NO: 1313797 - RNA, 23 nt, Homo sapiens
gaaaugcccaucuaugucccuug

SEQ ID NO: 1313798 - RNA, 22 nt, Homo sapiens
acgaguggccaguucauugugg

SEQ ID NO: 1313799 - RNA, 19 nt, Homo sapiens
acgcaacaagaaacucaau

SEQ ID NO: 1313800 - RNA, 18 nt, Homo sapiens
acgcaggagaucaucuga

SEQ ID NO: 1313801 - RNA, 22 nt, Homo sapiens
acgcaggccccucuccuccgug

SEQ ID NO: 1313802 - RNA, 15 nt, Homo sapiens
acgccgcccuaaaag

SEQ ID NO: 1313803 - RNA, 19 nt, Homo sapiens
acgcggccccacauugcac

SEQ ID NO: 1313804 - RNA, 20 nt, Homo sapiens
acgcugauccauaaagacaa

SEQ ID NO: 1313805 - RNA, 13 nt, Homo sapiens
acgcuugcucugu

SEQ ID NO: 1313806 - RNA, 12 nt, Homo sapiens
acggacacucaa

SEQ ID NO: 1313807 - RNA, 20 nt, Homo sapiens
acggagccacuccucugacu

SEQ ID NO: 1313808 - RNA, 18 nt, Homo sapiens
acggccagggagaagcuc

SEQ ID NO: 1313809 - RNA, 14 nt, Homo sapiens
acgggcucagcaaa

SEQ ID NO: 1313810 - RNA, 20 nt, Homo sapiens
acggggcucuucucauuuca

SEQ ID NO: 1313811 - RNA, 23 nt, Homo sapiens
acggggcugacuccugcucucug

SEQ ID NO: 1313812 - RNA, 15 nt, Homo sapiens
acgguguuuugccau

SEQ ID NO: 1313813 - RNA, 17 nt, Homo sapiens
acgguuuaauucugucu

SEQ ID NO: 1313814 - RNA, 14 nt, Homo sapiens
acgucacuucaugc

SEQ ID NO: 1313815 - RNA, 19 nt, Homo sapiens
acguccuccguccauauca

SEQ ID NO: 1313816 - RNA, 22 nt, Homo sapiens
acgucugcagaaacagugcaag

SEQ ID NO: 1313817 - RNA, 16 nt, Homo sapiens
acgugagaacaaucau

SEQ ID NO: 1313818 - RNA, 16 nt, Homo sapiens
acguggcucagccagc

SEQ ID NO: 1313819 - RNA, 18 nt, Homo sapiens
acguugccucuacuuuau

SEQ ID NO: 1313820 - RNA, 16 nt, Homo sapiens
acuaaaaauacaaaaa

SEQ ID NO: 1313821 - RNA, 16 nt, Homo sapiens
acuaaaguagagcccu

SEQ ID NO: 1313822 - RNA, 19 nt, Homo sapiens
acuaagggcgcuuguccca

SEQ ID NO: 1313823 - RNA, 15 nt, Homo sapiens
acuaaggugcuaaau

SEQ ID NO: 1313824 - RNA, 22 nt, Homo sapiens
acuaaggugugcucugaucauc

SEQ ID NO: 1313825 - RNA, 18 nt, Homo sapiens
acuacagcuaugaagaaa

SEQ ID NO: 1313826 - RNA, 16 nt, Homo sapiens
acuacgcugauuugau

SEQ ID NO: 1313827 - RNA, 14 nt, Homo sapiens
acuacuauauugau

SEQ ID NO: 1313828 - RNA, 18 nt, Homo sapiens
acuacucuuacauguaua

SEQ ID NO: 1313829 - RNA, 18 nt, Homo sapiens
acuagccacauacuagca

SEQ ID NO: 1313830 - RNA, 16 nt, Homo sapiens
acuagggaauccugcg

SEQ ID NO: 1313831 - RNA, 16 nt, Homo sapiens
acuagggagccauuug

SEQ ID NO: 1313832 - RNA, 15 nt, Homo sapiens
acuagggaucccuca

SEQ ID NO: 1313833 - RNA, 20 nt, Homo sapiens
acuagggcuuauccaugccu

SEQ ID NO: 1313834 - RNA, 17 nt, Homo sapiens
acuauauuuauacugua

SEQ ID NO: 1313835 - RNA, 17 nt, Homo sapiens
acuaucccauuugcccu

SEQ ID NO: 1313836 - RNA, 19 nt, Homo sapiens
acuaucuacucuccucauc

SEQ ID NO: 1313837 - RNA, 22 nt, Homo sapiens
acuauguaaaugacucuacuaa

SEQ ID NO: 1313838 - RNA, 15 nt, Homo sapiens
acuauguaacaugua

SEQ ID NO: 1313839 - RNA, 19 nt, Homo sapiens
acuaugucuagagccucuu

SEQ ID NO: 1313840 - RNA, 15 nt, Homo sapiens
acuauguugcccagg

SEQ ID NO: 1313841 - RNA, 18 nt, Homo sapiens
acuauguugcccaggcag

SEQ ID NO: 1313842 - RNA, 15 nt, Homo sapiens
acuauguugccuaag

SEQ ID NO: 1313843 - RNA, 15 nt, Homo sapiens
acuauuuucaaagaa

SEQ ID NO: 1313844 - RNA, 19 nt, Homo sapiens
acuauuuugguaagugcag

SEQ ID NO: 1313845 - RNA, 22 nt, Homo sapiens
acuauuuugguaagugcagcuu

SEQ ID NO: 1313846 - RNA, 15 nt, Homo sapiens
acucaaaugcucaga

SEQ ID NO: 1313847 - RNA, 19 nt, Homo sapiens
acucaagccaagcagccaa

SEQ ID NO: 1313848 - RNA, 19 nt, Homo sapiens
acucacccucauaccaucu

SEQ ID NO: 1313849 - RNA, 16 nt, Homo sapiens
acucacucugcugcug

SEQ ID NO: 1313850 - RNA, 23 nt, Homo sapiens
acucacugaggguaucugacaau

SEQ ID NO: 1313851 - RNA, 16 nt, Homo sapiens
acucagaagacacuga

SEQ ID NO: 1313852 - RNA, 17 nt, Homo sapiens
acucagaagacacugau

SEQ ID NO: 1313853 - RNA, 18 nt, Homo sapiens
acucagcucuuggcucca

SEQ ID NO: 1313854 - RNA, 14 nt, Homo sapiens
acucagcugcucug

SEQ ID NO: 1313855 - RNA, 17 nt, Homo sapiens
acucagcugcucugcaa

SEQ ID NO: 1313856 - RNA, 13 nt, Homo sapiens
acucagggcuccu

SEQ ID NO: 1313857 - RNA, 15 nt, Homo sapiens
acucaugaagcauac

SEQ ID NO: 1313858 - RNA, 18 nt, Homo sapiens
acucaugguguguuacac

SEQ ID NO: 1313859 - RNA, 19 nt, Homo sapiens
acuccagccugggugacaa

SEQ ID NO: 1313860 - RNA, 14 nt, Homo sapiens
acuccaugcauuca

SEQ ID NO: 1313861 - RNA, 15 nt, Homo sapiens
acucccauuccugaa

SEQ ID NO: 1313862 - RNA, 20 nt, Homo sapiens
acuccuaggcaggacaugcu

SEQ ID NO: 1313863 - RNA, 14 nt, Homo sapiens
acuccuagggccac

SEQ ID NO: 1313864 - RNA, 21 nt, Homo sapiens
acucguauagcaugcaucugu

SEQ ID NO: 1313865 - RNA, 22 nt, Homo sapiens
acucuaaagaauucuugaaaaa

SEQ ID NO: 1313866 - RNA, 17 nt, Homo sapiens
acucuaggcagugacag

SEQ ID NO: 1313867 - RNA, 17 nt, Homo sapiens
acucuauaagauuccaa

SEQ ID NO: 1313868 - RNA, 18 nt, Homo sapiens
acucucaccaaaugagaa

SEQ ID NO: 1313869 - RNA, 15 nt, Homo sapiens
acucucaccuuccaa

SEQ ID NO: 1313870 - RNA, 17 nt, Homo sapiens
acucucgcaucuuccca

SEQ ID NO: 1313871 - RNA, 23 nt, Homo sapiens
acucucuaccagauaacugagga

SEQ ID NO: 1313872 - RNA, 21 nt, Homo sapiens
acucugauagaauuauuucac

SEQ ID NO: 1313873 - RNA, 21 nt, Homo sapiens
acucugauguugggauggaau

SEQ ID NO: 1313874 - RNA, 16 nt, Homo sapiens
acucugcauccagaga

SEQ ID NO: 1313875 - RNA, 22 nt, Homo sapiens
acucugcccucuagagccuuca

SEQ ID NO: 1313876 - RNA, 13 nt, Homo sapiens
acucugggcucca

SEQ ID NO: 1313877 - RNA, 14 nt, Homo sapiens
acucugggcuccag

SEQ ID NO: 1313878 - RNA, 13 nt, Homo sapiens
acucuggggaugg

SEQ ID NO: 1313879 - RNA, 14 nt, Homo sapiens
acucugguggcaca

SEQ ID NO: 1313880 - RNA, 18 nt, Homo sapiens
acucuguugguagcaauu

SEQ ID NO: 1313881 - RNA, 21 nt, Homo sapiens
acucuuuuuuaugccuauucu

SEQ ID NO: 1313882 - RNA, 15 nt, Homo sapiens
acugaaaaccucucc

SEQ ID NO: 1313883 - RNA, 23 nt, Homo sapiens
acugacagcccuguguugugcuc

SEQ ID NO: 1313884 - RNA, 20 nt, Homo sapiens
acugauacauccauuuugau

SEQ ID NO: 1313885 - RNA, 15 nt, Homo sapiens
acugauagaugucua

SEQ ID NO: 1313886 - RNA, 21 nt, Homo sapiens
acugauagaugucuauucuug

SEQ ID NO: 1313887 - RNA, 20 nt, Homo sapiens
acugcaccgggccacagaga

SEQ ID NO: 1313888 - RNA, 20 nt, Homo sapiens
acugcacuauagccuaggug

SEQ ID NO: 1313889 - RNA, 17 nt, Homo sapiens
acugcagccacagggga

SEQ ID NO: 1313890 - RNA, 18 nt, Homo sapiens
acugcaggcaucacagcu

SEQ ID NO: 1313891 - RNA, 21 nt, Homo sapiens
acugcaguggacaguccccac

SEQ ID NO: 1313892 - RNA, 12 nt, Homo sapiens
acugcauccuca

SEQ ID NO: 1313893 - RNA, 17 nt, Homo sapiens
acugccaaaaugcucua

SEQ ID NO: 1313894 - RNA, 19 nt, Homo sapiens
acugccacuccaguccugc

SEQ ID NO: 1313895 - RNA, 19 nt, Homo sapiens
acugcccauggacaggcug

SEQ ID NO: 1313896 - RNA, 15 nt, Homo sapiens
acugcuaccuuccua

SEQ ID NO: 1313897 - RNA, 18 nt, Homo sapiens
ugucaacauugugaugua

SEQ ID NO: 1313898 - RNA, 19 nt, Homo sapiens
ugucaagccggaugccuaa

SEQ ID NO: 1313899 - RNA, 20 nt, Homo sapiens
ugucaagccugugcaaaaaa

SEQ ID NO: 1313900 - RNA, 17 nt, Homo sapiens
ugucaaugauuucaaaa

SEQ ID NO: 1313901 - RNA, 18 nt, Homo sapiens
ugucaauucuugccaaau

SEQ ID NO: 1313902 - RNA, 20 nt, Homo sapiens
ugucacagaagcagcuaaac

SEQ ID NO: 1313903 - RNA, 23 nt, Homo sapiens
ugucaccacccacccuaccugca

SEQ ID NO: 1313904 - RNA, 19 nt, Homo sapiens
ugucagaaacugaagcugu

SEQ ID NO: 1313905 - RNA, 19 nt, Homo sapiens
ugucaucuuucuuguuuca

SEQ ID NO: 1313906 - RNA, 16 nt, Homo sapiens
ugucauuccaguuuga

SEQ ID NO: 1313907 - RNA, 16 nt, Homo sapiens
ugucauugacaaagcu

SEQ ID NO: 1313908 - RNA, 18 nt, Homo sapiens
ugucauugacaaagcugu

SEQ ID NO: 1313909 - RNA, 20 nt, Homo sapiens
ugucauuuugcacuguaaau

SEQ ID NO: 1313910 - RNA, 18 nt, Homo sapiens
uguccaaaacugccucag

SEQ ID NO: 1313911 - RNA, 21 nt, Homo sapiens
uguccacgugugugugugauu

SEQ ID NO: 1313912 - RNA, 13 nt, Homo sapiens
ugucccaagguga

SEQ ID NO: 1313913 - RNA, 22 nt, Homo sapiens
ugucccacucaagccaagcagc

SEQ ID NO: 1313914 - RNA, 16 nt, Homo sapiens
ugucccaguaaagcca

SEQ ID NO: 1313915 - RNA, 17 nt, Homo sapiens
uggccaaggagcugcua

SEQ ID NO: 1313916 - RNA, 15 nt, Homo sapiens
uggccaccaguauga

SEQ ID NO: 1313917 - RNA, 21 nt, Homo sapiens
uggccaccaguaugacaguau

SEQ ID NO: 1313918 - RNA, 18 nt, Homo sapiens
uggccaggcuggucucaa

SEQ ID NO: 1313919 - RNA, 15 nt, Homo sapiens
uggcccaaauccagu

SEQ ID NO: 1313920 - RNA, 16 nt, Homo sapiens
uggcccacgcacuucg

SEQ ID NO: 1313921 - RNA, 19 nt, Homo sapiens
uggccuaaaaaugcaacuu

SEQ ID NO: 1313922 - RNA, 22 nt, Homo sapiens
uggccugaagaguccucugaau

SEQ ID NO: 1313923 - RNA, 22 nt, Homo sapiens
uggccuggucccuguuuuccca

SEQ ID NO: 1313924 - RNA, 20 nt, Homo sapiens
uggcgagugaaugccagugu

SEQ ID NO: 1313925 - RNA, 22 nt, Homo sapiens
uggcgccccuuccuaggucaug

SEQ ID NO: 1313926 - RNA, 14 nt, Homo sapiens
uggcguuacugcuu

SEQ ID NO: 1313927 - RNA, 20 nt, Homo sapiens
uggcguuuggacccaguuca

SEQ ID NO: 1313928 - RNA, 15 nt, Homo sapiens
uggcuacacagggau

SEQ ID NO: 1313929 - RNA, 16 nt, Homo sapiens
uggcucacacugagaa

SEQ ID NO: 1313930 - RNA, 20 nt, Homo sapiens
uggcuccaacacugcugcuc

SEQ ID NO: 1313931 - RNA, 14 nt, Homo sapiens
uggcucugaccgaa

SEQ ID NO: 1313932 - RNA, 19 nt, Homo sapiens
uggcucugaugcugagcga

SEQ ID NO: 1313933 - RNA, 16 nt, Homo sapiens
uggcugccugcaucua

SEQ ID NO: 1313934 - RNA, 19 nt, Homo sapiens
uggcugggggccucagugc

SEQ ID NO: 1313935 - RNA, 20 nt, Homo sapiens
ugggaaaguauucuguacuc

SEQ ID NO: 1313936 - RNA, 17 nt, Homo sapiens
ugggaagcaggagccca

SEQ ID NO: 1313937 - RNA, 16 nt, Homo sapiens
ugggaaggggaggacc

SEQ ID NO: 1313938 - RNA, 15 nt, Homo sapiens
uaaguuguugauguu

SEQ ID NO: 1313939 - RNA, 23 nt, Homo sapiens
uaaguuuccuucccuacccaguc

SEQ ID NO: 1313940 - RNA, 20 nt, Homo sapiens
uaauaagauauuuaguaaua

SEQ ID NO: 1313941 - RNA, 14 nt, Homo sapiens
uaauacaucaaaga

SEQ ID NO: 1313942 - RNA, 14 nt, Homo sapiens
uaauaguaccuaaa

SEQ ID NO: 1313943 - RNA, 21 nt, Homo sapiens
uaauauacagucaguucucau

SEQ ID NO: 1313944 - RNA, 20 nt, Homo sapiens
uaauaugaguaauacaucaa

SEQ ID NO: 1313945 - RNA, 23 nt, Homo sapiens
uaauaugaguaauacaucaaaga

SEQ ID NO: 1313946 - RNA, 16 nt, Homo sapiens
uaauauguacuuugag

SEQ ID NO: 1313947 - RNA, 22 nt, Homo sapiens
uaauauugauaagcuauugucu

SEQ ID NO: 1313948 - RNA, 13 nt, Homo sapiens
uaaucaaaccacu

SEQ ID NO: 1313949 - RNA, 20 nt, Homo sapiens
uaaucacuauuguuccagca

SEQ ID NO: 1313950 - RNA, 16 nt, Homo sapiens
uaauccaauaccucuu

SEQ ID NO: 1313951 - RNA, 17 nt, Homo sapiens
uaaucccagcacuuugg

SEQ ID NO: 1313952 - RNA, 16 nt, Homo sapiens
uaaucuaccuugcagu

SEQ ID NO: 1313953 - RNA, 21 nt, Homo sapiens
uaaugaaguuugaauguuaaa

SEQ ID NO: 1313954 - RNA, 14 nt, Homo sapiens
uaaugacauaaaaa

SEQ ID NO: 1313955 - RNA, 16 nt, Homo sapiens
uaaugcauauuccccu

SEQ ID NO: 1313956 - RNA, 16 nt, Homo sapiens
uaaugcucgucugugu

SEQ ID NO: 1313957 - RNA, 15 nt, Homo sapiens
uaaugcuuauaagac

SEQ ID NO: 1313958 - RNA, 20 nt, Homo sapiens
uaauggagaggaaaccagau

SEQ ID NO: 1313959 - RNA, 15 nt, Homo sapiens
uaauguaauuguaau

SEQ ID NO: 1313960 - RNA, 23 nt, Homo sapiens
uaaugucuuuaaaaguauccaga

SEQ ID NO: 1313961 - RNA, 15 nt, Homo sapiens
uaauuaagggaaucc

SEQ ID NO: 1313962 - RNA, 17 nt, Homo sapiens
uaauuauacuacuuugu

SEQ ID NO: 1313963 - RNA, 13 nt, Homo sapiens
uaauuauuuacuc

SEQ ID NO: 1313964 - RNA, 16 nt, Homo sapiens
uaauucagguauguaa

SEQ ID NO: 1313965 - RNA, 14 nt, Homo sapiens
uaauuccucagugg

SEQ ID NO: 1313966 - RNA, 14 nt, Homo sapiens
uaauuuaaugcaug

SEQ ID NO: 1313967 - RNA, 15 nt, Homo sapiens
uaauuuacaugcaau

SEQ ID NO: 1313968 - RNA, 17 nt, Homo sapiens
uaauuucgcacaaugca

SEQ ID NO: 1313969 - RNA, 24 nt, Homo sapiens
uaauuuuagaugccugugaaauag

SEQ ID NO: 1313970 - RNA, 18 nt, Homo sapiens
uacaaaacuuccaggcua

SEQ ID NO: 1313971 - RNA, 16 nt, Homo sapiens
uacaaacuucaaagag

SEQ ID NO: 1313972 - RNA, 17 nt, Homo sapiens
uacaaaggcuugcuaag

SEQ ID NO: 1313973 - RNA, 18 nt, Homo sapiens
uacaaaguacuagcuaaa

SEQ ID NO: 1313974 - RNA, 16 nt, Homo sapiens
uacaaaugacuccuaa

SEQ ID NO: 1313975 - RNA, 18 nt, Homo sapiens
uacaacugccucgaaaca

SEQ ID NO: 1313976 - RNA, 17 nt, Homo sapiens
uacaagauauuauguau

SEQ ID NO: 1313977 - RNA, 14 nt, Homo sapiens
uacaagcgugagcc

SEQ ID NO: 1313978 - RNA, 20 nt, Homo sapiens
uacaaguugaaauaugcucu

SEQ ID NO: 1313979 - RNA, 18 nt, Homo sapiens
uacaauaaaaacauugcc

SEQ ID NO: 1313980 - RNA, 13 nt, Homo sapiens
uacaauagucaaa

SEQ ID NO: 1313981 - RNA, 20 nt, Homo sapiens
uacaaugugaacuuuauuaa

SEQ ID NO: 1313982 - RNA, 11 nt, Homo sapiens
uacaauuguga

SEQ ID NO: 1313983 - RNA, 12 nt, Homo sapiens
uacaauugugag

SEQ ID NO: 1313984 - RNA, 16 nt, Homo sapiens
uacaauuugacauaca

SEQ ID NO: 1313985 - RNA, 18 nt, Homo sapiens
uacacagaaaugcugcug

SEQ ID NO: 1313986 - RNA, 16 nt, Homo sapiens
uacacauagcagagua

SEQ ID NO: 1313987 - RNA, 16 nt, Homo sapiens
uacaccaauuaaugua

SEQ ID NO: 1313988 - RNA, 17 nt, Homo sapiens
uacacccacaguggaaa

SEQ ID NO: 1313989 - RNA, 13 nt, Homo sapiens
uacacgacucagu

SEQ ID NO: 1313990 - RNA, 13 nt, Homo sapiens
uacacgugacaga

SEQ ID NO: 1313991 - RNA, 15 nt, Homo sapiens
uacacgugacagagu

SEQ ID NO: 1313992 - RNA, 22 nt, Homo sapiens
uacacuguauguuauagaacuu

SEQ ID NO: 1313993 - RNA, 20 nt, Homo sapiens
uacagauacauaucugugua

SEQ ID NO: 1313994 - RNA, 16 nt, Homo sapiens
uacagcuaacccucac

SEQ ID NO: 1313995 - RNA, 22 nt, Homo sapiens
uacaggcaugaaauacugugcc

SEQ ID NO: 1313996 - RNA, 21 nt, Homo sapiens
uacagguuacgugagaacaau

SEQ ID NO: 1313997 - RNA, 12 nt, Homo sapiens
uacaguaugcuu

SEQ ID NO: 1313998 - RNA, 18 nt, Homo sapiens
uacagucuuccauuugca

SEQ ID NO: 1313999 - RNA, 12 nt, Homo sapiens
uacagugauaua

SEQ ID NO: 1314000 - RNA, 15 nt, Homo sapiens
uacaguucugucaua

SEQ ID NO: 1314001 - RNA, 15 nt, Homo sapiens
uacauacaccagcau

SEQ ID NO: 1314002 - RNA, 16 nt, Homo sapiens
uacauacagaauuacu

SEQ ID NO: 1314003 - RNA, 12 nt, Homo sapiens
uacauacugcug

SEQ ID NO: 1314004 - RNA, 23 nt, Homo sapiens
uacauaggauggcuggcucugca

SEQ ID NO: 1314005 - RNA, 15 nt, Homo sapiens
uacauaguuguauau

SEQ ID NO: 1314006 - RNA, 18 nt, Homo sapiens
uacaucauuuuaacagcu

SEQ ID NO: 1314007 - RNA, 18 nt, Homo sapiens
uacaucuuguaggaucua

SEQ ID NO: 1314008 - RNA, 21 nt, Homo sapiens
uacauguuuauaaaucuuaug

SEQ ID NO: 1314009 - RNA, 21 nt, Homo sapiens
uacauuccaacucguauagca

SEQ ID NO: 1314010 - RNA, 20 nt, Homo sapiens
uacauucugcaagcacaucu

SEQ ID NO: 1314011 - RNA, 16 nt, Homo sapiens
uacauucugcuuucau

SEQ ID NO: 1314012 - RNA, 23 nt, Homo sapiens
uacauuguuugucugucuucaua

SEQ ID NO: 1314013 - RNA, 13 nt, Homo sapiens
uacauuuccaaau

SEQ ID NO: 1314014 - RNA, 22 nt, Homo sapiens
uacauuugaugcaugucuuuua

SEQ ID NO: 1314015 - RNA, 13 nt, Homo sapiens
uaccaaagugucu

SEQ ID NO: 1314016 - RNA, 13 nt, Homo sapiens
uaccaacuuuuag

SEQ ID NO: 1314017 - RNA, 19 nt, Homo sapiens
uaccaccaaaaaagcugua

SEQ ID NO: 1314018 - RNA, 13 nt, Homo sapiens
uaccacucuggca

SEQ ID NO: 1314019 - RNA, 16 nt, Homo sapiens
uaccaggggaggcagu

SEQ ID NO: 1314020 - RNA, 20 nt, Homo sapiens
uaccaggggaggcagugucu

SEQ ID NO: 1314021 - RNA, 21 nt, Homo sapiens
uaccaucuucuguaccaaaaa

SEQ ID NO: 1314022 - RNA, 16 nt, Homo sapiens
uaccauugcuguucua

SEQ ID NO: 1314023 - RNA, 13 nt, Homo sapiens
uacccaaacguga

SEQ ID NO: 1314024 - RNA, 15 nt, Homo sapiens
uacccacuucuccca

SEQ ID NO: 1314025 - RNA, 21 nt, Homo sapiens
uacccauuuuuuaaaaaagca

SEQ ID NO: 1314026 - RNA, 14 nt, Homo sapiens
uaccgagagccaaa

SEQ ID NO: 1314027 - RNA, 23 nt, Homo sapiens
uaccucacagagugcauugugag

SEQ ID NO: 1314028 - RNA, 21 nt, Homo sapiens
uaccugaaaacacugugcaca

SEQ ID NO: 1314029 - RNA, 21 nt, Homo sapiens
uaccuugguucccccacugau

SEQ ID NO: 1314030 - RNA, 12 nt, Homo sapiens
uacuaaagccaa

SEQ ID NO: 1314031 - RNA, 16 nt, Homo sapiens
uacuaauauuaagaaa

SEQ ID NO: 1314032 - RNA, 21 nt, Homo sapiens
uacuaauuccacaccuuuuau

SEQ ID NO: 1314033 - RNA, 22 nt, Homo sapiens
uacuauaaaagcuuucugccac

SEQ ID NO: 1314034 - RNA, 16 nt, Homo sapiens
uacuauagguccagaa

SEQ ID NO: 1314035 - RNA, 20 nt, Homo sapiens
uacuauauuuauacuguaua

SEQ ID NO: 1314036 - RNA, 15 nt, Homo sapiens
uacucaaagucaucc

SEQ ID NO: 1314037 - RNA, 16 nt, Homo sapiens
uacucccuccacccuc

SEQ ID NO: 1314038 - RNA, 18 nt, Homo sapiens
uacucuguuccuucacau

SEQ ID NO: 1314039 - RNA, 17 nt, Homo sapiens
uacucuuacauguauaa

SEQ ID NO: 1314040 - RNA, 21 nt, Homo sapiens
uacugaaaaggaggggucugg

SEQ ID NO: 1314041 - RNA, 14 nt, Homo sapiens
uacugagacaaugu

SEQ ID NO: 1314042 - RNA, 16 nt, Homo sapiens
uacugauaauuuugcu

SEQ ID NO: 1314043 - RNA, 13 nt, Homo sapiens
uacugccauguac

SEQ ID NO: 1314044 - RNA, 17 nt, Homo sapiens
uacugcuaccacaacua

SEQ ID NO: 1314045 - RNA, 22 nt, Homo sapiens
uacugcucaucauuccuugaga

SEQ ID NO: 1314046 - RNA, 17 nt, Homo sapiens
uacugcuugaccaaaga

SEQ ID NO: 1314047 - RNA, 21 nt, Homo sapiens
uacugcuuuuccaaacauucu

SEQ ID NO: 1314048 - RNA, 16 nt, Homo sapiens
uacuggauuugacuuc

SEQ ID NO: 1314049 - RNA, 17 nt, Homo sapiens
uacuggccgagcugcug

SEQ ID NO: 1314050 - RNA, 21 nt, Homo sapiens
uacugggguuuuucuaagaaa

SEQ ID NO: 1314051 - RNA, 15 nt, Homo sapiens
uacuguauauauaau

SEQ ID NO: 1314052 - RNA, 14 nt, Homo sapiens
uacuguuaaaggaa

SEQ ID NO: 1314053 - RNA, 17 nt, Homo sapiens
uacuucugacauuccau

SEQ ID NO: 1314054 - RNA, 15 nt, Homo sapiens
uacuuugugcuugua

SEQ ID NO: 1314055 - RNA, 15 nt, Homo sapiens
uacuuuguuaggauu

SEQ ID NO: 1314056 - RNA, 22 nt, Homo sapiens
uacuuuuggccucaucucugcc

SEQ ID NO: 1314057 - RNA, 23 nt, Homo sapiens
uagaaaaccuaauuaaggaagua

SEQ ID NO: 1314058 - RNA, 17 nt, Homo sapiens
uagaaaauauaaguaaa

SEQ ID NO: 1314059 - RNA, 19 nt, Homo sapiens
uagaaagcugacauugcca

SEQ ID NO: 1314060 - RNA, 11 nt, Homo sapiens
uagaaaugcca

SEQ ID NO: 1314061 - RNA, 15 nt, Homo sapiens
uagaacagucauuaa

SEQ ID NO: 1314062 - RNA, 19 nt, Homo sapiens
uagaacagugcuugccaca

SEQ ID NO: 1314063 - RNA, 21 nt, Homo sapiens
uagaagaggguuuuagguaga

SEQ ID NO: 1314064 - RNA, 22 nt, Homo sapiens
uagaagguucucuccuccccaa

SEQ ID NO: 1314065 - RNA, 16 nt, Homo sapiens
uagaagucacacagua

SEQ ID NO: 1314066 - RNA, 23 nt, Homo sapiens
uagaauagccuguggccuuugca

SEQ ID NO: 1314067 - RNA, 21 nt, Homo sapiens
uagaauauuuuaagaauuuca

SEQ ID NO: 1314068 - RNA, 15 nt, Homo sapiens
uagaaugaaccacug

SEQ ID NO: 1314069 - RNA, 14 nt, Homo sapiens
uagaauuagcuuuu

SEQ ID NO: 1314070 - RNA, 22 nt, Homo sapiens
uagaauuauuucacaaauaaua

SEQ ID NO: 1314071 - RNA, 13 nt, Homo sapiens
uagaauuuauuca

SEQ ID NO: 1314072 - RNA, 14 nt, Homo sapiens
uagacaagccagaa

SEQ ID NO: 1314073 - RNA, 23 nt, Homo sapiens
cagcucuuuuccagaucaaagaa

SEQ ID NO: 1314074 - RNA, 20 nt, Homo sapiens
cagcugaccuuugucaucuu

SEQ ID NO: 1314075 - RNA, 19 nt, Homo sapiens
cagcuggaagggucaacau

SEQ ID NO: 1314076 - RNA, 21 nt, Homo sapiens
cagcuggaagggucaacaucu

SEQ ID NO: 1314077 - RNA, 19 nt, Homo sapiens
cagcuggcgucaugcaaag

SEQ ID NO: 1314078 - RNA, 23 nt, Homo sapiens
cagcuggcgucaugcaaagucau

SEQ ID NO: 1314079 - RNA, 15 nt, Homo sapiens
cagcugguauggccu

SEQ ID NO: 1314080 - RNA, 22 nt, Homo sapiens
cagcuuaucucaggggugugcg

SEQ ID NO: 1314081 - RNA, 13 nt, Homo sapiens
cagcuugcugcua

SEQ ID NO: 1314082 - RNA, 22 nt, Homo sapiens
caggaaauauaucuuaaugcag

SEQ ID NO: 1314083 - RNA, 16 nt, Homo sapiens
caggaagccgugcccu

SEQ ID NO: 1314084 - RNA, 21 nt, Homo sapiens
caggaagggggccgacuccac

SEQ ID NO: 1314085 - RNA, 15 nt, Homo sapiens
caggaaucucagaga

SEQ ID NO: 1314086 - RNA, 16 nt, Homo sapiens
caggaaucucagagac

SEQ ID NO: 1314087 - RNA, 16 nt, Homo sapiens
gaaauuaagaaggcaa

SEQ ID NO: 1314088 - RNA, 17 nt, Homo sapiens
gaaauuaagaaggcaaa

SEQ ID NO: 1314089 - RNA, 15 nt, Homo sapiens
gaaauugauguuacu

SEQ ID NO: 1314090 - RNA, 20 nt, Homo sapiens
gaacaaagugagacagucca

SEQ ID NO: 1314091 - RNA, 15 nt, Homo sapiens
gaacaaaugugaagg

SEQ ID NO: 1314092 - RNA, 16 nt, Homo sapiens
gaacaagcaaacccag

SEQ ID NO: 1314093 - RNA, 15 nt, Homo sapiens
gaacaauauugacuu

SEQ ID NO: 1314094 - RNA, 19 nt, Homo sapiens
gaacacacaagcuugucaa

SEQ ID NO: 1314095 - RNA, 20 nt, Homo sapiens
gaacacagccgauucaccug

SEQ ID NO: 1314096 - RNA, 13 nt, Homo sapiens
gaacagacaauca

SEQ ID NO: 1314097 - RNA, 16 nt, Homo sapiens
gaacaggauuccagaa

SEQ ID NO: 1314098 - RNA, 15 nt, Homo sapiens
gaacaguaacugcca

SEQ ID NO: 1314099 - RNA, 15 nt, Homo sapiens
gaacagugcuugcca

SEQ ID NO: 1314100 - RNA, 14 nt, Homo sapiens
gaacauauucaguu

SEQ ID NO: 1314101 - RNA, 13 nt, Homo sapiens
gaacauccuccac

SEQ ID NO: 1314102 - RNA, 20 nt, Homo sapiens
gaaccaaaucuggaagccaa

SEQ ID NO: 1314103 - RNA, 12 nt, Homo sapiens
gaaccauaucaa

SEQ ID NO: 1314104 - RNA, 22 nt, Homo sapiens
gaacccaagcuuagaacuuuaa

SEQ ID NO: 1314105 - RNA, 22 nt, Homo sapiens
gaacccuuucgcuggcuuucca

SEQ ID NO: 1314106 - RNA, 23 nt, Homo sapiens
gaaccgugguaugucugccaugu

SEQ ID NO: 1314107 - RNA, 18 nt, Homo sapiens
gaaccuggguugcagaca

SEQ ID NO: 1314108 - RNA, 13 nt, Homo sapiens
gaacuaaccaaau

SEQ ID NO: 1314109 - RNA, 17 nt, Homo sapiens
gaacuaagcaucuuuau

SEQ ID NO: 1314110 - RNA, 19 nt, Homo sapiens
gaacuaugcagugugcucc

SEQ ID NO: 1314111 - RNA, 20 nt, Homo sapiens
gaacuauguaaaugacucua

SEQ ID NO: 1314112 - RNA, 19 nt, Homo sapiens
gaacucaaauggggccaga

SEQ ID NO: 1314113 - RNA, 23 nt, Homo sapiens
gaacucaaauggggccagaucca

SEQ ID NO: 1314114 - RNA, 21 nt, Homo sapiens
gaacucaugagaaguugauau

SEQ ID NO: 1314115 - RNA, 13 nt, Homo sapiens
gaacucugagcag

SEQ ID NO: 1314116 - RNA, 17 nt, Homo sapiens
gaacugcauauguuucg

SEQ ID NO: 1314117 - RNA, 15 nt, Homo sapiens
gaacuggacccuguu

SEQ ID NO: 1314118 - RNA, 12 nt, Homo sapiens
gaacugugccac

SEQ ID NO: 1314119 - RNA, 13 nt, Homo sapiens
gaacuuacuguag

SEQ ID NO: 1314120 - RNA, 14 nt, Homo sapiens
gaacuuuaagcaac

SEQ ID NO: 1314121 - RNA, 13 nt, Homo sapiens
gaagaacaguaac

SEQ ID NO: 1314122 - RNA, 20 nt, Homo sapiens
gaagaacaguaacugccauc

SEQ ID NO: 1314123 - RNA, 20 nt, Homo sapiens
gaagaacggggcucuucuca

SEQ ID NO: 1314124 - RNA, 17 nt, Homo sapiens
gaagaaggggacaaugg

SEQ ID NO: 1314125 - RNA, 19 nt, Homo sapiens
gaagaccauccauccuccc

SEQ ID NO: 1314126 - RNA, 16 nt, Homo sapiens
gaagacuacaugaaca

SEQ ID NO: 1314127 - RNA, 13 nt, Homo sapiens
gaagacuugcccc

SEQ ID NO: 1314128 - RNA, 18 nt, Homo sapiens
gaagacuuuuguuaugag

SEQ ID NO: 1314129 - RNA, 23 nt, Homo sapiens
gaagagccuugcggaagguucua

SEQ ID NO: 1314130 - RNA, 22 nt, Homo sapiens
gaagaguggguuucacaaguga

SEQ ID NO: 1314131 - RNA, 20 nt, Homo sapiens
gaagauccuaaaacaaaagc

SEQ ID NO: 1314132 - RNA, 24 nt, Homo sapiens
gaagauccuaaaacaaaagcucau

SEQ ID NO: 1314133 - RNA, 12 nt, Homo sapiens
gaagcacagcuu

SEQ ID NO: 1314134 - RNA, 12 nt, Homo sapiens
gaagcauuuacu

SEQ ID NO: 1314135 - RNA, 15 nt, Homo sapiens
gaagcauuuacuuug

SEQ ID NO: 1314136 - RNA, 14 nt, Homo sapiens
gaagccaaagccaa

SEQ ID NO: 1314137 - RNA, 22 nt, Homo sapiens
gaagccuucuuuuucugagaca

SEQ ID NO: 1314138 - RNA, 15 nt, Homo sapiens
gaagcuuccauucca

SEQ ID NO: 1314139 - RNA, 21 nt, Homo sapiens
gaagcuuuggugagaaccugg

SEQ ID NO: 1314140 - RNA, 23 nt, Homo sapiens
gaaggagcgugcucuacccugug

SEQ ID NO: 1314141 - RNA, 10 nt, Homo sapiens
gaaggccagc

SEQ ID NO: 1314142 - RNA, 18 nt, Homo sapiens
gaaggcccugcugaguca

SEQ ID NO: 1314143 - RNA, 12 nt, Homo sapiens
gaaggcuaugua

SEQ ID NO: 1314144 - RNA, 16 nt, Homo sapiens
gaaggcuuguugugcu

SEQ ID NO: 1314145 - RNA, 19 nt, Homo sapiens
gaagggaguggcucuguaa

SEQ ID NO: 1314146 - RNA, 12 nt, Homo sapiens
gaagggccagag

SEQ ID NO: 1314147 - RNA, 15 nt, Homo sapiens
gaaggggacaauggc

SEQ ID NO: 1314148 - RNA, 19 nt, Homo sapiens
gaagguggggacagggaug

SEQ ID NO: 1314149 - RNA, 20 nt, Homo sapiens
gaagguggggacagggauga

SEQ ID NO: 1314150 - RNA, 19 nt, Homo sapiens
gaagguuggugaauuucac

SEQ ID NO: 1314151 - RNA, 20 nt, Homo sapiens
gaagguuggugaauuucaca

SEQ ID NO: 1314152 - RNA, 22 nt, Homo sapiens
gaaguagauucuggacagucag

SEQ ID NO: 1314153 - RNA, 19 nt, Homo sapiens
gaagucacacaguauuacu

SEQ ID NO: 1314154 - RNA, 21 nt, Homo sapiens
gaaguccuguaugucugucau

SEQ ID NO: 1314155 - RNA, 14 nt, Homo sapiens
gaagucuugcaguu

SEQ ID NO: 1314156 - RNA, 15 nt, Homo sapiens
gaagugccaucucaa

SEQ ID NO: 1314157 - RNA, 18 nt, Homo sapiens
gaaguggagaggguguca

SEQ ID NO: 1314158 - RNA, 19 nt, Homo sapiens
gaaguguucugagcuguau

SEQ ID NO: 1314159 - RNA, 13 nt, Homo sapiens
gaaguuaccaaau

SEQ ID NO: 1314160 - RNA, 14 nt, Homo sapiens
gaaguucacaucag

SEQ ID NO: 1314161 - RNA, 15 nt, Homo sapiens
gaaguucacaucaga

SEQ ID NO: 1314162 - RNA, 14 nt, Homo sapiens
gaaguucuaggaaa

SEQ ID NO: 1314163 - RNA, 21 nt, Homo sapiens
gaauaaaccaucaucuugcca

SEQ ID NO: 1314164 - RNA, 18 nt, Homo sapiens
gaauaauacaguaucuca

SEQ ID NO: 1314165 - RNA, 16 nt, Homo sapiens
gaauauaauacuguau

SEQ ID NO: 1314166 - RNA, 21 nt, Homo sapiens
gaauauaccauuucaaauauu

SEQ ID NO: 1314167 - RNA, 14 nt, Homo sapiens
gaauauccauguac

SEQ ID NO: 1314168 - RNA, 18 nt, Homo sapiens
gaauauuuauuaccucug

SEQ ID NO: 1314169 - RNA, 21 nt, Homo sapiens
gaaucacaucuuuuaagacaa

SEQ ID NO: 1314170 - RNA, 17 nt, Homo sapiens
gaaucagaucauuucaa

SEQ ID NO: 1314171 - RNA, 16 nt, Homo sapiens
gaaucagauuuuaaca

SEQ ID NO: 1314172 - RNA, 16 nt, Homo sapiens
gaauccagacccggcu

SEQ ID NO: 1314173 - RNA, 23 nt, Homo sapiens
gaauccuuuggugccaacuggug

SEQ ID NO: 1314174 - RNA, 17 nt, Homo sapiens
gaaucucauccaucaca

SEQ ID NO: 1314175 - RNA, 17 nt, Homo sapiens
gaaugaaccacugcccc

SEQ ID NO: 1314176 - RNA, 19 nt, Homo sapiens
gaaugagagcgacacagac

SEQ ID NO: 1314177 - RNA, 23 nt, Homo sapiens
gaaugaugcucaaaaucuuucca

SEQ ID NO: 1314178 - RNA, 18 nt, Homo sapiens
gaaugcagucuguccagg

SEQ ID NO: 1314179 - RNA, 19 nt, Homo sapiens
gaauguaaucaacauucca

SEQ ID NO: 1314180 - RNA, 20 nt, Homo sapiens
gaauguauugaacuuggaaa

SEQ ID NO: 1314181 - RNA, 22 nt, Homo sapiens
gaauguuaauuuuuugguacaa

SEQ ID NO: 1314182 - RNA, 19 nt, Homo sapiens
gaauguuugucucauccca

SEQ ID NO: 1314183 - RNA, 21 nt, Homo sapiens
gaauuaacaauaaaaguguga

SEQ ID NO: 1314184 - RNA, 13 nt, Homo sapiens
gaauuacuguaac

SEQ ID NO: 1314185 - RNA, 16 nt, Homo sapiens
gaauucaaacuggggc

SEQ ID NO: 1314186 - RNA, 15 nt, Homo sapiens
gaauuccaaagcaaa

SEQ ID NO: 1314187 - RNA, 13 nt, Homo sapiens
gaauugcagagua

SEQ ID NO: 1314188 - RNA, 12 nt, Homo sapiens
gaauuguuacau

SEQ ID NO: 1314189 - RNA, 18 nt, Homo sapiens
gaauuucauaugacauuc

SEQ ID NO: 1314190 - RNA, 14 nt, Homo sapiens
gaauuugcaaagua

SEQ ID NO: 1314191 - RNA, 20 nt, Homo sapiens
gaauuuucucuaacuucaag

SEQ ID NO: 1314192 - RNA, 22 nt, Homo sapiens
gaauuuuguucucugggagaaa

SEQ ID NO: 1314193 - RNA, 22 nt, Homo sapiens
gaauuuuugcaauaaugcagua

SEQ ID NO: 1314194 - RNA, 17 nt, Homo sapiens
gaauuuuuuucugcaca

SEQ ID NO: 1314195 - RNA, 17 nt, Homo sapiens
gacaaaaauauuuacac

SEQ ID NO: 1314196 - RNA, 21 nt, Homo sapiens
gacaaagaauuccaaagcaaa

SEQ ID NO: 1314197 - RNA, 16 nt, Homo sapiens
gacaaauaauaagcaa

SEQ ID NO: 1314198 - RNA, 13 nt, Homo sapiens
gacaacacuggga

SEQ ID NO: 1314199 - RNA, 14 nt, Homo sapiens
gacaacacugggaa

SEQ ID NO: 1314200 - RNA, 17 nt, Homo sapiens
gacaacucagaggccag

SEQ ID NO: 1314201 - RNA, 19 nt, Homo sapiens
gacaagacccccagcacuu

SEQ ID NO: 1314202 - RNA, 16 nt, Homo sapiens
gacaagccuaacuuca

SEQ ID NO: 1314203 - RNA, 15 nt, Homo sapiens
gacaaggaaaggcaa

SEQ ID NO: 1314204 - RNA, 16 nt, Homo sapiens
gacaagggaaauguca

SEQ ID NO: 1314205 - RNA, 23 nt, Homo sapiens
gacaaggucaccugggcugugau

SEQ ID NO: 1314206 - RNA, 13 nt, Homo sapiens
gacaauaugugcc

SEQ ID NO: 1314207 - RNA, 21 nt, Homo sapiens
gacaauaugugccaaucaaua

SEQ ID NO: 1314208 - RNA, 22 nt, Homo sapiens
gacaaugcugagguuaugaaca

SEQ ID NO: 1314209 - RNA, 15 nt, Homo sapiens
gacacaaaccugccu

SEQ ID NO: 1314210 - RNA, 20 nt, Homo sapiens
gacacagcccgaggaaucaa

SEQ ID NO: 1314211 - RNA, 21 nt, Homo sapiens
gacacagcucuucuccaggcu

SEQ ID NO: 1314212 - RNA, 20 nt, Homo sapiens
gacacaggaugaaggcaaug

SEQ ID NO: 1314213 - RNA, 19 nt, Homo sapiens
gacacaggcccucccuguu

SEQ ID NO: 1314214 - RNA, 17 nt, Homo sapiens
gacacaggucuuuccua

SEQ ID NO: 1314215 - RNA, 17 nt, Homo sapiens
agggaucagacgaaagu

SEQ ID NO: 1314216 - RNA, 20 nt, Homo sapiens
agggauggugcccuguucuc

SEQ ID NO: 1314217 - RNA, 15 nt, Homo sapiens
agggccccugcacac

SEQ ID NO: 1314218 - RNA, 14 nt, Homo sapiens
agggcgcaaagggc

SEQ ID NO: 1314219 - RNA, 17 nt, Homo sapiens
agggcgcaaagggcaug

SEQ ID NO: 1314220 - RNA, 18 nt, Homo sapiens
agggcgggcagagggcug

SEQ ID NO: 1314221 - RNA, 23 nt, Homo sapiens
agggcugacucuaggugcccuug

SEQ ID NO: 1314222 - RNA, 17 nt, Homo sapiens
agggcuuauccaugccu

SEQ ID NO: 1314223 - RNA, 13 nt, Homo sapiens
aggggcauugcug

SEQ ID NO: 1314224 - RNA, 23 nt, Homo sapiens
aggggcuucagguccaggcugug

SEQ ID NO: 1314225 - RNA, 22 nt, Homo sapiens
agggggagccccuucugcucag

SEQ ID NO: 1314226 - RNA, 19 nt, Homo sapiens
agggguggaguuuuguaua

SEQ ID NO: 1314227 - RNA, 15 nt, Homo sapiens
agggucccucugugu

SEQ ID NO: 1314228 - RNA, 16 nt, Homo sapiens
aggguguaauggagca

SEQ ID NO: 1314229 - RNA, 19 nt, Homo sapiens
aggguguaucuagcucuag

SEQ ID NO: 1314230 - RNA, 16 nt, Homo sapiens
aggguuugcagaaagc

SEQ ID NO: 1314231 - RNA, 16 nt, Homo sapiens
agguaaaaugccauga

SEQ ID NO: 1314232 - RNA, 18 nt, Homo sapiens
agguagagcccuugucca

SEQ ID NO: 1314233 - RNA, 14 nt, Homo sapiens
agguagagugguca

SEQ ID NO: 1314234 - RNA, 19 nt, Homo sapiens
agguaggggcccacuucac

SEQ ID NO: 1314235 - RNA, 16 nt, Homo sapiens
aggucagagaugggcu

SEQ ID NO: 1314236 - RNA, 22 nt, Homo sapiens
aggucagagccugcaguuauua

SEQ ID NO: 1314237 - RNA, 16 nt, Homo sapiens
aggucauuacucucaa

SEQ ID NO: 1314238 - RNA, 19 nt, Homo sapiens
agguccugagagcugcuuu

SEQ ID NO: 1314239 - RNA, 20 nt, Homo sapiens
aggugaaacccagucacugu

SEQ ID NO: 1314240 - RNA, 21 nt, Homo sapiens
aggugaacaagcaaacccaga

SEQ ID NO: 1314241 - RNA, 22 nt, Homo sapiens
aggugcgcaguggcauguccac

SEQ ID NO: 1314242 - RNA, 19 nt, Homo sapiens
aggugcugacuucaucucc

SEQ ID NO: 1314243 - RNA, 20 nt, Homo sapiens
aggugcugacuucaucuccc

SEQ ID NO: 1314244 - RNA, 17 nt, Homo sapiens
agguggaaggacccugu

SEQ ID NO: 1314245 - RNA, 20 nt, Homo sapiens
aggugggaggaucucuugag

SEQ ID NO: 1314246 - RNA, 20 nt, Homo sapiens
aggugguaagcaccaggacg

SEQ ID NO: 1314247 - RNA, 17 nt, Homo sapiens
agguguggcggcgagca

SEQ ID NO: 1314248 - RNA, 18 nt, Homo sapiens
agguguuggacaggggau

SEQ ID NO: 1314249 - RNA, 18 nt, Homo sapiens
agguuaauaaagaugauu

SEQ ID NO: 1314250 - RNA, 13 nt, Homo sapiens
agguucauggauu

SEQ ID NO: 1314251 - RNA, 20 nt, Homo sapiens
agguuccuugguguucaaaa

SEQ ID NO: 1314252 - RNA, 19 nt, Homo sapiens
agguuggugaauuucacaa

SEQ ID NO: 1314253 - RNA, 22 nt, Homo sapiens
agguuggugaauuucacaagcu

SEQ ID NO: 1314254 - RNA, 18 nt, Homo sapiens
agguuucuuugacuucaa

SEQ ID NO: 1314255 - RNA, 16 nt, Homo sapiens
agguuugccagcauuu

SEQ ID NO: 1314256 - RNA, 15 nt, Homo sapiens
agguuuuaaagaccu

SEQ ID NO: 1314257 - RNA, 15 nt, Homo sapiens
agguuuuuaugcaug

SEQ ID NO: 1314258 - RNA, 16 nt, Homo sapiens
agguuuuuggucugac

SEQ ID NO: 1314259 - RNA, 20 nt, Homo sapiens
aguaaaacuccgagugaacu

SEQ ID NO: 1314260 - RNA, 16 nt, Homo sapiens
aguaaaagaaaccacu

SEQ ID NO: 1314261 - RNA, 13 nt, Homo sapiens
aguaacauuaacu

SEQ ID NO: 1314262 - RNA, 18 nt, Homo sapiens
aguaagagcuuuguuuca

SEQ ID NO: 1314263 - RNA, 12 nt, Homo sapiens
aguacaggugaa

SEQ ID NO: 1314264 - RNA, 22 nt, Homo sapiens
aguaccaacucuccaaaacuaa

SEQ ID NO: 1314265 - RNA, 21 nt, Homo sapiens
aguaccuugcuucuuacugau

SEQ ID NO: 1314266 - RNA, 22 nt, Homo sapiens
aguaccuuuccauuuauucuuu

SEQ ID NO: 1314267 - RNA, 14 nt, Homo sapiens
aguacuggcauggu

SEQ ID NO: 1314268 - RNA, 17 nt, Homo sapiens
aguacuggcaugguacg

SEQ ID NO: 1314269 - RNA, 15 nt, Homo sapiens
aguagaaaggccuuu

SEQ ID NO: 1314270 - RNA, 14 nt, Homo sapiens
aguagaaucucagu

SEQ ID NO: 1314271 - RNA, 14 nt, Homo sapiens
aguagacugcagug

SEQ ID NO: 1314272 - RNA, 14 nt, Homo sapiens
aguagagacagggu

SEQ ID NO: 1314273 - RNA, 17 nt, Homo sapiens
aguagagggcacugggu

SEQ ID NO: 1314274 - RNA, 14 nt, Homo sapiens
aguagcugggacua

SEQ ID NO: 1314275 - RNA, 18 nt, Homo sapiens
aguagggccccugcacac

SEQ ID NO: 1314276 - RNA, 23 nt, Homo sapiens
aguaguuuuuacagcuguguuau

SEQ ID NO: 1314277 - RNA, 14 nt, Homo sapiens
aguauacaaaaaga

SEQ ID NO: 1314278 - RNA, 17 nt, Homo sapiens
aguaucacugucuuucc

SEQ ID NO: 1314279 - RNA, 21 nt, Homo sapiens
aguaucaugcccugugcaacc

SEQ ID NO: 1314280 - RNA, 15 nt, Homo sapiens
aguauccaugcucuu

SEQ ID NO: 1314281 - RNA, 14 nt, Homo sapiens
aguaugguaauuaa

SEQ ID NO: 1314282 - RNA, 15 nt, Homo sapiens
aguaugguaauuaaa

SEQ ID NO: 1314283 - RNA, 18 nt, Homo sapiens
aguauuaagagcaauuca

SEQ ID NO: 1314284 - RNA, 16 nt, Homo sapiens
aguauucaugacuaug

SEQ ID NO: 1314285 - RNA, 20 nt, Homo sapiens
aguauugucgguuaccucug

SEQ ID NO: 1314286 - RNA, 13 nt, Homo sapiens
aguauugugauau

SEQ ID NO: 1314287 - RNA, 21 nt, Homo sapiens
aguauuuuguguccuccagga

SEQ ID NO: 1314288 - RNA, 19 nt, Homo sapiens
aguauuuuugcugcuucug

SEQ ID NO: 1314289 - RNA, 17 nt, Homo sapiens
agucaacaguucaaaga

SEQ ID NO: 1314290 - RNA, 22 nt, Homo sapiens
agucaauccaagagucugauga

SEQ ID NO: 1314291 - RNA, 21 nt, Homo sapiens
agucacacgggggcagcugau

SEQ ID NO: 1314292 - RNA, 18 nt, Homo sapiens
agucaguucucauuauuc

SEQ ID NO: 1314293 - RNA, 23 nt, Homo sapiens
agucaguuguggccccagccccu

SEQ ID NO: 1314294 - RNA, 14 nt, Homo sapiens
agucauuggcuuua

SEQ ID NO: 1314295 - RNA, 23 nt, Homo sapiens
aguccaaggaaaccacagcugcu

SEQ ID NO: 1314296 - RNA, 20 nt, Homo sapiens
aguccagccuggagaugaaa

SEQ ID NO: 1314297 - RNA, 23 nt, Homo sapiens
agucccaaccccagcuacucuga

SEQ ID NO: 1314298 - RNA, 18 nt, Homo sapiens
agucccaccuuggcugca

SEQ ID NO: 1314299 - RNA, 14 nt, Homo sapiens
agucccaugcacaa

SEQ ID NO: 1314300 - RNA, 20 nt, Homo sapiens
aguccccuucuuuuggcccu

SEQ ID NO: 1314301 - RNA, 12 nt, Homo sapiens
aguccucugaau

SEQ ID NO: 1314302 - RNA, 22 nt, Homo sapiens
aguccugcuaccucccuugccu

SEQ ID NO: 1314303 - RNA, 18 nt, Homo sapiens
aguccuggagcaaucaca

SEQ ID NO: 1314304 - RNA, 21 nt, Homo sapiens
aguccuggagcuggcucuaua

SEQ ID NO: 1314305 - RNA, 15 nt, Homo sapiens
agucgaacaauucau

SEQ ID NO: 1314306 - RNA, 23 nt, Homo sapiens
agucgaggacagggaggugaccc

SEQ ID NO: 1314307 - RNA, 17 nt, Homo sapiens
agucggagccacugguc

SEQ ID NO: 1314308 - RNA, 17 nt, Homo sapiens
agucuauguucaaagac

SEQ ID NO: 1314309 - RNA, 16 nt, Homo sapiens
agucucacuguugccc

SEQ ID NO: 1314310 - RNA, 14 nt, Homo sapiens
agucucauucuguc

SEQ ID NO: 1314311 - RNA, 21 nt, Homo sapiens
agucucugguagccugcagaa

SEQ ID NO: 1314312 - RNA, 17 nt, Homo sapiens
agucucuucuaagcaaa

SEQ ID NO: 1314313 - RNA, 22 nt, Homo sapiens
agucuggucagagccacagggu

SEQ ID NO: 1314314 - RNA, 19 nt, Homo sapiens
agucuugcagcaggaucua

SEQ ID NO: 1314315 - RNA, 17 nt, Homo sapiens
agucuuucuaacugaau

SEQ ID NO: 1314316 - RNA, 19 nt, Homo sapiens
agucuuugguaaauggcaa

SEQ ID NO: 1314317 - RNA, 17 nt, Homo sapiens
agugaaaacaaguccuu

SEQ ID NO: 1314318 - RNA, 14 nt, Homo sapiens
agugaacauucuga

SEQ ID NO: 1314319 - RNA, 13 nt, Homo sapiens
agugaacuugaaa

SEQ ID NO: 1314320 - RNA, 14 nt, Homo sapiens
agugaaggauuuau

SEQ ID NO: 1314321 - RNA, 17 nt, Homo sapiens
agugaaggcuguccuua

SEQ ID NO: 1314322 - RNA, 21 nt, Homo sapiens
agugacauaauuuacaugcaa

SEQ ID NO: 1314323 - RNA, 21 nt, Homo sapiens
agugacuguucaagagcacac

SEQ ID NO: 1314324 - RNA, 22 nt, Homo sapiens
agugagcccaucugcacagugg

SEQ ID NO: 1314325 - RNA, 15 nt, Homo sapiens
agugagcugauauca

SEQ ID NO: 1314326 - RNA, 21 nt, Homo sapiens
agugaggcugcacccacccag

SEQ ID NO: 1314327 - RNA, 16 nt, Homo sapiens
agugaggucacagucc

SEQ ID NO: 1314328 - RNA, 19 nt, Homo sapiens
agugauaaaauguuuguua

SEQ ID NO: 1314329 - RNA, 14 nt, Homo sapiens
agugauccucccac

SEQ ID NO: 1314330 - RNA, 21 nt, Homo sapiens
agugaugcugugauaccuuag

SEQ ID NO: 1314331 - RNA, 19 nt, Homo sapiens
agugauuuagaacagucau

SEQ ID NO: 1314332 - RNA, 21 nt, Homo sapiens
agugcaaccucugcuucccag

SEQ ID NO: 1314333 - RNA, 14 nt, Homo sapiens
agugcagcauauac

SEQ ID NO: 1314334 - RNA, 16 nt, Homo sapiens
agugcaggcacaguau

SEQ ID NO: 1314335 - RNA, 21 nt, Homo sapiens
agugcagugagccgagaucac

SEQ ID NO: 1314336 - RNA, 17 nt, Homo sapiens
agugccucuuucaucca

SEQ ID NO: 1314337 - RNA, 20 nt, Homo sapiens
agugccuucuaaagguguug

SEQ ID NO: 1314338 - RNA, 16 nt, Homo sapiens
aguggaggcacuuuag

SEQ ID NO: 1314339 - RNA, 19 nt, Homo sapiens
aguggcaggggacaggagu

SEQ ID NO: 1314340 - RNA, 12 nt, Homo sapiens
aguggccaguuc

SEQ ID NO: 1314341 - RNA, 23 nt, Homo sapiens
aguggcucacaccuguaauccca

SEQ ID NO: 1314342 - RNA, 12 nt, Homo sapiens
aguggcuucucu

SEQ ID NO: 1314343 - RNA, 19 nt, Homo sapiens
agugggugaauaauacagu

SEQ ID NO: 1314344 - RNA, 20 nt, Homo sapiens
aguguaguuaaggagccuaa

SEQ ID NO: 1314345 - RNA, 23 nt, Homo sapiens
agugucaccccucacugugacug

SEQ ID NO: 1314346 - RNA, 15 nt, Homo sapiens
auauagcaucuuuca

SEQ ID NO: 1314347 - RNA, 12 nt, Homo sapiens
auauaggauaau

SEQ ID NO: 1314348 - RNA, 19 nt, Homo sapiens
auauagggaucaaccagcu

SEQ ID NO: 1314349 - RNA, 18 nt, Homo sapiens
auauauaagaaagacauc

SEQ ID NO: 1314350 - RNA, 13 nt, Homo sapiens
auauauaauacug

SEQ ID NO: 1314351 - RNA, 23 nt, Homo sapiens
auauaugauauauaaaugugauu

SEQ ID NO: 1314352 - RNA, 20 nt, Homo sapiens
auauauuuuugugcacauuu

SEQ ID NO: 1314353 - RNA, 14 nt, Homo sapiens
auaucaaaagcaaa

SEQ ID NO: 1314354 - RNA, 17 nt, Homo sapiens
auaucaaaagcaaauaa

SEQ ID NO: 1314355 - RNA, 14 nt, Homo sapiens
auaucgaucucuua

SEQ ID NO: 1314356 - RNA, 16 nt, Homo sapiens
auaucuuuauuaauca

SEQ ID NO: 1314357 - RNA, 13 nt, Homo sapiens
auaugaacauaua

SEQ ID NO: 1314358 - RNA, 13 nt, Homo sapiens
auaugacaagccu

SEQ ID NO: 1314359 - RNA, 18 nt, Homo sapiens
auaugaguaauacaucaa

SEQ ID NO: 1314360 - RNA, 21 nt, Homo sapiens
auaugaguaauacaucaaaga

SEQ ID NO: 1314361 - RNA, 20 nt, Homo sapiens
auaugaugaucuggauccac

SEQ ID NO: 1314362 - RNA, 14 nt, Homo sapiens
auaugcagucucuu

SEQ ID NO: 1314363 - RNA, 15 nt, Homo sapiens
auauguacagaagau

SEQ ID NO: 1314364 - RNA, 14 nt, Homo sapiens
auauguagccuuca

SEQ ID NO: 1314365 - RNA, 20 nt, Homo sapiens
auauguauaaacuuacauca

SEQ ID NO: 1314366 - RNA, 17 nt, Homo sapiens
auauguauaggagcucu

SEQ ID NO: 1314367 - RNA, 16 nt, Homo sapiens
auauguauuuaccaaa

SEQ ID NO: 1314368 - RNA, 20 nt, Homo sapiens
auaugugaagaaaaauguau

SEQ ID NO: 1314369 - RNA, 16 nt, Homo sapiens
auauguucaacuggag

SEQ ID NO: 1314370 - RNA, 13 nt, Homo sapiens
auauguugcuaua

SEQ ID NO: 1314371 - RNA, 15 nt, Homo sapiens
auauguugcuauaau

SEQ ID NO: 1314372 - RNA, 12 nt, Homo sapiens
auauuagcuuua

SEQ ID NO: 1314373 - RNA, 18 nt, Homo sapiens
auauuauuguaaccaaua

SEQ ID NO: 1314374 - RNA, 20 nt, Homo sapiens
auauucccggucagcaguau

SEQ ID NO: 1314375 - RNA, 19 nt, Homo sapiens
auauugcagcuuauauuca

SEQ ID NO: 1314376 - RNA, 23 nt, Homo sapiens
auauugggguuggaacauuucag

SEQ ID NO: 1314377 - RNA, 18 nt, Homo sapiens
auauuguaaaagggauuu

SEQ ID NO: 1314378 - RNA, 14 nt, Homo sapiens
auauuuaacaugua

SEQ ID NO: 1314379 - RNA, 20 nt, Homo sapiens
auauuuaauggcacugagaa

SEQ ID NO: 1314380 - RNA, 15 nt, Homo sapiens
auauuuauacuguau

SEQ ID NO: 1314381 - RNA, 13 nt, Homo sapiens
auauuuaucugau

SEQ ID NO: 1314382 - RNA, 19 nt, Homo sapiens
auauuugggccugcuccag

SEQ ID NO: 1314383 - RNA, 16 nt, Homo sapiens
auauuugguuuggcca

SEQ ID NO: 1314384 - RNA, 21 nt, Homo sapiens
auauuuguaauuuuacacaaa

SEQ ID NO: 1314385 - RNA, 13 nt, Homo sapiens
auauuuuacauac

SEQ ID NO: 1314386 - RNA, 20 nt, Homo sapiens
auauuuuccauauauuggca

SEQ ID NO: 1314387 - RNA, 14 nt, Homo sapiens
aucaaaaaguauua

SEQ ID NO: 1314388 - RNA, 18 nt, Homo sapiens
aucaaaauuucagcauua

SEQ ID NO: 1314389 - RNA, 23 nt, Homo sapiens
aucaaauggaagacacauugaaa

SEQ ID NO: 1314390 - RNA, 16 nt, Homo sapiens
aucaacgaguacuuca

SEQ ID NO: 1314391 - RNA, 19 nt, Homo sapiens
aucaacuuccuaaauauua

SEQ ID NO: 1314392 - RNA, 23 nt, Homo sapiens
aucaacuugcuuaucaacuuccu

SEQ ID NO: 1314393 - RNA, 17 nt, Homo sapiens
aucaagagagcuuaaca

SEQ ID NO: 1314394 - RNA, 14 nt, Homo sapiens
aucaagcagccaag

SEQ ID NO: 1314395 - RNA, 22 nt, Homo sapiens
aucaagucaucuauaguugaua

SEQ ID NO: 1314396 - RNA, 15 nt, Homo sapiens
aucaagucuguuuac

SEQ ID NO: 1314397 - RNA, 19 nt, Homo sapiens
aucaauagaaggauguaca

SEQ ID NO: 1314398 - RNA, 19 nt, Homo sapiens
aucacacugggugguggcc

SEQ ID NO: 1314399 - RNA, 22 nt, Homo sapiens
aucacagaugaguuaucuaaga

SEQ ID NO: 1314400 - RNA, 15 nt, Homo sapiens
aucaccacucaaaaa

SEQ ID NO: 1314401 - RNA, 20 nt, Homo sapiens
aucaccagagaccaaacaag

SEQ ID NO: 1314402 - RNA, 20 nt, Homo sapiens
aucaccgugggcucccugac

SEQ ID NO: 1314403 - RNA, 17 nt, Homo sapiens
aucaccuccaccauacu

SEQ ID NO: 1314404 - RNA, 18 nt, Homo sapiens
aucaccuuaggcagggaa

SEQ ID NO: 1314405 - RNA, 19 nt, Homo sapiens
aucacucucaccuuccaaa

SEQ ID NO: 1314406 - RNA, 17 nt, Homo sapiens
aucacugguugcacuua

SEQ ID NO: 1314407 - RNA, 15 nt, Homo sapiens
aucacuucaggucag

SEQ ID NO: 1314408 - RNA, 19 nt, Homo sapiens
aucacuucugagaacucau

SEQ ID NO: 1314409 - RNA, 14 nt, Homo sapiens
aucacuugagguca

SEQ ID NO: 1314410 - RNA, 17 nt, Homo sapiens
aucagacuccugugcaa

SEQ ID NO: 1314411 - RNA, 13 nt, Homo sapiens
aucagagagggaa

SEQ ID NO: 1314412 - RNA, 11 nt, Homo sapiens
aucagagccuu

SEQ ID NO: 1314413 - RNA, 12 nt, Homo sapiens
aucagauuuauu

SEQ ID NO: 1314414 - RNA, 15 nt, Homo sapiens
aucagcauuuuacua

SEQ ID NO: 1314415 - RNA, 15 nt, Homo sapiens
aucagccacauucua

SEQ ID NO: 1314416 - RNA, 18 nt, Homo sapiens
aucaggaauauuuuccaa

SEQ ID NO: 1314417 - RNA, 20 nt, Homo sapiens
aucaggaccuccaagccacu

SEQ ID NO: 1314418 - RNA, 17 nt, Homo sapiens
aucaggagaaaaagccu

SEQ ID NO: 1314419 - RNA, 21 nt, Homo sapiens
aucagugcuccuguaagucaa

SEQ ID NO: 1314420 - RNA, 18 nt, Homo sapiens
aucaucuccugccuuccu

SEQ ID NO: 1314421 - RNA, 14 nt, Homo sapiens
aucaucuguggaac

SEQ ID NO: 1314422 - RNA, 14 nt, Homo sapiens
aucaucuuuuagac

SEQ ID NO: 1314423 - RNA, 19 nt, Homo sapiens
aucaugcaaaugcuguauu

SEQ ID NO: 1314424 - RNA, 17 nt, Homo sapiens
aucauggucucagucau

SEQ ID NO: 1314425 - RNA, 15 nt, Homo sapiens
aucauguguguccac

SEQ ID NO: 1314426 - RNA, 15 nt, Homo sapiens
aucauucccauuuug

SEQ ID NO: 1314427 - RNA, 13 nt, Homo sapiens
aucauuccuugag

SEQ ID NO: 1314428 - RNA, 16 nt, Homo sapiens
aucauucucauucuca

SEQ ID NO: 1314429 - RNA, 17 nt, Homo sapiens
aucauucucugucucau

SEQ ID NO: 1314430 - RNA, 22 nt, Homo sapiens
aucauuugguuuuaaaauauga

SEQ ID NO: 1314431 - RNA, 17 nt, Homo sapiens
auccaaagcugaauaca

SEQ ID NO: 1314432 - RNA, 12 nt, Homo sapiens
auccacauggga

SEQ ID NO: 1314433 - RNA, 14 nt, Homo sapiens
auccacccaccuca

SEQ ID NO: 1314434 - RNA, 20 nt, Homo sapiens
auccagggcccccaucucau

SEQ ID NO: 1314435 - RNA, 17 nt, Homo sapiens
auccauaaagacaauca

SEQ ID NO: 1314436 - RNA, 17 nt, Homo sapiens
auccauauugagucaaa

SEQ ID NO: 1314437 - RNA, 20 nt, Homo sapiens
auccauccucacugcuguca

SEQ ID NO: 1314438 - RNA, 17 nt, Homo sapiens
auccaugaaccaagacc

SEQ ID NO: 1314439 - RNA, 18 nt, Homo sapiens
auccaugcaccuaccuua

SEQ ID NO: 1314440 - RNA, 22 nt, Homo sapiens
auccaugccugggaaaugccac

SEQ ID NO: 1314441 - RNA, 15 nt, Homo sapiens
auccauucacaguuc

SEQ ID NO: 1314442 - RNA, 20 nt, Homo sapiens
aucccaaguagaaucucagu

SEQ ID NO: 1314443 - RNA, 22 nt, Homo sapiens
aucccugacaucuggaaucugg

SEQ ID NO: 1314444 - RNA, 12 nt, Homo sapiens
aucccugagauc

SEQ ID NO: 1314445 - RNA, 20 nt, Homo sapiens
auccgaaccuccucugugaa

SEQ ID NO: 1314446 - RNA, 13 nt, Homo sapiens
auccgcacuguaa

SEQ ID NO: 1314447 - RNA, 14 nt, Homo sapiens
auccuaaucaucca

SEQ ID NO: 1314448 - RNA, 14 nt, Homo sapiens
auccuagcacuuug

SEQ ID NO: 1314449 - RNA, 13 nt, Homo sapiens
auccuagugcuuu

SEQ ID NO: 1314450 - RNA, 23 nt, Homo sapiens
auccuauuacauaguuugaaaaa

SEQ ID NO: 1314451 - RNA, 15 nt, Homo sapiens
auccuccaguaccuu

SEQ ID NO: 1314452 - RNA, 16 nt, Homo sapiens
auccucccaccucagc

SEQ ID NO: 1314453 - RNA, 13 nt, Homo sapiens
auccugcaguggg

SEQ ID NO: 1314454 - RNA, 11 nt, Homo sapiens
auccugggcug

SEQ ID NO: 1314455 - RNA, 21 nt, Homo sapiens
auccuuccacuaucauuccca

SEQ ID NO: 1314456 - RNA, 12 nt, Homo sapiens
aucgaagcagau

SEQ ID NO: 1314457 - RNA, 17 nt, Homo sapiens
aucgaaucccuuucuca

SEQ ID NO: 1314458 - RNA, 19 nt, Homo sapiens
aucgaaucuacuaauucca

SEQ ID NO: 1314459 - RNA, 22 nt, Homo sapiens
aucgagauguccauagucaaau

SEQ ID NO: 1314460 - RNA, 14 nt, Homo sapiens
aucgaucaugaugu

SEQ ID NO: 1314461 - RNA, 13 nt, Homo sapiens
aucgcaagagcca

SEQ ID NO: 1314462 - RNA, 13 nt, Homo sapiens
aucggcaggcagu

SEQ ID NO: 1314463 - RNA, 18 nt, Homo sapiens
aucguaaagcuguucaaa

SEQ ID NO: 1314464 - RNA, 22 nt, Homo sapiens
aucgucuaaacuuuagaauuaa

SEQ ID NO: 1314465 - RNA, 22 nt, Homo sapiens
aucuaaaccauaugaacauaua

SEQ ID NO: 1314466 - RNA, 22 nt, Homo sapiens
aucuaauauggccacaguaguc

SEQ ID NO: 1314467 - RNA, 17 nt, Homo sapiens
aucuagcucuaguucaa

SEQ ID NO: 1314468 - RNA, 15 nt, Homo sapiens
aucucaaagaaggca

SEQ ID NO: 1314469 - RNA, 17 nt, Homo sapiens
aucucaaccauccccuc

SEQ ID NO: 1314470 - RNA, 16 nt, Homo sapiens
aucucauggaaacugg

SEQ ID NO: 1314471 - RNA, 17 nt, Homo sapiens
aucuccugcgcccuuca

SEQ ID NO: 1314472 - RNA, 20 nt, Homo sapiens
aucucgaacuccuaaccuca

SEQ ID NO: 1314473 - RNA, 13 nt, Homo sapiens
aucucugacuuaa

SEQ ID NO: 1314474 - RNA, 16 nt, Homo sapiens
aucucugcuuucacuc

SEQ ID NO: 1314475 - RNA, 22 nt, Homo sapiens
aucucugucccacuuggcauca

SEQ ID NO: 1314476 - RNA, 16 nt, Homo sapiens
aucucuuauuuuacaa

SEQ ID NO: 1314477 - RNA, 23 nt, Homo sapiens
aucucuuguauaugaugaucugg

SEQ ID NO: 1314478 - RNA, 14 nt, Homo sapiens
aucugagaaacucu

SEQ ID NO: 1314479 - RNA, 23 nt, Homo sapiens
auuuugcuagcuaugagcuuuua

SEQ ID NO: 1314480 - RNA, 20 nt, Homo sapiens
auuuugggguacccacugcu

SEQ ID NO: 1314481 - RNA, 16 nt, Homo sapiens
auuuuguaaaaguggc

SEQ ID NO: 1314482 - RNA, 19 nt, Homo sapiens
auuuuguuuuugucuuaaa

SEQ ID NO: 1314483 - RNA, 19 nt, Homo sapiens
auuuuuaaggauguugcca

SEQ ID NO: 1314484 - RNA, 16 nt, Homo sapiens
auuuuuagacagaguc

SEQ ID NO: 1314485 - RNA, 13 nt, Homo sapiens
auuuuuagccuaa

SEQ ID NO: 1314486 - RNA, 21 nt, Homo sapiens
auuuuuauaaaaaugagugcu

SEQ ID NO: 1314487 - RNA, 17 nt, Homo sapiens
auuuuuauagacaaaua

SEQ ID NO: 1314488 - RNA, 17 nt, Homo sapiens
auuuuucaagagcuccu

SEQ ID NO: 1314489 - RNA, 22 nt, Homo sapiens
auuuuucauugugagacacuaa

SEQ ID NO: 1314490 - RNA, 23 nt, Homo sapiens
auuuuuccuaugcuauugacaau

SEQ ID NO: 1314491 - RNA, 12 nt, Homo sapiens
auuuuugcaaua

SEQ ID NO: 1314492 - RNA, 13 nt, Homo sapiens
auuuuugugcaca

SEQ ID NO: 1314493 - RNA, 15 nt, Homo sapiens
auuuuuuugagacag

SEQ ID NO: 1314494 - RNA, 14 nt, Homo sapiens
auuuuuuuuuggau

SEQ ID NO: 1314495 - RNA, 18 nt, Homo sapiens
caaaacauugaucuggcu

SEQ ID NO: 1314496 - RNA, 17 nt, Homo sapiens
caaaacauuuuacuuua

SEQ ID NO: 1314497 - RNA, 15 nt, Homo sapiens
caaaaccucaugaca

SEQ ID NO: 1314498 - RNA, 16 nt, Homo sapiens
caaaacuaaauuugaa

SEQ ID NO: 1314499 - RNA, 15 nt, Homo sapiens
caaaacugcauuuca

SEQ ID NO: 1314500 - RNA, 17 nt, Homo sapiens
caaaacuggagucccaa

SEQ ID NO: 1314501 - RNA, 14 nt, Homo sapiens
caaaagcugcucag

SEQ ID NO: 1314502 - RNA, 15 nt, Homo sapiens
caaaaggacucucag

SEQ ID NO: 1314503 - RNA, 20 nt, Homo sapiens
caaaauaaaaaccaagaaga

SEQ ID NO: 1314504 - RNA, 21 nt, Homo sapiens
caaaauaaaaggacucuggaa

SEQ ID NO: 1314505 - RNA, 17 nt, Homo sapiens
caaaauagaaaaguuau

SEQ ID NO: 1314506 - RNA, 17 nt, Homo sapiens
caaaaucaagcaagccu

SEQ ID NO: 1314507 - RNA, 16 nt, Homo sapiens
caaaaugauacuuacu

SEQ ID NO: 1314508 - RNA, 18 nt, Homo sapiens
caaaauguagaauauuca

SEQ ID NO: 1314509 - RNA, 22 nt, Homo sapiens
caaaaugugaaaauaauauuaa

SEQ ID NO: 1314510 - RNA, 16 nt, Homo sapiens
caaaauuucagcauua

SEQ ID NO: 1314511 - RNA, 18 nt, Homo sapiens
caaaauuuugucccaucu

SEQ ID NO: 1314512 - RNA, 20 nt, Homo sapiens
caaaauuuugucccaucucu

SEQ ID NO: 1314513 - RNA, 22 nt, Homo sapiens
caaacaggcaguuggccagaga

SEQ ID NO: 1314514 - RNA, 11 nt, Homo sapiens
caaacagugac

SEQ ID NO: 1314515 - RNA, 14 nt, Homo sapiens
caaaccacuguuau

SEQ ID NO: 1314516 - RNA, 23 nt, Homo sapiens
caaaccacuguuauuaacagaua

SEQ ID NO: 1314517 - RNA, 19 nt, Homo sapiens
caaaccagcuucauguggc

SEQ ID NO: 1314518 - RNA, 14 nt, Homo sapiens
caaacccaaaaaag

SEQ ID NO: 1314519 - RNA, 17 nt, Homo sapiens
caaacgcccuuuccucc

SEQ ID NO: 1314520 - RNA, 21 nt, Homo sapiens
caaacuacuggcaauuuguaa

SEQ ID NO: 1314521 - RNA, 13 nt, Homo sapiens
caaacucuucagu

SEQ ID NO: 1314522 - RNA, 12 nt, Homo sapiens
caaacugugcuu

SEQ ID NO: 1314523 - RNA, 20 nt, Homo sapiens
caaagaaaacugucugggag

SEQ ID NO: 1314524 - RNA, 23 nt, Homo sapiens
caaagaaccuucucuauggggca

SEQ ID NO: 1314525 - RNA, 12 nt, Homo sapiens
caaagaauucca

SEQ ID NO: 1314526 - RNA, 14 nt, Homo sapiens
caaagacuauuccc

SEQ ID NO: 1314527 - RNA, 14 nt, Homo sapiens
caaagagugaagga

SEQ ID NO: 1314528 - RNA, 11 nt, Homo sapiens
caaagaugacc

SEQ ID NO: 1314529 - RNA, 21 nt, Homo sapiens
caaagaugaccauaaccacug

SEQ ID NO: 1314530 - RNA, 17 nt, Homo sapiens
caaagaugggugaaggc

SEQ ID NO: 1314531 - RNA, 23 nt, Homo sapiens
caaagcagccacgaggugcaaca

SEQ ID NO: 1314532 - RNA, 21 nt, Homo sapiens
caaagcaggggaguaugcaaa

SEQ ID NO: 1314533 - RNA, 16 nt, Homo sapiens
caaagccaagaccuca

SEQ ID NO: 1314534 - RNA, 21 nt, Homo sapiens
caaagccaauaacacacagcu

SEQ ID NO: 1314535 - RNA, 23 nt, Homo sapiens
caaagccuccuccagccgccaug

SEQ ID NO: 1314536 - RNA, 23 nt, Homo sapiens
caaagcucaagaugacagcucuu

SEQ ID NO: 1314537 - RNA, 18 nt, Homo sapiens
caaaggcacagugaaggc

SEQ ID NO: 1314538 - RNA, 22 nt, Homo sapiens
caaaggcugagaacacugugaa

SEQ ID NO: 1314539 - RNA, 21 nt, Homo sapiens
caaagguuccauucagugcag

SEQ ID NO: 1314540 - RNA, 20 nt, Homo sapiens
caaaguaaaagaaaccacuu

SEQ ID NO: 1314541 - RNA, 22 nt, Homo sapiens
caaagucaucccucuguucaca

SEQ ID NO: 1314542 - RNA, 18 nt, Homo sapiens
caaagugagacaguccag

SEQ ID NO: 1314543 - RNA, 22 nt, Homo sapiens
caaaguuaaaagccuaccuaag

SEQ ID NO: 1314544 - RNA, 13 nt, Homo sapiens
caaaguuaugcaa

SEQ ID NO: 1314545 - RNA, 18 nt, Homo sapiens
caaauaaugucucuguga

SEQ ID NO: 1314546 - RNA, 16 nt, Homo sapiens
caaauacuaucuguca

SEQ ID NO: 1314547 - RNA, 23 nt, Homo sapiens
caaauaucccguguuaccuuucu

SEQ ID NO: 1314548 - RNA, 13 nt, Homo sapiens
caaaucaaagcag

SEQ ID NO: 1314549 - RNA, 22 nt, Homo sapiens
caaauccuuagaucuggcaugu

SEQ ID NO: 1314550 - RNA, 14 nt, Homo sapiens
caaaucucuuccuu

SEQ ID NO: 1314551 - RNA, 13 nt, Homo sapiens
caaaucugaggga

SEQ ID NO: 1314552 - RNA, 17 nt, Homo sapiens
caaaugaaacacuuuca

SEQ ID NO: 1314553 - RNA, 18 nt, Homo sapiens
caaaugaaacacuuucag

SEQ ID NO: 1314554 - RNA, 15 nt, Homo sapiens
caaaugcccaaggga

SEQ ID NO: 1314555 - RNA, 16 nt, Homo sapiens
caaaugcccaagggaa

SEQ ID NO: 1314556 - RNA, 22 nt, Homo sapiens
caaaugcucucucuucuuauua

SEQ ID NO: 1314557 - RNA, 20 nt, Homo sapiens
caaauggaagacacauugaa

SEQ ID NO: 1314558 - RNA, 13 nt, Homo sapiens
caaauggcacugc

SEQ ID NO: 1314559 - RNA, 19 nt, Homo sapiens
caaauggggccagauccag

SEQ ID NO: 1314560 - RNA, 24 nt, Homo sapiens
caaaugguggaggauugcugccag

SEQ ID NO: 1314561 - RNA, 23 nt, Homo sapiens
caaaugugcuggucacccuucaa

SEQ ID NO: 1314562 - RNA, 16 nt, Homo sapiens
caaauguuaugcauaa

SEQ ID NO: 1314563 - RNA, 19 nt, Homo sapiens
caaauuugugguccacuga

SEQ ID NO: 1314564 - RNA, 11 nt, Homo sapiens
caacaaaccau

SEQ ID NO: 1314565 - RNA, 19 nt, Homo sapiens
caacaaaccauccagugac

SEQ ID NO: 1314566 - RNA, 18 nt, Homo sapiens
caacaacaccagaacugu

SEQ ID NO: 1314567 - RNA, 22 nt, Homo sapiens
caacaaccggccaccagauguc

SEQ ID NO: 1314568 - RNA, 15 nt, Homo sapiens
caacaagaccaccac

SEQ ID NO: 1314569 - RNA, 15 nt, Homo sapiens
caacaccagaacugu

SEQ ID NO: 1314570 - RNA, 14 nt, Homo sapiens
caacacugcugcuc

SEQ ID NO: 1314571 - RNA, 23 nt, Homo sapiens
caacacugcugcuccagugcagg

SEQ ID NO: 1314572 - RNA, 19 nt, Homo sapiens
caacacuguggguguguga

SEQ ID NO: 1314573 - RNA, 13 nt, Homo sapiens
caacagagacugg

SEQ ID NO: 1314574 - RNA, 11 nt, Homo sapiens
caacagcauuu

SEQ ID NO: 1314575 - RNA, 20 nt, Homo sapiens
caacaggaaucucagagaca

SEQ ID NO: 1314576 - RNA, 20 nt, Homo sapiens
caacaguggggaagagugac

SEQ ID NO: 1314577 - RNA, 18 nt, Homo sapiens
caacaguuacauaauuca

SEQ ID NO: 1314578 - RNA, 12 nt, Homo sapiens
caacaguuuucc

SEQ ID NO: 1314579 - RNA, 18 nt, Homo sapiens
caacaucuaaaaaucaaa

SEQ ID NO: 1314580 - RNA, 23 nt, Homo sapiens
caacaugaugugaaaacccaucu

SEQ ID NO: 1314581 - RNA, 20 nt, Homo sapiens
caacauggcgaaaccccucu

SEQ ID NO: 1314582 - RNA, 22 nt, Homo sapiens
caacauuuacaacucauuccag

SEQ ID NO: 1314583 - RNA, 18 nt, Homo sapiens
caaccaagucaugugcau

SEQ ID NO: 1314584 - RNA, 15 nt, Homo sapiens
caaccacucauucaa

SEQ ID NO: 1314585 - RNA, 20 nt, Homo sapiens
caaccauaaaauugucauaa

SEQ ID NO: 1314586 - RNA, 23 nt, Homo sapiens
caacccgagucauucguucugug

SEQ ID NO: 1314587 - RNA, 15 nt, Homo sapiens
caacccuucauuuaa

SEQ ID NO: 1314588 - RNA, 12 nt, Homo sapiens
caaccucaguga

SEQ ID NO: 1314589 - RNA, 19 nt, Homo sapiens
caaccucugucucccgggu

SEQ ID NO: 1314590 - RNA, 14 nt, Homo sapiens
caacgaguacuuca

SEQ ID NO: 1314591 - RNA, 17 nt, Homo sapiens
caacuacgcugauuuga

SEQ ID NO: 1314592 - RNA, 17 nt, Homo sapiens
caacuauauuaucaugc

SEQ ID NO: 1314593 - RNA, 16 nt, Homo sapiens
caacuccucaugucuu

SEQ ID NO: 1314594 - RNA, 16 nt, Homo sapiens
caacucguauagcaug

SEQ ID NO: 1314595 - RNA, 21 nt, Homo sapiens
caacucuccccugaccuguga

SEQ ID NO: 1314596 - RNA, 22 nt, Homo sapiens
caacucuccccugaccugugag

SEQ ID NO: 1314597 - RNA, 19 nt, Homo sapiens
caacucuguacaaagcccu

SEQ ID NO: 1314598 - RNA, 12 nt, Homo sapiens
caacugaaggcu

SEQ ID NO: 1314599 - RNA, 18 nt, Homo sapiens
caacugaaggcuaaaaag

SEQ ID NO: 1314600 - RNA, 19 nt, Homo sapiens
caacuucgccagccuccaa

SEQ ID NO: 1314601 - RNA, 16 nt, Homo sapiens
caacuucuaaacacaa

SEQ ID NO: 1314602 - RNA, 20 nt, Homo sapiens
caacuuguauuaaagacaga

SEQ ID NO: 1314603 - RNA, 21 nt, Homo sapiens
caagaagucuugagaaaaaga

SEQ ID NO: 1314604 - RNA, 13 nt, Homo sapiens
caagaauuguuac

SEQ ID NO: 1314605 - RNA, 18 nt, Homo sapiens
caagaauuguuaccuguc

SEQ ID NO: 1314606 - RNA, 18 nt, Homo sapiens
caagacccccagcacuug

SEQ ID NO: 1314607 - RNA, 22 nt, Homo sapiens
caagaccucacacacacaaaaa

SEQ ID NO: 1314608 - RNA, 19 nt, Homo sapiens
caagacucugucucaaaaa

SEQ ID NO: 1314609 - RNA, 14 nt, Homo sapiens
caagagaccagccu

SEQ ID NO: 1314610 - RNA, 17 nt, Homo sapiens
caagagcguugucuacc

SEQ ID NO: 1314611 - RNA, 22 nt, Homo sapiens
uagaggggccccugauccucac

SEQ ID NO: 1314612 - RNA, 20 nt, Homo sapiens
uagagugugguuaugaacuu

SEQ ID NO: 1314613 - RNA, 18 nt, Homo sapiens
uagauguuuccuugccuu

SEQ ID NO: 1314614 - RNA, 16 nt, Homo sapiens
uagauuaccuagcuua

SEQ ID NO: 1314615 - RNA, 22 nt, Homo sapiens
uagauugagcuuagauugccuc

SEQ ID NO: 1314616 - RNA, 16 nt, Homo sapiens
uagauugccucucuag

SEQ ID NO: 1314617 - RNA, 21 nt, Homo sapiens
uagauuuaaccauggcacuga

SEQ ID NO: 1314618 - RNA, 13 nt, Homo sapiens
uagauuucaggga

SEQ ID NO: 1314619 - RNA, 17 nt, Homo sapiens
uagcaaacugaauccag

SEQ ID NO: 1314620 - RNA, 19 nt, Homo sapiens
caugucucacgucucccua

SEQ ID NO: 1314621 - RNA, 14 nt, Homo sapiens
caugugaagagaau

SEQ ID NO: 1314622 - RNA, 20 nt, Homo sapiens
caugugcacaagugugcaca

SEQ ID NO: 1314623 - RNA, 17 nt, Homo sapiens
caugugccagggcaaug

SEQ ID NO: 1314624 - RNA, 18 nt, Homo sapiens
caugugcgcgcgugcaug

SEQ ID NO: 1314625 - RNA, 21 nt, Homo sapiens
cauguguugcaccguucucug

SEQ ID NO: 1314626 - RNA, 21 nt, Homo sapiens
cauguugguuuauuuucacag

SEQ ID NO: 1314627 - RNA, 16 nt, Homo sapiens
cauguuguacauuuca

SEQ ID NO: 1314628 - RNA, 23 nt, Homo sapiens
cauguuuauaaaucuuaugcucu

SEQ ID NO: 1314629 - RNA, 19 nt, Homo sapiens
cauguuuuuaaagggcuau

SEQ ID NO: 1314630 - RNA, 18 nt, Homo sapiens
cauuaaauucacaaacuu

SEQ ID NO: 1314631 - RNA, 17 nt, Homo sapiens
cauuaagacaacuacag

SEQ ID NO: 1314632 - RNA, 16 nt, Homo sapiens
cauuaauauuugcuga

SEQ ID NO: 1314633 - RNA, 17 nt, Homo sapiens
cauuaccuucucccuca

SEQ ID NO: 1314634 - RNA, 12 nt, Homo sapiens
cauuacugcaua

SEQ ID NO: 1314635 - RNA, 23 nt, Homo sapiens
cauuagagcaggcguucagcuca

SEQ ID NO: 1314636 - RNA, 20 nt, Homo sapiens
cauuaguugcacuaacugcu

SEQ ID NO: 1314637 - RNA, 14 nt, Homo sapiens
cauuauaugcacua

SEQ ID NO: 1314638 - RNA, 23 nt, Homo sapiens
cauuauccauucccaagaugccu

SEQ ID NO: 1314639 - RNA, 17 nt, Homo sapiens
cauuauuuaauuacaga

SEQ ID NO: 1314640 - RNA, 14 nt, Homo sapiens
cauucaacugaaca

SEQ ID NO: 1314641 - RNA, 14 nt, Homo sapiens
cauucacagagccu

SEQ ID NO: 1314642 - RNA, 13 nt, Homo sapiens
cauucacaguucu

SEQ ID NO: 1314643 - RNA, 20 nt, Homo sapiens
cauucaggagcuuccugucc

SEQ ID NO: 1314644 - RNA, 14 nt, Homo sapiens
cauuccuguucuuu

SEQ ID NO: 1314645 - RNA, 17 nt, Homo sapiens
cauucgcgcucugcuca

SEQ ID NO: 1314646 - RNA, 14 nt, Homo sapiens
cauucuacugaaaa

SEQ ID NO: 1314647 - RNA, 19 nt, Homo sapiens
cauucuaggccuccuggcc

SEQ ID NO: 1314648 - RNA, 16 nt, Homo sapiens
cauucucaggcaccag

SEQ ID NO: 1314649 - RNA, 15 nt, Homo sapiens
cauucucgcuucccu

SEQ ID NO: 1314650 - RNA, 22 nt, Homo sapiens
cauucucuaauaagaaaaccac

SEQ ID NO: 1314651 - RNA, 12 nt, Homo sapiens
cauucucugucu

SEQ ID NO: 1314652 - RNA, 17 nt, Homo sapiens
cauucugccugcccagg

SEQ ID NO: 1314653 - RNA, 12 nt, Homo sapiens
cauucugucacc

SEQ ID NO: 1314654 - RNA, 17 nt, Homo sapiens
cauucuguuagauacua

SEQ ID NO: 1314655 - RNA, 18 nt, Homo sapiens
cauucuuaacaaacucuu

SEQ ID NO: 1314656 - RNA, 19 nt, Homo sapiens
cauugacucuguggcuuug

SEQ ID NO: 1314657 - RNA, 23 nt, Homo sapiens
cauugagaacugcauauguuucg

SEQ ID NO: 1314658 - RNA, 16 nt, Homo sapiens
cauugauggggaagga

SEQ ID NO: 1314659 - RNA, 22 nt, Homo sapiens
cauugauucaguauuacaaaua

SEQ ID NO: 1314660 - RNA, 11 nt, Homo sapiens
aaaacuacagg

SEQ ID NO: 1314661 - RNA, 17 nt, Homo sapiens
aaaacugaacuauguaa

SEQ ID NO: 1314662 - RNA, 16 nt, Homo sapiens
aaaacugcauuucacu

SEQ ID NO: 1314663 - RNA, 22 nt, Homo sapiens
aaaacuggcaacauuccaagaa

SEQ ID NO: 1314664 - RNA, 12 nt, Homo sapiens
aaaacuuccuag

SEQ ID NO: 1314665 - RNA, 14 nt, Homo sapiens
aaaacuugcugccu

SEQ ID NO: 1314666 - RNA, 15 nt, Homo sapiens
aaaagaaaccacuuc

SEQ ID NO: 1314667 - RNA, 12 nt, Homo sapiens
aaaagaacaugc

SEQ ID NO: 1314668 - RNA, 17 nt, Homo sapiens
aaaagacaagacuucag

SEQ ID NO: 1314669 - RNA, 13 nt, Homo sapiens
aaaagacagugaa

SEQ ID NO: 1314670 - RNA, 18 nt, Homo sapiens
aaaagauauaagugcugu

SEQ ID NO: 1314671 - RNA, 18 nt, Homo sapiens
aaaagcaaugcuuucuug

SEQ ID NO: 1314672 - RNA, 18 nt, Homo sapiens
aaaagcacacucaucccc

SEQ ID NO: 1314673 - RNA, 18 nt, Homo sapiens
aaaagcaguaacugacaa

SEQ ID NO: 1314674 - RNA, 20 nt, Homo sapiens
aaaaggacucucaggaccaa

SEQ ID NO: 1314675 - RNA, 20 nt, Homo sapiens
aaaaggcuaagcuucacugu

SEQ ID NO: 1314676 - RNA, 15 nt, Homo sapiens
aaaagguuuacagaa

SEQ ID NO: 1314677 - RNA, 15 nt, Homo sapiens
aaaagucaguaucau

SEQ ID NO: 1314678 - RNA, 14 nt, Homo sapiens
aaaagucucacaaa

SEQ ID NO: 1314679 - RNA, 14 nt, Homo sapiens
aaaauacugauaca

SEQ ID NO: 1314680 - RNA, 16 nt, Homo sapiens
aaaauagaauauagca

SEQ ID NO: 1314681 - RNA, 13 nt, Homo sapiens
aaaauagcaacac

SEQ ID NO: 1314682 - RNA, 14 nt, Homo sapiens
aaaaucaaguucua

SEQ ID NO: 1314683 - RNA, 12 nt, Homo sapiens
aaaaucagagag

SEQ ID NO: 1314684 - RNA, 21 nt, Homo sapiens
aaaaucauuuuauaugucaaa

SEQ ID NO: 1314685 - RNA, 16 nt, Homo sapiens
aaaauccuaacauuca

SEQ ID NO: 1314686 - RNA, 14 nt, Homo sapiens
aaaaucuguucuaa

SEQ ID NO: 1314687 - RNA, 16 nt, Homo sapiens
aaaaugagugcuuaaa

SEQ ID NO: 1314688 - RNA, 20 nt, Homo sapiens
aaaaugcaauguaagcauac

SEQ ID NO: 1314689 - RNA, 17 nt, Homo sapiens
aaaaugguuuguccuga

SEQ ID NO: 1314690 - RNA, 16 nt, Homo sapiens
aaaauguaaagccaug

SEQ ID NO: 1314691 - RNA, 21 nt, Homo sapiens
aaaauuagccgggcauggugg

SEQ ID NO: 1314692 - RNA, 14 nt, Homo sapiens
aaaauuaugccaua

SEQ ID NO: 1314693 - RNA, 13 nt, Homo sapiens
aaaauucccauuu

SEQ ID NO: 1314694 - RNA, 17 nt, Homo sapiens
aaaauuuaacuucuuca

SEQ ID NO: 1314695 - RNA, 16 nt, Homo sapiens
aaaauuucagcauuau

SEQ ID NO: 1314696 - RNA, 15 nt, Homo sapiens
aaaauuugcugccaa

SEQ ID NO: 1314697 - RNA, 17 nt, Homo sapiens
aaacaaaacaccaggga

SEQ ID NO: 1314698 - RNA, 14 nt, Homo sapiens
aaacaaaagcucau

SEQ ID NO: 1314699 - RNA, 17 nt, Homo sapiens
aaacaaaauuugacuaa

SEQ ID NO: 1314700 - RNA, 13 nt, Homo sapiens
aaacaaauaugca

SEQ ID NO: 1314701 - RNA, 14 nt, Homo sapiens
aaacaaauaugcaa

SEQ ID NO: 1314702 - RNA, 17 nt, Homo sapiens
aaacaaauguauuucaa

SEQ ID NO: 1314703 - RNA, 13 nt, Homo sapiens
aaauggcacugca

SEQ ID NO: 1314704 - RNA, 14 nt, Homo sapiens
aaauggcuuaucca

SEQ ID NO: 1314705 - RNA, 20 nt, Homo sapiens
aaaugggcuacuuuguccuu

SEQ ID NO: 1314706 - RNA, 18 nt, Homo sapiens
aaaugguaggcauuuccu

SEQ ID NO: 1314707 - RNA, 21 nt, Homo sapiens
aaaugguuuuuaaacaaccaa

SEQ ID NO: 1314708 - RNA, 14 nt, Homo sapiens
aaauguaaagccau

SEQ ID NO: 1314709 - RNA, 15 nt, Homo sapiens
aaauguaacugugcc

SEQ ID NO: 1314710 - RNA, 15 nt, Homo sapiens
aaauguaauagccaa

SEQ ID NO: 1314711 - RNA, 16 nt, Homo sapiens
aaauguacagacauau

SEQ ID NO: 1314712 - RNA, 17 nt, Homo sapiens
aaauguacagacauauu

SEQ ID NO: 1314713 - RNA, 15 nt, Homo sapiens
aaauguuaacacuca

SEQ ID NO: 1314714 - RNA, 15 nt, Homo sapiens
aaauguuaacuacau

SEQ ID NO: 1314715 - RNA, 18 nt, Homo sapiens
aaauguugagaaucccaa

SEQ ID NO: 1314716 - RNA, 15 nt, Homo sapiens
aaauuaagaaggcaa

SEQ ID NO: 1314717 - RNA, 19 nt, Homo sapiens
aaauuauauuugugcuaua

SEQ ID NO: 1314718 - RNA, 13 nt, Homo sapiens
aaauucacuuuca

SEQ ID NO: 1314719 - RNA, 20 nt, Homo sapiens
aaauucaucaaauggaagac

SEQ ID NO: 1314720 - RNA, 23 nt, Homo sapiens
aaauucgcugcaaccuguugaua

SEQ ID NO: 1314721 - RNA, 19 nt, Homo sapiens
aaauugaaaggcauucucu

SEQ ID NO: 1314722 - RNA, 14 nt, Homo sapiens
aaauugagugguuu

SEQ ID NO: 1314723 - RNA, 21 nt, Homo sapiens
aaauugcugcaccaaugcacu

SEQ ID NO: 1314724 - RNA, 18 nt, Homo sapiens
aaauuggaagcugucaua

SEQ ID NO: 1314725 - RNA, 13 nt, Homo sapiens
aaauuggucccaa

SEQ ID NO: 1314726 - RNA, 21 nt, Homo sapiens
aaauuguacauaaguaccuca

SEQ ID NO: 1314727 - RNA, 20 nt, Homo sapiens
aaauuguaucaaaugugaca

SEQ ID NO: 1314728 - RNA, 21 nt, Homo sapiens
aaauuuauuuccuaguucugu

SEQ ID NO: 1314729 - RNA, 22 nt, Homo sapiens
aaauuuggguauagacaauaaa

SEQ ID NO: 1314730 - RNA, 10 nt, Homo sapiens
aacaaaaagu

SEQ ID NO: 1314731 - RNA, 16 nt, Homo sapiens
aacaaaagcucaucca

SEQ ID NO: 1314732 - RNA, 12 nt, Homo sapiens
aacaaagccaga

SEQ ID NO: 1314733 - RNA, 19 nt, Homo sapiens
aacaaagggcacagcaucu

SEQ ID NO: 1314734 - RNA, 22 nt, Homo sapiens
aacaaagggcacagcaucugua

SEQ ID NO: 1314735 - RNA, 18 nt, Homo sapiens
aacaaaguaacagccuuu

SEQ ID NO: 1314736 - RNA, 14 nt, Homo sapiens
aacaaauacauuca

SEQ ID NO: 1314737 - RNA, 19 nt, Homo sapiens
aacaaauauauauauguau

SEQ ID NO: 1314738 - RNA, 12 nt, Homo sapiens
aacaaauaugca

SEQ ID NO: 1314739 - RNA, 15 nt, Homo sapiens
aacaaauguauuuca

SEQ ID NO: 1314740 - RNA, 19 nt, Homo sapiens
aacaacaccagaacugugu

SEQ ID NO: 1314741 - RNA, 16 nt, Homo sapiens
aacaagcaaacccaga

SEQ ID NO: 1314742 - RNA, 18 nt, Homo sapiens
aacaccacgucacuucau

SEQ ID NO: 1314743 - RNA, 10 nt, Homo sapiens
aacaccagaa

SEQ ID NO: 1314744 - RNA, 13 nt, Homo sapiens
aacacccaugccc

SEQ ID NO: 1314745 - RNA, 13 nt, Homo sapiens
aacaccucugcac

SEQ ID NO: 1314746 - RNA, 23 nt, Homo sapiens
aacacucacauuuauucugcuca

SEQ ID NO: 1314747 - RNA, 19 nt, Homo sapiens
aacacugcaggcaucacag

SEQ ID NO: 1314748 - RNA, 21 nt, Homo sapiens
aacacugcugcuccagugcag

SEQ ID NO: 1314749 - RNA, 14 nt, Homo sapiens
aacacugucccaag

SEQ ID NO: 1314750 - RNA, 23 nt, Homo sapiens
aacacuuuacaauguucauccca

SEQ ID NO: 1314751 - RNA, 16 nt, Homo sapiens
aacagaaaaauaugua

SEQ ID NO: 1314752 - RNA, 14 nt, Homo sapiens
aacagaagcuucca

SEQ ID NO: 1314753 - RNA, 16 nt, Homo sapiens
aacagaagcuuccauu

SEQ ID NO: 1314754 - RNA, 19 nt, Homo sapiens
aacagaggaguacagguga

SEQ ID NO: 1314755 - RNA, 20 nt, Homo sapiens
aacagauaucuucaguuuaa

SEQ ID NO: 1314756 - RNA, 13 nt, Homo sapiens
aacagaucuggaa

SEQ ID NO: 1314757 - RNA, 14 nt, Homo sapiens
aacagaugccccag

SEQ ID NO: 1314758 - RNA, 14 nt, Homo sapiens
aacagauuugagaa

SEQ ID NO: 1314759 - RNA, 22 nt, Homo sapiens
aacagcauuacccuccucucuc

SEQ ID NO: 1314760 - RNA, 16 nt, Homo sapiens
aacagccuacagccag

SEQ ID NO: 1314761 - RNA, 15 nt, Homo sapiens
aacaggaaucucaga

SEQ ID NO: 1314762 - RNA, 14 nt, Homo sapiens
aacaggccauugug

SEQ ID NO: 1314763 - RNA, 15 nt, Homo sapiens
aacaguaacugccau

SEQ ID NO: 1314764 - RNA, 16 nt, Homo sapiens
aacaguaacugccauc

SEQ ID NO: 1314765 - RNA, 12 nt, Homo sapiens
aacauacuucua

SEQ ID NO: 1314766 - RNA, 23 nt, Homo sapiens
aacauacuucuaaaauucccauu

SEQ ID NO: 1314767 - RNA, 14 nt, Homo sapiens
aacauagcagaccu

SEQ ID NO: 1314768 - RNA, 20 nt, Homo sapiens
aacaucaucaaggcacugcc

SEQ ID NO: 1314769 - RNA, 13 nt, Homo sapiens
aacaucgucuaaa

SEQ ID NO: 1314770 - RNA, 17 nt, Homo sapiens
aacaugaagccaggugu

SEQ ID NO: 1314771 - RNA, 22 nt, Homo sapiens
aacaugauguuuuaagcugcua

SEQ ID NO: 1314772 - RNA, 21 nt, Homo sapiens
aacaugguggaaaacgaagcu

SEQ ID NO: 1314773 - RNA, 11 nt, Homo sapiens
aacauguaauu

SEQ ID NO: 1314774 - RNA, 13 nt, Homo sapiens
aacauguaugugc

SEQ ID NO: 1314775 - RNA, 17 nt, Homo sapiens
aacauguccuaauucuu

SEQ ID NO: 1314776 - RNA, 19 nt, Homo sapiens
aacauguuguacauuucac

SEQ ID NO: 1314777 - RNA, 21 nt, Homo sapiens
aacauuccucagaaaccaaag

SEQ ID NO: 1314778 - RNA, 15 nt, Homo sapiens
aacauugugauguau

SEQ ID NO: 1314779 - RNA, 23 nt, Homo sapiens
aacauuguuuuguguaacauauu

SEQ ID NO: 1314780 - RNA, 14 nt, Homo sapiens
aacauuuacaacuc

SEQ ID NO: 1314781 - RNA, 22 nt, Homo sapiens
aacauuuauuuugagaagcucu

SEQ ID NO: 1314782 - RNA, 19 nt, Homo sapiens
aacauuuugagaacaaaga

SEQ ID NO: 1314783 - RNA, 16 nt, Homo sapiens
aaccaaaauacuccaa

SEQ ID NO: 1314784 - RNA, 19 nt, Homo sapiens
aaccaaaaugauacuuacu

SEQ ID NO: 1314785 - RNA, 18 nt, Homo sapiens
aaccaaaggugaaggaau

SEQ ID NO: 1314786 - RNA, 11 nt, Homo sapiens
aaccaaugcaa

SEQ ID NO: 1314787 - RNA, 16 nt, Homo sapiens
aaccagcuucaugugg

SEQ ID NO: 1314788 - RNA, 19 nt, Homo sapiens
aaccaguauuuuugcugcu

SEQ ID NO: 1314789 - RNA, 23 nt, Homo sapiens
aaccaguauuuuugcugcuucug

SEQ ID NO: 1314790 - RNA, 20 nt, Homo sapiens
aaccaguccccccacccuca

SEQ ID NO: 1314791 - RNA, 18 nt, Homo sapiens
aaccauaugaacauauau

SEQ ID NO: 1314792 - RNA, 16 nt, Homo sapiens
aaccaucaucuugcca

SEQ ID NO: 1314793 - RNA, 16 nt, Homo sapiens
aaccauccagugacaa

SEQ ID NO: 1314794 - RNA, 21 nt, Homo sapiens
aaccauuuguaaaacauucca

SEQ ID NO: 1314795 - RNA, 14 nt, Homo sapiens
aacccagucacugu

SEQ ID NO: 1314796 - RNA, 22 nt, Homo sapiens
aacccagucacugugagcuccc

SEQ ID NO: 1314797 - RNA, 22 nt, Homo sapiens
auagguagaaacaaauacuuga

SEQ ID NO: 1314798 - RNA, 15 nt, Homo sapiens
auaggugugugagac

SEQ ID NO: 1314799 - RNA, 15 nt, Homo sapiens
auaguacugcacuua

SEQ ID NO: 1314800 - RNA, 13 nt, Homo sapiens
auaguacuggcau

SEQ ID NO: 1314801 - RNA, 21 nt, Homo sapiens
auaguauaaaaauguuaggau

SEQ ID NO: 1314802 - RNA, 20 nt, Homo sapiens
auaguauucaugacuaugga

SEQ ID NO: 1314803 - RNA, 14 nt, Homo sapiens
auagucauaccugg

SEQ ID NO: 1314804 - RNA, 18 nt, Homo sapiens
auagucuuugccagucau

SEQ ID NO: 1314805 - RNA, 16 nt, Homo sapiens
auaguguuaacuguca

SEQ ID NO: 1314806 - RNA, 21 nt, Homo sapiens
auaguuguuuuauauguugcu

SEQ ID NO: 1314807 - RNA, 15 nt, Homo sapiens
auauaaagcacagau

SEQ ID NO: 1314808 - RNA, 19 nt, Homo sapiens
auauaacauucuauugacu

SEQ ID NO: 1314809 - RNA, 11 nt, Homo sapiens
auauaauacug

SEQ ID NO: 1314810 - RNA, 13 nt, Homo sapiens
auauaauacugua

SEQ ID NO: 1314811 - RNA, 14 nt, Homo sapiens
auauaauggauaau

SEQ ID NO: 1314812 - RNA, 22 nt, Homo sapiens
auauacugcuugucaucugcau

SEQ ID NO: 1314813 - RNA, 13 nt, Homo sapiens
auauauacauaua

SEQ ID NO: 1314814 - RNA, 15 nt, Homo sapiens
auauauauaauuuaa

SEQ ID NO: 1314815 - RNA, 19 nt, Homo sapiens
auauauauuuuugugcaca

SEQ ID NO: 1314816 - RNA, 20 nt, Homo sapiens
auauauauuuuugugcacau

SEQ ID NO: 1314817 - RNA, 22 nt, Homo sapiens
auauauggaaauauuaacaaug

SEQ ID NO: 1314818 - RNA, 19 nt, Homo sapiens
auauaugugaggauguauc

SEQ ID NO: 1314819 - RNA, 20 nt, Homo sapiens
auauauguguuuuucacauu

SEQ ID NO: 1314820 - RNA, 14 nt, Homo sapiens
auauauuaagugac

SEQ ID NO: 1314821 - RNA, 15 nt, Homo sapiens
auaucacaucagugg

SEQ ID NO: 1314822 - RNA, 18 nt, Homo sapiens
auaucaguccucuuucaa

SEQ ID NO: 1314823 - RNA, 23 nt, Homo sapiens
auaucaugccccuguacuccagc

SEQ ID NO: 1314824 - RNA, 19 nt, Homo sapiens
auaucauuguugguguuaa

SEQ ID NO: 1314825 - RNA, 15 nt, Homo sapiens
auaucuaaguucaca

SEQ ID NO: 1314826 - RNA, 11 nt, Homo sapiens
auaucuuggcc

SEQ ID NO: 1314827 - RNA, 19 nt, Homo sapiens
auaugaaucugcucacuuu

SEQ ID NO: 1314828 - RNA, 17 nt, Homo sapiens
auauggcuugaguuuaa

SEQ ID NO: 1314829 - RNA, 21 nt, Homo sapiens
auaugguaaauaaaacgugac

SEQ ID NO: 1314830 - RNA, 21 nt, Homo sapiens
auauguagccuucacacagau

SEQ ID NO: 1314831 - RNA, 15 nt, Homo sapiens
auauguauaggagcu

SEQ ID NO: 1314832 - RNA, 22 nt, Homo sapiens
auauguaucuaaaccauaugaa

SEQ ID NO: 1314833 - RNA, 19 nt, Homo sapiens
auaugugauuuacauuuca

SEQ ID NO: 1314834 - RNA, 22 nt, Homo sapiens
auauguugcaaaauauaucacu

SEQ ID NO: 1314835 - RNA, 17 nt, Homo sapiens
auauucugcaacacugu

SEQ ID NO: 1314836 - RNA, 15 nt, Homo sapiens
auauugucagucuuu

SEQ ID NO: 1314837 - RNA, 22 nt, Homo sapiens
auauuuaacuggugcacuuugu

SEQ ID NO: 1314838 - RNA, 17 nt, Homo sapiens
auauuuaagcaacaucu

SEQ ID NO: 1314839 - RNA, 21 nt, Homo sapiens
auauuuaauguggaaugucaa

SEQ ID NO: 1314840 - RNA, 23 nt, Homo sapiens
auauuuauucauuauuugucaaa

SEQ ID NO: 1314841 - RNA, 14 nt, Homo sapiens
auauuuuaucucaa

SEQ ID NO: 1314842 - RNA, 15 nt, Homo sapiens
auauuuucaccauuu

SEQ ID NO: 1314843 - RNA, 12 nt, Homo sapiens
auauuuuccaua

SEQ ID NO: 1314844 - RNA, 18 nt, Homo sapiens
auauuuuuagauaguuag

SEQ ID NO: 1314845 - RNA, 15 nt, Homo sapiens
aucaaaccacuguua

SEQ ID NO: 1314846 - RNA, 16 nt, Homo sapiens
aucaaagccacacucu

SEQ ID NO: 1314847 - RNA, 14 nt, Homo sapiens
aucaaauaagcuaa

SEQ ID NO: 1314848 - RNA, 22 nt, Homo sapiens
aucaaauggaagacacauugaa

SEQ ID NO: 1314849 - RNA, 13 nt, Homo sapiens
aucaagaagggcu

SEQ ID NO: 1314850 - RNA, 18 nt, Homo sapiens
aucaagaagggcugcaug

SEQ ID NO: 1314851 - RNA, 22 nt, Homo sapiens
aucaaucauuaaggucauuacu

SEQ ID NO: 1314852 - RNA, 17 nt, Homo sapiens
aucacaagaaaacuaua

SEQ ID NO: 1314853 - RNA, 17 nt, Homo sapiens
aucacaccugcccuaaa

SEQ ID NO: 1314854 - RNA, 12 nt, Homo sapiens
aucacacuguaa

SEQ ID NO: 1314855 - RNA, 21 nt, Homo sapiens
aucacagcaaugcucuauucc

SEQ ID NO: 1314856 - RNA, 17 nt, Homo sapiens
aucacauauucuagugu

SEQ ID NO: 1314857 - RNA, 19 nt, Homo sapiens
aucaccucucuguaucccc

SEQ ID NO: 1314858 - RNA, 12 nt, Homo sapiens
aucacgaccacu

SEQ ID NO: 1314859 - RNA, 17 nt, Homo sapiens
aucacucucaccuucca

SEQ ID NO: 1314860 - RNA, 16 nt, Homo sapiens
aucagaacuguuggca

SEQ ID NO: 1314861 - RNA, 22 nt, Homo sapiens
aucagaaguguuaagugacaug

SEQ ID NO: 1314862 - RNA, 18 nt, Homo sapiens
aucagacuccugugcaac

SEQ ID NO: 1314863 - RNA, 18 nt, Homo sapiens
aucagcgccgcaccagcc

SEQ ID NO: 1314864 - RNA, 16 nt, Homo sapiens
aucagcuaaacaccac

SEQ ID NO: 1314865 - RNA, 18 nt, Homo sapiens
aucaggaccuccaagcca

SEQ ID NO: 1314866 - RNA, 22 nt, Homo sapiens
aucaggucauacuaucuacucu

SEQ ID NO: 1314867 - RNA, 14 nt, Homo sapiens
aucaguauugugaa

SEQ ID NO: 1314868 - RNA, 20 nt, Homo sapiens
aucagugaagccaaagggac

SEQ ID NO: 1314869 - RNA, 20 nt, Homo sapiens
aucagugcuccuguaaguca

SEQ ID NO: 1314870 - RNA, 21 nt, Homo sapiens
aucaguuagagcugacacaaa

SEQ ID NO: 1314871 - RNA, 19 nt, Homo sapiens
aucauaauuaauguaguag

SEQ ID NO: 1314872 - RNA, 13 nt, Homo sapiens
aucauagcaauau

SEQ ID NO: 1314873 - RNA, 14 nt, Homo sapiens
aucaucaaaugcau

SEQ ID NO: 1314874 - RNA, 16 nt, Homo sapiens
aucaucaucauucuca

SEQ ID NO: 1314875 - RNA, 18 nt, Homo sapiens
aucaugcccugugcaacc

SEQ ID NO: 1314876 - RNA, 21 nt, Homo sapiens
aucaugucccccuuauguuga

SEQ ID NO: 1314877 - RNA, 23 nt, Homo sapiens
aucauuaaggucauuacucucaa

SEQ ID NO: 1314878 - RNA, 14 nt, Homo sapiens
aucauuccuugaga

SEQ ID NO: 1314879 - RNA, 21 nt, Homo sapiens
aucauuuaauaauauacuugu

SEQ ID NO: 1314880 - RNA, 21 nt, Homo sapiens
aucauuucaaaacucauuucc

SEQ ID NO: 1314881 - RNA, 22 nt, Homo sapiens
aucauuucuauuucuccuccau

SEQ ID NO: 1314882 - RNA, 21 nt, Homo sapiens
aucauuuguuuacauuugaug

SEQ ID NO: 1314883 - RNA, 13 nt, Homo sapiens
auccaauaccucu

SEQ ID NO: 1314884 - RNA, 14 nt, Homo sapiens
auccaauaccucuu

SEQ ID NO: 1314885 - RNA, 15 nt, Homo sapiens
auccaaugcucaaga

SEQ ID NO: 1314886 - RNA, 18 nt, Homo sapiens
auccaauggguuuuuccc

SEQ ID NO: 1314887 - RNA, 16 nt, Homo sapiens
auccacccaccucagc

SEQ ID NO: 1314888 - RNA, 13 nt, Homo sapiens
auccacugugcca

SEQ ID NO: 1314889 - RNA, 15 nt, Homo sapiens
auccacuucuuucag

SEQ ID NO: 1314890 - RNA, 15 nt, Homo sapiens
auccagcccaugccg

SEQ ID NO: 1314891 - RNA, 19 nt, Homo sapiens
auccagccucccacaagaa

SEQ ID NO: 1314892 - RNA, 15 nt, Homo sapiens
auccagcucaucccc

SEQ ID NO: 1314893 - RNA, 23 nt, Homo sapiens
auccagggacugaagccaaaguu

SEQ ID NO: 1314894 - RNA, 14 nt, Homo sapiens
auccauaaagacaa

SEQ ID NO: 1314895 - RNA, 23 nt, Homo sapiens
auccauaaagacaaucacugcca

SEQ ID NO: 1314896 - RNA, 23 nt, Homo sapiens
auccauaaugauggauuuaacag

SEQ ID NO: 1314897 - RNA, 13 nt, Homo sapiens
aucccacuguaug

SEQ ID NO: 1314898 - RNA, 15 nt, Homo sapiens
aucccagcuacucga

SEQ ID NO: 1314899 - RNA, 14 nt, Homo sapiens
aucccaguacucug

SEQ ID NO: 1314900 - RNA, 18 nt, Homo sapiens
aucccauggguuaucugu

SEQ ID NO: 1314901 - RNA, 17 nt, Homo sapiens
aucccauucugcgucau

SEQ ID NO: 1314902 - RNA, 23 nt, Homo sapiens
auccccccgccaaaagcugcuca

SEQ ID NO: 1314903 - RNA, 20 nt, Homo sapiens
auccccgcagugugcacuaa

SEQ ID NO: 1314904 - RNA, 19 nt, Homo sapiens
agugcagcuugaauuucaa

SEQ ID NO: 1314905 - RNA, 18 nt, Homo sapiens
agugcaggagagacagug

SEQ ID NO: 1314906 - RNA, 16 nt, Homo sapiens
agugcauuugugcuag

SEQ ID NO: 1314907 - RNA, 13 nt, Homo sapiens
agugccaucucaa

SEQ ID NO: 1314908 - RNA, 17 nt, Homo sapiens
agugcccaacuguuaua

SEQ ID NO: 1314909 - RNA, 20 nt, Homo sapiens
agugccuggccaaagggaua

SEQ ID NO: 1314910 - RNA, 21 nt, Homo sapiens
agugcuguauaaaaucagcca

SEQ ID NO: 1314911 - RNA, 17 nt, Homo sapiens
agugcuuguuccucuca

SEQ ID NO: 1314912 - RNA, 19 nt, Homo sapiens
aguggacucagaaagccaa

SEQ ID NO: 1314913 - RNA, 12 nt, Homo sapiens
aguggagccaug

SEQ ID NO: 1314914 - RNA, 15 nt, Homo sapiens
aguggcagugucauu

SEQ ID NO: 1314915 - RNA, 14 nt, Homo sapiens
aguggcucuguaag

SEQ ID NO: 1314916 - RNA, 23 nt, Homo sapiens
aguggcugcacaggcacugugca

SEQ ID NO: 1314917 - RNA, 19 nt, Homo sapiens
aguggggagacuucuuggc

SEQ ID NO: 1314918 - RNA, 22 nt, Homo sapiens
aguggguaaaauuagaugcaug

SEQ ID NO: 1314919 - RNA, 13 nt, Homo sapiens
agugggugaauaa

SEQ ID NO: 1314920 - RNA, 21 nt, Homo sapiens
agugguggcaggacaagagaa

SEQ ID NO: 1314921 - RNA, 15 nt, Homo sapiens
agugguggucuucaa

SEQ ID NO: 1314922 - RNA, 16 nt, Homo sapiens
agugguggucuucaag

SEQ ID NO: 1314923 - RNA, 13 nt, Homo sapiens
agugguuacccag

SEQ ID NO: 1314924 - RNA, 15 nt, Homo sapiens
aguguaaacaccaua

SEQ ID NO: 1314925 - RNA, 15 nt, Homo sapiens
aguguaccauuugcc

SEQ ID NO: 1314926 - RNA, 19 nt, Homo sapiens
aguguauagaaaaaccaaa

SEQ ID NO: 1314927 - RNA, 17 nt, Homo sapiens
aguguaugacugcacau

SEQ ID NO: 1314928 - RNA, 18 nt, Homo sapiens
aguguaugacugcacaug

SEQ ID NO: 1314929 - RNA, 20 nt, Homo sapiens
agugucaggaggaaggcuua

SEQ ID NO: 1314930 - RNA, 23 nt, Homo sapiens
agugugaaacagcugcccugugu

SEQ ID NO: 1314931 - RNA, 18 nt, Homo sapiens
aguguucacaacagugaa

SEQ ID NO: 1314932 - RNA, 16 nt, Homo sapiens
aguguuccccuuccac

SEQ ID NO: 1314933 - RNA, 21 nt, Homo sapiens
aguguugaugcuuucgucucc

SEQ ID NO: 1314934 - RNA, 21 nt, Homo sapiens
aguuaaaagccuaccuaagca

SEQ ID NO: 1314935 - RNA, 22 nt, Homo sapiens
aguuaaaagccuaccuaagcau

SEQ ID NO: 1314936 - RNA, 12 nt, Homo sapiens
aguuaaggguua

SEQ ID NO: 1314937 - RNA, 12 nt, Homo sapiens
aguuaauuugca

SEQ ID NO: 1314938 - RNA, 23 nt, Homo sapiens
aguuacccugcauguuggcccag

SEQ ID NO: 1314939 - RNA, 16 nt, Homo sapiens
aguuagagcugacaca

SEQ ID NO: 1314940 - RNA, 13 nt, Homo sapiens
aguuagccaaaca

SEQ ID NO: 1314941 - RNA, 15 nt, Homo sapiens
aguuauaauucugug

SEQ ID NO: 1314942 - RNA, 18 nt, Homo sapiens
aguuaugcaagggacugu

SEQ ID NO: 1314943 - RNA, 12 nt, Homo sapiens
aguucaagagaa

SEQ ID NO: 1314944 - RNA, 17 nt, Homo sapiens
aguucaaggaacuugaa

SEQ ID NO: 1314945 - RNA, 14 nt, Homo sapiens
aguucaagugcucu

SEQ ID NO: 1314946 - RNA, 17 nt, Homo sapiens
aguucaagugcucuuca

SEQ ID NO: 1314947 - RNA, 18 nt, Homo sapiens
aguucaagugcucuucag

SEQ ID NO: 1314948 - RNA, 21 nt, Homo sapiens
aguucacaucagaacagacaa

SEQ ID NO: 1314949 - RNA, 17 nt, Homo sapiens
aguucaccagacucuau

SEQ ID NO: 1314950 - RNA, 19 nt, Homo sapiens
aguucacggcaaaauguca

SEQ ID NO: 1314951 - RNA, 17 nt, Homo sapiens
aguucauccgcacugua

SEQ ID NO: 1314952 - RNA, 12 nt, Homo sapiens
aguucauugugg

SEQ ID NO: 1314953 - RNA, 21 nt, Homo sapiens
aguuccucauuagcauuuugc

SEQ ID NO: 1314954 - RNA, 13 nt, Homo sapiens
aguucugccuuau

SEQ ID NO: 1314955 - RNA, 17 nt, Homo sapiens
aguugaaauucuauucu

SEQ ID NO: 1314956 - RNA, 20 nt, Homo sapiens
aguugaagcugacucaaaaa

SEQ ID NO: 1314957 - RNA, 17 nt, Homo sapiens
aguugagaacuggucag

SEQ ID NO: 1314958 - RNA, 21 nt, Homo sapiens
aguugaucuggaacccagacu

SEQ ID NO: 1314959 - RNA, 14 nt, Homo sapiens
aguugauucagcuc

SEQ ID NO: 1314960 - RNA, 13 nt, Homo sapiens
aguuguauguggc

SEQ ID NO: 1314961 - RNA, 16 nt, Homo sapiens
aguugucuuuugccau

SEQ ID NO: 1314962 - RNA, 23 nt, Homo sapiens
aguuuaacauuagcuaaaacugc

SEQ ID NO: 1314963 - RNA, 16 nt, Homo sapiens
aguuuaaccugaugca

SEQ ID NO: 1314964 - RNA, 15 nt, Homo sapiens
aguuuauaugcuucu

SEQ ID NO: 1314965 - RNA, 20 nt, Homo sapiens
aguuucagagaccauugcaa

SEQ ID NO: 1314966 - RNA, 22 nt, Homo sapiens
aguuuccaauuauuugacuuua

SEQ ID NO: 1314967 - RNA, 23 nt, Homo sapiens
aguuugcuuuuugcguacacaga

SEQ ID NO: 1314968 - RNA, 23 nt, Homo sapiens
aguuuuccuucucaucugugauu

SEQ ID NO: 1314969 - RNA, 21 nt, Homo sapiens
aguuuuuaauuuaucagagac

SEQ ID NO: 1314970 - RNA, 12 nt, Homo sapiens
auaaaaaacauc

SEQ ID NO: 1314971 - RNA, 15 nt, Homo sapiens
auaaaaaugagugcu

SEQ ID NO: 1314972 - RNA, 17 nt, Homo sapiens
auaaaaauguuaggaua

SEQ ID NO: 1314973 - RNA, 16 nt, Homo sapiens
auaaaagacuauucua

SEQ ID NO: 1314974 - RNA, 15 nt, Homo sapiens
auaaaaucagaguug

SEQ ID NO: 1314975 - RNA, 15 nt, Homo sapiens
auaaaauuaugccau

SEQ ID NO: 1314976 - RNA, 16 nt, Homo sapiens
auaaaauuaugccaua

SEQ ID NO: 1314977 - RNA, 13 nt, Homo sapiens
auaaaauuuaacu

SEQ ID NO: 1314978 - RNA, 20 nt, Homo sapiens
auaaacaaaguuacuaggua

SEQ ID NO: 1314979 - RNA, 17 nt, Homo sapiens
auaaacguccuacugua

SEQ ID NO: 1314980 - RNA, 16 nt, Homo sapiens
auaaacuuuccucuuc

SEQ ID NO: 1314981 - RNA, 13 nt, Homo sapiens
auaaagauuuaua

SEQ ID NO: 1314982 - RNA, 12 nt, Homo sapiens
auaaagcacaga

SEQ ID NO: 1314983 - RNA, 19 nt, Homo sapiens
auaaagcuguucucauucc

SEQ ID NO: 1314984 - RNA, 14 nt, Homo sapiens
auaaaggaugugau

SEQ ID NO: 1314985 - RNA, 13 nt, Homo sapiens
auaaagugacaga

SEQ ID NO: 1314986 - RNA, 15 nt, Homo sapiens
auaaaugaguucaac

SEQ ID NO: 1314987 - RNA, 16 nt, Homo sapiens
auaaauuggagaugca

SEQ ID NO: 1314988 - RNA, 19 nt, Homo sapiens
auaacacuggcuucaggca

SEQ ID NO: 1314989 - RNA, 13 nt, Homo sapiens
auaacagaaugau

SEQ ID NO: 1314990 - RNA, 11 nt, Homo sapiens
auaaccacugc

SEQ ID NO: 1314991 - RNA, 22 nt, Homo sapiens
auaaccuccagccuccugccca

SEQ ID NO: 1314992 - RNA, 18 nt, Homo sapiens
auaacuaguguugcuugg

SEQ ID NO: 1314993 - RNA, 20 nt, Homo sapiens
auaacuuuguuuagcccaaa

SEQ ID NO: 1314994 - RNA, 13 nt, Homo sapiens
auaagauuccaaa

SEQ ID NO: 1314995 - RNA, 14 nt, Homo sapiens
auaagauuccaaaa

SEQ ID NO: 1314996 - RNA, 21 nt, Homo sapiens
auaagggaggaauauagaaug

SEQ ID NO: 1314997 - RNA, 20 nt, Homo sapiens
auaaguuauuuuuguacaug

SEQ ID NO: 1314998 - RNA, 17 nt, Homo sapiens
auaauagagcucagaca

SEQ ID NO: 1314999 - RNA, 22 nt, Homo sapiens
auaauauauuuucaaggauguu

SEQ ID NO: 1315000 - RNA, 22 nt, Homo sapiens
auaauaugaugcaaacugugcu

SEQ ID NO: 1315001 - RNA, 13 nt, Homo sapiens
auaaugaaugaga

SEQ ID NO: 1315002 - RNA, 19 nt, Homo sapiens
auaaugacucuuaggacau

SEQ ID NO: 1315003 - RNA, 14 nt, Homo sapiens
auaaugcaguaugg

SEQ ID NO: 1315004 - RNA, 11 nt, Homo sapiens
auaaugcucac

SEQ ID NO: 1315005 - RNA, 15 nt, Homo sapiens
auaaugcucacuugg

SEQ ID NO: 1315006 - RNA, 18 nt, Homo sapiens
auaaugguugacuggguu

SEQ ID NO: 1315007 - RNA, 19 nt, Homo sapiens
auaaugguugacuggguuu

SEQ ID NO: 1315008 - RNA, 18 nt, Homo sapiens
auacaaaggcuugcuaag

SEQ ID NO: 1315009 - RNA, 17 nt, Homo sapiens
auacaaguauccaguca

SEQ ID NO: 1315010 - RNA, 21 nt, Homo sapiens
auacaccuacugguuaaauaa

SEQ ID NO: 1315011 - RNA, 20 nt, Homo sapiens
auccccggggcggcaggaag

SEQ ID NO: 1315012 - RNA, 22 nt, Homo sapiens
auccccuaagcagaccacugau

SEQ ID NO: 1315013 - RNA, 19 nt, Homo sapiens
auccgauuccccuguagca

SEQ ID NO: 1315014 - RNA, 15 nt, Homo sapiens
auccgggaucaaagu

SEQ ID NO: 1315015 - RNA, 13 nt, Homo sapiens
auccguggcugca

SEQ ID NO: 1315016 - RNA, 20 nt, Homo sapiens
auccuaaagaaggugauaaa

SEQ ID NO: 1315017 - RNA, 13 nt, Homo sapiens
auccuaccuugcu

SEQ ID NO: 1315018 - RNA, 14 nt, Homo sapiens
auccuaugugauuu

SEQ ID NO: 1315019 - RNA, 13 nt, Homo sapiens
auccucacugcug

SEQ ID NO: 1315020 - RNA, 20 nt, Homo sapiens
auccucccaccucagcuucu

SEQ ID NO: 1315021 - RNA, 23 nt, Homo sapiens
auccucuguaaaaagaucccuga

SEQ ID NO: 1315022 - RNA, 21 nt, Homo sapiens
auccuggcucuuuggagauca

SEQ ID NO: 1315023 - RNA, 22 nt, Homo sapiens
auccugguuucauaacuuccug

SEQ ID NO: 1315024 - RNA, 18 nt, Homo sapiens
auccuguuuuuaaaccau

SEQ ID NO: 1315025 - RNA, 15 nt, Homo sapiens
auccuuaaaggugag

SEQ ID NO: 1315026 - RNA, 13 nt, Homo sapiens
auccuucuacuug

SEQ ID NO: 1315027 - RNA, 15 nt, Homo sapiens
auccuucuacuuguc

SEQ ID NO: 1315028 - RNA, 14 nt, Homo sapiens
auccuugcaggugg

SEQ ID NO: 1315029 - RNA, 19 nt, Homo sapiens
auccuuuuaaaucuugaua

SEQ ID NO: 1315030 - RNA, 16 nt, Homo sapiens
aucgucuaaacuuuag

SEQ ID NO: 1315031 - RNA, 13 nt, Homo sapiens
aucuaaaccauau

SEQ ID NO: 1315032 - RNA, 14 nt, Homo sapiens
aucuaugguaauau

SEQ ID NO: 1315033 - RNA, 17 nt, Homo sapiens
aucucaaagaaggcauu

SEQ ID NO: 1315034 - RNA, 18 nt, Homo sapiens
aucucaauggaaacauca

SEQ ID NO: 1315035 - RNA, 16 nt, Homo sapiens
aucucaccccauccca

SEQ ID NO: 1315036 - RNA, 23 nt, Homo sapiens
auggcuuuggcuuugcaaaauaa

SEQ ID NO: 1315037 - RNA, 18 nt, Homo sapiens
auggcuuuuagcauuuau

SEQ ID NO: 1315038 - RNA, 13 nt, Homo sapiens
augggaacacugg

SEQ ID NO: 1315039 - RNA, 15 nt, Homo sapiens
augggaggcagggac

SEQ ID NO: 1315040 - RNA, 17 nt, Homo sapiens
augggcuaucaacuuaa

SEQ ID NO: 1315041 - RNA, 14 nt, Homo sapiens
auggugaaaugcag

SEQ ID NO: 1315042 - RNA, 13 nt, Homo sapiens
auggugugccuuc

SEQ ID NO: 1315043 - RNA, 17 nt, Homo sapiens
augguguggguguccug

SEQ ID NO: 1315044 - RNA, 17 nt, Homo sapiens
auguaaacaaaccacag

SEQ ID NO: 1315045 - RNA, 14 nt, Homo sapiens
auguaaacugugca

SEQ ID NO: 1315046 - RNA, 15 nt, Homo sapiens
auguaaacugugcac

SEQ ID NO: 1315047 - RNA, 16 nt, Homo sapiens
auguaaacugugcacc

SEQ ID NO: 1315048 - RNA, 13 nt, Homo sapiens
auguaaagccaug

SEQ ID NO: 1315049 - RNA, 12 nt, Homo sapiens
auguaaggccuu

SEQ ID NO: 1315050 - RNA, 16 nt, Homo sapiens
auguacagacauauuu

SEQ ID NO: 1315051 - RNA, 19 nt, Homo sapiens
auguacaucuggccuugaa

SEQ ID NO: 1315052 - RNA, 16 nt, Homo sapiens
auguaccaaaacauug

SEQ ID NO: 1315053 - RNA, 20 nt, Homo sapiens
auguacuaaaguagagcccu

SEQ ID NO: 1315054 - RNA, 15 nt, Homo sapiens
auguagcccauccuu

SEQ ID NO: 1315055 - RNA, 22 nt, Homo sapiens
auguauaaaauguaacacugau

SEQ ID NO: 1315056 - RNA, 14 nt, Homo sapiens
auguauaaagugau

SEQ ID NO: 1315057 - RNA, 19 nt, Homo sapiens
auguauauauauauaugca

SEQ ID NO: 1315058 - RNA, 14 nt, Homo sapiens
auguauaugcacuu

SEQ ID NO: 1315059 - RNA, 12 nt, Homo sapiens
caaaauugcuaa

SEQ ID NO: 1315060 - RNA, 19 nt, Homo sapiens
caaaauugcugcaccaaug

SEQ ID NO: 1315061 - RNA, 16 nt, Homo sapiens
caaaauuugcugccaa

SEQ ID NO: 1315062 - RNA, 14 nt, Homo sapiens
caaacaaaauggac

SEQ ID NO: 1315063 - RNA, 12 nt, Homo sapiens
caaacacccaug

SEQ ID NO: 1315064 - RNA, 17 nt, Homo sapiens
caaacacccaugcccag

SEQ ID NO: 1315065 - RNA, 15 nt, Homo sapiens
caaacacugcaggca

SEQ ID NO: 1315066 - RNA, 20 nt, Homo sapiens
caaacauccaaaaguucaac

SEQ ID NO: 1315067 - RNA, 18 nt, Homo sapiens
caaaccuccaaauguccu

SEQ ID NO: 1315068 - RNA, 14 nt, Homo sapiens
caaaccuucaggaa

SEQ ID NO: 1315069 - RNA, 20 nt, Homo sapiens
caaacugaauggcaaugaaa

SEQ ID NO: 1315070 - RNA, 20 nt, Homo sapiens
caaacugugcuucucuauga

SEQ ID NO: 1315071 - RNA, 13 nt, Homo sapiens
caaacuuuaguuu

SEQ ID NO: 1315072 - RNA, 13 nt, Homo sapiens
caaagaaggcauu

SEQ ID NO: 1315073 - RNA, 17 nt, Homo sapiens
caaagaauuccaaagca

SEQ ID NO: 1315074 - RNA, 14 nt, Homo sapiens
caaagagauuauuu

SEQ ID NO: 1315075 - RNA, 22 nt, Homo sapiens
caaagaucuguccucagccuug

SEQ ID NO: 1315076 - RNA, 16 nt, Homo sapiens
caaagaugacuugaaa

SEQ ID NO: 1315077 - RNA, 13 nt, Homo sapiens
caaagauuugcaa

SEQ ID NO: 1315078 - RNA, 21 nt, Homo sapiens
caaagcccuuguccccaugaa

SEQ ID NO: 1315079 - RNA, 15 nt, Homo sapiens
ccauaugaacauaua

SEQ ID NO: 1315080 - RNA, 15 nt, Homo sapiens
ccauauugagucaaa

SEQ ID NO: 1315081 - RNA, 16 nt, Homo sapiens
ccauauuuaacaugua

SEQ ID NO: 1315082 - RNA, 19 nt, Homo sapiens
ccaucagcuaaacaccacg

SEQ ID NO: 1315083 - RNA, 14 nt, Homo sapiens
ccaucagugcuccc

SEQ ID NO: 1315084 - RNA, 14 nt, Homo sapiens
ccauccucaaacac

SEQ ID NO: 1315085 - RNA, 16 nt, Homo sapiens
ccaucggcaggcagug

SEQ ID NO: 1315086 - RNA, 20 nt, Homo sapiens
ccaucguuuucuucacuguc

SEQ ID NO: 1315087 - RNA, 18 nt, Homo sapiens
ccaucucuuccuuuccaa

SEQ ID NO: 1315088 - RNA, 23 nt, Homo sapiens
ccaucugggcuccuccagggugu

SEQ ID NO: 1315089 - RNA, 22 nt, Homo sapiens
ccaucugucuugccagccagaa

SEQ ID NO: 1315090 - RNA, 18 nt, Homo sapiens
ccaucugugcacgcagug

SEQ ID NO: 1315091 - RNA, 19 nt, Homo sapiens
ccaugaaccaagaccauug

SEQ ID NO: 1315092 - RNA, 14 nt, Homo sapiens
ccaugacauugcau

SEQ ID NO: 1315093 - RNA, 15 nt, Homo sapiens
ccaugacccaggcug

SEQ ID NO: 1315094 - RNA, 17 nt, Homo sapiens
ccaugcguccuggucaa

SEQ ID NO: 1315095 - RNA, 22 nt, Homo sapiens
ccauggcucuauuucuucuuca

SEQ ID NO: 1315096 - RNA, 19 nt, Homo sapiens
ccaugguaugaaggugauu

SEQ ID NO: 1315097 - RNA, 14 nt, Homo sapiens
ccauggugagcucu

SEQ ID NO: 1315098 - RNA, 16 nt, Homo sapiens
ccauggugugaucguc

SEQ ID NO: 1315099 - RNA, 17 nt, Homo sapiens
ccauguagaagcugcau

SEQ ID NO: 1315100 - RNA, 14 nt, Homo sapiens
ccauguauuuugua

SEQ ID NO: 1315101 - RNA, 20 nt, Homo sapiens
ccaugucagcaaaaagcaaa

SEQ ID NO: 1315102 - RNA, 17 nt, Homo sapiens
ccaugugaaacucaucu

SEQ ID NO: 1315103 - RNA, 23 nt, Homo sapiens
ccauguuucacaaggucuuuaaa

SEQ ID NO: 1315104 - RNA, 12 nt, Homo sapiens
ccauuacugcau

SEQ ID NO: 1315105 - RNA, 16 nt, Homo sapiens
ccauuacugcauaaaa

SEQ ID NO: 1315106 - RNA, 23 nt, Homo sapiens
ccauucgguguggugcaguguga

SEQ ID NO: 1315107 - RNA, 13 nt, Homo sapiens
ccauugcucuuga

SEQ ID NO: 1315108 - RNA, 23 nt, Homo sapiens
ccauuggaggggcuggcacugga

SEQ ID NO: 1315109 - RNA, 14 nt, Homo sapiens
ccauugugaaccaa

SEQ ID NO: 1315110 - RNA, 17 nt, Homo sapiens
ccauugugaaccaaugc

SEQ ID NO: 1315111 - RNA, 15 nt, Homo sapiens
ccauuuuacauuucu

SEQ ID NO: 1315112 - RNA, 20 nt, Homo sapiens
ccauuuuagcaucuacuugu

SEQ ID NO: 1315113 - RNA, 22 nt, Homo sapiens
cccaaaacugauacccuuugaa

SEQ ID NO: 1315114 - RNA, 13 nt, Homo sapiens
cccaaacagugac

SEQ ID NO: 1315115 - RNA, 12 nt, Homo sapiens
cccaaacauguu

SEQ ID NO: 1315116 - RNA, 23 nt, Homo sapiens
cccaaacauguuguacauuucac

SEQ ID NO: 1315117 - RNA, 19 nt, Homo sapiens
cccaaaggaacacugacau

SEQ ID NO: 1315118 - RNA, 20 nt, Homo sapiens
cccaaauccuuagaucuggc

SEQ ID NO: 1315119 - RNA, 13 nt, Homo sapiens
cccaacauauaaa

SEQ ID NO: 1315120 - RNA, 20 nt, Homo sapiens
cccaaccccagcuacucuga

SEQ ID NO: 1315121 - RNA, 17 nt, Homo sapiens
cccaacuccucaugucu

SEQ ID NO: 1315122 - RNA, 21 nt, Homo sapiens
cccaagacaugaagacaucuu

SEQ ID NO: 1315123 - RNA, 19 nt, Homo sapiens
cccaagcagagaagcucuc

SEQ ID NO: 1315124 - RNA, 21 nt, Homo sapiens
cccaagcaugggggaccccuu

SEQ ID NO: 1315125 - RNA, 16 nt, Homo sapiens
cccaagccugcaguca

SEQ ID NO: 1315126 - RNA, 20 nt, Homo sapiens
cccaaguagcugcuaccuuc

SEQ ID NO: 1315127 - RNA, 18 nt, Homo sapiens
cccaaucaccuuuccugu

SEQ ID NO: 1315128 - RNA, 17 nt, Homo sapiens
cccacacaagacccaag

SEQ ID NO: 1315129 - RNA, 15 nt, Homo sapiens
cccaccaucaugucu

SEQ ID NO: 1315130 - RNA, 21 nt, Homo sapiens
cccacccuccuuucaccacau

SEQ ID NO: 1315131 - RNA, 13 nt, Homo sapiens
cccacugagauuu

SEQ ID NO: 1315132 - RNA, 18 nt, Homo sapiens
cccacuguaucuaggcaa

SEQ ID NO: 1315133 - RNA, 17 nt, Homo sapiens
cccacuucugugccacc

SEQ ID NO: 1315134 - RNA, 23 nt, Homo sapiens
cccagacacuggcguuacugcuu

SEQ ID NO: 1315135 - RNA, 19 nt, Homo sapiens
cccagagcacccagaucag

SEQ ID NO: 1315136 - RNA, 19 nt, Homo sapiens
cccagaugugguugcauaa

SEQ ID NO: 1315137 - RNA, 22 nt, Homo sapiens
cccagauuggcucacacugaga

SEQ ID NO: 1315138 - RNA, 12 nt, Homo sapiens
cccagcacugac

SEQ ID NO: 1315139 - RNA, 11 nt, Homo sapiens
cccagcacugc

SEQ ID NO: 1315140 - RNA, 11 nt, Homo sapiens
cccagcacuug

SEQ ID NO: 1315141 - RNA, 17 nt, Homo sapiens
cccagcagcuuggaugg

SEQ ID NO: 1315142 - RNA, 21 nt, Homo sapiens
cccagcaggugcugacuucau

SEQ ID NO: 1315143 - RNA, 10 nt, Homo sapiens
cccagcauuu

SEQ ID NO: 1315144 - RNA, 15 nt, Homo sapiens
cccagcccagagaca

SEQ ID NO: 1315145 - RNA, 16 nt, Homo sapiens
cccagcccugcagcaa

SEQ ID NO: 1315146 - RNA, 22 nt, Homo sapiens
cccagcuguugggaacagcaug

SEQ ID NO: 1315147 - RNA, 23 nt, Homo sapiens
cccaggacccugaaggggccaug

SEQ ID NO: 1315148 - RNA, 13 nt, Homo sapiens
cccaggacugggc

SEQ ID NO: 1315149 - RNA, 16 nt, Homo sapiens
cccaggaguguggcca

SEQ ID NO: 1315150 - RNA, 19 nt, Homo sapiens
cccaggcuggaaugcagug

SEQ ID NO: 1315151 - RNA, 20 nt, Homo sapiens
cccagggccugcaggaccug

SEQ ID NO: 1315152 - RNA, 19 nt, Homo sapiens
cccagggcuccugcacuua

SEQ ID NO: 1315153 - RNA, 17 nt, Homo sapiens
cccagguacauccauga

SEQ ID NO: 1315154 - RNA, 15 nt, Homo sapiens
cccagucacugugag

SEQ ID NO: 1315155 - RNA, 19 nt, Homo sapiens
cccagucgaccccaaagga

SEQ ID NO: 1315156 - RNA, 19 nt, Homo sapiens
cccagucuggaaugcagug

SEQ ID NO: 1315157 - RNA, 16 nt, Homo sapiens
cccaguuagcucucaa

SEQ ID NO: 1315158 - RNA, 13 nt, Homo sapiens
cccaucucuacaa

SEQ ID NO: 1315159 - RNA, 18 nt, Homo sapiens
cccaucuggcugugacag

SEQ ID NO: 1315160 - RNA, 21 nt, Homo sapiens
cccaugagaguagagggcacu

SEQ ID NO: 1315161 - RNA, 17 nt, Homo sapiens
cccaugcacugugaagg

SEQ ID NO: 1315162 - RNA, 15 nt, Homo sapiens
cccauggcucuauuu

SEQ ID NO: 1315163 - RNA, 18 nt, Homo sapiens
cccauggggagacaguug

SEQ ID NO: 1315164 - RNA, 17 nt, Homo sapiens
cccauucagacacuuca

SEQ ID NO: 1315165 - RNA, 22 nt, Homo sapiens
ccccaaaccuggcaagucaccu

SEQ ID NO: 1315166 - RNA, 19 nt, Homo sapiens
ccccacauugcacuucugg

SEQ ID NO: 1315167 - RNA, 22 nt, Homo sapiens
ccccacguugccucuacuuuau

SEQ ID NO: 1315168 - RNA, 23 nt, Homo sapiens
ccccacguugccucuacuuuauc

SEQ ID NO: 1315169 - RNA, 11 nt, Homo sapiens
ccccacugaca

SEQ ID NO: 1315170 - RNA, 23 nt, Homo sapiens
ccccacuggacugaccuggucca

SEQ ID NO: 1315171 - RNA, 19 nt, Homo sapiens
ccccagaaaaaggccgggu

SEQ ID NO: 1315172 - RNA, 18 nt, Homo sapiens
ccccagaguagcuggaau

SEQ ID NO: 1315173 - RNA, 18 nt, Homo sapiens
ccccagccccuuggaugu

SEQ ID NO: 1315174 - RNA, 13 nt, Homo sapiens
ccccaugcacugu

SEQ ID NO: 1315175 - RNA, 15 nt, Homo sapiens
ccccauuccugggaa

SEQ ID NO: 1315176 - RNA, 17 nt, Homo sapiens
cccccaaaaucugucac

SEQ ID NO: 1315177 - RNA, 16 nt, Homo sapiens
cccccacugaccagaa

SEQ ID NO: 1315178 - RNA, 13 nt, Homo sapiens
cccccacugccac

SEQ ID NO: 1315179 - RNA, 21 nt, Homo sapiens
cccccaucuucgggaccagga

SEQ ID NO: 1315180 - RNA, 12 nt, Homo sapiens
cccccauuucac

SEQ ID NO: 1315181 - RNA, 12 nt, Homo sapiens
cccccugugcag

SEQ ID NO: 1315182 - RNA, 13 nt, Homo sapiens
cccccuucacaaa

SEQ ID NO: 1315183 - RNA, 12 nt, Homo sapiens
cccccuugaggg

SEQ ID NO: 1315184 - RNA, 17 nt, Homo sapiens
cccccuuguuguaaaaa

SEQ ID NO: 1315185 - RNA, 12 nt, Homo sapiens
ccccgacuuccu

SEQ ID NO: 1315186 - RNA, 16 nt, Homo sapiens
ccccuaaaccaaaaac

SEQ ID NO: 1315187 - RNA, 16 nt, Homo sapiens
ccccuaaaccaacuga

SEQ ID NO: 1315188 - RNA, 15 nt, Homo sapiens
ccccuacugcuguga

SEQ ID NO: 1315189 - RNA, 18 nt, Homo sapiens
ccccucaacaccucugca

SEQ ID NO: 1315190 - RNA, 18 nt, Homo sapiens
ccccucacucuguuuccu

SEQ ID NO: 1315191 - RNA, 13 nt, Homo sapiens
ccccuccacucuc

SEQ ID NO: 1315192 - RNA, 18 nt, Homo sapiens
ccccucuacccacuucuc

SEQ ID NO: 1315193 - RNA, 13 nt, Homo sapiens
ccccucuccuccg

SEQ ID NO: 1315194 - RNA, 14 nt, Homo sapiens
ccccucucuuguca

SEQ ID NO: 1315195 - RNA, 20 nt, Homo sapiens
ccccucuucugagcacagau

SEQ ID NO: 1315196 - RNA, 14 nt, Homo sapiens
ccccugcacaguug

SEQ ID NO: 1315197 - RNA, 16 nt, Homo sapiens
ccccugcugcugucac

SEQ ID NO: 1315198 - RNA, 21 nt, Homo sapiens
ccccugcugcugucaccucuc

SEQ ID NO: 1315199 - RNA, 16 nt, Homo sapiens
ccccuguagcagucac

SEQ ID NO: 1315200 - RNA, 22 nt, Homo sapiens
ccccugucucggggcuugcccc

SEQ ID NO: 1315201 - RNA, 21 nt, Homo sapiens
ccccuuaguuauaauucugug

SEQ ID NO: 1315202 - RNA, 16 nt, Homo sapiens
ccccuucucucaucuc

SEQ ID NO: 1315203 - RNA, 22 nt, Homo sapiens
cuauuuugaaguaccaccaaaa

SEQ ID NO: 1315204 - RNA, 13 nt, Homo sapiens
cucaaaagaacuu

SEQ ID NO: 1315205 - RNA, 20 nt, Homo sapiens
cucaaaagaaggccacuguu

SEQ ID NO: 1315206 - RNA, 19 nt, Homo sapiens
cucaaaaucuuuccaaaua

SEQ ID NO: 1315207 - RNA, 23 nt, Homo sapiens
cucaaccaccuaggcaaugaaga

SEQ ID NO: 1315208 - RNA, 23 nt, Homo sapiens
cucuagcugggggugggccaggc

SEQ ID NO: 1315209 - RNA, 21 nt, Homo sapiens
cucuauagacucuaggacaua

SEQ ID NO: 1315210 - RNA, 14 nt, Homo sapiens
cucuauuacagcuu

SEQ ID NO: 1315211 - RNA, 13 nt, Homo sapiens
cucuauuaucuca

SEQ ID NO: 1315212 - RNA, 21 nt, Homo sapiens
cucuauuuguaauugaacuua

SEQ ID NO: 1315213 - RNA, 23 nt, Homo sapiens
cucucaccuguacuauugcagac

SEQ ID NO: 1315214 - RNA, 11 nt, Homo sapiens
cucucauuucc

SEQ ID NO: 1315215 - RNA, 11 nt, Homo sapiens
cucuccaggga

SEQ ID NO: 1315216 - RNA, 17 nt, Homo sapiens
cucuccccagcaaguga

SEQ ID NO: 1315217 - RNA, 21 nt, Homo sapiens
cucucuaccagauaacugagg

SEQ ID NO: 1315218 - RNA, 15 nt, Homo sapiens
cucugacacacagcu

SEQ ID NO: 1315219 - RNA, 15 nt, Homo sapiens
cucugcaaaccaaca

SEQ ID NO: 1315220 - RNA, 16 nt, Homo sapiens
cucugcagacuuccca

SEQ ID NO: 1315221 - RNA, 18 nt, Homo sapiens
cucugccucccuagcuuu

SEQ ID NO: 1315222 - RNA, 22 nt, Homo sapiens
cucugccugaagucacacagug

SEQ ID NO: 1315223 - RNA, 15 nt, Homo sapiens
cucugcuccaccuug

SEQ ID NO: 1315224 - RNA, 21 nt, Homo sapiens
cucuggauuccauuuggguca

SEQ ID NO: 1315225 - RNA, 21 nt, Homo sapiens
cucuggcauuccuuuucccaa

SEQ ID NO: 1315226 - RNA, 19 nt, Homo sapiens
cucuggccaagggccagac

SEQ ID NO: 1315227 - RNA, 16 nt, Homo sapiens
cucuguaccccaugac

SEQ ID NO: 1315228 - RNA, 15 nt, Homo sapiens
cucuguacuuuucau

SEQ ID NO: 1315229 - RNA, 21 nt, Homo sapiens
cucugugaacgauuuagaaag

SEQ ID NO: 1315230 - RNA, 14 nt, Homo sapiens
cucuucucauuuca

SEQ ID NO: 1315231 - RNA, 22 nt, Homo sapiens
cucuucuggccuggugucuccu

SEQ ID NO: 1315232 - RNA, 20 nt, Homo sapiens
cucuucuguuugcacaccca

SEQ ID NO: 1315233 - RNA, 20 nt, Homo sapiens
cucuucuuuagaacagggaa

SEQ ID NO: 1315234 - RNA, 19 nt, Homo sapiens
cucuugaaaauagaacaac

SEQ ID NO: 1315235 - RNA, 15 nt, Homo sapiens
cucuugaagagaaaa

SEQ ID NO: 1315236 - RNA, 12 nt, Homo sapiens
cucuuggcaguc

SEQ ID NO: 1315237 - RNA, 14 nt, Homo sapiens
cucuuguugcugag

SEQ ID NO: 1315238 - RNA, 18 nt, Homo sapiens
cucuuuagagaaguccaa

SEQ ID NO: 1315239 - RNA, 20 nt, Homo sapiens
cucuuuagccagaaucucau

SEQ ID NO: 1315240 - RNA, 16 nt, Homo sapiens
cucuuuccuauuucag

SEQ ID NO: 1315241 - RNA, 15 nt, Homo sapiens
cucuuugaucccaua

SEQ ID NO: 1315242 - RNA, 11 nt, Homo sapiens
cugaaaaccaa

SEQ ID NO: 1315243 - RNA, 14 nt, Homo sapiens
cugaaaaccucucc

SEQ ID NO: 1315244 - RNA, 19 nt, Homo sapiens
cugaaagacuucacuaaaa

SEQ ID NO: 1315245 - RNA, 17 nt, Homo sapiens
cugaaagugacagagac

SEQ ID NO: 1315246 - RNA, 18 nt, Homo sapiens
cugaaaguuguacaugaa

SEQ ID NO: 1315247 - RNA, 17 nt, Homo sapiens
cugaaauaaaauucauu

SEQ ID NO: 1315248 - RNA, 17 nt, Homo sapiens
cugaaauagaggcuaaa

SEQ ID NO: 1315249 - RNA, 19 nt, Homo sapiens
cugaaaucaagucaucuau

SEQ ID NO: 1315250 - RNA, 21 nt, Homo sapiens
cugaaauggacuuuuguacau

SEQ ID NO: 1315251 - RNA, 18 nt, Homo sapiens
cugaacauuaguugcacu

SEQ ID NO: 1315252 - RNA, 16 nt, Homo sapiens
cugaacguggcacucu

SEQ ID NO: 1315253 - RNA, 12 nt, Homo sapiens
cugaacugaugg

SEQ ID NO: 1315254 - RNA, 12 nt, Homo sapiens
cugaagccaaag

SEQ ID NO: 1315255 - RNA, 22 nt, Homo sapiens
cugaagccaaaguuaugcaagg

SEQ ID NO: 1315256 - RNA, 13 nt, Homo sapiens
cugaagucacaca

SEQ ID NO: 1315257 - RNA, 20 nt, Homo sapiens
cugaauacauucugcuuuca

SEQ ID NO: 1315258 - RNA, 17 nt, Homo sapiens
cugaaucgagaugucca

SEQ ID NO: 1315259 - RNA, 20 nt, Homo sapiens
cugaauguauugaacuugga

SEQ ID NO: 1315260 - RNA, 13 nt, Homo sapiens
cugaauuaguaau

SEQ ID NO: 1315261 - RNA, 20 nt, Homo sapiens
cugaauuugcaaaguacugu

SEQ ID NO: 1315262 - RNA, 13 nt, Homo sapiens
cugaauuuugcuu

SEQ ID NO: 1315263 - RNA, 12 nt, Homo sapiens
cugacaguauua

SEQ ID NO: 1315264 - RNA, 23 nt, Homo sapiens
cugacaguuaauaaaccuuugca

SEQ ID NO: 1315265 - RNA, 11 nt, Homo sapiens
cugacccaaau

SEQ ID NO: 1315266 - RNA, 19 nt, Homo sapiens
cugaccccagcauucucag

SEQ ID NO: 1315267 - RNA, 19 nt, Homo sapiens
cugaccucaggugauccac

SEQ ID NO: 1315268 - RNA, 15 nt, Homo sapiens
cugaccuccacagcu

SEQ ID NO: 1315269 - RNA, 20 nt, Homo sapiens
cugacucucgugcauuucaa

SEQ ID NO: 1315270 - RNA, 17 nt, Homo sapiens
cugacuuuuaaugucau

SEQ ID NO: 1315271 - RNA, 19 nt, Homo sapiens
cugacuuuuaaugucauuu

SEQ ID NO: 1315272 - RNA, 13 nt, Homo sapiens
cugagaagacugc

SEQ ID NO: 1315273 - RNA, 12 nt, Homo sapiens
cugagauucaau

SEQ ID NO: 1315274 - RNA, 13 nt, Homo sapiens
cugagauugacaa

SEQ ID NO: 1315275 - RNA, 19 nt, Homo sapiens
cugagcaaaucaccacaaa

SEQ ID NO: 1315276 - RNA, 22 nt, Homo sapiens
cugagcagugaaugauucagug

SEQ ID NO: 1315277 - RNA, 20 nt, Homo sapiens
cugagccuccacagcagugg

SEQ ID NO: 1315278 - RNA, 15 nt, Homo sapiens
cugaggcacacagag

SEQ ID NO: 1315279 - RNA, 15 nt, Homo sapiens
cugaggccacacuca

SEQ ID NO: 1315280 - RNA, 23 nt, Homo sapiens
cugaggccuggggaugugaacaa

SEQ ID NO: 1315281 - RNA, 12 nt, Homo sapiens
cugaggugggag

SEQ ID NO: 1315282 - RNA, 15 nt, Homo sapiens
cugagucaucuguua

SEQ ID NO: 1315283 - RNA, 19 nt, Homo sapiens
cugauaagcuaacaccaga

SEQ ID NO: 1315284 - RNA, 18 nt, Homo sapiens
cugauaaggaucuaggag

SEQ ID NO: 1315285 - RNA, 15 nt, Homo sapiens
cugauaaugcucacu

SEQ ID NO: 1315286 - RNA, 16 nt, Homo sapiens
cugauacccuuugaaa

SEQ ID NO: 1315287 - RNA, 12 nt, Homo sapiens
cugauaccucaa

SEQ ID NO: 1315288 - RNA, 22 nt, Homo sapiens
cugauaccuucuggcugugcua

SEQ ID NO: 1315289 - RNA, 18 nt, Homo sapiens
cugauacuagacuagaca

SEQ ID NO: 1315290 - RNA, 18 nt, Homo sapiens
cugauagccuaguuaaau

SEQ ID NO: 1315291 - RNA, 22 nt, Homo sapiens
cugauagcuauaauugggucau

SEQ ID NO: 1315292 - RNA, 23 nt, Homo sapiens
cugauagguagcauuuuccagca

SEQ ID NO: 1315293 - RNA, 14 nt, Homo sapiens
cugauauggcuuuu

SEQ ID NO: 1315294 - RNA, 14 nt, Homo sapiens
cugauccugugaag

SEQ ID NO: 1315295 - RNA, 17 nt, Homo sapiens
cugaugaugguauaaag

SEQ ID NO: 1315296 - RNA, 15 nt, Homo sapiens
cugcaaaccaauaga

SEQ ID NO: 1315297 - RNA, 15 nt, Homo sapiens
cugcaaacgcugccu

SEQ ID NO: 1315298 - RNA, 18 nt, Homo sapiens
cugcaaaggacagaucca

SEQ ID NO: 1315299 - RNA, 22 nt, Homo sapiens
cugcaaaggacagauccaggga

SEQ ID NO: 1315300 - RNA, 16 nt, Homo sapiens
cugcaagcacaucugc

SEQ ID NO: 1315301 - RNA, 20 nt, Homo sapiens
cugcacaguggggagcaugg

SEQ ID NO: 1315302 - RNA, 17 nt, Homo sapiens
cugcacccacccaggag

SEQ ID NO: 1315303 - RNA, 17 nt, Homo sapiens
cugcaccguacugugga

SEQ ID NO: 1315304 - RNA, 14 nt, Homo sapiens
cugcacuccagccu

SEQ ID NO: 1315305 - RNA, 23 nt, Homo sapiens
cugcaguggacaguccccaccuu

SEQ ID NO: 1315306 - RNA, 21 nt, Homo sapiens
cugcauaccaaccugggcaau

SEQ ID NO: 1315307 - RNA, 21 nt, Homo sapiens
cugcauacuggccgagcugcu

SEQ ID NO: 1315308 - RNA, 15 nt, Homo sapiens
cugcauccagagauu

SEQ ID NO: 1315309 - RNA, 13 nt, Homo sapiens
cugcaucucaaaa

SEQ ID NO: 1315310 - RNA, 14 nt, Homo sapiens
cugcaucucaaaaa

SEQ ID NO: 1315311 - RNA, 16 nt, Homo sapiens
cugcauuuacacacac

SEQ ID NO: 1315312 - RNA, 20 nt, Homo sapiens
cugcauuuagcuguauucau

SEQ ID NO: 1315313 - RNA, 22 nt, Homo sapiens
cugcauuuauagcauacgguau

SEQ ID NO: 1315314 - RNA, 22 nt, Homo sapiens
cugcauuugccugucaugcgca

SEQ ID NO: 1315315 - RNA, 21 nt, Homo sapiens
cugcauuugugucauugacaa

SEQ ID NO: 1315316 - RNA, 15 nt, Homo sapiens
cugccaaaaugcucu

SEQ ID NO: 1315317 - RNA, 12 nt, Homo sapiens
cugccagcuucc

SEQ ID NO: 1315318 - RNA, 15 nt, Homo sapiens
cugccaugccagcuu

SEQ ID NO: 1315319 - RNA, 14 nt, Homo sapiens
cugccauguugccc

SEQ ID NO: 1315320 - RNA, 14 nt, Homo sapiens
cugcccagcacagg

SEQ ID NO: 1315321 - RNA, 22 nt, Homo sapiens
cugcccagucgaccccaaagga

SEQ ID NO: 1315322 - RNA, 22 nt, Homo sapiens
cugcccauggacaggcuggcuc

SEQ ID NO: 1315323 - RNA, 21 nt, Homo sapiens
cugccccaaacaaauaugcaa

SEQ ID NO: 1315324 - RNA, 13 nt, Homo sapiens
cugcccccagaaa

SEQ ID NO: 1315325 - RNA, 17 nt, Homo sapiens
cugcccuuggcacccaa

SEQ ID NO: 1315326 - RNA, 16 nt, Homo sapiens
cugcccuugucacugg

SEQ ID NO: 1315327 - RNA, 16 nt, Homo sapiens
cugcccuugucccacu

SEQ ID NO: 1315328 - RNA, 17 nt, Homo sapiens
cugccgaaccaaaagaa

SEQ ID NO: 1315329 - RNA, 15 nt, Homo sapiens
cugccgcuaccuccc

SEQ ID NO: 1315330 - RNA, 19 nt, Homo sapiens
cugccgggcugagggccug

SEQ ID NO: 1315331 - RNA, 20 nt, Homo sapiens
cugccucccaacagugggga

SEQ ID NO: 1315332 - RNA, 15 nt, Homo sapiens
cugccucccuagcuu

SEQ ID NO: 1315333 - RNA, 21 nt, Homo sapiens
cugccucggccucccaaagug

SEQ ID NO: 1315334 - RNA, 17 nt, Homo sapiens
cugccugaagucacaca

SEQ ID NO: 1315335 - RNA, 20 nt, Homo sapiens
cugccugccgguaaacacgc

SEQ ID NO: 1315336 - RNA, 23 nt, Homo sapiens
cugccuuguguucagugaaccca

SEQ ID NO: 1315337 - RNA, 16 nt, Homo sapiens
gcuauccaggauuuug

SEQ ID NO: 1315338 - RNA, 21 nt, Homo sapiens
gcuauccaggauuuuguuucu

SEQ ID NO: 1315339 - RNA, 23 nt, Homo sapiens
gcuaucccuuuccaaaggccaug

SEQ ID NO: 1315340 - RNA, 14 nt, Homo sapiens
gcuaugagcuuuua

SEQ ID NO: 1315341 - RNA, 18 nt, Homo sapiens
gcuauguaaacaaaccac

SEQ ID NO: 1315342 - RNA, 15 nt, Homo sapiens
gcuauucuccaugua

SEQ ID NO: 1315343 - RNA, 19 nt, Homo sapiens
gcuauuucuucuacugcua

SEQ ID NO: 1315344 - RNA, 22 nt, Homo sapiens
gcucaaagaguggcuugaauau

SEQ ID NO: 1315345 - RNA, 14 nt, Homo sapiens
gcucacaccuguaa

SEQ ID NO: 1315346 - RNA, 17 nt, Homo sapiens
gcucacggaagggaugc

SEQ ID NO: 1315347 - RNA, 21 nt, Homo sapiens
gcucacguuaccuugacacau

SEQ ID NO: 1315348 - RNA, 22 nt, Homo sapiens
gcucacuguucuauucaucuca

SEQ ID NO: 1315349 - RNA, 21 nt, Homo sapiens
gcucagacaccugugugcugu

SEQ ID NO: 1315350 - RNA, 13 nt, Homo sapiens
gcucagacauuuu

SEQ ID NO: 1315351 - RNA, 22 nt, Homo sapiens
gcucagcaaaagaugcuucuca

SEQ ID NO: 1315352 - RNA, 15 nt, Homo sapiens
gcucagcauuuccac

SEQ ID NO: 1315353 - RNA, 20 nt, Homo sapiens
gcucagcucgguacccgggg

SEQ ID NO: 1315354 - RNA, 14 nt, Homo sapiens
gcucaggacucaga

SEQ ID NO: 1315355 - RNA, 22 nt, Homo sapiens
gcucaggacucagaagccucug

SEQ ID NO: 1315356 - RNA, 18 nt, Homo sapiens
gcucagggaaaagcagcu

SEQ ID NO: 1315357 - RNA, 16 nt, Homo sapiens
gcuccaaccugcaaag

SEQ ID NO: 1315358 - RNA, 22 nt, Homo sapiens
gcuccaaccugcaaagaucugu

SEQ ID NO: 1315359 - RNA, 20 nt, Homo sapiens
gcuccacccuggccgagucc

SEQ ID NO: 1315360 - RNA, 23 nt, Homo sapiens
gcucccaagggauggugcccugu

SEQ ID NO: 1315361 - RNA, 19 nt, Homo sapiens
gcucccagacggucaggaa

SEQ ID NO: 1315362 - RNA, 23 nt, Homo sapiens
gcucccccucccccacugccaua

SEQ ID NO: 1315363 - RNA, 20 nt, Homo sapiens
gcuccccucugcacggacca

SEQ ID NO: 1315364 - RNA, 19 nt, Homo sapiens
gcucccugguucugaugau

SEQ ID NO: 1315365 - RNA, 14 nt, Homo sapiens
gcuccggccugucc

SEQ ID NO: 1315366 - RNA, 17 nt, Homo sapiens
gcucgccaaggccuagg

SEQ ID NO: 1315367 - RNA, 19 nt, Homo sapiens
gcucuaagucaaauuccaa

SEQ ID NO: 1315368 - RNA, 13 nt, Homo sapiens
gcucuaguucaaa

SEQ ID NO: 1315369 - RNA, 15 nt, Homo sapiens
gcucuauguuuacaa

SEQ ID NO: 1315370 - RNA, 16 nt, Homo sapiens
gcucucaaaucccucu

SEQ ID NO: 1315371 - RNA, 15 nt, Homo sapiens
gcucuccauucaauu

SEQ ID NO: 1315372 - RNA, 16 nt, Homo sapiens
gcucugcugacagaca

SEQ ID NO: 1315373 - RNA, 20 nt, Homo sapiens
gcucugcuugacaacaucug

SEQ ID NO: 1315374 - RNA, 14 nt, Homo sapiens
gcucuggacaggca

SEQ ID NO: 1315375 - RNA, 17 nt, Homo sapiens
gcucuuuuccagaucaa

SEQ ID NO: 1315376 - RNA, 15 nt, Homo sapiens
gcugaaacccaauga

SEQ ID NO: 1315377 - RNA, 14 nt, Homo sapiens
gcugaccacagcac

SEQ ID NO: 1315378 - RNA, 20 nt, Homo sapiens
gcugaccacagcacagccaa

SEQ ID NO: 1315379 - RNA, 16 nt, Homo sapiens
gcugaggcaagagaau

SEQ ID NO: 1315380 - RNA, 15 nt, Homo sapiens
gcugaggcuggcaca

SEQ ID NO: 1315381 - RNA, 19 nt, Homo sapiens
gcugaucuucuagaugcca

SEQ ID NO: 1315382 - RNA, 19 nt, Homo sapiens
gcugaucuuuaacuggaag

SEQ ID NO: 1315383 - RNA, 13 nt, Homo sapiens
gcugauguccuca

SEQ ID NO: 1315384 - RNA, 14 nt, Homo sapiens
gcugcaugcccucu

SEQ ID NO: 1315385 - RNA, 19 nt, Homo sapiens
gcugcauuugccugucaug

SEQ ID NO: 1315386 - RNA, 18 nt, Homo sapiens
gcugccagcucuguauca

SEQ ID NO: 1315387 - RNA, 20 nt, Homo sapiens
gcugcccccuccaggccagu

SEQ ID NO: 1315388 - RNA, 23 nt, Homo sapiens
gcugccuccauuauccauuccca

SEQ ID NO: 1315389 - RNA, 18 nt, Homo sapiens
gcugcuagaucuuuauua

SEQ ID NO: 1315390 - RNA, 16 nt, Homo sapiens
gcugcuccugagagag

SEQ ID NO: 1315391 - RNA, 12 nt, Homo sapiens
gcuggaaccugc

SEQ ID NO: 1315392 - RNA, 13 nt, Homo sapiens
gcuggaaugcagu

SEQ ID NO: 1315393 - RNA, 14 nt, Homo sapiens
gcuggaaugcagug

SEQ ID NO: 1315394 - RNA, 20 nt, Homo sapiens
gcuggaaugcaguggugcga

SEQ ID NO: 1315395 - RNA, 17 nt, Homo sapiens
gcuggagaaaucuugaa

SEQ ID NO: 1315396 - RNA, 20 nt, Homo sapiens
gcuggagccuggugcccuaa

SEQ ID NO: 1315397 - RNA, 18 nt, Homo sapiens
gcuggagugcaguggugu

SEQ ID NO: 1315398 - RNA, 13 nt, Homo sapiens
gcuggaucaggaa

SEQ ID NO: 1315399 - RNA, 15 nt, Homo sapiens
gcuggaugauggucu

SEQ ID NO: 1315400 - RNA, 13 nt, Homo sapiens
gcuggcaccagaa

SEQ ID NO: 1315401 - RNA, 22 nt, Homo sapiens
gcuggccaaagagccuuuccaa

SEQ ID NO: 1315402 - RNA, 11 nt, Homo sapiens
gcugggaacau

SEQ ID NO: 1315403 - RNA, 16 nt, Homo sapiens
gcugggacguggcuca

SEQ ID NO: 1315404 - RNA, 19 nt, Homo sapiens
gcugggagaaauacuugaa

SEQ ID NO: 1315405 - RNA, 16 nt, Homo sapiens
gcugggauuacaggug

SEQ ID NO: 1315406 - RNA, 23 nt, Homo sapiens
gcugggucaggcagggugcagua

SEQ ID NO: 1315407 - RNA, 22 nt, Homo sapiens
gcuggucccggggccagcacuu

SEQ ID NO: 1315408 - RNA, 16 nt, Homo sapiens
gcugucccgugcaugg

SEQ ID NO: 1315409 - RNA, 18 nt, Homo sapiens
gcuguccucccaccucag

SEQ ID NO: 1315410 - RNA, 21 nt, Homo sapiens
gcugugggaaaccucauuguu

SEQ ID NO: 1315411 - RNA, 13 nt, Homo sapiens
gcuguugcugaau

SEQ ID NO: 1315412 - RNA, 20 nt, Homo sapiens
gcuuaaaggggcuagaguga

SEQ ID NO: 1315413 - RNA, 20 nt, Homo sapiens
gcuuacagaauggaucaugu

SEQ ID NO: 1315414 - RNA, 23 nt, Homo sapiens
gcuuaguccaauuccuugcacau

SEQ ID NO: 1315415 - RNA, 16 nt, Homo sapiens
gcuuaguuuguguguu

SEQ ID NO: 1315416 - RNA, 13 nt, Homo sapiens
gcuuaugaauaua

SEQ ID NO: 1315417 - RNA, 18 nt, Homo sapiens
gcuucaaguggggagaag

SEQ ID NO: 1315418 - RNA, 21 nt, Homo sapiens
gcuucccagcaccaacaugua

SEQ ID NO: 1315419 - RNA, 23 nt, Homo sapiens
gcuuccccuuuugccaaucucaa

SEQ ID NO: 1315420 - RNA, 15 nt, Homo sapiens
gcuucccuaaucuau

SEQ ID NO: 1315421 - RNA, 15 nt, Homo sapiens
gcuucccugacucau

SEQ ID NO: 1315422 - RNA, 22 nt, Homo sapiens
gcuuccuuagguugaugcugga

SEQ ID NO: 1315423 - RNA, 18 nt, Homo sapiens
gcuucgcaaaauguuuca

SEQ ID NO: 1315424 - RNA, 11 nt, Homo sapiens
gcuucugccau

SEQ ID NO: 1315425 - RNA, 18 nt, Homo sapiens
gcuucugugugcugcuaa

SEQ ID NO: 1315426 - RNA, 20 nt, Homo sapiens
gcuucuugccucugugcugu

SEQ ID NO: 1315427 - RNA, 15 nt, Homo sapiens
gcuugacaacaucug

SEQ ID NO: 1315428 - RNA, 23 nt, Homo sapiens
gcuugcaaaaacuacaaccaaug

SEQ ID NO: 1315429 - RNA, 14 nt, Homo sapiens
gcuuggagaacuca

SEQ ID NO: 1315430 - RNA, 16 nt, Homo sapiens
gcuuggauggggugcc

SEQ ID NO: 1315431 - RNA, 16 nt, Homo sapiens
gcuuggcugugcccuc

SEQ ID NO: 1315432 - RNA, 23 nt, Homo sapiens
gcuuggcugugcccucagauucc

SEQ ID NO: 1315433 - RNA, 18 nt, Homo sapiens
gcuuguuauugccucuac

SEQ ID NO: 1315434 - RNA, 16 nt, Homo sapiens
gcuuguugugcuuuua

SEQ ID NO: 1315435 - RNA, 21 nt, Homo sapiens
gcuuuccaaaccuuaucucca

SEQ ID NO: 1315436 - RNA, 23 nt, Homo sapiens
gcuuucugucuccuuaacacuga

SEQ ID NO: 1315437 - RNA, 18 nt, Homo sapiens
ggcauuaggaguguuuca

SEQ ID NO: 1315438 - RNA, 20 nt, Homo sapiens
ggcauuugcaccuaccucac

SEQ ID NO: 1315439 - RNA, 15 nt, Homo sapiens
ggccaacacuguggg

SEQ ID NO: 1315440 - RNA, 18 nt, Homo sapiens
ggccagagggagugacag

SEQ ID NO: 1315441 - RNA, 15 nt, Homo sapiens
ggccagcacuuccau

SEQ ID NO: 1315442 - RNA, 16 nt, Homo sapiens
ggccagugagccacuc

SEQ ID NO: 1315443 - RNA, 18 nt, Homo sapiens
ggccauggcucaugggac

SEQ ID NO: 1315444 - RNA, 22 nt, Homo sapiens
ggccauuggaggggcuggcacu

SEQ ID NO: 1315445 - RNA, 13 nt, Homo sapiens
ggccccacugggg

SEQ ID NO: 1315446 - RNA, 23 nt, Homo sapiens
ggccccagccccucucccugugc

SEQ ID NO: 1315447 - RNA, 15 nt, Homo sapiens
ggcccccacaggccc

SEQ ID NO: 1315448 - RNA, 16 nt, Homo sapiens
ggccccucucauuccc

SEQ ID NO: 1315449 - RNA, 15 nt, Homo sapiens
ggccgcuguggccuu

SEQ ID NO: 1315450 - RNA, 14 nt, Homo sapiens
ggccuacagcuuug

SEQ ID NO: 1315451 - RNA, 16 nt, Homo sapiens
ggccuauguugaucca

SEQ ID NO: 1315452 - RNA, 21 nt, Homo sapiens
ggccucaacuccucccauaga

SEQ ID NO: 1315453 - RNA, 18 nt, Homo sapiens
ggccucaucucugccuga

SEQ ID NO: 1315454 - RNA, 20 nt, Homo sapiens
ggccucccaaaugagccaug

SEQ ID NO: 1315455 - RNA, 16 nt, Homo sapiens
ggccuccugugugugc

SEQ ID NO: 1315456 - RNA, 20 nt, Homo sapiens
ggccugcccagucgacccca

SEQ ID NO: 1315457 - RNA, 20 nt, Homo sapiens
ggcgacaguuuuccuucuca

SEQ ID NO: 1315458 - RNA, 15 nt, Homo sapiens
ggcgcccgggaucca

SEQ ID NO: 1315459 - RNA, 20 nt, Homo sapiens
ggcgcccgggauccagcuca

SEQ ID NO: 1315460 - RNA, 14 nt, Homo sapiens
ggcgucccuaccuc

SEQ ID NO: 1315461 - RNA, 15 nt, Homo sapiens
ggcuaaaaagcaaca

SEQ ID NO: 1315462 - RNA, 13 nt, Homo sapiens
ggcuacacaggga

SEQ ID NO: 1315463 - RNA, 18 nt, Homo sapiens
ggcuacuauagguccaga

SEQ ID NO: 1315464 - RNA, 19 nt, Homo sapiens
ggcuacuauagguccagaa

SEQ ID NO: 1315465 - RNA, 20 nt, Homo sapiens
ggcucaagcgauccucccac

SEQ ID NO: 1315466 - RNA, 14 nt, Homo sapiens
ggcucaagcugucc

SEQ ID NO: 1315467 - RNA, 13 nt, Homo sapiens
ggcucagccagca

SEQ ID NO: 1315468 - RNA, 19 nt, Homo sapiens
ggcucagcggggacagcuc

SEQ ID NO: 1315469 - RNA, 20 nt, Homo sapiens
ggcucagugcaaccucugcu

SEQ ID NO: 1315470 - RNA, 18 nt, Homo sapiens
ggcuccagaugcagggca

SEQ ID NO: 1315471 - RNA, 17 nt, Homo sapiens
ggcuccauccguggcug

SEQ ID NO: 1315472 - RNA, 21 nt, Homo sapiens
ggcucccagggacaccuggga

SEQ ID NO: 1315473 - RNA, 21 nt, Homo sapiens
ggcucccccaggccugagcug

SEQ ID NO: 1315474 - RNA, 19 nt, Homo sapiens
ggcugacucuaggugcccu

SEQ ID NO: 1315475 - RNA, 19 nt, Homo sapiens
ggcugccucauuuagagag

SEQ ID NO: 1315476 - RNA, 20 nt, Homo sapiens
gauugcaugugacucugaag

SEQ ID NO: 1315477 - RNA, 17 nt, Homo sapiens
gauugccucucuagaca

SEQ ID NO: 1315478 - RNA, 18 nt, Homo sapiens
gauugcuuaaaauagcaa

SEQ ID NO: 1315479 - RNA, 16 nt, Homo sapiens
gauuggagauagggaa

SEQ ID NO: 1315480 - RNA, 16 nt, Homo sapiens
gauugguaugaugcug

SEQ ID NO: 1315481 - RNA, 21 nt, Homo sapiens
gauuguuuacaggauauucca

SEQ ID NO: 1315482 - RNA, 12 nt, Homo sapiens
gauuugcauuuc

SEQ ID NO: 1315483 - RNA, 19 nt, Homo sapiens
gauuuuugacucuggcaaa

SEQ ID NO: 1315484 - RNA, 17 nt, Homo sapiens
gauuuuuuccucugcau

SEQ ID NO: 1315485 - RNA, 18 nt, Homo sapiens
gauuuuuuccucugcauu

SEQ ID NO: 1315486 - RNA, 18 nt, Homo sapiens
gcaaaaggauauucacuu

SEQ ID NO: 1315487 - RNA, 21 nt, Homo sapiens
gcaaaaggaucuuuguggcca

SEQ ID NO: 1315488 - RNA, 17 nt, Homo sapiens
gcaaaauccuggugaug

SEQ ID NO: 1315489 - RNA, 22 nt, Homo sapiens
gcaaaauguuucaaguacugua

SEQ ID NO: 1315490 - RNA, 13 nt, Homo sapiens
gcaaacaggcagu

SEQ ID NO: 1315491 - RNA, 20 nt, Homo sapiens
gcaaaggcugagaacacugu

SEQ ID NO: 1315492 - RNA, 23 nt, Homo sapiens
gcaaaggcugggaccacgugaga

SEQ ID NO: 1315493 - RNA, 15 nt, Homo sapiens
gcaaauccuauguga

SEQ ID NO: 1315494 - RNA, 13 nt, Homo sapiens
ggcuggcacugac

SEQ ID NO: 1315495 - RNA, 14 nt, Homo sapiens
ggcuggccucccaa

SEQ ID NO: 1315496 - RNA, 15 nt, Homo sapiens
ggcuguaucccauga

SEQ ID NO: 1315497 - RNA, 17 nt, Homo sapiens
ggcuucucucucucuuu

SEQ ID NO: 1315498 - RNA, 22 nt, Homo sapiens
ggcuuguuuuccaaagaaaagu

SEQ ID NO: 1315499 - RNA, 14 nt, Homo sapiens
ggcuuuccagcuua

SEQ ID NO: 1315500 - RNA, 14 nt, Homo sapiens
ggcuuugcaaaaua

SEQ ID NO: 1315501 - RNA, 16 nt, Homo sapiens
gggaaaaggggcuccu

SEQ ID NO: 1315502 - RNA, 23 nt, Homo sapiens
gggaaacagguugggaugggaua

SEQ ID NO: 1315503 - RNA, 17 nt, Homo sapiens
gggaacucagauccagg

SEQ ID NO: 1315504 - RNA, 18 nt, Homo sapiens
gggaaggccaggaccaug

SEQ ID NO: 1315505 - RNA, 20 nt, Homo sapiens
gggaagggugguggagccag

SEQ ID NO: 1315506 - RNA, 20 nt, Homo sapiens
gggaaucucauccaucacag

SEQ ID NO: 1315507 - RNA, 12 nt, Homo sapiens
gggaauggggac

SEQ ID NO: 1315508 - RNA, 18 nt, Homo sapiens
gggagauggaucaaucaa

SEQ ID NO: 1315509 - RNA, 15 nt, Homo sapiens
gggagcagaugcaau

SEQ ID NO: 1315510 - RNA, 20 nt, Homo sapiens
gggaggccagugagccacuc

SEQ ID NO: 1315511 - RNA, 20 nt, Homo sapiens
gggaguaggacauaccagcu

SEQ ID NO: 1315512 - RNA, 12 nt, Homo sapiens
gggagucugggc

SEQ ID NO: 1315513 - RNA, 13 nt, Homo sapiens
gggcacacacugu

SEQ ID NO: 1315514 - RNA, 17 nt, Homo sapiens
gggcacagcaucuguag

SEQ ID NO: 1315515 - RNA, 14 nt, Homo sapiens
gggcagucauuauc

SEQ ID NO: 1315516 - RNA, 12 nt, Homo sapiens
gggccagagcca

SEQ ID NO: 1315517 - RNA, 15 nt, Homo sapiens
gggccugaugugugu

SEQ ID NO: 1315518 - RNA, 20 nt, Homo sapiens
gggccuggcaggacuccaga

SEQ ID NO: 1315519 - RNA, 22 nt, Homo sapiens
gggccuuaucgggcuccagcca

SEQ ID NO: 1315520 - RNA, 12 nt, Homo sapiens
gggcgcgguggc

SEQ ID NO: 1315521 - RNA, 21 nt, Homo sapiens
gggcggcaggaccagccagca

SEQ ID NO: 1315522 - RNA, 16 nt, Homo sapiens
gggcuuauccaugccu

SEQ ID NO: 1315523 - RNA, 18 nt, Homo sapiens
gggcuuggaccagaucua

SEQ ID NO: 1315524 - RNA, 22 nt, Homo sapiens
gggcuuggcugugcccucagau

SEQ ID NO: 1315525 - RNA, 14 nt, Homo sapiens
ggggaagagugacu

SEQ ID NO: 1315526 - RNA, 18 nt, Homo sapiens
ggggacaauaugugccaa

SEQ ID NO: 1315527 - RNA, 19 nt, Homo sapiens
ggggacucgguaagcacuu

SEQ ID NO: 1315528 - RNA, 15 nt, Homo sapiens
ggggaucaccucucu

SEQ ID NO: 1315529 - RNA, 19 nt, Homo sapiens
ggggaugacaugcacucag

SEQ ID NO: 1315530 - RNA, 20 nt, Homo sapiens
ggggcccugugcgucucagu

SEQ ID NO: 1315531 - RNA, 19 nt, Homo sapiens
ggggcucacaccuguaauc

SEQ ID NO: 1315532 - RNA, 13 nt, Homo sapiens
ggggcucuucuca

SEQ ID NO: 1315533 - RNA, 23 nt, Homo sapiens
gggggcucccguggccuguagaa

SEQ ID NO: 1315534 - RNA, 15 nt, Homo sapiens
ggggguuggauuuga

SEQ ID NO: 1315535 - RNA, 23 nt, Homo sapiens
gggguagguagauaccaaaugaa

SEQ ID NO: 1315536 - RNA, 23 nt, Homo sapiens
gggguccuguuaacgucaucuca

SEQ ID NO: 1315537 - RNA, 16 nt, Homo sapiens
ggggugccaguuugaa

SEQ ID NO: 1315538 - RNA, 12 nt, Homo sapiens
ggggugugcaug

SEQ ID NO: 1315539 - RNA, 20 nt, Homo sapiens
gggucucacuauguugccca

SEQ ID NO: 1315540 - RNA, 19 nt, Homo sapiens
gggucucgcuuuguugccc

SEQ ID NO: 1315541 - RNA, 20 nt, Homo sapiens
gggucucgcuuuguugccca

SEQ ID NO: 1315542 - RNA, 13 nt, Homo sapiens
gggugagugcaag

SEQ ID NO: 1315543 - RNA, 17 nt, Homo sapiens
gggugugacauauuuca

SEQ ID NO: 1315544 - RNA, 19 nt, Homo sapiens
ggguucucucucucugucu

SEQ ID NO: 1315545 - RNA, 21 nt, Homo sapiens
ggguuuguuuuucaaagccug

SEQ ID NO: 1315546 - RNA, 18 nt, Homo sapiens
gguaaaaucuagaagcuu

SEQ ID NO: 1315547 - RNA, 21 nt, Homo sapiens
gguauaaugguugacuggguu

SEQ ID NO: 1315548 - RNA, 18 nt, Homo sapiens
gguauuuuuuacugcuug

SEQ ID NO: 1315549 - RNA, 13 nt, Homo sapiens
ggucaaaauuugc

SEQ ID NO: 1315550 - RNA, 19 nt, Homo sapiens
ggucaaacaaacucucuga

SEQ ID NO: 1315551 - RNA, 13 nt, Homo sapiens
ggucacaguccac

SEQ ID NO: 1315552 - RNA, 12 nt, Homo sapiens
ggucacccagga

SEQ ID NO: 1315553 - RNA, 18 nt, Homo sapiens
ggucacccuucaacgcuc

SEQ ID NO: 1315554 - RNA, 12 nt, Homo sapiens
ggucagagccac

SEQ ID NO: 1315555 - RNA, 15 nt, Homo sapiens
ggucaggcagggugc

SEQ ID NO: 1315556 - RNA, 18 nt, Homo sapiens
ggucaggcagggugcagu

SEQ ID NO: 1315557 - RNA, 12 nt, Homo sapiens
ggucaguccaug

SEQ ID NO: 1315558 - RNA, 16 nt, Homo sapiens
ggucauagauguuucc

SEQ ID NO: 1315559 - RNA, 14 nt, Homo sapiens
ggucauucuuuauu

SEQ ID NO: 1315560 - RNA, 20 nt, Homo sapiens
gguccugaaaguaacucaua

SEQ ID NO: 1315561 - RNA, 19 nt, Homo sapiens
gguccugcugcuggcugcc

SEQ ID NO: 1315562 - RNA, 14 nt, Homo sapiens
ggucugugugauga

SEQ ID NO: 1315563 - RNA, 14 nt, Homo sapiens
ggugacagagcaag

SEQ ID NO: 1315564 - RNA, 17 nt, Homo sapiens
ggugaggggcuggcacu

SEQ ID NO: 1315565 - RNA, 17 nt, Homo sapiens
ggugcacucacuccuga

SEQ ID NO: 1315566 - RNA, 13 nt, Homo sapiens
ggugcagccagag

SEQ ID NO: 1315567 - RNA, 24 nt, Homo sapiens
ggugcagccagaggcaccucaaga

SEQ ID NO: 1315568 - RNA, 22 nt, Homo sapiens
ggugcagucacggcucacugca

SEQ ID NO: 1315569 - RNA, 18 nt, Homo sapiens
ggugccgggcucccccau

SEQ ID NO: 1315570 - RNA, 18 nt, Homo sapiens
ggugccugccauagccag

SEQ ID NO: 1315571 - RNA, 23 nt, Homo sapiens
ggugcuacacccuuuuccagcug

SEQ ID NO: 1315572 - RNA, 23 nt, Homo sapiens
ggugcucauucauuuaacagagc

SEQ ID NO: 1315573 - RNA, 21 nt, Homo sapiens
gguggaugccugguggcagcu

SEQ ID NO: 1315574 - RNA, 23 nt, Homo sapiens
gguggcuaccaugcaggauuuga

SEQ ID NO: 1315575 - RNA, 20 nt, Homo sapiens
ggugggcacccacccuggga

SEQ ID NO: 1315576 - RNA, 22 nt, Homo sapiens
ggugggcaccugaggcccaaua

SEQ ID NO: 1315577 - RNA, 16 nt, Homo sapiens
ggugguaagcaccagg

SEQ ID NO: 1315578 - RNA, 14 nt, Homo sapiens
gguggugucuccaa

SEQ ID NO: 1315579 - RNA, 17 nt, Homo sapiens
gguguaagccuucaaag

SEQ ID NO: 1315580 - RNA, 15 nt, Homo sapiens
gguuaaggccugaau

SEQ ID NO: 1315581 - RNA, 15 nt, Homo sapiens
gguuaucugggcaua

SEQ ID NO: 1315582 - RNA, 14 nt, Homo sapiens
gguucaacuuauua

SEQ ID NO: 1315583 - RNA, 15 nt, Homo sapiens
gguuccauucagugc

SEQ ID NO: 1315584 - RNA, 20 nt, Homo sapiens
gguuccugugauacauuucu

SEQ ID NO: 1315585 - RNA, 13 nt, Homo sapiens
guacuuacaucag

SEQ ID NO: 1315586 - RNA, 16 nt, Homo sapiens
guacuuuuuacauaca

SEQ ID NO: 1315587 - RNA, 21 nt, Homo sapiens
guagaaaauaaaacugagcua

SEQ ID NO: 1315588 - RNA, 16 nt, Homo sapiens
guagaauauucagaca

SEQ ID NO: 1315589 - RNA, 20 nt, Homo sapiens
guagagauggagucuugcua

SEQ ID NO: 1315590 - RNA, 23 nt, Homo sapiens
guagcagguuaccacucuggcag

SEQ ID NO: 1315591 - RNA, 20 nt, Homo sapiens
guagcugccccuggcucuga

SEQ ID NO: 1315592 - RNA, 11 nt, Homo sapiens
guagcugcuac

SEQ ID NO: 1315593 - RNA, 18 nt, Homo sapiens
guagcuggggcuacagga

SEQ ID NO: 1315594 - RNA, 20 nt, Homo sapiens
guaggaagaugauggcucau

SEQ ID NO: 1315595 - RNA, 13 nt, Homo sapiens
guaggacccaagc

SEQ ID NO: 1315596 - RNA, 21 nt, Homo sapiens
guaggagcugccuuggcucag

SEQ ID NO: 1315597 - RNA, 16 nt, Homo sapiens
guaggcuuaguuugug

SEQ ID NO: 1315598 - RNA, 20 nt, Homo sapiens
guagggccccugcacacuca

SEQ ID NO: 1315599 - RNA, 22 nt, Homo sapiens
guagguuaaaaaaauggcagug

SEQ ID NO: 1315600 - RNA, 16 nt, Homo sapiens
guagguuaacacugaa

SEQ ID NO: 1315601 - RNA, 17 nt, Homo sapiens
guaguuaaggagccuaa

SEQ ID NO: 1315602 - RNA, 16 nt, Homo sapiens
guaguuggcagaaaua

SEQ ID NO: 1315603 - RNA, 21 nt, Homo sapiens
guaguuuuuacagcuguguua

SEQ ID NO: 1315604 - RNA, 18 nt, Homo sapiens
guauaauuugcuggaaca

SEQ ID NO: 1315605 - RNA, 15 nt, Homo sapiens
guauauacaauaaca

SEQ ID NO: 1315606 - RNA, 23 nt, Homo sapiens
guauauuuugacgucacugauau

SEQ ID NO: 1315607 - RNA, 16 nt, Homo sapiens
guaucagaaguguuaa

SEQ ID NO: 1315608 - RNA, 22 nt, Homo sapiens
guaucagucagugcuggagaaa

SEQ ID NO: 1315609 - RNA, 17 nt, Homo sapiens
guaucaugcccugugca

SEQ ID NO: 1315610 - RNA, 18 nt, Homo sapiens
guaucaugcccugugcaa

SEQ ID NO: 1315611 - RNA, 23 nt, Homo sapiens
guauccagagauacuacaauauu

SEQ ID NO: 1315612 - RNA, 17 nt, Homo sapiens
guaugaucacggcucac

SEQ ID NO: 1315613 - RNA, 17 nt, Homo sapiens
guaugcuacaaucugug

SEQ ID NO: 1315614 - RNA, 17 nt, Homo sapiens
guauggacugacugggu

SEQ ID NO: 1315615 - RNA, 12 nt, Homo sapiens
guaugugcucuu

SEQ ID NO: 1315616 - RNA, 16 nt, Homo sapiens
guauucauauauugca

SEQ ID NO: 1315617 - RNA, 20 nt, Homo sapiens
guauucugacccaugggaga

SEQ ID NO: 1315618 - RNA, 21 nt, Homo sapiens
guauugucgguuaccucugca

SEQ ID NO: 1315619 - RNA, 15 nt, Homo sapiens
guauuuaacaaaaag

SEQ ID NO: 1315620 - RNA, 16 nt, Homo sapiens
guauuuuacuuuucca

SEQ ID NO: 1315621 - RNA, 16 nt, Homo sapiens
guauuuucaaccauaa

SEQ ID NO: 1315622 - RNA, 23 nt, Homo sapiens
guauuuucuuacacugugucauu

SEQ ID NO: 1315623 - RNA, 20 nt, Homo sapiens
guauuuuguuuuugucuuaa

SEQ ID NO: 1315624 - RNA, 17 nt, Homo sapiens
gucaaagugaugaauau

SEQ ID NO: 1315625 - RNA, 20 nt, Homo sapiens
gucaaauuccaaggaacuaa

SEQ ID NO: 1315626 - RNA, 14 nt, Homo sapiens
gucaacaguucaaa

SEQ ID NO: 1315627 - RNA, 12 nt, Homo sapiens
gucaacauugug

SEQ ID NO: 1315628 - RNA, 19 nt, Homo sapiens
gucaacuuuugaccaaaaa

SEQ ID NO: 1315629 - RNA, 19 nt, Homo sapiens
gucaagccugugcaaaaaa

SEQ ID NO: 1315630 - RNA, 20 nt, Homo sapiens
gucaauguugguuacuaaau

SEQ ID NO: 1315631 - RNA, 14 nt, Homo sapiens
gucaauuuaugaau

SEQ ID NO: 1315632 - RNA, 11 nt, Homo sapiens
gucacagggac

SEQ ID NO: 1315633 - RNA, 20 nt, Homo sapiens
gucacaugaaacauuugcaa

SEQ ID NO: 1315634 - RNA, 22 nt, Homo sapiens
gucacguggaggagcagugcag

SEQ ID NO: 1315635 - RNA, 11 nt, Homo sapiens
gucacugugag

SEQ ID NO: 1315636 - RNA, 16 nt, Homo sapiens
gucagcucucugcccu

SEQ ID NO: 1315637 - RNA, 15 nt, Homo sapiens
gucagucacagccac

SEQ ID NO: 1315638 - RNA, 19 nt, Homo sapiens
gucagugcccaacuguuau

SEQ ID NO: 1315639 - RNA, 23 nt, Homo sapiens
gucaucaggagaaaaagccucca

SEQ ID NO: 1315640 - RNA, 19 nt, Homo sapiens
guccaaggaaaccacagcu

SEQ ID NO: 1315641 - RNA, 17 nt, Homo sapiens
guccacaggaagugaag

SEQ ID NO: 1315642 - RNA, 20 nt, Homo sapiens
guccagaaggagacaggcag

SEQ ID NO: 1315643 - RNA, 15 nt, Homo sapiens
guccagaucuugccu

SEQ ID NO: 1315644 - RNA, 23 nt, Homo sapiens
guccauuaagcugagagugcuau

SEQ ID NO: 1315645 - RNA, 17 nt, Homo sapiens
guccauuguccaauccu

SEQ ID NO: 1315646 - RNA, 16 nt, Homo sapiens
gucccaaaugucauca

SEQ ID NO: 1315647 - RNA, 18 nt, Homo sapiens
gucccacucaggucugua

SEQ ID NO: 1315648 - RNA, 19 nt, Homo sapiens
gucccggggccagcacuuc

SEQ ID NO: 1315649 - RNA, 20 nt, Homo sapiens
gucccggggcuccacugaac

SEQ ID NO: 1315650 - RNA, 13 nt, Homo sapiens
gucccguggcauu

SEQ ID NO: 1315651 - RNA, 11 nt, Homo sapiens
gucccuaccuc

SEQ ID NO: 1315652 - RNA, 22 nt, Homo sapiens
gucccuguuuucccacgaggaa

SEQ ID NO: 1315653 - RNA, 13 nt, Homo sapiens
guccgagcuuuga

SEQ ID NO: 1315654 - RNA, 21 nt, Homo sapiens
guccucagccuugccagagau

SEQ ID NO: 1315655 - RNA, 20 nt, Homo sapiens
guccucccaauuucagacuc

SEQ ID NO: 1315656 - RNA, 23 nt, Homo sapiens
guccucuggguaggaaucagcaa

SEQ ID NO: 1315657 - RNA, 20 nt, Homo sapiens
guccugaaaguaacucauaa

SEQ ID NO: 1315658 - RNA, 12 nt, Homo sapiens
guccugcugcug

SEQ ID NO: 1315659 - RNA, 18 nt, Homo sapiens
guccuggauucacuggcu

SEQ ID NO: 1315660 - RNA, 12 nt, Homo sapiens
guccuggucaag

SEQ ID NO: 1315661 - RNA, 23 nt, Homo sapiens
guccuguuaacgucaucucaggg

SEQ ID NO: 1315662 - RNA, 23 nt, Homo sapiens
guccuuaaaaaucacacuguaaa

SEQ ID NO: 1315663 - RNA, 19 nt, Homo sapiens
guccuuaaugaagagccag

SEQ ID NO: 1315664 - RNA, 16 nt, Homo sapiens
gucgaacaauucauau

SEQ ID NO: 1315665 - RNA, 18 nt, Homo sapiens
gucgcaucucagugcagg

SEQ ID NO: 1315666 - RNA, 16 nt, Homo sapiens
gucgucuuaacucacc

SEQ ID NO: 1315667 - RNA, 14 nt, Homo sapiens
gucuaaaagcagaa

SEQ ID NO: 1315668 - RNA, 15 nt, Homo sapiens
gucuaaaaugccuca

SEQ ID NO: 1315669 - RNA, 19 nt, Homo sapiens
gucuaauagucuuugccag

SEQ ID NO: 1315670 - RNA, 20 nt, Homo sapiens
ugcaaauagcaaaacuaaau

SEQ ID NO: 1315671 - RNA, 21 nt, Homo sapiens
ugcaaauccuugauacugcuc

SEQ ID NO: 1315672 - RNA, 21 nt, Homo sapiens
ugcaaccucuuggccugauca

SEQ ID NO: 1315673 - RNA, 22 nt, Homo sapiens
ugcaagaauugaagcaggacua

SEQ ID NO: 1315674 - RNA, 15 nt, Homo sapiens
ugcaagcacaucugc

SEQ ID NO: 1315675 - RNA, 19 nt, Homo sapiens
ugcaagcacaucugcauuu

SEQ ID NO: 1315676 - RNA, 15 nt, Homo sapiens
ugcaauaaugcagua

SEQ ID NO: 1315677 - RNA, 17 nt, Homo sapiens
ugcaauagaacagagaa

SEQ ID NO: 1315678 - RNA, 18 nt, Homo sapiens
ugcaauaggugugcguca

SEQ ID NO: 1315679 - RNA, 20 nt, Homo sapiens
ugcaaugacucaggacaucc

SEQ ID NO: 1315680 - RNA, 18 nt, Homo sapiens
ugcaauuuuucaagagcu

SEQ ID NO: 1315681 - RNA, 18 nt, Homo sapiens
ugcacacccacucagcuc

SEQ ID NO: 1315682 - RNA, 13 nt, Homo sapiens
ugcacacucaguu

SEQ ID NO: 1315683 - RNA, 23 nt, Homo sapiens
ugcacauaguagguacccaauuc

SEQ ID NO: 1315684 - RNA, 14 nt, Homo sapiens
ugcaccacugcacu

SEQ ID NO: 1315685 - RNA, 22 nt, Homo sapiens
ugcaccccuccccauucacaga

SEQ ID NO: 1315686 - RNA, 13 nt, Homo sapiens
ugcacccuggaag

SEQ ID NO: 1315687 - RNA, 22 nt, Homo sapiens
ugcaccugggagaaagacuuug

SEQ ID NO: 1315688 - RNA, 20 nt, Homo sapiens
ugcacuauguauauacauau

SEQ ID NO: 1315689 - RNA, 18 nt, Homo sapiens
ugcacucagcucuuggcu

SEQ ID NO: 1315690 - RNA, 22 nt, Homo sapiens
ugcacuuauaagaaagaucaaa

SEQ ID NO: 1315691 - RNA, 15 nt, Homo sapiens
ugcagaaacagugca

SEQ ID NO: 1315692 - RNA, 17 nt, Homo sapiens
ugcagaaacaguucacc

SEQ ID NO: 1315693 - RNA, 13 nt, Homo sapiens
ugcagaagcagaa

SEQ ID NO: 1315694 - RNA, 17 nt, Homo sapiens
ugcagacaaacaaacau

SEQ ID NO: 1315695 - RNA, 22 nt, Homo sapiens
ugcagagaaacuuaagcaaagg

SEQ ID NO: 1315696 - RNA, 16 nt, Homo sapiens
ugcagaggaaguacaa

SEQ ID NO: 1315697 - RNA, 19 nt, Homo sapiens
ugcagaggccugggggacc

SEQ ID NO: 1315698 - RNA, 18 nt, Homo sapiens
ugcagcagggucaucugu

SEQ ID NO: 1315699 - RNA, 11 nt, Homo sapiens
ugcagccagag

SEQ ID NO: 1315700 - RNA, 16 nt, Homo sapiens
ugcagccucaaccucc

SEQ ID NO: 1315701 - RNA, 15 nt, Homo sapiens
ugcagcuuauauuca

SEQ ID NO: 1315702 - RNA, 19 nt, Homo sapiens
ugcagcuuauauucaucca

SEQ ID NO: 1315703 - RNA, 14 nt, Homo sapiens
ugcaggaaaacuga

SEQ ID NO: 1315704 - RNA, 16 nt, Homo sapiens
ugcaggacuugagaag

SEQ ID NO: 1315705 - RNA, 17 nt, Homo sapiens
ugcaggagagacaguga

SEQ ID NO: 1315706 - RNA, 13 nt, Homo sapiens
ugcaggcacagua

SEQ ID NO: 1315707 - RNA, 18 nt, Homo sapiens
ugcagggccgccagggag

SEQ ID NO: 1315708 - RNA, 23 nt, Homo sapiens
ugcagguucauggauuacuucuc

SEQ ID NO: 1315709 - RNA, 22 nt, Homo sapiens
ugcagguuggaacuaugcagug

SEQ ID NO: 1315710 - RNA, 22 nt, Homo sapiens
ugcagguuuagaggaccaguga

SEQ ID NO: 1315711 - RNA, 18 nt, Homo sapiens
ugcagucaucuugaccaa

SEQ ID NO: 1315712 - RNA, 23 nt, Homo sapiens
ugcagugguaugaucacggcuca

SEQ ID NO: 1315713 - RNA, 17 nt, Homo sapiens
ugcaguggugugaucuc

SEQ ID NO: 1315714 - RNA, 14 nt, Homo sapiens
ugcaguuugaaauu

SEQ ID NO: 1315715 - RNA, 22 nt, Homo sapiens
ugcaguuugaaauucugaauuu

SEQ ID NO: 1315716 - RNA, 21 nt, Homo sapiens
ugcauaaaauagagugcauuu

SEQ ID NO: 1315717 - RNA, 22 nt, Homo sapiens
ugcauaaaugcgauccacagaa

SEQ ID NO: 1315718 - RNA, 21 nt, Homo sapiens
ugcauagcagaugguuuccac

SEQ ID NO: 1315719 - RNA, 17 nt, Homo sapiens
ugcauagcagcugcuac

SEQ ID NO: 1315720 - RNA, 23 nt, Homo sapiens
ugcaucuaagcccaugggacaaa

SEQ ID NO: 1315721 - RNA, 13 nt, Homo sapiens
ugcaucucuaaua

SEQ ID NO: 1315722 - RNA, 16 nt, Homo sapiens
ugcaucugaccagcag

SEQ ID NO: 1315723 - RNA, 21 nt, Homo sapiens
ugcaucuguauaaguaagaaa

SEQ ID NO: 1315724 - RNA, 23 nt, Homo sapiens
ugcaucuguuuauucuauaguua

SEQ ID NO: 1315725 - RNA, 20 nt, Homo sapiens
ugcauggaacccccagaaua

SEQ ID NO: 1315726 - RNA, 21 nt, Homo sapiens
ugcauguaaacacgccugcaa

SEQ ID NO: 1315727 - RNA, 22 nt, Homo sapiens
ugcauguccucuuguugcugag

SEQ ID NO: 1315728 - RNA, 22 nt, Homo sapiens
ugcauguuuuccagcuccucau

SEQ ID NO: 1315729 - RNA, 23 nt, Homo sapiens
ugcauucaccugcccugugcaug

SEQ ID NO: 1315730 - RNA, 18 nt, Homo sapiens
ugcauugagaacugcaua

SEQ ID NO: 1315731 - RNA, 23 nt, Homo sapiens
ugcauuuaaauacagucuuccau

SEQ ID NO: 1315732 - RNA, 13 nt, Homo sapiens
ugcauuuauagca

SEQ ID NO: 1315733 - RNA, 21 nt, Homo sapiens
ugcauuugugucauugacaaa

SEQ ID NO: 1315734 - RNA, 21 nt, Homo sapiens
ugcauuuuugaagacaucaaa

SEQ ID NO: 1315735 - RNA, 10 nt, Homo sapiens
ugccaaaaaa

SEQ ID NO: 1315736 - RNA, 15 nt, Homo sapiens
ugccaaaaaaagaca

SEQ ID NO: 1315737 - RNA, 20 nt, Homo sapiens
ugccaaccggucacccagga

SEQ ID NO: 1315738 - RNA, 17 nt, Homo sapiens
ugccaccccuaaacucc

SEQ ID NO: 1315739 - RNA, 18 nt, Homo sapiens
ugccaccuccugccucag

SEQ ID NO: 1315740 - RNA, 12 nt, Homo sapiens
ugccaucaucuc

SEQ ID NO: 1315741 - RNA, 23 nt, Homo sapiens
ugccaugccagcuuaucucaggg

SEQ ID NO: 1315742 - RNA, 11 nt, Homo sapiens
ugccaugucug

SEQ ID NO: 1315743 - RNA, 21 nt, Homo sapiens
ugcccaaccuauccuguucuu

SEQ ID NO: 1315744 - RNA, 20 nt, Homo sapiens
ugcccacgcuggagugcagu

SEQ ID NO: 1315745 - RNA, 16 nt, Homo sapiens
ugcccagcacaggaau

SEQ ID NO: 1315746 - RNA, 20 nt, Homo sapiens
ugcccaggcuggcgugcagu

SEQ ID NO: 1315747 - RNA, 20 nt, Homo sapiens
ugccccaaacaaauaugcaa

SEQ ID NO: 1315748 - RNA, 20 nt, Homo sapiens
ugccccauucucacugcuau

SEQ ID NO: 1315749 - RNA, 22 nt, Homo sapiens
ugccccucccagaacacacucc

SEQ ID NO: 1315750 - RNA, 12 nt, Homo sapiens
ugccccucucgu

SEQ ID NO: 1315751 - RNA, 14 nt, Homo sapiens
ugccccucucuggg

SEQ ID NO: 1315752 - RNA, 21 nt, Homo sapiens
ugccccuggaugcacuuucau

SEQ ID NO: 1315753 - RNA, 23 nt, Homo sapiens
ugcccguaaacacgccugcaaac

SEQ ID NO: 1315754 - RNA, 13 nt, Homo sapiens
ugcccuaaacccu

SEQ ID NO: 1315755 - RNA, 14 nt, Homo sapiens
ugcccucagauucc

SEQ ID NO: 1315756 - RNA, 15 nt, Homo sapiens
ugcccuccuucccaa

SEQ ID NO: 1315757 - RNA, 17 nt, Homo sapiens
ugcccucuuuagccaga

SEQ ID NO: 1315758 - RNA, 16 nt, Homo sapiens
ugcccuggcaccugug

SEQ ID NO: 1315759 - RNA, 16 nt, Homo sapiens
ugcccuggggaucaaa

SEQ ID NO: 1315760 - RNA, 19 nt, Homo sapiens
ugcccuguaccugugcacg

SEQ ID NO: 1315761 - RNA, 16 nt, Homo sapiens
ugcccuguguacuucc

SEQ ID NO: 1315762 - RNA, 20 nt, Homo sapiens
ugcccuuaaacauuggacag

SEQ ID NO: 1315763 - RNA, 22 nt, Homo sapiens
ugccggagaggaagagacacuc

SEQ ID NO: 1315764 - RNA, 22 nt, Homo sapiens
ugccuaaggugucugaguuucu

SEQ ID NO: 1315765 - RNA, 22 nt, Homo sapiens
ugccuacgaauagccacugcau

SEQ ID NO: 1315766 - RNA, 17 nt, Homo sapiens
ugccuagaggugcucau

SEQ ID NO: 1315767 - RNA, 18 nt, Homo sapiens
ugccuauuuguguggaca

SEQ ID NO: 1315768 - RNA, 19 nt, Homo sapiens
ugccuccugaugggacaua

SEQ ID NO: 1315769 - RNA, 18 nt, Homo sapiens
ugccucgaacuggcugca

SEQ ID NO: 1315770 - RNA, 22 nt, Homo sapiens
uucaauucucauuugucacaca

SEQ ID NO: 1315771 - RNA, 17 nt, Homo sapiens
uucaauugcaucuccca

SEQ ID NO: 1315772 - RNA, 16 nt, Homo sapiens
uucacacuguccccca

SEQ ID NO: 1315773 - RNA, 19 nt, Homo sapiens
uucacagcccugcagugcc

SEQ ID NO: 1315774 - RNA, 21 nt, Homo sapiens
uucacaguucuuugggccaga

SEQ ID NO: 1315775 - RNA, 17 nt, Homo sapiens
uucacauuagaagacaa

SEQ ID NO: 1315776 - RNA, 22 nt, Homo sapiens
uucaccauauugcccagggugg

SEQ ID NO: 1315777 - RNA, 20 nt, Homo sapiens
uucaccuccuucaauuccau

SEQ ID NO: 1315778 - RNA, 21 nt, Homo sapiens
uucaccugggcugaggcaucc

SEQ ID NO: 1315779 - RNA, 16 nt, Homo sapiens
uucacguguaccugug

SEQ ID NO: 1315780 - RNA, 17 nt, Homo sapiens
uucacugacugucuccu

SEQ ID NO: 1315781 - RNA, 15 nt, Homo sapiens
uucacuuuugacaaa

SEQ ID NO: 1315782 - RNA, 19 nt, Homo sapiens
uucagagaccauugcaaug

SEQ ID NO: 1315783 - RNA, 22 nt, Homo sapiens
uucagauuauccuuccuccuca

SEQ ID NO: 1315784 - RNA, 16 nt, Homo sapiens
uucagcagagcugaaa

SEQ ID NO: 1315785 - RNA, 13 nt, Homo sapiens
uucagccagguga

SEQ ID NO: 1315786 - RNA, 21 nt, Homo sapiens
uucagccaggugaacuggaau

SEQ ID NO: 1315787 - RNA, 19 nt, Homo sapiens
uucagcucacggaagggau

SEQ ID NO: 1315788 - RNA, 15 nt, Homo sapiens
uucagcugguugagg

SEQ ID NO: 1315789 - RNA, 15 nt, Homo sapiens
uucagggaacugcau

SEQ ID NO: 1315790 - RNA, 13 nt, Homo sapiens
uucagggagacaa

SEQ ID NO: 1315791 - RNA, 18 nt, Homo sapiens
uucagguacuaaauaccu

SEQ ID NO: 1315792 - RNA, 14 nt, Homo sapiens
uucaguggcagcug

SEQ ID NO: 1315793 - RNA, 17 nt, Homo sapiens
uucaguuuauuuccacu

SEQ ID NO: 1315794 - RNA, 21 nt, Homo sapiens
uucaugaguuuuucccagcua

SEQ ID NO: 1315795 - RNA, 13 nt, Homo sapiens
uucauggaacuca

SEQ ID NO: 1315796 - RNA, 16 nt, Homo sapiens
uucauggucugcugag

SEQ ID NO: 1315797 - RNA, 19 nt, Homo sapiens
uucauucacucaacaaaca

SEQ ID NO: 1315798 - RNA, 13 nt, Homo sapiens
uucauucugcaag

SEQ ID NO: 1315799 - RNA, 17 nt, Homo sapiens
uucauuucauguauagu

SEQ ID NO: 1315800 - RNA, 16 nt, Homo sapiens
uucauuuguggugaua

SEQ ID NO: 1315801 - RNA, 23 nt, Homo sapiens
uucauuuuugauagcugucccau

SEQ ID NO: 1315802 - RNA, 17 nt, Homo sapiens
uuccaaaauaaagcaua

SEQ ID NO: 1315803 - RNA, 18 nt, Homo sapiens
uuccaaagaaaaguauug

SEQ ID NO: 1315804 - RNA, 17 nt, Homo sapiens
uuccacuuguuugcacu

SEQ ID NO: 1315805 - RNA, 16 nt, Homo sapiens
uuccagcacuuugcaa

SEQ ID NO: 1315806 - RNA, 11 nt, Homo sapiens
uuccagccaca

SEQ ID NO: 1315807 - RNA, 23 nt, Homo sapiens
uuccagcuuagaaugcaucucau

SEQ ID NO: 1315808 - RNA, 23 nt, Homo sapiens
uuccaguggcuuggguucacagu

SEQ ID NO: 1315809 - RNA, 19 nt, Homo sapiens
uuccaguucaucuauggca

SEQ ID NO: 1315810 - RNA, 19 nt, Homo sapiens
uuccaucuaguaccagagg

SEQ ID NO: 1315811 - RNA, 21 nt, Homo sapiens
uuccaucuccauccaagcaaa

SEQ ID NO: 1315812 - RNA, 21 nt, Homo sapiens
uuccauuuauucuuugaucuu

SEQ ID NO: 1315813 - RNA, 16 nt, Homo sapiens
uucccacaggacauuu

SEQ ID NO: 1315814 - RNA, 17 nt, Homo sapiens
uucccagagucaucuga

SEQ ID NO: 1315815 - RNA, 14 nt, Homo sapiens
uucccagcuaggaa

SEQ ID NO: 1315816 - RNA, 12 nt, Homo sapiens
uuccccacugac

SEQ ID NO: 1315817 - RNA, 12 nt, Homo sapiens
uuccccagagaa

SEQ ID NO: 1315818 - RNA, 22 nt, Homo sapiens
uuccccagccccuuggauguga

SEQ ID NO: 1315819 - RNA, 17 nt, Homo sapiens
uuccccugugucauccc

SEQ ID NO: 1315820 - RNA, 20 nt, Homo sapiens
uucccuaacacuuaccccau

SEQ ID NO: 1315821 - RNA, 17 nt, Homo sapiens
uucccuacaguugaaaa

SEQ ID NO: 1315822 - RNA, 22 nt, Homo sapiens
uucccugaauguauugaacuug

SEQ ID NO: 1315823 - RNA, 20 nt, Homo sapiens
uucccuuuaugcacccaaga

SEQ ID NO: 1315824 - RNA, 19 nt, Homo sapiens
uucccuuugauacagucaa

SEQ ID NO: 1315825 - RNA, 18 nt, Homo sapiens
uucccuuuggcagcugca

SEQ ID NO: 1315826 - RNA, 21 nt, Homo sapiens
uuccgcaccaauaaagccuuc

SEQ ID NO: 1315827 - RNA, 21 nt, Homo sapiens
uuccgucaccacgacuggcca

SEQ ID NO: 1315828 - RNA, 17 nt, Homo sapiens
uuccguggcacugcaua

SEQ ID NO: 1315829 - RNA, 17 nt, Homo sapiens
uuccuaaagcaugggau

SEQ ID NO: 1315830 - RNA, 21 nt, Homo sapiens
uuccuaugcuuugaaacagaa

SEQ ID NO: 1315831 - RNA, 23 nt, Homo sapiens
uuccucauuagcauuuugcuaaa

SEQ ID NO: 1315832 - RNA, 17 nt, Homo sapiens
uuccucccuucugcuac

SEQ ID NO: 1315833 - RNA, 23 nt, Homo sapiens
uuccuccucacccugccggguag

SEQ ID NO: 1315834 - RNA, 15 nt, Homo sapiens
uuccugcuuauucau

SEQ ID NO: 1315835 - RNA, 20 nt, Homo sapiens
uuccugcuuauucauaauaa

SEQ ID NO: 1315836 - RNA, 15 nt, Homo sapiens
uuccuguccagcucc

SEQ ID NO: 1315837 - RNA, 12 nt, Homo sapiens
uuccugugagcu

SEQ ID NO: 1315838 - RNA, 15 nt, Homo sapiens
uuccuguucaguaau

SEQ ID NO: 1315839 - RNA, 21 nt, Homo sapiens
uuccuucaugaucaucacaau

SEQ ID NO: 1315840 - RNA, 11 nt, Homo sapiens
uuccuugagaa

SEQ ID NO: 1315841 - RNA, 19 nt, Homo sapiens
uuccuuggcaguggacuca

SEQ ID NO: 1315842 - RNA, 18 nt, Homo sapiens
uuccuuuccuaaaagugu

SEQ ID NO: 1315843 - RNA, 20 nt, Homo sapiens
uuccuuuuuaaccauuccaa

SEQ ID NO: 1315844 - RNA, 16 nt, Homo sapiens
uucggacaacucaguc

SEQ ID NO: 1315845 - RNA, 15 nt, Homo sapiens
uucggguuggcaaaa

SEQ ID NO: 1315846 - RNA, 18 nt, Homo sapiens
uucgguacuuacccggag

SEQ ID NO: 1315847 - RNA, 16 nt, Homo sapiens
uucguuacaucuugua

SEQ ID NO: 1315848 - RNA, 14 nt, Homo sapiens
uucuagcuucccuu

SEQ ID NO: 1315849 - RNA, 14 nt, Homo sapiens
uucuaggauagcua

SEQ ID NO: 1315850 - RNA, 22 nt, Homo sapiens
uucuaggcaaaauugugaagcu

SEQ ID NO: 1315851 - RNA, 17 nt, Homo sapiens
uucuaggcuuuguggua

SEQ ID NO: 1315852 - RNA, 21 nt, Homo sapiens
uucuauuuauauguacaugag

SEQ ID NO: 1315853 - RNA, 15 nt, Homo sapiens
uucuauuuauuuacu

SEQ ID NO: 1315854 - RNA, 19 nt, Homo sapiens
uucucacaaugucccuuca

SEQ ID NO: 1315855 - RNA, 16 nt, Homo sapiens
uucucagcuggaugau

SEQ ID NO: 1315856 - RNA, 15 nt, Homo sapiens
uucucagguugccag

SEQ ID NO: 1315857 - RNA, 20 nt, Homo sapiens
uucucauccugcaggcagcu

SEQ ID NO: 1315858 - RNA, 14 nt, Homo sapiens
uucucauuucaccc

SEQ ID NO: 1315859 - RNA, 17 nt, Homo sapiens
uucucccaccaccucac

SEQ ID NO: 1315860 - RNA, 17 nt, Homo sapiens
uucuccugugugauuga

SEQ ID NO: 1315861 - RNA, 14 nt, Homo sapiens
uucucggguucucu

SEQ ID NO: 1315862 - RNA, 13 nt, Homo sapiens
uucucucacugug

SEQ ID NO: 1315863 - RNA, 22 nt, Homo sapiens
uucucucucucuuugaucccau

SEQ ID NO: 1315864 - RNA, 19 nt, Homo sapiens
uucucugccgcuaccuccc

SEQ ID NO: 1315865 - RNA, 22 nt, Homo sapiens
uucucuuaugaucaccauguau

SEQ ID NO: 1315866 - RNA, 16 nt, Homo sapiens
uucugaauuugcaaag

SEQ ID NO: 1315867 - RNA, 12 nt, Homo sapiens
uucugagcaaac

SEQ ID NO: 1315868 - RNA, 20 nt, Homo sapiens
uucugagcuguaucuugaug

SEQ ID NO: 1315869 - RNA, 20 nt, Homo sapiens
uucugcaucacccaaucaau

SEQ ID NO: 1315870 - RNA, 13 nt, Homo sapiens
uucugcucacaua

SEQ ID NO: 1315871 - RNA, 14 nt, Homo sapiens
uucuggcacauaaa

SEQ ID NO: 1315872 - RNA, 21 nt, Homo sapiens
uucuguauuuuuuguuuguau

SEQ ID NO: 1315873 - RNA, 21 nt, Homo sapiens
uucugucccucacagcacuag

SEQ ID NO: 1315874 - RNA, 21 nt, Homo sapiens
uucuuaauccaguucugcaaa

SEQ ID NO: 1315875 - RNA, 12 nt, Homo sapiens
uucuuacacugu

SEQ ID NO: 1315876 - RNA, 20 nt, Homo sapiens
uucuuagauacacuaaaaau

SEQ ID NO: 1315877 - RNA, 13 nt, Homo sapiens
uucuucuaccaga

SEQ ID NO: 1315878 - RNA, 14 nt, Homo sapiens
uucuucuacugcua

SEQ ID NO: 1315879 - RNA, 15 nt, Homo sapiens
uucuucuacugcuau

SEQ ID NO: 1315880 - RNA, 15 nt, Homo sapiens
uucuucuguccugag

SEQ ID NO: 1315881 - RNA, 19 nt, Homo sapiens
uucuugacauuuaaacuca

SEQ ID NO: 1315882 - RNA, 13 nt, Homo sapiens
uucuuguauucau

SEQ ID NO: 1315883 - RNA, 12 nt, Homo sapiens
uucuugucuuua

SEQ ID NO: 1315884 - RNA, 14 nt, Homo sapiens
uucuuuccauaaua

SEQ ID NO: 1315885 - RNA, 12 nt, Homo sapiens
uucuuugcaaag

SEQ ID NO: 1315886 - RNA, 17 nt, Homo sapiens
uucuuugggccagacau

SEQ ID NO: 1315887 - RNA, 17 nt, Homo sapiens
uucuuuguaccaucugu

SEQ ID NO: 1315888 - RNA, 13 nt, Homo sapiens
uugaaaaaguaua

SEQ ID NO: 1315889 - RNA, 15 nt, Homo sapiens
uugaaaaauaguauu

SEQ ID NO: 1315890 - RNA, 13 nt, Homo sapiens
uugaaaagucaaa

SEQ ID NO: 1315891 - RNA, 20 nt, Homo sapiens
uugaaauuaagaaggcaaaa

SEQ ID NO: 1315892 - RNA, 17 nt, Homo sapiens
uugaaauuguaagugaa

SEQ ID NO: 1315893 - RNA, 14 nt, Homo sapiens
uugaagaagauaug

SEQ ID NO: 1315894 - RNA, 14 nt, Homo sapiens
uugaagagaguugc

SEQ ID NO: 1315895 - RNA, 17 nt, Homo sapiens
uugacaaauguaaacau

SEQ ID NO: 1315896 - RNA, 13 nt, Homo sapiens
uugacaacaguua

SEQ ID NO: 1315897 - RNA, 21 nt, Homo sapiens
uugacauaggcaauaauaagu

SEQ ID NO: 1315898 - RNA, 22 nt, Homo sapiens
uugacuagaugauggaugccaa

SEQ ID NO: 1315899 - RNA, 22 nt, Homo sapiens
uugagauguugaaauuacauua

SEQ ID NO: 1315900 - RNA, 16 nt, Homo sapiens
uugagcaggucucaua

SEQ ID NO: 1315901 - RNA, 20 nt, Homo sapiens
uugagcaucacagaauguga

SEQ ID NO: 1315902 - RNA, 17 nt, Homo sapiens
uugaggauuuugaucca

SEQ ID NO: 1315903 - RNA, 18 nt, Homo sapiens
uugagggacugagccaga

SEQ ID NO: 1315904 - RNA, 16 nt, Homo sapiens
uugagggugacagcca

SEQ ID NO: 1315905 - RNA, 21 nt, Homo sapiens
uugaguuguuuggaugauuaa

SEQ ID NO: 1315906 - RNA, 23 nt, Homo sapiens
uugauccuuaccuuguauaucau

SEQ ID NO: 1315907 - RNA, 14 nt, Homo sapiens
uugaugcaugcacu

SEQ ID NO: 1315908 - RNA, 14 nt, Homo sapiens
uugauucaguauua

SEQ ID NO: 1315909 - RNA, 14 nt, Homo sapiens
uugauucugauaau

SEQ ID NO: 1315910 - RNA, 15 nt, Homo sapiens
uugcaaaaacuacaa

SEQ ID NO: 1315911 - RNA, 16 nt, Homo sapiens
uugcaacucuguaaau

SEQ ID NO: 1315912 - RNA, 22 nt, Homo sapiens
uugcaacuucuaaacacaaaua

SEQ ID NO: 1315913 - RNA, 14 nt, Homo sapiens
uugcaauggcagcc

SEQ ID NO: 1315914 - RNA, 13 nt, Homo sapiens
uugcacauaguag

SEQ ID NO: 1315915 - RNA, 18 nt, Homo sapiens
uugcaccguucucuguau

SEQ ID NO: 1315916 - RNA, 18 nt, Homo sapiens
uugcacugaaauggaauu

SEQ ID NO: 1315917 - RNA, 18 nt, Homo sapiens
uugcagacaggaaucuua

SEQ ID NO: 1315918 - RNA, 17 nt, Homo sapiens
uugcagauaacuuugac

SEQ ID NO: 1315919 - RNA, 20 nt, Homo sapiens
uugcagcuuauauucaucca

SEQ ID NO: 1315920 - RNA, 18 nt, Homo sapiens
uugcaggaccucagguga

SEQ ID NO: 1315921 - RNA, 20 nt, Homo sapiens
uugcaggaccucaggugaga

SEQ ID NO: 1315922 - RNA, 19 nt, Homo sapiens
uugcaggaggcccaaccuc

SEQ ID NO: 1315923 - RNA, 18 nt, Homo sapiens
uugcaggcagaaggcagu

SEQ ID NO: 1315924 - RNA, 17 nt, Homo sapiens
uugcaugugacucugaa

SEQ ID NO: 1315925 - RNA, 23 nt, Homo sapiens
uugcauugugacaagaauuguua

SEQ ID NO: 1315926 - RNA, 14 nt, Homo sapiens
uugccagaaccaaa

SEQ ID NO: 1315927 - RNA, 14 nt, Homo sapiens
uugccagcagagua

SEQ ID NO: 1315928 - RNA, 16 nt, Homo sapiens
uugcccaccagaucau

SEQ ID NO: 1315929 - RNA, 13 nt, Homo sapiens
uugcguacacaga

SEQ ID NO: 1315930 - RNA, 15 nt, Homo sapiens
uugcuauauugccca

SEQ ID NO: 1315931 - RNA, 22 nt, Homo sapiens
uugcugccaaacacccaugccc

SEQ ID NO: 1315932 - RNA, 11 nt, Homo sapiens
uugcuguauau

SEQ ID NO: 1315933 - RNA, 13 nt, Homo sapiens
uugcuguugucca

SEQ ID NO: 1315934 - RNA, 20 nt, Homo sapiens
uugcuuccccuuuugccaau

SEQ ID NO: 1315935 - RNA, 15 nt, Homo sapiens
uugcuuuauuccaga

SEQ ID NO: 1315936 - RNA, 22 nt, Homo sapiens
uugcuuucgcuucuacagugca

SEQ ID NO: 1315937 - RNA, 15 nt, Homo sapiens
uugcuuuugcuucua

SEQ ID NO: 1315938 - RNA, 14 nt, Homo sapiens
uuggaacagugaau

SEQ ID NO: 1315939 - RNA, 21 nt, Homo sapiens
uuggaacuuuuauuacugggg

SEQ ID NO: 1315940 - RNA, 18 nt, Homo sapiens
uuggaaggcaaagacauu

SEQ ID NO: 1315941 - RNA, 12 nt, Homo sapiens
uuggagcugucu

SEQ ID NO: 1315942 - RNA, 19 nt, Homo sapiens
uuggauacauacaccagca

SEQ ID NO: 1315943 - RNA, 20 nt, Homo sapiens
uuggauacauacaccagcau

SEQ ID NO: 1315944 - RNA, 22 nt, Homo sapiens
uuggaugcagugcucgcuguug

SEQ ID NO: 1315945 - RNA, 15 nt, Homo sapiens
uuggaugcccugugg

SEQ ID NO: 1315946 - RNA, 15 nt, Homo sapiens
uuggauugggguccc

SEQ ID NO: 1315947 - RNA, 13 nt, Homo sapiens
uuggcaaauacua

SEQ ID NO: 1315948 - RNA, 13 nt, Homo sapiens
uuggcacccaaga

SEQ ID NO: 1315949 - RNA, 18 nt, Homo sapiens
uuggcaggcuggccaguc

SEQ ID NO: 1315950 - RNA, 16 nt, Homo sapiens
uuggcaguggacucag

SEQ ID NO: 1315951 - RNA, 17 nt, Homo sapiens
uuggcaguggacucaga

SEQ ID NO: 1315952 - RNA, 16 nt, Homo sapiens
uuggccaucucuggau

SEQ ID NO: 1315953 - RNA, 14 nt, Homo sapiens
uuggccucccaaaa

SEQ ID NO: 1315954 - RNA, 16 nt, Homo sapiens
uuggcuauaaccucca

SEQ ID NO: 1315955 - RNA, 22 nt, Homo sapiens
uugggaggcugaggcaagagaa

SEQ ID NO: 1315956 - RNA, 21 nt, Homo sapiens
uugggaucagcaggccaggca

SEQ ID NO: 1315957 - RNA, 23 nt, Homo sapiens
uugggauggaauggccucugaaa

SEQ ID NO: 1315958 - RNA, 21 nt, Homo sapiens
uugggcaccucgacuugugaa

SEQ ID NO: 1315959 - RNA, 15 nt, Homo sapiens
uugggccugcuccag

SEQ ID NO: 1315960 - RNA, 20 nt, Homo sapiens
uuggggaugagaaagguuga

SEQ ID NO: 1315961 - RNA, 16 nt, Homo sapiens
uuggggcagaccccag

SEQ ID NO: 1315962 - RNA, 23 nt, Homo sapiens
uugggguagguagauaccaaaug

SEQ ID NO: 1315963 - RNA, 17 nt, Homo sapiens
uugggugaacuaaccaa

SEQ ID NO: 1315964 - RNA, 18 nt, Homo sapiens
uugggugugugguggauu

SEQ ID NO: 1315965 - RNA, 20 nt, Homo sapiens
uugguaagugcagcuugaau

SEQ ID NO: 1315966 - RNA, 23 nt, Homo sapiens
uugguagcaauuggcagcccuau

SEQ ID NO: 1315967 - RNA, 19 nt, Homo sapiens
uuggucacauauaugccua

SEQ ID NO: 1315968 - RNA, 16 nt, Homo sapiens
uuggugaauuucacaa

SEQ ID NO: 1315969 - RNA, 11 nt, Homo sapiens
uuggugacaau

SEQ ID NO: 1315970 - RNA, 21 nt, Homo sapiens
uuggugacuucacagugaagu

SEQ ID NO: 1315971 - RNA, 11 nt, Homo sapiens
uugguggcaug

SEQ ID NO: 1315972 - RNA, 19 nt, Homo sapiens
uuggugugugugacaauuc

SEQ ID NO: 1315973 - RNA, 14 nt, Homo sapiens
uugguuugacccag

SEQ ID NO: 1315974 - RNA, 17 nt, Homo sapiens
uugguuuuaauacuuga

SEQ ID NO: 1315975 - RNA, 15 nt, Homo sapiens
uuguaaaauguucuc

SEQ ID NO: 1315976 - RNA, 20 nt, Homo sapiens
uuguaaagugaagaauccuu

SEQ ID NO: 1315977 - RNA, 20 nt, Homo sapiens
uuguaaauaaagcccuggga

SEQ ID NO: 1315978 - RNA, 17 nt, Homo sapiens
uuguaaauagcucaggu

SEQ ID NO: 1315979 - RNA, 15 nt, Homo sapiens
uuguaaauaggauuu

SEQ ID NO: 1315980 - RNA, 17 nt, Homo sapiens
uuguaaaucacauccuu

SEQ ID NO: 1315981 - RNA, 18 nt, Homo sapiens
uuguaaggcuuugauuag

SEQ ID NO: 1315982 - RNA, 24 nt, Homo sapiens
uuguaagugaaguaaaacuuaaga

SEQ ID NO: 1315983 - RNA, 19 nt, Homo sapiens
uuguaauuuuacacaaaua

SEQ ID NO: 1315984 - RNA, 21 nt, Homo sapiens
uuguacauagugaggagcuuu

SEQ ID NO: 1315985 - RNA, 22 nt, Homo sapiens
uuguagagauggggucucacag

SEQ ID NO: 1315986 - RNA, 21 nt, Homo sapiens
uuguagagccagggucucacu

SEQ ID NO: 1315987 - RNA, 19 nt, Homo sapiens
uuguagccacaagccugaa

SEQ ID NO: 1315988 - RNA, 21 nt, Homo sapiens
uuguaggagaaacucccaugu

SEQ ID NO: 1315989 - RNA, 23 nt, Homo sapiens
uuguaguugcaauagaacagaga

SEQ ID NO: 1315990 - RNA, 17 nt, Homo sapiens
uuguauuaucaacagca

SEQ ID NO: 1315991 - RNA, 20 nt, Homo sapiens
uugucaagucagaacagcca

SEQ ID NO: 1315992 - RNA, 17 nt, Homo sapiens
uugucaaugauuuguca

SEQ ID NO: 1315993 - RNA, 16 nt, Homo sapiens
uugucauauacugcuu

SEQ ID NO: 1315994 - RNA, 14 nt, Homo sapiens
uugucccucugccc

SEQ ID NO: 1315995 - RNA, 18 nt, Homo sapiens
uugucuaaacaaugcuga

SEQ ID NO: 1315996 - RNA, 23 nt, Homo sapiens
uugucuaauuaaaacacuuucaa

SEQ ID NO: 1315997 - RNA, 15 nt, Homo sapiens
uugucuaccuucuuu

SEQ ID NO: 1315998 - RNA, 17 nt, Homo sapiens
uugucucugugacugaa

SEQ ID NO: 1315999 - RNA, 15 nt, Homo sapiens
uuguucuaguuuuca

SEQ ID NO: 1316000 - RNA, 22 nt, Homo sapiens
uuguuggauccguuugaccaau

SEQ ID NO: 1316001 - RNA, 13 nt, Homo sapiens
uuguugugugugc

SEQ ID NO: 1316002 - RNA, 14 nt, Homo sapiens
uuguuuaacuguga

SEQ ID NO: 1316003 - RNA, 19 nt, Homo sapiens
uuguuuuguagcaaccauu

SEQ ID NO: 1316004 - RNA, 16 nt, Homo sapiens
uuuaaaaaaaagcaua

SEQ ID NO: 1316005 - RNA, 17 nt, Homo sapiens
uuuaaaaagugugcuua

SEQ ID NO: 1316006 - RNA, 18 nt, Homo sapiens
uuuaaaagucucacaaag

SEQ ID NO: 1316007 - RNA, 22 nt, Homo sapiens
uuuaaaauacugauacauccau

SEQ ID NO: 1316008 - RNA, 15 nt, Homo sapiens
uuuaaaauaugcucu

SEQ ID NO: 1316009 - RNA, 21 nt, Homo sapiens
uuuaaacauuuuuaucuauca

SEQ ID NO: 1316010 - RNA, 15 nt, Homo sapiens
uuuaagaauuucaca

SEQ ID NO: 1316011 - RNA, 14 nt, Homo sapiens
uuuaagcuaccaau

SEQ ID NO: 1316012 - RNA, 13 nt, Homo sapiens
uuuaagcuguaca

SEQ ID NO: 1316013 - RNA, 15 nt, Homo sapiens
uuuaagucacauuau

SEQ ID NO: 1316014 - RNA, 14 nt, Homo sapiens
uuuaaucaccacuc

SEQ ID NO: 1316015 - RNA, 12 nt, Homo sapiens
uuuaaugaguca

SEQ ID NO: 1316016 - RNA, 22 nt, Homo sapiens
uuuaauggacacuuuucaccuc

SEQ ID NO: 1316017 - RNA, 13 nt, Homo sapiens
uuuaauucugucu

SEQ ID NO: 1316018 - RNA, 14 nt, Homo sapiens
uuuacaaccugaug

SEQ ID NO: 1316019 - RNA, 21 nt, Homo sapiens
uuuacaacucaaaaaacauug

SEQ ID NO: 1316020 - RNA, 23 nt, Homo sapiens
uuuacaauaaaacuuugcugcca

SEQ ID NO: 1316021 - RNA, 19 nt, Homo sapiens
uuuacagugucugugugug

SEQ ID NO: 1316022 - RNA, 15 nt, Homo sapiens
uuuacauacacugua

SEQ ID NO: 1316023 - RNA, 22 nt, Homo sapiens
uuuacggacacccccucgcuug

SEQ ID NO: 1316024 - RNA, 18 nt, Homo sapiens
aacuugggaauaaaucau

SEQ ID NO: 1316025 - RNA, 23 nt, Homo sapiens
aacuugggaauaaaucauagcaa

SEQ ID NO: 1316026 - RNA, 23 nt, Homo sapiens
aacuuguuuaauuccucaguggg

SEQ ID NO: 1316027 - RNA, 21 nt, Homo sapiens
aacuuuaauaagaucuagucu

SEQ ID NO: 1316028 - RNA, 19 nt, Homo sapiens
aacuuuuuaaagugacaua

SEQ ID NO: 1316029 - RNA, 15 nt, Homo sapiens
aacuuuuuacauuac

SEQ ID NO: 1316030 - RNA, 19 nt, Homo sapiens
aacuuuuugcaaggcauuu

SEQ ID NO: 1316031 - RNA, 19 nt, Homo sapiens
aagaaaaaaggccuugaau

SEQ ID NO: 1316032 - RNA, 19 nt, Homo sapiens
aagaaaacaucuauucucu

SEQ ID NO: 1316033 - RNA, 15 nt, Homo sapiens
aagaaaagcauucaa

SEQ ID NO: 1316034 - RNA, 21 nt, Homo sapiens
aagaaaauuagggcaaggugu

SEQ ID NO: 1316035 - RNA, 16 nt, Homo sapiens
aagaaagaucaaagac

SEQ ID NO: 1316036 - RNA, 12 nt, Homo sapiens
aagaacauguga

SEQ ID NO: 1316037 - RNA, 12 nt, Homo sapiens
aagaacuuaccc

SEQ ID NO: 1316038 - RNA, 18 nt, Homo sapiens
aagaagagacucuuugca

SEQ ID NO: 1316039 - RNA, 13 nt, Homo sapiens
aagaagggcugca

SEQ ID NO: 1316040 - RNA, 19 nt, Homo sapiens
aagaccucugagaccaaaa

SEQ ID NO: 1316041 - RNA, 19 nt, Homo sapiens
aagaccugacaccuuucau

SEQ ID NO: 1316042 - RNA, 14 nt, Homo sapiens
aagacgugauucaa

SEQ ID NO: 1316043 - RNA, 14 nt, Homo sapiens
aagacuacaugaac

SEQ ID NO: 1316044 - RNA, 19 nt, Homo sapiens
aagagacuaggcgcugggg

SEQ ID NO: 1316045 - RNA, 22 nt, Homo sapiens
aagagaucccaaguagaaucuc

SEQ ID NO: 1316046 - RNA, 23 nt, Homo sapiens
aagagauuccugagccaguguca

SEQ ID NO: 1316047 - RNA, 16 nt, Homo sapiens
aagagccaaguuccaa

SEQ ID NO: 1316048 - RNA, 19 nt, Homo sapiens
aagagcgaaacuccaucuc

SEQ ID NO: 1316049 - RNA, 14 nt, Homo sapiens
aagaggcagggucu

SEQ ID NO: 1316050 - RNA, 15 nt, Homo sapiens
aagaggcuacagggc

SEQ ID NO: 1316051 - RNA, 17 nt, Homo sapiens
aagaggcugcacugcag

SEQ ID NO: 1316052 - RNA, 14 nt, Homo sapiens
aagagggaauagua

SEQ ID NO: 1316053 - RNA, 20 nt, Homo sapiens
aagagggugauugcuggggc

SEQ ID NO: 1316054 - RNA, 21 nt, Homo sapiens
aagauaucuuuggauaauguu

SEQ ID NO: 1316055 - RNA, 17 nt, Homo sapiens
aagauauuauguauaaa

SEQ ID NO: 1316056 - RNA, 14 nt, Homo sapiens
aagaugaucagugg

SEQ ID NO: 1316057 - RNA, 16 nt, Homo sapiens
aagaugggaacacugg

SEQ ID NO: 1316058 - RNA, 14 nt, Homo sapiens
aagauggggucugu

SEQ ID NO: 1316059 - RNA, 11 nt, Homo sapiens
aagauuccaaa

SEQ ID NO: 1316060 - RNA, 14 nt, Homo sapiens
aagcaaaaucauuu

SEQ ID NO: 1316061 - RNA, 21 nt, Homo sapiens
aagcaaauaaaugaacugacu

SEQ ID NO: 1316062 - RNA, 17 nt, Homo sapiens
aagcaacuuuacugaga

SEQ ID NO: 1316063 - RNA, 12 nt, Homo sapiens
aagcaagcuccc

SEQ ID NO: 1316064 - RNA, 17 nt, Homo sapiens
aagcaauguacaccaga

SEQ ID NO: 1316065 - RNA, 14 nt, Homo sapiens
aagcaccaagcuca

SEQ ID NO: 1316066 - RNA, 11 nt, Homo sapiens
aagcacugugc

SEQ ID NO: 1316067 - RNA, 14 nt, Homo sapiens
aagcagaugcucug

SEQ ID NO: 1316068 - RNA, 16 nt, Homo sapiens
aagcagccaagcuccu

SEQ ID NO: 1316069 - RNA, 21 nt, Homo sapiens
aagcagguucccaagcucaga

SEQ ID NO: 1316070 - RNA, 15 nt, Homo sapiens
aagcaguuaguuccu

SEQ ID NO: 1316071 - RNA, 21 nt, Homo sapiens
aagccaauucagacaggcaaa

SEQ ID NO: 1316072 - RNA, 13 nt, Homo sapiens
aagccacugagca

SEQ ID NO: 1316073 - RNA, 14 nt, Homo sapiens
aagccagcugccua

SEQ ID NO: 1316074 - RNA, 15 nt, Homo sapiens
aagcccaauauuaua

SEQ ID NO: 1316075 - RNA, 22 nt, Homo sapiens
aagcccaugggacaaauugcac

SEQ ID NO: 1316076 - RNA, 22 nt, Homo sapiens
aagccccuuacuaugaucucag

SEQ ID NO: 1316077 - RNA, 16 nt, Homo sapiens
aagccucaucaucaga

SEQ ID NO: 1316078 - RNA, 20 nt, Homo sapiens
aagccugaugcugacauuca

SEQ ID NO: 1316079 - RNA, 22 nt, Homo sapiens
aagccuuccagggauuugccuc

SEQ ID NO: 1316080 - RNA, 15 nt, Homo sapiens
aagcgauuuccugcg

SEQ ID NO: 1316081 - RNA, 16 nt, Homo sapiens
aagcggcugccuccau

SEQ ID NO: 1316082 - RNA, 18 nt, Homo sapiens
aagcuaguguaccuccuc

SEQ ID NO: 1316083 - RNA, 17 nt, Homo sapiens
aagcucaaguguucaca

SEQ ID NO: 1316084 - RNA, 21 nt, Homo sapiens
aagcucagaggcgcacuguga

SEQ ID NO: 1316085 - RNA, 14 nt, Homo sapiens
aagcucauccauuu

SEQ ID NO: 1316086 - RNA, 15 nt, Homo sapiens
aagcucuucuuccca

SEQ ID NO: 1316087 - RNA, 15 nt, Homo sapiens
aagcugacauugcca

SEQ ID NO: 1316088 - RNA, 16 nt, Homo sapiens
aagcugacucaaaaau

SEQ ID NO: 1316089 - RNA, 23 nt, Homo sapiens
aagcugagucucccuaaggcaug

SEQ ID NO: 1316090 - RNA, 14 nt, Homo sapiens
aagcugcucaggga

SEQ ID NO: 1316091 - RNA, 23 nt, Homo sapiens
aagcugcucagggaaaagcagcu

SEQ ID NO: 1316092 - RNA, 13 nt, Homo sapiens
aagcugcuuuaaa

SEQ ID NO: 1316093 - RNA, 20 nt, Homo sapiens
aagcuguccucccaccucag

SEQ ID NO: 1316094 - RNA, 19 nt, Homo sapiens
aagcuguuuccauagggug

SEQ ID NO: 1316095 - RNA, 20 nt, Homo sapiens
aagcuuuauuucaaaucucu

SEQ ID NO: 1316096 - RNA, 12 nt, Homo sapiens
aaggaacuucca

SEQ ID NO: 1316097 - RNA, 22 nt, Homo sapiens
aaggaauuuguuuaaauaacau

SEQ ID NO: 1316098 - RNA, 11 nt, Homo sapiens
aaggacucuca

SEQ ID NO: 1316099 - RNA, 18 nt, Homo sapiens
aaggacucuggaagauuu

SEQ ID NO: 1316100 - RNA, 16 nt, Homo sapiens
aaggagccccauuccu

SEQ ID NO: 1316101 - RNA, 22 nt, Homo sapiens
aaggagccuugggggugugaug

SEQ ID NO: 1316102 - RNA, 18 nt, Homo sapiens
aaggaggccacgugaugu

SEQ ID NO: 1316103 - RNA, 20 nt, Homo sapiens
aaggaggcugaucccugaga

SEQ ID NO: 1316104 - RNA, 22 nt, Homo sapiens
aaggagggagcucugaugagca

SEQ ID NO: 1316105 - RNA, 18 nt, Homo sapiens
aaggagggugagugcaag

SEQ ID NO: 1316106 - RNA, 11 nt, Homo sapiens
aaggagucaaa

SEQ ID NO: 1316107 - RNA, 19 nt, Homo sapiens
aaggagugagaugaaucaa

SEQ ID NO: 1316108 - RNA, 23 nt, Homo sapiens
aaggauacuguaacacuuuacaa

SEQ ID NO: 1316109 - RNA, 14 nt, Homo sapiens
aaggauacuuuaca

SEQ ID NO: 1316110 - RNA, 15 nt, Homo sapiens
aaggauucuauauca

SEQ ID NO: 1316111 - RNA, 19 nt, Homo sapiens
aaggcaaugccauccucaa

SEQ ID NO: 1316112 - RNA, 19 nt, Homo sapiens
aaggcaggcagaucacuug

SEQ ID NO: 1316113 - RNA, 19 nt, Homo sapiens
aaggccacuguuugucuca

SEQ ID NO: 1316114 - RNA, 14 nt, Homo sapiens
aaggccgggugaca

SEQ ID NO: 1316115 - RNA, 16 nt, Homo sapiens
aaggccuccugugacu

SEQ ID NO: 1316116 - RNA, 19 nt, Homo sapiens
aaggcggguggaucacuug

SEQ ID NO: 1316117 - RNA, 22 nt, Homo sapiens
aaggcucccggaauuccgucac

SEQ ID NO: 1316118 - RNA, 23 nt, Homo sapiens
aaggcucccggaauuccgucacc

SEQ ID NO: 1316119 - RNA, 18 nt, Homo sapiens
aaggcugagaacacugug

SEQ ID NO: 1316120 - RNA, 23 nt, Homo sapiens
aaggcuuacacccacaguggaaa

SEQ ID NO: 1316121 - RNA, 14 nt, Homo sapiens
aaggcuucagucuc

SEQ ID NO: 1316122 - RNA, 17 nt, Homo sapiens
aagggagcuagccagag

SEQ ID NO: 1316123 - RNA, 17 nt, Homo sapiens
aagggauggggugccag

SEQ ID NO: 1316124 - RNA, 16 nt, Homo sapiens
aagggauggugcccug

SEQ ID NO: 1316125 - RNA, 16 nt, Homo sapiens
aagggcgcuuguccca

SEQ ID NO: 1316126 - RNA, 17 nt, Homo sapiens
aaggggacaauggcaga

SEQ ID NO: 1316127 - RNA, 15 nt, Homo sapiens
aaggggauggaguga

SEQ ID NO: 1316128 - RNA, 14 nt, Homo sapiens
aagguaaaaugcca

SEQ ID NO: 1316129 - RNA, 12 nt, Homo sapiens
aaggugcucaca

SEQ ID NO: 1316130 - RNA, 23 nt, Homo sapiens
aagguuuuauaaggcugauguca

SEQ ID NO: 1316131 - RNA, 15 nt, Homo sapiens
aaguaagagcucuaa

SEQ ID NO: 1316132 - RNA, 17 nt, Homo sapiens
aaguacuguaacugugu

SEQ ID NO: 1316133 - RNA, 14 nt, Homo sapiens
aaguagcugagacu

SEQ ID NO: 1316134 - RNA, 20 nt, Homo sapiens
aaguagcugagacuacaggu

SEQ ID NO: 1316135 - RNA, 23 nt, Homo sapiens
aaguauacaauaaagucuuaccu

SEQ ID NO: 1316136 - RNA, 19 nt, Homo sapiens
aaguauugcaucuguauaa

SEQ ID NO: 1316137 - RNA, 16 nt, Homo sapiens
aagucagaacagccag

SEQ ID NO: 1316138 - RNA, 13 nt, Homo sapiens
aagucaguaucau

SEQ ID NO: 1316139 - RNA, 18 nt, Homo sapiens
aagucaguaucauauuau

SEQ ID NO: 1316140 - RNA, 20 nt, Homo sapiens
aaguccuguaugucugucau

SEQ ID NO: 1316141 - RNA, 16 nt, Homo sapiens
aagucgucuuaacuca

SEQ ID NO: 1316142 - RNA, 21 nt, Homo sapiens
aagucuuugguaaauggcaaa

SEQ ID NO: 1316143 - RNA, 20 nt, Homo sapiens
aagugacauaauuuacaugc

SEQ ID NO: 1316144 - RNA, 20 nt, Homo sapiens
aagugauccucccaccucag

SEQ ID NO: 1316145 - RNA, 15 nt, Homo sapiens
aagugauugacuuga

SEQ ID NO: 1316146 - RNA, 15 nt, Homo sapiens
aagugcauauuuauc

SEQ ID NO: 1316147 - RNA, 17 nt, Homo sapiens
aagugcauauuuaucca

SEQ ID NO: 1316148 - RNA, 17 nt, Homo sapiens
aagugccaagacacagc

SEQ ID NO: 1316149 - RNA, 23 nt, Homo sapiens
aagugcugggauuacagguguga

SEQ ID NO: 1316150 - RNA, 22 nt, Homo sapiens
aaguguaagaaacacacugagg

SEQ ID NO: 1316151 - RNA, 21 nt, Homo sapiens
aagugucaccccucacuguga

SEQ ID NO: 1316152 - RNA, 15 nt, Homo sapiens
aagugucuuuugaca

SEQ ID NO: 1316153 - RNA, 18 nt, Homo sapiens
aagugugcuuuaugcuga

SEQ ID NO: 1316154 - RNA, 20 nt, Homo sapiens
aaguuacuagguaacuucau

SEQ ID NO: 1316155 - RNA, 16 nt, Homo sapiens
aaguuauuuuuguaca

SEQ ID NO: 1316156 - RNA, 17 nt, Homo sapiens
accagagugauggauuu

SEQ ID NO: 1316157 - RNA, 11 nt, Homo sapiens
accagcacauc

SEQ ID NO: 1316158 - RNA, 18 nt, Homo sapiens
accagcgugugacuacuc

SEQ ID NO: 1316159 - RNA, 15 nt, Homo sapiens
accaggaaccucuuc

SEQ ID NO: 1316160 - RNA, 16 nt, Homo sapiens
accaggagagcccugg

SEQ ID NO: 1316161 - RNA, 15 nt, Homo sapiens
accaguauaagcauc

SEQ ID NO: 1316162 - RNA, 22 nt, Homo sapiens
accaguuuaaccugaugcaguc

SEQ ID NO: 1316163 - RNA, 15 nt, Homo sapiens
accaguuuuauccau

SEQ ID NO: 1316164 - RNA, 23 nt, Homo sapiens
accauagaguccagaucuugccu

SEQ ID NO: 1316165 - RNA, 20 nt, Homo sapiens
accauagggacccauucuac

SEQ ID NO: 1316166 - RNA, 16 nt, Homo sapiens
accauaugaacauaua

SEQ ID NO: 1316167 - RNA, 15 nt, Homo sapiens
accauccagugacaa

SEQ ID NO: 1316168 - RNA, 21 nt, Homo sapiens
accaugaugaccugaaguuca

SEQ ID NO: 1316169 - RNA, 23 nt, Homo sapiens
accaugauuaaccacuucagcug

SEQ ID NO: 1316170 - RNA, 22 nt, Homo sapiens
accauuccauuuccaagcacuu

SEQ ID NO: 1316171 - RNA, 15 nt, Homo sapiens
accauucugcauuua

SEQ ID NO: 1316172 - RNA, 16 nt, Homo sapiens
accauuuuacauuucu

SEQ ID NO: 1316173 - RNA, 21 nt, Homo sapiens
accauuuugggguacccacug

SEQ ID NO: 1316174 - RNA, 14 nt, Homo sapiens
acccaaaguaucag

SEQ ID NO: 1316175 - RNA, 13 nt, Homo sapiens
acccaacucugua

SEQ ID NO: 1316176 - RNA, 16 nt, Homo sapiens
acccaaguagcugcua

SEQ ID NO: 1316177 - RNA, 19 nt, Homo sapiens
acccaauauuuaccagacc

SEQ ID NO: 1316178 - RNA, 18 nt, Homo sapiens
acccaauuccacucugau

SEQ ID NO: 1316179 - RNA, 16 nt, Homo sapiens
acccaccaucaugucu

SEQ ID NO: 1316180 - RNA, 12 nt, Homo sapiens
acccacccagga

SEQ ID NO: 1316181 - RNA, 19 nt, Homo sapiens
acccaccccacaauuccuc

SEQ ID NO: 1316182 - RNA, 12 nt, Homo sapiens
acccaccucagc

SEQ ID NO: 1316183 - RNA, 13 nt, Homo sapiens
acccacuauccca

SEQ ID NO: 1316184 - RNA, 17 nt, Homo sapiens
acccaggaguguggcca

SEQ ID NO: 1316185 - RNA, 18 nt, Homo sapiens
acccagggaacagccacu

SEQ ID NO: 1316186 - RNA, 16 nt, Homo sapiens
acccaggguggggaca

SEQ ID NO: 1316187 - RNA, 16 nt, Homo sapiens
acccagucacugugag

SEQ ID NO: 1316188 - RNA, 16 nt, Homo sapiens
acccaguuagcucuca

SEQ ID NO: 1316189 - RNA, 17 nt, Homo sapiens
acccaguuagcucucaa

SEQ ID NO: 1316190 - RNA, 14 nt, Homo sapiens
acccaguucaguga

SEQ ID NO: 1316191 - RNA, 21 nt, Homo sapiens
acccauagagggcuccucuca

SEQ ID NO: 1316192 - RNA, 23 nt, Homo sapiens
acccauagagggcuccucucaga

SEQ ID NO: 1316193 - RNA, 17 nt, Homo sapiens
acccauucuacacagag

SEQ ID NO: 1316194 - RNA, 18 nt, Homo sapiens
acccauucuacacagagc

SEQ ID NO: 1316195 - RNA, 20 nt, Homo sapiens
acccauuugucucuacuuuu

SEQ ID NO: 1316196 - RNA, 19 nt, Homo sapiens
accccaaaggaacacugac

SEQ ID NO: 1316197 - RNA, 20 nt, Homo sapiens
accccaaaggaacacugaca

SEQ ID NO: 1316198 - RNA, 21 nt, Homo sapiens
accccaaaggaacacugacau

SEQ ID NO: 1316199 - RNA, 22 nt, Homo sapiens
accccagcauucucaggcacca

SEQ ID NO: 1316200 - RNA, 19 nt, Homo sapiens
accccagguacauccauga

SEQ ID NO: 1316201 - RNA, 13 nt, Homo sapiens
acccccagcacuu

SEQ ID NO: 1316202 - RNA, 15 nt, Homo sapiens
acccccaguuccuau

SEQ ID NO: 1316203 - RNA, 18 nt, Homo sapiens
accccucacugugacuga

SEQ ID NO: 1316204 - RNA, 21 nt, Homo sapiens
accccucuuucgucuacugca

SEQ ID NO: 1316205 - RNA, 14 nt, Homo sapiens
accccugcacaguu

SEQ ID NO: 1316206 - RNA, 19 nt, Homo sapiens
accccuggaagagcccagu

SEQ ID NO: 1316207 - RNA, 18 nt, Homo sapiens
accccuuguuucuauaca

SEQ ID NO: 1316208 - RNA, 16 nt, Homo sapiens
acccgcuccuacagcu

SEQ ID NO: 1316209 - RNA, 16 nt, Homo sapiens
acccggagagugcucc

SEQ ID NO: 1316210 - RNA, 12 nt, Homo sapiens
acccggugcucc

SEQ ID NO: 1316211 - RNA, 16 nt, Homo sapiens
acccuaaaucuugacu

SEQ ID NO: 1316212 - RNA, 13 nt, Homo sapiens
acccuaagaaaag

SEQ ID NO: 1316213 - RNA, 11 nt, Homo sapiens
acccuaccugc

SEQ ID NO: 1316214 - RNA, 23 nt, Homo sapiens
acccuagcccucucccucuaggc

SEQ ID NO: 1316215 - RNA, 19 nt, Homo sapiens
acccucacaagcaugaagu

SEQ ID NO: 1316216 - RNA, 13 nt, Homo sapiens
acccucacauggg

SEQ ID NO: 1316217 - RNA, 20 nt, Homo sapiens
acccucccucccugaucccg

SEQ ID NO: 1316218 - RNA, 16 nt, Homo sapiens
acccucucucugaucu

SEQ ID NO: 1316219 - RNA, 19 nt, Homo sapiens
acccugaaggggccaugau

SEQ ID NO: 1316220 - RNA, 23 nt, Homo sapiens
acccugacuccucuuugugcaga

SEQ ID NO: 1316221 - RNA, 18 nt, Homo sapiens
acccugcaggacuugcca

SEQ ID NO: 1316222 - RNA, 17 nt, Homo sapiens
acccugccccuugccau

SEQ ID NO: 1316223 - RNA, 17 nt, Homo sapiens
acccugccggguagcug

SEQ ID NO: 1316224 - RNA, 17 nt, Homo sapiens
acccuggaccagugguc

SEQ ID NO: 1316225 - RNA, 22 nt, Homo sapiens
acccuggaccaguggucucaca

SEQ ID NO: 1316226 - RNA, 23 nt, Homo sapiens
acccugggccuggcagcucagcu

SEQ ID NO: 1316227 - RNA, 16 nt, Homo sapiens
acccuguaaaauggag

SEQ ID NO: 1316228 - RNA, 22 nt, Homo sapiens
acccuucauuuaacaaguaaga

SEQ ID NO: 1316229 - RNA, 19 nt, Homo sapiens
acccuucuggaaacuguga

SEQ ID NO: 1316230 - RNA, 14 nt, Homo sapiens
accguaggacccaa

SEQ ID NO: 1316231 - RNA, 16 nt, Homo sapiens
accguaggacccaagc

SEQ ID NO: 1316232 - RNA, 16 nt, Homo sapiens
accgugaccagugcug

SEQ ID NO: 1316233 - RNA, 17 nt, Homo sapiens
accgugggcucccugac

SEQ ID NO: 1316234 - RNA, 23 nt, Homo sapiens
accuaaaaggaaaucucacccca

SEQ ID NO: 1316235 - RNA, 20 nt, Homo sapiens
accuaaauggccucaugugg

SEQ ID NO: 1316236 - RNA, 16 nt, Homo sapiens
accuaaauuugguucu

SEQ ID NO: 1316237 - RNA, 19 nt, Homo sapiens
accuaacauuauacuucau

SEQ ID NO: 1316238 - RNA, 12 nt, Homo sapiens
accuaagcaaca

SEQ ID NO: 1316239 - RNA, 14 nt, Homo sapiens
accuaauccaggca

SEQ ID NO: 1316240 - RNA, 18 nt, Homo sapiens
accuaauccaggcagauc

SEQ ID NO: 1316241 - RNA, 21 nt, Homo sapiens
accuaccacaugccaagcacu

SEQ ID NO: 1316242 - RNA, 19 nt, Homo sapiens
accuaccccugcacaagcc

SEQ ID NO: 1316243 - RNA, 13 nt, Homo sapiens
accuauuugacuu

SEQ ID NO: 1316244 - RNA, 16 nt, Homo sapiens
accucaccaagacauc

SEQ ID NO: 1316245 - RNA, 20 nt, Homo sapiens
accucagccuggccagacac

SEQ ID NO: 1316246 - RNA, 17 nt, Homo sapiens
accucagggcacaaaga

SEQ ID NO: 1316247 - RNA, 20 nt, Homo sapiens
accucauuguucuguacaaa

SEQ ID NO: 1316248 - RNA, 19 nt, Homo sapiens
accuccaaauguccuuaaa

SEQ ID NO: 1316249 - RNA, 19 nt, Homo sapiens
accuccaagccacugagca

SEQ ID NO: 1316250 - RNA, 18 nt, Homo sapiens
accucccuccccgucuca

SEQ ID NO: 1316251 - RNA, 19 nt, Homo sapiens
accucccugccuccaggaa

SEQ ID NO: 1316252 - RNA, 20 nt, Homo sapiens
accuccuccucuggacaaag

SEQ ID NO: 1316253 - RNA, 22 nt, Homo sapiens
accuccuuucaucacacugggu

SEQ ID NO: 1316254 - RNA, 16 nt, Homo sapiens
accucucccugacccu

SEQ ID NO: 1316255 - RNA, 16 nt, Homo sapiens
accucugagaccaaaa

SEQ ID NO: 1316256 - RNA, 23 nt, Homo sapiens
accucugccugaagucacacagu

SEQ ID NO: 1316257 - RNA, 21 nt, Homo sapiens
accucuugaaaauagaacaac

SEQ ID NO: 1316258 - RNA, 18 nt, Homo sapiens
accucuugcgagauaaga

SEQ ID NO: 1316259 - RNA, 22 nt, Homo sapiens
accugaaauaaaauucauuagu

SEQ ID NO: 1316260 - RNA, 14 nt, Homo sapiens
accugaacugaugg

SEQ ID NO: 1316261 - RNA, 19 nt, Homo sapiens
accugagcaggaccucuga

SEQ ID NO: 1316262 - RNA, 13 nt, Homo sapiens
accugauccugga

SEQ ID NO: 1316263 - RNA, 22 nt, Homo sapiens
accugcaaagaucuguccucag

SEQ ID NO: 1316264 - RNA, 21 nt, Homo sapiens
accugcagcccauggugagcu

SEQ ID NO: 1316265 - RNA, 15 nt, Homo sapiens
accugggcugugaug

SEQ ID NO: 1316266 - RNA, 16 nt, Homo sapiens
accugggcugugaugu

SEQ ID NO: 1316267 - RNA, 18 nt, Homo sapiens
accuguaauccuagcacu

SEQ ID NO: 1316268 - RNA, 13 nt, Homo sapiens
accugucauucua

SEQ ID NO: 1316269 - RNA, 21 nt, Homo sapiens
accugugcucauccucugccc

SEQ ID NO: 1316270 - RNA, 14 nt, Homo sapiens
accugugugcuugg

SEQ ID NO: 1316271 - RNA, 23 nt, Homo sapiens
accuguuaucuguguuugcugag

SEQ ID NO: 1316272 - RNA, 21 nt, Homo sapiens
accuguugauagcaagugaau

SEQ ID NO: 1316273 - RNA, 17 nt, Homo sapiens
accuuauuguaccucuc

SEQ ID NO: 1316274 - RNA, 14 nt, Homo sapiens
accuucagagccag

SEQ ID NO: 1316275 - RNA, 16 nt, Homo sapiens
accuucauaugcagua

SEQ ID NO: 1316276 - RNA, 19 nt, Homo sapiens
accuuccuuccucuugcag

SEQ ID NO: 1316277 - RNA, 20 nt, Homo sapiens
accuuccuuccucuugcagu

SEQ ID NO: 1316278 - RNA, 17 nt, Homo sapiens
accuuggcaccagacac

SEQ ID NO: 1316279 - RNA, 23 nt, Homo sapiens
accuugggugaacuaaccaaaua

SEQ ID NO: 1316280 - RNA, 12 nt, Homo sapiens
accuugugagag

SEQ ID NO: 1316281 - RNA, 18 nt, Homo sapiens
accuuuggugcuuuccag

SEQ ID NO: 1316282 - RNA, 15 nt, Homo sapiens
acgagggucccgauc

SEQ ID NO: 1316283 - RNA, 18 nt, Homo sapiens
acgauugguaugaugcug

SEQ ID NO: 1316284 - RNA, 16 nt, Homo sapiens
acgccuguaauccuag

SEQ ID NO: 1316285 - RNA, 21 nt, Homo sapiens
acgccuguauucccacaccag

SEQ ID NO: 1316286 - RNA, 17 nt, Homo sapiens
acggacacucaaaagcu

SEQ ID NO: 1316287 - RNA, 21 nt, Homo sapiens
acggagcucacccaugugcac

SEQ ID NO: 1316288 - RNA, 13 nt, Homo sapiens
agcaccaagcuca

SEQ ID NO: 1316289 - RNA, 14 nt, Homo sapiens
agcaccaggggaug

SEQ ID NO: 1316290 - RNA, 16 nt, Homo sapiens
agcaccauaacuuugu

SEQ ID NO: 1316291 - RNA, 18 nt, Homo sapiens
agcaccuccagccugaac

SEQ ID NO: 1316292 - RNA, 21 nt, Homo sapiens
agcaccugcgggagcugcacu

SEQ ID NO: 1316293 - RNA, 11 nt, Homo sapiens
agcacugagca

SEQ ID NO: 1316294 - RNA, 10 nt, Homo sapiens
agcacugagg

SEQ ID NO: 1316295 - RNA, 15 nt, Homo sapiens
agcacugccaccagu

SEQ ID NO: 1316296 - RNA, 21 nt, Homo sapiens
agcacuugaagaauauuccca

SEQ ID NO: 1316297 - RNA, 15 nt, Homo sapiens
agcagagagcacagc

SEQ ID NO: 1316298 - RNA, 21 nt, Homo sapiens
agcagauauauuaagugacug

SEQ ID NO: 1316299 - RNA, 19 nt, Homo sapiens
agcagaugcaaagaggcaa

SEQ ID NO: 1316300 - RNA, 19 nt, Homo sapiens
agcagauuucuaugguacc

SEQ ID NO: 1316301 - RNA, 21 nt, Homo sapiens
agcagcacaggggacgcaaug

SEQ ID NO: 1316302 - RNA, 22 nt, Homo sapiens
agcagcucaaaggcacagugaa

SEQ ID NO: 1316303 - RNA, 18 nt, Homo sapiens
agcaggaaccccaggaga

SEQ ID NO: 1316304 - RNA, 15 nt, Homo sapiens
agcaggaagcucaga

SEQ ID NO: 1316305 - RNA, 23 nt, Homo sapiens
agcaggaauauaugugugccuau

SEQ ID NO: 1316306 - RNA, 15 nt, Homo sapiens
agcaggacugcacag

SEQ ID NO: 1316307 - RNA, 21 nt, Homo sapiens
agcagggggggaaaugcauuu

SEQ ID NO: 1316308 - RNA, 23 nt, Homo sapiens
agcagggggggaaaugcauuuau

SEQ ID NO: 1316309 - RNA, 17 nt, Homo sapiens
agcaggugcugacuuca

SEQ ID NO: 1316310 - RNA, 20 nt, Homo sapiens
agcagguuaccacucuggca

SEQ ID NO: 1316311 - RNA, 16 nt, Homo sapiens
agcaguagacaagcaa

SEQ ID NO: 1316312 - RNA, 15 nt, Homo sapiens
agcagucgugccugu

SEQ ID NO: 1316313 - RNA, 19 nt, Homo sapiens
agcagucuaucauugcagg

SEQ ID NO: 1316314 - RNA, 17 nt, Homo sapiens
agcauaccaccaugccu

SEQ ID NO: 1316315 - RNA, 16 nt, Homo sapiens
agcauaucugccuuua

SEQ ID NO: 1316316 - RNA, 22 nt, Homo sapiens
agcauaucugccuuuauugugu

SEQ ID NO: 1316317 - RNA, 13 nt, Homo sapiens
agcaucuugcauc

SEQ ID NO: 1316318 - RNA, 20 nt, Homo sapiens
agcauggucacaagcacaaa

SEQ ID NO: 1316319 - RNA, 14 nt, Homo sapiens
agcauguaccccag

SEQ ID NO: 1316320 - RNA, 23 nt, Homo sapiens
agcauuacccuccucucucccca

SEQ ID NO: 1316321 - RNA, 18 nt, Homo sapiens
agcauugcuggacucuga

SEQ ID NO: 1316322 - RNA, 16 nt, Homo sapiens
agcauuuaauccaaac

SEQ ID NO: 1316323 - RNA, 20 nt, Homo sapiens
agcauuuugcuaaaugugaa

SEQ ID NO: 1316324 - RNA, 20 nt, Homo sapiens
agccaaaguuaugcaaggga

SEQ ID NO: 1316325 - RNA, 12 nt, Homo sapiens
agccaaggcagg

SEQ ID NO: 1316326 - RNA, 11 nt, Homo sapiens
agccaagggau

SEQ ID NO: 1316327 - RNA, 18 nt, Homo sapiens
agccaauaacacacagcu

SEQ ID NO: 1316328 - RNA, 14 nt, Homo sapiens
agccaaucugcaau

SEQ ID NO: 1316329 - RNA, 15 nt, Homo sapiens
agccacagacaauau

SEQ ID NO: 1316330 - RNA, 21 nt, Homo sapiens
agccacugcauaccaaccugg

SEQ ID NO: 1316331 - RNA, 19 nt, Homo sapiens
agccacugccacuccaguc

SEQ ID NO: 1316332 - RNA, 13 nt, Homo sapiens
agccagaacuuga

SEQ ID NO: 1316333 - RNA, 24 nt, Homo sapiens
agccagaaucucauuacugcuuca

SEQ ID NO: 1316334 - RNA, 18 nt, Homo sapiens
agcccaagcuucccucca

SEQ ID NO: 1316335 - RNA, 16 nt, Homo sapiens
agcccagcacuugaau

SEQ ID NO: 1316336 - RNA, 22 nt, Homo sapiens
agcccauggugagcucugggaa

SEQ ID NO: 1316337 - RNA, 15 nt, Homo sapiens
agccccaucugugca

SEQ ID NO: 1316338 - RNA, 21 nt, Homo sapiens
agccccugccagcuuccccua

SEQ ID NO: 1316339 - RNA, 20 nt, Homo sapiens
agccccuuacuaugaucuca

SEQ ID NO: 1316340 - RNA, 17 nt, Homo sapiens
agcccuauuucaguuua

SEQ ID NO: 1316341 - RNA, 15 nt, Homo sapiens
agcccuguugacaca

SEQ ID NO: 1316342 - RNA, 20 nt, Homo sapiens
agccgagauugcaccacugc

SEQ ID NO: 1316343 - RNA, 13 nt, Homo sapiens
agccuaaauguua

SEQ ID NO: 1316344 - RNA, 16 nt, Homo sapiens
agccuaacuccauccc

SEQ ID NO: 1316345 - RNA, 17 nt, Homo sapiens
agccuaauaacgugaaa

SEQ ID NO: 1316346 - RNA, 21 nt, Homo sapiens
agccuaauaacgugaaacuua

SEQ ID NO: 1316347 - RNA, 15 nt, Homo sapiens
agccuacagccagaa

SEQ ID NO: 1316348 - RNA, 14 nt, Homo sapiens
agccucagcucuca

SEQ ID NO: 1316349 - RNA, 14 nt, Homo sapiens
agccucccagugug

SEQ ID NO: 1316350 - RNA, 23 nt, Homo sapiens
agccuccugcccagcacaggaau

SEQ ID NO: 1316351 - RNA, 17 nt, Homo sapiens
agccucucaaguaauau

SEQ ID NO: 1316352 - RNA, 14 nt, Homo sapiens
agccugcagucauc

SEQ ID NO: 1316353 - RNA, 23 nt, Homo sapiens
agccugcaguuauuaacacuaac

SEQ ID NO: 1316354 - RNA, 22 nt, Homo sapiens
agccugccuggcaggcugucug

SEQ ID NO: 1316355 - RNA, 13 nt, Homo sapiens
agccugcuuucac

SEQ ID NO: 1316356 - RNA, 14 nt, Homo sapiens
agccuggaacauca

SEQ ID NO: 1316357 - RNA, 17 nt, Homo sapiens
agccuggaacaucauca

SEQ ID NO: 1316358 - RNA, 13 nt, Homo sapiens
agccuggccagac

SEQ ID NO: 1316359 - RNA, 17 nt, Homo sapiens
agccuggggaggccagg

SEQ ID NO: 1316360 - RNA, 14 nt, Homo sapiens
agccugggugacaa

SEQ ID NO: 1316361 - RNA, 15 nt, Homo sapiens
agccuggugcugcug

SEQ ID NO: 1316362 - RNA, 23 nt, Homo sapiens
agccuucacacagauagaccuuu

SEQ ID NO: 1316363 - RNA, 16 nt, Homo sapiens
agccuucagccuuaau

SEQ ID NO: 1316364 - RNA, 16 nt, Homo sapiens
agccuugggagccacu

SEQ ID NO: 1316365 - RNA, 14 nt, Homo sapiens
agccuuugccuccc

SEQ ID NO: 1316366 - RNA, 18 nt, Homo sapiens
agccuuuggucuccugga

SEQ ID NO: 1316367 - RNA, 19 nt, Homo sapiens
agcgaggaggcuccagagg

SEQ ID NO: 1316368 - RNA, 23 nt, Homo sapiens
agcggcuggcagcccaccccuca

SEQ ID NO: 1316369 - RNA, 15 nt, Homo sapiens
agcguccucuuggcu

SEQ ID NO: 1316370 - RNA, 16 nt, Homo sapiens
agcgugagccacugca

SEQ ID NO: 1316371 - RNA, 16 nt, Homo sapiens
agcuaaacuccuuccu

SEQ ID NO: 1316372 - RNA, 22 nt, Homo sapiens
agcuaaauuuucugaaacugca

SEQ ID NO: 1316373 - RNA, 15 nt, Homo sapiens
agcuaagacugaugu

SEQ ID NO: 1316374 - RNA, 16 nt, Homo sapiens
agcuaagacugauguc

SEQ ID NO: 1316375 - RNA, 17 nt, Homo sapiens
agcuaccucaaccaaug

SEQ ID NO: 1316376 - RNA, 15 nt, Homo sapiens
agcuacuaugcccaa

SEQ ID NO: 1316377 - RNA, 21 nt, Homo sapiens
agcuacucuccccacgagggc

SEQ ID NO: 1316378 - RNA, 22 nt, Homo sapiens
agcuacuguuuauuauuuuauu

SEQ ID NO: 1316379 - RNA, 22 nt, Homo sapiens
agcuaggccuggccagaugcac

SEQ ID NO: 1316380 - RNA, 17 nt, Homo sapiens
agcuaguguaccuccuc

SEQ ID NO: 1316381 - RNA, 14 nt, Homo sapiens
agcucacccacccc

SEQ ID NO: 1316382 - RNA, 18 nt, Homo sapiens
agcucagcauuuccacac

SEQ ID NO: 1316383 - RNA, 12 nt, Homo sapiens
agcucagguguc

SEQ ID NO: 1316384 - RNA, 15 nt, Homo sapiens
agcuccaaccugcaa

SEQ ID NO: 1316385 - RNA, 17 nt, Homo sapiens
agcuccaauuucaagag

SEQ ID NO: 1316386 - RNA, 14 nt, Homo sapiens
agcuccaucaauga

SEQ ID NO: 1316387 - RNA, 15 nt, Homo sapiens
agcuccggccugucc

SEQ ID NO: 1316388 - RNA, 10 nt, Homo sapiens
agcuccucac

SEQ ID NO: 1316389 - RNA, 15 nt, Homo sapiens
agcuccuguggccac

SEQ ID NO: 1316390 - RNA, 14 nt, Homo sapiens
agcucuaguucaaa

SEQ ID NO: 1316391 - RNA, 15 nt, Homo sapiens
agcucuauguuuaca

SEQ ID NO: 1316392 - RNA, 22 nt, Homo sapiens
agcucuccccucagagugcaag

SEQ ID NO: 1316393 - RNA, 19 nt, Homo sapiens
agcucucuucaaugacaua

SEQ ID NO: 1316394 - RNA, 23 nt, Homo sapiens
agcucugaaaccaguguuaggga

SEQ ID NO: 1316395 - RNA, 23 nt, Homo sapiens
agcucuggacagccccacccugg

SEQ ID NO: 1316396 - RNA, 20 nt, Homo sapiens
agcucuguuuauaaaaacaa

SEQ ID NO: 1316397 - RNA, 13 nt, Homo sapiens
agcucuucuuccc

SEQ ID NO: 1316398 - RNA, 13 nt, Homo sapiens
agcugaaccuggg

SEQ ID NO: 1316399 - RNA, 17 nt, Homo sapiens
agcugaagaguugcccc

SEQ ID NO: 1316400 - RNA, 17 nt, Homo sapiens
agcugacauugccaaaa

SEQ ID NO: 1316401 - RNA, 14 nt, Homo sapiens
agcugcaauaggaa

SEQ ID NO: 1316402 - RNA, 13 nt, Homo sapiens
agcugcacccuca

SEQ ID NO: 1316403 - RNA, 21 nt, Homo sapiens
agcugcagucaacaguucaaa

SEQ ID NO: 1316404 - RNA, 22 nt, Homo sapiens
agcugcagucaacaguucaaag

SEQ ID NO: 1316405 - RNA, 20 nt, Homo sapiens
agcugcagucccaugcacaa

SEQ ID NO: 1316406 - RNA, 18 nt, Homo sapiens
agcugcgccugcgcugca

SEQ ID NO: 1316407 - RNA, 18 nt, Homo sapiens
agcugcuccccucugcac

SEQ ID NO: 1316408 - RNA, 19 nt, Homo sapiens
agcugcucugcaagcagaa

SEQ ID NO: 1316409 - RNA, 18 nt, Homo sapiens
agcuggaaaaaguguccu

SEQ ID NO: 1316410 - RNA, 22 nt, Homo sapiens
agcuggcagcagaguguggccu

SEQ ID NO: 1316411 - RNA, 18 nt, Homo sapiens
agcugggacuacaggcac

SEQ ID NO: 1316412 - RNA, 21 nt, Homo sapiens
agcugggcuagaggcugagca

SEQ ID NO: 1316413 - RNA, 19 nt, Homo sapiens
agcugucccucacuguuga

SEQ ID NO: 1316414 - RNA, 19 nt, Homo sapiens
agcuguggccagcuuguua

SEQ ID NO: 1316415 - RNA, 12 nt, Homo sapiens
agcuguggcuca

SEQ ID NO: 1316416 - RNA, 17 nt, Homo sapiens
agcuguggugucagaaa

SEQ ID NO: 1316417 - RNA, 17 nt, Homo sapiens
agcuguucucauuccug

SEQ ID NO: 1316418 - RNA, 14 nt, Homo sapiens
agcuguuuccauag

SEQ ID NO: 1316419 - RNA, 18 nt, Homo sapiens
agcuuaauuuucugugga

SEQ ID NO: 1316420 - RNA, 21 nt, Homo sapiens
cagggaaugccugagugccug

SEQ ID NO: 1316421 - RNA, 17 nt, Homo sapiens
cagggaccccugcccuu

SEQ ID NO: 1316422 - RNA, 23 nt, Homo sapiens
cagggacuugaaguuguuacuaa

SEQ ID NO: 1316423 - RNA, 16 nt, Homo sapiens
cagggcaccugccacc

SEQ ID NO: 1316424 - RNA, 22 nt, Homo sapiens
cagggcagucauuggcugucuc

SEQ ID NO: 1316425 - RNA, 13 nt, Homo sapiens
cagggccagucuu

SEQ ID NO: 1316426 - RNA, 19 nt, Homo sapiens
cagggcccagagcccagcu

SEQ ID NO: 1316427 - RNA, 16 nt, Homo sapiens
cagggcccccaucuca

SEQ ID NO: 1316428 - RNA, 18 nt, Homo sapiens
cagggccccucuacccac

SEQ ID NO: 1316429 - RNA, 13 nt, Homo sapiens
cagggcugcauug

SEQ ID NO: 1316430 - RNA, 18 nt, Homo sapiens
caggggaguaugcaaaag

SEQ ID NO: 1316431 - RNA, 21 nt, Homo sapiens
caggggcucacaccuguaauc

SEQ ID NO: 1316432 - RNA, 17 nt, Homo sapiens
caggguaaaaggugcag

SEQ ID NO: 1316433 - RNA, 14 nt, Homo sapiens
cagggucauagcau

SEQ ID NO: 1316434 - RNA, 15 nt, Homo sapiens
cagggugcaguauca

SEQ ID NO: 1316435 - RNA, 18 nt, Homo sapiens
caggguggagugcagugg

SEQ ID NO: 1316436 - RNA, 13 nt, Homo sapiens
cagguacuuguaa

SEQ ID NO: 1316437 - RNA, 22 nt, Homo sapiens
cagguccuccccucucuuguca

SEQ ID NO: 1316438 - RNA, 21 nt, Homo sapiens
caggugauccacccaccucag

SEQ ID NO: 1316439 - RNA, 20 nt, Homo sapiens
caggugcuguuuuuguucua

SEQ ID NO: 1316440 - RNA, 19 nt, Homo sapiens
caggugugaaccaccacac

SEQ ID NO: 1316441 - RNA, 14 nt, Homo sapiens
caggugugagucac

SEQ ID NO: 1316442 - RNA, 13 nt, Homo sapiens
caggugugcacca

SEQ ID NO: 1316443 - RNA, 17 nt, Homo sapiens
cagguuaccacucuggc

SEQ ID NO: 1316444 - RNA, 20 nt, Homo sapiens
cagguuggaacuaugcagug

SEQ ID NO: 1316445 - RNA, 23 nt, Homo sapiens
caguaaacagaggaguacaggug

SEQ ID NO: 1316446 - RNA, 12 nt, Homo sapiens
caguaaaccuua

SEQ ID NO: 1316447 - RNA, 19 nt, Homo sapiens
caguaacccccacuggacu

SEQ ID NO: 1316448 - RNA, 16 nt, Homo sapiens
caguaacgcaggggaa

SEQ ID NO: 1316449 - RNA, 12 nt, Homo sapiens
caguaacugaca

SEQ ID NO: 1316450 - RNA, 14 nt, Homo sapiens
caguaauggaauga

SEQ ID NO: 1316451 - RNA, 23 nt, Homo sapiens
caguaauuauguucuacagaaua

SEQ ID NO: 1316452 - RNA, 16 nt, Homo sapiens
caguacacucuggcca

SEQ ID NO: 1316453 - RNA, 12 nt, Homo sapiens
caguacuuguca

SEQ ID NO: 1316454 - RNA, 15 nt, Homo sapiens
caguagacugcagug

SEQ ID NO: 1316455 - RNA, 14 nt, Homo sapiens
caguaugacaguau

SEQ ID NO: 1316456 - RNA, 20 nt, Homo sapiens
caguaugugggggcuucauc

SEQ ID NO: 1316457 - RNA, 21 nt, Homo sapiens
caguauuuuuuccacuacaca

SEQ ID NO: 1316458 - RNA, 16 nt, Homo sapiens
cagucaacaguucaaa

SEQ ID NO: 1316459 - RNA, 13 nt, Homo sapiens
cagucacagccac

SEQ ID NO: 1316460 - RNA, 22 nt, Homo sapiens
cagucacgccugaaacuuugag

SEQ ID NO: 1316461 - RNA, 19 nt, Homo sapiens
cagucacugacaguuaaua

SEQ ID NO: 1316462 - RNA, 15 nt, Homo sapiens
cagucacugugagcu

SEQ ID NO: 1316463 - RNA, 14 nt, Homo sapiens
cagucaucuugacc

SEQ ID NO: 1316464 - RNA, 16 nt, Homo sapiens
caguccaauaggugua

SEQ ID NO: 1316465 - RNA, 16 nt, Homo sapiens
caguccauagcagaga

SEQ ID NO: 1316466 - RNA, 18 nt, Homo sapiens
cagucccuaaaaacacag

SEQ ID NO: 1316467 - RNA, 13 nt, Homo sapiens
cagucuauggguu

SEQ ID NO: 1316468 - RNA, 14 nt, Homo sapiens
cagucuuccauuug

SEQ ID NO: 1316469 - RNA, 17 nt, Homo sapiens
cagucuuccauuugcaa

SEQ ID NO: 1316470 - RNA, 12 nt, Homo sapiens
cagucuuucuau

SEQ ID NO: 1316471 - RNA, 20 nt, Homo sapiens
cagugaaggcuguccuuacc

SEQ ID NO: 1316472 - RNA, 16 nt, Homo sapiens
cagugacagugcccag

SEQ ID NO: 1316473 - RNA, 19 nt, Homo sapiens
cagugagcaaagauugugc

SEQ ID NO: 1316474 - RNA, 20 nt, Homo sapiens
cagugagccgagaucgugcc

SEQ ID NO: 1316475 - RNA, 19 nt, Homo sapiens
cagugagguucuuggguuu

SEQ ID NO: 1316476 - RNA, 22 nt, Homo sapiens
cagugcccacaggaucagucug

SEQ ID NO: 1316477 - RNA, 16 nt, Homo sapiens
cagugcccaugggcua

SEQ ID NO: 1316478 - RNA, 16 nt, Homo sapiens
cagugcccccacugac

SEQ ID NO: 1316479 - RNA, 12 nt, Homo sapiens
cagugcucccuc

SEQ ID NO: 1316480 - RNA, 14 nt, Homo sapiens
caguggaaggcauu

SEQ ID NO: 1316481 - RNA, 19 nt, Homo sapiens
caguggacucaaaacccau

SEQ ID NO: 1316482 - RNA, 17 nt, Homo sapiens
caguggauugcauuucu

SEQ ID NO: 1316483 - RNA, 18 nt, Homo sapiens
caguggcugcugcccagg

SEQ ID NO: 1316484 - RNA, 12 nt, Homo sapiens
caguggggcucu

SEQ ID NO: 1316485 - RNA, 15 nt, Homo sapiens
cagugguaugaucac

SEQ ID NO: 1316486 - RNA, 20 nt, Homo sapiens
caguguauagaaaaaccaaa

SEQ ID NO: 1316487 - RNA, 13 nt, Homo sapiens
caguuaaggggag

SEQ ID NO: 1316488 - RNA, 20 nt, Homo sapiens
caguuaauaaaccuuugcaa

SEQ ID NO: 1316489 - RNA, 14 nt, Homo sapiens
caguuagcucucaa

SEQ ID NO: 1316490 - RNA, 16 nt, Homo sapiens
caguucaccuugaaga

SEQ ID NO: 1316491 - RNA, 15 nt, Homo sapiens
caguuccaaaagaga

SEQ ID NO: 1316492 - RNA, 14 nt, Homo sapiens
caguucugucauau

SEQ ID NO: 1316493 - RNA, 19 nt, Homo sapiens
caguucugucauauguuaa

SEQ ID NO: 1316494 - RNA, 17 nt, Homo sapiens
caguugaagcugacuca

SEQ ID NO: 1316495 - RNA, 18 nt, Homo sapiens
caguugccauugacagaa

SEQ ID NO: 1316496 - RNA, 22 nt, Homo sapiens
caguugggugagaacaaccaaa

SEQ ID NO: 1316497 - RNA, 21 nt, Homo sapiens
caguuguuaaaaugagcauug

SEQ ID NO: 1316498 - RNA, 23 nt, Homo sapiens
caguuguuaaaaugagcauugau

SEQ ID NO: 1316499 - RNA, 16 nt, Homo sapiens
caguuuauuuccacua

SEQ ID NO: 1316500 - RNA, 19 nt, Homo sapiens
caguuugaguuaaugugcu

SEQ ID NO: 1316501 - RNA, 14 nt, Homo sapiens
caguuuuguugccc

SEQ ID NO: 1316502 - RNA, 23 nt, Homo sapiens
cauaaaaauacaacagugcauuu

SEQ ID NO: 1316503 - RNA, 22 nt, Homo sapiens
cauaaaaggacucucagccucu

SEQ ID NO: 1316504 - RNA, 17 nt, Homo sapiens
cauaaaauagagugcau

SEQ ID NO: 1316505 - RNA, 14 nt, Homo sapiens
cauaaacauuugag

SEQ ID NO: 1316506 - RNA, 19 nt, Homo sapiens
cauaaacuuuccucuuccu

SEQ ID NO: 1316507 - RNA, 17 nt, Homo sapiens
cauaaagacaaucacug

SEQ ID NO: 1316508 - RNA, 13 nt, Homo sapiens
cauaacaauuccu

SEQ ID NO: 1316509 - RNA, 19 nt, Homo sapiens
cauaaguaccucagcauuu

SEQ ID NO: 1316510 - RNA, 21 nt, Homo sapiens
cauaaucuauaaacaaugaaa

SEQ ID NO: 1316511 - RNA, 18 nt, Homo sapiens
cauaauuuacaugcaaua

SEQ ID NO: 1316512 - RNA, 23 nt, Homo sapiens
cauacaauuauuuuuacaguucu

SEQ ID NO: 1316513 - RNA, 15 nt, Homo sapiens
cauacccuguuacca

SEQ ID NO: 1316514 - RNA, 18 nt, Homo sapiens
cauacuaucuacucuccu

SEQ ID NO: 1316515 - RNA, 23 nt, Homo sapiens
cauagaaaauuggguguguauac

SEQ ID NO: 1316516 - RNA, 19 nt, Homo sapiens
cauagauguuaugcaaaaa

SEQ ID NO: 1316517 - RNA, 17 nt, Homo sapiens
cauagcagcugcuacua

SEQ ID NO: 1316518 - RNA, 18 nt, Homo sapiens
cauagguugagcaauuuc

SEQ ID NO: 1316519 - RNA, 20 nt, Homo sapiens
cauaguaccauuuauacaaa

SEQ ID NO: 1316520 - RNA, 19 nt, Homo sapiens
cauaguguuaacugucagu

SEQ ID NO: 1316521 - RNA, 13 nt, Homo sapiens
cauauacaauaau

SEQ ID NO: 1316522 - RNA, 19 nt, Homo sapiens
cauauacacaauaauguga

SEQ ID NO: 1316523 - RNA, 21 nt, Homo sapiens
cauauauauuaauacugguau

SEQ ID NO: 1316524 - RNA, 13 nt, Homo sapiens
cauauauguagcu

SEQ ID NO: 1316525 - RNA, 14 nt, Homo sapiens
cauaucagaacugu

SEQ ID NO: 1316526 - RNA, 17 nt, Homo sapiens
cauaucguaaagcuguu

SEQ ID NO: 1316527 - RNA, 13 nt, Homo sapiens
cauaucuuuauua

SEQ ID NO: 1316528 - RNA, 16 nt, Homo sapiens
cauaugaaaggugcca

SEQ ID NO: 1316529 - RNA, 14 nt, Homo sapiens
cauaugaacauaua

SEQ ID NO: 1316530 - RNA, 15 nt, Homo sapiens
cauauguacagaaga

SEQ ID NO: 1316531 - RNA, 20 nt, Homo sapiens
cauauuguuccuuaucaccu

SEQ ID NO: 1316532 - RNA, 23 nt, Homo sapiens
cauauuuugguuuguguauccau

SEQ ID NO: 1316533 - RNA, 14 nt, Homo sapiens
caucaaagaugacu

SEQ ID NO: 1316534 - RNA, 18 nt, Homo sapiens
caucaaagaugacuugaa

SEQ ID NO: 1316535 - RNA, 19 nt, Homo sapiens
caucaaauggaagacacau

SEQ ID NO: 1316536 - RNA, 24 nt, Homo sapiens
caucaaauggaagacacauugaaa

SEQ ID NO: 1316537 - RNA, 17 nt, Homo sapiens
caucaccuccaccauac

SEQ ID NO: 1316538 - RNA, 16 nt, Homo sapiens
caucacugguugcacu

SEQ ID NO: 1316539 - RNA, 21 nt, Homo sapiens
caucagacuccugugcaacuu

SEQ ID NO: 1316540 - RNA, 23 nt, Homo sapiens
caucagguuuuguuuuuuuucag

SEQ ID NO: 1316541 - RNA, 17 nt, Homo sapiens
caucaucuccugccuuc

SEQ ID NO: 1316542 - RNA, 15 nt, Homo sapiens
caucaucuuguucag

SEQ ID NO: 1316543 - RNA, 12 nt, Homo sapiens
cauccaaagcag

SEQ ID NO: 1316544 - RNA, 16 nt, Homo sapiens
cauccaagcaaacuga

SEQ ID NO: 1316545 - RNA, 17 nt, Homo sapiens
cauccaaugcucaagaa

SEQ ID NO: 1316546 - RNA, 13 nt, Homo sapiens
cauccagugacaa

SEQ ID NO: 1316547 - RNA, 17 nt, Homo sapiens
cauccagugacaaacca

SEQ ID NO: 1316548 - RNA, 12 nt, Homo sapiens
cauccaucacag

SEQ ID NO: 1316549 - RNA, 16 nt, Homo sapiens
cauccaucaucaugug

SEQ ID NO: 1316550 - RNA, 15 nt, Homo sapiens
caucccagagccugg

SEQ ID NO: 1316551 - RNA, 15 nt, Homo sapiens
caucccucuguucac

SEQ ID NO: 1316552 - RNA, 15 nt, Homo sapiens
cauccguggcugcag

SEQ ID NO: 1316553 - RNA, 19 nt, Homo sapiens
cauuuuucaacuuugaaua

SEQ ID NO: 1316554 - RNA, 19 nt, Homo sapiens
cauuuuuuaaaaaagcaag

SEQ ID NO: 1316555 - RNA, 13 nt, Homo sapiens
ccaaaagaagccc

SEQ ID NO: 1316556 - RNA, 22 nt, Homo sapiens
ccaaaagacuccaguacuauuu

SEQ ID NO: 1316557 - RNA, 16 nt, Homo sapiens
ccaaaaucaugccauu

SEQ ID NO: 1316558 - RNA, 16 nt, Homo sapiens
ccaaaaucuuaucaug

SEQ ID NO: 1316559 - RNA, 21 nt, Homo sapiens
ccaaaauuuugucccaucucu

SEQ ID NO: 1316560 - RNA, 11 nt, Homo sapiens
ccaaacauguu

SEQ ID NO: 1316561 - RNA, 21 nt, Homo sapiens
ccaaacauguuguacauuuca

SEQ ID NO: 1316562 - RNA, 17 nt, Homo sapiens
ccaaaccuuaucuccac

SEQ ID NO: 1316563 - RNA, 10 nt, Homo sapiens
ccaaagggac

SEQ ID NO: 1316564 - RNA, 22 nt, Homo sapiens
ccaaaggguuaauauuuaaccu

SEQ ID NO: 1316565 - RNA, 21 nt, Homo sapiens
ccaaaguaaaagaaaccacuu

SEQ ID NO: 1316566 - RNA, 18 nt, Homo sapiens
ccaaagugucuuuugaca

SEQ ID NO: 1316567 - RNA, 18 nt, Homo sapiens
ccaaauaaaauguucccu

SEQ ID NO: 1316568 - RNA, 21 nt, Homo sapiens
ccaaauauuuagcaucuuccu

SEQ ID NO: 1316569 - RNA, 23 nt, Homo sapiens
ccaaauccagugugcaccccucc

SEQ ID NO: 1316570 - RNA, 13 nt, Homo sapiens
ccaaaucuccaag

SEQ ID NO: 1316571 - RNA, 15 nt, Homo sapiens
ccaaauguccuuaaa

SEQ ID NO: 1316572 - RNA, 18 nt, Homo sapiens
ccaaauuuuaucuggaag

SEQ ID NO: 1316573 - RNA, 14 nt, Homo sapiens
ccaacacugagcaa

SEQ ID NO: 1316574 - RNA, 15 nt, Homo sapiens
ccaacauacuuuaag

SEQ ID NO: 1316575 - RNA, 20 nt, Homo sapiens
ccaaccccccagcacugagg

SEQ ID NO: 1316576 - RNA, 17 nt, Homo sapiens
ccaaccggucacccagg

SEQ ID NO: 1316577 - RNA, 19 nt, Homo sapiens
ccaacuagcucuauguuua

SEQ ID NO: 1316578 - RNA, 16 nt, Homo sapiens
ccaacucagaagggag

SEQ ID NO: 1316579 - RNA, 21 nt, Homo sapiens
ccaacuucuucagagcugaca

SEQ ID NO: 1316580 - RNA, 13 nt, Homo sapiens
ccaacuuuugcau

SEQ ID NO: 1316581 - RNA, 17 nt, Homo sapiens
ccaagaaaaaaaauaga

SEQ ID NO: 1316582 - RNA, 19 nt, Homo sapiens
ccaagcagagaagcucucg

SEQ ID NO: 1316583 - RNA, 23 nt, Homo sapiens
ccaagcagugccugccuaugaaa

SEQ ID NO: 1316584 - RNA, 22 nt, Homo sapiens
ccaagcuucaacccucagccuu

SEQ ID NO: 1316585 - RNA, 22 nt, Homo sapiens
ccaaggaacuaauuucuucucc

SEQ ID NO: 1316586 - RNA, 21 nt, Homo sapiens
ccaaggaggguguaauggagc

SEQ ID NO: 1316587 - RNA, 15 nt, Homo sapiens
ccaagucaugugcau

SEQ ID NO: 1316588 - RNA, 23 nt, Homo sapiens
ccaaguuccaaaauaaagcauaa

SEQ ID NO: 1316589 - RNA, 22 nt, Homo sapiens
ccaauaaagccuucaaacuccc

SEQ ID NO: 1316590 - RNA, 16 nt, Homo sapiens
ccaauauuuaccagac

SEQ ID NO: 1316591 - RNA, 15 nt, Homo sapiens
ccaauuaauguagcu

SEQ ID NO: 1316592 - RNA, 14 nt, Homo sapiens
ccacaaacuguaau

SEQ ID NO: 1316593 - RNA, 16 nt, Homo sapiens
ccacaagccugaauuu

SEQ ID NO: 1316594 - RNA, 15 nt, Homo sapiens
ccacacccagcucag

SEQ ID NO: 1316595 - RNA, 18 nt, Homo sapiens
ccacagacucaaaugcuc

SEQ ID NO: 1316596 - RNA, 19 nt, Homo sapiens
ccacagcaaccccaggcug

SEQ ID NO: 1316597 - RNA, 14 nt, Homo sapiens
ccacaggacauuuc

SEQ ID NO: 1316598 - RNA, 19 nt, Homo sapiens
ccacaggccugagauuuca

SEQ ID NO: 1316599 - RNA, 21 nt, Homo sapiens
ccacaggccugagauuucauc

SEQ ID NO: 1316600 - RNA, 22 nt, Homo sapiens
ccacagggucugccuccagcca

SEQ ID NO: 1316601 - RNA, 14 nt, Homo sapiens
ccacaggugugagc

SEQ ID NO: 1316602 - RNA, 20 nt, Homo sapiens
ccacaguggaaagacagcuu

SEQ ID NO: 1316603 - RNA, 23 nt, Homo sapiens
ccacauccuccacguucugcuca

SEQ ID NO: 1316604 - RNA, 15 nt, Homo sapiens
ccacaugccaagcac

SEQ ID NO: 1316605 - RNA, 18 nt, Homo sapiens
ccaccaccaucaccagac

SEQ ID NO: 1316606 - RNA, 22 nt, Homo sapiens
ccaccacgcagaccaccagcau

SEQ ID NO: 1316607 - RNA, 22 nt, Homo sapiens
ccaccaggagggaguggcagcu

SEQ ID NO: 1316608 - RNA, 19 nt, Homo sapiens
ccaccauaugaauuguaca

SEQ ID NO: 1316609 - RNA, 20 nt, Homo sapiens
ccacccuccuuucaccacau

SEQ ID NO: 1316610 - RNA, 21 nt, Homo sapiens
ccacccuggugggccaacaaa

SEQ ID NO: 1316611 - RNA, 14 nt, Homo sapiens
ccaccuuucuggac

SEQ ID NO: 1316612 - RNA, 21 nt, Homo sapiens
ccacggcaggccccugcagga

SEQ ID NO: 1316613 - RNA, 19 nt, Homo sapiens
ccacguugccucuacuuua

SEQ ID NO: 1316614 - RNA, 14 nt, Homo sapiens
ccacuacacuccag

SEQ ID NO: 1316615 - RNA, 12 nt, Homo sapiens
ccacuacugcua

SEQ ID NO: 1316616 - RNA, 20 nt, Homo sapiens
ccacuaggguccaccaggag

SEQ ID NO: 1316617 - RNA, 20 nt, Homo sapiens
ccacuaucccauuugcccuc

SEQ ID NO: 1316618 - RNA, 17 nt, Homo sapiens
ccacuauuuucaaagaa

SEQ ID NO: 1316619 - RNA, 15 nt, Homo sapiens
ccacucaggucugua

SEQ ID NO: 1316620 - RNA, 16 nt, Homo sapiens
ccacucggcggcagca

SEQ ID NO: 1316621 - RNA, 18 nt, Homo sapiens
ccacucucuaccagauaa

SEQ ID NO: 1316622 - RNA, 14 nt, Homo sapiens
ccacugacccaaau

SEQ ID NO: 1316623 - RNA, 17 nt, Homo sapiens
ccacugccacacccucc

SEQ ID NO: 1316624 - RNA, 19 nt, Homo sapiens
ccacugcugcccccagaaa

SEQ ID NO: 1316625 - RNA, 20 nt, Homo sapiens
ccacuggcaaauguaacugu

SEQ ID NO: 1316626 - RNA, 15 nt, Homo sapiens
ccacuguuugucuca

SEQ ID NO: 1316627 - RNA, 16 nt, Homo sapiens
ccacuguuugucucac

SEQ ID NO: 1316628 - RNA, 21 nt, Homo sapiens
ccacuucuggguggggcagug

SEQ ID NO: 1316629 - RNA, 15 nt, Homo sapiens
ccacuucugugccac

SEQ ID NO: 1316630 - RNA, 16 nt, Homo sapiens
ccacuuguuugcacug

SEQ ID NO: 1316631 - RNA, 17 nt, Homo sapiens
ccagaaaaccuccagua

SEQ ID NO: 1316632 - RNA, 15 nt, Homo sapiens
ccagaaauguacuuu

SEQ ID NO: 1316633 - RNA, 15 nt, Homo sapiens
ccagaacacacucca

SEQ ID NO: 1316634 - RNA, 17 nt, Homo sapiens
ccagaagcugagcacca

SEQ ID NO: 1316635 - RNA, 12 nt, Homo sapiens
ccagaaugcugc

SEQ ID NO: 1316636 - RNA, 19 nt, Homo sapiens
ccagaaugcugcaggacuu

SEQ ID NO: 1316637 - RNA, 13 nt, Homo sapiens
ccagacccggcug

SEQ ID NO: 1316638 - RNA, 15 nt, Homo sapiens
ccagacucagacauu

SEQ ID NO: 1316639 - RNA, 19 nt, Homo sapiens
ccagagaccaaacaaggac

SEQ ID NO: 1316640 - RNA, 20 nt, Homo sapiens
ccagagagccuggugcugcu

SEQ ID NO: 1316641 - RNA, 22 nt, Homo sapiens
ccagagcggaaggagggagcuc

SEQ ID NO: 1316642 - RNA, 15 nt, Homo sapiens
ccagaggacugugau

SEQ ID NO: 1316643 - RNA, 15 nt, Homo sapiens
ccagagggcacucug

SEQ ID NO: 1316644 - RNA, 18 nt, Homo sapiens
ccagaucuaacaucuuga

SEQ ID NO: 1316645 - RNA, 16 nt, Homo sapiens
ccagaugcagggcagu

SEQ ID NO: 1316646 - RNA, 13 nt, Homo sapiens
ccagaugccaggg

SEQ ID NO: 1316647 - RNA, 17 nt, Homo sapiens
ccagaugugguugcaua

SEQ ID NO: 1316648 - RNA, 14 nt, Homo sapiens
ccagauuggcucac

SEQ ID NO: 1316649 - RNA, 22 nt, Homo sapiens
ccagauuggcucacacugagaa

SEQ ID NO: 1316650 - RNA, 13 nt, Homo sapiens
ccagcacccaaag

SEQ ID NO: 1316651 - RNA, 14 nt, Homo sapiens
ccagcacugaggaa

SEQ ID NO: 1316652 - RNA, 10 nt, Homo sapiens
ccagcacuuc

SEQ ID NO: 1316653 - RNA, 21 nt, Homo sapiens
ccagcauucucaggcaccagu

SEQ ID NO: 1316654 - RNA, 16 nt, Homo sapiens
ccagccagggcugcua

SEQ ID NO: 1316655 - RNA, 17 nt, Homo sapiens
ccagccaugucugcauu

SEQ ID NO: 1316656 - RNA, 20 nt, Homo sapiens
ccagcccagaaagucucuca

SEQ ID NO: 1316657 - RNA, 13 nt, Homo sapiens
ccagcccagagac

SEQ ID NO: 1316658 - RNA, 17 nt, Homo sapiens
ccagcccauaaccagua

SEQ ID NO: 1316659 - RNA, 12 nt, Homo sapiens
ccagccuaagaa

SEQ ID NO: 1316660 - RNA, 22 nt, Homo sapiens
ccagccuggccaagagaccagc

SEQ ID NO: 1316661 - RNA, 20 nt, Homo sapiens
ccagccugggugacagagca

SEQ ID NO: 1316662 - RNA, 18 nt, Homo sapiens
ccagcuaagaaccuggaa

SEQ ID NO: 1316663 - RNA, 23 nt, Homo sapiens
ccagcucaggacagaugccacac

SEQ ID NO: 1316664 - RNA, 20 nt, Homo sapiens
ccagcuccaaccugcaaaga

SEQ ID NO: 1316665 - RNA, 16 nt, Homo sapiens
ccagcuccaaggggaa

SEQ ID NO: 1316666 - RNA, 15 nt, Homo sapiens
ccagcuccugggcag

SEQ ID NO: 1316667 - RNA, 21 nt, Homo sapiens
ccagcuucccgaguaccagug

SEQ ID NO: 1316668 - RNA, 23 nt, Homo sapiens
ccagcuucccgaguaccagugac

SEQ ID NO: 1316669 - RNA, 23 nt, Homo sapiens
ccaggaagcuuuggugagaaccu

SEQ ID NO: 1316670 - RNA, 15 nt, Homo sapiens
ccaggacacccagug

SEQ ID NO: 1316671 - RNA, 22 nt, Homo sapiens
ccaggacccugaaggggccaug

SEQ ID NO: 1316672 - RNA, 19 nt, Homo sapiens
ccaggacgcccucacugca

SEQ ID NO: 1316673 - RNA, 23 nt, Homo sapiens
ccaggacucugaccccagcauuc

SEQ ID NO: 1316674 - RNA, 13 nt, Homo sapiens
ccaggauuugcac

SEQ ID NO: 1316675 - RNA, 13 nt, Homo sapiens
ccaggcaggcuaa

SEQ ID NO: 1316676 - RNA, 16 nt, Homo sapiens
ccaggccucuuggcag

SEQ ID NO: 1316677 - RNA, 17 nt, Homo sapiens
ccaggccugagcugcuu

SEQ ID NO: 1316678 - RNA, 18 nt, Homo sapiens
ccaggcgggcaccaaaca

SEQ ID NO: 1316679 - RNA, 18 nt, Homo sapiens
ccaggcugaccacagcac

SEQ ID NO: 1316680 - RNA, 20 nt, Homo sapiens
ccaggcuggcgugcaguggu

SEQ ID NO: 1316681 - RNA, 22 nt, Homo sapiens
ccagggacugaagccaaaguua

SEQ ID NO: 1316682 - RNA, 23 nt, Homo sapiens
ccagggcucuaaugugucucuca

SEQ ID NO: 1316683 - RNA, 18 nt, Homo sapiens
ccagggcuggacugaggc

SEQ ID NO: 1316684 - RNA, 20 nt, Homo sapiens
ccaguaggaaaagcaaugcu

SEQ ID NO: 1316685 - RNA, 23 nt, Homo sapiens
cggagacggagucccaccuuggc

SEQ ID NO: 1316686 - RNA, 14 nt, Homo sapiens
cggauacaaacugg

SEQ ID NO: 1316687 - RNA, 17 nt, Homo sapiens
cggcaacaucaacccga

SEQ ID NO: 1316688 - RNA, 14 nt, Homo sapiens
cggcaacaucucug

SEQ ID NO: 1316689 - RNA, 16 nt, Homo sapiens
cggcaacauuccucag

SEQ ID NO: 1316690 - RNA, 21 nt, Homo sapiens
cggccccugcugguucagggu

SEQ ID NO: 1316691 - RNA, 14 nt, Homo sapiens
cggcgauaccauag

SEQ ID NO: 1316692 - RNA, 16 nt, Homo sapiens
cggcgcaagaccagcu

SEQ ID NO: 1316693 - RNA, 16 nt, Homo sapiens
cggcucgauuucucca

SEQ ID NO: 1316694 - RNA, 11 nt, Homo sapiens
cggcugaccau

SEQ ID NO: 1316695 - RNA, 13 nt, Homo sapiens
cgggacagacuaa

SEQ ID NO: 1316696 - RNA, 22 nt, Homo sapiens
cgggaggauguucugggacaca

SEQ ID NO: 1316697 - RNA, 16 nt, Homo sapiens
cgggauccagcucauc

SEQ ID NO: 1316698 - RNA, 13 nt, Homo sapiens
cgggcaccuguaa

SEQ ID NO: 1316699 - RNA, 22 nt, Homo sapiens
cggggcugucccgugcaugggu

SEQ ID NO: 1316700 - RNA, 17 nt, Homo sapiens
cgggggaggcccgcaga

SEQ ID NO: 1316701 - RNA, 23 nt, Homo sapiens
cgggggcuuggcugugcccucag

SEQ ID NO: 1316702 - RNA, 18 nt, Homo sapiens
cgguaaacacgccugcaa

SEQ ID NO: 1316703 - RNA, 14 nt, Homo sapiens
cggugaacucuggc

SEQ ID NO: 1316704 - RNA, 21 nt, Homo sapiens
cggugagcuacaaaugcauuu

SEQ ID NO: 1316705 - RNA, 22 nt, Homo sapiens
cggugcuugauagaaaugccaa

SEQ ID NO: 1316706 - RNA, 14 nt, Homo sapiens
cgguguuuugccau

SEQ ID NO: 1316707 - RNA, 14 nt, Homo sapiens
cgguuaccucugca

SEQ ID NO: 1316708 - RNA, 17 nt, Homo sapiens
cgguuaccucugcaugg

SEQ ID NO: 1316709 - RNA, 16 nt, Homo sapiens
cgguuccugucccugc

SEQ ID NO: 1316710 - RNA, 23 nt, Homo sapiens
cguaacaccugauuaacugaggc

SEQ ID NO: 1316711 - RNA, 17 nt, Homo sapiens
cgucaaagcugaaaugg

SEQ ID NO: 1316712 - RNA, 16 nt, Homo sapiens
cgucaugcuuguguua

SEQ ID NO: 1316713 - RNA, 19 nt, Homo sapiens
cguccauauuuaacaugua

SEQ ID NO: 1316714 - RNA, 13 nt, Homo sapiens
cguccuacuguau

SEQ ID NO: 1316715 - RNA, 18 nt, Homo sapiens
cguccuccguccauauca

SEQ ID NO: 1316716 - RNA, 17 nt, Homo sapiens
cgucuccgaagauuugg

SEQ ID NO: 1316717 - RNA, 20 nt, Homo sapiens
cgucucuacuaaaaauacaa

SEQ ID NO: 1316718 - RNA, 18 nt, Homo sapiens
cgucucuguuccaugucu

SEQ ID NO: 1316719 - RNA, 18 nt, Homo sapiens
cgugaaggccgagaagca

SEQ ID NO: 1316720 - RNA, 22 nt, Homo sapiens
cgugaagggauuuuagucacac

SEQ ID NO: 1316721 - RNA, 16 nt, Homo sapiens
cgugaccagugcugcu

SEQ ID NO: 1316722 - RNA, 15 nt, Homo sapiens
cgugagaacaaucau

SEQ ID NO: 1316723 - RNA, 12 nt, Homo sapiens
cgugaguggucu

SEQ ID NO: 1316724 - RNA, 21 nt, Homo sapiens
cgugggcugggcccacaaagg

SEQ ID NO: 1316725 - RNA, 23 nt, Homo sapiens
cgugguaugucugccauguugcc

SEQ ID NO: 1316726 - RNA, 12 nt, Homo sapiens
cguggucccuga

SEQ ID NO: 1316727 - RNA, 16 nt, Homo sapiens
cguuccacauccacac

SEQ ID NO: 1316728 - RNA, 23 nt, Homo sapiens
cuaaaacagaaaaaaaaauggaa

SEQ ID NO: 1316729 - RNA, 15 nt, Homo sapiens
cuaaaagcacacuca

SEQ ID NO: 1316730 - RNA, 22 nt, Homo sapiens
cuaaaauaagggcagagucaca

SEQ ID NO: 1316731 - RNA, 14 nt, Homo sapiens
cuaaaaucagggaa

SEQ ID NO: 1316732 - RNA, 15 nt, Homo sapiens
cuaaacaccacguca

SEQ ID NO: 1316733 - RNA, 18 nt, Homo sapiens
cuaaaccaaggacugagc

SEQ ID NO: 1316734 - RNA, 20 nt, Homo sapiens
cuaaaccaaggacugagcac

SEQ ID NO: 1316735 - RNA, 16 nt, Homo sapiens
cuaaacucauuuauaa

SEQ ID NO: 1316736 - RNA, 20 nt, Homo sapiens
cuaaacuccaggggggacaa

SEQ ID NO: 1316737 - RNA, 23 nt, Homo sapiens
cuaaacuccuuccuggccugaga

SEQ ID NO: 1316738 - RNA, 14 nt, Homo sapiens
cuaaagaguuuauu

SEQ ID NO: 1316739 - RNA, 15 nt, Homo sapiens
cuaaaguagagcccu

SEQ ID NO: 1316740 - RNA, 14 nt, Homo sapiens
cuaaaugacuuuca

SEQ ID NO: 1316741 - RNA, 21 nt, Homo sapiens
cuaaaugcacagucaugugcc

SEQ ID NO: 1316742 - RNA, 20 nt, Homo sapiens
cuaaauuuucugaaacugca

SEQ ID NO: 1316743 - RNA, 21 nt, Homo sapiens
cuaacacagccaucaagggaa

SEQ ID NO: 1316744 - RNA, 17 nt, Homo sapiens
cuaaccagccuggucaa

SEQ ID NO: 1316745 - RNA, 18 nt, Homo sapiens
cuaacccucacaagcaug

SEQ ID NO: 1316746 - RNA, 21 nt, Homo sapiens
cuaacuaugcauggugcccca

SEQ ID NO: 1316747 - RNA, 24 nt, Homo sapiens
cuaacuccuuaacaacuguagcaa

SEQ ID NO: 1316748 - RNA, 16 nt, Homo sapiens
cuaacugucugacuua

SEQ ID NO: 1316749 - RNA, 17 nt, Homo sapiens
cuaacuucaaggcccau

SEQ ID NO: 1316750 - RNA, 18 nt, Homo sapiens
cuaagaauucaaacuggg

SEQ ID NO: 1316751 - RNA, 20 nt, Homo sapiens
cuaagaucucgguuugccaa

SEQ ID NO: 1316752 - RNA, 14 nt, Homo sapiens
cuaagcuggucuca

SEQ ID NO: 1316753 - RNA, 16 nt, Homo sapiens
cuaagcuucacuguaa

SEQ ID NO: 1316754 - RNA, 23 nt, Homo sapiens
cuaaggggcccggccagccaugu

SEQ ID NO: 1316755 - RNA, 13 nt, Homo sapiens
cuaaguauauuaa

SEQ ID NO: 1316756 - RNA, 18 nt, Homo sapiens
cuaaguauauuaauauca

SEQ ID NO: 1316757 - RNA, 12 nt, Homo sapiens
cuaagugaugcu

SEQ ID NO: 1316758 - RNA, 18 nt, Homo sapiens
cuaaucccaacaagcaag

SEQ ID NO: 1316759 - RNA, 12 nt, Homo sapiens
cuaaugggacac

SEQ ID NO: 1316760 - RNA, 18 nt, Homo sapiens
cuaauguugcuggaucag

SEQ ID NO: 1316761 - RNA, 14 nt, Homo sapiens
cuaauuauuuacuc

SEQ ID NO: 1316762 - RNA, 13 nt, Homo sapiens
cuaauucagccau

SEQ ID NO: 1316763 - RNA, 19 nt, Homo sapiens
cuaauucuucuguccugag

SEQ ID NO: 1316764 - RNA, 16 nt, Homo sapiens
cuaauuuacuggacaa

SEQ ID NO: 1316765 - RNA, 18 nt, Homo sapiens
cuaauuuauaacuauuau

SEQ ID NO: 1316766 - RNA, 21 nt, Homo sapiens
cuaauuugcauuaaauucaca

SEQ ID NO: 1316767 - RNA, 22 nt, Homo sapiens
cuaauuuuuaagaaauuuugcc

SEQ ID NO: 1316768 - RNA, 17 nt, Homo sapiens
cuacaaaaccacuggaa

SEQ ID NO: 1316769 - RNA, 14 nt, Homo sapiens
cuacacacugucau

SEQ ID NO: 1316770 - RNA, 15 nt, Homo sapiens
cuacacugacacugg

SEQ ID NO: 1316771 - RNA, 14 nt, Homo sapiens
cuacagaggccaug

SEQ ID NO: 1316772 - RNA, 20 nt, Homo sapiens
cuaccaacgaaagacgugau

SEQ ID NO: 1316773 - RNA, 21 nt, Homo sapiens
cuaccaacgaaagacgugauu

SEQ ID NO: 1316774 - RNA, 21 nt, Homo sapiens
cuaccaacuuguauccaggcc

SEQ ID NO: 1316775 - RNA, 21 nt, Homo sapiens
cuaccacaugccaagcacugu

SEQ ID NO: 1316776 - RNA, 15 nt, Homo sapiens
cuacccacuucuccc

SEQ ID NO: 1316777 - RNA, 13 nt, Homo sapiens
cuacccccugaaa

SEQ ID NO: 1316778 - RNA, 21 nt, Homo sapiens
cuaccucaaccaaugccaaaa

SEQ ID NO: 1316779 - RNA, 12 nt, Homo sapiens
cuaccucuccag

SEQ ID NO: 1316780 - RNA, 19 nt, Homo sapiens
cuaccugaguccugaagcu

SEQ ID NO: 1316781 - RNA, 20 nt, Homo sapiens
cuaccuuagaaaacaaguau

SEQ ID NO: 1316782 - RNA, 17 nt, Homo sapiens
cuaccuucucuacccau

SEQ ID NO: 1316783 - RNA, 16 nt, Homo sapiens
cuacgaaauacuaaga

SEQ ID NO: 1316784 - RNA, 19 nt, Homo sapiens
cuacuaaaaauacaaaaau

SEQ ID NO: 1316785 - RNA, 16 nt, Homo sapiens
cuacugcaagagccaa

SEQ ID NO: 1316786 - RNA, 23 nt, Homo sapiens
cuacugcaagagccaaguuccaa

SEQ ID NO: 1316787 - RNA, 14 nt, Homo sapiens
cuacuucugagcaa

SEQ ID NO: 1316788 - RNA, 23 nt, Homo sapiens
cuacuugccugggaaacauagca

SEQ ID NO: 1316789 - RNA, 17 nt, Homo sapiens
cuacuugcucagguacu

SEQ ID NO: 1316790 - RNA, 19 nt, Homo sapiens
cuacuugggaggcugaggc

SEQ ID NO: 1316791 - RNA, 13 nt, Homo sapiens
cuacuuuugggaa

SEQ ID NO: 1316792 - RNA, 14 nt, Homo sapiens
cuagaaguagauuc

SEQ ID NO: 1316793 - RNA, 18 nt, Homo sapiens
cuagaagugccaucucaa

SEQ ID NO: 1316794 - RNA, 16 nt, Homo sapiens
cuagaaucuucuuaca

SEQ ID NO: 1316795 - RNA, 18 nt, Homo sapiens
cuagacuagacaucacaa

SEQ ID NO: 1316796 - RNA, 14 nt, Homo sapiens
cuagacuggcugaa

SEQ ID NO: 1316797 - RNA, 14 nt, Homo sapiens
cuagagcacugcca

SEQ ID NO: 1316798 - RNA, 15 nt, Homo sapiens
cuagagcacugccac

SEQ ID NO: 1316799 - RNA, 15 nt, Homo sapiens
cuagagcuacagggg

SEQ ID NO: 1316800 - RNA, 15 nt, Homo sapiens
cuagaggcccuuugc

SEQ ID NO: 1316801 - RNA, 20 nt, Homo sapiens
cuagaucaaggagcccagaa

SEQ ID NO: 1316802 - RNA, 15 nt, Homo sapiens
cuagcagcugcaguc

SEQ ID NO: 1316803 - RNA, 18 nt, Homo sapiens
cuagccagaggacuguga

SEQ ID NO: 1316804 - RNA, 19 nt, Homo sapiens
cuagccagaggacugugau

SEQ ID NO: 1316805 - RNA, 14 nt, Homo sapiens
cuagccagcuguca

SEQ ID NO: 1316806 - RNA, 17 nt, Homo sapiens
cuagcccugggacauca

SEQ ID NO: 1316807 - RNA, 23 nt, Homo sapiens
cuagcuauuggccucccaaaaga

SEQ ID NO: 1316808 - RNA, 21 nt, Homo sapiens
cuaggagaagggcugaacccu

SEQ ID NO: 1316809 - RNA, 17 nt, Homo sapiens
cuaggcauuugcugaau

SEQ ID NO: 1316810 - RNA, 17 nt, Homo sapiens
cuagggaaggguggugg

SEQ ID NO: 1316811 - RNA, 15 nt, Homo sapiens
cuagggaucccucau

SEQ ID NO: 1316812 - RNA, 16 nt, Homo sapiens
cuaggguaugggaaau

SEQ ID NO: 1316813 - RNA, 13 nt, Homo sapiens
cuaggugcccuug

SEQ ID NO: 1316814 - RNA, 15 nt, Homo sapiens
cuaguuacuguggua

SEQ ID NO: 1316815 - RNA, 22 nt, Homo sapiens
cuaguuuuguuuauaaauugga

SEQ ID NO: 1316816 - RNA, 18 nt, Homo sapiens
cuauaaaucaacaccuua

SEQ ID NO: 1316817 - RNA, 16 nt, Homo sapiens
cuugugagaacacagc

SEQ ID NO: 1316818 - RNA, 19 nt, Homo sapiens
cuuguguuauuuaaugagu

SEQ ID NO: 1316819 - RNA, 20 nt, Homo sapiens
cuuguuauugccucuacuuu

SEQ ID NO: 1316820 - RNA, 23 nt, Homo sapiens
cuuguuccccacugacagccucc

SEQ ID NO: 1316821 - RNA, 19 nt, Homo sapiens
cuuguucugagauucaaua

SEQ ID NO: 1316822 - RNA, 16 nt, Homo sapiens
cuuguuguaaaaagcc

SEQ ID NO: 1316823 - RNA, 21 nt, Homo sapiens
cuuuaaaaaauacacauagca

SEQ ID NO: 1316824 - RNA, 15 nt, Homo sapiens
cuuuaaaaagcaugu

SEQ ID NO: 1316825 - RNA, 16 nt, Homo sapiens
cuuuaaaaugcaaaau

SEQ ID NO: 1316826 - RNA, 19 nt, Homo sapiens
cuuuaaaauguaaagccau

SEQ ID NO: 1316827 - RNA, 20 nt, Homo sapiens
cuuuaagccugcauucuuaa

SEQ ID NO: 1316828 - RNA, 21 nt, Homo sapiens
cuuuaagugcacaacauuaca

SEQ ID NO: 1316829 - RNA, 16 nt, Homo sapiens
cuuuaaguuauuuuac

SEQ ID NO: 1316830 - RNA, 12 nt, Homo sapiens
cuuuaccugggg

SEQ ID NO: 1316831 - RNA, 22 nt, Homo sapiens
cuuuacgaggagucucacuggg

SEQ ID NO: 1316832 - RNA, 11 nt, Homo sapiens
cuuuacuccuc

SEQ ID NO: 1316833 - RNA, 16 nt, Homo sapiens
cuuuagaacagggaaa

SEQ ID NO: 1316834 - RNA, 17 nt, Homo sapiens
cuuuagaugguggcaca

SEQ ID NO: 1316835 - RNA, 22 nt, Homo sapiens
cuuuaguggugguauguaaugg

SEQ ID NO: 1316836 - RNA, 13 nt, Homo sapiens
cuuuaugcacauu

SEQ ID NO: 1316837 - RNA, 18 nt, Homo sapiens
cuuucaccccagggccug

SEQ ID NO: 1316838 - RNA, 21 nt, Homo sapiens
cuuucacccgcuccuacagcu

SEQ ID NO: 1316839 - RNA, 21 nt, Homo sapiens
cuuucacugagccuccacagc

SEQ ID NO: 1316840 - RNA, 16 nt, Homo sapiens
cuuucauaaaaacacu

SEQ ID NO: 1316841 - RNA, 14 nt, Homo sapiens
cuuucauaaucuuu

SEQ ID NO: 1316842 - RNA, 20 nt, Homo sapiens
cuuucauccacuagugcaaa

SEQ ID NO: 1316843 - RNA, 14 nt, Homo sapiens
cuuuccccagugac

SEQ ID NO: 1316844 - RNA, 17 nt, Homo sapiens
cuuuccuaaggcugcaa

SEQ ID NO: 1316845 - RNA, 14 nt, Homo sapiens
cuuuccuagauggc

SEQ ID NO: 1316846 - RNA, 13 nt, Homo sapiens
cuuucgaggccug

SEQ ID NO: 1316847 - RNA, 13 nt, Homo sapiens
cuuucucuuaaca

SEQ ID NO: 1316848 - RNA, 14 nt, Homo sapiens
cuuucucuuaacag

SEQ ID NO: 1316849 - RNA, 19 nt, Homo sapiens
cuuucugaccuucagcuca

SEQ ID NO: 1316850 - RNA, 18 nt, Homo sapiens
cuuucugcuaucaaagag

SEQ ID NO: 1316851 - RNA, 13 nt, Homo sapiens
cuuucuguucucc

SEQ ID NO: 1316852 - RNA, 15 nt, Homo sapiens
cuuucuguucuccag

SEQ ID NO: 1316853 - RNA, 14 nt, Homo sapiens
cuuucuucugaaua

SEQ ID NO: 1316854 - RNA, 14 nt, Homo sapiens
cuuucuuguuucau

SEQ ID NO: 1316855 - RNA, 15 nt, Homo sapiens
cuuucuuucuuagaa

SEQ ID NO: 1316856 - RNA, 12 nt, Homo sapiens
cuuucuuugugu

SEQ ID NO: 1316857 - RNA, 22 nt, Homo sapiens
cuuugauacagucaacaagccu

SEQ ID NO: 1316858 - RNA, 12 nt, Homo sapiens
cuuugcaaagac

SEQ ID NO: 1316859 - RNA, 14 nt, Homo sapiens
cuuugcugcagaac

SEQ ID NO: 1316860 - RNA, 21 nt, Homo sapiens
cuuugcuuuaaguguaacugg

SEQ ID NO: 1316861 - RNA, 14 nt, Homo sapiens
cuuuggaacacuac

SEQ ID NO: 1316862 - RNA, 17 nt, Homo sapiens
cuuuggagaucaaggag

SEQ ID NO: 1316863 - RNA, 17 nt, Homo sapiens
cuuuggagaugcugagg

SEQ ID NO: 1316864 - RNA, 17 nt, Homo sapiens
cuuuggcagcugcaaua

SEQ ID NO: 1316865 - RNA, 19 nt, Homo sapiens
cuuugggccagacaugcca

SEQ ID NO: 1316866 - RNA, 21 nt, Homo sapiens
cuuugggccagacaugccaca

SEQ ID NO: 1316867 - RNA, 22 nt, Homo sapiens
cuuuguacacgaagaccaucca

SEQ ID NO: 1316868 - RNA, 21 nt, Homo sapiens
cuuuguuuguugucagcugaa

SEQ ID NO: 1316869 - RNA, 17 nt, Homo sapiens
cuuuuaaaagcacguau

SEQ ID NO: 1316870 - RNA, 22 nt, Homo sapiens
cuuuuaaugucauuuguuaaaa

SEQ ID NO: 1316871 - RNA, 23 nt, Homo sapiens
cuuuuauaggugagaaaaaaaca

SEQ ID NO: 1316872 - RNA, 12 nt, Homo sapiens
cuuuuauuacau

SEQ ID NO: 1316873 - RNA, 17 nt, Homo sapiens
cuuuuauugacacagaa

SEQ ID NO: 1316874 - RNA, 15 nt, Homo sapiens
cuuuucagauugugg

SEQ ID NO: 1316875 - RNA, 15 nt, Homo sapiens
cuuuucauaaccuag

SEQ ID NO: 1316876 - RNA, 19 nt, Homo sapiens
cuuuuccaagcugccacug

SEQ ID NO: 1316877 - RNA, 18 nt, Homo sapiens
cuuuucccauugccaugc

SEQ ID NO: 1316878 - RNA, 14 nt, Homo sapiens
cuuuucccauuugu

SEQ ID NO: 1316879 - RNA, 16 nt, Homo sapiens
cuuuuccgaagcagaa

SEQ ID NO: 1316880 - RNA, 16 nt, Homo sapiens
cuuuuccuuaccuuua

SEQ ID NO: 1316881 - RNA, 18 nt, Homo sapiens
cuuuucuugccucugucc

SEQ ID NO: 1316882 - RNA, 18 nt, Homo sapiens
cuuuugcacaucuaguga

SEQ ID NO: 1316883 - RNA, 16 nt, Homo sapiens
cuuuugccauuagcca

SEQ ID NO: 1316884 - RNA, 15 nt, Homo sapiens
cuuuuggaaggugac

SEQ ID NO: 1316885 - RNA, 16 nt, Homo sapiens
cuuuuggagguauuca

SEQ ID NO: 1316886 - RNA, 19 nt, Homo sapiens
cuuuugguuacagcacaaa

SEQ ID NO: 1316887 - RNA, 17 nt, Homo sapiens
cuuuuuaaccugcaaaa

SEQ ID NO: 1316888 - RNA, 16 nt, Homo sapiens
cuuuuuauugccuucu

SEQ ID NO: 1316889 - RNA, 13 nt, Homo sapiens
cuuuuucacuccc

SEQ ID NO: 1316890 - RNA, 19 nt, Homo sapiens
cuuuuuccaguccccagaa

SEQ ID NO: 1316891 - RNA, 12 nt, Homo sapiens
cuuuuuucugcc

SEQ ID NO: 1316892 - RNA, 15 nt, Homo sapiens
gaaaaaaaaauggaa

SEQ ID NO: 1316893 - RNA, 22 nt, Homo sapiens
gaaaaaaagacaaggcugauuu

SEQ ID NO: 1316894 - RNA, 16 nt, Homo sapiens
gaaaaacaagucuuua

SEQ ID NO: 1316895 - RNA, 19 nt, Homo sapiens
gaaaaaccaccaccaucac

SEQ ID NO: 1316896 - RNA, 22 nt, Homo sapiens
gaaaaagccaaggugucauuua

SEQ ID NO: 1316897 - RNA, 15 nt, Homo sapiens
gaaaaauaaacacua

SEQ ID NO: 1316898 - RNA, 14 nt, Homo sapiens
gaaaaauaaugacu

SEQ ID NO: 1316899 - RNA, 17 nt, Homo sapiens
gaaaaaugguggucauu

SEQ ID NO: 1316900 - RNA, 12 nt, Homo sapiens
gaaaaauucauu

SEQ ID NO: 1316901 - RNA, 19 nt, Homo sapiens
gaaaacacugugcacaucu

SEQ ID NO: 1316902 - RNA, 22 nt, Homo sapiens
gaaaacuauaagccaauauucc

SEQ ID NO: 1316903 - RNA, 23 nt, Homo sapiens
gaaaagaaagaaguuauuuucca

SEQ ID NO: 1316904 - RNA, 17 nt, Homo sapiens
gaaaagagaaugaugcu

SEQ ID NO: 1316905 - RNA, 19 nt, Homo sapiens
gaaaagcggacaucagcug

SEQ ID NO: 1316906 - RNA, 20 nt, Homo sapiens
gaaaagcugcugacaguguu

SEQ ID NO: 1316907 - RNA, 19 nt, Homo sapiens
gaaaaggaaggcucuucuc

SEQ ID NO: 1316908 - RNA, 23 nt, Homo sapiens
gaaaaggaaggcucuucucccca

SEQ ID NO: 1316909 - RNA, 23 nt, Homo sapiens
gaaaaggugguguugguauccaa

SEQ ID NO: 1316910 - RNA, 14 nt, Homo sapiens
gaaaagugcauauu

SEQ ID NO: 1316911 - RNA, 11 nt, Homo sapiens
gaaaaguuauu

SEQ ID NO: 1316912 - RNA, 13 nt, Homo sapiens
gaaaauaauauua

SEQ ID NO: 1316913 - RNA, 14 nt, Homo sapiens
gaaaaugcauugua

SEQ ID NO: 1316914 - RNA, 21 nt, Homo sapiens
gaaaauguugagaaucccaaa

SEQ ID NO: 1316915 - RNA, 14 nt, Homo sapiens
gaaaauuauuugca

SEQ ID NO: 1316916 - RNA, 13 nt, Homo sapiens
gaaacaacuucua

SEQ ID NO: 1316917 - RNA, 12 nt, Homo sapiens
gaaacaggaaac

SEQ ID NO: 1316918 - RNA, 20 nt, Homo sapiens
gaaacauccauauugcacaa

SEQ ID NO: 1316919 - RNA, 13 nt, Homo sapiens
gaaaccacagcug

SEQ ID NO: 1316920 - RNA, 14 nt, Homo sapiens
gaaacuaacacagc

SEQ ID NO: 1316921 - RNA, 17 nt, Homo sapiens
gaaacuuuacaaccuga

SEQ ID NO: 1316922 - RNA, 22 nt, Homo sapiens
gaaagacaagcucaaguguuca

SEQ ID NO: 1316923 - RNA, 12 nt, Homo sapiens
gaaagagacaca

SEQ ID NO: 1316924 - RNA, 14 nt, Homo sapiens
gaaagaucaaagac

SEQ ID NO: 1316925 - RNA, 21 nt, Homo sapiens
gaaagcaacuuuacugagaca

SEQ ID NO: 1316926 - RNA, 19 nt, Homo sapiens
gaaagcaguucugaugcuu

SEQ ID NO: 1316927 - RNA, 18 nt, Homo sapiens
gaaagcugacauugccaa

SEQ ID NO: 1316928 - RNA, 12 nt, Homo sapiens
gaaaggccuuca

SEQ ID NO: 1316929 - RNA, 13 nt, Homo sapiens
gaaaggccuucag

SEQ ID NO: 1316930 - RNA, 13 nt, Homo sapiens
gaaaggugccaug

SEQ ID NO: 1316931 - RNA, 23 nt, Homo sapiens
gaaaguauguaccaaaacauuga

SEQ ID NO: 1316932 - RNA, 14 nt, Homo sapiens
gaaaguucuggaaa

SEQ ID NO: 1316933 - RNA, 16 nt, Homo sapiens
gaaauaaaggaguuau

SEQ ID NO: 1316934 - RNA, 18 nt, Homo sapiens
gaaauacagucuuccaca

SEQ ID NO: 1316935 - RNA, 18 nt, Homo sapiens
gaaauagauccagugcug

SEQ ID NO: 1316936 - RNA, 19 nt, Homo sapiens
gaaauagauccagugcuga

SEQ ID NO: 1316937 - RNA, 21 nt, Homo sapiens
gaaauagguuaaacugaagca

SEQ ID NO: 1316938 - RNA, 13 nt, Homo sapiens
gaaauaguacuua

SEQ ID NO: 1316939 - RNA, 19 nt, Homo sapiens
gaaauauucuuaggcagau

SEQ ID NO: 1316940 - RNA, 22 nt, Homo sapiens
gaaaucuaccaagcuugcaaga

SEQ ID NO: 1316941 - RNA, 18 nt, Homo sapiens
gaaaugaggccuacucua

SEQ ID NO: 1316942 - RNA, 19 nt, Homo sapiens
gaaaugaggccuacucuaa

SEQ ID NO: 1316943 - RNA, 20 nt, Homo sapiens
gaaauggaacagugaggaau

SEQ ID NO: 1316944 - RNA, 15 nt, Homo sapiens
gaaauggagaagcuc

SEQ ID NO: 1316945 - RNA, 20 nt, Homo sapiens
gaaaugguuuuuaaacaacc

SEQ ID NO: 1316946 - RNA, 14 nt, Homo sapiens
gaaauguaaaagca

SEQ ID NO: 1316947 - RNA, 14 nt, Homo sapiens
gaaauguaugugcu

SEQ ID NO: 1316948 - RNA, 17 nt, Homo sapiens
gaaauguaugugcucuu

SEQ ID NO: 1316949 - RNA, 20 nt, Homo sapiens
gaaauuauaaauaaauaucu

SEQ ID NO: 1316950 - RNA, 18 nt, Homo sapiens
uaaagcaauaugcauuua

SEQ ID NO: 1316951 - RNA, 12 nt, Homo sapiens
uaaagccuucaa

SEQ ID NO: 1316952 - RNA, 24 nt, Homo sapiens
uaaagguaaaacaugcuggugaac

SEQ ID NO: 1316953 - RNA, 15 nt, Homo sapiens
uaaagucacagaauu

SEQ ID NO: 1316954 - RNA, 16 nt, Homo sapiens
uaaagucacagaauua

SEQ ID NO: 1316955 - RNA, 21 nt, Homo sapiens
uaaauaaaacgugacagggaa

SEQ ID NO: 1316956 - RNA, 15 nt, Homo sapiens
uaaauaaauggaaua

SEQ ID NO: 1316957 - RNA, 17 nt, Homo sapiens
uaaauaaucuuacucua

SEQ ID NO: 1316958 - RNA, 14 nt, Homo sapiens
uaaauaccuucuug

SEQ ID NO: 1316959 - RNA, 16 nt, Homo sapiens
uaaauacuugcuccau

SEQ ID NO: 1316960 - RNA, 21 nt, Homo sapiens
uaaauagaguauaugcacuuu

SEQ ID NO: 1316961 - RNA, 23 nt, Homo sapiens
uaaaucauguugaucauguacuu

SEQ ID NO: 1316962 - RNA, 12 nt, Homo sapiens
uaaaugggaccc

SEQ ID NO: 1316963 - RNA, 16 nt, Homo sapiens
uaaauguacagacaua

SEQ ID NO: 1316964 - RNA, 19 nt, Homo sapiens
uaaauguaucuuauucaca

SEQ ID NO: 1316965 - RNA, 16 nt, Homo sapiens
uaacaauaaaagacaa

SEQ ID NO: 1316966 - RNA, 12 nt, Homo sapiens
uaacaauguuua

SEQ ID NO: 1316967 - RNA, 19 nt, Homo sapiens
uaacaauucccaguacuau

SEQ ID NO: 1316968 - RNA, 22 nt, Homo sapiens
uaacacacagagcucaccuguu

SEQ ID NO: 1316969 - RNA, 23 nt, Homo sapiens
uaacaccagacagacaacacugg

SEQ ID NO: 1316970 - RNA, 20 nt, Homo sapiens
uaacaccaucgaucaugaug

SEQ ID NO: 1316971 - RNA, 19 nt, Homo sapiens
uaacaccaugauuaaccac

SEQ ID NO: 1316972 - RNA, 19 nt, Homo sapiens
uaacacuggcuucaggcaa

SEQ ID NO: 1316973 - RNA, 18 nt, Homo sapiens
uaacagcuguggcucacg

SEQ ID NO: 1316974 - RNA, 13 nt, Homo sapiens
uaacagugcaaaa

SEQ ID NO: 1316975 - RNA, 22 nt, Homo sapiens
uaacauaauuuguacauaugua

SEQ ID NO: 1316976 - RNA, 15 nt, Homo sapiens
uaacauguauacaaa

SEQ ID NO: 1316977 - RNA, 19 nt, Homo sapiens
uaaccaauccuacuaauaa

SEQ ID NO: 1316978 - RNA, 22 nt, Homo sapiens
uaaccaucacugguugcacuua

SEQ ID NO: 1316979 - RNA, 21 nt, Homo sapiens
uaacccucacaagcaugaagu

SEQ ID NO: 1316980 - RNA, 12 nt, Homo sapiens
uaacccuuuuuc

SEQ ID NO: 1316981 - RNA, 22 nt, Homo sapiens
uaaccugccaacauacuuuaag

SEQ ID NO: 1316982 - RNA, 24 nt, Homo sapiens
uaaccuggguaaaugcagcgugaa

SEQ ID NO: 1316983 - RNA, 15 nt, Homo sapiens
uaacgauaaaagaca

SEQ ID NO: 1316984 - RNA, 23 nt, Homo sapiens
uaacgcaggccuuuuauuuucua

SEQ ID NO: 1316985 - RNA, 15 nt, Homo sapiens
uaacgucaucucagg

SEQ ID NO: 1316986 - RNA, 16 nt, Homo sapiens
uaacgucaucucaggg

SEQ ID NO: 1316987 - RNA, 23 nt, Homo sapiens
uaacucagaaacaucaguuacuc

SEQ ID NO: 1316988 - RNA, 19 nt, Homo sapiens
uaacucuuuuggacaaagg

SEQ ID NO: 1316989 - RNA, 21 nt, Homo sapiens
uaacugcauugagaacugcau

SEQ ID NO: 1316990 - RNA, 18 nt, Homo sapiens
uaacugugccaguucuuu

SEQ ID NO: 1316991 - RNA, 15 nt, Homo sapiens
uaacuucuccaagga

SEQ ID NO: 1316992 - RNA, 24 nt, Homo sapiens
uaacuucuccaaggagcaugucac

SEQ ID NO: 1316993 - RNA, 17 nt, Homo sapiens
uaacuugaaccuaugaa

SEQ ID NO: 1316994 - RNA, 15 nt, Homo sapiens
uaacuuggcugcauu

SEQ ID NO: 1316995 - RNA, 20 nt, Homo sapiens
uaacuuuucaaugacauuuu

SEQ ID NO: 1316996 - RNA, 17 nt, Homo sapiens
uaacuuuuuacauuaca

SEQ ID NO: 1316997 - RNA, 22 nt, Homo sapiens
uaagaaaaauuuguauacuaau

SEQ ID NO: 1316998 - RNA, 15 nt, Homo sapiens
uaagaagcucuggcc

SEQ ID NO: 1316999 - RNA, 15 nt, Homo sapiens
uaagacaacuacagc

SEQ ID NO: 1317000 - RNA, 18 nt, Homo sapiens
uaagacagagaaacagac

SEQ ID NO: 1317001 - RNA, 21 nt, Homo sapiens
uaagacaugauuuccuugaau

SEQ ID NO: 1317002 - RNA, 21 nt, Homo sapiens
uaagacauuaguaacauaaua

SEQ ID NO: 1317003 - RNA, 12 nt, Homo sapiens
uaagacugaugu

SEQ ID NO: 1317004 - RNA, 15 nt, Homo sapiens
uaagagaacaaugug

SEQ ID NO: 1317005 - RNA, 16 nt, Homo sapiens
uaagagggcacacacu

SEQ ID NO: 1317006 - RNA, 19 nt, Homo sapiens
uaagagggcacacacugug

SEQ ID NO: 1317007 - RNA, 18 nt, Homo sapiens
uaagauauuuaguaauau

SEQ ID NO: 1317008 - RNA, 10 nt, Homo sapiens
uaagauuuau

SEQ ID NO: 1317009 - RNA, 15 nt, Homo sapiens
uaagauuuugugaau

SEQ ID NO: 1317010 - RNA, 21 nt, Homo sapiens
uaagcaucugccaucugcuuu

SEQ ID NO: 1317011 - RNA, 19 nt, Homo sapiens
uaagcauuuuuaaucugug

SEQ ID NO: 1317012 - RNA, 22 nt, Homo sapiens
uaagcugcuggaaaccucaugc

SEQ ID NO: 1317013 - RNA, 16 nt, Homo sapiens
uaagguguagccacac

SEQ ID NO: 1317014 - RNA, 16 nt, Homo sapiens
uaaguaaaagucugua

SEQ ID NO: 1317015 - RNA, 21 nt, Homo sapiens
uaagucccgcauauacuuuaa

SEQ ID NO: 1317016 - RNA, 18 nt, Homo sapiens
uaaguugagaaggugccu

SEQ ID NO: 1317017 - RNA, 15 nt, Homo sapiens
uaauacaucaaagag

SEQ ID NO: 1317018 - RNA, 22 nt, Homo sapiens
uaauacuauauuuauacuguau

SEQ ID NO: 1317019 - RNA, 11 nt, Homo sapiens
uaauacuguau

SEQ ID NO: 1317020 - RNA, 23 nt, Homo sapiens
uaauagagauuaaaaacaacaaa

SEQ ID NO: 1317021 - RNA, 17 nt, Homo sapiens
uaauagucuuugccagu

SEQ ID NO: 1317022 - RNA, 22 nt, Homo sapiens
uaauauaaaaagcuuccaugau

SEQ ID NO: 1317023 - RNA, 15 nt, Homo sapiens
uaauauaaauucacu

SEQ ID NO: 1317024 - RNA, 19 nt, Homo sapiens
uaauaucaaaugcaguaua

SEQ ID NO: 1317025 - RNA, 17 nt, Homo sapiens
uaauauuuuacauacac

SEQ ID NO: 1317026 - RNA, 12 nt, Homo sapiens
uaaucaaaccac

SEQ ID NO: 1317027 - RNA, 21 nt, Homo sapiens
uaaucccaauaaaauucugag

SEQ ID NO: 1317028 - RNA, 20 nt, Homo sapiens
uaaucccagcuacucgagag

SEQ ID NO: 1317029 - RNA, 14 nt, Homo sapiens
uaaucuguguaaac

SEQ ID NO: 1317030 - RNA, 20 nt, Homo sapiens
uaaucuugcucugcuugaca

SEQ ID NO: 1317031 - RNA, 14 nt, Homo sapiens
uaaucuuugcuuua

SEQ ID NO: 1317032 - RNA, 19 nt, Homo sapiens
uaaugaaaaacuaugucag

SEQ ID NO: 1317033 - RNA, 22 nt, Homo sapiens
uaaugaaauaauguacaucugg

SEQ ID NO: 1317034 - RNA, 15 nt, Homo sapiens
uaaugcucugauaug

SEQ ID NO: 1317035 - RNA, 16 nt, Homo sapiens
uaauggaacuuagcca

SEQ ID NO: 1317036 - RNA, 14 nt, Homo sapiens
uaauggaaugaagg

SEQ ID NO: 1317037 - RNA, 13 nt, Homo sapiens
uaaugggacacua

SEQ ID NO: 1317038 - RNA, 15 nt, Homo sapiens
uaauguuauuuccac

SEQ ID NO: 1317039 - RNA, 16 nt, Homo sapiens
uaauguuauuuccacu

SEQ ID NO: 1317040 - RNA, 18 nt, Homo sapiens
uaauuaaaggagaagauu

SEQ ID NO: 1317041 - RNA, 14 nt, Homo sapiens
uaauuaauuuccaa

SEQ ID NO: 1317042 - RNA, 13 nt, Homo sapiens
uaauuacaccaua

SEQ ID NO: 1317043 - RNA, 19 nt, Homo sapiens
uaauuaccuguauugugga

SEQ ID NO: 1317044 - RNA, 13 nt, Homo sapiens
uaauuagcaguau

SEQ ID NO: 1317045 - RNA, 17 nt, Homo sapiens
uaauuagcuucaggaua

SEQ ID NO: 1317046 - RNA, 21 nt, Homo sapiens
uaauuaggaaaaaaacuauua

SEQ ID NO: 1317047 - RNA, 12 nt, Homo sapiens
uaauuagugaac

SEQ ID NO: 1317048 - RNA, 19 nt, Homo sapiens
uaauucauccuagcaaauu

SEQ ID NO: 1317049 - RNA, 22 nt, Homo sapiens
uaauuuagucuaacacaguuga

SEQ ID NO: 1317050 - RNA, 14 nt, Homo sapiens
uaauuuaugcagaa

SEQ ID NO: 1317051 - RNA, 21 nt, Homo sapiens
uaauuuccaaaggcguaugua

SEQ ID NO: 1317052 - RNA, 22 nt, Homo sapiens
uaauuucgcacaaugcaugccc

SEQ ID NO: 1317053 - RNA, 18 nt, Homo sapiens
uaauuugcuggaacacaa

SEQ ID NO: 1317054 - RNA, 21 nt, Homo sapiens
uaauuuugauauaaucuuuca

SEQ ID NO: 1317055 - RNA, 18 nt, Homo sapiens
uaauuuuuuuaaccaaag

SEQ ID NO: 1317056 - RNA, 21 nt, Homo sapiens
uacaaaauaaagcuguucuca

SEQ ID NO: 1317057 - RNA, 11 nt, Homo sapiens
uacaaauggac

SEQ ID NO: 1317058 - RNA, 14 nt, Homo sapiens
uacaaauggacaua

SEQ ID NO: 1317059 - RNA, 13 nt, Homo sapiens
uacaagauauuau

SEQ ID NO: 1317060 - RNA, 19 nt, Homo sapiens
uacaagcuaagaguuuaca

SEQ ID NO: 1317061 - RNA, 16 nt, Homo sapiens
uacaaggcccagaugu

SEQ ID NO: 1317062 - RNA, 17 nt, Homo sapiens
uacaauuuacaaagugu

SEQ ID NO: 1317063 - RNA, 13 nt, Homo sapiens
uacacaacuaguu

SEQ ID NO: 1317064 - RNA, 17 nt, Homo sapiens
uacacacacaccuagcc

SEQ ID NO: 1317065 - RNA, 18 nt, Homo sapiens
uacacacuuuuuaagaaa

SEQ ID NO: 1317066 - RNA, 15 nt, Homo sapiens
uacacauauccacaa

SEQ ID NO: 1317067 - RNA, 20 nt, Homo sapiens
uacaccagagccucagugag

SEQ ID NO: 1317068 - RNA, 16 nt, Homo sapiens
uacagacagagaauau

SEQ ID NO: 1317069 - RNA, 21 nt, Homo sapiens
uacagauacauaucuguguau

SEQ ID NO: 1317070 - RNA, 23 nt, Homo sapiens
uacagcccagaggccaacacugu

SEQ ID NO: 1317071 - RNA, 20 nt, Homo sapiens
uacagcuaacccucacaagc

SEQ ID NO: 1317072 - RNA, 20 nt, Homo sapiens
uacagcuggguggcacugcc

SEQ ID NO: 1317073 - RNA, 16 nt, Homo sapiens
uacaggugaagcacca

SEQ ID NO: 1317074 - RNA, 18 nt, Homo sapiens
uacaggugugcaccacca

SEQ ID NO: 1317075 - RNA, 22 nt, Homo sapiens
uacagguuacagugagcaaaga

SEQ ID NO: 1317076 - RNA, 22 nt, Homo sapiens
uacaguaggagcccagcucuga

SEQ ID NO: 1317077 - RNA, 18 nt, Homo sapiens
uacaguauauguugcaaa

SEQ ID NO: 1317078 - RNA, 11 nt, Homo sapiens
uacaguaugcu

SEQ ID NO: 1317079 - RNA, 22 nt, Homo sapiens
uacaguauuguggcugcacuug

SEQ ID NO: 1317080 - RNA, 16 nt, Homo sapiens
uacaguucugucauau

SEQ ID NO: 1317081 - RNA, 19 nt, Homo sapiens
uacaguuugucacaugaaa

SEQ ID NO: 1317082 - RNA, 18 nt, Homo sapiens
ucaguugugcagcuuuug

SEQ ID NO: 1317083 - RNA, 18 nt, Homo sapiens
ucauaaaaggacucucag

SEQ ID NO: 1317084 - RNA, 20 nt, Homo sapiens
ucauaaucuauaaacaauga

SEQ ID NO: 1317085 - RNA, 16 nt, Homo sapiens
ucauaccaucugcugc

SEQ ID NO: 1317086 - RNA, 18 nt, Homo sapiens
ucauagaaauucuuuaua

SEQ ID NO: 1317087 - RNA, 22 nt, Homo sapiens
ucauaguggcuuaaaacaacac

SEQ ID NO: 1317088 - RNA, 15 nt, Homo sapiens
ucauaguugggguca

SEQ ID NO: 1317089 - RNA, 12 nt, Homo sapiens
ucauauauugca

SEQ ID NO: 1317090 - RNA, 19 nt, Homo sapiens
ucaucaggagaaaaagccu

SEQ ID NO: 1317091 - RNA, 21 nt, Homo sapiens
ucaucaguggagccauguuaa

SEQ ID NO: 1317092 - RNA, 21 nt, Homo sapiens
ucaucauuuguggcagucccu

SEQ ID NO: 1317093 - RNA, 16 nt, Homo sapiens
ucauccacuagugcaa

SEQ ID NO: 1317094 - RNA, 16 nt, Homo sapiens
ucauccacugugccau

SEQ ID NO: 1317095 - RNA, 16 nt, Homo sapiens
ucauccaucacagauc

SEQ ID NO: 1317096 - RNA, 21 nt, Homo sapiens
ucaucccgagcaccuccacau

SEQ ID NO: 1317097 - RNA, 17 nt, Homo sapiens
ucauccgcacuguaaau

SEQ ID NO: 1317098 - RNA, 15 nt, Homo sapiens
ucaucuagcgcaauu

SEQ ID NO: 1317099 - RNA, 18 nt, Homo sapiens
ucaucuuccuguguccug

SEQ ID NO: 1317100 - RNA, 20 nt, Homo sapiens
ucaucuugaccaagcaggaa

SEQ ID NO: 1317101 - RNA, 18 nt, Homo sapiens
ucaucuuggucacauaca

SEQ ID NO: 1317102 - RNA, 14 nt, Homo sapiens
ucaugaucaucaca

SEQ ID NO: 1317103 - RNA, 18 nt, Homo sapiens
ucaugccacccugcauuu

SEQ ID NO: 1317104 - RNA, 17 nt, Homo sapiens
ucaugcccccucaguga

SEQ ID NO: 1317105 - RNA, 18 nt, Homo sapiens
ucaugcccccucagugag

SEQ ID NO: 1317106 - RNA, 17 nt, Homo sapiens
ucauggaaacuggccag

SEQ ID NO: 1317107 - RNA, 15 nt, Homo sapiens
ucauggaaagacugg

SEQ ID NO: 1317108 - RNA, 19 nt, Homo sapiens
ucaugggaaggggaggacc

SEQ ID NO: 1317109 - RNA, 21 nt, Homo sapiens
ucaugggaauauucaaauauc

SEQ ID NO: 1317110 - RNA, 22 nt, Homo sapiens
ucauggugaaaagcuccaucaa

SEQ ID NO: 1317111 - RNA, 19 nt, Homo sapiens
ucauggugauagacugaag

SEQ ID NO: 1317112 - RNA, 16 nt, Homo sapiens
ucaugucucacuucac

SEQ ID NO: 1317113 - RNA, 23 nt, Homo sapiens
ucauguguguccacgacugucuc

SEQ ID NO: 1317114 - RNA, 18 nt, Homo sapiens
ucauguugaucauguacu

SEQ ID NO: 1317115 - RNA, 21 nt, Homo sapiens
ucauuaaggucauuacucuca

SEQ ID NO: 1317116 - RNA, 23 nt, Homo sapiens
ucauuaaugacacuuguccccaa

SEQ ID NO: 1317117 - RNA, 12 nt, Homo sapiens
ucauuacugcuu

SEQ ID NO: 1317118 - RNA, 18 nt, Homo sapiens
ucauuagaaguuaccaaa

SEQ ID NO: 1317119 - RNA, 15 nt, Homo sapiens
ucauucacucaacaa

SEQ ID NO: 1317120 - RNA, 17 nt, Homo sapiens
ucauuccccagcuccau

SEQ ID NO: 1317121 - RNA, 16 nt, Homo sapiens
ucauugacaaagcugu

SEQ ID NO: 1317122 - RNA, 22 nt, Homo sapiens
ucauugaggauaaauugccaua

SEQ ID NO: 1317123 - RNA, 20 nt, Homo sapiens
ucauuguauuuuuaacacca

SEQ ID NO: 1317124 - RNA, 23 nt, Homo sapiens
ucauuguauuuuuaacaccagaa

SEQ ID NO: 1317125 - RNA, 21 nt, Homo sapiens
ucauuuugugaauacuaugua

SEQ ID NO: 1317126 - RNA, 19 nt, Homo sapiens
uccaaaaagcacauauuag

SEQ ID NO: 1317127 - RNA, 19 nt, Homo sapiens
uccaaaggcguauguauua

SEQ ID NO: 1317128 - RNA, 13 nt, Homo sapiens
uccaaauucacaa

SEQ ID NO: 1317129 - RNA, 23 nt, Homo sapiens
uccaaccccccagcacugaggaa

SEQ ID NO: 1317130 - RNA, 17 nt, Homo sapiens
uccaacuggagcucucc

SEQ ID NO: 1317131 - RNA, 20 nt, Homo sapiens
uccaauauucgcugugucag

SEQ ID NO: 1317132 - RNA, 12 nt, Homo sapiens
uccaaucagaac

SEQ ID NO: 1317133 - RNA, 13 nt, Homo sapiens
uccaaugcucaag

SEQ ID NO: 1317134 - RNA, 14 nt, Homo sapiens
uccaaugcucaaga

SEQ ID NO: 1317135 - RNA, 11 nt, Homo sapiens
uccaaugucaa

SEQ ID NO: 1317136 - RNA, 16 nt, Homo sapiens
uccaaugucaauguga

SEQ ID NO: 1317137 - RNA, 19 nt, Homo sapiens
uccaauuauuugacuuuaa

SEQ ID NO: 1317138 - RNA, 19 nt, Homo sapiens
uccaauuccuugcacauag

SEQ ID NO: 1317139 - RNA, 13 nt, Homo sapiens
uccaauuucaaga

SEQ ID NO: 1317140 - RNA, 13 nt, Homo sapiens
uccacacagccaa

SEQ ID NO: 1317141 - RNA, 17 nt, Homo sapiens
uccacaccuuuuauuga

SEQ ID NO: 1317142 - RNA, 10 nt, Homo sapiens
uccacagcaa

SEQ ID NO: 1317143 - RNA, 16 nt, Homo sapiens
uccacaucaccagaaa

SEQ ID NO: 1317144 - RNA, 19 nt, Homo sapiens
uccacgugugugugugauu

SEQ ID NO: 1317145 - RNA, 14 nt, Homo sapiens
uccacuagugcaaa

SEQ ID NO: 1317146 - RNA, 15 nt, Homo sapiens
uccacucccaggcag

SEQ ID NO: 1317147 - RNA, 15 nt, Homo sapiens
uccacugcucucagc

SEQ ID NO: 1317148 - RNA, 15 nt, Homo sapiens
uccacugugccaugu

SEQ ID NO: 1317149 - RNA, 17 nt, Homo sapiens
uccacuuguuugcacug

SEQ ID NO: 1317150 - RNA, 14 nt, Homo sapiens
uccagaacacggcu

SEQ ID NO: 1317151 - RNA, 22 nt, Homo sapiens
uccagaagauagcuucacccca

SEQ ID NO: 1317152 - RNA, 13 nt, Homo sapiens
uccagaagcacug

SEQ ID NO: 1317153 - RNA, 21 nt, Homo sapiens
uccagaaguccuuauguuaag

SEQ ID NO: 1317154 - RNA, 23 nt, Homo sapiens
uccagaaucccguaacaccugau

SEQ ID NO: 1317155 - RNA, 14 nt, Homo sapiens
uccagaaugaucau

SEQ ID NO: 1317156 - RNA, 16 nt, Homo sapiens
uccagagauuugcuuu

SEQ ID NO: 1317157 - RNA, 17 nt, Homo sapiens
uccagaucuugccucca

SEQ ID NO: 1317158 - RNA, 17 nt, Homo sapiens
uccagaugcagggcagu

SEQ ID NO: 1317159 - RNA, 19 nt, Homo sapiens
uccagcaaacaaaauggac

SEQ ID NO: 1317160 - RNA, 15 nt, Homo sapiens
uccagcucaccagcc

SEQ ID NO: 1317161 - RNA, 20 nt, Homo sapiens
uccagcuugggcaacagggc

SEQ ID NO: 1317162 - RNA, 21 nt, Homo sapiens
uccaggcauuuagcccucaca

SEQ ID NO: 1317163 - RNA, 22 nt, Homo sapiens
uccagggagccggggcugugag

SEQ ID NO: 1317164 - RNA, 17 nt, Homo sapiens
uccagguguuacuguaa

SEQ ID NO: 1317165 - RNA, 21 nt, Homo sapiens
uccaguaagcagguacuacau

SEQ ID NO: 1317166 - RNA, 15 nt, Homo sapiens
uccaguccaaggaaa

SEQ ID NO: 1317167 - RNA, 18 nt, Homo sapiens
uccagucuccaccaggaa

SEQ ID NO: 1317168 - RNA, 21 nt, Homo sapiens
uccaguuugaguuaaugugcu

SEQ ID NO: 1317169 - RNA, 22 nt, Homo sapiens
uccauaaagacaaucacugcca

SEQ ID NO: 1317170 - RNA, 23 nt, Homo sapiens
uccauaaagacaaucacugccaa

SEQ ID NO: 1317171 - RNA, 21 nt, Homo sapiens
uccauauauuggcacugcuaa

SEQ ID NO: 1317172 - RNA, 22 nt, Homo sapiens
uccauauuguuccuuaucaccu

SEQ ID NO: 1317173 - RNA, 19 nt, Homo sapiens
uccaucccccguggccauu

SEQ ID NO: 1317174 - RNA, 23 nt, Homo sapiens
uccaucgcaguguucaaggccau

SEQ ID NO: 1317175 - RNA, 16 nt, Homo sapiens
uccaucucugacuuaa

SEQ ID NO: 1317176 - RNA, 17 nt, Homo sapiens
uccaucuuuccugaugg

SEQ ID NO: 1317177 - RNA, 20 nt, Homo sapiens
uccaugauuuuaaauuguga

SEQ ID NO: 1317178 - RNA, 14 nt, Homo sapiens
uccaugccugggaa

SEQ ID NO: 1317179 - RNA, 20 nt, Homo sapiens
uccauggcaggaaggcuugu

SEQ ID NO: 1317180 - RNA, 16 nt, Homo sapiens
uccauguccccuccca

SEQ ID NO: 1317181 - RNA, 20 nt, Homo sapiens
uccauuccagucaaaucugg

SEQ ID NO: 1317182 - RNA, 16 nt, Homo sapiens
uccauugcucuugagu

SEQ ID NO: 1317183 - RNA, 17 nt, Homo sapiens
uccauuuuuagugaaau

SEQ ID NO: 1317184 - RNA, 18 nt, Homo sapiens
ucccaaaccuucaggaaa

SEQ ID NO: 1317185 - RNA, 13 nt, Homo sapiens
ucccaagcucaga

SEQ ID NO: 1317186 - RNA, 19 nt, Homo sapiens
ucccaaguucuuucuccau

SEQ ID NO: 1317187 - RNA, 13 nt, Homo sapiens
ucccacaccaggu

SEQ ID NO: 1317188 - RNA, 20 nt, Homo sapiens
ucccaccucagcuucucaaa

SEQ ID NO: 1317189 - RNA, 13 nt, Homo sapiens
ucccacucaagcc

SEQ ID NO: 1317190 - RNA, 21 nt, Homo sapiens
ucccagauuggcucacacuga

SEQ ID NO: 1317191 - RNA, 21 nt, Homo sapiens
ucccagcacgaguggccaguu

SEQ ID NO: 1317192 - RNA, 14 nt, Homo sapiens
ucccagcaguggac

SEQ ID NO: 1317193 - RNA, 18 nt, Homo sapiens
ucccagcuacaccuuucu

SEQ ID NO: 1317194 - RNA, 18 nt, Homo sapiens
ucccaggacccugaaggg

SEQ ID NO: 1317195 - RNA, 20 nt, Homo sapiens
ucccaggacucugaccccag

SEQ ID NO: 1317196 - RNA, 18 nt, Homo sapiens
ucccagguuaucugggca

SEQ ID NO: 1317197 - RNA, 11 nt, Homo sapiens
ucccagugugc

SEQ ID NO: 1317198 - RNA, 18 nt, Homo sapiens
ucccauaaacacugaauu

SEQ ID NO: 1317199 - RNA, 12 nt, Homo sapiens
ucccauggaaua

SEQ ID NO: 1317200 - RNA, 21 nt, Homo sapiens
ucccauggaucaucaagguga

SEQ ID NO: 1317201 - RNA, 15 nt, Homo sapiens
ucccaugugauuuaa

SEQ ID NO: 1317202 - RNA, 16 nt, Homo sapiens
ucccauuccugaagaa

SEQ ID NO: 1317203 - RNA, 18 nt, Homo sapiens
uccccacagaacugcuua

SEQ ID NO: 1317204 - RNA, 16 nt, Homo sapiens
uccccaccaaccaaga

SEQ ID NO: 1317205 - RNA, 16 nt, Homo sapiens
uccccagcccagagac

SEQ ID NO: 1317206 - RNA, 16 nt, Homo sapiens
uccccaggcaccucac

SEQ ID NO: 1317207 - RNA, 23 nt, Homo sapiens
uccccaggucucuccacugcucu

SEQ ID NO: 1317208 - RNA, 18 nt, Homo sapiens
uccccaguucgccuggag

SEQ ID NO: 1317209 - RNA, 12 nt, Homo sapiens
uccccaucucag

SEQ ID NO: 1317210 - RNA, 19 nt, Homo sapiens
uccccauuagcuuucaauu

SEQ ID NO: 1317211 - RNA, 20 nt, Homo sapiens
ucccccaggccugagcugcu

SEQ ID NO: 1317212 - RNA, 16 nt, Homo sapiens
uccccucagagugcaa

SEQ ID NO: 1317213 - RNA, 20 nt, Homo sapiens
uccccuccacucucuaccag

SEQ ID NO: 1317214 - RNA, 15 nt, Homo sapiens
ugacugagaauauaa

SEQ ID NO: 1317215 - RNA, 23 nt, Homo sapiens
ugacugagaauauaauacuguau

SEQ ID NO: 1317216 - RNA, 19 nt, Homo sapiens
ugacuuaacagaacucaac

SEQ ID NO: 1317217 - RNA, 15 nt, Homo sapiens
ugacuuauguaauca

SEQ ID NO: 1317218 - RNA, 14 nt, Homo sapiens
ugacuucacaguga

SEQ ID NO: 1317219 - RNA, 17 nt, Homo sapiens
ugacuuccucccacugu

SEQ ID NO: 1317220 - RNA, 17 nt, Homo sapiens
ugacuuuagaaagcuga

SEQ ID NO: 1317221 - RNA, 18 nt, Homo sapiens
ugacuuucuagcuucccu

SEQ ID NO: 1317222 - RNA, 23 nt, Homo sapiens
ugacuuuuucucggagcauauau

SEQ ID NO: 1317223 - RNA, 17 nt, Homo sapiens
ugagaaacccaccagcc

SEQ ID NO: 1317224 - RNA, 17 nt, Homo sapiens
ugagaaagagcacuuaa

SEQ ID NO: 1317225 - RNA, 12 nt, Homo sapiens
ugagaacaacca

SEQ ID NO: 1317226 - RNA, 13 nt, Homo sapiens
ugagaacacugug

SEQ ID NO: 1317227 - RNA, 15 nt, Homo sapiens
ugagaagaaaaucag

SEQ ID NO: 1317228 - RNA, 23 nt, Homo sapiens
ugagaagaaaaucagagagggaa

SEQ ID NO: 1317229 - RNA, 18 nt, Homo sapiens
ugagaaggugccugccau

SEQ ID NO: 1317230 - RNA, 12 nt, Homo sapiens
ugagaagugaua

SEQ ID NO: 1317231 - RNA, 11 nt, Homo sapiens
ugagacaaaga

SEQ ID NO: 1317232 - RNA, 16 nt, Homo sapiens
ugagacauugugaaaa

SEQ ID NO: 1317233 - RNA, 15 nt, Homo sapiens
ugagaccaaccuggg

SEQ ID NO: 1317234 - RNA, 18 nt, Homo sapiens
ugagaccagccuggccaa

SEQ ID NO: 1317235 - RNA, 18 nt, Homo sapiens
ugagaccuggcagccaca

SEQ ID NO: 1317236 - RNA, 16 nt, Homo sapiens
ugagagcgacacagac

SEQ ID NO: 1317237 - RNA, 19 nt, Homo sapiens
ugagagcugcuuugaggca

SEQ ID NO: 1317238 - RNA, 20 nt, Homo sapiens
ugagaggaagggugggucug

SEQ ID NO: 1317239 - RNA, 19 nt, Homo sapiens
ugagaggaucaucuggggc

SEQ ID NO: 1317240 - RNA, 18 nt, Homo sapiens
ugagaggggaacagacug

SEQ ID NO: 1317241 - RNA, 19 nt, Homo sapiens
ugagaguuuuggaugcagu

SEQ ID NO: 1317242 - RNA, 14 nt, Homo sapiens
ugagauacauacag

SEQ ID NO: 1317243 - RNA, 13 nt, Homo sapiens
ugagaucauucac

SEQ ID NO: 1317244 - RNA, 17 nt, Homo sapiens
ugagaugauacauccaa

SEQ ID NO: 1317245 - RNA, 21 nt, Homo sapiens
ugagauucagaugucauuuag

SEQ ID NO: 1317246 - RNA, 14 nt, Homo sapiens
ugagcaaaggugau

SEQ ID NO: 1317247 - RNA, 19 nt, Homo sapiens
ugagcaacucuugauuauc

SEQ ID NO: 1317248 - RNA, 15 nt, Homo sapiens
ugagcaagacauacu

SEQ ID NO: 1317249 - RNA, 21 nt, Homo sapiens
ugagcacagauguucccccau

SEQ ID NO: 1317250 - RNA, 15 nt, Homo sapiens
ugagcagacaggaca

SEQ ID NO: 1317251 - RNA, 21 nt, Homo sapiens
ugagcagugcuugaaugaagu

SEQ ID NO: 1317252 - RNA, 18 nt, Homo sapiens
ugagcauggucacaagca

SEQ ID NO: 1317253 - RNA, 14 nt, Homo sapiens
ugagccaugagaug

SEQ ID NO: 1317254 - RNA, 13 nt, Homo sapiens
ugagcucugggaa

SEQ ID NO: 1317255 - RNA, 20 nt, Homo sapiens
ugagcugguuugucaaacaa

SEQ ID NO: 1317256 - RNA, 13 nt, Homo sapiens
ugagcuucuuuag

SEQ ID NO: 1317257 - RNA, 13 nt, Homo sapiens
ugaggaauggagg

SEQ ID NO: 1317258 - RNA, 17 nt, Homo sapiens
ugaggauaacuuuuuaa

SEQ ID NO: 1317259 - RNA, 17 nt, Homo sapiens
ugaggcaagagaauuac

SEQ ID NO: 1317260 - RNA, 16 nt, Homo sapiens
ugaggcauuuccagac

SEQ ID NO: 1317261 - RNA, 19 nt, Homo sapiens
ugaggcccaauaauauuug

SEQ ID NO: 1317262 - RNA, 17 nt, Homo sapiens
ugaggcccucauuccca

SEQ ID NO: 1317263 - RNA, 22 nt, Homo sapiens
ugaggcugcgagagaaagggag

SEQ ID NO: 1317264 - RNA, 19 nt, Homo sapiens
ugagggagccuggccccau

SEQ ID NO: 1317265 - RNA, 17 nt, Homo sapiens
ugaggggcuggcacuga

SEQ ID NO: 1317266 - RNA, 15 nt, Homo sapiens
ugaggucacagucca

SEQ ID NO: 1317267 - RNA, 20 nt, Homo sapiens
ugaggucaggaguucgagac

SEQ ID NO: 1317268 - RNA, 15 nt, Homo sapiens
ugaggugaccacuua

SEQ ID NO: 1317269 - RNA, 17 nt, Homo sapiens
ugaguaauacaucaaag

SEQ ID NO: 1317270 - RNA, 13 nt, Homo sapiens
ugaguaucuccuc

SEQ ID NO: 1317271 - RNA, 18 nt, Homo sapiens
ugagucugcagaugagga

SEQ ID NO: 1317272 - RNA, 15 nt, Homo sapiens
ugagugcgugcucag

SEQ ID NO: 1317273 - RNA, 17 nt, Homo sapiens
ugaguggaugauguuuc

SEQ ID NO: 1317274 - RNA, 21 nt, Homo sapiens
ugaguuaacucacugagggua

SEQ ID NO: 1317275 - RNA, 22 nt, Homo sapiens
ugauaagcuauugucuguaaua

SEQ ID NO: 1317276 - RNA, 21 nt, Homo sapiens
ugauacaaauugcagacugug

SEQ ID NO: 1317277 - RNA, 19 nt, Homo sapiens
ugauaccuucuggcugugc

SEQ ID NO: 1317278 - RNA, 20 nt, Homo sapiens
ugauacuuacugaacugugu

SEQ ID NO: 1317279 - RNA, 13 nt, Homo sapiens
ugauagcacuuuc

SEQ ID NO: 1317280 - RNA, 21 nt, Homo sapiens
ugauauauaaaugugauugca

SEQ ID NO: 1317281 - RNA, 22 nt, Homo sapiens
ugauaugcauuugacuuguuaa

SEQ ID NO: 1317282 - RNA, 23 nt, Homo sapiens
ugauauuucccuccccuggggac

SEQ ID NO: 1317283 - RNA, 21 nt, Homo sapiens
ugaucaaguccuuugugaaua

SEQ ID NO: 1317284 - RNA, 19 nt, Homo sapiens
ugaucacggcucacugcag

SEQ ID NO: 1317285 - RNA, 15 nt, Homo sapiens
ugaucaggaccucca

SEQ ID NO: 1317286 - RNA, 13 nt, Homo sapiens
ugaucgaugauuc

SEQ ID NO: 1317287 - RNA, 21 nt, Homo sapiens
ugaugaugguauaaaguuugc

SEQ ID NO: 1317288 - RNA, 17 nt, Homo sapiens
ugaugauuaauucaccu

SEQ ID NO: 1317289 - RNA, 13 nt, Homo sapiens
ugaugcucaaaau

SEQ ID NO: 1317290 - RNA, 21 nt, Homo sapiens
ugaugcucaaaaucuuuccaa

SEQ ID NO: 1317291 - RNA, 19 nt, Homo sapiens
ugaugcuuagauguuccag

SEQ ID NO: 1317292 - RNA, 11 nt, Homo sapiens
ugaugcuugua

SEQ ID NO: 1317293 - RNA, 17 nt, Homo sapiens
ugauggcaacagaucug

SEQ ID NO: 1317294 - RNA, 16 nt, Homo sapiens
ugauggcucauuuaca

SEQ ID NO: 1317295 - RNA, 21 nt, Homo sapiens
ugauggcucauuuacacucag

SEQ ID NO: 1317296 - RNA, 16 nt, Homo sapiens
ugauuaaagugcucac

SEQ ID NO: 1317297 - RNA, 14 nt, Homo sapiens
ugauucaugucuca

SEQ ID NO: 1317298 - RNA, 16 nt, Homo sapiens
ugauucccuccugcua

SEQ ID NO: 1317299 - RNA, 18 nt, Homo sapiens
ugauuguugucaggccau

SEQ ID NO: 1317300 - RNA, 14 nt, Homo sapiens
ugauuuaaaucagc

SEQ ID NO: 1317301 - RNA, 21 nt, Homo sapiens
ugauuuuaaccaauguagcac

SEQ ID NO: 1317302 - RNA, 16 nt, Homo sapiens
ugauuuuaacucuguc

SEQ ID NO: 1317303 - RNA, 17 nt, Homo sapiens
ugauuuuagauuuucca

SEQ ID NO: 1317304 - RNA, 22 nt, Homo sapiens
ugauuuuauuguacaaguugaa

SEQ ID NO: 1317305 - RNA, 22 nt, Homo sapiens
ugauuuuuugcauuccugacaa

SEQ ID NO: 1317306 - RNA, 14 nt, Homo sapiens
ugauuuuuuuccac

SEQ ID NO: 1317307 - RNA, 13 nt, Homo sapiens
ugcaaaccaacag

SEQ ID NO: 1317308 - RNA, 13 nt, Homo sapiens
ugcaaacgcugcc

SEQ ID NO: 1317309 - RNA, 14 nt, Homo sapiens
ugcaaauaccuccu

SEQ ID NO: 1317310 - RNA, 17 nt, Homo sapiens
ugcaaauagcaaaacua

SEQ ID NO: 1317311 - RNA, 17 nt, Homo sapiens
ugcaacuucuaaacaca

SEQ ID NO: 1317312 - RNA, 16 nt, Homo sapiens
ugcaagggacugugug

SEQ ID NO: 1317313 - RNA, 22 nt, Homo sapiens
ugcaauaaaucugacccagugc

SEQ ID NO: 1317314 - RNA, 20 nt, Homo sapiens
ugcaauacacaguguuauuc

SEQ ID NO: 1317315 - RNA, 15 nt, Homo sapiens
ugcaauguaagcaua

SEQ ID NO: 1317316 - RNA, 16 nt, Homo sapiens
ugcaauguaagcauac

SEQ ID NO: 1317317 - RNA, 19 nt, Homo sapiens
ugcaauugacauaggcaau

SEQ ID NO: 1317318 - RNA, 11 nt, Homo sapiens
ugcacaaacaa

SEQ ID NO: 1317319 - RNA, 14 nt, Homo sapiens
ugcacaagugugca

SEQ ID NO: 1317320 - RNA, 16 nt, Homo sapiens
ugcacagggcaauuga

SEQ ID NO: 1317321 - RNA, 23 nt, Homo sapiens
ugcaccaaugcacugagugaagg

SEQ ID NO: 1317322 - RNA, 15 nt, Homo sapiens
ugcacccacccagga

SEQ ID NO: 1317323 - RNA, 12 nt, Homo sapiens
ugcaccuaccca

SEQ ID NO: 1317324 - RNA, 13 nt, Homo sapiens
ugcaccuacccau

SEQ ID NO: 1317325 - RNA, 12 nt, Homo sapiens
ugcaccuaccuu

SEQ ID NO: 1317326 - RNA, 23 nt, Homo sapiens
ugcaccuugccagggagguggaa

SEQ ID NO: 1317327 - RNA, 23 nt, Homo sapiens
ugcacuccagccugggugacaaa

SEQ ID NO: 1317328 - RNA, 21 nt, Homo sapiens
ugcacuguucccccugugcag

SEQ ID NO: 1317329 - RNA, 16 nt, Homo sapiens
ugcacuuaugauuuca

SEQ ID NO: 1317330 - RNA, 18 nt, Homo sapiens
ugcagaagcaaucgggau

SEQ ID NO: 1317331 - RNA, 20 nt, Homo sapiens
ugcagaagcagaagugcaau

SEQ ID NO: 1317332 - RNA, 18 nt, Homo sapiens
ugcagcagggaugcccug

SEQ ID NO: 1317333 - RNA, 19 nt, Homo sapiens
ugcagcauuuuguauuugu

SEQ ID NO: 1317334 - RNA, 13 nt, Homo sapiens
ugcagccagcuca

SEQ ID NO: 1317335 - RNA, 17 nt, Homo sapiens
ugcagccuuugccuccc

SEQ ID NO: 1317336 - RNA, 23 nt, Homo sapiens
ugcagguuggaacuaugcagugu

SEQ ID NO: 1317337 - RNA, 16 nt, Homo sapiens
ugcaguagacugcagu

SEQ ID NO: 1317338 - RNA, 20 nt, Homo sapiens
ugcagucaacaguucaaaga

SEQ ID NO: 1317339 - RNA, 23 nt, Homo sapiens
ugcagugugaaacuuaccauuca

SEQ ID NO: 1317340 - RNA, 21 nt, Homo sapiens
ugcaguguucuacaccuugcu

SEQ ID NO: 1317341 - RNA, 18 nt, Homo sapiens
ugcaguuccaaaagagaa

SEQ ID NO: 1317342 - RNA, 15 nt, Homo sapiens
ugcaguucugagcac

SEQ ID NO: 1317343 - RNA, 22 nt, Homo sapiens
ugcauaagugaaaaucuuacaa

SEQ ID NO: 1317344 - RNA, 17 nt, Homo sapiens
ugcauaugcauucacuc

SEQ ID NO: 1317345 - RNA, 19 nt, Homo sapiens
ugcaugcgccuacucgcuu

SEQ ID NO: 1317346 - RNA, 15 nt, Homo sapiens
uguuauuuaacagcu

SEQ ID NO: 1317347 - RNA, 17 nt, Homo sapiens
uguucagcuccagcuca

SEQ ID NO: 1317348 - RNA, 11 nt, Homo sapiens
uguucaggaua

SEQ ID NO: 1317349 - RNA, 23 nt, Homo sapiens
uguuccacuuguuugcacugugu

SEQ ID NO: 1317350 - RNA, 14 nt, Homo sapiens
uguuccccacugac

SEQ ID NO: 1317351 - RNA, 22 nt, Homo sapiens
uguuccccacuguaucuaggca

SEQ ID NO: 1317352 - RNA, 15 nt, Homo sapiens
uguuccccaucaucu

SEQ ID NO: 1317353 - RNA, 14 nt, Homo sapiens
uguucccugacucc

SEQ ID NO: 1317354 - RNA, 14 nt, Homo sapiens
uguucccuuacugu

SEQ ID NO: 1317355 - RNA, 16 nt, Homo sapiens
uguucuauucaucuca

SEQ ID NO: 1317356 - RNA, 19 nt, Homo sapiens
uguucucaacuucaaaagu

SEQ ID NO: 1317357 - RNA, 13 nt, Homo sapiens
uguucucccuccu

SEQ ID NO: 1317358 - RNA, 23 nt, Homo sapiens
uguucucuuaugaucaccaugua

SEQ ID NO: 1317359 - RNA, 16 nt, Homo sapiens
uguucugggacacagu

SEQ ID NO: 1317360 - RNA, 19 nt, Homo sapiens
uguucuuucuuacacaaga

SEQ ID NO: 1317361 - RNA, 13 nt, Homo sapiens
uguugcaagcccc

SEQ ID NO: 1317362 - RNA, 17 nt, Homo sapiens
uguugcacugaaaugga

SEQ ID NO: 1317363 - RNA, 13 nt, Homo sapiens
uguuggacagggg

SEQ ID NO: 1317364 - RNA, 19 nt, Homo sapiens
uguuggagguuaaggcaua

SEQ ID NO: 1317365 - RNA, 15 nt, Homo sapiens
uguuggccaguguga

SEQ ID NO: 1317366 - RNA, 15 nt, Homo sapiens
uguuguacauuucac

SEQ ID NO: 1317367 - RNA, 15 nt, Homo sapiens
uguugugcucaggac

SEQ ID NO: 1317368 - RNA, 16 nt, Homo sapiens
uguuuacagugucugu

SEQ ID NO: 1317369 - RNA, 18 nt, Homo sapiens
uguuucacaauaccucau

SEQ ID NO: 1317370 - RNA, 13 nt, Homo sapiens
uguuuccuugccu

SEQ ID NO: 1317371 - RNA, 22 nt, Homo sapiens
uguuucucugccgcuaccuccc

SEQ ID NO: 1317372 - RNA, 13 nt, Homo sapiens
uguuugcacugug

SEQ ID NO: 1317373 - RNA, 24 nt, Homo sapiens
uguuugcacugugugcugacugaa

SEQ ID NO: 1317374 - RNA, 20 nt, Homo sapiens
uguuuggauccugacucaaa

SEQ ID NO: 1317375 - RNA, 23 nt, Homo sapiens
uguuuuaaagaauaugacuuuuu

SEQ ID NO: 1317376 - RNA, 15 nt, Homo sapiens
uguuuucaccauuca

SEQ ID NO: 1317377 - RNA, 13 nt, Homo sapiens
uguuuucagugaa

SEQ ID NO: 1317378 - RNA, 12 nt, Homo sapiens
uguuuucugaca

SEQ ID NO: 1317379 - RNA, 15 nt, Homo sapiens
uguuuucuuugcaaa

SEQ ID NO: 1317380 - RNA, 22 nt, Homo sapiens
uguuuuuaaagaaaagcauuca

SEQ ID NO: 1317381 - RNA, 13 nt, Homo sapiens
uguuuuuaagcug

SEQ ID NO: 1317382 - RNA, 15 nt, Homo sapiens
uguuuuuugccuaaa

SEQ ID NO: 1317383 - RNA, 18 nt, Homo sapiens
uuaaaaaaaaaauucaau

SEQ ID NO: 1317384 - RNA, 16 nt, Homo sapiens
uuaaaaaacacuucau

SEQ ID NO: 1317385 - RNA, 19 nt, Homo sapiens
uuaaaaaauacacauagca

SEQ ID NO: 1317386 - RNA, 13 nt, Homo sapiens
uuaaaaacuuaag

SEQ ID NO: 1317387 - RNA, 16 nt, Homo sapiens
uuaaaaauagacacuc

SEQ ID NO: 1317388 - RNA, 13 nt, Homo sapiens
uuaaaaauuguca

SEQ ID NO: 1317389 - RNA, 18 nt, Homo sapiens
uuaaaagaugucucugca

SEQ ID NO: 1317390 - RNA, 21 nt, Homo sapiens
uuaaaaggaaauguaaaagca

SEQ ID NO: 1317391 - RNA, 15 nt, Homo sapiens
uuaaacacaugcaua

SEQ ID NO: 1317392 - RNA, 10 nt, Homo sapiens
uuaaacuggu

SEQ ID NO: 1317393 - RNA, 22 nt, Homo sapiens
uuaaagcaaauaaaugaacuga

SEQ ID NO: 1317394 - RNA, 21 nt, Homo sapiens
uuaaaucaacgaguacuucaa

SEQ ID NO: 1317395 - RNA, 24 nt, Homo sapiens
uuaaaucagccguguaaccaugga

SEQ ID NO: 1317396 - RNA, 17 nt, Homo sapiens
uuaaauuacaauuuuau

SEQ ID NO: 1317397 - RNA, 20 nt, Homo sapiens
uuaacaaaaauauuagcaaa

SEQ ID NO: 1317398 - RNA, 17 nt, Homo sapiens
uuaacaaauacauucaa

SEQ ID NO: 1317399 - RNA, 12 nt, Homo sapiens
uuaacaccagaa

SEQ ID NO: 1317400 - RNA, 16 nt, Homo sapiens
uuaacauguauacaaa

SEQ ID NO: 1317401 - RNA, 17 nt, Homo sapiens
uuaaccauggcacugag

SEQ ID NO: 1317402 - RNA, 18 nt, Homo sapiens
uuaacucuaucugucaua

SEQ ID NO: 1317403 - RNA, 18 nt, Homo sapiens
uuaacucuuuuggacaaa

SEQ ID NO: 1317404 - RNA, 17 nt, Homo sapiens
uuaacuuaacucaugaa

SEQ ID NO: 1317405 - RNA, 24 nt, Homo sapiens
uuaagaaaaaaagacaaggcugau

SEQ ID NO: 1317406 - RNA, 18 nt, Homo sapiens
uuaagaaauuuugccuuu

SEQ ID NO: 1317407 - RNA, 15 nt, Homo sapiens
uuaagagcaauucaa

SEQ ID NO: 1317408 - RNA, 20 nt, Homo sapiens
uuaagaggcagggucucacu

SEQ ID NO: 1317409 - RNA, 16 nt, Homo sapiens
uuaauaccagcuuaaa

SEQ ID NO: 1317410 - RNA, 13 nt, Homo sapiens
uuaauacuugauu

SEQ ID NO: 1317411 - RNA, 18 nt, Homo sapiens
uuaauauuuaaccucuuu

SEQ ID NO: 1317412 - RNA, 23 nt, Homo sapiens
uuaaucaaaccacuguuauuaac

SEQ ID NO: 1317413 - RNA, 16 nt, Homo sapiens
uuaaucaccacucaaa

SEQ ID NO: 1317414 - RNA, 19 nt, Homo sapiens
uuaaucacuauuguuccag

SEQ ID NO: 1317415 - RNA, 20 nt, Homo sapiens
uuaaucaguuguuuaauaau

SEQ ID NO: 1317416 - RNA, 12 nt, Homo sapiens
uuaaucugugua

SEQ ID NO: 1317417 - RNA, 13 nt, Homo sapiens
uuaaugauaauau

SEQ ID NO: 1317418 - RNA, 17 nt, Homo sapiens
uuaauguuauaucauau

SEQ ID NO: 1317419 - RNA, 17 nt, Homo sapiens
uuacaaaccucaagcca

SEQ ID NO: 1317420 - RNA, 15 nt, Homo sapiens
uuacaaaguguguau

SEQ ID NO: 1317421 - RNA, 19 nt, Homo sapiens
uuacaaucagccacauucu

SEQ ID NO: 1317422 - RNA, 20 nt, Homo sapiens
uuacaaucagccacauucua

SEQ ID NO: 1317423 - RNA, 18 nt, Homo sapiens
uuacagaauggaucaugu

SEQ ID NO: 1317424 - RNA, 20 nt, Homo sapiens
uuacagcuggguggcacugc

SEQ ID NO: 1317425 - RNA, 17 nt, Homo sapiens
uuacaggauauuccaaa

SEQ ID NO: 1317426 - RNA, 10 nt, Homo sapiens
uuacauacac

SEQ ID NO: 1317427 - RNA, 11 nt, Homo sapiens
uuacauaugcc

SEQ ID NO: 1317428 - RNA, 16 nt, Homo sapiens
uuacaucuacaaacag

SEQ ID NO: 1317429 - RNA, 13 nt, Homo sapiens
uuacaucuuucac

SEQ ID NO: 1317430 - RNA, 19 nt, Homo sapiens
uuacccaacucuguacaaa

SEQ ID NO: 1317431 - RNA, 16 nt, Homo sapiens
uuaccgagagccaaac

SEQ ID NO: 1317432 - RNA, 18 nt, Homo sapiens
uuaccgagagccaaacag

SEQ ID NO: 1317433 - RNA, 15 nt, Homo sapiens
uuaccuaccacaugc

SEQ ID NO: 1317434 - RNA, 21 nt, Homo sapiens
uuaccuuguuauuuaacccau

SEQ ID NO: 1317435 - RNA, 14 nt, Homo sapiens
uuacgcccaucuca

SEQ ID NO: 1317436 - RNA, 21 nt, Homo sapiens
uuacuauaagaacuuugagcu

SEQ ID NO: 1317437 - RNA, 14 nt, Homo sapiens
uuacuaugaucuca

SEQ ID NO: 1317438 - RNA, 16 nt, Homo sapiens
uuacuaugaucucagg

SEQ ID NO: 1317439 - RNA, 17 nt, Homo sapiens
uuacuaugaucucagga

SEQ ID NO: 1317440 - RNA, 15 nt, Homo sapiens
uuacuccagugccaa

SEQ ID NO: 1317441 - RNA, 10 nt, Homo sapiens
uuacuguaac

SEQ ID NO: 1317442 - RNA, 15 nt, Homo sapiens
uuacuguagccucag

SEQ ID NO: 1317443 - RNA, 16 nt, Homo sapiens
uuacuguauauaacua

SEQ ID NO: 1317444 - RNA, 17 nt, Homo sapiens
uuacuguuguacaauca

SEQ ID NO: 1317445 - RNA, 21 nt, Homo sapiens
uuacuuggacgcaacauugca

SEQ ID NO: 1317446 - RNA, 22 nt, Homo sapiens
uuacuuggcuuuuuacuauuaa

SEQ ID NO: 1317447 - RNA, 16 nt, Homo sapiens
uuacuuuguguucacc

SEQ ID NO: 1317448 - RNA, 20 nt, Homo sapiens
uuagaaaaagaacaugcagu

SEQ ID NO: 1317449 - RNA, 21 nt, Homo sapiens
uuagaaaauucaagcauuuag

SEQ ID NO: 1317450 - RNA, 16 nt, Homo sapiens
uuagaagucacacagu

SEQ ID NO: 1317451 - RNA, 21 nt, Homo sapiens
uuagaaugggaucacgaggaa

SEQ ID NO: 1317452 - RNA, 11 nt, Homo sapiens
uuagacuguug

SEQ ID NO: 1317453 - RNA, 20 nt, Homo sapiens
uuagagaaaagagacacaaa

SEQ ID NO: 1317454 - RNA, 16 nt, Homo sapiens
uuagaggaccagugag

SEQ ID NO: 1317455 - RNA, 20 nt, Homo sapiens
uuagaggaucccucucugga

SEQ ID NO: 1317456 - RNA, 12 nt, Homo sapiens
uuagaucuggca

SEQ ID NO: 1317457 - RNA, 22 nt, Homo sapiens
uuagaugcacuaccauugcugu

SEQ ID NO: 1317458 - RNA, 23 nt, Homo sapiens
uuagauguucuaagucuuuccau

SEQ ID NO: 1317459 - RNA, 14 nt, Homo sapiens
uuagauguuucaca

SEQ ID NO: 1317460 - RNA, 12 nt, Homo sapiens
uuagccaggugu

SEQ ID NO: 1317461 - RNA, 20 nt, Homo sapiens
uuagcuaggcuaaaacaccu

SEQ ID NO: 1317462 - RNA, 15 nt, Homo sapiens
uuagcuucaggauac

SEQ ID NO: 1317463 - RNA, 17 nt, Homo sapiens
uuaggaaagaauaaaga

SEQ ID NO: 1317464 - RNA, 15 nt, Homo sapiens
uuaggaaaggcugau

SEQ ID NO: 1317465 - RNA, 16 nt, Homo sapiens
uuaggaaggccuucag

SEQ ID NO: 1317466 - RNA, 23 nt, Homo sapiens
uuaggauuuucacauucuuggcu

SEQ ID NO: 1317467 - RNA, 17 nt, Homo sapiens
uuaggcccggagcugcc

SEQ ID NO: 1317468 - RNA, 20 nt, Homo sapiens
uuagguuucagcagagcuga

SEQ ID NO: 1317469 - RNA, 21 nt, Homo sapiens
uuagguuucagcagagcugaa

SEQ ID NO: 1317470 - RNA, 13 nt, Homo sapiens
uuagucauugcag

SEQ ID NO: 1317471 - RNA, 20 nt, Homo sapiens
uuagucgugagcucuuguga

SEQ ID NO: 1317472 - RNA, 11 nt, Homo sapiens
uuagugccuuu

SEQ ID NO: 1317473 - RNA, 20 nt, Homo sapiens
uuaguuuacaaucagccaca

SEQ ID NO: 1317474 - RNA, 18 nt, Homo sapiens
uuaguuuuuaaaauacug

SEQ ID NO: 1317475 - RNA, 13 nt, Homo sapiens
uuauaaaaaugag

SEQ ID NO: 1317476 - RNA, 21 nt, Homo sapiens
uuauaaauaaacuguugcucg

SEQ ID NO: 1317477 - RNA, 17 nt, Homo sapiens
uuauaaauaaauaucuc

SEQ ID NO: 1317478 - RNA, 20 nt, Homo sapiens
uuauaaauuggagaugcaaa

SEQ ID NO: 1317479 - RNA, 17 nt, Homo sapiens
agagaggccuuguccca

SEQ ID NO: 1317480 - RNA, 15 nt, Homo sapiens
agagaugaaccacau

SEQ ID NO: 1317481 - RNA, 16 nt, Homo sapiens
agagauuccugagcca

SEQ ID NO: 1317482 - RNA, 22 nt, Homo sapiens
agagauuccugagccaguguca

SEQ ID NO: 1317483 - RNA, 16 nt, Homo sapiens
agagauugauggguua

SEQ ID NO: 1317484 - RNA, 20 nt, Homo sapiens
agagcaagacucugucucaa

SEQ ID NO: 1317485 - RNA, 22 nt, Homo sapiens
agagcacacuuggcccaagugg

SEQ ID NO: 1317486 - RNA, 16 nt, Homo sapiens
agagcaggacugcaca

SEQ ID NO: 1317487 - RNA, 19 nt, Homo sapiens
agagcaggcguucagcuca

SEQ ID NO: 1317488 - RNA, 19 nt, Homo sapiens
agagcauuuuuuaugauau

SEQ ID NO: 1317489 - RNA, 23 nt, Homo sapiens
agagccaggggggugaggagcug

SEQ ID NO: 1317490 - RNA, 13 nt, Homo sapiens
agagccagggucu

SEQ ID NO: 1317491 - RNA, 13 nt, Homo sapiens
cagagcuguggug

SEQ ID NO: 1317492 - RNA, 14 nt, Homo sapiens
cagaggacugugau

SEQ ID NO: 1317493 - RNA, 22 nt, Homo sapiens
cagaggagagauagccuguggc

SEQ ID NO: 1317494 - RNA, 22 nt, Homo sapiens
cagaggaggggccgcugccacc

SEQ ID NO: 1317495 - RNA, 16 nt, Homo sapiens
cagaggaugagcucua

SEQ ID NO: 1317496 - RNA, 18 nt, Homo sapiens
cagagguuuccucuuagg

SEQ ID NO: 1317497 - RNA, 18 nt, Homo sapiens
cagaguaucugucuuauu

SEQ ID NO: 1317498 - RNA, 16 nt, Homo sapiens
cagagucaaugaacuu

SEQ ID NO: 1317499 - RNA, 19 nt, Homo sapiens
cagagucaaugaacuuucc

SEQ ID NO: 1317500 - RNA, 22 nt, Homo sapiens
cagagucugccccacauguggc

SEQ ID NO: 1317501 - RNA, 18 nt, Homo sapiens
cagaguggggaugacaug

SEQ ID NO: 1317502 - RNA, 22 nt, Homo sapiens
cagauaagguaaaaugccauga

SEQ ID NO: 1317503 - RNA, 18 nt, Homo sapiens
cagauacauaucugugua

SEQ ID NO: 1317504 - RNA, 13 nt, Homo sapiens
cagauaucuucag

SEQ ID NO: 1317505 - RNA, 16 nt, Homo sapiens
cagaucaaagaacuca

SEQ ID NO: 1317506 - RNA, 22 nt, Homo sapiens
cagaucacuucaggucaggagu

SEQ ID NO: 1317507 - RNA, 15 nt, Homo sapiens
cagauccucuucuca

SEQ ID NO: 1317508 - RNA, 14 nt, Homo sapiens
cagaugcaccagcc

SEQ ID NO: 1317509 - RNA, 17 nt, Homo sapiens
cagaugccacacaagga

SEQ ID NO: 1317510 - RNA, 16 nt, Homo sapiens
cagaugcuaaaagcua

SEQ ID NO: 1317511 - RNA, 19 nt, Homo sapiens
cagaugggcauauguguca

SEQ ID NO: 1317512 - RNA, 19 nt, Homo sapiens
cagaugggggaaagcacag

SEQ ID NO: 1317513 - RNA, 18 nt, Homo sapiens
cagauuagcuaggggaca

SEQ ID NO: 1317514 - RNA, 12 nt, Homo sapiens
cagauucuucag

SEQ ID NO: 1317515 - RNA, 15 nt, Homo sapiens
cagauuugcauuuca

SEQ ID NO: 1317516 - RNA, 17 nt, Homo sapiens
cagauuugggcuggaac

SEQ ID NO: 1317517 - RNA, 18 nt, Homo sapiens
cagauuuuuuccucugca

SEQ ID NO: 1317518 - RNA, 19 nt, Homo sapiens
cagauuuuuuccucugcau

SEQ ID NO: 1317519 - RNA, 17 nt, Homo sapiens
cagcaacagcaaaucac

SEQ ID NO: 1317520 - RNA, 16 nt, Homo sapiens
cagcacacagggcagu

SEQ ID NO: 1317521 - RNA, 20 nt, Homo sapiens
cagcaccugcgggagcugca

SEQ ID NO: 1317522 - RNA, 18 nt, Homo sapiens
cagcacgaguggccaguu

SEQ ID NO: 1317523 - RNA, 20 nt, Homo sapiens
cagcacgaguggccaguuca

SEQ ID NO: 1317524 - RNA, 12 nt, Homo sapiens
cagcacuuccau

SEQ ID NO: 1317525 - RNA, 15 nt, Homo sapiens
cagcacuuuccguca

SEQ ID NO: 1317526 - RNA, 17 nt, Homo sapiens
cagcagcaaauuuucag

SEQ ID NO: 1317527 - RNA, 16 nt, Homo sapiens
cagcagcuuggagcag

SEQ ID NO: 1317528 - RNA, 21 nt, Homo sapiens
cagcagcuuuguacacgaaga

SEQ ID NO: 1317529 - RNA, 23 nt, Homo sapiens
cagcaggcauaaggcaccaguua

SEQ ID NO: 1317530 - RNA, 16 nt, Homo sapiens
cagcagggucaucugu

SEQ ID NO: 1317531 - RNA, 16 nt, Homo sapiens
cagcauccacacugcc

SEQ ID NO: 1317532 - RNA, 16 nt, Homo sapiens
cagcauuugauuaaca

SEQ ID NO: 1317533 - RNA, 20 nt, Homo sapiens
cagcauuuuacuacuuuaaa

SEQ ID NO: 1317534 - RNA, 17 nt, Homo sapiens
cagccacgaggugcaac

SEQ ID NO: 1317535 - RNA, 19 nt, Homo sapiens
cagccagugaccugaggaa

SEQ ID NO: 1317536 - RNA, 17 nt, Homo sapiens
cagccaugucugcauuu

SEQ ID NO: 1317537 - RNA, 15 nt, Homo sapiens
cagccccagcccagc

SEQ ID NO: 1317538 - RNA, 19 nt, Homo sapiens
cagccccugauccugugaa

SEQ ID NO: 1317539 - RNA, 14 nt, Homo sapiens
cagcccuccagcgu

SEQ ID NO: 1317540 - RNA, 15 nt, Homo sapiens
cagcccugcagugcc

SEQ ID NO: 1317541 - RNA, 20 nt, Homo sapiens
cagccggcuaugaaagggag

SEQ ID NO: 1317542 - RNA, 14 nt, Homo sapiens
cagccuacagccag

SEQ ID NO: 1317543 - RNA, 16 nt, Homo sapiens
cagccuacagccagaa

SEQ ID NO: 1317544 - RNA, 18 nt, Homo sapiens
cagccucccauccagggc

SEQ ID NO: 1317545 - RNA, 20 nt, Homo sapiens
cagccucccgaauagcuggg

SEQ ID NO: 1317546 - RNA, 19 nt, Homo sapiens
cagccuccuuaaauguuuu

SEQ ID NO: 1317547 - RNA, 18 nt, Homo sapiens
cagccugcgccugcugca

SEQ ID NO: 1317548 - RNA, 16 nt, Homo sapiens
cagccugcuuucacac

SEQ ID NO: 1317549 - RNA, 21 nt, Homo sapiens
cagccuggccaacauggugaa

SEQ ID NO: 1317550 - RNA, 19 nt, Homo sapiens
cagccuggccaguauggug

SEQ ID NO: 1317551 - RNA, 19 nt, Homo sapiens
cagccuggcugguccccaa

SEQ ID NO: 1317552 - RNA, 16 nt, Homo sapiens
cagccuugaacucugg

SEQ ID NO: 1317553 - RNA, 23 nt, Homo sapiens
cagccuugccagagauccaaaag

SEQ ID NO: 1317554 - RNA, 20 nt, Homo sapiens
cagccuuuggucuccuggau

SEQ ID NO: 1317555 - RNA, 15 nt, Homo sapiens
cagcgugaagggauu

SEQ ID NO: 1317556 - RNA, 23 nt, Homo sapiens
cagcuaaaauuuucgacuugacu

SEQ ID NO: 1317557 - RNA, 20 nt, Homo sapiens
cagcuaaacaccacgucacu

SEQ ID NO: 1317558 - RNA, 22 nt, Homo sapiens
cagcuaaacaccacgucacuuc

SEQ ID NO: 1317559 - RNA, 14 nt, Homo sapiens
cagcuaaugggaca

SEQ ID NO: 1317560 - RNA, 19 nt, Homo sapiens
cagcuaauucaggucauuu

SEQ ID NO: 1317561 - RNA, 23 nt, Homo sapiens
cagcuaccucaaccaaugccaaa

SEQ ID NO: 1317562 - RNA, 19 nt, Homo sapiens
cagcuaguggcucuucuca

SEQ ID NO: 1317563 - RNA, 15 nt, Homo sapiens
cagcuauaccugugc

SEQ ID NO: 1317564 - RNA, 22 nt, Homo sapiens
cagcucacggaagggaugcuag

SEQ ID NO: 1317565 - RNA, 19 nt, Homo sapiens
cagcuccccagaguccucu

SEQ ID NO: 1317566 - RNA, 14 nt, Homo sapiens
cagcuccucacuca

SEQ ID NO: 1317567 - RNA, 15 nt, Homo sapiens
cagcucugcaagaau

SEQ ID NO: 1317568 - RNA, 14 nt, Homo sapiens
cagcucugggccau

SEQ ID NO: 1317569 - RNA, 21 nt, Homo sapiens
cagcucuguaucugccaugug

SEQ ID NO: 1317570 - RNA, 19 nt, Homo sapiens
cagcucuuccgaaaaccag

SEQ ID NO: 1317571 - RNA, 22 nt, Homo sapiens
cagcucuuggcuccacugggau

SEQ ID NO: 1317572 - RNA, 24 nt, Homo sapiens
cagcugacuuuucuguccgagcuu

SEQ ID NO: 1317573 - RNA, 22 nt, Homo sapiens
cagcugcagucaacaguucaaa

SEQ ID NO: 1317574 - RNA, 14 nt, Homo sapiens
cagcugguauggcc

SEQ ID NO: 1317575 - RNA, 21 nt, Homo sapiens
cagcuggucaaacaaacucuc

SEQ ID NO: 1317576 - RNA, 20 nt, Homo sapiens
cagcuuaggggcugcugacc

SEQ ID NO: 1317577 - RNA, 19 nt, Homo sapiens
cagcuucccgaguaccagu

SEQ ID NO: 1317578 - RNA, 15 nt, Homo sapiens
cagcuugaauuucaa

SEQ ID NO: 1317579 - RNA, 19 nt, Homo sapiens
cagcuuguaaauagcucag

SEQ ID NO: 1317580 - RNA, 22 nt, Homo sapiens
caggaaaaacaaaugggaaaug

SEQ ID NO: 1317581 - RNA, 23 nt, Homo sapiens
caggaaaaggugauauccauucu

SEQ ID NO: 1317582 - RNA, 18 nt, Homo sapiens
caggacacacauggugag

SEQ ID NO: 1317583 - RNA, 16 nt, Homo sapiens
caggacagaugccaca

SEQ ID NO: 1317584 - RNA, 19 nt, Homo sapiens
caggacagaugccacacaa

SEQ ID NO: 1317585 - RNA, 15 nt, Homo sapiens
caggacaguauuccu

SEQ ID NO: 1317586 - RNA, 17 nt, Homo sapiens
caggaccagcucaggac

SEQ ID NO: 1317587 - RNA, 15 nt, Homo sapiens
caggaccuccaagcc

SEQ ID NO: 1317588 - RNA, 19 nt, Homo sapiens
caggacuauauuugggccu

SEQ ID NO: 1317589 - RNA, 20 nt, Homo sapiens
caggacucaaucuacaggcc

SEQ ID NO: 1317590 - RNA, 20 nt, Homo sapiens
caggacuuccauuugcuuug

SEQ ID NO: 1317591 - RNA, 17 nt, Homo sapiens
caggagaccuggcacug

SEQ ID NO: 1317592 - RNA, 18 nt, Homo sapiens
caggagaccuggcacugg

SEQ ID NO: 1317593 - RNA, 21 nt, Homo sapiens
caggagacuuuacauggaugc

SEQ ID NO: 1317594 - RNA, 15 nt, Homo sapiens
caggaggauggcaaa

SEQ ID NO: 1317595 - RNA, 20 nt, Homo sapiens
caggaguguggccacguggg

SEQ ID NO: 1317596 - RNA, 21 nt, Homo sapiens
caggaguucagggucauagca

SEQ ID NO: 1317597 - RNA, 17 nt, Homo sapiens
caggaguuugaauccau

SEQ ID NO: 1317598 - RNA, 23 nt, Homo sapiens
caggcaaugugacuuugcaucag

SEQ ID NO: 1317599 - RNA, 17 nt, Homo sapiens
caggcacccaccaucau

SEQ ID NO: 1317600 - RNA, 12 nt, Homo sapiens
caggcaccugcc

SEQ ID NO: 1317601 - RNA, 14 nt, Homo sapiens
caggcacgucugca

SEQ ID NO: 1317602 - RNA, 15 nt, Homo sapiens
caggcagaaggcagu

SEQ ID NO: 1317603 - RNA, 15 nt, Homo sapiens
caggcagauccagga

SEQ ID NO: 1317604 - RNA, 16 nt, Homo sapiens
caggcagauccaggac

SEQ ID NO: 1317605 - RNA, 16 nt, Homo sapiens
caggcagguccagggu

SEQ ID NO: 1317606 - RNA, 13 nt, Homo sapiens
caggcauugccaa

SEQ ID NO: 1317607 - RNA, 18 nt, Homo sapiens
caggccauauuaucaaug

SEQ ID NO: 1317608 - RNA, 14 nt, Homo sapiens
caggccccugccac

SEQ ID NO: 1317609 - RNA, 13 nt, Homo sapiens
caggcccuccacu

SEQ ID NO: 1317610 - RNA, 22 nt, Homo sapiens
caggccgcccugcgggugaaca

SEQ ID NO: 1317611 - RNA, 21 nt, Homo sapiens
caggcgcccgggauccagcuc

SEQ ID NO: 1317612 - RNA, 22 nt, Homo sapiens
caggcugaaauuucuuguucau

SEQ ID NO: 1317613 - RNA, 18 nt, Homo sapiens
caggcuggaaugcagugg

SEQ ID NO: 1317614 - RNA, 14 nt, Homo sapiens
caggcuggccaguc

SEQ ID NO: 1317615 - RNA, 13 nt, Homo sapiens
caggcuggucuca

SEQ ID NO: 1317616 - RNA, 14 nt, Homo sapiens
caggcuuaugaaua

SEQ ID NO: 1317617 - RNA, 17 nt, Homo sapiens
caggcuuaugaauauau

SEQ ID NO: 1317618 - RNA, 17 nt, Homo sapiens
caggcuugucacuagca

SEQ ID NO: 1317619 - RNA, 19 nt, Homo sapiens
cagggaaaauuauuugcau

SEQ ID NO: 1317620 - RNA, 12 nt, Homo sapiens
cagggacuugaa

SEQ ID NO: 1317621 - RNA, 14 nt, Homo sapiens
cagggaggugaccc

SEQ ID NO: 1317622 - RNA, 13 nt, Homo sapiens
cagggcacaaaga

SEQ ID NO: 1317623 - RNA, 18 nt, Homo sapiens
cagggcagcgccaggcug

SEQ ID NO: 1317624 - RNA, 22 nt, Homo sapiens
cagggcucuaaugugucucuca

SEQ ID NO: 1317625 - RNA, 13 nt, Homo sapiens
cagggcugauaag

SEQ ID NO: 1317626 - RNA, 13 nt, Homo sapiens
cagggcugcaaug

SEQ ID NO: 1317627 - RNA, 21 nt, Homo sapiens
cagggggggaaaugcauuuau

SEQ ID NO: 1317628 - RNA, 18 nt, Homo sapiens
cagggucccucuguguau

SEQ ID NO: 1317629 - RNA, 21 nt, Homo sapiens
cagggucucacuauguugccc

SEQ ID NO: 1317630 - RNA, 21 nt, Homo sapiens
cagggucucacucugucgccc

SEQ ID NO: 1317631 - RNA, 17 nt, Homo sapiens
caggguggagugcagug

SEQ ID NO: 1317632 - RNA, 20 nt, Homo sapiens
caggguuucaccauguugcc

SEQ ID NO: 1317633 - RNA, 20 nt, Homo sapiens
caggguuuugccauguuggc

SEQ ID NO: 1317634 - RNA, 15 nt, Homo sapiens
caggugaaacccagu

SEQ ID NO: 1317635 - RNA, 17 nt, Homo sapiens
caggugauccaccugcc

SEQ ID NO: 1317636 - RNA, 16 nt, Homo sapiens
caggugccuucccaga

SEQ ID NO: 1317637 - RNA, 17 nt, Homo sapiens
caggugccuucccagac

SEQ ID NO: 1317638 - RNA, 21 nt, Homo sapiens
caggugcgcucagagcugucc

SEQ ID NO: 1317639 - RNA, 15 nt, Homo sapiens
caggugcugccaucc

SEQ ID NO: 1317640 - RNA, 14 nt, Homo sapiens
caggugguaaaaau

SEQ ID NO: 1317641 - RNA, 19 nt, Homo sapiens
caggugugagccaccacac

SEQ ID NO: 1317642 - RNA, 20 nt, Homo sapiens
cagguguuacuguaauuccu

SEQ ID NO: 1317643 - RNA, 12 nt, Homo sapiens
cagguucuuagg

SEQ ID NO: 1317644 - RNA, 21 nt, Homo sapiens
cagguuggaacuaugcagugu

SEQ ID NO: 1317645 - RNA, 15 nt, Homo sapiens
caguaaaccuuaaca

SEQ ID NO: 1317646 - RNA, 22 nt, Homo sapiens
caguaaacguguuuguggucaa

SEQ ID NO: 1317647 - RNA, 14 nt, Homo sapiens
caguaaauauccca

SEQ ID NO: 1317648 - RNA, 15 nt, Homo sapiens
caguaaauaucccaa

SEQ ID NO: 1317649 - RNA, 10 nt, Homo sapiens
caguaacuga

SEQ ID NO: 1317650 - RNA, 18 nt, Homo sapiens
caguaagacgacaaggaa

SEQ ID NO: 1317651 - RNA, 15 nt, Homo sapiens
caguaauggaaugaa

SEQ ID NO: 1317652 - RNA, 18 nt, Homo sapiens
caguacaggcagcacaga

SEQ ID NO: 1317653 - RNA, 18 nt, Homo sapiens
caguagaaauaauaugca

SEQ ID NO: 1317654 - RNA, 17 nt, Homo sapiens
caguaugggaucugaua

SEQ ID NO: 1317655 - RNA, 13 nt, Homo sapiens
cagucacugugag

SEQ ID NO: 1317656 - RNA, 12 nt, Homo sapiens
caguccaaggaa

SEQ ID NO: 1317657 - RNA, 18 nt, Homo sapiens
caguccaaggaaaccaca

SEQ ID NO: 1317658 - RNA, 13 nt, Homo sapiens
caguccaugucuc

SEQ ID NO: 1317659 - RNA, 13 nt, Homo sapiens
caguccauugcuc

SEQ ID NO: 1317660 - RNA, 18 nt, Homo sapiens
caguccucauuuacugga

SEQ ID NO: 1317661 - RNA, 12 nt, Homo sapiens
caguccuuccac

SEQ ID NO: 1317662 - RNA, 13 nt, Homo sapiens
cagucucacuuug

SEQ ID NO: 1317663 - RNA, 23 nt, Homo sapiens
cagucucauauuuaguauugaau

SEQ ID NO: 1317664 - RNA, 18 nt, Homo sapiens
cagucucuucuaagcaaa

SEQ ID NO: 1317665 - RNA, 23 nt, Homo sapiens
cagugaauuuuugcaauaaugca

SEQ ID NO: 1317666 - RNA, 10 nt, Homo sapiens
cagugacacc

SEQ ID NO: 1317667 - RNA, 12 nt, Homo sapiens
cagugacauuua

SEQ ID NO: 1317668 - RNA, 18 nt, Homo sapiens
cagugagaacaucuggcc

SEQ ID NO: 1317669 - RNA, 20 nt, Homo sapiens
cagugagcugauaucaugcc

SEQ ID NO: 1317670 - RNA, 20 nt, Homo sapiens
cagugaugcuggaugcuccu

SEQ ID NO: 1317671 - RNA, 15 nt, Homo sapiens
cagugcgcuguagua

SEQ ID NO: 1317672 - RNA, 18 nt, Homo sapiens
cagugcucgcuguugcug

SEQ ID NO: 1317673 - RNA, 14 nt, Homo sapiens
cagugcuugauaca

SEQ ID NO: 1317674 - RNA, 19 nt, Homo sapiens
cagugguggucuucaagac

SEQ ID NO: 1317675 - RNA, 19 nt, Homo sapiens
caguguauagaaaaaccaa

SEQ ID NO: 1317676 - RNA, 17 nt, Homo sapiens
cagugugaaacuuacca

SEQ ID NO: 1317677 - RNA, 23 nt, Homo sapiens
caguuaacguauuaguugccaau

SEQ ID NO: 1317678 - RNA, 15 nt, Homo sapiens
caguuaaguguuucc

SEQ ID NO: 1317679 - RNA, 14 nt, Homo sapiens
caguuaauuugcac

SEQ ID NO: 1317680 - RNA, 16 nt, Homo sapiens
caguucagaaucacuu

SEQ ID NO: 1317681 - RNA, 20 nt, Homo sapiens
caguucagaaucacuucuga

SEQ ID NO: 1317682 - RNA, 14 nt, Homo sapiens
caguucugaugcuu

SEQ ID NO: 1317683 - RNA, 13 nt, Homo sapiens
caguucugcugac

SEQ ID NO: 1317684 - RNA, 18 nt, Homo sapiens
caguucuuugggccagac

SEQ ID NO: 1317685 - RNA, 16 nt, Homo sapiens
caguuugucacaugaa

SEQ ID NO: 1317686 - RNA, 20 nt, Homo sapiens
cauaaaaauaaaucaguuca

SEQ ID NO: 1317687 - RNA, 21 nt, Homo sapiens
cauaaaaauaaaucaguucau

SEQ ID NO: 1317688 - RNA, 21 nt, Homo sapiens
cauaaacuuuccucuuccugc

SEQ ID NO: 1317689 - RNA, 21 nt, Homo sapiens
cauaaagugagacauugugaa

SEQ ID NO: 1317690 - RNA, 19 nt, Homo sapiens
cauaaccgcugauucucag

SEQ ID NO: 1317691 - RNA, 14 nt, Homo sapiens
cauaauaugaugca

SEQ ID NO: 1317692 - RNA, 16 nt, Homo sapiens
cauaauauuucuuaaa

SEQ ID NO: 1317693 - RNA, 19 nt, Homo sapiens
cauaaugaaaaacuauguc

SEQ ID NO: 1317694 - RNA, 22 nt, Homo sapiens
cauacacacacacgcgugcaca

SEQ ID NO: 1317695 - RNA, 12 nt, Homo sapiens
cauacagaauua

SEQ ID NO: 1317696 - RNA, 14 nt, Homo sapiens
cauacauuaucuca

SEQ ID NO: 1317697 - RNA, 21 nt, Homo sapiens
cauacauugauucaugucuca

SEQ ID NO: 1317698 - RNA, 22 nt, Homo sapiens
cauacgguaugauauugcagcu

SEQ ID NO: 1317699 - RNA, 16 nt, Homo sapiens
cauacuuaaugcauau

SEQ ID NO: 1317700 - RNA, 17 nt, Homo sapiens
cauacuugaagggccag

SEQ ID NO: 1317701 - RNA, 18 nt, Homo sapiens
cauagagggcuccucuca

SEQ ID NO: 1317702 - RNA, 15 nt, Homo sapiens
cauagcagcugcuac

SEQ ID NO: 1317703 - RNA, 16 nt, Homo sapiens
cauagcugugcuauga

SEQ ID NO: 1317704 - RNA, 23 nt, Homo sapiens
cauaggcccagugagaugcauuc

SEQ ID NO: 1317705 - RNA, 14 nt, Homo sapiens
cauaguucacugac

SEQ ID NO: 1317706 - RNA, 22 nt, Homo sapiens
cauauaguuaauugauaagcau

SEQ ID NO: 1317707 - RNA, 16 nt, Homo sapiens
cauauauauuaauacu

SEQ ID NO: 1317708 - RNA, 16 nt, Homo sapiens
cauauauugcauuucu

SEQ ID NO: 1317709 - RNA, 19 nt, Homo sapiens
cauauauugcauuucugua

SEQ ID NO: 1317710 - RNA, 20 nt, Homo sapiens
cauaucguaaagcuguucaa

SEQ ID NO: 1317711 - RNA, 22 nt, Homo sapiens
cauaugaaaaggcuaagcuuca

SEQ ID NO: 1317712 - RNA, 13 nt, Homo sapiens
cauaugaacauau

SEQ ID NO: 1317713 - RNA, 15 nt, Homo sapiens
cauauugucuggaaa

SEQ ID NO: 1317714 - RNA, 23 nt, Homo sapiens
cauauuguuccuuaucaccugcc

SEQ ID NO: 1317715 - RNA, 21 nt, Homo sapiens
cauauuuucuuuaaaagacaa

SEQ ID NO: 1317716 - RNA, 21 nt, Homo sapiens
caucaaagacucagguuaaaa

SEQ ID NO: 1317717 - RNA, 21 nt, Homo sapiens
caucacagcugaacuuguuga

SEQ ID NO: 1317718 - RNA, 21 nt, Homo sapiens
caucacgacuuucucuuaaca

SEQ ID NO: 1317719 - RNA, 16 nt, Homo sapiens
caucagagccuuuccu

SEQ ID NO: 1317720 - RNA, 16 nt, Homo sapiens
caucagcuaaacacca

SEQ ID NO: 1317721 - RNA, 15 nt, Homo sapiens
caucaggaaauuugg

SEQ ID NO: 1317722 - RNA, 15 nt, Homo sapiens
caucaguccauugcu

SEQ ID NO: 1317723 - RNA, 17 nt, Homo sapiens
caucaucaguggagcca

SEQ ID NO: 1317724 - RNA, 21 nt, Homo sapiens
caucauggaaagacugggaca

SEQ ID NO: 1317725 - RNA, 17 nt, Homo sapiens
cauccaagcaaacugaa

SEQ ID NO: 1317726 - RNA, 14 nt, Homo sapiens
cauccacugugcca

SEQ ID NO: 1317727 - RNA, 16 nt, Homo sapiens
cauccacugugccaug

SEQ ID NO: 1317728 - RNA, 17 nt, Homo sapiens
cugugccacaaugcagu

SEQ ID NO: 1317729 - RNA, 14 nt, Homo sapiens
cugugcccucagau

SEQ ID NO: 1317730 - RNA, 22 nt, Homo sapiens
cuguggccacagcagcuuugua

SEQ ID NO: 1317731 - RNA, 15 nt, Homo sapiens
cuguggcucacguga

SEQ ID NO: 1317732 - RNA, 18 nt, Homo sapiens
cugugggauaucacauca

SEQ ID NO: 1317733 - RNA, 16 nt, Homo sapiens
cugugggccugggaua

SEQ ID NO: 1317734 - RNA, 15 nt, Homo sapiens
cuguggggaccccag

SEQ ID NO: 1317735 - RNA, 21 nt, Homo sapiens
cuguggggcugaauugccagg

SEQ ID NO: 1317736 - RNA, 21 nt, Homo sapiens
cugugggucugggagucacac

SEQ ID NO: 1317737 - RNA, 18 nt, Homo sapiens
cuguguacacgugacaga

SEQ ID NO: 1317738 - RNA, 20 nt, Homo sapiens
cugugucuugcaauggcagc

SEQ ID NO: 1317739 - RNA, 13 nt, Homo sapiens
cugugugcugagc

SEQ ID NO: 1317740 - RNA, 15 nt, Homo sapiens
cugugugugugaaug

SEQ ID NO: 1317741 - RNA, 17 nt, Homo sapiens
cuguuaacgucaucuca

SEQ ID NO: 1317742 - RNA, 23 nt, Homo sapiens
cuguucaguguaaauaguuacuc

SEQ ID NO: 1317743 - RNA, 22 nt, Homo sapiens
cuguuccuggaggucagcauuu

SEQ ID NO: 1317744 - RNA, 14 nt, Homo sapiens
cuguuccuucacau

SEQ ID NO: 1317745 - RNA, 12 nt, Homo sapiens
cuguucugggac

SEQ ID NO: 1317746 - RNA, 12 nt, Homo sapiens
cuguugcugucc

SEQ ID NO: 1317747 - RNA, 17 nt, Homo sapiens
cuguuggcaaggugaca

SEQ ID NO: 1317748 - RNA, 19 nt, Homo sapiens
cuguuggccagugugacaa

SEQ ID NO: 1317749 - RNA, 12 nt, Homo sapiens
cuguuugcacac

SEQ ID NO: 1317750 - RNA, 15 nt, Homo sapiens
cuguuugugggguga

SEQ ID NO: 1317751 - RNA, 20 nt, Homo sapiens
cuguuuuuacuaaguuuuca

SEQ ID NO: 1317752 - RNA, 18 nt, Homo sapiens
cuuaaaaaauacuugcau

SEQ ID NO: 1317753 - RNA, 21 nt, Homo sapiens
cuuaaaaauauuuuuucugua

SEQ ID NO: 1317754 - RNA, 22 nt, Homo sapiens
cuuaaaaaucuuguacauuaua

SEQ ID NO: 1317755 - RNA, 23 nt, Homo sapiens
cuuaaaaauuuguucacauuaca

SEQ ID NO: 1317756 - RNA, 20 nt, Homo sapiens
cuuaaagaauaauacuuaga

SEQ ID NO: 1317757 - RNA, 15 nt, Homo sapiens
cuuaaaguuguaaca

SEQ ID NO: 1317758 - RNA, 16 nt, Homo sapiens
cuuaaauuuaaaacug

SEQ ID NO: 1317759 - RNA, 15 nt, Homo sapiens
cuuaacucaccauaa

SEQ ID NO: 1317760 - RNA, 16 nt, Homo sapiens
cuuaacucaugaauua

SEQ ID NO: 1317761 - RNA, 20 nt, Homo sapiens
cuuaacuguuucaaagccaa

SEQ ID NO: 1317762 - RNA, 12 nt, Homo sapiens
cuuaagauuugg

SEQ ID NO: 1317763 - RNA, 14 nt, Homo sapiens
cuuaagcaaaagaa

SEQ ID NO: 1317764 - RNA, 12 nt, Homo sapiens
cuuaagcaaagg

SEQ ID NO: 1317765 - RNA, 22 nt, Homo sapiens
cuuaagcaaaggggacagcugu

SEQ ID NO: 1317766 - RNA, 13 nt, Homo sapiens
cuuaauacugucc

SEQ ID NO: 1317767 - RNA, 17 nt, Homo sapiens
cuuaauccauuucuuga

SEQ ID NO: 1317768 - RNA, 21 nt, Homo sapiens
cuuaaugaagagccagcccaa

SEQ ID NO: 1317769 - RNA, 19 nt, Homo sapiens
cuuggccggauguccucag

SEQ ID NO: 1317770 - RNA, 13 nt, Homo sapiens
cuuggcugugaaa

SEQ ID NO: 1317771 - RNA, 14 nt, Homo sapiens
cuugggaccguguu

SEQ ID NO: 1317772 - RNA, 14 nt, Homo sapiens
cuugggccaagcca

SEQ ID NO: 1317773 - RNA, 23 nt, Homo sapiens
cuugggcuguaguuuggagacaa

SEQ ID NO: 1317774 - RNA, 15 nt, Homo sapiens
cuuggggucacuccu

SEQ ID NO: 1317775 - RNA, 15 nt, Homo sapiens
cuuggguaucaauga

SEQ ID NO: 1317776 - RNA, 17 nt, Homo sapiens
cuuggguucacagugca

SEQ ID NO: 1317777 - RNA, 19 nt, Homo sapiens
cuuguacuacacagaauug

SEQ ID NO: 1317778 - RNA, 22 nt, Homo sapiens
cuuguauuaaacucuucacaaa

SEQ ID NO: 1317779 - RNA, 10 nt, Homo sapiens
cuuguauuca

SEQ ID NO: 1317780 - RNA, 19 nt, Homo sapiens
cuugucaagccugugcaaa

SEQ ID NO: 1317781 - RNA, 14 nt, Homo sapiens
cuugucagauguau

SEQ ID NO: 1317782 - RNA, 13 nt, Homo sapiens
cuuguccccauga

SEQ ID NO: 1317783 - RNA, 19 nt, Homo sapiens
cuugucuaacuuuugugaa

SEQ ID NO: 1317784 - RNA, 21 nt, Homo sapiens
cuugucucugggccacuugga

SEQ ID NO: 1317785 - RNA, 20 nt, Homo sapiens
cuugucugguaaguggcuuc

SEQ ID NO: 1317786 - RNA, 20 nt, Homo sapiens
cuugugccaacacucaagaa

SEQ ID NO: 1317787 - RNA, 23 nt, Homo sapiens
cuuguguugcaaguugguccaca

SEQ ID NO: 1317788 - RNA, 21 nt, Homo sapiens
cuuguucauaagauuaugaaa

SEQ ID NO: 1317789 - RNA, 24 nt, Homo sapiens
cuuguuccccaucaucuguggaac

SEQ ID NO: 1317790 - RNA, 13 nt, Homo sapiens
cuuguugcugagu

SEQ ID NO: 1317791 - RNA, 20 nt, Homo sapiens
cuuguugcuuuguugcacug

SEQ ID NO: 1317792 - RNA, 18 nt, Homo sapiens
cuuguuucuauacauucu

SEQ ID NO: 1317793 - RNA, 13 nt, Homo sapiens
cuuguuugcacug

SEQ ID NO: 1317794 - RNA, 16 nt, Homo sapiens
cuuguuuuugcacaug

SEQ ID NO: 1317795 - RNA, 20 nt, Homo sapiens
cuuuaaaaguauccagagau

SEQ ID NO: 1317796 - RNA, 18 nt, Homo sapiens
cuuuaaaauguaaagcca

SEQ ID NO: 1317797 - RNA, 19 nt, Homo sapiens
cuuuaaucuccuuuacuag

SEQ ID NO: 1317798 - RNA, 18 nt, Homo sapiens
cuuuacuccucacacuua

SEQ ID NO: 1317799 - RNA, 12 nt, Homo sapiens
cuuuacuccucg

SEQ ID NO: 1317800 - RNA, 17 nt, Homo sapiens
cuuuagccgacaacaga

SEQ ID NO: 1317801 - RNA, 12 nt, Homo sapiens
cuuuaguacuua

SEQ ID NO: 1317802 - RNA, 19 nt, Homo sapiens
cuuuaguccuucugccauu

SEQ ID NO: 1317803 - RNA, 19 nt, Homo sapiens
cuuuagucugcaaaaugag

SEQ ID NO: 1317804 - RNA, 14 nt, Homo sapiens
cuuuaucaccucau

SEQ ID NO: 1317805 - RNA, 16 nt, Homo sapiens
cuuuauuaaauacaaa

SEQ ID NO: 1317806 - RNA, 17 nt, Homo sapiens
cuuuauugcucacuguc

SEQ ID NO: 1317807 - RNA, 18 nt, Homo sapiens
cuuuauugcucacugucc

SEQ ID NO: 1317808 - RNA, 16 nt, Homo sapiens
cuuucaaacauguuga

SEQ ID NO: 1317809 - RNA, 15 nt, Homo sapiens
cuuucagaaacuaaa

SEQ ID NO: 1317810 - RNA, 16 nt, Homo sapiens
cuuucagcagacugau

SEQ ID NO: 1317811 - RNA, 18 nt, Homo sapiens
accauucugcauuuagcu

SEQ ID NO: 1317812 - RNA, 20 nt, Homo sapiens
accauucuugagucauggau

SEQ ID NO: 1317813 - RNA, 19 nt, Homo sapiens
accauuuugggguacccac

SEQ ID NO: 1317814 - RNA, 17 nt, Homo sapiens
acccaacucuguacaaa

SEQ ID NO: 1317815 - RNA, 14 nt, Homo sapiens
acccaagugccaag

SEQ ID NO: 1317816 - RNA, 19 nt, Homo sapiens
acccaauuccacucugaua

SEQ ID NO: 1317817 - RNA, 23 nt, Homo sapiens
acccaauuccacucugauagaau

SEQ ID NO: 1317818 - RNA, 13 nt, Homo sapiens
acccacauuggaa

SEQ ID NO: 1317819 - RNA, 19 nt, Homo sapiens
acccaccccccguggcacu

SEQ ID NO: 1317820 - RNA, 14 nt, Homo sapiens
acccaccucagccu

SEQ ID NO: 1317821 - RNA, 14 nt, Homo sapiens
acccacuaucccau

SEQ ID NO: 1317822 - RNA, 22 nt, Homo sapiens
acccacuaucccauuugcccuc

SEQ ID NO: 1317823 - RNA, 19 nt, Homo sapiens
acccagggaacagccacuc

SEQ ID NO: 1317824 - RNA, 15 nt, Homo sapiens
acccagggccugcag

SEQ ID NO: 1317825 - RNA, 17 nt, Homo sapiens
acccagggccugcagga

SEQ ID NO: 1317826 - RNA, 20 nt, Homo sapiens
acccaggguggagugcagug

SEQ ID NO: 1317827 - RNA, 18 nt, Homo sapiens
acccaugagauucauuca

SEQ ID NO: 1317828 - RNA, 16 nt, Homo sapiens
accccaaaugcucucu

SEQ ID NO: 1317829 - RNA, 18 nt, Homo sapiens
accccaaggagggagaug

SEQ ID NO: 1317830 - RNA, 13 nt, Homo sapiens
accccagccuggg

SEQ ID NO: 1317831 - RNA, 16 nt, Homo sapiens
accccagcuacucuga

SEQ ID NO: 1317832 - RNA, 18 nt, Homo sapiens
accccaggaaaagcacaa

SEQ ID NO: 1317833 - RNA, 21 nt, Homo sapiens
accccaggcaaggaugucuga

SEQ ID NO: 1317834 - RNA, 11 nt, Homo sapiens
accccaggugg

SEQ ID NO: 1317835 - RNA, 16 nt, Homo sapiens
accccaucuggcugug

SEQ ID NO: 1317836 - RNA, 18 nt, Homo sapiens
accccccagcacugagga

SEQ ID NO: 1317837 - RNA, 17 nt, Homo sapiens
accccccguggcacuca

SEQ ID NO: 1317838 - RNA, 19 nt, Homo sapiens
accccccugggcugagaga

SEQ ID NO: 1317839 - RNA, 22 nt, Homo sapiens
accccgaauugacaacccaaac

SEQ ID NO: 1317840 - RNA, 15 nt, Homo sapiens
accccuacucacaua

SEQ ID NO: 1317841 - RNA, 16 nt, Homo sapiens
accccucacugugacu

SEQ ID NO: 1317842 - RNA, 17 nt, Homo sapiens
accccucccuuucuccc

SEQ ID NO: 1317843 - RNA, 19 nt, Homo sapiens
accccucuuucgucuacug

SEQ ID NO: 1317844 - RNA, 14 nt, Homo sapiens
accccugacucauc

SEQ ID NO: 1317845 - RNA, 20 nt, Homo sapiens
accccugagauccggcaaca

SEQ ID NO: 1317846 - RNA, 15 nt, Homo sapiens
accccugguucucau

SEQ ID NO: 1317847 - RNA, 15 nt, Homo sapiens
acccuaccugcagag

SEQ ID NO: 1317848 - RNA, 14 nt, Homo sapiens
acccucugcugaag

SEQ ID NO: 1317849 - RNA, 19 nt, Homo sapiens
acccucuuagaaaaaccac

SEQ ID NO: 1317850 - RNA, 18 nt, Homo sapiens
acccugaggucacugcua

SEQ ID NO: 1317851 - RNA, 21 nt, Homo sapiens
acccugcagagcacacaggua

SEQ ID NO: 1317852 - RNA, 16 nt, Homo sapiens
acccugcauguuggcc

SEQ ID NO: 1317853 - RNA, 17 nt, Homo sapiens
acccugcucuccgacca

SEQ ID NO: 1317854 - RNA, 18 nt, Homo sapiens
acccugcuuuuugcuucu

SEQ ID NO: 1317855 - RNA, 21 nt, Homo sapiens
acccuggagcccauccagucu

SEQ ID NO: 1317856 - RNA, 23 nt, Homo sapiens
acccuggagcccauccagucucc

SEQ ID NO: 1317857 - RNA, 12 nt, Homo sapiens
acccuguugcua

SEQ ID NO: 1317858 - RNA, 13 nt, Homo sapiens
acccuucaacgcu

SEQ ID NO: 1317859 - RNA, 17 nt, Homo sapiens
acccuucgagaucauca

SEQ ID NO: 1317860 - RNA, 15 nt, Homo sapiens
accgagagccaaaca

SEQ ID NO: 1317861 - RNA, 21 nt, Homo sapiens
accgggcacucagaagacacu

SEQ ID NO: 1317862 - RNA, 17 nt, Homo sapiens
accguaggacccaagca

SEQ ID NO: 1317863 - RNA, 15 nt, Homo sapiens
accguucugugcaca

SEQ ID NO: 1317864 - RNA, 15 nt, Homo sapiens
accuaauccaggcag

SEQ ID NO: 1317865 - RNA, 13 nt, Homo sapiens
accuacccaugac

SEQ ID NO: 1317866 - RNA, 17 nt, Homo sapiens
accuauuugacuuacca

SEQ ID NO: 1317867 - RNA, 13 nt, Homo sapiens
accucaagugauc

SEQ ID NO: 1317868 - RNA, 15 nt, Homo sapiens
accucacgcaccucc

SEQ ID NO: 1317869 - RNA, 12 nt, Homo sapiens
accucagccucc

SEQ ID NO: 1317870 - RNA, 19 nt, Homo sapiens
accucagccucccaaagug

SEQ ID NO: 1317871 - RNA, 16 nt, Homo sapiens
accucagccuggccag

SEQ ID NO: 1317872 - RNA, 19 nt, Homo sapiens
accucagccuggccagaca

SEQ ID NO: 1317873 - RNA, 20 nt, Homo sapiens
accucaggugagaagcagag

SEQ ID NO: 1317874 - RNA, 18 nt, Homo sapiens
accucaguuauuacaugu

SEQ ID NO: 1317875 - RNA, 13 nt, Homo sapiens
accucauucugaa

SEQ ID NO: 1317876 - RNA, 22 nt, Homo sapiens
accucccaggcucaagcugucc

SEQ ID NO: 1317877 - RNA, 15 nt, Homo sapiens
accucccccaggugc

SEQ ID NO: 1317878 - RNA, 19 nt, Homo sapiens
accucccccaggugcagug

SEQ ID NO: 1317879 - RNA, 17 nt, Homo sapiens
accucccuauacugcuu

SEQ ID NO: 1317880 - RNA, 19 nt, Homo sapiens
accuccucccuaaugcuca

SEQ ID NO: 1317881 - RNA, 20 nt, Homo sapiens
accuccucccuaaugcucac

SEQ ID NO: 1317882 - RNA, 12 nt, Homo sapiens
accuccugccuc

SEQ ID NO: 1317883 - RNA, 16 nt, Homo sapiens
accuccuggaaggcag

SEQ ID NO: 1317884 - RNA, 17 nt, Homo sapiens
accuccuucaauuccau

SEQ ID NO: 1317885 - RNA, 17 nt, Homo sapiens
accucgcuggacucuca

SEQ ID NO: 1317886 - RNA, 14 nt, Homo sapiens
accucuccagccuc

SEQ ID NO: 1317887 - RNA, 16 nt, Homo sapiens
accucuccucuuuuca

SEQ ID NO: 1317888 - RNA, 22 nt, Homo sapiens
accucugagccaucccagagcc

SEQ ID NO: 1317889 - RNA, 17 nt, Homo sapiens
accucugccugaaguca

SEQ ID NO: 1317890 - RNA, 20 nt, Homo sapiens
accucugccugaagucacac

SEQ ID NO: 1317891 - RNA, 19 nt, Homo sapiens
accugaaaacacugugcac

SEQ ID NO: 1317892 - RNA, 16 nt, Homo sapiens
accugaacugaugggu

SEQ ID NO: 1317893 - RNA, 11 nt, Homo sapiens
accugacaaug

SEQ ID NO: 1317894 - RNA, 14 nt, Homo sapiens
accugcuucuauua

SEQ ID NO: 1317895 - RNA, 17 nt, Homo sapiens
accuggaaucagugaag

SEQ ID NO: 1317896 - RNA, 14 nt, Homo sapiens
accuggaauguguc

SEQ ID NO: 1317897 - RNA, 15 nt, Homo sapiens
accugggcaaagccu

SEQ ID NO: 1317898 - RNA, 18 nt, Homo sapiens
accugggcaauauagcaa

SEQ ID NO: 1317899 - RNA, 22 nt, Homo sapiens
accugggcugaggcauccuucc

SEQ ID NO: 1317900 - RNA, 18 nt, Homo sapiens
accuggguaaaugcagcg

SEQ ID NO: 1317901 - RNA, 13 nt, Homo sapiens
accuguaauccca

SEQ ID NO: 1317902 - RNA, 15 nt, Homo sapiens
accugugagcccagc

SEQ ID NO: 1317903 - RNA, 21 nt, Homo sapiens
accugugccucggcuuuucuc

SEQ ID NO: 1317904 - RNA, 13 nt, Homo sapiens
accuuagauuuag

SEQ ID NO: 1317905 - RNA, 16 nt, Homo sapiens
accuuaggcagggaag

SEQ ID NO: 1317906 - RNA, 20 nt, Homo sapiens
accuuaugagaaacugcaug

SEQ ID NO: 1317907 - RNA, 16 nt, Homo sapiens
accuuauuuuacagaa

SEQ ID NO: 1317908 - RNA, 15 nt, Homo sapiens
accuuccucucccaa

SEQ ID NO: 1317909 - RNA, 21 nt, Homo sapiens
accuucggagaguaaugccac

SEQ ID NO: 1317910 - RNA, 16 nt, Homo sapiens
accuugcaguguagga

SEQ ID NO: 1317911 - RNA, 15 nt, Homo sapiens
accuuggcuuguuau

SEQ ID NO: 1317912 - RNA, 16 nt, Homo sapiens
accuuguuauuucuca

SEQ ID NO: 1317913 - RNA, 14 nt, Homo sapiens
accuuuacuuuaga

SEQ ID NO: 1317914 - RNA, 14 nt, Homo sapiens
accuuuccauuuau

SEQ ID NO: 1317915 - RNA, 21 nt, Homo sapiens
accuuuggaaacaacauuuaa

SEQ ID NO: 1317916 - RNA, 20 nt, Homo sapiens
acgaauuucugugcccuccu

SEQ ID NO: 1317917 - RNA, 17 nt, Homo sapiens
acgauaaaagacaguga

SEQ ID NO: 1317918 - RNA, 20 nt, Homo sapiens
acgauugguaugaugcugcc

SEQ ID NO: 1317919 - RNA, 14 nt, Homo sapiens
acgcaccugccuca

SEQ ID NO: 1317920 - RNA, 17 nt, Homo sapiens
acgcaggagaucaucug

SEQ ID NO: 1317921 - RNA, 21 nt, Homo sapiens
acgccacugcacuauagccua

SEQ ID NO: 1317922 - RNA, 15 nt, Homo sapiens
acgccuguaauccca

SEQ ID NO: 1317923 - RNA, 21 nt, Homo sapiens
acgcguauuuacagccagugg

SEQ ID NO: 1317924 - RNA, 20 nt, Homo sapiens
acgcgugcacacaccagagc

SEQ ID NO: 1317925 - RNA, 23 nt, Homo sapiens
acgcuccuuugugugugugucag

SEQ ID NO: 1317926 - RNA, 16 nt, Homo sapiens
acgcuggcaacacaga

SEQ ID NO: 1317927 - RNA, 19 nt, Homo sapiens
acgcuuuucuuuguuauac

SEQ ID NO: 1317928 - RNA, 13 nt, Homo sapiens
acggaagggaugc

SEQ ID NO: 1317929 - RNA, 22 nt, Homo sapiens
acggagccacuccucugacuca

SEQ ID NO: 1317930 - RNA, 14 nt, Homo sapiens
acggccacaucaaa

SEQ ID NO: 1317931 - RNA, 15 nt, Homo sapiens
acggggcucuucuca

SEQ ID NO: 1317932 - RNA, 15 nt, Homo sapiens
acgggggcagcugau

SEQ ID NO: 1317933 - RNA, 22 nt, Homo sapiens
acgggguucgcgcaccaggugu

SEQ ID NO: 1317934 - RNA, 17 nt, Homo sapiens
acggucaggaaaacugu

SEQ ID NO: 1317935 - RNA, 13 nt, Homo sapiens
acgucaucucagg

SEQ ID NO: 1317936 - RNA, 22 nt, Homo sapiens
acuaaagcagagcuaguaaugc

SEQ ID NO: 1317937 - RNA, 11 nt, Homo sapiens
acuaaagccaa

SEQ ID NO: 1317938 - RNA, 19 nt, Homo sapiens
acuaacuaugcauggugcc

SEQ ID NO: 1317939 - RNA, 21 nt, Homo sapiens
acuaagcaucuuuauaugcuu

SEQ ID NO: 1317940 - RNA, 16 nt, Homo sapiens
acuaagcccugccgug

SEQ ID NO: 1317941 - RNA, 19 nt, Homo sapiens
acuaaggugcuaaaucugc

SEQ ID NO: 1317942 - RNA, 12 nt, Homo sapiens
acuaagugaugc

SEQ ID NO: 1317943 - RNA, 20 nt, Homo sapiens
acuaauuauacuacuuuguu

SEQ ID NO: 1317944 - RNA, 13 nt, Homo sapiens
acuaauugucaca

SEQ ID NO: 1317945 - RNA, 17 nt, Homo sapiens
acuacaaacacaauauu

SEQ ID NO: 1317946 - RNA, 21 nt, Homo sapiens
acuacaaccaauggaauguga

SEQ ID NO: 1317947 - RNA, 17 nt, Homo sapiens
acuacagguguugucca

SEQ ID NO: 1317948 - RNA, 23 nt, Homo sapiens
acuaccuugguucccccacugau

SEQ ID NO: 1317949 - RNA, 15 nt, Homo sapiens
acuacuggcaauuug

SEQ ID NO: 1317950 - RNA, 23 nt, Homo sapiens
acuaguugucaacuaaugaaaau

SEQ ID NO: 1317951 - RNA, 15 nt, Homo sapiens
acuauagguccagaa

SEQ ID NO: 1317952 - RNA, 20 nt, Homo sapiens
acuaucuuucagcuccaguu

SEQ ID NO: 1317953 - RNA, 23 nt, Homo sapiens
acuauggacggugcuccaggcag

SEQ ID NO: 1317954 - RNA, 22 nt, Homo sapiens
acuauuaaaaagguuuacagaa

SEQ ID NO: 1317955 - RNA, 22 nt, Homo sapiens
acuauucuaaugaaaacauuaa

SEQ ID NO: 1317956 - RNA, 21 nt, Homo sapiens
acucaaaacccaucugggcuc

SEQ ID NO: 1317957 - RNA, 19 nt, Homo sapiens
acucaaauggggccagauc

SEQ ID NO: 1317958 - RNA, 20 nt, Homo sapiens
acucacauacacacacaccu

SEQ ID NO: 1317959 - RNA, 15 nt, Homo sapiens
acucagaaagccaac

SEQ ID NO: 1317960 - RNA, 21 nt, Homo sapiens
acucagaaagccaacaugugg

SEQ ID NO: 1317961 - RNA, 12 nt, Homo sapiens
acucagcauuug

SEQ ID NO: 1317962 - RNA, 23 nt, Homo sapiens
acucagcugcucugcaagcagaa

SEQ ID NO: 1317963 - RNA, 16 nt, Homo sapiens
acucagugauacucau

SEQ ID NO: 1317964 - RNA, 16 nt, Homo sapiens
acucaguugcaacuug

SEQ ID NO: 1317965 - RNA, 19 nt, Homo sapiens
acucaucccuaaugcugca

SEQ ID NO: 1317966 - RNA, 18 nt, Homo sapiens
acucaugaagcauacccc

SEQ ID NO: 1317967 - RNA, 20 nt, Homo sapiens
acucaugaugagaaauggau

SEQ ID NO: 1317968 - RNA, 16 nt, Homo sapiens
acucauggccuugucu

SEQ ID NO: 1317969 - RNA, 19 nt, Homo sapiens
acuccaggggggacaauau

SEQ ID NO: 1317970 - RNA, 13 nt, Homo sapiens
acucccauaccuu

SEQ ID NO: 1317971 - RNA, 16 nt, Homo sapiens
acuccuaggcaggaca

SEQ ID NO: 1317972 - RNA, 14 nt, Homo sapiens
acuccucuuuacac

SEQ ID NO: 1317973 - RNA, 16 nt, Homo sapiens
acucggggugcuuccu

SEQ ID NO: 1317974 - RNA, 13 nt, Homo sapiens
acucuacaauucc

SEQ ID NO: 1317975 - RNA, 21 nt, Homo sapiens
acucuagaugaaguuuuacau

SEQ ID NO: 1317976 - RNA, 17 nt, Homo sapiens
acucuaggucaguauua

SEQ ID NO: 1317977 - RNA, 23 nt, Homo sapiens
acucuauaaauaaaaccugacag

SEQ ID NO: 1317978 - RNA, 22 nt, Homo sapiens
acucuauaagauuccaaaaagc

SEQ ID NO: 1317979 - RNA, 21 nt, Homo sapiens
acucuaucugucauacauccu

SEQ ID NO: 1317980 - RNA, 16 nt, Homo sapiens
acucuccucaucucua

SEQ ID NO: 1317981 - RNA, 14 nt, Homo sapiens
acucucuaccagau

SEQ ID NO: 1317982 - RNA, 22 nt, Homo sapiens
acucucuauugaccaccaguua

SEQ ID NO: 1317983 - RNA, 11 nt, Homo sapiens
acucucugaac

SEQ ID NO: 1317984 - RNA, 16 nt, Homo sapiens
acucugauagaauuau

SEQ ID NO: 1317985 - RNA, 22 nt, Homo sapiens
acucugcucgccuuagcacuac

SEQ ID NO: 1317986 - RNA, 20 nt, Homo sapiens
acucugcugcugguggaaac

SEQ ID NO: 1317987 - RNA, 21 nt, Homo sapiens
acucuggaagauuuucauuga

SEQ ID NO: 1317988 - RNA, 18 nt, Homo sapiens
acucuguuuccuggucag

SEQ ID NO: 1317989 - RNA, 21 nt, Homo sapiens
acugaaacuguaugugcugua

SEQ ID NO: 1317990 - RNA, 14 nt, Homo sapiens
acugaaagugaaag

SEQ ID NO: 1317991 - RNA, 23 nt, Homo sapiens
acugaaauuaaaacuauucaugc

SEQ ID NO: 1317992 - RNA, 15 nt, Homo sapiens
acugaacucacuuuc

SEQ ID NO: 1317993 - RNA, 16 nt, Homo sapiens
acugaacuguguguaa

SEQ ID NO: 1317994 - RNA, 14 nt, Homo sapiens
acugaagccuuucu

SEQ ID NO: 1317995 - RNA, 16 nt, Homo sapiens
acugaagcuguucuca

SEQ ID NO: 1317996 - RNA, 20 nt, Homo sapiens
acugagccuccacagcagug

SEQ ID NO: 1317997 - RNA, 12 nt, Homo sapiens
acugagcuguca

SEQ ID NO: 1317998 - RNA, 13 nt, Homo sapiens
acugauacaucca

SEQ ID NO: 1317999 - RNA, 12 nt, Homo sapiens
acugaugcugcc

SEQ ID NO: 1318000 - RNA, 21 nt, Homo sapiens
acugauucauacauuaucuca

SEQ ID NO: 1318001 - RNA, 14 nt, Homo sapiens
acugcaaaccgcca

SEQ ID NO: 1318002 - RNA, 21 nt, Homo sapiens
acugcacgguacaaacccaaa

SEQ ID NO: 1318003 - RNA, 23 nt, Homo sapiens
acugcagggaaaauuauuugcau

SEQ ID NO: 1318004 - RNA, 13 nt, Homo sapiens
acugcaucucaaa

SEQ ID NO: 1318005 - RNA, 21 nt, Homo sapiens
acugccaucaagaugagagaa

SEQ ID NO: 1318006 - RNA, 15 nt, Homo sapiens
acugccaugccagcu

SEQ ID NO: 1318007 - RNA, 15 nt, Homo sapiens
acugcccauggacag

SEQ ID NO: 1318008 - RNA, 19 nt, Homo sapiens
acugccucgaaacacagaa

SEQ ID NO: 1318009 - RNA, 20 nt, Homo sapiens
acugccuucgcuucuugccu

SEQ ID NO: 1318010 - RNA, 21 nt, Homo sapiens
acugccuucgcuucuugccuc

SEQ ID NO: 1318011 - RNA, 17 nt, Homo sapiens
acugcucaucauuccuu

SEQ ID NO: 1318012 - RNA, 17 nt, Homo sapiens
acugcugcuccagugca

SEQ ID NO: 1318013 - RNA, 15 nt, Homo sapiens
acugcuguuguugaa

SEQ ID NO: 1318014 - RNA, 14 nt, Homo sapiens
acugcuugaggaaa

SEQ ID NO: 1318015 - RNA, 20 nt, Homo sapiens
acuggacaaagaauuccaaa

SEQ ID NO: 1318016 - RNA, 22 nt, Homo sapiens
acuggacaaagaauuccaaagc

SEQ ID NO: 1318017 - RNA, 14 nt, Homo sapiens
acuggaccagacaa

SEQ ID NO: 1318018 - RNA, 17 nt, Homo sapiens
acuggacccuguugcua

SEQ ID NO: 1318019 - RNA, 23 nt, Homo sapiens
acuggaugcauguuuuccagcuc

SEQ ID NO: 1318020 - RNA, 23 nt, Homo sapiens
acugggcucccgggccccacaga

SEQ ID NO: 1318021 - RNA, 20 nt, Homo sapiens
acugggcugguugugcugca

SEQ ID NO: 1318022 - RNA, 23 nt, Homo sapiens
acuggggccuccagaacucacug

SEQ ID NO: 1318023 - RNA, 19 nt, Homo sapiens
acugguauuuuaucuuuga

SEQ ID NO: 1318024 - RNA, 23 nt, Homo sapiens
acuggucagggcaaaccugccuc

SEQ ID NO: 1318025 - RNA, 23 nt, Homo sapiens
acugguuucucagaauccaaaga

SEQ ID NO: 1318026 - RNA, 18 nt, Homo sapiens
acuguaugugggaauuua

SEQ ID NO: 1318027 - RNA, 20 nt, Homo sapiens
acuguauuuauugugaugcc

SEQ ID NO: 1318028 - RNA, 13 nt, Homo sapiens
acugucagccuca

SEQ ID NO: 1318029 - RNA, 19 nt, Homo sapiens
acugugugucucaugguau

SEQ ID NO: 1318030 - RNA, 18 nt, Homo sapiens
acuguucuauucaucuca

SEQ ID NO: 1318031 - RNA, 13 nt, Homo sapiens
acuguugcccagg

SEQ ID NO: 1318032 - RNA, 19 nt, Homo sapiens
acuguuggcaaggugacau

SEQ ID NO: 1318033 - RNA, 19 nt, Homo sapiens
acuguuucaaagccaagac

SEQ ID NO: 1318034 - RNA, 22 nt, Homo sapiens
acuuaaaaaauacuugcaugaa

SEQ ID NO: 1318035 - RNA, 14 nt, Homo sapiens
acuuacuguagccu

SEQ ID NO: 1318036 - RNA, 21 nt, Homo sapiens
acuuaucccugcccauuucau

SEQ ID NO: 1318037 - RNA, 20 nt, Homo sapiens
acuucaaagaggaaccagga

SEQ ID NO: 1318038 - RNA, 19 nt, Homo sapiens
acuucacagcccugcagug

SEQ ID NO: 1318039 - RNA, 12 nt, Homo sapiens
acuucacaguga

SEQ ID NO: 1318040 - RNA, 23 nt, Homo sapiens
acuucagccaggugaacuggaau

SEQ ID NO: 1318041 - RNA, 21 nt, Homo sapiens
acuucauagaaaccucucuau

SEQ ID NO: 1318042 - RNA, 18 nt, Homo sapiens
acuucauauugcugagag

SEQ ID NO: 1318043 - RNA, 23 nt, Homo sapiens
acuucaugcaggugaaacccagu

SEQ ID NO: 1318044 - RNA, 20 nt, Homo sapiens
acuucccagagcaucuugca

SEQ ID NO: 1318045 - RNA, 11 nt, Homo sapiens
acuucccugaa

SEQ ID NO: 1318046 - RNA, 23 nt, Homo sapiens
acuuccugguugagcuucugcua

SEQ ID NO: 1318047 - RNA, 21 nt, Homo sapiens
acuuccuugcccccauuucac

SEQ ID NO: 1318048 - RNA, 20 nt, Homo sapiens
acuucgugcggaaucagcuu

SEQ ID NO: 1318049 - RNA, 21 nt, Homo sapiens
acuucuccaaggagcauguca

SEQ ID NO: 1318050 - RNA, 18 nt, Homo sapiens
acuucucuauuaucucaa

SEQ ID NO: 1318051 - RNA, 13 nt, Homo sapiens
acuucugugccac

SEQ ID NO: 1318052 - RNA, 11 nt, Homo sapiens
acuucuuggcu

SEQ ID NO: 1318053 - RNA, 18 nt, Homo sapiens
acuucuuuaguacuuaca

SEQ ID NO: 1318054 - RNA, 23 nt, Homo sapiens
acuugaaaugaggccuacucuaa

SEQ ID NO: 1318055 - RNA, 14 nt, Homo sapiens
acuugauguguaga

SEQ ID NO: 1318056 - RNA, 16 nt, Homo sapiens
acuugauuuaaucacc

SEQ ID NO: 1318057 - RNA, 20 nt, Homo sapiens
acuugccucacuggacucuu

SEQ ID NO: 1318058 - RNA, 19 nt, Homo sapiens
acuugcucagguacuugua

SEQ ID NO: 1318059 - RNA, 17 nt, Homo sapiens
acuugcugcugucuugu

SEQ ID NO: 1318060 - RNA, 19 nt, Homo sapiens
acuuggcuacacagggaug

SEQ ID NO: 1318061 - RNA, 23 nt, Homo sapiens
acuuggcucgaaucucugugccu

SEQ ID NO: 1318062 - RNA, 17 nt, Homo sapiens
acuuggcugcauuugcc

SEQ ID NO: 1318063 - RNA, 16 nt, Homo sapiens
acuugucuucaccaac

SEQ ID NO: 1318064 - RNA, 16 nt, Homo sapiens
acuuguggacacagcu

SEQ ID NO: 1318065 - RNA, 13 nt, Homo sapiens
acuuuagaauuaa

SEQ ID NO: 1318066 - RNA, 22 nt, Homo sapiens
acuuucaggaccuuccuuccuc

SEQ ID NO: 1318067 - RNA, 18 nt, Homo sapiens
acuuucuuaucacuuaua

SEQ ID NO: 1318068 - RNA, 15 nt, Homo sapiens
acuuucuucugaaua

SEQ ID NO: 1318069 - RNA, 16 nt, Homo sapiens
caccaauaaagccuuc

SEQ ID NO: 1318070 - RNA, 15 nt, Homo sapiens
caccacacccggcua

SEQ ID NO: 1318071 - RNA, 15 nt, Homo sapiens
caccacaugugcaca

SEQ ID NO: 1318072 - RNA, 15 nt, Homo sapiens
caccacgacuggcca

SEQ ID NO: 1318073 - RNA, 19 nt, Homo sapiens
caccacggcguuguaccug

SEQ ID NO: 1318074 - RNA, 17 nt, Homo sapiens
caccagaacacaaugcu

SEQ ID NO: 1318075 - RNA, 16 nt, Homo sapiens
caccaggaucagccag

SEQ ID NO: 1318076 - RNA, 16 nt, Homo sapiens
caccaggaugugugcc

SEQ ID NO: 1318077 - RNA, 11 nt, Homo sapiens
caccagguguc

SEQ ID NO: 1318078 - RNA, 18 nt, Homo sapiens
caccaucaccagacaggu

SEQ ID NO: 1318079 - RNA, 19 nt, Homo sapiens
caccaugauggccaggcug

SEQ ID NO: 1318080 - RNA, 22 nt, Homo sapiens
caccauucugcauuuagcugua

SEQ ID NO: 1318081 - RNA, 19 nt, Homo sapiens
cacccagacuggagugcag

SEQ ID NO: 1318082 - RNA, 22 nt, Homo sapiens
cacccagaugggggaaagcaca

SEQ ID NO: 1318083 - RNA, 20 nt, Homo sapiens
cacccauggggagacaguug

SEQ ID NO: 1318084 - RNA, 14 nt, Homo sapiens
cacccaugugcaca

SEQ ID NO: 1318085 - RNA, 23 nt, Homo sapiens
cacccccaaaaaaagagaaaaag

SEQ ID NO: 1318086 - RNA, 21 nt, Homo sapiens
caccccucaaaaaaagccuuu

SEQ ID NO: 1318087 - RNA, 13 nt, Homo sapiens
caccccugcaguu

SEQ ID NO: 1318088 - RNA, 22 nt, Homo sapiens
caccuaagaucucgguuugcca

SEQ ID NO: 1318089 - RNA, 22 nt, Homo sapiens
caccuaauccaggcagauccag

SEQ ID NO: 1318090 - RNA, 23 nt, Homo sapiens
caccuauugagggugacagccac

SEQ ID NO: 1318091 - RNA, 12 nt, Homo sapiens
caccuauuucca

SEQ ID NO: 1318092 - RNA, 18 nt, Homo sapiens
caccuccugacaguauua

SEQ ID NO: 1318093 - RNA, 15 nt, Homo sapiens
caccucucccugacc

SEQ ID NO: 1318094 - RNA, 16 nt, Homo sapiens
caccucugcacaagcu

SEQ ID NO: 1318095 - RNA, 19 nt, Homo sapiens
caccucugcacaagcugca

SEQ ID NO: 1318096 - RNA, 12 nt, Homo sapiens
caccugcaucug

SEQ ID NO: 1318097 - RNA, 17 nt, Homo sapiens
caccugcccugugcaug

SEQ ID NO: 1318098 - RNA, 19 nt, Homo sapiens
caccugggagaaaucuggc

SEQ ID NO: 1318099 - RNA, 14 nt, Homo sapiens
caccugugaguuua

SEQ ID NO: 1318100 - RNA, 21 nt, Homo sapiens
caccugugugcuguagauuca

SEQ ID NO: 1318101 - RNA, 14 nt, Homo sapiens
caccuugacagggc

SEQ ID NO: 1318102 - RNA, 23 nt, Homo sapiens
caccuugcggggauaaagagaga

SEQ ID NO: 1318103 - RNA, 22 nt, Homo sapiens
caccuuguuuucuguucuccuu

SEQ ID NO: 1318104 - RNA, 20 nt, Homo sapiens
caccuuucuggacggaacca

SEQ ID NO: 1318105 - RNA, 19 nt, Homo sapiens
caccuuuggugcuuuccag

SEQ ID NO: 1318106 - RNA, 16 nt, Homo sapiens
cacgacgaaaagacaa

SEQ ID NO: 1318107 - RNA, 22 nt, Homo sapiens
cacgccuguauucccacaccag

SEQ ID NO: 1318108 - RNA, 20 nt, Homo sapiens
cacgcggccccacauugcac

SEQ ID NO: 1318109 - RNA, 15 nt, Homo sapiens
cacggaccaugcgac

SEQ ID NO: 1318110 - RNA, 20 nt, Homo sapiens
cacggccacaucaaagaggc

SEQ ID NO: 1318111 - RNA, 12 nt, Homo sapiens
cacggggcacag

SEQ ID NO: 1318112 - RNA, 18 nt, Homo sapiens
cacguacacacacauaca

SEQ ID NO: 1318113 - RNA, 21 nt, Homo sapiens
cacgucugcagaaacagugca

SEQ ID NO: 1318114 - RNA, 16 nt, Homo sapiens
cacgugagaucauuca

SEQ ID NO: 1318115 - RNA, 20 nt, Homo sapiens
cacgugggcaaacaggcagu

SEQ ID NO: 1318116 - RNA, 15 nt, Homo sapiens
cacguucugcucauc

SEQ ID NO: 1318117 - RNA, 16 nt, Homo sapiens
cacuaacaaacucuga

SEQ ID NO: 1318118 - RNA, 16 nt, Homo sapiens
cacuaaggugugcucu

SEQ ID NO: 1318119 - RNA, 17 nt, Homo sapiens
cacuaaggugugcucug

SEQ ID NO: 1318120 - RNA, 14 nt, Homo sapiens
cacuaccauugcug

SEQ ID NO: 1318121 - RNA, 18 nt, Homo sapiens
cacuaggguccaccagga

SEQ ID NO: 1318122 - RNA, 11 nt, Homo sapiens
cacuaugacau

SEQ ID NO: 1318123 - RNA, 14 nt, Homo sapiens
cacuauguauauac

SEQ ID NO: 1318124 - RNA, 17 nt, Homo sapiens
cacuauguauauacaua

SEQ ID NO: 1318125 - RNA, 15 nt, Homo sapiens
cacucaccccagcga

SEQ ID NO: 1318126 - RNA, 13 nt, Homo sapiens
cacucagcucuug

SEQ ID NO: 1318127 - RNA, 20 nt, Homo sapiens
cacucagcucuuggcuccac

SEQ ID NO: 1318128 - RNA, 20 nt, Homo sapiens
cacucaggcuggaguacagu

SEQ ID NO: 1318129 - RNA, 21 nt, Homo sapiens
cacuccuucucucacuguguu

SEQ ID NO: 1318130 - RNA, 22 nt, Homo sapiens
cacucucuaccagauaacugag

SEQ ID NO: 1318131 - RNA, 22 nt, Homo sapiens
cacucugcucgccuuagcacua

SEQ ID NO: 1318132 - RNA, 21 nt, Homo sapiens
cacugaggugccgugugacgg

SEQ ID NO: 1318133 - RNA, 22 nt, Homo sapiens
cacugaugcuuagauguuccag

SEQ ID NO: 1318134 - RNA, 13 nt, Homo sapiens
cacugcaagaagu

SEQ ID NO: 1318135 - RNA, 19 nt, Homo sapiens
cacugccggcaggaugcag

SEQ ID NO: 1318136 - RNA, 24 nt, Homo sapiens
cacugcuaaaauagaauauagcau

SEQ ID NO: 1318137 - RNA, 21 nt, Homo sapiens
cacugcugcccccagaaaaag

SEQ ID NO: 1318138 - RNA, 14 nt, Homo sapiens
cacugggaucacag

SEQ ID NO: 1318139 - RNA, 16 nt, Homo sapiens
cacugguugcacuuau

SEQ ID NO: 1318140 - RNA, 16 nt, Homo sapiens
cacugucugcccugaa

SEQ ID NO: 1318141 - RNA, 23 nt, Homo sapiens
cacugugaagagaaccauaucaa

SEQ ID NO: 1318142 - RNA, 16 nt, Homo sapiens
cacugugucauucugu

SEQ ID NO: 1318143 - RNA, 15 nt, Homo sapiens
cacuguguuacugcu

SEQ ID NO: 1318144 - RNA, 17 nt, Homo sapiens
cacuguugcccaggcug

SEQ ID NO: 1318145 - RNA, 19 nt, Homo sapiens
cacuguuugucucaccuac

SEQ ID NO: 1318146 - RNA, 22 nt, Homo sapiens
cacuuaaugaaugaaugaauuc

SEQ ID NO: 1318147 - RNA, 19 nt, Homo sapiens
cacuuaugauuucaugugc

SEQ ID NO: 1318148 - RNA, 13 nt, Homo sapiens
cacuuccuugccc

SEQ ID NO: 1318149 - RNA, 22 nt, Homo sapiens
cacuucugagaacucaucccua

SEQ ID NO: 1318150 - RNA, 15 nt, Homo sapiens
cacuuguuugcacug

SEQ ID NO: 1318151 - RNA, 15 nt, Homo sapiens
cacuuuaaaccuguu

SEQ ID NO: 1318152 - RNA, 23 nt, Homo sapiens
cacuuuugaagaggccuaaguca

SEQ ID NO: 1318153 - RNA, 23 nt, Homo sapiens
cacuuuuggaaggugacuuuuca

SEQ ID NO: 1318154 - RNA, 17 nt, Homo sapiens
cagaaaaaaaaauggaa

SEQ ID NO: 1318155 - RNA, 18 nt, Homo sapiens
cagaaaaaugguggucau

SEQ ID NO: 1318156 - RNA, 23 nt, Homo sapiens
cagaaaauguugagaaucccaaa

SEQ ID NO: 1318157 - RNA, 14 nt, Homo sapiens
cagaaaccaaagcu

SEQ ID NO: 1318158 - RNA, 18 nt, Homo sapiens
cagaaacuuuacaaccug

SEQ ID NO: 1318159 - RNA, 21 nt, Homo sapiens
cagaaagcaguucugaugcuu

SEQ ID NO: 1318160 - RNA, 18 nt, Homo sapiens
cagaaagcugcuugccau

SEQ ID NO: 1318161 - RNA, 21 nt, Homo sapiens
cagaaagugugcuuuaugcug

SEQ ID NO: 1318162 - RNA, 22 nt, Homo sapiens
cagaaauacagucuuccacaaa

SEQ ID NO: 1318163 - RNA, 14 nt, Homo sapiens
cagaacacaaugcu

SEQ ID NO: 1318164 - RNA, 12 nt, Homo sapiens
cagaacacacuc

SEQ ID NO: 1318165 - RNA, 19 nt, Homo sapiens
cagaaccuuguuauuucuc

SEQ ID NO: 1318166 - RNA, 20 nt, Homo sapiens
cagaacguggugaccuuuca

SEQ ID NO: 1318167 - RNA, 14 nt, Homo sapiens
cagaacuaaacuca

SEQ ID NO: 1318168 - RNA, 20 nt, Homo sapiens
cagaacugcuaccuuccuag

SEQ ID NO: 1318169 - RNA, 14 nt, Homo sapiens
cagaagaacugugu

SEQ ID NO: 1318170 - RNA, 20 nt, Homo sapiens
cagaagaccccugacucauc

SEQ ID NO: 1318171 - RNA, 18 nt, Homo sapiens
cagaagccugaugcugac

SEQ ID NO: 1318172 - RNA, 24 nt, Homo sapiens
cagaaggaaccagcguguauauga

SEQ ID NO: 1318173 - RNA, 21 nt, Homo sapiens
cagaaguuugagaucagccug

SEQ ID NO: 1318174 - RNA, 18 nt, Homo sapiens
cagaaucccguaacaccu

SEQ ID NO: 1318175 - RNA, 13 nt, Homo sapiens
cuuucauauggua

SEQ ID NO: 1318176 - RNA, 21 nt, Homo sapiens
cuuucauccacuagugcaaau

SEQ ID NO: 1318177 - RNA, 18 nt, Homo sapiens
cuuucauuauagcagaga

SEQ ID NO: 1318178 - RNA, 17 nt, Homo sapiens
cuuucauucagccuuua

SEQ ID NO: 1318179 - RNA, 18 nt, Homo sapiens
cuuucauucagccuuuag

SEQ ID NO: 1318180 - RNA, 15 nt, Homo sapiens
cuuuccaaaggccau

SEQ ID NO: 1318181 - RNA, 15 nt, Homo sapiens
cuuuccagcuuagaa

SEQ ID NO: 1318182 - RNA, 22 nt, Homo sapiens
cuuuccccagugacaccucagc

SEQ ID NO: 1318183 - RNA, 22 nt, Homo sapiens
cuuucccccugugaaagcaaaa

SEQ ID NO: 1318184 - RNA, 22 nt, Homo sapiens
cuuuccuuguuccccaucaucu

SEQ ID NO: 1318185 - RNA, 16 nt, Homo sapiens
cuuucgucuacugcaa

SEQ ID NO: 1318186 - RNA, 20 nt, Homo sapiens
cuuucuucccuacaguugaa

SEQ ID NO: 1318187 - RNA, 21 nt, Homo sapiens
cuuugaaugcuaagaaugcau

SEQ ID NO: 1318188 - RNA, 17 nt, Homo sapiens
cuuugagacugggucuc

SEQ ID NO: 1318189 - RNA, 22 nt, Homo sapiens
cuuugaucccugacaucuggaa

SEQ ID NO: 1318190 - RNA, 21 nt, Homo sapiens
cuuugcauagcagcugcuacu

SEQ ID NO: 1318191 - RNA, 19 nt, Homo sapiens
cuuugcccaaaacugucau

SEQ ID NO: 1318192 - RNA, 17 nt, Homo sapiens
cuuugcugcagaacuga

SEQ ID NO: 1318193 - RNA, 13 nt, Homo sapiens
cuuuggacacuca

SEQ ID NO: 1318194 - RNA, 15 nt, Homo sapiens
cuuuggcgaccuccu

SEQ ID NO: 1318195 - RNA, 14 nt, Homo sapiens
cuuuggcuuugcaa

SEQ ID NO: 1318196 - RNA, 20 nt, Homo sapiens
cuuuggugacuucacaguga

SEQ ID NO: 1318197 - RNA, 15 nt, Homo sapiens
cuuuggugcuuucca

SEQ ID NO: 1318198 - RNA, 17 nt, Homo sapiens
cuuugucccggggcucc

SEQ ID NO: 1318199 - RNA, 17 nt, Homo sapiens
cuuugucccguggcauu

SEQ ID NO: 1318200 - RNA, 15 nt, Homo sapiens
cuuugugacuucaag

SEQ ID NO: 1318201 - RNA, 20 nt, Homo sapiens
cuuuguugcacugaaaugga

SEQ ID NO: 1318202 - RNA, 19 nt, Homo sapiens
cuuuuaaaaugcaauguaa

SEQ ID NO: 1318203 - RNA, 13 nt, Homo sapiens
cuuuuacauucug

SEQ ID NO: 1318204 - RNA, 17 nt, Homo sapiens
cuuuuacugaagccuuu

SEQ ID NO: 1318205 - RNA, 21 nt, Homo sapiens
cuuuuaguauuuuagugaacu

SEQ ID NO: 1318206 - RNA, 21 nt, Homo sapiens
cuuuuauguaguaauugacau

SEQ ID NO: 1318207 - RNA, 20 nt, Homo sapiens
cuuuucaccuuaaugcauau

SEQ ID NO: 1318208 - RNA, 21 nt, Homo sapiens
cuuuucuguccgagcuuugaa

SEQ ID NO: 1318209 - RNA, 16 nt, Homo sapiens
cuuuuguuauguauuu

SEQ ID NO: 1318210 - RNA, 18 nt, Homo sapiens
cuuuuguuuugaguuacu

SEQ ID NO: 1318211 - RNA, 18 nt, Homo sapiens
cuuuuuaaccugcaaaau

SEQ ID NO: 1318212 - RNA, 15 nt, Homo sapiens
cuuuuuaacuuaacu

SEQ ID NO: 1318213 - RNA, 18 nt, Homo sapiens
cuuuuuaaggacacuggg

SEQ ID NO: 1318214 - RNA, 16 nt, Homo sapiens
cuuuuuacaauuaaaa

SEQ ID NO: 1318215 - RNA, 16 nt, Homo sapiens
cuuuuucuuguauuca

SEQ ID NO: 1318216 - RNA, 19 nt, Homo sapiens
cuuuuugcguacacagaga

SEQ ID NO: 1318217 - RNA, 21 nt, Homo sapiens
cuuuuuucacggaaguuuuca

SEQ ID NO: 1318218 - RNA, 17 nt, Homo sapiens
cuuuuuuuaacugguga

SEQ ID NO: 1318219 - RNA, 16 nt, Homo sapiens
gaaaaaaaaauggaag

SEQ ID NO: 1318220 - RNA, 14 nt, Homo sapiens
gaaaaacauuauuu

SEQ ID NO: 1318221 - RNA, 23 nt, Homo sapiens
gaaaaauagcaacuuguguuaca

SEQ ID NO: 1318222 - RNA, 16 nt, Homo sapiens
gaaaacugucugggag

SEQ ID NO: 1318223 - RNA, 13 nt, Homo sapiens
gaaaagauuuuua

SEQ ID NO: 1318224 - RNA, 16 nt, Homo sapiens
gaaaagugaauuucac

SEQ ID NO: 1318225 - RNA, 19 nt, Homo sapiens
gaaaaguuauuagugguuu

SEQ ID NO: 1318226 - RNA, 19 nt, Homo sapiens
gaaaauaauauuaaaucua

SEQ ID NO: 1318227 - RNA, 17 nt, Homo sapiens
gaaaaucaucaagaagg

SEQ ID NO: 1318228 - RNA, 22 nt, Homo sapiens
gaaaaucgugacaacacuugug

SEQ ID NO: 1318229 - RNA, 23 nt, Homo sapiens
gaaaaucuagaggaaaagaaaga

SEQ ID NO: 1318230 - RNA, 15 nt, Homo sapiens
gaaaauggaaccagg

SEQ ID NO: 1318231 - RNA, 18 nt, Homo sapiens
gaaaaugugucauucauu

SEQ ID NO: 1318232 - RNA, 20 nt, Homo sapiens
gaaaauuaauagaauuauuu

SEQ ID NO: 1318233 - RNA, 22 nt, Homo sapiens
gaaaauucaagcauuuaggaau

SEQ ID NO: 1318234 - RNA, 18 nt, Homo sapiens
gaaacaaaaggauaauga

SEQ ID NO: 1318235 - RNA, 22 nt, Homo sapiens
gaaacaacaauuucuacuuuga

SEQ ID NO: 1318236 - RNA, 23 nt, Homo sapiens
gaaacaacaauuucuacuuugaa

SEQ ID NO: 1318237 - RNA, 14 nt, Homo sapiens
gaaacaacauuuaa

SEQ ID NO: 1318238 - RNA, 17 nt, Homo sapiens
gaaacacagaaaccuuu

SEQ ID NO: 1318239 - RNA, 23 nt, Homo sapiens
gaaacaccguguuuucugacaca

SEQ ID NO: 1318240 - RNA, 19 nt, Homo sapiens
gaaacacuuucaggaccuu

SEQ ID NO: 1318241 - RNA, 15 nt, Homo sapiens
gaaacagcgcugggu

SEQ ID NO: 1318242 - RNA, 22 nt, Homo sapiens
gaaacaugcaagauacaggaaa

SEQ ID NO: 1318243 - RNA, 21 nt, Homo sapiens
gaaaccugucauuguauucag

SEQ ID NO: 1318244 - RNA, 21 nt, Homo sapiens
gaaacgucuucuaaacuuccc

SEQ ID NO: 1318245 - RNA, 19 nt, Homo sapiens
gaaacuaacacagccauca

SEQ ID NO: 1318246 - RNA, 18 nt, Homo sapiens
gaaacuauauguauucac

SEQ ID NO: 1318247 - RNA, 23 nt, Homo sapiens
gaaacuauauuuugucauaucaa

SEQ ID NO: 1318248 - RNA, 23 nt, Homo sapiens
gaaacugcccuggcuccagugaa

SEQ ID NO: 1318249 - RNA, 21 nt, Homo sapiens
gaaacuuaccauucaacugaa

SEQ ID NO: 1318250 - RNA, 11 nt, Homo sapiens
gaaacuuugag

SEQ ID NO: 1318251 - RNA, 14 nt, Homo sapiens
gaaagaacugucau

SEQ ID NO: 1318252 - RNA, 13 nt, Homo sapiens
gaaagaaggaauc

SEQ ID NO: 1318253 - RNA, 18 nt, Homo sapiens
gaaagaaguuauuuucca

SEQ ID NO: 1318254 - RNA, 19 nt, Homo sapiens
gaaagaaguucacaucaga

SEQ ID NO: 1318255 - RNA, 18 nt, Homo sapiens
gaaagcaaguguucacaa

SEQ ID NO: 1318256 - RNA, 21 nt, Homo sapiens
gaaagcaaguguucacaacag

SEQ ID NO: 1318257 - RNA, 16 nt, Homo sapiens
gaaagccacagacaau

SEQ ID NO: 1318258 - RNA, 16 nt, Homo sapiens
gaaagcugcuugccau

SEQ ID NO: 1318259 - RNA, 17 nt, Homo sapiens
gaaagcuguuaaauucu

SEQ ID NO: 1318260 - RNA, 18 nt, Homo sapiens
gaaagcuguuaaauucuc

SEQ ID NO: 1318261 - RNA, 22 nt, Homo sapiens
gaaaggcaaaugcccaagggaa

SEQ ID NO: 1318262 - RNA, 17 nt, Homo sapiens
gaaaggcagccuccuua

SEQ ID NO: 1318263 - RNA, 14 nt, Homo sapiens
gaaagggacaauga

SEQ ID NO: 1318264 - RNA, 12 nt, Homo sapiens
gaaagguggugu

SEQ ID NO: 1318265 - RNA, 14 nt, Homo sapiens
gucucaaugcucau

SEQ ID NO: 1318266 - RNA, 22 nt, Homo sapiens
gucucacugugggaaggccagc

SEQ ID NO: 1318267 - RNA, 18 nt, Homo sapiens
gucucaugugguccuccu

SEQ ID NO: 1318268 - RNA, 23 nt, Homo sapiens
gucuccacggccugcccagucga

SEQ ID NO: 1318269 - RNA, 21 nt, Homo sapiens
gucuccucaugcccccucagu

SEQ ID NO: 1318270 - RNA, 13 nt, Homo sapiens
gucucgcuuuguu

SEQ ID NO: 1318271 - RNA, 17 nt, Homo sapiens
gucucgcuuuguugccc

SEQ ID NO: 1318272 - RNA, 21 nt, Homo sapiens
gucucuagaagugccaucuca

SEQ ID NO: 1318273 - RNA, 13 nt, Homo sapiens
gucucucugucuc

SEQ ID NO: 1318274 - RNA, 17 nt, Homo sapiens
gucucuguuccaugucu

SEQ ID NO: 1318275 - RNA, 16 nt, Homo sapiens
gucucuuggaaacagc

SEQ ID NO: 1318276 - RNA, 16 nt, Homo sapiens
gucuggaaugcagugg

SEQ ID NO: 1318277 - RNA, 19 nt, Homo sapiens
gucuggcaucucccacaca

SEQ ID NO: 1318278 - RNA, 18 nt, Homo sapiens
gucugggagucacacagu

SEQ ID NO: 1318279 - RNA, 23 nt, Homo sapiens
gucuuaucaagcagccaagggau

SEQ ID NO: 1318280 - RNA, 15 nt, Homo sapiens
gucuuauuuguucau

SEQ ID NO: 1318281 - RNA, 15 nt, Homo sapiens
gucuugccagccaga

SEQ ID NO: 1318282 - RNA, 15 nt, Homo sapiens
gucuuuacagaauca

SEQ ID NO: 1318283 - RNA, 20 nt, Homo sapiens
gucuuuccuaaggcugcaag

SEQ ID NO: 1318284 - RNA, 19 nt, Homo sapiens
gucuuugccagucauucag

SEQ ID NO: 1318285 - RNA, 17 nt, Homo sapiens
gucuuuuucgccaaacu

SEQ ID NO: 1318286 - RNA, 22 nt, Homo sapiens
gucuuuuucgccaaacugucuc

SEQ ID NO: 1318287 - RNA, 22 nt, Homo sapiens
gucuuuuuuucccuaccauuca

SEQ ID NO: 1318288 - RNA, 14 nt, Homo sapiens
gugaaaagcuccau

SEQ ID NO: 1318289 - RNA, 15 nt, Homo sapiens
gugaaauaauuccuc

SEQ ID NO: 1318290 - RNA, 19 nt, Homo sapiens
gugaaauacuguacagggg

SEQ ID NO: 1318291 - RNA, 14 nt, Homo sapiens
gugaaaugcuggca

SEQ ID NO: 1318292 - RNA, 20 nt, Homo sapiens
gugaaaugcuggcauuugca

SEQ ID NO: 1318293 - RNA, 14 nt, Homo sapiens
gugaacaaagcagc

SEQ ID NO: 1318294 - RNA, 19 nt, Homo sapiens
gugaacaaagcagccacga

SEQ ID NO: 1318295 - RNA, 15 nt, Homo sapiens
gugaacugaaauuaa

SEQ ID NO: 1318296 - RNA, 23 nt, Homo sapiens
gugaagucgucuuaacucaccau

SEQ ID NO: 1318297 - RNA, 15 nt, Homo sapiens
gugaauaaaccauca

SEQ ID NO: 1318298 - RNA, 16 nt, Homo sapiens
gugaauaaaccaucau

SEQ ID NO: 1318299 - RNA, 14 nt, Homo sapiens
gugaauuuuugcaa

SEQ ID NO: 1318300 - RNA, 18 nt, Homo sapiens
gugacaagaauuguuacc

SEQ ID NO: 1318301 - RNA, 13 nt, Homo sapiens
gugacacccaaga

SEQ ID NO: 1318302 - RNA, 16 nt, Homo sapiens
gugacacucuauaaga

SEQ ID NO: 1318303 - RNA, 16 nt, Homo sapiens
gugacauuuccaugca

SEQ ID NO: 1318304 - RNA, 14 nt, Homo sapiens
gugaccagugcugc

SEQ ID NO: 1318305 - RNA, 21 nt, Homo sapiens
gugacuggcagcauugacucu

SEQ ID NO: 1318306 - RNA, 14 nt, Homo sapiens
gugagaaaagaaua

SEQ ID NO: 1318307 - RNA, 13 nt, Homo sapiens
gugagaacacagc

SEQ ID NO: 1318308 - RNA, 22 nt, Homo sapiens
gugagacaguccagccuggaga

SEQ ID NO: 1318309 - RNA, 17 nt, Homo sapiens
gugagcacaaugcauaa

SEQ ID NO: 1318310 - RNA, 14 nt, Homo sapiens
gugagggcuggaug

SEQ ID NO: 1318311 - RNA, 16 nt, Homo sapiens
gugaggucacagucca

SEQ ID NO: 1318312 - RNA, 13 nt, Homo sapiens
gugauagcacuuu

SEQ ID NO: 1318313 - RNA, 14 nt, Homo sapiens
gugaucacagcagc

SEQ ID NO: 1318314 - RNA, 13 nt, Homo sapiens
gugauccacccac

SEQ ID NO: 1318315 - RNA, 21 nt, Homo sapiens
gugaugaugaaaugaggucag

SEQ ID NO: 1318316 - RNA, 19 nt, Homo sapiens
gugaugguacacagugggu

SEQ ID NO: 1318317 - RNA, 11 nt, Homo sapiens
gugauguauau

SEQ ID NO: 1318318 - RNA, 23 nt, Homo sapiens
gugauucccuccugcuacucugu

SEQ ID NO: 1318319 - RNA, 22 nt, Homo sapiens
gugauugacagcuuugcugcug

SEQ ID NO: 1318320 - RNA, 18 nt, Homo sapiens
gugcaaaugugcugguca

SEQ ID NO: 1318321 - RNA, 20 nt, Homo sapiens
gugcacaacauuacagggaa

SEQ ID NO: 1318322 - RNA, 15 nt, Homo sapiens
gugcacaucucugcu

SEQ ID NO: 1318323 - RNA, 19 nt, Homo sapiens
gugcaccccuccccauuca

SEQ ID NO: 1318324 - RNA, 23 nt, Homo sapiens
gugcaccccuccccauucacaga

SEQ ID NO: 1318325 - RNA, 15 nt, Homo sapiens
gugcaccugggagaa

SEQ ID NO: 1318326 - RNA, 18 nt, Homo sapiens
gugcacguacacacacau

SEQ ID NO: 1318327 - RNA, 19 nt, Homo sapiens
gugcagcagggucaucugu

SEQ ID NO: 1318328 - RNA, 19 nt, Homo sapiens
gugcaguggcgcauucuag

SEQ ID NO: 1318329 - RNA, 19 nt, Homo sapiens
gugccagauccucuucuca

SEQ ID NO: 1318330 - RNA, 15 nt, Homo sapiens
gugccaucaucucuu

SEQ ID NO: 1318331 - RNA, 22 nt, Homo sapiens
gugccauuaagacaacuacagc

SEQ ID NO: 1318332 - RNA, 19 nt, Homo sapiens
gugcccugcaucccucucc

SEQ ID NO: 1318333 - RNA, 14 nt, Homo sapiens
gugcccuguucucu

SEQ ID NO: 1318334 - RNA, 20 nt, Homo sapiens
gugcccuuggaggccagcca

SEQ ID NO: 1318335 - RNA, 18 nt, Homo sapiens
gugccuggccaaagggau

SEQ ID NO: 1318336 - RNA, 17 nt, Homo sapiens
gugccuucccagacacu

SEQ ID NO: 1318337 - RNA, 14 nt, Homo sapiens
gugccuuuaucugu

SEQ ID NO: 1318338 - RNA, 22 nt, Homo sapiens
gugcgaucucggcucagugcaa

SEQ ID NO: 1318339 - RNA, 16 nt, Homo sapiens
gugcucaggacucaga

SEQ ID NO: 1318340 - RNA, 22 nt, Homo sapiens
gugcucauucauuuaacagagc

SEQ ID NO: 1318341 - RNA, 17 nt, Homo sapiens
gugcucugaucauccac

SEQ ID NO: 1318342 - RNA, 18 nt, Homo sapiens
gugcugggauuacaggug

SEQ ID NO: 1318343 - RNA, 21 nt, Homo sapiens
gugcugggauuacagguguga

SEQ ID NO: 1318344 - RNA, 19 nt, Homo sapiens
gugcuguagauucacauac

SEQ ID NO: 1318345 - RNA, 19 nt, Homo sapiens
uaaaaaccaagaagauguc

SEQ ID NO: 1318346 - RNA, 14 nt, Homo sapiens
uaaaaagcuuccau

SEQ ID NO: 1318347 - RNA, 20 nt, Homo sapiens
uaaaaagguuuacagaauuu

SEQ ID NO: 1318348 - RNA, 15 nt, Homo sapiens
uaaaaagugugcuua

SEQ ID NO: 1318349 - RNA, 19 nt, Homo sapiens
uaaaaagugugcuuaacau

SEQ ID NO: 1318350 - RNA, 22 nt, Homo sapiens
uaaaaauaaaucccauggaaua

SEQ ID NO: 1318351 - RNA, 13 nt, Homo sapiens
uaaaaauagacac

SEQ ID NO: 1318352 - RNA, 16 nt, Homo sapiens
uaaaaaucacacugua

SEQ ID NO: 1318353 - RNA, 15 nt, Homo sapiens
uaaaaaugagugcuu

SEQ ID NO: 1318354 - RNA, 18 nt, Homo sapiens
uaaaaaugagugcuuaaa

SEQ ID NO: 1318355 - RNA, 14 nt, Homo sapiens
uaaaaaugcaacuu

SEQ ID NO: 1318356 - RNA, 22 nt, Homo sapiens
uaaaaaugucuugcuguugaca

SEQ ID NO: 1318357 - RNA, 16 nt, Homo sapiens
uaaaacaaaagcucau

SEQ ID NO: 1318358 - RNA, 22 nt, Homo sapiens
uaaaacaaaauuugacuaauuu

SEQ ID NO: 1318359 - RNA, 20 nt, Homo sapiens
uaaaacagaagccugaugcu

SEQ ID NO: 1318360 - RNA, 20 nt, Homo sapiens
uaaaacaugcuggugaacca

SEQ ID NO: 1318361 - RNA, 15 nt, Homo sapiens
uaaaacauuaagaaa

SEQ ID NO: 1318362 - RNA, 16 nt, Homo sapiens
uaaaacccaagugccu

SEQ ID NO: 1318363 - RNA, 18 nt, Homo sapiens
uaaaacccaagugccuua

SEQ ID NO: 1318364 - RNA, 17 nt, Homo sapiens
uaaaacuauucaugcua

SEQ ID NO: 1318365 - RNA, 23 nt, Homo sapiens
uaaaagcaaaaggauauucacuu

SEQ ID NO: 1318366 - RNA, 22 nt, Homo sapiens
uaaaagcacacucauccccuca

SEQ ID NO: 1318367 - RNA, 23 nt, Homo sapiens
uaaaagcacacucauccccucac

SEQ ID NO: 1318368 - RNA, 16 nt, Homo sapiens
uaaaagcaucacauga

SEQ ID NO: 1318369 - RNA, 17 nt, Homo sapiens
uaaaagcaucacaugaa

SEQ ID NO: 1318370 - RNA, 16 nt, Homo sapiens
uaaaagcuuucugcca

SEQ ID NO: 1318371 - RNA, 24 nt, Homo sapiens
uaaaaggaaauguaaaagcacaug

SEQ ID NO: 1318372 - RNA, 19 nt, Homo sapiens
uaaaaguuggagaagucuu

SEQ ID NO: 1318373 - RNA, 19 nt, Homo sapiens
uaaaauauagcuguacaaa

SEQ ID NO: 1318374 - RNA, 18 nt, Homo sapiens
uaaaauauuuaucugauu

SEQ ID NO: 1318375 - RNA, 12 nt, Homo sapiens
uaaaaugcuagg

SEQ ID NO: 1318376 - RNA, 17 nt, Homo sapiens
uaaaauggaugccuuga

SEQ ID NO: 1318377 - RNA, 17 nt, Homo sapiens
uaaaauguaaagccaug

SEQ ID NO: 1318378 - RNA, 13 nt, Homo sapiens
uaaaauguucucu

SEQ ID NO: 1318379 - RNA, 20 nt, Homo sapiens
uaaaauguuuguuaaagcua

SEQ ID NO: 1318380 - RNA, 22 nt, Homo sapiens
uaaaauguuuguuaaagcuaga

SEQ ID NO: 1318381 - RNA, 18 nt, Homo sapiens
uaaaauuaugccauagca

SEQ ID NO: 1318382 - RNA, 19 nt, Homo sapiens
uaaaauuuucgacuugacu

SEQ ID NO: 1318383 - RNA, 23 nt, Homo sapiens
uaaacacgccugcaaacgcugcc

SEQ ID NO: 1318384 - RNA, 22 nt, Homo sapiens
uaaacagaggaguacaggugaa

SEQ ID NO: 1318385 - RNA, 15 nt, Homo sapiens
uaaaccaaaaacuga

SEQ ID NO: 1318386 - RNA, 19 nt, Homo sapiens
uaaaccaaaaacugaaagu

SEQ ID NO: 1318387 - RNA, 15 nt, Homo sapiens
uaaacucuguugcaa

SEQ ID NO: 1318388 - RNA, 22 nt, Homo sapiens
uaaacucuguugcaagugcaau

SEQ ID NO: 1318389 - RNA, 23 nt, Homo sapiens
uaaacugguauuuuaucuuugau

SEQ ID NO: 1318390 - RNA, 11 nt, Homo sapiens
uaaacuguaaa

SEQ ID NO: 1318391 - RNA, 11 nt, Homo sapiens
uaaacuugaau

SEQ ID NO: 1318392 - RNA, 17 nt, Homo sapiens
uaaagaaauaaccacug

SEQ ID NO: 1318393 - RNA, 23 nt, Homo sapiens
uaaagaaggugauaaaugucagu

SEQ ID NO: 1318394 - RNA, 22 nt, Homo sapiens
uaaagaagguuggugaauuuca

SEQ ID NO: 1318395 - RNA, 15 nt, Homo sapiens
uaaagaauacuugaa

SEQ ID NO: 1318396 - RNA, 15 nt, Homo sapiens
uaaagacaaucacug

SEQ ID NO: 1318397 - RNA, 16 nt, Homo sapiens
uaaagacaaucacugc

SEQ ID NO: 1318398 - RNA, 15 nt, Homo sapiens
uaaucccagcacuuu

SEQ ID NO: 1318399 - RNA, 19 nt, Homo sapiens
uaaucccagcuacucggga

SEQ ID NO: 1318400 - RNA, 20 nt, Homo sapiens
uaaucccagcuacuugggag

SEQ ID NO: 1318401 - RNA, 22 nt, Homo sapiens
uaaucuguguaaacacaggaau

SEQ ID NO: 1318402 - RNA, 17 nt, Homo sapiens
uaaugaaaaacuauguc

SEQ ID NO: 1318403 - RNA, 14 nt, Homo sapiens
uaaugaaaagcaca

SEQ ID NO: 1318404 - RNA, 15 nt, Homo sapiens
uaaugauagcuacug

SEQ ID NO: 1318405 - RNA, 16 nt, Homo sapiens
uaaugcucaccuuuau

SEQ ID NO: 1318406 - RNA, 11 nt, Homo sapiens
uaaugcuuaua

SEQ ID NO: 1318407 - RNA, 19 nt, Homo sapiens
uaauggaagcaucuagcau

SEQ ID NO: 1318408 - RNA, 19 nt, Homo sapiens
uaauggagcaucaagccac

SEQ ID NO: 1318409 - RNA, 20 nt, Homo sapiens
uaauggauuguuaaaaucau

SEQ ID NO: 1318410 - RNA, 16 nt, Homo sapiens
uaauggcacugagaaa

SEQ ID NO: 1318411 - RNA, 16 nt, Homo sapiens
uaaugguugacugggu

SEQ ID NO: 1318412 - RNA, 14 nt, Homo sapiens
uaauguacaucugg

SEQ ID NO: 1318413 - RNA, 14 nt, Homo sapiens
uaauguauucccua

SEQ ID NO: 1318414 - RNA, 15 nt, Homo sapiens
uaaugucaauucuug

SEQ ID NO: 1318415 - RNA, 18 nt, Homo sapiens
uaaugucccauuucacga

SEQ ID NO: 1318416 - RNA, 17 nt, Homo sapiens
uaaugugcugagcauuu

SEQ ID NO: 1318417 - RNA, 18 nt, Homo sapiens
uaaugugcugagcauuuu

SEQ ID NO: 1318418 - RNA, 17 nt, Homo sapiens
uaauguuagcaguucug

SEQ ID NO: 1318419 - RNA, 20 nt, Homo sapiens
uaauguuauaucauauguau

SEQ ID NO: 1318420 - RNA, 17 nt, Homo sapiens
uaauuuagauauuuucc

SEQ ID NO: 1318421 - RNA, 21 nt, Homo sapiens
uaauuuagauauuuuccauau

SEQ ID NO: 1318422 - RNA, 21 nt, Homo sapiens
uaauuuaucuugucucugggc

SEQ ID NO: 1318423 - RNA, 14 nt, Homo sapiens
uaauuuguauugaa

SEQ ID NO: 1318424 - RNA, 20 nt, Homo sapiens
uaauuuuuaaggauguugcc

SEQ ID NO: 1318425 - RNA, 20 nt, Homo sapiens
uaauuuuuuugagacagagu

SEQ ID NO: 1318426 - RNA, 16 nt, Homo sapiens
uacaaaaaaauacaaa

SEQ ID NO: 1318427 - RNA, 15 nt, Homo sapiens
uacaaaaagauugua

SEQ ID NO: 1318428 - RNA, 18 nt, Homo sapiens
uacaaacacaauauucaa

SEQ ID NO: 1318429 - RNA, 12 nt, Homo sapiens
uacaaacccaaa

SEQ ID NO: 1318430 - RNA, 13 nt, Homo sapiens
uacaaaugacucc

SEQ ID NO: 1318431 - RNA, 13 nt, Homo sapiens
uacaaauggacau

SEQ ID NO: 1318432 - RNA, 17 nt, Homo sapiens
uacaaccugaugucaua

SEQ ID NO: 1318433 - RNA, 23 nt, Homo sapiens
uacaagacuuguuauccauuuaa

SEQ ID NO: 1318434 - RNA, 21 nt, Homo sapiens
uacaauaaaacuuugcugcca

SEQ ID NO: 1318435 - RNA, 18 nt, Homo sapiens
uacaauaaagucuuaccu

SEQ ID NO: 1318436 - RNA, 23 nt, Homo sapiens
uacaauaacauaauuuguacaua

SEQ ID NO: 1318437 - RNA, 16 nt, Homo sapiens
uacaauguucauccca

SEQ ID NO: 1318438 - RNA, 22 nt, Homo sapiens
uacaauuauuuuuacaguucuc

SEQ ID NO: 1318439 - RNA, 19 nt, Homo sapiens
uacacacacacgcacacaa

SEQ ID NO: 1318440 - RNA, 21 nt, Homo sapiens
uacacacacacgcgugcacac

SEQ ID NO: 1318441 - RNA, 18 nt, Homo sapiens
uacacaguaagucauuua

SEQ ID NO: 1318442 - RNA, 19 nt, Homo sapiens
uacacaguaagucauuuaa

SEQ ID NO: 1318443 - RNA, 19 nt, Homo sapiens
uacacuaaaaaucugagaa

SEQ ID NO: 1318444 - RNA, 14 nt, Homo sapiens
uacagaacucuuuc

SEQ ID NO: 1318445 - RNA, 18 nt, Homo sapiens
uacagaagauuaagacag

SEQ ID NO: 1318446 - RNA, 21 nt, Homo sapiens
uacagaagauuaagacagaga

SEQ ID NO: 1318447 - RNA, 19 nt, Homo sapiens
uacagaaucaaaugcaauu

SEQ ID NO: 1318448 - RNA, 20 nt, Homo sapiens
uacagaaucaaaugcaauuu

SEQ ID NO: 1318449 - RNA, 13 nt, Homo sapiens
uacagauacauau

SEQ ID NO: 1318450 - RNA, 21 nt, Homo sapiens
uacagcaacaggaaucucaga

SEQ ID NO: 1318451 - RNA, 15 nt, Homo sapiens
uacaggagugagcac

SEQ ID NO: 1318452 - RNA, 16 nt, Homo sapiens
uacaggauauuccaaa

SEQ ID NO: 1318453 - RNA, 18 nt, Homo sapiens
uacaggauauuccaaaau

SEQ ID NO: 1318454 - RNA, 15 nt, Homo sapiens
uacaggcagcacaga

SEQ ID NO: 1318455 - RNA, 14 nt, Homo sapiens
uacaggugugaguc

SEQ ID NO: 1318456 - RNA, 19 nt, Homo sapiens
uacaguauauguugcaaaa

SEQ ID NO: 1318457 - RNA, 16 nt, Homo sapiens
uacaguaucucagggc

SEQ ID NO: 1318458 - RNA, 18 nt, Homo sapiens
uacaguaugcuugcucua

SEQ ID NO: 1318459 - RNA, 23 nt, Homo sapiens
uacauaucuguguauuaucucaa

SEQ ID NO: 1318460 - RNA, 16 nt, Homo sapiens
uacauaucuuuauuaa

SEQ ID NO: 1318461 - RNA, 18 nt, Homo sapiens
uacauauguuuaucucac

SEQ ID NO: 1318462 - RNA, 19 nt, Homo sapiens
uacaucacucucaccuucc

SEQ ID NO: 1318463 - RNA, 16 nt, Homo sapiens
uacauccaaagcagac

SEQ ID NO: 1318464 - RNA, 22 nt, Homo sapiens
uacauccaaagcagacagcucc

SEQ ID NO: 1318465 - RNA, 21 nt, Homo sapiens
uacauccauuuugauauacca

SEQ ID NO: 1318466 - RNA, 14 nt, Homo sapiens
uacauccugcagcu

SEQ ID NO: 1318467 - RNA, 12 nt, Homo sapiens
uacaucuuucac

SEQ ID NO: 1318468 - RNA, 14 nt, Homo sapiens
uacaucuuucacau

SEQ ID NO: 1318469 - RNA, 13 nt, Homo sapiens
uacaugacauuua

SEQ ID NO: 1318470 - RNA, 21 nt, Homo sapiens
uacaugagaaggaacuuccag

SEQ ID NO: 1318471 - RNA, 16 nt, Homo sapiens
uacauguaauuugaug

SEQ ID NO: 1318472 - RNA, 22 nt, Homo sapiens
uacauucugcaagcacaucugc

SEQ ID NO: 1318473 - RNA, 19 nt, Homo sapiens
uacauugauucaugucuca

SEQ ID NO: 1318474 - RNA, 18 nt, Homo sapiens
uacauuuccaaauucaca

SEQ ID NO: 1318475 - RNA, 23 nt, Homo sapiens
uaccaaaaauuuugugacauucc

SEQ ID NO: 1318476 - RNA, 22 nt, Homo sapiens
uaccacaugccaagcacugugc

SEQ ID NO: 1318477 - RNA, 22 nt, Homo sapiens
uaccaguauaagcaucugccau

SEQ ID NO: 1318478 - RNA, 21 nt, Homo sapiens
uaccagugaauuuuugcaaua

SEQ ID NO: 1318479 - RNA, 15 nt, Homo sapiens
uaccauauuuaauaa

SEQ ID NO: 1318480 - RNA, 20 nt, Homo sapiens
uaccauugcuguucuacuuu

SEQ ID NO: 1318481 - RNA, 14 nt, Homo sapiens
uaccauuuccucag

SEQ ID NO: 1318482 - RNA, 16 nt, Homo sapiens
uaccauuuuacauuuc

SEQ ID NO: 1318483 - RNA, 21 nt, Homo sapiens
uacccaaacccauggcucuau

SEQ ID NO: 1318484 - RNA, 17 nt, Homo sapiens
uacccaaggcucuucuc

SEQ ID NO: 1318485 - RNA, 16 nt, Homo sapiens
uacccauacacccccu

SEQ ID NO: 1318486 - RNA, 23 nt, Homo sapiens
uacccugcgcccaguccuuccac

SEQ ID NO: 1318487 - RNA, 17 nt, Homo sapiens
uacccugugcuaagcac

SEQ ID NO: 1318488 - RNA, 21 nt, Homo sapiens
uacccuuaagucacccuagcc

SEQ ID NO: 1318489 - RNA, 18 nt, Homo sapiens
uacccuuucauucagccu

SEQ ID NO: 1318490 - RNA, 16 nt, Homo sapiens
uaccgagagccaaaca

SEQ ID NO: 1318491 - RNA, 18 nt, Homo sapiens
uaccuaaaauugcaacuu

SEQ ID NO: 1318492 - RNA, 22 nt, Homo sapiens
uaccucaaccaaugccaaaaaa

SEQ ID NO: 1318493 - RNA, 20 nt, Homo sapiens
uaccugaaauaaaauucauu

SEQ ID NO: 1318494 - RNA, 14 nt, Homo sapiens
uaccuuuaccccau

SEQ ID NO: 1318495 - RNA, 20 nt, Homo sapiens
uacgugauccucucaccuca

SEQ ID NO: 1318496 - RNA, 15 nt, Homo sapiens
uacuaaaaauacaaa

SEQ ID NO: 1318497 - RNA, 18 nt, Homo sapiens
uacuaacauuuucauuga

SEQ ID NO: 1318498 - RNA, 15 nt, Homo sapiens
uacuaauuagcuuca

SEQ ID NO: 1318499 - RNA, 14 nt, Homo sapiens
uacuacacagaauu

SEQ ID NO: 1318500 - RNA, 13 nt, Homo sapiens
uacuaccuugaaa

SEQ ID NO: 1318501 - RNA, 20 nt, Homo sapiens
uacuagacuagacaucacaa

SEQ ID NO: 1318502 - RNA, 17 nt, Homo sapiens
uacuauuugccauuuaa

SEQ ID NO: 1318503 - RNA, 14 nt, Homo sapiens
uacucagcauuuga

SEQ ID NO: 1318504 - RNA, 13 nt, Homo sapiens
uacuccagugcca

SEQ ID NO: 1318505 - RNA, 15 nt, Homo sapiens
uacucuagauaccua

SEQ ID NO: 1318506 - RNA, 16 nt, Homo sapiens
uacucugcccucuaga

SEQ ID NO: 1318507 - RNA, 22 nt, Homo sapiens
uacugcaagguucaacuuauua

SEQ ID NO: 1318508 - RNA, 23 nt, Homo sapiens
uacugcagcuuuguuuguuguca

SEQ ID NO: 1318509 - RNA, 14 nt, Homo sapiens
uacugccuuuagaa

SEQ ID NO: 1318510 - RNA, 17 nt, Homo sapiens
uacugcugagauacaua

SEQ ID NO: 1318511 - RNA, 12 nt, Homo sapiens
uacugcugugaa

SEQ ID NO: 1318512 - RNA, 21 nt, Homo sapiens
uacugcuucauuuuuguaaua

SEQ ID NO: 1318513 - RNA, 18 nt, Homo sapiens
uacugcuugaccaaagag

SEQ ID NO: 1318514 - RNA, 14 nt, Homo sapiens
uacuggaaggcuuc

SEQ ID NO: 1318515 - RNA, 17 nt, Homo sapiens
uacugggacugugcuca

SEQ ID NO: 1318516 - RNA, 21 nt, Homo sapiens
uacugggacugugcucagaga

SEQ ID NO: 1318517 - RNA, 13 nt, Homo sapiens
uacuguaauuccu

SEQ ID NO: 1318518 - RNA, 15 nt, Homo sapiens
uacuguuucacgugu

SEQ ID NO: 1318519 - RNA, 14 nt, Homo sapiens
uacuuaaugcauau

SEQ ID NO: 1318520 - RNA, 13 nt, Homo sapiens
uacuuacaucagg

SEQ ID NO: 1318521 - RNA, 19 nt, Homo sapiens
uacuucauuuucagaguga

SEQ ID NO: 1318522 - RNA, 18 nt, Homo sapiens
uacuucuauucagcauug

SEQ ID NO: 1318523 - RNA, 15 nt, Homo sapiens
uacuuguuuuuccca

SEQ ID NO: 1318524 - RNA, 17 nt, Homo sapiens
uacuuucuggcacauaa

SEQ ID NO: 1318525 - RNA, 21 nt, Homo sapiens
uacuuuugcccuuugauuaaa

SEQ ID NO: 1318526 - RNA, 15 nt, Homo sapiens
uacuuuuuaguaauu

SEQ ID NO: 1318527 - RNA, 13 nt, Homo sapiens
uagaaaaaccacc

SEQ ID NO: 1318528 - RNA, 23 nt, Homo sapiens
uagaaaaacuuuuaaacaugaga

SEQ ID NO: 1318529 - RNA, 20 nt, Homo sapiens
uagaaaaagaacaugcaguu

SEQ ID NO: 1318530 - RNA, 13 nt, Homo sapiens
uagaaaaguauuc

SEQ ID NO: 1318531 - RNA, 21 nt, Homo sapiens
uagaaacaacauagcaaauua

SEQ ID NO: 1318532 - RNA, 19 nt, Homo sapiens
uagaaaguaagagcucuaa

SEQ ID NO: 1318533 - RNA, 16 nt, Homo sapiens
uagaaauaauaugcau

SEQ ID NO: 1318534 - RNA, 15 nt, Homo sapiens
uagaaauaaugguca

SEQ ID NO: 1318535 - RNA, 19 nt, Homo sapiens
uagaaccaccaacaagcaa

SEQ ID NO: 1318536 - RNA, 17 nt, Homo sapiens
uagaacuucauggauca

SEQ ID NO: 1318537 - RNA, 22 nt, Homo sapiens
uagaagccacuauuacugggac

SEQ ID NO: 1318538 - RNA, 12 nt, Homo sapiens
uagaagucacac

SEQ ID NO: 1318539 - RNA, 18 nt, Homo sapiens
uagaaguugaaacucacu

SEQ ID NO: 1318540 - RNA, 16 nt, Homo sapiens
uagaauaagucauugu

SEQ ID NO: 1318541 - RNA, 22 nt, Homo sapiens
uagaauagccuguggccuuugc

SEQ ID NO: 1318542 - RNA, 18 nt, Homo sapiens
uagaauauagcaucuuuc

SEQ ID NO: 1318543 - RNA, 17 nt, Homo sapiens
uagaauauuuauuaccu

SEQ ID NO: 1318544 - RNA, 23 nt, Homo sapiens
uagaauauuuauuaccucugaua

SEQ ID NO: 1318545 - RNA, 13 nt, Homo sapiens
uagaaucuucuua

SEQ ID NO: 1318546 - RNA, 15 nt, Homo sapiens
uagaaugaaagacug

SEQ ID NO: 1318547 - RNA, 12 nt, Homo sapiens
uagaauugcauu

SEQ ID NO: 1318548 - RNA, 23 nt, Homo sapiens
uagacccgaggaaacucagaguc

SEQ ID NO: 1318549 - RNA, 14 nt, Homo sapiens
uagacuaaggccau

SEQ ID NO: 1318550 - RNA, 19 nt, Homo sapiens
uagagaacacgcguauuua

SEQ ID NO: 1318551 - RNA, 21 nt, Homo sapiens
uagagacaggguuuugccaug

SEQ ID NO: 1318552 - RNA, 14 nt, Homo sapiens
uagagaguuaugaa

SEQ ID NO: 1318553 - RNA, 22 nt, Homo sapiens
uagagauggggucucacagugu

SEQ ID NO: 1318554 - RNA, 18 nt, Homo sapiens
uagagauuaccuccugag

SEQ ID NO: 1318555 - RNA, 22 nt, Homo sapiens
uagagcaggcguucagcucacu

SEQ ID NO: 1318556 - RNA, 18 nt, Homo sapiens
uagagccagggucucacu

SEQ ID NO: 1318557 - RNA, 21 nt, Homo sapiens
uagaggaaggagauagggaaa

SEQ ID NO: 1318558 - RNA, 14 nt, Homo sapiens
uagaggagaggaaa

SEQ ID NO: 1318559 - RNA, 18 nt, Homo sapiens
uagagggauuucuuugcu

SEQ ID NO: 1318560 - RNA, 20 nt, Homo sapiens
uagaggugcucauucauuua

SEQ ID NO: 1318561 - RNA, 13 nt, Homo sapiens
uagagucauugcu

SEQ ID NO: 1318562 - RNA, 18 nt, Homo sapiens
uagaguccagaucuugcc

SEQ ID NO: 1318563 - RNA, 19 nt, Homo sapiens
uagaguccagaucuugccu

SEQ ID NO: 1318564 - RNA, 19 nt, Homo sapiens
uagaucaaggagcccagaa

SEQ ID NO: 1318565 - RNA, 20 nt, Homo sapiens
uagauccagugcugagcaag

SEQ ID NO: 1318566 - RNA, 14 nt, Homo sapiens
uagaugccugugaa

SEQ ID NO: 1318567 - RNA, 23 nt, Homo sapiens
uagauuuuagacccuauugcugc

SEQ ID NO: 1318568 - RNA, 14 nt, Homo sapiens
uagauuuucacuua

SEQ ID NO: 1318569 - RNA, 21 nt, Homo sapiens
uagauuuuuucagacuuguca

SEQ ID NO: 1318570 - RNA, 22 nt, Homo sapiens
uagcaaaaacauguaugugcau

SEQ ID NO: 1318571 - RNA, 22 nt, Homo sapiens
uagcaaagccucgccuuccaug

SEQ ID NO: 1318572 - RNA, 20 nt, Homo sapiens
uagcaagcugccgaaccaaa

SEQ ID NO: 1318573 - RNA, 16 nt, Homo sapiens
uagcacaugcuucaau

SEQ ID NO: 1318574 - RNA, 14 nt, Homo sapiens
uagcaccccuacuc

SEQ ID NO: 1318575 - RNA, 20 nt, Homo sapiens
uagcacuuucuacaauguga

SEQ ID NO: 1318576 - RNA, 19 nt, Homo sapiens
uagcaucuuccuugauaau

SEQ ID NO: 1318577 - RNA, 21 nt, Homo sapiens
uagccaaggauagaagcugca

SEQ ID NO: 1318578 - RNA, 18 nt, Homo sapiens
uagccaccugucaccucu

SEQ ID NO: 1318579 - RNA, 23 nt, Homo sapiens
uagccaugugaaacucaucucau

SEQ ID NO: 1318580 - RNA, 22 nt, Homo sapiens
uagccauuuuucaaagcaauug

SEQ ID NO: 1318581 - RNA, 14 nt, Homo sapiens
uagcccacucugcu

SEQ ID NO: 1318582 - RNA, 22 nt, Homo sapiens
uagccuguggccuuugcaauuu

SEQ ID NO: 1318583 - RNA, 22 nt, Homo sapiens
uagccuuuauuuuuaaccugcc

SEQ ID NO: 1318584 - RNA, 17 nt, Homo sapiens
uagcuaccuucucuacc

SEQ ID NO: 1318585 - RNA, 14 nt, Homo sapiens
uagcugacuugcac

SEQ ID NO: 1318586 - RNA, 17 nt, Homo sapiens
uagcugagacuacaggu

SEQ ID NO: 1318587 - RNA, 14 nt, Homo sapiens
accauucagaauau

SEQ ID NO: 1318588 - RNA, 20 nt, Homo sapiens
accauuuuaagucccuguca

SEQ ID NO: 1318589 - RNA, 23 nt, Homo sapiens
accauuuuacauuucuauuucau

SEQ ID NO: 1318590 - RNA, 15 nt, Homo sapiens
acccaccaggaugug

SEQ ID NO: 1318591 - RNA, 14 nt, Homo sapiens
acccaccccagugc

SEQ ID NO: 1318592 - RNA, 16 nt, Homo sapiens
acccaccccugcacag

SEQ ID NO: 1318593 - RNA, 13 nt, Homo sapiens
acccacucagcuc

SEQ ID NO: 1318594 - RNA, 22 nt, Homo sapiens
acccacucuguugguagcaauu

SEQ ID NO: 1318595 - RNA, 21 nt, Homo sapiens
acccacugcuuuuggucugug

SEQ ID NO: 1318596 - RNA, 16 nt, Homo sapiens
acccagacugucucca

SEQ ID NO: 1318597 - RNA, 13 nt, Homo sapiens
acccagaucucau

SEQ ID NO: 1318598 - RNA, 20 nt, Homo sapiens
acccaggacuuccauuugcu

SEQ ID NO: 1318599 - RNA, 14 nt, Homo sapiens
acccaggaguggau

SEQ ID NO: 1318600 - RNA, 19 nt, Homo sapiens
acccaggguggagugcagu

SEQ ID NO: 1318601 - RNA, 23 nt, Homo sapiens
acccaggugggucccggcucugu

SEQ ID NO: 1318602 - RNA, 15 nt, Homo sapiens
acccagucacuguga

SEQ ID NO: 1318603 - RNA, 15 nt, Homo sapiens
acccaguucagugag

SEQ ID NO: 1318604 - RNA, 23 nt, Homo sapiens
acccaugugcacaagugugcaca

SEQ ID NO: 1318605 - RNA, 15 nt, Homo sapiens
accccaaaccuggca

SEQ ID NO: 1318606 - RNA, 15 nt, Homo sapiens
accccaagcaggaac

SEQ ID NO: 1318607 - RNA, 13 nt, Homo sapiens
accccacccaagu

SEQ ID NO: 1318608 - RNA, 22 nt, Homo sapiens
accccaggacgcccucacugca

SEQ ID NO: 1318609 - RNA, 22 nt, Homo sapiens
accccagugcuuguuccucuca

SEQ ID NO: 1318610 - RNA, 14 nt, Homo sapiens
acccccagcacuug

SEQ ID NO: 1318611 - RNA, 14 nt, Homo sapiens
acccccagugcagc

SEQ ID NO: 1318612 - RNA, 17 nt, Homo sapiens
acccccucuucugagca

SEQ ID NO: 1318613 - RNA, 15 nt, Homo sapiens
accccgagacuacca

SEQ ID NO: 1318614 - RNA, 16 nt, Homo sapiens
accccgagacuaccag

SEQ ID NO: 1318615 - RNA, 21 nt, Homo sapiens
accccggggugcccacaggcc

SEQ ID NO: 1318616 - RNA, 14 nt, Homo sapiens
accccucacuguga

SEQ ID NO: 1318617 - RNA, 16 nt, Homo sapiens
accccugguucucauc

SEQ ID NO: 1318618 - RNA, 15 nt, Homo sapiens
accccuuagcaauaa

SEQ ID NO: 1318619 - RNA, 18 nt, Homo sapiens
accccuucccacauauaa

SEQ ID NO: 1318620 - RNA, 20 nt, Homo sapiens
acccuaccugcagaguuacu

SEQ ID NO: 1318621 - RNA, 19 nt, Homo sapiens
acccucauucuacugaaaa

SEQ ID NO: 1318622 - RNA, 18 nt, Homo sapiens
acccuccaggaccccagc

SEQ ID NO: 1318623 - RNA, 14 nt, Homo sapiens
auauaagugcugua

SEQ ID NO: 1318624 - RNA, 22 nt, Homo sapiens
auauaauacuauauuuauacug

SEQ ID NO: 1318625 - RNA, 15 nt, Homo sapiens
auauaauacugacug

SEQ ID NO: 1318626 - RNA, 14 nt, Homo sapiens
auauaauacuguau

SEQ ID NO: 1318627 - RNA, 14 nt, Homo sapiens
auauaauaugcaca

SEQ ID NO: 1318628 - RNA, 15 nt, Homo sapiens
auauacaauaacaua

SEQ ID NO: 1318629 - RNA, 14 nt, Homo sapiens
auauaccauuucaa

SEQ ID NO: 1318630 - RNA, 19 nt, Homo sapiens
auauauacagauacauauc

SEQ ID NO: 1318631 - RNA, 13 nt, Homo sapiens
auauauagcacau

SEQ ID NO: 1318632 - RNA, 17 nt, Homo sapiens
auauaugcacuauguau

SEQ ID NO: 1318633 - RNA, 14 nt, Homo sapiens
auauauuauucucg

SEQ ID NO: 1318634 - RNA, 22 nt, Homo sapiens
auauccuuuucuucuauguagg

SEQ ID NO: 1318635 - RNA, 13 nt, Homo sapiens
auaucgaucucuu

SEQ ID NO: 1318636 - RNA, 20 nt, Homo sapiens
auaugaaauaaaauuacaca

SEQ ID NO: 1318637 - RNA, 16 nt, Homo sapiens
auaugaaucugcucac

SEQ ID NO: 1318638 - RNA, 17 nt, Homo sapiens
auaugaaugucaguagu

SEQ ID NO: 1318639 - RNA, 15 nt, Homo sapiens
auaugcaacugcagu

SEQ ID NO: 1318640 - RNA, 13 nt, Homo sapiens
auauggcuugagu

SEQ ID NO: 1318641 - RNA, 12 nt, Homo sapiens
auaugugucagu

SEQ ID NO: 1318642 - RNA, 18 nt, Homo sapiens
auaugugugugugugcau

SEQ ID NO: 1318643 - RNA, 15 nt, Homo sapiens
auauuaacaauguuu

SEQ ID NO: 1318644 - RNA, 21 nt, Homo sapiens
auauuaaggaagacaauguga

SEQ ID NO: 1318645 - RNA, 19 nt, Homo sapiens
auauuagccaguaccagcu

SEQ ID NO: 1318646 - RNA, 16 nt, Homo sapiens
auauuccuuugaagau

SEQ ID NO: 1318647 - RNA, 20 nt, Homo sapiens
auauugcagcuuauauucau

SEQ ID NO: 1318648 - RNA, 14 nt, Homo sapiens
auauugcuguuuau

SEQ ID NO: 1318649 - RNA, 14 nt, Homo sapiens
auauuggaaugcac

SEQ ID NO: 1318650 - RNA, 17 nt, Homo sapiens
auauugguguacuguaa

SEQ ID NO: 1318651 - RNA, 23 nt, Homo sapiens
auauuguucuuguaagcuuuaac

SEQ ID NO: 1318652 - RNA, 19 nt, Homo sapiens
auauuuuaaaaucugucac

SEQ ID NO: 1318653 - RNA, 14 nt, Homo sapiens
auauuuugcauaua

SEQ ID NO: 1318654 - RNA, 16 nt, Homo sapiens
auauuuuuagccuaaa

SEQ ID NO: 1318655 - RNA, 16 nt, Homo sapiens
auauuuuuguaaaaaa

SEQ ID NO: 1318656 - RNA, 22 nt, Homo sapiens
aucaaaauuucagcauuauuga

SEQ ID NO: 1318657 - RNA, 15 nt, Homo sapiens
aucaaagaugacuug

SEQ ID NO: 1318658 - RNA, 22 nt, Homo sapiens
aucaaauaagcuaauauacagu

SEQ ID NO: 1318659 - RNA, 22 nt, Homo sapiens
aucaaaugugacauuauaugca

SEQ ID NO: 1318660 - RNA, 20 nt, Homo sapiens
aucaaggcucuuccguucca

SEQ ID NO: 1318661 - RNA, 19 nt, Homo sapiens
aucaaguccuuugugaaua

SEQ ID NO: 1318662 - RNA, 18 nt, Homo sapiens
aucaauaaaaaacaaaua

SEQ ID NO: 1318663 - RNA, 19 nt, Homo sapiens
aucaauaaaaaacaaauau

SEQ ID NO: 1318664 - RNA, 15 nt, Homo sapiens
aucaccaacuguccc

SEQ ID NO: 1318665 - RNA, 15 nt, Homo sapiens
aucacgccacugcac

SEQ ID NO: 1318666 - RNA, 17 nt, Homo sapiens
aucacggcucacugcag

SEQ ID NO: 1318667 - RNA, 22 nt, Homo sapiens
aucacggcucacugcagccuca

SEQ ID NO: 1318668 - RNA, 23 nt, Homo sapiens
aucacggcucacugcagccucaa

SEQ ID NO: 1318669 - RNA, 17 nt, Homo sapiens
aucagaacugugccaca

SEQ ID NO: 1318670 - RNA, 18 nt, Homo sapiens
aucagaauuuguguugaa

SEQ ID NO: 1318671 - RNA, 17 nt, Homo sapiens
aucagacucuccuucag

SEQ ID NO: 1318672 - RNA, 16 nt, Homo sapiens
aucagauggcauaaau

SEQ ID NO: 1318673 - RNA, 17 nt, Homo sapiens
aucagcauuuuacuacu

SEQ ID NO: 1318674 - RNA, 17 nt, Homo sapiens
aucagccugcuccagcu

SEQ ID NO: 1318675 - RNA, 19 nt, Homo sapiens
aucagcucuugaugccuuu

SEQ ID NO: 1318676 - RNA, 21 nt, Homo sapiens
aucagcuggcgucaugcaaag

SEQ ID NO: 1318677 - RNA, 16 nt, Homo sapiens
aucagcuuaggggcug

SEQ ID NO: 1318678 - RNA, 23 nt, Homo sapiens
aucaggaaauuuggggcagauuu

SEQ ID NO: 1318679 - RNA, 13 nt, Homo sapiens
aucaggacgagaa

SEQ ID NO: 1318680 - RNA, 18 nt, Homo sapiens
aucaguccauugcucuug

SEQ ID NO: 1318681 - RNA, 16 nt, Homo sapiens
aucaguguaccauuug

SEQ ID NO: 1318682 - RNA, 14 nt, Homo sapiens
aucaguuacucuga

SEQ ID NO: 1318683 - RNA, 22 nt, Homo sapiens
aucaucagagccuuuccucaaa

SEQ ID NO: 1318684 - RNA, 14 nt, Homo sapiens
aucaucauucucau

SEQ ID NO: 1318685 - RNA, 19 nt, Homo sapiens
aucauccacugugccaugu

SEQ ID NO: 1318686 - RNA, 17 nt, Homo sapiens
aucaugccauugcacuc

SEQ ID NO: 1318687 - RNA, 20 nt, Homo sapiens
aucaugccccuguacuccag

SEQ ID NO: 1318688 - RNA, 22 nt, Homo sapiens
aucauuaaggucauuacucuca

SEQ ID NO: 1318689 - RNA, 19 nt, Homo sapiens
aucauugcaggagccauau

SEQ ID NO: 1318690 - RNA, 15 nt, Homo sapiens
auccaauaccucuug

SEQ ID NO: 1318691 - RNA, 18 nt, Homo sapiens
auccaauccuagcccuca

SEQ ID NO: 1318692 - RNA, 15 nt, Homo sapiens
auccacugugccaug

SEQ ID NO: 1318693 - RNA, 15 nt, Homo sapiens
auccagacccggcug

SEQ ID NO: 1318694 - RNA, 15 nt, Homo sapiens
auccagcaaccuaua

SEQ ID NO: 1318695 - RNA, 15 nt, Homo sapiens
auccagcugggcuag

SEQ ID NO: 1318696 - RNA, 14 nt, Homo sapiens
auccaggaggcaga

SEQ ID NO: 1318697 - RNA, 15 nt, Homo sapiens
auccaggcagaucca

SEQ ID NO: 1318698 - RNA, 16 nt, Homo sapiens
auccaggcagauccag

SEQ ID NO: 1318699 - RNA, 19 nt, Homo sapiens
auccagguaauccaagaua

SEQ ID NO: 1318700 - RNA, 13 nt, Homo sapiens
auccagugcugag

SEQ ID NO: 1318701 - RNA, 17 nt, Homo sapiens
auccauccagcuugcca

SEQ ID NO: 1318702 - RNA, 15 nt, Homo sapiens
auccaucgaagcaga

SEQ ID NO: 1318703 - RNA, 20 nt, Homo sapiens
auccaucugggcuaccccac

SEQ ID NO: 1318704 - RNA, 17 nt, Homo sapiens
auccaugcaccuaccuu

SEQ ID NO: 1318705 - RNA, 19 nt, Homo sapiens
auccaugcaccuaccuuag

SEQ ID NO: 1318706 - RNA, 20 nt, Homo sapiens
auccaugcaccuaccuuaga

SEQ ID NO: 1318707 - RNA, 20 nt, Homo sapiens
auccauuugcguuccaugau

SEQ ID NO: 1318708 - RNA, 15 nt, Homo sapiens
aucccaaacugugau

SEQ ID NO: 1318709 - RNA, 18 nt, Homo sapiens
aucccaaacugugaugaa

SEQ ID NO: 1318710 - RNA, 16 nt, Homo sapiens
aucccagcuaccucaa

SEQ ID NO: 1318711 - RNA, 15 nt, Homo sapiens
aucccaugagccuca

SEQ ID NO: 1318712 - RNA, 21 nt, Homo sapiens
aucccaugauguagugccucu

SEQ ID NO: 1318713 - RNA, 13 nt, Homo sapiens
aucccauggaaua

SEQ ID NO: 1318714 - RNA, 16 nt, Homo sapiens
auccccaggcaccuca

SEQ ID NO: 1318715 - RNA, 19 nt, Homo sapiens
auccccuccguggcaucac

SEQ ID NO: 1318716 - RNA, 22 nt, Homo sapiens
aucccgacucugauaccuucug

SEQ ID NO: 1318717 - RNA, 22 nt, Homo sapiens
aucccgggccucagugccccau

SEQ ID NO: 1318718 - RNA, 16 nt, Homo sapiens
aucccuuuccaaaggc

SEQ ID NO: 1318719 - RNA, 19 nt, Homo sapiens
auccgaaccuccucuguga

SEQ ID NO: 1318720 - RNA, 13 nt, Homo sapiens
auccuaacauuca

SEQ ID NO: 1318721 - RNA, 17 nt, Homo sapiens
auccuaacguuugucau

SEQ ID NO: 1318722 - RNA, 22 nt, Homo sapiens
auccuacuguaauaaagaugau

SEQ ID NO: 1318723 - RNA, 14 nt, Homo sapiens
auccuagcaaauuc

SEQ ID NO: 1318724 - RNA, 14 nt, Homo sapiens
auccuaggcauuug

SEQ ID NO: 1318725 - RNA, 15 nt, Homo sapiens
auccuaggcauuugc

SEQ ID NO: 1318726 - RNA, 15 nt, Homo sapiens
auccucacacuucag

SEQ ID NO: 1318727 - RNA, 13 nt, Homo sapiens
auccuccacugac

SEQ ID NO: 1318728 - RNA, 14 nt, Homo sapiens
auccucccaccuca

SEQ ID NO: 1318729 - RNA, 15 nt, Homo sapiens
auccucccaccucag

SEQ ID NO: 1318730 - RNA, 22 nt, Homo sapiens
auccuggguggucugcaggcag

SEQ ID NO: 1318731 - RNA, 15 nt, Homo sapiens
auccugugccuccau

SEQ ID NO: 1318732 - RNA, 16 nt, Homo sapiens
auccuuccacuaucau

SEQ ID NO: 1318733 - RNA, 23 nt, Homo sapiens
auccuugucaaaaugagauucca

SEQ ID NO: 1318734 - RNA, 17 nt, Homo sapiens
aucgcaguguucaaggc

SEQ ID NO: 1318735 - RNA, 23 nt, Homo sapiens
aucggaucuggggcucugggaua

SEQ ID NO: 1318736 - RNA, 20 nt, Homo sapiens
aucuaagaauacagcuuucu

SEQ ID NO: 1318737 - RNA, 23 nt, Homo sapiens
aucuaagauauuuugaacuaagc

SEQ ID NO: 1318738 - RNA, 14 nt, Homo sapiens
aucuaccaacgaaa

SEQ ID NO: 1318739 - RNA, 14 nt, Homo sapiens
aucuacuaauucca

SEQ ID NO: 1318740 - RNA, 16 nt, Homo sapiens
aucuacuaauuccaca

SEQ ID NO: 1318741 - RNA, 21 nt, Homo sapiens
aucuacuacaaacuucaaaga

SEQ ID NO: 1318742 - RNA, 20 nt, Homo sapiens
aucuaggagaagggucucau

SEQ ID NO: 1318743 - RNA, 17 nt, Homo sapiens
aucucaauugugcuuug

SEQ ID NO: 1318744 - RNA, 19 nt, Homo sapiens
aucucaauugugcuuugua

SEQ ID NO: 1318745 - RNA, 17 nt, Homo sapiens
aucucagagacaggugg

SEQ ID NO: 1318746 - RNA, 20 nt, Homo sapiens
aucucaggagcuugcaagaa

SEQ ID NO: 1318747 - RNA, 22 nt, Homo sapiens
aucucaggagcuugcaagaagc

SEQ ID NO: 1318748 - RNA, 15 nt, Homo sapiens
aucucauuacugcuu

SEQ ID NO: 1318749 - RNA, 20 nt, Homo sapiens
aucucauuggacccuuccau

SEQ ID NO: 1318750 - RNA, 23 nt, Homo sapiens
aucucauuggacccuuccauggu

SEQ ID NO: 1318751 - RNA, 14 nt, Homo sapiens
aucucccacacaag

SEQ ID NO: 1318752 - RNA, 18 nt, Homo sapiens
aucucggcucagugcaac

SEQ ID NO: 1318753 - RNA, 16 nt, Homo sapiens
aucucuuccuuuccaa

SEQ ID NO: 1318754 - RNA, 14 nt, Homo sapiens
aucucuucuggccg

SEQ ID NO: 1318755 - RNA, 13 nt, Homo sapiens
aucugcacagugg

SEQ ID NO: 1318756 - RNA, 14 nt, Homo sapiens
aucugcgugcacuu

SEQ ID NO: 1318757 - RNA, 19 nt, Homo sapiens
aucuggaacccagacucag

SEQ ID NO: 1318758 - RNA, 19 nt, Homo sapiens
cuccauacgcguucuaggc

SEQ ID NO: 1318759 - RNA, 23 nt, Homo sapiens
cuccaucaguuagagcugacaca

SEQ ID NO: 1318760 - RNA, 16 nt, Homo sapiens
cuccauguacuggcaa

SEQ ID NO: 1318761 - RNA, 19 nt, Homo sapiens
cucccaaagugcugggauu

SEQ ID NO: 1318762 - RNA, 13 nt, Homo sapiens
cucccacacaaga

SEQ ID NO: 1318763 - RNA, 21 nt, Homo sapiens
cucccacugggguccagggag

SEQ ID NO: 1318764 - RNA, 20 nt, Homo sapiens
cucccacugucugcccugaa

SEQ ID NO: 1318765 - RNA, 15 nt, Homo sapiens
cucccauaccuuuaa

SEQ ID NO: 1318766 - RNA, 17 nt, Homo sapiens
cucccauccuaaucauc

SEQ ID NO: 1318767 - RNA, 17 nt, Homo sapiens
cuccccaccaaccaaga

SEQ ID NO: 1318768 - RNA, 17 nt, Homo sapiens
cuccccagcccagagac

SEQ ID NO: 1318769 - RNA, 21 nt, Homo sapiens
cuccccagccuuugaucaggu

SEQ ID NO: 1318770 - RNA, 22 nt, Homo sapiens
cuccccauucacagagccuuuu

SEQ ID NO: 1318771 - RNA, 21 nt, Homo sapiens
cucccccaggccugagcugcu

SEQ ID NO: 1318772 - RNA, 15 nt, Homo sapiens
cuccccggcacuucc

SEQ ID NO: 1318773 - RNA, 18 nt, Homo sapiens
cuccccucagagugcaag

SEQ ID NO: 1318774 - RNA, 16 nt, Homo sapiens
cucccguggccuguag

SEQ ID NO: 1318775 - RNA, 16 nt, Homo sapiens
cucccugaagccuuug

SEQ ID NO: 1318776 - RNA, 21 nt, Homo sapiens
cucccugaucccgugugccac

SEQ ID NO: 1318777 - RNA, 23 nt, Homo sapiens
cucccuugggaagggcagggaau

SEQ ID NO: 1318778 - RNA, 15 nt, Homo sapiens
cuccgcaggacuucc

SEQ ID NO: 1318779 - RNA, 21 nt, Homo sapiens
cuccuagggccacugaagaua

SEQ ID NO: 1318780 - RNA, 24 nt, Homo sapiens
cuccuagggcuaugguguggacug

SEQ ID NO: 1318781 - RNA, 21 nt, Homo sapiens
cuccucaugcccccucaguga

SEQ ID NO: 1318782 - RNA, 22 nt, Homo sapiens
cuccucaugcccccucagugag

SEQ ID NO: 1318783 - RNA, 20 nt, Homo sapiens
cuccuccccaaggagacaca

SEQ ID NO: 1318784 - RNA, 20 nt, Homo sapiens
cuccuccugcccaccuguca

SEQ ID NO: 1318785 - RNA, 17 nt, Homo sapiens
cuccucguaugcaugga

SEQ ID NO: 1318786 - RNA, 16 nt, Homo sapiens
cuccucuccccagcaa

SEQ ID NO: 1318787 - RNA, 13 nt, Homo sapiens
cuccucuuacccc

SEQ ID NO: 1318788 - RNA, 19 nt, Homo sapiens
cuccugaagauagccagag

SEQ ID NO: 1318789 - RNA, 13 nt, Homo sapiens
cuccugacuuuua

SEQ ID NO: 1318790 - RNA, 23 nt, Homo sapiens
cuccugcgcccuucauugccaca

SEQ ID NO: 1318791 - RNA, 15 nt, Homo sapiens
cuccugcuggagcca

SEQ ID NO: 1318792 - RNA, 16 nt, Homo sapiens
cuccuggcccacugca

SEQ ID NO: 1318793 - RNA, 23 nt, Homo sapiens
cuccuggcuggggccuguugaag

SEQ ID NO: 1318794 - RNA, 18 nt, Homo sapiens
cuccugggcuaagugauc

SEQ ID NO: 1318795 - RNA, 21 nt, Homo sapiens
cuccuguggucucugaccagg

SEQ ID NO: 1318796 - RNA, 22 nt, Homo sapiens
cuccugugugauugacagcuuu

SEQ ID NO: 1318797 - RNA, 15 nt, Homo sapiens
cuccuucagacaccc

SEQ ID NO: 1318798 - RNA, 13 nt, Homo sapiens
cuccuuccagugu

SEQ ID NO: 1318799 - RNA, 23 nt, Homo sapiens
cuccuuccuggagcccagaggag

SEQ ID NO: 1318800 - RNA, 21 nt, Homo sapiens
cuccuuguuccuagaguagag

SEQ ID NO: 1318801 - RNA, 24 nt, Homo sapiens
cuccuuucaccacaugugcacaug

SEQ ID NO: 1318802 - RNA, 15 nt, Homo sapiens
cucgaaacacagaaa

SEQ ID NO: 1318803 - RNA, 16 nt, Homo sapiens
cucuaauacauuccaa

SEQ ID NO: 1318804 - RNA, 14 nt, Homo sapiens
cucuacaaaaagca

SEQ ID NO: 1318805 - RNA, 21 nt, Homo sapiens
cucuacccugugcuaagcacg

SEQ ID NO: 1318806 - RNA, 20 nt, Homo sapiens
cucuacuaaaaauacaaaaa

SEQ ID NO: 1318807 - RNA, 21 nt, Homo sapiens
cucuacucuagggaaaaacca

SEQ ID NO: 1318808 - RNA, 19 nt, Homo sapiens
cucuagaagugccaucuca

SEQ ID NO: 1318809 - RNA, 19 nt, Homo sapiens
cucuagacaacuaccccuu

SEQ ID NO: 1318810 - RNA, 16 nt, Homo sapiens
cucuaggucaguauua

SEQ ID NO: 1318811 - RNA, 19 nt, Homo sapiens
cucuauaaaaaauauguau

SEQ ID NO: 1318812 - RNA, 18 nt, Homo sapiens
cucuaugauaauuacaau

SEQ ID NO: 1318813 - RNA, 23 nt, Homo sapiens
cucuauguuuacaaauggacaua

SEQ ID NO: 1318814 - RNA, 15 nt, Homo sapiens
cucuauuccaaaaag

SEQ ID NO: 1318815 - RNA, 19 nt, Homo sapiens
cucuauugaccaccaguua

SEQ ID NO: 1318816 - RNA, 15 nt, Homo sapiens
cucuauuugagaaua

SEQ ID NO: 1318817 - RNA, 19 nt, Homo sapiens
cucucaugucuuugcugca

SEQ ID NO: 1318818 - RNA, 19 nt, Homo sapiens
cucuccccguggacccugu

SEQ ID NO: 1318819 - RNA, 23 nt, Homo sapiens
cucuccuguauuuaacaaaaagu

SEQ ID NO: 1318820 - RNA, 23 nt, Homo sapiens
cucucugguaccgagccccugaa

SEQ ID NO: 1318821 - RNA, 14 nt, Homo sapiens
cucucugucucucu

SEQ ID NO: 1318822 - RNA, 19 nt, Homo sapiens
cucucuuuaaaaugcaaaa

SEQ ID NO: 1318823 - RNA, 14 nt, Homo sapiens
cucugaaaccagug

SEQ ID NO: 1318824 - RNA, 17 nt, Homo sapiens
cucugaaaccaguguua

SEQ ID NO: 1318825 - RNA, 20 nt, Homo sapiens
cucugaaccccucccuccau

SEQ ID NO: 1318826 - RNA, 20 nt, Homo sapiens
cucugaaugaaccuucuggc

SEQ ID NO: 1318827 - RNA, 24 nt, Homo sapiens
cucugagagggaaaggucuguccu

SEQ ID NO: 1318828 - RNA, 15 nt, Homo sapiens
cucugagcugugcag

SEQ ID NO: 1318829 - RNA, 21 nt, Homo sapiens
cucugagguuuccgaaaucag

SEQ ID NO: 1318830 - RNA, 23 nt, Homo sapiens
cucugaguaucuccucgcaagcu

SEQ ID NO: 1318831 - RNA, 12 nt, Homo sapiens
cucugauaccuc

SEQ ID NO: 1318832 - RNA, 13 nt, Homo sapiens
cucugaucccucu

SEQ ID NO: 1318833 - RNA, 17 nt, Homo sapiens
cucugcaaaccaacagg

SEQ ID NO: 1318834 - RNA, 22 nt, Homo sapiens
cucugcacaagcugcacccuca

SEQ ID NO: 1318835 - RNA, 20 nt, Homo sapiens
cucugcaggccuaggugcag

SEQ ID NO: 1318836 - RNA, 15 nt, Homo sapiens
cucugcccgcuuuga

SEQ ID NO: 1318837 - RNA, 19 nt, Homo sapiens
cucugcccuuacacccaug

SEQ ID NO: 1318838 - RNA, 20 nt, Homo sapiens
cucuggacaggcauguucuc

SEQ ID NO: 1318839 - RNA, 15 nt, Homo sapiens
cucuggcgacaguuu

SEQ ID NO: 1318840 - RNA, 15 nt, Homo sapiens
cucugggaagugugg

SEQ ID NO: 1318841 - RNA, 17 nt, Homo sapiens
cucugggcucaagcaau

SEQ ID NO: 1318842 - RNA, 16 nt, Homo sapiens
cucugucucucugucu

SEQ ID NO: 1318843 - RNA, 16 nt, Homo sapiens
cucuuagaaaaaccac

SEQ ID NO: 1318844 - RNA, 13 nt, Homo sapiens
cucuucacagucc

SEQ ID NO: 1318845 - RNA, 21 nt, Homo sapiens
cucuucccauaccacccaaug

SEQ ID NO: 1318846 - RNA, 22 nt, Homo sapiens
cucuuccgacucuuucugagug

SEQ ID NO: 1318847 - RNA, 15 nt, Homo sapiens
cucuuccuccaggga

SEQ ID NO: 1318848 - RNA, 20 nt, Homo sapiens
cucuuccuugaccugcauug

SEQ ID NO: 1318849 - RNA, 15 nt, Homo sapiens
cucuucucauuucac

SEQ ID NO: 1318850 - RNA, 23 nt, Homo sapiens
cucuucuccaccucccacaaagg

SEQ ID NO: 1318851 - RNA, 15 nt, Homo sapiens
cucuuggccugauca

SEQ ID NO: 1318852 - RNA, 19 nt, Homo sapiens
cucuuggcuccacugggau

SEQ ID NO: 1318853 - RNA, 21 nt, Homo sapiens
cucuugggaacugaacucacu

SEQ ID NO: 1318854 - RNA, 18 nt, Homo sapiens
cucuuguauaugaugauc

SEQ ID NO: 1318855 - RNA, 23 nt, Homo sapiens
cucuuguauuaaacucuucacaa

SEQ ID NO: 1318856 - RNA, 20 nt, Homo sapiens
cucuuuccuccuuccaugga

SEQ ID NO: 1318857 - RNA, 14 nt, Homo sapiens
cugaaacccaauga

SEQ ID NO: 1318858 - RNA, 24 nt, Homo sapiens
cugaaaucugucaagaguaguuau

SEQ ID NO: 1318859 - RNA, 17 nt, Homo sapiens
cugaaauggaauuccca

SEQ ID NO: 1318860 - RNA, 20 nt, Homo sapiens
cugaaauggaauucccaugc

SEQ ID NO: 1318861 - RNA, 22 nt, Homo sapiens
cugaacagaagcucuuacucuu

SEQ ID NO: 1318862 - RNA, 12 nt, Homo sapiens
cugaacugcugu

SEQ ID NO: 1318863 - RNA, 23 nt, Homo sapiens
cugaacuguggggugugcacauc

SEQ ID NO: 1318864 - RNA, 18 nt, Homo sapiens
cugaagaaauugguccca

SEQ ID NO: 1318865 - RNA, 20 nt, Homo sapiens
cugaagaacaguaacugcca

SEQ ID NO: 1318866 - RNA, 17 nt, Homo sapiens
cugaagauagccagaga

SEQ ID NO: 1318867 - RNA, 15 nt, Homo sapiens
cugaagcuguucuca

SEQ ID NO: 1318868 - RNA, 12 nt, Homo sapiens
cugaaggcuaaa

SEQ ID NO: 1318869 - RNA, 18 nt, Homo sapiens
cugaaggcuaaaaagcaa

SEQ ID NO: 1318870 - RNA, 14 nt, Homo sapiens
cugaaggggaaccc

SEQ ID NO: 1318871 - RNA, 21 nt, Homo sapiens
cugaagucaccucuugguuac

SEQ ID NO: 1318872 - RNA, 23 nt, Homo sapiens
cugaauagcagaagguugcaccu

SEQ ID NO: 1318873 - RNA, 14 nt, Homo sapiens
cugaaucaugagcc

SEQ ID NO: 1318874 - RNA, 15 nt, Homo sapiens
cugaauggcaaugaa

SEQ ID NO: 1318875 - RNA, 20 nt, Homo sapiens
cugaauuuuggggauuuuca

SEQ ID NO: 1318876 - RNA, 21 nt, Homo sapiens
cugaauuuuggggauuuucaa

SEQ ID NO: 1318877 - RNA, 22 nt, Homo sapiens
cugacaaggccagcacccaaag

SEQ ID NO: 1318878 - RNA, 18 nt, Homo sapiens
cugacacacagcucuguc

SEQ ID NO: 1318879 - RNA, 14 nt, Homo sapiens
cugacaccuuucau

SEQ ID NO: 1318880 - RNA, 19 nt, Homo sapiens
cugaccacagcacagccaa

SEQ ID NO: 1318881 - RNA, 20 nt, Homo sapiens
cugaccagccgugagcaugu

SEQ ID NO: 1318882 - RNA, 17 nt, Homo sapiens
cugacccagugccccca

SEQ ID NO: 1318883 - RNA, 14 nt, Homo sapiens
cugaccugguccac

SEQ ID NO: 1318884 - RNA, 18 nt, Homo sapiens
cugacguagcugcaaagg

SEQ ID NO: 1318885 - RNA, 15 nt, Homo sapiens
cugacuccacucaaa

SEQ ID NO: 1318886 - RNA, 12 nt, Homo sapiens
cugacuguaaau

SEQ ID NO: 1318887 - RNA, 23 nt, Homo sapiens
cugacuuauguaaucaaagccac

SEQ ID NO: 1318888 - RNA, 19 nt, Homo sapiens
cugagaaacccaccagccu

SEQ ID NO: 1318889 - RNA, 16 nt, Homo sapiens
cugagaacacugugaa

SEQ ID NO: 1318890 - RNA, 18 nt, Homo sapiens
ccucccugccuccaggaa

SEQ ID NO: 1318891 - RNA, 19 nt, Homo sapiens
ccucccuguuccccagaga

SEQ ID NO: 1318892 - RNA, 16 nt, Homo sapiens
ccuccucaggcacaca

SEQ ID NO: 1318893 - RNA, 15 nt, Homo sapiens
ccuccucaguaugug

SEQ ID NO: 1318894 - RNA, 17 nt, Homo sapiens
ccuccuccccuagggaa

SEQ ID NO: 1318895 - RNA, 18 nt, Homo sapiens
ccuccugaagccacagca

SEQ ID NO: 1318896 - RNA, 19 nt, Homo sapiens
ccuccuggagcucuguggg

SEQ ID NO: 1318897 - RNA, 18 nt, Homo sapiens
ccuccuuagaccugaggg

SEQ ID NO: 1318898 - RNA, 16 nt, Homo sapiens
ccuccuucaauuccau

SEQ ID NO: 1318899 - RNA, 24 nt, Homo sapiens
ccuccuucauaugaaaggugccau

SEQ ID NO: 1318900 - RNA, 14 nt, Homo sapiens
ccucgcugccagcu

SEQ ID NO: 1318901 - RNA, 21 nt, Homo sapiens
ccucgcuuggacggcugggca

SEQ ID NO: 1318902 - RNA, 14 nt, Homo sapiens
ccucguaugcaugg

SEQ ID NO: 1318903 - RNA, 22 nt, Homo sapiens
ccucucagauucuuaucuggca

SEQ ID NO: 1318904 - RNA, 20 nt, Homo sapiens
ccucucauuucccuuugaua

SEQ ID NO: 1318905 - RNA, 15 nt, Homo sapiens
ccucuccaacugccu

SEQ ID NO: 1318906 - RNA, 21 nt, Homo sapiens
ccucugaaacagcugccuuag

SEQ ID NO: 1318907 - RNA, 17 nt, Homo sapiens
ccucugagccaucccag

SEQ ID NO: 1318908 - RNA, 11 nt, Homo sapiens
ccucugcauuu

SEQ ID NO: 1318909 - RNA, 20 nt, Homo sapiens
ccucugucagucacagccac

SEQ ID NO: 1318910 - RNA, 22 nt, Homo sapiens
ccucugugccccucaugcugau

SEQ ID NO: 1318911 - RNA, 15 nt, Homo sapiens
ccucuguguucagga

SEQ ID NO: 1318912 - RNA, 15 nt, Homo sapiens
ccucuuggcucugag

SEQ ID NO: 1318913 - RNA, 13 nt, Homo sapiens
ccucuuucaucca

SEQ ID NO: 1318914 - RNA, 11 nt, Homo sapiens
ccucuuuggag

SEQ ID NO: 1318915 - RNA, 19 nt, Homo sapiens
ccucuuugucuaaaacaau

SEQ ID NO: 1318916 - RNA, 14 nt, Homo sapiens
ccugaaagccacag

SEQ ID NO: 1318917 - RNA, 18 nt, Homo sapiens
ccugaaagccacagacaa

SEQ ID NO: 1318918 - RNA, 21 nt, Homo sapiens
ccugaacuauaacaccugcca

SEQ ID NO: 1318919 - RNA, 20 nt, Homo sapiens
ccugacaggcugugacucuu

SEQ ID NO: 1318920 - RNA, 22 nt, Homo sapiens
ccugacagugugggacaggcuc

SEQ ID NO: 1318921 - RNA, 16 nt, Homo sapiens
ccugacggugggccug

SEQ ID NO: 1318922 - RNA, 20 nt, Homo sapiens
ccugagguuugccagcauuu

SEQ ID NO: 1318923 - RNA, 21 nt, Homo sapiens
ccugaucagagccgugguccu

SEQ ID NO: 1318924 - RNA, 13 nt, Homo sapiens
ccugaugagauuu

SEQ ID NO: 1318925 - RNA, 14 nt, Homo sapiens
ccugcaaacgcugc

SEQ ID NO: 1318926 - RNA, 21 nt, Homo sapiens
ccugcaccccugcaguuugag

SEQ ID NO: 1318927 - RNA, 15 nt, Homo sapiens
ccugcagaagcagaa

SEQ ID NO: 1318928 - RNA, 16 nt, Homo sapiens
ccugcaggacuugcca

SEQ ID NO: 1318929 - RNA, 17 nt, Homo sapiens
ccugcaggacuugccac

SEQ ID NO: 1318930 - RNA, 21 nt, Homo sapiens
ccugcaguuauuaacacuaac

SEQ ID NO: 1318931 - RNA, 21 nt, Homo sapiens
ccugcauuguaaauagguucu

SEQ ID NO: 1318932 - RNA, 19 nt, Homo sapiens
ccugcccuugucccacuca

SEQ ID NO: 1318933 - RNA, 18 nt, Homo sapiens
ccugcuuuggcagugcca

SEQ ID NO: 1318934 - RNA, 18 nt, Homo sapiens
ccuggagcaaucacagau

SEQ ID NO: 1318935 - RNA, 23 nt, Homo sapiens
ccuggaguguaugacugcacaug

SEQ ID NO: 1318936 - RNA, 22 nt, Homo sapiens
ccuggcaaggacacagaugaaa

SEQ ID NO: 1318937 - RNA, 20 nt, Homo sapiens
ccuggcacuggaugcagaaa

SEQ ID NO: 1318938 - RNA, 17 nt, Homo sapiens
ccuggcccgggccuaug

SEQ ID NO: 1318939 - RNA, 15 nt, Homo sapiens
ccuggccgaguccaa

SEQ ID NO: 1318940 - RNA, 17 nt, Homo sapiens
ccuggccgccuccagga

SEQ ID NO: 1318941 - RNA, 23 nt, Homo sapiens
ccuggccggcuccaguuucccca

SEQ ID NO: 1318942 - RNA, 17 nt, Homo sapiens
ccugggcaauuccgcau

SEQ ID NO: 1318943 - RNA, 17 nt, Homo sapiens
ccugggguaccaagaga

SEQ ID NO: 1318944 - RNA, 20 nt, Homo sapiens
ccugguauuuucaaccauaa

SEQ ID NO: 1318945 - RNA, 22 nt, Homo sapiens
ccuggucagugguggucuucaa

SEQ ID NO: 1318946 - RNA, 13 nt, Homo sapiens
ccuggugcugcug

SEQ ID NO: 1318947 - RNA, 18 nt, Homo sapiens
ccuguaaucccagcauuu

SEQ ID NO: 1318948 - RNA, 15 nt, Homo sapiens
ccuguaaucccagcu

SEQ ID NO: 1318949 - RNA, 18 nt, Homo sapiens
ccuguaauccuagcacuu

SEQ ID NO: 1318950 - RNA, 19 nt, Homo sapiens
ccuguaauccuagcacuuu

SEQ ID NO: 1318951 - RNA, 18 nt, Homo sapiens
ccuguaguugacaauucu

SEQ ID NO: 1318952 - RNA, 21 nt, Homo sapiens
ccugucaaacaaagccagaag

SEQ ID NO: 1318953 - RNA, 22 nt, Homo sapiens
ccugucauucuagaaacaggaa

SEQ ID NO: 1318954 - RNA, 16 nt, Homo sapiens
ccuguccugccaugca

SEQ ID NO: 1318955 - RNA, 23 nt, Homo sapiens
ccugugaaauauucuuaggcaga

SEQ ID NO: 1318956 - RNA, 16 nt, Homo sapiens
ccugugcccaccaguu

SEQ ID NO: 1318957 - RNA, 12 nt, Homo sapiens
ccugugccucca

SEQ ID NO: 1318958 - RNA, 20 nt, Homo sapiens
ccuguguguccaaaacugcc

SEQ ID NO: 1318959 - RNA, 15 nt, Homo sapiens
ccuguuagacguccu

SEQ ID NO: 1318960 - RNA, 22 nt, Homo sapiens
ccuguuaucuguguuugcugag

SEQ ID NO: 1318961 - RNA, 12 nt, Homo sapiens
ccuguuccagaa

SEQ ID NO: 1318962 - RNA, 23 nt, Homo sapiens
ccuguuccccagagaaaggggag

SEQ ID NO: 1318963 - RNA, 20 nt, Homo sapiens
ccuguuccuggaggucagca

SEQ ID NO: 1318964 - RNA, 14 nt, Homo sapiens
ccuguucuuucuua

SEQ ID NO: 1318965 - RNA, 17 nt, Homo sapiens
cucacauaucugucauu

SEQ ID NO: 1318966 - RNA, 12 nt, Homo sapiens
cucacaucuugg

SEQ ID NO: 1318967 - RNA, 18 nt, Homo sapiens
cucaccaaaugagaagaa

SEQ ID NO: 1318968 - RNA, 18 nt, Homo sapiens
cucaccuacccaugaccu

SEQ ID NO: 1318969 - RNA, 15 nt, Homo sapiens
cucaccucuugccuu

SEQ ID NO: 1318970 - RNA, 19 nt, Homo sapiens
cucaccugucgcuuccuag

SEQ ID NO: 1318971 - RNA, 19 nt, Homo sapiens
cucaccuguuugaaaccaa

SEQ ID NO: 1318972 - RNA, 21 nt, Homo sapiens
cucacgccucuguguucagga

SEQ ID NO: 1318973 - RNA, 18 nt, Homo sapiens
cucacggaagggaugcua

SEQ ID NO: 1318974 - RNA, 14 nt, Homo sapiens
cucacucaccuuca

SEQ ID NO: 1318975 - RNA, 18 nt, Homo sapiens
cucacugaggguaucuga

SEQ ID NO: 1318976 - RNA, 19 nt, Homo sapiens
cucacuguguuacugcuuu

SEQ ID NO: 1318977 - RNA, 22 nt, Homo sapiens
cucagaagacacugaugggcaa

SEQ ID NO: 1318978 - RNA, 16 nt, Homo sapiens
cucagaauccaaagau

SEQ ID NO: 1318979 - RNA, 20 nt, Homo sapiens
cucagaauccaaagaucaca

SEQ ID NO: 1318980 - RNA, 12 nt, Homo sapiens
cucagaccagcu

SEQ ID NO: 1318981 - RNA, 22 nt, Homo sapiens
cucagagcuguccucaagaugg

SEQ ID NO: 1318982 - RNA, 12 nt, Homo sapiens
cucagaggccag

SEQ ID NO: 1318983 - RNA, 18 nt, Homo sapiens
cucagagugcaagccccu

SEQ ID NO: 1318984 - RNA, 23 nt, Homo sapiens
cucagauaagguaaaaugccaug

SEQ ID NO: 1318985 - RNA, 19 nt, Homo sapiens
cucagaugggcagcagcuu

SEQ ID NO: 1318986 - RNA, 18 nt, Homo sapiens
cucagccucccaaagugc

SEQ ID NO: 1318987 - RNA, 20 nt, Homo sapiens
cucagccucccgaguagcug

SEQ ID NO: 1318988 - RNA, 22 nt, Homo sapiens
cucagcuggaugauggucuuca

SEQ ID NO: 1318989 - RNA, 13 nt, Homo sapiens
cucagcuuaucuc

SEQ ID NO: 1318990 - RNA, 13 nt, Homo sapiens
cucaggacagaug

SEQ ID NO: 1318991 - RNA, 17 nt, Homo sapiens
cucaggagucucuggua

SEQ ID NO: 1318992 - RNA, 18 nt, Homo sapiens
cucaggcgggacagugcu

SEQ ID NO: 1318993 - RNA, 20 nt, Homo sapiens
cucaggguccagacccugaa

SEQ ID NO: 1318994 - RNA, 18 nt, Homo sapiens
cucagucauaaucauuag

SEQ ID NO: 1318995 - RNA, 11 nt, Homo sapiens
cucagugcaac

SEQ ID NO: 1318996 - RNA, 17 nt, Homo sapiens
cucaguguagggaucag

SEQ ID NO: 1318997 - RNA, 21 nt, Homo sapiens
cucaguguuuuggacuccauc

SEQ ID NO: 1318998 - RNA, 15 nt, Homo sapiens
cucaguucugccuua

SEQ ID NO: 1318999 - RNA, 22 nt, Homo sapiens
cucauaaguuggaccagaggaa

SEQ ID NO: 1319000 - RNA, 18 nt, Homo sapiens
cucauagguugagcaauu

SEQ ID NO: 1319001 - RNA, 18 nt, Homo sapiens
cucaucagaaacucaaaa

SEQ ID NO: 1319002 - RNA, 18 nt, Homo sapiens
cucaucaucagagccuuu

SEQ ID NO: 1319003 - RNA, 23 nt, Homo sapiens
cucauccagggcucugaccaguu

SEQ ID NO: 1319004 - RNA, 20 nt, Homo sapiens
cucaucugaggcauccagca

SEQ ID NO: 1319005 - RNA, 13 nt, Homo sapiens
cucaucugugauu

SEQ ID NO: 1319006 - RNA, 22 nt, Homo sapiens
cucaucuuagguuggcaaaaag

SEQ ID NO: 1319007 - RNA, 15 nt, Homo sapiens
cucaugcauaugcau

SEQ ID NO: 1319008 - RNA, 16 nt, Homo sapiens
cucaugcugaucuucu

SEQ ID NO: 1319009 - RNA, 16 nt, Homo sapiens
cucaugcuucacuuag

SEQ ID NO: 1319010 - RNA, 16 nt, Homo sapiens
cucaugggaaggggag

SEQ ID NO: 1319011 - RNA, 17 nt, Homo sapiens
cucaugguauguaacuc

SEQ ID NO: 1319012 - RNA, 16 nt, Homo sapiens
cucauuaaugacacuu

SEQ ID NO: 1319013 - RNA, 13 nt, Homo sapiens
cucauuacugcuu

SEQ ID NO: 1319014 - RNA, 15 nt, Homo sapiens
cucauuacugcuuca

SEQ ID NO: 1319015 - RNA, 20 nt, Homo sapiens
cucauuauucacaguaauua

SEQ ID NO: 1319016 - RNA, 14 nt, Homo sapiens
cucauucugucacc

SEQ ID NO: 1319017 - RNA, 20 nt, Homo sapiens
cucauuuacacucagcugcu

SEQ ID NO: 1319018 - RNA, 19 nt, Homo sapiens
cucauuuuagaaccaccaa

SEQ ID NO: 1319019 - RNA, 13 nt, Homo sapiens
cuccaacaccaag

SEQ ID NO: 1319020 - RNA, 17 nt, Homo sapiens
cuccaagccacugagca

SEQ ID NO: 1319021 - RNA, 12 nt, Homo sapiens
cuccaaggagca

SEQ ID NO: 1319022 - RNA, 23 nt, Homo sapiens
cuccaaggagcaugucacuccag

SEQ ID NO: 1319023 - RNA, 20 nt, Homo sapiens
cuccaagguagaauuugcaa

SEQ ID NO: 1319024 - RNA, 17 nt, Homo sapiens
cuccacucaguugcaac

SEQ ID NO: 1319025 - RNA, 18 nt, Homo sapiens
cuccacucaguugcaacu

SEQ ID NO: 1319026 - RNA, 17 nt, Homo sapiens
cuccagaccugauccug

SEQ ID NO: 1319027 - RNA, 19 nt, Homo sapiens
cuccagagggaauugcaga

SEQ ID NO: 1319028 - RNA, 22 nt, Homo sapiens
cuccagcuucccgaguaccagu

SEQ ID NO: 1319029 - RNA, 22 nt, Homo sapiens
cuccagcuugggcaacagggcg

SEQ ID NO: 1319030 - RNA, 19 nt, Homo sapiens
cuccaggagccuacccccu

SEQ ID NO: 1319031 - RNA, 16 nt, Homo sapiens
cuccaggagcugcaag

SEQ ID NO: 1319032 - RNA, 14 nt, Homo sapiens
cuccaggauuuccu

SEQ ID NO: 1319033 - RNA, 12 nt, Homo sapiens
cuccagugcagg

SEQ ID NO: 1319034 - RNA, 18 nt, Homo sapiens
auucugauaaugcucacu

SEQ ID NO: 1319035 - RNA, 23 nt, Homo sapiens
auucugcaguaaaucuuuuacaa

SEQ ID NO: 1319036 - RNA, 22 nt, Homo sapiens
auucugcauguacuaguccucu

SEQ ID NO: 1319037 - RNA, 17 nt, Homo sapiens
auucuuuauucuuuacu

SEQ ID NO: 1319038 - RNA, 20 nt, Homo sapiens
auucuuucccaauucacauc

SEQ ID NO: 1319039 - RNA, 19 nt, Homo sapiens
auucuuugcgguauucuug

SEQ ID NO: 1319040 - RNA, 17 nt, Homo sapiens
auugaaaggcauucucu

SEQ ID NO: 1319041 - RNA, 15 nt, Homo sapiens
auugaacacaaacug

SEQ ID NO: 1319042 - RNA, 22 nt, Homo sapiens
auugaagagggccaaacacuga

SEQ ID NO: 1319043 - RNA, 13 nt, Homo sapiens
auugaaguguucu

SEQ ID NO: 1319044 - RNA, 22 nt, Homo sapiens
auugaccgcgacuaauuucaaa

SEQ ID NO: 1319045 - RNA, 14 nt, Homo sapiens
auugagagugauuc

SEQ ID NO: 1319046 - RNA, 17 nt, Homo sapiens
auugauuuuaaccaaug

SEQ ID NO: 1319047 - RNA, 17 nt, Homo sapiens
auugcagaccugucacc

SEQ ID NO: 1319048 - RNA, 20 nt, Homo sapiens
auugccuuuagugaucacag

SEQ ID NO: 1319049 - RNA, 23 nt, Homo sapiens
auugcugcaccaaugcacugagu

SEQ ID NO: 1319050 - RNA, 22 nt, Homo sapiens
auuggaggugaacaagcaaacc

SEQ ID NO: 1319051 - RNA, 17 nt, Homo sapiens
auuggcaaauacuaucu

SEQ ID NO: 1319052 - RNA, 20 nt, Homo sapiens
auuggcaccuaauccaggca

SEQ ID NO: 1319053 - RNA, 20 nt, Homo sapiens
auuggccggcuaguguuucc

SEQ ID NO: 1319054 - RNA, 23 nt, Homo sapiens
auugggaaaugaaaaaaaaaugg

SEQ ID NO: 1319055 - RNA, 17 nt, Homo sapiens
auugguaugaugcugcc

SEQ ID NO: 1319056 - RNA, 15 nt, Homo sapiens
auuggucuccucuca

SEQ ID NO: 1319057 - RNA, 16 nt, Homo sapiens
auugguguacuguaau

SEQ ID NO: 1319058 - RNA, 22 nt, Homo sapiens
auugguucccccugaccacuuu

SEQ ID NO: 1319059 - RNA, 16 nt, Homo sapiens
auuguacuaaagccaa

SEQ ID NO: 1319060 - RNA, 21 nt, Homo sapiens
auuguaggcucccccuccucu

SEQ ID NO: 1319061 - RNA, 14 nt, Homo sapiens
auuguaguguucaa

SEQ ID NO: 1319062 - RNA, 13 nt, Homo sapiens
auuguaugguggg

SEQ ID NO: 1319063 - RNA, 15 nt, Homo sapiens
auugucccucugccc

SEQ ID NO: 1319064 - RNA, 15 nt, Homo sapiens
auugugagccaccac

SEQ ID NO: 1319065 - RNA, 23 nt, Homo sapiens
auugugccgagaaaagcauuuua

SEQ ID NO: 1319066 - RNA, 20 nt, Homo sapiens
auugugcuuuguaucaguca

SEQ ID NO: 1319067 - RNA, 12 nt, Homo sapiens
auuguggcugca

SEQ ID NO: 1319068 - RNA, 15 nt, Homo sapiens
auuguugauggcuuu

SEQ ID NO: 1319069 - RNA, 17 nt, Homo sapiens
auuguugucaggccaua

SEQ ID NO: 1319070 - RNA, 11 nt, Homo sapiens
auuguuuacag

SEQ ID NO: 1319071 - RNA, 18 nt, Homo sapiens
auuuaaaagcagagcauu

SEQ ID NO: 1319072 - RNA, 12 nt, Homo sapiens
auuuaaagcaua

SEQ ID NO: 1319073 - RNA, 18 nt, Homo sapiens
auuuaaaucuuacagauc

SEQ ID NO: 1319074 - RNA, 13 nt, Homo sapiens
auuuaaguuaaau

SEQ ID NO: 1319075 - RNA, 18 nt, Homo sapiens
auuuaauaaagcacaaaa

SEQ ID NO: 1319076 - RNA, 13 nt, Homo sapiens
auuuaaugucauu

SEQ ID NO: 1319077 - RNA, 18 nt, Homo sapiens
auuuacacauauccacaa

SEQ ID NO: 1319078 - RNA, 19 nt, Homo sapiens
auuuaggagaagccaggaa

SEQ ID NO: 1319079 - RNA, 23 nt, Homo sapiens
auuuauccaaaauguguauuucu

SEQ ID NO: 1319080 - RNA, 14 nt, Homo sapiens
auuuaucugugcaa

SEQ ID NO: 1319081 - RNA, 19 nt, Homo sapiens
auuuaucugugcaaauccu

SEQ ID NO: 1319082 - RNA, 21 nt, Homo sapiens
auuuaugagaaauauuugaag

SEQ ID NO: 1319083 - RNA, 14 nt, Homo sapiens
auuuauuaccucug

SEQ ID NO: 1319084 - RNA, 17 nt, Homo sapiens
auuuauuaccucugaua

SEQ ID NO: 1319085 - RNA, 13 nt, Homo sapiens
auuuauucugcuc

SEQ ID NO: 1319086 - RNA, 12 nt, Homo sapiens
auuuauugccuc

SEQ ID NO: 1319087 - RNA, 16 nt, Homo sapiens
auuuauuuacaacuca

SEQ ID NO: 1319088 - RNA, 20 nt, Homo sapiens
auuuauuuacaacucaaaaa

SEQ ID NO: 1319089 - RNA, 22 nt, Homo sapiens
auuucaaaagauuguguuccca

SEQ ID NO: 1319090 - RNA, 22 nt, Homo sapiens
auuucaaauuguuuucagugaa

SEQ ID NO: 1319091 - RNA, 13 nt, Homo sapiens
auuucaaguuuac

SEQ ID NO: 1319092 - RNA, 13 nt, Homo sapiens
auuucacaagcua

SEQ ID NO: 1319093 - RNA, 15 nt, Homo sapiens
auuucacaagcuauu

SEQ ID NO: 1319094 - RNA, 10 nt, Homo sapiens
auuucaggga

SEQ ID NO: 1319095 - RNA, 23 nt, Homo sapiens
auuucagguuuuguaaagaugcc

SEQ ID NO: 1319096 - RNA, 12 nt, Homo sapiens
auuucaucucuu

SEQ ID NO: 1319097 - RNA, 23 nt, Homo sapiens
auuuccaagcacuuucaguccaa

SEQ ID NO: 1319098 - RNA, 14 nt, Homo sapiens
auuuccacaccaag

SEQ ID NO: 1319099 - RNA, 21 nt, Homo sapiens
auuuccagucuccaccaggaa

SEQ ID NO: 1319100 - RNA, 12 nt, Homo sapiens
auuucccaggac

SEQ ID NO: 1319101 - RNA, 19 nt, Homo sapiens
auuucccaggacccugaag

SEQ ID NO: 1319102 - RNA, 15 nt, Homo sapiens
auuucgcacaaugca

SEQ ID NO: 1319103 - RNA, 16 nt, Homo sapiens
auuucuaaaguuguag

SEQ ID NO: 1319104 - RNA, 18 nt, Homo sapiens
auuucuagaggaacuuuu

SEQ ID NO: 1319105 - RNA, 14 nt, Homo sapiens
auuucucagaacaa

SEQ ID NO: 1319106 - RNA, 16 nt, Homo sapiens
auuucuccuccauggg

SEQ ID NO: 1319107 - RNA, 15 nt, Homo sapiens
auuucugucuacuaa

SEQ ID NO: 1319108 - RNA, 15 nt, Homo sapiens
auuucuucuacugcu

SEQ ID NO: 1319109 - RNA, 13 nt, Homo sapiens
auuucuugauuaa

SEQ ID NO: 1319110 - RNA, 18 nt, Homo sapiens
auuugacauacaaaaagg

SEQ ID NO: 1319111 - RNA, 20 nt, Homo sapiens
auuugacuucagccagguga

SEQ ID NO: 1319112 - RNA, 16 nt, Homo sapiens
auuugcaaaguacugu

SEQ ID NO: 1319113 - RNA, 13 nt, Homo sapiens
auuugcauuucag

SEQ ID NO: 1319114 - RNA, 18 nt, Homo sapiens
auuugcauuucagaauau

SEQ ID NO: 1319115 - RNA, 20 nt, Homo sapiens
auuugcgacucacccacaau

SEQ ID NO: 1319116 - RNA, 13 nt, Homo sapiens
auuugcuggaaca

SEQ ID NO: 1319117 - RNA, 20 nt, Homo sapiens
auuuggaaggcaaagacauu

SEQ ID NO: 1319118 - RNA, 20 nt, Homo sapiens
auuugggccugcuccagacc

SEQ ID NO: 1319119 - RNA, 21 nt, Homo sapiens
auuuguaaaacauuccaaaua

SEQ ID NO: 1319120 - RNA, 15 nt, Homo sapiens
auuuguagcaauuua

SEQ ID NO: 1319121 - RNA, 16 nt, Homo sapiens
auuuguagcaauuuaa

SEQ ID NO: 1319122 - RNA, 14 nt, Homo sapiens
auuugucaauuuau

SEQ ID NO: 1319123 - RNA, 15 nt, Homo sapiens
auuugugccacuuua

SEQ ID NO: 1319124 - RNA, 22 nt, Homo sapiens
auuuguggugauauagaauuag

SEQ ID NO: 1319125 - RNA, 12 nt, Homo sapiens
auuugugucauu

SEQ ID NO: 1319126 - RNA, 14 nt, Homo sapiens
auuuuaaaaacaua

SEQ ID NO: 1319127 - RNA, 21 nt, Homo sapiens
auuuuaagaauuucacaagcu

SEQ ID NO: 1319128 - RNA, 13 nt, Homo sapiens
auuuuaauuugua

SEQ ID NO: 1319129 - RNA, 12 nt, Homo sapiens
auuuuaccuguu

SEQ ID NO: 1319130 - RNA, 16 nt, Homo sapiens
auuuuagauuuuccag

SEQ ID NO: 1319131 - RNA, 17 nt, Homo sapiens
auuuuaggaugcagugu

SEQ ID NO: 1319132 - RNA, 21 nt, Homo sapiens
auuuuaguaagagauuccuga

SEQ ID NO: 1319133 - RNA, 18 nt, Homo sapiens
auuuuaguuauacuccuc

SEQ ID NO: 1319134 - RNA, 21 nt, Homo sapiens
auuuucagagugacacccaag

SEQ ID NO: 1319135 - RNA, 17 nt, Homo sapiens
auuuucgacuugacuuu

SEQ ID NO: 1319136 - RNA, 16 nt, Homo sapiens
auuuucuagauacaau

SEQ ID NO: 1319137 - RNA, 16 nt, Homo sapiens
auuuucuucucugcac

SEQ ID NO: 1319138 - RNA, 20 nt, Homo sapiens
auuuucuucucugcacuuau

SEQ ID NO: 1319139 - RNA, 21 nt, Homo sapiens
auuuugcggcauuaaagccau

SEQ ID NO: 1319140 - RNA, 16 nt, Homo sapiens
auuuugucccaucucu

SEQ ID NO: 1319141 - RNA, 18 nt, Homo sapiens
auuuugugaauacuaugu

SEQ ID NO: 1319142 - RNA, 19 nt, Homo sapiens
auuuugugguuccuucccu

SEQ ID NO: 1319143 - RNA, 18 nt, Homo sapiens
auuuuguucuaguuuuca

SEQ ID NO: 1319144 - RNA, 15 nt, Homo sapiens
auuuuuagaauuaaa

SEQ ID NO: 1319145 - RNA, 22 nt, Homo sapiens
auuuuuauaaaaaugagugcuu

SEQ ID NO: 1319146 - RNA, 15 nt, Homo sapiens
auuuuucuaguauau

SEQ ID NO: 1319147 - RNA, 20 nt, Homo sapiens
auuuuucuuagugugccaag

SEQ ID NO: 1319148 - RNA, 16 nt, Homo sapiens
auuuuuguacauguuc

SEQ ID NO: 1319149 - RNA, 19 nt, Homo sapiens
auuuuuguagagccagggu

SEQ ID NO: 1319150 - RNA, 14 nt, Homo sapiens
auuuuuucuugaca

SEQ ID NO: 1319151 - RNA, 15 nt, Homo sapiens
auuuuuugguacaaa

SEQ ID NO: 1319152 - RNA, 20 nt, Homo sapiens
auuuuuuuagaaagcauuug

SEQ ID NO: 1319153 - RNA, 15 nt, Homo sapiens
caaaaaaaucugcag

SEQ ID NO: 1319154 - RNA, 14 nt, Homo sapiens
caaaaaaauugugc

SEQ ID NO: 1319155 - RNA, 15 nt, Homo sapiens
caaaaaagcuguauu

SEQ ID NO: 1319156 - RNA, 20 nt, Homo sapiens
caaaaaaguccaauuuuaau

SEQ ID NO: 1319157 - RNA, 21 nt, Homo sapiens
caaaacaccagggacacauuu

SEQ ID NO: 1319158 - RNA, 12 nt, Homo sapiens
caaaaccagcug

SEQ ID NO: 1319159 - RNA, 15 nt, Homo sapiens
caaaacuacaugaga

SEQ ID NO: 1319160 - RNA, 12 nt, Homo sapiens
caaaacugccuc

SEQ ID NO: 1319161 - RNA, 18 nt, Homo sapiens
caaaagauuguguuccca

SEQ ID NO: 1319162 - RNA, 20 nt, Homo sapiens
caaaagcugcucagggaaaa

SEQ ID NO: 1319163 - RNA, 18 nt, Homo sapiens
caaaaggauaaugaauac

SEQ ID NO: 1319164 - RNA, 17 nt, Homo sapiens
caaaauaaagugacaga

SEQ ID NO: 1319165 - RNA, 24 nt, Homo sapiens
caaaauaagucccgcauauacuuu

SEQ ID NO: 1319166 - RNA, 18 nt, Homo sapiens
caaaauagacaauuugca

SEQ ID NO: 1319167 - RNA, 17 nt, Homo sapiens
caaaaucugucacuaca

SEQ ID NO: 1319168 - RNA, 17 nt, Homo sapiens
caaaauggauacauaaa

SEQ ID NO: 1319169 - RNA, 22 nt, Homo sapiens
auggucacaagcacaaagcuca

SEQ ID NO: 1319170 - RNA, 20 nt, Homo sapiens
augguccugcagaagcagaa

SEQ ID NO: 1319171 - RNA, 21 nt, Homo sapiens
auggucuuaaggaacaucucu

SEQ ID NO: 1319172 - RNA, 19 nt, Homo sapiens
auggugaaacccugucucu

SEQ ID NO: 1319173 - RNA, 17 nt, Homo sapiens
auggugagcucugggaa

SEQ ID NO: 1319174 - RNA, 20 nt, Homo sapiens
augguggcgggcaccuguaa

SEQ ID NO: 1319175 - RNA, 22 nt, Homo sapiens
augguguggacugaaugggauc

SEQ ID NO: 1319176 - RNA, 14 nt, Homo sapiens
acaaaaugauggca

SEQ ID NO: 1319177 - RNA, 13 nt, Homo sapiens
acaaacucaccau

SEQ ID NO: 1319178 - RNA, 18 nt, Homo sapiens
acaaacuucaaagaggaa

SEQ ID NO: 1319179 - RNA, 21 nt, Homo sapiens
acaaagauuugcaacauuaga

SEQ ID NO: 1319180 - RNA, 20 nt, Homo sapiens
acaaagguuccauucagugc

SEQ ID NO: 1319181 - RNA, 17 nt, Homo sapiens
acaaaguguguauuaaa

SEQ ID NO: 1319182 - RNA, 17 nt, Homo sapiens
acaaauauaaaauuaaa

SEQ ID NO: 1319183 - RNA, 12 nt, Homo sapiens
acaaauaugcaa

SEQ ID NO: 1319184 - RNA, 17 nt, Homo sapiens
acaaaugguuaccuugu

SEQ ID NO: 1319185 - RNA, 23 nt, Homo sapiens
acaaauugcacagaaguccugua

SEQ ID NO: 1319186 - RNA, 13 nt, Homo sapiens
acaacacugggaa

SEQ ID NO: 1319187 - RNA, 13 nt, Homo sapiens
acaacagugcauu

SEQ ID NO: 1319188 - RNA, 17 nt, Homo sapiens
acaacauagcaaauuaa

SEQ ID NO: 1319189 - RNA, 22 nt, Homo sapiens
acaacccucuccuguuuacuga

SEQ ID NO: 1319190 - RNA, 17 nt, Homo sapiens
acaacucagucccuaaa

SEQ ID NO: 1319191 - RNA, 18 nt, Homo sapiens
acaagaucuguaauguua

SEQ ID NO: 1319192 - RNA, 17 nt, Homo sapiens
acaagauuaaauuccuu

SEQ ID NO: 1319193 - RNA, 12 nt, Homo sapiens
acaagauuuaug

SEQ ID NO: 1319194 - RNA, 13 nt, Homo sapiens
acaagccaagaaa

SEQ ID NO: 1319195 - RNA, 15 nt, Homo sapiens
acaagccagccaacu

SEQ ID NO: 1319196 - RNA, 17 nt, Homo sapiens
acaagcuauucccucaa

SEQ ID NO: 1319197 - RNA, 16 nt, Homo sapiens
acaagcugcacccuca

SEQ ID NO: 1319198 - RNA, 20 nt, Homo sapiens
acaaggaaaaauacugaauu

SEQ ID NO: 1319199 - RNA, 20 nt, Homo sapiens
acaagguggugcuucugcca

SEQ ID NO: 1319200 - RNA, 13 nt, Homo sapiens
acaauaaauacag

SEQ ID NO: 1319201 - RNA, 19 nt, Homo sapiens
acaauaacgauaaaagaca

SEQ ID NO: 1319202 - RNA, 13 nt, Homo sapiens
acaauagucaaaa

SEQ ID NO: 1319203 - RNA, 13 nt, Homo sapiens
acaauaugugcca

SEQ ID NO: 1319204 - RNA, 15 nt, Homo sapiens
acaauauucaaucaa

SEQ ID NO: 1319205 - RNA, 16 nt, Homo sapiens
acaauauugacuuugu

SEQ ID NO: 1319206 - RNA, 14 nt, Homo sapiens
acaaucacugccaa

SEQ ID NO: 1319207 - RNA, 19 nt, Homo sapiens
acaaucaugaaauaugcau

SEQ ID NO: 1319208 - RNA, 12 nt, Homo sapiens
acaaucauguaa

SEQ ID NO: 1319209 - RNA, 12 nt, Homo sapiens
acaaugaaauau

SEQ ID NO: 1319210 - RNA, 11 nt, Homo sapiens
acaaugcugau

SEQ ID NO: 1319211 - RNA, 13 nt, Homo sapiens
acaaugugaaaag

SEQ ID NO: 1319212 - RNA, 14 nt, Homo sapiens
acaauguucauccc

SEQ ID NO: 1319213 - RNA, 21 nt, Homo sapiens
acaauuauuuuuacaguucuc

SEQ ID NO: 1319214 - RNA, 20 nt, Homo sapiens
acaauuccauuuccaguuca

SEQ ID NO: 1319215 - RNA, 14 nt, Homo sapiens
acaauuuuuuguuc

SEQ ID NO: 1319216 - RNA, 13 nt, Homo sapiens
acacaaaaauuag

SEQ ID NO: 1319217 - RNA, 13 nt, Homo sapiens
acacaaagacauu

SEQ ID NO: 1319218 - RNA, 16 nt, Homo sapiens
acacaaaucuauuuaa

SEQ ID NO: 1319219 - RNA, 12 nt, Homo sapiens
acacacacaaac

SEQ ID NO: 1319220 - RNA, 13 nt, Homo sapiens
acacacacaccaa

SEQ ID NO: 1319221 - RNA, 16 nt, Homo sapiens
acacacaccuagccag

SEQ ID NO: 1319222 - RNA, 17 nt, Homo sapiens
acacacauuaugagcuu

SEQ ID NO: 1319223 - RNA, 23 nt, Homo sapiens
acacaccccucaaaaaaagccuu

SEQ ID NO: 1319224 - RNA, 20 nt, Homo sapiens
acacacgcacacaaaccaca

SEQ ID NO: 1319225 - RNA, 11 nt, Homo sapiens
acacacuguuu

SEQ ID NO: 1319226 - RNA, 18 nt, Homo sapiens
acacagaugaaacacaaa

SEQ ID NO: 1319227 - RNA, 22 nt, Homo sapiens
acacagcccgaggaaucaacaa

SEQ ID NO: 1319228 - RNA, 17 nt, Homo sapiens
acacagcucccauaacc

SEQ ID NO: 1319229 - RNA, 23 nt, Homo sapiens
acacaguguuggagguuaaggca

SEQ ID NO: 1319230 - RNA, 12 nt, Homo sapiens
acacauccugcu

SEQ ID NO: 1319231 - RNA, 19 nt, Homo sapiens
acaccaaguaccaguauaa

SEQ ID NO: 1319232 - RNA, 19 nt, Homo sapiens
acaccagggacacauuucu

SEQ ID NO: 1319233 - RNA, 23 nt, Homo sapiens
acacccaaguugaagacuuuguu

SEQ ID NO: 1319234 - RNA, 22 nt, Homo sapiens
acacccccaugacauugcauuu

SEQ ID NO: 1319235 - RNA, 20 nt, Homo sapiens
acaccguguuuucugacaca

SEQ ID NO: 1319236 - RNA, 15 nt, Homo sapiens
acaccuacucuauca

SEQ ID NO: 1319237 - RNA, 14 nt, Homo sapiens
acaccugugugcug

SEQ ID NO: 1319238 - RNA, 16 nt, Homo sapiens
acaccugugugcugua

SEQ ID NO: 1319239 - RNA, 18 nt, Homo sapiens
acaccuuaauaugcugca

SEQ ID NO: 1319240 - RNA, 19 nt, Homo sapiens
acaccuugacagggcacac

SEQ ID NO: 1319241 - RNA, 20 nt, Homo sapiens
acaccuuuuuucaacaguga

SEQ ID NO: 1319242 - RNA, 15 nt, Homo sapiens
acacgauaaagggau

SEQ ID NO: 1319243 - RNA, 22 nt, Homo sapiens
acacgccugcaaacgcugccug

SEQ ID NO: 1319244 - RNA, 16 nt, Homo sapiens
acacguaaguauaaau

SEQ ID NO: 1319245 - RNA, 12 nt, Homo sapiens
acacgugacaga

SEQ ID NO: 1319246 - RNA, 16 nt, Homo sapiens
acacuaccuuaucagg

SEQ ID NO: 1319247 - RNA, 17 nt, Homo sapiens
acacuacucuuacaugu

SEQ ID NO: 1319248 - RNA, 16 nt, Homo sapiens
acacucaaaagcuggg

SEQ ID NO: 1319249 - RNA, 19 nt, Homo sapiens
acacucauccccucacuug

SEQ ID NO: 1319250 - RNA, 21 nt, Homo sapiens
acacucauccccucacuugcc

SEQ ID NO: 1319251 - RNA, 19 nt, Homo sapiens
acacucuauaagauuccaa

SEQ ID NO: 1319252 - RNA, 18 nt, Homo sapiens
acacugcugcuccagugc

SEQ ID NO: 1319253 - RNA, 19 nt, Homo sapiens
acacugcugcuccagugca

SEQ ID NO: 1319254 - RNA, 20 nt, Homo sapiens
acacugcugcuccagugcag

SEQ ID NO: 1319255 - RNA, 14 nt, Homo sapiens
acacuuacccaagg

SEQ ID NO: 1319256 - RNA, 21 nt, Homo sapiens
acacuucguucgcagagcuuu

SEQ ID NO: 1319257 - RNA, 24 nt, Homo sapiens
acacuucguucgcagagcuuuuca

SEQ ID NO: 1319258 - RNA, 20 nt, Homo sapiens
acacuuucaggaccuuccuu

SEQ ID NO: 1319259 - RNA, 15 nt, Homo sapiens
acagaaagagacaca

SEQ ID NO: 1319260 - RNA, 21 nt, Homo sapiens
acagaaccuuguuauuucuca

SEQ ID NO: 1319261 - RNA, 22 nt, Homo sapiens
acagaagcagcuaaaccaagga

SEQ ID NO: 1319262 - RNA, 23 nt, Homo sapiens
acagaaugauuuuagauuuucca

SEQ ID NO: 1319263 - RNA, 22 nt, Homo sapiens
acagaauuuuaugcggcauuuu

SEQ ID NO: 1319264 - RNA, 18 nt, Homo sapiens
acagaauuuuauggugca

SEQ ID NO: 1319265 - RNA, 18 nt, Homo sapiens
gcuguccauguauucaca

SEQ ID NO: 1319266 - RNA, 19 nt, Homo sapiens
gcugucccccaacacugag

SEQ ID NO: 1319267 - RNA, 15 nt, Homo sapiens
gcugugggccaaaau

SEQ ID NO: 1319268 - RNA, 19 nt, Homo sapiens
gcugugggccaaaaucaug

SEQ ID NO: 1319269 - RNA, 22 nt, Homo sapiens
gcugugggccaaaaucaugcca

SEQ ID NO: 1319270 - RNA, 16 nt, Homo sapiens
gcugugggcugcauac

SEQ ID NO: 1319271 - RNA, 20 nt, Homo sapiens
gcuguggguucuuucuccuc

SEQ ID NO: 1319272 - RNA, 16 nt, Homo sapiens
gcugugugaccuggga

SEQ ID NO: 1319273 - RNA, 16 nt, Homo sapiens
gcuguguuuccaucuc

SEQ ID NO: 1319274 - RNA, 18 nt, Homo sapiens
gcuguguuuccaucucaa

SEQ ID NO: 1319275 - RNA, 15 nt, Homo sapiens
gcuguugacauauuu

SEQ ID NO: 1319276 - RNA, 19 nt, Homo sapiens
gcuguuuauuaaugcugaa

SEQ ID NO: 1319277 - RNA, 20 nt, Homo sapiens
gcuguuuccauagggugaca

SEQ ID NO: 1319278 - RNA, 16 nt, Homo sapiens
gcuuauaagacaauga

SEQ ID NO: 1319279 - RNA, 18 nt, Homo sapiens
gcuuauccaugccuggga

SEQ ID NO: 1319280 - RNA, 16 nt, Homo sapiens
gcuucacuggggcccu

SEQ ID NO: 1319281 - RNA, 19 nt, Homo sapiens
gcuucacuggggcccuguc

SEQ ID NO: 1319282 - RNA, 18 nt, Homo sapiens
aagcuaacaccagacaga

SEQ ID NO: 1319283 - RNA, 17 nt, Homo sapiens
aagcuaguguaccuccu

SEQ ID NO: 1319284 - RNA, 21 nt, Homo sapiens
aagcuaguguaccuccucuca

SEQ ID NO: 1319285 - RNA, 18 nt, Homo sapiens
aagcuauugucuguaaua

SEQ ID NO: 1319286 - RNA, 16 nt, Homo sapiens
aagcucccaagggaug

SEQ ID NO: 1319287 - RNA, 14 nt, Homo sapiens
aagcugacauugcc

SEQ ID NO: 1319288 - RNA, 17 nt, Homo sapiens
aagcugacauugccaaa

SEQ ID NO: 1319289 - RNA, 23 nt, Homo sapiens
aagcugcuggaaaccucaugcca

SEQ ID NO: 1319290 - RNA, 14 nt, Homo sapiens
aagcugcuuuagaa

SEQ ID NO: 1319291 - RNA, 21 nt, Homo sapiens
aagcugugcccugaccacccu

SEQ ID NO: 1319292 - RNA, 21 nt, Homo sapiens
aagcuguucucaggaucacug

SEQ ID NO: 1319293 - RNA, 20 nt, Homo sapiens
aagcuuuuuuugaaucauca

SEQ ID NO: 1319294 - RNA, 12 nt, Homo sapiens
aaggaaagcuca

SEQ ID NO: 1319295 - RNA, 12 nt, Homo sapiens
aaggaaagugau

SEQ ID NO: 1319296 - RNA, 15 nt, Homo sapiens
aaggaaaucucaccc

SEQ ID NO: 1319297 - RNA, 17 nt, Homo sapiens
aaggaagacaaugugaa

SEQ ID NO: 1319298 - RNA, 19 nt, Homo sapiens
aaggaagaggcugacaaua

SEQ ID NO: 1319299 - RNA, 21 nt, Homo sapiens
aaggaagcaaguuuucuucca

SEQ ID NO: 1319300 - RNA, 22 nt, Homo sapiens
aaggaagcaaguuuucuuccau

SEQ ID NO: 1319301 - RNA, 16 nt, Homo sapiens
aaggaaggaaauagua

SEQ ID NO: 1319302 - RNA, 20 nt, Homo sapiens
aaggacuuccuguccagcuc

SEQ ID NO: 1319303 - RNA, 13 nt, Homo sapiens
aaggagaaucaaa

SEQ ID NO: 1319304 - RNA, 20 nt, Homo sapiens
aaggagacacaacaacuccu

SEQ ID NO: 1319305 - RNA, 22 nt, Homo sapiens
aaggagcccuuaucugugcuca

SEQ ID NO: 1319306 - RNA, 21 nt, Homo sapiens
aaggaucuuaggcaugacugu

SEQ ID NO: 1319307 - RNA, 12 nt, Homo sapiens
aaggaugugauu

SEQ ID NO: 1319308 - RNA, 14 nt, Homo sapiens
aaggcaaaugccca

SEQ ID NO: 1319309 - RNA, 13 nt, Homo sapiens
aaggcacagugaa

SEQ ID NO: 1319310 - RNA, 14 nt, Homo sapiens
aaggcacagugaag

SEQ ID NO: 1319311 - RNA, 15 nt, Homo sapiens
aaggcaccuauaaaa

SEQ ID NO: 1319312 - RNA, 23 nt, Homo sapiens
aaggcaccuauaaaacaggucaa

SEQ ID NO: 1319313 - RNA, 20 nt, Homo sapiens
aaggcagcugguauauucag

SEQ ID NO: 1319314 - RNA, 16 nt, Homo sapiens
aaggcauuuucaucuu

SEQ ID NO: 1319315 - RNA, 16 nt, Homo sapiens
aaggcccugcugaguc

SEQ ID NO: 1319316 - RNA, 15 nt, Homo sapiens
aaggccuccugugac

SEQ ID NO: 1319317 - RNA, 23 nt, Homo sapiens
aaggcuaaaaagcaacaggccau

SEQ ID NO: 1319318 - RNA, 23 nt, Homo sapiens
aaggcucgauuuuguaucugcag

SEQ ID NO: 1319319 - RNA, 13 nt, Homo sapiens
aagggcauggguc

SEQ ID NO: 1319320 - RNA, 16 nt, Homo sapiens
aagggcugaacccuca

SEQ ID NO: 1319321 - RNA, 18 nt, Homo sapiens
aaggggaaucagaacuca

SEQ ID NO: 1319322 - RNA, 15 nt, Homo sapiens
aaggggagaagggaa

SEQ ID NO: 1319323 - RNA, 16 nt, Homo sapiens
aagguaaaaugccaug

SEQ ID NO: 1319324 - RNA, 18 nt, Homo sapiens
aagguacugucaugggcu

SEQ ID NO: 1319325 - RNA, 18 nt, Homo sapiens
aagguccucugucaguca

SEQ ID NO: 1319326 - RNA, 21 nt, Homo sapiens
aaggugaggccugucugugac

SEQ ID NO: 1319327 - RNA, 19 nt, Homo sapiens
aagguggggacagggauga

SEQ ID NO: 1319328 - RNA, 16 nt, Homo sapiens
aagguuaagucaggga

SEQ ID NO: 1319329 - RNA, 15 nt, Homo sapiens
aaguaaaacuuaaga

SEQ ID NO: 1319330 - RNA, 20 nt, Homo sapiens
aaguaaaacuugcugccuga

SEQ ID NO: 1319331 - RNA, 19 nt, Homo sapiens
aaguaauuccguagguuau

SEQ ID NO: 1319332 - RNA, 18 nt, Homo sapiens
aaguacuucuccacccug

SEQ ID NO: 1319333 - RNA, 17 nt, Homo sapiens
aaguagaaauggugaga

SEQ ID NO: 1319334 - RNA, 14 nt, Homo sapiens
aaguagcugcuacc

SEQ ID NO: 1319335 - RNA, 17 nt, Homo sapiens
aaguagggauuaauauu

SEQ ID NO: 1319336 - RNA, 19 nt, Homo sapiens
aaguagggauuaauauuua

SEQ ID NO: 1319337 - RNA, 15 nt, Homo sapiens
aaguauaauuugcug

SEQ ID NO: 1319338 - RNA, 19 nt, Homo sapiens
aagucaaaugugugcuuug

SEQ ID NO: 1319339 - RNA, 15 nt, Homo sapiens
aagucacccuuccac

SEQ ID NO: 1319340 - RNA, 18 nt, Homo sapiens
aaguccaggacacccagu

SEQ ID NO: 1319341 - RNA, 20 nt, Homo sapiens
aagucccccagcagaaccag

SEQ ID NO: 1319342 - RNA, 17 nt, Homo sapiens
aagucccuuugugacuu

SEQ ID NO: 1319343 - RNA, 20 nt, Homo sapiens
aagucccuuugugacuucaa

SEQ ID NO: 1319344 - RNA, 16 nt, Homo sapiens
aagucuguuuacugca

SEQ ID NO: 1319345 - RNA, 23 nt, Homo sapiens
aagucuucucccguccauuccag

SEQ ID NO: 1319346 - RNA, 13 nt, Homo sapiens
aagugaaagcaag

SEQ ID NO: 1319347 - RNA, 13 nt, Homo sapiens
aagugaaagugag

SEQ ID NO: 1319348 - RNA, 16 nt, Homo sapiens
aagugaauuguugaca

SEQ ID NO: 1319349 - RNA, 22 nt, Homo sapiens
aagugagacccugucucaaaaa

SEQ ID NO: 1319350 - RNA, 16 nt, Homo sapiens
aagugccaucucaauu

SEQ ID NO: 1319351 - RNA, 20 nt, Homo sapiens
aagugcucacuacucaguga

SEQ ID NO: 1319352 - RNA, 18 nt, Homo sapiens
aagugcuggcaaccacua

SEQ ID NO: 1319353 - RNA, 13 nt, Homo sapiens
aagugcuguggcu

SEQ ID NO: 1319354 - RNA, 23 nt, Homo sapiens
aagugugugccaccaugccucac

SEQ ID NO: 1319355 - RNA, 20 nt, Homo sapiens
aaguguucacaacagugaaa

SEQ ID NO: 1319356 - RNA, 22 nt, Homo sapiens
aaguuaugcaagggacugugug

SEQ ID NO: 1319357 - RNA, 19 nt, Homo sapiens
aaguucaaaagcugguggu

SEQ ID NO: 1319358 - RNA, 21 nt, Homo sapiens
aaguucacaucagaacagaca

SEQ ID NO: 1319359 - RNA, 15 nt, Homo sapiens
aaguucagaucuuaa

SEQ ID NO: 1319360 - RNA, 15 nt, Homo sapiens
acacuugcaaccuac

SEQ ID NO: 1319361 - RNA, 17 nt, Homo sapiens
acacuugcaaccuaccu

SEQ ID NO: 1319362 - RNA, 20 nt, Homo sapiens
acacuuuuggaaccaugccu

SEQ ID NO: 1319363 - RNA, 23 nt, Homo sapiens
acagaagagugacauguuuacaa

SEQ ID NO: 1319364 - RNA, 12 nt, Homo sapiens
acagaauauucu

SEQ ID NO: 1319365 - RNA, 22 nt, Homo sapiens
acagaaugauuuuagauuuucc

SEQ ID NO: 1319366 - RNA, 16 nt, Homo sapiens
acagacuggaagcaca

SEQ ID NO: 1319367 - RNA, 22 nt, Homo sapiens
agccacagggucugccuccagc

SEQ ID NO: 1319368 - RNA, 13 nt, Homo sapiens
agccacaguaugg

SEQ ID NO: 1319369 - RNA, 15 nt, Homo sapiens
agccaccaagaggga

SEQ ID NO: 1319370 - RNA, 19 nt, Homo sapiens
agccacuccccuccacucu

SEQ ID NO: 1319371 - RNA, 16 nt, Homo sapiens
agccacuggcugcuaa

SEQ ID NO: 1319372 - RNA, 23 nt, Homo sapiens
agccacuggcugcuaacaaguca

SEQ ID NO: 1319373 - RNA, 16 nt, Homo sapiens
agccacugguuucuca

SEQ ID NO: 1319374 - RNA, 18 nt, Homo sapiens
agccacugguuucucaga

SEQ ID NO: 1319375 - RNA, 18 nt, Homo sapiens
agccagcaaccagcacau

SEQ ID NO: 1319376 - RNA, 17 nt, Homo sapiens
agccaggugaacuggaa

SEQ ID NO: 1319377 - RNA, 19 nt, Homo sapiens
agccauggaaaaacuuccu

SEQ ID NO: 1319378 - RNA, 12 nt, Homo sapiens
agccauuccaaa

SEQ ID NO: 1319379 - RNA, 11 nt, Homo sapiens
agccauugcac

SEQ ID NO: 1319380 - RNA, 13 nt, Homo sapiens
agcccaccccuca

SEQ ID NO: 1319381 - RNA, 15 nt, Homo sapiens
agcccaccccugugc

SEQ ID NO: 1319382 - RNA, 18 nt, Homo sapiens
agcccagaaagucucuca

SEQ ID NO: 1319383 - RNA, 16 nt, Homo sapiens
agcccagcccuccagc

SEQ ID NO: 1319384 - RNA, 17 nt, Homo sapiens
agcccagucuggaugug

SEQ ID NO: 1319385 - RNA, 15 nt, Homo sapiens
agcccccccuuccac

SEQ ID NO: 1319386 - RNA, 16 nt, Homo sapiens
agcccgugcacccugg

SEQ ID NO: 1319387 - RNA, 20 nt, Homo sapiens
agcccuccgccuucacauuc

SEQ ID NO: 1319388 - RNA, 23 nt, Homo sapiens
agcccuguggaugagcccucaga

SEQ ID NO: 1319389 - RNA, 16 nt, Homo sapiens
agcccuuagcagggaa

SEQ ID NO: 1319390 - RNA, 20 nt, Homo sapiens
agccgacaccuuuuuucaac

SEQ ID NO: 1319391 - RNA, 20 nt, Homo sapiens
agccguugugcgaagacaga

SEQ ID NO: 1319392 - RNA, 13 nt, Homo sapiens
agccuacagccag

SEQ ID NO: 1319393 - RNA, 18 nt, Homo sapiens
agccuaggugacagagug

SEQ ID NO: 1319394 - RNA, 20 nt, Homo sapiens
agccuaguggcuuguccuca

SEQ ID NO: 1319395 - RNA, 17 nt, Homo sapiens
agccucagaugauuucc

SEQ ID NO: 1319396 - RNA, 20 nt, Homo sapiens
agccucagcgcggcccuccc

SEQ ID NO: 1319397 - RNA, 23 nt, Homo sapiens
agccuccaauguacaacuuccgc

SEQ ID NO: 1319398 - RNA, 22 nt, Homo sapiens
agccucccaaguagcugagacu

SEQ ID NO: 1319399 - RNA, 20 nt, Homo sapiens
agccugaugcugacauucac

SEQ ID NO: 1319400 - RNA, 13 nt, Homo sapiens
agccugcagucau

SEQ ID NO: 1319401 - RNA, 20 nt, Homo sapiens
agccuggccagacacaggcc

SEQ ID NO: 1319402 - RNA, 14 nt, Homo sapiens
agccugugcaaaaa

SEQ ID NO: 1319403 - RNA, 15 nt, Homo sapiens
agccugugcaaaaaa

SEQ ID NO: 1319404 - RNA, 16 nt, Homo sapiens
agccuguggccuuugc

SEQ ID NO: 1319405 - RNA, 14 nt, Homo sapiens
agccuuagaaguca

SEQ ID NO: 1319406 - RNA, 23 nt, Homo sapiens
agccuuccagggauuugccucac

SEQ ID NO: 1319407 - RNA, 21 nt, Homo sapiens
agccuuggcugccuuggugca

SEQ ID NO: 1319408 - RNA, 16 nt, Homo sapiens
agcgaacugucagccu

SEQ ID NO: 1319409 - RNA, 19 nt, Homo sapiens
agcgauccucccaccucag

SEQ ID NO: 1319410 - RNA, 14 nt, Homo sapiens
agcgggaauggcag

SEQ ID NO: 1319411 - RNA, 16 nt, Homo sapiens
agcgugugacuacucc

SEQ ID NO: 1319412 - RNA, 21 nt, Homo sapiens
agcuaaaccaaggacugagca

SEQ ID NO: 1319413 - RNA, 20 nt, Homo sapiens
agcuacucgggaggcugaga

SEQ ID NO: 1319414 - RNA, 16 nt, Homo sapiens
agcuaguguaccuccu

SEQ ID NO: 1319415 - RNA, 18 nt, Homo sapiens
agcuauaacuaagcaucc

SEQ ID NO: 1319416 - RNA, 19 nt, Homo sapiens
agcuauaacuuacuucugu

SEQ ID NO: 1319417 - RNA, 20 nt, Homo sapiens
agcucaagaugacagcucuu

SEQ ID NO: 1319418 - RNA, 20 nt, Homo sapiens
agcucagcauuuccacacca

SEQ ID NO: 1319419 - RNA, 16 nt, Homo sapiens
agcucccuguccugaa

SEQ ID NO: 1319420 - RNA, 21 nt, Homo sapiens
agcuccgugaacuugugagaa

SEQ ID NO: 1319421 - RNA, 20 nt, Homo sapiens
agcuccuauuucaaggagaa

SEQ ID NO: 1319422 - RNA, 13 nt, Homo sapiens
agcuccucacuca

SEQ ID NO: 1319423 - RNA, 21 nt, Homo sapiens
agcucuauguuuacaaaugga

SEQ ID NO: 1319424 - RNA, 15 nt, Homo sapiens
agcucucaguugcag

SEQ ID NO: 1319425 - RNA, 16 nt, Homo sapiens
agcucuccugacuuuu

SEQ ID NO: 1319426 - RNA, 21 nt, Homo sapiens
agcucugcaacagggggcaaa

SEQ ID NO: 1319427 - RNA, 16 nt, Homo sapiens
agcucuucaucugccc

SEQ ID NO: 1319428 - RNA, 14 nt, Homo sapiens
agcucuucuaagga

SEQ ID NO: 1319429 - RNA, 16 nt, Homo sapiens
agcugaccagccguga

SEQ ID NO: 1319430 - RNA, 14 nt, Homo sapiens
agcugagguaaaaa

SEQ ID NO: 1319431 - RNA, 20 nt, Homo sapiens
agcugagucucccuaaggca

SEQ ID NO: 1319432 - RNA, 18 nt, Homo sapiens
agcugcaagaaguccaua

SEQ ID NO: 1319433 - RNA, 16 nt, Homo sapiens
agcugccuuagcuuca

SEQ ID NO: 1319434 - RNA, 16 nt, Homo sapiens
agcugccuuggcucag

SEQ ID NO: 1319435 - RNA, 22 nt, Homo sapiens
agcugccuuggcucagacaugu

SEQ ID NO: 1319436 - RNA, 11 nt, Homo sapiens
agcugcucagg

SEQ ID NO: 1319437 - RNA, 19 nt, Homo sapiens
agcugcuccuagagggagg

SEQ ID NO: 1319438 - RNA, 17 nt, Homo sapiens
agcugcucugagccaca

SEQ ID NO: 1319439 - RNA, 21 nt, Homo sapiens
agcugcuuugaggcaguucca

SEQ ID NO: 1319440 - RNA, 22 nt, Homo sapiens
agcuggaagggucaacaucuuu

SEQ ID NO: 1319441 - RNA, 23 nt, Homo sapiens
agcuggaagggucaacaucuuuu

SEQ ID NO: 1319442 - RNA, 23 nt, Homo sapiens
agcuggagcccgugcccuaccac

SEQ ID NO: 1319443 - RNA, 14 nt, Homo sapiens
agcuggcaccagaa

SEQ ID NO: 1319444 - RNA, 22 nt, Homo sapiens
agcuggcgucaugcaaagucau

SEQ ID NO: 1319445 - RNA, 14 nt, Homo sapiens
agcuggucugggug

SEQ ID NO: 1319446 - RNA, 15 nt, Homo sapiens
agcuggugagugaug

SEQ ID NO: 1319447 - RNA, 15 nt, Homo sapiens
agcugguggacccag

SEQ ID NO: 1319448 - RNA, 19 nt, Homo sapiens
agcuguccucccaccucag

SEQ ID NO: 1319449 - RNA, 18 nt, Homo sapiens
agcugugaagacuugccu

SEQ ID NO: 1319450 - RNA, 17 nt, Homo sapiens
agcuguuccuguucagu

SEQ ID NO: 1319451 - RNA, 16 nt, Homo sapiens
agcuguuuucccugac

SEQ ID NO: 1319452 - RNA, 18 nt, Homo sapiens
agcuuagacuaaggccau

SEQ ID NO: 1319453 - RNA, 20 nt, Homo sapiens
agcuuaggaaagaacaucac

SEQ ID NO: 1319454 - RNA, 12 nt, Homo sapiens
agcuuaucucag

SEQ ID NO: 1319455 - RNA, 23 nt, Homo sapiens
agcuucaacccucagccuugaaa

SEQ ID NO: 1319456 - RNA, 18 nt, Homo sapiens
agcuucucagccuuccua

SEQ ID NO: 1319457 - RNA, 18 nt, Homo sapiens
agcuugaauuucaaauau

SEQ ID NO: 1319458 - RNA, 12 nt, Homo sapiens
agcuugcugcua

SEQ ID NO: 1319459 - RNA, 17 nt, Homo sapiens
agcuuguaaauagcuca

SEQ ID NO: 1319460 - RNA, 12 nt, Homo sapiens
agcuuguugaaa

SEQ ID NO: 1319461 - RNA, 19 nt, Homo sapiens
agcuuguugaaaacccaga

SEQ ID NO: 1319462 - RNA, 22 nt, Homo sapiens
agcuuucauguaaacugugcac

SEQ ID NO: 1319463 - RNA, 12 nt, Homo sapiens
agcuuucugcca

SEQ ID NO: 1319464 - RNA, 19 nt, Homo sapiens
agcuuucugcuaucaaaga

SEQ ID NO: 1319465 - RNA, 16 nt, Homo sapiens
agcuuugaaaauucag

SEQ ID NO: 1319466 - RNA, 12 nt, Homo sapiens
agcuuugcugcu

SEQ ID NO: 1319467 - RNA, 23 nt, Homo sapiens
agcuuuuauuuaacagugcaaaa

SEQ ID NO: 1319468 - RNA, 15 nt, Homo sapiens
aggaaaaauguguaa

SEQ ID NO: 1319469 - RNA, 20 nt, Homo sapiens
aggaaaagcggacaucagcu

SEQ ID NO: 1319470 - RNA, 14 nt, Homo sapiens
aggaaacaacagcu

SEQ ID NO: 1319471 - RNA, 17 nt, Homo sapiens
aggaaacaacagcuuua

SEQ ID NO: 1319472 - RNA, 22 nt, Homo sapiens
aggaaacaaggggucugaggau

SEQ ID NO: 1319473 - RNA, 22 nt, Homo sapiens
aggaaaccacagcugcuggaga

SEQ ID NO: 1319474 - RNA, 15 nt, Homo sapiens
aggaaagaguauuaa

SEQ ID NO: 1319475 - RNA, 16 nt, Homo sapiens
aggaaagucauuggcu

SEQ ID NO: 1319476 - RNA, 21 nt, Homo sapiens
aggaaagugauuuuuuuccac

SEQ ID NO: 1319477 - RNA, 13 nt, Homo sapiens
aggaacacugaca

SEQ ID NO: 1319478 - RNA, 22 nt, Homo sapiens
aggaaccaacaaggaaacuuuc

SEQ ID NO: 1319479 - RNA, 19 nt, Homo sapiens
aggaaccucgaguacugug

SEQ ID NO: 1319480 - RNA, 15 nt, Homo sapiens
aggaagacaauguga

SEQ ID NO: 1319481 - RNA, 16 nt, Homo sapiens
aggaagagcaggacuc

SEQ ID NO: 1319482 - RNA, 14 nt, Homo sapiens
aggaagccgugccc

SEQ ID NO: 1319483 - RNA, 23 nt, Homo sapiens
aggaagcgaaaggggauggagug

SEQ ID NO: 1319484 - RNA, 20 nt, Homo sapiens
aggaagcucagacugguuga

SEQ ID NO: 1319485 - RNA, 19 nt, Homo sapiens
aggaagcuucaaaacauug

SEQ ID NO: 1319486 - RNA, 17 nt, Homo sapiens
aggaaggccuccugagg

SEQ ID NO: 1319487 - RNA, 19 nt, Homo sapiens
aggaaggcuuguugugcuu

SEQ ID NO: 1319488 - RNA, 16 nt, Homo sapiens
aggacucaaaguuuca

SEQ ID NO: 1319489 - RNA, 14 nt, Homo sapiens
aggacugggccacu

SEQ ID NO: 1319490 - RNA, 17 nt, Homo sapiens
aggacuucugccugaac

SEQ ID NO: 1319491 - RNA, 20 nt, Homo sapiens
aggagaaacucccauguaug

SEQ ID NO: 1319492 - RNA, 18 nt, Homo sapiens
aggagaaagaagagcagc

SEQ ID NO: 1319493 - RNA, 13 nt, Homo sapiens
aggagaaaucacu

SEQ ID NO: 1319494 - RNA, 18 nt, Homo sapiens
aggagaauuuaaacaaug

SEQ ID NO: 1319495 - RNA, 20 nt, Homo sapiens
aggagaccuggcacuggaug

SEQ ID NO: 1319496 - RNA, 22 nt, Homo sapiens
aggagaccuggcacuggaugca

SEQ ID NO: 1319497 - RNA, 23 nt, Homo sapiens
aggagacuuuacauggaugccaa

SEQ ID NO: 1319498 - RNA, 14 nt, Homo sapiens
aggagaucaucuga

SEQ ID NO: 1319499 - RNA, 20 nt, Homo sapiens
aggagcccuuaucugugcuc

SEQ ID NO: 1319500 - RNA, 18 nt, Homo sapiens
aggagcuugcaagaagca

SEQ ID NO: 1319501 - RNA, 20 nt, Homo sapiens
aggaggcagagguugcagug

SEQ ID NO: 1319502 - RNA, 14 nt, Homo sapiens
aggaggccacguga

SEQ ID NO: 1319503 - RNA, 14 nt, Homo sapiens
aggaggccguggcu

SEQ ID NO: 1319504 - RNA, 18 nt, Homo sapiens
aggagggcagaucacuuc

SEQ ID NO: 1319505 - RNA, 23 nt, Homo sapiens
aggaggggucuggguacuucuug

SEQ ID NO: 1319506 - RNA, 15 nt, Homo sapiens
aggaguacaggugaa

SEQ ID NO: 1319507 - RNA, 20 nt, Homo sapiens
aggaguggugggugcagucc

SEQ ID NO: 1319508 - RNA, 13 nt, Homo sapiens
aggaguuccuuga

SEQ ID NO: 1319509 - RNA, 18 nt, Homo sapiens
aggauauuggaaugcaca

SEQ ID NO: 1319510 - RNA, 19 nt, Homo sapiens
aggaugaaggcaaugccau

SEQ ID NO: 1319511 - RNA, 18 nt, Homo sapiens
aggauggcaaagagaguc

SEQ ID NO: 1319512 - RNA, 19 nt, Homo sapiens
aggaugugauuguggaaug

SEQ ID NO: 1319513 - RNA, 17 nt, Homo sapiens
aggauuccagaaugauc

SEQ ID NO: 1319514 - RNA, 19 nt, Homo sapiens
aggauuccagaaugaucau

SEQ ID NO: 1319515 - RNA, 14 nt, Homo sapiens
aggauuugcacaga

SEQ ID NO: 1319516 - RNA, 21 nt, Homo sapiens
aggauuuucacauucuuggcu

SEQ ID NO: 1319517 - RNA, 16 nt, Homo sapiens
aggcaaauuuguauau

SEQ ID NO: 1319518 - RNA, 14 nt, Homo sapiens
aggcaacauccaaa

SEQ ID NO: 1319519 - RNA, 12 nt, Homo sapiens
aggcaagcacuu

SEQ ID NO: 1319520 - RNA, 14 nt, Homo sapiens
aggcaauccuaccu

SEQ ID NO: 1319521 - RNA, 19 nt, Homo sapiens
aggcaccugccaccaugcc

SEQ ID NO: 1319522 - RNA, 16 nt, Homo sapiens
aggcacgucugcagaa

SEQ ID NO: 1319523 - RNA, 21 nt, Homo sapiens
aggcagaggcuguggugagcc

SEQ ID NO: 1319524 - RNA, 15 nt, Homo sapiens
aggcagccuccuuaa

SEQ ID NO: 1319525 - RNA, 23 nt, Homo sapiens
aggcagcugguauauucagucuc

SEQ ID NO: 1319526 - RNA, 20 nt, Homo sapiens
aggcagcuuuuucucuccca

SEQ ID NO: 1319527 - RNA, 23 nt, Homo sapiens
aggcagcuuuuucucucccacua

SEQ ID NO: 1319528 - RNA, 17 nt, Homo sapiens
aggcaggagaaucucuu

SEQ ID NO: 1319529 - RNA, 20 nt, Homo sapiens
aggcagggucucacucuguc

SEQ ID NO: 1319530 - RNA, 23 nt, Homo sapiens
aggcaguauuuuguguccuccag

SEQ ID NO: 1319531 - RNA, 21 nt, Homo sapiens
aggcagugucuggaugaugcu

SEQ ID NO: 1319532 - RNA, 17 nt, Homo sapiens
aggcaguuggccagaga

SEQ ID NO: 1319533 - RNA, 22 nt, Homo sapiens
aggcauccucugacuccacuca

SEQ ID NO: 1319534 - RNA, 20 nt, Homo sapiens
aggcaugaaauacugugccu

SEQ ID NO: 1319535 - RNA, 17 nt, Homo sapiens
aggcauuuagcccucac

SEQ ID NO: 1319536 - RNA, 18 nt, Homo sapiens
aggcauuuucaucuuucc

SEQ ID NO: 1319537 - RNA, 16 nt, Homo sapiens
aggccaaaccucuguu

SEQ ID NO: 1319538 - RNA, 21 nt, Homo sapiens
aggccagagggagugacagag

SEQ ID NO: 1319539 - RNA, 17 nt, Homo sapiens
aggccaguaugauuuau

SEQ ID NO: 1319540 - RNA, 15 nt, Homo sapiens
aggccaucaucagug

SEQ ID NO: 1319541 - RNA, 12 nt, Homo sapiens
aggcccucgcug

SEQ ID NO: 1319542 - RNA, 16 nt, Homo sapiens
aggcccuugggcaccu

SEQ ID NO: 1319543 - RNA, 21 nt, Homo sapiens
aggccuccuggcccaggugag

SEQ ID NO: 1319544 - RNA, 13 nt, Homo sapiens
aggccugaagcca

SEQ ID NO: 1319545 - RNA, 12 nt, Homo sapiens
aggccugaauca

SEQ ID NO: 1319546 - RNA, 23 nt, Homo sapiens
aggccuggccagaugcaccagcc

SEQ ID NO: 1319547 - RNA, 15 nt, Homo sapiens
aggccuguacagaug

SEQ ID NO: 1319548 - RNA, 19 nt, Homo sapiens
aggccuuagccaugaucug

SEQ ID NO: 1319549 - RNA, 22 nt, Homo sapiens
aggcgauccaccugucucagcc

SEQ ID NO: 1319550 - RNA, 20 nt, Homo sapiens
aggcggguggaucacuugag

SEQ ID NO: 1319551 - RNA, 14 nt, Homo sapiens
aggcggugcuugau

SEQ ID NO: 1319552 - RNA, 19 nt, Homo sapiens
aggcguggagcugccugau

SEQ ID NO: 1319553 - RNA, 19 nt, Homo sapiens
aggcucauggcccuguagu

SEQ ID NO: 1319554 - RNA, 17 nt, Homo sapiens
aggcucgccaaggccua

SEQ ID NO: 1319555 - RNA, 18 nt, Homo sapiens
aggcugagaacacuguga

SEQ ID NO: 1319556 - RNA, 15 nt, Homo sapiens
aggcugaucccugag

SEQ ID NO: 1319557 - RNA, 12 nt, Homo sapiens
aggcugcucaga

SEQ ID NO: 1319558 - RNA, 16 nt, Homo sapiens
aggcuggaaugcagug

SEQ ID NO: 1319559 - RNA, 17 nt, Homo sapiens
aggcuggcacaggacau

SEQ ID NO: 1319560 - RNA, 14 nt, Homo sapiens
aggcuggcagauuu

SEQ ID NO: 1319561 - RNA, 21 nt, Homo sapiens
aggcuggcagauuuccaaaag

SEQ ID NO: 1319562 - RNA, 12 nt, Homo sapiens
aggcuggcuugu

SEQ ID NO: 1319563 - RNA, 13 nt, Homo sapiens
agggaaaagcagc

SEQ ID NO: 1319564 - RNA, 18 nt, Homo sapiens
agggaagcugucccucac

SEQ ID NO: 1319565 - RNA, 13 nt, Homo sapiens
agggaauccuccu

SEQ ID NO: 1319566 - RNA, 18 nt, Homo sapiens
agggaaucucauccauca

SEQ ID NO: 1319567 - RNA, 17 nt, Homo sapiens
agggacugaagccaaag

SEQ ID NO: 1319568 - RNA, 20 nt, Homo sapiens
agggagacuccgcuguggga

SEQ ID NO: 1319569 - RNA, 17 nt, Homo sapiens
agggagacugcaucuca

SEQ ID NO: 1319570 - RNA, 18 nt, Homo sapiens
agggagacugcaucucaa

SEQ ID NO: 1319571 - RNA, 18 nt, Homo sapiens
agggagcucugaugagca

SEQ ID NO: 1319572 - RNA, 14 nt, Homo sapiens
agggagcuggaaaa

SEQ ID NO: 1319573 - RNA, 20 nt, Homo sapiens
agggaggcaagcccuguuga

SEQ ID NO: 1319574 - RNA, 15 nt, Homo sapiens
agggaguuccaguca

SEQ ID NO: 1319575 - RNA, 20 nt, Homo sapiens
agggaugaaagagaaggugg

SEQ ID NO: 1319576 - RNA, 18 nt, Homo sapiens
agggaugcuaguccguga

SEQ ID NO: 1319577 - RNA, 21 nt, Homo sapiens
agggauuuuagucacacgugg

SEQ ID NO: 1319578 - RNA, 11 nt, Homo sapiens
agggcacaaag

SEQ ID NO: 1319579 - RNA, 14 nt, Homo sapiens
agggccacauggga

SEQ ID NO: 1319580 - RNA, 13 nt, Homo sapiens
agggccagagcaa

SEQ ID NO: 1319581 - RNA, 19 nt, Homo sapiens
agggcggugaacucuggcu

SEQ ID NO: 1319582 - RNA, 18 nt, Homo sapiens
agggcucacagaauucau

SEQ ID NO: 1319583 - RNA, 20 nt, Homo sapiens
aggggaacagaagaaaauaa

SEQ ID NO: 1319584 - RNA, 21 nt, Homo sapiens
aggggauagagagagaccacu

SEQ ID NO: 1319585 - RNA, 20 nt, Homo sapiens
aggggauggagugagcccau

SEQ ID NO: 1319586 - RNA, 13 nt, Homo sapiens
aggggcacagggu

SEQ ID NO: 1319587 - RNA, 20 nt, Homo sapiens
aggggcuguguuuccaucuc

SEQ ID NO: 1319588 - RNA, 17 nt, Homo sapiens
agggggaagaagaagag

SEQ ID NO: 1319589 - RNA, 20 nt, Homo sapiens
agggguucuggaaacauuca

SEQ ID NO: 1319590 - RNA, 17 nt, Homo sapiens
agggguucuugagccag

SEQ ID NO: 1319591 - RNA, 18 nt, Homo sapiens
agggguucuugagccagc

SEQ ID NO: 1319592 - RNA, 13 nt, Homo sapiens
agggucauagcau

SEQ ID NO: 1319593 - RNA, 18 nt, Homo sapiens
agggucugccuccagcca

SEQ ID NO: 1319594 - RNA, 17 nt, Homo sapiens
agggucuuguguugcaa

SEQ ID NO: 1319595 - RNA, 14 nt, Homo sapiens
agggugagugcaag

SEQ ID NO: 1319596 - RNA, 15 nt, Homo sapiens
agggugagugcaagg

SEQ ID NO: 1319597 - RNA, 19 nt, Homo sapiens
agggugcaguaucaugccc

SEQ ID NO: 1319598 - RNA, 21 nt, Homo sapiens
aggguucaagccuuccaggga

SEQ ID NO: 1319599 - RNA, 19 nt, Homo sapiens
aggguugggcuggugucac

SEQ ID NO: 1319600 - RNA, 20 nt, Homo sapiens
aggguuucaccauguugccc

SEQ ID NO: 1319601 - RNA, 22 nt, Homo sapiens
agguacugucaugggcuaggca

SEQ ID NO: 1319602 - RNA, 14 nt, Homo sapiens
agguagauaccaaa

SEQ ID NO: 1319603 - RNA, 16 nt, Homo sapiens
agguagauaccaaaug

SEQ ID NO: 1319604 - RNA, 12 nt, Homo sapiens
agguagcacuac

SEQ ID NO: 1319605 - RNA, 17 nt, Homo sapiens
aggucaaaaaucugucc

SEQ ID NO: 1319606 - RNA, 17 nt, Homo sapiens
aggucauuaaaauuaca

SEQ ID NO: 1319607 - RNA, 19 nt, Homo sapiens
aguucauacccuguuacca

SEQ ID NO: 1319608 - RNA, 19 nt, Homo sapiens
aguuccaaaauaaagcaua

SEQ ID NO: 1319609 - RNA, 21 nt, Homo sapiens
aguuccuaaagcaugggaucu

SEQ ID NO: 1319610 - RNA, 13 nt, Homo sapiens
aguucugaugcuu

SEQ ID NO: 1319611 - RNA, 13 nt, Homo sapiens
aguucuguagaaa

SEQ ID NO: 1319612 - RNA, 21 nt, Homo sapiens
aguucuugagggccuccccac

SEQ ID NO: 1319613 - RNA, 22 nt, Homo sapiens
aguucuuuaaaauguaaagcca

SEQ ID NO: 1319614 - RNA, 17 nt, Homo sapiens
aguucuuugggccagac

SEQ ID NO: 1319615 - RNA, 19 nt, Homo sapiens
aguugaucuggaacccaga

SEQ ID NO: 1319616 - RNA, 15 nt, Homo sapiens
aguugauucagcucu

SEQ ID NO: 1319617 - RNA, 21 nt, Homo sapiens
aguugauuccucaaguuauga

SEQ ID NO: 1319618 - RNA, 14 nt, Homo sapiens
aguugauuuuacaa

SEQ ID NO: 1319619 - RNA, 22 nt, Homo sapiens
aguugcauagagauuuguauug

SEQ ID NO: 1319620 - RNA, 23 nt, Homo sapiens
aguugcauugauucaguauuaca

SEQ ID NO: 1319621 - RNA, 17 nt, Homo sapiens
aguuggaccagaggaag

SEQ ID NO: 1319622 - RNA, 19 nt, Homo sapiens
aguuggacccauugccagu

SEQ ID NO: 1319623 - RNA, 23 nt, Homo sapiens
aguuggguuaauaccagcuuaaa

SEQ ID NO: 1319624 - RNA, 16 nt, Homo sapiens
auuaacuuacuuccaa

SEQ ID NO: 1319625 - RNA, 20 nt, Homo sapiens
auuaaggucauuacucucaa

SEQ ID NO: 1319626 - RNA, 22 nt, Homo sapiens
auuaagugacuguucaagagca

SEQ ID NO: 1319627 - RNA, 15 nt, Homo sapiens
auuaauaucauuuau

SEQ ID NO: 1319628 - RNA, 17 nt, Homo sapiens
auuaaugaaaagcacaa

SEQ ID NO: 1319629 - RNA, 12 nt, Homo sapiens
auuaauucaccu

SEQ ID NO: 1319630 - RNA, 17 nt, Homo sapiens
auuaauuuucaacucaa

SEQ ID NO: 1319631 - RNA, 17 nt, Homo sapiens
auuacaaauccaaugaa

SEQ ID NO: 1319632 - RNA, 17 nt, Homo sapiens
auuacaacuagaucaag

SEQ ID NO: 1319633 - RNA, 15 nt, Homo sapiens
auuacaggcaccugc

SEQ ID NO: 1319634 - RNA, 19 nt, Homo sapiens
auuacagggaaugccugag

SEQ ID NO: 1319635 - RNA, 15 nt, Homo sapiens
auuacaggugugcac

SEQ ID NO: 1319636 - RNA, 17 nt, Homo sapiens
auuaccucugauaccuc

SEQ ID NO: 1319637 - RNA, 14 nt, Homo sapiens
auuacugcauaaaa

SEQ ID NO: 1319638 - RNA, 20 nt, Homo sapiens
auuacuggaaggcuuccacu

SEQ ID NO: 1319639 - RNA, 14 nt, Homo sapiens
auuacuucugcuac

SEQ ID NO: 1319640 - RNA, 18 nt, Homo sapiens
auuagaaacaacauagca

SEQ ID NO: 1319641 - RNA, 17 nt, Homo sapiens
auuagaauuucauauga

SEQ ID NO: 1319642 - RNA, 22 nt, Homo sapiens
auuagagggagcccagucugga

SEQ ID NO: 1319643 - RNA, 21 nt, Homo sapiens
auuagcugcuucuauguuuca

SEQ ID NO: 1319644 - RNA, 14 nt, Homo sapiens
auuagcuucaggau

SEQ ID NO: 1319645 - RNA, 14 nt, Homo sapiens
auuagugcagccaa

SEQ ID NO: 1319646 - RNA, 19 nt, Homo sapiens
auuaguugccaauaugcca

SEQ ID NO: 1319647 - RNA, 22 nt, Homo sapiens
auuaguuguuuagagaaugaga

SEQ ID NO: 1319648 - RNA, 18 nt, Homo sapiens
auuauaauuaguuccuca

SEQ ID NO: 1319649 - RNA, 17 nt, Homo sapiens
auuauauuugugcuaua

SEQ ID NO: 1319650 - RNA, 18 nt, Homo sapiens
auuaucucacuugugcca

SEQ ID NO: 1319651 - RNA, 18 nt, Homo sapiens
auuaugccauagcaagau

SEQ ID NO: 1319652 - RNA, 20 nt, Homo sapiens
auuauguauaaaauguaaca

SEQ ID NO: 1319653 - RNA, 16 nt, Homo sapiens
auuauuaauacuaugc

SEQ ID NO: 1319654 - RNA, 14 nt, Homo sapiens
auuauuauccuccu

SEQ ID NO: 1319655 - RNA, 19 nt, Homo sapiens
auucaaauugacugaagca

SEQ ID NO: 1319656 - RNA, 14 nt, Homo sapiens
auucaagcauuuag

SEQ ID NO: 1319657 - RNA, 19 nt, Homo sapiens
auucaagggacccaugagu

SEQ ID NO: 1319658 - RNA, 21 nt, Homo sapiens
auucacccccaaacagugaca

SEQ ID NO: 1319659 - RNA, 16 nt, Homo sapiens
auucacucauacaucu

SEQ ID NO: 1319660 - RNA, 19 nt, Homo sapiens
auucagacaaaauggauac

SEQ ID NO: 1319661 - RNA, 15 nt, Homo sapiens
auucagauaauuaga

SEQ ID NO: 1319662 - RNA, 13 nt, Homo sapiens
auucagccuuuag

SEQ ID NO: 1319663 - RNA, 15 nt, Homo sapiens
auucagccuuuagaa

SEQ ID NO: 1319664 - RNA, 18 nt, Homo sapiens
auucaggugcagaggaag

SEQ ID NO: 1319665 - RNA, 15 nt, Homo sapiens
auucagucucugugu

SEQ ID NO: 1319666 - RNA, 17 nt, Homo sapiens
auucagugauuacuguc

SEQ ID NO: 1319667 - RNA, 23 nt, Homo sapiens
auucagugcagcauauacaauaa

SEQ ID NO: 1319668 - RNA, 17 nt, Homo sapiens
auucauacauuaucuca

SEQ ID NO: 1319669 - RNA, 16 nt, Homo sapiens
auucaucucaaggaau

SEQ ID NO: 1319670 - RNA, 15 nt, Homo sapiens
auucauuuaacagag

SEQ ID NO: 1319671 - RNA, 17 nt, Homo sapiens
auuccaaaaagcacaua

SEQ ID NO: 1319672 - RNA, 20 nt, Homo sapiens
auuccagucaaaucugggcu

SEQ ID NO: 1319673 - RNA, 17 nt, Homo sapiens
auucccaacgugcaaag

SEQ ID NO: 1319674 - RNA, 17 nt, Homo sapiens
auucccaagaugccuga

SEQ ID NO: 1319675 - RNA, 11 nt, Homo sapiens
auucccacugc

SEQ ID NO: 1319676 - RNA, 16 nt, Homo sapiens
auuccccugugucauc

SEQ ID NO: 1319677 - RNA, 14 nt, Homo sapiens
auuccgcaccaaua

SEQ ID NO: 1319678 - RNA, 18 nt, Homo sapiens
auuccucagaaaccaaag

SEQ ID NO: 1319679 - RNA, 14 nt, Homo sapiens
auuccuguccuuca

SEQ ID NO: 1319680 - RNA, 21 nt, Homo sapiens
auucgcugcaaccuguugaua

SEQ ID NO: 1319681 - RNA, 14 nt, Homo sapiens
auucuaaaccaauc

SEQ ID NO: 1319682 - RNA, 16 nt, Homo sapiens
auucuaaaccaaucaa

SEQ ID NO: 1319683 - RNA, 16 nt, Homo sapiens
auucuacacagagcag

SEQ ID NO: 1319684 - RNA, 17 nt, Homo sapiens
auucuaguguaacacug

SEQ ID NO: 1319685 - RNA, 21 nt, Homo sapiens
auucuauuuauauguacauga

SEQ ID NO: 1319686 - RNA, 13 nt, Homo sapiens
auucucauuuagu

SEQ ID NO: 1319687 - RNA, 21 nt, Homo sapiens
auucucauuuagugcccucuu

SEQ ID NO: 1319688 - RNA, 16 nt, Homo sapiens
auucucauuugucaca

SEQ ID NO: 1319689 - RNA, 15 nt, Homo sapiens
auucuccugccucag

SEQ ID NO: 1319690 - RNA, 18 nt, Homo sapiens
auucucugagcugugcag

SEQ ID NO: 1319691 - RNA, 16 nt, Homo sapiens
auucugaaucucaaga

SEQ ID NO: 1319692 - RNA, 12 nt, Homo sapiens
auucugacccau

SEQ ID NO: 1319693 - RNA, 15 nt, Homo sapiens
auucugcagccacaa

SEQ ID NO: 1319694 - RNA, 20 nt, Homo sapiens
auucuguguccccucugcau

SEQ ID NO: 1319695 - RNA, 18 nt, Homo sapiens
auucuguuuuuaaugcua

SEQ ID NO: 1319696 - RNA, 13 nt, Homo sapiens
auucuucugcuuc

SEQ ID NO: 1319697 - RNA, 12 nt, Homo sapiens
auucuucuguac

SEQ ID NO: 1319698 - RNA, 21 nt, Homo sapiens
auucuugauuuauuugcuucu

SEQ ID NO: 1319699 - RNA, 22 nt, Homo sapiens
auucuuguuggagacaugggau

SEQ ID NO: 1319700 - RNA, 18 nt, Homo sapiens
auucuuuauucuuuacua

SEQ ID NO: 1319701 - RNA, 15 nt, Homo sapiens
auucuuuuguaauau

SEQ ID NO: 1319702 - RNA, 17 nt, Homo sapiens
auugaaagcuuuuguua

SEQ ID NO: 1319703 - RNA, 21 nt, Homo sapiens
auugaaaggcauucucugaag

SEQ ID NO: 1319704 - RNA, 13 nt, Homo sapiens
auugaagaugaac

SEQ ID NO: 1319705 - RNA, 17 nt, Homo sapiens
auugacaaaaaccagca

SEQ ID NO: 1319706 - RNA, 17 nt, Homo sapiens
auugacagaacacccaa

SEQ ID NO: 1319707 - RNA, 15 nt, Homo sapiens
auugagaacugcaua

SEQ ID NO: 1319708 - RNA, 14 nt, Homo sapiens
auugcacuccaguc

SEQ ID NO: 1319709 - RNA, 20 nt, Homo sapiens
auugcagauaacuuugacuu

SEQ ID NO: 1319710 - RNA, 17 nt, Homo sapiens
auugccuagaggugcuc

SEQ ID NO: 1319711 - RNA, 13 nt, Homo sapiens
auugccuguaaca

SEQ ID NO: 1319712 - RNA, 21 nt, Homo sapiens
auugccuucucaccagcugca

SEQ ID NO: 1319713 - RNA, 19 nt, Homo sapiens
auugccuuuagugaucaca

SEQ ID NO: 1319714 - RNA, 16 nt, Homo sapiens
auugcucuugagucuu

SEQ ID NO: 1319715 - RNA, 13 nt, Homo sapiens
auugcuguuucag

SEQ ID NO: 1319716 - RNA, 16 nt, Homo sapiens
auuggaccagugcucu

SEQ ID NO: 1319717 - RNA, 21 nt, Homo sapiens
auuggaggggcuggcacugga

SEQ ID NO: 1319718 - RNA, 15 nt, Homo sapiens
auugguaugaugcug

SEQ ID NO: 1319719 - RNA, 11 nt, Homo sapiens
auuguaaaaaa

SEQ ID NO: 1319720 - RNA, 18 nt, Homo sapiens
auuguacauaaguaccuc

SEQ ID NO: 1319721 - RNA, 20 nt, Homo sapiens
auuguaguccuguaauggaa

SEQ ID NO: 1319722 - RNA, 19 nt, Homo sapiens
auuguaucaaaugugacau

SEQ ID NO: 1319723 - RNA, 20 nt, Homo sapiens
auuguaucaaaugugacauu

SEQ ID NO: 1319724 - RNA, 21 nt, Homo sapiens
auugucucuagagauugucag

SEQ ID NO: 1319725 - RNA, 18 nt, Homo sapiens
auugucucugugacugaa

SEQ ID NO: 1319726 - RNA, 17 nt, Homo sapiens
auugugagacacuaaaa

SEQ ID NO: 1319727 - RNA, 17 nt, Homo sapiens
auuguguuacucaugau

SEQ ID NO: 1319728 - RNA, 16 nt, Homo sapiens
auuguuaaaauaacua

SEQ ID NO: 1319729 - RNA, 18 nt, Homo sapiens
auuguucuuguaagcuuu

SEQ ID NO: 1319730 - RNA, 16 nt, Homo sapiens
auuguuuacaggauau

SEQ ID NO: 1319731 - RNA, 20 nt, Homo sapiens
auuguuuuguguaacauauu

SEQ ID NO: 1319732 - RNA, 23 nt, Homo sapiens
auuuaaauuacaauuuuaucugu

SEQ ID NO: 1319733 - RNA, 17 nt, Homo sapiens
auuuaaucaccacucaa

SEQ ID NO: 1319734 - RNA, 20 nt, Homo sapiens
auuuaaucaccacucaaaaa

SEQ ID NO: 1319735 - RNA, 20 nt, Homo sapiens
auuuaauuuagauauuuucc

SEQ ID NO: 1319736 - RNA, 23 nt, Homo sapiens
auuuccugugucuuuuuucacua

SEQ ID NO: 1319737 - RNA, 21 nt, Homo sapiens
auuucucccuuguccaaaguc

SEQ ID NO: 1319738 - RNA, 19 nt, Homo sapiens
auuucuccuccaugggaga

SEQ ID NO: 1319739 - RNA, 20 nt, Homo sapiens
auuucugugcccuccugacc

SEQ ID NO: 1319740 - RNA, 13 nt, Homo sapiens
auuucuguguugc

SEQ ID NO: 1319741 - RNA, 20 nt, Homo sapiens
auuucuuaaacacuugcaac

SEQ ID NO: 1319742 - RNA, 17 nt, Homo sapiens
auuugaagaacauguga

SEQ ID NO: 1319743 - RNA, 14 nt, Homo sapiens
auuugaugcauguc

SEQ ID NO: 1319744 - RNA, 15 nt, Homo sapiens
auuugcaacauuaga

SEQ ID NO: 1319745 - RNA, 21 nt, Homo sapiens
auuugcaagggaaaagucucu

SEQ ID NO: 1319746 - RNA, 16 nt, Homo sapiens
auuugcauuaaauuca

SEQ ID NO: 1319747 - RNA, 21 nt, Homo sapiens
auuuggaggcaauccuaccuu

SEQ ID NO: 1319748 - RNA, 18 nt, Homo sapiens
auuuggguauagacaaua

SEQ ID NO: 1319749 - RNA, 17 nt, Homo sapiens
auuugguacaaaaccac

SEQ ID NO: 1319750 - RNA, 21 nt, Homo sapiens
auuuguauaacgguuuaauuc

SEQ ID NO: 1319751 - RNA, 20 nt, Homo sapiens
auuugugcuagaaauuuuca

SEQ ID NO: 1319752 - RNA, 14 nt, Homo sapiens
auuuuaacucuguc

SEQ ID NO: 1319753 - RNA, 21 nt, Homo sapiens
auuuuaaugaagaaaguggaa

SEQ ID NO: 1319754 - RNA, 17 nt, Homo sapiens
auuuuaauuuguauuga

SEQ ID NO: 1319755 - RNA, 14 nt, Homo sapiens
auuuuacacaaaua

SEQ ID NO: 1319756 - RNA, 13 nt, Homo sapiens
auuuuacauuucu

SEQ ID NO: 1319757 - RNA, 14 nt, Homo sapiens
auuuuagaugccug

SEQ ID NO: 1319758 - RNA, 18 nt, Homo sapiens
auuuuagcagagacuuua

SEQ ID NO: 1319759 - RNA, 14 nt, Homo sapiens
auuuuagccuuuau

SEQ ID NO: 1319760 - RNA, 18 nt, Homo sapiens
auuuuagugaacuugaaa

SEQ ID NO: 1319761 - RNA, 14 nt, Homo sapiens
auuuuauagcuacu

SEQ ID NO: 1319762 - RNA, 18 nt, Homo sapiens
auuuuauuacaucuuuca

SEQ ID NO: 1319763 - RNA, 14 nt, Homo sapiens
auuuucaaggccuu

SEQ ID NO: 1319764 - RNA, 18 nt, Homo sapiens
auuuucaagucuguguuc

SEQ ID NO: 1319765 - RNA, 14 nt, Homo sapiens
auuuucagcauuaa

SEQ ID NO: 1319766 - RNA, 22 nt, Homo sapiens
auuuucuacuugccagcagagu

SEQ ID NO: 1319767 - RNA, 20 nt, Homo sapiens
auuuucuguggaucauuucc

SEQ ID NO: 1319768 - RNA, 21 nt, Homo sapiens
auuuucuuacacugugucauu

SEQ ID NO: 1319769 - RNA, 23 nt, Homo sapiens
auuuugaaaaaaaauuucaaaaa

SEQ ID NO: 1319770 - RNA, 17 nt, Homo sapiens
auuuugauauaccaugu

SEQ ID NO: 1319771 - RNA, 15 nt, Homo sapiens
auuuugauccaagcu

SEQ ID NO: 1319772 - RNA, 11 nt, Homo sapiens
auuuugcacug

SEQ ID NO: 1319773 - RNA, 20 nt, Homo sapiens
auuuuggagaguuuccugaa

SEQ ID NO: 1319774 - RNA, 17 nt, Homo sapiens
auuuugguuuguguauc

SEQ ID NO: 1319775 - RNA, 20 nt, Homo sapiens
auuuugucaccagaacacaa

SEQ ID NO: 1319776 - RNA, 14 nt, Homo sapiens
auuuuucaaagcaa

SEQ ID NO: 1319777 - RNA, 14 nt, Homo sapiens
auuuuuuugcaagu

SEQ ID NO: 1319778 - RNA, 17 nt, Homo sapiens
caaaaaaacagacccac

SEQ ID NO: 1319779 - RNA, 16 nt, Homo sapiens
caaaaaaagaaaaaga

SEQ ID NO: 1319780 - RNA, 21 nt, Homo sapiens
caaaaaaauuaaaauggaugc

SEQ ID NO: 1319781 - RNA, 15 nt, Homo sapiens
caaaaaaauugugcc

SEQ ID NO: 1319782 - RNA, 24 nt, Homo sapiens
caaaaaacauuguuuuguguaaca

SEQ ID NO: 1319783 - RNA, 19 nt, Homo sapiens
caaaaaagaacaagcucau

SEQ ID NO: 1319784 - RNA, 23 nt, Homo sapiens
caaaaacauguaugugcauuuca

SEQ ID NO: 1319785 - RNA, 15 nt, Homo sapiens
caaaaauauauucau

SEQ ID NO: 1319786 - RNA, 15 nt, Homo sapiens
caaaaaugcacccaa

SEQ ID NO: 1319787 - RNA, 22 nt, Homo sapiens
caaaaaugcacccaacuagcuc

SEQ ID NO: 1319788 - RNA, 17 nt, Homo sapiens
caaaaauugucccuuaa

SEQ ID NO: 1319789 - RNA, 13 nt, Homo sapiens
caaaaccagugaa

SEQ ID NO: 1319790 - RNA, 14 nt, Homo sapiens
caaaacuacaugag

SEQ ID NO: 1319791 - RNA, 20 nt, Homo sapiens
caaaacugauacccuuugaa

SEQ ID NO: 1319792 - RNA, 13 nt, Homo sapiens
caaaacugucauc

SEQ ID NO: 1319793 - RNA, 16 nt, Homo sapiens
caaaagucuggccuuu

SEQ ID NO: 1319794 - RNA, 20 nt, Homo sapiens
caaaaucaugccauugcacu

SEQ ID NO: 1319795 - RNA, 18 nt, Homo sapiens
caaaaugauacuuacuga

SEQ ID NO: 1319796 - RNA, 20 nt, Homo sapiens
caaacaaagccagaagcuga

SEQ ID NO: 1319797 - RNA, 20 nt, Homo sapiens
caaacaauaguaauucucag

SEQ ID NO: 1319798 - RNA, 18 nt, Homo sapiens
caaacacaaaaaucauua

SEQ ID NO: 1319799 - RNA, 20 nt, Homo sapiens
caaacacugcaggcaucaca

SEQ ID NO: 1319800 - RNA, 20 nt, Homo sapiens
caaacauguuguacauuuca

SEQ ID NO: 1319801 - RNA, 20 nt, Homo sapiens
caaaccugccucccauucua

SEQ ID NO: 1319802 - RNA, 22 nt, Homo sapiens
caaaccuucugccuuugauguu

SEQ ID NO: 1319803 - RNA, 23 nt, Homo sapiens
caaacuggggccuccagaacuca

SEQ ID NO: 1319804 - RNA, 19 nt, Homo sapiens
caaagaagaguuaagaaga

SEQ ID NO: 1319805 - RNA, 23 nt, Homo sapiens
caaagcaaggaaacuauguaaca

SEQ ID NO: 1319806 - RNA, 20 nt, Homo sapiens
caaagcaggggaguaugcaa

SEQ ID NO: 1319807 - RNA, 23 nt, Homo sapiens
caaagcagggucugggcaggacu

SEQ ID NO: 1319808 - RNA, 14 nt, Homo sapiens
caaagccacacucu

SEQ ID NO: 1319809 - RNA, 13 nt, Homo sapiens
caaagcguggaca

SEQ ID NO: 1319810 - RNA, 22 nt, Homo sapiens
caaagcuuucauguaaacugug

SEQ ID NO: 1319811 - RNA, 13 nt, Homo sapiens
caaaggaacacug

SEQ ID NO: 1319812 - RNA, 16 nt, Homo sapiens
caaaggaacacugaca

SEQ ID NO: 1319813 - RNA, 17 nt, Homo sapiens
caaaggaacacugacau

SEQ ID NO: 1319814 - RNA, 15 nt, Homo sapiens
caaaggacagaucca

SEQ ID NO: 1319815 - RNA, 16 nt, Homo sapiens
caaaggacagauccag

SEQ ID NO: 1319816 - RNA, 18 nt, Homo sapiens
caaaggcguauguauuaa

SEQ ID NO: 1319817 - RNA, 14 nt, Homo sapiens
caaagggcaugggu

SEQ ID NO: 1319818 - RNA, 20 nt, Homo sapiens
caaagggcaugggucgggag

SEQ ID NO: 1319819 - RNA, 15 nt, Homo sapiens
caaaguaacagccuu

SEQ ID NO: 1319820 - RNA, 16 nt, Homo sapiens
caaagucaugcaaagg

SEQ ID NO: 1319821 - RNA, 23 nt, Homo sapiens
caaagucccaggcccagugcagu

SEQ ID NO: 1319822 - RNA, 18 nt, Homo sapiens
caaaguccuuuuuuucca

SEQ ID NO: 1319823 - RNA, 11 nt, Homo sapiens
caaagugcugg

SEQ ID NO: 1319824 - RNA, 23 nt, Homo sapiens
caaaguuaugcaagggacugugu

SEQ ID NO: 1319825 - RNA, 20 nt, Homo sapiens
caaaguuguauguggcauga

SEQ ID NO: 1319826 - RNA, 14 nt, Homo sapiens
caaauaaaaaccca

SEQ ID NO: 1319827 - RNA, 15 nt, Homo sapiens
caaauaaaugaacug

SEQ ID NO: 1319828 - RNA, 16 nt, Homo sapiens
caaauaaguuacaucu

SEQ ID NO: 1319829 - RNA, 14 nt, Homo sapiens
caaauaauuggcau

SEQ ID NO: 1319830 - RNA, 20 nt, Homo sapiens
caaauauuuagcaucuuccu

SEQ ID NO: 1319831 - RNA, 16 nt, Homo sapiens
caaauccuaugugauu

SEQ ID NO: 1319832 - RNA, 20 nt, Homo sapiens
caaaucugagggagcugagu

SEQ ID NO: 1319833 - RNA, 17 nt, Homo sapiens
caaaucuggaagccaaa

SEQ ID NO: 1319834 - RNA, 13 nt, Homo sapiens
caaauggacauag

SEQ ID NO: 1319835 - RNA, 20 nt, Homo sapiens
caaauggacauaggacucaa

SEQ ID NO: 1319836 - RNA, 12 nt, Homo sapiens
caaaugucauca

SEQ ID NO: 1319837 - RNA, 22 nt, Homo sapiens
caaauucuaccuuauuuuacag

SEQ ID NO: 1319838 - RNA, 17 nt, Homo sapiens
caaauucuuuugaauug

SEQ ID NO: 1319839 - RNA, 16 nt, Homo sapiens
caaauugcagacugug

SEQ ID NO: 1319840 - RNA, 23 nt, Homo sapiens
caaauuuuucacccauuuacaca

SEQ ID NO: 1319841 - RNA, 18 nt, Homo sapiens
caacaaacuuaggaauaa

SEQ ID NO: 1319842 - RNA, 14 nt, Homo sapiens
caacaacaccagaa

SEQ ID NO: 1319843 - RNA, 22 nt, Homo sapiens
caacaagcaagcucccaaggga

SEQ ID NO: 1319844 - RNA, 18 nt, Homo sapiens
caacacccaaguugaaga

SEQ ID NO: 1319845 - RNA, 17 nt, Homo sapiens
caacacugggaaacaga

SEQ ID NO: 1319846 - RNA, 19 nt, Homo sapiens
aucuuauacuguacaauaa

SEQ ID NO: 1319847 - RNA, 17 nt, Homo sapiens
aucuuaucauggucuca

SEQ ID NO: 1319848 - RNA, 20 nt, Homo sapiens
aucuuauucuuuuguaauau

SEQ ID NO: 1319849 - RNA, 21 nt, Homo sapiens
aucuucagggaacugcauaga

SEQ ID NO: 1319850 - RNA, 14 nt, Homo sapiens
aucuucaguuuaau

SEQ ID NO: 1319851 - RNA, 18 nt, Homo sapiens
aucuucaguuuaaugcaa

SEQ ID NO: 1319852 - RNA, 22 nt, Homo sapiens
aucuucgggaccaggauuugca

SEQ ID NO: 1319853 - RNA, 16 nt, Homo sapiens
aucuucuguaccaaaa

SEQ ID NO: 1319854 - RNA, 17 nt, Homo sapiens
aucuugcucugcugaca

SEQ ID NO: 1319855 - RNA, 15 nt, Homo sapiens
aucuuguacauuaua

SEQ ID NO: 1319856 - RNA, 15 nt, Homo sapiens
aucuuguuuuuccac

SEQ ID NO: 1319857 - RNA, 21 nt, Homo sapiens
aucuuuacaaaacuacaugag

SEQ ID NO: 1319858 - RNA, 22 nt, Homo sapiens
aucuuugcuuuauaaaagaaca

SEQ ID NO: 1319859 - RNA, 17 nt, Homo sapiens
aucuuuuagacacagcc

SEQ ID NO: 1319860 - RNA, 17 nt, Homo sapiens
augaaaauaaaacauuu

SEQ ID NO: 1319861 - RNA, 15 nt, Homo sapiens
augaaauggagucau

SEQ ID NO: 1319862 - RNA, 22 nt, Homo sapiens
augaacauaaucuaccaacgaa

SEQ ID NO: 1319863 - RNA, 12 nt, Homo sapiens
augaaccacugc

SEQ ID NO: 1319864 - RNA, 19 nt, Homo sapiens
augaaccccuggcuccuuc

SEQ ID NO: 1319865 - RNA, 21 nt, Homo sapiens
augaagaauauaccauuucaa

SEQ ID NO: 1319866 - RNA, 17 nt, Homo sapiens
ccaugcauucaccugcc

SEQ ID NO: 1319867 - RNA, 13 nt, Homo sapiens
ccauggcacugag

SEQ ID NO: 1319868 - RNA, 21 nt, Homo sapiens
ccaugguacuccaugcauuca

SEQ ID NO: 1319869 - RNA, 18 nt, Homo sapiens
ccauguaaucagauuuau

SEQ ID NO: 1319870 - RNA, 15 nt, Homo sapiens
ccauguagaagcugc

SEQ ID NO: 1319871 - RNA, 22 nt, Homo sapiens
ccauguagaagcugcaucuugu

SEQ ID NO: 1319872 - RNA, 17 nt, Homo sapiens
ccauuagaauagucaua

SEQ ID NO: 1319873 - RNA, 13 nt, Homo sapiens
ccauuaucaguca

SEQ ID NO: 1319874 - RNA, 18 nt, Homo sapiens
ccauucaagucuuucuaa

SEQ ID NO: 1319875 - RNA, 14 nt, Homo sapiens
ccauucacagagcc

SEQ ID NO: 1319876 - RNA, 14 nt, Homo sapiens
ccauucugcauuua

SEQ ID NO: 1319877 - RNA, 15 nt, Homo sapiens
ccauucugcauuuag

SEQ ID NO: 1319878 - RNA, 22 nt, Homo sapiens
ccauugcucuucuuuugaaaau

SEQ ID NO: 1319879 - RNA, 13 nt, Homo sapiens
ccauugugaacca

SEQ ID NO: 1319880 - RNA, 16 nt, Homo sapiens
ccauugugaaccaaug

SEQ ID NO: 1319881 - RNA, 15 nt, Homo sapiens
ccauuucucugggac

SEQ ID NO: 1319882 - RNA, 17 nt, Homo sapiens
ccauuucugagaucaaa

SEQ ID NO: 1319883 - RNA, 20 nt, Homo sapiens
ccauuugcccuccuccucag

SEQ ID NO: 1319884 - RNA, 19 nt, Homo sapiens
ccauuugcguuccaugaug

SEQ ID NO: 1319885 - RNA, 17 nt, Homo sapiens
cccaaaacugucauccu

SEQ ID NO: 1319886 - RNA, 20 nt, Homo sapiens
cccaaaauuagggagcucuu

SEQ ID NO: 1319887 - RNA, 23 nt, Homo sapiens
cccaaaggaacacugacaucaau

SEQ ID NO: 1319888 - RNA, 14 nt, Homo sapiens
cccaaauccagugu

SEQ ID NO: 1319889 - RNA, 13 nt, Homo sapiens
cccaaaugcucuc

SEQ ID NO: 1319890 - RNA, 17 nt, Homo sapiens
cccaacgugcaaagcca

SEQ ID NO: 1319891 - RNA, 17 nt, Homo sapiens
cccaacuucgccagccu

SEQ ID NO: 1319892 - RNA, 16 nt, Homo sapiens
cccaagaaauguaaua

SEQ ID NO: 1319893 - RNA, 11 nt, Homo sapiens
cccaagggaaa

SEQ ID NO: 1319894 - RNA, 21 nt, Homo sapiens
cccaaguaagaggcuggaguu

SEQ ID NO: 1319895 - RNA, 17 nt, Homo sapiens
cccaagugccaagacac

SEQ ID NO: 1319896 - RNA, 16 nt, Homo sapiens
cccaauaaaauucuga

SEQ ID NO: 1319897 - RNA, 13 nt, Homo sapiens
cccaauaauugca

SEQ ID NO: 1319898 - RNA, 17 nt, Homo sapiens
cccaauauuuaccagac

SEQ ID NO: 1319899 - RNA, 15 nt, Homo sapiens
cccaaucaccuuucc

SEQ ID NO: 1319900 - RNA, 22 nt, Homo sapiens
cccacacccuggaggauuucau

SEQ ID NO: 1319901 - RNA, 14 nt, Homo sapiens
cccacauugcacuu

SEQ ID NO: 1319902 - RNA, 14 nt, Homo sapiens
cccacccugggacc

SEQ ID NO: 1319903 - RNA, 21 nt, Homo sapiens
cccacgauugguaugaugcug

SEQ ID NO: 1319904 - RNA, 17 nt, Homo sapiens
cccacuuucuucuacca

SEQ ID NO: 1319905 - RNA, 13 nt, Homo sapiens
cccagacacuggc

SEQ ID NO: 1319906 - RNA, 21 nt, Homo sapiens
cccagaccuguuagcagacag

SEQ ID NO: 1319907 - RNA, 20 nt, Homo sapiens
cccagagaggguggugaccu

SEQ ID NO: 1319908 - RNA, 16 nt, Homo sapiens
cccagagucaucugau

SEQ ID NO: 1319909 - RNA, 18 nt, Homo sapiens
cccagaguccucuaugaa

SEQ ID NO: 1319910 - RNA, 22 nt, Homo sapiens
cccagagugcugggauuacaau

SEQ ID NO: 1319911 - RNA, 12 nt, Homo sapiens
cccagaucucau

SEQ ID NO: 1319912 - RNA, 17 nt, Homo sapiens
cccagauucuucagcuu

SEQ ID NO: 1319913 - RNA, 14 nt, Homo sapiens
cccagcacugagga

SEQ ID NO: 1319914 - RNA, 20 nt, Homo sapiens
cccagcagcuccuguggcca

SEQ ID NO: 1319915 - RNA, 14 nt, Homo sapiens
cccagccaccgaag

SEQ ID NO: 1319916 - RNA, 21 nt, Homo sapiens
cccagccuccugcucaucccu

SEQ ID NO: 1319917 - RNA, 15 nt, Homo sapiens
cccagcgagcucuca

SEQ ID NO: 1319918 - RNA, 18 nt, Homo sapiens
cccagcuaagaaccugga

SEQ ID NO: 1319919 - RNA, 18 nt, Homo sapiens
cccagcuaccucaaccaa

SEQ ID NO: 1319920 - RNA, 14 nt, Homo sapiens
cccaggaccagcuc

SEQ ID NO: 1319921 - RNA, 24 nt, Homo sapiens
cccaggaguggauaacacuggcuu

SEQ ID NO: 1319922 - RNA, 19 nt, Homo sapiens
cccaggaucagauugcaug

SEQ ID NO: 1319923 - RNA, 22 nt, Homo sapiens
cccaggcccagaccuucuagga

SEQ ID NO: 1319924 - RNA, 15 nt, Homo sapiens
cccaggcugggaacu

SEQ ID NO: 1319925 - RNA, 15 nt, Homo sapiens
cccaggcugggugca

SEQ ID NO: 1319926 - RNA, 18 nt, Homo sapiens
cccaggguggagugcagu

SEQ ID NO: 1319927 - RNA, 19 nt, Homo sapiens
cccaggucucuccacugcu

SEQ ID NO: 1319928 - RNA, 16 nt, Homo sapiens
cccaggugaguccuag

SEQ ID NO: 1319929 - RNA, 19 nt, Homo sapiens
cccagucacugugagcucc

SEQ ID NO: 1319930 - RNA, 17 nt, Homo sapiens
cccagugcccccacuga

SEQ ID NO: 1319931 - RNA, 20 nt, Homo sapiens
cccagugcccccacugacca

SEQ ID NO: 1319932 - RNA, 22 nt, Homo sapiens
cccaguucacccugauuuagga

SEQ ID NO: 1319933 - RNA, 17 nt, Homo sapiens
cccauaucugugaaaug

SEQ ID NO: 1319934 - RNA, 12 nt, Homo sapiens
cccaucuugaua

SEQ ID NO: 1319935 - RNA, 22 nt, Homo sapiens
cccaugccgacggggacugcuu

SEQ ID NO: 1319936 - RNA, 14 nt, Homo sapiens
cccaugggacaaau

SEQ ID NO: 1319937 - RNA, 17 nt, Homo sapiens
cccaugggagauuugga

SEQ ID NO: 1319938 - RNA, 22 nt, Homo sapiens
cccaugggcuaucaacuuaaua

SEQ ID NO: 1319939 - RNA, 20 nt, Homo sapiens
cccaugugcacaagugugca

SEQ ID NO: 1319940 - RNA, 14 nt, Homo sapiens
cccauugccaguga

SEQ ID NO: 1319941 - RNA, 22 nt, Homo sapiens
ccccacgauugguaugaugcug

SEQ ID NO: 1319942 - RNA, 12 nt, Homo sapiens
ccccacugacca

SEQ ID NO: 1319943 - RNA, 12 nt, Homo sapiens
ccccagcacuug

SEQ ID NO: 1319944 - RNA, 14 nt, Homo sapiens
ccccagcccagaga

SEQ ID NO: 1319945 - RNA, 19 nt, Homo sapiens
ccccagcccagagacauac

SEQ ID NO: 1319946 - RNA, 15 nt, Homo sapiens
ccccaggcauugcca

SEQ ID NO: 1319947 - RNA, 16 nt, Homo sapiens
ccccaggccccaggaa

SEQ ID NO: 1319948 - RNA, 16 nt, Homo sapiens
ccccaggccugagcug

SEQ ID NO: 1319949 - RNA, 21 nt, Homo sapiens
ccccaggugcagugugacauu

SEQ ID NO: 1319950 - RNA, 16 nt, Homo sapiens
ccccauaguucacuga

SEQ ID NO: 1319951 - RNA, 17 nt, Homo sapiens
ccccaucuucgggacca

SEQ ID NO: 1319952 - RNA, 15 nt, Homo sapiens
cccccagcacugagg

SEQ ID NO: 1319953 - RNA, 14 nt, Homo sapiens
cccccuaagcuucu

SEQ ID NO: 1319954 - RNA, 21 nt, Homo sapiens
cccccucagugaggaucuuca

SEQ ID NO: 1319955 - RNA, 21 nt, Homo sapiens
cccccuccaggccaguuugaa

SEQ ID NO: 1319956 - RNA, 23 nt, Homo sapiens
cccccuccucugaaacagcugcc

SEQ ID NO: 1319957 - RNA, 14 nt, Homo sapiens
cccccugggcugag

SEQ ID NO: 1319958 - RNA, 14 nt, Homo sapiens
ccccgcuggugacc

SEQ ID NO: 1319959 - RNA, 17 nt, Homo sapiens
ccccggggugcccacag

SEQ ID NO: 1319960 - RNA, 15 nt, Homo sapiens
ccccucagagugcaa

SEQ ID NO: 1319961 - RNA, 16 nt, Homo sapiens
ccccuccuccacucuc

SEQ ID NO: 1319962 - RNA, 17 nt, Homo sapiens
ccccucucguguuugau

SEQ ID NO: 1319963 - RNA, 20 nt, Homo sapiens
ccccugcugucucucugggc

SEQ ID NO: 1319964 - RNA, 16 nt, Homo sapiens
ccccuuguuguaaaaa

SEQ ID NO: 1319965 - RNA, 15 nt, Homo sapiens
ccccuuuacuccucg

SEQ ID NO: 1319966 - RNA, 22 nt, Homo sapiens
ccccuuuuggggaucaccucuc

SEQ ID NO: 1319967 - RNA, 20 nt, Homo sapiens
ccuggccaauacggcaaaac

SEQ ID NO: 1319968 - RNA, 13 nt, Homo sapiens
ccuggccagacac

SEQ ID NO: 1319969 - RNA, 13 nt, Homo sapiens
ccugggacaucag

SEQ ID NO: 1319970 - RNA, 14 nt, Homo sapiens
ccugggacuuccau

SEQ ID NO: 1319971 - RNA, 14 nt, Homo sapiens
ccugggcaaagccu

SEQ ID NO: 1319972 - RNA, 15 nt, Homo sapiens
ccugggcaaugugau

SEQ ID NO: 1319973 - RNA, 19 nt, Homo sapiens
ccuggggagucugggcaca

SEQ ID NO: 1319974 - RNA, 20 nt, Homo sapiens
ccuggggcuagggggagccc

SEQ ID NO: 1319975 - RNA, 16 nt, Homo sapiens
ccugggggugccagga

SEQ ID NO: 1319976 - RNA, 22 nt, Homo sapiens
ccugggugacagagcaagugag

SEQ ID NO: 1319977 - RNA, 16 nt, Homo sapiens
ccugguacucaagccc

SEQ ID NO: 1319978 - RNA, 11 nt, Homo sapiens
ccuggucaguc

SEQ ID NO: 1319979 - RNA, 15 nt, Homo sapiens
ccuggugcugcugcu

SEQ ID NO: 1319980 - RNA, 15 nt, Homo sapiens
ccugguucugaugau

SEQ ID NO: 1319981 - RNA, 12 nt, Homo sapiens
ccuguaacacau

SEQ ID NO: 1319982 - RNA, 17 nt, Homo sapiens
ccuguagcagucacuga

SEQ ID NO: 1319983 - RNA, 15 nt, Homo sapiens
ccuguagcucaagag

SEQ ID NO: 1319984 - RNA, 19 nt, Homo sapiens
ccuguauuuaacaaaaagu

SEQ ID NO: 1319985 - RNA, 15 nt, Homo sapiens
ccugucaacauuugg

SEQ ID NO: 1319986 - RNA, 16 nt, Homo sapiens
ccuguccacacccagc

SEQ ID NO: 1319987 - RNA, 23 nt, Homo sapiens
ccuguccuccaacaccaagcaca

SEQ ID NO: 1319988 - RNA, 18 nt, Homo sapiens
ccuguccugaaagccaca

SEQ ID NO: 1319989 - RNA, 18 nt, Homo sapiens
ccugucuuucagcauuca

SEQ ID NO: 1319990 - RNA, 13 nt, Homo sapiens
ccugugagcucaa

SEQ ID NO: 1319991 - RNA, 13 nt, Homo sapiens
ccugugcaaaaaa

SEQ ID NO: 1319992 - RNA, 18 nt, Homo sapiens
ccugugcaacuuucccaa

SEQ ID NO: 1319993 - RNA, 12 nt, Homo sapiens
ccuguggaugag

SEQ ID NO: 1319994 - RNA, 18 nt, Homo sapiens
ccuguggucucugaccag

SEQ ID NO: 1319995 - RNA, 14 nt, Homo sapiens
ccuguguacuuccc

SEQ ID NO: 1319996 - RNA, 15 nt, Homo sapiens
ccugugucaucccau

SEQ ID NO: 1319997 - RNA, 18 nt, Homo sapiens
ccuguguugugcucagga

SEQ ID NO: 1319998 - RNA, 17 nt, Homo sapiens
ccuguucugaacugugg

SEQ ID NO: 1319999 - RNA, 16 nt, Homo sapiens
ccuguugaaaugugaa

SEQ ID NO: 1320000 - RNA, 20 nt, Homo sapiens
ccuguuucuaccuauaugca

SEQ ID NO: 1320001 - RNA, 15 nt, Homo sapiens
ccuuaaaccuaccuc

SEQ ID NO: 1320002 - RNA, 21 nt, Homo sapiens
ccuuacaguaaaguauagaaa

SEQ ID NO: 1320003 - RNA, 18 nt, Homo sapiens
ccuuagaaauuagugcca

SEQ ID NO: 1320004 - RNA, 23 nt, Homo sapiens
ccuuagaacuuugcauagcagcu

SEQ ID NO: 1320005 - RNA, 20 nt, Homo sapiens
ccuuagcagggaaacagcua

SEQ ID NO: 1320006 - RNA, 14 nt, Homo sapiens
ccuuaucugugcuc

SEQ ID NO: 1320007 - RNA, 13 nt, Homo sapiens
ccuuaugcuucuu

SEQ ID NO: 1320008 - RNA, 14 nt, Homo sapiens
ccuuauuguaccuc

SEQ ID NO: 1320009 - RNA, 21 nt, Homo sapiens
ccuuauuguaccucucuuaua

SEQ ID NO: 1320010 - RNA, 13 nt, Homo sapiens
ccuucagagccag

SEQ ID NO: 1320011 - RNA, 12 nt, Homo sapiens
ccuucagccuua

SEQ ID NO: 1320012 - RNA, 22 nt, Homo sapiens
ccuucaucaugaguucugcuga

SEQ ID NO: 1320013 - RNA, 22 nt, Homo sapiens
ccuucaugaucaucacaaucau

SEQ ID NO: 1320014 - RNA, 14 nt, Homo sapiens
ccuucauugccaca

SEQ ID NO: 1320015 - RNA, 12 nt, Homo sapiens
ccuuccacugag

SEQ ID NO: 1320016 - RNA, 13 nt, Homo sapiens
ccuucccaugacc

SEQ ID NO: 1320017 - RNA, 14 nt, Homo sapiens
ccuuccgaugacag

SEQ ID NO: 1320018 - RNA, 16 nt, Homo sapiens
ccuuccuaagacuucu

SEQ ID NO: 1320019 - RNA, 14 nt, Homo sapiens
ccuuccuggccuga

SEQ ID NO: 1320020 - RNA, 21 nt, Homo sapiens
ccuucgggcugugcccgggga

SEQ ID NO: 1320021 - RNA, 19 nt, Homo sapiens
ccuucuccauccacauggg

SEQ ID NO: 1320022 - RNA, 14 nt, Homo sapiens
ccuucucuacccau

SEQ ID NO: 1320023 - RNA, 16 nt, Homo sapiens
ccuucucucacugugu

SEQ ID NO: 1320024 - RNA, 20 nt, Homo sapiens
ccuucugugcuucagcucuu

SEQ ID NO: 1320025 - RNA, 21 nt, Homo sapiens
ccuucuuaggugacaaugucc

SEQ ID NO: 1320026 - RNA, 17 nt, Homo sapiens
ccuugacuuugcuccuc

SEQ ID NO: 1320027 - RNA, 18 nt, Homo sapiens
ccuugcccccauuucacc

SEQ ID NO: 1320028 - RNA, 17 nt, Homo sapiens
ccuuggcacccaagacc

SEQ ID NO: 1320029 - RNA, 22 nt, Homo sapiens
ccuuggcuuuuacugaagccuu

SEQ ID NO: 1320030 - RNA, 17 nt, Homo sapiens
ccuuggggucacuccuu

SEQ ID NO: 1320031 - RNA, 21 nt, Homo sapiens
ccuugguaggggacuaauuca

SEQ ID NO: 1320032 - RNA, 14 nt, Homo sapiens
ccuugguguucaaa

SEQ ID NO: 1320033 - RNA, 19 nt, Homo sapiens
ccuugguucccccacugau

SEQ ID NO: 1320034 - RNA, 12 nt, Homo sapiens
ccuugugaccca

SEQ ID NO: 1320035 - RNA, 14 nt, Homo sapiens
ccuugugacccagg

SEQ ID NO: 1320036 - RNA, 16 nt, Homo sapiens
ccuuguuacccaugaa

SEQ ID NO: 1320037 - RNA, 19 nt, Homo sapiens
ccuuguuauuuaacccauu

SEQ ID NO: 1320038 - RNA, 20 nt, Homo sapiens
ccuuucaccacaugugcaca

SEQ ID NO: 1320039 - RNA, 19 nt, Homo sapiens
ccuuucauggucugcugag

SEQ ID NO: 1320040 - RNA, 22 nt, Homo sapiens
ccuuuccaaaugcccagcuuaa

SEQ ID NO: 1320041 - RNA, 18 nt, Homo sapiens
ccuuuccuuuucuuuaaa

SEQ ID NO: 1320042 - RNA, 18 nt, Homo sapiens
ccuuucuccuuuguacuu

SEQ ID NO: 1320043 - RNA, 18 nt, Homo sapiens
ccuuugaccccagcagcu

SEQ ID NO: 1320044 - RNA, 14 nt, Homo sapiens
ccuuuguacuuugu

SEQ ID NO: 1320045 - RNA, 15 nt, Homo sapiens
ccuuuguacuuugug

SEQ ID NO: 1320046 - RNA, 16 nt, Homo sapiens
ccuuuguugcacaaau

SEQ ID NO: 1320047 - RNA, 17 nt, Homo sapiens
ccuuuuacauacugcug

SEQ ID NO: 1320048 - RNA, 14 nt, Homo sapiens
ccuuuuaugugguc

SEQ ID NO: 1320049 - RNA, 21 nt, Homo sapiens
ccuuuucuuuguucaagauga

SEQ ID NO: 1320050 - RNA, 21 nt, Homo sapiens
ccuuuuuuguuuuuucaaaau

SEQ ID NO: 1320051 - RNA, 19 nt, Homo sapiens
cgaaaaagagguagcacua

SEQ ID NO: 1320052 - RNA, 21 nt, Homo sapiens
cgaaagacgugauucaauuca

SEQ ID NO: 1320053 - RNA, 12 nt, Homo sapiens
cgaaaguggaaa

SEQ ID NO: 1320054 - RNA, 15 nt, Homo sapiens
cgaaggauauuguca

SEQ ID NO: 1320055 - RNA, 18 nt, Homo sapiens
cgaaugguuccauucucu

SEQ ID NO: 1320056 - RNA, 17 nt, Homo sapiens
cgacuaauuucaaaaug

SEQ ID NO: 1320057 - RNA, 18 nt, Homo sapiens
cgacuuucugccuggagu

SEQ ID NO: 1320058 - RNA, 14 nt, Homo sapiens
cgagagccaaacag

SEQ ID NO: 1320059 - RNA, 21 nt, Homo sapiens
cgagaucgugccauugcacuc

SEQ ID NO: 1320060 - RNA, 21 nt, Homo sapiens
cgagauggcgcuauugcacuc

SEQ ID NO: 1320061 - RNA, 19 nt, Homo sapiens
cgagcaccuguaaucccag

SEQ ID NO: 1320062 - RNA, 12 nt, Homo sapiens
cgaggccugaag

SEQ ID NO: 1320063 - RNA, 10 nt, Homo sapiens
cgaguacuuc

SEQ ID NO: 1320064 - RNA, 12 nt, Homo sapiens
cgauaaagggau

SEQ ID NO: 1320065 - RNA, 20 nt, Homo sapiens
cgaucuggguucacugcaac

SEQ ID NO: 1320066 - RNA, 16 nt, Homo sapiens
cgcaaaccacacugga

SEQ ID NO: 1320067 - RNA, 19 nt, Homo sapiens
cuccguggcaucaccuuag

SEQ ID NO: 1320068 - RNA, 18 nt, Homo sapiens
cuccguuuggcagugcaa

SEQ ID NO: 1320069 - RNA, 18 nt, Homo sapiens
cuccucacucaccuucag

SEQ ID NO: 1320070 - RNA, 18 nt, Homo sapiens
cuccucccuaaugcucac

SEQ ID NO: 1320071 - RNA, 17 nt, Homo sapiens
cuccucgacaucacugu

SEQ ID NO: 1320072 - RNA, 13 nt, Homo sapiens
cuccucgcaagcu

SEQ ID NO: 1320073 - RNA, 17 nt, Homo sapiens
cuccucugaaacagcug

SEQ ID NO: 1320074 - RNA, 22 nt, Homo sapiens
cuccucuuucaaccucagugau

SEQ ID NO: 1320075 - RNA, 23 nt, Homo sapiens
cuccugaggcuuuggauuugaca

SEQ ID NO: 1320076 - RNA, 18 nt, Homo sapiens
cuccugcccaccugucaa

SEQ ID NO: 1320077 - RNA, 19 nt, Homo sapiens
cuccugcccagcacaggaa

SEQ ID NO: 1320078 - RNA, 20 nt, Homo sapiens
cuccuggcccaggugagucc

SEQ ID NO: 1320079 - RNA, 20 nt, Homo sapiens
cuccuggccucaagugauuc

SEQ ID NO: 1320080 - RNA, 20 nt, Homo sapiens
cuccuguauuuaacaaaaag

SEQ ID NO: 1320081 - RNA, 21 nt, Homo sapiens
cuccuguggccacagcagcuu

SEQ ID NO: 1320082 - RNA, 20 nt, Homo sapiens
cuccuuaacaacuguagcaa

SEQ ID NO: 1320083 - RNA, 19 nt, Homo sapiens
cuccuugggaggccccacu

SEQ ID NO: 1320084 - RNA, 22 nt, Homo sapiens
cuccuugggaggccccacuggg

SEQ ID NO: 1320085 - RNA, 15 nt, Homo sapiens
cucgaaguucuagga

SEQ ID NO: 1320086 - RNA, 17 nt, Homo sapiens
cucgaaucucugugccu

SEQ ID NO: 1320087 - RNA, 21 nt, Homo sapiens
cucgagaauguauggauuuac

SEQ ID NO: 1320088 - RNA, 16 nt, Homo sapiens
cucgagcuuggggcaa

SEQ ID NO: 1320089 - RNA, 15 nt, Homo sapiens
cucgaggugccuucu

SEQ ID NO: 1320090 - RNA, 21 nt, Homo sapiens
cucgccaagcaggacagugcu

SEQ ID NO: 1320091 - RNA, 13 nt, Homo sapiens
cucgcuguugcug

SEQ ID NO: 1320092 - RNA, 17 nt, Homo sapiens
cucggcucagugcaacc

SEQ ID NO: 1320093 - RNA, 14 nt, Homo sapiens
cucuacauguaacu

SEQ ID NO: 1320094 - RNA, 19 nt, Homo sapiens
cucuacuaaaaauacaaaa

SEQ ID NO: 1320095 - RNA, 15 nt, Homo sapiens
cucuacuuaauccaa

SEQ ID NO: 1320096 - RNA, 20 nt, Homo sapiens
cucuaugcuuuccaaaccuu

SEQ ID NO: 1320097 - RNA, 22 nt, Homo sapiens
cucucacggcuuguaaauguga

SEQ ID NO: 1320098 - RNA, 17 nt, Homo sapiens
cucucacuauaccagua

SEQ ID NO: 1320099 - RNA, 16 nt, Homo sapiens
cucucaguguuuugga

SEQ ID NO: 1320100 - RNA, 22 nt, Homo sapiens
cucucauguuuucaacugccaa

SEQ ID NO: 1320101 - RNA, 14 nt, Homo sapiens
cucuccagacauca

SEQ ID NO: 1320102 - RNA, 20 nt, Homo sapiens
cucuccccucagagugcaag

SEQ ID NO: 1320103 - RNA, 17 nt, Homo sapiens
cucuccuccguggcaca

SEQ ID NO: 1320104 - RNA, 16 nt, Homo sapiens
cucuccugacuuuuaa

SEQ ID NO: 1320105 - RNA, 22 nt, Homo sapiens
cugcagauuagcuaggggacag

SEQ ID NO: 1320106 - RNA, 21 nt, Homo sapiens
cugcagccagcucacguccag

SEQ ID NO: 1320107 - RNA, 15 nt, Homo sapiens
cugcaggcagggcug

SEQ ID NO: 1320108 - RNA, 21 nt, Homo sapiens
cugcaggggucucaugugguc

SEQ ID NO: 1320109 - RNA, 23 nt, Homo sapiens
cugcagucccauccucuugucag

SEQ ID NO: 1320110 - RNA, 16 nt, Homo sapiens
cugcaucauccuugca

SEQ ID NO: 1320111 - RNA, 23 nt, Homo sapiens
cugcaucuaagcccaugggacaa

SEQ ID NO: 1320112 - RNA, 23 nt, Homo sapiens
cugcauguaaacacgccugcaaa

SEQ ID NO: 1320113 - RNA, 18 nt, Homo sapiens
cugcauugggagcaucca

SEQ ID NO: 1320114 - RNA, 15 nt, Homo sapiens
cugcauuguugaauu

SEQ ID NO: 1320115 - RNA, 19 nt, Homo sapiens
cugcauuguugaauucugc

SEQ ID NO: 1320116 - RNA, 16 nt, Homo sapiens
cugcauuugccuguca

SEQ ID NO: 1320117 - RNA, 21 nt, Homo sapiens
cugcauuugccugucaugcgc

SEQ ID NO: 1320118 - RNA, 12 nt, Homo sapiens
cugccaccaccc

SEQ ID NO: 1320119 - RNA, 16 nt, Homo sapiens
cugccagcugcacuga

SEQ ID NO: 1320120 - RNA, 19 nt, Homo sapiens
cugccauauucuguuggcc

SEQ ID NO: 1320121 - RNA, 17 nt, Homo sapiens
cugccauguugccccuu

SEQ ID NO: 1320122 - RNA, 18 nt, Homo sapiens
cugccauuucugagauca

SEQ ID NO: 1320123 - RNA, 19 nt, Homo sapiens
cugcccacacagguucacg

SEQ ID NO: 1320124 - RNA, 18 nt, Homo sapiens
cugcccaggcacugcaaa

SEQ ID NO: 1320125 - RNA, 23 nt, Homo sapiens
cugcccauuucauauucuuucaa

SEQ ID NO: 1320126 - RNA, 17 nt, Homo sapiens
cugcccgcagaccucug

SEQ ID NO: 1320127 - RNA, 16 nt, Homo sapiens
cugcccugugcauguc

SEQ ID NO: 1320128 - RNA, 19 nt, Homo sapiens
cugccuccaggagcugcaa

SEQ ID NO: 1320129 - RNA, 16 nt, Homo sapiens
cugccugaagucacac

SEQ ID NO: 1320130 - RNA, 17 nt, Homo sapiens
cugccugcaucuauucu

SEQ ID NO: 1320131 - RNA, 21 nt, Homo sapiens
cugccugccuuccagccacau

SEQ ID NO: 1320132 - RNA, 17 nt, Homo sapiens
cugcgagagaaagggag

SEQ ID NO: 1320133 - RNA, 18 nt, Homo sapiens
cugcggaccccucgucau

SEQ ID NO: 1320134 - RNA, 16 nt, Homo sapiens
cugcgggacagaggac

SEQ ID NO: 1320135 - RNA, 17 nt, Homo sapiens
cugcguuaugaagagcu

SEQ ID NO: 1320136 - RNA, 22 nt, Homo sapiens
cugcuaaaauagaauauagcau

SEQ ID NO: 1320137 - RNA, 15 nt, Homo sapiens
cugcuaacaagucac

SEQ ID NO: 1320138 - RNA, 19 nt, Homo sapiens
cugcuaacaagucaccaaa

SEQ ID NO: 1320139 - RNA, 20 nt, Homo sapiens
cugcuaacaagucaccaaaa

SEQ ID NO: 1320140 - RNA, 12 nt, Homo sapiens
cugcuccagcug

SEQ ID NO: 1320141 - RNA, 15 nt, Homo sapiens
cugcuccagugcagg

SEQ ID NO: 1320142 - RNA, 23 nt, Homo sapiens
cugcuccgugcuuguuugcucac

SEQ ID NO: 1320143 - RNA, 18 nt, Homo sapiens
cugcucuccgaccagaca

SEQ ID NO: 1320144 - RNA, 13 nt, Homo sapiens
gaggccaacacug

SEQ ID NO: 1320145 - RNA, 16 nt, Homo sapiens
gaggccacacucagca

SEQ ID NO: 1320146 - RNA, 14 nt, Homo sapiens
gaggccauccugcc

SEQ ID NO: 1320147 - RNA, 17 nt, Homo sapiens
gaggcccaggcugggaa

SEQ ID NO: 1320148 - RNA, 21 nt, Homo sapiens
gaggccccuucuagguggcaa

SEQ ID NO: 1320149 - RNA, 22 nt, Homo sapiens
gaggccccuucuagguggcaag

SEQ ID NO: 1320150 - RNA, 21 nt, Homo sapiens
gaggcugacggcgcaagacca

SEQ ID NO: 1320151 - RNA, 23 nt, Homo sapiens
gaggcuuagcuuugcucugccaa

SEQ ID NO: 1320152 - RNA, 20 nt, Homo sapiens
gagggagcuuggagaacuca

SEQ ID NO: 1320153 - RNA, 16 nt, Homo sapiens
gagggaguggcagcua

SEQ ID NO: 1320154 - RNA, 14 nt, Homo sapiens
gagggcaaacccaa

SEQ ID NO: 1320155 - RNA, 16 nt, Homo sapiens
gagggcagaucacuuc

SEQ ID NO: 1320156 - RNA, 16 nt, Homo sapiens
gagggcagucgauaga

SEQ ID NO: 1320157 - RNA, 17 nt, Homo sapiens
gagggccacaugggagg

SEQ ID NO: 1320158 - RNA, 21 nt, Homo sapiens
gagggcucaccucuugccuuc

SEQ ID NO: 1320159 - RNA, 15 nt, Homo sapiens
gagggugacagccac

SEQ ID NO: 1320160 - RNA, 21 nt, Homo sapiens
gagggugaggggcuggcacug

SEQ ID NO: 1320161 - RNA, 15 nt, Homo sapiens
gagguaaaaacugaa

SEQ ID NO: 1320162 - RNA, 21 nt, Homo sapiens
gagguauucaauauccuuugc

SEQ ID NO: 1320163 - RNA, 18 nt, Homo sapiens
gaggucagcauuugaucu

SEQ ID NO: 1320164 - RNA, 14 nt, Homo sapiens
gaggucuaaucuag

SEQ ID NO: 1320165 - RNA, 19 nt, Homo sapiens
gaggucuguuagguguaca

SEQ ID NO: 1320166 - RNA, 14 nt, Homo sapiens
gagguuaaggcaua

SEQ ID NO: 1320167 - RNA, 18 nt, Homo sapiens
gaguaauacaucaaagag

SEQ ID NO: 1320168 - RNA, 17 nt, Homo sapiens
gaguagaauugcauuga

SEQ ID NO: 1320169 - RNA, 18 nt, Homo sapiens
gaguaguauuaaaagcua

SEQ ID NO: 1320170 - RNA, 23 nt, Homo sapiens
gagucacacgggggcagcugaua

SEQ ID NO: 1320171 - RNA, 19 nt, Homo sapiens
gagucaggaaaacuacagg

SEQ ID NO: 1320172 - RNA, 17 nt, Homo sapiens
gaguccagaucuugccu

SEQ ID NO: 1320173 - RNA, 15 nt, Homo sapiens
gagucccaaccccag

SEQ ID NO: 1320174 - RNA, 20 nt, Homo sapiens
gagucgcaucucagugcagg

SEQ ID NO: 1320175 - RNA, 17 nt, Homo sapiens
gagucucacuguugccc

SEQ ID NO: 1320176 - RNA, 21 nt, Homo sapiens
gagucucccuaaggcaugugu

SEQ ID NO: 1320177 - RNA, 14 nt, Homo sapiens
gagucugaagcaga

SEQ ID NO: 1320178 - RNA, 15 nt, Homo sapiens
gagugacacccaaga

SEQ ID NO: 1320179 - RNA, 19 nt, Homo sapiens
gagugagacucugucucaa

SEQ ID NO: 1320180 - RNA, 13 nt, Homo sapiens
gagugagcugguu

SEQ ID NO: 1320181 - RNA, 14 nt, Homo sapiens
gaguggggaugaca

SEQ ID NO: 1320182 - RNA, 14 nt, Homo sapiens
gaguggugggugca

SEQ ID NO: 1320183 - RNA, 23 nt, Homo sapiens
gagugucuuuccacggagccacu

SEQ ID NO: 1320184 - RNA, 22 nt, Homo sapiens
gaguuaaugugcugagcauuuu

SEQ ID NO: 1320185 - RNA, 20 nt, Homo sapiens
gaguucauacccuguuacca

SEQ ID NO: 1320186 - RNA, 13 nt, Homo sapiens
gaguugaucugga

SEQ ID NO: 1320187 - RNA, 17 nt, Homo sapiens
gaguugucaagucucug

SEQ ID NO: 1320188 - RNA, 16 nt, Homo sapiens
gauaaaagacagugaa

SEQ ID NO: 1320189 - RNA, 14 nt, Homo sapiens
gauaaaauccaaaa

SEQ ID NO: 1320190 - RNA, 19 nt, Homo sapiens
gauaaaauuauugaugauu

SEQ ID NO: 1320191 - RNA, 17 nt, Homo sapiens
gauaacuagauggugcu

SEQ ID NO: 1320192 - RNA, 24 nt, Homo sapiens
gauaauauccagccucccacaaga

SEQ ID NO: 1320193 - RNA, 18 nt, Homo sapiens
gauaauauuguggugcca

SEQ ID NO: 1320194 - RNA, 22 nt, Homo sapiens
gauacaaauugcagacugugua

SEQ ID NO: 1320195 - RNA, 19 nt, Homo sapiens
gauacacuaaaaaucugag

SEQ ID NO: 1320196 - RNA, 20 nt, Homo sapiens
gauacagccuuccguaucca

SEQ ID NO: 1320197 - RNA, 18 nt, Homo sapiens
gauacaggaaaagcugcu

SEQ ID NO: 1320198 - RNA, 13 nt, Homo sapiens
gauacauacagaa

SEQ ID NO: 1320199 - RNA, 22 nt, Homo sapiens
gauacugcucaucauuccuuga

SEQ ID NO: 1320200 - RNA, 18 nt, Homo sapiens
gauacuguaacacuuuac

SEQ ID NO: 1320201 - RNA, 17 nt, Homo sapiens
gauacugucucuuucau

SEQ ID NO: 1320202 - RNA, 21 nt, Homo sapiens
gauacuuaacaaauacauuca

SEQ ID NO: 1320203 - RNA, 13 nt, Homo sapiens
gauagaaaugcca

SEQ ID NO: 1320204 - RNA, 20 nt, Homo sapiens
gauagaagauuguuggugaa

SEQ ID NO: 1320205 - RNA, 12 nt, Homo sapiens
gauagcaaguga

SEQ ID NO: 1320206 - RNA, 21 nt, Homo sapiens
gauagcuucaccccaauccca

SEQ ID NO: 1320207 - RNA, 21 nt, Homo sapiens
gauauaaucuuucaaaccagc

SEQ ID NO: 1320208 - RNA, 22 nt, Homo sapiens
gauauaaucuuucaaaccagcu

SEQ ID NO: 1320209 - RNA, 14 nt, Homo sapiens
gauauacuuacuca

SEQ ID NO: 1320210 - RNA, 15 nt, Homo sapiens
gauauacuuacucau

SEQ ID NO: 1320211 - RNA, 21 nt, Homo sapiens
gauaucaugccccuguacucc

SEQ ID NO: 1320212 - RNA, 14 nt, Homo sapiens
gauaugcauuugac

SEQ ID NO: 1320213 - RNA, 12 nt, Homo sapiens
gauauggcuuuu

SEQ ID NO: 1320214 - RNA, 19 nt, Homo sapiens
gauauuuuuuauacaguga

SEQ ID NO: 1320215 - RNA, 20 nt, Homo sapiens
gaucaaaguguaaacaccau

SEQ ID NO: 1320216 - RNA, 23 nt, Homo sapiens
gaucacagccucugaaaaccaau

SEQ ID NO: 1320217 - RNA, 17 nt, Homo sapiens
gaucacgccacugcacu

SEQ ID NO: 1320218 - RNA, 19 nt, Homo sapiens
gaucacuucaggucaggag

SEQ ID NO: 1320219 - RNA, 18 nt, Homo sapiens
gaucauccacugugccau

SEQ ID NO: 1320220 - RNA, 18 nt, Homo sapiens
gaucaucgccagaggugc

SEQ ID NO: 1320221 - RNA, 22 nt, Homo sapiens
gaucaucgccagaggugcuuca

SEQ ID NO: 1320222 - RNA, 22 nt, Homo sapiens
gauccaaaagaagcccccagcu

SEQ ID NO: 1320223 - RNA, 20 nt, Homo sapiens
gauccaagcagccugagcaa

SEQ ID NO: 1320224 - RNA, 21 nt, Homo sapiens
gauccaccugucucagccucc

SEQ ID NO: 1320225 - RNA, 13 nt, Homo sapiens
gauccagcucauc

SEQ ID NO: 1320226 - RNA, 14 nt, Homo sapiens
gauccagugcugag

SEQ ID NO: 1320227 - RNA, 15 nt, Homo sapiens
gauccagugcugagc

SEQ ID NO: 1320228 - RNA, 20 nt, Homo sapiens
gaucucggcucagugcaacc

SEQ ID NO: 1320229 - RNA, 22 nt, Homo sapiens
gaucucggcucagugcaaccuc

SEQ ID NO: 1320230 - RNA, 20 nt, Homo sapiens
gaugacacaacugcacucca

SEQ ID NO: 1320231 - RNA, 17 nt, Homo sapiens
gaugaccauaaccacug

SEQ ID NO: 1320232 - RNA, 15 nt, Homo sapiens
uugccaaguucucca

SEQ ID NO: 1320233 - RNA, 14 nt, Homo sapiens
uugccagagccaaa

SEQ ID NO: 1320234 - RNA, 14 nt, Homo sapiens
uugccauguuggcc

SEQ ID NO: 1320235 - RNA, 14 nt, Homo sapiens
uugcccccauuuca

SEQ ID NO: 1320236 - RNA, 21 nt, Homo sapiens
uugccucugaagccuauguau

SEQ ID NO: 1320237 - RNA, 16 nt, Homo sapiens
uugccuucuaggucac

SEQ ID NO: 1320238 - RNA, 19 nt, Homo sapiens
uugcguuuguauauccaaa

SEQ ID NO: 1320239 - RNA, 20 nt, Homo sapiens
uugcucuaggaagacauuuu

SEQ ID NO: 1320240 - RNA, 18 nt, Homo sapiens
uugcugcaccaaugcacu

SEQ ID NO: 1320241 - RNA, 23 nt, Homo sapiens
uugcuggggcucgugcccugcau

SEQ ID NO: 1320242 - RNA, 13 nt, Homo sapiens
uugcugugagcaa

SEQ ID NO: 1320243 - RNA, 11 nt, Homo sapiens
uugcuguucua

SEQ ID NO: 1320244 - RNA, 12 nt, Homo sapiens
uugcuguucuac

SEQ ID NO: 1320245 - RNA, 23 nt, Homo sapiens
uugcuucccggcgucccuaccuc

SEQ ID NO: 1320246 - RNA, 13 nt, Homo sapiens
uugcuuugcccag

SEQ ID NO: 1320247 - RNA, 16 nt, Homo sapiens
uuggaacuaugcagug

SEQ ID NO: 1320248 - RNA, 18 nt, Homo sapiens
uuggaaguguucccugag

SEQ ID NO: 1320249 - RNA, 20 nt, Homo sapiens
uuggaggacccagcacugac

SEQ ID NO: 1320250 - RNA, 12 nt, Homo sapiens
uuggaggcaauc

SEQ ID NO: 1320251 - RNA, 17 nt, Homo sapiens
uuggagguuaaggcaua

SEQ ID NO: 1320252 - RNA, 21 nt, Homo sapiens
uuggauaaaauaaaugcaauu

SEQ ID NO: 1320253 - RNA, 12 nt, Homo sapiens
uuggauuugaca

SEQ ID NO: 1320254 - RNA, 13 nt, Homo sapiens
uuggcaccagaca

SEQ ID NO: 1320255 - RNA, 22 nt, Homo sapiens
uuggcaccagacacccaggacu

SEQ ID NO: 1320256 - RNA, 21 nt, Homo sapiens
uuggccuucuuaggugacaau

SEQ ID NO: 1320257 - RNA, 21 nt, Homo sapiens
uuggcgggggcuuggcugugc

SEQ ID NO: 1320258 - RNA, 17 nt, Homo sapiens
uuggcguuuggacccag

SEQ ID NO: 1320259 - RNA, 16 nt, Homo sapiens
uuggcuacacagggau

SEQ ID NO: 1320260 - RNA, 17 nt, Homo sapiens
uuggcucacacugagaa

SEQ ID NO: 1320261 - RNA, 11 nt, Homo sapiens
uuggcuugcuu

SEQ ID NO: 1320262 - RNA, 15 nt, Homo sapiens
uuggcuuugcaaaau

SEQ ID NO: 1320263 - RNA, 17 nt, Homo sapiens
uugggaugcucucuggu

SEQ ID NO: 1320264 - RNA, 20 nt, Homo sapiens
uugggcuggaugccgaggua

SEQ ID NO: 1320265 - RNA, 13 nt, Homo sapiens
uugggucuuugaa

SEQ ID NO: 1320266 - RNA, 21 nt, Homo sapiens
uugggugaacuaaccaaauaa

SEQ ID NO: 1320267 - RNA, 16 nt, Homo sapiens
uugguaccuauuugac

SEQ ID NO: 1320268 - RNA, 20 nt, Homo sapiens
uuggugaaaauuaggguugg

SEQ ID NO: 1320269 - RNA, 22 nt, Homo sapiens
uuggugaauuucacaagcuauu

SEQ ID NO: 1320270 - RNA, 14 nt, Homo sapiens
uuggugcuuuccag

SEQ ID NO: 1320271 - RNA, 15 nt, Homo sapiens
uugguguacuguaau

SEQ ID NO: 1320272 - RNA, 15 nt, Homo sapiens
uugguucaacaucua

SEQ ID NO: 1320273 - RNA, 13 nt, Homo sapiens
uuguaaaaagccc

SEQ ID NO: 1320274 - RNA, 20 nt, Homo sapiens
uuguaaaaagcccagcacuu

SEQ ID NO: 1320275 - RNA, 20 nt, Homo sapiens
uuguaaaacaaaauuugacu

SEQ ID NO: 1320276 - RNA, 17 nt, Homo sapiens
uuguaaaguuagccuuu

SEQ ID NO: 1320277 - RNA, 15 nt, Homo sapiens
uuguaaaugugacac

SEQ ID NO: 1320278 - RNA, 23 nt, Homo sapiens
uuguaaauuauauuugugcuaua

SEQ ID NO: 1320279 - RNA, 16 nt, Homo sapiens
uuguacagaauauuuc

SEQ ID NO: 1320280 - RNA, 13 nt, Homo sapiens
uuguacauuucac

SEQ ID NO: 1320281 - RNA, 16 nt, Homo sapiens
uuguaccgaugcagcu

SEQ ID NO: 1320282 - RNA, 19 nt, Homo sapiens
uuguagagauggggucuca

SEQ ID NO: 1320283 - RNA, 21 nt, Homo sapiens
uuguagagauggggucucaca

SEQ ID NO: 1320284 - RNA, 16 nt, Homo sapiens
uuguagcagaaaggaa

SEQ ID NO: 1320285 - RNA, 18 nt, Homo sapiens
uuguaggagaaacuccca

SEQ ID NO: 1320286 - RNA, 20 nt, Homo sapiens
uuguaucaaaugugacauua

SEQ ID NO: 1320287 - RNA, 13 nt, Homo sapiens
uuguauuguggaa

SEQ ID NO: 1320288 - RNA, 19 nt, Homo sapiens
uugucaaaaugagauucca

SEQ ID NO: 1320289 - RNA, 22 nt, Homo sapiens
uugucaagcaguagacaagcaa

SEQ ID NO: 1320290 - RNA, 21 nt, Homo sapiens
uugucaagccugugcaaaaaa

SEQ ID NO: 1320291 - RNA, 14 nt, Homo sapiens
uugucacaugaaac

SEQ ID NO: 1320292 - RNA, 18 nt, Homo sapiens
uuguccccacuuacagau

SEQ ID NO: 1320293 - RNA, 19 nt, Homo sapiens
uugucccguggcauuucaa

SEQ ID NO: 1320294 - RNA, 17 nt, Homo sapiens
uugucgcucaugugugc

SEQ ID NO: 1320295 - RNA, 16 nt, Homo sapiens
uugucgguuaccucug

SEQ ID NO: 1320296 - RNA, 17 nt, Homo sapiens
uugucuuauuacagcau

SEQ ID NO: 1320297 - RNA, 15 nt, Homo sapiens
uugugagccaccacg

SEQ ID NO: 1320298 - RNA, 15 nt, Homo sapiens
uugugauagcacuuu

SEQ ID NO: 1320299 - RNA, 12 nt, Homo sapiens
uugugauugccu

SEQ ID NO: 1320300 - RNA, 19 nt, Homo sapiens
uugugccacuacacuccag

SEQ ID NO: 1320301 - RNA, 23 nt, Homo sapiens
uugugcuuaguccaauuccuugc

SEQ ID NO: 1320302 - RNA, 18 nt, Homo sapiens
uuguuaaaaugagcauug

SEQ ID NO: 1320303 - RNA, 12 nt, Homo sapiens
uuguuauaccau

SEQ ID NO: 1320304 - RNA, 13 nt, Homo sapiens
uuguuauaccauu

SEQ ID NO: 1320305 - RNA, 15 nt, Homo sapiens
uuguuaucagucaau

SEQ ID NO: 1320306 - RNA, 16 nt, Homo sapiens
uuguuaucagucaaua

SEQ ID NO: 1320307 - RNA, 16 nt, Homo sapiens
uuguuccccacugaca

SEQ ID NO: 1320308 - RNA, 12 nt, Homo sapiens
uuguucuacucu

SEQ ID NO: 1320309 - RNA, 12 nt, Homo sapiens
uuguucugagau

SEQ ID NO: 1320310 - RNA, 11 nt, Homo sapiens
uuguugacaaa

SEQ ID NO: 1320311 - RNA, 16 nt, Homo sapiens
uuguuggauaaaucag

SEQ ID NO: 1320312 - RNA, 18 nt, Homo sapiens
uuguuguaaaaagcccag

SEQ ID NO: 1320313 - RNA, 14 nt, Homo sapiens
uuguuucuguagaa

SEQ ID NO: 1320314 - RNA, 19 nt, Homo sapiens
uuguuuuguguaacauauu

SEQ ID NO: 1320315 - RNA, 19 nt, Homo sapiens
uuuaaaaaauauuuucucu

SEQ ID NO: 1320316 - RNA, 19 nt, Homo sapiens
uuuaaaaaugucuugcugu

SEQ ID NO: 1320317 - RNA, 14 nt, Homo sapiens
uuuaaaaucuguca

SEQ ID NO: 1320318 - RNA, 17 nt, Homo sapiens
uuuaaagcuugcucaca

SEQ ID NO: 1320319 - RNA, 18 nt, Homo sapiens
uuuaaauauaugcuaagu

SEQ ID NO: 1320320 - RNA, 22 nt, Homo sapiens
uuuaaauuacaauuuuaucugu

SEQ ID NO: 1320321 - RNA, 13 nt, Homo sapiens
uuuaaauugugcc

SEQ ID NO: 1320322 - RNA, 14 nt, Homo sapiens
uuuaacccauuugu

SEQ ID NO: 1320323 - RNA, 18 nt, Homo sapiens
uuuaacgauuaaguccaa

SEQ ID NO: 1320324 - RNA, 20 nt, Homo sapiens
uuuaacuggugaagagaaaa

SEQ ID NO: 1320325 - RNA, 14 nt, Homo sapiens
uuuaagaauuucac

SEQ ID NO: 1320326 - RNA, 18 nt, Homo sapiens
uuuaagccugcauucuua

SEQ ID NO: 1320327 - RNA, 15 nt, Homo sapiens
uuuaaggauguugcc

SEQ ID NO: 1320328 - RNA, 23 nt, Homo sapiens
uuuaaggauguugccacuggcaa

SEQ ID NO: 1320329 - RNA, 17 nt, Homo sapiens
uuuaaguuuccuuccag

SEQ ID NO: 1320330 - RNA, 17 nt, Homo sapiens
uuuaauaaagcacaaaa

SEQ ID NO: 1320331 - RNA, 21 nt, Homo sapiens
uuuaauagggaauauaucucu

SEQ ID NO: 1320332 - RNA, 22 nt, Homo sapiens
uuuaaugcaagagaacauuuua

SEQ ID NO: 1320333 - RNA, 16 nt, Homo sapiens
uuuaauggacacuuuu

SEQ ID NO: 1320334 - RNA, 17 nt, Homo sapiens
uuuaauuuucuuguaua

SEQ ID NO: 1320335 - RNA, 14 nt, Homo sapiens
uuuacagaagugaa

SEQ ID NO: 1320336 - RNA, 23 nt, Homo sapiens
uuuacagaaucaaaugcaauuuu

SEQ ID NO: 1320337 - RNA, 12 nt, Homo sapiens
uuuacagaauuu

SEQ ID NO: 1320338 - RNA, 23 nt, Homo sapiens
uuuacagccagugggagauguua

SEQ ID NO: 1320339 - RNA, 17 nt, Homo sapiens
uuuacauuauuaagaaa

SEQ ID NO: 1320340 - RNA, 14 nt, Homo sapiens
uuuacauucugcaa

SEQ ID NO: 1320341 - RNA, 12 nt, Homo sapiens
uuuacauuugau

SEQ ID NO: 1320342 - RNA, 19 nt, Homo sapiens
uuuacccugaggucacugc

SEQ ID NO: 1320343 - RNA, 22 nt, Homo sapiens
uuuagaaaaagaacaugcaguu

SEQ ID NO: 1320344 - RNA, 20 nt, Homo sapiens
uuuagaaccaccaacaagca

SEQ ID NO: 1320345 - RNA, 16 nt, Homo sapiens
uuuagaugccugugaa

SEQ ID NO: 1320346 - RNA, 16 nt, Homo sapiens
uuuagccagaaucuca

SEQ ID NO: 1320347 - RNA, 11 nt, Homo sapiens
uuuagccuuua

SEQ ID NO: 1320348 - RNA, 17 nt, Homo sapiens
uuuaguacuuacaucag

SEQ ID NO: 1320349 - RNA, 16 nt, Homo sapiens
uuuagugaucacagca

SEQ ID NO: 1320350 - RNA, 13 nt, Homo sapiens
uuuaguuacuuua

SEQ ID NO: 1320351 - RNA, 19 nt, Homo sapiens
uuuauaaaucuuaugcucu

SEQ ID NO: 1320352 - RNA, 21 nt, Homo sapiens
uuuauaacuauuauauuauca

SEQ ID NO: 1320353 - RNA, 13 nt, Homo sapiens
uuuauaagucauu

SEQ ID NO: 1320354 - RNA, 13 nt, Homo sapiens
uuuauacauucua

SEQ ID NO: 1320355 - RNA, 17 nt, Homo sapiens
uuuauauguacaugaga

SEQ ID NO: 1320356 - RNA, 13 nt, Homo sapiens
uuuaucaccucau

SEQ ID NO: 1320357 - RNA, 18 nt, Homo sapiens
uuuaucuguuuccugaca

SEQ ID NO: 1320358 - RNA, 19 nt, Homo sapiens
uuuaucuuugauucuccuu

SEQ ID NO: 1320359 - RNA, 13 nt, Homo sapiens
uuuauuaccucug

SEQ ID NO: 1320360 - RNA, 13 nt, Homo sapiens
uuuauuauggaaa

SEQ ID NO: 1320361 - RNA, 17 nt, Homo sapiens
uuuauuuuugagacaga

SEQ ID NO: 1320362 - RNA, 19 nt, Homo sapiens
uuuauuuuuguagagccag

SEQ ID NO: 1320363 - RNA, 18 nt, Homo sapiens
uuucaaauuggagcuuca

SEQ ID NO: 1320364 - RNA, 11 nt, Homo sapiens
uuucacaagcu

SEQ ID NO: 1320365 - RNA, 11 nt, Homo sapiens
uuucaccacau

SEQ ID NO: 1320366 - RNA, 22 nt, Homo sapiens
uuucaccauauugcccagggug

SEQ ID NO: 1320367 - RNA, 18 nt, Homo sapiens
uuucacccauuuacacau

SEQ ID NO: 1320368 - RNA, 15 nt, Homo sapiens
uuucagaaauauuca

SEQ ID NO: 1320369 - RNA, 21 nt, Homo sapiens
uuucaggcucgccaaggccua

SEQ ID NO: 1320370 - RNA, 18 nt, Homo sapiens
uuucaguugccauugaca

SEQ ID NO: 1320371 - RNA, 22 nt, Homo sapiens
uuucauaaaaacacucaacaaa

SEQ ID NO: 1320372 - RNA, 12 nt, Homo sapiens
uuucauagcaaa

SEQ ID NO: 1320373 - RNA, 15 nt, Homo sapiens
uuucaucacacuggg

SEQ ID NO: 1320374 - RNA, 19 nt, Homo sapiens
uuucauggucugcugagua

SEQ ID NO: 1320375 - RNA, 13 nt, Homo sapiens
uuucauguaaucc

SEQ ID NO: 1320376 - RNA, 14 nt, Homo sapiens
uuuccaaacauucu

SEQ ID NO: 1320377 - RNA, 11 nt, Homo sapiens
uuuccaaagag

SEQ ID NO: 1320378 - RNA, 15 nt, Homo sapiens
uuuccacuacugcua

SEQ ID NO: 1320379 - RNA, 20 nt, Homo sapiens
uuuccacuauuuucaaagaa

SEQ ID NO: 1320380 - RNA, 19 nt, Homo sapiens
uuuccagacuuccuugaga

SEQ ID NO: 1320381 - RNA, 17 nt, Homo sapiens
uuuccagcagaagacaa

SEQ ID NO: 1320382 - RNA, 20 nt, Homo sapiens
uuuccaguucaucuauggca

SEQ ID NO: 1320383 - RNA, 20 nt, Homo sapiens
uuucccauaagacaaugaca

SEQ ID NO: 1320384 - RNA, 19 nt, Homo sapiens
uuucccccugugaaagcaa

SEQ ID NO: 1320385 - RNA, 15 nt, Homo sapiens
uuuccuccucaggca

SEQ ID NO: 1320386 - RNA, 21 nt, Homo sapiens
uuuccuguguacacgugacag

SEQ ID NO: 1320387 - RNA, 20 nt, Homo sapiens
uuuccuucggguuggcaaaa

SEQ ID NO: 1320388 - RNA, 17 nt, Homo sapiens
uuuccuugccuuguuga

SEQ ID NO: 1320389 - RNA, 20 nt, Homo sapiens
uuucuacaaugugaacuuua

SEQ ID NO: 1320390 - RNA, 21 nt, Homo sapiens
uuucuacuugccagcagagua

SEQ ID NO: 1320391 - RNA, 15 nt, Homo sapiens
uuucuagagacaaca

SEQ ID NO: 1320392 - RNA, 15 nt, Homo sapiens
uuucuccagggucag

SEQ ID NO: 1320393 - RNA, 19 nt, Homo sapiens
uuucucuguuguaagaaua

SEQ ID NO: 1320394 - RNA, 12 nt, Homo sapiens
uuucugacacag

SEQ ID NO: 1320395 - RNA, 14 nt, Homo sapiens
uuucuguaguguga

SEQ ID NO: 1320396 - RNA, 14 nt, Homo sapiens
uuucuguucaccuu

SEQ ID NO: 1320397 - RNA, 16 nt, Homo sapiens
uuucuuacacaagagc

SEQ ID NO: 1320398 - RNA, 14 nt, Homo sapiens
uuucuucauuaaga

SEQ ID NO: 1320399 - RNA, 23 nt, Homo sapiens
uuucuucccgaaccccaaggagg

SEQ ID NO: 1320400 - RNA, 23 nt, Homo sapiens
uuucuucuacugcuaucuacuac

SEQ ID NO: 1320401 - RNA, 13 nt, Homo sapiens
uuucuuuauauca

SEQ ID NO: 1320402 - RNA, 17 nt, Homo sapiens
uuucuuuuguauguaaa

SEQ ID NO: 1320403 - RNA, 18 nt, Homo sapiens
uuugaaauuaaccucuca

SEQ ID NO: 1320404 - RNA, 18 nt, Homo sapiens
uuugaacagcuugcugcu

SEQ ID NO: 1320405 - RNA, 19 nt, Homo sapiens
uuugagaagaaaacaucua

SEQ ID NO: 1320406 - RNA, 22 nt, Homo sapiens
uuugagaagaaaacaucuauuc

SEQ ID NO: 1320407 - RNA, 15 nt, Homo sapiens
uuugagcacaacuuu

SEQ ID NO: 1320408 - RNA, 21 nt, Homo sapiens
uuugaugggcaugaaugagac

SEQ ID NO: 1320409 - RNA, 15 nt, Homo sapiens
uuugauuauucagug

SEQ ID NO: 1320410 - RNA, 13 nt, Homo sapiens
uuugcaaacguuc

SEQ ID NO: 1320411 - RNA, 15 nt, Homo sapiens
uuugcauguuuugua

SEQ ID NO: 1320412 - RNA, 17 nt, Homo sapiens
uuugcuuaguauuguga

SEQ ID NO: 1320413 - RNA, 23 nt, Homo sapiens
uuuggaaauguggucaucaaaga

SEQ ID NO: 1320414 - RNA, 16 nt, Homo sapiens
uuuggaaccaugccuu

SEQ ID NO: 1320415 - RNA, 15 nt, Homo sapiens
uuuggaaggcaaaga

SEQ ID NO: 1320416 - RNA, 17 nt, Homo sapiens
uuuggaauauuguccau

SEQ ID NO: 1320417 - RNA, 17 nt, Homo sapiens
uuuggauauaagugaua

SEQ ID NO: 1320418 - RNA, 22 nt, Homo sapiens
uuugggagcccaugggggagcu

SEQ ID NO: 1320419 - RNA, 17 nt, Homo sapiens
uuuggguuuugggucuu

SEQ ID NO: 1320420 - RNA, 13 nt, Homo sapiens
uuuggugacuuca

SEQ ID NO: 1320421 - RNA, 13 nt, Homo sapiens
uuugguuugaccc

SEQ ID NO: 1320422 - RNA, 22 nt, Homo sapiens
uuugguuuuacauuuuaguuac

SEQ ID NO: 1320423 - RNA, 17 nt, Homo sapiens
uuuguaaaauguucucu

SEQ ID NO: 1320424 - RNA, 16 nt, Homo sapiens
uuuguaaaguuagccu

SEQ ID NO: 1320425 - RNA, 13 nt, Homo sapiens
uuuguaaauuccc

SEQ ID NO: 1320426 - RNA, 21 nt, Homo sapiens
uuuguagagccagggucucac

SEQ ID NO: 1320427 - RNA, 17 nt, Homo sapiens
uuugucaacauugugau

SEQ ID NO: 1320428 - RNA, 14 nt, Homo sapiens
uuugucccaucucu

SEQ ID NO: 1320429 - RNA, 22 nt, Homo sapiens
uuugucccggggcuccacugaa

SEQ ID NO: 1320430 - RNA, 18 nt, Homo sapiens
uuuguggcaucuugccaa

SEQ ID NO: 1320431 - RNA, 21 nt, Homo sapiens
uuuguuccacuuguuugcacu

SEQ ID NO: 1320432 - RNA, 23 nt, Homo sapiens
uuuuaaaaaaauaaaacaguauc

SEQ ID NO: 1320433 - RNA, 19 nt, Homo sapiens
uuuuaaaaaaauuccaagu

SEQ ID NO: 1320434 - RNA, 16 nt, Homo sapiens
uuuuaaaaauugucau

SEQ ID NO: 1320435 - RNA, 16 nt, Homo sapiens
uuuuaaauuuugacaa

SEQ ID NO: 1320436 - RNA, 15 nt, Homo sapiens
uuuuaaccauuccaa

SEQ ID NO: 1320437 - RNA, 13 nt, Homo sapiens
uuuuaacucuaga

SEQ ID NO: 1320438 - RNA, 14 nt, Homo sapiens
uuuuaacucuagaa

SEQ ID NO: 1320439 - RNA, 15 nt, Homo sapiens
uuuuaaggauguugc

SEQ ID NO: 1320440 - RNA, 23 nt, Homo sapiens
uuuuacagaagugaaagugaggu

SEQ ID NO: 1320441 - RNA, 20 nt, Homo sapiens
uuuuacccugaggucacugc

SEQ ID NO: 1320442 - RNA, 23 nt, Homo sapiens
uuuuacccugaggucacugcuag

SEQ ID NO: 1320443 - RNA, 17 nt, Homo sapiens
uuuuagaaucucuuucg

SEQ ID NO: 1320444 - RNA, 19 nt, Homo sapiens
uuuuagacccuauugcugc

SEQ ID NO: 1320445 - RNA, 12 nt, Homo sapiens
uuuuagcagaga

SEQ ID NO: 1320446 - RNA, 12 nt, Homo sapiens
uuuuauauguca

SEQ ID NO: 1320447 - RNA, 23 nt, Homo sapiens
uuuuauuuuuagacagagucuca

SEQ ID NO: 1320448 - RNA, 16 nt, Homo sapiens
uuuucaacuuugaaua

SEQ ID NO: 1320449 - RNA, 15 nt, Homo sapiens
uuuucaagagcuccu

SEQ ID NO: 1320450 - RNA, 12 nt, Homo sapiens
uuuucuguucuc

SEQ ID NO: 1320451 - RNA, 13 nt, Homo sapiens
uuuugaaggcaaa

SEQ ID NO: 1320452 - RNA, 14 nt, Homo sapiens
uuuugaccaaaaaa

SEQ ID NO: 1320453 - RNA, 22 nt, Homo sapiens
uuuugaguuucauguugguuua

SEQ ID NO: 1320454 - RNA, 15 nt, Homo sapiens
uuuugccaaucucaa

SEQ ID NO: 1320455 - RNA, 15 nt, Homo sapiens
uuuuggagguauuca

SEQ ID NO: 1320456 - RNA, 20 nt, Homo sapiens
uuuuguauuguuuucugaca

SEQ ID NO: 1320457 - RNA, 13 nt, Homo sapiens
uuuuucaagagcu

SEQ ID NO: 1320458 - RNA, 11 nt, Homo sapiens
uuuuucaauuu

SEQ ID NO: 1320459 - RNA, 23 nt, Homo sapiens
uuuuucacccauuuacacauauc

SEQ ID NO: 1320460 - RNA, 12 nt, Homo sapiens
uuuuucuaguau

SEQ ID NO: 1320461 - RNA, 16 nt, Homo sapiens
uuuuugaacauggaaa

SEQ ID NO: 1320462 - RNA, 11 nt, Homo sapiens
uuuuugcaaua

SEQ ID NO: 1320463 - RNA, 18 nt, Homo sapiens
uuuuuguucaaagccagc

SEQ ID NO: 1320464 - RNA, 21 nt, Homo sapiens
aaacauaccaacauguuuaaa

SEQ ID NO: 1320465 - RNA, 22 nt, Homo sapiens
aaacaucaguuacucugaaggg

SEQ ID NO: 1320466 - RNA, 17 nt, Homo sapiens
aaacaucauuacuauaa

SEQ ID NO: 1320467 - RNA, 16 nt, Homo sapiens
aaacauccagauacac

SEQ ID NO: 1320468 - RNA, 14 nt, Homo sapiens
aaacaucuauucuc

SEQ ID NO: 1320469 - RNA, 9 nt, Homo sapiens
aaacauguu

SEQ ID NO: 1320470 - RNA, 20 nt, Homo sapiens
aaacauguuguacauuucac

SEQ ID NO: 1320471 - RNA, 17 nt, Homo sapiens
aaacauuggacagugag

SEQ ID NO: 1320472 - RNA, 17 nt, Homo sapiens
aaacauuuuucuggaga

SEQ ID NO: 1320473 - RNA, 15 nt, Homo sapiens
aaaccaaaaacugaa

SEQ ID NO: 1320474 - RNA, 17 nt, Homo sapiens
aaaccaaggacugagca

SEQ ID NO: 1320475 - RNA, 18 nt, Homo sapiens
aaaccauaugaacauaua

SEQ ID NO: 1320476 - RNA, 14 nt, Homo sapiens
aaaccauccaguga

SEQ ID NO: 1320477 - RNA, 21 nt, Homo sapiens
aaacccugucucuacuaaaaa

SEQ ID NO: 1320478 - RNA, 23 nt, Homo sapiens
aaaccucaugccacccugcauuu

SEQ ID NO: 1320479 - RNA, 12 nt, Homo sapiens
aaaccucauugu

SEQ ID NO: 1320480 - RNA, 21 nt, Homo sapiens
aaaccuccaaauguccuuaaa

SEQ ID NO: 1320481 - RNA, 22 nt, Homo sapiens
aaaccuggcaagucaccugcag

SEQ ID NO: 1320482 - RNA, 13 nt, Homo sapiens
aaaccuuugcaaa

SEQ ID NO: 1320483 - RNA, 13 nt, Homo sapiens
aaaccuuuguuaa

SEQ ID NO: 1320484 - RNA, 13 nt, Homo sapiens
aaacgcugccugc

SEQ ID NO: 1320485 - RNA, 20 nt, Homo sapiens
aaacgucuucuaaacuuccc

SEQ ID NO: 1320486 - RNA, 18 nt, Homo sapiens
aaacuaaugguccacacc

SEQ ID NO: 1320487 - RNA, 15 nt, Homo sapiens
aaacucuccagacau

SEQ ID NO: 1320488 - RNA, 11 nt, Homo sapiens
aaacucuucag

SEQ ID NO: 1320489 - RNA, 20 nt, Homo sapiens
aaacucuugaccucagguga

SEQ ID NO: 1320490 - RNA, 21 nt, Homo sapiens
aaacugagacaggcaguuuca

SEQ ID NO: 1320491 - RNA, 19 nt, Homo sapiens
aaacugaggcccuugggca

SEQ ID NO: 1320492 - RNA, 23 nt, Homo sapiens
aaacugauacccuuugaaaaagu

SEQ ID NO: 1320493 - RNA, 22 nt, Homo sapiens
aaacugcccuggcuccagugaa

SEQ ID NO: 1320494 - RNA, 13 nt, Homo sapiens
aaacugcuuugag

SEQ ID NO: 1320495 - RNA, 20 nt, Homo sapiens
aaacugggcuccugcuuuau

SEQ ID NO: 1320496 - RNA, 14 nt, Homo sapiens
aaacugucugggag

SEQ ID NO: 1320497 - RNA, 18 nt, Homo sapiens
aaacugucuuuaaaagag

SEQ ID NO: 1320498 - RNA, 10 nt, Homo sapiens
aaacuugaau

SEQ ID NO: 1320499 - RNA, 23 nt, Homo sapiens
aaacuuggcucgaaucucugugc

SEQ ID NO: 1320500 - RNA, 22 nt, Homo sapiens
aaacuuuauauuguucuuguaa

SEQ ID NO: 1320501 - RNA, 20 nt, Homo sapiens
aaacuuuccucuuccugccu

SEQ ID NO: 1320502 - RNA, 20 nt, Homo sapiens
aaacuuuucuaauacucuac

SEQ ID NO: 1320503 - RNA, 19 nt, Homo sapiens
aaagaaaaauaucuuggcc

SEQ ID NO: 1320504 - RNA, 12 nt, Homo sapiens
aaagaaaugcau

SEQ ID NO: 1320505 - RNA, 16 nt, Homo sapiens
aaagaaaugcccaucu

SEQ ID NO: 1320506 - RNA, 19 nt, Homo sapiens
aaagaacaugcaguuugaa

SEQ ID NO: 1320507 - RNA, 18 nt, Homo sapiens
aaagaagugaaacuauau

SEQ ID NO: 1320508 - RNA, 20 nt, Homo sapiens
aaagaauaguaguaacuguu

SEQ ID NO: 1320509 - RNA, 14 nt, Homo sapiens
aaagaauccauaaa

SEQ ID NO: 1320510 - RNA, 16 nt, Homo sapiens
aaagaauuccaaagca

SEQ ID NO: 1320511 - RNA, 19 nt, Homo sapiens
aaagacaagacucugggga

SEQ ID NO: 1320512 - RNA, 17 nt, Homo sapiens
aaagacaaucacugcca

SEQ ID NO: 1320513 - RNA, 13 nt, Homo sapiens
aaagacacugcag

SEQ ID NO: 1320514 - RNA, 19 nt, Homo sapiens
aaagagaagguuucuucca

SEQ ID NO: 1320515 - RNA, 18 nt, Homo sapiens
aaagagagaugaaccaca

SEQ ID NO: 1320516 - RNA, 19 nt, Homo sapiens
aaagagagucgcaucucag

SEQ ID NO: 1320517 - RNA, 16 nt, Homo sapiens
aaagagcucagacauu

SEQ ID NO: 1320518 - RNA, 19 nt, Homo sapiens
aaagagguagcacuacaaa

SEQ ID NO: 1320519 - RNA, 14 nt, Homo sapiens
aaagaugauugaau

SEQ ID NO: 1320520 - RNA, 21 nt, Homo sapiens
aaagaugugcuuauaucauug

SEQ ID NO: 1320521 - RNA, 16 nt, Homo sapiens
aaagcaaaaaacaaaa

SEQ ID NO: 1320522 - RNA, 13 nt, Homo sapiens
aaagcacaggugg

SEQ ID NO: 1320523 - RNA, 12 nt, Homo sapiens
aaagcagccacg

SEQ ID NO: 1320524 - RNA, 19 nt, Homo sapiens
aaagcagcucaaaggcaca

SEQ ID NO: 1320525 - RNA, 15 nt, Homo sapiens
aaagcauuugaaugc

SEQ ID NO: 1320526 - RNA, 12 nt, Homo sapiens
aaagccaaaaac

SEQ ID NO: 1320527 - RNA, 18 nt, Homo sapiens
agcaucuugcauccaaac

SEQ ID NO: 1320528 - RNA, 15 nt, Homo sapiens
agcauguacuccccu

SEQ ID NO: 1320529 - RNA, 16 nt, Homo sapiens
agcaugucgucaaagc

SEQ ID NO: 1320530 - RNA, 21 nt, Homo sapiens
agcauugacucuguggcuuug

SEQ ID NO: 1320531 - RNA, 17 nt, Homo sapiens
agcauuuagacccugca

SEQ ID NO: 1320532 - RNA, 18 nt, Homo sapiens
agcauuuaggaaugugac

SEQ ID NO: 1320533 - RNA, 19 nt, Homo sapiens
agcauuugauuaacauuug

SEQ ID NO: 1320534 - RNA, 12 nt, Homo sapiens
agccaaagggac

SEQ ID NO: 1320535 - RNA, 23 nt, Homo sapiens
agccaacuuuugcauguuuugua

SEQ ID NO: 1320536 - RNA, 20 nt, Homo sapiens
agccaaggaggggccugagg

SEQ ID NO: 1320537 - RNA, 13 nt, Homo sapiens
agccaauauuccu

SEQ ID NO: 1320538 - RNA, 22 nt, Homo sapiens
agccacacucugggcuccagag

SEQ ID NO: 1320539 - RNA, 20 nt, Homo sapiens
agccacaggccugagauuuc

SEQ ID NO: 1320540 - RNA, 20 nt, Homo sapiens
agccacagggucugccucca

SEQ ID NO: 1320541 - RNA, 15 nt, Homo sapiens
agccacauacuagca

SEQ ID NO: 1320542 - RNA, 19 nt, Homo sapiens
agccacauacuagcaucuu

SEQ ID NO: 1320543 - RNA, 18 nt, Homo sapiens
agccaccacaccuggcua

SEQ ID NO: 1320544 - RNA, 15 nt, Homo sapiens
agcuuuuggucauca

SEQ ID NO: 1320545 - RNA, 20 nt, Homo sapiens
aggaaaaaacuaguauuccc

SEQ ID NO: 1320546 - RNA, 19 nt, Homo sapiens
aggaaaagcggacaucagc

SEQ ID NO: 1320547 - RNA, 14 nt, Homo sapiens
aggaaaccacagcu

SEQ ID NO: 1320548 - RNA, 13 nt, Homo sapiens
aggaaagaguauu

SEQ ID NO: 1320549 - RNA, 12 nt, Homo sapiens
aggaaagugauu

SEQ ID NO: 1320550 - RNA, 20 nt, Homo sapiens
aggaaauauaucuuaaugca

SEQ ID NO: 1320551 - RNA, 15 nt, Homo sapiens
aggaaaugauuaauu

SEQ ID NO: 1320552 - RNA, 19 nt, Homo sapiens
aggaaauggagaagcucug

SEQ ID NO: 1320553 - RNA, 18 nt, Homo sapiens
aggaacacccccaugaca

SEQ ID NO: 1320554 - RNA, 19 nt, Homo sapiens
aggaagaggcugcacugca

SEQ ID NO: 1320555 - RNA, 18 nt, Homo sapiens
aggaagccgccaguacuu

SEQ ID NO: 1320556 - RNA, 17 nt, Homo sapiens
aggaagcuuucugucuc

SEQ ID NO: 1320557 - RNA, 22 nt, Homo sapiens
aggaauauauggcagaguugua

SEQ ID NO: 1320558 - RNA, 17 nt, Homo sapiens
aggacacccaguggggu

SEQ ID NO: 1320559 - RNA, 18 nt, Homo sapiens
aggacagggagaugcugc

SEQ ID NO: 1320560 - RNA, 20 nt, Homo sapiens
aggacauugcggacagccac

SEQ ID NO: 1320561 - RNA, 14 nt, Homo sapiens
aggaccaagcaucu

SEQ ID NO: 1320562 - RNA, 16 nt, Homo sapiens
aggacccagcacugac

SEQ ID NO: 1320563 - RNA, 21 nt, Homo sapiens
aggacccugaaggggccauga

SEQ ID NO: 1320564 - RNA, 16 nt, Homo sapiens
aggaccuggcugccau

SEQ ID NO: 1320565 - RNA, 15 nt, Homo sapiens
aggaccuuuccacca

SEQ ID NO: 1320566 - RNA, 20 nt, Homo sapiens
aggacguguuacccacugcc

SEQ ID NO: 1320567 - RNA, 23 nt, Homo sapiens
aggacuagggcuuauccaugccu

SEQ ID NO: 1320568 - RNA, 13 nt, Homo sapiens
aggacucaaaagu

SEQ ID NO: 1320569 - RNA, 22 nt, Homo sapiens
aggacugagcacccucuggauu

SEQ ID NO: 1320570 - RNA, 22 nt, Homo sapiens
aggagaaugaaauguaugugcu

SEQ ID NO: 1320571 - RNA, 16 nt, Homo sapiens
aggagacacaacaacu

SEQ ID NO: 1320572 - RNA, 21 nt, Homo sapiens
aggagacuuuacauggaugcc

SEQ ID NO: 1320573 - RNA, 20 nt, Homo sapiens
aggagagcuagcagcaggga

SEQ ID NO: 1320574 - RNA, 18 nt, Homo sapiens
aggagaggggcacagggu

SEQ ID NO: 1320575 - RNA, 13 nt, Homo sapiens
aggagaucaucug

SEQ ID NO: 1320576 - RNA, 20 nt, Homo sapiens
aggagauggaaguugcagug

SEQ ID NO: 1320577 - RNA, 16 nt, Homo sapiens
aggagcaaaguuaaaa

SEQ ID NO: 1320578 - RNA, 14 nt, Homo sapiens
aggagcgcaucuca

SEQ ID NO: 1320579 - RNA, 18 nt, Homo sapiens
aggagcuucuuguuuccu

SEQ ID NO: 1320580 - RNA, 15 nt, Homo sapiens
aggagcuugcaagaa

SEQ ID NO: 1320581 - RNA, 19 nt, Homo sapiens
aggaggccguggcucugau

SEQ ID NO: 1320582 - RNA, 21 nt, Homo sapiens
aggagggagggacacuuaccc

SEQ ID NO: 1320583 - RNA, 22 nt, Homo sapiens
aggaggggccgcugccacccac

SEQ ID NO: 1320584 - RNA, 15 nt, Homo sapiens
aggaggggccugagg

SEQ ID NO: 1320585 - RNA, 18 nt, Homo sapiens
aggagguuuuuuugucaa

SEQ ID NO: 1320586 - RNA, 13 nt, Homo sapiens
aggaguacaggug

SEQ ID NO: 1320587 - RNA, 16 nt, Homo sapiens
aggagucaaaacuaca

SEQ ID NO: 1320588 - RNA, 21 nt, Homo sapiens
aggaguguccucuucccucuc

SEQ ID NO: 1320589 - RNA, 18 nt, Homo sapiens
aggagugugaccacugaa

SEQ ID NO: 1320590 - RNA, 16 nt, Homo sapiens
aggauaaauugccaua

SEQ ID NO: 1320591 - RNA, 22 nt, Homo sapiens
aggauacauaaugggccacuga

SEQ ID NO: 1320592 - RNA, 18 nt, Homo sapiens
aggauacuuuacaugguu

SEQ ID NO: 1320593 - RNA, 23 nt, Homo sapiens
aggauagaagcugcagugguauu

SEQ ID NO: 1320594 - RNA, 14 nt, Homo sapiens
aggauagaugcugg

SEQ ID NO: 1320595 - RNA, 20 nt, Homo sapiens
aggaugucugagaccacuug

SEQ ID NO: 1320596 - RNA, 23 nt, Homo sapiens
aggauguugccacuggcaaaugu

SEQ ID NO: 1320597 - RNA, 14 nt, Homo sapiens
aggcaaaauugcaa

SEQ ID NO: 1320598 - RNA, 19 nt, Homo sapiens
aggcaaaugcccaagggaa

SEQ ID NO: 1320599 - RNA, 17 nt, Homo sapiens
aggcaaauggcacugca

SEQ ID NO: 1320600 - RNA, 15 nt, Homo sapiens
aggcaaggaugucug

SEQ ID NO: 1320601 - RNA, 23 nt, Homo sapiens
aggcaauaauaagugaugugcug

SEQ ID NO: 1320602 - RNA, 15 nt, Homo sapiens
aggcaauccuaccuu

SEQ ID NO: 1320603 - RNA, 22 nt, Homo sapiens
aggcaccaguuacccugcaugu

SEQ ID NO: 1320604 - RNA, 12 nt, Homo sapiens
aggcacugaagc

SEQ ID NO: 1320605 - RNA, 22 nt, Homo sapiens
aggcagccuccuuaaauguuuu

SEQ ID NO: 1320606 - RNA, 21 nt, Homo sapiens
aggcagcuuuuucucucccac

SEQ ID NO: 1320607 - RNA, 20 nt, Homo sapiens
aggcaggagaaucucuugaa

SEQ ID NO: 1320608 - RNA, 23 nt, Homo sapiens
aggcauacaaggggguaacucau

SEQ ID NO: 1320609 - RNA, 16 nt, Homo sapiens
aggcaugaaguuuccu

SEQ ID NO: 1320610 - RNA, 19 nt, Homo sapiens
aggcaugacacaccugggg

SEQ ID NO: 1320611 - RNA, 15 nt, Homo sapiens
aggcaugacuguaga

SEQ ID NO: 1320612 - RNA, 14 nt, Homo sapiens
aggccagagccaag

SEQ ID NO: 1320613 - RNA, 19 nt, Homo sapiens
aggccagcuggcagcagag

SEQ ID NO: 1320614 - RNA, 22 nt, Homo sapiens
aggccccucuccuccguggcac

SEQ ID NO: 1320615 - RNA, 18 nt, Homo sapiens
aggccgagaagcaagaaa

SEQ ID NO: 1320616 - RNA, 12 nt, Homo sapiens
aggccugagauu

SEQ ID NO: 1320617 - RNA, 15 nt, Homo sapiens
aggccuggauaauau

SEQ ID NO: 1320618 - RNA, 18 nt, Homo sapiens
aggccuggccagaugcac

SEQ ID NO: 1320619 - RNA, 20 nt, Homo sapiens
aggccuggccagaugcacca

SEQ ID NO: 1320620 - RNA, 21 nt, Homo sapiens
aggccuucaguuuauuuccac

SEQ ID NO: 1320621 - RNA, 15 nt, Homo sapiens
aggcgauccaccugu

SEQ ID NO: 1320622 - RNA, 23 nt, Homo sapiens
aggcgguggacuugaacuuuccu

SEQ ID NO: 1320623 - RNA, 20 nt, Homo sapiens
aggcgugguggcgggugccu

SEQ ID NO: 1320624 - RNA, 22 nt, Homo sapiens
aggcuaaaacaccuuggcuugu

SEQ ID NO: 1320625 - RNA, 13 nt, Homo sapiens
aggcuacagggcc

SEQ ID NO: 1320626 - RNA, 21 nt, Homo sapiens
aggcuauguaaacaaaccaca

SEQ ID NO: 1320627 - RNA, 14 nt, Homo sapiens
aggcugagcugcau

SEQ ID NO: 1320628 - RNA, 16 nt, Homo sapiens
aggcugagcugcaucc

SEQ ID NO: 1320629 - RNA, 23 nt, Homo sapiens
aggcugaggcuggcacaggacau

SEQ ID NO: 1320630 - RNA, 15 nt, Homo sapiens
aggcuggccagucca

SEQ ID NO: 1320631 - RNA, 18 nt, Homo sapiens
aggcuggcuccagaugca

SEQ ID NO: 1320632 - RNA, 15 nt, Homo sapiens
aggcugggcagcaca

SEQ ID NO: 1320633 - RNA, 14 nt, Homo sapiens
aggcuucagucuca

SEQ ID NO: 1320634 - RNA, 17 nt, Homo sapiens
aggcuucugugugcugc

SEQ ID NO: 1320635 - RNA, 17 nt, Homo sapiens
aggcuuguugugcuuuu

SEQ ID NO: 1320636 - RNA, 13 nt, Homo sapiens
aggcuuucagcuu

SEQ ID NO: 1320637 - RNA, 19 nt, Homo sapiens
aggcuuugaguuaacucac

SEQ ID NO: 1320638 - RNA, 11 nt, Homo sapiens
aggcuuugugg

SEQ ID NO: 1320639 - RNA, 18 nt, Homo sapiens
agggaaaauuauuugcau

SEQ ID NO: 1320640 - RNA, 20 nt, Homo sapiens
agggaacucuggcauuccuu

SEQ ID NO: 1320641 - RNA, 16 nt, Homo sapiens
agggaagacauugcaa

SEQ ID NO: 1320642 - RNA, 22 nt, Homo sapiens
agggaagcugucccucacuguu

SEQ ID NO: 1320643 - RNA, 21 nt, Homo sapiens
agggaauaguauagacaauaa

SEQ ID NO: 1320644 - RNA, 14 nt, Homo sapiens
agggaaugacuugg

SEQ ID NO: 1320645 - RNA, 16 nt, Homo sapiens
agggaaugugagcaca

SEQ ID NO: 1320646 - RNA, 14 nt, Homo sapiens
agggacccaugagu

SEQ ID NO: 1320647 - RNA, 17 nt, Homo sapiens
agggaccccugcccuug

SEQ ID NO: 1320648 - RNA, 21 nt, Homo sapiens
agggaccccugcccuuguccc

SEQ ID NO: 1320649 - RNA, 18 nt, Homo sapiens
agggacuugaaguuguua

SEQ ID NO: 1320650 - RNA, 20 nt, Homo sapiens
agggagcugaguaacaccau

SEQ ID NO: 1320651 - RNA, 12 nt, Homo sapiens
agggaggcucag

SEQ ID NO: 1320652 - RNA, 15 nt, Homo sapiens
agggagggcugucau

SEQ ID NO: 1320653 - RNA, 14 nt, Homo sapiens
agggagguggcaag

SEQ ID NO: 1320654 - RNA, 16 nt, Homo sapiens
agggauuccccuaacc

SEQ ID NO: 1320655 - RNA, 15 nt, Homo sapiens
agggcacacacugug

SEQ ID NO: 1320656 - RNA, 18 nt, Homo sapiens
agggcacagcaucuguag

SEQ ID NO: 1320657 - RNA, 12 nt, Homo sapiens
agggcagcagaa

SEQ ID NO: 1320658 - RNA, 17 nt, Homo sapiens
agggcaguucugagugu

SEQ ID NO: 1320659 - RNA, 20 nt, Homo sapiens
agggcaguucugaguguuua

SEQ ID NO: 1320660 - RNA, 16 nt, Homo sapiens
agggccacaugggagg

SEQ ID NO: 1320661 - RNA, 14 nt, Homo sapiens
agggccacucgggg

SEQ ID NO: 1320662 - RNA, 20 nt, Homo sapiens
agggcccccaucucaugccc

SEQ ID NO: 1320663 - RNA, 19 nt, Homo sapiens
agggcuccugcacuuacuu

SEQ ID NO: 1320664 - RNA, 16 nt, Homo sapiens
agagaauguuccagac

SEQ ID NO: 1320665 - RNA, 19 nt, Homo sapiens
agagaauguuccagacauu

SEQ ID NO: 1320666 - RNA, 15 nt, Homo sapiens
agagacaacaaaaau

SEQ ID NO: 1320667 - RNA, 16 nt, Homo sapiens
agagacccaagcugcc

SEQ ID NO: 1320668 - RNA, 15 nt, Homo sapiens
agagacccagaucuc

SEQ ID NO: 1320669 - RNA, 16 nt, Homo sapiens
agagagaggcauuuag

SEQ ID NO: 1320670 - RNA, 19 nt, Homo sapiens
agagagccuggugcugcug

SEQ ID NO: 1320671 - RNA, 17 nt, Homo sapiens
agagaggguggugaccu

SEQ ID NO: 1320672 - RNA, 16 nt, Homo sapiens
agagagucgcaucuca

SEQ ID NO: 1320673 - RNA, 23 nt, Homo sapiens
agagagucgcaucucagugcagg

SEQ ID NO: 1320674 - RNA, 19 nt, Homo sapiens
agagaucagcgacccugag

SEQ ID NO: 1320675 - RNA, 20 nt, Homo sapiens
agagauuugcuuuaccuucc

SEQ ID NO: 1320676 - RNA, 14 nt, Homo sapiens
agagcaggacucca

SEQ ID NO: 1320677 - RNA, 13 nt, Homo sapiens
agagcccagcucc

SEQ ID NO: 1320678 - RNA, 16 nt, Homo sapiens
agagcugggugucaag

SEQ ID NO: 1320679 - RNA, 19 nt, Homo sapiens
agaggaaaaguaaccauca

SEQ ID NO: 1320680 - RNA, 18 nt, Homo sapiens
agaggaaauuguacauaa

SEQ ID NO: 1320681 - RNA, 22 nt, Homo sapiens
agaggacguguuacccacugcc

SEQ ID NO: 1320682 - RNA, 21 nt, Homo sapiens
agaggccggucccuuccuugg

SEQ ID NO: 1320683 - RNA, 14 nt, Homo sapiens
agaggccuuguccc

SEQ ID NO: 1320684 - RNA, 15 nt, Homo sapiens
agaggcugcacuugu

SEQ ID NO: 1320685 - RNA, 16 nt, Homo sapiens
agaggcugcacuugug

SEQ ID NO: 1320686 - RNA, 14 nt, Homo sapiens
aagagaguugcuuu

SEQ ID NO: 1320687 - RNA, 17 nt, Homo sapiens
aagagaguugcuuuuga

SEQ ID NO: 1320688 - RNA, 14 nt, Homo sapiens
aagagauauuuucc

SEQ ID NO: 1320689 - RNA, 13 nt, Homo sapiens
aagagauuccuga

SEQ ID NO: 1320690 - RNA, 17 nt, Homo sapiens
aagagcacacuuggccc

SEQ ID NO: 1320691 - RNA, 21 nt, Homo sapiens
aagaggaaggccucuguggca

SEQ ID NO: 1320692 - RNA, 20 nt, Homo sapiens
aagaggaggcaaauggcacu

SEQ ID NO: 1320693 - RNA, 23 nt, Homo sapiens
aagaggcguugcuuucacucucc

SEQ ID NO: 1320694 - RNA, 22 nt, Homo sapiens
aagaggcuggaguugucacugc

SEQ ID NO: 1320695 - RNA, 16 nt, Homo sapiens
aagagguuuguauaua

SEQ ID NO: 1320696 - RNA, 13 nt, Homo sapiens
aagaguaguuaua

SEQ ID NO: 1320697 - RNA, 15 nt, Homo sapiens
aagaguaguuauaua

SEQ ID NO: 1320698 - RNA, 20 nt, Homo sapiens
aagaguauuaagagcaauuc

SEQ ID NO: 1320699 - RNA, 22 nt, Homo sapiens
aagaguauuaagagcaauucaa

SEQ ID NO: 1320700 - RNA, 18 nt, Homo sapiens
aagaguccucugaaugaa

SEQ ID NO: 1320701 - RNA, 22 nt, Homo sapiens
aagaguggguuucacaagugaa

SEQ ID NO: 1320702 - RNA, 13 nt, Homo sapiens
aagaguugagcuc

SEQ ID NO: 1320703 - RNA, 14 nt, Homo sapiens
aagauaacuaggaa

SEQ ID NO: 1320704 - RNA, 17 nt, Homo sapiens
aagauagcuucacccca

SEQ ID NO: 1320705 - RNA, 15 nt, Homo sapiens
aagauaguaacugua

SEQ ID NO: 1320706 - RNA, 16 nt, Homo sapiens
aagauauuauguauaa

SEQ ID NO: 1320707 - RNA, 14 nt, Homo sapiens
aagauauuuacugu

SEQ ID NO: 1320708 - RNA, 12 nt, Homo sapiens
aagaucaaagac

SEQ ID NO: 1320709 - RNA, 21 nt, Homo sapiens
aagaucaggucauacuaucua

SEQ ID NO: 1320710 - RNA, 18 nt, Homo sapiens
aagaucuagucuguuaca

SEQ ID NO: 1320711 - RNA, 18 nt, Homo sapiens
aagaucuguccucagccu

SEQ ID NO: 1320712 - RNA, 18 nt, Homo sapiens
aagaugagagaacuggag

SEQ ID NO: 1320713 - RNA, 23 nt, Homo sapiens
aagaugauggcucauuuacacuc

SEQ ID NO: 1320714 - RNA, 16 nt, Homo sapiens
aagauuaagacagaga

SEQ ID NO: 1320715 - RNA, 23 nt, Homo sapiens
aagauuaagacagagaaacagac

SEQ ID NO: 1320716 - RNA, 14 nt, Homo sapiens
aagauuaaugcuau

SEQ ID NO: 1320717 - RNA, 19 nt, Homo sapiens
aagauuccaaaaagcacau

SEQ ID NO: 1320718 - RNA, 18 nt, Homo sapiens
aagcagaugcaaagaggc

SEQ ID NO: 1320719 - RNA, 21 nt, Homo sapiens
aagcagaugcaaagaggcaag

SEQ ID NO: 1320720 - RNA, 16 nt, Homo sapiens
aagcagcaacagcaaa

SEQ ID NO: 1320721 - RNA, 20 nt, Homo sapiens
aagcaggaaaugaaaauguc

SEQ ID NO: 1320722 - RNA, 17 nt, Homo sapiens
aagcaggacagugcuug

SEQ ID NO: 1320723 - RNA, 19 nt, Homo sapiens
aagcaggacuaaaugucua

SEQ ID NO: 1320724 - RNA, 14 nt, Homo sapiens
aagcagucgugccu

SEQ ID NO: 1320725 - RNA, 20 nt, Homo sapiens
aagcagucgugccugugucc

SEQ ID NO: 1320726 - RNA, 13 nt, Homo sapiens
aagcauacuuugu

SEQ ID NO: 1320727 - RNA, 22 nt, Homo sapiens
aagcauggcuuuggcuuugcaa

SEQ ID NO: 1320728 - RNA, 14 nt, Homo sapiens
aagcauuuacuuug

SEQ ID NO: 1320729 - RNA, 15 nt, Homo sapiens
aagcauuuguagcaa

SEQ ID NO: 1320730 - RNA, 15 nt, Homo sapiens
aagccacacucuggg

SEQ ID NO: 1320731 - RNA, 12 nt, Homo sapiens
aagccauuccaa

SEQ ID NO: 1320732 - RNA, 15 nt, Homo sapiens
aagccauuccaaagu

SEQ ID NO: 1320733 - RNA, 22 nt, Homo sapiens
aagcccagcacuugaauuguua

SEQ ID NO: 1320734 - RNA, 16 nt, Homo sapiens
aagcccccccuuccac

SEQ ID NO: 1320735 - RNA, 23 nt, Homo sapiens
aagccccuuacuaugaucucagg

SEQ ID NO: 1320736 - RNA, 15 nt, Homo sapiens
aagccgugauuuuca

SEQ ID NO: 1320737 - RNA, 22 nt, Homo sapiens
aagccugacccuguaaaaugga

SEQ ID NO: 1320738 - RNA, 22 nt, Homo sapiens
aagccugcagucaucuugacca

SEQ ID NO: 1320739 - RNA, 19 nt, Homo sapiens
aagcgagacuccaucucaa

SEQ ID NO: 1320740 - RNA, 15 nt, Homo sapiens
aagcgauucuccugc

SEQ ID NO: 1320741 - RNA, 17 nt, Homo sapiens
aagcgauucuccugccu

SEQ ID NO: 1320742 - RNA, 15 nt, Homo sapiens
agaaaacuguuaaua

SEQ ID NO: 1320743 - RNA, 19 nt, Homo sapiens
agaaaagauuauauauuau

SEQ ID NO: 1320744 - RNA, 16 nt, Homo sapiens
agaaaauaacaauaaa

SEQ ID NO: 1320745 - RNA, 20 nt, Homo sapiens
agaaaauaacaauaaaagac

SEQ ID NO: 1320746 - RNA, 21 nt, Homo sapiens
agaaaaucaucaagaagggcu

SEQ ID NO: 1320747 - RNA, 22 nt, Homo sapiens
agaaaaugauguguacccaaac

SEQ ID NO: 1320748 - RNA, 15 nt, Homo sapiens
agaaacaucuagaaa

SEQ ID NO: 1320749 - RNA, 16 nt, Homo sapiens
agaaagacaucuuucu

SEQ ID NO: 1320750 - RNA, 14 nt, Homo sapiens
agaaaggccuuuaa

SEQ ID NO: 1320751 - RNA, 21 nt, Homo sapiens
agaaagggcggugaacucugg

SEQ ID NO: 1320752 - RNA, 14 nt, Homo sapiens
agaaauaaccacug

SEQ ID NO: 1320753 - RNA, 14 nt, Homo sapiens
agaaauacagucuu

SEQ ID NO: 1320754 - RNA, 19 nt, Homo sapiens
agaaauauggaacuuacau

SEQ ID NO: 1320755 - RNA, 23 nt, Homo sapiens
agaaaucuugaauagcuuaugua

SEQ ID NO: 1320756 - RNA, 17 nt, Homo sapiens
agaaauggauguguuau

SEQ ID NO: 1320757 - RNA, 16 nt, Homo sapiens
agaaaugggaaucaug

SEQ ID NO: 1320758 - RNA, 21 nt, Homo sapiens
agaaauuagugccacaaauaa

SEQ ID NO: 1320759 - RNA, 19 nt, Homo sapiens
agaaauuuuucuaguauau

SEQ ID NO: 1320760 - RNA, 21 nt, Homo sapiens
agaaauuuuucuaguauauaa

SEQ ID NO: 1320761 - RNA, 12 nt, Homo sapiens
agaacaaaaaca

SEQ ID NO: 1320762 - RNA, 13 nt, Homo sapiens
agaacaaccaaaa

SEQ ID NO: 1320763 - RNA, 22 nt, Homo sapiens
agaacagccagguagagcccuu

SEQ ID NO: 1320764 - RNA, 19 nt, Homo sapiens
agaacagguguuggugaca

SEQ ID NO: 1320765 - RNA, 14 nt, Homo sapiens
agaacaguaugaau

SEQ ID NO: 1320766 - RNA, 23 nt, Homo sapiens
agaacauaaagguaaaacaaaac

SEQ ID NO: 1320767 - RNA, 16 nt, Homo sapiens
agaacauuuuaauuca

SEQ ID NO: 1320768 - RNA, 20 nt, Homo sapiens
agaaccccaggacgcccuca

SEQ ID NO: 1320769 - RNA, 18 nt, Homo sapiens
agaacggggcucuucuca

SEQ ID NO: 1320770 - RNA, 19 nt, Homo sapiens
agaacguuuuuuccucagu

SEQ ID NO: 1320771 - RNA, 23 nt, Homo sapiens
agaacguuuuuuccucagugcau

SEQ ID NO: 1320772 - RNA, 19 nt, Homo sapiens
agaacucaaauggggccag

SEQ ID NO: 1320773 - RNA, 17 nt, Homo sapiens
agaacucaacuguauaa

SEQ ID NO: 1320774 - RNA, 18 nt, Homo sapiens
agaacugucauguaaaca

SEQ ID NO: 1320775 - RNA, 13 nt, Homo sapiens
agaacugugccac

SEQ ID NO: 1320776 - RNA, 12 nt, Homo sapiens
agaacuuugcau

SEQ ID NO: 1320777 - RNA, 20 nt, Homo sapiens
agaacuuugcauagcagcug

SEQ ID NO: 1320778 - RNA, 23 nt, Homo sapiens
agaacuuugcauagcagcugcua

SEQ ID NO: 1320779 - RNA, 13 nt, Homo sapiens
agaagaaguucau

SEQ ID NO: 1320780 - RNA, 15 nt, Homo sapiens
agaagagaaggggag

SEQ ID NO: 1320781 - RNA, 20 nt, Homo sapiens
agaagccugaugcugacauu

SEQ ID NO: 1320782 - RNA, 16 nt, Homo sapiens
agaagcucuggcccca

SEQ ID NO: 1320783 - RNA, 12 nt, Homo sapiens
agaaggggacaa

SEQ ID NO: 1320784 - RNA, 23 nt, Homo sapiens
agaaggggacaauggcagaacag

SEQ ID NO: 1320785 - RNA, 18 nt, Homo sapiens
agaaggugauaaauguca

SEQ ID NO: 1320786 - RNA, 20 nt, Homo sapiens
agaagguggguuuucaucaa

SEQ ID NO: 1320787 - RNA, 22 nt, Homo sapiens
agaagguuggugaauuucacaa

SEQ ID NO: 1320788 - RNA, 20 nt, Homo sapiens
agaagugccaucucaauugu

SEQ ID NO: 1320789 - RNA, 14 nt, Homo sapiens
agaaguuauuuucc

SEQ ID NO: 1320790 - RNA, 22 nt, Homo sapiens
agaaguugaaacucacuaguaa

SEQ ID NO: 1320791 - RNA, 16 nt, Homo sapiens
agaauaaagauuuaua

SEQ ID NO: 1320792 - RNA, 23 nt, Homo sapiens
agaauacaagauauuauguauaa

SEQ ID NO: 1320793 - RNA, 17 nt, Homo sapiens
agaauauaauacuguau

SEQ ID NO: 1320794 - RNA, 19 nt, Homo sapiens
agaauauagcaucuuucau

SEQ ID NO: 1320795 - RNA, 13 nt, Homo sapiens
agaauaugacuuu

SEQ ID NO: 1320796 - RNA, 12 nt, Homo sapiens
agaauauucucc

SEQ ID NO: 1320797 - RNA, 11 nt, Homo sapiens
agaauccaaac

SEQ ID NO: 1320798 - RNA, 16 nt, Homo sapiens
agaauccaaagaucac

SEQ ID NO: 1320799 - RNA, 20 nt, Homo sapiens
agaaucucauuacugcuuca

SEQ ID NO: 1320800 - RNA, 18 nt, Homo sapiens
agaaucucuugaaccugg

SEQ ID NO: 1320801 - RNA, 22 nt, Homo sapiens
agaaucuguuucccagcagugg

SEQ ID NO: 1320802 - RNA, 20 nt, Homo sapiens
agaaugaaauguaugugcuc

SEQ ID NO: 1320803 - RNA, 14 nt, Homo sapiens
agaauguaacuguu

SEQ ID NO: 1320804 - RNA, 17 nt, Homo sapiens
agaauguguuucaaaac

SEQ ID NO: 1320805 - RNA, 23 nt, Homo sapiens
agaauucagaagaccccugacuc

SEQ ID NO: 1320806 - RNA, 23 nt, Homo sapiens
agaauucauucacucaacaaaca

SEQ ID NO: 1320807 - RNA, 15 nt, Homo sapiens
agaauucuuacaugu

SEQ ID NO: 1320808 - RNA, 21 nt, Homo sapiens
agaauuuauucaauuccucug

SEQ ID NO: 1320809 - RNA, 18 nt, Homo sapiens
agaauuucacaagcuauu

SEQ ID NO: 1320810 - RNA, 16 nt, Homo sapiens
agaauuuguguugaag

SEQ ID NO: 1320811 - RNA, 16 nt, Homo sapiens
agacaaaauauuuucc

SEQ ID NO: 1320812 - RNA, 14 nt, Homo sapiens
agacaacacuggga

SEQ ID NO: 1320813 - RNA, 14 nt, Homo sapiens
agacaagauuuaug

SEQ ID NO: 1320814 - RNA, 14 nt, Homo sapiens
agacaauaugugag

SEQ ID NO: 1320815 - RNA, 13 nt, Homo sapiens
agacaauuugcac

SEQ ID NO: 1320816 - RNA, 20 nt, Homo sapiens
agacacuggcguuacugcuu

SEQ ID NO: 1320817 - RNA, 19 nt, Homo sapiens
agacagacaacacugggaa

SEQ ID NO: 1320818 - RNA, 14 nt, Homo sapiens
agacagaguccugc

SEQ ID NO: 1320819 - RNA, 22 nt, Homo sapiens
agacagaguuuucacucuuauu

SEQ ID NO: 1320820 - RNA, 18 nt, Homo sapiens
agacaggguuuggcugug

SEQ ID NO: 1320821 - RNA, 19 nt, Homo sapiens
agacaggguuuugccaugu

SEQ ID NO: 1320822 - RNA, 13 nt, Homo sapiens
agacauacuugaa

SEQ ID NO: 1320823 - RNA, 21 nt, Homo sapiens
agacaugauuuccuugaaugu

SEQ ID NO: 1320824 - RNA, 21 nt, Homo sapiens
agacauucucgcuucccugaa

SEQ ID NO: 1320825 - RNA, 19 nt, Homo sapiens
agaccagccuggccaagag

SEQ ID NO: 1320826 - RNA, 19 nt, Homo sapiens
agacccagcugauugcacu

SEQ ID NO: 1320827 - RNA, 16 nt, Homo sapiens
agacccugaagauuuc

SEQ ID NO: 1320828 - RNA, 21 nt, Homo sapiens
agaccgugaccagugcugcug

SEQ ID NO: 1320829 - RNA, 13 nt, Homo sapiens
agaccucagggca

SEQ ID NO: 1320830 - RNA, 14 nt, Homo sapiens
agaccugauccugg

SEQ ID NO: 1320831 - RNA, 21 nt, Homo sapiens
agaccuggcacuggaugcaga

SEQ ID NO: 1320832 - RNA, 18 nt, Homo sapiens
agacguuaggcauuuccu

SEQ ID NO: 1320833 - RNA, 13 nt, Homo sapiens
agacuaaggccau

SEQ ID NO: 1320834 - RNA, 17 nt, Homo sapiens
agacucaaaugcucaga

SEQ ID NO: 1320835 - RNA, 20 nt, Homo sapiens
agacucuacagaggccaugg

SEQ ID NO: 1320836 - RNA, 19 nt, Homo sapiens
agacucucgcaucuuccca

SEQ ID NO: 1320837 - RNA, 21 nt, Homo sapiens
agacucuggggaugggaauga

SEQ ID NO: 1320838 - RNA, 20 nt, Homo sapiens
agacugcaguggacaguccc

SEQ ID NO: 1320839 - RNA, 14 nt, Homo sapiens
agacugcccugggu

SEQ ID NO: 1320840 - RNA, 14 nt, Homo sapiens
agacuggaaggugg

SEQ ID NO: 1320841 - RNA, 18 nt, Homo sapiens
agacuuaaaaaauacuug

SEQ ID NO: 1320842 - RNA, 21 nt, Homo sapiens
agacuuaaaaaauacuugcau

SEQ ID NO: 1320843 - RNA, 13 nt, Homo sapiens
agacuucccugaa

SEQ ID NO: 1320844 - RNA, 15 nt, Homo sapiens
agacuuucucugugu

SEQ ID NO: 1320845 - RNA, 22 nt, Homo sapiens
agagaaaacagaccuaaugcuc

SEQ ID NO: 1320846 - RNA, 15 nt, Homo sapiens
agagaaccucagauc

SEQ ID NO: 1320847 - RNA, 18 nt, Homo sapiens
agagaaugcugucaauau

SEQ ID NO: 1320848 - RNA, 17 nt, Homo sapiens
agagaauggauccucau

SEQ ID NO: 1320849 - RNA, 14 nt, Homo sapiens
uugguguaagccuu

SEQ ID NO: 1320850 - RNA, 21 nt, Homo sapiens
uugguguacuguaaugugaau

SEQ ID NO: 1320851 - RNA, 16 nt, Homo sapiens
uugguuuugacuucag

SEQ ID NO: 1320852 - RNA, 15 nt, Homo sapiens
uuguaaugaauuccu

SEQ ID NO: 1320853 - RNA, 18 nt, Homo sapiens
uuguagccacaagccuga

SEQ ID NO: 1320854 - RNA, 18 nt, Homo sapiens
uugucaagccugugcaaa

SEQ ID NO: 1320855 - RNA, 23 nt, Homo sapiens
uugucaagucagaacagccaggu

SEQ ID NO: 1320856 - RNA, 15 nt, Homo sapiens
uugucacacgauaaa

SEQ ID NO: 1320857 - RNA, 19 nt, Homo sapiens
uugucacagggacugaaaa

SEQ ID NO: 1320858 - RNA, 17 nt, Homo sapiens
uugucccacucaagcca

SEQ ID NO: 1320859 - RNA, 16 nt, Homo sapiens
uuguccccguccccca

SEQ ID NO: 1320860 - RNA, 13 nt, Homo sapiens
uugugccaaccua

SEQ ID NO: 1320861 - RNA, 20 nt, Homo sapiens
uugugccacuacacuccagc

SEQ ID NO: 1320862 - RNA, 20 nt, Homo sapiens
uugugcuucuuucuuuggga

SEQ ID NO: 1320863 - RNA, 16 nt, Homo sapiens
uuguguauccaugcac

SEQ ID NO: 1320864 - RNA, 20 nt, Homo sapiens
uuguguauggguagcacuac

SEQ ID NO: 1320865 - RNA, 17 nt, Homo sapiens
uuguuacuucugaggua

SEQ ID NO: 1320866 - RNA, 11 nt, Homo sapiens
uuguucaauua

SEQ ID NO: 1320867 - RNA, 23 nt, Homo sapiens
uuguuccagcaguuuucaaguca

SEQ ID NO: 1320868 - RNA, 17 nt, Homo sapiens
uuguucgggugugcaau

SEQ ID NO: 1320869 - RNA, 21 nt, Homo sapiens
uuguucguauuuagaauggga

SEQ ID NO: 1320870 - RNA, 17 nt, Homo sapiens
uuguuggccaaagccaa

SEQ ID NO: 1320871 - RNA, 19 nt, Homo sapiens
uuguuucaaccaagucaug

SEQ ID NO: 1320872 - RNA, 21 nt, Homo sapiens
uuguuuuaaaauuaaagcuaa

SEQ ID NO: 1320873 - RNA, 21 nt, Homo sapiens
uuguuuuaugcucagggucaa

SEQ ID NO: 1320874 - RNA, 18 nt, Homo sapiens
uuguuuucuguucuccuu

SEQ ID NO: 1320875 - RNA, 18 nt, Homo sapiens
uuguuuuguguaacauau

SEQ ID NO: 1320876 - RNA, 23 nt, Homo sapiens
uuuaaaaaaaaaaaaaaagccaa

SEQ ID NO: 1320877 - RNA, 15 nt, Homo sapiens
uuuaaaaauacacau

SEQ ID NO: 1320878 - RNA, 21 nt, Homo sapiens
uuuaaacaguaaaccuuaaca

SEQ ID NO: 1320879 - RNA, 18 nt, Homo sapiens
uuuaaaccugacaauggu

SEQ ID NO: 1320880 - RNA, 23 nt, Homo sapiens
uuuaaauacagucuuccauuugc

SEQ ID NO: 1320881 - RNA, 21 nt, Homo sapiens
uuuaaauauauauuauucuca

SEQ ID NO: 1320882 - RNA, 22 nt, Homo sapiens
uuuaaaucaacgaguacuucaa

SEQ ID NO: 1320883 - RNA, 21 nt, Homo sapiens
uuuaacuagaauuuauucaau

SEQ ID NO: 1320884 - RNA, 21 nt, Homo sapiens
uuuaacuucugccuguggaac

SEQ ID NO: 1320885 - RNA, 15 nt, Homo sapiens
uuuaagggaauguga

SEQ ID NO: 1320886 - RNA, 19 nt, Homo sapiens
uuuaagguuuuuacuguga

SEQ ID NO: 1320887 - RNA, 22 nt, Homo sapiens
uuuaauaaacacugacauuucc

SEQ ID NO: 1320888 - RNA, 16 nt, Homo sapiens
uuuaaucaaguugaau

SEQ ID NO: 1320889 - RNA, 19 nt, Homo sapiens
uuuaaugccgauauacucu

SEQ ID NO: 1320890 - RNA, 13 nt, Homo sapiens
uuuaauuuacacu

SEQ ID NO: 1320891 - RNA, 17 nt, Homo sapiens
uuuacaauguucauccc

SEQ ID NO: 1320892 - RNA, 20 nt, Homo sapiens
uuuacaauuugacauacaaa

SEQ ID NO: 1320893 - RNA, 12 nt, Homo sapiens
uuuacacaaaua

SEQ ID NO: 1320894 - RNA, 14 nt, Homo sapiens
uuuacagaauuuua

SEQ ID NO: 1320895 - RNA, 11 nt, Homo sapiens
uuuacauuucu

SEQ ID NO: 1320896 - RNA, 10 nt, Homo sapiens
uuuacuuuag

SEQ ID NO: 1320897 - RNA, 14 nt, Homo sapiens
uuuagaaacuaaga

SEQ ID NO: 1320898 - RNA, 21 nt, Homo sapiens
uuuagaaagguuuugagcaug

SEQ ID NO: 1320899 - RNA, 19 nt, Homo sapiens
uuuagaaauagaacuacaa

SEQ ID NO: 1320900 - RNA, 17 nt, Homo sapiens
uuuagcagagacuuuag

SEQ ID NO: 1320901 - RNA, 23 nt, Homo sapiens
uuuaggaaaggcugaugauggua

SEQ ID NO: 1320902 - RNA, 23 nt, Homo sapiens
uuuagggaaaaaaaacaggagga

SEQ ID NO: 1320903 - RNA, 15 nt, Homo sapiens
uuuagggaagacauu

SEQ ID NO: 1320904 - RNA, 14 nt, Homo sapiens
uuuaguaaauguua

SEQ ID NO: 1320905 - RNA, 23 nt, Homo sapiens
uuuaguaagagauuccugagcca

SEQ ID NO: 1320906 - RNA, 15 nt, Homo sapiens
uuuaucucacacaca

SEQ ID NO: 1320907 - RNA, 14 nt, Homo sapiens
uuuaucugugcaaa

SEQ ID NO: 1320908 - RNA, 16 nt, Homo sapiens
uuuauuaccucugaua

SEQ ID NO: 1320909 - RNA, 14 nt, Homo sapiens
uuuauuuuggaacu

SEQ ID NO: 1320910 - RNA, 18 nt, Homo sapiens
uuuauuuuugagacagag

SEQ ID NO: 1320911 - RNA, 20 nt, Homo sapiens
uuucaaagaaaauagauuag

SEQ ID NO: 1320912 - RNA, 13 nt, Homo sapiens
uuucaacugccaa

SEQ ID NO: 1320913 - RNA, 14 nt, Homo sapiens
uuucaagcucugca

SEQ ID NO: 1320914 - RNA, 12 nt, Homo sapiens
uuucaaggccuu

SEQ ID NO: 1320915 - RNA, 21 nt, Homo sapiens
uuagacuuaauagaaacauug

SEQ ID NO: 1320916 - RNA, 15 nt, Homo sapiens
uuagaggaaggagau

SEQ ID NO: 1320917 - RNA, 20 nt, Homo sapiens
uuagauuguuaaaauaacua

SEQ ID NO: 1320918 - RNA, 13 nt, Homo sapiens
uuagcaaacugaa

SEQ ID NO: 1320919 - RNA, 16 nt, Homo sapiens
uuagccagauuugucu

SEQ ID NO: 1320920 - RNA, 22 nt, Homo sapiens
uuagccauuuuucaaagcaauu

SEQ ID NO: 1320921 - RNA, 17 nt, Homo sapiens
uuaggaaaaaaacuauu

SEQ ID NO: 1320922 - RNA, 14 nt, Homo sapiens
uuaggaaucaauga

SEQ ID NO: 1320923 - RNA, 20 nt, Homo sapiens
uuaggccuccggaugacugc

SEQ ID NO: 1320924 - RNA, 20 nt, Homo sapiens
uuaggugguguuugcuuguu

SEQ ID NO: 1320925 - RNA, 22 nt, Homo sapiens
uuagguuuuuuuuuuuuuuaac

SEQ ID NO: 1320926 - RNA, 17 nt, Homo sapiens
uuaguacagguuacuca

SEQ ID NO: 1320927 - RNA, 15 nt, Homo sapiens
uuaguacuuacauca

SEQ ID NO: 1320928 - RNA, 16 nt, Homo sapiens
uuaguacuuacaucag

SEQ ID NO: 1320929 - RNA, 17 nt, Homo sapiens
uuaguccaauuccuugc

SEQ ID NO: 1320930 - RNA, 19 nt, Homo sapiens
uuagugguuacccaguuag

SEQ ID NO: 1320931 - RNA, 21 nt, Homo sapiens
uuaguuacuuuggaacacuac

SEQ ID NO: 1320932 - RNA, 16 nt, Homo sapiens
uuaguuauacuccuca

SEQ ID NO: 1320933 - RNA, 20 nt, Homo sapiens
uuaguugcacuaacugcugg

SEQ ID NO: 1320934 - RNA, 20 nt, Homo sapiens
uuauaagaaagaucaaagac

SEQ ID NO: 1320935 - RNA, 12 nt, Homo sapiens
uuauacagugau

SEQ ID NO: 1320936 - RNA, 14 nt, Homo sapiens
uuauacuacuuugu

SEQ ID NO: 1320937 - RNA, 13 nt, Homo sapiens
uuauacuguacaa

SEQ ID NO: 1320938 - RNA, 14 nt, Homo sapiens
uuauacuguacaau

SEQ ID NO: 1320939 - RNA, 21 nt, Homo sapiens
uuauacuucucuauuaucuca

SEQ ID NO: 1320940 - RNA, 24 nt, Homo sapiens
uuauauauguaucuaaaccauaug

SEQ ID NO: 1320941 - RNA, 18 nt, Homo sapiens
uuaucaccgugggcuccc

SEQ ID NO: 1320942 - RNA, 16 nt, Homo sapiens
uuauccuucuacuugu

SEQ ID NO: 1320943 - RNA, 13 nt, Homo sapiens
uuaucugugcaaa

SEQ ID NO: 1320944 - RNA, 13 nt, Homo sapiens
uuauguaacuuga

SEQ ID NO: 1320945 - RNA, 13 nt, Homo sapiens
uuauuaaaauucu

SEQ ID NO: 1320946 - RNA, 22 nt, Homo sapiens
uuauuacccaaacccauggcuc

SEQ ID NO: 1320947 - RNA, 15 nt, Homo sapiens
uuauuauaacaucca

SEQ ID NO: 1320948 - RNA, 12 nt, Homo sapiens
uuauuauauucc

SEQ ID NO: 1320949 - RNA, 19 nt, Homo sapiens
uuauucuaaacagacucau

SEQ ID NO: 1320950 - RNA, 15 nt, Homo sapiens
uuauucuugguuuuc

SEQ ID NO: 1320951 - RNA, 18 nt, Homo sapiens
uuauugagauuguccuca

SEQ ID NO: 1320952 - RNA, 15 nt, Homo sapiens
uuauugcacauuguu

SEQ ID NO: 1320953 - RNA, 23 nt, Homo sapiens
uuauuuaccugaaauaaaauuca

SEQ ID NO: 1320954 - RNA, 19 nt, Homo sapiens
uuauuuagggaacugcuug

SEQ ID NO: 1320955 - RNA, 17 nt, Homo sapiens
uuauuugccagagccaa

SEQ ID NO: 1320956 - RNA, 17 nt, Homo sapiens
uuauuugcuucuucgaa

SEQ ID NO: 1320957 - RNA, 14 nt, Homo sapiens
uuauuuuccaggua

SEQ ID NO: 1320958 - RNA, 15 nt, Homo sapiens
uucaaaccagcuuca

SEQ ID NO: 1320959 - RNA, 13 nt, Homo sapiens
uucaaagacugug

SEQ ID NO: 1320960 - RNA, 20 nt, Homo sapiens
uucaaagauuuuuauuuuga

SEQ ID NO: 1320961 - RNA, 19 nt, Homo sapiens
uucaaagcaauugaaaugc

SEQ ID NO: 1320962 - RNA, 11 nt, Homo sapiens
uucaacuggag

SEQ ID NO: 1320963 - RNA, 16 nt, Homo sapiens
uucaagagcacacuug

SEQ ID NO: 1320964 - RNA, 22 nt, Homo sapiens
uucaagguugguucaacaucua

SEQ ID NO: 1320965 - RNA, 18 nt, Homo sapiens
uucaauuguaaauugaau

SEQ ID NO: 1320966 - RNA, 15 nt, Homo sapiens
uucacaaauacauaa

SEQ ID NO: 1320967 - RNA, 10 nt, Homo sapiens
uucacaagcu

SEQ ID NO: 1320968 - RNA, 21 nt, Homo sapiens
uucacaaggucuuuaaaguga

SEQ ID NO: 1320969 - RNA, 15 nt, Homo sapiens
uucacagugaucgau

SEQ ID NO: 1320970 - RNA, 11 nt, Homo sapiens
uucacagugca

SEQ ID NO: 1320971 - RNA, 17 nt, Homo sapiens
uucacaucagaacagac

SEQ ID NO: 1320972 - RNA, 17 nt, Homo sapiens
uucacauugaaacccag

SEQ ID NO: 1320973 - RNA, 19 nt, Homo sapiens
uucaccuuuguagcacuca

SEQ ID NO: 1320974 - RNA, 16 nt, Homo sapiens
uucacucaacaaacau

SEQ ID NO: 1320975 - RNA, 15 nt, Homo sapiens
uucacucauacaucu

SEQ ID NO: 1320976 - RNA, 16 nt, Homo sapiens
uucacucccaaccuga

SEQ ID NO: 1320977 - RNA, 14 nt, Homo sapiens
uucagacaaaaugg

SEQ ID NO: 1320978 - RNA, 19 nt, Homo sapiens
uucagagugacacccaaga

SEQ ID NO: 1320979 - RNA, 12 nt, Homo sapiens
uucagaugugaa

SEQ ID NO: 1320980 - RNA, 18 nt, Homo sapiens
uucagcagcacccaugua

SEQ ID NO: 1320981 - RNA, 20 nt, Homo sapiens
uucagggaagaagcauacaa

SEQ ID NO: 1320982 - RNA, 18 nt, Homo sapiens
uucagguccaggcugugu

SEQ ID NO: 1320983 - RNA, 18 nt, Homo sapiens
uucagugcagcauauaca

SEQ ID NO: 1320984 - RNA, 16 nt, Homo sapiens
uucauaaaaacacuca

SEQ ID NO: 1320985 - RNA, 16 nt, Homo sapiens
uucauacccuguuacc

SEQ ID NO: 1320986 - RNA, 21 nt, Homo sapiens
uucauaugacauucaugccug

SEQ ID NO: 1320987 - RNA, 16 nt, Homo sapiens
uucauccgcacuguaa

SEQ ID NO: 1320988 - RNA, 11 nt, Homo sapiens
uucaucucuug

SEQ ID NO: 1320989 - RNA, 21 nt, Homo sapiens
uugcaaauaccuccucccuaa

SEQ ID NO: 1320990 - RNA, 16 nt, Homo sapiens
uugcaaaucuugaaau

SEQ ID NO: 1320991 - RNA, 24 nt, Homo sapiens
uugcaaccuaccuguugagcauca

SEQ ID NO: 1320992 - RNA, 22 nt, Homo sapiens
uugcaaccucgcuggacucuca

SEQ ID NO: 1320993 - RNA, 13 nt, Homo sapiens
uugcaaggcauuu

SEQ ID NO: 1320994 - RNA, 15 nt, Homo sapiens
uugcaauaaugcagu

SEQ ID NO: 1320995 - RNA, 19 nt, Homo sapiens
uugcacaacucuacuguug

SEQ ID NO: 1320996 - RNA, 22 nt, Homo sapiens
uugcacauaguagguacccaau

SEQ ID NO: 1320997 - RNA, 23 nt, Homo sapiens
uugcacugaaauggaauucccau

SEQ ID NO: 1320998 - RNA, 17 nt, Homo sapiens
uugcacuuaugauuuca

SEQ ID NO: 1320999 - RNA, 13 nt, Homo sapiens
uugcagacaggaa

SEQ ID NO: 1321000 - RNA, 20 nt, Homo sapiens
uugcagagaaccucagauca

SEQ ID NO: 1321001 - RNA, 14 nt, Homo sapiens
uugcaucagcaaca

SEQ ID NO: 1321002 - RNA, 20 nt, Homo sapiens
uugcaucucuaauagagauu

SEQ ID NO: 1321003 - RNA, 21 nt, Homo sapiens
uugccacugauuuagccaugu

SEQ ID NO: 1321004 - RNA, 16 nt, Homo sapiens
uugcccaaaacuguca

SEQ ID NO: 1321005 - RNA, 14 nt, Homo sapiens
uugccccacucugc

SEQ ID NO: 1321006 - RNA, 17 nt, Homo sapiens
uugccgcgucgcccucc

SEQ ID NO: 1321007 - RNA, 17 nt, Homo sapiens
uugccuaaauccaaaga

SEQ ID NO: 1321008 - RNA, 15 nt, Homo sapiens
uugccucugugcugu

SEQ ID NO: 1321009 - RNA, 23 nt, Homo sapiens
uugccugcacaaacucaccaucu

SEQ ID NO: 1321010 - RNA, 20 nt, Homo sapiens
uugccugggaaacauagcag

SEQ ID NO: 1321011 - RNA, 16 nt, Homo sapiens
uugccuuugaauguua

SEQ ID NO: 1321012 - RNA, 13 nt, Homo sapiens
uugcggacagcca

SEQ ID NO: 1321013 - RNA, 17 nt, Homo sapiens
uugcggggauaaagaga

SEQ ID NO: 1321014 - RNA, 18 nt, Homo sapiens
uugcuauaauaaagaagu

SEQ ID NO: 1321015 - RNA, 22 nt, Homo sapiens
uugcuccuggcuggggccuguu

SEQ ID NO: 1321016 - RNA, 15 nt, Homo sapiens
uugcuggaguacuua

SEQ ID NO: 1321017 - RNA, 17 nt, Homo sapiens
uugcugugggccaaaau

SEQ ID NO: 1321018 - RNA, 21 nt, Homo sapiens
uugcuucuagagcuuagcaua

SEQ ID NO: 1321019 - RNA, 18 nt, Homo sapiens
uuggaaaaagccugugaa

SEQ ID NO: 1321020 - RNA, 14 nt, Homo sapiens
uuggaaagcagucc

SEQ ID NO: 1321021 - RNA, 20 nt, Homo sapiens
uuggaaauguggucaucaaa

SEQ ID NO: 1321022 - RNA, 22 nt, Homo sapiens
uuggaaauuuugaugcuuguau

SEQ ID NO: 1321023 - RNA, 12 nt, Homo sapiens
uuggaacccaag

SEQ ID NO: 1321024 - RNA, 21 nt, Homo sapiens
uuggaagaaagaauuucaaaa

SEQ ID NO: 1321025 - RNA, 20 nt, Homo sapiens
uuggaaguguucccugagaa

SEQ ID NO: 1321026 - RNA, 17 nt, Homo sapiens
uuggaaugggcagcuca

SEQ ID NO: 1321027 - RNA, 23 nt, Homo sapiens
uuggacaaucaugaaauaugcau

SEQ ID NO: 1321028 - RNA, 19 nt, Homo sapiens
uuggacauagcgaauacaa

SEQ ID NO: 1321029 - RNA, 19 nt, Homo sapiens
uuggacccauugccaguga

SEQ ID NO: 1321030 - RNA, 23 nt, Homo sapiens
uuggacugggugcggugacucau

SEQ ID NO: 1321031 - RNA, 12 nt, Homo sapiens
uuggagaacuca

SEQ ID NO: 1321032 - RNA, 19 nt, Homo sapiens
uuggagaagcucaucagaa

SEQ ID NO: 1321033 - RNA, 14 nt, Homo sapiens
uuggcaccagacac

SEQ ID NO: 1321034 - RNA, 17 nt, Homo sapiens
uuggcagagcuucuucc

SEQ ID NO: 1321035 - RNA, 19 nt, Homo sapiens
uuggcagcccugaugacug

SEQ ID NO: 1321036 - RNA, 16 nt, Homo sapiens
uuggcucacacugaga

SEQ ID NO: 1321037 - RNA, 18 nt, Homo sapiens
uuggcugcaggaaucuuu

SEQ ID NO: 1321038 - RNA, 19 nt, Homo sapiens
uuggcuguggggaccccag

SEQ ID NO: 1321039 - RNA, 18 nt, Homo sapiens
uuggcuuguuuggagcau

SEQ ID NO: 1321040 - RNA, 14 nt, Homo sapiens
uuggcuuuuacuga

SEQ ID NO: 1321041 - RNA, 17 nt, Homo sapiens
uugggaagggcagggaa

SEQ ID NO: 1321042 - RNA, 19 nt, Homo sapiens
uugggagaaagagaaauca

SEQ ID NO: 1321043 - RNA, 20 nt, Homo sapiens
uugggauugagucugugcca

SEQ ID NO: 1321044 - RNA, 22 nt, Homo sapiens
uugggcagagcuggcucugagc

SEQ ID NO: 1321045 - RNA, 15 nt, Homo sapiens
uugggcccuuugagu

SEQ ID NO: 1321046 - RNA, 16 nt, Homo sapiens
uugggcuggugucacc

SEQ ID NO: 1321047 - RNA, 20 nt, Homo sapiens
uugggguagguagauaccaa

SEQ ID NO: 1321048 - RNA, 16 nt, Homo sapiens
uuggguucacagugca

SEQ ID NO: 1321049 - RNA, 16 nt, Homo sapiens
uugguaaauucacaaa

SEQ ID NO: 1321050 - RNA, 21 nt, Homo sapiens
uugguccuaccuauuauccuu

SEQ ID NO: 1321051 - RNA, 15 nt, Homo sapiens
uuggugaauuucaca

SEQ ID NO: 1321052 - RNA, 16 nt, Homo sapiens
uugguggcuaccaugc

SEQ ID NO: 1321053 - RNA, 13 nt, Homo sapiens
ugugugugcauau

SEQ ID NO: 1321054 - RNA, 15 nt, Homo sapiens
ugugugugugcauau

SEQ ID NO: 1321055 - RNA, 20 nt, Homo sapiens
uguguguugccacaggacac

SEQ ID NO: 1321056 - RNA, 19 nt, Homo sapiens
uguguuauuuaaugaguca

SEQ ID NO: 1321057 - RNA, 17 nt, Homo sapiens
uguguuuuugccacuga

SEQ ID NO: 1321058 - RNA, 21 nt, Homo sapiens
uguuaaaauagacuaaccucu

SEQ ID NO: 1321059 - RNA, 15 nt, Homo sapiens
uguuaagguucaaga

SEQ ID NO: 1321060 - RNA, 13 nt, Homo sapiens
uguuaaugcauca

SEQ ID NO: 1321061 - RNA, 18 nt, Homo sapiens
uguuacugccuaucagca

SEQ ID NO: 1321062 - RNA, 15 nt, Homo sapiens
uguuacugucuucag

SEQ ID NO: 1321063 - RNA, 16 nt, Homo sapiens
uguuauagaacuucau

SEQ ID NO: 1321064 - RNA, 18 nt, Homo sapiens
uguuauagaacuucaugg

SEQ ID NO: 1321065 - RNA, 23 nt, Homo sapiens
uguuauauagggaucaaccagcu

SEQ ID NO: 1321066 - RNA, 14 nt, Homo sapiens
uguuaugcaaaaaa

SEQ ID NO: 1321067 - RNA, 17 nt, Homo sapiens
uguuauuaacagauaau

SEQ ID NO: 1321068 - RNA, 12 nt, Homo sapiens
uguuauucuugc

SEQ ID NO: 1321069 - RNA, 16 nt, Homo sapiens
uguuauugauguugcu

SEQ ID NO: 1321070 - RNA, 12 nt, Homo sapiens
uguucaagagca

SEQ ID NO: 1321071 - RNA, 18 nt, Homo sapiens
uguucaagagcacacuug

SEQ ID NO: 1321072 - RNA, 14 nt, Homo sapiens
uguucaguacucua

SEQ ID NO: 1321073 - RNA, 13 nt, Homo sapiens
uguuccaugucuc

SEQ ID NO: 1321074 - RNA, 13 nt, Homo sapiens
uguuccccagaga

SEQ ID NO: 1321075 - RNA, 18 nt, Homo sapiens
uguuccccuuccacugag

SEQ ID NO: 1321076 - RNA, 22 nt, Homo sapiens
uguucuaagucuuuccauugga

SEQ ID NO: 1321077 - RNA, 23 nt, Homo sapiens
uguucuacuuuuugguacaggua

SEQ ID NO: 1321078 - RNA, 20 nt, Homo sapiens
uguucuauucaucucaagga

SEQ ID NO: 1321079 - RNA, 16 nt, Homo sapiens
uguucuauuugugcuu

SEQ ID NO: 1321080 - RNA, 19 nt, Homo sapiens
uguucuuuagaugguggca

SEQ ID NO: 1321081 - RNA, 21 nt, Homo sapiens
uguugaaaacccagacugucu

SEQ ID NO: 1321082 - RNA, 14 nt, Homo sapiens
uguugcagguucau

SEQ ID NO: 1321083 - RNA, 24 nt, Homo sapiens
uguugcccuggcaccuguggccag

SEQ ID NO: 1321084 - RNA, 22 nt, Homo sapiens
uguugcugagucugcagaugag

SEQ ID NO: 1321085 - RNA, 17 nt, Homo sapiens
uguugcuuuguugcacu

SEQ ID NO: 1321086 - RNA, 13 nt, Homo sapiens
uguuggugacaau

SEQ ID NO: 1321087 - RNA, 17 nt, Homo sapiens
uguuuaaaaauacacau

SEQ ID NO: 1321088 - RNA, 18 nt, Homo sapiens
uguuuagaaaaguauucg

SEQ ID NO: 1321089 - RNA, 18 nt, Homo sapiens
uguuuagcccaaaaccaa

SEQ ID NO: 1321090 - RNA, 17 nt, Homo sapiens
uguuucuaccuauaugc

SEQ ID NO: 1321091 - RNA, 14 nt, Homo sapiens
uguuugaaaccaag

SEQ ID NO: 1321092 - RNA, 19 nt, Homo sapiens
uguuuguuguauacuuccu

SEQ ID NO: 1321093 - RNA, 22 nt, Homo sapiens
uguuuguuguauacuuccuuau

SEQ ID NO: 1321094 - RNA, 17 nt, Homo sapiens
uguuuuaaauguacaga

SEQ ID NO: 1321095 - RNA, 20 nt, Homo sapiens
uguuuuaaauuuugugguuc

SEQ ID NO: 1321096 - RNA, 20 nt, Homo sapiens
uguuuugccauguuggccag

SEQ ID NO: 1321097 - RNA, 13 nt, Homo sapiens
uguuuuguagcaa

SEQ ID NO: 1321098 - RNA, 12 nt, Homo sapiens
uguuuuuacuaa

SEQ ID NO: 1321099 - RNA, 23 nt, Homo sapiens
uuaaaaaaaacaaaaagaacaaa

SEQ ID NO: 1321100 - RNA, 14 nt, Homo sapiens
uuaaaaaaacaauc

SEQ ID NO: 1321101 - RNA, 19 nt, Homo sapiens
uuaaaaacuuaaguaccaa

SEQ ID NO: 1321102 - RNA, 20 nt, Homo sapiens
uuaaaaaugucuugcuguug

SEQ ID NO: 1321103 - RNA, 14 nt, Homo sapiens
uuaaaacacuuuca

SEQ ID NO: 1321104 - RNA, 22 nt, Homo sapiens
uuaaaaggaaauguaaaagcac

SEQ ID NO: 1321105 - RNA, 16 nt, Homo sapiens
uuaaaagucaguauca

SEQ ID NO: 1321106 - RNA, 22 nt, Homo sapiens
uuaaaauauuuaucugauuaag

SEQ ID NO: 1321107 - RNA, 13 nt, Homo sapiens
uuaaacaccaauu

SEQ ID NO: 1321108 - RNA, 16 nt, Homo sapiens
uuaaagaauuuggaag

SEQ ID NO: 1321109 - RNA, 14 nt, Homo sapiens
uuaaauaaauggaa

SEQ ID NO: 1321110 - RNA, 21 nt, Homo sapiens
uuaaauauuuuggcauuguac

SEQ ID NO: 1321111 - RNA, 13 nt, Homo sapiens
uuaaauguauuau

SEQ ID NO: 1321112 - RNA, 14 nt, Homo sapiens
uuaaauuacaauuu

SEQ ID NO: 1321113 - RNA, 21 nt, Homo sapiens
uuaaauuugguacaaaaccac

SEQ ID NO: 1321114 - RNA, 13 nt, Homo sapiens
uuaacaaacucuu

SEQ ID NO: 1321115 - RNA, 15 nt, Homo sapiens
uuaacacucaugaag

SEQ ID NO: 1321116 - RNA, 13 nt, Homo sapiens
uuaacauaagaaa

SEQ ID NO: 1321117 - RNA, 15 nt, Homo sapiens
uuaaccagaugguug

SEQ ID NO: 1321118 - RNA, 14 nt, Homo sapiens
uuaacgucaucuca

SEQ ID NO: 1321119 - RNA, 16 nt, Homo sapiens
uuaacgucaucucagg

SEQ ID NO: 1321120 - RNA, 19 nt, Homo sapiens
uuaacucuaucugucauac

SEQ ID NO: 1321121 - RNA, 15 nt, Homo sapiens
uuaacucuuuuggac

SEQ ID NO: 1321122 - RNA, 18 nt, Homo sapiens
uuaagaccuggcagcucu

SEQ ID NO: 1321123 - RNA, 18 nt, Homo sapiens
uuaagagcucuggugaua

SEQ ID NO: 1321124 - RNA, 17 nt, Homo sapiens
uuaagaugguaagaccu

SEQ ID NO: 1321125 - RNA, 18 nt, Homo sapiens
uuaaggaaaaauaaauau

SEQ ID NO: 1321126 - RNA, 13 nt, Homo sapiens
uuaaggacacugg

SEQ ID NO: 1321127 - RNA, 14 nt, Homo sapiens
uuaaggauguugcc

SEQ ID NO: 1321128 - RNA, 23 nt, Homo sapiens
uuaaguguaacuggcaguuuucc

SEQ ID NO: 1321129 - RNA, 20 nt, Homo sapiens
uuaaguuguugauguuuuaa

SEQ ID NO: 1321130 - RNA, 21 nt, Homo sapiens
uuaaguuguugauguuuuaac

SEQ ID NO: 1321131 - RNA, 13 nt, Homo sapiens
ugcugcagagaaa

SEQ ID NO: 1321132 - RNA, 16 nt, Homo sapiens
ugcugcuaaaugggac

SEQ ID NO: 1321133 - RNA, 16 nt, Homo sapiens
ugcuggaacacaaaga

SEQ ID NO: 1321134 - RNA, 14 nt, Homo sapiens
ugcuggcauuugca

SEQ ID NO: 1321135 - RNA, 19 nt, Homo sapiens
ugcugggcccccuacccug

SEQ ID NO: 1321136 - RNA, 19 nt, Homo sapiens
ugcuggugaaaacaauuuu

SEQ ID NO: 1321137 - RNA, 17 nt, Homo sapiens
ugcugucugcagccuug

SEQ ID NO: 1321138 - RNA, 16 nt, Homo sapiens
ugcugugauaccuuag

SEQ ID NO: 1321139 - RNA, 13 nt, Homo sapiens
ugcugugcuaugg

SEQ ID NO: 1321140 - RNA, 23 nt, Homo sapiens
ugcuguucuagcacuucaucugg

SEQ ID NO: 1321141 - RNA, 14 nt, Homo sapiens
ugcuuaaaauagca

SEQ ID NO: 1321142 - RNA, 12 nt, Homo sapiens
ugcuuauaucau

SEQ ID NO: 1321143 - RNA, 14 nt, Homo sapiens
ugcuugaaugaagu

SEQ ID NO: 1321144 - RNA, 14 nt, Homo sapiens
ugcuugaccaaaga

SEQ ID NO: 1321145 - RNA, 19 nt, Homo sapiens
ugcuugccauucucuugca

SEQ ID NO: 1321146 - RNA, 16 nt, Homo sapiens
ugcuugcucuaaguca

SEQ ID NO: 1321147 - RNA, 23 nt, Homo sapiens
ugcuuguauaaaugucagauaau

SEQ ID NO: 1321148 - RNA, 21 nt, Homo sapiens
ugcuuguuugcucaccugggg

SEQ ID NO: 1321149 - RNA, 17 nt, Homo sapiens
ugcuuuaaaaaaauaca

SEQ ID NO: 1321150 - RNA, 16 nt, Homo sapiens
ugcuuuaaauugugcc

SEQ ID NO: 1321151 - RNA, 21 nt, Homo sapiens
ugcuuuccuucuuugggauag

SEQ ID NO: 1321152 - RNA, 15 nt, Homo sapiens
ugcuuugcaaagacc

SEQ ID NO: 1321153 - RNA, 19 nt, Homo sapiens
ugcuuuguugcacugaaau

SEQ ID NO: 1321154 - RNA, 18 nt, Homo sapiens
ugcuuuuagcaaccauaa

SEQ ID NO: 1321155 - RNA, 13 nt, Homo sapiens
uggaaaaguuuga

SEQ ID NO: 1321156 - RNA, 16 nt, Homo sapiens
uggaaagacugggaca

SEQ ID NO: 1321157 - RNA, 22 nt, Homo sapiens
uggaaauguggucaucaaagau

SEQ ID NO: 1321158 - RNA, 19 nt, Homo sapiens
uggaacagauucacacugu

SEQ ID NO: 1321159 - RNA, 15 nt, Homo sapiens
uggaacccagacuca

SEQ ID NO: 1321160 - RNA, 20 nt, Homo sapiens
uggaaccugacguagcugca

SEQ ID NO: 1321161 - RNA, 16 nt, Homo sapiens
uggaaccugcaaaaaa

SEQ ID NO: 1321162 - RNA, 15 nt, Homo sapiens
uggaacuaugcagug

SEQ ID NO: 1321163 - RNA, 14 nt, Homo sapiens
uggaagcugucaua

SEQ ID NO: 1321164 - RNA, 21 nt, Homo sapiens
uggaagcuuguugaaaaccca

SEQ ID NO: 1321165 - RNA, 19 nt, Homo sapiens
uggaagguggggacaggga

SEQ ID NO: 1321166 - RNA, 23 nt, Homo sapiens
uggaagguggggacagggaugag

SEQ ID NO: 1321167 - RNA, 22 nt, Homo sapiens
uggaagugcaucuacuugccag

SEQ ID NO: 1321168 - RNA, 15 nt, Homo sapiens
uggaauaacucugug

SEQ ID NO: 1321169 - RNA, 20 nt, Homo sapiens
uggaauaggagaccauuuga

SEQ ID NO: 1321170 - RNA, 15 nt, Homo sapiens
uggaauggagauuca

SEQ ID NO: 1321171 - RNA, 16 nt, Homo sapiens
uggaauguacucuguu

SEQ ID NO: 1321172 - RNA, 14 nt, Homo sapiens
uggacaaaggaauc

SEQ ID NO: 1321173 - RNA, 22 nt, Homo sapiens
uggacaaucaugaaauaugcau

SEQ ID NO: 1321174 - RNA, 14 nt, Homo sapiens
uggacccauugcca

SEQ ID NO: 1321175 - RNA, 12 nt, Homo sapiens
uggacggaacca

SEQ ID NO: 1321176 - RNA, 22 nt, Homo sapiens
uggacuccaucucucauccucc

SEQ ID NO: 1321177 - RNA, 23 nt, Homo sapiens
uggagaagccacaggccugagau

SEQ ID NO: 1321178 - RNA, 21 nt, Homo sapiens
uggagacuccuaggcaggaca

SEQ ID NO: 1321179 - RNA, 14 nt, Homo sapiens
uggagcugccugau

SEQ ID NO: 1321180 - RNA, 23 nt, Homo sapiens
uggaggacagugggaacuggagg

SEQ ID NO: 1321181 - RNA, 10 nt, Homo sapiens
uggaggaccc

SEQ ID NO: 1321182 - RNA, 17 nt, Homo sapiens
uggaggauugcugccag

SEQ ID NO: 1321183 - RNA, 13 nt, Homo sapiens
uggaggcacuuua

SEQ ID NO: 1321184 - RNA, 22 nt, Homo sapiens
uggaggcccaguucacccugau

SEQ ID NO: 1321185 - RNA, 16 nt, Homo sapiens
uggaggcugagcugca

SEQ ID NO: 1321186 - RNA, 14 nt, Homo sapiens
uggagggggcugca

SEQ ID NO: 1321187 - RNA, 24 nt, Homo sapiens
uggagguauucaauauccuuugcc

SEQ ID NO: 1321188 - RNA, 15 nt, Homo sapiens
uggaggugcuggggc

SEQ ID NO: 1321189 - RNA, 14 nt, Homo sapiens
uggaguacaguggu

SEQ ID NO: 1321190 - RNA, 18 nt, Homo sapiens
uggaguacaguggugcca

SEQ ID NO: 1321191 - RNA, 22 nt, Homo sapiens
uggauaauuuucauagcugccu

SEQ ID NO: 1321192 - RNA, 18 nt, Homo sapiens
uggauaucaaaagcaaau

SEQ ID NO: 1321193 - RNA, 16 nt, Homo sapiens
uggauauuuguacugu

SEQ ID NO: 1321194 - RNA, 23 nt, Homo sapiens
uggaucugcccccuuuacuccuc

SEQ ID NO: 1321195 - RNA, 17 nt, Homo sapiens
uggaugcgcagugccuu

SEQ ID NO: 1321196 - RNA, 12 nt, Homo sapiens
uggauguccaga

SEQ ID NO: 1321197 - RNA, 23 nt, Homo sapiens
uggauuggaaugcagaggucucc

SEQ ID NO: 1321198 - RNA, 23 nt, Homo sapiens
uggcaacagaucuggaaccucag

SEQ ID NO: 1321199 - RNA, 22 nt, Homo sapiens
uggcaagucaccugcagcccau

SEQ ID NO: 1321200 - RNA, 13 nt, Homo sapiens
uggcacccaagac

SEQ ID NO: 1321201 - RNA, 20 nt, Homo sapiens
uggcagcagaguguggccuu

SEQ ID NO: 1321202 - RNA, 15 nt, Homo sapiens
uggcagucacaucuc

SEQ ID NO: 1321203 - RNA, 14 nt, Homo sapiens
uggcaguggacuca

SEQ ID NO: 1321204 - RNA, 21 nt, Homo sapiens
uggcagugggagcugccuguu

SEQ ID NO: 1321205 - RNA, 22 nt, Homo sapiens
uggcaucucccacacaagaccc

SEQ ID NO: 1321206 - RNA, 17 nt, Homo sapiens
uggcaugacaacuacuu

SEQ ID NO: 1321207 - RNA, 14 nt, Homo sapiens
uggccaacuguuac

SEQ ID NO: 1321208 - RNA, 17 nt, Homo sapiens
uggccaagagaccagcc

SEQ ID NO: 1321209 - RNA, 22 nt, Homo sapiens
uggccacgugggcaaacaggca

SEQ ID NO: 1321210 - RNA, 16 nt, Homo sapiens
uggccaggcugaucuc

SEQ ID NO: 1321211 - RNA, 13 nt, Homo sapiens
uggcccacgcacu

SEQ ID NO: 1321212 - RNA, 22 nt, Homo sapiens
uggcccgaaauagauccagugc

SEQ ID NO: 1321213 - RNA, 16 nt, Homo sapiens
uggccggauguccuca

SEQ ID NO: 1321214 - RNA, 21 nt, Homo sapiens
uggccuagcaggcacaggaca

SEQ ID NO: 1321215 - RNA, 17 nt, Homo sapiens
uggccuugaaaccaccu

SEQ ID NO: 1321216 - RNA, 23 nt, Homo sapiens
uccaagccugaccacgcuuucua

SEQ ID NO: 1321217 - RNA, 18 nt, Homo sapiens
uccaaggaaaccacagcu

SEQ ID NO: 1321218 - RNA, 21 nt, Homo sapiens
uccaaggagcaugucacucca

SEQ ID NO: 1321219 - RNA, 17 nt, Homo sapiens
uccaauauuuucuuuaa

SEQ ID NO: 1321220 - RNA, 15 nt, Homo sapiens
uccaaucaugaaaag

SEQ ID NO: 1321221 - RNA, 18 nt, Homo sapiens
uccaaugucaaugugaac

SEQ ID NO: 1321222 - RNA, 18 nt, Homo sapiens
uccaauuccuugcacaua

SEQ ID NO: 1321223 - RNA, 19 nt, Homo sapiens
uccacaaagaaaauuccua

SEQ ID NO: 1321224 - RNA, 17 nt, Homo sapiens
uccacacccaauuccac

SEQ ID NO: 1321225 - RNA, 14 nt, Homo sapiens
uccaccccauguca

SEQ ID NO: 1321226 - RNA, 17 nt, Homo sapiens
uccacgucaacagaauu

SEQ ID NO: 1321227 - RNA, 17 nt, Homo sapiens
uccacguguguguguga

SEQ ID NO: 1321228 - RNA, 13 nt, Homo sapiens
uccacuacugcua

SEQ ID NO: 1321229 - RNA, 20 nt, Homo sapiens
uccacuaggguccaccagga

SEQ ID NO: 1321230 - RNA, 18 nt, Homo sapiens
uccacuauuuucaaagaa

SEQ ID NO: 1321231 - RNA, 13 nt, Homo sapiens
uccacucaguugc

SEQ ID NO: 1321232 - RNA, 15 nt, Homo sapiens
uccacuuguuugcac

SEQ ID NO: 1321233 - RNA, 19 nt, Homo sapiens
uccacuuguuugcacugug

SEQ ID NO: 1321234 - RNA, 21 nt, Homo sapiens
uccagacuugaaauucucauc

SEQ ID NO: 1321235 - RNA, 18 nt, Homo sapiens
uccagaucaaagaacuca

SEQ ID NO: 1321236 - RNA, 21 nt, Homo sapiens
uccagaucuugccuccagaga

SEQ ID NO: 1321237 - RNA, 19 nt, Homo sapiens
uccagcacccccagugcag

SEQ ID NO: 1321238 - RNA, 10 nt, Homo sapiens
uccagccaca

SEQ ID NO: 1321239 - RNA, 14 nt, Homo sapiens
uccagccugaacag

SEQ ID NO: 1321240 - RNA, 16 nt, Homo sapiens
gcaggugaaacccagu

SEQ ID NO: 1321241 - RNA, 14 nt, Homo sapiens
gcaggugagcagac

SEQ ID NO: 1321242 - RNA, 19 nt, Homo sapiens
gcagguuggaacuaugcag

SEQ ID NO: 1321243 - RNA, 19 nt, Homo sapiens
gcaguagaaauaauaugca

SEQ ID NO: 1321244 - RNA, 20 nt, Homo sapiens
gcaguagaaauaauaugcau

SEQ ID NO: 1321245 - RNA, 13 nt, Homo sapiens
gcaguagacaagc

SEQ ID NO: 1321246 - RNA, 19 nt, Homo sapiens
gcaguaucaugcccugugc

SEQ ID NO: 1321247 - RNA, 19 nt, Homo sapiens
gcagucaacaguucaaaga

SEQ ID NO: 1321248 - RNA, 15 nt, Homo sapiens
gcagugaugcuggau

SEQ ID NO: 1321249 - RNA, 19 nt, Homo sapiens
gcaguguauagaaaaacca

SEQ ID NO: 1321250 - RNA, 21 nt, Homo sapiens
gcaguguauagaaaaaccaaa

SEQ ID NO: 1321251 - RNA, 17 nt, Homo sapiens
gcaguguucaaggccau

SEQ ID NO: 1321252 - RNA, 16 nt, Homo sapiens
gcauaaaaacauuuua

SEQ ID NO: 1321253 - RNA, 16 nt, Homo sapiens
gcauagcagcugcuac

SEQ ID NO: 1321254 - RNA, 23 nt, Homo sapiens
gcauauuuauccaaaauguguau

SEQ ID NO: 1321255 - RNA, 14 nt, Homo sapiens
gcaucacagcuaac

SEQ ID NO: 1321256 - RNA, 21 nt, Homo sapiens
gcaucaccuuaggcagggaag

SEQ ID NO: 1321257 - RNA, 22 nt, Homo sapiens
gcaucccaggaucgcaagagcc

SEQ ID NO: 1321258 - RNA, 18 nt, Homo sapiens
gcauccuggcacccggcc

SEQ ID NO: 1321259 - RNA, 23 nt, Homo sapiens
gcaucuauucuuuguaccaucug

SEQ ID NO: 1321260 - RNA, 22 nt, Homo sapiens
gcaucuggaaagggggggaaaa

SEQ ID NO: 1321261 - RNA, 15 nt, Homo sapiens
gcaucuuagugccuu

SEQ ID NO: 1321262 - RNA, 16 nt, Homo sapiens
gcauggaaggggcuuc

SEQ ID NO: 1321263 - RNA, 23 nt, Homo sapiens
gcauuaggaguguuucauuugau

SEQ ID NO: 1321264 - RNA, 21 nt, Homo sapiens
gcauucuuaacaaacucuuca

SEQ ID NO: 1321265 - RNA, 20 nt, Homo sapiens
gcauugccuuuagugaucac

SEQ ID NO: 1321266 - RNA, 19 nt, Homo sapiens
guaucuagcucuaguucaa

SEQ ID NO: 1321267 - RNA, 17 nt, Homo sapiens
guauggcuaauaccugu

SEQ ID NO: 1321268 - RNA, 13 nt, Homo sapiens
guaugggaucuga

SEQ ID NO: 1321269 - RNA, 19 nt, Homo sapiens
guauguaccaaaacauuga

SEQ ID NO: 1321270 - RNA, 22 nt, Homo sapiens
guaugucuacacguaaguauaa

SEQ ID NO: 1321271 - RNA, 15 nt, Homo sapiens
guggcucagccagca

SEQ ID NO: 1321272 - RNA, 18 nt, Homo sapiens
guggcugcacaggcacug

SEQ ID NO: 1321273 - RNA, 18 nt, Homo sapiens
guggcugcaggggucuca

SEQ ID NO: 1321274 - RNA, 17 nt, Homo sapiens
gugggcaaacaggcagu

SEQ ID NO: 1321275 - RNA, 18 nt, Homo sapiens
guggggaaggaggccaag

SEQ ID NO: 1321276 - RNA, 16 nt, Homo sapiens
gugguaugucugccau

SEQ ID NO: 1321277 - RNA, 22 nt, Homo sapiens
guggucaacagaugacaacagc

SEQ ID NO: 1321278 - RNA, 14 nt, Homo sapiens
guggugucugugaa

SEQ ID NO: 1321279 - RNA, 12 nt, Homo sapiens
guguaacauauu

SEQ ID NO: 1321280 - RNA, 20 nt, Homo sapiens
guguaccuccucucaguguu

SEQ ID NO: 1321281 - RNA, 13 nt, Homo sapiens
guguauccaugca

SEQ ID NO: 1321282 - RNA, 11 nt, Homo sapiens
gugucagccau

SEQ ID NO: 1321283 - RNA, 13 nt, Homo sapiens
gugucugucagac

SEQ ID NO: 1321284 - RNA, 17 nt, Homo sapiens
gugucuuacgugccacc

SEQ ID NO: 1321285 - RNA, 14 nt, Homo sapiens
gugugauugcacgu

SEQ ID NO: 1321286 - RNA, 18 nt, Homo sapiens
gugugccaagaguucgau

SEQ ID NO: 1321287 - RNA, 14 nt, Homo sapiens
guguggcauuugga

SEQ ID NO: 1321288 - RNA, 20 nt, Homo sapiens
guguggccacuucuguccau

SEQ ID NO: 1321289 - RNA, 19 nt, Homo sapiens
gugugggggaagcaccaua

SEQ ID NO: 1321290 - RNA, 14 nt, Homo sapiens
gugugugugucuua

SEQ ID NO: 1321291 - RNA, 14 nt, Homo sapiens
guguuaaaugugau

SEQ ID NO: 1321292 - RNA, 22 nt, Homo sapiens
guguuaaugucccauuucacga

SEQ ID NO: 1321293 - RNA, 16 nt, Homo sapiens
guguuccccacuguau

SEQ ID NO: 1321294 - RNA, 13 nt, Homo sapiens
guguuugcugagg

SEQ ID NO: 1321295 - RNA, 16 nt, Homo sapiens
guuaaacuagcauauc

SEQ ID NO: 1321296 - RNA, 18 nt, Homo sapiens
guuaacgucaucucaggg

SEQ ID NO: 1321297 - RNA, 17 nt, Homo sapiens
guuaauaaaccuuugca

SEQ ID NO: 1321298 - RNA, 20 nt, Homo sapiens
guuaauaaaccuuugcaaac

SEQ ID NO: 1321299 - RNA, 18 nt, Homo sapiens
guuaaugucccauuucac

SEQ ID NO: 1321300 - RNA, 22 nt, Homo sapiens
guuaauugaaaguauaauuugc

SEQ ID NO: 1321301 - RNA, 14 nt, Homo sapiens
guuacccacugcca

SEQ ID NO: 1321302 - RNA, 18 nt, Homo sapiens
guuacccugcauguuggc

SEQ ID NO: 1321303 - RNA, 16 nt, Homo sapiens
guuaccucugcaugga

SEQ ID NO: 1321304 - RNA, 17 nt, Homo sapiens
guuaccucugcauggaa

SEQ ID NO: 1321305 - RNA, 21 nt, Homo sapiens
guuaccugaaaacacugugca

SEQ ID NO: 1321306 - RNA, 21 nt, Homo sapiens
guuacugcuugaccaaagagc

SEQ ID NO: 1321307 - RNA, 17 nt, Homo sapiens
guuacugcuuugcaaag

SEQ ID NO: 1321308 - RNA, 13 nt, Homo sapiens
guuacuugggagg

SEQ ID NO: 1321309 - RNA, 22 nt, Homo sapiens
guuagaagcaaugaauguauau

SEQ ID NO: 1321310 - RNA, 17 nt, Homo sapiens
guuaggaaaauuucaca

SEQ ID NO: 1321311 - RNA, 12 nt, Homo sapiens
guuauacuccuc

SEQ ID NO: 1321312 - RNA, 13 nt, Homo sapiens
guuauacuccuca

SEQ ID NO: 1321313 - RNA, 15 nt, Homo sapiens
guuauagaacuucau

SEQ ID NO: 1321314 - RNA, 18 nt, Homo sapiens
guuauaucauauguauau

SEQ ID NO: 1321315 - RNA, 16 nt, Homo sapiens
guucaaagacugugaa

SEQ ID NO: 1321316 - RNA, 22 nt, Homo sapiens
guucaaagacugugaacagcuu

SEQ ID NO: 1321317 - RNA, 13 nt, Homo sapiens
guucaacaucuaa

SEQ ID NO: 1321318 - RNA, 20 nt, Homo sapiens
guucaagacagaugggcaua

SEQ ID NO: 1321319 - RNA, 15 nt, Homo sapiens
guucaauaaagcacu

SEQ ID NO: 1321320 - RNA, 15 nt, Homo sapiens
guucacaacagugaa

SEQ ID NO: 1321321 - RNA, 12 nt, Homo sapiens
guucacagugca

SEQ ID NO: 1321322 - RNA, 16 nt, Homo sapiens
guucacggcaaaaugu

SEQ ID NO: 1321323 - RNA, 11 nt, Homo sapiens
guucacuccca

SEQ ID NO: 1321324 - RNA, 14 nt, Homo sapiens
guucagggucauag

SEQ ID NO: 1321325 - RNA, 16 nt, Homo sapiens
guucagguaacaggca

SEQ ID NO: 1321326 - RNA, 20 nt, Homo sapiens
guucaguacucuacaauucc

SEQ ID NO: 1321327 - RNA, 21 nt, Homo sapiens
guucauggauuacuucucuau

SEQ ID NO: 1321328 - RNA, 17 nt, Homo sapiens
guuccaaugucaaugug

SEQ ID NO: 1321329 - RNA, 21 nt, Homo sapiens
guuccacauccacacagccaa

SEQ ID NO: 1321330 - RNA, 19 nt, Homo sapiens
guuccacuuguuugcacug

SEQ ID NO: 1321331 - RNA, 15 nt, Homo sapiens
guuccagacauucuc

SEQ ID NO: 1321332 - RNA, 13 nt, Homo sapiens
guuccccacugac

SEQ ID NO: 1321333 - RNA, 14 nt, Homo sapiens
guuccccacugaca

SEQ ID NO: 1321334 - RNA, 14 nt, Homo sapiens
guucccccacugau

SEQ ID NO: 1321335 - RNA, 14 nt, Homo sapiens
guucccccugugca

SEQ ID NO: 1321336 - RNA, 22 nt, Homo sapiens
guucccugacuccuccaaggaa

SEQ ID NO: 1321337 - RNA, 12 nt, Homo sapiens
guucugaugcuu

SEQ ID NO: 1321338 - RNA, 11 nt, Homo sapiens
guucugcagcc

SEQ ID NO: 1321339 - RNA, 15 nt, Homo sapiens
guucugggacacagu

SEQ ID NO: 1321340 - RNA, 12 nt, Homo sapiens
guucuguagaaa

SEQ ID NO: 1321341 - RNA, 18 nt, Homo sapiens
guucuuucuuacacaaga

SEQ ID NO: 1321342 - RNA, 11 nt, Homo sapiens
guugagcaauu

SEQ ID NO: 1321343 - RNA, 19 nt, Homo sapiens
guugauucagcucugcaag

SEQ ID NO: 1321344 - RNA, 19 nt, Homo sapiens
guugcaauagaacagagaa

SEQ ID NO: 1321345 - RNA, 14 nt, Homo sapiens
guugccacaggaca

SEQ ID NO: 1321346 - RNA, 22 nt, Homo sapiens
guugcuguuauuauauuugaca

SEQ ID NO: 1321347 - RNA, 22 nt, Homo sapiens
guuggccagugugacaaggauu

SEQ ID NO: 1321348 - RNA, 23 nt, Homo sapiens
guuggcccagaccucaggugcua

SEQ ID NO: 1321349 - RNA, 18 nt, Homo sapiens
guuggccugcacuggugu

SEQ ID NO: 1321350 - RNA, 21 nt, Homo sapiens
guugguuguuuuuuccuuugc

SEQ ID NO: 1321351 - RNA, 18 nt, Homo sapiens
guuguagacguuguguaa

SEQ ID NO: 1321352 - RNA, 15 nt, Homo sapiens
guugugaagguugua

SEQ ID NO: 1321353 - RNA, 12 nt, Homo sapiens
guugugcucagg

SEQ ID NO: 1321354 - RNA, 15 nt, Homo sapiens
guuuaucaacucaag

SEQ ID NO: 1321355 - RNA, 23 nt, Homo sapiens
guuuaucguauuugaugcuacag

SEQ ID NO: 1321356 - RNA, 19 nt, Homo sapiens
guuucaucguaaacauacu

SEQ ID NO: 1321357 - RNA, 21 nt, Homo sapiens
guuuccuuauccagacagugg

SEQ ID NO: 1321358 - RNA, 21 nt, Homo sapiens
guuucgugaaguauacuguau

SEQ ID NO: 1321359 - RNA, 14 nt, Homo sapiens
guuucuggcucuug

SEQ ID NO: 1321360 - RNA, 13 nt, Homo sapiens
guuucuguucacc

SEQ ID NO: 1321361 - RNA, 15 nt, Homo sapiens
guuugaagcugcugu

SEQ ID NO: 1321362 - RNA, 15 nt, Homo sapiens
guuugaauguuaaau

SEQ ID NO: 1321363 - RNA, 22 nt, Homo sapiens
guuugacccaggggucagccuu

SEQ ID NO: 1321364 - RNA, 13 nt, Homo sapiens
guuugacucagua

SEQ ID NO: 1321365 - RNA, 17 nt, Homo sapiens
guuugauuauucagugu

SEQ ID NO: 1321366 - RNA, 18 nt, Homo sapiens
guuuggaagauccuguga

SEQ ID NO: 1321367 - RNA, 17 nt, Homo sapiens
guuuggaggagcaaagu

SEQ ID NO: 1321368 - RNA, 15 nt, Homo sapiens
guuuggccaucucug

SEQ ID NO: 1321369 - RNA, 22 nt, Homo sapiens
guuugucacacgauaaagggau

SEQ ID NO: 1321370 - RNA, 16 nt, Homo sapiens
guuuguuacuauguau

SEQ ID NO: 1321371 - RNA, 16 nt, Homo sapiens
guuuguuuaacuguga

SEQ ID NO: 1321372 - RNA, 13 nt, Homo sapiens
guuuuaacucuau

SEQ ID NO: 1321373 - RNA, 16 nt, Homo sapiens
guuuuaagcugcuaag

SEQ ID NO: 1321374 - RNA, 14 nt, Homo sapiens
guuuucaagucaaa

SEQ ID NO: 1321375 - RNA, 21 nt, Homo sapiens
guuuucccugaccucccucua

SEQ ID NO: 1321376 - RNA, 19 nt, Homo sapiens
guuuuccucccuucugcua

SEQ ID NO: 1321377 - RNA, 20 nt, Homo sapiens
guuuuccucccuucugcuac

SEQ ID NO: 1321378 - RNA, 16 nt, Homo sapiens
guuuuccugaaaucaa

SEQ ID NO: 1321379 - RNA, 19 nt, Homo sapiens
guuuuccuucucaucugug

SEQ ID NO: 1321380 - RNA, 14 nt, Homo sapiens
guuuucucucuccg

SEQ ID NO: 1321381 - RNA, 17 nt, Homo sapiens
guuuucugacacaguca

SEQ ID NO: 1321382 - RNA, 14 nt, Homo sapiens
guuuugugccuuug

SEQ ID NO: 1321383 - RNA, 19 nt, Homo sapiens
guuuuuccacuacugcuac

SEQ ID NO: 1321384 - RNA, 22 nt, Homo sapiens
guuuuuuuucagccacuaagaa

SEQ ID NO: 1321385 - RNA, 19 nt, Homo sapiens
uaaaaaaauacaugcaucu

SEQ ID NO: 1321386 - RNA, 21 nt, Homo sapiens
uaaaaaaugaaaaacauuauu

SEQ ID NO: 1321387 - RNA, 20 nt, Homo sapiens
uaaaaaggaauccacuccca

SEQ ID NO: 1321388 - RNA, 13 nt, Homo sapiens
uaaaaaguaauaa

SEQ ID NO: 1321389 - RNA, 18 nt, Homo sapiens
uaaaaaguaauaaaugag

SEQ ID NO: 1321390 - RNA, 12 nt, Homo sapiens
uaaaaagucugu

SEQ ID NO: 1321391 - RNA, 14 nt, Homo sapiens
uaaaaagugugacu

SEQ ID NO: 1321392 - RNA, 15 nt, Homo sapiens
uaaaaaucacacugu

SEQ ID NO: 1321393 - RNA, 13 nt, Homo sapiens
uaaaaaugcaaau

SEQ ID NO: 1321394 - RNA, 19 nt, Homo sapiens
uaaaacaaaagcucaucca

SEQ ID NO: 1321395 - RNA, 17 nt, Homo sapiens
uaaaacaaaauuugacu

SEQ ID NO: 1321396 - RNA, 20 nt, Homo sapiens
uaaaacaacacucacauuua

SEQ ID NO: 1321397 - RNA, 13 nt, Homo sapiens
uaaaagacaagga

SEQ ID NO: 1321398 - RNA, 15 nt, Homo sapiens
uaaaagacagugaaa

SEQ ID NO: 1321399 - RNA, 14 nt, Homo sapiens
uaaaagcacacuca

SEQ ID NO: 1321400 - RNA, 14 nt, Homo sapiens
uaaaagcagagcau

SEQ ID NO: 1321401 - RNA, 18 nt, Homo sapiens
uaaaagccuaccuaagca

SEQ ID NO: 1321402 - RNA, 13 nt, Homo sapiens
uaaaaguggcauu

SEQ ID NO: 1321403 - RNA, 14 nt, Homo sapiens
uaaaauaaaugcaa

SEQ ID NO: 1321404 - RNA, 17 nt, Homo sapiens
uaaaauaaaugcaauug

SEQ ID NO: 1321405 - RNA, 18 nt, Homo sapiens
uaauugcuuugagcacaa

SEQ ID NO: 1321406 - RNA, 18 nt, Homo sapiens
uaauuggcaugugaauua

SEQ ID NO: 1321407 - RNA, 18 nt, Homo sapiens
uaauuguacuaaagccaa

SEQ ID NO: 1321408 - RNA, 14 nt, Homo sapiens
uaauuuuacacaaa

SEQ ID NO: 1321409 - RNA, 14 nt, Homo sapiens
uaauuuuacauguu

SEQ ID NO: 1321410 - RNA, 23 nt, Homo sapiens
gauccucucuggggcuguguuuu

SEQ ID NO: 1321411 - RNA, 18 nt, Homo sapiens
gaucucggcucucugcaa

SEQ ID NO: 1321412 - RNA, 23 nt, Homo sapiens
gaucuggaacccagacucagaca

SEQ ID NO: 1321413 - RNA, 19 nt, Homo sapiens
gaucuguuuugaaggcaaa

SEQ ID NO: 1321414 - RNA, 21 nt, Homo sapiens
gaucuuaauauaaauucacuu

SEQ ID NO: 1321415 - RNA, 13 nt, Homo sapiens
gaucuugccucca

SEQ ID NO: 1321416 - RNA, 16 nt, Homo sapiens
gaucuuuuaaguuucc

SEQ ID NO: 1321417 - RNA, 21 nt, Homo sapiens
gaugaaguuuuacauuguuga

SEQ ID NO: 1321418 - RNA, 14 nt, Homo sapiens
gaugacugccuugc

SEQ ID NO: 1321419 - RNA, 14 nt, Homo sapiens
gaugacuggucucu

SEQ ID NO: 1321420 - RNA, 17 nt, Homo sapiens
gaugagcaagacauacu

SEQ ID NO: 1321421 - RNA, 18 nt, Homo sapiens
gaugagcaagacauacuu

SEQ ID NO: 1321422 - RNA, 15 nt, Homo sapiens
gaugaggcuuuccau

SEQ ID NO: 1321423 - RNA, 23 nt, Homo sapiens
gaugauacuuggaugcagcucuu

SEQ ID NO: 1321424 - RNA, 21 nt, Homo sapiens
gaugaucuggauccaccaaga

SEQ ID NO: 1321425 - RNA, 21 nt, Homo sapiens
gaugauggcucauuuacacuc

SEQ ID NO: 1321426 - RNA, 20 nt, Homo sapiens
gaugcagcucuugggaccgu

SEQ ID NO: 1321427 - RNA, 20 nt, Homo sapiens
gaugcaggauuuguucucug

SEQ ID NO: 1321428 - RNA, 20 nt, Homo sapiens
gaugcauguugaccaugucu

SEQ ID NO: 1321429 - RNA, 13 nt, Homo sapiens
gaugcauucgaga

SEQ ID NO: 1321430 - RNA, 22 nt, Homo sapiens
gaugccgagguaaaaguucuuu

SEQ ID NO: 1321431 - RNA, 20 nt, Homo sapiens
gaugcugagauccugaguca

SEQ ID NO: 1321432 - RNA, 9 nt, Homo sapiens
gauggagcu

SEQ ID NO: 1321433 - RNA, 21 nt, Homo sapiens
gauggcagauucccacugccg

SEQ ID NO: 1321434 - RNA, 21 nt, Homo sapiens
gauggcauuagagggagccca

SEQ ID NO: 1321435 - RNA, 21 nt, Homo sapiens
gaugggcauaugugucagugg

SEQ ID NO: 1321436 - RNA, 16 nt, Homo sapiens
gaugggcaugaaugag

SEQ ID NO: 1321437 - RNA, 21 nt, Homo sapiens
gaugggggaaagcacaggugg

SEQ ID NO: 1321438 - RNA, 14 nt, Homo sapiens
gaugggggugggca

SEQ ID NO: 1321439 - RNA, 20 nt, Homo sapiens
gaugugccuggguggacaug

SEQ ID NO: 1321440 - RNA, 15 nt, Homo sapiens
gauguucugggacac

SEQ ID NO: 1321441 - RNA, 18 nt, Homo sapiens
gaauaaauaaauguaucu

SEQ ID NO: 1321442 - RNA, 22 nt, Homo sapiens
gaauaaauaugcucagccaccc

SEQ ID NO: 1321443 - RNA, 20 nt, Homo sapiens
gaauaguaguaacuguuuca

SEQ ID NO: 1321444 - RNA, 21 nt, Homo sapiens
gaauauaauacuguauuugag

SEQ ID NO: 1321445 - RNA, 21 nt, Homo sapiens
gaauauuuauuaccucugaua

SEQ ID NO: 1321446 - RNA, 16 nt, Homo sapiens
gaaucaauuacuugaa

SEQ ID NO: 1321447 - RNA, 13 nt, Homo sapiens
gaaucacauucuu

SEQ ID NO: 1321448 - RNA, 21 nt, Homo sapiens
gaaucagugaagccaaaggga

SEQ ID NO: 1321449 - RNA, 21 nt, Homo sapiens
gaaucaugagccugcuggaag

SEQ ID NO: 1321450 - RNA, 16 nt, Homo sapiens
gaauccaaagaucaca

SEQ ID NO: 1321451 - RNA, 20 nt, Homo sapiens
gaauccaaagaucacauauu

SEQ ID NO: 1321452 - RNA, 17 nt, Homo sapiens
gaaucccggcugucaag

SEQ ID NO: 1321453 - RNA, 23 nt, Homo sapiens
gaaucuuuaaaagaugcuuuuaa

SEQ ID NO: 1321454 - RNA, 21 nt, Homo sapiens
gaaugaaccuucuggccuccc

SEQ ID NO: 1321455 - RNA, 16 nt, Homo sapiens
gaaugauaugcauuug

SEQ ID NO: 1321456 - RNA, 18 nt, Homo sapiens
gaaugcagaggucuccaa

SEQ ID NO: 1321457 - RNA, 19 nt, Homo sapiens
gaaugccagugugcugaug

SEQ ID NO: 1321458 - RNA, 19 nt, Homo sapiens
gaaugcuccucucuuugug

SEQ ID NO: 1321459 - RNA, 17 nt, Homo sapiens
gaauggagcuggcccuc

SEQ ID NO: 1321460 - RNA, 14 nt, Homo sapiens
gaauggcagcugcc

SEQ ID NO: 1321461 - RNA, 19 nt, Homo sapiens
gaauguaaaaugcaaaauc

SEQ ID NO: 1321462 - RNA, 23 nt, Homo sapiens
gaauguguggccugcacagugaa

SEQ ID NO: 1321463 - RNA, 21 nt, Homo sapiens
gaauuaagaauugguugccau

SEQ ID NO: 1321464 - RNA, 15 nt, Homo sapiens
gaauucuaaaccaau

SEQ ID NO: 1321465 - RNA, 19 nt, Homo sapiens
gaauucuugaaaaacuuac

SEQ ID NO: 1321466 - RNA, 23 nt, Homo sapiens
gaauugacaacccaaacucucca

SEQ ID NO: 1321467 - RNA, 21 nt, Homo sapiens
gaauugauauguauguuguga

SEQ ID NO: 1321468 - RNA, 23 nt, Homo sapiens
gaauuggauacauacaccagcau

SEQ ID NO: 1321469 - RNA, 16 nt, Homo sapiens
gaauuuacaguuccuu

SEQ ID NO: 1321470 - RNA, 17 nt, Homo sapiens
gaauuuauucaauuccu

SEQ ID NO: 1321471 - RNA, 15 nt, Homo sapiens
gaauuucacacuguc

SEQ ID NO: 1321472 - RNA, 11 nt, Homo sapiens
gaauuugcacc

SEQ ID NO: 1321473 - RNA, 17 nt, Homo sapiens
gaauuuggaaggcaaag

SEQ ID NO: 1321474 - RNA, 20 nt, Homo sapiens
gaauuuuuacccaauuggau

SEQ ID NO: 1321475 - RNA, 16 nt, Homo sapiens
gaauuuuugcaauaau

SEQ ID NO: 1321476 - RNA, 21 nt, Homo sapiens
gaauuuuuuucugcacagcuu

SEQ ID NO: 1321477 - RNA, 19 nt, Homo sapiens
gacaaaauggauacauaaa

SEQ ID NO: 1321478 - RNA, 16 nt, Homo sapiens
gacaaagacucacucu

SEQ ID NO: 1321479 - RNA, 20 nt, Homo sapiens
gacaaaggaaucaauuacuu

SEQ ID NO: 1321480 - RNA, 12 nt, Homo sapiens
gacaacaucuga

SEQ ID NO: 1321481 - RNA, 14 nt, Homo sapiens
cuuuugucuaauua

SEQ ID NO: 1321482 - RNA, 21 nt, Homo sapiens
cuuuugucuaauuaaaacacu

SEQ ID NO: 1321483 - RNA, 17 nt, Homo sapiens
cuuuuuaaccauuccaa

SEQ ID NO: 1321484 - RNA, 14 nt, Homo sapiens
cuuuuuacacuuua

SEQ ID NO: 1321485 - RNA, 14 nt, Homo sapiens
cuuuuuacauuaca

SEQ ID NO: 1321486 - RNA, 14 nt, Homo sapiens
cuuuuugaguuuca

SEQ ID NO: 1321487 - RNA, 20 nt, Homo sapiens
cuuuuugguuuuuacuuaac

SEQ ID NO: 1321488 - RNA, 18 nt, Homo sapiens
gaaaaaaaccacacaaag

SEQ ID NO: 1321489 - RNA, 12 nt, Homo sapiens
gaaaaagaacau

SEQ ID NO: 1321490 - RNA, 22 nt, Homo sapiens
gaaaaagagguagcacuacaaa

SEQ ID NO: 1321491 - RNA, 20 nt, Homo sapiens
gaaaaagguuugcauucuca

SEQ ID NO: 1321492 - RNA, 18 nt, Homo sapiens
gaaaaauaaagaugugcu

SEQ ID NO: 1321493 - RNA, 20 nt, Homo sapiens
gaaaaauaaagaugugcuua

SEQ ID NO: 1321494 - RNA, 15 nt, Homo sapiens
gaaaaauguguaauu

SEQ ID NO: 1321495 - RNA, 15 nt, Homo sapiens
gaaaacacugugcac

SEQ ID NO: 1321496 - RNA, 16 nt, Homo sapiens
gaaaacacugugcaca

SEQ ID NO: 1321497 - RNA, 16 nt, Homo sapiens
gaaaacaucuauucuc

SEQ ID NO: 1321498 - RNA, 20 nt, Homo sapiens
gaaaacauuucaaguuuacu

SEQ ID NO: 1321499 - RNA, 14 nt, Homo sapiens
gaaaaccuccagua

SEQ ID NO: 1321500 - RNA, 12 nt, Homo sapiens
gaaaacuacagg

SEQ ID NO: 1321501 - RNA, 23 nt, Homo sapiens
gaaaagagauaugggaacacugg

SEQ ID NO: 1321502 - RNA, 20 nt, Homo sapiens
gaaaagauuauauauuauuu

SEQ ID NO: 1321503 - RNA, 15 nt, Homo sapiens
gaaaagauuccuguc

SEQ ID NO: 1321504 - RNA, 23 nt, Homo sapiens
gaaaagcuccauuuuuagugaaa

SEQ ID NO: 1321505 - RNA, 15 nt, Homo sapiens
gaaaagcugcugaca

SEQ ID NO: 1321506 - RNA, 14 nt, Homo sapiens
gaaaauagaacaac

SEQ ID NO: 1321507 - RNA, 23 nt, Homo sapiens
gaaaauuaguaugguaauuaaau

SEQ ID NO: 1321508 - RNA, 20 nt, Homo sapiens
gaaacacuuugguauucuuu

SEQ ID NO: 1321509 - RNA, 21 nt, Homo sapiens
gaaacagcuccccaccaacca

SEQ ID NO: 1321510 - RNA, 21 nt, Homo sapiens
gaaaccaaagcuuuauuucaa

SEQ ID NO: 1321511 - RNA, 22 nt, Homo sapiens
gaaacccaaugacggcaaccuc

SEQ ID NO: 1321512 - RNA, 17 nt, Homo sapiens
gaaacccaggaguggau

SEQ ID NO: 1321513 - RNA, 18 nt, Homo sapiens
gaaacccgacagagggaa

SEQ ID NO: 1321514 - RNA, 18 nt, Homo sapiens
gaaaccuacacacuguca

SEQ ID NO: 1321515 - RNA, 16 nt, Homo sapiens
gaaaccuuaguuucaa

SEQ ID NO: 1321516 - RNA, 20 nt, Homo sapiens
gaaaccuuauuguaccucuc

SEQ ID NO: 1321517 - RNA, 19 nt, Homo sapiens
gaaacuaaaugacuuucaa

SEQ ID NO: 1321518 - RNA, 17 nt, Homo sapiens
gaaacuaacacagccau

SEQ ID NO: 1321519 - RNA, 22 nt, Homo sapiens
gaaacucuacauguaacuauuu

SEQ ID NO: 1321520 - RNA, 19 nt, Homo sapiens
gaaacugaagcuguucuca

SEQ ID NO: 1321521 - RNA, 17 nt, Homo sapiens
gaaacuguaugugcugu

SEQ ID NO: 1321522 - RNA, 17 nt, Homo sapiens
gaaacugugaagaucuc

SEQ ID NO: 1321523 - RNA, 16 nt, Homo sapiens
gaaacuguucccaccu

SEQ ID NO: 1321524 - RNA, 22 nt, Homo sapiens
gaaacuuuacaaccugauguca

SEQ ID NO: 1321525 - RNA, 16 nt, Homo sapiens
cugugcauuguaggau

SEQ ID NO: 1321526 - RNA, 13 nt, Homo sapiens
cugugccaguucu

SEQ ID NO: 1321527 - RNA, 22 nt, Homo sapiens
cugugccccuugacaacuggca

SEQ ID NO: 1321528 - RNA, 22 nt, Homo sapiens
cugugcccuccugacccauugc

SEQ ID NO: 1321529 - RNA, 18 nt, Homo sapiens
cugugccuccaucagcua

SEQ ID NO: 1321530 - RNA, 22 nt, Homo sapiens
cugugccucggcuuuucucagc

SEQ ID NO: 1321531 - RNA, 15 nt, Homo sapiens
cugugcuauggugcu

SEQ ID NO: 1321532 - RNA, 19 nt, Homo sapiens
cugugcuauggugcucugu

SEQ ID NO: 1321533 - RNA, 16 nt, Homo sapiens
cuguggccuucgucac

SEQ ID NO: 1321534 - RNA, 22 nt, Homo sapiens
cugugucauucuguuagauacu

SEQ ID NO: 1321535 - RNA, 16 nt, Homo sapiens
cugugugauugacagc

SEQ ID NO: 1321536 - RNA, 20 nt, Homo sapiens
cugugugugugugugcauau

SEQ ID NO: 1321537 - RNA, 15 nt, Homo sapiens
cuguguguugccaca

SEQ ID NO: 1321538 - RNA, 23 nt, Homo sapiens
cuguguuacugcuuugcaaagac

SEQ ID NO: 1321539 - RNA, 18 nt, Homo sapiens
cuguuaauuccuggaacu

SEQ ID NO: 1321540 - RNA, 18 nt, Homo sapiens
cuguuauggggacuuuau

SEQ ID NO: 1321541 - RNA, 19 nt, Homo sapiens
cuguuauuauauuugacau

SEQ ID NO: 1321542 - RNA, 12 nt, Homo sapiens
cuguucacagag

SEQ ID NO: 1321543 - RNA, 18 nt, Homo sapiens
cuguuccuucacauccug

SEQ ID NO: 1321544 - RNA, 12 nt, Homo sapiens
cuguucuacuuu

SEQ ID NO: 1321545 - RNA, 20 nt, Homo sapiens
cuguucuuucuuacacaaga

SEQ ID NO: 1321546 - RNA, 16 nt, Homo sapiens
cuguugaaaugugaau

SEQ ID NO: 1321547 - RNA, 14 nt, Homo sapiens
cuguugacauauuu

SEQ ID NO: 1321548 - RNA, 21 nt, Homo sapiens
cuguuggccagugugacaagg

SEQ ID NO: 1321549 - RNA, 18 nt, Homo sapiens
cuguuguaacugcccaag

SEQ ID NO: 1321550 - RNA, 16 nt, Homo sapiens
cuguuuaaagugucac

SEQ ID NO: 1321551 - RNA, 13 nt, Homo sapiens
cuguuuacugaaa

SEQ ID NO: 1321552 - RNA, 19 nt, Homo sapiens
cuguuuccauagggugaca

SEQ ID NO: 1321553 - RNA, 14 nt, Homo sapiens
cuguuucuaccuau

SEQ ID NO: 1321554 - RNA, 22 nt, Homo sapiens
cuguuugaaaccaagcuuucaa

SEQ ID NO: 1321555 - RNA, 21 nt, Homo sapiens
cuuaaaaaucuuguacauuau

SEQ ID NO: 1321556 - RNA, 14 nt, Homo sapiens
cuuaaacacuugca

SEQ ID NO: 1321557 - RNA, 13 nt, Homo sapiens
cuuaaaugccaau

SEQ ID NO: 1321558 - RNA, 16 nt, Homo sapiens
cuuaaguacuguagaa

SEQ ID NO: 1321559 - RNA, 23 nt, Homo sapiens
cuuacauguuuguuucuguagaa

SEQ ID NO: 1321560 - RNA, 13 nt, Homo sapiens
cuuaccuguucag

SEQ ID NO: 1321561 - RNA, 15 nt, Homo sapiens
cuuacugugcaccua

SEQ ID NO: 1321562 - RNA, 20 nt, Homo sapiens
cuuagaaaauucaagcauuu

SEQ ID NO: 1321563 - RNA, 22 nt, Homo sapiens
cuuagaaaauucaagcauuuag

SEQ ID NO: 1321564 - RNA, 13 nt, Homo sapiens
cuuagaauccaaa

SEQ ID NO: 1321565 - RNA, 20 nt, Homo sapiens
cuuagauuuaguaguguaag

SEQ ID NO: 1321566 - RNA, 14 nt, Homo sapiens
cuuaggcagggaag

SEQ ID NO: 1321567 - RNA, 14 nt, Homo sapiens
cuuaggcaugacug

SEQ ID NO: 1321568 - RNA, 21 nt, Homo sapiens
cuuaggugacaauguccccca

SEQ ID NO: 1321569 - RNA, 18 nt, Homo sapiens
cuuagguuguagcagaaa

SEQ ID NO: 1321570 - RNA, 14 nt, Homo sapiens
cuuagucucagcac

SEQ ID NO: 1321571 - RNA, 14 nt, Homo sapiens
cuuaguuaucaguc

SEQ ID NO: 1321572 - RNA, 19 nt, Homo sapiens
cuuauaagaaagaucaaag

SEQ ID NO: 1321573 - RNA, 20 nt, Homo sapiens
cuuauaauuuaaaauaugcu

SEQ ID NO: 1321574 - RNA, 14 nt, Homo sapiens
cuuauacuguacaa

SEQ ID NO: 1321575 - RNA, 13 nt, Homo sapiens
cuuaucauggucu

SEQ ID NO: 1321576 - RNA, 16 nt, Homo sapiens
cuuauccagcugguga

SEQ ID NO: 1321577 - RNA, 16 nt, Homo sapiens
cuuaugccagcgugac

SEQ ID NO: 1321578 - RNA, 23 nt, Homo sapiens
cuuauggaauugauuugcauuga

SEQ ID NO: 1321579 - RNA, 20 nt, Homo sapiens
cuuaugguaccagaugcagc

SEQ ID NO: 1321580 - RNA, 17 nt, Homo sapiens
cuuauguauuuucuucc

SEQ ID NO: 1321581 - RNA, 11 nt, Homo sapiens
cuuauguuaca

SEQ ID NO: 1321582 - RNA, 22 nt, Homo sapiens
cuuauuagggagaaaauucaau

SEQ ID NO: 1321583 - RNA, 18 nt, Homo sapiens
cuucaaaugccugacuag

SEQ ID NO: 1321584 - RNA, 19 nt, Homo sapiens
cuucacuguccuccaagcc

SEQ ID NO: 1321585 - RNA, 22 nt, Homo sapiens
cuucacuguccuccaagccagc

SEQ ID NO: 1321586 - RNA, 12 nt, Homo sapiens
cuucagagccag

SEQ ID NO: 1321587 - RNA, 22 nt, Homo sapiens
cuucagcccucaccccugguuc

SEQ ID NO: 1321588 - RNA, 24 nt, Homo sapiens
cuucagccuaguggcuuguccuca

SEQ ID NO: 1321589 - RNA, 22 nt, Homo sapiens
cuucagcucuucuugacaucaa

SEQ ID NO: 1321590 - RNA, 22 nt, Homo sapiens
cuucaggaaccucgaguacugu

SEQ ID NO: 1321591 - RNA, 17 nt, Homo sapiens
cuucagggaacugcaua

SEQ ID NO: 1321592 - RNA, 16 nt, Homo sapiens
cuucaguauguuguca

SEQ ID NO: 1321593 - RNA, 14 nt, Homo sapiens
cuucagucucauau

SEQ ID NO: 1321594 - RNA, 14 nt, Homo sapiens
cuucaguuaauucu

SEQ ID NO: 1321595 - RNA, 17 nt, Homo sapiens
cuucauagaaaccucuc

SEQ ID NO: 1321596 - RNA, 23 nt, Homo sapiens
cuucaucauucccucucaucuca

SEQ ID NO: 1321597 - RNA, 15 nt, Homo sapiens
cuucauucuuugcag

SEQ ID NO: 1321598 - RNA, 21 nt, Homo sapiens
cuuccaacucaaacucuuaaa

SEQ ID NO: 1321599 - RNA, 13 nt, Homo sapiens
cuuccacaaagaa

SEQ ID NO: 1321600 - RNA, 14 nt, Homo sapiens
cuuccacugagggc

SEQ ID NO: 1321601 - RNA, 16 nt, Homo sapiens
cuuccagagucaucua

SEQ ID NO: 1321602 - RNA, 20 nt, Homo sapiens
cuuccagauccucucugggg

SEQ ID NO: 1321603 - RNA, 11 nt, Homo sapiens
cuuccauuugc

SEQ ID NO: 1321604 - RNA, 20 nt, Homo sapiens
cuucccacuagccuagguca

SEQ ID NO: 1321605 - RNA, 22 nt, Homo sapiens
cuucccggcgucccuaccuccu

SEQ ID NO: 1321606 - RNA, 17 nt, Homo sapiens
cagcuaacaauugugaa

SEQ ID NO: 1321607 - RNA, 18 nt, Homo sapiens
cagcuaccucaaccaaug

SEQ ID NO: 1321608 - RNA, 16 nt, Homo sapiens
cagcucccgcuguggc

SEQ ID NO: 1321609 - RNA, 15 nt, Homo sapiens
cagcuccuguggcca

SEQ ID NO: 1321610 - RNA, 17 nt, Homo sapiens
cagcucuaauacauucc

SEQ ID NO: 1321611 - RNA, 18 nt, Homo sapiens
cagcucucaguugcagcc

SEQ ID NO: 1321612 - RNA, 23 nt, Homo sapiens
cagcucuccccucagagugcaag

SEQ ID NO: 1321613 - RNA, 20 nt, Homo sapiens
cagcucuucuugacaucaag

SEQ ID NO: 1321614 - RNA, 15 nt, Homo sapiens
cagcugagcagcuuu

SEQ ID NO: 1321615 - RNA, 14 nt, Homo sapiens
cagcugcccugugu

SEQ ID NO: 1321616 - RNA, 21 nt, Homo sapiens
cagcugucaagggcagaauga

SEQ ID NO: 1321617 - RNA, 20 nt, Homo sapiens
cagcuuagaaugcaucucau

SEQ ID NO: 1321618 - RNA, 13 nt, Homo sapiens
cagcuuauauuca

SEQ ID NO: 1321619 - RNA, 17 nt, Homo sapiens
cagcuuauauucaucca

SEQ ID NO: 1321620 - RNA, 13 nt, Homo sapiens
cagcuuaucucag

SEQ ID NO: 1321621 - RNA, 12 nt, Homo sapiens
cagcuuaucucu

SEQ ID NO: 1321622 - RNA, 14 nt, Homo sapiens
cagcuugcugcuaa

SEQ ID NO: 1321623 - RNA, 13 nt, Homo sapiens
cagcuuuagccga

SEQ ID NO: 1321624 - RNA, 23 nt, Homo sapiens
caggaaccucuucagaaagugug

SEQ ID NO: 1321625 - RNA, 15 nt, Homo sapiens
caggaauauuuucca

SEQ ID NO: 1321626 - RNA, 22 nt, Homo sapiens
caggaaucgguggucuccaccu

SEQ ID NO: 1321627 - RNA, 23 nt, Homo sapiens
caggaauuucccaggacccugaa

SEQ ID NO: 1321628 - RNA, 22 nt, Homo sapiens
caggaccuccaagccacugagc

SEQ ID NO: 1321629 - RNA, 12 nt, Homo sapiens
caggaccugccu

SEQ ID NO: 1321630 - RNA, 20 nt, Homo sapiens
caggacuugagaagaccuca

SEQ ID NO: 1321631 - RNA, 22 nt, Homo sapiens
caggagaccuggcacuggaugc

SEQ ID NO: 1321632 - RNA, 13 nt, Homo sapiens
caggagacugggc

SEQ ID NO: 1321633 - RNA, 19 nt, Homo sapiens
caggagagacagugaggcu

SEQ ID NO: 1321634 - RNA, 14 nt, Homo sapiens
caggagaucaucug

SEQ ID NO: 1321635 - RNA, 18 nt, Homo sapiens
caggaggaaggcuuacac

SEQ ID NO: 1321636 - RNA, 21 nt, Homo sapiens
caggaggcccugguccuggcc

SEQ ID NO: 1321637 - RNA, 13 nt, Homo sapiens
caggaggggaaac

SEQ ID NO: 1321638 - RNA, 14 nt, Homo sapiens
caggaguucagggu

SEQ ID NO: 1321639 - RNA, 14 nt, Homo sapiens
caggauuccagaau

SEQ ID NO: 1321640 - RNA, 16 nt, Homo sapiens
caggauuugcacagaa

SEQ ID NO: 1321641 - RNA, 13 nt, Homo sapiens
caggcaagcaccu

SEQ ID NO: 1321642 - RNA, 18 nt, Homo sapiens
caggcacacagcuacucu

SEQ ID NO: 1321643 - RNA, 12 nt, Homo sapiens
caggcaccucac

SEQ ID NO: 1321644 - RNA, 12 nt, Homo sapiens
caggcacugaga

SEQ ID NO: 1321645 - RNA, 20 nt, Homo sapiens
caggcagcuuuuucucuccc

SEQ ID NO: 1321646 - RNA, 20 nt, Homo sapiens
caggcaugaaauacugugcc

SEQ ID NO: 1321647 - RNA, 19 nt, Homo sapiens
caggcaugagucagucuga

SEQ ID NO: 1321648 - RNA, 23 nt, Homo sapiens
caggccacugggcccugagccag

SEQ ID NO: 1321649 - RNA, 14 nt, Homo sapiens
caggccaucaucag

SEQ ID NO: 1321650 - RNA, 14 nt, Homo sapiens
caggccauggcuca

SEQ ID NO: 1321651 - RNA, 18 nt, Homo sapiens
caggcccggcuccaggcu

SEQ ID NO: 1321652 - RNA, 12 nt, Homo sapiens
caggcccugugg

SEQ ID NO: 1321653 - RNA, 14 nt, Homo sapiens
caggcccuguggca

SEQ ID NO: 1321654 - RNA, 15 nt, Homo sapiens
caggcgggacagugc

SEQ ID NO: 1321655 - RNA, 22 nt, Homo sapiens
caggcugaccaggcgcccggga

SEQ ID NO: 1321656 - RNA, 17 nt, Homo sapiens
caggcuggagugcagug

SEQ ID NO: 1321657 - RNA, 15 nt, Homo sapiens
caggcuggccagucc

SEQ ID NO: 1321658 - RNA, 18 nt, Homo sapiens
caggcuggucuugaacuc

SEQ ID NO: 1321659 - RNA, 22 nt, Homo sapiens
caggcugugacucuucucucaa

SEQ ID NO: 1321660 - RNA, 18 nt, Homo sapiens
caggcuuaaaaucagucc

SEQ ID NO: 1321661 - RNA, 18 nt, Homo sapiens
cagggaacagccacuccc

SEQ ID NO: 1321662 - RNA, 21 nt, Homo sapiens
cagggagacugcaucucaaaa

SEQ ID NO: 1321663 - RNA, 22 nt, Homo sapiens
cagggcauauuaguugaugaaa

SEQ ID NO: 1321664 - RNA, 17 nt, Homo sapiens
cagggcccccaucucau

SEQ ID NO: 1321665 - RNA, 20 nt, Homo sapiens
cagggcucuaaugugucucu

SEQ ID NO: 1321666 - RNA, 15 nt, Homo sapiens
cagggcugugcuuga

SEQ ID NO: 1321667 - RNA, 18 nt, Homo sapiens
cagggcuuccucuuccgg

SEQ ID NO: 1321668 - RNA, 16 nt, Homo sapiens
caggggaguaugcaaa

SEQ ID NO: 1321669 - RNA, 23 nt, Homo sapiens
caggggcuggcccagggcugcaa

SEQ ID NO: 1321670 - RNA, 19 nt, Homo sapiens
caggguccagacccugaag

SEQ ID NO: 1321671 - RNA, 20 nt, Homo sapiens
caggguccucuucugggccu

SEQ ID NO: 1321672 - RNA, 13 nt, Homo sapiens
cagggucugccuc

SEQ ID NO: 1321673 - RNA, 16 nt, Homo sapiens
caggguggagugcagu

SEQ ID NO: 1321674 - RNA, 21 nt, Homo sapiens
caggguuuugccauguuggcc

SEQ ID NO: 1321675 - RNA, 18 nt, Homo sapiens
cagguccugagagcugcu

SEQ ID NO: 1321676 - RNA, 20 nt, Homo sapiens
caggugaaacccagucacug

SEQ ID NO: 1321677 - RNA, 21 nt, Homo sapiens
caggugcagccagaggcaccu

SEQ ID NO: 1321678 - RNA, 14 nt, Homo sapiens
caggugcauagcaa

SEQ ID NO: 1321679 - RNA, 22 nt, Homo sapiens
caggugcugacuucaucuccca

SEQ ID NO: 1321680 - RNA, 15 nt, Homo sapiens
cagguggccuagcag

SEQ ID NO: 1321681 - RNA, 15 nt, Homo sapiens
cagguguuggugaca

SEQ ID NO: 1321682 - RNA, 22 nt, Homo sapiens
cagguucaugccaccauggcca

SEQ ID NO: 1321683 - RNA, 16 nt, Homo sapiens
cagguuccaaucagaa

SEQ ID NO: 1321684 - RNA, 14 nt, Homo sapiens
cagguucugagaua

SEQ ID NO: 1321685 - RNA, 23 nt, Homo sapiens
cagguuggaacuaugcagugugc

SEQ ID NO: 1321686 - RNA, 15 nt, Homo sapiens
cagguuuuuggucug

SEQ ID NO: 1321687 - RNA, 21 nt, Homo sapiens
caguacagccuccggaagcag

SEQ ID NO: 1321688 - RNA, 21 nt, Homo sapiens
caguacuugucauauguagcc

SEQ ID NO: 1321689 - RNA, 19 nt, Homo sapiens
caguagaaauaauaugcau

SEQ ID NO: 1321690 - RNA, 17 nt, Homo sapiens
caguauauguugcaaaa

SEQ ID NO: 1321691 - RNA, 15 nt, Homo sapiens
caguaugcuugcucu

SEQ ID NO: 1321692 - RNA, 17 nt, Homo sapiens
caguauuuuguguccuc

SEQ ID NO: 1321693 - RNA, 15 nt, Homo sapiens
cagucaacaguucaa

SEQ ID NO: 1321694 - RNA, 13 nt, Homo sapiens
cagucaauucuga

SEQ ID NO: 1321695 - RNA, 17 nt, Homo sapiens
cagucauuaauuuucaa

SEQ ID NO: 1321696 - RNA, 15 nt, Homo sapiens
cagucccaugcacaa

SEQ ID NO: 1321697 - RNA, 17 nt, Homo sapiens
cagucccccaacuaccc

SEQ ID NO: 1321698 - RNA, 19 nt, Homo sapiens
cagucccuaaaaacacaga

SEQ ID NO: 1321699 - RNA, 19 nt, Homo sapiens
caguccugccucagccucc

SEQ ID NO: 1321700 - RNA, 14 nt, Homo sapiens
cagucgcccggggc

SEQ ID NO: 1321701 - RNA, 19 nt, Homo sapiens
cagugaauuuuugcaauaa

SEQ ID NO: 1321702 - RNA, 14 nt, Homo sapiens
cagugagaugcauu

SEQ ID NO: 1321703 - RNA, 18 nt, Homo sapiens
cagugagucugaauguca

SEQ ID NO: 1321704 - RNA, 18 nt, Homo sapiens
cagugcaaauacucuggu

SEQ ID NO: 1321705 - RNA, 12 nt, Homo sapiens
cagugcaauggg

SEQ ID NO: 1321706 - RNA, 15 nt, Homo sapiens
cagugcagcucguga

SEQ ID NO: 1321707 - RNA, 12 nt, Homo sapiens
cagugcauuuac

SEQ ID NO: 1321708 - RNA, 20 nt, Homo sapiens
cagugcuccuguaagucaaa

SEQ ID NO: 1321709 - RNA, 15 nt, Homo sapiens
caguguccaaagcag

SEQ ID NO: 1321710 - RNA, 12 nt, Homo sapiens
cagugugacaag

SEQ ID NO: 1321711 - RNA, 20 nt, Homo sapiens
caguguuaaaugugaugaau

SEQ ID NO: 1321712 - RNA, 17 nt, Homo sapiens
caguguugacacuuaaa

SEQ ID NO: 1321713 - RNA, 11 nt, Homo sapiens
caguguugccc

SEQ ID NO: 1321714 - RNA, 15 nt, Homo sapiens
caguuacauaauuca

SEQ ID NO: 1321715 - RNA, 14 nt, Homo sapiens
caguucagugaggu

SEQ ID NO: 1321716 - RNA, 22 nt, Homo sapiens
caguuccuucaauaaccaugau

SEQ ID NO: 1321717 - RNA, 18 nt, Homo sapiens
caguucugccuuaucuaa

SEQ ID NO: 1321718 - RNA, 23 nt, Homo sapiens
caguugacccuauuuuuugacac

SEQ ID NO: 1321719 - RNA, 21 nt, Homo sapiens
caguuggcaugguaguauaca

SEQ ID NO: 1321720 - RNA, 19 nt, Homo sapiens
caguuguccuuaaauuugu

SEQ ID NO: 1321721 - RNA, 12 nt, Homo sapiens
caguuguuaaaa

SEQ ID NO: 1321722 - RNA, 19 nt, Homo sapiens
caguuguuaaaaugagcau

SEQ ID NO: 1321723 - RNA, 20 nt, Homo sapiens
caguuuaaccugaugcaguc

SEQ ID NO: 1321724 - RNA, 15 nt, Homo sapiens
cauaaaaagaagccu

SEQ ID NO: 1321725 - RNA, 18 nt, Homo sapiens
cauaaaaaggaauccacu

SEQ ID NO: 1321726 - RNA, 20 nt, Homo sapiens
cauaaaaaguaauaaaugag

SEQ ID NO: 1321727 - RNA, 18 nt, Homo sapiens
cauaaaauagagugcauu

SEQ ID NO: 1321728 - RNA, 21 nt, Homo sapiens
cauaaagacaaucacugccaa

SEQ ID NO: 1321729 - RNA, 15 nt, Homo sapiens
cauaaagucagugcc

SEQ ID NO: 1321730 - RNA, 15 nt, Homo sapiens
cauaagaaaagauua

SEQ ID NO: 1321731 - RNA, 16 nt, Homo sapiens
cauaagugaaaaucuu

SEQ ID NO: 1321732 - RNA, 21 nt, Homo sapiens
cauaagugaaaaucuuacaac

SEQ ID NO: 1321733 - RNA, 13 nt, Homo sapiens
cauaauuaaugua

SEQ ID NO: 1321734 - RNA, 22 nt, Homo sapiens
cauaauuaauguaguaguaaua

SEQ ID NO: 1321735 - RNA, 12 nt, Homo sapiens
cauaauuuacau

SEQ ID NO: 1321736 - RNA, 19 nt, Homo sapiens
cauaauuuguacauaugua

SEQ ID NO: 1321737 - RNA, 22 nt, Homo sapiens
cauaauuuguacauauguaaaa

SEQ ID NO: 1321738 - RNA, 22 nt, Homo sapiens
cauaauuuuagaugccugugaa

SEQ ID NO: 1321739 - RNA, 18 nt, Homo sapiens
cauacaaguauccaguca

SEQ ID NO: 1321740 - RNA, 13 nt, Homo sapiens
cauacaccagcau

SEQ ID NO: 1321741 - RNA, 21 nt, Homo sapiens
aguggugcgaucuggguucac

SEQ ID NO: 1321742 - RNA, 12 nt, Homo sapiens
aguggugguaug

SEQ ID NO: 1321743 - RNA, 16 nt, Homo sapiens
aguggugguauguaau

SEQ ID NO: 1321744 - RNA, 19 nt, Homo sapiens
aguggugucugugaagggu

SEQ ID NO: 1321745 - RNA, 15 nt, Homo sapiens
accugcccugugcau

SEQ ID NO: 1321746 - RNA, 16 nt, Homo sapiens
accugcgggagcugca

SEQ ID NO: 1321747 - RNA, 16 nt, Homo sapiens
accuggcaacccagga

SEQ ID NO: 1321748 - RNA, 16 nt, Homo sapiens
accuggcaaggacaca

SEQ ID NO: 1321749 - RNA, 19 nt, Homo sapiens
accuggcagccacaacugc

SEQ ID NO: 1321750 - RNA, 19 nt, Homo sapiens
accuggcagcucuggacag

SEQ ID NO: 1321751 - RNA, 18 nt, Homo sapiens
accuggccgccuccagga

SEQ ID NO: 1321752 - RNA, 14 nt, Homo sapiens
accugggcugugau

SEQ ID NO: 1321753 - RNA, 19 nt, Homo sapiens
accuggggucaucgauuca

SEQ ID NO: 1321754 - RNA, 14 nt, Homo sapiens
accuggguguuaca

SEQ ID NO: 1321755 - RNA, 15 nt, Homo sapiens
accuguaaucccagc

SEQ ID NO: 1321756 - RNA, 18 nt, Homo sapiens
accugucaccucuguucc

SEQ ID NO: 1321757 - RNA, 17 nt, Homo sapiens
accugucauucuagaaa

SEQ ID NO: 1321758 - RNA, 14 nt, Homo sapiens
accugucauuguau

SEQ ID NO: 1321759 - RNA, 16 nt, Homo sapiens
accugucauuuugcac

SEQ ID NO: 1321760 - RNA, 18 nt, Homo sapiens
accugucauuuugcacug

SEQ ID NO: 1321761 - RNA, 15 nt, Homo sapiens
accugucgcuuccua

SEQ ID NO: 1321762 - RNA, 22 nt, Homo sapiens
accugugagcccagcuggguca

SEQ ID NO: 1321763 - RNA, 21 nt, Homo sapiens
accugugcacguuggaacuuu

SEQ ID NO: 1321764 - RNA, 19 nt, Homo sapiens
accuguuagcagacaggcc

SEQ ID NO: 1321765 - RNA, 19 nt, Homo sapiens
accuguuuuuaagcuguuu

SEQ ID NO: 1321766 - RNA, 16 nt, Homo sapiens
accuguuuuuguuucu

SEQ ID NO: 1321767 - RNA, 19 nt, Homo sapiens
accuuaguguccuuuucuc

SEQ ID NO: 1321768 - RNA, 13 nt, Homo sapiens
accuucaggaaau

SEQ ID NO: 1321769 - RNA, 21 nt, Homo sapiens
accuucugugcuucagcucuu

SEQ ID NO: 1321770 - RNA, 21 nt, Homo sapiens
accuugaacauuuuacaagaa

SEQ ID NO: 1321771 - RNA, 23 nt, Homo sapiens
accuugcgauucugcagccacaa

SEQ ID NO: 1321772 - RNA, 16 nt, Homo sapiens
accuuggacauccucc

SEQ ID NO: 1321773 - RNA, 22 nt, Homo sapiens
accuuggcaccagacacccagg

SEQ ID NO: 1321774 - RNA, 20 nt, Homo sapiens
accuuuccauuuauucuuug

SEQ ID NO: 1321775 - RNA, 22 nt, Homo sapiens
accuuucggcaaggacgguaac

SEQ ID NO: 1321776 - RNA, 19 nt, Homo sapiens
accuuuuuuuuuuuuccaa

SEQ ID NO: 1321777 - RNA, 13 nt, Homo sapiens
acgaaaguggaaa

SEQ ID NO: 1321778 - RNA, 17 nt, Homo sapiens
acgacugucuccauggc

SEQ ID NO: 1321779 - RNA, 17 nt, Homo sapiens
acgagauacagaauuuu

SEQ ID NO: 1321780 - RNA, 18 nt, Homo sapiens
acugcugagauacauaca

SEQ ID NO: 1321781 - RNA, 16 nt, Homo sapiens
acugcuugaccaaaga

SEQ ID NO: 1321782 - RNA, 15 nt, Homo sapiens
acugcuuuuggucug

SEQ ID NO: 1321783 - RNA, 15 nt, Homo sapiens
acuggaagcacagcu

SEQ ID NO: 1321784 - RNA, 22 nt, Homo sapiens
acuggcagggacgaggacaaau

SEQ ID NO: 1321785 - RNA, 14 nt, Homo sapiens
acuggcugauggag

SEQ ID NO: 1321786 - RNA, 19 nt, Homo sapiens
acuggcugugugaccuuag

SEQ ID NO: 1321787 - RNA, 13 nt, Homo sapiens
acugguugcacuu

SEQ ID NO: 1321788 - RNA, 14 nt, Homo sapiens
acugguuucucaga

SEQ ID NO: 1321789 - RNA, 16 nt, Homo sapiens
acuguaacacuuuaca

SEQ ID NO: 1321790 - RNA, 23 nt, Homo sapiens
acuguauuuauugugaugccuug

SEQ ID NO: 1321791 - RNA, 20 nt, Homo sapiens
acugucaaggcugcuuagaa

SEQ ID NO: 1321792 - RNA, 16 nt, Homo sapiens
acuguccuacccaccc

SEQ ID NO: 1321793 - RNA, 14 nt, Homo sapiens
acugugacugauau

SEQ ID NO: 1321794 - RNA, 14 nt, Homo sapiens
acuguguguugcca

SEQ ID NO: 1321795 - RNA, 22 nt, Homo sapiens
acuguuugucucaccuacccau

SEQ ID NO: 1321796 - RNA, 14 nt, Homo sapiens
acuuaaccuugcaa

SEQ ID NO: 1321797 - RNA, 15 nt, Homo sapiens
acuuacagaucuauc

SEQ ID NO: 1321798 - RNA, 19 nt, Homo sapiens
acuuacagaucuaucuccu

SEQ ID NO: 1321799 - RNA, 20 nt, Homo sapiens
acuuacuauuggucaugcaa

SEQ ID NO: 1321800 - RNA, 22 nt, Homo sapiens
acuuagucucuaaagaguuuau

SEQ ID NO: 1321801 - RNA, 23 nt, Homo sapiens
acuuauaauuugcauaccauuaa

SEQ ID NO: 1321802 - RNA, 13 nt, Homo sapiens
acuuaugauuuca

SEQ ID NO: 1321803 - RNA, 16 nt, Homo sapiens
acuuauuaacaauuag

SEQ ID NO: 1321804 - RNA, 23 nt, Homo sapiens
acuucaagaacccugacuccucu

SEQ ID NO: 1321805 - RNA, 16 nt, Homo sapiens
acuucagccaggugaa

SEQ ID NO: 1321806 - RNA, 16 nt, Homo sapiens
acuucaugcaggugaa

SEQ ID NO: 1321807 - RNA, 14 nt, Homo sapiens
acuucauggaucag

SEQ ID NO: 1321808 - RNA, 17 nt, Homo sapiens
acuuccucccacugucu

SEQ ID NO: 1321809 - RNA, 19 nt, Homo sapiens
acuuccucgagaccauaca

SEQ ID NO: 1321810 - RNA, 18 nt, Homo sapiens
acuucuucaccucuucca

SEQ ID NO: 1321811 - RNA, 22 nt, Homo sapiens
acuucuuuaguacuuacaucag

SEQ ID NO: 1321812 - RNA, 19 nt, Homo sapiens
acuucuuucagcagacuga

SEQ ID NO: 1321813 - RNA, 19 nt, Homo sapiens
acuugcacagggauucuca

SEQ ID NO: 1321814 - RNA, 16 nt, Homo sapiens
agcaaguuuucuucca

SEQ ID NO: 1321815 - RNA, 14 nt, Homo sapiens
agcaauaagcacuc

SEQ ID NO: 1321816 - RNA, 22 nt, Homo sapiens
agcaauguacaccagagccuca

SEQ ID NO: 1321817 - RNA, 24 nt, Homo sapiens
agcaauuucccccuaaaccaacug

SEQ ID NO: 1321818 - RNA, 18 nt, Homo sapiens
agcacaaugcauaauguc

SEQ ID NO: 1321819 - RNA, 19 nt, Homo sapiens
agcacagcuugaccugagg

SEQ ID NO: 1321820 - RNA, 20 nt, Homo sapiens
agcacagggggaagaagaag

SEQ ID NO: 1321821 - RNA, 17 nt, Homo sapiens
agcacccccagugcagc

SEQ ID NO: 1321822 - RNA, 22 nt, Homo sapiens
agcacccucuggauucugaauc

SEQ ID NO: 1321823 - RNA, 20 nt, Homo sapiens
agcaccgugucaagcugcuc

SEQ ID NO: 1321824 - RNA, 21 nt, Homo sapiens
agcaccugaagugaccuggaa

SEQ ID NO: 1321825 - RNA, 16 nt, Homo sapiens
agcaccuguaauccca

SEQ ID NO: 1321826 - RNA, 17 nt, Homo sapiens
agcacuaggauugugau

SEQ ID NO: 1321827 - RNA, 12 nt, Homo sapiens
agcacuggguug

SEQ ID NO: 1321828 - RNA, 15 nt, Homo sapiens
agcagaaacuuuaca

SEQ ID NO: 1321829 - RNA, 23 nt, Homo sapiens
agcagaaaggaaaagauuccugu

SEQ ID NO: 1321830 - RNA, 20 nt, Homo sapiens
agcagacaggccccgugagg

SEQ ID NO: 1321831 - RNA, 15 nt, Homo sapiens
agcagaugguuucca

SEQ ID NO: 1321832 - RNA, 15 nt, Homo sapiens
agcagccaagggaug

SEQ ID NO: 1321833 - RNA, 21 nt, Homo sapiens
agcagcgccccucccaagagg

SEQ ID NO: 1321834 - RNA, 15 nt, Homo sapiens
agcagcugcagcuca

SEQ ID NO: 1321835 - RNA, 14 nt, Homo sapiens
agcaggcacccacu

SEQ ID NO: 1321836 - RNA, 20 nt, Homo sapiens
agcagggccaacaaccugug

SEQ ID NO: 1321837 - RNA, 18 nt, Homo sapiens
agcaggggaguaugcaaa

SEQ ID NO: 1321838 - RNA, 20 nt, Homo sapiens
agcaggggaguaugcaaaag

SEQ ID NO: 1321839 - RNA, 19 nt, Homo sapiens
agcagggggggaaaugcau

SEQ ID NO: 1321840 - RNA, 22 nt, Homo sapiens
agcagucacugacaguuaauaa

SEQ ID NO: 1321841 - RNA, 13 nt, Homo sapiens
agcaucaagccac

SEQ ID NO: 1321842 - RNA, 14 nt, Homo sapiens
agcaucaagccacu

SEQ ID NO: 1321843 - RNA, 22 nt, Homo sapiens
agcauccucucggggcagaccc

SEQ ID NO: 1321844 - RNA, 20 nt, Homo sapiens
agcaugaaaguggacaagga

SEQ ID NO: 1321845 - RNA, 19 nt, Homo sapiens
caaucaucaucauucucau

SEQ ID NO: 1321846 - RNA, 22 nt, Homo sapiens
caaucaugaaauaugcaucuca

SEQ ID NO: 1321847 - RNA, 12 nt, Homo sapiens
caauccaagagu

SEQ ID NO: 1321848 - RNA, 19 nt, Homo sapiens
caauccaagagucugauga

SEQ ID NO: 1321849 - RNA, 17 nt, Homo sapiens
caauccucucaccucag

SEQ ID NO: 1321850 - RNA, 18 nt, Homo sapiens
caaugaaauauugcugua

SEQ ID NO: 1321851 - RNA, 20 nt, Homo sapiens
caaugaaauauugcuguaua

SEQ ID NO: 1321852 - RNA, 11 nt, Homo sapiens
caaugaacuuu

SEQ ID NO: 1321853 - RNA, 14 nt, Homo sapiens
caaugaauccccaa

SEQ ID NO: 1321854 - RNA, 12 nt, Homo sapiens
caauggcuccuu

SEQ ID NO: 1321855 - RNA, 13 nt, Homo sapiens
caaugggagcuga

SEQ ID NO: 1321856 - RNA, 19 nt, Homo sapiens
caauguauugagcauguga

SEQ ID NO: 1321857 - RNA, 15 nt, Homo sapiens
caaugucaaugugaa

SEQ ID NO: 1321858 - RNA, 15 nt, Homo sapiens
caauguucaucccau

SEQ ID NO: 1321859 - RNA, 13 nt, Homo sapiens
caauuccucuggg

SEQ ID NO: 1321860 - RNA, 16 nt, Homo sapiens
caauugaaaugcauug

SEQ ID NO: 1321861 - RNA, 15 nt, Homo sapiens
caauuggcauuaaca

SEQ ID NO: 1321862 - RNA, 11 nt, Homo sapiens
caauuuaguuc

SEQ ID NO: 1321863 - RNA, 13 nt, Homo sapiens
caauuugcugcca

SEQ ID NO: 1321864 - RNA, 22 nt, Homo sapiens
caauuuuucaagagcuccuuga

SEQ ID NO: 1321865 - RNA, 13 nt, Homo sapiens
cacaaaacccaga

SEQ ID NO: 1321866 - RNA, 14 nt, Homo sapiens
cacaaaauugggaa

SEQ ID NO: 1321867 - RNA, 13 nt, Homo sapiens
cacaaauuuguau

SEQ ID NO: 1321868 - RNA, 14 nt, Homo sapiens
cacaacacaguucu

SEQ ID NO: 1321869 - RNA, 13 nt, Homo sapiens
cacaacagugaaa

SEQ ID NO: 1321870 - RNA, 20 nt, Homo sapiens
cacaagaagcugguggagca

SEQ ID NO: 1321871 - RNA, 15 nt, Homo sapiens
cacaaggccuugccu

SEQ ID NO: 1321872 - RNA, 21 nt, Homo sapiens
cacaauuccauuuccaguuca

SEQ ID NO: 1321873 - RNA, 12 nt, Homo sapiens
cacacacacaaa

SEQ ID NO: 1321874 - RNA, 14 nt, Homo sapiens
cacacacacaaaaa

SEQ ID NO: 1321875 - RNA, 13 nt, Homo sapiens
cacacacauacac

SEQ ID NO: 1321876 - RNA, 20 nt, Homo sapiens
cacacaccaaguaccaguau

SEQ ID NO: 1321877 - RNA, 18 nt, Homo sapiens
cacacaccuguagcacuu

SEQ ID NO: 1321878 - RNA, 13 nt, Homo sapiens
cacacagcuaaca

SEQ ID NO: 1321879 - RNA, 11 nt, Homo sapiens
cacacaguguu

SEQ ID NO: 1321880 - RNA, 17 nt, Homo sapiens
cacacccuccccauuca

SEQ ID NO: 1321881 - RNA, 19 nt, Homo sapiens
cacaccuacaccucuugaa

SEQ ID NO: 1321882 - RNA, 13 nt, Homo sapiens
cacaccugcccua

SEQ ID NO: 1321883 - RNA, 13 nt, Homo sapiens
cacaccuguaauc

SEQ ID NO: 1321884 - RNA, 16 nt, Homo sapiens
cacacgauaaagggau

SEQ ID NO: 1321885 - RNA, 21 nt, Homo sapiens
cacacgccucccacugggguc

SEQ ID NO: 1321886 - RNA, 18 nt, Homo sapiens
cacacugaggcagggaag

SEQ ID NO: 1321887 - RNA, 16 nt, Homo sapiens
cacacuuuuggaacca

SEQ ID NO: 1321888 - RNA, 22 nt, Homo sapiens
cacacuuuuggaaccaugccuu

SEQ ID NO: 1321889 - RNA, 14 nt, Homo sapiens
cacagaaaugcugc

SEQ ID NO: 1321890 - RNA, 13 nt, Homo sapiens
cacagaagcacau

SEQ ID NO: 1321891 - RNA, 12 nt, Homo sapiens
cacagaauguga

SEQ ID NO: 1321892 - RNA, 20 nt, Homo sapiens
cacagaggggagucaccagc

SEQ ID NO: 1321893 - RNA, 16 nt, Homo sapiens
cacagauaaaguuuuc

SEQ ID NO: 1321894 - RNA, 20 nt, Homo sapiens
cacagcaacauuuucuugaa

SEQ ID NO: 1321895 - RNA, 13 nt, Homo sapiens
cacagcacagcca

SEQ ID NO: 1321896 - RNA, 14 nt, Homo sapiens
cacagccaacacgc

SEQ ID NO: 1321897 - RNA, 20 nt, Homo sapiens
cacagcuucauuuccugugu

SEQ ID NO: 1321898 - RNA, 23 nt, Homo sapiens
cacagcuucugcagcagacuguc

SEQ ID NO: 1321899 - RNA, 14 nt, Homo sapiens
cacagcuuuuccaa

SEQ ID NO: 1321900 - RNA, 14 nt, Homo sapiens
cacaggccugagau

SEQ ID NO: 1321901 - RNA, 16 nt, Homo sapiens
cacagguucaugccac

SEQ ID NO: 1321902 - RNA, 18 nt, Homo sapiens
cacaguaauuauguucua

SEQ ID NO: 1321903 - RNA, 15 nt, Homo sapiens
cacaguccucauuua

SEQ ID NO: 1321904 - RNA, 22 nt, Homo sapiens
cacagugagucgaggacaggga

SEQ ID NO: 1321905 - RNA, 23 nt, Homo sapiens
cacauaguagguacccaauucaa

SEQ ID NO: 1321906 - RNA, 14 nt, Homo sapiens
cacauccaucagca

SEQ ID NO: 1321907 - RNA, 22 nt, Homo sapiens
cacaucuccuguggucucugac

SEQ ID NO: 1321908 - RNA, 18 nt, Homo sapiens
cacaucuuccauuuccau

SEQ ID NO: 1321909 - RNA, 19 nt, Homo sapiens
cacaugaaaccuacacacu

SEQ ID NO: 1321910 - RNA, 17 nt, Homo sapiens
cacaugcaccuacccau

SEQ ID NO: 1321911 - RNA, 18 nt, Homo sapiens
cacaugcaccuacccaua

SEQ ID NO: 1321912 - RNA, 22 nt, Homo sapiens
caccaacacugucccaagguga

SEQ ID NO: 1321913 - RNA, 14 nt, Homo sapiens
caccaagcccaguu

SEQ ID NO: 1321914 - RNA, 21 nt, Homo sapiens
caccaauuaauguagcugcua

SEQ ID NO: 1321915 - RNA, 13 nt, Homo sapiens
caccacaaacugu

SEQ ID NO: 1321916 - RNA, 17 nt, Homo sapiens
caccacagccagcaccu

SEQ ID NO: 1321917 - RNA, 14 nt, Homo sapiens
caccacucaaaaau

SEQ ID NO: 1321918 - RNA, 17 nt, Homo sapiens
caccagccuaagaagcu

SEQ ID NO: 1321919 - RNA, 21 nt, Homo sapiens
caccaggauagagacuggaac

SEQ ID NO: 1321920 - RNA, 15 nt, Homo sapiens
caccaggugccuuuc

SEQ ID NO: 1321921 - RNA, 15 nt, Homo sapiens
caccaguuauuccuu

SEQ ID NO: 1321922 - RNA, 21 nt, Homo sapiens
caccaugacccucuuccucau

SEQ ID NO: 1321923 - RNA, 15 nt, Homo sapiens
caccauguauuuugu

SEQ ID NO: 1321924 - RNA, 17 nt, Homo sapiens
caccauguauuuuguaa

SEQ ID NO: 1321925 - RNA, 12 nt, Homo sapiens
cacccacaucuu

SEQ ID NO: 1321926 - RNA, 23 nt, Homo sapiens
cacccagcucagcauuuccacac

SEQ ID NO: 1321927 - RNA, 16 nt, Homo sapiens
cacccaugcccagcug

SEQ ID NO: 1321928 - RNA, 17 nt, Homo sapiens
cacccaugcccagcugu

SEQ ID NO: 1321929 - RNA, 14 nt, Homo sapiens
cacccccagugcag

SEQ ID NO: 1321930 - RNA, 15 nt, Homo sapiens
cacccccaugacauu

SEQ ID NO: 1321931 - RNA, 13 nt, Homo sapiens
caccccucaaaaa

SEQ ID NO: 1321932 - RNA, 16 nt, Homo sapiens
caccccugcacaguug

SEQ ID NO: 1321933 - RNA, 22 nt, Homo sapiens
cacccuccuuucaccacaugug

SEQ ID NO: 1321934 - RNA, 16 nt, Homo sapiens
cacccuggaggauuuc

SEQ ID NO: 1321935 - RNA, 21 nt, Homo sapiens
cacccuggaggauuucaucuc

SEQ ID NO: 1321936 - RNA, 12 nt, Homo sapiens
caccguucugug

SEQ ID NO: 1321937 - RNA, 18 nt, Homo sapiens
caccuauaaaacagguca

SEQ ID NO: 1321938 - RNA, 22 nt, Homo sapiens
caccuauauagaugcagcauuu

SEQ ID NO: 1321939 - RNA, 20 nt, Homo sapiens
caccucacaggccccaggaa

SEQ ID NO: 1321940 - RNA, 13 nt, Homo sapiens
caccucugcacaa

SEQ ID NO: 1321941 - RNA, 20 nt, Homo sapiens
caccugcagcccauggugag

SEQ ID NO: 1321942 - RNA, 16 nt, Homo sapiens
caccugcuggagugaa

SEQ ID NO: 1321943 - RNA, 15 nt, Homo sapiens
caccuggggcugcug

SEQ ID NO: 1321944 - RNA, 14 nt, Homo sapiens
caccuguaauccca

SEQ ID NO: 1321945 - RNA, 23 nt, Homo sapiens
caccuguuugaaaccaagcuuuc

SEQ ID NO: 1321946 - RNA, 18 nt, Homo sapiens
caccuuaauaugcugcaa

SEQ ID NO: 1321947 - RNA, 23 nt, Homo sapiens
caccuuggggccuugaugacugc

SEQ ID NO: 1321948 - RNA, 19 nt, Homo sapiens
cacgacugcccggcagggu

SEQ ID NO: 1321949 - RNA, 20 nt, Homo sapiens
cacgcaggagcacacccagc

SEQ ID NO: 1321950 - RNA, 18 nt, Homo sapiens
cacgcccuucaaaaccug

SEQ ID NO: 1321951 - RNA, 12 nt, Homo sapiens
cacgccugcaaa

SEQ ID NO: 1321952 - RNA, 22 nt, Homo sapiens
cacgccuguaaucccagcacuu

SEQ ID NO: 1321953 - RNA, 16 nt, Homo sapiens
cacgcuggagugcagu

SEQ ID NO: 1321954 - RNA, 17 nt, Homo sapiens
cacgcuggagugcagug

SEQ ID NO: 1321955 - RNA, 18 nt, Homo sapiens
cacggauaucaauuugag

SEQ ID NO: 1321956 - RNA, 17 nt, Homo sapiens
cacggcaaaaugucauu

SEQ ID NO: 1321957 - RNA, 22 nt, Homo sapiens
cacgucugcagaaacagugcaa

SEQ ID NO: 1321958 - RNA, 20 nt, Homo sapiens
cacgugagaucauucacuca

SEQ ID NO: 1321959 - RNA, 16 nt, Homo sapiens
cacgugugugugugau

SEQ ID NO: 1321960 - RNA, 20 nt, Homo sapiens
cacuaaaaacuguuaaucag

SEQ ID NO: 1321961 - RNA, 16 nt, Homo sapiens
cacuaaccacgcugga

SEQ ID NO: 1321962 - RNA, 15 nt, Homo sapiens
cacuacauucauuua

SEQ ID NO: 1321963 - RNA, 15 nt, Homo sapiens
cacuacucuuacaug

SEQ ID NO: 1321964 - RNA, 13 nt, Homo sapiens
cacuagacaagcc

SEQ ID NO: 1321965 - RNA, 16 nt, Homo sapiens
cacuagccuaggucau

SEQ ID NO: 1321966 - RNA, 15 nt, Homo sapiens
cacuaggauugugau

SEQ ID NO: 1321967 - RNA, 11 nt, Homo sapiens
cacuaucccau

SEQ ID NO: 1321968 - RNA, 16 nt, Homo sapiens
cacuauuuucaaagaa

SEQ ID NO: 1321969 - RNA, 17 nt, Homo sapiens
cacucaagccaagcagc

SEQ ID NO: 1321970 - RNA, 21 nt, Homo sapiens
cacucacacggacacucaaaa

SEQ ID NO: 1321971 - RNA, 15 nt, Homo sapiens
cacucaguugcaacu

SEQ ID NO: 1321972 - RNA, 16 nt, Homo sapiens
cacucauacaucuggc

SEQ ID NO: 1321973 - RNA, 16 nt, Homo sapiens
cacucaugaagcauac

SEQ ID NO: 1321974 - RNA, 14 nt, Homo sapiens
cacuccuucucuca

SEQ ID NO: 1321975 - RNA, 14 nt, Homo sapiens
cacucugauagaau

SEQ ID NO: 1321976 - RNA, 22 nt, Homo sapiens
cacucuuauugcccacgcugga

SEQ ID NO: 1321977 - RNA, 18 nt, Homo sapiens
cacucuucaaaugccuga

SEQ ID NO: 1321978 - RNA, 16 nt, Homo sapiens
cacucuuuugcuuuau

SEQ ID NO: 1321979 - RNA, 17 nt, Homo sapiens
cacugaagcaccacagg

SEQ ID NO: 1321980 - RNA, 22 nt, Homo sapiens
cacugauauuuuuuauacagug

SEQ ID NO: 1321981 - RNA, 12 nt, Homo sapiens
cugcuccagaag

SEQ ID NO: 1321982 - RNA, 16 nt, Homo sapiens
cugcuccagugcagga

SEQ ID NO: 1321983 - RNA, 16 nt, Homo sapiens
cugcuccccucugcac

SEQ ID NO: 1321984 - RNA, 13 nt, Homo sapiens
cugcucugagcca

SEQ ID NO: 1321985 - RNA, 16 nt, Homo sapiens
cugcucugcaagcaga

SEQ ID NO: 1321986 - RNA, 16 nt, Homo sapiens
cugcugaaugccgcga

SEQ ID NO: 1321987 - RNA, 13 nt, Homo sapiens
cugcugaccucca

SEQ ID NO: 1321988 - RNA, 14 nt, Homo sapiens
cugcugaccuccac

SEQ ID NO: 1321989 - RNA, 22 nt, Homo sapiens
cugcugagagacagagcuauuc

SEQ ID NO: 1321990 - RNA, 23 nt, Homo sapiens
cugcugccauacuguaugcagua

SEQ ID NO: 1321991 - RNA, 17 nt, Homo sapiens
cugcuuaaaaauguagc

SEQ ID NO: 1321992 - RNA, 18 nt, Homo sapiens
cugcuucccagguucaag

SEQ ID NO: 1321993 - RNA, 19 nt, Homo sapiens
cugcuuugaggcaguucca

SEQ ID NO: 1321994 - RNA, 17 nt, Homo sapiens
cugcuuuucccauugcc

SEQ ID NO: 1321995 - RNA, 15 nt, Homo sapiens
cuggaaacauucagg

SEQ ID NO: 1321996 - RNA, 23 nt, Homo sapiens
cuggaacagauucacacugucug

SEQ ID NO: 1321997 - RNA, 14 nt, Homo sapiens
cuggaacaucauca

SEQ ID NO: 1321998 - RNA, 15 nt, Homo sapiens
cuggaacaucaucaa

SEQ ID NO: 1321999 - RNA, 12 nt, Homo sapiens
cuggaagccaaa

SEQ ID NO: 1322000 - RNA, 12 nt, Homo sapiens
cuggacacagag

SEQ ID NO: 1322001 - RNA, 22 nt, Homo sapiens
cuggacaugccuguccugaaag

SEQ ID NO: 1322002 - RNA, 14 nt, Homo sapiens
cuggaccagugguc

SEQ ID NO: 1322003 - RNA, 16 nt, Homo sapiens
cuggacccuguugcua

SEQ ID NO: 1322004 - RNA, 22 nt, Homo sapiens
cuggacuuuuccucucaugucu

SEQ ID NO: 1322005 - RNA, 21 nt, Homo sapiens
cuggagaccagggagccuuug

SEQ ID NO: 1322006 - RNA, 21 nt, Homo sapiens
cuggagucccaaaugucauca

SEQ ID NO: 1322007 - RNA, 18 nt, Homo sapiens
cuggaguggccacuaagc

SEQ ID NO: 1322008 - RNA, 18 nt, Homo sapiens
cuggaugcacuuucauua

SEQ ID NO: 1322009 - RNA, 20 nt, Homo sapiens
cuggauggccaaacccaaga

SEQ ID NO: 1322010 - RNA, 15 nt, Homo sapiens
cuggcaacacagagg

SEQ ID NO: 1322011 - RNA, 15 nt, Homo sapiens
cuggcaagaaugugu

SEQ ID NO: 1322012 - RNA, 14 nt, Homo sapiens
cuggcacauaaaga

SEQ ID NO: 1322013 - RNA, 22 nt, Homo sapiens
cuggcaucucccacacaagacc

SEQ ID NO: 1322014 - RNA, 20 nt, Homo sapiens
cuggccaagggccagacaga

SEQ ID NO: 1322015 - RNA, 17 nt, Homo sapiens
cuggccaauacggcaaa

SEQ ID NO: 1322016 - RNA, 19 nt, Homo sapiens
cuggccagaugcaccagcc

SEQ ID NO: 1322017 - RNA, 14 nt, Homo sapiens
cuggcccagccaaa

SEQ ID NO: 1322018 - RNA, 16 nt, Homo sapiens
cuggcccagggcugca

SEQ ID NO: 1322019 - RNA, 16 nt, Homo sapiens
cuggccuaaugagaua

SEQ ID NO: 1322020 - RNA, 17 nt, Homo sapiens
cuggccuggaugggcuu

SEQ ID NO: 1322021 - RNA, 17 nt, Homo sapiens
cuggcgccccuuccuag

SEQ ID NO: 1322022 - RNA, 13 nt, Homo sapiens
cuggcgugcagug

SEQ ID NO: 1322023 - RNA, 12 nt, Homo sapiens
cuggcugcuaac

SEQ ID NO: 1322024 - RNA, 14 nt, Homo sapiens
cuggcugcuaacaa

SEQ ID NO: 1322025 - RNA, 19 nt, Homo sapiens
cugggacugugcucagaga

SEQ ID NO: 1322026 - RNA, 16 nt, Homo sapiens
cugggagucacacagu

SEQ ID NO: 1322027 - RNA, 18 nt, Homo sapiens
cugggagucacacagugu

SEQ ID NO: 1322028 - RNA, 22 nt, Homo sapiens
cugggauuacaauugugagcca

SEQ ID NO: 1322029 - RNA, 19 nt, Homo sapiens
cugggauuacaggugugca

SEQ ID NO: 1322030 - RNA, 22 nt, Homo sapiens
cugggcaaggaggccacgugau

SEQ ID NO: 1322031 - RNA, 22 nt, Homo sapiens
cugggccauucuccacagcaac

SEQ ID NO: 1322032 - RNA, 15 nt, Homo sapiens
cugggcccacaaagg

SEQ ID NO: 1322033 - RNA, 13 nt, Homo sapiens
cugggcucacuca

SEQ ID NO: 1322034 - RNA, 13 nt, Homo sapiens
cugggcugugaug

SEQ ID NO: 1322035 - RNA, 20 nt, Homo sapiens
cugggcuucgggcuaugcaa

SEQ ID NO: 1322036 - RNA, 15 nt, Homo sapiens
cugggcuugucugua

SEQ ID NO: 1322037 - RNA, 15 nt, Homo sapiens
cuggggaaaggggac

SEQ ID NO: 1322038 - RNA, 15 nt, Homo sapiens
cuggggccuguugaa

SEQ ID NO: 1322039 - RNA, 21 nt, Homo sapiens
cugggguggggucaugcccuc

SEQ ID NO: 1322040 - RNA, 20 nt, Homo sapiens
cuggguaaaugcagcgugaa

SEQ ID NO: 1322041 - RNA, 21 nt, Homo sapiens
cugggucucgcuuuguugccc

SEQ ID NO: 1322042 - RNA, 16 nt, Homo sapiens
cugggugacccuggca

SEQ ID NO: 1322043 - RNA, 20 nt, Homo sapiens
cugggugcggugacucaugc

SEQ ID NO: 1322044 - RNA, 12 nt, Homo sapiens
cuggguggacau

SEQ ID NO: 1322045 - RNA, 17 nt, Homo sapiens
cuggguuucucuguaua

SEQ ID NO: 1322046 - RNA, 22 nt, Homo sapiens
cuggguuuuguauucucugagc

SEQ ID NO: 1322047 - RNA, 18 nt, Homo sapiens
cugguauggccuuaccuu

SEQ ID NO: 1322048 - RNA, 21 nt, Homo sapiens
cugguauuccugccuccauau

SEQ ID NO: 1322049 - RNA, 19 nt, Homo sapiens
cugguauuuuaucuuugau

SEQ ID NO: 1322050 - RNA, 17 nt, Homo sapiens
cuggucagggcaaaccu

SEQ ID NO: 1322051 - RNA, 15 nt, Homo sapiens
cugguggcacaggag

SEQ ID NO: 1322052 - RNA, 22 nt, Homo sapiens
cugguggcacaggaguguccuc

SEQ ID NO: 1322053 - RNA, 21 nt, Homo sapiens
cuggugguuugauuguuuaca

SEQ ID NO: 1322054 - RNA, 23 nt, Homo sapiens
cugguugaacucugguggcacag

SEQ ID NO: 1322055 - RNA, 23 nt, Homo sapiens
cugguuuguggggcacagaugcc

SEQ ID NO: 1322056 - RNA, 16 nt, Homo sapiens
cuguaaggcauuuuca

SEQ ID NO: 1322057 - RNA, 19 nt, Homo sapiens
cuguaagucaaaugugugc

SEQ ID NO: 1322058 - RNA, 21 nt, Homo sapiens
cuguaauaguuuuauauuguu

SEQ ID NO: 1322059 - RNA, 19 nt, Homo sapiens
cuguaaucccagcacuuug

SEQ ID NO: 1322060 - RNA, 21 nt, Homo sapiens
cuguaaucccagcacuuuggg

SEQ ID NO: 1322061 - RNA, 23 nt, Homo sapiens
cuguaaucccagcacuuugggag

SEQ ID NO: 1322062 - RNA, 14 nt, Homo sapiens
cuguaaucccagcu

SEQ ID NO: 1322063 - RNA, 18 nt, Homo sapiens
cuguaauccuagcacuuu

SEQ ID NO: 1322064 - RNA, 13 nt, Homo sapiens
cuguaguugacaa

SEQ ID NO: 1322065 - RNA, 16 nt, Homo sapiens
cuguauauaacuaugg

SEQ ID NO: 1322066 - RNA, 18 nt, Homo sapiens
cugucaaacaaagccaga

SEQ ID NO: 1322067 - RNA, 23 nt, Homo sapiens
cugucacuacaauuuaaacacca

SEQ ID NO: 1322068 - RNA, 20 nt, Homo sapiens
cugucaugcuucaucauucc

SEQ ID NO: 1322069 - RNA, 15 nt, Homo sapiens
cugucauuuugcacu

SEQ ID NO: 1322070 - RNA, 11 nt, Homo sapiens
cuguccagugc

SEQ ID NO: 1322071 - RNA, 18 nt, Homo sapiens
cugucccauagucccugc

SEQ ID NO: 1322072 - RNA, 21 nt, Homo sapiens
cuguccccuucucucaucucu

SEQ ID NO: 1322073 - RNA, 19 nt, Homo sapiens
cugucccucacagcacuag

SEQ ID NO: 1322074 - RNA, 21 nt, Homo sapiens
cuguccuuucuagagcacugc

SEQ ID NO: 1322075 - RNA, 14 nt, Homo sapiens
cugucucagccucc

SEQ ID NO: 1322076 - RNA, 19 nt, Homo sapiens
cugucuccuuaacacugag

SEQ ID NO: 1322077 - RNA, 14 nt, Homo sapiens
cugucugcccugaa

SEQ ID NO: 1322078 - RNA, 23 nt, Homo sapiens
cugucugcccugaacccacugcu

SEQ ID NO: 1322079 - RNA, 15 nt, Homo sapiens
cugucugugugcuga

SEQ ID NO: 1322080 - RNA, 20 nt, Homo sapiens
cugucuucccaaacccaguc

SEQ ID NO: 1322081 - RNA, 17 nt, Homo sapiens
cugucuuucagcauuca

SEQ ID NO: 1322082 - RNA, 19 nt, Homo sapiens
cugucuuugaguuguggug

SEQ ID NO: 1322083 - RNA, 19 nt, Homo sapiens
cugugaauugccuguaaca

SEQ ID NO: 1322084 - RNA, 15 nt, Homo sapiens
cugugacugauauga

SEQ ID NO: 1322085 - RNA, 19 nt, Homo sapiens
cugugagccggagcucaug

SEQ ID NO: 1322086 - RNA, 18 nt, Homo sapiens
cugugagcucaacuaagu

SEQ ID NO: 1322087 - RNA, 14 nt, Homo sapiens
cugugauaccuuag

SEQ ID NO: 1322088 - RNA, 18 nt, Homo sapiens
cugugcaaauccuugaua

SEQ ID NO: 1322089 - RNA, 14 nt, Homo sapiens
cugugcacgcagug

SEQ ID NO: 1322090 - RNA, 20 nt, Homo sapiens
cugugcccaccaugacccuc

SEQ ID NO: 1322091 - RNA, 18 nt, Homo sapiens
cugugcccucagauuccg

SEQ ID NO: 1322092 - RNA, 16 nt, Homo sapiens
cugugcgucucagugu

SEQ ID NO: 1322093 - RNA, 18 nt, Homo sapiens
cugugcuucucuaugaua

SEQ ID NO: 1322094 - RNA, 18 nt, Homo sapiens
cuguggaugauaaaacac

SEQ ID NO: 1322095 - RNA, 19 nt, Homo sapiens
cuguggcuguggagacaau

SEQ ID NO: 1322096 - RNA, 15 nt, Homo sapiens
cugugggccaaaauc

SEQ ID NO: 1322097 - RNA, 17 nt, Homo sapiens
cuguggugagccaagau

SEQ ID NO: 1322098 - RNA, 16 nt, Homo sapiens
cugugucagaaacuga

SEQ ID NO: 1322099 - RNA, 16 nt, Homo sapiens
cugugucuucuccacc

SEQ ID NO: 1322100 - RNA, 15 nt, Homo sapiens
cugugugaccuggga

SEQ ID NO: 1322101 - RNA, 23 nt, Homo sapiens
cuguguggaguggacacccugac

SEQ ID NO: 1322102 - RNA, 14 nt, Homo sapiens
cuguguguccaaaa

SEQ ID NO: 1322103 - RNA, 16 nt, Homo sapiens
cuguguguccaaaacu

SEQ ID NO: 1322104 - RNA, 18 nt, Homo sapiens
cugugugugugugugcau

SEQ ID NO: 1322105 - RNA, 19 nt, Homo sapiens
cuguguguuuuaguuucau

SEQ ID NO: 1322106 - RNA, 21 nt, Homo sapiens
cuguguuauucuuugcgugua

SEQ ID NO: 1322107 - RNA, 21 nt, Homo sapiens
cuguguugccaagcuccaagc

SEQ ID NO: 1322108 - RNA, 17 nt, Homo sapiens
cuguguugugcucagga

SEQ ID NO: 1322109 - RNA, 15 nt, Homo sapiens
cuguguuuccaucuc

SEQ ID NO: 1322110 - RNA, 15 nt, Homo sapiens
cuguuccccagagaa

SEQ ID NO: 1322111 - RNA, 16 nt, Homo sapiens
cuguucuaacauguaa

SEQ ID NO: 1322112 - RNA, 14 nt, Homo sapiens
cuguucuccagugu

SEQ ID NO: 1322113 - RNA, 16 nt, Homo sapiens
cuguucugaaaccuua

SEQ ID NO: 1322114 - RNA, 14 nt, Homo sapiens
cuguugaagucuca

SEQ ID NO: 1322115 - RNA, 13 nt, Homo sapiens
cuguugacauauu

SEQ ID NO: 1322116 - RNA, 22 nt, Homo sapiens
cuguugacuggcugugugaccu

SEQ ID NO: 1322117 - RNA, 19 nt, Homo sapiens
cuguuguugaaauugaugu

SEQ ID NO: 1322118 - RNA, 19 nt, Homo sapiens
cuguuuaauguucugugau

SEQ ID NO: 1322119 - RNA, 13 nt, Homo sapiens
cuguuuacuuuag

SEQ ID NO: 1322120 - RNA, 14 nt, Homo sapiens
cuguuuacuuuagg

SEQ ID NO: 1322121 - RNA, 21 nt, Homo sapiens
cuguuuauugaaagaauuauc

SEQ ID NO: 1322122 - RNA, 15 nt, Homo sapiens
cuguuucauagcaaa

SEQ ID NO: 1322123 - RNA, 13 nt, Homo sapiens
cuguuugcugaga

SEQ ID NO: 1322124 - RNA, 19 nt, Homo sapiens
cuguuuuuuggcuugcuua

SEQ ID NO: 1322125 - RNA, 13 nt, Homo sapiens
cuuaaaauuguau

SEQ ID NO: 1322126 - RNA, 23 nt, Homo sapiens
cuuaaaccgccaaggcuggggga

SEQ ID NO: 1322127 - RNA, 16 nt, Homo sapiens
cuuaaaccuaccuccc

SEQ ID NO: 1322128 - RNA, 14 nt, Homo sapiens
cuuaaauaugugaa

SEQ ID NO: 1322129 - RNA, 23 nt, Homo sapiens
cuuaaauguuuaauaaacacuga

SEQ ID NO: 1322130 - RNA, 17 nt, Homo sapiens
cuuaacaaauacauuca

SEQ ID NO: 1322131 - RNA, 16 nt, Homo sapiens
cuuaauacuaccuuga

SEQ ID NO: 1322132 - RNA, 18 nt, Homo sapiens
cuuaauacuaccuugaaa

SEQ ID NO: 1322133 - RNA, 21 nt, Homo sapiens
cuuaauauaaauucacuuuca

SEQ ID NO: 1322134 - RNA, 22 nt, Homo sapiens
cuuaauauaaauucacuuucau

SEQ ID NO: 1322135 - RNA, 20 nt, Homo sapiens
cuuaaugaaugaaugaauuc

SEQ ID NO: 1322136 - RNA, 19 nt, Homo sapiens
cuuacagaauggaucaugu

SEQ ID NO: 1322137 - RNA, 18 nt, Homo sapiens
cuuaccuaccacaugcca

SEQ ID NO: 1322138 - RNA, 19 nt, Homo sapiens
cuuaccuucauaugcagua

SEQ ID NO: 1322139 - RNA, 20 nt, Homo sapiens
cuuagaacauuuuaauucau

SEQ ID NO: 1322140 - RNA, 15 nt, Homo sapiens
cuuagccaugaucug

SEQ ID NO: 1322141 - RNA, 21 nt, Homo sapiens
cuuagccauuuuucaaagcaa

SEQ ID NO: 1322142 - RNA, 14 nt, Homo sapiens
cuuagcuucaggaa

SEQ ID NO: 1322143 - RNA, 20 nt, Homo sapiens
cuuaggaaggccuucaggag

SEQ ID NO: 1322144 - RNA, 17 nt, Homo sapiens
cuuagguuggcaaaaag

SEQ ID NO: 1322145 - RNA, 18 nt, Homo sapiens
cuuagugauaaaacuggg

SEQ ID NO: 1322146 - RNA, 16 nt, Homo sapiens
cuuauacuguacaaua

SEQ ID NO: 1322147 - RNA, 18 nt, Homo sapiens
cuuauggaauugauuugc

SEQ ID NO: 1322148 - RNA, 23 nt, Homo sapiens
cuuauguguaggugaacagucac

SEQ ID NO: 1322149 - RNA, 23 nt, Homo sapiens
cuuauguuacagguuacgugaga

SEQ ID NO: 1322150 - RNA, 22 nt, Homo sapiens
cuuauuaaaaccuuaguguccu

SEQ ID NO: 1322151 - RNA, 21 nt, Homo sapiens
cuuauuaacaauuaggcagac

SEQ ID NO: 1322152 - RNA, 20 nt, Homo sapiens
cuuauuaauacaaacacaaa

SEQ ID NO: 1322153 - RNA, 14 nt, Homo sapiens
cuuauuacccaaac

SEQ ID NO: 1322154 - RNA, 14 nt, Homo sapiens
cuuauugcuguuuc

SEQ ID NO: 1322155 - RNA, 14 nt, Homo sapiens
cuuauuguaccucu

SEQ ID NO: 1322156 - RNA, 19 nt, Homo sapiens
cuucaaagaggaaccagga

SEQ ID NO: 1322157 - RNA, 23 nt, Homo sapiens
cuucaacuccucgacaucacugu

SEQ ID NO: 1322158 - RNA, 17 nt, Homo sapiens
cuucaagaaauuacugg

SEQ ID NO: 1322159 - RNA, 21 nt, Homo sapiens
cuucaagacgacagcucugua

SEQ ID NO: 1322160 - RNA, 19 nt, Homo sapiens
cuucaauaaccaugaugac

SEQ ID NO: 1322161 - RNA, 22 nt, Homo sapiens
cuucaauguauugagcauguga

SEQ ID NO: 1322162 - RNA, 17 nt, Homo sapiens
cuucaauuguauuauau

SEQ ID NO: 1322163 - RNA, 18 nt, Homo sapiens
cuucacagcccugcagug

SEQ ID NO: 1322164 - RNA, 14 nt, Homo sapiens
cuucaccucuucca

SEQ ID NO: 1322165 - RNA, 19 nt, Homo sapiens
cuucacucuucaaaugccu

SEQ ID NO: 1322166 - RNA, 12 nt, Homo sapiens
cuucagacaccc

SEQ ID NO: 1322167 - RNA, 21 nt, Homo sapiens
cuucagagcugacacaggaug

SEQ ID NO: 1322168 - RNA, 21 nt, Homo sapiens
cuucagcucuucuugacauca

SEQ ID NO: 1322169 - RNA, 20 nt, Homo sapiens
cuucaggaauguggcugcaa

SEQ ID NO: 1322170 - RNA, 21 nt, Homo sapiens
cuucaguauguugucaaagag

SEQ ID NO: 1322171 - RNA, 21 nt, Homo sapiens
cuucaugaucaucacaaucau

SEQ ID NO: 1322172 - RNA, 20 nt, Homo sapiens
cuucauucuccuuguuguug

SEQ ID NO: 1322173 - RNA, 14 nt, Homo sapiens
cuucauucugcaag

SEQ ID NO: 1322174 - RNA, 20 nt, Homo sapiens
cuucauuucauguauaguuu

SEQ ID NO: 1322175 - RNA, 19 nt, Homo sapiens
cuucauuuuuguaauaaca

SEQ ID NO: 1322176 - RNA, 17 nt, Homo sapiens
cuuccagccuaggccug

SEQ ID NO: 1322177 - RNA, 22 nt, Homo sapiens
cuuccauuguuuaaaaauacac

SEQ ID NO: 1322178 - RNA, 12 nt, Homo sapiens
cuuccauuugcu

SEQ ID NO: 1322179 - RNA, 13 nt, Homo sapiens
cuuccccacagaa

SEQ ID NO: 1322180 - RNA, 16 nt, Homo sapiens
cuucccucuucccuca

SEQ ID NO: 1322181 - RNA, 12 nt, Homo sapiens
cuuccuacccug

SEQ ID NO: 1322182 - RNA, 18 nt, Homo sapiens
cuuccuagauaugauaaa

SEQ ID NO: 1322183 - RNA, 12 nt, Homo sapiens
cuuccuagguca

SEQ ID NO: 1322184 - RNA, 14 nt, Homo sapiens
cuuccucacaccag

SEQ ID NO: 1322185 - RNA, 23 nt, Homo sapiens
cuuccucgagaccauacagccag

SEQ ID NO: 1322186 - RNA, 20 nt, Homo sapiens
cuuccuggcuccaacacugc

SEQ ID NO: 1322187 - RNA, 23 nt, Homo sapiens
cuuccugguugagcuucugcuaa

SEQ ID NO: 1322188 - RNA, 19 nt, Homo sapiens
cuuccuugaagaacugcag

SEQ ID NO: 1322189 - RNA, 21 nt, Homo sapiens
cuucgaccacaucagaaagaa

SEQ ID NO: 1322190 - RNA, 19 nt, Homo sapiens
cuucgaccuacugaaaagg

SEQ ID NO: 1322191 - RNA, 21 nt, Homo sapiens
cuucguguucuguauucugac

SEQ ID NO: 1322192 - RNA, 16 nt, Homo sapiens
cuucuaaacacaaaua

SEQ ID NO: 1322193 - RNA, 21 nt, Homo sapiens
cuucuaaacccaauccaaaug

SEQ ID NO: 1322194 - RNA, 20 nt, Homo sapiens
cuucuaaccugaacugaugg

SEQ ID NO: 1322195 - RNA, 19 nt, Homo sapiens
cuucuagagcuuagcauau

SEQ ID NO: 1322196 - RNA, 20 nt, Homo sapiens
cuucuauucagcauuguacu

SEQ ID NO: 1322197 - RNA, 19 nt, Homo sapiens
cuucucaaagcugggauua

SEQ ID NO: 1322198 - RNA, 22 nt, Homo sapiens
cuucucccgauggccacugggu

SEQ ID NO: 1322199 - RNA, 17 nt, Homo sapiens
cuucucucacuguguua

SEQ ID NO: 1322200 - RNA, 23 nt, Homo sapiens
cuucucuucccugcgccugugau

SEQ ID NO: 1322201 - RNA, 16 nt, Homo sapiens
cuucucuuccuuggga

SEQ ID NO: 1322202 - RNA, 16 nt, Homo sapiens
cuucugcccuugccaa

SEQ ID NO: 1322203 - RNA, 15 nt, Homo sapiens
cuucugcucagcucu

SEQ ID NO: 1322204 - RNA, 18 nt, Homo sapiens
cuucuguuugcacaccca

SEQ ID NO: 1322205 - RNA, 16 nt, Homo sapiens
cuucuucccagcacua

SEQ ID NO: 1322206 - RNA, 12 nt, Homo sapiens
cuucuucuaguu

SEQ ID NO: 1322207 - RNA, 18 nt, Homo sapiens
cuucuugacaucaaggcu

SEQ ID NO: 1322208 - RNA, 20 nt, Homo sapiens
cuucuugccucugugcugug

SEQ ID NO: 1322209 - RNA, 19 nt, Homo sapiens
cuucuuguucugagauuca

SEQ ID NO: 1322210 - RNA, 16 nt, Homo sapiens
cuucuuucccaaaauu

SEQ ID NO: 1322211 - RNA, 23 nt, Homo sapiens
cuugaaaagcuaguguaccuccu

SEQ ID NO: 1322212 - RNA, 21 nt, Homo sapiens
cuugaaauucucaucagucca

SEQ ID NO: 1322213 - RNA, 16 nt, Homo sapiens
cuugaagagaaaaaag

SEQ ID NO: 1322214 - RNA, 23 nt, Homo sapiens
cuugaauacucugcccucuagag

SEQ ID NO: 1322215 - RNA, 14 nt, Homo sapiens
cuugacaacaucug

SEQ ID NO: 1322216 - RNA, 17 nt, Homo sapiens
cuugacauuuaaacuca

SEQ ID NO: 1322217 - RNA, 20 nt, Homo sapiens
cuugaccucaggugauccac

SEQ ID NO: 1322218 - RNA, 18 nt, Homo sapiens
cuugaggaaaacaagcau

SEQ ID NO: 1322219 - RNA, 16 nt, Homo sapiens
cuugaggcaacucauc

SEQ ID NO: 1322220 - RNA, 20 nt, Homo sapiens
cuugagggugcuuguucccu

SEQ ID NO: 1322221 - RNA, 21 nt, Homo sapiens
cuugauaagaccaccaccuca

SEQ ID NO: 1322222 - RNA, 22 nt, Homo sapiens
cuugaucaacaucuuuucuugc

SEQ ID NO: 1322223 - RNA, 10 nt, Homo sapiens
cuugauggag

SEQ ID NO: 1322224 - RNA, 14 nt, Homo sapiens
cuugccugcaggca

SEQ ID NO: 1322225 - RNA, 21 nt, Homo sapiens
cuugcgauucugcagccacaa

SEQ ID NO: 1322226 - RNA, 18 nt, Homo sapiens
cuugcucacagcugugcu

SEQ ID NO: 1322227 - RNA, 18 nt, Homo sapiens
cuugcucagguacuugua

SEQ ID NO: 1322228 - RNA, 18 nt, Homo sapiens
cuugcucauaugcaugua

SEQ ID NO: 1322229 - RNA, 21 nt, Homo sapiens
cuugcuccacagggcccuguu

SEQ ID NO: 1322230 - RNA, 13 nt, Homo sapiens
cuugcugccugaa

SEQ ID NO: 1322231 - RNA, 12 nt, Homo sapiens
cuugcugugagc

SEQ ID NO: 1322232 - RNA, 21 nt, Homo sapiens
cuugcuuccccuuuugccaau

SEQ ID NO: 1322233 - RNA, 15 nt, Homo sapiens
cuuggacucaugagg

SEQ ID NO: 1322234 - RNA, 21 nt, Homo sapiens
cuuggaggccagccagugacc

SEQ ID NO: 1322235 - RNA, 16 nt, Homo sapiens
cuuggaugcccugugg

SEQ ID NO: 1322236 - RNA, 20 nt, Homo sapiens
cuuggcaccagacacccagg

SEQ ID NO: 1322237 - RNA, 17 nt, Homo sapiens
cuuggcuacacagggau

SEQ ID NO: 1322238 - RNA, 22 nt, Homo sapiens
cuuggcugcaggaaucuuuaaa

SEQ ID NO: 1322239 - RNA, 10 nt, Homo sapiens
cuuggcugug

SEQ ID NO: 1322240 - RNA, 17 nt, Homo sapiens
cuugguuuucccuuugc

SEQ ID NO: 1322241 - RNA, 15 nt, Homo sapiens
gaaauguacuuucug

SEQ ID NO: 1322242 - RNA, 17 nt, Homo sapiens
gaaaugugcaaccacug

SEQ ID NO: 1322243 - RNA, 22 nt, Homo sapiens
ugggaauauuugaaucuugucu

SEQ ID NO: 1322244 - RNA, 17 nt, Homo sapiens
ugggaaugagaaugaau

SEQ ID NO: 1322245 - RNA, 17 nt, Homo sapiens
ugggaauuaagcaaaau

SEQ ID NO: 1322246 - RNA, 16 nt, Homo sapiens
ugggacaaaggacauu

SEQ ID NO: 1322247 - RNA, 15 nt, Homo sapiens
ugggacguggcucag

SEQ ID NO: 1322248 - RNA, 20 nt, Homo sapiens
ugggagauucaagggaccca

SEQ ID NO: 1322249 - RNA, 16 nt, Homo sapiens
ugggaggccaaggugg

SEQ ID NO: 1322250 - RNA, 15 nt, Homo sapiens
ugggaggccagugag

SEQ ID NO: 1322251 - RNA, 18 nt, Homo sapiens
ugggagguugugggcauu

SEQ ID NO: 1322252 - RNA, 15 nt, Homo sapiens
ugggagucacacagu

SEQ ID NO: 1322253 - RNA, 20 nt, Homo sapiens
ugggauccuaagggcucacc

SEQ ID NO: 1322254 - RNA, 22 nt, Homo sapiens
ugggaucguccuggauucacug

SEQ ID NO: 1322255 - RNA, 17 nt, Homo sapiens
ugggaugagagggccca

SEQ ID NO: 1322256 - RNA, 14 nt, Homo sapiens
ugggauguacuguu

SEQ ID NO: 1322257 - RNA, 22 nt, Homo sapiens
ugggcagggucuguuuggacug

SEQ ID NO: 1322258 - RNA, 16 nt, Homo sapiens
ugggccagacaugcca

SEQ ID NO: 1322259 - RNA, 22 nt, Homo sapiens
ugggcccagccccugccagcuu

SEQ ID NO: 1322260 - RNA, 16 nt, Homo sapiens
ugggcccuuugagugc

SEQ ID NO: 1322261 - RNA, 22 nt, Homo sapiens
ugggcuaggguggucagaggaa

SEQ ID NO: 1322262 - RNA, 21 nt, Homo sapiens
ugggcuggaggcugagcugca

SEQ ID NO: 1322263 - RNA, 22 nt, Homo sapiens
ugggcuggaggcugagcugcau

SEQ ID NO: 1322264 - RNA, 19 nt, Homo sapiens
ugggcuggugucaccugaa

SEQ ID NO: 1322265 - RNA, 16 nt, Homo sapiens
ugggcugugggcugca

SEQ ID NO: 1322266 - RNA, 15 nt, Homo sapiens
uggggaaaacuugca

SEQ ID NO: 1322267 - RNA, 21 nt, Homo sapiens
uggggaaaagugaauuucaca

SEQ ID NO: 1322268 - RNA, 21 nt, Homo sapiens
uggggaaauaaaucuagcaaa

SEQ ID NO: 1322269 - RNA, 20 nt, Homo sapiens
uggggcagcuugaggguugg

SEQ ID NO: 1322270 - RNA, 14 nt, Homo sapiens
uggggccagaucca

SEQ ID NO: 1322271 - RNA, 23 nt, Homo sapiens
uggggcccugugcgucucagugu

SEQ ID NO: 1322272 - RNA, 17 nt, Homo sapiens
uggggccuugaugacug

SEQ ID NO: 1322273 - RNA, 22 nt, Homo sapiens
uggggcuggccucccaaaugag

SEQ ID NO: 1322274 - RNA, 23 nt, Homo sapiens
ugggggaagaccuggcaaggaca

SEQ ID NO: 1322275 - RNA, 15 nt, Homo sapiens
ugggggagaagcaag

SEQ ID NO: 1322276 - RNA, 18 nt, Homo sapiens
ugggguacccacugcucu

SEQ ID NO: 1322277 - RNA, 14 nt, Homo sapiens
ugggguccagggag

SEQ ID NO: 1322278 - RNA, 17 nt, Homo sapiens
ugggguggccaccagua

SEQ ID NO: 1322279 - RNA, 18 nt, Homo sapiens
uggguacuuguggacaca

SEQ ID NO: 1322280 - RNA, 23 nt, Homo sapiens
uggguauguuaaccuaggcagug

SEQ ID NO: 1322281 - RNA, 19 nt, Homo sapiens
ugggucagagcuaaacucc

SEQ ID NO: 1322282 - RNA, 20 nt, Homo sapiens
ugggugaauaauacaguauc

SEQ ID NO: 1322283 - RNA, 20 nt, Homo sapiens
ugggugacagagcaagugag

SEQ ID NO: 1322284 - RNA, 19 nt, Homo sapiens
ugggugagaacaaccaaaa

SEQ ID NO: 1322285 - RNA, 22 nt, Homo sapiens
uggguugcagacaggaaucuua

SEQ ID NO: 1322286 - RNA, 23 nt, Homo sapiens
uggguugcaggaccucaggugag

SEQ ID NO: 1322287 - RNA, 18 nt, Homo sapiens
ugguaaauucacaaauac

SEQ ID NO: 1322288 - RNA, 20 nt, Homo sapiens
ugguaagaccucugagacca

SEQ ID NO: 1322289 - RNA, 18 nt, Homo sapiens
ugguaccuauuugacuua

SEQ ID NO: 1322290 - RNA, 12 nt, Homo sapiens
ugguaugaaggu

SEQ ID NO: 1322291 - RNA, 12 nt, Homo sapiens
ugguaugaucac

SEQ ID NO: 1322292 - RNA, 13 nt, Homo sapiens
ugguaugaugcug

SEQ ID NO: 1322293 - RNA, 13 nt, Homo sapiens
ugguauggccuua

SEQ ID NO: 1322294 - RNA, 15 nt, Homo sapiens
ugguauuuuuuacug

SEQ ID NO: 1322295 - RNA, 22 nt, Homo sapiens
uggucaaacaaacucucugaac

SEQ ID NO: 1322296 - RNA, 15 nt, Homo sapiens
uggucacacacugau

SEQ ID NO: 1322297 - RNA, 14 nt, Homo sapiens
uggucacauacaau

SEQ ID NO: 1322298 - RNA, 20 nt, Homo sapiens
uggucagugguggucuucaa

SEQ ID NO: 1322299 - RNA, 21 nt, Homo sapiens
uggucccggggccagcacuuc

SEQ ID NO: 1322300 - RNA, 13 nt, Homo sapiens
uggucuccucuca

SEQ ID NO: 1322301 - RNA, 22 nt, Homo sapiens
uggucugcaggcagggcugacu

SEQ ID NO: 1322302 - RNA, 13 nt, Homo sapiens
uggucuggccacu

SEQ ID NO: 1322303 - RNA, 17 nt, Homo sapiens
uggugaauaauuggaag

SEQ ID NO: 1322304 - RNA, 19 nt, Homo sapiens
uggugaauugggauuugca

SEQ ID NO: 1322305 - RNA, 14 nt, Homo sapiens
uggugacuucacag

SEQ ID NO: 1322306 - RNA, 20 nt, Homo sapiens
uggugacuucacagugaagu

SEQ ID NO: 1322307 - RNA, 15 nt, Homo sapiens
ugguggagggccaca

SEQ ID NO: 1322308 - RNA, 19 nt, Homo sapiens
uggugggggugcagaugag

SEQ ID NO: 1322309 - RNA, 16 nt, Homo sapiens
ugguggucuuacugag

SEQ ID NO: 1322310 - RNA, 16 nt, Homo sapiens
ugguguggguguccug

SEQ ID NO: 1322311 - RNA, 13 nt, Homo sapiens
ugguuaacgccuu

SEQ ID NO: 1322312 - RNA, 17 nt, Homo sapiens
ugguucauuaauucuau

SEQ ID NO: 1322313 - RNA, 20 nt, Homo sapiens
ugguucugaugaugugccug

SEQ ID NO: 1322314 - RNA, 14 nt, Homo sapiens
ugguucugugccaa

SEQ ID NO: 1322315 - RNA, 17 nt, Homo sapiens
ugguucuuagaccucaa

SEQ ID NO: 1322316 - RNA, 20 nt, Homo sapiens
ugguugguuuugacuucaga

SEQ ID NO: 1322317 - RNA, 13 nt, Homo sapiens
uguaaaagcacau

SEQ ID NO: 1322318 - RNA, 17 nt, Homo sapiens
uguaaaggcaagccagc

SEQ ID NO: 1322319 - RNA, 19 nt, Homo sapiens
uguaaaguugguuggauaa

SEQ ID NO: 1322320 - RNA, 18 nt, Homo sapiens
uguaaaugacucuacuaa

SEQ ID NO: 1322321 - RNA, 16 nt, Homo sapiens
uguaacacugcaagaa

SEQ ID NO: 1322322 - RNA, 14 nt, Homo sapiens
uguaagaaacacac

SEQ ID NO: 1322323 - RNA, 16 nt, Homo sapiens
uguaagcauacuuugu

SEQ ID NO: 1322324 - RNA, 15 nt, Homo sapiens
uguaagccuucaaag

SEQ ID NO: 1322325 - RNA, 17 nt, Homo sapiens
uguaaggaaggugcuca

SEQ ID NO: 1322326 - RNA, 15 nt, Homo sapiens
uguaaguuucauucc

SEQ ID NO: 1322327 - RNA, 20 nt, Homo sapiens
uguaaucccagcauuuuggg

SEQ ID NO: 1322328 - RNA, 19 nt, Homo sapiens
uguaaucccagcuacuugg

SEQ ID NO: 1322329 - RNA, 20 nt, Homo sapiens
uguaauggagcaucaagcca

SEQ ID NO: 1322330 - RNA, 18 nt, Homo sapiens
uguaauuuuacacaaaua

SEQ ID NO: 1322331 - RNA, 14 nt, Homo sapiens
uguacaaguugaaa

SEQ ID NO: 1322332 - RNA, 20 nt, Homo sapiens
uguacaaguugaaauaugcu

SEQ ID NO: 1322333 - RNA, 23 nt, Homo sapiens
uguacaauaaaaacauugccuuu

SEQ ID NO: 1322334 - RNA, 22 nt, Homo sapiens
uguacaccagagccucagugag

SEQ ID NO: 1322335 - RNA, 15 nt, Homo sapiens
uguaccugugcacgu

SEQ ID NO: 1322336 - RNA, 16 nt, Homo sapiens
uguacuguaugugaug

SEQ ID NO: 1322337 - RNA, 15 nt, Homo sapiens
uguacuugccuuauu

SEQ ID NO: 1322338 - RNA, 20 nt, Homo sapiens
uguagagauggggucucaca

SEQ ID NO: 1322339 - RNA, 10 nt, Homo sapiens
uguagagugg

SEQ ID NO: 1322340 - RNA, 17 nt, Homo sapiens
uguagauaaacucagaa

SEQ ID NO: 1322341 - RNA, 19 nt, Homo sapiens
uguagauaaacucagaaau

SEQ ID NO: 1322342 - RNA, 17 nt, Homo sapiens
uguagauucacauacag

SEQ ID NO: 1322343 - RNA, 16 nt, Homo sapiens
uguagcugugcuuuga

SEQ ID NO: 1322344 - RNA, 14 nt, Homo sapiens
uguaguaauugaca

SEQ ID NO: 1322345 - RNA, 16 nt, Homo sapiens
uguaguccgugcugac

SEQ ID NO: 1322346 - RNA, 15 nt, Homo sapiens
uguaucaaaugugac

SEQ ID NO: 1322347 - RNA, 16 nt, Homo sapiens
uguaucuuauucacau

SEQ ID NO: 1322348 - RNA, 20 nt, Homo sapiens
uguauggagagaaaacagac

SEQ ID NO: 1322349 - RNA, 17 nt, Homo sapiens
uguauguuuacguccuu

SEQ ID NO: 1322350 - RNA, 23 nt, Homo sapiens
uguauuuuauuacaucuuucaca

SEQ ID NO: 1322351 - RNA, 18 nt, Homo sapiens
uguauuuuuuguuuguau

SEQ ID NO: 1322352 - RNA, 18 nt, Homo sapiens
ugucaaaaugagauucca

SEQ ID NO: 1322353 - RNA, 17 nt, Homo sapiens
ugucaaacaaagccaga

SEQ ID NO: 1322354 - RNA, 18 nt, Homo sapiens
gucuacucagcauuugau

SEQ ID NO: 1322355 - RNA, 21 nt, Homo sapiens
gucuacuugcucagguacuug

SEQ ID NO: 1322356 - RNA, 22 nt, Homo sapiens
gucuauacaaaggcuugcuaag

SEQ ID NO: 1322357 - RNA, 11 nt, Homo sapiens
gucuauuccau

SEQ ID NO: 1322358 - RNA, 20 nt, Homo sapiens
gucucacgucucccuaaaaa

SEQ ID NO: 1322359 - RNA, 16 nt, Homo sapiens
gucucagucauaauca

SEQ ID NO: 1322360 - RNA, 13 nt, Homo sapiens
gucucccuaaaaa

SEQ ID NO: 1322361 - RNA, 13 nt, Homo sapiens
gucuccucuccau

SEQ ID NO: 1322362 - RNA, 17 nt, Homo sapiens
gucucggggcuugcccc

SEQ ID NO: 1322363 - RNA, 14 nt, Homo sapiens
gucucuacuaaaaa

SEQ ID NO: 1322364 - RNA, 21 nt, Homo sapiens
gucucucuugucaagucagaa

SEQ ID NO: 1322365 - RNA, 17 nt, Homo sapiens
gucucuucuaagcaaaa

SEQ ID NO: 1322366 - RNA, 22 nt, Homo sapiens
gucucuuguaauccgaaucucu

SEQ ID NO: 1322367 - RNA, 19 nt, Homo sapiens
gucugaaugucacugacag

SEQ ID NO: 1322368 - RNA, 14 nt, Homo sapiens
gucugagaccacuu

SEQ ID NO: 1322369 - RNA, 15 nt, Homo sapiens
gucuggcaucuccca

SEQ ID NO: 1322370 - RNA, 22 nt, Homo sapiens
gucuguccuugggaugcucucu

SEQ ID NO: 1322371 - RNA, 14 nt, Homo sapiens
gucugugugcugag

SEQ ID NO: 1322372 - RNA, 18 nt, Homo sapiens
gucugugugugugugugc

SEQ ID NO: 1322373 - RNA, 11 nt, Homo sapiens
gucuguuggca

SEQ ID NO: 1322374 - RNA, 19 nt, Homo sapiens
gucuguuuggacugcagaa

SEQ ID NO: 1322375 - RNA, 12 nt, Homo sapiens
gucuugaacucc

SEQ ID NO: 1322376 - RNA, 16 nt, Homo sapiens
gucuugccagccagaa

SEQ ID NO: 1322377 - RNA, 15 nt, Homo sapiens
gucuuuaacugucaa

SEQ ID NO: 1322378 - RNA, 16 nt, Homo sapiens
gucuuuacuccucaca

SEQ ID NO: 1322379 - RNA, 21 nt, Homo sapiens
gucuuuagacucaaaugcuua

SEQ ID NO: 1322380 - RNA, 22 nt, Homo sapiens
gucuuuagggguugggcuggau

SEQ ID NO: 1322381 - RNA, 16 nt, Homo sapiens
gucuuucuaacugaau

SEQ ID NO: 1322382 - RNA, 14 nt, Homo sapiens
gucuuucuauccug

SEQ ID NO: 1322383 - RNA, 13 nt, Homo sapiens
gucuuugcugcag

SEQ ID NO: 1322384 - RNA, 21 nt, Homo sapiens
gucuuuuuuucccuaccauuc

SEQ ID NO: 1322385 - RNA, 15 nt, Homo sapiens
gugaaacucaucuca

SEQ ID NO: 1322386 - RNA, 12 nt, Homo sapiens
gugaaaugaagc

SEQ ID NO: 1322387 - RNA, 20 nt, Homo sapiens
gugaacagcuugcugucacu

SEQ ID NO: 1322388 - RNA, 23 nt, Homo sapiens
gugaaccaccacacccagcccac

SEQ ID NO: 1322389 - RNA, 14 nt, Homo sapiens
gugaacuaaccaaa

SEQ ID NO: 1322390 - RNA, 18 nt, Homo sapiens
gugaagagauacagccuu

SEQ ID NO: 1322391 - RNA, 15 nt, Homo sapiens
gugaagcaccaagcu

SEQ ID NO: 1322392 - RNA, 23 nt, Homo sapiens
gugaagcauucgagacagaaccu

SEQ ID NO: 1322393 - RNA, 17 nt, Homo sapiens
gugaagccaaagggacu

SEQ ID NO: 1322394 - RNA, 11 nt, Homo sapiens
gugaaggaaua

SEQ ID NO: 1322395 - RNA, 23 nt, Homo sapiens
gugaauaaaccaucaucuugcca

SEQ ID NO: 1322396 - RNA, 15 nt, Homo sapiens
gugaaucagucccau

SEQ ID NO: 1322397 - RNA, 23 nt, Homo sapiens
gugacaagaauuguuaccuguca

SEQ ID NO: 1322398 - RNA, 19 nt, Homo sapiens
gugacauuuauuuuucuca

SEQ ID NO: 1322399 - RNA, 19 nt, Homo sapiens
gugaccuggaaucagugaa

SEQ ID NO: 1322400 - RNA, 19 nt, Homo sapiens
gugacuaauggcaugagaa

SEQ ID NO: 1322401 - RNA, 17 nt, Homo sapiens
gugacuucacagugaag

SEQ ID NO: 1322402 - RNA, 12 nt, Homo sapiens
gugagacccagc

SEQ ID NO: 1322403 - RNA, 17 nt, Homo sapiens
guucuuuaaaauguaaa

SEQ ID NO: 1322404 - RNA, 14 nt, Homo sapiens
guucuuugggccag

SEQ ID NO: 1322405 - RNA, 15 nt, Homo sapiens
guucuuugggccaga

SEQ ID NO: 1322406 - RNA, 16 nt, Homo sapiens
guucuuugggccagac

SEQ ID NO: 1322407 - RNA, 21 nt, Homo sapiens
guucuuuugacugaagucuga

SEQ ID NO: 1322408 - RNA, 15 nt, Homo sapiens
guugacaauucugca

SEQ ID NO: 1322409 - RNA, 16 nt, Homo sapiens
guugagcuauugcugu

SEQ ID NO: 1322410 - RNA, 13 nt, Homo sapiens
guugaucuuuuaa

SEQ ID NO: 1322411 - RNA, 16 nt, Homo sapiens
guugauguggacauga

SEQ ID NO: 1322412 - RNA, 18 nt, Homo sapiens
guugauguuggcugggaa

SEQ ID NO: 1322413 - RNA, 18 nt, Homo sapiens
guugauuacagugcagug

SEQ ID NO: 1322414 - RNA, 17 nt, Homo sapiens
guugcacggcugcugag

SEQ ID NO: 1322415 - RNA, 13 nt, Homo sapiens
guugccauuauuc

SEQ ID NO: 1322416 - RNA, 12 nt, Homo sapiens
guugcuauaaua

SEQ ID NO: 1322417 - RNA, 14 nt, Homo sapiens
guugcuguuucaca

SEQ ID NO: 1322418 - RNA, 22 nt, Homo sapiens
guuggaaaugugcaaccacugc

SEQ ID NO: 1322419 - RNA, 23 nt, Homo sapiens
guuggcaugguaguauacaaaaa

SEQ ID NO: 1322420 - RNA, 22 nt, Homo sapiens
guuggcgggggcuuggcugugc

SEQ ID NO: 1322421 - RNA, 16 nt, Homo sapiens
guuggugaauuucaca

SEQ ID NO: 1322422 - RNA, 19 nt, Homo sapiens
guugguucuuagaccucaa

SEQ ID NO: 1322423 - RNA, 15 nt, Homo sapiens
guugguuuaaugcaa

SEQ ID NO: 1322424 - RNA, 21 nt, Homo sapiens
guuguauuguggaacacugaa

SEQ ID NO: 1322425 - RNA, 14 nt, Homo sapiens
guugucaggccaua

SEQ ID NO: 1322426 - RNA, 22 nt, Homo sapiens
guugucuuuuaaaaagugugcu

SEQ ID NO: 1322427 - RNA, 22 nt, Homo sapiens
guuguugauguuuuaacucuau

SEQ ID NO: 1322428 - RNA, 18 nt, Homo sapiens
guuguuuuauauguugcu

SEQ ID NO: 1322429 - RNA, 15 nt, Homo sapiens
guuuaaaacagaagc

SEQ ID NO: 1322430 - RNA, 13 nt, Homo sapiens
guuuaaugcaaua

SEQ ID NO: 1322431 - RNA, 14 nt, Homo sapiens
guuuacaaauggac

SEQ ID NO: 1322432 - RNA, 13 nt, Homo sapiens
guuuacagaauuu

SEQ ID NO: 1322433 - RNA, 17 nt, Homo sapiens
guuuacagugucugugu

SEQ ID NO: 1322434 - RNA, 15 nt, Homo sapiens
guuuacguccuuugg

SEQ ID NO: 1322435 - RNA, 17 nt, Homo sapiens
guuuaggaauccuuugg

SEQ ID NO: 1322436 - RNA, 19 nt, Homo sapiens
guuucaaaauaaaaaccaa

SEQ ID NO: 1322437 - RNA, 20 nt, Homo sapiens
guuucaaguacuguaacugu

SEQ ID NO: 1322438 - RNA, 14 nt, Homo sapiens
guuucaccaugaug

SEQ ID NO: 1322439 - RNA, 12 nt, Homo sapiens
guuuccugaaac

SEQ ID NO: 1322440 - RNA, 13 nt, Homo sapiens
guuuccuggucag

SEQ ID NO: 1322441 - RNA, 17 nt, Homo sapiens
guuucuccagagggaau

SEQ ID NO: 1322442 - RNA, 14 nt, Homo sapiens
guuucugcuucauu

SEQ ID NO: 1322443 - RNA, 22 nt, Homo sapiens
guuugaaauucugaauuugcaa

SEQ ID NO: 1322444 - RNA, 17 nt, Homo sapiens
guuugaagacuacauga

SEQ ID NO: 1322445 - RNA, 21 nt, Homo sapiens
guuugacuuauugcuguuuca

SEQ ID NO: 1322446 - RNA, 18 nt, Homo sapiens
guuugauuugcuuuugaa

SEQ ID NO: 1322447 - RNA, 21 nt, Homo sapiens
guuuggacccaguucagugag

SEQ ID NO: 1322448 - RNA, 19 nt, Homo sapiens
guuuggagguccuagguca

SEQ ID NO: 1322449 - RNA, 22 nt, Homo sapiens
guuugggaauauccauguacuu

SEQ ID NO: 1322450 - RNA, 22 nt, Homo sapiens
guuugggaucccugucuuuccu

SEQ ID NO: 1322451 - RNA, 19 nt, Homo sapiens
guuuguguguugucucuug

SEQ ID NO: 1322452 - RNA, 11 nt, Homo sapiens
guuuguuaaaa

SEQ ID NO: 1322453 - RNA, 20 nt, Homo sapiens
guuuuaaagcuugcucacau

SEQ ID NO: 1322454 - RNA, 15 nt, Homo sapiens
guuuucagcuuuaag

SEQ ID NO: 1322455 - RNA, 17 nt, Homo sapiens
guuuucaucaagacugg

SEQ ID NO: 1322456 - RNA, 20 nt, Homo sapiens
guuuucucucuccgauuuug

SEQ ID NO: 1322457 - RNA, 20 nt, Homo sapiens
uaacagcugguauggccuua

SEQ ID NO: 1322458 - RNA, 18 nt, Homo sapiens
uaacaggauauuuaauga

SEQ ID NO: 1322459 - RNA, 16 nt, Homo sapiens
uaacaggcagauacag

SEQ ID NO: 1322460 - RNA, 20 nt, Homo sapiens
uaacagggagacugcaucuc

SEQ ID NO: 1322461 - RNA, 22 nt, Homo sapiens
uaacauccacaaagagauuauu

SEQ ID NO: 1322462 - RNA, 15 nt, Homo sapiens
uaacauucccacugc

SEQ ID NO: 1322463 - RNA, 23 nt, Homo sapiens
uaacauuuguguaauaugaaaua

SEQ ID NO: 1322464 - RNA, 12 nt, Homo sapiens
uaaccaguauuu

SEQ ID NO: 1322465 - RNA, 20 nt, Homo sapiens
uaaccucuaccagcacauua

SEQ ID NO: 1322466 - RNA, 16 nt, Homo sapiens
uaaccucuucaccuua

SEQ ID NO: 1322467 - RNA, 22 nt, Homo sapiens
uaaccugcaaaaucuguucuaa

SEQ ID NO: 1322468 - RNA, 18 nt, Homo sapiens
uaaccuuauacuacuaaa

SEQ ID NO: 1322469 - RNA, 12 nt, Homo sapiens
uaacuagauggu

SEQ ID NO: 1322470 - RNA, 16 nt, Homo sapiens
uaacucccuuuuuaca

SEQ ID NO: 1322471 - RNA, 12 nt, Homo sapiens
uaacucuagaau

SEQ ID NO: 1322472 - RNA, 14 nt, Homo sapiens
uaacucuagaauuu

SEQ ID NO: 1322473 - RNA, 18 nt, Homo sapiens
uaacugaggacuguuugc

SEQ ID NO: 1322474 - RNA, 22 nt, Homo sapiens
uaacugaggacuguuugcaauu

SEQ ID NO: 1322475 - RNA, 14 nt, Homo sapiens
uaacugcauugaga

SEQ ID NO: 1322476 - RNA, 16 nt, Homo sapiens
uaacugccaauccuua

SEQ ID NO: 1322477 - RNA, 15 nt, Homo sapiens
uaacuggcaguuuuc

SEQ ID NO: 1322478 - RNA, 19 nt, Homo sapiens
uaacuguuucauagcaaac

SEQ ID NO: 1322479 - RNA, 15 nt, Homo sapiens
uaacuucugcuacua

SEQ ID NO: 1322480 - RNA, 18 nt, Homo sapiens
uaacuuggcugcauuugc

SEQ ID NO: 1322481 - RNA, 23 nt, Homo sapiens
uaagaaaaaccaaaauacuccaa

SEQ ID NO: 1322482 - RNA, 16 nt, Homo sapiens
uaagaaauuucuaguu

SEQ ID NO: 1322483 - RNA, 16 nt, Homo sapiens
uaagaagagaauuccu

SEQ ID NO: 1322484 - RNA, 16 nt, Homo sapiens
uaagaauuagacaucu

SEQ ID NO: 1322485 - RNA, 19 nt, Homo sapiens
uaagaauucaaacuggggc

SEQ ID NO: 1322486 - RNA, 12 nt, Homo sapiens
uaagaauuucac

SEQ ID NO: 1322487 - RNA, 14 nt, Homo sapiens
uaagaauuucacaa

SEQ ID NO: 1322488 - RNA, 17 nt, Homo sapiens
uaagaauuucacaagcu

SEQ ID NO: 1322489 - RNA, 21 nt, Homo sapiens
uaagaccucugagaccaaaau

SEQ ID NO: 1322490 - RNA, 19 nt, Homo sapiens
uaagacucucgcaucuucc

SEQ ID NO: 1322491 - RNA, 17 nt, Homo sapiens
uaagagcagaacagauc

SEQ ID NO: 1322492 - RNA, 19 nt, Homo sapiens
uaagagccuaacuccaucc

SEQ ID NO: 1322493 - RNA, 20 nt, Homo sapiens
uaagagggcacacacugugu

SEQ ID NO: 1322494 - RNA, 22 nt, Homo sapiens
uaagagggcacacacuguguac

SEQ ID NO: 1322495 - RNA, 16 nt, Homo sapiens
uaagagguuuguauau

SEQ ID NO: 1322496 - RNA, 17 nt, Homo sapiens
uaagauauuuaguaaua

SEQ ID NO: 1322497 - RNA, 19 nt, Homo sapiens
uaagauuccaaaaagcaca

SEQ ID NO: 1322498 - RNA, 17 nt, Homo sapiens
uaagauuuugugaauug

SEQ ID NO: 1322499 - RNA, 13 nt, Homo sapiens
uaagcaacaucua

SEQ ID NO: 1322500 - RNA, 14 nt, Homo sapiens
uaagcaucugccau

SEQ ID NO: 1322501 - RNA, 22 nt, Homo sapiens
uaagcaucuuuauaugcuugug

SEQ ID NO: 1322502 - RNA, 15 nt, Homo sapiens
uaagcugcuggaaac

SEQ ID NO: 1322503 - RNA, 19 nt, Homo sapiens
uaaggauguagcuuuucac

SEQ ID NO: 1322504 - RNA, 12 nt, Homo sapiens
uaaggccugaau

SEQ ID NO: 1322505 - RNA, 20 nt, Homo sapiens
uaaggguuaguuuacaauca

SEQ ID NO: 1322506 - RNA, 18 nt, Homo sapiens
uaagguaaaaugccauga

SEQ ID NO: 1322507 - RNA, 17 nt, Homo sapiens
uaaggucauuacucuca

SEQ ID NO: 1322508 - RNA, 19 nt, Homo sapiens
uaaguaugcaaaauguuua

SEQ ID NO: 1322509 - RNA, 23 nt, Homo sapiens
uaagucaaaaugugaaaauaaua

SEQ ID NO: 1322510 - RNA, 19 nt, Homo sapiens
uaagucagggaagagcagu

SEQ ID NO: 1322511 - RNA, 11 nt, Homo sapiens
uaagugaugcu

SEQ ID NO: 1322512 - RNA, 19 nt, Homo sapiens
uaaguggcuucucugugaa

SEQ ID NO: 1322513 - RNA, 22 nt, Homo sapiens
uaaguggugcuuagaaaauuca

SEQ ID NO: 1322514 - RNA, 22 nt, Homo sapiens
uaaguugucuaaacaaugcuga

SEQ ID NO: 1322515 - RNA, 15 nt, Homo sapiens
uagaccaaaucuugu

SEQ ID NO: 1322516 - RNA, 21 nt, Homo sapiens
uagacccugcauuuauagcau

SEQ ID NO: 1322517 - RNA, 20 nt, Homo sapiens
uagacucaugguguguuaca

SEQ ID NO: 1322518 - RNA, 20 nt, Homo sapiens
uagacugcaguggacagucc

SEQ ID NO: 1322519 - RNA, 22 nt, Homo sapiens
uagacuggacuggaccagacaa

SEQ ID NO: 1322520 - RNA, 19 nt, Homo sapiens
uagacuuaucugcauauug

SEQ ID NO: 1322521 - RNA, 23 nt, Homo sapiens
uagagaaguccaagcaacagccu

SEQ ID NO: 1322522 - RNA, 21 nt, Homo sapiens
uagagaggugaagguaugaga

SEQ ID NO: 1322523 - RNA, 22 nt, Homo sapiens
uagagaugagguuucaccauga

SEQ ID NO: 1322524 - RNA, 23 nt, Homo sapiens
uagaggugcucauucauuuaaca

SEQ ID NO: 1322525 - RNA, 14 nt, Homo sapiens
uagaguauaugcac

SEQ ID NO: 1322526 - RNA, 16 nt, Homo sapiens
uagauaaacucagaaa

SEQ ID NO: 1322527 - RNA, 22 nt, Homo sapiens
uagauacucucuucuucucaua

SEQ ID NO: 1322528 - RNA, 13 nt, Homo sapiens
uagauauuuucca

SEQ ID NO: 1322529 - RNA, 15 nt, Homo sapiens
uagauccagugcuga

SEQ ID NO: 1322530 - RNA, 11 nt, Homo sapiens
uagaucuggca

SEQ ID NO: 1322531 - RNA, 21 nt, Homo sapiens
uagaugcacuaccauugcugu

SEQ ID NO: 1322532 - RNA, 18 nt, Homo sapiens
uagauuaccuagcuuagu

SEQ ID NO: 1322533 - RNA, 20 nt, Homo sapiens
uagcaaaauacaugacauuu

SEQ ID NO: 1322534 - RNA, 16 nt, Homo sapiens
uagcaaagcgacguua

SEQ ID NO: 1322535 - RNA, 16 nt, Homo sapiens
uagcaagaacugcacg

SEQ ID NO: 1322536 - RNA, 15 nt, Homo sapiens
uagcacuacaaacac

SEQ ID NO: 1322537 - RNA, 22 nt, Homo sapiens
uagcagagacuuuagucuuugg

SEQ ID NO: 1322538 - RNA, 22 nt, Homo sapiens
uagcagcagggagggcuucugc

SEQ ID NO: 1322539 - RNA, 21 nt, Homo sapiens
uagcaggccauggcucauggg

SEQ ID NO: 1322540 - RNA, 13 nt, Homo sapiens
uagcagucacuga

SEQ ID NO: 1322541 - RNA, 14 nt, Homo sapiens
uagcaucuacuugu

SEQ ID NO: 1322542 - RNA, 17 nt, Homo sapiens
uagcaucuuccuugaua

SEQ ID NO: 1322543 - RNA, 22 nt, Homo sapiens
uagccauguaaucagauuuauu

SEQ ID NO: 1322544 - RNA, 21 nt, Homo sapiens
uagccauuuuucaaagcaauu

SEQ ID NO: 1322545 - RNA, 14 nt, Homo sapiens
uagcccaaaaccaa

SEQ ID NO: 1322546 - RNA, 22 nt, Homo sapiens
uagccugccucuucucuacucu

SEQ ID NO: 1322547 - RNA, 17 nt, Homo sapiens
uagccuuagaagucaca

SEQ ID NO: 1322548 - RNA, 13 nt, Homo sapiens
uagcgcagugucc

SEQ ID NO: 1322549 - RNA, 12 nt, Homo sapiens
uagcucuauguu

SEQ ID NO: 1322550 - RNA, 17 nt, Homo sapiens
uagcugcaaaggacaga

SEQ ID NO: 1322551 - RNA, 14 nt, Homo sapiens
uagcugcuaccuuc

SEQ ID NO: 1322552 - RNA, 17 nt, Homo sapiens
uagcugggacuacaggu

SEQ ID NO: 1322553 - RNA, 17 nt, Homo sapiens
uaggaaaauauaugaag

SEQ ID NO: 1322554 - RNA, 14 nt, Homo sapiens
uaggaaaauuucac

SEQ ID NO: 1322555 - RNA, 17 nt, Homo sapiens
uaggaagaucucugcag

SEQ ID NO: 1322556 - RNA, 13 nt, Homo sapiens
uaggaaguaggaa

SEQ ID NO: 1322557 - RNA, 22 nt, Homo sapiens
uaggacacauuuagaugcacua

SEQ ID NO: 1322558 - RNA, 17 nt, Homo sapiens
uaggacucaaaguuuca

SEQ ID NO: 1322559 - RNA, 19 nt, Homo sapiens
uaggacucaaaguuucaga

SEQ ID NO: 1322560 - RNA, 13 nt, Homo sapiens
uaggauacuuaac

SEQ ID NO: 1322561 - RNA, 15 nt, Homo sapiens
uaggcaaccuucuaa

SEQ ID NO: 1322562 - RNA, 16 nt, Homo sapiens
uaggcagacacaggga

SEQ ID NO: 1322563 - RNA, 14 nt, Homo sapiens
uaggcauuugcuga

SEQ ID NO: 1322564 - RNA, 21 nt, Homo sapiens
uaggccuccuggcccagguga

SEQ ID NO: 1322565 - RNA, 22 nt, Homo sapiens
uaggccuggggacggcuuuuac

SEQ ID NO: 1322566 - RNA, 19 nt, Homo sapiens
uaggcgcuggggcucagcu

SEQ ID NO: 1322567 - RNA, 14 nt, Homo sapiens
uaggcuauucacaa

SEQ ID NO: 1322568 - RNA, 15 nt, Homo sapiens
uaggcucugccuucg

SEQ ID NO: 1322569 - RNA, 19 nt, Homo sapiens
uagggccccugcacacuca

SEQ ID NO: 1322570 - RNA, 13 nt, Homo sapiens
uagggcuguaaaa

SEQ ID NO: 1322571 - RNA, 22 nt, Homo sapiens
uaggggacuaauucacuggcga

SEQ ID NO: 1322572 - RNA, 15 nt, Homo sapiens
uaggugcagcuccuc

SEQ ID NO: 1322573 - RNA, 20 nt, Homo sapiens
uagguguccagcauugcugg

SEQ ID NO: 1322574 - RNA, 16 nt, Homo sapiens
uagguuaggaauucaa

SEQ ID NO: 1322575 - RNA, 12 nt, Homo sapiens
uaguaacaugug

SEQ ID NO: 1322576 - RNA, 16 nt, Homo sapiens
uaguaacuguagaugg

SEQ ID NO: 1322577 - RNA, 13 nt, Homo sapiens
uaguaauucucag

SEQ ID NO: 1322578 - RNA, 12 nt, Homo sapiens
uagucauugcag

SEQ ID NO: 1322579 - RNA, 21 nt, Homo sapiens
uaguccgugcugacagcugcu

SEQ ID NO: 1322580 - RNA, 17 nt, Homo sapiens
uagucgaacaauucaua

SEQ ID NO: 1322581 - RNA, 22 nt, Homo sapiens
uagugcaacuguuuugauacug

SEQ ID NO: 1322582 - RNA, 20 nt, Homo sapiens
ugcugcaacaaaauguagaa

SEQ ID NO: 1322583 - RNA, 19 nt, Homo sapiens
ugcugcaccaaugcacuga

SEQ ID NO: 1322584 - RNA, 12 nt, Homo sapiens
ugcugccaaaca

SEQ ID NO: 1322585 - RNA, 21 nt, Homo sapiens
ugcugccaaacacccaugccc

SEQ ID NO: 1322586 - RNA, 15 nt, Homo sapiens
ugcugcccccagaaa

SEQ ID NO: 1322587 - RNA, 14 nt, Homo sapiens
ugcugccugccugg

SEQ ID NO: 1322588 - RNA, 16 nt, Homo sapiens
ugcugcuccagugcag

SEQ ID NO: 1322589 - RNA, 19 nt, Homo sapiens
ugcugcuugaggcaacuca

SEQ ID NO: 1322590 - RNA, 15 nt, Homo sapiens
ugcuggaagcccagc

SEQ ID NO: 1322591 - RNA, 13 nt, Homo sapiens
ugcuggcauuugc

SEQ ID NO: 1322592 - RNA, 23 nt, Homo sapiens
ugcuggucccggggccagcacuu

SEQ ID NO: 1322593 - RNA, 14 nt, Homo sapiens
ugcuguaugcugau

SEQ ID NO: 1322594 - RNA, 21 nt, Homo sapiens
ugcugucaauauugguguacu

SEQ ID NO: 1322595 - RNA, 18 nt, Homo sapiens
ugcuguccagugccuaca

SEQ ID NO: 1322596 - RNA, 18 nt, Homo sapiens
ugcuguguggaguggaca

SEQ ID NO: 1322597 - RNA, 20 nt, Homo sapiens
ugcuguuguugaaauugaug

SEQ ID NO: 1322598 - RNA, 14 nt, Homo sapiens
ugcuucaauguagu

SEQ ID NO: 1322599 - RNA, 13 nt, Homo sapiens
ugcuucagccucc

SEQ ID NO: 1322600 - RNA, 16 nt, Homo sapiens
ugcuucagugcugcuc

SEQ ID NO: 1322601 - RNA, 14 nt, Homo sapiens
ugcuucaucauucc

SEQ ID NO: 1322602 - RNA, 16 nt, Homo sapiens
ugcuugacaacaucug

SEQ ID NO: 1322603 - RNA, 21 nt, Homo sapiens
ugcuuguguaacaggaacaaa

SEQ ID NO: 1322604 - RNA, 12 nt, Homo sapiens
ugcuuguucccu

SEQ ID NO: 1322605 - RNA, 12 nt, Homo sapiens
ugcuuucugcuc

SEQ ID NO: 1322606 - RNA, 15 nt, Homo sapiens
ugcuuuuaacucuag

SEQ ID NO: 1322607 - RNA, 16 nt, Homo sapiens
ugcuuuugcuucuaga

SEQ ID NO: 1322608 - RNA, 22 nt, Homo sapiens
ugcuuuugguggcuaccaugca

SEQ ID NO: 1322609 - RNA, 23 nt, Homo sapiens
ugcuuuuguguaaggaaggugcu

SEQ ID NO: 1322610 - RNA, 18 nt, Homo sapiens
ugcuuuuugcguacacag

SEQ ID NO: 1322611 - RNA, 19 nt, Homo sapiens
ugcuuuuuuaaacuugaau

SEQ ID NO: 1322612 - RNA, 22 nt, Homo sapiens
uggaaaaagccaaggugucauu

SEQ ID NO: 1322613 - RNA, 13 nt, Homo sapiens
uggaaaaagccug

SEQ ID NO: 1322614 - RNA, 17 nt, Homo sapiens
uggaaaaagccugugaa

SEQ ID NO: 1322615 - RNA, 13 nt, Homo sapiens
uggaaacuggcca

SEQ ID NO: 1322616 - RNA, 17 nt, Homo sapiens
uggaaagacaagcucaa

SEQ ID NO: 1322617 - RNA, 21 nt, Homo sapiens
uggaaagacagcuucucaucc

SEQ ID NO: 1322618 - RNA, 19 nt, Homo sapiens
uggaaagcggcuagguuuu

SEQ ID NO: 1322619 - RNA, 17 nt, Homo sapiens
uggaaauguggucauca

SEQ ID NO: 1322620 - RNA, 12 nt, Homo sapiens
uggaacacggcc

SEQ ID NO: 1322621 - RNA, 22 nt, Homo sapiens
uggaacacuacucuuacaugua

SEQ ID NO: 1322622 - RNA, 21 nt, Homo sapiens
uggaacacuagacaagccaga

SEQ ID NO: 1322623 - RNA, 16 nt, Homo sapiens
uggaacuuagccauuu

SEQ ID NO: 1322624 - RNA, 22 nt, Homo sapiens
uggaagaaaaaaaccacacaaa

SEQ ID NO: 1322625 - RNA, 18 nt, Homo sapiens
uggaagacacauugaaag

SEQ ID NO: 1322626 - RNA, 18 nt, Homo sapiens
uggaagcugucauaaaaa

SEQ ID NO: 1322627 - RNA, 20 nt, Homo sapiens
uggaagcuuguugaaaaccc

SEQ ID NO: 1322628 - RNA, 23 nt, Homo sapiens
uggaagcuuguugaaaacccaga

SEQ ID NO: 1322629 - RNA, 17 nt, Homo sapiens
uggaaggcugcuuucuc

SEQ ID NO: 1322630 - RNA, 16 nt, Homo sapiens
uggaaggcuuccacua

SEQ ID NO: 1322631 - RNA, 23 nt, Homo sapiens
uggaaguugcauggcaucaccuc

SEQ ID NO: 1322632 - RNA, 20 nt, Homo sapiens
uggaauaaagucacagaauu

SEQ ID NO: 1322633 - RNA, 23 nt, Homo sapiens
uggaauaauccuaaacauaugaa

SEQ ID NO: 1322634 - RNA, 21 nt, Homo sapiens
uggaauauuguccauugucca

SEQ ID NO: 1322635 - RNA, 13 nt, Homo sapiens
uggaaucagugaa

SEQ ID NO: 1322636 - RNA, 23 nt, Homo sapiens
uggaaucagugaagccaaaggga

SEQ ID NO: 1322637 - RNA, 16 nt, Homo sapiens
uggaaugaagguaaua

SEQ ID NO: 1322638 - RNA, 20 nt, Homo sapiens
uggacaaacaccaaucucuc

SEQ ID NO: 1322639 - RNA, 16 nt, Homo sapiens
uggacagccugaguca

SEQ ID NO: 1322640 - RNA, 14 nt, Homo sapiens
uggacaugagccau

SEQ ID NO: 1322641 - RNA, 15 nt, Homo sapiens
uggacaugagccauu

SEQ ID NO: 1322642 - RNA, 21 nt, Homo sapiens
uggaccacuuuguauacacuc

SEQ ID NO: 1322643 - RNA, 13 nt, Homo sapiens
uggaccagacaau

SEQ ID NO: 1322644 - RNA, 19 nt, Homo sapiens
uggaccuaggguggccuga

SEQ ID NO: 1322645 - RNA, 17 nt, Homo sapiens
uggacucagaaagccaa

SEQ ID NO: 1322646 - RNA, 15 nt, Homo sapiens
uggacuggaugcaug

SEQ ID NO: 1322647 - RNA, 22 nt, Homo sapiens
uggacugguuuucacauuagaa

SEQ ID NO: 1322648 - RNA, 19 nt, Homo sapiens
uggagaacucacugugggc

SEQ ID NO: 1322649 - RNA, 17 nt, Homo sapiens
uggagaccgugaccagu

SEQ ID NO: 1322650 - RNA, 23 nt, Homo sapiens
uggagaccgugaccagugcugcu

SEQ ID NO: 1322651 - RNA, 17 nt, Homo sapiens
uggagagaagugagaau

SEQ ID NO: 1322652 - RNA, 19 nt, Homo sapiens
uggagagggugucaucuag

SEQ ID NO: 1322653 - RNA, 13 nt, Homo sapiens
uggagauagggaa

SEQ ID NO: 1322654 - RNA, 23 nt, Homo sapiens
uggagauccagaagagaauuaga

SEQ ID NO: 1322655 - RNA, 19 nt, Homo sapiens
uggagauggaagcuuguug

SEQ ID NO: 1322656 - RNA, 17 nt, Homo sapiens
uggagauucuaauccca

SEQ ID NO: 1322657 - RNA, 15 nt, Homo sapiens
uggagcaucaagcca

SEQ ID NO: 1322658 - RNA, 18 nt, Homo sapiens
uggaggacggucagucca

SEQ ID NO: 1322659 - RNA, 22 nt, Homo sapiens
uggaggaucucacuuaauucuc

SEQ ID NO: 1322660 - RNA, 16 nt, Homo sapiens
uggaggcaccauuugu

SEQ ID NO: 1322661 - RNA, 11 nt, Homo sapiens
uggagugcagg

SEQ ID NO: 1322662 - RNA, 17 nt, Homo sapiens
uggagugcaguggugcg

SEQ ID NO: 1322663 - RNA, 18 nt, Homo sapiens
uggagugcaguggugcga

SEQ ID NO: 1322664 - RNA, 19 nt, Homo sapiens
uggagugcaguggugcgau

SEQ ID NO: 1322665 - RNA, 19 nt, Homo sapiens
uggauaaaauaaaugcaau

SEQ ID NO: 1322666 - RNA, 12 nt, Homo sapiens
uggaucagaaua

SEQ ID NO: 1322667 - RNA, 14 nt, Homo sapiens
uggaugcacuuuca

SEQ ID NO: 1322668 - RNA, 13 nt, Homo sapiens
uggaugcagcucu

SEQ ID NO: 1322669 - RNA, 14 nt, Homo sapiens
uggaugcauguucu

SEQ ID NO: 1322670 - RNA, 22 nt, Homo sapiens
uggaugccaaccggucacccag

SEQ ID NO: 1322671 - RNA, 20 nt, Homo sapiens
uggaugccgauuucuguaaa

SEQ ID NO: 1322672 - RNA, 18 nt, Homo sapiens
uggaugccugauugccaa

SEQ ID NO: 1322673 - RNA, 13 nt, Homo sapiens
uggaugcuccuuc

SEQ ID NO: 1322674 - RNA, 23 nt, Homo sapiens
uggaugggggaacucagauccag

SEQ ID NO: 1322675 - RNA, 12 nt, Homo sapiens
uggaugugaugg

SEQ ID NO: 1322676 - RNA, 13 nt, Homo sapiens
uggcacugagaaa

SEQ ID NO: 1322677 - RNA, 19 nt, Homo sapiens
uggcacugagaaacaugca

SEQ ID NO: 1322678 - RNA, 16 nt, Homo sapiens
uggcacuggaugcaga

SEQ ID NO: 1322679 - RNA, 13 nt, Homo sapiens
uggcagacugugu

SEQ ID NO: 1322680 - RNA, 18 nt, Homo sapiens
uggcagcauugacucugu

SEQ ID NO: 1322681 - RNA, 17 nt, Homo sapiens
uggcagcucagcuuccc

SEQ ID NO: 1322682 - RNA, 14 nt, Homo sapiens
uggcaggacuccag

SEQ ID NO: 1322683 - RNA, 15 nt, Homo sapiens
uggcaggacuccaga

SEQ ID NO: 1322684 - RNA, 17 nt, Homo sapiens
uggcagucccuuauaau

SEQ ID NO: 1322685 - RNA, 14 nt, Homo sapiens
uggcaucuugccaa

SEQ ID NO: 1322686 - RNA, 15 nt, Homo sapiens
uggcaugauccaagc

SEQ ID NO: 1322687 - RNA, 19 nt, Homo sapiens
uggcaugauccaagcaaga

SEQ ID NO: 1322688 - RNA, 17 nt, Homo sapiens
gacacugggaggccagu

SEQ ID NO: 1322689 - RNA, 20 nt, Homo sapiens
gacacuuaauacuaccuuga

SEQ ID NO: 1322690 - RNA, 14 nt, Homo sapiens
gacagaaccuuguu

SEQ ID NO: 1322691 - RNA, 20 nt, Homo sapiens
gacagagccucgcucuguua

SEQ ID NO: 1322692 - RNA, 20 nt, Homo sapiens
gacagagguuaucuguccca

SEQ ID NO: 1322693 - RNA, 20 nt, Homo sapiens
gacagauuuggaugcacuca

SEQ ID NO: 1322694 - RNA, 15 nt, Homo sapiens
agugugaaugaucaa

SEQ ID NO: 1322695 - RNA, 14 nt, Homo sapiens
aguguggccugagu

SEQ ID NO: 1322696 - RNA, 17 nt, Homo sapiens
aguguucacaaccugga

SEQ ID NO: 1322697 - RNA, 13 nt, Homo sapiens
aguguucccugac

SEQ ID NO: 1322698 - RNA, 13 nt, Homo sapiens
aguguucuacacc

SEQ ID NO: 1322699 - RNA, 15 nt, Homo sapiens
aguguugacacuuaa

SEQ ID NO: 1322700 - RNA, 12 nt, Homo sapiens
aguguugcuugg

SEQ ID NO: 1322701 - RNA, 21 nt, Homo sapiens
aguguugcuuuaaauugugcc

SEQ ID NO: 1322702 - RNA, 14 nt, Homo sapiens
aguguuuaaaugaa

SEQ ID NO: 1322703 - RNA, 19 nt, Homo sapiens
aguuaagagguuuguauau

SEQ ID NO: 1322704 - RNA, 18 nt, Homo sapiens
aguuacuagguaacuuca

SEQ ID NO: 1322705 - RNA, 20 nt, Homo sapiens
aguuagagcuggcaccagaa

SEQ ID NO: 1322706 - RNA, 15 nt, Homo sapiens
aguuagauuauugaa

SEQ ID NO: 1322707 - RNA, 14 nt, Homo sapiens
aguuagccaaacaa

SEQ ID NO: 1322708 - RNA, 13 nt, Homo sapiens
aguuaucaguccu

SEQ ID NO: 1322709 - RNA, 12 nt, Homo sapiens
aguucacaucag

SEQ ID NO: 1322710 - RNA, 13 nt, Homo sapiens
aguucacaucaga

SEQ ID NO: 1322711 - RNA, 22 nt, Homo sapiens
aguucagaaucacuucugagaa

SEQ ID NO: 1322712 - RNA, 20 nt, Homo sapiens
aguuccuacuuuagccacug

SEQ ID NO: 1322713 - RNA, 20 nt, Homo sapiens
aguuccuaugacacaguuau

SEQ ID NO: 1322714 - RNA, 22 nt, Homo sapiens
aguucuccacuagcuauggugu

SEQ ID NO: 1322715 - RNA, 19 nt, Homo sapiens
aguucugagcaccguguca

SEQ ID NO: 1322716 - RNA, 23 nt, Homo sapiens
aguucugcuuucuccccaaugag

SEQ ID NO: 1322717 - RNA, 18 nt, Homo sapiens
aguucugggacuacaggc

SEQ ID NO: 1322718 - RNA, 23 nt, Homo sapiens
aguucuuuaaaauguaaagccau

SEQ ID NO: 1322719 - RNA, 18 nt, Homo sapiens
aguucuuugggccagaca

SEQ ID NO: 1322720 - RNA, 17 nt, Homo sapiens
aguugaaauaugcucuu

SEQ ID NO: 1322721 - RNA, 14 nt, Homo sapiens
aguugagacuuaaa

SEQ ID NO: 1322722 - RNA, 18 nt, Homo sapiens
aguugauuuuacaauuga

SEQ ID NO: 1322723 - RNA, 19 nt, Homo sapiens
aguugguaaauucacaaau

SEQ ID NO: 1322724 - RNA, 19 nt, Homo sapiens
aguuguagguaauauugca

SEQ ID NO: 1322725 - RNA, 11 nt, Homo sapiens
aguuguugaug

SEQ ID NO: 1322726 - RNA, 21 nt, Homo sapiens
aguuguuucuacuacauggaa

SEQ ID NO: 1322727 - RNA, 19 nt, Homo sapiens
aguuguuuuauauguugcu

SEQ ID NO: 1322728 - RNA, 13 nt, Homo sapiens
aguuuagggaaaa

SEQ ID NO: 1322729 - RNA, 20 nt, Homo sapiens
aguuuauaaaugugaacuua

SEQ ID NO: 1322730 - RNA, 17 nt, Homo sapiens
aguuuauugacaauaau

SEQ ID NO: 1322731 - RNA, 17 nt, Homo sapiens
aguuucuggcucuugag

SEQ ID NO: 1322732 - RNA, 13 nt, Homo sapiens
aguuugagacagg

SEQ ID NO: 1322733 - RNA, 19 nt, Homo sapiens
aguuugagaccaaccuggg

SEQ ID NO: 1322734 - RNA, 19 nt, Homo sapiens
aguuuuaguuuucucuuag

SEQ ID NO: 1322735 - RNA, 13 nt, Homo sapiens
aguuuuguugccc

SEQ ID NO: 1322736 - RNA, 13 nt, Homo sapiens
aguuuuucagucu

SEQ ID NO: 1322737 - RNA, 16 nt, Homo sapiens
auaaaaacccaauuca

SEQ ID NO: 1322738 - RNA, 20 nt, Homo sapiens
auaaaaauaaaucaguucau

SEQ ID NO: 1322739 - RNA, 14 nt, Homo sapiens
auaaaaaugagugc

SEQ ID NO: 1322740 - RNA, 19 nt, Homo sapiens
auaaaacgugacagggaaa

SEQ ID NO: 1322741 - RNA, 15 nt, Homo sapiens
auaaaagacagugaa

SEQ ID NO: 1322742 - RNA, 18 nt, Homo sapiens
auaaaauauuauugaacu

SEQ ID NO: 1322743 - RNA, 19 nt, Homo sapiens
auaaaauauuauugaacua

SEQ ID NO: 1322744 - RNA, 21 nt, Homo sapiens
auaaaauguugaaaagucaaa

SEQ ID NO: 1322745 - RNA, 12 nt, Homo sapiens
auaaacuguaaa

SEQ ID NO: 1322746 - RNA, 23 nt, Homo sapiens
auaaagcacagauuugcauuuca

SEQ ID NO: 1322747 - RNA, 15 nt, Homo sapiens
auaaagcacugagca

SEQ ID NO: 1322748 - RNA, 13 nt, Homo sapiens
auaaagcuaaaau

SEQ ID NO: 1322749 - RNA, 18 nt, Homo sapiens
auaaaguaguccugugaa

SEQ ID NO: 1322750 - RNA, 13 nt, Homo sapiens
auaaaguauuuaa

SEQ ID NO: 1322751 - RNA, 15 nt, Homo sapiens
auaaagugauugacu

SEQ ID NO: 1322752 - RNA, 12 nt, Homo sapiens
auaaaucaucuu

SEQ ID NO: 1322753 - RNA, 18 nt, Homo sapiens
auaaaucugacccagugc

SEQ ID NO: 1322754 - RNA, 17 nt, Homo sapiens
auaaaugucagauaauu

SEQ ID NO: 1322755 - RNA, 18 nt, Homo sapiens
auaaaugucagauaauua

SEQ ID NO: 1322756 - RNA, 19 nt, Homo sapiens
auaaauugccauaauauga

SEQ ID NO: 1322757 - RNA, 17 nt, Homo sapiens
auaacauccacaaagag

SEQ ID NO: 1322758 - RNA, 14 nt, Homo sapiens
auaacaucuaugaa

SEQ ID NO: 1322759 - RNA, 15 nt, Homo sapiens
auaacgcaggccuuu

SEQ ID NO: 1322760 - RNA, 13 nt, Homo sapiens
auaacuauggaau

SEQ ID NO: 1322761 - RNA, 16 nt, Homo sapiens
auaacuuuaacuuuua

SEQ ID NO: 1322762 - RNA, 20 nt, Homo sapiens
auaacuuuuuaaagugacau

SEQ ID NO: 1322763 - RNA, 19 nt, Homo sapiens
auaagaaaaccaccccuua

SEQ ID NO: 1322764 - RNA, 13 nt, Homo sapiens
auaagacaaugac

SEQ ID NO: 1322765 - RNA, 15 nt, Homo sapiens
auaagacaaugacau

SEQ ID NO: 1322766 - RNA, 19 nt, Homo sapiens
auaagauauuuaguaauau

SEQ ID NO: 1322767 - RNA, 22 nt, Homo sapiens
auaagauuccaaaaagcacaua

SEQ ID NO: 1322768 - RNA, 22 nt, Homo sapiens
auaaguguuauguuuguagaua

SEQ ID NO: 1322769 - RNA, 17 nt, Homo sapiens
auaauaaagguugugaa

SEQ ID NO: 1322770 - RNA, 16 nt, Homo sapiens
auaauacaguaucuca

SEQ ID NO: 1322771 - RNA, 17 nt, Homo sapiens
auaauacaguaucucag

SEQ ID NO: 1322772 - RNA, 12 nt, Homo sapiens
auaaucuuucaa

SEQ ID NO: 1322773 - RNA, 11 nt, Homo sapiens
auaauuccaca

SEQ ID NO: 1322774 - RNA, 14 nt, Homo sapiens
auaauuuacaugca

SEQ ID NO: 1322775 - RNA, 11 nt, Homo sapiens
auacaaaaaga

SEQ ID NO: 1322776 - RNA, 20 nt, Homo sapiens
auacaaggcccagauguggu

SEQ ID NO: 1322777 - RNA, 20 nt, Homo sapiens
auacaauaauguaauuuagu

SEQ ID NO: 1322778 - RNA, 16 nt, Homo sapiens
auacaauagcauugau

SEQ ID NO: 1322779 - RNA, 22 nt, Homo sapiens
auacaauuauuuuuacaguucu

SEQ ID NO: 1322780 - RNA, 12 nt, Homo sapiens
auacacaguguu

SEQ ID NO: 1322781 - RNA, 18 nt, Homo sapiens
auacacuaaaaaucugag

SEQ ID NO: 1322782 - RNA, 16 nt, Homo sapiens
auacagaauuacugua

SEQ ID NO: 1322783 - RNA, 17 nt, Homo sapiens
auacagaauuacuguaa

SEQ ID NO: 1322784 - RNA, 13 nt, Homo sapiens
auacagugauaua

SEQ ID NO: 1322785 - RNA, 16 nt, Homo sapiens
auacauggacugagag

SEQ ID NO: 1322786 - RNA, 22 nt, Homo sapiens
auacauuuggaaauguggucau

SEQ ID NO: 1322787 - RNA, 17 nt, Homo sapiens
auaccuaaaacauaaga

SEQ ID NO: 1322788 - RNA, 21 nt, Homo sapiens
auaccucaacccccauuucua

SEQ ID NO: 1322789 - RNA, 19 nt, Homo sapiens
auaccuucuggcugugcua

SEQ ID NO: 1322790 - RNA, 16 nt, Homo sapiens
auacuagggagccauu

SEQ ID NO: 1322791 - RNA, 20 nt, Homo sapiens
auacuauauuuauacuguau

SEQ ID NO: 1322792 - RNA, 21 nt, Homo sapiens
auacuauauuuauacuguaua

SEQ ID NO: 1322793 - RNA, 15 nt, Homo sapiens
auacugcuacuguaa

SEQ ID NO: 1322794 - RNA, 16 nt, Homo sapiens
auacuguauuuuuacc

SEQ ID NO: 1322795 - RNA, 15 nt, Homo sapiens
auacuuaacaaauac

SEQ ID NO: 1322796 - RNA, 13 nt, Homo sapiens
auacuuacugaac

SEQ ID NO: 1322797 - RNA, 19 nt, Homo sapiens
auacuucucuauuaucuca

SEQ ID NO: 1322798 - RNA, 13 nt, Homo sapiens
auacuuuacaugg

SEQ ID NO: 1322799 - RNA, 18 nt, Homo sapiens
auacuuucuguucuccag

SEQ ID NO: 1322800 - RNA, 13 nt, Homo sapiens
auagaaaaaccaa

SEQ ID NO: 1322801 - RNA, 16 nt, Homo sapiens
auagaaaaugcuaaag

SEQ ID NO: 1322802 - RNA, 14 nt, Homo sapiens
auagaaaugccaag

SEQ ID NO: 1322803 - RNA, 19 nt, Homo sapiens
auagaacaggcugaaauuu

SEQ ID NO: 1322804 - RNA, 21 nt, Homo sapiens
auagaauuauuucacaaauaa

SEQ ID NO: 1322805 - RNA, 15 nt, Homo sapiens
auagacaauuugcac

SEQ ID NO: 1322806 - RNA, 15 nt, Homo sapiens
auagacccgaggaaa

SEQ ID NO: 1322807 - RNA, 13 nt, Homo sapiens
auagagccugagg

SEQ ID NO: 1322808 - RNA, 19 nt, Homo sapiens
auagauaggucagugcaaa

SEQ ID NO: 1322809 - RNA, 23 nt, Homo sapiens
auagaugcuggcccagggcccag

SEQ ID NO: 1322810 - RNA, 19 nt, Homo sapiens
auagcaaacuucaggacuu

SEQ ID NO: 1322811 - RNA, 19 nt, Homo sapiens
auagcaauaucauaauuaa

SEQ ID NO: 1322812 - RNA, 11 nt, Homo sapiens
auagcacuuuc

SEQ ID NO: 1322813 - RNA, 14 nt, Homo sapiens
auagccgauaucag

SEQ ID NO: 1322814 - RNA, 19 nt, Homo sapiens
auagccuguggccuuugca

SEQ ID NO: 1322815 - RNA, 17 nt, Homo sapiens
auaggcccagugagaug

SEQ ID NO: 1322816 - RNA, 21 nt, Homo sapiens
auaggucagugcaaauacucu

SEQ ID NO: 1322817 - RNA, 15 nt, Homo sapiens
auagguugagcaauu

SEQ ID NO: 1322818 - RNA, 17 nt, Homo sapiens
auagguugagcaauuuc

SEQ ID NO: 1322819 - RNA, 11 nt, Homo sapiens
auaguacuggc

SEQ ID NO: 1322820 - RNA, 19 nt, Homo sapiens
auaguacuggcaugguacg

SEQ ID NO: 1322821 - RNA, 14 nt, Homo sapiens
auagucuuugccag

SEQ ID NO: 1322822 - RNA, 21 nt, Homo sapiens
auagugagaccuuggcgcuac

SEQ ID NO: 1322823 - RNA, 19 nt, Homo sapiens
auagugguaugacauugga

SEQ ID NO: 1322824 - RNA, 15 nt, Homo sapiens
auauaauacuguauu

SEQ ID NO: 1322825 - RNA, 17 nt, Homo sapiens
auauacaauaacauaau

SEQ ID NO: 1322826 - RNA, 14 nt, Homo sapiens
auauagaacagugc

SEQ ID NO: 1322827 - RNA, 16 nt, Homo sapiens
auauagcaagauccca

SEQ ID NO: 1322828 - RNA, 15 nt, Homo sapiens
auggucacacacuga

SEQ ID NO: 1322829 - RNA, 14 nt, Homo sapiens
auggucccaaauga

SEQ ID NO: 1322830 - RNA, 20 nt, Homo sapiens
auggucuuggcagcaccugu

SEQ ID NO: 1322831 - RNA, 12 nt, Homo sapiens
auggugagcucu

SEQ ID NO: 1322832 - RNA, 13 nt, Homo sapiens
auggugagcucug

SEQ ID NO: 1322833 - RNA, 14 nt, Homo sapiens
auggugauaaggga

SEQ ID NO: 1322834 - RNA, 16 nt, Homo sapiens
auggugauagacugaa

SEQ ID NO: 1322835 - RNA, 22 nt, Homo sapiens
auggugccccaggaccagcuca

SEQ ID NO: 1322836 - RNA, 17 nt, Homo sapiens
auggugcuacgccugca

SEQ ID NO: 1322837 - RNA, 23 nt, Homo sapiens
augguggagggccacaugggagg

SEQ ID NO: 1322838 - RNA, 20 nt, Homo sapiens
augguggcgcgcaccuguaa

SEQ ID NO: 1322839 - RNA, 20 nt, Homo sapiens
augguggcucacaccuguaa

SEQ ID NO: 1322840 - RNA, 19 nt, Homo sapiens
auggugugccuuccagauc

SEQ ID NO: 1322841 - RNA, 19 nt, Homo sapiens
augguuccauucucucucc

SEQ ID NO: 1322842 - RNA, 23 nt, Homo sapiens
augguucuggacggcccagcagc

SEQ ID NO: 1322843 - RNA, 14 nt, Homo sapiens
auguaaaacaagaa

SEQ ID NO: 1322844 - RNA, 14 nt, Homo sapiens
auguaaaagcacau

SEQ ID NO: 1322845 - RNA, 15 nt, Homo sapiens
auguaaaaugcaaaa

SEQ ID NO: 1322846 - RNA, 23 nt, Homo sapiens
auguaacauguaggaaguaggaa

SEQ ID NO: 1322847 - RNA, 14 nt, Homo sapiens
auguaacugugcca

SEQ ID NO: 1322848 - RNA, 16 nt, Homo sapiens
auguaaucaacauucc

SEQ ID NO: 1322849 - RNA, 17 nt, Homo sapiens
auguaaucaacauucca

SEQ ID NO: 1322850 - RNA, 21 nt, Homo sapiens
auguacaccagagccucagug

SEQ ID NO: 1322851 - RNA, 16 nt, Homo sapiens
auguacuuguuugcaa

SEQ ID NO: 1322852 - RNA, 18 nt, Homo sapiens
auguagagagauaccauc

SEQ ID NO: 1322853 - RNA, 22 nt, Homo sapiens
auguauaaagugauugacuuga

SEQ ID NO: 1322854 - RNA, 12 nt, Homo sapiens
auguauggauuu

SEQ ID NO: 1322855 - RNA, 15 nt, Homo sapiens
augucccccuuaugu

SEQ ID NO: 1322856 - RNA, 23 nt, Homo sapiens
augucccuugcugugagcaagaa

SEQ ID NO: 1322857 - RNA, 13 nt, Homo sapiens
auguccucagggc

SEQ ID NO: 1322858 - RNA, 13 nt, Homo sapiens
augucuauuccau

SEQ ID NO: 1322859 - RNA, 23 nt, Homo sapiens
augucucacgucucccuaaaaau

SEQ ID NO: 1322860 - RNA, 21 nt, Homo sapiens
augucucugugagacucgaga

SEQ ID NO: 1322861 - RNA, 19 nt, Homo sapiens
augucucuuuaaugucaca

SEQ ID NO: 1322862 - RNA, 18 nt, Homo sapiens
augucugccauguugccc

SEQ ID NO: 1322863 - RNA, 18 nt, Homo sapiens
augugaaaggaacauuuu

SEQ ID NO: 1322864 - RNA, 20 nt, Homo sapiens
augugaacaaccugcucaca

SEQ ID NO: 1322865 - RNA, 14 nt, Homo sapiens
augugaagcccagc

SEQ ID NO: 1322866 - RNA, 17 nt, Homo sapiens
augugacaccccggggg

SEQ ID NO: 1322867 - RNA, 18 nt, Homo sapiens
augugagugccuuuugca

SEQ ID NO: 1322868 - RNA, 22 nt, Homo sapiens
augugauaaaaccccaucucua

SEQ ID NO: 1322869 - RNA, 17 nt, Homo sapiens
augugauuuacauuuca

SEQ ID NO: 1322870 - RNA, 16 nt, Homo sapiens
augugcaaccacugcu

SEQ ID NO: 1322871 - RNA, 14 nt, Homo sapiens
augugcacaugcac

SEQ ID NO: 1322872 - RNA, 18 nt, Homo sapiens
augugcggggaucaucug

SEQ ID NO: 1322873 - RNA, 13 nt, Homo sapiens
augugcuggucac

SEQ ID NO: 1322874 - RNA, 15 nt, Homo sapiens
augugcuuauaucau

SEQ ID NO: 1322875 - RNA, 16 nt, Homo sapiens
auguggucaucaaaga

SEQ ID NO: 1322876 - RNA, 19 nt, Homo sapiens
auguguaggugaacaguca

SEQ ID NO: 1322877 - RNA, 17 nt, Homo sapiens
auguguucauucuggaa

SEQ ID NO: 1322878 - RNA, 13 nt, Homo sapiens
auguuaacacuca

SEQ ID NO: 1322879 - RNA, 21 nt, Homo sapiens
auguuaauuuuuugguacaaa

SEQ ID NO: 1322880 - RNA, 15 nt, Homo sapiens
auguuacugccuuaa

SEQ ID NO: 1322881 - RNA, 18 nt, Homo sapiens
auguuagccacaguguau

SEQ ID NO: 1322882 - RNA, 22 nt, Homo sapiens
auguuauagaacuucauggauc

SEQ ID NO: 1322883 - RNA, 13 nt, Homo sapiens
auguuaugcauaa

SEQ ID NO: 1322884 - RNA, 14 nt, Homo sapiens
auguucucuaucau

SEQ ID NO: 1322885 - RNA, 17 nt, Homo sapiens
auguucucugaggacac

SEQ ID NO: 1322886 - RNA, 13 nt, Homo sapiens
auguucugcuuuc

SEQ ID NO: 1322887 - RNA, 16 nt, Homo sapiens
auguucugggacacag

SEQ ID NO: 1322888 - RNA, 15 nt, Homo sapiens
auguugaucauguac

SEQ ID NO: 1322889 - RNA, 17 nt, Homo sapiens
auguuggggcccugugc

SEQ ID NO: 1322890 - RNA, 18 nt, Homo sapiens
auguugguuuuaauacuu

SEQ ID NO: 1322891 - RNA, 22 nt, Homo sapiens
auguuguguuucuguucaccuu

SEQ ID NO: 1322892 - RNA, 14 nt, Homo sapiens
auguuuccccagac

SEQ ID NO: 1322893 - RNA, 16 nt, Homo sapiens
auguuugcacuuguga

SEQ ID NO: 1322894 - RNA, 17 nt, Homo sapiens
auguuuuaagcugcuaa

SEQ ID NO: 1322895 - RNA, 20 nt, Homo sapiens
auguuuuuuuucugcuggaa

SEQ ID NO: 1322896 - RNA, 18 nt, Homo sapiens
auuaaaaagugugacuuu

SEQ ID NO: 1322897 - RNA, 15 nt, Homo sapiens
auuaaaacuauucau

SEQ ID NO: 1322898 - RNA, 20 nt, Homo sapiens
auuaaaagaugucucugcaa

SEQ ID NO: 1322899 - RNA, 22 nt, Homo sapiens
auuaaaagaugucucugcaaac

SEQ ID NO: 1322900 - RNA, 19 nt, Homo sapiens
auuaaaauguuaagcugcu

SEQ ID NO: 1322901 - RNA, 18 nt, Homo sapiens
auuaacaugauguacuaa

SEQ ID NO: 1322902 - RNA, 19 nt, Homo sapiens
auuaacaugauguacuaaa

SEQ ID NO: 1322903 - RNA, 15 nt, Homo sapiens
auuaacuuacuucca

SEQ ID NO: 1322904 - RNA, 21 nt, Homo sapiens
auuaaggauguagcuuuucac

SEQ ID NO: 1322905 - RNA, 11 nt, Homo sapiens
auuaaggggau

SEQ ID NO: 1322906 - RNA, 13 nt, Homo sapiens
auuaaggucauua

SEQ ID NO: 1322907 - RNA, 13 nt, Homo sapiens
auuaauauuugcu

SEQ ID NO: 1322908 - RNA, 20 nt, Homo sapiens
auuaaucaaaccacuguuau

SEQ ID NO: 1322909 - RNA, 18 nt, Homo sapiens
auuaauucauccaauacc

SEQ ID NO: 1322910 - RNA, 14 nt, Homo sapiens
auuaauugcugcaa

SEQ ID NO: 1322911 - RNA, 20 nt, Homo sapiens
auuaauuuugauauaaucuu

SEQ ID NO: 1322912 - RNA, 23 nt, Homo sapiens
auuaauuuuuaaggauguugcca

SEQ ID NO: 1322913 - RNA, 14 nt, Homo sapiens
auuacaauugugag

SEQ ID NO: 1322914 - RNA, 18 nt, Homo sapiens
auuacauggggucuagaa

SEQ ID NO: 1322915 - RNA, 15 nt, Homo sapiens
auuacccaaacccau

SEQ ID NO: 1322916 - RNA, 17 nt, Homo sapiens
auuaccgcguuguaaaa

SEQ ID NO: 1322917 - RNA, 16 nt, Homo sapiens
auuacucucaaccacc

SEQ ID NO: 1322918 - RNA, 23 nt, Homo sapiens
auuacugaguuuuuuauuccagu

SEQ ID NO: 1322919 - RNA, 19 nt, Homo sapiens
auuagaaaaauagcaacuu

SEQ ID NO: 1322920 - RNA, 18 nt, Homo sapiens
auuagaaguuaccaaauu

SEQ ID NO: 1322921 - RNA, 18 nt, Homo sapiens
auuagaggucuccaaaau

SEQ ID NO: 1322922 - RNA, 13 nt, Homo sapiens
auuagccaaggau

SEQ ID NO: 1322923 - RNA, 13 nt, Homo sapiens
auuagccaggugu

SEQ ID NO: 1322924 - RNA, 19 nt, Homo sapiens
auuagccaguaccagcuuu

SEQ ID NO: 1322925 - RNA, 18 nt, Homo sapiens
auuaggcagacucuuuau

SEQ ID NO: 1322926 - RNA, 22 nt, Homo sapiens
auuagugccacaaauaaguuac

SEQ ID NO: 1322927 - RNA, 13 nt, Homo sapiens
auuaguugcacua

SEQ ID NO: 1322928 - RNA, 13 nt, Homo sapiens
auuauauuugaca

SEQ ID NO: 1322929 - RNA, 13 nt, Homo sapiens
auuaucaacagca

SEQ ID NO: 1322930 - RNA, 13 nt, Homo sapiens
auuaucaugcaaa

SEQ ID NO: 1322931 - RNA, 16 nt, Homo sapiens
auuauccuucuacuug

SEQ ID NO: 1322932 - RNA, 19 nt, Homo sapiens
auuauggggacuuugguuu

SEQ ID NO: 1322933 - RNA, 18 nt, Homo sapiens
auuauguuaaacuagcau

SEQ ID NO: 1322934 - RNA, 18 nt, Homo sapiens
auuauuaaaagaugucuc

SEQ ID NO: 1322935 - RNA, 19 nt, Homo sapiens
auuauuuaugugaaaguca

SEQ ID NO: 1322936 - RNA, 13 nt, Homo sapiens
auuauuuuuacag

SEQ ID NO: 1322937 - RNA, 16 nt, Homo sapiens
auucaaagagcuugaa

SEQ ID NO: 1322938 - RNA, 21 nt, Homo sapiens
auucaaauugacugaagcaaa

SEQ ID NO: 1322939 - RNA, 20 nt, Homo sapiens
auucacacaccccucaaaaa

SEQ ID NO: 1322940 - RNA, 15 nt, Homo sapiens
auucacauaauaaac

SEQ ID NO: 1322941 - RNA, 22 nt, Homo sapiens
auucaccugcccugugcauguc

SEQ ID NO: 1322942 - RNA, 22 nt, Homo sapiens
auucaccuuccagugucucgga

SEQ ID NO: 1322943 - RNA, 12 nt, Homo sapiens
auucagacacuu

SEQ ID NO: 1322944 - RNA, 14 nt, Homo sapiens
auucagcucugcaa

SEQ ID NO: 1322945 - RNA, 17 nt, Homo sapiens
auucagcucugcaagaa

SEQ ID NO: 1322946 - RNA, 17 nt, Homo sapiens
auucaguuuucauuugg

SEQ ID NO: 1322947 - RNA, 15 nt, Homo sapiens
auucauacauuaucu

SEQ ID NO: 1322948 - RNA, 19 nt, Homo sapiens
auucauauauugcauuucu

SEQ ID NO: 1322949 - RNA, 17 nt, Homo sapiens
auucaucucaaggaaua

SEQ ID NO: 1322950 - RNA, 16 nt, Homo sapiens
auucauuuaacagagc

SEQ ID NO: 1322951 - RNA, 16 nt, Homo sapiens
auuccagaaugaucau

SEQ ID NO: 1322952 - RNA, 22 nt, Homo sapiens
auuccagccacuggcugcuaac

SEQ ID NO: 1322953 - RNA, 23 nt, Homo sapiens
auuccccuguagcagucacugac

SEQ ID NO: 1322954 - RNA, 22 nt, Homo sapiens
auucccuuuuaacccaguguac

SEQ ID NO: 1322955 - RNA, 20 nt, Homo sapiens
auuccgucaccacgacuggc

SEQ ID NO: 1322956 - RNA, 19 nt, Homo sapiens
auuccuauauaguuuauug

SEQ ID NO: 1322957 - RNA, 17 nt, Homo sapiens
auuccucagaaaccaaa

SEQ ID NO: 1322958 - RNA, 21 nt, Homo sapiens
auuccuucgaaaggccuucag

SEQ ID NO: 1322959 - RNA, 14 nt, Homo sapiens
auuccuugcacaua

SEQ ID NO: 1322960 - RNA, 18 nt, Homo sapiens
caagauauaauggauaau

SEQ ID NO: 1322961 - RNA, 15 nt, Homo sapiens
caagaucuguaaugu

SEQ ID NO: 1322962 - RNA, 19 nt, Homo sapiens
caagcaagcucccaaggga

SEQ ID NO: 1322963 - RNA, 21 nt, Homo sapiens
caagcaagcucccaagggaug

SEQ ID NO: 1322964 - RNA, 20 nt, Homo sapiens
caagcaagggucuccuucaa

SEQ ID NO: 1322965 - RNA, 18 nt, Homo sapiens
caagcagccaagcuccuu

SEQ ID NO: 1322966 - RNA, 15 nt, Homo sapiens
caagcagccaaggga

SEQ ID NO: 1322967 - RNA, 22 nt, Homo sapiens
caagcauguaacuuauauuaau

SEQ ID NO: 1322968 - RNA, 23 nt, Homo sapiens
caagccagccuugcuccuggcug

SEQ ID NO: 1322969 - RNA, 16 nt, Homo sapiens
caagccugugcaaaaa

SEQ ID NO: 1322970 - RNA, 13 nt, Homo sapiens
caagcgauucucc

SEQ ID NO: 1322971 - RNA, 11 nt, Homo sapiens
caagcucugcu

SEQ ID NO: 1322972 - RNA, 12 nt, Homo sapiens
caagcugccucc

SEQ ID NO: 1322973 - RNA, 16 nt, Homo sapiens
caaggaaaccacagcu

SEQ ID NO: 1322974 - RNA, 20 nt, Homo sapiens
caaggagggcagaucacuuc

SEQ ID NO: 1322975 - RNA, 21 nt, Homo sapiens
caaggaggguguaauggagca

SEQ ID NO: 1322976 - RNA, 18 nt, Homo sapiens
caaggcaaagacuauucc

SEQ ID NO: 1322977 - RNA, 13 nt, Homo sapiens
caaggcacugccu

SEQ ID NO: 1322978 - RNA, 14 nt, Homo sapiens
caaggcacugccug

SEQ ID NO: 1322979 - RNA, 11 nt, Homo sapiens
caaggccuuca

SEQ ID NO: 1322980 - RNA, 23 nt, Homo sapiens
caaggcggguggaucacuugaga

SEQ ID NO: 1322981 - RNA, 20 nt, Homo sapiens
caaggcugcuuagaauccaa

SEQ ID NO: 1322982 - RNA, 15 nt, Homo sapiens
caaggcuucagucuc

SEQ ID NO: 1322983 - RNA, 16 nt, Homo sapiens
caagggacccaugagu

SEQ ID NO: 1322984 - RNA, 21 nt, Homo sapiens
caagggcuuuguuuugcacac

SEQ ID NO: 1322985 - RNA, 12 nt, Homo sapiens
caagguaaaaag

SEQ ID NO: 1322986 - RNA, 17 nt, Homo sapiens
caaggugacauuuccau

SEQ ID NO: 1322987 - RNA, 14 nt, Homo sapiens
caaguaaguaugaa

SEQ ID NO: 1322988 - RNA, 15 nt, Homo sapiens
caaguagcugcuacc

SEQ ID NO: 1322989 - RNA, 19 nt, Homo sapiens
caagucaagccuagccuga

SEQ ID NO: 1322990 - RNA, 16 nt, Homo sapiens
caagucccuuugugac

SEQ ID NO: 1322991 - RNA, 20 nt, Homo sapiens
caagugcucagggaaauggc

SEQ ID NO: 1322992 - RNA, 22 nt, Homo sapiens
caaguggaccuuaggccuuccu

SEQ ID NO: 1322993 - RNA, 17 nt, Homo sapiens
caaguguuaaaacugaa

SEQ ID NO: 1322994 - RNA, 16 nt, Homo sapiens
caaguguucacaaccu

SEQ ID NO: 1322995 - RNA, 19 nt, Homo sapiens
caaguugguaaauucacaa

SEQ ID NO: 1322996 - RNA, 16 nt, Homo sapiens
caaguuguguuugaua

SEQ ID NO: 1322997 - RNA, 14 nt, Homo sapiens
caauaaaaguguga

SEQ ID NO: 1322998 - RNA, 15 nt, Homo sapiens
caauaaagccuucaa

SEQ ID NO: 1322999 - RNA, 22 nt, Homo sapiens
caauaaauacagaaaagucaua

SEQ ID NO: 1323000 - RNA, 21 nt, Homo sapiens
caauagaaggauguacauuuc

SEQ ID NO: 1323001 - RNA, 18 nt, Homo sapiens
caauauagcaagauccca

SEQ ID NO: 1323002 - RNA, 14 nt, Homo sapiens
caauaugccagcuu

SEQ ID NO: 1323003 - RNA, 13 nt, Homo sapiens
caauaugugccaa

SEQ ID NO: 1323004 - RNA, 14 nt, Homo sapiens
caaucaaaugucug

SEQ ID NO: 1323005 - RNA, 22 nt, Homo sapiens
caaucaacagaaaagcuguaaa

SEQ ID NO: 1323006 - RNA, 13 nt, Homo sapiens
caaucacugccaa

SEQ ID NO: 1323007 - RNA, 17 nt, Homo sapiens
caaucagugcuccugua

SEQ ID NO: 1323008 - RNA, 17 nt, Homo sapiens
caaucaugaaauaugca

SEQ ID NO: 1323009 - RNA, 18 nt, Homo sapiens
caaucauguaaaucuaua

SEQ ID NO: 1323010 - RNA, 15 nt, Homo sapiens
caauccuagugcuuu

SEQ ID NO: 1323011 - RNA, 20 nt, Homo sapiens
caaugauccuguauucagac

SEQ ID NO: 1323012 - RNA, 14 nt, Homo sapiens
caaugcacugagug

SEQ ID NO: 1323013 - RNA, 22 nt, Homo sapiens
caaugcuaccgccccaaaguaa

SEQ ID NO: 1323014 - RNA, 22 nt, Homo sapiens
caauggauauuuguacuguuua

SEQ ID NO: 1323015 - RNA, 19 nt, Homo sapiens
caaugggagcugaggccac

SEQ ID NO: 1323016 - RNA, 21 nt, Homo sapiens
caauggggauguuguguuucu

SEQ ID NO: 1323017 - RNA, 14 nt, Homo sapiens
caauguaagcauac

SEQ ID NO: 1323018 - RNA, 16 nt, Homo sapiens
caauguacaccagagc

SEQ ID NO: 1323019 - RNA, 22 nt, Homo sapiens
caauguacaguugaaauaacug

SEQ ID NO: 1323020 - RNA, 20 nt, Homo sapiens
caauguauugagcaugugau

SEQ ID NO: 1323021 - RNA, 20 nt, Homo sapiens
caaugugggcagagauugga

SEQ ID NO: 1323022 - RNA, 16 nt, Homo sapiens
caauucagacaggcaa

SEQ ID NO: 1323023 - RNA, 20 nt, Homo sapiens
caauuccauuuccaguucau

SEQ ID NO: 1323024 - RNA, 14 nt, Homo sapiens
caauuccgcauuua

SEQ ID NO: 1323025 - RNA, 14 nt, Homo sapiens
caauuccucugaua

SEQ ID NO: 1323026 - RNA, 15 nt, Homo sapiens
caauuccucugggaa

SEQ ID NO: 1323027 - RNA, 18 nt, Homo sapiens
caauugacauaggcaaua

SEQ ID NO: 1323028 - RNA, 21 nt, Homo sapiens
caauugugcuuuguaucaguc

SEQ ID NO: 1323029 - RNA, 15 nt, Homo sapiens
caauuucagacuccc

SEQ ID NO: 1323030 - RNA, 19 nt, Homo sapiens
caauuuguuaagguucaag

SEQ ID NO: 1323031 - RNA, 18 nt, Homo sapiens
cacaaaauaaccaauccu

SEQ ID NO: 1323032 - RNA, 14 nt, Homo sapiens
cacaaauagaguuu

SEQ ID NO: 1323033 - RNA, 17 nt, Homo sapiens
cacaaaugacugcaaaa

SEQ ID NO: 1323034 - RNA, 15 nt, Homo sapiens
cacaaaugauagcau

SEQ ID NO: 1323035 - RNA, 17 nt, Homo sapiens
cacaacauuacagggaa

SEQ ID NO: 1323036 - RNA, 16 nt, Homo sapiens
cacaaccacucauuca

SEQ ID NO: 1323037 - RNA, 22 nt, Homo sapiens
cacaagacccaaguagcugcua

SEQ ID NO: 1323038 - RNA, 21 nt, Homo sapiens
cacaauagccgauaucagaau

SEQ ID NO: 1323039 - RNA, 18 nt, Homo sapiens
cacaaugcauaaugucuu

SEQ ID NO: 1323040 - RNA, 16 nt, Homo sapiens
cacaauuccauuucca

SEQ ID NO: 1323041 - RNA, 22 nt, Homo sapiens
cacaauuccauuuccaguucau

SEQ ID NO: 1323042 - RNA, 10 nt, Homo sapiens
cacacacaaa

SEQ ID NO: 1323043 - RNA, 13 nt, Homo sapiens
cacacacacaaac

SEQ ID NO: 1323044 - RNA, 21 nt, Homo sapiens
cacacaccccucaaaaaaagc

SEQ ID NO: 1323045 - RNA, 20 nt, Homo sapiens
cacacaguauuacuucugcu

SEQ ID NO: 1323046 - RNA, 21 nt, Homo sapiens
cacacccaauuccacucugau

SEQ ID NO: 1323047 - RNA, 22 nt, Homo sapiens
cacacccagcccacuucugcca

SEQ ID NO: 1323048 - RNA, 14 nt, Homo sapiens
cacacccuccccau

SEQ ID NO: 1323049 - RNA, 14 nt, Homo sapiens
cacacucagcacaa

SEQ ID NO: 1323050 - RNA, 13 nt, Homo sapiens
cacacuuacugua

SEQ ID NO: 1323051 - RNA, 21 nt, Homo sapiens
cacacuucaguauagcauugg

SEQ ID NO: 1323052 - RNA, 17 nt, Homo sapiens
cacagaagcacaugcac

SEQ ID NO: 1323053 - RNA, 14 nt, Homo sapiens
cacagaagggugug

SEQ ID NO: 1323054 - RNA, 22 nt, Homo sapiens
cacagaaggguguggcauuugg

SEQ ID NO: 1323055 - RNA, 15 nt, Homo sapiens
cacagaaguccugua

SEQ ID NO: 1323056 - RNA, 14 nt, Homo sapiens
cacagacauacaau

SEQ ID NO: 1323057 - RNA, 20 nt, Homo sapiens
cacagagcaggacugcacag

SEQ ID NO: 1323058 - RNA, 22 nt, Homo sapiens
cacagaugccuggguugcugcu

SEQ ID NO: 1323059 - RNA, 19 nt, Homo sapiens
cacagauuuccucucuaaa

SEQ ID NO: 1323060 - RNA, 17 nt, Homo sapiens
cacagauuugcauuuca

SEQ ID NO: 1323061 - RNA, 19 nt, Homo sapiens
cacagccaccccugagauc

SEQ ID NO: 1323062 - RNA, 15 nt, Homo sapiens
cacagccaucaaggg

SEQ ID NO: 1323063 - RNA, 17 nt, Homo sapiens
cacagccuccccugcca

SEQ ID NO: 1323064 - RNA, 17 nt, Homo sapiens
cacagcggagucugucc

SEQ ID NO: 1323065 - RNA, 14 nt, Homo sapiens
cacagcguccuguc

SEQ ID NO: 1323066 - RNA, 20 nt, Homo sapiens
cacagcugaacuuguugaga

SEQ ID NO: 1323067 - RNA, 20 nt, Homo sapiens
cacagcugcuggagacuccu

SEQ ID NO: 1323068 - RNA, 12 nt, Homo sapiens
cacaggacacag

SEQ ID NO: 1323069 - RNA, 15 nt, Homo sapiens
cacaggacacaguca

SEQ ID NO: 1323070 - RNA, 18 nt, Homo sapiens
cacaggcagguccagggu

SEQ ID NO: 1323071 - RNA, 16 nt, Homo sapiens
cacagggauguacaag

SEQ ID NO: 1323072 - RNA, 15 nt, Homo sapiens
cacagggcaauugag

SEQ ID NO: 1323073 - RNA, 17 nt, Homo sapiens
cacagggcaccugccac

SEQ ID NO: 1323074 - RNA, 15 nt, Homo sapiens
cacaguaagucauuu

SEQ ID NO: 1323075 - RNA, 16 nt, Homo sapiens
cacaguagucuugaug

SEQ ID NO: 1323076 - RNA, 17 nt, Homo sapiens
cacaguccucauuuacu

SEQ ID NO: 1323077 - RNA, 11 nt, Homo sapiens
cacagugcaua

SEQ ID NO: 1323078 - RNA, 23 nt, Homo sapiens
cacaguucuuugggccagacaug

SEQ ID NO: 1323079 - RNA, 17 nt, Homo sapiens
cacauccacacagccaa

SEQ ID NO: 1323080 - RNA, 18 nt, Homo sapiens
cacauccacacagccaau

SEQ ID NO: 1323081 - RNA, 15 nt, Homo sapiens
cacauccaucagcac

SEQ ID NO: 1323082 - RNA, 17 nt, Homo sapiens
cacaugaaaccuacaca

SEQ ID NO: 1323083 - RNA, 19 nt, Homo sapiens
cacaugcacgugugugcac

SEQ ID NO: 1323084 - RNA, 16 nt, Homo sapiens
cacaugccaagcacug

SEQ ID NO: 1323085 - RNA, 15 nt, Homo sapiens
cacaugcuacaagac

SEQ ID NO: 1323086 - RNA, 13 nt, Homo sapiens
cacaugcuauguu

SEQ ID NO: 1323087 - RNA, 17 nt, Homo sapiens
cacauggaggacccaac

SEQ ID NO: 1323088 - RNA, 22 nt, Homo sapiens
cacauggaggacccaacaggag

SEQ ID NO: 1323089 - RNA, 22 nt, Homo sapiens
cacaugggcagaaaaauggugg

SEQ ID NO: 1323090 - RNA, 21 nt, Homo sapiens
cacauguaucacccccaaaaa

SEQ ID NO: 1323091 - RNA, 17 nt, Homo sapiens
cacaugucaguaccuuc

SEQ ID NO: 1323092 - RNA, 17 nt, Homo sapiens
cacaugugcacaugcac

SEQ ID NO: 1323093 - RNA, 19 nt, Homo sapiens
gccacacccuccccauuca

SEQ ID NO: 1323094 - RNA, 12 nt, Homo sapiens
gccacacucugg

SEQ ID NO: 1323095 - RNA, 13 nt, Homo sapiens
gccacagcagcuu

SEQ ID NO: 1323096 - RNA, 22 nt, Homo sapiens
gccaccacccuacuucauuuuc

SEQ ID NO: 1323097 - RNA, 19 nt, Homo sapiens
gccaccccacagcucuuuc

SEQ ID NO: 1323098 - RNA, 22 nt, Homo sapiens
gccacccugcauuugugucauu

SEQ ID NO: 1323099 - RNA, 23 nt, Homo sapiens
gccaccucccuauacugcuugga

SEQ ID NO: 1323100 - RNA, 16 nt, Homo sapiens
gccacgaggugcaaca

SEQ ID NO: 1323101 - RNA, 22 nt, Homo sapiens
gccacgugggcaaacaggcagu

SEQ ID NO: 1323102 - RNA, 20 nt, Homo sapiens
gccacugggcccugagccag

SEQ ID NO: 1323103 - RNA, 18 nt, Homo sapiens
gccacugguuucucagaa

SEQ ID NO: 1323104 - RNA, 16 nt, Homo sapiens
gccacuguuugucuca

SEQ ID NO: 1323105 - RNA, 20 nt, Homo sapiens
gccacuguuugucucaccua

SEQ ID NO: 1323106 - RNA, 19 nt, Homo sapiens
gccacuuuugugugugucu

SEQ ID NO: 1323107 - RNA, 13 nt, Homo sapiens
gccagaacuugac

SEQ ID NO: 1323108 - RNA, 17 nt, Homo sapiens
gccagagauaaacuaau

SEQ ID NO: 1323109 - RNA, 17 nt, Homo sapiens
gccagagauccaaaaga

SEQ ID NO: 1323110 - RNA, 16 nt, Homo sapiens
gccagaggacugugau

SEQ ID NO: 1323111 - RNA, 13 nt, Homo sapiens
gccagaggcaccu

SEQ ID NO: 1323112 - RNA, 16 nt, Homo sapiens
gccagaggcaccucaa

SEQ ID NO: 1323113 - RNA, 17 nt, Homo sapiens
gccagccggcuaugaaa

SEQ ID NO: 1323114 - RNA, 15 nt, Homo sapiens
gccagcugcacugau

SEQ ID NO: 1323115 - RNA, 17 nt, Homo sapiens
gccagcuuaucucaggg

SEQ ID NO: 1323116 - RNA, 23 nt, Homo sapiens
gccaggccagagggagugacaga

SEQ ID NO: 1323117 - RNA, 14 nt, Homo sapiens
gccagggucucacu

SEQ ID NO: 1323118 - RNA, 22 nt, Homo sapiens
gccaguaaacagaggaguacag

SEQ ID NO: 1323119 - RNA, 20 nt, Homo sapiens
gccauaaaacauuaagaaaa

SEQ ID NO: 1323120 - RNA, 22 nt, Homo sapiens
gccaugagaugauacauccaaa

SEQ ID NO: 1323121 - RNA, 14 nt, Homo sapiens
gccauucucuugca

SEQ ID NO: 1323122 - RNA, 22 nt, Homo sapiens
gcccaagcuucccuccaucccc

SEQ ID NO: 1323123 - RNA, 16 nt, Homo sapiens
gcccacuucugccaua

SEQ ID NO: 1323124 - RNA, 17 nt, Homo sapiens
gcccagaaagucucuca

SEQ ID NO: 1323125 - RNA, 15 nt, Homo sapiens
gcccagagcccagcu

SEQ ID NO: 1323126 - RNA, 15 nt, Homo sapiens
gcccagcacaggaau

SEQ ID NO: 1323127 - RNA, 21 nt, Homo sapiens
gcccagcagcuccuguggcca

SEQ ID NO: 1323128 - RNA, 17 nt, Homo sapiens
gcccaggaaacaagggg

SEQ ID NO: 1323129 - RNA, 20 nt, Homo sapiens
gcccaggcuggaguggagug

SEQ ID NO: 1323130 - RNA, 20 nt, Homo sapiens
gcccaggcuggcgugcagug

SEQ ID NO: 1323131 - RNA, 17 nt, Homo sapiens
gcccagucgacgucagc

SEQ ID NO: 1323132 - RNA, 14 nt, Homo sapiens
gcccauaaccagua

SEQ ID NO: 1323133 - RNA, 18 nt, Homo sapiens
gcccauccccaggcaccu

SEQ ID NO: 1323134 - RNA, 19 nt, Homo sapiens
gcccauccgugcuaugaca

SEQ ID NO: 1323135 - RNA, 19 nt, Homo sapiens
gcccaugaugagaagcaga

SEQ ID NO: 1323136 - RNA, 13 nt, Homo sapiens
gcccaugguacuc

SEQ ID NO: 1323137 - RNA, 21 nt, Homo sapiens
gcccauggugagcucugggaa

SEQ ID NO: 1323138 - RNA, 18 nt, Homo sapiens
gccccaauucaauccugc

SEQ ID NO: 1323139 - RNA, 23 nt, Homo sapiens
gccccaauucaauccugccaaua

SEQ ID NO: 1323140 - RNA, 15 nt, Homo sapiens
gccccacauugcacu

SEQ ID NO: 1323141 - RNA, 16 nt, Homo sapiens
gccccagcacauggaa

SEQ ID NO: 1323142 - RNA, 16 nt, Homo sapiens
gccccaggcauugcca

SEQ ID NO: 1323143 - RNA, 17 nt, Homo sapiens
gccccaucugugcauuc

SEQ ID NO: 1323144 - RNA, 13 nt, Homo sapiens
gcccccacugacc

SEQ ID NO: 1323145 - RNA, 13 nt, Homo sapiens
gcccccauuucac

SEQ ID NO: 1323146 - RNA, 22 nt, Homo sapiens
gccccucuccuccguggcacau

SEQ ID NO: 1323147 - RNA, 11 nt, Homo sapiens
gccccuggacg

SEQ ID NO: 1323148 - RNA, 22 nt, Homo sapiens
gccccugggguggccaccagua

SEQ ID NO: 1323149 - RNA, 20 nt, Homo sapiens
gccccugucgucaggaccuc

SEQ ID NO: 1323150 - RNA, 22 nt, Homo sapiens
gccccuuacuaugaucucagga

SEQ ID NO: 1323151 - RNA, 15 nt, Homo sapiens
gcccuagacuggcug

SEQ ID NO: 1323152 - RNA, 21 nt, Homo sapiens
gcccucaccccugguucucau

SEQ ID NO: 1323153 - RNA, 17 nt, Homo sapiens
gcccuccuuagaccuga

SEQ ID NO: 1323154 - RNA, 16 nt, Homo sapiens
gcccugccaugcucuc

SEQ ID NO: 1323155 - RNA, 13 nt, Homo sapiens
gcccugcccucac

SEQ ID NO: 1323156 - RNA, 13 nt, Homo sapiens
gcccuggcaccug

SEQ ID NO: 1323157 - RNA, 22 nt, Homo sapiens
gcccuggcaggcagguguuuau

SEQ ID NO: 1323158 - RNA, 16 nt, Homo sapiens
gcccuucauugccaca

SEQ ID NO: 1323159 - RNA, 20 nt, Homo sapiens
gcccuuguccaaaccugggc

SEQ ID NO: 1323160 - RNA, 20 nt, Homo sapiens
gcccuuucauggucugcuga

SEQ ID NO: 1323161 - RNA, 15 nt, Homo sapiens
gccgaguccaagcug

SEQ ID NO: 1323162 - RNA, 13 nt, Homo sapiens
gccgcuaccuccc

SEQ ID NO: 1323163 - RNA, 15 nt, Homo sapiens
gccggaggccagcua

SEQ ID NO: 1323164 - RNA, 21 nt, Homo sapiens
gccgggcuuuuccaagcugcc

SEQ ID NO: 1323165 - RNA, 20 nt, Homo sapiens
gccgugauuuucauugcugg

SEQ ID NO: 1323166 - RNA, 23 nt, Homo sapiens
gccguuugagaagaaaacaucua

SEQ ID NO: 1323167 - RNA, 13 nt, Homo sapiens
gccuaacacuggg

SEQ ID NO: 1323168 - RNA, 16 nt, Homo sapiens
gccuaaggugucugag

SEQ ID NO: 1323169 - RNA, 19 nt, Homo sapiens
gccuacaggagugagcacu

SEQ ID NO: 1323170 - RNA, 16 nt, Homo sapiens
gccuacuucugagcaa

SEQ ID NO: 1323171 - RNA, 16 nt, Homo sapiens
gccuauagacacuuau

SEQ ID NO: 1323172 - RNA, 16 nt, Homo sapiens
gccuaucagcauuuua

SEQ ID NO: 1323173 - RNA, 15 nt, Homo sapiens
gccucagccagagaa

SEQ ID NO: 1323174 - RNA, 21 nt, Homo sapiens
gccuccaggagccuacccccu

SEQ ID NO: 1323175 - RNA, 21 nt, Homo sapiens
gccuccccucuccuuccugug

SEQ ID NO: 1323176 - RNA, 16 nt, Homo sapiens
gccucccgaguagcug

SEQ ID NO: 1323177 - RNA, 18 nt, Homo sapiens
gccuccuggcccagguga

SEQ ID NO: 1323178 - RNA, 19 nt, Homo sapiens
gccuccuggcccaggugag

SEQ ID NO: 1323179 - RNA, 20 nt, Homo sapiens
gccucuacuuugauucugau

SEQ ID NO: 1323180 - RNA, 22 nt, Homo sapiens
gccucuccuguauuuaacaaaa

SEQ ID NO: 1323181 - RNA, 21 nt, Homo sapiens
gccucucugcuccaccuugug

SEQ ID NO: 1323182 - RNA, 16 nt, Homo sapiens
gccucuuucacauuga

SEQ ID NO: 1323183 - RNA, 20 nt, Homo sapiens
gccucuuuuaccugcugcuu

SEQ ID NO: 1323184 - RNA, 21 nt, Homo sapiens
gccugaaacuuugaggauaac

SEQ ID NO: 1323185 - RNA, 17 nt, Homo sapiens
gccugaagaacaguaac

SEQ ID NO: 1323186 - RNA, 15 nt, Homo sapiens
gccugaagucacaca

SEQ ID NO: 1323187 - RNA, 23 nt, Homo sapiens
gccugaggccagccugcgggaag

SEQ ID NO: 1323188 - RNA, 14 nt, Homo sapiens
gccugaugcugaca

SEQ ID NO: 1323189 - RNA, 18 nt, Homo sapiens
gccugaugcugacauuca

SEQ ID NO: 1323190 - RNA, 20 nt, Homo sapiens
gccugcauguaaacacgccu

SEQ ID NO: 1323191 - RNA, 20 nt, Homo sapiens
gccugcccguaaacacgccu

SEQ ID NO: 1323192 - RNA, 18 nt, Homo sapiens
gccugccgguaaacacgc

SEQ ID NO: 1323193 - RNA, 22 nt, Homo sapiens
gccugccuuaccgagagccaaa

SEQ ID NO: 1323194 - RNA, 14 nt, Homo sapiens
gccugcugcacuuc

SEQ ID NO: 1323195 - RNA, 15 nt, Homo sapiens
gccugcugcacuucc

SEQ ID NO: 1323196 - RNA, 13 nt, Homo sapiens
gccugcugguuuu

SEQ ID NO: 1323197 - RNA, 14 nt, Homo sapiens
gccuggacccugug

SEQ ID NO: 1323198 - RNA, 21 nt, Homo sapiens
gccuggagcccuccgccuuca

SEQ ID NO: 1323199 - RNA, 20 nt, Homo sapiens
gccuggccaauacggcaaaa

SEQ ID NO: 1323200 - RNA, 18 nt, Homo sapiens
gccuggccggcuccaguu

SEQ ID NO: 1323201 - RNA, 17 nt, Homo sapiens
gccuggggaccaggugc

SEQ ID NO: 1323202 - RNA, 22 nt, Homo sapiens
gccugggguggggucaugcccu

SEQ ID NO: 1323203 - RNA, 20 nt, Homo sapiens
gccugucugccccagcccag

SEQ ID NO: 1323204 - RNA, 22 nt, Homo sapiens
gccugugacugaggcggagccc

SEQ ID NO: 1323205 - RNA, 20 nt, Homo sapiens
gccuucacauuccccugggg

SEQ ID NO: 1323206 - RNA, 14 nt, Homo sapiens
gccuucauucugca

SEQ ID NO: 1323207 - RNA, 18 nt, Homo sapiens
gccuuccagaaaacaaaa

SEQ ID NO: 1323208 - RNA, 15 nt, Homo sapiens
gccuucucaccagcu

SEQ ID NO: 1323209 - RNA, 17 nt, Homo sapiens
gccuuggaggacccagc

SEQ ID NO: 1323210 - RNA, 18 nt, Homo sapiens
gccuuggaggacccagca

SEQ ID NO: 1323211 - RNA, 22 nt, Homo sapiens
gccuuggagucgucuggcaucu

SEQ ID NO: 1323212 - RNA, 17 nt, Homo sapiens
gccuugggggugugaug

SEQ ID NO: 1323213 - RNA, 17 nt, Homo sapiens
gccuuguugauguggac

SEQ ID NO: 1323214 - RNA, 16 nt, Homo sapiens
gccuuuagaaauuaua

SEQ ID NO: 1323215 - RNA, 21 nt, Homo sapiens
gccuuuauuuuuaaccugcca

SEQ ID NO: 1323216 - RNA, 18 nt, Homo sapiens
gccuuuggucuccuggau

SEQ ID NO: 1323217 - RNA, 20 nt, Homo sapiens
gcgagcccugguggcagugg

SEQ ID NO: 1323218 - RNA, 16 nt, Homo sapiens
gcgaugucacccgugu

SEQ ID NO: 1323219 - RNA, 14 nt, Homo sapiens
gcgcaagaccagcu

SEQ ID NO: 1323220 - RNA, 20 nt, Homo sapiens
gcgcaauugaaggaucaucu

SEQ ID NO: 1323221 - RNA, 13 nt, Homo sapiens
gcgccacaggacc

SEQ ID NO: 1323222 - RNA, 19 nt, Homo sapiens
gcgcccaguccuuccaccu

SEQ ID NO: 1323223 - RNA, 20 nt, Homo sapiens
gcgccgcaaaccacacugga

SEQ ID NO: 1323224 - RNA, 15 nt, Homo sapiens
ggaaaccacagcugc

SEQ ID NO: 1323225 - RNA, 18 nt, Homo sapiens
ggaaagacagcuucucau

SEQ ID NO: 1323226 - RNA, 17 nt, Homo sapiens
ggaaaggugguguuucu

SEQ ID NO: 1323227 - RNA, 21 nt, Homo sapiens
ggaaauauuaacaauguuuau

SEQ ID NO: 1323228 - RNA, 23 nt, Homo sapiens
ggaaauguucuuuagaugguggc

SEQ ID NO: 1323229 - RNA, 14 nt, Homo sapiens
ggaacacggccaca

SEQ ID NO: 1323230 - RNA, 12 nt, Homo sapiens
ggaacauuucag

SEQ ID NO: 1323231 - RNA, 22 nt, Homo sapiens
ggaacccccagaauaaauaugc

SEQ ID NO: 1323232 - RNA, 14 nt, Homo sapiens
ggaacuaugcagug

SEQ ID NO: 1323233 - RNA, 16 nt, Homo sapiens
ggaacucuagccaaau

SEQ ID NO: 1323234 - RNA, 19 nt, Homo sapiens
ggaacuuuuauuacugggg

SEQ ID NO: 1323235 - RNA, 19 nt, Homo sapiens
ggaagaagacuguuuccaa

SEQ ID NO: 1323236 - RNA, 16 nt, Homo sapiens
ggaagauuuucauuga

SEQ ID NO: 1323237 - RNA, 22 nt, Homo sapiens
ggaagccucccacgacugcccg

SEQ ID NO: 1323238 - RNA, 17 nt, Homo sapiens
ggaagcucuucuuccca

SEQ ID NO: 1323239 - RNA, 22 nt, Homo sapiens
ggaaggaggccaagcagugccu

SEQ ID NO: 1323240 - RNA, 11 nt, Homo sapiens
ggaaggugacu

SEQ ID NO: 1323241 - RNA, 17 nt, Homo sapiens
ggaagucuaaauauuca

SEQ ID NO: 1323242 - RNA, 22 nt, Homo sapiens
ggaauaauccuaaacauaugaa

SEQ ID NO: 1323243 - RNA, 23 nt, Homo sapiens
ggaaucagaacucaaauggggcc

SEQ ID NO: 1323244 - RNA, 23 nt, Homo sapiens
ggaaucagugaagccaaagggac

SEQ ID NO: 1323245 - RNA, 17 nt, Homo sapiens
ggaauccagacccggcu

SEQ ID NO: 1323246 - RNA, 20 nt, Homo sapiens
ggaauccuuuggugccaacu

SEQ ID NO: 1323247 - RNA, 24 nt, Homo sapiens
ggaaucgguggucuccaccuguca

SEQ ID NO: 1323248 - RNA, 16 nt, Homo sapiens
ggaaucucauccauca

SEQ ID NO: 1323249 - RNA, 12 nt, Homo sapiens
ggaaugccugag

SEQ ID NO: 1323250 - RNA, 21 nt, Homo sapiens
ggaaugcugggcuguuuacuu

SEQ ID NO: 1323251 - RNA, 19 nt, Homo sapiens
ggaaugggcagcucaucuc

SEQ ID NO: 1323252 - RNA, 16 nt, Homo sapiens
ggaauuaagcaaaauc

SEQ ID NO: 1323253 - RNA, 15 nt, Homo sapiens
ggaauugauuugcau

SEQ ID NO: 1323254 - RNA, 23 nt, Homo sapiens
ggaauuuugaaaaaaaauuucaa

SEQ ID NO: 1323255 - RNA, 14 nt, Homo sapiens
ggacaaacagggaa

SEQ ID NO: 1323256 - RNA, 21 nt, Homo sapiens
ggacaacucagucccuaaaaa

SEQ ID NO: 1323257 - RNA, 20 nt, Homo sapiens
ggacacagucagauuuccag

SEQ ID NO: 1323258 - RNA, 21 nt, Homo sapiens
ggacaguaauaagaauggaaa

SEQ ID NO: 1323259 - RNA, 15 nt, Homo sapiens
ggacagugaggucac

SEQ ID NO: 1323260 - RNA, 15 nt, Homo sapiens
ggacaugaaacucca

SEQ ID NO: 1323261 - RNA, 20 nt, Homo sapiens
ggaccacgugagaucauuca

SEQ ID NO: 1323262 - RNA, 19 nt, Homo sapiens
ggaccaugcgacacuggga

SEQ ID NO: 1323263 - RNA, 20 nt, Homo sapiens
ggacccacgaaacugcccug

SEQ ID NO: 1323264 - RNA, 14 nt, Homo sapiens
ggaccccugcccuu

SEQ ID NO: 1323265 - RNA, 17 nt, Homo sapiens
ggacucaaucuacaggc

SEQ ID NO: 1323266 - RNA, 22 nt, Homo sapiens
ggacucaaugcacugacauugu

SEQ ID NO: 1323267 - RNA, 23 nt, Homo sapiens
ggacucaaugcacugacauuguu

SEQ ID NO: 1323268 - RNA, 15 nt, Homo sapiens
ggacuggaccagaca

SEQ ID NO: 1323269 - RNA, 20 nt, Homo sapiens
ggacugggugcggugacuca

SEQ ID NO: 1323270 - RNA, 15 nt, Homo sapiens
ggacuuccauuugcu

SEQ ID NO: 1323271 - RNA, 17 nt, Homo sapiens
ggagaaacgggugagcu

SEQ ID NO: 1323272 - RNA, 23 nt, Homo sapiens
ggagaagccccuacccugugagc

SEQ ID NO: 1323273 - RNA, 20 nt, Homo sapiens
ggagaaguaauccuagggaa

SEQ ID NO: 1323274 - RNA, 23 nt, Homo sapiens
ggagacaaaauauuuuccugcca

SEQ ID NO: 1323275 - RNA, 19 nt, Homo sapiens
ggagaccauuugauuuucu

SEQ ID NO: 1323276 - RNA, 15 nt, Homo sapiens
ggagaccuggcacug

SEQ ID NO: 1323277 - RNA, 14 nt, Homo sapiens
ggagaggggacgca

SEQ ID NO: 1323278 - RNA, 17 nt, Homo sapiens
ggagcaaaaagcaacuu

SEQ ID NO: 1323279 - RNA, 13 nt, Homo sapiens
ggagcaacagagg

SEQ ID NO: 1323280 - RNA, 16 nt, Homo sapiens
ggagcaucaagccacu

SEQ ID NO: 1323281 - RNA, 15 nt, Homo sapiens
ggagccccuggacau

SEQ ID NO: 1323282 - RNA, 13 nt, Homo sapiens
ggagcuccaacuc

SEQ ID NO: 1323283 - RNA, 16 nt, Homo sapiens
ggagcugccccucucu

SEQ ID NO: 1323284 - RNA, 19 nt, Homo sapiens
ggagcugccuguucagcuc

SEQ ID NO: 1323285 - RNA, 17 nt, Homo sapiens
ggaggaguuagccaaac

SEQ ID NO: 1323286 - RNA, 21 nt, Homo sapiens
ggaggauacugaggcacacag

SEQ ID NO: 1323287 - RNA, 20 nt, Homo sapiens
ggaggauggcuugcgcucag

SEQ ID NO: 1323288 - RNA, 12 nt, Homo sapiens
ggaggauguucu

SEQ ID NO: 1323289 - RNA, 12 nt, Homo sapiens
ggaggcacuuua

SEQ ID NO: 1323290 - RNA, 16 nt, Homo sapiens
ggaggccagccaguga

SEQ ID NO: 1323291 - RNA, 21 nt, Homo sapiens
ggaggccagccagugaccuga

SEQ ID NO: 1323292 - RNA, 15 nt, Homo sapiens
ggaggcugaggcaag

SEQ ID NO: 1323293 - RNA, 18 nt, Homo sapiens
ggagggaaaagagugccu

SEQ ID NO: 1323294 - RNA, 20 nt, Homo sapiens
ggaggugaccccagguuucu

SEQ ID NO: 1323295 - RNA, 14 nt, Homo sapiens
ggaguacaggugaa

SEQ ID NO: 1323296 - RNA, 16 nt, Homo sapiens
ggaguaggacauacca

SEQ ID NO: 1323297 - RNA, 13 nt, Homo sapiens
ggagucaucucaa

SEQ ID NO: 1323298 - RNA, 15 nt, Homo sapiens
ggagucggagccacu

SEQ ID NO: 1323299 - RNA, 19 nt, Homo sapiens
ggagugagcccauggugac

SEQ ID NO: 1323300 - RNA, 15 nt, Homo sapiens
ggauacgacacaugc

SEQ ID NO: 1323301 - RNA, 18 nt, Homo sapiens
ggauauuggaaugcacag

SEQ ID NO: 1323302 - RNA, 15 nt, Homo sapiens
ggaucccucucugga

SEQ ID NO: 1323303 - RNA, 20 nt, Homo sapiens
ggaucguccuggauucacug

SEQ ID NO: 1323304 - RNA, 14 nt, Homo sapiens
ggaucuguuccuug

SEQ ID NO: 1323305 - RNA, 20 nt, Homo sapiens
ggaugauuauuuucuguucu

SEQ ID NO: 1323306 - RNA, 22 nt, Homo sapiens
ggaugauuauuuucuguucuau

SEQ ID NO: 1323307 - RNA, 17 nt, Homo sapiens
ggaugauucaagccauu

SEQ ID NO: 1323308 - RNA, 23 nt, Homo sapiens
ggaugccgagguaaaaguucuuu

SEQ ID NO: 1323309 - RNA, 15 nt, Homo sapiens
ggaugcgcagugccu

SEQ ID NO: 1323310 - RNA, 23 nt, Homo sapiens
ggauggaacacggccacaucaaa

SEQ ID NO: 1323311 - RNA, 22 nt, Homo sapiens
ggaugucuccgucucugucuca

SEQ ID NO: 1323312 - RNA, 19 nt, Homo sapiens
ggauguguuauucuugccc

SEQ ID NO: 1323313 - RNA, 19 nt, Homo sapiens
ggauuacaggugugcacca

SEQ ID NO: 1323314 - RNA, 21 nt, Homo sapiens
ggauugcuacuguccuaccca

SEQ ID NO: 1323315 - RNA, 19 nt, Homo sapiens
ggauuuccagccagggcug

SEQ ID NO: 1323316 - RNA, 17 nt, Homo sapiens
ggauuuuucuacauucu

SEQ ID NO: 1323317 - RNA, 13 nt, Homo sapiens
ggcaaaaugucau

SEQ ID NO: 1323318 - RNA, 12 nt, Homo sapiens
ggcaaacaggca

SEQ ID NO: 1323319 - RNA, 15 nt, Homo sapiens
ggcaaagccuaguga

SEQ ID NO: 1323320 - RNA, 22 nt, Homo sapiens
ggcaaccucugagccaucccag

SEQ ID NO: 1323321 - RNA, 23 nt, Homo sapiens
ggcaauugagggacugagccaga

SEQ ID NO: 1323322 - RNA, 15 nt, Homo sapiens
ggcacacacugugua

SEQ ID NO: 1323323 - RNA, 20 nt, Homo sapiens
ggcacacgccucccacuggg

SEQ ID NO: 1323324 - RNA, 19 nt, Homo sapiens
ggcacagccuuugcccaaa

SEQ ID NO: 1323325 - RNA, 18 nt, Homo sapiens
ggcaccagacacccagga

SEQ ID NO: 1323326 - RNA, 19 nt, Homo sapiens
ggcaccagacacccaggac

SEQ ID NO: 1323327 - RNA, 16 nt, Homo sapiens
ggcaccuaauccaggc

SEQ ID NO: 1323328 - RNA, 16 nt, Homo sapiens
ggcaccucucuugaac

SEQ ID NO: 1323329 - RNA, 13 nt, Homo sapiens
ggcaccuguaauc

SEQ ID NO: 1323330 - RNA, 13 nt, Homo sapiens
ggcacucauggag

SEQ ID NO: 1323331 - RNA, 13 nt, Homo sapiens
ggcacugccugau

SEQ ID NO: 1323332 - RNA, 17 nt, Homo sapiens
ggcagaaggcaguaggg

SEQ ID NO: 1323333 - RNA, 13 nt, Homo sapiens
ggcagagcuucuu

SEQ ID NO: 1323334 - RNA, 21 nt, Homo sapiens
ggcagauacugucucuuucau

SEQ ID NO: 1323335 - RNA, 18 nt, Homo sapiens
ggcagccaggcuggcaga

SEQ ID NO: 1323336 - RNA, 14 nt, Homo sapiens
ggcagcucaucucu

SEQ ID NO: 1323337 - RNA, 22 nt, Homo sapiens
ggcagcugacaguuuguggcau

SEQ ID NO: 1323338 - RNA, 15 nt, Homo sapiens
ggcagggcugugcuu

SEQ ID NO: 1323339 - RNA, 19 nt, Homo sapiens
ggcaguccuggaaucacau

SEQ ID NO: 1323340 - RNA, 23 nt, Homo sapiens
ggcagugaugcuggaugcuccuu

SEQ ID NO: 1323341 - RNA, 14 nt, Homo sapiens
ggcaguuccaggag

SEQ ID NO: 1323342 - RNA, 20 nt, Homo sapiens
ggcauacaaggggguaacuc

SEQ ID NO: 1323343 - RNA, 18 nt, Homo sapiens
ggcaucucccacacaaga

SEQ ID NO: 1323344 - RNA, 16 nt, Homo sapiens
ggcaugacacaccugg

SEQ ID NO: 1323345 - RNA, 22 nt, Homo sapiens
ggcaugcccagguucaggucac

SEQ ID NO: 1323346 - RNA, 11 nt, Homo sapiens
ggcauugcuga

SEQ ID NO: 1323347 - RNA, 22 nt, Homo sapiens
ggcauuucacaaaacagccuuu

SEQ ID NO: 1323348 - RNA, 22 nt, Homo sapiens
ggccaaggagggugagugcaag

SEQ ID NO: 1323349 - RNA, 21 nt, Homo sapiens
ggccaauuuuuccagcauuua

SEQ ID NO: 1323350 - RNA, 18 nt, Homo sapiens
ggccacggagcaguucag

SEQ ID NO: 1323351 - RNA, 16 nt, Homo sapiens
ggccacucgggggggu

SEQ ID NO: 1323352 - RNA, 11 nt, Homo sapiens
ggccacugucc

SEQ ID NO: 1323353 - RNA, 13 nt, Homo sapiens
ggccagauccagc

SEQ ID NO: 1323354 - RNA, 22 nt, Homo sapiens
ggccagcuucgagcuacaugca

SEQ ID NO: 1323355 - RNA, 20 nt, Homo sapiens
ggccaggcuggucuugaacu

SEQ ID NO: 1323356 - RNA, 21 nt, Homo sapiens
gucaccccucacugugacuga

SEQ ID NO: 1323357 - RNA, 13 nt, Homo sapiens
gucaccugcagcc

SEQ ID NO: 1323358 - RNA, 15 nt, Homo sapiens
gucacucauugcuga

SEQ ID NO: 1323359 - RNA, 16 nt, Homo sapiens
gucacugacaguuaau

SEQ ID NO: 1323360 - RNA, 19 nt, Homo sapiens
gucacuucaugcaggugaa

SEQ ID NO: 1323361 - RNA, 22 nt, Homo sapiens
gucagaacccugccauggaacu

SEQ ID NO: 1323362 - RNA, 14 nt, Homo sapiens
gucagaaguucaag

SEQ ID NO: 1323363 - RNA, 21 nt, Homo sapiens
gucagaauuagcugcuucuau

SEQ ID NO: 1323364 - RNA, 13 nt, Homo sapiens
gucagagcuaaac

SEQ ID NO: 1323365 - RNA, 18 nt, Homo sapiens
gucagcauguacuccccu

SEQ ID NO: 1323366 - RNA, 19 nt, Homo sapiens
gucaggaaaacuguuccaa

SEQ ID NO: 1323367 - RNA, 20 nt, Homo sapiens
gucagggaccccugcccuug

SEQ ID NO: 1323368 - RNA, 22 nt, Homo sapiens
gucagucugaugagaacucuga

SEQ ID NO: 1323369 - RNA, 16 nt, Homo sapiens
gucaugcuucaucauu

SEQ ID NO: 1323370 - RNA, 19 nt, Homo sapiens
gucauucuagaaacaggaa

SEQ ID NO: 1323371 - RNA, 21 nt, Homo sapiens
gucauucuuuauucuuuacua

SEQ ID NO: 1323372 - RNA, 19 nt, Homo sapiens
gucauugagcaguauauau

SEQ ID NO: 1323373 - RNA, 15 nt, Homo sapiens
gucauuggaggugaa

SEQ ID NO: 1323374 - RNA, 19 nt, Homo sapiens
gucauuggccgacaucaca

SEQ ID NO: 1323375 - RNA, 20 nt, Homo sapiens
gucauuggccgacaucacag

SEQ ID NO: 1323376 - RNA, 17 nt, Homo sapiens
guccacagggcaccugc

SEQ ID NO: 1323377 - RNA, 24 nt, Homo sapiens
guccacgagcuguuuacuagggau

SEQ ID NO: 1323378 - RNA, 22 nt, Homo sapiens
guccauuaagcugagagugcua

SEQ ID NO: 1323379 - RNA, 14 nt, Homo sapiens
gucccauccuggac

SEQ ID NO: 1323380 - RNA, 19 nt, Homo sapiens
guccccccgcugucuuuga

SEQ ID NO: 1323381 - RNA, 18 nt, Homo sapiens
guccccucuuccuacccu

SEQ ID NO: 1323382 - RNA, 13 nt, Homo sapiens
guccccuucuuuu

SEQ ID NO: 1323383 - RNA, 16 nt, Homo sapiens
gucccgugcauggguu

SEQ ID NO: 1323384 - RNA, 21 nt, Homo sapiens
gucccuucagcaccugacccu

SEQ ID NO: 1323385 - RNA, 17 nt, Homo sapiens
gucccuugcugugagca

SEQ ID NO: 1323386 - RNA, 20 nt, Homo sapiens
guccuccaacaccaagcaca

SEQ ID NO: 1323387 - RNA, 22 nt, Homo sapiens
guccucugucagucacagccac

SEQ ID NO: 1323388 - RNA, 20 nt, Homo sapiens
guccugaugcuuuugucuaa

SEQ ID NO: 1323389 - RNA, 17 nt, Homo sapiens
guccugccucagccucc

SEQ ID NO: 1323390 - RNA, 14 nt, Homo sapiens
gucgcaucucagug

SEQ ID NO: 1323391 - RNA, 15 nt, Homo sapiens
gucgcccuacucacc

SEQ ID NO: 1323392 - RNA, 14 nt, Homo sapiens
gucgugagugucuc

SEQ ID NO: 1323393 - RNA, 20 nt, Homo sapiens
gucuaaacuuuagaauuaau

SEQ ID NO: 1323394 - RNA, 22 nt, Homo sapiens
gucuaacuggggauauaauacu

SEQ ID NO: 1323395 - RNA, 18 nt, Homo sapiens
gucuauuuuuucuugaca

SEQ ID NO: 1323396 - RNA, 17 nt, Homo sapiens
gucucacaguguugccc

SEQ ID NO: 1323397 - RNA, 20 nt, Homo sapiens
gucucaugcggacccucaca

SEQ ID NO: 1323398 - RNA, 13 nt, Homo sapiens
gucucauucuguc

SEQ ID NO: 1323399 - RNA, 14 nt, Homo sapiens
gucucauucuguca

SEQ ID NO: 1323400 - RNA, 18 nt, Homo sapiens
gucucuacuaaaaauaca

SEQ ID NO: 1323401 - RNA, 22 nt, Homo sapiens
gucucuagaagugccaucucaa

SEQ ID NO: 1323402 - RNA, 22 nt, Homo sapiens
gucucucucucucucucucuuu

SEQ ID NO: 1323403 - RNA, 18 nt, Homo sapiens
gucucucugucucucugu

SEQ ID NO: 1323404 - RNA, 13 nt, Homo sapiens
gucucugugagac

SEQ ID NO: 1323405 - RNA, 21 nt, Homo sapiens
gucucuguuccaugucuccuu

SEQ ID NO: 1323406 - RNA, 12 nt, Homo sapiens
gucucuucaucu

SEQ ID NO: 1323407 - RNA, 21 nt, Homo sapiens
gucucuuuaaugucacaggca

SEQ ID NO: 1323408 - RNA, 12 nt, Homo sapiens
gucugacaggca

SEQ ID NO: 1323409 - RNA, 16 nt, Homo sapiens
gucuggcaucucccac

SEQ ID NO: 1323410 - RNA, 12 nt, Homo sapiens
gucuguaaaauc

SEQ ID NO: 1323411 - RNA, 18 nt, Homo sapiens
gucuguuuggacugcaga

SEQ ID NO: 1323412 - RNA, 15 nt, Homo sapiens
gucuuaacucaccau

SEQ ID NO: 1323413 - RNA, 17 nt, Homo sapiens
gucuugcaauggcagcc

SEQ ID NO: 1323414 - RNA, 17 nt, Homo sapiens
gucuuggcagcaccugu

SEQ ID NO: 1323415 - RNA, 13 nt, Homo sapiens
gucuuuacuccuc

SEQ ID NO: 1323416 - RNA, 14 nt, Homo sapiens
gucuuugaacccuu

SEQ ID NO: 1323417 - RNA, 14 nt, Homo sapiens
gucuuuugaugaau

SEQ ID NO: 1323418 - RNA, 21 nt, Homo sapiens
gugaaacccugucucuacuaa

SEQ ID NO: 1323419 - RNA, 16 nt, Homo sapiens
gugaaacucaucucau

SEQ ID NO: 1323420 - RNA, 15 nt, Homo sapiens
gugaaaugcagaguc

SEQ ID NO: 1323421 - RNA, 19 nt, Homo sapiens
gugaaaugcuggcauuugc

SEQ ID NO: 1323422 - RNA, 13 nt, Homo sapiens
gugaacaagcaaa

SEQ ID NO: 1323423 - RNA, 16 nt, Homo sapiens
gugaagacuugccuuu

SEQ ID NO: 1323424 - RNA, 22 nt, Homo sapiens
gugaaggcuggcaugauccaag

SEQ ID NO: 1323425 - RNA, 21 nt, Homo sapiens
gugaagguaugagaauuaaua

SEQ ID NO: 1323426 - RNA, 16 nt, Homo sapiens
gugaaugaacacucuu

SEQ ID NO: 1323427 - RNA, 16 nt, Homo sapiens
gugaauuucacaagcu

SEQ ID NO: 1323428 - RNA, 19 nt, Homo sapiens
gugacaacacuuguguuau

SEQ ID NO: 1323429 - RNA, 14 nt, Homo sapiens
gugacauauuucau

SEQ ID NO: 1323430 - RNA, 17 nt, Homo sapiens
gugacauuuccaugcau

SEQ ID NO: 1323431 - RNA, 19 nt, Homo sapiens
gugacauuuccaugcauaa

SEQ ID NO: 1323432 - RNA, 16 nt, Homo sapiens
gugaccacugaagcac

SEQ ID NO: 1323433 - RNA, 16 nt, Homo sapiens
gugaccagugcugcug

SEQ ID NO: 1323434 - RNA, 21 nt, Homo sapiens
gugaccucugccugaagucac

SEQ ID NO: 1323435 - RNA, 15 nt, Homo sapiens
gugacucuucucuca

SEQ ID NO: 1323436 - RNA, 15 nt, Homo sapiens
gugagcacuaaggug

SEQ ID NO: 1323437 - RNA, 18 nt, Homo sapiens
gugagugaaaguugccau

SEQ ID NO: 1323438 - RNA, 13 nt, Homo sapiens
gugauccucccac

SEQ ID NO: 1323439 - RNA, 17 nt, Homo sapiens
gugauuuucauugcugg

SEQ ID NO: 1323440 - RNA, 20 nt, Homo sapiens
gugcaugcgccuacucgcuu

SEQ ID NO: 1323441 - RNA, 18 nt, Homo sapiens
gugcaugugcgcgcgugc

SEQ ID NO: 1323442 - RNA, 12 nt, Homo sapiens
gugccaauguau

SEQ ID NO: 1323443 - RNA, 18 nt, Homo sapiens
gugccacuacacuccagc

SEQ ID NO: 1323444 - RNA, 15 nt, Homo sapiens
gugccaguucuuucc

SEQ ID NO: 1323445 - RNA, 21 nt, Homo sapiens
gugccaguucuuuccauaaua

SEQ ID NO: 1323446 - RNA, 16 nt, Homo sapiens
gugccaguuugaaugc

SEQ ID NO: 1323447 - RNA, 16 nt, Homo sapiens
gugccugccauagcca

SEQ ID NO: 1323448 - RNA, 14 nt, Homo sapiens
gugccuuuugcaga

SEQ ID NO: 1323449 - RNA, 15 nt, Homo sapiens
gugcgcgcgugcaug

SEQ ID NO: 1323450 - RNA, 18 nt, Homo sapiens
gugcucugucuacuugcu

SEQ ID NO: 1323451 - RNA, 16 nt, Homo sapiens
gugcugugcugugcua

SEQ ID NO: 1323452 - RNA, 18 nt, Homo sapiens
gugcuguuuuuguucuac

SEQ ID NO: 1323453 - RNA, 19 nt, Homo sapiens
gugcuuggucuguuugacu

SEQ ID NO: 1323454 - RNA, 21 nt, Homo sapiens
gugcuuuccguggcacugcau

SEQ ID NO: 1323455 - RNA, 17 nt, Homo sapiens
gugcuuuguacugcugu

SEQ ID NO: 1323456 - RNA, 16 nt, Homo sapiens
guggaaaaacugagac

SEQ ID NO: 1323457 - RNA, 23 nt, Homo sapiens
guggacaaacagggaacaaagaa

SEQ ID NO: 1323458 - RNA, 18 nt, Homo sapiens
guggacagucugcucuag

SEQ ID NO: 1323459 - RNA, 11 nt, Homo sapiens
guggacaugcg

SEQ ID NO: 1323460 - RNA, 13 nt, Homo sapiens
guggaggcacuuu

SEQ ID NO: 1323461 - RNA, 22 nt, Homo sapiens
guggccacagcagcuuuguaca

SEQ ID NO: 1323462 - RNA, 14 nt, Homo sapiens
guggccacuaagca

SEQ ID NO: 1323463 - RNA, 23 nt, Homo sapiens
guggccaugccucagcccugacc

SEQ ID NO: 1323464 - RNA, 20 nt, Homo sapiens
gugggagauguuagacucau

SEQ ID NO: 1323465 - RNA, 20 nt, Homo sapiens
gugggcucccugacugggag

SEQ ID NO: 1323466 - RNA, 14 nt, Homo sapiens
guggggacagggau

SEQ ID NO: 1323467 - RNA, 21 nt, Homo sapiens
guggguaaaauuagaugcaug

SEQ ID NO: 1323468 - RNA, 22 nt, Homo sapiens
gugggucuggccguacuuguga

SEQ ID NO: 1323469 - RNA, 22 nt, Homo sapiens
guggguuuuuuugaauguuggu

SEQ ID NO: 1323470 - RNA, 20 nt, Homo sapiens
gugguauggcuaauaccugu

SEQ ID NO: 1323471 - RNA, 17 nt, Homo sapiens
gugguccuuugggguga

SEQ ID NO: 1323472 - RNA, 17 nt, Homo sapiens
guggucuccaccuguca

SEQ ID NO: 1323473 - RNA, 14 nt, Homo sapiens
gugguggucuucaa

SEQ ID NO: 1323474 - RNA, 16 nt, Homo sapiens
gugguguuucuguaag

SEQ ID NO: 1323475 - RNA, 19 nt, Homo sapiens
gugguuuaucagcaaaaaa

SEQ ID NO: 1323476 - RNA, 17 nt, Homo sapiens
guguacacgugacagag

SEQ ID NO: 1323477 - RNA, 23 nt, Homo sapiens
gugucaccccucacugugacuga

SEQ ID NO: 1323478 - RNA, 22 nt, Homo sapiens
gugucaucuuucuuguuucauc

SEQ ID NO: 1323479 - RNA, 16 nt, Homo sapiens
guguccagcauugcug

SEQ ID NO: 1323480 - RNA, 13 nt, Homo sapiens
gugucuuuugaca

SEQ ID NO: 1323481 - RNA, 20 nt, Homo sapiens
guguguaugugugugcaugu

SEQ ID NO: 1323482 - RNA, 16 nt, Homo sapiens
gugugugugcauaugu

SEQ ID NO: 1323483 - RNA, 16 nt, Homo sapiens
guguuauucuggggaa

SEQ ID NO: 1323484 - RNA, 12 nt, Homo sapiens
guguuuugccau

SEQ ID NO: 1323485 - RNA, 19 nt, Homo sapiens
guuaaacagccuauuccug

SEQ ID NO: 1323486 - RNA, 21 nt, Homo sapiens
guuaacguauuaguugccaau

SEQ ID NO: 1323487 - RNA, 14 nt, Homo sapiens
guuaacuacauauu

SEQ ID NO: 1323488 - RNA, 19 nt, Homo sapiens
gcagguugaucaccugagg

SEQ ID NO: 1323489 - RNA, 22 nt, Homo sapiens
gcagucauagggcugauaauac

SEQ ID NO: 1323490 - RNA, 17 nt, Homo sapiens
gcauaucuguuauaugu

SEQ ID NO: 1323491 - RNA, 17 nt, Homo sapiens
gcaucugccucuauuca

SEQ ID NO: 1323492 - RNA, 15 nt, Homo sapiens
gcauucaauuuacag

SEQ ID NO: 1323493 - RNA, 14 nt, Homo sapiens
gccauccugauaca

SEQ ID NO: 1323494 - RNA, 18 nt, Homo sapiens
gccucugccuuaucucau

SEQ ID NO: 1323495 - RNA, 20 nt, Homo sapiens
gccuggccagcauggugaaa

SEQ ID NO: 1323496 - RNA, 22 nt, Homo sapiens
gccuguaauuccagccacucga

SEQ ID NO: 1323497 - RNA, 18 nt, Homo sapiens
gcgugauuguggcauuua

SEQ ID NO: 1323498 - RNA, 23 nt, Homo sapiens
gcucauuuaguuagaaaauaagg

SEQ ID NO: 1323499 - RNA, 14 nt, Homo sapiens
gcugcuuggcacau

SEQ ID NO: 1323500 - RNA, 14 nt, Homo sapiens
gcuggacagcacuc

SEQ ID NO: 1323501 - RNA, 14 nt, Homo sapiens
gcuguaaaauggaa

SEQ ID NO: 1323502 - RNA, 23 nt, Homo sapiens
ggaaccuaaugggaaucauucca

SEQ ID NO: 1323503 - RNA, 20 nt, Homo sapiens
ggaggcagagguugcaguga

SEQ ID NO: 1323504 - RNA, 20 nt, Homo sapiens
ggcaggagaauugcuugaac

SEQ ID NO: 1323505 - RNA, 22 nt, Homo sapiens
ggcuccacagaggccacaaaau

SEQ ID NO: 1323506 - RNA, 14 nt, Homo sapiens
ggcuucuucuuaua

SEQ ID NO: 1323507 - RNA, 14 nt, Homo sapiens
ggucuagcuggcca

SEQ ID NO: 1323508 - RNA, 14 nt, Homo sapiens
guaaagaugucaau

SEQ ID NO: 1323509 - RNA, 18 nt, Homo sapiens
guaugaaaaugauuuauu

SEQ ID NO: 1323510 - RNA, 21 nt, Homo sapiens
gucagcuuuacuagugccaaa

SEQ ID NO: 1323511 - RNA, 16 nt, Homo sapiens
gucauuuucuauucac

SEQ ID NO: 1323512 - RNA, 13 nt, Homo sapiens
gucgaacuggggg

SEQ ID NO: 1323513 - RNA, 19 nt, Homo sapiens
gugacuuacagugccaaca

SEQ ID NO: 1323514 - RNA, 13 nt, Homo sapiens
gugccugugacuc

SEQ ID NO: 1323515 - RNA, 23 nt, Homo sapiens
guggcccgcgugauuguggcauu

SEQ ID NO: 1323516 - RNA, 18 nt, Homo sapiens
guguucacucagcacuuu

SEQ ID NO: 1323517 - RNA, 23 nt, Homo sapiens
guuaccaguguuaauaaauggau

SEQ ID NO: 1323518 - RNA, 16 nt, Homo sapiens
guuauuuguuacuaaa

SEQ ID NO: 1323519 - RNA, 15 nt, Homo sapiens
guucacucagcacuu

SEQ ID NO: 1323520 - RNA, 20 nt, Homo sapiens
guuccucuuggagucuagaa

SEQ ID NO: 1323521 - RNA, 20 nt, Homo sapiens
guucuuucccacacugaaau

SEQ ID NO: 1323522 - RNA, 20 nt, Homo sapiens
guuguacuuuuuauucaauu

SEQ ID NO: 1323523 - RNA, 17 nt, Homo sapiens
uaaagagaccaucuucu

SEQ ID NO: 1323524 - RNA, 18 nt, Homo sapiens
uaauaauuagccaggcgu

SEQ ID NO: 1323525 - RNA, 17 nt, Homo sapiens
uaauagaaagauacaac

SEQ ID NO: 1323526 - RNA, 11 nt, Homo sapiens
uaaucauucca

SEQ ID NO: 1323527 - RNA, 12 nt, Homo sapiens
uaaucauuccau

SEQ ID NO: 1323528 - RNA, 21 nt, Homo sapiens
uacaaauuguucauguuacca

SEQ ID NO: 1323529 - RNA, 17 nt, Homo sapiens
uaccaaguuacuugaaa

SEQ ID NO: 1323530 - RNA, 16 nt, Homo sapiens
uaccuuaaaucugccu

SEQ ID NO: 1323531 - RNA, 12 nt, Homo sapiens
uacuaaggagcc

SEQ ID NO: 1323532 - RNA, 13 nt, Homo sapiens
uacuuaaauuaca

SEQ ID NO: 1323533 - RNA, 15 nt, Homo sapiens
uagccuggccagcau

SEQ ID NO: 1323534 - RNA, 15 nt, Homo sapiens
uaugaaaccaacugu

SEQ ID NO: 1323535 - RNA, 20 nt, Homo sapiens
uaugaugcuggaaauaugaa

SEQ ID NO: 1323536 - RNA, 15 nt, Homo sapiens
uauuaaucauuccau

SEQ ID NO: 1323537 - RNA, 14 nt, Homo sapiens
uauuaauguacuua

SEQ ID NO: 1323538 - RNA, 23 nt, Homo sapiens
uauuaauuuguuuuucuuaucca

SEQ ID NO: 1323539 - RNA, 15 nt, Homo sapiens
uauucucagcacuuu

SEQ ID NO: 1323540 - RNA, 21 nt, Homo sapiens
uauuugucuccaugauaccac

SEQ ID NO: 1323541 - RNA, 21 nt, Homo sapiens
uauuuuaauagaaagauacaa

SEQ ID NO: 1323542 - RNA, 15 nt, Homo sapiens
uauuuuuauuugaua

SEQ ID NO: 1323543 - RNA, 21 nt, Homo sapiens
ucaacaagaacgauucaccug

SEQ ID NO: 1323544 - RNA, 18 nt, Homo sapiens
ucaacaguucauugcuca

SEQ ID NO: 1323545 - RNA, 14 nt, Homo sapiens
ucaagcagugugcu

SEQ ID NO: 1323546 - RNA, 20 nt, Homo sapiens
ucaaugugcaaguuguacug

SEQ ID NO: 1323547 - RNA, 17 nt, Homo sapiens
ucacaaccuaaauggag

SEQ ID NO: 1323548 - RNA, 21 nt, Homo sapiens
ucacagagacucuguccuucc

SEQ ID NO: 1323549 - RNA, 23 nt, Homo sapiens
ucacucagcacuuucccucugca

SEQ ID NO: 1323550 - RNA, 19 nt, Homo sapiens
ucagcuuuacuagugccaa

SEQ ID NO: 1323551 - RNA, 17 nt, Homo sapiens
ucauauuaauguacuua

SEQ ID NO: 1323552 - RNA, 16 nt, Homo sapiens
ucaucacaaccuaaau

SEQ ID NO: 1323553 - RNA, 14 nt, Homo sapiens
ucccacacugaaau

SEQ ID NO: 1323554 - RNA, 12 nt, Homo sapiens
ucgaacuggggg

SEQ ID NO: 1323555 - RNA, 20 nt, Homo sapiens
ucguuucugacauaccuuag

SEQ ID NO: 1323556 - RNA, 13 nt, Homo sapiens
ucuauuauauucg

SEQ ID NO: 1323557 - RNA, 23 nt, Homo sapiens
ucugaagacuaguuauauauucc

SEQ ID NO: 1323558 - RNA, 17 nt, Homo sapiens
ucugccucuauucaauu

SEQ ID NO: 1323559 - RNA, 18 nt, Homo sapiens
ucugccucuauucaauuu

SEQ ID NO: 1323560 - RNA, 13 nt, Homo sapiens
ucuguccuuccau

SEQ ID NO: 1323561 - RNA, 22 nt, Homo sapiens
ugaauucguuucugacauaccu

SEQ ID NO: 1323562 - RNA, 14 nt, Homo sapiens
ugacuucacagcag

SEQ ID NO: 1323563 - RNA, 19 nt, Homo sapiens
ugagcuaaggcagccuuca

SEQ ID NO: 1323564 - RNA, 13 nt, Homo sapiens
ugauauucaccua

SEQ ID NO: 1323565 - RNA, 13 nt, Homo sapiens
ugauuguggcauu

SEQ ID NO: 1323566 - RNA, 12 nt, Homo sapiens
ugcaagaaucua

SEQ ID NO: 1323567 - RNA, 22 nt, Homo sapiens
ugcaucgaaauguauucaccuu

SEQ ID NO: 1323568 - RNA, 15 nt, Homo sapiens
ugcauucaauuuaca

SEQ ID NO: 1323569 - RNA, 20 nt, Homo sapiens
ugccuacagagggauuuauu

SEQ ID NO: 1323570 - RNA, 22 nt, Homo sapiens
ugcgccgcauucgcacuggggg

SEQ ID NO: 1323571 - RNA, 18 nt, Homo sapiens
ugcuggaccuaaaauacu

SEQ ID NO: 1323572 - RNA, 20 nt, Homo sapiens
ugcuugaacccaggaggcag

SEQ ID NO: 1323573 - RNA, 16 nt, Homo sapiens
uggcauaugauuuauc

SEQ ID NO: 1323574 - RNA, 15 nt, Homo sapiens
uguaggccaggcgug

SEQ ID NO: 1323575 - RNA, 14 nt, Homo sapiens
uguauucucagcac

SEQ ID NO: 1323576 - RNA, 14 nt, Homo sapiens
ugugacuguggcau

SEQ ID NO: 1323577 - RNA, 20 nt, Homo sapiens
ugugauuuuaaaauuuugcu

SEQ ID NO: 1323578 - RNA, 12 nt, Homo sapiens
uguggcauuuaa

SEQ ID NO: 1323579 - RNA, 17 nt, Homo sapiens
uguucacucagcacuuu

SEQ ID NO: 1323580 - RNA, 19 nt, Homo sapiens
uguugacuggcauccauaa

SEQ ID NO: 1323581 - RNA, 18 nt, Homo sapiens
uguugccuugagcucuuc

SEQ ID NO: 1323582 - RNA, 20 nt, Homo sapiens
uguuucuaaagguagaucau

SEQ ID NO: 1323583 - RNA, 13 nt, Homo sapiens
uuaaaauuucacu

SEQ ID NO: 1323584 - RNA, 21 nt, Homo sapiens
uuaaaauuuugcuaccaaaga

SEQ ID NO: 1323585 - RNA, 16 nt, Homo sapiens
uuaaauaaaucaagaa

SEQ ID NO: 1323586 - RNA, 21 nt, Homo sapiens
uuacuuuuuuuuaagucacaa

SEQ ID NO: 1323587 - RNA, 21 nt, Homo sapiens
uuauuucugcugcuuggcaca

SEQ ID NO: 1323588 - RNA, 19 nt, Homo sapiens
uuauuugucuccaugauac

SEQ ID NO: 1323589 - RNA, 15 nt, Homo sapiens
uuauuuucacuccuu

SEQ ID NO: 1323590 - RNA, 22 nt, Homo sapiens
uucaauuuacagguaccaguac

SEQ ID NO: 1323591 - RNA, 19 nt, Homo sapiens
uucaccuuucuuuuguaaa

SEQ ID NO: 1323592 - RNA, 18 nt, Homo sapiens
uucauugcucaacaagaa

SEQ ID NO: 1323593 - RNA, 14 nt, Homo sapiens
uuccagccacucga

SEQ ID NO: 1323594 - RNA, 16 nt, Homo sapiens
uuccagccacucgaga

SEQ ID NO: 1323595 - RNA, 22 nt, Homo sapiens
uucccccuccuccgggggccaa

SEQ ID NO: 1323596 - RNA, 12 nt, Homo sapiens
uucccuguuaua

SEQ ID NO: 1323597 - RNA, 19 nt, Homo sapiens
uuccugugccugugacucu

SEQ ID NO: 1323598 - RNA, 21 nt, Homo sapiens
acaacucguguucacucagca

SEQ ID NO: 1323599 - RNA, 22 nt, Homo sapiens
acagcugaacaguguuaauaau

SEQ ID NO: 1323600 - RNA, 17 nt, Homo sapiens
acauaguuauucuauca

SEQ ID NO: 1323601 - RNA, 16 nt, Homo sapiens
acauuauuaaucauuc

SEQ ID NO: 1323602 - RNA, 19 nt, Homo sapiens
acauuauuaaucauuccau

SEQ ID NO: 1323603 - RNA, 18 nt, Homo sapiens
accauccuuuacuauuaa

SEQ ID NO: 1323604 - RNA, 12 nt, Homo sapiens
accuaaauggag

SEQ ID NO: 1323605 - RNA, 21 nt, Homo sapiens
accuaaugggaaucauuccac

SEQ ID NO: 1323606 - RNA, 19 nt, Homo sapiens
accugagccuuuucuuaua

SEQ ID NO: 1323607 - RNA, 12 nt, Homo sapiens
acgauucaccug

SEQ ID NO: 1323608 - RNA, 16 nt, Homo sapiens
acgcuggacagcacuc

SEQ ID NO: 1323609 - RNA, 15 nt, Homo sapiens
acggaaaaggggugg

SEQ ID NO: 1323610 - RNA, 13 nt, Homo sapiens
acucagcacuuuc

SEQ ID NO: 1323611 - RNA, 19 nt, Homo sapiens
acucugccauccugauaca

SEQ ID NO: 1323612 - RNA, 21 nt, Homo sapiens
acugaaaaacuguugguucau

SEQ ID NO: 1323613 - RNA, 18 nt, Homo sapiens
acugacugaguagcucau

SEQ ID NO: 1323614 - RNA, 15 nt, Homo sapiens
acuuacagugccaac

SEQ ID NO: 1323615 - RNA, 21 nt, Homo sapiens
acuuacagugccaacauuuaa

SEQ ID NO: 1323616 - RNA, 13 nt, Homo sapiens
acuucacagagac

SEQ ID NO: 1323617 - RNA, 18 nt, Homo sapiens
acuucccagagaacuuca

SEQ ID NO: 1323618 - RNA, 21 nt, Homo sapiens
agaaaagugaaaguaacuguu

SEQ ID NO: 1323619 - RNA, 18 nt, Homo sapiens
agaacauccuuaaauguc

SEQ ID NO: 1323620 - RNA, 14 nt, Homo sapiens
agaacgauucaccu

SEQ ID NO: 1323621 - RNA, 22 nt, Homo sapiens
agaauugcuugaacccaggagg

SEQ ID NO: 1323622 - RNA, 17 nt, Homo sapiens
agacggcaagacuccau

SEQ ID NO: 1323623 - RNA, 22 nt, Homo sapiens
agcacgcuggacagcacucugc

SEQ ID NO: 1323624 - RNA, 23 nt, Homo sapiens
agcacgcuggacagcacucugcc

SEQ ID NO: 1323625 - RNA, 20 nt, Homo sapiens
aggaggcagagguugcagug

SEQ ID NO: 1323626 - RNA, 13 nt, Homo sapiens
aggcaaggggugg

SEQ ID NO: 1323627 - RNA, 16 nt, Homo sapiens
aggcagguugaucacc

SEQ ID NO: 1323628 - RNA, 15 nt, Homo sapiens
aggccaggcguggug

SEQ ID NO: 1323629 - RNA, 18 nt, Homo sapiens
aggccaggcgugguggcu

SEQ ID NO: 1323630 - RNA, 20 nt, Homo sapiens
aggccaggcgugguggcuca

SEQ ID NO: 1323631 - RNA, 14 nt, Homo sapiens
aguagaaaagugcu

SEQ ID NO: 1323632 - RNA, 21 nt, Homo sapiens
aguagcucauucuugugacuu

SEQ ID NO: 1323633 - RNA, 21 nt, Homo sapiens
agucagcuuuacuagugccaa

SEQ ID NO: 1323634 - RNA, 17 nt, Homo sapiens
agugaaaauaauuuguu

SEQ ID NO: 1323635 - RNA, 16 nt, Homo sapiens
agugagcuaagaucac

SEQ ID NO: 1323636 - RNA, 22 nt, Homo sapiens
aguguucuguauuuuaaggugu

SEQ ID NO: 1323637 - RNA, 13 nt, Homo sapiens
aguuacugacuua

SEQ ID NO: 1323638 - RNA, 21 nt, Homo sapiens
auaaacugagccucuuuucaa

SEQ ID NO: 1323639 - RNA, 22 nt, Homo sapiens
auaauugccuacagagggauuu

SEQ ID NO: 1323640 - RNA, 21 nt, Homo sapiens
auacccauaaagaaugcucau

SEQ ID NO: 1323641 - RNA, 21 nt, Homo sapiens
auauucauaauauauaaaaga

SEQ ID NO: 1323642 - RNA, 19 nt, Homo sapiens
auauucgguuggaaccuaa

SEQ ID NO: 1323643 - RNA, 14 nt, Homo sapiens
aucacaccacuaca

SEQ ID NO: 1323644 - RNA, 15 nt, Homo sapiens
aucaccauuacuuuu

SEQ ID NO: 1323645 - RNA, 16 nt, Homo sapiens
aucccuauguugcuau

SEQ ID NO: 1323646 - RNA, 19 nt, Homo sapiens
aucuaucaccauuacuuuu

SEQ ID NO: 1323647 - RNA, 15 nt, Homo sapiens
aucugccucuauuca

SEQ ID NO: 1323648 - RNA, 16 nt, Homo sapiens
aucugccuuuguuucu

SEQ ID NO: 1323649 - RNA, 18 nt, Homo sapiens
aucuucuuuccaccuuuc

SEQ ID NO: 1323650 - RNA, 15 nt, Homo sapiens
augaaggacuauuaa

SEQ ID NO: 1323651 - RNA, 12 nt, Homo sapiens
augacaguguga

SEQ ID NO: 1323652 - RNA, 18 nt, Homo sapiens
augauguauacccauaaa

SEQ ID NO: 1323653 - RNA, 19 nt, Homo sapiens
auguacuuaaauuacacau

SEQ ID NO: 1323654 - RNA, 14 nt, Homo sapiens
auuaaucauuccau

SEQ ID NO: 1323655 - RNA, 17 nt, Homo sapiens
auuauuaaucauuccau

SEQ ID NO: 1323656 - RNA, 21 nt, Homo sapiens
aaaaauucaucauaugaaugu

SEQ ID NO: 1323657 - RNA, 19 nt, Homo sapiens
aaaauguuaugauaaucuu

SEQ ID NO: 1323658 - RNA, 19 nt, Homo sapiens
aaaccucaucucucuaaca

SEQ ID NO: 1323659 - RNA, 19 nt, Homo sapiens
aaacugagccucuuuucaa

SEQ ID NO: 1323660 - RNA, 19 nt, Homo sapiens
aaagaaauauaucugugau

SEQ ID NO: 1323661 - RNA, 21 nt, Homo sapiens
aaagaaugcauguucugugug

SEQ ID NO: 1323662 - RNA, 21 nt, Homo sapiens
aaagccugcguucucauccca

SEQ ID NO: 1323663 - RNA, 19 nt, Homo sapiens
aaagucagcuuuacuagug

SEQ ID NO: 1323664 - RNA, 14 nt, Homo sapiens
aaagugaacuugau

SEQ ID NO: 1323665 - RNA, 14 nt, Homo sapiens
aaauguauucaccu

SEQ ID NO: 1323666 - RNA, 17 nt, Homo sapiens
aacaugauacuauucag

SEQ ID NO: 1323667 - RNA, 22 nt, Homo sapiens
aaccauggauagaaucaauauu

SEQ ID NO: 1323668 - RNA, 21 nt, Homo sapiens
aaccuaaugggaaucauucca

SEQ ID NO: 1323669 - RNA, 17 nt, Homo sapiens
aaccuuuuuauuuucac

SEQ ID NO: 1323670 - RNA, 21 nt, Homo sapiens
aacuguuuucuucuuggugcu

SEQ ID NO: 1323671 - RNA, 19 nt, Homo sapiens
aagaacucugcacagcaac

SEQ ID NO: 1323672 - RNA, 23 nt, Homo sapiens
aagaauaggucauuuucuauuca

SEQ ID NO: 1323673 - RNA, 14 nt, Homo sapiens
aagcaaauggaugg

SEQ ID NO: 1323674 - RNA, 19 nt, Homo sapiens
aagguguuuccugcaccug

SEQ ID NO: 1323675 - RNA, 11 nt, Homo sapiens
aauaaauggau

SEQ ID NO: 1323676 - RNA, 17 nt, Homo sapiens
aaucuuucuccacuguu

SEQ ID NO: 1323677 - RNA, 17 nt, Homo sapiens
aaugaaaggagcagugg

SEQ ID NO: 1323678 - RNA, 18 nt, Homo sapiens
aauguacuuaaauuacac

SEQ ID NO: 1323679 - RNA, 14 nt, Homo sapiens
aauuccagccacuc

SEQ ID NO: 1323680 - RNA, 17 nt, Homo sapiens
aauugcuagugauuuca

SEQ ID NO: 1323681 - RNA, 15 nt, Homo sapiens
aauuuuaaguuauuu

SEQ ID NO: 1323682 - RNA, 17 nt, Homo sapiens
acaaccuuuuuauuuuc

SEQ ID NO: 1323683 - RNA, 19 nt, Homo sapiens
acaaccuuuuuauuuucac

SEQ ID NO: 1323684 - RNA, 23 nt, Homo sapiens
acaauuucagaauuuugggacau

SEQ ID NO: 1323685 - RNA, 21 nt, Homo sapiens
acacuagcuaaggaagggaaa

SEQ ID NO: 1323686 - RNA, 21 nt, Homo sapiens
acagguaacauuauaaaugac

SEQ ID NO: 1323687 - RNA, 14 nt, Homo sapiens
acauuugcauucaa

SEQ ID NO: 1323688 - RNA, 20 nt, Homo sapiens
accaaggggcugcuaguaua

SEQ ID NO: 1323689 - RNA, 20 nt, Homo sapiens
accuaaugggaaucauucca

SEQ ID NO: 1323690 - RNA, 21 nt, Homo sapiens
accucaucucucuaacaauau

SEQ ID NO: 1323691 - RNA, 14 nt, Homo sapiens
acuagccuggccag

SEQ ID NO: 1323692 - RNA, 19 nt, Homo sapiens
acucuggcauaugauuuau

SEQ ID NO: 1323693 - RNA, 20 nt, Homo sapiens
acucuguccuuccaugcaaa

SEQ ID NO: 1323694 - RNA, 19 nt, Homo sapiens
acugauuauucuucuuaca

SEQ ID NO: 1323695 - RNA, 21 nt, Homo sapiens
acuucacagagacucuguccu

SEQ ID NO: 1323696 - RNA, 18 nt, Homo sapiens
acuugaaaaaauguucua

SEQ ID NO: 1323697 - RNA, 13 nt, Homo sapiens
acuuuucauuacu

SEQ ID NO: 1323698 - RNA, 13 nt, Homo sapiens
acuuuuuauucaa

SEQ ID NO: 1323699 - RNA, 14 nt, Homo sapiens
acuuuuuauucaau

SEQ ID NO: 1323700 - RNA, 18 nt, Homo sapiens
acuuuuuuucugauucaa

SEQ ID NO: 1323701 - RNA, 18 nt, Homo sapiens
agaaucuagauaggugcu

SEQ ID NO: 1323702 - RNA, 16 nt, Homo sapiens
agaaugaaaggagcag

SEQ ID NO: 1323703 - RNA, 16 nt, Homo sapiens
agacggcaagacucca

SEQ ID NO: 1323704 - RNA, 21 nt, Homo sapiens
agacucuguccuuccaugcaa

SEQ ID NO: 1323705 - RNA, 16 nt, Homo sapiens
agacugaaaaacuguu

SEQ ID NO: 1323706 - RNA, 21 nt, Homo sapiens
agagaauaagcugaacuugua

SEQ ID NO: 1323707 - RNA, 17 nt, Homo sapiens
agagcaaucaaagcagc

SEQ ID NO: 1323708 - RNA, 17 nt, Homo sapiens
agagcauaucuguuaua

SEQ ID NO: 1323709 - RNA, 23 nt, Homo sapiens
agauacaaccuuuuuauuuucac

SEQ ID NO: 1323710 - RNA, 13 nt, Homo sapiens
agaucacaccacu

SEQ ID NO: 1323711 - RNA, 16 nt, Homo sapiens
agcagcacaugguguu

SEQ ID NO: 1323712 - RNA, 20 nt, Homo sapiens
agccaaaggccgugccuggu

SEQ ID NO: 1323713 - RNA, 13 nt, Homo sapiens
agccacuugacua

SEQ ID NO: 1323714 - RNA, 14 nt, Homo sapiens
agccaggcguggug

SEQ ID NO: 1323715 - RNA, 15 nt, Homo sapiens
agcccuacucacaca

SEQ ID NO: 1323716 - RNA, 22 nt, Homo sapiens
aggaagggaaagggaagugaua

SEQ ID NO: 1323717 - RNA, 13 nt, Homo sapiens
aggagaaccuguc

SEQ ID NO: 1323718 - RNA, 21 nt, Homo sapiens
aggagaauugcuugaacccag

SEQ ID NO: 1323719 - RNA, 15 nt, Homo sapiens
aggcagguugaucac

SEQ ID NO: 1323720 - RNA, 20 nt, Homo sapiens
aggcgugguggugggugccu

SEQ ID NO: 1323721 - RNA, 19 nt, Homo sapiens
agguucuuucccacacuga

SEQ ID NO: 1323722 - RNA, 18 nt, Homo sapiens
aguaugaaaaugauuuau

SEQ ID NO: 1323723 - RNA, 17 nt, Homo sapiens
agugagcuaagaucaca

SEQ ID NO: 1323724 - RNA, 14 nt, Homo sapiens
agugucuaauuccc

SEQ ID NO: 1323725 - RNA, 14 nt, Homo sapiens
aguugaacccagaa

SEQ ID NO: 1323726 - RNA, 15 nt, Homo sapiens
auaaagaaugcucau

SEQ ID NO: 1323727 - RNA, 16 nt, Homo sapiens
auaaaugacagaucuc

SEQ ID NO: 1323728 - RNA, 14 nt, Homo sapiens
auaauaauuagcca

SEQ ID NO: 1323729 - RNA, 20 nt, Homo sapiens
auaccacucaagcagugugc

SEQ ID NO: 1323730 - RNA, 23 nt, Homo sapiens
auagaaucaauauuuguaggcca

SEQ ID NO: 1323731 - RNA, 19 nt, Homo sapiens
auauauuccuuacuagaaa

SEQ ID NO: 1323732 - RNA, 23 nt, Homo sapiens
auauauuguauuuuuauuugaua

SEQ ID NO: 1323733 - RNA, 17 nt, Homo sapiens
auauguuuauguaacua

SEQ ID NO: 1323734 - RNA, 17 nt, Homo sapiens
aucaaaugguuauuugu

SEQ ID NO: 1323735 - RNA, 14 nt, Homo sapiens
aucuaucaccauua

SEQ ID NO: 1323736 - RNA, 21 nt, Homo sapiens
aucucauuucucaacaguuca

SEQ ID NO: 1323737 - RNA, 18 nt, Homo sapiens
aucugccucuauucaauu

SEQ ID NO: 1323738 - RNA, 16 nt, Homo sapiens
aucuucuuuccaccuu

SEQ ID NO: 1323739 - RNA, 21 nt, Homo sapiens
augacuuuuuuucugauucaa

SEQ ID NO: 1323740 - RNA, 18 nt, Homo sapiens
auguacuuaaauuacaca

SEQ ID NO: 1323741 - RNA, 15 nt, Homo sapiens
auguauucaccuuuc

SEQ ID NO: 1323742 - RNA, 13 nt, Homo sapiens
auuaaucauucca

SEQ ID NO: 1323743 - RNA, 14 nt, Homo sapiens
auuccuuacuagaa

SEQ ID NO: 1323744 - RNA, 15 nt, Homo sapiens
auugcauuaguccaa

SEQ ID NO: 1323745 - RNA, 18 nt, Homo sapiens
auuugucuccaugauacc

SEQ ID NO: 1323746 - RNA, 14 nt, Homo sapiens
auuuuaaaauuuca

SEQ ID NO: 1323747 - RNA, 19 nt, Homo sapiens
auuuuaauagaaagauaca

SEQ ID NO: 1323748 - RNA, 19 nt, Homo sapiens
auuuuaggauaauugccua

SEQ ID NO: 1323749 - RNA, 12 nt, Homo sapiens
auuuuauuaaau

SEQ ID NO: 1323750 - RNA, 22 nt, Homo sapiens
auuuuuauaugauguauaccca

SEQ ID NO: 1323751 - RNA, 13 nt, Homo sapiens
auuuuuauuaaau

SEQ ID NO: 1323752 - RNA, 17 nt, Homo sapiens
caaaacaaaauguuaug

SEQ ID NO: 1323753 - RNA, 18 nt, Homo sapiens
caaaacuuccugauuuga

SEQ ID NO: 1323754 - RNA, 19 nt, Homo sapiens
caaaacuuccugauuugau

SEQ ID NO: 1323755 - RNA, 17 nt, Homo sapiens
caaaccauggauagaau

SEQ ID NO: 1323756 - RNA, 18 nt, Homo sapiens
caaagcagcacauggugu

SEQ ID NO: 1323757 - RNA, 10 nt, Homo sapiens
caauucugua

SEQ ID NO: 1323758 - RNA, 21 nt, Homo sapiens
caccggccccgcccaugagga

SEQ ID NO: 1323759 - RNA, 17 nt, Homo sapiens
cacgcuggacagcacuc

SEQ ID NO: 1323760 - RNA, 12 nt, Homo sapiens
cagaacuaggag

SEQ ID NO: 1323761 - RNA, 18 nt, Homo sapiens
cagaauuuugggacauuu

SEQ ID NO: 1323762 - RNA, 20 nt, Homo sapiens
cagcacgcuggacagcacuc

SEQ ID NO: 1323763 - RNA, 12 nt, Homo sapiens
cagcacucugcc

SEQ ID NO: 1323764 - RNA, 18 nt, Homo sapiens
cagccacuugacuaauac

SEQ ID NO: 1323765 - RNA, 18 nt, Homo sapiens
cagucugauauucaccua

SEQ ID NO: 1323766 - RNA, 16 nt, Homo sapiens
cagucugcaucaucau

SEQ ID NO: 1323767 - RNA, 18 nt, Homo sapiens
caucauaugaauguucuu

SEQ ID NO: 1323768 - RNA, 13 nt, Homo sapiens
cauccugauacau

SEQ ID NO: 1323769 - RNA, 20 nt, Homo sapiens
caucgaaauguauucaccuu

SEQ ID NO: 1323770 - RNA, 16 nt, Homo sapiens
caucugccucuauuca

SEQ ID NO: 1323771 - RNA, 13 nt, Homo sapiens
caugauacuauuc

SEQ ID NO: 1323772 - RNA, 17 nt, Homo sapiens
caugugacuguggcauu

SEQ ID NO: 1323773 - RNA, 18 nt, Homo sapiens
cauuaccaaguuacuuga

SEQ ID NO: 1323774 - RNA, 14 nt, Homo sapiens
cauucuugugacuu

SEQ ID NO: 1323775 - RNA, 18 nt, Homo sapiens
cauuucuugacuucacag

SEQ ID NO: 1323776 - RNA, 15 nt, Homo sapiens
ccaaguuacuugaaa

SEQ ID NO: 1323777 - RNA, 19 nt, Homo sapiens
ccaugugacuguggcauuu

SEQ ID NO: 1323778 - RNA, 17 nt, Homo sapiens
cccaugaggacuaggag

SEQ ID NO: 1323779 - RNA, 21 nt, Homo sapiens
cccaugugacuguggcauuuu

SEQ ID NO: 1323780 - RNA, 21 nt, Homo sapiens
cccccuguauucucagcacuu

SEQ ID NO: 1323781 - RNA, 20 nt, Homo sapiens
ccccuguauucucagcacuu

SEQ ID NO: 1323782 - RNA, 22 nt, Homo sapiens
cccgcgugauuguggcauuuaa

SEQ ID NO: 1323783 - RNA, 19 nt, Homo sapiens
cccuguuauaauuugcaca

SEQ ID NO: 1323784 - RNA, 18 nt, Homo sapiens
ccuaaugggaaucauucc

SEQ ID NO: 1323785 - RNA, 23 nt, Homo sapiens
ccucugccuuaucucauuucuca

SEQ ID NO: 1323786 - RNA, 19 nt, Homo sapiens
ccuguauucucagcacuuu

SEQ ID NO: 1323787 - RNA, 17 nt, Homo sapiens
ccuuccaugcaaaggcu

SEQ ID NO: 1323788 - RNA, 18 nt, Homo sapiens
ccuuuacuauuaagggaa

SEQ ID NO: 1323789 - RNA, 16 nt, Homo sapiens
cgauucaccuggguuu

SEQ ID NO: 1323790 - RNA, 18 nt, Homo sapiens
cgcacugggggacauggg

SEQ ID NO: 1323791 - RNA, 14 nt, Homo sapiens
cgccuuccggugag

SEQ ID NO: 1323792 - RNA, 20 nt, Homo sapiens
cgcuggacagcacucugcca

SEQ ID NO: 1323793 - RNA, 15 nt, Homo sapiens
cggccagaggcuggg

SEQ ID NO: 1323794 - RNA, 16 nt, Homo sapiens
cgugguggugggugcc

SEQ ID NO: 1323795 - RNA, 17 nt, Homo sapiens
cuaagaucacaccacua

SEQ ID NO: 1323796 - RNA, 19 nt, Homo sapiens
cuaaugggaaucauuccac

SEQ ID NO: 1323797 - RNA, 17 nt, Homo sapiens
cuaauuuuaaguuauuu

SEQ ID NO: 1323798 - RNA, 14 nt, Homo sapiens
cuacauaguuauuc

SEQ ID NO: 1323799 - RNA, 11 nt, Homo sapiens
cucagcacuuu

SEQ ID NO: 1323800 - RNA, 16 nt, Homo sapiens
cucuccccaaauugcc

SEQ ID NO: 1323801 - RNA, 22 nt, Homo sapiens
cucugaguaccuuuuaguauua

SEQ ID NO: 1323802 - RNA, 13 nt, Homo sapiens
cucuuuucaauua

SEQ ID NO: 1323803 - RNA, 15 nt, Homo sapiens
cuggaauuuaauuca

SEQ ID NO: 1323804 - RNA, 13 nt, Homo sapiens
cuggacagcacuc

SEQ ID NO: 1323805 - RNA, 13 nt, Homo sapiens
cuguaauuccagc

SEQ ID NO: 1323806 - RNA, 17 nt, Homo sapiens
cuguauucucagcacuu

SEQ ID NO: 1323807 - RNA, 14 nt, Homo sapiens
cugugccugugacu

SEQ ID NO: 1323808 - RNA, 20 nt, Homo sapiens
cuuaagcauaaaaauugaau

SEQ ID NO: 1323809 - RNA, 13 nt, Homo sapiens
cuuacagugccaa

SEQ ID NO: 1323810 - RNA, 20 nt, Homo sapiens
cuuacuagaaauauauucau

SEQ ID NO: 1323811 - RNA, 19 nt, Homo sapiens
cuucauauacuaaggagcc

SEQ ID NO: 1323812 - RNA, 15 nt, Homo sapiens
cuucccagagaacuu

SEQ ID NO: 1323813 - RNA, 16 nt, Homo sapiens
cuuccugugccuguga

SEQ ID NO: 1323814 - RNA, 16 nt, Homo sapiens
cuugaauauuugcuua

SEQ ID NO: 1323815 - RNA, 21 nt, Homo sapiens
cuugucuuuaaaucuucaaua

SEQ ID NO: 1323816 - RNA, 20 nt, Homo sapiens
cuuuucuuauauaagacaag

SEQ ID NO: 1323817 - RNA, 12 nt, Homo sapiens
gaaauauauuca

SEQ ID NO: 1323818 - RNA, 16 nt, Homo sapiens
gaaauggcauaaucuu

SEQ ID NO: 1323819 - RNA, 16 nt, Homo sapiens
gaaauguauucaccuu

SEQ ID NO: 1323820 - RNA, 21 nt, Homo sapiens
gaaccuaaugggaaucauucc

SEQ ID NO: 1323821 - RNA, 14 nt, Homo sapiens
gaacgauucaccug

SEQ ID NO: 1323822 - RNA, 20 nt, Homo sapiens
gaauaacaugauacuauuca

SEQ ID NO: 1323823 - RNA, 19 nt, Homo sapiens
gaaucauuccacuauacaa

SEQ ID NO: 1323824 - RNA, 21 nt, Homo sapiens
gaaugcucauauuaauguacu

SEQ ID NO: 1323825 - RNA, 22 nt, Homo sapiens
gacacagcugaacaguguuaau

SEQ ID NO: 1323826 - RNA, 16 nt, Homo sapiens
gacggaaaaggggugg

SEQ ID NO: 1323827 - RNA, 15 nt, Homo sapiens
gacuuacagugccaa

SEQ ID NO: 1323828 - RNA, 17 nt, Homo sapiens
gagacggcaagacucca

SEQ ID NO: 1323829 - RNA, 20 nt, Homo sapiens
gagccuuuucuuauauaaga

SEQ ID NO: 1323830 - RNA, 20 nt, Homo sapiens
gaggcagagguugcagugag

SEQ ID NO: 1323831 - RNA, 23 nt, Homo sapiens
gaggcagcgcuggucgucaccug

SEQ ID NO: 1323832 - RNA, 16 nt, Homo sapiens
gagguucuuucccaca

SEQ ID NO: 1323833 - RNA, 20 nt, Homo sapiens
gaucacaccacuacacucca

SEQ ID NO: 1323834 - RNA, 23 nt, Homo sapiens
gaugucaauaggaauugcauuag

SEQ ID NO: 1323835 - RNA, 17 nt, Homo sapiens
gauuuauuuuuauauga

SEQ ID NO: 1323836 - RNA, 23 nt, Homo sapiens
gcaaauaagcucuauuauauucg

SEQ ID NO: 1323837 - RNA, 18 nt, Homo sapiens
gcacugggggacauggga

SEQ ID NO: 1323838 - RNA, 12 nt, Homo sapiens
gcauaugauuua

SEQ ID NO: 1323839 - RNA, 14 nt, Homo sapiens
gcauaugauuuauc

SEQ ID NO: 1323840 - RNA, 15 nt, Homo sapiens
gcauggugaaaccuc

SEQ ID NO: 1323841 - RNA, 16 nt, Homo sapiens
gcauucgcacuggggg

SEQ ID NO: 1323842 - RNA, 17 nt, Homo sapiens
gccacaaaauguugcaa

SEQ ID NO: 1323843 - RNA, 15 nt, Homo sapiens
gccaggcgugguggc

SEQ ID NO: 1323844 - RNA, 18 nt, Homo sapiens
gccccagucgaacugggg

SEQ ID NO: 1323845 - RNA, 18 nt, Homo sapiens
gccgcauucgcacugggg

SEQ ID NO: 1323846 - RNA, 19 nt, Homo sapiens
gcgcuggucgucaccuggg

SEQ ID NO: 1323847 - RNA, 22 nt, Homo sapiens
ggaggggcgggagagaggcaag

SEQ ID NO: 1323848 - RNA, 23 nt, Homo sapiens
ggauuuuuagauucccagugucu

SEQ ID NO: 1323849 - RNA, 19 nt, Homo sapiens
ggccccagucgaacugggg

SEQ ID NO: 1323850 - RNA, 16 nt, Homo sapiens
ggccgaggcagguuga

SEQ ID NO: 1323851 - RNA, 19 nt, Homo sapiens
ggccuuuuucauaaacuga

SEQ ID NO: 1323852 - RNA, 17 nt, Homo sapiens
ggguggacggagccaaa

SEQ ID NO: 1323853 - RNA, 20 nt, Homo sapiens
gguaccaagcugcugggugc

SEQ ID NO: 1323854 - RNA, 14 nt, Homo sapiens
ggucauuuucuauu

SEQ ID NO: 1323855 - RNA, 14 nt, Homo sapiens
gguugaucaccuga

SEQ ID NO: 1323856 - RNA, 16 nt, Homo sapiens
guaauuccagccacuc

SEQ ID NO: 1323857 - RNA, 16 nt, Homo sapiens
guacuuuuuauucaau

SEQ ID NO: 1323858 - RNA, 15 nt, Homo sapiens
guauucucagcacuu

SEQ ID NO: 1323859 - RNA, 14 nt, Homo sapiens
ucuucuuacauuau

SEQ ID NO: 1323860 - RNA, 14 nt, Homo sapiens
ucuuucaacauuuc

SEQ ID NO: 1323861 - RNA, 16 nt, Homo sapiens
ugaaaucagucuacca

SEQ ID NO: 1323862 - RNA, 20 nt, Homo sapiens
ugacuucacagcagccacuu

SEQ ID NO: 1323863 - RNA, 19 nt, Homo sapiens
ugagaaauaaagaucugaa

SEQ ID NO: 1323864 - RNA, 20 nt, Homo sapiens
ugauaaucuuucuccacugu

SEQ ID NO: 1323865 - RNA, 19 nt, Homo sapiens
ugauagcuugggauuuaaa

SEQ ID NO: 1323866 - RNA, 12 nt, Homo sapiens
ugauauucaccu

SEQ ID NO: 1323867 - RNA, 16 nt, Homo sapiens
ugauuuaucuaucacc

SEQ ID NO: 1323868 - RNA, 21 nt, Homo sapiens
ugauuuaucuaucaccauuac

SEQ ID NO: 1323869 - RNA, 14 nt, Homo sapiens
ugcaucaucaucac

SEQ ID NO: 1323870 - RNA, 16 nt, Homo sapiens
ugcauuauucauaugc

SEQ ID NO: 1323871 - RNA, 23 nt, Homo sapiens
ugcuagugauuucauuaccaagu

SEQ ID NO: 1323872 - RNA, 18 nt, Homo sapiens
ugcugaacucaaugugca

SEQ ID NO: 1323873 - RNA, 14 nt, Homo sapiens
uggacagcacucug

SEQ ID NO: 1323874 - RNA, 15 nt, Homo sapiens
uggccagcaugguga

SEQ ID NO: 1323875 - RNA, 21 nt, Homo sapiens
uggcccaugugacuguggcau

SEQ ID NO: 1323876 - RNA, 22 nt, Homo sapiens
uggcccgcgugauuguggcauu

SEQ ID NO: 1323877 - RNA, 18 nt, Homo sapiens
ugguuauuuguuacuaaa

SEQ ID NO: 1323878 - RNA, 13 nt, Homo sapiens
ugguuuuucacca

SEQ ID NO: 1323879 - RNA, 12 nt, Homo sapiens
uguaaaauggaa

SEQ ID NO: 1323880 - RNA, 19 nt, Homo sapiens
uguaauuccagccacucga

SEQ ID NO: 1323881 - RNA, 17 nt, Homo sapiens
ugugacuguggcauuuu

SEQ ID NO: 1323882 - RNA, 15 nt, Homo sapiens
uguuaauaaauggau

SEQ ID NO: 1323883 - RNA, 20 nt, Homo sapiens
uguugacauacaaaccauga

SEQ ID NO: 1323884 - RNA, 14 nt, Homo sapiens
uguugguucaucca

SEQ ID NO: 1323885 - RNA, 13 nt, Homo sapiens
uuaauaaauggau

SEQ ID NO: 1323886 - RNA, 19 nt, Homo sapiens
uuacuuuuuuuuaagucac

SEQ ID NO: 1323887 - RNA, 21 nt, Homo sapiens
uuaugaugcuggaaauaugaa

SEQ ID NO: 1323888 - RNA, 16 nt, Homo sapiens
uuauuaaucauuccau

SEQ ID NO: 1323889 - RNA, 12 nt, Homo sapiens
uucaauuuacag

SEQ ID NO: 1323890 - RNA, 21 nt, Homo sapiens
uucacagcagccacuugacua

SEQ ID NO: 1323891 - RNA, 22 nt, Homo sapiens
uucguggagcccuacucacaca

SEQ ID NO: 1323892 - RNA, 12 nt, Homo sapiens
uucucagcacuu

SEQ ID NO: 1323893 - RNA, 18 nt, Homo sapiens
uuuagauucccagugucu

SEQ ID NO: 1323894 - RNA, 20 nt, Homo sapiens
uuuaugaaaccaacuguuga

SEQ ID NO: 1323895 - RNA, 16 nt, Homo sapiens
uuuauguaacuaucaa

SEQ ID NO: 1323896 - RNA, 14 nt, Homo sapiens
uuugauccuuuuga

SEQ ID NO: 1323897 - RNA, 21 nt, Homo sapiens
uuuuaugaaaccaacuguuga

SEQ ID NO: 1323898 - RNA, 16 nt, Homo sapiens
cccaugaggacuagga

SEQ ID NO: 1323899 - RNA, 21 nt, Homo sapiens
ccccuguauucucagcacuuu

SEQ ID NO: 1323900 - RNA, 19 nt, Homo sapiens
cccuguugccuugagcucu

SEQ ID NO: 1323901 - RNA, 16 nt, Homo sapiens
ccuagaagcaaaugga

SEQ ID NO: 1323902 - RNA, 17 nt, Homo sapiens
ccuccuuuacuucccag

SEQ ID NO: 1323903 - RNA, 19 nt, Homo sapiens
ccucugcagcacgcuggac

SEQ ID NO: 1323904 - RNA, 16 nt, Homo sapiens
ccuguauucucagcac

SEQ ID NO: 1323905 - RNA, 14 nt, Homo sapiens
ccuuagacugaaaa

SEQ ID NO: 1323906 - RNA, 17 nt, Homo sapiens
ccuugagcucuucugag

SEQ ID NO: 1323907 - RNA, 22 nt, Homo sapiens
ccuugcgccgcauucgcacugg

SEQ ID NO: 1323908 - RNA, 18 nt, Homo sapiens
cggacggaaaaggggugg

SEQ ID NO: 1323909 - RNA, 15 nt, Homo sapiens
cgugauuguggcauu

SEQ ID NO: 1323910 - RNA, 13 nt, Homo sapiens
cuaaagcuauauu

SEQ ID NO: 1323911 - RNA, 15 nt, Homo sapiens
cuagaaauauauuca

SEQ ID NO: 1323912 - RNA, 23 nt, Homo sapiens
cuagcuaaggaagggaaagggaa

SEQ ID NO: 1323913 - RNA, 13 nt, Homo sapiens
cuauuaagggaaa

SEQ ID NO: 1323914 - RNA, 12 nt, Homo sapiens
cucagcacuuuc

SEQ ID NO: 1323915 - RNA, 13 nt, Homo sapiens
cucuccacccgcu

SEQ ID NO: 1323916 - RNA, 18 nt, Homo sapiens
cucuucugagcuaaggca

SEQ ID NO: 1323917 - RNA, 19 nt, Homo sapiens
cugaacaguguuaauaaua

SEQ ID NO: 1323918 - RNA, 14 nt, Homo sapiens
cugccucuauucaa

SEQ ID NO: 1323919 - RNA, 18 nt, Homo sapiens
cuguugccuugagcucuu

SEQ ID NO: 1323920 - RNA, 13 nt, Homo sapiens
cuuaaaucugccu

SEQ ID NO: 1323921 - RNA, 21 nt, Homo sapiens
cuuacauuauuaaucauucca

SEQ ID NO: 1323922 - RNA, 18 nt, Homo sapiens
cuuagccuaaacaaccug

SEQ ID NO: 1323923 - RNA, 20 nt, Homo sapiens
cuuuguugccuuaucuugaa

SEQ ID NO: 1323924 - RNA, 18 nt, Homo sapiens
gaaaucagucuaccaagg

SEQ ID NO: 1323925 - RNA, 18 nt, Homo sapiens
gaaauguauucaccuuuc

SEQ ID NO: 1323926 - RNA, 14 nt, Homo sapiens
gaauauguucacau

SEQ ID NO: 1323927 - RNA, 12 nt, Homo sapiens
gaaucauuccac

SEQ ID NO: 1323928 - RNA, 19 nt, Homo sapiens
gacucuguccuuccaugca

SEQ ID NO: 1323929 - RNA, 14 nt, Homo sapiens
gacuucacagcagc

SEQ ID NO: 1323930 - RNA, 20 nt, Homo sapiens
gaggcaggagaauugcuuga

SEQ ID NO: 1323931 - RNA, 17 nt, Homo sapiens
gagggugaggagcugga

SEQ ID NO: 1323932 - RNA, 12 nt, Homo sapiens
gauauucaccua

SEQ ID NO: 1323933 - RNA, 16 nt, Homo sapiens
gauuucauuaccaagu

SEQ ID NO: 1323934 - RNA, 18 nt, Homo sapiens
gcacgcuggacagcacuc

SEQ ID NO: 1323935 - RNA, 18 nt, Homo sapiens
gcaguuuuguaaauaagu

SEQ ID NO: 1323936 - RNA, 18 nt, Homo sapiens
gcaucugccucuauucaa

SEQ ID NO: 1323937 - RNA, 13 nt, Homo sapiens
gccaaggacaggg

SEQ ID NO: 1323938 - RNA, 21 nt, Homo sapiens
gcccgcgugauuguggcauuu

SEQ ID NO: 1323939 - RNA, 16 nt, Homo sapiens
gcccuguugccuugag

SEQ ID NO: 1323940 - RNA, 19 nt, Homo sapiens
gccgcauucgcacuggggg

SEQ ID NO: 1323941 - RNA, 17 nt, Homo sapiens
gccuguaauuccagcca

SEQ ID NO: 1323942 - RNA, 17 nt, Homo sapiens
gcgaaguugaacccaga

SEQ ID NO: 1323943 - RNA, 15 nt, Homo sapiens
gcuaaggaagggaaa

SEQ ID NO: 1323944 - RNA, 19 nt, Homo sapiens
gcuauguuuccaucuucag

SEQ ID NO: 1323945 - RNA, 21 nt, Homo sapiens
gcucauauuaauguacuuaaa

SEQ ID NO: 1323946 - RNA, 16 nt, Homo sapiens
gcuggccacugcugga

SEQ ID NO: 1323947 - RNA, 14 nt, Homo sapiens
gcugggaucugcga

SEQ ID NO: 1323948 - RNA, 18 nt, Homo sapiens
gcugggugcgaaggcaga

SEQ ID NO: 1323949 - RNA, 16 nt, Homo sapiens
gcuuuacuagugccaa

SEQ ID NO: 1323950 - RNA, 12 nt, Homo sapiens
ggcauaugauuu

SEQ ID NO: 1323951 - RNA, 17 nt, Homo sapiens
ggccaaggacagggugg

SEQ ID NO: 1323952 - RNA, 14 nt, Homo sapiens
ggccagcaugguga

SEQ ID NO: 1323953 - RNA, 21 nt, Homo sapiens
ggcccaugugacuguggcauu

SEQ ID NO: 1323954 - RNA, 21 nt, Homo sapiens
ggucacucugaccuuauuacu

SEQ ID NO: 1323955 - RNA, 22 nt, Homo sapiens
guacugauuauucuucuuacau

SEQ ID NO: 1323956 - RNA, 17 nt, Homo sapiens
guacuuaaauuacacau

SEQ ID NO: 1323957 - RNA, 23 nt, Homo sapiens
guaugguuuuucaccaaaccaug

SEQ ID NO: 1323958 - RNA, 12 nt, Homo sapiens
guuuuucuuauc

SEQ ID NO: 1323959 - RNA, 21 nt, Homo sapiens
uaaaauuucacucuggcauau

SEQ ID NO: 1323960 - RNA, 19 nt, Homo sapiens
uaaucuuucuccacuguuc

SEQ ID NO: 1323961 - RNA, 18 nt, Homo sapiens
uaaugggaaucauuccac

SEQ ID NO: 1323962 - RNA, 16 nt, Homo sapiens
uaccuuagacugaaaa

SEQ ID NO: 1323963 - RNA, 13 nt, Homo sapiens
uacuaaagcuaua

SEQ ID NO: 1323964 - RNA, 20 nt, Homo sapiens
uagaaguacguuuuugcauu

SEQ ID NO: 1323965 - RNA, 19 nt, Homo sapiens
uagacugaaaaacuguugg

SEQ ID NO: 1323966 - RNA, 16 nt, Homo sapiens
uagcuggccacugcug

SEQ ID NO: 1323967 - RNA, 21 nt, Homo sapiens
uauauucgguuggaaccuaau

SEQ ID NO: 1323968 - RNA, 13 nt, Homo sapiens
uauauuucugaua

SEQ ID NO: 1323969 - RNA, 14 nt, Homo sapiens
uaucaaaugguuau

SEQ ID NO: 1323970 - RNA, 22 nt, Homo sapiens
uauguucuaacagcaucugccu

SEQ ID NO: 1323971 - RNA, 12 nt, Homo sapiens
uauuaagggaaa

SEQ ID NO: 1323972 - RNA, 13 nt, Homo sapiens
uauucauaugcuu

SEQ ID NO: 1323973 - RNA, 14 nt, Homo sapiens
uauucucagcacuu

SEQ ID NO: 1323974 - RNA, 21 nt, Homo sapiens
ucaauaugaaggacuauuaau

SEQ ID NO: 1323975 - RNA, 12 nt, Homo sapiens
ucacaauuucag

SEQ ID NO: 1323976 - RNA, 23 nt, Homo sapiens
ucacaucuugguauguggccaua

SEQ ID NO: 1323977 - RNA, 15 nt, Homo sapiens
ucacucugaccuuau

SEQ ID NO: 1323978 - RNA, 17 nt, Homo sapiens
ucagagaaaacuguuga

SEQ ID NO: 1323979 - RNA, 15 nt, Homo sapiens
ucagaggagccagaa

SEQ ID NO: 1323980 - RNA, 13 nt, Homo sapiens
ucauugaccuaau

SEQ ID NO: 1323981 - RNA, 11 nt, Homo sapiens
uccaccuuucu

SEQ ID NO: 1323982 - RNA, 14 nt, Homo sapiens
ucccagucugauau

SEQ ID NO: 1323983 - RNA, 16 nt, Homo sapiens
ucccuauguugcuaua

SEQ ID NO: 1323984 - RNA, 12 nt, Homo sapiens
ucccuguuauaa

SEQ ID NO: 1323985 - RNA, 16 nt, Homo sapiens
uccuccgggggccaag

SEQ ID NO: 1323986 - RNA, 14 nt, Homo sapiens
uccugcaccugcug

SEQ ID NO: 1323987 - RNA, 21 nt, Homo sapiens
uccugcauuuuuuuaccuuaa

SEQ ID NO: 1323988 - RNA, 13 nt, Homo sapiens
ucguguucacuca

SEQ ID NO: 1323989 - RNA, 13 nt, Homo sapiens
ucuacgcccuucc

SEQ ID NO: 1323990 - RNA, 15 nt, Homo sapiens
ucugauauucaccua

SEQ ID NO: 1323991 - RNA, 19 nt, Homo sapiens
ucugcagcacgcuggacag

SEQ ID NO: 1323992 - RNA, 21 nt, Homo sapiens
ugaagacuaguuauauauucc

SEQ ID NO: 1323993 - RNA, 22 nt, Homo sapiens
ugaagacuaguuauauauuccu

SEQ ID NO: 1323994 - RNA, 15 nt, Homo sapiens
ugacuguggcauuuu

SEQ ID NO: 1323995 - RNA, 20 nt, Homo sapiens
ugagcuaaggcagccuucag

SEQ ID NO: 1323996 - RNA, 16 nt, Homo sapiens
ugaggcaggagaauug

SEQ ID NO: 1323997 - RNA, 15 nt, Homo sapiens
ugauuguggcauuua

SEQ ID NO: 1323998 - RNA, 13 nt, Homo sapiens
ugcacagcaacug

SEQ ID NO: 1323999 - RNA, 22 nt, Homo sapiens
ugcagaggaaacuuaagcauaa

SEQ ID NO: 1324000 - RNA, 21 nt, Homo sapiens
ugcaucaucaucacaaccuaa

SEQ ID NO: 1324001 - RNA, 13 nt, Homo sapiens
ugccaaaccuuua

SEQ ID NO: 1324002 - RNA, 14 nt, Homo sapiens
ugccaaaccuuuaa

SEQ ID NO: 1324003 - RNA, 22 nt, Homo sapiens
ugcucauauuaauguacuuaaa

SEQ ID NO: 1324004 - RNA, 15 nt, Homo sapiens
uggacagcacucugc

SEQ ID NO: 1324005 - RNA, 16 nt, Homo sapiens
uggcauuuaaggagca

SEQ ID NO: 1324006 - RNA, 22 nt, Homo sapiens
uggcccaugugacuguggcauu

SEQ ID NO: 1324007 - RNA, 19 nt, Homo sapiens
agucugcaucaucaucaca

SEQ ID NO: 1324008 - RNA, 19 nt, Homo sapiens
agugucuaauucccuguua

SEQ ID NO: 1324009 - RNA, 13 nt, Homo sapiens
aguuuucccacau

SEQ ID NO: 1324010 - RNA, 18 nt, Homo sapiens
auaacaugauacuauuca

SEQ ID NO: 1324011 - RNA, 14 nt, Homo sapiens
auaagacaagaaua

SEQ ID NO: 1324012 - RNA, 20 nt, Homo sapiens
auaggucauuuucuauucac

SEQ ID NO: 1324013 - RNA, 20 nt, Homo sapiens
auauauuuaugaaugugcau

SEQ ID NO: 1324014 - RNA, 15 nt, Homo sapiens
auaugaaauguauuu

SEQ ID NO: 1324015 - RNA, 21 nt, Homo sapiens
auauguuuauguaacuaucaa

SEQ ID NO: 1324016 - RNA, 23 nt, Homo sapiens
auauuaauuuguuuuucuuaucc

SEQ ID NO: 1324017 - RNA, 21 nt, Homo sapiens
aucacuggcaauauuuguucu

SEQ ID NO: 1324018 - RNA, 19 nt, Homo sapiens
aucccagucugauauucac

SEQ ID NO: 1324019 - RNA, 15 nt, Homo sapiens
augaaaggagcagug

SEQ ID NO: 1324020 - RNA, 19 nt, Homo sapiens
augaaugugcauuucuuga

SEQ ID NO: 1324021 - RNA, 18 nt, Homo sapiens
augaauguucuugguucc

SEQ ID NO: 1324022 - RNA, 14 nt, Homo sapiens
augauacuauucag

SEQ ID NO: 1324023 - RNA, 19 nt, Homo sapiens
augaugcuggaaauaugaa

SEQ ID NO: 1324024 - RNA, 16 nt, Homo sapiens
augcuggaaauaugaa

SEQ ID NO: 1324025 - RNA, 15 nt, Homo sapiens
augggaaucauucca

SEQ ID NO: 1324026 - RNA, 13 nt, Homo sapiens
auguaacuaucaa

SEQ ID NO: 1324027 - RNA, 12 nt, Homo sapiens
auguauucaccu

SEQ ID NO: 1324028 - RNA, 17 nt, Homo sapiens
augucuguaucuacuua

SEQ ID NO: 1324029 - RNA, 21 nt, Homo sapiens
auguuaguguuuagauaauac

SEQ ID NO: 1324030 - RNA, 20 nt, Homo sapiens
auguuuccaucuucaguuuc

SEQ ID NO: 1324031 - RNA, 12 nt, Homo sapiens
auuaaucauucc

SEQ ID NO: 1324032 - RNA, 21 nt, Homo sapiens
auuaaucauuccauuuauccu

SEQ ID NO: 1324033 - RNA, 14 nt, Homo sapiens
auuagccaggcgug

SEQ ID NO: 1324034 - RNA, 17 nt, Homo sapiens
auuauaaaugacagauc

SEQ ID NO: 1324035 - RNA, 19 nt, Homo sapiens
auucaaaguuuguggcaua

SEQ ID NO: 1324036 - RNA, 20 nt, Homo sapiens
auucugaaaucagucuacca

SEQ ID NO: 1324037 - RNA, 13 nt, Homo sapiens
auugcuagugauu

SEQ ID NO: 1324038 - RNA, 14 nt, Homo sapiens
auuuauccuagaaa

SEQ ID NO: 1324039 - RNA, 22 nt, Homo sapiens
auuucccuggaauuuaauucaa

SEQ ID NO: 1324040 - RNA, 17 nt, Homo sapiens
auuuugggacauuugca

SEQ ID NO: 1324041 - RNA, 18 nt, Homo sapiens
caaagccugcguucucau

SEQ ID NO: 1324042 - RNA, 16 nt, Homo sapiens
caaaggcuuccugaaa

SEQ ID NO: 1324043 - RNA, 13 nt, Homo sapiens
caacuguugacau

SEQ ID NO: 1324044 - RNA, 16 nt, Homo sapiens
caagaacgauucaccu

SEQ ID NO: 1324045 - RNA, 18 nt, Homo sapiens
caagugaguuugguguuu

SEQ ID NO: 1324046 - RNA, 19 nt, Homo sapiens
caauaugaaggacuauuaa

SEQ ID NO: 1324047 - RNA, 16 nt, Homo sapiens
cacaguuacugacuua

SEQ ID NO: 1324048 - RNA, 12 nt, Homo sapiens
cacgcuggacag

SEQ ID NO: 1324049 - RNA, 21 nt, Homo sapiens
cacgcuggacagcacucugcc

SEQ ID NO: 1324050 - RNA, 14 nt, Homo sapiens
cagaaguguauuca

SEQ ID NO: 1324051 - RNA, 23 nt, Homo sapiens
cagaggaaacuuaagcauaaaaa

SEQ ID NO: 1324052 - RNA, 11 nt, Homo sapiens
cagcacucugc

SEQ ID NO: 1324053 - RNA, 18 nt, Homo sapiens
cagcacuuucccucugca

SEQ ID NO: 1324054 - RNA, 21 nt, Homo sapiens
cagcagccacuugacuaauac

SEQ ID NO: 1324055 - RNA, 23 nt, Homo sapiens
cagcauggugaaaccucaucucu

SEQ ID NO: 1324056 - RNA, 22 nt, Homo sapiens
cagucccuaucagcgccuccuu

SEQ ID NO: 1324057 - RNA, 18 nt, Homo sapiens
caguguuaauaaauggau

SEQ ID NO: 1324058 - RNA, 23 nt, Homo sapiens
caucaucacaaccuaaauggaga

SEQ ID NO: 1324059 - RNA, 21 nt, Homo sapiens
cauccagaaguguauucauau

SEQ ID NO: 1324060 - RNA, 20 nt, Homo sapiens
cauggugaaaccucaucucu

SEQ ID NO: 1324061 - RNA, 22 nt, Homo sapiens
cauucuugugacuuacagugcc

SEQ ID NO: 1324062 - RNA, 19 nt, Homo sapiens
cauuugcauucaauuuaca

SEQ ID NO: 1324063 - RNA, 18 nt, Homo sapiens
ccaggcgugguggcucac

SEQ ID NO: 1324064 - RNA, 18 nt, Homo sapiens
cccuguauucucagcacu

SEQ ID NO: 1324065 - RNA, 21 nt, Homo sapiens
cccuguauucucagcacuuug

SEQ ID NO: 1324066 - RNA, 18 nt, Homo sapiens
ccgaggcagguugaucac

SEQ ID NO: 1324067 - RNA, 16 nt, Homo sapiens
ccggugaggggagggu

SEQ ID NO: 1324068 - RNA, 19 nt, Homo sapiens
ccuaaugggaaucauucca

SEQ ID NO: 1324069 - RNA, 14 nt, Homo sapiens
ccuggaauuuaauu

SEQ ID NO: 1324070 - RNA, 23 nt, Homo sapiens
ccuggugcaucgaaauguauuca

SEQ ID NO: 1324071 - RNA, 18 nt, Homo sapiens
ccuguauucucagcacuu

SEQ ID NO: 1324072 - RNA, 17 nt, Homo sapiens
ccuucauuuuacauucu

SEQ ID NO: 1324073 - RNA, 18 nt, Homo sapiens
cguguucacucagcacuu

SEQ ID NO: 1324074 - RNA, 20 nt, Homo sapiens
cguguucacucagcacuuuc

SEQ ID NO: 1324075 - RNA, 21 nt, Homo sapiens
cuaaagguagaucaucuugaa

SEQ ID NO: 1324076 - RNA, 17 nt, Homo sapiens
cuacagagggauuuauu

SEQ ID NO: 1324077 - RNA, 15 nt, Homo sapiens
cuagugauuucauua

SEQ ID NO: 1324078 - RNA, 18 nt, Homo sapiens
cucaacaagaacgauuca

SEQ ID NO: 1324079 - RNA, 15 nt, Homo sapiens
cucagguugucugua

SEQ ID NO: 1324080 - RNA, 13 nt, Homo sapiens
cuccgggggccaa

SEQ ID NO: 1324081 - RNA, 19 nt, Homo sapiens
cucuauucaauuuaauucu

SEQ ID NO: 1324082 - RNA, 15 nt, Homo sapiens
cucugccuuaucuca

SEQ ID NO: 1324083 - RNA, 20 nt, Homo sapiens
cugaagggcuucuucuuaua

SEQ ID NO: 1324084 - RNA, 17 nt, Homo sapiens
cugacugaguagcucau

SEQ ID NO: 1324085 - RNA, 22 nt, Homo sapiens
cugcagcacgcuggacagcacu

SEQ ID NO: 1324086 - RNA, 17 nt, Homo sapiens
cugccucuauucaauuu

SEQ ID NO: 1324087 - RNA, 18 nt, Homo sapiens
cugcgaaguugaacccag

SEQ ID NO: 1324088 - RNA, 17 nt, Homo sapiens
cuggacagcacucugcc

SEQ ID NO: 1324089 - RNA, 15 nt, Homo sapiens
cuggcaauauuuguu

SEQ ID NO: 1324090 - RNA, 14 nt, Homo sapiens
cugguaccaagcug

SEQ ID NO: 1324091 - RNA, 14 nt, Homo sapiens
cuguaaaauuuguu

SEQ ID NO: 1324092 - RNA, 18 nt, Homo sapiens
cuguauucucagcacuuu

SEQ ID NO: 1324093 - RNA, 15 nt, Homo sapiens
cuguuauaauuugca

SEQ ID NO: 1324094 - RNA, 20 nt, Homo sapiens
cuuaagguacgcuugcuugu

SEQ ID NO: 1324095 - RNA, 22 nt, Homo sapiens
cuuacauuauuaaucauuccau

SEQ ID NO: 1324096 - RNA, 17 nt, Homo sapiens
cuuagacugaaaaacug

SEQ ID NO: 1324097 - RNA, 22 nt, Homo sapiens
cuucaauaugaaggacuauuaa

SEQ ID NO: 1324098 - RNA, 19 nt, Homo sapiens
cuuguaugguuuuucacca

SEQ ID NO: 1324099 - RNA, 20 nt, Homo sapiens
cuuuaguuaguauccuugga

SEQ ID NO: 1324100 - RNA, 13 nt, Homo sapiens
gaaaccaacuguu

SEQ ID NO: 1324101 - RNA, 13 nt, Homo sapiens
gaaaguaacuguu

SEQ ID NO: 1324102 - RNA, 18 nt, Homo sapiens
gaaccuguccaacauguu

SEQ ID NO: 1324103 - RNA, 15 nt, Homo sapiens
gaacuucacagagac

SEQ ID NO: 1324104 - RNA, 12 nt, Homo sapiens
gaagacuaguua

SEQ ID NO: 1324105 - RNA, 23 nt, Homo sapiens
gaaguugaggcuuagcuauguuu

SEQ ID NO: 1324106 - RNA, 14 nt, Homo sapiens
gacuaggagcccag

SEQ ID NO: 1324107 - RNA, 18 nt, Homo sapiens
gagcaguggcccauguga

SEQ ID NO: 1324108 - RNA, 19 nt, Homo sapiens
gagcuaaggcagccuucag

SEQ ID NO: 1324109 - RNA, 14 nt, Homo sapiens
gaggcaaggggugg

SEQ ID NO: 1324110 - RNA, 20 nt, Homo sapiens
gaggcagguugaucaccuga

SEQ ID NO: 1324111 - RNA, 17 nt, Homo sapiens
gaggcugggaucugcga

SEQ ID NO: 1324112 - RNA, 23 nt, Homo sapiens
gaggggagggugaggagcuggag

SEQ ID NO: 1324113 - RNA, 15 nt, Homo sapiens
gauuuaaaacaucuc

SEQ ID NO: 1324114 - RNA, 17 nt, Homo sapiens
gcacugggggacauggg

SEQ ID NO: 1324115 - RNA, 17 nt, Homo sapiens
gcaggagaauugcuuga

SEQ ID NO: 1324116 - RNA, 18 nt, Homo sapiens
aaacuguugguucaucca

SEQ ID NO: 1324117 - RNA, 19 nt, Homo sapiens
aaagaggauuaagcuuuuu

SEQ ID NO: 1324118 - RNA, 18 nt, Homo sapiens
aaagauaaaugaugauuc

SEQ ID NO: 1324119 - RNA, 11 nt, Homo sapiens
aaaugguuauu

SEQ ID NO: 1324120 - RNA, 22 nt, Homo sapiens
aacaaaauguuaugauaaucuu

SEQ ID NO: 1324121 - RNA, 22 nt, Homo sapiens
aaccucaucucucuaacaauau

SEQ ID NO: 1324122 - RNA, 23 nt, Homo sapiens
aaccucaucucucuaacaauaua

SEQ ID NO: 1324123 - RNA, 16 nt, Homo sapiens
aaccuuuaaauuuuca

SEQ ID NO: 1324124 - RNA, 14 nt, Homo sapiens
aagaaauggcauaa

SEQ ID NO: 1324125 - RNA, 24 nt, Homo sapiens
aaggaugacuuuuuuucugauuca

SEQ ID NO: 1324126 - RNA, 23 nt, Homo sapiens
aagugugccucugccuuaucuca

SEQ ID NO: 1324127 - RNA, 18 nt, Homo sapiens
aauaugaaggacuauuaa

SEQ ID NO: 1324128 - RNA, 11 nt, Homo sapiens
aauauguucua

SEQ ID NO: 1324129 - RNA, 20 nt, Homo sapiens
aaucagucuaccaaggggcu

SEQ ID NO: 1324130 - RNA, 14 nt, Homo sapiens
aaucauuccacuau

SEQ ID NO: 1324131 - RNA, 18 nt, Homo sapiens
aaucuuucuccacuguuc

SEQ ID NO: 1324132 - RNA, 14 nt, Homo sapiens
aaugcucauauuaa

SEQ ID NO: 1324133 - RNA, 17 nt, Homo sapiens
aaugggaaucauuccac

SEQ ID NO: 1324134 - RNA, 13 nt, Homo sapiens
aaugugcauuucu

SEQ ID NO: 1324135 - RNA, 14 nt, Homo sapiens
aauuacacauguag

SEQ ID NO: 1324136 - RNA, 21 nt, Homo sapiens
aauucccuguuauaauuugca

SEQ ID NO: 1324137 - RNA, 22 nt, Homo sapiens
acaaaacaaaauguuaugauaa

SEQ ID NO: 1324138 - RNA, 15 nt, Homo sapiens
acaaccuaaauggag

SEQ ID NO: 1324139 - RNA, 18 nt, Homo sapiens
cccuguuauaauuugcac

SEQ ID NO: 1324140 - RNA, 11 nt, Homo sapiens
ccuaaauggag

SEQ ID NO: 1324141 - RNA, 20 nt, Homo sapiens
ccuaaugggaaucauuccac

SEQ ID NO: 1324142 - RNA, 18 nt, Homo sapiens
ccuacagagggauuuauu

SEQ ID NO: 1324143 - RNA, 13 nt, Homo sapiens
ccucuauucaauu

SEQ ID NO: 1324144 - RNA, 22 nt, Homo sapiens
ccugaaaauguuaccaguguua

SEQ ID NO: 1324145 - RNA, 13 nt, Homo sapiens
ccugcaccugcug

SEQ ID NO: 1324146 - RNA, 17 nt, Homo sapiens
ccugugccugugacucu

SEQ ID NO: 1324147 - RNA, 19 nt, Homo sapiens
ccuguugccuugagcucuu

SEQ ID NO: 1324148 - RNA, 12 nt, Homo sapiens
ccuuuuccuuag

SEQ ID NO: 1324149 - RNA, 16 nt, Homo sapiens
cgcgugauuguggcau

SEQ ID NO: 1324150 - RNA, 19 nt, Homo sapiens
cguguucacucagcacuuu

SEQ ID NO: 1324151 - RNA, 18 nt, Homo sapiens
cuaaaagucagcuuuacu

SEQ ID NO: 1324152 - RNA, 22 nt, Homo sapiens
cuaaagguagaucaucuugaau

SEQ ID NO: 1324153 - RNA, 19 nt, Homo sapiens
cuagaaauauauucauaau

SEQ ID NO: 1324154 - RNA, 18 nt, Homo sapiens
cuauaugcauuuaauucu

SEQ ID NO: 1324155 - RNA, 17 nt, Homo sapiens
cuaugccgccaccggcc

SEQ ID NO: 1324156 - RNA, 16 nt, Homo sapiens
cuauucaauuuaauuc

SEQ ID NO: 1324157 - RNA, 15 nt, Homo sapiens
cucaccccccuguau

SEQ ID NO: 1324158 - RNA, 12 nt, Homo sapiens
cucagcacuuug

SEQ ID NO: 1324159 - RNA, 18 nt, Homo sapiens
cucaucucucuaacaaua

SEQ ID NO: 1324160 - RNA, 13 nt, Homo sapiens
cucauucuuguga

SEQ ID NO: 1324161 - RNA, 14 nt, Homo sapiens
cucguguucacuca

SEQ ID NO: 1324162 - RNA, 19 nt, Homo sapiens
cucguguucacucagcacu

SEQ ID NO: 1324163 - RNA, 14 nt, Homo sapiens
cucuguugaaggcu

SEQ ID NO: 1324164 - RNA, 21 nt, Homo sapiens
cugacuuagccuaaacaaccu

SEQ ID NO: 1324165 - RNA, 22 nt, Homo sapiens
cugaggcaggagaauugcuuga

SEQ ID NO: 1324166 - RNA, 20 nt, Homo sapiens
cugcaucaucaucacaaccu

SEQ ID NO: 1324167 - RNA, 18 nt, Homo sapiens
cuggagggaggggcggga

SEQ ID NO: 1324168 - RNA, 20 nt, Homo sapiens
cuggccccagucgaacuggg

SEQ ID NO: 1324169 - RNA, 15 nt, Homo sapiens
cuguaauuccagcca

SEQ ID NO: 1324170 - RNA, 21 nt, Homo sapiens
cuguagagaaugaaaggagca

SEQ ID NO: 1324171 - RNA, 18 nt, Homo sapiens
cuguccuuccaugcaaag

SEQ ID NO: 1324172 - RNA, 17 nt, Homo sapiens
cuuacauuauuaaucau

SEQ ID NO: 1324173 - RNA, 18 nt, Homo sapiens
cuuagcuguaaaauggaa

SEQ ID NO: 1324174 - RNA, 20 nt, Homo sapiens
cuuccaugcaaaggcuuccu

SEQ ID NO: 1324175 - RNA, 19 nt, Homo sapiens
cuuccugugccugugacuc

SEQ ID NO: 1324176 - RNA, 23 nt, Homo sapiens
cuucuuacauuauuaaucauucc

SEQ ID NO: 1324177 - RNA, 15 nt, Homo sapiens
cuuuacuagugccaa

SEQ ID NO: 1324178 - RNA, 17 nt, Homo sapiens
cuuuacuagugccaaac

SEQ ID NO: 1324179 - RNA, 18 nt, Homo sapiens
cuuuucaauuauuucaau

SEQ ID NO: 1324180 - RNA, 18 nt, Homo sapiens
cuuuuuuuuaagucacaa

SEQ ID NO: 1324181 - RNA, 12 nt, Homo sapiens
gaaaaugauuua

SEQ ID NO: 1324182 - RNA, 18 nt, Homo sapiens
gaaaccaacuguugacau

SEQ ID NO: 1324183 - RNA, 15 nt, Homo sapiens
gaaacuuaagcauaa

SEQ ID NO: 1324184 - RNA, 18 nt, Homo sapiens
gaaagagaaaugauguga

SEQ ID NO: 1324185 - RNA, 23 nt, Homo sapiens
gaaccuaaugggaaucauuccac

SEQ ID NO: 1324186 - RNA, 15 nt, Homo sapiens
gaacucaaugugcaa

SEQ ID NO: 1324187 - RNA, 22 nt, Homo sapiens
gaauaggucauuuucuauucac

SEQ ID NO: 1324188 - RNA, 16 nt, Homo sapiens
gaauucguuucugaca

SEQ ID NO: 1324189 - RNA, 17 nt, Homo sapiens
gaauucguuucugacau

SEQ ID NO: 1324190 - RNA, 23 nt, Homo sapiens
gaauucguuucugacauaccuua

SEQ ID NO: 1324191 - RNA, 15 nt, Homo sapiens
gacggcaagacucca

SEQ ID NO: 1324192 - RNA, 21 nt, Homo sapiens
gacuggcauccauaagugugc

SEQ ID NO: 1324193 - RNA, 16 nt, Homo sapiens
gagcauaucuguuaua

SEQ ID NO: 1324194 - RNA, 17 nt, Homo sapiens
gaggcagguugaucacc

SEQ ID NO: 1324195 - RNA, 12 nt, Homo sapiens
gauacuauucag

SEQ ID NO: 1324196 - RNA, 14 nt, Homo sapiens
gauauauauuaucu

SEQ ID NO: 1324197 - RNA, 16 nt, Homo sapiens
gauuauucuucuuaca

SEQ ID NO: 1324198 - RNA, 13 nt, Homo sapiens
gauuccugcauuu

SEQ ID NO: 1324199 - RNA, 22 nt, Homo sapiens
gauucguggagcccuacucaca

SEQ ID NO: 1324200 - RNA, 20 nt, Homo sapiens
gcaccaggucacucugaccu

SEQ ID NO: 1324201 - RNA, 20 nt, Homo sapiens
gcaucaucaucacaaccuaa

SEQ ID NO: 1324202 - RNA, 14 nt, Homo sapiens
gcauucgcacuggg

SEQ ID NO: 1324203 - RNA, 13 nt, Homo sapiens
gccgugccuggug

SEQ ID NO: 1324204 - RNA, 13 nt, Homo sapiens
gccuuuucuuaua

SEQ ID NO: 1324205 - RNA, 17 nt, Homo sapiens
gcuggacagcacucugc

SEQ ID NO: 1324206 - RNA, 19 nt, Homo sapiens
ggaaauaugaaauguauuu

SEQ ID NO: 1324207 - RNA, 22 nt, Homo sapiens
ggaaauauguucuaacagcauc

SEQ ID NO: 1324208 - RNA, 16 nt, Homo sapiens
ggcauuuaaggagcag

SEQ ID NO: 1324209 - RNA, 16 nt, Homo sapiens
ggccaaggacagggug

SEQ ID NO: 1324210 - RNA, 20 nt, Homo sapiens
gggucuagcuggccacugcu

SEQ ID NO: 1324211 - RNA, 21 nt, Homo sapiens
ggucuuucuacauaguuauuc

SEQ ID NO: 1324212 - RNA, 23 nt, Homo sapiens
ggugcaucgaaauguauucaccu

SEQ ID NO: 1324213 - RNA, 11 nt, Homo sapiens
guaaaauggaa

SEQ ID NO: 1324214 - RNA, 13 nt, Homo sapiens
guaaagaugucaa

SEQ ID NO: 1324215 - RNA, 21 nt, Homo sapiens
guaacaacucguguucacuca

SEQ ID NO: 1324216 - RNA, 14 nt, Homo sapiens
guaacagucugcau

SEQ ID NO: 1324217 - RNA, 15 nt, Homo sapiens
guacaaauuguucau

SEQ ID NO: 1324218 - RNA, 17 nt, Homo sapiens
guacguuuuugcauuau

SEQ ID NO: 1324219 - RNA, 23 nt, Homo sapiens
guagaaaagugcuguuugaggga

SEQ ID NO: 1324220 - RNA, 15 nt, Homo sapiens
guauucauauuacca

SEQ ID NO: 1324221 - RNA, 13 nt, Homo sapiens
gucgucaccuggg

SEQ ID NO: 1324222 - RNA, 14 nt, Homo sapiens
gugacuguggcauu

SEQ ID NO: 1324223 - RNA, 14 nt, Homo sapiens
gugacuuacagugc

SEQ ID NO: 1324224 - RNA, 14 nt, Homo sapiens
guggacggagccaa

SEQ ID NO: 1324225 - RNA, 23 nt, Homo sapiens
guggcccaugugacuguggcauu

SEQ ID NO: 1324226 - RNA, 17 nt, Homo sapiens
guguucacucagcacuu

SEQ ID NO: 1324227 - RNA, 13 nt, Homo sapiens
guuauaauuugca

SEQ ID NO: 1324228 - RNA, 14 nt, Homo sapiens
guuauaauuugcac

SEQ ID NO: 1324229 - RNA, 19 nt, Homo sapiens
guuauuuuaaaaaaauuca

SEQ ID NO: 1324230 - RNA, 16 nt, Homo sapiens
guucacucagcacuuu

SEQ ID NO: 1324231 - RNA, 19 nt, Homo sapiens
guugaucaccugaggucag

SEQ ID NO: 1324232 - RNA, 17 nt, Homo sapiens
guuuauguaacuaucaa

SEQ ID NO: 1324233 - RNA, 18 nt, Homo sapiens
uaauacagguaacauuau

SEQ ID NO: 1324234 - RNA, 16 nt, Homo sapiens
uaaucauuccauuuau

SEQ ID NO: 1324235 - RNA, 18 nt, Homo sapiens
uacacacaguuacugacu

SEQ ID NO: 1324236 - RNA, 20 nt, Homo sapiens
uacauuauuaaucauuccau

SEQ ID NO: 1324237 - RNA, 21 nt, Homo sapiens
uaccaguguuaauaaauggau

SEQ ID NO: 1324238 - RNA, 18 nt, Homo sapiens
uacuaaaagucagcuuua

SEQ ID NO: 1324239 - RNA, 15 nt, Homo sapiens
uacuauuaagggaaa

SEQ ID NO: 1324240 - RNA, 18 nt, Homo sapiens
uacuugaaaaaauguucu

SEQ ID NO: 1324241 - RNA, 15 nt, Homo sapiens
uagaaauauauucau

SEQ ID NO: 1324242 - RNA, 22 nt, Homo sapiens
uagcaagaacucugcacagcaa

SEQ ID NO: 1324243 - RNA, 17 nt, Homo sapiens
uagccaggcgugguggu

SEQ ID NO: 1324244 - RNA, 13 nt, Homo sapiens
uaggaauugcauu

SEQ ID NO: 1324245 - RNA, 18 nt, Homo sapiens
uaggccaggcgugguggc

SEQ ID NO: 1324246 - RNA, 22 nt, Homo sapiens
uagggcugauaauacacacagu

SEQ ID NO: 1324247 - RNA, 17 nt, Homo sapiens
uagugauuucauuacca

SEQ ID NO: 1324248 - RNA, 14 nt, Homo sapiens
uauauauuccuuac

SEQ ID NO: 1324249 - RNA, 21 nt, Homo sapiens
uauauguuuauguaacuauca

SEQ ID NO: 1324250 - RNA, 17 nt, Homo sapiens
uaucaccauuacuuuuu

SEQ ID NO: 1324251 - RNA, 20 nt, Homo sapiens
uaucuacgcccuuccugugc

SEQ ID NO: 1324252 - RNA, 12 nt, Homo sapiens
uaucuguuauau

SEQ ID NO: 1324253 - RNA, 20 nt, Homo sapiens
uaugaaggacuauuaauucc

SEQ ID NO: 1324254 - RNA, 13 nt, Homo sapiens
uaugaaugugcau

SEQ ID NO: 1324255 - RNA, 16 nt, Homo sapiens
uaugauguauacccau

SEQ ID NO: 1324256 - RNA, 15 nt, Homo sapiens
uauuuuaaaauuuca

SEQ ID NO: 1324257 - RNA, 24 nt, Homo sapiens
uauuuuaaaauuucacucuggcau

SEQ ID NO: 1324258 - RNA, 21 nt, Homo sapiens
ucacaccacuacacuccagcc

SEQ ID NO: 1324259 - RNA, 14 nt, Homo sapiens
ucacucagcacuuu

SEQ ID NO: 1324260 - RNA, 14 nt, Homo sapiens
ucacucuggcauau

SEQ ID NO: 1324261 - RNA, 21 nt, Homo sapiens
ucauaaaaguagcaaccuuca

SEQ ID NO: 1324262 - RNA, 11 nt, Homo sapiens
ucaucauauga

SEQ ID NO: 1324263 - RNA, 16 nt, Homo sapiens
ucauucuugugacuua

SEQ ID NO: 1324264 - RNA, 23 nt, Homo sapiens
ucccagugucuaauucccuguua

SEQ ID NO: 1324265 - RNA, 17 nt, Homo sapiens
ucccuccugguaccaag

SEQ ID NO: 1324266 - RNA, 21 nt, Homo sapiens
ucgaaauguauucaccuuucu

SEQ ID NO: 1324267 - RNA, 17 nt, Homo sapiens
ucgcacugggggacaug

SEQ ID NO: 1324268 - RNA, 19 nt, Homo sapiens
ucguguucacucagcacuu

SEQ ID NO: 1324269 - RNA, 14 nt, Homo sapiens
ucucaacaguucau

SEQ ID NO: 1324270 - RNA, 12 nt, Homo sapiens
ucucagcacuuu

SEQ ID NO: 1324271 - RNA, 17 nt, Homo sapiens
ucugcaucaucaucaca

SEQ ID NO: 1324272 - RNA, 14 nt, Homo sapiens
ucuggcauaugauu

SEQ ID NO: 1324273 - RNA, 15 nt, Homo sapiens
ucuucaauaugaagg

SEQ ID NO: 1324274 - RNA, 19 nt, Homo sapiens
ucuucuaucuacgcccuuc

SEQ ID NO: 1324275 - RNA, 23 nt, Homo sapiens
ucuucugagcuaaggcagccuuc

SEQ ID NO: 1324276 - RNA, 18 nt, Homo sapiens
ucuugaauauuugcuuaa

SEQ ID NO: 1324277 - RNA, 15 nt, Homo sapiens
ugaaaccucaucucu

SEQ ID NO: 1324278 - RNA, 24 nt, Homo sapiens
ugaaauguauuuuaaaauuucacu

SEQ ID NO: 1324279 - RNA, 16 nt, Homo sapiens
ugacuuacagugccaa

SEQ ID NO: 1324280 - RNA, 20 nt, Homo sapiens
ugagcuaagaucacaccacu

SEQ ID NO: 1324281 - RNA, 19 nt, Homo sapiens
ugaugccacagagaauaag

SEQ ID NO: 1324282 - RNA, 15 nt, Homo sapiens
ugauguauacccaua

SEQ ID NO: 1324283 - RNA, 12 nt, Homo sapiens
ugauuguggcau

SEQ ID NO: 1324284 - RNA, 17 nt, Homo sapiens
ugauuuuuuaaagcgua

SEQ ID NO: 1324285 - RNA, 13 nt, Homo sapiens
ugcagcacgcugg

SEQ ID NO: 1324286 - RNA, 13 nt, Homo sapiens
ugccaacauuuaa

SEQ ID NO: 1324287 - RNA, 14 nt, Homo sapiens
ugcuuaaaauugcu

SEQ ID NO: 1324288 - RNA, 15 nt, Homo sapiens
ugggaaucauuccac

SEQ ID NO: 1324289 - RNA, 20 nt, Homo sapiens
ugguguuguauacuucauua

SEQ ID NO: 1324290 - RNA, 23 nt, Homo sapiens
uguacacaaaucccuauguugcu

SEQ ID NO: 1324291 - RNA, 16 nt, Homo sapiens
uguauucucagcacuu

SEQ ID NO: 1324292 - RNA, 17 nt, Homo sapiens
uguauucucagcacuuu

SEQ ID NO: 1324293 - RNA, 18 nt, Homo sapiens
uguauuuuaaaauuucac

SEQ ID NO: 1324294 - RNA, 17 nt, Homo sapiens
uguuacuaaagcuauau

SEQ ID NO: 1324295 - RNA, 16 nt, Homo sapiens
uguucacucagcacuu

SEQ ID NO: 1324296 - RNA, 18 nt, Homo sapiens
uguuuauguaacuaucaa

SEQ ID NO: 1324297 - RNA, 18 nt, Homo sapiens
uuaacccccaaauucaaa

SEQ ID NO: 1324298 - RNA, 23 nt, Homo sapiens
uuagcagucauagggcugauaau

SEQ ID NO: 1324299 - RNA, 11 nt, Homo sapiens
uuauauauucc

SEQ ID NO: 1324300 - RNA, 15 nt, Homo sapiens
uuaugaaaccaacug

SEQ ID NO: 1324301 - RNA, 15 nt, Homo sapiens
uuauguaacuaucaa

SEQ ID NO: 1324302 - RNA, 16 nt, Homo sapiens
uuauuuuuaugaugcu

SEQ ID NO: 1324303 - RNA, 15 nt, Homo sapiens
uucauauuaccagaa

SEQ ID NO: 1324304 - RNA, 22 nt, Homo sapiens
uucucaacaguucauugcucaa

SEQ ID NO: 1324305 - RNA, 14 nt, Homo sapiens
uucuccacuguucu

SEQ ID NO: 1324306 - RNA, 13 nt, Homo sapiens
uugcagugagcua

SEQ ID NO: 1324307 - RNA, 14 nt, Homo sapiens
uugccuugagcucu

SEQ ID NO: 1324308 - RNA, 19 nt, Homo sapiens
uugggacauuugcauucaa

SEQ ID NO: 1324309 - RNA, 21 nt, Homo sapiens
uuuaauagaaagauacaaccu

SEQ ID NO: 1324310 - RNA, 15 nt, Homo sapiens
uuucaauuauuucaa

SEQ ID NO: 1324311 - RNA, 21 nt, Homo sapiens
uuucugcugcuuggcacauuu

SEQ ID NO: 1324312 - RNA, 22 nt, Homo sapiens
uuugaagccugcuaaaugaaga

SEQ ID NO: 1324313 - RNA, 17 nt, Homo sapiens
uuugcuuaaaauugcua

SEQ ID NO: 1324314 - RNA, 18 nt, Homo sapiens
uuuuaagucacaauuuca

SEQ ID NO: 1324315 - RNA, 20 nt, Homo sapiens
uuuuagauucccagugucua

SEQ ID NO: 1324316 - RNA, 13 nt, Homo sapiens
uuuuauaugaugu

SEQ ID NO: 1324317 - RNA, 17 nt, Homo sapiens
uuuuccuuagcuguaaa

SEQ ID NO: 1324318 - RNA, 19 nt, Homo sapiens
aaaagaaauauaucuguga

SEQ ID NO: 1324319 - RNA, 15 nt, Homo sapiens
aaaagucagcuuuac

SEQ ID NO: 1324320 - RNA, 20 nt, Homo sapiens
aaacugagccucuuuucaau

SEQ ID NO: 1324321 - RNA, 20 nt, Homo sapiens
aaagguagaucaucuugaau

SEQ ID NO: 1324322 - RNA, 22 nt, Homo sapiens
aaccuaaugggaaucauuccac

SEQ ID NO: 1324323 - RNA, 20 nt, Homo sapiens
aacucguguucacucagcac

SEQ ID NO: 1324324 - RNA, 22 nt, Homo sapiens
aacucguguucacucagcacuu

SEQ ID NO: 1324325 - RNA, 23 nt, Homo sapiens
aacucguguucacucagcacuuu

SEQ ID NO: 1324326 - RNA, 18 nt, Homo sapiens
aagaaauggcauaaucuu

SEQ ID NO: 1324327 - RNA, 14 nt, Homo sapiens
aagaucacaccacu

SEQ ID NO: 1324328 - RNA, 15 nt, Homo sapiens
aagaucacaccacua

SEQ ID NO: 1324329 - RNA, 21 nt, Homo sapiens
aaggagcaguggcccauguga

SEQ ID NO: 1324330 - RNA, 14 nt, Homo sapiens
aaggcuuccugaaa

SEQ ID NO: 1324331 - RNA, 19 nt, Homo sapiens
aaucagagaaaacuguuga

SEQ ID NO: 1324332 - RNA, 10 nt, Homo sapiens
aaucauucca

SEQ ID NO: 1324333 - RNA, 20 nt, Homo sapiens
aaugugcaaguuguacugua

SEQ ID NO: 1324334 - RNA, 20 nt, Homo sapiens
aauucaguacugauuauucu

SEQ ID NO: 1324335 - RNA, 23 nt, Homo sapiens
aauugcccuguugccuugagcuc

SEQ ID NO: 1324336 - RNA, 22 nt, Homo sapiens
aauugccuacagagggauuuau

SEQ ID NO: 1324337 - RNA, 19 nt, Homo sapiens
aauuuugggacauuugcau

SEQ ID NO: 1324338 - RNA, 17 nt, Homo sapiens
acaacucguguucacuc

SEQ ID NO: 1324339 - RNA, 23 nt, Homo sapiens
acacaaaucccuauguugcuaua

SEQ ID NO: 1324340 - RNA, 15 nt, Homo sapiens
acagagggauuuauu

SEQ ID NO: 1324341 - RNA, 20 nt, Homo sapiens
acagcaucugccucuauuca

SEQ ID NO: 1324342 - RNA, 22 nt, Homo sapiens
acagcaucugccucuauucaau

SEQ ID NO: 1324343 - RNA, 15 nt, Homo sapiens
acaggaacuaggaua

SEQ ID NO: 1324344 - RNA, 16 nt, Homo sapiens
accacuacacuccagc

SEQ ID NO: 1324345 - RNA, 20 nt, Homo sapiens
accauggauagaaucaauau

SEQ ID NO: 1324346 - RNA, 19 nt, Homo sapiens
accuaaugggaaucauucc

SEQ ID NO: 1324347 - RNA, 17 nt, Homo sapiens
acgcuggacagcacucu

SEQ ID NO: 1324348 - RNA, 11 nt, Homo sapiens
acuacacucca

SEQ ID NO: 1324349 - RNA, 17 nt, Homo sapiens
acucaagcagugugcug

SEQ ID NO: 1324350 - RNA, 19 nt, Homo sapiens
acucgagaggcugaggcag

SEQ ID NO: 1324351 - RNA, 13 nt, Homo sapiens
acuguggcauuuu

SEQ ID NO: 1324352 - RNA, 21 nt, Homo sapiens
agaauuuugggacauuugcau

SEQ ID NO: 1324353 - RNA, 23 nt, Homo sapiens
agaccaucuucuaucuucuuucc

SEQ ID NO: 1324354 - RNA, 20 nt, Homo sapiens
agacugacugaguagcucau

SEQ ID NO: 1324355 - RNA, 13 nt, Homo sapiens
agagaaaacuguu

SEQ ID NO: 1324356 - RNA, 17 nt, Homo sapiens
agaucacaccacuacac

SEQ ID NO: 1324357 - RNA, 23 nt, Homo sapiens
agaucucaauuuuauaguagugg

SEQ ID NO: 1324358 - RNA, 21 nt, Homo sapiens
agauuggaucauuuaacaaua

SEQ ID NO: 1324359 - RNA, 21 nt, Homo sapiens
agauugggguguuagaagugc

SEQ ID NO: 1324360 - RNA, 15 nt, Homo sapiens
agcuguaaaauggaa

SEQ ID NO: 1324361 - RNA, 14 nt, Homo sapiens
aggauuaagcuuuu

SEQ ID NO: 1324362 - RNA, 19 nt, Homo sapiens
agggguggacggagccaaa

SEQ ID NO: 1324363 - RNA, 17 nt, Homo sapiens
aggucauuuucuauuca

SEQ ID NO: 1324364 - RNA, 21 nt, Homo sapiens
agucgaacugggggcuagcca

SEQ ID NO: 1324365 - RNA, 14 nt, Homo sapiens
aguucauugcucaa

SEQ ID NO: 1324366 - RNA, 15 nt, Homo sapiens
auaauacacacaguu

SEQ ID NO: 1324367 - RNA, 20 nt, Homo sapiens
auaauuucaucccuauuuau

SEQ ID NO: 1324368 - RNA, 13 nt, Homo sapiens
auacaugaacuuc

SEQ ID NO: 1324369 - RNA, 18 nt, Homo sapiens
auagaaucaauauuugua

SEQ ID NO: 1324370 - RNA, 17 nt, Homo sapiens
auagaaugcugaacuca

SEQ ID NO: 1324371 - RNA, 19 nt, Homo sapiens
auaggucauuuucuauuca

SEQ ID NO: 1324372 - RNA, 15 nt, Homo sapiens
aucaagaaucauuga

SEQ ID NO: 1324373 - RNA, 12 nt, Homo sapiens
aucaucaucaca

SEQ ID NO: 1324374 - RNA, 18 nt, Homo sapiens
aucccuauguugcuauaa

SEQ ID NO: 1324375 - RNA, 18 nt, Homo sapiens
aucugaaagaaauggcau

SEQ ID NO: 1324376 - RNA, 16 nt, Homo sapiens
aucugccucuauucaa

SEQ ID NO: 1324377 - RNA, 20 nt, Homo sapiens
augcuucccagagaagcuca

SEQ ID NO: 1324378 - RNA, 19 nt, Homo sapiens
auggaaugugguacaaauu

SEQ ID NO: 1324379 - RNA, 15 nt, Homo sapiens
auggugaaaccucau

SEQ ID NO: 1324380 - RNA, 17 nt, Homo sapiens
auuaacccccaaauuca

SEQ ID NO: 1324381 - RNA, 22 nt, Homo sapiens
auuacacauguagagcauaucu

SEQ ID NO: 1324382 - RNA, 22 nt, Homo sapiens
auucaauuuacagguaccagua

SEQ ID NO: 1324383 - RNA, 21 nt, Homo sapiens
auucaccuggguuugcaagaa

SEQ ID NO: 1324384 - RNA, 13 nt, Homo sapiens
auucucagcacuu

SEQ ID NO: 1324385 - RNA, 14 nt, Homo sapiens
auucucagcacuuu

SEQ ID NO: 1324386 - RNA, 16 nt, Homo sapiens
auuuaaggagcagugg

SEQ ID NO: 1324387 - RNA, 19 nt, Homo sapiens
auuucccuggaauuuaauu

SEQ ID NO: 1324388 - RNA, 22 nt, Homo sapiens
auuuguuguacuuuuuauucaa

SEQ ID NO: 1324389 - RNA, 23 nt, Homo sapiens
auuuuaaaauuuugcuaccaaag

SEQ ID NO: 1324390 - RNA, 12 nt, Homo sapiens
auuuucuauuca

SEQ ID NO: 1324391 - RNA, 16 nt, Homo sapiens
auuuugcuaccaaaga

SEQ ID NO: 1324392 - RNA, 15 nt, Homo sapiens
auuuuuagauuccca

SEQ ID NO: 1324393 - RNA, 15 nt, Homo sapiens
caaaucccuauguug

SEQ ID NO: 1324394 - RNA, 14 nt, Homo sapiens
caaccuaaauggag

SEQ ID NO: 1324395 - RNA, 17 nt, Homo sapiens
caagucaugauggaugg

SEQ ID NO: 1324396 - RNA, 15 nt, Homo sapiens
caauucuguauagau

SEQ ID NO: 1324397 - RNA, 19 nt, Homo sapiens
caccauccuuuacuauuaa

SEQ ID NO: 1324398 - RNA, 14 nt, Homo sapiens
cacuacacuccagc

SEQ ID NO: 1324399 - RNA, 20 nt, Homo sapiens
cacuagcuaaggaagggaaa

SEQ ID NO: 1324400 - RNA, 14 nt, Homo sapiens
cacucagcacuuuc

SEQ ID NO: 1324401 - RNA, 15 nt, Homo sapiens
cacucagcacuuucc

SEQ ID NO: 1324402 - RNA, 15 nt, Homo sapiens
cacuccagccugggc

SEQ ID NO: 1324403 - RNA, 22 nt, Homo sapiens
cagaauuuugggacauuugcau

SEQ ID NO: 1324404 - RNA, 15 nt, Homo sapiens
cagcacaugguguug

SEQ ID NO: 1324405 - RNA, 22 nt, Homo sapiens
cagcacgcuggacagcacucug

SEQ ID NO: 1324406 - RNA, 13 nt, Homo sapiens
cagcacucugcca

SEQ ID NO: 1324407 - RNA, 12 nt, Homo sapiens
cagcaucugccu

SEQ ID NO: 1324408 - RNA, 16 nt, Homo sapiens
cagcuuuacuagugcc

SEQ ID NO: 1324409 - RNA, 16 nt, Homo sapiens
cagguugaucaccuga

SEQ ID NO: 1324410 - RNA, 17 nt, Homo sapiens
cauauauuuaugaaugu

SEQ ID NO: 1324411 - RNA, 22 nt, Homo sapiens
cauccuuuacuauuaagggaaa

SEQ ID NO: 1324412 - RNA, 15 nt, Homo sapiens
caugaggacuaggag

SEQ ID NO: 1324413 - RNA, 15 nt, Homo sapiens
caugauacuauucag

SEQ ID NO: 1324414 - RNA, 15 nt, Homo sapiens
cauuccauuuauccu

SEQ ID NO: 1324415 - RNA, 16 nt, Homo sapiens
cauuuaaggagcagug

SEQ ID NO: 1324416 - RNA, 16 nt, Homo sapiens
cauuuuacauucuguc

SEQ ID NO: 1324417 - RNA, 13 nt, Homo sapiens
cauuuucuauuca

SEQ ID NO: 1324418 - RNA, 18 nt, Homo sapiens
ccacagagaauaagcuga

SEQ ID NO: 1324419 - RNA, 13 nt, Homo sapiens
ccacauuauuugu

SEQ ID NO: 1324420 - RNA, 19 nt, Homo sapiens
ccagaaguaaaguuuauuu

SEQ ID NO: 1324421 - RNA, 15 nt, Homo sapiens
ccagaaguguauuca

SEQ ID NO: 1324422 - RNA, 18 nt, Homo sapiens
ccagucugauauucaccu

SEQ ID NO: 1324423 - RNA, 12 nt, Homo sapiens
cccacuggguuu

SEQ ID NO: 1324424 - RNA, 21 nt, Homo sapiens
uggcccgcgugauuguggcau

SEQ ID NO: 1324425 - RNA, 18 nt, Homo sapiens
auuauuugucuccaugau

SEQ ID NO: 1324426 - RNA, 19 nt, Homo sapiens
auucaaaagugaacuugau

SEQ ID NO: 1324427 - RNA, 18 nt, Homo sapiens
auuccauuuauccuagaa

SEQ ID NO: 1324428 - RNA, 19 nt, Homo sapiens
auucuaucacuggcaauau

SEQ ID NO: 1324429 - RNA, 15 nt, Homo sapiens
auucucagcacuuug

SEQ ID NO: 1324430 - RNA, 20 nt, Homo sapiens
auucuugugacuuacagugc

SEQ ID NO: 1324431 - RNA, 21 nt, Homo sapiens
auugucuuaaauaaaucaaga

SEQ ID NO: 1324432 - RNA, 15 nt, Homo sapiens
auuucacucuggcau

SEQ ID NO: 1324433 - RNA, 15 nt, Homo sapiens
auuucauuaccaagu

SEQ ID NO: 1324434 - RNA, 16 nt, Homo sapiens
auuucuguguuacuca

SEQ ID NO: 1324435 - RNA, 13 nt, Homo sapiens
auuuucuauucac

SEQ ID NO: 1324436 - RNA, 15 nt, Homo sapiens
auuuucuuucaacau

SEQ ID NO: 1324437 - RNA, 16 nt, Homo sapiens
caaaacaaaauguuau

SEQ ID NO: 1324438 - RNA, 22 nt, Homo sapiens
caaaccauggauagaaucaaua

SEQ ID NO: 1324439 - RNA, 19 nt, Homo sapiens
caaaccuuuaaauuuucaa

SEQ ID NO: 1324440 - RNA, 20 nt, Homo sapiens
caacaagaacgauucaccug

SEQ ID NO: 1324441 - RNA, 23 nt, Homo sapiens
caacucguguucacucagcacuu

SEQ ID NO: 1324442 - RNA, 18 nt, Homo sapiens
caauauaauaauuagcca

SEQ ID NO: 1324443 - RNA, 21 nt, Homo sapiens
caauucaguacugauuauucu

SEQ ID NO: 1324444 - RNA, 23 nt, Homo sapiens
cacacugaaauucuaaauauuga

SEQ ID NO: 1324445 - RNA, 20 nt, Homo sapiens
cacgcuggacagcacucugc

SEQ ID NO: 1324446 - RNA, 13 nt, Homo sapiens
cacucagcacuuu

SEQ ID NO: 1324447 - RNA, 13 nt, Homo sapiens
cacucugccaucc

SEQ ID NO: 1324448 - RNA, 19 nt, Homo sapiens
cagagguugcagugagcua

SEQ ID NO: 1324449 - RNA, 11 nt, Homo sapiens
cagcacuuugg

SEQ ID NO: 1324450 - RNA, 21 nt, Homo sapiens
cagcgcuggucgucaccuggg

SEQ ID NO: 1324451 - RNA, 20 nt, Homo sapiens
caggaggcagagguugcagu

SEQ ID NO: 1324452 - RNA, 18 nt, Homo sapiens
caggcgugguggcucacc

SEQ ID NO: 1324453 - RNA, 20 nt, Homo sapiens
caguggcccaugugacugug

SEQ ID NO: 1324454 - RNA, 20 nt, Homo sapiens
cauaguuauucuaucacugg

SEQ ID NO: 1324455 - RNA, 13 nt, Homo sapiens
cauaugauuuauc

SEQ ID NO: 1324456 - RNA, 14 nt, Homo sapiens
cauauuuauagaau

SEQ ID NO: 1324457 - RNA, 16 nt, Homo sapiens
caucccagucugauau

SEQ ID NO: 1324458 - RNA, 22 nt, Homo sapiens
caucccagucugauauucaccu

SEQ ID NO: 1324459 - RNA, 16 nt, Homo sapiens
caucgaaauguauuca

SEQ ID NO: 1324460 - RNA, 19 nt, Homo sapiens
caucgaaauguauucaccu

SEQ ID NO: 1324461 - RNA, 16 nt, Homo sapiens
caugaccccugcugau

SEQ ID NO: 1324462 - RNA, 21 nt, Homo sapiens
cauguucugugugcccugaaa

SEQ ID NO: 1324463 - RNA, 18 nt, Homo sapiens
cauuauuaaucauuccau

SEQ ID NO: 1324464 - RNA, 13 nt, Homo sapiens
cauuuaaggagca

SEQ ID NO: 1324465 - RNA, 16 nt, Homo sapiens
ccaggcgugguggcuc

SEQ ID NO: 1324466 - RNA, 21 nt, Homo sapiens
ccaguacguacauauuuuaau

SEQ ID NO: 1324467 - RNA, 13 nt, Homo sapiens
ccagucgaacugg

SEQ ID NO: 1324468 - RNA, 23 nt, Homo sapiens
ccauaaagaaugcucauauuaau

SEQ ID NO: 1324469 - RNA, 16 nt, Homo sapiens
ccaucuucuaucuucu

SEQ ID NO: 1324470 - RNA, 14 nt, Homo sapiens
cccagaacuaggag

SEQ ID NO: 1324471 - RNA, 18 nt, Homo sapiens
cccaugugacuguggcau

SEQ ID NO: 1324472 - RNA, 22 nt, Homo sapiens
ccccuguauucucagcacuuug

SEQ ID NO: 1324473 - RNA, 16 nt, Homo sapiens
cccugcugaugccaca

SEQ ID NO: 1324474 - RNA, 19 nt, Homo sapiens
cccuguauucucagcacuu

SEQ ID NO: 1324475 - RNA, 14 nt, Homo sapiens
ugggaaucauucca

SEQ ID NO: 1324476 - RNA, 23 nt, Homo sapiens
ugguguuguauacuucauuagca

SEQ ID NO: 1324477 - RNA, 19 nt, Homo sapiens
uguacauuggucuuucuac

SEQ ID NO: 1324478 - RNA, 16 nt, Homo sapiens
uguacuuaaauuacac

SEQ ID NO: 1324479 - RNA, 18 nt, Homo sapiens
uguacuuaaauuacacau

SEQ ID NO: 1324480 - RNA, 18 nt, Homo sapiens
uguacuuuuuauucaauu

SEQ ID NO: 1324481 - RNA, 15 nt, Homo sapiens
uguuauaauuugcac

SEQ ID NO: 1324482 - RNA, 22 nt, Homo sapiens
uguuguacuuuuuauucaauuc

SEQ ID NO: 1324483 - RNA, 16 nt, Homo sapiens
uguuuauguaacuauc

SEQ ID NO: 1324484 - RNA, 18 nt, Homo sapiens
uguuuccugcaccugcug

SEQ ID NO: 1324485 - RNA, 22 nt, Homo sapiens
uuaaaauuuugcuaccaaagaa

SEQ ID NO: 1324486 - RNA, 21 nt, Homo sapiens
uuaauagaaagauacaaccuu

SEQ ID NO: 1324487 - RNA, 13 nt, Homo sapiens
uuacuagugccaa

SEQ ID NO: 1324488 - RNA, 13 nt, Homo sapiens
uuaugaaugugca

SEQ ID NO: 1324489 - RNA, 14 nt, Homo sapiens
uucacucagcacuu

SEQ ID NO: 1324490 - RNA, 19 nt, Homo sapiens
uucacucuggcauaugauu

SEQ ID NO: 1324491 - RNA, 21 nt, Homo sapiens
uucccacacugaaauucuaaa

SEQ ID NO: 1324492 - RNA, 20 nt, Homo sapiens
uucuuucaacauuucuugaa

SEQ ID NO: 1324493 - RNA, 17 nt, Homo sapiens
uugaucaccugagguca

SEQ ID NO: 1324494 - RNA, 15 nt, Homo sapiens
uuuacuagugccaaa

SEQ ID NO: 1324495 - RNA, 20 nt, Homo sapiens
uuuacuucccagagaacuuc

SEQ ID NO: 1324496 - RNA, 11 nt, Homo sapiens
uuucuauucac

SEQ ID NO: 1324497 - RNA, 20 nt, Homo sapiens
uuugggacauuugcauucaa

SEQ ID NO: 1324498 - RNA, 16 nt, Homo sapiens
uuuuccuuagcuguaa

SEQ ID NO: 1324499 - RNA, 20 nt, Homo sapiens
uuuugggacauuugcauuca

SEQ ID NO: 1324500 - RNA, 13 nt, Homo sapiens
cccagaacuagga

SEQ ID NO: 1324501 - RNA, 16 nt, Homo sapiens
guauucucagcacuuu

SEQ ID NO: 1324502 - RNA, 13 nt, Homo sapiens
gucaagauugcaa

SEQ ID NO: 1324503 - RNA, 15 nt, Homo sapiens
gucauuuucuauuca

SEQ ID NO: 1324504 - RNA, 17 nt, Homo sapiens
gucuaauucccuguuau

SEQ ID NO: 1324505 - RNA, 17 nt, Homo sapiens
gugacuuacagugccaa

SEQ ID NO: 1324506 - RNA, 14 nt, Homo sapiens
gugauuguggcauu

SEQ ID NO: 1324507 - RNA, 16 nt, Homo sapiens
gugcauuucuugacuu

SEQ ID NO: 1324508 - RNA, 15 nt, Homo sapiens
guuaccaaagcaaua

SEQ ID NO: 1324509 - RNA, 16 nt, Homo sapiens
guuauaauuugcacaa

SEQ ID NO: 1324510 - RNA, 13 nt, Homo sapiens
guuauauauuccu

SEQ ID NO: 1324511 - RNA, 14 nt, Homo sapiens
guucuauaugcauu

SEQ ID NO: 1324512 - RNA, 18 nt, Homo sapiens
guuguacuguaugcaguu

SEQ ID NO: 1324513 - RNA, 14 nt, Homo sapiens
uaaaacaucucugu

SEQ ID NO: 1324514 - RNA, 17 nt, Homo sapiens
uaaauuacacauguaga

SEQ ID NO: 1324515 - RNA, 20 nt, Homo sapiens
uaacaacucguguucacuca

SEQ ID NO: 1324516 - RNA, 16 nt, Homo sapiens
uaacagucugcaucau

SEQ ID NO: 1324517 - RNA, 19 nt, Homo sapiens
uaacagucugcaucaucau

SEQ ID NO: 1324518 - RNA, 23 nt, Homo sapiens
uaagaucacaccacuacacucca

SEQ ID NO: 1324519 - RNA, 13 nt, Homo sapiens
uaaggaagggaaa

SEQ ID NO: 1324520 - RNA, 15 nt, Homo sapiens
uaauuuguuguacuu

SEQ ID NO: 1324521 - RNA, 22 nt, Homo sapiens
uaccaguacguacauauuuuaa

SEQ ID NO: 1324522 - RNA, 16 nt, Homo sapiens
uaggauagaugugauu

SEQ ID NO: 1324523 - RNA, 22 nt, Homo sapiens
uaucagcgccuccuuuacuucc

SEQ ID NO: 1324524 - RNA, 16 nt, Homo sapiens
uaucuuauacugaaaa

SEQ ID NO: 1324525 - RNA, 18 nt, Homo sapiens
uaugaaaccaacuguuga

SEQ ID NO: 1324526 - RNA, 21 nt, Homo sapiens
uaugauguauacccauaaaga

SEQ ID NO: 1324527 - RNA, 17 nt, Homo sapiens
uaugucuguaucuacuu

SEQ ID NO: 1324528 - RNA, 13 nt, Homo sapiens
uauguugcuauaa

SEQ ID NO: 1324529 - RNA, 17 nt, Homo sapiens
uauguuuccaucuucag

SEQ ID NO: 1324530 - RNA, 16 nt, Homo sapiens
uauuuuaaaauuucac

SEQ ID NO: 1324531 - RNA, 22 nt, Homo sapiens
uauuuuaauagaaagauacaac

SEQ ID NO: 1324532 - RNA, 17 nt, Homo sapiens
ucaauuuaauucuuauu

SEQ ID NO: 1324533 - RNA, 13 nt, Homo sapiens
ucacucagcacuu

SEQ ID NO: 1324534 - RNA, 15 nt, Homo sapiens
ucacucagcacuuuc

SEQ ID NO: 1324535 - RNA, 12 nt, Homo sapiens
ucagacaugaaa

SEQ ID NO: 1324536 - RNA, 18 nt, Homo sapiens
ucaggaguuugagacuag

SEQ ID NO: 1324537 - RNA, 23 nt, Homo sapiens
ucauaaacugagccucuuuucaa

SEQ ID NO: 1324538 - RNA, 19 nt, Homo sapiens
ucauccagaaguguauuca

SEQ ID NO: 1324539 - RNA, 20 nt, Homo sapiens
ucaucccagucugauauuca

SEQ ID NO: 1324540 - RNA, 16 nt, Homo sapiens
ucauguacauuggucu

SEQ ID NO: 1324541 - RNA, 15 nt, Homo sapiens
ucauuuucuauucac

SEQ ID NO: 1324542 - RNA, 22 nt, Homo sapiens
ucccccuccuccgggggccaag

SEQ ID NO: 1324543 - RNA, 21 nt, Homo sapiens
uccugaaauagggagacugac

SEQ ID NO: 1324544 - RNA, 17 nt, Homo sapiens
ucguguucacucagcac

SEQ ID NO: 1324545 - RNA, 15 nt, Homo sapiens
ucucaacaguucauu

SEQ ID NO: 1324546 - RNA, 13 nt, Homo sapiens
ucucagcacuuug

SEQ ID NO: 1324547 - RNA, 21 nt, Homo sapiens
ucugaaaucagucuaccaagg

SEQ ID NO: 1324548 - RNA, 15 nt, Homo sapiens
ucugaagacuaguua

SEQ ID NO: 1324549 - RNA, 14 nt, Homo sapiens
ucuuauacugaaaa

SEQ ID NO: 1324550 - RNA, 23 nt, Homo sapiens
aaaauguuaugauaaucuuucuc

SEQ ID NO: 1324551 - RNA, 13 nt, Homo sapiens
aaaauuuucuuuc

SEQ ID NO: 1324552 - RNA, 15 nt, Homo sapiens
aaaauuuucuuucaa

SEQ ID NO: 1324553 - RNA, 13 nt, Homo sapiens
aaaccucaucucu

SEQ ID NO: 1324554 - RNA, 18 nt, Homo sapiens
aaagaggauuaagcuuuu

SEQ ID NO: 1324555 - RNA, 12 nt, Homo sapiens
aaagaugucaau

SEQ ID NO: 1324556 - RNA, 22 nt, Homo sapiens
aaauagggagacugacugagua

SEQ ID NO: 1324557 - RNA, 19 nt, Homo sapiens
aacaacucguguucacuca

SEQ ID NO: 1324558 - RNA, 21 nt, Homo sapiens
aaccauggauagaaucaauau

SEQ ID NO: 1324559 - RNA, 19 nt, Homo sapiens
aaccuaaugggaaucauuc

SEQ ID NO: 1324560 - RNA, 16 nt, Homo sapiens
aaccuuuuuauuuuca

SEQ ID NO: 1324561 - RNA, 13 nt, Homo sapiens
aagacuccaucuc

SEQ ID NO: 1324562 - RNA, 11 nt, Homo sapiens
aaggagcagug

SEQ ID NO: 1324563 - RNA, 16 nt, Homo sapiens
aaggcagccuucaguc

SEQ ID NO: 1324564 - RNA, 22 nt, Homo sapiens
aagucagcuuuacuagugccaa

SEQ ID NO: 1324565 - RNA, 13 nt, Homo sapiens
aaguuacuugaaa

SEQ ID NO: 1324566 - RNA, 15 nt, Homo sapiens
aauauuuuaggauaa

SEQ ID NO: 1324567 - RNA, 16 nt, Homo sapiens
aaucagucuaccaagg

SEQ ID NO: 1324568 - RNA, 13 nt, Homo sapiens
aaucauuccauuu

SEQ ID NO: 1324569 - RNA, 18 nt, Homo sapiens
aaugguuauuuguuacua

SEQ ID NO: 1324570 - RNA, 20 nt, Homo sapiens
aauguauuuuaaaauuucac

SEQ ID NO: 1324571 - RNA, 19 nt, Homo sapiens
aauguucuauaugcauuua

SEQ ID NO: 1324572 - RNA, 13 nt, Homo sapiens
aauuacacaugua

SEQ ID NO: 1324573 - RNA, 22 nt, Homo sapiens
aauucccuguuauaauuugcac

SEQ ID NO: 1324574 - RNA, 21 nt, Homo sapiens
aauucuaaauauugacacuua

SEQ ID NO: 1324575 - RNA, 22 nt, Homo sapiens
aauugcccuguugccuugagcu

SEQ ID NO: 1324576 - RNA, 16 nt, Homo sapiens
aauuuugggacauuug

SEQ ID NO: 1324577 - RNA, 19 nt, Homo sapiens
acaaauuguucauguuacc

SEQ ID NO: 1324578 - RNA, 18 nt, Homo sapiens
acaacucguguucacuca

SEQ ID NO: 1324579 - RNA, 20 nt, Homo sapiens
acacaaaucccuauguugcu

SEQ ID NO: 1324580 - RNA, 19 nt, Homo sapiens
acagcugaacaguguuaau

SEQ ID NO: 1324581 - RNA, 21 nt, Homo sapiens
acagucugcaucaucaucaca

SEQ ID NO: 1324582 - RNA, 18 nt, Homo sapiens
acagugccaacauuuaaa

SEQ ID NO: 1324583 - RNA, 16 nt, Homo sapiens
acaugauacuauucag

SEQ ID NO: 1324584 - RNA, 17 nt, Homo sapiens
acauuauuaaucauucc

SEQ ID NO: 1324585 - RNA, 20 nt, Homo sapiens
acauuauuugucuccaugau

SEQ ID NO: 1324586 - RNA, 17 nt, Homo sapiens
accaguacguacauauu

SEQ ID NO: 1324587 - RNA, 14 nt, Homo sapiens
acuauuaagggaaa

SEQ ID NO: 1324588 - RNA, 12 nt, Homo sapiens
acucagcacuuu

SEQ ID NO: 1324589 - RNA, 21 nt, Homo sapiens
acucguguucacucagcacuu

SEQ ID NO: 1324590 - RNA, 16 nt, Homo sapiens
acugagccucuuuuca

SEQ ID NO: 1324591 - RNA, 14 nt, Homo sapiens
acuuacagugccaa

SEQ ID NO: 1324592 - RNA, 14 nt, Homo sapiens
acuuucccucugca

SEQ ID NO: 1324593 - RNA, 19 nt, Homo sapiens
agaaccuguccaacauguu

SEQ ID NO: 1324594 - RNA, 19 nt, Homo sapiens
agacggcaagacuccaucu

SEQ ID NO: 1324595 - RNA, 14 nt, Homo sapiens
agaucacaccacua

SEQ ID NO: 1324596 - RNA, 13 nt, Homo sapiens
agauucccagugu

SEQ ID NO: 1324597 - RNA, 19 nt, Homo sapiens
agcacgcuggacagcacuc

SEQ ID NO: 1324598 - RNA, 15 nt, Homo sapiens
agcagccacuugacu

SEQ ID NO: 1324599 - RNA, 16 nt, Homo sapiens
agcagucauagggcug

SEQ ID NO: 1324600 - RNA, 18 nt, Homo sapiens
agcaucugccucuauuca

SEQ ID NO: 1324601 - RNA, 22 nt, Homo sapiens
agccaaaggccgugccuggugg

SEQ ID NO: 1324602 - RNA, 16 nt, Homo sapiens
agccaggcgugguggu

SEQ ID NO: 1324603 - RNA, 18 nt, Homo sapiens
agccuucagucccuauca

SEQ ID NO: 1324604 - RNA, 17 nt, Homo sapiens
agcuuuacuagugccaa

SEQ ID NO: 1324605 - RNA, 22 nt, Homo sapiens
aggcagagguugcagugagcua

SEQ ID NO: 1324606 - RNA, 22 nt, Homo sapiens
aggccgaggcagguugaucacc

SEQ ID NO: 1324607 - RNA, 13 nt, Homo sapiens
agucacaauuuca

SEQ ID NO: 1324608 - RNA, 17 nt, Homo sapiens
agucauagggcugauaa

SEQ ID NO: 1324609 - RNA, 21 nt, Homo sapiens
agucaugauggauggaaauau

SEQ ID NO: 1324610 - RNA, 21 nt, Homo sapiens
uuccugugccugugacucucc

SEQ ID NO: 1324611 - RNA, 17 nt, Homo sapiens
uucgcacugggggacau

SEQ ID NO: 1324612 - RNA, 17 nt, Homo sapiens
uuguacuuuuuauucaa

SEQ ID NO: 1324613 - RNA, 16 nt, Homo sapiens
uuuaaaaaaguaugaa

SEQ ID NO: 1324614 - RNA, 13 nt, Homo sapiens
uuucuuucaacau

SEQ ID NO: 1324615 - RNA, 20 nt, Homo sapiens
uuugaguuuucccacauuau

SEQ ID NO: 1324616 - RNA, 18 nt, Homo sapiens
uuuuaaaaaaauucauca

SEQ ID NO: 1324617 - RNA, 17 nt, Homo sapiens
uuuuaauggaauguggu

SEQ ID NO: 1324618 - RNA, 19 nt, Homo sapiens
uuuuuaagucacaauuuca

SEQ ID NO: 1324619 - RNA, 12 nt, Homo sapiens
aaaaaagacuug

SEQ ID NO: 1324620 - RNA, 16 nt, Homo sapiens
aaaaaagccuccaagg

SEQ ID NO: 1324621 - RNA, 11 nt, Homo sapiens
aaaaagacaua

SEQ ID NO: 1324622 - RNA, 17 nt, Homo sapiens
aaaaagcccuuugcuaa

SEQ ID NO: 1324623 - RNA, 12 nt, Homo sapiens
aaaaagugcagu

SEQ ID NO: 1324624 - RNA, 14 nt, Homo sapiens
aaaaauaauugcca

SEQ ID NO: 1324625 - RNA, 15 nt, Homo sapiens
aaaaauguccugccu

SEQ ID NO: 1324626 - RNA, 17 nt, Homo sapiens
aaaaaugucuuucaugu

SEQ ID NO: 1324627 - RNA, 19 nt, Homo sapiens
aaaacaccgcuucugccuu

SEQ ID NO: 1324628 - RNA, 13 nt, Homo sapiens
aaaacacuuccau

SEQ ID NO: 1324629 - RNA, 23 nt, Homo sapiens
aaaacagcccuauuucuugauaa

SEQ ID NO: 1324630 - RNA, 22 nt, Homo sapiens
aaaacaggaaaggagcaaugaa

SEQ ID NO: 1324631 - RNA, 20 nt, Homo sapiens
aaaacauaugaccauugagu

SEQ ID NO: 1324632 - RNA, 14 nt, Homo sapiens
aaaaccugacuuca

SEQ ID NO: 1324633 - RNA, 21 nt, Homo sapiens
aaaacgcgucugccugggccg

SEQ ID NO: 1324634 - RNA, 17 nt, Homo sapiens
aaaacugcccauuguaa

SEQ ID NO: 1324635 - RNA, 17 nt, Homo sapiens
aaaacuggcccuguuuc

SEQ ID NO: 1324636 - RNA, 12 nt, Homo sapiens
aaaacugucauc

SEQ ID NO: 1324637 - RNA, 15 nt, Homo sapiens
aaaacuucaaagcug

SEQ ID NO: 1324638 - RNA, 22 nt, Homo sapiens
aaaacuugauguguuaucucuu

SEQ ID NO: 1324639 - RNA, 15 nt, Homo sapiens
aaaagaaaagaaaau

SEQ ID NO: 1324640 - RNA, 16 nt, Homo sapiens
aaaagaaaagccgaaa

SEQ ID NO: 1324641 - RNA, 13 nt, Homo sapiens
aaaagaccaucug

SEQ ID NO: 1324642 - RNA, 13 nt, Homo sapiens
aaaagauugccaa

SEQ ID NO: 1324643 - RNA, 14 nt, Homo sapiens
aaaagcaauacugu

SEQ ID NO: 1324644 - RNA, 18 nt, Homo sapiens
aaaagccauaacuugaaa

SEQ ID NO: 1324645 - RNA, 16 nt, Homo sapiens
aaaagcccuuugcuaa

SEQ ID NO: 1324646 - RNA, 19 nt, Homo sapiens
aaaaggaacaaaaauuaca

SEQ ID NO: 1324647 - RNA, 18 nt, Homo sapiens
aaaaggccuguggcccag

SEQ ID NO: 1324648 - RNA, 19 nt, Homo sapiens
aaaagguuuucuucauuca

SEQ ID NO: 1324649 - RNA, 16 nt, Homo sapiens
aaaaguugcauguuau

SEQ ID NO: 1324650 - RNA, 13 nt, Homo sapiens
aaaauaaaccaaa

SEQ ID NO: 1324651 - RNA, 17 nt, Homo sapiens
aaaauaaagcaaugugu

SEQ ID NO: 1324652 - RNA, 18 nt, Homo sapiens
aaaauaacagauuucuca

SEQ ID NO: 1324653 - RNA, 17 nt, Homo sapiens
aaaauacagauuugaau

SEQ ID NO: 1324654 - RNA, 22 nt, Homo sapiens
aaaauaguugcaaagcauuuga

SEQ ID NO: 1324655 - RNA, 16 nt, Homo sapiens
aaaauauugacauuga

SEQ ID NO: 1324656 - RNA, 15 nt, Homo sapiens
aaaaucacacugucu

SEQ ID NO: 1324657 - RNA, 14 nt, Homo sapiens
aaaaucaccaucuu

SEQ ID NO: 1324658 - RNA, 15 nt, Homo sapiens
aaaaucauuucugca

SEQ ID NO: 1324659 - RNA, 13 nt, Homo sapiens
aaaauccaaggca

SEQ ID NO: 1324660 - RNA, 20 nt, Homo sapiens
aaaauccugaacuuucuccc

SEQ ID NO: 1324661 - RNA, 17 nt, Homo sapiens
aaaaucuuaauguauca

SEQ ID NO: 1324662 - RNA, 17 nt, Homo sapiens
aaaaugcaaaagcacau

SEQ ID NO: 1324663 - RNA, 19 nt, Homo sapiens
aaaaugcaacucuaacucu

SEQ ID NO: 1324664 - RNA, 19 nt, Homo sapiens
aaaaugcaagccaucucua

SEQ ID NO: 1324665 - RNA, 16 nt, Homo sapiens
aaaauggccagugaga

SEQ ID NO: 1324666 - RNA, 17 nt, Homo sapiens
aaaauggcgaacaugug

SEQ ID NO: 1324667 - RNA, 17 nt, Homo sapiens
aaaaugguuuguccuga

SEQ ID NO: 1324668 - RNA, 15 nt, Homo sapiens
aaaauguccugccuu

SEQ ID NO: 1324669 - RNA, 16 nt, Homo sapiens
aaaauguccugccuuu

SEQ ID NO: 1324670 - RNA, 23 nt, Homo sapiens
aaaauguuuuuaaacagugucau

SEQ ID NO: 1324671 - RNA, 15 nt, Homo sapiens
aaaauuaaacaaaua

SEQ ID NO: 1324672 - RNA, 13 nt, Homo sapiens
aaaauuacaaaga

SEQ ID NO: 1324673 - RNA, 13 nt, Homo sapiens
aaaauuacauguu

SEQ ID NO: 1324674 - RNA, 15 nt, Homo sapiens
aaaauucucuuaaac

SEQ ID NO: 1324675 - RNA, 19 nt, Homo sapiens
aaaauugcccccacauugg

SEQ ID NO: 1324676 - RNA, 13 nt, Homo sapiens
aaaauuuuggaaa

SEQ ID NO: 1324677 - RNA, 16 nt, Homo sapiens
aaacaaaaaacccaca

SEQ ID NO: 1324678 - RNA, 19 nt, Homo sapiens
aaacaaaacuugcaucuaa

SEQ ID NO: 1324679 - RNA, 20 nt, Homo sapiens
aaacaaaacuugcaucuaac

SEQ ID NO: 1324680 - RNA, 17 nt, Homo sapiens
aaacaaagacauugaca

SEQ ID NO: 1324681 - RNA, 23 nt, Homo sapiens
aaacaacuuucuccuacucuucc

SEQ ID NO: 1324682 - RNA, 13 nt, Homo sapiens
aaacaacuuugua

SEQ ID NO: 1324683 - RNA, 17 nt, Homo sapiens
aaacaaucuuccaaaga

SEQ ID NO: 1324684 - RNA, 23 nt, Homo sapiens
aaacaaucuuucaugucuuguca

SEQ ID NO: 1324685 - RNA, 15 nt, Homo sapiens
aaacaauucugugac

SEQ ID NO: 1324686 - RNA, 19 nt, Homo sapiens
aaacaauucuuauugacuc

SEQ ID NO: 1324687 - RNA, 19 nt, Homo sapiens
aaacacacauugcagcuuc

SEQ ID NO: 1324688 - RNA, 13 nt, Homo sapiens
aaacacauuucca

SEQ ID NO: 1324689 - RNA, 11 nt, Homo sapiens
aaacagacuug

SEQ ID NO: 1324690 - RNA, 17 nt, Homo sapiens
aaacagcugcccugugu

SEQ ID NO: 1324691 - RNA, 17 nt, Homo sapiens
aaacaucccaauucuuu

SEQ ID NO: 1324692 - RNA, 15 nt, Homo sapiens
aaacauuacuuauuu

SEQ ID NO: 1324693 - RNA, 14 nt, Homo sapiens
aaacauuucuggac

SEQ ID NO: 1324694 - RNA, 13 nt, Homo sapiens
aaacauuuugaca

SEQ ID NO: 1324695 - RNA, 15 nt, Homo sapiens
aaaccaacugugaaa

SEQ ID NO: 1324696 - RNA, 22 nt, Homo sapiens
aaaccaaugaaauuuugauuaa

SEQ ID NO: 1324697 - RNA, 18 nt, Homo sapiens
aaaccaccuaguucuccc

SEQ ID NO: 1324698 - RNA, 21 nt, Homo sapiens
aaaccacuuuuuuuuccccaa

SEQ ID NO: 1324699 - RNA, 15 nt, Homo sapiens
aaaccaggacauuaa

SEQ ID NO: 1324700 - RNA, 16 nt, Homo sapiens
aaaccaggauuuccuu

SEQ ID NO: 1324701 - RNA, 21 nt, Homo sapiens
aaaccaggauuuccuugacuu

SEQ ID NO: 1324702 - RNA, 15 nt, Homo sapiens
aaacccacucaugac

SEQ ID NO: 1324703 - RNA, 17 nt, Homo sapiens
aaacccccacuccagcu

SEQ ID NO: 1324704 - RNA, 18 nt, Homo sapiens
aaaccccuucuuuacuuc

SEQ ID NO: 1324705 - RNA, 17 nt, Homo sapiens
aaaccuccagccucccu

SEQ ID NO: 1324706 - RNA, 14 nt, Homo sapiens
aaaccucuccugac

SEQ ID NO: 1324707 - RNA, 9 nt, Homo sapiens
aaaccuggg

SEQ ID NO: 1324708 - RNA, 18 nt, Homo sapiens
aaaccugggaaggccagc

SEQ ID NO: 1324709 - RNA, 22 nt, Homo sapiens
aaaccuucugacuuugccaaaa

SEQ ID NO: 1324710 - RNA, 15 nt, Homo sapiens
aaaccuugcacaggu

SEQ ID NO: 1324711 - RNA, 18 nt, Homo sapiens
aaaccuugcucuccucau

SEQ ID NO: 1324712 - RNA, 13 nt, Homo sapiens
aaaccuuugcaaa

SEQ ID NO: 1324713 - RNA, 13 nt, Homo sapiens
aaacgguuccugg

SEQ ID NO: 1324714 - RNA, 14 nt, Homo sapiens
aaacuaaagauaca

SEQ ID NO: 1324715 - RNA, 12 nt, Homo sapiens
aaacuaaggauu

SEQ ID NO: 1324716 - RNA, 12 nt, Homo sapiens
aaacucucacca

SEQ ID NO: 1324717 - RNA, 13 nt, Homo sapiens
aaacucucugaac

SEQ ID NO: 1324718 - RNA, 23 nt, Homo sapiens
aaacugaacuucagagcaugaaa

SEQ ID NO: 1324719 - RNA, 22 nt, Homo sapiens
aaacugagaugugaacacauca

SEQ ID NO: 1324720 - RNA, 16 nt, Homo sapiens
aaacugcgaggccagu

SEQ ID NO: 1324721 - RNA, 22 nt, Homo sapiens
aaacuggcccuguuucuggucu

SEQ ID NO: 1324722 - RNA, 21 nt, Homo sapiens
aaacuucaccuacauuaucuc

SEQ ID NO: 1324723 - RNA, 23 nt, Homo sapiens
aaacuuucucauaagcaccuaaa

SEQ ID NO: 1324724 - RNA, 16 nt, Homo sapiens
aaacuuuuaacugaga

SEQ ID NO: 1324725 - RNA, 12 nt, Homo sapiens
aaagaaaaccac

SEQ ID NO: 1324726 - RNA, 19 nt, Homo sapiens
aaagaaauaaaccaaagga

SEQ ID NO: 1324727 - RNA, 13 nt, Homo sapiens
aaagaaaugcacu

SEQ ID NO: 1324728 - RNA, 12 nt, Homo sapiens
aaagaccaguuu

SEQ ID NO: 1324729 - RNA, 14 nt, Homo sapiens
aaagaccugagaac

SEQ ID NO: 1324730 - RNA, 15 nt, Homo sapiens
aaagacguucccuuu

SEQ ID NO: 1324731 - RNA, 14 nt, Homo sapiens
aaagacuccaaaga

SEQ ID NO: 1324732 - RNA, 21 nt, Homo sapiens
aaagacuuugauccauguaug

SEQ ID NO: 1324733 - RNA, 19 nt, Homo sapiens
aaagagaagguuucuucca

SEQ ID NO: 1324734 - RNA, 14 nt, Homo sapiens
aaagagacaaagcu

SEQ ID NO: 1324735 - RNA, 16 nt, Homo sapiens
aaagagagaagccagc

SEQ ID NO: 1324736 - RNA, 23 nt, Homo sapiens
aaagagcauacacgcguggcaaa

SEQ ID NO: 1324737 - RNA, 19 nt, Homo sapiens
aaagaugugcaaaaucacu

SEQ ID NO: 1324738 - RNA, 19 nt, Homo sapiens
aaagcaaaauacaucagcu

SEQ ID NO: 1324739 - RNA, 14 nt, Homo sapiens
aaagcaaagcucuu

SEQ ID NO: 1324740 - RNA, 14 nt, Homo sapiens
aaagcaaguguuca

SEQ ID NO: 1324741 - RNA, 15 nt, Homo sapiens
aaagcaccuuagcug

SEQ ID NO: 1324742 - RNA, 12 nt, Homo sapiens
caggacuguuga

SEQ ID NO: 1324743 - RNA, 14 nt, Homo sapiens
caggagaagccagu

SEQ ID NO: 1324744 - RNA, 23 nt, Homo sapiens
caggagaagccagugucuaggca

SEQ ID NO: 1324745 - RNA, 13 nt, Homo sapiens
caggagaaucacu

SEQ ID NO: 1324746 - RNA, 23 nt, Homo sapiens
caggagaaucacuugaacccagg

SEQ ID NO: 1324747 - RNA, 17 nt, Homo sapiens
caggagacaaaagagca

SEQ ID NO: 1324748 - RNA, 14 nt, Homo sapiens
caggagaguagcaa

SEQ ID NO: 1324749 - RNA, 17 nt, Homo sapiens
caggaggaucacuugag

SEQ ID NO: 1324750 - RNA, 18 nt, Homo sapiens
caggaggaucacuugagg

SEQ ID NO: 1324751 - RNA, 22 nt, Homo sapiens
caggaggggggagggaagggag

SEQ ID NO: 1324752 - RNA, 18 nt, Homo sapiens
caggaguauccucuugcc

SEQ ID NO: 1324753 - RNA, 14 nt, Homo sapiens
caggaguucagggu

SEQ ID NO: 1324754 - RNA, 13 nt, Homo sapiens
caggaguuugugg

SEQ ID NO: 1324755 - RNA, 15 nt, Homo sapiens
caggauccagugaca

SEQ ID NO: 1324756 - RNA, 23 nt, Homo sapiens
caggaugacgugcuccguagcuc

SEQ ID NO: 1324757 - RNA, 12 nt, Homo sapiens
caggcaaaagac

SEQ ID NO: 1324758 - RNA, 14 nt, Homo sapiens
caggcaacgcacaa

SEQ ID NO: 1324759 - RNA, 20 nt, Homo sapiens
caggcaacgcacaaaacaga

SEQ ID NO: 1324760 - RNA, 12 nt, Homo sapiens
caggcaccucac

SEQ ID NO: 1324761 - RNA, 12 nt, Homo sapiens
caggcacuccaa

SEQ ID NO: 1324762 - RNA, 16 nt, Homo sapiens
caggcagauccaggac

SEQ ID NO: 1324763 - RNA, 15 nt, Homo sapiens
caggcagcugaaauu

SEQ ID NO: 1324764 - RNA, 15 nt, Homo sapiens
caggcagggucuguu

SEQ ID NO: 1324765 - RNA, 14 nt, Homo sapiens
caggccagcccagc

SEQ ID NO: 1324766 - RNA, 23 nt, Homo sapiens
caggcccucccugucuccagggc

SEQ ID NO: 1324767 - RNA, 18 nt, Homo sapiens
caggcccuuccucuccac

SEQ ID NO: 1324768 - RNA, 22 nt, Homo sapiens
caggccucugggacccacagaa

SEQ ID NO: 1324769 - RNA, 16 nt, Homo sapiens
caggccuuacaucugg

SEQ ID NO: 1324770 - RNA, 16 nt, Homo sapiens
caggccuuaucuccaa

SEQ ID NO: 1324771 - RNA, 15 nt, Homo sapiens
caggcuagagugcaa

SEQ ID NO: 1324772 - RNA, 19 nt, Homo sapiens
caggcuagagugcaauggu

SEQ ID NO: 1324773 - RNA, 14 nt, Homo sapiens
caggcucugaccag

SEQ ID NO: 1324774 - RNA, 13 nt, Homo sapiens
caggcucuucucc

SEQ ID NO: 1324775 - RNA, 20 nt, Homo sapiens
caggcuggagugcaauggcg

SEQ ID NO: 1324776 - RNA, 19 nt, Homo sapiens
caggcuggagugcaauggu

SEQ ID NO: 1324777 - RNA, 23 nt, Homo sapiens
caggcuguuggaaaauccagaac

SEQ ID NO: 1324778 - RNA, 17 nt, Homo sapiens
caggcuuaugaauauau

SEQ ID NO: 1324779 - RNA, 14 nt, Homo sapiens
cagggaacugaccc

SEQ ID NO: 1324780 - RNA, 17 nt, Homo sapiens
cagggaaggagacacca

SEQ ID NO: 1324781 - RNA, 18 nt, Homo sapiens
cagggaagugacaggacu

SEQ ID NO: 1324782 - RNA, 15 nt, Homo sapiens
cagggacaagauaca

SEQ ID NO: 1324783 - RNA, 19 nt, Homo sapiens
cagggacacuaucacucau

SEQ ID NO: 1324784 - RNA, 12 nt, Homo sapiens
cagggagcauuu

SEQ ID NO: 1324785 - RNA, 13 nt, Homo sapiens
cagggaucuugca

SEQ ID NO: 1324786 - RNA, 14 nt, Homo sapiens
cagggaucuugcaa

SEQ ID NO: 1324787 - RNA, 20 nt, Homo sapiens
cagggauucuuccugcuuag

SEQ ID NO: 1324788 - RNA, 13 nt, Homo sapiens
cagggccacaacu

SEQ ID NO: 1324789 - RNA, 12 nt, Homo sapiens
cagggccagugc

SEQ ID NO: 1324790 - RNA, 14 nt, Homo sapiens
cagggcucaaucuc

SEQ ID NO: 1324791 - RNA, 20 nt, Homo sapiens
cagggcucuaaugugucucu

SEQ ID NO: 1324792 - RNA, 19 nt, Homo sapiens
cagggcugggccagugcau

SEQ ID NO: 1324793 - RNA, 20 nt, Homo sapiens
cagggcugggccagugcauc

SEQ ID NO: 1324794 - RNA, 18 nt, Homo sapiens
cagggcuuccucuuccgg

SEQ ID NO: 1324795 - RNA, 15 nt, Homo sapiens
caggggaagcucuca

SEQ ID NO: 1324796 - RNA, 23 nt, Homo sapiens
caggggccaaccucaggcuccua

SEQ ID NO: 1324797 - RNA, 18 nt, Homo sapiens
caggggccggccaguggc

SEQ ID NO: 1324798 - RNA, 17 nt, Homo sapiens
caggggcucuguggcaa

SEQ ID NO: 1324799 - RNA, 20 nt, Homo sapiens
caggguaccucaagccccau

SEQ ID NO: 1324800 - RNA, 16 nt, Homo sapiens
caggguagugugguau

SEQ ID NO: 1324801 - RNA, 18 nt, Homo sapiens
cagggucaguuccugaag

SEQ ID NO: 1324802 - RNA, 17 nt, Homo sapiens
cagguaccucuuucagg

SEQ ID NO: 1324803 - RNA, 13 nt, Homo sapiens
caggucacuuuac

SEQ ID NO: 1324804 - RNA, 23 nt, Homo sapiens
cagguccuuuagucuguuguucu

SEQ ID NO: 1324805 - RNA, 14 nt, Homo sapiens
caggucugacucca

SEQ ID NO: 1324806 - RNA, 20 nt, Homo sapiens
caggucuuuccuaaggcugc

SEQ ID NO: 1324807 - RNA, 17 nt, Homo sapiens
caggugaacugggagca

SEQ ID NO: 1324808 - RNA, 19 nt, Homo sapiens
caggugccaguuauggcua

SEQ ID NO: 1324809 - RNA, 17 nt, Homo sapiens
caggugcgguuccucau

SEQ ID NO: 1324810 - RNA, 16 nt, Homo sapiens
caggugcuuguggaca

SEQ ID NO: 1324811 - RNA, 23 nt, Homo sapiens
caggugggagauuuggaauacac

SEQ ID NO: 1324812 - RNA, 18 nt, Homo sapiens
cagguuaagacaaagggu

SEQ ID NO: 1324813 - RNA, 15 nt, Homo sapiens
caguaaaccuuaaca

SEQ ID NO: 1324814 - RNA, 19 nt, Homo sapiens
caguaaauauuuacuauuu

SEQ ID NO: 1324815 - RNA, 15 nt, Homo sapiens
caguaaccaugcccg

SEQ ID NO: 1324816 - RNA, 20 nt, Homo sapiens
caguaacugugcuguacuga

SEQ ID NO: 1324817 - RNA, 19 nt, Homo sapiens
caguacuaaucaugugagg

SEQ ID NO: 1324818 - RNA, 16 nt, Homo sapiens
caguaguaaugugcuu

SEQ ID NO: 1324819 - RNA, 23 nt, Homo sapiens
caguagugcaccaucucacugca

SEQ ID NO: 1324820 - RNA, 11 nt, Homo sapiens
caguaguggug

SEQ ID NO: 1324821 - RNA, 22 nt, Homo sapiens
caguauaagcaucugccaucug

SEQ ID NO: 1324822 - RNA, 21 nt, Homo sapiens
caguauuaacacuaaauugca

SEQ ID NO: 1324823 - RNA, 14 nt, Homo sapiens
cagucaauuuucac

SEQ ID NO: 1324824 - RNA, 16 nt, Homo sapiens
cagucacugacaguua

SEQ ID NO: 1324825 - RNA, 16 nt, Homo sapiens
cagucagaaccacuaa

SEQ ID NO: 1324826 - RNA, 15 nt, Homo sapiens
cagucagcauucuua

SEQ ID NO: 1324827 - RNA, 16 nt, Homo sapiens
cagucccacacugugc

SEQ ID NO: 1324828 - RNA, 19 nt, Homo sapiens
cagucccacacuguggcca

SEQ ID NO: 1324829 - RNA, 21 nt, Homo sapiens
cagucccagcuaacucugacc

SEQ ID NO: 1324830 - RNA, 23 nt, Homo sapiens
cagucuaaaaaaggaauccucug

SEQ ID NO: 1324831 - RNA, 13 nt, Homo sapiens
cagucucccuucc

SEQ ID NO: 1324832 - RNA, 17 nt, Homo sapiens
cagucuccucacucugu

SEQ ID NO: 1324833 - RNA, 23 nt, Homo sapiens
cagucuccucacucugucccugu

SEQ ID NO: 1324834 - RNA, 15 nt, Homo sapiens
cagugacaaccaaaa

SEQ ID NO: 1324835 - RNA, 11 nt, Homo sapiens
cagugacucca

SEQ ID NO: 1324836 - RNA, 20 nt, Homo sapiens
cagugacuccagggugacaa

SEQ ID NO: 1324837 - RNA, 14 nt, Homo sapiens
cagugacuccugcu

SEQ ID NO: 1324838 - RNA, 13 nt, Homo sapiens
cagugacuugauu

SEQ ID NO: 1324839 - RNA, 17 nt, Homo sapiens
cagugagaucaauguga

SEQ ID NO: 1324840 - RNA, 12 nt, Homo sapiens
cagugaugacua

SEQ ID NO: 1324841 - RNA, 12 nt, Homo sapiens
cagugcacucga

SEQ ID NO: 1324842 - RNA, 10 nt, Homo sapiens
cagugcaguc

SEQ ID NO: 1324843 - RNA, 14 nt, Homo sapiens
cagugcaguuucuu

SEQ ID NO: 1324844 - RNA, 19 nt, Homo sapiens
cagugccagcaaguccuua

SEQ ID NO: 1324845 - RNA, 13 nt, Homo sapiens
cagugcccuaggc

SEQ ID NO: 1324846 - RNA, 15 nt, Homo sapiens
cagugccuauugaua

SEQ ID NO: 1324847 - RNA, 15 nt, Homo sapiens
cagugccugugagca

SEQ ID NO: 1324848 - RNA, 22 nt, Homo sapiens
cagugcuaaagccuguggguuu

SEQ ID NO: 1324849 - RNA, 17 nt, Homo sapiens
cagugcugaauuucccu

SEQ ID NO: 1324850 - RNA, 17 nt, Homo sapiens
caguguauuucuucaaa

SEQ ID NO: 1324851 - RNA, 12 nt, Homo sapiens
cagugugcaaua

SEQ ID NO: 1324852 - RNA, 18 nt, Homo sapiens
cagugugugaaaauucag

SEQ ID NO: 1324853 - RNA, 20 nt, Homo sapiens
caguuaccacagcaacugac

SEQ ID NO: 1324854 - RNA, 21 nt, Homo sapiens
caguuacucccuacacugaug

SEQ ID NO: 1324855 - RNA, 22 nt, Homo sapiens
caguuacucccuacacugaugc

SEQ ID NO: 1324856 - RNA, 18 nt, Homo sapiens
caguucaaaaacaagaca

SEQ ID NO: 1324857 - RNA, 20 nt, Homo sapiens
caguucugaauaacuugaag

SEQ ID NO: 1324858 - RNA, 14 nt, Homo sapiens
caguucugucauau

SEQ ID NO: 1324859 - RNA, 13 nt, Homo sapiens
caguucugugguu

SEQ ID NO: 1324860 - RNA, 14 nt, Homo sapiens
caguucuuacacau

SEQ ID NO: 1324861 - RNA, 18 nt, Homo sapiens
caguucuuacacauucca

SEQ ID NO: 1324862 - RNA, 18 nt, Homo sapiens
caguucuuugggccagac

SEQ ID NO: 1324863 - RNA, 16 nt, Homo sapiens
caguugaucagacuga

SEQ ID NO: 1324864 - RNA, 18 nt, Homo sapiens
caguuuagguucuaggua

SEQ ID NO: 1324865 - RNA, 19 nt, Homo sapiens
caguuucuaggcaccucag

SEQ ID NO: 1324866 - RNA, 19 nt, Homo sapiens
caguuugaagaccaaucaa

SEQ ID NO: 1324867 - RNA, 19 nt, Homo sapiens
caguuugaguuaaugugcu

SEQ ID NO: 1324868 - RNA, 12 nt, Homo sapiens
caguuuugacau

SEQ ID NO: 1324869 - RNA, 13 nt, Homo sapiens
caguuuuuccucc

SEQ ID NO: 1324870 - RNA, 18 nt, Homo sapiens
cauaaaagauauguugaa

SEQ ID NO: 1324871 - RNA, 23 nt, Homo sapiens
cauaaacaaauguaaugggcaua

SEQ ID NO: 1324872 - RNA, 23 nt, Homo sapiens
cauaaagaauuuuguauuuucau

SEQ ID NO: 1324873 - RNA, 18 nt, Homo sapiens
cauaaauaaaguuucagc

SEQ ID NO: 1324874 - RNA, 20 nt, Homo sapiens
cauaacucugugaucuugcu

SEQ ID NO: 1324875 - RNA, 16 nt, Homo sapiens
ccugcccaccaagaag

SEQ ID NO: 1324876 - RNA, 13 nt, Homo sapiens
ccugccucaggcc

SEQ ID NO: 1324877 - RNA, 15 nt, Homo sapiens
ccugcgccaccucac

SEQ ID NO: 1324878 - RNA, 20 nt, Homo sapiens
ccugcgccuccagagguccu

SEQ ID NO: 1324879 - RNA, 12 nt, Homo sapiens
ccugcuaccugu

SEQ ID NO: 1324880 - RNA, 20 nt, Homo sapiens
ccugcucagcccugcaccau

SEQ ID NO: 1324881 - RNA, 20 nt, Homo sapiens
ccugcucaggagcagcacuc

SEQ ID NO: 1324882 - RNA, 17 nt, Homo sapiens
ccugcuccaacuccaua

SEQ ID NO: 1324883 - RNA, 23 nt, Homo sapiens
ccugcugcaucuucccacagugg

SEQ ID NO: 1324884 - RNA, 23 nt, Homo sapiens
ccugcuuauacuuuucucaauau

SEQ ID NO: 1324885 - RNA, 20 nt, Homo sapiens
ccugcuuuccugcagcaguc

SEQ ID NO: 1324886 - RNA, 16 nt, Homo sapiens
ccuggauccagcacug

SEQ ID NO: 1324887 - RNA, 22 nt, Homo sapiens
ccuggcagccacaacugcaguc

SEQ ID NO: 1324888 - RNA, 23 nt, Homo sapiens
ccuggcagcuuuuucaaaguguu

SEQ ID NO: 1324889 - RNA, 19 nt, Homo sapiens
ccuggcccgcuaaggugaa

SEQ ID NO: 1324890 - RNA, 19 nt, Homo sapiens
ccuggcuaagaucaugucu

SEQ ID NO: 1324891 - RNA, 16 nt, Homo sapiens
ccuggcuuugccucuu

SEQ ID NO: 1324892 - RNA, 18 nt, Homo sapiens
ccugggcaacauagugau

SEQ ID NO: 1324893 - RNA, 20 nt, Homo sapiens
ccugggcaacauagugauac

SEQ ID NO: 1324894 - RNA, 12 nt, Homo sapiens
ccugggcacaaa

SEQ ID NO: 1324895 - RNA, 22 nt, Homo sapiens
ccugggggcaggccagggcagu

SEQ ID NO: 1324896 - RNA, 18 nt, Homo sapiens
ccugggggcuuuugccac

SEQ ID NO: 1324897 - RNA, 19 nt, Homo sapiens
ccugggguucuuuuugcca

SEQ ID NO: 1324898 - RNA, 17 nt, Homo sapiens
ccuggucgccaauccau

SEQ ID NO: 1324899 - RNA, 18 nt, Homo sapiens
ccuguaaucucagcacuu

SEQ ID NO: 1324900 - RNA, 12 nt, Homo sapiens
ccuguacauaug

SEQ ID NO: 1324901 - RNA, 17 nt, Homo sapiens
ccuguacuguauggaaa

SEQ ID NO: 1324902 - RNA, 15 nt, Homo sapiens
ccuguccagcuccaa

SEQ ID NO: 1324903 - RNA, 15 nt, Homo sapiens
ccuguccuaucacuc

SEQ ID NO: 1324904 - RNA, 15 nt, Homo sapiens
ccuguccucuuugug

SEQ ID NO: 1324905 - RNA, 20 nt, Homo sapiens
ccuguccugcagucccacac

SEQ ID NO: 1324906 - RNA, 16 nt, Homo sapiens
ccuguccuugcccuuu

SEQ ID NO: 1324907 - RNA, 16 nt, Homo sapiens
ccugucuguuuccucu

SEQ ID NO: 1324908 - RNA, 17 nt, Homo sapiens
ccugugcgucccagcug

SEQ ID NO: 1324909 - RNA, 16 nt, Homo sapiens
ccuguggaaaggccaa

SEQ ID NO: 1324910 - RNA, 15 nt, Homo sapiens
ccuguguacugccuu

SEQ ID NO: 1324911 - RNA, 13 nt, Homo sapiens
ccuguguccucca

SEQ ID NO: 1324912 - RNA, 15 nt, Homo sapiens
ccuuaaaaugcauug

SEQ ID NO: 1324913 - RNA, 16 nt, Homo sapiens
ccuuaacacauucaau

SEQ ID NO: 1324914 - RNA, 14 nt, Homo sapiens
ccuuaacugcaucc

SEQ ID NO: 1324915 - RNA, 21 nt, Homo sapiens
ccuuaagcaaauuuuguauua

SEQ ID NO: 1324916 - RNA, 19 nt, Homo sapiens
ccuuaaugacaacacuuaa

SEQ ID NO: 1324917 - RNA, 14 nt, Homo sapiens
ccuuacaucuggcu

SEQ ID NO: 1324918 - RNA, 16 nt, Homo sapiens
ccuuccaugugccuuu

SEQ ID NO: 1324919 - RNA, 22 nt, Homo sapiens
ccuucuccacuggccggaguca

SEQ ID NO: 1324920 - RNA, 23 nt, Homo sapiens
ccuucugaagucugagcccauuu

SEQ ID NO: 1324921 - RNA, 17 nt, Homo sapiens
ccuucuggcaagccugu

SEQ ID NO: 1324922 - RNA, 23 nt, Homo sapiens
ccuugacauuguagagcuucugg

SEQ ID NO: 1324923 - RNA, 23 nt, Homo sapiens
ccuugcagcggcuccugcaaaag

SEQ ID NO: 1324924 - RNA, 14 nt, Homo sapiens
ccuugcuaaccuaa

SEQ ID NO: 1324925 - RNA, 21 nt, Homo sapiens
ccuugcuucuuggacuucuug

SEQ ID NO: 1324926 - RNA, 20 nt, Homo sapiens
ccuugcuuugagacuccuca

SEQ ID NO: 1324927 - RNA, 17 nt, Homo sapiens
ccuuggagaaguggcau

SEQ ID NO: 1324928 - RNA, 19 nt, Homo sapiens
ccuuggcacccccaugcug

SEQ ID NO: 1324929 - RNA, 16 nt, Homo sapiens
ccuuggccucugcuaa

SEQ ID NO: 1324930 - RNA, 16 nt, Homo sapiens
ccuuggcuucgugaau

SEQ ID NO: 1324931 - RNA, 11 nt, Homo sapiens
ccuuggcuuua

SEQ ID NO: 1324932 - RNA, 12 nt, Homo sapiens
ccuuggcuuuau

SEQ ID NO: 1324933 - RNA, 15 nt, Homo sapiens
ccuugggauagcaaa

SEQ ID NO: 1324934 - RNA, 19 nt, Homo sapiens
ccuugguggggagcacaga

SEQ ID NO: 1324935 - RNA, 13 nt, Homo sapiens
ccuuguaccucaa

SEQ ID NO: 1324936 - RNA, 16 nt, Homo sapiens
ccuuguuaaaauccaa

SEQ ID NO: 1324937 - RNA, 24 nt, Homo sapiens
ccuuuagaggguaccgucuucucc

SEQ ID NO: 1324938 - RNA, 15 nt, Homo sapiens
ccuuuagucuguugu

SEQ ID NO: 1324939 - RNA, 17 nt, Homo sapiens
ccuuucagugcaguuuc

SEQ ID NO: 1324940 - RNA, 16 nt, Homo sapiens
ccuuucccaccauucc

SEQ ID NO: 1324941 - RNA, 18 nt, Homo sapiens
ccuuucuccuuuguacuu

SEQ ID NO: 1324942 - RNA, 24 nt, Homo sapiens
ccuuucucucuccucucugcuuca

SEQ ID NO: 1324943 - RNA, 24 nt, Homo sapiens
ccuuucugucccacuacaucuggg

SEQ ID NO: 1324944 - RNA, 15 nt, Homo sapiens
ccuuucuuacauuag

SEQ ID NO: 1324945 - RNA, 14 nt, Homo sapiens
ccuuucuuugccuc

SEQ ID NO: 1324946 - RNA, 21 nt, Homo sapiens
ccuuugaaguagacucauucu

SEQ ID NO: 1324947 - RNA, 19 nt, Homo sapiens
ccuuugaguuuuguauuca

SEQ ID NO: 1324948 - RNA, 18 nt, Homo sapiens
ccuuuuccaugacugugg

SEQ ID NO: 1324949 - RNA, 21 nt, Homo sapiens
ccuuuuccuuauuugccuucu

SEQ ID NO: 1324950 - RNA, 13 nt, Homo sapiens
ccuuuugccaucc

SEQ ID NO: 1324951 - RNA, 17 nt, Homo sapiens
ccuuuuuuauacaggaa

SEQ ID NO: 1324952 - RNA, 17 nt, Homo sapiens
ccuuuuuucaauaugca

SEQ ID NO: 1324953 - RNA, 22 nt, Homo sapiens
cgaaauuaaaucugaauaaaua

SEQ ID NO: 1324954 - RNA, 20 nt, Homo sapiens
cgaauuagcaauaacauaca

SEQ ID NO: 1324955 - RNA, 14 nt, Homo sapiens
cgaccccaaaggaa

SEQ ID NO: 1324956 - RNA, 20 nt, Homo sapiens
cgacuucaugacaagcauuu

SEQ ID NO: 1324957 - RNA, 16 nt, Homo sapiens
cgacuuguucuugaua

SEQ ID NO: 1324958 - RNA, 14 nt, Homo sapiens
cgagaacccugagc

SEQ ID NO: 1324959 - RNA, 21 nt, Homo sapiens
cgagauugcgccauugcacuc

SEQ ID NO: 1324960 - RNA, 17 nt, Homo sapiens
cgagcaggcuacuguca

SEQ ID NO: 1324961 - RNA, 20 nt, Homo sapiens
cgaggagcuagaacauucca

SEQ ID NO: 1324962 - RNA, 19 nt, Homo sapiens
cgagucucuucuccacugg

SEQ ID NO: 1324963 - RNA, 13 nt, Homo sapiens
cgcacagugugag

SEQ ID NO: 1324964 - RNA, 17 nt, Homo sapiens
cgcaggagccauugcuc

SEQ ID NO: 1324965 - RNA, 16 nt, Homo sapiens
cgcaggccagcaacuc

SEQ ID NO: 1324966 - RNA, 20 nt, Homo sapiens
cgcauacuacaguaacugug

SEQ ID NO: 1324967 - RNA, 15 nt, Homo sapiens
cgcaucccgucagcu

SEQ ID NO: 1324968 - RNA, 15 nt, Homo sapiens
cgcccaaggcccacg

SEQ ID NO: 1324969 - RNA, 16 nt, Homo sapiens
cgccccuuccuagguc

SEQ ID NO: 1324970 - RNA, 13 nt, Homo sapiens
cgcccuccacaaa

SEQ ID NO: 1324971 - RNA, 20 nt, Homo sapiens
cgccugaguaacgacaugga

SEQ ID NO: 1324972 - RNA, 22 nt, Homo sapiens
cgccuuaugccucagucuauuc

SEQ ID NO: 1324973 - RNA, 14 nt, Homo sapiens
cgcguacagaucuc

SEQ ID NO: 1324974 - RNA, 17 nt, Homo sapiens
cgcuaauucaaggaauu

SEQ ID NO: 1324975 - RNA, 15 nt, Homo sapiens
cgcuagcauuuccca

SEQ ID NO: 1324976 - RNA, 18 nt, Homo sapiens
cgcucccagguuccccca

SEQ ID NO: 1324977 - RNA, 22 nt, Homo sapiens
cgcucuuggcagguacucagcg

SEQ ID NO: 1324978 - RNA, 23 nt, Homo sapiens
cgcuucuccaagucugcugauga

SEQ ID NO: 1324979 - RNA, 22 nt, Homo sapiens
cggacccuucuggguccaggga

SEQ ID NO: 1324980 - RNA, 11 nt, Homo sapiens
cggaggucucu

SEQ ID NO: 1324981 - RNA, 17 nt, Homo sapiens
cggaggucucuguaaaa

SEQ ID NO: 1324982 - RNA, 18 nt, Homo sapiens
cggagugagcaauggagu

SEQ ID NO: 1324983 - RNA, 20 nt, Homo sapiens
cggaguuuccucgcauuaaa

SEQ ID NO: 1324984 - RNA, 21 nt, Homo sapiens
cggauaguaagaaaacaaaca

SEQ ID NO: 1324985 - RNA, 14 nt, Homo sapiens
cggcacacacugug

SEQ ID NO: 1324986 - RNA, 19 nt, Homo sapiens
cggcaggugcucuguggau

SEQ ID NO: 1324987 - RNA, 20 nt, Homo sapiens
cggccgcccggcagugcacg

SEQ ID NO: 1324988 - RNA, 14 nt, Homo sapiens
cggccuccaugcac

SEQ ID NO: 1324989 - RNA, 14 nt, Homo sapiens
cggcucacugcaac

SEQ ID NO: 1324990 - RNA, 15 nt, Homo sapiens
cggcuccugcaaaag

SEQ ID NO: 1324991 - RNA, 17 nt, Homo sapiens
cgggaugaccuccagaa

SEQ ID NO: 1324992 - RNA, 15 nt, Homo sapiens
cgggcaaacuggccg

SEQ ID NO: 1324993 - RNA, 17 nt, Homo sapiens
cgggcaccaggggccaa

SEQ ID NO: 1324994 - RNA, 21 nt, Homo sapiens
cgggcaggguguggggccaug

SEQ ID NO: 1324995 - RNA, 14 nt, Homo sapiens
cgggcuuuccccca

SEQ ID NO: 1324996 - RNA, 15 nt, Homo sapiens
cggggauagagggua

SEQ ID NO: 1324997 - RNA, 21 nt, Homo sapiens
cggguccccaaaccuguuccc

SEQ ID NO: 1324998 - RNA, 19 nt, Homo sapiens
cgggugggcggcacagccu

SEQ ID NO: 1324999 - RNA, 17 nt, Homo sapiens
cggguggggccauaaac

SEQ ID NO: 1325000 - RNA, 16 nt, Homo sapiens
cggucccugucccucu

SEQ ID NO: 1325001 - RNA, 16 nt, Homo sapiens
cggucucauuucuucu

SEQ ID NO: 1325002 - RNA, 17 nt, Homo sapiens
cguagggcuaagggagg

SEQ ID NO: 1325003 - RNA, 15 nt, Homo sapiens
cguauauugcuguua

SEQ ID NO: 1325004 - RNA, 21 nt, Homo sapiens
cgucaagagcaugcacaugcu

SEQ ID NO: 1325005 - RNA, 24 nt, Homo sapiens
cgugcuccguagcucugcugcuga

SEQ ID NO: 1325006 - RNA, 22 nt, Homo sapiens
cgugcucugugggucuccccca

SEQ ID NO: 1325007 - RNA, 14 nt, Homo sapiens
ucauuaugccacuu

SEQ ID NO: 1325008 - RNA, 18 nt, Homo sapiens
ucauucgcuacuaugauu

SEQ ID NO: 1325009 - RNA, 13 nt, Homo sapiens
ucauucuacugaa

SEQ ID NO: 1325010 - RNA, 14 nt, Homo sapiens
ucauugaccuucag

SEQ ID NO: 1325011 - RNA, 23 nt, Homo sapiens
ucauugaugagcaagacauacuu

SEQ ID NO: 1325012 - RNA, 18 nt, Homo sapiens
ucauuggugaaguaaauu

SEQ ID NO: 1325013 - RNA, 21 nt, Homo sapiens
ucauuugacuaagagucucca

SEQ ID NO: 1325014 - RNA, 14 nt, Homo sapiens
uccaaaacauuucu

SEQ ID NO: 1325015 - RNA, 22 nt, Homo sapiens
uccaaaccugucuuggggccac

SEQ ID NO: 1325016 - RNA, 17 nt, Homo sapiens
uccaaagccggcuugau

SEQ ID NO: 1325017 - RNA, 14 nt, Homo sapiens
uccaaaucaaggau

SEQ ID NO: 1325018 - RNA, 16 nt, Homo sapiens
uccaacacaucucccu

SEQ ID NO: 1325019 - RNA, 19 nt, Homo sapiens
uccaacacuuugagcauuu

SEQ ID NO: 1325020 - RNA, 14 nt, Homo sapiens
uccaaccacuguac

SEQ ID NO: 1325021 - RNA, 17 nt, Homo sapiens
uccaacccgaggcaaua

SEQ ID NO: 1325022 - RNA, 14 nt, Homo sapiens
uccaagaauggagg

SEQ ID NO: 1325023 - RNA, 14 nt, Homo sapiens
uccaagcauaccaa

SEQ ID NO: 1325024 - RNA, 22 nt, Homo sapiens
uccaagcauaccaacacgagca

SEQ ID NO: 1325025 - RNA, 13 nt, Homo sapiens
uccaaggcuuuaa

SEQ ID NO: 1325026 - RNA, 13 nt, Homo sapiens
uccaaucagguag

SEQ ID NO: 1325027 - RNA, 12 nt, Homo sapiens
uccaaucuguga

SEQ ID NO: 1325028 - RNA, 13 nt, Homo sapiens
uccaaucugugau

SEQ ID NO: 1325029 - RNA, 22 nt, Homo sapiens
uccaauuucucuuuacuugaaa

SEQ ID NO: 1325030 - RNA, 13 nt, Homo sapiens
uccacacacagcu

SEQ ID NO: 1325031 - RNA, 12 nt, Homo sapiens
uccacacccacc

SEQ ID NO: 1325032 - RNA, 19 nt, Homo sapiens
uccacacuuccugagccag

SEQ ID NO: 1325033 - RNA, 23 nt, Homo sapiens
uccacuacucucuuccuccacuu

SEQ ID NO: 1325034 - RNA, 23 nt, Homo sapiens
uccacugaggugggagcaucucc

SEQ ID NO: 1325035 - RNA, 19 nt, Homo sapiens
uccacuugagugucaagcu

SEQ ID NO: 1325036 - RNA, 21 nt, Homo sapiens
uccagacaaugccagcauaaa

SEQ ID NO: 1325037 - RNA, 17 nt, Homo sapiens
uccaggaauuaaaucau

SEQ ID NO: 1325038 - RNA, 19 nt, Homo sapiens
uccaggauguacaaagaac

SEQ ID NO: 1325039 - RNA, 16 nt, Homo sapiens
uccagggcaaggccau

SEQ ID NO: 1325040 - RNA, 17 nt, Homo sapiens
uccaggguguagccuac

SEQ ID NO: 1325041 - RNA, 22 nt, Homo sapiens
uccagguuuaugaaugacagua

SEQ ID NO: 1325042 - RNA, 22 nt, Homo sapiens
uccaguacuauggagugcucac

SEQ ID NO: 1325043 - RNA, 12 nt, Homo sapiens
uccagugcaguc

SEQ ID NO: 1325044 - RNA, 13 nt, Homo sapiens
uccagugugagau

SEQ ID NO: 1325045 - RNA, 22 nt, Homo sapiens
uccauaaagacaaucacugcca

SEQ ID NO: 1325046 - RNA, 13 nt, Homo sapiens
uccauacuccacu

SEQ ID NO: 1325047 - RNA, 17 nt, Homo sapiens
uccauacuccacuccaa

SEQ ID NO: 1325048 - RNA, 20 nt, Homo sapiens
uccauauaacaauucaguaa

SEQ ID NO: 1325049 - RNA, 17 nt, Homo sapiens
uccaucucugucucaaa

SEQ ID NO: 1325050 - RNA, 13 nt, Homo sapiens
uccaucuuucuac

SEQ ID NO: 1325051 - RNA, 20 nt, Homo sapiens
uccaugcaccuaccuuagaa

SEQ ID NO: 1325052 - RNA, 13 nt, Homo sapiens
uccaugugccuuu

SEQ ID NO: 1325053 - RNA, 22 nt, Homo sapiens
uccaugugccuuucuuugccuc

SEQ ID NO: 1325054 - RNA, 15 nt, Homo sapiens
uccauguuugcaccu

SEQ ID NO: 1325055 - RNA, 17 nt, Homo sapiens
uccauguuugcaccugu

SEQ ID NO: 1325056 - RNA, 16 nt, Homo sapiens
uccauuaaguacaugu

SEQ ID NO: 1325057 - RNA, 16 nt, Homo sapiens
uccauuacaccacagc

SEQ ID NO: 1325058 - RNA, 19 nt, Homo sapiens
uccauuacaccacagcauu

SEQ ID NO: 1325059 - RNA, 14 nt, Homo sapiens
uccauucuucccuu

SEQ ID NO: 1325060 - RNA, 15 nt, Homo sapiens
uccauugauucaggg

SEQ ID NO: 1325061 - RNA, 18 nt, Homo sapiens
uccauuuauuaagcagua

SEQ ID NO: 1325062 - RNA, 20 nt, Homo sapiens
uccauuuugugaauugugac

SEQ ID NO: 1325063 - RNA, 15 nt, Homo sapiens
ucccaaaccagacac

SEQ ID NO: 1325064 - RNA, 19 nt, Homo sapiens
ucccaaaucccucucacaa

SEQ ID NO: 1325065 - RNA, 15 nt, Homo sapiens
ucccaaccccaggaa

SEQ ID NO: 1325066 - RNA, 11 nt, Homo sapiens
ucccacacugu

SEQ ID NO: 1325067 - RNA, 13 nt, Homo sapiens
ucccacacugugc

SEQ ID NO: 1325068 - RNA, 21 nt, Homo sapiens
ucccaccauuccugccuuuaa

SEQ ID NO: 1325069 - RNA, 17 nt, Homo sapiens
ucccacccacacagcug

SEQ ID NO: 1325070 - RNA, 23 nt, Homo sapiens
ucccacccacacagcugcccuag

SEQ ID NO: 1325071 - RNA, 15 nt, Homo sapiens
ucccaccgaacacua

SEQ ID NO: 1325072 - RNA, 22 nt, Homo sapiens
ucccacugcccccuccacugga

SEQ ID NO: 1325073 - RNA, 13 nt, Homo sapiens
ucccacuuucauc

SEQ ID NO: 1325074 - RNA, 14 nt, Homo sapiens
ucccagagaccuca

SEQ ID NO: 1325075 - RNA, 21 nt, Homo sapiens
ucccagcacgaguggccaguu

SEQ ID NO: 1325076 - RNA, 14 nt, Homo sapiens
ucccagcuacucag

SEQ ID NO: 1325077 - RNA, 22 nt, Homo sapiens
ucccagcucuagccucuggacu

SEQ ID NO: 1325078 - RNA, 23 nt, Homo sapiens
ucccaggccagcaagcucuucac

SEQ ID NO: 1325079 - RNA, 23 nt, Homo sapiens
ucccaugcuuuguaggugucuca

SEQ ID NO: 1325080 - RNA, 16 nt, Homo sapiens
ucccauuccugaagaa

SEQ ID NO: 1325081 - RNA, 12 nt, Homo sapiens
ucccauugccau

SEQ ID NO: 1325082 - RNA, 21 nt, Homo sapiens
uccccaaggcugcaaagcaaa

SEQ ID NO: 1325083 - RNA, 17 nt, Homo sapiens
uccccacgaacuggccu

SEQ ID NO: 1325084 - RNA, 18 nt, Homo sapiens
uccccacuuuauugccaa

SEQ ID NO: 1325085 - RNA, 16 nt, Homo sapiens
uccccaggcaccucac

SEQ ID NO: 1325086 - RNA, 13 nt, Homo sapiens
uccccagucccag

SEQ ID NO: 1325087 - RNA, 12 nt, Homo sapiens
ucccccccaugc

SEQ ID NO: 1325088 - RNA, 14 nt, Homo sapiens
ucccccucuuucac

SEQ ID NO: 1325089 - RNA, 15 nt, Homo sapiens
ucccccugcaacuuc

SEQ ID NO: 1325090 - RNA, 15 nt, Homo sapiens
ucccccuucacaaag

SEQ ID NO: 1325091 - RNA, 23 nt, Homo sapiens
uccccgauugaaagaaccagaga

SEQ ID NO: 1325092 - RNA, 13 nt, Homo sapiens
uccccguccacag

SEQ ID NO: 1325093 - RNA, 16 nt, Homo sapiens
uccccguccacagggc

SEQ ID NO: 1325094 - RNA, 14 nt, Homo sapiens
uccccuaaaccaaa

SEQ ID NO: 1325095 - RNA, 23 nt, Homo sapiens
uccccuaaaccaaaaacugaaag

SEQ ID NO: 1325096 - RNA, 14 nt, Homo sapiens
uccccuaaagccag

SEQ ID NO: 1325097 - RNA, 11 nt, Homo sapiens
uccccuaccca

SEQ ID NO: 1325098 - RNA, 14 nt, Homo sapiens
uccccuacucugcc

SEQ ID NO: 1325099 - RNA, 13 nt, Homo sapiens
uccccucccucag

SEQ ID NO: 1325100 - RNA, 17 nt, Homo sapiens
uccccucccuguauaag

SEQ ID NO: 1325101 - RNA, 13 nt, Homo sapiens
uccccucggagaa

SEQ ID NO: 1325102 - RNA, 21 nt, Homo sapiens
uccccuguagcagucacugac

SEQ ID NO: 1325103 - RNA, 14 nt, Homo sapiens
uccccuucugcaau

SEQ ID NO: 1325104 - RNA, 19 nt, Homo sapiens
uccccuuuugccaaucuca

SEQ ID NO: 1325105 - RNA, 21 nt, Homo sapiens
ucccgccccgccccucccacg

SEQ ID NO: 1325106 - RNA, 14 nt, Homo sapiens
ucccuaaacugcag

SEQ ID NO: 1325107 - RNA, 21 nt, Homo sapiens
ucccuagauagcuauuaagau

SEQ ID NO: 1325108 - RNA, 11 nt, Homo sapiens
ucccucaggcc

SEQ ID NO: 1325109 - RNA, 19 nt, Homo sapiens
ucccucaggccgaaggagg

SEQ ID NO: 1325110 - RNA, 23 nt, Homo sapiens
ucccucucagaggccugcugcca

SEQ ID NO: 1325111 - RNA, 14 nt, Homo sapiens
ucccucucaugacu

SEQ ID NO: 1325112 - RNA, 22 nt, Homo sapiens
ucccucucuuccccuucccuua

SEQ ID NO: 1325113 - RNA, 20 nt, Homo sapiens
ucccugaagagaagggcagg

SEQ ID NO: 1325114 - RNA, 11 nt, Homo sapiens
ucccugcaaaa

SEQ ID NO: 1325115 - RNA, 13 nt, Homo sapiens
ucccugccuggag

SEQ ID NO: 1325116 - RNA, 16 nt, Homo sapiens
ucccugucuccagggc

SEQ ID NO: 1325117 - RNA, 16 nt, Homo sapiens
ucccugugucauuuca

SEQ ID NO: 1325118 - RNA, 18 nt, Homo sapiens
ucccugugucauuucaaa

SEQ ID NO: 1325119 - RNA, 18 nt, Homo sapiens
ucccuucuggacacugag

SEQ ID NO: 1325120 - RNA, 20 nt, Homo sapiens
ucccuugaggaaacaacagc

SEQ ID NO: 1325121 - RNA, 13 nt, Homo sapiens
ucccuuggacauu

SEQ ID NO: 1325122 - RNA, 15 nt, Homo sapiens
uccgcuuugcuugcu

SEQ ID NO: 1325123 - RNA, 20 nt, Homo sapiens
uccggagugagcaauggagu

SEQ ID NO: 1325124 - RNA, 19 nt, Homo sapiens
uccggccuccugucccuca

SEQ ID NO: 1325125 - RNA, 22 nt, Homo sapiens
uccgugcugacagcugcuccua

SEQ ID NO: 1325126 - RNA, 18 nt, Homo sapiens
uccgugcuuaaccaaaga

SEQ ID NO: 1325127 - RNA, 17 nt, Homo sapiens
uccuaacguuugucauu

SEQ ID NO: 1325128 - RNA, 21 nt, Homo sapiens
uccuaccagagugaagcccac

SEQ ID NO: 1325129 - RNA, 14 nt, Homo sapiens
uccuacccuuccag

SEQ ID NO: 1325130 - RNA, 13 nt, Homo sapiens
uccuagucauucu

SEQ ID NO: 1325131 - RNA, 24 nt, Homo sapiens
uccuaucaccucgagaaguaauua

SEQ ID NO: 1325132 - RNA, 19 nt, Homo sapiens
uccuaucucccuggcucac

SEQ ID NO: 1325133 - RNA, 22 nt, Homo sapiens
uccucagagaauuucuaccauu

SEQ ID NO: 1325134 - RNA, 15 nt, Homo sapiens
uccucagccuccuca

SEQ ID NO: 1325135 - RNA, 16 nt, Homo sapiens
uccucagccuccucau

SEQ ID NO: 1325136 - RNA, 19 nt, Homo sapiens
uccucagccuugccagaga

SEQ ID NO: 1325137 - RNA, 22 nt, Homo sapiens
uccucaggaaauuagauaaaua

SEQ ID NO: 1325138 - RNA, 23 nt, Homo sapiens
uccucaucugggggaguggaaua

SEQ ID NO: 1325139 - RNA, 15 nt, Homo sapiens
uccuccuugucuuaa

SEQ ID NO: 1325140 - RNA, 23 nt, Homo sapiens
ugcagugauguuugccauuugcu

SEQ ID NO: 1325141 - RNA, 20 nt, Homo sapiens
ugcaguuucuuuucacauua

SEQ ID NO: 1325142 - RNA, 22 nt, Homo sapiens
ugcauaagugaaaaucuuacaa

SEQ ID NO: 1325143 - RNA, 14 nt, Homo sapiens
ugcauauagacaca

SEQ ID NO: 1325144 - RNA, 16 nt, Homo sapiens
ugcauccaaaccugua

SEQ ID NO: 1325145 - RNA, 23 nt, Homo sapiens
ugcaucuuuguuacuuccuuaug

SEQ ID NO: 1325146 - RNA, 22 nt, Homo sapiens
ugcaugaccucuacauugaaaa

SEQ ID NO: 1325147 - RNA, 15 nt, Homo sapiens
ugcauggaguauuau

SEQ ID NO: 1325148 - RNA, 14 nt, Homo sapiens
ugcaugggcugugg

SEQ ID NO: 1325149 - RNA, 13 nt, Homo sapiens
ugcauguuuucca

SEQ ID NO: 1325150 - RNA, 22 nt, Homo sapiens
ugcauuccuuuuucuucacuua

SEQ ID NO: 1325151 - RNA, 19 nt, Homo sapiens
ugcauugaaagaauuagau

SEQ ID NO: 1325152 - RNA, 18 nt, Homo sapiens
ugccaaaggaugugauau

SEQ ID NO: 1325153 - RNA, 19 nt, Homo sapiens
ugccaaaggaugugauaua

SEQ ID NO: 1325154 - RNA, 13 nt, Homo sapiens
ugccaacugccag

SEQ ID NO: 1325155 - RNA, 15 nt, Homo sapiens
ugccaauuagcaauu

SEQ ID NO: 1325156 - RNA, 19 nt, Homo sapiens
ugccaccagcgaacucuca

SEQ ID NO: 1325157 - RNA, 12 nt, Homo sapiens
ugccacccaguu

SEQ ID NO: 1325158 - RNA, 21 nt, Homo sapiens
ugccacgccgcccuaaaagca

SEQ ID NO: 1325159 - RNA, 16 nt, Homo sapiens
ugccagccacugugau

SEQ ID NO: 1325160 - RNA, 17 nt, Homo sapiens
ugccaggcccuuugcac

SEQ ID NO: 1325161 - RNA, 14 nt, Homo sapiens
ugccagggccaguc

SEQ ID NO: 1325162 - RNA, 17 nt, Homo sapiens
ugccagguccuugcccu

SEQ ID NO: 1325163 - RNA, 15 nt, Homo sapiens
ugccaguaacugugc

SEQ ID NO: 1325164 - RNA, 21 nt, Homo sapiens
ugccaguuacuugggcuucaa

SEQ ID NO: 1325165 - RNA, 22 nt, Homo sapiens
ugcccaauuagggccuagccuu

SEQ ID NO: 1325166 - RNA, 20 nt, Homo sapiens
ugcccacucuccauccuccc

SEQ ID NO: 1325167 - RNA, 21 nt, Homo sapiens
ugcccaggcuagagugcaaug

SEQ ID NO: 1325168 - RNA, 16 nt, Homo sapiens
ugccccaccccaucca

SEQ ID NO: 1325169 - RNA, 17 nt, Homo sapiens
ugcccccuccaggagag

SEQ ID NO: 1325170 - RNA, 14 nt, Homo sapiens
ugcccccuccccca

SEQ ID NO: 1325171 - RNA, 21 nt, Homo sapiens
ugcccccucccccaugggcug

SEQ ID NO: 1325172 - RNA, 16 nt, Homo sapiens
ugcccuaggugagaac

SEQ ID NO: 1325173 - RNA, 13 nt, Homo sapiens
ugcccugccccac

SEQ ID NO: 1325174 - RNA, 17 nt, Homo sapiens
ugcccuuucaaagcacu

SEQ ID NO: 1325175 - RNA, 12 nt, Homo sapiens
ugccgcauuugg

SEQ ID NO: 1325176 - RNA, 15 nt, Homo sapiens
ugccgcugucucuga

SEQ ID NO: 1325177 - RNA, 19 nt, Homo sapiens
ugccgcugucucugagggg

SEQ ID NO: 1325178 - RNA, 17 nt, Homo sapiens
ugccgcuuucucugagg

SEQ ID NO: 1325179 - RNA, 20 nt, Homo sapiens
ugccuagaguguagccuaaa

SEQ ID NO: 1325180 - RNA, 21 nt, Homo sapiens
ugccuccagugcaguccauuu

SEQ ID NO: 1325181 - RNA, 15 nt, Homo sapiens
ugccucuguccgugc

SEQ ID NO: 1325182 - RNA, 16 nt, Homo sapiens
ugccugcuccaucuca

SEQ ID NO: 1325183 - RNA, 17 nt, Homo sapiens
ugccugcuccaucucau

SEQ ID NO: 1325184 - RNA, 14 nt, Homo sapiens
ugccuggcacagac

SEQ ID NO: 1325185 - RNA, 22 nt, Homo sapiens
ugccugggccguggcacagcug

SEQ ID NO: 1325186 - RNA, 16 nt, Homo sapiens
ugccuguaacaaugua

SEQ ID NO: 1325187 - RNA, 20 nt, Homo sapiens
ugccuguaaucucagcacuu

SEQ ID NO: 1325188 - RNA, 17 nt, Homo sapiens
ugccugugagcaugggg

SEQ ID NO: 1325189 - RNA, 18 nt, Homo sapiens
ugccuguguacugccuua

SEQ ID NO: 1325190 - RNA, 16 nt, Homo sapiens
ugccuuaaacucuguu

SEQ ID NO: 1325191 - RNA, 13 nt, Homo sapiens
ugccuucuccuau

SEQ ID NO: 1325192 - RNA, 14 nt, Homo sapiens
ugccuucugcugaa

SEQ ID NO: 1325193 - RNA, 16 nt, Homo sapiens
ugccuuggugugcugu

SEQ ID NO: 1325194 - RNA, 22 nt, Homo sapiens
ugccuugucucuaguagugugg

SEQ ID NO: 1325195 - RNA, 16 nt, Homo sapiens
ugccuuuaagccaaag

SEQ ID NO: 1325196 - RNA, 22 nt, Homo sapiens
ugccuuuuuuucucugcauuua

SEQ ID NO: 1325197 - RNA, 15 nt, Homo sapiens
ugcgaaagacccaca

SEQ ID NO: 1325198 - RNA, 14 nt, Homo sapiens
ugcgccaccucacu

SEQ ID NO: 1325199 - RNA, 14 nt, Homo sapiens
ugcgccugaguaac

SEQ ID NO: 1325200 - RNA, 22 nt, Homo sapiens
ugcgugauucaaugaaccacaa

SEQ ID NO: 1325201 - RNA, 14 nt, Homo sapiens
ugcuaacaggauau

SEQ ID NO: 1325202 - RNA, 16 nt, Homo sapiens
ugcuaacauagauuua

SEQ ID NO: 1325203 - RNA, 11 nt, Homo sapiens
ugcuaacuggg

SEQ ID NO: 1325204 - RNA, 14 nt, Homo sapiens
ugcuaacugguuaa

SEQ ID NO: 1325205 - RNA, 20 nt, Homo sapiens
ugcuaaucuucuuaugcaau

SEQ ID NO: 1325206 - RNA, 22 nt, Homo sapiens
ugcuacuacugcagucuuuauu

SEQ ID NO: 1325207 - RNA, 20 nt, Homo sapiens
ugcuauaacuaugaccaugc

SEQ ID NO: 1325208 - RNA, 20 nt, Homo sapiens
ugcuauagugacaugcaguu

SEQ ID NO: 1325209 - RNA, 15 nt, Homo sapiens
ugcuaucaccaauca

SEQ ID NO: 1325210 - RNA, 21 nt, Homo sapiens
ugcucacaaaggauacuuuua

SEQ ID NO: 1325211 - RNA, 20 nt, Homo sapiens
ugcucacacauuacaacagu

SEQ ID NO: 1325212 - RNA, 23 nt, Homo sapiens
ugcucagaccgagcgugugccac

SEQ ID NO: 1325213 - RNA, 19 nt, Homo sapiens
ugcucaggagcagcacucu

SEQ ID NO: 1325214 - RNA, 17 nt, Homo sapiens
ugcucauuucacuauuc

SEQ ID NO: 1325215 - RNA, 13 nt, Homo sapiens
ugcuccaccagca

SEQ ID NO: 1325216 - RNA, 14 nt, Homo sapiens
ugcuccccugugaa

SEQ ID NO: 1325217 - RNA, 23 nt, Homo sapiens
ugcucguucaacagugugagcau

SEQ ID NO: 1325218 - RNA, 22 nt, Homo sapiens
ugcucuacagauaaugucuaua

SEQ ID NO: 1325219 - RNA, 18 nt, Homo sapiens
ugcucuccuccaccucaa

SEQ ID NO: 1325220 - RNA, 18 nt, Homo sapiens
ugcucucggugcuuccaa

SEQ ID NO: 1325221 - RNA, 14 nt, Homo sapiens
ugcucucucugagg

SEQ ID NO: 1325222 - RNA, 16 nt, Homo sapiens
ugcucuguuguagggg

SEQ ID NO: 1325223 - RNA, 18 nt, Homo sapiens
ugcucuguuuugcaugga

SEQ ID NO: 1325224 - RNA, 12 nt, Homo sapiens
ugcugacguguu

SEQ ID NO: 1325225 - RNA, 13 nt, Homo sapiens
ugcugagagccau

SEQ ID NO: 1325226 - RNA, 14 nt, Homo sapiens
ugcugauacugggu

SEQ ID NO: 1325227 - RNA, 22 nt, Homo sapiens
ugcugauacugggucugcgaug

SEQ ID NO: 1325228 - RNA, 18 nt, Homo sapiens
ugcugauaucaacagcuu

SEQ ID NO: 1325229 - RNA, 22 nt, Homo sapiens
ugcugcagauuugauauuugca

SEQ ID NO: 1325230 - RNA, 15 nt, Homo sapiens
ugcugccagcucuca

SEQ ID NO: 1325231 - RNA, 11 nt, Homo sapiens
ugcugccuuaa

SEQ ID NO: 1325232 - RNA, 12 nt, Homo sapiens
ugcugccuucac

SEQ ID NO: 1325233 - RNA, 20 nt, Homo sapiens
ugcugcuccccuaaagccag

SEQ ID NO: 1325234 - RNA, 12 nt, Homo sapiens
ugcugcucucuc

SEQ ID NO: 1325235 - RNA, 19 nt, Homo sapiens
ugcuggaauuacaggcgug

SEQ ID NO: 1325236 - RNA, 17 nt, Homo sapiens
ugcuggccggagcaaac

SEQ ID NO: 1325237 - RNA, 14 nt, Homo sapiens
ugcuggcugccuua

SEQ ID NO: 1325238 - RNA, 18 nt, Homo sapiens
ugcugggaaccuagcaca

SEQ ID NO: 1325239 - RNA, 14 nt, Homo sapiens
ugcuggggaagaca

SEQ ID NO: 1325240 - RNA, 15 nt, Homo sapiens
ugcuggugcagcgua

SEQ ID NO: 1325241 - RNA, 18 nt, Homo sapiens
ugcuguagacauuugcua

SEQ ID NO: 1325242 - RNA, 21 nt, Homo sapiens
ugcuguagacauuugcuauga

SEQ ID NO: 1325243 - RNA, 18 nt, Homo sapiens
ugcuguauccauccaugg

SEQ ID NO: 1325244 - RNA, 14 nt, Homo sapiens
ugcuguuaaucuga

SEQ ID NO: 1325245 - RNA, 15 nt, Homo sapiens
ugcuguuaaucugau

SEQ ID NO: 1325246 - RNA, 14 nt, Homo sapiens
ugcuguuauauuuc

SEQ ID NO: 1325247 - RNA, 16 nt, Homo sapiens
ugcuuaugacaucacu

SEQ ID NO: 1325248 - RNA, 14 nt, Homo sapiens
ugcuuccaacucau

SEQ ID NO: 1325249 - RNA, 18 nt, Homo sapiens
ugcuuccaacucauccac

SEQ ID NO: 1325250 - RNA, 18 nt, Homo sapiens
ugcuuccugucugaguaa

SEQ ID NO: 1325251 - RNA, 15 nt, Homo sapiens
ugcuucuaauauuag

SEQ ID NO: 1325252 - RNA, 16 nt, Homo sapiens
ugcuugcccgcuccca

SEQ ID NO: 1325253 - RNA, 18 nt, Homo sapiens
ugcuuggaagccagguac

SEQ ID NO: 1325254 - RNA, 13 nt, Homo sapiens
ugcuuggcacuua

SEQ ID NO: 1325255 - RNA, 15 nt, Homo sapiens
ugcuuggcccuucaa

SEQ ID NO: 1325256 - RNA, 17 nt, Homo sapiens
ugcuugggacauugcaa

SEQ ID NO: 1325257 - RNA, 13 nt, Homo sapiens
ugcuuuaaccuca

SEQ ID NO: 1325258 - RNA, 22 nt, Homo sapiens
ugcuuuaaugucuaaccaagaa

SEQ ID NO: 1325259 - RNA, 12 nt, Homo sapiens
ugcuuucugcuc

SEQ ID NO: 1325260 - RNA, 14 nt, Homo sapiens
ugcuuuuaaaugca

SEQ ID NO: 1325261 - RNA, 21 nt, Homo sapiens
ugcuuuuggcagagaccauaa

SEQ ID NO: 1325262 - RNA, 19 nt, Homo sapiens
ugcuuuuuuaaacuugaau

SEQ ID NO: 1325263 - RNA, 18 nt, Homo sapiens
uggaaaaacaggaaagga

SEQ ID NO: 1325264 - RNA, 19 nt, Homo sapiens
uggaaaaaugguugaugga

SEQ ID NO: 1325265 - RNA, 21 nt, Homo sapiens
uggaaaacagcgaacagccuu

SEQ ID NO: 1325266 - RNA, 22 nt, Homo sapiens
uggaaaaggccuguggcccaga

SEQ ID NO: 1325267 - RNA, 13 nt, Homo sapiens
uggaaaaguuuga

SEQ ID NO: 1325268 - RNA, 23 nt, Homo sapiens
uggaaaaugaccucaaggaagcu

SEQ ID NO: 1325269 - RNA, 21 nt, Homo sapiens
uggaaaccuuccacccagugc

SEQ ID NO: 1325270 - RNA, 23 nt, Homo sapiens
uggaaaguaucaugaaaggaaga

SEQ ID NO: 1325271 - RNA, 14 nt, Homo sapiens
uggaaauacacuca

SEQ ID NO: 1325272 - RNA, 15 nt, Homo sapiens
uggaaauagaugugc

SEQ ID NO: 1325273 - RNA, 14 nt, Homo sapiens
aaucccagcacuuu

SEQ ID NO: 1325274 - RNA, 15 nt, Homo sapiens
aaucccagcuacuug

SEQ ID NO: 1325275 - RNA, 15 nt, Homo sapiens
aaucccucucacaag

SEQ ID NO: 1325276 - RNA, 21 nt, Homo sapiens
aauccuaguuuaugcacauga

SEQ ID NO: 1325277 - RNA, 19 nt, Homo sapiens
aauccuuuuccuguucaua

SEQ ID NO: 1325278 - RNA, 21 nt, Homo sapiens
aaucuauaugauuucagaaau

SEQ ID NO: 1325279 - RNA, 14 nt, Homo sapiens
aaucucagcacuuu

SEQ ID NO: 1325280 - RNA, 22 nt, Homo sapiens
aaucucccagugacaacaucgc

SEQ ID NO: 1325281 - RNA, 14 nt, Homo sapiens
aaucucuugcacuc

SEQ ID NO: 1325282 - RNA, 14 nt, Homo sapiens
aaucucuugccugc

SEQ ID NO: 1325283 - RNA, 23 nt, Homo sapiens
aaucucuugccugcuccaucuca

SEQ ID NO: 1325284 - RNA, 20 nt, Homo sapiens
aaucugaacugaccuugaau

SEQ ID NO: 1325285 - RNA, 23 nt, Homo sapiens
aaucugagaggccacagugcaau

SEQ ID NO: 1325286 - RNA, 17 nt, Homo sapiens
acacacacgcacucucc

SEQ ID NO: 1325287 - RNA, 16 nt, Homo sapiens
acacacauugcagcuu

SEQ ID NO: 1325288 - RNA, 16 nt, Homo sapiens
acacacucaaaucaag

SEQ ID NO: 1325289 - RNA, 14 nt, Homo sapiens
acacagcugggcug

SEQ ID NO: 1325290 - RNA, 14 nt, Homo sapiens
acacaggcaaaauc

SEQ ID NO: 1325291 - RNA, 23 nt, Homo sapiens
acacaucucccuuuuccaugacu

SEQ ID NO: 1325292 - RNA, 16 nt, Homo sapiens
acacaugcccaugaug

SEQ ID NO: 1325293 - RNA, 15 nt, Homo sapiens
acaccggccuugcau

SEQ ID NO: 1325294 - RNA, 14 nt, Homo sapiens
acaccguucauuca

SEQ ID NO: 1325295 - RNA, 14 nt, Homo sapiens
acaccugcugagaa

SEQ ID NO: 1325296 - RNA, 14 nt, Homo sapiens
acaccuggccuuaa

SEQ ID NO: 1325297 - RNA, 12 nt, Homo sapiens
acacgcauuaau

SEQ ID NO: 1325298 - RNA, 17 nt, Homo sapiens
acacgcguggcaaacaa

SEQ ID NO: 1325299 - RNA, 20 nt, Homo sapiens
acacggaggucucuguaaaa

SEQ ID NO: 1325300 - RNA, 12 nt, Homo sapiens
acacgugacaga

SEQ ID NO: 1325301 - RNA, 17 nt, Homo sapiens
acacguucgacaaaagc

SEQ ID NO: 1325302 - RNA, 14 nt, Homo sapiens
acacuaccaguuuc

SEQ ID NO: 1325303 - RNA, 23 nt, Homo sapiens
caagaauagaugcugacuguacu

SEQ ID NO: 1325304 - RNA, 15 nt, Homo sapiens
caagaaugcuuuaau

SEQ ID NO: 1325305 - RNA, 18 nt, Homo sapiens
caagaccucugugcacuu

SEQ ID NO: 1325306 - RNA, 17 nt, Homo sapiens
caagacuggcccagugc

SEQ ID NO: 1325307 - RNA, 19 nt, Homo sapiens
caagagaucuuucuuucca

SEQ ID NO: 1325308 - RNA, 13 nt, Homo sapiens
caagagcaugcac

SEQ ID NO: 1325309 - RNA, 21 nt, Homo sapiens
caagaucauagcucauugcaa

SEQ ID NO: 1325310 - RNA, 15 nt, Homo sapiens
caagcaauccuccua

SEQ ID NO: 1325311 - RNA, 17 nt, Homo sapiens
caagccccauuuccuca

SEQ ID NO: 1325312 - RNA, 17 nt, Homo sapiens
caagccugucuucagag

SEQ ID NO: 1325313 - RNA, 15 nt, Homo sapiens
caagcucuucacuga

SEQ ID NO: 1325314 - RNA, 12 nt, Homo sapiens
caagcugccucc

SEQ ID NO: 1325315 - RNA, 20 nt, Homo sapiens
caagcuuugguuuaugguuu

SEQ ID NO: 1325316 - RNA, 20 nt, Homo sapiens
caaggagggcagaucacuuc

SEQ ID NO: 1325317 - RNA, 18 nt, Homo sapiens
caaggagggugagugcaa

SEQ ID NO: 1325318 - RNA, 20 nt, Homo sapiens
caaggagggugagugcaagg

SEQ ID NO: 1325319 - RNA, 16 nt, Homo sapiens
caaggaugucugccac

SEQ ID NO: 1325320 - RNA, 20 nt, Homo sapiens
caaggcccaggagaccucca

SEQ ID NO: 1325321 - RNA, 16 nt, Homo sapiens
caagggucagggugag

SEQ ID NO: 1325322 - RNA, 18 nt, Homo sapiens
caagguggugugaucuua

SEQ ID NO: 1325323 - RNA, 19 nt, Homo sapiens
caaguaaaacaaaugaaau

SEQ ID NO: 1325324 - RNA, 22 nt, Homo sapiens
caaguaaaacaaaugaaauuua

SEQ ID NO: 1325325 - RNA, 14 nt, Homo sapiens
caaguaagggcaca

SEQ ID NO: 1325326 - RNA, 12 nt, Homo sapiens
caagucaaauac

SEQ ID NO: 1325327 - RNA, 17 nt, Homo sapiens
caagucaaauaccacau

SEQ ID NO: 1325328 - RNA, 22 nt, Homo sapiens
caagugaaaagcaggcaaaaga

SEQ ID NO: 1325329 - RNA, 21 nt, Homo sapiens
caaguggugagcaagcaccaa

SEQ ID NO: 1325330 - RNA, 19 nt, Homo sapiens
caaguuuuggcagccauga

SEQ ID NO: 1325331 - RNA, 15 nt, Homo sapiens
caauaaaucuuucaa

SEQ ID NO: 1325332 - RNA, 14 nt, Homo sapiens
caauaaauuugcuu

SEQ ID NO: 1325333 - RNA, 15 nt, Homo sapiens
caauaacaguagugu

SEQ ID NO: 1325334 - RNA, 15 nt, Homo sapiens
caauaagcaaaaaca

SEQ ID NO: 1325335 - RNA, 14 nt, Homo sapiens
caauacaaccagcc

SEQ ID NO: 1325336 - RNA, 12 nt, Homo sapiens
caauacuacuga

SEQ ID NO: 1325337 - RNA, 15 nt, Homo sapiens
caauacuguuuccau

SEQ ID NO: 1325338 - RNA, 19 nt, Homo sapiens
caauagcauaucacagaga

SEQ ID NO: 1325339 - RNA, 24 nt, Homo sapiens
caauauuaagucauuguuucccau

SEQ ID NO: 1325340 - RNA, 15 nt, Homo sapiens
caauauuuauuacac

SEQ ID NO: 1325341 - RNA, 18 nt, Homo sapiens
caaucaagccauguauaa

SEQ ID NO: 1325342 - RNA, 21 nt, Homo sapiens
caaucacagggaauggccaca

SEQ ID NO: 1325343 - RNA, 14 nt, Homo sapiens
caaucagcccagug

SEQ ID NO: 1325344 - RNA, 15 nt, Homo sapiens
caauccuccuaccuc

SEQ ID NO: 1325345 - RNA, 18 nt, Homo sapiens
caauccuugccacagugu

SEQ ID NO: 1325346 - RNA, 14 nt, Homo sapiens
caaucuaaaauggc

SEQ ID NO: 1325347 - RNA, 15 nt, Homo sapiens
caaucuaaaauggca

SEQ ID NO: 1325348 - RNA, 20 nt, Homo sapiens
caaucuaaagauacaguguc

SEQ ID NO: 1325349 - RNA, 13 nt, Homo sapiens
caaucucacaccu

SEQ ID NO: 1325350 - RNA, 19 nt, Homo sapiens
caaucucuuuauuacugag

SEQ ID NO: 1325351 - RNA, 15 nt, Homo sapiens
caaugaaauuuugau

SEQ ID NO: 1325352 - RNA, 15 nt, Homo sapiens
caaugacacagucuu

SEQ ID NO: 1325353 - RNA, 20 nt, Homo sapiens
caaugcccaguaaaauuuca

SEQ ID NO: 1325354 - RNA, 16 nt, Homo sapiens
caauggagacugucuc

SEQ ID NO: 1325355 - RNA, 19 nt, Homo sapiens
caauggugcaaucacagcu

SEQ ID NO: 1325356 - RNA, 19 nt, Homo sapiens
caaugguugaugauacuuc

SEQ ID NO: 1325357 - RNA, 20 nt, Homo sapiens
caauguauugagcaugugau

SEQ ID NO: 1325358 - RNA, 22 nt, Homo sapiens
caauguccaaacccacucauga

SEQ ID NO: 1325359 - RNA, 21 nt, Homo sapiens
caauuagcaauugacugucac

SEQ ID NO: 1325360 - RNA, 21 nt, Homo sapiens
caauuagcuccuccuuuuucc

SEQ ID NO: 1325361 - RNA, 14 nt, Homo sapiens
caauuccugugauu

SEQ ID NO: 1325362 - RNA, 18 nt, Homo sapiens
caauuccugugauuuaug

SEQ ID NO: 1325363 - RNA, 23 nt, Homo sapiens
caauucugugacauacauauuau

SEQ ID NO: 1325364 - RNA, 23 nt, Homo sapiens
caauugagaaaaauauauacuaa

SEQ ID NO: 1325365 - RNA, 15 nt, Homo sapiens
caauuggacaauuau

SEQ ID NO: 1325366 - RNA, 20 nt, Homo sapiens
cacaaauaaaggaaacccag

SEQ ID NO: 1325367 - RNA, 14 nt, Homo sapiens
cacaaaucugccaa

SEQ ID NO: 1325368 - RNA, 13 nt, Homo sapiens
cacaacugcaguc

SEQ ID NO: 1325369 - RNA, 14 nt, Homo sapiens
cacaaggggcucca

SEQ ID NO: 1325370 - RNA, 14 nt, Homo sapiens
cacaauaggucuuu

SEQ ID NO: 1325371 - RNA, 21 nt, Homo sapiens
cacaauccuugccacagugug

SEQ ID NO: 1325372 - RNA, 13 nt, Homo sapiens
cacacacacagau

SEQ ID NO: 1325373 - RNA, 21 nt, Homo sapiens
cacacacccccccacaaggaa

SEQ ID NO: 1325374 - RNA, 22 nt, Homo sapiens
cacacacccccccacaaggaac

SEQ ID NO: 1325375 - RNA, 23 nt, Homo sapiens
cagacccccccauuucccgcaca

SEQ ID NO: 1325376 - RNA, 19 nt, Homo sapiens
cagaccgccgucuaacuca

SEQ ID NO: 1325377 - RNA, 13 nt, Homo sapiens
cagaccuccuagc

SEQ ID NO: 1325378 - RNA, 14 nt, Homo sapiens
cagacucacuggga

SEQ ID NO: 1325379 - RNA, 15 nt, Homo sapiens
cagacucacugggaa

SEQ ID NO: 1325380 - RNA, 20 nt, Homo sapiens
cagacugaacucgcagggaa

SEQ ID NO: 1325381 - RNA, 19 nt, Homo sapiens
cagacugacccccaucuga

SEQ ID NO: 1325382 - RNA, 18 nt, Homo sapiens
cagagaaaggacugugga

SEQ ID NO: 1325383 - RNA, 20 nt, Homo sapiens
cagagaagguaaggugugaa

SEQ ID NO: 1325384 - RNA, 21 nt, Homo sapiens
cagagaagguaaggugugaac

SEQ ID NO: 1325385 - RNA, 17 nt, Homo sapiens
cagagaaguuuguagcc

SEQ ID NO: 1325386 - RNA, 13 nt, Homo sapiens
cagagacauacuu

SEQ ID NO: 1325387 - RNA, 14 nt, Homo sapiens
cagagaccucauca

SEQ ID NO: 1325388 - RNA, 17 nt, Homo sapiens
cagagcacccccugcuc

SEQ ID NO: 1325389 - RNA, 11 nt, Homo sapiens
cagagcacuug

SEQ ID NO: 1325390 - RNA, 22 nt, Homo sapiens
cagagcccugugucuguauaca

SEQ ID NO: 1325391 - RNA, 20 nt, Homo sapiens
cagagcgaggaaaggauuuu

SEQ ID NO: 1325392 - RNA, 16 nt, Homo sapiens
cagagcuccucacuua

SEQ ID NO: 1325393 - RNA, 20 nt, Homo sapiens
cagaggaauuuauaccucaa

SEQ ID NO: 1325394 - RNA, 20 nt, Homo sapiens
cagaggaggggaaaguccag

SEQ ID NO: 1325395 - RNA, 20 nt, Homo sapiens
cagaggauaucggcauuugu

SEQ ID NO: 1325396 - RNA, 21 nt, Homo sapiens
cagaggccugcugccagugca

SEQ ID NO: 1325397 - RNA, 19 nt, Homo sapiens
cagaggcguacuacccagc

SEQ ID NO: 1325398 - RNA, 15 nt, Homo sapiens
cagaggcgugggcuc

SEQ ID NO: 1325399 - RNA, 21 nt, Homo sapiens
cagaggcuucuccaaagggag

SEQ ID NO: 1325400 - RNA, 19 nt, Homo sapiens
cagagucaggcuguugcgc

SEQ ID NO: 1325401 - RNA, 15 nt, Homo sapiens
cagagucaugggaga

SEQ ID NO: 1325402 - RNA, 20 nt, Homo sapiens
cagagucucgcucuguugcc

SEQ ID NO: 1325403 - RNA, 20 nt, Homo sapiens
cagauagcaucagaccugca

SEQ ID NO: 1325404 - RNA, 19 nt, Homo sapiens
cagauauauuuaagccuua

SEQ ID NO: 1325405 - RNA, 22 nt, Homo sapiens
cagaucacuucaggucaggagu

SEQ ID NO: 1325406 - RNA, 12 nt, Homo sapiens
cagaucaugccc

SEQ ID NO: 1325407 - RNA, 16 nt, Homo sapiens
cagaugcaaugacuca

SEQ ID NO: 1325408 - RNA, 13 nt, Homo sapiens
cagaugcaguuug

SEQ ID NO: 1325409 - RNA, 19 nt, Homo sapiens
cagaugcauauagacacac

SEQ ID NO: 1325410 - RNA, 16 nt, Homo sapiens
cagauucuucacugug

SEQ ID NO: 1325411 - RNA, 18 nt, Homo sapiens
cagauucuucucucucaa

SEQ ID NO: 1325412 - RNA, 18 nt, Homo sapiens
cagauuuaagccuuacaa

SEQ ID NO: 1325413 - RNA, 18 nt, Homo sapiens
cagauuuuuuccucugca

SEQ ID NO: 1325414 - RNA, 19 nt, Homo sapiens
cagauuuuuuccucugcau

SEQ ID NO: 1325415 - RNA, 23 nt, Homo sapiens
cagcaaauguguguagauuucau

SEQ ID NO: 1325416 - RNA, 15 nt, Homo sapiens
cagcaacugaccuga

SEQ ID NO: 1325417 - RNA, 21 nt, Homo sapiens
cagcaccgauggccauguaaa

SEQ ID NO: 1325418 - RNA, 15 nt, Homo sapiens
cagcacucuuaucua

SEQ ID NO: 1325419 - RNA, 17 nt, Homo sapiens
cagcacuggugaacuga

SEQ ID NO: 1325420 - RNA, 20 nt, Homo sapiens
cagcacuggugaacugagcu

SEQ ID NO: 1325421 - RNA, 15 nt, Homo sapiens
cagcagaugcuguug

SEQ ID NO: 1325422 - RNA, 21 nt, Homo sapiens
cagcaggaaggaacaaagaca

SEQ ID NO: 1325423 - RNA, 24 nt, Homo sapiens
cagcaggccucugggacccacaga

SEQ ID NO: 1325424 - RNA, 13 nt, Homo sapiens
cagcaguuuccag

SEQ ID NO: 1325425 - RNA, 16 nt, Homo sapiens
cagcaguuuccagaga

SEQ ID NO: 1325426 - RNA, 19 nt, Homo sapiens
cagcauuuuagaaacuaca

SEQ ID NO: 1325427 - RNA, 14 nt, Homo sapiens
cagccagacuggca

SEQ ID NO: 1325428 - RNA, 20 nt, Homo sapiens
cagccagaggaggccgguga

SEQ ID NO: 1325429 - RNA, 13 nt, Homo sapiens
cagccagggccag

SEQ ID NO: 1325430 - RNA, 15 nt, Homo sapiens
cagccagggcucaau

SEQ ID NO: 1325431 - RNA, 16 nt, Homo sapiens
cagcccaggccaguca

SEQ ID NO: 1325432 - RNA, 13 nt, Homo sapiens
cagcccagugcaa

SEQ ID NO: 1325433 - RNA, 18 nt, Homo sapiens
cagcccauucccaaggga

SEQ ID NO: 1325434 - RNA, 18 nt, Homo sapiens
cagccccaacuccagggg

SEQ ID NO: 1325435 - RNA, 15 nt, Homo sapiens
cagcccugcaccaug

SEQ ID NO: 1325436 - RNA, 21 nt, Homo sapiens
cagcccugcaccaugcugcug

SEQ ID NO: 1325437 - RNA, 20 nt, Homo sapiens
cagcccuggcaaaugccuga

SEQ ID NO: 1325438 - RNA, 23 nt, Homo sapiens
cagccgccagcugggagcacugg

SEQ ID NO: 1325439 - RNA, 13 nt, Homo sapiens
cagccucaucucu

SEQ ID NO: 1325440 - RNA, 14 nt, Homo sapiens
gugacuccagggug

SEQ ID NO: 1325441 - RNA, 17 nt, Homo sapiens
gugacuugauugccaag

SEQ ID NO: 1325442 - RNA, 22 nt, Homo sapiens
gugacuugauugccaaggaaug

SEQ ID NO: 1325443 - RNA, 18 nt, Homo sapiens
gugagacuguaaguuaca

SEQ ID NO: 1325444 - RNA, 20 nt, Homo sapiens
gugagacuguaaguuacaug

SEQ ID NO: 1325445 - RNA, 23 nt, Homo sapiens
gugagacuguguuguacagcuag

SEQ ID NO: 1325446 - RNA, 22 nt, Homo sapiens
gugaggaugucugggccacuca

SEQ ID NO: 1325447 - RNA, 15 nt, Homo sapiens
gugaggcccauucuu

SEQ ID NO: 1325448 - RNA, 17 nt, Homo sapiens
gugaggcccauucuuca

SEQ ID NO: 1325449 - RNA, 20 nt, Homo sapiens
gugaguucuuucaucucccu

SEQ ID NO: 1325450 - RNA, 17 nt, Homo sapiens
gugaguuuccacugcau

SEQ ID NO: 1325451 - RNA, 12 nt, Homo sapiens
gugauacauuua

SEQ ID NO: 1325452 - RNA, 18 nt, Homo sapiens
gugauagagugcagugau

SEQ ID NO: 1325453 - RNA, 21 nt, Homo sapiens
gugauauuuucacacugguaa

SEQ ID NO: 1325454 - RNA, 18 nt, Homo sapiens
gugaucuugagaaccuuu

SEQ ID NO: 1325455 - RNA, 21 nt, Homo sapiens
gugauguguccugauaagcug

SEQ ID NO: 1325456 - RNA, 12 nt, Homo sapiens
gugauuccauca

SEQ ID NO: 1325457 - RNA, 17 nt, Homo sapiens
gugcaacuacuauucaa

SEQ ID NO: 1325458 - RNA, 23 nt, Homo sapiens
gugcaaucacagcucacugcagc

SEQ ID NO: 1325459 - RNA, 20 nt, Homo sapiens
gugcaccugccuccaccagc

SEQ ID NO: 1325460 - RNA, 22 nt, Homo sapiens
gugcagcuccucagcggcucca

SEQ ID NO: 1325461 - RNA, 21 nt, Homo sapiens
gugcaucacggauggugcaug

SEQ ID NO: 1325462 - RNA, 20 nt, Homo sapiens
gugcauccgggggcagcucu

SEQ ID NO: 1325463 - RNA, 15 nt, Homo sapiens
gugcaugcuaguguu

SEQ ID NO: 1325464 - RNA, 17 nt, Homo sapiens
gugccacuggaccucag

SEQ ID NO: 1325465 - RNA, 16 nt, Homo sapiens
gugccagcaccacagc

SEQ ID NO: 1325466 - RNA, 22 nt, Homo sapiens
gugcccauguguacauucugcc

SEQ ID NO: 1325467 - RNA, 20 nt, Homo sapiens
gugccccacaaaacuucagu

SEQ ID NO: 1325468 - RNA, 22 nt, Homo sapiens
gugccccaccacuccccaaccc

SEQ ID NO: 1325469 - RNA, 19 nt, Homo sapiens
gugcccuagaugcacgugg

SEQ ID NO: 1325470 - RNA, 17 nt, Homo sapiens
gugccgcuuucucugag

SEQ ID NO: 1325471 - RNA, 12 nt, Homo sapiens
gugcugcucucu

SEQ ID NO: 1325472 - RNA, 11 nt, Homo sapiens
gugcugggauu

SEQ ID NO: 1325473 - RNA, 22 nt, Homo sapiens
gugcugggauuauaggcaugag

SEQ ID NO: 1325474 - RNA, 13 nt, Homo sapiens
gugcuuaaccaaa

SEQ ID NO: 1325475 - RNA, 15 nt, Homo sapiens
gugcuuuuggcagag

SEQ ID NO: 1325476 - RNA, 19 nt, Homo sapiens
guggaaagucacaggucac

SEQ ID NO: 1325477 - RNA, 17 nt, Homo sapiens
guggaaauagaugugca

SEQ ID NO: 1325478 - RNA, 21 nt, Homo sapiens
guggacuacacagcuccugag

SEQ ID NO: 1325479 - RNA, 13 nt, Homo sapiens
guggaguuugaca

SEQ ID NO: 1325480 - RNA, 20 nt, Homo sapiens
guggauuaaagugcccagca

SEQ ID NO: 1325481 - RNA, 22 nt, Homo sapiens
guggauuguauuuaagacauaa

SEQ ID NO: 1325482 - RNA, 13 nt, Homo sapiens
guggccacagacu

SEQ ID NO: 1325483 - RNA, 22 nt, Homo sapiens
guggcguuguugcauguuugaa

SEQ ID NO: 1325484 - RNA, 13 nt, Homo sapiens
gugggcacuggug

SEQ ID NO: 1325485 - RNA, 21 nt, Homo sapiens
gugggcccccaaugacaccca

SEQ ID NO: 1325486 - RNA, 15 nt, Homo sapiens
guggggggacugccu

SEQ ID NO: 1325487 - RNA, 23 nt, Homo sapiens
gugggggugccgcugucucugag

SEQ ID NO: 1325488 - RNA, 19 nt, Homo sapiens
gugggucccagagaccuca

SEQ ID NO: 1325489 - RNA, 14 nt, Homo sapiens
guggguugcacugg

SEQ ID NO: 1325490 - RNA, 13 nt, Homo sapiens
gugguauggggcu

SEQ ID NO: 1325491 - RNA, 14 nt, Homo sapiens
guggugacaccucc

SEQ ID NO: 1325492 - RNA, 17 nt, Homo sapiens
guggugacaccuccccc

SEQ ID NO: 1325493 - RNA, 15 nt, Homo sapiens
guggugggcagguga

SEQ ID NO: 1325494 - RNA, 20 nt, Homo sapiens
guguaccucauggaugcuuu

SEQ ID NO: 1325495 - RNA, 19 nt, Homo sapiens
guguagauuucaugcucga

SEQ ID NO: 1325496 - RNA, 19 nt, Homo sapiens
guguaggaaaaaugcaagc

SEQ ID NO: 1325497 - RNA, 14 nt, Homo sapiens
guguauucauuuua

SEQ ID NO: 1325498 - RNA, 23 nt, Homo sapiens
guguccccugacagggccagugc

SEQ ID NO: 1325499 - RNA, 20 nt, Homo sapiens
gugucucccagaacuauucu

SEQ ID NO: 1325500 - RNA, 18 nt, Homo sapiens
gugucugucugaggugac

SEQ ID NO: 1325501 - RNA, 15 nt, Homo sapiens
gugugaagacccaaa

SEQ ID NO: 1325502 - RNA, 22 nt, Homo sapiens
gugugaucuuaauauauuugaa

SEQ ID NO: 1325503 - RNA, 10 nt, Homo sapiens
guguggcaaa

SEQ ID NO: 1325504 - RNA, 12 nt, Homo sapiens
guguguccaaaa

SEQ ID NO: 1325505 - RNA, 13 nt, Homo sapiens
guguguguguaug

SEQ ID NO: 1325506 - RNA, 18 nt, Homo sapiens
guguucacaacagugaaa

SEQ ID NO: 1325507 - RNA, 12 nt, Homo sapiens
guguuccagugu

SEQ ID NO: 1325508 - RNA, 14 nt, Homo sapiens
guguucuucauuac

SEQ ID NO: 1325509 - RNA, 19 nt, Homo sapiens
guguucuucauuaccucag

SEQ ID NO: 1325510 - RNA, 13 nt, Homo sapiens
guguuugucaugg

SEQ ID NO: 1325511 - RNA, 22 nt, Homo sapiens
guguuuucaucauuucagccaa

SEQ ID NO: 1325512 - RNA, 18 nt, Homo sapiens
guuaaaacauaaacacau

SEQ ID NO: 1325513 - RNA, 21 nt, Homo sapiens
guuaaauuaagcucuugcuaa

SEQ ID NO: 1325514 - RNA, 17 nt, Homo sapiens
guuaaauuuuacaugac

SEQ ID NO: 1325515 - RNA, 17 nt, Homo sapiens
guuaauauugugcaaac

SEQ ID NO: 1325516 - RNA, 11 nt, Homo sapiens
guuaaucugau

SEQ ID NO: 1325517 - RNA, 19 nt, Homo sapiens
guuacaugaaggcagcaga

SEQ ID NO: 1325518 - RNA, 19 nt, Homo sapiens
guuaccacagcaacugacc

SEQ ID NO: 1325519 - RNA, 17 nt, Homo sapiens
guuacucccuacacuga

SEQ ID NO: 1325520 - RNA, 24 nt, Homo sapiens
guuacuggcuucucuugagucaca

SEQ ID NO: 1325521 - RNA, 13 nt, Homo sapiens
guuacuuccuuau

SEQ ID NO: 1325522 - RNA, 13 nt, Homo sapiens
guuacuugggagg

SEQ ID NO: 1325523 - RNA, 14 nt, Homo sapiens
guuaugacuaugua

SEQ ID NO: 1325524 - RNA, 23 nt, Homo sapiens
guuauugguguaagguacuuuca

SEQ ID NO: 1325525 - RNA, 15 nt, Homo sapiens
guucaaaaacaagac

SEQ ID NO: 1325526 - RNA, 20 nt, Homo sapiens
guucaaaaccuugcacaggu

SEQ ID NO: 1325527 - RNA, 14 nt, Homo sapiens
guucaacuacaugu

SEQ ID NO: 1325528 - RNA, 23 nt, Homo sapiens
guucaagcaauccuccuaccuca

SEQ ID NO: 1325529 - RNA, 13 nt, Homo sapiens
guucaaguauuaa

SEQ ID NO: 1325530 - RNA, 23 nt, Homo sapiens
guucaaguuugcugcaacccaag

SEQ ID NO: 1325531 - RNA, 15 nt, Homo sapiens
guucacaacagugaa

SEQ ID NO: 1325532 - RNA, 17 nt, Homo sapiens
guucacucuacuuagca

SEQ ID NO: 1325533 - RNA, 15 nt, Homo sapiens
guucauggauuuucc

SEQ ID NO: 1325534 - RNA, 16 nt, Homo sapiens
guuccacagaggacac

SEQ ID NO: 1325535 - RNA, 14 nt, Homo sapiens
guuccaguacuaug

SEQ ID NO: 1325536 - RNA, 22 nt, Homo sapiens
guuccaguuugaagaccaauca

SEQ ID NO: 1325537 - RNA, 15 nt, Homo sapiens
guucccccagcaagc

SEQ ID NO: 1325538 - RNA, 15 nt, Homo sapiens
guucccccuguuuca

SEQ ID NO: 1325539 - RNA, 15 nt, Homo sapiens
guuccugauaaacag

SEQ ID NO: 1325540 - RNA, 12 nt, Homo sapiens
guuccuggugac

SEQ ID NO: 1325541 - RNA, 13 nt, Homo sapiens
guucgacaaaagc

SEQ ID NO: 1325542 - RNA, 19 nt, Homo sapiens
guucgauguuagcguuuac

SEQ ID NO: 1325543 - RNA, 22 nt, Homo sapiens
guucucaaauauuugcuaugaa

SEQ ID NO: 1325544 - RNA, 11 nt, Homo sapiens
guucucaggcc

SEQ ID NO: 1325545 - RNA, 13 nt, Homo sapiens
guucucugccuca

SEQ ID NO: 1325546 - RNA, 21 nt, Homo sapiens
guucucuucuuuaaagggaug

SEQ ID NO: 1325547 - RNA, 14 nt, Homo sapiens
guucugaggccaga

SEQ ID NO: 1325548 - RNA, 22 nt, Homo sapiens
guucugucugggcucagacauc

SEQ ID NO: 1325549 - RNA, 14 nt, Homo sapiens
guucuuacacauuc

SEQ ID NO: 1325550 - RNA, 19 nt, Homo sapiens
guucuuacacauuccaucu

SEQ ID NO: 1325551 - RNA, 16 nt, Homo sapiens
guucuucauuaccuca

SEQ ID NO: 1325552 - RNA, 19 nt, Homo sapiens
guugacuuauaguacauga

SEQ ID NO: 1325553 - RNA, 14 nt, Homo sapiens
guugaggugcaagg

SEQ ID NO: 1325554 - RNA, 16 nt, Homo sapiens
guugaguguguggucu

SEQ ID NO: 1325555 - RNA, 22 nt, Homo sapiens
guugaucuggaacccagacuca

SEQ ID NO: 1325556 - RNA, 16 nt, Homo sapiens
guugcagccgcagaga

SEQ ID NO: 1325557 - RNA, 14 nt, Homo sapiens
guugccuauaacag

SEQ ID NO: 1325558 - RNA, 16 nt, Homo sapiens
guugcuuuuacuucuc

SEQ ID NO: 1325559 - RNA, 14 nt, Homo sapiens
guugggaacagaaa

SEQ ID NO: 1325560 - RNA, 21 nt, Homo sapiens
guuggucugccuucugcugaa

SEQ ID NO: 1325561 - RNA, 20 nt, Homo sapiens
guugucacaucucagggaac

SEQ ID NO: 1325562 - RNA, 14 nt, Homo sapiens
guuguuauuauuca

SEQ ID NO: 1325563 - RNA, 21 nt, Homo sapiens
guuguucaaauguuccuuuua

SEQ ID NO: 1325564 - RNA, 16 nt, Homo sapiens
guuuaaaaaucuuaau

SEQ ID NO: 1325565 - RNA, 19 nt, Homo sapiens
guuuaaaguggcaaucuca

SEQ ID NO: 1325566 - RNA, 20 nt, Homo sapiens
guuuaaauucuaguguccau

SEQ ID NO: 1325567 - RNA, 20 nt, Homo sapiens
guuuaagaguaacaguuuga

SEQ ID NO: 1325568 - RNA, 21 nt, Homo sapiens
guuuaagccgcagaccuggag

SEQ ID NO: 1325569 - RNA, 13 nt, Homo sapiens
guuuaauguuaau

SEQ ID NO: 1325570 - RNA, 20 nt, Homo sapiens
guuuauccaaaucuugaauu

SEQ ID NO: 1325571 - RNA, 16 nt, Homo sapiens
guuuaugcugugcuaa

SEQ ID NO: 1325572 - RNA, 18 nt, Homo sapiens
guuuauuauaaacuguau

SEQ ID NO: 1325573 - RNA, 16 nt, Homo sapiens
guuuauugauauucaa

SEQ ID NO: 1325574 - RNA, 19 nt, Homo sapiens
guuucaccauguuggccag

SEQ ID NO: 1325575 - RNA, 22 nt, Homo sapiens
uaacucagucuuuaaucugaga

SEQ ID NO: 1325576 - RNA, 14 nt, Homo sapiens
uaacugaguuauau

SEQ ID NO: 1325577 - RNA, 13 nt, Homo sapiens
uaacugugcugua

SEQ ID NO: 1325578 - RNA, 12 nt, Homo sapiens
uaacuguucaaa

SEQ ID NO: 1325579 - RNA, 18 nt, Homo sapiens
uaacuugagauucaagac

SEQ ID NO: 1325580 - RNA, 15 nt, Homo sapiens
uaacuuggcugcauu

SEQ ID NO: 1325581 - RNA, 20 nt, Homo sapiens
uaacuuuuuuuucucucuuu

SEQ ID NO: 1325582 - RNA, 16 nt, Homo sapiens
uaagaagaaggccaga

SEQ ID NO: 1325583 - RNA, 13 nt, Homo sapiens
uaagaagggaaaa

SEQ ID NO: 1325584 - RNA, 13 nt, Homo sapiens
uaagaaguaagca

SEQ ID NO: 1325585 - RNA, 17 nt, Homo sapiens
uaagaauaguucuaaaa

SEQ ID NO: 1325586 - RNA, 15 nt, Homo sapiens
uaagacacucaaaua

SEQ ID NO: 1325587 - RNA, 19 nt, Homo sapiens
uaagacauaaacaaagaca

SEQ ID NO: 1325588 - RNA, 14 nt, Homo sapiens
uaagcaucugccau

SEQ ID NO: 1325589 - RNA, 23 nt, Homo sapiens
uaagccaaagaaacaagcugugc

SEQ ID NO: 1325590 - RNA, 21 nt, Homo sapiens
uaagcccccacuacaagugau

SEQ ID NO: 1325591 - RNA, 14 nt, Homo sapiens
uaagcccucaggag

SEQ ID NO: 1325592 - RNA, 20 nt, Homo sapiens
uaagcugagcuccuuagccu

SEQ ID NO: 1325593 - RNA, 21 nt, Homo sapiens
uagaaacugaggcccagagag

SEQ ID NO: 1325594 - RNA, 20 nt, Homo sapiens
uagaaagcuggcaacaugaa

SEQ ID NO: 1325595 - RNA, 12 nt, Homo sapiens
uagaacauucca

SEQ ID NO: 1325596 - RNA, 16 nt, Homo sapiens
uagaaccguagguuuu

SEQ ID NO: 1325597 - RNA, 18 nt, Homo sapiens
uagaagaugcaguucaaa

SEQ ID NO: 1325598 - RNA, 22 nt, Homo sapiens
uagaagcaacuaggaaaaucac

SEQ ID NO: 1325599 - RNA, 22 nt, Homo sapiens
uagaaguuaaugauuuuacuua

SEQ ID NO: 1325600 - RNA, 14 nt, Homo sapiens
uagaaguuacuuaa

SEQ ID NO: 1325601 - RNA, 18 nt, Homo sapiens
uagaaguuccuagugaug

SEQ ID NO: 1325602 - RNA, 13 nt, Homo sapiens
uagaauacauuaa

SEQ ID NO: 1325603 - RNA, 11 nt, Homo sapiens
uagaauaccac

SEQ ID NO: 1325604 - RNA, 19 nt, Homo sapiens
uagaauacccuaaaguaua

SEQ ID NO: 1325605 - RNA, 13 nt, Homo sapiens
uagacugugccag

SEQ ID NO: 1325606 - RNA, 15 nt, Homo sapiens
uagacuuaaaucuca

SEQ ID NO: 1325607 - RNA, 12 nt, Homo sapiens
uagagaaaaccu

SEQ ID NO: 1325608 - RNA, 22 nt, Homo sapiens
uagagccagcuguccugucagu

SEQ ID NO: 1325609 - RNA, 16 nt, Homo sapiens
uagaggagaaccugga

SEQ ID NO: 1325610 - RNA, 16 nt, Homo sapiens
uagaggcugaggaauc

SEQ ID NO: 1325611 - RNA, 17 nt, Homo sapiens
uagaguuucuguuugau

SEQ ID NO: 1325612 - RNA, 12 nt, Homo sapiens
uagauaugaaga

SEQ ID NO: 1325613 - RNA, 13 nt, Homo sapiens
uagauauggaaaa

SEQ ID NO: 1325614 - RNA, 16 nt, Homo sapiens
uagaucaucagucacc

SEQ ID NO: 1325615 - RNA, 14 nt, Homo sapiens
uagaugaaugucag

SEQ ID NO: 1325616 - RNA, 22 nt, Homo sapiens
uagaugacaaccuccauucuau

SEQ ID NO: 1325617 - RNA, 18 nt, Homo sapiens
uagauguggccuuugaau

SEQ ID NO: 1325618 - RNA, 21 nt, Homo sapiens
uagauugcaccauugcacucu

SEQ ID NO: 1325619 - RNA, 15 nt, Homo sapiens
uagauuuaagugaau

SEQ ID NO: 1325620 - RNA, 14 nt, Homo sapiens
uagcaaaacuggac

SEQ ID NO: 1325621 - RNA, 11 nt, Homo sapiens
uagcaaagagg

SEQ ID NO: 1325622 - RNA, 21 nt, Homo sapiens
uagcaaauggcagaaccaaag

SEQ ID NO: 1325623 - RNA, 20 nt, Homo sapiens
uagcaaggcugugcaucuag

SEQ ID NO: 1325624 - RNA, 16 nt, Homo sapiens
uagcaauaacauacau

SEQ ID NO: 1325625 - RNA, 19 nt, Homo sapiens
uagcagagaacugccuuaa

SEQ ID NO: 1325626 - RNA, 20 nt, Homo sapiens
uagcagccuguacuagcuuu

SEQ ID NO: 1325627 - RNA, 18 nt, Homo sapiens
uagcagguaguuagcuuc

SEQ ID NO: 1325628 - RNA, 13 nt, Homo sapiens
uagcagucacuga

SEQ ID NO: 1325629 - RNA, 19 nt, Homo sapiens
uagcaguuuccucagugau

SEQ ID NO: 1325630 - RNA, 19 nt, Homo sapiens
uagcaucagaccugcauug

SEQ ID NO: 1325631 - RNA, 19 nt, Homo sapiens
uagcauuucccaacacaaa

SEQ ID NO: 1325632 - RNA, 18 nt, Homo sapiens
uagccagcugugcacuuu

SEQ ID NO: 1325633 - RNA, 12 nt, Homo sapiens
uagcccaaccua

SEQ ID NO: 1325634 - RNA, 16 nt, Homo sapiens
uagcccucaccacagc

SEQ ID NO: 1325635 - RNA, 20 nt, Homo sapiens
uagcccugcuccaacuccau

SEQ ID NO: 1325636 - RNA, 18 nt, Homo sapiens
uagccugggcucacugug

SEQ ID NO: 1325637 - RNA, 20 nt, Homo sapiens
uagcuaauaacaugugaaaa

SEQ ID NO: 1325638 - RNA, 22 nt, Homo sapiens
uagcuauuuuuauacacuguaa

SEQ ID NO: 1325639 - RNA, 13 nt, Homo sapiens
uagcucauugcaa

SEQ ID NO: 1325640 - RNA, 15 nt, Homo sapiens
uagcuccacuggaga

SEQ ID NO: 1325641 - RNA, 16 nt, Homo sapiens
uagcucugcugcugau

SEQ ID NO: 1325642 - RNA, 15 nt, Homo sapiens
uagcugucugcucag

SEQ ID NO: 1325643 - RNA, 17 nt, Homo sapiens
uagcuuaccugggcaca

SEQ ID NO: 1325644 - RNA, 14 nt, Homo sapiens
uagcuuuaguccuu

SEQ ID NO: 1325645 - RNA, 23 nt, Homo sapiens
uaggaagugcccucgagcacuga

SEQ ID NO: 1325646 - RNA, 16 nt, Homo sapiens
uaggaaucaaauaucc

SEQ ID NO: 1325647 - RNA, 20 nt, Homo sapiens
uaggagccgacucuuugaua

SEQ ID NO: 1325648 - RNA, 12 nt, Homo sapiens
uaggaucuccac

SEQ ID NO: 1325649 - RNA, 18 nt, Homo sapiens
uaggcacaaauacauucc

SEQ ID NO: 1325650 - RNA, 15 nt, Homo sapiens
uaggcauacuuuuca

SEQ ID NO: 1325651 - RNA, 16 nt, Homo sapiens
uaggcauacuuuucaa

SEQ ID NO: 1325652 - RNA, 17 nt, Homo sapiens
uaggcauuuuaaguaaa

SEQ ID NO: 1325653 - RNA, 17 nt, Homo sapiens
uaggccuuuccucugca

SEQ ID NO: 1325654 - RNA, 18 nt, Homo sapiens
uaggcuaagucagcugaa

SEQ ID NO: 1325655 - RNA, 21 nt, Homo sapiens
uaggcucuuaugugugccuuu

SEQ ID NO: 1325656 - RNA, 14 nt, Homo sapiens
uagggaagcucagg

SEQ ID NO: 1325657 - RNA, 20 nt, Homo sapiens
uagggugcugcgcagcaucc

SEQ ID NO: 1325658 - RNA, 19 nt, Homo sapiens
uaggucuuucucucaguga

SEQ ID NO: 1325659 - RNA, 20 nt, Homo sapiens
uaggugggggaacacugaga

SEQ ID NO: 1325660 - RNA, 22 nt, Homo sapiens
uaggugggggaacacugagaaa

SEQ ID NO: 1325661 - RNA, 13 nt, Homo sapiens
uaguaaauccaug

SEQ ID NO: 1325662 - RNA, 18 nt, Homo sapiens
uaguaaauccaugguguu

SEQ ID NO: 1325663 - RNA, 16 nt, Homo sapiens
uagucaaggaaccuca

SEQ ID NO: 1325664 - RNA, 14 nt, Homo sapiens
uagucaccagagac

SEQ ID NO: 1325665 - RNA, 15 nt, Homo sapiens
uaguccuuccuggca

SEQ ID NO: 1325666 - RNA, 16 nt, Homo sapiens
uagucucuacccagua

SEQ ID NO: 1325667 - RNA, 15 nt, Homo sapiens
uagugaugaaccaga

SEQ ID NO: 1325668 - RNA, 22 nt, Homo sapiens
uagugcugaugccuguguacug

SEQ ID NO: 1325669 - RNA, 16 nt, Homo sapiens
uaguggaagcuucuaa

SEQ ID NO: 1325670 - RNA, 14 nt, Homo sapiens
uaguguuauacuug

SEQ ID NO: 1325671 - RNA, 16 nt, Homo sapiens
uaguuauaaaccaaug

SEQ ID NO: 1325672 - RNA, 19 nt, Homo sapiens
uaguucaauccugauucau

SEQ ID NO: 1325673 - RNA, 19 nt, Homo sapiens
uaguucagguccaaauuca

SEQ ID NO: 1325674 - RNA, 20 nt, Homo sapiens
uaguucuccccgauggggca

SEQ ID NO: 1325675 - RNA, 15 nt, Homo sapiens
uaguugacaguauua

SEQ ID NO: 1325676 - RNA, 12 nt, Homo sapiens
uaguugccaauc

SEQ ID NO: 1325677 - RNA, 15 nt, Homo sapiens
uaguuuaggcuggaa

SEQ ID NO: 1325678 - RNA, 16 nt, Homo sapiens
uaguuucauuuccuug

SEQ ID NO: 1325679 - RNA, 14 nt, Homo sapiens
uaguuuuucacuuu

SEQ ID NO: 1325680 - RNA, 21 nt, Homo sapiens
uaguuuuuucuuccuuuucac

SEQ ID NO: 1325681 - RNA, 14 nt, Homo sapiens
uauaaaaaacacua

SEQ ID NO: 1325682 - RNA, 15 nt, Homo sapiens
uauaaaauuaaucac

SEQ ID NO: 1325683 - RNA, 22 nt, Homo sapiens
uauaaagcauguggucuuauag

SEQ ID NO: 1325684 - RNA, 19 nt, Homo sapiens
uauaaauaaauaccaaaaa

SEQ ID NO: 1325685 - RNA, 14 nt, Homo sapiens
uauaaauguaaaaa

SEQ ID NO: 1325686 - RNA, 20 nt, Homo sapiens
uauaacaauucaguaacaaa

SEQ ID NO: 1325687 - RNA, 14 nt, Homo sapiens
uauaacgucaugug

SEQ ID NO: 1325688 - RNA, 13 nt, Homo sapiens
uauaacuguuguc

SEQ ID NO: 1325689 - RNA, 14 nt, Homo sapiens
uauaacuuacuuau

SEQ ID NO: 1325690 - RNA, 21 nt, Homo sapiens
uauaacuuaggccuagccucu

SEQ ID NO: 1325691 - RNA, 20 nt, Homo sapiens
uauaaggaauaaagccuuuu

SEQ ID NO: 1325692 - RNA, 21 nt, Homo sapiens
uauaauaguagauuugaacag

SEQ ID NO: 1325693 - RNA, 16 nt, Homo sapiens
uauaauuaauugucau

SEQ ID NO: 1325694 - RNA, 17 nt, Homo sapiens
uauacaccagcaauuua

SEQ ID NO: 1325695 - RNA, 15 nt, Homo sapiens
uauacaccauauacu

SEQ ID NO: 1325696 - RNA, 23 nt, Homo sapiens
uauacacuuacacuuuaugcaca

SEQ ID NO: 1325697 - RNA, 19 nt, Homo sapiens
uauacagaaagauugguaa

SEQ ID NO: 1325698 - RNA, 12 nt, Homo sapiens
uauacagaggaa

SEQ ID NO: 1325699 - RNA, 17 nt, Homo sapiens
uauagacauucucacau

SEQ ID NO: 1325700 - RNA, 21 nt, Homo sapiens
uauaggaacugagguuuacau

SEQ ID NO: 1325701 - RNA, 13 nt, Homo sapiens
uggguaccuguau

SEQ ID NO: 1325702 - RNA, 15 nt, Homo sapiens
uggguacuucuugaa

SEQ ID NO: 1325703 - RNA, 16 nt, Homo sapiens
ugggucccauucuugg

SEQ ID NO: 1325704 - RNA, 16 nt, Homo sapiens
uggguccuuggcuccc

SEQ ID NO: 1325705 - RNA, 19 nt, Homo sapiens
ugggugaucugcugcugag

SEQ ID NO: 1325706 - RNA, 18 nt, Homo sapiens
ugggugcagaagcugugg

SEQ ID NO: 1325707 - RNA, 10 nt, Homo sapiens
ugggugcugc

SEQ ID NO: 1325708 - RNA, 14 nt, Homo sapiens
uggguguacauuuu

SEQ ID NO: 1325709 - RNA, 21 nt, Homo sapiens
uggguuuucuccauucaggau

SEQ ID NO: 1325710 - RNA, 21 nt, Homo sapiens
ugguaaaaguauuugcuuaaa

SEQ ID NO: 1325711 - RNA, 13 nt, Homo sapiens
ugguaaagcacau

SEQ ID NO: 1325712 - RNA, 14 nt, Homo sapiens
ugguaaagcacaug

SEQ ID NO: 1325713 - RNA, 15 nt, Homo sapiens
ugguaacuugagauu

SEQ ID NO: 1325714 - RNA, 16 nt, Homo sapiens
ugguauuuucagagaa

SEQ ID NO: 1325715 - RNA, 14 nt, Homo sapiens
uggucagauuugaa

SEQ ID NO: 1325716 - RNA, 18 nt, Homo sapiens
uggucaggcuggucucaa

SEQ ID NO: 1325717 - RNA, 14 nt, Homo sapiens
uggucaugugaguc

SEQ ID NO: 1325718 - RNA, 14 nt, Homo sapiens
ugguccuugaacaa

SEQ ID NO: 1325719 - RNA, 21 nt, Homo sapiens
uggucgccaauccaugcucuc

SEQ ID NO: 1325720 - RNA, 23 nt, Homo sapiens
uggucucaaacccccagccucaa

SEQ ID NO: 1325721 - RNA, 18 nt, Homo sapiens
uggucugggcaccaccuc

SEQ ID NO: 1325722 - RNA, 17 nt, Homo sapiens
uggucuucgcagccuag

SEQ ID NO: 1325723 - RNA, 19 nt, Homo sapiens
uggucuucgcagccuagau

SEQ ID NO: 1325724 - RNA, 21 nt, Homo sapiens
uggugaaguaaauuaggcagu

SEQ ID NO: 1325725 - RNA, 21 nt, Homo sapiens
uggugacauugcaccuggaug

SEQ ID NO: 1325726 - RNA, 19 nt, Homo sapiens
uggugccccaggaccagcu

SEQ ID NO: 1325727 - RNA, 22 nt, Homo sapiens
uggugccccaggaccagcucag

SEQ ID NO: 1325728 - RNA, 22 nt, Homo sapiens
uggugcguuuauaauuggcuua

SEQ ID NO: 1325729 - RNA, 18 nt, Homo sapiens
ugguggcauuguuuacag

SEQ ID NO: 1325730 - RNA, 13 nt, Homo sapiens
uggugugcuguau

SEQ ID NO: 1325731 - RNA, 22 nt, Homo sapiens
ugguguuuagaaugucaguuga

SEQ ID NO: 1325732 - RNA, 23 nt, Homo sapiens
ugguuuaagaguaacaguuugau

SEQ ID NO: 1325733 - RNA, 15 nt, Homo sapiens
uguaaaaagugcagu

SEQ ID NO: 1325734 - RNA, 16 nt, Homo sapiens
uguaaaaagugcagua

SEQ ID NO: 1325735 - RNA, 14 nt, Homo sapiens
uguaaaagcacaug

SEQ ID NO: 1325736 - RNA, 15 nt, Homo sapiens
uguaaaauguauauu

SEQ ID NO: 1325737 - RNA, 22 nt, Homo sapiens
uguaaaguugccuuuauuugcu

SEQ ID NO: 1325738 - RNA, 13 nt, Homo sapiens
uguaaaugugcuu

SEQ ID NO: 1325739 - RNA, 16 nt, Homo sapiens
uguaaauuuaugugau

SEQ ID NO: 1325740 - RNA, 22 nt, Homo sapiens
uguaacaggguagugugguauu

SEQ ID NO: 1325741 - RNA, 21 nt, Homo sapiens
uguaacugagagaaagauucu

SEQ ID NO: 1325742 - RNA, 17 nt, Homo sapiens
uguaacuuaacuauuaa

SEQ ID NO: 1325743 - RNA, 22 nt, Homo sapiens
uguaagaaauacagacuggaug

SEQ ID NO: 1325744 - RNA, 22 nt, Homo sapiens
uguaagcaggagagaaauuucu

SEQ ID NO: 1325745 - RNA, 19 nt, Homo sapiens
uguaagggcagugcccaug

SEQ ID NO: 1325746 - RNA, 13 nt, Homo sapiens
uguaauaaacucu

SEQ ID NO: 1325747 - RNA, 15 nt, Homo sapiens
uguaauaaacucucu

SEQ ID NO: 1325748 - RNA, 19 nt, Homo sapiens
uguaauaaacucucuaggg

SEQ ID NO: 1325749 - RNA, 16 nt, Homo sapiens
uguaauccuagcacuu

SEQ ID NO: 1325750 - RNA, 12 nt, Homo sapiens
uguaaugcugca

SEQ ID NO: 1325751 - RNA, 12 nt, Homo sapiens
uguacaauguga

SEQ ID NO: 1325752 - RNA, 19 nt, Homo sapiens
uguacacagaauuguucca

SEQ ID NO: 1325753 - RNA, 14 nt, Homo sapiens
uguaccauaugauc

SEQ ID NO: 1325754 - RNA, 14 nt, Homo sapiens
uguacugccuuagu

SEQ ID NO: 1325755 - RNA, 16 nt, Homo sapiens
uguacugccuuagugc

SEQ ID NO: 1325756 - RNA, 15 nt, Homo sapiens
uguagaaugauuuca

SEQ ID NO: 1325757 - RNA, 20 nt, Homo sapiens
uguagaaugauuucaugcua

SEQ ID NO: 1325758 - RNA, 15 nt, Homo sapiens
uguagacugugccag

SEQ ID NO: 1325759 - RNA, 16 nt, Homo sapiens
uguagagcuucuggca

SEQ ID NO: 1325760 - RNA, 22 nt, Homo sapiens
uguagcaaagcacauagagcca

SEQ ID NO: 1325761 - RNA, 15 nt, Homo sapiens
uguagcagucacuga

SEQ ID NO: 1325762 - RNA, 22 nt, Homo sapiens
uguaggucauugcaccuaucuc

SEQ ID NO: 1325763 - RNA, 13 nt, Homo sapiens
uguaguuacucaa

SEQ ID NO: 1325764 - RNA, 13 nt, Homo sapiens
uguauagaacugg

SEQ ID NO: 1325765 - RNA, 20 nt, Homo sapiens
uguauagguuuuaaagaccu

SEQ ID NO: 1325766 - RNA, 13 nt, Homo sapiens
uguauccacuuuc

SEQ ID NO: 1325767 - RNA, 19 nt, Homo sapiens
uguauccauccauggggcu

SEQ ID NO: 1325768 - RNA, 16 nt, Homo sapiens
uguauuuaagacauaa

SEQ ID NO: 1325769 - RNA, 17 nt, Homo sapiens
uucagaagguugcucua

SEQ ID NO: 1325770 - RNA, 24 nt, Homo sapiens
uucagaaguaauuugaauagccug

SEQ ID NO: 1325771 - RNA, 23 nt, Homo sapiens
uucagaccccaaaggagucagag

SEQ ID NO: 1325772 - RNA, 14 nt, Homo sapiens
uucagauuugccuu

SEQ ID NO: 1325773 - RNA, 14 nt, Homo sapiens
uucagccuuucuaa

SEQ ID NO: 1325774 - RNA, 16 nt, Homo sapiens
uucagcucuguuuuac

SEQ ID NO: 1325775 - RNA, 20 nt, Homo sapiens
uucaggugcuagaagccuac

SEQ ID NO: 1325776 - RNA, 17 nt, Homo sapiens
uucaguaauguugacug

SEQ ID NO: 1325777 - RNA, 16 nt, Homo sapiens
uucaguucuuacacau

SEQ ID NO: 1325778 - RNA, 13 nt, Homo sapiens
uucauacaacaga

SEQ ID NO: 1325779 - RNA, 18 nt, Homo sapiens
uucauauuuuaaacagag

SEQ ID NO: 1325780 - RNA, 22 nt, Homo sapiens
uucauggugcacugagcugcaa

SEQ ID NO: 1325781 - RNA, 15 nt, Homo sapiens
uucauguccagugag

SEQ ID NO: 1325782 - RNA, 19 nt, Homo sapiens
uucauguuaguuaccuuau

SEQ ID NO: 1325783 - RNA, 13 nt, Homo sapiens
uucauucacauuc

SEQ ID NO: 1325784 - RNA, 15 nt, Homo sapiens
uucauucacuuuaau

SEQ ID NO: 1325785 - RNA, 15 nt, Homo sapiens
uucauuccauugacu

SEQ ID NO: 1325786 - RNA, 20 nt, Homo sapiens
uucauucuuuacugcacuca

SEQ ID NO: 1325787 - RNA, 18 nt, Homo sapiens
uucauuuagucaugugac

SEQ ID NO: 1325788 - RNA, 14 nt, Homo sapiens
uucauuucauuuca

SEQ ID NO: 1325789 - RNA, 17 nt, Homo sapiens
uucauuuuagacauuca

SEQ ID NO: 1325790 - RNA, 21 nt, Homo sapiens
uuccaaagcuuuauuaccagu

SEQ ID NO: 1325791 - RNA, 15 nt, Homo sapiens
uuccacagaggacac

SEQ ID NO: 1325792 - RNA, 11 nt, Homo sapiens
uuccacugaaa

SEQ ID NO: 1325793 - RNA, 13 nt, Homo sapiens
uuccacugaaaau

SEQ ID NO: 1325794 - RNA, 23 nt, Homo sapiens
uuccacuuagaaauugcauuucc

SEQ ID NO: 1325795 - RNA, 17 nt, Homo sapiens
uuccacuugagugucaa

SEQ ID NO: 1325796 - RNA, 16 nt, Homo sapiens
uuccagccuaucuaau

SEQ ID NO: 1325797 - RNA, 22 nt, Homo sapiens
uuccagccuucuacugcucucc

SEQ ID NO: 1325798 - RNA, 14 nt, Homo sapiens
uuccagugucuguc

SEQ ID NO: 1325799 - RNA, 22 nt, Homo sapiens
uuccauaagcuuggugacaaaa

SEQ ID NO: 1325800 - RNA, 19 nt, Homo sapiens
uuccaucuguuugauacag

SEQ ID NO: 1325801 - RNA, 17 nt, Homo sapiens
uucccaaaucccucuca

SEQ ID NO: 1325802 - RNA, 15 nt, Homo sapiens
uucccacagugccua

SEQ ID NO: 1325803 - RNA, 20 nt, Homo sapiens
uucccaccugcuggagugaa

SEQ ID NO: 1325804 - RNA, 17 nt, Homo sapiens
uucccagcuacaccuuu

SEQ ID NO: 1325805 - RNA, 21 nt, Homo sapiens
uucccaggccagcaagcucuu

SEQ ID NO: 1325806 - RNA, 12 nt, Homo sapiens
uuccccagagaa

SEQ ID NO: 1325807 - RNA, 14 nt, Homo sapiens
uucccccuccccca

SEQ ID NO: 1325808 - RNA, 15 nt, Homo sapiens
uuccccuccuuggcu

SEQ ID NO: 1325809 - RNA, 23 nt, Homo sapiens
uuccccuccuuggcuuuaugcaa

SEQ ID NO: 1325810 - RNA, 19 nt, Homo sapiens
uucccuuuuguauucucuu

SEQ ID NO: 1325811 - RNA, 18 nt, Homo sapiens
uuccgcuuugaaagaagc

SEQ ID NO: 1325812 - RNA, 19 nt, Homo sapiens
uuccggggagaaacccaga

SEQ ID NO: 1325813 - RNA, 14 nt, Homo sapiens
uuccggguucaagu

SEQ ID NO: 1325814 - RNA, 17 nt, Homo sapiens
uuccggguucaagugac

SEQ ID NO: 1325815 - RNA, 12 nt, Homo sapiens
uuccuaggucau

SEQ ID NO: 1325816 - RNA, 12 nt, Homo sapiens
uuccucacauuu

SEQ ID NO: 1325817 - RNA, 18 nt, Homo sapiens
uuccuccuuuaccuuuca

SEQ ID NO: 1325818 - RNA, 22 nt, Homo sapiens
uuccugcuggccccuucugggg

SEQ ID NO: 1325819 - RNA, 11 nt, Homo sapiens
uuccuggugac

SEQ ID NO: 1325820 - RNA, 18 nt, Homo sapiens
uuccuugacuucuuugag

SEQ ID NO: 1325821 - RNA, 14 nt, Homo sapiens
uuccuuucuugauu

SEQ ID NO: 1325822 - RNA, 20 nt, Homo sapiens
uuccuuuuaaaacacuucca

SEQ ID NO: 1325823 - RNA, 16 nt, Homo sapiens
uucgcagccuagauau

SEQ ID NO: 1325824 - RNA, 21 nt, Homo sapiens
uucuaaagacuuguauagcau

SEQ ID NO: 1325825 - RNA, 23 nt, Homo sapiens
uucuaaagauggaaaaaccaccc

SEQ ID NO: 1325826 - RNA, 16 nt, Homo sapiens
uucuaauacaagcaua

SEQ ID NO: 1325827 - RNA, 18 nt, Homo sapiens
uucuaaugcugauaugau

SEQ ID NO: 1325828 - RNA, 13 nt, Homo sapiens
uucuaccaagcaa

SEQ ID NO: 1325829 - RNA, 16 nt, Homo sapiens
uucuacuaugaucaga

SEQ ID NO: 1325830 - RNA, 18 nt, Homo sapiens
uucuagcucucacagaca

SEQ ID NO: 1325831 - RNA, 16 nt, Homo sapiens
uucuauauuccuccag

SEQ ID NO: 1325832 - RNA, 19 nt, Homo sapiens
uucuauguauuagugucaa

SEQ ID NO: 1325833 - RNA, 16 nt, Homo sapiens
uucuauuuucuauaau

SEQ ID NO: 1325834 - RNA, 17 nt, Homo sapiens
uucucauuuagcauuga

SEQ ID NO: 1325835 - RNA, 21 nt, Homo sapiens
uucucauuuagcauugaaaua

SEQ ID NO: 1325836 - RNA, 20 nt, Homo sapiens
uucucauuucgggugaaucu

SEQ ID NO: 1325837 - RNA, 14 nt, Homo sapiens
uucuccaaagggag

SEQ ID NO: 1325838 - RNA, 16 nt, Homo sapiens
uucucguuuucacagg

SEQ ID NO: 1325839 - RNA, 14 nt, Homo sapiens
uucucugguaauau

SEQ ID NO: 1325840 - RNA, 19 nt, Homo sapiens
uucucugguaauauugacu

SEQ ID NO: 1325841 - RNA, 20 nt, Homo sapiens
uucucuugccauuuguagcu

SEQ ID NO: 1325842 - RNA, 16 nt, Homo sapiens
uucugaaguguuucac

SEQ ID NO: 1325843 - RNA, 16 nt, Homo sapiens
cugaaacaacuuggaa

SEQ ID NO: 1325844 - RNA, 17 nt, Homo sapiens
cugaaagccacagacaa

SEQ ID NO: 1325845 - RNA, 13 nt, Homo sapiens
cugaaauuuaccu

SEQ ID NO: 1325846 - RNA, 17 nt, Homo sapiens
cugaacuuuguggucga

SEQ ID NO: 1325847 - RNA, 19 nt, Homo sapiens
cugaagaggaaaagucaaa

SEQ ID NO: 1325848 - RNA, 19 nt, Homo sapiens
cugaaggcugaaagacagg

SEQ ID NO: 1325849 - RNA, 17 nt, Homo sapiens
cugaaggggaggucaca

SEQ ID NO: 1325850 - RNA, 20 nt, Homo sapiens
cugaaggggaggucacagcc

SEQ ID NO: 1325851 - RNA, 16 nt, Homo sapiens
cugaagggugccuagu

SEQ ID NO: 1325852 - RNA, 22 nt, Homo sapiens
cugaagucuucuccuccaugaa

SEQ ID NO: 1325853 - RNA, 20 nt, Homo sapiens
cugaauaaauaauucuuccu

SEQ ID NO: 1325854 - RNA, 12 nt, Homo sapiens
cugaauauugcc

SEQ ID NO: 1325855 - RNA, 19 nt, Homo sapiens
cugacaaaaggcuccaguu

SEQ ID NO: 1325856 - RNA, 20 nt, Homo sapiens
cugacaauuugugauaucua

SEQ ID NO: 1325857 - RNA, 23 nt, Homo sapiens
cugacaauuugugauaucuaaua

SEQ ID NO: 1325858 - RNA, 18 nt, Homo sapiens
cugacagaaggacucagg

SEQ ID NO: 1325859 - RNA, 15 nt, Homo sapiens
cugacauauuaugcc

SEQ ID NO: 1325860 - RNA, 19 nt, Homo sapiens
cugacaugcucacacauua

SEQ ID NO: 1325861 - RNA, 18 nt, Homo sapiens
cugaccuuggguccugaa

SEQ ID NO: 1325862 - RNA, 22 nt, Homo sapiens
cugaccuuggguccugaaguga

SEQ ID NO: 1325863 - RNA, 22 nt, Homo sapiens
cugacuaauuuuguaguuuuag

SEQ ID NO: 1325864 - RNA, 17 nt, Homo sapiens
cugacucuucaagugcc

SEQ ID NO: 1325865 - RNA, 16 nt, Homo sapiens
cugacuucauacaucc

SEQ ID NO: 1325866 - RNA, 17 nt, Homo sapiens
cugacuuuuaaugucau

SEQ ID NO: 1325867 - RNA, 14 nt, Homo sapiens
cugagaagaucuga

SEQ ID NO: 1325868 - RNA, 15 nt, Homo sapiens
cugagagacagaauu

SEQ ID NO: 1325869 - RNA, 18 nt, Homo sapiens
cugagaugugaacacauc

SEQ ID NO: 1325870 - RNA, 23 nt, Homo sapiens
cugagcaccacacccagugggaa

SEQ ID NO: 1325871 - RNA, 16 nt, Homo sapiens
cugagcagcauccacc

SEQ ID NO: 1325872 - RNA, 19 nt, Homo sapiens
cugagcuggcccuugggga

SEQ ID NO: 1325873 - RNA, 22 nt, Homo sapiens
cugaggaaguggggcaaggaau

SEQ ID NO: 1325874 - RNA, 17 nt, Homo sapiens
cugaggacacucagugu

SEQ ID NO: 1325875 - RNA, 13 nt, Homo sapiens
cugaggaccagcc

SEQ ID NO: 1325876 - RNA, 19 nt, Homo sapiens
cugaggagccugcaacaug

SEQ ID NO: 1325877 - RNA, 22 nt, Homo sapiens
cugaggagccugcaacaugcca

SEQ ID NO: 1325878 - RNA, 15 nt, Homo sapiens
cugaggggugggggu

SEQ ID NO: 1325879 - RNA, 14 nt, Homo sapiens
cugaggugacuuaa

SEQ ID NO: 1325880 - RNA, 15 nt, Homo sapiens
cugagguuuacauac

SEQ ID NO: 1325881 - RNA, 18 nt, Homo sapiens
cugaguaagcccucagga

SEQ ID NO: 1325882 - RNA, 19 nt, Homo sapiens
cugaguaagcccucaggag

SEQ ID NO: 1325883 - RNA, 18 nt, Homo sapiens
cugaguauaaauuuacuu

SEQ ID NO: 1325884 - RNA, 21 nt, Homo sapiens
cugagucaaauccaguggugg

SEQ ID NO: 1325885 - RNA, 17 nt, Homo sapiens
cugaguguuuaauuuca

SEQ ID NO: 1325886 - RNA, 14 nt, Homo sapiens
cugaguugcuuuua

SEQ ID NO: 1325887 - RNA, 17 nt, Homo sapiens
cugauaaacagaguaac

SEQ ID NO: 1325888 - RNA, 18 nt, Homo sapiens
cugauacugggucugcga

SEQ ID NO: 1325889 - RNA, 18 nt, Homo sapiens
cugaucaucgaggagcua

SEQ ID NO: 1325890 - RNA, 21 nt, Homo sapiens
cugaugacacaggcugacuca

SEQ ID NO: 1325891 - RNA, 17 nt, Homo sapiens
cugauggugacauugca

SEQ ID NO: 1325892 - RNA, 20 nt, Homo sapiens
cugauuaaaaauaccuucua

SEQ ID NO: 1325893 - RNA, 16 nt, Homo sapiens
cugauuaguugacagu

SEQ ID NO: 1325894 - RNA, 22 nt, Homo sapiens
cugauugucaacacaaacuggc

SEQ ID NO: 1325895 - RNA, 16 nt, Homo sapiens
cugauuuaacuuguau

SEQ ID NO: 1325896 - RNA, 21 nt, Homo sapiens
cugcaaccugauugauuauau

SEQ ID NO: 1325897 - RNA, 22 nt, Homo sapiens
cugcaaucccagcuacuuggaa

SEQ ID NO: 1325898 - RNA, 18 nt, Homo sapiens
cugcacagugcaucucag

SEQ ID NO: 1325899 - RNA, 15 nt, Homo sapiens
cugcaccaugcugcu

SEQ ID NO: 1325900 - RNA, 15 nt, Homo sapiens
cugcagagugggcuc

SEQ ID NO: 1325901 - RNA, 22 nt, Homo sapiens
cugcagcagucgcccaagcaga

SEQ ID NO: 1325902 - RNA, 12 nt, Homo sapiens
cugcagcccagg

SEQ ID NO: 1325903 - RNA, 19 nt, Homo sapiens
cugcaggguuacacaaaaa

SEQ ID NO: 1325904 - RNA, 11 nt, Homo sapiens
cugcagguguu

SEQ ID NO: 1325905 - RNA, 15 nt, Homo sapiens
cugcaguagugcacc

SEQ ID NO: 1325906 - RNA, 21 nt, Homo sapiens
cugcauaccaaccugggcaau

SEQ ID NO: 1325907 - RNA, 20 nt, Homo sapiens
cugcaucuucccacaguggc

SEQ ID NO: 1325908 - RNA, 23 nt, Homo sapiens
cugcaugacggagccgagccaug

SEQ ID NO: 1325909 - RNA, 16 nt, Homo sapiens
cugcauuuacacacac

SEQ ID NO: 1325910 - RNA, 20 nt, Homo sapiens
cugccaggcuguuucagcca

SEQ ID NO: 1325911 - RNA, 23 nt, Homo sapiens
cugccaucauguuuacagaggac

SEQ ID NO: 1325912 - RNA, 20 nt, Homo sapiens
cugcccaacccuucccucac

SEQ ID NO: 1325913 - RNA, 19 nt, Homo sapiens
cugcccaccuggcugccaa

SEQ ID NO: 1325914 - RNA, 19 nt, Homo sapiens
cugcccgcgggagacagcu

SEQ ID NO: 1325915 - RNA, 17 nt, Homo sapiens
cugcccucuauuuauua

SEQ ID NO: 1325916 - RNA, 21 nt, Homo sapiens
cugccgaguggucacugucag

SEQ ID NO: 1325917 - RNA, 16 nt, Homo sapiens
cugccuaauuuugcca

SEQ ID NO: 1325918 - RNA, 23 nt, Homo sapiens
cugccuccagaauggucuuucua

SEQ ID NO: 1325919 - RNA, 15 nt, Homo sapiens
cugccuccugugacg

SEQ ID NO: 1325920 - RNA, 19 nt, Homo sapiens
cugccuccugugacgugag

SEQ ID NO: 1325921 - RNA, 23 nt, Homo sapiens
cugccuccuuuccccucccucag

SEQ ID NO: 1325922 - RNA, 17 nt, Homo sapiens
cugccugucugaagcca

SEQ ID NO: 1325923 - RNA, 14 nt, Homo sapiens
cugccuucucagga

SEQ ID NO: 1325924 - RNA, 18 nt, Homo sapiens
cugccuuuaagccaaaga

SEQ ID NO: 1325925 - RNA, 21 nt, Homo sapiens
cugccuuuguugaggugcaag

SEQ ID NO: 1325926 - RNA, 20 nt, Homo sapiens
cugcgcuguguacaauguga

SEQ ID NO: 1325927 - RNA, 15 nt, Homo sapiens
cugcguuuuccuagc

SEQ ID NO: 1325928 - RNA, 11 nt, Homo sapiens
cugcucaggag

SEQ ID NO: 1325929 - RNA, 22 nt, Homo sapiens
cugcucguuuacacugcacauu

SEQ ID NO: 1325930 - RNA, 16 nt, Homo sapiens
cugcucuauacugugg

SEQ ID NO: 1325931 - RNA, 18 nt, Homo sapiens
cugcugagacgccacgga

SEQ ID NO: 1325932 - RNA, 22 nt, Homo sapiens
cugcugagagggcugcugacca

SEQ ID NO: 1325933 - RNA, 15 nt, Homo sapiens
gaagauccaagcaaa

SEQ ID NO: 1325934 - RNA, 23 nt, Homo sapiens
gaagaugacgaguaacuccccuc

SEQ ID NO: 1325935 - RNA, 16 nt, Homo sapiens
gaagauuagaaacuac

SEQ ID NO: 1325936 - RNA, 13 nt, Homo sapiens
gaagcaacauuuu

SEQ ID NO: 1325937 - RNA, 16 nt, Homo sapiens
gaagcaccuaaaugau

SEQ ID NO: 1325938 - RNA, 12 nt, Homo sapiens
gaagcacugccu

SEQ ID NO: 1325939 - RNA, 14 nt, Homo sapiens
gaagccaaugcugu

SEQ ID NO: 1325940 - RNA, 18 nt, Homo sapiens
gaagccaggaauuuccca

SEQ ID NO: 1325941 - RNA, 16 nt, Homo sapiens
gaagccuaccagaaga

SEQ ID NO: 1325942 - RNA, 15 nt, Homo sapiens
gaagccuacugguag

SEQ ID NO: 1325943 - RNA, 22 nt, Homo sapiens
gaagccuucuuuuucugagaca

SEQ ID NO: 1325944 - RNA, 19 nt, Homo sapiens
gaagcuuaaaaucugugaa

SEQ ID NO: 1325945 - RNA, 14 nt, Homo sapiens
gaaggaauuauucc

SEQ ID NO: 1325946 - RNA, 13 nt, Homo sapiens
gaaggauuaccug

SEQ ID NO: 1325947 - RNA, 15 nt, Homo sapiens
gaaggauuacucucc

SEQ ID NO: 1325948 - RNA, 12 nt, Homo sapiens
gaaggugccucu

SEQ ID NO: 1325949 - RNA, 20 nt, Homo sapiens
gaagguucucugugcuccuc

SEQ ID NO: 1325950 - RNA, 21 nt, Homo sapiens
gaaguagacucauucuucaca

SEQ ID NO: 1325951 - RNA, 20 nt, Homo sapiens
gaagucaccccuuucugucc

SEQ ID NO: 1325952 - RNA, 22 nt, Homo sapiens
gaagucgggcaugguggcucau

SEQ ID NO: 1325953 - RNA, 20 nt, Homo sapiens
gaagugcccucgagcacuga

SEQ ID NO: 1325954 - RNA, 23 nt, Homo sapiens
gaagugguguuuagaaugucagu

SEQ ID NO: 1325955 - RNA, 17 nt, Homo sapiens
gaaguuaaaagcacaaa

SEQ ID NO: 1325956 - RNA, 21 nt, Homo sapiens
gaaguuacuguuacuugauaa

SEQ ID NO: 1325957 - RNA, 15 nt, Homo sapiens
gaaguuugcugugcu

SEQ ID NO: 1325958 - RNA, 15 nt, Homo sapiens
gaauaaaaugaaggu

SEQ ID NO: 1325959 - RNA, 14 nt, Homo sapiens
gaauaaagccuuuu

SEQ ID NO: 1325960 - RNA, 14 nt, Homo sapiens
gaauaaauaauucu

SEQ ID NO: 1325961 - RNA, 14 nt, Homo sapiens
gugacaaagcaauu

SEQ ID NO: 1325962 - RNA, 19 nt, Homo sapiens
gugacaauuaaaagugucu

SEQ ID NO: 1325963 - RNA, 21 nt, Homo sapiens
gugacagaggagaaaguggaa

SEQ ID NO: 1325964 - RNA, 13 nt, Homo sapiens
gugacaugcaguu

SEQ ID NO: 1325965 - RNA, 18 nt, Homo sapiens
gugacauuuauauauuga

SEQ ID NO: 1325966 - RNA, 15 nt, Homo sapiens
gugacauuugggaga

SEQ ID NO: 1325967 - RNA, 16 nt, Homo sapiens
gugacauuugggagac

SEQ ID NO: 1325968 - RNA, 15 nt, Homo sapiens
gugaccucacuggcc

SEQ ID NO: 1325969 - RNA, 14 nt, Homo sapiens
cuuucauaaucuuu

SEQ ID NO: 1325970 - RNA, 22 nt, Homo sapiens
cuuucaugaauucugucauuuc

SEQ ID NO: 1325971 - RNA, 18 nt, Homo sapiens
cuuucaugaguuuuuccc

SEQ ID NO: 1325972 - RNA, 21 nt, Homo sapiens
cuuucauguaaaaagugcagu

SEQ ID NO: 1325973 - RNA, 23 nt, Homo sapiens
cuuucauuggacccugacuguau

SEQ ID NO: 1325974 - RNA, 21 nt, Homo sapiens
cuuucccagucccauuccuca

SEQ ID NO: 1325975 - RNA, 22 nt, Homo sapiens
cuuucccagucccauuccucag

SEQ ID NO: 1325976 - RNA, 17 nt, Homo sapiens
cuuuccuaaggcugcaa

SEQ ID NO: 1325977 - RNA, 18 nt, Homo sapiens
cuuuccuguuccagagag

SEQ ID NO: 1325978 - RNA, 13 nt, Homo sapiens
cuuucuaugcugu

SEQ ID NO: 1325979 - RNA, 16 nt, Homo sapiens
cuuucuauucuuggaa

SEQ ID NO: 1325980 - RNA, 21 nt, Homo sapiens
cuuucucauaagcaccuaaaa

SEQ ID NO: 1325981 - RNA, 12 nt, Homo sapiens
cuuucucugagg

SEQ ID NO: 1325982 - RNA, 21 nt, Homo sapiens
cuuucuuaagcaacaauggau

SEQ ID NO: 1325983 - RNA, 14 nt, Homo sapiens
cuuugaauuuacug

SEQ ID NO: 1325984 - RNA, 15 nt, Homo sapiens
cuuugagauuauucu

SEQ ID NO: 1325985 - RNA, 20 nt, Homo sapiens
cuuugauugcugagagccau

SEQ ID NO: 1325986 - RNA, 11 nt, Homo sapiens
cuuugcacuga

SEQ ID NO: 1325987 - RNA, 20 nt, Homo sapiens
cuuugcagugaaagcuuuca

SEQ ID NO: 1325988 - RNA, 22 nt, Homo sapiens
cuuugcagugaaagcuuucaug

SEQ ID NO: 1325989 - RNA, 19 nt, Homo sapiens
cuuugcccaaaacugucau

SEQ ID NO: 1325990 - RNA, 16 nt, Homo sapiens
cuuuggaaauacacag

SEQ ID NO: 1325991 - RNA, 19 nt, Homo sapiens
cuuugggccagacaugcca

SEQ ID NO: 1325992 - RNA, 21 nt, Homo sapiens
cuuugggccagacaugccaca

SEQ ID NO: 1325993 - RNA, 17 nt, Homo sapiens
cuuuguaugcacuuugu

SEQ ID NO: 1325994 - RNA, 18 nt, Homo sapiens
cuuuuaaaaaaaaauacu

SEQ ID NO: 1325995 - RNA, 15 nt, Homo sapiens
cuuuuaaaaaugucc

SEQ ID NO: 1325996 - RNA, 17 nt, Homo sapiens
cuuuuacugaagccuuu

SEQ ID NO: 1325997 - RNA, 19 nt, Homo sapiens
cuuuucaaaauauuacuca

SEQ ID NO: 1325998 - RNA, 18 nt, Homo sapiens
cuuuuccaaaucaaggau

SEQ ID NO: 1325999 - RNA, 19 nt, Homo sapiens
cuuuuccacacgcauuaau

SEQ ID NO: 1326000 - RNA, 22 nt, Homo sapiens
cuuuuccaugcacccucauaca

SEQ ID NO: 1326001 - RNA, 18 nt, Homo sapiens
cuuuucccauugccaugc

SEQ ID NO: 1326002 - RNA, 16 nt, Homo sapiens
cuuuuccuuugcuagu

SEQ ID NO: 1326003 - RNA, 22 nt, Homo sapiens
cuuuucggccccauguaucuca

SEQ ID NO: 1326004 - RNA, 23 nt, Homo sapiens
cuuuucggccccauguaucucag

SEQ ID NO: 1326005 - RNA, 22 nt, Homo sapiens
cuuuucuccucacuguauccag

SEQ ID NO: 1326006 - RNA, 21 nt, Homo sapiens
cuuuucucugucuacuccuua

SEQ ID NO: 1326007 - RNA, 17 nt, Homo sapiens
cuuuucugccacuccau

SEQ ID NO: 1326008 - RNA, 15 nt, Homo sapiens
cuuuugaacccagga

SEQ ID NO: 1326009 - RNA, 14 nt, Homo sapiens
cuuuugaugucuuu

SEQ ID NO: 1326010 - RNA, 20 nt, Homo sapiens
cuuuugguagagaaggagca

SEQ ID NO: 1326011 - RNA, 13 nt, Homo sapiens
cuuuugucccaga

SEQ ID NO: 1326012 - RNA, 14 nt, Homo sapiens
cuuuugucccagaa

SEQ ID NO: 1326013 - RNA, 22 nt, Homo sapiens
cuuuuguguuugugugggauga

SEQ ID NO: 1326014 - RNA, 15 nt, Homo sapiens
cuuuuuauacuauua

SEQ ID NO: 1326015 - RNA, 19 nt, Homo sapiens
cuuuuuauucccugcccaa

SEQ ID NO: 1326016 - RNA, 14 nt, Homo sapiens
cuuuuucaaagugu

SEQ ID NO: 1326017 - RNA, 23 nt, Homo sapiens
cuuuuugucauguuaugcaguga

SEQ ID NO: 1326018 - RNA, 16 nt, Homo sapiens
cuuuuuucaauaugca

SEQ ID NO: 1326019 - RNA, 12 nt, Homo sapiens
cuuuuuucuucc

SEQ ID NO: 1326020 - RNA, 16 nt, Homo sapiens
cuuuuuuucuguacca

SEQ ID NO: 1326021 - RNA, 21 nt, Homo sapiens
cuuuuuuuuccccaaguauua

SEQ ID NO: 1326022 - RNA, 13 nt, Homo sapiens
gaaaaacaggaaa

SEQ ID NO: 1326023 - RNA, 19 nt, Homo sapiens
gaaaaaggaacuaccuauc

SEQ ID NO: 1326024 - RNA, 21 nt, Homo sapiens
gaaaaaugcaagccaucucua

SEQ ID NO: 1326025 - RNA, 12 nt, Homo sapiens
gaaaacacuguc

SEQ ID NO: 1326026 - RNA, 19 nt, Homo sapiens
gaaaagaccaguccaugag

SEQ ID NO: 1326027 - RNA, 18 nt, Homo sapiens
gaaaagcaggcaaaagac

SEQ ID NO: 1326028 - RNA, 14 nt, Homo sapiens
gaaaagcugccauu

SEQ ID NO: 1326029 - RNA, 18 nt, Homo sapiens
gaaaaggccuucuuccca

SEQ ID NO: 1326030 - RNA, 23 nt, Homo sapiens
gaaaagggguguggcaaaggagc

SEQ ID NO: 1326031 - RNA, 14 nt, Homo sapiens
gaaaaguucaggga

SEQ ID NO: 1326032 - RNA, 20 nt, Homo sapiens
gaaaaguugaugguauucau

SEQ ID NO: 1326033 - RNA, 19 nt, Homo sapiens
gaaaauaaaauuuaacuca

SEQ ID NO: 1326034 - RNA, 16 nt, Homo sapiens
gaaaauaaacaucagu

SEQ ID NO: 1326035 - RNA, 19 nt, Homo sapiens
gaaaauaacugaaccaaau

SEQ ID NO: 1326036 - RNA, 18 nt, Homo sapiens
gaaaaucacuugccaaaa

SEQ ID NO: 1326037 - RNA, 17 nt, Homo sapiens
gaaaaugagagcagaaa

SEQ ID NO: 1326038 - RNA, 13 nt, Homo sapiens
gaaaaugcaaaag

SEQ ID NO: 1326039 - RNA, 15 nt, Homo sapiens
gaaaauggcuuucuc

SEQ ID NO: 1326040 - RNA, 16 nt, Homo sapiens
gaaaauuauauauacc

SEQ ID NO: 1326041 - RNA, 18 nt, Homo sapiens
gaaaauucaggucuguau

SEQ ID NO: 1326042 - RNA, 13 nt, Homo sapiens
gaaaauucaggug

SEQ ID NO: 1326043 - RNA, 13 nt, Homo sapiens
gaaacaacagcuu

SEQ ID NO: 1326044 - RNA, 15 nt, Homo sapiens
gaaacacaauaccua

SEQ ID NO: 1326045 - RNA, 17 nt, Homo sapiens
gaaacagcugcccugug

SEQ ID NO: 1326046 - RNA, 19 nt, Homo sapiens
gaaacaguugguaacuuuu

SEQ ID NO: 1326047 - RNA, 10 nt, Homo sapiens
gaaacauuua

SEQ ID NO: 1326048 - RNA, 13 nt, Homo sapiens
gaaacccagagau

SEQ ID NO: 1326049 - RNA, 21 nt, Homo sapiens
gaaaccccuucuuuacuuccc

SEQ ID NO: 1326050 - RNA, 14 nt, Homo sapiens
gaaacuccgucuca

SEQ ID NO: 1326051 - RNA, 16 nt, Homo sapiens
gaaacuccgucucaaa

SEQ ID NO: 1326052 - RNA, 16 nt, Homo sapiens
gaaacucuacccugaa

SEQ ID NO: 1326053 - RNA, 12 nt, Homo sapiens
gaaacugaugcc

SEQ ID NO: 1326054 - RNA, 13 nt, Homo sapiens
gaaagaaccagag

SEQ ID NO: 1326055 - RNA, 18 nt, Homo sapiens
gaaagacuauucaaacag

SEQ ID NO: 1326056 - RNA, 17 nt, Homo sapiens
gaaagagagaagccagc

SEQ ID NO: 1326057 - RNA, 18 nt, Homo sapiens
gaaagcaaguguucacaa

SEQ ID NO: 1326058 - RNA, 21 nt, Homo sapiens
gaaagcaaguguucacaacag

SEQ ID NO: 1326059 - RNA, 20 nt, Homo sapiens
gaaagccugggugacauuug

SEQ ID NO: 1326060 - RNA, 11 nt, Homo sapiens
gaaagcuuugu

SEQ ID NO: 1326061 - RNA, 19 nt, Homo sapiens
gaaaggauuuuaccaaagc

SEQ ID NO: 1326062 - RNA, 20 nt, Homo sapiens
gaaaggauuuuaccaaagca

SEQ ID NO: 1326063 - RNA, 16 nt, Homo sapiens
gaaagguuuuccuuau

SEQ ID NO: 1326064 - RNA, 17 nt, Homo sapiens
gaaaguauuggcauuca

SEQ ID NO: 1326065 - RNA, 21 nt, Homo sapiens
gaaagucaggcuagcugugcu

SEQ ID NO: 1326066 - RNA, 14 nt, Homo sapiens
gaaaguucuggaaa

SEQ ID NO: 1326067 - RNA, 15 nt, Homo sapiens
gaaauaccuucuccc

SEQ ID NO: 1326068 - RNA, 23 nt, Homo sapiens
gaaauaucuauguuuuaccaagc

SEQ ID NO: 1326069 - RNA, 20 nt, Homo sapiens
gaaauccauuccauuuugug

SEQ ID NO: 1326070 - RNA, 14 nt, Homo sapiens
gaaaugaugagaaa

SEQ ID NO: 1326071 - RNA, 19 nt, Homo sapiens
gaaaugcuguuaguaaauu

SEQ ID NO: 1326072 - RNA, 19 nt, Homo sapiens
gaaaugcuuuuauauucua

SEQ ID NO: 1326073 - RNA, 14 nt, Homo sapiens
gaaaugucaugugg

SEQ ID NO: 1326074 - RNA, 14 nt, Homo sapiens
gaaauucagacuug

SEQ ID NO: 1326075 - RNA, 18 nt, Homo sapiens
gaaauuugauaaacugaa

SEQ ID NO: 1326076 - RNA, 19 nt, Homo sapiens
gaaauuugauaaacugaau

SEQ ID NO: 1326077 - RNA, 13 nt, Homo sapiens
gaaauuuggcaaa

SEQ ID NO: 1326078 - RNA, 21 nt, Homo sapiens
gaacaagaagguggaaggcag

SEQ ID NO: 1326079 - RNA, 11 nt, Homo sapiens
gaacacagugc

SEQ ID NO: 1326080 - RNA, 19 nt, Homo sapiens
gaacacccuggaugcuguu

SEQ ID NO: 1326081 - RNA, 23 nt, Homo sapiens
gaacacuaacuaugcauggugcc

SEQ ID NO: 1326082 - RNA, 18 nt, Homo sapiens
gaacagaaguguucacau

SEQ ID NO: 1326083 - RNA, 15 nt, Homo sapiens
gaacagaugcugagc

SEQ ID NO: 1326084 - RNA, 14 nt, Homo sapiens
gaacauauguuugc

SEQ ID NO: 1326085 - RNA, 16 nt, Homo sapiens
gaacaugaaaugcccu

SEQ ID NO: 1326086 - RNA, 17 nt, Homo sapiens
gaaccaaauugcacuga

SEQ ID NO: 1326087 - RNA, 21 nt, Homo sapiens
gaaccagagaggcucugagaa

SEQ ID NO: 1326088 - RNA, 19 nt, Homo sapiens
gaacccacauaaaagcccc

SEQ ID NO: 1326089 - RNA, 15 nt, Homo sapiens
gaacccagacucaga

SEQ ID NO: 1326090 - RNA, 15 nt, Homo sapiens
gaacccuacacccca

SEQ ID NO: 1326091 - RNA, 12 nt, Homo sapiens
gaacccugagca

SEQ ID NO: 1326092 - RNA, 22 nt, Homo sapiens
gaacccuuggagccaauggaga

SEQ ID NO: 1326093 - RNA, 20 nt, Homo sapiens
gaaccuagauugcaccauug

SEQ ID NO: 1326094 - RNA, 18 nt, Homo sapiens
gaaccucuaagugcugcu

SEQ ID NO: 1326095 - RNA, 22 nt, Homo sapiens
gaacguuacuuugugucgugau

SEQ ID NO: 1326096 - RNA, 19 nt, Homo sapiens
gaacuauucugggggcccg

SEQ ID NO: 1326097 - RNA, 14 nt, Homo sapiens
gaacuccaggcaug

SEQ ID NO: 1326098 - RNA, 19 nt, Homo sapiens
gaacuucuuugaauuuacu

SEQ ID NO: 1326099 - RNA, 16 nt, Homo sapiens
gaagaaaagcugccau

SEQ ID NO: 1326100 - RNA, 16 nt, Homo sapiens
gaagaaaauagucagu

SEQ ID NO: 1326101 - RNA, 14 nt, Homo sapiens
gaagaagagaggca

SEQ ID NO: 1326102 - RNA, 20 nt, Homo sapiens
gaagaaucuuccuggcacaa

SEQ ID NO: 1326103 - RNA, 17 nt, Homo sapiens
gaagauaaauuggcuaa

SEQ ID NO: 1326104 - RNA, 14 nt, Homo sapiens
cugcugcgcugcuu

SEQ ID NO: 1326105 - RNA, 20 nt, Homo sapiens
cugcugggcucugccuuaaa

SEQ ID NO: 1326106 - RNA, 19 nt, Homo sapiens
cugcuuaucagugugcaau

SEQ ID NO: 1326107 - RNA, 20 nt, Homo sapiens
cugcuuaucagugugcaaua

SEQ ID NO: 1326108 - RNA, 23 nt, Homo sapiens
cugcuucccacaacuacuagugu

SEQ ID NO: 1326109 - RNA, 13 nt, Homo sapiens
cugcuuccugucu

SEQ ID NO: 1326110 - RNA, 19 nt, Homo sapiens
cuggaagcuuuguagaaau

SEQ ID NO: 1326111 - RNA, 15 nt, Homo sapiens
cuggaaggggccacg

SEQ ID NO: 1326112 - RNA, 19 nt, Homo sapiens
cuggaaggggccacgugga

SEQ ID NO: 1326113 - RNA, 20 nt, Homo sapiens
cuggacuggaaagcacaaga

SEQ ID NO: 1326114 - RNA, 18 nt, Homo sapiens
cuggagagaacacagugc

SEQ ID NO: 1326115 - RNA, 23 nt, Homo sapiens
cuggaggcccaguucacccugau

SEQ ID NO: 1326116 - RNA, 15 nt, Homo sapiens
cuggagucagguguc

SEQ ID NO: 1326117 - RNA, 20 nt, Homo sapiens
cuggagugcaauggugugau

SEQ ID NO: 1326118 - RNA, 13 nt, Homo sapiens
cuggaugagaaac

SEQ ID NO: 1326119 - RNA, 15 nt, Homo sapiens
cuggaugcccaggaa

SEQ ID NO: 1326120 - RNA, 19 nt, Homo sapiens
cuggaugucugggugaccu

SEQ ID NO: 1326121 - RNA, 19 nt, Homo sapiens
cuggcaaaugccugacuca

SEQ ID NO: 1326122 - RNA, 23 nt, Homo sapiens
cuggcaaaugccugacucaguga

SEQ ID NO: 1326123 - RNA, 19 nt, Homo sapiens
cuggcaagccugucuucag

SEQ ID NO: 1326124 - RNA, 13 nt, Homo sapiens
cuggcacacuggc

SEQ ID NO: 1326125 - RNA, 19 nt, Homo sapiens
cuggcagccgugccuucag

SEQ ID NO: 1326126 - RNA, 19 nt, Homo sapiens
cuggcagggacgaggacaa

SEQ ID NO: 1326127 - RNA, 12 nt, Homo sapiens
cuggcccugugc

SEQ ID NO: 1326128 - RNA, 17 nt, Homo sapiens
cuggccugaacugagga

SEQ ID NO: 1326129 - RNA, 15 nt, Homo sapiens
cuggccuguacccag

SEQ ID NO: 1326130 - RNA, 21 nt, Homo sapiens
cuggccuguggcuaauggagg

SEQ ID NO: 1326131 - RNA, 20 nt, Homo sapiens
cuggcucugcccccuccccc

SEQ ID NO: 1326132 - RNA, 21 nt, Homo sapiens
cuggcugcggggcgggcacac

SEQ ID NO: 1326133 - RNA, 23 nt, Homo sapiens
cuggcugguggagaacucaaggc

SEQ ID NO: 1326134 - RNA, 18 nt, Homo sapiens
cuggcuucaaaaagccac

SEQ ID NO: 1326135 - RNA, 14 nt, Homo sapiens
cuggcuuugccucu

SEQ ID NO: 1326136 - RNA, 18 nt, Homo sapiens
cugggaaggccagccuug

SEQ ID NO: 1326137 - RNA, 22 nt, Homo sapiens
cugggacacuccgucugcucca

SEQ ID NO: 1326138 - RNA, 17 nt, Homo sapiens
cugggaccucccacugc

SEQ ID NO: 1326139 - RNA, 20 nt, Homo sapiens
cugggaccucccacugcccc

SEQ ID NO: 1326140 - RNA, 16 nt, Homo sapiens
cugggagcacuggugu

SEQ ID NO: 1326141 - RNA, 23 nt, Homo sapiens
cugggauuacaggcgugagccac

SEQ ID NO: 1326142 - RNA, 15 nt, Homo sapiens
cugggcaauauagca

SEQ ID NO: 1326143 - RNA, 14 nt, Homo sapiens
cugggcaccaccuc

SEQ ID NO: 1326144 - RNA, 21 nt, Homo sapiens
cugggcauuuggugagaguca

SEQ ID NO: 1326145 - RNA, 12 nt, Homo sapiens
cugggccagugc

SEQ ID NO: 1326146 - RNA, 22 nt, Homo sapiens
cugggcccggaagggcuuuggu

SEQ ID NO: 1326147 - RNA, 18 nt, Homo sapiens
cugggccuguggugccug

SEQ ID NO: 1326148 - RNA, 16 nt, Homo sapiens
cugggcucaagugauc

SEQ ID NO: 1326149 - RNA, 17 nt, Homo sapiens
cugggcucaagugaucc

SEQ ID NO: 1326150 - RNA, 17 nt, Homo sapiens
cugggcucacugugcug

SEQ ID NO: 1326151 - RNA, 16 nt, Homo sapiens
cuggggaagacagugg

SEQ ID NO: 1326152 - RNA, 20 nt, Homo sapiens
cuggggagugguuaggcagc

SEQ ID NO: 1326153 - RNA, 19 nt, Homo sapiens
cuggggaugucucucauga

SEQ ID NO: 1326154 - RNA, 14 nt, Homo sapiens
cugggugaccucac

SEQ ID NO: 1326155 - RNA, 19 nt, Homo sapiens
cugggugaccucacuuuag

SEQ ID NO: 1326156 - RNA, 21 nt, Homo sapiens
cugguaauaaaugugacucag

SEQ ID NO: 1326157 - RNA, 20 nt, Homo sapiens
cugguaauuuaagauuccag

SEQ ID NO: 1326158 - RNA, 16 nt, Homo sapiens
cugguacucugugaaa

SEQ ID NO: 1326159 - RNA, 22 nt, Homo sapiens
cugguacugcaggaccuccagc

SEQ ID NO: 1326160 - RNA, 17 nt, Homo sapiens
cugguacuuagaguuuc

SEQ ID NO: 1326161 - RNA, 20 nt, Homo sapiens
cugguagggauauggcagga

SEQ ID NO: 1326162 - RNA, 16 nt, Homo sapiens
cuggucagcauguacu

SEQ ID NO: 1326163 - RNA, 20 nt, Homo sapiens
cuggucucaaacuccugacc

SEQ ID NO: 1326164 - RNA, 15 nt, Homo sapiens
cuggugaaaugcugu

SEQ ID NO: 1326165 - RNA, 14 nt, Homo sapiens
cuggugagguccug

SEQ ID NO: 1326166 - RNA, 16 nt, Homo sapiens
cuggugagucaccacu

SEQ ID NO: 1326167 - RNA, 21 nt, Homo sapiens
cugguugcuaaugacagccuu

SEQ ID NO: 1326168 - RNA, 13 nt, Homo sapiens
cugguuugcuugg

SEQ ID NO: 1326169 - RNA, 21 nt, Homo sapiens
cuguaaaggaccuccuaaaua

SEQ ID NO: 1326170 - RNA, 20 nt, Homo sapiens
cuguaacacauaguggcuuc

SEQ ID NO: 1326171 - RNA, 23 nt, Homo sapiens
cuguaacagcggcaggguguccc

SEQ ID NO: 1326172 - RNA, 12 nt, Homo sapiens
cuguaacagggu

SEQ ID NO: 1326173 - RNA, 18 nt, Homo sapiens
cuguaaucucagcacuuu

SEQ ID NO: 1326174 - RNA, 19 nt, Homo sapiens
cuguaaucucagcacuuug

SEQ ID NO: 1326175 - RNA, 15 nt, Homo sapiens
cuguacacagaauug

SEQ ID NO: 1326176 - RNA, 15 nt, Homo sapiens
cuguaccaguuaauu

SEQ ID NO: 1326177 - RNA, 16 nt, Homo sapiens
cuguacucagccuuuu

SEQ ID NO: 1326178 - RNA, 23 nt, Homo sapiens
cuguacucagccuuuugaugucu

SEQ ID NO: 1326179 - RNA, 17 nt, Homo sapiens
cuguacugagcacugaa

SEQ ID NO: 1326180 - RNA, 22 nt, Homo sapiens
cuguagaaugauuucaugcuau

SEQ ID NO: 1326181 - RNA, 18 nt, Homo sapiens
cuguaggaauuuucuuga

SEQ ID NO: 1326182 - RNA, 20 nt, Homo sapiens
cuguaguaauuguuacaauu

SEQ ID NO: 1326183 - RNA, 19 nt, Homo sapiens
cuguagucccagcuacuca

SEQ ID NO: 1326184 - RNA, 12 nt, Homo sapiens
cuguaugccugg

SEQ ID NO: 1326185 - RNA, 17 nt, Homo sapiens
cuguaugccugggccaa

SEQ ID NO: 1326186 - RNA, 14 nt, Homo sapiens
cugucaacuuguau

SEQ ID NO: 1326187 - RNA, 12 nt, Homo sapiens
cugucaagaaga

SEQ ID NO: 1326188 - RNA, 23 nt, Homo sapiens
cugucacugaugguggcucuggu

SEQ ID NO: 1326189 - RNA, 12 nt, Homo sapiens
cugucauccacu

SEQ ID NO: 1326190 - RNA, 14 nt, Homo sapiens
cugucauccacuuu

SEQ ID NO: 1326191 - RNA, 17 nt, Homo sapiens
cuguccacuuggagcua

SEQ ID NO: 1326192 - RNA, 21 nt, Homo sapiens
cuguccuaguuguccagagau

SEQ ID NO: 1326193 - RNA, 17 nt, Homo sapiens
cuguccugcagucccac

SEQ ID NO: 1326194 - RNA, 23 nt, Homo sapiens
cuguccugcagucccacacugug

SEQ ID NO: 1326195 - RNA, 13 nt, Homo sapiens
cuguccugucagu

SEQ ID NO: 1326196 - RNA, 13 nt, Homo sapiens
cugucucugaggg

SEQ ID NO: 1326197 - RNA, 19 nt, Homo sapiens
cugucuuauuaagacuggc

SEQ ID NO: 1326198 - RNA, 20 nt, Homo sapiens
cugucuuauuaagacuggcu

SEQ ID NO: 1326199 - RNA, 23 nt, Homo sapiens
cugucuuauuaagacuggcuuua

SEQ ID NO: 1326200 - RNA, 19 nt, Homo sapiens
cugugaauugccuguaaca

SEQ ID NO: 1326201 - RNA, 22 nt, Homo sapiens
cugugaauugugcucuguugua

SEQ ID NO: 1326202 - RNA, 15 nt, Homo sapiens
cugugacugauauga

SEQ ID NO: 1326203 - RNA, 21 nt, Homo sapiens
cugugaggggcucucucauga

SEQ ID NO: 1326204 - RNA, 23 nt, Homo sapiens
cugugauauuuucacacugguaa

SEQ ID NO: 1326205 - RNA, 18 nt, Homo sapiens
cugugcaucuagccucaa

SEQ ID NO: 1326206 - RNA, 10 nt, Homo sapiens
cugugccaac

SEQ ID NO: 1326207 - RNA, 20 nt, Homo sapiens
cuguggagauggacucagga

SEQ ID NO: 1326208 - RNA, 18 nt, Homo sapiens
cuguguacacgugacaga

SEQ ID NO: 1326209 - RNA, 16 nt, Homo sapiens
cuguguaccucaugga

SEQ ID NO: 1326210 - RNA, 21 nt, Homo sapiens
cuguguaccucauggaugcuu

SEQ ID NO: 1326211 - RNA, 22 nt, Homo sapiens
cugugucauucuguuagauacu

SEQ ID NO: 1326212 - RNA, 17 nt, Homo sapiens
cugugugucuguccuga

SEQ ID NO: 1326213 - RNA, 18 nt, Homo sapiens
cuguguuuaacugcugca

SEQ ID NO: 1326214 - RNA, 14 nt, Homo sapiens
cuguuaacuaugac

SEQ ID NO: 1326215 - RNA, 19 nt, Homo sapiens
cuguuaaucugauguauaa

SEQ ID NO: 1326216 - RNA, 20 nt, Homo sapiens
cuguuaugcuguuuccuagc

SEQ ID NO: 1326217 - RNA, 22 nt, Homo sapiens
cuguucuguuggaugacuuuga

SEQ ID NO: 1326218 - RNA, 17 nt, Homo sapiens
cuguucuucaguccuuu

SEQ ID NO: 1326219 - RNA, 16 nt, Homo sapiens
cuguugaggguccuca

SEQ ID NO: 1326220 - RNA, 13 nt, Homo sapiens
cuguugaugugga

SEQ ID NO: 1326221 - RNA, 15 nt, Homo sapiens
cuguugcauauacca

SEQ ID NO: 1326222 - RNA, 21 nt, Homo sapiens
cuguugucacaucucagggaa

SEQ ID NO: 1326223 - RNA, 16 nt, Homo sapiens
cuguuugaagaaaaua

SEQ ID NO: 1326224 - RNA, 21 nt, Homo sapiens
cuguuuugcauggaguauuau

SEQ ID NO: 1326225 - RNA, 13 nt, Homo sapiens
cuguuuugccagc

SEQ ID NO: 1326226 - RNA, 17 nt, Homo sapiens
cuguuuugccagcccau

SEQ ID NO: 1326227 - RNA, 14 nt, Homo sapiens
cuguuuuguuguuu

SEQ ID NO: 1326228 - RNA, 21 nt, Homo sapiens
cuguuuuucucuaaugcuuga

SEQ ID NO: 1326229 - RNA, 15 nt, Homo sapiens
cuguuuuucuuuaau

SEQ ID NO: 1326230 - RNA, 22 nt, Homo sapiens
cuguuuuuuuuuuuuagccaua

SEQ ID NO: 1326231 - RNA, 22 nt, Homo sapiens
cuuaaaaaauuuuggaaauuca

SEQ ID NO: 1326232 - RNA, 18 nt, Homo sapiens
cuuaaaagaacauguaua

SEQ ID NO: 1326233 - RNA, 20 nt, Homo sapiens
cuuaaaauagaaauauauua

SEQ ID NO: 1326234 - RNA, 15 nt, Homo sapiens
cuuaaaaucugugaa

SEQ ID NO: 1326235 - RNA, 14 nt, Homo sapiens
cuuaaaauugauau

SEQ ID NO: 1326236 - RNA, 14 nt, Homo sapiens
cuuaaaauugugag

SEQ ID NO: 1326237 - RNA, 21 nt, Homo sapiens
cuuaaacauaauaaaucacac

SEQ ID NO: 1326238 - RNA, 21 nt, Homo sapiens
cuuaaauuugauuuacauaua

SEQ ID NO: 1326239 - RNA, 14 nt, Homo sapiens
cuuaacacauucaa

SEQ ID NO: 1326240 - RNA, 16 nt, Homo sapiens
cuuaacacauucaaua

SEQ ID NO: 1326241 - RNA, 21 nt, Homo sapiens
cuuaacacauucaauagcaua

SEQ ID NO: 1326242 - RNA, 14 nt, Homo sapiens
cuuaaccacuuuca

SEQ ID NO: 1326243 - RNA, 15 nt, Homo sapiens
cuuaacuauuucaca

SEQ ID NO: 1326244 - RNA, 14 nt, Homo sapiens
cuuaagaauugaau

SEQ ID NO: 1326245 - RNA, 18 nt, Homo sapiens
cuuaaggucauaaaaaua

SEQ ID NO: 1326246 - RNA, 21 nt, Homo sapiens
cuuaauuauugauguuuucau

SEQ ID NO: 1326247 - RNA, 23 nt, Homo sapiens
cuuaauucccgccuuaugccuca

SEQ ID NO: 1326248 - RNA, 18 nt, Homo sapiens
cuuacacuuuaugcacaa

SEQ ID NO: 1326249 - RNA, 16 nt, Homo sapiens
cuuacaggagccagcc

SEQ ID NO: 1326250 - RNA, 15 nt, Homo sapiens
cuuacauaucugacu

SEQ ID NO: 1326251 - RNA, 17 nt, Homo sapiens
cuuacgaucucuugaca

SEQ ID NO: 1326252 - RNA, 20 nt, Homo sapiens
cuuacgaucucuugacauau

SEQ ID NO: 1326253 - RNA, 17 nt, Homo sapiens
cuuacgcacgauaucua

SEQ ID NO: 1326254 - RNA, 18 nt, Homo sapiens
cuuagaaauugcauuucc

SEQ ID NO: 1326255 - RNA, 15 nt, Homo sapiens
cuuagagacuaucaa

SEQ ID NO: 1326256 - RNA, 18 nt, Homo sapiens
cuuagaguguagcuguaa

SEQ ID NO: 1326257 - RNA, 13 nt, Homo sapiens
cuuagcauguccc

SEQ ID NO: 1326258 - RNA, 22 nt, Homo sapiens
cuuagcuauccuuggcuuucag

SEQ ID NO: 1326259 - RNA, 16 nt, Homo sapiens
cuuagcugucugcuca

SEQ ID NO: 1326260 - RNA, 15 nt, Homo sapiens
cuuauacauuugaua

SEQ ID NO: 1326261 - RNA, 16 nt, Homo sapiens
cuuauaccaugagugu

SEQ ID NO: 1326262 - RNA, 14 nt, Homo sapiens
cuuaucaacaacuu

SEQ ID NO: 1326263 - RNA, 23 nt, Homo sapiens
cuuaucaacauuuguuccaugag

SEQ ID NO: 1326264 - RNA, 17 nt, Homo sapiens
cuuaucagugugcaaua

SEQ ID NO: 1326265 - RNA, 16 nt, Homo sapiens
cuuaugaaaugugcac

SEQ ID NO: 1326266 - RNA, 15 nt, Homo sapiens
cuuaugauacuugag

SEQ ID NO: 1326267 - RNA, 22 nt, Homo sapiens
cuuaugauacuugagguaccag

SEQ ID NO: 1326268 - RNA, 19 nt, Homo sapiens
cuuauuaagacuggcuuua

SEQ ID NO: 1326269 - RNA, 20 nt, Homo sapiens
cuuauucaguucuuacacau

SEQ ID NO: 1326270 - RNA, 20 nt, Homo sapiens
cuuauucuuggcaagaaugc

SEQ ID NO: 1326271 - RNA, 21 nt, Homo sapiens
cuuauuuugugugcuuuccca

SEQ ID NO: 1326272 - RNA, 20 nt, Homo sapiens
cuucaaauguuuaaaccacu

SEQ ID NO: 1326273 - RNA, 19 nt, Homo sapiens
cuucaaucucuugcacuca

SEQ ID NO: 1326274 - RNA, 21 nt, Homo sapiens
cuucaaucucuugcacucaaa

SEQ ID NO: 1326275 - RNA, 17 nt, Homo sapiens
cuucacgcccuuggcca

SEQ ID NO: 1326276 - RNA, 15 nt, Homo sapiens
cuucacuuuccucag

SEQ ID NO: 1326277 - RNA, 18 nt, Homo sapiens
cuucagaacugcccuugc

SEQ ID NO: 1326278 - RNA, 17 nt, Homo sapiens
cuucagucuugguaaaa

SEQ ID NO: 1326279 - RNA, 19 nt, Homo sapiens
cuucagucuugguaaaaca

SEQ ID NO: 1326280 - RNA, 16 nt, Homo sapiens
cuucaucuuugccaua

SEQ ID NO: 1326281 - RNA, 15 nt, Homo sapiens
cuucauguccaguga

SEQ ID NO: 1326282 - RNA, 17 nt, Homo sapiens
cuucauuaccucaguga

SEQ ID NO: 1326283 - RNA, 21 nt, Homo sapiens
cuucauucuuuacugcacuca

SEQ ID NO: 1326284 - RNA, 19 nt, Homo sapiens
cuucauuuuauuaauauuu

SEQ ID NO: 1326285 - RNA, 20 nt, Homo sapiens
cuuccacugaggugggagca

SEQ ID NO: 1326286 - RNA, 20 nt, Homo sapiens
cuuccagugcccuaggccug

SEQ ID NO: 1326287 - RNA, 19 nt, Homo sapiens
cuuccaugguacuguagca

SEQ ID NO: 1326288 - RNA, 14 nt, Homo sapiens
cuucccaguauuau

SEQ ID NO: 1326289 - RNA, 12 nt, Homo sapiens
cuucccauuucu

SEQ ID NO: 1326290 - RNA, 14 nt, Homo sapiens
cuucccuaaugaag

SEQ ID NO: 1326291 - RNA, 17 nt, Homo sapiens
cuucccucucaugacuu

SEQ ID NO: 1326292 - RNA, 23 nt, Homo sapiens
cuuccgcuuugaaagaagcaaga

SEQ ID NO: 1326293 - RNA, 15 nt, Homo sapiens
cuuccuaauugugcc

SEQ ID NO: 1326294 - RNA, 12 nt, Homo sapiens
cuuccuagguca

SEQ ID NO: 1326295 - RNA, 15 nt, Homo sapiens
cuuccucacaccccu

SEQ ID NO: 1326296 - RNA, 14 nt, Homo sapiens
cuuccuccaauagu

SEQ ID NO: 1326297 - RNA, 13 nt, Homo sapiens
cuuccucugguaa

SEQ ID NO: 1326298 - RNA, 13 nt, Homo sapiens
cuuccuggcacaa

SEQ ID NO: 1326299 - RNA, 14 nt, Homo sapiens
cuuccuggcuguaa

SEQ ID NO: 1326300 - RNA, 23 nt, Homo sapiens
cuucgauacaccgggccuggaga

SEQ ID NO: 1326301 - RNA, 13 nt, Homo sapiens
cuucuaaaacaau

SEQ ID NO: 1326302 - RNA, 13 nt, Homo sapiens
cuucuaaauuccc

SEQ ID NO: 1326303 - RNA, 16 nt, Homo sapiens
cuucuaacaugaaaua

SEQ ID NO: 1326304 - RNA, 15 nt, Homo sapiens
cuucuaggauuuauu

SEQ ID NO: 1326305 - RNA, 22 nt, Homo sapiens
cuucuaggauuuauuguuauau

SEQ ID NO: 1326306 - RNA, 14 nt, Homo sapiens
cuucuauguauuag

SEQ ID NO: 1326307 - RNA, 19 nt, Homo sapiens
cuucucagauuucugagga

SEQ ID NO: 1326308 - RNA, 13 nt, Homo sapiens
cuucucugugaau

SEQ ID NO: 1326309 - RNA, 16 nt, Homo sapiens
cuucucuugagucaca

SEQ ID NO: 1326310 - RNA, 16 nt, Homo sapiens
cuucugauaaacacaa

SEQ ID NO: 1326311 - RNA, 15 nt, Homo sapiens
cuucugccuucucag

SEQ ID NO: 1326312 - RNA, 20 nt, Homo sapiens
cuucuucucuccacauggaa

SEQ ID NO: 1326313 - RNA, 18 nt, Homo sapiens
cuucuugaaaucaaucaa

SEQ ID NO: 1326314 - RNA, 22 nt, Homo sapiens
cuucuuggacuucuugaaauca

SEQ ID NO: 1326315 - RNA, 22 nt, Homo sapiens
cuugaacaagaugugggccuug

SEQ ID NO: 1326316 - RNA, 16 nt, Homo sapiens
cuugaacugggcucaa

SEQ ID NO: 1326317 - RNA, 22 nt, Homo sapiens
cuugaauuuuuuuaauuuacac

SEQ ID NO: 1326318 - RNA, 23 nt, Homo sapiens
cuugaccucucauaaauuuacuu

SEQ ID NO: 1326319 - RNA, 14 nt, Homo sapiens
cuugacuuccugcc

SEQ ID NO: 1326320 - RNA, 18 nt, Homo sapiens
cuugacuuccugccaugg

SEQ ID NO: 1326321 - RNA, 19 nt, Homo sapiens
cuugagccacagucacugg

SEQ ID NO: 1326322 - RNA, 15 nt, Homo sapiens
cuugagcuucugggg

SEQ ID NO: 1326323 - RNA, 18 nt, Homo sapiens
cuugaguugaagaucuuu

SEQ ID NO: 1326324 - RNA, 15 nt, Homo sapiens
cuugauuacuuccac

SEQ ID NO: 1326325 - RNA, 18 nt, Homo sapiens
cuugauuacuuccacuga

SEQ ID NO: 1326326 - RNA, 14 nt, Homo sapiens
cuugcaagauucca

SEQ ID NO: 1326327 - RNA, 18 nt, Homo sapiens
cuugcacuuguuauauua

SEQ ID NO: 1326328 - RNA, 21 nt, Homo sapiens
cuugcagcggcuccugcaaaa

SEQ ID NO: 1326329 - RNA, 14 nt, Homo sapiens
cuugcagggccguu

SEQ ID NO: 1326330 - RNA, 24 nt, Homo sapiens
cuugcauaggcucuuaagcagcau

SEQ ID NO: 1326331 - RNA, 19 nt, Homo sapiens
cuugcauccaaaccuguaa

SEQ ID NO: 1326332 - RNA, 22 nt, Homo sapiens
cuugccaaaucaaaagacuuuu

SEQ ID NO: 1326333 - RNA, 16 nt, Homo sapiens
cuugccugcuccaucu

SEQ ID NO: 1326334 - RNA, 18 nt, Homo sapiens
cuugccuugcugaacucc

SEQ ID NO: 1326335 - RNA, 23 nt, Homo sapiens
cuugcugcccgcgggagacagcu

SEQ ID NO: 1326336 - RNA, 23 nt, Homo sapiens
cuugcuuuccugggccuuugcaa

SEQ ID NO: 1326337 - RNA, 18 nt, Homo sapiens
cuuggacagcagccagcg

SEQ ID NO: 1326338 - RNA, 20 nt, Homo sapiens
cuuggagcuaaaacuggccc

SEQ ID NO: 1326339 - RNA, 20 nt, Homo sapiens
cuuggcaccagacacccagg

SEQ ID NO: 1326340 - RNA, 17 nt, Homo sapiens
cuuggccgacucaggga

SEQ ID NO: 1326341 - RNA, 17 nt, Homo sapiens
cuuggcugcuguaucuu

SEQ ID NO: 1326342 - RNA, 16 nt, Homo sapiens
cuuggcuuuaugcaaa

SEQ ID NO: 1326343 - RNA, 17 nt, Homo sapiens
cuuggcuuuaugcaaau

SEQ ID NO: 1326344 - RNA, 16 nt, Homo sapiens
cuugggaccgugccca

SEQ ID NO: 1326345 - RNA, 23 nt, Homo sapiens
cuugggcguuugaacucagggag

SEQ ID NO: 1326346 - RNA, 16 nt, Homo sapiens
cuugguaaucaugaaa

SEQ ID NO: 1326347 - RNA, 23 nt, Homo sapiens
cuuguaacuaaaauaauuuugua

SEQ ID NO: 1326348 - RNA, 19 nt, Homo sapiens
cuuguaaggcauacugccu

SEQ ID NO: 1326349 - RNA, 20 nt, Homo sapiens
cuugucccuuucccuaccuu

SEQ ID NO: 1326350 - RNA, 20 nt, Homo sapiens
cuugucugguaaguggcuuc

SEQ ID NO: 1326351 - RNA, 19 nt, Homo sapiens
cuugugucuuuggugggga

SEQ ID NO: 1326352 - RNA, 15 nt, Homo sapiens
cuuguguucugagua

SEQ ID NO: 1326353 - RNA, 13 nt, Homo sapiens
cuuguucuacuga

SEQ ID NO: 1326354 - RNA, 15 nt, Homo sapiens
cuuguucuacugaga

SEQ ID NO: 1326355 - RNA, 16 nt, Homo sapiens
cuuguucuacugagaa

SEQ ID NO: 1326356 - RNA, 21 nt, Homo sapiens
cuuuaaagcaggauuucucaa

SEQ ID NO: 1326357 - RNA, 21 nt, Homo sapiens
cuuuaaccccaaauuuggcua

SEQ ID NO: 1326358 - RNA, 22 nt, Homo sapiens
cuuuaaccccaaauuuggcuaa

SEQ ID NO: 1326359 - RNA, 21 nt, Homo sapiens
cuuuaagcagcgccagugaca

SEQ ID NO: 1326360 - RNA, 12 nt, Homo sapiens
cuuuaagugugc

SEQ ID NO: 1326361 - RNA, 20 nt, Homo sapiens
cuuuagaaaugucaguugcu

SEQ ID NO: 1326362 - RNA, 16 nt, Homo sapiens
cuuuagcuuaccuggg

SEQ ID NO: 1326363 - RNA, 17 nt, Homo sapiens
cuuuauagcacauggca

SEQ ID NO: 1326364 - RNA, 12 nt, Homo sapiens
cuuuaugcaaau

SEQ ID NO: 1326365 - RNA, 16 nt, Homo sapiens
cuuuaugcaaauacaa

SEQ ID NO: 1326366 - RNA, 22 nt, Homo sapiens
cuuuaugcaaauacaaucagcc

SEQ ID NO: 1326367 - RNA, 16 nt, Homo sapiens
cuuuauucacaguauc

SEQ ID NO: 1326368 - RNA, 22 nt, Homo sapiens
cuuucaaaagaagaguuuuaga

SEQ ID NO: 1326369 - RNA, 13 nt, Homo sapiens
cuuucaaaagccu

SEQ ID NO: 1326370 - RNA, 14 nt, Homo sapiens
cuuucaccuuucua

SEQ ID NO: 1326371 - RNA, 22 nt, Homo sapiens
aaacuguuuauuugcacuauga

SEQ ID NO: 1326372 - RNA, 18 nt, Homo sapiens
aaacuuaaaaguauucau

SEQ ID NO: 1326373 - RNA, 12 nt, Homo sapiens
aaacuucaccua

SEQ ID NO: 1326374 - RNA, 10 nt, Homo sapiens
aaacuugaau

SEQ ID NO: 1326375 - RNA, 11 nt, Homo sapiens
aaacuuucuaa

SEQ ID NO: 1326376 - RNA, 21 nt, Homo sapiens
aaacuuucucauaagcaccua

SEQ ID NO: 1326377 - RNA, 21 nt, Homo sapiens
aaacuuugauaggauguggau

SEQ ID NO: 1326378 - RNA, 13 nt, Homo sapiens
aaagaaccagaga

SEQ ID NO: 1326379 - RNA, 12 nt, Homo sapiens
aaagaacucuca

SEQ ID NO: 1326380 - RNA, 12 nt, Homo sapiens
aaagaacuguau

SEQ ID NO: 1326381 - RNA, 12 nt, Homo sapiens
aaagaagcuuug

SEQ ID NO: 1326382 - RNA, 18 nt, Homo sapiens
aaagacaccuacugagug

SEQ ID NO: 1326383 - RNA, 16 nt, Homo sapiens
aaagacagaagcuuaa

SEQ ID NO: 1326384 - RNA, 18 nt, Homo sapiens
aaagacaggguuucacca

SEQ ID NO: 1326385 - RNA, 17 nt, Homo sapiens
aaagacaucagucucca

SEQ ID NO: 1326386 - RNA, 20 nt, Homo sapiens
aaagaccaguuuccauuuau

SEQ ID NO: 1326387 - RNA, 22 nt, Homo sapiens
aaagaccuuuuccaugcacccu

SEQ ID NO: 1326388 - RNA, 17 nt, Homo sapiens
aaagacguugccuauaa

SEQ ID NO: 1326389 - RNA, 20 nt, Homo sapiens
aaagacugauuuugcuuuuu

SEQ ID NO: 1326390 - RNA, 22 nt, Homo sapiens
aaagacuugaauagacacuuca

SEQ ID NO: 1326391 - RNA, 23 nt, Homo sapiens
aaagagaaauauauuugucacuu

SEQ ID NO: 1326392 - RNA, 15 nt, Homo sapiens
aaagaggcagcuuga

SEQ ID NO: 1326393 - RNA, 15 nt, Homo sapiens
aaagagucacucaca

SEQ ID NO: 1326394 - RNA, 18 nt, Homo sapiens
aaagauaauuuauuucaa

SEQ ID NO: 1326395 - RNA, 16 nt, Homo sapiens
aaagauccuauagcuc

SEQ ID NO: 1326396 - RNA, 21 nt, Homo sapiens
aaagcaaaauacaucagcuug

SEQ ID NO: 1326397 - RNA, 13 nt, Homo sapiens
aaagcaaaggugc

SEQ ID NO: 1326398 - RNA, 18 nt, Homo sapiens
aaagcagacccaccuccc

SEQ ID NO: 1326399 - RNA, 15 nt, Homo sapiens
aaagcauaaaaaggu

SEQ ID NO: 1326400 - RNA, 18 nt, Homo sapiens
aaagcauaaaaagguuuu

SEQ ID NO: 1326401 - RNA, 21 nt, Homo sapiens
aaagcaucugagcuaacuuau

SEQ ID NO: 1326402 - RNA, 22 nt, Homo sapiens
aaagccacacucugggcuccag

SEQ ID NO: 1326403 - RNA, 16 nt, Homo sapiens
aaagccacaucuugcu

SEQ ID NO: 1326404 - RNA, 22 nt, Homo sapiens
aaagccagguuccacagaggac

SEQ ID NO: 1326405 - RNA, 23 nt, Homo sapiens
aaagcccucccuaccuaccaaga

SEQ ID NO: 1326406 - RNA, 15 nt, Homo sapiens
aaagcccuuccaugu

SEQ ID NO: 1326407 - RNA, 14 nt, Homo sapiens
aaagccuauuccau

SEQ ID NO: 1326408 - RNA, 24 nt, Homo sapiens
aaagccuccaaggguuucgacugg

SEQ ID NO: 1326409 - RNA, 22 nt, Homo sapiens
aaagccuugugugaacucacca

SEQ ID NO: 1326410 - RNA, 21 nt, Homo sapiens
aaagcggacaucagcugguca

SEQ ID NO: 1326411 - RNA, 19 nt, Homo sapiens
aaagcuacuauguacugcc

SEQ ID NO: 1326412 - RNA, 21 nt, Homo sapiens
aaagcuacuauguacugccuu

SEQ ID NO: 1326413 - RNA, 11 nt, Homo sapiens
aaagcugccau

SEQ ID NO: 1326414 - RNA, 12 nt, Homo sapiens
aaagcugccauu

SEQ ID NO: 1326415 - RNA, 13 nt, Homo sapiens
aaagcugccauuu

SEQ ID NO: 1326416 - RNA, 20 nt, Homo sapiens
aaaggaaacccagcucacag

SEQ ID NO: 1326417 - RNA, 22 nt, Homo sapiens
aaaggaaauguaaaagcacaug

SEQ ID NO: 1326418 - RNA, 22 nt, Homo sapiens
aaaggaagagcuauauccuuaa

SEQ ID NO: 1326419 - RNA, 16 nt, Homo sapiens
aaaggacaucagcaaa

SEQ ID NO: 1326420 - RNA, 15 nt, Homo sapiens
aaaggagucagagca

SEQ ID NO: 1326421 - RNA, 15 nt, Homo sapiens
aaaggauuuuaccaa

SEQ ID NO: 1326422 - RNA, 15 nt, Homo sapiens
aaaggcagugcaaua

SEQ ID NO: 1326423 - RNA, 13 nt, Homo sapiens
aaagggacuaccu

SEQ ID NO: 1326424 - RNA, 16 nt, Homo sapiens
aaagguacacugguau

SEQ ID NO: 1326425 - RNA, 16 nt, Homo sapiens
aaaggucaaaacugaa

SEQ ID NO: 1326426 - RNA, 19 nt, Homo sapiens
aaagguuuucuucauucau

SEQ ID NO: 1326427 - RNA, 15 nt, Homo sapiens
aaaguaaacgauaaa

SEQ ID NO: 1326428 - RNA, 16 nt, Homo sapiens
aaaguaagcauuucca

SEQ ID NO: 1326429 - RNA, 19 nt, Homo sapiens
aaaguaauuuaauuuguaa

SEQ ID NO: 1326430 - RNA, 15 nt, Homo sapiens
aaaguauaacauguc

SEQ ID NO: 1326431 - RNA, 17 nt, Homo sapiens
aaagucaaaguguugcu

SEQ ID NO: 1326432 - RNA, 12 nt, Homo sapiens
aaagucacuuac

SEQ ID NO: 1326433 - RNA, 19 nt, Homo sapiens
aaagucuguugauuaaaga

SEQ ID NO: 1326434 - RNA, 11 nt, Homo sapiens
aaagugacaug

SEQ ID NO: 1326435 - RNA, 15 nt, Homo sapiens
aaagugacaugcauu

SEQ ID NO: 1326436 - RNA, 11 nt, Homo sapiens
aaagugcagua

SEQ ID NO: 1326437 - RNA, 17 nt, Homo sapiens
aaaguuauuuaugcuau

SEQ ID NO: 1326438 - RNA, 12 nt, Homo sapiens
aaaguucuggaa

SEQ ID NO: 1326439 - RNA, 16 nt, Homo sapiens
aaaguugagcgucauu

SEQ ID NO: 1326440 - RNA, 22 nt, Homo sapiens
aaaguugguguagcagcaguug

SEQ ID NO: 1326441 - RNA, 13 nt, Homo sapiens
aaauaaauagugu

SEQ ID NO: 1326442 - RNA, 16 nt, Homo sapiens
aaauaaucaacugcau

SEQ ID NO: 1326443 - RNA, 19 nt, Homo sapiens
aaauaauguuugauaguaa

SEQ ID NO: 1326444 - RNA, 13 nt, Homo sapiens
aaauaauuucucu

SEQ ID NO: 1326445 - RNA, 12 nt, Homo sapiens
aaauacaaucag

SEQ ID NO: 1326446 - RNA, 14 nt, Homo sapiens
aaauacaaucagcc

SEQ ID NO: 1326447 - RNA, 16 nt, Homo sapiens
aaauacaaucagccca

SEQ ID NO: 1326448 - RNA, 20 nt, Homo sapiens
aaauuacugcccacuuguca

SEQ ID NO: 1326449 - RNA, 13 nt, Homo sapiens
aaauuaugugaca

SEQ ID NO: 1326450 - RNA, 14 nt, Homo sapiens
aaauuaugugacau

SEQ ID NO: 1326451 - RNA, 17 nt, Homo sapiens
aaauuauuucucucaca

SEQ ID NO: 1326452 - RNA, 14 nt, Homo sapiens
aaauucaggugcua

SEQ ID NO: 1326453 - RNA, 17 nt, Homo sapiens
aaauucauuugcuugca

SEQ ID NO: 1326454 - RNA, 22 nt, Homo sapiens
aaauucccaacuucucuugcuu

SEQ ID NO: 1326455 - RNA, 12 nt, Homo sapiens
aaauucuaccuc

SEQ ID NO: 1326456 - RNA, 15 nt, Homo sapiens
aaauucuucacaugu

SEQ ID NO: 1326457 - RNA, 19 nt, Homo sapiens
aaauugaaauaaagauaaa

SEQ ID NO: 1326458 - RNA, 15 nt, Homo sapiens
aaauugcuccuugac

SEQ ID NO: 1326459 - RNA, 15 nt, Homo sapiens
aaauuuaaugcugcc

SEQ ID NO: 1326460 - RNA, 15 nt, Homo sapiens
aaauuuaauuacaaa

SEQ ID NO: 1326461 - RNA, 19 nt, Homo sapiens
aaauuuauaaaggucugca

SEQ ID NO: 1326462 - RNA, 22 nt, Homo sapiens
aaauuucaggauuaacuaaaga

SEQ ID NO: 1326463 - RNA, 20 nt, Homo sapiens
aaauuucucaucacagggau

SEQ ID NO: 1326464 - RNA, 16 nt, Homo sapiens
aaauuugagagacaaa

SEQ ID NO: 1326465 - RNA, 14 nt, Homo sapiens
aaauuugauuuuga

SEQ ID NO: 1326466 - RNA, 22 nt, Homo sapiens
aaauuuugauuaaccuuuucaa

SEQ ID NO: 1326467 - RNA, 12 nt, Homo sapiens
aacaaagacauu

SEQ ID NO: 1326468 - RNA, 14 nt, Homo sapiens
aacaaagacuuuga

SEQ ID NO: 1326469 - RNA, 15 nt, Homo sapiens
aacaaauaauuuaga

SEQ ID NO: 1326470 - RNA, 19 nt, Homo sapiens
aacaaccuggucacaggac

SEQ ID NO: 1326471 - RNA, 14 nt, Homo sapiens
aacaagaauuggaa

SEQ ID NO: 1326472 - RNA, 13 nt, Homo sapiens
aacaagacagacu

SEQ ID NO: 1326473 - RNA, 22 nt, Homo sapiens
aacaagagaaguacuaucuuug

SEQ ID NO: 1326474 - RNA, 22 nt, Homo sapiens
aacaagguggugugaucuuaau

SEQ ID NO: 1326475 - RNA, 13 nt, Homo sapiens
aacaauccauuca

SEQ ID NO: 1326476 - RNA, 12 nt, Homo sapiens
aacaauggauau

SEQ ID NO: 1326477 - RNA, 23 nt, Homo sapiens
aacaauggauauugccuguguuu

SEQ ID NO: 1326478 - RNA, 13 nt, Homo sapiens
aacacagaacuga

SEQ ID NO: 1326479 - RNA, 11 nt, Homo sapiens
aacacaucugg

SEQ ID NO: 1326480 - RNA, 19 nt, Homo sapiens
aacaccaguguuagcuuaa

SEQ ID NO: 1326481 - RNA, 14 nt, Homo sapiens
aacacuaaacauuc

SEQ ID NO: 1326482 - RNA, 21 nt, Homo sapiens
aacagaaaccagaaaagcaau

SEQ ID NO: 1326483 - RNA, 16 nt, Homo sapiens
aacagaauuuuccauu

SEQ ID NO: 1326484 - RNA, 22 nt, Homo sapiens
aacagauaaucccuguauuuca

SEQ ID NO: 1326485 - RNA, 20 nt, Homo sapiens
aacagauucaggccagccca

SEQ ID NO: 1326486 - RNA, 20 nt, Homo sapiens
aacagauuuuguuggcauag

SEQ ID NO: 1326487 - RNA, 24 nt, Homo sapiens
aacagccaagcuggcacaaaagac

SEQ ID NO: 1326488 - RNA, 23 nt, Homo sapiens
aacagccuucuagcacacuuuuu

SEQ ID NO: 1326489 - RNA, 21 nt, Homo sapiens
aacaggaaaggagcaaugaag

SEQ ID NO: 1326490 - RNA, 23 nt, Homo sapiens
aacaggauacaggugacagugaa

SEQ ID NO: 1326491 - RNA, 18 nt, Homo sapiens
aacaggcuugaaucaaag

SEQ ID NO: 1326492 - RNA, 16 nt, Homo sapiens
aacaggguaccucaag

SEQ ID NO: 1326493 - RNA, 21 nt, Homo sapiens
aacagucaaacccauggagac

SEQ ID NO: 1326494 - RNA, 19 nt, Homo sapiens
aacagugguggcaacauuc

SEQ ID NO: 1326495 - RNA, 15 nt, Homo sapiens
aacauauguuugcuu

SEQ ID NO: 1326496 - RNA, 13 nt, Homo sapiens
aacaucaguuucu

SEQ ID NO: 1326497 - RNA, 17 nt, Homo sapiens
aacaucuggaguccuau

SEQ ID NO: 1326498 - RNA, 21 nt, Homo sapiens
aacaucuuggucagauuugaa

SEQ ID NO: 1326499 - RNA, 21 nt, Homo sapiens
aacaucuuuuuaaccugcaaa

SEQ ID NO: 1326500 - RNA, 18 nt, Homo sapiens
aacaugaagaaugcauuc

SEQ ID NO: 1326501 - RNA, 19 nt, Homo sapiens
aacaugccagccacuguga

SEQ ID NO: 1326502 - RNA, 22 nt, Homo sapiens
aacaugguaaacgcugucccua

SEQ ID NO: 1326503 - RNA, 12 nt, Homo sapiens
aacaugugaaaa

SEQ ID NO: 1326504 - RNA, 22 nt, Homo sapiens
aacauguuccuuauauuuacuc

SEQ ID NO: 1326505 - RNA, 20 nt, Homo sapiens
aacauuucuggacaguaccu

SEQ ID NO: 1326506 - RNA, 14 nt, Homo sapiens
aaccacagcacuau

SEQ ID NO: 1326507 - RNA, 22 nt, Homo sapiens
aaccacuaguugauguauggua

SEQ ID NO: 1326508 - RNA, 14 nt, Homo sapiens
aaccacuguacaca

SEQ ID NO: 1326509 - RNA, 16 nt, Homo sapiens
aaccagaaaagcaaua

SEQ ID NO: 1326510 - RNA, 23 nt, Homo sapiens
aaccagccagcgucccuugguga

SEQ ID NO: 1326511 - RNA, 15 nt, Homo sapiens
aaccagcccaaccau

SEQ ID NO: 1326512 - RNA, 17 nt, Homo sapiens
aaccagggcucuucuca

SEQ ID NO: 1326513 - RNA, 19 nt, Homo sapiens
aacccaccccgcuuucgua

SEQ ID NO: 1326514 - RNA, 21 nt, Homo sapiens
aacccugacuccucuuugugc

SEQ ID NO: 1326515 - RNA, 15 nt, Homo sapiens
aacccuuaacugaca

SEQ ID NO: 1326516 - RNA, 13 nt, Homo sapiens
aacccuugcacua

SEQ ID NO: 1326517 - RNA, 23 nt, Homo sapiens
aacccuuucauaaagucuugccu

SEQ ID NO: 1326518 - RNA, 21 nt, Homo sapiens
aaccucagccuggccagacac

SEQ ID NO: 1326519 - RNA, 13 nt, Homo sapiens
aaccuccacugcu

SEQ ID NO: 1326520 - RNA, 12 nt, Homo sapiens
aaccuccagugu

SEQ ID NO: 1326521 - RNA, 20 nt, Homo sapiens
aaccuccgccucccagguuc

SEQ ID NO: 1326522 - RNA, 17 nt, Homo sapiens
aaccucuaccagcacau

SEQ ID NO: 1326523 - RNA, 16 nt, Homo sapiens
aaccugaaauuaacuc

SEQ ID NO: 1326524 - RNA, 15 nt, Homo sapiens
aaccugaaauuccaa

SEQ ID NO: 1326525 - RNA, 20 nt, Homo sapiens
aaccugcaaagaucuguccu

SEQ ID NO: 1326526 - RNA, 22 nt, Homo sapiens
aaccugcaguacaacaguuuua

SEQ ID NO: 1326527 - RNA, 13 nt, Homo sapiens
aaccugcucuccu

SEQ ID NO: 1326528 - RNA, 17 nt, Homo sapiens
aaccugggaaggccagc

SEQ ID NO: 1326529 - RNA, 19 nt, Homo sapiens
aaccuggggugaauacuua

SEQ ID NO: 1326530 - RNA, 20 nt, Homo sapiens
aaccuuccacccagugcuga

SEQ ID NO: 1326531 - RNA, 20 nt, Homo sapiens
aaccuucuggccucccacag

SEQ ID NO: 1326532 - RNA, 18 nt, Homo sapiens
aaccuugaccgacaugaa

SEQ ID NO: 1326533 - RNA, 15 nt, Homo sapiens
aacgccgagugcacu

SEQ ID NO: 1326534 - RNA, 17 nt, Homo sapiens
aacgccgagugcacugc

SEQ ID NO: 1326535 - RNA, 14 nt, Homo sapiens
aacgugcaaagcca

SEQ ID NO: 1326536 - RNA, 19 nt, Homo sapiens
aacgugcaacuacuauuca

SEQ ID NO: 1326537 - RNA, 18 nt, Homo sapiens
aacguuugucauuccagu

SEQ ID NO: 1326538 - RNA, 13 nt, Homo sapiens
aacuaaaauguuc

SEQ ID NO: 1326539 - RNA, 15 nt, Homo sapiens
aacuaaaauguucua

SEQ ID NO: 1326540 - RNA, 18 nt, Homo sapiens
aacuaaagauacauaccu

SEQ ID NO: 1326541 - RNA, 18 nt, Homo sapiens
aacuaccauguggccauu

SEQ ID NO: 1326542 - RNA, 19 nt, Homo sapiens
aacuagcugggcacagugg

SEQ ID NO: 1326543 - RNA, 21 nt, Homo sapiens
aacuaguaaaaugcuggugaa

SEQ ID NO: 1326544 - RNA, 14 nt, Homo sapiens
aacuaugacagaua

SEQ ID NO: 1326545 - RNA, 15 nt, Homo sapiens
aacuauuaaggccuu

SEQ ID NO: 1326546 - RNA, 23 nt, Homo sapiens
aacucaaauggggccagauccag

SEQ ID NO: 1326547 - RNA, 17 nt, Homo sapiens
aacucaguuucuaggca

SEQ ID NO: 1326548 - RNA, 20 nt, Homo sapiens
aacuccauacuccacuccaa

SEQ ID NO: 1326549 - RNA, 22 nt, Homo sapiens
aacuccccucagggauacgaca

SEQ ID NO: 1326550 - RNA, 20 nt, Homo sapiens
aacuccgugcuuaaccaaag

SEQ ID NO: 1326551 - RNA, 14 nt, Homo sapiens
aacuccuacaugau

SEQ ID NO: 1326552 - RNA, 12 nt, Homo sapiens
aacucucuaggg

SEQ ID NO: 1326553 - RNA, 18 nt, Homo sapiens
aacucugugaucuugcuc

SEQ ID NO: 1326554 - RNA, 22 nt, Homo sapiens
aacucuugacuuccugccaugg

SEQ ID NO: 1326555 - RNA, 22 nt, Homo sapiens
aacucuuuaucaagcaacauuc

SEQ ID NO: 1326556 - RNA, 17 nt, Homo sapiens
aacugacauugcuccaa

SEQ ID NO: 1326557 - RNA, 22 nt, Homo sapiens
aacugaguuuaagggggacuua

SEQ ID NO: 1326558 - RNA, 17 nt, Homo sapiens
aacugauuacguuuaca

SEQ ID NO: 1326559 - RNA, 17 nt, Homo sapiens
aacugcugaauucaccu

SEQ ID NO: 1326560 - RNA, 19 nt, Homo sapiens
aacuggaaaggaucuguga

SEQ ID NO: 1326561 - RNA, 15 nt, Homo sapiens
aacuggcccuguuuc

SEQ ID NO: 1326562 - RNA, 17 nt, Homo sapiens
aacugggcucaagugau

SEQ ID NO: 1326563 - RNA, 24 nt, Homo sapiens
aacuggugcaugacaaguacugua

SEQ ID NO: 1326564 - RNA, 22 nt, Homo sapiens
aacugguuaaacauuaauauuu

SEQ ID NO: 1326565 - RNA, 19 nt, Homo sapiens
aacugguuugccuauaauu

SEQ ID NO: 1326566 - RNA, 19 nt, Homo sapiens
aacugugcuguacugagca

SEQ ID NO: 1326567 - RNA, 15 nt, Homo sapiens
aacuguucaaacuca

SEQ ID NO: 1326568 - RNA, 16 nt, Homo sapiens
aacuguuucccugcug

SEQ ID NO: 1326569 - RNA, 13 nt, Homo sapiens
aacuuaacuauca

SEQ ID NO: 1326570 - RNA, 22 nt, Homo sapiens
aacuucaccuacauuaucucac

SEQ ID NO: 1326571 - RNA, 23 nt, Homo sapiens
aacuucagagcaugaaaaucaca

SEQ ID NO: 1326572 - RNA, 13 nt, Homo sapiens
aacuucagugugg

SEQ ID NO: 1326573 - RNA, 19 nt, Homo sapiens
aacuucagugugguacaag

SEQ ID NO: 1326574 - RNA, 15 nt, Homo sapiens
aacuuccaauuuaca

SEQ ID NO: 1326575 - RNA, 15 nt, Homo sapiens
aacuugaaacagauu

SEQ ID NO: 1326576 - RNA, 20 nt, Homo sapiens
aacuugauguguuaucucuu

SEQ ID NO: 1326577 - RNA, 17 nt, Homo sapiens
aacuugcacuuguuaua

SEQ ID NO: 1326578 - RNA, 17 nt, Homo sapiens
aacuuuaaaacugcuca

SEQ ID NO: 1326579 - RNA, 19 nt, Homo sapiens
aacuuugauaggaugugga

SEQ ID NO: 1326580 - RNA, 15 nt, Homo sapiens
acucagaaaauuccc

SEQ ID NO: 1326581 - RNA, 21 nt, Homo sapiens
acucagccuuuugaugucuuu

SEQ ID NO: 1326582 - RNA, 16 nt, Homo sapiens
acucaggauccaguga

SEQ ID NO: 1326583 - RNA, 16 nt, Homo sapiens
acucaggggaccccac

SEQ ID NO: 1326584 - RNA, 22 nt, Homo sapiens
acucagguaccucuuucagggu

SEQ ID NO: 1326585 - RNA, 15 nt, Homo sapiens
acucauauguggaau

SEQ ID NO: 1326586 - RNA, 16 nt, Homo sapiens
acucauuagugacuuc

SEQ ID NO: 1326587 - RNA, 20 nt, Homo sapiens
acuccaagugccccaccacu

SEQ ID NO: 1326588 - RNA, 20 nt, Homo sapiens
acuccagauuuuuuacagcu

SEQ ID NO: 1326589 - RNA, 21 nt, Homo sapiens
acuccagauuuuuuacagcug

SEQ ID NO: 1326590 - RNA, 21 nt, Homo sapiens
acuccagccugggcgacaaaa

SEQ ID NO: 1326591 - RNA, 15 nt, Homo sapiens
acucccacuuggcau

SEQ ID NO: 1326592 - RNA, 20 nt, Homo sapiens
acuccccagagcugugccag

SEQ ID NO: 1326593 - RNA, 16 nt, Homo sapiens
acucccccucuuucac

SEQ ID NO: 1326594 - RNA, 19 nt, Homo sapiens
acuccucuguccaggcacu

SEQ ID NO: 1326595 - RNA, 18 nt, Homo sapiens
acuccugggacacuccgu

SEQ ID NO: 1326596 - RNA, 12 nt, Homo sapiens
acucgacccaga

SEQ ID NO: 1326597 - RNA, 18 nt, Homo sapiens
acucuaggcagugacagu

SEQ ID NO: 1326598 - RNA, 11 nt, Homo sapiens
acucucuaggg

SEQ ID NO: 1326599 - RNA, 11 nt, Homo sapiens
acucucugaac

SEQ ID NO: 1326600 - RNA, 21 nt, Homo sapiens
acucuggagguuuguuuagaa

SEQ ID NO: 1326601 - RNA, 21 nt, Homo sapiens
acucuggcuucaaaaagccac

SEQ ID NO: 1326602 - RNA, 22 nt, Homo sapiens
acucuggcuucaaaaagccaca

SEQ ID NO: 1326603 - RNA, 12 nt, Homo sapiens
acucugucuugu

SEQ ID NO: 1326604 - RNA, 23 nt, Homo sapiens
acucuguuugaagaaaauaguca

SEQ ID NO: 1326605 - RNA, 19 nt, Homo sapiens
acucuuaacuuacgaucuc

SEQ ID NO: 1326606 - RNA, 21 nt, Homo sapiens
acucuuccuuccuaauaggca

SEQ ID NO: 1326607 - RNA, 14 nt, Homo sapiens
acucuugaucucuc

SEQ ID NO: 1326608 - RNA, 16 nt, Homo sapiens
acucuugaucucucuu

SEQ ID NO: 1326609 - RNA, 20 nt, Homo sapiens
acugaaaaaucuaagugaua

SEQ ID NO: 1326610 - RNA, 12 nt, Homo sapiens
acugaaacugga

SEQ ID NO: 1326611 - RNA, 13 nt, Homo sapiens
acugaaacuggaa

SEQ ID NO: 1326612 - RNA, 14 nt, Homo sapiens
acugaaagugaaag

SEQ ID NO: 1326613 - RNA, 17 nt, Homo sapiens
acugaaccacauucagg

SEQ ID NO: 1326614 - RNA, 15 nt, Homo sapiens
acugaaccaggguau

SEQ ID NO: 1326615 - RNA, 12 nt, Homo sapiens
acugaagcuuuu

SEQ ID NO: 1326616 - RNA, 21 nt, Homo sapiens
acugaaguuuuugaaauaccu

SEQ ID NO: 1326617 - RNA, 19 nt, Homo sapiens
acugaauuagggugggcuc

SEQ ID NO: 1326618 - RNA, 21 nt, Homo sapiens
acugacagacuuagaaccuga

SEQ ID NO: 1326619 - RNA, 15 nt, Homo sapiens
acugacagggagcag

SEQ ID NO: 1326620 - RNA, 16 nt, Homo sapiens
acugaccagccuccau

SEQ ID NO: 1326621 - RNA, 20 nt, Homo sapiens
acugacccccaucugagcug

SEQ ID NO: 1326622 - RNA, 14 nt, Homo sapiens
acugacccucaggc

SEQ ID NO: 1326623 - RNA, 17 nt, Homo sapiens
acugacugaaugcuguu

SEQ ID NO: 1326624 - RNA, 19 nt, Homo sapiens
acugagaagugcacuuuaa

SEQ ID NO: 1326625 - RNA, 14 nt, Homo sapiens
acugagcacugaac

SEQ ID NO: 1326626 - RNA, 17 nt, Homo sapiens
acugagguuuacauacg

SEQ ID NO: 1326627 - RNA, 12 nt, Homo sapiens
acugaugcugcc

SEQ ID NO: 1326628 - RNA, 17 nt, Homo sapiens
acugauuacguuuacau

SEQ ID NO: 1326629 - RNA, 14 nt, Homo sapiens
acugauuuaucuau

SEQ ID NO: 1326630 - RNA, 17 nt, Homo sapiens
acugcaggaccuccagc

SEQ ID NO: 1326631 - RNA, 20 nt, Homo sapiens
acugcauaccaaccugggca

SEQ ID NO: 1326632 - RNA, 19 nt, Homo sapiens
acugcaugggcugugggcu

SEQ ID NO: 1326633 - RNA, 12 nt, Homo sapiens
acugccaagaaa

SEQ ID NO: 1326634 - RNA, 16 nt, Homo sapiens
acugccaggcugccuc

SEQ ID NO: 1326635 - RNA, 23 nt, Homo sapiens
acugccccccugccuugcucccc

SEQ ID NO: 1326636 - RNA, 17 nt, Homo sapiens
acugcccccuccacugg

SEQ ID NO: 1326637 - RNA, 13 nt, Homo sapiens
acugcccuaagcc

SEQ ID NO: 1326638 - RNA, 13 nt, Homo sapiens
acugcucauuuca

SEQ ID NO: 1326639 - RNA, 19 nt, Homo sapiens
acugcucguggacugugcu

SEQ ID NO: 1326640 - RNA, 21 nt, Homo sapiens
acugcucuauaaauaguauuc

SEQ ID NO: 1326641 - RNA, 20 nt, Homo sapiens
acugcucuccuccaccucaa

SEQ ID NO: 1326642 - RNA, 13 nt, Homo sapiens
acugcugaauuca

SEQ ID NO: 1326643 - RNA, 16 nt, Homo sapiens
acugcugggcuuggca

SEQ ID NO: 1326644 - RNA, 13 nt, Homo sapiens
acugcuguagaca

SEQ ID NO: 1326645 - RNA, 20 nt, Homo sapiens
acugcuguagacauuugcua

SEQ ID NO: 1326646 - RNA, 22 nt, Homo sapiens
acugcuucaaucucaauugcuu

SEQ ID NO: 1326647 - RNA, 22 nt, Homo sapiens
acuggaaaaucuucuagcaugu

SEQ ID NO: 1326648 - RNA, 21 nt, Homo sapiens
acuggaaauugaaauaaagau

SEQ ID NO: 1326649 - RNA, 20 nt, Homo sapiens
acuggaacguuucacugcaa

SEQ ID NO: 1326650 - RNA, 21 nt, Homo sapiens
acuggaacguuucacugcaaa

SEQ ID NO: 1326651 - RNA, 12 nt, Homo sapiens
acuggaccucag

SEQ ID NO: 1326652 - RNA, 19 nt, Homo sapiens
acuggcacacuggccucca

SEQ ID NO: 1326653 - RNA, 22 nt, Homo sapiens
acuggcagggacgaggacaaau

SEQ ID NO: 1326654 - RNA, 15 nt, Homo sapiens
acuggcaugggagac

SEQ ID NO: 1326655 - RNA, 19 nt, Homo sapiens
acugggcaaugauggcaau

SEQ ID NO: 1326656 - RNA, 12 nt, Homo sapiens
acugggugacca

SEQ ID NO: 1326657 - RNA, 22 nt, Homo sapiens
acuggugcaugacaaguacugu

SEQ ID NO: 1326658 - RNA, 15 nt, Homo sapiens
acugguuaccuggag

SEQ ID NO: 1326659 - RNA, 19 nt, Homo sapiens
acugguuugcagugaauuu

SEQ ID NO: 1326660 - RNA, 22 nt, Homo sapiens
acuguacacagaauuguuccag

SEQ ID NO: 1326661 - RNA, 13 nt, Homo sapiens
acuguacuccucc

SEQ ID NO: 1326662 - RNA, 19 nt, Homo sapiens
acuguaggcacacuuugca

SEQ ID NO: 1326663 - RNA, 20 nt, Homo sapiens
acuguaguaauuguuacaau

SEQ ID NO: 1326664 - RNA, 15 nt, Homo sapiens
acuugccuaucugac

SEQ ID NO: 1326665 - RNA, 17 nt, Homo sapiens
acuugcugauccaugag

SEQ ID NO: 1326666 - RNA, 14 nt, Homo sapiens
acuuggagcuaaaa

SEQ ID NO: 1326667 - RNA, 18 nt, Homo sapiens
acuuggagcuaaaacugg

SEQ ID NO: 1326668 - RNA, 14 nt, Homo sapiens
acuuggcugcauuu

SEQ ID NO: 1326669 - RNA, 18 nt, Homo sapiens
acuuguauagcaugaaau

SEQ ID NO: 1326670 - RNA, 14 nt, Homo sapiens
acuuguucuugaua

SEQ ID NO: 1326671 - RNA, 21 nt, Homo sapiens
acuuuaaaacugcucauuuca

SEQ ID NO: 1326672 - RNA, 21 nt, Homo sapiens
acuuuaucaauuaacugagua

SEQ ID NO: 1326673 - RNA, 12 nt, Homo sapiens
acuuuauugcca

SEQ ID NO: 1326674 - RNA, 23 nt, Homo sapiens
acuuuccgagccuccaguccaaa

SEQ ID NO: 1326675 - RNA, 14 nt, Homo sapiens
acuuucucaaugcu

SEQ ID NO: 1326676 - RNA, 20 nt, Homo sapiens
acuuucucuucuacacagca

SEQ ID NO: 1326677 - RNA, 18 nt, Homo sapiens
acuuucuucucuuuccca

SEQ ID NO: 1326678 - RNA, 19 nt, Homo sapiens
acuuucuucucuuucccaa

SEQ ID NO: 1326679 - RNA, 15 nt, Homo sapiens
acuuugcacagcucu

SEQ ID NO: 1326680 - RNA, 14 nt, Homo sapiens
acuuugcacugaua

SEQ ID NO: 1326681 - RNA, 22 nt, Homo sapiens
acuuugcugucaaaacuacuga

SEQ ID NO: 1326682 - RNA, 23 nt, Homo sapiens
acuuugcugucaaaacuacugac

SEQ ID NO: 1326683 - RNA, 20 nt, Homo sapiens
acuuuguauaugaaucaaaa

SEQ ID NO: 1326684 - RNA, 13 nt, Homo sapiens
acuuuuaauguca

SEQ ID NO: 1326685 - RNA, 14 nt, Homo sapiens
acuuuuauuaaaga

SEQ ID NO: 1326686 - RNA, 15 nt, Homo sapiens
acuuuucucaauauu

SEQ ID NO: 1326687 - RNA, 13 nt, Homo sapiens
acuuuugcuugaa

SEQ ID NO: 1326688 - RNA, 23 nt, Homo sapiens
acuuuugggcguaagaccaaaug

SEQ ID NO: 1326689 - RNA, 20 nt, Homo sapiens
agaaaaauauauacuaaaca

SEQ ID NO: 1326690 - RNA, 16 nt, Homo sapiens
agaaaacauaacugau

SEQ ID NO: 1326691 - RNA, 17 nt, Homo sapiens
agaaaagcaauacuguu

SEQ ID NO: 1326692 - RNA, 16 nt, Homo sapiens
agaaaagcaguggcuc

SEQ ID NO: 1326693 - RNA, 19 nt, Homo sapiens
agaaaagcaguggcuccau

SEQ ID NO: 1326694 - RNA, 19 nt, Homo sapiens
agaaaagcccaaguucaug

SEQ ID NO: 1326695 - RNA, 17 nt, Homo sapiens
agaaaauagagcuuuua

SEQ ID NO: 1326696 - RNA, 19 nt, Homo sapiens
agaaaaucaaauauauaac

SEQ ID NO: 1326697 - RNA, 23 nt, Homo sapiens
agaaaaugacuuauuucugcucu

SEQ ID NO: 1326698 - RNA, 14 nt, Homo sapiens
agaaacaagcugug

SEQ ID NO: 1326699 - RNA, 23 nt, Homo sapiens
agaaaccaagugcgcuuugcaau

SEQ ID NO: 1326700 - RNA, 14 nt, Homo sapiens
agaaagacuauuca

SEQ ID NO: 1326701 - RNA, 15 nt, Homo sapiens
agaaauaaaugaaac

SEQ ID NO: 1326702 - RNA, 23 nt, Homo sapiens
agaaaugucauguggcuaccugu

SEQ ID NO: 1326703 - RNA, 18 nt, Homo sapiens
agaacauuccauuugcuu

SEQ ID NO: 1326704 - RNA, 20 nt, Homo sapiens
agaaccucuaagugcugcug

SEQ ID NO: 1326705 - RNA, 16 nt, Homo sapiens
agaacguggcucugcu

SEQ ID NO: 1326706 - RNA, 15 nt, Homo sapiens
agaacguggugaccu

SEQ ID NO: 1326707 - RNA, 23 nt, Homo sapiens
agaacguggugaccuuucacgaa

SEQ ID NO: 1326708 - RNA, 16 nt, Homo sapiens
agaacuucaagcucuc

SEQ ID NO: 1326709 - RNA, 16 nt, Homo sapiens
agaacuuuuucacuuc

SEQ ID NO: 1326710 - RNA, 17 nt, Homo sapiens
agaagcaagacacgugg

SEQ ID NO: 1326711 - RNA, 21 nt, Homo sapiens
agaagcaaugggucuuagcuc

SEQ ID NO: 1326712 - RNA, 16 nt, Homo sapiens
agaagccaacuaugau

SEQ ID NO: 1326713 - RNA, 22 nt, Homo sapiens
agaagcuaccccucaaacugca

SEQ ID NO: 1326714 - RNA, 11 nt, Homo sapiens
agaagcuuugu

SEQ ID NO: 1326715 - RNA, 22 nt, Homo sapiens
agaagggauaucuacugugguc

SEQ ID NO: 1326716 - RNA, 18 nt, Homo sapiens
agaagggcaaauauuuau

SEQ ID NO: 1326717 - RNA, 14 nt, Homo sapiens
agaagguaaggugu

SEQ ID NO: 1326718 - RNA, 18 nt, Homo sapiens
agaagguggaaggcagug

SEQ ID NO: 1326719 - RNA, 22 nt, Homo sapiens
agaagguggaaggcaguguuau

SEQ ID NO: 1326720 - RNA, 14 nt, Homo sapiens
agaagguugcucua

SEQ ID NO: 1326721 - RNA, 12 nt, Homo sapiens
agaaguacuauc

SEQ ID NO: 1326722 - RNA, 21 nt, Homo sapiens
agaaguggcauaaaugucuaa

SEQ ID NO: 1326723 - RNA, 18 nt, Homo sapiens
agaauacccuaaaguaua

SEQ ID NO: 1326724 - RNA, 18 nt, Homo sapiens
agaaucuuccuggcacaa

SEQ ID NO: 1326725 - RNA, 16 nt, Homo sapiens
agaaugcuuuaauguc

SEQ ID NO: 1326726 - RNA, 20 nt, Homo sapiens
agaaugucaauaaauuugcu

SEQ ID NO: 1326727 - RNA, 17 nt, Homo sapiens
agaaugucauggaagag

SEQ ID NO: 1326728 - RNA, 12 nt, Homo sapiens
agaauuaucuca

SEQ ID NO: 1326729 - RNA, 21 nt, Homo sapiens
agaauucaaguggguauucug

SEQ ID NO: 1326730 - RNA, 13 nt, Homo sapiens
agaauugcucaaa

SEQ ID NO: 1326731 - RNA, 15 nt, Homo sapiens
agacaaagccuuaag

SEQ ID NO: 1326732 - RNA, 18 nt, Homo sapiens
agacaaggucuugcuaug

SEQ ID NO: 1326733 - RNA, 18 nt, Homo sapiens
agacacguggccucguga

SEQ ID NO: 1326734 - RNA, 23 nt, Homo sapiens
agacacucccacuuggcaucauu

SEQ ID NO: 1326735 - RNA, 22 nt, Homo sapiens
agacacugaaaaaucuaaguga

SEQ ID NO: 1326736 - RNA, 15 nt, Homo sapiens
agacacuucaccaaa

SEQ ID NO: 1326737 - RNA, 18 nt, Homo sapiens
agacagacaacacuggga

SEQ ID NO: 1326738 - RNA, 20 nt, Homo sapiens
agacagauucuucacugugu

SEQ ID NO: 1326739 - RNA, 16 nt, Homo sapiens
agacagcagggacaag

SEQ ID NO: 1326740 - RNA, 21 nt, Homo sapiens
agacagcuggcggaggcugcu

SEQ ID NO: 1326741 - RNA, 14 nt, Homo sapiens
agacaguucaagaa

SEQ ID NO: 1326742 - RNA, 15 nt, Homo sapiens
agacaguucaagaaa

SEQ ID NO: 1326743 - RNA, 21 nt, Homo sapiens
agacauaaacaaagacauuga

SEQ ID NO: 1326744 - RNA, 13 nt, Homo sapiens
agacauacuugaa

SEQ ID NO: 1326745 - RNA, 21 nt, Homo sapiens
agacauacuugaagggccaga

SEQ ID NO: 1326746 - RNA, 13 nt, Homo sapiens
agacauuccacca

SEQ ID NO: 1326747 - RNA, 21 nt, Homo sapiens
agacauuggcaccuaauccag

SEQ ID NO: 1326748 - RNA, 16 nt, Homo sapiens
aguaacaguuugauau

SEQ ID NO: 1326749 - RNA, 18 nt, Homo sapiens
aguaagcauuuccagccu

SEQ ID NO: 1326750 - RNA, 23 nt, Homo sapiens
aguaagcauuuccagccuaucua

SEQ ID NO: 1326751 - RNA, 13 nt, Homo sapiens
aguaagugaacua

SEQ ID NO: 1326752 - RNA, 15 nt, Homo sapiens
aguaaguuuauccaa

SEQ ID NO: 1326753 - RNA, 23 nt, Homo sapiens
aguaauguugacuguauuuucca

SEQ ID NO: 1326754 - RNA, 12 nt, Homo sapiens
aguacagucuua

SEQ ID NO: 1326755 - RNA, 19 nt, Homo sapiens
aguacaugauaaaugauag

SEQ ID NO: 1326756 - RNA, 22 nt, Homo sapiens
aguaccuuuuccuacacagcgg

SEQ ID NO: 1326757 - RNA, 23 nt, Homo sapiens
aguagaaguuacuuaauugccag

SEQ ID NO: 1326758 - RNA, 18 nt, Homo sapiens
aguagauauugauuacua

SEQ ID NO: 1326759 - RNA, 13 nt, Homo sapiens
aguagcacgcccu

SEQ ID NO: 1326760 - RNA, 16 nt, Homo sapiens
aguagcuggauuacag

SEQ ID NO: 1326761 - RNA, 18 nt, Homo sapiens
aguagcugggaugacagg

SEQ ID NO: 1326762 - RNA, 23 nt, Homo sapiens
aguaggauuuugagggugggggu

SEQ ID NO: 1326763 - RNA, 20 nt, Homo sapiens
aguaggugggggaacacuga

SEQ ID NO: 1326764 - RNA, 22 nt, Homo sapiens
aguaggugggggaacacugaga

SEQ ID NO: 1326765 - RNA, 22 nt, Homo sapiens
aguaguauuugccuauuucccc

SEQ ID NO: 1326766 - RNA, 18 nt, Homo sapiens
aguagugcaccaucucac

SEQ ID NO: 1326767 - RNA, 16 nt, Homo sapiens
aguaguuucauuuccu

SEQ ID NO: 1326768 - RNA, 12 nt, Homo sapiens
aguauaacaguu

SEQ ID NO: 1326769 - RNA, 13 nt, Homo sapiens
aguauaacauguc

SEQ ID NO: 1326770 - RNA, 24 nt, Homo sapiens
aguauauuuuugucugcagcuguu

SEQ ID NO: 1326771 - RNA, 15 nt, Homo sapiens
aguauccucuugcca

SEQ ID NO: 1326772 - RNA, 14 nt, Homo sapiens
aguaucugcuguuc

SEQ ID NO: 1326773 - RNA, 15 nt, Homo sapiens
aguaugugaagauau

SEQ ID NO: 1326774 - RNA, 19 nt, Homo sapiens
aguauuggcauucaaaaag

SEQ ID NO: 1326775 - RNA, 17 nt, Homo sapiens
aguauugucgguuaccu

SEQ ID NO: 1326776 - RNA, 18 nt, Homo sapiens
aguauuuuaauccuguac

SEQ ID NO: 1326777 - RNA, 13 nt, Homo sapiens
agucaaauccagu

SEQ ID NO: 1326778 - RNA, 22 nt, Homo sapiens
agucaacagagaggggcaggga

SEQ ID NO: 1326779 - RNA, 17 nt, Homo sapiens
agucacugacaguuaau

SEQ ID NO: 1326780 - RNA, 15 nt, Homo sapiens
agucagacugauaga

SEQ ID NO: 1326781 - RNA, 20 nt, Homo sapiens
agucagacugauagacacca

SEQ ID NO: 1326782 - RNA, 19 nt, Homo sapiens
agucagggaaggugccucu

SEQ ID NO: 1326783 - RNA, 19 nt, Homo sapiens
agucauuggcaaagugaca

SEQ ID NO: 1326784 - RNA, 13 nt, Homo sapiens
aguccacucccag

SEQ ID NO: 1326785 - RNA, 13 nt, Homo sapiens
aguccacugcuga

SEQ ID NO: 1326786 - RNA, 18 nt, Homo sapiens
aguccacugcugaggaca

SEQ ID NO: 1326787 - RNA, 16 nt, Homo sapiens
agucccacacugugca

SEQ ID NO: 1326788 - RNA, 16 nt, Homo sapiens
agucccacacuguggc

SEQ ID NO: 1326789 - RNA, 16 nt, Homo sapiens
agucccagcuacucag

SEQ ID NO: 1326790 - RNA, 18 nt, Homo sapiens
agucccuuugugacuuca

SEQ ID NO: 1326791 - RNA, 14 nt, Homo sapiens
aguccuguacugua

SEQ ID NO: 1326792 - RNA, 22 nt, Homo sapiens
agucgaccccaaaggaacacug

SEQ ID NO: 1326793 - RNA, 22 nt, Homo sapiens
agucuaaaaaaggaauccucug

SEQ ID NO: 1326794 - RNA, 12 nt, Homo sapiens
agucuauucugu

SEQ ID NO: 1326795 - RNA, 22 nt, Homo sapiens
agucucuggaaaaagacugauu

SEQ ID NO: 1326796 - RNA, 21 nt, Homo sapiens
agucugacccuuacagccucu

SEQ ID NO: 1326797 - RNA, 15 nt, Homo sapiens
agucugauaaacuga

SEQ ID NO: 1326798 - RNA, 16 nt, Homo sapiens
agucuucacuaaccuu

SEQ ID NO: 1326799 - RNA, 15 nt, Homo sapiens
agugaaaacuuugua

SEQ ID NO: 1326800 - RNA, 17 nt, Homo sapiens
agugaaacuccgucuca

SEQ ID NO: 1326801 - RNA, 22 nt, Homo sapiens
agugaaauaauagaaugagcac

SEQ ID NO: 1326802 - RNA, 22 nt, Homo sapiens
agugaauacauuaacggugcua

SEQ ID NO: 1326803 - RNA, 18 nt, Homo sapiens
agugacaacaucgcaaua

SEQ ID NO: 1326804 - RNA, 14 nt, Homo sapiens
agugaccagugccu

SEQ ID NO: 1326805 - RNA, 16 nt, Homo sapiens
agugacuccaggguga

SEQ ID NO: 1326806 - RNA, 14 nt, Homo sapiens
agugacuccugcug

SEQ ID NO: 1326807 - RNA, 13 nt, Homo sapiens
agugagacagacu

SEQ ID NO: 1326808 - RNA, 23 nt, Homo sapiens
agugagcacacccgugugcacac

SEQ ID NO: 1326809 - RNA, 11 nt, Homo sapiens
agugaguucaa

SEQ ID NO: 1326810 - RNA, 16 nt, Homo sapiens
agugauagagugcagu

SEQ ID NO: 1326811 - RNA, 19 nt, Homo sapiens
agugauagagugcagugau

SEQ ID NO: 1326812 - RNA, 16 nt, Homo sapiens
agugaugaaccagagu

SEQ ID NO: 1326813 - RNA, 18 nt, Homo sapiens
agugcaauaaaucugacc

SEQ ID NO: 1326814 - RNA, 13 nt, Homo sapiens
agugcaccugccu

SEQ ID NO: 1326815 - RNA, 21 nt, Homo sapiens
agugcacugcauuccugugcc

SEQ ID NO: 1326816 - RNA, 20 nt, Homo sapiens
agugcaguuugguguguccu

SEQ ID NO: 1326817 - RNA, 17 nt, Homo sapiens
agugcccucgagcacug

SEQ ID NO: 1326818 - RNA, 21 nt, Homo sapiens
agugcccucgagcacugaagu

SEQ ID NO: 1326819 - RNA, 18 nt, Homo sapiens
agugcuauuugcauuucu

SEQ ID NO: 1326820 - RNA, 16 nt, Homo sapiens
agugcucacaaaggau

SEQ ID NO: 1326821 - RNA, 21 nt, Homo sapiens
agugcugggauuauaggcaug

SEQ ID NO: 1326822 - RNA, 18 nt, Homo sapiens
agugcuugcaagauucca

SEQ ID NO: 1326823 - RNA, 17 nt, Homo sapiens
aguggaugccugcugca

SEQ ID NO: 1326824 - RNA, 20 nt, Homo sapiens
aguggcgcgaucucggcuca

SEQ ID NO: 1326825 - RNA, 12 nt, Homo sapiens
aguggcuucucu

SEQ ID NO: 1326826 - RNA, 15 nt, Homo sapiens
aguggcuucuuucca

SEQ ID NO: 1326827 - RNA, 18 nt, Homo sapiens
agugggaagggagcauug

SEQ ID NO: 1326828 - RNA, 20 nt, Homo sapiens
agugggagcugagcuggaag

SEQ ID NO: 1326829 - RNA, 22 nt, Homo sapiens
agugggccccgggcuggagaaa

SEQ ID NO: 1326830 - RNA, 19 nt, Homo sapiens
aguggggagacuucuuggc

SEQ ID NO: 1326831 - RNA, 16 nt, Homo sapiens
aguggggugcucuggu

SEQ ID NO: 1326832 - RNA, 22 nt, Homo sapiens
agugguaaaaguauuugcuuaa

SEQ ID NO: 1326833 - RNA, 14 nt, Homo sapiens
aguggucacuguca

SEQ ID NO: 1326834 - RNA, 21 nt, Homo sapiens
agugguguuuagaaugucagu

SEQ ID NO: 1326835 - RNA, 17 nt, Homo sapiens
aguguaugauuacuggc

SEQ ID NO: 1326836 - RNA, 23 nt, Homo sapiens
agugucaccccucacugugacug

SEQ ID NO: 1326837 - RNA, 19 nt, Homo sapiens
aguguccuuuccagagcaa

SEQ ID NO: 1326838 - RNA, 13 nt, Homo sapiens
agugugaauucac

SEQ ID NO: 1326839 - RNA, 19 nt, Homo sapiens
agugugagauacuguguau

SEQ ID NO: 1326840 - RNA, 18 nt, Homo sapiens
aguguucacaacagugaa

SEQ ID NO: 1326841 - RNA, 20 nt, Homo sapiens
aguguucacauggcucucau

SEQ ID NO: 1326842 - RNA, 15 nt, Homo sapiens
aguguucugcuccug

SEQ ID NO: 1326843 - RNA, 22 nt, Homo sapiens
aguguucuuugcauuucugucc

SEQ ID NO: 1326844 - RNA, 22 nt, Homo sapiens
aguuaccuuauaguuacugugu

SEQ ID NO: 1326845 - RNA, 21 nt, Homo sapiens
aguuacucccuacacugaugc

SEQ ID NO: 1326846 - RNA, 20 nt, Homo sapiens
aguuaugccucugacagucc

SEQ ID NO: 1326847 - RNA, 20 nt, Homo sapiens
aguuauggcuucacauucau

SEQ ID NO: 1326848 - RNA, 21 nt, Homo sapiens
aguucagggaccguccagggg

SEQ ID NO: 1326849 - RNA, 13 nt, Homo sapiens
aguucaucuugca

SEQ ID NO: 1326850 - RNA, 18 nt, Homo sapiens
aguucugaauaacuugaa

SEQ ID NO: 1326851 - RNA, 19 nt, Homo sapiens
aguucugacgcugacaaua

SEQ ID NO: 1326852 - RNA, 17 nt, Homo sapiens
aguucuuacacauucca

SEQ ID NO: 1326853 - RNA, 18 nt, Homo sapiens
aguucuuugggccagaca

SEQ ID NO: 1326854 - RNA, 16 nt, Homo sapiens
aguugaaaaugcaacu

SEQ ID NO: 1326855 - RNA, 14 nt, Homo sapiens
aguugaagaucuuu

SEQ ID NO: 1326856 - RNA, 15 nt, Homo sapiens
aguugaucagacuga

SEQ ID NO: 1326857 - RNA, 13 nt, Homo sapiens
aguugaucuggaa

SEQ ID NO: 1326858 - RNA, 19 nt, Homo sapiens
aguugaucuggaacccaga

SEQ ID NO: 1326859 - RNA, 19 nt, Homo sapiens
aguugcagccagggccagu

SEQ ID NO: 1326860 - RNA, 23 nt, Homo sapiens
aguugccacauuuaguccuguac

SEQ ID NO: 1326861 - RNA, 21 nt, Homo sapiens
aguugccuuuauuugcuguua

SEQ ID NO: 1326862 - RNA, 14 nt, Homo sapiens
aguugcugucaucc

SEQ ID NO: 1326863 - RNA, 22 nt, Homo sapiens
aguuucauuuccuuguccugcu

SEQ ID NO: 1326864 - RNA, 17 nt, Homo sapiens
aguuucuauucugucag

SEQ ID NO: 1326865 - RNA, 18 nt, Homo sapiens
aguuugcuucuacaugau

SEQ ID NO: 1326866 - RNA, 19 nt, Homo sapiens
aguuugcuuuguaugcacu

SEQ ID NO: 1326867 - RNA, 15 nt, Homo sapiens
aguuuguagccaggu

SEQ ID NO: 1326868 - RNA, 23 nt, Homo sapiens
aguuugugguaacuugagauuca

SEQ ID NO: 1326869 - RNA, 18 nt, Homo sapiens
aguuuuauuacacauuua

SEQ ID NO: 1326870 - RNA, 16 nt, Homo sapiens
aguuuuguauucaaua

SEQ ID NO: 1326871 - RNA, 14 nt, Homo sapiens
auaaaaaguucuca

SEQ ID NO: 1326872 - RNA, 16 nt, Homo sapiens
auaaaacacuaacuua

SEQ ID NO: 1326873 - RNA, 22 nt, Homo sapiens
auaaaagaaauaaaccaaagga

SEQ ID NO: 1326874 - RNA, 13 nt, Homo sapiens
auaaaagcaauaa

SEQ ID NO: 1326875 - RNA, 17 nt, Homo sapiens
auaaaaugauccugcca

SEQ ID NO: 1326876 - RNA, 15 nt, Homo sapiens
auaaaauuuaacuca

SEQ ID NO: 1326877 - RNA, 16 nt, Homo sapiens
auaaacauuucauuuc

SEQ ID NO: 1326878 - RNA, 16 nt, Homo sapiens
auaaaccccucagaca

SEQ ID NO: 1326879 - RNA, 14 nt, Homo sapiens
auaaacucucuagg

SEQ ID NO: 1326880 - RNA, 16 nt, Homo sapiens
auaaacugauuuaucu

SEQ ID NO: 1326881 - RNA, 22 nt, Homo sapiens
auaaacugauuuaucuauuuaa

SEQ ID NO: 1326882 - RNA, 14 nt, Homo sapiens
aucagaguauguca

SEQ ID NO: 1326883 - RNA, 13 nt, Homo sapiens
aucagcaucaucu

SEQ ID NO: 1326884 - RNA, 23 nt, Homo sapiens
aucagcauuuuagaaacuacaaa

SEQ ID NO: 1326885 - RNA, 19 nt, Homo sapiens
aucagccuuuuauguauuu

SEQ ID NO: 1326886 - RNA, 19 nt, Homo sapiens
aucagcuggacauacugcu

SEQ ID NO: 1326887 - RNA, 21 nt, Homo sapiens
aucaggacucugacgucucuu

SEQ ID NO: 1326888 - RNA, 18 nt, Homo sapiens
aucagggucuaagcaccu

SEQ ID NO: 1326889 - RNA, 21 nt, Homo sapiens
aucaggugcauagcaagugaa

SEQ ID NO: 1326890 - RNA, 14 nt, Homo sapiens
aucagugugcaaua

SEQ ID NO: 1326891 - RNA, 15 nt, Homo sapiens
aucagugugcaauac

SEQ ID NO: 1326892 - RNA, 14 nt, Homo sapiens
aucaguuaacuauu

SEQ ID NO: 1326893 - RNA, 18 nt, Homo sapiens
aucaguugguuuggauuu

SEQ ID NO: 1326894 - RNA, 16 nt, Homo sapiens
aucauaaaacuugaug

SEQ ID NO: 1326895 - RNA, 20 nt, Homo sapiens
aucauauuugaaaaccauau

SEQ ID NO: 1326896 - RNA, 23 nt, Homo sapiens
aucaucaacuaccauucuauucc

SEQ ID NO: 1326897 - RNA, 22 nt, Homo sapiens
aucauccugcagacagacaaua

SEQ ID NO: 1326898 - RNA, 23 nt, Homo sapiens
aucaucuuauucagcaccaagca

SEQ ID NO: 1326899 - RNA, 19 nt, Homo sapiens
aucaugaaagccuauucca

SEQ ID NO: 1326900 - RNA, 14 nt, Homo sapiens
aucaugauaauuca

SEQ ID NO: 1326901 - RNA, 12 nt, Homo sapiens
aucauuaacagu

SEQ ID NO: 1326902 - RNA, 12 nt, Homo sapiens
aucauugguucg

SEQ ID NO: 1326903 - RNA, 15 nt, Homo sapiens
aucauuugacuaaga

SEQ ID NO: 1326904 - RNA, 16 nt, Homo sapiens
aucauuuuaagugcau

SEQ ID NO: 1326905 - RNA, 23 nt, Homo sapiens
auccaccgccacugggccuguca

SEQ ID NO: 1326906 - RNA, 12 nt, Homo sapiens
auccagcacugg

SEQ ID NO: 1326907 - RNA, 15 nt, Homo sapiens
auccagccagacccc

SEQ ID NO: 1326908 - RNA, 23 nt, Homo sapiens
auccagccagaccccacgcugac

SEQ ID NO: 1326909 - RNA, 22 nt, Homo sapiens
auccaggaauauaugucaguga

SEQ ID NO: 1326910 - RNA, 16 nt, Homo sapiens
auccaggcaugggcug

SEQ ID NO: 1326911 - RNA, 13 nt, Homo sapiens
auccagugacaug

SEQ ID NO: 1326912 - RNA, 14 nt, Homo sapiens
auccagugugagau

SEQ ID NO: 1326913 - RNA, 18 nt, Homo sapiens
auccagugugagauacug

SEQ ID NO: 1326914 - RNA, 17 nt, Homo sapiens
auccauaaagacaauca

SEQ ID NO: 1326915 - RNA, 17 nt, Homo sapiens
auccaugcaccuaccuu

SEQ ID NO: 1326916 - RNA, 19 nt, Homo sapiens
auccaugcaccuaccuuag

SEQ ID NO: 1326917 - RNA, 19 nt, Homo sapiens
auccauggggcugauugua

SEQ ID NO: 1326918 - RNA, 20 nt, Homo sapiens
aucccagacugacagacuua

SEQ ID NO: 1326919 - RNA, 20 nt, Homo sapiens
auccccgcagugugcacuaa

SEQ ID NO: 1326920 - RNA, 13 nt, Homo sapiens
aucccuacaugua

SEQ ID NO: 1326921 - RNA, 20 nt, Homo sapiens
aucccuacauguauugcaca

SEQ ID NO: 1326922 - RNA, 12 nt, Homo sapiens
aucccugagauc

SEQ ID NO: 1326923 - RNA, 20 nt, Homo sapiens
aucccuuccucucaggcucu

SEQ ID NO: 1326924 - RNA, 15 nt, Homo sapiens
aucccuuccuggaaa

SEQ ID NO: 1326925 - RNA, 20 nt, Homo sapiens
aucccuuuuuuuacauuuca

SEQ ID NO: 1326926 - RNA, 13 nt, Homo sapiens
caggccuguguga

SEQ ID NO: 1326927 - RNA, 19 nt, Homo sapiens
caggccuuaccgcucuguu

SEQ ID NO: 1326928 - RNA, 19 nt, Homo sapiens
caggccuugggcuccugau

SEQ ID NO: 1326929 - RNA, 17 nt, Homo sapiens
caggcuagagugcaaug

SEQ ID NO: 1326930 - RNA, 21 nt, Homo sapiens
caggcucugcuggaugugagu

SEQ ID NO: 1326931 - RNA, 17 nt, Homo sapiens
caggcugaaauauccac

SEQ ID NO: 1326932 - RNA, 12 nt, Homo sapiens
caggcuugaauc

SEQ ID NO: 1326933 - RNA, 23 nt, Homo sapiens
cagggaaauguaugugugucuau

SEQ ID NO: 1326934 - RNA, 16 nt, Homo sapiens
cagggaccugagagca

SEQ ID NO: 1326935 - RNA, 22 nt, Homo sapiens
cagggagcucuggggacagcuu

SEQ ID NO: 1326936 - RNA, 18 nt, Homo sapiens
cagggauucuuccugcuu

SEQ ID NO: 1326937 - RNA, 22 nt, Homo sapiens
cagggauuuagacuuacuauua

SEQ ID NO: 1326938 - RNA, 19 nt, Homo sapiens
cagggcccagagcccagcu

SEQ ID NO: 1326939 - RNA, 18 nt, Homo sapiens
cagggccuggagccccau

SEQ ID NO: 1326940 - RNA, 19 nt, Homo sapiens
cagggcucccugcccugac

SEQ ID NO: 1326941 - RNA, 19 nt, Homo sapiens
cagggcugaggccucucau

SEQ ID NO: 1326942 - RNA, 20 nt, Homo sapiens
cagggcuuuacuccguaaca

SEQ ID NO: 1326943 - RNA, 19 nt, Homo sapiens
caggggccaaccucaggcu

SEQ ID NO: 1326944 - RNA, 16 nt, Homo sapiens
caggggccugcagaag

SEQ ID NO: 1326945 - RNA, 18 nt, Homo sapiens
caggguuuacaugaagca

SEQ ID NO: 1326946 - RNA, 16 nt, Homo sapiens
caggugcucuguggau

SEQ ID NO: 1326947 - RNA, 18 nt, Homo sapiens
cagguguauaaauguaca

SEQ ID NO: 1326948 - RNA, 19 nt, Homo sapiens
cagguuccugaaauaucca

SEQ ID NO: 1326949 - RNA, 13 nt, Homo sapiens
caguaaacauaaa

SEQ ID NO: 1326950 - RNA, 17 nt, Homo sapiens
caguaacuccccaacuc

SEQ ID NO: 1326951 - RNA, 17 nt, Homo sapiens
caguaacugugacugau

SEQ ID NO: 1326952 - RNA, 23 nt, Homo sapiens
caguacaaauguuuuucauccau

SEQ ID NO: 1326953 - RNA, 13 nt, Homo sapiens
caguacaacaguu

SEQ ID NO: 1326954 - RNA, 15 nt, Homo sapiens
caguacuauggagug

SEQ ID NO: 1326955 - RNA, 23 nt, Homo sapiens
caguacuauggagugcucacaaa

SEQ ID NO: 1326956 - RNA, 14 nt, Homo sapiens
caguagaugccacu

SEQ ID NO: 1326957 - RNA, 23 nt, Homo sapiens
caguagcagccuacaacugaaua

SEQ ID NO: 1326958 - RNA, 20 nt, Homo sapiens
caguagcuccaacacuuuga

SEQ ID NO: 1326959 - RNA, 14 nt, Homo sapiens
caguaguaucaaau

SEQ ID NO: 1326960 - RNA, 19 nt, Homo sapiens
cagucacugacaguuaaua

SEQ ID NO: 1326961 - RNA, 23 nt, Homo sapiens
cagucagcuguggggaacacagc

SEQ ID NO: 1326962 - RNA, 21 nt, Homo sapiens
caguccauuuccuaauguaua

SEQ ID NO: 1326963 - RNA, 15 nt, Homo sapiens
cagucccacacugug

SEQ ID NO: 1326964 - RNA, 16 nt, Homo sapiens
cagucccacacugugg

SEQ ID NO: 1326965 - RNA, 16 nt, Homo sapiens
cagucuuucuucacuc

SEQ ID NO: 1326966 - RNA, 21 nt, Homo sapiens
cagugaaagcuuucaugacca

SEQ ID NO: 1326967 - RNA, 14 nt, Homo sapiens
cagugacaacaucg

SEQ ID NO: 1326968 - RNA, 19 nt, Homo sapiens
cagugacaacaucgcaaua

SEQ ID NO: 1326969 - RNA, 22 nt, Homo sapiens
cagugacaaccaaaagucuuca

SEQ ID NO: 1326970 - RNA, 17 nt, Homo sapiens
cagugacagucagggaa

SEQ ID NO: 1326971 - RNA, 17 nt, Homo sapiens
cagugacaugauucuga

SEQ ID NO: 1326972 - RNA, 12 nt, Homo sapiens
cagugaccacag

SEQ ID NO: 1326973 - RNA, 19 nt, Homo sapiens
cagugaccagugccuguga

SEQ ID NO: 1326974 - RNA, 17 nt, Homo sapiens
cagugagaagccagcuu

SEQ ID NO: 1326975 - RNA, 21 nt, Homo sapiens
cagugcaauauuuagcugcua

SEQ ID NO: 1326976 - RNA, 16 nt, Homo sapiens
cagugcccccacugac

SEQ ID NO: 1326977 - RNA, 16 nt, Homo sapiens
cagugcgguuccucau

SEQ ID NO: 1326978 - RNA, 16 nt, Homo sapiens
cagugcugaauuuccc

SEQ ID NO: 1326979 - RNA, 20 nt, Homo sapiens
cagugcuugcaagauuccaa

SEQ ID NO: 1326980 - RNA, 19 nt, Homo sapiens
caguggcuggaucugugag

SEQ ID NO: 1326981 - RNA, 21 nt, Homo sapiens
cagugggcguugggagccuag

SEQ ID NO: 1326982 - RNA, 16 nt, Homo sapiens
caguuaacuauugcau

SEQ ID NO: 1326983 - RNA, 13 nt, Homo sapiens
caguucagcuuua

SEQ ID NO: 1326984 - RNA, 14 nt, Homo sapiens
caguucauuguggg

SEQ ID NO: 1326985 - RNA, 23 nt, Homo sapiens
caguuccccuguuugccucugaa

SEQ ID NO: 1326986 - RNA, 19 nt, Homo sapiens
caguucugucauauguuaa

SEQ ID NO: 1326987 - RNA, 20 nt, Homo sapiens
caguugccacauuuaguccu

SEQ ID NO: 1326988 - RNA, 13 nt, Homo sapiens
caguugugacaau

SEQ ID NO: 1326989 - RNA, 12 nt, Homo sapiens
caguugugauac

SEQ ID NO: 1326990 - RNA, 12 nt, Homo sapiens
caguuguuaaaa

SEQ ID NO: 1326991 - RNA, 19 nt, Homo sapiens
caguuguuaaaaugagcau

SEQ ID NO: 1326992 - RNA, 21 nt, Homo sapiens
caguuguuaaaaugagcauug

SEQ ID NO: 1326993 - RNA, 22 nt, Homo sapiens
caguuguuaaaaugagcauuga

SEQ ID NO: 1326994 - RNA, 15 nt, Homo sapiens
caguuguuauauuca

SEQ ID NO: 1326995 - RNA, 20 nt, Homo sapiens
caguuguugaaacacuuugc

SEQ ID NO: 1326996 - RNA, 19 nt, Homo sapiens
caguuugguguguccuccg

SEQ ID NO: 1326997 - RNA, 21 nt, Homo sapiens
cauaaacgguuccuggugacu

SEQ ID NO: 1326998 - RNA, 17 nt, Homo sapiens
cauaaagacaaucacug

SEQ ID NO: 1326999 - RNA, 15 nt, Homo sapiens
cauaaagucuugccu

SEQ ID NO: 1327000 - RNA, 23 nt, Homo sapiens
cauaaauuuaugguucucaggcc

SEQ ID NO: 1327001 - RNA, 14 nt, Homo sapiens
cauaaccugucuca

SEQ ID NO: 1327002 - RNA, 15 nt, Homo sapiens
cauaaccugucucac

SEQ ID NO: 1327003 - RNA, 17 nt, Homo sapiens
cauaacuacaccugaca

SEQ ID NO: 1327004 - RNA, 16 nt, Homo sapiens
cauaacucugugaucu

SEQ ID NO: 1327005 - RNA, 12 nt, Homo sapiens
cauaacuugaaa

SEQ ID NO: 1327006 - RNA, 18 nt, Homo sapiens
cauaagagaaaccugcca

SEQ ID NO: 1327007 - RNA, 16 nt, Homo sapiens
cauaagcccaguucau

SEQ ID NO: 1327008 - RNA, 16 nt, Homo sapiens
cauaauucagcacuua

SEQ ID NO: 1327009 - RNA, 20 nt, Homo sapiens
cauaauucagcacuuaacua

SEQ ID NO: 1327010 - RNA, 15 nt, Homo sapiens
cauaauuuaaaaaua

SEQ ID NO: 1327011 - RNA, 15 nt, Homo sapiens
cauacacagaaacca

SEQ ID NO: 1327012 - RNA, 15 nt, Homo sapiens
cauacacaugugcac

SEQ ID NO: 1327013 - RNA, 19 nt, Homo sapiens
cauacccucacuuaaacuu

SEQ ID NO: 1327014 - RNA, 22 nt, Homo sapiens
cauaccuggcccugugccuugg

SEQ ID NO: 1327015 - RNA, 17 nt, Homo sapiens
cauacucugcuuagaau

SEQ ID NO: 1327016 - RNA, 17 nt, Homo sapiens
cauacuugaagggccag

SEQ ID NO: 1327017 - RNA, 19 nt, Homo sapiens
cauagaaauuacacccaaa

SEQ ID NO: 1327018 - RNA, 11 nt, Homo sapiens
cauagagccag

SEQ ID NO: 1327019 - RNA, 20 nt, Homo sapiens
cauagcucaccaggacuguu

SEQ ID NO: 1327020 - RNA, 13 nt, Homo sapiens
caucuugcagcau

SEQ ID NO: 1327021 - RNA, 16 nt, Homo sapiens
caucuugcuaccagua

SEQ ID NO: 1327022 - RNA, 23 nt, Homo sapiens
caucuuggucagauuugaacucu

SEQ ID NO: 1327023 - RNA, 10 nt, Homo sapiens
caucuuguca

SEQ ID NO: 1327024 - RNA, 14 nt, Homo sapiens
caucuugucauuuu

SEQ ID NO: 1327025 - RNA, 13 nt, Homo sapiens
caucuuugccaua

SEQ ID NO: 1327026 - RNA, 13 nt, Homo sapiens
caugaaaaguuau

SEQ ID NO: 1327027 - RNA, 20 nt, Homo sapiens
caugaaagcaucugagcuaa

SEQ ID NO: 1327028 - RNA, 17 nt, Homo sapiens
caugaaaggaagaguua

SEQ ID NO: 1327029 - RNA, 14 nt, Homo sapiens
caugaaauaaaaua

SEQ ID NO: 1327030 - RNA, 22 nt, Homo sapiens
caugaacaucauggacugagcu

SEQ ID NO: 1327031 - RNA, 12 nt, Homo sapiens
caugaacuguac

SEQ ID NO: 1327032 - RNA, 13 nt, Homo sapiens
caugaagugcaca

SEQ ID NO: 1327033 - RNA, 18 nt, Homo sapiens
caugaauaaaacacucau

SEQ ID NO: 1327034 - RNA, 18 nt, Homo sapiens
caugaaugugagucauua

SEQ ID NO: 1327035 - RNA, 17 nt, Homo sapiens
caugagggccacauucc

SEQ ID NO: 1327036 - RNA, 20 nt, Homo sapiens
caugaguggaaauacacuca

SEQ ID NO: 1327037 - RNA, 16 nt, Homo sapiens
caugauaaaugauaga

SEQ ID NO: 1327038 - RNA, 19 nt, Homo sapiens
caugauacuaucugugcca

SEQ ID NO: 1327039 - RNA, 20 nt, Homo sapiens
caugaugcuaaaggcugcga

SEQ ID NO: 1327040 - RNA, 21 nt, Homo sapiens
caugcaccuuccagcccgggg

SEQ ID NO: 1327041 - RNA, 23 nt, Homo sapiens
caugcacuuuauguggagacuac

SEQ ID NO: 1327042 - RNA, 23 nt, Homo sapiens
caugcaggaaggaaaacuaugua

SEQ ID NO: 1327043 - RNA, 22 nt, Homo sapiens
caugcauaaaaauuaaauggau

SEQ ID NO: 1327044 - RNA, 13 nt, Homo sapiens
caugcauucacau

SEQ ID NO: 1327045 - RNA, 18 nt, Homo sapiens
caugccaguaacugugcu

SEQ ID NO: 1327046 - RNA, 14 nt, Homo sapiens
caugcccaugauga

SEQ ID NO: 1327047 - RNA, 22 nt, Homo sapiens
caugccuguaaucucagcacuu

SEQ ID NO: 1327048 - RNA, 21 nt, Homo sapiens
caugcucacacauuacaacag

SEQ ID NO: 1327049 - RNA, 22 nt, Homo sapiens
caugcugcuggggaagacagug

SEQ ID NO: 1327050 - RNA, 21 nt, Homo sapiens
caugcuggcuuuugugcccaa

SEQ ID NO: 1327051 - RNA, 22 nt, Homo sapiens
caugcuugcauuauauuuguaa

SEQ ID NO: 1327052 - RNA, 20 nt, Homo sapiens
cauggagaagccccgucucu

SEQ ID NO: 1327053 - RNA, 20 nt, Homo sapiens
cauggagacagcaguuucca

SEQ ID NO: 1327054 - RNA, 18 nt, Homo sapiens
cauggaugcuuuggcaau

SEQ ID NO: 1327055 - RNA, 19 nt, Homo sapiens
cauggaugcuuuggcaaug

SEQ ID NO: 1327056 - RNA, 16 nt, Homo sapiens
cauggggcugauugua

SEQ ID NO: 1327057 - RNA, 14 nt, Homo sapiens
cauggguccagggc

SEQ ID NO: 1327058 - RNA, 22 nt, Homo sapiens
cauggugcaguuuuggugugua

SEQ ID NO: 1327059 - RNA, 18 nt, Homo sapiens
cauguauugcucuuuauc

SEQ ID NO: 1327060 - RNA, 12 nt, Homo sapiens
cauguccaguga

SEQ ID NO: 1327061 - RNA, 16 nt, Homo sapiens
cauguccagugagcag

SEQ ID NO: 1327062 - RNA, 16 nt, Homo sapiens
caugucgccucugcau

SEQ ID NO: 1327063 - RNA, 22 nt, Homo sapiens
caugucuuaccagugacgcugc

SEQ ID NO: 1327064 - RNA, 16 nt, Homo sapiens
caugugccugaaggcu

SEQ ID NO: 1327065 - RNA, 18 nt, Homo sapiens
caugugccuuucuuugcc

SEQ ID NO: 1327066 - RNA, 15 nt, Homo sapiens
caugugcugacuccc

SEQ ID NO: 1327067 - RNA, 19 nt, Homo sapiens
cauguggccauuaacaaug

SEQ ID NO: 1327068 - RNA, 19 nt, Homo sapiens
caugugugugguggugacu

SEQ ID NO: 1327069 - RNA, 14 nt, Homo sapiens
cauguuaguuaccu

SEQ ID NO: 1327070 - RNA, 17 nt, Homo sapiens
cauguuguaaugcugca

SEQ ID NO: 1327071 - RNA, 21 nt, Homo sapiens
cauguuugaaucuacauucac

SEQ ID NO: 1327072 - RNA, 15 nt, Homo sapiens
cauguuugcaccugu

SEQ ID NO: 1327073 - RNA, 20 nt, Homo sapiens
cauguuuguuucuguagaaa

SEQ ID NO: 1327074 - RNA, 15 nt, Homo sapiens
cauguuuuagcauuu

SEQ ID NO: 1327075 - RNA, 12 nt, Homo sapiens
cauguuuuccag

SEQ ID NO: 1327076 - RNA, 20 nt, Homo sapiens
cauuaaaaauguuaguauuu

SEQ ID NO: 1327077 - RNA, 17 nt, Homo sapiens
cauuacaaaaaaacacg

SEQ ID NO: 1327078 - RNA, 17 nt, Homo sapiens
cauuacaacaguagaga

SEQ ID NO: 1327079 - RNA, 20 nt, Homo sapiens
cauuaccagcuuaaaacacu

SEQ ID NO: 1327080 - RNA, 18 nt, Homo sapiens
cauuagagaaaaccuuaa

SEQ ID NO: 1327081 - RNA, 23 nt, Homo sapiens
cauuagauuuggaggcuaccuca

SEQ ID NO: 1327082 - RNA, 16 nt, Homo sapiens
cauuaugccacuuccu

SEQ ID NO: 1327083 - RNA, 21 nt, Homo sapiens
cauuauuuuccagauaacuua

SEQ ID NO: 1327084 - RNA, 22 nt, Homo sapiens
cauuauuuuuguuagcaaagau

SEQ ID NO: 1327085 - RNA, 17 nt, Homo sapiens
cauucaauagcauauca

SEQ ID NO: 1327086 - RNA, 22 nt, Homo sapiens
cauucacagcaagucacuggcc

SEQ ID NO: 1327087 - RNA, 13 nt, Homo sapiens
cauucacaguucu

SEQ ID NO: 1327088 - RNA, 12 nt, Homo sapiens
cauucacauuca

SEQ ID NO: 1327089 - RNA, 20 nt, Homo sapiens
cauucaggauucuguuccuu

SEQ ID NO: 1327090 - RNA, 17 nt, Homo sapiens
cauucaucauguucaca

SEQ ID NO: 1327091 - RNA, 23 nt, Homo sapiens
cauuccauuuugugaauugugac

SEQ ID NO: 1327092 - RNA, 13 nt, Homo sapiens
cauuccugaagaa

SEQ ID NO: 1327093 - RNA, 21 nt, Homo sapiens
cauucuaccaagcugucacag

SEQ ID NO: 1327094 - RNA, 15 nt, Homo sapiens
cauucuauuuuagaa

SEQ ID NO: 1327095 - RNA, 19 nt, Homo sapiens
cauucucgugagucauuua

SEQ ID NO: 1327096 - RNA, 20 nt, Homo sapiens
cauucugaaggccuuguuaa

SEQ ID NO: 1327097 - RNA, 20 nt, Homo sapiens
cauucuucacucuguuugaa

SEQ ID NO: 1327098 - RNA, 20 nt, Homo sapiens
cauucuucagacaucaguca

SEQ ID NO: 1327099 - RNA, 17 nt, Homo sapiens
cauucuucccuugaugg

SEQ ID NO: 1327100 - RNA, 13 nt, Homo sapiens
cauucuuggccca

SEQ ID NO: 1327101 - RNA, 22 nt, Homo sapiens
cauugaagaauguuagaguaau

SEQ ID NO: 1327102 - RNA, 15 nt, Homo sapiens
cauugcaauuugcag

SEQ ID NO: 1327103 - RNA, 18 nt, Homo sapiens
cauugcacucuagccugg

SEQ ID NO: 1327104 - RNA, 17 nt, Homo sapiens
cauugcgugauucaaug

SEQ ID NO: 1327105 - RNA, 19 nt, Homo sapiens
cauugcucagaaaugucau

SEQ ID NO: 1327106 - RNA, 22 nt, Homo sapiens
cauugcucugaauaugucauca

SEQ ID NO: 1327107 - RNA, 22 nt, Homo sapiens
cauugcucuguuaauaaucuca

SEQ ID NO: 1327108 - RNA, 21 nt, Homo sapiens
cauuggaccuuuccugaggaa

SEQ ID NO: 1327109 - RNA, 15 nt, Homo sapiens
cauuggcugccuuau

SEQ ID NO: 1327110 - RNA, 21 nt, Homo sapiens
cauugguacacguguaacaag

SEQ ID NO: 1327111 - RNA, 23 nt, Homo sapiens
cauugguucuuucauuugcuuug

SEQ ID NO: 1327112 - RNA, 14 nt, Homo sapiens
cauuguaaaagcau

SEQ ID NO: 1327113 - RNA, 14 nt, Homo sapiens
cauuguagccucaa

SEQ ID NO: 1327114 - RNA, 20 nt, Homo sapiens
cauugucaccgcaggugcuc

SEQ ID NO: 1327115 - RNA, 21 nt, Homo sapiens
cauugucaccgcaggugcuca

SEQ ID NO: 1327116 - RNA, 13 nt, Homo sapiens
cauuguguggaau

SEQ ID NO: 1327117 - RNA, 22 nt, Homo sapiens
cauuuagaaaauagagcuuuua

SEQ ID NO: 1327118 - RNA, 15 nt, Homo sapiens
cauuuagucauguga

SEQ ID NO: 1327119 - RNA, 16 nt, Homo sapiens
cauuuagucaugugac

SEQ ID NO: 1327120 - RNA, 17 nt, Homo sapiens
cauuuagucaugugacc

SEQ ID NO: 1327121 - RNA, 16 nt, Homo sapiens
cauuucaugaagcaag

SEQ ID NO: 1327122 - RNA, 15 nt, Homo sapiens
cauuuccucuguucu

SEQ ID NO: 1327123 - RNA, 23 nt, Homo sapiens
cauuucuacuaugaucagaagaa

SEQ ID NO: 1327124 - RNA, 16 nt, Homo sapiens
cauuucucauguugaa

SEQ ID NO: 1327125 - RNA, 17 nt, Homo sapiens
cauuucugaugucucca

SEQ ID NO: 1327126 - RNA, 16 nt, Homo sapiens
cauuucugauucugau

SEQ ID NO: 1327127 - RNA, 20 nt, Homo sapiens
cauuucuggacaguaccuga

SEQ ID NO: 1327128 - RNA, 21 nt, Homo sapiens
cauuuguaaucuaguugucaa

SEQ ID NO: 1327129 - RNA, 16 nt, Homo sapiens
cauuuguuaaaauaca

SEQ ID NO: 1327130 - RNA, 21 nt, Homo sapiens
cauuuguuggaaugaauuaaa

SEQ ID NO: 1327131 - RNA, 21 nt, Homo sapiens
cauuuuaaaaugcuuggguac

SEQ ID NO: 1327132 - RNA, 21 nt, Homo sapiens
cauuuuaaauuccacugaaaa

SEQ ID NO: 1327133 - RNA, 18 nt, Homo sapiens
cauuuuaacgcugccuaa

SEQ ID NO: 1327134 - RNA, 14 nt, Homo sapiens
cauuuuaaggcaau

SEQ ID NO: 1327135 - RNA, 14 nt, Homo sapiens
cauuuuacacaaag

SEQ ID NO: 1327136 - RNA, 15 nt, Homo sapiens
cauuuucauugauga

SEQ ID NO: 1327137 - RNA, 13 nt, Homo sapiens
cauuuugaugaua

SEQ ID NO: 1327138 - RNA, 13 nt, Homo sapiens
cauuuugcucaac

SEQ ID NO: 1327139 - RNA, 23 nt, Homo sapiens
cauuuugcuuuggacacaguguu

SEQ ID NO: 1327140 - RNA, 14 nt, Homo sapiens
cauuuuguaauaau

SEQ ID NO: 1327141 - RNA, 16 nt, Homo sapiens
cauuuuugccaaaaua

SEQ ID NO: 1327142 - RNA, 17 nt, Homo sapiens
cauuuuuuaaaaaagca

SEQ ID NO: 1327143 - RNA, 19 nt, Homo sapiens
cauuuuuugggcagcaauu

SEQ ID NO: 1327144 - RNA, 13 nt, Homo sapiens
cauuuuuuuagaa

SEQ ID NO: 1327145 - RNA, 15 nt, Homo sapiens
ccaaaaauggcagug

SEQ ID NO: 1327146 - RNA, 18 nt, Homo sapiens
ccaaaacaagccaaagag

SEQ ID NO: 1327147 - RNA, 23 nt, Homo sapiens
ccaaaacagcuuugucuccaaag

SEQ ID NO: 1327148 - RNA, 18 nt, Homo sapiens
ccaaaauaaaaccagcuc

SEQ ID NO: 1327149 - RNA, 19 nt, Homo sapiens
ccaaacaauauugcuccau

SEQ ID NO: 1327150 - RNA, 15 nt, Homo sapiens
ccaaacacaccacau

SEQ ID NO: 1327151 - RNA, 18 nt, Homo sapiens
ccaaacccuuaacugaca

SEQ ID NO: 1327152 - RNA, 17 nt, Homo sapiens
ccaaacuggugcaugac

SEQ ID NO: 1327153 - RNA, 22 nt, Homo sapiens
ccaaagagauauugauauugaa

SEQ ID NO: 1327154 - RNA, 22 nt, Homo sapiens
ccaaagcaucaauacaaccagc

SEQ ID NO: 1327155 - RNA, 15 nt, Homo sapiens
ccaaagugcugggau

SEQ ID NO: 1327156 - RNA, 19 nt, Homo sapiens
ccaaaucaaaagacuuuuu

SEQ ID NO: 1327157 - RNA, 15 nt, Homo sapiens
ccaaauucaccuucc

SEQ ID NO: 1327158 - RNA, 14 nt, Homo sapiens
ccaaauuuggcuaa

SEQ ID NO: 1327159 - RNA, 16 nt, Homo sapiens
ccaacaggcccagcuu

SEQ ID NO: 1327160 - RNA, 16 nt, Homo sapiens
ccaacccgaggcaaua

SEQ ID NO: 1327161 - RNA, 16 nt, Homo sapiens
ccaaccuccaguguca

SEQ ID NO: 1327162 - RNA, 21 nt, Homo sapiens
ccaaccuucuugucauugaaa

SEQ ID NO: 1327163 - RNA, 17 nt, Homo sapiens
ccaacuguuucccugcu

SEQ ID NO: 1327164 - RNA, 17 nt, Homo sapiens
ccaagcugcucauuuca

SEQ ID NO: 1327165 - RNA, 19 nt, Homo sapiens
ccaaggagggugagugcaa

SEQ ID NO: 1327166 - RNA, 16 nt, Homo sapiens
ccaaggaugucugcca

SEQ ID NO: 1327167 - RNA, 15 nt, Homo sapiens
ccaaggggaaucaga

SEQ ID NO: 1327168 - RNA, 18 nt, Homo sapiens
ccaaggguuucgacuggu

SEQ ID NO: 1327169 - RNA, 14 nt, Homo sapiens
ccaaguaccaguau

SEQ ID NO: 1327170 - RNA, 12 nt, Homo sapiens
ccaaguagcuag

SEQ ID NO: 1327171 - RNA, 20 nt, Homo sapiens
ccaaguuccuuggccaugca

SEQ ID NO: 1327172 - RNA, 12 nt, Homo sapiens
ccaauccaugcu

SEQ ID NO: 1327173 - RNA, 21 nt, Homo sapiens
ccaaugacacccaugccagag

SEQ ID NO: 1327174 - RNA, 20 nt, Homo sapiens
ccaaugagaucauugugaag

SEQ ID NO: 1327175 - RNA, 22 nt, Homo sapiens
ccaaugcugucugguugcgcca

SEQ ID NO: 1327176 - RNA, 22 nt, Homo sapiens
ccaaugugaaguucaucuugca

SEQ ID NO: 1327177 - RNA, 14 nt, Homo sapiens
ccaauuuacauacu

SEQ ID NO: 1327178 - RNA, 17 nt, Homo sapiens
ccaauuucagacuccca

SEQ ID NO: 1327179 - RNA, 19 nt, Homo sapiens
ccaauuucucuuuacuuga

SEQ ID NO: 1327180 - RNA, 23 nt, Homo sapiens
ccaauuuucuggaauacaugaaa

SEQ ID NO: 1327181 - RNA, 23 nt, Homo sapiens
ccaauuuucuucaucuuugccau

SEQ ID NO: 1327182 - RNA, 20 nt, Homo sapiens
ccaauuuuuuaagugaaaau

SEQ ID NO: 1327183 - RNA, 22 nt, Homo sapiens
ccacaauuccuccucuggccac

SEQ ID NO: 1327184 - RNA, 14 nt, Homo sapiens
ccacacacagcugg

SEQ ID NO: 1327185 - RNA, 13 nt, Homo sapiens
ccacacccaggaa

SEQ ID NO: 1327186 - RNA, 23 nt, Homo sapiens
ccacagaacacagcaauuccuca

SEQ ID NO: 1327187 - RNA, 21 nt, Homo sapiens
ccacagagaaguuuguagcca

SEQ ID NO: 1327188 - RNA, 23 nt, Homo sapiens
ccacagagaaguuuguagccagg

SEQ ID NO: 1327189 - RNA, 16 nt, Homo sapiens
ccacagaggacucacu

SEQ ID NO: 1327190 - RNA, 22 nt, Homo sapiens
ccacagcaucgggagcacccag

SEQ ID NO: 1327191 - RNA, 18 nt, Homo sapiens
ccacagccuuaccaaagc

SEQ ID NO: 1327192 - RNA, 18 nt, Homo sapiens
ccacagggcagggccuca

SEQ ID NO: 1327193 - RNA, 18 nt, Homo sapiens
ccacaguucugacgcuga

SEQ ID NO: 1327194 - RNA, 14 nt, Homo sapiens
ccacauaccuggcc

SEQ ID NO: 1327195 - RNA, 17 nt, Homo sapiens
ccacaugauuuuacuca

SEQ ID NO: 1327196 - RNA, 13 nt, Homo sapiens
ccaccaccaaaau

SEQ ID NO: 1327197 - RNA, 13 nt, Homo sapiens
ccaccaggauauc

SEQ ID NO: 1327198 - RNA, 12 nt, Homo sapiens
ccaccaugcccu

SEQ ID NO: 1327199 - RNA, 20 nt, Homo sapiens
ccaccuaauccuucuggcaa

SEQ ID NO: 1327200 - RNA, 20 nt, Homo sapiens
ccaccucggcacacacugug

SEQ ID NO: 1327201 - RNA, 21 nt, Homo sapiens
ccaccucggcacacacugugc

SEQ ID NO: 1327202 - RNA, 16 nt, Homo sapiens
ccaccugacacaccag

SEQ ID NO: 1327203 - RNA, 12 nt, Homo sapiens
ccaccuggagag

SEQ ID NO: 1327204 - RNA, 16 nt, Homo sapiens
ccacgagggugccgug

SEQ ID NO: 1327205 - RNA, 17 nt, Homo sapiens
ccacggugccuccagau

SEQ ID NO: 1327206 - RNA, 19 nt, Homo sapiens
ccacggugccuccagaugg

SEQ ID NO: 1327207 - RNA, 13 nt, Homo sapiens
ccacguaucuuuc

SEQ ID NO: 1327208 - RNA, 14 nt, Homo sapiens
ccacguuaagucca

SEQ ID NO: 1327209 - RNA, 16 nt, Homo sapiens
ccacuacaucugggac

SEQ ID NO: 1327210 - RNA, 15 nt, Homo sapiens
ccacuaccaaaagac

SEQ ID NO: 1327211 - RNA, 21 nt, Homo sapiens
ccacuaccagccagccucaga

SEQ ID NO: 1327212 - RNA, 14 nt, Homo sapiens
ccacucaccuauca

SEQ ID NO: 1327213 - RNA, 14 nt, Homo sapiens
ccacucaugacugc

SEQ ID NO: 1327214 - RNA, 22 nt, Homo sapiens
ccacuccaagugccccaccacu

SEQ ID NO: 1327215 - RNA, 16 nt, Homo sapiens
ccacuccacuacucuc

SEQ ID NO: 1327216 - RNA, 18 nt, Homo sapiens
ccacucccagugcuugca

SEQ ID NO: 1327217 - RNA, 15 nt, Homo sapiens
ccacuccccaacccc

SEQ ID NO: 1327218 - RNA, 20 nt, Homo sapiens
ccacugcccugggcagccau

SEQ ID NO: 1327219 - RNA, 14 nt, Homo sapiens
ccacugcucgugga

SEQ ID NO: 1327220 - RNA, 23 nt, Homo sapiens
ccacuggaacguuucacugcaaa

SEQ ID NO: 1327221 - RNA, 19 nt, Homo sapiens
ccacuuagaaauugcauuu

SEQ ID NO: 1327222 - RNA, 21 nt, Homo sapiens
ccacuuccuuuuaacugccaa

SEQ ID NO: 1327223 - RNA, 11 nt, Homo sapiens
ccacuucucac

SEQ ID NO: 1327224 - RNA, 18 nt, Homo sapiens
ccacuucucacucaccac

SEQ ID NO: 1327225 - RNA, 21 nt, Homo sapiens
ccagaaaaccucuccugaccc

SEQ ID NO: 1327226 - RNA, 19 nt, Homo sapiens
ccagaaagcuucauccaca

SEQ ID NO: 1327227 - RNA, 12 nt, Homo sapiens
ccagagaccuca

SEQ ID NO: 1327228 - RNA, 15 nt, Homo sapiens
ccagagcugugccag

SEQ ID NO: 1327229 - RNA, 21 nt, Homo sapiens
ccagaggagccaccaguucuc

SEQ ID NO: 1327230 - RNA, 17 nt, Homo sapiens
ccagagggacacuagga

SEQ ID NO: 1327231 - RNA, 15 nt, Homo sapiens
ccagaggguugcugg

SEQ ID NO: 1327232 - RNA, 18 nt, Homo sapiens
ccagaggucuggcccuau

SEQ ID NO: 1327233 - RNA, 21 nt, Homo sapiens
ccagauggcagguuugcaauc

SEQ ID NO: 1327234 - RNA, 19 nt, Homo sapiens
ccagauucaugcacuguag

SEQ ID NO: 1327235 - RNA, 17 nt, Homo sapiens
ccagcacucacaccacu

SEQ ID NO: 1327236 - RNA, 13 nt, Homo sapiens
ccagcacuugaau

SEQ ID NO: 1327237 - RNA, 16 nt, Homo sapiens
ccagcacuuugggagg

SEQ ID NO: 1327238 - RNA, 20 nt, Homo sapiens
ccagcacuuugggaguccaa

SEQ ID NO: 1327239 - RNA, 19 nt, Homo sapiens
ccagcauccccaacugcga

SEQ ID NO: 1327240 - RNA, 17 nt, Homo sapiens
ccagccaugucugcauu

SEQ ID NO: 1327241 - RNA, 17 nt, Homo sapiens
ccagcccagcaccccuu

SEQ ID NO: 1327242 - RNA, 20 nt, Homo sapiens
ccagccguauuuuacaugaa

SEQ ID NO: 1327243 - RNA, 17 nt, Homo sapiens
ccagcuaacucugaccu

SEQ ID NO: 1327244 - RNA, 19 nt, Homo sapiens
ccagcuccaaccugcaaag

SEQ ID NO: 1327245 - RNA, 21 nt, Homo sapiens
ccagcuccaaccugcaaagau

SEQ ID NO: 1327246 - RNA, 11 nt, Homo sapiens
ccagcucugac

SEQ ID NO: 1327247 - RNA, 18 nt, Homo sapiens
gaauccuugacucuuaca

SEQ ID NO: 1327248 - RNA, 14 nt, Homo sapiens
gaaucuacauucac

SEQ ID NO: 1327249 - RNA, 17 nt, Homo sapiens
gaaucuagcccaaccua

SEQ ID NO: 1327250 - RNA, 19 nt, Homo sapiens
gaaucugucuaucugugaa

SEQ ID NO: 1327251 - RNA, 21 nt, Homo sapiens
gaaugaaaauaacugaaccaa

SEQ ID NO: 1327252 - RNA, 21 nt, Homo sapiens
gaaugaaccuucuggccuccc

SEQ ID NO: 1327253 - RNA, 19 nt, Homo sapiens
gaaugagcacccauuccaa

SEQ ID NO: 1327254 - RNA, 20 nt, Homo sapiens
gaaugccucgcucccuucaa

SEQ ID NO: 1327255 - RNA, 15 nt, Homo sapiens
gaauguaugugcaca

SEQ ID NO: 1327256 - RNA, 15 nt, Homo sapiens
gaaugucagggccag

SEQ ID NO: 1327257 - RNA, 21 nt, Homo sapiens
gaaugugucugcguuccuguu

SEQ ID NO: 1327258 - RNA, 19 nt, Homo sapiens
gaauuagcaauaacauaca

SEQ ID NO: 1327259 - RNA, 16 nt, Homo sapiens
gaauucauuucacugu

SEQ ID NO: 1327260 - RNA, 16 nt, Homo sapiens
gaauugcaguucagaa

SEQ ID NO: 1327261 - RNA, 23 nt, Homo sapiens
gaauuggauacauacaccagcau

SEQ ID NO: 1327262 - RNA, 20 nt, Homo sapiens
gacaaagccuuaaaaugcau

SEQ ID NO: 1327263 - RNA, 17 nt, Homo sapiens
gacaaagguuuuccucu

SEQ ID NO: 1327264 - RNA, 13 nt, Homo sapiens
gacaacugugaag

SEQ ID NO: 1327265 - RNA, 13 nt, Homo sapiens
gacaaggugcuaa

SEQ ID NO: 1327266 - RNA, 23 nt, Homo sapiens
gaggcuuucuccaggaggauuag

SEQ ID NO: 1327267 - RNA, 15 nt, Homo sapiens
gagggaggugguccu

SEQ ID NO: 1327268 - RNA, 20 nt, Homo sapiens
gagggcaaucuuugccuuua

SEQ ID NO: 1327269 - RNA, 16 nt, Homo sapiens
gagggcagaucacuuc

SEQ ID NO: 1327270 - RNA, 20 nt, Homo sapiens
gagggccaccuccacaccca

SEQ ID NO: 1327271 - RNA, 19 nt, Homo sapiens
gaggggaaggacgccucca

SEQ ID NO: 1327272 - RNA, 14 nt, Homo sapiens
gaggggcagggaag

SEQ ID NO: 1327273 - RNA, 17 nt, Homo sapiens
gagggggacuaaacuca

SEQ ID NO: 1327274 - RNA, 14 nt, Homo sapiens
gaggguccucaguc

SEQ ID NO: 1327275 - RNA, 21 nt, Homo sapiens
gagguauucaauauccuuugc

SEQ ID NO: 1327276 - RNA, 18 nt, Homo sapiens
gaggucugauuggcugcu

SEQ ID NO: 1327277 - RNA, 13 nt, Homo sapiens
gaggucuggcuga

SEQ ID NO: 1327278 - RNA, 17 nt, Homo sapiens
gaggugacggcacuccc

SEQ ID NO: 1327279 - RNA, 19 nt, Homo sapiens
gaguauccuuguagcaaag

SEQ ID NO: 1327280 - RNA, 21 nt, Homo sapiens
gagucauuuuuuaagugacuu

SEQ ID NO: 1327281 - RNA, 13 nt, Homo sapiens
gaguccacuccca

SEQ ID NO: 1327282 - RNA, 20 nt, Homo sapiens
gaguccacucccagugcuug

SEQ ID NO: 1327283 - RNA, 17 nt, Homo sapiens
gagugaaacauugaacu

SEQ ID NO: 1327284 - RNA, 22 nt, Homo sapiens
gagugacgcaucuccaagccaa

SEQ ID NO: 1327285 - RNA, 16 nt, Homo sapiens
gagugcaguggcgcga

SEQ ID NO: 1327286 - RNA, 13 nt, Homo sapiens
gagugcugggauu

SEQ ID NO: 1327287 - RNA, 19 nt, Homo sapiens
gagugucaugaagugcaca

SEQ ID NO: 1327288 - RNA, 23 nt, Homo sapiens
gagugugggggaggcgcacagug

SEQ ID NO: 1327289 - RNA, 19 nt, Homo sapiens
gaguuaacaggacaguuga

SEQ ID NO: 1327290 - RNA, 22 nt, Homo sapiens
gaguuaaugugcugagcauuuu

SEQ ID NO: 1327291 - RNA, 21 nt, Homo sapiens
gaguuccuuaucccucucuuc

SEQ ID NO: 1327292 - RNA, 20 nt, Homo sapiens
gaguuuaaacaaaaaaccca

SEQ ID NO: 1327293 - RNA, 17 nt, Homo sapiens
gaguuuccucgcauuaa

SEQ ID NO: 1327294 - RNA, 22 nt, Homo sapiens
gaguuugacuuagaauaaugaa

SEQ ID NO: 1327295 - RNA, 17 nt, Homo sapiens
gaguuuuguauucaaua

SEQ ID NO: 1327296 - RNA, 23 nt, Homo sapiens
gauaaaacacuaacuuaaugugu

SEQ ID NO: 1327297 - RNA, 19 nt, Homo sapiens
gauaaaauuauugaugauu

SEQ ID NO: 1327298 - RNA, 18 nt, Homo sapiens
gauaagcuaacaccagac

SEQ ID NO: 1327299 - RNA, 17 nt, Homo sapiens
gauaaucguguccugaa

SEQ ID NO: 1327300 - RNA, 13 nt, Homo sapiens
gauaaucugagca

SEQ ID NO: 1327301 - RNA, 17 nt, Homo sapiens
gauacauacaccagcau

SEQ ID NO: 1327302 - RNA, 17 nt, Homo sapiens
gauacugucucuuucau

SEQ ID NO: 1327303 - RNA, 16 nt, Homo sapiens
gauacuuuuacagguu

SEQ ID NO: 1327304 - RNA, 14 nt, Homo sapiens
gauagaaggcuaug

SEQ ID NO: 1327305 - RNA, 13 nt, Homo sapiens
gauagaggguacu

SEQ ID NO: 1327306 - RNA, 18 nt, Homo sapiens
gauagcucucugacugcu

SEQ ID NO: 1327307 - RNA, 22 nt, Homo sapiens
gauauauaaguguacauaugug

SEQ ID NO: 1327308 - RNA, 16 nt, Homo sapiens
gauauauaggcuauuu

SEQ ID NO: 1327309 - RNA, 13 nt, Homo sapiens
gauauauuccacc

SEQ ID NO: 1327310 - RNA, 19 nt, Homo sapiens
gauaucugcagggacagag

SEQ ID NO: 1327311 - RNA, 17 nt, Homo sapiens
gauaugaagaaucugcu

SEQ ID NO: 1327312 - RNA, 22 nt, Homo sapiens
gauauggcaggacuccuggcag

SEQ ID NO: 1327313 - RNA, 15 nt, Homo sapiens
gauauucucuaguca

SEQ ID NO: 1327314 - RNA, 14 nt, Homo sapiens
gauauuuaaauuca

SEQ ID NO: 1327315 - RNA, 20 nt, Homo sapiens
gauauuuauugauguuuuca

SEQ ID NO: 1327316 - RNA, 19 nt, Homo sapiens
gaucacuucaggucaggag

SEQ ID NO: 1327317 - RNA, 19 nt, Homo sapiens
gaucacuugaggccaguga

SEQ ID NO: 1327318 - RNA, 18 nt, Homo sapiens
gaucagauaauuaugcuu

SEQ ID NO: 1327319 - RNA, 16 nt, Homo sapiens
gaucaucuuuccuguu

SEQ ID NO: 1327320 - RNA, 18 nt, Homo sapiens
gaucauuaucagccugug

SEQ ID NO: 1327321 - RNA, 22 nt, Homo sapiens
gauccaaaagaagcccccagcu

SEQ ID NO: 1327322 - RNA, 21 nt, Homo sapiens
gauccagggcagcaggccaga

SEQ ID NO: 1327323 - RNA, 15 nt, Homo sapiens
gauccuccacagaga

SEQ ID NO: 1327324 - RNA, 23 nt, Homo sapiens
gaucuccccucacacuuugccau

SEQ ID NO: 1327325 - RNA, 19 nt, Homo sapiens
gaucuggaacccagacuca

SEQ ID NO: 1327326 - RNA, 18 nt, Homo sapiens
gaucuggaaccucagccu

SEQ ID NO: 1327327 - RNA, 20 nt, Homo sapiens
gaugacaggcgugcaccugg

SEQ ID NO: 1327328 - RNA, 12 nt, Homo sapiens
gaugacauuccc

SEQ ID NO: 1327329 - RNA, 13 nt, Homo sapiens
gaugacauucccu

SEQ ID NO: 1327330 - RNA, 17 nt, Homo sapiens
gaugagcaagacauacu

SEQ ID NO: 1327331 - RNA, 18 nt, Homo sapiens
gaugagcaagacauacuu

SEQ ID NO: 1327332 - RNA, 22 nt, Homo sapiens
gaugaucuuuaaaauacacacu

SEQ ID NO: 1327333 - RNA, 20 nt, Homo sapiens
gaugcaaauagauucagaga

SEQ ID NO: 1327334 - RNA, 11 nt, Homo sapiens
gaugcacagua

SEQ ID NO: 1327335 - RNA, 20 nt, Homo sapiens
gaugcacaguaucugcuguu

SEQ ID NO: 1327336 - RNA, 22 nt, Homo sapiens
gaugcacaguaucugcuguucu

SEQ ID NO: 1327337 - RNA, 18 nt, Homo sapiens
gaugccauauaguguuau

SEQ ID NO: 1327338 - RNA, 22 nt, Homo sapiens
gaugcuaugauguuaguuuucc

SEQ ID NO: 1327339 - RNA, 14 nt, Homo sapiens
gaugcugagccaua

SEQ ID NO: 1327340 - RNA, 15 nt, Homo sapiens
gaugcuugguacugu

SEQ ID NO: 1327341 - RNA, 14 nt, Homo sapiens
gauggaagcaccua

SEQ ID NO: 1327342 - RNA, 16 nt, Homo sapiens
gauggacaucuuguca

SEQ ID NO: 1327343 - RNA, 20 nt, Homo sapiens
gauggacaucuugucauuuu

SEQ ID NO: 1327344 - RNA, 22 nt, Homo sapiens
gauggacucaggauccagugac

SEQ ID NO: 1327345 - RNA, 13 nt, Homo sapiens
gauggagacaccc

SEQ ID NO: 1327346 - RNA, 14 nt, Homo sapiens
gaugggagaguaaa

SEQ ID NO: 1327347 - RNA, 17 nt, Homo sapiens
gauggucccuauuccuc

SEQ ID NO: 1327348 - RNA, 18 nt, Homo sapiens
gauggugacauugcaccu

SEQ ID NO: 1327349 - RNA, 18 nt, Homo sapiens
gauguaaaacugaacuuc

SEQ ID NO: 1327350 - RNA, 13 nt, Homo sapiens
gauguauauccau

SEQ ID NO: 1327351 - RNA, 17 nt, Homo sapiens
gaugucuccacuuucac

SEQ ID NO: 1327352 - RNA, 14 nt, Homo sapiens
gaugugaacacauc

SEQ ID NO: 1327353 - RNA, 17 nt, Homo sapiens
gaugugcaguuuggaau

SEQ ID NO: 1327354 - RNA, 19 nt, Homo sapiens
gauuacaggcgugagccac

SEQ ID NO: 1327355 - RNA, 19 nt, Homo sapiens
gauuaggucguuuuccaaa

SEQ ID NO: 1327356 - RNA, 21 nt, Homo sapiens
gauucauauuuacuucuuaua

SEQ ID NO: 1327357 - RNA, 14 nt, Homo sapiens
gauucaugcacugu

SEQ ID NO: 1327358 - RNA, 16 nt, Homo sapiens
gauucaugcacuguag

SEQ ID NO: 1327359 - RNA, 14 nt, Homo sapiens
gauucaugccaauu

SEQ ID NO: 1327360 - RNA, 12 nt, Homo sapiens
gauuccagagag

SEQ ID NO: 1327361 - RNA, 15 nt, Homo sapiens
gauuccaucaaagag

SEQ ID NO: 1327362 - RNA, 13 nt, Homo sapiens
gauucuauguuaa

SEQ ID NO: 1327363 - RNA, 13 nt, Homo sapiens
gauucuucacugu

SEQ ID NO: 1327364 - RNA, 22 nt, Homo sapiens
gauugccccuggcuuugccucu

SEQ ID NO: 1327365 - RNA, 14 nt, Homo sapiens
gauuguaugaaguu

SEQ ID NO: 1327366 - RNA, 19 nt, Homo sapiens
gauuguauuuaagacauaa

SEQ ID NO: 1327367 - RNA, 22 nt, Homo sapiens
gauuuaaagguugaguauguga

SEQ ID NO: 1327368 - RNA, 15 nt, Homo sapiens
gauuuaauguugauu

SEQ ID NO: 1327369 - RNA, 23 nt, Homo sapiens
gauuuaccuguuuuucaguauuu

SEQ ID NO: 1327370 - RNA, 14 nt, Homo sapiens
gauuuaugugcacu

SEQ ID NO: 1327371 - RNA, 14 nt, Homo sapiens
gauuuccauuugca

SEQ ID NO: 1327372 - RNA, 14 nt, Homo sapiens
gauuuccuuggcuu

SEQ ID NO: 1327373 - RNA, 18 nt, Homo sapiens
gauuuggaggcuaccuca

SEQ ID NO: 1327374 - RNA, 20 nt, Homo sapiens
gauuuggggcagagggacag

SEQ ID NO: 1327375 - RNA, 13 nt, Homo sapiens
gauuuuaccaaag

SEQ ID NO: 1327376 - RNA, 20 nt, Homo sapiens
gauuuugaaauuuuuauuaa

SEQ ID NO: 1327377 - RNA, 23 nt, Homo sapiens
gauuuuggccaucaggacucuga

SEQ ID NO: 1327378 - RNA, 17 nt, Homo sapiens
gauuuuuuccucugcau

SEQ ID NO: 1327379 - RNA, 14 nt, Homo sapiens
gcaaacccuuucau

SEQ ID NO: 1327380 - RNA, 17 nt, Homo sapiens
gcaaagaucuguccuca

SEQ ID NO: 1327381 - RNA, 19 nt, Homo sapiens
gcaaagcacauagagccag

SEQ ID NO: 1327382 - RNA, 22 nt, Homo sapiens
gcaaaggaaaaauugaugaaua

SEQ ID NO: 1327383 - RNA, 16 nt, Homo sapiens
gcaaaggagccuacuc

SEQ ID NO: 1327384 - RNA, 14 nt, Homo sapiens
gcaaagggaaauca

SEQ ID NO: 1327385 - RNA, 12 nt, Homo sapiens
gcaaaugaugcc

SEQ ID NO: 1327386 - RNA, 16 nt, Homo sapiens
cuuuuaacugccaaga

SEQ ID NO: 1327387 - RNA, 18 nt, Homo sapiens
cuuuuacagguuaagaca

SEQ ID NO: 1327388 - RNA, 16 nt, Homo sapiens
cuuuuccccaguccca

SEQ ID NO: 1327389 - RNA, 11 nt, Homo sapiens
cuuuucucugu

SEQ ID NO: 1327390 - RNA, 22 nt, Homo sapiens
cuuuucugccacuccauauuaa

SEQ ID NO: 1327391 - RNA, 21 nt, Homo sapiens
cuuuucuggcaaaaaggagcc

SEQ ID NO: 1327392 - RNA, 21 nt, Homo sapiens
cuuuugcucauggugaauaua

SEQ ID NO: 1327393 - RNA, 21 nt, Homo sapiens
cuuuugguuaugaauacuuug

SEQ ID NO: 1327394 - RNA, 14 nt, Homo sapiens
cuuuugucuaauua

SEQ ID NO: 1327395 - RNA, 19 nt, Homo sapiens
cuuuuguggaguuugacac

SEQ ID NO: 1327396 - RNA, 12 nt, Homo sapiens
cuuuuguugccc

SEQ ID NO: 1327397 - RNA, 17 nt, Homo sapiens
cuuuuuaaccugcaaaa

SEQ ID NO: 1327398 - RNA, 20 nt, Homo sapiens
cuuuuuaauauugauaugcu

SEQ ID NO: 1327399 - RNA, 18 nt, Homo sapiens
cuuuuuuauacucaauca

SEQ ID NO: 1327400 - RNA, 16 nt, Homo sapiens
cuuuuuuugcuuuaaa

SEQ ID NO: 1327401 - RNA, 15 nt, Homo sapiens
gaaaaagacauaaaa

SEQ ID NO: 1327402 - RNA, 15 nt, Homo sapiens
gaaaacaacaaaaca

SEQ ID NO: 1327403 - RNA, 12 nt, Homo sapiens
gaaaacaauucu

SEQ ID NO: 1327404 - RNA, 13 nt, Homo sapiens
gaaaacacuguca

SEQ ID NO: 1327405 - RNA, 14 nt, Homo sapiens
gaaaacacugucau

SEQ ID NO: 1327406 - RNA, 20 nt, Homo sapiens
gaaaaccuaguacauuacua

SEQ ID NO: 1327407 - RNA, 17 nt, Homo sapiens
gaaaaccucuccugacc

SEQ ID NO: 1327408 - RNA, 18 nt, Homo sapiens
gaaaaccuucugccucau

SEQ ID NO: 1327409 - RNA, 17 nt, Homo sapiens
gaaaacggagagggaau

SEQ ID NO: 1327410 - RNA, 14 nt, Homo sapiens
gaaaagaaagugaa

SEQ ID NO: 1327411 - RNA, 21 nt, Homo sapiens
gccccaggguuuacaugaagc

SEQ ID NO: 1327412 - RNA, 21 nt, Homo sapiens
gccccauccuccagcagggaa

SEQ ID NO: 1327413 - RNA, 20 nt, Homo sapiens
gccccauggcagcuccugac

SEQ ID NO: 1327414 - RNA, 13 nt, Homo sapiens
gcccccacugacc

SEQ ID NO: 1327415 - RNA, 16 nt, Homo sapiens
gcccccagcccuggga

SEQ ID NO: 1327416 - RNA, 16 nt, Homo sapiens
ggcuuugcuuagcuug

SEQ ID NO: 1327417 - RNA, 16 nt, Homo sapiens
ggcuuuguugugagaa

SEQ ID NO: 1327418 - RNA, 19 nt, Homo sapiens
ggcuuuuccaaaucaagga

SEQ ID NO: 1327419 - RNA, 12 nt, Homo sapiens
ggcuuuugccac

SEQ ID NO: 1327420 - RNA, 22 nt, Homo sapiens
gggaaacuuagaucaucaguca

SEQ ID NO: 1327421 - RNA, 15 nt, Homo sapiens
gggaaauccauucca

SEQ ID NO: 1327422 - RNA, 19 nt, Homo sapiens
gggaagaucugguauuucc

SEQ ID NO: 1327423 - RNA, 18 nt, Homo sapiens
gggaaggcaaaugaugcc

SEQ ID NO: 1327424 - RNA, 21 nt, Homo sapiens
gggaagggagccaagggaugg

SEQ ID NO: 1327425 - RNA, 22 nt, Homo sapiens
gggaaggucagcccagccccuc

SEQ ID NO: 1327426 - RNA, 17 nt, Homo sapiens
gggaaucucuugccugc

SEQ ID NO: 1327427 - RNA, 15 nt, Homo sapiens
gggaauggauccugg

SEQ ID NO: 1327428 - RNA, 15 nt, Homo sapiens
gggaauucccucccc

SEQ ID NO: 1327429 - RNA, 19 nt, Homo sapiens
gggaccuaagccacguuaa

SEQ ID NO: 1327430 - RNA, 18 nt, Homo sapiens
gggacugaaaaccucucc

SEQ ID NO: 1327431 - RNA, 18 nt, Homo sapiens
gggacuucugucuucaca

SEQ ID NO: 1327432 - RNA, 14 nt, Homo sapiens
gggagaaacccaga

SEQ ID NO: 1327433 - RNA, 19 nt, Homo sapiens
gggagacaccaguggugcg

SEQ ID NO: 1327434 - RNA, 22 nt, Homo sapiens
gggagcacugcguuuuccuagc

SEQ ID NO: 1327435 - RNA, 15 nt, Homo sapiens
gggagcagaugcaau

SEQ ID NO: 1327436 - RNA, 14 nt, Homo sapiens
gggagccaagggau

SEQ ID NO: 1327437 - RNA, 16 nt, Homo sapiens
gggagcccagugaagc

SEQ ID NO: 1327438 - RNA, 20 nt, Homo sapiens
gggagccgcuucuccaaguc

SEQ ID NO: 1327439 - RNA, 23 nt, Homo sapiens
gggaggaaaaggccccugcaaug

SEQ ID NO: 1327440 - RNA, 17 nt, Homo sapiens
gggaggcacacuuucug

SEQ ID NO: 1327441 - RNA, 22 nt, Homo sapiens
gggaggcagagguugcagugaa

SEQ ID NO: 1327442 - RNA, 13 nt, Homo sapiens
gggaucuugcaaa

SEQ ID NO: 1327443 - RNA, 23 nt, Homo sapiens
gggaugucuccgucucugucuca

SEQ ID NO: 1327444 - RNA, 23 nt, Homo sapiens
gggauuauaggcaugagccacug

SEQ ID NO: 1327445 - RNA, 20 nt, Homo sapiens
gggauuguagauaacacuga

SEQ ID NO: 1327446 - RNA, 19 nt, Homo sapiens
gggcaacgagugaaacucc

SEQ ID NO: 1327447 - RNA, 13 nt, Homo sapiens
gggcaaucuuugc

SEQ ID NO: 1327448 - RNA, 13 nt, Homo sapiens
gggcacacgcugc

SEQ ID NO: 1327449 - RNA, 23 nt, Homo sapiens
gggcacagauccccccacaaagu

SEQ ID NO: 1327450 - RNA, 20 nt, Homo sapiens
gggcaccaggggccaaccuc

SEQ ID NO: 1327451 - RNA, 12 nt, Homo sapiens
gggcagggauga

SEQ ID NO: 1327452 - RNA, 17 nt, Homo sapiens
gggcaguccuuacuccc

SEQ ID NO: 1327453 - RNA, 21 nt, Homo sapiens
gggccagagccagggggguga

SEQ ID NO: 1327454 - RNA, 13 nt, Homo sapiens
gggccagugcagu

SEQ ID NO: 1327455 - RNA, 12 nt, Homo sapiens
gggccaugccuc

SEQ ID NO: 1327456 - RNA, 14 nt, Homo sapiens
gggcccacguguau

SEQ ID NO: 1327457 - RNA, 15 nt, Homo sapiens
gggcccagcccagag

SEQ ID NO: 1327458 - RNA, 16 nt, Homo sapiens
gggccggaaggaaugu

SEQ ID NO: 1327459 - RNA, 14 nt, Homo sapiens
gggccguggcacag

SEQ ID NO: 1327460 - RNA, 15 nt, Homo sapiens
gggccugaugugugu

SEQ ID NO: 1327461 - RNA, 15 nt, Homo sapiens
gggccugucacugau

SEQ ID NO: 1327462 - RNA, 18 nt, Homo sapiens
gggcgcauacuacaguaa

SEQ ID NO: 1327463 - RNA, 17 nt, Homo sapiens
gggcguucucccaaaga

SEQ ID NO: 1327464 - RNA, 17 nt, Homo sapiens
gggcguugggagccuag

SEQ ID NO: 1327465 - RNA, 16 nt, Homo sapiens
gggcucagaguggggu

SEQ ID NO: 1327466 - RNA, 18 nt, Homo sapiens
gggcucuaaugugucucu

SEQ ID NO: 1327467 - RNA, 17 nt, Homo sapiens
gggcugaggccucucau

SEQ ID NO: 1327468 - RNA, 21 nt, Homo sapiens
gggcuugugauuuccauuucu

SEQ ID NO: 1327469 - RNA, 17 nt, Homo sapiens
ggggagugggcgcagug

SEQ ID NO: 1327470 - RNA, 16 nt, Homo sapiens
ggggccacguggaugg

SEQ ID NO: 1327471 - RNA, 17 nt, Homo sapiens
ggggcggggggcgggga

SEQ ID NO: 1327472 - RNA, 15 nt, Homo sapiens
ggggcguucgcugcg

SEQ ID NO: 1327473 - RNA, 15 nt, Homo sapiens
ggggcucuguggcaa

SEQ ID NO: 1327474 - RNA, 13 nt, Homo sapiens
gggguugcugaag

SEQ ID NO: 1327475 - RNA, 17 nt, Homo sapiens
gggguuucuggggucca

SEQ ID NO: 1327476 - RNA, 13 nt, Homo sapiens
ggguccacagcug

SEQ ID NO: 1327477 - RNA, 18 nt, Homo sapiens
ggguccugaagugaccuc

SEQ ID NO: 1327478 - RNA, 19 nt, Homo sapiens
ggguccuuuugacacugcu

SEQ ID NO: 1327479 - RNA, 20 nt, Homo sapiens
gggucucaccauguugccca

SEQ ID NO: 1327480 - RNA, 20 nt, Homo sapiens
gggucucacucuguugccca

SEQ ID NO: 1327481 - RNA, 21 nt, Homo sapiens
gggucucacucuguugcccag

SEQ ID NO: 1327482 - RNA, 21 nt, Homo sapiens
gggucuugcuauauugcccag

SEQ ID NO: 1327483 - RNA, 13 nt, Homo sapiens
gggugagugcaag

SEQ ID NO: 1327484 - RNA, 21 nt, Homo sapiens
ggguugcugguccugcacaug

SEQ ID NO: 1327485 - RNA, 18 nt, Homo sapiens
ggguuucaccauguuggc

SEQ ID NO: 1327486 - RNA, 16 nt, Homo sapiens
gguaaaacauuacuua

SEQ ID NO: 1327487 - RNA, 14 nt, Homo sapiens
gguaaggcugguga

SEQ ID NO: 1327488 - RNA, 21 nt, Homo sapiens
gguaccugguccccacugcug

SEQ ID NO: 1327489 - RNA, 11 nt, Homo sapiens
gguacuuucau

SEQ ID NO: 1327490 - RNA, 15 nt, Homo sapiens
gguagaaguggcaua

SEQ ID NO: 1327491 - RNA, 20 nt, Homo sapiens
gguagaggcugggggcucca

SEQ ID NO: 1327492 - RNA, 21 nt, Homo sapiens
gguaggcacaaauacauuccu

SEQ ID NO: 1327493 - RNA, 22 nt, Homo sapiens
gguagucacuugcgugaaugcu

SEQ ID NO: 1327494 - RNA, 21 nt, Homo sapiens
gguauuaaauugauguugcug

SEQ ID NO: 1327495 - RNA, 21 nt, Homo sapiens
ggucacguuuggugcuucuca

SEQ ID NO: 1327496 - RNA, 13 nt, Homo sapiens
ggucagcauguac

SEQ ID NO: 1327497 - RNA, 13 nt, Homo sapiens
ggucagggugaga

SEQ ID NO: 1327498 - RNA, 13 nt, Homo sapiens
gguccaccuggag

SEQ ID NO: 1327499 - RNA, 20 nt, Homo sapiens
gguccccacuuuauugccaa

SEQ ID NO: 1327500 - RNA, 21 nt, Homo sapiens
gguccccccgagucuccggga

SEQ ID NO: 1327501 - RNA, 23 nt, Homo sapiens
gguccugcagccugcaggaccuc

SEQ ID NO: 1327502 - RNA, 15 nt, Homo sapiens
gguccuuuagucugu

SEQ ID NO: 1327503 - RNA, 15 nt, Homo sapiens
ggucuaaucagugau

SEQ ID NO: 1327504 - RNA, 23 nt, Homo sapiens
ggucuccccuccugcacacaggg

SEQ ID NO: 1327505 - RNA, 20 nt, Homo sapiens
ggucuccucagccuccucau

SEQ ID NO: 1327506 - RNA, 16 nt, Homo sapiens
ggucuccucugcagcu

SEQ ID NO: 1327507 - RNA, 17 nt, Homo sapiens
ggucuccucugcagcuc

SEQ ID NO: 1327508 - RNA, 17 nt, Homo sapiens
ggucuguggugcagugu

SEQ ID NO: 1327509 - RNA, 22 nt, Homo sapiens
ggucuucgcagccuagauauga

SEQ ID NO: 1327510 - RNA, 20 nt, Homo sapiens
ggugaaaagggguguggcaa

SEQ ID NO: 1327511 - RNA, 14 nt, Homo sapiens
ggugaaaucccugc

SEQ ID NO: 1327512 - RNA, 23 nt, Homo sapiens
ggugaaauuauaacuauuacagu

SEQ ID NO: 1327513 - RNA, 13 nt, Homo sapiens
ggugaaccaaaga

SEQ ID NO: 1327514 - RNA, 14 nt, Homo sapiens
ggugacaccucccc

SEQ ID NO: 1327515 - RNA, 17 nt, Homo sapiens
ggugauggaacaagaga

SEQ ID NO: 1327516 - RNA, 18 nt, Homo sapiens
ggugcagaccuuggggga

SEQ ID NO: 1327517 - RNA, 17 nt, Homo sapiens
ggugccgcucucucuga

SEQ ID NO: 1327518 - RNA, 18 nt, Homo sapiens
ggugccgcugucucugag

SEQ ID NO: 1327519 - RNA, 14 nt, Homo sapiens
ggugcucucucuga

SEQ ID NO: 1327520 - RNA, 16 nt, Homo sapiens
ggugcuguuuugccag

SEQ ID NO: 1327521 - RNA, 17 nt, Homo sapiens
ggugcuucucagauuuc

SEQ ID NO: 1327522 - RNA, 22 nt, Homo sapiens
gguggaaugccgcugucucuga

SEQ ID NO: 1327523 - RNA, 21 nt, Homo sapiens
gguggauuugagcuguggcug

SEQ ID NO: 1327524 - RNA, 19 nt, Homo sapiens
ggugggggugcugcucucu

SEQ ID NO: 1327525 - RNA, 14 nt, Homo sapiens
ggugggguggcacc

SEQ ID NO: 1327526 - RNA, 18 nt, Homo sapiens
gguguacacggaggucuc

SEQ ID NO: 1327527 - RNA, 17 nt, Homo sapiens
gguguccccaccaucug

SEQ ID NO: 1327528 - RNA, 17 nt, Homo sapiens
gguguuaauuuugcuaa

SEQ ID NO: 1327529 - RNA, 22 nt, Homo sapiens
gguguuaauuuugcuaacuggg

SEQ ID NO: 1327530 - RNA, 20 nt, Homo sapiens
gguuaaacauuaauauuuac

SEQ ID NO: 1327531 - RNA, 17 nt, Homo sapiens
gguuaccuuuguuccca

SEQ ID NO: 1327532 - RNA, 19 nt, Homo sapiens
gguucaaaaccuugcacag

SEQ ID NO: 1327533 - RNA, 18 nt, Homo sapiens
gguuccuggugacuccug

SEQ ID NO: 1327534 - RNA, 11 nt, Homo sapiens
gguucucaggc

SEQ ID NO: 1327535 - RNA, 17 nt, Homo sapiens
gguucucuccaccaggu

SEQ ID NO: 1327536 - RNA, 19 nt, Homo sapiens
gguugcugguccugcacau

SEQ ID NO: 1327537 - RNA, 20 nt, Homo sapiens
gguuucugagagagugccau

SEQ ID NO: 1327538 - RNA, 21 nt, Homo sapiens
uagaaagcuggcaacaugaag

SEQ ID NO: 1327539 - RNA, 12 nt, Homo sapiens
uagaacaaagaa

SEQ ID NO: 1327540 - RNA, 11 nt, Homo sapiens
uagaaccagcc

SEQ ID NO: 1327541 - RNA, 21 nt, Homo sapiens
uagaaccugaggucucauuca

SEQ ID NO: 1327542 - RNA, 22 nt, Homo sapiens
uagaagaugcaguucaaaaaca

SEQ ID NO: 1327543 - RNA, 23 nt, Homo sapiens
uagaaguuaaugauuuuacuuaa

SEQ ID NO: 1327544 - RNA, 17 nt, Homo sapiens
uagaauaaugcaagaua

SEQ ID NO: 1327545 - RNA, 19 nt, Homo sapiens
uagaauaggcagggggccc

SEQ ID NO: 1327546 - RNA, 17 nt, Homo sapiens
uagaaucugaguauaaa

SEQ ID NO: 1327547 - RNA, 19 nt, Homo sapiens
uagaaucugugaccucuga

SEQ ID NO: 1327548 - RNA, 20 nt, Homo sapiens
uagaauuugggggaaaauuu

SEQ ID NO: 1327549 - RNA, 11 nt, Homo sapiens
uagacuugaaa

SEQ ID NO: 1327550 - RNA, 19 nt, Homo sapiens
uagagacgggguuucucca

SEQ ID NO: 1327551 - RNA, 18 nt, Homo sapiens
uagagggcgagggaugau

SEQ ID NO: 1327552 - RNA, 22 nt, Homo sapiens
uagaggguacuugaaucuucag

SEQ ID NO: 1327553 - RNA, 15 nt, Homo sapiens
uagaguguagcugua

SEQ ID NO: 1327554 - RNA, 17 nt, Homo sapiens
uagaugcugacuguacu

SEQ ID NO: 1327555 - RNA, 22 nt, Homo sapiens
uagauucccaucauacacuucc

SEQ ID NO: 1327556 - RNA, 23 nt, Homo sapiens
uagcaaagauuaaaugugucauu

SEQ ID NO: 1327557 - RNA, 21 nt, Homo sapiens
uagcaaaggaaaaauugauga

SEQ ID NO: 1327558 - RNA, 19 nt, Homo sapiens
uagcaaauggcagaaccaa

SEQ ID NO: 1327559 - RNA, 14 nt, Homo sapiens
uagcaacaaaagga

SEQ ID NO: 1327560 - RNA, 22 nt, Homo sapiens
uagcaauaacauacaugagaua

SEQ ID NO: 1327561 - RNA, 11 nt, Homo sapiens
uagcacauggc

SEQ ID NO: 1327562 - RNA, 20 nt, Homo sapiens
uagcacauggcagauuugca

SEQ ID NO: 1327563 - RNA, 18 nt, Homo sapiens
uagcaccuccacauaccu

SEQ ID NO: 1327564 - RNA, 21 nt, Homo sapiens
uagcagcaggcucaggcacau

SEQ ID NO: 1327565 - RNA, 16 nt, Homo sapiens
uagcaguacuaaucau

SEQ ID NO: 1327566 - RNA, 17 nt, Homo sapiens
uagccagcugugcacuu

SEQ ID NO: 1327567 - RNA, 23 nt, Homo sapiens
uagcccaccuggguuggaggaag

SEQ ID NO: 1327568 - RNA, 17 nt, Homo sapiens
uagcccugcuccaacuc

SEQ ID NO: 1327569 - RNA, 17 nt, Homo sapiens
uagccucgcucuuggca

SEQ ID NO: 1327570 - RNA, 16 nt, Homo sapiens
uagccugggguggggu

SEQ ID NO: 1327571 - RNA, 20 nt, Homo sapiens
cuccaaaggucugaugucuc

SEQ ID NO: 1327572 - RNA, 14 nt, Homo sapiens
cuccaagcauuuca

SEQ ID NO: 1327573 - RNA, 23 nt, Homo sapiens
cuccaaggguuucgacuggucca

SEQ ID NO: 1327574 - RNA, 12 nt, Homo sapiens
cuccacauaccu

SEQ ID NO: 1327575 - RNA, 14 nt, Homo sapiens
cuccaccccacaga

SEQ ID NO: 1327576 - RNA, 22 nt, Homo sapiens
cuccaccgaccaacugcccuaa

SEQ ID NO: 1327577 - RNA, 17 nt, Homo sapiens
cuccagcccugcagcua

SEQ ID NO: 1327578 - RNA, 23 nt, Homo sapiens
cuccauaccugccccugccugac

SEQ ID NO: 1327579 - RNA, 18 nt, Homo sapiens
cuccauacuccacuccaa

SEQ ID NO: 1327580 - RNA, 17 nt, Homo sapiens
cuccaucuccacuccag

SEQ ID NO: 1327581 - RNA, 20 nt, Homo sapiens
cuccaucuuucuacagagau

SEQ ID NO: 1327582 - RNA, 18 nt, Homo sapiens
cucccaaagugcuggaau

SEQ ID NO: 1327583 - RNA, 19 nt, Homo sapiens
cucccaaggcucugagcaa

SEQ ID NO: 1327584 - RNA, 21 nt, Homo sapiens
cucccacaugaggccaucuca

SEQ ID NO: 1327585 - RNA, 22 nt, Homo sapiens
cucccagaggagccaccaguuc

SEQ ID NO: 1327586 - RNA, 19 nt, Homo sapiens
cuccccaguagcugggauu

SEQ ID NO: 1327587 - RNA, 21 nt, Homo sapiens
cuccccaugggcacaguggug

SEQ ID NO: 1327588 - RNA, 15 nt, Homo sapiens
cucccccaacacaaa

SEQ ID NO: 1327589 - RNA, 14 nt, Homo sapiens
cucccccacuccac

SEQ ID NO: 1327590 - RNA, 18 nt, Homo sapiens
cuccccucagagugcaag

SEQ ID NO: 1327591 - RNA, 19 nt, Homo sapiens
cucccucccccuggcacug

SEQ ID NO: 1327592 - RNA, 20 nt, Homo sapiens
cucccugcaucugaccagca

SEQ ID NO: 1327593 - RNA, 17 nt, Homo sapiens
cucccugcugugccaug

SEQ ID NO: 1327594 - RNA, 13 nt, Homo sapiens
cuccgacucugca

SEQ ID NO: 1327595 - RNA, 17 nt, Homo sapiens
cuccgugcuuaaccaaa

SEQ ID NO: 1327596 - RNA, 21 nt, Homo sapiens
cuccuacccuuccagugcccu

SEQ ID NO: 1327597 - RNA, 17 nt, Homo sapiens
cuccuauuugaccagaa

SEQ ID NO: 1327598 - RNA, 20 nt, Homo sapiens
cuccucacuguauccagguu

SEQ ID NO: 1327599 - RNA, 20 nt, Homo sapiens
cuccucagcggcuccagcuc

SEQ ID NO: 1327600 - RNA, 13 nt, Homo sapiens
cuccuccuaccag

SEQ ID NO: 1327601 - RNA, 22 nt, Homo sapiens
cuccuccuacccuuccagugcc

SEQ ID NO: 1327602 - RNA, 14 nt, Homo sapiens
cuccucggagagca

SEQ ID NO: 1327603 - RNA, 19 nt, Homo sapiens
cuccucucuagaaccuccu

SEQ ID NO: 1327604 - RNA, 22 nt, Homo sapiens
cuccucuguccaggcacugcug

SEQ ID NO: 1327605 - RNA, 20 nt, Homo sapiens
cuccugaccccgccaugcau

SEQ ID NO: 1327606 - RNA, 16 nt, Homo sapiens
cuccugaccucaggug

SEQ ID NO: 1327607 - RNA, 14 nt, Homo sapiens
cuccugacuuuuaa

SEQ ID NO: 1327608 - RNA, 21 nt, Homo sapiens
cuccugauguagcuugagaua

SEQ ID NO: 1327609 - RNA, 18 nt, Homo sapiens
cuccugcaucucaugagu

SEQ ID NO: 1327610 - RNA, 12 nt, Homo sapiens
cuccugccuuag

SEQ ID NO: 1327611 - RNA, 17 nt, Homo sapiens
cuccuggguucaagcaa

SEQ ID NO: 1327612 - RNA, 18 nt, Homo sapiens
cuccugucccucauccau

SEQ ID NO: 1327613 - RNA, 22 nt, Homo sapiens
cuccugugugauugacagcuuu

SEQ ID NO: 1327614 - RNA, 15 nt, Homo sapiens
cuccuucccauuucu

SEQ ID NO: 1327615 - RNA, 14 nt, Homo sapiens
ggcuucacauucau

SEQ ID NO: 1327616 - RNA, 16 nt, Homo sapiens
ggcuucccuaaacugc

SEQ ID NO: 1327617 - RNA, 17 nt, Homo sapiens
ggcuucgcgcuggaauc

SEQ ID NO: 1327618 - RNA, 11 nt, Homo sapiens
ggcuucucacg

SEQ ID NO: 1327619 - RNA, 15 nt, Homo sapiens
ggcuucuccaaaggg

SEQ ID NO: 1327620 - RNA, 18 nt, Homo sapiens
ggcuuguaaaugugacac

SEQ ID NO: 1327621 - RNA, 15 nt, Homo sapiens
ggcuuuaugcaaaua

SEQ ID NO: 1327622 - RNA, 15 nt, Homo sapiens
ggcuuucagagccag

SEQ ID NO: 1327623 - RNA, 11 nt, Homo sapiens
gggaaagccuc

SEQ ID NO: 1327624 - RNA, 19 nt, Homo sapiens
gggaagacuuuaaaccacc

SEQ ID NO: 1327625 - RNA, 14 nt, Homo sapiens
gggaagcucagggg

SEQ ID NO: 1327626 - RNA, 20 nt, Homo sapiens
gggaagcucccaccccacuc

SEQ ID NO: 1327627 - RNA, 16 nt, Homo sapiens
gggacacucauauugc

SEQ ID NO: 1327628 - RNA, 19 nt, Homo sapiens
gggacauugcaauuugcag

SEQ ID NO: 1327629 - RNA, 19 nt, Homo sapiens
gggaccccgagaacccuga

SEQ ID NO: 1327630 - RNA, 15 nt, Homo sapiens
gggaccgacuuucca

SEQ ID NO: 1327631 - RNA, 19 nt, Homo sapiens
gggagaagcuccucucccc

SEQ ID NO: 1327632 - RNA, 16 nt, Homo sapiens
gggagagagugcuauu

SEQ ID NO: 1327633 - RNA, 17 nt, Homo sapiens
gggagaggugauucuca

SEQ ID NO: 1327634 - RNA, 11 nt, Homo sapiens
gggagcacugc

SEQ ID NO: 1327635 - RNA, 20 nt, Homo sapiens
gggagccaagggauggacau

SEQ ID NO: 1327636 - RNA, 22 nt, Homo sapiens
gggagcccacuguccugggccu

SEQ ID NO: 1327637 - RNA, 12 nt, Homo sapiens
gggagcccagug

SEQ ID NO: 1327638 - RNA, 18 nt, Homo sapiens
gggagcgacacuugaaug

SEQ ID NO: 1327639 - RNA, 20 nt, Homo sapiens
gggaggcagagguugcagug

SEQ ID NO: 1327640 - RNA, 19 nt, Homo sapiens
gggagggaagggagccaag

SEQ ID NO: 1327641 - RNA, 16 nt, Homo sapiens
gggagugggcgcagug

SEQ ID NO: 1327642 - RNA, 14 nt, Homo sapiens
gggaguguguaauu

SEQ ID NO: 1327643 - RNA, 18 nt, Homo sapiens
gggauauggcugcccagg

SEQ ID NO: 1327644 - RNA, 20 nt, Homo sapiens
gggaugaggucaccagggga

SEQ ID NO: 1327645 - RNA, 13 nt, Homo sapiens
gggauuacaggcg

SEQ ID NO: 1327646 - RNA, 23 nt, Homo sapiens
gggauuacaggcgugagccacug

SEQ ID NO: 1327647 - RNA, 21 nt, Homo sapiens
gggcaaagccccucacacugc

SEQ ID NO: 1327648 - RNA, 12 nt, Homo sapiens
gggcaacauagu

SEQ ID NO: 1327649 - RNA, 23 nt, Homo sapiens
gggcaagaacagaaguguucaca

SEQ ID NO: 1327650 - RNA, 14 nt, Homo sapiens
gggcagcacucccc

SEQ ID NO: 1327651 - RNA, 19 nt, Homo sapiens
gggcagcgcaugugugcau

SEQ ID NO: 1327652 - RNA, 17 nt, Homo sapiens
gggcagggaucuugcaa

SEQ ID NO: 1327653 - RNA, 16 nt, Homo sapiens
gggcagggcccacgug

SEQ ID NO: 1327654 - RNA, 14 nt, Homo sapiens
gggcagugcccaug

SEQ ID NO: 1327655 - RNA, 15 nt, Homo sapiens
gggccaaccucaggc

SEQ ID NO: 1327656 - RNA, 12 nt, Homo sapiens
gggccagagcca

SEQ ID NO: 1327657 - RNA, 14 nt, Homo sapiens
gggccccauccuca

SEQ ID NO: 1327658 - RNA, 13 nt, Homo sapiens
gggccccauggca

SEQ ID NO: 1327659 - RNA, 22 nt, Homo sapiens
gggcccucuuucccugcgagac

SEQ ID NO: 1327660 - RNA, 14 nt, Homo sapiens
gggcccugagcuga

SEQ ID NO: 1327661 - RNA, 14 nt, Homo sapiens
gggccggccagugg

SEQ ID NO: 1327662 - RNA, 19 nt, Homo sapiens
ggaaggacuugacugggga

SEQ ID NO: 1327663 - RNA, 12 nt, Homo sapiens
ggaaggcaaaug

SEQ ID NO: 1327664 - RNA, 13 nt, Homo sapiens
ggaagggacacca

SEQ ID NO: 1327665 - RNA, 15 nt, Homo sapiens
ggaaguaccaagaac

SEQ ID NO: 1327666 - RNA, 16 nt, Homo sapiens
ggaaguuuuaaucucu

SEQ ID NO: 1327667 - RNA, 14 nt, Homo sapiens
ggaauaaagccuuu

SEQ ID NO: 1327668 - RNA, 12 nt, Homo sapiens
ggaaucagagag

SEQ ID NO: 1327669 - RNA, 20 nt, Homo sapiens
ggaaugccgcuagucucuga

SEQ ID NO: 1327670 - RNA, 23 nt, Homo sapiens
ggaaugccgcugucucugagggg

SEQ ID NO: 1327671 - RNA, 12 nt, Homo sapiens
ggaauguaggga

SEQ ID NO: 1327672 - RNA, 16 nt, Homo sapiens
ggaauuauucccauga

SEQ ID NO: 1327673 - RNA, 16 nt, Homo sapiens
ggacaaccucauuuua

SEQ ID NO: 1327674 - RNA, 11 nt, Homo sapiens
ggacacugaga

SEQ ID NO: 1327675 - RNA, 18 nt, Homo sapiens
ggacaggauaagagggau

SEQ ID NO: 1327676 - RNA, 17 nt, Homo sapiens
ggacauaaugggguccu

SEQ ID NO: 1327677 - RNA, 22 nt, Homo sapiens
ggacaucagcuggucaaacaaa

SEQ ID NO: 1327678 - RNA, 21 nt, Homo sapiens
ggaccaccguucagucauuuu

SEQ ID NO: 1327679 - RNA, 15 nt, Homo sapiens
ggaccagcucaggac

SEQ ID NO: 1327680 - RNA, 13 nt, Homo sapiens
ggacccucgagag

SEQ ID NO: 1327681 - RNA, 13 nt, Homo sapiens
ggaccucgugcca

SEQ ID NO: 1327682 - RNA, 21 nt, Homo sapiens
ggaccucuucuggagauggaa

SEQ ID NO: 1327683 - RNA, 23 nt, Homo sapiens
ggaccuggcgugcucagacccaa

SEQ ID NO: 1327684 - RNA, 12 nt, Homo sapiens
ggacuaccucug

SEQ ID NO: 1327685 - RNA, 23 nt, Homo sapiens
ggacucagguugucugaagucac

SEQ ID NO: 1327686 - RNA, 14 nt, Homo sapiens
ggacucuggacaau

SEQ ID NO: 1327687 - RNA, 18 nt, Homo sapiens
ggacugagcugggggaag

SEQ ID NO: 1327688 - RNA, 20 nt, Homo sapiens
ggacugccuugucucuagua

SEQ ID NO: 1327689 - RNA, 17 nt, Homo sapiens
ggacuggcacacuggcc

SEQ ID NO: 1327690 - RNA, 13 nt, Homo sapiens
ggacuuaaacugc

SEQ ID NO: 1327691 - RNA, 18 nt, Homo sapiens
ggagaagagcuguucaca

SEQ ID NO: 1327692 - RNA, 12 nt, Homo sapiens
ggagacuuguau

SEQ ID NO: 1327693 - RNA, 23 nt, Homo sapiens
ggagcacugcguuuuccuagcug

SEQ ID NO: 1327694 - RNA, 16 nt, Homo sapiens
ggagcagaugcaauga

SEQ ID NO: 1327695 - RNA, 16 nt, Homo sapiens
ggagcccuauugcugc

SEQ ID NO: 1327696 - RNA, 21 nt, Homo sapiens
ggagccuggcuccguccagga

SEQ ID NO: 1327697 - RNA, 15 nt, Homo sapiens
ggagcuaaaacuggc

SEQ ID NO: 1327698 - RNA, 16 nt, Homo sapiens
ggagcuagaacauucc

SEQ ID NO: 1327699 - RNA, 23 nt, Homo sapiens
ggagcuagaacauuccauuugcu

SEQ ID NO: 1327700 - RNA, 17 nt, Homo sapiens
ggaggagcuucucccag

SEQ ID NO: 1327701 - RNA, 20 nt, Homo sapiens
ggaggcagagguugcaguga

SEQ ID NO: 1327702 - RNA, 14 nt, Homo sapiens
ggaggcuucagaag

SEQ ID NO: 1327703 - RNA, 16 nt, Homo sapiens
ggagggaagcacugcc

SEQ ID NO: 1327704 - RNA, 22 nt, Homo sapiens
ggaggugaaaucccugccucag

SEQ ID NO: 1327705 - RNA, 23 nt, Homo sapiens
ggaggugguccuccuaucucccu

SEQ ID NO: 1327706 - RNA, 17 nt, Homo sapiens
ggaguauccucuugcca

SEQ ID NO: 1327707 - RNA, 12 nt, Homo sapiens
ggaguccacucc

SEQ ID NO: 1327708 - RNA, 14 nt, Homo sapiens
ggaguccacuccca

SEQ ID NO: 1327709 - RNA, 22 nt, Homo sapiens
ggagucuugcucugucacccag

SEQ ID NO: 1327710 - RNA, 19 nt, Homo sapiens
ggauaaaugucuuuccaaa

SEQ ID NO: 1327711 - RNA, 11 nt, Homo sapiens
ggaucagagau

SEQ ID NO: 1327712 - RNA, 19 nt, Homo sapiens
ggaucaguuaacuauugca

SEQ ID NO: 1327713 - RNA, 18 nt, Homo sapiens
ggauccugguuucgugug

SEQ ID NO: 1327714 - RNA, 19 nt, Homo sapiens
ggaugaggucaccagggga

SEQ ID NO: 1327715 - RNA, 20 nt, Homo sapiens
ggaugaugagggaagcaaua

SEQ ID NO: 1327716 - RNA, 22 nt, Homo sapiens
ggaugggugcuuaguaaguacu

SEQ ID NO: 1327717 - RNA, 13 nt, Homo sapiens
ggauguacaaaga

SEQ ID NO: 1327718 - RNA, 12 nt, Homo sapiens
ggauguacuuaa

SEQ ID NO: 1327719 - RNA, 15 nt, Homo sapiens
ggauuaaauuuaauu

SEQ ID NO: 1327720 - RNA, 14 nt, Homo sapiens
ggauuuuaccaaag

SEQ ID NO: 1327721 - RNA, 13 nt, Homo sapiens
ggcaaacaagcac

SEQ ID NO: 1327722 - RNA, 13 nt, Homo sapiens
ggcaaaugccuga

SEQ ID NO: 1327723 - RNA, 23 nt, Homo sapiens
ggcaagaggaauuacgugcucug

SEQ ID NO: 1327724 - RNA, 19 nt, Homo sapiens
ggcaccagacacccaggac

SEQ ID NO: 1327725 - RNA, 13 nt, Homo sapiens
ggcacucaggggg

SEQ ID NO: 1327726 - RNA, 20 nt, Homo sapiens
ggcacuccuggagauaugaa

SEQ ID NO: 1327727 - RNA, 16 nt, Homo sapiens
ggcacuggugggccau

SEQ ID NO: 1327728 - RNA, 19 nt, Homo sapiens
ggcagacugugaacuugac

SEQ ID NO: 1327729 - RNA, 12 nt, Homo sapiens
ggcagcaauuua

SEQ ID NO: 1327730 - RNA, 16 nt, Homo sapiens
ggcagccacaacugca

SEQ ID NO: 1327731 - RNA, 13 nt, Homo sapiens
ggcagcgacccca

SEQ ID NO: 1327732 - RNA, 16 nt, Homo sapiens
ggcagcuccacagggc

SEQ ID NO: 1327733 - RNA, 17 nt, Homo sapiens
ggcagcugagcagcuuu

SEQ ID NO: 1327734 - RNA, 15 nt, Homo sapiens
ggcaggaaagccaca

SEQ ID NO: 1327735 - RNA, 19 nt, Homo sapiens
ggcaggagaaucgcuugaa

SEQ ID NO: 1327736 - RNA, 20 nt, Homo sapiens
ggcaggagaaucgcuugaac

SEQ ID NO: 1327737 - RNA, 17 nt, Homo sapiens
ggcaggggaagcucuca

SEQ ID NO: 1327738 - RNA, 17 nt, Homo sapiens
ggcauaaaugucuaaag

SEQ ID NO: 1327739 - RNA, 14 nt, Homo sapiens
ggccaacagcaccu

SEQ ID NO: 1327740 - RNA, 17 nt, Homo sapiens
ggccaacggcaacagca

SEQ ID NO: 1327741 - RNA, 18 nt, Homo sapiens
ggccacagugcaauuuua

SEQ ID NO: 1327742 - RNA, 19 nt, Homo sapiens
ggccacggugccuccagau

SEQ ID NO: 1327743 - RNA, 19 nt, Homo sapiens
ggccagcaagcucuucacu

SEQ ID NO: 1327744 - RNA, 11 nt, Homo sapiens
ggccagcacca

SEQ ID NO: 1327745 - RNA, 16 nt, Homo sapiens
ggccagcaccaucucu

SEQ ID NO: 1327746 - RNA, 13 nt, Homo sapiens
ggccagguggcca

SEQ ID NO: 1327747 - RNA, 23 nt, Homo sapiens
ggccauaaacgguuccuggugac

SEQ ID NO: 1327748 - RNA, 18 nt, Homo sapiens
ggcccaaagaaagagcua

SEQ ID NO: 1327749 - RNA, 19 nt, Homo sapiens
ggcccagagcccagcucca

SEQ ID NO: 1327750 - RNA, 14 nt, Homo sapiens
ggccccuccaucca

SEQ ID NO: 1327751 - RNA, 23 nt, Homo sapiens
ggcccgaggacgcucccugcucc

SEQ ID NO: 1327752 - RNA, 15 nt, Homo sapiens
ggcccggccagccau

SEQ ID NO: 1327753 - RNA, 14 nt, Homo sapiens
ggcccuagacucau

SEQ ID NO: 1327754 - RNA, 20 nt, Homo sapiens
ggcccuggggaucuucccac

SEQ ID NO: 1327755 - RNA, 16 nt, Homo sapiens
ggcccuggucuccgga

SEQ ID NO: 1327756 - RNA, 16 nt, Homo sapiens
ggcccugugagcacaa

SEQ ID NO: 1327757 - RNA, 15 nt, Homo sapiens
ggcccugugccuugg

SEQ ID NO: 1327758 - RNA, 19 nt, Homo sapiens
ggccgggugggcggcacag

SEQ ID NO: 1327759 - RNA, 16 nt, Homo sapiens
ggccguggcacagcug

SEQ ID NO: 1327760 - RNA, 18 nt, Homo sapiens
ggccguggcacagcuggg

SEQ ID NO: 1327761 - RNA, 11 nt, Homo sapiens
ggccuaugaaa

SEQ ID NO: 1327762 - RNA, 19 nt, Homo sapiens
ggccuccccaugggcacag

SEQ ID NO: 1327763 - RNA, 17 nt, Homo sapiens
ggccuccugucccucau

SEQ ID NO: 1327764 - RNA, 14 nt, Homo sapiens
ggccugacucucag

SEQ ID NO: 1327765 - RNA, 19 nt, Homo sapiens
ggccugccuucuucuugug

SEQ ID NO: 1327766 - RNA, 22 nt, Homo sapiens
ggccugcggaggcgguggcaga

SEQ ID NO: 1327767 - RNA, 18 nt, Homo sapiens
ggccuggaagagcugaga

SEQ ID NO: 1327768 - RNA, 15 nt, Homo sapiens
ggccuguacccagua

SEQ ID NO: 1327769 - RNA, 16 nt, Homo sapiens
ggccuuuaagaaccuu

SEQ ID NO: 1327770 - RNA, 17 nt, Homo sapiens
ggcggcuucgcgcugga

SEQ ID NO: 1327771 - RNA, 21 nt, Homo sapiens
ggcuaauaaacuuugugcuga

SEQ ID NO: 1327772 - RNA, 16 nt, Homo sapiens
ggcuaauauacuugua

SEQ ID NO: 1327773 - RNA, 19 nt, Homo sapiens
ggcuaccaggaagaaggac

SEQ ID NO: 1327774 - RNA, 23 nt, Homo sapiens
ggcuaccucaccugggcagggau

SEQ ID NO: 1327775 - RNA, 13 nt, Homo sapiens
ggcuagacaguuc

SEQ ID NO: 1327776 - RNA, 14 nt, Homo sapiens
ggcuagagugcaau

SEQ ID NO: 1327777 - RNA, 19 nt, Homo sapiens
ggcuaugcgggggugccua

SEQ ID NO: 1327778 - RNA, 20 nt, Homo sapiens
ggcuauggaggguccuccuc

SEQ ID NO: 1327779 - RNA, 22 nt, Homo sapiens
ggcuccaccccauccaguucau

SEQ ID NO: 1327780 - RNA, 19 nt, Homo sapiens
ggcuccacucuugaucucu

SEQ ID NO: 1327781 - RNA, 13 nt, Homo sapiens
ggcuccacuggga

SEQ ID NO: 1327782 - RNA, 14 nt, Homo sapiens
ggcuccacugggau

SEQ ID NO: 1327783 - RNA, 21 nt, Homo sapiens
ggcuccgggcaccaggggcca

SEQ ID NO: 1327784 - RNA, 22 nt, Homo sapiens
ggcuccucuaggcccugugagc

SEQ ID NO: 1327785 - RNA, 18 nt, Homo sapiens
ggcuccugagugucauga

SEQ ID NO: 1327786 - RNA, 19 nt, Homo sapiens
ggcucuaauucacagugcu

SEQ ID NO: 1327787 - RNA, 12 nt, Homo sapiens
ggcucugaccag

SEQ ID NO: 1327788 - RNA, 20 nt, Homo sapiens
ggcucuuaugugugccuuug

SEQ ID NO: 1327789 - RNA, 14 nt, Homo sapiens
ggcugcagguguuc

SEQ ID NO: 1327790 - RNA, 11 nt, Homo sapiens
ggcugcucccc

SEQ ID NO: 1327791 - RNA, 19 nt, Homo sapiens
ggcuggagugcaauggcgc

SEQ ID NO: 1327792 - RNA, 19 nt, Homo sapiens
ggcuggagugcaauggugu

SEQ ID NO: 1327793 - RNA, 20 nt, Homo sapiens
ggcugguggcccaggaccau

SEQ ID NO: 1327794 - RNA, 23 nt, Homo sapiens
ggcuguaaauccuagacuugaaa

SEQ ID NO: 1327795 - RNA, 19 nt, Homo sapiens
ggcuguuauaaaagcaaua

SEQ ID NO: 1327796 - RNA, 19 nt, Homo sapiens
ggcuuaugaauauauuuaa

SEQ ID NO: 1327797 - RNA, 19 nt, Homo sapiens
gaaaugauuacuccuccau

SEQ ID NO: 1327798 - RNA, 14 nt, Homo sapiens
gaaaugauuucaca

SEQ ID NO: 1327799 - RNA, 17 nt, Homo sapiens
gaaaugccacugggaca

SEQ ID NO: 1327800 - RNA, 17 nt, Homo sapiens
gaaaugcuguuaguaaa

SEQ ID NO: 1327801 - RNA, 17 nt, Homo sapiens
gaaauggcuaugaacag

SEQ ID NO: 1327802 - RNA, 23 nt, Homo sapiens
gaaauggcuuauuaaacuuugaa

SEQ ID NO: 1327803 - RNA, 14 nt, Homo sapiens
gaaauguaaaagca

SEQ ID NO: 1327804 - RNA, 21 nt, Homo sapiens
gaaauguuccuuuuaauggau

SEQ ID NO: 1327805 - RNA, 18 nt, Homo sapiens
gaaauuaacucagacaca

SEQ ID NO: 1327806 - RNA, 17 nt, Homo sapiens
gaaauuaugugacauuu

SEQ ID NO: 1327807 - RNA, 20 nt, Homo sapiens
gaaauuccaaauggugugaa

SEQ ID NO: 1327808 - RNA, 18 nt, Homo sapiens
gaaauuuuuaaaaauaca

SEQ ID NO: 1327809 - RNA, 15 nt, Homo sapiens
gaacaauauugacuu

SEQ ID NO: 1327810 - RNA, 14 nt, Homo sapiens
gaacacaucagcuu

SEQ ID NO: 1327811 - RNA, 20 nt, Homo sapiens
gaacacguucgacaaaagca

SEQ ID NO: 1327812 - RNA, 15 nt, Homo sapiens
gaacaguccuguuca

SEQ ID NO: 1327813 - RNA, 17 nt, Homo sapiens
gaacauaaaaaggacau

SEQ ID NO: 1327814 - RNA, 17 nt, Homo sapiens
gaaccacauucagggaa

SEQ ID NO: 1327815 - RNA, 18 nt, Homo sapiens
gaaccacauucagggaaa

SEQ ID NO: 1327816 - RNA, 22 nt, Homo sapiens
gaaccacgaaugagguaggcac

SEQ ID NO: 1327817 - RNA, 21 nt, Homo sapiens
gaaccacucccaccacaggca

SEQ ID NO: 1327818 - RNA, 15 nt, Homo sapiens
gaacccuuguccucc

SEQ ID NO: 1327819 - RNA, 18 nt, Homo sapiens
gaaccugcccugcuccca

SEQ ID NO: 1327820 - RNA, 22 nt, Homo sapiens
gaaccuuaaugacaacacuuaa

SEQ ID NO: 1327821 - RNA, 19 nt, Homo sapiens
gaacucaaauggggccaga

SEQ ID NO: 1327822 - RNA, 23 nt, Homo sapiens
gaacucaaauggggccagaucca

SEQ ID NO: 1327823 - RNA, 22 nt, Homo sapiens
gaacucuagagggcgagggaug

SEQ ID NO: 1327824 - RNA, 13 nt, Homo sapiens
gaacugacccuca

SEQ ID NO: 1327825 - RNA, 17 nt, Homo sapiens
gaacugacccucaggca

SEQ ID NO: 1327826 - RNA, 14 nt, Homo sapiens
gaacuucagagcau

SEQ ID NO: 1327827 - RNA, 15 nt, Homo sapiens
gaacuugucacagau

SEQ ID NO: 1327828 - RNA, 21 nt, Homo sapiens
gaacuuuguggucgacaucaa

SEQ ID NO: 1327829 - RNA, 18 nt, Homo sapiens
gaagaaaguaaacuguaa

SEQ ID NO: 1327830 - RNA, 13 nt, Homo sapiens
gaagaaggccaga

SEQ ID NO: 1327831 - RNA, 15 nt, Homo sapiens
gaagaaggccagaga

SEQ ID NO: 1327832 - RNA, 16 nt, Homo sapiens
gaagaaggccagagag

SEQ ID NO: 1327833 - RNA, 15 nt, Homo sapiens
gaagaaugcauucaa

SEQ ID NO: 1327834 - RNA, 20 nt, Homo sapiens
gaagacuuuaaaccaccuag

SEQ ID NO: 1327835 - RNA, 19 nt, Homo sapiens
gaagaggagaaaaagaaga

SEQ ID NO: 1327836 - RNA, 24 nt, Homo sapiens
gaagaggccuagccugagccaaag

SEQ ID NO: 1327837 - RNA, 14 nt, Homo sapiens
gaagaggucugauu

SEQ ID NO: 1327838 - RNA, 17 nt, Homo sapiens
gaagaguuauaaaguau

SEQ ID NO: 1327839 - RNA, 22 nt, Homo sapiens
gaagauagcucucugacugcuu

SEQ ID NO: 1327840 - RNA, 17 nt, Homo sapiens
gaagauuauaugaaguu

SEQ ID NO: 1327841 - RNA, 15 nt, Homo sapiens
gaagauucuauguua

SEQ ID NO: 1327842 - RNA, 17 nt, Homo sapiens
gaagauucuauguuaau

SEQ ID NO: 1327843 - RNA, 19 nt, Homo sapiens
gaagauuuuuucaguuacu

SEQ ID NO: 1327844 - RNA, 17 nt, Homo sapiens
gaagcaacuaggaaaau

SEQ ID NO: 1327845 - RNA, 14 nt, Homo sapiens
gaagcaacugugaa

SEQ ID NO: 1327846 - RNA, 18 nt, Homo sapiens
gaagcaacugugaauuca

SEQ ID NO: 1327847 - RNA, 17 nt, Homo sapiens
gaagccagcuuuccuca

SEQ ID NO: 1327848 - RNA, 13 nt, Homo sapiens
gaagccuugccua

SEQ ID NO: 1327849 - RNA, 17 nt, Homo sapiens
gaagcuguauaauuaau

SEQ ID NO: 1327850 - RNA, 13 nt, Homo sapiens
gaagcuuccauga

SEQ ID NO: 1327851 - RNA, 17 nt, Homo sapiens
gaagcuuccaugaugca

SEQ ID NO: 1327852 - RNA, 15 nt, Homo sapiens
gaaggaaaagcaaga

SEQ ID NO: 1327853 - RNA, 14 nt, Homo sapiens
gaaggaacucugca

SEQ ID NO: 1327854 - RNA, 15 nt, Homo sapiens
gaaggaauuauuccc

SEQ ID NO: 1327855 - RNA, 18 nt, Homo sapiens
gaaggacaggacccucag

SEQ ID NO: 1327856 - RNA, 19 nt, Homo sapiens
gaaggaggagucagggaga

SEQ ID NO: 1327857 - RNA, 19 nt, Homo sapiens
gaaggcaaggcccugcccu

SEQ ID NO: 1327858 - RNA, 18 nt, Homo sapiens
gaaggcaguggcagggga

SEQ ID NO: 1327859 - RNA, 19 nt, Homo sapiens
gaagggagccaagggaugg

SEQ ID NO: 1327860 - RNA, 11 nt, Homo sapiens
gaaggggccac

SEQ ID NO: 1327861 - RNA, 17 nt, Homo sapiens
gaagggucucucuccag

SEQ ID NO: 1327862 - RNA, 19 nt, Homo sapiens
gaagggugaauaguuuccu

SEQ ID NO: 1327863 - RNA, 21 nt, Homo sapiens
gaaggucugucauaggacucu

SEQ ID NO: 1327864 - RNA, 16 nt, Homo sapiens
gaagguucucugugcu

SEQ ID NO: 1327865 - RNA, 14 nt, Homo sapiens
gaaguauguauauu

SEQ ID NO: 1327866 - RNA, 15 nt, Homo sapiens
gaaguccuucaguga

SEQ ID NO: 1327867 - RNA, 22 nt, Homo sapiens
gaagucucugauuaguugacag

SEQ ID NO: 1327868 - RNA, 21 nt, Homo sapiens
gaagucuucuccuccaugaac

SEQ ID NO: 1327869 - RNA, 13 nt, Homo sapiens
gaagugacaggac

SEQ ID NO: 1327870 - RNA, 21 nt, Homo sapiens
gaagugauugaauauuguuaa

SEQ ID NO: 1327871 - RNA, 15 nt, Homo sapiens
gaaguggucucccca

SEQ ID NO: 1327872 - RNA, 13 nt, Homo sapiens
gaauaaaacacuc

SEQ ID NO: 1327873 - RNA, 11 nt, Homo sapiens
gaauaaagccu

SEQ ID NO: 1327874 - RNA, 13 nt, Homo sapiens
gaauaacuugaag

SEQ ID NO: 1327875 - RNA, 13 nt, Homo sapiens
gaauaaugaaggu

SEQ ID NO: 1327876 - RNA, 12 nt, Homo sapiens
gaauaauugcau

SEQ ID NO: 1327877 - RNA, 12 nt, Homo sapiens
gaauacacaugc

SEQ ID NO: 1327878 - RNA, 23 nt, Homo sapiens
gaauagacacuucaccaaagagc

SEQ ID NO: 1327879 - RNA, 15 nt, Homo sapiens
gaauagaugcugacu

SEQ ID NO: 1327880 - RNA, 23 nt, Homo sapiens
gaauagugacgcaaaucugcaug

SEQ ID NO: 1327881 - RNA, 17 nt, Homo sapiens
gaauauuccacuauuug

SEQ ID NO: 1327882 - RNA, 23 nt, Homo sapiens
gaaucccagauaugguugcacaa

SEQ ID NO: 1327883 - RNA, 22 nt, Homo sapiens
gaauccuaguuuaugcacauga

SEQ ID NO: 1327884 - RNA, 23 nt, Homo sapiens
gaaucgguuguucuuuccucaca

SEQ ID NO: 1327885 - RNA, 14 nt, Homo sapiens
gaaucuauuucacu

SEQ ID NO: 1327886 - RNA, 18 nt, Homo sapiens
gaaugagguaggcacaaa

SEQ ID NO: 1327887 - RNA, 12 nt, Homo sapiens
gaaugcauucaa

SEQ ID NO: 1327888 - RNA, 14 nt, Homo sapiens
gaaugcccagugag

SEQ ID NO: 1327889 - RNA, 17 nt, Homo sapiens
gaauggagcucaggucc

SEQ ID NO: 1327890 - RNA, 21 nt, Homo sapiens
gaaugguugaguuacauuaaa

SEQ ID NO: 1327891 - RNA, 17 nt, Homo sapiens
gaaugugagcuuaccag

SEQ ID NO: 1327892 - RNA, 21 nt, Homo sapiens
gaauuaggcuguaacuacuuu

SEQ ID NO: 1327893 - RNA, 16 nt, Homo sapiens
gaauuaucucaaguaa

SEQ ID NO: 1327894 - RNA, 14 nt, Homo sapiens
gaauucaccugugg

SEQ ID NO: 1327895 - RNA, 18 nt, Homo sapiens
gaauucuaacaagucaua

SEQ ID NO: 1327896 - RNA, 20 nt, Homo sapiens
gaauuuaauacagacaucua

SEQ ID NO: 1327897 - RNA, 21 nt, Homo sapiens
gaauuuucuugaaacugugaa

SEQ ID NO: 1327898 - RNA, 21 nt, Homo sapiens
gacaaagguuuuccucuucua

SEQ ID NO: 1327899 - RNA, 22 nt, Homo sapiens
gacaaauauuccuuugcauauu

SEQ ID NO: 1327900 - RNA, 13 nt, Homo sapiens
gacaacacuggga

SEQ ID NO: 1327901 - RNA, 12 nt, Homo sapiens
gacaacacuuaa

SEQ ID NO: 1327902 - RNA, 11 nt, Homo sapiens
gacaacauguu

SEQ ID NO: 1327903 - RNA, 12 nt, Homo sapiens
gacaaccaaaag

SEQ ID NO: 1327904 - RNA, 16 nt, Homo sapiens
gacaaccucauuuuaa

SEQ ID NO: 1327905 - RNA, 16 nt, Homo sapiens
gacaagggaaauguca

SEQ ID NO: 1327906 - RNA, 20 nt, Homo sapiens
gacaauauaagagcuuccaa

SEQ ID NO: 1327907 - RNA, 17 nt, Homo sapiens
gacaauauggucccaaa

SEQ ID NO: 1327908 - RNA, 18 nt, Homo sapiens
gacaaucacugccaaccc

SEQ ID NO: 1327909 - RNA, 23 nt, Homo sapiens
gacacacggggcucgggccuuua

SEQ ID NO: 1327910 - RNA, 17 nt, Homo sapiens
gacaccaguggugcguu

SEQ ID NO: 1327911 - RNA, 15 nt, Homo sapiens
gacacuaucacucau

SEQ ID NO: 1327912 - RNA, 17 nt, Homo sapiens
gacacucauauugcccu

SEQ ID NO: 1327913 - RNA, 17 nt, Homo sapiens
gacacuuaccacucacc

SEQ ID NO: 1327914 - RNA, 19 nt, Homo sapiens
gacagcaucuaagaaguuu

SEQ ID NO: 1327915 - RNA, 20 nt, Homo sapiens
gacagcuggcggaggcugcu

SEQ ID NO: 1327916 - RNA, 17 nt, Homo sapiens
gacagcuuugcugcuga

SEQ ID NO: 1327917 - RNA, 15 nt, Homo sapiens
gacaggaauuuagaa

SEQ ID NO: 1327918 - RNA, 17 nt, Homo sapiens
gacagggccagugcagu

SEQ ID NO: 1327919 - RNA, 20 nt, Homo sapiens
gacaguccaaaccacuccac

SEQ ID NO: 1327920 - RNA, 14 nt, Homo sapiens
gacaguccacaggg

SEQ ID NO: 1327921 - RNA, 18 nt, Homo sapiens
gacaguccacaggggcca

SEQ ID NO: 1327922 - RNA, 19 nt, Homo sapiens
gacauaaacaaagacauug

SEQ ID NO: 1327923 - RNA, 13 nt, Homo sapiens
gacauaacauuuu

SEQ ID NO: 1327924 - RNA, 16 nt, Homo sapiens
gacauaaugggguccu

SEQ ID NO: 1327925 - RNA, 21 nt, Homo sapiens
gacauagcugugcuaugaggu

SEQ ID NO: 1327926 - RNA, 22 nt, Homo sapiens
gacauauuaugccugaaugacu

SEQ ID NO: 1327927 - RNA, 19 nt, Homo sapiens
gacauccccccgccaaaag

SEQ ID NO: 1327928 - RNA, 14 nt, Homo sapiens
gacaucugacccca

SEQ ID NO: 1327929 - RNA, 14 nt, Homo sapiens
gacaugacauucuu

SEQ ID NO: 1327930 - RNA, 22 nt, Homo sapiens
gacaugcugaaauuauuucucu

SEQ ID NO: 1327931 - RNA, 15 nt, Homo sapiens
gacaugugacauuua

SEQ ID NO: 1327932 - RNA, 13 nt, Homo sapiens
cuccuucgcuuaa

SEQ ID NO: 1327933 - RNA, 17 nt, Homo sapiens
cuccuuguguugcacug

SEQ ID NO: 1327934 - RNA, 21 nt, Homo sapiens
cuccuuuaccuuucagugcag

SEQ ID NO: 1327935 - RNA, 22 nt, Homo sapiens
cucgcaaacguuucuugaacaa

SEQ ID NO: 1327936 - RNA, 21 nt, Homo sapiens
cucggcacacacugugcccca

SEQ ID NO: 1327937 - RNA, 20 nt, Homo sapiens
cucguauaugucucaggucc

SEQ ID NO: 1327938 - RNA, 15 nt, Homo sapiens
cucgugagucauuua

SEQ ID NO: 1327939 - RNA, 22 nt, Homo sapiens
cucgugggucccagagaccuca

SEQ ID NO: 1327940 - RNA, 18 nt, Homo sapiens
cucguuuacacugcacau

SEQ ID NO: 1327941 - RNA, 12 nt, Homo sapiens
cucuaaggaauu

SEQ ID NO: 1327942 - RNA, 14 nt, Homo sapiens
cucuaagugcugcu

SEQ ID NO: 1327943 - RNA, 19 nt, Homo sapiens
cucuaauguaccaaugaug

SEQ ID NO: 1327944 - RNA, 18 nt, Homo sapiens
cucuaaugugucucucac

SEQ ID NO: 1327945 - RNA, 15 nt, Homo sapiens
cucuaccuucaaaua

SEQ ID NO: 1327946 - RNA, 14 nt, Homo sapiens
cucuagauugagag

SEQ ID NO: 1327947 - RNA, 21 nt, Homo sapiens
cucuagccuggcaacagagcg

SEQ ID NO: 1327948 - RNA, 19 nt, Homo sapiens
cucuaguugaguuucuggc

SEQ ID NO: 1327949 - RNA, 23 nt, Homo sapiens
cucuauguaucaaauguaacuua

SEQ ID NO: 1327950 - RNA, 14 nt, Homo sapiens
cucucacagacaua

SEQ ID NO: 1327951 - RNA, 22 nt, Homo sapiens
cucucacggcuuguaaauguga

SEQ ID NO: 1327952 - RNA, 13 nt, Homo sapiens
cucuccaccaggu

SEQ ID NO: 1327953 - RNA, 16 nt, Homo sapiens
cucuccagcugacuaa

SEQ ID NO: 1327954 - RNA, 21 nt, Homo sapiens
cucucccagugacaaccaaaa

SEQ ID NO: 1327955 - RNA, 22 nt, Homo sapiens
cucucccagugacaaccaaaag

SEQ ID NO: 1327956 - RNA, 18 nt, Homo sapiens
cucucccugggucugggg

SEQ ID NO: 1327957 - RNA, 15 nt, Homo sapiens
cucuccgaggggugg

SEQ ID NO: 1327958 - RNA, 17 nt, Homo sapiens
cucuccuuggccacaga

SEQ ID NO: 1327959 - RNA, 15 nt, Homo sapiens
cucucgggagcccua

SEQ ID NO: 1327960 - RNA, 21 nt, Homo sapiens
cucucgggagcccuagcccug

SEQ ID NO: 1327961 - RNA, 15 nt, Homo sapiens
cucucggugcuucca

SEQ ID NO: 1327962 - RNA, 15 nt, Homo sapiens
cucucucauacccuc

SEQ ID NO: 1327963 - RNA, 12 nt, Homo sapiens
cucucucugagg

SEQ ID NO: 1327964 - RNA, 22 nt, Homo sapiens
cucucugagucaaauccagugg

SEQ ID NO: 1327965 - RNA, 22 nt, Homo sapiens
cucucuggcuggucuucacuuu

SEQ ID NO: 1327966 - RNA, 14 nt, Homo sapiens
cucucuucucucca

SEQ ID NO: 1327967 - RNA, 20 nt, Homo sapiens
cucugagcaaauguggcucc

SEQ ID NO: 1327968 - RNA, 17 nt, Homo sapiens
cucugaggcuauggagg

SEQ ID NO: 1327969 - RNA, 23 nt, Homo sapiens
cucugaggggugggggugccgcu

SEQ ID NO: 1327970 - RNA, 21 nt, Homo sapiens
cucugauuaguugacaguauu

SEQ ID NO: 1327971 - RNA, 17 nt, Homo sapiens
cucugcagcccauuccc

SEQ ID NO: 1327972 - RNA, 16 nt, Homo sapiens
cucugcagcucaggga

SEQ ID NO: 1327973 - RNA, 12 nt, Homo sapiens
cucugcaguuuu

SEQ ID NO: 1327974 - RNA, 20 nt, Homo sapiens
cucugccaaaggaugugaua

SEQ ID NO: 1327975 - RNA, 15 nt, Homo sapiens
cucugccuuaaacac

SEQ ID NO: 1327976 - RNA, 20 nt, Homo sapiens
cucugcugucuaaccuguga

SEQ ID NO: 1327977 - RNA, 17 nt, Homo sapiens
cucuggaaaaagacuga

SEQ ID NO: 1327978 - RNA, 14 nt, Homo sapiens
cucuguauacugag

SEQ ID NO: 1327979 - RNA, 15 nt, Homo sapiens
cucuguccaaucagg

SEQ ID NO: 1327980 - RNA, 21 nt, Homo sapiens
cucugucucauugaccuucag

SEQ ID NO: 1327981 - RNA, 14 nt, Homo sapiens
cucugugaucuugc

SEQ ID NO: 1327982 - RNA, 14 nt, Homo sapiens
cucuguugcacaug

SEQ ID NO: 1327983 - RNA, 20 nt, Homo sapiens
cucuguuuauagugacccac

SEQ ID NO: 1327984 - RNA, 19 nt, Homo sapiens
cucuguuucccuuucacug

SEQ ID NO: 1327985 - RNA, 23 nt, Homo sapiens
cucuguuuugcauggaguauuau

SEQ ID NO: 1327986 - RNA, 22 nt, Homo sapiens
cucuuaaguggucuagucaagg

SEQ ID NO: 1327987 - RNA, 15 nt, Homo sapiens
cucuuacacacugga

SEQ ID NO: 1327988 - RNA, 17 nt, Homo sapiens
cucuuaugugugccuuu

SEQ ID NO: 1327989 - RNA, 14 nt, Homo sapiens
cucuuauucuuggc

SEQ ID NO: 1327990 - RNA, 18 nt, Homo sapiens
cucuucaacugaccagcc

SEQ ID NO: 1327991 - RNA, 19 nt, Homo sapiens
cucuucaacugaccagccu

SEQ ID NO: 1327992 - RNA, 14 nt, Homo sapiens
cucuucuccacugg

SEQ ID NO: 1327993 - RNA, 12 nt, Homo sapiens
cucuucugcaag

SEQ ID NO: 1327994 - RNA, 16 nt, Homo sapiens
cucuucuugacaucaa

SEQ ID NO: 1327995 - RNA, 23 nt, Homo sapiens
cucuugccaaaucaaaagacuuu

SEQ ID NO: 1327996 - RNA, 15 nt, Homo sapiens
cucuuggcugacccc

SEQ ID NO: 1327997 - RNA, 13 nt, Homo sapiens
cucuuggguucaa

SEQ ID NO: 1327998 - RNA, 12 nt, Homo sapiens
cucuuuaccucc

SEQ ID NO: 1327999 - RNA, 13 nt, Homo sapiens
cucuuuacuugaa

SEQ ID NO: 1328000 - RNA, 12 nt, Homo sapiens
cucuuucacuuc

SEQ ID NO: 1328001 - RNA, 20 nt, Homo sapiens
cucuuucuuauuuuguaaua

SEQ ID NO: 1328002 - RNA, 16 nt, Homo sapiens
cucuuugaaagcuuug

SEQ ID NO: 1328003 - RNA, 17 nt, Homo sapiens
cucuuugugauaauucu

SEQ ID NO: 1328004 - RNA, 23 nt, Homo sapiens
cucuuugugauaauucucaguag

SEQ ID NO: 1328005 - RNA, 16 nt, Homo sapiens
cugaaaaagacauaaa

SEQ ID NO: 1328006 - RNA, 18 nt, Homo sapiens
cugaaaagggacugugag

SEQ ID NO: 1328007 - RNA, 15 nt, Homo sapiens
cugaaauuaacucag

SEQ ID NO: 1328008 - RNA, 16 nt, Homo sapiens
cugaaauuaacucaga

SEQ ID NO: 1328009 - RNA, 17 nt, Homo sapiens
cugaacccuccaaagga

SEQ ID NO: 1328010 - RNA, 22 nt, Homo sapiens
cugaacuuuguggucgacauca

SEQ ID NO: 1328011 - RNA, 23 nt, Homo sapiens
cugaaggcaguggcaggggagca

SEQ ID NO: 1328012 - RNA, 18 nt, Homo sapiens
cugaagucugagcccauu

SEQ ID NO: 1328013 - RNA, 16 nt, Homo sapiens
cugaauaaaguaaugc

SEQ ID NO: 1328014 - RNA, 15 nt, Homo sapiens
cugaauaacuugaag

SEQ ID NO: 1328015 - RNA, 19 nt, Homo sapiens
cugaauaacuugaagaaca

SEQ ID NO: 1328016 - RNA, 24 nt, Homo sapiens
cugaauauuuuuuauuucuaagua

SEQ ID NO: 1328017 - RNA, 22 nt, Homo sapiens
cugaauuuuuuuuaaaaaucca

SEQ ID NO: 1328018 - RNA, 22 nt, Homo sapiens
cuggcuuuacauggguucaauu

SEQ ID NO: 1328019 - RNA, 23 nt, Homo sapiens
cuggcuuuacauggguucaauug

SEQ ID NO: 1328020 - RNA, 16 nt, Homo sapiens
cugggaacacaucugg

SEQ ID NO: 1328021 - RNA, 14 nt, Homo sapiens
cugggaaccuagca

SEQ ID NO: 1328022 - RNA, 20 nt, Homo sapiens
cugggaagcucccaccccac

SEQ ID NO: 1328023 - RNA, 18 nt, Homo sapiens
cugggaccucccacugcc

SEQ ID NO: 1328024 - RNA, 16 nt, Homo sapiens
cugggagcagcucugu

SEQ ID NO: 1328025 - RNA, 16 nt, Homo sapiens
cugggagcccucaggc

SEQ ID NO: 1328026 - RNA, 18 nt, Homo sapiens
cugggauauggcugccca

SEQ ID NO: 1328027 - RNA, 14 nt, Homo sapiens
cugggaugucuccg

SEQ ID NO: 1328028 - RNA, 15 nt, Homo sapiens
cugggcacaaacaga

SEQ ID NO: 1328029 - RNA, 19 nt, Homo sapiens
cugggcaucucugagcaau

SEQ ID NO: 1328030 - RNA, 11 nt, Homo sapiens
cugggccagug

SEQ ID NO: 1328031 - RNA, 22 nt, Homo sapiens
cugggcuaaguaaauaggaauu

SEQ ID NO: 1328032 - RNA, 17 nt, Homo sapiens
cugggcucagacaucca

SEQ ID NO: 1328033 - RNA, 18 nt, Homo sapiens
cuggggacagcuuccuca

SEQ ID NO: 1328034 - RNA, 22 nt, Homo sapiens
cuggggauaguccuuccuggca

SEQ ID NO: 1328035 - RNA, 20 nt, Homo sapiens
cuggggcguuuccuacugcg

SEQ ID NO: 1328036 - RNA, 21 nt, Homo sapiens
cugggggcaggccagggcagu

SEQ ID NO: 1328037 - RNA, 22 nt, Homo sapiens
cugggggcugccgagccaccau

SEQ ID NO: 1328038 - RNA, 19 nt, Homo sapiens
cuggggguccucucugagu

SEQ ID NO: 1328039 - RNA, 16 nt, Homo sapiens
cuggggucuccgaaga

SEQ ID NO: 1328040 - RNA, 22 nt, Homo sapiens
cugggguggagugggaagggag

SEQ ID NO: 1328041 - RNA, 13 nt, Homo sapiens
cugggugaucugc

SEQ ID NO: 1328042 - RNA, 19 nt, Homo sapiens
cuggguuaaauauuuugcu

SEQ ID NO: 1328043 - RNA, 18 nt, Homo sapiens
cugguaauaaaugugacu

SEQ ID NO: 1328044 - RNA, 14 nt, Homo sapiens
cugguaauauugac

SEQ ID NO: 1328045 - RNA, 15 nt, Homo sapiens
cugguccugcacaug

SEQ ID NO: 1328046 - RNA, 20 nt, Homo sapiens
cuggucgccaauccaugcuc

SEQ ID NO: 1328047 - RNA, 23 nt, Homo sapiens
cuggucuucgcagccuagauaug

SEQ ID NO: 1328048 - RNA, 12 nt, Homo sapiens
cuggugacuccu

SEQ ID NO: 1328049 - RNA, 13 nt, Homo sapiens
cuggugcuccugc

SEQ ID NO: 1328050 - RNA, 19 nt, Homo sapiens
cugguggcccgacagccug

SEQ ID NO: 1328051 - RNA, 21 nt, Homo sapiens
cugguguucuguuucaaugua

SEQ ID NO: 1328052 - RNA, 17 nt, Homo sapiens
cugguucccugcugcgc

SEQ ID NO: 1328053 - RNA, 20 nt, Homo sapiens
cugguuucccuuacagggcc

SEQ ID NO: 1328054 - RNA, 15 nt, Homo sapiens
cugguuugccuauaa

SEQ ID NO: 1328055 - RNA, 19 nt, Homo sapiens
cuguaaaauuaaacaaaua

SEQ ID NO: 1328056 - RNA, 13 nt, Homo sapiens
cuguaaacuacca

SEQ ID NO: 1328057 - RNA, 14 nt, Homo sapiens
cuguaaacuuccaa

SEQ ID NO: 1328058 - RNA, 12 nt, Homo sapiens
cuguaacuacuu

SEQ ID NO: 1328059 - RNA, 16 nt, Homo sapiens
cuguaauccuagcacu

SEQ ID NO: 1328060 - RNA, 22 nt, Homo sapiens
cuguacauaguccuuuuaucuc

SEQ ID NO: 1328061 - RNA, 16 nt, Homo sapiens
cuguacugagcacuga

SEQ ID NO: 1328062 - RNA, 21 nt, Homo sapiens
cuguagacauuugcuaugagc

SEQ ID NO: 1328063 - RNA, 23 nt, Homo sapiens
cuguagggugcugcgcagcaucc

SEQ ID NO: 1328064 - RNA, 18 nt, Homo sapiens
cuguaugguccauagcac

SEQ ID NO: 1328065 - RNA, 21 nt, Homo sapiens
cuguauucccaguuacuuggg

SEQ ID NO: 1328066 - RNA, 22 nt, Homo sapiens
cugucaagaagaggaaagggag

SEQ ID NO: 1328067 - RNA, 11 nt, Homo sapiens
cugucagggac

SEQ ID NO: 1328068 - RNA, 18 nt, Homo sapiens
cugucaggguugucuacc

SEQ ID NO: 1328069 - RNA, 15 nt, Homo sapiens
cuguccccacacuga

SEQ ID NO: 1328070 - RNA, 22 nt, Homo sapiens
cuuauugguggcuguuccugaa

SEQ ID NO: 1328071 - RNA, 17 nt, Homo sapiens
cuuauuuuugacagugu

SEQ ID NO: 1328072 - RNA, 15 nt, Homo sapiens
cuucaaagcugaaua

SEQ ID NO: 1328073 - RNA, 13 nt, Homo sapiens
cuucaaauaaaga

SEQ ID NO: 1328074 - RNA, 16 nt, Homo sapiens
cuucaacagccaagcu

SEQ ID NO: 1328075 - RNA, 12 nt, Homo sapiens
cuucaacccagu

SEQ ID NO: 1328076 - RNA, 12 nt, Homo sapiens
cuucaagaaugg

SEQ ID NO: 1328077 - RNA, 14 nt, Homo sapiens
cuucacaacagauu

SEQ ID NO: 1328078 - RNA, 12 nt, Homo sapiens
cuucacauucau

SEQ ID NO: 1328079 - RNA, 19 nt, Homo sapiens
cuucaccuacauuaucuca

SEQ ID NO: 1328080 - RNA, 22 nt, Homo sapiens
cuucacuguccuccaagccagc

SEQ ID NO: 1328081 - RNA, 23 nt, Homo sapiens
cuucacuguccuccaagccagcg

SEQ ID NO: 1328082 - RNA, 23 nt, Homo sapiens
cuucagaagucacacauuacaaa

SEQ ID NO: 1328083 - RNA, 16 nt, Homo sapiens
cuucagauuugccuua

SEQ ID NO: 1328084 - RNA, 16 nt, Homo sapiens
cuucaguccuuugucu

SEQ ID NO: 1328085 - RNA, 16 nt, Homo sapiens
cuucaugucuaggaua

SEQ ID NO: 1328086 - RNA, 16 nt, Homo sapiens
cuuccagagucaucua

SEQ ID NO: 1328087 - RNA, 18 nt, Homo sapiens
cuuccagugucugucauu

SEQ ID NO: 1328088 - RNA, 23 nt, Homo sapiens
cuuccaugacauaagugcuauug

SEQ ID NO: 1328089 - RNA, 15 nt, Homo sapiens
cuucccauuucucua

SEQ ID NO: 1328090 - RNA, 17 nt, Homo sapiens
cuucccuaaucuuccac

SEQ ID NO: 1328091 - RNA, 18 nt, Homo sapiens
cuucccugacucuucaag

SEQ ID NO: 1328092 - RNA, 22 nt, Homo sapiens
cuucccugucugccagggccag

SEQ ID NO: 1328093 - RNA, 14 nt, Homo sapiens
cuucccuugccucg

SEQ ID NO: 1328094 - RNA, 22 nt, Homo sapiens
cuuccgcugaggggucucggau

SEQ ID NO: 1328095 - RNA, 15 nt, Homo sapiens
cuuccugaaacuuca

SEQ ID NO: 1328096 - RNA, 15 nt, Homo sapiens
cuuccuggcaucaua

SEQ ID NO: 1328097 - RNA, 15 nt, Homo sapiens
cuuccuguccagcuc

SEQ ID NO: 1328098 - RNA, 15 nt, Homo sapiens
cuuccugucugagua

SEQ ID NO: 1328099 - RNA, 22 nt, Homo sapiens
cuuccuguguguccaaaacugc

SEQ ID NO: 1328100 - RNA, 16 nt, Homo sapiens
cuucgcagccuagaua

SEQ ID NO: 1328101 - RNA, 17 nt, Homo sapiens
cuucgcagccuagauau

SEQ ID NO: 1328102 - RNA, 21 nt, Homo sapiens
cuucgcagccuagauaugaag

SEQ ID NO: 1328103 - RNA, 10 nt, Homo sapiens
cuucuaauau

SEQ ID NO: 1328104 - RNA, 17 nt, Homo sapiens
cuucuacacagcaauac

SEQ ID NO: 1328105 - RNA, 20 nt, Homo sapiens
cuucuaggauuuauuguuau

SEQ ID NO: 1328106 - RNA, 18 nt, Homo sapiens
cuucuaggguuauugcau

SEQ ID NO: 1328107 - RNA, 19 nt, Homo sapiens
cuucuauacccacccagaa

SEQ ID NO: 1328108 - RNA, 15 nt, Homo sapiens
cuucuauggggucua

SEQ ID NO: 1328109 - RNA, 20 nt, Homo sapiens
cuucucagauuucugaggaa

SEQ ID NO: 1328110 - RNA, 13 nt, Homo sapiens
cuucuccaaaggg

SEQ ID NO: 1328111 - RNA, 14 nt, Homo sapiens
cuucuccacuggau

SEQ ID NO: 1328112 - RNA, 12 nt, Homo sapiens
cuucugcuacug

SEQ ID NO: 1328113 - RNA, 14 nt, Homo sapiens
cuucuuauuaauca

SEQ ID NO: 1328114 - RNA, 13 nt, Homo sapiens
cuucuuugcugca

SEQ ID NO: 1328115 - RNA, 19 nt, Homo sapiens
cuugaagggccagagccag

SEQ ID NO: 1328116 - RNA, 14 nt, Homo sapiens
cuugaagggcuuua

SEQ ID NO: 1328117 - RNA, 14 nt, Homo sapiens
cuugaaucaaagaa

SEQ ID NO: 1328118 - RNA, 18 nt, Homo sapiens
cuugacaucaaggcucuu

SEQ ID NO: 1328119 - RNA, 17 nt, Homo sapiens
cuugaguuccucugcag

SEQ ID NO: 1328120 - RNA, 19 nt, Homo sapiens
cuugaguuccucugcaguu

SEQ ID NO: 1328121 - RNA, 19 nt, Homo sapiens
cuugaguuuuuaguggaag

SEQ ID NO: 1328122 - RNA, 22 nt, Homo sapiens
cuugauauuuaagcagcuugaa

SEQ ID NO: 1328123 - RNA, 20 nt, Homo sapiens
cuugcaagauuccaaguucu

SEQ ID NO: 1328124 - RNA, 21 nt, Homo sapiens
cuugcacaggucccacugccc

SEQ ID NO: 1328125 - RNA, 19 nt, Homo sapiens
cuugcauuuauuauucuca

SEQ ID NO: 1328126 - RNA, 17 nt, Homo sapiens
cuugcucccugacuggg

SEQ ID NO: 1328127 - RNA, 19 nt, Homo sapiens
uucaauaaaucuuucaaaa

SEQ ID NO: 1328128 - RNA, 21 nt, Homo sapiens
uucaauagcauaucacagaga

SEQ ID NO: 1328129 - RNA, 19 nt, Homo sapiens
uucaauaugcaagcagcuu

SEQ ID NO: 1328130 - RNA, 15 nt, Homo sapiens
uucaauccugauuca

SEQ ID NO: 1328131 - RNA, 17 nt, Homo sapiens
uucaaugaaccacaaaa

SEQ ID NO: 1328132 - RNA, 18 nt, Homo sapiens
uucacagcgugcuaaaau

SEQ ID NO: 1328133 - RNA, 21 nt, Homo sapiens
uucacaguucuuugggccaga

SEQ ID NO: 1328134 - RNA, 19 nt, Homo sapiens
uucacaugguuacauauca

SEQ ID NO: 1328135 - RNA, 14 nt, Homo sapiens
uucaccaaagagca

SEQ ID NO: 1328136 - RNA, 16 nt, Homo sapiens
uucaccuacauuaucu

SEQ ID NO: 1328137 - RNA, 17 nt, Homo sapiens
uucacuuaacaaacaaa

SEQ ID NO: 1328138 - RNA, 23 nt, Homo sapiens
uucacuuuuggcaaugacucaaa

SEQ ID NO: 1328139 - RNA, 15 nt, Homo sapiens
uucagagaacccacu

SEQ ID NO: 1328140 - RNA, 13 nt, Homo sapiens
uucagagcacuca

SEQ ID NO: 1328141 - RNA, 15 nt, Homo sapiens
uucagauauuccagg

SEQ ID NO: 1328142 - RNA, 14 nt, Homo sapiens
uucagauuccccau

SEQ ID NO: 1328143 - RNA, 17 nt, Homo sapiens
uucagauuccccaucaa

SEQ ID NO: 1328144 - RNA, 15 nt, Homo sapiens
uucagcaccaagcau

SEQ ID NO: 1328145 - RNA, 19 nt, Homo sapiens
uucaggagggaaccagcuu

SEQ ID NO: 1328146 - RNA, 21 nt, Homo sapiens
uucaggauuaacuaaagaaga

SEQ ID NO: 1328147 - RNA, 16 nt, Homo sapiens
uucagggaccguccag

SEQ ID NO: 1328148 - RNA, 14 nt, Homo sapiens
uucagugcaguuuc

SEQ ID NO: 1328149 - RNA, 14 nt, Homo sapiens
uucaguguuuucau

SEQ ID NO: 1328150 - RNA, 20 nt, Homo sapiens
uucaguucuuacacauucca

SEQ ID NO: 1328151 - RNA, 15 nt, Homo sapiens
uucauacacuaacca

SEQ ID NO: 1328152 - RNA, 22 nt, Homo sapiens
uucauagugauagagugcagug

SEQ ID NO: 1328153 - RNA, 17 nt, Homo sapiens
uucauauuuuaaacaga

SEQ ID NO: 1328154 - RNA, 21 nt, Homo sapiens
uucauccuaaagaacaaagua

SEQ ID NO: 1328155 - RNA, 16 nt, Homo sapiens
uucaugaagcaagaau

SEQ ID NO: 1328156 - RNA, 15 nt, Homo sapiens
uucauggauuuucca

SEQ ID NO: 1328157 - RNA, 12 nt, Homo sapiens
uucauuaccuca

SEQ ID NO: 1328158 - RNA, 21 nt, Homo sapiens
uucauucaggcaacgcacaaa

SEQ ID NO: 1328159 - RNA, 15 nt, Homo sapiens
uucauuucauuucag

SEQ ID NO: 1328160 - RNA, 17 nt, Homo sapiens
uuccaaaauaaagcaua

SEQ ID NO: 1328161 - RNA, 16 nt, Homo sapiens
uuccaaugaagccaua

SEQ ID NO: 1328162 - RNA, 19 nt, Homo sapiens
uuccaaugcacaguugcca

SEQ ID NO: 1328163 - RNA, 20 nt, Homo sapiens
uuccaauuuacauacucugc

SEQ ID NO: 1328164 - RNA, 21 nt, Homo sapiens
uuccacacccucacugcugua

SEQ ID NO: 1328165 - RNA, 14 nt, Homo sapiens
uuccaccucaccuc

SEQ ID NO: 1328166 - RNA, 19 nt, Homo sapiens
uuccacugccuccugugac

SEQ ID NO: 1328167 - RNA, 13 nt, Homo sapiens
uuccagacugcuu

SEQ ID NO: 1328168 - RNA, 21 nt, Homo sapiens
uuccauaagcuuggugacaaa

SEQ ID NO: 1328169 - RNA, 21 nt, Homo sapiens
uuccauuaaguacaugugcca

SEQ ID NO: 1328170 - RNA, 15 nt, Homo sapiens
uuccauuugcaacag

SEQ ID NO: 1328171 - RNA, 14 nt, Homo sapiens
uucccauucuugca

SEQ ID NO: 1328172 - RNA, 19 nt, Homo sapiens
uuccccagguuccauacca

SEQ ID NO: 1328173 - RNA, 22 nt, Homo sapiens
uuccccagugacuccaggguga

SEQ ID NO: 1328174 - RNA, 18 nt, Homo sapiens
uucccccaauguuuaaaa

SEQ ID NO: 1328175 - RNA, 21 nt, Homo sapiens
uuccccuccuuggcuuuaugc

SEQ ID NO: 1328176 - RNA, 20 nt, Homo sapiens
uuccccuuagaaacacugca

SEQ ID NO: 1328177 - RNA, 19 nt, Homo sapiens
uuccccuuuucccaaccug

SEQ ID NO: 1328178 - RNA, 15 nt, Homo sapiens
uucccggagcagaag

SEQ ID NO: 1328179 - RNA, 19 nt, Homo sapiens
uucccucuucccugaccuc

SEQ ID NO: 1328180 - RNA, 19 nt, Homo sapiens
uucccugaccucccaacuc

SEQ ID NO: 1328181 - RNA, 17 nt, Homo sapiens
uucccugugucauuuca

SEQ ID NO: 1328182 - RNA, 15 nt, Homo sapiens
uuccuaauacuguca

SEQ ID NO: 1328183 - RNA, 14 nt, Homo sapiens
uuccuacaguuucu

SEQ ID NO: 1328184 - RNA, 22 nt, Homo sapiens
uuccuaugcuguucacuggaca

SEQ ID NO: 1328185 - RNA, 14 nt, Homo sapiens
uuccuccacuucau

SEQ ID NO: 1328186 - RNA, 17 nt, Homo sapiens
uuccucccuucugcuac

SEQ ID NO: 1328187 - RNA, 20 nt, Homo sapiens
uuccucgugggucccagaga

SEQ ID NO: 1328188 - RNA, 12 nt, Homo sapiens
uuccucuaguag

SEQ ID NO: 1328189 - RNA, 23 nt, Homo sapiens
uuccugauaaacagaguaacuga

SEQ ID NO: 1328190 - RNA, 20 nt, Homo sapiens
uuccuggaaacagcaugaau

SEQ ID NO: 1328191 - RNA, 18 nt, Homo sapiens
uuccuuggccaugcagaa

SEQ ID NO: 1328192 - RNA, 22 nt, Homo sapiens
uuccuuuauuuugcugcuugau

SEQ ID NO: 1328193 - RNA, 21 nt, Homo sapiens
uuccuuuuaaaacacuuccau

SEQ ID NO: 1328194 - RNA, 19 nt, Homo sapiens
uucgagaccagccugacca

SEQ ID NO: 1328195 - RNA, 18 nt, Homo sapiens
uucgcagccuagauauga

SEQ ID NO: 1328196 - RNA, 18 nt, Homo sapiens
uucgcgcuggaauccaga

SEQ ID NO: 1328197 - RNA, 22 nt, Homo sapiens
uucgggagccuugucagugugu

SEQ ID NO: 1328198 - RNA, 19 nt, Homo sapiens
uucuaaaaauaaaaguauu

SEQ ID NO: 1328199 - RNA, 13 nt, Homo sapiens
uucuaaaaugugu

SEQ ID NO: 1328200 - RNA, 23 nt, Homo sapiens
uucuaacccaagacaugacauuc

SEQ ID NO: 1328201 - RNA, 16 nt, Homo sapiens
uucuaaguguggguuu

SEQ ID NO: 1328202 - RNA, 15 nt, Homo sapiens
uucuaaugugugaau

SEQ ID NO: 1328203 - RNA, 14 nt, Homo sapiens
uucuagucacuucc

SEQ ID NO: 1328204 - RNA, 16 nt, Homo sapiens
uucuauacccacccag

SEQ ID NO: 1328205 - RNA, 15 nt, Homo sapiens
uucuauagugaugau

SEQ ID NO: 1328206 - RNA, 21 nt, Homo sapiens
uucuauggguuggacaaccuc

SEQ ID NO: 1328207 - RNA, 15 nt, Homo sapiens
uucuauuuugugaau

SEQ ID NO: 1328208 - RNA, 21 nt, Homo sapiens
uucucaguaguuguccgugau

SEQ ID NO: 1328209 - RNA, 11 nt, Homo sapiens
uucuccacugg

SEQ ID NO: 1328210 - RNA, 23 nt, Homo sapiens
uucucccacaugaggccaucuca

SEQ ID NO: 1328211 - RNA, 13 nt, Homo sapiens
uucuccugccuca

SEQ ID NO: 1328212 - RNA, 14 nt, Homo sapiens
uucuccuugaauau

SEQ ID NO: 1328213 - RNA, 16 nt, Homo sapiens
uucucuauagagccaa

SEQ ID NO: 1328214 - RNA, 14 nt, Homo sapiens
uucucuauguauca

SEQ ID NO: 1328215 - RNA, 21 nt, Homo sapiens
uucucuugaaaaguucaggga

SEQ ID NO: 1328216 - RNA, 20 nt, Homo sapiens
uucucuuuuccuuugguccu

SEQ ID NO: 1328217 - RNA, 15 nt, Homo sapiens
uucugaaaaaguauc

SEQ ID NO: 1328218 - RNA, 15 nt, Homo sapiens
uucugaaacugcaua

SEQ ID NO: 1328219 - RNA, 20 nt, Homo sapiens
uucugaagucugagcccauu

SEQ ID NO: 1328220 - RNA, 18 nt, Homo sapiens
uucugagacagcuugucu

SEQ ID NO: 1328221 - RNA, 19 nt, Homo sapiens
uucugagacagcuugucug

SEQ ID NO: 1328222 - RNA, 12 nt, Homo sapiens
uucuggcugaga

SEQ ID NO: 1328223 - RNA, 15 nt, Homo sapiens
uucuggggccaucca

SEQ ID NO: 1328224 - RNA, 16 nt, Homo sapiens
uucugucccacuacau

SEQ ID NO: 1328225 - RNA, 12 nt, Homo sapiens
uucuguggcuca

SEQ ID NO: 1328226 - RNA, 22 nt, Homo sapiens
uucuguuuuguuguuugauuca

SEQ ID NO: 1328227 - RNA, 18 nt, Homo sapiens
uucuuacacugugucauu

SEQ ID NO: 1328228 - RNA, 19 nt, Homo sapiens
uucuuacccuguacauaug

SEQ ID NO: 1328229 - RNA, 16 nt, Homo sapiens
uucuuacuaaaaagua

SEQ ID NO: 1328230 - RNA, 19 nt, Homo sapiens
uucuuacuucccuaaugaa

SEQ ID NO: 1328231 - RNA, 17 nt, Homo sapiens
uucuuauuaaucauaca

SEQ ID NO: 1328232 - RNA, 15 nt, Homo sapiens
uucuucacucuuuga

SEQ ID NO: 1328233 - RNA, 14 nt, Homo sapiens
uucuucauacuuaa

SEQ ID NO: 1328234 - RNA, 23 nt, Homo sapiens
uucuuccacccacaaacuccagg

SEQ ID NO: 1328235 - RNA, 19 nt, Homo sapiens
uucuuccuauuuccuugua

SEQ ID NO: 1328236 - RNA, 13 nt, Homo sapiens
uucuucuuuuugc

SEQ ID NO: 1328237 - RNA, 16 nt, Homo sapiens
uucuugaaacugugaa

SEQ ID NO: 1328238 - RNA, 18 nt, Homo sapiens
uucuugccuuguaccuca

SEQ ID NO: 1328239 - RNA, 13 nt, Homo sapiens
uucuuguugauag

SEQ ID NO: 1328240 - RNA, 20 nt, Homo sapiens
uucuuuagcuuaccugggca

SEQ ID NO: 1328241 - RNA, 13 nt, Homo sapiens
uucuuuccucaca

SEQ ID NO: 1328242 - RNA, 14 nt, Homo sapiens
uucuuugugccuuu

SEQ ID NO: 1328243 - RNA, 13 nt, Homo sapiens
uucuuuugcucuu

SEQ ID NO: 1328244 - RNA, 17 nt, Homo sapiens
uugaaaagacuccaaag

SEQ ID NO: 1328245 - RNA, 12 nt, Homo sapiens
uugaaaauguuc

SEQ ID NO: 1328246 - RNA, 22 nt, Homo sapiens
guaagcauuuccagccuaucua

SEQ ID NO: 1328247 - RNA, 15 nt, Homo sapiens
guaagggaaacugcc

SEQ ID NO: 1328248 - RNA, 11 nt, Homo sapiens
guaaguauuuu

SEQ ID NO: 1328249 - RNA, 16 nt, Homo sapiens
guaaguuaucuuugaa

SEQ ID NO: 1328250 - RNA, 15 nt, Homo sapiens
guaauaaaaagccuc

SEQ ID NO: 1328251 - RNA, 18 nt, Homo sapiens
guaauaaaugugacucag

SEQ ID NO: 1328252 - RNA, 19 nt, Homo sapiens
guaaucauuuuaaauucca

SEQ ID NO: 1328253 - RNA, 16 nt, Homo sapiens
guaaucccagcacuuu

SEQ ID NO: 1328254 - RNA, 17 nt, Homo sapiens
guaaucuaguugucaau

SEQ ID NO: 1328255 - RNA, 16 nt, Homo sapiens
guaaucucagcacuuu

SEQ ID NO: 1328256 - RNA, 17 nt, Homo sapiens
guaaugaaggacaguga

SEQ ID NO: 1328257 - RNA, 14 nt, Homo sapiens
guaauuguacaaua

SEQ ID NO: 1328258 - RNA, 14 nt, Homo sapiens
guaauuguuacaau

SEQ ID NO: 1328259 - RNA, 23 nt, Homo sapiens
guaauuucugccaauaaauucua

SEQ ID NO: 1328260 - RNA, 12 nt, Homo sapiens
guacagacaucc

SEQ ID NO: 1328261 - RNA, 22 nt, Homo sapiens
guacagacauccuagcauuugu

SEQ ID NO: 1328262 - RNA, 15 nt, Homo sapiens
guacagucuuaucaa

SEQ ID NO: 1328263 - RNA, 21 nt, Homo sapiens
guaccaaaucugacauauuau

SEQ ID NO: 1328264 - RNA, 14 nt, Homo sapiens
guaccccucuagcu

SEQ ID NO: 1328265 - RNA, 18 nt, Homo sapiens
guaccugguccccacugc

SEQ ID NO: 1328266 - RNA, 20 nt, Homo sapiens
guaccugguggauaucuagc

SEQ ID NO: 1328267 - RNA, 16 nt, Homo sapiens
guacucagcgaaugaa

SEQ ID NO: 1328268 - RNA, 16 nt, Homo sapiens
guacucccaaacugac

SEQ ID NO: 1328269 - RNA, 23 nt, Homo sapiens
guacucuuuugggcaacggcccu

SEQ ID NO: 1328270 - RNA, 23 nt, Homo sapiens
guacugccuuaaauguaccuaug

SEQ ID NO: 1328271 - RNA, 21 nt, Homo sapiens
guagaaacugaggcccagaga

SEQ ID NO: 1328272 - RNA, 22 nt, Homo sapiens
guagaaacugaggcccagagag

SEQ ID NO: 1328273 - RNA, 13 nt, Homo sapiens
guagaacaaagaa

SEQ ID NO: 1328274 - RNA, 19 nt, Homo sapiens
guagacaagcguugagcca

SEQ ID NO: 1328275 - RNA, 21 nt, Homo sapiens
guagaugccacccaguuguga

SEQ ID NO: 1328276 - RNA, 16 nt, Homo sapiens
guagcacucucagagu

SEQ ID NO: 1328277 - RNA, 10 nt, Homo sapiens
guagcucucc

SEQ ID NO: 1328278 - RNA, 16 nt, Homo sapiens
guagcucucccuaggc

SEQ ID NO: 1328279 - RNA, 17 nt, Homo sapiens
guagcugggauuacaga

SEQ ID NO: 1328280 - RNA, 20 nt, Homo sapiens
guagcugggauuacaggcgu

SEQ ID NO: 1328281 - RNA, 17 nt, Homo sapiens
guaggucauugcaccua

SEQ ID NO: 1328282 - RNA, 13 nt, Homo sapiens
guaggugucucau

SEQ ID NO: 1328283 - RNA, 13 nt, Homo sapiens
guagucacuugcg

SEQ ID NO: 1328284 - RNA, 22 nt, Homo sapiens
guaguuuguuuuagaaccagcc

SEQ ID NO: 1328285 - RNA, 14 nt, Homo sapiens
guauaaauguacau

SEQ ID NO: 1328286 - RNA, 22 nt, Homo sapiens
guauaacaugucgauguucgau

SEQ ID NO: 1328287 - RNA, 14 nt, Homo sapiens
guauaagcaucugc

SEQ ID NO: 1328288 - RNA, 22 nt, Homo sapiens
uaaaauuuagaguagguauuaa

SEQ ID NO: 1328289 - RNA, 15 nt, Homo sapiens
uaaacagugucauau

SEQ ID NO: 1328290 - RNA, 14 nt, Homo sapiens
uaaacaugcuugca

SEQ ID NO: 1328291 - RNA, 18 nt, Homo sapiens
uaaacauuaauauuuacc

SEQ ID NO: 1328292 - RNA, 15 nt, Homo sapiens
uaaacauuucauuuc

SEQ ID NO: 1328293 - RNA, 17 nt, Homo sapiens
uaaacauuucauuuccc

SEQ ID NO: 1328294 - RNA, 15 nt, Homo sapiens
uaaaccaaaaacuga

SEQ ID NO: 1328295 - RNA, 15 nt, Homo sapiens
uaaaccacagcacua

SEQ ID NO: 1328296 - RNA, 16 nt, Homo sapiens
uaaacgcugucccuag

SEQ ID NO: 1328297 - RNA, 19 nt, Homo sapiens
uaaacugauuacguuuaca

SEQ ID NO: 1328298 - RNA, 17 nt, Homo sapiens
uaaacuguaugcucaca

SEQ ID NO: 1328299 - RNA, 21 nt, Homo sapiens
uaaacuguuuauuugcacuau

SEQ ID NO: 1328300 - RNA, 22 nt, Homo sapiens
uaaacuucaccuacauuaucuc

SEQ ID NO: 1328301 - RNA, 16 nt, Homo sapiens
uaaacuugccuguuca

SEQ ID NO: 1328302 - RNA, 22 nt, Homo sapiens
uaaacuuugaagcaacugugaa

SEQ ID NO: 1328303 - RNA, 13 nt, Homo sapiens
uaaagaaacuggu

SEQ ID NO: 1328304 - RNA, 13 nt, Homo sapiens
uaaagacaggguc

SEQ ID NO: 1328305 - RNA, 14 nt, Homo sapiens
uaaagacagggucu

SEQ ID NO: 1328306 - RNA, 19 nt, Homo sapiens
uaaagacccaacauuacua

SEQ ID NO: 1328307 - RNA, 20 nt, Homo sapiens
uaaagaucgcccccaccucc

SEQ ID NO: 1328308 - RNA, 16 nt, Homo sapiens
uaaagaugaaugucag

SEQ ID NO: 1328309 - RNA, 16 nt, Homo sapiens
uaaagcauaaaaaggu

SEQ ID NO: 1328310 - RNA, 15 nt, Homo sapiens
uaaagccaagcacuu

SEQ ID NO: 1328311 - RNA, 23 nt, Homo sapiens
uaaagggaccaucugcugcaguu

SEQ ID NO: 1328312 - RNA, 15 nt, Homo sapiens
uaaagggacuaccuc

SEQ ID NO: 1328313 - RNA, 21 nt, Homo sapiens
uaaagguugaguaugugaaga

SEQ ID NO: 1328314 - RNA, 20 nt, Homo sapiens
uaaaguaaauacaugcauau

SEQ ID NO: 1328315 - RNA, 12 nt, Homo sapiens
uaaagucaguga

SEQ ID NO: 1328316 - RNA, 14 nt, Homo sapiens
uaaagucuugccuu

SEQ ID NO: 1328317 - RNA, 11 nt, Homo sapiens
uaaaguucuag

SEQ ID NO: 1328318 - RNA, 14 nt, Homo sapiens
uaaaguugccuuua

SEQ ID NO: 1328319 - RNA, 20 nt, Homo sapiens
uaaauaagauuuaauucaca

SEQ ID NO: 1328320 - RNA, 14 nt, Homo sapiens
uaaauaauucuucc

SEQ ID NO: 1328321 - RNA, 15 nt, Homo sapiens
uaaauacaugcauau

SEQ ID NO: 1328322 - RNA, 18 nt, Homo sapiens
uaaauauaucuaccccag

SEQ ID NO: 1328323 - RNA, 15 nt, Homo sapiens
uaaaucacacauuca

SEQ ID NO: 1328324 - RNA, 15 nt, Homo sapiens
uaaaucaucccuuaa

SEQ ID NO: 1328325 - RNA, 17 nt, Homo sapiens
uaaauccaugguguuau

SEQ ID NO: 1328326 - RNA, 17 nt, Homo sapiens
uaaaugaaacuuggcca

SEQ ID NO: 1328327 - RNA, 19 nt, Homo sapiens
uaaauggauuuccuagugg

SEQ ID NO: 1328328 - RNA, 20 nt, Homo sapiens
uaaauggcccggacaugucu

SEQ ID NO: 1328329 - RNA, 17 nt, Homo sapiens
uaaauguauacuauagu

SEQ ID NO: 1328330 - RNA, 23 nt, Homo sapiens
uaaaugucauuucacuacuggug

SEQ ID NO: 1328331 - RNA, 18 nt, Homo sapiens
uaaauguucuaacagauc

SEQ ID NO: 1328332 - RNA, 13 nt, Homo sapiens
uaaauuaccuuaa

SEQ ID NO: 1328333 - RNA, 14 nt, Homo sapiens
uaaauuauagcuca

SEQ ID NO: 1328334 - RNA, 13 nt, Homo sapiens
uaaauucuaccuc

SEQ ID NO: 1328335 - RNA, 19 nt, Homo sapiens
uaaauugauaacauggaaa

SEQ ID NO: 1328336 - RNA, 19 nt, Homo sapiens
uaaauugcuccuugacauu

SEQ ID NO: 1328337 - RNA, 12 nt, Homo sapiens
uaaauuggcuaa

SEQ ID NO: 1328338 - RNA, 18 nt, Homo sapiens
uaaauugggaaaacucca

SEQ ID NO: 1328339 - RNA, 16 nt, Homo sapiens
uaaauuuaugugaugg

SEQ ID NO: 1328340 - RNA, 14 nt, Homo sapiens
uaaauuuguguucu

SEQ ID NO: 1328341 - RNA, 17 nt, Homo sapiens
uaaauuuguguucucaa

SEQ ID NO: 1328342 - RNA, 18 nt, Homo sapiens
uaaauuuuuuuuggucaa

SEQ ID NO: 1328343 - RNA, 22 nt, Homo sapiens
uaaauuuuuuuuuuuuacuuga

SEQ ID NO: 1328344 - RNA, 15 nt, Homo sapiens
uaacaaacuagucag

SEQ ID NO: 1328345 - RNA, 18 nt, Homo sapiens
uaacaagaauacuacuua

SEQ ID NO: 1328346 - RNA, 12 nt, Homo sapiens
uaacacauucaa

SEQ ID NO: 1328347 - RNA, 14 nt, Homo sapiens
uaacacuauuugau

SEQ ID NO: 1328348 - RNA, 22 nt, Homo sapiens
uaacagaaagccugggugacau

SEQ ID NO: 1328349 - RNA, 18 nt, Homo sapiens
uaacaggauacaggugac

SEQ ID NO: 1328350 - RNA, 20 nt, Homo sapiens
uaaccaaagguuuugcagcc

SEQ ID NO: 1328351 - RNA, 21 nt, Homo sapiens
uaacccaagacaugacauucu

SEQ ID NO: 1328352 - RNA, 15 nt, Homo sapiens
uaaccucacauaccc

SEQ ID NO: 1328353 - RNA, 22 nt, Homo sapiens
uaaccugcaaaaucuguucuaa

SEQ ID NO: 1328354 - RNA, 17 nt, Homo sapiens
uaacgauguuguauuga

SEQ ID NO: 1328355 - RNA, 14 nt, Homo sapiens
uaacuaacuggcag

SEQ ID NO: 1328356 - RNA, 14 nt, Homo sapiens
uaacuaugacagau

SEQ ID NO: 1328357 - RNA, 20 nt, Homo sapiens
uaacuaugagcuugcucauu

SEQ ID NO: 1328358 - RNA, 15 nt, Homo sapiens
uaacuauugcauuua

SEQ ID NO: 1328359 - RNA, 23 nt, Homo sapiens
uaacuauuuauuuuuucuaagug

SEQ ID NO: 1328360 - RNA, 15 nt, Homo sapiens
uaacugaaccaaauu

SEQ ID NO: 1328361 - RNA, 23 nt, Homo sapiens
uaacugaguuauauuggaauuau

SEQ ID NO: 1328362 - RNA, 23 nt, Homo sapiens
uaacuguuaacuaugacagauau

SEQ ID NO: 1328363 - RNA, 16 nt, Homo sapiens
uaacuuggcugcauuu

SEQ ID NO: 1328364 - RNA, 18 nt, Homo sapiens
uaacuuggcugcauuugc

SEQ ID NO: 1328365 - RNA, 16 nt, Homo sapiens
uaacuuugacuuucuu

SEQ ID NO: 1328366 - RNA, 23 nt, Homo sapiens
uaacuuuugggcguaagaccaaa

SEQ ID NO: 1328367 - RNA, 17 nt, Homo sapiens
uaacuuuuguaagacaa

SEQ ID NO: 1328368 - RNA, 10 nt, Homo sapiens
uaagaacaag

SEQ ID NO: 1328369 - RNA, 14 nt, Homo sapiens
uaagaaccugaaua

SEQ ID NO: 1328370 - RNA, 15 nt, Homo sapiens
uaagaagagugcugu

SEQ ID NO: 1328371 - RNA, 15 nt, Homo sapiens
uaagaaguaagcaac

SEQ ID NO: 1328372 - RNA, 22 nt, Homo sapiens
uaagaaucuuuagagaaguaua

SEQ ID NO: 1328373 - RNA, 22 nt, Homo sapiens
uaagacaaauauuccuuugcau

SEQ ID NO: 1328374 - RNA, 20 nt, Homo sapiens
uaagacagauucuucacugu

SEQ ID NO: 1328375 - RNA, 16 nt, Homo sapiens
uaagacccagcauuuu

SEQ ID NO: 1328376 - RNA, 17 nt, Homo sapiens
uaagaggcuuucuccag

SEQ ID NO: 1328377 - RNA, 23 nt, Homo sapiens
uaagaugugcagcauuucacuua

SEQ ID NO: 1328378 - RNA, 14 nt, Homo sapiens
uaagauuuaauuca

SEQ ID NO: 1328379 - RNA, 16 nt, Homo sapiens
uaagauuuaauucaca

SEQ ID NO: 1328380 - RNA, 14 nt, Homo sapiens
uaagcaaauuuugu

SEQ ID NO: 1328381 - RNA, 19 nt, Homo sapiens
uaagccacguuaaguccaa

SEQ ID NO: 1328382 - RNA, 17 nt, Homo sapiens
uaagcccccacuacaag

SEQ ID NO: 1328383 - RNA, 16 nt, Homo sapiens
uaagggaaacugccag

SEQ ID NO: 1328384 - RNA, 23 nt, Homo sapiens
uaagggagggggcgcuggagcuu

SEQ ID NO: 1328385 - RNA, 22 nt, Homo sapiens
uaagggcagugcccauguguac

SEQ ID NO: 1328386 - RNA, 15 nt, Homo sapiens
uaaggugaaccaaag

SEQ ID NO: 1328387 - RNA, 13 nt, Homo sapiens
uaaguaaaaccac

SEQ ID NO: 1328388 - RNA, 13 nt, Homo sapiens
uauggauaaucug

SEQ ID NO: 1328389 - RNA, 17 nt, Homo sapiens
uauggcuucacauucau

SEQ ID NO: 1328390 - RNA, 15 nt, Homo sapiens
uaugggggcacugag

SEQ ID NO: 1328391 - RNA, 20 nt, Homo sapiens
uauggguuggacaaccucau

SEQ ID NO: 1328392 - RNA, 19 nt, Homo sapiens
uaugucacuagaauggaua

SEQ ID NO: 1328393 - RNA, 20 nt, Homo sapiens
uaugugcaaaggugugcuuc

SEQ ID NO: 1328394 - RNA, 15 nt, Homo sapiens
uaugugcacaucugu

SEQ ID NO: 1328395 - RNA, 18 nt, Homo sapiens
uauguuuggaauauucca

SEQ ID NO: 1328396 - RNA, 12 nt, Homo sapiens
uauuaacagaua

SEQ ID NO: 1328397 - RNA, 21 nt, Homo sapiens
uauuaaucauacaaacucuca

SEQ ID NO: 1328398 - RNA, 13 nt, Homo sapiens
uauuagauuuauu

SEQ ID NO: 1328399 - RNA, 19 nt, Homo sapiens
uauuauaaacuguaugcuc

SEQ ID NO: 1328400 - RNA, 22 nt, Homo sapiens
uauuauaaacuguaugcucaca

SEQ ID NO: 1328401 - RNA, 21 nt, Homo sapiens
uauuauaauuggaagugcagu

SEQ ID NO: 1328402 - RNA, 19 nt, Homo sapiens
uauuaucugucagcugcaa

SEQ ID NO: 1328403 - RNA, 18 nt, Homo sapiens
uauuaugccugaaugacu

SEQ ID NO: 1328404 - RNA, 16 nt, Homo sapiens
uauucacuaaggacuu

SEQ ID NO: 1328405 - RNA, 12 nt, Homo sapiens
uauucagaugua

SEQ ID NO: 1328406 - RNA, 12 nt, Homo sapiens
uauucccaugag

SEQ ID NO: 1328407 - RNA, 16 nt, Homo sapiens
uauuccuaugacaaaa

SEQ ID NO: 1328408 - RNA, 13 nt, Homo sapiens
uauuccugcauuu

SEQ ID NO: 1328409 - RNA, 11 nt, Homo sapiens
uauuccugcug

SEQ ID NO: 1328410 - RNA, 15 nt, Homo sapiens
uauucugugcuguua

SEQ ID NO: 1328411 - RNA, 15 nt, Homo sapiens
uauucuuuguuuccu

SEQ ID NO: 1328412 - RNA, 13 nt, Homo sapiens
ugaauauguagua

SEQ ID NO: 1328413 - RNA, 17 nt, Homo sapiens
ugaauauugccauuaug

SEQ ID NO: 1328414 - RNA, 14 nt, Homo sapiens
ugaaucuacauuca

SEQ ID NO: 1328415 - RNA, 13 nt, Homo sapiens
ugaaucugucuau

SEQ ID NO: 1328416 - RNA, 18 nt, Homo sapiens
ugaauucugucauuucaa

SEQ ID NO: 1328417 - RNA, 18 nt, Homo sapiens
ugacaaaauucauuugcu

SEQ ID NO: 1328418 - RNA, 12 nt, Homo sapiens
ugacaacauguu

SEQ ID NO: 1328419 - RNA, 17 nt, Homo sapiens
ugacaaccuccauucua

SEQ ID NO: 1328420 - RNA, 15 nt, Homo sapiens
ugacaagucacagac

SEQ ID NO: 1328421 - RNA, 16 nt, Homo sapiens
ugacacuaaacuccau

SEQ ID NO: 1328422 - RNA, 13 nt, Homo sapiens
ugacagagugccu

SEQ ID NO: 1328423 - RNA, 17 nt, Homo sapiens
ugacaggcgugcaccug

SEQ ID NO: 1328424 - RNA, 11 nt, Homo sapiens
ugacagugaag

SEQ ID NO: 1328425 - RNA, 16 nt, Homo sapiens
ugacauaagugcuauu

SEQ ID NO: 1328426 - RNA, 16 nt, Homo sapiens
ugacauaauaauagca

SEQ ID NO: 1328427 - RNA, 13 nt, Homo sapiens
ugacauacauauu

SEQ ID NO: 1328428 - RNA, 16 nt, Homo sapiens
ugacauacauccaaca

SEQ ID NO: 1328429 - RNA, 17 nt, Homo sapiens
ugacaugcauucacaua

SEQ ID NO: 1328430 - RNA, 18 nt, Homo sapiens
ugacauugcaccuggaug

SEQ ID NO: 1328431 - RNA, 15 nt, Homo sapiens
ugacauuuaggauuu

SEQ ID NO: 1328432 - RNA, 22 nt, Homo sapiens
ugacauuugggagacaugugac

SEQ ID NO: 1328433 - RNA, 21 nt, Homo sapiens
ugacccacccuagaucuuccc

SEQ ID NO: 1328434 - RNA, 23 nt, Homo sapiens
ugaccccaagggggcugcugcuc

SEQ ID NO: 1328435 - RNA, 18 nt, Homo sapiens
ugacccccaucugagcug

SEQ ID NO: 1328436 - RNA, 16 nt, Homo sapiens
ugaccccgccaugcau

SEQ ID NO: 1328437 - RNA, 13 nt, Homo sapiens
ugaccucaaggaa

SEQ ID NO: 1328438 - RNA, 15 nt, Homo sapiens
ugaccucacuggccu

SEQ ID NO: 1328439 - RNA, 14 nt, Homo sapiens
ugaccucacuuuag

SEQ ID NO: 1328440 - RNA, 23 nt, Homo sapiens
ugaccucacuuuaggcagcugua

SEQ ID NO: 1328441 - RNA, 20 nt, Homo sapiens
ugaccucgcccuccacaaau

SEQ ID NO: 1328442 - RNA, 20 nt, Homo sapiens
ugaccucucauaaauuuacu

SEQ ID NO: 1328443 - RNA, 20 nt, Homo sapiens
ugaccuugcugauggugaca

SEQ ID NO: 1328444 - RNA, 16 nt, Homo sapiens
ugaccuuggguccuga

SEQ ID NO: 1328445 - RNA, 17 nt, Homo sapiens
ugaccuuggguccugaa

SEQ ID NO: 1328446 - RNA, 22 nt, Homo sapiens
ugacgucacuggaccacugggc

SEQ ID NO: 1328447 - RNA, 18 nt, Homo sapiens
ugacucauuuccauacca

SEQ ID NO: 1328448 - RNA, 17 nt, Homo sapiens
ugacuccccagcccagc

SEQ ID NO: 1328449 - RNA, 12 nt, Homo sapiens
ugacugcaugac

SEQ ID NO: 1328450 - RNA, 16 nt, Homo sapiens
ugacugccaagccaga

SEQ ID NO: 1328451 - RNA, 22 nt, Homo sapiens
ugacuggaggaggccuguccca

SEQ ID NO: 1328452 - RNA, 14 nt, Homo sapiens
ugacuguauacaga

SEQ ID NO: 1328453 - RNA, 15 nt, Homo sapiens
ugacuuauaguacau

SEQ ID NO: 1328454 - RNA, 15 nt, Homo sapiens
ugacuuccugccaug

SEQ ID NO: 1328455 - RNA, 14 nt, Homo sapiens
ugacuuggggacaa

SEQ ID NO: 1328456 - RNA, 21 nt, Homo sapiens
ugagaacucguucaccuccaa

SEQ ID NO: 1328457 - RNA, 23 nt, Homo sapiens
ugagaagaaaaucagagagggaa

SEQ ID NO: 1328458 - RNA, 18 nt, Homo sapiens
ugagaagccagcuuuccu

SEQ ID NO: 1328459 - RNA, 20 nt, Homo sapiens
ugagaaggggcagauguucc

SEQ ID NO: 1328460 - RNA, 13 nt, Homo sapiens
ugagaagugcacu

SEQ ID NO: 1328461 - RNA, 13 nt, Homo sapiens
ugagaccuggcag

SEQ ID NO: 1328462 - RNA, 20 nt, Homo sapiens
ugagacugggcaucucugag

SEQ ID NO: 1328463 - RNA, 18 nt, Homo sapiens
ugagagcuguuuuugaca

SEQ ID NO: 1328464 - RNA, 19 nt, Homo sapiens
ugagaggccacagugcaau

SEQ ID NO: 1328465 - RNA, 23 nt, Homo sapiens
ugagaggcugucuguuguauuca

SEQ ID NO: 1328466 - RNA, 14 nt, Homo sapiens
ugagagucaaagcu

SEQ ID NO: 1328467 - RNA, 18 nt, Homo sapiens
ugagaguuccggggagaa

SEQ ID NO: 1328468 - RNA, 14 nt, Homo sapiens
ugagaucagucuuu

SEQ ID NO: 1328469 - RNA, 12 nt, Homo sapiens
ugagauggaguu

SEQ ID NO: 1328470 - RNA, 16 nt, Homo sapiens
ugagcaagacauacuu

SEQ ID NO: 1328471 - RNA, 14 nt, Homo sapiens
ugagcaauggagug

SEQ ID NO: 1328472 - RNA, 21 nt, Homo sapiens
ugagcacacccgugugcacac

SEQ ID NO: 1328473 - RNA, 19 nt, Homo sapiens
ugagcagcauccaccccac

SEQ ID NO: 1328474 - RNA, 23 nt, Homo sapiens
ugagcagguguucuucauuaccu

SEQ ID NO: 1328475 - RNA, 12 nt, Homo sapiens
ugagcgucagca

SEQ ID NO: 1328476 - RNA, 12 nt, Homo sapiens
ugagcuaacuua

SEQ ID NO: 1328477 - RNA, 16 nt, Homo sapiens
ugagcuauaacuuacu

SEQ ID NO: 1328478 - RNA, 17 nt, Homo sapiens
ugagcuggggaugucuc

SEQ ID NO: 1328479 - RNA, 22 nt, Homo sapiens
ugagcuggggaugucucucaug

SEQ ID NO: 1328480 - RNA, 16 nt, Homo sapiens
ugagcugggggaagaa

SEQ ID NO: 1328481 - RNA, 19 nt, Homo sapiens
ugagcuguaaaaauguuac

SEQ ID NO: 1328482 - RNA, 23 nt, Homo sapiens
ugagcuugaucuuuuucugccau

SEQ ID NO: 1328483 - RNA, 14 nt, Homo sapiens
ugaggaaaaacuga

SEQ ID NO: 1328484 - RNA, 21 nt, Homo sapiens
ugaggaaaagcggacaucagc

SEQ ID NO: 1328485 - RNA, 21 nt, Homo sapiens
ugaggaagacaagugaugcua

SEQ ID NO: 1328486 - RNA, 13 nt, Homo sapiens
ugaggaggacaaa

SEQ ID NO: 1328487 - RNA, 23 nt, Homo sapiens
ugaggcaaucuaagggagucauu

SEQ ID NO: 1328488 - RNA, 18 nt, Homo sapiens
ugaggcaauuagacacuu

SEQ ID NO: 1328489 - RNA, 19 nt, Homo sapiens
ugaggcuauggaggguccu

SEQ ID NO: 1328490 - RNA, 22 nt, Homo sapiens
ugagggcaguucugaguguuua

SEQ ID NO: 1328491 - RNA, 16 nt, Homo sapiens
ugaggggcucucucau

SEQ ID NO: 1328492 - RNA, 18 nt, Homo sapiens
ugaggggcucucucauga

SEQ ID NO: 1328493 - RNA, 21 nt, Homo sapiens
ugaggguccucaguccacugc

SEQ ID NO: 1328494 - RNA, 19 nt, Homo sapiens
ugagggugacuauggagcu

SEQ ID NO: 1328495 - RNA, 16 nt, Homo sapiens
ugaggugaacuccagg

SEQ ID NO: 1328496 - RNA, 22 nt, Homo sapiens
ugaggugcaaggaguguaaaau

SEQ ID NO: 1328497 - RNA, 19 nt, Homo sapiens
ugaguaauaaagauacaaa

SEQ ID NO: 1328498 - RNA, 13 nt, Homo sapiens
ugaguaauggcug

SEQ ID NO: 1328499 - RNA, 18 nt, Homo sapiens
ugaguagagcuuguaaua

SEQ ID NO: 1328500 - RNA, 18 nt, Homo sapiens
ugauaaaugauagacaau

SEQ ID NO: 1328501 - RNA, 14 nt, Homo sapiens
ugauacaguauuau

SEQ ID NO: 1328502 - RNA, 14 nt, Homo sapiens
ugauacuaucugug

SEQ ID NO: 1328503 - RNA, 13 nt, Homo sapiens
ugauagacaccau

SEQ ID NO: 1328504 - RNA, 14 nt, Homo sapiens
ugauagagugcagu

SEQ ID NO: 1328505 - RNA, 20 nt, Homo sapiens
ugauagagugcagugauguu

SEQ ID NO: 1328506 - RNA, 15 nt, Homo sapiens
ugauauuguucucca

SEQ ID NO: 1328507 - RNA, 19 nt, Homo sapiens
ugauauuuaagcagcuuga

SEQ ID NO: 1328508 - RNA, 17 nt, Homo sapiens
ugaucaagaacauguca

SEQ ID NO: 1328509 - RNA, 18 nt, Homo sapiens
ugaucacuccagugcacu

SEQ ID NO: 1328510 - RNA, 17 nt, Homo sapiens
ugauccggggguccagg

SEQ ID NO: 1328511 - RNA, 20 nt, Homo sapiens
ugauccuggaggcccaguuc

SEQ ID NO: 1328512 - RNA, 16 nt, Homo sapiens
ugaucuguaacagggu

SEQ ID NO: 1328513 - RNA, 19 nt, Homo sapiens
ugaucuuaauauauuugaa

SEQ ID NO: 1328514 - RNA, 21 nt, Homo sapiens
ugaugaaaacuaaggauuuuu

SEQ ID NO: 1328515 - RNA, 14 nt, Homo sapiens
ugaugauacuguaa

SEQ ID NO: 1328516 - RNA, 20 nt, Homo sapiens
ugaugccuguguacugccuu

SEQ ID NO: 1328517 - RNA, 22 nt, Homo sapiens
ugaugccuguguacugccuuaa

SEQ ID NO: 1328518 - RNA, 21 nt, Homo sapiens
ugauggggaguaaacccugga

SEQ ID NO: 1328519 - RNA, 19 nt, Homo sapiens
ugauguagagauuuaccug

SEQ ID NO: 1328520 - RNA, 14 nt, Homo sapiens
ugauguauaaugua

SEQ ID NO: 1328521 - RNA, 19 nt, Homo sapiens
ugauuccaucaaagagaag

SEQ ID NO: 1328522 - RNA, 15 nt, Homo sapiens
ugauuuagguagccu

SEQ ID NO: 1328523 - RNA, 15 nt, Homo sapiens
ugauuuccauuugca

SEQ ID NO: 1328524 - RNA, 13 nt, Homo sapiens
ugcaaaccaggau

SEQ ID NO: 1328525 - RNA, 16 nt, Homo sapiens
ugcaaacccuuucaua

SEQ ID NO: 1328526 - RNA, 15 nt, Homo sapiens
ugcaaagcauuugag

SEQ ID NO: 1328527 - RNA, 17 nt, Homo sapiens
ugcaaaguguauuagga

SEQ ID NO: 1328528 - RNA, 19 nt, Homo sapiens
ugcaaauacaaucagccca

SEQ ID NO: 1328529 - RNA, 22 nt, Homo sapiens
ugcaaauacaaucagcccagug

SEQ ID NO: 1328530 - RNA, 23 nt, Homo sapiens
ugcaaauacaaucagcccagugc

SEQ ID NO: 1328531 - RNA, 17 nt, Homo sapiens
ugcaaaucaaacauauu

SEQ ID NO: 1328532 - RNA, 18 nt, Homo sapiens
ugcaaaucaaacauauuc

SEQ ID NO: 1328533 - RNA, 14 nt, Homo sapiens
ugcaagccaucucu

SEQ ID NO: 1328534 - RNA, 19 nt, Homo sapiens
ugcaagccaucucuaauaa

SEQ ID NO: 1328535 - RNA, 22 nt, Homo sapiens
ugcaagccccugcuccagaaga

SEQ ID NO: 1328536 - RNA, 22 nt, Homo sapiens
ugcaauaaaucugacccagugc

SEQ ID NO: 1328537 - RNA, 18 nt, Homo sapiens
ugcaauaauccaccccca

SEQ ID NO: 1328538 - RNA, 16 nt, Homo sapiens
ugcaauccucccuacc

SEQ ID NO: 1328539 - RNA, 19 nt, Homo sapiens
uaaguaaaagcuacuaugu

SEQ ID NO: 1328540 - RNA, 19 nt, Homo sapiens
uaaguacacaauaagcaaa

SEQ ID NO: 1328541 - RNA, 15 nt, Homo sapiens
uaaguacaugugcca

SEQ ID NO: 1328542 - RNA, 14 nt, Homo sapiens
uaagucaguguuaa

SEQ ID NO: 1328543 - RNA, 19 nt, Homo sapiens
uaaguggcuucucugugaa

SEQ ID NO: 1328544 - RNA, 16 nt, Homo sapiens
uaaguuaucuuugaau

SEQ ID NO: 1328545 - RNA, 15 nt, Homo sapiens
uaauaaacucucuag

SEQ ID NO: 1328546 - RNA, 15 nt, Homo sapiens
uaauaaagacagggu

SEQ ID NO: 1328547 - RNA, 13 nt, Homo sapiens
uaauaaaucacac

SEQ ID NO: 1328548 - RNA, 17 nt, Homo sapiens
uaauaagaaaauucuaa

SEQ ID NO: 1328549 - RNA, 22 nt, Homo sapiens
uaauaauuguagauucagugua

SEQ ID NO: 1328550 - RNA, 15 nt, Homo sapiens
uaauacagacaucua

SEQ ID NO: 1328551 - RNA, 18 nt, Homo sapiens
uaauacguagcucucuua

SEQ ID NO: 1328552 - RNA, 16 nt, Homo sapiens
uaauaggcaucuccag

SEQ ID NO: 1328553 - RNA, 13 nt, Homo sapiens
uaauaggcauuuu

SEQ ID NO: 1328554 - RNA, 19 nt, Homo sapiens
uaauaggguuuucagauga

SEQ ID NO: 1328555 - RNA, 16 nt, Homo sapiens
uaauauuauuacuuua

SEQ ID NO: 1328556 - RNA, 15 nt, Homo sapiens
uaauauugugcaaac

SEQ ID NO: 1328557 - RNA, 14 nt, Homo sapiens
uaauauuuacucua

SEQ ID NO: 1328558 - RNA, 22 nt, Homo sapiens
uaaucaaaacuuucguuguuau

SEQ ID NO: 1328559 - RNA, 13 nt, Homo sapiens
uaaucaguauaca

SEQ ID NO: 1328560 - RNA, 19 nt, Homo sapiens
uaaucaugaaagcaucuga

SEQ ID NO: 1328561 - RNA, 18 nt, Homo sapiens
uaaucauuuuaagugcau

SEQ ID NO: 1328562 - RNA, 20 nt, Homo sapiens
uaauccaauuggugucugua

SEQ ID NO: 1328563 - RNA, 18 nt, Homo sapiens
uaauccaggcagauccag

SEQ ID NO: 1328564 - RNA, 14 nt, Homo sapiens
uaaucccagcacuu

SEQ ID NO: 1328565 - RNA, 11 nt, Homo sapiens
uaauccuuaac

SEQ ID NO: 1328566 - RNA, 14 nt, Homo sapiens
uaaucucagcacuu

SEQ ID NO: 1328567 - RNA, 19 nt, Homo sapiens
uaaucugauguauaaugua

SEQ ID NO: 1328568 - RNA, 19 nt, Homo sapiens
uaaugaaguuaagaaccug

SEQ ID NO: 1328569 - RNA, 16 nt, Homo sapiens
uaaugacagccuugca

SEQ ID NO: 1328570 - RNA, 17 nt, Homo sapiens
uagauuucuacacugag

SEQ ID NO: 1328571 - RNA, 13 nt, Homo sapiens
uagcaaacuccag

SEQ ID NO: 1328572 - RNA, 21 nt, Homo sapiens
uagcaaagcacauagagccag

SEQ ID NO: 1328573 - RNA, 23 nt, Homo sapiens
uagcaaagcacauagagccagcu

SEQ ID NO: 1328574 - RNA, 20 nt, Homo sapiens
uagcaaauggcagaaccaaa

SEQ ID NO: 1328575 - RNA, 16 nt, Homo sapiens
uagcaauugacuguca

SEQ ID NO: 1328576 - RNA, 23 nt, Homo sapiens
uagcaauuggcagcccuauuuca

SEQ ID NO: 1328577 - RNA, 16 nt, Homo sapiens
uagcacauggcagauu

SEQ ID NO: 1328578 - RNA, 18 nt, Homo sapiens
uagcagaaaaaccaacau

SEQ ID NO: 1328579 - RNA, 18 nt, Homo sapiens
uagcagccuacaacugaa

SEQ ID NO: 1328580 - RNA, 17 nt, Homo sapiens
uagcagccucacacugg

SEQ ID NO: 1328581 - RNA, 20 nt, Homo sapiens
uagcauguuccuccuuuucu

SEQ ID NO: 1328582 - RNA, 22 nt, Homo sapiens
uagccacugcauaccaaccugg

SEQ ID NO: 1328583 - RNA, 17 nt, Homo sapiens
uagccagcauuccauau

SEQ ID NO: 1328584 - RNA, 19 nt, Homo sapiens
uagcccaaccuacauucca

SEQ ID NO: 1328585 - RNA, 21 nt, Homo sapiens
uagcccuccucucccagugac

SEQ ID NO: 1328586 - RNA, 15 nt, Homo sapiens
uagccuuugucccag

SEQ ID NO: 1328587 - RNA, 14 nt, Homo sapiens
uagcgggacaaagc

SEQ ID NO: 1328588 - RNA, 14 nt, Homo sapiens
uagcuaauaacaug

SEQ ID NO: 1328589 - RNA, 11 nt, Homo sapiens
uagcuaggcau

SEQ ID NO: 1328590 - RNA, 13 nt, Homo sapiens
uagcucugcugcu

SEQ ID NO: 1328591 - RNA, 15 nt, Homo sapiens
uagcucugcugcuga

SEQ ID NO: 1328592 - RNA, 19 nt, Homo sapiens
uagcugauuuaacuuguau

SEQ ID NO: 1328593 - RNA, 18 nt, Homo sapiens
uagcugggauuacaggcg

SEQ ID NO: 1328594 - RNA, 21 nt, Homo sapiens
uaggaacugcugggcuuggca

SEQ ID NO: 1328595 - RNA, 12 nt, Homo sapiens
uaggacuccauu

SEQ ID NO: 1328596 - RNA, 21 nt, Homo sapiens
uaggcacaaauacauuccuuu

SEQ ID NO: 1328597 - RNA, 17 nt, Homo sapiens
uaggccagcaccaucuc

SEQ ID NO: 1328598 - RNA, 20 nt, Homo sapiens
uagggcugaggaaccaauca

SEQ ID NO: 1328599 - RNA, 15 nt, Homo sapiens
uaggugcaguuugcu

SEQ ID NO: 1328600 - RNA, 19 nt, Homo sapiens
uaggugggggaacacugag

SEQ ID NO: 1328601 - RNA, 14 nt, Homo sapiens
uaggugucucauag

SEQ ID NO: 1328602 - RNA, 13 nt, Homo sapiens
uagguuaacaaua

SEQ ID NO: 1328603 - RNA, 17 nt, Homo sapiens
uagguuacagaccucag

SEQ ID NO: 1328604 - RNA, 14 nt, Homo sapiens
uaguaaauguccac

SEQ ID NO: 1328605 - RNA, 21 nt, Homo sapiens
uaguacuuugugcucauaaau

SEQ ID NO: 1328606 - RNA, 19 nt, Homo sapiens
uaguagauguggccuuuga

SEQ ID NO: 1328607 - RNA, 14 nt, Homo sapiens
uaguauuccaauca

SEQ ID NO: 1328608 - RNA, 20 nt, Homo sapiens
uagucaacauauacuauuua

SEQ ID NO: 1328609 - RNA, 13 nt, Homo sapiens
uagucaauccaag

SEQ ID NO: 1328610 - RNA, 13 nt, Homo sapiens
uagucacacauag

SEQ ID NO: 1328611 - RNA, 13 nt, Homo sapiens
uagucaugugacc

SEQ ID NO: 1328612 - RNA, 15 nt, Homo sapiens
uaguccuguacugua

SEQ ID NO: 1328613 - RNA, 20 nt, Homo sapiens
uagucucuacccaguagaug

SEQ ID NO: 1328614 - RNA, 21 nt, Homo sapiens
uagucucuggaaaaagacuga

SEQ ID NO: 1328615 - RNA, 17 nt, Homo sapiens
uagucuguuguucuuga

SEQ ID NO: 1328616 - RNA, 15 nt, Homo sapiens
uagugaaaugccaca

SEQ ID NO: 1328617 - RNA, 14 nt, Homo sapiens
uagugacaugcagu

SEQ ID NO: 1328618 - RNA, 16 nt, Homo sapiens
uagugagacuagacau

SEQ ID NO: 1328619 - RNA, 19 nt, Homo sapiens
uagugauaccccaucucuu

SEQ ID NO: 1328620 - RNA, 17 nt, Homo sapiens
uagugauagagugcagu

SEQ ID NO: 1328621 - RNA, 20 nt, Homo sapiens
uagugaugaaccagaguuuc

SEQ ID NO: 1328622 - RNA, 23 nt, Homo sapiens
uaguggggacccaaagauucuag

SEQ ID NO: 1328623 - RNA, 15 nt, Homo sapiens
uaguguuauacuuga

SEQ ID NO: 1328624 - RNA, 19 nt, Homo sapiens
uaguucaaucuggauucau

SEQ ID NO: 1328625 - RNA, 20 nt, Homo sapiens
uaguucuguggccaucugcu

SEQ ID NO: 1328626 - RNA, 11 nt, Homo sapiens
uaguugcaaag

SEQ ID NO: 1328627 - RNA, 18 nt, Homo sapiens
uauaaagaacuuguguag

SEQ ID NO: 1328628 - RNA, 19 nt, Homo sapiens
uauaaaguauaacuauaaa

SEQ ID NO: 1328629 - RNA, 15 nt, Homo sapiens
uauaaauucuacuaa

SEQ ID NO: 1328630 - RNA, 20 nt, Homo sapiens
uauaaauuuuuugaaacaca

SEQ ID NO: 1328631 - RNA, 18 nt, Homo sapiens
uauaacagugacuugauu

SEQ ID NO: 1328632 - RNA, 17 nt, Homo sapiens
uauaaccuuguuccaaa

SEQ ID NO: 1328633 - RNA, 18 nt, Homo sapiens
uauaaguucuauuuuacu

SEQ ID NO: 1328634 - RNA, 13 nt, Homo sapiens
uauacacuguaag

SEQ ID NO: 1328635 - RNA, 14 nt, Homo sapiens
uauacauacuauga

SEQ ID NO: 1328636 - RNA, 12 nt, Homo sapiens
uauacauuugau

SEQ ID NO: 1328637 - RNA, 18 nt, Homo sapiens
uauacucagguaccucuu

SEQ ID NO: 1328638 - RNA, 15 nt, Homo sapiens
uauacuguaggcaca

SEQ ID NO: 1328639 - RNA, 17 nt, Homo sapiens
uauagacacacauacau

SEQ ID NO: 1328640 - RNA, 13 nt, Homo sapiens
uauagcuaaguac

SEQ ID NO: 1328641 - RNA, 19 nt, Homo sapiens
uauaguaacacacuuccag

SEQ ID NO: 1328642 - RNA, 11 nt, Homo sapiens
uauauaaacug

SEQ ID NO: 1328643 - RNA, 14 nt, Homo sapiens
uauaucuaccccag

SEQ ID NO: 1328644 - RNA, 20 nt, Homo sapiens
uauaucuuagguaagacaua

SEQ ID NO: 1328645 - RNA, 15 nt, Homo sapiens
uauauggauaaucug

SEQ ID NO: 1328646 - RNA, 12 nt, Homo sapiens
uauauguaccgu

SEQ ID NO: 1328647 - RNA, 16 nt, Homo sapiens
uauaugucagugauga

SEQ ID NO: 1328648 - RNA, 14 nt, Homo sapiens
uauauuacuugccu

SEQ ID NO: 1328649 - RNA, 19 nt, Homo sapiens
uauauuacuugccuaucug

SEQ ID NO: 1328650 - RNA, 18 nt, Homo sapiens
uauauuugggccugcucc

SEQ ID NO: 1328651 - RNA, 15 nt, Homo sapiens
uaucaaaacauccca

SEQ ID NO: 1328652 - RNA, 16 nt, Homo sapiens
uaucaaauacauuuaa

SEQ ID NO: 1328653 - RNA, 15 nt, Homo sapiens
uaucagaguauguca

SEQ ID NO: 1328654 - RNA, 11 nt, Homo sapiens
uaucaguuccc

SEQ ID NO: 1328655 - RNA, 18 nt, Homo sapiens
uaucauaauucagcacuu

SEQ ID NO: 1328656 - RNA, 21 nt, Homo sapiens
uauccacaauuauuggcaaag

SEQ ID NO: 1328657 - RNA, 13 nt, Homo sapiens
uauccaugcaccu

SEQ ID NO: 1328658 - RNA, 21 nt, Homo sapiens
uaucccuagauagcuauuaag

SEQ ID NO: 1328659 - RNA, 16 nt, Homo sapiens
uauccuagucauucuu

SEQ ID NO: 1328660 - RNA, 14 nt, Homo sapiens
uauccucauuccau

SEQ ID NO: 1328661 - RNA, 21 nt, Homo sapiens
uauccugggagcacugcguuu

SEQ ID NO: 1328662 - RNA, 22 nt, Homo sapiens
uaucuaauuuuacacucuguau

SEQ ID NO: 1328663 - RNA, 21 nt, Homo sapiens
uaucugaaaggccagcagcug

SEQ ID NO: 1328664 - RNA, 12 nt, Homo sapiens
uaucugcuuauc

SEQ ID NO: 1328665 - RNA, 21 nt, Homo sapiens
uaucuguuuuuauuagccaau

SEQ ID NO: 1328666 - RNA, 23 nt, Homo sapiens
uaugaaaauauagacauucucac

SEQ ID NO: 1328667 - RNA, 17 nt, Homo sapiens
uaugaaaugccacuggg

SEQ ID NO: 1328668 - RNA, 20 nt, Homo sapiens
uaugaagaaucugcucugaa

SEQ ID NO: 1328669 - RNA, 22 nt, Homo sapiens
uaugagccaggcaucauacuaa

SEQ ID NO: 1328670 - RNA, 22 nt, Homo sapiens
uaugagcuggggaugucucuca

SEQ ID NO: 1328671 - RNA, 13 nt, Homo sapiens
uaugagggccacg

SEQ ID NO: 1328672 - RNA, 22 nt, Homo sapiens
uaugagggccacgggucugugu

SEQ ID NO: 1328673 - RNA, 19 nt, Homo sapiens
uaugauuguuucucaaauc

SEQ ID NO: 1328674 - RNA, 18 nt, Homo sapiens
uaugcauguagcauauaa

SEQ ID NO: 1328675 - RNA, 22 nt, Homo sapiens
uaugcauuauaaauaaauacca

SEQ ID NO: 1328676 - RNA, 23 nt, Homo sapiens
uaugccacaccuggccuuaaaga

SEQ ID NO: 1328677 - RNA, 19 nt, Homo sapiens
uauggagaaacaaaauccu

SEQ ID NO: 1328678 - RNA, 15 nt, Homo sapiens
aauccugaagagcau

SEQ ID NO: 1328679 - RNA, 17 nt, Homo sapiens
aauccuuaacacauuca

SEQ ID NO: 1328680 - RNA, 17 nt, Homo sapiens
aauccuugccacagugu

SEQ ID NO: 1328681 - RNA, 15 nt, Homo sapiens
aauccuuuuccuuau

SEQ ID NO: 1328682 - RNA, 21 nt, Homo sapiens
aaucguaguuaacguauauug

SEQ ID NO: 1328683 - RNA, 12 nt, Homo sapiens
aaucuaagugau

SEQ ID NO: 1328684 - RNA, 19 nt, Homo sapiens
aaucucagaugcaguuugg

SEQ ID NO: 1328685 - RNA, 13 nt, Homo sapiens
aaucucagcacuu

SEQ ID NO: 1328686 - RNA, 16 nt, Homo sapiens
aaucucuugcacucaa

SEQ ID NO: 1328687 - RNA, 19 nt, Homo sapiens
aaucucuugccugcuccau

SEQ ID NO: 1328688 - RNA, 13 nt, Homo sapiens
aaucugacauauu

SEQ ID NO: 1328689 - RNA, 18 nt, Homo sapiens
aaucugcuuguauuccaa

SEQ ID NO: 1328690 - RNA, 14 nt, Homo sapiens
aaucugugaugaca

SEQ ID NO: 1328691 - RNA, 17 nt, Homo sapiens
aaucuuauggggccgga

SEQ ID NO: 1328692 - RNA, 17 nt, Homo sapiens
aaucuuccuggcacaau

SEQ ID NO: 1328693 - RNA, 16 nt, Homo sapiens
aaucuucuuaugcaau

SEQ ID NO: 1328694 - RNA, 20 nt, Homo sapiens
aaucuuucugcagaaacaga

SEQ ID NO: 1328695 - RNA, 18 nt, Homo sapiens
aaugaaaauaacugaacc

SEQ ID NO: 1328696 - RNA, 13 nt, Homo sapiens
aaugaaacacagc

SEQ ID NO: 1328697 - RNA, 17 nt, Homo sapiens
aaugaaagaaaaugaga

SEQ ID NO: 1328698 - RNA, 12 nt, Homo sapiens
aaugaaagugau

SEQ ID NO: 1328699 - RNA, 14 nt, Homo sapiens
aaugacaaguauuu

SEQ ID NO: 1328700 - RNA, 23 nt, Homo sapiens
aaugacacuaaacuccaugauau

SEQ ID NO: 1328701 - RNA, 16 nt, Homo sapiens
aaugagaucauuguga

SEQ ID NO: 1328702 - RNA, 16 nt, Homo sapiens
aaugauagacaauuga

SEQ ID NO: 1328703 - RNA, 23 nt, Homo sapiens
aaugauauccaauauuaaaagau

SEQ ID NO: 1328704 - RNA, 20 nt, Homo sapiens
aaugauuuacuggaauuaca

SEQ ID NO: 1328705 - RNA, 18 nt, Homo sapiens
aaugauuucacagugugu

SEQ ID NO: 1328706 - RNA, 23 nt, Homo sapiens
aaugauuucaugcuaucucugug

SEQ ID NO: 1328707 - RNA, 16 nt, Homo sapiens
aaugcauguuaauggu

SEQ ID NO: 1328708 - RNA, 12 nt, Homo sapiens
aaugccaaaaaa

SEQ ID NO: 1328709 - RNA, 13 nt, Homo sapiens
aaugccagcauaa

SEQ ID NO: 1328710 - RNA, 13 nt, Homo sapiens
aaugcccagugag

SEQ ID NO: 1328711 - RNA, 14 nt, Homo sapiens
aauggaaauaccaa

SEQ ID NO: 1328712 - RNA, 20 nt, Homo sapiens
aauggaauuucucaguagca

SEQ ID NO: 1328713 - RNA, 12 nt, Homo sapiens
aauggagcucag

SEQ ID NO: 1328714 - RNA, 19 nt, Homo sapiens
aauggcagcuagugccuuu

SEQ ID NO: 1328715 - RNA, 18 nt, Homo sapiens
aauggcauggcaggaguc

SEQ ID NO: 1328716 - RNA, 15 nt, Homo sapiens
aaugggaaaaccaga

SEQ ID NO: 1328717 - RNA, 16 nt, Homo sapiens
aauggggaggacaaaa

SEQ ID NO: 1328718 - RNA, 16 nt, Homo sapiens
aaugguaauuguugcu

SEQ ID NO: 1328719 - RNA, 20 nt, Homo sapiens
aaugguaguuuuacaguguu

SEQ ID NO: 1328720 - RNA, 13 nt, Homo sapiens
aauggugcugcag

SEQ ID NO: 1328721 - RNA, 17 nt, Homo sapiens
aaugguuaaauuuuaca

SEQ ID NO: 1328722 - RNA, 17 nt, Homo sapiens
aaugguuucacaugguu

SEQ ID NO: 1328723 - RNA, 23 nt, Homo sapiens
aauguaagaucguucucugccuc

SEQ ID NO: 1328724 - RNA, 19 nt, Homo sapiens
aauguacauuuaauugcaa

SEQ ID NO: 1328725 - RNA, 17 nt, Homo sapiens
aauguaucaaauacauu

SEQ ID NO: 1328726 - RNA, 15 nt, Homo sapiens
aauguaugugcacau

SEQ ID NO: 1328727 - RNA, 13 nt, Homo sapiens
aauguccauuuau

SEQ ID NO: 1328728 - RNA, 14 nt, Homo sapiens
aaugucugcagcuc

SEQ ID NO: 1328729 - RNA, 20 nt, Homo sapiens
aaugugaaguucaucuugca

SEQ ID NO: 1328730 - RNA, 23 nt, Homo sapiens
aauguggaaggaaaauauuucau

SEQ ID NO: 1328731 - RNA, 15 nt, Homo sapiens
acaauaaagcaauaa

SEQ ID NO: 1328732 - RNA, 20 nt, Homo sapiens
acaauaaauuuuuuuugguc

SEQ ID NO: 1328733 - RNA, 16 nt, Homo sapiens
acaauaguucuguggg

SEQ ID NO: 1328734 - RNA, 14 nt, Homo sapiens
acaauauuaauuca

SEQ ID NO: 1328735 - RNA, 16 nt, Homo sapiens
acaauauugacuuugu

SEQ ID NO: 1328736 - RNA, 13 nt, Homo sapiens
acaauauugcucc

SEQ ID NO: 1328737 - RNA, 17 nt, Homo sapiens
acaaucagcccagugca

SEQ ID NO: 1328738 - RNA, 20 nt, Homo sapiens
acaauguccaaacccacuca

SEQ ID NO: 1328739 - RNA, 23 nt, Homo sapiens
acaauuaaaagugucuugagacu

SEQ ID NO: 1328740 - RNA, 15 nt, Homo sapiens
acaauuauuggcaaa

SEQ ID NO: 1328741 - RNA, 17 nt, Homo sapiens
acaauucaguaacaaag

SEQ ID NO: 1328742 - RNA, 23 nt, Homo sapiens
acaauucugugacauacauauua

SEQ ID NO: 1328743 - RNA, 19 nt, Homo sapiens
acaauugaacuuccaggaa

SEQ ID NO: 1328744 - RNA, 15 nt, Homo sapiens
acaauuuaaugcacu

SEQ ID NO: 1328745 - RNA, 17 nt, Homo sapiens
acacaaaccacaccaca

SEQ ID NO: 1328746 - RNA, 15 nt, Homo sapiens
acacaaacuggcuua

SEQ ID NO: 1328747 - RNA, 12 nt, Homo sapiens
acacaaagggaa

SEQ ID NO: 1328748 - RNA, 20 nt, Homo sapiens
acacacgcacacaaaccaca

SEQ ID NO: 1328749 - RNA, 14 nt, Homo sapiens
acacacuccgucca

SEQ ID NO: 1328750 - RNA, 9 nt, Homo sapiens
acacacugu

SEQ ID NO: 1328751 - RNA, 15 nt, Homo sapiens
acacagacugcgauu

SEQ ID NO: 1328752 - RNA, 20 nt, Homo sapiens
acacagaugucuuaaaagac

SEQ ID NO: 1328753 - RNA, 22 nt, Homo sapiens
acacagcaagggugaugggaaa

SEQ ID NO: 1328754 - RNA, 23 nt, Homo sapiens
acacagcugcccuagcugacccc

SEQ ID NO: 1328755 - RNA, 16 nt, Homo sapiens
acacaggcuguccuua

SEQ ID NO: 1328756 - RNA, 17 nt, Homo sapiens
acacagugcuauuugca

SEQ ID NO: 1328757 - RNA, 13 nt, Homo sapiens
acacaucaaauau

SEQ ID NO: 1328758 - RNA, 12 nt, Homo sapiens
acacaugugcac

SEQ ID NO: 1328759 - RNA, 11 nt, Homo sapiens
acacauuccau

SEQ ID NO: 1328760 - RNA, 18 nt, Homo sapiens
acacauuccaucuuacau

SEQ ID NO: 1328761 - RNA, 23 nt, Homo sapiens
acaccacaucuaagccugaaggg

SEQ ID NO: 1328762 - RNA, 17 nt, Homo sapiens
acacccaugccagagag

SEQ ID NO: 1328763 - RNA, 16 nt, Homo sapiens
acacccgugugcacac

SEQ ID NO: 1328764 - RNA, 22 nt, Homo sapiens
acacccuggccugaacugagga

SEQ ID NO: 1328765 - RNA, 23 nt, Homo sapiens
acaccucccccuuucacacugga

SEQ ID NO: 1328766 - RNA, 23 nt, Homo sapiens
acaccucgcuguugucacaucuc

SEQ ID NO: 1328767 - RNA, 20 nt, Homo sapiens
acaccucuccuuugugacuu

SEQ ID NO: 1328768 - RNA, 22 nt, Homo sapiens
acacuaacgaaauaucaaaguc

SEQ ID NO: 1328769 - RNA, 19 nt, Homo sapiens
acacucauccccucacuug

SEQ ID NO: 1328770 - RNA, 13 nt, Homo sapiens
acacucgccagcu

SEQ ID NO: 1328771 - RNA, 16 nt, Homo sapiens
acacugaccuguguuc

SEQ ID NO: 1328772 - RNA, 12 nt, Homo sapiens
acacugucaugc

SEQ ID NO: 1328773 - RNA, 19 nt, Homo sapiens
acacuguggccaggccuua

SEQ ID NO: 1328774 - RNA, 23 nt, Homo sapiens
acacuugguccauccauuuccaa

SEQ ID NO: 1328775 - RNA, 15 nt, Homo sapiens
acacuuuugcuugaa

SEQ ID NO: 1328776 - RNA, 20 nt, Homo sapiens
acagaaaccagaaaagcaau

SEQ ID NO: 1328777 - RNA, 20 nt, Homo sapiens
acagaaagccugggugacau

SEQ ID NO: 1328778 - RNA, 18 nt, Homo sapiens
acagaacaugcuguuauu

SEQ ID NO: 1328779 - RNA, 13 nt, Homo sapiens
acagacaacacug

SEQ ID NO: 1328780 - RNA, 20 nt, Homo sapiens
acagacacucccacuuggca

SEQ ID NO: 1328781 - RNA, 23 nt, Homo sapiens
acagacacucccacuuggcauca

SEQ ID NO: 1328782 - RNA, 23 nt, Homo sapiens
acauuucugauucugauugcuau

SEQ ID NO: 1328783 - RNA, 20 nt, Homo sapiens
acauuugacaaaacuaaccu

SEQ ID NO: 1328784 - RNA, 20 nt, Homo sapiens
acauuugggagacaugugac

SEQ ID NO: 1328785 - RNA, 23 nt, Homo sapiens
acauuuuuaaagguacacuggua

SEQ ID NO: 1328786 - RNA, 15 nt, Homo sapiens
acauuuuuugggcag

SEQ ID NO: 1328787 - RNA, 16 nt, Homo sapiens
accaaagacaucaguc

SEQ ID NO: 1328788 - RNA, 20 nt, Homo sapiens
accaaagacaucagucucca

SEQ ID NO: 1328789 - RNA, 17 nt, Homo sapiens
accaaaucugacauauu

SEQ ID NO: 1328790 - RNA, 15 nt, Homo sapiens
accaaccacagcauc

SEQ ID NO: 1328791 - RNA, 16 nt, Homo sapiens
accaaccgaaacugaa

SEQ ID NO: 1328792 - RNA, 23 nt, Homo sapiens
accaagccuuggcucuacccuga

SEQ ID NO: 1328793 - RNA, 15 nt, Homo sapiens
accaagcucacccuu

SEQ ID NO: 1328794 - RNA, 14 nt, Homo sapiens
accaagcucugucc

SEQ ID NO: 1328795 - RNA, 21 nt, Homo sapiens
accaaguuccuuggccaugca

SEQ ID NO: 1328796 - RNA, 16 nt, Homo sapiens
accaauaacuagcuuc

SEQ ID NO: 1328797 - RNA, 14 nt, Homo sapiens
accaaugccaaaag

SEQ ID NO: 1328798 - RNA, 19 nt, Homo sapiens
accaauucuggacagacag

SEQ ID NO: 1328799 - RNA, 21 nt, Homo sapiens
accacacgcccccacaggcuc

SEQ ID NO: 1328800 - RNA, 15 nt, Homo sapiens
accacagcaacugac

SEQ ID NO: 1328801 - RNA, 14 nt, Homo sapiens
accacagcacuauu

SEQ ID NO: 1328802 - RNA, 17 nt, Homo sapiens
accaccucugugggcac

SEQ ID NO: 1328803 - RNA, 21 nt, Homo sapiens
accacguccuuauuggaauaa

SEQ ID NO: 1328804 - RNA, 12 nt, Homo sapiens
accacucaggcc

SEQ ID NO: 1328805 - RNA, 22 nt, Homo sapiens
accacuccccaaccccucucca

SEQ ID NO: 1328806 - RNA, 16 nt, Homo sapiens
accagaauaaacccag

SEQ ID NO: 1328807 - RNA, 19 nt, Homo sapiens
accagacagacaacacugg

SEQ ID NO: 1328808 - RNA, 15 nt, Homo sapiens
accagagacuuuagg

SEQ ID NO: 1328809 - RNA, 20 nt, Homo sapiens
accagaguuucuugguugcu

SEQ ID NO: 1328810 - RNA, 13 nt, Homo sapiens
accagauuugcua

SEQ ID NO: 1328811 - RNA, 13 nt, Homo sapiens
accagcagcaugg

SEQ ID NO: 1328812 - RNA, 17 nt, Homo sapiens
accagccguauuuuaca

SEQ ID NO: 1328813 - RNA, 20 nt, Homo sapiens
accagccguauuuuacauga

SEQ ID NO: 1328814 - RNA, 21 nt, Homo sapiens
accagccguauuuuacaugaa

SEQ ID NO: 1328815 - RNA, 14 nt, Homo sapiens
accaggauuuccuu

SEQ ID NO: 1328816 - RNA, 15 nt, Homo sapiens
accaguauaagcauc

SEQ ID NO: 1328817 - RNA, 13 nt, Homo sapiens
accaguccaugag

SEQ ID NO: 1328818 - RNA, 17 nt, Homo sapiens
accaguggugcguuuau

SEQ ID NO: 1328819 - RNA, 19 nt, Homo sapiens
accaguguuccugaagcug

SEQ ID NO: 1328820 - RNA, 22 nt, Homo sapiens
accauaaaauaaauaaucucau

SEQ ID NO: 1328821 - RNA, 12 nt, Homo sapiens
accaucaugccc

SEQ ID NO: 1328822 - RNA, 17 nt, Homo sapiens
accaucucuuuaccucc

SEQ ID NO: 1328823 - RNA, 11 nt, Homo sapiens
accaugaaguc

SEQ ID NO: 1328824 - RNA, 21 nt, Homo sapiens
accaugcugcuggggaagaca

SEQ ID NO: 1328825 - RNA, 14 nt, Homo sapiens
accauguggccauu

SEQ ID NO: 1328826 - RNA, 14 nt, Homo sapiens
accauguugcccag

SEQ ID NO: 1328827 - RNA, 18 nt, Homo sapiens
accauuaggucacuuaag

SEQ ID NO: 1328828 - RNA, 21 nt, Homo sapiens
accauuuggucaggauuccug

SEQ ID NO: 1328829 - RNA, 11 nt, Homo sapiens
acccaaaacag

SEQ ID NO: 1328830 - RNA, 19 nt, Homo sapiens
acccaaguugaagacuuug

SEQ ID NO: 1328831 - RNA, 13 nt, Homo sapiens
acccacacaagcg

SEQ ID NO: 1328832 - RNA, 18 nt, Homo sapiens
acccaccccguagauucc

SEQ ID NO: 1328833 - RNA, 19 nt, Homo sapiens
auucauucugaacccucca

SEQ ID NO: 1328834 - RNA, 15 nt, Homo sapiens
auucauugugauuua

SEQ ID NO: 1328835 - RNA, 17 nt, Homo sapiens
auucauuguggucauag

SEQ ID NO: 1328836 - RNA, 15 nt, Homo sapiens
auuccacacccucac

SEQ ID NO: 1328837 - RNA, 14 nt, Homo sapiens
auuccaucuuacau

SEQ ID NO: 1328838 - RNA, 12 nt, Homo sapiens
auuccccaguga

SEQ ID NO: 1328839 - RNA, 23 nt, Homo sapiens
auuccccuguagcagucacugac

SEQ ID NO: 1328840 - RNA, 15 nt, Homo sapiens
auuccuagaaguuga

SEQ ID NO: 1328841 - RNA, 21 nt, Homo sapiens
auuccugauggaaaaugcaaa

SEQ ID NO: 1328842 - RNA, 16 nt, Homo sapiens
auucuaacaagucaua

SEQ ID NO: 1328843 - RNA, 23 nt, Homo sapiens
auucuaacccaagacaugacauu

SEQ ID NO: 1328844 - RNA, 16 nt, Homo sapiens
auucucaaaugcuggc

SEQ ID NO: 1328845 - RNA, 16 nt, Homo sapiens
auucuccugccuuagc

SEQ ID NO: 1328846 - RNA, 17 nt, Homo sapiens
auucucuuuuaucuguu

SEQ ID NO: 1328847 - RNA, 18 nt, Homo sapiens
auucugaaggccuuguua

SEQ ID NO: 1328848 - RNA, 13 nt, Homo sapiens
auucugguaggga

SEQ ID NO: 1328849 - RNA, 16 nt, Homo sapiens
auucuguaaaauuuaa

SEQ ID NO: 1328850 - RNA, 22 nt, Homo sapiens
auucugugcuguuacaguuuuc

SEQ ID NO: 1328851 - RNA, 17 nt, Homo sapiens
auucuuacauuuuacuu

SEQ ID NO: 1328852 - RNA, 12 nt, Homo sapiens
auucuucacucu

SEQ ID NO: 1328853 - RNA, 21 nt, Homo sapiens
auucuucagcguaaaauggug

SEQ ID NO: 1328854 - RNA, 20 nt, Homo sapiens
auucuucccucugaguuuga

SEQ ID NO: 1328855 - RNA, 14 nt, Homo sapiens
auucuucucucuca

SEQ ID NO: 1328856 - RNA, 20 nt, Homo sapiens
auucuugccuuguaccucaa

SEQ ID NO: 1328857 - RNA, 11 nt, Homo sapiens
auucuuggccc

SEQ ID NO: 1328858 - RNA, 14 nt, Homo sapiens
auucuuucaaguca

SEQ ID NO: 1328859 - RNA, 16 nt, Homo sapiens
auugaaagaaccagag

SEQ ID NO: 1328860 - RNA, 17 nt, Homo sapiens
auugaaagaaccagaga

SEQ ID NO: 1328861 - RNA, 22 nt, Homo sapiens
auugaaauaaagauaaaugcaa

SEQ ID NO: 1328862 - RNA, 14 nt, Homo sapiens
auugacaacacagc

SEQ ID NO: 1328863 - RNA, 17 nt, Homo sapiens
auugacccuagccagag

SEQ ID NO: 1328864 - RNA, 23 nt, Homo sapiens
auugaccuguccucuuugugaua

SEQ ID NO: 1328865 - RNA, 17 nt, Homo sapiens
auugaccuucagauucc

SEQ ID NO: 1328866 - RNA, 20 nt, Homo sapiens
auugagaaaaauauauacua

SEQ ID NO: 1328867 - RNA, 17 nt, Homo sapiens
auugaggaaauauuaau

SEQ ID NO: 1328868 - RNA, 12 nt, Homo sapiens
auugauauucaa

SEQ ID NO: 1328869 - RNA, 15 nt, Homo sapiens
auugauuacuaucau

SEQ ID NO: 1328870 - RNA, 19 nt, Homo sapiens
auugcacucuagccuggca

SEQ ID NO: 1328871 - RNA, 16 nt, Homo sapiens
auugcaggagucccug

SEQ ID NO: 1328872 - RNA, 19 nt, Homo sapiens
auugccacaaguccagcug

SEQ ID NO: 1328873 - RNA, 14 nt, Homo sapiens
auugcuagccagca

SEQ ID NO: 1328874 - RNA, 14 nt, Homo sapiens
auuggaagugcagu

SEQ ID NO: 1328875 - RNA, 15 nt, Homo sapiens
auuggauuuccuaau

SEQ ID NO: 1328876 - RNA, 22 nt, Homo sapiens
auuggcaccccuuucuaguuca

SEQ ID NO: 1328877 - RNA, 20 nt, Homo sapiens
auuggcaccuaauccaggca

SEQ ID NO: 1328878 - RNA, 21 nt, Homo sapiens
auuggcaccuaauccaggcag

SEQ ID NO: 1328879 - RNA, 15 nt, Homo sapiens
auugggaaaacucca

SEQ ID NO: 1328880 - RNA, 21 nt, Homo sapiens
auugggcuugugauuuccauu

SEQ ID NO: 1328881 - RNA, 14 nt, Homo sapiens
auuguaaaacccca

SEQ ID NO: 1328882 - RNA, 18 nt, Homo sapiens
auuguaaaaccccaucuc

SEQ ID NO: 1328883 - RNA, 18 nt, Homo sapiens
auuguauuuaagacauaa

SEQ ID NO: 1328884 - RNA, 21 nt, Homo sapiens
auuguauuuaccuucuaccuc

SEQ ID NO: 1328885 - RNA, 20 nt, Homo sapiens
auugucaacacaaacuggcu

SEQ ID NO: 1328886 - RNA, 10 nt, Homo sapiens
auugugaugu

SEQ ID NO: 1328887 - RNA, 15 nt, Homo sapiens
auugugauuuauuuc

SEQ ID NO: 1328888 - RNA, 20 nt, Homo sapiens
auuguuccaguacuauggag

SEQ ID NO: 1328889 - RNA, 21 nt, Homo sapiens
auuguuuuguggauaauugaa

SEQ ID NO: 1328890 - RNA, 21 nt, Homo sapiens
auuuaaaaugcucaauuucag

SEQ ID NO: 1328891 - RNA, 16 nt, Homo sapiens
auuuaaagaaaaccac

SEQ ID NO: 1328892 - RNA, 23 nt, Homo sapiens
auuuaaauguguacaauguacac

SEQ ID NO: 1328893 - RNA, 22 nt, Homo sapiens
auuuaaauguuaugacuaugua

SEQ ID NO: 1328894 - RNA, 14 nt, Homo sapiens
auuuaacuauucau

SEQ ID NO: 1328895 - RNA, 22 nt, Homo sapiens
auuuaacugauuaaaaauaccu

SEQ ID NO: 1328896 - RNA, 19 nt, Homo sapiens
auuuaauacagacaucuaa

SEQ ID NO: 1328897 - RNA, 15 nt, Homo sapiens
auuuacagcugugcu

SEQ ID NO: 1328898 - RNA, 17 nt, Homo sapiens
auuuaccuucuaccucu

SEQ ID NO: 1328899 - RNA, 23 nt, Homo sapiens
auuuagaagccaacuaugauuau

SEQ ID NO: 1328900 - RNA, 22 nt, Homo sapiens
auuuagaguagguauuaaucuu

SEQ ID NO: 1328901 - RNA, 19 nt, Homo sapiens
auuuaggagaagccaggaa

SEQ ID NO: 1328902 - RNA, 19 nt, Homo sapiens
auuuagucaacauauacua

SEQ ID NO: 1328903 - RNA, 17 nt, Homo sapiens
auuuaguuggaauauca

SEQ ID NO: 1328904 - RNA, 18 nt, Homo sapiens
auuuauacaccagcaauu

SEQ ID NO: 1328905 - RNA, 22 nt, Homo sapiens
auuuaucuauaauuuaccuaag

SEQ ID NO: 1328906 - RNA, 15 nt, Homo sapiens
auuuaucugaucaag

SEQ ID NO: 1328907 - RNA, 13 nt, Homo sapiens
auuuaugugaugg

SEQ ID NO: 1328908 - RNA, 12 nt, Homo sapiens
auuuaugugcac

SEQ ID NO: 1328909 - RNA, 19 nt, Homo sapiens
auuuauuaagcaguacaaa

SEQ ID NO: 1328910 - RNA, 22 nt, Homo sapiens
auuuauuccccagugacuccag

SEQ ID NO: 1328911 - RNA, 21 nt, Homo sapiens
auuuauugaaaugauuucaca

SEQ ID NO: 1328912 - RNA, 22 nt, Homo sapiens
auuuauuguuauauuacuugcc

SEQ ID NO: 1328913 - RNA, 14 nt, Homo sapiens
auuuauuuauucau

SEQ ID NO: 1328914 - RNA, 21 nt, Homo sapiens
auuuauuucuuucuauucuug

SEQ ID NO: 1328915 - RNA, 13 nt, Homo sapiens
auuucaacugaag

SEQ ID NO: 1328916 - RNA, 16 nt, Homo sapiens
auuucaauacuuacau

SEQ ID NO: 1328917 - RNA, 14 nt, Homo sapiens
auuucaauuccugu

SEQ ID NO: 1328918 - RNA, 18 nt, Homo sapiens
auuucagauauuccaggu

SEQ ID NO: 1328919 - RNA, 22 nt, Homo sapiens
auuucagggucuuggcugccug

SEQ ID NO: 1328920 - RNA, 16 nt, Homo sapiens
auuucaguagugguga

SEQ ID NO: 1328921 - RNA, 18 nt, Homo sapiens
auuucauaccuaucaucu

SEQ ID NO: 1328922 - RNA, 20 nt, Homo sapiens
auuucauaccuaucaucuua

SEQ ID NO: 1328923 - RNA, 13 nt, Homo sapiens
auuucaucaugau

SEQ ID NO: 1328924 - RNA, 13 nt, Homo sapiens
auuucaugaagca

SEQ ID NO: 1328925 - RNA, 22 nt, Homo sapiens
auuucauugcucagaaauguca

SEQ ID NO: 1328926 - RNA, 22 nt, Homo sapiens
auuuccaaaccuccacugcugc

SEQ ID NO: 1328927 - RNA, 19 nt, Homo sapiens
auuuccauaccauugugga

SEQ ID NO: 1328928 - RNA, 17 nt, Homo sapiens
auuuccuuguccugcuu

SEQ ID NO: 1328929 - RNA, 11 nt, Homo sapiens
auuucuaaucc

SEQ ID NO: 1328930 - RNA, 14 nt, Homo sapiens
auuucuacacugag

SEQ ID NO: 1328931 - RNA, 21 nt, Homo sapiens
auuucuacauuacagccauau

SEQ ID NO: 1328932 - RNA, 13 nt, Homo sapiens
auuucuauacagu

SEQ ID NO: 1328933 - RNA, 13 nt, Homo sapiens
auuucugccaaua

SEQ ID NO: 1328934 - RNA, 17 nt, Homo sapiens
auuucuggggggagaaa

SEQ ID NO: 1328935 - RNA, 18 nt, Homo sapiens
auuucuuuuuugccaaau

SEQ ID NO: 1328936 - RNA, 22 nt, Homo sapiens
auuugaaaaaaacuucauucuc

SEQ ID NO: 1328937 - RNA, 23 nt, Homo sapiens
auuugaaaaaaacuucauucucg

SEQ ID NO: 1328938 - RNA, 17 nt, Homo sapiens
auuugaaaccaggacau

SEQ ID NO: 1328939 - RNA, 21 nt, Homo sapiens
auuugcauugaggaaauauua

SEQ ID NO: 1328940 - RNA, 23 nt, Homo sapiens
auuugcauugaggaaauauuaau

SEQ ID NO: 1328941 - RNA, 18 nt, Homo sapiens
auuugccaggggcaucca

SEQ ID NO: 1328942 - RNA, 19 nt, Homo sapiens
auuugccuccagugcaguc

SEQ ID NO: 1328943 - RNA, 13 nt, Homo sapiens
auuugcuaugagc

SEQ ID NO: 1328944 - RNA, 20 nt, Homo sapiens
auuugcuuuggaaguuuuaa

SEQ ID NO: 1328945 - RNA, 14 nt, Homo sapiens
auuuggaauacaca

SEQ ID NO: 1328946 - RNA, 17 nt, Homo sapiens
auuugggagacauguga

SEQ ID NO: 1328947 - RNA, 20 nt, Homo sapiens
auuugggccugcuccagacc

SEQ ID NO: 1328948 - RNA, 18 nt, Homo sapiens
auuuguuuaaacaaucuu

SEQ ID NO: 1328949 - RNA, 20 nt, Homo sapiens
auuuguuuuuauuugguucu

SEQ ID NO: 1328950 - RNA, 18 nt, Homo sapiens
auuuuaaauuccacugaa

SEQ ID NO: 1328951 - RNA, 14 nt, Homo sapiens
auuuuacaaguaua

SEQ ID NO: 1328952 - RNA, 16 nt, Homo sapiens
auuuuacaugacagau

SEQ ID NO: 1328953 - RNA, 14 nt, Homo sapiens
auuuuacuuaacuc

SEQ ID NO: 1328954 - RNA, 19 nt, Homo sapiens
auuuuagaaacuacaaaua

SEQ ID NO: 1328955 - RNA, 18 nt, Homo sapiens
auuuuagaaugucaauaa

SEQ ID NO: 1328956 - RNA, 18 nt, Homo sapiens
auuuuauuuuucucauga

SEQ ID NO: 1328957 - RNA, 16 nt, Homo sapiens
auuuucacaucaaaga

SEQ ID NO: 1328958 - RNA, 20 nt, Homo sapiens
auuuucauucaucauguuca

SEQ ID NO: 1328959 - RNA, 18 nt, Homo sapiens
auuuuccaaugcacaguu

SEQ ID NO: 1328960 - RNA, 18 nt, Homo sapiens
auuuuccaggacuguuuc

SEQ ID NO: 1328961 - RNA, 22 nt, Homo sapiens
auuuucuuaccucucaguuguu

SEQ ID NO: 1328962 - RNA, 21 nt, Homo sapiens
auuuucuuguauauuuugcua

SEQ ID NO: 1328963 - RNA, 16 nt, Homo sapiens
auuuucuuucacuuaa

SEQ ID NO: 1328964 - RNA, 15 nt, Homo sapiens
auuuugaagugcugu

SEQ ID NO: 1328965 - RNA, 13 nt, Homo sapiens
auuuugcaaaaau

SEQ ID NO: 1328966 - RNA, 17 nt, Homo sapiens
auuuugguuuguguauc

SEQ ID NO: 1328967 - RNA, 16 nt, Homo sapiens
cucaucugggggagug

SEQ ID NO: 1328968 - RNA, 21 nt, Homo sapiens
cucaucuguggagcugccaca

SEQ ID NO: 1328969 - RNA, 15 nt, Homo sapiens
cucaugacugcauga

SEQ ID NO: 1328970 - RNA, 16 nt, Homo sapiens
cucauuccaccuuccc

SEQ ID NO: 1328971 - RNA, 15 nt, Homo sapiens
cucauuccagaggaa

SEQ ID NO: 1328972 - RNA, 18 nt, Homo sapiens
cucauucccaacgugcaa

SEQ ID NO: 1328973 - RNA, 23 nt, Homo sapiens
cucauucugguucccugcugcgc

SEQ ID NO: 1328974 - RNA, 21 nt, Homo sapiens
cucauuuugugaugugucaca

SEQ ID NO: 1328975 - RNA, 17 nt, Homo sapiens
cuccaaaccuccagccu

SEQ ID NO: 1328976 - RNA, 18 nt, Homo sapiens
cuccaaaggcucagauua

SEQ ID NO: 1328977 - RNA, 15 nt, Homo sapiens
cuccaacacuuugag

SEQ ID NO: 1328978 - RNA, 22 nt, Homo sapiens
cuccaagaauggaggcuguagg

SEQ ID NO: 1328979 - RNA, 20 nt, Homo sapiens
cuccacaaaugggaaaacca

SEQ ID NO: 1328980 - RNA, 12 nt, Homo sapiens
cuccacagggca

SEQ ID NO: 1328981 - RNA, 23 nt, Homo sapiens
cuccacauggaagcccaacuggg

SEQ ID NO: 1328982 - RNA, 16 nt, Homo sapiens
cuccacugccuucgau

SEQ ID NO: 1328983 - RNA, 12 nt, Homo sapiens
cuccacugcugc

SEQ ID NO: 1328984 - RNA, 21 nt, Homo sapiens
cuccacuggaggggucuccuc

SEQ ID NO: 1328985 - RNA, 19 nt, Homo sapiens
cuccagaagaugccagcuu

SEQ ID NO: 1328986 - RNA, 17 nt, Homo sapiens
cuccagaccugauccug

SEQ ID NO: 1328987 - RNA, 14 nt, Homo sapiens
cuccauaccugccc

SEQ ID NO: 1328988 - RNA, 21 nt, Homo sapiens
cuccaucaauaaauguugcaa

SEQ ID NO: 1328989 - RNA, 11 nt, Homo sapiens
cuccaucucau

SEQ ID NO: 1328990 - RNA, 14 nt, Homo sapiens
cuccaucucugucu

SEQ ID NO: 1328991 - RNA, 18 nt, Homo sapiens
cuccaucucuucugcaag

SEQ ID NO: 1328992 - RNA, 15 nt, Homo sapiens
cuccaugaugacuua

SEQ ID NO: 1328993 - RNA, 14 nt, Homo sapiens
cuccauguuugaug

SEQ ID NO: 1328994 - RNA, 16 nt, Homo sapiens
cuccauguuugaugua

SEQ ID NO: 1328995 - RNA, 14 nt, Homo sapiens
cuccauuacucuau

SEQ ID NO: 1328996 - RNA, 22 nt, Homo sapiens
cuccauugguguugacauacau

SEQ ID NO: 1328997 - RNA, 17 nt, Homo sapiens
cuccauuucuuucuucc

SEQ ID NO: 1328998 - RNA, 18 nt, Homo sapiens
cuccauuucuuucuucca

SEQ ID NO: 1328999 - RNA, 20 nt, Homo sapiens
cucccaaagugcugggauua

SEQ ID NO: 1329000 - RNA, 12 nt, Homo sapiens
cucccacagaac

SEQ ID NO: 1329001 - RNA, 14 nt, Homo sapiens
cucccagugacaac

SEQ ID NO: 1329002 - RNA, 13 nt, Homo sapiens
cucccagugcuug

SEQ ID NO: 1329003 - RNA, 12 nt, Homo sapiens
cucccauagcaa

SEQ ID NO: 1329004 - RNA, 16 nt, Homo sapiens
cuccccaaggcugcaa

SEQ ID NO: 1329005 - RNA, 17 nt, Homo sapiens
cuccccagcccagagac

SEQ ID NO: 1329006 - RNA, 17 nt, Homo sapiens
cucccuaggcugcccac

SEQ ID NO: 1329007 - RNA, 18 nt, Homo sapiens
cucccuccagacaaugcc

SEQ ID NO: 1329008 - RNA, 15 nt, Homo sapiens
cucccuccagauaua

SEQ ID NO: 1329009 - RNA, 18 nt, Homo sapiens
cucccuccagauauacuu

SEQ ID NO: 1329010 - RNA, 21 nt, Homo sapiens
cucccugaagccuuugcauuu

SEQ ID NO: 1329011 - RNA, 17 nt, Homo sapiens
cucccugggucugggga

SEQ ID NO: 1329012 - RNA, 23 nt, Homo sapiens
cucccugggucuggggacaggcc

SEQ ID NO: 1329013 - RNA, 17 nt, Homo sapiens
cucccuuaaucugccag

SEQ ID NO: 1329014 - RNA, 23 nt, Homo sapiens
cuccgaugcccgcccggggaguu

SEQ ID NO: 1329015 - RNA, 15 nt, Homo sapiens
cuccgcgccuacccu

SEQ ID NO: 1329016 - RNA, 21 nt, Homo sapiens
cuccguagcucugcugcugau

SEQ ID NO: 1329017 - RNA, 16 nt, Homo sapiens
cuccuaaagcuuuuau

SEQ ID NO: 1329018 - RNA, 12 nt, Homo sapiens
cuccuacuguag

SEQ ID NO: 1329019 - RNA, 20 nt, Homo sapiens
cuccucccaaggcauucucc

SEQ ID NO: 1329020 - RNA, 21 nt, Homo sapiens
cuccucccaggaacugggcca

SEQ ID NO: 1329021 - RNA, 14 nt, Homo sapiens
cuccuccucuccag

SEQ ID NO: 1329022 - RNA, 19 nt, Homo sapiens
cuccuccuuuuuccuucca

SEQ ID NO: 1329023 - RNA, 22 nt, Homo sapiens
cuccucuccagcccugcagcua

SEQ ID NO: 1329024 - RNA, 12 nt, Homo sapiens
cuccucugcacu

SEQ ID NO: 1329025 - RNA, 20 nt, Homo sapiens
cuccugaccucaagugaucu

SEQ ID NO: 1329026 - RNA, 23 nt, Homo sapiens
cuccugaccucaagugaucuguc

SEQ ID NO: 1329027 - RNA, 19 nt, Homo sapiens
cuccugaccuuggguccug

SEQ ID NO: 1329028 - RNA, 13 nt, Homo sapiens
cuccugacuuuua

SEQ ID NO: 1329029 - RNA, 21 nt, Homo sapiens
cuccugcacacagggcagucc

SEQ ID NO: 1329030 - RNA, 14 nt, Homo sapiens
cuccugcaucucau

SEQ ID NO: 1329031 - RNA, 17 nt, Homo sapiens
cuccugccaccagcauc

SEQ ID NO: 1329032 - RNA, 19 nt, Homo sapiens
cuccuggguucaagcaauc

SEQ ID NO: 1329033 - RNA, 14 nt, Homo sapiens
cuccuguaccucag

SEQ ID NO: 1329034 - RNA, 21 nt, Homo sapiens
cuccuguggucucugaccagg

SEQ ID NO: 1329035 - RNA, 22 nt, Homo sapiens
cuccuucccauuucucuacacu

SEQ ID NO: 1329036 - RNA, 15 nt, Homo sapiens
cuccuuggccacaga

SEQ ID NO: 1329037 - RNA, 13 nt, Homo sapiens
cuccuuggcuuua

SEQ ID NO: 1329038 - RNA, 18 nt, Homo sapiens
cuccuuggcuuuaugcaa

SEQ ID NO: 1329039 - RNA, 17 nt, Homo sapiens
cuccuugucccccguga

SEQ ID NO: 1329040 - RNA, 19 nt, Homo sapiens
cuccuuguggccuaugaaa

SEQ ID NO: 1329041 - RNA, 18 nt, Homo sapiens
cuccuuugaagaaggcaa

SEQ ID NO: 1329042 - RNA, 18 nt, Homo sapiens
cuccuuuggaauggugua

SEQ ID NO: 1329043 - RNA, 14 nt, Homo sapiens
cuccuuuugaggcu

SEQ ID NO: 1329044 - RNA, 16 nt, Homo sapiens
cuccuuuuuccuucca

SEQ ID NO: 1329045 - RNA, 14 nt, Homo sapiens
cucgagauguaucc

SEQ ID NO: 1329046 - RNA, 12 nt, Homo sapiens
cucgagcacuga

SEQ ID NO: 1329047 - RNA, 12 nt, Homo sapiens
cucggaugacac

SEQ ID NO: 1329048 - RNA, 21 nt, Homo sapiens
cucgggaaacuuagaucauca

SEQ ID NO: 1329049 - RNA, 17 nt, Homo sapiens
cucuaaugucugcagcu

SEQ ID NO: 1329050 - RNA, 12 nt, Homo sapiens
cucuacccagua

SEQ ID NO: 1329051 - RNA, 19 nt, Homo sapiens
cucucacacuuuugcuuga

SEQ ID NO: 1329052 - RNA, 13 nt, Homo sapiens
cucucacccucau

SEQ ID NO: 1329053 - RNA, 22 nt, Homo sapiens
cucucauguuuucaacugccaa

SEQ ID NO: 1329054 - RNA, 20 nt, Homo sapiens
cucuccacauggaagcccaa

SEQ ID NO: 1329055 - RNA, 12 nt, Homo sapiens
cucucccaguga

SEQ ID NO: 1329056 - RNA, 16 nt, Homo sapiens
cucucccagugacaac

SEQ ID NO: 1329057 - RNA, 13 nt, Homo sapiens
cucucccuaggcu

SEQ ID NO: 1329058 - RNA, 13 nt, Homo sapiens
cucuccugccuca

SEQ ID NO: 1329059 - RNA, 23 nt, Homo sapiens
cucucgcaagggaaguccuugca

SEQ ID NO: 1329060 - RNA, 13 nt, Homo sapiens
cucucuaauucag

SEQ ID NO: 1329061 - RNA, 14 nt, Homo sapiens
cucucuaauucagu

SEQ ID NO: 1329062 - RNA, 18 nt, Homo sapiens
cucucuauagcaccaggg

SEQ ID NO: 1329063 - RNA, 13 nt, Homo sapiens
cucucucaugaua

SEQ ID NO: 1329064 - RNA, 9 nt, Homo sapiens
cucucucug

SEQ ID NO: 1329065 - RNA, 13 nt, Homo sapiens
cucucucugaggg

SEQ ID NO: 1329066 - RNA, 18 nt, Homo sapiens
cucucugagucaaaucca

SEQ ID NO: 1329067 - RNA, 20 nt, Homo sapiens
cucugaaugaaccuucuggc

SEQ ID NO: 1329068 - RNA, 12 nt, Homo sapiens
cucugacagucc

SEQ ID NO: 1329069 - RNA, 14 nt, Homo sapiens
cugcuggaugugag

SEQ ID NO: 1329070 - RNA, 20 nt, Homo sapiens
cugcuggaugugaguuucca

SEQ ID NO: 1329071 - RNA, 16 nt, Homo sapiens
cugcuggcugcucccc

SEQ ID NO: 1329072 - RNA, 19 nt, Homo sapiens
cugcuggggaagacagugg

SEQ ID NO: 1329073 - RNA, 15 nt, Homo sapiens
cugcugguaccugcc

SEQ ID NO: 1329074 - RNA, 16 nt, Homo sapiens
cugcuguaugugagcu

SEQ ID NO: 1329075 - RNA, 21 nt, Homo sapiens
cugcuuuggauagucuccuac

SEQ ID NO: 1329076 - RNA, 17 nt, Homo sapiens
cugcuuuucccauugcc

SEQ ID NO: 1329077 - RNA, 14 nt, Homo sapiens
cuggaaaugcugac

SEQ ID NO: 1329078 - RNA, 21 nt, Homo sapiens
cuggaaauugaaauaaagaua

SEQ ID NO: 1329079 - RNA, 18 nt, Homo sapiens
cuggaacguuucacugca

SEQ ID NO: 1329080 - RNA, 20 nt, Homo sapiens
cuggaauccagaaggaagcu

SEQ ID NO: 1329081 - RNA, 15 nt, Homo sapiens
cuggaccacugggca

SEQ ID NO: 1329082 - RNA, 22 nt, Homo sapiens
cuggagcaauaaaagacaaaug

SEQ ID NO: 1329083 - RNA, 22 nt, Homo sapiens
cuggagcaggcccaaugcugcu

SEQ ID NO: 1329084 - RNA, 19 nt, Homo sapiens
cuggagggaagcacugccu

SEQ ID NO: 1329085 - RNA, 20 nt, Homo sapiens
cuggagugcaauggcgcgau

SEQ ID NO: 1329086 - RNA, 18 nt, Homo sapiens
cuggaguggccacuaagc

SEQ ID NO: 1329087 - RNA, 14 nt, Homo sapiens
cuggcaacaugaag

SEQ ID NO: 1329088 - RNA, 18 nt, Homo sapiens
cuggcagggccaccugca

SEQ ID NO: 1329089 - RNA, 15 nt, Homo sapiens
cuggcccugccguuu

SEQ ID NO: 1329090 - RNA, 16 nt, Homo sapiens
cuggcccuuaagccaa

SEQ ID NO: 1329091 - RNA, 16 nt, Homo sapiens
cuggcccuuggggaga

SEQ ID NO: 1329092 - RNA, 16 nt, Homo sapiens
cuggccugccaugcca

SEQ ID NO: 1329093 - RNA, 17 nt, Homo sapiens
cuggccuguacccagua

SEQ ID NO: 1329094 - RNA, 16 nt, Homo sapiens
cuggcgacugccccug

SEQ ID NO: 1329095 - RNA, 20 nt, Homo sapiens
cuggcucacuggcaggugug

SEQ ID NO: 1329096 - RNA, 13 nt, Homo sapiens
cuggcucccaugu

SEQ ID NO: 1329097 - RNA, 14 nt, Homo sapiens
cuggcuuggaacac

SEQ ID NO: 1329098 - RNA, 18 nt, Homo sapiens
cugggaacacaucuggcu

SEQ ID NO: 1329099 - RNA, 16 nt, Homo sapiens
cugggaaccacuccca

SEQ ID NO: 1329100 - RNA, 22 nt, Homo sapiens
cugggagcagcucugugacucc

SEQ ID NO: 1329101 - RNA, 13 nt, Homo sapiens
cuuccgaaaacca

SEQ ID NO: 1329102 - RNA, 14 nt, Homo sapiens
cuuccuaggucaug

SEQ ID NO: 1329103 - RNA, 14 nt, Homo sapiens
cuuccuccacuuca

SEQ ID NO: 1329104 - RNA, 15 nt, Homo sapiens
cuuccuggcuguaaa

SEQ ID NO: 1329105 - RNA, 17 nt, Homo sapiens
cuuccuuuuaacugcca

SEQ ID NO: 1329106 - RNA, 18 nt, Homo sapiens
cuuccuuuuaacugccaa

SEQ ID NO: 1329107 - RNA, 21 nt, Homo sapiens
cuucgcgcuggaauccagaag

SEQ ID NO: 1329108 - RNA, 13 nt, Homo sapiens
cuucggauaugau

SEQ ID NO: 1329109 - RNA, 21 nt, Homo sapiens
cuucgugaugacauaucacau

SEQ ID NO: 1329110 - RNA, 18 nt, Homo sapiens
cuucuagcgucagugcug

SEQ ID NO: 1329111 - RNA, 20 nt, Homo sapiens
cuucuaguuucucuuagaaa

SEQ ID NO: 1329112 - RNA, 22 nt, Homo sapiens
cuucuauagugaugaugaucuc

SEQ ID NO: 1329113 - RNA, 18 nt, Homo sapiens
cuucuauuccauggcuaa

SEQ ID NO: 1329114 - RNA, 22 nt, Homo sapiens
cuucuauuccauggcuaacugg

SEQ ID NO: 1329115 - RNA, 11 nt, Homo sapiens
cuucucaggaa

SEQ ID NO: 1329116 - RNA, 14 nt, Homo sapiens
cuucucuccagcug

SEQ ID NO: 1329117 - RNA, 19 nt, Homo sapiens
cuucucuccagcugacuaa

SEQ ID NO: 1329118 - RNA, 20 nt, Homo sapiens
cuucucugcaguaaaacaca

SEQ ID NO: 1329119 - RNA, 13 nt, Homo sapiens
cuucucuugucau

SEQ ID NO: 1329120 - RNA, 17 nt, Homo sapiens
cuucugagcagaaaugg

SEQ ID NO: 1329121 - RNA, 21 nt, Homo sapiens
cuucugagccugccuuucucc

SEQ ID NO: 1329122 - RNA, 22 nt, Homo sapiens
cuucuggccucccacagacuca

SEQ ID NO: 1329123 - RNA, 15 nt, Homo sapiens
cuucuggggguggug

SEQ ID NO: 1329124 - RNA, 16 nt, Homo sapiens
cuucuuuuugcuucaa

SEQ ID NO: 1329125 - RNA, 17 nt, Homo sapiens
cuucuuuuugcuucaaa

SEQ ID NO: 1329126 - RNA, 21 nt, Homo sapiens
cuugaaacagauucaggccag

SEQ ID NO: 1329127 - RNA, 16 nt, Homo sapiens
cuugaaacugagaugu

SEQ ID NO: 1329128 - RNA, 14 nt, Homo sapiens
cuugaaaguuuucc

SEQ ID NO: 1329129 - RNA, 23 nt, Homo sapiens
cuugaaauuuggcuaauaacaaa

SEQ ID NO: 1329130 - RNA, 18 nt, Homo sapiens
cuugaagaauaaauucua

SEQ ID NO: 1329131 - RNA, 18 nt, Homo sapiens
cuugaagggccagagcca

SEQ ID NO: 1329132 - RNA, 14 nt, Homo sapiens
cuugaagguggcua

SEQ ID NO: 1329133 - RNA, 15 nt, Homo sapiens
cuugaaguaugccuu

SEQ ID NO: 1329134 - RNA, 14 nt, Homo sapiens
cuugaauuuaauac

SEQ ID NO: 1329135 - RNA, 13 nt, Homo sapiens
cuugacucuuaca

SEQ ID NO: 1329136 - RNA, 15 nt, Homo sapiens
cuugaggugaaaugg

SEQ ID NO: 1329137 - RNA, 17 nt, Homo sapiens
cuugaucucucuugucc

SEQ ID NO: 1329138 - RNA, 20 nt, Homo sapiens
cuugauuacuuccacugagg

SEQ ID NO: 1329139 - RNA, 14 nt, Homo sapiens
cuugcaaucuaauc

SEQ ID NO: 1329140 - RNA, 20 nt, Homo sapiens
cuugcaccacuuccguccca

SEQ ID NO: 1329141 - RNA, 21 nt, Homo sapiens
cuugcagaaggcaaggcccug

SEQ ID NO: 1329142 - RNA, 22 nt, Homo sapiens
cuugcagcggcuccugcaaaag

SEQ ID NO: 1329143 - RNA, 17 nt, Homo sapiens
cuugcauaggcucuuaa

SEQ ID NO: 1329144 - RNA, 13 nt, Homo sapiens
cuugccacagugu

SEQ ID NO: 1329145 - RNA, 12 nt, Homo sapiens
cuugccagagau

SEQ ID NO: 1329146 - RNA, 18 nt, Homo sapiens
cuugccuaucugacuuca

SEQ ID NO: 1329147 - RNA, 19 nt, Homo sapiens
cuugccuaugauacugucu

SEQ ID NO: 1329148 - RNA, 18 nt, Homo sapiens
cuugccugcuccaucuca

SEQ ID NO: 1329149 - RNA, 12 nt, Homo sapiens
cuugcucugcau

SEQ ID NO: 1329150 - RNA, 21 nt, Homo sapiens
cuugcugauggugacauugca

SEQ ID NO: 1329151 - RNA, 22 nt, Homo sapiens
cuugcugauggugacauugcac

SEQ ID NO: 1329152 - RNA, 16 nt, Homo sapiens
cuugcuuuccugcauc

SEQ ID NO: 1329153 - RNA, 16 nt, Homo sapiens
cuuggaaaaacaggaa

SEQ ID NO: 1329154 - RNA, 21 nt, Homo sapiens
cuuggaaauuggaagagcaca

SEQ ID NO: 1329155 - RNA, 21 nt, Homo sapiens
cuuggagaaugugagaagcca

SEQ ID NO: 1329156 - RNA, 14 nt, Homo sapiens
cuuggagauuuauc

SEQ ID NO: 1329157 - RNA, 16 nt, Homo sapiens
cuuggcaccagacacc

SEQ ID NO: 1329158 - RNA, 21 nt, Homo sapiens
cuuggcaccagacacccagga

SEQ ID NO: 1329159 - RNA, 19 nt, Homo sapiens
cuuggcuuuaugcaaauac

SEQ ID NO: 1329160 - RNA, 21 nt, Homo sapiens
cuuggcuuuaugcaaauacaa

SEQ ID NO: 1329161 - RNA, 17 nt, Homo sapiens
cuugggacauugcaauu

SEQ ID NO: 1329162 - RNA, 19 nt, Homo sapiens
cuugggauagcaaacucca

SEQ ID NO: 1329163 - RNA, 17 nt, Homo sapiens
cuuggggaaauggggcu

SEQ ID NO: 1329164 - RNA, 17 nt, Homo sapiens
cuuggguucaagugauu

SEQ ID NO: 1329165 - RNA, 18 nt, Homo sapiens
cuuggugacaaaauucau

SEQ ID NO: 1329166 - RNA, 15 nt, Homo sapiens
cuuguaacuaaaaua

SEQ ID NO: 1329167 - RNA, 18 nt, Homo sapiens
cuuguauagcaugaaaua

SEQ ID NO: 1329168 - RNA, 18 nt, Homo sapiens
cuuguccuuucucucuaa

SEQ ID NO: 1329169 - RNA, 13 nt, Homo sapiens
cuuguuagcuguu

SEQ ID NO: 1329170 - RNA, 11 nt, Homo sapiens
cuuuaaaccac

SEQ ID NO: 1329171 - RNA, 14 nt, Homo sapiens
cuuuaaaccaccua

SEQ ID NO: 1329172 - RNA, 20 nt, Homo sapiens
cuuuacuccguaacagauuu

SEQ ID NO: 1329173 - RNA, 14 nt, Homo sapiens
cuuuacuccuggcu

SEQ ID NO: 1329174 - RNA, 13 nt, Homo sapiens
cuuuacuucccag

SEQ ID NO: 1329175 - RNA, 17 nt, Homo sapiens
cuuuagcaaaacuggac

SEQ ID NO: 1329176 - RNA, 16 nt, Homo sapiens
cuuuauagcacauggc

SEQ ID NO: 1329177 - RNA, 21 nt, Homo sapiens
cuuuaugcaaauacaaucagc

SEQ ID NO: 1329178 - RNA, 13 nt, Homo sapiens
cuuuauugccaaa

SEQ ID NO: 1329179 - RNA, 14 nt, Homo sapiens
cuuucaaaagccuu

SEQ ID NO: 1329180 - RNA, 17 nt, Homo sapiens
cuuucauaaagucuugc

SEQ ID NO: 1329181 - RNA, 19 nt, Homo sapiens
cuuucauaaagucuugccu

SEQ ID NO: 1329182 - RNA, 22 nt, Homo sapiens
cuuucauuggacccugacugua

SEQ ID NO: 1329183 - RNA, 13 nt, Homo sapiens
cuuucccuaccuu

SEQ ID NO: 1329184 - RNA, 13 nt, Homo sapiens
cuuuccuguucca

SEQ ID NO: 1329185 - RNA, 16 nt, Homo sapiens
cuuucgucuacugcaa

SEQ ID NO: 1329186 - RNA, 18 nt, Homo sapiens
cuuucuaagcaaccacac

SEQ ID NO: 1329187 - RNA, 14 nt, Homo sapiens
cuuucuaaugcuga

SEQ ID NO: 1329188 - RNA, 16 nt, Homo sapiens
cuuucucucuaauuca

SEQ ID NO: 1329189 - RNA, 15 nt, Homo sapiens
cuuucuuauuuugua

SEQ ID NO: 1329190 - RNA, 18 nt, Homo sapiens
cuuucuuauuuuguaaua

SEQ ID NO: 1329191 - RNA, 20 nt, Homo sapiens
cuuucuuuccaaaacauuuc

SEQ ID NO: 1329192 - RNA, 22 nt, Homo sapiens
cuuugaauauguaguaucuaua

SEQ ID NO: 1329193 - RNA, 18 nt, Homo sapiens
cuuugaguuuuguauuca

SEQ ID NO: 1329194 - RNA, 15 nt, Homo sapiens
cuuugcaccaaagac

SEQ ID NO: 1329195 - RNA, 14 nt, Homo sapiens
cuuugcagcacagc

SEQ ID NO: 1329196 - RNA, 23 nt, Homo sapiens
cuuugccucuucuuugugccuuu

SEQ ID NO: 1329197 - RNA, 11 nt, Homo sapiens
cuuugcugcug

SEQ ID NO: 1329198 - RNA, 18 nt, Homo sapiens
cuuuggaagauggcauaa

SEQ ID NO: 1329199 - RNA, 15 nt, Homo sapiens
cuuuggaauggugua

SEQ ID NO: 1329200 - RNA, 20 nt, Homo sapiens
cuuugggccagacaugccac

SEQ ID NO: 1329201 - RNA, 22 nt, Homo sapiens
cuuugucauucaguucuaggcc

SEQ ID NO: 1329202 - RNA, 21 nt, Homo sapiens
cuuuguccacugucaggguug

SEQ ID NO: 1329203 - RNA, 15 nt, Homo sapiens
cuuugucugugggaa

SEQ ID NO: 1329204 - RNA, 21 nt, Homo sapiens
cuuugucugugggaaggcaaa

SEQ ID NO: 1329205 - RNA, 18 nt, Homo sapiens
cuuuuaaaacacuuccau

SEQ ID NO: 1329206 - RNA, 22 nt, Homo sapiens
cuuuuaaacugauuacguuuac

SEQ ID NO: 1329207 - RNA, 20 nt, Homo sapiens
gugaccucugacaacuguga

SEQ ID NO: 1329208 - RNA, 14 nt, Homo sapiens
gugacgcugcugac

SEQ ID NO: 1329209 - RNA, 13 nt, Homo sapiens
gugacuagugcug

SEQ ID NO: 1329210 - RNA, 14 nt, Homo sapiens
gugagaccuggcag

SEQ ID NO: 1329211 - RNA, 22 nt, Homo sapiens
gugagacuagacauaguaccga

SEQ ID NO: 1329212 - RNA, 23 nt, Homo sapiens
gugagagaaagagagaagccagc

SEQ ID NO: 1329213 - RNA, 11 nt, Homo sapiens
gugagcacaaa

SEQ ID NO: 1329214 - RNA, 16 nt, Homo sapiens
gugagcauggggccag

SEQ ID NO: 1329215 - RNA, 13 nt, Homo sapiens
gugagucaccugc

SEQ ID NO: 1329216 - RNA, 12 nt, Homo sapiens
gugagugcaagg

SEQ ID NO: 1329217 - RNA, 19 nt, Homo sapiens
gugaguuuaccuuguauac

SEQ ID NO: 1329218 - RNA, 14 nt, Homo sapiens
gugauccuguucug

SEQ ID NO: 1329219 - RNA, 15 nt, Homo sapiens
gugaugaugaucuca

SEQ ID NO: 1329220 - RNA, 16 nt, Homo sapiens
gugaugcuaaaaccug

SEQ ID NO: 1329221 - RNA, 14 nt, Homo sapiens
gugcaccaucucac

SEQ ID NO: 1329222 - RNA, 20 nt, Homo sapiens
gugcacgcaggcacagcagc

SEQ ID NO: 1329223 - RNA, 13 nt, Homo sapiens
gugcacuccagac

SEQ ID NO: 1329224 - RNA, 17 nt, Homo sapiens
gugcaguccauuuccua

SEQ ID NO: 1329225 - RNA, 21 nt, Homo sapiens
uaaaaaaacuguuaccagaua

SEQ ID NO: 1329226 - RNA, 16 nt, Homo sapiens
uaaaaaacacagucac

SEQ ID NO: 1329227 - RNA, 13 nt, Homo sapiens
uaaaaaauggaac

SEQ ID NO: 1329228 - RNA, 16 nt, Homo sapiens
uaaaaaccaacuguga

SEQ ID NO: 1329229 - RNA, 19 nt, Homo sapiens
uaaaaacugcccauuguaa

SEQ ID NO: 1329230 - RNA, 12 nt, Homo sapiens
uaaaaaguaaug

SEQ ID NO: 1329231 - RNA, 18 nt, Homo sapiens
uaaaaaguucucauugaa

SEQ ID NO: 1329232 - RNA, 13 nt, Homo sapiens
uaaaaauguccug

SEQ ID NO: 1329233 - RNA, 16 nt, Homo sapiens
uaaaaauuaaauggau

SEQ ID NO: 1329234 - RNA, 20 nt, Homo sapiens
uaaaaauuuauacaccagca

SEQ ID NO: 1329235 - RNA, 12 nt, Homo sapiens
uaaaacaauucu

SEQ ID NO: 1329236 - RNA, 21 nt, Homo sapiens
uaaaacauuacuuauuuaacu

SEQ ID NO: 1329237 - RNA, 22 nt, Homo sapiens
uaaaaccuguucucuuuaauca

SEQ ID NO: 1329238 - RNA, 19 nt, Homo sapiens
uaaaagaaauguugcguaa

SEQ ID NO: 1329239 - RNA, 17 nt, Homo sapiens
uaaaagcacaaguacuu

SEQ ID NO: 1329240 - RNA, 14 nt, Homo sapiens
uaaaagcacacuca

SEQ ID NO: 1329241 - RNA, 15 nt, Homo sapiens
uaaaagcuacuaugu

SEQ ID NO: 1329242 - RNA, 23 nt, Homo sapiens
uaaaagcuacuauguacugccuu

SEQ ID NO: 1329243 - RNA, 13 nt, Homo sapiens
uaaaaguaguauu

SEQ ID NO: 1329244 - RNA, 17 nt, Homo sapiens
uaaaaguauuugcuuaa

SEQ ID NO: 1329245 - RNA, 16 nt, Homo sapiens
uaaaauaacuugcauc

SEQ ID NO: 1329246 - RNA, 19 nt, Homo sapiens
uaaaauaauuuucauucau

SEQ ID NO: 1329247 - RNA, 20 nt, Homo sapiens
uaaaauccaagcugcucauu

SEQ ID NO: 1329248 - RNA, 17 nt, Homo sapiens
uaaaaucuaaaauuuca

SEQ ID NO: 1329249 - RNA, 14 nt, Homo sapiens
uaaaaugcauugaa

SEQ ID NO: 1329250 - RNA, 15 nt, Homo sapiens
uaaaaugcauugaaa

SEQ ID NO: 1329251 - RNA, 23 nt, Homo sapiens
uaaaauuaaucacaaauuucacu

SEQ ID NO: 1329252 - RNA, 21 nt, Homo sapiens
uaaaauugggcuugugauuuc

SEQ ID NO: 1329253 - RNA, 14 nt, Homo sapiens
uaaaauuuaacuca

SEQ ID NO: 1329254 - RNA, 17 nt, Homo sapiens
uaaaauuucaggauuaa

SEQ ID NO: 1329255 - RNA, 22 nt, Homo sapiens
uaaacaaaugugauacauuuaa

SEQ ID NO: 1329256 - RNA, 12 nt, Homo sapiens
uaaacagaggau

SEQ ID NO: 1329257 - RNA, 11 nt, Homo sapiens
uaaacaggguc

SEQ ID NO: 1329258 - RNA, 12 nt, Homo sapiens
uaaacagggucu

SEQ ID NO: 1329259 - RNA, 21 nt, Homo sapiens
uaaacauauucaaggagcaag

SEQ ID NO: 1329260 - RNA, 19 nt, Homo sapiens
uaaaccaaaaacugaaagu

SEQ ID NO: 1329261 - RNA, 14 nt, Homo sapiens
uaaacuacucuuug

SEQ ID NO: 1329262 - RNA, 16 nt, Homo sapiens
uaaacuaguguuauac

SEQ ID NO: 1329263 - RNA, 22 nt, Homo sapiens
uaaacucuguugcaagugcaau

SEQ ID NO: 1329264 - RNA, 16 nt, Homo sapiens
uaaagacaaucacugc

SEQ ID NO: 1329265 - RNA, 10 nt, Homo sapiens
uaaagacaga

SEQ ID NO: 1329266 - RNA, 14 nt, Homo sapiens
uaaagaccugagaa

SEQ ID NO: 1329267 - RNA, 14 nt, Homo sapiens
uaaagauacauacc

SEQ ID NO: 1329268 - RNA, 13 nt, Homo sapiens
uaaagcacauggu

SEQ ID NO: 1329269 - RNA, 13 nt, Homo sapiens
uaaagcauaaaaa

SEQ ID NO: 1329270 - RNA, 16 nt, Homo sapiens
uaaagccaagcacuuu

SEQ ID NO: 1329271 - RNA, 17 nt, Homo sapiens
uaaaggaaccauuccuu

SEQ ID NO: 1329272 - RNA, 20 nt, Homo sapiens
uaaagggcagggcccacgug

SEQ ID NO: 1329273 - RNA, 17 nt, Homo sapiens
uaaaguaaauacaugca

SEQ ID NO: 1329274 - RNA, 14 nt, Homo sapiens
uaaaguaaugccuc

SEQ ID NO: 1329275 - RNA, 19 nt, Homo sapiens
uaaaguuucuugcauuuau

SEQ ID NO: 1329276 - RNA, 14 nt, Homo sapiens
uaaauaaauaccaa

SEQ ID NO: 1329277 - RNA, 20 nt, Homo sapiens
uaaauauuauuagauuuauu

SEQ ID NO: 1329278 - RNA, 20 nt, Homo sapiens
uaaaucaggacagguggugc

SEQ ID NO: 1329279 - RNA, 12 nt, Homo sapiens
uaaaucugaaua

SEQ ID NO: 1329280 - RNA, 16 nt, Homo sapiens
uaaaugaaacuuaaga

SEQ ID NO: 1329281 - RNA, 18 nt, Homo sapiens
uaaaugauagacaauuga

SEQ ID NO: 1329282 - RNA, 18 nt, Homo sapiens
uaaauguauacuauagua

SEQ ID NO: 1329283 - RNA, 21 nt, Homo sapiens
uaaaugucuuuccaaaagugu

SEQ ID NO: 1329284 - RNA, 19 nt, Homo sapiens
uaaauguuaugacuaugua

SEQ ID NO: 1329285 - RNA, 22 nt, Homo sapiens
uaaauuauuuuuguucauauaa

SEQ ID NO: 1329286 - RNA, 18 nt, Homo sapiens
uaaauucccaacuucucu

SEQ ID NO: 1329287 - RNA, 15 nt, Homo sapiens
uaaauugauguugcu

SEQ ID NO: 1329288 - RNA, 14 nt, Homo sapiens
uaaauugcaguuua

SEQ ID NO: 1329289 - RNA, 21 nt, Homo sapiens
uaaauuuaugguucucaggcc

SEQ ID NO: 1329290 - RNA, 15 nt, Homo sapiens
uaaauuucagcuuug

SEQ ID NO: 1329291 - RNA, 16 nt, Homo sapiens
uaaauuuguguucuca

SEQ ID NO: 1329292 - RNA, 20 nt, Homo sapiens
uaaauuuguguucucaaaua

SEQ ID NO: 1329293 - RNA, 16 nt, Homo sapiens
uaacaauccauucaca

SEQ ID NO: 1329294 - RNA, 15 nt, Homo sapiens
uaacaaugaccuuua

SEQ ID NO: 1329295 - RNA, 24 nt, Homo sapiens
uaacacauucaauagcauaucaca

SEQ ID NO: 1329296 - RNA, 17 nt, Homo sapiens
uaacagauccuuucaaa

SEQ ID NO: 1329297 - RNA, 23 nt, Homo sapiens
uaacaguuugauauuuuguaaaa

SEQ ID NO: 1329298 - RNA, 22 nt, Homo sapiens
uaacaguuugauauuuuguuaa

SEQ ID NO: 1329299 - RNA, 16 nt, Homo sapiens
uaacaucgcacaguuu

SEQ ID NO: 1329300 - RNA, 22 nt, Homo sapiens
uaacaucuaaaaauagacuuaa

SEQ ID NO: 1329301 - RNA, 20 nt, Homo sapiens
uaacaugaggcccauucuuc

SEQ ID NO: 1329302 - RNA, 19 nt, Homo sapiens
uaacccaagacaugacauu

SEQ ID NO: 1329303 - RNA, 21 nt, Homo sapiens
uaaccugggaccuguggucau

SEQ ID NO: 1329304 - RNA, 23 nt, Homo sapiens
uaacgcagucuaauuacauuuca

SEQ ID NO: 1329305 - RNA, 14 nt, Homo sapiens
uaacgucaugugca

SEQ ID NO: 1329306 - RNA, 16 nt, Homo sapiens
uaacuagaaagugagu

SEQ ID NO: 1329307 - RNA, 18 nt, Homo sapiens
uaacuaugaccaugcuga

SEQ ID NO: 1329308 - RNA, 11 nt, Homo sapiens
uaacuauucau

SEQ ID NO: 1329309 - RNA, 17 nt, Homo sapiens
uaacucagacacaaaua

SEQ ID NO: 1329310 - RNA, 18 nt, Homo sapiens
uaacucuaccugcacacu

SEQ ID NO: 1329311 - RNA, 20 nt, Homo sapiens
uaacucugaccugggagccc

SEQ ID NO: 1329312 - RNA, 20 nt, Homo sapiens
uaacugaaccaaauugcacu

SEQ ID NO: 1329313 - RNA, 13 nt, Homo sapiens
uaacugauagaac

SEQ ID NO: 1329314 - RNA, 14 nt, Homo sapiens
uaacugcauccagc

SEQ ID NO: 1329315 - RNA, 14 nt, Homo sapiens
uaacugccaagaaa

SEQ ID NO: 1329316 - RNA, 14 nt, Homo sapiens
uaacuguugucaua

SEQ ID NO: 1329317 - RNA, 22 nt, Homo sapiens
uaacuugagauucaagacaaga

SEQ ID NO: 1329318 - RNA, 17 nt, Homo sapiens
uaagaaauagacagcau

SEQ ID NO: 1329319 - RNA, 18 nt, Homo sapiens
uaagaacuuuuucacuuc

SEQ ID NO: 1329320 - RNA, 22 nt, Homo sapiens
uaagacagauucuucacugugu

SEQ ID NO: 1329321 - RNA, 17 nt, Homo sapiens
uaagacauaaacaaaga

SEQ ID NO: 1329322 - RNA, 20 nt, Homo sapiens
uaagacauaaacaaagacau

SEQ ID NO: 1329323 - RNA, 13 nt, Homo sapiens
uaagcauaacuua

SEQ ID NO: 1329324 - RNA, 16 nt, Homo sapiens
uaagcuaggaaugaaa

SEQ ID NO: 1329325 - RNA, 17 nt, Homo sapiens
uaaggauagugugaaga

SEQ ID NO: 1329326 - RNA, 17 nt, Homo sapiens
uaaggucuaaucaguga

SEQ ID NO: 1329327 - RNA, 18 nt, Homo sapiens
uaaggucuaaucagugau

SEQ ID NO: 1329328 - RNA, 16 nt, Homo sapiens
uaaggugaaccaaaga

SEQ ID NO: 1329329 - RNA, 23 nt, Homo sapiens
uaaguaaaagcuacuauguacug

SEQ ID NO: 1329330 - RNA, 22 nt, Homo sapiens
uaaguagggacuucugucuuca

SEQ ID NO: 1329331 - RNA, 23 nt, Homo sapiens
uaaguauuuagaagugugaauuc

SEQ ID NO: 1329332 - RNA, 13 nt, Homo sapiens
uaaguccuuccac

SEQ ID NO: 1329333 - RNA, 17 nt, Homo sapiens
uaagucuuaaucauuug

SEQ ID NO: 1329334 - RNA, 24 nt, Homo sapiens
uaagugaaaaucuuacaacaggcu

SEQ ID NO: 1329335 - RNA, 14 nt, Homo sapiens
uaauaaauacugca

SEQ ID NO: 1329336 - RNA, 16 nt, Homo sapiens
uaauaagucgcuguca

SEQ ID NO: 1329337 - RNA, 17 nt, Homo sapiens
uaauaccaaaauugagc

SEQ ID NO: 1329338 - RNA, 18 nt, Homo sapiens
uaauaccaaaauugagcu

SEQ ID NO: 1329339 - RNA, 18 nt, Homo sapiens
uaauaucccuacauguau

SEQ ID NO: 1329340 - RNA, 20 nt, Homo sapiens
uaaucaagagaaacuucaaa

SEQ ID NO: 1329341 - RNA, 16 nt, Homo sapiens
uaaucacaaauuucac

SEQ ID NO: 1329342 - RNA, 18 nt, Homo sapiens
uaaucauuuuaaauucca

SEQ ID NO: 1329343 - RNA, 15 nt, Homo sapiens
uaaucccagcacuuu

SEQ ID NO: 1329344 - RNA, 15 nt, Homo sapiens
uaauccuagcacuuu

SEQ ID NO: 1329345 - RNA, 18 nt, Homo sapiens
uaauccuuaacacauuca

SEQ ID NO: 1329346 - RNA, 21 nt, Homo sapiens
uaaucguguccugaaaauccu

SEQ ID NO: 1329347 - RNA, 15 nt, Homo sapiens
uaaucucagcacuuu

SEQ ID NO: 1329348 - RNA, 15 nt, Homo sapiens
uaaucugaggcaauc

SEQ ID NO: 1329349 - RNA, 20 nt, Homo sapiens
uaaucugauguauaauguaa

SEQ ID NO: 1329350 - RNA, 22 nt, Homo sapiens
uaaucuggacuccucuguccag

SEQ ID NO: 1329351 - RNA, 14 nt, Homo sapiens
uaaugaaacacagc

SEQ ID NO: 1329352 - RNA, 13 nt, Homo sapiens
uaaugacauuccc

SEQ ID NO: 1329353 - RNA, 14 nt, Homo sapiens
uaaugagugcaccu

SEQ ID NO: 1329354 - RNA, 17 nt, Homo sapiens
uaaugauuuuacuuaac

SEQ ID NO: 1329355 - RNA, 20 nt, Homo sapiens
uaaugcacuaaaaguaguau

SEQ ID NO: 1329356 - RNA, 19 nt, Homo sapiens
uaauggaggugacggcacu

SEQ ID NO: 1329357 - RNA, 16 nt, Homo sapiens
uaauggaugguugaau

SEQ ID NO: 1329358 - RNA, 18 nt, Homo sapiens
uaauggaugguugaauua

SEQ ID NO: 1329359 - RNA, 21 nt, Homo sapiens
uaaugguaguuuuacaguguu

SEQ ID NO: 1329360 - RNA, 16 nt, Homo sapiens
ugcuggggaacuggcg

SEQ ID NO: 1329361 - RNA, 19 nt, Homo sapiens
ugcuguacugagcacugaa

SEQ ID NO: 1329362 - RNA, 15 nt, Homo sapiens
ugcuguauccaucca

SEQ ID NO: 1329363 - RNA, 21 nt, Homo sapiens
ugcugucuuuucuuugccauc

SEQ ID NO: 1329364 - RNA, 15 nt, Homo sapiens
ugcuguguccucuag

SEQ ID NO: 1329365 - RNA, 22 nt, Homo sapiens
ugcuguuuuuguucuacucuag

SEQ ID NO: 1329366 - RNA, 15 nt, Homo sapiens
ugcuuaaaauuguga

SEQ ID NO: 1329367 - RNA, 16 nt, Homo sapiens
ugcuuagcuuguugaa

SEQ ID NO: 1329368 - RNA, 19 nt, Homo sapiens
ugcuucaaaaacauucuua

SEQ ID NO: 1329369 - RNA, 19 nt, Homo sapiens
ugcuucagcucuucuugac

SEQ ID NO: 1329370 - RNA, 22 nt, Homo sapiens
ugcuuccacuaccaaaagacau

SEQ ID NO: 1329371 - RNA, 23 nt, Homo sapiens
ugcuuccccuuuugccaaucuca

SEQ ID NO: 1329372 - RNA, 15 nt, Homo sapiens
ugcuugggacauugc

SEQ ID NO: 1329373 - RNA, 22 nt, Homo sapiens
ugcuugggacauugcaauuugc

SEQ ID NO: 1329374 - RNA, 17 nt, Homo sapiens
ugcuugggcugacccag

SEQ ID NO: 1329375 - RNA, 16 nt, Homo sapiens
ugcuugguugucucca

SEQ ID NO: 1329376 - RNA, 18 nt, Homo sapiens
ugcuuuugaggaacauua

SEQ ID NO: 1329377 - RNA, 14 nt, Homo sapiens
ugcuuuuugucaug

SEQ ID NO: 1329378 - RNA, 21 nt, Homo sapiens
uggaaaaacaggaaaggagca

SEQ ID NO: 1329379 - RNA, 15 nt, Homo sapiens
uggaaaaggccugug

SEQ ID NO: 1329380 - RNA, 20 nt, Homo sapiens
uggaaaauaaacaucaguuu

SEQ ID NO: 1329381 - RNA, 15 nt, Homo sapiens
uggaaacagcaugaa

SEQ ID NO: 1329382 - RNA, 17 nt, Homo sapiens
uggaaacagcaugaaua

SEQ ID NO: 1329383 - RNA, 18 nt, Homo sapiens
uggaaacagcaugaauaa

SEQ ID NO: 1329384 - RNA, 22 nt, Homo sapiens
uggaaacauuggugaugcuauc

SEQ ID NO: 1329385 - RNA, 19 nt, Homo sapiens
uggaaaugcugacuuuuaa

SEQ ID NO: 1329386 - RNA, 19 nt, Homo sapiens
uggaacaagagaaguacua

SEQ ID NO: 1329387 - RNA, 17 nt, Homo sapiens
uggaacaagcacagaug

SEQ ID NO: 1329388 - RNA, 20 nt, Homo sapiens
uggaacaccuuggggucccu

SEQ ID NO: 1329389 - RNA, 21 nt, Homo sapiens
uggaacagcauuacccuccuc

SEQ ID NO: 1329390 - RNA, 20 nt, Homo sapiens
uggaagcuuguugaaaaccc

SEQ ID NO: 1329391 - RNA, 21 nt, Homo sapiens
uggaagcuuguugaaaaccca

SEQ ID NO: 1329392 - RNA, 13 nt, Homo sapiens
uggaaggggccac

SEQ ID NO: 1329393 - RNA, 18 nt, Homo sapiens
uggaagugugggucugug

SEQ ID NO: 1329394 - RNA, 19 nt, Homo sapiens
uggaauuaauaaaugucau

SEQ ID NO: 1329395 - RNA, 17 nt, Homo sapiens
uggaauucccuccugag

SEQ ID NO: 1329396 - RNA, 12 nt, Homo sapiens
uggaauucuucu

SEQ ID NO: 1329397 - RNA, 22 nt, Homo sapiens
uggacacggaucugcugggcuc

SEQ ID NO: 1329398 - RNA, 22 nt, Homo sapiens
uggacacuucacgcccuuggcc

SEQ ID NO: 1329399 - RNA, 18 nt, Homo sapiens
uggacagucucaccuccu

SEQ ID NO: 1329400 - RNA, 22 nt, Homo sapiens
uggacaugggccagguuuuuca

SEQ ID NO: 1329401 - RNA, 21 nt, Homo sapiens
uggaccaccguucagucauuu

SEQ ID NO: 1329402 - RNA, 23 nt, Homo sapiens
uggacuaaaugaucucugaaagu

SEQ ID NO: 1329403 - RNA, 16 nt, Homo sapiens
uggacuacacagcucc

SEQ ID NO: 1329404 - RNA, 14 nt, Homo sapiens
uggagaaagagcug

SEQ ID NO: 1329405 - RNA, 16 nt, Homo sapiens
uggagaaccagggcuc

SEQ ID NO: 1329406 - RNA, 22 nt, Homo sapiens
uggagaaccagggcucuucuca

SEQ ID NO: 1329407 - RNA, 22 nt, Homo sapiens
uggagaaggccuggaagagcug

SEQ ID NO: 1329408 - RNA, 21 nt, Homo sapiens
uggagagggaaaaucuucacu

SEQ ID NO: 1329409 - RNA, 19 nt, Homo sapiens
uggagagucagaucuuucu

SEQ ID NO: 1329410 - RNA, 19 nt, Homo sapiens
uggagauggaagcuuguug

SEQ ID NO: 1329411 - RNA, 20 nt, Homo sapiens
uggagauuucauuuugucag

SEQ ID NO: 1329412 - RNA, 22 nt, Homo sapiens
uggagcaggcccaaugcugcuu

SEQ ID NO: 1329413 - RNA, 16 nt, Homo sapiens
uggagcuaaaacuggc

SEQ ID NO: 1329414 - RNA, 22 nt, Homo sapiens
uggagcuaaaacuggcccuguu

SEQ ID NO: 1329415 - RNA, 16 nt, Homo sapiens
uggagcucagguccca

SEQ ID NO: 1329416 - RNA, 14 nt, Homo sapiens
uggagcugggcuaa

SEQ ID NO: 1329417 - RNA, 11 nt, Homo sapiens
uggaggacaaa

SEQ ID NO: 1329418 - RNA, 21 nt, Homo sapiens
uggaggcugccugcugugcug

SEQ ID NO: 1329419 - RNA, 23 nt, Homo sapiens
uggagggagaagcugucagggac

SEQ ID NO: 1329420 - RNA, 18 nt, Homo sapiens
uggagggcucagggcagu

SEQ ID NO: 1329421 - RNA, 19 nt, Homo sapiens
uggaguagagguacuagaa

SEQ ID NO: 1329422 - RNA, 14 nt, Homo sapiens
uggaguucucucau

SEQ ID NO: 1329423 - RNA, 13 nt, Homo sapiens
uggaguuugacac

SEQ ID NO: 1329424 - RNA, 17 nt, Homo sapiens
uggauaccauuauaugu

SEQ ID NO: 1329425 - RNA, 22 nt, Homo sapiens
uggauauuaaaaaucuguaaau

SEQ ID NO: 1329426 - RNA, 13 nt, Homo sapiens
uggauauuucaau

SEQ ID NO: 1329427 - RNA, 16 nt, Homo sapiens
uggaucagcauuuuag

SEQ ID NO: 1329428 - RNA, 14 nt, Homo sapiens
uggaugcugugaag

SEQ ID NO: 1329429 - RNA, 18 nt, Homo sapiens
uguagucccagcuacuca

SEQ ID NO: 1329430 - RNA, 18 nt, Homo sapiens
uguaguccuaugcaauaa

SEQ ID NO: 1329431 - RNA, 16 nt, Homo sapiens
uguaguguggcugugg

SEQ ID NO: 1329432 - RNA, 15 nt, Homo sapiens
uguauaccagccuac

SEQ ID NO: 1329433 - RNA, 19 nt, Homo sapiens
uguauacuauaguaccagu

SEQ ID NO: 1329434 - RNA, 16 nt, Homo sapiens
uguauacuguaggcac

SEQ ID NO: 1329435 - RNA, 15 nt, Homo sapiens
uguauaguaucugua

SEQ ID NO: 1329436 - RNA, 20 nt, Homo sapiens
uguaucuuuuauccugggag

SEQ ID NO: 1329437 - RNA, 15 nt, Homo sapiens
uguauuauucauaga

SEQ ID NO: 1329438 - RNA, 15 nt, Homo sapiens
uguauucaccaccaa

SEQ ID NO: 1329439 - RNA, 17 nt, Homo sapiens
uguauucucuuccucau

SEQ ID NO: 1329440 - RNA, 15 nt, Homo sapiens
uguauugguguugca

SEQ ID NO: 1329441 - RNA, 20 nt, Homo sapiens
uguauuuaccuucuaccucu

SEQ ID NO: 1329442 - RNA, 18 nt, Homo sapiens
uguauuuuccaacuuguu

SEQ ID NO: 1329443 - RNA, 22 nt, Homo sapiens
ugucaagacaaggucuugcuau

SEQ ID NO: 1329444 - RNA, 17 nt, Homo sapiens
ugucacagaugcagauu

SEQ ID NO: 1329445 - RNA, 17 nt, Homo sapiens
ugucacaucucagggaa

SEQ ID NO: 1329446 - RNA, 22 nt, Homo sapiens
ugucacuacggugauuguauga

SEQ ID NO: 1329447 - RNA, 15 nt, Homo sapiens
ugucagcaauuuaac

SEQ ID NO: 1329448 - RNA, 18 nt, Homo sapiens
ugucagcagcagugacca

SEQ ID NO: 1329449 - RNA, 15 nt, Homo sapiens
ugucaggguccagga

SEQ ID NO: 1329450 - RNA, 23 nt, Homo sapiens
ugucauuaaauggggcucacaaa

SEQ ID NO: 1329451 - RNA, 21 nt, Homo sapiens
ugucauucuguuagauacuaa

SEQ ID NO: 1329452 - RNA, 21 nt, Homo sapiens
ugucauuuuuuuucuuugaau

SEQ ID NO: 1329453 - RNA, 18 nt, Homo sapiens
uguccaaaacugccucag

SEQ ID NO: 1329454 - RNA, 14 nt, Homo sapiens
uguccaaacccacu

SEQ ID NO: 1329455 - RNA, 15 nt, Homo sapiens
ugucccagaaaagca

SEQ ID NO: 1329456 - RNA, 19 nt, Homo sapiens
uguccccuaaaccaaaaac

SEQ ID NO: 1329457 - RNA, 19 nt, Homo sapiens
uguccuaaggcccauuuga

SEQ ID NO: 1329458 - RNA, 19 nt, Homo sapiens
uguccucagccuugccaga

SEQ ID NO: 1329459 - RNA, 17 nt, Homo sapiens
uguccugagcaccacac

SEQ ID NO: 1329460 - RNA, 20 nt, Homo sapiens
uguccugaugcuuuugucua

SEQ ID NO: 1329461 - RNA, 14 nt, Homo sapiens
uguccuguccugcu

SEQ ID NO: 1329462 - RNA, 17 nt, Homo sapiens
uguccuucccuguucuc

SEQ ID NO: 1329463 - RNA, 22 nt, Homo sapiens
ugucgggcucauuuugcucaac

SEQ ID NO: 1329464 - RNA, 18 nt, Homo sapiens
ugucuacgggggcacuug

SEQ ID NO: 1329465 - RNA, 15 nt, Homo sapiens
ugucuccagcugccu

SEQ ID NO: 1329466 - RNA, 21 nt, Homo sapiens
ugucuccagggcccccaccga

SEQ ID NO: 1329467 - RNA, 12 nt, Homo sapiens
ugucucucauga

SEQ ID NO: 1329468 - RNA, 21 nt, Homo sapiens
ugucugaguaagcccucagga

SEQ ID NO: 1329469 - RNA, 23 nt, Homo sapiens
ugucugggcucagacauccacau

SEQ ID NO: 1329470 - RNA, 22 nt, Homo sapiens
ugucugggugaccucacuuuag

SEQ ID NO: 1329471 - RNA, 15 nt, Homo sapiens
ugucuggugguggca

SEQ ID NO: 1329472 - RNA, 14 nt, Homo sapiens
ugucuuaccaguga

SEQ ID NO: 1329473 - RNA, 20 nt, Homo sapiens
ugucuucaaagcaaagcucu

SEQ ID NO: 1329474 - RNA, 13 nt, Homo sapiens
ugucuucagagaa

SEQ ID NO: 1329475 - RNA, 18 nt, Homo sapiens
ugucuuuguucugugauu

SEQ ID NO: 1329476 - RNA, 20 nt, Homo sapiens
ugugaaacauuuuuucuucu

SEQ ID NO: 1329477 - RNA, 18 nt, Homo sapiens
ugugaaacucuacccuga

SEQ ID NO: 1329478 - RNA, 17 nt, Homo sapiens
ugugaacucaccaaaca

SEQ ID NO: 1329479 - RNA, 21 nt, Homo sapiens
ugugaaggaacucugcaguua

SEQ ID NO: 1329480 - RNA, 23 nt, Homo sapiens
ugugaaggaauuauucccaugag

SEQ ID NO: 1329481 - RNA, 13 nt, Homo sapiens
ugugaauauuccu

SEQ ID NO: 1329482 - RNA, 19 nt, Homo sapiens
ugugaauuaggcuguaacu

SEQ ID NO: 1329483 - RNA, 12 nt, Homo sapiens
ugugacauacau

SEQ ID NO: 1329484 - RNA, 13 nt, Homo sapiens
ugugacauacaua

SEQ ID NO: 1329485 - RNA, 23 nt, Homo sapiens
ugugacguuuuuccaguucacau

SEQ ID NO: 1329486 - RNA, 12 nt, Homo sapiens
ugugacuacuga

SEQ ID NO: 1329487 - RNA, 15 nt, Homo sapiens
ugugagcauggggcc

SEQ ID NO: 1329488 - RNA, 16 nt, Homo sapiens
ugugauggcaaagaag

SEQ ID NO: 1329489 - RNA, 17 nt, Homo sapiens
ugugaugggcuguuuaa

SEQ ID NO: 1329490 - RNA, 23 nt, Homo sapiens
ugugcacuuucuucucuuuccca

SEQ ID NO: 1329491 - RNA, 22 nt, Homo sapiens
ugugcauacuuucccucaucca

SEQ ID NO: 1329492 - RNA, 18 nt, Homo sapiens
ugugccuucccuuucuaa

SEQ ID NO: 1329493 - RNA, 17 nt, Homo sapiens
ugugcuaugaaacaauc

SEQ ID NO: 1329494 - RNA, 18 nt, Homo sapiens
ugugcucuggcaccauca

SEQ ID NO: 1329495 - RNA, 12 nt, Homo sapiens
ugugcugcucaa

SEQ ID NO: 1329496 - RNA, 13 nt, Homo sapiens
ugugcuggggucu

SEQ ID NO: 1329497 - RNA, 17 nt, Homo sapiens
uguggaaauagaugugc

SEQ ID NO: 1329498 - RNA, 12 nt, Homo sapiens
uguggaccugga

SEQ ID NO: 1329499 - RNA, 17 nt, Homo sapiens
uguggccaacugcaaaa

SEQ ID NO: 1329500 - RNA, 22 nt, Homo sapiens
uguggccuuuauguucuuucac

SEQ ID NO: 1329501 - RNA, 16 nt, Homo sapiens
uguggcuguauccacu

SEQ ID NO: 1329502 - RNA, 14 nt, Homo sapiens
ugugggaaggcaaa

SEQ ID NO: 1329503 - RNA, 18 nt, Homo sapiens
ugugggcgcauacuacag

SEQ ID NO: 1329504 - RNA, 19 nt, Homo sapiens
uguggucugggcaccaccu

SEQ ID NO: 1329505 - RNA, 16 nt, Homo sapiens
ugugguguuacuguag

SEQ ID NO: 1329506 - RNA, 15 nt, Homo sapiens
uguguaccacuuccu

SEQ ID NO: 1329507 - RNA, 18 nt, Homo sapiens
ugugugauugacagcuuu

SEQ ID NO: 1329508 - RNA, 12 nt, Homo sapiens
uguguguggcag

SEQ ID NO: 1329509 - RNA, 15 nt, Homo sapiens
uguguucgacucagc

SEQ ID NO: 1329510 - RNA, 17 nt, Homo sapiens
uguguuugguucaauuu

SEQ ID NO: 1329511 - RNA, 14 nt, Homo sapiens
uguguuuuuaauaa

SEQ ID NO: 1329512 - RNA, 20 nt, Homo sapiens
uguguuuuuaauaaagacag

SEQ ID NO: 1329513 - RNA, 21 nt, Homo sapiens
uguguuuuuaauaaagacagg

SEQ ID NO: 1329514 - RNA, 21 nt, Homo sapiens
uguuaaaauagacuaaccucu

SEQ ID NO: 1329515 - RNA, 21 nt, Homo sapiens
uguuaacauggacaugaucuu

SEQ ID NO: 1329516 - RNA, 15 nt, Homo sapiens
uguuacuauuccuuu

SEQ ID NO: 1329517 - RNA, 15 nt, Homo sapiens
uguuagcuuccuuaa

SEQ ID NO: 1329518 - RNA, 20 nt, Homo sapiens
uguuauauacauacuaugaa

SEQ ID NO: 1329519 - RNA, 15 nt, Homo sapiens
uguuauuugcucuaa

SEQ ID NO: 1329520 - RNA, 17 nt, Homo sapiens
uguucaaguuugcugca

SEQ ID NO: 1329521 - RNA, 19 nt, Homo sapiens
uguucacaacagugaaaag

SEQ ID NO: 1329522 - RNA, 11 nt, Homo sapiens
uguucacaugg

SEQ ID NO: 1329523 - RNA, 13 nt, Homo sapiens
uguuccucuagua

SEQ ID NO: 1329524 - RNA, 20 nt, Homo sapiens
uguuccucuaguaguauauu

SEQ ID NO: 1329525 - RNA, 18 nt, Homo sapiens
uguuccugauaaacagag

SEQ ID NO: 1329526 - RNA, 14 nt, Homo sapiens
uguucuacugagaa

SEQ ID NO: 1329527 - RNA, 13 nt, Homo sapiens
uguucucacuuau

SEQ ID NO: 1329528 - RNA, 19 nt, Homo sapiens
uguucugccuggagacaag

SEQ ID NO: 1329529 - RNA, 21 nt, Homo sapiens
uguucugcugauaucaacagc

SEQ ID NO: 1329530 - RNA, 20 nt, Homo sapiens
uguucuuaugcaaaauggaa

SEQ ID NO: 1329531 - RNA, 12 nt, Homo sapiens
uguucuuugcau

SEQ ID NO: 1329532 - RNA, 14 nt, Homo sapiens
uguucuuugucuca

SEQ ID NO: 1329533 - RNA, 21 nt, Homo sapiens
uguugaaaacccagacugucu

SEQ ID NO: 1329534 - RNA, 14 nt, Homo sapiens
uguugaaacacuuu

SEQ ID NO: 1329535 - RNA, 15 nt, Homo sapiens
uguugagcagcaucu

SEQ ID NO: 1329536 - RNA, 18 nt, Homo sapiens
uguugcaaugcaugauac

SEQ ID NO: 1329537 - RNA, 12 nt, Homo sapiens
uguugcacugaa

SEQ ID NO: 1329538 - RNA, 16 nt, Homo sapiens
uguuuauauaguuuag

SEQ ID NO: 1329539 - RNA, 20 nt, Homo sapiens
uguuuauauggauaaucuga

SEQ ID NO: 1329540 - RNA, 15 nt, Homo sapiens
uguuuccuguuggag

SEQ ID NO: 1329541 - RNA, 21 nt, Homo sapiens
uguuucuugucccucuguaua

SEQ ID NO: 1329542 - RNA, 15 nt, Homo sapiens
uguuugugugggaug

SEQ ID NO: 1329543 - RNA, 19 nt, Homo sapiens
uguuuuaaaauacucucau

SEQ ID NO: 1329544 - RNA, 14 nt, Homo sapiens
uguuuuaaguacua

SEQ ID NO: 1329545 - RNA, 17 nt, Homo sapiens
uguuuuuauuucaauug

SEQ ID NO: 1329546 - RNA, 14 nt, Homo sapiens
uguuuuuuacucaa

SEQ ID NO: 1329547 - RNA, 23 nt, Homo sapiens
uuaaaaaaucccuuccugaguaa

SEQ ID NO: 1329548 - RNA, 14 nt, Homo sapiens
uuaaaaaugucuua

SEQ ID NO: 1329549 - RNA, 13 nt, Homo sapiens
uuaaaaauuguca

SEQ ID NO: 1329550 - RNA, 17 nt, Homo sapiens
uuaaaacaaagggaaaa

SEQ ID NO: 1329551 - RNA, 16 nt, Homo sapiens
uuaaaacauaaacaca

SEQ ID NO: 1329552 - RNA, 19 nt, Homo sapiens
uuaaaagaaaacacuguca

SEQ ID NO: 1329553 - RNA, 17 nt, Homo sapiens
uuaaaaggcaagucaaa

SEQ ID NO: 1329554 - RNA, 22 nt, Homo sapiens
uuaaaaggcaagucaaauacca

SEQ ID NO: 1329555 - RNA, 14 nt, Homo sapiens
uuaaaauacaugaa

SEQ ID NO: 1329556 - RNA, 18 nt, Homo sapiens
uuaaaauagcuuugcagu

SEQ ID NO: 1329557 - RNA, 14 nt, Homo sapiens
uuaaaaugagcauu

SEQ ID NO: 1329558 - RNA, 20 nt, Homo sapiens
uuaaacauugugaucauuag

SEQ ID NO: 1329559 - RNA, 13 nt, Homo sapiens
uuaaacuugaauu

SEQ ID NO: 1329560 - RNA, 14 nt, Homo sapiens
uuaaagaaaaccac

SEQ ID NO: 1329561 - RNA, 16 nt, Homo sapiens
uuaaagaaaaccacag

SEQ ID NO: 1329562 - RNA, 21 nt, Homo sapiens
uuaaagacaggagacaaaaga

SEQ ID NO: 1329563 - RNA, 19 nt, Homo sapiens
uuaaagcaagcaacacaga

SEQ ID NO: 1329564 - RNA, 18 nt, Homo sapiens
uuacuguuccagauuccu

SEQ ID NO: 1329565 - RNA, 21 nt, Homo sapiens
uuacuuauuuaacugauuaaa

SEQ ID NO: 1329566 - RNA, 16 nt, Homo sapiens
uuacuugccuaucuga

SEQ ID NO: 1329567 - RNA, 21 nt, Homo sapiens
uuacuugggcuucaacagcca

SEQ ID NO: 1329568 - RNA, 20 nt, Homo sapiens
uuacuuuccccccauguauu

SEQ ID NO: 1329569 - RNA, 20 nt, Homo sapiens
uuagaagauauuauuugucu

SEQ ID NO: 1329570 - RNA, 13 nt, Homo sapiens
uuagaauaaugaa

SEQ ID NO: 1329571 - RNA, 18 nt, Homo sapiens
uuagaaucugaguauaaa

SEQ ID NO: 1329572 - RNA, 15 nt, Homo sapiens
uuagaugaaugucag

SEQ ID NO: 1329573 - RNA, 13 nt, Homo sapiens
uuagauucacuua

SEQ ID NO: 1329574 - RNA, 17 nt, Homo sapiens
uuagcaauugacuguca

SEQ ID NO: 1329575 - RNA, 20 nt, Homo sapiens
uuagcuguuucucaagacca

SEQ ID NO: 1329576 - RNA, 15 nt, Homo sapiens
uuaggcuggaaaugg

SEQ ID NO: 1329577 - RNA, 13 nt, Homo sapiens
uuagucucuggaa

SEQ ID NO: 1329578 - RNA, 13 nt, Homo sapiens
uuagugacuucaa

SEQ ID NO: 1329579 - RNA, 19 nt, Homo sapiens
uuagugugaauauuccuuu

SEQ ID NO: 1329580 - RNA, 16 nt, Homo sapiens
uuauaaaccaaucuua

SEQ ID NO: 1329581 - RNA, 12 nt, Homo sapiens
uuauaacuauua

SEQ ID NO: 1329582 - RNA, 13 nt, Homo sapiens
uuauaacuguugu

SEQ ID NO: 1329583 - RNA, 14 nt, Homo sapiens
uuauacaccagcaa

SEQ ID NO: 1329584 - RNA, 17 nt, Homo sapiens
uuauaggcaugagccac

SEQ ID NO: 1329585 - RNA, 20 nt, Homo sapiens
uuauaucucccccacuccac

SEQ ID NO: 1329586 - RNA, 21 nt, Homo sapiens
uuauauuacuugccuaucuga

SEQ ID NO: 1329587 - RNA, 22 nt, Homo sapiens
uuauauugccuaagaauaaaca

SEQ ID NO: 1329588 - RNA, 23 nt, Homo sapiens
uuauauuuguaaauuuaugugau

SEQ ID NO: 1329589 - RNA, 18 nt, Homo sapiens
uuaucacuucauucacau

SEQ ID NO: 1329590 - RNA, 21 nt, Homo sapiens
uuaucacuucauucacauuca

SEQ ID NO: 1329591 - RNA, 20 nt, Homo sapiens
uuaucuacuuuuacucauaa

SEQ ID NO: 1329592 - RNA, 19 nt, Homo sapiens
uuaucugguuuaagaguaa

SEQ ID NO: 1329593 - RNA, 14 nt, Homo sapiens
uuaugauugcauaa

SEQ ID NO: 1329594 - RNA, 17 nt, Homo sapiens
uuaugcaaauacaauca

SEQ ID NO: 1329595 - RNA, 14 nt, Homo sapiens
uuaugcuguuuccu

SEQ ID NO: 1329596 - RNA, 18 nt, Homo sapiens
uuaugggguuuaccuguu

SEQ ID NO: 1329597 - RNA, 13 nt, Homo sapiens
uuauuaaagaaau

SEQ ID NO: 1329598 - RNA, 17 nt, Homo sapiens
uuauuaagcaguacaaa

SEQ ID NO: 1329599 - RNA, 23 nt, Homo sapiens
uuauuaaucauacaaacucucac

SEQ ID NO: 1329600 - RNA, 17 nt, Homo sapiens
uuauuacuaauugucua

SEQ ID NO: 1329601 - RNA, 16 nt, Homo sapiens
uuauuauuucuaaucc

SEQ ID NO: 1329602 - RNA, 23 nt, Homo sapiens
uuauuccuuuguuacuucucuaa

SEQ ID NO: 1329603 - RNA, 19 nt, Homo sapiens
uuauugaauucauuucacu

SEQ ID NO: 1329604 - RNA, 21 nt, Homo sapiens
uuauuuacagcugugcuccac

SEQ ID NO: 1329605 - RNA, 13 nt, Homo sapiens
uuauuucugcucu

SEQ ID NO: 1329606 - RNA, 19 nt, Homo sapiens
uuauuuuuaagaaagaaau

SEQ ID NO: 1329607 - RNA, 14 nt, Homo sapiens
uuauuuuuccagcu

SEQ ID NO: 1329608 - RNA, 19 nt, Homo sapiens
uuauuuuuguuagcaaaga

SEQ ID NO: 1329609 - RNA, 22 nt, Homo sapiens
uucaaaauacagauuugaauag

SEQ ID NO: 1329610 - RNA, 19 nt, Homo sapiens
uucaaacagucucaggaaa

SEQ ID NO: 1329611 - RNA, 12 nt, Homo sapiens
uucaaaugaauu

SEQ ID NO: 1329612 - RNA, 19 nt, Homo sapiens
uucaacagccaagcuggca

SEQ ID NO: 1329613 - RNA, 23 nt, Homo sapiens
uucaaccccgaggucccuguugu

SEQ ID NO: 1329614 - RNA, 15 nt, Homo sapiens
uucaagccucuaaac

SEQ ID NO: 1329615 - RNA, 12 nt, Homo sapiens
uucaagcucucc

SEQ ID NO: 1329616 - RNA, 17 nt, Homo sapiens
uucaagggucaggguga

SEQ ID NO: 1329617 - RNA, 14 nt, Homo sapiens
uucaauacuuacau

SEQ ID NO: 1329618 - RNA, 17 nt, Homo sapiens
uucaauagcauaucaca

SEQ ID NO: 1329619 - RNA, 19 nt, Homo sapiens
uucaauagcauaucacaga

SEQ ID NO: 1329620 - RNA, 12 nt, Homo sapiens
uucaaucucuug

SEQ ID NO: 1329621 - RNA, 16 nt, Homo sapiens
uucacaggcacuccug

SEQ ID NO: 1329622 - RNA, 11 nt, Homo sapiens
uucacaguauc

SEQ ID NO: 1329623 - RNA, 19 nt, Homo sapiens
uucacauucagaaguaauu

SEQ ID NO: 1329624 - RNA, 11 nt, Homo sapiens
uucaccaaaga

SEQ ID NO: 1329625 - RNA, 19 nt, Homo sapiens
uucaccuccaagcauuuca

SEQ ID NO: 1329626 - RNA, 13 nt, Homo sapiens
uucaccuuucuag

SEQ ID NO: 1329627 - RNA, 20 nt, Homo sapiens
uucacuguagaaugauuuca

SEQ ID NO: 1329628 - RNA, 19 nt, Homo sapiens
uucacuuaaguuaguucca

SEQ ID NO: 1329629 - RNA, 19 nt, Homo sapiens
uucagaaagccuauuccau

SEQ ID NO: 1329630 - RNA, 23 nt, Homo sapiens
uucagaagaaucuuccuggcaca

SEQ ID NO: 1329631 - RNA, 23 nt, Homo sapiens
uucagacucccauuccugaagaa

SEQ ID NO: 1329632 - RNA, 17 nt, Homo sapiens
uucagacuugauuuaca

SEQ ID NO: 1329633 - RNA, 15 nt, Homo sapiens
uucagauuugccuua

SEQ ID NO: 1329634 - RNA, 16 nt, Homo sapiens
uucagcaagauaaaca

SEQ ID NO: 1329635 - RNA, 22 nt, Homo sapiens
uucagcagagaagguaaggugu

SEQ ID NO: 1329636 - RNA, 18 nt, Homo sapiens
uucaggcaacgcacaaaa

SEQ ID NO: 1329637 - RNA, 19 nt, Homo sapiens
uucagugagccccucccca

SEQ ID NO: 1329638 - RNA, 23 nt, Homo sapiens
uucagugcaguuucuuuucacau

SEQ ID NO: 1329639 - RNA, 13 nt, Homo sapiens
uucagugcaucau

SEQ ID NO: 1329640 - RNA, 21 nt, Homo sapiens
uucaguucuuacacauuccau

SEQ ID NO: 1329641 - RNA, 17 nt, Homo sapiens
uucauaaagucuugccu

SEQ ID NO: 1329642 - RNA, 21 nt, Homo sapiens
uucauagugauagagugcagu

SEQ ID NO: 1329643 - RNA, 22 nt, Homo sapiens
uucaucagaacucuuccuccuc

SEQ ID NO: 1329644 - RNA, 13 nt, Homo sapiens
uucaucauuucag

SEQ ID NO: 1329645 - RNA, 14 nt, Homo sapiens
uucaugaagcaaga

SEQ ID NO: 1329646 - RNA, 21 nt, Homo sapiens
uucaugaguuuuucccagcua

SEQ ID NO: 1329647 - RNA, 12 nt, Homo sapiens
uucaugcacugu

SEQ ID NO: 1329648 - RNA, 15 nt, Homo sapiens
gcaaauuuucuucca

SEQ ID NO: 1329649 - RNA, 20 nt, Homo sapiens
gcaacaugccagccacugug

SEQ ID NO: 1329650 - RNA, 17 nt, Homo sapiens
gcaacucuaacucugag

SEQ ID NO: 1329651 - RNA, 17 nt, Homo sapiens
gcaacuggaguuccuua

SEQ ID NO: 1329652 - RNA, 15 nt, Homo sapiens
gcaagaacagugggc

SEQ ID NO: 1329653 - RNA, 17 nt, Homo sapiens
gcaagaucauagcucau

SEQ ID NO: 1329654 - RNA, 23 nt, Homo sapiens
gcaagauuccaaguucucaccuc

SEQ ID NO: 1329655 - RNA, 23 nt, Homo sapiens
gcaagguuuaggcugguggccca

SEQ ID NO: 1329656 - RNA, 15 nt, Homo sapiens
gcaagugaaagcaag

SEQ ID NO: 1329657 - RNA, 15 nt, Homo sapiens
gcaaguuaugaaaua

SEQ ID NO: 1329658 - RNA, 21 nt, Homo sapiens
gcaaucccagcuacuuggaag

SEQ ID NO: 1329659 - RNA, 23 nt, Homo sapiens
gcaaucuuugccuuuaucucuga

SEQ ID NO: 1329660 - RNA, 20 nt, Homo sapiens
gcaaugaagauccaagcaaa

SEQ ID NO: 1329661 - RNA, 22 nt, Homo sapiens
gcaaugcaugauacuaucugug

SEQ ID NO: 1329662 - RNA, 16 nt, Homo sapiens
gcaaugguuucacaug

SEQ ID NO: 1329663 - RNA, 21 nt, Homo sapiens
gcaauuuagaacuagauuuug

SEQ ID NO: 1329664 - RNA, 23 nt, Homo sapiens
gcacacgcugcucugccccagcu

SEQ ID NO: 1329665 - RNA, 18 nt, Homo sapiens
gcacagagggaagccaug

SEQ ID NO: 1329666 - RNA, 16 nt, Homo sapiens
gcacaguaucugcugu

SEQ ID NO: 1329667 - RNA, 14 nt, Homo sapiens
gcacauagagccag

SEQ ID NO: 1329668 - RNA, 13 nt, Homo sapiens
gcacauggugugg

SEQ ID NO: 1329669 - RNA, 17 nt, Homo sapiens
gcaccaaagacaucagu

SEQ ID NO: 1329670 - RNA, 17 nt, Homo sapiens
gcaccaaccuccagacu

SEQ ID NO: 1329671 - RNA, 13 nt, Homo sapiens
gcaccaugcugcu

SEQ ID NO: 1329672 - RNA, 12 nt, Homo sapiens
gcacccauucca

SEQ ID NO: 1329673 - RNA, 21 nt, Homo sapiens
gcacccggcucguguauuuau

SEQ ID NO: 1329674 - RNA, 13 nt, Homo sapiens
gcacccuacaggg

SEQ ID NO: 1329675 - RNA, 16 nt, Homo sapiens
gcaccuaaaugaugcc

SEQ ID NO: 1329676 - RNA, 15 nt, Homo sapiens
gcaccuaauccaggc

SEQ ID NO: 1329677 - RNA, 21 nt, Homo sapiens
gcaccuaccuuagaaaacaag

SEQ ID NO: 1329678 - RNA, 23 nt, Homo sapiens
gcaccuaugagauggccaugcuc

SEQ ID NO: 1329679 - RNA, 13 nt, Homo sapiens
gcaccugaccaca

SEQ ID NO: 1329680 - RNA, 22 nt, Homo sapiens
gcacguguggccuguucuucua

SEQ ID NO: 1329681 - RNA, 23 nt, Homo sapiens
gcacucacaccacuaacaugccc

SEQ ID NO: 1329682 - RNA, 19 nt, Homo sapiens
gcacucagauuuaagccuu

SEQ ID NO: 1329683 - RNA, 17 nt, Homo sapiens
gcacugaaccacauuca

SEQ ID NO: 1329684 - RNA, 16 nt, Homo sapiens
gcacugagcagggauc

SEQ ID NO: 1329685 - RNA, 16 nt, Homo sapiens
gcacugaggaccagcc

SEQ ID NO: 1329686 - RNA, 20 nt, Homo sapiens
gcacuuaaguguuagaucua

SEQ ID NO: 1329687 - RNA, 15 nt, Homo sapiens
gcacuuauugaauau

SEQ ID NO: 1329688 - RNA, 22 nt, Homo sapiens
gcagaacucuugacuuccugcc

SEQ ID NO: 1329689 - RNA, 16 nt, Homo sapiens
gcagacucgggaccaa

SEQ ID NO: 1329690 - RNA, 20 nt, Homo sapiens
gcagagaaccaaaggggcca

SEQ ID NO: 1329691 - RNA, 15 nt, Homo sapiens
gcagagaaccugcuc

SEQ ID NO: 1329692 - RNA, 16 nt, Homo sapiens
gcagagaccauaagag

SEQ ID NO: 1329693 - RNA, 14 nt, Homo sapiens
gcagauacuuugaa

SEQ ID NO: 1329694 - RNA, 19 nt, Homo sapiens
gcagaucacguugcaaugg

SEQ ID NO: 1329695 - RNA, 16 nt, Homo sapiens
gcagcaacuauucaca

SEQ ID NO: 1329696 - RNA, 18 nt, Homo sapiens
gcagcaccaaccacagca

SEQ ID NO: 1329697 - RNA, 14 nt, Homo sapiens
gcagccagggccag

SEQ ID NO: 1329698 - RNA, 18 nt, Homo sapiens
gcagcccguguccaggag

SEQ ID NO: 1329699 - RNA, 12 nt, Homo sapiens
gcagcucaggga

SEQ ID NO: 1329700 - RNA, 22 nt, Homo sapiens
gcagcuccacagggcagggccu

SEQ ID NO: 1329701 - RNA, 13 nt, Homo sapiens
gcagcucuacucu

SEQ ID NO: 1329702 - RNA, 20 nt, Homo sapiens
gcagcugaaauucaccaaga

SEQ ID NO: 1329703 - RNA, 14 nt, Homo sapiens
gcagcugaugcugu

SEQ ID NO: 1329704 - RNA, 18 nt, Homo sapiens
gcagcuuuuucaaagugu

SEQ ID NO: 1329705 - RNA, 18 nt, Homo sapiens
gcaggaaauacuuuguaa

SEQ ID NO: 1329706 - RNA, 14 nt, Homo sapiens
gcaggaaggaacaa

SEQ ID NO: 1329707 - RNA, 14 nt, Homo sapiens
gcaggagaaucacu

SEQ ID NO: 1329708 - RNA, 17 nt, Homo sapiens
gcaggagaaucgcuuga

SEQ ID NO: 1329709 - RNA, 13 nt, Homo sapiens
gcaggccagagaa

SEQ ID NO: 1329710 - RNA, 19 nt, Homo sapiens
gcaggccagagaaagcaaa

SEQ ID NO: 1329711 - RNA, 15 nt, Homo sapiens
gcagggaugauggca

SEQ ID NO: 1329712 - RNA, 20 nt, Homo sapiens
gcagggggugugucugcuca

SEQ ID NO: 1329713 - RNA, 16 nt, Homo sapiens
gcagguguucugcuga

SEQ ID NO: 1329714 - RNA, 21 nt, Homo sapiens
gcaguaacuccccaacucccu

SEQ ID NO: 1329715 - RNA, 17 nt, Homo sapiens
gcaguacuuuaccuccu

SEQ ID NO: 1329716 - RNA, 19 nt, Homo sapiens
gcaguagugcaccaucuca

SEQ ID NO: 1329717 - RNA, 17 nt, Homo sapiens
gcagucaauuuucacau

SEQ ID NO: 1329718 - RNA, 21 nt, Homo sapiens
gcagucggugguaccugagau

SEQ ID NO: 1329719 - RNA, 14 nt, Homo sapiens
gcagucuaauuaca

SEQ ID NO: 1329720 - RNA, 15 nt, Homo sapiens
gcagucuaauuacau

SEQ ID NO: 1329721 - RNA, 21 nt, Homo sapiens
gcagucuaauuacauuucacu

SEQ ID NO: 1329722 - RNA, 13 nt, Homo sapiens
gcagugaugucac

SEQ ID NO: 1329723 - RNA, 17 nt, Homo sapiens
gcaguguucaaggccau

SEQ ID NO: 1329724 - RNA, 13 nt, Homo sapiens
gcaguuaauuuau

SEQ ID NO: 1329725 - RNA, 13 nt, Homo sapiens
gcaguuaccaagu

SEQ ID NO: 1329726 - RNA, 14 nt, Homo sapiens
gcaguucaaaaaca

SEQ ID NO: 1329727 - RNA, 19 nt, Homo sapiens
gcaguugaaaagacuccaa

SEQ ID NO: 1329728 - RNA, 17 nt, Homo sapiens
gcaguuguuauauucau

SEQ ID NO: 1329729 - RNA, 22 nt, Homo sapiens
gcauaaauccauccauccaaag

SEQ ID NO: 1329730 - RNA, 13 nt, Homo sapiens
gcauaaaugcauu

SEQ ID NO: 1329731 - RNA, 12 nt, Homo sapiens
gcauaacuuauu

SEQ ID NO: 1329732 - RNA, 18 nt, Homo sapiens
gcauaaguuaacuuccaa

SEQ ID NO: 1329733 - RNA, 14 nt, Homo sapiens
gcauaggcucuuaa

SEQ ID NO: 1329734 - RNA, 14 nt, Homo sapiens
gcauaucacagaga

SEQ ID NO: 1329735 - RNA, 23 nt, Homo sapiens
gcauaucccaccaaccuccagug

SEQ ID NO: 1329736 - RNA, 20 nt, Homo sapiens
gcauaugggugggauuuugc

SEQ ID NO: 1329737 - RNA, 19 nt, Homo sapiens
gcaucagaccugcauugaa

SEQ ID NO: 1329738 - RNA, 11 nt, Homo sapiens
gcaucauucac

SEQ ID NO: 1329739 - RNA, 23 nt, Homo sapiens
gcaucccuagucucuacccagua

SEQ ID NO: 1329740 - RNA, 23 nt, Homo sapiens
gcaucgggagcacccagagcacc

SEQ ID NO: 1329741 - RNA, 17 nt, Homo sapiens
gcaucucagccuccuga

SEQ ID NO: 1329742 - RNA, 16 nt, Homo sapiens
gcaucuuccacuggaa

SEQ ID NO: 1329743 - RNA, 16 nt, Homo sapiens
gcaugacaaguacugu

SEQ ID NO: 1329744 - RNA, 20 nt, Homo sapiens
gcaugacucuucaaccccga

SEQ ID NO: 1329745 - RNA, 19 nt, Homo sapiens
gcaugauauuguucuccaa

SEQ ID NO: 1329746 - RNA, 21 nt, Homo sapiens
gcaugcccccuccugcaaggg

SEQ ID NO: 1329747 - RNA, 14 nt, Homo sapiens
gcauggaacagcau

SEQ ID NO: 1329748 - RNA, 17 nt, Homo sapiens
gcauggaacagcauuac

SEQ ID NO: 1329749 - RNA, 21 nt, Homo sapiens
gcauuagcaaggcagagccuu

SEQ ID NO: 1329750 - RNA, 23 nt, Homo sapiens
gcauuauaaauaaauaccaaaaa

SEQ ID NO: 1329751 - RNA, 22 nt, Homo sapiens
gcauucaaaaagacagcagaca

SEQ ID NO: 1329752 - RNA, 17 nt, Homo sapiens
gcauuguaaaugugcuu

SEQ ID NO: 1329753 - RNA, 14 nt, Homo sapiens
gcauuguguggaau

SEQ ID NO: 1329754 - RNA, 23 nt, Homo sapiens
gccaaaaauacagccuauaguaa

SEQ ID NO: 1329755 - RNA, 17 nt, Homo sapiens
gccaaaacaagccaaag

SEQ ID NO: 1329756 - RNA, 14 nt, Homo sapiens
gccaaaagcugcuc

SEQ ID NO: 1329757 - RNA, 18 nt, Homo sapiens
gccaaaggaugugauaua

SEQ ID NO: 1329758 - RNA, 14 nt, Homo sapiens
gccaacccuuucau

SEQ ID NO: 1329759 - RNA, 15 nt, Homo sapiens
gccaacccuuucauu

SEQ ID NO: 1329760 - RNA, 15 nt, Homo sapiens
gccaacugcuuggac

SEQ ID NO: 1329761 - RNA, 16 nt, Homo sapiens
gccaagccaaccgugg

SEQ ID NO: 1329762 - RNA, 17 nt, Homo sapiens
gccaagcuggcacaaaa

SEQ ID NO: 1329763 - RNA, 11 nt, Homo sapiens
gccaaggagcu

SEQ ID NO: 1329764 - RNA, 14 nt, Homo sapiens
gccaaggagcugcu

SEQ ID NO: 1329765 - RNA, 20 nt, Homo sapiens
gccaaggagggugagugcaa

SEQ ID NO: 1329766 - RNA, 23 nt, Homo sapiens
gccaagggauggacaucuuguca

SEQ ID NO: 1329767 - RNA, 20 nt, Homo sapiens
gccaagggguagaaguggca

SEQ ID NO: 1329768 - RNA, 16 nt, Homo sapiens
gccaaguuccaaaaua

SEQ ID NO: 1329769 - RNA, 12 nt, Homo sapiens
gccaauccaugc

SEQ ID NO: 1329770 - RNA, 18 nt, Homo sapiens
gccaauggagacugucuc

SEQ ID NO: 1329771 - RNA, 15 nt, Homo sapiens
gccaauuuucuucau

SEQ ID NO: 1329772 - RNA, 12 nt, Homo sapiens
gccacacucugg

SEQ ID NO: 1329773 - RNA, 12 nt, Homo sapiens
gccacagacuga

SEQ ID NO: 1329774 - RNA, 16 nt, Homo sapiens
gccacagucacuggau

SEQ ID NO: 1329775 - RNA, 14 nt, Homo sapiens
gccacagugcaauu

SEQ ID NO: 1329776 - RNA, 21 nt, Homo sapiens
gccacaguggggcugcaggca

SEQ ID NO: 1329777 - RNA, 21 nt, Homo sapiens
gccacaucuccuguggucucu

SEQ ID NO: 1329778 - RNA, 22 nt, Homo sapiens
gccacccaaggaugucugccac

SEQ ID NO: 1329779 - RNA, 20 nt, Homo sapiens
gccacccaggaacuccugac

SEQ ID NO: 1329780 - RNA, 15 nt, Homo sapiens
gccaccucacugcag

SEQ ID NO: 1329781 - RNA, 15 nt, Homo sapiens
gccaccugcaggacc

SEQ ID NO: 1329782 - RNA, 16 nt, Homo sapiens
gccacggccuggcugg

SEQ ID NO: 1329783 - RNA, 19 nt, Homo sapiens
gccacucaggggucauuca

SEQ ID NO: 1329784 - RNA, 10 nt, Homo sapiens
gccacucccc

SEQ ID NO: 1329785 - RNA, 15 nt, Homo sapiens
gccacuggaccucag

SEQ ID NO: 1329786 - RNA, 21 nt, Homo sapiens
gccacugggccugucacugau

SEQ ID NO: 1329787 - RNA, 23 nt, Homo sapiens
gccacuuucauuggacccugacu

SEQ ID NO: 1329788 - RNA, 23 nt, Homo sapiens
gccagaacguggcucugcuggcc

SEQ ID NO: 1329789 - RNA, 19 nt, Homo sapiens
gccagacaugccacaagga

SEQ ID NO: 1329790 - RNA, 13 nt, Homo sapiens
gccagagaauaga

SEQ ID NO: 1329791 - RNA, 17 nt, Homo sapiens
gccagagauccaaaaga

SEQ ID NO: 1329792 - RNA, 13 nt, Homo sapiens
gccagagccucug

SEQ ID NO: 1329793 - RNA, 22 nt, Homo sapiens
gccagagguaauguuaguaaau

SEQ ID NO: 1329794 - RNA, 16 nt, Homo sapiens
gccagcagggcaucuu

SEQ ID NO: 1329795 - RNA, 18 nt, Homo sapiens
gccagccucagaaggccc

SEQ ID NO: 1329796 - RNA, 14 nt, Homo sapiens
gccagcucucagga

SEQ ID NO: 1329797 - RNA, 16 nt, Homo sapiens
gccagcugugcacuuu

SEQ ID NO: 1329798 - RNA, 17 nt, Homo sapiens
gccagcugugcacuuuc

SEQ ID NO: 1329799 - RNA, 14 nt, Homo sapiens
gccaggcucaggag

SEQ ID NO: 1329800 - RNA, 23 nt, Homo sapiens
gccaggcuguuggaaaauccaga

SEQ ID NO: 1329801 - RNA, 15 nt, Homo sapiens
gccagguccuugccc

SEQ ID NO: 1329802 - RNA, 21 nt, Homo sapiens
gccaguggcuggaucugugag

SEQ ID NO: 1329803 - RNA, 14 nt, Homo sapiens
gccauaacuugaaa

SEQ ID NO: 1329804 - RNA, 13 nt, Homo sapiens
gccauaauguugc

SEQ ID NO: 1329805 - RNA, 19 nt, Homo sapiens
gccauaggguccugaaugu

SEQ ID NO: 1329806 - RNA, 14 nt, Homo sapiens
gccauauuaccccu

SEQ ID NO: 1329807 - RNA, 16 nt, Homo sapiens
gccauccaauuucucu

SEQ ID NO: 1329808 - RNA, 21 nt, Homo sapiens
gccauccccaccuucaccucg

SEQ ID NO: 1329809 - RNA, 15 nt, Homo sapiens
gccaucguucaucca

SEQ ID NO: 1329810 - RNA, 15 nt, Homo sapiens
gccaucucuuccuca

SEQ ID NO: 1329811 - RNA, 18 nt, Homo sapiens
gccaugccuccucaggag

SEQ ID NO: 1329812 - RNA, 22 nt, Homo sapiens
gccaugcucaaccccccuccca

SEQ ID NO: 1329813 - RNA, 23 nt, Homo sapiens
gccauggaagguucucugugcuc

SEQ ID NO: 1329814 - RNA, 16 nt, Homo sapiens
gccauuaacaaugacc

SEQ ID NO: 1329815 - RNA, 13 nt, Homo sapiens
gccauuugugaua

SEQ ID NO: 1329816 - RNA, 16 nt, Homo sapiens
gccauuuuugugcuuu

SEQ ID NO: 1329817 - RNA, 14 nt, Homo sapiens
gcccaaacccuuaa

SEQ ID NO: 1329818 - RNA, 17 nt, Homo sapiens
gcccaaagaaagagcua

SEQ ID NO: 1329819 - RNA, 13 nt, Homo sapiens
gcccaaggcgaua

SEQ ID NO: 1329820 - RNA, 13 nt, Homo sapiens
gcccaaugcugcu

SEQ ID NO: 1329821 - RNA, 14 nt, Homo sapiens
gcccagagcccagc

SEQ ID NO: 1329822 - RNA, 12 nt, Homo sapiens
gcccagcacuug

SEQ ID NO: 1329823 - RNA, 15 nt, Homo sapiens
gcccagcacuugaau

SEQ ID NO: 1329824 - RNA, 22 nt, Homo sapiens
gcccagccaggccaacagcacc

SEQ ID NO: 1329825 - RNA, 16 nt, Homo sapiens
gcccagcucggaucaa

SEQ ID NO: 1329826 - RNA, 18 nt, Homo sapiens
gcccaggcuagagugcaa

SEQ ID NO: 1329827 - RNA, 20 nt, Homo sapiens
gcccaggcuagagugcaaug

SEQ ID NO: 1329828 - RNA, 20 nt, Homo sapiens
gcccaggcuggagugcagug

SEQ ID NO: 1329829 - RNA, 12 nt, Homo sapiens
gcccagggccag

SEQ ID NO: 1329830 - RNA, 15 nt, Homo sapiens
gcccagucgacccca

SEQ ID NO: 1329831 - RNA, 16 nt, Homo sapiens
gccccagccccuucca

SEQ ID NO: 1329832 - RNA, 13 nt, Homo sapiens
gccccauguaucu

SEQ ID NO: 1329833 - RNA, 21 nt, Homo sapiens
gccccgacguuugcggcagug

SEQ ID NO: 1329834 - RNA, 17 nt, Homo sapiens
gccccggccuccucgga

SEQ ID NO: 1329835 - RNA, 20 nt, Homo sapiens
gccccgucuguggcuuucag

SEQ ID NO: 1329836 - RNA, 16 nt, Homo sapiens
gccccucacacugcaa

SEQ ID NO: 1329837 - RNA, 17 nt, Homo sapiens
gccccugcuccagaaga

SEQ ID NO: 1329838 - RNA, 14 nt, Homo sapiens
gccccuuucaggag

SEQ ID NO: 1329839 - RNA, 16 nt, Homo sapiens
gcccuaaaagcacacu

SEQ ID NO: 1329840 - RNA, 17 nt, Homo sapiens
gcccuauuucuugauaa

SEQ ID NO: 1329841 - RNA, 17 nt, Homo sapiens
gcccucaaguaaaagaa

SEQ ID NO: 1329842 - RNA, 20 nt, Homo sapiens
gcccucagccccacuucuca

SEQ ID NO: 1329843 - RNA, 21 nt, Homo sapiens
gcccuccacgccggcucuucc

SEQ ID NO: 1329844 - RNA, 18 nt, Homo sapiens
gcccuccucugcacuccc

SEQ ID NO: 1329845 - RNA, 13 nt, Homo sapiens
gcccucuauuuau

SEQ ID NO: 1329846 - RNA, 13 nt, Homo sapiens
gcccugcaccaug

SEQ ID NO: 1329847 - RNA, 15 nt, Homo sapiens
gcccugcccaaccuc

SEQ ID NO: 1329848 - RNA, 19 nt, Homo sapiens
gcccugcccuuacaggaac

SEQ ID NO: 1329849 - RNA, 21 nt, Homo sapiens
gcccuguuucuggucuucgca

SEQ ID NO: 1329850 - RNA, 19 nt, Homo sapiens
gcccuuugcuaaaauauaa

SEQ ID NO: 1329851 - RNA, 15 nt, Homo sapiens
gccgcagaccuggag

SEQ ID NO: 1329852 - RNA, 11 nt, Homo sapiens
gccgcuagucu

SEQ ID NO: 1329853 - RNA, 16 nt, Homo sapiens
gccgggcugacugccc

SEQ ID NO: 1329854 - RNA, 23 nt, Homo sapiens
gccgguccuucccucucaugacu

SEQ ID NO: 1329855 - RNA, 16 nt, Homo sapiens
gccguccggcggcccc

SEQ ID NO: 1329856 - RNA, 23 nt, Homo sapiens
gccguuuccccuccuuggcuuua

SEQ ID NO: 1329857 - RNA, 19 nt, Homo sapiens
gccuaaauuuaaugcugcc

SEQ ID NO: 1329858 - RNA, 12 nt, Homo sapiens
gccuacauucac

SEQ ID NO: 1329859 - RNA, 12 nt, Homo sapiens
gccuaucugacu

SEQ ID NO: 1329860 - RNA, 22 nt, Homo sapiens
gccuauuaucugucagcugcaa

SEQ ID NO: 1329861 - RNA, 16 nt, Homo sapiens
gccucaaguuauuuca

SEQ ID NO: 1329862 - RNA, 11 nt, Homo sapiens
gccucaucucu

SEQ ID NO: 1329863 - RNA, 23 nt, Homo sapiens
gccucauuauuuuucacugcccc

SEQ ID NO: 1329864 - RNA, 21 nt, Homo sapiens
gccuccaaaaauggcagugac

SEQ ID NO: 1329865 - RNA, 17 nt, Homo sapiens
gccuccaccagcaaggg

SEQ ID NO: 1329866 - RNA, 14 nt, Homo sapiens
gccucccaccagag

SEQ ID NO: 1329867 - RNA, 21 nt, Homo sapiens
gccuccccaugggcacagugg

SEQ ID NO: 1329868 - RNA, 22 nt, Homo sapiens
gccuccugggaacacaucuggc

SEQ ID NO: 1329869 - RNA, 18 nt, Homo sapiens
gccugaagaguccucuga

SEQ ID NO: 1329870 - RNA, 18 nt, Homo sapiens
gccugaaggcuauccacu

SEQ ID NO: 1329871 - RNA, 22 nt, Homo sapiens
gccugaggcaauuagacacuuu

SEQ ID NO: 1329872 - RNA, 13 nt, Homo sapiens
gccugagucaccu

SEQ ID NO: 1329873 - RNA, 14 nt, Homo sapiens
gccugcuucuucuc

SEQ ID NO: 1329874 - RNA, 15 nt, Homo sapiens
gccuggaggugggca

SEQ ID NO: 1329875 - RNA, 21 nt, Homo sapiens
gccuggcccgcuaaggugaaa

SEQ ID NO: 1329876 - RNA, 21 nt, Homo sapiens
gccugggaccucccacugccc

SEQ ID NO: 1329877 - RNA, 21 nt, Homo sapiens
gccuggggcaggucacuuuac

SEQ ID NO: 1329878 - RNA, 15 nt, Homo sapiens
gccuggggucuggag

SEQ ID NO: 1329879 - RNA, 22 nt, Homo sapiens
gccugggguggggucaugcccu

SEQ ID NO: 1329880 - RNA, 23 nt, Homo sapiens
gccugggguggggucaugcccuc

SEQ ID NO: 1329881 - RNA, 16 nt, Homo sapiens
gccugggugacauuug

SEQ ID NO: 1329882 - RNA, 12 nt, Homo sapiens
gccugguuuguu

SEQ ID NO: 1329883 - RNA, 22 nt, Homo sapiens
gccuguaacacauaguggcuuc

SEQ ID NO: 1329884 - RNA, 19 nt, Homo sapiens
gccuguaaucucagcacuu

SEQ ID NO: 1329885 - RNA, 20 nt, Homo sapiens
gccuguaaucucagcacuuu

SEQ ID NO: 1329886 - RNA, 22 nt, Homo sapiens
gccuguagucccagcuacucag

SEQ ID NO: 1329887 - RNA, 21 nt, Homo sapiens
gccugucuuaauuuucuuuca

SEQ ID NO: 1329888 - RNA, 18 nt, Homo sapiens
gccuguggcuaauggagg

SEQ ID NO: 1329889 - RNA, 20 nt, Homo sapiens
gccugugggcgcauacuaca

SEQ ID NO: 1329890 - RNA, 20 nt, Homo sapiens
gccuuaaacacacauugcag

SEQ ID NO: 1329891 - RNA, 12 nt, Homo sapiens
gccuuaaauaua

SEQ ID NO: 1329892 - RNA, 23 nt, Homo sapiens
gccuuacaaagggaaagccucug

SEQ ID NO: 1329893 - RNA, 20 nt, Homo sapiens
gccuuacaucuggcuggaaa

SEQ ID NO: 1329894 - RNA, 14 nt, Homo sapiens
gccuuaccuugaaa

SEQ ID NO: 1329895 - RNA, 16 nt, Homo sapiens
gccuuauaaaccaauc

SEQ ID NO: 1329896 - RNA, 14 nt, Homo sapiens
gccuucacauuugg

SEQ ID NO: 1329897 - RNA, 20 nt, Homo sapiens
gccuuccccugggcccugac

SEQ ID NO: 1329898 - RNA, 17 nt, Homo sapiens
gccuuccggguucaagu

SEQ ID NO: 1329899 - RNA, 13 nt, Homo sapiens
gccuucucaggaa

SEQ ID NO: 1329900 - RNA, 14 nt, Homo sapiens
gccuugcaacccaa

SEQ ID NO: 1329901 - RNA, 20 nt, Homo sapiens
gccuugggauagcaaacucc

SEQ ID NO: 1329902 - RNA, 16 nt, Homo sapiens
gccuuuaagccaaaga

SEQ ID NO: 1329903 - RNA, 18 nt, Homo sapiens
gccuuuauauccaaaaua

SEQ ID NO: 1329904 - RNA, 19 nt, Homo sapiens
gccuuuccccccagagggc

SEQ ID NO: 1329905 - RNA, 12 nt, Homo sapiens
gccuuucuuugc

SEQ ID NO: 1329906 - RNA, 13 nt, Homo sapiens
gcgagcagucagc

SEQ ID NO: 1329907 - RNA, 20 nt, Homo sapiens
gcgagcagucagcauucuua

SEQ ID NO: 1329908 - RNA, 19 nt, Homo sapiens
gcgcagcaucccuagucuc

SEQ ID NO: 1329909 - RNA, 20 nt, Homo sapiens
gcgccacccgggcaaggguc

SEQ ID NO: 1329910 - RNA, 19 nt, Homo sapiens
gcgccaccucacugcagua

SEQ ID NO: 1329911 - RNA, 14 nt, Homo sapiens
gcgccagugacagu

SEQ ID NO: 1329912 - RNA, 15 nt, Homo sapiens
gcgcucccuugccuu

SEQ ID NO: 1329913 - RNA, 19 nt, Homo sapiens
gcggaaggucccucagaca

SEQ ID NO: 1329914 - RNA, 14 nt, Homo sapiens
gcggacaucagcug

SEQ ID NO: 1329915 - RNA, 17 nt, Homo sapiens
gcggauccaagcaaaug

SEQ ID NO: 1329916 - RNA, 12 nt, Homo sapiens
gcggccacugcg

SEQ ID NO: 1329917 - RNA, 14 nt, Homo sapiens
gcguacagaucucu

SEQ ID NO: 1329918 - RNA, 18 nt, Homo sapiens
gcugacuguacuccuccc

SEQ ID NO: 1329919 - RNA, 23 nt, Homo sapiens
gcugagcagguguucuucauuac

SEQ ID NO: 1329920 - RNA, 17 nt, Homo sapiens
gcugagccuggucccac

SEQ ID NO: 1329921 - RNA, 14 nt, Homo sapiens
gcugaggacacuca

SEQ ID NO: 1329922 - RNA, 18 nt, Homo sapiens
gcugaggccucucauucc

SEQ ID NO: 1329923 - RNA, 22 nt, Homo sapiens
gcugaggccucucauuccagag

SEQ ID NO: 1329924 - RNA, 14 nt, Homo sapiens
gcugagugaguuca

SEQ ID NO: 1329925 - RNA, 18 nt, Homo sapiens
gcugauacuucuacaacu

SEQ ID NO: 1329926 - RNA, 20 nt, Homo sapiens
gcugauacuucuacaacuuu

SEQ ID NO: 1329927 - RNA, 14 nt, Homo sapiens
gcugcaacccaagu

SEQ ID NO: 1329928 - RNA, 22 nt, Homo sapiens
gcugcacccugcgccuccagag

SEQ ID NO: 1329929 - RNA, 21 nt, Homo sapiens
gcugcagguguucugcugaua

SEQ ID NO: 1329930 - RNA, 16 nt, Homo sapiens
gcugccagggcuuccu

SEQ ID NO: 1329931 - RNA, 18 nt, Homo sapiens
gcugcccuagcugacccc

SEQ ID NO: 1329932 - RNA, 16 nt, Homo sapiens
gcugccucaggaccca

SEQ ID NO: 1329933 - RNA, 17 nt, Homo sapiens
gcugccugcugugcugg

SEQ ID NO: 1329934 - RNA, 22 nt, Homo sapiens
gcugcuccuucgcccucuugua

SEQ ID NO: 1329935 - RNA, 22 nt, Homo sapiens
gcugcuucuuauuaaucauaca

SEQ ID NO: 1329936 - RNA, 22 nt, Homo sapiens
gcuggaaaaggccuguggccca

SEQ ID NO: 1329937 - RNA, 12 nt, Homo sapiens
gcuggaauucua

SEQ ID NO: 1329938 - RNA, 19 nt, Homo sapiens
gcuggagcagucugaggaa

SEQ ID NO: 1329939 - RNA, 20 nt, Homo sapiens
gcuggaugucuccaucucug

SEQ ID NO: 1329940 - RNA, 22 nt, Homo sapiens
gcuggauuacaggcaugugcca

SEQ ID NO: 1329941 - RNA, 17 nt, Homo sapiens
gcuggccccuucugggg

SEQ ID NO: 1329942 - RNA, 13 nt, Homo sapiens
gcuggcccugccg

SEQ ID NO: 1329943 - RNA, 15 nt, Homo sapiens
gcugggccagugcau

SEQ ID NO: 1329944 - RNA, 15 nt, Homo sapiens
gcugguggugcugca

SEQ ID NO: 1329945 - RNA, 22 nt, Homo sapiens
gcuguaaacuaccauguggcca

SEQ ID NO: 1329946 - RNA, 19 nt, Homo sapiens
gcugucaggugugcaugaa

SEQ ID NO: 1329947 - RNA, 14 nt, Homo sapiens
gcuguuaaucugau

SEQ ID NO: 1329948 - RNA, 17 nt, Homo sapiens
gcuguuauuucuucccu

SEQ ID NO: 1329949 - RNA, 20 nt, Homo sapiens
gcuguuggaugcagcaauaa

SEQ ID NO: 1329950 - RNA, 17 nt, Homo sapiens
gcuguugucacaucuca

SEQ ID NO: 1329951 - RNA, 22 nt, Homo sapiens
gcuguuuuccucccuucugcua

SEQ ID NO: 1329952 - RNA, 15 nt, Homo sapiens
gcuguuuucuucuau

SEQ ID NO: 1329953 - RNA, 23 nt, Homo sapiens
gcuuaaaauccaaagugucauau

SEQ ID NO: 1329954 - RNA, 14 nt, Homo sapiens
gcuuagcuugaggg

SEQ ID NO: 1329955 - RNA, 17 nt, Homo sapiens
gcuuaggagacagauca

SEQ ID NO: 1329956 - RNA, 23 nt, Homo sapiens
gcuuauguuacagguuacgugag

SEQ ID NO: 1329957 - RNA, 22 nt, Homo sapiens
gcuuauucuuuuguucuugaaa

SEQ ID NO: 1329958 - RNA, 22 nt, Homo sapiens
gcuucagcucuucuugacauca

SEQ ID NO: 1329959 - RNA, 19 nt, Homo sapiens
gcuuccaugaugcacagua

SEQ ID NO: 1329960 - RNA, 23 nt, Homo sapiens
gcuucccuaaacugcagccucuc

SEQ ID NO: 1329961 - RNA, 23 nt, Homo sapiens
gcuuccgagaauagcuccacugg

SEQ ID NO: 1329962 - RNA, 23 nt, Homo sapiens
gcuuccuccccucggaaggugcg

SEQ ID NO: 1329963 - RNA, 16 nt, Homo sapiens
gcuucuccugugugau

SEQ ID NO: 1329964 - RNA, 23 nt, Homo sapiens
gcuucuccuucuccuucccauuu

SEQ ID NO: 1329965 - RNA, 15 nt, Homo sapiens
gcuucuucacaggca

SEQ ID NO: 1329966 - RNA, 14 nt, Homo sapiens
gcuugcucauuaau

SEQ ID NO: 1329967 - RNA, 16 nt, Homo sapiens
gcuuggaguucucuau

SEQ ID NO: 1329968 - RNA, 18 nt, Homo sapiens
gcuuguauuccaagcaua

SEQ ID NO: 1329969 - RNA, 16 nt, Homo sapiens
gcuuuaucaauagccc

SEQ ID NO: 1329970 - RNA, 12 nt, Homo sapiens
gcuuuaugcaaa

SEQ ID NO: 1329971 - RNA, 14 nt, Homo sapiens
gcuuucagagccag

SEQ ID NO: 1329972 - RNA, 20 nt, Homo sapiens
gcuuugaaaagucacuuacu

SEQ ID NO: 1329973 - RNA, 13 nt, Homo sapiens
gcuuugcagugaa

SEQ ID NO: 1329974 - RNA, 16 nt, Homo sapiens
gcuuugcuuagcuugu

SEQ ID NO: 1329975 - RNA, 16 nt, Homo sapiens
gcuuugcuuucugcuc

SEQ ID NO: 1329976 - RNA, 21 nt, Homo sapiens
gcuuugguuccuucucugggu

SEQ ID NO: 1329977 - RNA, 16 nt, Homo sapiens
gcuuuuaaacugauua

SEQ ID NO: 1329978 - RNA, 14 nt, Homo sapiens
ggaaaaacugacag

SEQ ID NO: 1329979 - RNA, 16 nt, Homo sapiens
ggaaaacgaagcucau

SEQ ID NO: 1329980 - RNA, 16 nt, Homo sapiens
ggaaaagauacccaaa

SEQ ID NO: 1329981 - RNA, 13 nt, Homo sapiens
ggaaaagcaagaa

SEQ ID NO: 1329982 - RNA, 24 nt, Homo sapiens
ggaaaaucuucacuuucuuaagca

SEQ ID NO: 1329983 - RNA, 14 nt, Homo sapiens
ggaaaauguauuua

SEQ ID NO: 1329984 - RNA, 11 nt, Homo sapiens
ggaaacagcau

SEQ ID NO: 1329985 - RNA, 21 nt, Homo sapiens
ggaaacguuuuguauaguuau

SEQ ID NO: 1329986 - RNA, 17 nt, Homo sapiens
ggaacaguguaaauccc

SEQ ID NO: 1329987 - RNA, 21 nt, Homo sapiens
ggaaccucagccuggccagac

SEQ ID NO: 1329988 - RNA, 21 nt, Homo sapiens
ggaacguaguguucuuugcau

SEQ ID NO: 1329989 - RNA, 23 nt, Homo sapiens
ggaacuagaaagaaggacccaga

SEQ ID NO: 1329990 - RNA, 16 nt, Homo sapiens
ggaacucagauccagg

SEQ ID NO: 1329991 - RNA, 13 nt, Homo sapiens
ggaacuccugacu

SEQ ID NO: 1329992 - RNA, 23 nt, Homo sapiens
ggaacugggccaacucaccugag

SEQ ID NO: 1329993 - RNA, 12 nt, Homo sapiens
ggaagagguggc

SEQ ID NO: 1329994 - RNA, 10 nt, Homo sapiens
ggaagccagg

SEQ ID NO: 1329995 - RNA, 20 nt, Homo sapiens
ggaagcucccaccccacuca

SEQ ID NO: 1329996 - RNA, 20 nt, Homo sapiens
ggaagcuguccuggaggucc

SEQ ID NO: 1329997 - RNA, 23 nt, Homo sapiens
ggaagcuucuaaauggugcugca

SEQ ID NO: 1329998 - RNA, 14 nt, Homo sapiens
ggaaggaacaaaga

SEQ ID NO: 1329999 - RNA, 12 nt, Homo sapiens
uccauguugacu

SEQ ID NO: 1330000 - RNA, 17 nt, Homo sapiens
uccauugguguugacau

SEQ ID NO: 1330001 - RNA, 18 nt, Homo sapiens
uccauuuccuaauguaua

SEQ ID NO: 1330002 - RNA, 22 nt, Homo sapiens
uccauuuugugaauugugacau

SEQ ID NO: 1330003 - RNA, 19 nt, Homo sapiens
ucccaaauccuagacugcu

SEQ ID NO: 1330004 - RNA, 19 nt, Homo sapiens
ucccaacgugcaaagccaa

SEQ ID NO: 1330005 - RNA, 19 nt, Homo sapiens
ucccaaucuuucuauauaa

SEQ ID NO: 1330006 - RNA, 22 nt, Homo sapiens
ucccacaacuacuagugugacu

SEQ ID NO: 1330007 - RNA, 18 nt, Homo sapiens
ucccacacccuguuuuac

SEQ ID NO: 1330008 - RNA, 13 nt, Homo sapiens
ucccacacugugg

SEQ ID NO: 1330009 - RNA, 20 nt, Homo sapiens
ucccacaugaggccaucuca

SEQ ID NO: 1330010 - RNA, 16 nt, Homo sapiens
ucccaccauuccugcc

SEQ ID NO: 1330011 - RNA, 18 nt, Homo sapiens
ucccacccugcaaaggga

SEQ ID NO: 1330012 - RNA, 20 nt, Homo sapiens
ucccacucccggccugucau

SEQ ID NO: 1330013 - RNA, 11 nt, Homo sapiens
ucccacucugg

SEQ ID NO: 1330014 - RNA, 20 nt, Homo sapiens
ucccacugcucccccaacac

SEQ ID NO: 1330015 - RNA, 15 nt, Homo sapiens
ucccacuugucaugu

SEQ ID NO: 1330016 - RNA, 21 nt, Homo sapiens
ucccagaggagccaccaguuc

SEQ ID NO: 1330017 - RNA, 13 nt, Homo sapiens
ucccagcuacuca

SEQ ID NO: 1330018 - RNA, 14 nt, Homo sapiens
ucccaggacccuga

SEQ ID NO: 1330019 - RNA, 15 nt, Homo sapiens
ucccaguuaagugaa

SEQ ID NO: 1330020 - RNA, 15 nt, Homo sapiens
ucugggggcugagga

SEQ ID NO: 1330021 - RNA, 21 nt, Homo sapiens
ucugggguccauucucugagu

SEQ ID NO: 1330022 - RNA, 22 nt, Homo sapiens
ucugggguccauucucugaguc

SEQ ID NO: 1330023 - RNA, 23 nt, Homo sapiens
ucugggguccauucucugaguca

SEQ ID NO: 1330024 - RNA, 14 nt, Homo sapiens
ucugggucugaguc

SEQ ID NO: 1330025 - RNA, 19 nt, Homo sapiens
ucugggugaccucacuuua

SEQ ID NO: 1330026 - RNA, 18 nt, Homo sapiens
ucugggugauaaaauuau

SEQ ID NO: 1330027 - RNA, 22 nt, Homo sapiens
ucugguaauauugacuuguaua

SEQ ID NO: 1330028 - RNA, 22 nt, Homo sapiens
ucuguaaaagcagacccaccuc

SEQ ID NO: 1330029 - RNA, 15 nt, Homo sapiens
ucuguagugugaaac

SEQ ID NO: 1330030 - RNA, 18 nt, Homo sapiens
ucuguccugauuucuaca

SEQ ID NO: 1330031 - RNA, 24 nt, Homo sapiens
ucugucugggcucagacauccaca

SEQ ID NO: 1330032 - RNA, 12 nt, Homo sapiens
ucugucuugggc

SEQ ID NO: 1330033 - RNA, 19 nt, Homo sapiens
ucugugaagaaagagguua

SEQ ID NO: 1330034 - RNA, 15 nt, Homo sapiens
ucuguggcaaaaaga

SEQ ID NO: 1330035 - RNA, 13 nt, Homo sapiens
ucuguucacuuuu

SEQ ID NO: 1330036 - RNA, 17 nt, Homo sapiens
ucuguugaggcaucaaa

SEQ ID NO: 1330037 - RNA, 22 nt, Homo sapiens
ucuguuggaugacuuugagauu

SEQ ID NO: 1330038 - RNA, 14 nt, Homo sapiens
ucuguuucaaugua

SEQ ID NO: 1330039 - RNA, 15 nt, Homo sapiens
ucuguuucaauguau

SEQ ID NO: 1330040 - RNA, 16 nt, Homo sapiens
ucuguuuccucuguau

SEQ ID NO: 1330041 - RNA, 12 nt, Homo sapiens
ucuguuugaaac

SEQ ID NO: 1330042 - RNA, 19 nt, Homo sapiens
ucuuaaaccacagcacuau

SEQ ID NO: 1330043 - RNA, 23 nt, Homo sapiens
ucuuaaauuugauuuacauauau

SEQ ID NO: 1330044 - RNA, 13 nt, Homo sapiens
ucuuaacuugaag

SEQ ID NO: 1330045 - RNA, 17 nt, Homo sapiens
ucuuaagagaacauuau

SEQ ID NO: 1330046 - RNA, 18 nt, Homo sapiens
ucuuaagcagcauggaaa

SEQ ID NO: 1330047 - RNA, 22 nt, Homo sapiens
ucuuaaguggucuagucaagga

SEQ ID NO: 1330048 - RNA, 13 nt, Homo sapiens
ucuuacacacugg

SEQ ID NO: 1330049 - RNA, 16 nt, Homo sapiens
ucuuacccuguacaua

SEQ ID NO: 1330050 - RNA, 21 nt, Homo sapiens
ucuuacuaauguaaaaugauu

SEQ ID NO: 1330051 - RNA, 23 nt, Homo sapiens
ucuuagauauucacuaaggacuu

SEQ ID NO: 1330052 - RNA, 22 nt, Homo sapiens
ucuuagcccucaccacagccuu

SEQ ID NO: 1330053 - RNA, 11 nt, Homo sapiens
ucuuagcuguc

SEQ ID NO: 1330054 - RNA, 22 nt, Homo sapiens
ucuuaguguaugauuacuggcc

SEQ ID NO: 1330055 - RNA, 14 nt, Homo sapiens
ucuuagugugccaa

SEQ ID NO: 1330056 - RNA, 23 nt, Homo sapiens
ucuuauaguguuuggacagcuga

SEQ ID NO: 1330057 - RNA, 15 nt, Homo sapiens
ucuuauuaagacugg

SEQ ID NO: 1330058 - RNA, 14 nt, Homo sapiens
ucuuauuaaucaua

SEQ ID NO: 1330059 - RNA, 18 nt, Homo sapiens
ucuucacaacagauuauu

SEQ ID NO: 1330060 - RNA, 22 nt, Homo sapiens
ucuucacacgauugaccugucc

SEQ ID NO: 1330061 - RNA, 12 nt, Homo sapiens
ucuucacaggca

SEQ ID NO: 1330062 - RNA, 16 nt, Homo sapiens
ucuucacucuuugaag

SEQ ID NO: 1330063 - RNA, 12 nt, Homo sapiens
ucuucacugugu

SEQ ID NO: 1330064 - RNA, 16 nt, Homo sapiens
ucuucaucuuugccau

SEQ ID NO: 1330065 - RNA, 16 nt, Homo sapiens
ucuucauguccaguga

SEQ ID NO: 1330066 - RNA, 12 nt, Homo sapiens
ucuucauuaccu

SEQ ID NO: 1330067 - RNA, 14 nt, Homo sapiens
ucuucauuaccuca

SEQ ID NO: 1330068 - RNA, 15 nt, Homo sapiens
ucuucauuaccucag

SEQ ID NO: 1330069 - RNA, 19 nt, Homo sapiens
ucuuccccuuguguuugaa

SEQ ID NO: 1330070 - RNA, 15 nt, Homo sapiens
ucuucccugaccucc

SEQ ID NO: 1330071 - RNA, 14 nt, Homo sapiens
ucuuccuccacuuc

SEQ ID NO: 1330072 - RNA, 19 nt, Homo sapiens
ucuuccuuccuaauaggca

SEQ ID NO: 1330073 - RNA, 18 nt, Homo sapiens
ucuuccuuuucacugcug

SEQ ID NO: 1330074 - RNA, 13 nt, Homo sapiens
ucuucgcagccua

SEQ ID NO: 1330075 - RNA, 16 nt, Homo sapiens
ucuucgcagccuagau

SEQ ID NO: 1330076 - RNA, 14 nt, Homo sapiens
ucuucucguuuuca

SEQ ID NO: 1330077 - RNA, 22 nt, Homo sapiens
ucuucuuuucuuuuuuuaaaca

SEQ ID NO: 1330078 - RNA, 23 nt, Homo sapiens
ucuugaagaauaaauucuaccuc

SEQ ID NO: 1330079 - RNA, 13 nt, Homo sapiens
ucuugcaaaagau

SEQ ID NO: 1330080 - RNA, 14 nt, Homo sapiens
ucuugcuaccagua

SEQ ID NO: 1330081 - RNA, 15 nt, Homo sapiens
ucuuggaaccacgaa

SEQ ID NO: 1330082 - RNA, 14 nt, Homo sapiens
ucuuggccaucuaa

SEQ ID NO: 1330083 - RNA, 20 nt, Homo sapiens
ucuuggcucaccauaaccuc

SEQ ID NO: 1330084 - RNA, 16 nt, Homo sapiens
ucuuguaguguggcug

SEQ ID NO: 1330085 - RNA, 18 nt, Homo sapiens
ucuuguaguguggcugug

SEQ ID NO: 1330086 - RNA, 15 nt, Homo sapiens
ucuuguucuacugag

SEQ ID NO: 1330087 - RNA, 21 nt, Homo sapiens
ucuuuaaagcaggauuucuca

SEQ ID NO: 1330088 - RNA, 17 nt, Homo sapiens
ucuuuaauaaauugcuu

SEQ ID NO: 1330089 - RNA, 23 nt, Homo sapiens
ucuuuaauaaauugcuuacugau

SEQ ID NO: 1330090 - RNA, 15 nt, Homo sapiens
ucuuuaaucagcuua

SEQ ID NO: 1330091 - RNA, 23 nt, Homo sapiens
ucuuuaauuuauaucagguguau

SEQ ID NO: 1330092 - RNA, 21 nt, Homo sapiens
ucuuuacaccucgcuguuguc

SEQ ID NO: 1330093 - RNA, 14 nt, Homo sapiens
ucuuuacucugcau

SEQ ID NO: 1330094 - RNA, 18 nt, Homo sapiens
ucuuuacugcacucagau

SEQ ID NO: 1330095 - RNA, 18 nt, Homo sapiens
ucuuuccaaaacauuucu

SEQ ID NO: 1330096 - RNA, 13 nt, Homo sapiens
ucuuuccaaaagu

SEQ ID NO: 1330097 - RNA, 15 nt, Homo sapiens
ucuuucucugaggac

SEQ ID NO: 1330098 - RNA, 18 nt, Homo sapiens
ucuuugacugucagcaag

SEQ ID NO: 1330099 - RNA, 15 nt, Homo sapiens
ucuuugcaccaaaga

SEQ ID NO: 1330100 - RNA, 11 nt, Homo sapiens
ucuuugccucu

SEQ ID NO: 1330101 - RNA, 23 nt, Homo sapiens
ucuuuguaauacuuucuauguga

SEQ ID NO: 1330102 - RNA, 18 nt, Homo sapiens
ucuuugugauaauucuca

SEQ ID NO: 1330103 - RNA, 13 nt, Homo sapiens
ucuuugugccuuu

SEQ ID NO: 1330104 - RNA, 18 nt, Homo sapiens
ucuuuguuacuuccuuau

SEQ ID NO: 1330105 - RNA, 17 nt, Homo sapiens
ucuuuuaccaguaugaa

SEQ ID NO: 1330106 - RNA, 11 nt, Homo sapiens
ucuuuugcucu

SEQ ID NO: 1330107 - RNA, 19 nt, Homo sapiens
ucuuuuuucuuccuauuuc

SEQ ID NO: 1330108 - RNA, 22 nt, Homo sapiens
ugaaaaaugguaauuguugcua

SEQ ID NO: 1330109 - RNA, 16 nt, Homo sapiens
ugaaaacccagacugu

SEQ ID NO: 1330110 - RNA, 14 nt, Homo sapiens
ugaaaacuaaagau

SEQ ID NO: 1330111 - RNA, 12 nt, Homo sapiens
ugaaaacuucaa

SEQ ID NO: 1330112 - RNA, 22 nt, Homo sapiens
ugaaaaggugaagcuggcugug

SEQ ID NO: 1330113 - RNA, 14 nt, Homo sapiens
ugaaaauauagcua

SEQ ID NO: 1330114 - RNA, 17 nt, Homo sapiens
ugaaaauauuuguauca

SEQ ID NO: 1330115 - RNA, 20 nt, Homo sapiens
ugaaaaugaagaaggaagcu

SEQ ID NO: 1330116 - RNA, 16 nt, Homo sapiens
ugaaacagacuuguau

SEQ ID NO: 1330117 - RNA, 13 nt, Homo sapiens
ugaaagaaaccac

SEQ ID NO: 1330118 - RNA, 14 nt, Homo sapiens
ugaaagaaccagag

SEQ ID NO: 1330119 - RNA, 17 nt, Homo sapiens
ugaaagccacagacaau

SEQ ID NO: 1330120 - RNA, 16 nt, Homo sapiens
ugaaaggcagggcaag

SEQ ID NO: 1330121 - RNA, 20 nt, Homo sapiens
ugaaauaaagauaaaugcaa

SEQ ID NO: 1330122 - RNA, 18 nt, Homo sapiens
ugaaauaacaaaauggac

SEQ ID NO: 1330123 - RNA, 18 nt, Homo sapiens
ugaaaugcuguuaguaaa

SEQ ID NO: 1330124 - RNA, 14 nt, Homo sapiens
ugaaaugcuuuuau

SEQ ID NO: 1330125 - RNA, 15 nt, Homo sapiens
ugaaaugugcacuuu

SEQ ID NO: 1330126 - RNA, 19 nt, Homo sapiens
ugaaauuugauaaacugaa

SEQ ID NO: 1330127 - RNA, 19 nt, Homo sapiens
ugaaauuuggcuaauaaca

SEQ ID NO: 1330128 - RNA, 15 nt, Homo sapiens
ugaacacaucagcuu

SEQ ID NO: 1330129 - RNA, 17 nt, Homo sapiens
ugaacagcuaauuguac

SEQ ID NO: 1330130 - RNA, 20 nt, Homo sapiens
ugaacaggggcugguauuau

SEQ ID NO: 1330131 - RNA, 22 nt, Homo sapiens
ugaaccauccacuuacauauau

SEQ ID NO: 1330132 - RNA, 17 nt, Homo sapiens
ugaaccaugaagucaua

SEQ ID NO: 1330133 - RNA, 18 nt, Homo sapiens
ugaaccugaauauugcca

SEQ ID NO: 1330134 - RNA, 16 nt, Homo sapiens
ugaacgagcagcccag

SEQ ID NO: 1330135 - RNA, 17 nt, Homo sapiens
ugaacuccaccgaccaa

SEQ ID NO: 1330136 - RNA, 20 nt, Homo sapiens
ugaacuucuuugaauuuacu

SEQ ID NO: 1330137 - RNA, 23 nt, Homo sapiens
ugaagaaaagacacugaagcuaa

SEQ ID NO: 1330138 - RNA, 15 nt, Homo sapiens
ugaagaaucugcucu

SEQ ID NO: 1330139 - RNA, 15 nt, Homo sapiens
ugaagaguccucuga

SEQ ID NO: 1330140 - RNA, 15 nt, Homo sapiens
ugaagcuaaugucac

SEQ ID NO: 1330141 - RNA, 15 nt, Homo sapiens
ugaagcuuccuuggc

SEQ ID NO: 1330142 - RNA, 22 nt, Homo sapiens
ugaagcuucggccgcgccaccc

SEQ ID NO: 1330143 - RNA, 16 nt, Homo sapiens
ugaaggggaggucaca

SEQ ID NO: 1330144 - RNA, 12 nt, Homo sapiens
accucccacugc

SEQ ID NO: 1330145 - RNA, 21 nt, Homo sapiens
accuccccacccgcucccaca

SEQ ID NO: 1330146 - RNA, 19 nt, Homo sapiens
accucccugccuccaggaa

SEQ ID NO: 1330147 - RNA, 13 nt, Homo sapiens
accuccucccacu

SEQ ID NO: 1330148 - RNA, 23 nt, Homo sapiens
accucgcuguugucacaucucag

SEQ ID NO: 1330149 - RNA, 19 nt, Homo sapiens
accucggcacacacugugc

SEQ ID NO: 1330150 - RNA, 22 nt, Homo sapiens
accucgggaaacuuagaucauc

SEQ ID NO: 1330151 - RNA, 10 nt, Homo sapiens
accucugcau

SEQ ID NO: 1330152 - RNA, 22 nt, Homo sapiens
accucuucuggagauggaagcu

SEQ ID NO: 1330153 - RNA, 17 nt, Homo sapiens
accucuuuuucuuacca

SEQ ID NO: 1330154 - RNA, 17 nt, Homo sapiens
accugaaucagcuggac

SEQ ID NO: 1330155 - RNA, 22 nt, Homo sapiens
accugccccugccugacagccu

SEQ ID NO: 1330156 - RNA, 19 nt, Homo sapiens
accuggcagcucuggacag

SEQ ID NO: 1330157 - RNA, 22 nt, Homo sapiens
accuggggagugguuaggcagc

SEQ ID NO: 1330158 - RNA, 13 nt, Homo sapiens
accuguauuccca

SEQ ID NO: 1330159 - RNA, 15 nt, Homo sapiens
accuguuucccgggc

SEQ ID NO: 1330160 - RNA, 17 nt, Homo sapiens
accuguuuguuucuuau

SEQ ID NO: 1330161 - RNA, 18 nt, Homo sapiens
accuuauaguuacugugu

SEQ ID NO: 1330162 - RNA, 17 nt, Homo sapiens
accuuggcaccagacac

SEQ ID NO: 1330163 - RNA, 22 nt, Homo sapiens
accuuggcaccagacacccagg

SEQ ID NO: 1330164 - RNA, 19 nt, Homo sapiens
accuugggggaagacuuua

SEQ ID NO: 1330165 - RNA, 13 nt, Homo sapiens
accuuggugcuua

SEQ ID NO: 1330166 - RNA, 19 nt, Homo sapiens
accuuucuagggacaugaa

SEQ ID NO: 1330167 - RNA, 19 nt, Homo sapiens
acgagcagcccagggccua

SEQ ID NO: 1330168 - RNA, 20 nt, Homo sapiens
acgagugaaacuccgucuca

SEQ ID NO: 1330169 - RNA, 18 nt, Homo sapiens
acgcacgauaucuaguga

SEQ ID NO: 1330170 - RNA, 20 nt, Homo sapiens
acgccaggcaccacagccuc

SEQ ID NO: 1330171 - RNA, 15 nt, Homo sapiens
acgccgcccuaaaag

SEQ ID NO: 1330172 - RNA, 18 nt, Homo sapiens
acgcgcguacagaucucu

SEQ ID NO: 1330173 - RNA, 17 nt, Homo sapiens
acggaaacaacguugcu

SEQ ID NO: 1330174 - RNA, 20 nt, Homo sapiens
acggacugugcauacuuucc

SEQ ID NO: 1330175 - RNA, 18 nt, Homo sapiens
acggagucuugcucuguc

SEQ ID NO: 1330176 - RNA, 13 nt, Homo sapiens
acggcacucccau

SEQ ID NO: 1330177 - RNA, 20 nt, Homo sapiens
acggugcuaaaaaugaaaau

SEQ ID NO: 1330178 - RNA, 16 nt, Homo sapiens
acgugagaacaaucau

SEQ ID NO: 1330179 - RNA, 18 nt, Homo sapiens
acguguauaguaucugua

SEQ ID NO: 1330180 - RNA, 13 nt, Homo sapiens
acguuaggccagg

SEQ ID NO: 1330181 - RNA, 15 nt, Homo sapiens
acguuucacugcaaa

SEQ ID NO: 1330182 - RNA, 23 nt, Homo sapiens
acuaaugucucuucuaacaucuu

SEQ ID NO: 1330183 - RNA, 18 nt, Homo sapiens
acuacaagugauccucag

SEQ ID NO: 1330184 - RNA, 23 nt, Homo sapiens
acuacacagcuccugagcuugau

SEQ ID NO: 1330185 - RNA, 22 nt, Homo sapiens
acuacaguaacugugacugaug

SEQ ID NO: 1330186 - RNA, 22 nt, Homo sapiens
acuacaucugggacugacuuuc

SEQ ID NO: 1330187 - RNA, 17 nt, Homo sapiens
acuacauuucuacuaug

SEQ ID NO: 1330188 - RNA, 13 nt, Homo sapiens
acuaccaugcuuu

SEQ ID NO: 1330189 - RNA, 19 nt, Homo sapiens
acuaccauguggccauuaa

SEQ ID NO: 1330190 - RNA, 18 nt, Homo sapiens
acuaccauucuauuccau

SEQ ID NO: 1330191 - RNA, 21 nt, Homo sapiens
acuaccuauccuuacauuuca

SEQ ID NO: 1330192 - RNA, 22 nt, Homo sapiens
acuaccucugugccuugccaca

SEQ ID NO: 1330193 - RNA, 15 nt, Homo sapiens
acuacuguccaauca

SEQ ID NO: 1330194 - RNA, 16 nt, Homo sapiens
acuacuucucuuguua

SEQ ID NO: 1330195 - RNA, 22 nt, Homo sapiens
acuagcacugacugaacuguaa

SEQ ID NO: 1330196 - RNA, 16 nt, Homo sapiens
acuagccacugagaag

SEQ ID NO: 1330197 - RNA, 11 nt, Homo sapiens
acuagcuguaa

SEQ ID NO: 1330198 - RNA, 22 nt, Homo sapiens
acuauccaaucugugaugacau

SEQ ID NO: 1330199 - RNA, 17 nt, Homo sapiens
acuauggccauggcuca

SEQ ID NO: 1330200 - RNA, 15 nt, Homo sapiens
acuauguacugccuu

SEQ ID NO: 1330201 - RNA, 14 nt, Homo sapiens
acuauucauaagau

SEQ ID NO: 1330202 - RNA, 16 nt, Homo sapiens
acuauucucaaaugcu

SEQ ID NO: 1330203 - RNA, 16 nt, Homo sapiens
acuauugagugaaaca

SEQ ID NO: 1330204 - RNA, 19 nt, Homo sapiens
acuauuucaauacuuacau

SEQ ID NO: 1330205 - RNA, 20 nt, Homo sapiens
acuauuucaauacuuacaua

SEQ ID NO: 1330206 - RNA, 14 nt, Homo sapiens
acuauuugcagagg

SEQ ID NO: 1330207 - RNA, 22 nt, Homo sapiens
acucacaccuguaaucccagca

SEQ ID NO: 1330208 - RNA, 15 nt, Homo sapiens
acucaccccuagccc

SEQ ID NO: 1330209 - RNA, 17 nt, Homo sapiens
acucaccuaucaacaga

SEQ ID NO: 1330210 - RNA, 23 nt, Homo sapiens
acucacugggaagcucccacccc

SEQ ID NO: 1330211 - RNA, 16 nt, Homo sapiens
acucagacacaaauaa

SEQ ID NO: 1330212 - RNA, 12 nt, Homo sapiens
acucagcaucac

SEQ ID NO: 1330213 - RNA, 19 nt, Homo sapiens
acucagcucuuggcuccac

SEQ ID NO: 1330214 - RNA, 15 nt, Homo sapiens
acucaggccacagug

SEQ ID NO: 1330215 - RNA, 16 nt, Homo sapiens
acucaggccacagugg

SEQ ID NO: 1330216 - RNA, 19 nt, Homo sapiens
acucaggccuccaucuucu

SEQ ID NO: 1330217 - RNA, 16 nt, Homo sapiens
acucagggagcauuua

SEQ ID NO: 1330218 - RNA, 16 nt, Homo sapiens
acucaggggucauuca

SEQ ID NO: 1330219 - RNA, 16 nt, Homo sapiens
acucaguaauuucaaa

SEQ ID NO: 1330220 - RNA, 18 nt, Homo sapiens
acucagugccuccacaug

SEQ ID NO: 1330221 - RNA, 14 nt, Homo sapiens
acucaugacugcau

SEQ ID NO: 1330222 - RNA, 17 nt, Homo sapiens
acucauuuuuguuuuca

SEQ ID NO: 1330223 - RNA, 16 nt, Homo sapiens
acuccagaaccgcaga

SEQ ID NO: 1330224 - RNA, 18 nt, Homo sapiens
acucccaccacaggcaua

SEQ ID NO: 1330225 - RNA, 19 nt, Homo sapiens
acucccaccacaggcauaa

SEQ ID NO: 1330226 - RNA, 17 nt, Homo sapiens
acuccccagagcugugc

SEQ ID NO: 1330227 - RNA, 23 nt, Homo sapiens
acuccccagcccagcaccccuuc

SEQ ID NO: 1330228 - RNA, 15 nt, Homo sapiens
acuccuuaucccuug

SEQ ID NO: 1330229 - RNA, 22 nt, Homo sapiens
acucgggaccaauacuacugac

SEQ ID NO: 1330230 - RNA, 19 nt, Homo sapiens
acucuaaagccaagcacuu

SEQ ID NO: 1330231 - RNA, 21 nt, Homo sapiens
acucuagguuuuacagauuua

SEQ ID NO: 1330232 - RNA, 20 nt, Homo sapiens
acucucagcagcuaugguag

SEQ ID NO: 1330233 - RNA, 23 nt, Homo sapiens
acucucuuuuuuuuuaaggugaa

SEQ ID NO: 1330234 - RNA, 15 nt, Homo sapiens
acucugcaguuaaau

SEQ ID NO: 1330235 - RNA, 17 nt, Homo sapiens
acucuggcuucaaaaag

SEQ ID NO: 1330236 - RNA, 16 nt, Homo sapiens
acucuucuuugcugca

SEQ ID NO: 1330237 - RNA, 15 nt, Homo sapiens
acugaaaaccucucc

SEQ ID NO: 1330238 - RNA, 12 nt, Homo sapiens
acugaaccaaau

SEQ ID NO: 1330239 - RNA, 16 nt, Homo sapiens
acugaacuucagagca

SEQ ID NO: 1330240 - RNA, 14 nt, Homo sapiens
acugaagccuuucu

SEQ ID NO: 1330241 - RNA, 11 nt, Homo sapiens
acugaccagcc

SEQ ID NO: 1330242 - RNA, 15 nt, Homo sapiens
acugaccagccucca

SEQ ID NO: 1330243 - RNA, 12 nt, Homo sapiens
acugaccaucau

SEQ ID NO: 1330244 - RNA, 18 nt, Homo sapiens
acugacccucaggcacac

SEQ ID NO: 1330245 - RNA, 21 nt, Homo sapiens
acugacccucaggcacaccuu

SEQ ID NO: 1330246 - RNA, 20 nt, Homo sapiens
acugacuuuccgagccucca

SEQ ID NO: 1330247 - RNA, 13 nt, Homo sapiens
acugagcacugaa

SEQ ID NO: 1330248 - RNA, 18 nt, Homo sapiens
acugagcagccgccagcu

SEQ ID NO: 1330249 - RNA, 14 nt, Homo sapiens
acugaggaccagcc

SEQ ID NO: 1330250 - RNA, 14 nt, Homo sapiens
acugagguuuacau

SEQ ID NO: 1330251 - RNA, 22 nt, Homo sapiens
acugauccucgcaucucagccu

SEQ ID NO: 1330252 - RNA, 12 nt, Homo sapiens
acugaugacuuu

SEQ ID NO: 1330253 - RNA, 21 nt, Homo sapiens
acugauuuuguaaaguugccu

SEQ ID NO: 1330254 - RNA, 16 nt, Homo sapiens
acugcaaaaaaagccu

SEQ ID NO: 1330255 - RNA, 15 nt, Homo sapiens
acugcaaacacaccu

SEQ ID NO: 1330256 - RNA, 17 nt, Homo sapiens
acugcaaacacaccuug

SEQ ID NO: 1330257 - RNA, 18 nt, Homo sapiens
acugcacagugcaucuca

SEQ ID NO: 1330258 - RNA, 19 nt, Homo sapiens
acugcacagugcaucucag

SEQ ID NO: 1330259 - RNA, 15 nt, Homo sapiens
acugcaggaccucca

SEQ ID NO: 1330260 - RNA, 21 nt, Homo sapiens
acugcauaugaaaggacacua

SEQ ID NO: 1330261 - RNA, 17 nt, Homo sapiens
acugccaaaaugcucua

SEQ ID NO: 1330262 - RNA, 14 nt, Homo sapiens
acugcccccgccac

SEQ ID NO: 1330263 - RNA, 21 nt, Homo sapiens
acugccccugcugugcugcuc

SEQ ID NO: 1330264 - RNA, 13 nt, Homo sapiens
acugcccugggca

SEQ ID NO: 1330265 - RNA, 21 nt, Homo sapiens
acugcccuuucaaagcacuua

SEQ ID NO: 1330266 - RNA, 19 nt, Homo sapiens
acugcgccgaccccgccac

SEQ ID NO: 1330267 - RNA, 22 nt, Homo sapiens
acugcucacguguuugcuguca

SEQ ID NO: 1330268 - RNA, 12 nt, Homo sapiens
acugcucauuuc

SEQ ID NO: 1330269 - RNA, 14 nt, Homo sapiens
acugcucauuucau

SEQ ID NO: 1330270 - RNA, 21 nt, Homo sapiens
acugcugaauucaccugugga

SEQ ID NO: 1330271 - RNA, 19 nt, Homo sapiens
acuggaacguuucacugca

SEQ ID NO: 1330272 - RNA, 12 nt, Homo sapiens
acuggccuccag

SEQ ID NO: 1330273 - RNA, 22 nt, Homo sapiens
acuggcucuuuuaccaguauga

SEQ ID NO: 1330274 - RNA, 22 nt, Homo sapiens
acugggauguaaguuuguguaa

SEQ ID NO: 1330275 - RNA, 16 nt, Homo sapiens
acuggugcuaauguca

SEQ ID NO: 1330276 - RNA, 20 nt, Homo sapiens
aggcauggcggcgcaugccu

SEQ ID NO: 1330277 - RNA, 22 nt, Homo sapiens
aggcauggucccuuaaggcaca

SEQ ID NO: 1330278 - RNA, 14 nt, Homo sapiens
aggccacaccggcc

SEQ ID NO: 1330279 - RNA, 17 nt, Homo sapiens
aggccacagugcaauuu

SEQ ID NO: 1330280 - RNA, 13 nt, Homo sapiens
aggccacaguggg

SEQ ID NO: 1330281 - RNA, 14 nt, Homo sapiens
aggccaccuggauu

SEQ ID NO: 1330282 - RNA, 14 nt, Homo sapiens
aggccagagaggga

SEQ ID NO: 1330283 - RNA, 18 nt, Homo sapiens
aggccagcaacucccagc

SEQ ID NO: 1330284 - RNA, 15 nt, Homo sapiens
aggccagcaccaucu

SEQ ID NO: 1330285 - RNA, 17 nt, Homo sapiens
aggccagcaccaucucu

SEQ ID NO: 1330286 - RNA, 18 nt, Homo sapiens
aggccaggccagcugccu

SEQ ID NO: 1330287 - RNA, 16 nt, Homo sapiens
aggcccaaugcugcuu

SEQ ID NO: 1330288 - RNA, 20 nt, Homo sapiens
aggccccugcaaugugguga

SEQ ID NO: 1330289 - RNA, 15 nt, Homo sapiens
aggcccuagacucau

SEQ ID NO: 1330290 - RNA, 13 nt, Homo sapiens
aggcccugcccug

SEQ ID NO: 1330291 - RNA, 16 nt, Homo sapiens
aggcccuggaggucuc

SEQ ID NO: 1330292 - RNA, 15 nt, Homo sapiens
aggcccuuagaggga

SEQ ID NO: 1330293 - RNA, 16 nt, Homo sapiens
aggccgaggugggcag

SEQ ID NO: 1330294 - RNA, 22 nt, Homo sapiens
aggccugcuugacuuuccagaa

SEQ ID NO: 1330295 - RNA, 22 nt, Homo sapiens
aggccugggaccucccacugcc

SEQ ID NO: 1330296 - RNA, 12 nt, Homo sapiens
aggccuguccaa

SEQ ID NO: 1330297 - RNA, 20 nt, Homo sapiens
aggccugucccuugccucug

SEQ ID NO: 1330298 - RNA, 13 nt, Homo sapiens
aggccuugcuuuu

SEQ ID NO: 1330299 - RNA, 21 nt, Homo sapiens
aggcgccccuucccccuccaa

SEQ ID NO: 1330300 - RNA, 17 nt, Homo sapiens
aggcuaccucaccuggg

SEQ ID NO: 1330301 - RNA, 19 nt, Homo sapiens
aggcuaccucuaccuucaa

SEQ ID NO: 1330302 - RNA, 21 nt, Homo sapiens
aggcucccucuuccucuccau

SEQ ID NO: 1330303 - RNA, 20 nt, Homo sapiens
aggcucuuaugugugccuuu

SEQ ID NO: 1330304 - RNA, 12 nt, Homo sapiens
aggcucuucucc

SEQ ID NO: 1330305 - RNA, 18 nt, Homo sapiens
aggcugcucggcuacugg

SEQ ID NO: 1330306 - RNA, 21 nt, Homo sapiens
aggcuggagagaacacagugc

SEQ ID NO: 1330307 - RNA, 16 nt, Homo sapiens
aggcuggagugcaaug

SEQ ID NO: 1330308 - RNA, 20 nt, Homo sapiens
aggcuggugagguccuggug

SEQ ID NO: 1330309 - RNA, 22 nt, Homo sapiens
aggcuguacauaguccuuuuau

SEQ ID NO: 1330310 - RNA, 13 nt, Homo sapiens
agggaaaagcagc

SEQ ID NO: 1330311 - RNA, 19 nt, Homo sapiens
agggaagauggagacaccc

SEQ ID NO: 1330312 - RNA, 12 nt, Homo sapiens
agggaagcaaua

SEQ ID NO: 1330313 - RNA, 15 nt, Homo sapiens
agggacagagcauug

SEQ ID NO: 1330314 - RNA, 18 nt, Homo sapiens
agggaccaucugcugcag

SEQ ID NO: 1330315 - RNA, 15 nt, Homo sapiens
agggacugaaaaccu

SEQ ID NO: 1330316 - RNA, 13 nt, Homo sapiens
agggacuggcaca

SEQ ID NO: 1330317 - RNA, 13 nt, Homo sapiens
agggacugugagu

SEQ ID NO: 1330318 - RNA, 15 nt, Homo sapiens
agggagaacuugaaa

SEQ ID NO: 1330319 - RNA, 20 nt, Homo sapiens
agggagaacuugaaacagau

SEQ ID NO: 1330320 - RNA, 22 nt, Homo sapiens
agggaggcggccuccaugcacu

SEQ ID NO: 1330321 - RNA, 18 nt, Homo sapiens
agggauuuggggcucaga

SEQ ID NO: 1330322 - RNA, 21 nt, Homo sapiens
agggcaccgggcaagcacugg

SEQ ID NO: 1330323 - RNA, 16 nt, Homo sapiens
agggcagcaggccaga

SEQ ID NO: 1330324 - RNA, 22 nt, Homo sapiens
agggcagcuggcccccagcccu

SEQ ID NO: 1330325 - RNA, 12 nt, Homo sapiens
agggcauugcuu

SEQ ID NO: 1330326 - RNA, 19 nt, Homo sapiens
agggccaagagaucugugu

SEQ ID NO: 1330327 - RNA, 23 nt, Homo sapiens
agggccaagagaucuguguggcu

SEQ ID NO: 1330328 - RNA, 16 nt, Homo sapiens
agggccaccuccacac

SEQ ID NO: 1330329 - RNA, 11 nt, Homo sapiens
agggccuguau

SEQ ID NO: 1330330 - RNA, 15 nt, Homo sapiens
agggcucagggcagu

SEQ ID NO: 1330331 - RNA, 21 nt, Homo sapiens
aggggagggagaaguuucugu

SEQ ID NO: 1330332 - RNA, 13 nt, Homo sapiens
aggggauccagcc

SEQ ID NO: 1330333 - RNA, 16 nt, Homo sapiens
aggggauccagccacu

SEQ ID NO: 1330334 - RNA, 16 nt, Homo sapiens
aggggccggccagugg

SEQ ID NO: 1330335 - RNA, 22 nt, Homo sapiens
aggggccuggaggucuggcuga

SEQ ID NO: 1330336 - RNA, 22 nt, Homo sapiens
aggggcuuugugaccagaaagc

SEQ ID NO: 1330337 - RNA, 21 nt, Homo sapiens
agggggcgcuggagcuuccaa

SEQ ID NO: 1330338 - RNA, 23 nt, Homo sapiens
agggggugggggugccgcuuucu

SEQ ID NO: 1330339 - RNA, 23 nt, Homo sapiens
aggggugcggcggucccagcucc

SEQ ID NO: 1330340 - RNA, 13 nt, Homo sapiens
agggucauagcau

SEQ ID NO: 1330341 - RNA, 19 nt, Homo sapiens
agggugagggccaccucca

SEQ ID NO: 1330342 - RNA, 17 nt, Homo sapiens
agggugcggcugugcag

SEQ ID NO: 1330343 - RNA, 22 nt, Homo sapiens
agguaaccccagauucaugcac

SEQ ID NO: 1330344 - RNA, 14 nt, Homo sapiens
agguagaacaaaga

SEQ ID NO: 1330345 - RNA, 15 nt, Homo sapiens
aggucaaaacugaag

SEQ ID NO: 1330346 - RNA, 15 nt, Homo sapiens
aggucacucugggcc

SEQ ID NO: 1330347 - RNA, 21 nt, Homo sapiens
aggucacugcuagagacgcug

SEQ ID NO: 1330348 - RNA, 12 nt, Homo sapiens
aggucacuuaag

SEQ ID NO: 1330349 - RNA, 21 nt, Homo sapiens
aggucagcccagccccuccaa

SEQ ID NO: 1330350 - RNA, 13 nt, Homo sapiens
aggucagccugga

SEQ ID NO: 1330351 - RNA, 22 nt, Homo sapiens
aggucaucuggcggaggucucu

SEQ ID NO: 1330352 - RNA, 11 nt, Homo sapiens
aggucaugccu

SEQ ID NO: 1330353 - RNA, 19 nt, Homo sapiens
aggucauugcaccuaucuc

SEQ ID NO: 1330354 - RNA, 15 nt, Homo sapiens
aggucccucagacau

SEQ ID NO: 1330355 - RNA, 18 nt, Homo sapiens
aggucccuguugucagau

SEQ ID NO: 1330356 - RNA, 21 nt, Homo sapiens
agguccuuauguccugucaua

SEQ ID NO: 1330357 - RNA, 14 nt, Homo sapiens
aggucggagugccu

SEQ ID NO: 1330358 - RNA, 17 nt, Homo sapiens
aggucggagugccugga

SEQ ID NO: 1330359 - RNA, 17 nt, Homo sapiens
aggucguuuuccaaaga

SEQ ID NO: 1330360 - RNA, 17 nt, Homo sapiens
aggucuguaugucaugg

SEQ ID NO: 1330361 - RNA, 17 nt, Homo sapiens
aggucuguggugcagug

SEQ ID NO: 1330362 - RNA, 18 nt, Homo sapiens
aggucuguggugcagugu

SEQ ID NO: 1330363 - RNA, 17 nt, Homo sapiens
aggugacggcacuccca

SEQ ID NO: 1330364 - RNA, 18 nt, Homo sapiens
aggugauucucagggcug

SEQ ID NO: 1330365 - RNA, 16 nt, Homo sapiens
aggugcccagggccag

SEQ ID NO: 1330366 - RNA, 16 nt, Homo sapiens
aggugccuaaccuggg

SEQ ID NO: 1330367 - RNA, 17 nt, Homo sapiens
aggugcuacaaaaacac

SEQ ID NO: 1330368 - RNA, 21 nt, Homo sapiens
aggugcuacaaaaacacagca

SEQ ID NO: 1330369 - RNA, 16 nt, Homo sapiens
aggugcuagaagccua

SEQ ID NO: 1330370 - RNA, 18 nt, Homo sapiens
agguggaacaagcacaga

SEQ ID NO: 1330371 - RNA, 20 nt, Homo sapiens
aggugugaaccuaccugccu

SEQ ID NO: 1330372 - RNA, 21 nt, Homo sapiens
agguguucuucauuaccucag

SEQ ID NO: 1330373 - RNA, 19 nt, Homo sapiens
agguuccugaaauauccag

SEQ ID NO: 1330374 - RNA, 22 nt, Homo sapiens
agguucucuuccuggcaucaua

SEQ ID NO: 1330375 - RNA, 21 nt, Homo sapiens
agguugucugaagucacugca

SEQ ID NO: 1330376 - RNA, 20 nt, Homo sapiens
agguuguggggccucaggcu

SEQ ID NO: 1330377 - RNA, 20 nt, Homo sapiens
agguuugauucaacacuuaa

SEQ ID NO: 1330378 - RNA, 15 nt, Homo sapiens
agguuuuaaagaccu

SEQ ID NO: 1330379 - RNA, 17 nt, Homo sapiens
aguaaaagcuacuaugu

SEQ ID NO: 1330380 - RNA, 16 nt, Homo sapiens
aguaaaagucuaccug

SEQ ID NO: 1330381 - RNA, 21 nt, Homo sapiens
aguaaaauuucaggauuaacu

SEQ ID NO: 1330382 - RNA, 14 nt, Homo sapiens
aguaaauauuuacu

SEQ ID NO: 1330383 - RNA, 12 nt, Homo sapiens
aguaaauccaug

SEQ ID NO: 1330384 - RNA, 19 nt, Homo sapiens
aguaaauguguuucuugcu

SEQ ID NO: 1330385 - RNA, 21 nt, Homo sapiens
aguaacgacauggaacugaaa

SEQ ID NO: 1330386 - RNA, 20 nt, Homo sapiens
aguaacucauugcucuguua

SEQ ID NO: 1330387 - RNA, 12 nt, Homo sapiens
aguaacugugac

SEQ ID NO: 1330388 - RNA, 16 nt, Homo sapiens
aguaacugugcuguac

SEQ ID NO: 1330389 - RNA, 16 nt, Homo sapiens
aguaagacccagcauu

SEQ ID NO: 1330390 - RNA, 15 nt, Homo sapiens
aguaagcaacuagcu

SEQ ID NO: 1330391 - RNA, 20 nt, Homo sapiens
aguaagcaacuagcugggca

SEQ ID NO: 1330392 - RNA, 18 nt, Homo sapiens
aguaauauuauuacuuua

SEQ ID NO: 1330393 - RNA, 22 nt, Homo sapiens
aguaauauuauuacuuuaugaa

SEQ ID NO: 1330394 - RNA, 13 nt, Homo sapiens
aguaauugcucua

SEQ ID NO: 1330395 - RNA, 14 nt, Homo sapiens
aguacaaaguuuca

SEQ ID NO: 1330396 - RNA, 21 nt, Homo sapiens
aguacaaauguuuuucaucca

SEQ ID NO: 1330397 - RNA, 22 nt, Homo sapiens
aguacaugauaaaugauagaca

SEQ ID NO: 1330398 - RNA, 24 nt, Homo sapiens
aguaccaguauaagcaucugccau

SEQ ID NO: 1330399 - RNA, 16 nt, Homo sapiens
aguaccccucuagcuu

SEQ ID NO: 1330400 - RNA, 20 nt, Homo sapiens
aguacuaucuuuguguugca

SEQ ID NO: 1330401 - RNA, 21 nt, Homo sapiens
aguagagcuuguaauaaauac

SEQ ID NO: 1330402 - RNA, 11 nt, Homo sapiens
aguagaugcca

SEQ ID NO: 1330403 - RNA, 23 nt, Homo sapiens
aguaggugggggaacacugagaa

SEQ ID NO: 1330404 - RNA, 16 nt, Homo sapiens
aguagugcaccaucuc

SEQ ID NO: 1330405 - RNA, 18 nt, Homo sapiens
aguaguguggccugugcc

SEQ ID NO: 1330406 - RNA, 15 nt, Homo sapiens
aguauaaauuuacuu

SEQ ID NO: 1330407 - RNA, 18 nt, Homo sapiens
aguauaagcaucugccau

SEQ ID NO: 1330408 - RNA, 16 nt, Homo sapiens
augcacaacagaguaa

SEQ ID NO: 1330409 - RNA, 21 nt, Homo sapiens
augcacacacacagaugucuu

SEQ ID NO: 1330410 - RNA, 19 nt, Homo sapiens
augcacucagcucuuggcu

SEQ ID NO: 1330411 - RNA, 22 nt, Homo sapiens
augcagcgccguguccucucug

SEQ ID NO: 1330412 - RNA, 13 nt, Homo sapiens
augcauaggauuc

SEQ ID NO: 1330413 - RNA, 18 nt, Homo sapiens
augcaucuuccacuggaa

SEQ ID NO: 1330414 - RNA, 17 nt, Homo sapiens
augcaugauacuaucug

SEQ ID NO: 1330415 - RNA, 16 nt, Homo sapiens
augcauggugccccag

SEQ ID NO: 1330416 - RNA, 22 nt, Homo sapiens
augcauggugccccaggaccag

SEQ ID NO: 1330417 - RNA, 15 nt, Homo sapiens
augcauucacauauc

SEQ ID NO: 1330418 - RNA, 22 nt, Homo sapiens
augcauucacauaucugcuuau

SEQ ID NO: 1330419 - RNA, 22 nt, Homo sapiens
augcauugccuguaacaaugua

SEQ ID NO: 1330420 - RNA, 13 nt, Homo sapiens
augccacuuccuu

SEQ ID NO: 1330421 - RNA, 23 nt, Homo sapiens
augccacuuccuuuuaacugcca

SEQ ID NO: 1330422 - RNA, 14 nt, Homo sapiens
augccacuucucac

SEQ ID NO: 1330423 - RNA, 13 nt, Homo sapiens
augcccaaggcga

SEQ ID NO: 1330424 - RNA, 22 nt, Homo sapiens
augccccgagcccaggcagcua

SEQ ID NO: 1330425 - RNA, 17 nt, Homo sapiens
augccucagucuauucu

SEQ ID NO: 1330426 - RNA, 14 nt, Homo sapiens
augccugacucagu

SEQ ID NO: 1330427 - RNA, 18 nt, Homo sapiens
augccuguaacccuggca

SEQ ID NO: 1330428 - RNA, 17 nt, Homo sapiens
augccuguaaucucagc

SEQ ID NO: 1330429 - RNA, 23 nt, Homo sapiens
augccuguaaucucagcacuuug

SEQ ID NO: 1330430 - RNA, 15 nt, Homo sapiens
augcuaucaguuuua

SEQ ID NO: 1330431 - RNA, 14 nt, Homo sapiens
augcucagaccagc

SEQ ID NO: 1330432 - RNA, 19 nt, Homo sapiens
augcucagaccagcucuuc

SEQ ID NO: 1330433 - RNA, 20 nt, Homo sapiens
augcugacagcucuucacag

SEQ ID NO: 1330434 - RNA, 13 nt, Homo sapiens
augcugacuguac

SEQ ID NO: 1330435 - RNA, 17 nt, Homo sapiens
augcugagaagaucuga

SEQ ID NO: 1330436 - RNA, 14 nt, Homo sapiens
augcugcaguucca

SEQ ID NO: 1330437 - RNA, 20 nt, Homo sapiens
augcugcuggggaagacagu

SEQ ID NO: 1330438 - RNA, 22 nt, Homo sapiens
augcuguucacuggacacuuca

SEQ ID NO: 1330439 - RNA, 23 nt, Homo sapiens
augcuguucacuggacacuucac

SEQ ID NO: 1330440 - RNA, 19 nt, Homo sapiens
augcuguuuguagugaaau

SEQ ID NO: 1330441 - RNA, 19 nt, Homo sapiens
augcuuacauuugaacuug

SEQ ID NO: 1330442 - RNA, 13 nt, Homo sapiens
auggaaacacuga

SEQ ID NO: 1330443 - RNA, 15 nt, Homo sapiens
auggaacagcauuac

SEQ ID NO: 1330444 - RNA, 21 nt, Homo sapiens
auggacuugugauuggcugca

SEQ ID NO: 1330445 - RNA, 23 nt, Homo sapiens
auggagugaccaaaaugccaaaa

SEQ ID NO: 1330446 - RNA, 20 nt, Homo sapiens
auggagugcucacaaaggau

SEQ ID NO: 1330447 - RNA, 16 nt, Homo sapiens
auggaguggcugccau

SEQ ID NO: 1330448 - RNA, 19 nt, Homo sapiens
auggaugggggaacucaga

SEQ ID NO: 1330449 - RNA, 23 nt, Homo sapiens
auggcaacagaucuggaaccuca

SEQ ID NO: 1330450 - RNA, 17 nt, Homo sapiens
auggcaauuuagcucuc

SEQ ID NO: 1330451 - RNA, 16 nt, Homo sapiens
auggcagaaccaaagc

SEQ ID NO: 1330452 - RNA, 19 nt, Homo sapiens
auggcagcugguugcucca

SEQ ID NO: 1330453 - RNA, 18 nt, Homo sapiens
auggcaggacuccuggca

SEQ ID NO: 1330454 - RNA, 18 nt, Homo sapiens
auggcauaaccugucuca

SEQ ID NO: 1330455 - RNA, 21 nt, Homo sapiens
auggcaugcgccaccaugccc

SEQ ID NO: 1330456 - RNA, 22 nt, Homo sapiens
auggccagugagaucaauguga

SEQ ID NO: 1330457 - RNA, 16 nt, Homo sapiens
auggcuucacauucau

SEQ ID NO: 1330458 - RNA, 22 nt, Homo sapiens
augggaggagaggacaagggaa

SEQ ID NO: 1330459 - RNA, 19 nt, Homo sapiens
augggccuuuaagaaccuu

SEQ ID NO: 1330460 - RNA, 16 nt, Homo sapiens
augguaauuguugcua

SEQ ID NO: 1330461 - RNA, 19 nt, Homo sapiens
augguaguuuuacaguguu

SEQ ID NO: 1330462 - RNA, 19 nt, Homo sapiens
auggucccuuaaggcacag

SEQ ID NO: 1330463 - RNA, 19 nt, Homo sapiens
auggugcaaucacagcuca

SEQ ID NO: 1330464 - RNA, 22 nt, Homo sapiens
augguguaggaaaaaugcaagc

SEQ ID NO: 1330465 - RNA, 15 nt, Homo sapiens
augguuacauaucaa

SEQ ID NO: 1330466 - RNA, 12 nt, Homo sapiens
augguucaagua

SEQ ID NO: 1330467 - RNA, 15 nt, Homo sapiens
augguugauggaaaa

SEQ ID NO: 1330468 - RNA, 17 nt, Homo sapiens
augguugauggaaaaua

SEQ ID NO: 1330469 - RNA, 14 nt, Homo sapiens
auguaaaacugaac

SEQ ID NO: 1330470 - RNA, 17 nt, Homo sapiens
auguaagcauaacuuau

SEQ ID NO: 1330471 - RNA, 18 nt, Homo sapiens
auguaauaaaaagccucu

SEQ ID NO: 1330472 - RNA, 14 nt, Homo sapiens
auguaccagcaucu

SEQ ID NO: 1330473 - RNA, 18 nt, Homo sapiens
auguaccguaggcuuugu

SEQ ID NO: 1330474 - RNA, 23 nt, Homo sapiens
auguacuauccaaucugugauga

SEQ ID NO: 1330475 - RNA, 19 nt, Homo sapiens
auguacuuaagaguggcau

SEQ ID NO: 1330476 - RNA, 19 nt, Homo sapiens
auguaguuuuauuacacau

SEQ ID NO: 1330477 - RNA, 14 nt, Homo sapiens
auguauaccagccu

SEQ ID NO: 1330478 - RNA, 16 nt, Homo sapiens
auguauaucuucuaca

SEQ ID NO: 1330479 - RNA, 20 nt, Homo sapiens
auguauaucuucuacaugca

SEQ ID NO: 1330480 - RNA, 19 nt, Homo sapiens
auguaucaaauguaacuua

SEQ ID NO: 1330481 - RNA, 20 nt, Homo sapiens
auguaucaaauguaacuuac

SEQ ID NO: 1330482 - RNA, 19 nt, Homo sapiens
auguaucucaguaccccau

SEQ ID NO: 1330483 - RNA, 19 nt, Homo sapiens
augucagccacugugauag

SEQ ID NO: 1330484 - RNA, 24 nt, Homo sapiens
augucagugaugacuauucucaaa

SEQ ID NO: 1330485 - RNA, 14 nt, Homo sapiens
auguccacuuaaaa

SEQ ID NO: 1330486 - RNA, 17 nt, Homo sapiens
auguccauuuauaucau

SEQ ID NO: 1330487 - RNA, 15 nt, Homo sapiens
auguccuauguauau

SEQ ID NO: 1330488 - RNA, 15 nt, Homo sapiens
auguccugccuuuua

SEQ ID NO: 1330489 - RNA, 20 nt, Homo sapiens
augucugguguuugucaugg

SEQ ID NO: 1330490 - RNA, 23 nt, Homo sapiens
augucuuaaaaccugcuuuucaa

SEQ ID NO: 1330491 - RNA, 14 nt, Homo sapiens
augucuugcuaaca

SEQ ID NO: 1330492 - RNA, 14 nt, Homo sapiens
augugaaaagaaua

SEQ ID NO: 1330493 - RNA, 13 nt, Homo sapiens
augugacuacuga

SEQ ID NO: 1330494 - RNA, 12 nt, Homo sapiens
augugacucagc

SEQ ID NO: 1330495 - RNA, 13 nt, Homo sapiens
augugaguuucca

SEQ ID NO: 1330496 - RNA, 20 nt, Homo sapiens
augugcauuauuuuccagau

SEQ ID NO: 1330497 - RNA, 20 nt, Homo sapiens
augugcuuguuagcuguuuc

SEQ ID NO: 1330498 - RNA, 23 nt, Homo sapiens
augugcuuguuagcuguuucuca

SEQ ID NO: 1330499 - RNA, 23 nt, Homo sapiens
augugcuuuuaaaaaaaaauacu

SEQ ID NO: 1330500 - RNA, 14 nt, Homo sapiens
auguguaacaggau

SEQ ID NO: 1330501 - RNA, 20 nt, Homo sapiens
auguguaguuauaaaccaau

SEQ ID NO: 1330502 - RNA, 21 nt, Homo sapiens
auguguguagauuucaugcuc

SEQ ID NO: 1330503 - RNA, 22 nt, Homo sapiens
auguguuuuaucacuucauuca

SEQ ID NO: 1330504 - RNA, 16 nt, Homo sapiens
auguuagaaugagauc

SEQ ID NO: 1330505 - RNA, 20 nt, Homo sapiens
auguuaggccuaagaggcuu

SEQ ID NO: 1330506 - RNA, 13 nt, Homo sapiens
auguuaugcagug

SEQ ID NO: 1330507 - RNA, 20 nt, Homo sapiens
auguuauguaccauaugauc

SEQ ID NO: 1330508 - RNA, 13 nt, Homo sapiens
auguucugcuuuc

SEQ ID NO: 1330509 - RNA, 16 nt, Homo sapiens
auguugagcagcaucu

SEQ ID NO: 1330510 - RNA, 16 nt, Homo sapiens
auguuguucuuacaaa

SEQ ID NO: 1330511 - RNA, 12 nt, Homo sapiens
auguuuucacaa

SEQ ID NO: 1330512 - RNA, 21 nt, Homo sapiens
auguuuucuagucacuuccuc

SEQ ID NO: 1330513 - RNA, 17 nt, Homo sapiens
auguuuugggaaacacu

SEQ ID NO: 1330514 - RNA, 16 nt, Homo sapiens
auuaaaacacuuucaa

SEQ ID NO: 1330515 - RNA, 23 nt, Homo sapiens
auuaaacuuugaagcaacuguga

SEQ ID NO: 1330516 - RNA, 22 nt, Homo sapiens
auuaaaguucuaggcauacuuu

SEQ ID NO: 1330517 - RNA, 15 nt, Homo sapiens
auuaacauggccauu

SEQ ID NO: 1330518 - RNA, 21 nt, Homo sapiens
auuaacuguauuuucuuucac

SEQ ID NO: 1330519 - RNA, 14 nt, Homo sapiens
auuaaguaacuuau

SEQ ID NO: 1330520 - RNA, 16 nt, Homo sapiens
auuaauaaaugucauu

SEQ ID NO: 1330521 - RNA, 20 nt, Homo sapiens
auuaaucaaaccacuguuau

SEQ ID NO: 1330522 - RNA, 17 nt, Homo sapiens
auuaaucauacaaacuc

SEQ ID NO: 1330523 - RNA, 19 nt, Homo sapiens
auuaauuuuccaaugcaca

SEQ ID NO: 1330524 - RNA, 22 nt, Homo sapiens
auuaauuuuccaaugcacaguu

SEQ ID NO: 1330525 - RNA, 13 nt, Homo sapiens
auuacacauuuau

SEQ ID NO: 1330526 - RNA, 17 nt, Homo sapiens
auuacagaaacugaugc

SEQ ID NO: 1330527 - RNA, 23 nt, Homo sapiens
auuacuaucauaauucagcacuu

SEQ ID NO: 1330528 - RNA, 18 nt, Homo sapiens
auuacuguuccagauucc

SEQ ID NO: 1330529 - RNA, 15 nt, Homo sapiens
auuacuuccacugag

SEQ ID NO: 1330530 - RNA, 14 nt, Homo sapiens
auuagugacuucaa

SEQ ID NO: 1330531 - RNA, 23 nt, Homo sapiens
auuagugggauuuuaugccaguu

SEQ ID NO: 1330532 - RNA, 17 nt, Homo sapiens
auuaguugacaguauua

SEQ ID NO: 1330533 - RNA, 16 nt, Homo sapiens
auuauaaacaaccuag

SEQ ID NO: 1330534 - RNA, 17 nt, Homo sapiens
auuauaaauaaauacca

SEQ ID NO: 1330535 - RNA, 21 nt, Homo sapiens
auuauaaauaaauaccaaaaa

SEQ ID NO: 1330536 - RNA, 14 nt, Homo sapiens
auuauaaguugacc

SEQ ID NO: 1330537 - RNA, 15 nt, Homo sapiens
auuauacuacaauaa

SEQ ID NO: 1330538 - RNA, 23 nt, Homo sapiens
auuauaugaaguuuaaauucuag

SEQ ID NO: 1330539 - RNA, 14 nt, Homo sapiens
auuauauucauucu

SEQ ID NO: 1330540 - RNA, 22 nt, Homo sapiens
auuauccagagucaugggagag

SEQ ID NO: 1330541 - RNA, 19 nt, Homo sapiens
auuaucuaaaaucugcuag

SEQ ID NO: 1330542 - RNA, 13 nt, Homo sapiens
auuauucccauga

SEQ ID NO: 1330543 - RNA, 17 nt, Homo sapiens
auuauuggacagucuca

SEQ ID NO: 1330544 - RNA, 20 nt, Homo sapiens
auuauuuuuguuagcaaaga

SEQ ID NO: 1330545 - RNA, 17 nt, Homo sapiens
auucaagcaaacaucaa

SEQ ID NO: 1330546 - RNA, 20 nt, Homo sapiens
auucaauagcauaucacaga

SEQ ID NO: 1330547 - RNA, 20 nt, Homo sapiens
auucacagcaagucacuggc

SEQ ID NO: 1330548 - RNA, 13 nt, Homo sapiens
auucacauucaga

SEQ ID NO: 1330549 - RNA, 14 nt, Homo sapiens
auucaccaauauca

SEQ ID NO: 1330550 - RNA, 14 nt, Homo sapiens
auucacuuacugac

SEQ ID NO: 1330551 - RNA, 12 nt, Homo sapiens
auucagccuuau

SEQ ID NO: 1330552 - RNA, 17 nt, Homo sapiens
auucaggccagcccagc

SEQ ID NO: 1330553 - RNA, 22 nt, Homo sapiens
auucauagugauagagugcagu

SEQ ID NO: 1330554 - RNA, 17 nt, Homo sapiens
auucaugguucaaguau

SEQ ID NO: 1330555 - RNA, 23 nt, Homo sapiens
auucauucuuuuugaaaugucaa

SEQ ID NO: 1330556 - RNA, 14 nt, Homo sapiens
auucauuggugaag

SEQ ID NO: 1330557 - RNA, 16 nt, Homo sapiens
auuccaaaauccaaaa

SEQ ID NO: 1330558 - RNA, 17 nt, Homo sapiens
auuccaaauggugugaa

SEQ ID NO: 1330559 - RNA, 23 nt, Homo sapiens
auucccaagguuacuuaauucaa

SEQ ID NO: 1330560 - RNA, 13 nt, Homo sapiens
auucccauucuac

SEQ ID NO: 1330561 - RNA, 13 nt, Homo sapiens
auucccuccauuu

SEQ ID NO: 1330562 - RNA, 12 nt, Homo sapiens
auucccuccuga

SEQ ID NO: 1330563 - RNA, 21 nt, Homo sapiens
auucccugcccaaacccuuaa

SEQ ID NO: 1330564 - RNA, 15 nt, Homo sapiens
auuccuaugacaaaa

SEQ ID NO: 1330565 - RNA, 16 nt, Homo sapiens
auucuagaacugugaa

SEQ ID NO: 1330566 - RNA, 15 nt, Homo sapiens
auucuagugagucaa

SEQ ID NO: 1330567 - RNA, 17 nt, Homo sapiens
auucuauuauacuacaa

SEQ ID NO: 1330568 - RNA, 14 nt, Homo sapiens
auucucagauuaaa

SEQ ID NO: 1330569 - RNA, 21 nt, Homo sapiens
auucucagggcuggagccugg

SEQ ID NO: 1330570 - RNA, 15 nt, Homo sapiens
auucucuauguauca

SEQ ID NO: 1330571 - RNA, 20 nt, Homo sapiens
auucucuuaugauacuugag

SEQ ID NO: 1330572 - RNA, 20 nt, Homo sapiens
auucugaaggccuuguuaaa

SEQ ID NO: 1330573 - RNA, 17 nt, Homo sapiens
auucugagcauacucaa

SEQ ID NO: 1330574 - RNA, 17 nt, Homo sapiens
auucugccuagagugua

SEQ ID NO: 1330575 - RNA, 17 nt, Homo sapiens
auucuuauaguaccuca

SEQ ID NO: 1330576 - RNA, 18 nt, Homo sapiens
auucuucacuguguuuua

SEQ ID NO: 1330577 - RNA, 13 nt, Homo sapiens
auucuuccugcuu

SEQ ID NO: 1330578 - RNA, 14 nt, Homo sapiens
auugaaagaaccag

SEQ ID NO: 1330579 - RNA, 16 nt, Homo sapiens
auugaaaugauuucac

SEQ ID NO: 1330580 - RNA, 13 nt, Homo sapiens
auugacagcaauu

SEQ ID NO: 1330581 - RNA, 14 nt, Homo sapiens
auugacccuagcca

SEQ ID NO: 1330582 - RNA, 13 nt, Homo sapiens
auugacucauaca

SEQ ID NO: 1330583 - RNA, 12 nt, Homo sapiens
auugacuuuguc

SEQ ID NO: 1330584 - RNA, 13 nt, Homo sapiens
auugagauuuacc

SEQ ID NO: 1330585 - RNA, 16 nt, Homo sapiens
auugagugaaacauug

SEQ ID NO: 1330586 - RNA, 17 nt, Homo sapiens
auugauggguuaauuaa

SEQ ID NO: 1330587 - RNA, 21 nt, Homo sapiens
auugaugugguauaaaugccc

SEQ ID NO: 1330588 - RNA, 20 nt, Homo sapiens
auugauucacuuacugacuu

SEQ ID NO: 1330589 - RNA, 15 nt, Homo sapiens
auugcauuuauaugu

SEQ ID NO: 1330590 - RNA, 13 nt, Homo sapiens
auugcuggcugcc

SEQ ID NO: 1330591 - RNA, 22 nt, Homo sapiens
auuggcaucucuccccauauau

SEQ ID NO: 1330592 - RNA, 15 nt, Homo sapiens
auuggccuguucccc

SEQ ID NO: 1330593 - RNA, 14 nt, Homo sapiens
auuggcugccuuau

SEQ ID NO: 1330594 - RNA, 19 nt, Homo sapiens
auugggcuugugauuucca

SEQ ID NO: 1330595 - RNA, 23 nt, Homo sapiens
auuguaaagauccuauagcucuu

SEQ ID NO: 1330596 - RNA, 17 nt, Homo sapiens
auuguagauaacacuga

SEQ ID NO: 1330597 - RNA, 13 nt, Homo sapiens
auuguagccucaa

SEQ ID NO: 1330598 - RNA, 16 nt, Homo sapiens
auuguaugaaguuuga

SEQ ID NO: 1330599 - RNA, 17 nt, Homo sapiens
auuguauuuaagacaua

SEQ ID NO: 1330600 - RNA, 22 nt, Homo sapiens
auugucaacacaaacuggcuua

SEQ ID NO: 1330601 - RNA, 18 nt, Homo sapiens
auuguccccuaaaccaaa

SEQ ID NO: 1330602 - RNA, 21 nt, Homo sapiens
auuguccccuaaaccaaaaac

SEQ ID NO: 1330603 - RNA, 15 nt, Homo sapiens
auugucccucugccc

SEQ ID NO: 1330604 - RNA, 12 nt, Homo sapiens
auugucccugaa

SEQ ID NO: 1330605 - RNA, 21 nt, Homo sapiens
auugugagcgaauuagcaaua

SEQ ID NO: 1330606 - RNA, 16 nt, Homo sapiens
auugugcaugcuagug

SEQ ID NO: 1330607 - RNA, 21 nt, Homo sapiens
auugugccuacgaauagccac

SEQ ID NO: 1330608 - RNA, 22 nt, Homo sapiens
auugugcuccuucggauaugau

SEQ ID NO: 1330609 - RNA, 20 nt, Homo sapiens
auuguuauauuacuugccua

SEQ ID NO: 1330610 - RNA, 15 nt, Homo sapiens
auuuaagccuuauaa

SEQ ID NO: 1330611 - RNA, 12 nt, Homo sapiens
auuuaagugaau

SEQ ID NO: 1330612 - RNA, 21 nt, Homo sapiens
auuuaauaaaugugccuucau

SEQ ID NO: 1330613 - RNA, 17 nt, Homo sapiens
auuuaauauuacagaua

SEQ ID NO: 1330614 - RNA, 17 nt, Homo sapiens
auuuaauuugaagauag

SEQ ID NO: 1330615 - RNA, 20 nt, Homo sapiens
auuuacauacucugcuuaga

SEQ ID NO: 1330616 - RNA, 14 nt, Homo sapiens
auuuaccaaaguag

SEQ ID NO: 1330617 - RNA, 22 nt, Homo sapiens
auuuaccuguuuuucaguauuu

SEQ ID NO: 1330618 - RNA, 18 nt, Homo sapiens
auuuaccuucuaccucuu

SEQ ID NO: 1330619 - RNA, 16 nt, Homo sapiens
auuuagaaaaagucaa

SEQ ID NO: 1330620 - RNA, 15 nt, Homo sapiens
auuuagauucacuua

SEQ ID NO: 1330621 - RNA, 13 nt, Homo sapiens
auuuaguccugua

SEQ ID NO: 1330622 - RNA, 13 nt, Homo sapiens
auuuauauuucaa

SEQ ID NO: 1330623 - RNA, 21 nt, Homo sapiens
auuuaugguucucaggccuga

SEQ ID NO: 1330624 - RNA, 12 nt, Homo sapiens
auuuauuaacua

SEQ ID NO: 1330625 - RNA, 15 nt, Homo sapiens
auuucaagucucuca

SEQ ID NO: 1330626 - RNA, 12 nt, Homo sapiens
auuucagacucc

SEQ ID NO: 1330627 - RNA, 23 nt, Homo sapiens
auuucaguaguggugaugguugu

SEQ ID NO: 1330628 - RNA, 21 nt, Homo sapiens
auuuccaaaccuccacugcug

SEQ ID NO: 1330629 - RNA, 13 nt, Homo sapiens
auuuccucugggc

SEQ ID NO: 1330630 - RNA, 14 nt, Homo sapiens
auuuccucuuauca

SEQ ID NO: 1330631 - RNA, 10 nt, Homo sapiens
auuuccuugu

SEQ ID NO: 1330632 - RNA, 17 nt, Homo sapiens
auuucuaguaccuguga

SEQ ID NO: 1330633 - RNA, 16 nt, Homo sapiens
auuucugccaggcaug

SEQ ID NO: 1330634 - RNA, 12 nt, Homo sapiens
auuucugugauu

SEQ ID NO: 1330635 - RNA, 15 nt, Homo sapiens
auuucuuaacuucuu

SEQ ID NO: 1330636 - RNA, 24 nt, Homo sapiens
auuucuuucuuugcaccaaagaca

SEQ ID NO: 1330637 - RNA, 23 nt, Homo sapiens
auuugaaaccccuguaggccuca

SEQ ID NO: 1330638 - RNA, 19 nt, Homo sapiens
auuugaacucuucaaucuc

SEQ ID NO: 1330639 - RNA, 22 nt, Homo sapiens
auuugaauagccuguuccuuua

SEQ ID NO: 1330640 - RNA, 17 nt, Homo sapiens
auuugacuaagagucuc

SEQ ID NO: 1330641 - RNA, 15 nt, Homo sapiens
auuugccauagccuu

SEQ ID NO: 1330642 - RNA, 16 nt, Homo sapiens
auuugcuugcaaucua

SEQ ID NO: 1330643 - RNA, 17 nt, Homo sapiens
auuugcuugcaaucuaa

SEQ ID NO: 1330644 - RNA, 18 nt, Homo sapiens
auuuggaggcuaccucac

SEQ ID NO: 1330645 - RNA, 17 nt, Homo sapiens
auuugggccugcuccag

SEQ ID NO: 1330646 - RNA, 20 nt, Homo sapiens
auuuguaguggaaacauuua

SEQ ID NO: 1330647 - RNA, 16 nt, Homo sapiens
auuugugauaucuaau

SEQ ID NO: 1330648 - RNA, 20 nt, Homo sapiens
auuugugguccacugagcua

SEQ ID NO: 1330649 - RNA, 23 nt, Homo sapiens
auuuguuuaaacaaucuuucaug

SEQ ID NO: 1330650 - RNA, 22 nt, Homo sapiens
auuuuaaguaaaagucuaccug

SEQ ID NO: 1330651 - RNA, 13 nt, Homo sapiens
auuuuaccaaagc

SEQ ID NO: 1330652 - RNA, 18 nt, Homo sapiens
auuuuacccacacacaga

SEQ ID NO: 1330653 - RNA, 20 nt, Homo sapiens
auuuuagaauaaauucccaa

SEQ ID NO: 1330654 - RNA, 15 nt, Homo sapiens
auuuuagaaugucaa

SEQ ID NO: 1330655 - RNA, 23 nt, Homo sapiens
auuuuccuccaucgcaguguuca

SEQ ID NO: 1330656 - RNA, 21 nt, Homo sapiens
auuuucuuacacugugucauu

SEQ ID NO: 1330657 - RNA, 15 nt, Homo sapiens
auuuugagaucaguc

SEQ ID NO: 1330658 - RNA, 20 nt, Homo sapiens
auuuugcuaacuggguuaaa

SEQ ID NO: 1330659 - RNA, 23 nt, Homo sapiens
auuuugcuagcuaugagcuuuua

SEQ ID NO: 1330660 - RNA, 11 nt, Homo sapiens
auuuugcucaa

SEQ ID NO: 1330661 - RNA, 12 nt, Homo sapiens
auuuugcucaac

SEQ ID NO: 1330662 - RNA, 15 nt, Homo sapiens
auuuugggggucauc

SEQ ID NO: 1330663 - RNA, 21 nt, Homo sapiens
auuuuguaauaaacucucuag

SEQ ID NO: 1330664 - RNA, 18 nt, Homo sapiens
auuuuguaauaauaaaga

SEQ ID NO: 1330665 - RNA, 23 nt, Homo sapiens
auuuugugaauugugacauaaua

SEQ ID NO: 1330666 - RNA, 16 nt, Homo sapiens
auuuuguugcuuucuu

SEQ ID NO: 1330667 - RNA, 14 nt, Homo sapiens
auuuuucaagagau

SEQ ID NO: 1330668 - RNA, 15 nt, Homo sapiens
auuuuuccaacuacu

SEQ ID NO: 1330669 - RNA, 19 nt, Homo sapiens
auuuuuccaguaacuuuuc

SEQ ID NO: 1330670 - RNA, 16 nt, Homo sapiens
auuuuugucugcagcu

SEQ ID NO: 1330671 - RNA, 17 nt, Homo sapiens
auuuuuguuagcaaaga

SEQ ID NO: 1330672 - RNA, 15 nt, Homo sapiens
cugggauuacaggcg

SEQ ID NO: 1330673 - RNA, 23 nt, Homo sapiens
cugggcagaccccucuaccuccu

SEQ ID NO: 1330674 - RNA, 16 nt, Homo sapiens
cugggcaucucugagc

SEQ ID NO: 1330675 - RNA, 15 nt, Homo sapiens
cugggccacugggga

SEQ ID NO: 1330676 - RNA, 19 nt, Homo sapiens
cuggggacagcuuccucac

SEQ ID NO: 1330677 - RNA, 21 nt, Homo sapiens
cuggggaugucucucaugacc

SEQ ID NO: 1330678 - RNA, 15 nt, Homo sapiens
cuggggcaggucacu

SEQ ID NO: 1330679 - RNA, 18 nt, Homo sapiens
cuggggcaggucacuuua

SEQ ID NO: 1330680 - RNA, 19 nt, Homo sapiens
cuggggcaggucacuuuac

SEQ ID NO: 1330681 - RNA, 15 nt, Homo sapiens
cugggggaguggaau

SEQ ID NO: 1330682 - RNA, 23 nt, Homo sapiens
cuggggguccucucugagucaaa

SEQ ID NO: 1330683 - RNA, 17 nt, Homo sapiens
cuggggugggcaguuuu

SEQ ID NO: 1330684 - RNA, 21 nt, Homo sapiens
cugggguggggucaugcccuc

SEQ ID NO: 1330685 - RNA, 14 nt, Homo sapiens
cugggucugaguca

SEQ ID NO: 1330686 - RNA, 16 nt, Homo sapiens
cuggguggaagugugu

SEQ ID NO: 1330687 - RNA, 21 nt, Homo sapiens
cuggguggaagugugugccaa

SEQ ID NO: 1330688 - RNA, 20 nt, Homo sapiens
cugguaauaaaugugacuca

SEQ ID NO: 1330689 - RNA, 22 nt, Homo sapiens
cugguaauauugacuuguauau

SEQ ID NO: 1330690 - RNA, 20 nt, Homo sapiens
cugguacugcaggaccucca

SEQ ID NO: 1330691 - RNA, 20 nt, Homo sapiens
cugguauauguaaguguuca

SEQ ID NO: 1330692 - RNA, 18 nt, Homo sapiens
cugguauuuauauuucaa

SEQ ID NO: 1330693 - RNA, 23 nt, Homo sapiens
cuggucauacauaggaugacaaa

SEQ ID NO: 1330694 - RNA, 19 nt, Homo sapiens
cuggucgccaauccaugcu

SEQ ID NO: 1330695 - RNA, 13 nt, Homo sapiens
cuggucuugugga

SEQ ID NO: 1330696 - RNA, 12 nt, Homo sapiens
cuggugcaugac

SEQ ID NO: 1330697 - RNA, 18 nt, Homo sapiens
cuggugguggcaccaucu

SEQ ID NO: 1330698 - RNA, 18 nt, Homo sapiens
cuguaacaggguagugug

SEQ ID NO: 1330699 - RNA, 20 nt, Homo sapiens
cuguaacuuccaaauaaaua

SEQ ID NO: 1330700 - RNA, 12 nt, Homo sapiens
cuguaagggcag

SEQ ID NO: 1330701 - RNA, 18 nt, Homo sapiens
cuguaaucccagcacuuu

SEQ ID NO: 1330702 - RNA, 17 nt, Homo sapiens
cuguaauccuagcacuu

SEQ ID NO: 1330703 - RNA, 14 nt, Homo sapiens
cuguacacagaauu

SEQ ID NO: 1330704 - RNA, 20 nt, Homo sapiens
cuguacacagaauuguucca

SEQ ID NO: 1330705 - RNA, 12 nt, Homo sapiens
cuguaccaguua

SEQ ID NO: 1330706 - RNA, 16 nt, Homo sapiens
cuguaccgacuuugau

SEQ ID NO: 1330707 - RNA, 19 nt, Homo sapiens
cuguacuaacccagucuuu

SEQ ID NO: 1330708 - RNA, 19 nt, Homo sapiens
cuguaggcacacuuugcac

SEQ ID NO: 1330709 - RNA, 15 nt, Homo sapiens
cuguauacugagucu

SEQ ID NO: 1330710 - RNA, 15 nt, Homo sapiens
cuguaucuaguugua

SEQ ID NO: 1330711 - RNA, 15 nt, Homo sapiens
cuguaugcucacaac

SEQ ID NO: 1330712 - RNA, 15 nt, Homo sapiens
cuguauggaaacacu

SEQ ID NO: 1330713 - RNA, 17 nt, Homo sapiens
cuguaugugagcuguaa

SEQ ID NO: 1330714 - RNA, 17 nt, Homo sapiens
cuguauuucaagaccuc

SEQ ID NO: 1330715 - RNA, 20 nt, Homo sapiens
cuguauuuuuaaauugccaa

SEQ ID NO: 1330716 - RNA, 22 nt, Homo sapiens
cugucacagguuuucagagaau

SEQ ID NO: 1330717 - RNA, 13 nt, Homo sapiens
cugucacccacag

SEQ ID NO: 1330718 - RNA, 20 nt, Homo sapiens
cuguccacuuggagcuaaaa

SEQ ID NO: 1330719 - RNA, 21 nt, Homo sapiens
cuguccccaaaccuauggaag

SEQ ID NO: 1330720 - RNA, 16 nt, Homo sapiens
cuguccccacacugac

SEQ ID NO: 1330721 - RNA, 19 nt, Homo sapiens
cugucccucauccauagca

SEQ ID NO: 1330722 - RNA, 22 nt, Homo sapiens
cuguccucagccuugccagaga

SEQ ID NO: 1330723 - RNA, 15 nt, Homo sapiens
cuguccucuuuguga

SEQ ID NO: 1330724 - RNA, 14 nt, Homo sapiens
cuguccugcagucc

SEQ ID NO: 1330725 - RNA, 13 nt, Homo sapiens
cugucuccagggc

SEQ ID NO: 1330726 - RNA, 15 nt, Homo sapiens
cugucucuccaguga

SEQ ID NO: 1330727 - RNA, 17 nt, Homo sapiens
cugucucuccagugaaa

SEQ ID NO: 1330728 - RNA, 12 nt, Homo sapiens
cugucucugagg

SEQ ID NO: 1330729 - RNA, 23 nt, Homo sapiens
cugucugaguaagcccucaggag

SEQ ID NO: 1330730 - RNA, 17 nt, Homo sapiens
cugucuggcccugggga

SEQ ID NO: 1330731 - RNA, 20 nt, Homo sapiens
cugucuguuuccucuguaua

SEQ ID NO: 1330732 - RNA, 19 nt, Homo sapiens
cugucuucagagaacccac

SEQ ID NO: 1330733 - RNA, 16 nt, Homo sapiens
cugucuucuuucucca

SEQ ID NO: 1330734 - RNA, 15 nt, Homo sapiens
cugucuuggggccac

SEQ ID NO: 1330735 - RNA, 16 nt, Homo sapiens
cugugaacccacugaa

SEQ ID NO: 1330736 - RNA, 21 nt, Homo sapiens
cugugacucccccucuuucac

SEQ ID NO: 1330737 - RNA, 18 nt, Homo sapiens
cugugagcauggggccag

SEQ ID NO: 1330738 - RNA, 16 nt, Homo sapiens
cugugaguauugcuua

SEQ ID NO: 1330739 - RNA, 14 nt, Homo sapiens
cugugauagaggcu

SEQ ID NO: 1330740 - RNA, 13 nt, Homo sapiens
cugugaucuugcu

SEQ ID NO: 1330741 - RNA, 20 nt, Homo sapiens
cugugcauacuuucccucau

SEQ ID NO: 1330742 - RNA, 20 nt, Homo sapiens
cugugcccaccaugacccuc

SEQ ID NO: 1330743 - RNA, 19 nt, Homo sapiens
cugugcccuagaugcacgu

SEQ ID NO: 1330744 - RNA, 15 nt, Homo sapiens
cugugccuugccaca

SEQ ID NO: 1330745 - RNA, 21 nt, Homo sapiens
cugugccuuggugugcuguau

SEQ ID NO: 1330746 - RNA, 16 nt, Homo sapiens
cugugccuuuuaucua

SEQ ID NO: 1330747 - RNA, 18 nt, Homo sapiens
cugugcuccacacucaga

SEQ ID NO: 1330748 - RNA, 22 nt, Homo sapiens
cugugcuguacugagcacugaa

SEQ ID NO: 1330749 - RNA, 16 nt, Homo sapiens
cuguggaacauaaaaa

SEQ ID NO: 1330750 - RNA, 17 nt, Homo sapiens
cuguggaugcaaauaga

SEQ ID NO: 1330751 - RNA, 13 nt, Homo sapiens
cuguggcuuucag

SEQ ID NO: 1330752 - RNA, 16 nt, Homo sapiens
cuguggggaacacagc

SEQ ID NO: 1330753 - RNA, 14 nt, Homo sapiens
cuguguacugccuu

SEQ ID NO: 1330754 - RNA, 13 nt, Homo sapiens
cugugucauuuca

SEQ ID NO: 1330755 - RNA, 18 nt, Homo sapiens
cuguguuuuaaaaggcaa

SEQ ID NO: 1330756 - RNA, 18 nt, Homo sapiens
cuguguuuuuuucuaaaa

SEQ ID NO: 1330757 - RNA, 16 nt, Homo sapiens
cuguuaacuaugacag

SEQ ID NO: 1330758 - RNA, 21 nt, Homo sapiens
cuguuaguaaauuucugugau

SEQ ID NO: 1330759 - RNA, 19 nt, Homo sapiens
cuguuauauuucaucauga

SEQ ID NO: 1330760 - RNA, 18 nt, Homo sapiens
cuguuaucaaacugcugu

SEQ ID NO: 1330761 - RNA, 17 nt, Homo sapiens
cuguuaugucagaggaa

SEQ ID NO: 1330762 - RNA, 16 nt, Homo sapiens
cuguuauuaacagaua

SEQ ID NO: 1330763 - RNA, 21 nt, Homo sapiens
cuguuccccucugcuacuagc

SEQ ID NO: 1330764 - RNA, 16 nt, Homo sapiens
cuguucuaacauguaa

SEQ ID NO: 1330765 - RNA, 18 nt, Homo sapiens
cuguucugcgcuguguac

SEQ ID NO: 1330766 - RNA, 22 nt, Homo sapiens
cuguucuuagaguguagcugua

SEQ ID NO: 1330767 - RNA, 18 nt, Homo sapiens
cuguugaauuucccacau

SEQ ID NO: 1330768 - RNA, 14 nt, Homo sapiens
cuguuggaugacuu

SEQ ID NO: 1330769 - RNA, 15 nt, Homo sapiens
cuguugguaaagcac

SEQ ID NO: 1330770 - RNA, 17 nt, Homo sapiens
cuguugguaaagcacau

SEQ ID NO: 1330771 - RNA, 18 nt, Homo sapiens
cuguugguaaagcacaug

SEQ ID NO: 1330772 - RNA, 19 nt, Homo sapiens
cuguugguaaagcacaugg

SEQ ID NO: 1330773 - RNA, 17 nt, Homo sapiens
cuguugucacaucucag

SEQ ID NO: 1330774 - RNA, 15 nt, Homo sapiens
cuguuuaaaguguca

SEQ ID NO: 1330775 - RNA, 16 nt, Homo sapiens
cuguuuaaagugucac

SEQ ID NO: 1330776 - RNA, 17 nt, Homo sapiens
cuguuuauuugcacuau

SEQ ID NO: 1330777 - RNA, 23 nt, Homo sapiens
cuguuuccuuuuacaauuguuga

SEQ ID NO: 1330778 - RNA, 20 nt, Homo sapiens
cuguuucucaagaccaacag

SEQ ID NO: 1330779 - RNA, 13 nt, Homo sapiens
cuguuucuggucu

SEQ ID NO: 1330780 - RNA, 13 nt, Homo sapiens
cuguuucuuuaaa

SEQ ID NO: 1330781 - RNA, 17 nt, Homo sapiens
cuguuugacaacauguu

SEQ ID NO: 1330782 - RNA, 19 nt, Homo sapiens
cuguuugauacaguauuau

SEQ ID NO: 1330783 - RNA, 17 nt, Homo sapiens
cuguuuugcauggagua

SEQ ID NO: 1330784 - RNA, 12 nt, Homo sapiens
cuguuuugccag

SEQ ID NO: 1330785 - RNA, 14 nt, Homo sapiens
cuuaaaaguaauaa

SEQ ID NO: 1330786 - RNA, 19 nt, Homo sapiens
cuuaaaaugaauuauguua

SEQ ID NO: 1330787 - RNA, 20 nt, Homo sapiens
cuuaaaauggcaaguuuucc

SEQ ID NO: 1330788 - RNA, 22 nt, Homo sapiens
cuuaaaauugugagcgaauuag

SEQ ID NO: 1330789 - RNA, 16 nt, Homo sapiens
cuuaaacucuguuaca

SEQ ID NO: 1330790 - RNA, 18 nt, Homo sapiens
cuuaaacugcugaauuca

SEQ ID NO: 1330791 - RNA, 14 nt, Homo sapiens
cuuaaauccauccu

SEQ ID NO: 1330792 - RNA, 13 nt, Homo sapiens
cuuaacacauuca

SEQ ID NO: 1330793 - RNA, 22 nt, Homo sapiens
cuuaacccccuagaaagacaga

SEQ ID NO: 1330794 - RNA, 13 nt, Homo sapiens
cuuaagccaaacu

SEQ ID NO: 1330795 - RNA, 21 nt, Homo sapiens
cuuaagccagcacucacacca

SEQ ID NO: 1330796 - RNA, 23 nt, Homo sapiens
cuuaaggucauaaaaauauuguu

SEQ ID NO: 1330797 - RNA, 14 nt, Homo sapiens
cuuaauaaacugug

SEQ ID NO: 1330798 - RNA, 22 nt, Homo sapiens
cuuaauaaacuguggugcuuuu

SEQ ID NO: 1330799 - RNA, 14 nt, Homo sapiens
cuuaaugacaacac

SEQ ID NO: 1330800 - RNA, 15 nt, Homo sapiens
cuuaaugacauuccc

SEQ ID NO: 1330801 - RNA, 22 nt, Homo sapiens
cuuacauccaaggcacugucac

SEQ ID NO: 1330802 - RNA, 21 nt, Homo sapiens
cuuaccagggucuuugcagau

SEQ ID NO: 1330803 - RNA, 16 nt, Homo sapiens
cuuaccugggcacaaa

SEQ ID NO: 1330804 - RNA, 23 nt, Homo sapiens
gauccaaaagaagcccccagcua

SEQ ID NO: 1330805 - RNA, 18 nt, Homo sapiens
gaucggcggccacugcgc

SEQ ID NO: 1330806 - RNA, 22 nt, Homo sapiens
gaucgucugguuagaaaacaua

SEQ ID NO: 1330807 - RNA, 18 nt, Homo sapiens
gaucguucucugccucac

SEQ ID NO: 1330808 - RNA, 18 nt, Homo sapiens
gaucucggcucacugcaa

SEQ ID NO: 1330809 - RNA, 11 nt, Homo sapiens
gaucucucuug

SEQ ID NO: 1330810 - RNA, 15 nt, Homo sapiens
gaucugcugcugaga

SEQ ID NO: 1330811 - RNA, 20 nt, Homo sapiens
gaucuguuuuggauguugcu

SEQ ID NO: 1330812 - RNA, 18 nt, Homo sapiens
gaucuucagaacugcccu

SEQ ID NO: 1330813 - RNA, 19 nt, Homo sapiens
gaucuuucuuuccaaaaca

SEQ ID NO: 1330814 - RNA, 15 nt, Homo sapiens
gaugaaugucaguug

SEQ ID NO: 1330815 - RNA, 14 nt, Homo sapiens
gaugaccuccagaa

SEQ ID NO: 1330816 - RNA, 22 nt, Homo sapiens
gaugacucugucucauugaccu

SEQ ID NO: 1330817 - RNA, 18 nt, Homo sapiens
gaugagagaauguggaaa

SEQ ID NO: 1330818 - RNA, 18 nt, Homo sapiens
gaugauuuaauauggauu

SEQ ID NO: 1330819 - RNA, 16 nt, Homo sapiens
gaugcaggauuucuuc

SEQ ID NO: 1330820 - RNA, 18 nt, Homo sapiens
gaugcauauagacacaca

SEQ ID NO: 1330821 - RNA, 17 nt, Homo sapiens
gaugccccagagcucua

SEQ ID NO: 1330822 - RNA, 13 nt, Homo sapiens
gaugcuaaaaccu

SEQ ID NO: 1330823 - RNA, 23 nt, Homo sapiens
gaugcuaagagaaaaaaaagacu

SEQ ID NO: 1330824 - RNA, 22 nt, Homo sapiens
gaugcugagccaacugcuugga

SEQ ID NO: 1330825 - RNA, 13 nt, Homo sapiens
gaugcugugaaga

SEQ ID NO: 1330826 - RNA, 14 nt, Homo sapiens
gauggaagcuuguu

SEQ ID NO: 1330827 - RNA, 14 nt, Homo sapiens
gauggggcaucggu

SEQ ID NO: 1330828 - RNA, 20 nt, Homo sapiens
gauguaucccugccccgugg

SEQ ID NO: 1330829 - RNA, 22 nt, Homo sapiens
gauguggaucacgcagugcuuu

SEQ ID NO: 1330830 - RNA, 23 nt, Homo sapiens
gauuaacuaaagaagaggagaaa

SEQ ID NO: 1330831 - RNA, 14 nt, Homo sapiens
gauuaauauuauua

SEQ ID NO: 1330832 - RNA, 21 nt, Homo sapiens
gauuacaaaucagaagucauc

SEQ ID NO: 1330833 - RNA, 18 nt, Homo sapiens
gauuacagaaacugaugc

SEQ ID NO: 1330834 - RNA, 12 nt, Homo sapiens
gauuacagaucu

SEQ ID NO: 1330835 - RNA, 22 nt, Homo sapiens
gauuagagaccagaucagauaa

SEQ ID NO: 1330836 - RNA, 18 nt, Homo sapiens
gauuaguugacaguauua

SEQ ID NO: 1330837 - RNA, 16 nt, Homo sapiens
gauuauaaacaaccua

SEQ ID NO: 1330838 - RNA, 21 nt, Homo sapiens
gauuauuggaaauuuguuaua

SEQ ID NO: 1330839 - RNA, 22 nt, Homo sapiens
gauucaagacaagagcuguuau

SEQ ID NO: 1330840 - RNA, 20 nt, Homo sapiens
gauuccccaucaacaaacac

SEQ ID NO: 1330841 - RNA, 17 nt, Homo sapiens
gauucuagaacugugaa

SEQ ID NO: 1330842 - RNA, 15 nt, Homo sapiens
gauucuccugccuca

SEQ ID NO: 1330843 - RNA, 16 nt, Homo sapiens
gauucuccugccucag

SEQ ID NO: 1330844 - RNA, 16 nt, Homo sapiens
gauucuuccugcuuag

SEQ ID NO: 1330845 - RNA, 16 nt, Homo sapiens
gauugaaagaaccaga

SEQ ID NO: 1330846 - RNA, 16 nt, Homo sapiens
gauugcugagagccau

SEQ ID NO: 1330847 - RNA, 16 nt, Homo sapiens
gauuguaacaaauuga

SEQ ID NO: 1330848 - RNA, 14 nt, Homo sapiens
gauugucaacacaa

SEQ ID NO: 1330849 - RNA, 22 nt, Homo sapiens
gauuuaagccuuacaaagggaa

SEQ ID NO: 1330850 - RNA, 14 nt, Homo sapiens
gauuuaauucacau

SEQ ID NO: 1330851 - RNA, 20 nt, Homo sapiens
gauuuccauuugcaacagga

SEQ ID NO: 1330852 - RNA, 12 nt, Homo sapiens
gauuuccuugac

SEQ ID NO: 1330853 - RNA, 21 nt, Homo sapiens
gauuuccuugacuucuuugag

SEQ ID NO: 1330854 - RNA, 22 nt, Homo sapiens
gauuucuuucuuugcaccaaag

SEQ ID NO: 1330855 - RNA, 20 nt, Homo sapiens
gauuuucuuccuccaauagu

SEQ ID NO: 1330856 - RNA, 18 nt, Homo sapiens
gauuuuuuccucugcauu

SEQ ID NO: 1330857 - RNA, 11 nt, Homo sapiens
gcaaaagugaa

SEQ ID NO: 1330858 - RNA, 12 nt, Homo sapiens
gcaaacuggccg

SEQ ID NO: 1330859 - RNA, 12 nt, Homo sapiens
gcaaaggaacua

SEQ ID NO: 1330860 - RNA, 16 nt, Homo sapiens
gcaaaggcgucugaau

SEQ ID NO: 1330861 - RNA, 11 nt, Homo sapiens
gcaaagggaau

SEQ ID NO: 1330862 - RNA, 13 nt, Homo sapiens
gcaaauacaauca

SEQ ID NO: 1330863 - RNA, 15 nt, Homo sapiens
gcaaauacaaucagc

SEQ ID NO: 1330864 - RNA, 16 nt, Homo sapiens
gcaaaugccugacuca

SEQ ID NO: 1330865 - RNA, 16 nt, Homo sapiens
gcaaauuuucuuccau

SEQ ID NO: 1330866 - RNA, 21 nt, Homo sapiens
gcaacaugccagccacuguga

SEQ ID NO: 1330867 - RNA, 23 nt, Homo sapiens
gcaacgcaggcccccaggugcca

SEQ ID NO: 1330868 - RNA, 14 nt, Homo sapiens
gcaacggcccucca

SEQ ID NO: 1330869 - RNA, 14 nt, Homo sapiens
gcaagaaacaguuu

SEQ ID NO: 1330870 - RNA, 22 nt, Homo sapiens
gcaagauaaacauuauuaagua

SEQ ID NO: 1330871 - RNA, 22 nt, Homo sapiens
gcaagaucauagcucauugcaa

SEQ ID NO: 1330872 - RNA, 15 nt, Homo sapiens
gcaagcaccaaccuc

SEQ ID NO: 1330873 - RNA, 16 nt, Homo sapiens
gcaagccugucuucag

SEQ ID NO: 1330874 - RNA, 13 nt, Homo sapiens
gcaagcuccugca

SEQ ID NO: 1330875 - RNA, 22 nt, Homo sapiens
gcaaggacugcagggacugcca

SEQ ID NO: 1330876 - RNA, 18 nt, Homo sapiens
gcaaguaaguaugaagga

SEQ ID NO: 1330877 - RNA, 13 nt, Homo sapiens
gcaagucaaauac

SEQ ID NO: 1330878 - RNA, 14 nt, Homo sapiens
gcaagucacuggcc

SEQ ID NO: 1330879 - RNA, 16 nt, Homo sapiens
gcaaguggagcugucu

SEQ ID NO: 1330880 - RNA, 15 nt, Homo sapiens
gcaauaaaagacaaa

SEQ ID NO: 1330881 - RNA, 15 nt, Homo sapiens
gcaauauauaauuga

SEQ ID NO: 1330882 - RNA, 23 nt, Homo sapiens
gcaaucuaaucugaacugaccuu

SEQ ID NO: 1330883 - RNA, 16 nt, Homo sapiens
gcaaucucagaugcag

SEQ ID NO: 1330884 - RNA, 14 nt, Homo sapiens
gcaaucuuugccuu

SEQ ID NO: 1330885 - RNA, 17 nt, Homo sapiens
gcaaucuuugccuuuau

SEQ ID NO: 1330886 - RNA, 13 nt, Homo sapiens
gcaaugacucagg

SEQ ID NO: 1330887 - RNA, 20 nt, Homo sapiens
gcaauucaugguucaaguau

SEQ ID NO: 1330888 - RNA, 14 nt, Homo sapiens
gcaauuuagcucuc

SEQ ID NO: 1330889 - RNA, 15 nt, Homo sapiens
gcacaaaacuacuuu

SEQ ID NO: 1330890 - RNA, 12 nt, Homo sapiens
gcacaaguacuu

SEQ ID NO: 1330891 - RNA, 12 nt, Homo sapiens
gcacacacugug

SEQ ID NO: 1330892 - RNA, 13 nt, Homo sapiens
gcacacacugugc

SEQ ID NO: 1330893 - RNA, 22 nt, Homo sapiens
gcacacuaguuuaugcuaccua

SEQ ID NO: 1330894 - RNA, 12 nt, Homo sapiens
gcacacuggccu

SEQ ID NO: 1330895 - RNA, 17 nt, Homo sapiens
gcacagagggaagccau

SEQ ID NO: 1330896 - RNA, 21 nt, Homo sapiens
gcacagccuuugcccaaaacu

SEQ ID NO: 1330897 - RNA, 19 nt, Homo sapiens
gcacaggucccacugcccu

SEQ ID NO: 1330898 - RNA, 18 nt, Homo sapiens
gcacaguugccacauuua

SEQ ID NO: 1330899 - RNA, 10 nt, Homo sapiens
gcaccaaaga

SEQ ID NO: 1330900 - RNA, 16 nt, Homo sapiens
gcaccaaccuccagac

SEQ ID NO: 1330901 - RNA, 14 nt, Homo sapiens
gcaccagggcucac

SEQ ID NO: 1330902 - RNA, 19 nt, Homo sapiens
gcaccaucagccuguucca

SEQ ID NO: 1330903 - RNA, 19 nt, Homo sapiens
gcaccaucucacugcagua

SEQ ID NO: 1330904 - RNA, 18 nt, Homo sapiens
gcaccccacacuggagcc

SEQ ID NO: 1330905 - RNA, 22 nt, Homo sapiens
gcacccugcccaccaagaagca

SEQ ID NO: 1330906 - RNA, 20 nt, Homo sapiens
gcacccugcgccuccagagg

SEQ ID NO: 1330907 - RNA, 21 nt, Homo sapiens
gcacccugcgccuccagaggu

SEQ ID NO: 1330908 - RNA, 23 nt, Homo sapiens
gcacuaaaaugaggauccagggc

SEQ ID NO: 1330909 - RNA, 13 nt, Homo sapiens
gcacucacgcccu

SEQ ID NO: 1330910 - RNA, 13 nt, Homo sapiens
gcacugaugcugc

SEQ ID NO: 1330911 - RNA, 14 nt, Homo sapiens
gcacuuucuucucu

SEQ ID NO: 1330912 - RNA, 14 nt, Homo sapiens
gcagaaauugaccu

SEQ ID NO: 1330913 - RNA, 21 nt, Homo sapiens
gcagaagccuccccagcucac

SEQ ID NO: 1330914 - RNA, 15 nt, Homo sapiens
gcagacucgggacca

SEQ ID NO: 1330915 - RNA, 23 nt, Homo sapiens
gcagagaccagcccaccccugug

SEQ ID NO: 1330916 - RNA, 16 nt, Homo sapiens
gcagagguugcaguga

SEQ ID NO: 1330917 - RNA, 17 nt, Homo sapiens
gcagaguuacaguucug

SEQ ID NO: 1330918 - RNA, 21 nt, Homo sapiens
gcagauacugucucuuucaug

SEQ ID NO: 1330919 - RNA, 14 nt, Homo sapiens
gcagaucucccaca

SEQ ID NO: 1330920 - RNA, 20 nt, Homo sapiens
gcagauuuccagccuucuac

SEQ ID NO: 1330921 - RNA, 14 nt, Homo sapiens
gcagcccagggccu

SEQ ID NO: 1330922 - RNA, 17 nt, Homo sapiens
gcagcgccuuucccaac

SEQ ID NO: 1330923 - RNA, 19 nt, Homo sapiens
gcagcggcuccugcaaaag

SEQ ID NO: 1330924 - RNA, 15 nt, Homo sapiens
gcagcuagugccuuu

SEQ ID NO: 1330925 - RNA, 17 nt, Homo sapiens
gcagcuugaaacugaga

SEQ ID NO: 1330926 - RNA, 22 nt, Homo sapiens
gcaggaguuugugguaacuuga

SEQ ID NO: 1330927 - RNA, 16 nt, Homo sapiens
gcagggacugccaguc

SEQ ID NO: 1330928 - RNA, 15 nt, Homo sapiens
gcagggccaccugca

SEQ ID NO: 1330929 - RNA, 20 nt, Homo sapiens
gcagggcugggccagugcau

SEQ ID NO: 1330930 - RNA, 22 nt, Homo sapiens
gcaggggaagcucucacucugu

SEQ ID NO: 1330931 - RNA, 20 nt, Homo sapiens
gcaggggaauucccuccccc

SEQ ID NO: 1330932 - RNA, 13 nt, Homo sapiens
gcaggggagacag

SEQ ID NO: 1330933 - RNA, 14 nt, Homo sapiens
gcaggggaggggug

SEQ ID NO: 1330934 - RNA, 21 nt, Homo sapiens
gcaggggggcaguaacucccc

SEQ ID NO: 1330935 - RNA, 18 nt, Homo sapiens
gcaggugagcaagcccag

SEQ ID NO: 1330936 - RNA, 20 nt, Homo sapiens
gcagguuccccaagggcccu

SEQ ID NO: 1330937 - RNA, 17 nt, Homo sapiens
ggccagaugcacauccc

SEQ ID NO: 1330938 - RNA, 20 nt, Homo sapiens
ggccaggacgggccacacgu

SEQ ID NO: 1330939 - RNA, 19 nt, Homo sapiens
ggccauaaacgguuccugg

SEQ ID NO: 1330940 - RNA, 19 nt, Homo sapiens
ggccauuugugauacuucc

SEQ ID NO: 1330941 - RNA, 12 nt, Homo sapiens
ggccccaucucu

SEQ ID NO: 1330942 - RNA, 21 nt, Homo sapiens
ggcccucccugucuccagggc

SEQ ID NO: 1330943 - RNA, 23 nt, Homo sapiens
ggcccuuccucuccacugccuuc

SEQ ID NO: 1330944 - RNA, 15 nt, Homo sapiens
ggccgggcagggugu

SEQ ID NO: 1330945 - RNA, 13 nt, Homo sapiens
ggccuccaugcac

SEQ ID NO: 1330946 - RNA, 14 nt, Homo sapiens
ggccugcuccagac

SEQ ID NO: 1330947 - RNA, 18 nt, Homo sapiens
ggccugcuccagaccuga

SEQ ID NO: 1330948 - RNA, 18 nt, Homo sapiens
ggccuguggcuaauggag

SEQ ID NO: 1330949 - RNA, 18 nt, Homo sapiens
ggccuuucccucuucccu

SEQ ID NO: 1330950 - RNA, 20 nt, Homo sapiens
ggcgaccccgucacagccuc

SEQ ID NO: 1330951 - RNA, 20 nt, Homo sapiens
ggcggguguggagaccaggc

SEQ ID NO: 1330952 - RNA, 12 nt, Homo sapiens
ggcuaaucagua

SEQ ID NO: 1330953 - RNA, 17 nt, Homo sapiens
ggcuaccucaccugggc

SEQ ID NO: 1330954 - RNA, 19 nt, Homo sapiens
ggcuacugguuaccuggag

SEQ ID NO: 1330955 - RNA, 18 nt, Homo sapiens
ggcuacuguaaugcugcc

SEQ ID NO: 1330956 - RNA, 23 nt, Homo sapiens
ggcuaucuaauuuuacacucugu

SEQ ID NO: 1330957 - RNA, 17 nt, Homo sapiens
ggcuauggaggguccuc

SEQ ID NO: 1330958 - RNA, 19 nt, Homo sapiens
ggcucaaacaacauuccac

SEQ ID NO: 1330959 - RNA, 11 nt, Homo sapiens
ggcucaucucu

SEQ ID NO: 1330960 - RNA, 17 nt, Homo sapiens
ggcucauuuugcucaac

SEQ ID NO: 1330961 - RNA, 24 nt, Homo sapiens
ggcucccaugucaagagucgcugu

SEQ ID NO: 1330962 - RNA, 19 nt, Homo sapiens
ggcucccggagggcccuga

SEQ ID NO: 1330963 - RNA, 19 nt, Homo sapiens
ggcucgucagccaccuggg

SEQ ID NO: 1330964 - RNA, 19 nt, Homo sapiens
ggcucucuugugcauugua

SEQ ID NO: 1330965 - RNA, 23 nt, Homo sapiens
ggcucuguggcaaaaagagucag

SEQ ID NO: 1330966 - RNA, 19 nt, Homo sapiens
ggcugacagacucacuggg

SEQ ID NO: 1330967 - RNA, 21 nt, Homo sapiens
ggcugacccagauucccuucc

SEQ ID NO: 1330968 - RNA, 20 nt, Homo sapiens
ggcugaggccucucauucca

SEQ ID NO: 1330969 - RNA, 15 nt, Homo sapiens
ggcugcacaacagcc

SEQ ID NO: 1330970 - RNA, 13 nt, Homo sapiens
ggcugcagguguu

SEQ ID NO: 1330971 - RNA, 14 nt, Homo sapiens
ggcuggagugcaau

SEQ ID NO: 1330972 - RNA, 20 nt, Homo sapiens
ggcuggagugcaauggcgcg

SEQ ID NO: 1330973 - RNA, 13 nt, Homo sapiens
ggcuggauccuau

SEQ ID NO: 1330974 - RNA, 13 nt, Homo sapiens
ggcugugccaacc

SEQ ID NO: 1330975 - RNA, 13 nt, Homo sapiens
ggcuuaaagggau

SEQ ID NO: 1330976 - RNA, 16 nt, Homo sapiens
ggcuucaaaaagccac

SEQ ID NO: 1330977 - RNA, 17 nt, Homo sapiens
ggcuucccuaaacugca

SEQ ID NO: 1330978 - RNA, 19 nt, Homo sapiens
ggcuucucuugagucacac

SEQ ID NO: 1330979 - RNA, 13 nt, Homo sapiens
ggcuuguugacuu

SEQ ID NO: 1330980 - RNA, 20 nt, Homo sapiens
ggcuuuacauggguucaauu

SEQ ID NO: 1330981 - RNA, 12 nt, Homo sapiens
ggcuuuaugcaa

SEQ ID NO: 1330982 - RNA, 22 nt, Homo sapiens
ggcuuuaugcaaauacaaucag

SEQ ID NO: 1330983 - RNA, 23 nt, Homo sapiens
ggcuuucucuuccccuuccuguu

SEQ ID NO: 1330984 - RNA, 19 nt, Homo sapiens
ggcuuugccucuucuuugu

SEQ ID NO: 1330985 - RNA, 16 nt, Homo sapiens
ggcuuuucccuugcuu

SEQ ID NO: 1330986 - RNA, 18 nt, Homo sapiens
gggaaaaggcaggugcuu

SEQ ID NO: 1330987 - RNA, 17 nt, Homo sapiens
gggaacucagauccagg

SEQ ID NO: 1330988 - RNA, 13 nt, Homo sapiens
gggaacugaaauc

SEQ ID NO: 1330989 - RNA, 12 nt, Homo sapiens
gggaacuggcag

SEQ ID NO: 1330990 - RNA, 20 nt, Homo sapiens
gggaagacuuuaaaccaccu

SEQ ID NO: 1330991 - RNA, 16 nt, Homo sapiens
gggagaaugucaguau

SEQ ID NO: 1330992 - RNA, 13 nt, Homo sapiens
gggagcaucucca

SEQ ID NO: 1330993 - RNA, 16 nt, Homo sapiens
gggagccaagggaugg

SEQ ID NO: 1330994 - RNA, 13 nt, Homo sapiens
gggaucuucccac

SEQ ID NO: 1330995 - RNA, 20 nt, Homo sapiens
gggaugcugggcugggcccu

SEQ ID NO: 1330996 - RNA, 19 nt, Homo sapiens
gggcaacauagugauaccc

SEQ ID NO: 1330997 - RNA, 17 nt, Homo sapiens
gggcaauggaaauacca

SEQ ID NO: 1330998 - RNA, 15 nt, Homo sapiens
gggcagagaggcugu

SEQ ID NO: 1330999 - RNA, 17 nt, Homo sapiens
gggcaggccagggcagu

SEQ ID NO: 1331000 - RNA, 15 nt, Homo sapiens
gggcaggcugagggu

SEQ ID NO: 1331001 - RNA, 22 nt, Homo sapiens
gggcaguggagaucaggaguga

SEQ ID NO: 1331002 - RNA, 17 nt, Homo sapiens
gggcaguuccuuaccuc

SEQ ID NO: 1331003 - RNA, 16 nt, Homo sapiens
gggcauggguccaggg

SEQ ID NO: 1331004 - RNA, 22 nt, Homo sapiens
gggccacucaggggucauucau

SEQ ID NO: 1331005 - RNA, 14 nt, Homo sapiens
gggccacuggggac

SEQ ID NO: 1331006 - RNA, 14 nt, Homo sapiens
gggcccccacugua

SEQ ID NO: 1331007 - RNA, 22 nt, Homo sapiens
gggcccugccccaccccaucca

SEQ ID NO: 1331008 - RNA, 17 nt, Homo sapiens
gggccgugagggguccc

SEQ ID NO: 1331009 - RNA, 19 nt, Homo sapiens
gggcggcacagccuucucc

SEQ ID NO: 1331010 - RNA, 16 nt, Homo sapiens
gggcucauuuugcuca

SEQ ID NO: 1331011 - RNA, 18 nt, Homo sapiens
gggcucuagggacugcca

SEQ ID NO: 1331012 - RNA, 15 nt, Homo sapiens
gggcucuguggcaaa

SEQ ID NO: 1331013 - RNA, 23 nt, Homo sapiens
gggcucuucugagcagaaauggc

SEQ ID NO: 1331014 - RNA, 19 nt, Homo sapiens
gggcugauuguauuuaccu

SEQ ID NO: 1331015 - RNA, 20 nt, Homo sapiens
gggcugcccaccuggcugcc

SEQ ID NO: 1331016 - RNA, 13 nt, Homo sapiens
gggcuuuugccac

SEQ ID NO: 1331017 - RNA, 19 nt, Homo sapiens
ggggacauagcugugcuau

SEQ ID NO: 1331018 - RNA, 19 nt, Homo sapiens
ggggagggcgcuggaugca

SEQ ID NO: 1331019 - RNA, 12 nt, Homo sapiens
ggggauuguaca

SEQ ID NO: 1331020 - RNA, 14 nt, Homo sapiens
ggggcagcacuccc

SEQ ID NO: 1331021 - RNA, 18 nt, Homo sapiens
ggggcaggggaggccauc

SEQ ID NO: 1331022 - RNA, 17 nt, Homo sapiens
ggggcagucgaguuucu

SEQ ID NO: 1331023 - RNA, 23 nt, Homo sapiens
gggggagugggcgcaguggcuca

SEQ ID NO: 1331024 - RNA, 15 nt, Homo sapiens
gggggcuccacccca

SEQ ID NO: 1331025 - RNA, 20 nt, Homo sapiens
gggggucucaccauguugcc

SEQ ID NO: 1331026 - RNA, 11 nt, Homo sapiens
ggggucucaga

SEQ ID NO: 1331027 - RNA, 15 nt, Homo sapiens
ggguaguuauggggu

SEQ ID NO: 1331028 - RNA, 23 nt, Homo sapiens
gggucccccugcuugucuucacc

SEQ ID NO: 1331029 - RNA, 18 nt, Homo sapiens
ggguccucaguccacugc

SEQ ID NO: 1331030 - RNA, 16 nt, Homo sapiens
gggucugggccagugc

SEQ ID NO: 1331031 - RNA, 21 nt, Homo sapiens
gggucuuuuucuagggucccu

SEQ ID NO: 1331032 - RNA, 22 nt, Homo sapiens
gggugccgcucucucugagggg

SEQ ID NO: 1331033 - RNA, 19 nt, Homo sapiens
gggugcucucucugagggg

SEQ ID NO: 1331034 - RNA, 14 nt, Homo sapiens
gggugggggugcug

SEQ ID NO: 1331035 - RNA, 12 nt, Homo sapiens
gggugucucagg

SEQ ID NO: 1331036 - RNA, 14 nt, Homo sapiens
gggugugucugcuc

SEQ ID NO: 1331037 - RNA, 14 nt, Homo sapiens
ggguucaagugauu

SEQ ID NO: 1331038 - RNA, 17 nt, Homo sapiens
ggguuggacaaccucau

SEQ ID NO: 1331039 - RNA, 12 nt, Homo sapiens
gguaaagcacau

SEQ ID NO: 1331040 - RNA, 17 nt, Homo sapiens
gguaacuuggcugcauu

SEQ ID NO: 1331041 - RNA, 14 nt, Homo sapiens
gguaauuguugcua

SEQ ID NO: 1331042 - RNA, 21 nt, Homo sapiens
gguacagacacucccacuugg

SEQ ID NO: 1331043 - RNA, 20 nt, Homo sapiens
gguagaaaaggcuagguaca

SEQ ID NO: 1331044 - RNA, 16 nt, Homo sapiens
gguagagaaggagcag

SEQ ID NO: 1331045 - RNA, 17 nt, Homo sapiens
ggucaagaacacaguga

SEQ ID NO: 1331046 - RNA, 20 nt, Homo sapiens
ggucauuacaaaaaaacacg

SEQ ID NO: 1331047 - RNA, 16 nt, Homo sapiens
ggucccacgagggugc

SEQ ID NO: 1331048 - RNA, 17 nt, Homo sapiens
ggucccugaacgcccug

SEQ ID NO: 1331049 - RNA, 22 nt, Homo sapiens
ggucccuggucggagagggaca

SEQ ID NO: 1331050 - RNA, 17 nt, Homo sapiens
ggucccuuggucaggag

SEQ ID NO: 1331051 - RNA, 14 nt, Homo sapiens
gguccuccuaucuc

SEQ ID NO: 1331052 - RNA, 13 nt, Homo sapiens
gguccuggugccc

SEQ ID NO: 1331053 - RNA, 17 nt, Homo sapiens
ggucgccaauccaugcu

SEQ ID NO: 1331054 - RNA, 16 nt, Homo sapiens
ggucuaaucagugauu

SEQ ID NO: 1331055 - RNA, 19 nt, Homo sapiens
ggucuccccuccugcacac

SEQ ID NO: 1331056 - RNA, 20 nt, Homo sapiens
ggucuuggccgacucaggga

SEQ ID NO: 1331057 - RNA, 21 nt, Homo sapiens
ggucuuuccuaaggcugcaag

SEQ ID NO: 1331058 - RNA, 23 nt, Homo sapiens
ggugaaggaugcggcaggugcuc

SEQ ID NO: 1331059 - RNA, 12 nt, Homo sapiens
ggugagugcaag

SEQ ID NO: 1331060 - RNA, 16 nt, Homo sapiens
ggugaugggugaugga

SEQ ID NO: 1331061 - RNA, 15 nt, Homo sapiens
ggugcacuccagacu

SEQ ID NO: 1331062 - RNA, 19 nt, Homo sapiens
ggugcauagcaagugaaag

SEQ ID NO: 1331063 - RNA, 18 nt, Homo sapiens
ggugccgcuuucucugag

SEQ ID NO: 1331064 - RNA, 20 nt, Homo sapiens
ggugcuaaugucaaaccacu

SEQ ID NO: 1331065 - RNA, 15 nt, Homo sapiens
ggugcucaugcugcu

SEQ ID NO: 1331066 - RNA, 18 nt, Homo sapiens
ggugcuuuuauuuucaca

SEQ ID NO: 1331067 - RNA, 16 nt, Homo sapiens
ggugggcccccaauga

SEQ ID NO: 1331068 - RNA, 22 nt, Homo sapiens
ggugggcccccaaugacaccca

SEQ ID NO: 1331069 - RNA, 14 nt, Homo sapiens
uaaauuauuuguua

SEQ ID NO: 1331070 - RNA, 21 nt, Homo sapiens
uaaauucaggcuacugcuuca

SEQ ID NO: 1331071 - RNA, 20 nt, Homo sapiens
uaaauucccaacuucucuug

SEQ ID NO: 1331072 - RNA, 19 nt, Homo sapiens
uaaauugacccuagccaga

SEQ ID NO: 1331073 - RNA, 13 nt, Homo sapiens
uaaauugauaaca

SEQ ID NO: 1331074 - RNA, 15 nt, Homo sapiens
uaaauuggcuaauca

SEQ ID NO: 1331075 - RNA, 16 nt, Homo sapiens
uaaauuggcuaaucag

SEQ ID NO: 1331076 - RNA, 23 nt, Homo sapiens
uaaauugggaaaacuccaucaau

SEQ ID NO: 1331077 - RNA, 16 nt, Homo sapiens
uaaauuuaaugcugcc

SEQ ID NO: 1331078 - RNA, 15 nt, Homo sapiens
uaaauuuaugugaug

SEQ ID NO: 1331079 - RNA, 17 nt, Homo sapiens
uaacaaacccaacuaaa

SEQ ID NO: 1331080 - RNA, 17 nt, Homo sapiens
uaacacuaaauugcagu

SEQ ID NO: 1331081 - RNA, 23 nt, Homo sapiens
uaacagauaauagcaacuuggga

SEQ ID NO: 1331082 - RNA, 21 nt, Homo sapiens
uaacagcggcaggguguccca

SEQ ID NO: 1331083 - RNA, 16 nt, Homo sapiens
uaacaguggacaaagu

SEQ ID NO: 1331084 - RNA, 16 nt, Homo sapiens
uaacaucuguuaucaa

SEQ ID NO: 1331085 - RNA, 13 nt, Homo sapiens
uaacaugugaaaa

SEQ ID NO: 1331086 - RNA, 18 nt, Homo sapiens
uaacccaagacaugacau

SEQ ID NO: 1331087 - RNA, 17 nt, Homo sapiens
uaacccugucacccaca

SEQ ID NO: 1331088 - RNA, 23 nt, Homo sapiens
uaaccucccacccugcaaaggga

SEQ ID NO: 1331089 - RNA, 20 nt, Homo sapiens
uaaccucuaccagcacauua

SEQ ID NO: 1331090 - RNA, 12 nt, Homo sapiens
uaaccuuuucaa

SEQ ID NO: 1331091 - RNA, 16 nt, Homo sapiens
uaacgcagucuaauua

SEQ ID NO: 1331092 - RNA, 13 nt, Homo sapiens
uaacgugugcgca

SEQ ID NO: 1331093 - RNA, 18 nt, Homo sapiens
uaacuaugagccaggcau

SEQ ID NO: 1331094 - RNA, 14 nt, Homo sapiens
uaacucauugcucu

SEQ ID NO: 1331095 - RNA, 14 nt, Homo sapiens
uaacugaaccaaau

SEQ ID NO: 1331096 - RNA, 22 nt, Homo sapiens
uaacuguauuuucuuucacuuu

SEQ ID NO: 1331097 - RNA, 19 nt, Homo sapiens
uaacugugacugaugacuu

SEQ ID NO: 1331098 - RNA, 20 nt, Homo sapiens
uaacuguuaacuaugacaga

SEQ ID NO: 1331099 - RNA, 20 nt, Homo sapiens
uaacuguucaaacucaggcc

SEQ ID NO: 1331100 - RNA, 14 nt, Homo sapiens
uaacuuacgaucuc

SEQ ID NO: 1331101 - RNA, 20 nt, Homo sapiens
uaacuuacgaucucuugaca

SEQ ID NO: 1331102 - RNA, 22 nt, Homo sapiens
uaacuuacugcgacuaaacuua

SEQ ID NO: 1331103 - RNA, 13 nt, Homo sapiens
uaacuuccugcug

SEQ ID NO: 1331104 - RNA, 15 nt, Homo sapiens
uaacuuccuguggau

SEQ ID NO: 1331105 - RNA, 13 nt, Homo sapiens
uaagaaaauucua

SEQ ID NO: 1331106 - RNA, 22 nt, Homo sapiens
uaagaaaguaauuuaauuugua

SEQ ID NO: 1331107 - RNA, 19 nt, Homo sapiens
uaagaaccugucuuauuaa

SEQ ID NO: 1331108 - RNA, 19 nt, Homo sapiens
uaagaacuaaaauguucua

SEQ ID NO: 1331109 - RNA, 14 nt, Homo sapiens
uaagaauaguagau

SEQ ID NO: 1331110 - RNA, 13 nt, Homo sapiens
uaagaccuggcag

SEQ ID NO: 1331111 - RNA, 18 nt, Homo sapiens
uaagacuaaaaguugcau

SEQ ID NO: 1331112 - RNA, 20 nt, Homo sapiens
uaagagaagaggcuggccaa

SEQ ID NO: 1331113 - RNA, 18 nt, Homo sapiens
uaagaguaacaguuugau

SEQ ID NO: 1331114 - RNA, 14 nt, Homo sapiens
uaagauaugcauua

SEQ ID NO: 1331115 - RNA, 21 nt, Homo sapiens
uaagaucguucucugccucac

SEQ ID NO: 1331116 - RNA, 15 nt, Homo sapiens
uaagauguacauuua

SEQ ID NO: 1331117 - RNA, 21 nt, Homo sapiens
uaagaugugcagcauuucacu

SEQ ID NO: 1331118 - RNA, 20 nt, Homo sapiens
uaagcaaaaucagaaguaua

SEQ ID NO: 1331119 - RNA, 17 nt, Homo sapiens
uaagcagcgccagugac

SEQ ID NO: 1331120 - RNA, 21 nt, Homo sapiens
uaagcaucugccaucugcuuu

SEQ ID NO: 1331121 - RNA, 17 nt, Homo sapiens
uaaggaauaaagccuuu

SEQ ID NO: 1331122 - RNA, 19 nt, Homo sapiens
uaaggauuauaaacaaccu

SEQ ID NO: 1331123 - RNA, 14 nt, Homo sapiens
uaaggauuuuucaa

SEQ ID NO: 1331124 - RNA, 15 nt, Homo sapiens
uaaggcuguacauag

SEQ ID NO: 1331125 - RNA, 14 nt, Homo sapiens
uaaguaaaaccaca

SEQ ID NO: 1331126 - RNA, 15 nt, Homo sapiens
uaaguacacaauaag

SEQ ID NO: 1331127 - RNA, 20 nt, Homo sapiens
uaaguauuuuccuguuguca

SEQ ID NO: 1331128 - RNA, 17 nt, Homo sapiens
uaagugaauacauuaac

SEQ ID NO: 1331129 - RNA, 20 nt, Homo sapiens
uaagugauauaaaucagauu

SEQ ID NO: 1331130 - RNA, 15 nt, Homo sapiens
uaaguuaaacaguca

SEQ ID NO: 1331131 - RNA, 13 nt, Homo sapiens
uaauaaagacagg

SEQ ID NO: 1331132 - RNA, 16 nt, Homo sapiens
uaauaaaugugacuca

SEQ ID NO: 1331133 - RNA, 20 nt, Homo sapiens
uaauaaauugcuuacugaua

SEQ ID NO: 1331134 - RNA, 21 nt, Homo sapiens
uaauaaauugcuuacugauau

SEQ ID NO: 1331135 - RNA, 15 nt, Homo sapiens
uaauaacagguuuaa

SEQ ID NO: 1331136 - RNA, 23 nt, Homo sapiens
uaauaauuguagauucaguguau

SEQ ID NO: 1331137 - RNA, 23 nt, Homo sapiens
uaauauuuuugaaaaaugcacug

SEQ ID NO: 1331138 - RNA, 12 nt, Homo sapiens
uaaucaaaccac

SEQ ID NO: 1331139 - RNA, 12 nt, Homo sapiens
uaaucauacaaa

SEQ ID NO: 1331140 - RNA, 15 nt, Homo sapiens
uaaucugaacugacc

SEQ ID NO: 1331141 - RNA, 16 nt, Homo sapiens
uaaucugagaggccac

SEQ ID NO: 1331142 - RNA, 16 nt, Homo sapiens
uaaugaaggacaguga

SEQ ID NO: 1331143 - RNA, 19 nt, Homo sapiens
uaaugauuuuuuuacuaau

SEQ ID NO: 1331144 - RNA, 19 nt, Homo sapiens
uaaugcacuaaaaguagua

SEQ ID NO: 1331145 - RNA, 15 nt, Homo sapiens
uaauggggaggacaa

SEQ ID NO: 1331146 - RNA, 19 nt, Homo sapiens
uaaugguuaaaaaccaacu

SEQ ID NO: 1331147 - RNA, 20 nt, Homo sapiens
uaaugucacaauuaugugca

SEQ ID NO: 1331148 - RNA, 18 nt, Homo sapiens
uaaugugcugagcauuuu

SEQ ID NO: 1331149 - RNA, 16 nt, Homo sapiens
uaauguguauucauuu

SEQ ID NO: 1331150 - RNA, 18 nt, Homo sapiens
uaauuaaaggagaagauu

SEQ ID NO: 1331151 - RNA, 20 nt, Homo sapiens
uaauuaaugucaguauuuca

SEQ ID NO: 1331152 - RNA, 23 nt, Homo sapiens
uaauucaagccucuaaacagaca

SEQ ID NO: 1331153 - RNA, 14 nt, Homo sapiens
uaauucuuuuauca

SEQ ID NO: 1331154 - RNA, 16 nt, Homo sapiens
uaauugacaacacagc

SEQ ID NO: 1331155 - RNA, 15 nt, Homo sapiens
uaauugccagcaaau

SEQ ID NO: 1331156 - RNA, 14 nt, Homo sapiens
uaauuuucuuucac

SEQ ID NO: 1331157 - RNA, 17 nt, Homo sapiens
uaauuuuuuaguuuccc

SEQ ID NO: 1331158 - RNA, 15 nt, Homo sapiens
uacaaaaacacagca

SEQ ID NO: 1331159 - RNA, 17 nt, Homo sapiens
uacaaaaacacagcaag

SEQ ID NO: 1331160 - RNA, 20 nt, Homo sapiens
uacaaaaauuagccgggcau

SEQ ID NO: 1331161 - RNA, 20 nt, Homo sapiens
uacaaagggccaucguucau

SEQ ID NO: 1331162 - RNA, 22 nt, Homo sapiens
uacaacgccgagugcacugcau

SEQ ID NO: 1331163 - RNA, 19 nt, Homo sapiens
uacaacucuauuuaauuaa

SEQ ID NO: 1331164 - RNA, 22 nt, Homo sapiens
uacaaguaauauuauuacuuua

SEQ ID NO: 1331165 - RNA, 18 nt, Homo sapiens
uacaaguuccaacaugca

SEQ ID NO: 1331166 - RNA, 20 nt, Homo sapiens
uacaaguuucuagcucucac

SEQ ID NO: 1331167 - RNA, 15 nt, Homo sapiens
uacaaucagcccagu

SEQ ID NO: 1331168 - RNA, 17 nt, Homo sapiens
uacaaucagcccagugc

SEQ ID NO: 1331169 - RNA, 19 nt, Homo sapiens
uacaaucagcccagugcaa

SEQ ID NO: 1331170 - RNA, 18 nt, Homo sapiens
uacaauuuaaugcacuaa

SEQ ID NO: 1331171 - RNA, 22 nt, Homo sapiens
uacacacccgccugacaccgug

SEQ ID NO: 1331172 - RNA, 23 nt, Homo sapiens
uacacauuccaucuuacauuagu

SEQ ID NO: 1331173 - RNA, 22 nt, Homo sapiens
uacaccucgucaagagcaugca

SEQ ID NO: 1331174 - RNA, 13 nt, Homo sapiens
uacacgugacaga

SEQ ID NO: 1331175 - RNA, 15 nt, Homo sapiens
uacacgugacagagu

SEQ ID NO: 1331176 - RNA, 17 nt, Homo sapiens
uacacugaaucauuaac

SEQ ID NO: 1331177 - RNA, 12 nt, Homo sapiens
uacagaaacuga

SEQ ID NO: 1331178 - RNA, 21 nt, Homo sapiens
uacagacacucccacuuggca

SEQ ID NO: 1331179 - RNA, 21 nt, Homo sapiens
uacagacauccuagcauuugu

SEQ ID NO: 1331180 - RNA, 21 nt, Homo sapiens
uacagacaucuaauguucucc

SEQ ID NO: 1331181 - RNA, 18 nt, Homo sapiens
uacagagaagauucuugu

SEQ ID NO: 1331182 - RNA, 16 nt, Homo sapiens
uacagccuauaguaaa

SEQ ID NO: 1331183 - RNA, 22 nt, Homo sapiens
uacagcuaaucagcauucucac

SEQ ID NO: 1331184 - RNA, 22 nt, Homo sapiens
uacaggcgugcgccacuaugcc

SEQ ID NO: 1331185 - RNA, 15 nt, Homo sapiens
uacaguucugucaua

SEQ ID NO: 1331186 - RNA, 17 nt, Homo sapiens
uacaguucugugguuuc

SEQ ID NO: 1331187 - RNA, 18 nt, Homo sapiens
uacaguugcauguuauau

SEQ ID NO: 1331188 - RNA, 21 nt, Homo sapiens
uacaguuucuggcuggcuuca

SEQ ID NO: 1331189 - RNA, 15 nt, Homo sapiens
uacauacaccagcau

SEQ ID NO: 1331190 - RNA, 14 nt, Homo sapiens
uacauauuaucuca

SEQ ID NO: 1331191 - RNA, 16 nt, Homo sapiens
uacauauuaucucauu

SEQ ID NO: 1331192 - RNA, 20 nt, Homo sapiens
uacauccuugauuacuucca

SEQ ID NO: 1331193 - RNA, 22 nt, Homo sapiens
uacauccuugauuacuuccacu

SEQ ID NO: 1331194 - RNA, 16 nt, Homo sapiens
uacaugagauaacuca

SEQ ID NO: 1331195 - RNA, 16 nt, Homo sapiens
uacauguauugcacau

SEQ ID NO: 1331196 - RNA, 20 nt, Homo sapiens
uacauuaaaauaaaccaaau

SEQ ID NO: 1331197 - RNA, 14 nt, Homo sapiens
uacauucuugcuaa

SEQ ID NO: 1331198 - RNA, 20 nt, Homo sapiens
uacauucuugcuaauucuca

SEQ ID NO: 1331199 - RNA, 21 nt, Homo sapiens
uacauugaaaacaacaaaaca

SEQ ID NO: 1331200 - RNA, 23 nt, Homo sapiens
uacauuuuuugggcagcaauuua

SEQ ID NO: 1331201 - RNA, 21 nt, Homo sapiens
uuguuuauugaauucauuuca

SEQ ID NO: 1331202 - RNA, 21 nt, Homo sapiens
uuguuucccaucagacuguca

SEQ ID NO: 1331203 - RNA, 20 nt, Homo sapiens
uuguuuccccacaaaacaaa

SEQ ID NO: 1331204 - RNA, 17 nt, Homo sapiens
uuguuuuaaaauagcuu

SEQ ID NO: 1331205 - RNA, 18 nt, Homo sapiens
uuguuuuuauuguaaaac

SEQ ID NO: 1331206 - RNA, 22 nt, Homo sapiens
uuguuuuuuacucaaauuggga

SEQ ID NO: 1331207 - RNA, 21 nt, Homo sapiens
uuuaaaaaaaaauacugaugu

SEQ ID NO: 1331208 - RNA, 13 nt, Homo sapiens
uuuaaaacugcuc

SEQ ID NO: 1331209 - RNA, 22 nt, Homo sapiens
uuuaaaaugcucaauuucagca

SEQ ID NO: 1331210 - RNA, 14 nt, Homo sapiens
uuuaaaauugugau

SEQ ID NO: 1331211 - RNA, 21 nt, Homo sapiens
uuuaaacagugucauauacaa

SEQ ID NO: 1331212 - RNA, 15 nt, Homo sapiens
uuuaaagaaaaccac

SEQ ID NO: 1331213 - RNA, 21 nt, Homo sapiens
uuuaaagcuuauuaaaacuca

SEQ ID NO: 1331214 - RNA, 18 nt, Homo sapiens
uuuaaaguggcaaucuca

SEQ ID NO: 1331215 - RNA, 18 nt, Homo sapiens
uuuaaauaaaagcacaag

SEQ ID NO: 1331216 - RNA, 18 nt, Homo sapiens
uuuaaauagcauuaucuu

SEQ ID NO: 1331217 - RNA, 23 nt, Homo sapiens
uuuaaaugucaaaugugaauugg

SEQ ID NO: 1331218 - RNA, 18 nt, Homo sapiens
uuuaaauguguacaaugu

SEQ ID NO: 1331219 - RNA, 15 nt, Homo sapiens
uuuaaauuccacuga

SEQ ID NO: 1331220 - RNA, 13 nt, Homo sapiens
uuuaacagccucu

SEQ ID NO: 1331221 - RNA, 21 nt, Homo sapiens
uuuaacagucagaaccacuaa

SEQ ID NO: 1331222 - RNA, 21 nt, Homo sapiens
uuuaaccaauaacuagcuucu

SEQ ID NO: 1331223 - RNA, 23 nt, Homo sapiens
uuuaaccaauaacuagcuucuua

SEQ ID NO: 1331224 - RNA, 20 nt, Homo sapiens
uuuaacuuuaaccacaguga

SEQ ID NO: 1331225 - RNA, 20 nt, Homo sapiens
uuuaacuuuaaggauuugaa

SEQ ID NO: 1331226 - RNA, 17 nt, Homo sapiens
uuuaagcagcgccagug

SEQ ID NO: 1331227 - RNA, 10 nt, Homo sapiens
uuuaagguga

SEQ ID NO: 1331228 - RNA, 21 nt, Homo sapiens
uuuaauaaauugcuuacugau

SEQ ID NO: 1331229 - RNA, 12 nt, Homo sapiens
uuuaauccuuaa

SEQ ID NO: 1331230 - RNA, 13 nt, Homo sapiens
uuuaauuuugaca

SEQ ID NO: 1331231 - RNA, 14 nt, Homo sapiens
uuuaauuuugagau

SEQ ID NO: 1331232 - RNA, 19 nt, Homo sapiens
uuuacaagggcauaaagua

SEQ ID NO: 1331233 - RNA, 11 nt, Homo sapiens
uuuacaguguu

SEQ ID NO: 1331234 - RNA, 21 nt, Homo sapiens
uuuacauacguuuguguggug

SEQ ID NO: 1331235 - RNA, 11 nt, Homo sapiens
uuuacauuuca

SEQ ID NO: 1331236 - RNA, 13 nt, Homo sapiens
uuuacuaccuuau

SEQ ID NO: 1331237 - RNA, 17 nt, Homo sapiens
uuuacucauaaguaaaa

SEQ ID NO: 1331238 - RNA, 13 nt, Homo sapiens
uuuagaaccagcc

SEQ ID NO: 1331239 - RNA, 13 nt, Homo sapiens
uuuaggcucagaa

SEQ ID NO: 1331240 - RNA, 14 nt, Homo sapiens
uuuauaaugaauaa

SEQ ID NO: 1331241 - RNA, 14 nt, Homo sapiens
uuuaucacuguugc

SEQ ID NO: 1331242 - RNA, 19 nt, Homo sapiens
uuuauccugagucccuuaa

SEQ ID NO: 1331243 - RNA, 14 nt, Homo sapiens
uuuaucuauuggcc

SEQ ID NO: 1331244 - RNA, 13 nt, Homo sapiens
uuuaugacucuua

SEQ ID NO: 1331245 - RNA, 19 nt, Homo sapiens
uuuaugcaaauacaaucag

SEQ ID NO: 1331246 - RNA, 17 nt, Homo sapiens
uuuaugcccucaggaaa

SEQ ID NO: 1331247 - RNA, 15 nt, Homo sapiens
uuuauuaaucuuagu

SEQ ID NO: 1331248 - RNA, 23 nt, Homo sapiens
uuuauuaauuugaaaccaggaca

SEQ ID NO: 1331249 - RNA, 16 nt, Homo sapiens
uuuauuuaacuauuca

SEQ ID NO: 1331250 - RNA, 15 nt, Homo sapiens
uuuauuuugaaaugg

SEQ ID NO: 1331251 - RNA, 16 nt, Homo sapiens
uuuauuuuucucauga

SEQ ID NO: 1331252 - RNA, 20 nt, Homo sapiens
uuucaaaagaagaguuuuag

SEQ ID NO: 1331253 - RNA, 12 nt, Homo sapiens
uuucaagucucu

SEQ ID NO: 1331254 - RNA, 22 nt, Homo sapiens
uuucacacuggauccaucuuga

SEQ ID NO: 1331255 - RNA, 13 nt, Homo sapiens
uuucaccuacuaa

SEQ ID NO: 1331256 - RNA, 21 nt, Homo sapiens
uuucacugcuguuauauuuca

SEQ ID NO: 1331257 - RNA, 14 nt, Homo sapiens
uuucagaauguuga

SEQ ID NO: 1331258 - RNA, 18 nt, Homo sapiens
uuucaggguccaaacaaa

SEQ ID NO: 1331259 - RNA, 18 nt, Homo sapiens
uuucauaaagucuugccu

SEQ ID NO: 1331260 - RNA, 19 nt, Homo sapiens
uuucaucaggaaaccuuau

SEQ ID NO: 1331261 - RNA, 19 nt, Homo sapiens
uuucauuuugucagcagca

SEQ ID NO: 1331262 - RNA, 16 nt, Homo sapiens
uuuccaaaacauuucu

SEQ ID NO: 1331263 - RNA, 21 nt, Homo sapiens
uuuccaaaccuccacugcugc

SEQ ID NO: 1331264 - RNA, 14 nt, Homo sapiens
uuuccaaagagccg

SEQ ID NO: 1331265 - RNA, 11 nt, Homo sapiens
uuuccauuugc

SEQ ID NO: 1331266 - RNA, 14 nt, Homo sapiens
uuucccaacacaaa

SEQ ID NO: 1331267 - RNA, 18 nt, Homo sapiens
uuucccaucacuguaucc

SEQ ID NO: 1331268 - RNA, 14 nt, Homo sapiens
uuuccguaaauguc

SEQ ID NO: 1331269 - RNA, 13 nt, Homo sapiens
uuuccucagugau

SEQ ID NO: 1331270 - RNA, 18 nt, Homo sapiens
uuuccucccuucugcuac

SEQ ID NO: 1331271 - RNA, 12 nt, Homo sapiens
uuuccucugcau

SEQ ID NO: 1331272 - RNA, 21 nt, Homo sapiens
uuuccuuugaauagcagguag

SEQ ID NO: 1331273 - RNA, 16 nt, Homo sapiens
uuucuaauuggcuuua

SEQ ID NO: 1331274 - RNA, 15 nt, Homo sapiens
uuucuagaaugucau

SEQ ID NO: 1331275 - RNA, 20 nt, Homo sapiens
uuucuccucacuguauccag

SEQ ID NO: 1331276 - RNA, 13 nt, Homo sapiens
uuucucuaaugcu

SEQ ID NO: 1331277 - RNA, 15 nt, Homo sapiens
uuucucuucuacaca

SEQ ID NO: 1331278 - RNA, 19 nt, Homo sapiens
uuucugagagagugccaug

SEQ ID NO: 1331279 - RNA, 19 nt, Homo sapiens
uuucuuccuauuuccuugu

SEQ ID NO: 1331280 - RNA, 18 nt, Homo sapiens
uuucuuccuuuucacugc

SEQ ID NO: 1331281 - RNA, 19 nt, Homo sapiens
uuucuugcuuggaagccag

SEQ ID NO: 1331282 - RNA, 18 nt, Homo sapiens
uuucuuuaagucaguuca

SEQ ID NO: 1331283 - RNA, 12 nt, Homo sapiens
uuucuuugccau

SEQ ID NO: 1331284 - RNA, 23 nt, Homo sapiens
uuugaaaaugggcucaaccagaa

SEQ ID NO: 1331285 - RNA, 22 nt, Homo sapiens
uuugaaccauccacuuacauau

SEQ ID NO: 1331286 - RNA, 23 nt, Homo sapiens
uuugaaccauccacuuacauaua

SEQ ID NO: 1331287 - RNA, 15 nt, Homo sapiens
uuugaagcgagcagu

SEQ ID NO: 1331288 - RNA, 22 nt, Homo sapiens
uuugaauagccuguuccuuuaa

SEQ ID NO: 1331289 - RNA, 14 nt, Homo sapiens
uuugacacugcucu

SEQ ID NO: 1331290 - RNA, 14 nt, Homo sapiens
uuugacugucagca

SEQ ID NO: 1331291 - RNA, 17 nt, Homo sapiens
uuugagaagaaaaucag

SEQ ID NO: 1331292 - RNA, 18 nt, Homo sapiens
uuugagcuguggcuguga

SEQ ID NO: 1331293 - RNA, 20 nt, Homo sapiens
uuugaggaacauuauuuaau

SEQ ID NO: 1331294 - RNA, 23 nt, Homo sapiens
uuugauacuaccagggucucuca

SEQ ID NO: 1331295 - RNA, 19 nt, Homo sapiens
uuugaucuugugcuaugaa

SEQ ID NO: 1331296 - RNA, 19 nt, Homo sapiens
uuugauugcugagagccau

SEQ ID NO: 1331297 - RNA, 14 nt, Homo sapiens
uuugauuuacauau

SEQ ID NO: 1331298 - RNA, 16 nt, Homo sapiens
uuugauuuugauuuua

SEQ ID NO: 1331299 - RNA, 20 nt, Homo sapiens
uuugcagauauucucuaguc

SEQ ID NO: 1331300 - RNA, 17 nt, Homo sapiens
uuugcauggaguauuau

SEQ ID NO: 1331301 - RNA, 14 nt, Homo sapiens
uuugccauguugcc

SEQ ID NO: 1331302 - RNA, 17 nt, Homo sapiens
uuugcccaaaacuguca

SEQ ID NO: 1331303 - RNA, 14 nt, Homo sapiens
uuugccuucuccac

SEQ ID NO: 1331304 - RNA, 15 nt, Homo sapiens
uuugcuaacuggguu

SEQ ID NO: 1331305 - RNA, 15 nt, Homo sapiens
uuugcuuucugcuca

SEQ ID NO: 1331306 - RNA, 20 nt, Homo sapiens
uuuggaaauucagacuugau

SEQ ID NO: 1331307 - RNA, 11 nt, Homo sapiens
uuugggagaca

SEQ ID NO: 1331308 - RNA, 18 nt, Homo sapiens
uuuggggcaggaaauacu

SEQ ID NO: 1331309 - RNA, 16 nt, Homo sapiens
uuuguagccagguacu

SEQ ID NO: 1331310 - RNA, 15 nt, Homo sapiens
uuuguauuuauuaau

SEQ ID NO: 1331311 - RNA, 17 nt, Homo sapiens
uuugucuuggauauaua

SEQ ID NO: 1331312 - RNA, 22 nt, Homo sapiens
uuugugcagagauaaagaccuu

SEQ ID NO: 1331313 - RNA, 14 nt, Homo sapiens
uuuguuagcaaaga

SEQ ID NO: 1331314 - RNA, 13 nt, Homo sapiens
uuuguuuuaaucc

SEQ ID NO: 1331315 - RNA, 17 nt, Homo sapiens
uuuuaaacaaaugugau

SEQ ID NO: 1331316 - RNA, 22 nt, Homo sapiens
uuuuaaacagugucauauacaa

SEQ ID NO: 1331317 - RNA, 17 nt, Homo sapiens
uuuuaaaucaaguauuu

SEQ ID NO: 1331318 - RNA, 20 nt, Homo sapiens
uuuuaauccuuaacacauuc

SEQ ID NO: 1331319 - RNA, 20 nt, Homo sapiens
uuuuaauuuuuugucaagac

SEQ ID NO: 1331320 - RNA, 20 nt, Homo sapiens
uuuuacccugaggucacugc

SEQ ID NO: 1331321 - RNA, 23 nt, Homo sapiens
uuuuacccugaggucacugcuag

SEQ ID NO: 1331322 - RNA, 17 nt, Homo sapiens
uuuuagaaugucaauaa

SEQ ID NO: 1331323 - RNA, 13 nt, Homo sapiens
uuuuaggaagcua

SEQ ID NO: 1331324 - RNA, 20 nt, Homo sapiens
uuuuauauauauaaagucag

SEQ ID NO: 1331325 - RNA, 20 nt, Homo sapiens
uuuuaucugguucuauauga

SEQ ID NO: 1331326 - RNA, 22 nt, Homo sapiens
uuuuauuuacagcugugcucca

SEQ ID NO: 1331327 - RNA, 18 nt, Homo sapiens
uuuuauuucugacucuua

SEQ ID NO: 1331328 - RNA, 16 nt, Homo sapiens
uuuucacacugguaaa

SEQ ID NO: 1331329 - RNA, 11 nt, Homo sapiens
uuuucauucau

SEQ ID NO: 1331330 - RNA, 14 nt, Homo sapiens
uuuuccaacuacua

SEQ ID NO: 1331331 - RNA, 18 nt, Homo sapiens
uuuuccuauuuauuugag

SEQ ID NO: 1331332 - RNA, 14 nt, Homo sapiens
uuuucucaugauga

SEQ ID NO: 1331333 - RNA, 22 nt, Homo sapiens
uuuucuccccucauaucugcgu

SEQ ID NO: 1331334 - RNA, 14 nt, Homo sapiens
agaguuaugcuuua

SEQ ID NO: 1331335 - RNA, 19 nt, Homo sapiens
agauaaaaaucauauagac

SEQ ID NO: 1331336 - RNA, 13 nt, Homo sapiens
agauaaagaccuu

SEQ ID NO: 1331337 - RNA, 14 nt, Homo sapiens
agauaacacugacu

SEQ ID NO: 1331338 - RNA, 19 nt, Homo sapiens
agauaagguggcuucucac

SEQ ID NO: 1331339 - RNA, 19 nt, Homo sapiens
agauacugucucuuucaug

SEQ ID NO: 1331340 - RNA, 17 nt, Homo sapiens
agauagaccugacaauu

SEQ ID NO: 1331341 - RNA, 23 nt, Homo sapiens
agauagcaucagaccugcauuga

SEQ ID NO: 1331342 - RNA, 16 nt, Homo sapiens
agauaggaaacugaag

SEQ ID NO: 1331343 - RNA, 20 nt, Homo sapiens
agauauacgcccucuuucau

SEQ ID NO: 1331344 - RNA, 19 nt, Homo sapiens
agauaugaagaaucugcuc

SEQ ID NO: 1331345 - RNA, 14 nt, Homo sapiens
agauauugauuacu

SEQ ID NO: 1331346 - RNA, 17 nt, Homo sapiens
agauauugauuacuauc

SEQ ID NO: 1331347 - RNA, 15 nt, Homo sapiens
agaucagaacaugaa

SEQ ID NO: 1331348 - RNA, 16 nt, Homo sapiens
agaucagaacaugaaa

SEQ ID NO: 1331349 - RNA, 17 nt, Homo sapiens
agaucagggacuugaau

SEQ ID NO: 1331350 - RNA, 14 nt, Homo sapiens
agaucaucagucac

SEQ ID NO: 1331351 - RNA, 20 nt, Homo sapiens
agaucgagaccauccuggcc

SEQ ID NO: 1331352 - RNA, 14 nt, Homo sapiens
agaucuaugggaag

SEQ ID NO: 1331353 - RNA, 12 nt, Homo sapiens
agaucucccaca

SEQ ID NO: 1331354 - RNA, 13 nt, Homo sapiens
agaugaaugucag

SEQ ID NO: 1331355 - RNA, 17 nt, Homo sapiens
agaugacgaguaacucc

SEQ ID NO: 1331356 - RNA, 17 nt, Homo sapiens
agaugcauauagacaca

SEQ ID NO: 1331357 - RNA, 20 nt, Homo sapiens
agaugcugacuguacuccuc

SEQ ID NO: 1331358 - RNA, 15 nt, Homo sapiens
agaugcuguugugaa

SEQ ID NO: 1331359 - RNA, 18 nt, Homo sapiens
agaugcuguugugaagcu

SEQ ID NO: 1331360 - RNA, 15 nt, Homo sapiens
agaugcuuuugcuaa

SEQ ID NO: 1331361 - RNA, 14 nt, Homo sapiens
agauggaacaauaa

SEQ ID NO: 1331362 - RNA, 13 nt, Homo sapiens
agauggggaggag

SEQ ID NO: 1331363 - RNA, 21 nt, Homo sapiens
agaugguggccacagacugac

SEQ ID NO: 1331364 - RNA, 19 nt, Homo sapiens
agauguggccuuuagcaaa

SEQ ID NO: 1331365 - RNA, 17 nt, Homo sapiens
agaugugggcagugaug

SEQ ID NO: 1331366 - RNA, 19 nt, Homo sapiens
agaugugggcagugauguc

SEQ ID NO: 1331367 - RNA, 17 nt, Homo sapiens
agauucacuuaacaaac

SEQ ID NO: 1331368 - RNA, 14 nt, Homo sapiens
agauugaguuauua

SEQ ID NO: 1331369 - RNA, 20 nt, Homo sapiens
agauuggcaccccuuucuag

SEQ ID NO: 1331370 - RNA, 12 nt, Homo sapiens
agauugugcucc

SEQ ID NO: 1331371 - RNA, 20 nt, Homo sapiens
agauuuaaagaaaaccacag

SEQ ID NO: 1331372 - RNA, 17 nt, Homo sapiens
agauuuaagccuuacaa

SEQ ID NO: 1331373 - RNA, 13 nt, Homo sapiens
agauuugccuuau

SEQ ID NO: 1331374 - RNA, 19 nt, Homo sapiens
agauuuggaggcuaccuca

SEQ ID NO: 1331375 - RNA, 15 nt, Homo sapiens
agauuuuuuccucug

SEQ ID NO: 1331376 - RNA, 17 nt, Homo sapiens
agcaaaacagacugugu

SEQ ID NO: 1331377 - RNA, 14 nt, Homo sapiens
agcaaaacuuuacu

SEQ ID NO: 1331378 - RNA, 12 nt, Homo sapiens
agcaaacuccag

SEQ ID NO: 1331379 - RNA, 16 nt, Homo sapiens
agcaaagauuaaaugu

SEQ ID NO: 1331380 - RNA, 19 nt, Homo sapiens
agcaaagauuaaauguguc

SEQ ID NO: 1331381 - RNA, 17 nt, Homo sapiens
agcaaaggugcacucca

SEQ ID NO: 1331382 - RNA, 19 nt, Homo sapiens
agcaaauaaauacguguca

SEQ ID NO: 1331383 - RNA, 21 nt, Homo sapiens
agcaaauggccucaugucaaa

SEQ ID NO: 1331384 - RNA, 16 nt, Homo sapiens
agcaaauguggcuccu

SEQ ID NO: 1331385 - RNA, 16 nt, Homo sapiens
agcaacuaggaaaauc

SEQ ID NO: 1331386 - RNA, 15 nt, Homo sapiens
agcaacuauucacaa

SEQ ID NO: 1331387 - RNA, 23 nt, Homo sapiens
agcaagacugaagauggcuuuuc

SEQ ID NO: 1331388 - RNA, 19 nt, Homo sapiens
agcaaggcacagccuuugc

SEQ ID NO: 1331389 - RNA, 16 nt, Homo sapiens
agcaagucacuggcca

SEQ ID NO: 1331390 - RNA, 22 nt, Homo sapiens
agcaaguccuuaggcuacugua

SEQ ID NO: 1331391 - RNA, 19 nt, Homo sapiens
agcaaugccccaaacuuuc

SEQ ID NO: 1331392 - RNA, 22 nt, Homo sapiens
agcaaugccccaaacuuucuca

SEQ ID NO: 1331393 - RNA, 21 nt, Homo sapiens
agcaauggaguggcugccaug

SEQ ID NO: 1331394 - RNA, 22 nt, Homo sapiens
agcaauuauuacaauucuugaa

SEQ ID NO: 1331395 - RNA, 20 nt, Homo sapiens
agcaauucuccugccuuagc

SEQ ID NO: 1331396 - RNA, 22 nt, Homo sapiens
agcacaagcaggugaacuggga

SEQ ID NO: 1331397 - RNA, 12 nt, Homo sapiens
agcacacuuuuu

SEQ ID NO: 1331398 - RNA, 19 nt, Homo sapiens
agcaccacacccaguggga

SEQ ID NO: 1331399 - RNA, 19 nt, Homo sapiens
agcacccugcccaccaaga

SEQ ID NO: 1331400 - RNA, 20 nt, Homo sapiens
agcacccugcccaccaagaa

SEQ ID NO: 1331401 - RNA, 20 nt, Homo sapiens
agcacggacugucaguucuc

SEQ ID NO: 1331402 - RNA, 14 nt, Homo sapiens
agcacucauuccuu

SEQ ID NO: 1331403 - RNA, 21 nt, Homo sapiens
agcacuccccagagcugugcc

SEQ ID NO: 1331404 - RNA, 19 nt, Homo sapiens
agcacugaaccacauucag

SEQ ID NO: 1331405 - RNA, 22 nt, Homo sapiens
agcacugaaccacauucaggga

SEQ ID NO: 1331406 - RNA, 18 nt, Homo sapiens
agcacugccucccuuaau

SEQ ID NO: 1331407 - RNA, 14 nt, Homo sapiens
agcagagaacugcc

SEQ ID NO: 1331408 - RNA, 22 nt, Homo sapiens
agcagaggaggggaaaguccag

SEQ ID NO: 1331409 - RNA, 22 nt, Homo sapiens
agcagccuguacuagcuuuuga

SEQ ID NO: 1331410 - RNA, 15 nt, Homo sapiens
agcagcgccagugac

SEQ ID NO: 1331411 - RNA, 13 nt, Homo sapiens
agcagcucuguga

SEQ ID NO: 1331412 - RNA, 15 nt, Homo sapiens
agcagcugaugcugu

SEQ ID NO: 1331413 - RNA, 15 nt, Homo sapiens
agcaggcaaaagacu

SEQ ID NO: 1331414 - RNA, 20 nt, Homo sapiens
agcaggcaaaagacuugaau

SEQ ID NO: 1331415 - RNA, 20 nt, Homo sapiens
agcaggcauuucugugaugu

SEQ ID NO: 1331416 - RNA, 19 nt, Homo sapiens
agcaggccucugggaccca

SEQ ID NO: 1331417 - RNA, 16 nt, Homo sapiens
agcagggaagugacag

SEQ ID NO: 1331418 - RNA, 13 nt, Homo sapiens
agcagggacaaga

SEQ ID NO: 1331419 - RNA, 11 nt, Homo sapiens
agcagguaguu

SEQ ID NO: 1331420 - RNA, 16 nt, Homo sapiens
agcaguggcuccauug

SEQ ID NO: 1331421 - RNA, 22 nt, Homo sapiens
agcaguuugcuuuguaugcacu

SEQ ID NO: 1331422 - RNA, 20 nt, Homo sapiens
agcauaggaaaccacacaga

SEQ ID NO: 1331423 - RNA, 22 nt, Homo sapiens
agcauauguuaguaggcuuagu

SEQ ID NO: 1331424 - RNA, 19 nt, Homo sapiens
agcaucaauacaaccagcc

SEQ ID NO: 1331425 - RNA, 17 nt, Homo sapiens
agcauccagugugagau

SEQ ID NO: 1331426 - RNA, 15 nt, Homo sapiens
agcaucccucaccca

SEQ ID NO: 1331427 - RNA, 19 nt, Homo sapiens
agcaucgggagcacccaga

SEQ ID NO: 1331428 - RNA, 21 nt, Homo sapiens
agcaugaaaaucacacugucu

SEQ ID NO: 1331429 - RNA, 15 nt, Homo sapiens
agcauuacccuccuc

SEQ ID NO: 1331430 - RNA, 17 nt, Homo sapiens
agccaagcuggcacaaa

SEQ ID NO: 1331431 - RNA, 15 nt, Homo sapiens
agccacagacaauau

SEQ ID NO: 1331432 - RNA, 18 nt, Homo sapiens
agccaccaugcuugccug

SEQ ID NO: 1331433 - RNA, 13 nt, Homo sapiens
aggacuuucucuu

SEQ ID NO: 1331434 - RNA, 19 nt, Homo sapiens
aggagaagcgggaguggcu

SEQ ID NO: 1331435 - RNA, 21 nt, Homo sapiens
aggagaagcgggaguggcuga

SEQ ID NO: 1331436 - RNA, 17 nt, Homo sapiens
aggagacaccaagcuca

SEQ ID NO: 1331437 - RNA, 13 nt, Homo sapiens
aggagacagauca

SEQ ID NO: 1331438 - RNA, 21 nt, Homo sapiens
aggagaggggaggucacucuu

SEQ ID NO: 1331439 - RNA, 21 nt, Homo sapiens
aggagccauugcucuccuaga

SEQ ID NO: 1331440 - RNA, 14 nt, Homo sapiens
aggagcccuucuau

SEQ ID NO: 1331441 - RNA, 15 nt, Homo sapiens
aggagccuacuccaa

SEQ ID NO: 1331442 - RNA, 18 nt, Homo sapiens
aggaggcccccuccucac

SEQ ID NO: 1331443 - RNA, 22 nt, Homo sapiens
aggaggggccgcugccacccac

SEQ ID NO: 1331444 - RNA, 20 nt, Homo sapiens
aggagggggacuaaacucaa

SEQ ID NO: 1331445 - RNA, 23 nt, Homo sapiens
aggaggggucuggguacuucuug

SEQ ID NO: 1331446 - RNA, 21 nt, Homo sapiens
aggagggucccgguguauccu

SEQ ID NO: 1331447 - RNA, 15 nt, Homo sapiens
aggaggguuggagug

SEQ ID NO: 1331448 - RNA, 20 nt, Homo sapiens
aggaggguuggagugcucuu

SEQ ID NO: 1331449 - RNA, 15 nt, Homo sapiens
aggagucccugccau

SEQ ID NO: 1331450 - RNA, 12 nt, Homo sapiens
aggauacaggug

SEQ ID NO: 1331451 - RNA, 14 nt, Homo sapiens
aggauacaggugac

SEQ ID NO: 1331452 - RNA, 17 nt, Homo sapiens
aggaucaguuaacuauu

SEQ ID NO: 1331453 - RNA, 23 nt, Homo sapiens
aggauccagggcagcaggccaga

SEQ ID NO: 1331454 - RNA, 14 nt, Homo sapiens
aggauccgugcugu

SEQ ID NO: 1331455 - RNA, 17 nt, Homo sapiens
aggaucucaaacuugau

SEQ ID NO: 1331456 - RNA, 14 nt, Homo sapiens
aggauguacaaaga

SEQ ID NO: 1331457 - RNA, 13 nt, Homo sapiens
aggaugugauaua

SEQ ID NO: 1331458 - RNA, 13 nt, Homo sapiens
aggauuaacuaaa

SEQ ID NO: 1331459 - RNA, 23 nt, Homo sapiens
aggcacagugggagcugagcugg

SEQ ID NO: 1331460 - RNA, 22 nt, Homo sapiens
aggcacugcugcccagccucca

SEQ ID NO: 1331461 - RNA, 18 nt, Homo sapiens
aggcagcuucuacuccug

SEQ ID NO: 1331462 - RNA, 21 nt, Homo sapiens
aggcaggagaaucacuugaac

SEQ ID NO: 1331463 - RNA, 13 nt, Homo sapiens
aggcagggaccua

SEQ ID NO: 1331464 - RNA, 14 nt, Homo sapiens
aggcagggcaagaa

SEQ ID NO: 1331465 - RNA, 20 nt, Homo sapiens
aggcaggugcuuuuggcaga

SEQ ID NO: 1331466 - RNA, 14 nt, Homo sapiens
aggcagugcaauau

SEQ ID NO: 1331467 - RNA, 21 nt, Homo sapiens
aggcaucauacuaaacuucac

SEQ ID NO: 1331468 - RNA, 19 nt, Homo sapiens
aggcaugugucccuuccaa

SEQ ID NO: 1331469 - RNA, 22 nt, Homo sapiens
aggccacaccggccuugcauug

SEQ ID NO: 1331470 - RNA, 12 nt, Homo sapiens
aggccacagugg

SEQ ID NO: 1331471 - RNA, 15 nt, Homo sapiens
aggccagaugcacau

SEQ ID NO: 1331472 - RNA, 13 nt, Homo sapiens
agucuucuauuua

SEQ ID NO: 1331473 - RNA, 18 nt, Homo sapiens
agucuucuccuccaugaa

SEQ ID NO: 1331474 - RNA, 13 nt, Homo sapiens
agucuugccuugc

SEQ ID NO: 1331475 - RNA, 17 nt, Homo sapiens
agucuuguuuuuuauuc

SEQ ID NO: 1331476 - RNA, 18 nt, Homo sapiens
agucuuguuuuuuauuca

SEQ ID NO: 1331477 - RNA, 19 nt, Homo sapiens
agucuuguuuuuuauucag

SEQ ID NO: 1331478 - RNA, 19 nt, Homo sapiens
agucuuugguaaauggcaa

SEQ ID NO: 1331479 - RNA, 16 nt, Homo sapiens
agugaaacauugaacu

SEQ ID NO: 1331480 - RNA, 19 nt, Homo sapiens
agugaaacauugaacucau

SEQ ID NO: 1331481 - RNA, 20 nt, Homo sapiens
agugaacuauuuuuaagguc

SEQ ID NO: 1331482 - RNA, 16 nt, Homo sapiens
agugaccccuucccug

SEQ ID NO: 1331483 - RNA, 18 nt, Homo sapiens
agugacuccagggugaca

SEQ ID NO: 1331484 - RNA, 20 nt, Homo sapiens
agugagcacacccgugugca

SEQ ID NO: 1331485 - RNA, 18 nt, Homo sapiens
agugaucuugagaaccuu

SEQ ID NO: 1331486 - RNA, 20 nt, Homo sapiens
agugaugaaccagaguuucu

SEQ ID NO: 1331487 - RNA, 16 nt, Homo sapiens
agugaugaacgggcug

SEQ ID NO: 1331488 - RNA, 21 nt, Homo sapiens
agugauggcuuaugauagcaa

SEQ ID NO: 1331489 - RNA, 16 nt, Homo sapiens
agugauucuccugccu

SEQ ID NO: 1331490 - RNA, 16 nt, Homo sapiens
agugcaccaucucacu

SEQ ID NO: 1331491 - RNA, 18 nt, Homo sapiens
agugcaccaucucacugc

SEQ ID NO: 1331492 - RNA, 19 nt, Homo sapiens
agugcagugauguuugcca

SEQ ID NO: 1331493 - RNA, 14 nt, Homo sapiens
agugcaucucagcc

SEQ ID NO: 1331494 - RNA, 21 nt, Homo sapiens
agugccuuaaacucuguuaca

SEQ ID NO: 1331495 - RNA, 15 nt, Homo sapiens
agugcuauugcagag

SEQ ID NO: 1331496 - RNA, 15 nt, Homo sapiens
agugcugcuguggag

SEQ ID NO: 1331497 - RNA, 18 nt, Homo sapiens
aguggaauggagauuuca

SEQ ID NO: 1331498 - RNA, 20 nt, Homo sapiens
aguggaguuuuauaaauuaa

SEQ ID NO: 1331499 - RNA, 22 nt, Homo sapiens
aguggcguuguugcauguuuga

SEQ ID NO: 1331500 - RNA, 23 nt, Homo sapiens
aguggcucacaccuguaauccca

SEQ ID NO: 1331501 - RNA, 15 nt, Homo sapiens
agugggguagguugg

SEQ ID NO: 1331502 - RNA, 16 nt, Homo sapiens
aguggucacugucagu

SEQ ID NO: 1331503 - RNA, 23 nt, Homo sapiens
aguggugggcccugaugcugcca

SEQ ID NO: 1331504 - RNA, 22 nt, Homo sapiens
agugguggguaauuguacaaua

SEQ ID NO: 1331505 - RNA, 20 nt, Homo sapiens
agugguguuuagaaugucag

SEQ ID NO: 1331506 - RNA, 17 nt, Homo sapiens
aguguacccaucuuuaa

SEQ ID NO: 1331507 - RNA, 15 nt, Homo sapiens
aguguauuucuucaa

SEQ ID NO: 1331508 - RNA, 21 nt, Homo sapiens
agugucaugaagugcacagga

SEQ ID NO: 1331509 - RNA, 23 nt, Homo sapiens
agugucugucugaggugacuuaa

SEQ ID NO: 1331510 - RNA, 19 nt, Homo sapiens
agugucuugagacuuuauc

SEQ ID NO: 1331511 - RNA, 19 nt, Homo sapiens
agugugacuccuuaucucu

SEQ ID NO: 1331512 - RNA, 13 nt, Homo sapiens
agugugcugggca

SEQ ID NO: 1331513 - RNA, 23 nt, Homo sapiens
agugugggggaggcgcacagugu

SEQ ID NO: 1331514 - RNA, 13 nt, Homo sapiens
agugugugaaaau

SEQ ID NO: 1331515 - RNA, 15 nt, Homo sapiens
aguuaaacagucagu

SEQ ID NO: 1331516 - RNA, 13 nt, Homo sapiens
aguuaacaggaca

SEQ ID NO: 1331517 - RNA, 12 nt, Homo sapiens
aguuaacuauug

SEQ ID NO: 1331518 - RNA, 14 nt, Homo sapiens
aguuaagaacuaug

SEQ ID NO: 1331519 - RNA, 19 nt, Homo sapiens
aguuaaugauuuuacuuaa

SEQ ID NO: 1331520 - RNA, 18 nt, Homo sapiens
aguuacaguucugugguu

SEQ ID NO: 1331521 - RNA, 23 nt, Homo sapiens
aguuacauuaaaauaaaccaaau

SEQ ID NO: 1331522 - RNA, 14 nt, Homo sapiens
aguuauaaaccaau

SEQ ID NO: 1331523 - RNA, 19 nt, Homo sapiens
aguuauggcuauaggugcu

SEQ ID NO: 1331524 - RNA, 14 nt, Homo sapiens
aguucaauaaucca

SEQ ID NO: 1331525 - RNA, 14 nt, Homo sapiens
aguucaucaccauu

SEQ ID NO: 1331526 - RNA, 17 nt, Homo sapiens
aguucaucaccauuucc

SEQ ID NO: 1331527 - RNA, 17 nt, Homo sapiens
aguuccucugcaguuuu

SEQ ID NO: 1331528 - RNA, 19 nt, Homo sapiens
aguucugaauaacuugaag

SEQ ID NO: 1331529 - RNA, 18 nt, Homo sapiens
aguucugugguuccagua

SEQ ID NO: 1331530 - RNA, 13 nt, Homo sapiens
aguugaagaucuu

SEQ ID NO: 1331531 - RNA, 21 nt, Homo sapiens
aguugaucuggaacccagacu

SEQ ID NO: 1331532 - RNA, 14 nt, Homo sapiens
aguugcagccaggg

SEQ ID NO: 1331533 - RNA, 19 nt, Homo sapiens
aguugcaguccagcucuuu

SEQ ID NO: 1331534 - RNA, 15 nt, Homo sapiens
aguugccacauuuag

SEQ ID NO: 1331535 - RNA, 12 nt, Homo sapiens
aguugccuuuau

SEQ ID NO: 1331536 - RNA, 18 nt, Homo sapiens
aguugcugucauccacuu

SEQ ID NO: 1331537 - RNA, 14 nt, Homo sapiens
aguuguccgugaua

SEQ ID NO: 1331538 - RNA, 19 nt, Homo sapiens
aguuguuagggcugaggaa

SEQ ID NO: 1331539 - RNA, 18 nt, Homo sapiens
aguuuaagggggacuuaa

SEQ ID NO: 1331540 - RNA, 14 nt, Homo sapiens
aguuuauccauccu

SEQ ID NO: 1331541 - RNA, 21 nt, Homo sapiens
aguuuaugcugugcuaaauau

SEQ ID NO: 1331542 - RNA, 16 nt, Homo sapiens
aguuuauugauauuca

SEQ ID NO: 1331543 - RNA, 18 nt, Homo sapiens
aguuucauuuccuugucc

SEQ ID NO: 1331544 - RNA, 14 nt, Homo sapiens
aguuuccucaguga

SEQ ID NO: 1331545 - RNA, 16 nt, Homo sapiens
aguuuccucagugaug

SEQ ID NO: 1331546 - RNA, 19 nt, Homo sapiens
aguuucuggcuggcuucau

SEQ ID NO: 1331547 - RNA, 20 nt, Homo sapiens
aguuuguuuuagaaccagcc

SEQ ID NO: 1331548 - RNA, 22 nt, Homo sapiens
aguuuuaaacaaaugugauaca

SEQ ID NO: 1331549 - RNA, 23 nt, Homo sapiens
aguuuuauccccugccuaaugcu

SEQ ID NO: 1331550 - RNA, 22 nt, Homo sapiens
aguuuugccugagaaggggcag

SEQ ID NO: 1331551 - RNA, 14 nt, Homo sapiens
auaaaaaacacuaa

SEQ ID NO: 1331552 - RNA, 17 nt, Homo sapiens
auaaaaaacacuaaaca

SEQ ID NO: 1331553 - RNA, 19 nt, Homo sapiens
auaaaaauacaugcaaaua

SEQ ID NO: 1331554 - RNA, 17 nt, Homo sapiens
auaaaaucagugugcuu

SEQ ID NO: 1331555 - RNA, 14 nt, Homo sapiens
auaaacacauuucc

SEQ ID NO: 1331556 - RNA, 16 nt, Homo sapiens
auaaacacauuuccau

SEQ ID NO: 1331557 - RNA, 18 nt, Homo sapiens
auaaacaugcuugcauua

SEQ ID NO: 1331558 - RNA, 15 nt, Homo sapiens
auaaaccauaaaaua

SEQ ID NO: 1331559 - RNA, 20 nt, Homo sapiens
auaccucaaacuaucuggcc

SEQ ID NO: 1331560 - RNA, 14 nt, Homo sapiens
auaccugguuugcu

SEQ ID NO: 1331561 - RNA, 17 nt, Homo sapiens
auacuaaacaucauuga

SEQ ID NO: 1331562 - RNA, 22 nt, Homo sapiens
auacuacaguaacugugacuga

SEQ ID NO: 1331563 - RNA, 14 nt, Homo sapiens
auacucaacaaaac

SEQ ID NO: 1331564 - RNA, 14 nt, Homo sapiens
auacuccacuccaa

SEQ ID NO: 1331565 - RNA, 18 nt, Homo sapiens
auacugucucuccaguga

SEQ ID NO: 1331566 - RNA, 22 nt, Homo sapiens
auacuucuuuauucacaguauc

SEQ ID NO: 1331567 - RNA, 16 nt, Homo sapiens
auacuuuauagcacau

SEQ ID NO: 1331568 - RNA, 22 nt, Homo sapiens
auagaaugagcacccauuccaa

SEQ ID NO: 1331569 - RNA, 13 nt, Homo sapiens
auagacaccauag

SEQ ID NO: 1331570 - RNA, 15 nt, Homo sapiens
auagacacuucacca

SEQ ID NO: 1331571 - RNA, 15 nt, Homo sapiens
auagcaagaucccau

SEQ ID NO: 1331572 - RNA, 18 nt, Homo sapiens
auagcuaaguacacaaua

SEQ ID NO: 1331573 - RNA, 15 nt, Homo sapiens
auaggcaugagccac

SEQ ID NO: 1331574 - RNA, 20 nt, Homo sapiens
auaggucuuucucucaguga

SEQ ID NO: 1331575 - RNA, 21 nt, Homo sapiens
auaguaccaguaggggcuuau

SEQ ID NO: 1331576 - RNA, 18 nt, Homo sapiens
auaguaugaaaauggaaa

SEQ ID NO: 1331577 - RNA, 15 nt, Homo sapiens
auaguggcaagauca

SEQ ID NO: 1331578 - RNA, 13 nt, Homo sapiens
auaguuacugugu

SEQ ID NO: 1331579 - RNA, 21 nt, Homo sapiens
auaguugcugucauccacuuu

SEQ ID NO: 1331580 - RNA, 19 nt, Homo sapiens
auauaaaaauaaagcacuu

SEQ ID NO: 1331581 - RNA, 18 nt, Homo sapiens
auauaaacaugcuugcau

SEQ ID NO: 1331582 - RNA, 12 nt, Homo sapiens
auauaaagucag

SEQ ID NO: 1331583 - RNA, 19 nt, Homo sapiens
auauaaauuuguguucuca

SEQ ID NO: 1331584 - RNA, 19 nt, Homo sapiens
auauaaggaauaaagccuu

SEQ ID NO: 1331585 - RNA, 16 nt, Homo sapiens
auauaaguacugacca

SEQ ID NO: 1331586 - RNA, 16 nt, Homo sapiens
auauacuauuuagucu

SEQ ID NO: 1331587 - RNA, 15 nt, Homo sapiens
auauaggcuucucac

SEQ ID NO: 1331588 - RNA, 23 nt, Homo sapiens
auauaggcuucucacggcgacca

SEQ ID NO: 1331589 - RNA, 17 nt, Homo sapiens
auauagguuugauucaa

SEQ ID NO: 1331590 - RNA, 18 nt, Homo sapiens
auauauaaagucagugac

SEQ ID NO: 1331591 - RNA, 13 nt, Homo sapiens
auauauaugcaua

SEQ ID NO: 1331592 - RNA, 18 nt, Homo sapiens
auauauuaugauugcaua

SEQ ID NO: 1331593 - RNA, 22 nt, Homo sapiens
auauauuauuuagucaacauau

SEQ ID NO: 1331594 - RNA, 13 nt, Homo sapiens
auauauuccacca

SEQ ID NO: 1331595 - RNA, 17 nt, Homo sapiens
auaucaaaacaucccaa

SEQ ID NO: 1331596 - RNA, 17 nt, Homo sapiens
auaucacaugucagcca

SEQ ID NO: 1331597 - RNA, 21 nt, Homo sapiens
auaucccuacauguauugcac

SEQ ID NO: 1331598 - RNA, 18 nt, Homo sapiens
auaucccuuccucucagg

SEQ ID NO: 1331599 - RNA, 14 nt, Homo sapiens
auauccucccucca

SEQ ID NO: 1331600 - RNA, 14 nt, Homo sapiens
auaucuacuguggu

SEQ ID NO: 1331601 - RNA, 17 nt, Homo sapiens
auaucugacuucuagga

SEQ ID NO: 1331602 - RNA, 15 nt, Homo sapiens
auaugaagaaucugc

SEQ ID NO: 1331603 - RNA, 21 nt, Homo sapiens
auaugaagaaucugcucugaa

SEQ ID NO: 1331604 - RNA, 15 nt, Homo sapiens
auaugaaggauuacu

SEQ ID NO: 1331605 - RNA, 20 nt, Homo sapiens
auaugauuguccgugauaau

SEQ ID NO: 1331606 - RNA, 17 nt, Homo sapiens
auaugauuguuucucaa

SEQ ID NO: 1331607 - RNA, 18 nt, Homo sapiens
auaugcuuguaacuaaaa

SEQ ID NO: 1331608 - RNA, 24 nt, Homo sapiens
auauguguguaaaaugugaauaau

SEQ ID NO: 1331609 - RNA, 21 nt, Homo sapiens
auauguuguucuuacaaacca

SEQ ID NO: 1331610 - RNA, 19 nt, Homo sapiens
auauguuuuaaaauacucu

SEQ ID NO: 1331611 - RNA, 20 nt, Homo sapiens
auauuaaaagauuauaggaa

SEQ ID NO: 1331612 - RNA, 19 nt, Homo sapiens
auauuaauuuuccaaugca

SEQ ID NO: 1331613 - RNA, 14 nt, Homo sapiens
auauucacuaagga

SEQ ID NO: 1331614 - RNA, 18 nt, Homo sapiens
auauuccugcauuuguga

SEQ ID NO: 1331615 - RNA, 21 nt, Homo sapiens
auauuccugcauuugugaaau

SEQ ID NO: 1331616 - RNA, 14 nt, Homo sapiens
auauugacuuguau

SEQ ID NO: 1331617 - RNA, 18 nt, Homo sapiens
auauuguaaagauccuau

SEQ ID NO: 1331618 - RNA, 13 nt, Homo sapiens
auauugugcaaac

SEQ ID NO: 1331619 - RNA, 21 nt, Homo sapiens
auauuuaggcaugagcucuug

SEQ ID NO: 1331620 - RNA, 19 nt, Homo sapiens
auauuuauuuaacuauuca

SEQ ID NO: 1331621 - RNA, 17 nt, Homo sapiens
auauuucaucaugauaa

SEQ ID NO: 1331622 - RNA, 17 nt, Homo sapiens
auauuugaaaaccauau

SEQ ID NO: 1331623 - RNA, 17 nt, Homo sapiens
auauuugcuaugaagcg

SEQ ID NO: 1331624 - RNA, 21 nt, Homo sapiens
aucaaauauauuauuuaguca

SEQ ID NO: 1331625 - RNA, 17 nt, Homo sapiens
aucaacaaacacuugag

SEQ ID NO: 1331626 - RNA, 17 nt, Homo sapiens
aucaacauuuguuccau

SEQ ID NO: 1331627 - RNA, 15 nt, Homo sapiens
aucaacgugcaaugu

SEQ ID NO: 1331628 - RNA, 23 nt, Homo sapiens
aucaagaacaugucagcaauguc

SEQ ID NO: 1331629 - RNA, 20 nt, Homo sapiens
aucaagacugcaaacccuuu

SEQ ID NO: 1331630 - RNA, 20 nt, Homo sapiens
aucaaggcucuuccguucca

SEQ ID NO: 1331631 - RNA, 20 nt, Homo sapiens
aucaaguauuuuugacauuu

SEQ ID NO: 1331632 - RNA, 20 nt, Homo sapiens
aucaauaaauguugcaaugc

SEQ ID NO: 1331633 - RNA, 22 nt, Homo sapiens
aucaauaaauguugcaaugcau

SEQ ID NO: 1331634 - RNA, 14 nt, Homo sapiens
aucacacugaauua

SEQ ID NO: 1331635 - RNA, 22 nt, Homo sapiens
aucaccaaucauaguguaccca

SEQ ID NO: 1331636 - RNA, 15 nt, Homo sapiens
aucagaguaugucag

SEQ ID NO: 1331637 - RNA, 19 nt, Homo sapiens
aucagcaaugccccaaacu

SEQ ID NO: 1331638 - RNA, 18 nt, Homo sapiens
aucaggacagguggugca

SEQ ID NO: 1331639 - RNA, 22 nt, Homo sapiens
aucagggacuugaaugcacuuu

SEQ ID NO: 1331640 - RNA, 18 nt, Homo sapiens
aucauaaaggaucagaga

SEQ ID NO: 1331641 - RNA, 22 nt, Homo sapiens
aucauaauucagcacuuaacua

SEQ ID NO: 1331642 - RNA, 15 nt, Homo sapiens
aucaugauaauucag

SEQ ID NO: 1331643 - RNA, 22 nt, Homo sapiens
cauuuguaaucuaguugucaau

SEQ ID NO: 1331644 - RNA, 12 nt, Homo sapiens
cauuuguagcuu

SEQ ID NO: 1331645 - RNA, 18 nt, Homo sapiens
ccaaaaauggcagugacu

SEQ ID NO: 1331646 - RNA, 19 nt, Homo sapiens
ccaaaagcugcucagggaa

SEQ ID NO: 1331647 - RNA, 12 nt, Homo sapiens
ccaaaaugccaa

SEQ ID NO: 1331648 - RNA, 13 nt, Homo sapiens
ccaaacaaaauag

SEQ ID NO: 1331649 - RNA, 14 nt, Homo sapiens
ccaaaccuguaacc

SEQ ID NO: 1331650 - RNA, 15 nt, Homo sapiens
ccaaacuggugcaug

SEQ ID NO: 1331651 - RNA, 14 nt, Homo sapiens
ccaaagacaucagu

SEQ ID NO: 1331652 - RNA, 19 nt, Homo sapiens
ccaaagcccucccuaccua

SEQ ID NO: 1331653 - RNA, 20 nt, Homo sapiens
ccaaaggaacacugacauca

SEQ ID NO: 1331654 - RNA, 18 nt, Homo sapiens
ccaaagggagggugacau

SEQ ID NO: 1331655 - RNA, 14 nt, Homo sapiens
ccaaagguuuugca

SEQ ID NO: 1331656 - RNA, 17 nt, Homo sapiens
ccaaaucugacauauua

SEQ ID NO: 1331657 - RNA, 22 nt, Homo sapiens
ccaaauuucuuuugcugaacag

SEQ ID NO: 1331658 - RNA, 16 nt, Homo sapiens
ccaaauuuggcuaaaa

SEQ ID NO: 1331659 - RNA, 15 nt, Homo sapiens
ccaaccuggacuugu

SEQ ID NO: 1331660 - RNA, 19 nt, Homo sapiens
ccaacugcaaaaaaagccu

SEQ ID NO: 1331661 - RNA, 20 nt, Homo sapiens
ccaacugcagcucuccauca

SEQ ID NO: 1331662 - RNA, 19 nt, Homo sapiens
ccaacuucucuugcuuucu

SEQ ID NO: 1331663 - RNA, 19 nt, Homo sapiens
ccaagaauggaggcuguag

SEQ ID NO: 1331664 - RNA, 13 nt, Homo sapiens
ccaagcaggcaaa

SEQ ID NO: 1331665 - RNA, 15 nt, Homo sapiens
ccaagcuggcacaaa

SEQ ID NO: 1331666 - RNA, 20 nt, Homo sapiens
ccaaggagggugagugcaag

SEQ ID NO: 1331667 - RNA, 21 nt, Homo sapiens
ccaaggagggugagugcaagg

SEQ ID NO: 1331668 - RNA, 17 nt, Homo sapiens
ccaaggcagaaagauag

SEQ ID NO: 1331669 - RNA, 17 nt, Homo sapiens
ccaaggcugcaaagcaa

SEQ ID NO: 1331670 - RNA, 20 nt, Homo sapiens
ccaagggggcugcugcuccu

SEQ ID NO: 1331671 - RNA, 19 nt, Homo sapiens
ccaaguaaaauauuaacau

SEQ ID NO: 1331672 - RNA, 22 nt, Homo sapiens
ccaaguaaacaggguaccucaa

SEQ ID NO: 1331673 - RNA, 20 nt, Homo sapiens
ccaagugaaaagcaggcaaa

SEQ ID NO: 1331674 - RNA, 17 nt, Homo sapiens
ccaagugccccaccacu

SEQ ID NO: 1331675 - RNA, 23 nt, Homo sapiens
ccaaguuccaaaauaaagcauaa

SEQ ID NO: 1331676 - RNA, 16 nt, Homo sapiens
ccaauaacuagcuucu

SEQ ID NO: 1331677 - RNA, 13 nt, Homo sapiens
ccaauacuacuga

SEQ ID NO: 1331678 - RNA, 19 nt, Homo sapiens
ccaaucaaauauauuauuu

SEQ ID NO: 1331679 - RNA, 21 nt, Homo sapiens
ccaaucaccuuuccuguucca

SEQ ID NO: 1331680 - RNA, 13 nt, Homo sapiens
ccaaucagaucaa

SEQ ID NO: 1331681 - RNA, 19 nt, Homo sapiens
ccaaucccaccaacccuca

SEQ ID NO: 1331682 - RNA, 19 nt, Homo sapiens
ccaaugacacccaugccag

SEQ ID NO: 1331683 - RNA, 19 nt, Homo sapiens
ccaaugagaucauugugaa

SEQ ID NO: 1331684 - RNA, 22 nt, Homo sapiens
ccaaugcacaguugccacauuu

SEQ ID NO: 1331685 - RNA, 18 nt, Homo sapiens
ccaaugccaaaaaaagac

SEQ ID NO: 1331686 - RNA, 14 nt, Homo sapiens
ccaauuauaucucc

SEQ ID NO: 1331687 - RNA, 22 nt, Homo sapiens
ccacaacuacuagugugacucc

SEQ ID NO: 1331688 - RNA, 19 nt, Homo sapiens
ccacaauuauuggcaaagu

SEQ ID NO: 1331689 - RNA, 23 nt, Homo sapiens
ccacacacagcugggcuguggua

SEQ ID NO: 1331690 - RNA, 16 nt, Homo sapiens
ccacacccucacugcu

SEQ ID NO: 1331691 - RNA, 22 nt, Homo sapiens
ccacaccggccuugcauugccu

SEQ ID NO: 1331692 - RNA, 16 nt, Homo sapiens
ccacaccugggcauuu

SEQ ID NO: 1331693 - RNA, 20 nt, Homo sapiens
ccacacuaccaguuucacac

SEQ ID NO: 1331694 - RNA, 21 nt, Homo sapiens
ccacacuguggccaggccuua

SEQ ID NO: 1331695 - RNA, 18 nt, Homo sapiens
ccacagacucaaugugcu

SEQ ID NO: 1331696 - RNA, 22 nt, Homo sapiens
ccacagaggacucacuugccca

SEQ ID NO: 1331697 - RNA, 23 nt, Homo sapiens
ccacagccuucggacagacauau

SEQ ID NO: 1331698 - RNA, 16 nt, Homo sapiens
ccacaggcucugacca

SEQ ID NO: 1331699 - RNA, 14 nt, Homo sapiens
ccacaguggcuuca

SEQ ID NO: 1331700 - RNA, 12 nt, Homo sapiens
ccacaguuauua

SEQ ID NO: 1331701 - RNA, 17 nt, Homo sapiens
ccacauccacacagcca

SEQ ID NO: 1331702 - RNA, 22 nt, Homo sapiens
ccacaugaggccaucucaggag

SEQ ID NO: 1331703 - RNA, 17 nt, Homo sapiens
ccacauuggcugccuua

SEQ ID NO: 1331704 - RNA, 21 nt, Homo sapiens
ccaccacucaggccacagugg

SEQ ID NO: 1331705 - RNA, 20 nt, Homo sapiens
ccaccagcauccacacugcc

SEQ ID NO: 1331706 - RNA, 13 nt, Homo sapiens
ccaccaguucuca

SEQ ID NO: 1331707 - RNA, 19 nt, Homo sapiens
ccaccauuccugccuuuaa

SEQ ID NO: 1331708 - RNA, 18 nt, Homo sapiens
ccacccaguccugcacac

SEQ ID NO: 1331709 - RNA, 15 nt, Homo sapiens
ccacccagugcugaa

SEQ ID NO: 1331710 - RNA, 15 nt, Homo sapiens
ccacccgggggagcc

SEQ ID NO: 1331711 - RNA, 18 nt, Homo sapiens
ccaccgagccccugaccc

SEQ ID NO: 1331712 - RNA, 16 nt, Homo sapiens
ccaccucacugcagua

SEQ ID NO: 1331713 - RNA, 21 nt, Homo sapiens
ccaccucacugcaguagugca

SEQ ID NO: 1331714 - RNA, 15 nt, Homo sapiens
ccaccuggcugccaa

SEQ ID NO: 1331715 - RNA, 13 nt, Homo sapiens
ccacgcugaccau

SEQ ID NO: 1331716 - RNA, 19 nt, Homo sapiens
ccacuaccguaaaugucca

SEQ ID NO: 1331717 - RNA, 15 nt, Homo sapiens
ccacuauuugcagag

SEQ ID NO: 1331718 - RNA, 18 nt, Homo sapiens
ccacucaggccacagugg

SEQ ID NO: 1331719 - RNA, 18 nt, Homo sapiens
ccacucaggggucauuca

SEQ ID NO: 1331720 - RNA, 12 nt, Homo sapiens
ccacugaccaga

SEQ ID NO: 1331721 - RNA, 11 nt, Homo sapiens
ccacuguguuu

SEQ ID NO: 1331722 - RNA, 15 nt, Homo sapiens
ccacuuggagcuaaa

SEQ ID NO: 1331723 - RNA, 20 nt, Homo sapiens
ccacuuucagaauguugaag

SEQ ID NO: 1331724 - RNA, 14 nt, Homo sapiens
ccagaaaagcaaua

SEQ ID NO: 1331725 - RNA, 21 nt, Homo sapiens
ccagaaccucuaagugcugcu

SEQ ID NO: 1331726 - RNA, 17 nt, Homo sapiens
ccagaauggagccugcu

SEQ ID NO: 1331727 - RNA, 13 nt, Homo sapiens
ccagacacagugc

SEQ ID NO: 1331728 - RNA, 21 nt, Homo sapiens
ccagacagacaacacugggaa

SEQ ID NO: 1331729 - RNA, 14 nt, Homo sapiens
ccagacuggcacag

SEQ ID NO: 1331730 - RNA, 18 nt, Homo sapiens
ccagacuuccuccuuucc

SEQ ID NO: 1331731 - RNA, 23 nt, Homo sapiens
ccagacuucucuuucuuauuuug

SEQ ID NO: 1331732 - RNA, 18 nt, Homo sapiens
ccagagcaacagccuaaa

SEQ ID NO: 1331733 - RNA, 22 nt, Homo sapiens
ccagagccaggggggugaggag

SEQ ID NO: 1331734 - RNA, 14 nt, Homo sapiens
ccagagcccagcuc

SEQ ID NO: 1331735 - RNA, 17 nt, Homo sapiens
ccagagcccagcuccaa

SEQ ID NO: 1331736 - RNA, 14 nt, Homo sapiens
ccagagcugugcca

SEQ ID NO: 1331737 - RNA, 17 nt, Homo sapiens
ccagagcugugccagca

SEQ ID NO: 1331738 - RNA, 15 nt, Homo sapiens
ccagaggcaguaacc

SEQ ID NO: 1331739 - RNA, 19 nt, Homo sapiens
ccagaggcuauuauuuuca

SEQ ID NO: 1331740 - RNA, 22 nt, Homo sapiens
ccagaggcuucuccaaagggag

SEQ ID NO: 1331741 - RNA, 17 nt, Homo sapiens
ccagagugaagcccaca

SEQ ID NO: 1331742 - RNA, 22 nt, Homo sapiens
ccagaguuucuugguugcuuuu

SEQ ID NO: 1331743 - RNA, 20 nt, Homo sapiens
ccagauaacuuagcuuauga

SEQ ID NO: 1331744 - RNA, 21 nt, Homo sapiens
ccagaugaacugacugaagga

SEQ ID NO: 1331745 - RNA, 16 nt, Homo sapiens
ccagcaaccagcacau

SEQ ID NO: 1331746 - RNA, 17 nt, Homo sapiens
ccagcaauuuagacaaa

SEQ ID NO: 1331747 - RNA, 19 nt, Homo sapiens
ccagcacgaguggccaguu

SEQ ID NO: 1331748 - RNA, 20 nt, Homo sapiens
ccagcacuuugggaggccaa

SEQ ID NO: 1331749 - RNA, 21 nt, Homo sapiens
ccagcagagggggaguagcca

SEQ ID NO: 1331750 - RNA, 15 nt, Homo sapiens
ccagcagcgccuuuc

SEQ ID NO: 1331751 - RNA, 13 nt, Homo sapiens
ccagcaucuccca

SEQ ID NO: 1331752 - RNA, 10 nt, Homo sapiens
ccagcccaga

SEQ ID NO: 1331753 - RNA, 15 nt, Homo sapiens
ccagcccagagccac

SEQ ID NO: 1331754 - RNA, 14 nt, Homo sapiens
ccagccucaucucu

SEQ ID NO: 1331755 - RNA, 18 nt, Homo sapiens
ccagcuaagaaccuggaa

SEQ ID NO: 1331756 - RNA, 23 nt, Homo sapiens
ccagcucaggacagaugccacac

SEQ ID NO: 1331757 - RNA, 13 nt, Homo sapiens
ccagcucuggagu

SEQ ID NO: 1331758 - RNA, 18 nt, Homo sapiens
ccagcucuggaguucucu

SEQ ID NO: 1331759 - RNA, 23 nt, Homo sapiens
ccagcugcgccugcgcugcagga

SEQ ID NO: 1331760 - RNA, 13 nt, Homo sapiens
ccagcuggcagac

SEQ ID NO: 1331761 - RNA, 15 nt, Homo sapiens
ccagcugugcacuuu

SEQ ID NO: 1331762 - RNA, 22 nt, Homo sapiens
ccagcugugcacuuucuucucu

SEQ ID NO: 1331763 - RNA, 15 nt, Homo sapiens
ccagcuuaaaacacu

SEQ ID NO: 1331764 - RNA, 19 nt, Homo sapiens
ccagcuuucccugccaggc

SEQ ID NO: 1331765 - RNA, 21 nt, Homo sapiens
ccaggaauauaugucagugau

SEQ ID NO: 1331766 - RNA, 22 nt, Homo sapiens
ccaggacccugaaggggccaug

SEQ ID NO: 1331767 - RNA, 13 nt, Homo sapiens
ccaggagacaguu

SEQ ID NO: 1331768 - RNA, 18 nt, Homo sapiens
ccaggaguuugagaccag

SEQ ID NO: 1331769 - RNA, 17 nt, Homo sapiens
ccaggccaacagcaccu

SEQ ID NO: 1331770 - RNA, 15 nt, Homo sapiens
ccaggccugccuguu

SEQ ID NO: 1331771 - RNA, 18 nt, Homo sapiens
ccaggccugggugaucug

SEQ ID NO: 1331772 - RNA, 23 nt, Homo sapiens
ccaggccuuaucugaaaggccag

SEQ ID NO: 1331773 - RNA, 18 nt, Homo sapiens
ccaggcuagagugcaaug

SEQ ID NO: 1331774 - RNA, 20 nt, Homo sapiens
ccaggcuagagugcaauggu

SEQ ID NO: 1331775 - RNA, 16 nt, Homo sapiens
ccaggcuggagugcaa

SEQ ID NO: 1331776 - RNA, 21 nt, Homo sapiens
ccaggcuguuggaaaauccag

SEQ ID NO: 1331777 - RNA, 20 nt, Homo sapiens
cauaaguuaugccucugaca

SEQ ID NO: 1331778 - RNA, 13 nt, Homo sapiens
cauaauaauagca

SEQ ID NO: 1331779 - RNA, 17 nt, Homo sapiens
cauaauucagcacuuaa

SEQ ID NO: 1331780 - RNA, 13 nt, Homo sapiens
cauacaacagaaa

SEQ ID NO: 1331781 - RNA, 16 nt, Homo sapiens
cauacaacagaaacca

SEQ ID NO: 1331782 - RNA, 14 nt, Homo sapiens
cauacuaugaaaua

SEQ ID NO: 1331783 - RNA, 22 nt, Homo sapiens
cauacuccacuccaagugcccc

SEQ ID NO: 1331784 - RNA, 14 nt, Homo sapiens
cauagcacuguaua

SEQ ID NO: 1331785 - RNA, 13 nt, Homo sapiens
cauagguucuucu

SEQ ID NO: 1331786 - RNA, 14 nt, Homo sapiens
cauauaacaauuca

SEQ ID NO: 1331787 - RNA, 16 nt, Homo sapiens
cauauacaauugucau

SEQ ID NO: 1331788 - RNA, 21 nt, Homo sapiens
cauauagagaugaaguuugua

SEQ ID NO: 1331789 - RNA, 19 nt, Homo sapiens
cauaugaacagcuguucag

SEQ ID NO: 1331790 - RNA, 20 nt, Homo sapiens
cauaugauuguccgugauaa

SEQ ID NO: 1331791 - RNA, 23 nt, Homo sapiens
cauauguuugcuuauauguuaaa

SEQ ID NO: 1331792 - RNA, 12 nt, Homo sapiens
cauauuaucuca

SEQ ID NO: 1331793 - RNA, 13 nt, Homo sapiens
cauauuaucucau

SEQ ID NO: 1331794 - RNA, 13 nt, Homo sapiens
cauauucaaggag

SEQ ID NO: 1331795 - RNA, 14 nt, Homo sapiens
cauauuuacugguc

SEQ ID NO: 1331796 - RNA, 13 nt, Homo sapiens
cauauuuacuucu

SEQ ID NO: 1331797 - RNA, 23 nt, Homo sapiens
caucaaucuaaagauacaguguc

SEQ ID NO: 1331798 - RNA, 23 nt, Homo sapiens
caucacggauggugcaugggcuc

SEQ ID NO: 1331799 - RNA, 15 nt, Homo sapiens
caucagccuugggau

SEQ ID NO: 1331800 - RNA, 21 nt, Homo sapiens
caucaucacgacacauuugcc

SEQ ID NO: 1331801 - RNA, 18 nt, Homo sapiens
cauccaaccacuguacac

SEQ ID NO: 1331802 - RNA, 22 nt, Homo sapiens
cauccagugugagauacugugu

SEQ ID NO: 1331803 - RNA, 22 nt, Homo sapiens
cauccccaacugcgacugugac

SEQ ID NO: 1331804 - RNA, 19 nt, Homo sapiens
caucccuagucucuaccca

SEQ ID NO: 1331805 - RNA, 22 nt, Homo sapiens
caucccuagucucuacccagua

SEQ ID NO: 1331806 - RNA, 22 nt, Homo sapiens
caucccuuccuggaaacagcau

SEQ ID NO: 1331807 - RNA, 16 nt, Homo sapiens
caucccuuuuuuuaca

SEQ ID NO: 1331808 - RNA, 14 nt, Homo sapiens
cauccgacugcccc

SEQ ID NO: 1331809 - RNA, 14 nt, Homo sapiens
cauccguaucuuuu

SEQ ID NO: 1331810 - RNA, 14 nt, Homo sapiens
cauccuaagacaga

SEQ ID NO: 1331811 - RNA, 14 nt, Homo sapiens
cauccugagccaaa

SEQ ID NO: 1331812 - RNA, 17 nt, Homo sapiens
cauccuggccaacauug

SEQ ID NO: 1331813 - RNA, 24 nt, Homo sapiens
cauccuuaaaacaauucugugaca

SEQ ID NO: 1331814 - RNA, 20 nt, Homo sapiens
cauccuucuuucuaguucag

SEQ ID NO: 1331815 - RNA, 22 nt, Homo sapiens
cauccuugauuacuuccacuga

SEQ ID NO: 1331816 - RNA, 15 nt, Homo sapiens
caucgcgaugucgca

SEQ ID NO: 1331817 - RNA, 12 nt, Homo sapiens
caucgggagcac

SEQ ID NO: 1331818 - RNA, 23 nt, Homo sapiens
caucuaagaaguuuuguucuguc

SEQ ID NO: 1331819 - RNA, 13 nt, Homo sapiens
caucuaagccuga

SEQ ID NO: 1331820 - RNA, 12 nt, Homo sapiens
caucuaccugag

SEQ ID NO: 1331821 - RNA, 15 nt, Homo sapiens
caucucacugcagua

SEQ ID NO: 1331822 - RNA, 13 nt, Homo sapiens
caucucuaauaau

SEQ ID NO: 1331823 - RNA, 23 nt, Homo sapiens
caucugaaugaaaauaacugaac

SEQ ID NO: 1331824 - RNA, 15 nt, Homo sapiens
caucugagaggcucu

SEQ ID NO: 1331825 - RNA, 19 nt, Homo sapiens
caucugcaguacagucuua

SEQ ID NO: 1331826 - RNA, 16 nt, Homo sapiens
caucugcugcaguuac

SEQ ID NO: 1331827 - RNA, 22 nt, Homo sapiens
caucugcuuuucccauugccau

SEQ ID NO: 1331828 - RNA, 20 nt, Homo sapiens
caucuuauuucugucaacuu

SEQ ID NO: 1331829 - RNA, 18 nt, Homo sapiens
caucuugagccacaguca

SEQ ID NO: 1331830 - RNA, 16 nt, Homo sapiens
caucuugcagcauuua

SEQ ID NO: 1331831 - RNA, 14 nt, Homo sapiens
caucuugcuaccag

SEQ ID NO: 1331832 - RNA, 15 nt, Homo sapiens
caucuugcucugcau

SEQ ID NO: 1331833 - RNA, 17 nt, Homo sapiens
caucuugcucugcauuu

SEQ ID NO: 1331834 - RNA, 15 nt, Homo sapiens
caugaauaaaacacu

SEQ ID NO: 1331835 - RNA, 20 nt, Homo sapiens
caugacucguauaugucuca

SEQ ID NO: 1331836 - RNA, 18 nt, Homo sapiens
caugagggccacauucca

SEQ ID NO: 1331837 - RNA, 24 nt, Homo sapiens
caugagucaaaacaaagcagcuuu

SEQ ID NO: 1331838 - RNA, 18 nt, Homo sapiens
caugauggcaacagaucu

SEQ ID NO: 1331839 - RNA, 23 nt, Homo sapiens
caugaugugaagaguuucacaaa

SEQ ID NO: 1331840 - RNA, 15 nt, Homo sapiens
caugauuuuacucau

SEQ ID NO: 1331841 - RNA, 22 nt, Homo sapiens
caugauuuuuuuuuuucagucc

SEQ ID NO: 1331842 - RNA, 17 nt, Homo sapiens
cccacugaaccuucuga

SEQ ID NO: 1331843 - RNA, 18 nt, Homo sapiens
cccacugcccacuggccg

SEQ ID NO: 1331844 - RNA, 19 nt, Homo sapiens
cccacuugucaaguucagc

SEQ ID NO: 1331845 - RNA, 22 nt, Homo sapiens
cccagaaccucuaagugcugcu

SEQ ID NO: 1331846 - RNA, 18 nt, Homo sapiens
cccagaaugagacaucca

SEQ ID NO: 1331847 - RNA, 18 nt, Homo sapiens
cccagagcaaaauaauuu

SEQ ID NO: 1331848 - RNA, 22 nt, Homo sapiens
cccagaggcuucuccaaaggga

SEQ ID NO: 1331849 - RNA, 13 nt, Homo sapiens
cccagcaccccuu

SEQ ID NO: 1331850 - RNA, 14 nt, Homo sapiens
cccagccaccgaag

SEQ ID NO: 1331851 - RNA, 15 nt, Homo sapiens
cccagcccagagaca

SEQ ID NO: 1331852 - RNA, 17 nt, Homo sapiens
cccagcucaaugcaaug

SEQ ID NO: 1331853 - RNA, 17 nt, Homo sapiens
cccagcugaaggcagug

SEQ ID NO: 1331854 - RNA, 16 nt, Homo sapiens
cccaggaacugggcca

SEQ ID NO: 1331855 - RNA, 14 nt, Homo sapiens
cccaggacccugaa

SEQ ID NO: 1331856 - RNA, 18 nt, Homo sapiens
cccaggacccugaagggg

SEQ ID NO: 1331857 - RNA, 14 nt, Homo sapiens
cccaggagacagac

SEQ ID NO: 1331858 - RNA, 17 nt, Homo sapiens
cccaggcuagagugcaa

SEQ ID NO: 1331859 - RNA, 20 nt, Homo sapiens
cccaggcuggagugcaauga

SEQ ID NO: 1331860 - RNA, 23 nt, Homo sapiens
cccaguagaugccacuagcccuc

SEQ ID NO: 1331861 - RNA, 12 nt, Homo sapiens
cccagugcaaac

SEQ ID NO: 1331862 - RNA, 17 nt, Homo sapiens
cccagugcccccacuga

SEQ ID NO: 1331863 - RNA, 22 nt, Homo sapiens
cccagugcccccacugaccaga

SEQ ID NO: 1331864 - RNA, 14 nt, Homo sapiens
cccagugcuugcaa

SEQ ID NO: 1331865 - RNA, 14 nt, Homo sapiens
cccaguucaucacc

SEQ ID NO: 1331866 - RNA, 21 nt, Homo sapiens
cccaguucaucaccauuuccu

SEQ ID NO: 1331867 - RNA, 23 nt, Homo sapiens
cccauagcaaagaggcuguuaua

SEQ ID NO: 1331868 - RNA, 15 nt, Homo sapiens
cccaugaaugugagc

SEQ ID NO: 1331869 - RNA, 14 nt, Homo sapiens
cccaugcacuguga

SEQ ID NO: 1331870 - RNA, 17 nt, Homo sapiens
cccaugcaucuuccacu

SEQ ID NO: 1331871 - RNA, 20 nt, Homo sapiens
cccaugcccuggauccauca

SEQ ID NO: 1331872 - RNA, 22 nt, Homo sapiens
cccaugcuuuguaggugucuca

SEQ ID NO: 1331873 - RNA, 17 nt, Homo sapiens
ccccaaauuuggcuaaa

SEQ ID NO: 1331874 - RNA, 15 nt, Homo sapiens
ccccaaggcugcaaa

SEQ ID NO: 1331875 - RNA, 17 nt, Homo sapiens
ccccaaguuaguucaau

SEQ ID NO: 1331876 - RNA, 22 nt, Homo sapiens
ccccaccccaucuuugcugcca

SEQ ID NO: 1331877 - RNA, 23 nt, Homo sapiens
ccccaccucggcacacacugugc

SEQ ID NO: 1331878 - RNA, 14 nt, Homo sapiens
ccccacgcugacca

SEQ ID NO: 1331879 - RNA, 23 nt, Homo sapiens
ccccacguugccucuacuuuauc

SEQ ID NO: 1331880 - RNA, 16 nt, Homo sapiens
ccccacuccagcuccu

SEQ ID NO: 1331881 - RNA, 16 nt, Homo sapiens
ccccacuuuauugcca

SEQ ID NO: 1331882 - RNA, 20 nt, Homo sapiens
ccccagagaaaacccggagc

SEQ ID NO: 1331883 - RNA, 20 nt, Homo sapiens
ccccagagcucuaaccaaag

SEQ ID NO: 1331884 - RNA, 19 nt, Homo sapiens
ccccagauucaugcacugu

SEQ ID NO: 1331885 - RNA, 17 nt, Homo sapiens
ccccagccagggcucaa

SEQ ID NO: 1331886 - RNA, 22 nt, Homo sapiens
ccccagccagggcucaaucucu

SEQ ID NO: 1331887 - RNA, 15 nt, Homo sapiens
ccccagcuuggcuca

SEQ ID NO: 1331888 - RNA, 22 nt, Homo sapiens
ccccaggcccagugggguggcc

SEQ ID NO: 1331889 - RNA, 18 nt, Homo sapiens
ccccagguuccauaccau

SEQ ID NO: 1331890 - RNA, 16 nt, Homo sapiens
cccccacuacaaguga

SEQ ID NO: 1331891 - RNA, 16 nt, Homo sapiens
cccccacugaccagaa

SEQ ID NO: 1331892 - RNA, 14 nt, Homo sapiens
cccccagcuaagaa

SEQ ID NO: 1331893 - RNA, 14 nt, Homo sapiens
cccccaugcugccu

SEQ ID NO: 1331894 - RNA, 18 nt, Homo sapiens
cccccauucacuuuguca

SEQ ID NO: 1331895 - RNA, 13 nt, Homo sapiens
cccccgccaaaag

SEQ ID NO: 1331896 - RNA, 17 nt, Homo sapiens
cccccucuguugcacau

SEQ ID NO: 1331897 - RNA, 17 nt, Homo sapiens
cccccuuucacacugga

SEQ ID NO: 1331898 - RNA, 16 nt, Homo sapiens
ccccgacacacggggc

SEQ ID NO: 1331899 - RNA, 19 nt, Homo sapiens
ccccgagcccaggcagcua

SEQ ID NO: 1331900 - RNA, 19 nt, Homo sapiens
ccccuaaaaagauugccaa

SEQ ID NO: 1331901 - RNA, 16 nt, Homo sapiens
ccccuaaaccaaaaac

SEQ ID NO: 1331902 - RNA, 18 nt, Homo sapiens
ccccucacucuguuuccu

SEQ ID NO: 1331903 - RNA, 19 nt, Homo sapiens
ccccugcaauguggugaca

SEQ ID NO: 1331904 - RNA, 14 nt, Homo sapiens
ccccugccagugaa

SEQ ID NO: 1331905 - RNA, 18 nt, Homo sapiens
ccccugcuccaccagcag

SEQ ID NO: 1331906 - RNA, 15 nt, Homo sapiens
ccccuggcuuugccu

SEQ ID NO: 1331907 - RNA, 12 nt, Homo sapiens
ccccuucauccg

SEQ ID NO: 1331908 - RNA, 16 nt, Homo sapiens
ccccuuguuguaaaaa

SEQ ID NO: 1331909 - RNA, 20 nt, Homo sapiens
ccccuuguuguaaaaagccc

SEQ ID NO: 1331910 - RNA, 13 nt, Homo sapiens
cccgacagccugg

SEQ ID NO: 1331911 - RNA, 23 nt, Homo sapiens
cccgaucaucuuuccuguuccag

SEQ ID NO: 1331912 - RNA, 23 nt, Homo sapiens
cccgcuaaggugaaaaggggugu

SEQ ID NO: 1331913 - RNA, 23 nt, Homo sapiens
cccgcuauuaucagaucaugccc

SEQ ID NO: 1331914 - RNA, 15 nt, Homo sapiens
cccguccacagggca

SEQ ID NO: 1331915 - RNA, 23 nt, Homo sapiens
cccguuucauuuagucaugugac

SEQ ID NO: 1331916 - RNA, 15 nt, Homo sapiens
cccuaaaccaaaaac

SEQ ID NO: 1331917 - RNA, 16 nt, Homo sapiens
ccuaaaagcacacuca

SEQ ID NO: 1331918 - RNA, 23 nt, Homo sapiens
ccuaaagagcauccugauaccau

SEQ ID NO: 1331919 - RNA, 20 nt, Homo sapiens
ccuaaagccucaaaacaaag

SEQ ID NO: 1331920 - RNA, 19 nt, Homo sapiens
ccuaaagcuuuuauuuaac

SEQ ID NO: 1331921 - RNA, 17 nt, Homo sapiens
ccuaaagggacuaccuc

SEQ ID NO: 1331922 - RNA, 23 nt, Homo sapiens
ccuaaagggcagggcccacgugu

SEQ ID NO: 1331923 - RNA, 19 nt, Homo sapiens
ccuaaaguauaacaugucg

SEQ ID NO: 1331924 - RNA, 17 nt, Homo sapiens
ccuaauuccacacccuc

SEQ ID NO: 1331925 - RNA, 21 nt, Homo sapiens
ccuacagggacacuaucacuc

SEQ ID NO: 1331926 - RNA, 21 nt, Homo sapiens
ccuacauguauugcacauugu

SEQ ID NO: 1331927 - RNA, 15 nt, Homo sapiens
ccuaccaagauauac

SEQ ID NO: 1331928 - RNA, 19 nt, Homo sapiens
ccuacuccaagaauggagg

SEQ ID NO: 1331929 - RNA, 16 nt, Homo sapiens
ccuacuucuuuugcuc

SEQ ID NO: 1331930 - RNA, 14 nt, Homo sapiens
ccuagaaagacaga

SEQ ID NO: 1331931 - RNA, 19 nt, Homo sapiens
ccuagauaugaagaaucug

SEQ ID NO: 1331932 - RNA, 21 nt, Homo sapiens
ccuagauaugaagaaucugcu

SEQ ID NO: 1331933 - RNA, 17 nt, Homo sapiens
ccuagcagccucaaaac

SEQ ID NO: 1331934 - RNA, 18 nt, Homo sapiens
ccuagucucuacccagua

SEQ ID NO: 1331935 - RNA, 11 nt, Homo sapiens
ccuaucugacu

SEQ ID NO: 1331936 - RNA, 21 nt, Homo sapiens
ccuauucccucucucucccag

SEQ ID NO: 1331937 - RNA, 21 nt, Homo sapiens
ccuauucugaaaaagacauaa

SEQ ID NO: 1331938 - RNA, 22 nt, Homo sapiens
ccuauucugaaaaagacauaaa

SEQ ID NO: 1331939 - RNA, 19 nt, Homo sapiens
ccuauuuaucugaucaaga

SEQ ID NO: 1331940 - RNA, 13 nt, Homo sapiens
ccucaaacugcac

SEQ ID NO: 1331941 - RNA, 18 nt, Homo sapiens
ccucacaggccccaggaa

SEQ ID NO: 1331942 - RNA, 23 nt, Homo sapiens
ccucacauuuggaugauugucau

SEQ ID NO: 1331943 - RNA, 20 nt, Homo sapiens
ccucacccccagcuuugcua

SEQ ID NO: 1331944 - RNA, 19 nt, Homo sapiens
ccucagaaggccccagaga

SEQ ID NO: 1331945 - RNA, 12 nt, Homo sapiens
ccucagacaucc

SEQ ID NO: 1331946 - RNA, 13 nt, Homo sapiens
ccucagagugcaa

SEQ ID NO: 1331947 - RNA, 14 nt, Homo sapiens
ccucagccagagaa

SEQ ID NO: 1331948 - RNA, 22 nt, Homo sapiens
ccucagggccacguuaccacag

SEQ ID NO: 1331949 - RNA, 14 nt, Homo sapiens
ccucaguccacugc

SEQ ID NO: 1331950 - RNA, 21 nt, Homo sapiens
ccucauauacuugaauauuau

SEQ ID NO: 1331951 - RNA, 19 nt, Homo sapiens
ccucauccaugcugugcug

SEQ ID NO: 1331952 - RNA, 15 nt, Homo sapiens
ccucauucuacugaa

SEQ ID NO: 1331953 - RNA, 16 nt, Homo sapiens
ccuccaaaggucugau

SEQ ID NO: 1331954 - RNA, 22 nt, Homo sapiens
ccuccaacgccccuguggccaa

SEQ ID NO: 1331955 - RNA, 20 nt, Homo sapiens
ccuccaagcuccaucuccac

SEQ ID NO: 1331956 - RNA, 12 nt, Homo sapiens
ccuccacagaga

SEQ ID NO: 1331957 - RNA, 18 nt, Homo sapiens
ccuccaccaugcacucac

SEQ ID NO: 1331958 - RNA, 12 nt, Homo sapiens
ccuccaccucaa

SEQ ID NO: 1331959 - RNA, 23 nt, Homo sapiens
ccuccaugaacaucauggacuga

SEQ ID NO: 1331960 - RNA, 16 nt, Homo sapiens
ccucccccaguguccc

SEQ ID NO: 1331961 - RNA, 15 nt, Homo sapiens
ccucccgucuucaga

SEQ ID NO: 1331962 - RNA, 16 nt, Homo sapiens
ccucccgucuucagau

SEQ ID NO: 1331963 - RNA, 14 nt, Homo sapiens
ccucccucauucca

SEQ ID NO: 1331964 - RNA, 15 nt, Homo sapiens
ccucccugcaucuga

SEQ ID NO: 1331965 - RNA, 18 nt, Homo sapiens
ccucccugccuccaggaa

SEQ ID NO: 1331966 - RNA, 17 nt, Homo sapiens
ccucccugccugcuccu

SEQ ID NO: 1331967 - RNA, 20 nt, Homo sapiens
ccucccuuccccuuuuccca

SEQ ID NO: 1331968 - RNA, 20 nt, Homo sapiens
ccuccuacccuuccagugcc

SEQ ID NO: 1331969 - RNA, 17 nt, Homo sapiens
ccuccuccccuagggaa

SEQ ID NO: 1331970 - RNA, 14 nt, Homo sapiens
ccuccugcacacag

SEQ ID NO: 1331971 - RNA, 22 nt, Homo sapiens
ccuccugggaacacaucuggcu

SEQ ID NO: 1331972 - RNA, 14 nt, Homo sapiens
ccuccuggguucaa

SEQ ID NO: 1331973 - RNA, 18 nt, Homo sapiens
ccuccugucccucaucca

SEQ ID NO: 1331974 - RNA, 16 nt, Homo sapiens
ccuccuuggcuuuaug

SEQ ID NO: 1331975 - RNA, 19 nt, Homo sapiens
ccuccuuggcuuuaugcaa

SEQ ID NO: 1331976 - RNA, 21 nt, Homo sapiens
ccuccuuggcuuuaugcaaau

SEQ ID NO: 1331977 - RNA, 20 nt, Homo sapiens
ccucgcggcucuccagggcu

SEQ ID NO: 1331978 - RNA, 19 nt, Homo sapiens
ccucgggccccauccucau

SEQ ID NO: 1331979 - RNA, 15 nt, Homo sapiens
ccucgguaucuggcu

SEQ ID NO: 1331980 - RNA, 18 nt, Homo sapiens
ccucucaggcucuugacu

SEQ ID NO: 1331981 - RNA, 17 nt, Homo sapiens
ccucucaguuguugaaa

SEQ ID NO: 1331982 - RNA, 12 nt, Homo sapiens
ccucucauucca

SEQ ID NO: 1331983 - RNA, 21 nt, Homo sapiens
ccucucucucccaggucccag

SEQ ID NO: 1331984 - RNA, 11 nt, Homo sapiens
ccucucugagu

SEQ ID NO: 1331985 - RNA, 15 nt, Homo sapiens
ccucucugagucaaa

SEQ ID NO: 1331986 - RNA, 23 nt, Homo sapiens
ccucucugagucaaauccagugg

SEQ ID NO: 1331987 - RNA, 20 nt, Homo sapiens
ccucuguggucacccaugca

SEQ ID NO: 1331988 - RNA, 18 nt, Homo sapiens
ccucuuagauauucacua

SEQ ID NO: 1331989 - RNA, 13 nt, Homo sapiens
ccucuuagcucag

SEQ ID NO: 1331990 - RNA, 21 nt, Homo sapiens
ccucuuccgugacgucacugg

SEQ ID NO: 1331991 - RNA, 23 nt, Homo sapiens
ccucuugaguuccucugcaguuu

SEQ ID NO: 1331992 - RNA, 17 nt, Homo sapiens
ccucuuggcugccuugu

SEQ ID NO: 1331993 - RNA, 16 nt, Homo sapiens
ccucuuucaucuguaa

SEQ ID NO: 1331994 - RNA, 18 nt, Homo sapiens
gcauggagacagcaguuu

SEQ ID NO: 1331995 - RNA, 19 nt, Homo sapiens
gcaugugugcaugugcugu

SEQ ID NO: 1331996 - RNA, 17 nt, Homo sapiens
gcauuaauagucccauu

SEQ ID NO: 1331997 - RNA, 22 nt, Homo sapiens
gcauugucaccgcaggugcuca

SEQ ID NO: 1331998 - RNA, 12 nt, Homo sapiens
gcauuucuugcg

SEQ ID NO: 1331999 - RNA, 13 nt, Homo sapiens
gccaaaaauacag

SEQ ID NO: 1332000 - RNA, 19 nt, Homo sapiens
gccaaaagcugcucaggga

SEQ ID NO: 1332001 - RNA, 13 nt, Homo sapiens
gccaaaaugcucu

SEQ ID NO: 1332002 - RNA, 16 nt, Homo sapiens
gccaaauuucuuuugc

SEQ ID NO: 1332003 - RNA, 20 nt, Homo sapiens
gccaacaaagaacacuaacu

SEQ ID NO: 1332004 - RNA, 13 nt, Homo sapiens
gccaacccuuuca

SEQ ID NO: 1332005 - RNA, 22 nt, Homo sapiens
gccaaccgugggguuagcucua

SEQ ID NO: 1332006 - RNA, 14 nt, Homo sapiens
gccaacugcaaaaa

SEQ ID NO: 1332007 - RNA, 22 nt, Homo sapiens
ggaauauaaacaggaucucaaa

SEQ ID NO: 1332008 - RNA, 19 nt, Homo sapiens
ggaaugccgcugucucuga

SEQ ID NO: 1332009 - RNA, 20 nt, Homo sapiens
ggaaugccgcugucucugag

SEQ ID NO: 1332010 - RNA, 13 nt, Homo sapiens
ggaauguucuuuc

SEQ ID NO: 1332011 - RNA, 17 nt, Homo sapiens
ggacaagauacauauga

SEQ ID NO: 1332012 - RNA, 15 nt, Homo sapiens
ggacaccaagccuug

SEQ ID NO: 1332013 - RNA, 16 nt, Homo sapiens
ggacacuaucacucau

SEQ ID NO: 1332014 - RNA, 22 nt, Homo sapiens
ggacagaauuggauacauacac

SEQ ID NO: 1332015 - RNA, 18 nt, Homo sapiens
ggacagccccacccuggu

SEQ ID NO: 1332016 - RNA, 13 nt, Homo sapiens
ggacagguggugc

SEQ ID NO: 1332017 - RNA, 20 nt, Homo sapiens
ggacaguaucguuuguuuau

SEQ ID NO: 1332018 - RNA, 23 nt, Homo sapiens
ggacauaaugggguccuggccau

SEQ ID NO: 1332019 - RNA, 13 nt, Homo sapiens
ggaccguccaggg

SEQ ID NO: 1332020 - RNA, 18 nt, Homo sapiens
ggaccuggcgugcucaga

SEQ ID NO: 1332021 - RNA, 18 nt, Homo sapiens
ggacuauuacauccacau

SEQ ID NO: 1332022 - RNA, 15 nt, Homo sapiens
ggagaaacccagaga

SEQ ID NO: 1332023 - RNA, 17 nt, Homo sapiens
ggagaaacuucugcuca

SEQ ID NO: 1332024 - RNA, 16 nt, Homo sapiens
ggagacugucucaaga

SEQ ID NO: 1332025 - RNA, 15 nt, Homo sapiens
ggagagagugcuauu

SEQ ID NO: 1332026 - RNA, 13 nt, Homo sapiens
ggagagcccuuca

SEQ ID NO: 1332027 - RNA, 19 nt, Homo sapiens
ggagaguagcaacaaaagg

SEQ ID NO: 1332028 - RNA, 20 nt, Homo sapiens
ggagcagguuccccaagggc

SEQ ID NO: 1332029 - RNA, 13 nt, Homo sapiens
ggagcccagugaa

SEQ ID NO: 1332030 - RNA, 16 nt, Homo sapiens
ggagccccuuucagga

SEQ ID NO: 1332031 - RNA, 20 nt, Homo sapiens
ggagccugaagggugccuag

SEQ ID NO: 1332032 - RNA, 14 nt, Homo sapiens
ggagccugcaacau

SEQ ID NO: 1332033 - RNA, 20 nt, Homo sapiens
ggagccugggcauccucagg

SEQ ID NO: 1332034 - RNA, 22 nt, Homo sapiens
ggagccugguucagacacagcu

SEQ ID NO: 1332035 - RNA, 17 nt, Homo sapiens
ggagcucaggucccagg

SEQ ID NO: 1332036 - RNA, 12 nt, Homo sapiens
ggagcugccaca

SEQ ID NO: 1332037 - RNA, 11 nt, Homo sapiens
ggagcugcuau

SEQ ID NO: 1332038 - RNA, 15 nt, Homo sapiens
ggaggccaaccagcc

SEQ ID NO: 1332039 - RNA, 16 nt, Homo sapiens
ggaggccuauuccugc

SEQ ID NO: 1332040 - RNA, 17 nt, Homo sapiens
ggagggccagcgcugug

SEQ ID NO: 1332041 - RNA, 12 nt, Homo sapiens
ggaggggaccaa

SEQ ID NO: 1332042 - RNA, 16 nt, Homo sapiens
ggagggugagugcaag

SEQ ID NO: 1332043 - RNA, 18 nt, Homo sapiens
ggagugaccaaaaugcca

SEQ ID NO: 1332044 - RNA, 12 nt, Homo sapiens
ggagugcaaugg

SEQ ID NO: 1332045 - RNA, 16 nt, Homo sapiens
ggagugggcgcagugg

SEQ ID NO: 1332046 - RNA, 12 nt, Homo sapiens
ggauagucuccu

SEQ ID NO: 1332047 - RNA, 13 nt, Homo sapiens
ggauccagccacu

SEQ ID NO: 1332048 - RNA, 17 nt, Homo sapiens
ggauccuccacagagag

SEQ ID NO: 1332049 - RNA, 23 nt, Homo sapiens
ggaucuucccacaggagggccag

SEQ ID NO: 1332050 - RNA, 22 nt, Homo sapiens
ggaugcaaauagauucagagaa

SEQ ID NO: 1332051 - RNA, 22 nt, Homo sapiens
ggaugucuccaucucugucuca

SEQ ID NO: 1332052 - RNA, 22 nt, Homo sapiens
ggaugucuccgucucugucuca

SEQ ID NO: 1332053 - RNA, 13 nt, Homo sapiens
ggauuacagggau

SEQ ID NO: 1332054 - RNA, 20 nt, Homo sapiens
ggauucuagaacugugaauu

SEQ ID NO: 1332055 - RNA, 22 nt, Homo sapiens
ggauuguauuuaagacauaaac

SEQ ID NO: 1332056 - RNA, 21 nt, Homo sapiens
ggauuuccuugacuucuuuga

SEQ ID NO: 1332057 - RNA, 15 nt, Homo sapiens
ggcaaaagacuugaa

SEQ ID NO: 1332058 - RNA, 19 nt, Homo sapiens
ggcaaaugccugacucagu

SEQ ID NO: 1332059 - RNA, 23 nt, Homo sapiens
ggcaacagagcgagauuccaucu

SEQ ID NO: 1332060 - RNA, 16 nt, Homo sapiens
ggcaacgcacaaaaca

SEQ ID NO: 1332061 - RNA, 19 nt, Homo sapiens
ggcaacguagccugggcuc

SEQ ID NO: 1332062 - RNA, 21 nt, Homo sapiens
ggcaauaaaagaaauguugcg

SEQ ID NO: 1332063 - RNA, 19 nt, Homo sapiens
ggcaaucucagaugcaguu

SEQ ID NO: 1332064 - RNA, 19 nt, Homo sapiens
ggcaaucuuugccuuuauc

SEQ ID NO: 1332065 - RNA, 14 nt, Homo sapiens
ggcacccuggucug

SEQ ID NO: 1332066 - RNA, 16 nt, Homo sapiens
ggcaccuaauccaggc

SEQ ID NO: 1332067 - RNA, 13 nt, Homo sapiens
ggcagacuuucuu

SEQ ID NO: 1332068 - RNA, 13 nt, Homo sapiens
ggcagagcuuuua

SEQ ID NO: 1332069 - RNA, 23 nt, Homo sapiens
ggcagauuugcaacuaguaaaau

SEQ ID NO: 1332070 - RNA, 14 nt, Homo sapiens
ggcagcaggccaga

SEQ ID NO: 1332071 - RNA, 16 nt, Homo sapiens
ggcagcccuauuucag

SEQ ID NO: 1332072 - RNA, 13 nt, Homo sapiens
ggcagcugcuccu

SEQ ID NO: 1332073 - RNA, 18 nt, Homo sapiens
ggcaggagaaucacuuga

SEQ ID NO: 1332074 - RNA, 16 nt, Homo sapiens
ggcaggccagggcagu

SEQ ID NO: 1332075 - RNA, 21 nt, Homo sapiens
ggcagggcugaggccucucau

SEQ ID NO: 1332076 - RNA, 17 nt, Homo sapiens
ggcaggucuaguguucc

SEQ ID NO: 1332077 - RNA, 22 nt, Homo sapiens
ggcagucgaguuucuacguggu

SEQ ID NO: 1332078 - RNA, 17 nt, Homo sapiens
ggcaguggagaucagga

SEQ ID NO: 1332079 - RNA, 10 nt, Homo sapiens
ggcaguuuuu

SEQ ID NO: 1332080 - RNA, 20 nt, Homo sapiens
ggcaugagccacugugcuug

SEQ ID NO: 1332081 - RNA, 12 nt, Homo sapiens
ggcaugggagac

SEQ ID NO: 1332082 - RNA, 16 nt, Homo sapiens
ggcauggguccagggc

SEQ ID NO: 1332083 - RNA, 20 nt, Homo sapiens
ggccaaggagggcagaucac

SEQ ID NO: 1332084 - RNA, 10 nt, Homo sapiens
ggccacagac

SEQ ID NO: 1332085 - RNA, 13 nt, Homo sapiens
ggccacccaggaa

SEQ ID NO: 1332086 - RNA, 21 nt, Homo sapiens
ggccacccaggaacuccugac

SEQ ID NO: 1332087 - RNA, 12 nt, Homo sapiens
ggccaccggugg

SEQ ID NO: 1332088 - RNA, 21 nt, Homo sapiens
ggccagugagaucaaugugac

SEQ ID NO: 1332089 - RNA, 17 nt, Homo sapiens
ggccauaaacgguuccu

SEQ ID NO: 1332090 - RNA, 14 nt, Homo sapiens
ggccauauuuacua

SEQ ID NO: 1332091 - RNA, 14 nt, Homo sapiens
ggccaucuucuuuc

SEQ ID NO: 1332092 - RNA, 23 nt, Homo sapiens
ggccaugauggcaacagaucugg

SEQ ID NO: 1332093 - RNA, 22 nt, Homo sapiens
ggccauggaagguucucugugc

SEQ ID NO: 1332094 - RNA, 22 nt, Homo sapiens
ggccauuuccaagaggcuguag

SEQ ID NO: 1332095 - RNA, 19 nt, Homo sapiens
ggcccagcuuucccugcca

SEQ ID NO: 1332096 - RNA, 17 nt, Homo sapiens
ggccccaccggggucua

SEQ ID NO: 1332097 - RNA, 14 nt, Homo sapiens
ggccccauccucau

SEQ ID NO: 1332098 - RNA, 15 nt, Homo sapiens
ggcccccuucaggag

SEQ ID NO: 1332099 - RNA, 13 nt, Homo sapiens
ggccccgggcugg

SEQ ID NO: 1332100 - RNA, 14 nt, Homo sapiens
ggccccgucugugg

SEQ ID NO: 1332101 - RNA, 19 nt, Homo sapiens
ggcccgacagccuggcaca

SEQ ID NO: 1332102 - RNA, 22 nt, Homo sapiens
ggcccucccaucuccccgcuga

SEQ ID NO: 1332103 - RNA, 20 nt, Homo sapiens
ggccgguucuaaggcucaga

SEQ ID NO: 1332104 - RNA, 16 nt, Homo sapiens
ggccuagaaagggcaa

SEQ ID NO: 1332105 - RNA, 11 nt, Homo sapiens
ggccucaggug

SEQ ID NO: 1332106 - RNA, 15 nt, Homo sapiens
ggccuccaugcacuu

SEQ ID NO: 1332107 - RNA, 20 nt, Homo sapiens
ggccucccaaagugcuggga

SEQ ID NO: 1332108 - RNA, 18 nt, Homo sapiens
ggccucccacagacucaa

SEQ ID NO: 1332109 - RNA, 20 nt, Homo sapiens
ggccucccagagugcuggga

SEQ ID NO: 1332110 - RNA, 22 nt, Homo sapiens
ggccucccagagugcugggauu

SEQ ID NO: 1332111 - RNA, 13 nt, Homo sapiens
ggccugcuccaga

SEQ ID NO: 1332112 - RNA, 19 nt, Homo sapiens
ggccugcugccagugcagc

SEQ ID NO: 1332113 - RNA, 20 nt, Homo sapiens
ggccuuaucugaaaggccag

SEQ ID NO: 1332114 - RNA, 15 nt, Homo sapiens
ggccuucaccaagca

SEQ ID NO: 1332115 - RNA, 17 nt, Homo sapiens
ggccuucccauggccau

SEQ ID NO: 1332116 - RNA, 17 nt, Homo sapiens
ggcgaggagagggcgcu

SEQ ID NO: 1332117 - RNA, 14 nt, Homo sapiens
ggcgcaguggcuca

SEQ ID NO: 1332118 - RNA, 22 nt, Homo sapiens
ggcgcuugcaccacuuccgucc

SEQ ID NO: 1332119 - RNA, 22 nt, Homo sapiens
ggcuauuguccccuaaaccaaa

SEQ ID NO: 1332120 - RNA, 20 nt, Homo sapiens
ggcucagauuguaauaugua

SEQ ID NO: 1332121 - RNA, 13 nt, Homo sapiens
ggcucagggcagu

SEQ ID NO: 1332122 - RNA, 20 nt, Homo sapiens
ggcucagucgcuagcauuuc

SEQ ID NO: 1332123 - RNA, 12 nt, Homo sapiens
ggcuccuaccug

SEQ ID NO: 1332124 - RNA, 20 nt, Homo sapiens
ggcucgucagccaccuggga

SEQ ID NO: 1332125 - RNA, 16 nt, Homo sapiens
ggcucguguauuuauu

SEQ ID NO: 1332126 - RNA, 19 nt, Homo sapiens
ggcucuuaugugugccuuu

SEQ ID NO: 1332127 - RNA, 16 nt, Homo sapiens
ggcucuugacuacuug

SEQ ID NO: 1332128 - RNA, 19 nt, Homo sapiens
ggcugacaugcucacacau

SEQ ID NO: 1332129 - RNA, 14 nt, Homo sapiens
ggcugcacaacagc

SEQ ID NO: 1332130 - RNA, 23 nt, Homo sapiens
ggcugcccaccuggcugccaaca

SEQ ID NO: 1332131 - RNA, 15 nt, Homo sapiens
ggcuggagccugggg

SEQ ID NO: 1332132 - RNA, 20 nt, Homo sapiens
ggcuggagugcaaugacaca

SEQ ID NO: 1332133 - RNA, 16 nt, Homo sapiens
ggcuggagugcaaugg

SEQ ID NO: 1332134 - RNA, 20 nt, Homo sapiens
ggcuggagugcaguggcgcg

SEQ ID NO: 1332135 - RNA, 19 nt, Homo sapiens
ggcugggagacagagucag

SEQ ID NO: 1332136 - RNA, 17 nt, Homo sapiens
ggcugugguuuggggga

SEQ ID NO: 1332137 - RNA, 19 nt, Homo sapiens
ggcuguuucuugucuguua

SEQ ID NO: 1332138 - RNA, 20 nt, Homo sapiens
ggcuucccuaaacugcagcc

SEQ ID NO: 1332139 - RNA, 17 nt, Homo sapiens
ggcuucuccaaagggag

SEQ ID NO: 1332140 - RNA, 13 nt, Homo sapiens
ggcuuuaugcaaa

SEQ ID NO: 1332141 - RNA, 14 nt, Homo sapiens
ggcuuuaugcaaau

SEQ ID NO: 1332142 - RNA, 21 nt, Homo sapiens
ggcuuuuacugaagccuuucu

SEQ ID NO: 1332143 - RNA, 13 nt, Homo sapiens
gggaaaaccagac

SEQ ID NO: 1332144 - RNA, 21 nt, Homo sapiens
gggaaaccccccagagcucuu

SEQ ID NO: 1332145 - RNA, 18 nt, Homo sapiens
gggaaaggaaucagagag

SEQ ID NO: 1332146 - RNA, 14 nt, Homo sapiens
gggaaauccauucc

SEQ ID NO: 1332147 - RNA, 22 nt, Homo sapiens
gggaacagaaaaaauaaacuga

SEQ ID NO: 1332148 - RNA, 14 nt, Homo sapiens
gggaaccacuccca

SEQ ID NO: 1332149 - RNA, 14 nt, Homo sapiens
gggaagaagggaua

SEQ ID NO: 1332150 - RNA, 11 nt, Homo sapiens
gggaagacagu

SEQ ID NO: 1332151 - RNA, 14 nt, Homo sapiens
gggaagacaguggc

SEQ ID NO: 1332152 - RNA, 14 nt, Homo sapiens
gggaaguaacagac

SEQ ID NO: 1332153 - RNA, 13 nt, Homo sapiens
gggaccccgagaa

SEQ ID NO: 1332154 - RNA, 12 nt, Homo sapiens
gggaccugagag

SEQ ID NO: 1332155 - RNA, 19 nt, Homo sapiens
gggacuaucuuugcugcag

SEQ ID NO: 1332156 - RNA, 19 nt, Homo sapiens
gggagaaaaaaagggaucu

SEQ ID NO: 1332157 - RNA, 15 nt, Homo sapiens
gggagacaugugaca

SEQ ID NO: 1332158 - RNA, 19 nt, Homo sapiens
gggagaguaaaccuugaag

SEQ ID NO: 1332159 - RNA, 14 nt, Homo sapiens
gggagcccucaggc

SEQ ID NO: 1332160 - RNA, 13 nt, Homo sapiens
gggaggcagggga

SEQ ID NO: 1332161 - RNA, 16 nt, Homo sapiens
gggauaucuacugugg

SEQ ID NO: 1332162 - RNA, 14 nt, Homo sapiens
gggcaccugaccac

SEQ ID NO: 1332163 - RNA, 18 nt, Homo sapiens
gggcacugaggaccagcc

SEQ ID NO: 1332164 - RNA, 13 nt, Homo sapiens
gggcacugguggc

SEQ ID NO: 1332165 - RNA, 22 nt, Homo sapiens
gggcagaucucccacaugccag

SEQ ID NO: 1332166 - RNA, 13 nt, Homo sapiens
gggcaguugacag

SEQ ID NO: 1332167 - RNA, 22 nt, Homo sapiens
gggccaucugacugccaagcca

SEQ ID NO: 1332168 - RNA, 22 nt, Homo sapiens
gggcccaaguaagggcacagau

SEQ ID NO: 1332169 - RNA, 14 nt, Homo sapiens
gggcccagagccca

SEQ ID NO: 1332170 - RNA, 22 nt, Homo sapiens
gggccccgccagggcuggggac

SEQ ID NO: 1332171 - RNA, 15 nt, Homo sapiens
gggccggaaggaaug

SEQ ID NO: 1332172 - RNA, 19 nt, Homo sapiens
gggccuccagggcccaggu

SEQ ID NO: 1332173 - RNA, 19 nt, Homo sapiens
gggccuuucccucuucccu

SEQ ID NO: 1332174 - RNA, 17 nt, Homo sapiens
gggcgugggcgcuugca

SEQ ID NO: 1332175 - RNA, 16 nt, Homo sapiens
gggcuaccaggaagaa

SEQ ID NO: 1332176 - RNA, 23 nt, Homo sapiens
gggcuagagaaaucagcugcuau

SEQ ID NO: 1332177 - RNA, 19 nt, Homo sapiens
gggcucagcagccagagga

SEQ ID NO: 1332178 - RNA, 17 nt, Homo sapiens
gggcucagggcaguggc

SEQ ID NO: 1332179 - RNA, 14 nt, Homo sapiens
gggcucucucauga

SEQ ID NO: 1332180 - RNA, 19 nt, Homo sapiens
gggcucucucaugauagaa

SEQ ID NO: 1332181 - RNA, 15 nt, Homo sapiens
gggcugcccuggugc

SEQ ID NO: 1332182 - RNA, 14 nt, Homo sapiens
gggcuggcacguga

SEQ ID NO: 1332183 - RNA, 17 nt, Homo sapiens
gggcuggcacgugacag

SEQ ID NO: 1332184 - RNA, 22 nt, Homo sapiens
ggggacagcuuccucacacccc

SEQ ID NO: 1332185 - RNA, 21 nt, Homo sapiens
ggggacccaucuuccaccuca

SEQ ID NO: 1332186 - RNA, 15 nt, Homo sapiens
ggggagaaacccaga

SEQ ID NO: 1332187 - RNA, 18 nt, Homo sapiens
ggggaggagccucuggcu

SEQ ID NO: 1332188 - RNA, 14 nt, Homo sapiens
ggggaucccucccc

SEQ ID NO: 1332189 - RNA, 15 nt, Homo sapiens
ggggaugucucucau

SEQ ID NO: 1332190 - RNA, 13 nt, Homo sapiens
ggggccacuuuca

SEQ ID NO: 1332191 - RNA, 17 nt, Homo sapiens
ggggugccgcuuucucu

SEQ ID NO: 1332192 - RNA, 11 nt, Homo sapiens
gggguggcacc

SEQ ID NO: 1332193 - RNA, 15 nt, Homo sapiens
ggguaccuggcuaug

SEQ ID NO: 1332194 - RNA, 22 nt, Homo sapiens
ggguacuucuugaaggugcuga

SEQ ID NO: 1332195 - RNA, 22 nt, Homo sapiens
gggucccugcaaaacuccaggc

SEQ ID NO: 1332196 - RNA, 18 nt, Homo sapiens
gggucuccgaaaugcugu

SEQ ID NO: 1332197 - RNA, 18 nt, Homo sapiens
gggucugggccagugcac

SEQ ID NO: 1332198 - RNA, 10 nt, Homo sapiens
gggucugugu

SEQ ID NO: 1332199 - RNA, 20 nt, Homo sapiens
gggucuugcuauauugccca

SEQ ID NO: 1332200 - RNA, 11 nt, Homo sapiens
gggucuuggcc

SEQ ID NO: 1332201 - RNA, 14 nt, Homo sapiens
gggugccccacuaa

SEQ ID NO: 1332202 - RNA, 14 nt, Homo sapiens
gggugccgcugucu

SEQ ID NO: 1332203 - RNA, 18 nt, Homo sapiens
gggugccgcugucucuga

SEQ ID NO: 1332204 - RNA, 22 nt, Homo sapiens
gggugccgcugucucugagggg

SEQ ID NO: 1332205 - RNA, 22 nt, Homo sapiens
gggugccgcuuucucugagggg

SEQ ID NO: 1332206 - RNA, 18 nt, Homo sapiens
ggguggcacucagucucu

SEQ ID NO: 1332207 - RNA, 13 nt, Homo sapiens
gguaaacaaagac

SEQ ID NO: 1332208 - RNA, 14 nt, Homo sapiens
gguaaauguuaccu

SEQ ID NO: 1332209 - RNA, 18 nt, Homo sapiens
gguaaauuuuuaggcaaa

SEQ ID NO: 1332210 - RNA, 21 nt, Homo sapiens
gguaaccccagauucaugcac

SEQ ID NO: 1332211 - RNA, 22 nt, Homo sapiens
gguaaggcuggugagguccugg

SEQ ID NO: 1332212 - RNA, 21 nt, Homo sapiens
gguaaggugugaaccuaccug

SEQ ID NO: 1332213 - RNA, 21 nt, Homo sapiens
gguaauauugacuuguauauu

SEQ ID NO: 1332214 - RNA, 11 nt, Homo sapiens
gguacacuggu

SEQ ID NO: 1332215 - RNA, 14 nt, Homo sapiens
gguagaaguggcau

SEQ ID NO: 1332216 - RNA, 14 nt, Homo sapiens
gguagguugggaga

SEQ ID NO: 1332217 - RNA, 19 nt, Homo sapiens
ggucaaacaaacucucuga

SEQ ID NO: 1332218 - RNA, 17 nt, Homo sapiens
ggucacuuaagaaguaa

SEQ ID NO: 1332219 - RNA, 12 nt, Homo sapiens
ggucaugcccuc

SEQ ID NO: 1332220 - RNA, 15 nt, Homo sapiens
gguccauucucugag

SEQ ID NO: 1332221 - RNA, 22 nt, Homo sapiens
ggucccugcaaaacuccaggca

SEQ ID NO: 1332222 - RNA, 13 nt, Homo sapiens
gguccuacccauc

SEQ ID NO: 1332223 - RNA, 20 nt, Homo sapiens
gguccuucccucucaugacu

SEQ ID NO: 1332224 - RNA, 12 nt, Homo sapiens
gguccuugcccu

SEQ ID NO: 1332225 - RNA, 22 nt, Homo sapiens
ggucuaagcaccuuggugcuua

SEQ ID NO: 1332226 - RNA, 19 nt, Homo sapiens
ggucucauucauccuuaug

SEQ ID NO: 1332227 - RNA, 20 nt, Homo sapiens
ggucucgaacuccugaccuc

SEQ ID NO: 1332228 - RNA, 19 nt, Homo sapiens
ggucugggcaccaccucug

SEQ ID NO: 1332229 - RNA, 19 nt, Homo sapiens
ggucuguggugcagugugu

SEQ ID NO: 1332230 - RNA, 15 nt, Homo sapiens
ggucuguuggggucu

SEQ ID NO: 1332231 - RNA, 21 nt, Homo sapiens
ggucuuagcucuuucucuauu

SEQ ID NO: 1332232 - RNA, 19 nt, Homo sapiens
ggucuucgcagccuagaua

SEQ ID NO: 1332233 - RNA, 16 nt, Homo sapiens
ggugacauugcaccug

SEQ ID NO: 1332234 - RNA, 16 nt, Homo sapiens
ggugaccucacuuuag

SEQ ID NO: 1332235 - RNA, 14 nt, Homo sapiens
ggugagaaagggau

SEQ ID NO: 1332236 - RNA, 15 nt, Homo sapiens
ggugauagguaaauu

SEQ ID NO: 1332237 - RNA, 19 nt, Homo sapiens
ggugcaugggcucgccgug

SEQ ID NO: 1332238 - RNA, 18 nt, Homo sapiens
ggugccgcucucucugag

SEQ ID NO: 1332239 - RNA, 17 nt, Homo sapiens
ggugccgcugucucuga

SEQ ID NO: 1332240 - RNA, 14 nt, Homo sapiens
ggugcuagauccag

SEQ ID NO: 1332241 - RNA, 18 nt, Homo sapiens
gguggcagcuugugaaga

SEQ ID NO: 1332242 - RNA, 15 nt, Homo sapiens
gguggcaggugagca

SEQ ID NO: 1332243 - RNA, 23 nt, Homo sapiens
ggugggcggcacagccuucucca

SEQ ID NO: 1332244 - RNA, 20 nt, Homo sapiens
gguggggguaaggugcaucu

SEQ ID NO: 1332245 - RNA, 15 nt, Homo sapiens
ggugggggugccgcu

SEQ ID NO: 1332246 - RNA, 16 nt, Homo sapiens
ggugggggugcucucu

SEQ ID NO: 1332247 - RNA, 20 nt, Homo sapiens
gguguauccuggcccugggg

SEQ ID NO: 1332248 - RNA, 12 nt, Homo sapiens
ggugugcuguau

SEQ ID NO: 1332249 - RNA, 15 nt, Homo sapiens
gguuaagacaaaggg

SEQ ID NO: 1332250 - RNA, 17 nt, Homo sapiens
gguuacauaucaaaaca

SEQ ID NO: 1332251 - RNA, 22 nt, Homo sapiens
gguuacauaucaaaacauccca

SEQ ID NO: 1332252 - RNA, 12 nt, Homo sapiens
gguucaagugac

SEQ ID NO: 1332253 - RNA, 13 nt, Homo sapiens
gguucaagugauu

SEQ ID NO: 1332254 - RNA, 19 nt, Homo sapiens
gguucagcuaagcuaggaa

SEQ ID NO: 1332255 - RNA, 12 nt, Homo sapiens
gguucucuccac

SEQ ID NO: 1332256 - RNA, 14 nt, Homo sapiens
gguucugaggccag

SEQ ID NO: 1332257 - RNA, 13 nt, Homo sapiens
gguucuguuccug

SEQ ID NO: 1332258 - RNA, 15 nt, Homo sapiens
gguuggagugcucuu

SEQ ID NO: 1332259 - RNA, 19 nt, Homo sapiens
guaaaaacaaaaacacacc

SEQ ID NO: 1332260 - RNA, 14 nt, Homo sapiens
guaaaacauuuuua

SEQ ID NO: 1332261 - RNA, 15 nt, Homo sapiens
guaaaagucuaccug

SEQ ID NO: 1332262 - RNA, 22 nt, Homo sapiens
guaaaccuugaagggcuuuauu

SEQ ID NO: 1332263 - RNA, 10 nt, Homo sapiens
guaaacugua

SEQ ID NO: 1332264 - RNA, 12 nt, Homo sapiens
guaaacuuccaa

SEQ ID NO: 1332265 - RNA, 20 nt, Homo sapiens
guaaagauccuauagcucuu

SEQ ID NO: 1332266 - RNA, 22 nt, Homo sapiens
guaaaguuugcucuaccaaaua

SEQ ID NO: 1332267 - RNA, 18 nt, Homo sapiens
guaaauccaccaccaaaa

SEQ ID NO: 1332268 - RNA, 18 nt, Homo sapiens
guaaauccuagacuugaa

SEQ ID NO: 1332269 - RNA, 22 nt, Homo sapiens
guaaaugaaacuuaagaauuga

SEQ ID NO: 1332270 - RNA, 15 nt, Homo sapiens
guaaauuuuuaggca

SEQ ID NO: 1332271 - RNA, 22 nt, Homo sapiens
guaacaggcuugaaucaaagaa

SEQ ID NO: 1332272 - RNA, 21 nt, Homo sapiens
guaacaggguagugugguauu

SEQ ID NO: 1332273 - RNA, 14 nt, Homo sapiens
guaacaguuugaua

SEQ ID NO: 1332274 - RNA, 16 nt, Homo sapiens
guaacaguuugauauu

SEQ ID NO: 1332275 - RNA, 17 nt, Homo sapiens
guaacccuggcacuuaa

SEQ ID NO: 1332276 - RNA, 14 nt, Homo sapiens
guaacgauguugua

SEQ ID NO: 1332277 - RNA, 15 nt, Homo sapiens
guaagugaacuacca

SEQ ID NO: 1332278 - RNA, 14 nt, Homo sapiens
guaaguucuguggu

SEQ ID NO: 1332279 - RNA, 17 nt, Homo sapiens
guaauaaaaagccucuu

SEQ ID NO: 1332280 - RNA, 15 nt, Homo sapiens
guaauaaacucucua

SEQ ID NO: 1332281 - RNA, 16 nt, Homo sapiens
guaauaaacucucuag

SEQ ID NO: 1332282 - RNA, 18 nt, Homo sapiens
guaauccuagcacuuugg

SEQ ID NO: 1332283 - RNA, 15 nt, Homo sapiens
guaauuguaauucca

SEQ ID NO: 1332284 - RNA, 16 nt, Homo sapiens
guaauuucaaaauaca

SEQ ID NO: 1332285 - RNA, 20 nt, Homo sapiens
guacaaacucagauccuugg

SEQ ID NO: 1332286 - RNA, 19 nt, Homo sapiens
guacacacugguacuuaga

SEQ ID NO: 1332287 - RNA, 16 nt, Homo sapiens
guacacugguauuuau

SEQ ID NO: 1332288 - RNA, 12 nt, Homo sapiens
guacagacacuc

SEQ ID NO: 1332289 - RNA, 13 nt, Homo sapiens
guacagacacucc

SEQ ID NO: 1332290 - RNA, 11 nt, Homo sapiens
guaccaguuaa

SEQ ID NO: 1332291 - RNA, 22 nt, Homo sapiens
guaccccuaaaaagauugccaa

SEQ ID NO: 1332292 - RNA, 13 nt, Homo sapiens
guacucugugaaa

SEQ ID NO: 1332293 - RNA, 13 nt, Homo sapiens
guacugccuuaaa

SEQ ID NO: 1332294 - RNA, 21 nt, Homo sapiens
guagaaaauaaaacugagcua

SEQ ID NO: 1332295 - RNA, 20 nt, Homo sapiens
guagaauagugguugccaau

SEQ ID NO: 1332296 - RNA, 20 nt, Homo sapiens
guagaccucuuuuucuuacc

SEQ ID NO: 1332297 - RNA, 19 nt, Homo sapiens
guagaggcugggggcucca

SEQ ID NO: 1332298 - RNA, 23 nt, Homo sapiens
guagagguuuuuuuccuccuugu

SEQ ID NO: 1332299 - RNA, 14 nt, Homo sapiens
guagauaacacuga

SEQ ID NO: 1332300 - RNA, 12 nt, Homo sapiens
guagccagguac

SEQ ID NO: 1332301 - RNA, 16 nt, Homo sapiens
guagcucuccugacuu

SEQ ID NO: 1332302 - RNA, 12 nt, Homo sapiens
guagcucugcug

SEQ ID NO: 1332303 - RNA, 16 nt, Homo sapiens
guagcucugcugcuga

SEQ ID NO: 1332304 - RNA, 12 nt, Homo sapiens
guagcugggauu

SEQ ID NO: 1332305 - RNA, 13 nt, Homo sapiens
guaggaauuuucu

SEQ ID NO: 1332306 - RNA, 22 nt, Homo sapiens
guaggugggggaacacugagaa

SEQ ID NO: 1332307 - RNA, 15 nt, Homo sapiens
guagugcaccaucuc

SEQ ID NO: 1332308 - RNA, 21 nt, Homo sapiens
guagugcaccaucucacugca

SEQ ID NO: 1332309 - RNA, 15 nt, Homo sapiens
guaguuauaaaccaa

SEQ ID NO: 1332310 - RNA, 13 nt, Homo sapiens
guauaacaugucg

SEQ ID NO: 1332311 - RNA, 17 nt, Homo sapiens
guauaagguggucauaa

SEQ ID NO: 1332312 - RNA, 19 nt, Homo sapiens
guauaaugcaguacauuaa

SEQ ID NO: 1332313 - RNA, 16 nt, Homo sapiens
guauacuauaguacca

SEQ ID NO: 1332314 - RNA, 18 nt, Homo sapiens
guauaucuucuacaugca

SEQ ID NO: 1332315 - RNA, 11 nt, Homo sapiens
guauccuucag

SEQ ID NO: 1332316 - RNA, 17 nt, Homo sapiens
guaucucaguaccccau

SEQ ID NO: 1332317 - RNA, 15 nt, Homo sapiens
guaucuggcuucccu

SEQ ID NO: 1332318 - RNA, 15 nt, Homo sapiens
guauggaaacacuga

SEQ ID NO: 1332319 - RNA, 16 nt, Homo sapiens
guauuagggcauuugu

SEQ ID NO: 1332320 - RNA, 22 nt, Homo sapiens
guauuauccacaauuauuggca

SEQ ID NO: 1332321 - RNA, 17 nt, Homo sapiens
guauuucaagucucuca

SEQ ID NO: 1332322 - RNA, 14 nt, Homo sapiens
gucaaaacuacuga

SEQ ID NO: 1332323 - RNA, 18 nt, Homo sapiens
gucaaagaagucauucuu

SEQ ID NO: 1332324 - RNA, 22 nt, Homo sapiens
gucaacauccauaacucuguau

SEQ ID NO: 1332325 - RNA, 17 nt, Homo sapiens
gucacacucuucaguga

SEQ ID NO: 1332326 - RNA, 17 nt, Homo sapiens
gucacagguuaaugugg

SEQ ID NO: 1332327 - RNA, 18 nt, Homo sapiens
gucacagguuaauguggu

SEQ ID NO: 1332328 - RNA, 12 nt, Homo sapiens
gucaccagagac

SEQ ID NO: 1332329 - RNA, 14 nt, Homo sapiens
gucacccacagacc

SEQ ID NO: 1332330 - RNA, 21 nt, Homo sapiens
gucaccccucacugugacuga

SEQ ID NO: 1332331 - RNA, 18 nt, Homo sapiens
gucacguuuggugcuucu

SEQ ID NO: 1332332 - RNA, 16 nt, Homo sapiens
gucacugacaguuaau

SEQ ID NO: 1332333 - RNA, 23 nt, Homo sapiens
gucagaucuauuguuuguugcac

SEQ ID NO: 1332334 - RNA, 15 nt, Homo sapiens
gucagcauccagguu

SEQ ID NO: 1332335 - RNA, 18 nt, Homo sapiens
gucagcauguacuccccu

SEQ ID NO: 1332336 - RNA, 18 nt, Homo sapiens
gucagggaaggugccucu

SEQ ID NO: 1332337 - RNA, 15 nt, Homo sapiens
gucaguauguggaag

SEQ ID NO: 1332338 - RNA, 20 nt, Homo sapiens
gucaguuccccuguuugccu

SEQ ID NO: 1332339 - RNA, 14 nt, Homo sapiens
gucaucuaccugag

SEQ ID NO: 1332340 - RNA, 15 nt, Homo sapiens
gucaugaagugcaca

SEQ ID NO: 1332341 - RNA, 12 nt, Homo sapiens
gucauggaagag

SEQ ID NO: 1332342 - RNA, 16 nt, Homo sapiens
gucauuauuuuuguua

SEQ ID NO: 1332343 - RNA, 21 nt, Homo sapiens
gucauuauuuuuguuagcaaa

SEQ ID NO: 1332344 - RNA, 23 nt, Homo sapiens
gucauucgcuacuaugauuuaau

SEQ ID NO: 1332345 - RNA, 19 nt, Homo sapiens
gucauuucaaagacucuca

SEQ ID NO: 1332346 - RNA, 22 nt, Homo sapiens
gucauuuuuauaaaacuuugaa

SEQ ID NO: 1332347 - RNA, 13 nt, Homo sapiens
guccaaaacugcc

SEQ ID NO: 1332348 - RNA, 19 nt, Homo sapiens
guccaaacccacucaugac

SEQ ID NO: 1332349 - RNA, 18 nt, Homo sapiens
guccacagggcagccuga

SEQ ID NO: 1332350 - RNA, 12 nt, Homo sapiens
guccacucccag

SEQ ID NO: 1332351 - RNA, 15 nt, Homo sapiens
guccaguugcagcug

SEQ ID NO: 1332352 - RNA, 13 nt, Homo sapiens
gucccacacugug

SEQ ID NO: 1332353 - RNA, 16 nt, Homo sapiens
gucccagagaccucau

SEQ ID NO: 1332354 - RNA, 14 nt, Homo sapiens
gucccauuccucag

SEQ ID NO: 1332355 - RNA, 17 nt, Homo sapiens
guccccacgaacuggcc

SEQ ID NO: 1332356 - RNA, 18 nt, Homo sapiens
guccccuccccucucagc

SEQ ID NO: 1332357 - RNA, 13 nt, Homo sapiens
gucccucuguaua

SEQ ID NO: 1332358 - RNA, 15 nt, Homo sapiens
gucccuggacacagc

SEQ ID NO: 1332359 - RNA, 13 nt, Homo sapiens
guccuauguauau

SEQ ID NO: 1332360 - RNA, 16 nt, Homo sapiens
guccuauuauauucau

SEQ ID NO: 1332361 - RNA, 16 nt, Homo sapiens
guccucaguccacugc

SEQ ID NO: 1332362 - RNA, 12 nt, Homo sapiens
guccucucugag

SEQ ID NO: 1332363 - RNA, 22 nt, Homo sapiens
guccucugccugggcucuggaa

SEQ ID NO: 1332364 - RNA, 22 nt, Homo sapiens
guccugaauguuucagaccaca

SEQ ID NO: 1332365 - RNA, 21 nt, Homo sapiens
guccugagcaccacacccagu

SEQ ID NO: 1332366 - RNA, 20 nt, Homo sapiens
guccugaugcuuuugucuaa

SEQ ID NO: 1332367 - RNA, 22 nt, Homo sapiens
guccugggcauggguccagggc

SEQ ID NO: 1332368 - RNA, 16 nt, Homo sapiens
guccuguccugcucau

SEQ ID NO: 1332369 - RNA, 22 nt, Homo sapiens
guccuuucccaccauuccugcc

SEQ ID NO: 1332370 - RNA, 21 nt, Homo sapiens
guccuuuugacacugcucuaa

SEQ ID NO: 1332371 - RNA, 16 nt, Homo sapiens
gucgacuucaugacaa

SEQ ID NO: 1332372 - RNA, 16 nt, Homo sapiens
gucuaaauuuucuaaa

SEQ ID NO: 1332373 - RNA, 21 nt, Homo sapiens
gucuaacucaaagacuuccuc

SEQ ID NO: 1332374 - RNA, 15 nt, Homo sapiens
gucuauggcacuaau

SEQ ID NO: 1332375 - RNA, 23 nt, Homo sapiens
gucucagaaacugcgaggccagu

SEQ ID NO: 1332376 - RNA, 10 nt, Homo sapiens
gucucaggcc

SEQ ID NO: 1332377 - RNA, 15 nt, Homo sapiens
gucucgaacuccuga

SEQ ID NO: 1332378 - RNA, 21 nt, Homo sapiens
gucucgaacuccugaccucaa

SEQ ID NO: 1332379 - RNA, 21 nt, Homo sapiens
gucucuaaugucugcagcuca

SEQ ID NO: 1332380 - RNA, 14 nt, Homo sapiens
gucucuacccagua

SEQ ID NO: 1332381 - RNA, 18 nt, Homo sapiens
gucucuacccaguagaug

SEQ ID NO: 1332382 - RNA, 21 nt, Homo sapiens
gucugaguaagcccucaggag

SEQ ID NO: 1332383 - RNA, 15 nt, Homo sapiens
gucugagucuugggu

SEQ ID NO: 1332384 - RNA, 19 nt, Homo sapiens
gucugccacaccucuccaa

SEQ ID NO: 1332385 - RNA, 15 nt, Homo sapiens
gucugccuucugcug

SEQ ID NO: 1332386 - RNA, 17 nt, Homo sapiens
gucugggccacucaggg

SEQ ID NO: 1332387 - RNA, 15 nt, Homo sapiens
gucugggcucagaca

SEQ ID NO: 1332388 - RNA, 15 nt, Homo sapiens
gucuguggcuuucag

SEQ ID NO: 1332389 - RNA, 20 nt, Homo sapiens
gucuguguucgacucagccu

SEQ ID NO: 1332390 - RNA, 21 nt, Homo sapiens
gucuuaccagugacgcugcug

SEQ ID NO: 1332391 - RNA, 15 nt, Homo sapiens
gucuuaucaacuggu

SEQ ID NO: 1332392 - RNA, 21 nt, Homo sapiens
gucuucgcagccuagauauga

SEQ ID NO: 1332393 - RNA, 18 nt, Homo sapiens
gucuucuuucuccaugga

SEQ ID NO: 1332394 - RNA, 12 nt, Homo sapiens
gucuugaacucc

SEQ ID NO: 1332395 - RNA, 14 nt, Homo sapiens
gucuugcauuuaaa

SEQ ID NO: 1332396 - RNA, 23 nt, Homo sapiens
gucuugccuugcugaacucccuc

SEQ ID NO: 1332397 - RNA, 22 nt, Homo sapiens
gucuuggcucacugcaacuucu

SEQ ID NO: 1332398 - RNA, 18 nt, Homo sapiens
gucuuggggccacuuuca

SEQ ID NO: 1332399 - RNA, 16 nt, Homo sapiens
gucuuuguucugugau

SEQ ID NO: 1332400 - RNA, 21 nt, Homo sapiens
gucuuuucaaaauauuacuca

SEQ ID NO: 1332401 - RNA, 16 nt, Homo sapiens
gucuuuucuuugccau

SEQ ID NO: 1332402 - RNA, 15 nt, Homo sapiens
gugaaagaggcagcu

SEQ ID NO: 1332403 - RNA, 14 nt, Homo sapiens
gugaaagcuuucau

SEQ ID NO: 1332404 - RNA, 15 nt, Homo sapiens
gugaaagcuuucaug

SEQ ID NO: 1332405 - RNA, 21 nt, Homo sapiens
gugaaaugcuuuuauauucua

SEQ ID NO: 1332406 - RNA, 22 nt, Homo sapiens
uauaggcuucucacggcgacca

SEQ ID NO: 1332407 - RNA, 14 nt, Homo sapiens
uauaguacaugaua

SEQ ID NO: 1332408 - RNA, 21 nt, Homo sapiens
uauagugacccacccuagauc

SEQ ID NO: 1332409 - RNA, 11 nt, Homo sapiens
uauauaaacua

SEQ ID NO: 1332410 - RNA, 12 nt, Homo sapiens
uauauaaaguca

SEQ ID NO: 1332411 - RNA, 12 nt, Homo sapiens
uauauaaccaau

SEQ ID NO: 1332412 - RNA, 16 nt, Homo sapiens
uauauaagacuauucc

SEQ ID NO: 1332413 - RNA, 12 nt, Homo sapiens
uauauauugaau

SEQ ID NO: 1332414 - RNA, 15 nt, Homo sapiens
uauaucuaccccaga

SEQ ID NO: 1332415 - RNA, 22 nt, Homo sapiens
uauaucucccccacuccacuac

SEQ ID NO: 1332416 - RNA, 14 nt, Homo sapiens
uauaucuucuacau

SEQ ID NO: 1332417 - RNA, 13 nt, Homo sapiens
uauauguaccgua

SEQ ID NO: 1332418 - RNA, 11 nt, Homo sapiens
uauauguauuu

SEQ ID NO: 1332419 - RNA, 21 nt, Homo sapiens
uauauuccaccaggauauccu

SEQ ID NO: 1332420 - RNA, 18 nt, Homo sapiens
uauauuguaaagauccua

SEQ ID NO: 1332421 - RNA, 15 nt, Homo sapiens
uauauuucaucauga

SEQ ID NO: 1332422 - RNA, 22 nt, Homo sapiens
uaucaaaauagucuaaggccau

SEQ ID NO: 1332423 - RNA, 23 nt, Homo sapiens
uaucaaaugaaagugaugauacu

SEQ ID NO: 1332424 - RNA, 18 nt, Homo sapiens
uaucaaauguaacuuacu

SEQ ID NO: 1332425 - RNA, 16 nt, Homo sapiens
uaucaaguguauuuga

SEQ ID NO: 1332426 - RNA, 21 nt, Homo sapiens
uaucaauguucuaguucugug

SEQ ID NO: 1332427 - RNA, 20 nt, Homo sapiens
uaucacuguugcauauacca

SEQ ID NO: 1332428 - RNA, 13 nt, Homo sapiens
uaucagugugcaa

SEQ ID NO: 1332429 - RNA, 19 nt, Homo sapiens
uaucaucugcuaaguaauu

SEQ ID NO: 1332430 - RNA, 15 nt, Homo sapiens
uauccaaucugugau

SEQ ID NO: 1332431 - RNA, 16 nt, Homo sapiens
uauccaaucugugaug

SEQ ID NO: 1332432 - RNA, 19 nt, Homo sapiens
uauccaaucugugaugaca

SEQ ID NO: 1332433 - RNA, 18 nt, Homo sapiens
uauccacuacauucugaa

SEQ ID NO: 1332434 - RNA, 16 nt, Homo sapiens
uauccccccaaaugga

SEQ ID NO: 1332435 - RNA, 13 nt, Homo sapiens
uaucccucucuuc

SEQ ID NO: 1332436 - RNA, 17 nt, Homo sapiens
uauccuagucauucuuc

SEQ ID NO: 1332437 - RNA, 19 nt, Homo sapiens
uauccuagucauucuuccc

SEQ ID NO: 1332438 - RNA, 13 nt, Homo sapiens
uauccucuugcca

SEQ ID NO: 1332439 - RNA, 14 nt, Homo sapiens
uauccucuugccaa

SEQ ID NO: 1332440 - RNA, 19 nt, Homo sapiens
uauccugggagcacugcgu

SEQ ID NO: 1332441 - RNA, 15 nt, Homo sapiens
uauccuuacauuuca

SEQ ID NO: 1332442 - RNA, 12 nt, Homo sapiens
uaucuacugugg

SEQ ID NO: 1332443 - RNA, 20 nt, Homo sapiens
uaucuauagcuaaguacaca

SEQ ID NO: 1332444 - RNA, 22 nt, Homo sapiens
uaucugcagggacagagcauug

SEQ ID NO: 1332445 - RNA, 15 nt, Homo sapiens
uaucugcgugcacuu

SEQ ID NO: 1332446 - RNA, 14 nt, Homo sapiens
uaucugugaacuga

SEQ ID NO: 1332447 - RNA, 13 nt, Homo sapiens
uaucuguucuguu

SEQ ID NO: 1332448 - RNA, 15 nt, Homo sapiens
uaucuucuacaugca

SEQ ID NO: 1332449 - RNA, 22 nt, Homo sapiens
uaucuuuguguugcagccucaa

SEQ ID NO: 1332450 - RNA, 20 nt, Homo sapiens
uaugaaaauauagacauucu

SEQ ID NO: 1332451 - RNA, 16 nt, Homo sapiens
uaugaagaaucugcuc

SEQ ID NO: 1332452 - RNA, 21 nt, Homo sapiens
uaugaaugacaguagucacac

SEQ ID NO: 1332453 - RNA, 16 nt, Homo sapiens
uaugacaucacuugua

SEQ ID NO: 1332454 - RNA, 23 nt, Homo sapiens
uaugaccucgcccuccacaaaug

SEQ ID NO: 1332455 - RNA, 23 nt, Homo sapiens
uaugagcuggggaugucucucau

SEQ ID NO: 1332456 - RNA, 15 nt, Homo sapiens
uaugaggcuguuguc

SEQ ID NO: 1332457 - RNA, 24 nt, Homo sapiens
uaugaggggguuuggcaccaagcu

SEQ ID NO: 1332458 - RNA, 22 nt, Homo sapiens
uaugauaugcauguagcauaua

SEQ ID NO: 1332459 - RNA, 17 nt, Homo sapiens
uaugcaaaccaggauuu

SEQ ID NO: 1332460 - RNA, 18 nt, Homo sapiens
uaugcaaauacaaucagc

SEQ ID NO: 1332461 - RNA, 15 nt, Homo sapiens
uaugcauaccuggau

SEQ ID NO: 1332462 - RNA, 17 nt, Homo sapiens
uaugccaauaaaguuug

SEQ ID NO: 1332463 - RNA, 16 nt, Homo sapiens
uaugccuugaacuuau

SEQ ID NO: 1332464 - RNA, 13 nt, Homo sapiens
uaugcuguuuccu

SEQ ID NO: 1332465 - RNA, 19 nt, Homo sapiens
uauggcuucacauucauug

SEQ ID NO: 1332466 - RNA, 20 nt, Homo sapiens
uaugggggcacugaggacca

SEQ ID NO: 1332467 - RNA, 15 nt, Homo sapiens
uauguaccauaugau

SEQ ID NO: 1332468 - RNA, 14 nt, Homo sapiens
uauguacugccuua

SEQ ID NO: 1332469 - RNA, 15 nt, Homo sapiens
uauguacugccuuag

SEQ ID NO: 1332470 - RNA, 13 nt, Homo sapiens
uauguagcugucg

SEQ ID NO: 1332471 - RNA, 23 nt, Homo sapiens
uauguggaagugugggucugugu

SEQ ID NO: 1332472 - RNA, 16 nt, Homo sapiens
uaugugggggucugug

SEQ ID NO: 1332473 - RNA, 15 nt, Homo sapiens
uauguuagcauuaaa

SEQ ID NO: 1332474 - RNA, 23 nt, Homo sapiens
uauuaaauugggaaaacuccauc

SEQ ID NO: 1332475 - RNA, 15 nt, Homo sapiens
uauuaagacuggcuu

SEQ ID NO: 1332476 - RNA, 12 nt, Homo sapiens
uauuaagauaug

SEQ ID NO: 1332477 - RNA, 20 nt, Homo sapiens
uauuaaggccuuuuccacac

SEQ ID NO: 1332478 - RNA, 23 nt, Homo sapiens
uauuaaguaacuuauuuaugaaa

SEQ ID NO: 1332479 - RNA, 21 nt, Homo sapiens
uauuaagucauuguuucccau

SEQ ID NO: 1332480 - RNA, 23 nt, Homo sapiens
uauuaaucaagagaaacuucaaa

SEQ ID NO: 1332481 - RNA, 18 nt, Homo sapiens
uauuacacauuuauguaa

SEQ ID NO: 1332482 - RNA, 22 nt, Homo sapiens
uauuacuuauuuuugacagugu

SEQ ID NO: 1332483 - RNA, 13 nt, Homo sapiens
uauucaguucuua

SEQ ID NO: 1332484 - RNA, 16 nt, Homo sapiens
uauuccacuauuugca

SEQ ID NO: 1332485 - RNA, 18 nt, Homo sapiens
uauuccuuugcauauuau

SEQ ID NO: 1332486 - RNA, 16 nt, Homo sapiens
uauucugaaaaagaca

SEQ ID NO: 1332487 - RNA, 22 nt, Homo sapiens
uauucuuggcaagaaugcuuua

SEQ ID NO: 1332488 - RNA, 20 nt, Homo sapiens
uauugauguuuucacaaaga

SEQ ID NO: 1332489 - RNA, 14 nt, Homo sapiens
uauugcccuaauua

SEQ ID NO: 1332490 - RNA, 19 nt, Homo sapiens
uauugcuuaccugaucuca

SEQ ID NO: 1332491 - RNA, 13 nt, Homo sapiens
uauuggacagucu

SEQ ID NO: 1332492 - RNA, 14 nt, Homo sapiens
uauuggcagcucua

SEQ ID NO: 1332493 - RNA, 15 nt, Homo sapiens
uauugggacucguau

SEQ ID NO: 1332494 - RNA, 13 nt, Homo sapiens
uauugguguugca

SEQ ID NO: 1332495 - RNA, 15 nt, Homo sapiens
uauuguuaguucuca

SEQ ID NO: 1332496 - RNA, 15 nt, Homo sapiens
uauuguucucacuua

SEQ ID NO: 1332497 - RNA, 13 nt, Homo sapiens
uauuuaauuuuga

SEQ ID NO: 1332498 - RNA, 12 nt, Homo sapiens
uauuuacagcug

SEQ ID NO: 1332499 - RNA, 20 nt, Homo sapiens
uauuuacucuauaaccaaau

SEQ ID NO: 1332500 - RNA, 17 nt, Homo sapiens
uauuuaggcaugagcuc

SEQ ID NO: 1332501 - RNA, 22 nt, Homo sapiens
uauuuagguuaacaauauuaau

SEQ ID NO: 1332502 - RNA, 17 nt, Homo sapiens
uauuuaucaaguguauu

SEQ ID NO: 1332503 - RNA, 22 nt, Homo sapiens
uauuuauugaaaugauuucaca

SEQ ID NO: 1332504 - RNA, 20 nt, Homo sapiens
uauuucaucaugauaauuca

SEQ ID NO: 1332505 - RNA, 16 nt, Homo sapiens
uauuucuguaccaaag

SEQ ID NO: 1332506 - RNA, 13 nt, Homo sapiens
uauuugaggucag

SEQ ID NO: 1332507 - RNA, 19 nt, Homo sapiens
uauuugccuccagugcagu

SEQ ID NO: 1332508 - RNA, 19 nt, Homo sapiens
uauuugcuuaaaauuguga

SEQ ID NO: 1332509 - RNA, 14 nt, Homo sapiens
uauuuguaucacaa

SEQ ID NO: 1332510 - RNA, 17 nt, Homo sapiens
uauuuuaauuacugcua

SEQ ID NO: 1332511 - RNA, 13 nt, Homo sapiens
uauuuuaggucaa

SEQ ID NO: 1332512 - RNA, 14 nt, Homo sapiens
uauuuucagugcau

SEQ ID NO: 1332513 - RNA, 17 nt, Homo sapiens
uauuuucucauugcucu

SEQ ID NO: 1332514 - RNA, 17 nt, Homo sapiens
uauuuuguaauaaacuc

SEQ ID NO: 1332515 - RNA, 20 nt, Homo sapiens
uauuuuuauaauaaacauaa

SEQ ID NO: 1332516 - RNA, 14 nt, Homo sapiens
uauuuuucucauga

SEQ ID NO: 1332517 - RNA, 14 nt, Homo sapiens
uauuuuucuuuaac

SEQ ID NO: 1332518 - RNA, 13 nt, Homo sapiens
ucaaaaacauucu

SEQ ID NO: 1332519 - RNA, 12 nt, Homo sapiens
ucaaaaagccac

SEQ ID NO: 1332520 - RNA, 20 nt, Homo sapiens
ucaaaauagucuaaggccau

SEQ ID NO: 1332521 - RNA, 17 nt, Homo sapiens
ucaaacaaacucucuga

SEQ ID NO: 1332522 - RNA, 15 nt, Homo sapiens
ucaaacaacauucca

SEQ ID NO: 1332523 - RNA, 22 nt, Homo sapiens
ucaaaccauuuuuaaaauguga

SEQ ID NO: 1332524 - RNA, 16 nt, Homo sapiens
ucaaacugcacaucua

SEQ ID NO: 1332525 - RNA, 17 nt, Homo sapiens
ucaaagccacacucugg

SEQ ID NO: 1332526 - RNA, 16 nt, Homo sapiens
ucaaagucauuaaaga

SEQ ID NO: 1332527 - RNA, 12 nt, Homo sapiens
ucaaaguucucu

SEQ ID NO: 1332528 - RNA, 15 nt, Homo sapiens
ucaaauaccacauga

SEQ ID NO: 1332529 - RNA, 19 nt, Homo sapiens
ucaaauauauuauuuaguc

SEQ ID NO: 1332530 - RNA, 21 nt, Homo sapiens
ucaaauaugcaaagcacugac

SEQ ID NO: 1332531 - RNA, 13 nt, Homo sapiens
ucaaauccagugg

SEQ ID NO: 1332532 - RNA, 18 nt, Homo sapiens
ucaaauguucuccaguca

SEQ ID NO: 1332533 - RNA, 18 nt, Homo sapiens
ucaaauuauuaccaguga

SEQ ID NO: 1332534 - RNA, 23 nt, Homo sapiens
ucaaauuauuuccaagagagauu

SEQ ID NO: 1332535 - RNA, 19 nt, Homo sapiens
ucaaauuccuacaguuucu

SEQ ID NO: 1332536 - RNA, 21 nt, Homo sapiens
ucaaauugggaaauccauucc

SEQ ID NO: 1332537 - RNA, 18 nt, Homo sapiens
ucaacacuuaagucucag

SEQ ID NO: 1332538 - RNA, 18 nt, Homo sapiens
ucaaccaaugccaaaaaa

SEQ ID NO: 1332539 - RNA, 17 nt, Homo sapiens
ucaaccagauaacauac

SEQ ID NO: 1332540 - RNA, 16 nt, Homo sapiens
ucaaccuaacacauua

SEQ ID NO: 1332541 - RNA, 16 nt, Homo sapiens
ucaacuccgugcuuaa

SEQ ID NO: 1332542 - RNA, 21 nt, Homo sapiens
ucaacuccgugcuuaaccaaa

SEQ ID NO: 1332543 - RNA, 16 nt, Homo sapiens
ucaacugguuguauau

SEQ ID NO: 1332544 - RNA, 15 nt, Homo sapiens
ucaacuuugauacuu

SEQ ID NO: 1332545 - RNA, 15 nt, Homo sapiens
ucaagaacacaguga

SEQ ID NO: 1332546 - RNA, 17 nt, Homo sapiens
ucaagaccaacagaaga

SEQ ID NO: 1332547 - RNA, 19 nt, Homo sapiens
ucaagauuuuuuuugucag

SEQ ID NO: 1332548 - RNA, 16 nt, Homo sapiens
ucaagcaaacaucaaa

SEQ ID NO: 1332549 - RNA, 22 nt, Homo sapiens
ucaagcaauucuccugccuuag

SEQ ID NO: 1332550 - RNA, 15 nt, Homo sapiens
ucaagcuccccucac

SEQ ID NO: 1332551 - RNA, 19 nt, Homo sapiens
ucaaguauuaagcaguuca

SEQ ID NO: 1332552 - RNA, 13 nt, Homo sapiens
ucaagucucucac

SEQ ID NO: 1332553 - RNA, 21 nt, Homo sapiens
ucaagugauucuccugccuca

SEQ ID NO: 1332554 - RNA, 22 nt, Homo sapiens
ucaagugauucuccugccucag

SEQ ID NO: 1332555 - RNA, 14 nt, Homo sapiens
ucaaguguauuuga

SEQ ID NO: 1332556 - RNA, 19 nt, Homo sapiens
ucaauacaaccagcccaac

SEQ ID NO: 1332557 - RNA, 16 nt, Homo sapiens
ucaauacuuacauauc

SEQ ID NO: 1332558 - RNA, 18 nt, Homo sapiens
ucaauacuuacauaucug

SEQ ID NO: 1332559 - RNA, 18 nt, Homo sapiens
ucaauauuaagucauugu

SEQ ID NO: 1332560 - RNA, 13 nt, Homo sapiens
ucaauauuuacua

SEQ ID NO: 1332561 - RNA, 19 nt, Homo sapiens
ucaaugaaccacaaaaaag

SEQ ID NO: 1332562 - RNA, 20 nt, Homo sapiens
ucaaugccucacgagauuug

SEQ ID NO: 1332563 - RNA, 19 nt, Homo sapiens
ucaaugugccuuugcauaa

SEQ ID NO: 1332564 - RNA, 22 nt, Homo sapiens
ucaauuucuaguaccugugacu

SEQ ID NO: 1332565 - RNA, 13 nt, Homo sapiens
ucacaaaaccacc

SEQ ID NO: 1332566 - RNA, 19 nt, Homo sapiens
ucacaaaucuuaacuugaa

SEQ ID NO: 1332567 - RNA, 17 nt, Homo sapiens
ucacaaauuucacuuau

SEQ ID NO: 1332568 - RNA, 23 nt, Homo sapiens
ucacaacagauuauuaccuuaca

SEQ ID NO: 1332569 - RNA, 16 nt, Homo sapiens
ucacaagaaugugcag

SEQ ID NO: 1332570 - RNA, 18 nt, Homo sapiens
ucacacagacacuaacga

SEQ ID NO: 1332571 - RNA, 17 nt, Homo sapiens
ucacacagagaggcaga

SEQ ID NO: 1332572 - RNA, 16 nt, Homo sapiens
ucacacugucuucuga

SEQ ID NO: 1332573 - RNA, 12 nt, Homo sapiens
ucacagccucaa

SEQ ID NO: 1332574 - RNA, 19 nt, Homo sapiens
ucacagccucaagucacuc

SEQ ID NO: 1332575 - RNA, 14 nt, Homo sapiens
ucacagcgugcuaa

SEQ ID NO: 1332576 - RNA, 16 nt, Homo sapiens
ucacagggacugaaaa

SEQ ID NO: 1332577 - RNA, 23 nt, Homo sapiens
ucacaggugggaucggcacucag

SEQ ID NO: 1332578 - RNA, 17 nt, Homo sapiens
ucacagguuaauguggu

SEQ ID NO: 1332579 - RNA, 18 nt, Homo sapiens
ucacauccauucuucccu

SEQ ID NO: 1332580 - RNA, 19 nt, Homo sapiens
ucacauccauucuucccuu

SEQ ID NO: 1332581 - RNA, 15 nt, Homo sapiens
ucacaucucagggaa

SEQ ID NO: 1332582 - RNA, 20 nt, Homo sapiens
ucacaucucagggaacugac

SEQ ID NO: 1332583 - RNA, 18 nt, Homo sapiens
ucacaugguuacauauca

SEQ ID NO: 1332584 - RNA, 21 nt, Homo sapiens
ucaccaaaaaccuauuccacu

SEQ ID NO: 1332585 - RNA, 20 nt, Homo sapiens
ucaccagaauaaacccagcu

SEQ ID NO: 1332586 - RNA, 15 nt, Homo sapiens
ucaccagauuugcua

SEQ ID NO: 1332587 - RNA, 19 nt, Homo sapiens
ucaccaggggaggagccug

SEQ ID NO: 1332588 - RNA, 17 nt, Homo sapiens
ucaccccucacugugac

SEQ ID NO: 1332589 - RNA, 17 nt, Homo sapiens
ucacccgacccgugcac

SEQ ID NO: 1332590 - RNA, 20 nt, Homo sapiens
ucaccuagcagccucaaaac

SEQ ID NO: 1332591 - RNA, 19 nt, Homo sapiens
ucaccucuuuguucuuccu

SEQ ID NO: 1332592 - RNA, 21 nt, Homo sapiens
ucaccuggacuuaagcaucug

SEQ ID NO: 1332593 - RNA, 15 nt, Homo sapiens
ucacgcagugcuuuc

SEQ ID NO: 1332594 - RNA, 12 nt, Homo sapiens
ucacuacuggug

SEQ ID NO: 1332595 - RNA, 24 nt, Homo sapiens
ucacuacugguguucuguuucaau

SEQ ID NO: 1332596 - RNA, 22 nt, Homo sapiens
ucacuagagacaaaucuuuaag

SEQ ID NO: 1332597 - RNA, 15 nt, Homo sapiens
ucacucuguugccau

SEQ ID NO: 1332598 - RNA, 23 nt, Homo sapiens
ucacucuuugaagcgagcaguca

SEQ ID NO: 1332599 - RNA, 14 nt, Homo sapiens
ucacugcaaccucc

SEQ ID NO: 1332600 - RNA, 23 nt, Homo sapiens
ucacugcaguagugcaccaucuc

SEQ ID NO: 1332601 - RNA, 18 nt, Homo sapiens
ucacugccccucucucag

SEQ ID NO: 1332602 - RNA, 17 nt, Homo sapiens
ucacuggaccacugggc

SEQ ID NO: 1332603 - RNA, 13 nt, Homo sapiens
ucacuguugcaua

SEQ ID NO: 1332604 - RNA, 21 nt, Homo sapiens
ucacuuaagaaguaagcaacu

SEQ ID NO: 1332605 - RNA, 17 nt, Homo sapiens
ucagaaauaaaucacag

SEQ ID NO: 1332606 - RNA, 19 nt, Homo sapiens
ucagaaguuucucagcucc

SEQ ID NO: 1332607 - RNA, 20 nt, Homo sapiens
ucagacaucagucaauggaa

SEQ ID NO: 1332608 - RNA, 16 nt, Homo sapiens
ucagacauuggcaccu

SEQ ID NO: 1332609 - RNA, 13 nt, Homo sapiens
ucagaccacaagg

SEQ ID NO: 1332610 - RNA, 19 nt, Homo sapiens
ucagaccugcauugaacag

SEQ ID NO: 1332611 - RNA, 16 nt, Homo sapiens
ucagacgccaggcacc

SEQ ID NO: 1332612 - RNA, 19 nt, Homo sapiens
ucagagaaaggacugugga

SEQ ID NO: 1332613 - RNA, 17 nt, Homo sapiens
ucagagcacucauuccu

SEQ ID NO: 1332614 - RNA, 17 nt, Homo sapiens
ucagagcuccucacuua

SEQ ID NO: 1332615 - RNA, 17 nt, Homo sapiens
ucagaggagcgcaggca

SEQ ID NO: 1332616 - RNA, 18 nt, Homo sapiens
ucagaggccugcugccag

SEQ ID NO: 1332617 - RNA, 19 nt, Homo sapiens
ucagauaauuaugcuuuua

SEQ ID NO: 1332618 - RNA, 14 nt, Homo sapiens
ucagaucauuauca

SEQ ID NO: 1332619 - RNA, 21 nt, Homo sapiens
ucagcaaaaaucucccaguga

SEQ ID NO: 1332620 - RNA, 21 nt, Homo sapiens
ucagcaacccuacaguauaua

SEQ ID NO: 1332621 - RNA, 22 nt, Homo sapiens
ucagcauccagguuuaugaaug

SEQ ID NO: 1332622 - RNA, 16 nt, Homo sapiens
ucagcauccaguguga

SEQ ID NO: 1332623 - RNA, 11 nt, Homo sapiens
ucagcauuucc

SEQ ID NO: 1332624 - RNA, 22 nt, Homo sapiens
ucagcccagccccuccaaaggu

SEQ ID NO: 1332625 - RNA, 11 nt, Homo sapiens
ucagcccagug

SEQ ID NO: 1332626 - RNA, 23 nt, Homo sapiens
ucagccccaccccagguccugca

SEQ ID NO: 1332627 - RNA, 20 nt, Homo sapiens
ucagcccugcaccaugcugc

SEQ ID NO: 1332628 - RNA, 14 nt, Homo sapiens
ucagccucccaaag

SEQ ID NO: 1332629 - RNA, 21 nt, Homo sapiens
ucagccuugccagagauccaa

SEQ ID NO: 1332630 - RNA, 19 nt, Homo sapiens
ucagccuuuugaugucuuu

SEQ ID NO: 1332631 - RNA, 14 nt, Homo sapiens
ucagcggcuccagc

SEQ ID NO: 1332632 - RNA, 20 nt, Homo sapiens
ucagcucccugccuguuucc

SEQ ID NO: 1332633 - RNA, 23 nt, Homo sapiens
ucagcucuuggcuccacugggau

SEQ ID NO: 1332634 - RNA, 19 nt, Homo sapiens
ucagcugcaagguacucug

SEQ ID NO: 1332635 - RNA, 18 nt, Homo sapiens
ucagcuggaaaaggccug

SEQ ID NO: 1332636 - RNA, 20 nt, Homo sapiens
ucaggaaaucaaauaugcaa

SEQ ID NO: 1332637 - RNA, 16 nt, Homo sapiens
ucaggacagaugccac

SEQ ID NO: 1332638 - RNA, 12 nt, Homo sapiens
ucaggacucucu

SEQ ID NO: 1332639 - RNA, 16 nt, Homo sapiens
ucaggauccagugaca

SEQ ID NO: 1332640 - RNA, 13 nt, Homo sapiens
ucaggccagccca

SEQ ID NO: 1332641 - RNA, 18 nt, Homo sapiens
ucaggccauugucccuga

SEQ ID NO: 1332642 - RNA, 18 nt, Homo sapiens
ucagggaacugacccuca

SEQ ID NO: 1332643 - RNA, 21 nt, Homo sapiens
ucagggggucuggaaagaagg

SEQ ID NO: 1332644 - RNA, 12 nt, Homo sapiens
ucagggucuaag

SEQ ID NO: 1332645 - RNA, 19 nt, Homo sapiens
ucagggucuaagcaccuug

SEQ ID NO: 1332646 - RNA, 17 nt, Homo sapiens
ucaggucccaggccagc

SEQ ID NO: 1332647 - RNA, 21 nt, Homo sapiens
ucaggucuguaugucauggau

SEQ ID NO: 1332648 - RNA, 21 nt, Homo sapiens
ucagguuuucgaaccuugacc

SEQ ID NO: 1332649 - RNA, 14 nt, Homo sapiens
ucaguaccccaugg

SEQ ID NO: 1332650 - RNA, 18 nt, Homo sapiens
ucaguccuuugucuuucu

SEQ ID NO: 1332651 - RNA, 20 nt, Homo sapiens
ucagugaccagugccuguga

SEQ ID NO: 1332652 - RNA, 16 nt, Homo sapiens
ucagugacuccugcug

SEQ ID NO: 1332653 - RNA, 20 nt, Homo sapiens
ucagugcaguuucuuuucac

SEQ ID NO: 1332654 - RNA, 13 nt, Homo sapiens
ucagugugcaaua

SEQ ID NO: 1332655 - RNA, 16 nt, Homo sapiens
ucaguucuaggccuuu

SEQ ID NO: 1332656 - RNA, 23 nt, Homo sapiens
ucaguuguuauuuauugaaauga

SEQ ID NO: 1332657 - RNA, 13 nt, Homo sapiens
ucauaaauuuacu

SEQ ID NO: 1332658 - RNA, 21 nt, Homo sapiens
ucauaacucugugaucuugcu

SEQ ID NO: 1332659 - RNA, 18 nt, Homo sapiens
ucauaaguuaugccucug

SEQ ID NO: 1332660 - RNA, 15 nt, Homo sapiens
ucauaaucacaaccc

SEQ ID NO: 1332661 - RNA, 17 nt, Homo sapiens
ucauaaucuuugcuuua

SEQ ID NO: 1332662 - RNA, 20 nt, Homo sapiens
ucauaauucagcacuuaacu

SEQ ID NO: 1332663 - RNA, 16 nt, Homo sapiens
ucauacacaugugcac

SEQ ID NO: 1332664 - RNA, 21 nt, Homo sapiens
ucauagugauagagugcagug

SEQ ID NO: 1332665 - RNA, 14 nt, Homo sapiens
ucauauguggaauc

SEQ ID NO: 1332666 - RNA, 20 nt, Homo sapiens
ucauauuuuaaacagaggau

SEQ ID NO: 1332667 - RNA, 12 nt, Homo sapiens
ucaucaaugugc

SEQ ID NO: 1332668 - RNA, 23 nt, Homo sapiens
ucaucaggugcauagcaagugaa

SEQ ID NO: 1332669 - RNA, 17 nt, Homo sapiens
ucaucauuucagccaaa

SEQ ID NO: 1332670 - RNA, 18 nt, Homo sapiens
ucaucccuuaauaaaaua

SEQ ID NO: 1332671 - RNA, 14 nt, Homo sapiens
ucaucucuuuauuc

SEQ ID NO: 1332672 - RNA, 17 nt, Homo sapiens
ucaucuguggagcugcc

SEQ ID NO: 1332673 - RNA, 18 nt, Homo sapiens
ucaucuguggagcugcca

SEQ ID NO: 1332674 - RNA, 20 nt, Homo sapiens
ucaucuguggagcugccaca

SEQ ID NO: 1332675 - RNA, 15 nt, Homo sapiens
ucaugaagugcacag

SEQ ID NO: 1332676 - RNA, 18 nt, Homo sapiens
ucaugaagugcacaggag

SEQ ID NO: 1332677 - RNA, 14 nt, Homo sapiens
ucaugagugaauaa

SEQ ID NO: 1332678 - RNA, 19 nt, Homo sapiens
ucaugcucgacacuuacca

SEQ ID NO: 1332679 - RNA, 11 nt, Homo sapiens
ucaugcugcuc

SEQ ID NO: 1332680 - RNA, 12 nt, Homo sapiens
ucauggauuuuc

SEQ ID NO: 1332681 - RNA, 15 nt, Homo sapiens
ucauggugcacugag

SEQ ID NO: 1332682 - RNA, 16 nt, Homo sapiens
ucauguggcuaccugu

SEQ ID NO: 1332683 - RNA, 16 nt, Homo sapiens
ucauguuaugcaguga

SEQ ID NO: 1332684 - RNA, 19 nt, Homo sapiens
ucauguuuacagaggacag

SEQ ID NO: 1332685 - RNA, 20 nt, Homo sapiens
ucauuacaaaaaaacacgug

SEQ ID NO: 1332686 - RNA, 11 nt, Homo sapiens
ucauuaccuca

SEQ ID NO: 1332687 - RNA, 20 nt, Homo sapiens
ucauuagaacuucaagcucu

SEQ ID NO: 1332688 - RNA, 14 nt, Homo sapiens
ucauuauguuaaua

SEQ ID NO: 1332689 - RNA, 14 nt, Homo sapiens
ucauucacauucag

SEQ ID NO: 1332690 - RNA, 13 nt, Homo sapiens
ucauucauggcua

SEQ ID NO: 1332691 - RNA, 14 nt, Homo sapiens
ucauucauucacuc

SEQ ID NO: 1332692 - RNA, 20 nt, Homo sapiens
ucauucccaacgugcaaagc

SEQ ID NO: 1332693 - RNA, 21 nt, Homo sapiens
ucauucuuuuugaaaugucaa

SEQ ID NO: 1332694 - RNA, 22 nt, Homo sapiens
ucauugcaccuaucucagccau

SEQ ID NO: 1332695 - RNA, 20 nt, Homo sapiens
ucauugcgugauucaaugaa

SEQ ID NO: 1332696 - RNA, 14 nt, Homo sapiens
ucauuugaguuuag

SEQ ID NO: 1332697 - RNA, 20 nt, Homo sapiens
ucauuuuuuaagugacuuua

SEQ ID NO: 1332698 - RNA, 17 nt, Homo sapiens
uccaaaaagcucugaaa

SEQ ID NO: 1332699 - RNA, 12 nt, Homo sapiens
uccaaaaauggc

SEQ ID NO: 1332700 - RNA, 16 nt, Homo sapiens
uccaaaaauggcagug

SEQ ID NO: 1332701 - RNA, 13 nt, Homo sapiens
uccaaaacauuuc

SEQ ID NO: 1332702 - RNA, 16 nt, Homo sapiens
uccaaaccuccacugc

SEQ ID NO: 1332703 - RNA, 21 nt, Homo sapiens
uccaaagaaauguaagggaaa

SEQ ID NO: 1332704 - RNA, 18 nt, Homo sapiens
uccaaagcccucccuacc

SEQ ID NO: 1332705 - RNA, 14 nt, Homo sapiens
uccaaagcuuuauu

SEQ ID NO: 1332706 - RNA, 17 nt, Homo sapiens
uccaaaggucugauguc

SEQ ID NO: 1332707 - RNA, 17 nt, Homo sapiens
uccaacauuaaaagcca

SEQ ID NO: 1332708 - RNA, 21 nt, Homo sapiens
uccaagcccgcucccugcuca

SEQ ID NO: 1332709 - RNA, 21 nt, Homo sapiens
uccaaggaugggaaucaggca

SEQ ID NO: 1332710 - RNA, 23 nt, Homo sapiens
uccaaguaaaauauuaacauauu

SEQ ID NO: 1332711 - RNA, 23 nt, Homo sapiens
uccaagugccccaccacucccca

SEQ ID NO: 1332712 - RNA, 15 nt, Homo sapiens
uccaaucugugauga

SEQ ID NO: 1332713 - RNA, 11 nt, Homo sapiens
uccaaugcaca

SEQ ID NO: 1332714 - RNA, 18 nt, Homo sapiens
uccaaugcacaguugcca

SEQ ID NO: 1332715 - RNA, 20 nt, Homo sapiens
uccaauuuuuuaagugaaaa

SEQ ID NO: 1332716 - RNA, 22 nt, Homo sapiens
uccacacacagcugggcugugg

SEQ ID NO: 1332717 - RNA, 17 nt, Homo sapiens
uccacacccucacugcu

SEQ ID NO: 1332718 - RNA, 12 nt, Homo sapiens
uccacagaggac

SEQ ID NO: 1332719 - RNA, 21 nt, Homo sapiens
uccacccagcaggcagagugg

SEQ ID NO: 1332720 - RNA, 21 nt, Homo sapiens
uccaccccagcaggacaguga

SEQ ID NO: 1332721 - RNA, 14 nt, Homo sapiens
uccacccuguuacu

SEQ ID NO: 1332722 - RNA, 23 nt, Homo sapiens
uccacguaucuuuccuaggcaga

SEQ ID NO: 1332723 - RNA, 13 nt, Homo sapiens
uccacuacucucu

SEQ ID NO: 1332724 - RNA, 17 nt, Homo sapiens
uccacucguguguuucu

SEQ ID NO: 1332725 - RNA, 24 nt, Homo sapiens
uccacugaggugggagcaucucca

SEQ ID NO: 1332726 - RNA, 21 nt, Homo sapiens
uccacuucauuuuucccuugu

SEQ ID NO: 1332727 - RNA, 21 nt, Homo sapiens
uccacuuggagcuaaaacugg

SEQ ID NO: 1332728 - RNA, 15 nt, Homo sapiens
uccagagaguggcuc

SEQ ID NO: 1332729 - RNA, 17 nt, Homo sapiens
uccagagguccuccgua

SEQ ID NO: 1332730 - RNA, 13 nt, Homo sapiens
uccagcagcuuuc

SEQ ID NO: 1332731 - RNA, 14 nt, Homo sapiens
uccagccacuuccc

SEQ ID NO: 1332732 - RNA, 15 nt, Homo sapiens
uccagcccugcagcu

SEQ ID NO: 1332733 - RNA, 18 nt, Homo sapiens
uccagcuccaaccugcaa

SEQ ID NO: 1332734 - RNA, 18 nt, Homo sapiens
uccaggaauauaugucag

SEQ ID NO: 1332735 - RNA, 22 nt, Homo sapiens
uccaggaauauaugucagugau

SEQ ID NO: 1332736 - RNA, 19 nt, Homo sapiens
uccaggcuggagugcaaug

SEQ ID NO: 1332737 - RNA, 19 nt, Homo sapiens
uccagggaauggagcucag

SEQ ID NO: 1332738 - RNA, 22 nt, Homo sapiens
uccagggcagcaggccagagaa

SEQ ID NO: 1332739 - RNA, 23 nt, Homo sapiens
uccagggcuauagggugugauga

SEQ ID NO: 1332740 - RNA, 12 nt, Homo sapiens
uccagggcuccc

SEQ ID NO: 1332741 - RNA, 18 nt, Homo sapiens
uccagggugacaaggccu

SEQ ID NO: 1332742 - RNA, 15 nt, Homo sapiens
uccagguuuaugaau

SEQ ID NO: 1332743 - RNA, 21 nt, Homo sapiens
uccaguccaaagccggcuuga

SEQ ID NO: 1332744 - RNA, 22 nt, Homo sapiens
uccaguggaauggagauuucau

SEQ ID NO: 1332745 - RNA, 20 nt, Homo sapiens
uccagugucugucauuucag

SEQ ID NO: 1332746 - RNA, 21 nt, Homo sapiens
uccaguuugaguuaaugugcu

SEQ ID NO: 1332747 - RNA, 14 nt, Homo sapiens
uccauauaacaauu

SEQ ID NO: 1332748 - RNA, 24 nt, Homo sapiens
uccauauaacaauucaguaacaaa

SEQ ID NO: 1332749 - RNA, 23 nt, Homo sapiens
uccauaucccuuccucucaggcu

SEQ ID NO: 1332750 - RNA, 23 nt, Homo sapiens
uccauauggguaguuaugggguu

SEQ ID NO: 1332751 - RNA, 14 nt, Homo sapiens
uccaucaacuguga

SEQ ID NO: 1332752 - RNA, 18 nt, Homo sapiens
uccaucagagaugacucu

SEQ ID NO: 1332753 - RNA, 16 nt, Homo sapiens
uccaucucuucugcaa

SEQ ID NO: 1332754 - RNA, 18 nt, Homo sapiens
uccaugaaagaacuuaag

SEQ ID NO: 1332755 - RNA, 22 nt, Homo sapiens
uccauguuugcaccugugcauu

SEQ ID NO: 1332756 - RNA, 19 nt, Homo sapiens
uccauuuugugaauuguga

SEQ ID NO: 1332757 - RNA, 15 nt, Homo sapiens
ucccaacgugcaaag

SEQ ID NO: 1332758 - RNA, 19 nt, Homo sapiens
ucccaagggagacugacca

SEQ ID NO: 1332759 - RNA, 20 nt, Homo sapiens
ucccacaacuacuaguguga

SEQ ID NO: 1332760 - RNA, 21 nt, Homo sapiens
ucccaccaaccuccaguguca

SEQ ID NO: 1332761 - RNA, 14 nt, Homo sapiens
ucccaccacaggca

SEQ ID NO: 1332762 - RNA, 23 nt, Homo sapiens
ucccaccucuccuuuugaggcuu

SEQ ID NO: 1332763 - RNA, 15 nt, Homo sapiens
ucccacgagggugcc

SEQ ID NO: 1332764 - RNA, 15 nt, Homo sapiens
ucccacuacaucugg

SEQ ID NO: 1332765 - RNA, 19 nt, Homo sapiens
ucccacugcccacuggccg

SEQ ID NO: 1332766 - RNA, 13 nt, Homo sapiens
ucccacuuggcau

SEQ ID NO: 1332767 - RNA, 18 nt, Homo sapiens
ucccagagcaucuugcau

SEQ ID NO: 1332768 - RNA, 17 nt, Homo sapiens
ucccagagugcugggau

SEQ ID NO: 1332769 - RNA, 15 nt, Homo sapiens
ucccaggaacugggc

SEQ ID NO: 1332770 - RNA, 12 nt, Homo sapiens
ucccagucccau

SEQ ID NO: 1332771 - RNA, 13 nt, Homo sapiens
ucccagugacaac

SEQ ID NO: 1332772 - RNA, 19 nt, Homo sapiens
ucccagugacaaccaaaag

SEQ ID NO: 1332773 - RNA, 18 nt, Homo sapiens
ucccaucacuguauccau

SEQ ID NO: 1332774 - RNA, 21 nt, Homo sapiens
ucccaucacuguauccauucu

SEQ ID NO: 1332775 - RNA, 13 nt, Homo sapiens
ucccauugccaug

SEQ ID NO: 1332776 - RNA, 16 nt, Homo sapiens
uccccaagcacggugu

SEQ ID NO: 1332777 - RNA, 16 nt, Homo sapiens
uccccagaugugacua

SEQ ID NO: 1332778 - RNA, 21 nt, Homo sapiens
uccccagcccagagacauacu

SEQ ID NO: 1332779 - RNA, 17 nt, Homo sapiens
uccccagucccagacaa

SEQ ID NO: 1332780 - RNA, 19 nt, Homo sapiens
ucccccuuucacacuggau

SEQ ID NO: 1332781 - RNA, 16 nt, Homo sapiens
uccccuaaaccaaaaa

SEQ ID NO: 1332782 - RNA, 17 nt, Homo sapiens
uccccucagagugcaag

SEQ ID NO: 1332783 - RNA, 22 nt, Homo sapiens
uccccucagggauacgacacau

SEQ ID NO: 1332784 - RNA, 19 nt, Homo sapiens
uccccuccuuggcuuuaug

SEQ ID NO: 1332785 - RNA, 23 nt, Homo sapiens
uccccuccuuggcuuuaugcaaa

SEQ ID NO: 1332786 - RNA, 20 nt, Homo sapiens
uccccugacagggccagugc

SEQ ID NO: 1332787 - RNA, 15 nt, Homo sapiens
uccccuuucacaggu

SEQ ID NO: 1332788 - RNA, 14 nt, Homo sapiens
ucccgaaacuccac

SEQ ID NO: 1332789 - RNA, 20 nt, Homo sapiens
ucccucaggucccuugguca

SEQ ID NO: 1332790 - RNA, 23 nt, Homo sapiens
ucccuccagauauacuugguucu

SEQ ID NO: 1332791 - RNA, 13 nt, Homo sapiens
ucccuccauacag

SEQ ID NO: 1332792 - RNA, 17 nt, Homo sapiens
ucccucccccccaugca

SEQ ID NO: 1332793 - RNA, 22 nt, Homo sapiens
ucccucccccccaugcacugug

SEQ ID NO: 1332794 - RNA, 19 nt, Homo sapiens
ucccucucaugacuugcag

SEQ ID NO: 1332795 - RNA, 21 nt, Homo sapiens
ucccucucaugacuugcaggg

SEQ ID NO: 1332796 - RNA, 15 nt, Homo sapiens
ucccucugaguuuga

SEQ ID NO: 1332797 - RNA, 13 nt, Homo sapiens
ucccugacugggg

SEQ ID NO: 1332798 - RNA, 15 nt, Homo sapiens
ucccugccucaggcc

SEQ ID NO: 1332799 - RNA, 18 nt, Homo sapiens
ucccuggaaaccuuccac

SEQ ID NO: 1332800 - RNA, 21 nt, Homo sapiens
ucccuggggcugcugugcgcu

SEQ ID NO: 1332801 - RNA, 22 nt, Homo sapiens
ucccugggguggggauagggag

SEQ ID NO: 1332802 - RNA, 16 nt, Homo sapiens
ucccuguccuugcccu

SEQ ID NO: 1332803 - RNA, 16 nt, Homo sapiens
ucccuuaaucugccag

SEQ ID NO: 1332804 - RNA, 20 nt, Homo sapiens
ucccuuuuaaaugcaaauca

SEQ ID NO: 1332805 - RNA, 14 nt, Homo sapiens
ucccuuuucccuua

SEQ ID NO: 1332806 - RNA, 19 nt, Homo sapiens
ucccuuuuuuuacauuuca

SEQ ID NO: 1332807 - RNA, 14 nt, Homo sapiens
uccgagcuccagcu

SEQ ID NO: 1332808 - RNA, 18 nt, Homo sapiens
uccgagugugauuugaau

SEQ ID NO: 1332809 - RNA, 18 nt, Homo sapiens
uccgauuccccuguagca

SEQ ID NO: 1332810 - RNA, 17 nt, Homo sapiens
uccgcuagcaguacuaa

SEQ ID NO: 1332811 - RNA, 20 nt, Homo sapiens
uccggccuccugucccucau

SEQ ID NO: 1332812 - RNA, 18 nt, Homo sapiens
uccguccaggagccugug

SEQ ID NO: 1332813 - RNA, 17 nt, Homo sapiens
uccguuccacauccaca

SEQ ID NO: 1332814 - RNA, 21 nt, Homo sapiens
uccguucuauuuugugaauuu

SEQ ID NO: 1332815 - RNA, 13 nt, Homo sapiens
uccuaaagagaca

SEQ ID NO: 1332816 - RNA, 18 nt, Homo sapiens
uccuaagaagagugcugu

SEQ ID NO: 1332817 - RNA, 14 nt, Homo sapiens
uccuaauacuguca

SEQ ID NO: 1332818 - RNA, 18 nt, Homo sapiens
uccuaaucaaauucuguc

SEQ ID NO: 1332819 - RNA, 20 nt, Homo sapiens
uccuacagugacucccuggg

SEQ ID NO: 1332820 - RNA, 14 nt, Homo sapiens
uccuaccugucugc

SEQ ID NO: 1332821 - RNA, 15 nt, Homo sapiens
uccuaggucaugccu

SEQ ID NO: 1332822 - RNA, 14 nt, Homo sapiens
uccucaaagggaga

SEQ ID NO: 1332823 - RNA, 20 nt, Homo sapiens
uccucagccuccucaucugg

SEQ ID NO: 1332824 - RNA, 23 nt, Homo sapiens
uccucagggccacguuaccacag

SEQ ID NO: 1332825 - RNA, 14 nt, Homo sapiens
uccucaguccacug

SEQ ID NO: 1332826 - RNA, 18 nt, Homo sapiens
uccucaguccacugcuga

SEQ ID NO: 1332827 - RNA, 18 nt, Homo sapiens
uccucauauacuugaaua

SEQ ID NO: 1332828 - RNA, 22 nt, Homo sapiens
uccucaucugggggaguggaau

SEQ ID NO: 1332829 - RNA, 20 nt, Homo sapiens
uccucauuuguaaucuaguu

SEQ ID NO: 1332830 - RNA, 15 nt, Homo sapiens
uccuccaugccugac

SEQ ID NO: 1332831 - RNA, 19 nt, Homo sapiens
uccuccauuacucuauuga

SEQ ID NO: 1332832 - RNA, 15 nt, Homo sapiens
uccucccuucugcua

SEQ ID NO: 1332833 - RNA, 13 nt, Homo sapiens
uccucuccacugc

SEQ ID NO: 1332834 - RNA, 15 nt, Homo sapiens
uccucucccagugac

SEQ ID NO: 1332835 - RNA, 18 nt, Homo sapiens
uccucucccagugacaac

SEQ ID NO: 1332836 - RNA, 12 nt, Homo sapiens
uccucucugagu

SEQ ID NO: 1332837 - RNA, 11 nt, Homo sapiens
uccucucugcu

SEQ ID NO: 1332838 - RNA, 12 nt, Homo sapiens
uccucucuggcu

SEQ ID NO: 1332839 - RNA, 17 nt, Homo sapiens
uccucugcauuuacaca

SEQ ID NO: 1332840 - RNA, 14 nt, Homo sapiens
uccugaacuuucuc

SEQ ID NO: 1332841 - RNA, 17 nt, Homo sapiens
uccugaagugaccucac

SEQ ID NO: 1332842 - RNA, 16 nt, Homo sapiens
uccugaaucugugcaa

SEQ ID NO: 1332843 - RNA, 19 nt, Homo sapiens
uccugacagaaggacucag

SEQ ID NO: 1332844 - RNA, 23 nt, Homo sapiens
uccugaccucaaguaauccaccu

SEQ ID NO: 1332845 - RNA, 20 nt, Homo sapiens
uccugaguagcugggauuac

SEQ ID NO: 1332846 - RNA, 18 nt, Homo sapiens
uccugaugcuuuugucua

SEQ ID NO: 1332847 - RNA, 18 nt, Homo sapiens
uccugauggaacuaagga

SEQ ID NO: 1332848 - RNA, 13 nt, Homo sapiens
uccugcacacagg

SEQ ID NO: 1332849 - RNA, 15 nt, Homo sapiens
uccugcagucccaca

SEQ ID NO: 1332850 - RNA, 20 nt, Homo sapiens
uccugccaccagcauccaca

SEQ ID NO: 1332851 - RNA, 15 nt, Homo sapiens
uccugcuucugauau

SEQ ID NO: 1332852 - RNA, 10 nt, Homo sapiens
uccugggcug

SEQ ID NO: 1332853 - RNA, 17 nt, Homo sapiens
uccuguccuaucacucu

SEQ ID NO: 1332854 - RNA, 23 nt, Homo sapiens
uccuguggaugcaaauagauuca

SEQ ID NO: 1332855 - RNA, 15 nt, Homo sapiens
uccuguggucucuga

SEQ ID NO: 1332856 - RNA, 18 nt, Homo sapiens
uccuguggucucugacca

SEQ ID NO: 1332857 - RNA, 20 nt, Homo sapiens
uccuguggucucugaccagg

SEQ ID NO: 1332858 - RNA, 15 nt, Homo sapiens
uccuuaacacauuca

SEQ ID NO: 1332859 - RNA, 16 nt, Homo sapiens
uccuuaacacauucaa

SEQ ID NO: 1332860 - RNA, 16 nt, Homo sapiens
uccuuauucagccuua

SEQ ID NO: 1332861 - RNA, 14 nt, Homo sapiens
uccuuauuugccuu

SEQ ID NO: 1332862 - RNA, 22 nt, Homo sapiens
uccuucccucucaugacuugca

SEQ ID NO: 1332863 - RNA, 18 nt, Homo sapiens
uccuucugagccugccuu

SEQ ID NO: 1332864 - RNA, 20 nt, Homo sapiens
uccuugauuacuuccacuga

SEQ ID NO: 1332865 - RNA, 21 nt, Homo sapiens
uccuuggaaaucaaauguaaa

SEQ ID NO: 1332866 - RNA, 15 nt, Homo sapiens
uccuuggaaauugga

SEQ ID NO: 1332867 - RNA, 15 nt, Homo sapiens
uccuuggccacagac

SEQ ID NO: 1332868 - RNA, 22 nt, Homo sapiens
uccuuggcuuuaugcaaauaca

SEQ ID NO: 1332869 - RNA, 21 nt, Homo sapiens
uccuuuccccucccucaggcc

SEQ ID NO: 1332870 - RNA, 15 nt, Homo sapiens
uccuuugcugcugag

SEQ ID NO: 1332871 - RNA, 17 nt, Homo sapiens
uccuuugguccuucaaa

SEQ ID NO: 1332872 - RNA, 19 nt, Homo sapiens
uccuuuuacaauuguugaa

SEQ ID NO: 1332873 - RNA, 13 nt, Homo sapiens
uccuuuuccuuau

SEQ ID NO: 1332874 - RNA, 14 nt, Homo sapiens
uccuuuucuucacc

SEQ ID NO: 1332875 - RNA, 23 nt, Homo sapiens
ucgcacauguauugcucuuuauc

SEQ ID NO: 1332876 - RNA, 20 nt, Homo sapiens
ucgcaucuugugucgcugaa

SEQ ID NO: 1332877 - RNA, 21 nt, Homo sapiens
ucgcggcucuccagggcuccc

SEQ ID NO: 1332878 - RNA, 13 nt, Homo sapiens
ucgcugugccaca

SEQ ID NO: 1332879 - RNA, 19 nt, Homo sapiens
ucgcuguugucacaucuca

SEQ ID NO: 1332880 - RNA, 22 nt, Homo sapiens
ucggaucucacaggcugagaac

SEQ ID NO: 1332881 - RNA, 19 nt, Homo sapiens
ucggauuugccauagccuu

SEQ ID NO: 1332882 - RNA, 21 nt, Homo sapiens
ucggcuacugguuaccuggag

SEQ ID NO: 1332883 - RNA, 13 nt, Homo sapiens
ucgucuacugcaa

SEQ ID NO: 1332884 - RNA, 15 nt, Homo sapiens
ucguggacugugcug

SEQ ID NO: 1332885 - RNA, 15 nt, Homo sapiens
ucgugggaaagggga

SEQ ID NO: 1332886 - RNA, 14 nt, Homo sapiens
ucguuaaaaacaga

SEQ ID NO: 1332887 - RNA, 16 nt, Homo sapiens
ucuaaaauucuauuau

SEQ ID NO: 1332888 - RNA, 16 nt, Homo sapiens
ucuaaagagcaucuga

SEQ ID NO: 1332889 - RNA, 14 nt, Homo sapiens
ucuaacaagucaua

SEQ ID NO: 1332890 - RNA, 12 nt, Homo sapiens
ucuaacagauca

SEQ ID NO: 1332891 - RNA, 18 nt, Homo sapiens
ucuaaccaaagguuuugc

SEQ ID NO: 1332892 - RNA, 19 nt, Homo sapiens
ucuaagaaguuuuguucug

SEQ ID NO: 1332893 - RNA, 13 nt, Homo sapiens
ucuaagggaguca

SEQ ID NO: 1332894 - RNA, 16 nt, Homo sapiens
ucuaauaauaagucag

SEQ ID NO: 1332895 - RNA, 19 nt, Homo sapiens
ucuaaugccuuuugaauac

SEQ ID NO: 1332896 - RNA, 18 nt, Homo sapiens
ucuacaggaaucaaaaga

SEQ ID NO: 1332897 - RNA, 11 nt, Homo sapiens
ucuacauucac

SEQ ID NO: 1332898 - RNA, 14 nt, Homo sapiens
ucuacauucacuuu

SEQ ID NO: 1332899 - RNA, 23 nt, Homo sapiens
ucuaccuccuuguguugcacuga

SEQ ID NO: 1332900 - RNA, 14 nt, Homo sapiens
ucuacugcaagagc

SEQ ID NO: 1332901 - RNA, 15 nt, Homo sapiens
ucuagaacacaggca

SEQ ID NO: 1332902 - RNA, 13 nt, Homo sapiens
ucuagaaugucau

SEQ ID NO: 1332903 - RNA, 23 nt, Homo sapiens
ucuagcacacuuuuuuaaaugaa

SEQ ID NO: 1332904 - RNA, 20 nt, Homo sapiens
ucuagcccaaccuacauucc

SEQ ID NO: 1332905 - RNA, 21 nt, Homo sapiens
ucuaggauaacuugcuuucuu

SEQ ID NO: 1332906 - RNA, 22 nt, Homo sapiens
ucuaggcccugugagcacaaag

SEQ ID NO: 1332907 - RNA, 14 nt, Homo sapiens
ucuaggugcuuuaa

SEQ ID NO: 1332908 - RNA, 15 nt, Homo sapiens
ucuaggugcuuuaac

SEQ ID NO: 1332909 - RNA, 22 nt, Homo sapiens
ucuagugagucaacauccauaa

SEQ ID NO: 1332910 - RNA, 15 nt, Homo sapiens
ucuaguugucaauaa

SEQ ID NO: 1332911 - RNA, 20 nt, Homo sapiens
ucuauacaaaaugauuuuga

SEQ ID NO: 1332912 - RNA, 19 nt, Homo sapiens
ucuauacucagguaccucu

SEQ ID NO: 1332913 - RNA, 14 nt, Homo sapiens
ucuauagagccaag

SEQ ID NO: 1332914 - RNA, 15 nt, Homo sapiens
ucuaucaucugcuaa

SEQ ID NO: 1332915 - RNA, 23 nt, Homo sapiens
ucuaugaccucgcccuccacaaa

SEQ ID NO: 1332916 - RNA, 21 nt, Homo sapiens
ucuauuauguuaucauccucc

SEQ ID NO: 1332917 - RNA, 20 nt, Homo sapiens
ucuauuugccuccagugcag

SEQ ID NO: 1332918 - RNA, 21 nt, Homo sapiens
ucucaaaacugcacugucaag

SEQ ID NO: 1332919 - RNA, 19 nt, Homo sapiens
ucucaaacccccagccuca

SEQ ID NO: 1332920 - RNA, 20 nt, Homo sapiens
ucucaaacuccugaccucag

SEQ ID NO: 1332921 - RNA, 22 nt, Homo sapiens
ucucaaaugcuggcaaauccag

SEQ ID NO: 1332922 - RNA, 14 nt, Homo sapiens
ucucaacuuugaua

SEQ ID NO: 1332923 - RNA, 22 nt, Homo sapiens
ucucaacuuugauacuuacuca

SEQ ID NO: 1332924 - RNA, 14 nt, Homo sapiens
ucucaagaccaaca

SEQ ID NO: 1332925 - RNA, 20 nt, Homo sapiens
ucucacauaagcccaguuca

SEQ ID NO: 1332926 - RNA, 22 nt, Homo sapiens
ucucacauaagcccaguucauc

SEQ ID NO: 1332927 - RNA, 15 nt, Homo sapiens
ucucacugccaugga

SEQ ID NO: 1332928 - RNA, 13 nt, Homo sapiens
ucucagaugcagu

SEQ ID NO: 1332929 - RNA, 12 nt, Homo sapiens
ucucagcacuuu

SEQ ID NO: 1332930 - RNA, 13 nt, Homo sapiens
ucucagcacuuug

SEQ ID NO: 1332931 - RNA, 13 nt, Homo sapiens
ucucauuccagag

SEQ ID NO: 1332932 - RNA, 17 nt, Homo sapiens
ucuccaaggaugggaau

SEQ ID NO: 1332933 - RNA, 18 nt, Homo sapiens
ucuccacggccugcccag

SEQ ID NO: 1332934 - RNA, 13 nt, Homo sapiens
ucuccagugaaau

SEQ ID NO: 1332935 - RNA, 18 nt, Homo sapiens
ucuccccagcccagagac

SEQ ID NO: 1332936 - RNA, 14 nt, Homo sapiens
ucucccccacucca

SEQ ID NO: 1332937 - RNA, 23 nt, Homo sapiens
ucucccuuccuaugcuguucacu

SEQ ID NO: 1332938 - RNA, 16 nt, Homo sapiens
ucuccuaaagcuuuua

SEQ ID NO: 1332939 - RNA, 20 nt, Homo sapiens
ucuccucugcagcucaggga

SEQ ID NO: 1332940 - RNA, 13 nt, Homo sapiens
ucuccuguggucu

SEQ ID NO: 1332941 - RNA, 16 nt, Homo sapiens
ucuccuucccauuucu

SEQ ID NO: 1332942 - RNA, 17 nt, Homo sapiens
ucucuaacaguggacaa

SEQ ID NO: 1332943 - RNA, 17 nt, Homo sapiens
ucucuaauuuaacuuau

SEQ ID NO: 1332944 - RNA, 23 nt, Homo sapiens
ucucuacaaacucccacuuguca

SEQ ID NO: 1332945 - RNA, 15 nt, Homo sapiens
ucucuacuaaaacau

SEQ ID NO: 1332946 - RNA, 21 nt, Homo sapiens
ucucuauagagccaaguccaa

SEQ ID NO: 1332947 - RNA, 18 nt, Homo sapiens
ucucuccaggagggcucg

SEQ ID NO: 1332948 - RNA, 16 nt, Homo sapiens
ucucuccuuggccaca

SEQ ID NO: 1332949 - RNA, 16 nt, Homo sapiens
ucucucucucuacaaa

SEQ ID NO: 1332950 - RNA, 17 nt, Homo sapiens
ucucugaggacaagaga

SEQ ID NO: 1332951 - RNA, 14 nt, Homo sapiens
ucucugaggggugg

SEQ ID NO: 1332952 - RNA, 22 nt, Homo sapiens
ucucugauuaguugacaguauu

SEQ ID NO: 1332953 - RNA, 15 nt, Homo sapiens
ucucuggcuggucuu

SEQ ID NO: 1332954 - RNA, 13 nt, Homo sapiens
ucucugguaauau

SEQ ID NO: 1332955 - RNA, 17 nt, Homo sapiens
ucucugucuacuccuua

SEQ ID NO: 1332956 - RNA, 15 nt, Homo sapiens
ucucugucucaaauu

SEQ ID NO: 1332957 - RNA, 16 nt, Homo sapiens
ucucugugugcacaaa

SEQ ID NO: 1332958 - RNA, 11 nt, Homo sapiens
ucucuguuauc

SEQ ID NO: 1332959 - RNA, 20 nt, Homo sapiens
ucucuuagaaaagcuaagag

SEQ ID NO: 1332960 - RNA, 21 nt, Homo sapiens
ucucuuaugauacuugaggua

SEQ ID NO: 1332961 - RNA, 22 nt, Homo sapiens
ucucuuccucauauuucagcag

SEQ ID NO: 1332962 - RNA, 18 nt, Homo sapiens
ucucuugcacucaaagcu

SEQ ID NO: 1332963 - RNA, 13 nt, Homo sapiens
ucucuuucuuauu

SEQ ID NO: 1332964 - RNA, 16 nt, Homo sapiens
ucugaaacugcauaag

SEQ ID NO: 1332965 - RNA, 23 nt, Homo sapiens
ucugaaacugcauaagugaaaau

SEQ ID NO: 1332966 - RNA, 18 nt, Homo sapiens
ucugaaccccucccucca

SEQ ID NO: 1332967 - RNA, 23 nt, Homo sapiens
ucugaacugaccuugaaucuuuu

SEQ ID NO: 1332968 - RNA, 15 nt, Homo sapiens
ucugaagucacugca

SEQ ID NO: 1332969 - RNA, 16 nt, Homo sapiens
ucugaauaacuugaag

SEQ ID NO: 1332970 - RNA, 21 nt, Homo sapiens
ucugacaacugugaagccacc

SEQ ID NO: 1332971 - RNA, 23 nt, Homo sapiens
ucugacuuaagcugccucaagga

SEQ ID NO: 1332972 - RNA, 16 nt, Homo sapiens
ucugacuuugccaaaa

SEQ ID NO: 1332973 - RNA, 19 nt, Homo sapiens
ucugagaaagacuauucaa

SEQ ID NO: 1332974 - RNA, 17 nt, Homo sapiens
ucugagagacagaauuc

SEQ ID NO: 1332975 - RNA, 20 nt, Homo sapiens
ucugagaggcucuccgugca

SEQ ID NO: 1332976 - RNA, 21 nt, Homo sapiens
ucugagcccccacugcuucua

SEQ ID NO: 1332977 - RNA, 14 nt, Homo sapiens
ucugaguaagcccu

SEQ ID NO: 1332978 - RNA, 21 nt, Homo sapiens
ucugauaaaagauggccauau

SEQ ID NO: 1332979 - RNA, 22 nt, Homo sapiens
ucugauaugcaguuuuccuuaa

SEQ ID NO: 1332980 - RNA, 19 nt, Homo sapiens
ucugaucaagaacauguca

SEQ ID NO: 1332981 - RNA, 15 nt, Homo sapiens
ucugaucaaguauuu

SEQ ID NO: 1332982 - RNA, 20 nt, Homo sapiens
ucugauuaguugacaguauu

SEQ ID NO: 1332983 - RNA, 21 nt, Homo sapiens
ucugauuaguugacaguauua

SEQ ID NO: 1332984 - RNA, 22 nt, Homo sapiens
ucugcaacauuugacaaaacua

SEQ ID NO: 1332985 - RNA, 16 nt, Homo sapiens
ucugcacagacaagca

SEQ ID NO: 1332986 - RNA, 20 nt, Homo sapiens
ucugcacccagaacaguggu

SEQ ID NO: 1332987 - RNA, 21 nt, Homo sapiens
ucugcagggggugugucugcu

SEQ ID NO: 1332988 - RNA, 19 nt, Homo sapiens
ucugcauggaacagcauua

SEQ ID NO: 1332989 - RNA, 21 nt, Homo sapiens
ucugcauuucgguggcuaguc

SEQ ID NO: 1332990 - RNA, 23 nt, Homo sapiens
ucugcauuucgguggcuagucaa

SEQ ID NO: 1332991 - RNA, 15 nt, Homo sapiens
ucugccccagccugu

SEQ ID NO: 1332992 - RNA, 18 nt, Homo sapiens
ucugccugggcucuggaa

SEQ ID NO: 1332993 - RNA, 15 nt, Homo sapiens
ucugccuuuucacug

SEQ ID NO: 1332994 - RNA, 13 nt, Homo sapiens
ucugcugcugaua

SEQ ID NO: 1332995 - RNA, 19 nt, Homo sapiens
ucugcuuuucccauugcca

SEQ ID NO: 1332996 - RNA, 22 nt, Homo sapiens
ucuggaaaucagacuuuuacaa

SEQ ID NO: 1332997 - RNA, 18 nt, Homo sapiens
ucuggaacccagacucag

SEQ ID NO: 1332998 - RNA, 13 nt, Homo sapiens
ucuggacacugag

SEQ ID NO: 1332999 - RNA, 14 nt, Homo sapiens
ucuggacuggaaag

SEQ ID NO: 1333000 - RNA, 15 nt, Homo sapiens
ucuggaggggcagug

SEQ ID NO: 1333001 - RNA, 17 nt, Homo sapiens
ucuggaggucaucuggc

SEQ ID NO: 1333002 - RNA, 20 nt, Homo sapiens
ucuggauaccauuauauguu

SEQ ID NO: 1333003 - RNA, 19 nt, Homo sapiens
ucuggcaagccugucuuca

SEQ ID NO: 1333004 - RNA, 23 nt, Homo sapiens
ucuggccauauuuacuaccuuau

SEQ ID NO: 1333005 - RNA, 22 nt, Homo sapiens
ucuggccuguggcuaauggagg

SEQ ID NO: 1333006 - RNA, 13 nt, Homo sapiens
ucuggcugcacag

SEQ ID NO: 1333007 - RNA, 16 nt, Homo sapiens
ucuggcuucaaaaagc

SEQ ID NO: 1333008 - RNA, 19 nt, Homo sapiens
ucugggauauggcugccca

SEQ ID NO: 1333009 - RNA, 12 nt, Homo sapiens
ucugggccagug

SEQ ID NO: 1333010 - RNA, 15 nt, Homo sapiens
ucugggccagugcac

SEQ ID NO: 1333011 - RNA, 17 nt, Homo sapiens
ucugggccugcugagga

SEQ ID NO: 1333012 - RNA, 16 nt, Homo sapiens
ucugggcuaauauacu

SEQ ID NO: 1333013 - RNA, 18 nt, Homo sapiens
ucugggcucagacaucca

SEQ ID NO: 1333014 - RNA, 12 nt, Homo sapiens
ucuggggguccu

SEQ ID NO: 1333015 - RNA, 20 nt, Homo sapiens
ucuggggguccucucugagu

SEQ ID NO: 1333016 - RNA, 21 nt, Homo sapiens
ucugguaauaaaugugacuca

SEQ ID NO: 1333017 - RNA, 22 nt, Homo sapiens
ucugguaauaaaugugacucag

SEQ ID NO: 1333018 - RNA, 14 nt, Homo sapiens
ucugguccuaccca

SEQ ID NO: 1333019 - RNA, 22 nt, Homo sapiens
ucuggucuucgcagccuagaua

SEQ ID NO: 1333020 - RNA, 17 nt, Homo sapiens
ucugguguuugucaugg

SEQ ID NO: 1333021 - RNA, 17 nt, Homo sapiens
ucuguaggaaacccaac

SEQ ID NO: 1333022 - RNA, 14 nt, Homo sapiens
ucuguaugucaugg

SEQ ID NO: 1333023 - RNA, 14 nt, Homo sapiens
ucuguccucuuggc

SEQ ID NO: 1333024 - RNA, 20 nt, Homo sapiens
ucuguccugauuucuacaac

SEQ ID NO: 1333025 - RNA, 15 nt, Homo sapiens
ucugucuaucuguga

SEQ ID NO: 1333026 - RNA, 16 nt, Homo sapiens
ucugucuaucugugaa

SEQ ID NO: 1333027 - RNA, 14 nt, Homo sapiens
ucugugaagaaaga

SEQ ID NO: 1333028 - RNA, 15 nt, Homo sapiens
ucugugacauacaua

SEQ ID NO: 1333029 - RNA, 21 nt, Homo sapiens
ucugugaggggcucucucaug

SEQ ID NO: 1333030 - RNA, 14 nt, Homo sapiens
ucugugggcacugg

SEQ ID NO: 1333031 - RNA, 17 nt, Homo sapiens
ucugugggcacuggugg

SEQ ID NO: 1333032 - RNA, 18 nt, Homo sapiens
ucuguuugauacaguauu

SEQ ID NO: 1333033 - RNA, 21 nt, Homo sapiens
ucuuaaaaugaauuauguuau

SEQ ID NO: 1333034 - RNA, 21 nt, Homo sapiens
ucuuaaacauaauaaaucaca

SEQ ID NO: 1333035 - RNA, 16 nt, Homo sapiens
ucuuaacuucuugcuu

SEQ ID NO: 1333036 - RNA, 16 nt, Homo sapiens
ucuuaaguagggacuu

SEQ ID NO: 1333037 - RNA, 14 nt, Homo sapiens
ucuuaaguggucua

SEQ ID NO: 1333038 - RNA, 14 nt, Homo sapiens
ucuuacacacugga

SEQ ID NO: 1333039 - RNA, 19 nt, Homo sapiens
ucuuacauuagugauucca

SEQ ID NO: 1333040 - RNA, 15 nt, Homo sapiens
ucuuagagggugaug

SEQ ID NO: 1333041 - RNA, 16 nt, Homo sapiens
ucuuagcugucugcuc

SEQ ID NO: 1333042 - RNA, 18 nt, Homo sapiens
ucuucaaagcaaagcucu

SEQ ID NO: 1333043 - RNA, 13 nt, Homo sapiens
ucuucacaacaga

SEQ ID NO: 1333044 - RNA, 18 nt, Homo sapiens
ucuucacaggcacuccug

SEQ ID NO: 1333045 - RNA, 10 nt, Homo sapiens
ucuucacugu

SEQ ID NO: 1333046 - RNA, 18 nt, Homo sapiens
ucuucacuguguuuuaaa

SEQ ID NO: 1333047 - RNA, 10 nt, Homo sapiens
ucuucacuuu

SEQ ID NO: 1333048 - RNA, 15 nt, Homo sapiens
ucuucaucuuugcca

SEQ ID NO: 1333049 - RNA, 15 nt, Homo sapiens
ucuucccacuccagc

SEQ ID NO: 1333050 - RNA, 14 nt, Homo sapiens
ucuucccaguauua

SEQ ID NO: 1333051 - RNA, 11 nt, Homo sapiens
ucuucccgccg

SEQ ID NO: 1333052 - RNA, 14 nt, Homo sapiens
ucuucuacacagca

SEQ ID NO: 1333053 - RNA, 19 nt, Homo sapiens
ucuucuauuaaucaagaga

SEQ ID NO: 1333054 - RNA, 16 nt, Homo sapiens
ucuucuccuccaugaa

SEQ ID NO: 1333055 - RNA, 22 nt, Homo sapiens
ucuucugaauauuuuaucuuuc

SEQ ID NO: 1333056 - RNA, 16 nt, Homo sapiens
ucuucugguguugacu

SEQ ID NO: 1333057 - RNA, 19 nt, Homo sapiens
ucuucuuuuuuugugaugu

SEQ ID NO: 1333058 - RNA, 14 nt, Homo sapiens
ucuugcauccaaac

SEQ ID NO: 1333059 - RNA, 14 nt, Homo sapiens
ucuugccugcucca

SEQ ID NO: 1333060 - RNA, 18 nt, Homo sapiens
ucuugcuauguugcccag

SEQ ID NO: 1333061 - RNA, 17 nt, Homo sapiens
ucuuggccaucuaaaca

SEQ ID NO: 1333062 - RNA, 16 nt, Homo sapiens
ucuuggcugaccccuc

SEQ ID NO: 1333063 - RNA, 13 nt, Homo sapiens
ucuuggggccacu

SEQ ID NO: 1333064 - RNA, 18 nt, Homo sapiens
ucuugguaaaacauuacu

SEQ ID NO: 1333065 - RNA, 17 nt, Homo sapiens
ucuugucccucuguaua

SEQ ID NO: 1333066 - RNA, 17 nt, Homo sapiens
ucuugucccuuucccua

SEQ ID NO: 1333067 - RNA, 18 nt, Homo sapiens
ucuuuaauaaauugcuua

SEQ ID NO: 1333068 - RNA, 23 nt, Homo sapiens
ucuuuagcaguuuccucagugau

SEQ ID NO: 1333069 - RNA, 17 nt, Homo sapiens
ucuuuagcuuaccuggg

SEQ ID NO: 1333070 - RNA, 17 nt, Homo sapiens
ucuuucgucuacugcaa

SEQ ID NO: 1333071 - RNA, 22 nt, Homo sapiens
ucuuucuuugcaccaaagacau

SEQ ID NO: 1333072 - RNA, 21 nt, Homo sapiens
ucuuucuuuucucugucuacu

SEQ ID NO: 1333073 - RNA, 17 nt, Homo sapiens
ucuuugcaccaaagaca

SEQ ID NO: 1333074 - RNA, 17 nt, Homo sapiens
ucuuugccuuuaucucu

SEQ ID NO: 1333075 - RNA, 13 nt, Homo sapiens
ucuuugcugccag

SEQ ID NO: 1333076 - RNA, 19 nt, Homo sapiens
ucuuugucagcaguucccu

SEQ ID NO: 1333077 - RNA, 15 nt, Homo sapiens
ucuuuguuucugcuu

SEQ ID NO: 1333078 - RNA, 19 nt, Homo sapiens
ucuuuucauaucucuugcc

SEQ ID NO: 1333079 - RNA, 18 nt, Homo sapiens
ucuuuucuucuauggggu

SEQ ID NO: 1333080 - RNA, 13 nt, Homo sapiens
ucuuuugcaggag

SEQ ID NO: 1333081 - RNA, 16 nt, Homo sapiens
ucuuuugucccagaaa

SEQ ID NO: 1333082 - RNA, 21 nt, Homo sapiens
ucuuuuuuaauaaacuacucu

SEQ ID NO: 1333083 - RNA, 13 nt, Homo sapiens
ugaaaaagacaua

SEQ ID NO: 1333084 - RNA, 23 nt, Homo sapiens
ugaaaaggugaagcuggcugugc

SEQ ID NO: 1333085 - RNA, 15 nt, Homo sapiens
ugaaaagucacuuac

SEQ ID NO: 1333086 - RNA, 20 nt, Homo sapiens
ugaaaauaacugaaccaaau

SEQ ID NO: 1333087 - RNA, 19 nt, Homo sapiens
ugaaaauauagacauucuc

SEQ ID NO: 1333088 - RNA, 12 nt, Homo sapiens
ugaaaauguuca

SEQ ID NO: 1333089 - RNA, 21 nt, Homo sapiens
ugaaacacaauaccuacaaua

SEQ ID NO: 1333090 - RNA, 19 nt, Homo sapiens
ugaaacagcugcccugugu

SEQ ID NO: 1333091 - RNA, 18 nt, Homo sapiens
ugaaacuccagaugccac

SEQ ID NO: 1333092 - RNA, 12 nt, Homo sapiens
ugaaacugugaa

SEQ ID NO: 1333093 - RNA, 14 nt, Homo sapiens
ugaaagaacuuaag

SEQ ID NO: 1333094 - RNA, 18 nt, Homo sapiens
ugaaagaggcagcuugaa

SEQ ID NO: 1333095 - RNA, 16 nt, Homo sapiens
ugaaagcaaguguuca

SEQ ID NO: 1333096 - RNA, 15 nt, Homo sapiens
ugaaagugaugauac

SEQ ID NO: 1333097 - RNA, 22 nt, Homo sapiens
ugaaauaaagauaaaugcaacc

SEQ ID NO: 1333098 - RNA, 20 nt, Homo sapiens
ugaaaucccugccucaggcc

SEQ ID NO: 1333099 - RNA, 19 nt, Homo sapiens
ugaaaugauuucacagugu

SEQ ID NO: 1333100 - RNA, 22 nt, Homo sapiens
ugaaauggaggaucucuaaaga

SEQ ID NO: 1333101 - RNA, 19 nt, Homo sapiens
ugaaauuaacucagacaca

SEQ ID NO: 1333102 - RNA, 18 nt, Homo sapiens
ugaaauuugagagacaaa

SEQ ID NO: 1333103 - RNA, 20 nt, Homo sapiens
ugaaauuugauaaacugaau

SEQ ID NO: 1333104 - RNA, 19 nt, Homo sapiens
ugaaauuuguuauacuuca

SEQ ID NO: 1333105 - RNA, 14 nt, Homo sapiens
ugaacacaucagcu

SEQ ID NO: 1333106 - RNA, 23 nt, Homo sapiens
ugaacagcuguucaguugcacuu

SEQ ID NO: 1333107 - RNA, 16 nt, Homo sapiens
ugaacagggcaguuua

SEQ ID NO: 1333108 - RNA, 17 nt, Homo sapiens
ugaacaucauggacuga

SEQ ID NO: 1333109 - RNA, 18 nt, Homo sapiens
ugaaccacauucagggaa

SEQ ID NO: 1333110 - RNA, 15 nt, Homo sapiens
ugaaccuagauugca

SEQ ID NO: 1333111 - RNA, 16 nt, Homo sapiens
ugaacuagccaaucag

SEQ ID NO: 1333112 - RNA, 18 nt, Homo sapiens
ugaacuagggaagcucag

SEQ ID NO: 1333113 - RNA, 16 nt, Homo sapiens
ugaacucacccuggga

SEQ ID NO: 1333114 - RNA, 13 nt, Homo sapiens
ugaacucagggag

SEQ ID NO: 1333115 - RNA, 23 nt, Homo sapiens
ugaagaaaauagucaguguucuu

SEQ ID NO: 1333116 - RNA, 17 nt, Homo sapiens
ugaagaaucugcucuga

SEQ ID NO: 1333117 - RNA, 17 nt, Homo sapiens
ugaagaaugcauucaaa

SEQ ID NO: 1333118 - RNA, 14 nt, Homo sapiens
ugaagacagaggca

SEQ ID NO: 1333119 - RNA, 17 nt, Homo sapiens
ugaagacccaaaacagc

SEQ ID NO: 1333120 - RNA, 19 nt, Homo sapiens
ugaagacccaaaacagcuu

SEQ ID NO: 1333121 - RNA, 14 nt, Homo sapiens
ugaagagcaaaggg

SEQ ID NO: 1333122 - RNA, 14 nt, Homo sapiens
ugaagaguuucaca

SEQ ID NO: 1333123 - RNA, 22 nt, Homo sapiens
ugaagauagaagguuugcagau

SEQ ID NO: 1333124 - RNA, 12 nt, Homo sapiens
ugaagcauuaug

SEQ ID NO: 1333125 - RNA, 21 nt, Homo sapiens
ugaagccuaccagaagaacua

SEQ ID NO: 1333126 - RNA, 18 nt, Homo sapiens
ugaagcuaaugucacaau

SEQ ID NO: 1333127 - RNA, 21 nt, Homo sapiens
ugaagcuuuaagaacuaaaau

SEQ ID NO: 1333128 - RNA, 16 nt, Homo sapiens
ugaaggauuacucucc

SEQ ID NO: 1333129 - RNA, 18 nt, Homo sapiens
ugaaggcagcagaauauu

SEQ ID NO: 1333130 - RNA, 13 nt, Homo sapiens
ugaaggggccaug

SEQ ID NO: 1333131 - RNA, 14 nt, Homo sapiens
ugaaggggccauga

SEQ ID NO: 1333132 - RNA, 19 nt, Homo sapiens
ugaaggguggucaguaguu

SEQ ID NO: 1333133 - RNA, 22 nt, Homo sapiens
ugaaggguggucaguaguuuca

SEQ ID NO: 1333134 - RNA, 22 nt, Homo sapiens
ugaagguaacuagaaagugagu

SEQ ID NO: 1333135 - RNA, 14 nt, Homo sapiens
ugaaguucacucag

SEQ ID NO: 1333136 - RNA, 21 nt, Homo sapiens
ugaauacauuaacggugcuaa

SEQ ID NO: 1333137 - RNA, 22 nt, Homo sapiens
ugaauagcagguaguuagcuuc

SEQ ID NO: 1333138 - RNA, 16 nt, Homo sapiens
ugaauauuauacuucu

SEQ ID NO: 1333139 - RNA, 17 nt, Homo sapiens
ugaaucauuaacagugc

SEQ ID NO: 1333140 - RNA, 21 nt, Homo sapiens
ugaauuuaucagcguauuuca

SEQ ID NO: 1333141 - RNA, 13 nt, Homo sapiens
ugaauuuucuuca

SEQ ID NO: 1333142 - RNA, 14 nt, Homo sapiens
ugaauuuuguugcu

SEQ ID NO: 1333143 - RNA, 20 nt, Homo sapiens
ugacaacugugaagccaccc

SEQ ID NO: 1333144 - RNA, 16 nt, Homo sapiens
ugacaauuugugauau

SEQ ID NO: 1333145 - RNA, 13 nt, Homo sapiens
ugacacagucuug

SEQ ID NO: 1333146 - RNA, 14 nt, Homo sapiens
ugacacccaugcca

SEQ ID NO: 1333147 - RNA, 19 nt, Homo sapiens
ugacaccccugacuuuuau

SEQ ID NO: 1333148 - RNA, 23 nt, Homo sapiens
ugacaccgugggucauuacaaaa

SEQ ID NO: 1333149 - RNA, 14 nt, Homo sapiens
ugacaccuuucaua

SEQ ID NO: 1333150 - RNA, 20 nt, Homo sapiens
ugacagacuuagaaccugag

SEQ ID NO: 1333151 - RNA, 16 nt, Homo sapiens
ugacagacuuuggaca

SEQ ID NO: 1333152 - RNA, 17 nt, Homo sapiens
ugacagccuucuugaug

SEQ ID NO: 1333153 - RNA, 17 nt, Homo sapiens
ugacaguccacaggggc

SEQ ID NO: 1333154 - RNA, 19 nt, Homo sapiens
ugacaguccacaggggcca

SEQ ID NO: 1333155 - RNA, 13 nt, Homo sapiens
ugacauaauaaua

SEQ ID NO: 1333156 - RNA, 16 nt, Homo sapiens
ugacauauuaugccug

SEQ ID NO: 1333157 - RNA, 17 nt, Homo sapiens
ugacauauuaugccuga

SEQ ID NO: 1333158 - RNA, 19 nt, Homo sapiens
ugacaucccuuccuggaaa

SEQ ID NO: 1333159 - RNA, 19 nt, Homo sapiens
ugacaugcauucacauauc

SEQ ID NO: 1333160 - RNA, 20 nt, Homo sapiens
ugacaugcauucacauaucu

SEQ ID NO: 1333161 - RNA, 17 nt, Homo sapiens
ugacauucacacagaga

SEQ ID NO: 1333162 - RNA, 21 nt, Homo sapiens
ugaccccuucccuguccuugc

SEQ ID NO: 1333163 - RNA, 20 nt, Homo sapiens
ugacccucaggcacaccuug

SEQ ID NO: 1333164 - RNA, 20 nt, Homo sapiens
ugaccucaggugaucugccc

SEQ ID NO: 1333165 - RNA, 20 nt, Homo sapiens
ugaccucugacaacugugaa

SEQ ID NO: 1333166 - RNA, 19 nt, Homo sapiens
ugaccugauuuccauuugc

SEQ ID NO: 1333167 - RNA, 15 nt, Homo sapiens
ugaccuguguucccu

SEQ ID NO: 1333168 - RNA, 17 nt, Homo sapiens
ugaccuuaaaugcaacc

SEQ ID NO: 1333169 - RNA, 14 nt, Homo sapiens
ugacucagugacca

SEQ ID NO: 1333170 - RNA, 15 nt, Homo sapiens
ugacucagugaccag

SEQ ID NO: 1333171 - RNA, 18 nt, Homo sapiens
ugacuccccagcccagca

SEQ ID NO: 1333172 - RNA, 20 nt, Homo sapiens
ugacuccccccaucccugcc

SEQ ID NO: 1333173 - RNA, 15 nt, Homo sapiens
ugacuuaagcugccu

SEQ ID NO: 1333174 - RNA, 14 nt, Homo sapiens
ugacuuugccaaaa

SEQ ID NO: 1333175 - RNA, 13 nt, Homo sapiens
ugagaaacagcuc

SEQ ID NO: 1333176 - RNA, 18 nt, Homo sapiens
ugagaaagacuauucaaa

SEQ ID NO: 1333177 - RNA, 17 nt, Homo sapiens
ugagaaagggauugcug

SEQ ID NO: 1333178 - RNA, 23 nt, Homo sapiens
ugagaagauaaaaacugcccauu

SEQ ID NO: 1333179 - RNA, 17 nt, Homo sapiens
ugagaagugcacuuuaa

SEQ ID NO: 1333180 - RNA, 17 nt, Homo sapiens
ugagaccagccugggca

SEQ ID NO: 1333181 - RNA, 23 nt, Homo sapiens
ugagagggagggcugcugccaca

SEQ ID NO: 1333182 - RNA, 18 nt, Homo sapiens
ugagauauacgcccucuu

SEQ ID NO: 1333183 - RNA, 23 nt, Homo sapiens
ugagauguugagaggaacaagaa

SEQ ID NO: 1333184 - RNA, 22 nt, Homo sapiens
ugagcaaauaaacuuacagauc

SEQ ID NO: 1333185 - RNA, 15 nt, Homo sapiens
ugagcaagacauacu

SEQ ID NO: 1333186 - RNA, 16 nt, Homo sapiens
ugagcaauuguagggc

SEQ ID NO: 1333187 - RNA, 19 nt, Homo sapiens
ugagcaguuguuauauuca

SEQ ID NO: 1333188 - RNA, 17 nt, Homo sapiens
ugagcauuuuuaaggga

SEQ ID NO: 1333189 - RNA, 22 nt, Homo sapiens
ugagcgucagcauccagguuua

SEQ ID NO: 1333190 - RNA, 14 nt, Homo sapiens
ugagcuaacuuaua

SEQ ID NO: 1333191 - RNA, 15 nt, Homo sapiens
ugagcucuucccuua

SEQ ID NO: 1333192 - RNA, 19 nt, Homo sapiens
ugagcuggcaaccagccag

SEQ ID NO: 1333193 - RNA, 14 nt, Homo sapiens
ugagcuggggacuc

SEQ ID NO: 1333194 - RNA, 20 nt, Homo sapiens
ugagcuggggacucagggac

SEQ ID NO: 1333195 - RNA, 18 nt, Homo sapiens
ugagcuggggaugucucu

SEQ ID NO: 1333196 - RNA, 18 nt, Homo sapiens
ugagcuuccccaagcacg

SEQ ID NO: 1333197 - RNA, 14 nt, Homo sapiens
ugagcuugcucauu

SEQ ID NO: 1333198 - RNA, 17 nt, Homo sapiens
ugaggaaggacuugacu

SEQ ID NO: 1333199 - RNA, 16 nt, Homo sapiens
ugaggcccauucuuca

SEQ ID NO: 1333200 - RNA, 21 nt, Homo sapiens
ugaggcccauucuucacucuu

SEQ ID NO: 1333201 - RNA, 13 nt, Homo sapiens
ugaggccucucau

SEQ ID NO: 1333202 - RNA, 17 nt, Homo sapiens
ugaggcuucuccuucuc

SEQ ID NO: 1333203 - RNA, 14 nt, Homo sapiens
ugagggaagcaaua

SEQ ID NO: 1333204 - RNA, 15 nt, Homo sapiens
ugagggccaccucca

SEQ ID NO: 1333205 - RNA, 15 nt, Homo sapiens
ugaggggcucucuca

SEQ ID NO: 1333206 - RNA, 21 nt, Homo sapiens
ugagggucgugggaaagggga

SEQ ID NO: 1333207 - RNA, 21 nt, Homo sapiens
ugagggugggggugcucucuc

SEQ ID NO: 1333208 - RNA, 21 nt, Homo sapiens
ugagguaccaguuguauuuaa

SEQ ID NO: 1333209 - RNA, 21 nt, Homo sapiens
ugagguuucuuugacuucaau

SEQ ID NO: 1333210 - RNA, 20 nt, Homo sapiens
ugaguagcuggauuacaggc

SEQ ID NO: 1333211 - RNA, 22 nt, Homo sapiens
ugaguagcuggauuacaggcau

SEQ ID NO: 1333212 - RNA, 21 nt, Homo sapiens
ugaguagcugggauuacaggc

SEQ ID NO: 1333213 - RNA, 16 nt, Homo sapiens
ugaguagggcaaugga

SEQ ID NO: 1333214 - RNA, 14 nt, Homo sapiens
ugaguaugugaaga

SEQ ID NO: 1333215 - RNA, 19 nt, Homo sapiens
ugagucauuauguagcugu

SEQ ID NO: 1333216 - RNA, 11 nt, Homo sapiens
ugagugcaagg

SEQ ID NO: 1333217 - RNA, 19 nt, Homo sapiens
ugagugcaccugccuccac

SEQ ID NO: 1333218 - RNA, 23 nt, Homo sapiens
ugaguuccucugcaguuuugaca

SEQ ID NO: 1333219 - RNA, 16 nt, Homo sapiens
ugauaaaagauggcca

SEQ ID NO: 1333220 - RNA, 12 nt, Homo sapiens
ugauaaacugaa

SEQ ID NO: 1333221 - RNA, 13 nt, Homo sapiens
ugauaaacugaau

SEQ ID NO: 1333222 - RNA, 17 nt, Homo sapiens
ugauaagcugagcuccu

SEQ ID NO: 1333223 - RNA, 16 nt, Homo sapiens
ugauaccacgaggaaa

SEQ ID NO: 1333224 - RNA, 17 nt, Homo sapiens
ugauauauuccaccagg

SEQ ID NO: 1333225 - RNA, 15 nt, Homo sapiens
ugauaucaacagcuu

SEQ ID NO: 1333226 - RNA, 19 nt, Homo sapiens
ugauauuuucacacuggua

SEQ ID NO: 1333227 - RNA, 18 nt, Homo sapiens
ugaucaucgaggagcuag

SEQ ID NO: 1333228 - RNA, 22 nt, Homo sapiens
ugaucaucgaggagcuagaaca

SEQ ID NO: 1333229 - RNA, 12 nt, Homo sapiens
ugauccauaaag

SEQ ID NO: 1333230 - RNA, 22 nt, Homo sapiens
ugauccguguguaccaucuuug

SEQ ID NO: 1333231 - RNA, 16 nt, Homo sapiens
ugaucugggucucuaa

SEQ ID NO: 1333232 - RNA, 17 nt, Homo sapiens
ugaugaaaacuuucuaa

SEQ ID NO: 1333233 - RNA, 22 nt, Homo sapiens
ugaugaaccagaguuucuuggu

SEQ ID NO: 1333234 - RNA, 17 nt, Homo sapiens
ugaugaacgggcuggag

SEQ ID NO: 1333235 - RNA, 17 nt, Homo sapiens
ugaugagggaagcaaua

SEQ ID NO: 1333236 - RNA, 13 nt, Homo sapiens
ugaugauacuucc

SEQ ID NO: 1333237 - RNA, 17 nt, Homo sapiens
ugaugccuguguacugc

SEQ ID NO: 1333238 - RNA, 19 nt, Homo sapiens
ugauggugacauugcaccu

SEQ ID NO: 1333239 - RNA, 17 nt, Homo sapiens
ugauuaguugacaguau

SEQ ID NO: 1333240 - RNA, 15 nt, Homo sapiens
ugauuguauuuaccu

SEQ ID NO: 1333241 - RNA, 15 nt, Homo sapiens
ugauuucacagugug

SEQ ID NO: 1333242 - RNA, 18 nt, Homo sapiens
ugauuucuuucuuugcac

SEQ ID NO: 1333243 - RNA, 23 nt, Homo sapiens
ugauuuuacucauauguggaauc

SEQ ID NO: 1333244 - RNA, 13 nt, Homo sapiens
ugauuuuacuuaa

SEQ ID NO: 1333245 - RNA, 14 nt, Homo sapiens
ugauuuuacuuaac

SEQ ID NO: 1333246 - RNA, 16 nt, Homo sapiens
ugcaaaacuccaggca

SEQ ID NO: 1333247 - RNA, 20 nt, Homo sapiens
ugcaaaagugaaacauacaa

SEQ ID NO: 1333248 - RNA, 14 nt, Homo sapiens
ugcaaagcauuuga

SEQ ID NO: 1333249 - RNA, 19 nt, Homo sapiens
ugcaaaggcgucugaaugu

SEQ ID NO: 1333250 - RNA, 20 nt, Homo sapiens
ugcaaaguucccuacuuccu

SEQ ID NO: 1333251 - RNA, 15 nt, Homo sapiens
ugcaaauacaaucag

SEQ ID NO: 1333252 - RNA, 16 nt, Homo sapiens
ugcaaauacaaucagc

SEQ ID NO: 1333253 - RNA, 19 nt, Homo sapiens
ugcaacaggaagacacugg

SEQ ID NO: 1333254 - RNA, 12 nt, Homo sapiens
ugcaacuacuau

SEQ ID NO: 1333255 - RNA, 16 nt, Homo sapiens
ugcaacuacuauucaa

SEQ ID NO: 1333256 - RNA, 18 nt, Homo sapiens
ugcaacuggaguuccuua

SEQ ID NO: 1333257 - RNA, 12 nt, Homo sapiens
ugcaagauucca

SEQ ID NO: 1333258 - RNA, 22 nt, Homo sapiens
ugcaagcgaaauuaaaucugaa

SEQ ID NO: 1333259 - RNA, 14 nt, Homo sapiens
ugcaaggggcucaa

SEQ ID NO: 1333260 - RNA, 18 nt, Homo sapiens
ugcaauaacucagcaguu

SEQ ID NO: 1333261 - RNA, 14 nt, Homo sapiens
ugcaaugcaugaua

SEQ ID NO: 1333262 - RNA, 12 nt, Homo sapiens
ugcacaacagcc

SEQ ID NO: 1333263 - RNA, 14 nt, Homo sapiens
ugcacaucuacaca

SEQ ID NO: 1333264 - RNA, 16 nt, Homo sapiens
ugcaccccugagccag

SEQ ID NO: 1333265 - RNA, 20 nt, Homo sapiens
ugcaccuaucucagccauag

SEQ ID NO: 1333266 - RNA, 14 nt, Homo sapiens
ugcaccuggaugua

SEQ ID NO: 1333267 - RNA, 18 nt, Homo sapiens
ugcacgcucaaugcccag

SEQ ID NO: 1333268 - RNA, 18 nt, Homo sapiens
ugcacucagcucuuggcu

SEQ ID NO: 1333269 - RNA, 18 nt, Homo sapiens
ugcacucuagccuggcaa

SEQ ID NO: 1333270 - RNA, 19 nt, Homo sapiens
ugcacucuagccuggcaac

SEQ ID NO: 1333271 - RNA, 13 nt, Homo sapiens
ugcacuguagggu

SEQ ID NO: 1333272 - RNA, 15 nt, Homo sapiens
ugcacuuguuauauu

SEQ ID NO: 1333273 - RNA, 17 nt, Homo sapiens
ugcagaaggaaagaagg

SEQ ID NO: 1333274 - RNA, 14 nt, Homo sapiens
ugcagauacuuuga

SEQ ID NO: 1333275 - RNA, 15 nt, Homo sapiens
ugcagauacuuugaa

SEQ ID NO: 1333276 - RNA, 22 nt, Homo sapiens
ugcagaugcaagccuguaucag

SEQ ID NO: 1333277 - RNA, 14 nt, Homo sapiens
ugcagauuugauau

SEQ ID NO: 1333278 - RNA, 16 nt, Homo sapiens
ugcagcauuucacuua

SEQ ID NO: 1333279 - RNA, 13 nt, Homo sapiens
ugcagcucaaggg

SEQ ID NO: 1333280 - RNA, 14 nt, Homo sapiens
ugcagcucagggac

SEQ ID NO: 1333281 - RNA, 19 nt, Homo sapiens
ugcaggaccucgugccacc

SEQ ID NO: 1333282 - RNA, 16 nt, Homo sapiens
ugcaggcuuuuccucc

SEQ ID NO: 1333283 - RNA, 12 nt, Homo sapiens
ugcagggccauc

SEQ ID NO: 1333284 - RNA, 21 nt, Homo sapiens
ugcagggggugugucugcuca

SEQ ID NO: 1333285 - RNA, 20 nt, Homo sapiens
ugcaguagugcaccaucuca

SEQ ID NO: 1333286 - RNA, 18 nt, Homo sapiens
ugcaguaucucccauaaa

SEQ ID NO: 1333287 - RNA, 19 nt, Homo sapiens
ugcaguaucucccauaaac

SEQ ID NO: 1333288 - RNA, 16 nt, Homo sapiens
ugcagucccacacugu

SEQ ID NO: 1333289 - RNA, 21 nt, Homo sapiens
ugcaguguuucccucuguguu

SEQ ID NO: 1333290 - RNA, 13 nt, Homo sapiens
ugcaguuaccaca

SEQ ID NO: 1333291 - RNA, 14 nt, Homo sapiens
ugcaguuuugacau

SEQ ID NO: 1333292 - RNA, 15 nt, Homo sapiens
ugcauaggcucuuaa

SEQ ID NO: 1333293 - RNA, 22 nt, Homo sapiens
ugcauauuauaaaggauaaaga

SEQ ID NO: 1333294 - RNA, 15 nt, Homo sapiens
ugcaucugaccagca

SEQ ID NO: 1333295 - RNA, 17 nt, Homo sapiens
ugcaucuuccacuggaa

SEQ ID NO: 1333296 - RNA, 14 nt, Homo sapiens
ugcauguaucuucu

SEQ ID NO: 1333297 - RNA, 18 nt, Homo sapiens
ugcauucguaaacaccaa

SEQ ID NO: 1333298 - RNA, 21 nt, Homo sapiens
ugcauucguaaacaccaaaua

SEQ ID NO: 1333299 - RNA, 23 nt, Homo sapiens
ugcauucguaaacaccaaauacc

SEQ ID NO: 1333300 - RNA, 15 nt, Homo sapiens
ugcauucucuauaga

SEQ ID NO: 1333301 - RNA, 17 nt, Homo sapiens
ugcauugccuguaacaa

SEQ ID NO: 1333302 - RNA, 16 nt, Homo sapiens
ugcauuugcagugcau

SEQ ID NO: 1333303 - RNA, 10 nt, Homo sapiens
ugccaaaaaa

SEQ ID NO: 1333304 - RNA, 15 nt, Homo sapiens
ugccaaaaaaagaca

SEQ ID NO: 1333305 - RNA, 17 nt, Homo sapiens
ugccaaaaagcauacaa

SEQ ID NO: 1333306 - RNA, 12 nt, Homo sapiens
ugccaagccaga

SEQ ID NO: 1333307 - RNA, 20 nt, Homo sapiens
ugccaaggggcugagugagu

SEQ ID NO: 1333308 - RNA, 12 nt, Homo sapiens
ugccacagugug

SEQ ID NO: 1333309 - RNA, 17 nt, Homo sapiens
ugccaccagcauccaca

SEQ ID NO: 1333310 - RNA, 22 nt, Homo sapiens
ugccacuuccuuuuaacugcca

SEQ ID NO: 1333311 - RNA, 14 nt, Homo sapiens
ugccagcaaauaaa

SEQ ID NO: 1333312 - RNA, 21 nt, Homo sapiens
ugccaggccugggaccuccca

SEQ ID NO: 1333313 - RNA, 17 nt, Homo sapiens
ugccauccagccagaac

SEQ ID NO: 1333314 - RNA, 15 nt, Homo sapiens
ugcccaaaacuguca

SEQ ID NO: 1333315 - RNA, 21 nt, Homo sapiens
ugcccaaccugcucuccucuu

SEQ ID NO: 1333316 - RNA, 21 nt, Homo sapiens
ugccccacaaaacuucagugu

SEQ ID NO: 1333317 - RNA, 23 nt, Homo sapiens
ugccccacaaaacuucagugugg

SEQ ID NO: 1333318 - RNA, 14 nt, Homo sapiens
ugcccccuccacug

SEQ ID NO: 1333319 - RNA, 15 nt, Homo sapiens
ugccccucucucagu

SEQ ID NO: 1333320 - RNA, 16 nt, Homo sapiens
ugcccucgagcacuga

SEQ ID NO: 1333321 - RNA, 22 nt, Homo sapiens
ugcccuuuguggaaagucacag

SEQ ID NO: 1333322 - RNA, 20 nt, Homo sapiens
ugccgaguggucacugucag

SEQ ID NO: 1333323 - RNA, 20 nt, Homo sapiens
ugccuaaauuuaaugcugcc

SEQ ID NO: 1333324 - RNA, 13 nt, Homo sapiens
ugccuaaccuggg

SEQ ID NO: 1333325 - RNA, 13 nt, Homo sapiens
ugccuccaccagc

SEQ ID NO: 1333326 - RNA, 16 nt, Homo sapiens
ugccuccagugcaguc

SEQ ID NO: 1333327 - RNA, 20 nt, Homo sapiens
ugccucccuuaaucugccag

SEQ ID NO: 1333328 - RNA, 21 nt, Homo sapiens
ugccucucaauucgcugaaaa

SEQ ID NO: 1333329 - RNA, 12 nt, Homo sapiens
ugccuggaagaa

SEQ ID NO: 1333330 - RNA, 14 nt, Homo sapiens
ugccuggacacugu

SEQ ID NO: 1333331 - RNA, 15 nt, Homo sapiens
ugccuggacacugua

SEQ ID NO: 1333332 - RNA, 19 nt, Homo sapiens
ugccuggcacagaccaggc

SEQ ID NO: 1333333 - RNA, 19 nt, Homo sapiens
ugccuggcuagucccugcc

SEQ ID NO: 1333334 - RNA, 13 nt, Homo sapiens
ugccugggcucag

SEQ ID NO: 1333335 - RNA, 21 nt, Homo sapiens
ugccugugugggacugagaug

SEQ ID NO: 1333336 - RNA, 21 nt, Homo sapiens
ugccuuaaacacacauugcag

SEQ ID NO: 1333337 - RNA, 13 nt, Homo sapiens
ugccuucucagga

SEQ ID NO: 1333338 - RNA, 21 nt, Homo sapiens
ugccuucuccuauuucuccaa

SEQ ID NO: 1333339 - RNA, 15 nt, Homo sapiens
ugccuucugcugaaa

SEQ ID NO: 1333340 - RNA, 14 nt, Homo sapiens
ugccuuuuauguaa

SEQ ID NO: 1333341 - RNA, 12 nt, Homo sapiens
ugcgaugcagcg

SEQ ID NO: 1333342 - RNA, 19 nt, Homo sapiens
ugcgccaccucacugcagu

SEQ ID NO: 1333343 - RNA, 15 nt, Homo sapiens
ugcgccuaauguguu

SEQ ID NO: 1333344 - RNA, 15 nt, Homo sapiens
ugcgcucccaccuca

SEQ ID NO: 1333345 - RNA, 14 nt, Homo sapiens
ugcgcuguguacaa

SEQ ID NO: 1333346 - RNA, 15 nt, Homo sapiens
ugcgcuguguacaau

SEQ ID NO: 1333347 - RNA, 11 nt, Homo sapiens
ugcggcugugc

SEQ ID NO: 1333348 - RNA, 18 nt, Homo sapiens
ugcggggggcaccagagg

SEQ ID NO: 1333349 - RNA, 13 nt, Homo sapiens
ugcguguguuugg

SEQ ID NO: 1333350 - RNA, 15 nt, Homo sapiens
ugcuaacuggguuaa

SEQ ID NO: 1333351 - RNA, 14 nt, Homo sapiens
ugcuaauaccaaaa

SEQ ID NO: 1333352 - RNA, 16 nt, Homo sapiens
ugcuaaugacagccuu

SEQ ID NO: 1333353 - RNA, 20 nt, Homo sapiens
ugcuaaugacagccuugcaa

SEQ ID NO: 1333354 - RNA, 17 nt, Homo sapiens
ugcuacaaaaacacagc

SEQ ID NO: 1333355 - RNA, 14 nt, Homo sapiens
ugcuaucagcaaug

SEQ ID NO: 1333356 - RNA, 19 nt, Homo sapiens
ugcuaugaagcguugaugg

SEQ ID NO: 1333357 - RNA, 21 nt, Homo sapiens
ugcuaugauguuaguuuuccu

SEQ ID NO: 1333358 - RNA, 22 nt, Homo sapiens
ugcuauucccuggggcugcugu

SEQ ID NO: 1333359 - RNA, 20 nt, Homo sapiens
ugcuauucuaacuaaugaca

SEQ ID NO: 1333360 - RNA, 21 nt, Homo sapiens
ugcucaaaauugcuucuaaaa

SEQ ID NO: 1333361 - RNA, 22 nt, Homo sapiens
ugcucaaccccccucccagaca

SEQ ID NO: 1333362 - RNA, 17 nt, Homo sapiens
ugcucacacauuacaac

SEQ ID NO: 1333363 - RNA, 21 nt, Homo sapiens
ugcucagcccugcaccaugcu

SEQ ID NO: 1333364 - RNA, 12 nt, Homo sapiens
ugcuccaucuca

SEQ ID NO: 1333365 - RNA, 13 nt, Homo sapiens
ugcuccaucucau

SEQ ID NO: 1333366 - RNA, 19 nt, Homo sapiens
ugcuccguagcucugcugc

SEQ ID NO: 1333367 - RNA, 21 nt, Homo sapiens
ugcuccuagagggaggggccu

SEQ ID NO: 1333368 - RNA, 15 nt, Homo sapiens
ugcucuauacugugg

SEQ ID NO: 1333369 - RNA, 21 nt, Homo sapiens
ugcucugaauaugucaucacu

SEQ ID NO: 1333370 - RNA, 17 nt, Homo sapiens
ugcugcuugaugaugag

SEQ ID NO: 1333371 - RNA, 16 nt, Homo sapiens
ugcuggaaaugcugac

SEQ ID NO: 1333372 - RNA, 13 nt, Homo sapiens
ugcuggugcauca

SEQ ID NO: 1333373 - RNA, 18 nt, Homo sapiens
ugcuguacugagcacuga

SEQ ID NO: 1333374 - RNA, 20 nt, Homo sapiens
ugcuguagacauuugcuaug

SEQ ID NO: 1333375 - RNA, 20 nt, Homo sapiens
ugcuguauaugcaaugucca

SEQ ID NO: 1333376 - RNA, 19 nt, Homo sapiens
ugcuguaugugagcuguaa

SEQ ID NO: 1333377 - RNA, 16 nt, Homo sapiens
ugcuguuaacuguuaa

SEQ ID NO: 1333378 - RNA, 19 nt, Homo sapiens
ugcuguucuucaguccuuu

SEQ ID NO: 1333379 - RNA, 15 nt, Homo sapiens
ugcuguuuugccagc

SEQ ID NO: 1333380 - RNA, 21 nt, Homo sapiens
ugcuuaauuuaaauagcauua

SEQ ID NO: 1333381 - RNA, 18 nt, Homo sapiens
ugcuuacacggaugccuu

SEQ ID NO: 1333382 - RNA, 17 nt, Homo sapiens
ugcuuagagacuaucaa

SEQ ID NO: 1333383 - RNA, 19 nt, Homo sapiens
ugcuugacaugguuuccaa

SEQ ID NO: 1333384 - RNA, 18 nt, Homo sapiens
ugcuugcccgcucccaca

SEQ ID NO: 1333385 - RNA, 12 nt, Homo sapiens
ugcuuggaugua

SEQ ID NO: 1333386 - RNA, 18 nt, Homo sapiens
ugcuuuguaggugucuca

SEQ ID NO: 1333387 - RNA, 17 nt, Homo sapiens
ugcuuuguaugcacuuu

SEQ ID NO: 1333388 - RNA, 15 nt, Homo sapiens
ugcuuuuacuucucu

SEQ ID NO: 1333389 - RNA, 14 nt, Homo sapiens
ugcuuuucuguccu

SEQ ID NO: 1333390 - RNA, 15 nt, Homo sapiens
ugcuuuuugucaugu

SEQ ID NO: 1333391 - RNA, 17 nt, Homo sapiens
ugcuuuuuuaaauauua

SEQ ID NO: 1333392 - RNA, 23 nt, Homo sapiens
uggaaaaacaggaaaggagcaau

SEQ ID NO: 1333393 - RNA, 19 nt, Homo sapiens
uggaaacauuggugaugcu

SEQ ID NO: 1333394 - RNA, 15 nt, Homo sapiens
uggaaagcacaagac

SEQ ID NO: 1333395 - RNA, 20 nt, Homo sapiens
uggaaauuugggagagccau

SEQ ID NO: 1333396 - RNA, 23 nt, Homo sapiens
uggaacgcuaaugaaacacagcu

SEQ ID NO: 1333397 - RNA, 19 nt, Homo sapiens
uggaagaaauggcuaugaa

SEQ ID NO: 1333398 - RNA, 17 nt, Homo sapiens
uggaagaagaaaggacu

SEQ ID NO: 1333399 - RNA, 16 nt, Homo sapiens
uggaagagcacaagag

SEQ ID NO: 1333400 - RNA, 19 nt, Homo sapiens
uggaauacacaugcaggac

SEQ ID NO: 1333401 - RNA, 15 nt, Homo sapiens
uggaauaucacccaa

SEQ ID NO: 1333402 - RNA, 21 nt, Homo sapiens
uggacacaauaggucuuucuc

SEQ ID NO: 1333403 - RNA, 22 nt, Homo sapiens
uggacaggcgccuggugugagg

SEQ ID NO: 1333404 - RNA, 20 nt, Homo sapiens
uggacccugacuguauacag

SEQ ID NO: 1333405 - RNA, 23 nt, Homo sapiens
uggacccugacuguauacagaau

SEQ ID NO: 1333406 - RNA, 13 nt, Homo sapiens
uggacgggaugac

SEQ ID NO: 1333407 - RNA, 16 nt, Homo sapiens
uggagaacaacaaaua

SEQ ID NO: 1333408 - RNA, 23 nt, Homo sapiens
uggagaaccagggcucuucucag

SEQ ID NO: 1333409 - RNA, 15 nt, Homo sapiens
uggagaagaggaaga

SEQ ID NO: 1333410 - RNA, 18 nt, Homo sapiens
uggagaaguaguauuugc

SEQ ID NO: 1333411 - RNA, 22 nt, Homo sapiens
uggagaaguggcaucagucaac

SEQ ID NO: 1333412 - RNA, 14 nt, Homo sapiens
uggagacaaacuug

SEQ ID NO: 1333413 - RNA, 17 nt, Homo sapiens
uggagagaaagugacau

SEQ ID NO: 1333414 - RNA, 17 nt, Homo sapiens
uggagaguacauuugcu

SEQ ID NO: 1333415 - RNA, 23 nt, Homo sapiens
uggagauuuaucucuguuuccuu

SEQ ID NO: 1333416 - RNA, 18 nt, Homo sapiens
uggagcaauaaaagacaa

SEQ ID NO: 1333417 - RNA, 23 nt, Homo sapiens
uggagcaauaaaagacaaaugca

SEQ ID NO: 1333418 - RNA, 19 nt, Homo sapiens
uggagcaggagccccgcca

SEQ ID NO: 1333419 - RNA, 16 nt, Homo sapiens
uggagcauaguggcaa

SEQ ID NO: 1333420 - RNA, 18 nt, Homo sapiens
uggagccugggguguccu

SEQ ID NO: 1333421 - RNA, 15 nt, Homo sapiens
uggagcuaaaacugg

SEQ ID NO: 1333422 - RNA, 22 nt, Homo sapiens
uggaggacaaauaagaaaugaa

SEQ ID NO: 1333423 - RNA, 19 nt, Homo sapiens
uggagggaagaccugaaag

SEQ ID NO: 1333424 - RNA, 23 nt, Homo sapiens
uggaguuucucucuuguugucca

SEQ ID NO: 1333425 - RNA, 23 nt, Homo sapiens
uggaugucuccaucucugucuca

SEQ ID NO: 1333426 - RNA, 17 nt, Homo sapiens
uggcaaacauuuuucca

SEQ ID NO: 1333427 - RNA, 21 nt, Homo sapiens
uggcaacagagcgagauucca

SEQ ID NO: 1333428 - RNA, 20 nt, Homo sapiens
uggcaacaugaagaaugcau

SEQ ID NO: 1333429 - RNA, 17 nt, Homo sapiens
uggcaagaucauagcuc

SEQ ID NO: 1333430 - RNA, 23 nt, Homo sapiens
uggcaaucucagaugcaguuugg

SEQ ID NO: 1333431 - RNA, 19 nt, Homo sapiens
uggcacucagggagcauuu

SEQ ID NO: 1333432 - RNA, 22 nt, Homo sapiens
uggcagacuagagucugagaug

SEQ ID NO: 1333433 - RNA, 16 nt, Homo sapiens
uggccaaggagcugcu

SEQ ID NO: 1333434 - RNA, 19 nt, Homo sapiens
uggccaaggagcugcuaua

SEQ ID NO: 1333435 - RNA, 13 nt, Homo sapiens
uggccaaugagau

SEQ ID NO: 1333436 - RNA, 19 nt, Homo sapiens
uggccacagaggacucacu

SEQ ID NO: 1333437 - RNA, 18 nt, Homo sapiens
uggccaggcuggucucaa

SEQ ID NO: 1333438 - RNA, 19 nt, Homo sapiens
uggccagugagaucaaugu

SEQ ID NO: 1333439 - RNA, 19 nt, Homo sapiens
uggccaguuuguuccucua

SEQ ID NO: 1333440 - RNA, 22 nt, Homo sapiens
uggccaugucgccaaaaauaca

SEQ ID NO: 1333441 - RNA, 18 nt, Homo sapiens
uggcccgcuggauuccca

SEQ ID NO: 1333442 - RNA, 14 nt, Homo sapiens
uggcccuaugcuuc

SEQ ID NO: 1333443 - RNA, 18 nt, Homo sapiens
uggcccugccguuucccc

SEQ ID NO: 1333444 - RNA, 20 nt, Homo sapiens
uggcccugggggucugggcg

SEQ ID NO: 1333445 - RNA, 20 nt, Homo sapiens
uggccuauuuaucugaucaa

SEQ ID NO: 1333446 - RNA, 20 nt, Homo sapiens
uggccucccugcugugccau

SEQ ID NO: 1333447 - RNA, 15 nt, Homo sapiens
uggccuccuaugccu

SEQ ID NO: 1333448 - RNA, 14 nt, Homo sapiens
uugaugguauucau

SEQ ID NO: 1333449 - RNA, 14 nt, Homo sapiens
uugauuacuuccac

SEQ ID NO: 1333450 - RNA, 15 nt, Homo sapiens
uugauuacuuccacu

SEQ ID NO: 1333451 - RNA, 23 nt, Homo sapiens
uugcacagcucuccggucucucu

SEQ ID NO: 1333452 - RNA, 12 nt, Homo sapiens
uugcaccaaaga

SEQ ID NO: 1333453 - RNA, 15 nt, Homo sapiens
uugcaccauugcacu

SEQ ID NO: 1333454 - RNA, 17 nt, Homo sapiens
uugcaccuaucucagcc

SEQ ID NO: 1333455 - RNA, 20 nt, Homo sapiens
uugcagcggcuccugcaaaa

SEQ ID NO: 1333456 - RNA, 18 nt, Homo sapiens
uugcagugaaagcuuuca

SEQ ID NO: 1333457 - RNA, 21 nt, Homo sapiens
uugcagugaaccuagauugca

SEQ ID NO: 1333458 - RNA, 18 nt, Homo sapiens
uugccaaggaauguaaau

SEQ ID NO: 1333459 - RNA, 13 nt, Homo sapiens
uugcccaccccuc

SEQ ID NO: 1333460 - RNA, 21 nt, Homo sapiens
uugcccaggcuagagugcaau

SEQ ID NO: 1333461 - RNA, 17 nt, Homo sapiens
uugcccccagacuuccu

SEQ ID NO: 1333462 - RNA, 17 nt, Homo sapiens
uugccgcgucgcccucc

SEQ ID NO: 1333463 - RNA, 12 nt, Homo sapiens
uugccgcuguau

SEQ ID NO: 1333464 - RNA, 16 nt, Homo sapiens
uugccgcuguauaaag

SEQ ID NO: 1333465 - RNA, 16 nt, Homo sapiens
uugccucguguaacau

SEQ ID NO: 1333466 - RNA, 20 nt, Homo sapiens
uugccuuauuggcagcucua

SEQ ID NO: 1333467 - RNA, 20 nt, Homo sapiens
uugccuucuccacuuuggga

SEQ ID NO: 1333468 - RNA, 14 nt, Homo sapiens
uugcuagccagcau

SEQ ID NO: 1333469 - RNA, 13 nt, Homo sapiens
uugcucuccuaga

SEQ ID NO: 1333470 - RNA, 17 nt, Homo sapiens
uugcucugaauauguca

SEQ ID NO: 1333471 - RNA, 14 nt, Homo sapiens
uugcucugcauuua

SEQ ID NO: 1333472 - RNA, 17 nt, Homo sapiens
uugcugagagccauuuu

SEQ ID NO: 1333473 - RNA, 13 nt, Homo sapiens
uugcugaugguga

SEQ ID NO: 1333474 - RNA, 16 nt, Homo sapiens
uugcuguuaaucugau

SEQ ID NO: 1333475 - RNA, 15 nt, Homo sapiens
uuggaacacccugga

SEQ ID NO: 1333476 - RNA, 22 nt, Homo sapiens
uuggaagccagguacaggagag

SEQ ID NO: 1333477 - RNA, 23 nt, Homo sapiens
uuggagcuaaaacuggcccuguu

SEQ ID NO: 1333478 - RNA, 18 nt, Homo sapiens
uuggauacauacaccagc

SEQ ID NO: 1333479 - RNA, 19 nt, Homo sapiens
uuggauacauacaccagca

SEQ ID NO: 1333480 - RNA, 23 nt, Homo sapiens
uuggcaccccuuucuaguucaau

SEQ ID NO: 1333481 - RNA, 12 nt, Homo sapiens
uuggcccaggau

SEQ ID NO: 1333482 - RNA, 20 nt, Homo sapiens
uuggcccaggauuauuguca

SEQ ID NO: 1333483 - RNA, 23 nt, Homo sapiens
uuggccugucuuuggauuguuaa

SEQ ID NO: 1333484 - RNA, 13 nt, Homo sapiens
uuggcuaaucagu

SEQ ID NO: 1333485 - RNA, 14 nt, Homo sapiens
uuggcugaccccuc

SEQ ID NO: 1333486 - RNA, 14 nt, Homo sapiens
uuggcuuuaugcaa

SEQ ID NO: 1333487 - RNA, 12 nt, Homo sapiens
uugggaacagaa

SEQ ID NO: 1333488 - RNA, 18 nt, Homo sapiens
uugggaaguuacuguuac

SEQ ID NO: 1333489 - RNA, 13 nt, Homo sapiens
uugggaaguuugc

SEQ ID NO: 1333490 - RNA, 17 nt, Homo sapiens
uugggagacaugugaca

SEQ ID NO: 1333491 - RNA, 16 nt, Homo sapiens
uugggauauucugaaa

SEQ ID NO: 1333492 - RNA, 16 nt, Homo sapiens
uugggcaccugaccac

SEQ ID NO: 1333493 - RNA, 24 nt, Homo sapiens
uugguaccccuaaaaagauugcca

SEQ ID NO: 1333494 - RNA, 22 nt, Homo sapiens
uuggugagaaagggauugcuga

SEQ ID NO: 1333495 - RNA, 23 nt, Homo sapiens
uuggugaggaaaagcggacauca

SEQ ID NO: 1333496 - RNA, 18 nt, Homo sapiens
uugguuuaaagaaagugu

SEQ ID NO: 1333497 - RNA, 22 nt, Homo sapiens
uuguaaaaagcccagcacuuga

SEQ ID NO: 1333498 - RNA, 16 nt, Homo sapiens
uuguaaaaaugucuuu

SEQ ID NO: 1333499 - RNA, 15 nt, Homo sapiens
uuguaaagauccuau

SEQ ID NO: 1333500 - RNA, 15 nt, Homo sapiens
uuguaaaugugacac

SEQ ID NO: 1333501 - RNA, 14 nt, Homo sapiens
uuguaauaaacucu

SEQ ID NO: 1333502 - RNA, 17 nt, Homo sapiens
uuguagcaaagcacaua

SEQ ID NO: 1333503 - RNA, 20 nt, Homo sapiens
uuguaguuuuggcuaguccu

SEQ ID NO: 1333504 - RNA, 16 nt, Homo sapiens
uuguauuuaagacaua

SEQ ID NO: 1333505 - RNA, 22 nt, Homo sapiens
uuguauuuaagacauaaacaaa

SEQ ID NO: 1333506 - RNA, 19 nt, Homo sapiens
uugucaaagaagucauucu

SEQ ID NO: 1333507 - RNA, 23 nt, Homo sapiens
uugucagcagcagugaccacagc

SEQ ID NO: 1333508 - RNA, 15 nt, Homo sapiens
uugucagcaguuccc

SEQ ID NO: 1333509 - RNA, 19 nt, Homo sapiens
uugucauugaaauuuggca

SEQ ID NO: 1333510 - RNA, 22 nt, Homo sapiens
uuguccaggcuggagugcaaug

SEQ ID NO: 1333511 - RNA, 19 nt, Homo sapiens
uugucuuuucaaaauauua

SEQ ID NO: 1333512 - RNA, 12 nt, Homo sapiens
uugugacuucaa

SEQ ID NO: 1333513 - RNA, 16 nt, Homo sapiens
uugugauaauucucag

SEQ ID NO: 1333514 - RNA, 18 nt, Homo sapiens
uugugaugugucacaggu

SEQ ID NO: 1333515 - RNA, 17 nt, Homo sapiens
uugugcccaagcucacc

SEQ ID NO: 1333516 - RNA, 21 nt, Homo sapiens
uugugcuccuucggauaugau

SEQ ID NO: 1333517 - RNA, 15 nt, Homo sapiens
uugugcuuuuuguca

SEQ ID NO: 1333518 - RNA, 19 nt, Homo sapiens
uuguggaauugagcagaga

SEQ ID NO: 1333519 - RNA, 19 nt, Homo sapiens
uuguguaagaaauacagac

SEQ ID NO: 1333520 - RNA, 18 nt, Homo sapiens
uuguuaaaaugagcauug

SEQ ID NO: 1333521 - RNA, 19 nt, Homo sapiens
uuguuaaaaugagcauuga

SEQ ID NO: 1333522 - RNA, 14 nt, Homo sapiens
uuguuaauguuugc

SEQ ID NO: 1333523 - RNA, 23 nt, Homo sapiens
uuguuacuguauccucauuugua

SEQ ID NO: 1333524 - RNA, 15 nt, Homo sapiens
auaaagaccugagaa

SEQ ID NO: 1333525 - RNA, 18 nt, Homo sapiens
auaaaggcaguuuucuaa

SEQ ID NO: 1333526 - RNA, 17 nt, Homo sapiens
auaaagugccucggaca

SEQ ID NO: 1333527 - RNA, 15 nt, Homo sapiens
auaaauaaaguuuca

SEQ ID NO: 1333528 - RNA, 16 nt, Homo sapiens
auaaauaguauuccaa

SEQ ID NO: 1333529 - RNA, 20 nt, Homo sapiens
auaaauggcccggacauguc

SEQ ID NO: 1333530 - RNA, 19 nt, Homo sapiens
auaaauguaauagccaaac

SEQ ID NO: 1333531 - RNA, 16 nt, Homo sapiens
auaaauguugcaaugc

SEQ ID NO: 1333532 - RNA, 19 nt, Homo sapiens
auaaauguugcaaugcaug

SEQ ID NO: 1333533 - RNA, 21 nt, Homo sapiens
auaaauuauuuaacuaauuaa

SEQ ID NO: 1333534 - RNA, 18 nt, Homo sapiens
auaaauugcuccuugaca

SEQ ID NO: 1333535 - RNA, 22 nt, Homo sapiens
auaaauugcuuacugauauuau

SEQ ID NO: 1333536 - RNA, 17 nt, Homo sapiens
auaaauuggcuaaucag

SEQ ID NO: 1333537 - RNA, 20 nt, Homo sapiens
auaaauuuuuugaaacacaa

SEQ ID NO: 1333538 - RNA, 17 nt, Homo sapiens
auaacagauccuuucaa

SEQ ID NO: 1333539 - RNA, 15 nt, Homo sapiens
auaacauacaugaga

SEQ ID NO: 1333540 - RNA, 15 nt, Homo sapiens
auaacugaaccaaau

SEQ ID NO: 1333541 - RNA, 17 nt, Homo sapiens
auaacuugaagaacagg

SEQ ID NO: 1333542 - RNA, 14 nt, Homo sapiens
auaacuugcaucua

SEQ ID NO: 1333543 - RNA, 20 nt, Homo sapiens
auaagcagucauccucagau

SEQ ID NO: 1333544 - RNA, 16 nt, Homo sapiens
auaaguaaaagcccua

SEQ ID NO: 1333545 - RNA, 19 nt, Homo sapiens
auaagucaauuccuagaag

SEQ ID NO: 1333546 - RNA, 16 nt, Homo sapiens
auaagucaguguuaaa

SEQ ID NO: 1333547 - RNA, 16 nt, Homo sapiens
auaaguuaacuuccaa

SEQ ID NO: 1333548 - RNA, 19 nt, Homo sapiens
auaaucgacuuguucuuga

SEQ ID NO: 1333549 - RNA, 15 nt, Homo sapiens
auaaugguacuccca

SEQ ID NO: 1333550 - RNA, 15 nt, Homo sapiens
auaauuuucauucau

SEQ ID NO: 1333551 - RNA, 17 nt, Homo sapiens
auacaaaaauaccuacu

SEQ ID NO: 1333552 - RNA, 20 nt, Homo sapiens
auacaaaacccuuucugccc

SEQ ID NO: 1333553 - RNA, 13 nt, Homo sapiens
auacaaacucuca

SEQ ID NO: 1333554 - RNA, 12 nt, Homo sapiens
auacaaucagcc

SEQ ID NO: 1333555 - RNA, 20 nt, Homo sapiens
auacaaucagcccagugcaa

SEQ ID NO: 1333556 - RNA, 13 nt, Homo sapiens
auacaauuaugaa

SEQ ID NO: 1333557 - RNA, 12 nt, Homo sapiens
auacacacucaa

SEQ ID NO: 1333558 - RNA, 22 nt, Homo sapiens
auacaccagcaauuuagacaaa

SEQ ID NO: 1333559 - RNA, 21 nt, Homo sapiens
auacacuguaagcuuuguucu

SEQ ID NO: 1333560 - RNA, 11 nt, Homo sapiens
auacaguauuu

SEQ ID NO: 1333561 - RNA, 16 nt, Homo sapiens
auacaugaaugggcau

SEQ ID NO: 1333562 - RNA, 15 nt, Homo sapiens
auacccuaaaguaua

SEQ ID NO: 1333563 - RNA, 14 nt, Homo sapiens
auaccuacugcuga

SEQ ID NO: 1333564 - RNA, 14 nt, Homo sapiens
auaccuaucaucuu

SEQ ID NO: 1333565 - RNA, 14 nt, Homo sapiens
auaccugcucuugu

SEQ ID NO: 1333566 - RNA, 19 nt, Homo sapiens
auacuacaguaacugugac

SEQ ID NO: 1333567 - RNA, 14 nt, Homo sapiens
auacuacuuaugaa

SEQ ID NO: 1333568 - RNA, 23 nt, Homo sapiens
auacucagguaccucuuucaggg

SEQ ID NO: 1333569 - RNA, 21 nt, Homo sapiens
auacuccacuccaagugcccc

SEQ ID NO: 1333570 - RNA, 19 nt, Homo sapiens
uagccuuguguucugagua

SEQ ID NO: 1333571 - RNA, 17 nt, Homo sapiens
uagcuaugagcuuuuaa

SEQ ID NO: 1333572 - RNA, 19 nt, Homo sapiens
uagcucucacagacauaua

SEQ ID NO: 1333573 - RNA, 17 nt, Homo sapiens
uaggaaaagaccaucug

SEQ ID NO: 1333574 - RNA, 20 nt, Homo sapiens
uaggaagauaaaaaaacugu

SEQ ID NO: 1333575 - RNA, 17 nt, Homo sapiens
uaggaauuuucuugaaa

SEQ ID NO: 1333576 - RNA, 22 nt, Homo sapiens
uaggcaaagauaauuuauuuca

SEQ ID NO: 1333577 - RNA, 20 nt, Homo sapiens
uaggcuacuguaaugcugcc

SEQ ID NO: 1333578 - RNA, 22 nt, Homo sapiens
uagggacaugaaauuuacaaag

SEQ ID NO: 1333579 - RNA, 23 nt, Homo sapiens
uagggaguuagaggcuguacaag

SEQ ID NO: 1333580 - RNA, 15 nt, Homo sapiens
uagggggugucucag

SEQ ID NO: 1333581 - RNA, 12 nt, Homo sapiens
uagguagccuug

SEQ ID NO: 1333582 - RNA, 15 nt, Homo sapiens
uaggugcagcuccuc

SEQ ID NO: 1333583 - RNA, 18 nt, Homo sapiens
uaggugggggaacacuga

SEQ ID NO: 1333584 - RNA, 21 nt, Homo sapiens
uaggugggggaacacugagaa

SEQ ID NO: 1333585 - RNA, 23 nt, Homo sapiens
uagguuuuuuuccuucugaagug

SEQ ID NO: 1333586 - RNA, 18 nt, Homo sapiens
uaguaaugugcuuguuag

SEQ ID NO: 1333587 - RNA, 18 nt, Homo sapiens
uaguaucacaaaaccacc

SEQ ID NO: 1333588 - RNA, 12 nt, Homo sapiens
uaguaucuguau

SEQ ID NO: 1333589 - RNA, 16 nt, Homo sapiens
uagucaauccaagacu

SEQ ID NO: 1333590 - RNA, 23 nt, Homo sapiens
uagucccauuuuucucuugccau

SEQ ID NO: 1333591 - RNA, 21 nt, Homo sapiens
uagucuccacuuucucaaugc

SEQ ID NO: 1333592 - RNA, 22 nt, Homo sapiens
uagucuguuguucuugaaaacu

SEQ ID NO: 1333593 - RNA, 18 nt, Homo sapiens
uagugauagagugcagug

SEQ ID NO: 1333594 - RNA, 15 nt, Homo sapiens
uagugcaccaucuca

SEQ ID NO: 1333595 - RNA, 16 nt, Homo sapiens
uagugcaccaucucac

SEQ ID NO: 1333596 - RNA, 23 nt, Homo sapiens
uagugcugaugccuguguacugc

SEQ ID NO: 1333597 - RNA, 14 nt, Homo sapiens
uaguguggcugugg

SEQ ID NO: 1333598 - RNA, 13 nt, Homo sapiens
uaguuaaguuaag

SEQ ID NO: 1333599 - RNA, 13 nt, Homo sapiens
uaguuaauggauu

SEQ ID NO: 1333600 - RNA, 18 nt, Homo sapiens
uaguuaccuuauaguuac

SEQ ID NO: 1333601 - RNA, 14 nt, Homo sapiens
uaguuauaaaccaa

SEQ ID NO: 1333602 - RNA, 15 nt, Homo sapiens
uaguuauaaaccaau

SEQ ID NO: 1333603 - RNA, 16 nt, Homo sapiens
uaguuucagugcauua

SEQ ID NO: 1333604 - RNA, 21 nt, Homo sapiens
uaguuuguuuuagaaccagcc

SEQ ID NO: 1333605 - RNA, 16 nt, Homo sapiens
uauaaagucagugacg

SEQ ID NO: 1333606 - RNA, 19 nt, Homo sapiens
uauaaauuuguguucucaa

SEQ ID NO: 1333607 - RNA, 14 nt, Homo sapiens
uauaacuaacaugu

SEQ ID NO: 1333608 - RNA, 22 nt, Homo sapiens
uauaagaaaugcauaugucacu

SEQ ID NO: 1333609 - RNA, 22 nt, Homo sapiens
uauaagcuuuuuucucaauaaa

SEQ ID NO: 1333610 - RNA, 18 nt, Homo sapiens
uauacaauugucauguau

SEQ ID NO: 1333611 - RNA, 17 nt, Homo sapiens
uauaccagccuacugua

SEQ ID NO: 1333612 - RNA, 19 nt, Homo sapiens
uauaccagcuuguaugcaa

SEQ ID NO: 1333613 - RNA, 18 nt, Homo sapiens
uauaccaugagugugcca

SEQ ID NO: 1333614 - RNA, 18 nt, Homo sapiens
uauacuauuuagucucag

SEQ ID NO: 1333615 - RNA, 18 nt, Homo sapiens
uauacuucaaaagccaua

SEQ ID NO: 1333616 - RNA, 16 nt, Homo sapiens
uauacuugaauauuau

SEQ ID NO: 1333617 - RNA, 18 nt, Homo sapiens
uauagacacacauacaua

SEQ ID NO: 1333618 - RNA, 16 nt, Homo sapiens
uauagcaagaucccau

SEQ ID NO: 1333619 - RNA, 19 nt, Homo sapiens
uauagcucaugugcauuau

SEQ ID NO: 1333620 - RNA, 15 nt, Homo sapiens
uauauaaguguacau

SEQ ID NO: 1333621 - RNA, 18 nt, Homo sapiens
uauauacugcuauuuaca

SEQ ID NO: 1333622 - RNA, 19 nt, Homo sapiens
uauauaugcauaccuggau

SEQ ID NO: 1333623 - RNA, 19 nt, Homo sapiens
uauauauuggccaaacugg

SEQ ID NO: 1333624 - RNA, 19 nt, Homo sapiens
uauaucuuagguaagacau

SEQ ID NO: 1333625 - RNA, 14 nt, Homo sapiens
uauauuccaccagg

SEQ ID NO: 1333626 - RNA, 12 nt, Homo sapiens
uauauugcccag

SEQ ID NO: 1333627 - RNA, 13 nt, Homo sapiens
uauauuguuauau

SEQ ID NO: 1333628 - RNA, 12 nt, Homo sapiens
uaucaaagucau

SEQ ID NO: 1333629 - RNA, 15 nt, Homo sapiens
uaucaaauacauuua

SEQ ID NO: 1333630 - RNA, 14 nt, Homo sapiens
uaucacaaaaccac

SEQ ID NO: 1333631 - RNA, 15 nt, Homo sapiens
uaucacaaaaccacc

SEQ ID NO: 1333632 - RNA, 21 nt, Homo sapiens
uaucaccuagcagccucaaaa

SEQ ID NO: 1333633 - RNA, 22 nt, Homo sapiens
uaucaccuagcagccucaaaac

SEQ ID NO: 1333634 - RNA, 12 nt, Homo sapiens
uaucacuguugc

SEQ ID NO: 1333635 - RNA, 21 nt, Homo sapiens
uaucacuucauucacauucag

SEQ ID NO: 1333636 - RNA, 19 nt, Homo sapiens
uaucagacucggaaucuau

SEQ ID NO: 1333637 - RNA, 20 nt, Homo sapiens
uaucagguguauaaauguac

SEQ ID NO: 1333638 - RNA, 20 nt, Homo sapiens
uaucauaauucagcacuuaa

SEQ ID NO: 1333639 - RNA, 14 nt, Homo sapiens
uaucaugugucuuc

SEQ ID NO: 1333640 - RNA, 23 nt, Homo sapiens
uauccaaucugugaugacauucc

SEQ ID NO: 1333641 - RNA, 15 nt, Homo sapiens
uaucccaccaaccuc

SEQ ID NO: 1333642 - RNA, 22 nt, Homo sapiens
uaucccagaaaaaguaacucau

SEQ ID NO: 1333643 - RNA, 14 nt, Homo sapiens
uaucccuacaugua

SEQ ID NO: 1333644 - RNA, 21 nt, Homo sapiens
uaucccuacauguauugcaca

SEQ ID NO: 1333645 - RNA, 23 nt, Homo sapiens
uaucccuugguuuagaggaaccc

SEQ ID NO: 1333646 - RNA, 14 nt, Homo sapiens
uauccuuguagcaa

SEQ ID NO: 1333647 - RNA, 15 nt, Homo sapiens
uaucuaaaaucugcu

SEQ ID NO: 1333648 - RNA, 15 nt, Homo sapiens
uaucuacauaaggau

SEQ ID NO: 1333649 - RNA, 12 nt, Homo sapiens
uaucuaccccag

SEQ ID NO: 1333650 - RNA, 23 nt, Homo sapiens
uaucuauuugagauugaugacaa

SEQ ID NO: 1333651 - RNA, 14 nt, Homo sapiens
uaucucagccauag

SEQ ID NO: 1333652 - RNA, 16 nt, Homo sapiens
uaucucaguaccccau

SEQ ID NO: 1333653 - RNA, 14 nt, Homo sapiens
uaucucccauaaac

SEQ ID NO: 1333654 - RNA, 20 nt, Homo sapiens
uaucugcgugcacuucccag

SEQ ID NO: 1333655 - RNA, 19 nt, Homo sapiens
uaugaagaaucugcucuga

SEQ ID NO: 1333656 - RNA, 21 nt, Homo sapiens
uaugagacugggcaucucuga

SEQ ID NO: 1333657 - RNA, 18 nt, Homo sapiens
uaugagccaggcaucaua

SEQ ID NO: 1333658 - RNA, 19 nt, Homo sapiens
uaugagcuugcucauuaau

SEQ ID NO: 1333659 - RNA, 17 nt, Homo sapiens
uaugauuguuucucaaa

SEQ ID NO: 1333660 - RNA, 14 nt, Homo sapiens
uaugcaaaauggaa

SEQ ID NO: 1333661 - RNA, 20 nt, Homo sapiens
uaugcaaauacaaucagccc

SEQ ID NO: 1333662 - RNA, 21 nt, Homo sapiens
uaugcaaaucaaacauauucu

SEQ ID NO: 1333663 - RNA, 17 nt, Homo sapiens
uaugcacaaaucugcca

SEQ ID NO: 1333664 - RNA, 15 nt, Homo sapiens
uaugcagccauauau

SEQ ID NO: 1333665 - RNA, 14 nt, Homo sapiens
uaugcaguccuuua

SEQ ID NO: 1333666 - RNA, 16 nt, Homo sapiens
uaugcauguagcauau

SEQ ID NO: 1333667 - RNA, 18 nt, Homo sapiens
gcgaccccgucacagccu

SEQ ID NO: 1333668 - RNA, 21 nt, Homo sapiens
gcgcccuuaacugcauccagc

SEQ ID NO: 1333669 - RNA, 15 nt, Homo sapiens
gcgccuccagagguc

SEQ ID NO: 1333670 - RNA, 18 nt, Homo sapiens
gcgcuguguacaauguga

SEQ ID NO: 1333671 - RNA, 22 nt, Homo sapiens
gcggaccccucgucaucaggug

SEQ ID NO: 1333672 - RNA, 17 nt, Homo sapiens
gcggaggcgguggcaga

SEQ ID NO: 1333673 - RNA, 14 nt, Homo sapiens
gcggccuccaugca

SEQ ID NO: 1333674 - RNA, 15 nt, Homo sapiens
gcggcgucccuucca

SEQ ID NO: 1333675 - RNA, 13 nt, Homo sapiens
uuguuauauacau

SEQ ID NO: 1333676 - RNA, 13 nt, Homo sapiens
uuguucuugauag

SEQ ID NO: 1333677 - RNA, 12 nt, Homo sapiens
uuguugugagaa

SEQ ID NO: 1333678 - RNA, 21 nt, Homo sapiens
uuguuuauauggauaaucuga

SEQ ID NO: 1333679 - RNA, 18 nt, Homo sapiens
uuguuuucauuaucucaa

SEQ ID NO: 1333680 - RNA, 23 nt, Homo sapiens
uuguuuuuaaacaauaaagcaau

SEQ ID NO: 1333681 - RNA, 18 nt, Homo sapiens
uuuaaaacgcgucugccu

SEQ ID NO: 1333682 - RNA, 18 nt, Homo sapiens
uuuaaaauacacacucaa

SEQ ID NO: 1333683 - RNA, 11 nt, Homo sapiens
uuuaaagacag

SEQ ID NO: 1333684 - RNA, 19 nt, Homo sapiens
uuuaaagacagggucuugc

SEQ ID NO: 1333685 - RNA, 17 nt, Homo sapiens
uuuaaauuauacaauga

SEQ ID NO: 1333686 - RNA, 15 nt, Homo sapiens
uuuaacaaugucuga

SEQ ID NO: 1333687 - RNA, 20 nt, Homo sapiens
uuuaacggaugguugaauga

SEQ ID NO: 1333688 - RNA, 16 nt, Homo sapiens
uuuaacuagacacaga

SEQ ID NO: 1333689 - RNA, 19 nt, Homo sapiens
uuuaacuuaagggagaaaa

SEQ ID NO: 1333690 - RNA, 18 nt, Homo sapiens
uuuaaggcaauauauaau

SEQ ID NO: 1333691 - RNA, 13 nt, Homo sapiens
uuuaauauuuacu

SEQ ID NO: 1333692 - RNA, 12 nt, Homo sapiens
uuuaaucagcuu

SEQ ID NO: 1333693 - RNA, 19 nt, Homo sapiens
uuuaauccuuaacacauuc

SEQ ID NO: 1333694 - RNA, 20 nt, Homo sapiens
uuuaauccuuaacacauuca

SEQ ID NO: 1333695 - RNA, 14 nt, Homo sapiens
uuuaaucucuaaca

SEQ ID NO: 1333696 - RNA, 15 nt, Homo sapiens
uuuacaaugugcaau

SEQ ID NO: 1333697 - RNA, 19 nt, Homo sapiens
uuuacaauuuaaugcacua

SEQ ID NO: 1333698 - RNA, 15 nt, Homo sapiens
uuuacacaaagggaa

SEQ ID NO: 1333699 - RNA, 16 nt, Homo sapiens
uuuacauggguucaau

SEQ ID NO: 1333700 - RNA, 11 nt, Homo sapiens
uuuaccaaagc

SEQ ID NO: 1333701 - RNA, 19 nt, Homo sapiens
uuuaccuguuuuacuuuug

SEQ ID NO: 1333702 - RNA, 17 nt, Homo sapiens
uuuaccuuuaucuuuca

SEQ ID NO: 1333703 - RNA, 18 nt, Homo sapiens
uuuagaagauucuauguu

SEQ ID NO: 1333704 - RNA, 16 nt, Homo sapiens
uuuagaagugugaauu

SEQ ID NO: 1333705 - RNA, 20 nt, Homo sapiens
uuuagaugaggcucagagag

SEQ ID NO: 1333706 - RNA, 17 nt, Homo sapiens
uuuagauucacuuaaca

SEQ ID NO: 1333707 - RNA, 20 nt, Homo sapiens
uuuaggcuuuuccaaaucaa

SEQ ID NO: 1333708 - RNA, 21 nt, Homo sapiens
uuuaggugaauuaauuaaaca

SEQ ID NO: 1333709 - RNA, 16 nt, Homo sapiens
uuuauaaaacuuugaa

SEQ ID NO: 1333710 - RNA, 10 nt, Homo sapiens
uuuauacaau

SEQ ID NO: 1333711 - RNA, 15 nt, Homo sapiens
uuuauacaauguucu

SEQ ID NO: 1333712 - RNA, 14 nt, Homo sapiens
uuuauccuagucau

SEQ ID NO: 1333713 - RNA, 16 nt, Homo sapiens
uuuauccucauuccau

SEQ ID NO: 1333714 - RNA, 18 nt, Homo sapiens
uuuaucuguuuuguacuu

SEQ ID NO: 1333715 - RNA, 11 nt, Homo sapiens
uuuaugguucu

SEQ ID NO: 1333716 - RNA, 17 nt, Homo sapiens
uuuaugugaacuaugau

SEQ ID NO: 1333717 - RNA, 17 nt, Homo sapiens
uuuaugugcacugccug

SEQ ID NO: 1333718 - RNA, 17 nt, Homo sapiens
uuuauuaaaauauuuca

SEQ ID NO: 1333719 - RNA, 21 nt, Homo sapiens
uuuauuccccagugacuccag

SEQ ID NO: 1333720 - RNA, 22 nt, Homo sapiens
uuuauuucugguaacucacuca

SEQ ID NO: 1333721 - RNA, 14 nt, Homo sapiens
uuucaaagcacuua

SEQ ID NO: 1333722 - RNA, 17 nt, Homo sapiens
uuucaaaguguugaugg

SEQ ID NO: 1333723 - RNA, 20 nt, Homo sapiens
uuucaaaguguugaugguaa

SEQ ID NO: 1333724 - RNA, 12 nt, Homo sapiens
uuucaagagauc

SEQ ID NO: 1333725 - RNA, 20 nt, Homo sapiens
uuucacagcccauaauucau

SEQ ID NO: 1333726 - RNA, 20 nt, Homo sapiens
uuucagagaaaggacugugg

SEQ ID NO: 1333727 - RNA, 16 nt, Homo sapiens
uuucaguucuauuuaa

SEQ ID NO: 1333728 - RNA, 14 nt, Homo sapiens
uuucaguugcagua

SEQ ID NO: 1333729 - RNA, 13 nt, Homo sapiens
uuucauacaacag

SEQ ID NO: 1333730 - RNA, 19 nt, Homo sapiens
uuucaucuuuugaagagca

SEQ ID NO: 1333731 - RNA, 20 nt, Homo sapiens
uuucaugaagcaagaaugga

SEQ ID NO: 1333732 - RNA, 12 nt, Homo sapiens
uuucauucacuu

SEQ ID NO: 1333733 - RNA, 21 nt, Homo sapiens
uuucauugcucagaaauguca

SEQ ID NO: 1333734 - RNA, 15 nt, Homo sapiens
uuucauuguucuugg

SEQ ID NO: 1333735 - RNA, 15 nt, Homo sapiens
uuuccaacuacuaau

SEQ ID NO: 1333736 - RNA, 22 nt, Homo sapiens
uuuccagcuccguguuucucua

SEQ ID NO: 1333737 - RNA, 15 nt, Homo sapiens
uuuccauaccauugu

SEQ ID NO: 1333738 - RNA, 22 nt, Homo sapiens
uuuccaugcacccucauacaca

SEQ ID NO: 1333739 - RNA, 23 nt, Homo sapiens
uuuccauuaaguacaugugccag

SEQ ID NO: 1333740 - RNA, 13 nt, Homo sapiens
uuucccaucacug

SEQ ID NO: 1333741 - RNA, 15 nt, Homo sapiens
uuuccccagucccag

SEQ ID NO: 1333742 - RNA, 13 nt, Homo sapiens
uuuccccuaucau

SEQ ID NO: 1333743 - RNA, 17 nt, Homo sapiens
uuucccuucucuucuaa

SEQ ID NO: 1333744 - RNA, 18 nt, Homo sapiens
uuuccucagguccuuuag

SEQ ID NO: 1333745 - RNA, 12 nt, Homo sapiens
uuuccuccuugu

SEQ ID NO: 1333746 - RNA, 23 nt, Homo sapiens
uuuccuugggcuuuagccuuaaa

SEQ ID NO: 1333747 - RNA, 19 nt, Homo sapiens
uuuccuuuaaauuucagcu

SEQ ID NO: 1333748 - RNA, 12 nt, Homo sapiens
uuuccuuugcua

SEQ ID NO: 1333749 - RNA, 18 nt, Homo sapiens
uuuccuuugguccuucaa

SEQ ID NO: 1333750 - RNA, 20 nt, Homo sapiens
uuuccuuuuacaauuguuga

SEQ ID NO: 1333751 - RNA, 16 nt, Homo sapiens
uuucuaaagacuugua

SEQ ID NO: 1333752 - RNA, 14 nt, Homo sapiens
uuucuacacugagg

SEQ ID NO: 1333753 - RNA, 22 nt, Homo sapiens
uuucucaauauuaagucauugu

SEQ ID NO: 1333754 - RNA, 21 nt, Homo sapiens
uuucucagcucccaaggcucu

SEQ ID NO: 1333755 - RNA, 18 nt, Homo sapiens
uuucucauuuagcauuga

SEQ ID NO: 1333756 - RNA, 15 nt, Homo sapiens
uuucuccauucagga

SEQ ID NO: 1333757 - RNA, 23 nt, Homo sapiens
uuucucucuggaaaggauuuuca

SEQ ID NO: 1333758 - RNA, 19 nt, Homo sapiens
uuucucuguaaacuuccaa

SEQ ID NO: 1333759 - RNA, 23 nt, Homo sapiens
uuucucuuuacuugaaauuuggc

SEQ ID NO: 1333760 - RNA, 18 nt, Homo sapiens
uuucugagagagugccau

SEQ ID NO: 1333761 - RNA, 22 nt, Homo sapiens
uuucuggaugaaugcccaguga

SEQ ID NO: 1333762 - RNA, 14 nt, Homo sapiens
uuucuguaguguga

SEQ ID NO: 1333763 - RNA, 19 nt, Homo sapiens
uuucuguucuguuggauga

SEQ ID NO: 1333764 - RNA, 14 nt, Homo sapiens
uuucuuacauuagc

SEQ ID NO: 1333765 - RNA, 23 nt, Homo sapiens
uuucuucaaauguuuaaaccacu

SEQ ID NO: 1333766 - RNA, 16 nt, Homo sapiens
uuucuucgugaugaca

SEQ ID NO: 1333767 - RNA, 12 nt, Homo sapiens
uuucuuugccuc

SEQ ID NO: 1333768 - RNA, 17 nt, Homo sapiens
uuucuuuuuuauacuca

SEQ ID NO: 1333769 - RNA, 17 nt, Homo sapiens
uuugaaaagucacuuac

SEQ ID NO: 1333770 - RNA, 19 nt, Homo sapiens
uuugaaaccaggacauuaa

SEQ ID NO: 1333771 - RNA, 14 nt, Homo sapiens
uuugaaaguauaau

SEQ ID NO: 1333772 - RNA, 13 nt, Homo sapiens
uuugaaauaccuu

SEQ ID NO: 1333773 - RNA, 19 nt, Homo sapiens
uuugaacagggcaguuuag

SEQ ID NO: 1333774 - RNA, 16 nt, Homo sapiens
uuugaagauagaaggu

SEQ ID NO: 1333775 - RNA, 16 nt, Homo sapiens
uuugaagugcagcuca

SEQ ID NO: 1333776 - RNA, 20 nt, Homo sapiens
uuugacuuucuucugaauau

SEQ ID NO: 1333777 - RNA, 15 nt, Homo sapiens
uuugagcacaacuuu

SEQ ID NO: 1333778 - RNA, 23 nt, Homo sapiens
uuugagggugggggugcucucuc

SEQ ID NO: 1333779 - RNA, 14 nt, Homo sapiens
uuugauaaacugaa

SEQ ID NO: 1333780 - RNA, 17 nt, Homo sapiens
uuugauaggauguggau

SEQ ID NO: 1333781 - RNA, 21 nt, Homo sapiens
uuugaugagauauuaaauucu

SEQ ID NO: 1333782 - RNA, 16 nt, Homo sapiens
uuugauucagcaaaaa

SEQ ID NO: 1333783 - RNA, 13 nt, Homo sapiens
uuugcaaacguuc

SEQ ID NO: 1333784 - RNA, 19 nt, Homo sapiens
uuugcauuucugucccaua

SEQ ID NO: 1333785 - RNA, 23 nt, Homo sapiens
uuugcccccauucacuuugucag

SEQ ID NO: 1333786 - RNA, 14 nt, Homo sapiens
uuugcuaacugguu

SEQ ID NO: 1333787 - RNA, 22 nt, Homo sapiens
uuugcucuuagcugucugcuca

SEQ ID NO: 1333788 - RNA, 17 nt, Homo sapiens
uuugcuguuaacuguua

SEQ ID NO: 1333789 - RNA, 17 nt, Homo sapiens
uuugcuuaaaauuguga

SEQ ID NO: 1333790 - RNA, 12 nt, Homo sapiens
uuuggcuaaaau

SEQ ID NO: 1333791 - RNA, 22 nt, Homo sapiens
uuugggagcccaugggggagcu

SEQ ID NO: 1333792 - RNA, 11 nt, Homo sapiens
uuuggggcuca

SEQ ID NO: 1333793 - RNA, 22 nt, Homo sapiens
uuuggggguaaaguuugcucua

SEQ ID NO: 1333794 - RNA, 20 nt, Homo sapiens
uuugggggucagcauccagu

SEQ ID NO: 1333795 - RNA, 11 nt, Homo sapiens
uuugggguccu

SEQ ID NO: 1333796 - RNA, 13 nt, Homo sapiens
uuugguccuugaa

SEQ ID NO: 1333797 - RNA, 20 nt, Homo sapiens
uuuguaauaaacucucuagg

SEQ ID NO: 1333798 - RNA, 11 nt, Homo sapiens
uuuguaccauu

SEQ ID NO: 1333799 - RNA, 12 nt, Homo sapiens
uuugucaccuca

SEQ ID NO: 1333800 - RNA, 21 nt, Homo sapiens
uuugucauauaagauucauau

SEQ ID NO: 1333801 - RNA, 16 nt, Homo sapiens
uuuguuacuuccuuau

SEQ ID NO: 1333802 - RNA, 20 nt, Homo sapiens
uuuuaaauguauacuauagu

SEQ ID NO: 1333803 - RNA, 20 nt, Homo sapiens
uuuuaaccaauaacuagcuu

SEQ ID NO: 1333804 - RNA, 20 nt, Homo sapiens
uuuuaagaaaguaauuuaau

SEQ ID NO: 1333805 - RNA, 21 nt, Homo sapiens
uuuuaaggucuaaucagugau

SEQ ID NO: 1333806 - RNA, 21 nt, Homo sapiens
uuuuaauccuuaacacauuca

SEQ ID NO: 1333807 - RNA, 12 nt, Homo sapiens
uuuuacauuuca

SEQ ID NO: 1333808 - RNA, 20 nt, Homo sapiens
uuuuaccuuucaugugccug

SEQ ID NO: 1333809 - RNA, 17 nt, Homo sapiens
uuuuacugcccuuucaa

SEQ ID NO: 1333810 - RNA, 13 nt, Homo sapiens
aaaaaaugugcau

SEQ ID NO: 1333811 - RNA, 21 nt, Homo sapiens
aaaaaauuuuagcucuuccca

SEQ ID NO: 1333812 - RNA, 16 nt, Homo sapiens
aaaaacacguggagau

SEQ ID NO: 1333813 - RNA, 13 nt, Homo sapiens
aaaaacauucuua

SEQ ID NO: 1333814 - RNA, 16 nt, Homo sapiens
aaaaagaagaaaagau

SEQ ID NO: 1333815 - RNA, 23 nt, Homo sapiens
aaaaaggagccuuuugcucucug

SEQ ID NO: 1333816 - RNA, 17 nt, Homo sapiens
aaaaauaaagcacuuau

SEQ ID NO: 1333817 - RNA, 16 nt, Homo sapiens
aaaaaucguccaggga

SEQ ID NO: 1333818 - RNA, 14 nt, Homo sapiens
aaaaaugucuuuca

SEQ ID NO: 1333819 - RNA, 14 nt, Homo sapiens
aaaaauuauuauuu

SEQ ID NO: 1333820 - RNA, 20 nt, Homo sapiens
aaaacaaagaaauaaugguc

SEQ ID NO: 1333821 - RNA, 10 nt, Homo sapiens
aaaacaaagg

SEQ ID NO: 1333822 - RNA, 17 nt, Homo sapiens
aaaacaaaggccuaauu

SEQ ID NO: 1333823 - RNA, 12 nt, Homo sapiens
aaaacagacugu

SEQ ID NO: 1333824 - RNA, 19 nt, Homo sapiens
aaaaccaggccuuaucucc

SEQ ID NO: 1333825 - RNA, 18 nt, Homo sapiens
aaaaccuaguacauuacu

SEQ ID NO: 1333826 - RNA, 13 nt, Homo sapiens
aaaaccuauucca

SEQ ID NO: 1333827 - RNA, 11 nt, Homo sapiens
aaaacuacuga

SEQ ID NO: 1333828 - RNA, 22 nt, Homo sapiens
aaaagacuuuuuccuugggcuu

SEQ ID NO: 1333829 - RNA, 13 nt, Homo sapiens
aaaagaguuuaaa

SEQ ID NO: 1333830 - RNA, 14 nt, Homo sapiens
aaaagcaaggcaca

SEQ ID NO: 1333831 - RNA, 11 nt, Homo sapiens
aaaagcaggca

SEQ ID NO: 1333832 - RNA, 14 nt, Homo sapiens
aaaaguaaugacuu

SEQ ID NO: 1333833 - RNA, 13 nt, Homo sapiens
aaaagucuaccug

SEQ ID NO: 1333834 - RNA, 23 nt, Homo sapiens
aaaaguucagggaccguccaggg

SEQ ID NO: 1333835 - RNA, 20 nt, Homo sapiens
aaaaguugaugucaauaaca

SEQ ID NO: 1333836 - RNA, 15 nt, Homo sapiens
aaaauaaacaucagu

SEQ ID NO: 1333837 - RNA, 19 nt, Homo sapiens
aaaauacaucagcuuggua

SEQ ID NO: 1333838 - RNA, 14 nt, Homo sapiens
aaaauaccaugcca

SEQ ID NO: 1333839 - RNA, 22 nt, Homo sapiens
aaaauauguuuggaauauucca

SEQ ID NO: 1333840 - RNA, 23 nt, Homo sapiens
aaaauauguuuggaauauuccac

SEQ ID NO: 1333841 - RNA, 17 nt, Homo sapiens
aaaauccagaacucaaa

SEQ ID NO: 1333842 - RNA, 17 nt, Homo sapiens
aaaaucccaccuuccca

SEQ ID NO: 1333843 - RNA, 18 nt, Homo sapiens
aaaaucuucuagcauguu

SEQ ID NO: 1333844 - RNA, 23 nt, Homo sapiens
aaaaugaaaauucuaacccaaga

SEQ ID NO: 1333845 - RNA, 23 nt, Homo sapiens
aaaaugaagguggaacaagcaca

SEQ ID NO: 1333846 - RNA, 15 nt, Homo sapiens
aaaaugauccugcca

SEQ ID NO: 1333847 - RNA, 21 nt, Homo sapiens
aaaauggucacguuuggugcu

SEQ ID NO: 1333848 - RNA, 21 nt, Homo sapiens
aaaauguuuuuaaacaguguc

SEQ ID NO: 1333849 - RNA, 19 nt, Homo sapiens
aaaauuaaacaaauaugca

SEQ ID NO: 1333850 - RNA, 22 nt, Homo sapiens
aaaauuagaaucugaguauaaa

SEQ ID NO: 1333851 - RNA, 23 nt, Homo sapiens
aaaauuucaggauuaacuaaaga

SEQ ID NO: 1333852 - RNA, 14 nt, Homo sapiens
aaacaaaaaaccca

SEQ ID NO: 1333853 - RNA, 16 nt, Homo sapiens
aaacaacagcuuuaaa

SEQ ID NO: 1333854 - RNA, 21 nt, Homo sapiens
aaacaacguugcuauuuccac

SEQ ID NO: 1333855 - RNA, 16 nt, Homo sapiens
aaacacaauaccuaca

SEQ ID NO: 1333856 - RNA, 17 nt, Homo sapiens
aaacaccgcuucugccu

SEQ ID NO: 1333857 - RNA, 20 nt, Homo sapiens
aaacagcucagccagugggg

SEQ ID NO: 1333858 - RNA, 21 nt, Homo sapiens
aaacagcuuugucuccaaaga

SEQ ID NO: 1333859 - RNA, 20 nt, Homo sapiens
aaacauaaacacauuuccau

SEQ ID NO: 1333860 - RNA, 23 nt, Homo sapiens
aaacauguuccuuauauuuacuc

SEQ ID NO: 1333861 - RNA, 22 nt, Homo sapiens
aaacauuaaaauauaaucucua

SEQ ID NO: 1333862 - RNA, 14 nt, Homo sapiens
aaacauugugauca

SEQ ID NO: 1333863 - RNA, 15 nt, Homo sapiens
aaacauuucauuucc

SEQ ID NO: 1333864 - RNA, 19 nt, Homo sapiens
aaaccaagugcgcuuugca

SEQ ID NO: 1333865 - RNA, 14 nt, Homo sapiens
aaaccaggacauua

SEQ ID NO: 1333866 - RNA, 14 nt, Homo sapiens
aaacccccacucca

SEQ ID NO: 1333867 - RNA, 15 nt, Homo sapiens
aaacccuuucauaaa

SEQ ID NO: 1333868 - RNA, 12 nt, Homo sapiens
aaaccuccacug

SEQ ID NO: 1333869 - RNA, 13 nt, Homo sapiens
aaaccuccacugc

SEQ ID NO: 1333870 - RNA, 19 nt, Homo sapiens
aaaccuggggugaauacuu

SEQ ID NO: 1333871 - RNA, 19 nt, Homo sapiens
aaacgaaacuccaucucaa

SEQ ID NO: 1333872 - RNA, 19 nt, Homo sapiens
aaacucacaagugcucauc

SEQ ID NO: 1333873 - RNA, 14 nt, Homo sapiens
aaacucucuagggc

SEQ ID NO: 1333874 - RNA, 19 nt, Homo sapiens
aaacugauuacguuuacau

SEQ ID NO: 1333875 - RNA, 13 nt, Homo sapiens
aaacugauuuauc

SEQ ID NO: 1333876 - RNA, 20 nt, Homo sapiens
aaacugauuuaucuauuuaa

SEQ ID NO: 1333877 - RNA, 20 nt, Homo sapiens
aaacugcagccucucuggcu

SEQ ID NO: 1333878 - RNA, 23 nt, Homo sapiens
aaacugggauuaagaaaccuugc

SEQ ID NO: 1333879 - RNA, 15 nt, Homo sapiens
aaacuggugcaugac

SEQ ID NO: 1333880 - RNA, 13 nt, Homo sapiens
aaacuguggugcu

SEQ ID NO: 1333881 - RNA, 16 nt, Homo sapiens
aaacuuaaagaggaau

SEQ ID NO: 1333882 - RNA, 15 nt, Homo sapiens
aaacuuaauguucuu

SEQ ID NO: 1333883 - RNA, 13 nt, Homo sapiens
aaacuuagaucau

SEQ ID NO: 1333884 - RNA, 19 nt, Homo sapiens
aaacuuagaucaucaguca

SEQ ID NO: 1333885 - RNA, 15 nt, Homo sapiens
aaacuugcaguaucu

SEQ ID NO: 1333886 - RNA, 11 nt, Homo sapiens
aaacuugcauc

SEQ ID NO: 1333887 - RNA, 11 nt, Homo sapiens
aaacuugccug

SEQ ID NO: 1333888 - RNA, 18 nt, Homo sapiens
aaacuuugaagcaacugu

SEQ ID NO: 1333889 - RNA, 19 nt, Homo sapiens
aaacuuuuuuucuguacca

SEQ ID NO: 1333890 - RNA, 23 nt, Homo sapiens
aaacuuuuuuucuguaccaguua

SEQ ID NO: 1333891 - RNA, 13 nt, Homo sapiens
aaagaacaaagua

SEQ ID NO: 1333892 - RNA, 17 nt, Homo sapiens
aaagaacgcugauuuaa

SEQ ID NO: 1333893 - RNA, 17 nt, Homo sapiens
aaagacaaucacugcca

SEQ ID NO: 1333894 - RNA, 9 nt, Homo sapiens
aaagacaga

SEQ ID NO: 1333895 - RNA, 19 nt, Homo sapiens
aaagacccaacauuacuaa

SEQ ID NO: 1333896 - RNA, 20 nt, Homo sapiens
aaagaccugacaccuuucau

SEQ ID NO: 1333897 - RNA, 15 nt, Homo sapiens
aaagacguugccuau

SEQ ID NO: 1333898 - RNA, 16 nt, Homo sapiens
aaagagacuucuccca

SEQ ID NO: 1333899 - RNA, 16 nt, Homo sapiens
aaagagauauugauau

SEQ ID NO: 1333900 - RNA, 21 nt, Homo sapiens
aaagauaguugauucuugccu

SEQ ID NO: 1333901 - RNA, 21 nt, Homo sapiens
aaagauggcugugccucugcc

SEQ ID NO: 1333902 - RNA, 19 nt, Homo sapiens
aaagauuaaaugugucauu

SEQ ID NO: 1333903 - RNA, 18 nt, Homo sapiens
aaagcaaaacagacugug

SEQ ID NO: 1333904 - RNA, 12 nt, Homo sapiens
aaagcaaaucag

SEQ ID NO: 1333905 - RNA, 12 nt, Homo sapiens
aaagcacacuca

SEQ ID NO: 1333906 - RNA, 21 nt, Homo sapiens
aaagcacacucauccccucac

SEQ ID NO: 1333907 - RNA, 19 nt, Homo sapiens
aaagcacaugguucaaauc

SEQ ID NO: 1333908 - RNA, 17 nt, Homo sapiens
aaagcagcaacuauuca

SEQ ID NO: 1333909 - RNA, 15 nt, Homo sapiens
aaagccaagcacuuu

SEQ ID NO: 1333910 - RNA, 13 nt, Homo sapiens
aaagccacaucuu

SEQ ID NO: 1333911 - RNA, 19 nt, Homo sapiens
aaagccacaucuugcucug

SEQ ID NO: 1333912 - RNA, 13 nt, Homo sapiens
aaagcccuuccau

SEQ ID NO: 1333913 - RNA, 16 nt, Homo sapiens
aaagccuuaagcaaau

SEQ ID NO: 1333914 - RNA, 17 nt, Homo sapiens
aaagcggacaucagcug

SEQ ID NO: 1333915 - RNA, 21 nt, Homo sapiens
aacuacauuucuacuaugauc

SEQ ID NO: 1333916 - RNA, 22 nt, Homo sapiens
aacuaccuauccuuacauuuca

SEQ ID NO: 1333917 - RNA, 21 nt, Homo sapiens
aacuaggaaaaucacuugcca

SEQ ID NO: 1333918 - RNA, 22 nt, Homo sapiens
aacuauuuauuuuuucuaagug

SEQ ID NO: 1333919 - RNA, 18 nt, Homo sapiens
aacucaaauggggccaga

SEQ ID NO: 1333920 - RNA, 22 nt, Homo sapiens
aacucacaagugcucaucuguu

SEQ ID NO: 1333921 - RNA, 10 nt, Homo sapiens
aacucaggga

SEQ ID NO: 1333922 - RNA, 19 nt, Homo sapiens
aacuccauacuccacucca

SEQ ID NO: 1333923 - RNA, 18 nt, Homo sapiens
aacuccuauaaagugccu

SEQ ID NO: 1333924 - RNA, 19 nt, Homo sapiens
aacuccuauaaagugccuc

SEQ ID NO: 1333925 - RNA, 21 nt, Homo sapiens
aacuccugucuucuuucucca

SEQ ID NO: 1333926 - RNA, 21 nt, Homo sapiens
aacucucaccaugaugugaag

SEQ ID NO: 1333927 - RNA, 17 nt, Homo sapiens
aacucugggucuuggcc

SEQ ID NO: 1333928 - RNA, 12 nt, Homo sapiens
aacucuguuaca

SEQ ID NO: 1333929 - RNA, 17 nt, Homo sapiens
aacucuuaagagaacau

SEQ ID NO: 1333930 - RNA, 13 nt, Homo sapiens
aacugaaccaaau

SEQ ID NO: 1333931 - RNA, 20 nt, Homo sapiens
aacugaauagcaaguggcau

SEQ ID NO: 1333932 - RNA, 22 nt, Homo sapiens
aacugacugaaggaaaagcaag

SEQ ID NO: 1333933 - RNA, 12 nt, Homo sapiens
aacugaggccca

SEQ ID NO: 1333934 - RNA, 14 nt, Homo sapiens
aacugcacugucaa

SEQ ID NO: 1333935 - RNA, 17 nt, Homo sapiens
aacugcauuccuucccc

SEQ ID NO: 1333936 - RNA, 12 nt, Homo sapiens
aacugccagcaa

SEQ ID NO: 1333937 - RNA, 23 nt, Homo sapiens
aacuggagccagcaaccagcaca

SEQ ID NO: 1333938 - RNA, 16 nt, Homo sapiens
aacuggugcaugacaa

SEQ ID NO: 1333939 - RNA, 19 nt, Homo sapiens
aacugugauuuuuaucaca

SEQ ID NO: 1333940 - RNA, 17 nt, Homo sapiens
aacuguuaacuaugaca

SEQ ID NO: 1333941 - RNA, 13 nt, Homo sapiens
aacuguugucaua

SEQ ID NO: 1333942 - RNA, 21 nt, Homo sapiens
aacuuacgaucucuugacaua

SEQ ID NO: 1333943 - RNA, 21 nt, Homo sapiens
aacuuacugcgacuaaacuua

SEQ ID NO: 1333944 - RNA, 20 nt, Homo sapiens
aacuucaccuacauuaucuc

SEQ ID NO: 1333945 - RNA, 21 nt, Homo sapiens
aacuucaccuacauuaucuca

SEQ ID NO: 1333946 - RNA, 12 nt, Homo sapiens
aacuucauucuc

SEQ ID NO: 1333947 - RNA, 19 nt, Homo sapiens
aacuucucuugcuuucuau

SEQ ID NO: 1333948 - RNA, 16 nt, Homo sapiens
aacuucuuccugugaa

SEQ ID NO: 1333949 - RNA, 18 nt, Homo sapiens
aacuucuugcuucuuucu

SEQ ID NO: 1333950 - RNA, 19 nt, Homo sapiens
aacuugagauucaagacaa

SEQ ID NO: 1333951 - RNA, 18 nt, Homo sapiens
aacuugauggcuaacuua

SEQ ID NO: 1333952 - RNA, 13 nt, Homo sapiens
aacuugcugccuc

SEQ ID NO: 1333953 - RNA, 19 nt, Homo sapiens
aacuuucucauaagcaccu

SEQ ID NO: 1333954 - RNA, 14 nt, Homo sapiens
aacuuugacuuucu

SEQ ID NO: 1333955 - RNA, 19 nt, Homo sapiens
aacuuuuuuugucuguuga

SEQ ID NO: 1333956 - RNA, 17 nt, Homo sapiens
aagaaacagaguggccu

SEQ ID NO: 1333957 - RNA, 21 nt, Homo sapiens
aagaaagaaaccaagugcgcu

SEQ ID NO: 1333958 - RNA, 15 nt, Homo sapiens
aagaaagacuuauca

SEQ ID NO: 1333959 - RNA, 16 nt, Homo sapiens
aagaaauggcuaugaa

SEQ ID NO: 1333960 - RNA, 20 nt, Homo sapiens
aagaagcagucaauuuucac

SEQ ID NO: 1333961 - RNA, 13 nt, Homo sapiens
aagaauacacaau

SEQ ID NO: 1333962 - RNA, 14 nt, Homo sapiens
aagaauagcuuuaa

SEQ ID NO: 1333963 - RNA, 16 nt, Homo sapiens
aagaaucugcucugaa

SEQ ID NO: 1333964 - RNA, 20 nt, Homo sapiens
aagacaaaugcaacauuuua

SEQ ID NO: 1333965 - RNA, 19 nt, Homo sapiens
aagacagauucuucacugu

SEQ ID NO: 1333966 - RNA, 15 nt, Homo sapiens
aagacagcagacaaa

SEQ ID NO: 1333967 - RNA, 22 nt, Homo sapiens
aagacaggcaaauguacuucuc

SEQ ID NO: 1333968 - RNA, 21 nt, Homo sapiens
aagacauauaacgcagucuaa

SEQ ID NO: 1333969 - RNA, 16 nt, Homo sapiens
aagaccucuugggcag

SEQ ID NO: 1333970 - RNA, 19 nt, Homo sapiens
aagaccugacaccuuucau

SEQ ID NO: 1333971 - RNA, 14 nt, Homo sapiens
aagacguugccuau

SEQ ID NO: 1333972 - RNA, 13 nt, Homo sapiens
aagacuccaaaga

SEQ ID NO: 1333973 - RNA, 17 nt, Homo sapiens
aagacugcaaacccuuu

SEQ ID NO: 1333974 - RNA, 14 nt, Homo sapiens
aagacuuguaauau

SEQ ID NO: 1333975 - RNA, 14 nt, Homo sapiens
aagagaaacuucaa

SEQ ID NO: 1333976 - RNA, 18 nt, Homo sapiens
aagagaaguacuaucuuu

SEQ ID NO: 1333977 - RNA, 15 nt, Homo sapiens
aagagagaagccagc

SEQ ID NO: 1333978 - RNA, 16 nt, Homo sapiens
aagagaucuuucuuuc

SEQ ID NO: 1333979 - RNA, 17 nt, Homo sapiens
aagagaucuuucuuucc

SEQ ID NO: 1333980 - RNA, 19 nt, Homo sapiens
aagagaucuuucuuuccaa

SEQ ID NO: 1333981 - RNA, 20 nt, Homo sapiens
aagagcaguaucagcaucau

SEQ ID NO: 1333982 - RNA, 14 nt, Homo sapiens
aagagcguguccag

SEQ ID NO: 1333983 - RNA, 14 nt, Homo sapiens
aagaggaaagggag

SEQ ID NO: 1333984 - RNA, 13 nt, Homo sapiens
aagaggccuuccc

SEQ ID NO: 1333985 - RNA, 16 nt, Homo sapiens
aagagggcccagccca

SEQ ID NO: 1333986 - RNA, 21 nt, Homo sapiens
aagagucuuguuuuuuauuca

SEQ ID NO: 1333987 - RNA, 19 nt, Homo sapiens
aagaguuucacaaauccuu

SEQ ID NO: 1333988 - RNA, 17 nt, Homo sapiens
aagaucgugaugcuaug

SEQ ID NO: 1333989 - RNA, 18 nt, Homo sapiens
aagaucuguccucagccu

SEQ ID NO: 1333990 - RNA, 23 nt, Homo sapiens
aagaugaaauuugauaaacugaa

SEQ ID NO: 1333991 - RNA, 20 nt, Homo sapiens
aagaugagcuuugucuacuu

SEQ ID NO: 1333992 - RNA, 14 nt, Homo sapiens
aagaugccuugagg

SEQ ID NO: 1333993 - RNA, 22 nt, Homo sapiens
aagaugcuuuuugaucuaccua

SEQ ID NO: 1333994 - RNA, 13 nt, Homo sapiens
aagauggagacac

SEQ ID NO: 1333995 - RNA, 17 nt, Homo sapiens
aagauggagacacccuc

SEQ ID NO: 1333996 - RNA, 21 nt, Homo sapiens
aagauggcugugccucugccu

SEQ ID NO: 1333997 - RNA, 22 nt, Homo sapiens
aagaugugggcagugaugucac

SEQ ID NO: 1333998 - RNA, 17 nt, Homo sapiens
aagauuauacaaucucu

SEQ ID NO: 1333999 - RNA, 13 nt, Homo sapiens
aagauucaauuaa

SEQ ID NO: 1334000 - RNA, 20 nt, Homo sapiens
aagauucauauuuacuucuu

SEQ ID NO: 1334001 - RNA, 17 nt, Homo sapiens
aagcaaacaucaaauaa

SEQ ID NO: 1334002 - RNA, 14 nt, Homo sapiens
aagcaaagcucuuu

SEQ ID NO: 1334003 - RNA, 14 nt, Homo sapiens
aagcaacuagcugg

SEQ ID NO: 1334004 - RNA, 16 nt, Homo sapiens
aagcaagaauggagga

SEQ ID NO: 1334005 - RNA, 19 nt, Homo sapiens
aagcaaguguucacaacag

SEQ ID NO: 1334006 - RNA, 15 nt, Homo sapiens
aagcaauaagaacaa

SEQ ID NO: 1334007 - RNA, 13 nt, Homo sapiens
aagcaauccuccu

SEQ ID NO: 1334008 - RNA, 17 nt, Homo sapiens
aagcaaugguugaugau

SEQ ID NO: 1334009 - RNA, 17 nt, Homo sapiens
aagcaauuuacugauga

SEQ ID NO: 1334010 - RNA, 14 nt, Homo sapiens
aagcacagcccuua

SEQ ID NO: 1334011 - RNA, 19 nt, Homo sapiens
aagcaccuaaaugaugccu

SEQ ID NO: 1334012 - RNA, 11 nt, Homo sapiens
aagcacugccu

SEQ ID NO: 1334013 - RNA, 17 nt, Homo sapiens
aagcagucaauuuucac

SEQ ID NO: 1334014 - RNA, 21 nt, Homo sapiens
aagcagucaauuuucacauca

SEQ ID NO: 1334015 - RNA, 20 nt, Homo sapiens
aagcaguuccugucccacau

SEQ ID NO: 1334016 - RNA, 13 nt, Homo sapiens
aagcauaacuuau

SEQ ID NO: 1334017 - RNA, 19 nt, Homo sapiens
aagcaucugagcuaacuua

SEQ ID NO: 1334018 - RNA, 15 nt, Homo sapiens
aagcaucuggcucua

SEQ ID NO: 1334019 - RNA, 16 nt, Homo sapiens
aagcauguagacugug

SEQ ID NO: 1334020 - RNA, 11 nt, Homo sapiens
aagcauuguaa

SEQ ID NO: 1334021 - RNA, 13 nt, Homo sapiens
aagccagcacuca

SEQ ID NO: 1334022 - RNA, 17 nt, Homo sapiens
aagccagccagaggcau

SEQ ID NO: 1334023 - RNA, 21 nt, Homo sapiens
aagcccaaguucaugcagcug

SEQ ID NO: 1334024 - RNA, 15 nt, Homo sapiens
aagccuaagaaucuu

SEQ ID NO: 1334025 - RNA, 21 nt, Homo sapiens
aagccuccuguaccucagugg

SEQ ID NO: 1334026 - RNA, 20 nt, Homo sapiens
aagccuuuuugucaccucaa

SEQ ID NO: 1334027 - RNA, 18 nt, Homo sapiens
aagcgagcagucagcauu

SEQ ID NO: 1334028 - RNA, 19 nt, Homo sapiens
aagcgagcagucagcauuc

SEQ ID NO: 1334029 - RNA, 18 nt, Homo sapiens
aagcuaaugucacaauua

SEQ ID NO: 1334030 - RNA, 22 nt, Homo sapiens
aagcuacuauguacugccuuag

SEQ ID NO: 1334031 - RNA, 15 nt, Homo sapiens
aagcucucacucugu

SEQ ID NO: 1334032 - RNA, 16 nt, Homo sapiens
aagcugauuuuugucu

SEQ ID NO: 1334033 - RNA, 17 nt, Homo sapiens
aagcugccgguucuuaa

SEQ ID NO: 1334034 - RNA, 12 nt, Homo sapiens
aagcugccucaa

SEQ ID NO: 1334035 - RNA, 14 nt, Homo sapiens
aagcugcucaggga

SEQ ID NO: 1334036 - RNA, 21 nt, Homo sapiens
aagcuggcugugcacuuaccc

SEQ ID NO: 1334037 - RNA, 17 nt, Homo sapiens
aagcuuccuuggcuuuu

SEQ ID NO: 1334038 - RNA, 21 nt, Homo sapiens
aagcuuuauuaccaguggcgu

SEQ ID NO: 1334039 - RNA, 18 nt, Homo sapiens
uuuuacuucucuauacaa

SEQ ID NO: 1334040 - RNA, 16 nt, Homo sapiens
uuuuauuacacauuua

SEQ ID NO: 1334041 - RNA, 17 nt, Homo sapiens
uuuuauuagaaguuuca

SEQ ID NO: 1334042 - RNA, 18 nt, Homo sapiens
uuuuauuuacauucuugc

SEQ ID NO: 1334043 - RNA, 10 nt, Homo sapiens
uuuucacugc

SEQ ID NO: 1334044 - RNA, 15 nt, Homo sapiens
uuuucauuuguaaaa

SEQ ID NO: 1334045 - RNA, 14 nt, Homo sapiens
uuuucccauuucaa

SEQ ID NO: 1334046 - RNA, 15 nt, Homo sapiens
uuuuccuccuugucu

SEQ ID NO: 1334047 - RNA, 16 nt, Homo sapiens
uuuuccucuuagauau

SEQ ID NO: 1334048 - RNA, 12 nt, Homo sapiens
uuuuccuuccag

SEQ ID NO: 1334049 - RNA, 22 nt, Homo sapiens
uuuucuaaaugcuuuuccuuug

SEQ ID NO: 1334050 - RNA, 17 nt, Homo sapiens
uuuucucuaaugcuuga

SEQ ID NO: 1334051 - RNA, 21 nt, Homo sapiens
uuuucuuccuauuuccuugua

SEQ ID NO: 1334052 - RNA, 19 nt, Homo sapiens
uuuucuucuuuuugcuuca

SEQ ID NO: 1334053 - RNA, 13 nt, Homo sapiens
uuuucuuugccau

SEQ ID NO: 1334054 - RNA, 15 nt, Homo sapiens
uuuugcucaguucca

SEQ ID NO: 1334055 - RNA, 15 nt, Homo sapiens
uuuugcucugcucug

SEQ ID NO: 1334056 - RNA, 23 nt, Homo sapiens
uuuugugaucuguaacaggguag

SEQ ID NO: 1334057 - RNA, 17 nt, Homo sapiens
uuuuguuggcauagcuc

SEQ ID NO: 1334058 - RNA, 17 nt, Homo sapiens
uuuuuaaaaaguguuua

SEQ ID NO: 1334059 - RNA, 13 nt, Homo sapiens
uuuuuaauuggcc

SEQ ID NO: 1334060 - RNA, 14 nt, Homo sapiens
uuuuuacagcaaaa

SEQ ID NO: 1334061 - RNA, 13 nt, Homo sapiens
uuuuuauuucuga

SEQ ID NO: 1334062 - RNA, 14 nt, Homo sapiens
uuuuucaguugcag

SEQ ID NO: 1334063 - RNA, 18 nt, Homo sapiens
uuuuuccaauuagcuccu

SEQ ID NO: 1334064 - RNA, 16 nt, Homo sapiens
uuuuuccuccuugucu

SEQ ID NO: 1334065 - RNA, 18 nt, Homo sapiens
uuuuucuaagcauauuca

SEQ ID NO: 1334066 - RNA, 21 nt, Homo sapiens
uuuuugacauuuacuguggau

SEQ ID NO: 1334067 - RNA, 13 nt, Homo sapiens
uuuuuguuauuaa

SEQ ID NO: 1334068 - RNA, 16 nt, Homo sapiens
uuauugauguuuucau

SEQ ID NO: 1334069 - RNA, 17 nt, Homo sapiens
uuauugauucacuuacu

SEQ ID NO: 1334070 - RNA, 13 nt, Homo sapiens
uuauugcuauuaa

SEQ ID NO: 1334071 - RNA, 15 nt, Homo sapiens
uuauuuaacuauuca

SEQ ID NO: 1334072 - RNA, 15 nt, Homo sapiens
uuauuuagauucacu

SEQ ID NO: 1334073 - RNA, 21 nt, Homo sapiens
uuauuugcacuaugagccuau

SEQ ID NO: 1334074 - RNA, 22 nt, Homo sapiens
uuauuuugaaauggaaauuaau

SEQ ID NO: 1334075 - RNA, 17 nt, Homo sapiens
uuauuuuuguucauaua

SEQ ID NO: 1334076 - RNA, 19 nt, Homo sapiens
uucaaacugcaugauucau

SEQ ID NO: 1334077 - RNA, 11 nt, Homo sapiens
uucaacagugu

SEQ ID NO: 1334078 - RNA, 11 nt, Homo sapiens
uucaagugauu

SEQ ID NO: 1334079 - RNA, 22 nt, Homo sapiens
uucaauaaacuuuuuuugucug

SEQ ID NO: 1334080 - RNA, 16 nt, Homo sapiens
acauccuugauuacuu

SEQ ID NO: 1334081 - RNA, 13 nt, Homo sapiens
acaucucagggaa

SEQ ID NO: 1334082 - RNA, 21 nt, Homo sapiens
acaucucagggaacugacccu

SEQ ID NO: 1334083 - RNA, 14 nt, Homo sapiens
acaucuugucauuu

SEQ ID NO: 1334084 - RNA, 17 nt, Homo sapiens
acaugaaaauagcaaua

SEQ ID NO: 1334085 - RNA, 23 nt, Homo sapiens
acaugagucaaaacaaagcagcu

SEQ ID NO: 1334086 - RNA, 17 nt, Homo sapiens
acaugcacucagcucuu

SEQ ID NO: 1334087 - RNA, 18 nt, Homo sapiens
acaugccagccacuguga

SEQ ID NO: 1334088 - RNA, 16 nt, Homo sapiens
acaugcccauuacuaa

SEQ ID NO: 1334089 - RNA, 15 nt, Homo sapiens
acaugcugccuggca

SEQ ID NO: 1334090 - RNA, 14 nt, Homo sapiens
acaugguucaaauc

SEQ ID NO: 1334091 - RNA, 15 nt, Homo sapiens
acauguauugcacau

SEQ ID NO: 1334092 - RNA, 19 nt, Homo sapiens
acauguauugcacauugua

SEQ ID NO: 1334093 - RNA, 21 nt, Homo sapiens
acauguuccuuauauuuacuc

SEQ ID NO: 1334094 - RNA, 20 nt, Homo sapiens
acauuaaacuaguguuauac

SEQ ID NO: 1334095 - RNA, 15 nt, Homo sapiens
acauucacacagaga

SEQ ID NO: 1334096 - RNA, 13 nt, Homo sapiens
acauucagggaaa

SEQ ID NO: 1334097 - RNA, 13 nt, Homo sapiens
acauuccacccca

SEQ ID NO: 1334098 - RNA, 16 nt, Homo sapiens
acauuccaucuuacau

SEQ ID NO: 1334099 - RNA, 18 nt, Homo sapiens
acauuccccucccaccuc

SEQ ID NO: 1334100 - RNA, 21 nt, Homo sapiens
acauucuuagcuguaacuuaa

SEQ ID NO: 1334101 - RNA, 14 nt, Homo sapiens
acauugagcaaaua

SEQ ID NO: 1334102 - RNA, 16 nt, Homo sapiens
acauugggagucugua

SEQ ID NO: 1334103 - RNA, 16 nt, Homo sapiens
acauugguucuuucau

SEQ ID NO: 1334104 - RNA, 19 nt, Homo sapiens
acauuguguccugcuuaua

SEQ ID NO: 1334105 - RNA, 23 nt, Homo sapiens
acauuuauguaauuuuauuuaca

SEQ ID NO: 1334106 - RNA, 14 nt, Homo sapiens
acauuucuuuggaa

SEQ ID NO: 1334107 - RNA, 14 nt, Homo sapiens
acauuuguuccaug

SEQ ID NO: 1334108 - RNA, 15 nt, Homo sapiens
acauuuuacauuaaa

SEQ ID NO: 1334109 - RNA, 19 nt, Homo sapiens
acauuuuacccacacacag

SEQ ID NO: 1334110 - RNA, 23 nt, Homo sapiens
acauuuuacuuuuuccuggcuca

SEQ ID NO: 1334111 - RNA, 12 nt, Homo sapiens
accaaaaacuga

SEQ ID NO: 1334112 - RNA, 14 nt, Homo sapiens
accaaaaacugaaa

SEQ ID NO: 1334113 - RNA, 12 nt, Homo sapiens
accaaaauugag

SEQ ID NO: 1334114 - RNA, 15 nt, Homo sapiens
accaaagcaucaaua

SEQ ID NO: 1334115 - RNA, 17 nt, Homo sapiens
accaacaggcccagcuu

SEQ ID NO: 1334116 - RNA, 18 nt, Homo sapiens
accaacugugaaaggaac

SEQ ID NO: 1334117 - RNA, 15 nt, Homo sapiens
accaagcauguccca

SEQ ID NO: 1334118 - RNA, 14 nt, Homo sapiens
accaauacuacuga

SEQ ID NO: 1334119 - RNA, 19 nt, Homo sapiens
accaauacuacugacgucc

SEQ ID NO: 1334120 - RNA, 16 nt, Homo sapiens
accacaaggggcucca

SEQ ID NO: 1334121 - RNA, 19 nt, Homo sapiens
accacacgcccccacaggc

SEQ ID NO: 1334122 - RNA, 19 nt, Homo sapiens
accacagacucaaugugcu

SEQ ID NO: 1334123 - RNA, 14 nt, Homo sapiens
accaccuaauccuu

SEQ ID NO: 1334124 - RNA, 15 nt, Homo sapiens
accaccuaguucucc

SEQ ID NO: 1334125 - RNA, 16 nt, Homo sapiens
accaccucugugggca

SEQ ID NO: 1334126 - RNA, 20 nt, Homo sapiens
accacgaggaaaagaacaaa

SEQ ID NO: 1334127 - RNA, 16 nt, Homo sapiens
accacuaccagccagc

SEQ ID NO: 1334128 - RNA, 15 nt, Homo sapiens
accacuccacuggcc

SEQ ID NO: 1334129 - RNA, 16 nt, Homo sapiens
accacucccaccacag

SEQ ID NO: 1334130 - RNA, 19 nt, Homo sapiens
accagaaagcuucauccac

SEQ ID NO: 1334131 - RNA, 15 nt, Homo sapiens
accagacacccagga

SEQ ID NO: 1334132 - RNA, 14 nt, Homo sapiens
accagaucagauaa

SEQ ID NO: 1334133 - RNA, 20 nt, Homo sapiens
accagaucagggacuugaau

SEQ ID NO: 1334134 - RNA, 11 nt, Homo sapiens
accagcacauc

SEQ ID NO: 1334135 - RNA, 21 nt, Homo sapiens
accagcuucugauaaacacaa

SEQ ID NO: 1334136 - RNA, 22 nt, Homo sapiens
accaggcagugugccaguuuaa

SEQ ID NO: 1334137 - RNA, 16 nt, Homo sapiens
accagggcucuucuca

SEQ ID NO: 1334138 - RNA, 22 nt, Homo sapiens
accaggguccuuuugacacugc

SEQ ID NO: 1334139 - RNA, 16 nt, Homo sapiens
accagguuugcaggag

SEQ ID NO: 1334140 - RNA, 18 nt, Homo sapiens
accaguaugaaugacaau

SEQ ID NO: 1334141 - RNA, 19 nt, Homo sapiens
accaguaugaaugacaauu

SEQ ID NO: 1334142 - RNA, 17 nt, Homo sapiens
accaguuaaaagcauuu

SEQ ID NO: 1334143 - RNA, 19 nt, Homo sapiens
accaguuaaaagcauuuua

SEQ ID NO: 1334144 - RNA, 16 nt, Homo sapiens
accauaacaacuucau

SEQ ID NO: 1334145 - RNA, 20 nt, Homo sapiens
accauccuggccaacauugu

SEQ ID NO: 1334146 - RNA, 19 nt, Homo sapiens
accaugagugugccacuuu

SEQ ID NO: 1334147 - RNA, 9 nt, Homo sapiens
accaugcug

SEQ ID NO: 1334148 - RNA, 23 nt, Homo sapiens
accauuuaauggggaggacaaaa

SEQ ID NO: 1334149 - RNA, 14 nt, Homo sapiens
acccaaacccccug

SEQ ID NO: 1334150 - RNA, 20 nt, Homo sapiens
acccaaagauucuagugagu

SEQ ID NO: 1334151 - RNA, 21 nt, Homo sapiens
acccaaggaugucugccacac

SEQ ID NO: 1334152 - RNA, 13 nt, Homo sapiens
acccacaaacucc

SEQ ID NO: 1334153 - RNA, 19 nt, Homo sapiens
acccacaauugaacuucca

SEQ ID NO: 1334154 - RNA, 19 nt, Homo sapiens
acccaccccacaauuccuc

SEQ ID NO: 1334155 - RNA, 14 nt, Homo sapiens
acccacucaugacu

SEQ ID NO: 1334156 - RNA, 19 nt, Homo sapiens
acccagaaagaauguucag

SEQ ID NO: 1334157 - RNA, 13 nt, Homo sapiens
acccagcaggcag

SEQ ID NO: 1334158 - RNA, 14 nt, Homo sapiens
acccaggaagggaa

SEQ ID NO: 1334159 - RNA, 22 nt, Homo sapiens
acccaggaguauccucuugcca

SEQ ID NO: 1334160 - RNA, 15 nt, Homo sapiens
acccaguagaugcca

SEQ ID NO: 1334161 - RNA, 16 nt, Homo sapiens
acccagucccacacug

SEQ ID NO: 1334162 - RNA, 22 nt, Homo sapiens
acccagucccacacuguggcca

SEQ ID NO: 1334163 - RNA, 15 nt, Homo sapiens
acccaguccugcaca

SEQ ID NO: 1334164 - RNA, 18 nt, Homo sapiens
acccaguugugacaauua

SEQ ID NO: 1334165 - RNA, 22 nt, Homo sapiens
acccaucuuuaauuuauaucag

SEQ ID NO: 1334166 - RNA, 19 nt, Homo sapiens
accccaaaggaacacugac

SEQ ID NO: 1334167 - RNA, 20 nt, Homo sapiens
accccaaaggaacacugaca

SEQ ID NO: 1334168 - RNA, 21 nt, Homo sapiens
accccaaaggaacacugacau

SEQ ID NO: 1334169 - RNA, 23 nt, Homo sapiens
accccaaaggaacacugacauca

SEQ ID NO: 1334170 - RNA, 14 nt, Homo sapiens
accccacucagggg

SEQ ID NO: 1334171 - RNA, 17 nt, Homo sapiens
acccccccacaaggaac

SEQ ID NO: 1334172 - RNA, 22 nt, Homo sapiens
accccgaccaccugcccaaccu

SEQ ID NO: 1334173 - RNA, 16 nt, Homo sapiens
accccggccugucuca

SEQ ID NO: 1334174 - RNA, 15 nt, Homo sapiens
accccguagauuccc

SEQ ID NO: 1334175 - RNA, 13 nt, Homo sapiens
accccuacaugaa

SEQ ID NO: 1334176 - RNA, 13 nt, Homo sapiens
accccuagcccug

SEQ ID NO: 1334177 - RNA, 17 nt, Homo sapiens
accccucacugugacug

SEQ ID NO: 1334178 - RNA, 20 nt, Homo sapiens
accccuccaguuuugccuga

SEQ ID NO: 1334179 - RNA, 19 nt, Homo sapiens
accccucuuucgucuacug

SEQ ID NO: 1334180 - RNA, 16 nt, Homo sapiens
acccuaaagugcaaaa

SEQ ID NO: 1334181 - RNA, 17 nt, Homo sapiens
acccucaggaauucagu

SEQ ID NO: 1334182 - RNA, 16 nt, Homo sapiens
acccucaucacuagga

SEQ ID NO: 1334183 - RNA, 13 nt, Homo sapiens
acccugaguucau

SEQ ID NO: 1334184 - RNA, 15 nt, Homo sapiens
acccugcaaagggaa

SEQ ID NO: 1334185 - RNA, 19 nt, Homo sapiens
acccugcuuuggcggcccg

SEQ ID NO: 1334186 - RNA, 11 nt, Homo sapiens
acccuggugcu

SEQ ID NO: 1334187 - RNA, 14 nt, Homo sapiens
acccuuaccaaaaa

SEQ ID NO: 1334188 - RNA, 22 nt, Homo sapiens
acccuuaggccagcaccaucuc

SEQ ID NO: 1334189 - RNA, 10 nt, Homo sapiens
acccuuccag

SEQ ID NO: 1334190 - RNA, 19 nt, Homo sapiens
acccuuggagccaauggag

SEQ ID NO: 1334191 - RNA, 19 nt, Homo sapiens
acccuuguuuacacauacc

SEQ ID NO: 1334192 - RNA, 23 nt, Homo sapiens
acccuuucauaaagucuugccuu

SEQ ID NO: 1334193 - RNA, 21 nt, Homo sapiens
accgagguucccacucugggc

SEQ ID NO: 1334194 - RNA, 15 nt, Homo sapiens
accgcaggugcucau

SEQ ID NO: 1334195 - RNA, 18 nt, Homo sapiens
accgccacgucccagcau

SEQ ID NO: 1334196 - RNA, 22 nt, Homo sapiens
accgcgcccagccuacauucac

SEQ ID NO: 1334197 - RNA, 21 nt, Homo sapiens
accgucuucucccuauucccu

SEQ ID NO: 1334198 - RNA, 23 nt, Homo sapiens
accguucauucaggcaacgcaca

SEQ ID NO: 1334199 - RNA, 15 nt, Homo sapiens
accuaaaacccaaag

SEQ ID NO: 1334200 - RNA, 14 nt, Homo sapiens
accuaauccaggca

SEQ ID NO: 1334201 - RNA, 18 nt, Homo sapiens
accuaauccaggcagauc

SEQ ID NO: 1334202 - RNA, 14 nt, Homo sapiens
accuacauuaucuc

SEQ ID NO: 1334203 - RNA, 15 nt, Homo sapiens
accuacauuaucuca

SEQ ID NO: 1334204 - RNA, 12 nt, Homo sapiens
accuacauuuga

SEQ ID NO: 1334205 - RNA, 23 nt, Homo sapiens
accuaguucuccccgauggggca

SEQ ID NO: 1334206 - RNA, 21 nt, Homo sapiens
accuaugagauggccaugcuc

SEQ ID NO: 1334207 - RNA, 19 nt, Homo sapiens
accuauggcaauuuagcuc

SEQ ID NO: 1334208 - RNA, 11 nt, Homo sapiens
accucaauauu

SEQ ID NO: 1334209 - RNA, 22 nt, Homo sapiens
accucacuuuaggcagcuguaa

SEQ ID NO: 1334210 - RNA, 13 nt, Homo sapiens
accucaucagccu

SEQ ID NO: 1334211 - RNA, 20 nt, Homo sapiens
accuccaagcauuucaugaa

SEQ ID NO: 1334212 - RNA, 18 nt, Homo sapiens
accuccagugucaggguc

SEQ ID NO: 1334213 - RNA, 18 nt, Homo sapiens
acugguucugaggccaga

SEQ ID NO: 1334214 - RNA, 16 nt, Homo sapiens
acuguacaaaauaagu

SEQ ID NO: 1334215 - RNA, 21 nt, Homo sapiens
acuguacacagaauuguucca

SEQ ID NO: 1334216 - RNA, 23 nt, Homo sapiens
acuguaggaauuuucuugaaacu

SEQ ID NO: 1334217 - RNA, 12 nt, Homo sapiens
acugucaggguu

SEQ ID NO: 1334218 - RNA, 14 nt, Homo sapiens
acugucaguucucu

SEQ ID NO: 1334219 - RNA, 14 nt, Homo sapiens
acugucauagaaau

SEQ ID NO: 1334220 - RNA, 21 nt, Homo sapiens
acuguccacuuggagcuaaaa

SEQ ID NO: 1334221 - RNA, 12 nt, Homo sapiens
acugucucaaga

SEQ ID NO: 1334222 - RNA, 23 nt, Homo sapiens
acugugaaggaacucugcaguua

SEQ ID NO: 1334223 - RNA, 23 nt, Homo sapiens
acugugcuguacugagcacugaa

SEQ ID NO: 1334224 - RNA, 21 nt, Homo sapiens
acuguguaauuagugccacuu

SEQ ID NO: 1334225 - RNA, 13 nt, Homo sapiens
acuguguaccuca

SEQ ID NO: 1334226 - RNA, 23 nt, Homo sapiens
acugugucauucuguuagauacu

SEQ ID NO: 1334227 - RNA, 16 nt, Homo sapiens
acuguuaacuaugaca

SEQ ID NO: 1334228 - RNA, 18 nt, Homo sapiens
acuguucaaacucaggcc

SEQ ID NO: 1334229 - RNA, 16 nt, Homo sapiens
acuguuccagauuccu

SEQ ID NO: 1334230 - RNA, 19 nt, Homo sapiens
acuuaacaugggcucuuca

SEQ ID NO: 1334231 - RNA, 19 nt, Homo sapiens
acuuaagaguggcauauaa

SEQ ID NO: 1334232 - RNA, 23 nt, Homo sapiens
acuuaagguuaccuuuguuccca

SEQ ID NO: 1334233 - RNA, 18 nt, Homo sapiens
acuuaauguucuuaugca

SEQ ID NO: 1334234 - RNA, 18 nt, Homo sapiens
acuuaauugccagcaaau

SEQ ID NO: 1334235 - RNA, 22 nt, Homo sapiens
acuuacaaguuucuagcucuca

SEQ ID NO: 1334236 - RNA, 15 nt, Homo sapiens
acuuacauaucugac

SEQ ID NO: 1334237 - RNA, 19 nt, Homo sapiens
acuuaccgagucagacuuu

SEQ ID NO: 1334238 - RNA, 23 nt, Homo sapiens
acuuagaaauugcauuuccugac

SEQ ID NO: 1334239 - RNA, 18 nt, Homo sapiens
acuuauaguacaugauaa

SEQ ID NO: 1334240 - RNA, 21 nt, Homo sapiens
acuuauauuuaaaacuugccu

SEQ ID NO: 1334241 - RNA, 15 nt, Homo sapiens
acuucaaagcugaau

SEQ ID NO: 1334242 - RNA, 15 nt, Homo sapiens
acuucaaagugccug

SEQ ID NO: 1334243 - RNA, 14 nt, Homo sapiens
acuucaaaguuaau

SEQ ID NO: 1334244 - RNA, 13 nt, Homo sapiens
acuucaagcucuc

SEQ ID NO: 1334245 - RNA, 18 nt, Homo sapiens
acuucaaugcacauggug

SEQ ID NO: 1334246 - RNA, 13 nt, Homo sapiens
acuucaccaaaga

SEQ ID NO: 1334247 - RNA, 14 nt, Homo sapiens
acuucaccaaagag

SEQ ID NO: 1334248 - RNA, 17 nt, Homo sapiens
acuucauucacauucag

SEQ ID NO: 1334249 - RNA, 18 nt, Homo sapiens
acuucauucacauucaga

SEQ ID NO: 1334250 - RNA, 19 nt, Homo sapiens
acuucauucucgugaguca

SEQ ID NO: 1334251 - RNA, 14 nt, Homo sapiens
acuuccaugacaua

SEQ ID NO: 1334252 - RNA, 23 nt, Homo sapiens
acuuccucuggcuccccaaggcu

SEQ ID NO: 1334253 - RNA, 20 nt, Homo sapiens
acuuccugccauggaucucu

SEQ ID NO: 1334254 - RNA, 23 nt, Homo sapiens
acuuccugugccuuuccuaucac

SEQ ID NO: 1334255 - RNA, 23 nt, Homo sapiens
acuucuaggauuuauuguuauau

SEQ ID NO: 1334256 - RNA, 22 nt, Homo sapiens
acuucucagccugguacuugua

SEQ ID NO: 1334257 - RNA, 15 nt, Homo sapiens
acuucuggagucuau

SEQ ID NO: 1334258 - RNA, 22 nt, Homo sapiens
acuucugucuguugaggcauca

SEQ ID NO: 1334259 - RNA, 19 nt, Homo sapiens
acuucuuauacauuugaua

SEQ ID NO: 1334260 - RNA, 20 nt, Homo sapiens
acuucuuuauucacaguauc

SEQ ID NO: 1334261 - RNA, 21 nt, Homo sapiens
acuugaaauuuggcuaauaac

SEQ ID NO: 1334262 - RNA, 19 nt, Homo sapiens
acuugauauuuaagcagcu

SEQ ID NO: 1334263 - RNA, 21 nt, Homo sapiens
acuugccuguucagagcacuc

SEQ ID NO: 1334264 - RNA, 19 nt, Homo sapiens
acuugcuccuuuugcucuu

SEQ ID NO: 1334265 - RNA, 17 nt, Homo sapiens
acuuggcugcauuugcc

SEQ ID NO: 1334266 - RNA, 17 nt, Homo sapiens
acuuuaccucuguggac

SEQ ID NO: 1334267 - RNA, 13 nt, Homo sapiens
acuuuaucaauua

SEQ ID NO: 1334268 - RNA, 18 nt, Homo sapiens
acuuucaguaaacauaaa

SEQ ID NO: 1334269 - RNA, 15 nt, Homo sapiens
acuuucccucaucca

SEQ ID NO: 1334270 - RNA, 16 nt, Homo sapiens
acuuuccucaguugau

SEQ ID NO: 1334271 - RNA, 16 nt, Homo sapiens
acuuucuaugugacau

SEQ ID NO: 1334272 - RNA, 22 nt, Homo sapiens
acuuucuuaagcaacaauggau

SEQ ID NO: 1334273 - RNA, 16 nt, Homo sapiens
acuuugaagcaacugu

SEQ ID NO: 1334274 - RNA, 18 nt, Homo sapiens
acuuuguggucgacauca

SEQ ID NO: 1334275 - RNA, 13 nt, Homo sapiens
acuuuuaucacug

SEQ ID NO: 1334276 - RNA, 23 nt, Homo sapiens
acuuuucuuuuuuucaaaugaau

SEQ ID NO: 1334277 - RNA, 17 nt, Homo sapiens
acuuuuuccuggcucau

SEQ ID NO: 1334278 - RNA, 21 nt, Homo sapiens
agaaaaccuguucuaccaagc

SEQ ID NO: 1334279 - RNA, 19 nt, Homo sapiens
agaaaaggccuucuuccca

SEQ ID NO: 1334280 - RNA, 17 nt, Homo sapiens
agaaaauaaauuuaacu

SEQ ID NO: 1334281 - RNA, 19 nt, Homo sapiens
agaaacaguugguaacuuu

SEQ ID NO: 1334282 - RNA, 18 nt, Homo sapiens
agaaaccacagucuuccc

SEQ ID NO: 1334283 - RNA, 14 nt, Homo sapiens
agaaaccugacuca

SEQ ID NO: 1334284 - RNA, 20 nt, Homo sapiens
agaaaccuggggugaauacu

SEQ ID NO: 1334285 - RNA, 14 nt, Homo sapiens
agaaagauagcuug

SEQ ID NO: 1334286 - RNA, 15 nt, Homo sapiens
agaaagccuauucca

SEQ ID NO: 1334287 - RNA, 20 nt, Homo sapiens
agaaagcugcacuggugcua

SEQ ID NO: 1334288 - RNA, 20 nt, Homo sapiens
agaaagggauugcugaggca

SEQ ID NO: 1334289 - RNA, 15 nt, Homo sapiens
agaaaguaaacugua

SEQ ID NO: 1334290 - RNA, 16 nt, Homo sapiens
agaaaguaagcauuuc

SEQ ID NO: 1334291 - RNA, 15 nt, Homo sapiens
agaaagugacaugca

SEQ ID NO: 1334292 - RNA, 13 nt, Homo sapiens
agaaaugucaugu

SEQ ID NO: 1334293 - RNA, 16 nt, Homo sapiens
agaaauuaaacauauu

SEQ ID NO: 1334294 - RNA, 17 nt, Homo sapiens
agaaauuaaaucugaau

SEQ ID NO: 1334295 - RNA, 16 nt, Homo sapiens
agaacagaaguguuca

SEQ ID NO: 1334296 - RNA, 12 nt, Homo sapiens
agaaccaaaggg

SEQ ID NO: 1334297 - RNA, 16 nt, Homo sapiens
agaaccagggcucuuc

SEQ ID NO: 1334298 - RNA, 21 nt, Homo sapiens
agaaccaugcaggaaggaaaa

SEQ ID NO: 1334299 - RNA, 19 nt, Homo sapiens
agaaccucagauucuucau

SEQ ID NO: 1334300 - RNA, 19 nt, Homo sapiens
agaaccuggauguacuuaa

SEQ ID NO: 1334301 - RNA, 14 nt, Homo sapiens
agaaccuucaaccc

SEQ ID NO: 1334302 - RNA, 21 nt, Homo sapiens
agaacucaaauggggccagau

SEQ ID NO: 1334303 - RNA, 21 nt, Homo sapiens
agaacucuugacuuccugcca

SEQ ID NO: 1334304 - RNA, 20 nt, Homo sapiens
agaacuuccccucccuuccc

SEQ ID NO: 1334305 - RNA, 14 nt, Homo sapiens
agaagaaggccaga

SEQ ID NO: 1334306 - RNA, 12 nt, Homo sapiens
agaagaugcuua

SEQ ID NO: 1334307 - RNA, 12 nt, Homo sapiens
agaagcaauggg

SEQ ID NO: 1334308 - RNA, 18 nt, Homo sapiens
agaagcacugggugacca

SEQ ID NO: 1334309 - RNA, 14 nt, Homo sapiens
agaagccagccaca

SEQ ID NO: 1334310 - RNA, 15 nt, Homo sapiens
agaagccccgucucu

SEQ ID NO: 1334311 - RNA, 20 nt, Homo sapiens
agaagcugaggcuaguucca

SEQ ID NO: 1334312 - RNA, 13 nt, Homo sapiens
agaaggauuaccu

SEQ ID NO: 1334313 - RNA, 20 nt, Homo sapiens
agaagggauaucuacugugg

SEQ ID NO: 1334314 - RNA, 21 nt, Homo sapiens
agaagggcagcuccacagggc

SEQ ID NO: 1334315 - RNA, 23 nt, Homo sapiens
agaaggucuguggugcagugugu

SEQ ID NO: 1334316 - RNA, 13 nt, Homo sapiens
agaaguacuaucu

SEQ ID NO: 1334317 - RNA, 12 nt, Homo sapiens
agaaguaggggu

SEQ ID NO: 1334318 - RNA, 16 nt, Homo sapiens
agaaguggcauaaaug

SEQ ID NO: 1334319 - RNA, 22 nt, Homo sapiens
agaaguuccuagugauggcuua

SEQ ID NO: 1334320 - RNA, 18 nt, Homo sapiens
agaaguuuguagccaggu

SEQ ID NO: 1334321 - RNA, 17 nt, Homo sapiens
agaauaaaggcaguuuu

SEQ ID NO: 1334322 - RNA, 15 nt, Homo sapiens
agaauaaauucccaa

SEQ ID NO: 1334323 - RNA, 17 nt, Homo sapiens
agaauaaauucuaccuc

SEQ ID NO: 1334324 - RNA, 22 nt, Homo sapiens
agaaucuguauucagacccugg

SEQ ID NO: 1334325 - RNA, 15 nt, Homo sapiens
agaaugagacaucca

SEQ ID NO: 1334326 - RNA, 14 nt, Homo sapiens
agaauggaggaauc

SEQ ID NO: 1334327 - RNA, 18 nt, Homo sapiens
agaaugguugaguuacau

SEQ ID NO: 1334328 - RNA, 22 nt, Homo sapiens
agaaugguugaguuacauuaaa

SEQ ID NO: 1334329 - RNA, 21 nt, Homo sapiens
agaauguuuucaaauguucuc

SEQ ID NO: 1334330 - RNA, 17 nt, Homo sapiens
agacacauacagagugg

SEQ ID NO: 1334331 - RNA, 19 nt, Homo sapiens
agacagacaacacugggaa

SEQ ID NO: 1334332 - RNA, 21 nt, Homo sapiens
agacagauucuucacuguguu

SEQ ID NO: 1334333 - RNA, 19 nt, Homo sapiens
agacagcagggacaagaua

SEQ ID NO: 1334334 - RNA, 16 nt, Homo sapiens
agacagcuucucugca

SEQ ID NO: 1334335 - RNA, 21 nt, Homo sapiens
agacauaguaccgaauuuagu

SEQ ID NO: 1334336 - RNA, 14 nt, Homo sapiens
agacaugguggggu

SEQ ID NO: 1334337 - RNA, 21 nt, Homo sapiens
agaccagagggacacuaggaa

SEQ ID NO: 1334338 - RNA, 23 nt, Homo sapiens
agaccagcccaccccugugccca

SEQ ID NO: 1334339 - RNA, 13 nt, Homo sapiens
agaccaguccaug

SEQ ID NO: 1334340 - RNA, 20 nt, Homo sapiens
agacccaacauuacuaacaa

SEQ ID NO: 1334341 - RNA, 15 nt, Homo sapiens
agaccucaucugugg

SEQ ID NO: 1334342 - RNA, 21 nt, Homo sapiens
agaccuggcuccacucuugau

SEQ ID NO: 1334343 - RNA, 16 nt, Homo sapiens
agacuagacuacucaa

SEQ ID NO: 1334344 - RNA, 18 nt, Homo sapiens
aguauaaugcaguacauu

SEQ ID NO: 1334345 - RNA, 20 nt, Homo sapiens
aguauauuuuugcaggugcu

SEQ ID NO: 1334346 - RNA, 22 nt, Homo sapiens
aguauauuuuugcaggugcuuu

SEQ ID NO: 1334347 - RNA, 16 nt, Homo sapiens
aguaucacaaaaccac

SEQ ID NO: 1334348 - RNA, 19 nt, Homo sapiens
aguauccugcuucugauau

SEQ ID NO: 1334349 - RNA, 13 nt, Homo sapiens
aguaugguauaug

SEQ ID NO: 1334350 - RNA, 15 nt, Homo sapiens
aguauguggaagugu

SEQ ID NO: 1334351 - RNA, 19 nt, Homo sapiens
aguauuaaaaugcuuacau

SEQ ID NO: 1334352 - RNA, 16 nt, Homo sapiens
aguauuuagaagccaa

SEQ ID NO: 1334353 - RNA, 20 nt, Homo sapiens
aguauuuagaagccaacuau

SEQ ID NO: 1334354 - RNA, 17 nt, Homo sapiens
aguauuucuacauuaca

SEQ ID NO: 1334355 - RNA, 14 nt, Homo sapiens
agucaauguacuug

SEQ ID NO: 1334356 - RNA, 15 nt, Homo sapiens
agucagaaccacuaa

SEQ ID NO: 1334357 - RNA, 14 nt, Homo sapiens
agucaguccaggau

SEQ ID NO: 1334358 - RNA, 13 nt, Homo sapiens
agucaguguuaaa

SEQ ID NO: 1334359 - RNA, 22 nt, Homo sapiens
agucaucuaccugaguccugaa

SEQ ID NO: 1334360 - RNA, 14 nt, Homo sapiens
agucccacacugug

SEQ ID NO: 1334361 - RNA, 15 nt, Homo sapiens
agucccacacugugc

SEQ ID NO: 1334362 - RNA, 15 nt, Homo sapiens
agucccacacugugg

SEQ ID NO: 1334363 - RNA, 14 nt, Homo sapiens
agucccugccugaa

SEQ ID NO: 1334364 - RNA, 18 nt, Homo sapiens
aguccuaacuuccugugc

SEQ ID NO: 1334365 - RNA, 18 nt, Homo sapiens
aguccuccacucgaccca

SEQ ID NO: 1334366 - RNA, 19 nt, Homo sapiens
aguccucgcggcucuccag

SEQ ID NO: 1334367 - RNA, 13 nt, Homo sapiens
aguccuguucaga

SEQ ID NO: 1334368 - RNA, 19 nt, Homo sapiens
aguccuuaggcuacuguaa

SEQ ID NO: 1334369 - RNA, 16 nt, Homo sapiens
agucggccccaucucu

SEQ ID NO: 1334370 - RNA, 16 nt, Homo sapiens
agucucuggaaaaaga

SEQ ID NO: 1334371 - RNA, 13 nt, Homo sapiens
agucugaaacugg

SEQ ID NO: 1334372 - RNA, 24 nt, Homo sapiens
agucuggcagacuuucuucucuau

SEQ ID NO: 1334373 - RNA, 14 nt, Homo sapiens
agucuguugauuaa

SEQ ID NO: 1334374 - RNA, 17 nt, Homo sapiens
agucuguuguucuugaa

SEQ ID NO: 1334375 - RNA, 20 nt, Homo sapiens
agucuuccacuucaaugcac

SEQ ID NO: 1334376 - RNA, 16 nt, Homo sapiens
agucuucccagcaauu

SEQ ID NO: 1334377 - RNA, 18 nt, Homo sapiens
agucuucccagcaauuau

SEQ ID NO: 1334378 - RNA, 14 nt, Homo sapiens
agucuucuauuuau

SEQ ID NO: 1334379 - RNA, 11 nt, Homo sapiens
agucuugccuu

SEQ ID NO: 1334380 - RNA, 16 nt, Homo sapiens
agucuugccuugcuga

SEQ ID NO: 1334381 - RNA, 20 nt, Homo sapiens
agucuugggucuaugccuug

SEQ ID NO: 1334382 - RNA, 17 nt, Homo sapiens
agugaaccuagauugca

SEQ ID NO: 1334383 - RNA, 15 nt, Homo sapiens
agugacaaccaaaag

SEQ ID NO: 1334384 - RNA, 16 nt, Homo sapiens
agugacagaucacagg

SEQ ID NO: 1334385 - RNA, 18 nt, Homo sapiens
agugacaggacuuucauu

SEQ ID NO: 1334386 - RNA, 14 nt, Homo sapiens
agugacaugcauuc

SEQ ID NO: 1334387 - RNA, 16 nt, Homo sapiens
agugacaugcauucac

SEQ ID NO: 1334388 - RNA, 21 nt, Homo sapiens
agugacaugcauucacauauc

SEQ ID NO: 1334389 - RNA, 16 nt, Homo sapiens
agugaccucacuggcc

SEQ ID NO: 1334390 - RNA, 13 nt, Homo sapiens
agugacgcugcug

SEQ ID NO: 1334391 - RNA, 13 nt, Homo sapiens
agugagaagccag

SEQ ID NO: 1334392 - RNA, 19 nt, Homo sapiens
agugagacuagacauagua

SEQ ID NO: 1334393 - RNA, 21 nt, Homo sapiens
agugagcacacccgugugcac

SEQ ID NO: 1334394 - RNA, 22 nt, Homo sapiens
agugagcacucacgcccuaagc

SEQ ID NO: 1334395 - RNA, 22 nt, Homo sapiens
agugagccugaauuuuguugcu

SEQ ID NO: 1334396 - RNA, 16 nt, Homo sapiens
agugagcugugaucac

SEQ ID NO: 1334397 - RNA, 15 nt, Homo sapiens
agugauuccaucaaa

SEQ ID NO: 1334398 - RNA, 19 nt, Homo sapiens
agugcaagccccugcucca

SEQ ID NO: 1334399 - RNA, 21 nt, Homo sapiens
agugcaagccccugcuccaga

SEQ ID NO: 1334400 - RNA, 14 nt, Homo sapiens
agugcaccaucuca

SEQ ID NO: 1334401 - RNA, 15 nt, Homo sapiens
agugcaccaucucac

SEQ ID NO: 1334402 - RNA, 16 nt, Homo sapiens
agugcaccugccucca

SEQ ID NO: 1334403 - RNA, 17 nt, Homo sapiens
agugcaguccauuuccu

SEQ ID NO: 1334404 - RNA, 15 nt, Homo sapiens
agugcagugauguuu

SEQ ID NO: 1334405 - RNA, 20 nt, Homo sapiens
agugccaugauugcuagcca

SEQ ID NO: 1334406 - RNA, 19 nt, Homo sapiens
agugccccaccacucccca

SEQ ID NO: 1334407 - RNA, 13 nt, Homo sapiens
agugcccuaggcc

SEQ ID NO: 1334408 - RNA, 20 nt, Homo sapiens
agugcccucgagcacugaag

SEQ ID NO: 1334409 - RNA, 20 nt, Homo sapiens
agugccuucuaaagguguug

SEQ ID NO: 1334410 - RNA, 15 nt, Homo sapiens
agugcuauuguagag

SEQ ID NO: 1334411 - RNA, 15 nt, Homo sapiens
agugcugaccagaca

SEQ ID NO: 1334412 - RNA, 16 nt, Homo sapiens
aguggaguuggugaau

SEQ ID NO: 1334413 - RNA, 22 nt, Homo sapiens
aguggaucuucagaacugcccu

SEQ ID NO: 1334414 - RNA, 12 nt, Homo sapiens
aguggccaguuc

SEQ ID NO: 1334415 - RNA, 14 nt, Homo sapiens
aguggcugccaugg

SEQ ID NO: 1334416 - RNA, 19 nt, Homo sapiens
aguggcuugagcuucuggg

SEQ ID NO: 1334417 - RNA, 15 nt, Homo sapiens
agugggaagggagca

SEQ ID NO: 1334418 - RNA, 16 nt, Homo sapiens
aguggggcugcaggca

SEQ ID NO: 1334419 - RNA, 14 nt, Homo sapiens
agugucucuucaag

SEQ ID NO: 1334420 - RNA, 16 nt, Homo sapiens
agugucugucauuuca

SEQ ID NO: 1334421 - RNA, 23 nt, Homo sapiens
agugugaaacagcugcccugugu

SEQ ID NO: 1334422 - RNA, 14 nt, Homo sapiens
agugugaagaccca

SEQ ID NO: 1334423 - RNA, 22 nt, Homo sapiens
agugugaagacccaaaacagcu

SEQ ID NO: 1334424 - RNA, 16 nt, Homo sapiens
agugugagauacugug

SEQ ID NO: 1334425 - RNA, 18 nt, Homo sapiens
aguguggccugugccagc

SEQ ID NO: 1334426 - RNA, 20 nt, Homo sapiens
aguguggguuuauauaagga

SEQ ID NO: 1334427 - RNA, 22 nt, Homo sapiens
agugugugaaaauucaggugcu

SEQ ID NO: 1334428 - RNA, 16 nt, Homo sapiens
aguguucacauggcuc

SEQ ID NO: 1334429 - RNA, 23 nt, Homo sapiens
aguguucacauggcucucaugua

SEQ ID NO: 1334430 - RNA, 21 nt, Homo sapiens
aguguuggagaacaacaaaua

SEQ ID NO: 1334431 - RNA, 19 nt, Homo sapiens
aguguuuuggaggccugac

SEQ ID NO: 1334432 - RNA, 13 nt, Homo sapiens
aguuaagaaccug

SEQ ID NO: 1334433 - RNA, 14 nt, Homo sapiens
aguuaagaaccuga

SEQ ID NO: 1334434 - RNA, 23 nt, Homo sapiens
aguuacaguucugugguuucaug

SEQ ID NO: 1334435 - RNA, 17 nt, Homo sapiens
aguuaccagugccuuaa

SEQ ID NO: 1334436 - RNA, 15 nt, Homo sapiens
aguuaguuccacuga

SEQ ID NO: 1334437 - RNA, 16 nt, Homo sapiens
aguuaucuuugaauau

SEQ ID NO: 1334438 - RNA, 15 nt, Homo sapiens
aguuauuuaugcuau

SEQ ID NO: 1334439 - RNA, 15 nt, Homo sapiens
aguucaauaauccau

SEQ ID NO: 1334440 - RNA, 19 nt, Homo sapiens
aguucaugcagcuguggca

SEQ ID NO: 1334441 - RNA, 19 nt, Homo sapiens
aguuccaaaauaaagcaua

SEQ ID NO: 1334442 - RNA, 19 nt, Homo sapiens
aguuccagaaaaccucucc

SEQ ID NO: 1334443 - RNA, 13 nt, Homo sapiens
aguuccucugcag

SEQ ID NO: 1334444 - RNA, 21 nt, Homo sapiens
aguucucauggguggcacuca

SEQ ID NO: 1334445 - RNA, 16 nt, Homo sapiens
aguucuuugggccaga

SEQ ID NO: 1334446 - RNA, 17 nt, Homo sapiens
aguucuuugggccagac

SEQ ID NO: 1334447 - RNA, 19 nt, Homo sapiens
aguucuuugggccagacau

SEQ ID NO: 1334448 - RNA, 13 nt, Homo sapiens
aguugacaguauu

SEQ ID NO: 1334449 - RNA, 14 nt, Homo sapiens
aguugacaguauua

SEQ ID NO: 1334450 - RNA, 17 nt, Homo sapiens
aguugcaguaguaucaa

SEQ ID NO: 1334451 - RNA, 19 nt, Homo sapiens
aguugcugcauuccuaaac

SEQ ID NO: 1334452 - RNA, 14 nt, Homo sapiens
aguuguuagauuaa

SEQ ID NO: 1334453 - RNA, 15 nt, Homo sapiens
aguuguuauauucau

SEQ ID NO: 1334454 - RNA, 16 nt, Homo sapiens
aguuuaaagauucuau

SEQ ID NO: 1334455 - RNA, 19 nt, Homo sapiens
aguuuaagccgcagaccug

SEQ ID NO: 1334456 - RNA, 18 nt, Homo sapiens
aguuuaaugccuagcaga

SEQ ID NO: 1334457 - RNA, 22 nt, Homo sapiens
aguuuaugcugugcuaaauauc

SEQ ID NO: 1334458 - RNA, 18 nt, Homo sapiens
aguuuauguuguacaaug

SEQ ID NO: 1334459 - RNA, 21 nt, Homo sapiens
aguuucucagcucccaaggcu

SEQ ID NO: 1334460 - RNA, 23 nt, Homo sapiens
aguuucuugcuuggaagccaggu

SEQ ID NO: 1334461 - RNA, 14 nt, Homo sapiens
aguuucuuuucaca

SEQ ID NO: 1334462 - RNA, 18 nt, Homo sapiens
aguuugcucuaccaaaua

SEQ ID NO: 1334463 - RNA, 16 nt, Homo sapiens
aguuugcugcaaccca

SEQ ID NO: 1334464 - RNA, 20 nt, Homo sapiens
aguuuuaaacaaaugugaua

SEQ ID NO: 1334465 - RNA, 13 nt, Homo sapiens
aguuuuccagugg

SEQ ID NO: 1334466 - RNA, 20 nt, Homo sapiens
aguuuucuggagugagcacu

SEQ ID NO: 1334467 - RNA, 13 nt, Homo sapiens
auaaaaaaugaca

SEQ ID NO: 1334468 - RNA, 22 nt, Homo sapiens
auaaaaacugcccauuguaacu

SEQ ID NO: 1334469 - RNA, 23 nt, Homo sapiens
auaaaaccuguucucuuuaauca

SEQ ID NO: 1334470 - RNA, 15 nt, Homo sapiens
auaaaagacaaaugc

SEQ ID NO: 1334471 - RNA, 17 nt, Homo sapiens
auaaacaaagacauuga

SEQ ID NO: 1334472 - RNA, 19 nt, Homo sapiens
auaaacauuucauuuccca

SEQ ID NO: 1334473 - RNA, 16 nt, Homo sapiens
auaaaccaaaggaaaa

SEQ ID NO: 1334474 - RNA, 14 nt, Homo sapiens
auaaacugaguuua

SEQ ID NO: 1334475 - RNA, 20 nt, Homo sapiens
auaaacuguaugcucacaac

SEQ ID NO: 1334476 - RNA, 19 nt, Homo sapiens
auaaaggaucagagauucu

SEQ ID NO: 1334477 - RNA, 16 nt, Homo sapiens
auuuuuuaaggcaaua

SEQ ID NO: 1334478 - RNA, 21 nt, Homo sapiens
auuuuuuacagcugccugcag

SEQ ID NO: 1334479 - RNA, 22 nt, Homo sapiens
auuuuuuauuucuaaguauuua

SEQ ID NO: 1334480 - RNA, 19 nt, Homo sapiens
caaaaaccuauuccacuua

SEQ ID NO: 1334481 - RNA, 19 nt, Homo sapiens
caaaaauagagaaaauuca

SEQ ID NO: 1334482 - RNA, 15 nt, Homo sapiens
caaaaauuacaaaga

SEQ ID NO: 1334483 - RNA, 22 nt, Homo sapiens
caaaaauuacaaagaaccaugc

SEQ ID NO: 1334484 - RNA, 14 nt, Homo sapiens
caaaaauuaucuau

SEQ ID NO: 1334485 - RNA, 12 nt, Homo sapiens
caaaacuacuga

SEQ ID NO: 1334486 - RNA, 15 nt, Homo sapiens
caaaacuugcaucua

SEQ ID NO: 1334487 - RNA, 20 nt, Homo sapiens
caaaagcugcucagggaaaa

SEQ ID NO: 1334488 - RNA, 19 nt, Homo sapiens
caaaaggauaaaugucuuu

SEQ ID NO: 1334489 - RNA, 17 nt, Homo sapiens
caaaaguuuguuugcuu

SEQ ID NO: 1334490 - RNA, 19 nt, Homo sapiens
caaaauaaauagugucucu

SEQ ID NO: 1334491 - RNA, 22 nt, Homo sapiens
caaaauccaaaaagcucugaaa

SEQ ID NO: 1334492 - RNA, 14 nt, Homo sapiens
caaaauccaaggca

SEQ ID NO: 1334493 - RNA, 15 nt, Homo sapiens
caaaaugauuuugaa

SEQ ID NO: 1334494 - RNA, 15 nt, Homo sapiens
caaaccagacaccug

SEQ ID NO: 1334495 - RNA, 13 nt, Homo sapiens
caaaccaggauuu

SEQ ID NO: 1334496 - RNA, 16 nt, Homo sapiens
caaaccccgaccaccu

SEQ ID NO: 1334497 - RNA, 13 nt, Homo sapiens
caaaccuauggaa

SEQ ID NO: 1334498 - RNA, 15 nt, Homo sapiens
caaacuccugaccuc

SEQ ID NO: 1334499 - RNA, 11 nt, Homo sapiens
caaacuggccg

SEQ ID NO: 1334500 - RNA, 14 nt, Homo sapiens
caaacuggcuuaau

SEQ ID NO: 1334501 - RNA, 21 nt, Homo sapiens
caaacuucccugacucuucaa

SEQ ID NO: 1334502 - RNA, 14 nt, Homo sapiens
caaagaacuguaua

SEQ ID NO: 1334503 - RNA, 21 nt, Homo sapiens
caaagaacuucuccuacugua

SEQ ID NO: 1334504 - RNA, 22 nt, Homo sapiens
caaagaacuucuccuacuguag

SEQ ID NO: 1334505 - RNA, 18 nt, Homo sapiens
caaagacaucagucucca

SEQ ID NO: 1334506 - RNA, 18 nt, Homo sapiens
caaagauaauuuauuuca

SEQ ID NO: 1334507 - RNA, 14 nt, Homo sapiens
caaagaugacugug

SEQ ID NO: 1334508 - RNA, 21 nt, Homo sapiens
caaagauuaaaugugucauug

SEQ ID NO: 1334509 - RNA, 15 nt, Homo sapiens
caaagauucuaguga

SEQ ID NO: 1334510 - RNA, 16 nt, Homo sapiens
caaagccggcuugauu

SEQ ID NO: 1334511 - RNA, 22 nt, Homo sapiens
caaagcggucccugucccucua

SEQ ID NO: 1334512 - RNA, 17 nt, Homo sapiens
caaagggaaaaaagagu

SEQ ID NO: 1334513 - RNA, 20 nt, Homo sapiens
caaaggucaagaacacagug

SEQ ID NO: 1334514 - RNA, 18 nt, Homo sapiens
caaaggugcacuccagac

SEQ ID NO: 1334515 - RNA, 19 nt, Homo sapiens
caaagguggcagcuuguga

SEQ ID NO: 1334516 - RNA, 12 nt, Homo sapiens
caaaggugugcu

SEQ ID NO: 1334517 - RNA, 23 nt, Homo sapiens
caaaggugugcuuccugcuguau

SEQ ID NO: 1334518 - RNA, 17 nt, Homo sapiens
caaagugcuggaauuac

SEQ ID NO: 1334519 - RNA, 19 nt, Homo sapiens
caaagugcugggauuacag

SEQ ID NO: 1334520 - RNA, 20 nt, Homo sapiens
caaaguuuaaauguauuuua

SEQ ID NO: 1334521 - RNA, 22 nt, Homo sapiens
caaauaaaggaaacccagcuca

SEQ ID NO: 1334522 - RNA, 18 nt, Homo sapiens
caaauacaaucagcccag

SEQ ID NO: 1334523 - RNA, 23 nt, Homo sapiens
caaauacaaucagcccagugcaa

SEQ ID NO: 1334524 - RNA, 17 nt, Homo sapiens
caaauauauuauuuagu

SEQ ID NO: 1334525 - RNA, 21 nt, Homo sapiens
caaauaugcaaagcacugacu

SEQ ID NO: 1334526 - RNA, 12 nt, Homo sapiens
caaaucaaggau

SEQ ID NO: 1334527 - RNA, 20 nt, Homo sapiens
caaaucaaggauaaauaucu

SEQ ID NO: 1334528 - RNA, 20 nt, Homo sapiens
caaauccuagacugcuccug

SEQ ID NO: 1334529 - RNA, 22 nt, Homo sapiens
caaauccuucaaaauaaaaagu

SEQ ID NO: 1334530 - RNA, 18 nt, Homo sapiens
caaaucuuaacuugaagg

SEQ ID NO: 1334531 - RNA, 23 nt, Homo sapiens
caaauggcagaaccaaagcucaa

SEQ ID NO: 1334532 - RNA, 14 nt, Homo sapiens
caaauggccucaug

SEQ ID NO: 1334533 - RNA, 18 nt, Homo sapiens
caaaugggaaaaccagac

SEQ ID NO: 1334534 - RNA, 20 nt, Homo sapiens
caaauuaucuuuuuucuucc

SEQ ID NO: 1334535 - RNA, 16 nt, Homo sapiens
caaauuuugauccuaa

SEQ ID NO: 1334536 - RNA, 16 nt, Homo sapiens
caacaauguguuguaa

SEQ ID NO: 1334537 - RNA, 13 nt, Homo sapiens
caacacagaggaa

SEQ ID NO: 1334538 - RNA, 18 nt, Homo sapiens
caacacccaaguugaaga

SEQ ID NO: 1334539 - RNA, 14 nt, Homo sapiens
caacagcaaaggaa

SEQ ID NO: 1334540 - RNA, 23 nt, Homo sapiens
caacagcaccuccccgcugggaa

SEQ ID NO: 1334541 - RNA, 23 nt, Homo sapiens
caacagcuuuucgucuucagugu

SEQ ID NO: 1334542 - RNA, 19 nt, Homo sapiens
caacaugccagccacugug

SEQ ID NO: 1334543 - RNA, 23 nt, Homo sapiens
caacauggagaagccccgucucu

SEQ ID NO: 1334544 - RNA, 16 nt, Homo sapiens
caaccaacaacaaugu

SEQ ID NO: 1334545 - RNA, 14 nt, Homo sapiens
caacccaaggugag

SEQ ID NO: 1334546 - RNA, 18 nt, Homo sapiens
caacccccuuaacuguau

SEQ ID NO: 1334547 - RNA, 17 nt, Homo sapiens
caacccgaggcaauaaa

SEQ ID NO: 1334548 - RNA, 17 nt, Homo sapiens
caacccuacaguauaua

SEQ ID NO: 1334549 - RNA, 14 nt, Homo sapiens
caacccuucccuca

SEQ ID NO: 1334550 - RNA, 13 nt, Homo sapiens
caacccuuucauu

SEQ ID NO: 1334551 - RNA, 19 nt, Homo sapiens
caaccuccgccuuccgggu

SEQ ID NO: 1334552 - RNA, 13 nt, Homo sapiens
caacuacuaauag

SEQ ID NO: 1334553 - RNA, 20 nt, Homo sapiens
caagaagguggaaggcagug

SEQ ID NO: 1334554 - RNA, 16 nt, Homo sapiens
caagagcaugcacaug

SEQ ID NO: 1334555 - RNA, 16 nt, Homo sapiens
caagauaaaaaucaca

SEQ ID NO: 1334556 - RNA, 21 nt, Homo sapiens
caagauacauaugaggacaag

SEQ ID NO: 1334557 - RNA, 13 nt, Homo sapiens
caagcaacacaga

SEQ ID NO: 1334558 - RNA, 16 nt, Homo sapiens
caagcaccaaccucca

SEQ ID NO: 1334559 - RNA, 21 nt, Homo sapiens
caagcauuucaugaaaaagcu

SEQ ID NO: 1334560 - RNA, 17 nt, Homo sapiens
caagcccuguugacaca

SEQ ID NO: 1334561 - RNA, 16 nt, Homo sapiens
caagccugucuucaga

SEQ ID NO: 1334562 - RNA, 22 nt, Homo sapiens
caagcuccuccucccugcaucu

SEQ ID NO: 1334563 - RNA, 14 nt, Homo sapiens
caagcuggcacaaa

SEQ ID NO: 1334564 - RNA, 21 nt, Homo sapiens
caagcugguggccucugcagg

SEQ ID NO: 1334565 - RNA, 15 nt, Homo sapiens
caagcugucccugca

SEQ ID NO: 1334566 - RNA, 17 nt, Homo sapiens
caaggaaagaccaguuu

SEQ ID NO: 1334567 - RNA, 19 nt, Homo sapiens
caaggagcaagaaaugaac

SEQ ID NO: 1334568 - RNA, 18 nt, Homo sapiens
caaggagcauccuuggca

SEQ ID NO: 1334569 - RNA, 21 nt, Homo sapiens
caaggcaggaggaucacuuga

SEQ ID NO: 1334570 - RNA, 19 nt, Homo sapiens
caaggcccugcccugccca

SEQ ID NO: 1334571 - RNA, 16 nt, Homo sapiens
caagggagacaccagu

SEQ ID NO: 1334572 - RNA, 13 nt, Homo sapiens
caagggagacuga

SEQ ID NO: 1334573 - RNA, 15 nt, Homo sapiens
caagggagacugacc

SEQ ID NO: 1334574 - RNA, 19 nt, Homo sapiens
caagggagacugaccauca

SEQ ID NO: 1334575 - RNA, 17 nt, Homo sapiens
caagggaucugguccua

SEQ ID NO: 1334576 - RNA, 21 nt, Homo sapiens
caagggauggacaucuuguca

SEQ ID NO: 1334577 - RNA, 22 nt, Homo sapiens
caagguggugugaucuuaauau

SEQ ID NO: 1334578 - RNA, 17 nt, Homo sapiens
caagguuacuuaauuca

SEQ ID NO: 1334579 - RNA, 17 nt, Homo sapiens
caaguccaaacuggcaa

SEQ ID NO: 1334580 - RNA, 12 nt, Homo sapiens
caaguccaagca

SEQ ID NO: 1334581 - RNA, 22 nt, Homo sapiens
caagucccuuugugacuucaag

SEQ ID NO: 1334582 - RNA, 16 nt, Homo sapiens
caagugacucuccugc

SEQ ID NO: 1334583 - RNA, 20 nt, Homo sapiens
caagugaugcuaaaaccuga

SEQ ID NO: 1334584 - RNA, 15 nt, Homo sapiens
caaguggagcugucu

SEQ ID NO: 1334585 - RNA, 15 nt, Homo sapiens
caaguuaguucaauc

SEQ ID NO: 1334586 - RNA, 22 nt, Homo sapiens
caauaaaaucagugugcuugcc

SEQ ID NO: 1334587 - RNA, 21 nt, Homo sapiens
caauaaacauuucauuuccca

SEQ ID NO: 1334588 - RNA, 21 nt, Homo sapiens
caauaacauacaugagauaac

SEQ ID NO: 1334589 - RNA, 14 nt, Homo sapiens
caauaauccaugaa

SEQ ID NO: 1334590 - RNA, 19 nt, Homo sapiens
caauacuuacauaucugac

SEQ ID NO: 1334591 - RNA, 17 nt, Homo sapiens
caauagugaaaugccac

SEQ ID NO: 1334592 - RNA, 16 nt, Homo sapiens
caaucagaucaacucu

SEQ ID NO: 1334593 - RNA, 22 nt, Homo sapiens
caaucaggaauugaaaauuuaa

SEQ ID NO: 1334594 - RNA, 12 nt, Homo sapiens
caaucauagcau

SEQ ID NO: 1334595 - RNA, 16 nt, Homo sapiens
caauccugauucauau

SEQ ID NO: 1334596 - RNA, 19 nt, Homo sapiens
caauccuugccacagugug

SEQ ID NO: 1334597 - RNA, 19 nt, Homo sapiens
caaucuaaagauacagugu

SEQ ID NO: 1334598 - RNA, 18 nt, Homo sapiens
caaucuaagggagucauu

SEQ ID NO: 1334599 - RNA, 20 nt, Homo sapiens
caaucucugggggcugagga

SEQ ID NO: 1334600 - RNA, 22 nt, Homo sapiens
caaucugcaaaaaaaugugcau

SEQ ID NO: 1334601 - RNA, 15 nt, Homo sapiens
caaucuuugccuuua

SEQ ID NO: 1334602 - RNA, 16 nt, Homo sapiens
caaugaagauccaagc

SEQ ID NO: 1334603 - RNA, 17 nt, Homo sapiens
caaugauacaguugcau

SEQ ID NO: 1334604 - RNA, 16 nt, Homo sapiens
caaugauggcaauuuu

SEQ ID NO: 1334605 - RNA, 23 nt, Homo sapiens
caaugccaaaaaaagacagggcu

SEQ ID NO: 1334606 - RNA, 18 nt, Homo sapiens
caaugcugucugguugcg

SEQ ID NO: 1334607 - RNA, 18 nt, Homo sapiens
caauggcgcgaucuuggc

SEQ ID NO: 1334608 - RNA, 21 nt, Homo sapiens
caauguucuuugucucaaaau

SEQ ID NO: 1334609 - RNA, 19 nt, Homo sapiens
cugaaucagcuggacauac

SEQ ID NO: 1334610 - RNA, 18 nt, Homo sapiens
cugaaugacuccacuguu

SEQ ID NO: 1334611 - RNA, 18 nt, Homo sapiens
cugacaacugugaagcca

SEQ ID NO: 1334612 - RNA, 19 nt, Homo sapiens
cugacaauaaaggaacuaa

SEQ ID NO: 1334613 - RNA, 19 nt, Homo sapiens
cugacacaccaggcgcuaa

SEQ ID NO: 1334614 - RNA, 16 nt, Homo sapiens
cugacacagacauccu

SEQ ID NO: 1334615 - RNA, 14 nt, Homo sapiens
cugacaccuuucau

SEQ ID NO: 1334616 - RNA, 15 nt, Homo sapiens
cugacagggccagug

SEQ ID NO: 1334617 - RNA, 16 nt, Homo sapiens
cugacagggccagugc

SEQ ID NO: 1334618 - RNA, 21 nt, Homo sapiens
cugacaugcucacacauuaca

SEQ ID NO: 1334619 - RNA, 14 nt, Homo sapiens
cugaccaacaugga

SEQ ID NO: 1334620 - RNA, 16 nt, Homo sapiens
cugaccauuuggucag

SEQ ID NO: 1334621 - RNA, 15 nt, Homo sapiens
cugaccuugaaucuu

SEQ ID NO: 1334622 - RNA, 13 nt, Homo sapiens
cugacuguauaca

SEQ ID NO: 1334623 - RNA, 19 nt, Homo sapiens
cugacuuauggcaugacuc

SEQ ID NO: 1334624 - RNA, 19 nt, Homo sapiens
cugacuucuaggauuuauu

SEQ ID NO: 1334625 - RNA, 15 nt, Homo sapiens
cugagacagcuuguc

SEQ ID NO: 1334626 - RNA, 21 nt, Homo sapiens
cugagcacugaaccacauuca

SEQ ID NO: 1334627 - RNA, 13 nt, Homo sapiens
cugagcagcaucc

SEQ ID NO: 1334628 - RNA, 18 nt, Homo sapiens
cugagccuggucccacga

SEQ ID NO: 1334629 - RNA, 23 nt, Homo sapiens
cugaggacaagagaaaaaagcca

SEQ ID NO: 1334630 - RNA, 18 nt, Homo sapiens
cugaggcagaaggauuac

SEQ ID NO: 1334631 - RNA, 15 nt, Homo sapiens
cugagggcaguucug

SEQ ID NO: 1334632 - RNA, 17 nt, Homo sapiens
cugagggcugaaaacgg

SEQ ID NO: 1334633 - RNA, 16 nt, Homo sapiens
cugagggggugggggu

SEQ ID NO: 1334634 - RNA, 23 nt, Homo sapiens
cugaggguugggguggggaagca

SEQ ID NO: 1334635 - RNA, 19 nt, Homo sapiens
cugaguagcuggauuacag

SEQ ID NO: 1334636 - RNA, 18 nt, Homo sapiens
cugaguagcugggauuac

SEQ ID NO: 1334637 - RNA, 15 nt, Homo sapiens
cugauaccauucuau

SEQ ID NO: 1334638 - RNA, 18 nt, Homo sapiens
cugauccauaaagacaau

SEQ ID NO: 1334639 - RNA, 13 nt, Homo sapiens
cugaugacagugu

SEQ ID NO: 1334640 - RNA, 19 nt, Homo sapiens
cugaugacuuuauccugag

SEQ ID NO: 1334641 - RNA, 22 nt, Homo sapiens
cugaugacuuuauccugagucc

SEQ ID NO: 1334642 - RNA, 17 nt, Homo sapiens
cugauggaaaaugcaaa

SEQ ID NO: 1334643 - RNA, 14 nt, Homo sapiens
cugauggugacauu

SEQ ID NO: 1334644 - RNA, 15 nt, Homo sapiens
cugauguacucuaaa

SEQ ID NO: 1334645 - RNA, 16 nt, Homo sapiens
cugauguauaauguaa

SEQ ID NO: 1334646 - RNA, 19 nt, Homo sapiens
cugauucugauugcuauca

SEQ ID NO: 1334647 - RNA, 15 nt, Homo sapiens
cugcaaacacaccuu

SEQ ID NO: 1334648 - RNA, 15 nt, Homo sapiens
cugcaaacccuuuca

SEQ ID NO: 1334649 - RNA, 20 nt, Homo sapiens
cugcaaagaucuguccucag

SEQ ID NO: 1334650 - RNA, 22 nt, Homo sapiens
cugcaaagcccuuggaacaccc

SEQ ID NO: 1334651 - RNA, 22 nt, Homo sapiens
cugcaaaggcgucugaaugugu

SEQ ID NO: 1334652 - RNA, 13 nt, Homo sapiens
cugcaagaccacg

SEQ ID NO: 1334653 - RNA, 12 nt, Homo sapiens
cugcacacuguc

SEQ ID NO: 1334654 - RNA, 21 nt, Homo sapiens
cugcacacuguccuauuauau

SEQ ID NO: 1334655 - RNA, 17 nt, Homo sapiens
cugcacagugcaucuca

SEQ ID NO: 1334656 - RNA, 19 nt, Homo sapiens
cugcacgcucaaugcccag

SEQ ID NO: 1334657 - RNA, 18 nt, Homo sapiens
cugcacucccaccugaca

SEQ ID NO: 1334658 - RNA, 13 nt, Homo sapiens
cugcagauuugau

SEQ ID NO: 1334659 - RNA, 19 nt, Homo sapiens
cugcagccugcaggaccuc

SEQ ID NO: 1334660 - RNA, 23 nt, Homo sapiens
cugcagcucagggacuggcacac

SEQ ID NO: 1334661 - RNA, 19 nt, Homo sapiens
cugcaggcagccugccuuu

SEQ ID NO: 1334662 - RNA, 20 nt, Homo sapiens
cugcaguacaacaguuuuag

SEQ ID NO: 1334663 - RNA, 22 nt, Homo sapiens
cugcaguagugcaccaucucac

SEQ ID NO: 1334664 - RNA, 16 nt, Homo sapiens
cugcaguuccaaaaga

SEQ ID NO: 1334665 - RNA, 14 nt, Homo sapiens
cugcauaguuccca

SEQ ID NO: 1334666 - RNA, 15 nt, Homo sapiens
cugcauguuuuccag

SEQ ID NO: 1334667 - RNA, 22 nt, Homo sapiens
cugcauuugccugucaugcgca

SEQ ID NO: 1334668 - RNA, 18 nt, Homo sapiens
cugccaaaggaugugaua

SEQ ID NO: 1334669 - RNA, 17 nt, Homo sapiens
cugccacagacuguggu

SEQ ID NO: 1334670 - RNA, 22 nt, Homo sapiens
cugccacccccuucccugggag

SEQ ID NO: 1334671 - RNA, 16 nt, Homo sapiens
cugccagcucucagga

SEQ ID NO: 1334672 - RNA, 16 nt, Homo sapiens
cugccagcugcacuga

SEQ ID NO: 1334673 - RNA, 21 nt, Homo sapiens
cugccaggcaugguagcucau

SEQ ID NO: 1334674 - RNA, 13 nt, Homo sapiens
cugccagggccag

SEQ ID NO: 1334675 - RNA, 18 nt, Homo sapiens
cugccagggccagucuug

SEQ ID NO: 1334676 - RNA, 14 nt, Homo sapiens
cugcccacuggccg

SEQ ID NO: 1334677 - RNA, 15 nt, Homo sapiens
cugcccucuauuuau

SEQ ID NO: 1334678 - RNA, 18 nt, Homo sapiens
cugcccuuucaaagcacu

SEQ ID NO: 1334679 - RNA, 21 nt, Homo sapiens
cugccuggaggcaaaggccug

SEQ ID NO: 1334680 - RNA, 20 nt, Homo sapiens
cugccugggccguggcacag

SEQ ID NO: 1334681 - RNA, 22 nt, Homo sapiens
cugccuuaaauguaccuauggc

SEQ ID NO: 1334682 - RNA, 14 nt, Homo sapiens
cugccuuagccuac

SEQ ID NO: 1334683 - RNA, 22 nt, Homo sapiens
cugccuuagugcugaugccugu

SEQ ID NO: 1334684 - RNA, 13 nt, Homo sapiens
cugcgcagcaucc

SEQ ID NO: 1334685 - RNA, 21 nt, Homo sapiens
cugcgccaccucacugcagua

SEQ ID NO: 1334686 - RNA, 21 nt, Homo sapiens
cugcgcccugccgcacccgcg

SEQ ID NO: 1334687 - RNA, 16 nt, Homo sapiens
cugcgccugacauuca

SEQ ID NO: 1334688 - RNA, 21 nt, Homo sapiens
cugcgugcacuucccagagca

SEQ ID NO: 1334689 - RNA, 21 nt, Homo sapiens
cugcuacuggcaaaaggaucu

SEQ ID NO: 1334690 - RNA, 17 nt, Homo sapiens
cugcuagggaauaucaa

SEQ ID NO: 1334691 - RNA, 12 nt, Homo sapiens
cugcuauaacua

SEQ ID NO: 1334692 - RNA, 22 nt, Homo sapiens
cugcucagcccugcaccaugcu

SEQ ID NO: 1334693 - RNA, 12 nt, Homo sapiens
cugcuccagaag

SEQ ID NO: 1334694 - RNA, 14 nt, Homo sapiens
cugcuccaucucau

SEQ ID NO: 1334695 - RNA, 14 nt, Homo sapiens
cugcucccacagaa

SEQ ID NO: 1334696 - RNA, 19 nt, Homo sapiens
cugcucccccugguggugg

SEQ ID NO: 1334697 - RNA, 22 nt, Homo sapiens
cugcuccuccccuuucacaggu

SEQ ID NO: 1334698 - RNA, 17 nt, Homo sapiens
cugcucuuguucuacug

SEQ ID NO: 1334699 - RNA, 18 nt, Homo sapiens
cugcugaaacaacaaaua

SEQ ID NO: 1334700 - RNA, 14 nt, Homo sapiens
cugcugaauucacc

SEQ ID NO: 1334701 - RNA, 18 nt, Homo sapiens
cugcugagagggcugcug

SEQ ID NO: 1334702 - RNA, 20 nt, Homo sapiens
cugcugauaucaacagcuuc

SEQ ID NO: 1334703 - RNA, 14 nt, Homo sapiens
cugcuguaucuuua

SEQ ID NO: 1334704 - RNA, 20 nt, Homo sapiens
cugcuuccaauuuucuggaa

SEQ ID NO: 1334705 - RNA, 20 nt, Homo sapiens
cuggaaauagcccuguaaca

SEQ ID NO: 1334706 - RNA, 19 nt, Homo sapiens
cuggaacguuucacugcaa

SEQ ID NO: 1334707 - RNA, 14 nt, Homo sapiens
cuggaauacaugaa

SEQ ID NO: 1334708 - RNA, 15 nt, Homo sapiens
cuggaauuauuuuag

SEQ ID NO: 1334709 - RNA, 18 nt, Homo sapiens
cuggacacaauaggucuu

SEQ ID NO: 1334710 - RNA, 20 nt, Homo sapiens
cuggacacagcucuucauuc

SEQ ID NO: 1334711 - RNA, 13 nt, Homo sapiens
cuggacacuucac

SEQ ID NO: 1334712 - RNA, 11 nt, Homo sapiens
cuggacuguca

SEQ ID NO: 1334713 - RNA, 18 nt, Homo sapiens
cuggagcaauaaaagaca

SEQ ID NO: 1334714 - RNA, 21 nt, Homo sapiens
cuggagccaucucuuccucau

SEQ ID NO: 1334715 - RNA, 14 nt, Homo sapiens
cuggaguccagugc

SEQ ID NO: 1334716 - RNA, 13 nt, Homo sapiens
cuggagugcaaug

SEQ ID NO: 1334717 - RNA, 20 nt, Homo sapiens
cuggagugcaguggcgcgau

SEQ ID NO: 1334718 - RNA, 19 nt, Homo sapiens
cuggauccagcacugguga

SEQ ID NO: 1334719 - RNA, 13 nt, Homo sapiens
cuggauccaucag

SEQ ID NO: 1334720 - RNA, 22 nt, Homo sapiens
cuggauguacuauccaaucugu

SEQ ID NO: 1334721 - RNA, 18 nt, Homo sapiens
cuggauguacuuaagagu

SEQ ID NO: 1334722 - RNA, 21 nt, Homo sapiens
cuggaugucugggugaccuca

SEQ ID NO: 1334723 - RNA, 17 nt, Homo sapiens
cuggaugugaguuucca

SEQ ID NO: 1334724 - RNA, 20 nt, Homo sapiens
cuggauuacaggcaugugcc

SEQ ID NO: 1334725 - RNA, 20 nt, Homo sapiens
cuggauugcgccuaaugugu

SEQ ID NO: 1334726 - RNA, 13 nt, Homo sapiens
cuggcaaauccag

SEQ ID NO: 1334727 - RNA, 23 nt, Homo sapiens
cuggcaacaugaagaaugcauuc

SEQ ID NO: 1334728 - RNA, 15 nt, Homo sapiens
cuggcacaguuuucu

SEQ ID NO: 1334729 - RNA, 16 nt, Homo sapiens
cuggccauauuuacua

SEQ ID NO: 1334730 - RNA, 19 nt, Homo sapiens
cuggcccuguuucuggucu

SEQ ID NO: 1334731 - RNA, 20 nt, Homo sapiens
cuggccggagucagugccag

SEQ ID NO: 1334732 - RNA, 16 nt, Homo sapiens
cuggccgucacacgua

SEQ ID NO: 1334733 - RNA, 21 nt, Homo sapiens
cuggccuauuuaucugaucaa

SEQ ID NO: 1334734 - RNA, 19 nt, Homo sapiens
cuggccuccuaugccucau

SEQ ID NO: 1334735 - RNA, 20 nt, Homo sapiens
cuggcuucucuugagucaca

SEQ ID NO: 1334736 - RNA, 17 nt, Homo sapiens
cuggcuuuacauggguu

SEQ ID NO: 1334737 - RNA, 17 nt, Homo sapiens
cuggcuuuugugcccaa

SEQ ID NO: 1334738 - RNA, 13 nt, Homo sapiens
cugggaaggccag

SEQ ID NO: 1334739 - RNA, 19 nt, Homo sapiens
cugggagcccagaacccac

SEQ ID NO: 1334740 - RNA, 17 nt, Homo sapiens
cugggagcccucaggca

SEQ ID NO: 1334741 - RNA, 15 nt, Homo sapiens
gaagaucgugaugcu

SEQ ID NO: 1334742 - RNA, 14 nt, Homo sapiens
gaagauggagacac

SEQ ID NO: 1334743 - RNA, 13 nt, Homo sapiens
gaagccagugucu

SEQ ID NO: 1334744 - RNA, 22 nt, Homo sapiens
gaagcuacgggcacaacuggaa

SEQ ID NO: 1334745 - RNA, 16 nt, Homo sapiens
gaagcuuccuuggcuu

SEQ ID NO: 1334746 - RNA, 19 nt, Homo sapiens
gaagcuucuaaauggugcu

SEQ ID NO: 1334747 - RNA, 22 nt, Homo sapiens
gaagcuucuaaauggugcugca

SEQ ID NO: 1334748 - RNA, 19 nt, Homo sapiens
gaaggaaaagauacccaaa

SEQ ID NO: 1334749 - RNA, 18 nt, Homo sapiens
gaaggacuugacugggga

SEQ ID NO: 1334750 - RNA, 16 nt, Homo sapiens
gaaggcaaaugaugcc

SEQ ID NO: 1334751 - RNA, 15 nt, Homo sapiens
gaaggccccagagag

SEQ ID NO: 1334752 - RNA, 15 nt, Homo sapiens
gaagggauaucuacu

SEQ ID NO: 1334753 - RNA, 12 nt, Homo sapiens
gaagggccagag

SEQ ID NO: 1334754 - RNA, 20 nt, Homo sapiens
gaagguaacuagaaagugag

SEQ ID NO: 1334755 - RNA, 21 nt, Homo sapiens
gaagguaauguuuaauguuga

SEQ ID NO: 1334756 - RNA, 15 nt, Homo sapiens
gaaggucccucagac

SEQ ID NO: 1334757 - RNA, 16 nt, Homo sapiens
gaaggucccucagaca

SEQ ID NO: 1334758 - RNA, 13 nt, Homo sapiens
gaagguugcucua

SEQ ID NO: 1334759 - RNA, 17 nt, Homo sapiens
gaaguaagcaacuagcu

SEQ ID NO: 1334760 - RNA, 20 nt, Homo sapiens
gaaguagacucauucuucac

SEQ ID NO: 1334761 - RNA, 22 nt, Homo sapiens
gaagucaccccuuucuguccca

SEQ ID NO: 1334762 - RNA, 16 nt, Homo sapiens
gaagucacugcacagu

SEQ ID NO: 1334763 - RNA, 12 nt, Homo sapiens
gaagucauucuu

SEQ ID NO: 1334764 - RNA, 15 nt, Homo sapiens
gaagucuucuauuua

SEQ ID NO: 1334765 - RNA, 17 nt, Homo sapiens
gaagugaaaacuuugua

SEQ ID NO: 1334766 - RNA, 17 nt, Homo sapiens
gaagugugggucugugu

SEQ ID NO: 1334767 - RNA, 12 nt, Homo sapiens
gaaguguuucac

SEQ ID NO: 1334768 - RNA, 22 nt, Homo sapiens
gaaguuauggcuucacauucau

SEQ ID NO: 1334769 - RNA, 17 nt, Homo sapiens
gaaguugacuuauagua

SEQ ID NO: 1334770 - RNA, 16 nt, Homo sapiens
gaauaaaauacucucu

SEQ ID NO: 1334771 - RNA, 17 nt, Homo sapiens
gaauaaaguaaugccuc

SEQ ID NO: 1334772 - RNA, 15 nt, Homo sapiens
gaauaaaugucuugc

SEQ ID NO: 1334773 - RNA, 15 nt, Homo sapiens
gaauaaauucccaac

SEQ ID NO: 1334774 - RNA, 12 nt, Homo sapiens
gaauaaggccca

SEQ ID NO: 1334775 - RNA, 18 nt, Homo sapiens
gaauaagucauggagccu

SEQ ID NO: 1334776 - RNA, 12 nt, Homo sapiens
gaauaaugaagg

SEQ ID NO: 1334777 - RNA, 13 nt, Homo sapiens
gaauacacaugca

SEQ ID NO: 1334778 - RNA, 20 nt, Homo sapiens
gaauacauuaacggugcuaa

SEQ ID NO: 1334779 - RNA, 21 nt, Homo sapiens
gaauacccuaaaguauaacau

SEQ ID NO: 1334780 - RNA, 19 nt, Homo sapiens
gaauauaaauuuguguucu

SEQ ID NO: 1334781 - RNA, 11 nt, Homo sapiens
gaauauuccac

SEQ ID NO: 1334782 - RNA, 20 nt, Homo sapiens
gaauauuuguuuuaauacca

SEQ ID NO: 1334783 - RNA, 13 nt, Homo sapiens
gaaucucuugccu

SEQ ID NO: 1334784 - RNA, 23 nt, Homo sapiens
gaaucucuugccugcuccaucuc

SEQ ID NO: 1334785 - RNA, 19 nt, Homo sapiens
gaaucuuugucagcaguuc

SEQ ID NO: 1334786 - RNA, 21 nt, Homo sapiens
gaaucuuugucagcaguuccc

SEQ ID NO: 1334787 - RNA, 15 nt, Homo sapiens
gaaugcugcacuaau

SEQ ID NO: 1334788 - RNA, 14 nt, Homo sapiens
gaauggagauuuca

SEQ ID NO: 1334789 - RNA, 16 nt, Homo sapiens
gaauggaggaauccuu

SEQ ID NO: 1334790 - RNA, 20 nt, Homo sapiens
gaauguuuucaaauguucuc

SEQ ID NO: 1334791 - RNA, 15 nt, Homo sapiens
gaauuacgugcucug

SEQ ID NO: 1334792 - RNA, 11 nt, Homo sapiens
gaauuaucuca

SEQ ID NO: 1334793 - RNA, 11 nt, Homo sapiens
gaauucagugc

SEQ ID NO: 1334794 - RNA, 12 nt, Homo sapiens
gaauugcucaaa

SEQ ID NO: 1334795 - RNA, 18 nt, Homo sapiens
gaauuuagaaaaagucaa

SEQ ID NO: 1334796 - RNA, 13 nt, Homo sapiens
gaauuucccacau

SEQ ID NO: 1334797 - RNA, 16 nt, Homo sapiens
gacaaaauucauuugc

SEQ ID NO: 1334798 - RNA, 18 nt, Homo sapiens
gacaaaucuuuaagaaua

SEQ ID NO: 1334799 - RNA, 13 nt, Homo sapiens
gacaaaugcaaca

SEQ ID NO: 1334800 - RNA, 15 nt, Homo sapiens
gacaaccucauuuua

SEQ ID NO: 1334801 - RNA, 12 nt, Homo sapiens
gacaacugugaa

SEQ ID NO: 1334802 - RNA, 21 nt, Homo sapiens
gacaagauacauaugaggaca

SEQ ID NO: 1334803 - RNA, 14 nt, Homo sapiens
gacaaggugcuaac

SEQ ID NO: 1334804 - RNA, 12 nt, Homo sapiens
gacaaguacugu

SEQ ID NO: 1334805 - RNA, 14 nt, Homo sapiens
gacaaguacuguau

SEQ ID NO: 1334806 - RNA, 17 nt, Homo sapiens
gacacagacauccucua

SEQ ID NO: 1334807 - RNA, 18 nt, Homo sapiens
gacacagcucuucauucc

SEQ ID NO: 1334808 - RNA, 17 nt, Homo sapiens
gacacaggucuuuccua

SEQ ID NO: 1334809 - RNA, 14 nt, Homo sapiens
gacacagugcccaa

SEQ ID NO: 1334810 - RNA, 16 nt, Homo sapiens
gacacucauauugccc

SEQ ID NO: 1334811 - RNA, 16 nt, Homo sapiens
gacagauucuucacug

SEQ ID NO: 1334812 - RNA, 22 nt, Homo sapiens
gacagcccuggcaaaugccuga

SEQ ID NO: 1334813 - RNA, 15 nt, Homo sapiens
gacagcuuugcugcu

SEQ ID NO: 1334814 - RNA, 18 nt, Homo sapiens
gacaggauaagagggauu

SEQ ID NO: 1334815 - RNA, 13 nt, Homo sapiens
gacaggcacucca

SEQ ID NO: 1334816 - RNA, 18 nt, Homo sapiens
gacaggcuccucugggga

SEQ ID NO: 1334817 - RNA, 12 nt, Homo sapiens
gacaguaccuga

SEQ ID NO: 1334818 - RNA, 21 nt, Homo sapiens
gacagucucaccuccugccau

SEQ ID NO: 1334819 - RNA, 18 nt, Homo sapiens
gacauacauauuaucuca

SEQ ID NO: 1334820 - RNA, 19 nt, Homo sapiens
gacauacauauuaucucau

SEQ ID NO: 1334821 - RNA, 17 nt, Homo sapiens
gacauacuuaaugcaua

SEQ ID NO: 1334822 - RNA, 14 nt, Homo sapiens
gacaugcauucaca

SEQ ID NO: 1334823 - RNA, 18 nt, Homo sapiens
gacauggaacugaaagac

SEQ ID NO: 1334824 - RNA, 13 nt, Homo sapiens
gacaugugacauu

SEQ ID NO: 1334825 - RNA, 15 nt, Homo sapiens
gacauugacagcaau

SEQ ID NO: 1334826 - RNA, 21 nt, Homo sapiens
gacauuugggagacaugugac

SEQ ID NO: 1334827 - RNA, 20 nt, Homo sapiens
gacauuuuagaaugucaaua

SEQ ID NO: 1334828 - RNA, 16 nt, Homo sapiens
gaccaaaaugccaaaa

SEQ ID NO: 1334829 - RNA, 18 nt, Homo sapiens
gaccaacaggcccagcuu

SEQ ID NO: 1334830 - RNA, 23 nt, Homo sapiens
gaccaacugguuugccuauaauu

SEQ ID NO: 1334831 - RNA, 20 nt, Homo sapiens
gaccaaucaucaacuaccau

SEQ ID NO: 1334832 - RNA, 20 nt, Homo sapiens
gaccacacgcccccacaggc

SEQ ID NO: 1334833 - RNA, 22 nt, Homo sapiens
gaccagaucagauaauuaugcu

SEQ ID NO: 1334834 - RNA, 23 nt, Homo sapiens
gaccagccugggcaacauaguga

SEQ ID NO: 1334835 - RNA, 13 nt, Homo sapiens
gaccaggaccucc

SEQ ID NO: 1334836 - RNA, 15 nt, Homo sapiens
gaccagucugacccu

SEQ ID NO: 1334837 - RNA, 23 nt, Homo sapiens
gaccaucuuuagcaguuuccuca

SEQ ID NO: 1334838 - RNA, 19 nt, Homo sapiens
gaccccaaaggaacacuga

SEQ ID NO: 1334839 - RNA, 17 nt, Homo sapiens
gaccccagccauccagg

SEQ ID NO: 1334840 - RNA, 14 nt, Homo sapiens
gaccccgucauggg

SEQ ID NO: 1334841 - RNA, 23 nt, Homo sapiens
gaccccuucccuguccuugcccu

SEQ ID NO: 1334842 - RNA, 20 nt, Homo sapiens
gacccggaggggccuggcag

SEQ ID NO: 1334843 - RNA, 21 nt, Homo sapiens
gacccuacuucuuuugcucuu

SEQ ID NO: 1334844 - RNA, 13 nt, Homo sapiens
gacccucucagaa

SEQ ID NO: 1334845 - RNA, 15 nt, Homo sapiens
gacccugacuguaua

SEQ ID NO: 1334846 - RNA, 23 nt, Homo sapiens
gacccuguccugcagucccacac

SEQ ID NO: 1334847 - RNA, 14 nt, Homo sapiens
gaccucacuggccu

SEQ ID NO: 1334848 - RNA, 18 nt, Homo sapiens
gaccucuuggccacagag

SEQ ID NO: 1334849 - RNA, 21 nt, Homo sapiens
gaccuggauaauuauaucaga

SEQ ID NO: 1334850 - RNA, 20 nt, Homo sapiens
gaccugggagcccucaggca

SEQ ID NO: 1334851 - RNA, 14 nt, Homo sapiens
gaccuuaaaugcaa

SEQ ID NO: 1334852 - RNA, 20 nt, Homo sapiens
gaccuucauuucuagguucu

SEQ ID NO: 1334853 - RNA, 19 nt, Homo sapiens
gaccuugcugauggugaca

SEQ ID NO: 1334854 - RNA, 20 nt, Homo sapiens
gaccuugggggaagacuuua

SEQ ID NO: 1334855 - RNA, 21 nt, Homo sapiens
gaccuugggggaagacuuuaa

SEQ ID NO: 1334856 - RNA, 20 nt, Homo sapiens
gaccuuggguucccaauaca

SEQ ID NO: 1334857 - RNA, 16 nt, Homo sapiens
gacgaguaacuccccu

SEQ ID NO: 1334858 - RNA, 13 nt, Homo sapiens
gacgcugcugaca

SEQ ID NO: 1334859 - RNA, 21 nt, Homo sapiens
gacggaaacaacguugcuauu

SEQ ID NO: 1334860 - RNA, 19 nt, Homo sapiens
gacggagccgagccaugug

SEQ ID NO: 1334861 - RNA, 14 nt, Homo sapiens
gacguuaggccagg

SEQ ID NO: 1334862 - RNA, 21 nt, Homo sapiens
gacuacuuggaacuaggcucu

SEQ ID NO: 1334863 - RNA, 18 nt, Homo sapiens
gacuagauguaguauuuu

SEQ ID NO: 1334864 - RNA, 23 nt, Homo sapiens
gacuagcacugacugaacuguaa

SEQ ID NO: 1334865 - RNA, 20 nt, Homo sapiens
gacuaggaaaagaccaucug

SEQ ID NO: 1334866 - RNA, 15 nt, Homo sapiens
gacuauguaaacuac

SEQ ID NO: 1334867 - RNA, 14 nt, Homo sapiens
gacucacuugccca

SEQ ID NO: 1334868 - RNA, 18 nt, Homo sapiens
gacucauacaccagguca

SEQ ID NO: 1334869 - RNA, 23 nt, Homo sapiens
gacuccaaagaaauguaagggaa

SEQ ID NO: 1334870 - RNA, 18 nt, Homo sapiens
gacuccucuuugugcaga

SEQ ID NO: 1334871 - RNA, 16 nt, Homo sapiens
gacucuuugauaugcc

SEQ ID NO: 1334872 - RNA, 17 nt, Homo sapiens
gacugaccaucaugccc

SEQ ID NO: 1334873 - RNA, 16 nt, Homo sapiens
gacugacccccaucug

SEQ ID NO: 1334874 - RNA, 13 nt, Homo sapiens
gcagguuugcaau

SEQ ID NO: 1334875 - RNA, 20 nt, Homo sapiens
gcaguaaauauuuacuauuu

SEQ ID NO: 1334876 - RNA, 15 nt, Homo sapiens
gcaguccauuuccua

SEQ ID NO: 1334877 - RNA, 16 nt, Homo sapiens
gcagucccacacugug

SEQ ID NO: 1334878 - RNA, 20 nt, Homo sapiens
gcagucggugguaccugaga

SEQ ID NO: 1334879 - RNA, 18 nt, Homo sapiens
gcagugaaagcuuucaug

SEQ ID NO: 1334880 - RNA, 17 nt, Homo sapiens
gcagugcuaaagccugu

SEQ ID NO: 1334881 - RNA, 18 nt, Homo sapiens
gcagugcuaaagccugug

SEQ ID NO: 1334882 - RNA, 22 nt, Homo sapiens
gcaguggaguaaguauuuagaa

SEQ ID NO: 1334883 - RNA, 23 nt, Homo sapiens
gcaguucugaguguuuaauuuca

SEQ ID NO: 1334884 - RNA, 18 nt, Homo sapiens
gcaguugaucagacugaa

SEQ ID NO: 1334885 - RNA, 19 nt, Homo sapiens
gcauaaaaauuaaauggau

SEQ ID NO: 1334886 - RNA, 23 nt, Homo sapiens
gcauaccuggauuuccuuggcuu

SEQ ID NO: 1334887 - RNA, 21 nt, Homo sapiens
gcauacuacaguaacugugac

SEQ ID NO: 1334888 - RNA, 20 nt, Homo sapiens
gcauacuuucccucauccau

SEQ ID NO: 1334889 - RNA, 17 nt, Homo sapiens
gcauauguuaguaggcu

SEQ ID NO: 1334890 - RNA, 21 nt, Homo sapiens
gcaucaauacaaccagcccaa

SEQ ID NO: 1334891 - RNA, 15 nt, Homo sapiens
gcauccaaguuuaug

SEQ ID NO: 1334892 - RNA, 16 nt, Homo sapiens
gcauccagugugagau

SEQ ID NO: 1334893 - RNA, 12 nt, Homo sapiens
gcaucuccagug

SEQ ID NO: 1334894 - RNA, 17 nt, Homo sapiens
gcaucucccagcaagac

SEQ ID NO: 1334895 - RNA, 14 nt, Homo sapiens
gcaucucugagcaa

SEQ ID NO: 1334896 - RNA, 22 nt, Homo sapiens
gcaugagggccacauuccaugg

SEQ ID NO: 1334897 - RNA, 16 nt, Homo sapiens
gcaugguaaugaagga

SEQ ID NO: 1334898 - RNA, 21 nt, Homo sapiens
gcauuaaaguucuaggcauac

SEQ ID NO: 1334899 - RNA, 15 nt, Homo sapiens
gcauuauggucuaau

SEQ ID NO: 1334900 - RNA, 14 nt, Homo sapiens
gcauucacauaucu

SEQ ID NO: 1334901 - RNA, 17 nt, Homo sapiens
gcauuccuuuuucuuca

SEQ ID NO: 1334902 - RNA, 20 nt, Homo sapiens
gcauucguaaacaccaaaua

SEQ ID NO: 1334903 - RNA, 15 nt, Homo sapiens
gcauugaaagaauua

SEQ ID NO: 1334904 - RNA, 18 nt, Homo sapiens
gcauuguaaaagcauuuu

SEQ ID NO: 1334905 - RNA, 15 nt, Homo sapiens
gcauuuccagccuau

SEQ ID NO: 1334906 - RNA, 19 nt, Homo sapiens
gcauuuggugagagucaaa

SEQ ID NO: 1334907 - RNA, 17 nt, Homo sapiens
gccaaauuuugauccua

SEQ ID NO: 1334908 - RNA, 21 nt, Homo sapiens
gccaaggagggcagaucacuu

SEQ ID NO: 1334909 - RNA, 21 nt, Homo sapiens
gccaaggagggugagugcaag

SEQ ID NO: 1334910 - RNA, 20 nt, Homo sapiens
gccaaggcagcgaccccagg

SEQ ID NO: 1334911 - RNA, 14 nt, Homo sapiens
gccaauccaugcuc

SEQ ID NO: 1334912 - RNA, 16 nt, Homo sapiens
gccaaucuaaaauggc

SEQ ID NO: 1334913 - RNA, 14 nt, Homo sapiens
gccacaacugcccc

SEQ ID NO: 1334914 - RNA, 18 nt, Homo sapiens
gccacaccguggcagcuu

SEQ ID NO: 1334915 - RNA, 15 nt, Homo sapiens
gccacaccucuccaa

SEQ ID NO: 1334916 - RNA, 15 nt, Homo sapiens
gccacagucacugga

SEQ ID NO: 1334917 - RNA, 19 nt, Homo sapiens
gccaccuggcaaaggaccc

SEQ ID NO: 1334918 - RNA, 17 nt, Homo sapiens
gccacuaugccugacua

SEQ ID NO: 1334919 - RNA, 23 nt, Homo sapiens
gccagagaauagaucaguauuuc

SEQ ID NO: 1334920 - RNA, 13 nt, Homo sapiens
gccagccucagaa

SEQ ID NO: 1334921 - RNA, 22 nt, Homo sapiens
gccagccuggcugggacuggga

SEQ ID NO: 1334922 - RNA, 15 nt, Homo sapiens
gccagcugcacugau

SEQ ID NO: 1334923 - RNA, 12 nt, Homo sapiens
gccagguggcca

SEQ ID NO: 1334924 - RNA, 21 nt, Homo sapiens
gccagugggacccucucagaa

SEQ ID NO: 1334925 - RNA, 15 nt, Homo sapiens
gccaguuauggcuau

SEQ ID NO: 1334926 - RNA, 21 nt, Homo sapiens
gccauaaacgguuccugguga

SEQ ID NO: 1334927 - RNA, 23 nt, Homo sapiens
gccaucccuuuuuuuacauuuca

SEQ ID NO: 1334928 - RNA, 16 nt, Homo sapiens
gccaucuaaacaucau

SEQ ID NO: 1334929 - RNA, 17 nt, Homo sapiens
gccauucucccccucag

SEQ ID NO: 1334930 - RNA, 23 nt, Homo sapiens
gcccagaggcuucuccaaaggga

SEQ ID NO: 1334931 - RNA, 23 nt, Homo sapiens
gcccagcuccaaggggaaucaga

SEQ ID NO: 1334932 - RNA, 19 nt, Homo sapiens
gcccaggaccaucauccua

SEQ ID NO: 1334933 - RNA, 17 nt, Homo sapiens
gcccaggccugccuguu

SEQ ID NO: 1334934 - RNA, 19 nt, Homo sapiens
gcccaggcuggagugcaau

SEQ ID NO: 1334935 - RNA, 20 nt, Homo sapiens
gcccaggcuggagugcaaug

SEQ ID NO: 1334936 - RNA, 17 nt, Homo sapiens
gcccaggcuggucuuga

SEQ ID NO: 1334937 - RNA, 18 nt, Homo sapiens
gcccauccccaggcaccu

SEQ ID NO: 1334938 - RNA, 16 nt, Homo sapiens
gccccaaacuuucuca

SEQ ID NO: 1334939 - RNA, 16 nt, Homo sapiens
gccccaacucuuuauc

SEQ ID NO: 1334940 - RNA, 22 nt, Homo sapiens
gccccaccucggcacacacugu

SEQ ID NO: 1334941 - RNA, 19 nt, Homo sapiens
gccccacuucuggccacau

SEQ ID NO: 1334942 - RNA, 16 nt, Homo sapiens
gccccagucggcccca

SEQ ID NO: 1334943 - RNA, 16 nt, Homo sapiens
gcccccgccacaaccc

SEQ ID NO: 1334944 - RNA, 14 nt, Homo sapiens
gcccccgcuguguc

SEQ ID NO: 1334945 - RNA, 16 nt, Homo sapiens
gcccccugccagugaa

SEQ ID NO: 1334946 - RNA, 14 nt, Homo sapiens
gccccgccacagcc

SEQ ID NO: 1334947 - RNA, 16 nt, Homo sapiens
gccccugcacaaagcc

SEQ ID NO: 1334948 - RNA, 18 nt, Homo sapiens
gccccuggucaagugcug

SEQ ID NO: 1334949 - RNA, 12 nt, Homo sapiens
gccccuucaucc

SEQ ID NO: 1334950 - RNA, 18 nt, Homo sapiens
gcccgacagccuggcaca

SEQ ID NO: 1334951 - RNA, 14 nt, Homo sapiens
gcccgagccaggaa

SEQ ID NO: 1334952 - RNA, 14 nt, Homo sapiens
gcccggacaugucu

SEQ ID NO: 1334953 - RNA, 15 nt, Homo sapiens
gcccggggccagcuu

SEQ ID NO: 1334954 - RNA, 19 nt, Homo sapiens
gcccuaauuaaaaacugug

SEQ ID NO: 1334955 - RNA, 17 nt, Homo sapiens
gcccuagaugcacgugg

SEQ ID NO: 1334956 - RNA, 13 nt, Homo sapiens
gcccuaggugaga

SEQ ID NO: 1334957 - RNA, 21 nt, Homo sapiens
gcccucagccccacuucucag

SEQ ID NO: 1334958 - RNA, 11 nt, Homo sapiens
gcccucaggaa

SEQ ID NO: 1334959 - RNA, 14 nt, Homo sapiens
gcccuccacgccgg

SEQ ID NO: 1334960 - RNA, 17 nt, Homo sapiens
gcccucgagcacugaag

SEQ ID NO: 1334961 - RNA, 17 nt, Homo sapiens
gcccugaauuucuucuu

SEQ ID NO: 1334962 - RNA, 16 nt, Homo sapiens
gcccugcaccaugcug

SEQ ID NO: 1334963 - RNA, 18 nt, Homo sapiens
gcccuggaugcccaggaa

SEQ ID NO: 1334964 - RNA, 19 nt, Homo sapiens
gcccuggaugcccaggaau

SEQ ID NO: 1334965 - RNA, 16 nt, Homo sapiens
gcccuguucagcuacu

SEQ ID NO: 1334966 - RNA, 18 nt, Homo sapiens
gcccuuccucuccacugc

SEQ ID NO: 1334967 - RNA, 18 nt, Homo sapiens
gcccuuuccccccauguu

SEQ ID NO: 1334968 - RNA, 13 nt, Homo sapiens
gccgacucaggga

SEQ ID NO: 1334969 - RNA, 21 nt, Homo sapiens
gccgagccaugugucuuuaca

SEQ ID NO: 1334970 - RNA, 18 nt, Homo sapiens
gccgaggucacucugggc

SEQ ID NO: 1334971 - RNA, 23 nt, Homo sapiens
gccgcagagaaaugccccagugu

SEQ ID NO: 1334972 - RNA, 17 nt, Homo sapiens
gccggaguccacuccca

SEQ ID NO: 1334973 - RNA, 16 nt, Homo sapiens
gccggaucugagggag

SEQ ID NO: 1334974 - RNA, 21 nt, Homo sapiens
gccggggcucugggugcugcc

SEQ ID NO: 1334975 - RNA, 19 nt, Homo sapiens
gccgugccuucagcucuac

SEQ ID NO: 1334976 - RNA, 13 nt, Homo sapiens
gccuaaacuuaau

SEQ ID NO: 1334977 - RNA, 23 nt, Homo sapiens
gccuagauaugaagaaucugcuc

SEQ ID NO: 1334978 - RNA, 18 nt, Homo sapiens
gccucaagucacucccaa

SEQ ID NO: 1334979 - RNA, 20 nt, Homo sapiens
gccucaccuccucugugauu

SEQ ID NO: 1334980 - RNA, 15 nt, Homo sapiens
gccucagccagagaa

SEQ ID NO: 1334981 - RNA, 22 nt, Homo sapiens
gccucauuauuuuucacugccc

SEQ ID NO: 1334982 - RNA, 15 nt, Homo sapiens
gccuccagugcaguc

SEQ ID NO: 1334983 - RNA, 14 nt, Homo sapiens
gccuccaugcugcc

SEQ ID NO: 1334984 - RNA, 21 nt, Homo sapiens
gccuccccucuccuuccugug

SEQ ID NO: 1334985 - RNA, 18 nt, Homo sapiens
gccuccuccuuuucugaa

SEQ ID NO: 1334986 - RNA, 20 nt, Homo sapiens
gccuccugggaacacaucug

SEQ ID NO: 1334987 - RNA, 16 nt, Homo sapiens
gccuccugucccucau

SEQ ID NO: 1334988 - RNA, 23 nt, Homo sapiens
gccuccugugacgugaggcccau

SEQ ID NO: 1334989 - RNA, 18 nt, Homo sapiens
gccucgcagccuccggaa

SEQ ID NO: 1334990 - RNA, 20 nt, Homo sapiens
gccucugcuccccugugaac

SEQ ID NO: 1334991 - RNA, 23 nt, Homo sapiens
gccucuggcuucccuaaacugca

SEQ ID NO: 1334992 - RNA, 22 nt, Homo sapiens
gccucuuccgugacgucacugg

SEQ ID NO: 1334993 - RNA, 22 nt, Homo sapiens
gccugagcuggccuccuaugcc

SEQ ID NO: 1334994 - RNA, 13 nt, Homo sapiens
gccugaggcaauu

SEQ ID NO: 1334995 - RNA, 17 nt, Homo sapiens
gccugcaggaccucgug

SEQ ID NO: 1334996 - RNA, 16 nt, Homo sapiens
gccugcuccaucucau

SEQ ID NO: 1334997 - RNA, 13 nt, Homo sapiens
gccugcugugcug

SEQ ID NO: 1334998 - RNA, 19 nt, Homo sapiens
gccuggacacuguaccgac

SEQ ID NO: 1334999 - RNA, 22 nt, Homo sapiens
gccuggacacuguaccgacuuu

SEQ ID NO: 1335000 - RNA, 22 nt, Homo sapiens
gccuggacuagagggaccucuc

SEQ ID NO: 1335001 - RNA, 23 nt, Homo sapiens
gccuggacuagagggaccucucc

SEQ ID NO: 1335002 - RNA, 15 nt, Homo sapiens
gccugggcauccuca

SEQ ID NO: 1335003 - RNA, 21 nt, Homo sapiens
gccuggggacccaaacccccu

SEQ ID NO: 1335004 - RNA, 19 nt, Homo sapiens
gccugggggcuuuugccac

SEQ ID NO: 1335005 - RNA, 14 nt, Homo sapiens
gguggggccauaaa

SEQ ID NO: 1335006 - RNA, 18 nt, Homo sapiens
gguguucuguuucaaugu

SEQ ID NO: 1335007 - RNA, 19 nt, Homo sapiens
gguuaccuuuguucccaaa

SEQ ID NO: 1335008 - RNA, 23 nt, Homo sapiens
gguucaagcaauccuccuaccuc

SEQ ID NO: 1335009 - RNA, 15 nt, Homo sapiens
gguucaagugacucu

SEQ ID NO: 1335010 - RNA, 16 nt, Homo sapiens
gguucagacacagcuc

SEQ ID NO: 1335011 - RNA, 16 nt, Homo sapiens
gguuccuggugacucc

SEQ ID NO: 1335012 - RNA, 21 nt, Homo sapiens
gguucucauaacucugugauc

SEQ ID NO: 1335013 - RNA, 21 nt, Homo sapiens
gguugcacaaaaccacuuuuu

SEQ ID NO: 1335014 - RNA, 19 nt, Homo sapiens
gguugcacuggccacccaa

SEQ ID NO: 1335015 - RNA, 18 nt, Homo sapiens
gguuuauauaaggaauaa

SEQ ID NO: 1335016 - RNA, 14 nt, Homo sapiens
gguuugggagccag

SEQ ID NO: 1335017 - RNA, 16 nt, Homo sapiens
gguuugguccuugaac

SEQ ID NO: 1335018 - RNA, 23 nt, Homo sapiens
gguuuuuauguaaaacauuuuua

SEQ ID NO: 1335019 - RNA, 17 nt, Homo sapiens
guaaaacaaaugaaauu

SEQ ID NO: 1335020 - RNA, 15 nt, Homo sapiens
guaaaacauuacuua

SEQ ID NO: 1335021 - RNA, 12 nt, Homo sapiens
guaaacaaagac

SEQ ID NO: 1335022 - RNA, 16 nt, Homo sapiens
guaaauacaugcauau

SEQ ID NO: 1335023 - RNA, 19 nt, Homo sapiens
guaaaucccagacugacag

SEQ ID NO: 1335024 - RNA, 16 nt, Homo sapiens
guaaaugucugcacug

SEQ ID NO: 1335025 - RNA, 18 nt, Homo sapiens
guaacaucuguuaucaaa

SEQ ID NO: 1335026 - RNA, 17 nt, Homo sapiens
guaacuccccucaggga

SEQ ID NO: 1335027 - RNA, 17 nt, Homo sapiens
guaacugugacugauga

SEQ ID NO: 1335028 - RNA, 19 nt, Homo sapiens
guaacugugcuguacugag

SEQ ID NO: 1335029 - RNA, 22 nt, Homo sapiens
guaacuuccugcugcacccugc

SEQ ID NO: 1335030 - RNA, 15 nt, Homo sapiens
guaagcauaacuuau

SEQ ID NO: 1335031 - RNA, 17 nt, Homo sapiens
guaagggaaacugccag

SEQ ID NO: 1335032 - RNA, 17 nt, Homo sapiens
guaaggugcaucuguuu

SEQ ID NO: 1335033 - RNA, 21 nt, Homo sapiens
guaaguggcuucucugugaau

SEQ ID NO: 1335034 - RNA, 16 nt, Homo sapiens
guaauccuagcacuuu

SEQ ID NO: 1335035 - RNA, 11 nt, Homo sapiens
guaaugcugca

SEQ ID NO: 1335036 - RNA, 15 nt, Homo sapiens
guaauuguuacaauu

SEQ ID NO: 1335037 - RNA, 18 nt, Homo sapiens
guaauuuaaaauugugau

SEQ ID NO: 1335038 - RNA, 18 nt, Homo sapiens
guaauuuuucuaagcaua

SEQ ID NO: 1335039 - RNA, 17 nt, Homo sapiens
guacacaauaagcaaaa

SEQ ID NO: 1335040 - RNA, 23 nt, Homo sapiens
guacaugauaaaugauagacaau

SEQ ID NO: 1335041 - RNA, 15 nt, Homo sapiens
guacauugagcaaau

SEQ ID NO: 1335042 - RNA, 17 nt, Homo sapiens
guacauugggagucugu

SEQ ID NO: 1335043 - RNA, 12 nt, Homo sapiens
guaccauuuaau

SEQ ID NO: 1335044 - RNA, 22 nt, Homo sapiens
guaccauuuaugaagguuuguu

SEQ ID NO: 1335045 - RNA, 15 nt, Homo sapiens
guaccccauggagcu

SEQ ID NO: 1335046 - RNA, 14 nt, Homo sapiens
guaccgucuucucc

SEQ ID NO: 1335047 - RNA, 20 nt, Homo sapiens
guaccucaaucuauucugua

SEQ ID NO: 1335048 - RNA, 13 nt, Homo sapiens
guacuaacccagu

SEQ ID NO: 1335049 - RNA, 23 nt, Homo sapiens
guacuauccaaucugugaugaca

SEQ ID NO: 1335050 - RNA, 21 nt, Homo sapiens
guacuauucugagcauacuca

SEQ ID NO: 1335051 - RNA, 21 nt, Homo sapiens
guacuguauggaaacacugau

SEQ ID NO: 1335052 - RNA, 17 nt, Homo sapiens
guacuuaagaguggcau

SEQ ID NO: 1335053 - RNA, 15 nt, Homo sapiens
guacuucucacccag

SEQ ID NO: 1335054 - RNA, 12 nt, Homo sapiens
guacuucuugaa

SEQ ID NO: 1335055 - RNA, 16 nt, Homo sapiens
guagacauuugcuaug

SEQ ID NO: 1335056 - RNA, 18 nt, Homo sapiens
guagacucauucuucaca

SEQ ID NO: 1335057 - RNA, 18 nt, Homo sapiens
guagauguggccuuugaa

SEQ ID NO: 1335058 - RNA, 10 nt, Homo sapiens
guagauuccc

SEQ ID NO: 1335059 - RNA, 12 nt, Homo sapiens
guagcagcaguu

SEQ ID NO: 1335060 - RNA, 13 nt, Homo sapiens
guagcagcaguug

SEQ ID NO: 1335061 - RNA, 21 nt, Homo sapiens
guagccugggcucacugugcu

SEQ ID NO: 1335062 - RNA, 23 nt, Homo sapiens
guagccugggcucacugugcugg

SEQ ID NO: 1335063 - RNA, 17 nt, Homo sapiens
guagcucugcugcugau

SEQ ID NO: 1335064 - RNA, 14 nt, Homo sapiens
guaggaacugcugg

SEQ ID NO: 1335065 - RNA, 15 nt, Homo sapiens
guaggacccucgaga

SEQ ID NO: 1335066 - RNA, 17 nt, Homo sapiens
guagugcaccaucucac

SEQ ID NO: 1335067 - RNA, 20 nt, Homo sapiens
guagugcaccaucucacugc

SEQ ID NO: 1335068 - RNA, 13 nt, Homo sapiens
guaguuuguuuua

SEQ ID NO: 1335069 - RNA, 22 nt, Homo sapiens
guauaaggacuauagugauuua

SEQ ID NO: 1335070 - RNA, 17 nt, Homo sapiens
guauacccucuguuucc

SEQ ID NO: 1335071 - RNA, 14 nt, Homo sapiens
guauacuauaguac

SEQ ID NO: 1335072 - RNA, 15 nt, Homo sapiens
guauagaccaaagca

SEQ ID NO: 1335073 - RNA, 13 nt, Homo sapiens
guauaucuucuac

SEQ ID NO: 1335074 - RNA, 17 nt, Homo sapiens
guauaucuucuacaugc

SEQ ID NO: 1335075 - RNA, 19 nt, Homo sapiens
guauauuuuugcaggugcu

SEQ ID NO: 1335076 - RNA, 18 nt, Homo sapiens
guaucaaauacauuuaaa

SEQ ID NO: 1335077 - RNA, 19 nt, Homo sapiens
guaucaaauguaacuuacu

SEQ ID NO: 1335078 - RNA, 17 nt, Homo sapiens
guaucacaaaaccaccu

SEQ ID NO: 1335079 - RNA, 11 nt, Homo sapiens
guaucacuggu

SEQ ID NO: 1335080 - RNA, 15 nt, Homo sapiens
guaugcaaucuuaau

SEQ ID NO: 1335081 - RNA, 17 nt, Homo sapiens
guaugucuuaaaaccug

SEQ ID NO: 1335082 - RNA, 21 nt, Homo sapiens
guauguucccucuugucccuu

SEQ ID NO: 1335083 - RNA, 15 nt, Homo sapiens
guauuauugauauua

SEQ ID NO: 1335084 - RNA, 15 nt, Homo sapiens
guauuuaagacauaa

SEQ ID NO: 1335085 - RNA, 21 nt, Homo sapiens
guauuucaacugaaguucuau

SEQ ID NO: 1335086 - RNA, 21 nt, Homo sapiens
guauuuggaaauaaagucaga

SEQ ID NO: 1335087 - RNA, 23 nt, Homo sapiens
guauuuucuuacacugugucauu

SEQ ID NO: 1335088 - RNA, 15 nt, Homo sapiens
guauuuuguuagcau

SEQ ID NO: 1335089 - RNA, 21 nt, Homo sapiens
gucaaacccaaguuaguucaa

SEQ ID NO: 1335090 - RNA, 15 nt, Homo sapiens
gucaaggaaccucaa

SEQ ID NO: 1335091 - RNA, 14 nt, Homo sapiens
gucaaggcucaguc

SEQ ID NO: 1335092 - RNA, 19 nt, Homo sapiens
gucacagccucaagucacu

SEQ ID NO: 1335093 - RNA, 23 nt, Homo sapiens
gucacagguuuucagagaauuau

SEQ ID NO: 1335094 - RNA, 12 nt, Homo sapiens
gucacaucucag

SEQ ID NO: 1335095 - RNA, 23 nt, Homo sapiens
gucacaucucagggaacugaccc

SEQ ID NO: 1335096 - RNA, 21 nt, Homo sapiens
gucaccaguuaaaagcauuuu

SEQ ID NO: 1335097 - RNA, 16 nt, Homo sapiens
gucaccugcuccagaa

SEQ ID NO: 1335098 - RNA, 14 nt, Homo sapiens
gucacuaccuggcu

SEQ ID NO: 1335099 - RNA, 14 nt, Homo sapiens
gucacucacaucca

SEQ ID NO: 1335100 - RNA, 15 nt, Homo sapiens
gucagcagcagugac

SEQ ID NO: 1335101 - RNA, 22 nt, Homo sapiens
gucaggggcggggagggugaca

SEQ ID NO: 1335102 - RNA, 20 nt, Homo sapiens
gucaguccaggaugcuaaca

SEQ ID NO: 1335103 - RNA, 20 nt, Homo sapiens
gucagugacgaggaacuccc

SEQ ID NO: 1335104 - RNA, 22 nt, Homo sapiens
gucauagcaagcuuuugcucaa

SEQ ID NO: 1335105 - RNA, 16 nt, Homo sapiens
gucaugcuuuugcuau

SEQ ID NO: 1335106 - RNA, 14 nt, Homo sapiens
gucauuauguuaau

SEQ ID NO: 1335107 - RNA, 23 nt, Homo sapiens
gucauuauuuuuguuagcaaaga

SEQ ID NO: 1335108 - RNA, 21 nt, Homo sapiens
gucauuuuuauaaaacuuuga

SEQ ID NO: 1335109 - RNA, 18 nt, Homo sapiens
gucauuuuuuaagugacu

SEQ ID NO: 1335110 - RNA, 11 nt, Homo sapiens
guccacagggc

SEQ ID NO: 1335111 - RNA, 15 nt, Homo sapiens
guccagcucugacau

SEQ ID NO: 1335112 - RNA, 19 nt, Homo sapiens
guccaggauguacaaagaa

SEQ ID NO: 1335113 - RNA, 17 nt, Homo sapiens
guccauccgacugcccc

SEQ ID NO: 1335114 - RNA, 16 nt, Homo sapiens
gucccacacugugcag

SEQ ID NO: 1335115 - RNA, 15 nt, Homo sapiens
gucccagcuacucag

SEQ ID NO: 1335116 - RNA, 18 nt, Homo sapiens
gucccuccaccccacaga

SEQ ID NO: 1335117 - RNA, 13 nt, Homo sapiens
guccuaaggccca

SEQ ID NO: 1335118 - RNA, 12 nt, Homo sapiens
guccucagucca

SEQ ID NO: 1335119 - RNA, 19 nt, Homo sapiens
guccucaguccacugcuga

SEQ ID NO: 1335120 - RNA, 15 nt, Homo sapiens
guccuccaagccagc

SEQ ID NO: 1335121 - RNA, 15 nt, Homo sapiens
guccucucugaguca

SEQ ID NO: 1335122 - RNA, 15 nt, Homo sapiens
guccugaaagccaca

SEQ ID NO: 1335123 - RNA, 18 nt, Homo sapiens
guccugaagugaccucac

SEQ ID NO: 1335124 - RNA, 20 nt, Homo sapiens
guccuggugccuaucugccu

SEQ ID NO: 1335125 - RNA, 23 nt, Homo sapiens
guccuucagugagccccucccca

SEQ ID NO: 1335126 - RNA, 15 nt, Homo sapiens
guccuucuuuccucu

SEQ ID NO: 1335127 - RNA, 18 nt, Homo sapiens
guccuuucccaccauucc

SEQ ID NO: 1335128 - RNA, 22 nt, Homo sapiens
gucuaggauaacuugcuuucuu

SEQ ID NO: 1335129 - RNA, 21 nt, Homo sapiens
gucuaguguuccugcaccaaa

SEQ ID NO: 1335130 - RNA, 21 nt, Homo sapiens
gucucaaacuccugaccucaa

SEQ ID NO: 1335131 - RNA, 19 nt, Homo sapiens
gucucaagagggcacuggu

SEQ ID NO: 1335132 - RNA, 22 nt, Homo sapiens
gucucauuucucauaauuuugc

SEQ ID NO: 1335133 - RNA, 23 nt, Homo sapiens
gucuccacggccugcccagucga

SEQ ID NO: 1335134 - RNA, 18 nt, Homo sapiens
gucuccaucucugucuca

SEQ ID NO: 1335135 - RNA, 23 nt, Homo sapiens
gucucccuuccuaugcuguucac

SEQ ID NO: 1335136 - RNA, 21 nt, Homo sapiens
gucuccucugcagcucaggga

SEQ ID NO: 1335137 - RNA, 19 nt, Homo sapiens
uaccaaagcaucaauacaa

SEQ ID NO: 1335138 - RNA, 15 nt, Homo sapiens
uaccagggucucuca

SEQ ID NO: 1335139 - RNA, 21 nt, Homo sapiens
uaccaguaugaaugacaauuu

SEQ ID NO: 1335140 - RNA, 19 nt, Homo sapiens
uaccagugacgcugcugac

SEQ ID NO: 1335141 - RNA, 12 nt, Homo sapiens
uaccaugcugaa

SEQ ID NO: 1335142 - RNA, 14 nt, Homo sapiens
uacccaacccugcc

SEQ ID NO: 1335143 - RNA, 17 nt, Homo sapiens
uacccaguagaugccac

SEQ ID NO: 1335144 - RNA, 18 nt, Homo sapiens
uacccucacuuaaacuuu

SEQ ID NO: 1335145 - RNA, 18 nt, Homo sapiens
uacccuccucugcuggga

SEQ ID NO: 1335146 - RNA, 19 nt, Homo sapiens
uaccuaccaagauauaccu

SEQ ID NO: 1335147 - RNA, 15 nt, Homo sapiens
uaccuaucaucuuaa

SEQ ID NO: 1335148 - RNA, 23 nt, Homo sapiens
uaccuauccuuacauuucaccua

SEQ ID NO: 1335149 - RNA, 13 nt, Homo sapiens
uaccucaaccaau

SEQ ID NO: 1335150 - RNA, 13 nt, Homo sapiens
uaccucaccuggg

SEQ ID NO: 1335151 - RNA, 16 nt, Homo sapiens
uaccucuuucaggguu

SEQ ID NO: 1335152 - RNA, 23 nt, Homo sapiens
uaccugaagggguuuucuugaua

SEQ ID NO: 1335153 - RNA, 15 nt, Homo sapiens
uaccugagauggagg

SEQ ID NO: 1335154 - RNA, 14 nt, Homo sapiens
uaccugcacacugu

SEQ ID NO: 1335155 - RNA, 23 nt, Homo sapiens
uaccugcucagcccugcaccaug

SEQ ID NO: 1335156 - RNA, 21 nt, Homo sapiens
uaccuggcuuugcuuagcuug

SEQ ID NO: 1335157 - RNA, 15 nt, Homo sapiens
uaccuuucagugcag

SEQ ID NO: 1335158 - RNA, 23 nt, Homo sapiens
uacguuuguguggugacauuuua

SEQ ID NO: 1335159 - RNA, 18 nt, Homo sapiens
uacuaacauuuucauuga

SEQ ID NO: 1335160 - RNA, 24 nt, Homo sapiens
uacuaacauuuucauugaugagca

SEQ ID NO: 1335161 - RNA, 16 nt, Homo sapiens
uacuacccagcucugu

SEQ ID NO: 1335162 - RNA, 16 nt, Homo sapiens
uacuaccuguaaugac

SEQ ID NO: 1335163 - RNA, 17 nt, Homo sapiens
uacuaucuuuguguugc

SEQ ID NO: 1335164 - RNA, 17 nt, Homo sapiens
uacuauuucaauacuua

SEQ ID NO: 1335165 - RNA, 18 nt, Homo sapiens
uacucccuacacugaugc

SEQ ID NO: 1335166 - RNA, 17 nt, Homo sapiens
uacuccuggcucaagcc

SEQ ID NO: 1335167 - RNA, 14 nt, Homo sapiens
uacugagcacugaa

SEQ ID NO: 1335168 - RNA, 18 nt, Homo sapiens
uacugcacucagauuuaa

SEQ ID NO: 1335169 - RNA, 20 nt, Homo sapiens
uacugcccuuucaaagcacu

SEQ ID NO: 1335170 - RNA, 11 nt, Homo sapiens
uacugcugcug

SEQ ID NO: 1335171 - RNA, 23 nt, Homo sapiens
uacuguaggcacacuuugcacug

SEQ ID NO: 1335172 - RNA, 23 nt, Homo sapiens
uacuguggucugggcaccaccuc

SEQ ID NO: 1335173 - RNA, 14 nt, Homo sapiens
uacuuaaugcauau

SEQ ID NO: 1335174 - RNA, 15 nt, Homo sapiens
uacuuacauaucuga

SEQ ID NO: 1335175 - RNA, 16 nt, Homo sapiens
uacuuacauaucugac

SEQ ID NO: 1335176 - RNA, 17 nt, Homo sapiens
uacuucaaaagccauaa

SEQ ID NO: 1335177 - RNA, 22 nt, Homo sapiens
uacuugaaauuuggcuaauaac

SEQ ID NO: 1335178 - RNA, 23 nt, Homo sapiens
uacuuguguaguccuaugcaaua

SEQ ID NO: 1335179 - RNA, 15 nt, Homo sapiens
uacuuuauagcacau

SEQ ID NO: 1335180 - RNA, 16 nt, Homo sapiens
uacuuucccucaucca

SEQ ID NO: 1335181 - RNA, 22 nt, Homo sapiens
uagaaaaggccuucuucccaau

SEQ ID NO: 1335182 - RNA, 16 nt, Homo sapiens
uagaagaauaagucau

SEQ ID NO: 1335183 - RNA, 13 nt, Homo sapiens
uagaagauucuau

SEQ ID NO: 1335184 - RNA, 15 nt, Homo sapiens
uagaauaaauuccca

SEQ ID NO: 1335185 - RNA, 23 nt, Homo sapiens
uagaauaaauucccaacuucucu

SEQ ID NO: 1335186 - RNA, 21 nt, Homo sapiens
uagaaugagcacccauuccaa

SEQ ID NO: 1335187 - RNA, 20 nt, Homo sapiens
uagaauguugaaaaguaauu

SEQ ID NO: 1335188 - RNA, 14 nt, Homo sapiens
uagacacagauaau

SEQ ID NO: 1335189 - RNA, 23 nt, Homo sapiens
uagacuugaaaguuuuccaguau

SEQ ID NO: 1335190 - RNA, 16 nt, Homo sapiens
uagagacuucacccgg

SEQ ID NO: 1335191 - RNA, 18 nt, Homo sapiens
uagagcuagcuaaucucu

SEQ ID NO: 1335192 - RNA, 18 nt, Homo sapiens
uagaggcugggggcucca

SEQ ID NO: 1335193 - RNA, 16 nt, Homo sapiens
uagagggggucucaga

SEQ ID NO: 1335194 - RNA, 22 nt, Homo sapiens
uagaguguagccuaaagggcag

SEQ ID NO: 1335195 - RNA, 22 nt, Homo sapiens
uagauacucauuagugacuuca

SEQ ID NO: 1335196 - RNA, 14 nt, Homo sapiens
uagauauaugccuu

SEQ ID NO: 1335197 - RNA, 19 nt, Homo sapiens
uagauaugaagaaucugcu

SEQ ID NO: 1335198 - RNA, 19 nt, Homo sapiens
uagaugcacguggggccca

SEQ ID NO: 1335199 - RNA, 17 nt, Homo sapiens
uagauuaagaaauagac

SEQ ID NO: 1335200 - RNA, 20 nt, Homo sapiens
uagauuuggaggcuaccuca

SEQ ID NO: 1335201 - RNA, 19 nt, Homo sapiens
uagcaaagaggcuguuaua

SEQ ID NO: 1335202 - RNA, 16 nt, Homo sapiens
uagcaagcuuuugcuc

SEQ ID NO: 1335203 - RNA, 18 nt, Homo sapiens
uagcacugacugaacugu

SEQ ID NO: 1335204 - RNA, 22 nt, Homo sapiens
uagcagcaggcucaggcacaua

SEQ ID NO: 1335205 - RNA, 22 nt, Homo sapiens
uagcaugaaauaaaauauaucu

SEQ ID NO: 1335206 - RNA, 14 nt, Homo sapiens
uagcaugcugugau

SEQ ID NO: 1335207 - RNA, 14 nt, Homo sapiens
uagcauguuccucc

SEQ ID NO: 1335208 - RNA, 17 nt, Homo sapiens
uagcauuaucuuaucau

SEQ ID NO: 1335209 - RNA, 20 nt, Homo sapiens
uagcauuguaaaagcauuuu

SEQ ID NO: 1335210 - RNA, 19 nt, Homo sapiens
uagccagcugugcacuuuc

SEQ ID NO: 1335211 - RNA, 15 nt, Homo sapiens
uagccauugaucaua

SEQ ID NO: 1335212 - RNA, 18 nt, Homo sapiens
uagccucuggacuggaaa

SEQ ID NO: 1335213 - RNA, 14 nt, Homo sapiens
uagcggagcccagc

SEQ ID NO: 1335214 - RNA, 17 nt, Homo sapiens
uagcucucugacugcuu

SEQ ID NO: 1335215 - RNA, 21 nt, Homo sapiens
uagcuuagcuaugucagccaa

SEQ ID NO: 1335216 - RNA, 18 nt, Homo sapiens
uagcuuaugaguagcuua

SEQ ID NO: 1335217 - RNA, 19 nt, Homo sapiens
uagcuugaguccaggaguu

SEQ ID NO: 1335218 - RNA, 15 nt, Homo sapiens
uaggaaaaucacuug

SEQ ID NO: 1335219 - RNA, 22 nt, Homo sapiens
uaggaagugcccucgagcacug

SEQ ID NO: 1335220 - RNA, 14 nt, Homo sapiens
uaggacuacacuga

SEQ ID NO: 1335221 - RNA, 20 nt, Homo sapiens
uaggagggcuggcaacuuag

SEQ ID NO: 1335222 - RNA, 19 nt, Homo sapiens
uaggcagcaagcuuugguu

SEQ ID NO: 1335223 - RNA, 15 nt, Homo sapiens
uaggcagugcuaaag

SEQ ID NO: 1335224 - RNA, 20 nt, Homo sapiens
uaggccagcaccaucucuuu

SEQ ID NO: 1335225 - RNA, 17 nt, Homo sapiens
uaggccaguaguucuca

SEQ ID NO: 1335226 - RNA, 15 nt, Homo sapiens
uaggccugucccuug

SEQ ID NO: 1335227 - RNA, 14 nt, Homo sapiens
uaggcuacuguaau

SEQ ID NO: 1335228 - RNA, 23 nt, Homo sapiens
uaggcuggaaaugguuucacuug

SEQ ID NO: 1335229 - RNA, 21 nt, Homo sapiens
uagggacugccaggcuguuuc

SEQ ID NO: 1335230 - RNA, 15 nt, Homo sapiens
uaggguccugaaugu

SEQ ID NO: 1335231 - RNA, 19 nt, Homo sapiens
uagguuugauucaacacuu

SEQ ID NO: 1335232 - RNA, 23 nt, Homo sapiens
uaguaaguacuuaauaaacugug

SEQ ID NO: 1335233 - RNA, 16 nt, Homo sapiens
uaguagaagaagcuuu

SEQ ID NO: 1335234 - RNA, 21 nt, Homo sapiens
uaguccgugcugacagcugcu

SEQ ID NO: 1335235 - RNA, 22 nt, Homo sapiens
uaguccgugcugacagcugcuc

SEQ ID NO: 1335236 - RNA, 23 nt, Homo sapiens
uagucucuacccaguagaugcca

SEQ ID NO: 1335237 - RNA, 17 nt, Homo sapiens
uagugacagaggagaaa

SEQ ID NO: 1335238 - RNA, 16 nt, Homo sapiens
uagugacaugcaguua

SEQ ID NO: 1335239 - RNA, 16 nt, Homo sapiens
uagugaugaaccagag

SEQ ID NO: 1335240 - RNA, 22 nt, Homo sapiens
uagugcaccaucucacugcagu

SEQ ID NO: 1335241 - RNA, 14 nt, Homo sapiens
uaguggaaagucag

SEQ ID NO: 1335242 - RNA, 21 nt, Homo sapiens
uaguggggagacuucuuggcu

SEQ ID NO: 1335243 - RNA, 14 nt, Homo sapiens
uaguguccauaaau

SEQ ID NO: 1335244 - RNA, 17 nt, Homo sapiens
uaguguucuuugcauuu

SEQ ID NO: 1335245 - RNA, 18 nt, Homo sapiens
uaguguuuggacagcuga

SEQ ID NO: 1335246 - RNA, 14 nt, Homo sapiens
uaguucagcugccc

SEQ ID NO: 1335247 - RNA, 14 nt, Homo sapiens
uaguuccacugaga

SEQ ID NO: 1335248 - RNA, 17 nt, Homo sapiens
uaguugcugucauccac

SEQ ID NO: 1335249 - RNA, 23 nt, Homo sapiens
uauaaaauaguaugaaaauggaa

SEQ ID NO: 1335250 - RNA, 23 nt, Homo sapiens
uauaaaauguuuuuaaacagugu

SEQ ID NO: 1335251 - RNA, 17 nt, Homo sapiens
uauaaaauuaacauaaa

SEQ ID NO: 1335252 - RNA, 15 nt, Homo sapiens
uauaaaccaaucuua

SEQ ID NO: 1335253 - RNA, 15 nt, Homo sapiens
uauaaaccccucaga

SEQ ID NO: 1335254 - RNA, 17 nt, Homo sapiens
uauaaacuguaugcuca

SEQ ID NO: 1335255 - RNA, 13 nt, Homo sapiens
uauaaaggauaaa

SEQ ID NO: 1335256 - RNA, 16 nt, Homo sapiens
uauaaauaaauaccaa

SEQ ID NO: 1335257 - RNA, 18 nt, Homo sapiens
uauaaauuuguguucuca

SEQ ID NO: 1335258 - RNA, 18 nt, Homo sapiens
uauaaauuuuuaccuguu

SEQ ID NO: 1335259 - RNA, 15 nt, Homo sapiens
uauaacgcagucuaa

SEQ ID NO: 1335260 - RNA, 18 nt, Homo sapiens
uauaacuauuacaguguu

SEQ ID NO: 1335261 - RNA, 22 nt, Homo sapiens
uauaacuuaggccuagccucuu

SEQ ID NO: 1335262 - RNA, 21 nt, Homo sapiens
uauaagacuauuccaacuggg

SEQ ID NO: 1335263 - RNA, 19 nt, Homo sapiens
uauaagauucauauuuacu

SEQ ID NO: 1335264 - RNA, 16 nt, Homo sapiens
uauaagcaucugccau

SEQ ID NO: 1335265 - RNA, 12 nt, Homo sapiens
uauaauguauuu

SEQ ID NO: 1335266 - RNA, 18 nt, Homo sapiens
uauaauuuauaacuuacu

SEQ ID NO: 1335267 - RNA, 14 nt, Homo sapiens
uauacaaucucuuu

SEQ ID NO: 1335268 - RNA, 23 nt, Homo sapiens
uuauauuacuugccuaucugacu

SEQ ID NO: 1335269 - RNA, 17 nt, Homo sapiens
uuaucacuucauucaca

SEQ ID NO: 1335270 - RNA, 20 nt, Homo sapiens
uuaucacuucauucacauuc

SEQ ID NO: 1335271 - RNA, 23 nt, Homo sapiens
uuaucacuucauucacauucaga

SEQ ID NO: 1335272 - RNA, 21 nt, Homo sapiens
uuaucagugugcaauacugug

SEQ ID NO: 1335273 - RNA, 13 nt, Homo sapiens
uuaucccaaucau

SEQ ID NO: 1335274 - RNA, 21 nt, Homo sapiens
uuaucccauuuagugugaaua

SEQ ID NO: 1335275 - RNA, 15 nt, Homo sapiens
uuaucucugaggcua

SEQ ID NO: 1335276 - RNA, 21 nt, Homo sapiens
uuaugaaaugccacugggaca

SEQ ID NO: 1335277 - RNA, 22 nt, Homo sapiens
uuaugaagcaagccccacuuau

SEQ ID NO: 1335278 - RNA, 18 nt, Homo sapiens
uuaugcaaauacaaucag

SEQ ID NO: 1335279 - RNA, 18 nt, Homo sapiens
uuaugcagugaacuauuu

SEQ ID NO: 1335280 - RNA, 19 nt, Homo sapiens
uuauuacauugcugccuuu

SEQ ID NO: 1335281 - RNA, 14 nt, Homo sapiens
uuauuauaaauucu

SEQ ID NO: 1335282 - RNA, 20 nt, Homo sapiens
uuauuauauugccuaagaau

SEQ ID NO: 1335283 - RNA, 22 nt, Homo sapiens
uuauucugugcuguuacaguuu

SEQ ID NO: 1335284 - RNA, 22 nt, Homo sapiens
uuauugaaacaggauacacaca

SEQ ID NO: 1335285 - RNA, 13 nt, Homo sapiens
uuauuuagauuca

SEQ ID NO: 1335286 - RNA, 17 nt, Homo sapiens
uuauuuaucaaguguau

SEQ ID NO: 1335287 - RNA, 13 nt, Homo sapiens
uuauuuaugcuau

SEQ ID NO: 1335288 - RNA, 16 nt, Homo sapiens
uuauuuauuuauucau

SEQ ID NO: 1335289 - RNA, 22 nt, Homo sapiens
uuauuuguauuacuagauucau

SEQ ID NO: 1335290 - RNA, 18 nt, Homo sapiens
uucaaaaacaagacagac

SEQ ID NO: 1335291 - RNA, 14 nt, Homo sapiens
uucaaaaccuugca

SEQ ID NO: 1335292 - RNA, 13 nt, Homo sapiens
uucaaaccauuuu

SEQ ID NO: 1335293 - RNA, 17 nt, Homo sapiens
uucaaagcaaagcucuu

SEQ ID NO: 1335294 - RNA, 21 nt, Homo sapiens
uucaacagccaagcuggcaca

SEQ ID NO: 1335295 - RNA, 13 nt, Homo sapiens
uucaauaauccau

SEQ ID NO: 1335296 - RNA, 11 nt, Homo sapiens
uucaaucucaa

SEQ ID NO: 1335297 - RNA, 16 nt, Homo sapiens
uucaaucuggauucau

SEQ ID NO: 1335298 - RNA, 14 nt, Homo sapiens
uucaaugaaccaca

SEQ ID NO: 1335299 - RNA, 21 nt, Homo sapiens
uucacaaaauaucaccaaaaa

SEQ ID NO: 1335300 - RNA, 13 nt, Homo sapiens
uucacagccagac

SEQ ID NO: 1335301 - RNA, 19 nt, Homo sapiens
uucacagccagacuggcac

SEQ ID NO: 1335302 - RNA, 18 nt, Homo sapiens
uucacagcccauaauuca

SEQ ID NO: 1335303 - RNA, 11 nt, Homo sapiens
uucacauucau

SEQ ID NO: 1335304 - RNA, 18 nt, Homo sapiens
uucaccuacauuaucuca

SEQ ID NO: 1335305 - RNA, 13 nt, Homo sapiens
uucacgccauucu

SEQ ID NO: 1335306 - RNA, 15 nt, Homo sapiens
uucacugcaaacaca

SEQ ID NO: 1335307 - RNA, 22 nt, Homo sapiens
uucacugccccagacacagugc

SEQ ID NO: 1335308 - RNA, 17 nt, Homo sapiens
uucacuuuuaauuugcu

SEQ ID NO: 1335309 - RNA, 16 nt, Homo sapiens
uucagaaucuuuucaa

SEQ ID NO: 1335310 - RNA, 21 nt, Homo sapiens
uucagaccacaaggggcucca

SEQ ID NO: 1335311 - RNA, 20 nt, Homo sapiens
uucagaggcucagauuguaa

SEQ ID NO: 1335312 - RNA, 23 nt, Homo sapiens
uucagaugaaaagaaaacuuaaa

SEQ ID NO: 1335313 - RNA, 18 nt, Homo sapiens
uucagcaccgauggccau

SEQ ID NO: 1335314 - RNA, 13 nt, Homo sapiens
uucagcucuacag

SEQ ID NO: 1335315 - RNA, 21 nt, Homo sapiens
uucagugcauuaucuacuugu

SEQ ID NO: 1335316 - RNA, 17 nt, Homo sapiens
uucaguugcaguaguau

SEQ ID NO: 1335317 - RNA, 17 nt, Homo sapiens
uucauagggauggcagu

SEQ ID NO: 1335318 - RNA, 13 nt, Homo sapiens
uucauauaacguc

SEQ ID NO: 1335319 - RNA, 16 nt, Homo sapiens
uucaugacaagcauuu

SEQ ID NO: 1335320 - RNA, 15 nt, Homo sapiens
uucaugaccauacaa

SEQ ID NO: 1335321 - RNA, 11 nt, Homo sapiens
uucaugcacug

SEQ ID NO: 1335322 - RNA, 19 nt, Homo sapiens
uucauguaaaaagugcagu

SEQ ID NO: 1335323 - RNA, 14 nt, Homo sapiens
uucauucacauuca

SEQ ID NO: 1335324 - RNA, 15 nt, Homo sapiens
uucauucacauucag

SEQ ID NO: 1335325 - RNA, 14 nt, Homo sapiens
uucauucaucauga

SEQ ID NO: 1335326 - RNA, 22 nt, Homo sapiens
uucauucuggaggggcagugga

SEQ ID NO: 1335327 - RNA, 14 nt, Homo sapiens
uucauuuaucuaua

SEQ ID NO: 1335328 - RNA, 20 nt, Homo sapiens
uucauuucuuuccuuaucac

SEQ ID NO: 1335329 - RNA, 16 nt, Homo sapiens
uuccaacugggcauuu

SEQ ID NO: 1335330 - RNA, 20 nt, Homo sapiens
uuccaaugaagccauaugaa

SEQ ID NO: 1335331 - RNA, 14 nt, Homo sapiens
uuccaauuuacaua

SEQ ID NO: 1335332 - RNA, 14 nt, Homo sapiens
uuccacccacaaac

SEQ ID NO: 1335333 - RNA, 15 nt, Homo sapiens
uuccaguucacauuu

SEQ ID NO: 1335334 - RNA, 19 nt, Homo sapiens
uuccauaaucuggacuccu

SEQ ID NO: 1335335 - RNA, 22 nt, Homo sapiens
uuccaucauuucugucuuuaag

SEQ ID NO: 1335336 - RNA, 15 nt, Homo sapiens
uuccaucuuacauua

SEQ ID NO: 1335337 - RNA, 23 nt, Homo sapiens
uuccaugcaacuggaguuccuua

SEQ ID NO: 1335338 - RNA, 14 nt, Homo sapiens
uuccaugugccuuu

SEQ ID NO: 1335339 - RNA, 14 nt, Homo sapiens
uuccauuugcaaca

SEQ ID NO: 1335340 - RNA, 23 nt, Homo sapiens
uuccauuuugugaauugugacau

SEQ ID NO: 1335341 - RNA, 19 nt, Homo sapiens
uucccaacgugcaaagcca

SEQ ID NO: 1335342 - RNA, 21 nt, Homo sapiens
uucccacaacuacuaguguga

SEQ ID NO: 1335343 - RNA, 13 nt, Homo sapiens
uucccacuccagc

SEQ ID NO: 1335344 - RNA, 15 nt, Homo sapiens
uucccacucugggca

SEQ ID NO: 1335345 - RNA, 15 nt, Homo sapiens
uucccagcgcugcug

SEQ ID NO: 1335346 - RNA, 18 nt, Homo sapiens
uuccccagugacuccagg

SEQ ID NO: 1335347 - RNA, 15 nt, Homo sapiens
uuccccccauguugu

SEQ ID NO: 1335348 - RNA, 14 nt, Homo sapiens
uucccuaaugaagu

SEQ ID NO: 1335349 - RNA, 19 nt, Homo sapiens
uucccucucaugacuugca

SEQ ID NO: 1335350 - RNA, 16 nt, Homo sapiens
uucccucuucccugac

SEQ ID NO: 1335351 - RNA, 19 nt, Homo sapiens
uucccugauggaaccauaa

SEQ ID NO: 1335352 - RNA, 19 nt, Homo sapiens
uucccuggguuuucugccc

SEQ ID NO: 1335353 - RNA, 21 nt, Homo sapiens
uuccggccuccugucccucau

SEQ ID NO: 1335354 - RNA, 22 nt, Homo sapiens
uuccggggagaaacccagagau

SEQ ID NO: 1335355 - RNA, 23 nt, Homo sapiens
uuccucugcaguuuugacauuua

SEQ ID NO: 1335356 - RNA, 11 nt, Homo sapiens
uuccucugcau

SEQ ID NO: 1335357 - RNA, 19 nt, Homo sapiens
uuccugggcacacgcugcu

SEQ ID NO: 1335358 - RNA, 15 nt, Homo sapiens
uuccuguccagcucc

SEQ ID NO: 1335359 - RNA, 16 nt, Homo sapiens
uuccuuggccaugcag

SEQ ID NO: 1335360 - RNA, 14 nt, Homo sapiens
uuccuugggcuuua

SEQ ID NO: 1335361 - RNA, 21 nt, Homo sapiens
uuccuuuucacugcuguuaua

SEQ ID NO: 1335362 - RNA, 15 nt, Homo sapiens
uucgaagccuugccu

SEQ ID NO: 1335363 - RNA, 16 nt, Homo sapiens
uucgacugguccagcu

SEQ ID NO: 1335364 - RNA, 20 nt, Homo sapiens
uucgagaccagccuggccaa

SEQ ID NO: 1335365 - RNA, 23 nt, Homo sapiens
uucgauacaccgggccuggagaa

SEQ ID NO: 1335366 - RNA, 20 nt, Homo sapiens
uucggacaugcuuuucugcc

SEQ ID NO: 1335367 - RNA, 14 nt, Homo sapiens
uucggcagccuuaa

SEQ ID NO: 1335368 - RNA, 13 nt, Homo sapiens
uucguaaacacca

SEQ ID NO: 1335369 - RNA, 13 nt, Homo sapiens
uucguaguuuuca

SEQ ID NO: 1335370 - RNA, 13 nt, Homo sapiens
uucgucuacugca

SEQ ID NO: 1335371 - RNA, 18 nt, Homo sapiens
uucguuguuauuauucau

SEQ ID NO: 1335372 - RNA, 15 nt, Homo sapiens
uucuaaaaguugcau

SEQ ID NO: 1335373 - RNA, 20 nt, Homo sapiens
uucuaaaaguugcauguuau

SEQ ID NO: 1335374 - RNA, 13 nt, Homo sapiens
uucuaacccugac

SEQ ID NO: 1335375 - RNA, 19 nt, Homo sapiens
uucuaaguaaaaccacagc

SEQ ID NO: 1335376 - RNA, 19 nt, Homo sapiens
uucuaauccuuuuccuuau

SEQ ID NO: 1335377 - RNA, 21 nt, Homo sapiens
uucuaguaccugugacucuua

SEQ ID NO: 1335378 - RNA, 19 nt, Homo sapiens
uucuaguucagcugcccca

SEQ ID NO: 1335379 - RNA, 19 nt, Homo sapiens
uucuauaaagaucauauau

SEQ ID NO: 1335380 - RNA, 17 nt, Homo sapiens
uucuauacccacccaga

SEQ ID NO: 1335381 - RNA, 18 nt, Homo sapiens
uucuauacccacccagaa

SEQ ID NO: 1335382 - RNA, 17 nt, Homo sapiens
uucucaagaccaacaga

SEQ ID NO: 1335383 - RNA, 20 nt, Homo sapiens
uucucacuccuaccugguaa

SEQ ID NO: 1335384 - RNA, 19 nt, Homo sapiens
uucucauaacucugugauc

SEQ ID NO: 1335385 - RNA, 15 nt, Homo sapiens
uucuccucacuguau

SEQ ID NO: 1335386 - RNA, 18 nt, Homo sapiens
uucucucuuguuguccag

SEQ ID NO: 1335387 - RNA, 12 nt, Homo sapiens
uucucugccuca

SEQ ID NO: 1335388 - RNA, 15 nt, Homo sapiens
uucugaaaaagacau

SEQ ID NO: 1335389 - RNA, 16 nt, Homo sapiens
uucugacgcugacaau

SEQ ID NO: 1335390 - RNA, 18 nt, Homo sapiens
uucugagcauacucaaca

SEQ ID NO: 1335391 - RNA, 21 nt, Homo sapiens
uucugagcaucugcaguacag

SEQ ID NO: 1335392 - RNA, 16 nt, Homo sapiens
uucugauaaacacaau

SEQ ID NO: 1335393 - RNA, 18 nt, Homo sapiens
uucugaucuaauauccca

SEQ ID NO: 1335394 - RNA, 17 nt, Homo sapiens
uucuggagugagcacuc

SEQ ID NO: 1335395 - RNA, 22 nt, Homo sapiens
uucuggaugaaugcccagugag

SEQ ID NO: 1335396 - RNA, 19 nt, Homo sapiens
uucuggucuucgcagccua

SEQ ID NO: 1335397 - RNA, 20 nt, Homo sapiens
uucugucccacuacaucugg

SEQ ID NO: 1335398 - RNA, 13 nt, Homo sapiens
uucugucugggcu

SEQ ID NO: 1335399 - RNA, 19 nt, Homo sapiens
uucugugguuucauguuag

SEQ ID NO: 1335400 - RNA, 15 nt, Homo sapiens
uuuucugauaaaaga

SEQ ID NO: 1335401 - RNA, 19 nt, Homo sapiens
uuuucuggaauacaugaaa

SEQ ID NO: 1335402 - RNA, 16 nt, Homo sapiens
uuuugaaaaugggcuc

SEQ ID NO: 1335403 - RNA, 19 nt, Homo sapiens
uuuugaucuugugcuauga

SEQ ID NO: 1335404 - RNA, 14 nt, Homo sapiens
uuuuggaaauucag

SEQ ID NO: 1335405 - RNA, 15 nt, Homo sapiens
uuuuggagguauuca

SEQ ID NO: 1335406 - RNA, 18 nt, Homo sapiens
uuuugggaagaauccagu

SEQ ID NO: 1335407 - RNA, 11 nt, Homo sapiens
uuuuggucaaa

SEQ ID NO: 1335408 - RNA, 19 nt, Homo sapiens
uuuuguaaaguugccuuua

SEQ ID NO: 1335409 - RNA, 19 nt, Homo sapiens
uuuuguaauaaacucucua

SEQ ID NO: 1335410 - RNA, 20 nt, Homo sapiens
uuuuuacuaaucuuucugca

SEQ ID NO: 1335411 - RNA, 20 nt, Homo sapiens
uuuuuauggaggcuuugcau

SEQ ID NO: 1335412 - RNA, 16 nt, Homo sapiens
uuuuugucaagacaag

SEQ ID NO: 1335413 - RNA, 15 nt, Homo sapiens
uuuuuugccaaauag

SEQ ID NO: 1335414 - RNA, 21 nt, Homo sapiens
uuuuuuguauagaccaaagca

SEQ ID NO: 1335415 - RNA, 21 nt, Homo sapiens
acuucuuacuucccuaaugaa

SEQ ID NO: 1335416 - RNA, 18 nt, Homo sapiens
acuucuuauacauuugau

SEQ ID NO: 1335417 - RNA, 19 nt, Homo sapiens
acuucuugcuucuuucuag

SEQ ID NO: 1335418 - RNA, 22 nt, Homo sapiens
acuucuuuaagcggacccgcua

SEQ ID NO: 1335419 - RNA, 23 nt, Homo sapiens
acuugaaaguuuuccaguauuga

SEQ ID NO: 1335420 - RNA, 18 nt, Homo sapiens
acuugaagggccagagcc

SEQ ID NO: 1335421 - RNA, 22 nt, Homo sapiens
acuugacugggugagacccaaa

SEQ ID NO: 1335422 - RNA, 18 nt, Homo sapiens
acuugauggcuaacuuac

SEQ ID NO: 1335423 - RNA, 20 nt, Homo sapiens
acuugccuaucugacuucau

SEQ ID NO: 1335424 - RNA, 15 nt, Homo sapiens
acuuggaacuaggcu

SEQ ID NO: 1335425 - RNA, 14 nt, Homo sapiens
acuuggagauuuau

SEQ ID NO: 1335426 - RNA, 17 nt, Homo sapiens
acuugugauuggcugca

SEQ ID NO: 1335427 - RNA, 22 nt, Homo sapiens
acuuguuuguuuuaaccaauaa

SEQ ID NO: 1335428 - RNA, 19 nt, Homo sapiens
acuuguuuuaaacuugccu

SEQ ID NO: 1335429 - RNA, 17 nt, Homo sapiens
acuuuaaaacugcucau

SEQ ID NO: 1335430 - RNA, 15 nt, Homo sapiens
acuuucuaaauuuca

SEQ ID NO: 1335431 - RNA, 15 nt, Homo sapiens
acuuucuucugaaua

SEQ ID NO: 1335432 - RNA, 18 nt, Homo sapiens
acuuugaagcaacuguga

SEQ ID NO: 1335433 - RNA, 23 nt, Homo sapiens
acuuugacuuucuucugaauauu

SEQ ID NO: 1335434 - RNA, 18 nt, Homo sapiens
acuuugauaggaugugga

SEQ ID NO: 1335435 - RNA, 21 nt, Homo sapiens
acuuuuuccuggcucaucucu

SEQ ID NO: 1335436 - RNA, 21 nt, Homo sapiens
agaaaaacaccgcuucugccu

SEQ ID NO: 1335437 - RNA, 17 nt, Homo sapiens
agaaaaauauauacuaa

SEQ ID NO: 1335438 - RNA, 22 nt, Homo sapiens
agaaaaccucuccugaccccug

SEQ ID NO: 1335439 - RNA, 14 nt, Homo sapiens
agaaaagacacuga

SEQ ID NO: 1335440 - RNA, 14 nt, Homo sapiens
agaaaagcugccau

SEQ ID NO: 1335441 - RNA, 16 nt, Homo sapiens
agaaaagcugccauuu

SEQ ID NO: 1335442 - RNA, 20 nt, Homo sapiens
agaaaaggccuucuucccaa

SEQ ID NO: 1335443 - RNA, 22 nt, Homo sapiens
accuuccggggccgcaucccuu

SEQ ID NO: 1335444 - RNA, 14 nt, Homo sapiens
accuucuaccucuu

SEQ ID NO: 1335445 - RNA, 16 nt, Homo sapiens
accuucuauguauuag

SEQ ID NO: 1335446 - RNA, 20 nt, Homo sapiens
accuucuguggcucacagaa

SEQ ID NO: 1335447 - RNA, 22 nt, Homo sapiens
accuugaccgacaugaacugua

SEQ ID NO: 1335448 - RNA, 16 nt, Homo sapiens
accuuggcaccagaca

SEQ ID NO: 1335449 - RNA, 21 nt, Homo sapiens
accuuucaugugccugaaggc

SEQ ID NO: 1335450 - RNA, 15 nt, Homo sapiens
accuuuccugaggaa

SEQ ID NO: 1335451 - RNA, 22 nt, Homo sapiens
accuuucggcaaggacgguaac

SEQ ID NO: 1335452 - RNA, 23 nt, Homo sapiens
accuuucuccuuuguacuuugug

SEQ ID NO: 1335453 - RNA, 13 nt, Homo sapiens
accuuuguuccca

SEQ ID NO: 1335454 - RNA, 14 nt, Homo sapiens
acgacacauuugcc

SEQ ID NO: 1335455 - RNA, 22 nt, Homo sapiens
acgagcaggcuacugucagcuc

SEQ ID NO: 1335456 - RNA, 23 nt, Homo sapiens
acgaguugcagccagggccagug

SEQ ID NO: 1335457 - RNA, 22 nt, Homo sapiens
acgcagcugggugcagaagcug

SEQ ID NO: 1335458 - RNA, 21 nt, Homo sapiens
acgcaggccagcaacucccag

SEQ ID NO: 1335459 - RNA, 19 nt, Homo sapiens
acgcggcuuuaagugugcu

SEQ ID NO: 1335460 - RNA, 20 nt, Homo sapiens
acgcugauccauaaagacaa

SEQ ID NO: 1335461 - RNA, 14 nt, Homo sapiens
acgcuuucaugaau

SEQ ID NO: 1335462 - RNA, 15 nt, Homo sapiens
acggauggugcaugg

SEQ ID NO: 1335463 - RNA, 22 nt, Homo sapiens
acguagccugggcucacugugc

SEQ ID NO: 1335464 - RNA, 17 nt, Homo sapiens
acgugaggcccauucuu

SEQ ID NO: 1335465 - RNA, 17 nt, Homo sapiens
acgugcaaagccaaggc

SEQ ID NO: 1335466 - RNA, 23 nt, Homo sapiens
acgugcaugcuuuaaaaaacaca

SEQ ID NO: 1335467 - RNA, 13 nt, Homo sapiens
acguuuacauucu

SEQ ID NO: 1335468 - RNA, 14 nt, Homo sapiens
acuaaaauguucua

SEQ ID NO: 1335469 - RNA, 18 nt, Homo sapiens
acuaagggguauguuccc

SEQ ID NO: 1335470 - RNA, 22 nt, Homo sapiens
acuaauagaauaaaggcaguuu

SEQ ID NO: 1335471 - RNA, 16 nt, Homo sapiens
acuaauccucucugca

SEQ ID NO: 1335472 - RNA, 16 nt, Homo sapiens
acuacaguaacuguga

SEQ ID NO: 1335473 - RNA, 18 nt, Homo sapiens
acuacuagugugacuccu

SEQ ID NO: 1335474 - RNA, 17 nt, Homo sapiens
agcccgacagugccauc

SEQ ID NO: 1335475 - RNA, 17 nt, Homo sapiens
agcccuagacuggugcu

SEQ ID NO: 1335476 - RNA, 16 nt, Homo sapiens
agcccuauugcugcua

SEQ ID NO: 1335477 - RNA, 18 nt, Homo sapiens
agcccuccacgccggcuc

SEQ ID NO: 1335478 - RNA, 16 nt, Homo sapiens
agcccucccuaccuac

SEQ ID NO: 1335479 - RNA, 18 nt, Homo sapiens
agcccucccuaccuacca

SEQ ID NO: 1335480 - RNA, 20 nt, Homo sapiens
agcccuccucucccagugac

SEQ ID NO: 1335481 - RNA, 16 nt, Homo sapiens
agcccugcaccaugcu

SEQ ID NO: 1335482 - RNA, 20 nt, Homo sapiens
agcccugcaccaugcugcug

SEQ ID NO: 1335483 - RNA, 21 nt, Homo sapiens
agcccugggaaccacucccac

SEQ ID NO: 1335484 - RNA, 17 nt, Homo sapiens
agcccugugucuguaua

SEQ ID NO: 1335485 - RNA, 15 nt, Homo sapiens
agcccuguugacaca

SEQ ID NO: 1335486 - RNA, 19 nt, Homo sapiens
agcccuuugcuaaaauaua

SEQ ID NO: 1335487 - RNA, 17 nt, Homo sapiens
agccgggcaugguggca

SEQ ID NO: 1335488 - RNA, 19 nt, Homo sapiens
agccgggguguaacuuccu

SEQ ID NO: 1335489 - RNA, 15 nt, Homo sapiens
agccgguaacugucc

SEQ ID NO: 1335490 - RNA, 11 nt, Homo sapiens
agccuacucca

SEQ ID NO: 1335491 - RNA, 17 nt, Homo sapiens
agccuagauaugaagaa

SEQ ID NO: 1335492 - RNA, 19 nt, Homo sapiens
agccuauaggccaaugcau

SEQ ID NO: 1335493 - RNA, 14 nt, Homo sapiens
agccuauaguaaau

SEQ ID NO: 1335494 - RNA, 23 nt, Homo sapiens
agccuaugaggggguuuggcacc

SEQ ID NO: 1335495 - RNA, 16 nt, Homo sapiens
agccucagaaggcccc

SEQ ID NO: 1335496 - RNA, 19 nt, Homo sapiens
agaggcuucuccaaaggga

SEQ ID NO: 1335497 - RNA, 15 nt, Homo sapiens
agagggagaaacuuc

SEQ ID NO: 1335498 - RNA, 15 nt, Homo sapiens
agagggcccagccca

SEQ ID NO: 1335499 - RNA, 21 nt, Homo sapiens
agagggcgugggcgcuugcac

SEQ ID NO: 1335500 - RNA, 16 nt, Homo sapiens
agagggcugcugacca

SEQ ID NO: 1335501 - RNA, 19 nt, Homo sapiens
agaggucugauuggcugcu

SEQ ID NO: 1335502 - RNA, 13 nt, Homo sapiens
agaggugugugac

SEQ ID NO: 1335503 - RNA, 22 nt, Homo sapiens
agaguaaaccuugaagggcuuu

SEQ ID NO: 1335504 - RNA, 17 nt, Homo sapiens
agaguaacucaguaauu

SEQ ID NO: 1335505 - RNA, 17 nt, Homo sapiens
agagucaucuaccugag

SEQ ID NO: 1335506 - RNA, 13 nt, Homo sapiens
agagugcaauggu

SEQ ID NO: 1335507 - RNA, 15 nt, Homo sapiens
agaguguagcuguaa

SEQ ID NO: 1335508 - RNA, 14 nt, Homo sapiens
agaguuuaaacaaa

SEQ ID NO: 1335509 - RNA, 13 nt, Homo sapiens
agaguuuccugaa

SEQ ID NO: 1335510 - RNA, 24 nt, Homo sapiens
agaguuuccugaaacaacuuggaa

SEQ ID NO: 1335511 - RNA, 22 nt, Homo sapiens
agauaaauauugagcagaucua

SEQ ID NO: 1335512 - RNA, 13 nt, Homo sapiens
agauaacuaggaa

SEQ ID NO: 1335513 - RNA, 19 nt, Homo sapiens
agauacucauuagugacuu

SEQ ID NO: 1335514 - RNA, 18 nt, Homo sapiens
agauacugucucuuucau

SEQ ID NO: 1335515 - RNA, 16 nt, Homo sapiens
agauagcuucacccca

SEQ ID NO: 1335516 - RNA, 22 nt, Homo sapiens
agauagcuucaccccaauccca

SEQ ID NO: 1335517 - RNA, 20 nt, Homo sapiens
agauaguugauucuugccuu

SEQ ID NO: 1335518 - RNA, 21 nt, Homo sapiens
agauauacuugguucucucca

SEQ ID NO: 1335519 - RNA, 18 nt, Homo sapiens
agauaugaagaaucugcu

SEQ ID NO: 1335520 - RNA, 20 nt, Homo sapiens
agauaugaagaaucugcucu

SEQ ID NO: 1335521 - RNA, 19 nt, Homo sapiens
agauauggaaaauagugau

SEQ ID NO: 1335522 - RNA, 17 nt, Homo sapiens
agauauuaaauucucaa

SEQ ID NO: 1335523 - RNA, 20 nt, Homo sapiens
agauauucacuaaggacuua

SEQ ID NO: 1335524 - RNA, 19 nt, Homo sapiens
agaucagcgacccugagga

SEQ ID NO: 1335525 - RNA, 20 nt, Homo sapiens
agaucaggagugacagauca

SEQ ID NO: 1335526 - RNA, 15 nt, Homo sapiens
agaucaucagucacc

SEQ ID NO: 1335527 - RNA, 20 nt, Homo sapiens
agauccaagcaaaacuuuac

SEQ ID NO: 1335528 - RNA, 16 nt, Homo sapiens
agauccuauagcucuu

SEQ ID NO: 1335529 - RNA, 22 nt, Homo sapiens
agauccucaauaaacauuucau

SEQ ID NO: 1335530 - RNA, 22 nt, Homo sapiens
agaucugcaccaccaugcccag

SEQ ID NO: 1335531 - RNA, 13 nt, Homo sapiens
agaucuuccccaa

SEQ ID NO: 1335532 - RNA, 17 nt, Homo sapiens
agaugaacugacugaag

SEQ ID NO: 1335533 - RNA, 20 nt, Homo sapiens
agaugacaaccuccauucua

SEQ ID NO: 1335534 - RNA, 19 nt, Homo sapiens
agaugccacuagcccuccu

SEQ ID NO: 1335535 - RNA, 18 nt, Homo sapiens
agaugcccccuccaggag

SEQ ID NO: 1335536 - RNA, 15 nt, Homo sapiens
agaugcuugguugug

SEQ ID NO: 1335537 - RNA, 18 nt, Homo sapiens
agauggcuuuuccuggac

SEQ ID NO: 1335538 - RNA, 15 nt, Homo sapiens
agaugggggucucac

SEQ ID NO: 1335539 - RNA, 22 nt, Homo sapiens
agaugugcagcauuucacuuau

SEQ ID NO: 1335540 - RNA, 18 nt, Homo sapiens
agauguguuuuugggaag

SEQ ID NO: 1335541 - RNA, 18 nt, Homo sapiens
agauguugagaggaacaa

SEQ ID NO: 1335542 - RNA, 16 nt, Homo sapiens
agauuauacaaucucu

SEQ ID NO: 1335543 - RNA, 17 nt, Homo sapiens
agauucaagacaagagc

SEQ ID NO: 1335544 - RNA, 15 nt, Homo sapiens
agauucaugcaagug

SEQ ID NO: 1335545 - RNA, 22 nt, Homo sapiens
agauucccaucauacacuuccu

SEQ ID NO: 1335546 - RNA, 20 nt, Homo sapiens
agauucuagugagucaacau

SEQ ID NO: 1335547 - RNA, 15 nt, Homo sapiens
agauucugaccuuaa

SEQ ID NO: 1335548 - RNA, 22 nt, Homo sapiens
agauugauaaccauagcauuaa

SEQ ID NO: 1335549 - RNA, 20 nt, Homo sapiens
agauugcgccauugcacucc

SEQ ID NO: 1335550 - RNA, 23 nt, Homo sapiens
agauugcgccauugcacuccagc

SEQ ID NO: 1335551 - RNA, 13 nt, Homo sapiens
agauuuaucucug

SEQ ID NO: 1335552 - RNA, 19 nt, Homo sapiens
agauuugcaacuaguaaaa

SEQ ID NO: 1335553 - RNA, 18 nt, Homo sapiens
agcaaaacuuuacuuuca

SEQ ID NO: 1335554 - RNA, 20 nt, Homo sapiens
agcaaacuccagguuccuga

SEQ ID NO: 1335555 - RNA, 17 nt, Homo sapiens
agcaaacucugcugucu

SEQ ID NO: 1335556 - RNA, 20 nt, Homo sapiens
agcaaagcacauagagccag

SEQ ID NO: 1335557 - RNA, 19 nt, Homo sapiens
agcaaaggugcacuccaga

SEQ ID NO: 1335558 - RNA, 20 nt, Homo sapiens
agcaaauggcagaaccaaag

SEQ ID NO: 1335559 - RNA, 19 nt, Homo sapiens
agcaaauggccucauguca

SEQ ID NO: 1335560 - RNA, 22 nt, Homo sapiens
agcaacaucuuuuuaaccugca

SEQ ID NO: 1335561 - RNA, 23 nt, Homo sapiens
agcaacgccccuccaaaccucca

SEQ ID NO: 1335562 - RNA, 12 nt, Homo sapiens
agcaacugugaa

SEQ ID NO: 1335563 - RNA, 13 nt, Homo sapiens
agcaacugugaau

SEQ ID NO: 1335564 - RNA, 17 nt, Homo sapiens
agcaagacauacuuaau

SEQ ID NO: 1335565 - RNA, 20 nt, Homo sapiens
agcaagacauacuuaaugca

SEQ ID NO: 1335566 - RNA, 19 nt, Homo sapiens
agcaagucacuggccagug

SEQ ID NO: 1335567 - RNA, 9 nt, Homo sapiens
agcaauacu

SEQ ID NO: 1335568 - RNA, 16 nt, Homo sapiens
agcaauacuguuucca

SEQ ID NO: 1335569 - RNA, 16 nt, Homo sapiens
agcaaugggucuuagc

SEQ ID NO: 1335570 - RNA, 20 nt, Homo sapiens
agcaauugacugucacuguu

SEQ ID NO: 1335571 - RNA, 18 nt, Homo sapiens
agcacacccgugugcaca

SEQ ID NO: 1335572 - RNA, 14 nt, Homo sapiens
agcaccagggcuca

SEQ ID NO: 1335573 - RNA, 21 nt, Homo sapiens
agcaccaucucuuuaccuccu

SEQ ID NO: 1335574 - RNA, 14 nt, Homo sapiens
agcaccccuugccg

SEQ ID NO: 1335575 - RNA, 20 nt, Homo sapiens
agcaccuaaaugaugccuuu

SEQ ID NO: 1335576 - RNA, 23 nt, Homo sapiens
agcacuccccagagcugugccag

SEQ ID NO: 1335577 - RNA, 20 nt, Homo sapiens
agcacuuagcaggcaccgcc

SEQ ID NO: 1335578 - RNA, 20 nt, Homo sapiens
agcacuugagaaccagucuc

SEQ ID NO: 1335579 - RNA, 22 nt, Homo sapiens
agcagagaagguaaggugugaa

SEQ ID NO: 1335580 - RNA, 17 nt, Homo sapiens
agcagcaacuauucaca

SEQ ID NO: 1335581 - RNA, 12 nt, Homo sapiens
agcagcauccac

SEQ ID NO: 1335582 - RNA, 16 nt, Homo sapiens
agcagcauccacccca

SEQ ID NO: 1335583 - RNA, 14 nt, Homo sapiens
agcaggauuucuca

SEQ ID NO: 1335584 - RNA, 18 nt, Homo sapiens
agcaggcccaaugcugcu

SEQ ID NO: 1335585 - RNA, 19 nt, Homo sapiens
agcaggcccaaugcugcuu

SEQ ID NO: 1335586 - RNA, 17 nt, Homo sapiens
agcaggguccacagcug

SEQ ID NO: 1335587 - RNA, 22 nt, Homo sapiens
agcagucacugacaguuaauaa

SEQ ID NO: 1335588 - RNA, 21 nt, Homo sapiens
agcaguuacucccuacacuga

SEQ ID NO: 1335589 - RNA, 20 nt, Homo sapiens
agcaguugaucagacugaaa

SEQ ID NO: 1335590 - RNA, 19 nt, Homo sapiens
agcaguuuccucagugaug

SEQ ID NO: 1335591 - RNA, 13 nt, Homo sapiens
agcauaacuuauu

SEQ ID NO: 1335592 - RNA, 18 nt, Homo sapiens
agcauaccaacacgagca

SEQ ID NO: 1335593 - RNA, 22 nt, Homo sapiens
agcauaugggugggauuuugca

SEQ ID NO: 1335594 - RNA, 14 nt, Homo sapiens
agcauccaguguga

SEQ ID NO: 1335595 - RNA, 13 nt, Homo sapiens
agcaucuccagug

SEQ ID NO: 1335596 - RNA, 17 nt, Homo sapiens
agcaucucccagcaaga

SEQ ID NO: 1335597 - RNA, 18 nt, Homo sapiens
agcaucucccagcaagac

SEQ ID NO: 1335598 - RNA, 17 nt, Homo sapiens
agcaucucccaguucau

SEQ ID NO: 1335599 - RNA, 24 nt, Homo sapiens
agcauggugccuauguagacaaua

SEQ ID NO: 1335600 - RNA, 20 nt, Homo sapiens
agcaugucccaggcacugua

SEQ ID NO: 1335601 - RNA, 21 nt, Homo sapiens
agcauguggucuuauaguguu

SEQ ID NO: 1335602 - RNA, 16 nt, Homo sapiens
agcauuaaaguucuag

SEQ ID NO: 1335603 - RNA, 18 nt, Homo sapiens
agcauuaucuuaucauuu

SEQ ID NO: 1335604 - RNA, 21 nt, Homo sapiens
agcauuuccagccuaucuaau

SEQ ID NO: 1335605 - RNA, 17 nt, Homo sapiens
agcauuucccccaggga

SEQ ID NO: 1335606 - RNA, 13 nt, Homo sapiens
agccaaagagccu

SEQ ID NO: 1335607 - RNA, 23 nt, Homo sapiens
agccaagggguagaaguggcaua

SEQ ID NO: 1335608 - RNA, 16 nt, Homo sapiens
agccacaguucugacg

SEQ ID NO: 1335609 - RNA, 20 nt, Homo sapiens
agccacaucuugcucugcau

SEQ ID NO: 1335610 - RNA, 19 nt, Homo sapiens
agccagcaaccagcacauc

SEQ ID NO: 1335611 - RNA, 22 nt, Homo sapiens
agccagcacucacaccacuaac

SEQ ID NO: 1335612 - RNA, 19 nt, Homo sapiens
agccagccaacccuuucau

SEQ ID NO: 1335613 - RNA, 15 nt, Homo sapiens
agccagcugugcacu

SEQ ID NO: 1335614 - RNA, 16 nt, Homo sapiens
agccaggaacugugug

SEQ ID NO: 1335615 - RNA, 14 nt, Homo sapiens
agccaggcuccuac

SEQ ID NO: 1335616 - RNA, 17 nt, Homo sapiens
agccaguggggaugagg

SEQ ID NO: 1335617 - RNA, 21 nt, Homo sapiens
agccaguggggaugaggucac

SEQ ID NO: 1335618 - RNA, 14 nt, Homo sapiens
agccauaacuugaa

SEQ ID NO: 1335619 - RNA, 15 nt, Homo sapiens
agccauaacuugaaa

SEQ ID NO: 1335620 - RNA, 16 nt, Homo sapiens
agccauaggugcaguu

SEQ ID NO: 1335621 - RNA, 12 nt, Homo sapiens
agccauuuucca

SEQ ID NO: 1335622 - RNA, 15 nt, Homo sapiens
agcccaccccugugc

SEQ ID NO: 1335623 - RNA, 14 nt, Homo sapiens
agcccagugcaaac

SEQ ID NO: 1335624 - RNA, 17 nt, Homo sapiens
agccccccuugccccac

SEQ ID NO: 1335625 - RNA, 19 nt, Homo sapiens
agccccucacacugcaagg

SEQ ID NO: 1335626 - RNA, 23 nt, Homo sapiens
agccccugaccccugucuguccc

SEQ ID NO: 1335627 - RNA, 16 nt, Homo sapiens
agccccugcuccagaa

SEQ ID NO: 1335628 - RNA, 15 nt, Homo sapiens
agcccgacagugcca

SEQ ID NO: 1335629 - RNA, 23 nt, Homo sapiens
augcuuuugcuaauaccaaaauu

SEQ ID NO: 1335630 - RNA, 13 nt, Homo sapiens
auggaacauaaaa

SEQ ID NO: 1335631 - RNA, 22 nt, Homo sapiens
auggaagcaccuaaaugaugcc

SEQ ID NO: 1335632 - RNA, 22 nt, Homo sapiens
auggaagguucucugugcuccu

SEQ ID NO: 1335633 - RNA, 19 nt, Homo sapiens
auggaauucccuccugagu

SEQ ID NO: 1335634 - RNA, 15 nt, Homo sapiens
auggacaucuuguca

SEQ ID NO: 1335635 - RNA, 18 nt, Homo sapiens
auggacaucuugucauuu

SEQ ID NO: 1335636 - RNA, 16 nt, Homo sapiens
auggauuuccuagugg

SEQ ID NO: 1335637 - RNA, 18 nt, Homo sapiens
auggcaauuuagcucucu

SEQ ID NO: 1335638 - RNA, 22 nt, Homo sapiens
auggcagugacuccccagccca

SEQ ID NO: 1335639 - RNA, 17 nt, Homo sapiens
auggcugugccucugcc

SEQ ID NO: 1335640 - RNA, 18 nt, Homo sapiens
augggcuaccaggaagaa

SEQ ID NO: 1335641 - RNA, 13 nt, Homo sapiens
auggggaggacaa

SEQ ID NO: 1335642 - RNA, 12 nt, Homo sapiens
auggguccaggg

SEQ ID NO: 1335643 - RNA, 22 nt, Homo sapiens
augggugcuuaguaaguacuua

SEQ ID NO: 1335644 - RNA, 14 nt, Homo sapiens
auggucccaaauga

SEQ ID NO: 1335645 - RNA, 19 nt, Homo sapiens
auggugaagaacuagcaua

SEQ ID NO: 1335646 - RNA, 19 nt, Homo sapiens
auggugcacugagcugcaa

SEQ ID NO: 1335647 - RNA, 22 nt, Homo sapiens
augguguuauuuucugagagac

SEQ ID NO: 1335648 - RNA, 14 nt, Homo sapiens
augguuacauauca

SEQ ID NO: 1335649 - RNA, 20 nt, Homo sapiens
augguuucacaugguuacau

SEQ ID NO: 1335650 - RNA, 17 nt, Homo sapiens
auguaaaaagugcagua

SEQ ID NO: 1335651 - RNA, 15 nt, Homo sapiens
auguaaaagcacaug

SEQ ID NO: 1335652 - RNA, 16 nt, Homo sapiens
auguaaacuguuucuu

SEQ ID NO: 1335653 - RNA, 22 nt, Homo sapiens
auguaccaccaacuacuaccug

SEQ ID NO: 1335654 - RNA, 15 nt, Homo sapiens
auguaccagcaucuc

SEQ ID NO: 1335655 - RNA, 18 nt, Homo sapiens
auguacuaaaucuaauca

SEQ ID NO: 1335656 - RNA, 16 nt, Homo sapiens
auguacuauccaaucu

SEQ ID NO: 1335657 - RNA, 22 nt, Homo sapiens
auguacuuuuaaauuauacaau

SEQ ID NO: 1335658 - RNA, 17 nt, Homo sapiens
auguagacugugccaga

SEQ ID NO: 1335659 - RNA, 20 nt, Homo sapiens
auguaguccgugcugacagc

SEQ ID NO: 1335660 - RNA, 17 nt, Homo sapiens
auguaucaguguccuuu

SEQ ID NO: 1335661 - RNA, 22 nt, Homo sapiens
auguauuugaaaauuacauguu

SEQ ID NO: 1335662 - RNA, 19 nt, Homo sapiens
augucauguggcuaccugu

SEQ ID NO: 1335663 - RNA, 18 nt, Homo sapiens
auguccaaacccacucau

SEQ ID NO: 1335664 - RNA, 20 nt, Homo sapiens
auguccaaacccacucauga

SEQ ID NO: 1335665 - RNA, 22 nt, Homo sapiens
auguccaaacccacucaugacu

SEQ ID NO: 1335666 - RNA, 12 nt, Homo sapiens
auguccagugag

SEQ ID NO: 1335667 - RNA, 14 nt, Homo sapiens
augucuccaucucu

SEQ ID NO: 1335668 - RNA, 22 nt, Homo sapiens
augucuccaucucugucucaaa

SEQ ID NO: 1335669 - RNA, 21 nt, Homo sapiens
augucucuuugugcucuaaaa

SEQ ID NO: 1335670 - RNA, 15 nt, Homo sapiens
augucuguguguuga

SEQ ID NO: 1335671 - RNA, 15 nt, Homo sapiens
augucuuaaaaccug

SEQ ID NO: 1335672 - RNA, 14 nt, Homo sapiens
augucuuuccaaaa

SEQ ID NO: 1335673 - RNA, 17 nt, Homo sapiens
augugaacacaucagcu

SEQ ID NO: 1335674 - RNA, 20 nt, Homo sapiens
augugaagaguuucacaaau

SEQ ID NO: 1335675 - RNA, 17 nt, Homo sapiens
augugagcuguaaaaau

SEQ ID NO: 1335676 - RNA, 17 nt, Homo sapiens
augugaggaaaugauga

SEQ ID NO: 1335677 - RNA, 13 nt, Homo sapiens
augugcacugccu

SEQ ID NO: 1335678 - RNA, 15 nt, Homo sapiens
augugcugagcauuu

SEQ ID NO: 1335679 - RNA, 23 nt, Homo sapiens
augugcugugugagugagcacac

SEQ ID NO: 1335680 - RNA, 19 nt, Homo sapiens
auguuaaaacauaaacaca

SEQ ID NO: 1335681 - RNA, 16 nt, Homo sapiens
auguuaguuaccuuau

SEQ ID NO: 1335682 - RNA, 16 nt, Homo sapiens
auguuauuugcucuaa

SEQ ID NO: 1335683 - RNA, 22 nt, Homo sapiens
auguucagaaagccuauuccau

SEQ ID NO: 1335684 - RNA, 17 nt, Homo sapiens
auguucccccuguuuca

SEQ ID NO: 1335685 - RNA, 9 nt, Homo sapiens
auguugaaa

SEQ ID NO: 1335686 - RNA, 12 nt, Homo sapiens
auguugcaaugc

SEQ ID NO: 1335687 - RNA, 17 nt, Homo sapiens
auguuuggaauauucca

SEQ ID NO: 1335688 - RNA, 20 nt, Homo sapiens
auguuuuuaaacagugucau

SEQ ID NO: 1335689 - RNA, 13 nt, Homo sapiens
auuaaaaacugug

SEQ ID NO: 1335690 - RNA, 23 nt, Homo sapiens
auuaaaacucauuuuuguuuuca

SEQ ID NO: 1335691 - RNA, 13 nt, Homo sapiens
auuaaaagauuau

SEQ ID NO: 1335692 - RNA, 16 nt, Homo sapiens
auuaaaauaaaccaaa

SEQ ID NO: 1335693 - RNA, 20 nt, Homo sapiens
auuaaacuaguguuauacuu

SEQ ID NO: 1335694 - RNA, 14 nt, Homo sapiens
auuaacauggccau

SEQ ID NO: 1335695 - RNA, 21 nt, Homo sapiens
auuaagaaaccuugcucuccu

SEQ ID NO: 1335696 - RNA, 23 nt, Homo sapiens
auuaauaacagguuuaaauagcu

SEQ ID NO: 1335697 - RNA, 19 nt, Homo sapiens
auuaaucuuaguguaugau

SEQ ID NO: 1335698 - RNA, 18 nt, Homo sapiens
auuaauguauccaaugaa

SEQ ID NO: 1335699 - RNA, 16 nt, Homo sapiens
auuacaaaaaaacacg

SEQ ID NO: 1335700 - RNA, 21 nt, Homo sapiens
auuacagaaacugaugccaag

SEQ ID NO: 1335701 - RNA, 18 nt, Homo sapiens
auuacauugcugccuuug

SEQ ID NO: 1335702 - RNA, 17 nt, Homo sapiens
auuacauuucacuucaa

SEQ ID NO: 1335703 - RNA, 16 nt, Homo sapiens
auuacguuuacauucu

SEQ ID NO: 1335704 - RNA, 19 nt, Homo sapiens
auuacuaaaguacagacau

SEQ ID NO: 1335705 - RNA, 23 nt, Homo sapiens
auuacucuauugauacaauauug

SEQ ID NO: 1335706 - RNA, 19 nt, Homo sapiens
auuacugcccacuugucaa

SEQ ID NO: 1335707 - RNA, 21 nt, Homo sapiens
auuacuggccuuuuucauuua

SEQ ID NO: 1335708 - RNA, 14 nt, Homo sapiens
auuagaacuucaag

SEQ ID NO: 1335709 - RNA, 22 nt, Homo sapiens
auuagaacuucaagcucuccaa

SEQ ID NO: 1335710 - RNA, 23 nt, Homo sapiens
auuagauuuggaggcuaccucac

SEQ ID NO: 1335711 - RNA, 19 nt, Homo sapiens
auuagcaauugacugucac

SEQ ID NO: 1335712 - RNA, 19 nt, Homo sapiens
auuaguucccauucuuuca

SEQ ID NO: 1335713 - RNA, 17 nt, Homo sapiens
auuaguuggcuuucaua

SEQ ID NO: 1335714 - RNA, 17 nt, Homo sapiens
auuauaaacuguaugcu

SEQ ID NO: 1335715 - RNA, 15 nt, Homo sapiens
auuaugccacuuccu

SEQ ID NO: 1335716 - RNA, 19 nt, Homo sapiens
auuaugugacauuuuacau

SEQ ID NO: 1335717 - RNA, 15 nt, Homo sapiens
auuauucccauucua

SEQ ID NO: 1335718 - RNA, 14 nt, Homo sapiens
auuauuucuaaucc

SEQ ID NO: 1335719 - RNA, 16 nt, Homo sapiens
auuauuuucacuguag

SEQ ID NO: 1335720 - RNA, 19 nt, Homo sapiens
auucaaaaauuaucuauag

SEQ ID NO: 1335721 - RNA, 18 nt, Homo sapiens
auucaaauuccuacaguu

SEQ ID NO: 1335722 - RNA, 20 nt, Homo sapiens
auucaacuuaacuaucaucu

SEQ ID NO: 1335723 - RNA, 13 nt, Homo sapiens
auucacaguaucu

SEQ ID NO: 1335724 - RNA, 12 nt, Homo sapiens
auucagcacuua

SEQ ID NO: 1335725 - RNA, 22 nt, Homo sapiens
auucagcucuggagaacagugg

SEQ ID NO: 1335726 - RNA, 17 nt, Homo sapiens
auucaggcaacgcacaa

SEQ ID NO: 1335727 - RNA, 22 nt, Homo sapiens
auucaguucuuacacauuccau

SEQ ID NO: 1335728 - RNA, 14 nt, Homo sapiens
auucaugguucaag

SEQ ID NO: 1335729 - RNA, 20 nt, Homo sapiens
auucauucugaacccuccaa

SEQ ID NO: 1335730 - RNA, 14 nt, Homo sapiens
auucauugugauuu

SEQ ID NO: 1335731 - RNA, 15 nt, Homo sapiens
auucauuguggucau

SEQ ID NO: 1335732 - RNA, 14 nt, Homo sapiens
auucauuucacugu

SEQ ID NO: 1335733 - RNA, 16 nt, Homo sapiens
auuccacccuguuacu

SEQ ID NO: 1335734 - RNA, 17 nt, Homo sapiens
auuccacuuacauccaa

SEQ ID NO: 1335735 - RNA, 23 nt, Homo sapiens
auuccauuuugugaauugugaca

SEQ ID NO: 1335736 - RNA, 14 nt, Homo sapiens
auuccccagugacu

SEQ ID NO: 1335737 - RNA, 19 nt, Homo sapiens
auuccuaagaggaguuuau

SEQ ID NO: 1335738 - RNA, 15 nt, Homo sapiens
auuccuaugauggau

SEQ ID NO: 1335739 - RNA, 12 nt, Homo sapiens
auuccucagggc

SEQ ID NO: 1335740 - RNA, 22 nt, Homo sapiens
auuccuuuauuuugcugcuuga

SEQ ID NO: 1335741 - RNA, 15 nt, Homo sapiens
auuccuuugcauauu

SEQ ID NO: 1335742 - RNA, 19 nt, Homo sapiens
auucgcuacuaugauuuaa

SEQ ID NO: 1335743 - RNA, 18 nt, Homo sapiens
auucuaacccaagacaug

SEQ ID NO: 1335744 - RNA, 14 nt, Homo sapiens
auucucacuccuac

SEQ ID NO: 1335745 - RNA, 12 nt, Homo sapiens
auucucagggcu

SEQ ID NO: 1335746 - RNA, 15 nt, Homo sapiens
auucuccugccucag

SEQ ID NO: 1335747 - RNA, 15 nt, Homo sapiens
auucuccugccuuag

SEQ ID NO: 1335748 - RNA, 20 nt, Homo sapiens
auucucugcagcccauuccc

SEQ ID NO: 1335749 - RNA, 21 nt, Homo sapiens
auucucugcagcccauuccca

SEQ ID NO: 1335750 - RNA, 18 nt, Homo sapiens
auucugaagcaacauuuu

SEQ ID NO: 1335751 - RNA, 14 nt, Homo sapiens
auucuucacugugu

SEQ ID NO: 1335752 - RNA, 21 nt, Homo sapiens
auucuuucaagucaguucugu

SEQ ID NO: 1335753 - RNA, 15 nt, Homo sapiens
auucuuuguuuccug

SEQ ID NO: 1335754 - RNA, 17 nt, Homo sapiens
auugacugucacuguuc

SEQ ID NO: 1335755 - RNA, 22 nt, Homo sapiens
auugacuuucaguaaacauaaa

SEQ ID NO: 1335756 - RNA, 16 nt, Homo sapiens
auugaggaaaaacuga

SEQ ID NO: 1335757 - RNA, 20 nt, Homo sapiens
auugaguuauuaacuguauu

SEQ ID NO: 1335758 - RNA, 17 nt, Homo sapiens
auugauaugcuuauaca

SEQ ID NO: 1335759 - RNA, 16 nt, Homo sapiens
auugauauugaaggaa

SEQ ID NO: 1335760 - RNA, 24 nt, Homo sapiens
auugaucauaaacugacuaucaua

SEQ ID NO: 1335761 - RNA, 15 nt, Homo sapiens
auugaugagcaagac

SEQ ID NO: 1335762 - RNA, 12 nt, Homo sapiens
auugauguugcu

SEQ ID NO: 1335763 - RNA, 16 nt, Homo sapiens
auccagugguggguaa

SEQ ID NO: 1335764 - RNA, 23 nt, Homo sapiens
auccauaaagacaaucacugcca

SEQ ID NO: 1335765 - RNA, 14 nt, Homo sapiens
auccauccauccaa

SEQ ID NO: 1335766 - RNA, 17 nt, Homo sapiens
auccauccugagccaaa

SEQ ID NO: 1335767 - RNA, 18 nt, Homo sapiens
auccaucuugagccacag

SEQ ID NO: 1335768 - RNA, 15 nt, Homo sapiens
auccauucacaguuc

SEQ ID NO: 1335769 - RNA, 18 nt, Homo sapiens
aucccagcuacuuggaag

SEQ ID NO: 1335770 - RNA, 22 nt, Homo sapiens
auccccaacugcgacugugacc

SEQ ID NO: 1335771 - RNA, 16 nt, Homo sapiens
auccccaggcaccuca

SEQ ID NO: 1335772 - RNA, 24 nt, Homo sapiens
aucccucucacaagaaugugcaga

SEQ ID NO: 1335773 - RNA, 17 nt, Homo sapiens
auccuaacguuugucau

SEQ ID NO: 1335774 - RNA, 17 nt, Homo sapiens
auccuagacugcuccug

SEQ ID NO: 1335775 - RNA, 17 nt, Homo sapiens
auccuagucauucuucc

SEQ ID NO: 1335776 - RNA, 14 nt, Homo sapiens
auccuccuaccuca

SEQ ID NO: 1335777 - RNA, 18 nt, Homo sapiens
auccugcagauacuuuga

SEQ ID NO: 1335778 - RNA, 22 nt, Homo sapiens
auccuguaccaaaucugacaua

SEQ ID NO: 1335779 - RNA, 17 nt, Homo sapiens
auccuuaaaacaauucu

SEQ ID NO: 1335780 - RNA, 16 nt, Homo sapiens
auccuuaacacauuca

SEQ ID NO: 1335781 - RNA, 17 nt, Homo sapiens
auccuuauucagccuua

SEQ ID NO: 1335782 - RNA, 13 nt, Homo sapiens
auccuuauuccuc

SEQ ID NO: 1335783 - RNA, 14 nt, Homo sapiens
auccuucacugcuc

SEQ ID NO: 1335784 - RNA, 13 nt, Homo sapiens
aucgagaccaucc

SEQ ID NO: 1335785 - RNA, 17 nt, Homo sapiens
aucguucucugccucac

SEQ ID NO: 1335786 - RNA, 21 nt, Homo sapiens
aucuaacagcccugugcagca

SEQ ID NO: 1335787 - RNA, 19 nt, Homo sapiens
aucuacauaaggaugaagg

SEQ ID NO: 1335788 - RNA, 14 nt, Homo sapiens
aucuacuugcacac

SEQ ID NO: 1335789 - RNA, 15 nt, Homo sapiens
aucuauuucacuuau

SEQ ID NO: 1335790 - RNA, 12 nt, Homo sapiens
aucucagcacuu

SEQ ID NO: 1335791 - RNA, 14 nt, Homo sapiens
aucucagcacuuug

SEQ ID NO: 1335792 - RNA, 15 nt, Homo sapiens
aucucaguaccccau

SEQ ID NO: 1335793 - RNA, 22 nt, Homo sapiens
aucucauugcuuacaagccuaa

SEQ ID NO: 1335794 - RNA, 18 nt, Homo sapiens
aucucccagugacaacau

SEQ ID NO: 1335795 - RNA, 19 nt, Homo sapiens
aucucccccacuccacuac

SEQ ID NO: 1335796 - RNA, 20 nt, Homo sapiens
aucucggcucacugcaagcu

SEQ ID NO: 1335797 - RNA, 13 nt, Homo sapiens
aucucugucucaa

SEQ ID NO: 1335798 - RNA, 17 nt, Homo sapiens
aucucuugcccuuccua

SEQ ID NO: 1335799 - RNA, 18 nt, Homo sapiens
aucugaaugaaaauaacu

SEQ ID NO: 1335800 - RNA, 19 nt, Homo sapiens
aucugacugccaagccaga

SEQ ID NO: 1335801 - RNA, 12 nt, Homo sapiens
aucugacuucau

SEQ ID NO: 1335802 - RNA, 13 nt, Homo sapiens
aucugacuucaua

SEQ ID NO: 1335803 - RNA, 19 nt, Homo sapiens
aucugacuucauacauccc

SEQ ID NO: 1335804 - RNA, 22 nt, Homo sapiens
aucugacuucauacaucccuca

SEQ ID NO: 1335805 - RNA, 16 nt, Homo sapiens
aucugagcuaacuuau

SEQ ID NO: 1335806 - RNA, 20 nt, Homo sapiens
aucugcuucauccaauguga

SEQ ID NO: 1335807 - RNA, 19 nt, Homo sapiens
aucugggggaguggaauag

SEQ ID NO: 1335808 - RNA, 23 nt, Homo sapiens
aucugugaggggcucucucauga

SEQ ID NO: 1335809 - RNA, 19 nt, Homo sapiens
aucuguucuaacauguaau

SEQ ID NO: 1335810 - RNA, 18 nt, Homo sapiens
aucuguuugauacaguau

SEQ ID NO: 1335811 - RNA, 19 nt, Homo sapiens
aucuguuugauacaguauu

SEQ ID NO: 1335812 - RNA, 20 nt, Homo sapiens
aucuguuugauacaguauua

SEQ ID NO: 1335813 - RNA, 23 nt, Homo sapiens
aucuuaaacauaauaaaucacac

SEQ ID NO: 1335814 - RNA, 18 nt, Homo sapiens
aucuuacauuagugauuc

SEQ ID NO: 1335815 - RNA, 20 nt, Homo sapiens
aucuuagguaagacauauaa

SEQ ID NO: 1335816 - RNA, 15 nt, Homo sapiens
aucuuauuuaggaag

SEQ ID NO: 1335817 - RNA, 15 nt, Homo sapiens
aucuuauuucuguca

SEQ ID NO: 1335818 - RNA, 17 nt, Homo sapiens
aucuucauguccaguga

SEQ ID NO: 1335819 - RNA, 21 nt, Homo sapiens
aucuuccacuggaacguuuca

SEQ ID NO: 1335820 - RNA, 15 nt, Homo sapiens
aucuucuuaugcaau

SEQ ID NO: 1335821 - RNA, 22 nt, Homo sapiens
aucuugcauccaaaccuguaac

SEQ ID NO: 1335822 - RNA, 18 nt, Homo sapiens
aucuuuaaaauacacacu

SEQ ID NO: 1335823 - RNA, 21 nt, Homo sapiens
aucuuuaaaauacacacucaa

SEQ ID NO: 1335824 - RNA, 23 nt, Homo sapiens
aucuuucuuuccaaaacauuucu

SEQ ID NO: 1335825 - RNA, 18 nt, Homo sapiens
aucuuuguggccaaggag

SEQ ID NO: 1335826 - RNA, 17 nt, Homo sapiens
augaaaacuaaggauuu

SEQ ID NO: 1335827 - RNA, 21 nt, Homo sapiens
augaaaauaacugaaccaaau

SEQ ID NO: 1335828 - RNA, 21 nt, Homo sapiens
augaaagugaugauacuguaa

SEQ ID NO: 1335829 - RNA, 20 nt, Homo sapiens
augaaccugcccugcuccca

SEQ ID NO: 1335830 - RNA, 14 nt, Homo sapiens
augaagaaucugcu

SEQ ID NO: 1335831 - RNA, 17 nt, Homo sapiens
augaagaaugcauucaa

SEQ ID NO: 1335832 - RNA, 20 nt, Homo sapiens
augaagcaagccccacuuau

SEQ ID NO: 1335833 - RNA, 18 nt, Homo sapiens
augaagguggaacaagca

SEQ ID NO: 1335834 - RNA, 21 nt, Homo sapiens
augaagguggaacaagcacag

SEQ ID NO: 1335835 - RNA, 15 nt, Homo sapiens
augaauaaaacacuc

SEQ ID NO: 1335836 - RNA, 19 nt, Homo sapiens
augaauacuuugcagcaca

SEQ ID NO: 1335837 - RNA, 19 nt, Homo sapiens
augacaaccuccauucuau

SEQ ID NO: 1335838 - RNA, 16 nt, Homo sapiens
augacaaguacuguau

SEQ ID NO: 1335839 - RNA, 12 nt, Homo sapiens
augacacagucu

SEQ ID NO: 1335840 - RNA, 13 nt, Homo sapiens
augacaucacuug

SEQ ID NO: 1335841 - RNA, 14 nt, Homo sapiens
augaccgacugcac

SEQ ID NO: 1335842 - RNA, 14 nt, Homo sapiens
augaccucaaggaa

SEQ ID NO: 1335843 - RNA, 21 nt, Homo sapiens
augaccuugaguuaacaggac

SEQ ID NO: 1335844 - RNA, 21 nt, Homo sapiens
augacuuggagauuuaucucu

SEQ ID NO: 1335845 - RNA, 19 nt, Homo sapiens
augacuuuauccugagucc

SEQ ID NO: 1335846 - RNA, 16 nt, Homo sapiens
augacuuugagauuau

SEQ ID NO: 1335847 - RNA, 15 nt, Homo sapiens
augagauaacucaag

SEQ ID NO: 1335848 - RNA, 22 nt, Homo sapiens
augagcuggggaugucucucau

SEQ ID NO: 1335849 - RNA, 23 nt, Homo sapiens
augagcuggggaugucucucaug

SEQ ID NO: 1335850 - RNA, 16 nt, Homo sapiens
augagguggagagugg

SEQ ID NO: 1335851 - RNA, 20 nt, Homo sapiens
augaguggaaauacacucau

SEQ ID NO: 1335852 - RNA, 22 nt, Homo sapiens
augauacugucucuccagugaa

SEQ ID NO: 1335853 - RNA, 14 nt, Homo sapiens
augaugaugaucuu

SEQ ID NO: 1335854 - RNA, 16 nt, Homo sapiens
augauuuaauguugau

SEQ ID NO: 1335855 - RNA, 16 nt, Homo sapiens
augauuucacagugug

SEQ ID NO: 1335856 - RNA, 23 nt, Homo sapiens
augauuuguaguggaaacauuua

SEQ ID NO: 1335857 - RNA, 16 nt, Homo sapiens
augauuuuacucauau

SEQ ID NO: 1335858 - RNA, 14 nt, Homo sapiens
augcaaagcacuga

SEQ ID NO: 1335859 - RNA, 18 nt, Homo sapiens
augcaaauagauucagag

SEQ ID NO: 1335860 - RNA, 20 nt, Homo sapiens
augcaaggucuugcauuuaa

SEQ ID NO: 1335861 - RNA, 18 nt, Homo sapiens
augcacaaaucugccaaa

SEQ ID NO: 1335862 - RNA, 14 nt, Homo sapiens
augcacacauauau

SEQ ID NO: 1335863 - RNA, 16 nt, Homo sapiens
augcacaguugccaca

SEQ ID NO: 1335864 - RNA, 18 nt, Homo sapiens
augcagaaagcaucccuc

SEQ ID NO: 1335865 - RNA, 17 nt, Homo sapiens
augcagcaggaaggaac

SEQ ID NO: 1335866 - RNA, 22 nt, Homo sapiens
augcagcaggaaggaacaaaga

SEQ ID NO: 1335867 - RNA, 13 nt, Homo sapiens
augcagcagggau

SEQ ID NO: 1335868 - RNA, 23 nt, Homo sapiens
augcagcuguggcagaguuacag

SEQ ID NO: 1335869 - RNA, 22 nt, Homo sapiens
augcaguucaaaaacaagacag

SEQ ID NO: 1335870 - RNA, 23 nt, Homo sapiens
augcauggugccccaggaccagc

SEQ ID NO: 1335871 - RNA, 17 nt, Homo sapiens
augcauguagcauauaa

SEQ ID NO: 1335872 - RNA, 15 nt, Homo sapiens
augcauuucauaaac

SEQ ID NO: 1335873 - RNA, 21 nt, Homo sapiens
augccacccaguugugacaau

SEQ ID NO: 1335874 - RNA, 23 nt, Homo sapiens
augccacccaguugugacaauua

SEQ ID NO: 1335875 - RNA, 22 nt, Homo sapiens
augccagcagccagccaacccu

SEQ ID NO: 1335876 - RNA, 15 nt, Homo sapiens
augcccaaggcgaua

SEQ ID NO: 1335877 - RNA, 15 nt, Homo sapiens
augcccgcccgggga

SEQ ID NO: 1335878 - RNA, 23 nt, Homo sapiens
augccucgcucccuucaagacga

SEQ ID NO: 1335879 - RNA, 19 nt, Homo sapiens
augccuguguacugccuua

SEQ ID NO: 1335880 - RNA, 13 nt, Homo sapiens
augccuuaccuaa

SEQ ID NO: 1335881 - RNA, 14 nt, Homo sapiens
augcgggggugccu

SEQ ID NO: 1335882 - RNA, 21 nt, Homo sapiens
augcuacaagacgggcaaaau

SEQ ID NO: 1335883 - RNA, 21 nt, Homo sapiens
augcucucuuucuuuucucug

SEQ ID NO: 1335884 - RNA, 14 nt, Homo sapiens
augcugacagcucu

SEQ ID NO: 1335885 - RNA, 16 nt, Homo sapiens
augcugagccaacugc

SEQ ID NO: 1335886 - RNA, 19 nt, Homo sapiens
augcugcaguuccaaaaga

SEQ ID NO: 1335887 - RNA, 23 nt, Homo sapiens
augcugcuggggaagacaguggc

SEQ ID NO: 1335888 - RNA, 15 nt, Homo sapiens
augcuggcaaaucca

SEQ ID NO: 1335889 - RNA, 21 nt, Homo sapiens
augcuguugguaaagcacaug

SEQ ID NO: 1335890 - RNA, 18 nt, Homo sapiens
augcuguuuguagugaaa

SEQ ID NO: 1335891 - RNA, 20 nt, Homo sapiens
augcuuccacuaccaaaaga

SEQ ID NO: 1335892 - RNA, 14 nt, Homo sapiens
augcuuggauguaa

SEQ ID NO: 1335893 - RNA, 23 nt, Homo sapiens
augcuuggguacacuucucuuaa

SEQ ID NO: 1335894 - RNA, 19 nt, Homo sapiens
augcuuuaaaaaacacagu

SEQ ID NO: 1335895 - RNA, 12 nt, Homo sapiens
augcuuuggcaa

SEQ ID NO: 1335896 - RNA, 19 nt, Homo sapiens
acauugcagcuucaacuuu

SEQ ID NO: 1335897 - RNA, 18 nt, Homo sapiens
acauuggagccugggcau

SEQ ID NO: 1335898 - RNA, 17 nt, Homo sapiens
acauuggcaccuaaucc

SEQ ID NO: 1335899 - RNA, 17 nt, Homo sapiens
acauuuaauaauaucaa

SEQ ID NO: 1335900 - RNA, 22 nt, Homo sapiens
acauuucuggacaguaccugau

SEQ ID NO: 1335901 - RNA, 12 nt, Homo sapiens
acauuuguucca

SEQ ID NO: 1335902 - RNA, 16 nt, Homo sapiens
acauuuuaugucuuuc

SEQ ID NO: 1335903 - RNA, 14 nt, Homo sapiens
acauuuucauugau

SEQ ID NO: 1335904 - RNA, 13 nt, Homo sapiens
acauuuugacaca

SEQ ID NO: 1335905 - RNA, 15 nt, Homo sapiens
acauuuuuccaguaa

SEQ ID NO: 1335906 - RNA, 15 nt, Homo sapiens
accaaaaugccaaaa

SEQ ID NO: 1335907 - RNA, 14 nt, Homo sapiens
accaaagacaucag

SEQ ID NO: 1335908 - RNA, 18 nt, Homo sapiens
accaaaucugacauauua

SEQ ID NO: 1335909 - RNA, 19 nt, Homo sapiens
accaaaugcuuuuccucaa

SEQ ID NO: 1335910 - RNA, 15 nt, Homo sapiens
accaacccucagagc

SEQ ID NO: 1335911 - RNA, 20 nt, Homo sapiens
accaagauauaccugauaua

SEQ ID NO: 1335912 - RNA, 15 nt, Homo sapiens
accaagcucugucca

SEQ ID NO: 1335913 - RNA, 17 nt, Homo sapiens
accaaguaccaguauaa

SEQ ID NO: 1335914 - RNA, 13 nt, Homo sapiens
accaauaaacagc

SEQ ID NO: 1335915 - RNA, 14 nt, Homo sapiens
accaaugccaaaaa

SEQ ID NO: 1335916 - RNA, 20 nt, Homo sapiens
accaauucuggacagacaga

SEQ ID NO: 1335917 - RNA, 20 nt, Homo sapiens
accacaaaaaagaaacuugc

SEQ ID NO: 1335918 - RNA, 17 nt, Homo sapiens
accacacccagugggaa

SEQ ID NO: 1335919 - RNA, 18 nt, Homo sapiens
accacaugauucugaugu

SEQ ID NO: 1335920 - RNA, 15 nt, Homo sapiens
accacucccaccaca

SEQ ID NO: 1335921 - RNA, 20 nt, Homo sapiens
accacugcccugacugucac

SEQ ID NO: 1335922 - RNA, 14 nt, Homo sapiens
accacugggugaga

SEQ ID NO: 1335923 - RNA, 16 nt, Homo sapiens
accagaaaagcaauac

SEQ ID NO: 1335924 - RNA, 20 nt, Homo sapiens
accagagaggcucugagaaa

SEQ ID NO: 1335925 - RNA, 11 nt, Homo sapiens
accagaggcag

SEQ ID NO: 1335926 - RNA, 23 nt, Homo sapiens
accagagggacacuaggaaucaa

SEQ ID NO: 1335927 - RNA, 12 nt, Homo sapiens
accagauuugcu

SEQ ID NO: 1335928 - RNA, 13 nt, Homo sapiens
accagcccacccc

SEQ ID NO: 1335929 - RNA, 21 nt, Homo sapiens
accaggcagugugccaguuua

SEQ ID NO: 1335930 - RNA, 14 nt, Homo sapiens
accaguaugaauga

SEQ ID NO: 1335931 - RNA, 16 nt, Homo sapiens
accaguaugaaugaca

SEQ ID NO: 1335932 - RNA, 20 nt, Homo sapiens
accaguugugauacaauaaa

SEQ ID NO: 1335933 - RNA, 21 nt, Homo sapiens
gugacaauuaaaagugucuug

SEQ ID NO: 1335934 - RNA, 16 nt, Homo sapiens
gugacaggacuuucau

SEQ ID NO: 1335935 - RNA, 23 nt, Homo sapiens
gugacauuugggagacaugugac

SEQ ID NO: 1335936 - RNA, 19 nt, Homo sapiens
gugacauuuuagaauguca

SEQ ID NO: 1335937 - RNA, 22 nt, Homo sapiens
gugaccagaaagcuucauccac

SEQ ID NO: 1335938 - RNA, 14 nt, Homo sapiens
gugacucauuucca

SEQ ID NO: 1335939 - RNA, 18 nt, Homo sapiens
gugagaacccuugcacua

SEQ ID NO: 1335940 - RNA, 19 nt, Homo sapiens
gugagaucggugcguucuc

SEQ ID NO: 1335941 - RNA, 14 nt, Homo sapiens
gugagcacaaagaa

SEQ ID NO: 1335942 - RNA, 21 nt, Homo sapiens
gugagcacacccgugugcaca

SEQ ID NO: 1335943 - RNA, 21 nt, Homo sapiens
gugagcauuugucucuguuau

SEQ ID NO: 1335944 - RNA, 20 nt, Homo sapiens
gugagcuguaaaaauguuac

SEQ ID NO: 1335945 - RNA, 17 nt, Homo sapiens
gugaggggcucucucau

SEQ ID NO: 1335946 - RNA, 12 nt, Homo sapiens
gugagggguccc

SEQ ID NO: 1335947 - RNA, 18 nt, Homo sapiens
gugaguauugcuuauaug

SEQ ID NO: 1335948 - RNA, 15 nt, Homo sapiens
gugagucaccacuuc

SEQ ID NO: 1335949 - RNA, 15 nt, Homo sapiens
gugauagagugcagu

SEQ ID NO: 1335950 - RNA, 14 nt, Homo sapiens
gugaucaaagccac

SEQ ID NO: 1335951 - RNA, 14 nt, Homo sapiens
gugaugacauuccc

SEQ ID NO: 1335952 - RNA, 16 nt, Homo sapiens
gugauucuguuugccu

SEQ ID NO: 1335953 - RNA, 22 nt, Homo sapiens
gugauugacagcuuugcugcug

SEQ ID NO: 1335954 - RNA, 19 nt, Homo sapiens
gugauuucuuucuuugcac

SEQ ID NO: 1335955 - RNA, 19 nt, Homo sapiens
gugcaaaguucccuacuuc

SEQ ID NO: 1335956 - RNA, 22 nt, Homo sapiens
gugcacuuuaagaggugggagc

SEQ ID NO: 1335957 - RNA, 17 nt, Homo sapiens
gugcagaccuuggggga

SEQ ID NO: 1335958 - RNA, 18 nt, Homo sapiens
gugccagguccuugcccu

SEQ ID NO: 1335959 - RNA, 18 nt, Homo sapiens
gugccauccccaccuuca

SEQ ID NO: 1335960 - RNA, 13 nt, Homo sapiens
gugcccaugugua

SEQ ID NO: 1335961 - RNA, 17 nt, Homo sapiens
gugccuaguugacuuac

SEQ ID NO: 1335962 - RNA, 18 nt, Homo sapiens
gugcuggaauuacaggcg

SEQ ID NO: 1335963 - RNA, 15 nt, Homo sapiens
gugcugucauuauuu

SEQ ID NO: 1335964 - RNA, 14 nt, Homo sapiens
gugcuguuuugcca

SEQ ID NO: 1335965 - RNA, 18 nt, Homo sapiens
gugcuguuuuuguucuac

SEQ ID NO: 1335966 - RNA, 21 nt, Homo sapiens
gugcuuuaaccucacauaccc

SEQ ID NO: 1335967 - RNA, 20 nt, Homo sapiens
gugcuuuuaaaaaaaaauac

SEQ ID NO: 1335968 - RNA, 18 nt, Homo sapiens
guggaaugccgcugucuc

SEQ ID NO: 1335969 - RNA, 23 nt, Homo sapiens
guggaugcaaauagauucagaga

SEQ ID NO: 1335970 - RNA, 17 nt, Homo sapiens
guggcaaacaagcacac

SEQ ID NO: 1335971 - RNA, 16 nt, Homo sapiens
guggcacucagucucu

SEQ ID NO: 1335972 - RNA, 22 nt, Homo sapiens
guggcuucacagacccacaaga

SEQ ID NO: 1335973 - RNA, 13 nt, Homo sapiens
gugggacugagau

SEQ ID NO: 1335974 - RNA, 17 nt, Homo sapiens
gugggauaucacuucca

SEQ ID NO: 1335975 - RNA, 14 nt, Homo sapiens
gugggauuuugcaa

SEQ ID NO: 1335976 - RNA, 22 nt, Homo sapiens
gugggcgcuugcaccacuuccg

SEQ ID NO: 1335977 - RNA, 21 nt, Homo sapiens
guggggguaaggugcaucugu

SEQ ID NO: 1335978 - RNA, 23 nt, Homo sapiens
gugggggugccgcucucucugag

SEQ ID NO: 1335979 - RNA, 13 nt, Homo sapiens
gugggguggcacc

SEQ ID NO: 1335980 - RNA, 20 nt, Homo sapiens
guggucugggcaccaccucu

SEQ ID NO: 1335981 - RNA, 16 nt, Homo sapiens
guguaaaauguauauu

SEQ ID NO: 1335982 - RNA, 20 nt, Homo sapiens
guguaacaggauacagguga

SEQ ID NO: 1335983 - RNA, 17 nt, Homo sapiens
guguacacgugacagag

SEQ ID NO: 1335984 - RNA, 22 nt, Homo sapiens
guguauccaugcaccuaccuua

SEQ ID NO: 1335985 - RNA, 20 nt, Homo sapiens
gugucacagguuaauguggu

SEQ ID NO: 1335986 - RNA, 13 nt, Homo sapiens
gugucacccuuag

SEQ ID NO: 1335987 - RNA, 21 nt, Homo sapiens
gugugaacucaccaaacacaa

SEQ ID NO: 1335988 - RNA, 18 nt, Homo sapiens
gugugaagcuuugcacac

SEQ ID NO: 1335989 - RNA, 15 nt, Homo sapiens
gugugacccugggca

SEQ ID NO: 1335990 - RNA, 23 nt, Homo sapiens
gugugacuccuuaucucuuucca

SEQ ID NO: 1335991 - RNA, 22 nt, Homo sapiens
gugugauuugaauucugugaua

SEQ ID NO: 1335992 - RNA, 18 nt, Homo sapiens
gugugccaagaguucgau

SEQ ID NO: 1335993 - RNA, 18 nt, Homo sapiens
gugugcuuccugcuguau

SEQ ID NO: 1335994 - RNA, 14 nt, Homo sapiens
guguggggccaugc

SEQ ID NO: 1335995 - RNA, 19 nt, Homo sapiens
gugugugggaguguguaau

SEQ ID NO: 1335996 - RNA, 15 nt, Homo sapiens
guguuccugaagcug

SEQ ID NO: 1335997 - RNA, 23 nt, Homo sapiens
guguucuucauuaccucagugag

SEQ ID NO: 1335998 - RNA, 23 nt, Homo sapiens
guguuguaaaaaugucuuucaug

SEQ ID NO: 1335999 - RNA, 17 nt, Homo sapiens
guguuuuaaaauugaug

SEQ ID NO: 1336000 - RNA, 20 nt, Homo sapiens
guuaaauuaagcucuugcua

SEQ ID NO: 1336001 - RNA, 13 nt, Homo sapiens
guuaaauuuagca

SEQ ID NO: 1336002 - RNA, 18 nt, Homo sapiens
guuaacguauauugcugu

SEQ ID NO: 1336003 - RNA, 20 nt, Homo sapiens
guuaauaaaccuuugcaaac

SEQ ID NO: 1336004 - RNA, 13 nt, Homo sapiens
guuaauaaucuca

SEQ ID NO: 1336005 - RNA, 23 nt, Homo sapiens
guuaaucauauuugaaaaccaua

SEQ ID NO: 1336006 - RNA, 19 nt, Homo sapiens
guuaauuuugaagugcugu

SEQ ID NO: 1336007 - RNA, 17 nt, Homo sapiens
guuaccucugcauggaa

SEQ ID NO: 1336008 - RNA, 12 nt, Homo sapiens
guuacgugaaga

SEQ ID NO: 1336009 - RNA, 21 nt, Homo sapiens
guuacucccuacacugaugca

SEQ ID NO: 1336010 - RNA, 20 nt, Homo sapiens
guuacuuaauucaacuuaac

SEQ ID NO: 1336011 - RNA, 19 nt, Homo sapiens
guuacuuaauugccagcaa

SEQ ID NO: 1336012 - RNA, 14 nt, Homo sapiens
guuauagcuucagg

SEQ ID NO: 1336013 - RNA, 14 nt, Homo sapiens
guuaugcagugaac

SEQ ID NO: 1336014 - RNA, 22 nt, Homo sapiens
guuauuugaaaauuugauuuug

SEQ ID NO: 1336015 - RNA, 22 nt, Homo sapiens
guucaaauucaaaccauuuuua

SEQ ID NO: 1336016 - RNA, 21 nt, Homo sapiens
guucaaucuggauucauauuu

SEQ ID NO: 1336017 - RNA, 18 nt, Homo sapiens
guucaauuggacaauuau

SEQ ID NO: 1336018 - RNA, 21 nt, Homo sapiens
guucaccuccaagcauuucau

SEQ ID NO: 1336019 - RNA, 16 nt, Homo sapiens
guucacucagagggaa

SEQ ID NO: 1336020 - RNA, 21 nt, Homo sapiens
guuccacauccacacagccaa

SEQ ID NO: 1336021 - RNA, 13 nt, Homo sapiens
guuccccagagaa

SEQ ID NO: 1336022 - RNA, 15 nt, Homo sapiens
guuccgagaagaaca

SEQ ID NO: 1336023 - RNA, 15 nt, Homo sapiens
guuccuggugacucc

SEQ ID NO: 1336024 - RNA, 13 nt, Homo sapiens
guucuaccaagca

SEQ ID NO: 1336025 - RNA, 20 nt, Homo sapiens
guucucauggguggcacuca

SEQ ID NO: 1336026 - RNA, 21 nt, Homo sapiens
guucuccagucauuauguuaa

SEQ ID NO: 1336027 - RNA, 13 nt, Homo sapiens
guucucuauacuc

SEQ ID NO: 1336028 - RNA, 22 nt, Homo sapiens
guucuguauuuuuaaauugcca

SEQ ID NO: 1336029 - RNA, 12 nt, Homo sapiens
guucugucauau

SEQ ID NO: 1336030 - RNA, 15 nt, Homo sapiens
guucuuugggccaga

SEQ ID NO: 1336031 - RNA, 17 nt, Homo sapiens
guucuuugucucaaaau

SEQ ID NO: 1336032 - RNA, 14 nt, Homo sapiens
guucuuuuugccag

SEQ ID NO: 1336033 - RNA, 14 nt, Homo sapiens
guugaagacuuugu

SEQ ID NO: 1336034 - RNA, 19 nt, Homo sapiens
guugaaugagcgucagcau

SEQ ID NO: 1336035 - RNA, 22 nt, Homo sapiens
guugauggaaaauaaacaucag

SEQ ID NO: 1336036 - RNA, 17 nt, Homo sapiens
guugcagccagggcugu

SEQ ID NO: 1336037 - RNA, 16 nt, Homo sapiens
guugcuggacugucau

SEQ ID NO: 1336038 - RNA, 14 nt, Homo sapiens
guuguaaaaagccc

SEQ ID NO: 1336039 - RNA, 14 nt, Homo sapiens
guuguagcagaaac

SEQ ID NO: 1336040 - RNA, 19 nt, Homo sapiens
guugucacaucucagggaa

SEQ ID NO: 1336041 - RNA, 14 nt, Homo sapiens
guuguccgugauaa

SEQ ID NO: 1336042 - RNA, 15 nt, Homo sapiens
guuguggggccucag

SEQ ID NO: 1336043 - RNA, 12 nt, Homo sapiens
guugugucuuaa

SEQ ID NO: 1336044 - RNA, 18 nt, Homo sapiens
guuuaaagauucuaugcc

SEQ ID NO: 1336045 - RNA, 15 nt, Homo sapiens
guuuaacugcugcag

SEQ ID NO: 1336046 - RNA, 19 nt, Homo sapiens
guuuaagugugcagccaua

SEQ ID NO: 1336047 - RNA, 20 nt, Homo sapiens
guuuagaugaggcucagaga

SEQ ID NO: 1336048 - RNA, 12 nt, Homo sapiens
guuuaugaauga

SEQ ID NO: 1336049 - RNA, 14 nt, Homo sapiens
guuuaugcuaccua

SEQ ID NO: 1336050 - RNA, 14 nt, Homo sapiens
guuuauuugcacua

SEQ ID NO: 1336051 - RNA, 13 nt, Homo sapiens
guuuccucuguau

SEQ ID NO: 1336052 - RNA, 14 nt, Homo sapiens
guuuccucuguaua

SEQ ID NO: 1336053 - RNA, 12 nt, Homo sapiens
guuuccugguca

SEQ ID NO: 1336054 - RNA, 16 nt, Homo sapiens
guuucuccauguuggu

SEQ ID NO: 1336055 - RNA, 22 nt, Homo sapiens
guuucugagagagugccaugau

SEQ ID NO: 1336056 - RNA, 17 nt, Homo sapiens
guuucuugcauuuauua

SEQ ID NO: 1336057 - RNA, 20 nt, Homo sapiens
guuucuuugacuucaaugua

SEQ ID NO: 1336058 - RNA, 15 nt, Homo sapiens
guuugaacucaggga

SEQ ID NO: 1336059 - RNA, 22 nt, Homo sapiens
guuugaagaugccgcauuugga

SEQ ID NO: 1336060 - RNA, 23 nt, Homo sapiens
guuugaaucuacauucacuuuuu

SEQ ID NO: 1336061 - RNA, 15 nt, Homo sapiens
guuugauucagcaaa

SEQ ID NO: 1336062 - RNA, 14 nt, Homo sapiens
guuugccucugaaa

SEQ ID NO: 1336063 - RNA, 18 nt, Homo sapiens
guuugcugucaagccauu

SEQ ID NO: 1336064 - RNA, 15 nt, Homo sapiens
guuuuaaaaggcaag

SEQ ID NO: 1336065 - RNA, 15 nt, Homo sapiens
guuuuaaacuugccu

SEQ ID NO: 1336066 - RNA, 16 nt, Homo sapiens
guuuuaaccaauaacu

SEQ ID NO: 1336067 - RNA, 20 nt, Homo sapiens
guauacauaaguuuaggaua

SEQ ID NO: 1336068 - RNA, 19 nt, Homo sapiens
guauagaacuggauuuuca

SEQ ID NO: 1336069 - RNA, 17 nt, Homo sapiens
guauauuuuugucugca

SEQ ID NO: 1336070 - RNA, 23 nt, Homo sapiens
guauccaugcaccuaccuuagaa

SEQ ID NO: 1336071 - RNA, 13 nt, Homo sapiens
guauccauucuac

SEQ ID NO: 1336072 - RNA, 22 nt, Homo sapiens
guauccuuguagcaaagcacau

SEQ ID NO: 1336073 - RNA, 21 nt, Homo sapiens
guaucugacaaaagguuugug

SEQ ID NO: 1336074 - RNA, 18 nt, Homo sapiens
guaugaauaauugcauca

SEQ ID NO: 1336075 - RNA, 22 nt, Homo sapiens
guaugcauaugauuguccguga

SEQ ID NO: 1336076 - RNA, 15 nt, Homo sapiens
guauucaagcaaaca

SEQ ID NO: 1336077 - RNA, 16 nt, Homo sapiens
guauucucuuccucau

SEQ ID NO: 1336078 - RNA, 16 nt, Homo sapiens
guauugaaaacuucaa

SEQ ID NO: 1336079 - RNA, 21 nt, Homo sapiens
guauugucgguuaccucugca

SEQ ID NO: 1336080 - RNA, 19 nt, Homo sapiens
guauuugccuucuccacuu

SEQ ID NO: 1336081 - RNA, 22 nt, Homo sapiens
gucaaacccaaguuaguucaau

SEQ ID NO: 1336082 - RNA, 14 nt, Homo sapiens
gucaaauaccacau

SEQ ID NO: 1336083 - RNA, 12 nt, Homo sapiens
gucaacauuucu

SEQ ID NO: 1336084 - RNA, 22 nt, Homo sapiens
gucaaccccaaguuaguucaau

SEQ ID NO: 1336085 - RNA, 20 nt, Homo sapiens
gucaagaagaggaaagggag

SEQ ID NO: 1336086 - RNA, 11 nt, Homo sapiens
gucacagggac

SEQ ID NO: 1336087 - RNA, 14 nt, Homo sapiens
gucacaucucaggg

SEQ ID NO: 1336088 - RNA, 16 nt, Homo sapiens
gucaccccucacugug

SEQ ID NO: 1336089 - RNA, 19 nt, Homo sapiens
gucaccucaauauuuacua

SEQ ID NO: 1336090 - RNA, 22 nt, Homo sapiens
gucacgcuuucaugaauucugu

SEQ ID NO: 1336091 - RNA, 23 nt, Homo sapiens
gucacgcuuucaugaauucuguc

SEQ ID NO: 1336092 - RNA, 18 nt, Homo sapiens
gucacuuauaccaugagu

SEQ ID NO: 1336093 - RNA, 12 nt, Homo sapiens
gucagcauguac

SEQ ID NO: 1336094 - RNA, 22 nt, Homo sapiens
gucagccaccugggaacacagu

SEQ ID NO: 1336095 - RNA, 13 nt, Homo sapiens
gucaguguucuua

SEQ ID NO: 1336096 - RNA, 16 nt, Homo sapiens
gucaucuguaccucug

SEQ ID NO: 1336097 - RNA, 11 nt, Homo sapiens
gucaugcccuc

SEQ ID NO: 1336098 - RNA, 22 nt, Homo sapiens
gucauguaugugaaacaaugug

SEQ ID NO: 1336099 - RNA, 14 nt, Homo sapiens
gucauuucaaagac

SEQ ID NO: 1336100 - RNA, 20 nt, Homo sapiens
guccaaaacugccucaggag

SEQ ID NO: 1336101 - RNA, 21 nt, Homo sapiens
guccaaacccacucaugacug

SEQ ID NO: 1336102 - RNA, 10 nt, Homo sapiens
guccacaggg

SEQ ID NO: 1336103 - RNA, 19 nt, Homo sapiens
guccaggcuggagugcaau

SEQ ID NO: 1336104 - RNA, 15 nt, Homo sapiens
gucccacacugugca

SEQ ID NO: 1336105 - RNA, 18 nt, Homo sapiens
gucccacuacaucuggga

SEQ ID NO: 1336106 - RNA, 15 nt, Homo sapiens
gucccagacaauucc

SEQ ID NO: 1336107 - RNA, 18 nt, Homo sapiens
gucccagcuacucaggag

SEQ ID NO: 1336108 - RNA, 20 nt, Homo sapiens
gucccauuuuucucuugcca

SEQ ID NO: 1336109 - RNA, 17 nt, Homo sapiens
guccccuaaaccaaaaa

SEQ ID NO: 1336110 - RNA, 12 nt, Homo sapiens
gucccugcaaaa

SEQ ID NO: 1336111 - RNA, 16 nt, Homo sapiens
gucccugcugcugcca

SEQ ID NO: 1336112 - RNA, 22 nt, Homo sapiens
gucccuguccuucccuguucuc

SEQ ID NO: 1336113 - RNA, 20 nt, Homo sapiens
gucccuucccagcgcugcug

SEQ ID NO: 1336114 - RNA, 13 nt, Homo sapiens
gucccuugccucu

SEQ ID NO: 1336115 - RNA, 17 nt, Homo sapiens
gucccuuucccuaccuu

SEQ ID NO: 1336116 - RNA, 12 nt, Homo sapiens
guccuacaguga

SEQ ID NO: 1336117 - RNA, 21 nt, Homo sapiens
guccucagccuugccagagau

SEQ ID NO: 1336118 - RNA, 20 nt, Homo sapiens
guccucaguccacugcugag

SEQ ID NO: 1336119 - RNA, 14 nt, Homo sapiens
guccuccaccaugc

SEQ ID NO: 1336120 - RNA, 15 nt, Homo sapiens
guccuccaccaugca

SEQ ID NO: 1336121 - RNA, 21 nt, Homo sapiens
guccuccaccaugcacucacc

SEQ ID NO: 1336122 - RNA, 14 nt, Homo sapiens
guccugaagugacc

SEQ ID NO: 1336123 - RNA, 13 nt, Homo sapiens
guccugcacauga

SEQ ID NO: 1336124 - RNA, 21 nt, Homo sapiens
guccugcagucccacacugug

SEQ ID NO: 1336125 - RNA, 22 nt, Homo sapiens
guccugcagucccacacugugc

SEQ ID NO: 1336126 - RNA, 12 nt, Homo sapiens
guccuggucaag

SEQ ID NO: 1336127 - RNA, 20 nt, Homo sapiens
guccuuacucccccaccacu

SEQ ID NO: 1336128 - RNA, 16 nt, Homo sapiens
guccuuaggcuacugu

SEQ ID NO: 1336129 - RNA, 19 nt, Homo sapiens
gucggucuccuuauccccc

SEQ ID NO: 1336130 - RNA, 17 nt, Homo sapiens
gucguuuuccaaagagc

SEQ ID NO: 1336131 - RNA, 20 nt, Homo sapiens
gucuaaaaaaggaauccucu

SEQ ID NO: 1336132 - RNA, 21 nt, Homo sapiens
gucuaaagcagggaagugaca

SEQ ID NO: 1336133 - RNA, 22 nt, Homo sapiens
gucuaaagcagggaagugacag

SEQ ID NO: 1336134 - RNA, 13 nt, Homo sapiens
gucuaaagcuuug

SEQ ID NO: 1336135 - RNA, 18 nt, Homo sapiens
gucuagagagaaccaaua

SEQ ID NO: 1336136 - RNA, 11 nt, Homo sapiens
gucuagucaag

SEQ ID NO: 1336137 - RNA, 17 nt, Homo sapiens
gucuccaggggccugca

SEQ ID NO: 1336138 - RNA, 16 nt, Homo sapiens
gucuccucugcagcuc

SEQ ID NO: 1336139 - RNA, 17 nt, Homo sapiens
gucuccucugcagcuca

SEQ ID NO: 1336140 - RNA, 16 nt, Homo sapiens
gucucuccagugaaau

SEQ ID NO: 1336141 - RNA, 18 nt, Homo sapiens
gucucugcgccugaguaa

SEQ ID NO: 1336142 - RNA, 13 nt, Homo sapiens
gucucuggaagag

SEQ ID NO: 1336143 - RNA, 17 nt, Homo sapiens
gucugccuucugcugaa

SEQ ID NO: 1336144 - RNA, 16 nt, Homo sapiens
gucugggauauggcug

SEQ ID NO: 1336145 - RNA, 22 nt, Homo sapiens
gucuggggacgaaggguuggac

SEQ ID NO: 1336146 - RNA, 18 nt, Homo sapiens
gucuggucuccucagccu

SEQ ID NO: 1336147 - RNA, 19 nt, Homo sapiens
gucuguguguuuaugugug

SEQ ID NO: 1336148 - RNA, 15 nt, Homo sapiens
gucuuaaucauuugu

SEQ ID NO: 1336149 - RNA, 19 nt, Homo sapiens
gucuuauuaagacuggcuu

SEQ ID NO: 1336150 - RNA, 15 nt, Homo sapiens
gucuuccacuucaau

SEQ ID NO: 1336151 - RNA, 22 nt, Homo sapiens
gucuucuccuccaugaacauca

SEQ ID NO: 1336152 - RNA, 12 nt, Homo sapiens
gucuuggcucac

SEQ ID NO: 1336153 - RNA, 18 nt, Homo sapiens
gucuuguuuuuuacucaa

SEQ ID NO: 1336154 - RNA, 14 nt, Homo sapiens
gucuuuuaaacugg

SEQ ID NO: 1336155 - RNA, 14 nt, Homo sapiens
gugaacacaucagc

SEQ ID NO: 1336156 - RNA, 15 nt, Homo sapiens
gugaacucuggugcu

SEQ ID NO: 1336157 - RNA, 15 nt, Homo sapiens
gugaagucucugggu

SEQ ID NO: 1336158 - RNA, 19 nt, Homo sapiens
gugaaguuuaauugucuca

SEQ ID NO: 1336159 - RNA, 14 nt, Homo sapiens
gugaauuaggcugu

SEQ ID NO: 1336160 - RNA, 23 nt, Homo sapiens
gggccucaggcucugcacagaca

SEQ ID NO: 1336161 - RNA, 16 nt, Homo sapiens
gggccugcagaaggaa

SEQ ID NO: 1336162 - RNA, 16 nt, Homo sapiens
gggccugcuccagacc

SEQ ID NO: 1336163 - RNA, 17 nt, Homo sapiens
gggccuuugggugcugu

SEQ ID NO: 1336164 - RNA, 17 nt, Homo sapiens
gggcgaccccgucacag

SEQ ID NO: 1336165 - RNA, 20 nt, Homo sapiens
gggcuggagcagucugagga

SEQ ID NO: 1336166 - RNA, 17 nt, Homo sapiens
ggggacucagggaccgg

SEQ ID NO: 1336167 - RNA, 20 nt, Homo sapiens
ggggagaaaaaaaaagcaaa

SEQ ID NO: 1336168 - RNA, 17 nt, Homo sapiens
ggggagacuucuuggcu

SEQ ID NO: 1336169 - RNA, 19 nt, Homo sapiens
ggggaugacaugcacucag

SEQ ID NO: 1336170 - RNA, 19 nt, Homo sapiens
ggggcagcgcaugugugca

SEQ ID NO: 1336171 - RNA, 15 nt, Homo sapiens
ggggccagauccagc

SEQ ID NO: 1336172 - RNA, 13 nt, Homo sapiens
ggggcucucucau

SEQ ID NO: 1336173 - RNA, 14 nt, Homo sapiens
ggggcuuuugccac

SEQ ID NO: 1336174 - RNA, 23 nt, Homo sapiens
gggggaagacuuuaaaccaccua

SEQ ID NO: 1336175 - RNA, 14 nt, Homo sapiens
gggggcugugccaa

SEQ ID NO: 1336176 - RNA, 19 nt, Homo sapiens
ggggucuccucugcagcuc

SEQ ID NO: 1336177 - RNA, 16 nt, Homo sapiens
gggucccagagaccuc

SEQ ID NO: 1336178 - RNA, 14 nt, Homo sapiens
gggugaaucugucu

SEQ ID NO: 1336179 - RNA, 18 nt, Homo sapiens
gggugaucugcugcugag

SEQ ID NO: 1336180 - RNA, 14 nt, Homo sapiens
ggguggggccauaa

SEQ ID NO: 1336181 - RNA, 12 nt, Homo sapiens
ggguguggcaaa

SEQ ID NO: 1336182 - RNA, 15 nt, Homo sapiens
ggguguggcaaagga

SEQ ID NO: 1336183 - RNA, 22 nt, Homo sapiens
ggguugcacuggccacccaagg

SEQ ID NO: 1336184 - RNA, 23 nt, Homo sapiens
ggguuggcaccuucccccucccc

SEQ ID NO: 1336185 - RNA, 19 nt, Homo sapiens
gguaagagaaaaccuagua

SEQ ID NO: 1336186 - RNA, 20 nt, Homo sapiens
gguaauaaaugugacucagc

SEQ ID NO: 1336187 - RNA, 20 nt, Homo sapiens
gguaauguuaguaaauccau

SEQ ID NO: 1336188 - RNA, 21 nt, Homo sapiens
gguaccugcccucuauuuauu

SEQ ID NO: 1336189 - RNA, 23 nt, Homo sapiens
gguaguuuguuuuagaaccagcc

SEQ ID NO: 1336190 - RNA, 22 nt, Homo sapiens
gguauaugcacaaaacuacuuu

SEQ ID NO: 1336191 - RNA, 12 nt, Homo sapiens
gguaugauuaac

SEQ ID NO: 1336192 - RNA, 22 nt, Homo sapiens
gguaugucauucgcuacuauga

SEQ ID NO: 1336193 - RNA, 22 nt, Homo sapiens
gguauuuguucaaaauaaugaa

SEQ ID NO: 1336194 - RNA, 15 nt, Homo sapiens
gguccacagcuggaa

SEQ ID NO: 1336195 - RNA, 18 nt, Homo sapiens
gguccagggagggguccc

SEQ ID NO: 1336196 - RNA, 20 nt, Homo sapiens
gguccucaguccacugcuga

SEQ ID NO: 1336197 - RNA, 13 nt, Homo sapiens
gguccucucugag

SEQ ID NO: 1336198 - RNA, 17 nt, Homo sapiens
gguccucucugagucaa

SEQ ID NO: 1336199 - RNA, 14 nt, Homo sapiens
gguccugaagugac

SEQ ID NO: 1336200 - RNA, 21 nt, Homo sapiens
gguccuucccucucaugacuu

SEQ ID NO: 1336201 - RNA, 16 nt, Homo sapiens
ggucguuuuccaaaga

SEQ ID NO: 1336202 - RNA, 15 nt, Homo sapiens
ggucucucagggaug

SEQ ID NO: 1336203 - RNA, 13 nt, Homo sapiens
ggucugggccagu

SEQ ID NO: 1336204 - RNA, 19 nt, Homo sapiens
ggucuguguucgacucagc

SEQ ID NO: 1336205 - RNA, 16 nt, Homo sapiens
ggucuuuugguuauga

SEQ ID NO: 1336206 - RNA, 13 nt, Homo sapiens
ggugaaguaaauu

SEQ ID NO: 1336207 - RNA, 16 nt, Homo sapiens
ggugacagcuccggga

SEQ ID NO: 1336208 - RNA, 20 nt, Homo sapiens
ggugacaguccaaaccacuc

SEQ ID NO: 1336209 - RNA, 17 nt, Homo sapiens
ggugcaaucacagcuca

SEQ ID NO: 1336210 - RNA, 15 nt, Homo sapiens
ggugccgcucucucu

SEQ ID NO: 1336211 - RNA, 15 nt, Homo sapiens
gguggaacaagcaca

SEQ ID NO: 1336212 - RNA, 22 nt, Homo sapiens
gguggauauuaaaaaucuguaa

SEQ ID NO: 1336213 - RNA, 16 nt, Homo sapiens
gguggcggcugcacaa

SEQ ID NO: 1336214 - RNA, 15 nt, Homo sapiens
ggugggauuccacuc

SEQ ID NO: 1336215 - RNA, 20 nt, Homo sapiens
ggugggauuccacucgugug

SEQ ID NO: 1336216 - RNA, 23 nt, Homo sapiens
ggugggggugccgcugucucuga

SEQ ID NO: 1336217 - RNA, 13 nt, Homo sapiens
ggugguaccugag

SEQ ID NO: 1336218 - RNA, 22 nt, Homo sapiens
gguggucaguaguuucauuucc

SEQ ID NO: 1336219 - RNA, 20 nt, Homo sapiens
ggugucaucuuggccaucua

SEQ ID NO: 1336220 - RNA, 18 nt, Homo sapiens
gguguuauuuucugagag

SEQ ID NO: 1336221 - RNA, 20 nt, Homo sapiens
gguguuauuuucugagagac

SEQ ID NO: 1336222 - RNA, 21 nt, Homo sapiens
gguuacauaucaaaacauccc

SEQ ID NO: 1336223 - RNA, 17 nt, Homo sapiens
gguuauagcuucaggag

SEQ ID NO: 1336224 - RNA, 18 nt, Homo sapiens
gguucacucauucucaga

SEQ ID NO: 1336225 - RNA, 21 nt, Homo sapiens
gguucccaaaucccucucaca

SEQ ID NO: 1336226 - RNA, 22 nt, Homo sapiens
gguugaaugagcgucagcaucc

SEQ ID NO: 1336227 - RNA, 18 nt, Homo sapiens
gguugcagugaaccuaga

SEQ ID NO: 1336228 - RNA, 17 nt, Homo sapiens
gguuuaauucagcagag

SEQ ID NO: 1336229 - RNA, 20 nt, Homo sapiens
gguuuacauccuucacugcu

SEQ ID NO: 1336230 - RNA, 21 nt, Homo sapiens
gguuucacaugguuacauauc

SEQ ID NO: 1336231 - RNA, 19 nt, Homo sapiens
gguuucauguuaguuaccu

SEQ ID NO: 1336232 - RNA, 13 nt, Homo sapiens
gguuuuccgccca

SEQ ID NO: 1336233 - RNA, 20 nt, Homo sapiens
gguuuuuuucuuuggcugca

SEQ ID NO: 1336234 - RNA, 14 nt, Homo sapiens
guaaaaagugcagu

SEQ ID NO: 1336235 - RNA, 21 nt, Homo sapiens
guaaaaccccaucucuacuaa

SEQ ID NO: 1336236 - RNA, 17 nt, Homo sapiens
guaaaaugcuaguauaa

SEQ ID NO: 1336237 - RNA, 15 nt, Homo sapiens
guaaaggauuguuaa

SEQ ID NO: 1336238 - RNA, 12 nt, Homo sapiens
guaaaggcagua

SEQ ID NO: 1336239 - RNA, 16 nt, Homo sapiens
guaaauccaugguguu

SEQ ID NO: 1336240 - RNA, 14 nt, Homo sapiens
guaaaucuauauga

SEQ ID NO: 1336241 - RNA, 15 nt, Homo sapiens
guaaauguccauuua

SEQ ID NO: 1336242 - RNA, 22 nt, Homo sapiens
guaacagauuuuguuggcauag

SEQ ID NO: 1336243 - RNA, 23 nt, Homo sapiens
guaacuguaaagaugaaugucag

SEQ ID NO: 1336244 - RNA, 23 nt, Homo sapiens
guaacugugcuguacugagcacu

SEQ ID NO: 1336245 - RNA, 23 nt, Homo sapiens
guaacuguuuagaugaaugucag

SEQ ID NO: 1336246 - RNA, 15 nt, Homo sapiens
guaagaaaacaaaca

SEQ ID NO: 1336247 - RNA, 22 nt, Homo sapiens
guaagaucguucucugccucac

SEQ ID NO: 1336248 - RNA, 17 nt, Homo sapiens
gacauucuuagcuguaa

SEQ ID NO: 1336249 - RNA, 22 nt, Homo sapiens
gaccacucugucuuguguuucc

SEQ ID NO: 1336250 - RNA, 16 nt, Homo sapiens
gaccagagggacacua

SEQ ID NO: 1336251 - RNA, 20 nt, Homo sapiens
gaccagagggacacuaggaa

SEQ ID NO: 1336252 - RNA, 20 nt, Homo sapiens
gaccauaagagaaaccugcc

SEQ ID NO: 1336253 - RNA, 18 nt, Homo sapiens
gaccaucugcugcaguua

SEQ ID NO: 1336254 - RNA, 13 nt, Homo sapiens
gacccaagcugcc

SEQ ID NO: 1336255 - RNA, 21 nt, Homo sapiens
gacccacagaacuuguggccu

SEQ ID NO: 1336256 - RNA, 18 nt, Homo sapiens
gaccccaaaggagucaga

SEQ ID NO: 1336257 - RNA, 23 nt, Homo sapiens
gaccccgucacagccucaaguca

SEQ ID NO: 1336258 - RNA, 16 nt, Homo sapiens
gacccuagccagagaa

SEQ ID NO: 1336259 - RNA, 19 nt, Homo sapiens
gacccugacuguauacaga

SEQ ID NO: 1336260 - RNA, 15 nt, Homo sapiens
gacccugcaagacca

SEQ ID NO: 1336261 - RNA, 15 nt, Homo sapiens
gacccuguccugcag

SEQ ID NO: 1336262 - RNA, 21 nt, Homo sapiens
gacccuguccugcagucccac

SEQ ID NO: 1336263 - RNA, 13 nt, Homo sapiens
gaccucaucagcc

SEQ ID NO: 1336264 - RNA, 15 nt, Homo sapiens
gaccucuacauugaa

SEQ ID NO: 1336265 - RNA, 19 nt, Homo sapiens
gaccucucauaaauuuacu

SEQ ID NO: 1336266 - RNA, 20 nt, Homo sapiens
gaccucucauaaauuuacuu

SEQ ID NO: 1336267 - RNA, 14 nt, Homo sapiens
gaccugacaccuuu

SEQ ID NO: 1336268 - RNA, 14 nt, Homo sapiens
gaccugagaaccuu

SEQ ID NO: 1336269 - RNA, 20 nt, Homo sapiens
gaccugagagcaucucagga

SEQ ID NO: 1336270 - RNA, 14 nt, Homo sapiens
gaccugauccugga

SEQ ID NO: 1336271 - RNA, 19 nt, Homo sapiens
gaccuggagcaauaaaaga

SEQ ID NO: 1336272 - RNA, 16 nt, Homo sapiens
gaccuggcagcucugg

SEQ ID NO: 1336273 - RNA, 12 nt, Homo sapiens
gaccuguguucc

SEQ ID NO: 1336274 - RNA, 14 nt, Homo sapiens
gaccuguugggagu

SEQ ID NO: 1336275 - RNA, 17 nt, Homo sapiens
gaccuugugaucugccc

SEQ ID NO: 1336276 - RNA, 13 nt, Homo sapiens
gaccuuuauuuau

SEQ ID NO: 1336277 - RNA, 21 nt, Homo sapiens
gacgguaacuuggcugcauuu

SEQ ID NO: 1336278 - RNA, 15 nt, Homo sapiens
gacguggguugcacu

SEQ ID NO: 1336279 - RNA, 22 nt, Homo sapiens
gacuacacugaaucauuaacag

SEQ ID NO: 1336280 - RNA, 18 nt, Homo sapiens
gacuaccucugugccuug

SEQ ID NO: 1336281 - RNA, 18 nt, Homo sapiens
gacuagacauaguaccga

SEQ ID NO: 1336282 - RNA, 16 nt, Homo sapiens
gacuaggaaauuccaa

SEQ ID NO: 1336283 - RNA, 14 nt, Homo sapiens
gacuaucaguuccc

SEQ ID NO: 1336284 - RNA, 18 nt, Homo sapiens
gacucacugggaagcucc

SEQ ID NO: 1336285 - RNA, 13 nt, Homo sapiens
gacucagccucag

SEQ ID NO: 1336286 - RNA, 15 nt, Homo sapiens
gacucaggacauccc

SEQ ID NO: 1336287 - RNA, 18 nt, Homo sapiens
gacucauggccgggcuga

SEQ ID NO: 1336288 - RNA, 15 nt, Homo sapiens
gacuccaagagggaa

SEQ ID NO: 1336289 - RNA, 20 nt, Homo sapiens
gacuccauuucuuucuucca

SEQ ID NO: 1336290 - RNA, 13 nt, Homo sapiens
gacucgggaccaa

SEQ ID NO: 1336291 - RNA, 20 nt, Homo sapiens
gacucuaaagucuguugauu

SEQ ID NO: 1336292 - RNA, 14 nt, Homo sapiens
gacugaaacuggaa

SEQ ID NO: 1336293 - RNA, 14 nt, Homo sapiens
gacugaacuguaau

SEQ ID NO: 1336294 - RNA, 17 nt, Homo sapiens
gacugacccccaucuga

SEQ ID NO: 1336295 - RNA, 17 nt, Homo sapiens
gacuggcacacuggccu

SEQ ID NO: 1336296 - RNA, 21 nt, Homo sapiens
gacugggugagacccaaagcg

SEQ ID NO: 1336297 - RNA, 14 nt, Homo sapiens
gacugucaguucuc

SEQ ID NO: 1336298 - RNA, 21 nt, Homo sapiens
gacugucaguucucugggaag

SEQ ID NO: 1336299 - RNA, 23 nt, Homo sapiens
gacuguggacguggguugcacug

SEQ ID NO: 1336300 - RNA, 22 nt, Homo sapiens
gacuuaaaauauuccugcauuu

SEQ ID NO: 1336301 - RNA, 21 nt, Homo sapiens
gacuuauggcaugacucuuca

SEQ ID NO: 1336302 - RNA, 20 nt, Homo sapiens
gacuucaugacaagcauuuu

SEQ ID NO: 1336303 - RNA, 15 nt, Homo sapiens
gacuucuugaaauca

SEQ ID NO: 1336304 - RNA, 18 nt, Homo sapiens
gacuugaauagacacuuc

SEQ ID NO: 1336305 - RNA, 14 nt, Homo sapiens
gacuuguggggcag

SEQ ID NO: 1336306 - RNA, 16 nt, Homo sapiens
gacuuguucuugauag

SEQ ID NO: 1336307 - RNA, 20 nt, Homo sapiens
gacuuugauacuaccagggu

SEQ ID NO: 1336308 - RNA, 19 nt, Homo sapiens
gacuuugccaaaaagcaua

SEQ ID NO: 1336309 - RNA, 19 nt, Homo sapiens
gacuuuguguucauuucau

SEQ ID NO: 1336310 - RNA, 15 nt, Homo sapiens
gacuuuuaaugucau

SEQ ID NO: 1336311 - RNA, 17 nt, Homo sapiens
gacuuuuuccuugggcu

SEQ ID NO: 1336312 - RNA, 21 nt, Homo sapiens
gagaaaaccuuaaaaguaaua

SEQ ID NO: 1336313 - RNA, 14 nt, Homo sapiens
gagaaaccugccaa

SEQ ID NO: 1336314 - RNA, 20 nt, Homo sapiens
gagaaagcaaaggugcacuc

SEQ ID NO: 1336315 - RNA, 12 nt, Homo sapiens
gagaaccuucca

SEQ ID NO: 1336316 - RNA, 12 nt, Homo sapiens
gagaacugccuu

SEQ ID NO: 1336317 - RNA, 17 nt, Homo sapiens
gagaacuugaaacagau

SEQ ID NO: 1336318 - RNA, 19 nt, Homo sapiens
gagaagauucuuguauuua

SEQ ID NO: 1336319 - RNA, 20 nt, Homo sapiens
gagaagccagcuuuccucau

SEQ ID NO: 1336320 - RNA, 16 nt, Homo sapiens
gagaauuaucucaagu

SEQ ID NO: 1336321 - RNA, 16 nt, Homo sapiens
gagaauucaugucugc

SEQ ID NO: 1336322 - RNA, 15 nt, Homo sapiens
gagacaaggugcuaa

SEQ ID NO: 1336323 - RNA, 17 nt, Homo sapiens
gagacaccaguggugcg

SEQ ID NO: 1336324 - RNA, 22 nt, Homo sapiens
gagacacccucuggggguccuc

SEQ ID NO: 1336325 - RNA, 16 nt, Homo sapiens
gagacagaccacuugc

SEQ ID NO: 1336326 - RNA, 14 nt, Homo sapiens
gagacauacuugaa

SEQ ID NO: 1336327 - RNA, 22 nt, Homo sapiens
gagacauacuugaagggccaga

SEQ ID NO: 1336328 - RNA, 15 nt, Homo sapiens
gagacaugugacauu

SEQ ID NO: 1336329 - RNA, 16 nt, Homo sapiens
gagacugggcaucucu

SEQ ID NO: 1336330 - RNA, 21 nt, Homo sapiens
gagacugucucaagagggcac

SEQ ID NO: 1336331 - RNA, 15 nt, Homo sapiens
gagaggaggggacca

SEQ ID NO: 1336332 - RNA, 18 nt, Homo sapiens
gagaggccuuuuggaaug

SEQ ID NO: 1336333 - RNA, 18 nt, Homo sapiens
gagagggcugcugaccau

SEQ ID NO: 1336334 - RNA, 14 nt, Homo sapiens
gagaggugauucuc

SEQ ID NO: 1336335 - RNA, 18 nt, Homo sapiens
gagaguccugguccucag

SEQ ID NO: 1336336 - RNA, 21 nt, Homo sapiens
gagauaagguggcuucucacg

SEQ ID NO: 1336337 - RNA, 17 nt, Homo sapiens
gagaucuuucuuuccaa

SEQ ID NO: 1336338 - RNA, 19 nt, Homo sapiens
gagaugcugcaguuccaaa

SEQ ID NO: 1336339 - RNA, 15 nt, Homo sapiens
gagauggccaugcuc

SEQ ID NO: 1336340 - RNA, 11 nt, Homo sapiens
gagauguaucc

SEQ ID NO: 1336341 - RNA, 18 nt, Homo sapiens
gagauuacuuugcugccu

SEQ ID NO: 1336342 - RNA, 15 nt, Homo sapiens
gagauuauucuuugu

SEQ ID NO: 1336343 - RNA, 13 nt, Homo sapiens
gagauuuaccugu

SEQ ID NO: 1336344 - RNA, 14 nt, Homo sapiens
gagauuuaccuguu

SEQ ID NO: 1336345 - RNA, 20 nt, Homo sapiens
gagcaccacacccaguggga

SEQ ID NO: 1336346 - RNA, 16 nt, Homo sapiens
gagcacccauuccaaa

SEQ ID NO: 1336347 - RNA, 16 nt, Homo sapiens
gagcaccgccugugaa

SEQ ID NO: 1336348 - RNA, 21 nt, Homo sapiens
gagcacggacugucaguucuc

SEQ ID NO: 1336349 - RNA, 13 nt, Homo sapiens
gagcacugaacca

SEQ ID NO: 1336350 - RNA, 14 nt, Homo sapiens
gagcagcagcacca

SEQ ID NO: 1336351 - RNA, 16 nt, Homo sapiens
gagcaggcuacuguca

SEQ ID NO: 1336352 - RNA, 15 nt, Homo sapiens
gagcaguaucagcau

SEQ ID NO: 1336353 - RNA, 15 nt, Homo sapiens
gagcauccuuggcag

SEQ ID NO: 1336354 - RNA, 24 nt, Homo sapiens
gagcaucuugcauccaaaccugua

SEQ ID NO: 1336355 - RNA, 12 nt, Homo sapiens
gagccaagggau

SEQ ID NO: 1336356 - RNA, 23 nt, Homo sapiens
gagccaagggguagaaguggcau

SEQ ID NO: 1336357 - RNA, 15 nt, Homo sapiens
gagccaccaguucuc

SEQ ID NO: 1336358 - RNA, 14 nt, Homo sapiens
gagccccugacccc

SEQ ID NO: 1336359 - RNA, 19 nt, Homo sapiens
gagccccuuucaggaggag

SEQ ID NO: 1336360 - RNA, 19 nt, Homo sapiens
gagccgccugcuucuucuc

SEQ ID NO: 1336361 - RNA, 22 nt, Homo sapiens
gagccuacuccaagaauggagg

SEQ ID NO: 1336362 - RNA, 12 nt, Homo sapiens
gagccuggccag

SEQ ID NO: 1336363 - RNA, 20 nt, Homo sapiens
gagccuggccaggcagggag

SEQ ID NO: 1336364 - RNA, 23 nt, Homo sapiens
gagccugggguguccuacaguga

SEQ ID NO: 1336365 - RNA, 13 nt, Homo sapiens
gagccugguccca

SEQ ID NO: 1336366 - RNA, 20 nt, Homo sapiens
gagccugguucagacacagc

SEQ ID NO: 1336367 - RNA, 18 nt, Homo sapiens
gagccuuagaggucuuua

SEQ ID NO: 1336368 - RNA, 14 nt, Homo sapiens
gagcuagaacauuc

SEQ ID NO: 1336369 - RNA, 16 nt, Homo sapiens
gagcuagaacauucca

SEQ ID NO: 1336370 - RNA, 18 nt, Homo sapiens
gagcuaggaacccuggag

SEQ ID NO: 1336371 - RNA, 21 nt, Homo sapiens
gagcucaggucccaggccagc

SEQ ID NO: 1336372 - RNA, 16 nt, Homo sapiens
gagcuggcaaccagcc

SEQ ID NO: 1336373 - RNA, 17 nt, Homo sapiens
gagcuggccuccuaugc

SEQ ID NO: 1336374 - RNA, 16 nt, Homo sapiens
gagcuguuaugcuguu

SEQ ID NO: 1336375 - RNA, 14 nt, Homo sapiens
gagcuuaaacagcu

SEQ ID NO: 1336376 - RNA, 21 nt, Homo sapiens
gagcuuccccaagcacggugu

SEQ ID NO: 1336377 - RNA, 20 nt, Homo sapiens
gagcuuguaauaaauacugc

SEQ ID NO: 1336378 - RNA, 16 nt, Homo sapiens
gaggaaaaacugacag

SEQ ID NO: 1336379 - RNA, 13 nt, Homo sapiens
gaggaaacuuuga

SEQ ID NO: 1336380 - RNA, 14 nt, Homo sapiens
gaggaaacuuugau

SEQ ID NO: 1336381 - RNA, 17 nt, Homo sapiens
gaggaagacaggcaaau

SEQ ID NO: 1336382 - RNA, 19 nt, Homo sapiens
gaggacauaaugggguccu

SEQ ID NO: 1336383 - RNA, 21 nt, Homo sapiens
cuugcuuccccuuuugccaau

SEQ ID NO: 1336384 - RNA, 17 nt, Homo sapiens
cuugcuuucuucuuucc

SEQ ID NO: 1336385 - RNA, 11 nt, Homo sapiens
cuuggaaccac

SEQ ID NO: 1336386 - RNA, 13 nt, Homo sapiens
cuuggaagccagg

SEQ ID NO: 1336387 - RNA, 14 nt, Homo sapiens
cuuggagcuaaaac

SEQ ID NO: 1336388 - RNA, 18 nt, Homo sapiens
cuuggagcuaaaacuggc

SEQ ID NO: 1336389 - RNA, 14 nt, Homo sapiens
cuuggagggcucag

SEQ ID NO: 1336390 - RNA, 20 nt, Homo sapiens
cuuggagggcucagggcagu

SEQ ID NO: 1336391 - RNA, 18 nt, Homo sapiens
cuuggcacccccaugcug

SEQ ID NO: 1336392 - RNA, 15 nt, Homo sapiens
cuuggcagugggaau

SEQ ID NO: 1336393 - RNA, 19 nt, Homo sapiens
cuuggccaucuaaacauca

SEQ ID NO: 1336394 - RNA, 22 nt, Homo sapiens
cuuggccaucuaaacaucauca

SEQ ID NO: 1336395 - RNA, 23 nt, Homo sapiens
cuuggcccaggauuauugucaaa

SEQ ID NO: 1336396 - RNA, 18 nt, Homo sapiens
cuuggcuucgugaaugua

SEQ ID NO: 1336397 - RNA, 12 nt, Homo sapiens
cuuggcuuuaug

SEQ ID NO: 1336398 - RNA, 20 nt, Homo sapiens
cuuggcuuuaugcaaauaca

SEQ ID NO: 1336399 - RNA, 17 nt, Homo sapiens
cuugggagcaccgccug

SEQ ID NO: 1336400 - RNA, 14 nt, Homo sapiens
cuuguaaaugugac

SEQ ID NO: 1336401 - RNA, 19 nt, Homo sapiens
cuuguauuaucuccuuuga

SEQ ID NO: 1336402 - RNA, 23 nt, Homo sapiens
cuugucaccaguuaaaagcauuu

SEQ ID NO: 1336403 - RNA, 17 nt, Homo sapiens
cuugucaugugacaggu

SEQ ID NO: 1336404 - RNA, 14 nt, Homo sapiens
cuugucugugcauc

SEQ ID NO: 1336405 - RNA, 17 nt, Homo sapiens
cuugucuuaaggucaua

SEQ ID NO: 1336406 - RNA, 24 nt, Homo sapiens
cuugugaagauuggggacacucau

SEQ ID NO: 1336407 - RNA, 22 nt, Homo sapiens
cuuguggggcaggauucucugc

SEQ ID NO: 1336408 - RNA, 17 nt, Homo sapiens
cuuguguugcacugaac

SEQ ID NO: 1336409 - RNA, 15 nt, Homo sapiens
cuuguuuuuuacuca

SEQ ID NO: 1336410 - RNA, 21 nt, Homo sapiens
cuuuaaaacugcucauuucau

SEQ ID NO: 1336411 - RNA, 20 nt, Homo sapiens
cuuuaaagggauggcaagau

SEQ ID NO: 1336412 - RNA, 13 nt, Homo sapiens
cuuuaagugugcu

SEQ ID NO: 1336413 - RNA, 12 nt, Homo sapiens
cuuuacuccugg

SEQ ID NO: 1336414 - RNA, 19 nt, Homo sapiens
cuuuagagaaguauacaua

SEQ ID NO: 1336415 - RNA, 16 nt, Homo sapiens
cuuuagcaaaacugga

SEQ ID NO: 1336416 - RNA, 21 nt, Homo sapiens
cuuuagcaguuuccucaguga

SEQ ID NO: 1336417 - RNA, 13 nt, Homo sapiens
cuuuauagcacau

SEQ ID NO: 1336418 - RNA, 17 nt, Homo sapiens
cuuuaugcaaauacaau

SEQ ID NO: 1336419 - RNA, 20 nt, Homo sapiens
cuuuaugcaaauacaaucag

SEQ ID NO: 1336420 - RNA, 20 nt, Homo sapiens
cuuucaaacccagaggguug

SEQ ID NO: 1336421 - RNA, 18 nt, Homo sapiens
cuuucagaaucuuuucaa

SEQ ID NO: 1336422 - RNA, 23 nt, Homo sapiens
cuuucagaaucuuuucaaugggu

SEQ ID NO: 1336423 - RNA, 23 nt, Homo sapiens
cuuucaggaggaggaggggagug

SEQ ID NO: 1336424 - RNA, 18 nt, Homo sapiens
cuuucauuugcuuuggaa

SEQ ID NO: 1336425 - RNA, 15 nt, Homo sapiens
cuuucccagucccau

SEQ ID NO: 1336426 - RNA, 16 nt, Homo sapiens
cuuuccccccauguug

SEQ ID NO: 1336427 - RNA, 16 nt, Homo sapiens
cuuuccccucccucag

SEQ ID NO: 1336428 - RNA, 14 nt, Homo sapiens
cuuucccucaucca

SEQ ID NO: 1336429 - RNA, 18 nt, Homo sapiens
cuuucccucauccaugcu

SEQ ID NO: 1336430 - RNA, 14 nt, Homo sapiens
cuuucucucaguga

SEQ ID NO: 1336431 - RNA, 13 nt, Homo sapiens
cuuucucugaggg

SEQ ID NO: 1336432 - RNA, 22 nt, Homo sapiens
cuuucuuacauuagcaguuugc

SEQ ID NO: 1336433 - RNA, 19 nt, Homo sapiens
cuuucuuauuuuguaauaa

SEQ ID NO: 1336434 - RNA, 14 nt, Homo sapiens
cuuucuucugaaua

SEQ ID NO: 1336435 - RNA, 17 nt, Homo sapiens
cuuugaauaaaugucac

SEQ ID NO: 1336436 - RNA, 20 nt, Homo sapiens
cuuugaauagcagguaguua

SEQ ID NO: 1336437 - RNA, 16 nt, Homo sapiens
cuuugcauauuauaaa

SEQ ID NO: 1336438 - RNA, 19 nt, Homo sapiens
cuuugccucuucuuugugc

SEQ ID NO: 1336439 - RNA, 15 nt, Homo sapiens
cuuugccuuuaucuc

SEQ ID NO: 1336440 - RNA, 12 nt, Homo sapiens
cuuugcugccag

SEQ ID NO: 1336441 - RNA, 21 nt, Homo sapiens
cuuugcugucaaaacuacuga

SEQ ID NO: 1336442 - RNA, 17 nt, Homo sapiens
cuuuggcugcagguguu

SEQ ID NO: 1336443 - RNA, 21 nt, Homo sapiens
cuuugggugcuguuuugccag

SEQ ID NO: 1336444 - RNA, 11 nt, Homo sapiens
cuuuggugggg

SEQ ID NO: 1336445 - RNA, 14 nt, Homo sapiens
cuuuguaggugucu

SEQ ID NO: 1336446 - RNA, 21 nt, Homo sapiens
cuuuguauauaggcuucucac

SEQ ID NO: 1336447 - RNA, 15 nt, Homo sapiens
cuuuguaugcacuuu

SEQ ID NO: 1336448 - RNA, 18 nt, Homo sapiens
cuuuguauuguauauuac

SEQ ID NO: 1336449 - RNA, 11 nt, Homo sapiens
cuuugugacca

SEQ ID NO: 1336450 - RNA, 15 nt, Homo sapiens
cuuugugacuucaag

SEQ ID NO: 1336451 - RNA, 18 nt, Homo sapiens
cuuuguggucgacaucaa

SEQ ID NO: 1336452 - RNA, 15 nt, Homo sapiens
cuuuguucugugauu

SEQ ID NO: 1336453 - RNA, 21 nt, Homo sapiens
cuuuguuuagccugaaaaccu

SEQ ID NO: 1336454 - RNA, 15 nt, Homo sapiens
cuuuuaaacuggaaa

SEQ ID NO: 1336455 - RNA, 15 nt, Homo sapiens
cuuuuaaaugcauaa

SEQ ID NO: 1336456 - RNA, 16 nt, Homo sapiens
cuuuuaaaugcauaaa

SEQ ID NO: 1336457 - RNA, 17 nt, Homo sapiens
cuguccccacacugacc

SEQ ID NO: 1336458 - RNA, 15 nt, Homo sapiens
cuguccucagccuug

SEQ ID NO: 1336459 - RNA, 19 nt, Homo sapiens
cuguccucagccuugccag

SEQ ID NO: 1336460 - RNA, 20 nt, Homo sapiens
cuguccucagccuugccaga

SEQ ID NO: 1336461 - RNA, 13 nt, Homo sapiens
cugucuccuuuga

SEQ ID NO: 1336462 - RNA, 14 nt, Homo sapiens
cugucucugagggg

SEQ ID NO: 1336463 - RNA, 19 nt, Homo sapiens
cugucucuuucaugaguuu

SEQ ID NO: 1336464 - RNA, 21 nt, Homo sapiens
cugucugggcucagacaucca

SEQ ID NO: 1336465 - RNA, 23 nt, Homo sapiens
cugucuucuuucuccauggagcc

SEQ ID NO: 1336466 - RNA, 18 nt, Homo sapiens
cugucuuuucuuugccau

SEQ ID NO: 1336467 - RNA, 22 nt, Homo sapiens
cugugaauugccuguaacacau

SEQ ID NO: 1336468 - RNA, 22 nt, Homo sapiens
cugugacauacauauuaucuca

SEQ ID NO: 1336469 - RNA, 13 nt, Homo sapiens
cugugagcacaaa

SEQ ID NO: 1336470 - RNA, 16 nt, Homo sapiens
cugugagcauggggcc

SEQ ID NO: 1336471 - RNA, 12 nt, Homo sapiens
cugugaugacau

SEQ ID NO: 1336472 - RNA, 14 nt, Homo sapiens
cugugcacuuaccc

SEQ ID NO: 1336473 - RNA, 20 nt, Homo sapiens
cugugccuuggugugcugua

SEQ ID NO: 1336474 - RNA, 17 nt, Homo sapiens
cugugcuguacugagca

SEQ ID NO: 1336475 - RNA, 14 nt, Homo sapiens
cuguggaacauaaa

SEQ ID NO: 1336476 - RNA, 21 nt, Homo sapiens
cuguggacguggguugcacug

SEQ ID NO: 1336477 - RNA, 17 nt, Homo sapiens
cuguggagugaggugua

SEQ ID NO: 1336478 - RNA, 15 nt, Homo sapiens
cuguggcagaguuac

SEQ ID NO: 1336479 - RNA, 17 nt, Homo sapiens
cuguggccaacugcaaa

SEQ ID NO: 1336480 - RNA, 21 nt, Homo sapiens
cuguggguuugguccuugaac

SEQ ID NO: 1336481 - RNA, 17 nt, Homo sapiens
cuguggucacccaugca

SEQ ID NO: 1336482 - RNA, 13 nt, Homo sapiens
cuguguccuccac

SEQ ID NO: 1336483 - RNA, 21 nt, Homo sapiens
cugugucggauacacacucga

SEQ ID NO: 1336484 - RNA, 21 nt, Homo sapiens
cuguguucgacucagccucag

SEQ ID NO: 1336485 - RNA, 19 nt, Homo sapiens
cuguguuuaacugcugcag

SEQ ID NO: 1336486 - RNA, 15 nt, Homo sapiens
cuguuaacuaugaca

SEQ ID NO: 1336487 - RNA, 22 nt, Homo sapiens
cuguuaacuaugacagauauau

SEQ ID NO: 1336488 - RNA, 14 nt, Homo sapiens
cuguuaaucugaug

SEQ ID NO: 1336489 - RNA, 18 nt, Homo sapiens
cuguuacacuuuuuggaa

SEQ ID NO: 1336490 - RNA, 16 nt, Homo sapiens
cuguuacuauuccuuu

SEQ ID NO: 1336491 - RNA, 17 nt, Homo sapiens
cuguuauaaaagcaaua

SEQ ID NO: 1336492 - RNA, 13 nt, Homo sapiens
cuguucaccuggg

SEQ ID NO: 1336493 - RNA, 17 nt, Homo sapiens
cuguuccagauuccuau

SEQ ID NO: 1336494 - RNA, 15 nt, Homo sapiens
cuguuccccagagaa

SEQ ID NO: 1336495 - RNA, 24 nt, Homo sapiens
cuguucuguagauucaugcaagug

SEQ ID NO: 1336496 - RNA, 17 nt, Homo sapiens
cuguugggacagccauu

SEQ ID NO: 1336497 - RNA, 19 nt, Homo sapiens
cuguuuagaugaaugucag

SEQ ID NO: 1336498 - RNA, 16 nt, Homo sapiens
cuguuucaauguauaa

SEQ ID NO: 1336499 - RNA, 20 nt, Homo sapiens
cuguuucccuuucacuggca

SEQ ID NO: 1336500 - RNA, 18 nt, Homo sapiens
cuguuugauacaguauua

SEQ ID NO: 1336501 - RNA, 20 nt, Homo sapiens
cuguuugcccccauucacuu

SEQ ID NO: 1336502 - RNA, 21 nt, Homo sapiens
cuguuuuauaaugaacccauc

SEQ ID NO: 1336503 - RNA, 19 nt, Homo sapiens
cuguuuuugucuacacucu

SEQ ID NO: 1336504 - RNA, 18 nt, Homo sapiens
cuuaaaaccugcuuuuca

SEQ ID NO: 1336505 - RNA, 22 nt, Homo sapiens
cuuaaaagacuagaauccacac

SEQ ID NO: 1336506 - RNA, 13 nt, Homo sapiens
cuuaaaaguauuc

SEQ ID NO: 1336507 - RNA, 14 nt, Homo sapiens
cuuaaacacacauu

SEQ ID NO: 1336508 - RNA, 18 nt, Homo sapiens
cuuaacaugggcucuuca

SEQ ID NO: 1336509 - RNA, 12 nt, Homo sapiens
cuuaaccaaaga

SEQ ID NO: 1336510 - RNA, 12 nt, Homo sapiens
cuuaacuaugag

SEQ ID NO: 1336511 - RNA, 14 nt, Homo sapiens
cuuaacuauuucac

SEQ ID NO: 1336512 - RNA, 19 nt, Homo sapiens
cuuaagccaaacucaggcc

SEQ ID NO: 1336513 - RNA, 22 nt, Homo sapiens
cuuaagucucagacugauuucu

SEQ ID NO: 1336514 - RNA, 21 nt, Homo sapiens
cuuacaacgccgagugcacug

SEQ ID NO: 1336515 - RNA, 22 nt, Homo sapiens
cuuacaagaaaggccugaaugg

SEQ ID NO: 1336516 - RNA, 14 nt, Homo sapiens
cuuacacauuccau

SEQ ID NO: 1336517 - RNA, 18 nt, Homo sapiens
cuuacaggccuugcucac

SEQ ID NO: 1336518 - RNA, 14 nt, Homo sapiens
cuuacauaucugac

SEQ ID NO: 1336519 - RNA, 23 nt, Homo sapiens
cuuacauguuuguuucuguagaa

SEQ ID NO: 1336520 - RNA, 15 nt, Homo sapiens
cuuacgaucucuuga

SEQ ID NO: 1336521 - RNA, 14 nt, Homo sapiens
cuuacuauuacaua

SEQ ID NO: 1336522 - RNA, 21 nt, Homo sapiens
cuuagagggaaucuagcccaa

SEQ ID NO: 1336523 - RNA, 15 nt, Homo sapiens
cuuagaguguagcug

SEQ ID NO: 1336524 - RNA, 15 nt, Homo sapiens
cuuaggccagcacca

SEQ ID NO: 1336525 - RNA, 13 nt, Homo sapiens
cuuauaccaugag

SEQ ID NO: 1336526 - RNA, 23 nt, Homo sapiens
cuuauaguguuuggacagcugau

SEQ ID NO: 1336527 - RNA, 19 nt, Homo sapiens
cuuaucaacauuuguucca

SEQ ID NO: 1336528 - RNA, 13 nt, Homo sapiens
cuuaugauacuug

SEQ ID NO: 1336529 - RNA, 23 nt, Homo sapiens
cuuaugguuuaggccuugccagu

SEQ ID NO: 1336530 - RNA, 11 nt, Homo sapiens
cuuauguuaca

SEQ ID NO: 1336531 - RNA, 23 nt, Homo sapiens
cuuauguuacagguuacgugaga

SEQ ID NO: 1336532 - RNA, 17 nt, Homo sapiens
cuuauuaaucauacaaa

SEQ ID NO: 1336533 - RNA, 18 nt, Homo sapiens
cuuauucaguucuuacac

SEQ ID NO: 1336534 - RNA, 16 nt, Homo sapiens
cuuauugacucauaca

SEQ ID NO: 1336535 - RNA, 14 nt, Homo sapiens
cugacaacugugaa

SEQ ID NO: 1336536 - RNA, 22 nt, Homo sapiens
cugacaauuugugauaucuaau

SEQ ID NO: 1336537 - RNA, 23 nt, Homo sapiens
cugacaguuaauaaaccuuugca

SEQ ID NO: 1336538 - RNA, 18 nt, Homo sapiens
cugacauucacacagaga

SEQ ID NO: 1336539 - RNA, 19 nt, Homo sapiens
cugaccagcagcgccuuuc

SEQ ID NO: 1336540 - RNA, 13 nt, Homo sapiens
cugaccucaggug

SEQ ID NO: 1336541 - RNA, 16 nt, Homo sapiens
cugaccuguguucccu

SEQ ID NO: 1336542 - RNA, 15 nt, Homo sapiens
cugaccuuaaaugca

SEQ ID NO: 1336543 - RNA, 21 nt, Homo sapiens
cugaccuugcugauggugaca

SEQ ID NO: 1336544 - RNA, 21 nt, Homo sapiens
cugacugaaggaaaagcaaga

SEQ ID NO: 1336545 - RNA, 16 nt, Homo sapiens
cugacuguacuccucc

SEQ ID NO: 1336546 - RNA, 14 nt, Homo sapiens
cugacuuggggaca

SEQ ID NO: 1336547 - RNA, 15 nt, Homo sapiens
cugacuuugccaaaa

SEQ ID NO: 1336548 - RNA, 15 nt, Homo sapiens
cugacuuuuaaccca

SEQ ID NO: 1336549 - RNA, 16 nt, Homo sapiens
cugacuuuuaauguca

SEQ ID NO: 1336550 - RNA, 19 nt, Homo sapiens
cugacuuuuaaugucauuu

SEQ ID NO: 1336551 - RNA, 17 nt, Homo sapiens
cugagaaaagccucucc

SEQ ID NO: 1336552 - RNA, 18 nt, Homo sapiens
cugagaaagacuauucaa

SEQ ID NO: 1336553 - RNA, 18 nt, Homo sapiens
cugagaagugcacuuuaa

SEQ ID NO: 1336554 - RNA, 16 nt, Homo sapiens
cugagcacugaaccac

SEQ ID NO: 1336555 - RNA, 22 nt, Homo sapiens
cugagcagguacauuucugauu

SEQ ID NO: 1336556 - RNA, 19 nt, Homo sapiens
cugagcagguguucuucau

SEQ ID NO: 1336557 - RNA, 22 nt, Homo sapiens
cugagcaguuguuauauucauu

SEQ ID NO: 1336558 - RNA, 20 nt, Homo sapiens
cugagcccccacugcuucua

SEQ ID NO: 1336559 - RNA, 19 nt, Homo sapiens
cugaggccagaaaggugug

SEQ ID NO: 1336560 - RNA, 18 nt, Homo sapiens
cugagggucgugggaaag

SEQ ID NO: 1336561 - RNA, 15 nt, Homo sapiens
cugagucaaauccag

SEQ ID NO: 1336562 - RNA, 17 nt, Homo sapiens
cugagucaaauccagug

SEQ ID NO: 1336563 - RNA, 18 nt, Homo sapiens
cugagucaaauccagugg

SEQ ID NO: 1336564 - RNA, 20 nt, Homo sapiens
cugagucaaauccaguggug

SEQ ID NO: 1336565 - RNA, 19 nt, Homo sapiens
cugagugagaagauaaaaa

SEQ ID NO: 1336566 - RNA, 19 nt, Homo sapiens
cugauaagcuaacaccaga

SEQ ID NO: 1336567 - RNA, 14 nt, Homo sapiens
cugauagacaccau

SEQ ID NO: 1336568 - RNA, 16 nt, Homo sapiens
cugauagacaccauag

SEQ ID NO: 1336569 - RNA, 18 nt, Homo sapiens
cugaucaagaacauguca

SEQ ID NO: 1336570 - RNA, 13 nt, Homo sapiens
cugaugacuuuau

SEQ ID NO: 1336571 - RNA, 21 nt, Homo sapiens
cugaugacuuuauccugaguc

SEQ ID NO: 1336572 - RNA, 18 nt, Homo sapiens
cugaugccuguguacugc

SEQ ID NO: 1336573 - RNA, 15 nt, Homo sapiens
cugaugcugccccuc

SEQ ID NO: 1336574 - RNA, 12 nt, Homo sapiens
cugauugggcac

SEQ ID NO: 1336575 - RNA, 18 nt, Homo sapiens
cugauugucaacacaaac

SEQ ID NO: 1336576 - RNA, 15 nt, Homo sapiens
cugcaaaaaaagccu

SEQ ID NO: 1336577 - RNA, 16 nt, Homo sapiens
cugcaaaaaaagccuc

SEQ ID NO: 1336578 - RNA, 17 nt, Homo sapiens
cugcaaaacuccaggca

SEQ ID NO: 1336579 - RNA, 14 nt, Homo sapiens
cugcaaaaggaggu

SEQ ID NO: 1336580 - RNA, 21 nt, Homo sapiens
cugcaaagggaaucucuugcc

SEQ ID NO: 1336581 - RNA, 17 nt, Homo sapiens
cugcaaguuaugaaaua

SEQ ID NO: 1336582 - RNA, 18 nt, Homo sapiens
cugcaaucccagcuacuu

SEQ ID NO: 1336583 - RNA, 22 nt, Homo sapiens
uggucaaacaaacucucugaac

SEQ ID NO: 1336584 - RNA, 13 nt, Homo sapiens
uggucacugucag

SEQ ID NO: 1336585 - RNA, 15 nt, Homo sapiens
uggucaggagccucu

SEQ ID NO: 1336586 - RNA, 23 nt, Homo sapiens
uggucaggauuccuguugccuuu

SEQ ID NO: 1336587 - RNA, 14 nt, Homo sapiens
ugguccccacugcu

SEQ ID NO: 1336588 - RNA, 19 nt, Homo sapiens
uggucuguggaucagcauu

SEQ ID NO: 1336589 - RNA, 20 nt, Homo sapiens
uggucuuguggaauugggag

SEQ ID NO: 1336590 - RNA, 20 nt, Homo sapiens
uggugaacugagcugggcag

SEQ ID NO: 1336591 - RNA, 14 nt, Homo sapiens
uggugacaguccaa

SEQ ID NO: 1336592 - RNA, 17 nt, Homo sapiens
uggugcacugagcugca

SEQ ID NO: 1336593 - RNA, 19 nt, Homo sapiens
uggugcagugugugaaaau

SEQ ID NO: 1336594 - RNA, 17 nt, Homo sapiens
ugguggcauuguuuaca

SEQ ID NO: 1336595 - RNA, 23 nt, Homo sapiens
ugguggggagcacagacacagga

SEQ ID NO: 1336596 - RNA, 16 nt, Homo sapiens
ugguguugacauacau

SEQ ID NO: 1336597 - RNA, 15 nt, Homo sapiens
ugguguuuuuacaga

SEQ ID NO: 1336598 - RNA, 19 nt, Homo sapiens
ugguuacauaucaaaacau

SEQ ID NO: 1336599 - RNA, 17 nt, Homo sapiens
ugguuacucacaccugu

SEQ ID NO: 1336600 - RNA, 16 nt, Homo sapiens
ugguucagacacagcu

SEQ ID NO: 1336601 - RNA, 17 nt, Homo sapiens
ugguucgugcugugcuc

SEQ ID NO: 1336602 - RNA, 21 nt, Homo sapiens
ugguuuauaauaaacucuuaa

SEQ ID NO: 1336603 - RNA, 22 nt, Homo sapiens
ugguuucacaugguuacauauc

SEQ ID NO: 1336604 - RNA, 13 nt, Homo sapiens
ugguuuugcuguu

SEQ ID NO: 1336605 - RNA, 12 nt, Homo sapiens
uguaaaaagccc

SEQ ID NO: 1336606 - RNA, 23 nt, Homo sapiens
uguaaagauguucuggauaccau

SEQ ID NO: 1336607 - RNA, 20 nt, Homo sapiens
uguaaaucuauaugauuuca

SEQ ID NO: 1336608 - RNA, 16 nt, Homo sapiens
uguaaaugaaacuuaa

SEQ ID NO: 1336609 - RNA, 21 nt, Homo sapiens
uguaacaagaaaguggucugu

SEQ ID NO: 1336610 - RNA, 22 nt, Homo sapiens
uguaaccuucuauuuucuauaa

SEQ ID NO: 1336611 - RNA, 15 nt, Homo sapiens
uguaacuguaaagau

SEQ ID NO: 1336612 - RNA, 17 nt, Homo sapiens
uguaagcauaacuuauu

SEQ ID NO: 1336613 - RNA, 17 nt, Homo sapiens
uguaauaaaacauguuc

SEQ ID NO: 1336614 - RNA, 18 nt, Homo sapiens
uguaauagccaaacccac

SEQ ID NO: 1336615 - RNA, 16 nt, Homo sapiens
uguaaucccagcacuu

SEQ ID NO: 1336616 - RNA, 12 nt, Homo sapiens
uguaaucucagc

SEQ ID NO: 1336617 - RNA, 18 nt, Homo sapiens
uguaauuuaaaauuguga

SEQ ID NO: 1336618 - RNA, 15 nt, Homo sapiens
uguacacagaauugu

SEQ ID NO: 1336619 - RNA, 16 nt, Homo sapiens
uguacauuuaauaaua

SEQ ID NO: 1336620 - RNA, 17 nt, Homo sapiens
uguaccuauggcaauuu

SEQ ID NO: 1336621 - RNA, 20 nt, Homo sapiens
uguacuauccaaucugugau

SEQ ID NO: 1336622 - RNA, 16 nt, Homo sapiens
uguacugagcacugaa

SEQ ID NO: 1336623 - RNA, 23 nt, Homo sapiens
uguagagauuuaccuguuuuuca

SEQ ID NO: 1336624 - RNA, 17 nt, Homo sapiens
uguagggggcaggggaa

SEQ ID NO: 1336625 - RNA, 16 nt, Homo sapiens
uguaguccgugcugac

SEQ ID NO: 1336626 - RNA, 19 nt, Homo sapiens
uguauaaaugugauaugau

SEQ ID NO: 1336627 - RNA, 22 nt, Homo sapiens
uguauaacuuggccgcuguaug

SEQ ID NO: 1336628 - RNA, 22 nt, Homo sapiens
uguauauuuuuaaagaauguua

SEQ ID NO: 1336629 - RNA, 17 nt, Homo sapiens
uguaucaaacuguauaa

SEQ ID NO: 1336630 - RNA, 16 nt, Homo sapiens
uguaucaguguccuuu

SEQ ID NO: 1336631 - RNA, 14 nt, Homo sapiens
uguauccauccaug

SEQ ID NO: 1336632 - RNA, 13 nt, Homo sapiens
uguauccaugcac

SEQ ID NO: 1336633 - RNA, 14 nt, Homo sapiens
uguauccauucuac

SEQ ID NO: 1336634 - RNA, 15 nt, Homo sapiens
uguaucugacaaaag

SEQ ID NO: 1336635 - RNA, 22 nt, Homo sapiens
uguaugcaaaucaaacauauuc

SEQ ID NO: 1336636 - RNA, 12 nt, Homo sapiens
uguaugcacuuu

SEQ ID NO: 1336637 - RNA, 14 nt, Homo sapiens
ugucaagagucgcu

SEQ ID NO: 1336638 - RNA, 18 nt, Homo sapiens
ugucaccccucacuguga

SEQ ID NO: 1336639 - RNA, 18 nt, Homo sapiens
ugucacuguuccuuguca

SEQ ID NO: 1336640 - RNA, 14 nt, Homo sapiens
ugucagcaguuccc

SEQ ID NO: 1336641 - RNA, 12 nt, Homo sapiens
ugucaguucucu

SEQ ID NO: 1336642 - RNA, 17 nt, Homo sapiens
ugucauauaagauucau

SEQ ID NO: 1336643 - RNA, 16 nt, Homo sapiens
ugucauccacuuuaug

SEQ ID NO: 1336644 - RNA, 21 nt, Homo sapiens
ugucauccucaaagaaagugu

SEQ ID NO: 1336645 - RNA, 16 nt, Homo sapiens
ugucauuccaguuuga

SEQ ID NO: 1336646 - RNA, 23 nt, Homo sapiens
ugucauuuuuauaaaacuuugaa

SEQ ID NO: 1336647 - RNA, 19 nt, Homo sapiens
uguccaggcuggagugcaa

SEQ ID NO: 1336648 - RNA, 16 nt, Homo sapiens
uguccagugagcagug

SEQ ID NO: 1336649 - RNA, 19 nt, Homo sapiens
uguccagugagcaguguug

SEQ ID NO: 1336650 - RNA, 14 nt, Homo sapiens
uguccauaaauaaa

SEQ ID NO: 1336651 - RNA, 22 nt, Homo sapiens
ugucccaaaccagacaccugga

SEQ ID NO: 1336652 - RNA, 16 nt, Homo sapiens
ugucccagaaugccuc

SEQ ID NO: 1336653 - RNA, 19 nt, Homo sapiens
uguccccugacagggccag

SEQ ID NO: 1336654 - RNA, 14 nt, Homo sapiens
ugucccucuguaua

SEQ ID NO: 1336655 - RNA, 22 nt, Homo sapiens
uguccucagccuugccagagau

SEQ ID NO: 1336656 - RNA, 22 nt, Homo sapiens
uguccuccaccaugcacucacc

SEQ ID NO: 1336657 - RNA, 17 nt, Homo sapiens
uguccucuuugugauaa

SEQ ID NO: 1336658 - RNA, 22 nt, Homo sapiens
uguccugagcaccacacccagu

SEQ ID NO: 1336659 - RNA, 15 nt, Homo sapiens
uguccuggaauuauu

SEQ ID NO: 1336660 - RNA, 20 nt, Homo sapiens
ugucgaggccacauugcugg

SEQ ID NO: 1336661 - RNA, 22 nt, Homo sapiens
ugucgugaugaaaacuuucuaa

SEQ ID NO: 1336662 - RNA, 22 nt, Homo sapiens
ugucuaauuaaaacacuuucaa

SEQ ID NO: 1336663 - RNA, 16 nt, Homo sapiens
ugucuccacacacagc

SEQ ID NO: 1336664 - RNA, 19 nt, Homo sapiens
ugucuccaucucugucuca

SEQ ID NO: 1336665 - RNA, 19 nt, Homo sapiens
ugucucuuugugcucuaaa

SEQ ID NO: 1336666 - RNA, 23 nt, Homo sapiens
ugucugguguuugucauggugaa

SEQ ID NO: 1336667 - RNA, 21 nt, Homo sapiens
ugucuguaauaauagacugua

SEQ ID NO: 1336668 - RNA, 18 nt, Homo sapiens
ugucuuaaggucauaaaa

SEQ ID NO: 1336669 - RNA, 18 nt, Homo sapiens
ugucuuguguuuccacag

SEQ ID NO: 1336670 - RNA, 18 nt, Homo sapiens
ugucuuuucaaaauauua

SEQ ID NO: 1336671 - RNA, 17 nt, Homo sapiens
ugucuuuucuuugccau

SEQ ID NO: 1336672 - RNA, 19 nt, Homo sapiens
ugugaacacaucagcuugc

SEQ ID NO: 1336673 - RNA, 19 nt, Homo sapiens
ugugaaguuugcuuuguac

SEQ ID NO: 1336674 - RNA, 22 nt, Homo sapiens
ugugacauacauauuaucucau

SEQ ID NO: 1336675 - RNA, 20 nt, Homo sapiens
ugugacucccccucuuucac

SEQ ID NO: 1336676 - RNA, 15 nt, Homo sapiens
ugugagauacugugu

SEQ ID NO: 1336677 - RNA, 19 nt, Homo sapiens
ugugaugugucacagguua

SEQ ID NO: 1336678 - RNA, 23 nt, Homo sapiens
ugugauuggcugguuaaugggaa

SEQ ID NO: 1336679 - RNA, 22 nt, Homo sapiens
ugugcacugccugcaugagcug

SEQ ID NO: 1336680 - RNA, 17 nt, Homo sapiens
ugugcaguaucugugaa

SEQ ID NO: 1336681 - RNA, 17 nt, Homo sapiens
ugugccagcaccacagc

SEQ ID NO: 1336682 - RNA, 15 nt, Homo sapiens
ugugccuugccacau

SEQ ID NO: 1336683 - RNA, 18 nt, Homo sapiens
ugugccuuggugugcugu

SEQ ID NO: 1336684 - RNA, 15 nt, Homo sapiens
ugugccuuugcauaa

SEQ ID NO: 1336685 - RNA, 20 nt, Homo sapiens
ugugcugcucaaggccacag

SEQ ID NO: 1336686 - RNA, 20 nt, Homo sapiens
uguggacguggguugcacug

SEQ ID NO: 1336687 - RNA, 19 nt, Homo sapiens
uguggagggagggcagcug

SEQ ID NO: 1336688 - RNA, 16 nt, Homo sapiens
uguggaugagaggaac

SEQ ID NO: 1336689 - RNA, 17 nt, Homo sapiens
ugugggacugagaugca

SEQ ID NO: 1336690 - RNA, 14 nt, Homo sapiens
uguguacaauguga

SEQ ID NO: 1336691 - RNA, 13 nt, Homo sapiens
uguguacugccuu

SEQ ID NO: 1336692 - RNA, 22 nt, Homo sapiens
ugugucgggcucauuuugcuca

SEQ ID NO: 1336693 - RNA, 11 nt, Homo sapiens
ugugugccuuu

SEQ ID NO: 1336694 - RNA, 14 nt, Homo sapiens
ugugugcuuuccca

SEQ ID NO: 1336695 - RNA, 16 nt, Homo sapiens
uguguuugguuuccca

SEQ ID NO: 1336696 - RNA, 18 nt, Homo sapiens
uguuaacauggacaugau

SEQ ID NO: 1336697 - RNA, 17 nt, Homo sapiens
uguuaauauuucuaaaa

SEQ ID NO: 1336698 - RNA, 23 nt, Homo sapiens
uguuaauguuugcauuuccucag

SEQ ID NO: 1336699 - RNA, 22 nt, Homo sapiens
uguuauauuauuacuaauuguc

SEQ ID NO: 1336700 - RNA, 20 nt, Homo sapiens
uguucccuccccgaucaucu

SEQ ID NO: 1336701 - RNA, 12 nt, Homo sapiens
uguucgacucag

SEQ ID NO: 1336702 - RNA, 18 nt, Homo sapiens
uguucgaugcugauacuu

SEQ ID NO: 1336703 - RNA, 20 nt, Homo sapiens
uguucguggagucucauggg

SEQ ID NO: 1336704 - RNA, 22 nt, Homo sapiens
uguucuaaaaauaaaaguauug

SEQ ID NO: 1336705 - RNA, 22 nt, Homo sapiens
uguucuccuuuggaauggugua

SEQ ID NO: 1336706 - RNA, 20 nt, Homo sapiens
uguucucuuuaaucagcuua

SEQ ID NO: 1336707 - RNA, 23 nt, Homo sapiens
uguucuucauuaccucagugaga

SEQ ID NO: 1336708 - RNA, 21 nt, Homo sapiens
uguugaaucuauuucacuuau

SEQ ID NO: 1336709 - RNA, 17 nt, Homo sapiens
uuuauuacauugcugcc

SEQ ID NO: 1336710 - RNA, 19 nt, Homo sapiens
uuuauuacauugcugccuu

SEQ ID NO: 1336711 - RNA, 23 nt, Homo sapiens
uuuauuacugagggccaccaaau

SEQ ID NO: 1336712 - RNA, 22 nt, Homo sapiens
uuucaauacuuacauaucugac

SEQ ID NO: 1336713 - RNA, 17 nt, Homo sapiens
uuucacaugagucaaaa

SEQ ID NO: 1336714 - RNA, 22 nt, Homo sapiens
uuucagugcauuaucuacuugu

SEQ ID NO: 1336715 - RNA, 14 nt, Homo sapiens
uuucauacaacaga

SEQ ID NO: 1336716 - RNA, 19 nt, Homo sapiens
uuucauaccuaucaucuua

SEQ ID NO: 1336717 - RNA, 17 nt, Homo sapiens
uuucaugucuugucaua

SEQ ID NO: 1336718 - RNA, 11 nt, Homo sapiens
uuuccagagag

SEQ ID NO: 1336719 - RNA, 12 nt, Homo sapiens
uuucccauuuca

SEQ ID NO: 1336720 - RNA, 20 nt, Homo sapiens
uuuccccuccuuggcuuuau

SEQ ID NO: 1336721 - RNA, 19 nt, Homo sapiens
uuuccccuuugauugcuga

SEQ ID NO: 1336722 - RNA, 23 nt, Homo sapiens
uuucccuuguccuuucucucuaa

SEQ ID NO: 1336723 - RNA, 16 nt, Homo sapiens
uuuccgagccuccagu

SEQ ID NO: 1336724 - RNA, 19 nt, Homo sapiens
uuuccgagccuccagucca

SEQ ID NO: 1336725 - RNA, 20 nt, Homo sapiens
uuuccgagccuccaguccaa

SEQ ID NO: 1336726 - RNA, 17 nt, Homo sapiens
uuuccuagcuguguuau

SEQ ID NO: 1336727 - RNA, 16 nt, Homo sapiens
uuuccuaggcagauca

SEQ ID NO: 1336728 - RNA, 21 nt, Homo sapiens
uuuccuguguacacgugacag

SEQ ID NO: 1336729 - RNA, 18 nt, Homo sapiens
uuuccuugacuucuuuga

SEQ ID NO: 1336730 - RNA, 21 nt, Homo sapiens
uuucuaaaaaggcugcucaca

SEQ ID NO: 1336731 - RNA, 16 nt, Homo sapiens
uuucuaaaaucuaaaa

SEQ ID NO: 1336732 - RNA, 10 nt, Homo sapiens
uuucuaagug

SEQ ID NO: 1336733 - RNA, 14 nt, Homo sapiens
uuucuauucuguca

SEQ ID NO: 1336734 - RNA, 19 nt, Homo sapiens
uuucuauuuuguuggauga

SEQ ID NO: 1336735 - RNA, 14 nt, Homo sapiens
uuucugagaaagac

SEQ ID NO: 1336736 - RNA, 18 nt, Homo sapiens
uuucugagacagcuuguc

SEQ ID NO: 1336737 - RNA, 21 nt, Homo sapiens
uuucugauaaaagauggccau

SEQ ID NO: 1336738 - RNA, 15 nt, Homo sapiens
uuucuguagugugaa

SEQ ID NO: 1336739 - RNA, 21 nt, Homo sapiens
uuucugucguuaaaaacagau

SEQ ID NO: 1336740 - RNA, 22 nt, Homo sapiens
uuucugugggaggagaagggga

SEQ ID NO: 1336741 - RNA, 23 nt, Homo sapiens
uuucuuccacccacaaacuccag

SEQ ID NO: 1336742 - RNA, 18 nt, Homo sapiens
uuucuuguauuuuuccaa

SEQ ID NO: 1336743 - RNA, 17 nt, Homo sapiens
uuucuuugcaccaaaga

SEQ ID NO: 1336744 - RNA, 18 nt, Homo sapiens
uuucuuuuuuauacucaa

SEQ ID NO: 1336745 - RNA, 18 nt, Homo sapiens
uuugaaaaaaguacauau

SEQ ID NO: 1336746 - RNA, 17 nt, Homo sapiens
uuugaaauaaugacaua

SEQ ID NO: 1336747 - RNA, 17 nt, Homo sapiens
uuugaacagggcaguuu

SEQ ID NO: 1336748 - RNA, 14 nt, Homo sapiens
uuugaacucaggga

SEQ ID NO: 1336749 - RNA, 14 nt, Homo sapiens
uuugaagcaacugu

SEQ ID NO: 1336750 - RNA, 18 nt, Homo sapiens
uuugaagguagaauguuu

SEQ ID NO: 1336751 - RNA, 22 nt, Homo sapiens
uuugaaguagacucauucuuca

SEQ ID NO: 1336752 - RNA, 17 nt, Homo sapiens
uuugaauaaaugucacu

SEQ ID NO: 1336753 - RNA, 14 nt, Homo sapiens
uuugacauuuacug

SEQ ID NO: 1336754 - RNA, 15 nt, Homo sapiens
uuugaggcaaaagaa

SEQ ID NO: 1336755 - RNA, 22 nt, Homo sapiens
uuugauaagaaaaccgaacugg

SEQ ID NO: 1336756 - RNA, 16 nt, Homo sapiens
uuugauacaguauuau

SEQ ID NO: 1336757 - RNA, 13 nt, Homo sapiens
uuugauauuugca

SEQ ID NO: 1336758 - RNA, 20 nt, Homo sapiens
uuugauuagagaccagauca

SEQ ID NO: 1336759 - RNA, 15 nt, Homo sapiens
uuugauucagcaaaa

SEQ ID NO: 1336760 - RNA, 20 nt, Homo sapiens
uuugauucagcaaaaaucuc

SEQ ID NO: 1336761 - RNA, 15 nt, Homo sapiens
uuugauuuacauaua

SEQ ID NO: 1336762 - RNA, 12 nt, Homo sapiens
uuugcaggugcu

SEQ ID NO: 1336763 - RNA, 20 nt, Homo sapiens
uuugcauaauaagcagguug

SEQ ID NO: 1336764 - RNA, 18 nt, Homo sapiens
uuugcauuugcagugcau

SEQ ID NO: 1336765 - RNA, 17 nt, Homo sapiens
uuugccaaggcucuccc

SEQ ID NO: 1336766 - RNA, 22 nt, Homo sapiens
uuugccauauggaggacuguga

SEQ ID NO: 1336767 - RNA, 18 nt, Homo sapiens
uuugcccaaaacugucau

SEQ ID NO: 1336768 - RNA, 18 nt, Homo sapiens
uuugccuccagugcaguc

SEQ ID NO: 1336769 - RNA, 12 nt, Homo sapiens
uuugcucaacau

SEQ ID NO: 1336770 - RNA, 19 nt, Homo sapiens
uuugcuucaaaaacauucu

SEQ ID NO: 1336771 - RNA, 23 nt, Homo sapiens
uuuggaaaacagcgaacagccuu

SEQ ID NO: 1336772 - RNA, 16 nt, Homo sapiens
uuuggaaagacuggac

SEQ ID NO: 1336773 - RNA, 14 nt, Homo sapiens
uuuggaauauucca

SEQ ID NO: 1336774 - RNA, 15 nt, Homo sapiens
uuuggaauauuccac

SEQ ID NO: 1336775 - RNA, 15 nt, Homo sapiens
uuuggagguauucaa

SEQ ID NO: 1336776 - RNA, 13 nt, Homo sapiens
uuugggccagaca

SEQ ID NO: 1336777 - RNA, 14 nt, Homo sapiens
uuugggccagacau

SEQ ID NO: 1336778 - RNA, 20 nt, Homo sapiens
uuuggggcucagaguggggu

SEQ ID NO: 1336779 - RNA, 20 nt, Homo sapiens
uuugggggaacuggacacaa

SEQ ID NO: 1336780 - RNA, 20 nt, Homo sapiens
uuugggugcuguuuugccag

SEQ ID NO: 1336781 - RNA, 19 nt, Homo sapiens
uuugguguuuuuacagagg

SEQ ID NO: 1336782 - RNA, 16 nt, Homo sapiens
uuuguaauaaacucuc

SEQ ID NO: 1336783 - RNA, 22 nt, Homo sapiens
uuuguauauaggcuucucacgg

SEQ ID NO: 1336784 - RNA, 14 nt, Homo sapiens
uuugugguaguccu

SEQ ID NO: 1336785 - RNA, 22 nt, Homo sapiens
uuuguuacagccaagugccaaa

SEQ ID NO: 1336786 - RNA, 15 nt, Homo sapiens
uuuguuagcaaagau

SEQ ID NO: 1336787 - RNA, 10 nt, Homo sapiens
uuuguucccu

SEQ ID NO: 1336788 - RNA, 15 nt, Homo sapiens
uuuguuuagucuuua

SEQ ID NO: 1336789 - RNA, 23 nt, Homo sapiens
uuuuaaaaggcaagucaaauacc

SEQ ID NO: 1336790 - RNA, 19 nt, Homo sapiens
uuuuaaauaaaagcacaag

SEQ ID NO: 1336791 - RNA, 15 nt, Homo sapiens
uuuuaacugccaaga

SEQ ID NO: 1336792 - RNA, 13 nt, Homo sapiens
uuuuaacuuuuaa

SEQ ID NO: 1336793 - RNA, 20 nt, Homo sapiens
uuuuaauuuauucaucuugc

SEQ ID NO: 1336794 - RNA, 17 nt, Homo sapiens
uuuuaauuuuuugucaa

SEQ ID NO: 1336795 - RNA, 23 nt, Homo sapiens
uuuuacaacuggaugugugacua

SEQ ID NO: 1336796 - RNA, 17 nt, Homo sapiens
uuuuacauuucauacaa

SEQ ID NO: 1336797 - RNA, 21 nt, Homo sapiens
uuuuacauuucauacaacaga

SEQ ID NO: 1336798 - RNA, 21 nt, Homo sapiens
uuuuaccaaagcaucaauaca

SEQ ID NO: 1336799 - RNA, 22 nt, Homo sapiens
uuuuaccaaagcaucaauacaa

SEQ ID NO: 1336800 - RNA, 17 nt, Homo sapiens
uuuuacuucucuauaca

SEQ ID NO: 1336801 - RNA, 21 nt, Homo sapiens
uuuuagaagauucuauguuaa

SEQ ID NO: 1336802 - RNA, 22 nt, Homo sapiens
uuuuaggaagcuagacuagcug

SEQ ID NO: 1336803 - RNA, 20 nt, Homo sapiens
uuuuauggaggcuuugcaua

SEQ ID NO: 1336804 - RNA, 23 nt, Homo sapiens
uuuuauggaggcuuugcauagau

SEQ ID NO: 1336805 - RNA, 16 nt, Homo sapiens
uuuuauuuacauucuu

SEQ ID NO: 1336806 - RNA, 21 nt, Homo sapiens
uuuucacugcuggcugccuua

SEQ ID NO: 1336807 - RNA, 14 nt, Homo sapiens
uuuucauuaucuca

SEQ ID NO: 1336808 - RNA, 13 nt, Homo sapiens
uuuuccacuuaga

SEQ ID NO: 1336809 - RNA, 18 nt, Homo sapiens
uuuuccuagcuguguuau

SEQ ID NO: 1336810 - RNA, 18 nt, Homo sapiens
uuuuccuggcucaucucu

SEQ ID NO: 1336811 - RNA, 12 nt, Homo sapiens
uuuucucuugcc

SEQ ID NO: 1336812 - RNA, 12 nt, Homo sapiens
uuuucugccacu

SEQ ID NO: 1336813 - RNA, 15 nt, Homo sapiens
uuuucuguaguguga

SEQ ID NO: 1336814 - RNA, 13 nt, Homo sapiens
uuuucuucauuca

SEQ ID NO: 1336815 - RNA, 14 nt, Homo sapiens
uuuucuuuggcugc

SEQ ID NO: 1336816 - RNA, 14 nt, Homo sapiens
uuuugaaaugucaa

SEQ ID NO: 1336817 - RNA, 20 nt, Homo sapiens
uuuugaagauucuauguuaa

SEQ ID NO: 1336818 - RNA, 17 nt, Homo sapiens
uuuugcucaguuccaug

SEQ ID NO: 1336819 - RNA, 20 nt, Homo sapiens
uuuugggggucagcauccag

SEQ ID NO: 1336820 - RNA, 21 nt, Homo sapiens
uuuugggggucagcauccagu

SEQ ID NO: 1336821 - RNA, 13 nt, Homo sapiens
uugacaggauuau

SEQ ID NO: 1336822 - RNA, 15 nt, Homo sapiens
uugacauucggggug

SEQ ID NO: 1336823 - RNA, 16 nt, Homo sapiens
uugaccucucauaaau

SEQ ID NO: 1336824 - RNA, 22 nt, Homo sapiens
uugacggaaacaacguugcuau

SEQ ID NO: 1336825 - RNA, 23 nt, Homo sapiens
uugacugucacuguuccuuguca

SEQ ID NO: 1336826 - RNA, 20 nt, Homo sapiens
uugacuucuuugagaaugca

SEQ ID NO: 1336827 - RNA, 13 nt, Homo sapiens
uugagacuccuca

SEQ ID NO: 1336828 - RNA, 20 nt, Homo sapiens
uugagaugggggucucacca

SEQ ID NO: 1336829 - RNA, 13 nt, Homo sapiens
uugagcaugugau

SEQ ID NO: 1336830 - RNA, 22 nt, Homo sapiens
uugaggaaguggcugucccugu

SEQ ID NO: 1336831 - RNA, 16 nt, Homo sapiens
uugaggcaaaagaagg

SEQ ID NO: 1336832 - RNA, 19 nt, Homo sapiens
uugauacaauauugugcau

SEQ ID NO: 1336833 - RNA, 13 nt, Homo sapiens
uugauagauuucu

SEQ ID NO: 1336834 - RNA, 17 nt, Homo sapiens
uugauagauuucuacac

SEQ ID NO: 1336835 - RNA, 22 nt, Homo sapiens
uugaucuggaacccagacucag

SEQ ID NO: 1336836 - RNA, 19 nt, Homo sapiens
uugaugaauaaaaugaagg

SEQ ID NO: 1336837 - RNA, 22 nt, Homo sapiens
uugauggauuaauuaaauaagu

SEQ ID NO: 1336838 - RNA, 22 nt, Homo sapiens
uugauguacauaacuccugucc

SEQ ID NO: 1336839 - RNA, 15 nt, Homo sapiens
uugauuuacauauau

SEQ ID NO: 1336840 - RNA, 15 nt, Homo sapiens
uugcaaagcauuuga

SEQ ID NO: 1336841 - RNA, 15 nt, Homo sapiens
uugcaacuaguaaaa

SEQ ID NO: 1336842 - RNA, 22 nt, Homo sapiens
uugcaagauuccaaguucucac

SEQ ID NO: 1336843 - RNA, 19 nt, Homo sapiens
uugcaaugcaugauacuau

SEQ ID NO: 1336844 - RNA, 19 nt, Homo sapiens
uugcaccuaucucagccau

SEQ ID NO: 1336845 - RNA, 20 nt, Homo sapiens
uugcagcuggacuucuccac

SEQ ID NO: 1336846 - RNA, 12 nt, Homo sapiens
uugccacugugu

SEQ ID NO: 1336847 - RNA, 13 nt, Homo sapiens
uugccauuugcug

SEQ ID NO: 1336848 - RNA, 18 nt, Homo sapiens
uugccauuuguagcuuug

SEQ ID NO: 1336849 - RNA, 23 nt, Homo sapiens
uugcccaggcuggagugcaaugg

SEQ ID NO: 1336850 - RNA, 14 nt, Homo sapiens
uugccccaccuccc

SEQ ID NO: 1336851 - RNA, 13 nt, Homo sapiens
uugccuaucugac

SEQ ID NO: 1336852 - RNA, 18 nt, Homo sapiens
uugccugcuccaucucau

SEQ ID NO: 1336853 - RNA, 20 nt, Homo sapiens
uugccugggggcuuuugcca

SEQ ID NO: 1336854 - RNA, 21 nt, Homo sapiens
uugccugggggcuuuugccac

SEQ ID NO: 1336855 - RNA, 17 nt, Homo sapiens
uugcuaacuugaaaaau

SEQ ID NO: 1336856 - RNA, 17 nt, Homo sapiens
uugcuaaugacagccuu

SEQ ID NO: 1336857 - RNA, 14 nt, Homo sapiens
uugcucacagcuga

SEQ ID NO: 1336858 - RNA, 14 nt, Homo sapiens
uugcuccuugacau

SEQ ID NO: 1336859 - RNA, 14 nt, Homo sapiens
uugcuggacuguca

SEQ ID NO: 1336860 - RNA, 20 nt, Homo sapiens
uugcuuccccuuuugccaau

SEQ ID NO: 1336861 - RNA, 12 nt, Homo sapiens
uugcuugaauuu

SEQ ID NO: 1336862 - RNA, 11 nt, Homo sapiens
uugcuuucuau

SEQ ID NO: 1336863 - RNA, 16 nt, Homo sapiens
uuggaaauacuguaug

SEQ ID NO: 1336864 - RNA, 13 nt, Homo sapiens
uuggaacaaucac

SEQ ID NO: 1336865 - RNA, 18 nt, Homo sapiens
uuggaagguggguucugc

SEQ ID NO: 1336866 - RNA, 13 nt, Homo sapiens
uuggaauggugua

SEQ ID NO: 1336867 - RNA, 14 nt, Homo sapiens
uuggacaaccucau

SEQ ID NO: 1336868 - RNA, 17 nt, Homo sapiens
uuggacagcugauaaau

SEQ ID NO: 1336869 - RNA, 14 nt, Homo sapiens
uuggacuucuugaa

SEQ ID NO: 1336870 - RNA, 22 nt, Homo sapiens
uuggagaaccagggcucuucuc

SEQ ID NO: 1336871 - RNA, 23 nt, Homo sapiens
uuggaggccugacuuggggacaa

SEQ ID NO: 1336872 - RNA, 20 nt, Homo sapiens
uuggaggcucucuugugcau

SEQ ID NO: 1336873 - RNA, 18 nt, Homo sapiens
uuggauaaguuucuauuc

SEQ ID NO: 1336874 - RNA, 14 nt, Homo sapiens
uuggcaccagacac

SEQ ID NO: 1336875 - RNA, 15 nt, Homo sapiens
uuggcucuacccuga

SEQ ID NO: 1336876 - RNA, 21 nt, Homo sapiens
uuggcuuuaugcaaauacaau

SEQ ID NO: 1336877 - RNA, 14 nt, Homo sapiens
uugggacauugcaa

SEQ ID NO: 1336878 - RNA, 18 nt, Homo sapiens
uugggaggauacagagga

SEQ ID NO: 1336879 - RNA, 15 nt, Homo sapiens
uuggggacaacguau

SEQ ID NO: 1336880 - RNA, 20 nt, Homo sapiens
uuggggguaaaguuugcucu

SEQ ID NO: 1336881 - RNA, 17 nt, Homo sapiens
uugggggucaucuugga

SEQ ID NO: 1336882 - RNA, 14 nt, Homo sapiens
uuguaaaagcauuu

SEQ ID NO: 1336883 - RNA, 15 nt, Homo sapiens
uuguaauaauaaaga

SEQ ID NO: 1336884 - RNA, 22 nt, Homo sapiens
uuguaauacuuucuaugugaca

SEQ ID NO: 1336885 - RNA, 14 nt, Homo sapiens
uuguacaauguaga

SEQ ID NO: 1336886 - RNA, 13 nt, Homo sapiens
uuguagcauuugg

SEQ ID NO: 1336887 - RNA, 19 nt, Homo sapiens
uuguauuuuauuguuucuu

SEQ ID NO: 1336888 - RNA, 20 nt, Homo sapiens
uugucaccucaauauuuacu

SEQ ID NO: 1336889 - RNA, 13 nt, Homo sapiens
uugucauacaaau

SEQ ID NO: 1336890 - RNA, 16 nt, Homo sapiens
uugucauguaugugaa

SEQ ID NO: 1336891 - RNA, 19 nt, Homo sapiens
uugucauguuaugcaguga

SEQ ID NO: 1336892 - RNA, 13 nt, Homo sapiens
uugucuacacucu

SEQ ID NO: 1336893 - RNA, 16 nt, Homo sapiens
uugugaaacagacuug

SEQ ID NO: 1336894 - RNA, 16 nt, Homo sapiens
uugugauguguccuga

SEQ ID NO: 1336895 - RNA, 14 nt, Homo sapiens
uugugguuaaucug

SEQ ID NO: 1336896 - RNA, 16 nt, Homo sapiens
uuguguauccaugcac

SEQ ID NO: 1336897 - RNA, 12 nt, Homo sapiens
uuguuauauccu

SEQ ID NO: 1336898 - RNA, 19 nt, Homo sapiens
uuguucaaaauaaugaagu

SEQ ID NO: 1336899 - RNA, 18 nt, Homo sapiens
uuguuuaaacaaucuuuc

SEQ ID NO: 1336900 - RNA, 22 nt, Homo sapiens
uuguuuagucuuuauacugcaa

SEQ ID NO: 1336901 - RNA, 18 nt, Homo sapiens
uuguuucugaucuaauau

SEQ ID NO: 1336902 - RNA, 14 nt, Homo sapiens
uuguuucuguagaa

SEQ ID NO: 1336903 - RNA, 13 nt, Homo sapiens
uuuaaaaaaugga

SEQ ID NO: 1336904 - RNA, 18 nt, Homo sapiens
uuuaaaaauaguugcugu

SEQ ID NO: 1336905 - RNA, 19 nt, Homo sapiens
uuuaaaaggcaagucaaau

SEQ ID NO: 1336906 - RNA, 23 nt, Homo sapiens
uuuaaaaggcaagucaaauacca

SEQ ID NO: 1336907 - RNA, 17 nt, Homo sapiens
uuuaaacaaaugugaua

SEQ ID NO: 1336908 - RNA, 21 nt, Homo sapiens
uuuaaacaguaaaccuuaaca

SEQ ID NO: 1336909 - RNA, 12 nt, Homo sapiens
uuuaaacaguga

SEQ ID NO: 1336910 - RNA, 18 nt, Homo sapiens
uuuaaacucaucaaugug

SEQ ID NO: 1336911 - RNA, 22 nt, Homo sapiens
uuuaaacugauuacguuuacau

SEQ ID NO: 1336912 - RNA, 12 nt, Homo sapiens
uuuaaagacaga

SEQ ID NO: 1336913 - RNA, 17 nt, Homo sapiens
uuuaaauaaaagcacaa

SEQ ID NO: 1336914 - RNA, 23 nt, Homo sapiens
uuuaaauaagauuuaauucacau

SEQ ID NO: 1336915 - RNA, 18 nt, Homo sapiens
uuuaacuauucauaagau

SEQ ID NO: 1336916 - RNA, 20 nt, Homo sapiens
uuuaacucaguuucuaggca

SEQ ID NO: 1336917 - RNA, 13 nt, Homo sapiens
uuuaagacauaaa

SEQ ID NO: 1336918 - RNA, 17 nt, Homo sapiens
uuuaagauguacauuua

SEQ ID NO: 1336919 - RNA, 21 nt, Homo sapiens
uuuaagccaaagaaacaagcu

SEQ ID NO: 1336920 - RNA, 20 nt, Homo sapiens
uuuaagccgcagaccuggag

SEQ ID NO: 1336921 - RNA, 18 nt, Homo sapiens
uuuaaggugaaccaaaga

SEQ ID NO: 1336922 - RNA, 19 nt, Homo sapiens
uuuaauauuacagauaaaa

SEQ ID NO: 1336923 - RNA, 23 nt, Homo sapiens
uuuaauccuguaccaaaucugac

SEQ ID NO: 1336924 - RNA, 13 nt, Homo sapiens
uuuaaugcacuaa

SEQ ID NO: 1336925 - RNA, 22 nt, Homo sapiens
uuuaauguuaaauucaauguag

SEQ ID NO: 1336926 - RNA, 15 nt, Homo sapiens
uuuaauuacaaacaa

SEQ ID NO: 1336927 - RNA, 13 nt, Homo sapiens
uuuaauuuacacu

SEQ ID NO: 1336928 - RNA, 17 nt, Homo sapiens
uuuaauuuucuuguaua

SEQ ID NO: 1336929 - RNA, 13 nt, Homo sapiens
uuuacagcugccu

SEQ ID NO: 1336930 - RNA, 12 nt, Homo sapiens
uuuacaguauuu

SEQ ID NO: 1336931 - RNA, 17 nt, Homo sapiens
uuuacauccuucacugc

SEQ ID NO: 1336932 - RNA, 20 nt, Homo sapiens
uuuaccaaagagauauugau

SEQ ID NO: 1336933 - RNA, 21 nt, Homo sapiens
uuuaccccucacaauccuugc

SEQ ID NO: 1336934 - RNA, 19 nt, Homo sapiens
uuuacccugaggucacugc

SEQ ID NO: 1336935 - RNA, 22 nt, Homo sapiens
uuuaccuuucagugcaguuucu

SEQ ID NO: 1336936 - RNA, 15 nt, Homo sapiens
uuuagaaaaagucaa

SEQ ID NO: 1336937 - RNA, 23 nt, Homo sapiens
guuuuaauccuuaacacauucaa

SEQ ID NO: 1336938 - RNA, 12 nt, Homo sapiens
guuuuagaacca

SEQ ID NO: 1336939 - RNA, 15 nt, Homo sapiens
guuuuagaaccagcc

SEQ ID NO: 1336940 - RNA, 15 nt, Homo sapiens
guuuuaucacuucau

SEQ ID NO: 1336941 - RNA, 14 nt, Homo sapiens
guuuuauuacacau

SEQ ID NO: 1336942 - RNA, 21 nt, Homo sapiens
guuuucacaaagaacaggaaa

SEQ ID NO: 1336943 - RNA, 15 nt, Homo sapiens
guuuugaguaauuca

SEQ ID NO: 1336944 - RNA, 14 nt, Homo sapiens
guuuugccugagaa

SEQ ID NO: 1336945 - RNA, 17 nt, Homo sapiens
guuuuuccaguucacau

SEQ ID NO: 1336946 - RNA, 19 nt, Homo sapiens
guuuuuggacacauuuaag

SEQ ID NO: 1336947 - RNA, 22 nt, Homo sapiens
guuuuuguauuuauuaauuuga

SEQ ID NO: 1336948 - RNA, 14 nt, Homo sapiens
uaaaaaagagacau

SEQ ID NO: 1336949 - RNA, 19 nt, Homo sapiens
uaaaaaucuuaauguauca

SEQ ID NO: 1336950 - RNA, 18 nt, Homo sapiens
uaaaaauggccauuugcu

SEQ ID NO: 1336951 - RNA, 17 nt, Homo sapiens
uaaaaauguccugccuu

SEQ ID NO: 1336952 - RNA, 19 nt, Homo sapiens
uaaaaaugucuuauugucc

SEQ ID NO: 1336953 - RNA, 19 nt, Homo sapiens
uaaaaauguuacgugaaga

SEQ ID NO: 1336954 - RNA, 20 nt, Homo sapiens
uaaaaauuuauaagcauuug

SEQ ID NO: 1336955 - RNA, 16 nt, Homo sapiens
uaaaagaaaacacugu

SEQ ID NO: 1336956 - RNA, 20 nt, Homo sapiens
uaaaagcacaaguacuuuug

SEQ ID NO: 1336957 - RNA, 15 nt, Homo sapiens
uaaaagccccagcuu

SEQ ID NO: 1336958 - RNA, 16 nt, Homo sapiens
uaaaagcuacuaugua

SEQ ID NO: 1336959 - RNA, 22 nt, Homo sapiens
uaaaagcuacuauguacugccu

SEQ ID NO: 1336960 - RNA, 15 nt, Homo sapiens
uaaaaggcaagucaa

SEQ ID NO: 1336961 - RNA, 19 nt, Homo sapiens
uaaaauaacagauuucuca

SEQ ID NO: 1336962 - RNA, 14 nt, Homo sapiens
uaaaauaacuugca

SEQ ID NO: 1336963 - RNA, 15 nt, Homo sapiens
uaaaauaguaugaaa

SEQ ID NO: 1336964 - RNA, 21 nt, Homo sapiens
uaaaauauaauuuucaaaaag

SEQ ID NO: 1336965 - RNA, 19 nt, Homo sapiens
uaaaauauuccugcauuug

SEQ ID NO: 1336966 - RNA, 19 nt, Homo sapiens
uaaaaucauuucugcauca

SEQ ID NO: 1336967 - RNA, 16 nt, Homo sapiens
uaaaaugcuggugaaa

SEQ ID NO: 1336968 - RNA, 19 nt, Homo sapiens
uaaaauggcaaguuuucca

SEQ ID NO: 1336969 - RNA, 14 nt, Homo sapiens
uaaaauguauucaa

SEQ ID NO: 1336970 - RNA, 22 nt, Homo sapiens
uaaaauguguuuuaucacuuca

SEQ ID NO: 1336971 - RNA, 18 nt, Homo sapiens
uaaaauuguuaauaugca

SEQ ID NO: 1336972 - RNA, 22 nt, Homo sapiens
uauugaaaugauuucacagugu

SEQ ID NO: 1336973 - RNA, 14 nt, Homo sapiens
uauugagauuuacc

SEQ ID NO: 1336974 - RNA, 14 nt, Homo sapiens
uauugagcauguga

SEQ ID NO: 1336975 - RNA, 15 nt, Homo sapiens
uauuggacagucuca

SEQ ID NO: 1336976 - RNA, 16 nt, Homo sapiens
uauuguuauauccuga

SEQ ID NO: 1336977 - RNA, 16 nt, Homo sapiens
uauuuaagcaacaucu

SEQ ID NO: 1336978 - RNA, 19 nt, Homo sapiens
uauuuacagcugugcucca

SEQ ID NO: 1336979 - RNA, 12 nt, Homo sapiens
uauuuacuauuu

SEQ ID NO: 1336980 - RNA, 22 nt, Homo sapiens
uauuuagaagccaacuaugauu

SEQ ID NO: 1336981 - RNA, 23 nt, Homo sapiens
uauuuaggcaagaagagguguga

SEQ ID NO: 1336982 - RNA, 19 nt, Homo sapiens
uauuucaauaaaucuuuca

SEQ ID NO: 1336983 - RNA, 14 nt, Homo sapiens
uauuucaauacuua

SEQ ID NO: 1336984 - RNA, 15 nt, Homo sapiens
uauuucuaaguauuu

SEQ ID NO: 1336985 - RNA, 21 nt, Homo sapiens
uauuucuauacaguagcuuga

SEQ ID NO: 1336986 - RNA, 23 nt, Homo sapiens
uauuucuugaagaauaaauucua

SEQ ID NO: 1336987 - RNA, 20 nt, Homo sapiens
uauuugcacuaugagccuau

SEQ ID NO: 1336988 - RNA, 13 nt, Homo sapiens
uauuugcuaugaa

SEQ ID NO: 1336989 - RNA, 22 nt, Homo sapiens
uauuugggggaacuggacacaa

SEQ ID NO: 1336990 - RNA, 21 nt, Homo sapiens
uauuugguucuguuccugaua

SEQ ID NO: 1336991 - RNA, 14 nt, Homo sapiens
uauuuguuacugua

SEQ ID NO: 1336992 - RNA, 20 nt, Homo sapiens
uauuuguuuuaauaccacag

SEQ ID NO: 1336993 - RNA, 23 nt, Homo sapiens
ucaaaaauuaucuauagcuaagu

SEQ ID NO: 1336994 - RNA, 13 nt, Homo sapiens
ucaaaacauccca

SEQ ID NO: 1336995 - RNA, 17 nt, Homo sapiens
ucaaaauaaaaaguaau

SEQ ID NO: 1336996 - RNA, 23 nt, Homo sapiens
ucaaaauaaaaaguaaugacuua

SEQ ID NO: 1336997 - RNA, 22 nt, Homo sapiens
ucaaaauaccaugccauuuaaa

SEQ ID NO: 1336998 - RNA, 22 nt, Homo sapiens
ucaaacaacauuccaccccagc

SEQ ID NO: 1336999 - RNA, 21 nt, Homo sapiens
ucaaacauauucuaaugccug

SEQ ID NO: 1337000 - RNA, 15 nt, Homo sapiens
ucaaauaaauuucug

SEQ ID NO: 1337001 - RNA, 14 nt, Homo sapiens
ucaaauaugcaaag

SEQ ID NO: 1337002 - RNA, 20 nt, Homo sapiens
ucaaaucuagaagaugcagu

SEQ ID NO: 1337003 - RNA, 21 nt, Homo sapiens
ucaaaugagccccuucauccg

SEQ ID NO: 1337004 - RNA, 23 nt, Homo sapiens
ucaaaugcucagaccagcucuuc

SEQ ID NO: 1337005 - RNA, 20 nt, Homo sapiens
ucaaauggggccagauccag

SEQ ID NO: 1337006 - RNA, 12 nt, Homo sapiens
ucaaauguucuc

SEQ ID NO: 1337007 - RNA, 14 nt, Homo sapiens
ucaaauucuucaca

SEQ ID NO: 1337008 - RNA, 12 nt, Homo sapiens
ucaacaguguga

SEQ ID NO: 1337009 - RNA, 20 nt, Homo sapiens
ucaacauccauaacucugua

SEQ ID NO: 1337010 - RNA, 15 nt, Homo sapiens
ucaaccaaugccaaa

SEQ ID NO: 1337011 - RNA, 16 nt, Homo sapiens
ucaacccccuaccccg

SEQ ID NO: 1337012 - RNA, 19 nt, Homo sapiens
ucaacccccuuaacuguau

SEQ ID NO: 1337013 - RNA, 24 nt, Homo sapiens
ucaacuccgugcuuaaccaaagaa

SEQ ID NO: 1337014 - RNA, 16 nt, Homo sapiens
ucaacugaaguucuau

SEQ ID NO: 1337015 - RNA, 15 nt, Homo sapiens
ucaagaaacugagga

SEQ ID NO: 1337016 - RNA, 15 nt, Homo sapiens
ucaagacaagagcug

SEQ ID NO: 1337017 - RNA, 22 nt, Homo sapiens
ucaagagaucuuucuuuccaaa

SEQ ID NO: 1337018 - RNA, 15 nt, Homo sapiens
ucaagccccauuucc

SEQ ID NO: 1337019 - RNA, 17 nt, Homo sapiens
ucaaguaaaacaaauga

SEQ ID NO: 1337020 - RNA, 13 nt, Homo sapiens
ucaaguaauccac

SEQ ID NO: 1337021 - RNA, 21 nt, Homo sapiens
ucaaguauuuuugacauuuac

SEQ ID NO: 1337022 - RNA, 16 nt, Homo sapiens
ucaagucucucacccu

SEQ ID NO: 1337023 - RNA, 22 nt, Homo sapiens
ucaagugauccuccugacucag

SEQ ID NO: 1337024 - RNA, 19 nt, Homo sapiens
ucaagugauucuccugccu

SEQ ID NO: 1337025 - RNA, 15 nt, Homo sapiens
ucaaguggguauucu

SEQ ID NO: 1337026 - RNA, 16 nt, Homo sapiens
ucaauaaaucuuucaa

SEQ ID NO: 1337027 - RNA, 23 nt, Homo sapiens
ucaauaaauggcccggacauguc

SEQ ID NO: 1337028 - RNA, 19 nt, Homo sapiens
ucaauacuuacauaucuga

SEQ ID NO: 1337029 - RNA, 18 nt, Homo sapiens
ucaauaugcaagcagcuu

SEQ ID NO: 1337030 - RNA, 23 nt, Homo sapiens
ucaaugccucacgagauuugcca

SEQ ID NO: 1337031 - RNA, 13 nt, Homo sapiens
ucaaugcuauucu

SEQ ID NO: 1337032 - RNA, 18 nt, Homo sapiens
ucaaugugcucuguaaca

SEQ ID NO: 1337033 - RNA, 15 nt, Homo sapiens
ucaauuauuugcaua

SEQ ID NO: 1337034 - RNA, 16 nt, Homo sapiens
ucacacauuacaaagu

SEQ ID NO: 1337035 - RNA, 20 nt, Homo sapiens
ucacagcaagucacuggcca

SEQ ID NO: 1337036 - RNA, 20 nt, Homo sapiens
ucacaguccuggacuccugc

SEQ ID NO: 1337037 - RNA, 21 nt, Homo sapiens
ucacauauacaaguagcuucc

SEQ ID NO: 1337038 - RNA, 16 nt, Homo sapiens
ucacaucucagggaac

SEQ ID NO: 1337039 - RNA, 14 nt, Homo sapiens
ucaccacagacuuu

SEQ ID NO: 1337040 - RNA, 23 nt, Homo sapiens
ucaccaugaugugaagaguuuca

SEQ ID NO: 1337041 - RNA, 18 nt, Homo sapiens
ucaccccugcuauaacua

SEQ ID NO: 1337042 - RNA, 14 nt, Homo sapiens
ucacccuaccugug

SEQ ID NO: 1337043 - RNA, 16 nt, Homo sapiens
ucaccuacauuaucuc

SEQ ID NO: 1337044 - RNA, 18 nt, Homo sapiens
ucaccuacauuaucucac

SEQ ID NO: 1337045 - RNA, 12 nt, Homo sapiens
ucaccucaauau

SEQ ID NO: 1337046 - RNA, 18 nt, Homo sapiens
ucaccuccaagcauuuca

SEQ ID NO: 1337047 - RNA, 17 nt, Homo sapiens
ucaccuccucugugauu

SEQ ID NO: 1337048 - RNA, 20 nt, Homo sapiens
ucaccugugacuccuguugc

SEQ ID NO: 1337049 - RNA, 18 nt, Homo sapiens
ucacggcuggauuucucu

SEQ ID NO: 1337050 - RNA, 14 nt, Homo sapiens
ucacuaaggacuua

SEQ ID NO: 1337051 - RNA, 23 nt, Homo sapiens
ucacucuggcuucaaaaagccac

SEQ ID NO: 1337052 - RNA, 21 nt, Homo sapiens
ucacucugggccuggggaccc

SEQ ID NO: 1337053 - RNA, 14 nt, Homo sapiens
ucacugcaguagca

SEQ ID NO: 1337054 - RNA, 15 nt, Homo sapiens
ucacugcuguuauau

SEQ ID NO: 1337055 - RNA, 18 nt, Homo sapiens
ucacuggcaugggagacc

SEQ ID NO: 1337056 - RNA, 17 nt, Homo sapiens
ucacuggugguuuuccg

SEQ ID NO: 1337057 - RNA, 23 nt, Homo sapiens
ucacuguagaaugauuucaugcu

SEQ ID NO: 1337058 - RNA, 17 nt, Homo sapiens
ucacuuauuuagauuca

SEQ ID NO: 1337059 - RNA, 14 nt, Homo sapiens
ucacuucauucaca

SEQ ID NO: 1337060 - RNA, 21 nt, Homo sapiens
ucacuuuuugaggcaaaagaa

SEQ ID NO: 1337061 - RNA, 13 nt, Homo sapiens
ucagacacagcuc

SEQ ID NO: 1337062 - RNA, 15 nt, Homo sapiens
ucagacccaacagca

SEQ ID NO: 1337063 - RNA, 14 nt, Homo sapiens
ucagaccugcauug

SEQ ID NO: 1337064 - RNA, 20 nt, Homo sapiens
ucagacugauagacaccaua

SEQ ID NO: 1337065 - RNA, 22 nt, Homo sapiens
ucagacuggcccuuaagccaaa

SEQ ID NO: 1337066 - RNA, 16 nt, Homo sapiens
ucagagaauuaucuca

SEQ ID NO: 1337067 - RNA, 15 nt, Homo sapiens
ucagagagguagcac

SEQ ID NO: 1337068 - RNA, 18 nt, Homo sapiens
ucagaguggaccccguca

SEQ ID NO: 1337069 - RNA, 18 nt, Homo sapiens
ucagauuauaacuguugu

SEQ ID NO: 1337070 - RNA, 12 nt, Homo sapiens
ucagauuugccu

SEQ ID NO: 1337071 - RNA, 21 nt, Homo sapiens
ucagauuuuuuccucugcauu

SEQ ID NO: 1337072 - RNA, 20 nt, Homo sapiens
ucagcaacccuacaguauau

SEQ ID NO: 1337073 - RNA, 13 nt, Homo sapiens
ucagcaagcauuu

SEQ ID NO: 1337074 - RNA, 19 nt, Homo sapiens
ucagcacguguggccuguu

SEQ ID NO: 1337075 - RNA, 22 nt, Homo sapiens
ucagcagaugcuguugugaagc

SEQ ID NO: 1337076 - RNA, 18 nt, Homo sapiens
ucagcauucucacuccua

SEQ ID NO: 1337077 - RNA, 20 nt, Homo sapiens
ucagccaauccgauugccuu

SEQ ID NO: 1337078 - RNA, 21 nt, Homo sapiens
ucagccaauccgauugccuua

SEQ ID NO: 1337079 - RNA, 16 nt, Homo sapiens
ucagcccagugcaaac

SEQ ID NO: 1337080 - RNA, 14 nt, Homo sapiens
ucagccccacagga

SEQ ID NO: 1337081 - RNA, 16 nt, Homo sapiens
ucagccccacaggacu

SEQ ID NO: 1337082 - RNA, 16 nt, Homo sapiens
ugcuuuucccauugcc

SEQ ID NO: 1337083 - RNA, 16 nt, Homo sapiens
ugcuuuuccuuugaau

SEQ ID NO: 1337084 - RNA, 19 nt, Homo sapiens
ugcuuuucugccacuccau

SEQ ID NO: 1337085 - RNA, 13 nt, Homo sapiens
ugcuuuuggcaga

SEQ ID NO: 1337086 - RNA, 18 nt, Homo sapiens
uggaaaaugcaaaagcac

SEQ ID NO: 1337087 - RNA, 12 nt, Homo sapiens
uggaaacagcau

SEQ ID NO: 1337088 - RNA, 13 nt, Homo sapiens
uggaaagucacag

SEQ ID NO: 1337089 - RNA, 14 nt, Homo sapiens
uggaaauaaaguca

SEQ ID NO: 1337090 - RNA, 21 nt, Homo sapiens
uggaaauaaagucagauggaa

SEQ ID NO: 1337091 - RNA, 19 nt, Homo sapiens
uggaaaucagacuuuuaca

SEQ ID NO: 1337092 - RNA, 14 nt, Homo sapiens
uggaacaagcacag

SEQ ID NO: 1337093 - RNA, 15 nt, Homo sapiens
uggaacccagacuca

SEQ ID NO: 1337094 - RNA, 20 nt, Homo sapiens
uggaaccucagccuggccag

SEQ ID NO: 1337095 - RNA, 23 nt, Homo sapiens
uggaacguuucacugcaaacaca

SEQ ID NO: 1337096 - RNA, 15 nt, Homo sapiens
uggaagaagaaagga

SEQ ID NO: 1337097 - RNA, 12 nt, Homo sapiens
uggaagauggca

SEQ ID NO: 1337098 - RNA, 16 nt, Homo sapiens
uggaaguuguugcuau

SEQ ID NO: 1337099 - RNA, 20 nt, Homo sapiens
uggaauaaaguugcagauga

SEQ ID NO: 1337100 - RNA, 15 nt, Homo sapiens
uggaauacacaugca

SEQ ID NO: 1337101 - RNA, 17 nt, Homo sapiens
uggaauccuauauagaa

SEQ ID NO: 1337102 - RNA, 20 nt, Homo sapiens
uggaaugccgcugucucuga

SEQ ID NO: 1337103 - RNA, 22 nt, Homo sapiens
uggaaugccgcugucucugagg

SEQ ID NO: 1337104 - RNA, 11 nt, Homo sapiens
uggacacugag

SEQ ID NO: 1337105 - RNA, 13 nt, Homo sapiens
uggacacugagag

SEQ ID NO: 1337106 - RNA, 15 nt, Homo sapiens
uggacauaacauuuu

SEQ ID NO: 1337107 - RNA, 14 nt, Homo sapiens
uggacaucuuguca

SEQ ID NO: 1337108 - RNA, 15 nt, Homo sapiens
uggacaucuugucau

SEQ ID NO: 1337109 - RNA, 16 nt, Homo sapiens
uggaccgagguuccca

SEQ ID NO: 1337110 - RNA, 16 nt, Homo sapiens
uggagaagaggaagac

SEQ ID NO: 1337111 - RNA, 21 nt, Homo sapiens
uggagaaggucacaacccuuc

SEQ ID NO: 1337112 - RNA, 17 nt, Homo sapiens
uggagacaaggugcuaa

SEQ ID NO: 1337113 - RNA, 20 nt, Homo sapiens
uggagacaaggugcuaacau

SEQ ID NO: 1337114 - RNA, 23 nt, Homo sapiens
uggagacacccucuggggguccu

SEQ ID NO: 1337115 - RNA, 20 nt, Homo sapiens
uggagagggaaaaucuucac

SEQ ID NO: 1337116 - RNA, 23 nt, Homo sapiens
uggagagucagaucuuucuccuu

SEQ ID NO: 1337117 - RNA, 11 nt, Homo sapiens
uggagcaauaa

SEQ ID NO: 1337118 - RNA, 23 nt, Homo sapiens
uggagccuaccucugucugagac

SEQ ID NO: 1337119 - RNA, 20 nt, Homo sapiens
uggagccugggcauccucag

SEQ ID NO: 1337120 - RNA, 17 nt, Homo sapiens
uggagcuaaaacuggcc

SEQ ID NO: 1337121 - RNA, 18 nt, Homo sapiens
uggagcuaaaacuggccc

SEQ ID NO: 1337122 - RNA, 21 nt, Homo sapiens
uggaggaccuggcgugcucag

SEQ ID NO: 1337123 - RNA, 22 nt, Homo sapiens
uggaggcccaguucacccugau

SEQ ID NO: 1337124 - RNA, 13 nt, Homo sapiens
uggaggggaugau

SEQ ID NO: 1337125 - RNA, 21 nt, Homo sapiens
uggagguuuguuuagaagaag

SEQ ID NO: 1337126 - RNA, 16 nt, Homo sapiens
uggaguaaguauuuag

SEQ ID NO: 1337127 - RNA, 17 nt, Homo sapiens
uggagugacgcaucucc

SEQ ID NO: 1337128 - RNA, 15 nt, Homo sapiens
uggagugcucacaaa

SEQ ID NO: 1337129 - RNA, 22 nt, Homo sapiens
uggaguggcugccauggaagga

SEQ ID NO: 1337130 - RNA, 14 nt, Homo sapiens
uggaguuguucaaa

SEQ ID NO: 1337131 - RNA, 22 nt, Homo sapiens
uggauacagcugcuuugagcua

SEQ ID NO: 1337132 - RNA, 13 nt, Homo sapiens
uggaucagcauuu

SEQ ID NO: 1337133 - RNA, 12 nt, Homo sapiens
uggaucugugag

SEQ ID NO: 1337134 - RNA, 20 nt, Homo sapiens
uggaugcugugaagagucua

SEQ ID NO: 1337135 - RNA, 16 nt, Homo sapiens
uggauguacuuaagag

SEQ ID NO: 1337136 - RNA, 14 nt, Homo sapiens
uggauugggguccc

SEQ ID NO: 1337137 - RNA, 20 nt, Homo sapiens
uggcaauauuccuuagucaa

SEQ ID NO: 1337138 - RNA, 16 nt, Homo sapiens
uggcaccccuuucuag

SEQ ID NO: 1337139 - RNA, 15 nt, Homo sapiens
uggcacucagucucu

SEQ ID NO: 1337140 - RNA, 15 nt, Homo sapiens
uggcagaaccaaagc

SEQ ID NO: 1337141 - RNA, 20 nt, Homo sapiens
uggcagagaagaugaaauuu

SEQ ID NO: 1337142 - RNA, 16 nt, Homo sapiens
uggcagccgugccuuc

SEQ ID NO: 1337143 - RNA, 15 nt, Homo sapiens
uggcauaaccugucu

SEQ ID NO: 1337144 - RNA, 16 nt, Homo sapiens
uggcauagccccggcc

SEQ ID NO: 1337145 - RNA, 18 nt, Homo sapiens
uggcaucaagggagacac

SEQ ID NO: 1337146 - RNA, 18 nt, Homo sapiens
uggcaucucuuucugcaa

SEQ ID NO: 1337147 - RNA, 18 nt, Homo sapiens
uggccaaggagcugcuau

SEQ ID NO: 1337148 - RNA, 21 nt, Homo sapiens
uggccaaugagaucauuguga

SEQ ID NO: 1337149 - RNA, 15 nt, Homo sapiens
uggccaucuaaacau

SEQ ID NO: 1337150 - RNA, 15 nt, Homo sapiens
uggccgacucaggga

SEQ ID NO: 1337151 - RNA, 14 nt, Homo sapiens
uggccgggcagggu

SEQ ID NO: 1337152 - RNA, 15 nt, Homo sapiens
uggccucccacagac

SEQ ID NO: 1337153 - RNA, 23 nt, Homo sapiens
uggccucuugaguuccucugcag

SEQ ID NO: 1337154 - RNA, 14 nt, Homo sapiens
uggccugucuuugg

SEQ ID NO: 1337155 - RNA, 22 nt, Homo sapiens
uggccuguucuucuauggguug

SEQ ID NO: 1337156 - RNA, 12 nt, Homo sapiens
uggccuuugaau

SEQ ID NO: 1337157 - RNA, 14 nt, Homo sapiens
uggcuaacuggcga

SEQ ID NO: 1337158 - RNA, 16 nt, Homo sapiens
uggcucacaccuguaa

SEQ ID NO: 1337159 - RNA, 12 nt, Homo sapiens
uggcucaucucu

SEQ ID NO: 1337160 - RNA, 14 nt, Homo sapiens
uggcucaucucuuu

SEQ ID NO: 1337161 - RNA, 21 nt, Homo sapiens
uggcucaugccuguaaucuca

SEQ ID NO: 1337162 - RNA, 22 nt, Homo sapiens
uggcucaugccuguaaucucag

SEQ ID NO: 1337163 - RNA, 18 nt, Homo sapiens
uggcuccacccucuuuag

SEQ ID NO: 1337164 - RNA, 16 nt, Homo sapiens
uggcucucauguacuu

SEQ ID NO: 1337165 - RNA, 19 nt, Homo sapiens
uggcugccaacaugauccc

SEQ ID NO: 1337166 - RNA, 13 nt, Homo sapiens
uggcugcccagga

SEQ ID NO: 1337167 - RNA, 23 nt, Homo sapiens
uggcuggucuucacuuuccucag

SEQ ID NO: 1337168 - RNA, 13 nt, Homo sapiens
uggcugucccugu

SEQ ID NO: 1337169 - RNA, 22 nt, Homo sapiens
uggcugugagggguguuuggga

SEQ ID NO: 1337170 - RNA, 16 nt, Homo sapiens
uggcugugcacuuacc

SEQ ID NO: 1337171 - RNA, 16 nt, Homo sapiens
uggcuuggaggacaaa

SEQ ID NO: 1337172 - RNA, 17 nt, Homo sapiens
uggcuuuaugcaaauac

SEQ ID NO: 1337173 - RNA, 14 nt, Homo sapiens
ugggaaaaccagac

SEQ ID NO: 1337174 - RNA, 15 nt, Homo sapiens
ugggaaccacuccca

SEQ ID NO: 1337175 - RNA, 17 nt, Homo sapiens
ugggaagcaggagccca

SEQ ID NO: 1337176 - RNA, 13 nt, Homo sapiens
ugggacagccauu

SEQ ID NO: 1337177 - RNA, 17 nt, Homo sapiens
ugggagaaugucaguau

SEQ ID NO: 1337178 - RNA, 15 nt, Homo sapiens
ugggagcuuauugcu

SEQ ID NO: 1337179 - RNA, 21 nt, Homo sapiens
ugggaggcagagguugcagug

SEQ ID NO: 1337180 - RNA, 17 nt, Homo sapiens
ugggauaguguucugcu

SEQ ID NO: 1337181 - RNA, 15 nt, Homo sapiens
ugggauuacagaucu

SEQ ID NO: 1337182 - RNA, 13 nt, Homo sapiens
ugggauuacaggg

SEQ ID NO: 1337183 - RNA, 19 nt, Homo sapiens
ugggcaaagggaaguaaca

SEQ ID NO: 1337184 - RNA, 12 nt, Homo sapiens
ugggcacugggg

SEQ ID NO: 1337185 - RNA, 12 nt, Homo sapiens
ugggcagggaug

SEQ ID NO: 1337186 - RNA, 18 nt, Homo sapiens
ugggcaggguacagacac

SEQ ID NO: 1337187 - RNA, 22 nt, Homo sapiens
ugggccacucaggggucauuca

SEQ ID NO: 1337188 - RNA, 16 nt, Homo sapiens
ugggccagacaugcca

SEQ ID NO: 1337189 - RNA, 22 nt, Homo sapiens
ugggcccuuggaaaaacaggaa

SEQ ID NO: 1337190 - RNA, 15 nt, Homo sapiens
ugggcggcacagccu

SEQ ID NO: 1337191 - RNA, 16 nt, Homo sapiens
ugggcggcacagccuu

SEQ ID NO: 1337192 - RNA, 17 nt, Homo sapiens
ugggcucuaaauccauu

SEQ ID NO: 1337193 - RNA, 23 nt, Homo sapiens
ugggcucugccuuaaacacacau

SEQ ID NO: 1337194 - RNA, 23 nt, Homo sapiens
ugggcugcccaccuggcugccaa

SEQ ID NO: 1337195 - RNA, 15 nt, Homo sapiens
ugggcugggccugug

SEQ ID NO: 1337196 - RNA, 18 nt, Homo sapiens
ugggcuggggccucagac

SEQ ID NO: 1337197 - RNA, 15 nt, Homo sapiens
uggggaacacagcua

SEQ ID NO: 1337198 - RNA, 13 nt, Homo sapiens
uggggccauaaac

SEQ ID NO: 1337199 - RNA, 14 nt, Homo sapiens
uggggccaugccuc

SEQ ID NO: 1337200 - RNA, 20 nt, Homo sapiens
uggggcggguggggccauaa

SEQ ID NO: 1337201 - RNA, 15 nt, Homo sapiens
ugggggaacacugag

SEQ ID NO: 1337202 - RNA, 16 nt, Homo sapiens
ugggggaacacugaga

SEQ ID NO: 1337203 - RNA, 19 nt, Homo sapiens
ugggggagguccaagcaga

SEQ ID NO: 1337204 - RNA, 14 nt, Homo sapiens
uggggggacugccu

SEQ ID NO: 1337205 - RNA, 21 nt, Homo sapiens
ugggggugccgcuuucucuga

SEQ ID NO: 1337206 - RNA, 20 nt, Homo sapiens
ugggggugcucucucugagg

SEQ ID NO: 1337207 - RNA, 14 nt, Homo sapiens
ugggguggggucau

SEQ ID NO: 1337208 - RNA, 14 nt, Homo sapiens
ugggucuaugccuu

SEQ ID NO: 1337209 - RNA, 13 nt, Homo sapiens
ugggugacauuug

SEQ ID NO: 1337210 - RNA, 23 nt, Homo sapiens
ugggugauguagagauuuaccug

SEQ ID NO: 1337211 - RNA, 20 nt, Homo sapiens
uggguucacagaucuuucug

SEQ ID NO: 1337212 - RNA, 20 nt, Homo sapiens
ugguaauauugacuuguaua

SEQ ID NO: 1337213 - RNA, 19 nt, Homo sapiens
ugguaaugaaggacaguga

SEQ ID NO: 1337214 - RNA, 16 nt, Homo sapiens
ugcaaugacacagucu

SEQ ID NO: 1337215 - RNA, 15 nt, Homo sapiens
ugcaauguggugaca

SEQ ID NO: 1337216 - RNA, 19 nt, Homo sapiens
ugcacaacagaguaacuau

SEQ ID NO: 1337217 - RNA, 21 nt, Homo sapiens
ugcacacucauacacaugugc

SEQ ID NO: 1337218 - RNA, 15 nt, Homo sapiens
aaagcacugacuucu

SEQ ID NO: 1337219 - RNA, 12 nt, Homo sapiens
aaagcagcaacu

SEQ ID NO: 1337220 - RNA, 20 nt, Homo sapiens
aaagcaguggcuccauuggu

SEQ ID NO: 1337221 - RNA, 20 nt, Homo sapiens
aaagcaucaauacaaccagc

SEQ ID NO: 1337222 - RNA, 23 nt, Homo sapiens
aaagcauuuuguaauaauaaaga

SEQ ID NO: 1337223 - RNA, 16 nt, Homo sapiens
aaagccauaacuugaa

SEQ ID NO: 1337224 - RNA, 19 nt, Homo sapiens
aaagccccucacacugcaa

SEQ ID NO: 1337225 - RNA, 11 nt, Homo sapiens
aaagcccuccc

SEQ ID NO: 1337226 - RNA, 18 nt, Homo sapiens
aaagcccucccuaccuac

SEQ ID NO: 1337227 - RNA, 17 nt, Homo sapiens
aaagcguuugcauuugc

SEQ ID NO: 1337228 - RNA, 21 nt, Homo sapiens
aaagcuggugucugauuuugg

SEQ ID NO: 1337229 - RNA, 22 nt, Homo sapiens
aaagcuuuauuaccaguggcgu

SEQ ID NO: 1337230 - RNA, 14 nt, Homo sapiens
aaaggaagaguuau

SEQ ID NO: 1337231 - RNA, 22 nt, Homo sapiens
aaaggacaucagcaaacaggau

SEQ ID NO: 1337232 - RNA, 21 nt, Homo sapiens
aaaggagagagagagagagua

SEQ ID NO: 1337233 - RNA, 17 nt, Homo sapiens
aaaggauuguuaauguu

SEQ ID NO: 1337234 - RNA, 18 nt, Homo sapiens
aaaggauuuuaccaaagc

SEQ ID NO: 1337235 - RNA, 17 nt, Homo sapiens
aaaggcagggcaagaac

SEQ ID NO: 1337236 - RNA, 13 nt, Homo sapiens
aaaggcaguuuuc

SEQ ID NO: 1337237 - RNA, 21 nt, Homo sapiens
aaaggccugcccugaugcucu

SEQ ID NO: 1337238 - RNA, 14 nt, Homo sapiens
aaagggacuaccuc

SEQ ID NO: 1337239 - RNA, 20 nt, Homo sapiens
aaagguugaguaugugaaga

SEQ ID NO: 1337240 - RNA, 17 nt, Homo sapiens
aaaguaaauacaugcau

SEQ ID NO: 1337241 - RNA, 13 nt, Homo sapiens
aaaguaaugacuu

SEQ ID NO: 1337242 - RNA, 12 nt, Homo sapiens
aaaguagggaug

SEQ ID NO: 1337243 - RNA, 16 nt, Homo sapiens
aaaguauaaaauagua

SEQ ID NO: 1337244 - RNA, 15 nt, Homo sapiens
aaaguauucuagugu

SEQ ID NO: 1337245 - RNA, 15 nt, Homo sapiens
aaagugaucuugaga

SEQ ID NO: 1337246 - RNA, 9 nt, Homo sapiens
aaagugaug

SEQ ID NO: 1337247 - RNA, 18 nt, Homo sapiens
aaagugaugauacuguaa

SEQ ID NO: 1337248 - RNA, 20 nt, Homo sapiens
aaagugcuugaggcuaccuc

SEQ ID NO: 1337249 - RNA, 18 nt, Homo sapiens
aaaguggguuuucccugg

SEQ ID NO: 1337250 - RNA, 22 nt, Homo sapiens
aaagugucaccccucacuguga

SEQ ID NO: 1337251 - RNA, 23 nt, Homo sapiens
aaaguuaugguacuauguuagcc

SEQ ID NO: 1337252 - RNA, 22 nt, Homo sapiens
aaaguucagggaccguccaggg

SEQ ID NO: 1337253 - RNA, 21 nt, Homo sapiens
aaaguucucuguggcaaagca

SEQ ID NO: 1337254 - RNA, 19 nt, Homo sapiens
aaaguugccuuuauuugcu

SEQ ID NO: 1337255 - RNA, 13 nt, Homo sapiens
aaauaaaacugag

SEQ ID NO: 1337256 - RNA, 14 nt, Homo sapiens
aaauaaacaucagu

SEQ ID NO: 1337257 - RNA, 22 nt, Homo sapiens
aaauaaauauugaugugguaua

SEQ ID NO: 1337258 - RNA, 15 nt, Homo sapiens
aaauaacugaaccaa

SEQ ID NO: 1337259 - RNA, 14 nt, Homo sapiens
aaauaauucuuccu

SEQ ID NO: 1337260 - RNA, 16 nt, Homo sapiens
aaauaauucuuccucu

SEQ ID NO: 1337261 - RNA, 23 nt, Homo sapiens
aaauaccacaugauuuuacucau

SEQ ID NO: 1337262 - RNA, 23 nt, Homo sapiens
aaauaccgagggaucaaucugca

SEQ ID NO: 1337263 - RNA, 14 nt, Homo sapiens
aaauacgugucaaa

SEQ ID NO: 1337264 - RNA, 18 nt, Homo sapiens
aaauacuuuauagcacau

SEQ ID NO: 1337265 - RNA, 15 nt, Homo sapiens
aaauaggauccugga

SEQ ID NO: 1337266 - RNA, 14 nt, Homo sapiens
aaauaggugagaua

SEQ ID NO: 1337267 - RNA, 22 nt, Homo sapiens
aaauauauaugcauaccuggau

SEQ ID NO: 1337268 - RNA, 21 nt, Homo sapiens
aaauaucaaagucauuaaaga

SEQ ID NO: 1337269 - RNA, 18 nt, Homo sapiens
aaauauuacucaguuuau

SEQ ID NO: 1337270 - RNA, 18 nt, Homo sapiens
aaauauuauuagauuuau

SEQ ID NO: 1337271 - RNA, 13 nt, Homo sapiens
aaauauuccugca

SEQ ID NO: 1337272 - RNA, 18 nt, Homo sapiens
aaauauuugcuaugaagc

SEQ ID NO: 1337273 - RNA, 13 nt, Homo sapiens
aaauauuuugcua

SEQ ID NO: 1337274 - RNA, 15 nt, Homo sapiens
aaaucaauaaauucc

SEQ ID NO: 1337275 - RNA, 19 nt, Homo sapiens
aaaucaaucaagacugcaa

SEQ ID NO: 1337276 - RNA, 19 nt, Homo sapiens
aaaucaauuauugaaacag

SEQ ID NO: 1337277 - RNA, 22 nt, Homo sapiens
aaaucagagagggaagaucugg

SEQ ID NO: 1337278 - RNA, 14 nt, Homo sapiens
aaaucauuucugca

SEQ ID NO: 1337279 - RNA, 17 nt, Homo sapiens
aaauccagaaguuuuaa

SEQ ID NO: 1337280 - RNA, 19 nt, Homo sapiens
aaaucucuucaaauucuuc

SEQ ID NO: 1337281 - RNA, 18 nt, Homo sapiens
aaaucuucccaguauuau

SEQ ID NO: 1337282 - RNA, 16 nt, Homo sapiens
aaaugaaacuuggcca

SEQ ID NO: 1337283 - RNA, 24 nt, Homo sapiens
aaaugaaagugaugauacuguaac

SEQ ID NO: 1337284 - RNA, 14 nt, Homo sapiens
aaaugaccucaagg

SEQ ID NO: 1337285 - RNA, 22 nt, Homo sapiens
aaaugacgguguuaauuuugcu

SEQ ID NO: 1337286 - RNA, 13 nt, Homo sapiens
aaaugauccugcc

SEQ ID NO: 1337287 - RNA, 21 nt, Homo sapiens
aaaugcagcagggaugcccug

SEQ ID NO: 1337288 - RNA, 14 nt, Homo sapiens
aaaugccugacuca

SEQ ID NO: 1337289 - RNA, 17 nt, Homo sapiens
aaaugcucaauuucagc

SEQ ID NO: 1337290 - RNA, 20 nt, Homo sapiens
aaauggaggaucucuaaaga

SEQ ID NO: 1337291 - RNA, 19 nt, Homo sapiens
aaauggcccggacaugucu

SEQ ID NO: 1337292 - RNA, 14 nt, Homo sapiens
aaauggcuaugaac

SEQ ID NO: 1337293 - RNA, 18 nt, Homo sapiens
aaaugggaaaaccagacu

SEQ ID NO: 1337294 - RNA, 13 nt, Homo sapiens
aaauggggccaga

SEQ ID NO: 1337295 - RNA, 21 nt, Homo sapiens
aaauggggccagauccagccu

SEQ ID NO: 1337296 - RNA, 22 nt, Homo sapiens
aaaugggggcaggaaagccaca

SEQ ID NO: 1337297 - RNA, 22 nt, Homo sapiens
aaauggugcugcagauuugaua

SEQ ID NO: 1337298 - RNA, 21 nt, Homo sapiens
aaaugguuaaauuuuacauga

SEQ ID NO: 1337299 - RNA, 18 nt, Homo sapiens
aaauguaaaagcacauga

SEQ ID NO: 1337300 - RNA, 15 nt, Homo sapiens
aaauguaauagccaa

SEQ ID NO: 1337301 - RNA, 14 nt, Homo sapiens
aaauguauacuaua

SEQ ID NO: 1337302 - RNA, 15 nt, Homo sapiens
aaauguauacuauag

SEQ ID NO: 1337303 - RNA, 13 nt, Homo sapiens
aaaugugacucag

SEQ ID NO: 1337304 - RNA, 20 nt, Homo sapiens
aaaugugcacuuuauccuca

SEQ ID NO: 1337305 - RNA, 18 nt, Homo sapiens
aaauguuaugacuaugua

SEQ ID NO: 1337306 - RNA, 17 nt, Homo sapiens
aaauguucuaacagauc

SEQ ID NO: 1337307 - RNA, 14 nt, Homo sapiens
aaauuaaacauauu

SEQ ID NO: 1337308 - RNA, 22 nt, Homo sapiens
aaauuauuguuaaagaauacac

SEQ ID NO: 1337309 - RNA, 15 nt, Homo sapiens
aaauuauuuaucaag

SEQ ID NO: 1337310 - RNA, 15 nt, Homo sapiens
aaauuauuucucuca

SEQ ID NO: 1337311 - RNA, 15 nt, Homo sapiens
aaauucaaaccauuu

SEQ ID NO: 1337312 - RNA, 14 nt, Homo sapiens
aaauucaggucugu

SEQ ID NO: 1337313 - RNA, 20 nt, Homo sapiens
aaauucauggugcacugagc

SEQ ID NO: 1337314 - RNA, 18 nt, Homo sapiens
aaauugggaaaacuccau

SEQ ID NO: 1337315 - RNA, 22 nt, Homo sapiens
aaauuuauaaaggucugcacuc

SEQ ID NO: 1337316 - RNA, 18 nt, Homo sapiens
aaauuugauaaacugaau

SEQ ID NO: 1337317 - RNA, 15 nt, Homo sapiens
aaauuuuuaggcaaa

SEQ ID NO: 1337318 - RNA, 12 nt, Homo sapiens
aacaaagacagg

SEQ ID NO: 1337319 - RNA, 19 nt, Homo sapiens
aacaaauauguucucugaa

SEQ ID NO: 1337320 - RNA, 20 nt, Homo sapiens
aacaacguugcuauuuccac

SEQ ID NO: 1337321 - RNA, 17 nt, Homo sapiens
aacaagacuggcucuuu

SEQ ID NO: 1337322 - RNA, 12 nt, Homo sapiens
aacaagcugugc

SEQ ID NO: 1337323 - RNA, 15 nt, Homo sapiens
aacaauaaagcaaua

SEQ ID NO: 1337324 - RNA, 14 nt, Homo sapiens
aacaaugaccuuua

SEQ ID NO: 1337325 - RNA, 16 nt, Homo sapiens
aacaauuacuggcuca

SEQ ID NO: 1337326 - RNA, 14 nt, Homo sapiens
aacaauucugugac

SEQ ID NO: 1337327 - RNA, 19 nt, Homo sapiens
aacacacccaaacacacca

SEQ ID NO: 1337328 - RNA, 23 nt, Homo sapiens
aacacagcuuacaaucgcaaauc

SEQ ID NO: 1337329 - RNA, 13 nt, Homo sapiens
aacacauuuccau

SEQ ID NO: 1337330 - RNA, 18 nt, Homo sapiens
aacaccgcuucugccuuu

SEQ ID NO: 1337331 - RNA, 21 nt, Homo sapiens
aacacgagcaggcuacuguca

SEQ ID NO: 1337332 - RNA, 17 nt, Homo sapiens
aacacguggagauggaa

SEQ ID NO: 1337333 - RNA, 14 nt, Homo sapiens
aacacuaacuuaau

SEQ ID NO: 1337334 - RNA, 23 nt, Homo sapiens
aacacugaaaugaaaucuuccca

SEQ ID NO: 1337335 - RNA, 10 nt, Homo sapiens
aacacugaga

SEQ ID NO: 1337336 - RNA, 22 nt, Homo sapiens
aacagaaagccugggugacauu

SEQ ID NO: 1337337 - RNA, 21 nt, Homo sapiens
aacagcaccuccccgcuggga

SEQ ID NO: 1337338 - RNA, 16 nt, Homo sapiens
aacagcaguggaguaa

SEQ ID NO: 1337339 - RNA, 14 nt, Homo sapiens
aacagcaugaauaa

SEQ ID NO: 1337340 - RNA, 14 nt, Homo sapiens
aacaggcuugaauc

SEQ ID NO: 1337341 - RNA, 17 nt, Homo sapiens
aacaggcuuggcaaaga

SEQ ID NO: 1337342 - RNA, 14 nt, Homo sapiens
aacagucucaggaa

SEQ ID NO: 1337343 - RNA, 21 nt, Homo sapiens
aacagugacuugauugccaag

SEQ ID NO: 1337344 - RNA, 14 nt, Homo sapiens
aacaguggacaaag

SEQ ID NO: 1337345 - RNA, 23 nt, Homo sapiens
aacagugggcguugggagccuag

SEQ ID NO: 1337346 - RNA, 18 nt, Homo sapiens
aacagugucauauacaau

SEQ ID NO: 1337347 - RNA, 23 nt, Homo sapiens
aacagugucauauacaauuguca

SEQ ID NO: 1337348 - RNA, 19 nt, Homo sapiens
aacauaaacacauuuccau

SEQ ID NO: 1337349 - RNA, 22 nt, Homo sapiens
aacauaauaaaucacacauuca

SEQ ID NO: 1337350 - RNA, 20 nt, Homo sapiens
cauaaguuuaggauaaaaua

SEQ ID NO: 1337351 - RNA, 15 nt, Homo sapiens
cauacauauuaucuc

SEQ ID NO: 1337352 - RNA, 16 nt, Homo sapiens
cauacauauuaucuca

SEQ ID NO: 1337353 - RNA, 17 nt, Homo sapiens
cauacauauuaucucau

SEQ ID NO: 1337354 - RNA, 22 nt, Homo sapiens
cauacuacaguaacugugacug

SEQ ID NO: 1337355 - RNA, 23 nt, Homo sapiens
cauacuacaguaacugugacuga

SEQ ID NO: 1337356 - RNA, 16 nt, Homo sapiens
cauacuuaaugcauau

SEQ ID NO: 1337357 - RNA, 11 nt, Homo sapiens
cauacuuuuca

SEQ ID NO: 1337358 - RNA, 22 nt, Homo sapiens
cauagagaauauaaaaauaaag

SEQ ID NO: 1337359 - RNA, 17 nt, Homo sapiens
cauagcaccuaacaaca

SEQ ID NO: 1337360 - RNA, 14 nt, Homo sapiens
cauaggcucuuaag

SEQ ID NO: 1337361 - RNA, 19 nt, Homo sapiens
cauagugauagagugcagu

SEQ ID NO: 1337362 - RNA, 20 nt, Homo sapiens
cauauaacgcagucuaauua

SEQ ID NO: 1337363 - RNA, 18 nt, Homo sapiens
cauauaacgucaugugca

SEQ ID NO: 1337364 - RNA, 22 nt, Homo sapiens
cauauagaccaauugaagcaug

SEQ ID NO: 1337365 - RNA, 17 nt, Homo sapiens
cauaucccuuccucuca

SEQ ID NO: 1337366 - RNA, 17 nt, Homo sapiens
cauaugauuguccguga

SEQ ID NO: 1337367 - RNA, 23 nt, Homo sapiens
cauauggguaguuaugggguuua

SEQ ID NO: 1337368 - RNA, 21 nt, Homo sapiens
cauauguuguguuugguucaa

SEQ ID NO: 1337369 - RNA, 15 nt, Homo sapiens
cauauuugaaaacca

SEQ ID NO: 1337370 - RNA, 14 nt, Homo sapiens
caucaauacaacca

SEQ ID NO: 1337371 - RNA, 19 nt, Homo sapiens
caucagacugucaagaaga

SEQ ID NO: 1337372 - RNA, 20 nt, Homo sapiens
caucaggcuaagacccugug

SEQ ID NO: 1337373 - RNA, 23 nt, Homo sapiens
caucagucaacagagaggggcag

SEQ ID NO: 1337374 - RNA, 18 nt, Homo sapiens
caucagucuccaacaugu

SEQ ID NO: 1337375 - RNA, 16 nt, Homo sapiens
caucaugaugaugaua

SEQ ID NO: 1337376 - RNA, 14 nt, Homo sapiens
caucauuucugucu

SEQ ID NO: 1337377 - RNA, 19 nt, Homo sapiens
cauccacauaacccuguca

SEQ ID NO: 1337378 - RNA, 13 nt, Homo sapiens
cauccacuuuaug

SEQ ID NO: 1337379 - RNA, 19 nt, Homo sapiens
cauccacuuuaugugcauc

SEQ ID NO: 1337380 - RNA, 15 nt, Homo sapiens
cauccagguuuauga

SEQ ID NO: 1337381 - RNA, 17 nt, Homo sapiens
cauccauagcaccucca

SEQ ID NO: 1337382 - RNA, 15 nt, Homo sapiens
cauccauccaaaggc

SEQ ID NO: 1337383 - RNA, 14 nt, Homo sapiens
caucccuagucucu

SEQ ID NO: 1337384 - RNA, 14 nt, Homo sapiens
caucccugccugga

SEQ ID NO: 1337385 - RNA, 17 nt, Homo sapiens
caucccuuaguuuccac

SEQ ID NO: 1337386 - RNA, 20 nt, Homo sapiens
cauccgcaaauuuucuucca

SEQ ID NO: 1337387 - RNA, 22 nt, Homo sapiens
cauccugcuugacuguaacaaa

SEQ ID NO: 1337388 - RNA, 22 nt, Homo sapiens
caucgaggagcuagaacauucc

SEQ ID NO: 1337389 - RNA, 21 nt, Homo sapiens
caucuagcaaccgccucaaaa

SEQ ID NO: 1337390 - RNA, 18 nt, Homo sapiens
caucucuccccauauaua

SEQ ID NO: 1337391 - RNA, 22 nt, Homo sapiens
caucucuggccuguacccagua

SEQ ID NO: 1337392 - RNA, 23 nt, Homo sapiens
caucucuuuaccuccuaauucca

SEQ ID NO: 1337393 - RNA, 16 nt, Homo sapiens
caucucuuucugcaaa

SEQ ID NO: 1337394 - RNA, 21 nt, Homo sapiens
caucugaaaguagagguugua

SEQ ID NO: 1337395 - RNA, 14 nt, Homo sapiens
caucugcugcaguu

SEQ ID NO: 1337396 - RNA, 19 nt, Homo sapiens
caucuuagagguccaugga

SEQ ID NO: 1337397 - RNA, 15 nt, Homo sapiens
caucuuccaccucac

SEQ ID NO: 1337398 - RNA, 17 nt, Homo sapiens
caucuucccacaguggc

SEQ ID NO: 1337399 - RNA, 21 nt, Homo sapiens
caucuuuuuaaccugcaaaau

SEQ ID NO: 1337400 - RNA, 18 nt, Homo sapiens
caugaaaggaagaguuau

SEQ ID NO: 1337401 - RNA, 14 nt, Homo sapiens
caugaagcaagaau

SEQ ID NO: 1337402 - RNA, 14 nt, Homo sapiens
caugaagugcacag

SEQ ID NO: 1337403 - RNA, 17 nt, Homo sapiens
caugacaaguacuguau

SEQ ID NO: 1337404 - RNA, 19 nt, Homo sapiens
caugacauucuuagcugua

SEQ ID NO: 1337405 - RNA, 20 nt, Homo sapiens
caugacugcaugacggagcc

SEQ ID NO: 1337406 - RNA, 11 nt, Homo sapiens
caugacugugg

SEQ ID NO: 1337407 - RNA, 15 nt, Homo sapiens
caugagauaacucaa

SEQ ID NO: 1337408 - RNA, 16 nt, Homo sapiens
caugaggccaucucag

SEQ ID NO: 1337409 - RNA, 17 nt, Homo sapiens
caugaguuggcugggaa

SEQ ID NO: 1337410 - RNA, 18 nt, Homo sapiens
caugauuuuacucauaug

SEQ ID NO: 1337411 - RNA, 19 nt, Homo sapiens
caugcacuuuauguggaga

SEQ ID NO: 1337412 - RNA, 15 nt, Homo sapiens
caugcagaaauugac

SEQ ID NO: 1337413 - RNA, 17 nt, Homo sapiens
caugccaguaacugugc

SEQ ID NO: 1337414 - RNA, 16 nt, Homo sapiens
caugccuccucaggag

SEQ ID NO: 1337415 - RNA, 22 nt, Homo sapiens
caugccuguaauccuagcacuu

SEQ ID NO: 1337416 - RNA, 16 nt, Homo sapiens
caugcguccuggucaa

SEQ ID NO: 1337417 - RNA, 17 nt, Homo sapiens
caugcugccuggcacag

SEQ ID NO: 1337418 - RNA, 20 nt, Homo sapiens
caugcugcuggggaagacag

SEQ ID NO: 1337419 - RNA, 21 nt, Homo sapiens
caugcugcuggggaagacagu

SEQ ID NO: 1337420 - RNA, 14 nt, Homo sapiens
caugcugugcugug

SEQ ID NO: 1337421 - RNA, 21 nt, Homo sapiens
cauggaacagcauuacccucc

SEQ ID NO: 1337422 - RNA, 17 nt, Homo sapiens
cauggauauuugucaac

SEQ ID NO: 1337423 - RNA, 11 nt, Homo sapiens
cauggaucucu

SEQ ID NO: 1337424 - RNA, 16 nt, Homo sapiens
cauggcagauuugcaa

SEQ ID NO: 1337425 - RNA, 23 nt, Homo sapiens
cauggccaucuucuuucuuccac

SEQ ID NO: 1337426 - RNA, 14 nt, Homo sapiens
cauggguacagagg

SEQ ID NO: 1337427 - RNA, 19 nt, Homo sapiens
cauggguggcacucagucu

SEQ ID NO: 1337428 - RNA, 15 nt, Homo sapiens
cauggugaaauuaua

SEQ ID NO: 1337429 - RNA, 16 nt, Homo sapiens
cauggugccccaggac

SEQ ID NO: 1337430 - RNA, 16 nt, Homo sapiens
caugguucaaguauua

SEQ ID NO: 1337431 - RNA, 17 nt, Homo sapiens
cauguaaaaagugcagu

SEQ ID NO: 1337432 - RNA, 14 nt, Homo sapiens
cauguauugcacau

SEQ ID NO: 1337433 - RNA, 13 nt, Homo sapiens
cauguccagugag

SEQ ID NO: 1337434 - RNA, 21 nt, Homo sapiens
caugugacauuuauauauuga

SEQ ID NO: 1337435 - RNA, 11 nt, Homo sapiens
caugugccuuu

SEQ ID NO: 1337436 - RNA, 17 nt, Homo sapiens
cauguuaugcagugaac

SEQ ID NO: 1337437 - RNA, 24 nt, Homo sapiens
cauguuggccaggcuggucucaaa

SEQ ID NO: 1337438 - RNA, 18 nt, Homo sapiens
cauuaaaauaaaccaaau

SEQ ID NO: 1337439 - RNA, 18 nt, Homo sapiens
cauuaauauuuaccaaag

SEQ ID NO: 1337440 - RNA, 20 nt, Homo sapiens
cauuaguaucacaaaaccac

SEQ ID NO: 1337441 - RNA, 22 nt, Homo sapiens
cauuaucucaaaacugcacugu

SEQ ID NO: 1337442 - RNA, 15 nt, Homo sapiens
cauuaucucacuuag

SEQ ID NO: 1337443 - RNA, 16 nt, Homo sapiens
cauuaucuuaucauuu

SEQ ID NO: 1337444 - RNA, 22 nt, Homo sapiens
cauucacaguucuuugggccag

SEQ ID NO: 1337445 - RNA, 19 nt, Homo sapiens
cauucaggcaacgcacaaa

SEQ ID NO: 1337446 - RNA, 14 nt, Homo sapiens
cauuccaccuuccc

SEQ ID NO: 1337447 - RNA, 18 nt, Homo sapiens
cauuccagacugcuucca

SEQ ID NO: 1337448 - RNA, 12 nt, Homo sapiens
cauuccauuugc

SEQ ID NO: 1337449 - RNA, 22 nt, Homo sapiens
cauucccaagggagacugacca

SEQ ID NO: 1337450 - RNA, 21 nt, Homo sapiens
cauuccuaaucaaauucuguc

SEQ ID NO: 1337451 - RNA, 14 nt, Homo sapiens
cauuccuucccacc

SEQ ID NO: 1337452 - RNA, 20 nt, Homo sapiens
cauuccuuuuucuucacuua

SEQ ID NO: 1337453 - RNA, 14 nt, Homo sapiens
cauucuacugaaaa

SEQ ID NO: 1337454 - RNA, 13 nt, Homo sapiens
cauucuauucucc

SEQ ID NO: 1337455 - RNA, 15 nt, Homo sapiens
cauucuauucuccag

SEQ ID NO: 1337456 - RNA, 17 nt, Homo sapiens
cauucuguuagauacua

SEQ ID NO: 1337457 - RNA, 19 nt, Homo sapiens
cauucuugcuaauucucag

SEQ ID NO: 1337458 - RNA, 20 nt, Homo sapiens
cauucuuuuugaaaugucaa

SEQ ID NO: 1337459 - RNA, 17 nt, Homo sapiens
cauugaaaacaacaaaa

SEQ ID NO: 1337460 - RNA, 20 nt, Homo sapiens
cauugaagauccgaguguga

SEQ ID NO: 1337461 - RNA, 14 nt, Homo sapiens
cauugacagcaauu

SEQ ID NO: 1337462 - RNA, 13 nt, Homo sapiens
cauugcaagcuca

SEQ ID NO: 1337463 - RNA, 13 nt, Homo sapiens
cauugccuguaac

SEQ ID NO: 1337464 - RNA, 14 nt, Homo sapiens
cauugcugcauauu

SEQ ID NO: 1337465 - RNA, 13 nt, Homo sapiens
cauuggaagccau

SEQ ID NO: 1337466 - RNA, 16 nt, Homo sapiens
cauuguagccucaauc

SEQ ID NO: 1337467 - RNA, 14 nt, Homo sapiens
cauugugauuuauu

SEQ ID NO: 1337468 - RNA, 20 nt, Homo sapiens
cauuguguauagaacuggau

SEQ ID NO: 1337469 - RNA, 18 nt, Homo sapiens
cauuguuucccaucacug

SEQ ID NO: 1337470 - RNA, 12 nt, Homo sapiens
cauuuaaaacau

SEQ ID NO: 1337471 - RNA, 15 nt, Homo sapiens
cauuuacaauugcau

SEQ ID NO: 1337472 - RNA, 17 nt, Homo sapiens
cauuucaauuccuguga

SEQ ID NO: 1337473 - RNA, 16 nt, Homo sapiens
cauuucacuacuggug

SEQ ID NO: 1337474 - RNA, 19 nt, Homo sapiens
cauuucaggacucucucca

SEQ ID NO: 1337475 - RNA, 18 nt, Homo sapiens
cauuucauacaacagaaa

SEQ ID NO: 1337476 - RNA, 13 nt, Homo sapiens
cauuuccauacca

SEQ ID NO: 1337477 - RNA, 19 nt, Homo sapiens
cauuuccugacagaaggac

SEQ ID NO: 1337478 - RNA, 22 nt, Homo sapiens
cauuucuaaaauguuaaaacau

SEQ ID NO: 1337479 - RNA, 22 nt, Homo sapiens
cauuucuagguucuucaagaau

SEQ ID NO: 1337480 - RNA, 12 nt, Homo sapiens
cauuucuuccca

SEQ ID NO: 1337481 - RNA, 21 nt, Homo sapiens
cauuucuucucguuuucacag

SEQ ID NO: 1337482 - RNA, 22 nt, Homo sapiens
cccuggcaaaugccugacucag

SEQ ID NO: 1337483 - RNA, 17 nt, Homo sapiens
cccuguccugaaagcca

SEQ ID NO: 1337484 - RNA, 20 nt, Homo sapiens
cccuguccugcagucccaca

SEQ ID NO: 1337485 - RNA, 22 nt, Homo sapiens
cccuuaacugacaugggccuuu

SEQ ID NO: 1337486 - RNA, 18 nt, Homo sapiens
cccuuaacugcauccagc

SEQ ID NO: 1337487 - RNA, 21 nt, Homo sapiens
cccuuacagccucugacuuaa

SEQ ID NO: 1337488 - RNA, 19 nt, Homo sapiens
cccuuaguuuccacugccu

SEQ ID NO: 1337489 - RNA, 22 nt, Homo sapiens
cccuucaaccauuccccauggg

SEQ ID NO: 1337490 - RNA, 16 nt, Homo sapiens
cccuuccugggcacac

SEQ ID NO: 1337491 - RNA, 18 nt, Homo sapiens
cccuucuauacccaccca

SEQ ID NO: 1337492 - RNA, 15 nt, Homo sapiens
cccuucucugccuca

SEQ ID NO: 1337493 - RNA, 17 nt, Homo sapiens
cccuucucuucuaacau

SEQ ID NO: 1337494 - RNA, 16 nt, Homo sapiens
cccuuggagccaaugg

SEQ ID NO: 1337495 - RNA, 20 nt, Homo sapiens
cccuuguguuugaacagggc

SEQ ID NO: 1337496 - RNA, 22 nt, Homo sapiens
cccuuuuguauucucuuccuca

SEQ ID NO: 1337497 - RNA, 23 nt, Homo sapiens
ccgacugccccugcugugcugcu

SEQ ID NO: 1337498 - RNA, 19 nt, Homo sapiens
ccgacuuuccauugauuca

SEQ ID NO: 1337499 - RNA, 12 nt, Homo sapiens
ccgagaagaaca

SEQ ID NO: 1337500 - RNA, 17 nt, Homo sapiens
ccgagccuccaguccaa

SEQ ID NO: 1337501 - RNA, 17 nt, Homo sapiens
ccgagcucuggugcuuu

SEQ ID NO: 1337502 - RNA, 17 nt, Homo sapiens
ccgcaaauuuucuucca

SEQ ID NO: 1337503 - RNA, 13 nt, Homo sapiens
ccgcagaccugga

SEQ ID NO: 1337504 - RNA, 21 nt, Homo sapiens
ccgcagacggucugugugcug

SEQ ID NO: 1337505 - RNA, 20 nt, Homo sapiens
ccgcccuaaaagcacacuca

SEQ ID NO: 1337506 - RNA, 22 nt, Homo sapiens
ccgcuagcaguacuaaucaugu

SEQ ID NO: 1337507 - RNA, 20 nt, Homo sapiens
ccgcucaggggccuggaggu

SEQ ID NO: 1337508 - RNA, 14 nt, Homo sapiens
ccgcucucucugag

SEQ ID NO: 1337509 - RNA, 15 nt, Homo sapiens
ccgcucucucugagg

SEQ ID NO: 1337510 - RNA, 15 nt, Homo sapiens
ccgcugucucugagg

SEQ ID NO: 1337511 - RNA, 16 nt, Homo sapiens
ccgggcaaacuggccg

SEQ ID NO: 1337512 - RNA, 20 nt, Homo sapiens
ccgggucaucuguaccucug

SEQ ID NO: 1337513 - RNA, 19 nt, Homo sapiens
ccguagcucugcugcugau

SEQ ID NO: 1337514 - RNA, 11 nt, Homo sapiens
ccgucuucucc

SEQ ID NO: 1337515 - RNA, 21 nt, Homo sapiens
ccgucuucucccuauucccuc

SEQ ID NO: 1337516 - RNA, 13 nt, Homo sapiens
ccuaaaagcacac

SEQ ID NO: 1337517 - RNA, 20 nt, Homo sapiens
ccuaaauaaauuauuuguua

SEQ ID NO: 1337518 - RNA, 19 nt, Homo sapiens
ccuaacguuugucauucca

SEQ ID NO: 1337519 - RNA, 19 nt, Homo sapiens
ccuaauccaggcagaucca

SEQ ID NO: 1337520 - RNA, 18 nt, Homo sapiens
ccuaaucuuccacuugag

SEQ ID NO: 1337521 - RNA, 14 nt, Homo sapiens
ccuaauguuuauag

SEQ ID NO: 1337522 - RNA, 12 nt, Homo sapiens
ccuacaacugaa

SEQ ID NO: 1337523 - RNA, 13 nt, Homo sapiens
ccuacacugaugc

SEQ ID NO: 1337524 - RNA, 15 nt, Homo sapiens
ccuacagggccacaa

SEQ ID NO: 1337525 - RNA, 15 nt, Homo sapiens
ccuacauuaucucac

SEQ ID NO: 1337526 - RNA, 16 nt, Homo sapiens
ccuaccuaccaagaua

SEQ ID NO: 1337527 - RNA, 15 nt, Homo sapiens
ccuagagcuccaguu

SEQ ID NO: 1337528 - RNA, 23 nt, Homo sapiens
ccuagagcuccaguucuuuauaa

SEQ ID NO: 1337529 - RNA, 20 nt, Homo sapiens
ccuagcagaggaaaguguaa

SEQ ID NO: 1337530 - RNA, 14 nt, Homo sapiens
ccuaggauguucug

SEQ ID NO: 1337531 - RNA, 23 nt, Homo sapiens
ccuaucagaaguuucucagcucc

SEQ ID NO: 1337532 - RNA, 17 nt, Homo sapiens
ccuaugaaauacuuuau

SEQ ID NO: 1337533 - RNA, 23 nt, Homo sapiens
ccuaugaaauacuuuauagcaca

SEQ ID NO: 1337534 - RNA, 22 nt, Homo sapiens
ccuaugauggauggcagacucu

SEQ ID NO: 1337535 - RNA, 17 nt, Homo sapiens
ccucaaaacaaaggccu

SEQ ID NO: 1337536 - RNA, 12 nt, Homo sapiens
ccucaaacugca

SEQ ID NO: 1337537 - RNA, 17 nt, Homo sapiens
ccucaagccccauuucc

SEQ ID NO: 1337538 - RNA, 20 nt, Homo sapiens
ccucaagccccauuuccuca

SEQ ID NO: 1337539 - RNA, 15 nt, Homo sapiens
ccucaauauuuacua

SEQ ID NO: 1337540 - RNA, 20 nt, Homo sapiens
ccucaauauuuacuauuuca

SEQ ID NO: 1337541 - RNA, 18 nt, Homo sapiens
ccucaccacagccuucua

SEQ ID NO: 1337542 - RNA, 14 nt, Homo sapiens
ccucacccauccua

SEQ ID NO: 1337543 - RNA, 14 nt, Homo sapiens
ccucaccugggcag

SEQ ID NO: 1337544 - RNA, 14 nt, Homo sapiens
ccucacugcaguag

SEQ ID NO: 1337545 - RNA, 15 nt, Homo sapiens
ccucacuuaaacuuu

SEQ ID NO: 1337546 - RNA, 11 nt, Homo sapiens
ccucacuuuag

SEQ ID NO: 1337547 - RNA, 13 nt, Homo sapiens
ccucagacauccc

SEQ ID NO: 1337548 - RNA, 19 nt, Homo sapiens
ccucagccuggccagacac

SEQ ID NO: 1337549 - RNA, 15 nt, Homo sapiens
ccucagccuugccag

SEQ ID NO: 1337550 - RNA, 19 nt, Homo sapiens
ccucagccuugccagagau

SEQ ID NO: 1337551 - RNA, 17 nt, Homo sapiens
ccucagcuucuucacag

SEQ ID NO: 1337552 - RNA, 20 nt, Homo sapiens
ccucaggcacaccuugcaga

SEQ ID NO: 1337553 - RNA, 22 nt, Homo sapiens
ccucaggcagguaaccccagau

SEQ ID NO: 1337554 - RNA, 9 nt, Homo sapiens
ccucaggcu

SEQ ID NO: 1337555 - RNA, 14 nt, Homo sapiens
ccucauacacagaa

SEQ ID NO: 1337556 - RNA, 15 nt, Homo sapiens
ccucauauacuugaa

SEQ ID NO: 1337557 - RNA, 22 nt, Homo sapiens
ccucaucugggggaguggaaua

SEQ ID NO: 1337558 - RNA, 22 nt, Homo sapiens
ccucauggaugcuuuggcaaug

SEQ ID NO: 1337559 - RNA, 14 nt, Homo sapiens
ccuccacaugcugc

SEQ ID NO: 1337560 - RNA, 17 nt, Homo sapiens
ccuccacgccggcucuu

SEQ ID NO: 1337561 - RNA, 13 nt, Homo sapiens
ccuccacugcugc

SEQ ID NO: 1337562 - RNA, 15 nt, Homo sapiens
ccuccagaggaugac

SEQ ID NO: 1337563 - RNA, 14 nt, Homo sapiens
ccuccagugcaguc

SEQ ID NO: 1337564 - RNA, 13 nt, Homo sapiens
ccucccaccagag

SEQ ID NO: 1337565 - RNA, 16 nt, Homo sapiens
ccucccacccugcaaa

SEQ ID NO: 1337566 - RNA, 21 nt, Homo sapiens
ccucccacccugcaaagggaa

SEQ ID NO: 1337567 - RNA, 14 nt, Homo sapiens
ccucccacugcccc

SEQ ID NO: 1337568 - RNA, 13 nt, Homo sapiens
ccucccgaaaaau

SEQ ID NO: 1337569 - RNA, 19 nt, Homo sapiens
ccucccuaccuaccaagau

SEQ ID NO: 1337570 - RNA, 13 nt, Homo sapiens
ccucccucaggcc

SEQ ID NO: 1337571 - RNA, 21 nt, Homo sapiens
ccucccuguauaagacacuuu

SEQ ID NO: 1337572 - RNA, 20 nt, Homo sapiens
ccucccuguuccccagagaa

SEQ ID NO: 1337573 - RNA, 19 nt, Homo sapiens
ccuccugcaaggggcucaa

SEQ ID NO: 1337574 - RNA, 16 nt, Homo sapiens
ccuccugcacacaggg

SEQ ID NO: 1337575 - RNA, 17 nt, Homo sapiens
ccuccugggaacacauc

SEQ ID NO: 1337576 - RNA, 22 nt, Homo sapiens
ccuccugugacgugaggcccau

SEQ ID NO: 1337577 - RNA, 20 nt, Homo sapiens
ccuccuuggcuuuaugcaaa

SEQ ID NO: 1337578 - RNA, 14 nt, Homo sapiens
ccuccuugugccuu

SEQ ID NO: 1337579 - RNA, 14 nt, Homo sapiens
ccucgagcacugaa

SEQ ID NO: 1337580 - RNA, 16 nt, Homo sapiens
ccucuaagugcugcug

SEQ ID NO: 1337581 - RNA, 15 nt, Homo sapiens
ccucuaauaaacacu

SEQ ID NO: 1337582 - RNA, 23 nt, Homo sapiens
ccucuacauugaaaacaacaaaa

SEQ ID NO: 1337583 - RNA, 15 nt, Homo sapiens
ccucuaccagcacau

SEQ ID NO: 1337584 - RNA, 16 nt, Homo sapiens
ccucucagcauuuccu

SEQ ID NO: 1337585 - RNA, 17 nt, Homo sapiens
ccucuccuuugugacuu

SEQ ID NO: 1337586 - RNA, 16 nt, Homo sapiens
ccucucucagugucaa

SEQ ID NO: 1337587 - RNA, 12 nt, Homo sapiens
ccucucugaguc

SEQ ID NO: 1337588 - RNA, 19 nt, Homo sapiens
ccucugcaguuuugacauu

SEQ ID NO: 1337589 - RNA, 20 nt, Homo sapiens
ccucugccagcgccaaaaca

SEQ ID NO: 1337590 - RNA, 21 nt, Homo sapiens
ccucuguauacaaaacccuuu

SEQ ID NO: 1337591 - RNA, 12 nt, Homo sapiens
ccucuguauacu

SEQ ID NO: 1337592 - RNA, 14 nt, Homo sapiens
ccucuguauacuga

SEQ ID NO: 1337593 - RNA, 22 nt, Homo sapiens
ccucuguauacugagucuuuac

SEQ ID NO: 1337594 - RNA, 23 nt, Homo sapiens
ccucugucugagacaggugccua

SEQ ID NO: 1337595 - RNA, 19 nt, Homo sapiens
ccucuuaccaguauuuaac

SEQ ID NO: 1337596 - RNA, 19 nt, Homo sapiens
ccucuucuuugugccuuug

SEQ ID NO: 1337597 - RNA, 16 nt, Homo sapiens
ccucuugccaaaucaa

SEQ ID NO: 1337598 - RNA, 14 nt, Homo sapiens
ccugaagaaccagu

SEQ ID NO: 1337599 - RNA, 15 nt, Homo sapiens
ccugaagaaccaguc

SEQ ID NO: 1337600 - RNA, 23 nt, Homo sapiens
ccugaagucuucuccuccaugaa

SEQ ID NO: 1337601 - RNA, 17 nt, Homo sapiens
ccugaaucagcuggaca

SEQ ID NO: 1337602 - RNA, 14 nt, Homo sapiens
ccugaaucugugca

SEQ ID NO: 1337603 - RNA, 20 nt, Homo sapiens
ccugacaauuugugauaucu

SEQ ID NO: 1337604 - RNA, 12 nt, Homo sapiens
ccugacaccccc

SEQ ID NO: 1337605 - RNA, 22 nt, Homo sapiens
ccugaccucaaguaauccaccu

SEQ ID NO: 1337606 - RNA, 20 nt, Homo sapiens
ccugagcgugcuuuccaaaa

SEQ ID NO: 1337607 - RNA, 13 nt, Homo sapiens
ccugauaaacaga

SEQ ID NO: 1337608 - RNA, 14 nt, Homo sapiens
ccugauaaacagag

SEQ ID NO: 1337609 - RNA, 20 nt, Homo sapiens
ccugauaaacagaguaacug

SEQ ID NO: 1337610 - RNA, 10 nt, Homo sapiens
ccugcaaaac

SEQ ID NO: 1337611 - RNA, 14 nt, Homo sapiens
ccugcaaagggaau

SEQ ID NO: 1337612 - RNA, 16 nt, Homo sapiens
ccugcagucuggcuga

SEQ ID NO: 1337613 - RNA, 14 nt, Homo sapiens
ccugcauugaacag

SEQ ID NO: 1337614 - RNA, 17 nt, Homo sapiens
ccugcccaaacccuuaa

SEQ ID NO: 1337615 - RNA, 16 nt, Homo sapiens
uccucuccacugccuu

SEQ ID NO: 1337616 - RNA, 14 nt, Homo sapiens
uccucucugaguca

SEQ ID NO: 1337617 - RNA, 19 nt, Homo sapiens
uccucugcagcucagggac

SEQ ID NO: 1337618 - RNA, 23 nt, Homo sapiens
uccucugcaguuuugacauuuag

SEQ ID NO: 1337619 - RNA, 10 nt, Homo sapiens
uccucugcau

SEQ ID NO: 1337620 - RNA, 15 nt, Homo sapiens
uccucugcauuuaca

SEQ ID NO: 1337621 - RNA, 19 nt, Homo sapiens
uccucuguccaggcacugc

SEQ ID NO: 1337622 - RNA, 14 nt, Homo sapiens
uccucuugccacug

SEQ ID NO: 1337623 - RNA, 14 nt, Homo sapiens
uccucuuugugaua

SEQ ID NO: 1337624 - RNA, 16 nt, Homo sapiens
uccugaaacaacuugg

SEQ ID NO: 1337625 - RNA, 22 nt, Homo sapiens
uccugaaagccacagacaauau

SEQ ID NO: 1337626 - RNA, 18 nt, Homo sapiens
uccugaccucaagugauc

SEQ ID NO: 1337627 - RNA, 22 nt, Homo sapiens
uccugaggaagagggacuguuc

SEQ ID NO: 1337628 - RNA, 19 nt, Homo sapiens
uccugaguagcuggauuac

SEQ ID NO: 1337629 - RNA, 21 nt, Homo sapiens
uccugaugaggagaaaggggc

SEQ ID NO: 1337630 - RNA, 22 nt, Homo sapiens
uccugauucauauuuaauuuga

SEQ ID NO: 1337631 - RNA, 21 nt, Homo sapiens
uccugcagucccacacugugc

SEQ ID NO: 1337632 - RNA, 16 nt, Homo sapiens
uccuggaaacagcaug

SEQ ID NO: 1337633 - RNA, 23 nt, Homo sapiens
uccuggaggcugccugcugugcu

SEQ ID NO: 1337634 - RNA, 19 nt, Homo sapiens
uccugggaacacaucuggc

SEQ ID NO: 1337635 - RNA, 18 nt, Homo sapiens
uccugggacacuccgucu

SEQ ID NO: 1337636 - RNA, 16 nt, Homo sapiens
uccugggccugcagaa

SEQ ID NO: 1337637 - RNA, 18 nt, Homo sapiens
uccuggggcagcacuccc

SEQ ID NO: 1337638 - RNA, 17 nt, Homo sapiens
uccugguccucagggga

SEQ ID NO: 1337639 - RNA, 17 nt, Homo sapiens
uccuguacuguauggaa

SEQ ID NO: 1337640 - RNA, 16 nt, Homo sapiens
uccugucccucaucca

SEQ ID NO: 1337641 - RNA, 14 nt, Homo sapiens
uccugucuccuuug

SEQ ID NO: 1337642 - RNA, 19 nt, Homo sapiens
uccuguuagcauaauguga

SEQ ID NO: 1337643 - RNA, 17 nt, Homo sapiens
uccuuaacacauucaau

SEQ ID NO: 1337644 - RNA, 22 nt, Homo sapiens
uccuuagccuuugucccagaau

SEQ ID NO: 1337645 - RNA, 19 nt, Homo sapiens
uccuuaggcuacuguaaug

SEQ ID NO: 1337646 - RNA, 20 nt, Homo sapiens
uccuucaguccaccacagca

SEQ ID NO: 1337647 - RNA, 19 nt, Homo sapiens
uccuucccauuucucuaca

SEQ ID NO: 1337648 - RNA, 18 nt, Homo sapiens
uccuucugaaguguuuca

SEQ ID NO: 1337649 - RNA, 20 nt, Homo sapiens
uccuucuuucuaguucagcu

SEQ ID NO: 1337650 - RNA, 11 nt, Homo sapiens
uccuugaacaa

SEQ ID NO: 1337651 - RNA, 19 nt, Homo sapiens
uccuugacuucuuugagaa

SEQ ID NO: 1337652 - RNA, 14 nt, Homo sapiens
uccuuggcuuuaug

SEQ ID NO: 1337653 - RNA, 21 nt, Homo sapiens
uccuugguaccccuaaaaaga

SEQ ID NO: 1337654 - RNA, 14 nt, Homo sapiens
uccuuuucugaaag

SEQ ID NO: 1337655 - RNA, 17 nt, Homo sapiens
uccuuuuucuucacuua

SEQ ID NO: 1337656 - RNA, 19 nt, Homo sapiens
uccuuuuuucaauaugcaa

SEQ ID NO: 1337657 - RNA, 22 nt, Homo sapiens
uccuuuuuuuuuuauccuaguc

SEQ ID NO: 1337658 - RNA, 17 nt, Homo sapiens
ucgaagggauuguguau

SEQ ID NO: 1337659 - RNA, 14 nt, Homo sapiens
ucgagcaucaggcu

SEQ ID NO: 1337660 - RNA, 16 nt, Homo sapiens
ucgcuuaagccagcac

SEQ ID NO: 1337661 - RNA, 21 nt, Homo sapiens
ucggauccccuuccuaccacc

SEQ ID NO: 1337662 - RNA, 14 nt, Homo sapiens
ucggccccaucucu

SEQ ID NO: 1337663 - RNA, 17 nt, Homo sapiens
ucgggccccauccucau

SEQ ID NO: 1337664 - RNA, 14 nt, Homo sapiens
ucgguccuggugcc

SEQ ID NO: 1337665 - RNA, 19 nt, Homo sapiens
ucgguuguucuuuccucac

SEQ ID NO: 1337666 - RNA, 19 nt, Homo sapiens
ucgucaagagcaugcacau

SEQ ID NO: 1337667 - RNA, 18 nt, Homo sapiens
ucgucaucaggugcauag

SEQ ID NO: 1337668 - RNA, 10 nt, Homo sapiens
ucgugcugug

SEQ ID NO: 1337669 - RNA, 17 nt, Homo sapiens
ucguuuagcauggcaug

SEQ ID NO: 1337670 - RNA, 15 nt, Homo sapiens
ucuaaaauuaaggaa

SEQ ID NO: 1337671 - RNA, 22 nt, Homo sapiens
ucuaaagauggaaaaaccaccc

SEQ ID NO: 1337672 - RNA, 21 nt, Homo sapiens
ucuaacagaucagaacaugaa

SEQ ID NO: 1337673 - RNA, 19 nt, Homo sapiens
ucuaaguaaaaccacagca

SEQ ID NO: 1337674 - RNA, 14 nt, Homo sapiens
ucuaaucagugauu

SEQ ID NO: 1337675 - RNA, 15 nt, Homo sapiens
ucuaauuacauuuca

SEQ ID NO: 1337676 - RNA, 18 nt, Homo sapiens
ucuaauucggauuugcca

SEQ ID NO: 1337677 - RNA, 20 nt, Homo sapiens
ucuacacagauggaaucucu

SEQ ID NO: 1337678 - RNA, 21 nt, Homo sapiens
ucuacacagauggaaucucuu

SEQ ID NO: 1337679 - RNA, 12 nt, Homo sapiens
ucuacacagcaa

SEQ ID NO: 1337680 - RNA, 17 nt, Homo sapiens
ucuacacugagguuuga

SEQ ID NO: 1337681 - RNA, 15 nt, Homo sapiens
ucuacauacuaugga

SEQ ID NO: 1337682 - RNA, 14 nt, Homo sapiens
ucuacaugaugcua

SEQ ID NO: 1337683 - RNA, 18 nt, Homo sapiens
ucuacuggucuuguggaa

SEQ ID NO: 1337684 - RNA, 21 nt, Homo sapiens
ucuagcccaaccuacauucca

SEQ ID NO: 1337685 - RNA, 16 nt, Homo sapiens
ucuaguucagcugccc

SEQ ID NO: 1337686 - RNA, 18 nt, Homo sapiens
ucuauagugaugaugauc

SEQ ID NO: 1337687 - RNA, 14 nt, Homo sapiens
ucuaucugugaacg

SEQ ID NO: 1337688 - RNA, 19 nt, Homo sapiens
ucuauggguuggacaaccu

SEQ ID NO: 1337689 - RNA, 11 nt, Homo sapiens
ucuauguuaau

SEQ ID NO: 1337690 - RNA, 12 nt, Homo sapiens
ucuauuaaucaa

SEQ ID NO: 1337691 - RNA, 18 nt, Homo sapiens
ucuauuguuuguugcacu

SEQ ID NO: 1337692 - RNA, 21 nt, Homo sapiens
ucuauuugccuccagugcagu

SEQ ID NO: 1337693 - RNA, 18 nt, Homo sapiens
ucucaaguaaaacaaaug

SEQ ID NO: 1337694 - RNA, 23 nt, Homo sapiens
ucucaccccugcuauaacuauga

SEQ ID NO: 1337695 - RNA, 18 nt, Homo sapiens
ucucacucuguugcccag

SEQ ID NO: 1337696 - RNA, 19 nt, Homo sapiens
ucucagccauaggugcagu

SEQ ID NO: 1337697 - RNA, 20 nt, Homo sapiens
ucucagccauaggugcaguu

SEQ ID NO: 1337698 - RNA, 12 nt, Homo sapiens
ucucagccucug

SEQ ID NO: 1337699 - RNA, 20 nt, Homo sapiens
ucucagggaacugacccuca

SEQ ID NO: 1337700 - RNA, 20 nt, Homo sapiens
ucucaguaccccauggagcu

SEQ ID NO: 1337701 - RNA, 19 nt, Homo sapiens
ucucauggguggcacucag

SEQ ID NO: 1337702 - RNA, 14 nt, Homo sapiens
ucuccaggggccug

SEQ ID NO: 1337703 - RNA, 16 nt, Homo sapiens
ucuccauguuggucag

SEQ ID NO: 1337704 - RNA, 18 nt, Homo sapiens
ucuccccucagagugcaa

SEQ ID NO: 1337705 - RNA, 13 nt, Homo sapiens
ucuccgacucugc

SEQ ID NO: 1337706 - RNA, 21 nt, Homo sapiens
ucuccuacuguagcaaccuga

SEQ ID NO: 1337707 - RNA, 14 nt, Homo sapiens
ucuccucugcagcu

SEQ ID NO: 1337708 - RNA, 12 nt, Homo sapiens
ucuccugacccc

SEQ ID NO: 1337709 - RNA, 22 nt, Homo sapiens
ucuccuuauccccccaaaugga

SEQ ID NO: 1337710 - RNA, 14 nt, Homo sapiens
ucucgaacuccuga

SEQ ID NO: 1337711 - RNA, 19 nt, Homo sapiens
ucucuagucauuuguuaau

SEQ ID NO: 1337712 - RNA, 15 nt, Homo sapiens
ucucuauagagccaa

SEQ ID NO: 1337713 - RNA, 17 nt, Homo sapiens
ucucuccaccagguucu

SEQ ID NO: 1337714 - RNA, 16 nt, Homo sapiens
ucucuccccauauaua

SEQ ID NO: 1337715 - RNA, 16 nt, Homo sapiens
ucucucgcaagggaag

SEQ ID NO: 1337716 - RNA, 14 nt, Homo sapiens
ucucucgggagccc

SEQ ID NO: 1337717 - RNA, 13 nt, Homo sapiens
ucucugucucaaa

SEQ ID NO: 1337718 - RNA, 20 nt, Homo sapiens
ucucuuaaguggucuaguca

SEQ ID NO: 1337719 - RNA, 13 nt, Homo sapiens
ucucuucugccuu

SEQ ID NO: 1337720 - RNA, 20 nt, Homo sapiens
ucucuugaaaaguucaggga

SEQ ID NO: 1337721 - RNA, 13 nt, Homo sapiens
ucucuugccauuu

SEQ ID NO: 1337722 - RNA, 18 nt, Homo sapiens
ucucuuuacuugaaauuu

SEQ ID NO: 1337723 - RNA, 14 nt, Homo sapiens
ucucuuucugcaaa

SEQ ID NO: 1337724 - RNA, 16 nt, Homo sapiens
ucucuuugugcucuaa

SEQ ID NO: 1337725 - RNA, 16 nt, Homo sapiens
ucugaaaaagacauaa

SEQ ID NO: 1337726 - RNA, 17 nt, Homo sapiens
ucugaaaaagacauaaa

SEQ ID NO: 1337727 - RNA, 20 nt, Homo sapiens
ucugaaaaaguauccugcuu

SEQ ID NO: 1337728 - RNA, 17 nt, Homo sapiens
ucugaauaaauaauucu

SEQ ID NO: 1337729 - RNA, 15 nt, Homo sapiens
ucugaaugagccuuu

SEQ ID NO: 1337730 - RNA, 15 nt, Homo sapiens
ucugacaacugugaa

SEQ ID NO: 1337731 - RNA, 12 nt, Homo sapiens
ucugacccagug

SEQ ID NO: 1337732 - RNA, 17 nt, Homo sapiens
ucugagacagcuugucu

SEQ ID NO: 1337733 - RNA, 13 nt, Homo sapiens
ucugagcaguugu

SEQ ID NO: 1337734 - RNA, 16 nt, Homo sapiens
ucugaggccucagagu

SEQ ID NO: 1337735 - RNA, 17 nt, Homo sapiens
ucugaucguuuauucuc

SEQ ID NO: 1337736 - RNA, 21 nt, Homo sapiens
ucugcaaaggcgucugaaugu

SEQ ID NO: 1337737 - RNA, 18 nt, Homo sapiens
ucugcaaggucuuugguu

SEQ ID NO: 1337738 - RNA, 11 nt, Homo sapiens
ucugcauuuac

SEQ ID NO: 1337739 - RNA, 23 nt, Homo sapiens
ucugccagcgccaaaacaagcca

SEQ ID NO: 1337740 - RNA, 17 nt, Homo sapiens
ucugcccgcuccaugga

SEQ ID NO: 1337741 - RNA, 21 nt, Homo sapiens
ucugcccgcuccauggaaaag

SEQ ID NO: 1337742 - RNA, 15 nt, Homo sapiens
ucugccuucucagga

SEQ ID NO: 1337743 - RNA, 22 nt, Homo sapiens
ucugcuccccugugaacccacu

SEQ ID NO: 1337744 - RNA, 20 nt, Homo sapiens
ucugcugucuaaccugugac

SEQ ID NO: 1337745 - RNA, 14 nt, Homo sapiens
ucuggaaauagccc

SEQ ID NO: 1337746 - RNA, 22 nt, Homo sapiens
ucuggccuguacccaguagaug

SEQ ID NO: 1337747 - RNA, 13 nt, Homo sapiens
ucuggccuguggc

SEQ ID NO: 1337748 - RNA, 20 nt, Homo sapiens
uggaaaugguuucacuugcu

SEQ ID NO: 1337749 - RNA, 13 nt, Homo sapiens
uggaacaagcaca

SEQ ID NO: 1337750 - RNA, 16 nt, Homo sapiens
uggaacaagcacagau

SEQ ID NO: 1337751 - RNA, 17 nt, Homo sapiens
uggaacuccuggccuuu

SEQ ID NO: 1337752 - RNA, 16 nt, Homo sapiens
uggaagaaauggcuau

SEQ ID NO: 1337753 - RNA, 16 nt, Homo sapiens
uggaagaggccuuccc

SEQ ID NO: 1337754 - RNA, 15 nt, Homo sapiens
uggaagauggcauaa

SEQ ID NO: 1337755 - RNA, 12 nt, Homo sapiens
uggaagcucucc

SEQ ID NO: 1337756 - RNA, 23 nt, Homo sapiens
uggaagcuuguugaaaacccaga

SEQ ID NO: 1337757 - RNA, 16 nt, Homo sapiens
uggaaggcaguguuau

SEQ ID NO: 1337758 - RNA, 20 nt, Homo sapiens
uggaagugugugccaagagc

SEQ ID NO: 1337759 - RNA, 21 nt, Homo sapiens
uggaagugugugccaagagcu

SEQ ID NO: 1337760 - RNA, 14 nt, Homo sapiens
uggaauaguauccu

SEQ ID NO: 1337761 - RNA, 13 nt, Homo sapiens
uggaauauuccac

SEQ ID NO: 1337762 - RNA, 16 nt, Homo sapiens
uggaauggagauuuca

SEQ ID NO: 1337763 - RNA, 13 nt, Homo sapiens
uggaauuacaggc

SEQ ID NO: 1337764 - RNA, 20 nt, Homo sapiens
uggaauucuaacaagucaua

SEQ ID NO: 1337765 - RNA, 23 nt, Homo sapiens
uggaauuuucucacgcaggagcc

SEQ ID NO: 1337766 - RNA, 10 nt, Homo sapiens
uggacacugu

SEQ ID NO: 1337767 - RNA, 16 nt, Homo sapiens
uggacagccugaguca

SEQ ID NO: 1337768 - RNA, 16 nt, Homo sapiens
uggacccugacuguau

SEQ ID NO: 1337769 - RNA, 17 nt, Homo sapiens
uggacccugacuguaua

SEQ ID NO: 1337770 - RNA, 18 nt, Homo sapiens
uggacguggguugcacug

SEQ ID NO: 1337771 - RNA, 19 nt, Homo sapiens
uggacguggguugcacugg

SEQ ID NO: 1337772 - RNA, 15 nt, Homo sapiens
uggacugucauagaa

SEQ ID NO: 1337773 - RNA, 18 nt, Homo sapiens
uggacugugcuggugcau

SEQ ID NO: 1337774 - RNA, 16 nt, Homo sapiens
uggagaaagagcugcc

SEQ ID NO: 1337775 - RNA, 22 nt, Homo sapiens
uggagaaagaugcaguccucag

SEQ ID NO: 1337776 - RNA, 22 nt, Homo sapiens
uggagacacccucugggggucc

SEQ ID NO: 1337777 - RNA, 21 nt, Homo sapiens
uggagagaacacagugcuauu

SEQ ID NO: 1337778 - RNA, 20 nt, Homo sapiens
uggagagucagaucuuucuc

SEQ ID NO: 1337779 - RNA, 22 nt, Homo sapiens
uggagcaauaaaagacaaaugc

SEQ ID NO: 1337780 - RNA, 22 nt, Homo sapiens
uggagccagcaaccagcacauc

SEQ ID NO: 1337781 - RNA, 24 nt, Homo sapiens
uggagcugagcagguguucuucau

SEQ ID NO: 1337782 - RNA, 14 nt, Homo sapiens
uggagcugucuguc

SEQ ID NO: 1337783 - RNA, 12 nt, Homo sapiens
uggagcuuccaa

SEQ ID NO: 1337784 - RNA, 21 nt, Homo sapiens
uggaggacaaauaagaaauga

SEQ ID NO: 1337785 - RNA, 20 nt, Homo sapiens
uggaggcucucuugugcauu

SEQ ID NO: 1337786 - RNA, 16 nt, Homo sapiens
uggagggacaugacua

SEQ ID NO: 1337787 - RNA, 16 nt, Homo sapiens
uggagggcucagggca

SEQ ID NO: 1337788 - RNA, 22 nt, Homo sapiens
uggagguauucaauauccuuug

SEQ ID NO: 1337789 - RNA, 24 nt, Homo sapiens
uggagguauucaauauccuuugcc

SEQ ID NO: 1337790 - RNA, 20 nt, Homo sapiens
uggaggugggcaaagggaag

SEQ ID NO: 1337791 - RNA, 12 nt, Homo sapiens
uggagugcaaug

SEQ ID NO: 1337792 - RNA, 13 nt, Homo sapiens
uggauaaucugag

SEQ ID NO: 1337793 - RNA, 13 nt, Homo sapiens
uggauacagcugc

SEQ ID NO: 1337794 - RNA, 13 nt, Homo sapiens
uggauccagcacu

SEQ ID NO: 1337795 - RNA, 14 nt, Homo sapiens
uggauccagcacug

SEQ ID NO: 1337796 - RNA, 22 nt, Homo sapiens
uggaucuuggagaaugugagaa

SEQ ID NO: 1337797 - RNA, 20 nt, Homo sapiens
uggaugaaugcccagugaga

SEQ ID NO: 1337798 - RNA, 15 nt, Homo sapiens
uggaugcagcaauaa

SEQ ID NO: 1337799 - RNA, 21 nt, Homo sapiens
uggauuacaggcaugugccac

SEQ ID NO: 1337800 - RNA, 17 nt, Homo sapiens
uggcaaacguuucucaa

SEQ ID NO: 1337801 - RNA, 14 nt, Homo sapiens
uggcaaagugacaa

SEQ ID NO: 1337802 - RNA, 19 nt, Homo sapiens
uggcaaaugccugacucag

SEQ ID NO: 1337803 - RNA, 15 nt, Homo sapiens
uggcacacgccugua

SEQ ID NO: 1337804 - RNA, 19 nt, Homo sapiens
uggcacaguuuucugagaa

SEQ ID NO: 1337805 - RNA, 22 nt, Homo sapiens
uggcacauggguggacacggau

SEQ ID NO: 1337806 - RNA, 20 nt, Homo sapiens
uggcagcaccgccucuuccc

SEQ ID NO: 1337807 - RNA, 21 nt, Homo sapiens
uggcagcccuauuucaguuua

SEQ ID NO: 1337808 - RNA, 17 nt, Homo sapiens
uggcagccgugccuuca

SEQ ID NO: 1337809 - RNA, 17 nt, Homo sapiens
uggcagcuagugccuuu

SEQ ID NO: 1337810 - RNA, 12 nt, Homo sapiens
uggcaggcccac

SEQ ID NO: 1337811 - RNA, 17 nt, Homo sapiens
uggcauauauguucaaa

SEQ ID NO: 1337812 - RNA, 21 nt, Homo sapiens
uggcauauauguucaaauuca

SEQ ID NO: 1337813 - RNA, 14 nt, Homo sapiens
uggccaaacuggug

SEQ ID NO: 1337814 - RNA, 17 nt, Homo sapiens
uggccaaggagcugcua

SEQ ID NO: 1337815 - RNA, 14 nt, Homo sapiens
uggccacagacuga

SEQ ID NO: 1337816 - RNA, 22 nt, Homo sapiens
uggccaggccuuacaucuggcu

SEQ ID NO: 1337817 - RNA, 13 nt, Homo sapiens
uggccaguucauu

SEQ ID NO: 1337818 - RNA, 18 nt, Homo sapiens
uggccaucuucuuucuuc

SEQ ID NO: 1337819 - RNA, 15 nt, Homo sapiens
uggccauuaacaaug

SEQ ID NO: 1337820 - RNA, 16 nt, Homo sapiens
uggcccccuguccucu

SEQ ID NO: 1337821 - RNA, 16 nt, Homo sapiens
uggcccggacaugucu

SEQ ID NO: 1337822 - RNA, 15 nt, Homo sapiens
uggcccugggggucu

SEQ ID NO: 1337823 - RNA, 14 nt, Homo sapiens
uggccggagucagu

SEQ ID NO: 1337824 - RNA, 23 nt, Homo sapiens
uggccucccaaagugcugggauu

SEQ ID NO: 1337825 - RNA, 18 nt, Homo sapiens
uggccuggccauuuccaa

SEQ ID NO: 1337826 - RNA, 16 nt, Homo sapiens
uggccugugccagcac

SEQ ID NO: 1337827 - RNA, 21 nt, Homo sapiens
uggccugugccagcaccacag

SEQ ID NO: 1337828 - RNA, 19 nt, Homo sapiens
uggcgugcucagacccaac

SEQ ID NO: 1337829 - RNA, 15 nt, Homo sapiens
uggcuaaucaguaua

SEQ ID NO: 1337830 - RNA, 13 nt, Homo sapiens
uggcucaucucuu

SEQ ID NO: 1337831 - RNA, 13 nt, Homo sapiens
uggcucugggaau

SEQ ID NO: 1337832 - RNA, 14 nt, Homo sapiens
uggcugcauuugcc

SEQ ID NO: 1337833 - RNA, 16 nt, Homo sapiens
uggcugggacugggaa

SEQ ID NO: 1337834 - RNA, 15 nt, Homo sapiens
uggcuggucuucacu

SEQ ID NO: 1337835 - RNA, 17 nt, Homo sapiens
uggcugguuucugagag

SEQ ID NO: 1337836 - RNA, 10 nt, Homo sapiens
uggcuuuaug

SEQ ID NO: 1337837 - RNA, 13 nt, Homo sapiens
uggcuuuaugcaa

SEQ ID NO: 1337838 - RNA, 17 nt, Homo sapiens
uggcuuucauaaaucau

SEQ ID NO: 1337839 - RNA, 13 nt, Homo sapiens
uggcuuugcuuag

SEQ ID NO: 1337840 - RNA, 15 nt, Homo sapiens
ugggaaaaccagacu

SEQ ID NO: 1337841 - RNA, 14 nt, Homo sapiens
ugggaaagcauugu

SEQ ID NO: 1337842 - RNA, 12 nt, Homo sapiens
ugggaaggccag

SEQ ID NO: 1337843 - RNA, 12 nt, Homo sapiens
ugggacugagau

SEQ ID NO: 1337844 - RNA, 15 nt, Homo sapiens
ugggagacaugugac

SEQ ID NO: 1337845 - RNA, 15 nt, Homo sapiens
ugggagcaccgccug

SEQ ID NO: 1337846 - RNA, 20 nt, Homo sapiens
ugggaggcagagguugcagu

SEQ ID NO: 1337847 - RNA, 15 nt, Homo sapiens
ugggaggccaaggca

SEQ ID NO: 1337848 - RNA, 15 nt, Homo sapiens
ugggauaucacuucc

SEQ ID NO: 1337849 - RNA, 14 nt, Homo sapiens
ugggauauucccaa

SEQ ID NO: 1337850 - RNA, 21 nt, Homo sapiens
ugggauucuagaacugugaau

SEQ ID NO: 1337851 - RNA, 11 nt, Homo sapiens
ugggcacaaac

SEQ ID NO: 1337852 - RNA, 14 nt, Homo sapiens
ugggcagggaugau

SEQ ID NO: 1337853 - RNA, 13 nt, Homo sapiens
ugggcauuucaau

SEQ ID NO: 1337854 - RNA, 18 nt, Homo sapiens
ugggccgucuggccugug

SEQ ID NO: 1337855 - RNA, 14 nt, Homo sapiens
ugggccugcuccag

SEQ ID NO: 1337856 - RNA, 17 nt, Homo sapiens
ugggcguccagcucagc

SEQ ID NO: 1337857 - RNA, 23 nt, Homo sapiens
ugggcuacagaaaccacagucuu

SEQ ID NO: 1337858 - RNA, 14 nt, Homo sapiens
ugggcuaccaggaa

SEQ ID NO: 1337859 - RNA, 23 nt, Homo sapiens
ugggcuauugcugcugccccuua

SEQ ID NO: 1337860 - RNA, 12 nt, Homo sapiens
uggggaagacag

SEQ ID NO: 1337861 - RNA, 13 nt, Homo sapiens
uggggaagacagu

SEQ ID NO: 1337862 - RNA, 20 nt, Homo sapiens
uggggaggccuauuccugcu

SEQ ID NO: 1337863 - RNA, 18 nt, Homo sapiens
uggggaugucucucauga

SEQ ID NO: 1337864 - RNA, 15 nt, Homo sapiens
uggggccagauccag

SEQ ID NO: 1337865 - RNA, 12 nt, Homo sapiens
uggggcucucuc

SEQ ID NO: 1337866 - RNA, 15 nt, Homo sapiens
uggggcugauuguau

SEQ ID NO: 1337867 - RNA, 18 nt, Homo sapiens
ugggggaacacugagaaa

SEQ ID NO: 1337868 - RNA, 19 nt, Homo sapiens
ugggggaacacugagaaag

SEQ ID NO: 1337869 - RNA, 15 nt, Homo sapiens
ugggggaagacuuua

SEQ ID NO: 1337870 - RNA, 19 nt, Homo sapiens
ugggggacccaucuuccac

SEQ ID NO: 1337871 - RNA, 16 nt, Homo sapiens
ugggggguggccugug

SEQ ID NO: 1337872 - RNA, 18 nt, Homo sapiens
ugggggugccgcucucuc

SEQ ID NO: 1337873 - RNA, 20 nt, Homo sapiens
ugggggugccgcucucucug

SEQ ID NO: 1337874 - RNA, 17 nt, Homo sapiens
ugggggugccgcugucu

SEQ ID NO: 1337875 - RNA, 23 nt, Homo sapiens
ugggggugccgcugucucugagg

SEQ ID NO: 1337876 - RNA, 20 nt, Homo sapiens
ugggggugcugcucucuccg

SEQ ID NO: 1337877 - RNA, 15 nt, Homo sapiens
ugggguaacaucugu

SEQ ID NO: 1337878 - RNA, 15 nt, Homo sapiens
ugggguaauacuucc

SEQ ID NO: 1337879 - RNA, 16 nt, Homo sapiens
ugggguggagugggaa

SEQ ID NO: 1337880 - RNA, 18 nt, Homo sapiens
ugggguuucuggggucca

SEQ ID NO: 1337881 - RNA, 16 nt, Homo sapiens
uggguauuuguucaaa

SEQ ID NO: 1337882 - RNA, 17 nt, Homo sapiens
caccuaucaacagauca

SEQ ID NO: 1337883 - RNA, 17 nt, Homo sapiens
caccuccucugugauuu

SEQ ID NO: 1337884 - RNA, 19 nt, Homo sapiens
caccucggcacacacugug

SEQ ID NO: 1337885 - RNA, 13 nt, Homo sapiens
caccugaaucagc

SEQ ID NO: 1337886 - RNA, 14 nt, Homo sapiens
caccuguaauccca

SEQ ID NO: 1337887 - RNA, 13 nt, Homo sapiens
caccuucaccucg

SEQ ID NO: 1337888 - RNA, 12 nt, Homo sapiens
cacgaggaaaag

SEQ ID NO: 1337889 - RNA, 16 nt, Homo sapiens
cacggauggugcaugg

SEQ ID NO: 1337890 - RNA, 15 nt, Homo sapiens
cacguggggcccacu

SEQ ID NO: 1337891 - RNA, 15 nt, Homo sapiens
cacuaaauugcaguu

SEQ ID NO: 1337892 - RNA, 17 nt, Homo sapiens
cacuaccguaaaugucc

SEQ ID NO: 1337893 - RNA, 17 nt, Homo sapiens
cacucaggccacagugg

SEQ ID NO: 1337894 - RNA, 17 nt, Homo sapiens
cacucagggagcauuua

SEQ ID NO: 1337895 - RNA, 17 nt, Homo sapiens
cacucaguuuaugcugu

SEQ ID NO: 1337896 - RNA, 16 nt, Homo sapiens
cacuccaagugcccca

SEQ ID NO: 1337897 - RNA, 14 nt, Homo sapiens
cacuccacuggccu

SEQ ID NO: 1337898 - RNA, 18 nt, Homo sapiens
cacucuguugguagcaau

SEQ ID NO: 1337899 - RNA, 23 nt, Homo sapiens
cacugacuucuaaguaaaaccac

SEQ ID NO: 1337900 - RNA, 13 nt, Homo sapiens
cacugaggacaca

SEQ ID NO: 1337901 - RNA, 14 nt, Homo sapiens
cacugaugcaagga

SEQ ID NO: 1337902 - RNA, 12 nt, Homo sapiens
cacugcaaacac

SEQ ID NO: 1337903 - RNA, 14 nt, Homo sapiens
cacugcaaacacac

SEQ ID NO: 1337904 - RNA, 14 nt, Homo sapiens
cacugcagugcuga

SEQ ID NO: 1337905 - RNA, 12 nt, Homo sapiens
cacugccaugga

SEQ ID NO: 1337906 - RNA, 23 nt, Homo sapiens
cacugcgcccuuaacugcaucca

SEQ ID NO: 1337907 - RNA, 21 nt, Homo sapiens
cacugcugaggacacucagug

SEQ ID NO: 1337908 - RNA, 22 nt, Homo sapiens
cacugcuuggcccuucaagggu

SEQ ID NO: 1337909 - RNA, 18 nt, Homo sapiens
cacuggaggggucuccuc

SEQ ID NO: 1337910 - RNA, 23 nt, Homo sapiens
cacuggaggggucuccucugcag

SEQ ID NO: 1337911 - RNA, 23 nt, Homo sapiens
cacuggauccaucuugagccaca

SEQ ID NO: 1337912 - RNA, 22 nt, Homo sapiens
cacuggugggccauuagauuug

SEQ ID NO: 1337913 - RNA, 19 nt, Homo sapiens
cacugguuuguucccugug

SEQ ID NO: 1337914 - RNA, 15 nt, Homo sapiens
cacuuaaagaaauaa

SEQ ID NO: 1337915 - RNA, 18 nt, Homo sapiens
cacuucaaugcacauggu

SEQ ID NO: 1337916 - RNA, 17 nt, Homo sapiens
cacuucccagagcaucu

SEQ ID NO: 1337917 - RNA, 20 nt, Homo sapiens
cacuuccugcugcgaaagac

SEQ ID NO: 1337918 - RNA, 23 nt, Homo sapiens
cacuuugggaggccaaggcagaa

SEQ ID NO: 1337919 - RNA, 21 nt, Homo sapiens
cagaaaacagggucugggaca

SEQ ID NO: 1337920 - RNA, 17 nt, Homo sapiens
cagaaaagcaauacugu

SEQ ID NO: 1337921 - RNA, 18 nt, Homo sapiens
cagaaaagcccaaguuca

SEQ ID NO: 1337922 - RNA, 15 nt, Homo sapiens
cagaaaagugccuga

SEQ ID NO: 1337923 - RNA, 18 nt, Homo sapiens
cagaaacaaaaacacuaa

SEQ ID NO: 1337924 - RNA, 13 nt, Homo sapiens
cagaaacugaugc

SEQ ID NO: 1337925 - RNA, 22 nt, Homo sapiens
cagaaacugaugccaaggggcu

SEQ ID NO: 1337926 - RNA, 20 nt, Homo sapiens
cagaaagccugggugacauu

SEQ ID NO: 1337927 - RNA, 22 nt, Homo sapiens
cagaaagcuucauccacagccu

SEQ ID NO: 1337928 - RNA, 16 nt, Homo sapiens
cagaaaguaagcauuu

SEQ ID NO: 1337929 - RNA, 19 nt, Homo sapiens
cagaaaguaagcauuucca

SEQ ID NO: 1337930 - RNA, 17 nt, Homo sapiens
cagaaaugucauguggc

SEQ ID NO: 1337931 - RNA, 23 nt, Homo sapiens
cagaaauugaccugauuuccauu

SEQ ID NO: 1337932 - RNA, 12 nt, Homo sapiens
cagaaccaaagc

SEQ ID NO: 1337933 - RNA, 16 nt, Homo sapiens
cagaaccaaagcucaa

SEQ ID NO: 1337934 - RNA, 19 nt, Homo sapiens
cagaaccuucaacccagug

SEQ ID NO: 1337935 - RNA, 17 nt, Homo sapiens
cagaacucaaaugagcc

SEQ ID NO: 1337936 - RNA, 14 nt, Homo sapiens
cagaagaaaucaua

SEQ ID NO: 1337937 - RNA, 14 nt, Homo sapiens
cagaagucccuuca

SEQ ID NO: 1337938 - RNA, 17 nt, Homo sapiens
cagaauauugugcccca

SEQ ID NO: 1337939 - RNA, 18 nt, Homo sapiens
cagaauauugugccccau

SEQ ID NO: 1337940 - RNA, 12 nt, Homo sapiens
cagaauguugaa

SEQ ID NO: 1337941 - RNA, 19 nt, Homo sapiens
cagaauuguuccaguacua

SEQ ID NO: 1337942 - RNA, 20 nt, Homo sapiens
cagacacuaacgaaauauca

SEQ ID NO: 1337943 - RNA, 20 nt, Homo sapiens
cagacagacaacacugggaa

SEQ ID NO: 1337944 - RNA, 18 nt, Homo sapiens
cagacauccucuaugcca

SEQ ID NO: 1337945 - RNA, 13 nt, Homo sapiens
cagacaugccaca

SEQ ID NO: 1337946 - RNA, 17 nt, Homo sapiens
cagacaugccacaagga

SEQ ID NO: 1337947 - RNA, 14 nt, Homo sapiens
cagaccacuugcca

SEQ ID NO: 1337948 - RNA, 22 nt, Homo sapiens
cagaccagcuggcgggugugga

SEQ ID NO: 1337949 - RNA, 15 nt, Homo sapiens
cagacccagucccac

SEQ ID NO: 1337950 - RNA, 18 nt, Homo sapiens
cagaccccacgcugacca

SEQ ID NO: 1337951 - RNA, 20 nt, Homo sapiens
acacucauggggaagcuucc

SEQ ID NO: 1337952 - RNA, 17 nt, Homo sapiens
acacugaaucauuaaca

SEQ ID NO: 1337953 - RNA, 10 nt, Homo sapiens
acacugagaa

SEQ ID NO: 1337954 - RNA, 13 nt, Homo sapiens
acacugugucauu

SEQ ID NO: 1337955 - RNA, 15 nt, Homo sapiens
acacuuaauagcaac

SEQ ID NO: 1337956 - RNA, 15 nt, Homo sapiens
acagaaaccuuuuau

SEQ ID NO: 1337957 - RNA, 16 nt, Homo sapiens
acagaacaugcuguua

SEQ ID NO: 1337958 - RNA, 20 nt, Homo sapiens
acagaacuuguggccuuuau

SEQ ID NO: 1337959 - RNA, 22 nt, Homo sapiens
acagaacuuuuccucuguauca

SEQ ID NO: 1337960 - RNA, 15 nt, Homo sapiens
acagacacucccacu

SEQ ID NO: 1337961 - RNA, 18 nt, Homo sapiens
acagacauccucuaugcc

SEQ ID NO: 1337962 - RNA, 16 nt, Homo sapiens
acagaccacuugccac

SEQ ID NO: 1337963 - RNA, 14 nt, Homo sapiens
acagacuguguuua

SEQ ID NO: 1337964 - RNA, 19 nt, Homo sapiens
acagagaaguuuguagcca

SEQ ID NO: 1337965 - RNA, 22 nt, Homo sapiens
acagaggaauuuauaccucaaa

SEQ ID NO: 1337966 - RNA, 14 nt, Homo sapiens
acagagggaagcca

SEQ ID NO: 1337967 - RNA, 15 nt, Homo sapiens
acagagggaagccau

SEQ ID NO: 1337968 - RNA, 16 nt, Homo sapiens
acagaugcugagccau

SEQ ID NO: 1337969 - RNA, 20 nt, Homo sapiens
acagauuuaaagaaaaccac

SEQ ID NO: 1337970 - RNA, 15 nt, Homo sapiens
acagauuuggaaaga

SEQ ID NO: 1337971 - RNA, 13 nt, Homo sapiens
acagcaaaugugu

SEQ ID NO: 1337972 - RNA, 23 nt, Homo sapiens
acagcaauucaugguucaaguau

SEQ ID NO: 1337973 - RNA, 17 nt, Homo sapiens
acagcagccccugcaca

SEQ ID NO: 1337974 - RNA, 14 nt, Homo sapiens
acagcagggacaag

SEQ ID NO: 1337975 - RNA, 15 nt, Homo sapiens
acagccaaaccacug

SEQ ID NO: 1337976 - RNA, 20 nt, Homo sapiens
acagccugagucaccugcag

SEQ ID NO: 1337977 - RNA, 15 nt, Homo sapiens
acagccuuagagcuc

SEQ ID NO: 1337978 - RNA, 22 nt, Homo sapiens
acagccuucuaaauucccaaau

SEQ ID NO: 1337979 - RNA, 17 nt, Homo sapiens
acagccuugcaacccaa

SEQ ID NO: 1337980 - RNA, 22 nt, Homo sapiens
acagcuagaaagcugcacuggu

SEQ ID NO: 1337981 - RNA, 20 nt, Homo sapiens
acagcucuagacacugccac

SEQ ID NO: 1337982 - RNA, 14 nt, Homo sapiens
acagcugugcucca

SEQ ID NO: 1337983 - RNA, 16 nt, Homo sapiens
acagcuuugucuccaa

SEQ ID NO: 1337984 - RNA, 15 nt, Homo sapiens
acaggagaugcugug

SEQ ID NO: 1337985 - RNA, 13 nt, Homo sapiens
acaggcacuccaa

SEQ ID NO: 1337986 - RNA, 21 nt, Homo sapiens
acaggcccuuccucuccacug

SEQ ID NO: 1337987 - RNA, 15 nt, Homo sapiens
acagggcauggccag

SEQ ID NO: 1337988 - RNA, 12 nt, Homo sapiens
acagggccagug

SEQ ID NO: 1337989 - RNA, 14 nt, Homo sapiens
acagggucuugcua

SEQ ID NO: 1337990 - RNA, 21 nt, Homo sapiens
acaguaggucccggccagcuc

SEQ ID NO: 1337991 - RNA, 12 nt, Homo sapiens
acagucacugga

SEQ ID NO: 1337992 - RNA, 15 nt, Homo sapiens
acagucagaaccacu

SEQ ID NO: 1337993 - RNA, 18 nt, Homo sapiens
acaguccacaggggccac

SEQ ID NO: 1337994 - RNA, 13 nt, Homo sapiens
acagucucaggaa

SEQ ID NO: 1337995 - RNA, 20 nt, Homo sapiens
acagucucccuuccuaugcu

SEQ ID NO: 1337996 - RNA, 16 nt, Homo sapiens
acagugccuauugaua

SEQ ID NO: 1337997 - RNA, 21 nt, Homo sapiens
acagugcucuuuucuccucac

SEQ ID NO: 1337998 - RNA, 18 nt, Homo sapiens
acaguggcucaugccugu

SEQ ID NO: 1337999 - RNA, 19 nt, Homo sapiens
acaguggggcugcaggcag

SEQ ID NO: 1338000 - RNA, 12 nt, Homo sapiens
acagugugagca

SEQ ID NO: 1338001 - RNA, 21 nt, Homo sapiens
acaguucuuugggccagacau

SEQ ID NO: 1338002 - RNA, 18 nt, Homo sapiens
acaguuucuugcuuggaa

SEQ ID NO: 1338003 - RNA, 20 nt, Homo sapiens
acauaaaggcuaacuaugag

SEQ ID NO: 1338004 - RNA, 16 nt, Homo sapiens
acauaacggaaaguuu

SEQ ID NO: 1338005 - RNA, 19 nt, Homo sapiens
acauaacuccugucccuuu

SEQ ID NO: 1338006 - RNA, 14 nt, Homo sapiens
acauaauaauagca

SEQ ID NO: 1338007 - RNA, 23 nt, Homo sapiens
acauaauaauagcagugguaaaa

SEQ ID NO: 1338008 - RNA, 13 nt, Homo sapiens
acauacaaaauaa

SEQ ID NO: 1338009 - RNA, 22 nt, Homo sapiens
acauacguuuguguggugacau

SEQ ID NO: 1338010 - RNA, 15 nt, Homo sapiens
acauacuuaaugcau

SEQ ID NO: 1338011 - RNA, 12 nt, Homo sapiens
acauagcugugc

SEQ ID NO: 1338012 - RNA, 11 nt, Homo sapiens
acauagugaua

SEQ ID NO: 1338013 - RNA, 22 nt, Homo sapiens
acauauaacgcagucuaauuac

SEQ ID NO: 1338014 - RNA, 13 nt, Homo sapiens
acauauagaauaa

SEQ ID NO: 1338015 - RNA, 12 nt, Homo sapiens
acauaugugcug

SEQ ID NO: 1338016 - RNA, 22 nt, Homo sapiens
acaucaaagacagcaucuaaga

SEQ ID NO: 1338017 - RNA, 22 nt, Homo sapiens
acaucaaggcucuuccguucca

SEQ ID NO: 1338018 - RNA, 19 nt, Homo sapiens
acaucagcaaacaggauca

SEQ ID NO: 1338019 - RNA, 14 nt, Homo sapiens
acaucauggacuga

SEQ ID NO: 1338020 - RNA, 17 nt, Homo sapiens
acauccauucuucccuu

SEQ ID NO: 1338021 - RNA, 17 nt, Homo sapiens
acauccccuucugcaau

SEQ ID NO: 1338022 - RNA, 11 nt, Homo sapiens
acaucccucag

SEQ ID NO: 1338023 - RNA, 21 nt, Homo sapiens
acauccuaugaaauacuuuau

SEQ ID NO: 1338024 - RNA, 19 nt, Homo sapiens
acauccuucucacugccau

SEQ ID NO: 1338025 - RNA, 16 nt, Homo sapiens
acaucuggcugcacag

SEQ ID NO: 1338026 - RNA, 15 nt, Homo sapiens
acaucuguauacccu

SEQ ID NO: 1338027 - RNA, 20 nt, Homo sapiens
acaugaaaugcccuccuaaa

SEQ ID NO: 1338028 - RNA, 14 nt, Homo sapiens
acaugagucaaaac

SEQ ID NO: 1338029 - RNA, 20 nt, Homo sapiens
acaugauaccucugaucaag

SEQ ID NO: 1338030 - RNA, 13 nt, Homo sapiens
acaugcacucagc

SEQ ID NO: 1338031 - RNA, 21 nt, Homo sapiens
acaugcacucagcucuuggcu

SEQ ID NO: 1338032 - RNA, 20 nt, Homo sapiens
acaugccucugccaaaggau

SEQ ID NO: 1338033 - RNA, 16 nt, Homo sapiens
acaugcuugcauuaua

SEQ ID NO: 1338034 - RNA, 17 nt, Homo sapiens
acaugggcucuucacua

SEQ ID NO: 1338035 - RNA, 17 nt, Homo sapiens
acaugguuacauaucaa

SEQ ID NO: 1338036 - RNA, 20 nt, Homo sapiens
acaugguucaaaucuagaag

SEQ ID NO: 1338037 - RNA, 17 nt, Homo sapiens
acauguauugcacauug

SEQ ID NO: 1338038 - RNA, 18 nt, Homo sapiens
acauguauugcacauugu

SEQ ID NO: 1338039 - RNA, 16 nt, Homo sapiens
acaugucagccacugu

SEQ ID NO: 1338040 - RNA, 23 nt, Homo sapiens
acaugugugugguggugacucau

SEQ ID NO: 1338041 - RNA, 23 nt, Homo sapiens
acauguuuccaucauuucugucu

SEQ ID NO: 1338042 - RNA, 20 nt, Homo sapiens
acauuagucguuauauuuga

SEQ ID NO: 1338043 - RNA, 12 nt, Homo sapiens
acauuaucucac

SEQ ID NO: 1338044 - RNA, 19 nt, Homo sapiens
acauuauuuaauauaguaa

SEQ ID NO: 1338045 - RNA, 15 nt, Homo sapiens
acauucaauagcaua

SEQ ID NO: 1338046 - RNA, 18 nt, Homo sapiens
acauucaauagcauauca

SEQ ID NO: 1338047 - RNA, 15 nt, Homo sapiens
acauucagaaguaau

SEQ ID NO: 1338048 - RNA, 19 nt, Homo sapiens
acauugacagcaauucaug

SEQ ID NO: 1338049 - RNA, 22 nt, Homo sapiens
acauuggcaccuaauccaggca

SEQ ID NO: 1338050 - RNA, 12 nt, Homo sapiens
acauuguagccu

SEQ ID NO: 1338051 - RNA, 14 nt, Homo sapiens
acauuuacugugga

SEQ ID NO: 1338052 - RNA, 15 nt, Homo sapiens
acauuuacuguggau

SEQ ID NO: 1338053 - RNA, 17 nt, Homo sapiens
acauuuccaaaugaacu

SEQ ID NO: 1338054 - RNA, 13 nt, Homo sapiens
acauuugggagac

SEQ ID NO: 1338055 - RNA, 19 nt, Homo sapiens
acauuugggagacauguga

SEQ ID NO: 1338056 - RNA, 21 nt, Homo sapiens
acauuugugggcaagcagaug

SEQ ID NO: 1338057 - RNA, 14 nt, Homo sapiens
acauuuuaaaugaa

SEQ ID NO: 1338058 - RNA, 16 nt, Homo sapiens
acauuuuaaaugaaag

SEQ ID NO: 1338059 - RNA, 14 nt, Homo sapiens
acauuuuacauuaa

SEQ ID NO: 1338060 - RNA, 21 nt, Homo sapiens
acauuuuagaaugucaauaaa

SEQ ID NO: 1338061 - RNA, 16 nt, Homo sapiens
acauuuucauugauga

SEQ ID NO: 1338062 - RNA, 15 nt, Homo sapiens
acauuuugacacaaa

SEQ ID NO: 1338063 - RNA, 16 nt, Homo sapiens
acauuuugacacaaaa

SEQ ID NO: 1338064 - RNA, 22 nt, Homo sapiens
acauuuuuaaaaauugucauuu

SEQ ID NO: 1338065 - RNA, 23 nt, Homo sapiens
acauuuuuugggcagcaauuuaa

SEQ ID NO: 1338066 - RNA, 14 nt, Homo sapiens
accaaaaugccaaa

SEQ ID NO: 1338067 - RNA, 18 nt, Homo sapiens
accaaaugcuuuuccuca

SEQ ID NO: 1338068 - RNA, 12 nt, Homo sapiens
accaaccacagc

SEQ ID NO: 1338069 - RNA, 17 nt, Homo sapiens
accaacuacuaccugua

SEQ ID NO: 1338070 - RNA, 23 nt, Homo sapiens
accaacuacuaccuguaaugaca

SEQ ID NO: 1338071 - RNA, 16 nt, Homo sapiens
accaagcucuguccaa

SEQ ID NO: 1338072 - RNA, 15 nt, Homo sapiens
accaaguggcuccca

SEQ ID NO: 1338073 - RNA, 21 nt, Homo sapiens
accaaugccaaaaaaagacag

SEQ ID NO: 1338074 - RNA, 22 nt, Homo sapiens
accaaugccaaaaaaagacagg

SEQ ID NO: 1338075 - RNA, 15 nt, Homo sapiens
accaauugaagcaug

SEQ ID NO: 1338076 - RNA, 21 nt, Homo sapiens
accacagucuucccagcaauu

SEQ ID NO: 1338077 - RNA, 14 nt, Homo sapiens
accacaugauucug

SEQ ID NO: 1338078 - RNA, 14 nt, Homo sapiens
accacgaggaaaag

SEQ ID NO: 1338079 - RNA, 15 nt, Homo sapiens
accacucaggccaca

SEQ ID NO: 1338080 - RNA, 12 nt, Homo sapiens
accacucugucu

SEQ ID NO: 1338081 - RNA, 17 nt, Homo sapiens
accagaaaagcaauacu

SEQ ID NO: 1338082 - RNA, 15 nt, Homo sapiens
accagaaagcuucau

SEQ ID NO: 1338083 - RNA, 13 nt, Homo sapiens
accagacagacaa

SEQ ID NO: 1338084 - RNA, 22 nt, Homo sapiens
accagacagacaacacugggaa

SEQ ID NO: 1338085 - RNA, 14 nt, Homo sapiens
accagcagcgccuu

SEQ ID NO: 1338086 - RNA, 14 nt, Homo sapiens
accagcccaaccau

SEQ ID NO: 1338087 - RNA, 20 nt, Homo sapiens
accagccugggcaacauagu

SEQ ID NO: 1338088 - RNA, 13 nt, Homo sapiens
accagggaugcug

SEQ ID NO: 1338089 - RNA, 18 nt, Homo sapiens
accaggggccaaccucag

SEQ ID NO: 1338090 - RNA, 19 nt, Homo sapiens
accaguauuuaacuucuga

SEQ ID NO: 1338091 - RNA, 20 nt, Homo sapiens
accagucuccuccccuacuc

SEQ ID NO: 1338092 - RNA, 17 nt, Homo sapiens
accagucugacccuuac

SEQ ID NO: 1338093 - RNA, 18 nt, Homo sapiens
accagugaaucuuuguca

SEQ ID NO: 1338094 - RNA, 11 nt, Homo sapiens
accaguguucc

SEQ ID NO: 1338095 - RNA, 18 nt, Homo sapiens
accaguuaauuuuuccaa

SEQ ID NO: 1338096 - RNA, 21 nt, Homo sapiens
accauaccuuagagacuuuga

SEQ ID NO: 1338097 - RNA, 17 nt, Homo sapiens
accauauuuuauuguau

SEQ ID NO: 1338098 - RNA, 16 nt, Homo sapiens
accaucugcugcaguu

SEQ ID NO: 1338099 - RNA, 22 nt, Homo sapiens
accaugcugcuggggaagacag

SEQ ID NO: 1338100 - RNA, 16 nt, Homo sapiens
accauguggccauuaa

SEQ ID NO: 1338101 - RNA, 19 nt, Homo sapiens
accauguggccauuaacaa

SEQ ID NO: 1338102 - RNA, 14 nt, Homo sapiens
accauuucagagag

SEQ ID NO: 1338103 - RNA, 23 nt, Homo sapiens
acccaaguuaguucaauccugau

SEQ ID NO: 1338104 - RNA, 16 nt, Homo sapiens
acccacacagcugccc

SEQ ID NO: 1338105 - RNA, 19 nt, Homo sapiens
acccaccccguagauuccc

SEQ ID NO: 1338106 - RNA, 22 nt, Homo sapiens
acccacucuguugguagcaauu

SEQ ID NO: 1338107 - RNA, 18 nt, Homo sapiens
acccagaaagaauguuca

SEQ ID NO: 1338108 - RNA, 16 nt, Homo sapiens
acccagcuaugguucu

SEQ ID NO: 1338109 - RNA, 18 nt, Homo sapiens
acccagugcugaauuucc

SEQ ID NO: 1338110 - RNA, 19 nt, Homo sapiens
acccaguugugacaauuaa

SEQ ID NO: 1338111 - RNA, 21 nt, Homo sapiens
accccaagggggcugcugcuc

SEQ ID NO: 1338112 - RNA, 15 nt, Homo sapiens
accccacgcugacca

SEQ ID NO: 1338113 - RNA, 22 nt, Homo sapiens
accccagauucaugcacuguag

SEQ ID NO: 1338114 - RNA, 19 nt, Homo sapiens
accccagucccagcuaacu

SEQ ID NO: 1338115 - RNA, 15 nt, Homo sapiens
accccaucucuacua

SEQ ID NO: 1338116 - RNA, 18 nt, Homo sapiens
accccgagaagugcucuu

SEQ ID NO: 1338117 - RNA, 14 nt, Homo sapiens
accccgccaugcau

SEQ ID NO: 1338118 - RNA, 17 nt, Homo sapiens
accccgucacagccuca

SEQ ID NO: 1338119 - RNA, 14 nt, Homo sapiens
accccucacuguga

SEQ ID NO: 1338120 - RNA, 12 nt, Homo sapiens
accccuccaguu

SEQ ID NO: 1338121 - RNA, 17 nt, Homo sapiens
accccuuucuaguucaa

SEQ ID NO: 1338122 - RNA, 22 nt, Homo sapiens
accccuuucugucccacuacau

SEQ ID NO: 1338123 - RNA, 18 nt, Homo sapiens
acccgacugaaacuggaa

SEQ ID NO: 1338124 - RNA, 21 nt, Homo sapiens
acccuaaaguauaacaugucg

SEQ ID NO: 1338125 - RNA, 16 nt, Homo sapiens
acccuacaguauauaa

SEQ ID NO: 1338126 - RNA, 21 nt, Homo sapiens
acccucgggccccauccucau

SEQ ID NO: 1338127 - RNA, 19 nt, Homo sapiens
acccugaaggggccaugau

SEQ ID NO: 1338128 - RNA, 23 nt, Homo sapiens
acccugacuccucuuugugcaga

SEQ ID NO: 1338129 - RNA, 16 nt, Homo sapiens
acccugacuguauaca

SEQ ID NO: 1338130 - RNA, 18 nt, Homo sapiens
acccugaggucacugcua

SEQ ID NO: 1338131 - RNA, 18 nt, Homo sapiens
acccugcaagaccacgga

SEQ ID NO: 1338132 - RNA, 16 nt, Homo sapiens
acccugcccaccaaga

SEQ ID NO: 1338133 - RNA, 14 nt, Homo sapiens
acccuguuuuacaa

SEQ ID NO: 1338134 - RNA, 14 nt, Homo sapiens
acccuuaggccagc

SEQ ID NO: 1338135 - RNA, 17 nt, Homo sapiens
acccuucagauuugccu

SEQ ID NO: 1338136 - RNA, 20 nt, Homo sapiens
acccuucccgccucccucuc

SEQ ID NO: 1338137 - RNA, 19 nt, Homo sapiens
acccuuggccuuuacagaa

SEQ ID NO: 1338138 - RNA, 21 nt, Homo sapiens
acccuuucagaaucuuuucaa

SEQ ID NO: 1338139 - RNA, 13 nt, Homo sapiens
accgauggccaug

SEQ ID NO: 1338140 - RNA, 20 nt, Homo sapiens
accgcaggugcucaugcugc

SEQ ID NO: 1338141 - RNA, 20 nt, Homo sapiens
accgccaacugcagcucucc

SEQ ID NO: 1338142 - RNA, 21 nt, Homo sapiens
accgcgcccagccucaucucu

SEQ ID NO: 1338143 - RNA, 22 nt, Homo sapiens
accggaaggaggccaaccagcc

SEQ ID NO: 1338144 - RNA, 14 nt, Homo sapiens
accgggaugggagc

SEQ ID NO: 1338145 - RNA, 15 nt, Homo sapiens
accguaaauguccau

SEQ ID NO: 1338146 - RNA, 18 nt, Homo sapiens
accgucacacucuucagu

SEQ ID NO: 1338147 - RNA, 22 nt, Homo sapiens
accuaaaagacagcagggacaa

SEQ ID NO: 1338148 - RNA, 15 nt, Homo sapiens
accuaauccaggcag

SEQ ID NO: 1338149 - RNA, 16 nt, Homo sapiens
accuacauuaucucac

SEQ ID NO: 1338150 - RNA, 23 nt, Homo sapiens
accuagauugcaccauugcacuc

SEQ ID NO: 1338151 - RNA, 18 nt, Homo sapiens
accuagcagccucaaaac

SEQ ID NO: 1338152 - RNA, 17 nt, Homo sapiens
accuauccuuacauuuc

SEQ ID NO: 1338153 - RNA, 18 nt, Homo sapiens
accucaccugggcaggga

SEQ ID NO: 1338154 - RNA, 12 nt, Homo sapiens
accucacugcag

SEQ ID NO: 1338155 - RNA, 22 nt, Homo sapiens
accucacuggccugccaugcca

SEQ ID NO: 1338156 - RNA, 16 nt, Homo sapiens
accucagccuggccag

SEQ ID NO: 1338157 - RNA, 19 nt, Homo sapiens
accucagccuggccagaca

SEQ ID NO: 1338158 - RNA, 22 nt, Homo sapiens
accucaguugaaaaugcaacuc

SEQ ID NO: 1338159 - RNA, 15 nt, Homo sapiens
accuccacauaccug

SEQ ID NO: 1338160 - RNA, 23 nt, Homo sapiens
accucccacugcccccuccacug

SEQ ID NO: 1338161 - RNA, 17 nt, Homo sapiens
accuccgccccugcccc

SEQ ID NO: 1338162 - RNA, 19 nt, Homo sapiens
accuccuuguguugcacug

SEQ ID NO: 1338163 - RNA, 19 nt, Homo sapiens
accucgucaagagcaugca

SEQ ID NO: 1338164 - RNA, 13 nt, Homo sapiens
accucuaacugau

SEQ ID NO: 1338165 - RNA, 13 nt, Homo sapiens
accucucauaaau

SEQ ID NO: 1338166 - RNA, 22 nt, Homo sapiens
accucuguggucacccaugcau

SEQ ID NO: 1338167 - RNA, 18 nt, Homo sapiens
accugaaauuaacucaga

SEQ ID NO: 1338168 - RNA, 15 nt, Homo sapiens
accugauauauucca

SEQ ID NO: 1338169 - RNA, 16 nt, Homo sapiens
accugauuuccauuug

SEQ ID NO: 1338170 - RNA, 18 nt, Homo sapiens
accugauuuccauuugca

SEQ ID NO: 1338171 - RNA, 13 nt, Homo sapiens
accugcauugaac

SEQ ID NO: 1338172 - RNA, 16 nt, Homo sapiens
accugccccugccuga

SEQ ID NO: 1338173 - RNA, 23 nt, Homo sapiens
accugcucuuguucuacugagaa

SEQ ID NO: 1338174 - RNA, 23 nt, Homo sapiens
accugcuguuggaugcagcaaua

SEQ ID NO: 1338175 - RNA, 20 nt, Homo sapiens
accuggauccagcacuggug

SEQ ID NO: 1338176 - RNA, 17 nt, Homo sapiens
accuggauguacuuaag

SEQ ID NO: 1338177 - RNA, 18 nt, Homo sapiens
accugggcaauauagcaa

SEQ ID NO: 1338178 - RNA, 11 nt, Homo sapiens
accugggccag

SEQ ID NO: 1338179 - RNA, 21 nt, Homo sapiens
accuggggagugguuaggcag

SEQ ID NO: 1338180 - RNA, 20 nt, Homo sapiens
accuguaaucccagcacuuu

SEQ ID NO: 1338181 - RNA, 22 nt, Homo sapiens
accugucuuauuaagacuggcu

SEQ ID NO: 1338182 - RNA, 16 nt, Homo sapiens
accuguucuaccaagc

SEQ ID NO: 1338183 - RNA, 15 nt, Homo sapiens
accuguucucuuuaa

SEQ ID NO: 1338184 - RNA, 24 nt, Homo sapiens
accuguucuuagaguguagcugua

SEQ ID NO: 1338185 - RNA, 15 nt, Homo sapiens
accuuaaugacaaca

SEQ ID NO: 1338186 - RNA, 21 nt, Homo sapiens
accuucugugcuucagcucuu

SEQ ID NO: 1338187 - RNA, 23 nt, Homo sapiens
accuuggcaccagacacccagga

SEQ ID NO: 1338188 - RNA, 18 nt, Homo sapiens
accuugggggaagacuuu

SEQ ID NO: 1338189 - RNA, 16 nt, Homo sapiens
accuuggggucccucc

SEQ ID NO: 1338190 - RNA, 16 nt, Homo sapiens
accuuucaaacccaga

SEQ ID NO: 1338191 - RNA, 20 nt, Homo sapiens
acggagucuugcucugucac

SEQ ID NO: 1338192 - RNA, 18 nt, Homo sapiens
acggccagggagaagcuc

SEQ ID NO: 1338193 - RNA, 13 nt, Homo sapiens
acggcuuacaugu

SEQ ID NO: 1338194 - RNA, 18 nt, Homo sapiens
acggcuuguaaaugugac

SEQ ID NO: 1338195 - RNA, 16 nt, Homo sapiens
acgggcacaacuggaa

SEQ ID NO: 1338196 - RNA, 14 nt, Homo sapiens
acguccugucuguu

SEQ ID NO: 1338197 - RNA, 16 nt, Homo sapiens
acguccugucuguuuc

SEQ ID NO: 1338198 - RNA, 13 nt, Homo sapiens
acgugacaggcuc

SEQ ID NO: 1338199 - RNA, 15 nt, Homo sapiens
acgugagaacaauca

SEQ ID NO: 1338200 - RNA, 15 nt, Homo sapiens
acgugcaaagccaag

SEQ ID NO: 1338201 - RNA, 15 nt, Homo sapiens
acguggguugcacug

SEQ ID NO: 1338202 - RNA, 14 nt, Homo sapiens
acguguuccagugu

SEQ ID NO: 1338203 - RNA, 22 nt, Homo sapiens
acguguuugcugucaagccauu

SEQ ID NO: 1338204 - RNA, 17 nt, Homo sapiens
acuaaacuucaccuaca

SEQ ID NO: 1338205 - RNA, 17 nt, Homo sapiens
acuaaagauacauaccu

SEQ ID NO: 1338206 - RNA, 20 nt, Homo sapiens
acuaacgaaauaucaaaguc

SEQ ID NO: 1338207 - RNA, 21 nt, Homo sapiens
acuaagaugugcagcauuuca

SEQ ID NO: 1338208 - RNA, 23 nt, Homo sapiens
acuaauagaauaaaggcaguuuu

SEQ ID NO: 1338209 - RNA, 19 nt, Homo sapiens
acuacaagugauccucagg

SEQ ID NO: 1338210 - RNA, 18 nt, Homo sapiens
acuacaguaacugugacu

SEQ ID NO: 1338211 - RNA, 21 nt, Homo sapiens
acuacuuggaacuaggcucuu

SEQ ID NO: 1338212 - RNA, 20 nt, Homo sapiens
acuagaaagaaggacccaga

SEQ ID NO: 1338213 - RNA, 15 nt, Homo sapiens
acuaggaaauuccaa

SEQ ID NO: 1338214 - RNA, 23 nt, Homo sapiens
acuaggcucuuaugugugccuuu

SEQ ID NO: 1338215 - RNA, 15 nt, Homo sapiens
acuagggaagcucag

SEQ ID NO: 1338216 - RNA, 20 nt, Homo sapiens
acuaguguuauacuugauga

SEQ ID NO: 1338217 - RNA, 13 nt, Homo sapiens
acuaucugugcca

SEQ ID NO: 1338218 - RNA, 23 nt, Homo sapiens
acuaugagccaggcaucauacua

SEQ ID NO: 1338219 - RNA, 13 nt, Homo sapiens
acuaugagccuau

SEQ ID NO: 1338220 - RNA, 13 nt, Homo sapiens
aaucuggauucau

SEQ ID NO: 1338221 - RNA, 16 nt, Homo sapiens
aaucugugcuguuuca

SEQ ID NO: 1338222 - RNA, 16 nt, Homo sapiens
aaucuuacaacaggcu

SEQ ID NO: 1338223 - RNA, 22 nt, Homo sapiens
aaugaaaguauuggcauucaaa

SEQ ID NO: 1338224 - RNA, 14 nt, Homo sapiens
aaugaaccacaaaa

SEQ ID NO: 1338225 - RNA, 13 nt, Homo sapiens
aaugaaccuucug

SEQ ID NO: 1338226 - RNA, 16 nt, Homo sapiens
aaugaaccuucuggcc

SEQ ID NO: 1338227 - RNA, 22 nt, Homo sapiens
aaugaaguagaaguuacuuaau

SEQ ID NO: 1338228 - RNA, 17 nt, Homo sapiens
aaugaauaaacaguuau

SEQ ID NO: 1338229 - RNA, 22 nt, Homo sapiens
aaugacaaaugacugucucuug

SEQ ID NO: 1338230 - RNA, 15 nt, Homo sapiens
aaugacacagucuug

SEQ ID NO: 1338231 - RNA, 13 nt, Homo sapiens
aaugacaguaguc

SEQ ID NO: 1338232 - RNA, 10 nt, Homo sapiens
aaugacauuc

SEQ ID NO: 1338233 - RNA, 17 nt, Homo sapiens
aaugaccgagcccugga

SEQ ID NO: 1338234 - RNA, 15 nt, Homo sapiens
aaugaccucaaggaa

SEQ ID NO: 1338235 - RNA, 14 nt, Homo sapiens
aaugacucaaaguc

SEQ ID NO: 1338236 - RNA, 19 nt, Homo sapiens
aaugacucaggacaucccc

SEQ ID NO: 1338237 - RNA, 17 nt, Homo sapiens
aaugaggucuguuuaaa

SEQ ID NO: 1338238 - RNA, 13 nt, Homo sapiens
aaugagugcaccu

SEQ ID NO: 1338239 - RNA, 16 nt, Homo sapiens
aaugauauuguuauau

SEQ ID NO: 1338240 - RNA, 23 nt, Homo sapiens
aaugcaaccauuuuuaggaagcu

SEQ ID NO: 1338241 - RNA, 14 nt, Homo sapiens
aaugccacugggac

SEQ ID NO: 1338242 - RNA, 23 nt, Homo sapiens
aaugccagcauaaauccauccau

SEQ ID NO: 1338243 - RNA, 12 nt, Homo sapiens
aaugcugagaag

SEQ ID NO: 1338244 - RNA, 17 nt, Homo sapiens
aaugcugauaugaucuu

SEQ ID NO: 1338245 - RNA, 19 nt, Homo sapiens
aaugcuuuucuaaugccuu

SEQ ID NO: 1338246 - RNA, 14 nt, Homo sapiens
aauggagauuucau

SEQ ID NO: 1338247 - RNA, 20 nt, Homo sapiens
aauggcgcgaucuuggcuca

SEQ ID NO: 1338248 - RNA, 14 nt, Homo sapiens
aauguaaaagcaca

SEQ ID NO: 1338249 - RNA, 22 nt, Homo sapiens
aauguaagggaaacugccagca

SEQ ID NO: 1338250 - RNA, 19 nt, Homo sapiens
aauguaauagccaaaccca

SEQ ID NO: 1338251 - RNA, 13 nt, Homo sapiens
aaugugacucagc

SEQ ID NO: 1338252 - RNA, 20 nt, Homo sapiens
aauguggauuaaagugccca

SEQ ID NO: 1338253 - RNA, 18 nt, Homo sapiens
aauguguguagauuucau

SEQ ID NO: 1338254 - RNA, 22 nt, Homo sapiens
aauguguuuuucccccaugaaa

SEQ ID NO: 1338255 - RNA, 23 nt, Homo sapiens
aauguuaauuaugcaguguuucc

SEQ ID NO: 1338256 - RNA, 13 nt, Homo sapiens
aauguuaccucua

SEQ ID NO: 1338257 - RNA, 18 nt, Homo sapiens
aauguuaugacuauguaa

SEQ ID NO: 1338258 - RNA, 17 nt, Homo sapiens
aauguucuccagucauu

SEQ ID NO: 1338259 - RNA, 16 nt, Homo sapiens
aauguuggagcagcag

SEQ ID NO: 1338260 - RNA, 21 nt, Homo sapiens
aauuaauaucccuacauguau

SEQ ID NO: 1338261 - RNA, 18 nt, Homo sapiens
aauuaaugcagauuucuc

SEQ ID NO: 1338262 - RNA, 23 nt, Homo sapiens
aauuagaucgguucugugccuuu

SEQ ID NO: 1338263 - RNA, 15 nt, Homo sapiens
aauuauauagcugcu

SEQ ID NO: 1338264 - RNA, 18 nt, Homo sapiens
aauuauuuaacuaauuaa

SEQ ID NO: 1338265 - RNA, 18 nt, Homo sapiens
aauucaguaacaaagguu

SEQ ID NO: 1338266 - RNA, 16 nt, Homo sapiens
aauucaucuucagucu

SEQ ID NO: 1338267 - RNA, 16 nt, Homo sapiens
aauucauuugcuugca

SEQ ID NO: 1338268 - RNA, 19 nt, Homo sapiens
aauucauuuuuuaaauucc

SEQ ID NO: 1338269 - RNA, 20 nt, Homo sapiens
aauuccugauggaaaaugca

SEQ ID NO: 1338270 - RNA, 19 nt, Homo sapiens
aauucuaaauuacaaaggu

SEQ ID NO: 1338271 - RNA, 18 nt, Homo sapiens
aauucuaccuccuugugu

SEQ ID NO: 1338272 - RNA, 14 nt, Homo sapiens
aauucuacuuugag

SEQ ID NO: 1338273 - RNA, 15 nt, Homo sapiens
aauucugaacuuuau

SEQ ID NO: 1338274 - RNA, 21 nt, Homo sapiens
aauucugcccgcuccauggaa

SEQ ID NO: 1338275 - RNA, 16 nt, Homo sapiens
aauucugugacauaca

SEQ ID NO: 1338276 - RNA, 15 nt, Homo sapiens
aauugacaacacagc

SEQ ID NO: 1338277 - RNA, 17 nt, Homo sapiens
aauugacaagucacaga

SEQ ID NO: 1338278 - RNA, 13 nt, Homo sapiens
aauugacugucac

SEQ ID NO: 1338279 - RNA, 21 nt, Homo sapiens
aauugagcagagaaccugcuc

SEQ ID NO: 1338280 - RNA, 16 nt, Homo sapiens
aauugauaacauggaa

SEQ ID NO: 1338281 - RNA, 16 nt, Homo sapiens
aauugcuucaagcauu

SEQ ID NO: 1338282 - RNA, 18 nt, Homo sapiens
aauuggcuaaucaguaua

SEQ ID NO: 1338283 - RNA, 13 nt, Homo sapiens
aauuguacaauaa

SEQ ID NO: 1338284 - RNA, 21 nt, Homo sapiens
aauugucuuuguucugugauu

SEQ ID NO: 1338285 - RNA, 13 nt, Homo sapiens
aauugugacauaa

SEQ ID NO: 1338286 - RNA, 21 nt, Homo sapiens
aauugugagcgaauuagcaau

SEQ ID NO: 1338287 - RNA, 23 nt, Homo sapiens
aauuguuuuuaaguuuucaugaa

SEQ ID NO: 1338288 - RNA, 19 nt, Homo sapiens
aauuuagacaaagccuuaa

SEQ ID NO: 1338289 - RNA, 15 nt, Homo sapiens
aauuuauaagcauuu

SEQ ID NO: 1338290 - RNA, 21 nt, Homo sapiens
aauuuauaucagguguauaaa

SEQ ID NO: 1338291 - RNA, 21 nt, Homo sapiens
aauuucauaccuaucaucuua

SEQ ID NO: 1338292 - RNA, 19 nt, Homo sapiens
aauuucuucuuuuccugca

SEQ ID NO: 1338293 - RNA, 14 nt, Homo sapiens
aauuugugauaucu

SEQ ID NO: 1338294 - RNA, 17 nt, Homo sapiens
aauuuuauuuacauucu

SEQ ID NO: 1338295 - RNA, 13 nt, Homo sapiens
aauuuucauucau

SEQ ID NO: 1338296 - RNA, 18 nt, Homo sapiens
aauuuucauucauucacu

SEQ ID NO: 1338297 - RNA, 21 nt, Homo sapiens
aauuuucuucauacuuaaaaa

SEQ ID NO: 1338298 - RNA, 18 nt, Homo sapiens
aauuuucuuccauuucau

SEQ ID NO: 1338299 - RNA, 17 nt, Homo sapiens
aauuuuguaauguauca

SEQ ID NO: 1338300 - RNA, 14 nt, Homo sapiens
aauuuuuaggcaaa

SEQ ID NO: 1338301 - RNA, 21 nt, Homo sapiens
aauuuuugaaaaaaguacaua

SEQ ID NO: 1338302 - RNA, 22 nt, Homo sapiens
aauuuuugaaaaaaguacauau

SEQ ID NO: 1338303 - RNA, 21 nt, Homo sapiens
aauuuuuucccagacuacuau

SEQ ID NO: 1338304 - RNA, 13 nt, Homo sapiens
acaaaaacacagc

SEQ ID NO: 1338305 - RNA, 16 nt, Homo sapiens
acaaaaauuacaaaga

SEQ ID NO: 1338306 - RNA, 15 nt, Homo sapiens
acaaaaugauuuuga

SEQ ID NO: 1338307 - RNA, 16 nt, Homo sapiens
acaaaauggacauggu

SEQ ID NO: 1338308 - RNA, 15 nt, Homo sapiens
acaaacaucauuguu

SEQ ID NO: 1338309 - RNA, 17 nt, Homo sapiens
acaaacauguaagcaua

SEQ ID NO: 1338310 - RNA, 20 nt, Homo sapiens
acaaacucucaccaugaugu

SEQ ID NO: 1338311 - RNA, 14 nt, Homo sapiens
acaaagaugacugu

SEQ ID NO: 1338312 - RNA, 18 nt, Homo sapiens
acaaagcaauucuuucaa

SEQ ID NO: 1338313 - RNA, 23 nt, Homo sapiens
acaaaguggaugccugcugcauc

SEQ ID NO: 1338314 - RNA, 15 nt, Homo sapiens
acaaauaaauguuca

SEQ ID NO: 1338315 - RNA, 13 nt, Homo sapiens
acaaauauguucu

SEQ ID NO: 1338316 - RNA, 15 nt, Homo sapiens
acaaauguaaugggc

SEQ ID NO: 1338317 - RNA, 16 nt, Homo sapiens
acaacacuuaauagca

SEQ ID NO: 1338318 - RNA, 10 nt, Homo sapiens
acaacauguu

SEQ ID NO: 1338319 - RNA, 19 nt, Homo sapiens
acaaccucauuuuaacuca

SEQ ID NO: 1338320 - RNA, 16 nt, Homo sapiens
acaacuccuacaugau

SEQ ID NO: 1338321 - RNA, 22 nt, Homo sapiens
acaacugaauagcaaguggcau

SEQ ID NO: 1338322 - RNA, 15 nt, Homo sapiens
acaagaaccacuccu

SEQ ID NO: 1338323 - RNA, 17 nt, Homo sapiens
acaaggcuccacaagcg

SEQ ID NO: 1338324 - RNA, 23 nt, Homo sapiens
acaauaaagaucgcccccaccuc

SEQ ID NO: 1338325 - RNA, 17 nt, Homo sapiens
acaauaccuacaauaaa

SEQ ID NO: 1338326 - RNA, 16 nt, Homo sapiens
acaauaggucuuucuc

SEQ ID NO: 1338327 - RNA, 19 nt, Homo sapiens
acaaucagcccagugcaaa

SEQ ID NO: 1338328 - RNA, 19 nt, Homo sapiens
acaaucucuuuauuacuga

SEQ ID NO: 1338329 - RNA, 16 nt, Homo sapiens
acaaucuuccaaagaa

SEQ ID NO: 1338330 - RNA, 13 nt, Homo sapiens
acaaugauacagu

SEQ ID NO: 1338331 - RNA, 21 nt, Homo sapiens
acaaugauacaguugcauguu

SEQ ID NO: 1338332 - RNA, 12 nt, Homo sapiens
acaauuccugua

SEQ ID NO: 1338333 - RNA, 15 nt, Homo sapiens
acaauugaacuucca

SEQ ID NO: 1338334 - RNA, 14 nt, Homo sapiens
acaauuuaaugcac

SEQ ID NO: 1338335 - RNA, 21 nt, Homo sapiens
acacaaaaaaaauuuuagcuc

SEQ ID NO: 1338336 - RNA, 23 nt, Homo sapiens
acacaaauaaaggaaacccagcu

SEQ ID NO: 1338337 - RNA, 12 nt, Homo sapiens
acacaauaccua

SEQ ID NO: 1338338 - RNA, 14 nt, Homo sapiens
acacaauuacuaaa

SEQ ID NO: 1338339 - RNA, 18 nt, Homo sapiens
auuuauuuaacuauucau

SEQ ID NO: 1338340 - RNA, 22 nt, Homo sapiens
auuuauuucuuuuuugccaaau

SEQ ID NO: 1338341 - RNA, 18 nt, Homo sapiens
auuuauuuuuucuaagug

SEQ ID NO: 1338342 - RNA, 15 nt, Homo sapiens
auuucagauauucca

SEQ ID NO: 1338343 - RNA, 23 nt, Homo sapiens
auuucauacaacagaaaccagaa

SEQ ID NO: 1338344 - RNA, 18 nt, Homo sapiens
auuucaugaagcaagaau

SEQ ID NO: 1338345 - RNA, 22 nt, Homo sapiens
auuucaugcucgacacuuacca

SEQ ID NO: 1338346 - RNA, 14 nt, Homo sapiens
auuucauugcucag

SEQ ID NO: 1338347 - RNA, 16 nt, Homo sapiens
auuucauuuagcuuuu

SEQ ID NO: 1338348 - RNA, 22 nt, Homo sapiens
auuuccauaccauuguggaauu

SEQ ID NO: 1338349 - RNA, 17 nt, Homo sapiens
auuucccaacacaaaga

SEQ ID NO: 1338350 - RNA, 14 nt, Homo sapiens
auuucccccaggga

SEQ ID NO: 1338351 - RNA, 17 nt, Homo sapiens
auuucccccuucaucca

SEQ ID NO: 1338352 - RNA, 13 nt, Homo sapiens
auuuccugacaga

SEQ ID NO: 1338353 - RNA, 21 nt, Homo sapiens
auuuccuuggcuucgugaaug

SEQ ID NO: 1338354 - RNA, 18 nt, Homo sapiens
auuucuauauuccuccag

SEQ ID NO: 1338355 - RNA, 14 nt, Homo sapiens
auuucuccaaagcc

SEQ ID NO: 1338356 - RNA, 14 nt, Homo sapiens
auuucugccaggca

SEQ ID NO: 1338357 - RNA, 11 nt, Homo sapiens
auuucuuccca

SEQ ID NO: 1338358 - RNA, 23 nt, Homo sapiens
auuucuuucuuugcaccaaagac

SEQ ID NO: 1338359 - RNA, 18 nt, Homo sapiens
auuugacaaaacuaaccu

SEQ ID NO: 1338360 - RNA, 12 nt, Homo sapiens
auuugcauuucu

SEQ ID NO: 1338361 - RNA, 19 nt, Homo sapiens
auuugcuggacaaccaaca

SEQ ID NO: 1338362 - RNA, 20 nt, Homo sapiens
auuugcuuuaaugagugcac

SEQ ID NO: 1338363 - RNA, 22 nt, Homo sapiens
auuugcuuuaaugagugcaccu

SEQ ID NO: 1338364 - RNA, 18 nt, Homo sapiens
auuugggagacaugugac

SEQ ID NO: 1338365 - RNA, 20 nt, Homo sapiens
auuuggguucugccugccag

SEQ ID NO: 1338366 - RNA, 20 nt, Homo sapiens
auuuguaaauuuaugugaug

SEQ ID NO: 1338367 - RNA, 16 nt, Homo sapiens
auuugucucuguuauc

SEQ ID NO: 1338368 - RNA, 15 nt, Homo sapiens
auuugugagacugua

SEQ ID NO: 1338369 - RNA, 17 nt, Homo sapiens
auuugugauacuuccuc

SEQ ID NO: 1338370 - RNA, 21 nt, Homo sapiens
auuugugguccacugagcuau

SEQ ID NO: 1338371 - RNA, 22 nt, Homo sapiens
auuuuaacuuccuuggacucau

SEQ ID NO: 1338372 - RNA, 16 nt, Homo sapiens
auuuuaaggauaugau

SEQ ID NO: 1338373 - RNA, 13 nt, Homo sapiens
auuuuaaggcaau

SEQ ID NO: 1338374 - RNA, 17 nt, Homo sapiens
auuuuaauuacugcuau

SEQ ID NO: 1338375 - RNA, 16 nt, Homo sapiens
auuuuacaagggcaua

SEQ ID NO: 1338376 - RNA, 17 nt, Homo sapiens
auuuuacaugacagaua

SEQ ID NO: 1338377 - RNA, 22 nt, Homo sapiens
auuuuacccugaggucacugcu

SEQ ID NO: 1338378 - RNA, 21 nt, Homo sapiens
auuuuacucauauguggaauc

SEQ ID NO: 1338379 - RNA, 17 nt, Homo sapiens
auuuucauucaucaugu

SEQ ID NO: 1338380 - RNA, 15 nt, Homo sapiens
auuuuccuguuguca

SEQ ID NO: 1338381 - RNA, 19 nt, Homo sapiens
auuuucuggaauacaugaa

SEQ ID NO: 1338382 - RNA, 18 nt, Homo sapiens
auuuugagaucagucuuu

SEQ ID NO: 1338383 - RNA, 17 nt, Homo sapiens
auuuugcacugaggaua

SEQ ID NO: 1338384 - RNA, 19 nt, Homo sapiens
auuuugcuaacugguuaaa

SEQ ID NO: 1338385 - RNA, 20 nt, Homo sapiens
auuuuguaauaaacucucua

SEQ ID NO: 1338386 - RNA, 20 nt, Homo sapiens
auuuuguaauguaucaaaua

SEQ ID NO: 1338387 - RNA, 22 nt, Homo sapiens
auuuugugaauuugggacauaa

SEQ ID NO: 1338388 - RNA, 18 nt, Homo sapiens
auuuugugaucuguaaca

SEQ ID NO: 1338389 - RNA, 22 nt, Homo sapiens
auuuugugaucuguaacagggu

SEQ ID NO: 1338390 - RNA, 16 nt, Homo sapiens
auuuuuaccuguuuaa

SEQ ID NO: 1338391 - RNA, 14 nt, Homo sapiens
auuuuuaccuuuca

SEQ ID NO: 1338392 - RNA, 15 nt, Homo sapiens
auuuuuaggcaaaga

SEQ ID NO: 1338393 - RNA, 22 nt, Homo sapiens
auuuuucacugccccagacaca

SEQ ID NO: 1338394 - RNA, 17 nt, Homo sapiens
auuuuucuauaaagauc

SEQ ID NO: 1338395 - RNA, 23 nt, Homo sapiens
auuuuugaaaaaaguacauauuu

SEQ ID NO: 1338396 - RNA, 20 nt, Homo sapiens
auuuuugcaggugcuuuuau

SEQ ID NO: 1338397 - RNA, 14 nt, Homo sapiens
caaaaaaagacagg

SEQ ID NO: 1338398 - RNA, 14 nt, Homo sapiens
caaaaaaaugugca

SEQ ID NO: 1338399 - RNA, 11 nt, Homo sapiens
caaaaaaccca

SEQ ID NO: 1338400 - RNA, 22 nt, Homo sapiens
caaaaaucaccaucuuugucaa

SEQ ID NO: 1338401 - RNA, 12 nt, Homo sapiens
caaaacugccuc

SEQ ID NO: 1338402 - RNA, 13 nt, Homo sapiens
caaaacugccuca

SEQ ID NO: 1338403 - RNA, 16 nt, Homo sapiens
caaaacuugcaucuaa

SEQ ID NO: 1338404 - RNA, 14 nt, Homo sapiens
caaaagaugucuga

SEQ ID NO: 1338405 - RNA, 15 nt, Homo sapiens
caaaagcacauauau

SEQ ID NO: 1338406 - RNA, 21 nt, Homo sapiens
caaaaggaggugaaaucccug

SEQ ID NO: 1338407 - RNA, 20 nt, Homo sapiens
caaaagguuuguguccagga

SEQ ID NO: 1338408 - RNA, 16 nt, Homo sapiens
caaaauaaacuccccu

SEQ ID NO: 1338409 - RNA, 17 nt, Homo sapiens
caaaauaaagugacaga

SEQ ID NO: 1338410 - RNA, 23 nt, Homo sapiens
caaaauaaauagugucucuucaa

SEQ ID NO: 1338411 - RNA, 20 nt, Homo sapiens
caaacaagcacacgaaaaga

SEQ ID NO: 1338412 - RNA, 13 nt, Homo sapiens
ccugcuuugcauc

SEQ ID NO: 1338413 - RNA, 14 nt, Homo sapiens
ccuggacacuguac

SEQ ID NO: 1338414 - RNA, 22 nt, Homo sapiens
ccuggacuagagggaccucucc

SEQ ID NO: 1338415 - RNA, 17 nt, Homo sapiens
ccuggagacaaggugcu

SEQ ID NO: 1338416 - RNA, 18 nt, Homo sapiens
ccuggagacaaggugcua

SEQ ID NO: 1338417 - RNA, 17 nt, Homo sapiens
ccuggauguacuaucca

SEQ ID NO: 1338418 - RNA, 23 nt, Homo sapiens
ccuggccaaauuuugauccuaac

SEQ ID NO: 1338419 - RNA, 13 nt, Homo sapiens
ccuggccagacac

SEQ ID NO: 1338420 - RNA, 14 nt, Homo sapiens
ccuggcucaucucu

SEQ ID NO: 1338421 - RNA, 16 nt, Homo sapiens
ccuggcugggacuggg

SEQ ID NO: 1338422 - RNA, 16 nt, Homo sapiens
ccugggccguggcaca

SEQ ID NO: 1338423 - RNA, 17 nt, Homo sapiens
ccugggccguggcacag

SEQ ID NO: 1338424 - RNA, 18 nt, Homo sapiens
ccugggggccgugcucac

SEQ ID NO: 1338425 - RNA, 21 nt, Homo sapiens
ccugggguguccuacagugac

SEQ ID NO: 1338426 - RNA, 12 nt, Homo sapiens
ccuggugcucuu

SEQ ID NO: 1338427 - RNA, 18 nt, Homo sapiens
ccugguuucugggugcua

SEQ ID NO: 1338428 - RNA, 19 nt, Homo sapiens
ccuguaaucucagcacuuu

SEQ ID NO: 1338429 - RNA, 20 nt, Homo sapiens
ccuguaaucucagcacuuug

SEQ ID NO: 1338430 - RNA, 18 nt, Homo sapiens
ccuguccugaaagccaca

SEQ ID NO: 1338431 - RNA, 21 nt, Homo sapiens
ccugucgaaggggaggcacac

SEQ ID NO: 1338432 - RNA, 14 nt, Homo sapiens
ccugucuccagggc

SEQ ID NO: 1338433 - RNA, 14 nt, Homo sapiens
ccugugcauuuucu

SEQ ID NO: 1338434 - RNA, 19 nt, Homo sapiens
ccuguggccaacugcaaaa

SEQ ID NO: 1338435 - RNA, 15 nt, Homo sapiens
ccuguggcuaaugga

SEQ ID NO: 1338436 - RNA, 21 nt, Homo sapiens
ccugugugauugacagcuuug

SEQ ID NO: 1338437 - RNA, 20 nt, Homo sapiens
ccuguguguccaaaacugcc

SEQ ID NO: 1338438 - RNA, 19 nt, Homo sapiens
ccuguucagagcacucauu

SEQ ID NO: 1338439 - RNA, 17 nt, Homo sapiens
ccuguucauuugaagaa

SEQ ID NO: 1338440 - RNA, 23 nt, Homo sapiens
ccuguuccccagagaaaggggag

SEQ ID NO: 1338441 - RNA, 15 nt, Homo sapiens
ccuguugucaagaau

SEQ ID NO: 1338442 - RNA, 18 nt, Homo sapiens
ccuguuucuggucuucgc

SEQ ID NO: 1338443 - RNA, 17 nt, Homo sapiens
ccuuaaagauacuugaa

SEQ ID NO: 1338444 - RNA, 15 nt, Homo sapiens
ccuuaacacauucaa

SEQ ID NO: 1338445 - RNA, 22 nt, Homo sapiens
ccuuaagcaaauuuuguauuau

SEQ ID NO: 1338446 - RNA, 17 nt, Homo sapiens
ccuuaaguauaucaugu

SEQ ID NO: 1338447 - RNA, 21 nt, Homo sapiens
ccuuacaacgccgagugcacu

SEQ ID NO: 1338448 - RNA, 13 nt, Homo sapiens
ucuggaaccucag

SEQ ID NO: 1338449 - RNA, 20 nt, Homo sapiens
ucuggacuggaaagcacaag

SEQ ID NO: 1338450 - RNA, 15 nt, Homo sapiens
ucuggaugcugugaa

SEQ ID NO: 1338451 - RNA, 22 nt, Homo sapiens
ucuggcaucucuuucugcaaag

SEQ ID NO: 1338452 - RNA, 21 nt, Homo sapiens
ucuggccuguacccaguagau

SEQ ID NO: 1338453 - RNA, 23 nt, Homo sapiens
ucuggcuccccaaggcugcaaag

SEQ ID NO: 1338454 - RNA, 20 nt, Homo sapiens
ucuggcuucccuaaacugca

SEQ ID NO: 1338455 - RNA, 16 nt, Homo sapiens
ucugggaacuugucac

SEQ ID NO: 1338456 - RNA, 14 nt, Homo sapiens
ucugggaagggaga

SEQ ID NO: 1338457 - RNA, 13 nt, Homo sapiens
ucugggccagugc

SEQ ID NO: 1338458 - RNA, 11 nt, Homo sapiens
ucugggcuccc

SEQ ID NO: 1338459 - RNA, 13 nt, Homo sapiens
uuuugucaccuca

SEQ ID NO: 1338460 - RNA, 22 nt, Homo sapiens
uuuugucagaggcuccaaauag

SEQ ID NO: 1338461 - RNA, 11 nt, Homo sapiens
uuuugugaauu

SEQ ID NO: 1338462 - RNA, 16 nt, Homo sapiens
uuuuuaaaaaagcaag

SEQ ID NO: 1338463 - RNA, 17 nt, Homo sapiens
uuuuuaaacagugucau

SEQ ID NO: 1338464 - RNA, 14 nt, Homo sapiens
uuuuuaaguguucu

SEQ ID NO: 1338465 - RNA, 19 nt, Homo sapiens
uuuuuaauuuuuugucaag

SEQ ID NO: 1338466 - RNA, 15 nt, Homo sapiens
uuuuuccccaaaguc

SEQ ID NO: 1338467 - RNA, 15 nt, Homo sapiens
uuuuuccuccuuguc

SEQ ID NO: 1338468 - RNA, 14 nt, Homo sapiens
uuuuuccucugcau

SEQ ID NO: 1338469 - RNA, 21 nt, Homo sapiens
uuuuugaaaaaaguacauauu

SEQ ID NO: 1338470 - RNA, 13 nt, Homo sapiens
uuuuugaggcaaa

SEQ ID NO: 1338471 - RNA, 17 nt, Homo sapiens
ucggauacacacucgaa

SEQ ID NO: 1338472 - RNA, 18 nt, Homo sapiens
ucggauacacacucgaau

SEQ ID NO: 1338473 - RNA, 18 nt, Homo sapiens
ucgggaguucgagaccag

SEQ ID NO: 1338474 - RNA, 15 nt, Homo sapiens
ucgguacccaccaca

SEQ ID NO: 1338475 - RNA, 15 nt, Homo sapiens
ucggugcauaccuua

SEQ ID NO: 1338476 - RNA, 19 nt, Homo sapiens
ucgucagccaccugggaac

SEQ ID NO: 1338477 - RNA, 15 nt, Homo sapiens
ucguccgucacuuau

SEQ ID NO: 1338478 - RNA, 15 nt, Homo sapiens
ucgugagucauuuaa

SEQ ID NO: 1338479 - RNA, 18 nt, Homo sapiens
ucgugggaaaggggagua

SEQ ID NO: 1338480 - RNA, 12 nt, Homo sapiens
ucguggguccca

SEQ ID NO: 1338481 - RNA, 16 nt, Homo sapiens
ucguuaaaaacagauu

SEQ ID NO: 1338482 - RNA, 15 nt, Homo sapiens
ucuaaaaucugcuag

SEQ ID NO: 1338483 - RNA, 19 nt, Homo sapiens
ucuaaaauguguuuuauca

SEQ ID NO: 1338484 - RNA, 20 nt, Homo sapiens
ucuaaagauggaaaaaccac

SEQ ID NO: 1338485 - RNA, 16 nt, Homo sapiens
ucuaaagccaagcacu

SEQ ID NO: 1338486 - RNA, 18 nt, Homo sapiens
ucuaaagccaagcacuuu

SEQ ID NO: 1338487 - RNA, 17 nt, Homo sapiens
ucagcccugcaccaugc

SEQ ID NO: 1338488 - RNA, 22 nt, Homo sapiens
ucagcccugcaccaugcugcug

SEQ ID NO: 1338489 - RNA, 21 nt, Homo sapiens
ucagccugcuuuccugcagca

SEQ ID NO: 1338490 - RNA, 16 nt, Homo sapiens
ucagccuuauccaggu

SEQ ID NO: 1338491 - RNA, 13 nt, Homo sapiens
ucagccuuucuaa

SEQ ID NO: 1338492 - RNA, 22 nt, Homo sapiens
ucagccuuucuaaaaguugcau

SEQ ID NO: 1338493 - RNA, 12 nt, Homo sapiens
ucagccuuuuau

SEQ ID NO: 1338494 - RNA, 11 nt, Homo sapiens
ucagcuggaaa

SEQ ID NO: 1338495 - RNA, 12 nt, Homo sapiens
ucagcuggaaaa

SEQ ID NO: 1338496 - RNA, 20 nt, Homo sapiens
ucaggaauucagugccuuca

SEQ ID NO: 1338497 - RNA, 14 nt, Homo sapiens
ucaggacagaugcc

SEQ ID NO: 1338498 - RNA, 17 nt, Homo sapiens
ucaggacagaugccaca

SEQ ID NO: 1338499 - RNA, 20 nt, Homo sapiens
ucaggacagguggugcaaau

SEQ ID NO: 1338500 - RNA, 20 nt, Homo sapiens
ucaggagaguagcaacaaaa

SEQ ID NO: 1338501 - RNA, 17 nt, Homo sapiens
ucaggauuaacuaaaga

SEQ ID NO: 1338502 - RNA, 15 nt, Homo sapiens
ucaggcaacgcacaa

SEQ ID NO: 1338503 - RNA, 22 nt, Homo sapiens
ucaggcuacugcuucaaucuca

SEQ ID NO: 1338504 - RNA, 22 nt, Homo sapiens
ucagggaacugacccucaggca

SEQ ID NO: 1338505 - RNA, 15 nt, Homo sapiens
ucagggccaggugca

SEQ ID NO: 1338506 - RNA, 22 nt, Homo sapiens
ucagggccaggugcagaccuug

SEQ ID NO: 1338507 - RNA, 18 nt, Homo sapiens
ucaggggaggacuaggaa

SEQ ID NO: 1338508 - RNA, 22 nt, Homo sapiens
ucaggggcggggagggugacag

SEQ ID NO: 1338509 - RNA, 16 nt, Homo sapiens
caaugagaucauugug

SEQ ID NO: 1338510 - RNA, 15 nt, Homo sapiens
caaugaguuugggca

SEQ ID NO: 1338511 - RNA, 19 nt, Homo sapiens
caaugaucaccgacugaaa

SEQ ID NO: 1338512 - RNA, 18 nt, Homo sapiens
caauggaguggcugccau

SEQ ID NO: 1338513 - RNA, 19 nt, Homo sapiens
caauggaguggcugccaug

SEQ ID NO: 1338514 - RNA, 14 nt, Homo sapiens
caaugguuucacau

SEQ ID NO: 1338515 - RNA, 17 nt, Homo sapiens
caaugguuucacauggu

SEQ ID NO: 1338516 - RNA, 19 nt, Homo sapiens
caauguauugagcauguga

SEQ ID NO: 1338517 - RNA, 23 nt, Homo sapiens
caauguuuuaaggucuaucuuaa

SEQ ID NO: 1338518 - RNA, 19 nt, Homo sapiens
caauuacuggcucacuggc

SEQ ID NO: 1338519 - RNA, 13 nt, Homo sapiens
caauuagcuccuc

SEQ ID NO: 1338520 - RNA, 15 nt, Homo sapiens
caauuauuggcaaag

SEQ ID NO: 1338521 - RNA, 14 nt, Homo sapiens
caauugaacuucca

SEQ ID NO: 1338522 - RNA, 17 nt, Homo sapiens
caauugaacuuccagga

SEQ ID NO: 1338523 - RNA, 19 nt, Homo sapiens
caauuuaacuagacacaga

SEQ ID NO: 1338524 - RNA, 15 nt, Homo sapiens
caauuucagacuccc

SEQ ID NO: 1338525 - RNA, 20 nt, Homo sapiens
cacaaaauguaggguuauaa

SEQ ID NO: 1338526 - RNA, 11 nt, Homo sapiens
cacaaagggaa

SEQ ID NO: 1338527 - RNA, 14 nt, Homo sapiens
cacaaauacauucc

SEQ ID NO: 1338528 - RNA, 23 nt, Homo sapiens
cacaacccuucagauuugccuua

SEQ ID NO: 1338529 - RNA, 18 nt, Homo sapiens
cacaauaccuacaauaaa

SEQ ID NO: 1338530 - RNA, 22 nt, Homo sapiens
cacacaauuacuaaaguacaga

SEQ ID NO: 1338531 - RNA, 19 nt, Homo sapiens
cacacacagaugucuuaaa

SEQ ID NO: 1338532 - RNA, 20 nt, Homo sapiens
cacacacuggcugguggaga

SEQ ID NO: 1338533 - RNA, 11 nt, Homo sapiens
cacacacugug

SEQ ID NO: 1338534 - RNA, 15 nt, Homo sapiens
cacacagaugucuua

SEQ ID NO: 1338535 - RNA, 13 nt, Homo sapiens
cacacagcugccc

SEQ ID NO: 1338536 - RNA, 16 nt, Homo sapiens
cacacagcugcccuag

SEQ ID NO: 1338537 - RNA, 15 nt, Homo sapiens
cacacccaggaaggg

SEQ ID NO: 1338538 - RNA, 23 nt, Homo sapiens
cacaccuuuguccacugucaggg

SEQ ID NO: 1338539 - RNA, 17 nt, Homo sapiens
cacacuaagagggcaga

SEQ ID NO: 1338540 - RNA, 21 nt, Homo sapiens
cacacucauacacaugugcac

SEQ ID NO: 1338541 - RNA, 22 nt, Homo sapiens
cacacucucccauuauauuuau

SEQ ID NO: 1338542 - RNA, 15 nt, Homo sapiens
cacacucuucaguga

SEQ ID NO: 1338543 - RNA, 14 nt, Homo sapiens
cacacugcuagcaa

SEQ ID NO: 1338544 - RNA, 14 nt, Homo sapiens
cacacugguacuua

SEQ ID NO: 1338545 - RNA, 15 nt, Homo sapiens
cacacugugccccac

SEQ ID NO: 1338546 - RNA, 15 nt, Homo sapiens
cacacuuugcacuga

SEQ ID NO: 1338547 - RNA, 13 nt, Homo sapiens
cacacuuugccau

SEQ ID NO: 1338548 - RNA, 17 nt, Homo sapiens
cacagaggacucacuug

SEQ ID NO: 1338549 - RNA, 19 nt, Homo sapiens
cacagaggacucacuugcc

SEQ ID NO: 1338550 - RNA, 19 nt, Homo sapiens
cacagauccccccacaaag

SEQ ID NO: 1338551 - RNA, 19 nt, Homo sapiens
cacagaugucuuaaaagac

SEQ ID NO: 1338552 - RNA, 21 nt, Homo sapiens
cacagcaagggugaugggaaa

SEQ ID NO: 1338553 - RNA, 21 nt, Homo sapiens
cacagcaagucacuggccagu

SEQ ID NO: 1338554 - RNA, 17 nt, Homo sapiens
cacagcaucgggagcac

SEQ ID NO: 1338555 - RNA, 23 nt, Homo sapiens
cacagcaugugaaugggggagug

SEQ ID NO: 1338556 - RNA, 20 nt, Homo sapiens
cacagccuucuaaauuccca

SEQ ID NO: 1338557 - RNA, 15 nt, Homo sapiens
cacagcuacucagug

SEQ ID NO: 1338558 - RNA, 19 nt, Homo sapiens
cacagcugcugcuggaaau

SEQ ID NO: 1338559 - RNA, 14 nt, Homo sapiens
cacagucacuggau

SEQ ID NO: 1338560 - RNA, 15 nt, Homo sapiens
cacaguggggcugca

SEQ ID NO: 1338561 - RNA, 16 nt, Homo sapiens
cacaguggugaccccc

SEQ ID NO: 1338562 - RNA, 23 nt, Homo sapiens
cacaguucuuugggccagacaug

SEQ ID NO: 1338563 - RNA, 18 nt, Homo sapiens
cacauccacacagccaau

SEQ ID NO: 1338564 - RNA, 15 nt, Homo sapiens
cacauccaucagcac

SEQ ID NO: 1338565 - RNA, 23 nt, Homo sapiens
cacaucccuggaaggacauccau

SEQ ID NO: 1338566 - RNA, 23 nt, Homo sapiens
cacaugauuuuacucauaugugg

SEQ ID NO: 1338567 - RNA, 17 nt, Homo sapiens
cacaugcccaugaugag

SEQ ID NO: 1338568 - RNA, 22 nt, Homo sapiens
cacaugucagccacugugauag

SEQ ID NO: 1338569 - RNA, 13 nt, Homo sapiens
cacaugugcacac

SEQ ID NO: 1338570 - RNA, 15 nt, Homo sapiens
caccaaccuccagac

SEQ ID NO: 1338571 - RNA, 15 nt, Homo sapiens
caccaagcucugucc

SEQ ID NO: 1338572 - RNA, 21 nt, Homo sapiens
caccaagcucuguccaaucag

SEQ ID NO: 1338573 - RNA, 17 nt, Homo sapiens
caccacuaacaugcccu

SEQ ID NO: 1338574 - RNA, 22 nt, Homo sapiens
caccagcgaacucucagaaaua

SEQ ID NO: 1338575 - RNA, 20 nt, Homo sapiens
caccaggggaggagccugug

SEQ ID NO: 1338576 - RNA, 12 nt, Homo sapiens
caccaugcugcu

SEQ ID NO: 1338577 - RNA, 16 nt, Homo sapiens
caccaugcuugccuga

SEQ ID NO: 1338578 - RNA, 21 nt, Homo sapiens
cacccaaguugaagacuuugu

SEQ ID NO: 1338579 - RNA, 18 nt, Homo sapiens
cacccaggaguauccucu

SEQ ID NO: 1338580 - RNA, 15 nt, Homo sapiens
cacccagugcugaau

SEQ ID NO: 1338581 - RNA, 20 nt, Homo sapiens
cacccagugggaagagugug

SEQ ID NO: 1338582 - RNA, 16 nt, Homo sapiens
cacccaguugugacaa

SEQ ID NO: 1338583 - RNA, 15 nt, Homo sapiens
cacccaugccagaga

SEQ ID NO: 1338584 - RNA, 15 nt, Homo sapiens
caccccuaaagagau

SEQ ID NO: 1338585 - RNA, 20 nt, Homo sapiens
cacccggcucguguauuuau

SEQ ID NO: 1338586 - RNA, 22 nt, Homo sapiens
cacccggcucguguauuuauua

SEQ ID NO: 1338587 - RNA, 14 nt, Homo sapiens
cacccugcuuuggc

SEQ ID NO: 1338588 - RNA, 22 nt, Homo sapiens
caccgcgcccagccucaucucu

SEQ ID NO: 1338589 - RNA, 21 nt, Homo sapiens
caccgugaccccuguccccac

SEQ ID NO: 1338590 - RNA, 12 nt, Homo sapiens
caccuaauccag

SEQ ID NO: 1338591 - RNA, 23 nt, Homo sapiens
caccuaccuuagaaaacaaguau

SEQ ID NO: 1338592 - RNA, 16 nt, Homo sapiens
caccuagagcuccagu

SEQ ID NO: 1338593 - RNA, 19 nt, Homo sapiens
caccucaacuccgugcuua

SEQ ID NO: 1338594 - RNA, 12 nt, Homo sapiens
caccucaauauu

SEQ ID NO: 1338595 - RNA, 21 nt, Homo sapiens
caccucacugcaguagugcac

SEQ ID NO: 1338596 - RNA, 16 nt, Homo sapiens
caccugcuggagugaa

SEQ ID NO: 1338597 - RNA, 23 nt, Homo sapiens
caccuggguuggaggaagggcac

SEQ ID NO: 1338598 - RNA, 20 nt, Homo sapiens
caccuguaaucccagcacuu

SEQ ID NO: 1338599 - RNA, 22 nt, Homo sapiens
caccuuggcaccagacacccag

SEQ ID NO: 1338600 - RNA, 17 nt, Homo sapiens
augcaaauacaaucagc

SEQ ID NO: 1338601 - RNA, 19 nt, Homo sapiens
augcaaauacaaucagccc

SEQ ID NO: 1338602 - RNA, 19 nt, Homo sapiens
augcaacauuuuaaggcaa

SEQ ID NO: 1338603 - RNA, 20 nt, Homo sapiens
augcaacauuuuaaggcaau

SEQ ID NO: 1338604 - RNA, 18 nt, Homo sapiens
augcaauggcucaucaga

SEQ ID NO: 1338605 - RNA, 17 nt, Homo sapiens
augcacaaaacuacuuu

SEQ ID NO: 1338606 - RNA, 19 nt, Homo sapiens
augcacaguaucugcuguu

SEQ ID NO: 1338607 - RNA, 21 nt, Homo sapiens
augcacaguaucugcuguucu

SEQ ID NO: 1338608 - RNA, 16 nt, Homo sapiens
augcaccccugagcca

SEQ ID NO: 1338609 - RNA, 20 nt, Homo sapiens
augcacgcugggcaaugaga

SEQ ID NO: 1338610 - RNA, 22 nt, Homo sapiens
augcacguggggcccacugcuc

SEQ ID NO: 1338611 - RNA, 20 nt, Homo sapiens
augcacugggaaaaaguuga

SEQ ID NO: 1338612 - RNA, 12 nt, Homo sapiens
augcacugugaa

SEQ ID NO: 1338613 - RNA, 19 nt, Homo sapiens
augcagcagggaugcccug

SEQ ID NO: 1338614 - RNA, 22 nt, Homo sapiens
augcaguguuucccucuguguu

SEQ ID NO: 1338615 - RNA, 16 nt, Homo sapiens
augcaguuuuccuuaa

SEQ ID NO: 1338616 - RNA, 14 nt, Homo sapiens
augcaugauacuau

SEQ ID NO: 1338617 - RNA, 18 nt, Homo sapiens
augcauugaaagaauuag

SEQ ID NO: 1338618 - RNA, 19 nt, Homo sapiens
augcauugccuguaacaau

SEQ ID NO: 1338619 - RNA, 22 nt, Homo sapiens
augccaaaaggauaaaugucuu

SEQ ID NO: 1338620 - RNA, 19 nt, Homo sapiens
augccagcuucucucucca

SEQ ID NO: 1338621 - RNA, 20 nt, Homo sapiens
augccccauuggauuacuuu

SEQ ID NO: 1338622 - RNA, 17 nt, Homo sapiens
augcccccuccugcaag

SEQ ID NO: 1338623 - RNA, 20 nt, Homo sapiens
augccucacgagauuugcca

SEQ ID NO: 1338624 - RNA, 17 nt, Homo sapiens
augccugcaaucccagc

SEQ ID NO: 1338625 - RNA, 14 nt, Homo sapiens
augccuguaaucuc

SEQ ID NO: 1338626 - RNA, 18 nt, Homo sapiens
augccuguguacugccuu

SEQ ID NO: 1338627 - RNA, 14 nt, Homo sapiens
augccuuaccuaag

SEQ ID NO: 1338628 - RNA, 17 nt, Homo sapiens
augcgccaccaugcccu

SEQ ID NO: 1338629 - RNA, 16 nt, Homo sapiens
augcgucaggggccua

SEQ ID NO: 1338630 - RNA, 15 nt, Homo sapiens
augcuaucucugugu

SEQ ID NO: 1338631 - RNA, 18 nt, Homo sapiens
augcugacagcucuucac

SEQ ID NO: 1338632 - RNA, 16 nt, Homo sapiens
augcuggcaaauccag

SEQ ID NO: 1338633 - RNA, 22 nt, Homo sapiens
augcugucugguugcgccauuu

SEQ ID NO: 1338634 - RNA, 13 nt, Homo sapiens
augcuguugugaa

SEQ ID NO: 1338635 - RNA, 15 nt, Homo sapiens
augcuugcauuauau

SEQ ID NO: 1338636 - RNA, 20 nt, Homo sapiens
augcuuuucugccacuccau

SEQ ID NO: 1338637 - RNA, 20 nt, Homo sapiens
auggaacagcauuacccucc

SEQ ID NO: 1338638 - RNA, 23 nt, Homo sapiens
auggaacgcuaaugaaacacagc

SEQ ID NO: 1338639 - RNA, 21 nt, Homo sapiens
auggaaggaagaaaagcugcc

SEQ ID NO: 1338640 - RNA, 18 nt, Homo sapiens
auggacaugaucuucuuu

SEQ ID NO: 1338641 - RNA, 20 nt, Homo sapiens
auggacucaggauccaguga

SEQ ID NO: 1338642 - RNA, 21 nt, Homo sapiens
auggaggaucucuaaagagca

SEQ ID NO: 1338643 - RNA, 16 nt, Homo sapiens
auggagugcucacaaa

SEQ ID NO: 1338644 - RNA, 14 nt, Homo sapiens
caaagagguauuua

SEQ ID NO: 1338645 - RNA, 20 nt, Homo sapiens
caaagaugcccccuccagga

SEQ ID NO: 1338646 - RNA, 12 nt, Homo sapiens
caaagcacuuaa

SEQ ID NO: 1338647 - RNA, 21 nt, Homo sapiens
caaagcccucccuaccuacca

SEQ ID NO: 1338648 - RNA, 17 nt, Homo sapiens
caaaggaacacugacau

SEQ ID NO: 1338649 - RNA, 18 nt, Homo sapiens
caaaggaacacugacauc

SEQ ID NO: 1338650 - RNA, 19 nt, Homo sapiens
caaaggagccuacuccaag

SEQ ID NO: 1338651 - RNA, 18 nt, Homo sapiens
caaagggccaucguucau

SEQ ID NO: 1338652 - RNA, 17 nt, Homo sapiens
caaauaaagauagaccu

SEQ ID NO: 1338653 - RNA, 23 nt, Homo sapiens
caaauaauuccauuccaguuuuu

SEQ ID NO: 1338654 - RNA, 18 nt, Homo sapiens
caaauagugauuguaaca

SEQ ID NO: 1338655 - RNA, 16 nt, Homo sapiens
caaaucaaaagacuuu

SEQ ID NO: 1338656 - RNA, 18 nt, Homo sapiens
caaaucaaacauauucua

SEQ ID NO: 1338657 - RNA, 13 nt, Homo sapiens
caaaucucuucaa

SEQ ID NO: 1338658 - RNA, 16 nt, Homo sapiens
caaaucugacauauua

SEQ ID NO: 1338659 - RNA, 16 nt, Homo sapiens
caaaucuuaacuugaa

SEQ ID NO: 1338660 - RNA, 22 nt, Homo sapiens
caaaugaaagugaugauacugu

SEQ ID NO: 1338661 - RNA, 23 nt, Homo sapiens
caaaugaaagugaugauacugua

SEQ ID NO: 1338662 - RNA, 11 nt, Homo sapiens
caaaugaugcc

SEQ ID NO: 1338663 - RNA, 21 nt, Homo sapiens
caaaugccugacucagugacc

SEQ ID NO: 1338664 - RNA, 16 nt, Homo sapiens
caaaugcuuuuccuca

SEQ ID NO: 1338665 - RNA, 12 nt, Homo sapiens
caaaugguguga

SEQ ID NO: 1338666 - RNA, 19 nt, Homo sapiens
caaauguggcuguauccac

SEQ ID NO: 1338667 - RNA, 21 nt, Homo sapiens
caaauguggcuguauccacuu

SEQ ID NO: 1338668 - RNA, 11 nt, Homo sapiens
caaauguucuc

SEQ ID NO: 1338669 - RNA, 16 nt, Homo sapiens
caaauucaccuucccc

SEQ ID NO: 1338670 - RNA, 18 nt, Homo sapiens
caaauuccuacaguuucu

SEQ ID NO: 1338671 - RNA, 20 nt, Homo sapiens
caaauugggaaauccauucc

SEQ ID NO: 1338672 - RNA, 19 nt, Homo sapiens
caaauuugugguccacuga

SEQ ID NO: 1338673 - RNA, 20 nt, Homo sapiens
caaauuuucuuccauuucau

SEQ ID NO: 1338674 - RNA, 23 nt, Homo sapiens
caacaauguguuguaaaaauguc

SEQ ID NO: 1338675 - RNA, 12 nt, Homo sapiens
caacacaaacug

SEQ ID NO: 1338676 - RNA, 18 nt, Homo sapiens
caacacaaacuggcuuaa

SEQ ID NO: 1338677 - RNA, 23 nt, Homo sapiens
caacacgagcaggcuacugucag

SEQ ID NO: 1338678 - RNA, 17 nt, Homo sapiens
caacacugggaaacaga

SEQ ID NO: 1338679 - RNA, 18 nt, Homo sapiens
caacagaaaccagaaaag

SEQ ID NO: 1338680 - RNA, 16 nt, Homo sapiens
caacagauuauuaccu

SEQ ID NO: 1338681 - RNA, 21 nt, Homo sapiens
caacagccaagcuggcacaaa

SEQ ID NO: 1338682 - RNA, 23 nt, Homo sapiens
caacagccaagcuggcacaaaag

SEQ ID NO: 1338683 - RNA, 23 nt, Homo sapiens
caacauagugauaccccaucucu

SEQ ID NO: 1338684 - RNA, 16 nt, Homo sapiens
caacaucgcaauaguu

SEQ ID NO: 1338685 - RNA, 22 nt, Homo sapiens
caacaucuuuuuaaccugcaaa

SEQ ID NO: 1338686 - RNA, 12 nt, Homo sapiens
caacaugcaaua

SEQ ID NO: 1338687 - RNA, 16 nt, Homo sapiens
caaccaaaagucuuca

SEQ ID NO: 1338688 - RNA, 18 nt, Homo sapiens
caaccauuugaaaccccu

SEQ ID NO: 1338689 - RNA, 14 nt, Homo sapiens
caaccccucuccag

SEQ ID NO: 1338690 - RNA, 22 nt, Homo sapiens
caaccccucuccaggccuguca

SEQ ID NO: 1338691 - RNA, 13 nt, Homo sapiens
caacccgaggcaa

SEQ ID NO: 1338692 - RNA, 22 nt, Homo sapiens
caacccgucuggcccaccaggg

SEQ ID NO: 1338693 - RNA, 18 nt, Homo sapiens
caacccuuccugcugcug

SEQ ID NO: 1338694 - RNA, 16 nt, Homo sapiens
caaccucaggcuccua

SEQ ID NO: 1338695 - RNA, 13 nt, Homo sapiens
caaccuccugggu

SEQ ID NO: 1338696 - RNA, 21 nt, Homo sapiens
caaccugcucuccucuugcca

SEQ ID NO: 1338697 - RNA, 18 nt, Homo sapiens
caacguauuauugauauu

SEQ ID NO: 1338698 - RNA, 13 nt, Homo sapiens
caacuaugauuau

SEQ ID NO: 1338699 - RNA, 12 nt, Homo sapiens
caacuccagggg

SEQ ID NO: 1338700 - RNA, 13 nt, Homo sapiens
caacucuauuuaa

SEQ ID NO: 1338701 - RNA, 21 nt, Homo sapiens
caacucuucgaagccuugccu

SEQ ID NO: 1338702 - RNA, 19 nt, Homo sapiens
caacugaaguucuauuuau

SEQ ID NO: 1338703 - RNA, 13 nt, Homo sapiens
caacugaccagcc

SEQ ID NO: 1338704 - RNA, 20 nt, Homo sapiens
caacugauccucgcaucuca

SEQ ID NO: 1338705 - RNA, 18 nt, Homo sapiens
caacugguuugccuauaa

SEQ ID NO: 1338706 - RNA, 16 nt, Homo sapiens
caacuuccgcugaggg

SEQ ID NO: 1338707 - RNA, 21 nt, Homo sapiens
caagaaaggccugaauggagg

SEQ ID NO: 1338708 - RNA, 14 nt, Homo sapiens
caagaacacaguga

SEQ ID NO: 1338709 - RNA, 21 nt, Homo sapiens
caagaacagaaguguucacau

SEQ ID NO: 1338710 - RNA, 17 nt, Homo sapiens
caagaaccacuccuuca

SEQ ID NO: 1338711 - RNA, 18 nt, Homo sapiens
caagaagguggaaggcag

SEQ ID NO: 1338712 - RNA, 12 nt, Homo sapiens
caagaauggagg

SEQ ID NO: 1338713 - RNA, 16 nt, Homo sapiens
caagaccucugugcac

SEQ ID NO: 1338714 - RNA, 18 nt, Homo sapiens
caagagaaguacuaucuu

SEQ ID NO: 1338715 - RNA, 15 nt, Homo sapiens
caagaucauagcuca

SEQ ID NO: 1338716 - RNA, 16 nt, Homo sapiens
caagaucauagcucau

SEQ ID NO: 1338717 - RNA, 14 nt, Homo sapiens
caagcaaauggcca

SEQ ID NO: 1338718 - RNA, 19 nt, Homo sapiens
caagcaauccuccuaccuc

SEQ ID NO: 1338719 - RNA, 19 nt, Homo sapiens
caagcacuuuauauuuucc

SEQ ID NO: 1338720 - RNA, 22 nt, Homo sapiens
caagcacuuuauauuuuccucu

SEQ ID NO: 1338721 - RNA, 15 nt, Homo sapiens
caagcagaugacaga

SEQ ID NO: 1338722 - RNA, 23 nt, Homo sapiens
caagcauuuugugaacuagggaa

SEQ ID NO: 1338723 - RNA, 16 nt, Homo sapiens
caagccccacuuauuc

SEQ ID NO: 1338724 - RNA, 24 nt, Homo sapiens
caagcucaaugaugcaggcaauaa

SEQ ID NO: 1338725 - RNA, 13 nt, Homo sapiens
caagcucacccuu

SEQ ID NO: 1338726 - RNA, 22 nt, Homo sapiens
caagcucuguccaaucagguag

SEQ ID NO: 1338727 - RNA, 17 nt, Homo sapiens
caagcugaccuugcuga

SEQ ID NO: 1338728 - RNA, 15 nt, Homo sapiens
caagcuggcacaaaa

SEQ ID NO: 1338729 - RNA, 20 nt, Homo sapiens
caaggaauuucagaguauuu

SEQ ID NO: 1338730 - RNA, 19 nt, Homo sapiens
caaggagggugagugcaag

SEQ ID NO: 1338731 - RNA, 16 nt, Homo sapiens
caaggaguguaaaaug

SEQ ID NO: 1338732 - RNA, 14 nt, Homo sapiens
caaggaugucugcc

SEQ ID NO: 1338733 - RNA, 17 nt, Homo sapiens
caaggaugucugccaca

SEQ ID NO: 1338734 - RNA, 17 nt, Homo sapiens
caaggccagaugcacau

SEQ ID NO: 1338735 - RNA, 17 nt, Homo sapiens
uuaaaguuuaaugccua

SEQ ID NO: 1338736 - RNA, 19 nt, Homo sapiens
uuaaauaagauuuaauuca

SEQ ID NO: 1338737 - RNA, 18 nt, Homo sapiens
uuaaauccugaagagcau

SEQ ID NO: 1338738 - RNA, 21 nt, Homo sapiens
uuaaaucugaauaaauaauuc

SEQ ID NO: 1338739 - RNA, 17 nt, Homo sapiens
uuaaauuauguuuuacu

SEQ ID NO: 1338740 - RNA, 17 nt, Homo sapiens
uuaaauuuggcucuaaa

SEQ ID NO: 1338741 - RNA, 14 nt, Homo sapiens
uuaacacauucaau

SEQ ID NO: 1338742 - RNA, 16 nt, Homo sapiens
uuaacaggacaguuga

SEQ ID NO: 1338743 - RNA, 23 nt, Homo sapiens
uuaacauccuuauucagccuuau

SEQ ID NO: 1338744 - RNA, 19 nt, Homo sapiens
uuaacccuauuuuaccuag

SEQ ID NO: 1338745 - RNA, 16 nt, Homo sapiens
uuaacuaugacagaua

SEQ ID NO: 1338746 - RNA, 21 nt, Homo sapiens
uuaacuuaaaagaacauguau

SEQ ID NO: 1338747 - RNA, 22 nt, Homo sapiens
uuaacuucagcauccaaguuua

SEQ ID NO: 1338748 - RNA, 19 nt, Homo sapiens
uuaacuuuuuuucuucuac

SEQ ID NO: 1338749 - RNA, 18 nt, Homo sapiens
uuaagacauaaacaaaga

SEQ ID NO: 1338750 - RNA, 23 nt, Homo sapiens
uuaagaggacauaaugggguccu

SEQ ID NO: 1338751 - RNA, 19 nt, Homo sapiens
uuaagccuuacaaagggaa

SEQ ID NO: 1338752 - RNA, 18 nt, Homo sapiens
uuaagccuuauaaaccaa

SEQ ID NO: 1338753 - RNA, 14 nt, Homo sapiens
uuaaggauagugug

SEQ ID NO: 1338754 - RNA, 16 nt, Homo sapiens
uuaauaaaccuuugca

SEQ ID NO: 1338755 - RNA, 15 nt, Homo sapiens
uuaauaaacuacucu

SEQ ID NO: 1338756 - RNA, 18 nt, Homo sapiens
uuaauaccacagcuauuu

SEQ ID NO: 1338757 - RNA, 17 nt, Homo sapiens
uuaauauaguaacacac

SEQ ID NO: 1338758 - RNA, 22 nt, Homo sapiens
uuaauauaguaacacacuucca

SEQ ID NO: 1338759 - RNA, 16 nt, Homo sapiens
uuaauauugugcaaac

SEQ ID NO: 1338760 - RNA, 14 nt, Homo sapiens
uuaaucaaaccacu

SEQ ID NO: 1338761 - RNA, 21 nt, Homo sapiens
uuaauccuguaccaaaucuga

SEQ ID NO: 1338762 - RNA, 19 nt, Homo sapiens
uuaauccuuaacacauuca

SEQ ID NO: 1338763 - RNA, 15 nt, Homo sapiens
uuaaugacaacacuu

SEQ ID NO: 1338764 - RNA, 14 nt, Homo sapiens
uuaaugcacuaaaa

SEQ ID NO: 1338765 - RNA, 16 nt, Homo sapiens
uuaauggggaggacaa

SEQ ID NO: 1338766 - RNA, 17 nt, Homo sapiens
uuaauggggaggacaaa

SEQ ID NO: 1338767 - RNA, 15 nt, Homo sapiens
uuaauucaacuuaac

SEQ ID NO: 1338768 - RNA, 14 nt, Homo sapiens
uuaauugaaagaau

SEQ ID NO: 1338769 - RNA, 15 nt, Homo sapiens
uuaauuugaaaccag

SEQ ID NO: 1338770 - RNA, 14 nt, Homo sapiens
uuacaaugugcaau

SEQ ID NO: 1338771 - RNA, 22 nt, Homo sapiens
uuacacuuuuuggaagugaaaa

SEQ ID NO: 1338772 - RNA, 15 nt, Homo sapiens
uuacagaaaauaugg

SEQ ID NO: 1338773 - RNA, 18 nt, Homo sapiens
uuacauuagugauuccau

SEQ ID NO: 1338774 - RNA, 15 nt, Homo sapiens
uuaccaaagcaucaa

SEQ ID NO: 1338775 - RNA, 16 nt, Homo sapiens
uuaccaguauuuaacu

SEQ ID NO: 1338776 - RNA, 20 nt, Homo sapiens
uuaccccucacaauccuugc

SEQ ID NO: 1338777 - RNA, 17 nt, Homo sapiens
uuacccugaggucacug

SEQ ID NO: 1338778 - RNA, 23 nt, Homo sapiens
uuaccugaagggguuuucuugau

SEQ ID NO: 1338779 - RNA, 19 nt, Homo sapiens
uuaccuguuuuucaguauu

SEQ ID NO: 1338780 - RNA, 20 nt, Homo sapiens
uuaccuugaaaugcuguuag

SEQ ID NO: 1338781 - RNA, 17 nt, Homo sapiens
uuacuaaugauacuuac

SEQ ID NO: 1338782 - RNA, 20 nt, Homo sapiens
uuacuauuucaauacuuaca

SEQ ID NO: 1338783 - RNA, 17 nt, Homo sapiens
uuacuggacauaacauu

SEQ ID NO: 1338784 - RNA, 15 nt, Homo sapiens
uuacuguuacuugau

SEQ ID NO: 1338785 - RNA, 21 nt, Homo sapiens
aagcuaccccucaaacugcac

SEQ ID NO: 1338786 - RNA, 22 nt, Homo sapiens
aagcuaccccucaaacugcaca

SEQ ID NO: 1338787 - RNA, 20 nt, Homo sapiens
aagcuacgggcacaacugga

SEQ ID NO: 1338788 - RNA, 16 nt, Homo sapiens
aagcucccaccccacu

SEQ ID NO: 1338789 - RNA, 23 nt, Homo sapiens
aagcucuguuccaugcaacugga

SEQ ID NO: 1338790 - RNA, 18 nt, Homo sapiens
aagcugccucaaggaauu

SEQ ID NO: 1338791 - RNA, 19 nt, Homo sapiens
aagcuggcuuuucccauuu

SEQ ID NO: 1338792 - RNA, 14 nt, Homo sapiens
aagcuugucaaaga

SEQ ID NO: 1338793 - RNA, 14 nt, Homo sapiens
aaggaaaagcaaga

SEQ ID NO: 1338794 - RNA, 13 nt, Homo sapiens
aaggaaacccagc

SEQ ID NO: 1338795 - RNA, 17 nt, Homo sapiens
aaggaagaguuaugcuu

SEQ ID NO: 1338796 - RNA, 18 nt, Homo sapiens
aaggaauaaagccuuuug

SEQ ID NO: 1338797 - RNA, 15 nt, Homo sapiens
aaggaaugaacuuau

SEQ ID NO: 1338798 - RNA, 15 nt, Homo sapiens
aaggacaggacccuc

SEQ ID NO: 1338799 - RNA, 19 nt, Homo sapiens
aaggagggagcuacucuca

SEQ ID NO: 1338800 - RNA, 17 nt, Homo sapiens
aaggaguccuugcauca

SEQ ID NO: 1338801 - RNA, 20 nt, Homo sapiens
aaggaucucuauaacagauc

SEQ ID NO: 1338802 - RNA, 12 nt, Homo sapiens
aaggaugucugc

SEQ ID NO: 1338803 - RNA, 16 nt, Homo sapiens
aaggauuacucuccau

SEQ ID NO: 1338804 - RNA, 18 nt, Homo sapiens
aaggauuuuaccaaagca

SEQ ID NO: 1338805 - RNA, 15 nt, Homo sapiens
aaggcaaaugaugcc

SEQ ID NO: 1338806 - RNA, 17 nt, Homo sapiens
aaggcagaaagauagcu

SEQ ID NO: 1338807 - RNA, 16 nt, Homo sapiens
aaggcccacuguaaua

SEQ ID NO: 1338808 - RNA, 16 nt, Homo sapiens
aaggccccugcaaugu

SEQ ID NO: 1338809 - RNA, 17 nt, Homo sapiens
aaggcgauauaagcaaa

SEQ ID NO: 1338810 - RNA, 22 nt, Homo sapiens
aaggcucugagcaaauguggcu

SEQ ID NO: 1338811 - RNA, 18 nt, Homo sapiens
aaggcugacagacucacu

SEQ ID NO: 1338812 - RNA, 14 nt, Homo sapiens
aaggcuugguccca

SEQ ID NO: 1338813 - RNA, 15 nt, Homo sapiens
aagggacuaccucug

SEQ ID NO: 1338814 - RNA, 15 nt, Homo sapiens
aagggagacugacca

SEQ ID NO: 1338815 - RNA, 16 nt, Homo sapiens
aagggagggugacaug

SEQ ID NO: 1338816 - RNA, 14 nt, Homo sapiens
aagguacacuggua

SEQ ID NO: 1338817 - RNA, 15 nt, Homo sapiens
aaggucuaaucagug

SEQ ID NO: 1338818 - RNA, 18 nt, Homo sapiens
aaggucuaucuuaagaag

SEQ ID NO: 1338819 - RNA, 17 nt, Homo sapiens
aaggucugcacuccuuu

SEQ ID NO: 1338820 - RNA, 15 nt, Homo sapiens
aaguaaaaccacagc

SEQ ID NO: 1338821 - RNA, 14 nt, Homo sapiens
aaguaagcauuucc

SEQ ID NO: 1338822 - RNA, 11 nt, Homo sapiens
aaguacauauu

SEQ ID NO: 1338823 - RNA, 21 nt, Homo sapiens
aaguagaauagugguugccaa

SEQ ID NO: 1338824 - RNA, 14 nt, Homo sapiens
aaguagggacuucu

SEQ ID NO: 1338825 - RNA, 18 nt, Homo sapiens
aaguagggacuucugucu

SEQ ID NO: 1338826 - RNA, 13 nt, Homo sapiens
aaguauugaauua

SEQ ID NO: 1338827 - RNA, 16 nt, Homo sapiens
aaguauuggcauucaa

SEQ ID NO: 1338828 - RNA, 21 nt, Homo sapiens
aagucaggcuagcugugcugg

SEQ ID NO: 1338829 - RNA, 17 nt, Homo sapiens
aagucaguucugugauc

SEQ ID NO: 1338830 - RNA, 23 nt, Homo sapiens
aagucauagguuacagaccucag

SEQ ID NO: 1338831 - RNA, 15 nt, Homo sapiens
aagucaucuugcuac

SEQ ID NO: 1338832 - RNA, 18 nt, Homo sapiens
aaguccaagcauaccaac

SEQ ID NO: 1338833 - RNA, 20 nt, Homo sapiens
aagucccugucauuugaacc

SEQ ID NO: 1338834 - RNA, 22 nt, Homo sapiens
aagucugguaauaaaugugacu

SEQ ID NO: 1338835 - RNA, 21 nt, Homo sapiens
aagucuuugguaaauggcaaa

SEQ ID NO: 1338836 - RNA, 12 nt, Homo sapiens
aagugauccuca

SEQ ID NO: 1338837 - RNA, 20 nt, Homo sapiens
aagugaucuguccaccucgg

SEQ ID NO: 1338838 - RNA, 17 nt, Homo sapiens
aagugcacaggagccaa

SEQ ID NO: 1338839 - RNA, 17 nt, Homo sapiens
aagugcaugaaauguau

SEQ ID NO: 1338840 - RNA, 17 nt, Homo sapiens
aauguuaugacuaugua

SEQ ID NO: 1338841 - RNA, 11 nt, Homo sapiens
aauguuugcau

SEQ ID NO: 1338842 - RNA, 15 nt, Homo sapiens
aauguuugcauuucc

SEQ ID NO: 1338843 - RNA, 15 nt, Homo sapiens
aauguuuuuauuuca

SEQ ID NO: 1338844 - RNA, 18 nt, Homo sapiens
aauuaaaaaauaguugca

SEQ ID NO: 1338845 - RNA, 18 nt, Homo sapiens
aauuaaaacacuuucaaa

SEQ ID NO: 1338846 - RNA, 21 nt, Homo sapiens
aauuaaaccaaggagucugau

SEQ ID NO: 1338847 - RNA, 23 nt, Homo sapiens
aauuaaaggagaagauuccugaa

SEQ ID NO: 1338848 - RNA, 14 nt, Homo sapiens
aauuaacucagaca

SEQ ID NO: 1338849 - RNA, 14 nt, Homo sapiens
aauuacccuuuugu

SEQ ID NO: 1338850 - RNA, 14 nt, Homo sapiens
aauuacugcuauaa

SEQ ID NO: 1338851 - RNA, 12 nt, Homo sapiens
aauuagcaauug

SEQ ID NO: 1338852 - RNA, 22 nt, Homo sapiens
aauuaggaacugaguaugugua

SEQ ID NO: 1338853 - RNA, 16 nt, Homo sapiens
aauuauaacuauuaca

SEQ ID NO: 1338854 - RNA, 13 nt, Homo sapiens
aauuauaugauau

SEQ ID NO: 1338855 - RNA, 14 nt, Homo sapiens
aauuaucuauagcu

SEQ ID NO: 1338856 - RNA, 20 nt, Homo sapiens
aauuauguuauuugcucuaa

SEQ ID NO: 1338857 - RNA, 17 nt, Homo sapiens
aauuauuuuaguagugu

SEQ ID NO: 1338858 - RNA, 17 nt, Homo sapiens
aauucaccacagacuuu

SEQ ID NO: 1338859 - RNA, 12 nt, Homo sapiens
aauucagacuug

SEQ ID NO: 1338860 - RNA, 22 nt, Homo sapiens
aauucaggucuguaugucaugg

SEQ ID NO: 1338861 - RNA, 22 nt, Homo sapiens
aauucaguaacaaagguuuaaa

SEQ ID NO: 1338862 - RNA, 23 nt, Homo sapiens
aauucauagugauagagugcagu

SEQ ID NO: 1338863 - RNA, 13 nt, Homo sapiens
aauuccugugauu

SEQ ID NO: 1338864 - RNA, 19 nt, Homo sapiens
aauucuaugccugucuuaa

SEQ ID NO: 1338865 - RNA, 16 nt, Homo sapiens
aauucuccugccuuag

SEQ ID NO: 1338866 - RNA, 11 nt, Homo sapiens
aauucugugac

SEQ ID NO: 1338867 - RNA, 20 nt, Homo sapiens
aauucugugacauacauauu

SEQ ID NO: 1338868 - RNA, 21 nt, Homo sapiens
aauucuuacccuguacauaug

SEQ ID NO: 1338869 - RNA, 20 nt, Homo sapiens
aauucuuauugacucauaca

SEQ ID NO: 1338870 - RNA, 21 nt, Homo sapiens
aauucuuauugacucauacac

SEQ ID NO: 1338871 - RNA, 13 nt, Homo sapiens
aauugacaggauu

SEQ ID NO: 1338872 - RNA, 14 nt, Homo sapiens
aauugauguugcug

SEQ ID NO: 1338873 - RNA, 12 nt, Homo sapiens
aauugcauuucc

SEQ ID NO: 1338874 - RNA, 22 nt, Homo sapiens
aauugccaagaaaaacaacuuu

SEQ ID NO: 1338875 - RNA, 11 nt, Homo sapiens
aauugccugua

SEQ ID NO: 1338876 - RNA, 19 nt, Homo sapiens
aauuggccaugucgccaaa

SEQ ID NO: 1338877 - RNA, 12 nt, Homo sapiens
aauuguacaaua

SEQ ID NO: 1338878 - RNA, 20 nt, Homo sapiens
aauugucuuuguucugugau

SEQ ID NO: 1338879 - RNA, 11 nt, Homo sapiens
aauuguugcua

SEQ ID NO: 1338880 - RNA, 19 nt, Homo sapiens
aauuuaaaauaaaaggcca

SEQ ID NO: 1338881 - RNA, 22 nt, Homo sapiens
aauuuaaauaagauuuaauuca

SEQ ID NO: 1338882 - RNA, 19 nt, Homo sapiens
aauuuagaaauauaauuga

SEQ ID NO: 1338883 - RNA, 12 nt, Homo sapiens
aauuuagcucuc

SEQ ID NO: 1338884 - RNA, 21 nt, Homo sapiens
aauuuauaccucaaacuaucu

SEQ ID NO: 1338885 - RNA, 16 nt, Homo sapiens
aauuuauucaucuugc

SEQ ID NO: 1338886 - RNA, 20 nt, Homo sapiens
aauuucauaccuaucaucuu

SEQ ID NO: 1338887 - RNA, 15 nt, Homo sapiens
aauuuggcuaauaac

SEQ ID NO: 1338888 - RNA, 17 nt, Homo sapiens
aauuugggagagccaua

SEQ ID NO: 1338889 - RNA, 20 nt, Homo sapiens
aauuugggagagccauacau

SEQ ID NO: 1338890 - RNA, 18 nt, Homo sapiens
aauuuguaaaacuucugc

SEQ ID NO: 1338891 - RNA, 18 nt, Homo sapiens
aauuuuaaaaagcagcug

SEQ ID NO: 1338892 - RNA, 13 nt, Homo sapiens
aauuuucuuucac

SEQ ID NO: 1338893 - RNA, 14 nt, Homo sapiens
aauuuuuaccuguu

SEQ ID NO: 1338894 - RNA, 18 nt, Homo sapiens
aauuuuucugugcucaau

SEQ ID NO: 1338895 - RNA, 16 nt, Homo sapiens
aauuuuuuaguuuccc

SEQ ID NO: 1338896 - RNA, 19 nt, Homo sapiens
acaaaaaacuaucaacuac

SEQ ID NO: 1338897 - RNA, 14 nt, Homo sapiens
acaaaaaauuagcu

SEQ ID NO: 1338898 - RNA, 12 nt, Homo sapiens
acaaaacaaagc

SEQ ID NO: 1338899 - RNA, 14 nt, Homo sapiens
acaaaacccuuucu

SEQ ID NO: 1338900 - RNA, 23 nt, Homo sapiens
acaaacaaugcauaggauuccaa

SEQ ID NO: 1338901 - RNA, 17 nt, Homo sapiens
acaaacagaauuuucca

SEQ ID NO: 1338902 - RNA, 14 nt, Homo sapiens
acaaaccacaccac

SEQ ID NO: 1338903 - RNA, 20 nt, Homo sapiens
acaaacccccacuccagcuc

SEQ ID NO: 1338904 - RNA, 13 nt, Homo sapiens
acaaacucucacc

SEQ ID NO: 1338905 - RNA, 18 nt, Homo sapiens
acaaacuucccugacucu

SEQ ID NO: 1338906 - RNA, 22 nt, Homo sapiens
acaaacuucccugacucuucaa

SEQ ID NO: 1338907 - RNA, 21 nt, Homo sapiens
acaaagauucucuauguauca

SEQ ID NO: 1338908 - RNA, 16 nt, Homo sapiens
acaaagcagauccuca

SEQ ID NO: 1338909 - RNA, 18 nt, Homo sapiens
acaaagcccuuccauguc

SEQ ID NO: 1338910 - RNA, 22 nt, Homo sapiens
acaaauauggaugagguggaga

SEQ ID NO: 1338911 - RNA, 18 nt, Homo sapiens
acaaaucugccaaaauau

SEQ ID NO: 1338912 - RNA, 18 nt, Homo sapiens
acaaaugggaaaaccaga

SEQ ID NO: 1338913 - RNA, 13 nt, Homo sapiens
acaacauguucua

SEQ ID NO: 1338914 - RNA, 20 nt, Homo sapiens
acaaccaaaagucuucauca

SEQ ID NO: 1338915 - RNA, 19 nt, Homo sapiens
acaacccaccccgcuuucg

SEQ ID NO: 1338916 - RNA, 13 nt, Homo sapiens
acaacugcuccau

SEQ ID NO: 1338917 - RNA, 16 nt, Homo sapiens
acaacuggaagcuuug

SEQ ID NO: 1338918 - RNA, 23 nt, Homo sapiens
acaacuuucuccuacucuuccuu

SEQ ID NO: 1338919 - RNA, 21 nt, Homo sapiens
acaagaagguggaaggcagug

SEQ ID NO: 1338920 - RNA, 20 nt, Homo sapiens
acaagcauauguuagcauua

SEQ ID NO: 1338921 - RNA, 23 nt, Homo sapiens
acaagccuccuguaccucagugg

SEQ ID NO: 1338922 - RNA, 20 nt, Homo sapiens
acagacagcuuacaggagcc

SEQ ID NO: 1338923 - RNA, 20 nt, Homo sapiens
acagacaggaauuuagaaaa

SEQ ID NO: 1338924 - RNA, 20 nt, Homo sapiens
acagacauccuagcauuugu

SEQ ID NO: 1338925 - RNA, 18 nt, Homo sapiens
acagacaucuaauguucu

SEQ ID NO: 1338926 - RNA, 20 nt, Homo sapiens
acagaccgccgucuaacuca

SEQ ID NO: 1338927 - RNA, 21 nt, Homo sapiens
acagacuauggccauggcuca

SEQ ID NO: 1338928 - RNA, 22 nt, Homo sapiens
acagacucaaugugcucuguaa

SEQ ID NO: 1338929 - RNA, 12 nt, Homo sapiens
acagacuguggu

SEQ ID NO: 1338930 - RNA, 22 nt, Homo sapiens
acagacuguguuuaacugcugc

SEQ ID NO: 1338931 - RNA, 12 nt, Homo sapiens
acagagcgagau

SEQ ID NO: 1338932 - RNA, 16 nt, Homo sapiens
acagauaaaacuugag

SEQ ID NO: 1338933 - RNA, 13 nt, Homo sapiens
acagauaaugucu

SEQ ID NO: 1338934 - RNA, 16 nt, Homo sapiens
acagaucacuccugga

SEQ ID NO: 1338935 - RNA, 21 nt, Homo sapiens
acagaucauccugcuugacug

SEQ ID NO: 1338936 - RNA, 13 nt, Homo sapiens
acagaucccgggg

SEQ ID NO: 1338937 - RNA, 14 nt, Homo sapiens
acagaucccgggga

SEQ ID NO: 1338938 - RNA, 18 nt, Homo sapiens
acagaugccauauagugu

SEQ ID NO: 1338939 - RNA, 17 nt, Homo sapiens
acagccaauccaauuaa

SEQ ID NO: 1338940 - RNA, 14 nt, Homo sapiens
acagccuggcacag

SEQ ID NO: 1338941 - RNA, 18 nt, Homo sapiens
acagccuuaccaaagcag

SEQ ID NO: 1338942 - RNA, 22 nt, Homo sapiens
acagcuaauuguaccauagugu

SEQ ID NO: 1338943 - RNA, 18 nt, Homo sapiens
acagcugcugcuggaaau

SEQ ID NO: 1338944 - RNA, 16 nt, Homo sapiens
acaggaccccagcucu

SEQ ID NO: 1338945 - RNA, 22 nt, Homo sapiens
acaggacuuucauuguucuugg

SEQ ID NO: 1338946 - RNA, 15 nt, Homo sapiens
acaggagacaaaaga

SEQ ID NO: 1338947 - RNA, 21 nt, Homo sapiens
acaggaggaagacaggcaaau

SEQ ID NO: 1338948 - RNA, 22 nt, Homo sapiens
acaggcaaauguacuucucacc

SEQ ID NO: 1338949 - RNA, 23 nt, Homo sapiens
acaggcaaauguacuucucaccc

SEQ ID NO: 1338950 - RNA, 17 nt, Homo sapiens
acagggccagugcaguu

SEQ ID NO: 1338951 - RNA, 21 nt, Homo sapiens
acagggucuugcuauauugcc

SEQ ID NO: 1338952 - RNA, 17 nt, Homo sapiens
acaggucccacugcccu

SEQ ID NO: 1338953 - RNA, 20 nt, Homo sapiens
acagguuacgugagaacaau

SEQ ID NO: 1338954 - RNA, 22 nt, Homo sapiens
acaguaacugugacugaugacu

SEQ ID NO: 1338955 - RNA, 13 nt, Homo sapiens
acaguccacaggg

SEQ ID NO: 1338956 - RNA, 20 nt, Homo sapiens
acagucucaggaaaucaaau

SEQ ID NO: 1338957 - RNA, 14 nt, Homo sapiens
acagucugcuccuc

SEQ ID NO: 1338958 - RNA, 13 nt, Homo sapiens
acagucuucccag

SEQ ID NO: 1338959 - RNA, 21 nt, Homo sapiens
acagugccauccccaccuuca

SEQ ID NO: 1338960 - RNA, 12 nt, Homo sapiens
acaguggcucau

SEQ ID NO: 1338961 - RNA, 15 nt, Homo sapiens
acaguguuucuggcu

SEQ ID NO: 1338962 - RNA, 16 nt, Homo sapiens
acaguucugucauaug

SEQ ID NO: 1338963 - RNA, 14 nt, Homo sapiens
acaguucugugguu

SEQ ID NO: 1338964 - RNA, 17 nt, Homo sapiens
acaguucuuugggccag

SEQ ID NO: 1338965 - RNA, 23 nt, Homo sapiens
acaguuucuggcuggcuucauua

SEQ ID NO: 1338966 - RNA, 16 nt, Homo sapiens
acauaaguaacuuuua

SEQ ID NO: 1338967 - RNA, 22 nt, Homo sapiens
acauaccuggcccugugccuug

SEQ ID NO: 1338968 - RNA, 21 nt, Homo sapiens
acauacucugcuuagaauuug

SEQ ID NO: 1338969 - RNA, 21 nt, Homo sapiens
acauauacaaguagcuucccu

SEQ ID NO: 1338970 - RNA, 15 nt, Homo sapiens
acauaucugacuucu

SEQ ID NO: 1338971 - RNA, 13 nt, Homo sapiens
acauauuaucuca

SEQ ID NO: 1338972 - RNA, 14 nt, Homo sapiens
acaucaaggcucuu

SEQ ID NO: 1338973 - RNA, 20 nt, Homo sapiens
acaucaaucuaaagauacag

SEQ ID NO: 1338974 - RNA, 18 nt, Homo sapiens
acaucagcuugcccuguu

SEQ ID NO: 1338975 - RNA, 14 nt, Homo sapiens
acaucagucuccaa

SEQ ID NO: 1338976 - RNA, 17 nt, Homo sapiens
acaucagucuccaacau

SEQ ID NO: 1338977 - RNA, 19 nt, Homo sapiens
acauccacaugauaccucu

SEQ ID NO: 1338978 - RNA, 22 nt, Homo sapiens
acaucccuuccuggaaacagca

SEQ ID NO: 1338979 - RNA, 16 nt, Homo sapiens
acauccuaugaaauac

SEQ ID NO: 1338980 - RNA, 23 nt, Homo sapiens
acaucucccuuuuccaugacugu

SEQ ID NO: 1338981 - RNA, 19 nt, Homo sapiens
acaucuugcucugcauuua

SEQ ID NO: 1338982 - RNA, 18 nt, Homo sapiens
acaugaaaauagcaauau

SEQ ID NO: 1338983 - RNA, 17 nt, Homo sapiens
acaugaagaaugcauuc

SEQ ID NO: 1338984 - RNA, 20 nt, Homo sapiens
acaugacauucuuagcugua

SEQ ID NO: 1338985 - RNA, 16 nt, Homo sapiens
acaugaggccaucuca

SEQ ID NO: 1338986 - RNA, 18 nt, Homo sapiens
acaugaucuucuuuauaa

SEQ ID NO: 1338987 - RNA, 14 nt, Homo sapiens
acaugcacucagcu

SEQ ID NO: 1338988 - RNA, 17 nt, Homo sapiens
acaugcauaaaaauuaa

SEQ ID NO: 1338989 - RNA, 14 nt, Homo sapiens
acaugccacaagga

SEQ ID NO: 1338990 - RNA, 18 nt, Homo sapiens
acaugcccuguucagcua

SEQ ID NO: 1338991 - RNA, 19 nt, Homo sapiens
acaugccucugccaaagga

SEQ ID NO: 1338992 - RNA, 19 nt, Homo sapiens
acaugcucacacauuacaa

SEQ ID NO: 1338993 - RNA, 18 nt, Homo sapiens
acaugcugccuggcacag

SEQ ID NO: 1338994 - RNA, 15 nt, Homo sapiens
acaugguuacauauc

SEQ ID NO: 1338995 - RNA, 16 nt, Homo sapiens
acaugguuacauauca

SEQ ID NO: 1338996 - RNA, 19 nt, Homo sapiens
acauguaagcauaacuuau

SEQ ID NO: 1338997 - RNA, 22 nt, Homo sapiens
acauguaauugcagauaacuuu

SEQ ID NO: 1338998 - RNA, 12 nt, Homo sapiens
acaugugacauu

SEQ ID NO: 1338999 - RNA, 12 nt, Homo sapiens
acaugugcacac

SEQ ID NO: 1339000 - RNA, 21 nt, Homo sapiens
acauguuuguuucuguagaaa

SEQ ID NO: 1339001 - RNA, 18 nt, Homo sapiens
acauguuuuuucauuugu

SEQ ID NO: 1339002 - RNA, 14 nt, Homo sapiens
acauuaacggugcu

SEQ ID NO: 1339003 - RNA, 20 nt, Homo sapiens
acauucaauagcauaucaca

SEQ ID NO: 1339004 - RNA, 15 nt, Homo sapiens
acauuuaguccugua

SEQ ID NO: 1339005 - RNA, 17 nt, Homo sapiens
aaccuggauccagcacu

SEQ ID NO: 1339006 - RNA, 22 nt, Homo sapiens
aaccuguucuaccaagcaacaa

SEQ ID NO: 1339007 - RNA, 15 nt, Homo sapiens
aacgaugcagaugca

SEQ ID NO: 1339008 - RNA, 16 nt, Homo sapiens
aacgguuuuuagucuc

SEQ ID NO: 1339009 - RNA, 23 nt, Homo sapiens
aacgguuuuuuucuuuggcugca

SEQ ID NO: 1339010 - RNA, 15 nt, Homo sapiens
aacguguuccagugu

SEQ ID NO: 1339011 - RNA, 19 nt, Homo sapiens
aacguuugucauuccaguu

SEQ ID NO: 1339012 - RNA, 19 nt, Homo sapiens
aacuaaagauacauaccug

SEQ ID NO: 1339013 - RNA, 12 nt, Homo sapiens
acuucauucucg

SEQ ID NO: 1339014 - RNA, 13 nt, Homo sapiens
acuuccaugacau

SEQ ID NO: 1339015 - RNA, 19 nt, Homo sapiens
acuuccucuggcuccccaa

SEQ ID NO: 1339016 - RNA, 19 nt, Homo sapiens
acuuccugugacuucagcu

SEQ ID NO: 1339017 - RNA, 13 nt, Homo sapiens
acuuccuguggau

SEQ ID NO: 1339018 - RNA, 23 nt, Homo sapiens
acuuccuuggaaaucaaauguaa

SEQ ID NO: 1339019 - RNA, 22 nt, Homo sapiens
acuucuaaguaaaaccacagca

SEQ ID NO: 1339020 - RNA, 18 nt, Homo sapiens
acuucucacucaccacua

SEQ ID NO: 1339021 - RNA, 17 nt, Homo sapiens
acuucuuauacauuuga

SEQ ID NO: 1339022 - RNA, 19 nt, Homo sapiens
acuucuuuauucacaguau

SEQ ID NO: 1339023 - RNA, 19 nt, Homo sapiens
acuugaaaguuuuccagua

SEQ ID NO: 1339024 - RNA, 21 nt, Homo sapiens
acuugagaaccagucuccuca

SEQ ID NO: 1339025 - RNA, 23 nt, Homo sapiens
acuugaggccagugagcugugau

SEQ ID NO: 1339026 - RNA, 20 nt, Homo sapiens
acuugagguaccaguuguau

SEQ ID NO: 1339027 - RNA, 20 nt, Homo sapiens
acuugaugacccccaaccaa

SEQ ID NO: 1339028 - RNA, 17 nt, Homo sapiens
acuugauguguuaucuc

SEQ ID NO: 1339029 - RNA, 19 nt, Homo sapiens
acuugauguguuaucucuu

SEQ ID NO: 1339030 - RNA, 16 nt, Homo sapiens
acuugcugauccauga

SEQ ID NO: 1339031 - RNA, 21 nt, Homo sapiens
acuuggagggcucagggcagu

SEQ ID NO: 1339032 - RNA, 15 nt, Homo sapiens
acuuggcaucauuca

SEQ ID NO: 1339033 - RNA, 21 nt, Homo sapiens
acuugggcuucaacagccaag

SEQ ID NO: 1339034 - RNA, 23 nt, Homo sapiens
acuuggggaguuaagaccuggca

SEQ ID NO: 1339035 - RNA, 22 nt, Homo sapiens
acuugggucacaugacucucau

SEQ ID NO: 1339036 - RNA, 23 nt, Homo sapiens
acuuguguaguccuaugcaauaa

SEQ ID NO: 1339037 - RNA, 15 nt, Homo sapiens
acuuguuucccuuuc

SEQ ID NO: 1339038 - RNA, 20 nt, Homo sapiens
acuuuaaacuugucuuuuca

SEQ ID NO: 1339039 - RNA, 15 nt, Homo sapiens
acuuuauagcacaug

SEQ ID NO: 1339040 - RNA, 19 nt, Homo sapiens
agccugggcucacugugcu

SEQ ID NO: 1339041 - RNA, 15 nt, Homo sapiens
agccugggguguccu

SEQ ID NO: 1339042 - RNA, 22 nt, Homo sapiens
agccugggguguccuacaguga

SEQ ID NO: 1339043 - RNA, 21 nt, Homo sapiens
agccuggucccacgagggugc

SEQ ID NO: 1339044 - RNA, 17 nt, Homo sapiens
agccugguuucugggug

SEQ ID NO: 1339045 - RNA, 17 nt, Homo sapiens
agccuuaaaaugcauug

SEQ ID NO: 1339046 - RNA, 14 nt, Homo sapiens
agccuuaccaaagc

SEQ ID NO: 1339047 - RNA, 16 nt, Homo sapiens
agccuuaccaaagcag

SEQ ID NO: 1339048 - RNA, 21 nt, Homo sapiens
agccuuacuucaaagugccug

SEQ ID NO: 1339049 - RNA, 14 nt, Homo sapiens
agccuugcaaccca

SEQ ID NO: 1339050 - RNA, 19 nt, Homo sapiens
agccuuucuaaaaguugca

SEQ ID NO: 1339051 - RNA, 19 nt, Homo sapiens
agccuuuuugucaccucaa

SEQ ID NO: 1339052 - RNA, 13 nt, Homo sapiens
agcgaaucucugc

SEQ ID NO: 1339053 - RNA, 14 nt, Homo sapiens
agcgaaucucugcc

SEQ ID NO: 1339054 - RNA, 14 nt, Homo sapiens
agcgacuucagguc

SEQ ID NO: 1339055 - RNA, 16 nt, Homo sapiens
agcgcaugcuggugca

SEQ ID NO: 1339056 - RNA, 23 nt, Homo sapiens
agcggccacggugccuccagaug

SEQ ID NO: 1339057 - RNA, 13 nt, Homo sapiens
agcgggaguggcu

SEQ ID NO: 1339058 - RNA, 19 nt, Homo sapiens
agcgggcuugacugcauug

SEQ ID NO: 1339059 - RNA, 24 nt, Homo sapiens
agcgugcauaaguuaacuuccaau

SEQ ID NO: 1339060 - RNA, 13 nt, Homo sapiens
agcguguccagua

SEQ ID NO: 1339061 - RNA, 16 nt, Homo sapiens
agcguuugcauuugca

SEQ ID NO: 1339062 - RNA, 23 nt, Homo sapiens
agcguuugcauuugcagugcauc

SEQ ID NO: 1339063 - RNA, 14 nt, Homo sapiens
agcuaagaaccugg

SEQ ID NO: 1339064 - RNA, 22 nt, Homo sapiens
agcuaccugcucagcccugcac

SEQ ID NO: 1339065 - RNA, 15 nt, Homo sapiens
agcuagaacauucca

SEQ ID NO: 1339066 - RNA, 22 nt, Homo sapiens
agcuagacuagcuguaaaggac

SEQ ID NO: 1339067 - RNA, 14 nt, Homo sapiens
agcuagugccuuua

SEQ ID NO: 1339068 - RNA, 19 nt, Homo sapiens
agcuauauucugagacuuu

SEQ ID NO: 1339069 - RNA, 14 nt, Homo sapiens
agcuauuaagauac

SEQ ID NO: 1339070 - RNA, 21 nt, Homo sapiens
agcuauuuuuauacacuguaa

SEQ ID NO: 1339071 - RNA, 14 nt, Homo sapiens
agcucacccacccc

SEQ ID NO: 1339072 - RNA, 14 nt, Homo sapiens
agcucagccagugg

SEQ ID NO: 1339073 - RNA, 22 nt, Homo sapiens
agcucagggacuggcacacugg

SEQ ID NO: 1339074 - RNA, 17 nt, Homo sapiens
agcuccccucacucugu

SEQ ID NO: 1339075 - RNA, 16 nt, Homo sapiens
agcucccuguccugaa

SEQ ID NO: 1339076 - RNA, 19 nt, Homo sapiens
agcuccugagcuugaucuu

SEQ ID NO: 1339077 - RNA, 14 nt, Homo sapiens
agcucucacagaca

SEQ ID NO: 1339078 - RNA, 18 nt, Homo sapiens
agcucuggagaacagugg

SEQ ID NO: 1339079 - RNA, 17 nt, Homo sapiens
agcucuuccgaaaacca

SEQ ID NO: 1339080 - RNA, 11 nt, Homo sapiens
agcugccauuu

SEQ ID NO: 1339081 - RNA, 16 nt, Homo sapiens
agcugcucauuucacu

SEQ ID NO: 1339082 - RNA, 19 nt, Homo sapiens
agcugcuuugagcuacagg

SEQ ID NO: 1339083 - RNA, 17 nt, Homo sapiens
agcuggaaaaggccugu

SEQ ID NO: 1339084 - RNA, 16 nt, Homo sapiens
agcugggagcacuggu

SEQ ID NO: 1339085 - RNA, 17 nt, Homo sapiens
agcugggagcacuggug

SEQ ID NO: 1339086 - RNA, 17 nt, Homo sapiens
agcugggauuacaggcg

SEQ ID NO: 1339087 - RNA, 19 nt, Homo sapiens
agcugggauuacaggcgug

SEQ ID NO: 1339088 - RNA, 15 nt, Homo sapiens
agcugggcacagugg

SEQ ID NO: 1339089 - RNA, 19 nt, Homo sapiens
agcuggggaugucucucau

SEQ ID NO: 1339090 - RNA, 16 nt, Homo sapiens
agcugggggaagaagg

SEQ ID NO: 1339091 - RNA, 20 nt, Homo sapiens
agcuguaacuuaacuauuaa

SEQ ID NO: 1339092 - RNA, 23 nt, Homo sapiens
agcuguauaauuaauugucauua

SEQ ID NO: 1339093 - RNA, 19 nt, Homo sapiens
agcuguccugucaguuccc

SEQ ID NO: 1339094 - RNA, 16 nt, Homo sapiens
agcugugcaggcaugg

SEQ ID NO: 1339095 - RNA, 19 nt, Homo sapiens
agcuguuaauuugaguacu

SEQ ID NO: 1339096 - RNA, 22 nt, Homo sapiens
agcuuaaacagcuggucagccc

SEQ ID NO: 1339097 - RNA, 16 nt, Homo sapiens
agcuuauuaaaacuca

SEQ ID NO: 1339098 - RNA, 14 nt, Homo sapiens
agcuucaaacugca

SEQ ID NO: 1339099 - RNA, 22 nt, Homo sapiens
agcuucaggagggaaccagcuu

SEQ ID NO: 1339100 - RNA, 21 nt, Homo sapiens
agcuuccaacccgaggcaaua

SEQ ID NO: 1339101 - RNA, 20 nt, Homo sapiens
agcuuccuuaaguauaucau

SEQ ID NO: 1339102 - RNA, 22 nt, Homo sapiens
agcuucucugcaguaaaacaca

SEQ ID NO: 1339103 - RNA, 17 nt, Homo sapiens
agcuucuggggaugcag

SEQ ID NO: 1339104 - RNA, 17 nt, Homo sapiens
agcuucuucacaggcac

SEQ ID NO: 1339105 - RNA, 20 nt, Homo sapiens
agcuugaguuuuuaguggaa

SEQ ID NO: 1339106 - RNA, 22 nt, Homo sapiens
agcuugucugguaaguggcuuc

SEQ ID NO: 1339107 - RNA, 12 nt, Homo sapiens
agcuuguugaaa

SEQ ID NO: 1339108 - RNA, 20 nt, Homo sapiens
agcuuuauuaccaguggcgu

SEQ ID NO: 1339109 - RNA, 19 nt, Homo sapiens
agcuuucugccuuagccua

SEQ ID NO: 1339110 - RNA, 14 nt, Homo sapiens
agcuuugugucguc

SEQ ID NO: 1339111 - RNA, 13 nt, Homo sapiens
aggaaaaauugau

SEQ ID NO: 1339112 - RNA, 13 nt, Homo sapiens
aggaaacaacagc

SEQ ID NO: 1339113 - RNA, 20 nt, Homo sapiens
aggaaauacuuuguaacuuu

SEQ ID NO: 1339114 - RNA, 22 nt, Homo sapiens
aggaaaucaaauaugcaaagca

SEQ ID NO: 1339115 - RNA, 13 nt, Homo sapiens
aggaaccaccugu

SEQ ID NO: 1339116 - RNA, 15 nt, Homo sapiens
aggaacuagaaagaa

SEQ ID NO: 1339117 - RNA, 20 nt, Homo sapiens
aggaagggaagagcauguaa

SEQ ID NO: 1339118 - RNA, 17 nt, Homo sapiens
aggaaguagaccucuuu

SEQ ID NO: 1339119 - RNA, 19 nt, Homo sapiens
aggaaguggcugucccugu

SEQ ID NO: 1339120 - RNA, 22 nt, Homo sapiens
aggaaguugacuuauaguacau

SEQ ID NO: 1339121 - RNA, 15 nt, Homo sapiens
aggaauuguuuuuau

SEQ ID NO: 1339122 - RNA, 19 nt, Homo sapiens
aggaauuucuuaacuucuu

SEQ ID NO: 1339123 - RNA, 22 nt, Homo sapiens
aggaauuuucuugaaacuguga

SEQ ID NO: 1339124 - RNA, 22 nt, Homo sapiens
aggacaaaauaaaccguguauu

SEQ ID NO: 1339125 - RNA, 21 nt, Homo sapiens
aggacacuagaagauuuugaa

SEQ ID NO: 1339126 - RNA, 18 nt, Homo sapiens
aggacagggagaugcugc

SEQ ID NO: 1339127 - RNA, 22 nt, Homo sapiens
aggacauuugugggcaagcaga

SEQ ID NO: 1339128 - RNA, 21 nt, Homo sapiens
aggacccugaaggggccauga

SEQ ID NO: 1339129 - RNA, 22 nt, Homo sapiens
aggacccugaaggggccaugau

SEQ ID NO: 1339130 - RNA, 21 nt, Homo sapiens
aggaccucccucccccuggca

SEQ ID NO: 1339131 - RNA, 20 nt, Homo sapiens
aggacucuggacaaucucac

SEQ ID NO: 1339132 - RNA, 19 nt, Homo sapiens
aggacuugugucucugugc

SEQ ID NO: 1339133 - RNA, 21 nt, Homo sapiens
aggacuuucauuguucuuggc

SEQ ID NO: 1339134 - RNA, 19 nt, Homo sapiens
aggccagcagcugaugcug

SEQ ID NO: 1339135 - RNA, 21 nt, Homo sapiens
aggccauugggauauucugaa

SEQ ID NO: 1339136 - RNA, 13 nt, Homo sapiens
aggcccauguaua

SEQ ID NO: 1339137 - RNA, 14 nt, Homo sapiens
aggcccauucuuca

SEQ ID NO: 1339138 - RNA, 19 nt, Homo sapiens
aggccccagccucccugaa

SEQ ID NO: 1339139 - RNA, 16 nt, Homo sapiens
aggccugggaccuccc

SEQ ID NO: 1339140 - RNA, 16 nt, Homo sapiens
aggccugugugacucc

SEQ ID NO: 1339141 - RNA, 19 nt, Homo sapiens
aggccuugcucacagcuga

SEQ ID NO: 1339142 - RNA, 15 nt, Homo sapiens
aggcuagagugcaau

SEQ ID NO: 1339143 - RNA, 19 nt, Homo sapiens
aggcuaugggguaggagaa

SEQ ID NO: 1339144 - RNA, 18 nt, Homo sapiens
aggcucagagagguagca

SEQ ID NO: 1339145 - RNA, 21 nt, Homo sapiens
aggcucugcacagacaagcag

SEQ ID NO: 1339146 - RNA, 18 nt, Homo sapiens
aggcugagaacucguuca

SEQ ID NO: 1339147 - RNA, 14 nt, Homo sapiens
aggcugaggacuua

SEQ ID NO: 1339148 - RNA, 15 nt, Homo sapiens
aggcuggaaaugguu

SEQ ID NO: 1339149 - RNA, 14 nt, Homo sapiens
aggcuggagugcaa

SEQ ID NO: 1339150 - RNA, 15 nt, Homo sapiens
aggcuggagugcaau

SEQ ID NO: 1339151 - RNA, 21 nt, Homo sapiens
aggcugggccccgacguuugc

SEQ ID NO: 1339152 - RNA, 13 nt, Homo sapiens
aggcuggucucaa

SEQ ID NO: 1339153 - RNA, 11 nt, Homo sapiens
aggcuguaacu

SEQ ID NO: 1339154 - RNA, 18 nt, Homo sapiens
agggaaaaucuucacuuu

SEQ ID NO: 1339155 - RNA, 21 nt, Homo sapiens
agggaagugacaggacuuuca

SEQ ID NO: 1339156 - RNA, 23 nt, Homo sapiens
agggaaucucuugccugcuccau

SEQ ID NO: 1339157 - RNA, 17 nt, Homo sapiens
agggaaugcagcaggaa

SEQ ID NO: 1339158 - RNA, 20 nt, Homo sapiens
agggacaccaagccuuggcu

SEQ ID NO: 1339159 - RNA, 17 nt, Homo sapiens
agggacaggcacuccaa

SEQ ID NO: 1339160 - RNA, 20 nt, Homo sapiens
agggacaggcuccucugggg

SEQ ID NO: 1339161 - RNA, 22 nt, Homo sapiens
agggaccaucugcugcaguuac

SEQ ID NO: 1339162 - RNA, 22 nt, Homo sapiens
agggaccgggcgcagcccuccc

SEQ ID NO: 1339163 - RNA, 22 nt, Homo sapiens
agggacuucugucuucacaaca

SEQ ID NO: 1339164 - RNA, 21 nt, Homo sapiens
agggacuugaaugcacuuuug

SEQ ID NO: 1339165 - RNA, 20 nt, Homo sapiens
agggagaaacuucugcucag

SEQ ID NO: 1339166 - RNA, 20 nt, Homo sapiens
agggagacaccaguggugcg

SEQ ID NO: 1339167 - RNA, 16 nt, Homo sapiens
agggagagagugcuau

SEQ ID NO: 1339168 - RNA, 20 nt, Homo sapiens
agggagcucuggggacagcu

SEQ ID NO: 1339169 - RNA, 20 nt, Homo sapiens
agggaggcaagcccuguuga

SEQ ID NO: 1339170 - RNA, 19 nt, Homo sapiens
agggagggguuauagcuuc

SEQ ID NO: 1339171 - RNA, 14 nt, Homo sapiens
agggagguggugau

SEQ ID NO: 1339172 - RNA, 15 nt, Homo sapiens
agggaucuguuugaa

SEQ ID NO: 1339173 - RNA, 14 nt, Homo sapiens
agggaucuugcaaa

SEQ ID NO: 1339174 - RNA, 16 nt, Homo sapiens
agggauggagaaagaa

SEQ ID NO: 1339175 - RNA, 17 nt, Homo sapiens
agggauggcagugauuc

SEQ ID NO: 1339176 - RNA, 17 nt, Homo sapiens
agggcauggccaggugg

SEQ ID NO: 1339177 - RNA, 13 nt, Homo sapiens
agggccaggugca

SEQ ID NO: 1339178 - RNA, 20 nt, Homo sapiens
agggccguugcccccagacu

SEQ ID NO: 1339179 - RNA, 17 nt, Homo sapiens
agggcuggagccugggg

SEQ ID NO: 1339180 - RNA, 15 nt, Homo sapiens
agggcuggggacaga

SEQ ID NO: 1339181 - RNA, 18 nt, Homo sapiens
aggggaggacuaggaaaa

SEQ ID NO: 1339182 - RNA, 15 nt, Homo sapiens
aggggaggagcuucu

SEQ ID NO: 1339183 - RNA, 17 nt, Homo sapiens
aggggagugcucugaag

SEQ ID NO: 1339184 - RNA, 15 nt, Homo sapiens
aggggcucucucaug

SEQ ID NO: 1339185 - RNA, 20 nt, Homo sapiens
aggggcucuguggcaaaaag

SEQ ID NO: 1339186 - RNA, 15 nt, Homo sapiens
agggggcugcugcuc

SEQ ID NO: 1339187 - RNA, 18 nt, Homo sapiens
agggggucugggccagug

SEQ ID NO: 1339188 - RNA, 17 nt, Homo sapiens
agggguagaaguggcau

SEQ ID NO: 1339189 - RNA, 13 nt, Homo sapiens
agggguauguucc

SEQ ID NO: 1339190 - RNA, 17 nt, Homo sapiens
aggguaccgucuucucc

SEQ ID NO: 1339191 - RNA, 16 nt, Homo sapiens
aggguagugugguauu

SEQ ID NO: 1339192 - RNA, 15 nt, Homo sapiens
agggucccgguguau

SEQ ID NO: 1339193 - RNA, 19 nt, Homo sapiens
aggguccucaguccacugc

SEQ ID NO: 1339194 - RNA, 22 nt, Homo sapiens
agggucuugcuauauugcccag

SEQ ID NO: 1339195 - RNA, 14 nt, Homo sapiens
agggugggggugcu

SEQ ID NO: 1339196 - RNA, 18 nt, Homo sapiens
agggugggggugcucucu

SEQ ID NO: 1339197 - RNA, 21 nt, Homo sapiens
agguaaagcguuugcauuugc

SEQ ID NO: 1339198 - RNA, 22 nt, Homo sapiens
agguaaauuuuuaggcaaagau

SEQ ID NO: 1339199 - RNA, 15 nt, Homo sapiens
agguaacacauuaua

SEQ ID NO: 1339200 - RNA, 22 nt, Homo sapiens
agguaauguuaguaaauccaug

SEQ ID NO: 1339201 - RNA, 21 nt, Homo sapiens
agguaggcacaaauacauucc

SEQ ID NO: 1339202 - RNA, 22 nt, Homo sapiens
agguaggcacaaauacauuccu

SEQ ID NO: 1339203 - RNA, 17 nt, Homo sapiens
agguaugaucucuucug

SEQ ID NO: 1339204 - RNA, 14 nt, Homo sapiens
aggucaaaacugaa

SEQ ID NO: 1339205 - RNA, 12 nt, Homo sapiens
aggucacucugg

SEQ ID NO: 1339206 - RNA, 23 nt, Homo sapiens
agguccaccgagccccugacccc

SEQ ID NO: 1339207 - RNA, 13 nt, Homo sapiens
agguccuggugcc

SEQ ID NO: 1339208 - RNA, 13 nt, Homo sapiens
aggucuguauguc

SEQ ID NO: 1339209 - RNA, 20 nt, Homo sapiens
aggucuguuuaaaguggcaa

SEQ ID NO: 1339210 - RNA, 16 nt, Homo sapiens
aggugaaagaaaccac

SEQ ID NO: 1339211 - RNA, 14 nt, Homo sapiens
aggugaaccaaaga

SEQ ID NO: 1339212 - RNA, 18 nt, Homo sapiens
aggugcauagcaagugaa

SEQ ID NO: 1339213 - RNA, 17 nt, Homo sapiens
aggugcccagaauuuac

SEQ ID NO: 1339214 - RNA, 18 nt, Homo sapiens
aggugcccagggccagug

SEQ ID NO: 1339215 - RNA, 16 nt, Homo sapiens
aggugcucaugcugcu

SEQ ID NO: 1339216 - RNA, 13 nt, Homo sapiens
aggugcucugugg

SEQ ID NO: 1339217 - RNA, 12 nt, Homo sapiens
aggugggagcau

SEQ ID NO: 1339218 - RNA, 18 nt, Homo sapiens
aggugggggaacacugag

SEQ ID NO: 1339219 - RNA, 20 nt, Homo sapiens
aggugggggaacacugagaa

SEQ ID NO: 1339220 - RNA, 23 nt, Homo sapiens
agguguucuucauuaccucagug

SEQ ID NO: 1339221 - RNA, 17 nt, Homo sapiens
agguuauuuugauguaa

SEQ ID NO: 1339222 - RNA, 15 nt, Homo sapiens
agguucccacucugg

SEQ ID NO: 1339223 - RNA, 18 nt, Homo sapiens
agguugucugaagucacu

SEQ ID NO: 1339224 - RNA, 23 nt, Homo sapiens
agguugucugaagucacugcaca

SEQ ID NO: 1339225 - RNA, 21 nt, Homo sapiens
agguuuguuuagaagaagugu

SEQ ID NO: 1339226 - RNA, 14 nt, Homo sapiens
agguuuuaacugaa

SEQ ID NO: 1339227 - RNA, 22 nt, Homo sapiens
agguuuucagagaauuaucuca

SEQ ID NO: 1339228 - RNA, 14 nt, Homo sapiens
aguaaaauuucagg

SEQ ID NO: 1339229 - RNA, 14 nt, Homo sapiens
aguaacacacuucc

SEQ ID NO: 1339230 - RNA, 17 nt, Homo sapiens
aguaacaguuugauauu

SEQ ID NO: 1339231 - RNA, 15 nt, Homo sapiens
aguaacuccccucag

SEQ ID NO: 1339232 - RNA, 11 nt, Homo sapiens
aguaacugugc

SEQ ID NO: 1339233 - RNA, 22 nt, Homo sapiens
aguaagacagauucuucacugu

SEQ ID NO: 1339234 - RNA, 22 nt, Homo sapiens
aguaaguacuuaauaaacugug

SEQ ID NO: 1339235 - RNA, 19 nt, Homo sapiens
aguaaguuuauccaaaucu

SEQ ID NO: 1339236 - RNA, 16 nt, Homo sapiens
aguacauuugcuuuaa

SEQ ID NO: 1339237 - RNA, 10 nt, Homo sapiens
aguaccccau

SEQ ID NO: 1339238 - RNA, 20 nt, Homo sapiens
aguacccuuggccuuuacag

SEQ ID NO: 1339239 - RNA, 12 nt, Homo sapiens
aguacuaaucau

SEQ ID NO: 1339240 - RNA, 20 nt, Homo sapiens
aguacuauggagugcucaca

SEQ ID NO: 1339241 - RNA, 15 nt, Homo sapiens
aguacugaccacugg

SEQ ID NO: 1339242 - RNA, 20 nt, Homo sapiens
aguacuuaauaaacuguggu

SEQ ID NO: 1339243 - RNA, 14 nt, Homo sapiens
aguagcaacaaaag

SEQ ID NO: 1339244 - RNA, 23 nt, Homo sapiens
aguagcguuuuuuaaauguauac

SEQ ID NO: 1339245 - RNA, 18 nt, Homo sapiens
aguaucacaaaaccaccu

SEQ ID NO: 1339246 - RNA, 13 nt, Homo sapiens
aguauccacuuug

SEQ ID NO: 1339247 - RNA, 11 nt, Homo sapiens
aguaugaauga

SEQ ID NO: 1339248 - RNA, 16 nt, Homo sapiens
aguauuaauagguuaa

SEQ ID NO: 1339249 - RNA, 20 nt, Homo sapiens
aguauugucgguuaccucug

SEQ ID NO: 1339250 - RNA, 15 nt, Homo sapiens
agucaaauaccacau

SEQ ID NO: 1339251 - RNA, 19 nt, Homo sapiens
agucaaauaccacaugauu

SEQ ID NO: 1339252 - RNA, 19 nt, Homo sapiens
agucacacuuuaaauuaag

SEQ ID NO: 1339253 - RNA, 20 nt, Homo sapiens
agucacgcaccaagcaggca

SEQ ID NO: 1339254 - RNA, 22 nt, Homo sapiens
agucagacuuuguguucauuuc

SEQ ID NO: 1339255 - RNA, 13 nt, Homo sapiens
agucagcauucuu

SEQ ID NO: 1339256 - RNA, 23 nt, Homo sapiens
agucaucuugcuaccaguauuua

SEQ ID NO: 1339257 - RNA, 16 nt, Homo sapiens
agucauuaaagacagg

SEQ ID NO: 1339258 - RNA, 14 nt, Homo sapiens
agucauucuucccu

SEQ ID NO: 1339259 - RNA, 21 nt, Homo sapiens
agucauucuucccuaaucuuc

SEQ ID NO: 1339260 - RNA, 12 nt, Homo sapiens
aguccacugcug

SEQ ID NO: 1339261 - RNA, 22 nt, Homo sapiens
agucccagacaauuccauucaa

SEQ ID NO: 1339262 - RNA, 20 nt, Homo sapiens
agucccauccucuugucagg

SEQ ID NO: 1339263 - RNA, 17 nt, Homo sapiens
agucccugccaucaugu

SEQ ID NO: 1339264 - RNA, 12 nt, Homo sapiens
aguccucugaau

SEQ ID NO: 1339265 - RNA, 18 nt, Homo sapiens
aguccuuaggcuacugua

SEQ ID NO: 1339266 - RNA, 16 nt, Homo sapiens
agucucaggaaaucaa

SEQ ID NO: 1339267 - RNA, 22 nt, Homo sapiens
agucucuacccaguagaugcca

SEQ ID NO: 1339268 - RNA, 23 nt, Homo sapiens
agucugguaauaaaugugacuca

SEQ ID NO: 1339269 - RNA, 17 nt, Homo sapiens
aucaugaugaugauaau

SEQ ID NO: 1339270 - RNA, 17 nt, Homo sapiens
aucauuuuaagugcaug

SEQ ID NO: 1339271 - RNA, 19 nt, Homo sapiens
auccaaaaagcucugaaaa

SEQ ID NO: 1339272 - RNA, 23 nt, Homo sapiens
auccaagcaaaacuuuacuuuca

SEQ ID NO: 1339273 - RNA, 16 nt, Homo sapiens
auccaccccaccccau

SEQ ID NO: 1339274 - RNA, 20 nt, Homo sapiens
auccacuacauucugaaggc

SEQ ID NO: 1339275 - RNA, 15 nt, Homo sapiens
auccacuuacauaua

SEQ ID NO: 1339276 - RNA, 21 nt, Homo sapiens
auccaggaauauaugucagug

SEQ ID NO: 1339277 - RNA, 22 nt, Homo sapiens
auccauagcaccuccacauacc

SEQ ID NO: 1339278 - RNA, 20 nt, Homo sapiens
auccaugcaccuaccuuaga

SEQ ID NO: 1339279 - RNA, 15 nt, Homo sapiens
auccaugcugugcug

SEQ ID NO: 1339280 - RNA, 15 nt, Homo sapiens
auccauuucaggacu

SEQ ID NO: 1339281 - RNA, 23 nt, Homo sapiens
auccauuuccaaaccuccacugc

SEQ ID NO: 1339282 - RNA, 20 nt, Homo sapiens
aucccaccaaccuccagugu

SEQ ID NO: 1339283 - RNA, 16 nt, Homo sapiens
aucccagcuaccucaa

SEQ ID NO: 1339284 - RNA, 16 nt, Homo sapiens
auccccuucugcaauc

SEQ ID NO: 1339285 - RNA, 14 nt, Homo sapiens
aucccuacauguau

SEQ ID NO: 1339286 - RNA, 14 nt, Homo sapiens
aucccucaccugua

SEQ ID NO: 1339287 - RNA, 15 nt, Homo sapiens
aucccucaccuguag

SEQ ID NO: 1339288 - RNA, 20 nt, Homo sapiens
aucccugccacgcuguggcc

SEQ ID NO: 1339289 - RNA, 13 nt, Homo sapiens
aucccuuccccag

SEQ ID NO: 1339290 - RNA, 19 nt, Homo sapiens
aucccuuuuuuuacauuuc

SEQ ID NO: 1339291 - RNA, 13 nt, Homo sapiens
auccuagcacuuu

SEQ ID NO: 1339292 - RNA, 15 nt, Homo sapiens
auccuagucauucuu

SEQ ID NO: 1339293 - RNA, 21 nt, Homo sapiens
auccucuugccaaaucaaaag

SEQ ID NO: 1339294 - RNA, 17 nt, Homo sapiens
auccugguuucgugugc

SEQ ID NO: 1339295 - RNA, 18 nt, Homo sapiens
auccuuaacacauucaau

SEQ ID NO: 1339296 - RNA, 18 nt, Homo sapiens
auccuucuuucuaguuca

SEQ ID NO: 1339297 - RNA, 17 nt, Homo sapiens
auccuugauuacuucca

SEQ ID NO: 1339298 - RNA, 17 nt, Homo sapiens
auccuuugccucaagga

SEQ ID NO: 1339299 - RNA, 22 nt, Homo sapiens
aucgaggagcuagaacauucca

SEQ ID NO: 1339300 - RNA, 14 nt, Homo sapiens
aucuaagugauaua

SEQ ID NO: 1339301 - RNA, 16 nt, Homo sapiens
aucuaguugucaauaa

SEQ ID NO: 1339302 - RNA, 17 nt, Homo sapiens
aucuaguugucaauaaa

SEQ ID NO: 1339303 - RNA, 22 nt, Homo sapiens
aucuauagcuaaguacacaaua

SEQ ID NO: 1339304 - RNA, 14 nt, Homo sapiens
aucucaaaacugca

SEQ ID NO: 1339305 - RNA, 18 nt, Homo sapiens
aucucagggaacugaccc

SEQ ID NO: 1339306 - RNA, 22 nt, Homo sapiens
aucucauuuuacacaaagggaa

SEQ ID NO: 1339307 - RNA, 18 nt, Homo sapiens
aucuccaagaccagagau

SEQ ID NO: 1339308 - RNA, 21 nt, Homo sapiens
aucuccccucacacuuugcca

SEQ ID NO: 1339309 - RNA, 19 nt, Homo sapiens
aucucccuuuguuggaaag

SEQ ID NO: 1339310 - RNA, 16 nt, Homo sapiens
aucucuauaacagauc

SEQ ID NO: 1339311 - RNA, 17 nt, Homo sapiens
aucucugaggccucaga

SEQ ID NO: 1339312 - RNA, 14 nt, Homo sapiens
aucucuucuggugu

SEQ ID NO: 1339313 - RNA, 22 nt, Homo sapiens
aucucuugccugcuccaucuca

SEQ ID NO: 1339314 - RNA, 23 nt, Homo sapiens
aucucuugccugcuccaucucau

SEQ ID NO: 1339315 - RNA, 16 nt, Homo sapiens
aucugaaaggccagca

SEQ ID NO: 1339316 - RNA, 14 nt, Homo sapiens
aucugagaggcucu

SEQ ID NO: 1339317 - RNA, 14 nt, Homo sapiens
aucugcgugcacuu

SEQ ID NO: 1339318 - RNA, 14 nt, Homo sapiens
aucugcuuaucagu

SEQ ID NO: 1339319 - RNA, 14 nt, Homo sapiens
aucuggaacccaga

SEQ ID NO: 1339320 - RNA, 19 nt, Homo sapiens
aucuggaacccagacucag

SEQ ID NO: 1339321 - RNA, 15 nt, Homo sapiens
aucuggaaccucagc

SEQ ID NO: 1339322 - RNA, 16 nt, Homo sapiens
aucuguuugaacacuu

SEQ ID NO: 1339323 - RNA, 22 nt, Homo sapiens
aucuuaaacauaauaaaucaca

SEQ ID NO: 1339324 - RNA, 19 nt, Homo sapiens
aucuuagguaagacauaua

SEQ ID NO: 1339325 - RNA, 13 nt, Homo sapiens
aucuuaguguuca

SEQ ID NO: 1339326 - RNA, 21 nt, Homo sapiens
aucuuccaccucaccucuuug

SEQ ID NO: 1339327 - RNA, 22 nt, Homo sapiens
aucuugagccacagucacugga

SEQ ID NO: 1339328 - RNA, 23 nt, Homo sapiens
aucuugcauccaaaccuguaacc

SEQ ID NO: 1339329 - RNA, 14 nt, Homo sapiens
aucuugcucugcau

SEQ ID NO: 1339330 - RNA, 14 nt, Homo sapiens
aucuuuaagaauag

SEQ ID NO: 1339331 - RNA, 17 nt, Homo sapiens
aucuuucaccuuucuag

SEQ ID NO: 1339332 - RNA, 19 nt, Homo sapiens
aucuuuccuaggcagauca

SEQ ID NO: 1339333 - RNA, 16 nt, Homo sapiens
aucuuucuccuugaau

SEQ ID NO: 1339334 - RNA, 17 nt, Homo sapiens
aucuuucuuuccaaaac

SEQ ID NO: 1339335 - RNA, 22 nt, Homo sapiens
augaaaauaacugaaccaaauu

SEQ ID NO: 1339336 - RNA, 16 nt, Homo sapiens
augaaaauuaggauuu

SEQ ID NO: 1339337 - RNA, 21 nt, Homo sapiens
augaaacaaucuuccaaagaa

SEQ ID NO: 1339338 - RNA, 18 nt, Homo sapiens
augaaacauccuaugaaa

SEQ ID NO: 1339339 - RNA, 16 nt, Homo sapiens
augaaacauuuuguca

SEQ ID NO: 1339340 - RNA, 11 nt, Homo sapiens
augaaacuggu

SEQ ID NO: 1339341 - RNA, 12 nt, Homo sapiens
augaaaggcagg

SEQ ID NO: 1339342 - RNA, 23 nt, Homo sapiens
augaaauacuuuauagcacaugg

SEQ ID NO: 1339343 - RNA, 23 nt, Homo sapiens
augaaccugcccugcucccacag

SEQ ID NO: 1339344 - RNA, 22 nt, Homo sapiens
augaacgaauuaauuaccuggc

SEQ ID NO: 1339345 - RNA, 22 nt, Homo sapiens
augaacuugcacuuguuauauu

SEQ ID NO: 1339346 - RNA, 18 nt, Homo sapiens
augaagaaucugcucuga

SEQ ID NO: 1339347 - RNA, 16 nt, Homo sapiens
augaagacagaggcag

SEQ ID NO: 1339348 - RNA, 12 nt, Homo sapiens
augaagcaagaa

SEQ ID NO: 1339349 - RNA, 22 nt, Homo sapiens
augaagguaacuagaaagugag

SEQ ID NO: 1339350 - RNA, 22 nt, Homo sapiens
augaagguuuguuccuuuguua

SEQ ID NO: 1339351 - RNA, 21 nt, Homo sapiens
augaauauauuuaagcaacau

SEQ ID NO: 1339352 - RNA, 22 nt, Homo sapiens
augaaucaaucaauucauaucu

SEQ ID NO: 1339353 - RNA, 14 nt, Homo sapiens
augaaugcccagug

SEQ ID NO: 1339354 - RNA, 18 nt, Homo sapiens
augacaaaaaaaauuaag

SEQ ID NO: 1339355 - RNA, 18 nt, Homo sapiens
augacaaaagauacaaaa

SEQ ID NO: 1339356 - RNA, 15 nt, Homo sapiens
augacauaagugcua

SEQ ID NO: 1339357 - RNA, 18 nt, Homo sapiens
augacauaucacauguca

SEQ ID NO: 1339358 - RNA, 15 nt, Homo sapiens
augaccaugcugaua

SEQ ID NO: 1339359 - RNA, 20 nt, Homo sapiens
augacgguguuaauuuugcu

SEQ ID NO: 1339360 - RNA, 18 nt, Homo sapiens
augagacauccagcagau

SEQ ID NO: 1339361 - RNA, 20 nt, Homo sapiens
augagacugggcaucucuga

SEQ ID NO: 1339362 - RNA, 18 nt, Homo sapiens
augagagggaugaggcaa

SEQ ID NO: 1339363 - RNA, 18 nt, Homo sapiens
augagcacccauuccaaa

SEQ ID NO: 1339364 - RNA, 16 nt, Homo sapiens
augagccacugugcuu

SEQ ID NO: 1339365 - RNA, 18 nt, Homo sapiens
augaggaaggacuugacu

SEQ ID NO: 1339366 - RNA, 16 nt, Homo sapiens
augaggcuguugucuu

SEQ ID NO: 1339367 - RNA, 15 nt, Homo sapiens
augagggaagcaaua

SEQ ID NO: 1339368 - RNA, 23 nt, Homo sapiens
augaggucuguuuaaaguggcaa

SEQ ID NO: 1339369 - RNA, 24 nt, Homo sapiens
augaggucuguuuaaaguggcaau

SEQ ID NO: 1339370 - RNA, 13 nt, Homo sapiens
augagucauuugu

SEQ ID NO: 1339371 - RNA, 15 nt, Homo sapiens
augauacugucucuc

SEQ ID NO: 1339372 - RNA, 19 nt, Homo sapiens
augauagcaaauggccuca

SEQ ID NO: 1339373 - RNA, 20 nt, Homo sapiens
augauagcaaauggccucau

SEQ ID NO: 1339374 - RNA, 16 nt, Homo sapiens
augaugagaagcagaa

SEQ ID NO: 1339375 - RNA, 11 nt, Homo sapiens
augaugaucuc

SEQ ID NO: 1339376 - RNA, 19 nt, Homo sapiens
augaugaucuuuaaaauac

SEQ ID NO: 1339377 - RNA, 14 nt, Homo sapiens
augaugcacaguau

SEQ ID NO: 1339378 - RNA, 16 nt, Homo sapiens
augauggcaacagauc

SEQ ID NO: 1339379 - RNA, 19 nt, Homo sapiens
augauuucaugcuaucucu

SEQ ID NO: 1339380 - RNA, 22 nt, Homo sapiens
augauuuuacucauauguggaa

SEQ ID NO: 1339381 - RNA, 15 nt, Homo sapiens
augcaaauacaauca

SEQ ID NO: 1339382 - RNA, 23 nt, Homo sapiens
augcaaauacaaucagcccagug

SEQ ID NO: 1339383 - RNA, 15 nt, Homo sapiens
augcaacucuaacuc

SEQ ID NO: 1339384 - RNA, 15 nt, Homo sapiens
augcaaggucuugca

SEQ ID NO: 1339385 - RNA, 16 nt, Homo sapiens
augcaaugacucagga

SEQ ID NO: 1339386 - RNA, 18 nt, Homo sapiens
augcaccccugagccagc

SEQ ID NO: 1339387 - RNA, 16 nt, Homo sapiens
augcacuaaaaguagu

SEQ ID NO: 1339388 - RNA, 21 nt, Homo sapiens
augcauggugccccaggacca

SEQ ID NO: 1339389 - RNA, 11 nt, Homo sapiens
augccaaaaaa

SEQ ID NO: 1339390 - RNA, 23 nt, Homo sapiens
augccaaaaggauaaaugucuuu

SEQ ID NO: 1339391 - RNA, 20 nt, Homo sapiens
augccaauaaaguuugccca

SEQ ID NO: 1339392 - RNA, 21 nt, Homo sapiens
augccaauaaaguuugcccau

SEQ ID NO: 1339393 - RNA, 23 nt, Homo sapiens
augccacaaggacuuccugucca

SEQ ID NO: 1339394 - RNA, 19 nt, Homo sapiens
augccagccacugugauag

SEQ ID NO: 1339395 - RNA, 16 nt, Homo sapiens
augccaguaacugugc

SEQ ID NO: 1339396 - RNA, 20 nt, Homo sapiens
augccaguaacugugcugua

SEQ ID NO: 1339397 - RNA, 17 nt, Homo sapiens
augcccaguaaaauuuc

SEQ ID NO: 1339398 - RNA, 21 nt, Homo sapiens
augcccaguaaaauuucagga

SEQ ID NO: 1339399 - RNA, 22 nt, Homo sapiens
augugcaauaacucagcaguua

SEQ ID NO: 1339400 - RNA, 16 nt, Homo sapiens
augugcacugccugca

SEQ ID NO: 1339401 - RNA, 10 nt, Homo sapiens
augugccuuu

SEQ ID NO: 1339402 - RNA, 16 nt, Homo sapiens
augugcugagcauuuu

SEQ ID NO: 1339403 - RNA, 17 nt, Homo sapiens
auguggccuuuagcaaa

SEQ ID NO: 1339404 - RNA, 21 nt, Homo sapiens
augugggggucuguguguuua

SEQ ID NO: 1339405 - RNA, 23 nt, Homo sapiens
augugggguugcugaagaugccu

SEQ ID NO: 1339406 - RNA, 19 nt, Homo sapiens
augugucauuggaagccau

SEQ ID NO: 1339407 - RNA, 21 nt, Homo sapiens
augugucuuuacaccucgcug

SEQ ID NO: 1339408 - RNA, 19 nt, Homo sapiens
auguuaauauugugcaaac

SEQ ID NO: 1339409 - RNA, 22 nt, Homo sapiens
auguuaguauuuuaauccugua

SEQ ID NO: 1339410 - RNA, 17 nt, Homo sapiens
auguuccgagaagaaca

SEQ ID NO: 1339411 - RNA, 21 nt, Homo sapiens
auguucucugaaugagccuuu

SEQ ID NO: 1339412 - RNA, 21 nt, Homo sapiens
auguugaagggaaguucagca

SEQ ID NO: 1339413 - RNA, 16 nt, Homo sapiens
auguuguaaugcugca

SEQ ID NO: 1339414 - RNA, 14 nt, Homo sapiens
auguuugcauuucc

SEQ ID NO: 1339415 - RNA, 20 nt, Homo sapiens
auuaaaccaaggagucugau

SEQ ID NO: 1339416 - RNA, 14 nt, Homo sapiens
auuaaaugugucau

SEQ ID NO: 1339417 - RNA, 13 nt, Homo sapiens
auuaaauuuggcu

SEQ ID NO: 1339418 - RNA, 12 nt, Homo sapiens
auuaacaaugac

SEQ ID NO: 1339419 - RNA, 15 nt, Homo sapiens
auuaacuuauacugu

SEQ ID NO: 1339420 - RNA, 24 nt, Homo sapiens
auuaaggccuuuuccacacgcauu

SEQ ID NO: 1339421 - RNA, 17 nt, Homo sapiens
auuaaguacaugugcca

SEQ ID NO: 1339422 - RNA, 21 nt, Homo sapiens
auuaaucaaaccacuguuauu

SEQ ID NO: 1339423 - RNA, 14 nt, Homo sapiens
auuacagaucugca

SEQ ID NO: 1339424 - RNA, 13 nt, Homo sapiens
auuacuaucauaa

SEQ ID NO: 1339425 - RNA, 16 nt, Homo sapiens
auuacuaucauaauuc

SEQ ID NO: 1339426 - RNA, 14 nt, Homo sapiens
auuacucaguuuau

SEQ ID NO: 1339427 - RNA, 18 nt, Homo sapiens
auuagaacuucaagcucu

SEQ ID NO: 1339428 - RNA, 15 nt, Homo sapiens
auuagaaucugagua

SEQ ID NO: 1339429 - RNA, 22 nt, Homo sapiens
auuagauuuggaggcuaccuca

SEQ ID NO: 1339430 - RNA, 17 nt, Homo sapiens
auuagccgggcauggug

SEQ ID NO: 1339431 - RNA, 20 nt, Homo sapiens
auuagccgggcaugguggca

SEQ ID NO: 1339432 - RNA, 18 nt, Homo sapiens
auuaggcuguaacuacuu

SEQ ID NO: 1339433 - RNA, 17 nt, Homo sapiens
auuauaaacaaccuaga

SEQ ID NO: 1339434 - RNA, 13 nt, Homo sapiens
auuauacaaucuc

SEQ ID NO: 1339435 - RNA, 13 nt, Homo sapiens
auuaucucacuua

SEQ ID NO: 1339436 - RNA, 13 nt, Homo sapiens
auuaugcuuuuaa

SEQ ID NO: 1339437 - RNA, 14 nt, Homo sapiens
auuauuauguucuu

SEQ ID NO: 1339438 - RNA, 21 nt, Homo sapiens
auuauucccauucuacauacu

SEQ ID NO: 1339439 - RNA, 16 nt, Homo sapiens
auuauuggacagucuc

SEQ ID NO: 1339440 - RNA, 20 nt, Homo sapiens
auuauugucaaagaagucau

SEQ ID NO: 1339441 - RNA, 19 nt, Homo sapiens
auuauuuagucaacauaua

SEQ ID NO: 1339442 - RNA, 16 nt, Homo sapiens
auuauuuuccagauaa

SEQ ID NO: 1339443 - RNA, 18 nt, Homo sapiens
auuauuuuucacugcccc

SEQ ID NO: 1339444 - RNA, 16 nt, Homo sapiens
auucaaaaauuaucua

SEQ ID NO: 1339445 - RNA, 23 nt, Homo sapiens
auucaaucuuuggaggcuuuuaa

SEQ ID NO: 1339446 - RNA, 13 nt, Homo sapiens
auucacagcaagu

SEQ ID NO: 1339447 - RNA, 18 nt, Homo sapiens
auucacagcaagucacug

SEQ ID NO: 1339448 - RNA, 14 nt, Homo sapiens
auucacagugcucu

SEQ ID NO: 1339449 - RNA, 16 nt, Homo sapiens
auucacauaucugcuu

SEQ ID NO: 1339450 - RNA, 16 nt, Homo sapiens
auucaccgugaaauag

SEQ ID NO: 1339451 - RNA, 13 nt, Homo sapiens
auucaccugugga

SEQ ID NO: 1339452 - RNA, 15 nt, Homo sapiens
auucaccuguggaug

SEQ ID NO: 1339453 - RNA, 16 nt, Homo sapiens
auucacuaaggacuua

SEQ ID NO: 1339454 - RNA, 23 nt, Homo sapiens
auucagacuugauuuacaauuua

SEQ ID NO: 1339455 - RNA, 18 nt, Homo sapiens
auucauaccuugauggua

SEQ ID NO: 1339456 - RNA, 13 nt, Homo sapiens
auucaugcacugu

SEQ ID NO: 1339457 - RNA, 22 nt, Homo sapiens
auucaugugggcauuucuugcg

SEQ ID NO: 1339458 - RNA, 19 nt, Homo sapiens
auucauucuggaggggcag

SEQ ID NO: 1339459 - RNA, 14 nt, Homo sapiens
auuccaaguucuca

SEQ ID NO: 1339460 - RNA, 23 nt, Homo sapiens
auuccacacccucacugcuguag

SEQ ID NO: 1339461 - RNA, 23 nt, Homo sapiens
auuccaccccagcaggacaguga

SEQ ID NO: 1339462 - RNA, 16 nt, Homo sapiens
auuccaccuucccaug

SEQ ID NO: 1339463 - RNA, 21 nt, Homo sapiens
auuccacuauuugcagaggcu

SEQ ID NO: 1339464 - RNA, 13 nt, Homo sapiens
auuccacugaaaa

SEQ ID NO: 1339465 - RNA, 12 nt, Homo sapiens
auuccaucuuac

SEQ ID NO: 1339466 - RNA, 17 nt, Homo sapiens
auucccaacgugcaaag

SEQ ID NO: 1339467 - RNA, 21 nt, Homo sapiens
auucccaucauacacuuccuu

SEQ ID NO: 1339468 - RNA, 21 nt, Homo sapiens
auuccccuguagcagucacug

SEQ ID NO: 1339469 - RNA, 22 nt, Homo sapiens
auuccugccuuuaagccaaaga

SEQ ID NO: 1339470 - RNA, 22 nt, Homo sapiens
auuccugcuggccccuucuggg

SEQ ID NO: 1339471 - RNA, 19 nt, Homo sapiens
auuccuuuuucuucacuua

SEQ ID NO: 1339472 - RNA, 15 nt, Homo sapiens
auucggauuugccau

SEQ ID NO: 1339473 - RNA, 22 nt, Homo sapiens
auucguacauaauaaguuucau

SEQ ID NO: 1339474 - RNA, 16 nt, Homo sapiens
auucuaacuaaugaca

SEQ ID NO: 1339475 - RNA, 13 nt, Homo sapiens
ccucuuugcuuug

SEQ ID NO: 1339476 - RNA, 18 nt, Homo sapiens
ccucuuugugauaauucu

SEQ ID NO: 1339477 - RNA, 20 nt, Homo sapiens
ccucuuuguuucugcuucau

SEQ ID NO: 1339478 - RNA, 21 nt, Homo sapiens
ccugaaacaacuuggaaagau

SEQ ID NO: 1339479 - RNA, 18 nt, Homo sapiens
ccugaaagccacagacaa

SEQ ID NO: 1339480 - RNA, 17 nt, Homo sapiens
ccugaaauuccaaugaa

SEQ ID NO: 1339481 - RNA, 19 nt, Homo sapiens
ccugaacuuucucccucau

SEQ ID NO: 1339482 - RNA, 12 nt, Homo sapiens
ccugaagaacca

SEQ ID NO: 1339483 - RNA, 15 nt, Homo sapiens
ccugaagugaccuca

SEQ ID NO: 1339484 - RNA, 20 nt, Homo sapiens
ccugaauaaaguaaugccuc

SEQ ID NO: 1339485 - RNA, 18 nt, Homo sapiens
ccugacagaaggacucag

SEQ ID NO: 1339486 - RNA, 20 nt, Homo sapiens
ccugacagggccagugcagu

SEQ ID NO: 1339487 - RNA, 17 nt, Homo sapiens
ccugaccaacaggccca

SEQ ID NO: 1339488 - RNA, 17 nt, Homo sapiens
ccugacccuacuucuuu

SEQ ID NO: 1339489 - RNA, 15 nt, Homo sapiens
ccugaccuccgcccc

SEQ ID NO: 1339490 - RNA, 14 nt, Homo sapiens
ccugacuggccaaa

SEQ ID NO: 1339491 - RNA, 12 nt, Homo sapiens
ccugacuguaua

SEQ ID NO: 1339492 - RNA, 17 nt, Homo sapiens
ccugacuuuuaauguca

SEQ ID NO: 1339493 - RNA, 15 nt, Homo sapiens
ccugaggaagaugac

SEQ ID NO: 1339494 - RNA, 16 nt, Homo sapiens
ccugcaaucccagcua

SEQ ID NO: 1339495 - RNA, 14 nt, Homo sapiens
ccugcacacuuggu

SEQ ID NO: 1339496 - RNA, 14 nt, Homo sapiens
ccugcaccaugcug

SEQ ID NO: 1339497 - RNA, 15 nt, Homo sapiens
ccugcaccaugcugc

SEQ ID NO: 1339498 - RNA, 16 nt, Homo sapiens
ccugcaccaugcugcu

SEQ ID NO: 1339499 - RNA, 16 nt, Homo sapiens
ccugcaggaccucgug

SEQ ID NO: 1339500 - RNA, 15 nt, Homo sapiens
ccugcccaccaagaa

SEQ ID NO: 1339501 - RNA, 19 nt, Homo sapiens
ccugcccccgcucccgcuc

SEQ ID NO: 1339502 - RNA, 14 nt, Homo sapiens
ccugcuccaucuca

SEQ ID NO: 1339503 - RNA, 13 nt, Homo sapiens
ccugcugcaucuu

SEQ ID NO: 1339504 - RNA, 15 nt, Homo sapiens
ccugcuuugcaucuu

SEQ ID NO: 1339505 - RNA, 11 nt, Homo sapiens
ccuggcacaau

SEQ ID NO: 1339506 - RNA, 19 nt, Homo sapiens
ccuggcacugguuuguucc

SEQ ID NO: 1339507 - RNA, 15 nt, Homo sapiens
ccuggcagcucugga

SEQ ID NO: 1339508 - RNA, 22 nt, Homo sapiens
ccuggcccgcuaaggugaaaag

SEQ ID NO: 1339509 - RNA, 19 nt, Homo sapiens
ccuggcuuugcuuagcuug

SEQ ID NO: 1339510 - RNA, 14 nt, Homo sapiens
ccugggcaacauag

SEQ ID NO: 1339511 - RNA, 13 nt, Homo sapiens
ccugggcucugga

SEQ ID NO: 1339512 - RNA, 20 nt, Homo sapiens
ccuggggcaggucacuuuac

SEQ ID NO: 1339513 - RNA, 14 nt, Homo sapiens
ccuggggugcaucu

SEQ ID NO: 1339514 - RNA, 20 nt, Homo sapiens
ccugggguguccuacaguga

SEQ ID NO: 1339515 - RNA, 22 nt, Homo sapiens
ccugggugacauuugggagaca

SEQ ID NO: 1339516 - RNA, 21 nt, Homo sapiens
ccugggugaucugcugcugag

SEQ ID NO: 1339517 - RNA, 13 nt, Homo sapiens
ccuggugacuccu

SEQ ID NO: 1339518 - RNA, 12 nt, Homo sapiens
ccuguaacacau

SEQ ID NO: 1339519 - RNA, 20 nt, Homo sapiens
ccuguaacccuggcacuuaa

SEQ ID NO: 1339520 - RNA, 22 nt, Homo sapiens
ccuguacccaguagaugccacc

SEQ ID NO: 1339521 - RNA, 15 nt, Homo sapiens
ccuguaccucagugg

SEQ ID NO: 1339522 - RNA, 17 nt, Homo sapiens
ccuguagcagccagucc

SEQ ID NO: 1339523 - RNA, 19 nt, Homo sapiens
ccuguccugaaagccacag

SEQ ID NO: 1339524 - RNA, 17 nt, Homo sapiens
ccugucuccagcugccu

SEQ ID NO: 1339525 - RNA, 19 nt, Homo sapiens
ccugugcccuagaugcacg

SEQ ID NO: 1339526 - RNA, 15 nt, Homo sapiens
ccugugccuuuugcc

SEQ ID NO: 1339527 - RNA, 18 nt, Homo sapiens
ccuguggccaacugcaaa

SEQ ID NO: 1339528 - RNA, 17 nt, Homo sapiens
ccuguggcuaauggagg

SEQ ID NO: 1339529 - RNA, 22 nt, Homo sapiens
ccuguggguuugguccuugaac

SEQ ID NO: 1339530 - RNA, 15 nt, Homo sapiens
cuaaaagcacacuca

SEQ ID NO: 1339531 - RNA, 14 nt, Homo sapiens
cuaaaauguucuaa

SEQ ID NO: 1339532 - RNA, 22 nt, Homo sapiens
cuaaacuguuuauuugcacuau

SEQ ID NO: 1339533 - RNA, 11 nt, Homo sapiens
cuaaacuuaau

SEQ ID NO: 1339534 - RNA, 20 nt, Homo sapiens
cuaaacuucaccuacauuau

SEQ ID NO: 1339535 - RNA, 14 nt, Homo sapiens
cuaaagagagccug

SEQ ID NO: 1339536 - RNA, 11 nt, Homo sapiens
cuaaagggcag

SEQ ID NO: 1339537 - RNA, 17 nt, Homo sapiens
cuaaaguauaacauguc

SEQ ID NO: 1339538 - RNA, 23 nt, Homo sapiens
cuaaagugcuugaggcuaccucu

SEQ ID NO: 1339539 - RNA, 12 nt, Homo sapiens
cuaaauccauua

SEQ ID NO: 1339540 - RNA, 16 nt, Homo sapiens
cuaaaugaugccuuug

SEQ ID NO: 1339541 - RNA, 23 nt, Homo sapiens
cuaaauggugcugcagauuugau

SEQ ID NO: 1339542 - RNA, 16 nt, Homo sapiens
cuaaauuuaaugcugc

SEQ ID NO: 1339543 - RNA, 18 nt, Homo sapiens
cuaaccaaaucucucaaa

SEQ ID NO: 1339544 - RNA, 22 nt, Homo sapiens
cuaaccucuaccagcacauuaa

SEQ ID NO: 1339545 - RNA, 13 nt, Homo sapiens
cuaaccugugacc

SEQ ID NO: 1339546 - RNA, 20 nt, Homo sapiens
cuaacuggcaggggagacag

SEQ ID NO: 1339547 - RNA, 19 nt, Homo sapiens
cuaacugguuaaacauuaa

SEQ ID NO: 1339548 - RNA, 20 nt, Homo sapiens
cuaagaagaaggccagagag

SEQ ID NO: 1339549 - RNA, 23 nt, Homo sapiens
cuaagaugugcagcauuucacuu

SEQ ID NO: 1339550 - RNA, 19 nt, Homo sapiens
cuaagcaaccacacugcuu

SEQ ID NO: 1339551 - RNA, 17 nt, Homo sapiens
cuaagcccccacuacaa

SEQ ID NO: 1339552 - RNA, 16 nt, Homo sapiens
cuaagcgcacauucau

SEQ ID NO: 1339553 - RNA, 20 nt, Homo sapiens
cuaagcugccgguucuuaaa

SEQ ID NO: 1339554 - RNA, 23 nt, Homo sapiens
cuaaggggcccggccagccaugu

SEQ ID NO: 1339555 - RNA, 17 nt, Homo sapiens
cuaagguuaucuacuuu

SEQ ID NO: 1339556 - RNA, 15 nt, Homo sapiens
cuaaguacacaauaa

SEQ ID NO: 1339557 - RNA, 20 nt, Homo sapiens
cuaaguuauuuuaugacaug

SEQ ID NO: 1339558 - RNA, 21 nt, Homo sapiens
cuaaguuauuuuaugacauga

SEQ ID NO: 1339559 - RNA, 13 nt, Homo sapiens
cuaauaccaaaau

SEQ ID NO: 1339560 - RNA, 14 nt, Homo sapiens
cuaauaccaaaauu

SEQ ID NO: 1339561 - RNA, 16 nt, Homo sapiens
cuaauaguuuuucacu

SEQ ID NO: 1339562 - RNA, 22 nt, Homo sapiens
cuaaucagcauucucacuccua

SEQ ID NO: 1339563 - RNA, 14 nt, Homo sapiens
cuaaugacagccuu

SEQ ID NO: 1339564 - RNA, 20 nt, Homo sapiens
cuaauguaccaaugaugaau

SEQ ID NO: 1339565 - RNA, 19 nt, Homo sapiens
cuaaugucucuucuaacau

SEQ ID NO: 1339566 - RNA, 16 nt, Homo sapiens
cuaaugucugcagcuc

SEQ ID NO: 1339567 - RNA, 17 nt, Homo sapiens
cuaauucacagugcucu

SEQ ID NO: 1339568 - RNA, 23 nt, Homo sapiens
cuacaaacucccacuugucaugu

SEQ ID NO: 1339569 - RNA, 20 nt, Homo sapiens
cuacaagugauccucaggca

SEQ ID NO: 1339570 - RNA, 19 nt, Homo sapiens
cuacagggccacaacugcc

SEQ ID NO: 1339571 - RNA, 15 nt, Homo sapiens
cuacaguaacuguga

SEQ ID NO: 1339572 - RNA, 18 nt, Homo sapiens
cuacauaaggaugaaggu

SEQ ID NO: 1339573 - RNA, 16 nt, Homo sapiens
cuacauguauugcaca

SEQ ID NO: 1339574 - RNA, 14 nt, Homo sapiens
cuacauuaucucac

SEQ ID NO: 1339575 - RNA, 13 nt, Homo sapiens
cuacauucacuuu

SEQ ID NO: 1339576 - RNA, 16 nt, Homo sapiens
cuacauucugaaggcc

SEQ ID NO: 1339577 - RNA, 16 nt, Homo sapiens
cuaccaaauagugauu

SEQ ID NO: 1339578 - RNA, 13 nt, Homo sapiens
cuaccaagauaua

SEQ ID NO: 1339579 - RNA, 18 nt, Homo sapiens
cuaccccucaaacugcac

SEQ ID NO: 1339580 - RNA, 14 nt, Homo sapiens
cuaccuaccaagau

SEQ ID NO: 1339581 - RNA, 16 nt, Homo sapiens
cuaccucuaccuucaa

SEQ ID NO: 1339582 - RNA, 23 nt, Homo sapiens
cuaccuuuauauuugggguccuu

SEQ ID NO: 1339583 - RNA, 14 nt, Homo sapiens
cuacuauguacugc

SEQ ID NO: 1339584 - RNA, 16 nt, Homo sapiens
cuacucucuuccucca

SEQ ID NO: 1339585 - RNA, 12 nt, Homo sapiens
cuacucuuugau

SEQ ID NO: 1339586 - RNA, 17 nt, Homo sapiens
cuacugacagggagcag

SEQ ID NO: 1339587 - RNA, 19 nt, Homo sapiens
cuacugagggcaguucuga

SEQ ID NO: 1339588 - RNA, 12 nt, Homo sapiens
cuacuugcacac

SEQ ID NO: 1339589 - RNA, 16 nt, Homo sapiens
cuagaaagacagaagc

SEQ ID NO: 1339590 - RNA, 13 nt, Homo sapiens
cuagaacauucca

SEQ ID NO: 1339591 - RNA, 14 nt, Homo sapiens
cuagaagaugcagu

SEQ ID NO: 1339592 - RNA, 22 nt, Homo sapiens
cuagagagggaggcaagcccug

SEQ ID NO: 1339593 - RNA, 16 nt, Homo sapiens
cuagauccagcccaaa

SEQ ID NO: 1339594 - RNA, 13 nt, Homo sapiens
cuagaugcacgug

SEQ ID NO: 1339595 - RNA, 23 nt, Homo sapiens
cuagcaaauggcagaaccaaagc

SEQ ID NO: 1339596 - RNA, 12 nt, Homo sapiens
cuagcaguacua

SEQ ID NO: 1339597 - RNA, 13 nt, Homo sapiens
cuagccaaucaga

SEQ ID NO: 1339598 - RNA, 16 nt, Homo sapiens
cuaggaaauccauuca

SEQ ID NO: 1339599 - RNA, 16 nt, Homo sapiens
cuaggcagugacagug

SEQ ID NO: 1339600 - RNA, 18 nt, Homo sapiens
cuaggcugcccacucucc

SEQ ID NO: 1339601 - RNA, 22 nt, Homo sapiens
cuagggacaugaaauuuacaaa

SEQ ID NO: 1339602 - RNA, 21 nt, Homo sapiens
cuaggugagaacccuugcacu

SEQ ID NO: 1339603 - RNA, 22 nt, Homo sapiens
cuaggugagaacccuugcacua

SEQ ID NO: 1339604 - RNA, 14 nt, Homo sapiens
cuagucucugaggg

SEQ ID NO: 1339605 - RNA, 12 nt, Homo sapiens
cuagugccuuua

SEQ ID NO: 1339606 - RNA, 15 nt, Homo sapiens
cuaguggaaagucag

SEQ ID NO: 1339607 - RNA, 17 nt, Homo sapiens
cuaguguuauacuugau

SEQ ID NO: 1339608 - RNA, 12 nt, Homo sapiens
cuaguucagcug

SEQ ID NO: 1339609 - RNA, 20 nt, Homo sapiens
cuauaaauaguauuccaauc

SEQ ID NO: 1339610 - RNA, 21 nt, Homo sapiens
cuauaauuuaccuaagauuac

SEQ ID NO: 1339611 - RNA, 18 nt, Homo sapiens
cuauacaaaaugauuuug

SEQ ID NO: 1339612 - RNA, 11 nt, Homo sapiens
cuauacugugg

SEQ ID NO: 1339613 - RNA, 14 nt, Homo sapiens
cuauaucuuaggua

SEQ ID NO: 1339614 - RNA, 15 nt, Homo sapiens
cuauccaaucuguga

SEQ ID NO: 1339615 - RNA, 11 nt, Homo sapiens
cucagccucag

SEQ ID NO: 1339616 - RNA, 21 nt, Homo sapiens
cucagccuugccagagaucca

SEQ ID NO: 1339617 - RNA, 13 nt, Homo sapiens
cucaggacagaug

SEQ ID NO: 1339618 - RNA, 16 nt, Homo sapiens
cucaggauccagugac

SEQ ID NO: 1339619 - RNA, 23 nt, Homo sapiens
cucaggcaaagaaaaugaaaugc

SEQ ID NO: 1339620 - RNA, 19 nt, Homo sapiens
cucaggccaagggaccagg

SEQ ID NO: 1339621 - RNA, 15 nt, Homo sapiens
cucaggccacagugg

SEQ ID NO: 1339622 - RNA, 20 nt, Homo sapiens
cucagguccuuuagucuguu

SEQ ID NO: 1339623 - RNA, 15 nt, Homo sapiens
cucaguccacugcug

SEQ ID NO: 1339624 - RNA, 13 nt, Homo sapiens
cucagucuauucu

SEQ ID NO: 1339625 - RNA, 21 nt, Homo sapiens
cucagugaccagugccuguga

SEQ ID NO: 1339626 - RNA, 21 nt, Homo sapiens
cucaguugaaaaugcaacucu

SEQ ID NO: 1339627 - RNA, 16 nt, Homo sapiens
cucaguuucuaggcac

SEQ ID NO: 1339628 - RNA, 19 nt, Homo sapiens
cucauaacucugugaucuu

SEQ ID NO: 1339629 - RNA, 14 nt, Homo sapiens
cucauaauuuugca

SEQ ID NO: 1339630 - RNA, 21 nt, Homo sapiens
cucaucugggggaguggaaua

SEQ ID NO: 1339631 - RNA, 23 nt, Homo sapiens
cucauggguggcacucagucucu

SEQ ID NO: 1339632 - RNA, 17 nt, Homo sapiens
cucauuauuuuucacug

SEQ ID NO: 1339633 - RNA, 19 nt, Homo sapiens
cucauucagaagaugcuua

SEQ ID NO: 1339634 - RNA, 23 nt, Homo sapiens
cucauucccaacgugcaaagcca

SEQ ID NO: 1339635 - RNA, 17 nt, Homo sapiens
cucauuuuuguuuucau

SEQ ID NO: 1339636 - RNA, 16 nt, Homo sapiens
cuccaaaccugucuug

SEQ ID NO: 1339637 - RNA, 22 nt, Homo sapiens
cuccaaaguauuguacaaauaa

SEQ ID NO: 1339638 - RNA, 15 nt, Homo sapiens
cuccaagaauggagg

SEQ ID NO: 1339639 - RNA, 13 nt, Homo sapiens
cuccaagcuccau

SEQ ID NO: 1339640 - RNA, 20 nt, Homo sapiens
cuccaaugacugagcagcau

SEQ ID NO: 1339641 - RNA, 13 nt, Homo sapiens
cuccacauauuuc

SEQ ID NO: 1339642 - RNA, 13 nt, Homo sapiens
cuccacuccagau

SEQ ID NO: 1339643 - RNA, 16 nt, Homo sapiens
cuccagaagggcagcu

SEQ ID NO: 1339644 - RNA, 20 nt, Homo sapiens
cuccagaagggcagcuccac

SEQ ID NO: 1339645 - RNA, 23 nt, Homo sapiens
cuccagaauggucuuucuaaugu

SEQ ID NO: 1339646 - RNA, 17 nt, Homo sapiens
cuccagaggaugacugg

SEQ ID NO: 1339647 - RNA, 16 nt, Homo sapiens
cuccaguuuugccuga

SEQ ID NO: 1339648 - RNA, 22 nt, Homo sapiens
cuccauaucccuuccucucagg

SEQ ID NO: 1339649 - RNA, 16 nt, Homo sapiens
cuccauucaggauucu

SEQ ID NO: 1339650 - RNA, 14 nt, Homo sapiens
cucccaaaacauuu

SEQ ID NO: 1339651 - RNA, 15 nt, Homo sapiens
cucccaaggcucuga

SEQ ID NO: 1339652 - RNA, 20 nt, Homo sapiens
cucccagagugcugggauua

SEQ ID NO: 1339653 - RNA, 15 nt, Homo sapiens
cucccagucauuuaa

SEQ ID NO: 1339654 - RNA, 15 nt, Homo sapiens
cucccauagcaaaga

SEQ ID NO: 1339655 - RNA, 16 nt, Homo sapiens
cuccccagcccagaga

SEQ ID NO: 1339656 - RNA, 15 nt, Homo sapiens
cuccccuaaagccag

SEQ ID NO: 1339657 - RNA, 16 nt, Homo sapiens
cuccccuuucacaggu

SEQ ID NO: 1339658 - RNA, 22 nt, Homo sapiens
cuccccuuuuauaccugcucuu

SEQ ID NO: 1339659 - RNA, 17 nt, Homo sapiens
cucccuaccguccuccu

SEQ ID NO: 1339660 - RNA, 21 nt, Homo sapiens
cucccuaccuaccaagauaua

SEQ ID NO: 1339661 - RNA, 13 nt, Homo sapiens
cucccucauucca

SEQ ID NO: 1339662 - RNA, 15 nt, Homo sapiens
cucccucauuccacc

SEQ ID NO: 1339663 - RNA, 21 nt, Homo sapiens
cucccucuccagcaggcccau

SEQ ID NO: 1339664 - RNA, 15 nt, Homo sapiens
cuccgucugcuccaa

SEQ ID NO: 1339665 - RNA, 20 nt, Homo sapiens
cuccgugcuuaaccaaagaa

SEQ ID NO: 1339666 - RNA, 14 nt, Homo sapiens
cuccuacaugaugu

SEQ ID NO: 1339667 - RNA, 19 nt, Homo sapiens
cuccucccaggaacugggc

SEQ ID NO: 1339668 - RNA, 14 nt, Homo sapiens
cuccuccccuuuca

SEQ ID NO: 1339669 - RNA, 16 nt, Homo sapiens
cuccucucccagugac

SEQ ID NO: 1339670 - RNA, 14 nt, Homo sapiens
cuccucugcagcuc

SEQ ID NO: 1339671 - RNA, 14 nt, Homo sapiens
cuccucuugccacu

SEQ ID NO: 1339672 - RNA, 20 nt, Homo sapiens
cuccugaccucaaguaaucc

SEQ ID NO: 1339673 - RNA, 17 nt, Homo sapiens
cuccugagccacucaga

SEQ ID NO: 1339674 - RNA, 13 nt, Homo sapiens
cuccugcagggau

SEQ ID NO: 1339675 - RNA, 23 nt, Homo sapiens
cuccugggcauuagcaaggcaga

SEQ ID NO: 1339676 - RNA, 18 nt, Homo sapiens
cuccuucccuugcuucuu

SEQ ID NO: 1339677 - RNA, 16 nt, Homo sapiens
cuccuuggccacagac

SEQ ID NO: 1339678 - RNA, 19 nt, Homo sapiens
cuccuuggcuuuaugcaaa

SEQ ID NO: 1339679 - RNA, 20 nt, Homo sapiens
cuccuuggcuuuaugcaaau

SEQ ID NO: 1339680 - RNA, 14 nt, Homo sapiens
cuccuugucugugc

SEQ ID NO: 1339681 - RNA, 15 nt, Homo sapiens
cuccuuuaccuuuca

SEQ ID NO: 1339682 - RNA, 21 nt, Homo sapiens
cucgcaagggaaguccuugca

SEQ ID NO: 1339683 - RNA, 17 nt, Homo sapiens
cucggcacacacugugc

SEQ ID NO: 1339684 - RNA, 22 nt, Homo sapiens
cucgguucaaaaccuugcacag

SEQ ID NO: 1339685 - RNA, 17 nt, Homo sapiens
cucgucagccaccuggg

SEQ ID NO: 1339686 - RNA, 15 nt, Homo sapiens
cucgugggucccaga

SEQ ID NO: 1339687 - RNA, 14 nt, Homo sapiens
cucguggugaggcu

SEQ ID NO: 1339688 - RNA, 13 nt, Homo sapiens
cucuaaagagcau

SEQ ID NO: 1339689 - RNA, 17 nt, Homo sapiens
cucuaaagccaagcacu

SEQ ID NO: 1339690 - RNA, 19 nt, Homo sapiens
cucuaaugcuugauuuagg

SEQ ID NO: 1339691 - RNA, 19 nt, Homo sapiens
cucuaauucggauuugcca

SEQ ID NO: 1339692 - RNA, 17 nt, Homo sapiens
cucuaccugcacacugu

SEQ ID NO: 1339693 - RNA, 18 nt, Homo sapiens
cucuacuaaaacauacaa

SEQ ID NO: 1339694 - RNA, 23 nt, Homo sapiens
cucuagcugggggugggccaggc

SEQ ID NO: 1339695 - RNA, 22 nt, Homo sapiens
cucuaggcccugugagcacaaa

SEQ ID NO: 1339696 - RNA, 15 nt, Homo sapiens
cucuauaacagaucc

SEQ ID NO: 1339697 - RNA, 22 nt, Homo sapiens
cucuauacaaaaugauuuugaa

SEQ ID NO: 1339698 - RNA, 13 nt, Homo sapiens
cucuauacugugg

SEQ ID NO: 1339699 - RNA, 14 nt, Homo sapiens
cucuauagagccaa

SEQ ID NO: 1339700 - RNA, 24 nt, Homo sapiens
cucuaugaccucgcccuccacaaa

SEQ ID NO: 1339701 - RNA, 17 nt, Homo sapiens
cucuauugauacucuuu

SEQ ID NO: 1339702 - RNA, 21 nt, Homo sapiens
cucucagaggccugcugccag

SEQ ID NO: 1339703 - RNA, 19 nt, Homo sapiens
cucucauauaagacaaaua

SEQ ID NO: 1339704 - RNA, 12 nt, Homo sapiens
cucuccagugaa

SEQ ID NO: 1339705 - RNA, 21 nt, Homo sapiens
cucucccugggucuggggaca

SEQ ID NO: 1339706 - RNA, 14 nt, Homo sapiens
cucuccucuugcca

SEQ ID NO: 1339707 - RNA, 11 nt, Homo sapiens
cucucucauga

SEQ ID NO: 1339708 - RNA, 10 nt, Homo sapiens
cucucugagg

SEQ ID NO: 1339709 - RNA, 23 nt, Homo sapiens
cucucugagucaaauccaguggu

SEQ ID NO: 1339710 - RNA, 19 nt, Homo sapiens
cucucuggaaaggauuuuc

SEQ ID NO: 1339711 - RNA, 15 nt, Homo sapiens
cucucuucucuccag

SEQ ID NO: 1339712 - RNA, 14 nt, Homo sapiens
cucucuuuaacccu

SEQ ID NO: 1339713 - RNA, 20 nt, Homo sapiens
cucugaaccccucccuccau

SEQ ID NO: 1339714 - RNA, 22 nt, Homo sapiens
cucugacaacugugaagccacc

SEQ ID NO: 1339715 - RNA, 15 nt, Homo sapiens
cucugacaguccaca

SEQ ID NO: 1339716 - RNA, 18 nt, Homo sapiens
cucugacaguccacaggg

SEQ ID NO: 1339717 - RNA, 22 nt, Homo sapiens
cucugacaguccacaggggcca

SEQ ID NO: 1339718 - RNA, 14 nt, Homo sapiens
cucugcacagacaa

SEQ ID NO: 1339719 - RNA, 20 nt, Homo sapiens
cucugcaggccuaggugcag

SEQ ID NO: 1339720 - RNA, 22 nt, Homo sapiens
cucugcaguaaaacacauuugg

SEQ ID NO: 1339721 - RNA, 17 nt, Homo sapiens
cucugccuccucuucaa

SEQ ID NO: 1339722 - RNA, 22 nt, Homo sapiens
cucugccuuaaacacacauugc

SEQ ID NO: 1339723 - RNA, 19 nt, Homo sapiens
cucuggaggucaucuggcg

SEQ ID NO: 1339724 - RNA, 16 nt, Homo sapiens
cucuggcuggggagca

SEQ ID NO: 1339725 - RNA, 16 nt, Homo sapiens
cucugggucugaguca

SEQ ID NO: 1339726 - RNA, 13 nt, Homo sapiens
cucugggucuugg

SEQ ID NO: 1339727 - RNA, 15 nt, Homo sapiens
cucugggucuuggcc

SEQ ID NO: 1339728 - RNA, 15 nt, Homo sapiens
cucuguaaacuucca

SEQ ID NO: 1339729 - RNA, 11 nt, Homo sapiens
cucuguauacu

SEQ ID NO: 1339730 - RNA, 23 nt, Homo sapiens
cucugucuugggcguuugaacuc

SEQ ID NO: 1339731 - RNA, 17 nt, Homo sapiens
cucuuauccaacaucaa

SEQ ID NO: 1339732 - RNA, 16 nt, Homo sapiens
cucuucaaucucuugc

SEQ ID NO: 1339733 - RNA, 13 nt, Homo sapiens
cucuucacagucc

SEQ ID NO: 1339734 - RNA, 15 nt, Homo sapiens
cucuucagugacucc

SEQ ID NO: 1339735 - RNA, 17 nt, Homo sapiens
cucuucccugaccuccc

SEQ ID NO: 1339736 - RNA, 11 nt, Homo sapiens
cucuuccucau

SEQ ID NO: 1339737 - RNA, 22 nt, Homo sapiens
cucuugagcuggcggugucauc

SEQ ID NO: 1339738 - RNA, 21 nt, Homo sapiens
cucuugaguuccucugcaguu

SEQ ID NO: 1339739 - RNA, 13 nt, Homo sapiens
cucuugcacucaa

SEQ ID NO: 1339740 - RNA, 20 nt, Homo sapiens
cucuugccaaaucaaaagac

SEQ ID NO: 1339741 - RNA, 21 nt, Homo sapiens
cucuuguccucuucugcucuu

SEQ ID NO: 1339742 - RNA, 14 nt, Homo sapiens
cucuuuaguguucu

SEQ ID NO: 1339743 - RNA, 15 nt, Homo sapiens
cucuuucccaacccc

SEQ ID NO: 1339744 - RNA, 14 nt, Homo sapiens
cugaaaaagacaua

SEQ ID NO: 1339745 - RNA, 14 nt, Homo sapiens
cugaaaaccucucc

SEQ ID NO: 1339746 - RNA, 16 nt, Homo sapiens
gaugcugauacuucua

SEQ ID NO: 1339747 - RNA, 20 nt, Homo sapiens
gaugcugccccucaucucuc

SEQ ID NO: 1339748 - RNA, 15 nt, Homo sapiens
gaugcuuuggcaaug

SEQ ID NO: 1339749 - RNA, 21 nt, Homo sapiens
gauggaacaagagaaguacua

SEQ ID NO: 1339750 - RNA, 11 nt, Homo sapiens
gauggagacac

SEQ ID NO: 1339751 - RNA, 12 nt, Homo sapiens
gaugggcaaagc

SEQ ID NO: 1339752 - RNA, 20 nt, Homo sapiens
gaugguggcccugaaccuca

SEQ ID NO: 1339753 - RNA, 20 nt, Homo sapiens
gauguaccagcaucucccag

SEQ ID NO: 1339754 - RNA, 17 nt, Homo sapiens
gaugucugggugaccuc

SEQ ID NO: 1339755 - RNA, 17 nt, Homo sapiens
gauuacagaaacugaug

SEQ ID NO: 1339756 - RNA, 16 nt, Homo sapiens
gauuacguuuacauuc

SEQ ID NO: 1339757 - RNA, 20 nt, Homo sapiens
gauuacuccuccauuacucu

SEQ ID NO: 1339758 - RNA, 16 nt, Homo sapiens
gauuacucuccauauc

SEQ ID NO: 1339759 - RNA, 20 nt, Homo sapiens
gauucaacacuuaagucuca

SEQ ID NO: 1339760 - RNA, 12 nt, Homo sapiens
gauucagcaaaa

SEQ ID NO: 1339761 - RNA, 15 nt, Homo sapiens
gauucaggggucuga

SEQ ID NO: 1339762 - RNA, 20 nt, Homo sapiens
gauucccugauggaaccaua

SEQ ID NO: 1339763 - RNA, 17 nt, Homo sapiens
gauucuucacuguguuu

SEQ ID NO: 1339764 - RNA, 12 nt, Homo sapiens
gauugggguccc

SEQ ID NO: 1339765 - RNA, 16 nt, Homo sapiens
gauugguaagagccaa

SEQ ID NO: 1339766 - RNA, 20 nt, Homo sapiens
gauuguagauaacacugacu

SEQ ID NO: 1339767 - RNA, 12 nt, Homo sapiens
gauuuacauaua

SEQ ID NO: 1339768 - RNA, 14 nt, Homo sapiens
gauuuccuugacuu

SEQ ID NO: 1339769 - RNA, 23 nt, Homo sapiens
gauuucuuucuuugcaccaaaga

SEQ ID NO: 1339770 - RNA, 15 nt, Homo sapiens
gauuuuaccaaagca

SEQ ID NO: 1339771 - RNA, 19 nt, Homo sapiens
gauuuuaccaaagcaucaa

SEQ ID NO: 1339772 - RNA, 20 nt, Homo sapiens
gauuuuuuucccaauugaga

SEQ ID NO: 1339773 - RNA, 13 nt, Homo sapiens
gcaaaaaaagccu

SEQ ID NO: 1339774 - RNA, 16 nt, Homo sapiens
gcaaaacuuuacuuuc

SEQ ID NO: 1339775 - RNA, 21 nt, Homo sapiens
gcaaaaggaucuuuguggcca

SEQ ID NO: 1339776 - RNA, 12 nt, Homo sapiens
gcaaacguuucu

SEQ ID NO: 1339777 - RNA, 18 nt, Homo sapiens
gcaaauaaagaccugaga

SEQ ID NO: 1339778 - RNA, 21 nt, Homo sapiens
gcaaauacaaucagcccagug

SEQ ID NO: 1339779 - RNA, 17 nt, Homo sapiens
gcaaaucagaaaaccca

SEQ ID NO: 1339780 - RNA, 19 nt, Homo sapiens
gcaaauggcagaaccaaag

SEQ ID NO: 1339781 - RNA, 16 nt, Homo sapiens
gcaaauggccaaugag

SEQ ID NO: 1339782 - RNA, 23 nt, Homo sapiens
gcaacuaggaaaaucacuugcca

SEQ ID NO: 1339783 - RNA, 23 nt, Homo sapiens
gcaacugugaauucauucuggag

SEQ ID NO: 1339784 - RNA, 15 nt, Homo sapiens
gcaagaaaugaacuu

SEQ ID NO: 1339785 - RNA, 16 nt, Homo sapiens
gcaagucaaauaccac

SEQ ID NO: 1339786 - RNA, 18 nt, Homo sapiens
gcaagucaaauaccacau

SEQ ID NO: 1339787 - RNA, 19 nt, Homo sapiens
gcaauaaaagacaaaugca

SEQ ID NO: 1339788 - RNA, 20 nt, Homo sapiens
gcaauaaaagacaaaugcaa

SEQ ID NO: 1339789 - RNA, 19 nt, Homo sapiens
gcaauaaaucugacccagu

SEQ ID NO: 1339790 - RNA, 21 nt, Homo sapiens
gcaauaaaucugacccagugc

SEQ ID NO: 1339791 - RNA, 19 nt, Homo sapiens
gcaauaacaguaguguuac

SEQ ID NO: 1339792 - RNA, 18 nt, Homo sapiens
gcaauaacucagcaguua

SEQ ID NO: 1339793 - RNA, 16 nt, Homo sapiens
gcaaugacucaaaguc

SEQ ID NO: 1339794 - RNA, 20 nt, Homo sapiens
gcaaugacucaggacauccc

SEQ ID NO: 1339795 - RNA, 21 nt, Homo sapiens
gcaaugucucuuugugcucua

SEQ ID NO: 1339796 - RNA, 18 nt, Homo sapiens
gcaauucuccugccuuag

SEQ ID NO: 1339797 - RNA, 14 nt, Homo sapiens
gcaauugacuguca

SEQ ID NO: 1339798 - RNA, 20 nt, Homo sapiens
gcacaagacuggcccagugc

SEQ ID NO: 1339799 - RNA, 19 nt, Homo sapiens
gcacacagcugagcacuua

SEQ ID NO: 1339800 - RNA, 19 nt, Homo sapiens
gcacacagggcaguccuua

SEQ ID NO: 1339801 - RNA, 17 nt, Homo sapiens
gcacacccgugugcaca

SEQ ID NO: 1339802 - RNA, 19 nt, Homo sapiens
gcacaguggcucaugccug

SEQ ID NO: 1339803 - RNA, 11 nt, Homo sapiens
gcaccaaagac

SEQ ID NO: 1339804 - RNA, 21 nt, Homo sapiens
gcaccaaccacagcaucggga

SEQ ID NO: 1339805 - RNA, 10 nt, Homo sapiens
gcaccaccuc

SEQ ID NO: 1339806 - RNA, 17 nt, Homo sapiens
gcaccagacacccagga

SEQ ID NO: 1339807 - RNA, 14 nt, Homo sapiens
gcaccaggggccaa

SEQ ID NO: 1339808 - RNA, 12 nt, Homo sapiens
gcaccaucucac

SEQ ID NO: 1339809 - RNA, 14 nt, Homo sapiens
gcaccaugcugcug

SEQ ID NO: 1339810 - RNA, 14 nt, Homo sapiens
gcaccauuuuguca

SEQ ID NO: 1339811 - RNA, 17 nt, Homo sapiens
gcaccccccaagcuguu

SEQ ID NO: 1339812 - RNA, 17 nt, Homo sapiens
gcacccugcccaccaag

SEQ ID NO: 1339813 - RNA, 18 nt, Homo sapiens
gcacccugcccaccaaga

SEQ ID NO: 1339814 - RNA, 21 nt, Homo sapiens
gcaccuaauccaggcagaucc

SEQ ID NO: 1339815 - RNA, 21 nt, Homo sapiens
gcaccucacaggccccaggaa

SEQ ID NO: 1339816 - RNA, 16 nt, Homo sapiens
gcaccuggauguacua

SEQ ID NO: 1339817 - RNA, 23 nt, Homo sapiens
gcacguccuugggcgucucuaau

SEQ ID NO: 1339818 - RNA, 18 nt, Homo sapiens
gcacucaaagcuuguuaa

SEQ ID NO: 1339819 - RNA, 17 nt, Homo sapiens
gcacugaggaccagcca

SEQ ID NO: 1339820 - RNA, 15 nt, Homo sapiens
gcacuggugggccau

SEQ ID NO: 1339821 - RNA, 20 nt, Homo sapiens
gcacuuugggaggccaagga

SEQ ID NO: 1339822 - RNA, 17 nt, Homo sapiens
gcagaaccaaagcucaa

SEQ ID NO: 1339823 - RNA, 16 nt, Homo sapiens
gcagaaccuucuuugg

SEQ ID NO: 1339824 - RNA, 16 nt, Homo sapiens
gcagacccagucccac

SEQ ID NO: 1339825 - RNA, 14 nt, Homo sapiens
gcagagaaccaaag

SEQ ID NO: 1339826 - RNA, 24 nt, Homo sapiens
gcagagcgaucucggcucacugca

SEQ ID NO: 1339827 - RNA, 21 nt, Homo sapiens
gcagaggcguacuacccagcu

SEQ ID NO: 1339828 - RNA, 12 nt, Homo sapiens
gcagcacucccc

SEQ ID NO: 1339829 - RNA, 14 nt, Homo sapiens
gcagcaggcagcuu

SEQ ID NO: 1339830 - RNA, 23 nt, Homo sapiens
gcagcaucccuagucucuaccca

SEQ ID NO: 1339831 - RNA, 16 nt, Homo sapiens
gcagcaucucuggccu

SEQ ID NO: 1339832 - RNA, 22 nt, Homo sapiens
gcagcaugcuugggcugaccca

SEQ ID NO: 1339833 - RNA, 13 nt, Homo sapiens
gcagcauuuacua

SEQ ID NO: 1339834 - RNA, 16 nt, Homo sapiens
gcagcgccagugacag

SEQ ID NO: 1339835 - RNA, 14 nt, Homo sapiens
gcagcucuggaggg

SEQ ID NO: 1339836 - RNA, 13 nt, Homo sapiens
gcagcucugugac

SEQ ID NO: 1339837 - RNA, 15 nt, Homo sapiens
gcaggaagggagaac

SEQ ID NO: 1339838 - RNA, 18 nt, Homo sapiens
gcaggagaaucacuugaa

SEQ ID NO: 1339839 - RNA, 16 nt, Homo sapiens
gcaggagucucugcca

SEQ ID NO: 1339840 - RNA, 15 nt, Homo sapiens
gcaggccagggcagu

SEQ ID NO: 1339841 - RNA, 16 nt, Homo sapiens
gcaggcccaugggagg

SEQ ID NO: 1339842 - RNA, 18 nt, Homo sapiens
gcaggcccccaggugcca

SEQ ID NO: 1339843 - RNA, 15 nt, Homo sapiens
gcaggcuacugucag

SEQ ID NO: 1339844 - RNA, 18 nt, Homo sapiens
gcagggaaggacaggacc

SEQ ID NO: 1339845 - RNA, 17 nt, Homo sapiens
gcagggaugauggcaga

SEQ ID NO: 1339846 - RNA, 15 nt, Homo sapiens
gcagggcuggcacgu

SEQ ID NO: 1339847 - RNA, 21 nt, Homo sapiens
gcaggggagacaggagccuag

SEQ ID NO: 1339848 - RNA, 17 nt, Homo sapiens
gcagguaguuagcuuca

SEQ ID NO: 1339849 - RNA, 19 nt, Homo sapiens
gcagguguucuucauuacc

SEQ ID NO: 1339850 - RNA, 17 nt, Homo sapiens
gcaguccauuuccuaau

SEQ ID NO: 1339851 - RNA, 15 nt, Homo sapiens
gcagucccacacugu

SEQ ID NO: 1339852 - RNA, 14 nt, Homo sapiens
gcaguccucaggaa

SEQ ID NO: 1339853 - RNA, 22 nt, Homo sapiens
gcagucgaguuucuacguggug

SEQ ID NO: 1339854 - RNA, 13 nt, Homo sapiens
gcagucuggcuga

SEQ ID NO: 1339855 - RNA, 22 nt, Homo sapiens
gcagugcaauauuuagcugcua

SEQ ID NO: 1339856 - RNA, 15 nt, Homo sapiens
gcagugcuaaagccu

SEQ ID NO: 1339857 - RNA, 22 nt, Homo sapiens
gcaguguuccuugugcccgugg

SEQ ID NO: 1339858 - RNA, 21 nt, Homo sapiens
gcaguguuucccucuguguua

SEQ ID NO: 1339859 - RNA, 23 nt, Homo sapiens
gcaguuacucccuacacugaugc

SEQ ID NO: 1339860 - RNA, 17 nt, Homo sapiens
gcaguuuccucagugau

SEQ ID NO: 1339861 - RNA, 18 nt, Homo sapiens
gcaguuuccucagugaug

SEQ ID NO: 1339862 - RNA, 21 nt, Homo sapiens
gcaguuugcuuuguaugcacu

SEQ ID NO: 1339863 - RNA, 23 nt, Homo sapiens
gcauaaaguaaauacaugcauau

SEQ ID NO: 1339864 - RNA, 13 nt, Homo sapiens
gcauaaccugucu

SEQ ID NO: 1339865 - RNA, 17 nt, Homo sapiens
gcauacccacacaaaua

SEQ ID NO: 1339866 - RNA, 17 nt, Homo sapiens
gcauacugccuuguuua

SEQ ID NO: 1339867 - RNA, 19 nt, Homo sapiens
gcauacugccuuguuuaau

SEQ ID NO: 1339868 - RNA, 16 nt, Homo sapiens
gcauacuuucccucau

SEQ ID NO: 1339869 - RNA, 21 nt, Homo sapiens
gcaucaauuuuucuuauuuca

SEQ ID NO: 1339870 - RNA, 23 nt, Homo sapiens
gcaucagcugcugaaacaacaaa

SEQ ID NO: 1339871 - RNA, 13 nt, Homo sapiens
gcaucauuacugu

SEQ ID NO: 1339872 - RNA, 23 nt, Homo sapiens
gcauccagugugagauacugugu

SEQ ID NO: 1339873 - RNA, 17 nt, Homo sapiens
gcaucgcuccucuccag

SEQ ID NO: 1339874 - RNA, 17 nt, Homo sapiens
gcaucucccaguucaua

SEQ ID NO: 1339875 - RNA, 15 nt, Homo sapiens
gcaucucugagcaau

SEQ ID NO: 1339876 - RNA, 15 nt, Homo sapiens
gcaucugaccagcag

SEQ ID NO: 1339877 - RNA, 17 nt, Homo sapiens
gcaucuucccacagugg

SEQ ID NO: 1339878 - RNA, 18 nt, Homo sapiens
gcaugaauaaaacacuca

SEQ ID NO: 1339879 - RNA, 13 nt, Homo sapiens
gcaugauagacac

SEQ ID NO: 1339880 - RNA, 22 nt, Homo sapiens
gcaugcuuuaaaaaacacaguc

SEQ ID NO: 1339881 - RNA, 17 nt, Homo sapiens
gccaagaauacuugaag

SEQ ID NO: 1339882 - RNA, 16 nt, Homo sapiens
gccaaggagcugcuau

SEQ ID NO: 1339883 - RNA, 17 nt, Homo sapiens
gccaaggagcugcuaua

SEQ ID NO: 1339884 - RNA, 21 nt, Homo sapiens
gccaaggcagcgaccccagga

SEQ ID NO: 1339885 - RNA, 11 nt, Homo sapiens
gccaaucucaa

SEQ ID NO: 1339886 - RNA, 14 nt, Homo sapiens
gccacaaaccugcc

SEQ ID NO: 1339887 - RNA, 21 nt, Homo sapiens
gccacagaggacucacuugcc

SEQ ID NO: 1339888 - RNA, 19 nt, Homo sapiens
gccacucagagcucccuca

SEQ ID NO: 1339889 - RNA, 23 nt, Homo sapiens
gccacugagaagugcacuuuaag

SEQ ID NO: 1339890 - RNA, 18 nt, Homo sapiens
gccagacuggcacaguuu

SEQ ID NO: 1339891 - RNA, 15 nt, Homo sapiens
gccagagaaagcaaa

SEQ ID NO: 1339892 - RNA, 19 nt, Homo sapiens
gccagcagggcaucuugga

SEQ ID NO: 1339893 - RNA, 14 nt, Homo sapiens
gccagccucagaag

SEQ ID NO: 1339894 - RNA, 21 nt, Homo sapiens
gccagcucaccccaucauccc

SEQ ID NO: 1339895 - RNA, 14 nt, Homo sapiens
gccaggcaccacag

SEQ ID NO: 1339896 - RNA, 20 nt, Homo sapiens
gccaggccuuacaucuggcu

SEQ ID NO: 1339897 - RNA, 13 nt, Homo sapiens
gccagguccuugc

SEQ ID NO: 1339898 - RNA, 22 nt, Homo sapiens
gccagguuuugucccugcucgu

SEQ ID NO: 1339899 - RNA, 15 nt, Homo sapiens
gccagugagaucaau

SEQ ID NO: 1339900 - RNA, 17 nt, Homo sapiens
gccagugagcugugauc

SEQ ID NO: 1339901 - RNA, 22 nt, Homo sapiens
gccagugcacauuuggaauuga

SEQ ID NO: 1339902 - RNA, 11 nt, Homo sapiens
gccagugcacc

SEQ ID NO: 1339903 - RNA, 14 nt, Homo sapiens
gccauaggguccug

SEQ ID NO: 1339904 - RNA, 15 nt, Homo sapiens
gccauaggugcaguu

SEQ ID NO: 1339905 - RNA, 16 nt, Homo sapiens
gccauccccaccuuca

SEQ ID NO: 1339906 - RNA, 20 nt, Homo sapiens
gccaucgccgggacuccaga

SEQ ID NO: 1339907 - RNA, 16 nt, Homo sapiens
gccaucucuuccucau

SEQ ID NO: 1339908 - RNA, 22 nt, Homo sapiens
gccaugauguauauccauauaa

SEQ ID NO: 1339909 - RNA, 15 nt, Homo sapiens
gccaugcugggccac

SEQ ID NO: 1339910 - RNA, 20 nt, Homo sapiens
gccauguauaaaugugauau

SEQ ID NO: 1339911 - RNA, 23 nt, Homo sapiens
gccauugaucauaaacugacuau

SEQ ID NO: 1339912 - RNA, 14 nt, Homo sapiens
gcccaaaccuggga

SEQ ID NO: 1339913 - RNA, 13 nt, Homo sapiens
gcccaagcucacc

SEQ ID NO: 1339914 - RNA, 19 nt, Homo sapiens
gcccacuguccugggccug

SEQ ID NO: 1339915 - RNA, 16 nt, Homo sapiens
gcccagccucaucucu

SEQ ID NO: 1339916 - RNA, 21 nt, Homo sapiens
gcccagccuccaagcuccauc

SEQ ID NO: 1339917 - RNA, 13 nt, Homo sapiens
gcccagccuggga

SEQ ID NO: 1339918 - RNA, 17 nt, Homo sapiens
gcccaggauuauuguca

SEQ ID NO: 1339919 - RNA, 13 nt, Homo sapiens
gcccaggcagcua

SEQ ID NO: 1339920 - RNA, 21 nt, Homo sapiens
gcccauccccaggcaccucac

SEQ ID NO: 1339921 - RNA, 22 nt, Homo sapiens
gcccauuaggucuggcaugccc

SEQ ID NO: 1339922 - RNA, 22 nt, Homo sapiens
gcccauugucuuauuggcacau

SEQ ID NO: 1339923 - RNA, 19 nt, Homo sapiens
gccccaccccagguccugc

SEQ ID NO: 1339924 - RNA, 16 nt, Homo sapiens
gccccagacacagugc

SEQ ID NO: 1339925 - RNA, 18 nt, Homo sapiens
gccccagccagggcucaa

SEQ ID NO: 1339926 - RNA, 15 nt, Homo sapiens
gccccaggaccagcu

SEQ ID NO: 1339927 - RNA, 20 nt, Homo sapiens
gccccagugcgguuccucau

SEQ ID NO: 1339928 - RNA, 15 nt, Homo sapiens
gcccccuccugcaag

SEQ ID NO: 1339929 - RNA, 19 nt, Homo sapiens
gcccccuccuugucugugc

SEQ ID NO: 1339930 - RNA, 21 nt, Homo sapiens
gcccccugggcuggggccuca

SEQ ID NO: 1339931 - RNA, 13 nt, Homo sapiens
gccccuacugugg

SEQ ID NO: 1339932 - RNA, 15 nt, Homo sapiens
gccccuuccauggua

SEQ ID NO: 1339933 - RNA, 22 nt, Homo sapiens
gccccuucuggggguggugggc

SEQ ID NO: 1339934 - RNA, 20 nt, Homo sapiens
gcccuaaaagcacacucauc

SEQ ID NO: 1339935 - RNA, 22 nt, Homo sapiens
gcccuaacuccuauaaagugcc

SEQ ID NO: 1339936 - RNA, 20 nt, Homo sapiens
gcccuagcccugcuccaacu

SEQ ID NO: 1339937 - RNA, 22 nt, Homo sapiens
gcccuagcccugcuccaacucc

SEQ ID NO: 1339938 - RNA, 14 nt, Homo sapiens
gcccuauugcugcu

SEQ ID NO: 1339939 - RNA, 11 nt, Homo sapiens
gcccucaggag

SEQ ID NO: 1339940 - RNA, 16 nt, Homo sapiens
gcccucaggcaccugc

SEQ ID NO: 1339941 - RNA, 22 nt, Homo sapiens
gcccucccuaccuaccaagaua

SEQ ID NO: 1339942 - RNA, 14 nt, Homo sapiens
gcccucucucggga

SEQ ID NO: 1339943 - RNA, 13 nt, Homo sapiens
gcccugaugcucu

SEQ ID NO: 1339944 - RNA, 21 nt, Homo sapiens
gcccugcgccaccucacugca

SEQ ID NO: 1339945 - RNA, 14 nt, Homo sapiens
gcccuggccaggac

SEQ ID NO: 1339946 - RNA, 23 nt, Homo sapiens
gcccugggcuccucuuagcucag

SEQ ID NO: 1339947 - RNA, 19 nt, Homo sapiens
gcccuguaacaggcuugaa

SEQ ID NO: 1339948 - RNA, 16 nt, Homo sapiens
gcccugugagcacaaa

SEQ ID NO: 1339949 - RNA, 20 nt, Homo sapiens
gcccuucuauacccacccag

SEQ ID NO: 1339950 - RNA, 15 nt, Homo sapiens
gccgagugcacugca

SEQ ID NO: 1339951 - RNA, 18 nt, Homo sapiens
gccgaguggucacuguca

SEQ ID NO: 1339952 - RNA, 12 nt, Homo sapiens
gccgccaugcuu

SEQ ID NO: 1339953 - RNA, 15 nt, Homo sapiens
gccgcugucucugag

SEQ ID NO: 1339954 - RNA, 15 nt, Homo sapiens
gccgcuuucucugag

SEQ ID NO: 1339955 - RNA, 20 nt, Homo sapiens
gccgggcaggguguggggcc

SEQ ID NO: 1339956 - RNA, 18 nt, Homo sapiens
gccguuuccccuccuugg

SEQ ID NO: 1339957 - RNA, 13 nt, Homo sapiens
gccuaaccuggga

SEQ ID NO: 1339958 - RNA, 19 nt, Homo sapiens
gccuaagaagaaggccaga

SEQ ID NO: 1339959 - RNA, 19 nt, Homo sapiens
gccuaccaaugccaaaagg

SEQ ID NO: 1339960 - RNA, 22 nt, Homo sapiens
gccuagauaugaagaaucugcu

SEQ ID NO: 1339961 - RNA, 13 nt, Homo sapiens
gccucaaggacuu

SEQ ID NO: 1339962 - RNA, 23 nt, Homo sapiens
gccucagccucccaaagugcugg

SEQ ID NO: 1339963 - RNA, 21 nt, Homo sapiens
gccucagggacgacucugacc

SEQ ID NO: 1339964 - RNA, 16 nt, Homo sapiens
gccuccaagcuccauc

SEQ ID NO: 1339965 - RNA, 23 nt, Homo sapiens
gccuccacaugcugccuggcaca

SEQ ID NO: 1339966 - RNA, 15 nt, Homo sapiens
gccuccccagcucac

SEQ ID NO: 1339967 - RNA, 17 nt, Homo sapiens
gccuccccaugggcaca

SEQ ID NO: 1339968 - RNA, 20 nt, Homo sapiens
gccuccuggcuucacgccau

SEQ ID NO: 1339969 - RNA, 21 nt, Homo sapiens
gccuccuuuccccucccucag

SEQ ID NO: 1339970 - RNA, 17 nt, Homo sapiens
gccucgcagccuccgga

SEQ ID NO: 1339971 - RNA, 15 nt, Homo sapiens
gccucgguaucuggc

SEQ ID NO: 1339972 - RNA, 19 nt, Homo sapiens
gccucuuccucccucauuc

SEQ ID NO: 1339973 - RNA, 17 nt, Homo sapiens
gccugacucagugacca

SEQ ID NO: 1339974 - RNA, 14 nt, Homo sapiens
gccugaggcuguaa

SEQ ID NO: 1339975 - RNA, 21 nt, Homo sapiens
gccugcuucuucucuccacau

SEQ ID NO: 1339976 - RNA, 20 nt, Homo sapiens
gccuggagacaaggugcuaa

SEQ ID NO: 1339977 - RNA, 14 nt, Homo sapiens
gccuggaggcuccu

SEQ ID NO: 1339978 - RNA, 13 nt, Homo sapiens
gccuggcacagac

SEQ ID NO: 1339979 - RNA, 20 nt, Homo sapiens
gccuggcagccgugccuuca

SEQ ID NO: 1339980 - RNA, 16 nt, Homo sapiens
gccugggcugguugga

SEQ ID NO: 1339981 - RNA, 15 nt, Homo sapiens
gccuguaacaaugua

SEQ ID NO: 1339982 - RNA, 22 nt, Homo sapiens
gccuguaaucucagcacuuugg

SEQ ID NO: 1339983 - RNA, 13 nt, Homo sapiens
gccuguaguccca

SEQ ID NO: 1339984 - RNA, 16 nt, Homo sapiens
gccugucugaagccaa

SEQ ID NO: 1339985 - RNA, 14 nt, Homo sapiens
gccugucuucagag

SEQ ID NO: 1339986 - RNA, 12 nt, Homo sapiens
gccugugccuuu

SEQ ID NO: 1339987 - RNA, 22 nt, Homo sapiens
gccuguggguuugguccuugaa

SEQ ID NO: 1339988 - RNA, 18 nt, Homo sapiens
gccuguguacugccuuaa

SEQ ID NO: 1339989 - RNA, 18 nt, Homo sapiens
gccuuacuucaaagugcc

SEQ ID NO: 1339990 - RNA, 10 nt, Homo sapiens
gccuuauauu

SEQ ID NO: 1339991 - RNA, 13 nt, Homo sapiens
gccuuauccaggu

SEQ ID NO: 1339992 - RNA, 13 nt, Homo sapiens
gccuucaccaagc

SEQ ID NO: 1339993 - RNA, 18 nt, Homo sapiens
gccuucuacugcucuccu

SEQ ID NO: 1339994 - RNA, 19 nt, Homo sapiens
gccuucuagcacacuuuuu

SEQ ID NO: 1339995 - RNA, 14 nt, Homo sapiens
gccuuguaccucaa

SEQ ID NO: 1339996 - RNA, 14 nt, Homo sapiens
gccuuguuuaaugu

SEQ ID NO: 1339997 - RNA, 20 nt, Homo sapiens
gccuuuauauccaaaauaaa

SEQ ID NO: 1339998 - RNA, 15 nt, Homo sapiens
gccuuuaucucugag

SEQ ID NO: 1339999 - RNA, 15 nt, Homo sapiens
gccuuuguuucccau

SEQ ID NO: 1340000 - RNA, 15 nt, Homo sapiens
gccuuuucacugugu

SEQ ID NO: 1340001 - RNA, 20 nt, Homo sapiens
gccuuuuccacacgcauuaa

SEQ ID NO: 1340002 - RNA, 15 nt, Homo sapiens
gccuuuuguuuucau

SEQ ID NO: 1340003 - RNA, 15 nt, Homo sapiens
cuuuuaccuguuauu

SEQ ID NO: 1340004 - RNA, 21 nt, Homo sapiens
cuuuuaucaaucccagcauuu

SEQ ID NO: 1340005 - RNA, 23 nt, Homo sapiens
cuuuucacugcuggcugccuuag

SEQ ID NO: 1340006 - RNA, 14 nt, Homo sapiens
cuuuucccauuuca

SEQ ID NO: 1340007 - RNA, 12 nt, Homo sapiens
cuuuuccuuuga

SEQ ID NO: 1340008 - RNA, 18 nt, Homo sapiens
cuuuucuaaaaucuaaaa

SEQ ID NO: 1340009 - RNA, 21 nt, Homo sapiens
cuuuucuccucacuguaucca

SEQ ID NO: 1340010 - RNA, 14 nt, Homo sapiens
cuuuucuuugccau

SEQ ID NO: 1340011 - RNA, 22 nt, Homo sapiens
cuuuugaacacguucgacaaaa

SEQ ID NO: 1340012 - RNA, 10 nt, Homo sapiens
cuuuugccac

SEQ ID NO: 1340013 - RNA, 18 nt, Homo sapiens
cuuuugcuaauaccaaaa

SEQ ID NO: 1340014 - RNA, 16 nt, Homo sapiens
cuuuugcuugaauuua

SEQ ID NO: 1340015 - RNA, 13 nt, Homo sapiens
cuuuuggguauuu

SEQ ID NO: 1340016 - RNA, 21 nt, Homo sapiens
cuuuugucuaauuaaaacacu

SEQ ID NO: 1340017 - RNA, 23 nt, Homo sapiens
cuuuugugaauuaggcuguaacu

SEQ ID NO: 1340018 - RNA, 18 nt, Homo sapiens
cuuuuuaaccugcaaaau

SEQ ID NO: 1340019 - RNA, 15 nt, Homo sapiens
cuuuuuauguuauau

SEQ ID NO: 1340020 - RNA, 13 nt, Homo sapiens
cuuuuucaaaaau

SEQ ID NO: 1340021 - RNA, 20 nt, Homo sapiens
cuuuuuccuggcucaucucu

SEQ ID NO: 1340022 - RNA, 19 nt, Homo sapiens
cuuuuucuagggucccuga

SEQ ID NO: 1340023 - RNA, 18 nt, Homo sapiens
cuuuuugaggcaaaagaa

SEQ ID NO: 1340024 - RNA, 17 nt, Homo sapiens
cuuuuuuucuguaccag

SEQ ID NO: 1340025 - RNA, 18 nt, Homo sapiens
cuuuuuuucuuguaugca

SEQ ID NO: 1340026 - RNA, 19 nt, Homo sapiens
gaaaaaucuaagugauaua

SEQ ID NO: 1340027 - RNA, 19 nt, Homo sapiens
gaaaacagggucugggaca

SEQ ID NO: 1340028 - RNA, 17 nt, Homo sapiens
gaaaacauaacugauac

SEQ ID NO: 1340029 - RNA, 14 nt, Homo sapiens
gaaaagaaaccugg

SEQ ID NO: 1340030 - RNA, 16 nt, Homo sapiens
gaaaagauucuucuua

SEQ ID NO: 1340031 - RNA, 19 nt, Homo sapiens
gaaaagcaguggcuccauu

SEQ ID NO: 1340032 - RNA, 14 nt, Homo sapiens
gaaaaggugaagcu

SEQ ID NO: 1340033 - RNA, 14 nt, Homo sapiens
gaaaauaaacauca

SEQ ID NO: 1340034 - RNA, 18 nt, Homo sapiens
gaaaauauagacauucuc

SEQ ID NO: 1340035 - RNA, 12 nt, Homo sapiens
gaaacaacuugg

SEQ ID NO: 1340036 - RNA, 15 nt, Homo sapiens
gaaacaaucuuccaa

SEQ ID NO: 1340037 - RNA, 13 nt, Homo sapiens
gaaacccaaccuu

SEQ ID NO: 1340038 - RNA, 12 nt, Homo sapiens
gaaaccuuccac

SEQ ID NO: 1340039 - RNA, 15 nt, Homo sapiens
gaaacucuacccuga

SEQ ID NO: 1340040 - RNA, 21 nt, Homo sapiens
gaaagagagaagccagccaca

SEQ ID NO: 1340041 - RNA, 20 nt, Homo sapiens
gaaagauugguaagagccaa

SEQ ID NO: 1340042 - RNA, 13 nt, Homo sapiens
gaaagcacaagac

SEQ ID NO: 1340043 - RNA, 19 nt, Homo sapiens
gaaagcauaucccaccaac

SEQ ID NO: 1340044 - RNA, 22 nt, Homo sapiens
gaaagcaucugagcuaacuuau

SEQ ID NO: 1340045 - RNA, 18 nt, Homo sapiens
gaaagccugggugacauu

SEQ ID NO: 1340046 - RNA, 19 nt, Homo sapiens
gaaagccugggugacauuu

SEQ ID NO: 1340047 - RNA, 18 nt, Homo sapiens
gaaagcuucaaacugcau

SEQ ID NO: 1340048 - RNA, 12 nt, Homo sapiens
gaaagcuuucau

SEQ ID NO: 1340049 - RNA, 19 nt, Homo sapiens
gaaagcuuucaugaccaua

SEQ ID NO: 1340050 - RNA, 15 nt, Homo sapiens
gaaaggacuguggac

SEQ ID NO: 1340051 - RNA, 17 nt, Homo sapiens
gaaaggauuuuaccaaa

SEQ ID NO: 1340052 - RNA, 19 nt, Homo sapiens
gaaagggauugcugaggca

SEQ ID NO: 1340053 - RNA, 23 nt, Homo sapiens
gaaaggggccccaccggggucua

SEQ ID NO: 1340054 - RNA, 15 nt, Homo sapiens
gaaaguaaacuguaa

SEQ ID NO: 1340055 - RNA, 17 nt, Homo sapiens
gaaaguaagugguagcu

SEQ ID NO: 1340056 - RNA, 17 nt, Homo sapiens
gaaaguauaaugcagua

SEQ ID NO: 1340057 - RNA, 14 nt, Homo sapiens
gaaagugacaugca

SEQ ID NO: 1340058 - RNA, 17 nt, Homo sapiens
gaaagugaugauacugu

SEQ ID NO: 1340059 - RNA, 15 nt, Homo sapiens
gaaaguggaaaauga

SEQ ID NO: 1340060 - RNA, 22 nt, Homo sapiens
gaaagugugaagacccaaaaca

SEQ ID NO: 1340061 - RNA, 12 nt, Homo sapiens
gaaauacuuuau

SEQ ID NO: 1340062 - RNA, 12 nt, Homo sapiens
gaaaucuuccca

SEQ ID NO: 1340063 - RNA, 17 nt, Homo sapiens
gaaaugaaaucuuccca

SEQ ID NO: 1340064 - RNA, 12 nt, Homo sapiens
gcggcucuccag

SEQ ID NO: 1340065 - RNA, 17 nt, Homo sapiens
gcgggauuuaugugcac

SEQ ID NO: 1340066 - RNA, 20 nt, Homo sapiens
gcgucaugacgugcaugaga

SEQ ID NO: 1340067 - RNA, 16 nt, Homo sapiens
gcuaacuggguuaaau

SEQ ID NO: 1340068 - RNA, 13 nt, Homo sapiens
gcuaaguacacaa

SEQ ID NO: 1340069 - RNA, 18 nt, Homo sapiens
gcuaauucucagcagaaa

SEQ ID NO: 1340070 - RNA, 21 nt, Homo sapiens
gcuacagaaaccacagucuuc

SEQ ID NO: 1340071 - RNA, 23 nt, Homo sapiens
gcuaccugcucagcccugcacca

SEQ ID NO: 1340072 - RNA, 21 nt, Homo sapiens
gcuacucaggaggcugaggca

SEQ ID NO: 1340073 - RNA, 13 nt, Homo sapiens
gcuagaacauucc

SEQ ID NO: 1340074 - RNA, 13 nt, Homo sapiens
gcuagagugcaau

SEQ ID NO: 1340075 - RNA, 11 nt, Homo sapiens
gcuaucucugu

SEQ ID NO: 1340076 - RNA, 21 nt, Homo sapiens
gcuaugaacagaaacuacauu

SEQ ID NO: 1340077 - RNA, 18 nt, Homo sapiens
gcuaugguucucucgcaa

SEQ ID NO: 1340078 - RNA, 14 nt, Homo sapiens
gcuauucaccaaua

SEQ ID NO: 1340079 - RNA, 19 nt, Homo sapiens
gcuauucuaacuaaugaca

SEQ ID NO: 1340080 - RNA, 15 nt, Homo sapiens
gcuauuguagagcca

SEQ ID NO: 1340081 - RNA, 14 nt, Homo sapiens
gcucaagcccugaa

SEQ ID NO: 1340082 - RNA, 19 nt, Homo sapiens
gcucacaaaccaugcaaau

SEQ ID NO: 1340083 - RNA, 19 nt, Homo sapiens
gcucacaaggcccaggaga

SEQ ID NO: 1340084 - RNA, 17 nt, Homo sapiens
gcucacaggagcuuaaa

SEQ ID NO: 1340085 - RNA, 20 nt, Homo sapiens
gcucagcccugcaccaugcu

SEQ ID NO: 1340086 - RNA, 17 nt, Homo sapiens
gcucaggagaagccagu

SEQ ID NO: 1340087 - RNA, 18 nt, Homo sapiens
gcucagggaaaagcagcu

SEQ ID NO: 1340088 - RNA, 20 nt, Homo sapiens
gcucauugcaagcucaagug

SEQ ID NO: 1340089 - RNA, 20 nt, Homo sapiens
gcucauuucacuauucuguu

SEQ ID NO: 1340090 - RNA, 22 nt, Homo sapiens
gcuccaacacuuugagcauuuu

SEQ ID NO: 1340091 - RNA, 13 nt, Homo sapiens
gcuccacugggau

SEQ ID NO: 1340092 - RNA, 20 nt, Homo sapiens
gcuccauugguguugacaua

SEQ ID NO: 1340093 - RNA, 14 nt, Homo sapiens
gcucccacagaaca

SEQ ID NO: 1340094 - RNA, 16 nt, Homo sapiens
gcuccccuaaagccag

SEQ ID NO: 1340095 - RNA, 17 nt, Homo sapiens
gcuccccuaaagccagg

SEQ ID NO: 1340096 - RNA, 15 nt, Homo sapiens
gcucccugcucagga

SEQ ID NO: 1340097 - RNA, 20 nt, Homo sapiens
gcuccugaccccgccaugca

SEQ ID NO: 1340098 - RNA, 12 nt, Homo sapiens
gcuccugcaaaa

SEQ ID NO: 1340099 - RNA, 14 nt, Homo sapiens
gcuccugcaucuca

SEQ ID NO: 1340100 - RNA, 21 nt, Homo sapiens
gcuccugccuggaagaauucc

SEQ ID NO: 1340101 - RNA, 20 nt, Homo sapiens
gcucuaauucacagugcucu

SEQ ID NO: 1340102 - RNA, 18 nt, Homo sapiens
gcucuccuccuaccagag

SEQ ID NO: 1340103 - RNA, 14 nt, Homo sapiens
gcucugaagaccuc

SEQ ID NO: 1340104 - RNA, 19 nt, Homo sapiens
gcucugcccccucccccau

SEQ ID NO: 1340105 - RNA, 20 nt, Homo sapiens
gcucugcgccgagccucaga

SEQ ID NO: 1340106 - RNA, 21 nt, Homo sapiens
gcucugcgccgagccucagaa

SEQ ID NO: 1340107 - RNA, 19 nt, Homo sapiens
gcucuggcaccaucagccu

SEQ ID NO: 1340108 - RNA, 13 nt, Homo sapiens
gcucuggugcuuu

SEQ ID NO: 1340109 - RNA, 20 nt, Homo sapiens
gcugaaucccgauaguacua

SEQ ID NO: 1340110 - RNA, 19 nt, Homo sapiens
gcugacacagacauccucu

SEQ ID NO: 1340111 - RNA, 20 nt, Homo sapiens
gcugaccuuucaaacccaga

SEQ ID NO: 1340112 - RNA, 12 nt, Homo sapiens
gcugagagccau

SEQ ID NO: 1340113 - RNA, 14 nt, Homo sapiens
gcugauccaugaga

SEQ ID NO: 1340114 - RNA, 21 nt, Homo sapiens
gcugaugccuguguacugccu

SEQ ID NO: 1340115 - RNA, 17 nt, Homo sapiens
gcugauugggcaccuga

SEQ ID NO: 1340116 - RNA, 19 nt, Homo sapiens
gcugcauuugccugucaug

SEQ ID NO: 1340117 - RNA, 15 nt, Homo sapiens
gcugccagcacagua

SEQ ID NO: 1340118 - RNA, 16 nt, Homo sapiens
gcugcucggcuacugg

SEQ ID NO: 1340119 - RNA, 12 nt, Homo sapiens
gcugcugccagg

SEQ ID NO: 1340120 - RNA, 17 nt, Homo sapiens
gcugcuggggaagacag

SEQ ID NO: 1340121 - RNA, 21 nt, Homo sapiens
gcugcuuugagcuacaggaca

SEQ ID NO: 1340122 - RNA, 22 nt, Homo sapiens
gcuggacgugcgcgaugccugg

SEQ ID NO: 1340123 - RNA, 23 nt, Homo sapiens
gcuggagagaacacagugcuauu

SEQ ID NO: 1340124 - RNA, 14 nt, Homo sapiens
gcuggagcuuccaa

SEQ ID NO: 1340125 - RNA, 12 nt, Homo sapiens
gcuggagugcaa

SEQ ID NO: 1340126 - RNA, 13 nt, Homo sapiens
gcuggagugcaau

SEQ ID NO: 1340127 - RNA, 20 nt, Homo sapiens
gcuggagugcaaugguguga

SEQ ID NO: 1340128 - RNA, 20 nt, Homo sapiens
gcuggagugcaguggcgcga

SEQ ID NO: 1340129 - RNA, 19 nt, Homo sapiens
gcuggaugugaguuuccac

SEQ ID NO: 1340130 - RNA, 17 nt, Homo sapiens
gcugguccugcacauga

SEQ ID NO: 1340131 - RNA, 22 nt, Homo sapiens
gcuggucucaaacuccugaccu

SEQ ID NO: 1340132 - RNA, 22 nt, Homo sapiens
gcugguguccauccagcacuga

SEQ ID NO: 1340133 - RNA, 14 nt, Homo sapiens
gcuguaacuacuuu

SEQ ID NO: 1340134 - RNA, 16 nt, Homo sapiens
gcuguacuaacccagu

SEQ ID NO: 1340135 - RNA, 17 nt, Homo sapiens
gcuguacugagcacuga

SEQ ID NO: 1340136 - RNA, 13 nt, Homo sapiens
gcuguagaugaca

SEQ ID NO: 1340137 - RNA, 14 nt, Homo sapiens
gcuguagaugacaa

SEQ ID NO: 1340138 - RNA, 19 nt, Homo sapiens
gcuguaggaauauaaccuc

SEQ ID NO: 1340139 - RNA, 16 nt, Homo sapiens
gcuguauaaagcaugu

SEQ ID NO: 1340140 - RNA, 19 nt, Homo sapiens
gcugucaaaacuacugaca

SEQ ID NO: 1340141 - RNA, 16 nt, Homo sapiens
gcugucgacuucauga

SEQ ID NO: 1340142 - RNA, 12 nt, Homo sapiens
gcugucucugag

SEQ ID NO: 1340143 - RNA, 12 nt, Homo sapiens
gcugucugcuca

SEQ ID NO: 1340144 - RNA, 15 nt, Homo sapiens
gcugugcgcuccccc

SEQ ID NO: 1340145 - RNA, 19 nt, Homo sapiens
gcuguggggaacacagcua

SEQ ID NO: 1340146 - RNA, 21 nt, Homo sapiens
gcugugguagggggugucuca

SEQ ID NO: 1340147 - RNA, 16 nt, Homo sapiens
gcuguguacaauguga

SEQ ID NO: 1340148 - RNA, 21 nt, Homo sapiens
gcuguuuugauuuguacugaa

SEQ ID NO: 1340149 - RNA, 22 nt, Homo sapiens
gcuuaaaauccaaagugucaua

SEQ ID NO: 1340150 - RNA, 21 nt, Homo sapiens
gcuuaauuauugauguuuuca

SEQ ID NO: 1340151 - RNA, 19 nt, Homo sapiens
gcuuacauuugaacuugau

SEQ ID NO: 1340152 - RNA, 15 nt, Homo sapiens
gcuuaccugaucuca

SEQ ID NO: 1340153 - RNA, 18 nt, Homo sapiens
gcuuaccugggcacaaac

SEQ ID NO: 1340154 - RNA, 14 nt, Homo sapiens
gcuuagaacaaagg

SEQ ID NO: 1340155 - RNA, 15 nt, Homo sapiens
gcuuagagacuauca

SEQ ID NO: 1340156 - RNA, 21 nt, Homo sapiens
gcuucaaaaagccacagcaga

SEQ ID NO: 1340157 - RNA, 23 nt, Homo sapiens
gcuucagaguguuaauuuaugaa

SEQ ID NO: 1340158 - RNA, 22 nt, Homo sapiens
gcuucuccugugugauugacag

SEQ ID NO: 1340159 - RNA, 12 nt, Homo sapiens
gcuucuccuucu

SEQ ID NO: 1340160 - RNA, 17 nt, Homo sapiens
gcuucuucacaggcacu

SEQ ID NO: 1340161 - RNA, 23 nt, Homo sapiens
gcuugacuuuccagaaugaccuu

SEQ ID NO: 1340162 - RNA, 15 nt, Homo sapiens
gcuugcaagauucca

SEQ ID NO: 1340163 - RNA, 16 nt, Homo sapiens
gcuugcaccacuuccg

SEQ ID NO: 1340164 - RNA, 23 nt, Homo sapiens
gcuuguaauaaauacugcagcuu

SEQ ID NO: 1340165 - RNA, 16 nt, Homo sapiens
gcuuguggcagccuga

SEQ ID NO: 1340166 - RNA, 12 nt, Homo sapiens
gcuuucaugacc

SEQ ID NO: 1340167 - RNA, 20 nt, Homo sapiens
gcuuucguaguuuucauuua

SEQ ID NO: 1340168 - RNA, 23 nt, Homo sapiens
gcuuugcccaccccucacucccc

SEQ ID NO: 1340169 - RNA, 23 nt, Homo sapiens
gcuuuugcuaauaccaaaauuga

SEQ ID NO: 1340170 - RNA, 18 nt, Homo sapiens
gcuuuugugccucucaca

SEQ ID NO: 1340171 - RNA, 19 nt, Homo sapiens
gcuuuuucaaaguguugau

SEQ ID NO: 1340172 - RNA, 18 nt, Homo sapiens
gcuuuuuuaaacuugaau

SEQ ID NO: 1340173 - RNA, 22 nt, Homo sapiens
ggaaaacgaagcucauucccaa

SEQ ID NO: 1340174 - RNA, 17 nt, Homo sapiens
ggaaaccuuccacccag

SEQ ID NO: 1340175 - RNA, 23 nt, Homo sapiens
ggaaauagcccuguaacaggcuu

SEQ ID NO: 1340176 - RNA, 15 nt, Homo sapiens
ggaaaugcugacuuu

SEQ ID NO: 1340177 - RNA, 19 nt, Homo sapiens
ggaaauguaugugugucua

SEQ ID NO: 1340178 - RNA, 14 nt, Homo sapiens
ggaacccagacuca

SEQ ID NO: 1340179 - RNA, 14 nt, Homo sapiens
ggaacucagaucca

SEQ ID NO: 1340180 - RNA, 23 nt, Homo sapiens
ggaacuccagagaugagugucug

SEQ ID NO: 1340181 - RNA, 23 nt, Homo sapiens
ggaacugaaagaauaagaacuuu

SEQ ID NO: 1340182 - RNA, 20 nt, Homo sapiens
ggaagcaccuaaaugaugcc

SEQ ID NO: 1340183 - RNA, 23 nt, Homo sapiens
ggaaggagggucccgguguaucc

SEQ ID NO: 1340184 - RNA, 17 nt, Homo sapiens
ggaaggcaaaugaugcc

SEQ ID NO: 1340185 - RNA, 14 nt, Homo sapiens
ggaagguucucugu

SEQ ID NO: 1340186 - RNA, 20 nt, Homo sapiens
ggaagugacaggacuuucau

SEQ ID NO: 1340187 - RNA, 14 nt, Homo sapiens
ggaaguuugcugug

SEQ ID NO: 1340188 - RNA, 13 nt, Homo sapiens
ggaauaaagccuu

SEQ ID NO: 1340189 - RNA, 15 nt, Homo sapiens
ggaauaaagccuuuu

SEQ ID NO: 1340190 - RNA, 20 nt, Homo sapiens
auaaacgguuccuggugacu

SEQ ID NO: 1340191 - RNA, 19 nt, Homo sapiens
auaaagacaaucacugcca

SEQ ID NO: 1340192 - RNA, 11 nt, Homo sapiens
auaaagacagg

SEQ ID NO: 1340193 - RNA, 15 nt, Homo sapiens
auaaagacaggguuu

SEQ ID NO: 1340194 - RNA, 19 nt, Homo sapiens
auaaaggaaacccagcuca

SEQ ID NO: 1340195 - RNA, 14 nt, Homo sapiens
auaaaggauaaaga

SEQ ID NO: 1340196 - RNA, 18 nt, Homo sapiens
auaaaguauauguucuga

SEQ ID NO: 1340197 - RNA, 12 nt, Homo sapiens
auaaagugccuc

SEQ ID NO: 1340198 - RNA, 15 nt, Homo sapiens
auaaauaauucuucc

SEQ ID NO: 1340199 - RNA, 19 nt, Homo sapiens
auaaauauaucuaccccag

SEQ ID NO: 1340200 - RNA, 20 nt, Homo sapiens
auaaaucauucuuacuaaaa

SEQ ID NO: 1340201 - RNA, 18 nt, Homo sapiens
auaaaucugacccagugc

SEQ ID NO: 1340202 - RNA, 16 nt, Homo sapiens
auaaaugcaaccauuu

SEQ ID NO: 1340203 - RNA, 14 nt, Homo sapiens
auaaaugugacuca

SEQ ID NO: 1340204 - RNA, 15 nt, Homo sapiens
auaaauuauuuaacu

SEQ ID NO: 1340205 - RNA, 12 nt, Homo sapiens
auaaauucccaa

SEQ ID NO: 1340206 - RNA, 19 nt, Homo sapiens
auaaauucuacuaaguuau

SEQ ID NO: 1340207 - RNA, 14 nt, Homo sapiens
auaacaaacacuga

SEQ ID NO: 1340208 - RNA, 16 nt, Homo sapiens
auaacucaagaaauca

SEQ ID NO: 1340209 - RNA, 16 nt, Homo sapiens
auaacugaaccaaauu

SEQ ID NO: 1340210 - RNA, 14 nt, Homo sapiens
auaagacacucaaa

SEQ ID NO: 1340211 - RNA, 18 nt, Homo sapiens
auaagauuuaauucacau

SEQ ID NO: 1340212 - RNA, 21 nt, Homo sapiens
auaagcaaaaucagaaguaua

SEQ ID NO: 1340213 - RNA, 17 nt, Homo sapiens
auaaggaauaaagccuu

SEQ ID NO: 1340214 - RNA, 17 nt, Homo sapiens
auaagugcuauugcaga

SEQ ID NO: 1340215 - RNA, 12 nt, Homo sapiens
auaauaaaucac

SEQ ID NO: 1340216 - RNA, 12 nt, Homo sapiens
auaauaauagca

SEQ ID NO: 1340217 - RNA, 15 nt, Homo sapiens
auaauccacccccag

SEQ ID NO: 1340218 - RNA, 20 nt, Homo sapiens
auaauccaugaaagaacuua

SEQ ID NO: 1340219 - RNA, 12 nt, Homo sapiens
auaaucuuugcu

SEQ ID NO: 1340220 - RNA, 22 nt, Homo sapiens
auaauguaauguuuuuauuuca

SEQ ID NO: 1340221 - RNA, 19 nt, Homo sapiens
auaauguuaacauggacau

SEQ ID NO: 1340222 - RNA, 16 nt, Homo sapiens
auaauucauagugaua

SEQ ID NO: 1340223 - RNA, 16 nt, Homo sapiens
auaauucuacuuugag

SEQ ID NO: 1340224 - RNA, 22 nt, Homo sapiens
auacaaaaauaccuacugcuga

SEQ ID NO: 1340225 - RNA, 14 nt, Homo sapiens
auacaaaacccuuu

SEQ ID NO: 1340226 - RNA, 16 nt, Homo sapiens
auacaaucagcccagu

SEQ ID NO: 1340227 - RNA, 22 nt, Homo sapiens
auacacacacacagacauauau

SEQ ID NO: 1340228 - RNA, 13 nt, Homo sapiens
auacacuuacacu

SEQ ID NO: 1340229 - RNA, 14 nt, Homo sapiens
auacagacaucuaa

SEQ ID NO: 1340230 - RNA, 23 nt, Homo sapiens
auacagaugccauauaguguuau

SEQ ID NO: 1340231 - RNA, 12 nt, Homo sapiens
auacagugucug

SEQ ID NO: 1340232 - RNA, 17 nt, Homo sapiens
auacauaaguuuaggau

SEQ ID NO: 1340233 - RNA, 14 nt, Homo sapiens
auacauauuaucuc

SEQ ID NO: 1340234 - RNA, 14 nt, Homo sapiens
auacaugcauauaa

SEQ ID NO: 1340235 - RNA, 21 nt, Homo sapiens
auacauuccuuuuagaguuaa

SEQ ID NO: 1340236 - RNA, 21 nt, Homo sapiens
auaccacuaguggaaagucag

SEQ ID NO: 1340237 - RNA, 18 nt, Homo sapiens
auaccauucuauucucca

SEQ ID NO: 1340238 - RNA, 13 nt, Homo sapiens
aauauuccuuuau

SEQ ID NO: 1340239 - RNA, 15 nt, Homo sapiens
aauauuccuuugcau

SEQ ID NO: 1340240 - RNA, 15 nt, Homo sapiens
aauauuuauuuaacu

SEQ ID NO: 1340241 - RNA, 21 nt, Homo sapiens
aauauuuauuuaacuauucau

SEQ ID NO: 1340242 - RNA, 21 nt, Homo sapiens
aauauuuuucuguagugugaa

SEQ ID NO: 1340243 - RNA, 15 nt, Homo sapiens
aaucaaauucugucu

SEQ ID NO: 1340244 - RNA, 11 nt, Homo sapiens
aaucacacugu

SEQ ID NO: 1340245 - RNA, 17 nt, Homo sapiens
aaucacagaugcauaua

SEQ ID NO: 1340246 - RNA, 20 nt, Homo sapiens
aaucagauucuucucucuca

SEQ ID NO: 1340247 - RNA, 17 nt, Homo sapiens
aaucagcccagugcaaa

SEQ ID NO: 1340248 - RNA, 19 nt, Homo sapiens
aaucauaaaacuugaugug

SEQ ID NO: 1340249 - RNA, 20 nt, Homo sapiens
aaucauaaaggaucagagau

SEQ ID NO: 1340250 - RNA, 21 nt, Homo sapiens
aaucauauuugaaaaccauau

SEQ ID NO: 1340251 - RNA, 19 nt, Homo sapiens
aaucaugugaggaaaugau

SEQ ID NO: 1340252 - RNA, 22 nt, Homo sapiens
aauccaagaaaauggccaguga

SEQ ID NO: 1340253 - RNA, 15 nt, Homo sapiens
aauccagaacucaaa

SEQ ID NO: 1340254 - RNA, 17 nt, Homo sapiens
aaucccaaucuuucuau

SEQ ID NO: 1340255 - RNA, 19 nt, Homo sapiens
aaucccuuccugaguaaua

SEQ ID NO: 1340256 - RNA, 14 nt, Homo sapiens
aauccuagcacuuu

SEQ ID NO: 1340257 - RNA, 23 nt, Homo sapiens
aauccuaguuuaugcacaugagu

SEQ ID NO: 1340258 - RNA, 15 nt, Homo sapiens
aauccucucugcaag

SEQ ID NO: 1340259 - RNA, 22 nt, Homo sapiens
aauccuguaccaaaucugacau

SEQ ID NO: 1340260 - RNA, 14 nt, Homo sapiens
aaucuaaaauggca

SEQ ID NO: 1340261 - RNA, 17 nt, Homo sapiens
aaucuaaaauuucauaa

SEQ ID NO: 1340262 - RNA, 14 nt, Homo sapiens
aaucuaguugucaa

SEQ ID NO: 1340263 - RNA, 13 nt, Homo sapiens
aaucucccaguga

SEQ ID NO: 1340264 - RNA, 18 nt, Homo sapiens
aaucucuuuauuacugag

SEQ ID NO: 1340265 - RNA, 19 nt, Homo sapiens
aaucugauguauaauguaa

SEQ ID NO: 1340266 - RNA, 17 nt, Homo sapiens
aaucugugaugacauuc

SEQ ID NO: 1340267 - RNA, 20 nt, Homo sapiens
aaucugugaugacauucccu

SEQ ID NO: 1340268 - RNA, 15 nt, Homo sapiens
aaucuuaauguauca

SEQ ID NO: 1340269 - RNA, 14 nt, Homo sapiens
aaucuuaguguuca

SEQ ID NO: 1340270 - RNA, 12 nt, Homo sapiens
aaucuucacuuu

SEQ ID NO: 1340271 - RNA, 16 nt, Homo sapiens
aaugaaaauucuaacc

SEQ ID NO: 1340272 - RNA, 22 nt, Homo sapiens
aaugaaacauccuaugaaauac

SEQ ID NO: 1340273 - RNA, 15 nt, Homo sapiens
aaugaaaucuuccca

SEQ ID NO: 1340274 - RNA, 15 nt, Homo sapiens
aaugaagauccaagc

SEQ ID NO: 1340275 - RNA, 13 nt, Homo sapiens
aaugaauugcuaa

SEQ ID NO: 1340276 - RNA, 22 nt, Homo sapiens
aaugaauuuucuucauacuuaa

SEQ ID NO: 1340277 - RNA, 20 nt, Homo sapiens
aaugacacagucuuggcuca

SEQ ID NO: 1340278 - RNA, 21 nt, Homo sapiens
aaugacacccaugccagagag

SEQ ID NO: 1340279 - RNA, 21 nt, Homo sapiens
aaugacacuaaacuccaugau

SEQ ID NO: 1340280 - RNA, 23 nt, Homo sapiens
aaugaccuuuagggaguuuuccu

SEQ ID NO: 1340281 - RNA, 18 nt, Homo sapiens
aaugagcacccauuccaa

SEQ ID NO: 1340282 - RNA, 12 nt, Homo sapiens
aaugagugcacc

SEQ ID NO: 1340283 - RNA, 14 nt, Homo sapiens
aaugagugcaccug

SEQ ID NO: 1340284 - RNA, 15 nt, Homo sapiens
aaugauacaguugca

SEQ ID NO: 1340285 - RNA, 21 nt, Homo sapiens
aaugauacaguugcauguuau

SEQ ID NO: 1340286 - RNA, 19 nt, Homo sapiens
aaugaugccccagagcucu

SEQ ID NO: 1340287 - RNA, 17 nt, Homo sapiens
aaugauuucacagugug

SEQ ID NO: 1340288 - RNA, 23 nt, Homo sapiens
aaugauuucacagugugugguca

SEQ ID NO: 1340289 - RNA, 23 nt, Homo sapiens
aaugcaaaucaauaaauucccaa

SEQ ID NO: 1340290 - RNA, 18 nt, Homo sapiens
aaugcaagccaucucuaa

SEQ ID NO: 1340291 - RNA, 15 nt, Homo sapiens
aaugcacaguugcca

SEQ ID NO: 1340292 - RNA, 23 nt, Homo sapiens
aaugcagcaggaaggaacaaaga

SEQ ID NO: 1340293 - RNA, 22 nt, Homo sapiens
aaugcauauuugcaaaguguau

SEQ ID NO: 1340294 - RNA, 19 nt, Homo sapiens
aaugccgcugucucugagg

SEQ ID NO: 1340295 - RNA, 19 nt, Homo sapiens
aaugcucagaccagcucuu

SEQ ID NO: 1340296 - RNA, 14 nt, Homo sapiens
aaugcuguuaauau

SEQ ID NO: 1340297 - RNA, 21 nt, Homo sapiens
aaugcuguugguaaagcacau

SEQ ID NO: 1340298 - RNA, 20 nt, Homo sapiens
aaugcuuacggccaucucuu

SEQ ID NO: 1340299 - RNA, 18 nt, Homo sapiens
aauggaggaauccuugac

SEQ ID NO: 1340300 - RNA, 16 nt, Homo sapiens
aauggcagaaccaaag

SEQ ID NO: 1340301 - RNA, 14 nt, Homo sapiens
aauggcagcugcca

SEQ ID NO: 1340302 - RNA, 14 nt, Homo sapiens
aauggccagugaga

SEQ ID NO: 1340303 - RNA, 22 nt, Homo sapiens
aaugggauggucggaucucaca

SEQ ID NO: 1340304 - RNA, 13 nt, Homo sapiens
aauggggccagau

SEQ ID NO: 1340305 - RNA, 21 nt, Homo sapiens
aauggugaagaacuagcauau

SEQ ID NO: 1340306 - RNA, 15 nt, Homo sapiens
aauggugcugcagau

SEQ ID NO: 1340307 - RNA, 23 nt, Homo sapiens
aaugguuaaauuuuacaugacag

SEQ ID NO: 1340308 - RNA, 17 nt, Homo sapiens
aaugguugaugauacuu

SEQ ID NO: 1340309 - RNA, 14 nt, Homo sapiens
aaugguuucacuug

SEQ ID NO: 1340310 - RNA, 17 nt, Homo sapiens
aauguaagagaaauuaa

SEQ ID NO: 1340311 - RNA, 20 nt, Homo sapiens
aauguaagggaaacugccag

SEQ ID NO: 1340312 - RNA, 16 nt, Homo sapiens
aauguaucauagaaau

SEQ ID NO: 1340313 - RNA, 15 nt, Homo sapiens
aaugucaaaccacug

SEQ ID NO: 1340314 - RNA, 21 nt, Homo sapiens
aaugucacaauuaugugcaaa

SEQ ID NO: 1340315 - RNA, 15 nt, Homo sapiens
aaugucagggccagg

SEQ ID NO: 1340316 - RNA, 19 nt, Homo sapiens
aauguccaaacccacucau

SEQ ID NO: 1340317 - RNA, 20 nt, Homo sapiens
aaugucuauauauuggccaa

SEQ ID NO: 1340318 - RNA, 21 nt, Homo sapiens
aaugugagucauuauguagcu

SEQ ID NO: 1340319 - RNA, 18 nt, Homo sapiens
aaugugguguuacuguag

SEQ ID NO: 1340320 - RNA, 22 nt, Homo sapiens
aauguguuuuaucacuucauuc

SEQ ID NO: 1340321 - RNA, 13 nt, Homo sapiens
aauguuaaauuca

SEQ ID NO: 1340322 - RNA, 23 nt, Homo sapiens
aauguuaguauuuuaauccugua

SEQ ID NO: 1340323 - RNA, 23 nt, Homo sapiens
aauguucagaaagccuauuccau

SEQ ID NO: 1340324 - RNA, 20 nt, Homo sapiens
aauguucuuugucucaaaau

SEQ ID NO: 1340325 - RNA, 19 nt, Homo sapiens
aauguugaaaaguaauuga

SEQ ID NO: 1340326 - RNA, 13 nt, Homo sapiens
aauguuguucucu

SEQ ID NO: 1340327 - RNA, 16 nt, Homo sapiens
aauguuugcauuuccu

SEQ ID NO: 1340328 - RNA, 19 nt, Homo sapiens
aauuaaaaaauaguugcaa

SEQ ID NO: 1340329 - RNA, 15 nt, Homo sapiens
aauuaaacauauuca

SEQ ID NO: 1340330 - RNA, 14 nt, Homo sapiens
aauuaaaucugaau

SEQ ID NO: 1340331 - RNA, 16 nt, Homo sapiens
aauuaagcucuugcua

SEQ ID NO: 1340332 - RNA, 15 nt, Homo sapiens
aauuaauaaauguca

SEQ ID NO: 1340333 - RNA, 13 nt, Homo sapiens
aauuaaucacaaa

SEQ ID NO: 1340334 - RNA, 13 nt, Homo sapiens
aauuaaugcagau

SEQ ID NO: 1340335 - RNA, 23 nt, Homo sapiens
aauuacauguuuuuucauuugua

SEQ ID NO: 1340336 - RNA, 19 nt, Homo sapiens
aauuacauuucacuucaag

SEQ ID NO: 1340337 - RNA, 20 nt, Homo sapiens
aauuagaucgguucugugcc

SEQ ID NO: 1340338 - RNA, 16 nt, Homo sapiens
aauuaggcagugcuaa

SEQ ID NO: 1340339 - RNA, 14 nt, Homo sapiens
aauuauaacuauua

SEQ ID NO: 1340340 - RNA, 20 nt, Homo sapiens
aauuauaacuauuacagugu

SEQ ID NO: 1340341 - RNA, 14 nt, Homo sapiens
aauuauacaaugau

SEQ ID NO: 1340342 - RNA, 17 nt, Homo sapiens
aauuauauuuuguugcu

SEQ ID NO: 1340343 - RNA, 19 nt, Homo sapiens
aauuauuacaauucuugaa

SEQ ID NO: 1340344 - RNA, 16 nt, Homo sapiens
aauuauugauguuuuc

SEQ ID NO: 1340345 - RNA, 20 nt, Homo sapiens
aauucacagugcucuuuucu

SEQ ID NO: 1340346 - RNA, 16 nt, Homo sapiens
aauucaccaguguucc

SEQ ID NO: 1340347 - RNA, 16 nt, Homo sapiens
aauucaccgugaaaua

SEQ ID NO: 1340348 - RNA, 14 nt, Homo sapiens
aauucagcacuuaa

SEQ ID NO: 1340349 - RNA, 16 nt, Homo sapiens
aauucuaacaagucau

SEQ ID NO: 1340350 - RNA, 17 nt, Homo sapiens
aauucuccugccuuagc

SEQ ID NO: 1340351 - RNA, 20 nt, Homo sapiens
aauucugucauuucaaagac

SEQ ID NO: 1340352 - RNA, 15 nt, Homo sapiens
aauucugucugggga

SEQ ID NO: 1340353 - RNA, 20 nt, Homo sapiens
aauucuuacccuguacauau

SEQ ID NO: 1340354 - RNA, 16 nt, Homo sapiens
aauugacaagucacag

SEQ ID NO: 1340355 - RNA, 23 nt, Homo sapiens
aauugauguugcuggacugucau

SEQ ID NO: 1340356 - RNA, 18 nt, Homo sapiens
aauugcuaagaagggaaa

SEQ ID NO: 1340357 - RNA, 14 nt, Homo sapiens
aauuggccaugucg

SEQ ID NO: 1340358 - RNA, 16 nt, Homo sapiens
aauuggcuaaucagua

SEQ ID NO: 1340359 - RNA, 21 nt, Homo sapiens
aauuguaauuccaaaauccaa

SEQ ID NO: 1340360 - RNA, 20 nt, Homo sapiens
aauuuaauacagacaucuaa

SEQ ID NO: 1340361 - RNA, 17 nt, Homo sapiens
aauuuaguucaugcauu

SEQ ID NO: 1340362 - RNA, 15 nt, Homo sapiens
aauuuauaacuuacu

SEQ ID NO: 1340363 - RNA, 17 nt, Homo sapiens
aauuucgggagccuugu

SEQ ID NO: 1340364 - RNA, 23 nt, Homo sapiens
aauuucuaguaccugugacucuu

SEQ ID NO: 1340365 - RNA, 15 nt, Homo sapiens
aauuucucccaguca

SEQ ID NO: 1340366 - RNA, 17 nt, Homo sapiens
aauuucucuuuacuuga

SEQ ID NO: 1340367 - RNA, 19 nt, Homo sapiens
aauuucucuuuacuugaaa

SEQ ID NO: 1340368 - RNA, 21 nt, Homo sapiens
aauuugaaaccaggacauuaa

SEQ ID NO: 1340369 - RNA, 15 nt, Homo sapiens
aauuugauaaacuga

SEQ ID NO: 1340370 - RNA, 23 nt, Homo sapiens
agccaccgcgcccagccucaucu

SEQ ID NO: 1340371 - RNA, 14 nt, Homo sapiens
agccaccugggaac

SEQ ID NO: 1340372 - RNA, 21 nt, Homo sapiens
agccacugcauaccaaccugg

SEQ ID NO: 1340373 - RNA, 13 nt, Homo sapiens
agccacugugaua

SEQ ID NO: 1340374 - RNA, 13 nt, Homo sapiens
agccacugugcuu

SEQ ID NO: 1340375 - RNA, 20 nt, Homo sapiens
agccagaggaggccggugaa

SEQ ID NO: 1340376 - RNA, 14 nt, Homo sapiens
agccagaggcaucu

SEQ ID NO: 1340377 - RNA, 16 nt, Homo sapiens
agccagaggcaucuga

SEQ ID NO: 1340378 - RNA, 18 nt, Homo sapiens
agccagcugugcacuuuc

SEQ ID NO: 1340379 - RNA, 18 nt, Homo sapiens
agccaggccaacagcacc

SEQ ID NO: 1340380 - RNA, 15 nt, Homo sapiens
agccagggccagugg

SEQ ID NO: 1340381 - RNA, 13 nt, Homo sapiens
agccauaaauugc

SEQ ID NO: 1340382 - RNA, 14 nt, Homo sapiens
agcccagaacccac

SEQ ID NO: 1340383 - RNA, 14 nt, Homo sapiens
agcccagagccacc

SEQ ID NO: 1340384 - RNA, 15 nt, Homo sapiens
agcccagccugggag

SEQ ID NO: 1340385 - RNA, 20 nt, Homo sapiens
agcccaggggccggccagug

SEQ ID NO: 1340386 - RNA, 13 nt, Homo sapiens
agcccagugcaaa

SEQ ID NO: 1340387 - RNA, 15 nt, Homo sapiens
agcccauaauucaua

SEQ ID NO: 1340388 - RNA, 17 nt, Homo sapiens
agcccuauuucaguuua

SEQ ID NO: 1340389 - RNA, 17 nt, Homo sapiens
agcccugcaccaugcug

SEQ ID NO: 1340390 - RNA, 23 nt, Homo sapiens
agcccuggcaaaugccugacuca

SEQ ID NO: 1340391 - RNA, 21 nt, Homo sapiens
agcccuucuauacccacccag

SEQ ID NO: 1340392 - RNA, 19 nt, Homo sapiens
agccgacucuuugauaugc

SEQ ID NO: 1340393 - RNA, 20 nt, Homo sapiens
agccgagccaugugucuuua

SEQ ID NO: 1340394 - RNA, 15 nt, Homo sapiens
agccgcagaccugga

SEQ ID NO: 1340395 - RNA, 16 nt, Homo sapiens
agccggcuugauuucc

SEQ ID NO: 1340396 - RNA, 14 nt, Homo sapiens
agccggucagagga

SEQ ID NO: 1340397 - RNA, 20 nt, Homo sapiens
agccuaccaaugccaaaagg

SEQ ID NO: 1340398 - RNA, 15 nt, Homo sapiens
agccuaccucugucu

SEQ ID NO: 1340399 - RNA, 18 nt, Homo sapiens
agccuaccucugucugag

SEQ ID NO: 1340400 - RNA, 20 nt, Homo sapiens
agccuagauaugaagaaucu

SEQ ID NO: 1340401 - RNA, 22 nt, Homo sapiens
agccuaugaggggguuuggcac

SEQ ID NO: 1340402 - RNA, 14 nt, Homo sapiens
agccucagggacga

SEQ ID NO: 1340403 - RNA, 14 nt, Homo sapiens
agccucaucucuuu

SEQ ID NO: 1340404 - RNA, 19 nt, Homo sapiens
agccucaugccaacccugg

SEQ ID NO: 1340405 - RNA, 22 nt, Homo sapiens
agccuccaaaaauggcagugac

SEQ ID NO: 1340406 - RNA, 19 nt, Homo sapiens
agccugaagggugccuagu

SEQ ID NO: 1340407 - RNA, 19 nt, Homo sapiens
agccugggcaacauaguga

SEQ ID NO: 1340408 - RNA, 19 nt, Homo sapiens
agccuuauuuaugauguau

SEQ ID NO: 1340409 - RNA, 16 nt, Homo sapiens
agccuucggacagaca

SEQ ID NO: 1340410 - RNA, 21 nt, Homo sapiens
agccuugugugaacucaccaa

SEQ ID NO: 1340411 - RNA, 19 nt, Homo sapiens
agcgagcagucagcauucu

SEQ ID NO: 1340412 - RNA, 23 nt, Homo sapiens
agcgcaugugugcaugugcugug

SEQ ID NO: 1340413 - RNA, 21 nt, Homo sapiens
agcgcgucaugacgugcauga

SEQ ID NO: 1340414 - RNA, 15 nt, Homo sapiens
agcuaaaacuggccc

SEQ ID NO: 1340415 - RNA, 23 nt, Homo sapiens
agcuaagagaagauaaggucuga

SEQ ID NO: 1340416 - RNA, 22 nt, Homo sapiens
agcuaaugucacaauuaugugc

SEQ ID NO: 1340417 - RNA, 14 nt, Homo sapiens
agcuacauguucuu

SEQ ID NO: 1340418 - RNA, 19 nt, Homo sapiens
agcuaccugcucagcccug

SEQ ID NO: 1340419 - RNA, 20 nt, Homo sapiens
agcuacuauguacugccuua

SEQ ID NO: 1340420 - RNA, 21 nt, Homo sapiens
agcuacuauguacugccuuag

SEQ ID NO: 1340421 - RNA, 14 nt, Homo sapiens
agcuagaacauucc

SEQ ID NO: 1340422 - RNA, 19 nt, Homo sapiens
agcuagaacauuccauuug

SEQ ID NO: 1340423 - RNA, 14 nt, Homo sapiens
agcuagaauaccac

SEQ ID NO: 1340424 - RNA, 13 nt, Homo sapiens
agcuagugccuuu

SEQ ID NO: 1340425 - RNA, 19 nt, Homo sapiens
agcuauaacuuacuucugu

SEQ ID NO: 1340426 - RNA, 22 nt, Homo sapiens
agcucaaugaugcaggcaauaa

SEQ ID NO: 1340427 - RNA, 10 nt, Homo sapiens
agcucaccag

SEQ ID NO: 1340428 - RNA, 16 nt, Homo sapiens
agcucagccagugggg

SEQ ID NO: 1340429 - RNA, 18 nt, Homo sapiens
agcucagggacuggcaca

SEQ ID NO: 1340430 - RNA, 15 nt, Homo sapiens
agcuccaaccugcaa

SEQ ID NO: 1340431 - RNA, 13 nt, Homo sapiens
agcuccacagggc

SEQ ID NO: 1340432 - RNA, 15 nt, Homo sapiens
agcuccguucccaag

SEQ ID NO: 1340433 - RNA, 23 nt, Homo sapiens
agcucuccccucagagugcaagc

SEQ ID NO: 1340434 - RNA, 16 nt, Homo sapiens
agcucuccugacuuuu

SEQ ID NO: 1340435 - RNA, 14 nt, Homo sapiens
agcucuggggacag

SEQ ID NO: 1340436 - RNA, 20 nt, Homo sapiens
agcucuggggugggcaguuu

SEQ ID NO: 1340437 - RNA, 16 nt, Homo sapiens
agcucuggugcuuuag

SEQ ID NO: 1340438 - RNA, 12 nt, Homo sapiens
agcucuucccac

SEQ ID NO: 1340439 - RNA, 17 nt, Homo sapiens
agcugaauuauuggaca

SEQ ID NO: 1340440 - RNA, 14 nt, Homo sapiens
agcugcacuacagc

SEQ ID NO: 1340441 - RNA, 11 nt, Homo sapiens
agcugcucagg

SEQ ID NO: 1340442 - RNA, 13 nt, Homo sapiens
agcugcucaggga

SEQ ID NO: 1340443 - RNA, 21 nt, Homo sapiens
agcugcugaaacaacaaauag

SEQ ID NO: 1340444 - RNA, 14 nt, Homo sapiens
agcugggagcacug

SEQ ID NO: 1340445 - RNA, 22 nt, Homo sapiens
agcugucguacauugagcaaau

SEQ ID NO: 1340446 - RNA, 13 nt, Homo sapiens
agcugucugcuca

SEQ ID NO: 1340447 - RNA, 15 nt, Homo sapiens
agcugugcaggcaug

SEQ ID NO: 1340448 - RNA, 20 nt, Homo sapiens
agcuguggggaacacagcua

SEQ ID NO: 1340449 - RNA, 21 nt, Homo sapiens
agcuguucaguugcacuucua

SEQ ID NO: 1340450 - RNA, 12 nt, Homo sapiens
agcuuaccuggg

SEQ ID NO: 1340451 - RNA, 19 nt, Homo sapiens
agcuuaccugggcacaaac

SEQ ID NO: 1340452 - RNA, 14 nt, Homo sapiens
agcuuauacaauua

SEQ ID NO: 1340453 - RNA, 21 nt, Homo sapiens
agcuucaggagggaaccagcu

SEQ ID NO: 1340454 - RNA, 23 nt, Homo sapiens
agcuuccaacccgaggcaauaaa

SEQ ID NO: 1340455 - RNA, 21 nt, Homo sapiens
agcuugagggugacuauggag

SEQ ID NO: 1340456 - RNA, 15 nt, Homo sapiens
agcuuugcagugaaa

SEQ ID NO: 1340457 - RNA, 23 nt, Homo sapiens
agcuuugcagugaaagcuuucau

SEQ ID NO: 1340458 - RNA, 23 nt, Homo sapiens
agcuuuuauuuaacagugcaaaa

SEQ ID NO: 1340459 - RNA, 13 nt, Homo sapiens
aggaaaaggcccc

SEQ ID NO: 1340460 - RNA, 19 nt, Homo sapiens
aggaaagccacaucuugcu

SEQ ID NO: 1340461 - RNA, 16 nt, Homo sapiens
aggaaaggauuuuacc

SEQ ID NO: 1340462 - RNA, 22 nt, Homo sapiens
aggaaaggauuuuaccaaagca

SEQ ID NO: 1340463 - RNA, 23 nt, Homo sapiens
aggaaaugaugagaaauauuaaa

SEQ ID NO: 1340464 - RNA, 17 nt, Homo sapiens
aggaacugagguuuaca

SEQ ID NO: 1340465 - RNA, 18 nt, Homo sapiens
aggaagaaaagcugccau

SEQ ID NO: 1340466 - RNA, 23 nt, Homo sapiens
aggaagcuguguugaaacagaaa

SEQ ID NO: 1340467 - RNA, 15 nt, Homo sapiens
aggaagggagaacuu

SEQ ID NO: 1340468 - RNA, 21 nt, Homo sapiens
aggaauccucugugucuucaa

SEQ ID NO: 1340469 - RNA, 14 nt, Homo sapiens
aggaauuacgugcu

SEQ ID NO: 1340470 - RNA, 15 nt, Homo sapiens
aggaauuuucuugaa

SEQ ID NO: 1340471 - RNA, 23 nt, Homo sapiens
aggaauuuucuugaaacugugaa

SEQ ID NO: 1340472 - RNA, 20 nt, Homo sapiens
aggacauccccccgccaaaa

SEQ ID NO: 1340473 - RNA, 14 nt, Homo sapiens
aggacuguaaucuu

SEQ ID NO: 1340474 - RNA, 12 nt, Homo sapiens
aggacuuucauu

SEQ ID NO: 1340475 - RNA, 17 nt, Homo sapiens
aggagaaaggggcccca

SEQ ID NO: 1340476 - RNA, 14 nt, Homo sapiens
aggagaaggggaag

SEQ ID NO: 1340477 - RNA, 16 nt, Homo sapiens
aggagacagaccacuu

SEQ ID NO: 1340478 - RNA, 12 nt, Homo sapiens
aggagaccucca

SEQ ID NO: 1340479 - RNA, 15 nt, Homo sapiens
aggagagagccagga

SEQ ID NO: 1340480 - RNA, 19 nt, Homo sapiens
aggagaugccacuucucac

SEQ ID NO: 1340481 - RNA, 16 nt, Homo sapiens
aggagcaagaaaugaa

SEQ ID NO: 1340482 - RNA, 13 nt, Homo sapiens
aggagcagcacuc

SEQ ID NO: 1340483 - RNA, 19 nt, Homo sapiens
aggagccuuuugcucucug

SEQ ID NO: 1340484 - RNA, 13 nt, Homo sapiens
aggagcuuugugu

SEQ ID NO: 1340485 - RNA, 23 nt, Homo sapiens
aggagggccagcgcuguggaccu

SEQ ID NO: 1340486 - RNA, 17 nt, Homo sapiens
aggagggugagugcaag

SEQ ID NO: 1340487 - RNA, 14 nt, Homo sapiens
aggagucagggaga

SEQ ID NO: 1340488 - RNA, 21 nt, Homo sapiens
aggagucccugccaucauguu

SEQ ID NO: 1340489 - RNA, 16 nt, Homo sapiens
aggagucugauugcag

SEQ ID NO: 1340490 - RNA, 17 nt, Homo sapiens
aggaguguccugcccau

SEQ ID NO: 1340491 - RNA, 15 nt, Homo sapiens
aggauaagagggauu

SEQ ID NO: 1340492 - RNA, 20 nt, Homo sapiens
aggauacaggugacagugaa

SEQ ID NO: 1340493 - RNA, 21 nt, Homo sapiens
aggauauccucccuccagaua

SEQ ID NO: 1340494 - RNA, 16 nt, Homo sapiens
aggcacugagcaggga

SEQ ID NO: 1340495 - RNA, 19 nt, Homo sapiens
aggcagagguugcagugaa

SEQ ID NO: 1340496 - RNA, 16 nt, Homo sapiens
aggcagccugccuuua

SEQ ID NO: 1340497 - RNA, 21 nt, Homo sapiens
aggcaggcagcugccugcucu

SEQ ID NO: 1340498 - RNA, 16 nt, Homo sapiens
aggcaggggaauguau

SEQ ID NO: 1340499 - RNA, 19 nt, Homo sapiens
aggcagugugccaguuuaa

SEQ ID NO: 1340500 - RNA, 20 nt, Homo sapiens
aggcauacugccuuguuuaa

SEQ ID NO: 1340501 - RNA, 15 nt, Homo sapiens
aggcauacuuuucaa

SEQ ID NO: 1340502 - RNA, 22 nt, Homo sapiens
aucacagggaauggccacaaac

SEQ ID NO: 1340503 - RNA, 17 nt, Homo sapiens
aucacggauggugcaug

SEQ ID NO: 1340504 - RNA, 14 nt, Homo sapiens
aucacguugcaaug

SEQ ID NO: 1340505 - RNA, 22 nt, Homo sapiens
aucacucuagguuuuacagauu

SEQ ID NO: 1340506 - RNA, 15 nt, Homo sapiens
aucacuucaggucag

SEQ ID NO: 1340507 - RNA, 14 nt, Homo sapiens
aucagacuuuuaca

SEQ ID NO: 1340508 - RNA, 19 nt, Homo sapiens
aucagauaauuaugcuuuu

SEQ ID NO: 1340509 - RNA, 18 nt, Homo sapiens
aucagcaccccaguggag

SEQ ID NO: 1340510 - RNA, 18 nt, Homo sapiens
aucagucuccaacauguu

SEQ ID NO: 1340511 - RNA, 12 nt, Homo sapiens
aucaguugguuu

SEQ ID NO: 1340512 - RNA, 14 nt, Homo sapiens
aucauaaaaucaaa

SEQ ID NO: 1340513 - RNA, 19 nt, Homo sapiens
aucauaaacugacuaucau

SEQ ID NO: 1340514 - RNA, 17 nt, Homo sapiens
aucauacaaacucucac

SEQ ID NO: 1340515 - RNA, 20 nt, Homo sapiens
aucauacuaaacuucaccua

SEQ ID NO: 1340516 - RNA, 13 nt, Homo sapiens
aucauauagacca

SEQ ID NO: 1340517 - RNA, 14 nt, Homo sapiens
aucaucuuauucag

SEQ ID NO: 1340518 - RNA, 15 nt, Homo sapiens
aucaugugaggaaau

SEQ ID NO: 1340519 - RNA, 15 nt, Homo sapiens
aucauuaucagccug

SEQ ID NO: 1340520 - RNA, 13 nt, Homo sapiens
auccaaccacugu

SEQ ID NO: 1340521 - RNA, 15 nt, Homo sapiens
auccaaucugugaug

SEQ ID NO: 1340522 - RNA, 16 nt, Homo sapiens
auccaccaccaaaauu

SEQ ID NO: 1340523 - RNA, 22 nt, Homo sapiens
auccacccagcaggcagagugg

SEQ ID NO: 1340524 - RNA, 16 nt, Homo sapiens
auccacuuacauauau

SEQ ID NO: 1340525 - RNA, 14 nt, Homo sapiens
auccagcacuggug

SEQ ID NO: 1340526 - RNA, 13 nt, Homo sapiens
auccagcccaaac

SEQ ID NO: 1340527 - RNA, 21 nt, Homo sapiens
auccagugugagauacugugu

SEQ ID NO: 1340528 - RNA, 14 nt, Homo sapiens
auccauaaagacaa

SEQ ID NO: 1340529 - RNA, 18 nt, Homo sapiens
auccauauaacaauucag

SEQ ID NO: 1340530 - RNA, 13 nt, Homo sapiens
auccauccaaagg

SEQ ID NO: 1340531 - RNA, 18 nt, Homo sapiens
auccaugcaccuaccuua

SEQ ID NO: 1340532 - RNA, 15 nt, Homo sapiens
auccauucuaccugu

SEQ ID NO: 1340533 - RNA, 22 nt, Homo sapiens
auccauuucaggacucucucca

SEQ ID NO: 1340534 - RNA, 22 nt, Homo sapiens
aucccagauaugguugcacaaa

SEQ ID NO: 1340535 - RNA, 23 nt, Homo sapiens
auccccccgccaaaagcugcuca

SEQ ID NO: 1340536 - RNA, 20 nt, Homo sapiens
auccccugccuaaugcugcg

SEQ ID NO: 1340537 - RNA, 16 nt, Homo sapiens
aucccucaguuucuua

SEQ ID NO: 1340538 - RNA, 15 nt, Homo sapiens
aucccucucuucccc

SEQ ID NO: 1340539 - RNA, 15 nt, Homo sapiens
aucccuggaaggaca

SEQ ID NO: 1340540 - RNA, 16 nt, Homo sapiens
aucccuuuuuuuacau

SEQ ID NO: 1340541 - RNA, 19 nt, Homo sapiens
auccgauuccccuguagca

SEQ ID NO: 1340542 - RNA, 17 nt, Homo sapiens
auccuaaagaacaaagu

SEQ ID NO: 1340543 - RNA, 22 nt, Homo sapiens
auccuacuguaauaaagaugau

SEQ ID NO: 1340544 - RNA, 16 nt, Homo sapiens
auccuagacugcuccu

SEQ ID NO: 1340545 - RNA, 18 nt, Homo sapiens
auccucacgccuuggccu

SEQ ID NO: 1340546 - RNA, 13 nt, Homo sapiens
auccuccacagag

SEQ ID NO: 1340547 - RNA, 15 nt, Homo sapiens
auccuccacagagag

SEQ ID NO: 1340548 - RNA, 17 nt, Homo sapiens
auccuccuaccucagcc

SEQ ID NO: 1340549 - RNA, 14 nt, Homo sapiens
auccugaacuuucu

SEQ ID NO: 1340550 - RNA, 23 nt, Homo sapiens
auccugauucauauuuaauuuga

SEQ ID NO: 1340551 - RNA, 18 nt, Homo sapiens
auccugcagggcuucucc

SEQ ID NO: 1340552 - RNA, 19 nt, Homo sapiens
auccuggggcagcacuccc

SEQ ID NO: 1340553 - RNA, 20 nt, Homo sapiens
auccuguaccaaaucugaca

SEQ ID NO: 1340554 - RNA, 19 nt, Homo sapiens
auccuuaacacauucaaua

SEQ ID NO: 1340555 - RNA, 17 nt, Homo sapiens
auccuucucacugccau

SEQ ID NO: 1340556 - RNA, 12 nt, Homo sapiens
auccuuggcagu

SEQ ID NO: 1340557 - RNA, 13 nt, Homo sapiens
aucgcaaaucaaa

SEQ ID NO: 1340558 - RNA, 17 nt, Homo sapiens
aucgcaguguucaaggc

SEQ ID NO: 1340559 - RNA, 16 nt, Homo sapiens
aucgcuugaaccuggg

SEQ ID NO: 1340560 - RNA, 18 nt, Homo sapiens
aucggccaucaagggaag

SEQ ID NO: 1340561 - RNA, 17 nt, Homo sapiens
aucguguccugaaaauc

SEQ ID NO: 1340562 - RNA, 15 nt, Homo sapiens
aucuaaaaucugcua

SEQ ID NO: 1340563 - RNA, 23 nt, Homo sapiens
aucuaacagcccugugcagcagc

SEQ ID NO: 1340564 - RNA, 20 nt, Homo sapiens
aucuaauuuuacacucugua

SEQ ID NO: 1340565 - RNA, 15 nt, Homo sapiens
aucuaguugucaaua

SEQ ID NO: 1340566 - RNA, 12 nt, Homo sapiens
aucucacugcag

SEQ ID NO: 1340567 - RNA, 15 nt, Homo sapiens
aucucagaugcaguu

SEQ ID NO: 1340568 - RNA, 13 nt, Homo sapiens
aucucagcacuuu

SEQ ID NO: 1340569 - RNA, 17 nt, Homo sapiens
aucucagggaacugacc

SEQ ID NO: 1340570 - RNA, 15 nt, Homo sapiens
aucucauugcuuaca

SEQ ID NO: 1340571 - RNA, 18 nt, Homo sapiens
aucucauuuuacacaaag

SEQ ID NO: 1340572 - RNA, 15 nt, Homo sapiens
aucucccagcaagac

SEQ ID NO: 1340573 - RNA, 18 nt, Homo sapiens
aucucccuuuuccaugac

SEQ ID NO: 1340574 - RNA, 15 nt, Homo sapiens
aucucuaaagagcau

SEQ ID NO: 1340575 - RNA, 16 nt, Homo sapiens
aucucucaaaucuguu

SEQ ID NO: 1340576 - RNA, 21 nt, Homo sapiens
aucucugggggcugaggagca

SEQ ID NO: 1340577 - RNA, 19 nt, Homo sapiens
aucucuugcacucaaagcu

SEQ ID NO: 1340578 - RNA, 16 nt, Homo sapiens
aucucuugcccuuccu

SEQ ID NO: 1340579 - RNA, 12 nt, Homo sapiens
aucugacuucua

SEQ ID NO: 1340580 - RNA, 14 nt, Homo sapiens
aucugaggcaaucu

SEQ ID NO: 1340581 - RNA, 16 nt, Homo sapiens
aucugcaccaccaugc

SEQ ID NO: 1340582 - RNA, 20 nt, Homo sapiens
aucugcuagggaauaucaau

SEQ ID NO: 1340583 - RNA, 20 nt, Homo sapiens
aucugcugcaguuaccacag

SEQ ID NO: 1340584 - RNA, 12 nt, Homo sapiens
aucugcuguucu

SEQ ID NO: 1340585 - RNA, 21 nt, Homo sapiens
aucugcuuaucagugugcaau

SEQ ID NO: 1340586 - RNA, 18 nt, Homo sapiens
aucuggaacccagacuca

SEQ ID NO: 1340587 - RNA, 18 nt, Homo sapiens
aucugggggaguggaaua

SEQ ID NO: 1340588 - RNA, 18 nt, Homo sapiens
aucugugccagagguaau

SEQ ID NO: 1340589 - RNA, 19 nt, Homo sapiens
aucuguuuuggauguugcu

SEQ ID NO: 1340590 - RNA, 15 nt, Homo sapiens
aucuuaaacauaaua

SEQ ID NO: 1340591 - RNA, 16 nt, Homo sapiens
aucuuaguguucaaaa

SEQ ID NO: 1340592 - RNA, 22 nt, Homo sapiens
aucuucuuuauaauucuacuuu

SEQ ID NO: 1340593 - RNA, 15 nt, Homo sapiens
aucuugaccaacaga

SEQ ID NO: 1340594 - RNA, 15 nt, Homo sapiens
aucuugcuaccagua

SEQ ID NO: 1340595 - RNA, 19 nt, Homo sapiens
aucuugcuaccaguauuua

SEQ ID NO: 1340596 - RNA, 22 nt, Homo sapiens
aucuugcucucggugcuuccaa

SEQ ID NO: 1340597 - RNA, 18 nt, Homo sapiens
aucuuggagaaugugaga

SEQ ID NO: 1340598 - RNA, 14 nt, Homo sapiens
aucuuggccaucua

SEQ ID NO: 1340599 - RNA, 10 nt, Homo sapiens
aucuuucuac

SEQ ID NO: 1340600 - RNA, 22 nt, Homo sapiens
aucuuugcuuuauaaaagaaca

SEQ ID NO: 1340601 - RNA, 20 nt, Homo sapiens
aucuuuguguugcagccuca

SEQ ID NO: 1340602 - RNA, 13 nt, Homo sapiens
augaaaacaauuc

SEQ ID NO: 1340603 - RNA, 19 nt, Homo sapiens
augaaaggcagggcaagaa

SEQ ID NO: 1340604 - RNA, 14 nt, Homo sapiens
augaaaucuuccca

SEQ ID NO: 1340605 - RNA, 15 nt, Homo sapiens
augaaaucuucccag

SEQ ID NO: 1340606 - RNA, 14 nt, Homo sapiens
augaaccagaguuu

SEQ ID NO: 1340607 - RNA, 15 nt, Homo sapiens
augaacuuucagcag

SEQ ID NO: 1340608 - RNA, 16 nt, Homo sapiens
augaagaaucugcucu

SEQ ID NO: 1340609 - RNA, 11 nt, Homo sapiens
augaagcaaga

SEQ ID NO: 1340610 - RNA, 15 nt, Homo sapiens
augaagccauaugaa

SEQ ID NO: 1340611 - RNA, 13 nt, Homo sapiens
augaagugcacag

SEQ ID NO: 1340612 - RNA, 19 nt, Homo sapiens
augaaguuuaaagauucua

SEQ ID NO: 1340613 - RNA, 16 nt, Homo sapiens
augaauaaacaguuau

SEQ ID NO: 1340614 - RNA, 22 nt, Homo sapiens
augaaugacaguagucacacau

SEQ ID NO: 1340615 - RNA, 19 nt, Homo sapiens
augaauucugucauuucaa

SEQ ID NO: 1340616 - RNA, 19 nt, Homo sapiens
augacacaggcugacucau

SEQ ID NO: 1340617 - RNA, 15 nt, Homo sapiens
augacacuaaacucc

SEQ ID NO: 1340618 - RNA, 20 nt, Homo sapiens
augacaucacuuguacaaaa

SEQ ID NO: 1340619 - RNA, 23 nt, Homo sapiens
augacgguguuaauuuugcuaac

SEQ ID NO: 1340620 - RNA, 16 nt, Homo sapiens
augacucucauuuuau

SEQ ID NO: 1340621 - RNA, 17 nt, Homo sapiens
augagagaauguggaaa

SEQ ID NO: 1340622 - RNA, 13 nt, Homo sapiens
augaggaaacuuu

SEQ ID NO: 1340623 - RNA, 14 nt, Homo sapiens
augaggccaucuca

SEQ ID NO: 1340624 - RNA, 15 nt, Homo sapiens
augaggccaucucag

SEQ ID NO: 1340625 - RNA, 15 nt, Homo sapiens
augaggucuguuuaa

SEQ ID NO: 1340626 - RNA, 16 nt, Homo sapiens
augagugcaccugccu

SEQ ID NO: 1340627 - RNA, 14 nt, Homo sapiens
augauacuucccac

SEQ ID NO: 1340628 - RNA, 12 nt, Homo sapiens
augauacuugag

SEQ ID NO: 1340629 - RNA, 21 nt, Homo sapiens
augaugaaaacuaaggauuuu

SEQ ID NO: 1340630 - RNA, 22 nt, Homo sapiens
augaugagguuuucuuaacuua

SEQ ID NO: 1340631 - RNA, 12 nt, Homo sapiens
augauuucacag

SEQ ID NO: 1340632 - RNA, 15 nt, Homo sapiens
augauuucacagugu

SEQ ID NO: 1340633 - RNA, 16 nt, Homo sapiens
augcaaauacaaucag

SEQ ID NO: 1340634 - RNA, 23 nt, Homo sapiens
augcaaccauuuuuaggaagcua

SEQ ID NO: 1340635 - RNA, 12 nt, Homo sapiens
augcaagcagcu

SEQ ID NO: 1340636 - RNA, 15 nt, Homo sapiens
cagaaacugaugcca

SEQ ID NO: 1340637 - RNA, 21 nt, Homo sapiens
cagaaagcaucccucacccau

SEQ ID NO: 1340638 - RNA, 16 nt, Homo sapiens
cagaaagccuauucca

SEQ ID NO: 1340639 - RNA, 19 nt, Homo sapiens
cagaaagcuucauccacag

SEQ ID NO: 1340640 - RNA, 20 nt, Homo sapiens
cagaacagaugcugagccau

SEQ ID NO: 1340641 - RNA, 15 nt, Homo sapiens
cagaacaugcuguua

SEQ ID NO: 1340642 - RNA, 13 nt, Homo sapiens
cagaaccaaaucu

SEQ ID NO: 1340643 - RNA, 18 nt, Homo sapiens
cagaaccccuacaugaaa

SEQ ID NO: 1340644 - RNA, 15 nt, Homo sapiens
cagaagaaucuuccu

SEQ ID NO: 1340645 - RNA, 19 nt, Homo sapiens
cagaagaaucuuccuggca

SEQ ID NO: 1340646 - RNA, 19 nt, Homo sapiens
cagaagaugccagcuucuc

SEQ ID NO: 1340647 - RNA, 22 nt, Homo sapiens
cagaagcaucgcuccucuccag

SEQ ID NO: 1340648 - RNA, 23 nt, Homo sapiens
cagaaggaaagaagggggcccug

SEQ ID NO: 1340649 - RNA, 15 nt, Homo sapiens
cagaaguaauuugaa

SEQ ID NO: 1340650 - RNA, 15 nt, Homo sapiens
cagaaguguucacau

SEQ ID NO: 1340651 - RNA, 13 nt, Homo sapiens
cagaauugcucaa

SEQ ID NO: 1340652 - RNA, 22 nt, Homo sapiens
cagacaauauggucccaaauga

SEQ ID NO: 1340653 - RNA, 13 nt, Homo sapiens
cagacaccagccu

SEQ ID NO: 1340654 - RNA, 16 nt, Homo sapiens
cagacagacaacacug

SEQ ID NO: 1340655 - RNA, 18 nt, Homo sapiens
cagacagcuuacaggagc

SEQ ID NO: 1340656 - RNA, 23 nt, Homo sapiens
cagaccuugggggaagacuuuaa

SEQ ID NO: 1340657 - RNA, 16 nt, Homo sapiens
cagacucaaaugcuca

SEQ ID NO: 1340658 - RNA, 15 nt, Homo sapiens
cagacucgggaccaa

SEQ ID NO: 1340659 - RNA, 13 nt, Homo sapiens
cagacugaaaaac

SEQ ID NO: 1340660 - RNA, 21 nt, Homo sapiens
cagacuuuguguucauuucau

SEQ ID NO: 1340661 - RNA, 20 nt, Homo sapiens
cagagaauucucuuauccaa

SEQ ID NO: 1340662 - RNA, 18 nt, Homo sapiens
cagagacccaagcugccu

SEQ ID NO: 1340663 - RNA, 23 nt, Homo sapiens
cagagagggaagaugaccugccc

SEQ ID NO: 1340664 - RNA, 16 nt, Homo sapiens
cagagauaaagaccuu

SEQ ID NO: 1340665 - RNA, 15 nt, Homo sapiens
cagagauccaaaaga

SEQ ID NO: 1340666 - RNA, 13 nt, Homo sapiens
cagagaugacucu

SEQ ID NO: 1340667 - RNA, 21 nt, Homo sapiens
cagagaugacucugucucauu

SEQ ID NO: 1340668 - RNA, 15 nt, Homo sapiens
cagagcaucuugcau

SEQ ID NO: 1340669 - RNA, 16 nt, Homo sapiens
cagagcccagcuccaa

SEQ ID NO: 1340670 - RNA, 19 nt, Homo sapiens
cagagccuuuuuaccuggc

SEQ ID NO: 1340671 - RNA, 14 nt, Homo sapiens
cagaggacacagag

SEQ ID NO: 1340672 - RNA, 13 nt, Homo sapiens
cagaggacaguau

SEQ ID NO: 1340673 - RNA, 12 nt, Homo sapiens
cagaggacucac

SEQ ID NO: 1340674 - RNA, 18 nt, Homo sapiens
cagaggagaaaguggaaa

SEQ ID NO: 1340675 - RNA, 23 nt, Homo sapiens
cagaggaggccggugaagugcau

SEQ ID NO: 1340676 - RNA, 22 nt, Homo sapiens
cagaggaggggccgcugccacc

SEQ ID NO: 1340677 - RNA, 19 nt, Homo sapiens
cagaggcaguaaccaugcc

SEQ ID NO: 1340678 - RNA, 23 nt, Homo sapiens
cagaggcccuggaggucuccagg

SEQ ID NO: 1340679 - RNA, 18 nt, Homo sapiens
cagaggcuucuccaaagg

SEQ ID NO: 1340680 - RNA, 14 nt, Homo sapiens
cagagggaagccau

SEQ ID NO: 1340681 - RNA, 19 nt, Homo sapiens
cagagggggaguagccaag

SEQ ID NO: 1340682 - RNA, 18 nt, Homo sapiens
cagagugaagcccacaga

SEQ ID NO: 1340683 - RNA, 18 nt, Homo sapiens
cagaguggggaugacaug

SEQ ID NO: 1340684 - RNA, 18 nt, Homo sapiens
cagauaacaaacacugaa

SEQ ID NO: 1340685 - RNA, 11 nt, Homo sapiens
cagauaacaua

SEQ ID NO: 1340686 - RNA, 13 nt, Homo sapiens
cagauaauagcaa

SEQ ID NO: 1340687 - RNA, 19 nt, Homo sapiens
cagauacugucucuuucau

SEQ ID NO: 1340688 - RNA, 22 nt, Homo sapiens
cagauauacuugguucucucca

SEQ ID NO: 1340689 - RNA, 14 nt, Homo sapiens
cagaucauccugcu

SEQ ID NO: 1340690 - RNA, 12 nt, Homo sapiens
cagauccaggga

SEQ ID NO: 1340691 - RNA, 23 nt, Homo sapiens
cagaucuauuguuuguugcacua

SEQ ID NO: 1340692 - RNA, 12 nt, Homo sapiens
cagaugcaauga

SEQ ID NO: 1340693 - RNA, 18 nt, Homo sapiens
cagaugcacacacacaga

SEQ ID NO: 1340694 - RNA, 17 nt, Homo sapiens
cagaugccacacaagga

SEQ ID NO: 1340695 - RNA, 20 nt, Homo sapiens
cagauggaaagaggugaaaa

SEQ ID NO: 1340696 - RNA, 11 nt, Homo sapiens
cagaugucuua

SEQ ID NO: 1340697 - RNA, 13 nt, Homo sapiens
cagauucuucacu

SEQ ID NO: 1340698 - RNA, 17 nt, Homo sapiens
cagauucuucacugugu

SEQ ID NO: 1340699 - RNA, 15 nt, Homo sapiens
cagauuuaagccuua

SEQ ID NO: 1340700 - RNA, 14 nt, Homo sapiens
cagcaacuauucac

SEQ ID NO: 1340701 - RNA, 12 nt, Homo sapiens
cagcaagcuuug

SEQ ID NO: 1340702 - RNA, 23 nt, Homo sapiens
cagcaaggccagaugcacauccc

SEQ ID NO: 1340703 - RNA, 18 nt, Homo sapiens
cagcaauucaugguucaa

SEQ ID NO: 1340704 - RNA, 16 nt, Homo sapiens
cagcaccaaccacagc

SEQ ID NO: 1340705 - RNA, 19 nt, Homo sapiens
cagcaccaagcauguccca

SEQ ID NO: 1340706 - RNA, 21 nt, Homo sapiens
cagcaccaucucuuuaccucc

SEQ ID NO: 1340707 - RNA, 20 nt, Homo sapiens
cagcacgaguggccaguuca

SEQ ID NO: 1340708 - RNA, 23 nt, Homo sapiens
cagcacguguggccuguucuucu

SEQ ID NO: 1340709 - RNA, 21 nt, Homo sapiens
cagcacuccccagagcugugc

SEQ ID NO: 1340710 - RNA, 19 nt, Homo sapiens
cagcacucuuaucuacaua

SEQ ID NO: 1340711 - RNA, 13 nt, Homo sapiens
cagcagauuucca

SEQ ID NO: 1340712 - RNA, 23 nt, Homo sapiens
cagcagccccaggagaaggggcu

SEQ ID NO: 1340713 - RNA, 15 nt, Homo sapiens
cagcaggccagagaa

SEQ ID NO: 1340714 - RNA, 18 nt, Homo sapiens
cagcaggccucugggacc

SEQ ID NO: 1340715 - RNA, 17 nt, Homo sapiens
cagcaggggggcugugc

SEQ ID NO: 1340716 - RNA, 16 nt, Homo sapiens
cagcauccacacugcc

SEQ ID NO: 1340717 - RNA, 14 nt, Homo sapiens
cagcaucggaaaga

SEQ ID NO: 1340718 - RNA, 19 nt, Homo sapiens
cagcaucuaagaaguuuug

SEQ ID NO: 1340719 - RNA, 21 nt, Homo sapiens
cagccagcgucccuuggugag

SEQ ID NO: 1340720 - RNA, 17 nt, Homo sapiens
cagccaugucugcauuu

SEQ ID NO: 1340721 - RNA, 20 nt, Homo sapiens
cagcccaccccugugcccac

SEQ ID NO: 1340722 - RNA, 14 nt, Homo sapiens
cagcccagugcaaa

SEQ ID NO: 1340723 - RNA, 15 nt, Homo sapiens
cagcccagugcaaac

SEQ ID NO: 1340724 - RNA, 14 nt, Homo sapiens
cagcccauaauuca

SEQ ID NO: 1340725 - RNA, 14 nt, Homo sapiens
cagcccauucccaa

SEQ ID NO: 1340726 - RNA, 17 nt, Homo sapiens
cagccccaacuccaggg

SEQ ID NO: 1340727 - RNA, 14 nt, Homo sapiens
cagcccuauuucag

SEQ ID NO: 1340728 - RNA, 16 nt, Homo sapiens
cagcccugcaccaugc

SEQ ID NO: 1340729 - RNA, 20 nt, Homo sapiens
cagcccugcaccaugcugcu

SEQ ID NO: 1340730 - RNA, 23 nt, Homo sapiens
cagccuccaaaaauggcagugac

SEQ ID NO: 1340731 - RNA, 14 nt, Homo sapiens
cagccucccaagua

SEQ ID NO: 1340732 - RNA, 14 nt, Homo sapiens
cagccucccugaag

SEQ ID NO: 1340733 - RNA, 17 nt, Homo sapiens
cagccugcuucccacaa

SEQ ID NO: 1340734 - RNA, 17 nt, Homo sapiens
cagccuggccaacaugg

SEQ ID NO: 1340735 - RNA, 20 nt, Homo sapiens
cagccugggcaacgagugaa

SEQ ID NO: 1340736 - RNA, 18 nt, Homo sapiens
cagccuugcaacccaagg

SEQ ID NO: 1340737 - RNA, 16 nt, Homo sapiens
cagccuugccagagau

SEQ ID NO: 1340738 - RNA, 22 nt, Homo sapiens
cagccuuuuauguauuuuccaa

SEQ ID NO: 1340739 - RNA, 15 nt, Homo sapiens
cagcgaacagccuua

SEQ ID NO: 1340740 - RNA, 18 nt, Homo sapiens
cagcgcagggcuggcacg

SEQ ID NO: 1340741 - RNA, 21 nt, Homo sapiens
cagcggucagauagcaucaga

SEQ ID NO: 1340742 - RNA, 22 nt, Homo sapiens
cagcguuggcuuggaggacaaa

SEQ ID NO: 1340743 - RNA, 14 nt, Homo sapiens
cagcuagugccuuu

SEQ ID NO: 1340744 - RNA, 11 nt, Homo sapiens
cagcucaggga

SEQ ID NO: 1340745 - RNA, 12 nt, Homo sapiens
cagcucagggac

SEQ ID NO: 1340746 - RNA, 19 nt, Homo sapiens
cagcuccuccaugccugac

SEQ ID NO: 1340747 - RNA, 23 nt, Homo sapiens
cagcucuccccucagagugcaag

SEQ ID NO: 1340748 - RNA, 19 nt, Homo sapiens
cagcucuuucaaacuuggg

SEQ ID NO: 1340749 - RNA, 13 nt, Homo sapiens
cagcugacuaaac

SEQ ID NO: 1340750 - RNA, 15 nt, Homo sapiens
cagcugauugggcac

SEQ ID NO: 1340751 - RNA, 19 nt, Homo sapiens
cagcugauugggcaccuga

SEQ ID NO: 1340752 - RNA, 12 nt, Homo sapiens
cagcugcuccua

SEQ ID NO: 1340753 - RNA, 21 nt, Homo sapiens
cagcuggacauacugcuggag

SEQ ID NO: 1340754 - RNA, 19 nt, Homo sapiens
cagcuggcggaggcugcuc

SEQ ID NO: 1340755 - RNA, 21 nt, Homo sapiens
cagcuggcggguguggagacc

SEQ ID NO: 1340756 - RNA, 17 nt, Homo sapiens
cagcugggaagcccuuu

SEQ ID NO: 1340757 - RNA, 16 nt, Homo sapiens
cagcugguugcuccau

SEQ ID NO: 1340758 - RNA, 21 nt, Homo sapiens
cagcugugcacuuucuucucu

SEQ ID NO: 1340759 - RNA, 20 nt, Homo sapiens
cagcuuuccucaucaggcca

SEQ ID NO: 1340760 - RNA, 18 nt, Homo sapiens
cagcuuugucuccaaaga

SEQ ID NO: 1340761 - RNA, 21 nt, Homo sapiens
caggaaagcuggugucugauu

SEQ ID NO: 1340762 - RNA, 15 nt, Homo sapiens
caggaaccacaccac

SEQ ID NO: 1340763 - RNA, 19 nt, Homo sapiens
caggaaggaaaacuaugua

SEQ ID NO: 1340764 - RNA, 23 nt, Homo sapiens
caggaagggggccgccacccucc

SEQ ID NO: 1340765 - RNA, 23 nt, Homo sapiens
caggaauuucccaggacccugaa

SEQ ID NO: 1340766 - RNA, 16 nt, Homo sapiens
caggacagaugccaca

SEQ ID NO: 1340767 - RNA, 22 nt, Homo sapiens
caggacucugccuccucuucaa

SEQ ID NO: 1340768 - RNA, 17 nt, Homo sapiens
cuuugaguuuuguauuc

SEQ ID NO: 1340769 - RNA, 22 nt, Homo sapiens
cuuugauagauuucuacacuga

SEQ ID NO: 1340770 - RNA, 14 nt, Homo sapiens
cuuugcaccaaaga

SEQ ID NO: 1340771 - RNA, 17 nt, Homo sapiens
cuuugcaccaaagacau

SEQ ID NO: 1340772 - RNA, 12 nt, Homo sapiens
cuuugcgcucuc

SEQ ID NO: 1340773 - RNA, 12 nt, Homo sapiens
cuuugcuaaaau

SEQ ID NO: 1340774 - RNA, 15 nt, Homo sapiens
cuuugcucuuuggua

SEQ ID NO: 1340775 - RNA, 15 nt, Homo sapiens
cuuuguacuuugugc

SEQ ID NO: 1340776 - RNA, 13 nt, Homo sapiens
cuuugucccagaa

SEQ ID NO: 1340777 - RNA, 14 nt, Homo sapiens
cuuugucucaaaau

SEQ ID NO: 1340778 - RNA, 16 nt, Homo sapiens
cuuugucucaaaauaa

SEQ ID NO: 1340779 - RNA, 17 nt, Homo sapiens
cuuugucuccaaagaag

SEQ ID NO: 1340780 - RNA, 22 nt, Homo sapiens
cuuugucuuucuuugucauuca

SEQ ID NO: 1340781 - RNA, 17 nt, Homo sapiens
cuuuguuacuuccuuau

SEQ ID NO: 1340782 - RNA, 20 nt, Homo sapiens
cuuuuaaauuauacaaugau

SEQ ID NO: 1340783 - RNA, 22 nt, Homo sapiens
cuuuuaauggaugguugaauua

SEQ ID NO: 1340784 - RNA, 22 nt, Homo sapiens
cuuuuaaugucauuuguuaaaa

SEQ ID NO: 1340785 - RNA, 19 nt, Homo sapiens
cuuuuaauuuaaaaacaca

SEQ ID NO: 1340786 - RNA, 13 nt, Homo sapiens
cuuuuauauucua

SEQ ID NO: 1340787 - RNA, 17 nt, Homo sapiens
cuuuuaucuccuugugg

SEQ ID NO: 1340788 - RNA, 15 nt, Homo sapiens
cuuuuauuuucacag

SEQ ID NO: 1340789 - RNA, 18 nt, Homo sapiens
cuuuucauaucucuugcc

SEQ ID NO: 1340790 - RNA, 17 nt, Homo sapiens
cuuuucccauugccaug

SEQ ID NO: 1340791 - RNA, 17 nt, Homo sapiens
cuuuuccccagucccag

SEQ ID NO: 1340792 - RNA, 20 nt, Homo sapiens
cuuuuccuggcagcugcugu

SEQ ID NO: 1340793 - RNA, 13 nt, Homo sapiens
cuuuuccuuugaa

SEQ ID NO: 1340794 - RNA, 22 nt, Homo sapiens
cuuuucucugagacauuccacc

SEQ ID NO: 1340795 - RNA, 16 nt, Homo sapiens
cuuuugaaauccagaa

SEQ ID NO: 1340796 - RNA, 18 nt, Homo sapiens
cuuuugaagagcaaaggg

SEQ ID NO: 1340797 - RNA, 20 nt, Homo sapiens
cuuuugacacugcucuaaca

SEQ ID NO: 1340798 - RNA, 12 nt, Homo sapiens
cuuuugauuugu

SEQ ID NO: 1340799 - RNA, 16 nt, Homo sapiens
cuuuuggagguauuca

SEQ ID NO: 1340800 - RNA, 20 nt, Homo sapiens
cuuuuuauuguuaguucuca

SEQ ID NO: 1340801 - RNA, 12 nt, Homo sapiens
cuuuuuccagag

SEQ ID NO: 1340802 - RNA, 14 nt, Homo sapiens
cuuuuuuauacuca

SEQ ID NO: 1340803 - RNA, 14 nt, Homo sapiens
cuuuuuugccaaau

SEQ ID NO: 1340804 - RNA, 18 nt, Homo sapiens
cuuuuuuuuaaaaaaacu

SEQ ID NO: 1340805 - RNA, 18 nt, Homo sapiens
cuuuuuuuuuaaggugaa

SEQ ID NO: 1340806 - RNA, 23 nt, Homo sapiens
cuuuuuuuuuuuuuaaagacaga

SEQ ID NO: 1340807 - RNA, 18 nt, Homo sapiens
gaaaaaaacuucauucuc

SEQ ID NO: 1340808 - RNA, 16 nt, Homo sapiens
gaaaaaauucucuuaa

SEQ ID NO: 1340809 - RNA, 19 nt, Homo sapiens
gaaaaacaccgcuucugcc

SEQ ID NO: 1340810 - RNA, 13 nt, Homo sapiens
gaaaaagacugau

SEQ ID NO: 1340811 - RNA, 20 nt, Homo sapiens
gaaaaaucccuguucugcca

SEQ ID NO: 1340812 - RNA, 23 nt, Homo sapiens
gaaaacccaccccguagauuccc

SEQ ID NO: 1340813 - RNA, 21 nt, Homo sapiens
gaaaagcaauacuguuuccau

SEQ ID NO: 1340814 - RNA, 14 nt, Homo sapiens
gaaaagcaggcaaa

SEQ ID NO: 1340815 - RNA, 19 nt, Homo sapiens
gaaaagcggacaucagcug

SEQ ID NO: 1340816 - RNA, 17 nt, Homo sapiens
gaaaagggagucaugca

SEQ ID NO: 1340817 - RNA, 13 nt, Homo sapiens
gaaaagucuuccu

SEQ ID NO: 1340818 - RNA, 12 nt, Homo sapiens
gaaaauauuuca

SEQ ID NO: 1340819 - RNA, 16 nt, Homo sapiens
gaaaaucacacugucu

SEQ ID NO: 1340820 - RNA, 12 nt, Homo sapiens
gaaaaucuuaca

SEQ ID NO: 1340821 - RNA, 17 nt, Homo sapiens
gaaaaugaaaugcauau

SEQ ID NO: 1340822 - RNA, 23 nt, Homo sapiens
gaaaaugcaacucuaacucugag

SEQ ID NO: 1340823 - RNA, 22 nt, Homo sapiens
gaaaaugcagcagggaugcccu

SEQ ID NO: 1340824 - RNA, 10 nt, Homo sapiens
gaaaauggaa

SEQ ID NO: 1340825 - RNA, 15 nt, Homo sapiens
gaaaaugucuuucuc

SEQ ID NO: 1340826 - RNA, 15 nt, Homo sapiens
gaaacaccaguguua

SEQ ID NO: 1340827 - RNA, 16 nt, Homo sapiens
gaaacaguuucuugcu

SEQ ID NO: 1340828 - RNA, 17 nt, Homo sapiens
gaaacauccuaugaaau

SEQ ID NO: 1340829 - RNA, 20 nt, Homo sapiens
gaaacauugaacucauaucu

SEQ ID NO: 1340830 - RNA, 18 nt, Homo sapiens
gaaaccaacaagaaccac

SEQ ID NO: 1340831 - RNA, 18 nt, Homo sapiens
gaaaccagaaaagcaaua

SEQ ID NO: 1340832 - RNA, 18 nt, Homo sapiens
gaaacggaggccagagag

SEQ ID NO: 1340833 - RNA, 15 nt, Homo sapiens
gaaacuacauuucua

SEQ ID NO: 1340834 - RNA, 23 nt, Homo sapiens
gaaacuccagaugccacaaugga

SEQ ID NO: 1340835 - RNA, 14 nt, Homo sapiens
gaaacuuagaucau

SEQ ID NO: 1340836 - RNA, 17 nt, Homo sapiens
gaaagacuggacucuaa

SEQ ID NO: 1340837 - RNA, 17 nt, Homo sapiens
gaaagaugcaguccuca

SEQ ID NO: 1340838 - RNA, 20 nt, Homo sapiens
gaaagcacaagacuggccca

SEQ ID NO: 1340839 - RNA, 16 nt, Homo sapiens
gaaagccacagacaau

SEQ ID NO: 1340840 - RNA, 17 nt, Homo sapiens
gaaagcuggugucugau

SEQ ID NO: 1340841 - RNA, 16 nt, Homo sapiens
gaaaggaucugugauu

SEQ ID NO: 1340842 - RNA, 23 nt, Homo sapiens
gaaagguuuuauucuauauugcu

SEQ ID NO: 1340843 - RNA, 17 nt, Homo sapiens
gaaagugacaugcauuc

SEQ ID NO: 1340844 - RNA, 16 nt, Homo sapiens
gaaaguggaaaaugac

SEQ ID NO: 1340845 - RNA, 20 nt, Homo sapiens
gaaagugugagcucuucccu

SEQ ID NO: 1340846 - RNA, 19 nt, Homo sapiens
gaaauaaaucacagaugca

SEQ ID NO: 1340847 - RNA, 23 nt, Homo sapiens
gaaauacacagugcugaccagac

SEQ ID NO: 1340848 - RNA, 21 nt, Homo sapiens
gaaauauccacccagcaggca

SEQ ID NO: 1340849 - RNA, 14 nt, Homo sapiens
gaaauauccaggaa

SEQ ID NO: 1340850 - RNA, 23 nt, Homo sapiens
gaaaucaaaagauaguugauucu

SEQ ID NO: 1340851 - RNA, 22 nt, Homo sapiens
gaaaucauaaaggaucagagau

SEQ ID NO: 1340852 - RNA, 20 nt, Homo sapiens
gaaauccguucuauuuugug

SEQ ID NO: 1340853 - RNA, 21 nt, Homo sapiens
gaaaugaaacauccuaugaaa

SEQ ID NO: 1340854 - RNA, 18 nt, Homo sapiens
gaaaugaaaucuucccag

SEQ ID NO: 1340855 - RNA, 18 nt, Homo sapiens
gaaaugauuuacuggaau

SEQ ID NO: 1340856 - RNA, 15 nt, Homo sapiens
gaaaugucaguugcu

SEQ ID NO: 1340857 - RNA, 22 nt, Homo sapiens
gaaauuaaacauauucaaggag

SEQ ID NO: 1340858 - RNA, 20 nt, Homo sapiens
gaaauuaacucagacacaaa

SEQ ID NO: 1340859 - RNA, 19 nt, Homo sapiens
gaacaaaaauuacaaagaa

SEQ ID NO: 1340860 - RNA, 17 nt, Homo sapiens
gaacaagagaaguacua

SEQ ID NO: 1340861 - RNA, 19 nt, Homo sapiens
gaacaauauugacuuuguc

SEQ ID NO: 1340862 - RNA, 15 nt, Homo sapiens
gaacacagugcuauu

SEQ ID NO: 1340863 - RNA, 12 nt, Homo sapiens
gaacacugagaa

SEQ ID NO: 1340864 - RNA, 18 nt, Homo sapiens
gaacagccuuagagcucu

SEQ ID NO: 1340865 - RNA, 17 nt, Homo sapiens
gaacagguucucuuccu

SEQ ID NO: 1340866 - RNA, 15 nt, Homo sapiens
gaacauuauuuaaua

SEQ ID NO: 1340867 - RNA, 10 nt, Homo sapiens
gaaccaaaga

SEQ ID NO: 1340868 - RNA, 22 nt, Homo sapiens
gaaccaaucaagguagaacaaa

SEQ ID NO: 1340869 - RNA, 23 nt, Homo sapiens
gaaccagccguauuuuacaugaa

SEQ ID NO: 1340870 - RNA, 13 nt, Homo sapiens
gaaccaugcagga

SEQ ID NO: 1340871 - RNA, 12 nt, Homo sapiens
gaacccucaggc

SEQ ID NO: 1340872 - RNA, 14 nt, Homo sapiens
gaacccuugcacua

SEQ ID NO: 1340873 - RNA, 19 nt, Homo sapiens
gaaccucagccuggccaga

SEQ ID NO: 1340874 - RNA, 15 nt, Homo sapiens
gaaccuggaacuugg

SEQ ID NO: 1340875 - RNA, 22 nt, Homo sapiens
gaaccuggauccagcacuggug

SEQ ID NO: 1340876 - RNA, 21 nt, Homo sapiens
gaaccuucuggccucccacag

SEQ ID NO: 1340877 - RNA, 21 nt, Homo sapiens
gaacggaggaggacaugggga

SEQ ID NO: 1340878 - RNA, 16 nt, Homo sapiens
gaacuagcauauagcc

SEQ ID NO: 1340879 - RNA, 11 nt, Homo sapiens
gaacucaggga

SEQ ID NO: 1340880 - RNA, 16 nt, Homo sapiens
gaacucauaucuguaa

SEQ ID NO: 1340881 - RNA, 22 nt, Homo sapiens
gaacucucagaaauaaaucaca

SEQ ID NO: 1340882 - RNA, 23 nt, Homo sapiens
gaacucuucuuugcugcauuccu

SEQ ID NO: 1340883 - RNA, 17 nt, Homo sapiens
gaacucuugacuuccug

SEQ ID NO: 1340884 - RNA, 16 nt, Homo sapiens
gaacugagguuuacau

SEQ ID NO: 1340885 - RNA, 15 nt, Homo sapiens
gaacugcauugacuu

SEQ ID NO: 1340886 - RNA, 22 nt, Homo sapiens
gaacugggagcagcucugugac

SEQ ID NO: 1340887 - RNA, 18 nt, Homo sapiens
gaacuguacacagaauug

SEQ ID NO: 1340888 - RNA, 15 nt, Homo sapiens
gaacugugaauugug

SEQ ID NO: 1340889 - RNA, 13 nt, Homo sapiens
gaacuuccaggaa

SEQ ID NO: 1340890 - RNA, 12 nt, Homo sapiens
gaacuuucuccc

SEQ ID NO: 1340891 - RNA, 14 nt, Homo sapiens
gaacuuuuuccucu

SEQ ID NO: 1340892 - RNA, 13 nt, Homo sapiens
gaagaaaaauaau

SEQ ID NO: 1340893 - RNA, 22 nt, Homo sapiens
gaagaacagauaaucccuguau

SEQ ID NO: 1340894 - RNA, 22 nt, Homo sapiens
gaagaaccacgaugaccacaga

SEQ ID NO: 1340895 - RNA, 14 nt, Homo sapiens
gaagaaucugcucu

SEQ ID NO: 1340896 - RNA, 15 nt, Homo sapiens
gaagaaucugcucug

SEQ ID NO: 1340897 - RNA, 17 nt, Homo sapiens
gaagaaucugcucugaa

SEQ ID NO: 1340898 - RNA, 15 nt, Homo sapiens
gaagaggaaagggag

SEQ ID NO: 1340899 - RNA, 16 nt, Homo sapiens
gaagaggagaaaaaga

SEQ ID NO: 1340900 - RNA, 14 nt, Homo sapiens
gaagagggucccuc

SEQ ID NO: 1340901 - RNA, 22 nt, Homo sapiens
gccuguaauccuagcacuuugg

SEQ ID NO: 1340902 - RNA, 21 nt, Homo sapiens
gccuguaaucucagcacuuug

SEQ ID NO: 1340903 - RNA, 14 nt, Homo sapiens
gccuguggcuugua

SEQ ID NO: 1340904 - RNA, 23 nt, Homo sapiens
gccuguuggcaggcccacucccc

SEQ ID NO: 1340905 - RNA, 19 nt, Homo sapiens
gccuuaaacacacauugca

SEQ ID NO: 1340906 - RNA, 14 nt, Homo sapiens
gccuuaagcaaauu

SEQ ID NO: 1340907 - RNA, 13 nt, Homo sapiens
gccuuaccaaagc

SEQ ID NO: 1340908 - RNA, 14 nt, Homo sapiens
gccuugcauugccu

SEQ ID NO: 1340909 - RNA, 20 nt, Homo sapiens
gccuugugugaacucaccaa

SEQ ID NO: 1340910 - RNA, 17 nt, Homo sapiens
gccuuucccucuucccu

SEQ ID NO: 1340911 - RNA, 22 nt, Homo sapiens
gccuuugcccaaaacugucauc

SEQ ID NO: 1340912 - RNA, 23 nt, Homo sapiens
gccuuugggugcuguuuugccag

SEQ ID NO: 1340913 - RNA, 20 nt, Homo sapiens
gcgaacauguguuuucauca

SEQ ID NO: 1340914 - RNA, 18 nt, Homo sapiens
gcgcccagccucaucucu

SEQ ID NO: 1340915 - RNA, 14 nt, Homo sapiens
gcgccuaaagucau

SEQ ID NO: 1340916 - RNA, 14 nt, Homo sapiens
gcgcucgcccagca

SEQ ID NO: 1340917 - RNA, 18 nt, Homo sapiens
gcggccucguuccagugg

SEQ ID NO: 1340918 - RNA, 17 nt, Homo sapiens
gcggcugcacaacagcc

SEQ ID NO: 1340919 - RNA, 22 nt, Homo sapiens
gcgggauuuaugugcacugccu

SEQ ID NO: 1340920 - RNA, 13 nt, Homo sapiens
gcgggcuugacug

SEQ ID NO: 1340921 - RNA, 13 nt, Homo sapiens
gcgugauucaaug

SEQ ID NO: 1340922 - RNA, 20 nt, Homo sapiens
gcgugcgccacuaugccuga

SEQ ID NO: 1340923 - RNA, 22 nt, Homo sapiens
gcguuuuuuaaauguauacuau

SEQ ID NO: 1340924 - RNA, 18 nt, Homo sapiens
gcuaaaacuggcccuguu

SEQ ID NO: 1340925 - RNA, 22 nt, Homo sapiens
gcuaagauacugaugacagugu

SEQ ID NO: 1340926 - RNA, 19 nt, Homo sapiens
gcuaaucuucuuaugcaau

SEQ ID NO: 1340927 - RNA, 12 nt, Homo sapiens
gcuacaccuuuc

SEQ ID NO: 1340928 - RNA, 20 nt, Homo sapiens
gcuacaccuuucuccuuugu

SEQ ID NO: 1340929 - RNA, 18 nt, Homo sapiens
gcuaccccucaaacugca

SEQ ID NO: 1340930 - RNA, 15 nt, Homo sapiens
gcuaccucaaccaau

SEQ ID NO: 1340931 - RNA, 21 nt, Homo sapiens
gcuaccuguucuugggccuca

SEQ ID NO: 1340932 - RNA, 17 nt, Homo sapiens
gcuacuacugcagucuu

SEQ ID NO: 1340933 - RNA, 17 nt, Homo sapiens
gcuacuauguacugccu

SEQ ID NO: 1340934 - RNA, 14 nt, Homo sapiens
gcuagaacauucca

SEQ ID NO: 1340935 - RNA, 17 nt, Homo sapiens
gcuaggaaugaaauccu

SEQ ID NO: 1340936 - RNA, 16 nt, Homo sapiens
gcuagucucugaggga

SEQ ID NO: 1340937 - RNA, 17 nt, Homo sapiens
gcuauaacuuacuucug

SEQ ID NO: 1340938 - RNA, 19 nt, Homo sapiens
gcuauagugacaugcaguu

SEQ ID NO: 1340939 - RNA, 21 nt, Homo sapiens
gcuauauucugagacuuugaa

SEQ ID NO: 1340940 - RNA, 20 nt, Homo sapiens
gcuaucuaauuuuacacucu

SEQ ID NO: 1340941 - RNA, 14 nt, Homo sapiens
gcuaugagcuuuua

SEQ ID NO: 1340942 - RNA, 15 nt, Homo sapiens
gcuauuugcauuucu

SEQ ID NO: 1340943 - RNA, 17 nt, Homo sapiens
gcuauuuuuauacacug

SEQ ID NO: 1340944 - RNA, 17 nt, Homo sapiens
gcucacugcagccucaa

SEQ ID NO: 1340945 - RNA, 22 nt, Homo sapiens
gcucacugugcuggggcacggc

SEQ ID NO: 1340946 - RNA, 16 nt, Homo sapiens
gcucagcccugcacca

SEQ ID NO: 1340947 - RNA, 23 nt, Homo sapiens
gcucagcccugcaccaugcugcu

SEQ ID NO: 1340948 - RNA, 19 nt, Homo sapiens
gcucaggacagaugccaca

SEQ ID NO: 1340949 - RNA, 21 nt, Homo sapiens
gcucagggaaaagcagcucuc

SEQ ID NO: 1340950 - RNA, 15 nt, Homo sapiens
gcuccaacuccauac

SEQ ID NO: 1340951 - RNA, 20 nt, Homo sapiens
gcuccacuuucucauccgaa

SEQ ID NO: 1340952 - RNA, 21 nt, Homo sapiens
gcuccagcucauaugcugaca

SEQ ID NO: 1340953 - RNA, 12 nt, Homo sapiens
gcuccaucucau

SEQ ID NO: 1340954 - RNA, 18 nt, Homo sapiens
gcuccaucucauaggcua

SEQ ID NO: 1340955 - RNA, 19 nt, Homo sapiens
gcucccggagggcccugag

SEQ ID NO: 1340956 - RNA, 15 nt, Homo sapiens
gcucccugacugggg

SEQ ID NO: 1340957 - RNA, 17 nt, Homo sapiens
gcucccugcccugaccu

SEQ ID NO: 1340958 - RNA, 15 nt, Homo sapiens
gcuccucuuagcuca

SEQ ID NO: 1340959 - RNA, 17 nt, Homo sapiens
gcuccugagugucauga

SEQ ID NO: 1340960 - RNA, 22 nt, Homo sapiens
gcucggagcggcgucccuucca

SEQ ID NO: 1340961 - RNA, 20 nt, Homo sapiens
gcucguuuacacugcacauu

SEQ ID NO: 1340962 - RNA, 19 nt, Homo sapiens
gcucuacccugaguucaua

SEQ ID NO: 1340963 - RNA, 15 nt, Homo sapiens
gcucucacagacaua

SEQ ID NO: 1340964 - RNA, 17 nt, Homo sapiens
gcucuccugacuuuuaa

SEQ ID NO: 1340965 - RNA, 16 nt, Homo sapiens
gcucugaaaacaaaaa

SEQ ID NO: 1340966 - RNA, 13 nt, Homo sapiens
gcucugaaauaua

SEQ ID NO: 1340967 - RNA, 22 nt, Homo sapiens
gcucugccccagcuugggcaga

SEQ ID NO: 1340968 - RNA, 20 nt, Homo sapiens
gcucugccccgcagacgguc

SEQ ID NO: 1340969 - RNA, 14 nt, Homo sapiens
gcucugcugcugau

SEQ ID NO: 1340970 - RNA, 15 nt, Homo sapiens
gcucuguaacaucgc

SEQ ID NO: 1340971 - RNA, 13 nt, Homo sapiens
gcucuucacugaa

SEQ ID NO: 1340972 - RNA, 21 nt, Homo sapiens
gcugaaggcaguggcagggga

SEQ ID NO: 1340973 - RNA, 16 nt, Homo sapiens
gcugaauuccuuuaca

SEQ ID NO: 1340974 - RNA, 19 nt, Homo sapiens
gcugacacgcucaguugaa

SEQ ID NO: 1340975 - RNA, 13 nt, Homo sapiens
gcugacuuuggga

SEQ ID NO: 1340976 - RNA, 16 nt, Homo sapiens
gcugaggacacucagu

SEQ ID NO: 1340977 - RNA, 21 nt, Homo sapiens
gcugaggcugaggcacuggcg

SEQ ID NO: 1340978 - RNA, 13 nt, Homo sapiens
gcugauggugaca

SEQ ID NO: 1340979 - RNA, 15 nt, Homo sapiens
gcugauggugacauu

SEQ ID NO: 1340980 - RNA, 19 nt, Homo sapiens
gcugauggugacauugcac

SEQ ID NO: 1340981 - RNA, 20 nt, Homo sapiens
gcugauugucaacacaaacu

SEQ ID NO: 1340982 - RNA, 12 nt, Homo sapiens
gcugcaacccaa

SEQ ID NO: 1340983 - RNA, 24 nt, Homo sapiens
gcugccauuucccuucuggacacu

SEQ ID NO: 1340984 - RNA, 19 nt, Homo sapiens
gcugccugcugugcuggga

SEQ ID NO: 1340985 - RNA, 20 nt, Homo sapiens
gcugcggggcgggcacaccu

SEQ ID NO: 1340986 - RNA, 20 nt, Homo sapiens
gcugcggggggcaccagagg

SEQ ID NO: 1340987 - RNA, 12 nt, Homo sapiens
gcugcuacugcu

SEQ ID NO: 1340988 - RNA, 13 nt, Homo sapiens
gcugcucagggaa

SEQ ID NO: 1340989 - RNA, 18 nt, Homo sapiens
gcugcucucuccgagggg

SEQ ID NO: 1340990 - RNA, 22 nt, Homo sapiens
gcugcugccccuuaaacacagg

SEQ ID NO: 1340991 - RNA, 13 nt, Homo sapiens
gcugcuggggaag

SEQ ID NO: 1340992 - RNA, 14 nt, Homo sapiens
gcuggaaaugcuga

SEQ ID NO: 1340993 - RNA, 15 nt, Homo sapiens
gcuggaguccagugc

SEQ ID NO: 1340994 - RNA, 20 nt, Homo sapiens
gcuggagugcaauggcgcga

SEQ ID NO: 1340995 - RNA, 17 nt, Homo sapiens
gcugggagcacuggugu

SEQ ID NO: 1340996 - RNA, 16 nt, Homo sapiens
gcugggcagaccccuc

SEQ ID NO: 1340997 - RNA, 14 nt, Homo sapiens
gcuggggaugucuc

SEQ ID NO: 1340998 - RNA, 20 nt, Homo sapiens
gcuggggggauguucugccu

SEQ ID NO: 1340999 - RNA, 21 nt, Homo sapiens
gcuguaaaaauguuacgugaa

SEQ ID NO: 1341000 - RNA, 22 nt, Homo sapiens
gcuguaaauccuagacuugaaa

SEQ ID NO: 1341001 - RNA, 22 nt, Homo sapiens
gcugucacuugucgggggccca

SEQ ID NO: 1341002 - RNA, 17 nt, Homo sapiens
gcugucauccacuuuau

SEQ ID NO: 1341003 - RNA, 12 nt, Homo sapiens
gcugucauuaau

SEQ ID NO: 1341004 - RNA, 19 nt, Homo sapiens
gcugucccugcagggccau

SEQ ID NO: 1341005 - RNA, 14 nt, Homo sapiens
gcuguccugucagu

SEQ ID NO: 1341006 - RNA, 19 nt, Homo sapiens
gcugugaucacuccagugc

SEQ ID NO: 1341007 - RNA, 12 nt, Homo sapiens
gcuguguguucu

SEQ ID NO: 1341008 - RNA, 20 nt, Homo sapiens
gcuguuaauauaguuuagga

SEQ ID NO: 1341009 - RNA, 19 nt, Homo sapiens
gcuguugguaaagcacaug

SEQ ID NO: 1341010 - RNA, 12 nt, Homo sapiens
gcuguugucaca

SEQ ID NO: 1341011 - RNA, 13 nt, Homo sapiens
gcuguugugaagc

SEQ ID NO: 1341012 - RNA, 15 nt, Homo sapiens
gcuguuuguagugaa

SEQ ID NO: 1341013 - RNA, 19 nt, Homo sapiens
gcuuacacggaugccuucc

SEQ ID NO: 1341014 - RNA, 13 nt, Homo sapiens
gcuuaccccuuca

SEQ ID NO: 1341015 - RNA, 23 nt, Homo sapiens
gcuuaguagagcuuuuugcaugu

SEQ ID NO: 1341016 - RNA, 13 nt, Homo sapiens
gcuuaugaauaua

SEQ ID NO: 1341017 - RNA, 16 nt, Homo sapiens
gcuucaccccaauccc

SEQ ID NO: 1341018 - RNA, 23 nt, Homo sapiens
gcuuccccuuuugccaaucucaa

SEQ ID NO: 1341019 - RNA, 21 nt, Homo sapiens
gcuucucagauuucugaggaa

SEQ ID NO: 1341020 - RNA, 15 nt, Homo sapiens
gcuucuccaaaggga

SEQ ID NO: 1341021 - RNA, 16 nt, Homo sapiens
gcuucucccaguguga

SEQ ID NO: 1341022 - RNA, 17 nt, Homo sapiens
gcuucucucuccagggu

SEQ ID NO: 1341023 - RNA, 19 nt, Homo sapiens
gcuucucuugagucacacu

SEQ ID NO: 1341024 - RNA, 14 nt, Homo sapiens
gcuucugauaugca

SEQ ID NO: 1341025 - RNA, 12 nt, Homo sapiens
gcuugaaauuga

SEQ ID NO: 1341026 - RNA, 21 nt, Homo sapiens
gcuugcccuguuaaaagauga

SEQ ID NO: 1341027 - RNA, 15 nt, Homo sapiens
gcuugccugaagcuu

SEQ ID NO: 1341028 - RNA, 14 nt, Homo sapiens
gcuuggaagccagg

SEQ ID NO: 1341029 - RNA, 17 nt, Homo sapiens
gcuuggaagccagguac

SEQ ID NO: 1341030 - RNA, 18 nt, Homo sapiens
gcuuuaaaaaacacaguc

SEQ ID NO: 1341031 - RNA, 20 nt, Homo sapiens
gcuuuaaaacaaagggaaaa

SEQ ID NO: 1341032 - RNA, 18 nt, Homo sapiens
gcuuuaaugucuaaccaa

SEQ ID NO: 1341033 - RNA, 19 nt, Homo sapiens
guugaucuggaacccagac

SEQ ID NO: 1341034 - RNA, 18 nt, Homo sapiens
guugcagccagggccagu

SEQ ID NO: 1341035 - RNA, 14 nt, Homo sapiens
guugccacauuuag

SEQ ID NO: 1341036 - RNA, 23 nt, Homo sapiens
guugcccaggcuagagugcaaug

SEQ ID NO: 1341037 - RNA, 22 nt, Homo sapiens
guugccugggggcuuuugccac

SEQ ID NO: 1341038 - RNA, 19 nt, Homo sapiens
guugccuuuauauccaaaa

SEQ ID NO: 1341039 - RNA, 15 nt, Homo sapiens
guugcuggacuguca

SEQ ID NO: 1341040 - RNA, 18 nt, Homo sapiens
guuggagugcucuuccca

SEQ ID NO: 1341041 - RNA, 16 nt, Homo sapiens
guugggccccugagga

SEQ ID NO: 1341042 - RNA, 22 nt, Homo sapiens
guuggucugccuucugcugaaa

SEQ ID NO: 1341043 - RNA, 14 nt, Homo sapiens
guuguaaugcugca

SEQ ID NO: 1341044 - RNA, 21 nt, Homo sapiens
guuguauucauuguggucaua

SEQ ID NO: 1341045 - RNA, 21 nt, Homo sapiens
guugucugaagucacugcaca

SEQ ID NO: 1341046 - RNA, 21 nt, Homo sapiens
guuguucuaaaggcuguuaaa

SEQ ID NO: 1341047 - RNA, 15 nt, Homo sapiens
guuuaaaugucaaau

SEQ ID NO: 1341048 - RNA, 19 nt, Homo sapiens
guuuacacugcacauugaa

SEQ ID NO: 1341049 - RNA, 17 nt, Homo sapiens
guuuagaugaaugucag

SEQ ID NO: 1341050 - RNA, 16 nt, Homo sapiens
guuuauauaaggaaua

SEQ ID NO: 1341051 - RNA, 20 nt, Homo sapiens
guuuauauggauaaucugag

SEQ ID NO: 1341052 - RNA, 21 nt, Homo sapiens
guuucauuuagucaugugacc

SEQ ID NO: 1341053 - RNA, 12 nt, Homo sapiens
guuuccugaaac

SEQ ID NO: 1341054 - RNA, 13 nt, Homo sapiens
guuuccuggucag

SEQ ID NO: 1341055 - RNA, 16 nt, Homo sapiens
guuucgacugguccag

SEQ ID NO: 1341056 - RNA, 20 nt, Homo sapiens
guuucuugcuuggaagccag

SEQ ID NO: 1341057 - RNA, 12 nt, Homo sapiens
guuugcauuucc

SEQ ID NO: 1341058 - RNA, 14 nt, Homo sapiens
guuugcuuauaugu

SEQ ID NO: 1341059 - RNA, 17 nt, Homo sapiens
guuuggacagcugauaa

SEQ ID NO: 1341060 - RNA, 14 nt, Homo sapiens
guuuguagugaaau

SEQ ID NO: 1341061 - RNA, 18 nt, Homo sapiens
guuuguugccccauuccu

SEQ ID NO: 1341062 - RNA, 15 nt, Homo sapiens
guuuguuuuugcaca

SEQ ID NO: 1341063 - RNA, 17 nt, Homo sapiens
guuuuaaguacuacaca

SEQ ID NO: 1341064 - RNA, 19 nt, Homo sapiens
guuuuaauuuucuuguaua

SEQ ID NO: 1341065 - RNA, 16 nt, Homo sapiens
guuuuagaaccagccg

SEQ ID NO: 1341066 - RNA, 19 nt, Homo sapiens
guuuuccucccuucugcua

SEQ ID NO: 1341067 - RNA, 23 nt, Homo sapiens
guuuuccuucuucccaauagaag

SEQ ID NO: 1341068 - RNA, 18 nt, Homo sapiens
guuuuucauucacuuuaa

SEQ ID NO: 1341069 - RNA, 16 nt, Homo sapiens
guuuuugaaauaccuu

SEQ ID NO: 1341070 - RNA, 13 nt, Homo sapiens
uaaaaaaacugga

SEQ ID NO: 1341071 - RNA, 18 nt, Homo sapiens
uaaaaagcagcugcauuu

SEQ ID NO: 1341072 - RNA, 23 nt, Homo sapiens
uaaaaaguuguucuuuguuucca

SEQ ID NO: 1341073 - RNA, 19 nt, Homo sapiens
uaaaaauggccauuugcuu

SEQ ID NO: 1341074 - RNA, 16 nt, Homo sapiens
uaaaaauguccugccu

SEQ ID NO: 1341075 - RNA, 19 nt, Homo sapiens
uaaaaauuuauaagcauuu

SEQ ID NO: 1341076 - RNA, 16 nt, Homo sapiens
uaaaacaauaauaaua

SEQ ID NO: 1341077 - RNA, 14 nt, Homo sapiens
uaaaaccacagcag

SEQ ID NO: 1341078 - RNA, 15 nt, Homo sapiens
uaaaaccccaucucu

SEQ ID NO: 1341079 - RNA, 19 nt, Homo sapiens
uaaaaccccaucucuacua

SEQ ID NO: 1341080 - RNA, 21 nt, Homo sapiens
uaaaaccccaucucuacuaaa

SEQ ID NO: 1341081 - RNA, 22 nt, Homo sapiens
uaaaaccccaucucuacuaaaa

SEQ ID NO: 1341082 - RNA, 17 nt, Homo sapiens
uaaaaccuugaaggucu

SEQ ID NO: 1341083 - RNA, 23 nt, Homo sapiens
uaaaacugaacuucagagcauga

SEQ ID NO: 1341084 - RNA, 14 nt, Homo sapiens
uaaaacuggcccug

SEQ ID NO: 1341085 - RNA, 18 nt, Homo sapiens
uaaaacuggcccuguuuc

SEQ ID NO: 1341086 - RNA, 18 nt, Homo sapiens
uaaaagaaaacacuguca

SEQ ID NO: 1341087 - RNA, 20 nt, Homo sapiens
uaaaagaaguuuuccagugg

SEQ ID NO: 1341088 - RNA, 17 nt, Homo sapiens
uaaaagacguugccuau

SEQ ID NO: 1341089 - RNA, 23 nt, Homo sapiens
uaaaagcacacucauccccucac

SEQ ID NO: 1341090 - RNA, 13 nt, Homo sapiens
uaaaagcauuuug

SEQ ID NO: 1341091 - RNA, 23 nt, Homo sapiens
uaaaagcccuagacuggugcuaa

SEQ ID NO: 1341092 - RNA, 18 nt, Homo sapiens
uaaaaggaaauguaaaag

SEQ ID NO: 1341093 - RNA, 24 nt, Homo sapiens
uaaaaggaaauguaaaagcacaug

SEQ ID NO: 1341094 - RNA, 16 nt, Homo sapiens
uaaaaggcaagucaaa

SEQ ID NO: 1341095 - RNA, 23 nt, Homo sapiens
uaaaaggcaagucaaauaccaca

SEQ ID NO: 1341096 - RNA, 15 nt, Homo sapiens
uaaaauaaaccaaau

SEQ ID NO: 1341097 - RNA, 15 nt, Homo sapiens
uaaaauacacacuca

SEQ ID NO: 1341098 - RNA, 16 nt, Homo sapiens
uaaaauacacacucaa

SEQ ID NO: 1341099 - RNA, 17 nt, Homo sapiens
uaaaauacacacucaaa

SEQ ID NO: 1341100 - RNA, 15 nt, Homo sapiens
uaaaauagcuuugca

SEQ ID NO: 1341101 - RNA, 22 nt, Homo sapiens
uaaaauauguaguugugucuua

SEQ ID NO: 1341102 - RNA, 23 nt, Homo sapiens
uaaaauauguaguugugucuuaa

SEQ ID NO: 1341103 - RNA, 22 nt, Homo sapiens
uaaaaugcuggugaaaugcugu

SEQ ID NO: 1341104 - RNA, 22 nt, Homo sapiens
uaaaauggcagagaagaugaaa

SEQ ID NO: 1341105 - RNA, 23 nt, Homo sapiens
uaaaauuagaaucugaguauaaa

SEQ ID NO: 1341106 - RNA, 20 nt, Homo sapiens
uaaaauugggcuugugauuu

SEQ ID NO: 1341107 - RNA, 11 nt, Homo sapiens
uaaaauuguga

SEQ ID NO: 1341108 - RNA, 12 nt, Homo sapiens
uaaaauugugag

SEQ ID NO: 1341109 - RNA, 14 nt, Homo sapiens
uaaaauugugaugu

SEQ ID NO: 1341110 - RNA, 16 nt, Homo sapiens
uaaaauuuaacucaca

SEQ ID NO: 1341111 - RNA, 18 nt, Homo sapiens
uaaacaaaaaacccacaa

SEQ ID NO: 1341112 - RNA, 14 nt, Homo sapiens
uaaacaaagacauu

SEQ ID NO: 1341113 - RNA, 14 nt, Homo sapiens
uaaacaaauaacaa

SEQ ID NO: 1341114 - RNA, 17 nt, Homo sapiens
uaaacaaauaacaaugu

SEQ ID NO: 1341115 - RNA, 18 nt, Homo sapiens
uaaacagacaggaauuua

SEQ ID NO: 1341116 - RNA, 20 nt, Homo sapiens
uaaacaguaaaccuuaacag

SEQ ID NO: 1341117 - RNA, 19 nt, Homo sapiens
uaaacauauucaaggagca

SEQ ID NO: 1341118 - RNA, 16 nt, Homo sapiens
uaaacauugugaucau

SEQ ID NO: 1341119 - RNA, 19 nt, Homo sapiens
uaaacauuuugacacaaaa

SEQ ID NO: 1341120 - RNA, 12 nt, Homo sapiens
uaaaccaaaaac

SEQ ID NO: 1341121 - RNA, 18 nt, Homo sapiens
uaaaccacuaguugaugu

SEQ ID NO: 1341122 - RNA, 13 nt, Homo sapiens
uaaaccauaaaau

SEQ ID NO: 1341123 - RNA, 21 nt, Homo sapiens
uaaaccuugaagggcuuuauu

SEQ ID NO: 1341124 - RNA, 17 nt, Homo sapiens
uaaacgguuccugguga

SEQ ID NO: 1341125 - RNA, 18 nt, Homo sapiens
uaaacgguuccuggugac

SEQ ID NO: 1341126 - RNA, 18 nt, Homo sapiens
uaaacuaguguuauacuu

SEQ ID NO: 1341127 - RNA, 21 nt, Homo sapiens
uaaacucaaccuaacacauua

SEQ ID NO: 1341128 - RNA, 15 nt, Homo sapiens
uaaacucuguugcaa

SEQ ID NO: 1341129 - RNA, 13 nt, Homo sapiens
uaaacugaguuua

SEQ ID NO: 1341130 - RNA, 19 nt, Homo sapiens
uaaacugcugaauucaccu

SEQ ID NO: 1341131 - RNA, 19 nt, Homo sapiens
uaaacuuugaagcaacugu

SEQ ID NO: 1341132 - RNA, 17 nt, Homo sapiens
uaaagaaaugcacuugc

SEQ ID NO: 1341133 - RNA, 12 nt, Homo sapiens
uaaagaauacac

SEQ ID NO: 1341134 - RNA, 15 nt, Homo sapiens
uaaagaauagcuuua

SEQ ID NO: 1341135 - RNA, 20 nt, Homo sapiens
uaaagaccugacaccuuuca

SEQ ID NO: 1341136 - RNA, 20 nt, Homo sapiens
uaaagaggaauggcccucau

SEQ ID NO: 1341137 - RNA, 15 nt, Homo sapiens
uaaagauacaguguc

SEQ ID NO: 1341138 - RNA, 18 nt, Homo sapiens
uaaagcguuugcauuugc

SEQ ID NO: 1341139 - RNA, 19 nt, Homo sapiens
uaaaggaacuaauccucac

SEQ ID NO: 1341140 - RNA, 19 nt, Homo sapiens
uaaaggccaggacgggcca

SEQ ID NO: 1341141 - RNA, 17 nt, Homo sapiens
uaaagucuguugauuaa

SEQ ID NO: 1341142 - RNA, 14 nt, Homo sapiens
uaaagugacagaug

SEQ ID NO: 1341143 - RNA, 16 nt, Homo sapiens
uaaagugcccagcaca

SEQ ID NO: 1341144 - RNA, 17 nt, Homo sapiens
uaaaguggaaguaugua

SEQ ID NO: 1341145 - RNA, 23 nt, Homo sapiens
uaaagugucaccccucacuguga

SEQ ID NO: 1341146 - RNA, 21 nt, Homo sapiens
uaaauaaauguaauagccaaa

SEQ ID NO: 1341147 - RNA, 21 nt, Homo sapiens
uaaauaaguaaaagcuacuau

SEQ ID NO: 1341148 - RNA, 15 nt, Homo sapiens
uaaauaauucuuccu

SEQ ID NO: 1341149 - RNA, 20 nt, Homo sapiens
uaaauauauauauauuucuc

SEQ ID NO: 1341150 - RNA, 20 nt, Homo sapiens
uaaauauauuuuagugacag

SEQ ID NO: 1341151 - RNA, 16 nt, Homo sapiens
uaaaucacacauucag

SEQ ID NO: 1341152 - RNA, 19 nt, Homo sapiens
uaaaucauucuuacuaaaa

SEQ ID NO: 1341153 - RNA, 17 nt, Homo sapiens
uaaauccauccauccaa

SEQ ID NO: 1341154 - RNA, 15 nt, Homo sapiens
uaaauccaugguguu

SEQ ID NO: 1341155 - RNA, 22 nt, Homo sapiens
uaaaugaaacuuaagaauugaa

SEQ ID NO: 1341156 - RNA, 12 nt, Homo sapiens
uaaaugaucucu

SEQ ID NO: 1341157 - RNA, 14 nt, Homo sapiens
uaaauguauacuau

SEQ ID NO: 1341158 - RNA, 14 nt, Homo sapiens
uaaauguccacuua

SEQ ID NO: 1341159 - RNA, 14 nt, Homo sapiens
uaaaugugacucag

SEQ ID NO: 1341160 - RNA, 19 nt, Homo sapiens
uaaaugugacucagcauca

SEQ ID NO: 1341161 - RNA, 12 nt, Homo sapiens
uaaaugugauau

SEQ ID NO: 1341162 - RNA, 16 nt, Homo sapiens
uaaauguuaugacuau

SEQ ID NO: 1341163 - RNA, 15 nt, Homo sapiens
uaaauguucuaacag

SEQ ID NO: 1341164 - RNA, 15 nt, Homo sapiens
uaaauguugcaaugc

SEQ ID NO: 1341165 - RNA, 19 nt, Homo sapiens
uguguggucaacauuucuc

SEQ ID NO: 1341166 - RNA, 21 nt, Homo sapiens
uguguguucuggggcaaccua

SEQ ID NO: 1341167 - RNA, 23 nt, Homo sapiens
uguguugcagccucaaccaacaa

SEQ ID NO: 1341168 - RNA, 20 nt, Homo sapiens
uguuaauuuaugaauauuag

SEQ ID NO: 1341169 - RNA, 18 nt, Homo sapiens
uguuacagguuacgugag

SEQ ID NO: 1341170 - RNA, 14 nt, Homo sapiens
uguuagagcagaga

SEQ ID NO: 1341171 - RNA, 20 nt, Homo sapiens
uguuauguauuccuaugaca

SEQ ID NO: 1341172 - RNA, 15 nt, Homo sapiens
uguuauuaacagaua

SEQ ID NO: 1341173 - RNA, 22 nt, Homo sapiens
uguuauuuuguauaaaugggaa

SEQ ID NO: 1341174 - RNA, 14 nt, Homo sapiens
uguucaaggcagug

SEQ ID NO: 1341175 - RNA, 20 nt, Homo sapiens
uguucacagccagacuggca

SEQ ID NO: 1341176 - RNA, 21 nt, Homo sapiens
uguuccaguacuauggagugc

SEQ ID NO: 1341177 - RNA, 22 nt, Homo sapiens
uguuccaguuugaagaccaauc

SEQ ID NO: 1341178 - RNA, 13 nt, Homo sapiens
uguuccccagaga

SEQ ID NO: 1341179 - RNA, 18 nt, Homo sapiens
uguuccuuauauuuacuc

SEQ ID NO: 1341180 - RNA, 22 nt, Homo sapiens
uguucugccucucccugggucu

SEQ ID NO: 1341181 - RNA, 19 nt, Homo sapiens
uguucugcgcuguguacaa

SEQ ID NO: 1341182 - RNA, 22 nt, Homo sapiens
uguucuguuggaugacuuugag

SEQ ID NO: 1341183 - RNA, 17 nt, Homo sapiens
uguugaaaauguucaga

SEQ ID NO: 1341184 - RNA, 18 nt, Homo sapiens
uguugagaggaacaagaa

SEQ ID NO: 1341185 - RNA, 11 nt, Homo sapiens
uguugcaaugc

SEQ ID NO: 1341186 - RNA, 21 nt, Homo sapiens
uguugcagccucaaccaacaa

SEQ ID NO: 1341187 - RNA, 14 nt, Homo sapiens
uguugcauauacca

SEQ ID NO: 1341188 - RNA, 20 nt, Homo sapiens
uguugcccaggcuggagugc

SEQ ID NO: 1341189 - RNA, 16 nt, Homo sapiens
uguuggcauagcucug

SEQ ID NO: 1341190 - RNA, 19 nt, Homo sapiens
uguuggguuguuacagagu

SEQ ID NO: 1341191 - RNA, 19 nt, Homo sapiens
uguugguauuuucagagaa

SEQ ID NO: 1341192 - RNA, 19 nt, Homo sapiens
uguuuauuugcacuaugag

SEQ ID NO: 1341193 - RNA, 17 nt, Homo sapiens
uguuuccagcuugcauu

SEQ ID NO: 1341194 - RNA, 22 nt, Homo sapiens
uguuucccaucacuguauccau

SEQ ID NO: 1341195 - RNA, 13 nt, Homo sapiens
uguuucuggucuu

SEQ ID NO: 1341196 - RNA, 21 nt, Homo sapiens
uguuucuuucucugaggacaa

SEQ ID NO: 1341197 - RNA, 16 nt, Homo sapiens
uguuugauacaguauu

SEQ ID NO: 1341198 - RNA, 18 nt, Homo sapiens
uguuuggaauauuccacu

SEQ ID NO: 1341199 - RNA, 19 nt, Homo sapiens
uguuuuaaguacuacacau

SEQ ID NO: 1341200 - RNA, 22 nt, Homo sapiens
uguuuuaauccuuaacacauuc

SEQ ID NO: 1341201 - RNA, 15 nt, Homo sapiens
uguuuuguacuuuag

SEQ ID NO: 1341202 - RNA, 19 nt, Homo sapiens
uguuuuuuuuuuccacuua

SEQ ID NO: 1341203 - RNA, 20 nt, Homo sapiens
uuaaaaaaaaauacugaugu

SEQ ID NO: 1341204 - RNA, 13 nt, Homo sapiens
uuaaaaaacagag

SEQ ID NO: 1341205 - RNA, 23 nt, Homo sapiens
uuaaaaaaguuggguuuucucca

SEQ ID NO: 1341206 - RNA, 14 nt, Homo sapiens
uuaaaacacuuuca

SEQ ID NO: 1341207 - RNA, 21 nt, Homo sapiens
uuaaaaggaaauguaaaagca

SEQ ID NO: 1341208 - RNA, 22 nt, Homo sapiens
uuaaaauccaaagugucauauu

SEQ ID NO: 1341209 - RNA, 16 nt, Homo sapiens
uuaaaaucugugaaga

SEQ ID NO: 1341210 - RNA, 22 nt, Homo sapiens
uuaaaaugcuuacauuugaacu

SEQ ID NO: 1341211 - RNA, 14 nt, Homo sapiens
uuaaaaugugaaga

SEQ ID NO: 1341212 - RNA, 19 nt, Homo sapiens
uuaaacacacauugcagcu

SEQ ID NO: 1341213 - RNA, 16 nt, Homo sapiens
uuaaacagugucauau

SEQ ID NO: 1341214 - RNA, 12 nt, Homo sapiens
uuaaaccaccua

SEQ ID NO: 1341215 - RNA, 20 nt, Homo sapiens
uuaaacugauuacguuuaca

SEQ ID NO: 1341216 - RNA, 17 nt, Homo sapiens
uuaaacuuugaagcaac

SEQ ID NO: 1341217 - RNA, 15 nt, Homo sapiens
uuaaagaaaaccaca

SEQ ID NO: 1341218 - RNA, 16 nt, Homo sapiens
uuaaauaaaagcacaa

SEQ ID NO: 1341219 - RNA, 20 nt, Homo sapiens
uuaaauaagauuuaauucac

SEQ ID NO: 1341220 - RNA, 21 nt, Homo sapiens
uuaaauaagauuuaauucaca

SEQ ID NO: 1341221 - RNA, 22 nt, Homo sapiens
uuaaauaaguaaaagcuacuau

SEQ ID NO: 1341222 - RNA, 14 nt, Homo sapiens
uuaaauagcauuau

SEQ ID NO: 1341223 - RNA, 16 nt, Homo sapiens
uuaaauagcuucagaa

SEQ ID NO: 1341224 - RNA, 21 nt, Homo sapiens
uuaaauuauguuuuacuguuc

SEQ ID NO: 1341225 - RNA, 20 nt, Homo sapiens
uuaaauugaauaaaauacuc

SEQ ID NO: 1341226 - RNA, 18 nt, Homo sapiens
uuaacaugggcucuucac

SEQ ID NO: 1341227 - RNA, 13 nt, Homo sapiens
uuaacggugcuaa

SEQ ID NO: 1341228 - RNA, 14 nt, Homo sapiens
uuaacggugcuaaa

SEQ ID NO: 1341229 - RNA, 15 nt, Homo sapiens
uuaacuaugacagau

SEQ ID NO: 1341230 - RNA, 18 nt, Homo sapiens
uuaacucacacugcccag

SEQ ID NO: 1341231 - RNA, 20 nt, Homo sapiens
uuaacugauuaaaaauaccu

SEQ ID NO: 1341232 - RNA, 21 nt, Homo sapiens
uuaacuuccaauuuacauacu

SEQ ID NO: 1341233 - RNA, 22 nt, Homo sapiens
uuaacuucuguuuuaccagcau

SEQ ID NO: 1341234 - RNA, 23 nt, Homo sapiens
uuaacuuguaaaugaaaaaauuc

SEQ ID NO: 1341235 - RNA, 19 nt, Homo sapiens
uuaagaaguaagcaacuag

SEQ ID NO: 1341236 - RNA, 15 nt, Homo sapiens
uuaagaguaacaguu

SEQ ID NO: 1341237 - RNA, 17 nt, Homo sapiens
uuaagaguaacaguuug

SEQ ID NO: 1341238 - RNA, 18 nt, Homo sapiens
uuaagcagcgccagugac

SEQ ID NO: 1341239 - RNA, 20 nt, Homo sapiens
uuaaggcaaugguuucacau

SEQ ID NO: 1341240 - RNA, 19 nt, Homo sapiens
uuaaggucuaaucagugau

SEQ ID NO: 1341241 - RNA, 20 nt, Homo sapiens
uuaauagcaacagagcacuu

SEQ ID NO: 1341242 - RNA, 13 nt, Homo sapiens
uuaauauaguuua

SEQ ID NO: 1341243 - RNA, 20 nt, Homo sapiens
uuaaucacaggaucccacga

SEQ ID NO: 1341244 - RNA, 21 nt, Homo sapiens
uuaauggcagcuagugccuuu

SEQ ID NO: 1341245 - RNA, 17 nt, Homo sapiens
uuaaugucuaaccaaga

SEQ ID NO: 1341246 - RNA, 15 nt, Homo sapiens
uuaauugccagcaaa

SEQ ID NO: 1341247 - RNA, 24 nt, Homo sapiens
uuacaaagggccaucguucaucca

SEQ ID NO: 1341248 - RNA, 20 nt, Homo sapiens
uuacaaguuucuagcucuca

SEQ ID NO: 1341249 - RNA, 18 nt, Homo sapiens
uuacaauuuaaugcacua

SEQ ID NO: 1341250 - RNA, 14 nt, Homo sapiens
uuacacaaagggaa

SEQ ID NO: 1341251 - RNA, 23 nt, Homo sapiens
uuacacacuggaaauugaaauaa

SEQ ID NO: 1341252 - RNA, 19 nt, Homo sapiens
uuacacugugucauucugu

SEQ ID NO: 1341253 - RNA, 24 nt, Homo sapiens
uuacagcugccugcaguacuuuac

SEQ ID NO: 1341254 - RNA, 19 nt, Homo sapiens
uuacagguuacgugagaac

SEQ ID NO: 1341255 - RNA, 11 nt, Homo sapiens
uuacaguucug

SEQ ID NO: 1341256 - RNA, 14 nt, Homo sapiens
uuacaugaagcaga

SEQ ID NO: 1341257 - RNA, 14 nt, Homo sapiens
uuacauuucaccua

SEQ ID NO: 1341258 - RNA, 14 nt, Homo sapiens
uuaccaaaaaagga

SEQ ID NO: 1341259 - RNA, 20 nt, Homo sapiens
uuaccaaagcaucaauacaa

SEQ ID NO: 1341260 - RNA, 19 nt, Homo sapiens
uuacccacacacagauaaa

SEQ ID NO: 1341261 - RNA, 22 nt, Homo sapiens
uuaccccuuuucggccccaugu

SEQ ID NO: 1341262 - RNA, 22 nt, Homo sapiens
uuacccuaaagugcaaaaguga

SEQ ID NO: 1341263 - RNA, 16 nt, Homo sapiens
uuaccuuuguucccaa

SEQ ID NO: 1341264 - RNA, 16 nt, Homo sapiens
uuacgaucucuugaca

SEQ ID NO: 1341265 - RNA, 21 nt, Homo sapiens
uuacguguaaaggaaaauaau

SEQ ID NO: 1341266 - RNA, 15 nt, Homo sapiens
uuacguuuacauucu

SEQ ID NO: 1341267 - RNA, 18 nt, Homo sapiens
uuacuaaaguacagacau

SEQ ID NO: 1341268 - RNA, 23 nt, Homo sapiens
uuacucacaccuguaaucccagc

SEQ ID NO: 1341269 - RNA, 13 nt, Homo sapiens
uuacugauauuau

SEQ ID NO: 1341270 - RNA, 14 nt, Homo sapiens
uuacugcacucaga

SEQ ID NO: 1341271 - RNA, 22 nt, Homo sapiens
uuacugcccuuucaaagcacuu

SEQ ID NO: 1341272 - RNA, 23 nt, Homo sapiens
uuagaaaauaaaauuuaacucac

SEQ ID NO: 1341273 - RNA, 17 nt, Homo sapiens
uuagaaacacugcaaau

SEQ ID NO: 1341274 - RNA, 15 nt, Homo sapiens
uuagaaauugcauuu

SEQ ID NO: 1341275 - RNA, 20 nt, Homo sapiens
uuagaaugucaguugaucag

SEQ ID NO: 1341276 - RNA, 16 nt, Homo sapiens
uuagaauguugaaaag

SEQ ID NO: 1341277 - RNA, 21 nt, Homo sapiens
uuagacccgcccuccccuuuu

SEQ ID NO: 1341278 - RNA, 16 nt, Homo sapiens
uuagagcugccugugc

SEQ ID NO: 1341279 - RNA, 19 nt, Homo sapiens
uuagaguaaugaaauggag

SEQ ID NO: 1341280 - RNA, 20 nt, Homo sapiens
uuagauguaauuuuguguaa

SEQ ID NO: 1341281 - RNA, 16 nt, Homo sapiens
uuagcaauaacauaca

SEQ ID NO: 1341282 - RNA, 16 nt, Homo sapiens
uuagccauaaauugcu

SEQ ID NO: 1341283 - RNA, 15 nt, Homo sapiens
uuaggcaaagauaau

SEQ ID NO: 1341284 - RNA, 21 nt, Homo sapiens
uuaggcgggauuuaugugcac

SEQ ID NO: 1341285 - RNA, 16 nt, Homo sapiens
uuagguaagacauaua

SEQ ID NO: 1341286 - RNA, 15 nt, Homo sapiens
uuagugagacuagac

SEQ ID NO: 1341287 - RNA, 10 nt, Homo sapiens
uuaguuccca

SEQ ID NO: 1341288 - RNA, 13 nt, Homo sapiens
uuauaauuggaag

SEQ ID NO: 1341289 - RNA, 17 nt, Homo sapiens
uuauacaaugauaucca

SEQ ID NO: 1341290 - RNA, 13 nt, Homo sapiens
uuauacaccagca

SEQ ID NO: 1341291 - RNA, 22 nt, Homo sapiens
uuauacaccagcaauuuagaca

SEQ ID NO: 1341292 - RNA, 15 nt, Homo sapiens
uuauacuacaauaau

SEQ ID NO: 1341293 - RNA, 15 nt, Homo sapiens
uuauacuucuuuauu

SEQ ID NO: 1341294 - RNA, 23 nt, Homo sapiens
uuauaggccugucccuugccucu

SEQ ID NO: 1341295 - RNA, 15 nt, Homo sapiens
uuauaucagaguaug

SEQ ID NO: 1341296 - RNA, 12 nt, Homo sapiens
aaaaaaguucau

SEQ ID NO: 1341297 - RNA, 18 nt, Homo sapiens
aaaaacucaggcaaagaa

SEQ ID NO: 1341298 - RNA, 12 nt, Homo sapiens
aaaaagacauaa

SEQ ID NO: 1341299 - RNA, 16 nt, Homo sapiens
aaaaaggaauccucug

SEQ ID NO: 1341300 - RNA, 19 nt, Homo sapiens
aaaaauagacuuaaaucuc

SEQ ID NO: 1341301 - RNA, 21 nt, Homo sapiens
aaaaauauauaugcauaccug

SEQ ID NO: 1341302 - RNA, 16 nt, Homo sapiens
aaaaaucucccaguga

SEQ ID NO: 1341303 - RNA, 14 nt, Homo sapiens
aaaaauggguguua

SEQ ID NO: 1341304 - RNA, 12 nt, Homo sapiens
aaaaauugucau

SEQ ID NO: 1341305 - RNA, 20 nt, Homo sapiens
aaaacaaguuuagaaagcug

SEQ ID NO: 1341306 - RNA, 17 nt, Homo sapiens
aaaacaauucugugaca

SEQ ID NO: 1341307 - RNA, 16 nt, Homo sapiens
aaaacacuaacuuaau

SEQ ID NO: 1341308 - RNA, 22 nt, Homo sapiens
aaaacagcuuugucuccaaaga

SEQ ID NO: 1341309 - RNA, 19 nt, Homo sapiens
aaaacauaacugauaccaa

SEQ ID NO: 1341310 - RNA, 18 nt, Homo sapiens
aaaaccacagcaguugaa

SEQ ID NO: 1341311 - RNA, 12 nt, Homo sapiens
aaaaccacuuuu

SEQ ID NO: 1341312 - RNA, 13 nt, Homo sapiens
aaaaccacuuuuu

SEQ ID NO: 1341313 - RNA, 18 nt, Homo sapiens
aaaacccacaauugaacu

SEQ ID NO: 1341314 - RNA, 14 nt, Homo sapiens
aaaaccuauuccac

SEQ ID NO: 1341315 - RNA, 18 nt, Homo sapiens
aaaacuacugacagggag

SEQ ID NO: 1341316 - RNA, 13 nt, Homo sapiens
aaaacucuggguc

SEQ ID NO: 1341317 - RNA, 23 nt, Homo sapiens
aaaacugaaagugaaaguccaga

SEQ ID NO: 1341318 - RNA, 17 nt, Homo sapiens
aaaacugucauccuaac

SEQ ID NO: 1341319 - RNA, 15 nt, Homo sapiens
aaaacuuuacuuuca

SEQ ID NO: 1341320 - RNA, 15 nt, Homo sapiens
aaaagacuccaaaga

SEQ ID NO: 1341321 - RNA, 16 nt, Homo sapiens
aaaagcacaaguacuu

SEQ ID NO: 1341322 - RNA, 23 nt, Homo sapiens
aaaaggaucguuuuuuuuugcuu

SEQ ID NO: 1341323 - RNA, 22 nt, Homo sapiens
aaaaggccauuuacaauugcau

SEQ ID NO: 1341324 - RNA, 16 nt, Homo sapiens
aaaagguaacuguaca

SEQ ID NO: 1341325 - RNA, 13 nt, Homo sapiens
aaaaguacauauu

SEQ ID NO: 1341326 - RNA, 18 nt, Homo sapiens
aaaaguauccugcuucug

SEQ ID NO: 1341327 - RNA, 14 nt, Homo sapiens
aaaagucacuuacu

SEQ ID NO: 1341328 - RNA, 11 nt, Homo sapiens
aaaagugcagu

SEQ ID NO: 1341329 - RNA, 17 nt, Homo sapiens
aaaauaacugaaccaaa

SEQ ID NO: 1341330 - RNA, 19 nt, Homo sapiens
aaaauagacuaaccucuac

SEQ ID NO: 1341331 - RNA, 21 nt, Homo sapiens
aaaauagacuaaccucuacca

SEQ ID NO: 1341332 - RNA, 15 nt, Homo sapiens
aaaauauauacuaaa

SEQ ID NO: 1341333 - RNA, 22 nt, Homo sapiens
aaaauauuuguaucacaaaucu

SEQ ID NO: 1341334 - RNA, 12 nt, Homo sapiens
aaaaucagagag

SEQ ID NO: 1341335 - RNA, 20 nt, Homo sapiens
aaaauccaaggcaauuccug

SEQ ID NO: 1341336 - RNA, 18 nt, Homo sapiens
aaaaucccuguucugcca

SEQ ID NO: 1341337 - RNA, 15 nt, Homo sapiens
aaaaucuucacuuuc

SEQ ID NO: 1341338 - RNA, 21 nt, Homo sapiens
aaaaucuuuguuacucuguaa

SEQ ID NO: 1341339 - RNA, 22 nt, Homo sapiens
aaaaugaaaauuaggauuucau

SEQ ID NO: 1341340 - RNA, 15 nt, Homo sapiens
aaaaugaaaauucua

SEQ ID NO: 1341341 - RNA, 11 nt, Homo sapiens
aaaaugaagga

SEQ ID NO: 1341342 - RNA, 11 nt, Homo sapiens
aaaaugaaggu

SEQ ID NO: 1341343 - RNA, 20 nt, Homo sapiens
aaaaugcaagccaucucuaa

SEQ ID NO: 1341344 - RNA, 22 nt, Homo sapiens
aaaaugcagcagggaugcccug

SEQ ID NO: 1341345 - RNA, 12 nt, Homo sapiens
aaaaugccaaaa

SEQ ID NO: 1341346 - RNA, 16 nt, Homo sapiens
aaaauggccauuugcu

SEQ ID NO: 1341347 - RNA, 18 nt, Homo sapiens
aaaaugguaauuguugcu

SEQ ID NO: 1341348 - RNA, 14 nt, Homo sapiens
aaaauggugaauga

SEQ ID NO: 1341349 - RNA, 17 nt, Homo sapiens
aaaauguccugccuuuu

SEQ ID NO: 1341350 - RNA, 14 nt, Homo sapiens
aaaauucauuugcu

SEQ ID NO: 1341351 - RNA, 20 nt, Homo sapiens
aaaauucucuuaaaccacag

SEQ ID NO: 1341352 - RNA, 19 nt, Homo sapiens
aaaauuuuagcucuuccca

SEQ ID NO: 1341353 - RNA, 13 nt, Homo sapiens
aaacaaaaacaca

SEQ ID NO: 1341354 - RNA, 16 nt, Homo sapiens
aaacaaagacuuugau

SEQ ID NO: 1341355 - RNA, 12 nt, Homo sapiens
aaacaacagcuu

SEQ ID NO: 1341356 - RNA, 14 nt, Homo sapiens
aaacaagccaaaga

SEQ ID NO: 1341357 - RNA, 14 nt, Homo sapiens
aaacaaucuuccaa

SEQ ID NO: 1341358 - RNA, 20 nt, Homo sapiens
aaacagaauuuuccauuuau

SEQ ID NO: 1341359 - RNA, 22 nt, Homo sapiens
aaacagccuucuagcacacuuu

SEQ ID NO: 1341360 - RNA, 18 nt, Homo sapiens
aaacaguaaaccuuaaca

SEQ ID NO: 1341361 - RNA, 18 nt, Homo sapiens
aaacagugucauauacaa

SEQ ID NO: 1341362 - RNA, 19 nt, Homo sapiens
aaacauaaacacauuucca

SEQ ID NO: 1341363 - RNA, 17 nt, Homo sapiens
aaacauuaauauuuacc

SEQ ID NO: 1341364 - RNA, 15 nt, Homo sapiens
aaaccaaaaacugaa

SEQ ID NO: 1341365 - RNA, 15 nt, Homo sapiens
aaaccagaaaagcaa

SEQ ID NO: 1341366 - RNA, 17 nt, Homo sapiens
aaaccagaaaagcaaua

SEQ ID NO: 1341367 - RNA, 12 nt, Homo sapiens
aaacccagagau

SEQ ID NO: 1341368 - RNA, 20 nt, Homo sapiens
aaaccccaucucuacuaaaa

SEQ ID NO: 1341369 - RNA, 18 nt, Homo sapiens
aaacccccacuccagcuc

SEQ ID NO: 1341370 - RNA, 21 nt, Homo sapiens
aaaccccccagagcucuuuac

SEQ ID NO: 1341371 - RNA, 18 nt, Homo sapiens
aaaccuauuccacuuaca

SEQ ID NO: 1341372 - RNA, 19 nt, Homo sapiens
aaaccugccaaggagcauc

SEQ ID NO: 1341373 - RNA, 15 nt, Homo sapiens
aaaccugcuuuucaa

SEQ ID NO: 1341374 - RNA, 18 nt, Homo sapiens
aaaccuuggccucugcua

SEQ ID NO: 1341375 - RNA, 19 nt, Homo sapiens
aaacgaagcucauucccaa

SEQ ID NO: 1341376 - RNA, 22 nt, Homo sapiens
aaacgauaaaauguggauuaaa

SEQ ID NO: 1341377 - RNA, 17 nt, Homo sapiens
aaacggaggccagagag

SEQ ID NO: 1341378 - RNA, 17 nt, Homo sapiens
aaacguuucuugaacaa

SEQ ID NO: 1341379 - RNA, 23 nt, Homo sapiens
aaacuaccauguggccauuaaca

SEQ ID NO: 1341380 - RNA, 22 nt, Homo sapiens
aaacucaaccuaacacauuaaa

SEQ ID NO: 1341381 - RNA, 14 nt, Homo sapiens
aaacugaagcuuuu

SEQ ID NO: 1341382 - RNA, 20 nt, Homo sapiens
aaacugacagaugcuuuugc

SEQ ID NO: 1341383 - RNA, 21 nt, Homo sapiens
aaacugagaugugaacacauc

SEQ ID NO: 1341384 - RNA, 13 nt, Homo sapiens
aaacugaugccaa

SEQ ID NO: 1341385 - RNA, 17 nt, Homo sapiens
aaacuggaaaaucuucu

SEQ ID NO: 1341386 - RNA, 14 nt, Homo sapiens
aaacuggacaaugu

SEQ ID NO: 1341387 - RNA, 16 nt, Homo sapiens
aaacuucaaagcugaa

SEQ ID NO: 1341388 - RNA, 22 nt, Homo sapiens
aaacuucaccuacauuaucuca

SEQ ID NO: 1341389 - RNA, 23 nt, Homo sapiens
aaacuucaccuacauuaucucac

SEQ ID NO: 1341390 - RNA, 15 nt, Homo sapiens
aaacuuguucaaaag

SEQ ID NO: 1341391 - RNA, 15 nt, Homo sapiens
aaagaaauacuguau

SEQ ID NO: 1341392 - RNA, 17 nt, Homo sapiens
aaagacaggcaaacggc

SEQ ID NO: 1341393 - RNA, 11 nt, Homo sapiens
aaagacaucag

SEQ ID NO: 1341394 - RNA, 12 nt, Homo sapiens
aaagacaucagu

SEQ ID NO: 1341395 - RNA, 17 nt, Homo sapiens
aaagacuuccucuggcu

SEQ ID NO: 1341396 - RNA, 16 nt, Homo sapiens
aaagagggacaggcug

SEQ ID NO: 1341397 - RNA, 23 nt, Homo sapiens
aaagauggccauauuaccccuuu

SEQ ID NO: 1341398 - RNA, 14 nt, Homo sapiens
aaagauuaaaugug

SEQ ID NO: 1341399 - RNA, 17 nt, Homo sapiens
aaagcaaaacagacugu

SEQ ID NO: 1341400 - RNA, 16 nt, Homo sapiens
aaagcaauucuuucaa

SEQ ID NO: 1341401 - RNA, 21 nt, Homo sapiens
aaagcaucaauacaaccagcc

SEQ ID NO: 1341402 - RNA, 13 nt, Homo sapiens
aaagccacacucu

SEQ ID NO: 1341403 - RNA, 17 nt, Homo sapiens
aaagccauaacuugaaa

SEQ ID NO: 1341404 - RNA, 18 nt, Homo sapiens
aaagcccagcacuugaau

SEQ ID NO: 1341405 - RNA, 14 nt, Homo sapiens
aaagccccucacac

SEQ ID NO: 1341406 - RNA, 13 nt, Homo sapiens
aaagcuacuaugu

SEQ ID NO: 1341407 - RNA, 24 nt, Homo sapiens
aaagcuuugggggagugggcgcag

SEQ ID NO: 1341408 - RNA, 23 nt, Homo sapiens
aaaggaaaauaaaugaacauaug

SEQ ID NO: 1341409 - RNA, 18 nt, Homo sapiens
aaaggaaacccagcucac

SEQ ID NO: 1341410 - RNA, 17 nt, Homo sapiens
aaaggaaauaggaucuc

SEQ ID NO: 1341411 - RNA, 14 nt, Homo sapiens
aaaggaacucuaga

SEQ ID NO: 1341412 - RNA, 16 nt, Homo sapiens
aaaggaauccucugug

SEQ ID NO: 1341413 - RNA, 17 nt, Homo sapiens
aaaggaauccucugugu

SEQ ID NO: 1341414 - RNA, 22 nt, Homo sapiens
aaaggaauccucugugucuuca

SEQ ID NO: 1341415 - RNA, 20 nt, Homo sapiens
aaaggacugaaccaggguau

SEQ ID NO: 1341416 - RNA, 12 nt, Homo sapiens
aaaggacuguaa

SEQ ID NO: 1341417 - RNA, 19 nt, Homo sapiens
aaaggagccuacuccaaga

SEQ ID NO: 1341418 - RNA, 21 nt, Homo sapiens
aaaggaucucuauaacagauc

SEQ ID NO: 1341419 - RNA, 22 nt, Homo sapiens
aaaggauuguuaauguuugcau

SEQ ID NO: 1341420 - RNA, 20 nt, Homo sapiens
aaaggauuuuaccaaagcau

SEQ ID NO: 1341421 - RNA, 20 nt, Homo sapiens
aaaggcaagucaaauaccac

SEQ ID NO: 1341422 - RNA, 21 nt, Homo sapiens
aaaggcuagguacacagcucu

SEQ ID NO: 1341423 - RNA, 15 nt, Homo sapiens
aaagggacuaccucu

SEQ ID NO: 1341424 - RNA, 10 nt, Homo sapiens
aaagggaugg

SEQ ID NO: 1341425 - RNA, 23 nt, Homo sapiens
aaagguauuaaauugauguugcu

SEQ ID NO: 1341426 - RNA, 17 nt, Homo sapiens
aaaguaagcauuuccag

SEQ ID NO: 1341427 - RNA, 16 nt, Homo sapiens
aaaguauaacaugucg

SEQ ID NO: 1341428 - RNA, 12 nt, Homo sapiens
aaagucuugccu

SEQ ID NO: 1341429 - RNA, 15 nt, Homo sapiens
aaagucuugccuugc

SEQ ID NO: 1341430 - RNA, 16 nt, Homo sapiens
aaagugacaugcauuc

SEQ ID NO: 1341431 - RNA, 13 nt, Homo sapiens
aaagugcaguaaa

SEQ ID NO: 1341432 - RNA, 16 nt, Homo sapiens
aaaguggaaguaugua

SEQ ID NO: 1341433 - RNA, 19 nt, Homo sapiens
aaagugugagcucuucccu

SEQ ID NO: 1341434 - RNA, 21 nt, Homo sapiens
aaaguguggucucuggaagag

SEQ ID NO: 1341435 - RNA, 23 nt, Homo sapiens
aaaguucuaggcauacuuuucaa

SEQ ID NO: 1341436 - RNA, 13 nt, Homo sapiens
aaaguugccuuua

SEQ ID NO: 1341437 - RNA, 18 nt, Homo sapiens
aaaguuuuccaguauuga

SEQ ID NO: 1341438 - RNA, 13 nt, Homo sapiens
aaauaaaccaaau

SEQ ID NO: 1341439 - RNA, 16 nt, Homo sapiens
aaauaaauacguguca

SEQ ID NO: 1341440 - RNA, 21 nt, Homo sapiens
aaauaacgugcaugcuuuaaa

SEQ ID NO: 1341441 - RNA, 13 nt, Homo sapiens
aaauaauugccac

SEQ ID NO: 1341442 - RNA, 20 nt, Homo sapiens
aaauacaaucagcccagugc

SEQ ID NO: 1341443 - RNA, 22 nt, Homo sapiens
aaauacaaucagcccagugcaa

SEQ ID NO: 1341444 - RNA, 19 nt, Homo sapiens
aaauacacacucaaaucaa

SEQ ID NO: 1341445 - RNA, 22 nt, Homo sapiens
aaauacacagugcugaccagac

SEQ ID NO: 1341446 - RNA, 18 nt, Homo sapiens
aaauacagacuggaugua

SEQ ID NO: 1341447 - RNA, 12 nt, Homo sapiens
aaauacagauuu

SEQ ID NO: 1341448 - RNA, 13 nt, Homo sapiens
aaauacaucagcu

SEQ ID NO: 1341449 - RNA, 12 nt, Homo sapiens
aaauacauuccu

SEQ ID NO: 1341450 - RNA, 20 nt, Homo sapiens
aaauagaaaauaugaccaga

SEQ ID NO: 1341451 - RNA, 20 nt, Homo sapiens
aaauagacuaaccucuacca

SEQ ID NO: 1341452 - RNA, 22 nt, Homo sapiens
aaauagagcuuuuaaaaauguc

SEQ ID NO: 1341453 - RNA, 23 nt, Homo sapiens
aaauagagcuuuuaaaaaugucc

SEQ ID NO: 1341454 - RNA, 19 nt, Homo sapiens
aaauauagacauucucaca

SEQ ID NO: 1341455 - RNA, 22 nt, Homo sapiens
aaauauagcuaauaacauguga

SEQ ID NO: 1341456 - RNA, 20 nt, Homo sapiens
aaauauccacccagcaggca

SEQ ID NO: 1341457 - RNA, 21 nt, Homo sapiens
aaauaucccuccauacagugu

SEQ ID NO: 1341458 - RNA, 19 nt, Homo sapiens
aaaucaaauaugcaaagca

SEQ ID NO: 1341459 - RNA, 17 nt, Homo sapiens
aaaucaaucuggugcua

SEQ ID NO: 1341460 - RNA, 13 nt, Homo sapiens
aaaucauauagac

SEQ ID NO: 1341461 - RNA, 16 nt, Homo sapiens
aaauccaggcuggugu

SEQ ID NO: 1341462 - RNA, 14 nt, Homo sapiens
aaauccauuuaccc

SEQ ID NO: 1341463 - RNA, 16 nt, Homo sapiens
aaauccuagacuugaa

SEQ ID NO: 1341464 - RNA, 17 nt, Homo sapiens
aaauccuagacuugaaa

SEQ ID NO: 1341465 - RNA, 22 nt, Homo sapiens
aaaucugacauauuaugccuga

SEQ ID NO: 1341466 - RNA, 23 nt, Homo sapiens
aaaucugacauauuaugccugaa

SEQ ID NO: 1341467 - RNA, 15 nt, Homo sapiens
aaaucuuaacuugaa

SEQ ID NO: 1341468 - RNA, 17 nt, Homo sapiens
aaaugagagcagaaagu

SEQ ID NO: 1341469 - RNA, 14 nt, Homo sapiens
aaaugaugccccag

SEQ ID NO: 1341470 - RNA, 18 nt, Homo sapiens
aaaugauuucacagugug

SEQ ID NO: 1341471 - RNA, 19 nt, Homo sapiens
aaaugauuucacagugugu

SEQ ID NO: 1341472 - RNA, 18 nt, Homo sapiens
aaaugcaaccauuuuuag

SEQ ID NO: 1341473 - RNA, 17 nt, Homo sapiens
aaaugcucucucaaauu

SEQ ID NO: 1341474 - RNA, 22 nt, Homo sapiens
aaaugcuguugguaaagcacau

SEQ ID NO: 1341475 - RNA, 15 nt, Homo sapiens
aaaugcuuuuccuca

SEQ ID NO: 1341476 - RNA, 16 nt, Homo sapiens
aaauggccaaugagau

SEQ ID NO: 1341477 - RNA, 17 nt, Homo sapiens
aaaugggaaaaccagac

SEQ ID NO: 1341478 - RNA, 21 nt, Homo sapiens
aaauggucacguuuggugcuu

SEQ ID NO: 1341479 - RNA, 15 nt, Homo sapiens
aaauguaaaagcaca

SEQ ID NO: 1341480 - RNA, 20 nt, Homo sapiens
aaauguaugagacugggcau

SEQ ID NO: 1341481 - RNA, 14 nt, Homo sapiens
aaauguauuuuaca

SEQ ID NO: 1341482 - RNA, 11 nt, Homo sapiens
aaaugucacuu

SEQ ID NO: 1341483 - RNA, 15 nt, Homo sapiens
aaaugucugcacuga

SEQ ID NO: 1341484 - RNA, 11 nt, Homo sapiens
aaaugucuugc

SEQ ID NO: 1341485 - RNA, 18 nt, Homo sapiens
aaaugugacucagcauca

SEQ ID NO: 1341486 - RNA, 14 nt, Homo sapiens
aaaugugauacauu

SEQ ID NO: 1341487 - RNA, 13 nt, Homo sapiens
aaaugugcacuuu

SEQ ID NO: 1341488 - RNA, 13 nt, Homo sapiens
aaauguggauuaa

SEQ ID NO: 1341489 - RNA, 22 nt, Homo sapiens
aaaugugucauuggaagccauc

SEQ ID NO: 1341490 - RNA, 13 nt, Homo sapiens
aaauguuacguga

SEQ ID NO: 1341491 - RNA, 19 nt, Homo sapiens
aaauguucagaagguugcu

SEQ ID NO: 1341492 - RNA, 19 nt, Homo sapiens
aaauuaaacauauucaagg

SEQ ID NO: 1341493 - RNA, 18 nt, Homo sapiens
aaauuaaugguuuauucu

SEQ ID NO: 1341494 - RNA, 17 nt, Homo sapiens
aaauuagaaucugagua

SEQ ID NO: 1341495 - RNA, 16 nt, Homo sapiens
aaauuaugugacauuu

SEQ ID NO: 1341496 - RNA, 21 nt, Homo sapiens
aaauuauuuuuguucauauaa

SEQ ID NO: 1341497 - RNA, 20 nt, Homo sapiens
aaauucauuugcuugcaauc

SEQ ID NO: 1341498 - RNA, 14 nt, Homo sapiens
aaauugccaagaaa

SEQ ID NO: 1341499 - RNA, 23 nt, Homo sapiens
aaauugccaagaaaaacaacuuu

SEQ ID NO: 1341500 - RNA, 12 nt, Homo sapiens
aaauuuacuuuu

SEQ ID NO: 1341501 - RNA, 13 nt, Homo sapiens
aaauuuaugugau

SEQ ID NO: 1341502 - RNA, 22 nt, Homo sapiens
aaauuugugguccacugagcua

SEQ ID NO: 1341503 - RNA, 23 nt, Homo sapiens
aaauuuucuuuuuauacuauuaa

SEQ ID NO: 1341504 - RNA, 15 nt, Homo sapiens
aaauuuuuaccuguu

SEQ ID NO: 1341505 - RNA, 15 nt, Homo sapiens
aaauuuuuaccuuua

SEQ ID NO: 1341506 - RNA, 23 nt, Homo sapiens
aaauuuuuuuuuuuuacuugaaa

SEQ ID NO: 1341507 - RNA, 21 nt, Homo sapiens
aacaaaaaaaaauuacccuuu

SEQ ID NO: 1341508 - RNA, 12 nt, Homo sapiens
aacaaaauccuc

SEQ ID NO: 1341509 - RNA, 16 nt, Homo sapiens
aacaaagacauugaca

SEQ ID NO: 1341510 - RNA, 14 nt, Homo sapiens
aacaacauguucua

SEQ ID NO: 1341511 - RNA, 15 nt, Homo sapiens
aacaaccuggucaca

SEQ ID NO: 1341512 - RNA, 22 nt, Homo sapiens
aacaaccuggucacaggacucu

SEQ ID NO: 1341513 - RNA, 12 nt, Homo sapiens
aacaagaucugc

SEQ ID NO: 1341514 - RNA, 15 nt, Homo sapiens
aacaagccaaagagc

SEQ ID NO: 1341515 - RNA, 15 nt, Homo sapiens
aacaagugaaauaac

SEQ ID NO: 1341516 - RNA, 22 nt, Homo sapiens
aacaauaaaagacguugccuau

SEQ ID NO: 1341517 - RNA, 14 nt, Homo sapiens
aacaauauugcucc

SEQ ID NO: 1341518 - RNA, 13 nt, Homo sapiens
aacaaucauguaa

SEQ ID NO: 1341519 - RNA, 15 nt, Homo sapiens
aacaauucugugaca

SEQ ID NO: 1341520 - RNA, 21 nt, Homo sapiens
aacaauucuuauugacucaua

SEQ ID NO: 1341521 - RNA, 21 nt, Homo sapiens
aacacagcuacaacccuaccc

SEQ ID NO: 1341522 - RNA, 19 nt, Homo sapiens
aacacagugcuauuugcau

SEQ ID NO: 1341523 - RNA, 13 nt, Homo sapiens
aacacauucaaua

SEQ ID NO: 1341524 - RNA, 11 nt, Homo sapiens
aacacugagaa

SEQ ID NO: 1341525 - RNA, 13 nt, Homo sapiens
aacagauaauccc

SEQ ID NO: 1341526 - RNA, 13 nt, Homo sapiens
aacagauuucuca

SEQ ID NO: 1341527 - RNA, 21 nt, Homo sapiens
aacagauuuggaaagacugga

SEQ ID NO: 1341528 - RNA, 21 nt, Homo sapiens
aacagcaugggccucaccucc

SEQ ID NO: 1341529 - RNA, 22 nt, Homo sapiens
aacagcuguucaguugcacuuc

SEQ ID NO: 1341530 - RNA, 17 nt, Homo sapiens
aacagcuuugucuccaa

SEQ ID NO: 1341531 - RNA, 13 nt, Homo sapiens
aacagugcuguaa

SEQ ID NO: 1341532 - RNA, 21 nt, Homo sapiens
aacauacaugagauaacucaa

SEQ ID NO: 1341533 - RNA, 14 nt, Homo sapiens
aacauagugauacc

SEQ ID NO: 1341534 - RNA, 13 nt, Homo sapiens
aacauauuauuuc

SEQ ID NO: 1341535 - RNA, 17 nt, Homo sapiens
aacaucauggacugagc

SEQ ID NO: 1341536 - RNA, 19 nt, Homo sapiens
aacauccauaacucuguau

SEQ ID NO: 1341537 - RNA, 21 nt, Homo sapiens
aacauccuuauucagccuuau

SEQ ID NO: 1341538 - RNA, 20 nt, Homo sapiens
aacaugccagccacugugau

SEQ ID NO: 1341539 - RNA, 19 nt, Homo sapiens
aacauguaagcauaacuua

SEQ ID NO: 1341540 - RNA, 22 nt, Homo sapiens
aacauguguuuucaucauuuca

SEQ ID NO: 1341541 - RNA, 18 nt, Homo sapiens
aacauugaacucauaucu

SEQ ID NO: 1341542 - RNA, 17 nt, Homo sapiens
aacauugguucuuucau

SEQ ID NO: 1341543 - RNA, 16 nt, Homo sapiens
aaccacagucuuccca

SEQ ID NO: 1341544 - RNA, 16 nt, Homo sapiens
aaccacauugaagaau

SEQ ID NO: 1341545 - RNA, 22 nt, Homo sapiens
aacccacuagaagcaacuagga

SEQ ID NO: 1341546 - RNA, 21 nt, Homo sapiens
aacccacugaaccuucugagc

SEQ ID NO: 1341547 - RNA, 21 nt, Homo sapiens
aacccaggaguucagggucau

SEQ ID NO: 1341548 - RNA, 17 nt, Homo sapiens
aaccccagauucaugca

SEQ ID NO: 1341549 - RNA, 15 nt, Homo sapiens
aaccccucuccaggc

SEQ ID NO: 1341550 - RNA, 16 nt, Homo sapiens
aacccugcccugcccc

SEQ ID NO: 1341551 - RNA, 23 nt, Homo sapiens
aacccuucccucaccuuggcacc

SEQ ID NO: 1341552 - RNA, 15 nt, Homo sapiens
aaccuauuccacuua

SEQ ID NO: 1341553 - RNA, 20 nt, Homo sapiens
aaccucagccuggccagaca

SEQ ID NO: 1341554 - RNA, 12 nt, Homo sapiens
aggauaaauauc

SEQ ID NO: 1341555 - RNA, 14 nt, Homo sapiens
aggauagaugcugg

SEQ ID NO: 1341556 - RNA, 17 nt, Homo sapiens
aggauaggacagaggga

SEQ ID NO: 1341557 - RNA, 17 nt, Homo sapiens
aggaucuuuugaaccca

SEQ ID NO: 1341558 - RNA, 11 nt, Homo sapiens
aggaugugaua

SEQ ID NO: 1341559 - RNA, 12 nt, Homo sapiens
aggaugugauau

SEQ ID NO: 1341560 - RNA, 21 nt, Homo sapiens
aggauuuggggcagagggaca

SEQ ID NO: 1341561 - RNA, 14 nt, Homo sapiens
aggauuuuaccaaa

SEQ ID NO: 1341562 - RNA, 16 nt, Homo sapiens
aggauuuuaccaaagc

SEQ ID NO: 1341563 - RNA, 13 nt, Homo sapiens
aggcaaaugaugc

SEQ ID NO: 1341564 - RNA, 14 nt, Homo sapiens
aggcaaaugaugcc

SEQ ID NO: 1341565 - RNA, 23 nt, Homo sapiens
aggcaacaggauugaucauucuu

SEQ ID NO: 1341566 - RNA, 21 nt, Homo sapiens
aggcaauuccugauggaaaau

SEQ ID NO: 1341567 - RNA, 15 nt, Homo sapiens
aggcacacuuugcac

SEQ ID NO: 1341568 - RNA, 16 nt, Homo sapiens
aggcacauacaccucg

SEQ ID NO: 1341569 - RNA, 19 nt, Homo sapiens
aggcagcuucuacuccugc

SEQ ID NO: 1341570 - RNA, 21 nt, Homo sapiens
aggcagcuucuacuccugccu

SEQ ID NO: 1341571 - RNA, 24 nt, Homo sapiens
aggcagcuucuacuccugccucau

SEQ ID NO: 1341572 - RNA, 16 nt, Homo sapiens
aggcaggacuucucac

SEQ ID NO: 1341573 - RNA, 15 nt, Homo sapiens
aggcaggaggaucac

SEQ ID NO: 1341574 - RNA, 18 nt, Homo sapiens
aggcagugcugagaggga

SEQ ID NO: 1341575 - RNA, 18 nt, Homo sapiens
aggcaucaaaaaaacaag

SEQ ID NO: 1341576 - RNA, 15 nt, Homo sapiens
aggcaugguagcuca

SEQ ID NO: 1341577 - RNA, 13 nt, Homo sapiens
aggccaacagcac

SEQ ID NO: 1341578 - RNA, 20 nt, Homo sapiens
aggccacuugaugaccccca

SEQ ID NO: 1341579 - RNA, 15 nt, Homo sapiens
aggccauugucccug

SEQ ID NO: 1341580 - RNA, 19 nt, Homo sapiens
aggccauuuacaauugcau

SEQ ID NO: 1341581 - RNA, 15 nt, Homo sapiens
aggcccacuguaaua

SEQ ID NO: 1341582 - RNA, 20 nt, Homo sapiens
aggcccaguucacccugauu

SEQ ID NO: 1341583 - RNA, 12 nt, Homo sapiens
aggcccaugccc

SEQ ID NO: 1341584 - RNA, 22 nt, Homo sapiens
aggcccuuccucuccacugccu

SEQ ID NO: 1341585 - RNA, 17 nt, Homo sapiens
aggccuauuuauuaaua

SEQ ID NO: 1341586 - RNA, 17 nt, Homo sapiens
aggccugcugccagugc

SEQ ID NO: 1341587 - RNA, 21 nt, Homo sapiens
aggccugggaccucccacugc

SEQ ID NO: 1341588 - RNA, 20 nt, Homo sapiens
aggccuuaucugaaaggcca

SEQ ID NO: 1341589 - RNA, 18 nt, Homo sapiens
aggcgauggggcaagaca

SEQ ID NO: 1341590 - RNA, 15 nt, Homo sapiens
aggcgcacaguguga

SEQ ID NO: 1341591 - RNA, 16 nt, Homo sapiens
aggcgccuaaagucau

SEQ ID NO: 1341592 - RNA, 21 nt, Homo sapiens
aggcguacuacccagcucugu

SEQ ID NO: 1341593 - RNA, 20 nt, Homo sapiens
aggcuaagacccuguguccu

SEQ ID NO: 1341594 - RNA, 19 nt, Homo sapiens
aggcuacuguaaugcugcc

SEQ ID NO: 1341595 - RNA, 14 nt, Homo sapiens
aggcuagagugcaa

SEQ ID NO: 1341596 - RNA, 15 nt, Homo sapiens
aggcucagauuguaa

SEQ ID NO: 1341597 - RNA, 13 nt, Homo sapiens
aggcucaggagaa

SEQ ID NO: 1341598 - RNA, 16 nt, Homo sapiens
aggcucucuugugcau

SEQ ID NO: 1341599 - RNA, 23 nt, Homo sapiens
aggcucuuccguuccacauccac

SEQ ID NO: 1341600 - RNA, 15 nt, Homo sapiens
aggcugaaagacagg

SEQ ID NO: 1341601 - RNA, 20 nt, Homo sapiens
aggcugacaugcucacacau

SEQ ID NO: 1341602 - RNA, 15 nt, Homo sapiens
aggcugaucccugag

SEQ ID NO: 1341603 - RNA, 17 nt, Homo sapiens
aggcuggagugcaaugg

SEQ ID NO: 1341604 - RNA, 17 nt, Homo sapiens
aggcugggccugaacua

SEQ ID NO: 1341605 - RNA, 15 nt, Homo sapiens
aggcuguacauaguc

SEQ ID NO: 1341606 - RNA, 17 nt, Homo sapiens
aggcuucuccaaaggga

SEQ ID NO: 1341607 - RNA, 17 nt, Homo sapiens
aggcuuuuccaaaucaa

SEQ ID NO: 1341608 - RNA, 20 nt, Homo sapiens
aggcuuuuccaaaucaagga

SEQ ID NO: 1341609 - RNA, 13 nt, Homo sapiens
agggaaagccucu

SEQ ID NO: 1341610 - RNA, 12 nt, Homo sapiens
agggaacugacc

SEQ ID NO: 1341611 - RNA, 22 nt, Homo sapiens
agggaacugacccucaggcaca

SEQ ID NO: 1341612 - RNA, 21 nt, Homo sapiens
agggaagaugaccugccccaa

SEQ ID NO: 1341613 - RNA, 21 nt, Homo sapiens
agggaagauggagacacccuc

SEQ ID NO: 1341614 - RNA, 15 nt, Homo sapiens
agggaagcucagggg

SEQ ID NO: 1341615 - RNA, 15 nt, Homo sapiens
agggaaguccuugca

SEQ ID NO: 1341616 - RNA, 16 nt, Homo sapiens
agggaauggagcucag

SEQ ID NO: 1341617 - RNA, 15 nt, Homo sapiens
agggaauggccacaa

SEQ ID NO: 1341618 - RNA, 16 nt, Homo sapiens
agggacaggcacucca

SEQ ID NO: 1341619 - RNA, 14 nt, Homo sapiens
agggacuaccucug

SEQ ID NO: 1341620 - RNA, 14 nt, Homo sapiens
agggagcucugggg

SEQ ID NO: 1341621 - RNA, 18 nt, Homo sapiens
agggauaucuacuguggu

SEQ ID NO: 1341622 - RNA, 18 nt, Homo sapiens
agggaugcggauccugcu

SEQ ID NO: 1341623 - RNA, 22 nt, Homo sapiens
agggauggagaaagaaguggag

SEQ ID NO: 1341624 - RNA, 22 nt, Homo sapiens
agggcagauucuucccucugag

SEQ ID NO: 1341625 - RNA, 23 nt, Homo sapiens
agggcagauucuucccucugagu

SEQ ID NO: 1341626 - RNA, 23 nt, Homo sapiens
agggcagggcugaggccucucau

SEQ ID NO: 1341627 - RNA, 18 nt, Homo sapiens
agggccaagcaccuagcc

SEQ ID NO: 1341628 - RNA, 18 nt, Homo sapiens
agggcugggccagugcau

SEQ ID NO: 1341629 - RNA, 16 nt, Homo sapiens
agggcuuccucuuccg

SEQ ID NO: 1341630 - RNA, 14 nt, Homo sapiens
aggggaccccacuc

SEQ ID NO: 1341631 - RNA, 18 nt, Homo sapiens
aggggcccuggccaggac

SEQ ID NO: 1341632 - RNA, 19 nt, Homo sapiens
aggggccuaggccucagcc

SEQ ID NO: 1341633 - RNA, 19 nt, Homo sapiens
aggggcguucucccaaaga

SEQ ID NO: 1341634 - RNA, 15 nt, Homo sapiens
agggggggagcaaaa

SEQ ID NO: 1341635 - RNA, 17 nt, Homo sapiens
agggggugggauuccac

SEQ ID NO: 1341636 - RNA, 15 nt, Homo sapiens
agggguauguucccu

SEQ ID NO: 1341637 - RNA, 22 nt, Homo sapiens
aggggugggggugccgcucucu

SEQ ID NO: 1341638 - RNA, 20 nt, Homo sapiens
aggguccucaguccacugcu

SEQ ID NO: 1341639 - RNA, 18 nt, Homo sapiens
aggguccuccuccaucuu

SEQ ID NO: 1341640 - RNA, 16 nt, Homo sapiens
agggucuaagcaccuu

SEQ ID NO: 1341641 - RNA, 14 nt, Homo sapiens
agggugacuaugga

SEQ ID NO: 1341642 - RNA, 14 nt, Homo sapiens
agggugagugcaag

SEQ ID NO: 1341643 - RNA, 17 nt, Homo sapiens
agggugugaugaaguca

SEQ ID NO: 1341644 - RNA, 15 nt, Homo sapiens
aggguuggagugcuc

SEQ ID NO: 1341645 - RNA, 19 nt, Homo sapiens
agguaauccggagugagca

SEQ ID NO: 1341646 - RNA, 19 nt, Homo sapiens
agguaccaguuguauuuaa

SEQ ID NO: 1341647 - RNA, 17 nt, Homo sapiens
agguagcacucucagag

SEQ ID NO: 1341648 - RNA, 14 nt, Homo sapiens
agguaguuagcuuc

SEQ ID NO: 1341649 - RNA, 18 nt, Homo sapiens
aggucaagaacacaguga

SEQ ID NO: 1341650 - RNA, 14 nt, Homo sapiens
aggucacucugggc

SEQ ID NO: 1341651 - RNA, 12 nt, Homo sapiens
aggucacugcua

SEQ ID NO: 1341652 - RNA, 20 nt, Homo sapiens
aggucccggccagcucugga

SEQ ID NO: 1341653 - RNA, 16 nt, Homo sapiens
aggucuaaucagugau

SEQ ID NO: 1341654 - RNA, 19 nt, Homo sapiens
aggucucauucauccuuau

SEQ ID NO: 1341655 - RNA, 17 nt, Homo sapiens
aggucuccuaaaacugg

SEQ ID NO: 1341656 - RNA, 13 nt, Homo sapiens
aggugaaccaaag

SEQ ID NO: 1341657 - RNA, 23 nt, Homo sapiens
aggugaacugggagcagcucugu

SEQ ID NO: 1341658 - RNA, 16 nt, Homo sapiens
aggugagauaaauuaa

SEQ ID NO: 1341659 - RNA, 18 nt, Homo sapiens
aggugagaucacacugaa

SEQ ID NO: 1341660 - RNA, 19 nt, Homo sapiens
aggugcacuccagacucug

SEQ ID NO: 1341661 - RNA, 17 nt, Homo sapiens
aggugcagccccagggc

SEQ ID NO: 1341662 - RNA, 15 nt, Homo sapiens
aggugcagcuccuca

SEQ ID NO: 1341663 - RNA, 19 nt, Homo sapiens
aggugcauagcaagugaaa

SEQ ID NO: 1341664 - RNA, 18 nt, Homo sapiens
aggugcuacaaaaacaca

SEQ ID NO: 1341665 - RNA, 17 nt, Homo sapiens
aggugcucaugcugcuc

SEQ ID NO: 1341666 - RNA, 14 nt, Homo sapiens
aggugggccuggga

SEQ ID NO: 1341667 - RNA, 19 nt, Homo sapiens
aggugggcggaucaccuga

SEQ ID NO: 1341668 - RNA, 19 nt, Homo sapiens
agguggggauccugccuaa

SEQ ID NO: 1341669 - RNA, 19 nt, Homo sapiens
aggugggggaacacugaga

SEQ ID NO: 1341670 - RNA, 13 nt, Homo sapiens
agguggugcaaau

SEQ ID NO: 1341671 - RNA, 20 nt, Homo sapiens
agguguucuucauuaccuca

SEQ ID NO: 1341672 - RNA, 20 nt, Homo sapiens
agguucccacucugggcaaa

SEQ ID NO: 1341673 - RNA, 15 nt, Homo sapiens
agguucuagguagug

SEQ ID NO: 1341674 - RNA, 21 nt, Homo sapiens
aguaaaauauuaacauauuau

SEQ ID NO: 1341675 - RNA, 19 nt, Homo sapiens
aguaaacgauaaaaugugg

SEQ ID NO: 1341676 - RNA, 16 nt, Homo sapiens
aguaaacuguaauaaa

SEQ ID NO: 1341677 - RNA, 19 nt, Homo sapiens
aguaacacacuuccagugu

SEQ ID NO: 1341678 - RNA, 23 nt, Homo sapiens
aguaaguacuuaauaaacugugg

SEQ ID NO: 1341679 - RNA, 19 nt, Homo sapiens
aguaauugaaaaaggugau

SEQ ID NO: 1341680 - RNA, 15 nt, Homo sapiens
aguaauugaggaaaa

SEQ ID NO: 1341681 - RNA, 23 nt, Homo sapiens
aguaauugaggaaaaacugacag

SEQ ID NO: 1341682 - RNA, 16 nt, Homo sapiens
aguacacccuuuccag

SEQ ID NO: 1341683 - RNA, 23 nt, Homo sapiens
aguacuuaauaaacuguggugcu

SEQ ID NO: 1341684 - RNA, 15 nt, Homo sapiens
aguacuuuaccuccu

SEQ ID NO: 1341685 - RNA, 17 nt, Homo sapiens
aguagaagaaaguaaac

SEQ ID NO: 1341686 - RNA, 14 nt, Homo sapiens
aguagaagaagcuu

SEQ ID NO: 1341687 - RNA, 16 nt, Homo sapiens
aguagaaguuacuuaa

SEQ ID NO: 1341688 - RNA, 17 nt, Homo sapiens
aguagaauagugguugc

SEQ ID NO: 1341689 - RNA, 13 nt, Homo sapiens
aaccucaguugaa

SEQ ID NO: 1341690 - RNA, 14 nt, Homo sapiens
aaccuccaguguca

SEQ ID NO: 1341691 - RNA, 16 nt, Homo sapiens
aaccuccagugucagg

SEQ ID NO: 1341692 - RNA, 19 nt, Homo sapiens
aaccuccagugucaggguc

SEQ ID NO: 1341693 - RNA, 14 nt, Homo sapiens
aaccuccauucuau

SEQ ID NO: 1341694 - RNA, 22 nt, Homo sapiens
aaccucccacccugcaaaggga

SEQ ID NO: 1341695 - RNA, 23 nt, Homo sapiens
aaccugaauauaaauuuguguuc

SEQ ID NO: 1341696 - RNA, 12 nt, Homo sapiens
aaccugucucac

SEQ ID NO: 1341697 - RNA, 15 nt, Homo sapiens
aaccuuccacccagu

SEQ ID NO: 1341698 - RNA, 23 nt, Homo sapiens
aaccuugcacaggucccacugcc

SEQ ID NO: 1341699 - RNA, 11 nt, Homo sapiens
aaccuuuucaa

SEQ ID NO: 1341700 - RNA, 18 nt, Homo sapiens
aacgaaacuccaucucaa

SEQ ID NO: 1341701 - RNA, 16 nt, Homo sapiens
aacgacauggaacuga

SEQ ID NO: 1341702 - RNA, 13 nt, Homo sapiens
aacgccgagugca

SEQ ID NO: 1341703 - RNA, 16 nt, Homo sapiens
aacgccgagugcacug

SEQ ID NO: 1341704 - RNA, 19 nt, Homo sapiens
aacgguuccuggugacucc

SEQ ID NO: 1341705 - RNA, 15 nt, Homo sapiens
aacguuucacugcaa

SEQ ID NO: 1341706 - RNA, 21 nt, Homo sapiens
aacuaccauguggccauuaac

SEQ ID NO: 1341707 - RNA, 23 nt, Homo sapiens
aacuaccauguggccauuaacaa

SEQ ID NO: 1341708 - RNA, 14 nt, Homo sapiens
aacuagccaaucag

SEQ ID NO: 1341709 - RNA, 15 nt, Homo sapiens
aacuaggaaaaucac

SEQ ID NO: 1341710 - RNA, 17 nt, Homo sapiens
aacuauaggcuucuucc

SEQ ID NO: 1341711 - RNA, 18 nt, Homo sapiens
aacuaugacagauauauu

SEQ ID NO: 1341712 - RNA, 17 nt, Homo sapiens
aacuaugagcuugcuca

SEQ ID NO: 1341713 - RNA, 21 nt, Homo sapiens
aacuaugcaauaauccacccc

SEQ ID NO: 1341714 - RNA, 20 nt, Homo sapiens
aacuauugcauuuauaugua

SEQ ID NO: 1341715 - RNA, 14 nt, Homo sapiens
aacuauugugcuca

SEQ ID NO: 1341716 - RNA, 16 nt, Homo sapiens
aacucacaagugcuca

SEQ ID NO: 1341717 - RNA, 18 nt, Homo sapiens
aacucacaagugcucauc

SEQ ID NO: 1341718 - RNA, 13 nt, Homo sapiens
aacucagauccag

SEQ ID NO: 1341719 - RNA, 21 nt, Homo sapiens
aacucagggcuucuaguuucu

SEQ ID NO: 1341720 - RNA, 20 nt, Homo sapiens
aacucauccacguccugucu

SEQ ID NO: 1341721 - RNA, 15 nt, Homo sapiens
aacuccagguuccug

SEQ ID NO: 1341722 - RNA, 19 nt, Homo sapiens
aacucuaaagccaagcacu

SEQ ID NO: 1341723 - RNA, 17 nt, Homo sapiens
aacucugugaucuugcu

SEQ ID NO: 1341724 - RNA, 17 nt, Homo sapiens
aacucuucuuugcugca

SEQ ID NO: 1341725 - RNA, 14 nt, Homo sapiens
aacugagguuuaca

SEQ ID NO: 1341726 - RNA, 19 nt, Homo sapiens
aacugcuuccuuucuugau

SEQ ID NO: 1341727 - RNA, 20 nt, Homo sapiens
aacugcuuccuuucuugauu

SEQ ID NO: 1341728 - RNA, 17 nt, Homo sapiens
aacuggguuaaauauuu

SEQ ID NO: 1341729 - RNA, 21 nt, Homo sapiens
aacuggguuaaauauuuugcu

SEQ ID NO: 1341730 - RNA, 13 nt, Homo sapiens
aacugguuguaua

SEQ ID NO: 1341731 - RNA, 18 nt, Homo sapiens
aacuguucccaccugcug

SEQ ID NO: 1341732 - RNA, 18 nt, Homo sapiens
aacuuacgaucucuugac

SEQ ID NO: 1341733 - RNA, 20 nt, Homo sapiens
aacuuagaucaucagucacc

SEQ ID NO: 1341734 - RNA, 16 nt, Homo sapiens
aacuucaccuacauua

SEQ ID NO: 1341735 - RNA, 19 nt, Homo sapiens
aacuuccgcugaggggucu

SEQ ID NO: 1341736 - RNA, 22 nt, Homo sapiens
aacuuccuuggacucauuuuaa

SEQ ID NO: 1341737 - RNA, 20 nt, Homo sapiens
aacuugauggcuaacuuaca

SEQ ID NO: 1341738 - RNA, 14 nt, Homo sapiens
aacuugcugaucca

SEQ ID NO: 1341739 - RNA, 20 nt, Homo sapiens
aacuuugaagcaacugugaa

SEQ ID NO: 1341740 - RNA, 11 nt, Homo sapiens
agccuccucau

SEQ ID NO: 1341741 - RNA, 18 nt, Homo sapiens
agccucuccgacucugca

SEQ ID NO: 1341742 - RNA, 13 nt, Homo sapiens
agccucucuggcu

SEQ ID NO: 1341743 - RNA, 18 nt, Homo sapiens
agccugaagggugccuag

SEQ ID NO: 1341744 - RNA, 19 nt, Homo sapiens
agccugaauuuuguugcug

SEQ ID NO: 1341745 - RNA, 22 nt, Homo sapiens
agccugacuagaacuccugucu

SEQ ID NO: 1341746 - RNA, 16 nt, Homo sapiens
agccugagccaaagag

SEQ ID NO: 1341747 - RNA, 13 nt, Homo sapiens
agccugccuuuaa

SEQ ID NO: 1341748 - RNA, 16 nt, Homo sapiens
agccuggccaacaugg

SEQ ID NO: 1341749 - RNA, 13 nt, Homo sapiens
agccuggccagac

SEQ ID NO: 1341750 - RNA, 16 nt, Homo sapiens
agccugggagcccaga

SEQ ID NO: 1341751 - RNA, 19 nt, Homo sapiens
agccuuaaaaugcauugaa

SEQ ID NO: 1341752 - RNA, 19 nt, Homo sapiens
agccuuagagcucuugugu

SEQ ID NO: 1341753 - RNA, 12 nt, Homo sapiens
agccuucuugau

SEQ ID NO: 1341754 - RNA, 23 nt, Homo sapiens
agccuuugugcuuuuugucaugu

SEQ ID NO: 1341755 - RNA, 16 nt, Homo sapiens
agccuuuugaugucuu

SEQ ID NO: 1341756 - RNA, 14 nt, Homo sapiens
agccuuuugcucuc

SEQ ID NO: 1341757 - RNA, 14 nt, Homo sapiens
agcgcaugugugca

SEQ ID NO: 1341758 - RNA, 22 nt, Homo sapiens
agcgccuuucccaacucuagcu

SEQ ID NO: 1341759 - RNA, 18 nt, Homo sapiens
agcgcuucaguucagcuu

SEQ ID NO: 1341760 - RNA, 11 nt, Homo sapiens
agcggacauca

SEQ ID NO: 1341761 - RNA, 14 nt, Homo sapiens
agcgggaauggcag

SEQ ID NO: 1341762 - RNA, 20 nt, Homo sapiens
agcgggcuugacugcauugc

SEQ ID NO: 1341763 - RNA, 14 nt, Homo sapiens
agcgugugccacug

SEQ ID NO: 1341764 - RNA, 13 nt, Homo sapiens
agcuaaaacuggc

SEQ ID NO: 1341765 - RNA, 14 nt, Homo sapiens
agcuaaaacuggcc

SEQ ID NO: 1341766 - RNA, 22 nt, Homo sapiens
agcuaaauuuucugaaacugca

SEQ ID NO: 1341767 - RNA, 21 nt, Homo sapiens
agcuacaccuuucuccuuugu

SEQ ID NO: 1341768 - RNA, 15 nt, Homo sapiens
agcuaccucaaccaa

SEQ ID NO: 1341769 - RNA, 23 nt, Homo sapiens
agcuaccucaaccaaugccaaaa

SEQ ID NO: 1341770 - RNA, 17 nt, Homo sapiens
agcuacuauguacugcc

SEQ ID NO: 1341771 - RNA, 16 nt, Homo sapiens
agcuagaaaacauuuu

SEQ ID NO: 1341772 - RNA, 17 nt, Homo sapiens
agcuagaauaccaccua

SEQ ID NO: 1341773 - RNA, 15 nt, Homo sapiens
agcuaggaacccugg

SEQ ID NO: 1341774 - RNA, 16 nt, Homo sapiens
agcuauuuuuauacac

SEQ ID NO: 1341775 - RNA, 23 nt, Homo sapiens
agcucaaugaugcaggcaauaaa

SEQ ID NO: 1341776 - RNA, 21 nt, Homo sapiens
agcucaccccuggaggacggc

SEQ ID NO: 1341777 - RNA, 20 nt, Homo sapiens
agcucacccuucgucaugga

SEQ ID NO: 1341778 - RNA, 11 nt, Homo sapiens
agcucagggac

SEQ ID NO: 1341779 - RNA, 22 nt, Homo sapiens
agcuccgaugcccgcccgggga

SEQ ID NO: 1341780 - RNA, 13 nt, Homo sapiens
agcucuacucugg

SEQ ID NO: 1341781 - RNA, 23 nt, Homo sapiens
agcucugcagcacucuuaucuac

SEQ ID NO: 1341782 - RNA, 21 nt, Homo sapiens
agcucugcuccccuaaagccu

SEQ ID NO: 1341783 - RNA, 23 nt, Homo sapiens
agcucuggacagccccacccugg

SEQ ID NO: 1341784 - RNA, 22 nt, Homo sapiens
agcucuggggacagcuuccuca

SEQ ID NO: 1341785 - RNA, 22 nt, Homo sapiens
agcucuggggugggcaguuuuu

SEQ ID NO: 1341786 - RNA, 15 nt, Homo sapiens
agcucuguuuuacaa

SEQ ID NO: 1341787 - RNA, 17 nt, Homo sapiens
agcugaaggcaguggca

SEQ ID NO: 1341788 - RNA, 22 nt, Homo sapiens
agcugaccccgagaagugcucu

SEQ ID NO: 1341789 - RNA, 23 nt, Homo sapiens
agcugauugggcaccugaccaca

SEQ ID NO: 1341790 - RNA, 10 nt, Homo sapiens
agcugccauu

SEQ ID NO: 1341791 - RNA, 18 nt, Homo sapiens
agcugccccacaggugug

SEQ ID NO: 1341792 - RNA, 11 nt, Homo sapiens
agcugcccuag

SEQ ID NO: 1341793 - RNA, 24 nt, Homo sapiens
agcugccuaggauguucugggcua

SEQ ID NO: 1341794 - RNA, 18 nt, Homo sapiens
agcugcgccugcgcugca

SEQ ID NO: 1341795 - RNA, 13 nt, Homo sapiens
agcugcucauuuc

SEQ ID NO: 1341796 - RNA, 19 nt, Homo sapiens
agcugcuccuagagggagg

SEQ ID NO: 1341797 - RNA, 17 nt, Homo sapiens
agcuggauuacaggcau

SEQ ID NO: 1341798 - RNA, 21 nt, Homo sapiens
agcuggcagacucgggaccaa

SEQ ID NO: 1341799 - RNA, 20 nt, Homo sapiens
agcuggcuuuucccauuuca

SEQ ID NO: 1341800 - RNA, 12 nt, Homo sapiens
agcugggagcac

SEQ ID NO: 1341801 - RNA, 15 nt, Homo sapiens
agcuguccugucagu

SEQ ID NO: 1341802 - RNA, 19 nt, Homo sapiens
agcugucgacuucaugaca

SEQ ID NO: 1341803 - RNA, 12 nt, Homo sapiens
agcugucugcuc

SEQ ID NO: 1341804 - RNA, 23 nt, Homo sapiens
agcuguuucucaagaccaacaga

SEQ ID NO: 1341805 - RNA, 16 nt, Homo sapiens
agcuuaaaaucuguga

SEQ ID NO: 1341806 - RNA, 11 nt, Homo sapiens
agcuuaccugg

SEQ ID NO: 1341807 - RNA, 13 nt, Homo sapiens
agcuucaacuuuu

SEQ ID NO: 1341808 - RNA, 18 nt, Homo sapiens
agcuuccaugaugcacag

SEQ ID NO: 1341809 - RNA, 21 nt, Homo sapiens
agcuuccaugaugcacaguau

SEQ ID NO: 1341810 - RNA, 19 nt, Homo sapiens
agcuuguugaaaacccaga

SEQ ID NO: 1341811 - RNA, 15 nt, Homo sapiens
agcuuuaaugauaug

SEQ ID NO: 1341812 - RNA, 19 nt, Homo sapiens
agcuuucaugaccauacaa

SEQ ID NO: 1341813 - RNA, 18 nt, Homo sapiens
agcuuuugaaauccagaa

SEQ ID NO: 1341814 - RNA, 14 nt, Homo sapiens
aggaaaaauugaug

SEQ ID NO: 1341815 - RNA, 21 nt, Homo sapiens
aggaaaaggccccugcaaugu

SEQ ID NO: 1341816 - RNA, 18 nt, Homo sapiens
aggaaaauaaaugaacau

SEQ ID NO: 1341817 - RNA, 14 nt, Homo sapiens
aggaaacaacagcu

SEQ ID NO: 1341818 - RNA, 17 nt, Homo sapiens
aggaaacaacagcuuua

SEQ ID NO: 1341819 - RNA, 23 nt, Homo sapiens
aggaaauccauucacaguucuuu

SEQ ID NO: 1341820 - RNA, 23 nt, Homo sapiens
aggaaauuacugcccacuuguca

SEQ ID NO: 1341821 - RNA, 14 nt, Homo sapiens
aggaacaaagacag

SEQ ID NO: 1341822 - RNA, 15 nt, Homo sapiens
aggaacaaagacagg

SEQ ID NO: 1341823 - RNA, 13 nt, Homo sapiens
aggaacacugaca

SEQ ID NO: 1341824 - RNA, 12 nt, Homo sapiens
aggaacccucag

SEQ ID NO: 1341825 - RNA, 22 nt, Homo sapiens
aggaacugggccaacucaccug

SEQ ID NO: 1341826 - RNA, 19 nt, Homo sapiens
aggaagaguuaugcuuuau

SEQ ID NO: 1341827 - RNA, 19 nt, Homo sapiens
aggaaggaggaagcuuauu

SEQ ID NO: 1341828 - RNA, 22 nt, Homo sapiens
aggaaguaccaagaacagucaa

SEQ ID NO: 1341829 - RNA, 22 nt, Homo sapiens
aggaagugcccucgagcacuga

SEQ ID NO: 1341830 - RNA, 23 nt, Homo sapiens
aggaagugcccucgagcacugaa

SEQ ID NO: 1341831 - RNA, 15 nt, Homo sapiens
aggaauaaagccuuu

SEQ ID NO: 1341832 - RNA, 19 nt, Homo sapiens
aggaauccucugugucuuc

SEQ ID NO: 1341833 - RNA, 14 nt, Homo sapiens
aggaauugguuuca

SEQ ID NO: 1341834 - RNA, 21 nt, Homo sapiens
aggaauuuucuugaaacugug

SEQ ID NO: 1341835 - RNA, 18 nt, Homo sapiens
aggacaaccauuccagac

SEQ ID NO: 1341836 - RNA, 21 nt, Homo sapiens
aggacaaccauuccagacugc

SEQ ID NO: 1341837 - RNA, 15 nt, Homo sapiens
aggacaagggaaaug

SEQ ID NO: 1341838 - RNA, 21 nt, Homo sapiens
aggacaagggaaaugucaggg

SEQ ID NO: 1341839 - RNA, 15 nt, Homo sapiens
aggacagugacccca

SEQ ID NO: 1341840 - RNA, 14 nt, Homo sapiens
aggacaucagcaaa

SEQ ID NO: 1341841 - RNA, 22 nt, Homo sapiens
aggacuccauuucuuucuucca

SEQ ID NO: 1341842 - RNA, 15 nt, Homo sapiens
aggacuuguuucccu

SEQ ID NO: 1341843 - RNA, 13 nt, Homo sapiens
aggagaagccagu

SEQ ID NO: 1341844 - RNA, 14 nt, Homo sapiens
aggagaccuccagc

SEQ ID NO: 1341845 - RNA, 16 nt, Homo sapiens
aggagaccuccagcua

SEQ ID NO: 1341846 - RNA, 12 nt, Homo sapiens
aggagagccugg

SEQ ID NO: 1341847 - RNA, 19 nt, Homo sapiens
aggagccaccaguucucau

SEQ ID NO: 1341848 - RNA, 22 nt, Homo sapiens
aggagccaggccuugggcuccu

SEQ ID NO: 1341849 - RNA, 15 nt, Homo sapiens
aggagcgcuacccac

SEQ ID NO: 1341850 - RNA, 19 nt, Homo sapiens
aggagcuagaacauuccau

SEQ ID NO: 1341851 - RNA, 22 nt, Homo sapiens
aggaguuacagggaaguggucu

SEQ ID NO: 1341852 - RNA, 20 nt, Homo sapiens
cccagagcaucuugcaucca

SEQ ID NO: 1341853 - RNA, 23 nt, Homo sapiens
cccagagcgaggaaaggauuuua

SEQ ID NO: 1341854 - RNA, 18 nt, Homo sapiens
cccagagcugugccagca

SEQ ID NO: 1341855 - RNA, 18 nt, Homo sapiens
cccagcagaaaucaucau

SEQ ID NO: 1341856 - RNA, 21 nt, Homo sapiens
cccagcaucgcacucuggcag

SEQ ID NO: 1341857 - RNA, 14 nt, Homo sapiens
cccagccccuccaa

SEQ ID NO: 1341858 - RNA, 19 nt, Homo sapiens
cccagccccuccaaagguc

SEQ ID NO: 1341859 - RNA, 14 nt, Homo sapiens
cccagccccuucca

SEQ ID NO: 1341860 - RNA, 23 nt, Homo sapiens
cccagcccugggaaccacuccca

SEQ ID NO: 1341861 - RNA, 15 nt, Homo sapiens
cccagccucaucucu

SEQ ID NO: 1341862 - RNA, 15 nt, Homo sapiens
cccagccucccugaa

SEQ ID NO: 1341863 - RNA, 13 nt, Homo sapiens
cccaggacuguug

SEQ ID NO: 1341864 - RNA, 23 nt, Homo sapiens
cccaggagacagaccacuugcca

SEQ ID NO: 1341865 - RNA, 16 nt, Homo sapiens
cccaggaguauccucu

SEQ ID NO: 1341866 - RNA, 17 nt, Homo sapiens
cccaggcuggagugcaa

SEQ ID NO: 1341867 - RNA, 20 nt, Homo sapiens
cccaggcuggagugcaaugg

SEQ ID NO: 1341868 - RNA, 16 nt, Homo sapiens
cccaggcuggucuuga

SEQ ID NO: 1341869 - RNA, 14 nt, Homo sapiens
cccagggagcucug

SEQ ID NO: 1341870 - RNA, 18 nt, Homo sapiens
cccaggggccggccagug

SEQ ID NO: 1341871 - RNA, 19 nt, Homo sapiens
cccaggggccggccagugg

SEQ ID NO: 1341872 - RNA, 15 nt, Homo sapiens
cccagggggcaacug

SEQ ID NO: 1341873 - RNA, 18 nt, Homo sapiens
cccagguacccaugaaug

SEQ ID NO: 1341874 - RNA, 13 nt, Homo sapiens
cccagguccugca

SEQ ID NO: 1341875 - RNA, 13 nt, Homo sapiens
cccagucccacac

SEQ ID NO: 1341876 - RNA, 18 nt, Homo sapiens
cccagucccacacugugg

SEQ ID NO: 1341877 - RNA, 19 nt, Homo sapiens
cccagucccagacaauucc

SEQ ID NO: 1341878 - RNA, 11 nt, Homo sapiens
cccagucccau

SEQ ID NO: 1341879 - RNA, 11 nt, Homo sapiens
cccagugcaaa

SEQ ID NO: 1341880 - RNA, 13 nt, Homo sapiens
cccagugcuugca

SEQ ID NO: 1341881 - RNA, 17 nt, Homo sapiens
cccaguugugacaauua

SEQ ID NO: 1341882 - RNA, 20 nt, Homo sapiens
cccauaaaaugauccugcca

SEQ ID NO: 1341883 - RNA, 20 nt, Homo sapiens
cccaucagacugucaagaag

SEQ ID NO: 1341884 - RNA, 20 nt, Homo sapiens
cccaucuuccaccucaccuc

SEQ ID NO: 1341885 - RNA, 18 nt, Homo sapiens
cccauuccaaagcuuuau

SEQ ID NO: 1341886 - RNA, 14 nt, Homo sapiens
cccauuccugaaga

SEQ ID NO: 1341887 - RNA, 21 nt, Homo sapiens
cccauuucaauuccugugauu

SEQ ID NO: 1341888 - RNA, 9 nt, Homo sapiens
cccauuucu

SEQ ID NO: 1341889 - RNA, 16 nt, Homo sapiens
ccccaaggcugcaaag

SEQ ID NO: 1341890 - RNA, 20 nt, Homo sapiens
ccccaagggggcugcugcuc

SEQ ID NO: 1341891 - RNA, 19 nt, Homo sapiens
ccccagcccagagacauac

SEQ ID NO: 1341892 - RNA, 17 nt, Homo sapiens
ccccaguagcugggauu

SEQ ID NO: 1341893 - RNA, 20 nt, Homo sapiens
ccccagugacuccaggguga

SEQ ID NO: 1341894 - RNA, 15 nt, Homo sapiens
ccccaugcacuguga

SEQ ID NO: 1341895 - RNA, 23 nt, Homo sapiens
ccccauguaucucaguaccccau

SEQ ID NO: 1341896 - RNA, 14 nt, Homo sapiens
cccccagagcucuu

SEQ ID NO: 1341897 - RNA, 16 nt, Homo sapiens
cccccaucccugccac

SEQ ID NO: 1341898 - RNA, 18 nt, Homo sapiens
cccccucccagacaggcc

SEQ ID NO: 1341899 - RNA, 14 nt, Homo sapiens
cccccuccugcaag

SEQ ID NO: 1341900 - RNA, 14 nt, Homo sapiens
cccccugcccagag

SEQ ID NO: 1341901 - RNA, 13 nt, Homo sapiens
cccccuucacaaa

SEQ ID NO: 1341902 - RNA, 17 nt, Homo sapiens
cccccuuguuguaaaaa

SEQ ID NO: 1341903 - RNA, 15 nt, Homo sapiens
ccccgucacagccuc

SEQ ID NO: 1341904 - RNA, 18 nt, Homo sapiens
ccccuacugugggcaaag

SEQ ID NO: 1341905 - RNA, 15 nt, Homo sapiens
ccccucagagugcaa

SEQ ID NO: 1341906 - RNA, 12 nt, Homo sapiens
ccccuccacugg

SEQ ID NO: 1341907 - RNA, 21 nt, Homo sapiens
ccccuccuuggcuuuaugcaa

SEQ ID NO: 1341908 - RNA, 22 nt, Homo sapiens
ccccuccuuggcuuuaugcaaa

SEQ ID NO: 1341909 - RNA, 15 nt, Homo sapiens
ccccucggagaagag

SEQ ID NO: 1341910 - RNA, 13 nt, Homo sapiens
ccccugucuggaa

SEQ ID NO: 1341911 - RNA, 20 nt, Homo sapiens
ccccuguggccaacugcaaa

SEQ ID NO: 1341912 - RNA, 22 nt, Homo sapiens
cccgaggacgcucccugcucca

SEQ ID NO: 1341913 - RNA, 16 nt, Homo sapiens
cccgcccucccggaga

SEQ ID NO: 1341914 - RNA, 21 nt, Homo sapiens
cccgcuaaggugaaaaggggu

SEQ ID NO: 1341915 - RNA, 18 nt, Homo sapiens
cccuaaaaagauugccaa

SEQ ID NO: 1341916 - RNA, 14 nt, Homo sapiens
cccuaaaccaaaaa

SEQ ID NO: 1341917 - RNA, 21 nt, Homo sapiens
cccuaaaccaaaaacugaaag

SEQ ID NO: 1341918 - RNA, 21 nt, Homo sapiens
cccuaaagccaggcucaggag

SEQ ID NO: 1341919 - RNA, 18 nt, Homo sapiens
cccuaagcgcacauucau

SEQ ID NO: 1341920 - RNA, 22 nt, Homo sapiens
cccuaccguccuccugagccac

SEQ ID NO: 1341921 - RNA, 16 nt, Homo sapiens
cccuagaugcacgugg

SEQ ID NO: 1341922 - RNA, 20 nt, Homo sapiens
cccuagaugcacguggggcc

SEQ ID NO: 1341923 - RNA, 23 nt, Homo sapiens
cccuagccagagaauagaucagu

SEQ ID NO: 1341924 - RNA, 12 nt, Homo sapiens
cccucacccauc

SEQ ID NO: 1341925 - RNA, 14 nt, Homo sapiens
cccucagagugcaa

SEQ ID NO: 1341926 - RNA, 20 nt, Homo sapiens
cccucaggagccucugcucc

SEQ ID NO: 1341927 - RNA, 18 nt, Homo sapiens
cccucaggcacaccuugc

SEQ ID NO: 1341928 - RNA, 10 nt, Homo sapiens
cccucaggcu

SEQ ID NO: 1341929 - RNA, 18 nt, Homo sapiens
cccucauucuacugaaaa

SEQ ID NO: 1341930 - RNA, 16 nt, Homo sapiens
cccuccaaaccuccag

SEQ ID NO: 1341931 - RNA, 15 nt, Homo sapiens
cccuccuuggcuuua

SEQ ID NO: 1341932 - RNA, 20 nt, Homo sapiens
cccucguuaaucacaggauc

SEQ ID NO: 1341933 - RNA, 12 nt, Homo sapiens
cccucucacuuu

SEQ ID NO: 1341934 - RNA, 14 nt, Homo sapiens
cccucuucauggau

SEQ ID NO: 1341935 - RNA, 16 nt, Homo sapiens
cccucuucauggaugg

SEQ ID NO: 1341936 - RNA, 23 nt, Homo sapiens
cccucuuuguuucugcuucauuu

SEQ ID NO: 1341937 - RNA, 11 nt, Homo sapiens
cccugcaaaac

SEQ ID NO: 1341938 - RNA, 14 nt, Homo sapiens
cccugcaaagggaa

SEQ ID NO: 1341939 - RNA, 17 nt, Homo sapiens
cccugcaauguggugac

SEQ ID NO: 1341940 - RNA, 14 nt, Homo sapiens
cccugcaccaugcu

SEQ ID NO: 1341941 - RNA, 13 nt, Homo sapiens
cccugccugaaua

SEQ ID NO: 1341942 - RNA, 13 nt, Homo sapiens
cccugcucccaca

SEQ ID NO: 1341943 - RNA, 18 nt, Homo sapiens
cccuggaaggacauccau

SEQ ID NO: 1341944 - RNA, 21 nt, Homo sapiens
cccuggugggccaacaaagaa

SEQ ID NO: 1341945 - RNA, 16 nt, Homo sapiens
cccuguccuugcccuu

SEQ ID NO: 1341946 - RNA, 14 nt, Homo sapiens
cccuguggcacuca

SEQ ID NO: 1341947 - RNA, 15 nt, Homo sapiens
cccugugucauuuca

SEQ ID NO: 1341948 - RNA, 20 nt, Homo sapiens
cccugugucauuucaaacag

SEQ ID NO: 1341949 - RNA, 17 nt, Homo sapiens
cccuuaacugcauccag

SEQ ID NO: 1341950 - RNA, 13 nt, Homo sapiens
cccuucacaaagc

SEQ ID NO: 1341951 - RNA, 20 nt, Homo sapiens
cccuucauccgccugugggc

SEQ ID NO: 1341952 - RNA, 14 nt, Homo sapiens
cccuuccagugccc

SEQ ID NO: 1341953 - RNA, 21 nt, Homo sapiens
cccuuccaugucgccucugca

SEQ ID NO: 1341954 - RNA, 20 nt, Homo sapiens
cccuucccucaccuuggcac

SEQ ID NO: 1341955 - RNA, 17 nt, Homo sapiens
cccuucuuuacuuccca

SEQ ID NO: 1341956 - RNA, 18 nt, Homo sapiens
cccuugaggaaacaacag

SEQ ID NO: 1341957 - RNA, 17 nt, Homo sapiens
cccuugguucucauaac

SEQ ID NO: 1341958 - RNA, 19 nt, Homo sapiens
cccuuugugacuucaagaa

SEQ ID NO: 1341959 - RNA, 23 nt, Homo sapiens
cccuuuugggccuagaauucuga

SEQ ID NO: 1341960 - RNA, 14 nt, Homo sapiens
ccgaaaugcugucu

SEQ ID NO: 1341961 - RNA, 19 nt, Homo sapiens
ccgacucuuugauaugcca

SEQ ID NO: 1341962 - RNA, 20 nt, Homo sapiens
ccgagucucuucuccacugg

SEQ ID NO: 1341963 - RNA, 18 nt, Homo sapiens
ccgcauuuggauuggaug

SEQ ID NO: 1341964 - RNA, 22 nt, Homo sapiens
ccgcuucuccaagucugcugau

SEQ ID NO: 1341965 - RNA, 14 nt, Homo sapiens
ccgggcuggagaaa

SEQ ID NO: 1341966 - RNA, 20 nt, Homo sapiens
ccggggagaaacccagagau

SEQ ID NO: 1341967 - RNA, 21 nt, Homo sapiens
ccgggugggcggcacagccuu

SEQ ID NO: 1341968 - RNA, 13 nt, Homo sapiens
ccguccacagggc

SEQ ID NO: 1341969 - RNA, 18 nt, Homo sapiens
ccguccucucggcugcca

SEQ ID NO: 1341970 - RNA, 22 nt, Homo sapiens
ccgucucaaaaaaaagaaaaug

SEQ ID NO: 1341971 - RNA, 15 nt, Homo sapiens
ccgucuggaccuggg

SEQ ID NO: 1341972 - RNA, 16 nt, Homo sapiens
ccgugcuuaaccaaag

SEQ ID NO: 1341973 - RNA, 15 nt, Homo sapiens
ccguggacuacacag

SEQ ID NO: 1341974 - RNA, 12 nt, Homo sapiens
ccguggagccuu

SEQ ID NO: 1341975 - RNA, 18 nt, Homo sapiens
ccguuuagaaaaaacaau

SEQ ID NO: 1341976 - RNA, 21 nt, Homo sapiens
ccuaaaacccaaagguggcag

SEQ ID NO: 1341977 - RNA, 17 nt, Homo sapiens
ccuaaaagcacacucau

SEQ ID NO: 1341978 - RNA, 11 nt, Homo sapiens
ccuaaagccag

SEQ ID NO: 1341979 - RNA, 17 nt, Homo sapiens
ccuaagaagaaggccag

SEQ ID NO: 1341980 - RNA, 21 nt, Homo sapiens
ccuaagaagaaggccagagag

SEQ ID NO: 1341981 - RNA, 20 nt, Homo sapiens
ccuaauacugucauccucaa

SEQ ID NO: 1341982 - RNA, 20 nt, Homo sapiens
ccuaauccaggcagauccag

SEQ ID NO: 1341983 - RNA, 12 nt, Homo sapiens
ccuaaucuucca

SEQ ID NO: 1341984 - RNA, 12 nt, Homo sapiens
ccuaaugaaguu

SEQ ID NO: 1341985 - RNA, 14 nt, Homo sapiens
ccuacacugaugca

SEQ ID NO: 1341986 - RNA, 13 nt, Homo sapiens
ccuacauuaucuc

SEQ ID NO: 1341987 - RNA, 20 nt, Homo sapiens
ccuacauuaucucacuuagu

SEQ ID NO: 1341988 - RNA, 18 nt, Homo sapiens
ccaaucccagcuaccuca

SEQ ID NO: 1341989 - RNA, 13 nt, Homo sapiens
ccaaucuuucuau

SEQ ID NO: 1341990 - RNA, 15 nt, Homo sapiens
ccaauuucagacucc

SEQ ID NO: 1341991 - RNA, 20 nt, Homo sapiens
ccaauuuucuucaucuuugc

SEQ ID NO: 1341992 - RNA, 18 nt, Homo sapiens
ccaauuuuuuaagugaaa

SEQ ID NO: 1341993 - RNA, 19 nt, Homo sapiens
ccacaaaacuucagugugg

SEQ ID NO: 1341994 - RNA, 21 nt, Homo sapiens
ccacaaaugggaaaaccagac

SEQ ID NO: 1341995 - RNA, 22 nt, Homo sapiens
ccacaauuauuggcaaaguuua

SEQ ID NO: 1341996 - RNA, 17 nt, Homo sapiens
ccacacuaccaguuuca

SEQ ID NO: 1341997 - RNA, 18 nt, Homo sapiens
ccacacuuccugagccag

SEQ ID NO: 1341998 - RNA, 18 nt, Homo sapiens
ccacagacucaaaugcuc

SEQ ID NO: 1341999 - RNA, 21 nt, Homo sapiens
ccacagacucaaaugcucaga

SEQ ID NO: 1342000 - RNA, 12 nt, Homo sapiens
ccacagcacuau

SEQ ID NO: 1342001 - RNA, 17 nt, Homo sapiens
ccacaggcucugaccag

SEQ ID NO: 1342002 - RNA, 14 nt, Homo sapiens
ccacagucacugga

SEQ ID NO: 1342003 - RNA, 12 nt, Homo sapiens
ccacaucuccug

SEQ ID NO: 1342004 - RNA, 14 nt, Homo sapiens
ccacauucagggaa

SEQ ID NO: 1342005 - RNA, 15 nt, Homo sapiens
ccacauucagggaaa

SEQ ID NO: 1342006 - RNA, 23 nt, Homo sapiens
ccaccaagaagcacugggugacc

SEQ ID NO: 1342007 - RNA, 13 nt, Homo sapiens
ccaccacucccca

SEQ ID NO: 1342008 - RNA, 17 nt, Homo sapiens
ccaccagcaaggggacc

SEQ ID NO: 1342009 - RNA, 23 nt, Homo sapiens
ccacccccaaauuuucuuuuuau

SEQ ID NO: 1342010 - RNA, 19 nt, Homo sapiens
ccaccccccacucagugcc

SEQ ID NO: 1342011 - RNA, 21 nt, Homo sapiens
ccacccuggugggccaacaaa

SEQ ID NO: 1342012 - RNA, 17 nt, Homo sapiens
ccaccguucagucauuu

SEQ ID NO: 1342013 - RNA, 21 nt, Homo sapiens
ccaccucccugccuccaggaa

SEQ ID NO: 1342014 - RNA, 19 nt, Homo sapiens
ccaccugcuggagugaagg

SEQ ID NO: 1342015 - RNA, 23 nt, Homo sapiens
ccacgggcccggguugggucacc

SEQ ID NO: 1342016 - RNA, 19 nt, Homo sapiens
ccacguugccucuacuuua

SEQ ID NO: 1342017 - RNA, 20 nt, Homo sapiens
ccacguugccucuacuuuau

SEQ ID NO: 1342018 - RNA, 20 nt, Homo sapiens
ccacuaaugggugucaucuu

SEQ ID NO: 1342019 - RNA, 14 nt, Homo sapiens
ccacuaccaaaaga

SEQ ID NO: 1342020 - RNA, 13 nt, Homo sapiens
ccacuaugccuga

SEQ ID NO: 1342021 - RNA, 20 nt, Homo sapiens
ccacucaccuaucaacagau

SEQ ID NO: 1342022 - RNA, 19 nt, Homo sapiens
ccacucaggccacaguggg

SEQ ID NO: 1342023 - RNA, 19 nt, Homo sapiens
ccacucaugacugcaugac

SEQ ID NO: 1342024 - RNA, 16 nt, Homo sapiens
ccacugcaugggcugu

SEQ ID NO: 1342025 - RNA, 16 nt, Homo sapiens
ccacugcccacuggcc

SEQ ID NO: 1342026 - RNA, 17 nt, Homo sapiens
ccacugcccacuggccg

SEQ ID NO: 1342027 - RNA, 18 nt, Homo sapiens
ccacugcgcucuugggac

SEQ ID NO: 1342028 - RNA, 13 nt, Homo sapiens
ccacuggggacuu

SEQ ID NO: 1342029 - RNA, 17 nt, Homo sapiens
ccacuuaaaauacauga

SEQ ID NO: 1342030 - RNA, 20 nt, Homo sapiens
ccagaaaaccucuccugacc

SEQ ID NO: 1342031 - RNA, 15 nt, Homo sapiens
ccagacaauuccauu

SEQ ID NO: 1342032 - RNA, 18 nt, Homo sapiens
ccagacuucucuuucuua

SEQ ID NO: 1342033 - RNA, 15 nt, Homo sapiens
ccagagaguggcucc

SEQ ID NO: 1342034 - RNA, 15 nt, Homo sapiens
ccagagcaucuugca

SEQ ID NO: 1342035 - RNA, 12 nt, Homo sapiens
ccagaggcaucu

SEQ ID NO: 1342036 - RNA, 21 nt, Homo sapiens
ccagauggaacaauaaaagac

SEQ ID NO: 1342037 - RNA, 14 nt, Homo sapiens
ccagauucaugcac

SEQ ID NO: 1342038 - RNA, 21 nt, Homo sapiens
ccagauuggcaccccuuucua

SEQ ID NO: 1342039 - RNA, 14 nt, Homo sapiens
ccagcacuggugaa

SEQ ID NO: 1342040 - RNA, 23 nt, Homo sapiens
ccagcagaaaucaucaucaugau

SEQ ID NO: 1342041 - RNA, 19 nt, Homo sapiens
ccagcagggaaaaugcagc

SEQ ID NO: 1342042 - RNA, 19 nt, Homo sapiens
ccagcaucucccaguucau

SEQ ID NO: 1342043 - RNA, 21 nt, Homo sapiens
ccagccagaggcaucugaggg

SEQ ID NO: 1342044 - RNA, 17 nt, Homo sapiens
ccagccagggcucaauc

SEQ ID NO: 1342045 - RNA, 13 nt, Homo sapiens
ccagcccagagac

SEQ ID NO: 1342046 - RNA, 16 nt, Homo sapiens
ccagcccugggaacca

SEQ ID NO: 1342047 - RNA, 16 nt, Homo sapiens
ccagccguauuuuaca

SEQ ID NO: 1342048 - RNA, 16 nt, Homo sapiens
ccagccuccaugcugc

SEQ ID NO: 1342049 - RNA, 21 nt, Homo sapiens
ccagccugggcaacauaguga

SEQ ID NO: 1342050 - RNA, 16 nt, Homo sapiens
ccagcuacaccuuucu

SEQ ID NO: 1342051 - RNA, 20 nt, Homo sapiens
ccagcuccaaccugcaaaga

SEQ ID NO: 1342052 - RNA, 18 nt, Homo sapiens
ccagcugcacugaugcug

SEQ ID NO: 1342053 - RNA, 18 nt, Homo sapiens
ccagcugggaagcccuuu

SEQ ID NO: 1342054 - RNA, 19 nt, Homo sapiens
ccagcugugcacuuucuuc

SEQ ID NO: 1342055 - RNA, 14 nt, Homo sapiens
ccagcuuuccucau

SEQ ID NO: 1342056 - RNA, 14 nt, Homo sapiens
ccaggaaaggccca

SEQ ID NO: 1342057 - RNA, 21 nt, Homo sapiens
ccaggacuauauuugggccug

SEQ ID NO: 1342058 - RNA, 22 nt, Homo sapiens
ccaggauauccucccuccagau

SEQ ID NO: 1342059 - RNA, 20 nt, Homo sapiens
ccaggauuauugucaaagaa

SEQ ID NO: 1342060 - RNA, 18 nt, Homo sapiens
ccaggcuggagugcaaug

SEQ ID NO: 1342061 - RNA, 17 nt, Homo sapiens
ccaggggccggccagug

SEQ ID NO: 1342062 - RNA, 15 nt, Homo sapiens
ccaggucugacucca

SEQ ID NO: 1342063 - RNA, 18 nt, Homo sapiens
ccagguuuaugaaugaca

SEQ ID NO: 1342064 - RNA, 17 nt, Homo sapiens
ccaguaacugugcugua

SEQ ID NO: 1342065 - RNA, 20 nt, Homo sapiens
ccaguaguaaugugcuuguu

SEQ ID NO: 1342066 - RNA, 15 nt, Homo sapiens
ccaguauuuaacuuc

SEQ ID NO: 1342067 - RNA, 14 nt, Homo sapiens
ccaguccaaagccg

SEQ ID NO: 1342068 - RNA, 12 nt, Homo sapiens
ccaguccaugag

SEQ ID NO: 1342069 - RNA, 16 nt, Homo sapiens
ccagucccacacugug

SEQ ID NO: 1342070 - RNA, 19 nt, Homo sapiens
ccagucccagcuaacucug

SEQ ID NO: 1342071 - RNA, 14 nt, Homo sapiens
ccaguccuguccua

SEQ ID NO: 1342072 - RNA, 18 nt, Homo sapiens
ccagucggccccaucucu

SEQ ID NO: 1342073 - RNA, 14 nt, Homo sapiens
ccagugagacugug

SEQ ID NO: 1342074 - RNA, 17 nt, Homo sapiens
ccagugcgguuccucau

SEQ ID NO: 1342075 - RNA, 14 nt, Homo sapiens
ccaguggugcguuu

SEQ ID NO: 1342076 - RNA, 21 nt, Homo sapiens
ccagugguggguaauuguaca

SEQ ID NO: 1342077 - RNA, 14 nt, Homo sapiens
ccauaacuugaaaa

SEQ ID NO: 1342078 - RNA, 16 nt, Homo sapiens
ccauaauguugcuucu

SEQ ID NO: 1342079 - RNA, 14 nt, Homo sapiens
ccauagcaccucca

SEQ ID NO: 1342080 - RNA, 20 nt, Homo sapiens
ccauaugaacagcuguucag

SEQ ID NO: 1342081 - RNA, 15 nt, Homo sapiens
ccaucaacugugaaa

SEQ ID NO: 1342082 - RNA, 12 nt, Homo sapiens
ccaucagacugu

SEQ ID NO: 1342083 - RNA, 15 nt, Homo sapiens
ccaucagacugucaa

SEQ ID NO: 1342084 - RNA, 21 nt, Homo sapiens
ccauccugcagauacuuugaa

SEQ ID NO: 1342085 - RNA, 16 nt, Homo sapiens
ccauccuggggcagca

SEQ ID NO: 1342086 - RNA, 14 nt, Homo sapiens
ccaucucacugcag

SEQ ID NO: 1342087 - RNA, 16 nt, Homo sapiens
ccaucucugauuuuca

SEQ ID NO: 1342088 - RNA, 19 nt, Homo sapiens
ccaucugcccggcacuggg

SEQ ID NO: 1342089 - RNA, 15 nt, Homo sapiens
ccaucugcugcaguu

SEQ ID NO: 1342090 - RNA, 23 nt, Homo sapiens
ccaucugggcuuauauguacuuu

SEQ ID NO: 1342091 - RNA, 20 nt, Homo sapiens
ccaugaaguuuaaagauucu

SEQ ID NO: 1342092 - RNA, 13 nt, Homo sapiens
ccaugaugcacag

SEQ ID NO: 1342093 - RNA, 22 nt, Homo sapiens
ccaugauggcaacagaucugga

SEQ ID NO: 1342094 - RNA, 16 nt, Homo sapiens
ccaugcugugcugugu

SEQ ID NO: 1342095 - RNA, 15 nt, Homo sapiens
ccaugggcacagugg

SEQ ID NO: 1342096 - RNA, 12 nt, Homo sapiens
ccaugugccuuu

SEQ ID NO: 1342097 - RNA, 16 nt, Homo sapiens
ccauuccaaagcuuua

SEQ ID NO: 1342098 - RNA, 19 nt, Homo sapiens
ccauucuucacucuuugaa

SEQ ID NO: 1342099 - RNA, 15 nt, Homo sapiens
ccauuggauuacuuu

SEQ ID NO: 1342100 - RNA, 21 nt, Homo sapiens
ccauuuauuaagcaguacaaa

SEQ ID NO: 1342101 - RNA, 22 nt, Homo sapiens
ccauuuccuccuuuaccuuuca

SEQ ID NO: 1342102 - RNA, 23 nt, Homo sapiens
ccauuuguuuucggcagccuuaa

SEQ ID NO: 1342103 - RNA, 20 nt, Homo sapiens
cccaaacccuuaacugacau

SEQ ID NO: 1342104 - RNA, 15 nt, Homo sapiens
cccaaaggagucaga

SEQ ID NO: 1342105 - RNA, 19 nt, Homo sapiens
cccaaaggagucagagcau

SEQ ID NO: 1342106 - RNA, 21 nt, Homo sapiens
cccaaccuucuugucauugaa

SEQ ID NO: 1342107 - RNA, 21 nt, Homo sapiens
cccaagacaugacauucuuag

SEQ ID NO: 1342108 - RNA, 23 nt, Homo sapiens
cccaagauguggccuuuagcaaa

SEQ ID NO: 1342109 - RNA, 20 nt, Homo sapiens
cccaaggcgauauaagcaaa

SEQ ID NO: 1342110 - RNA, 17 nt, Homo sapiens
cccaaguucaugcagcu

SEQ ID NO: 1342111 - RNA, 22 nt, Homo sapiens
cccacaauugaacuuccaggaa

SEQ ID NO: 1342112 - RNA, 17 nt, Homo sapiens
cccaccaucugcugucu

SEQ ID NO: 1342113 - RNA, 17 nt, Homo sapiens
cccacccugcaaaggga

SEQ ID NO: 1342114 - RNA, 13 nt, Homo sapiens
cccacgagggugc

SEQ ID NO: 1342115 - RNA, 17 nt, Homo sapiens
cccacgagggugccgug

SEQ ID NO: 1342116 - RNA, 17 nt, Homo sapiens
cccacucaugacugcau

SEQ ID NO: 1342117 - RNA, 13 nt, Homo sapiens
cccacugcuucua

SEQ ID NO: 1342118 - RNA, 14 nt, Homo sapiens
cccacuuggcauca

SEQ ID NO: 1342119 - RNA, 15 nt, Homo sapiens
cccacuuuauugcca

SEQ ID NO: 1342120 - RNA, 18 nt, Homo sapiens
cccagaaugccuccugca

SEQ ID NO: 1342121 - RNA, 19 nt, Homo sapiens
cccagacuacuauuuucuu

SEQ ID NO: 1342122 - RNA, 18 nt, Homo sapiens
cccagagacauacuugaa

SEQ ID NO: 1342123 - RNA, 15 nt, Homo sapiens
auaagauuuaauuca

SEQ ID NO: 1342124 - RNA, 18 nt, Homo sapiens
auaagcccaguucaucac

SEQ ID NO: 1342125 - RNA, 19 nt, Homo sapiens
auaagucaaaaggaacaaa

SEQ ID NO: 1342126 - RNA, 15 nt, Homo sapiens
auaauaauagcagug

SEQ ID NO: 1342127 - RNA, 14 nt, Homo sapiens
auaauagauugagu

SEQ ID NO: 1342128 - RNA, 16 nt, Homo sapiens
auaaucguguccugaa

SEQ ID NO: 1342129 - RNA, 16 nt, Homo sapiens
auaaugaauaaacagu

SEQ ID NO: 1342130 - RNA, 14 nt, Homo sapiens
auaauucagcacuu

SEQ ID NO: 1342131 - RNA, 19 nt, Homo sapiens
auaauucagcacuuaacua

SEQ ID NO: 1342132 - RNA, 20 nt, Homo sapiens
auaauucuggagauacuggu

SEQ ID NO: 1342133 - RNA, 20 nt, Homo sapiens
auaauuuucauucauucacu

SEQ ID NO: 1342134 - RNA, 18 nt, Homo sapiens
auacaacagaaaccagaa

SEQ ID NO: 1342135 - RNA, 13 nt, Homo sapiens
auacaaguaauau

SEQ ID NO: 1342136 - RNA, 14 nt, Homo sapiens
auacacaugugcac

SEQ ID NO: 1342137 - RNA, 14 nt, Homo sapiens
auacaccagcaauu

SEQ ID NO: 1342138 - RNA, 18 nt, Homo sapiens
auacaggugacagugaag

SEQ ID NO: 1342139 - RNA, 13 nt, Homo sapiens
auacauacuauga

SEQ ID NO: 1342140 - RNA, 17 nt, Homo sapiens
auacauaugaggacaag

SEQ ID NO: 1342141 - RNA, 16 nt, Homo sapiens
auacauuccuuuuaga

SEQ ID NO: 1342142 - RNA, 23 nt, Homo sapiens
auacccucacuuaaacuuuuauc

SEQ ID NO: 1342143 - RNA, 21 nt, Homo sapiens
auacccuccuuccaccaaguu

SEQ ID NO: 1342144 - RNA, 17 nt, Homo sapiens
auaccugauauauucca

SEQ ID NO: 1342145 - RNA, 20 nt, Homo sapiens
auaccuggcccugugccuug

SEQ ID NO: 1342146 - RNA, 13 nt, Homo sapiens
auaccuggcuuug

SEQ ID NO: 1342147 - RNA, 15 nt, Homo sapiens
auacguagcucucuu

SEQ ID NO: 1342148 - RNA, 19 nt, Homo sapiens
auacuaacauuuucauuga

SEQ ID NO: 1342149 - RNA, 23 nt, Homo sapiens
auacugccuuguuuaauguuaau

SEQ ID NO: 1342150 - RNA, 20 nt, Homo sapiens
auacugcuggaguccagugc

SEQ ID NO: 1342151 - RNA, 22 nt, Homo sapiens
auacuguaggcacacuuugcac

SEQ ID NO: 1342152 - RNA, 17 nt, Homo sapiens
auacuugaagggccaga

SEQ ID NO: 1342153 - RNA, 15 nt, Homo sapiens
auacuuugaagugca

SEQ ID NO: 1342154 - RNA, 21 nt, Homo sapiens
auagaaugagcacccauucca

SEQ ID NO: 1342155 - RNA, 14 nt, Homo sapiens
auagaccugacaau

SEQ ID NO: 1342156 - RNA, 22 nt, Homo sapiens
auagacuguaacuuccaaauaa

SEQ ID NO: 1342157 - RNA, 23 nt, Homo sapiens
auagagccaaguccaaacuggca

SEQ ID NO: 1342158 - RNA, 13 nt, Homo sapiens
auagagugcagug

SEQ ID NO: 1342159 - RNA, 22 nt, Homo sapiens
auagaugccgcggaaggucccu

SEQ ID NO: 1342160 - RNA, 22 nt, Homo sapiens
auagaugcuggcccagggccca

SEQ ID NO: 1342161 - RNA, 23 nt, Homo sapiens
auagaugcuggcccagggcccag

SEQ ID NO: 1342162 - RNA, 23 nt, Homo sapiens
auagauugaguuauuaacuguau

SEQ ID NO: 1342163 - RNA, 17 nt, Homo sapiens
auagauuucuacacuga

SEQ ID NO: 1342164 - RNA, 13 nt, Homo sapiens
auagcaaacucca

SEQ ID NO: 1342165 - RNA, 19 nt, Homo sapiens
auagcaacagagcacuuga

SEQ ID NO: 1342166 - RNA, 18 nt, Homo sapiens
auagcaccuccacauacc

SEQ ID NO: 1342167 - RNA, 14 nt, Homo sapiens
auagcagguaguua

SEQ ID NO: 1342168 - RNA, 22 nt, Homo sapiens
auagcucuggggugggcaguuu

SEQ ID NO: 1342169 - RNA, 23 nt, Homo sapiens
auagcucuggggugggcaguuuu

SEQ ID NO: 1342170 - RNA, 22 nt, Homo sapiens
auagcuuuaguccuucucaccu

SEQ ID NO: 1342171 - RNA, 19 nt, Homo sapiens
auagggagcagaugcaaug

SEQ ID NO: 1342172 - RNA, 18 nt, Homo sapiens
auaggugagauaaauuaa

SEQ ID NO: 1342173 - RNA, 20 nt, Homo sapiens
auaggugcuacaaaaacaca

SEQ ID NO: 1342174 - RNA, 22 nt, Homo sapiens
auagugaugaaccagaguuucu

SEQ ID NO: 1342175 - RNA, 15 nt, Homo sapiens
auagugucucuucaa

SEQ ID NO: 1342176 - RNA, 15 nt, Homo sapiens
auaguugauucuugc

SEQ ID NO: 1342177 - RNA, 15 nt, Homo sapiens
auaguugcugucauc

SEQ ID NO: 1342178 - RNA, 11 nt, Homo sapiens
auauaaggaau

SEQ ID NO: 1342179 - RNA, 20 nt, Homo sapiens
auauacuugguucucuccac

SEQ ID NO: 1342180 - RNA, 12 nt, Homo sapiens
auauagacacac

SEQ ID NO: 1342181 - RNA, 19 nt, Homo sapiens
auauaguaacacacuucca

SEQ ID NO: 1342182 - RNA, 15 nt, Homo sapiens
auauagucacacuuu

SEQ ID NO: 1342183 - RNA, 22 nt, Homo sapiens
auauauaggcaguugcaugcua

SEQ ID NO: 1342184 - RNA, 15 nt, Homo sapiens
auauaucuaccccag

SEQ ID NO: 1342185 - RNA, 15 nt, Homo sapiens
auauaugucagugau

SEQ ID NO: 1342186 - RNA, 17 nt, Homo sapiens
auauauuuauaaggaaa

SEQ ID NO: 1342187 - RNA, 14 nt, Homo sapiens
auaucaaucaagcc

SEQ ID NO: 1342188 - RNA, 13 nt, Homo sapiens
auaucaugaguga

SEQ ID NO: 1342189 - RNA, 22 nt, Homo sapiens
auauccaggaauauaugucagu

SEQ ID NO: 1342190 - RNA, 16 nt, Homo sapiens
auaucccuacauguau

SEQ ID NO: 1342191 - RNA, 17 nt, Homo sapiens
auauccugacaagauua

SEQ ID NO: 1342192 - RNA, 16 nt, Homo sapiens
auaugaagaaucugcu

SEQ ID NO: 1342193 - RNA, 16 nt, Homo sapiens
auaugaucggccauca

SEQ ID NO: 1342194 - RNA, 23 nt, Homo sapiens
auaugaucuguuuuguaucuuaa

SEQ ID NO: 1342195 - RNA, 14 nt, Homo sapiens
auaugcaaagcacu

SEQ ID NO: 1342196 - RNA, 15 nt, Homo sapiens
auaugcaagcagcuu

SEQ ID NO: 1342197 - RNA, 15 nt, Homo sapiens
auauggagugaccaa

SEQ ID NO: 1342198 - RNA, 13 nt, Homo sapiens
auauggcugccca

SEQ ID NO: 1342199 - RNA, 16 nt, Homo sapiens
auaugucaucacucua

SEQ ID NO: 1342200 - RNA, 12 nt, Homo sapiens
auauguggaauc

SEQ ID NO: 1342201 - RNA, 23 nt, Homo sapiens
auauguuguucuuacaaaccaua

SEQ ID NO: 1342202 - RNA, 13 nt, Homo sapiens
auauuaacauauu

SEQ ID NO: 1342203 - RNA, 12 nt, Homo sapiens
auauuaucucau

SEQ ID NO: 1342204 - RNA, 13 nt, Homo sapiens
auauuauugauuc

SEQ ID NO: 1342205 - RNA, 17 nt, Homo sapiens
auauuauugauucacuu

SEQ ID NO: 1342206 - RNA, 17 nt, Homo sapiens
auauucacuaaggacuu

SEQ ID NO: 1342207 - RNA, 14 nt, Homo sapiens
auauuccaccagga

SEQ ID NO: 1342208 - RNA, 17 nt, Homo sapiens
auauuccaccaggauau

SEQ ID NO: 1342209 - RNA, 21 nt, Homo sapiens
auauucugaagcaacauuuua

SEQ ID NO: 1342210 - RNA, 20 nt, Homo sapiens
auauuggccaaacuggugca

SEQ ID NO: 1342211 - RNA, 15 nt, Homo sapiens
auauuguuauauaca

SEQ ID NO: 1342212 - RNA, 20 nt, Homo sapiens
auauuuagcugcuaacaaga

SEQ ID NO: 1342213 - RNA, 20 nt, Homo sapiens
auauuuaggcaugagcucuu

SEQ ID NO: 1342214 - RNA, 20 nt, Homo sapiens
auauuuauuuaacuauucau

SEQ ID NO: 1342215 - RNA, 18 nt, Homo sapiens
auauuucauuuagcuuuu

SEQ ID NO: 1342216 - RNA, 13 nt, Homo sapiens
auauuuugcuaac

SEQ ID NO: 1342217 - RNA, 18 nt, Homo sapiens
auauuuuguuuugugcag

SEQ ID NO: 1342218 - RNA, 15 nt, Homo sapiens
aucaaaccacuguua

SEQ ID NO: 1342219 - RNA, 15 nt, Homo sapiens
aucaaagacagcauc

SEQ ID NO: 1342220 - RNA, 18 nt, Homo sapiens
aucaacauuuguuccaug

SEQ ID NO: 1342221 - RNA, 15 nt, Homo sapiens
aucaagaacauguca

SEQ ID NO: 1342222 - RNA, 20 nt, Homo sapiens
aucaagaacaugucagcaau

SEQ ID NO: 1342223 - RNA, 18 nt, Homo sapiens
aucaagacugcaaacccu

SEQ ID NO: 1342224 - RNA, 19 nt, Homo sapiens
aucaagguagaacaaagaa

SEQ ID NO: 1342225 - RNA, 21 nt, Homo sapiens
aucaauaaauguugcaaugca

SEQ ID NO: 1342226 - RNA, 16 nt, Homo sapiens
aucaauacaaccagcc

SEQ ID NO: 1342227 - RNA, 14 nt, Homo sapiens
aucaaucuggugcu

SEQ ID NO: 1342228 - RNA, 14 nt, Homo sapiens
aucacaaaaccacc

SEQ ID NO: 1342229 - RNA, 15 nt, Homo sapiens
aucacaaauuucacu

SEQ ID NO: 1342230 - RNA, 23 nt, Homo sapiens
aucacucuaauucggauuugcca

SEQ ID NO: 1342231 - RNA, 19 nt, Homo sapiens
aucacugcauuauucucuu

SEQ ID NO: 1342232 - RNA, 19 nt, Homo sapiens
aucacuucauucacauuca

SEQ ID NO: 1342233 - RNA, 15 nt, Homo sapiens
aucagaacauucagc

SEQ ID NO: 1342234 - RNA, 15 nt, Homo sapiens
aucagaccugcauug

SEQ ID NO: 1342235 - RNA, 13 nt, Homo sapiens
aucagagagggaa

SEQ ID NO: 1342236 - RNA, 17 nt, Homo sapiens
aucagcaaugccccaaa

SEQ ID NO: 1342237 - RNA, 16 nt, Homo sapiens
aucagcccagugcaaa

SEQ ID NO: 1342238 - RNA, 21 nt, Homo sapiens
aucaggacagguggugcaaau

SEQ ID NO: 1342239 - RNA, 22 nt, Homo sapiens
aucaguccucgcggcucuccag

SEQ ID NO: 1342240 - RNA, 14 nt, Homo sapiens
aucagucuuuauua

SEQ ID NO: 1342241 - RNA, 20 nt, Homo sapiens
aucagugauuauuuuuccag

SEQ ID NO: 1342242 - RNA, 13 nt, Homo sapiens
aucagugugcaau

SEQ ID NO: 1342243 - RNA, 17 nt, Homo sapiens
aucauaauucagcacuu

SEQ ID NO: 1342244 - RNA, 18 nt, Homo sapiens
aucauaauucagcacuua

SEQ ID NO: 1342245 - RNA, 15 nt, Homo sapiens
aucaucuuuccuguu

SEQ ID NO: 1342246 - RNA, 15 nt, Homo sapiens
aucauggacugagcu

SEQ ID NO: 1342247 - RNA, 18 nt, Homo sapiens
aucauuucugcaucagcu

SEQ ID NO: 1342248 - RNA, 18 nt, Homo sapiens
auccaaaucuugaauuuc

SEQ ID NO: 1342249 - RNA, 23 nt, Homo sapiens
auccacccgggggagcccaguga

SEQ ID NO: 1342250 - RNA, 20 nt, Homo sapiens
auccagaacucaaaugagcc

SEQ ID NO: 1342251 - RNA, 13 nt, Homo sapiens
auccagcacuggu

SEQ ID NO: 1342252 - RNA, 17 nt, Homo sapiens
auccagcacuggugaac

SEQ ID NO: 1342253 - RNA, 23 nt, Homo sapiens
auccagcacuggugaacugagcu

SEQ ID NO: 1342254 - RNA, 15 nt, Homo sapiens
auccaggcagaucca

SEQ ID NO: 1342255 - RNA, 16 nt, Homo sapiens
auccaggcagauccag

SEQ ID NO: 1342256 - RNA, 20 nt, Homo sapiens
auccagggcagcaggccaga

SEQ ID NO: 1342257 - RNA, 20 nt, Homo sapiens
auccagguuuaugaaugaca

SEQ ID NO: 1342258 - RNA, 21 nt, Homo sapiens
aguagcuggauuacaggcaug

SEQ ID NO: 1342259 - RNA, 17 nt, Homo sapiens
aguagugcaccaucuca

SEQ ID NO: 1342260 - RNA, 21 nt, Homo sapiens
aguagugcaccaucucacugc

SEQ ID NO: 1342261 - RNA, 22 nt, Homo sapiens
aguagugcaccaucucacugca

SEQ ID NO: 1342262 - RNA, 11 nt, Homo sapiens
aguaguucuca

SEQ ID NO: 1342263 - RNA, 18 nt, Homo sapiens
aguaugaaugacaauuua

SEQ ID NO: 1342264 - RNA, 15 nt, Homo sapiens
agucaaauccagugg

SEQ ID NO: 1342265 - RNA, 22 nt, Homo sapiens
agucacaaugaguuugggcaua

SEQ ID NO: 1342266 - RNA, 14 nt, Homo sapiens
agucacaggucaca

SEQ ID NO: 1342267 - RNA, 21 nt, Homo sapiens
agucaccauuaggucacuuaa

SEQ ID NO: 1342268 - RNA, 16 nt, Homo sapiens
agucaccgaagguccu

SEQ ID NO: 1342269 - RNA, 17 nt, Homo sapiens
agucacucccaagcccc

SEQ ID NO: 1342270 - RNA, 14 nt, Homo sapiens
agucacugcacagu

SEQ ID NO: 1342271 - RNA, 23 nt, Homo sapiens
agucacugcacagugcaucucag

SEQ ID NO: 1342272 - RNA, 13 nt, Homo sapiens
agucagaaccacu

SEQ ID NO: 1342273 - RNA, 13 nt, Homo sapiens
agucauccucaga

SEQ ID NO: 1342274 - RNA, 16 nt, Homo sapiens
agucauccucagauca

SEQ ID NO: 1342275 - RNA, 13 nt, Homo sapiens
agucaugcauuuu

SEQ ID NO: 1342276 - RNA, 13 nt, Homo sapiens
agucauuggcaaa

SEQ ID NO: 1342277 - RNA, 22 nt, Homo sapiens
agucauuguuucccaucacugu

SEQ ID NO: 1342278 - RNA, 17 nt, Homo sapiens
aguccaaaccacuccac

SEQ ID NO: 1342279 - RNA, 21 nt, Homo sapiens
aguccaaacuggcaagcucaa

SEQ ID NO: 1342280 - RNA, 13 nt, Homo sapiens
aguccaccacagc

SEQ ID NO: 1342281 - RNA, 13 nt, Homo sapiens
agucccacacugu

SEQ ID NO: 1342282 - RNA, 17 nt, Homo sapiens
agucccacacugugcag

SEQ ID NO: 1342283 - RNA, 15 nt, Homo sapiens
agucccuuugugacu

SEQ ID NO: 1342284 - RNA, 13 nt, Homo sapiens
aguccuucucacc

SEQ ID NO: 1342285 - RNA, 13 nt, Homo sapiens
aguccuuuaguca

SEQ ID NO: 1342286 - RNA, 15 nt, Homo sapiens
agucgcugugccaca

SEQ ID NO: 1342287 - RNA, 19 nt, Homo sapiens
agucggccccaucucucau

SEQ ID NO: 1342288 - RNA, 23 nt, Homo sapiens
agucucaccuccugccauagggu

SEQ ID NO: 1342289 - RNA, 15 nt, Homo sapiens
agucucccuuccuau

SEQ ID NO: 1342290 - RNA, 18 nt, Homo sapiens
agucuccuacgcaccauu

SEQ ID NO: 1342291 - RNA, 16 nt, Homo sapiens
agucuccucacucugu

SEQ ID NO: 1342292 - RNA, 21 nt, Homo sapiens
agucuccucacucugucccug

SEQ ID NO: 1342293 - RNA, 16 nt, Homo sapiens
agucucucacccucau

SEQ ID NO: 1342294 - RNA, 14 nt, Homo sapiens
agucugaaacuggc

SEQ ID NO: 1342295 - RNA, 14 nt, Homo sapiens
agucugagcccauu

SEQ ID NO: 1342296 - RNA, 13 nt, Homo sapiens
agucugggccagg

SEQ ID NO: 1342297 - RNA, 14 nt, Homo sapiens
agucuucuccucca

SEQ ID NO: 1342298 - RNA, 15 nt, Homo sapiens
agucuugcucuguca

SEQ ID NO: 1342299 - RNA, 21 nt, Homo sapiens
agucuuguuuuuuauucagau

SEQ ID NO: 1342300 - RNA, 22 nt, Homo sapiens
agugaaagcuuucaugaccaua

SEQ ID NO: 1342301 - RNA, 14 nt, Homo sapiens
agugaauacauuaa

SEQ ID NO: 1342302 - RNA, 23 nt, Homo sapiens
agugaauacauuaacggugcuaa

SEQ ID NO: 1342303 - RNA, 12 nt, Homo sapiens
agugacagucag

SEQ ID NO: 1342304 - RNA, 18 nt, Homo sapiens
agugacaugcauucacau

SEQ ID NO: 1342305 - RNA, 15 nt, Homo sapiens
agugacccacccuag

SEQ ID NO: 1342306 - RNA, 16 nt, Homo sapiens
agugacgcaucuccaa

SEQ ID NO: 1342307 - RNA, 14 nt, Homo sapiens
agugagacuguguu

SEQ ID NO: 1342308 - RNA, 22 nt, Homo sapiens
agugagccccuccccagccagc

SEQ ID NO: 1342309 - RNA, 12 nt, Homo sapiens
agugauccucag

SEQ ID NO: 1342310 - RNA, 14 nt, Homo sapiens
agugaugaaccaga

SEQ ID NO: 1342311 - RNA, 19 nt, Homo sapiens
agugauucuccugccucag

SEQ ID NO: 1342312 - RNA, 23 nt, Homo sapiens
agugauuuuauuagaaguuucau

SEQ ID NO: 1342313 - RNA, 22 nt, Homo sapiens
agugcaaaagugaaacauacaa

SEQ ID NO: 1342314 - RNA, 19 nt, Homo sapiens
agugcacuuuaagaggugg

SEQ ID NO: 1342315 - RNA, 12 nt, Homo sapiens
agugcagccacu

SEQ ID NO: 1342316 - RNA, 14 nt, Homo sapiens
agugcagguucuga

SEQ ID NO: 1342317 - RNA, 21 nt, Homo sapiens
agugccacuuaauguauguua

SEQ ID NO: 1342318 - RNA, 9 nt, Homo sapiens
agugcccua

SEQ ID NO: 1342319 - RNA, 17 nt, Homo sapiens
agugccuauugauacuu

SEQ ID NO: 1342320 - RNA, 20 nt, Homo sapiens
agugccuggagucagguguc

SEQ ID NO: 1342321 - RNA, 15 nt, Homo sapiens
agugcugaugccugu

SEQ ID NO: 1342322 - RNA, 15 nt, Homo sapiens
agugcuuggcugcug

SEQ ID NO: 1342323 - RNA, 21 nt, Homo sapiens
aguggaaaaugaccucaagga

SEQ ID NO: 1342324 - RNA, 15 nt, Homo sapiens
aguggagacaguccu

SEQ ID NO: 1342325 - RNA, 20 nt, Homo sapiens
aguggccuccgucacuaccu

SEQ ID NO: 1342326 - RNA, 17 nt, Homo sapiens
aguggcucacaccugua

SEQ ID NO: 1342327 - RNA, 11 nt, Homo sapiens
aguggugagca

SEQ ID NO: 1342328 - RNA, 23 nt, Homo sapiens
agugguggguaauuguacaauaa

SEQ ID NO: 1342329 - RNA, 17 nt, Homo sapiens
aguguaaaauguauauu

SEQ ID NO: 1342330 - RNA, 20 nt, Homo sapiens
aguguacauaugugcuggaa

SEQ ID NO: 1342331 - RNA, 13 nt, Homo sapiens
aguguaugauuac

SEQ ID NO: 1342332 - RNA, 14 nt, Homo sapiens
agugugagacccca

SEQ ID NO: 1342333 - RNA, 15 nt, Homo sapiens
agugugccaguuuaa

SEQ ID NO: 1342334 - RNA, 22 nt, Homo sapiens
agugugggugacagcaugguaa

SEQ ID NO: 1342335 - RNA, 24 nt, Homo sapiens
agugugugccaagagcuacuccca

SEQ ID NO: 1342336 - RNA, 11 nt, Homo sapiens
aguuaccaagu

SEQ ID NO: 1342337 - RNA, 23 nt, Homo sapiens
aguuaccuuauaguuacugugua

SEQ ID NO: 1342338 - RNA, 12 nt, Homo sapiens
aguuacugugua

SEQ ID NO: 1342339 - RNA, 17 nt, Homo sapiens
aguuauggcuucacauu

SEQ ID NO: 1342340 - RNA, 16 nt, Homo sapiens
aguuaugggguuuacc

SEQ ID NO: 1342341 - RNA, 15 nt, Homo sapiens
aguucaaaaacaaga

SEQ ID NO: 1342342 - RNA, 18 nt, Homo sapiens
aguucaauaauccaugaa

SEQ ID NO: 1342343 - RNA, 23 nt, Homo sapiens
aguucagcugccccacaggugug

SEQ ID NO: 1342344 - RNA, 13 nt, Homo sapiens
aguucaugcauug

SEQ ID NO: 1342345 - RNA, 14 nt, Homo sapiens
aguucaugcauugg

SEQ ID NO: 1342346 - RNA, 12 nt, Homo sapiens
aguucauugugg

SEQ ID NO: 1342347 - RNA, 23 nt, Homo sapiens
aguuccuuaucccucucuucccc

SEQ ID NO: 1342348 - RNA, 22 nt, Homo sapiens
aguuccuuggagggacaugacu

SEQ ID NO: 1342349 - RNA, 18 nt, Homo sapiens
aguucucacuuguuucca

SEQ ID NO: 1342350 - RNA, 18 nt, Homo sapiens
aguucuuacacauuccau

SEQ ID NO: 1342351 - RNA, 21 nt, Homo sapiens
aguucuuuauaacaaaacagg

SEQ ID NO: 1342352 - RNA, 12 nt, Homo sapiens
aguugaacaugg

SEQ ID NO: 1342353 - RNA, 16 nt, Homo sapiens
aguugauucuugccuu

SEQ ID NO: 1342354 - RNA, 16 nt, Homo sapiens
aguugcaaagcauuug

SEQ ID NO: 1342355 - RNA, 20 nt, Homo sapiens
aguugcagccagggccagug

SEQ ID NO: 1342356 - RNA, 13 nt, Homo sapiens
aguugcaguagua

SEQ ID NO: 1342357 - RNA, 11 nt, Homo sapiens
aguugccaauc

SEQ ID NO: 1342358 - RNA, 13 nt, Homo sapiens
aguuuacaguauu

SEQ ID NO: 1342359 - RNA, 14 nt, Homo sapiens
aguuuacaguauuu

SEQ ID NO: 1342360 - RNA, 23 nt, Homo sapiens
aguuuaggaguaagagucuuguu

SEQ ID NO: 1342361 - RNA, 15 nt, Homo sapiens
aguuuaugcuaccua

SEQ ID NO: 1342362 - RNA, 19 nt, Homo sapiens
aguuuccacugcaugggcu

SEQ ID NO: 1342363 - RNA, 14 nt, Homo sapiens
aguuuccuaauggu

SEQ ID NO: 1342364 - RNA, 15 nt, Homo sapiens
aguuuccucagugau

SEQ ID NO: 1342365 - RNA, 21 nt, Homo sapiens
aguuugagaccagccugggca

SEQ ID NO: 1342366 - RNA, 17 nt, Homo sapiens
aguuugcuuuguaugca

SEQ ID NO: 1342367 - RNA, 21 nt, Homo sapiens
aguuuguagccagguacugca

SEQ ID NO: 1342368 - RNA, 15 nt, Homo sapiens
aguuuuauuacacau

SEQ ID NO: 1342369 - RNA, 15 nt, Homo sapiens
auaaaaaagaacuuu

SEQ ID NO: 1342370 - RNA, 15 nt, Homo sapiens
auaaaauguauucaa

SEQ ID NO: 1342371 - RNA, 20 nt, Homo sapiens
auaaaauguuuuuaaacagu

SEQ ID NO: 1342372 - RNA, 21 nt, Homo sapiens
auaaaauugaaaguucuggaa

SEQ ID NO: 1342373 - RNA, 20 nt, Homo sapiens
auaaacaaauaacaaugugc

SEQ ID NO: 1342374 - RNA, 18 nt, Homo sapiens
auaaacgguuccugguga

SEQ ID NO: 1342375 - RNA, 23 nt, Homo sapiens
auaaacgguuccuggugacuccu

SEQ ID NO: 1342376 - RNA, 20 nt, Homo sapiens
auaaagacaaucacugccaa

SEQ ID NO: 1342377 - RNA, 11 nt, Homo sapiens
auaaagccuuu

SEQ ID NO: 1342378 - RNA, 13 nt, Homo sapiens
auaaagucuugcc

SEQ ID NO: 1342379 - RNA, 14 nt, Homo sapiens
auaaauacguguca

SEQ ID NO: 1342380 - RNA, 15 nt, Homo sapiens
auaaauacgugucaa

SEQ ID NO: 1342381 - RNA, 15 nt, Homo sapiens
auaaauauuauuaga

SEQ ID NO: 1342382 - RNA, 20 nt, Homo sapiens
auaaauauuauuagauuuau

SEQ ID NO: 1342383 - RNA, 13 nt, Homo sapiens
auaaaucauaaaa

SEQ ID NO: 1342384 - RNA, 22 nt, Homo sapiens
auaaauccauccauccaaaggc

SEQ ID NO: 1342385 - RNA, 21 nt, Homo sapiens
auaaauggcccggacaugucu

SEQ ID NO: 1342386 - RNA, 12 nt, Homo sapiens
auaaauguaucu

SEQ ID NO: 1342387 - RNA, 18 nt, Homo sapiens
auaaaugucuaaagcagg

SEQ ID NO: 1342388 - RNA, 20 nt, Homo sapiens
auaacaaaauggacauggug

SEQ ID NO: 1342389 - RNA, 20 nt, Homo sapiens
auaacagaaagccuggguga

SEQ ID NO: 1342390 - RNA, 14 nt, Homo sapiens
auaaccuuguucca

SEQ ID NO: 1342391 - RNA, 19 nt, Homo sapiens
auaacgcagucuaauuaca

SEQ ID NO: 1342392 - RNA, 18 nt, Homo sapiens
auaacuauuacaguguug

SEQ ID NO: 1342393 - RNA, 11 nt, Homo sapiens
auaacucugug

SEQ ID NO: 1342394 - RNA, 21 nt, Homo sapiens
ccuaccaagauauaccugaua

SEQ ID NO: 1342395 - RNA, 13 nt, Homo sapiens
ccuacccuuccag

SEQ ID NO: 1342396 - RNA, 15 nt, Homo sapiens
ccuacccuucccgcc

SEQ ID NO: 1342397 - RNA, 21 nt, Homo sapiens
ccuaccgcuggcccugccguu

SEQ ID NO: 1342398 - RNA, 21 nt, Homo sapiens
ccuaccuuagaaaacaaguau

SEQ ID NO: 1342399 - RNA, 11 nt, Homo sapiens
ccuaccuuuau

SEQ ID NO: 1342400 - RNA, 19 nt, Homo sapiens
ccuacuagucaccagagac

SEQ ID NO: 1342401 - RNA, 18 nt, Homo sapiens
ccuacucucuuaugcauu

SEQ ID NO: 1342402 - RNA, 20 nt, Homo sapiens
ccuacucucuuaugcauuag

SEQ ID NO: 1342403 - RNA, 11 nt, Homo sapiens
ccuacugcuga

SEQ ID NO: 1342404 - RNA, 19 nt, Homo sapiens
ccuacuguagcaaccugaa

SEQ ID NO: 1342405 - RNA, 15 nt, Homo sapiens
ccuagaaagggcaag

SEQ ID NO: 1342406 - RNA, 13 nt, Homo sapiens
ccuagacuugaaa

SEQ ID NO: 1342407 - RNA, 12 nt, Homo sapiens
ccuagauaugaa

SEQ ID NO: 1342408 - RNA, 15 nt, Homo sapiens
ccuagauaugaagaa

SEQ ID NO: 1342409 - RNA, 23 nt, Homo sapiens
ccuagauaugaagaaucugcucu

SEQ ID NO: 1342410 - RNA, 11 nt, Homo sapiens
ccuagccagag

SEQ ID NO: 1342411 - RNA, 14 nt, Homo sapiens
ccuaggcagaucac

SEQ ID NO: 1342412 - RNA, 23 nt, Homo sapiens
ccuagggaauggucccagcacga

SEQ ID NO: 1342413 - RNA, 23 nt, Homo sapiens
ccuaggugagaacccuugcacua

SEQ ID NO: 1342414 - RNA, 12 nt, Homo sapiens
ccuauagcucuu

SEQ ID NO: 1342415 - RNA, 23 nt, Homo sapiens
ccuauguauaucuucuacaugca

SEQ ID NO: 1342416 - RNA, 13 nt, Homo sapiens
ccuauugcugcua

SEQ ID NO: 1342417 - RNA, 14 nt, Homo sapiens
ccuauuuauuugag

SEQ ID NO: 1342418 - RNA, 22 nt, Homo sapiens
ccucaaaacgggucaguauuaa

SEQ ID NO: 1342419 - RNA, 18 nt, Homo sapiens
ccucaaauacaguauugu

SEQ ID NO: 1342420 - RNA, 19 nt, Homo sapiens
ccucaaccaacaacaaugu

SEQ ID NO: 1342421 - RNA, 22 nt, Homo sapiens
ccucaaccaacaacaauguguu

SEQ ID NO: 1342422 - RNA, 15 nt, Homo sapiens
ccucaaccaaugcca

SEQ ID NO: 1342423 - RNA, 18 nt, Homo sapiens
ccucaaccuccuggguuc

SEQ ID NO: 1342424 - RNA, 20 nt, Homo sapiens
ccucaaccuccuggguucaa

SEQ ID NO: 1342425 - RNA, 14 nt, Homo sapiens
ccucaaucuauucu

SEQ ID NO: 1342426 - RNA, 20 nt, Homo sapiens
ccucaaucuauucuguaaaa

SEQ ID NO: 1342427 - RNA, 14 nt, Homo sapiens
ccucacacugcaag

SEQ ID NO: 1342428 - RNA, 23 nt, Homo sapiens
ccucacugcuguagacauuugcu

SEQ ID NO: 1342429 - RNA, 17 nt, Homo sapiens
ccucagccuccugggua

SEQ ID NO: 1342430 - RNA, 18 nt, Homo sapiens
ccucagccuugccagaga

SEQ ID NO: 1342431 - RNA, 18 nt, Homo sapiens
ccucagcuucuucacagg

SEQ ID NO: 1342432 - RNA, 20 nt, Homo sapiens
ccucauauacuugaauauua

SEQ ID NO: 1342433 - RNA, 14 nt, Homo sapiens
ccucauccauagca

SEQ ID NO: 1342434 - RNA, 18 nt, Homo sapiens
ccucaucucucugcccaa

SEQ ID NO: 1342435 - RNA, 18 nt, Homo sapiens
ccucaucugagaggcucu

SEQ ID NO: 1342436 - RNA, 21 nt, Homo sapiens
ccucaucugggggaguggaau

SEQ ID NO: 1342437 - RNA, 20 nt, Homo sapiens
ccucauggaugcuuuggcaa

SEQ ID NO: 1342438 - RNA, 23 nt, Homo sapiens
ccuccacagagaggaggggacca

SEQ ID NO: 1342439 - RNA, 18 nt, Homo sapiens
ccuccagcuaaacaccaa

SEQ ID NO: 1342440 - RNA, 10 nt, Homo sapiens
ccuccagggc

SEQ ID NO: 1342441 - RNA, 19 nt, Homo sapiens
ccuccagugcaguccauuu

SEQ ID NO: 1342442 - RNA, 16 nt, Homo sapiens
ccuccaugaacaucau

SEQ ID NO: 1342443 - RNA, 20 nt, Homo sapiens
ccuccaugaacaucauggac

SEQ ID NO: 1342444 - RNA, 17 nt, Homo sapiens
ccuccaugccugaccaa

SEQ ID NO: 1342445 - RNA, 14 nt, Homo sapiens
ccucccaacucuaa

SEQ ID NO: 1342446 - RNA, 16 nt, Homo sapiens
ccucccaaguagcuag

SEQ ID NO: 1342447 - RNA, 14 nt, Homo sapiens
ccucccaccagagc

SEQ ID NO: 1342448 - RNA, 22 nt, Homo sapiens
ccucccaggaacugggccaacu

SEQ ID NO: 1342449 - RNA, 16 nt, Homo sapiens
ccuccccaugggcaca

SEQ ID NO: 1342450 - RNA, 16 nt, Homo sapiens
ccucccccaugggcug

SEQ ID NO: 1342451 - RNA, 16 nt, Homo sapiens
ccucccccccaugcac

SEQ ID NO: 1342452 - RNA, 19 nt, Homo sapiens
ccucccuguuccccagaga

SEQ ID NO: 1342453 - RNA, 11 nt, Homo sapiens
ccuccuacccu

SEQ ID NO: 1342454 - RNA, 20 nt, Homo sapiens
ccucggagagcagcagcacc

SEQ ID NO: 1342455 - RNA, 21 nt, Homo sapiens
ccucgucaagagcaugcacau

SEQ ID NO: 1342456 - RNA, 15 nt, Homo sapiens
ccucuaggaggagcu

SEQ ID NO: 1342457 - RNA, 22 nt, Homo sapiens
ccucuaggcccugugagcacaa

SEQ ID NO: 1342458 - RNA, 15 nt, Homo sapiens
ccucuaguaguauau

SEQ ID NO: 1342459 - RNA, 22 nt, Homo sapiens
ccucucugagucaaauccagug

SEQ ID NO: 1342460 - RNA, 11 nt, Homo sapiens
ccucugcauuu

SEQ ID NO: 1342461 - RNA, 23 nt, Homo sapiens
ccucugccaaaggaugugauaua

SEQ ID NO: 1342462 - RNA, 18 nt, Homo sapiens
ccucugcuaagguguauu

SEQ ID NO: 1342463 - RNA, 16 nt, Homo sapiens
ccucugcuacuagcca

SEQ ID NO: 1342464 - RNA, 13 nt, Homo sapiens
ccucugcugggaa

SEQ ID NO: 1342465 - RNA, 22 nt, Homo sapiens
ccucuggcuucccuaaacugca

SEQ ID NO: 1342466 - RNA, 11 nt, Homo sapiens
ccucuguggac

SEQ ID NO: 1342467 - RNA, 16 nt, Homo sapiens
ccucuucccugaccuc

SEQ ID NO: 1342468 - RNA, 18 nt, Homo sapiens
ccucuucuuugugccuuu

SEQ ID NO: 1342469 - RNA, 16 nt, Homo sapiens
ccucuuuuucuuacca

SEQ ID NO: 1342470 - RNA, 17 nt, Homo sapiens
ccugaaauauccaggaa

SEQ ID NO: 1342471 - RNA, 19 nt, Homo sapiens
ccugaaauuaacucagaca

SEQ ID NO: 1342472 - RNA, 18 nt, Homo sapiens
ccugaaccucauucuggu

SEQ ID NO: 1342473 - RNA, 13 nt, Homo sapiens
ccugaacuugccu

SEQ ID NO: 1342474 - RNA, 22 nt, Homo sapiens
ccugaagguguuuuucauucac

SEQ ID NO: 1342475 - RNA, 19 nt, Homo sapiens
ccugaauguuucagaccac

SEQ ID NO: 1342476 - RNA, 17 nt, Homo sapiens
ccugaauuuuguugcug

SEQ ID NO: 1342477 - RNA, 14 nt, Homo sapiens
ccugacaccuuuca

SEQ ID NO: 1342478 - RNA, 18 nt, Homo sapiens
ccugacacggacugugca

SEQ ID NO: 1342479 - RNA, 15 nt, Homo sapiens
ccugagaaggggcag

SEQ ID NO: 1342480 - RNA, 17 nt, Homo sapiens
ccugagcuggggaagcc

SEQ ID NO: 1342481 - RNA, 15 nt, Homo sapiens
ccugcaagucagucc

SEQ ID NO: 1342482 - RNA, 23 nt, Homo sapiens
ccugcacaugaguggaaauacac

SEQ ID NO: 1342483 - RNA, 15 nt, Homo sapiens
ccugcaucugaccag

SEQ ID NO: 1342484 - RNA, 15 nt, Homo sapiens
ccugccauggaucuc

SEQ ID NO: 1342485 - RNA, 19 nt, Homo sapiens
ccugccugaauaaaguaau

SEQ ID NO: 1342486 - RNA, 18 nt, Homo sapiens
ccugcucagcccugcacc

SEQ ID NO: 1342487 - RNA, 15 nt, Homo sapiens
ccugcuccaacucca

SEQ ID NO: 1342488 - RNA, 13 nt, Homo sapiens
ccugcuccagaag

SEQ ID NO: 1342489 - RNA, 15 nt, Homo sapiens
ccugcuccaucucau

SEQ ID NO: 1342490 - RNA, 14 nt, Homo sapiens
ccugcucccacaga

SEQ ID NO: 1342491 - RNA, 16 nt, Homo sapiens
ccugcugugcugcuca

SEQ ID NO: 1342492 - RNA, 17 nt, Homo sapiens
ccugcuuuccugcagca

SEQ ID NO: 1342493 - RNA, 19 nt, Homo sapiens
caucguuuucuucacuguc

SEQ ID NO: 1342494 - RNA, 19 nt, Homo sapiens
caucucagggaacugaccc

SEQ ID NO: 1342495 - RNA, 12 nt, Homo sapiens
caucuccagugc

SEQ ID NO: 1342496 - RNA, 12 nt, Homo sapiens
caucucuacuaa

SEQ ID NO: 1342497 - RNA, 11 nt, Homo sapiens
caucucugucu

SEQ ID NO: 1342498 - RNA, 16 nt, Homo sapiens
caucucuuuaccuccu

SEQ ID NO: 1342499 - RNA, 12 nt, Homo sapiens
caucuggcugca

SEQ ID NO: 1342500 - RNA, 20 nt, Homo sapiens
caucugucucggcucugcau

SEQ ID NO: 1342501 - RNA, 18 nt, Homo sapiens
caucuguuaucaaacugc

SEQ ID NO: 1342502 - RNA, 20 nt, Homo sapiens
caucuuccaccucaccucuu

SEQ ID NO: 1342503 - RNA, 16 nt, Homo sapiens
caucuucccacagugg

SEQ ID NO: 1342504 - RNA, 23 nt, Homo sapiens
caucuucuuucuuccacccacaa

SEQ ID NO: 1342505 - RNA, 16 nt, Homo sapiens
caucuuuccuguucca

SEQ ID NO: 1342506 - RNA, 14 nt, Homo sapiens
caucuuugucaaac

SEQ ID NO: 1342507 - RNA, 21 nt, Homo sapiens
caugaaaaguuauuuaugcua

SEQ ID NO: 1342508 - RNA, 23 nt, Homo sapiens
caugaaaaguuauuuaugcuaua

SEQ ID NO: 1342509 - RNA, 21 nt, Homo sapiens
caugaaauaaaauauaucuua

SEQ ID NO: 1342510 - RNA, 19 nt, Homo sapiens
caugaacaucauggacuga

SEQ ID NO: 1342511 - RNA, 19 nt, Homo sapiens
caugaagaaugcauucaaa

SEQ ID NO: 1342512 - RNA, 20 nt, Homo sapiens
caugaaguuuaaagauucua

SEQ ID NO: 1342513 - RNA, 14 nt, Homo sapiens
caugaauucuguca

SEQ ID NO: 1342514 - RNA, 23 nt, Homo sapiens
caugaccaaaugcuuuuccucaa

SEQ ID NO: 1342515 - RNA, 15 nt, Homo sapiens
caugaggccaucuca

SEQ ID NO: 1342516 - RNA, 19 nt, Homo sapiens
caugaggccaucucaggag

SEQ ID NO: 1342517 - RNA, 18 nt, Homo sapiens
caugagugaauaaauguc

SEQ ID NO: 1342518 - RNA, 18 nt, Homo sapiens
caugauacuaucugugcc

SEQ ID NO: 1342519 - RNA, 14 nt, Homo sapiens
caugauaggauuug

SEQ ID NO: 1342520 - RNA, 12 nt, Homo sapiens
caugaugcacag

SEQ ID NO: 1342521 - RNA, 15 nt, Homo sapiens
caugaugcuaaaggc

SEQ ID NO: 1342522 - RNA, 18 nt, Homo sapiens
caugcccucucucgggag

SEQ ID NO: 1342523 - RNA, 15 nt, Homo sapiens
caugccuuaccuaag

SEQ ID NO: 1342524 - RNA, 19 nt, Homo sapiens
caugcgccaccaugcccua

SEQ ID NO: 1342525 - RNA, 22 nt, Homo sapiens
caugcucucuuucuuuucucug

SEQ ID NO: 1342526 - RNA, 22 nt, Homo sapiens
caugcugcuccccuaaagccag

SEQ ID NO: 1342527 - RNA, 21 nt, Homo sapiens
caugcuuuucugccacuccau

SEQ ID NO: 1342528 - RNA, 19 nt, Homo sapiens
cauggcagauuugcaacua

SEQ ID NO: 1342529 - RNA, 21 nt, Homo sapiens
cauggccagguggccacucca

SEQ ID NO: 1342530 - RNA, 21 nt, Homo sapiens
cauggugccccaggaccagcu

SEQ ID NO: 1342531 - RNA, 22 nt, Homo sapiens
caugguggaaaacgaagcucau

SEQ ID NO: 1342532 - RNA, 13 nt, Homo sapiens
caugguggcacac

SEQ ID NO: 1342533 - RNA, 14 nt, Homo sapiens
caugguuacauauc

SEQ ID NO: 1342534 - RNA, 15 nt, Homo sapiens
caugguuacauauca

SEQ ID NO: 1342535 - RNA, 18 nt, Homo sapiens
cauguaaaaagugcagua

SEQ ID NO: 1342536 - RNA, 14 nt, Homo sapiens
cauguagcauauaa

SEQ ID NO: 1342537 - RNA, 15 nt, Homo sapiens
cauguaucucaguac

SEQ ID NO: 1342538 - RNA, 15 nt, Homo sapiens
cauguauugcacauu

SEQ ID NO: 1342539 - RNA, 17 nt, Homo sapiens
cauguauuuuguaugca

SEQ ID NO: 1342540 - RNA, 12 nt, Homo sapiens
caugucagcaau

SEQ ID NO: 1342541 - RNA, 16 nt, Homo sapiens
caugucagccacugug

SEQ ID NO: 1342542 - RNA, 14 nt, Homo sapiens
caugucugcauuuc

SEQ ID NO: 1342543 - RNA, 22 nt, Homo sapiens
caugucuugcuaacaggauaug

SEQ ID NO: 1342544 - RNA, 19 nt, Homo sapiens
cauguggcuaccuguaacu

SEQ ID NO: 1342545 - RNA, 21 nt, Homo sapiens
caugugugugguggugacuca

SEQ ID NO: 1342546 - RNA, 19 nt, Homo sapiens
cauguuauauuauuacuaa

SEQ ID NO: 1342547 - RNA, 19 nt, Homo sapiens
cauuacuguuccagauucc

SEQ ID NO: 1342548 - RNA, 22 nt, Homo sapiens
cauuauaaauaaauaccaaaaa

SEQ ID NO: 1342549 - RNA, 20 nt, Homo sapiens
cauuaucagccugugccacg

SEQ ID NO: 1342550 - RNA, 18 nt, Homo sapiens
cauucaguaaguucugug

SEQ ID NO: 1342551 - RNA, 17 nt, Homo sapiens
cauucaugugggcauuu

SEQ ID NO: 1342552 - RNA, 15 nt, Homo sapiens
cauuccauuuuguga

SEQ ID NO: 1342553 - RNA, 22 nt, Homo sapiens
cauuccauuuugugaauuguga

SEQ ID NO: 1342554 - RNA, 23 nt, Homo sapiens
cauucccaacgugcaaagccaag

SEQ ID NO: 1342555 - RNA, 22 nt, Homo sapiens
cauuccucagcuucuucacagg

SEQ ID NO: 1342556 - RNA, 21 nt, Homo sapiens
cauucuauuccauguuugcac

SEQ ID NO: 1342557 - RNA, 13 nt, Homo sapiens
cauucucugaguc

SEQ ID NO: 1342558 - RNA, 21 nt, Homo sapiens
cauucuucccuaaucuuccac

SEQ ID NO: 1342559 - RNA, 13 nt, Homo sapiens
cauucuugcuaau

SEQ ID NO: 1342560 - RNA, 21 nt, Homo sapiens
cauugaagauccgagugugau

SEQ ID NO: 1342561 - RNA, 16 nt, Homo sapiens
cauugacagcaauuca

SEQ ID NO: 1342562 - RNA, 14 nt, Homo sapiens
cauugagucccugc

SEQ ID NO: 1342563 - RNA, 23 nt, Homo sapiens
cauugaugagcaagacauacuua

SEQ ID NO: 1342564 - RNA, 14 nt, Homo sapiens
cauugcaauuugca

SEQ ID NO: 1342565 - RNA, 20 nt, Homo sapiens
cauugcacucuagccuggca

SEQ ID NO: 1342566 - RNA, 24 nt, Homo sapiens
cauugcacucuagccuggcaacag

SEQ ID NO: 1342567 - RNA, 22 nt, Homo sapiens
cauugcucagaaaugucaugug

SEQ ID NO: 1342568 - RNA, 19 nt, Homo sapiens
cauugcucugaauauguca

SEQ ID NO: 1342569 - RNA, 22 nt, Homo sapiens
cauuggacccugacuguauaca

SEQ ID NO: 1342570 - RNA, 17 nt, Homo sapiens
cauuggcaaagugacaa

SEQ ID NO: 1342571 - RNA, 19 nt, Homo sapiens
cauugguguugacauacau

SEQ ID NO: 1342572 - RNA, 22 nt, Homo sapiens
cauuguagccucaaucgaguga

SEQ ID NO: 1342573 - RNA, 12 nt, Homo sapiens
cauugucccuga

SEQ ID NO: 1342574 - RNA, 18 nt, Homo sapiens
cauuguggucauagcacc

SEQ ID NO: 1342575 - RNA, 16 nt, Homo sapiens
cauuguuucccaucac

SEQ ID NO: 1342576 - RNA, 19 nt, Homo sapiens
cauuuaaaacauuaaaaua

SEQ ID NO: 1342577 - RNA, 15 nt, Homo sapiens
cauuuaguccuguac

SEQ ID NO: 1342578 - RNA, 16 nt, Homo sapiens
cauuucacuauucugu

SEQ ID NO: 1342579 - RNA, 23 nt, Homo sapiens
cauuucagagaggccuuuuggaa

SEQ ID NO: 1342580 - RNA, 20 nt, Homo sapiens
cauuuccucuguucuuuuca

SEQ ID NO: 1342581 - RNA, 13 nt, Homo sapiens
cauuucuguucca

SEQ ID NO: 1342582 - RNA, 12 nt, Homo sapiens
cauuugaacuug

SEQ ID NO: 1342583 - RNA, 20 nt, Homo sapiens
cauuugcuggacaaccaaca

SEQ ID NO: 1342584 - RNA, 20 nt, Homo sapiens
cauuugggagacaugugaca

SEQ ID NO: 1342585 - RNA, 14 nt, Homo sapiens
cauuuguagcuuug

SEQ ID NO: 1342586 - RNA, 21 nt, Homo sapiens
cauuuguagcuuugcccauug

SEQ ID NO: 1342587 - RNA, 14 nt, Homo sapiens
cauuuguuccauga

SEQ ID NO: 1342588 - RNA, 15 nt, Homo sapiens
cauuuuaagugcaug

SEQ ID NO: 1342589 - RNA, 17 nt, Homo sapiens
cauuuuagaaugucaau

SEQ ID NO: 1342590 - RNA, 14 nt, Homo sapiens
ccaaaagucuucau

SEQ ID NO: 1342591 - RNA, 18 nt, Homo sapiens
ccaaacccacucaugacu

SEQ ID NO: 1342592 - RNA, 22 nt, Homo sapiens
ccaaacuguaguaauuguuaca

SEQ ID NO: 1342593 - RNA, 19 nt, Homo sapiens
ccaaagaaauguaagggaa

SEQ ID NO: 1342594 - RNA, 13 nt, Homo sapiens
ccaaagcaucaau

SEQ ID NO: 1342595 - RNA, 10 nt, Homo sapiens
ccaaaggggc

SEQ ID NO: 1342596 - RNA, 19 nt, Homo sapiens
ccaaaggucaagaacacag

SEQ ID NO: 1342597 - RNA, 23 nt, Homo sapiens
ccaaagucagaauugcucaaaga

SEQ ID NO: 1342598 - RNA, 20 nt, Homo sapiens
ccaaauccuagacugcuccu

SEQ ID NO: 1342599 - RNA, 18 nt, Homo sapiens
ccaaaucugacauauuau

SEQ ID NO: 1342600 - RNA, 19 nt, Homo sapiens
ccaaauuucauaccuauca

SEQ ID NO: 1342601 - RNA, 11 nt, Homo sapiens
ccaacacaaag

SEQ ID NO: 1342602 - RNA, 20 nt, Homo sapiens
ccaacaucaacaucuugguc

SEQ ID NO: 1342603 - RNA, 14 nt, Homo sapiens
ccaacauucuuggc

SEQ ID NO: 1342604 - RNA, 16 nt, Homo sapiens
ccaacauucuuggcau

SEQ ID NO: 1342605 - RNA, 19 nt, Homo sapiens
ccaaccccugaccuacccc

SEQ ID NO: 1342606 - RNA, 22 nt, Homo sapiens
ccaacccgucuggcccaccagg

SEQ ID NO: 1342607 - RNA, 13 nt, Homo sapiens
ccaaccucaggcu

SEQ ID NO: 1342608 - RNA, 16 nt, Homo sapiens
ccaaccugaagacacc

SEQ ID NO: 1342609 - RNA, 23 nt, Homo sapiens
ccaacgcgccucgccggaucuga

SEQ ID NO: 1342610 - RNA, 13 nt, Homo sapiens
ccaacuccauacu

SEQ ID NO: 1342611 - RNA, 20 nt, Homo sapiens
ccaacugcaaaaaaagccuc

SEQ ID NO: 1342612 - RNA, 20 nt, Homo sapiens
ccaacuuuccccacguuaaa

SEQ ID NO: 1342613 - RNA, 18 nt, Homo sapiens
ccaagacaugacauucuu

SEQ ID NO: 1342614 - RNA, 14 nt, Homo sapiens
ccaagagcuacucc

SEQ ID NO: 1342615 - RNA, 22 nt, Homo sapiens
ccaagauguggccuuuagcaaa

SEQ ID NO: 1342616 - RNA, 21 nt, Homo sapiens
ccaagcaaaacuuuacuuuca

SEQ ID NO: 1342617 - RNA, 17 nt, Homo sapiens
ccaagcagaguguuuua

SEQ ID NO: 1342618 - RNA, 13 nt, Homo sapiens
ccaagcauuucau

SEQ ID NO: 1342619 - RNA, 19 nt, Homo sapiens
ccaagcucuguccaaucag

SEQ ID NO: 1342620 - RNA, 14 nt, Homo sapiens
ccaagcuggcacaa

SEQ ID NO: 1342621 - RNA, 23 nt, Homo sapiens
ccaaggagggcagaucacuucag

SEQ ID NO: 1342622 - RNA, 14 nt, Homo sapiens
ccaaggagggugag

SEQ ID NO: 1342623 - RNA, 19 nt, Homo sapiens
ccaagggauggacaucuug

SEQ ID NO: 1342624 - RNA, 20 nt, Homo sapiens
ccaagggguagaaguggcau

SEQ ID NO: 1342625 - RNA, 18 nt, Homo sapiens
ccaaguugaagacuuugu

SEQ ID NO: 1342626 - RNA, 20 nt, Homo sapiens
ccaauagcaaggcugugcau

SEQ ID NO: 1342627 - RNA, 21 nt, Homo sapiens
aagugccaaaugcucucucaa

SEQ ID NO: 1342628 - RNA, 21 nt, Homo sapiens
aagugccucggacaguccgca

SEQ ID NO: 1342629 - RNA, 18 nt, Homo sapiens
aaguggguggaucacuug

SEQ ID NO: 1342630 - RNA, 14 nt, Homo sapiens
aaguguacauaugu

SEQ ID NO: 1342631 - RNA, 14 nt, Homo sapiens
aagugugaauucac

SEQ ID NO: 1342632 - RNA, 23 nt, Homo sapiens
aaguguggguuuauauaaggaau

SEQ ID NO: 1342633 - RNA, 16 nt, Homo sapiens
aaguuaaaagcacaaa

SEQ ID NO: 1342634 - RNA, 18 nt, Homo sapiens
aaguucacucagagggaa

SEQ ID NO: 1342635 - RNA, 21 nt, Homo sapiens
aaguuccaaaauaaagcauaa

SEQ ID NO: 1342636 - RNA, 14 nt, Homo sapiens
aaguucucauugaa

SEQ ID NO: 1342637 - RNA, 19 nt, Homo sapiens
aaguucugaagaugaugcg

SEQ ID NO: 1342638 - RNA, 22 nt, Homo sapiens
aaguugacuuauaguacaugau

SEQ ID NO: 1342639 - RNA, 16 nt, Homo sapiens
aauaaacucucuaggg

SEQ ID NO: 1342640 - RNA, 15 nt, Homo sapiens
aauaaauaccaaaaa

SEQ ID NO: 1342641 - RNA, 17 nt, Homo sapiens
aauaaaucacacauuca

SEQ ID NO: 1342642 - RNA, 12 nt, Homo sapiens
aauaaaugucau

SEQ ID NO: 1342643 - RNA, 15 nt, Homo sapiens
aauaaaugucuugcc

SEQ ID NO: 1342644 - RNA, 16 nt, Homo sapiens
aauaaaugugacucag

SEQ ID NO: 1342645 - RNA, 18 nt, Homo sapiens
aauaaaugugacucagca

SEQ ID NO: 1342646 - RNA, 16 nt, Homo sapiens
aauaaaugugccuuca

SEQ ID NO: 1342647 - RNA, 22 nt, Homo sapiens
aauaaauguugcaaugcaugau

SEQ ID NO: 1342648 - RNA, 20 nt, Homo sapiens
aauaaauuuuuuuuggucaa

SEQ ID NO: 1342649 - RNA, 22 nt, Homo sapiens
aauaacaguaguguuacaugua

SEQ ID NO: 1342650 - RNA, 12 nt, Homo sapiens
aauaacuugaag

SEQ ID NO: 1342651 - RNA, 16 nt, Homo sapiens
aauaagauuuaauuca

SEQ ID NO: 1342652 - RNA, 18 nt, Homo sapiens
aauaauaagcuacuugcc

SEQ ID NO: 1342653 - RNA, 11 nt, Homo sapiens
aauaauuuccu

SEQ ID NO: 1342654 - RNA, 11 nt, Homo sapiens
aauacacaauu

SEQ ID NO: 1342655 - RNA, 13 nt, Homo sapiens
aauaccacaugau

SEQ ID NO: 1342656 - RNA, 20 nt, Homo sapiens
aauacuacugacguccuccc

SEQ ID NO: 1342657 - RNA, 17 nt, Homo sapiens
aauacugagaaaaccug

SEQ ID NO: 1342658 - RNA, 11 nt, Homo sapiens
aauacugaugu

SEQ ID NO: 1342659 - RNA, 14 nt, Homo sapiens
aauacugcagcuug

SEQ ID NO: 1342660 - RNA, 16 nt, Homo sapiens
aauacuguguaccuca

SEQ ID NO: 1342661 - RNA, 21 nt, Homo sapiens
aauacuuaccgagucagacuu

SEQ ID NO: 1342662 - RNA, 23 nt, Homo sapiens
aauacuuugcagcacagcugaga

SEQ ID NO: 1342663 - RNA, 14 nt, Homo sapiens
aauagaagggcaaa

SEQ ID NO: 1342664 - RNA, 21 nt, Homo sapiens
aauagacuaaccucuaccagc

SEQ ID NO: 1342665 - RNA, 19 nt, Homo sapiens
aauagaucaguauuucacu

SEQ ID NO: 1342666 - RNA, 20 nt, Homo sapiens
aauagcagaaaaaccaacau

SEQ ID NO: 1342667 - RNA, 21 nt, Homo sapiens
aauagcauuaucuuaucauuu

SEQ ID NO: 1342668 - RNA, 20 nt, Homo sapiens
aauagcauuguaaaagcauu

SEQ ID NO: 1342669 - RNA, 13 nt, Homo sapiens
aauagccacugca

SEQ ID NO: 1342670 - RNA, 15 nt, Homo sapiens
aauagcccuguaaca

SEQ ID NO: 1342671 - RNA, 21 nt, Homo sapiens
aauagucuaaggccauggcau

SEQ ID NO: 1342672 - RNA, 16 nt, Homo sapiens
aauauaaaaugaguag

SEQ ID NO: 1342673 - RNA, 16 nt, Homo sapiens
aauauagcaguagucu

SEQ ID NO: 1342674 - RNA, 16 nt, Homo sapiens
aauauaucuaccccag

SEQ ID NO: 1342675 - RNA, 18 nt, Homo sapiens
aauaucaccaaaaaccua

SEQ ID NO: 1342676 - RNA, 21 nt, Homo sapiens
aauaucccuccauacagugua

SEQ ID NO: 1342677 - RNA, 16 nt, Homo sapiens
aauaugcaagcagcuu

SEQ ID NO: 1342678 - RNA, 14 nt, Homo sapiens
aauauuacagauaa

SEQ ID NO: 1342679 - RNA, 16 nt, Homo sapiens
aauauuauuacuuuau

SEQ ID NO: 1342680 - RNA, 22 nt, Homo sapiens
aauauuccuuuauuuugcugcu

SEQ ID NO: 1342681 - RNA, 19 nt, Homo sapiens
aauauugauuaagccuccu

SEQ ID NO: 1342682 - RNA, 20 nt, Homo sapiens
aauauugauuaagccuccuc

SEQ ID NO: 1342683 - RNA, 22 nt, Homo sapiens
aauauugcuccaugaugacuua

SEQ ID NO: 1342684 - RNA, 19 nt, Homo sapiens
aauauugugcaugcuagug

SEQ ID NO: 1342685 - RNA, 15 nt, Homo sapiens
aauauuuauaagcua

SEQ ID NO: 1342686 - RNA, 21 nt, Homo sapiens
aauauuuuuguggacaugcau

SEQ ID NO: 1342687 - RNA, 14 nt, Homo sapiens
aaucaaacauauuc

SEQ ID NO: 1342688 - RNA, 21 nt, Homo sapiens
aaucaaggaaagaccaguuuc

SEQ ID NO: 1342689 - RNA, 20 nt, Homo sapiens
aaucaagguagaacaaagaa

SEQ ID NO: 1342690 - RNA, 18 nt, Homo sapiens
aaucaaucuggugcuaau

SEQ ID NO: 1342691 - RNA, 15 nt, Homo sapiens
aaucacacugucuuc

SEQ ID NO: 1342692 - RNA, 14 nt, Homo sapiens
aaucagaaaaccca

SEQ ID NO: 1342693 - RNA, 13 nt, Homo sapiens
aaucagaaguaua

SEQ ID NO: 1342694 - RNA, 17 nt, Homo sapiens
aaucagcuuaaaaucca

SEQ ID NO: 1342695 - RNA, 16 nt, Homo sapiens
aaucauaaaacuugau

SEQ ID NO: 1342696 - RNA, 15 nt, Homo sapiens
aaucaugugaggaaa

SEQ ID NO: 1342697 - RNA, 20 nt, Homo sapiens
aaucaugugaggaaaugaug

SEQ ID NO: 1342698 - RNA, 18 nt, Homo sapiens
aaucauuuuaagugcaug

SEQ ID NO: 1342699 - RNA, 20 nt, Homo sapiens
aauccaagcugcucauuuca

SEQ ID NO: 1342700 - RNA, 21 nt, Homo sapiens
aauccaauuaaucaaaccacu

SEQ ID NO: 1342701 - RNA, 23 nt, Homo sapiens
aauccaggaauuaaaucaucccu

SEQ ID NO: 1342702 - RNA, 16 nt, Homo sapiens
aauccaggcagaucca

SEQ ID NO: 1342703 - RNA, 16 nt, Homo sapiens
aaucccagcuaccuca

SEQ ID NO: 1342704 - RNA, 16 nt, Homo sapiens
aaucccccagcacuuc

SEQ ID NO: 1342705 - RNA, 14 nt, Homo sapiens
aauccuccuaccuc

SEQ ID NO: 1342706 - RNA, 18 nt, Homo sapiens
aauccugaacuuucuccc

SEQ ID NO: 1342707 - RNA, 19 nt, Homo sapiens
auggaguguuuuaguucuu

SEQ ID NO: 1342708 - RNA, 19 nt, Homo sapiens
auggauaaaauaaugcugc

SEQ ID NO: 1342709 - RNA, 15 nt, Homo sapiens
auggauauuugucaa

SEQ ID NO: 1342710 - RNA, 18 nt, Homo sapiens
auggaucccuggggccaa

SEQ ID NO: 1342711 - RNA, 17 nt, Homo sapiens
auggaugggggaacuca

SEQ ID NO: 1342712 - RNA, 21 nt, Homo sapiens
auggaugggggaacucagauc

SEQ ID NO: 1342713 - RNA, 17 nt, Homo sapiens
auggaugguugaauuaa

SEQ ID NO: 1342714 - RNA, 12 nt, Homo sapiens
auggcagacucu

SEQ ID NO: 1342715 - RNA, 17 nt, Homo sapiens
auggcagagcugguguc

SEQ ID NO: 1342716 - RNA, 13 nt, Homo sapiens
auggcagcugcca

SEQ ID NO: 1342717 - RNA, 18 nt, Homo sapiens
auggcaguccuggaggca

SEQ ID NO: 1342718 - RNA, 22 nt, Homo sapiens
auggcaugagggccacauucca

SEQ ID NO: 1342719 - RNA, 18 nt, Homo sapiens
auggccacaaaccugccc

SEQ ID NO: 1342720 - RNA, 16 nt, Homo sapiens
auggcuauaggugcua

SEQ ID NO: 1342721 - RNA, 19 nt, Homo sapiens
auggcugcccaggagacag

SEQ ID NO: 1342722 - RNA, 23 nt, Homo sapiens
augggagaguacacccuuuccag

SEQ ID NO: 1342723 - RNA, 19 nt, Homo sapiens
augggggcaggaaagccac

SEQ ID NO: 1342724 - RNA, 21 nt, Homo sapiens
augguugcacaaaaccacuuu

SEQ ID NO: 1342725 - RNA, 16 nt, Homo sapiens
auguaaaaagugcagu

SEQ ID NO: 1342726 - RNA, 13 nt, Homo sapiens
auguaaacuacuu

SEQ ID NO: 1342727 - RNA, 13 nt, Homo sapiens
auguaaaugguau

SEQ ID NO: 1342728 - RNA, 18 nt, Homo sapiens
auguaagaucguucucug

SEQ ID NO: 1342729 - RNA, 20 nt, Homo sapiens
auguaauguuuuuauuucaa

SEQ ID NO: 1342730 - RNA, 13 nt, Homo sapiens
auguacuauccaa

SEQ ID NO: 1342731 - RNA, 16 nt, Homo sapiens
auguauaaaugugaua

SEQ ID NO: 1342732 - RNA, 15 nt, Homo sapiens
augucaaaccacugg

SEQ ID NO: 1342733 - RNA, 10 nt, Homo sapiens
augucacuuu

SEQ ID NO: 1342734 - RNA, 16 nt, Homo sapiens
augucagccacuguga

SEQ ID NO: 1342735 - RNA, 18 nt, Homo sapiens
augucauguggcuaccug

SEQ ID NO: 1342736 - RNA, 22 nt, Homo sapiens
augucuaaagcagggaagugac

SEQ ID NO: 1342737 - RNA, 14 nt, Homo sapiens
augucuaaccaaga

SEQ ID NO: 1342738 - RNA, 22 nt, Homo sapiens
augucuccacuuucacccgcag

SEQ ID NO: 1342739 - RNA, 16 nt, Homo sapiens
augucuuuccaaaagu

SEQ ID NO: 1342740 - RNA, 13 nt, Homo sapiens
augugaagucucu

SEQ ID NO: 1342741 - RNA, 15 nt, Homo sapiens
augugacuccaagag

SEQ ID NO: 1342742 - RNA, 16 nt, Homo sapiens
augugagcgagcaagc

SEQ ID NO: 1342743 - RNA, 14 nt, Homo sapiens
augugagucuggga

SEQ ID NO: 1342744 - RNA, 14 nt, Homo sapiens
augugcacuuuauc

SEQ ID NO: 1342745 - RNA, 16 nt, Homo sapiens
augugcagcauuucac

SEQ ID NO: 1342746 - RNA, 20 nt, Homo sapiens
augugccuuucuuugccucu

SEQ ID NO: 1342747 - RNA, 15 nt, Homo sapiens
augugcuuguuagcu

SEQ ID NO: 1342748 - RNA, 18 nt, Homo sapiens
auguggcuguauccacuu

SEQ ID NO: 1342749 - RNA, 22 nt, Homo sapiens
auguguaguuauaaaccaauga

SEQ ID NO: 1342750 - RNA, 18 nt, Homo sapiens
augugucccuuccaagcu

SEQ ID NO: 1342751 - RNA, 18 nt, Homo sapiens
augugucuuuacaccucg

SEQ ID NO: 1342752 - RNA, 21 nt, Homo sapiens
augugugugguggugacucau

SEQ ID NO: 1342753 - RNA, 16 nt, Homo sapiens
auguguguguguugug

SEQ ID NO: 1342754 - RNA, 18 nt, Homo sapiens
auguguuuuaucacuuca

SEQ ID NO: 1342755 - RNA, 15 nt, Homo sapiens
auguuaugacuaugu

SEQ ID NO: 1342756 - RNA, 15 nt, Homo sapiens
auguuauuugcucua

SEQ ID NO: 1342757 - RNA, 17 nt, Homo sapiens
auguuauuugcucuaau

SEQ ID NO: 1342758 - RNA, 15 nt, Homo sapiens
auguucuaacagauc

SEQ ID NO: 1342759 - RNA, 19 nt, Homo sapiens
auguugagaggaacaagaa

SEQ ID NO: 1342760 - RNA, 13 nt, Homo sapiens
auguuucagacca

SEQ ID NO: 1342761 - RNA, 22 nt, Homo sapiens
auguuugauaguaaauguccac

SEQ ID NO: 1342762 - RNA, 20 nt, Homo sapiens
auguuuuaaaauacucucau

SEQ ID NO: 1342763 - RNA, 14 nt, Homo sapiens
auguuuucuaguca

SEQ ID NO: 1342764 - RNA, 12 nt, Homo sapiens
auuaaacaaaua

SEQ ID NO: 1342765 - RNA, 18 nt, Homo sapiens
auuaacgguggugaaaag

SEQ ID NO: 1342766 - RNA, 22 nt, Homo sapiens
auuaaucacaaauuucacuuau

SEQ ID NO: 1342767 - RNA, 17 nt, Homo sapiens
auuaauugucauuauuu

SEQ ID NO: 1342768 - RNA, 19 nt, Homo sapiens
auuacagaaacugaugcca

SEQ ID NO: 1342769 - RNA, 18 nt, Homo sapiens
auuacaggcgugagccac

SEQ ID NO: 1342770 - RNA, 20 nt, Homo sapiens
auuaccuuaaacuugcagua

SEQ ID NO: 1342771 - RNA, 14 nt, Homo sapiens
auuagaaacuacca

SEQ ID NO: 1342772 - RNA, 16 nt, Homo sapiens
auuagaaucugaguau

SEQ ID NO: 1342773 - RNA, 14 nt, Homo sapiens
auuagcaaggcaga

SEQ ID NO: 1342774 - RNA, 19 nt, Homo sapiens
auuagucgcacauguauug

SEQ ID NO: 1342775 - RNA, 17 nt, Homo sapiens
auuauagcucaugugca

SEQ ID NO: 1342776 - RNA, 14 nt, Homo sapiens
auuaucaauguucu

SEQ ID NO: 1342777 - RNA, 23 nt, Homo sapiens
auuaucucaaaacugcacuguca

SEQ ID NO: 1342778 - RNA, 14 nt, Homo sapiens
auuaucucaaguaa

SEQ ID NO: 1342779 - RNA, 15 nt, Homo sapiens
auuaugauugcauaa

SEQ ID NO: 1342780 - RNA, 12 nt, Homo sapiens
auuauucccaug

SEQ ID NO: 1342781 - RNA, 17 nt, Homo sapiens
auuauucuuuguuuccu

SEQ ID NO: 1342782 - RNA, 17 nt, Homo sapiens
auuauuuguuacuguau

SEQ ID NO: 1342783 - RNA, 19 nt, Homo sapiens
auuauuuuucacugcccca

SEQ ID NO: 1342784 - RNA, 21 nt, Homo sapiens
auuauuuuugcucugcucugu

SEQ ID NO: 1342785 - RNA, 13 nt, Homo sapiens
auucaaaauauaa

SEQ ID NO: 1342786 - RNA, 22 nt, Homo sapiens
auucaaauguuuuaaaguuuaa

SEQ ID NO: 1342787 - RNA, 14 nt, Homo sapiens
auucaagacaagag

SEQ ID NO: 1342788 - RNA, 20 nt, Homo sapiens
auucaagacaagagcuguua

SEQ ID NO: 1342789 - RNA, 15 nt, Homo sapiens
auucacuaaggacuu

SEQ ID NO: 1342790 - RNA, 18 nt, Homo sapiens
auucagcaaaaaucuccc

SEQ ID NO: 1342791 - RNA, 22 nt, Homo sapiens
auucagcaaaaaucucccagug

SEQ ID NO: 1342792 - RNA, 13 nt, Homo sapiens
auucagcacuuaa

SEQ ID NO: 1342793 - RNA, 23 nt, Homo sapiens
auucauagugauagagugcagug

SEQ ID NO: 1342794 - RNA, 17 nt, Homo sapiens
auucauauuuacuucuu

SEQ ID NO: 1342795 - RNA, 22 nt, Homo sapiens
auucauauuuacuucuuauaca

SEQ ID NO: 1342796 - RNA, 19 nt, Homo sapiens
auucauccaggcaugggcu

SEQ ID NO: 1342797 - RNA, 20 nt, Homo sapiens
acccacucaugacugcauga

SEQ ID NO: 1342798 - RNA, 21 nt, Homo sapiens
acccagaaugagacauccagc

SEQ ID NO: 1342799 - RNA, 16 nt, Homo sapiens
acccagacugucucca

SEQ ID NO: 1342800 - RNA, 15 nt, Homo sapiens
acccagcaucuccca

SEQ ID NO: 1342801 - RNA, 19 nt, Homo sapiens
acccaguagaugccacuag

SEQ ID NO: 1342802 - RNA, 14 nt, Homo sapiens
acccagucccacac

SEQ ID NO: 1342803 - RNA, 18 nt, Homo sapiens
acccagucccacacugug

SEQ ID NO: 1342804 - RNA, 13 nt, Homo sapiens
acccaucuuccac

SEQ ID NO: 1342805 - RNA, 15 nt, Homo sapiens
acccaugccagagag

SEQ ID NO: 1342806 - RNA, 20 nt, Homo sapiens
accccagguccugcagucug

SEQ ID NO: 1342807 - RNA, 12 nt, Homo sapiens
acccccaugcug

SEQ ID NO: 1342808 - RNA, 19 nt, Homo sapiens
acccccguguccaccguga

SEQ ID NO: 1342809 - RNA, 15 nt, Homo sapiens
acccccuuaacugua

SEQ ID NO: 1342810 - RNA, 13 nt, Homo sapiens
acccccuucccug

SEQ ID NO: 1342811 - RNA, 16 nt, Homo sapiens
accccucacugugacu

SEQ ID NO: 1342812 - RNA, 18 nt, Homo sapiens
accccucacugugacuga

SEQ ID NO: 1342813 - RNA, 23 nt, Homo sapiens
accccuccaguuuugccugagaa

SEQ ID NO: 1342814 - RNA, 15 nt, Homo sapiens
accccucuaccuccu

SEQ ID NO: 1342815 - RNA, 15 nt, Homo sapiens
accccucucuuagag

SEQ ID NO: 1342816 - RNA, 20 nt, Homo sapiens
accccuugccggugaaggau

SEQ ID NO: 1342817 - RNA, 22 nt, Homo sapiens
accccuuucuaguucaaugccu

SEQ ID NO: 1342818 - RNA, 14 nt, Homo sapiens
acccgugugcacac

SEQ ID NO: 1342819 - RNA, 20 nt, Homo sapiens
acccuacuucuuuugcucuu

SEQ ID NO: 1342820 - RNA, 11 nt, Homo sapiens
acccucaggcc

SEQ ID NO: 1342821 - RNA, 14 nt, Homo sapiens
acccucauacacag

SEQ ID NO: 1342822 - RNA, 19 nt, Homo sapiens
acccucauucuacugaaaa

SEQ ID NO: 1342823 - RNA, 17 nt, Homo sapiens
acccugaaggggccaug

SEQ ID NO: 1342824 - RNA, 22 nt, Homo sapiens
acccugacuguauacagaauga

SEQ ID NO: 1342825 - RNA, 20 nt, Homo sapiens
acccugcgucgaaggaugcu

SEQ ID NO: 1342826 - RNA, 20 nt, Homo sapiens
acccuggagguaaacaaaga

SEQ ID NO: 1342827 - RNA, 20 nt, Homo sapiens
acccuggggauaguccuucc

SEQ ID NO: 1342828 - RNA, 21 nt, Homo sapiens
acccuggugggccaacaaaga

SEQ ID NO: 1342829 - RNA, 20 nt, Homo sapiens
acccuguccugcagucccac

SEQ ID NO: 1342830 - RNA, 17 nt, Homo sapiens
acccuugacaccugcug

SEQ ID NO: 1342831 - RNA, 21 nt, Homo sapiens
acccuugacaccugcugagaa

SEQ ID NO: 1342832 - RNA, 20 nt, Homo sapiens
acccuuucagaaucuuuuca

SEQ ID NO: 1342833 - RNA, 19 nt, Homo sapiens
acccuuucauuagaacuuc

SEQ ID NO: 1342834 - RNA, 22 nt, Homo sapiens
accgagcgugugccacuggacc

SEQ ID NO: 1342835 - RNA, 21 nt, Homo sapiens
accgagucucuucuccacugg

SEQ ID NO: 1342836 - RNA, 19 nt, Homo sapiens
accgcaggugcucaugcug

SEQ ID NO: 1342837 - RNA, 13 nt, Homo sapiens
accgccacugggc

SEQ ID NO: 1342838 - RNA, 20 nt, Homo sapiens
accggaaggaggccaaccag

SEQ ID NO: 1342839 - RNA, 15 nt, Homo sapiens
accgggcaagcacug

SEQ ID NO: 1342840 - RNA, 14 nt, Homo sapiens
accuaacacauuaa

SEQ ID NO: 1342841 - RNA, 22 nt, Homo sapiens
accuaaguccuuccaccugcca

SEQ ID NO: 1342842 - RNA, 22 nt, Homo sapiens
accuacuaauccucucugcaag

SEQ ID NO: 1342843 - RNA, 13 nt, Homo sapiens
accuacugcugag

SEQ ID NO: 1342844 - RNA, 16 nt, Homo sapiens
accuagcagccucaaa

SEQ ID NO: 1342845 - RNA, 12 nt, Homo sapiens
accuauucugaa

SEQ ID NO: 1342846 - RNA, 12 nt, Homo sapiens
accucacagcua

SEQ ID NO: 1342847 - RNA, 20 nt, Homo sapiens
accucacaggccccaggaaa

SEQ ID NO: 1342848 - RNA, 14 nt, Homo sapiens
accucacugcagua

SEQ ID NO: 1342849 - RNA, 20 nt, Homo sapiens
accucacuggccugccaugc

SEQ ID NO: 1342850 - RNA, 12 nt, Homo sapiens
accucacuuuag

SEQ ID NO: 1342851 - RNA, 22 nt, Homo sapiens
accucauggaugcuuuggcaau

SEQ ID NO: 1342852 - RNA, 17 nt, Homo sapiens
accuccaagcauuucau

SEQ ID NO: 1342853 - RNA, 14 nt, Homo sapiens
accuccacugcugc

SEQ ID NO: 1342854 - RNA, 14 nt, Homo sapiens
accucccacugccc

SEQ ID NO: 1342855 - RNA, 21 nt, Homo sapiens
accucccccuuccccuaccca

SEQ ID NO: 1342856 - RNA, 23 nt, Homo sapiens
accuccuaauuccacacccucac

SEQ ID NO: 1342857 - RNA, 22 nt, Homo sapiens
accucgcuguugucacaucuca

SEQ ID NO: 1342858 - RNA, 15 nt, Homo sapiens
accucggagggaugg

SEQ ID NO: 1342859 - RNA, 17 nt, Homo sapiens
accucggcacacacugu

SEQ ID NO: 1342860 - RNA, 20 nt, Homo sapiens
accucuccugcccugugaua

SEQ ID NO: 1342861 - RNA, 21 nt, Homo sapiens
accucuuaaagaaaacccacc

SEQ ID NO: 1342862 - RNA, 15 nt, Homo sapiens
accucuuucaggguu

SEQ ID NO: 1342863 - RNA, 13 nt, Homo sapiens
accugaagacacc

SEQ ID NO: 1342864 - RNA, 20 nt, Homo sapiens
accugacaauuugugauauc

SEQ ID NO: 1342865 - RNA, 13 nt, Homo sapiens
accugagaaccuu

SEQ ID NO: 1342866 - RNA, 13 nt, Homo sapiens
accugauccugga

SEQ ID NO: 1342867 - RNA, 22 nt, Homo sapiens
accugcaaagaucuguccucag

SEQ ID NO: 1342868 - RNA, 16 nt, Homo sapiens
accugccaaggagcau

SEQ ID NO: 1342869 - RNA, 19 nt, Homo sapiens
accuggagaguacauuugc

SEQ ID NO: 1342870 - RNA, 17 nt, Homo sapiens
accuggauccagcacug

SEQ ID NO: 1342871 - RNA, 19 nt, Homo sapiens
accuggcccugugccuugg

SEQ ID NO: 1342872 - RNA, 19 nt, Homo sapiens
accuggcugccaacaugau

SEQ ID NO: 1342873 - RNA, 19 nt, Homo sapiens
accugggcagggaugaugg

SEQ ID NO: 1342874 - RNA, 18 nt, Homo sapiens
accuggggugaauacuua

SEQ ID NO: 1342875 - RNA, 21 nt, Homo sapiens
accuggucgccaauccaugcu

SEQ ID NO: 1342876 - RNA, 21 nt, Homo sapiens
accuguaaucccagcacuuug

SEQ ID NO: 1342877 - RNA, 18 nt, Homo sapiens
accuuaaugacaacacuu

SEQ ID NO: 1342878 - RNA, 14 nt, Homo sapiens
accuuccacccagu

SEQ ID NO: 1342879 - RNA, 17 nt, Homo sapiens
accuuccagcccggggc

SEQ ID NO: 1342880 - RNA, 19 nt, Homo sapiens
auuuuguaacgaagacaca

SEQ ID NO: 1342881 - RNA, 17 nt, Homo sapiens
auuuuguaauaaacucu

SEQ ID NO: 1342882 - RNA, 16 nt, Homo sapiens
auuuugugaauuguga

SEQ ID NO: 1342883 - RNA, 23 nt, Homo sapiens
auuuugugucuuuuaaacuggaa

SEQ ID NO: 1342884 - RNA, 20 nt, Homo sapiens
auuuuuauaauaaacauaau

SEQ ID NO: 1342885 - RNA, 17 nt, Homo sapiens
auuuuucacugccccag

SEQ ID NO: 1342886 - RNA, 15 nt, Homo sapiens
auuuuuccaguaacu

SEQ ID NO: 1342887 - RNA, 20 nt, Homo sapiens
auuuuucuuagugugccaag

SEQ ID NO: 1342888 - RNA, 19 nt, Homo sapiens
auuuuugaaaaaugcacug

SEQ ID NO: 1342889 - RNA, 14 nt, Homo sapiens
auuuuuuaagugac

SEQ ID NO: 1342890 - RNA, 20 nt, Homo sapiens
auuuuuuuuuuuuacuugaa

SEQ ID NO: 1342891 - RNA, 18 nt, Homo sapiens
caaaaaaaauuuuagcuc

SEQ ID NO: 1342892 - RNA, 20 nt, Homo sapiens
caaaaaaaauuuuagcucuu

SEQ ID NO: 1342893 - RNA, 18 nt, Homo sapiens
caaaaacaagacagacuc

SEQ ID NO: 1342894 - RNA, 18 nt, Homo sapiens
caaaaaccuauuccacuu

SEQ ID NO: 1342895 - RNA, 21 nt, Homo sapiens
caaaaacgaaacuccaucuca

SEQ ID NO: 1342896 - RNA, 12 nt, Homo sapiens
caaaaacugaaa

SEQ ID NO: 1342897 - RNA, 16 nt, Homo sapiens
caaaaagagucagaca

SEQ ID NO: 1342898 - RNA, 11 nt, Homo sapiens
caaaaagccac

SEQ ID NO: 1342899 - RNA, 14 nt, Homo sapiens
caaaaagcucugaa

SEQ ID NO: 1342900 - RNA, 14 nt, Homo sapiens
caaaacccuuucug

SEQ ID NO: 1342901 - RNA, 14 nt, Homo sapiens
caaaaccuugcaca

SEQ ID NO: 1342902 - RNA, 14 nt, Homo sapiens
caaaacuccaggca

SEQ ID NO: 1342903 - RNA, 17 nt, Homo sapiens
caaaacugcacugucaa

SEQ ID NO: 1342904 - RNA, 13 nt, Homo sapiens
caaaacugucauc

SEQ ID NO: 1342905 - RNA, 19 nt, Homo sapiens
caaaacuuaaaaguauuca

SEQ ID NO: 1342906 - RNA, 14 nt, Homo sapiens
caaaacuucagugu

SEQ ID NO: 1342907 - RNA, 15 nt, Homo sapiens
caaaacuucuauuau

SEQ ID NO: 1342908 - RNA, 22 nt, Homo sapiens
caaaacuucuauuauccagagu

SEQ ID NO: 1342909 - RNA, 18 nt, Homo sapiens
caaaagaaacaccagugu

SEQ ID NO: 1342910 - RNA, 14 nt, Homo sapiens
caaaagcugcucag

SEQ ID NO: 1342911 - RNA, 20 nt, Homo sapiens
caaaaggaacaaaaauuaca

SEQ ID NO: 1342912 - RNA, 15 nt, Homo sapiens
caaaaggcuccaguu

SEQ ID NO: 1342913 - RNA, 22 nt, Homo sapiens
caaaauacagauuugaauagca

SEQ ID NO: 1342914 - RNA, 15 nt, Homo sapiens
caaaaucguuuuuaa

SEQ ID NO: 1342915 - RNA, 12 nt, Homo sapiens
caaaauguguaa

SEQ ID NO: 1342916 - RNA, 14 nt, Homo sapiens
caaaccacuguuau

SEQ ID NO: 1342917 - RNA, 23 nt, Homo sapiens
caaaccacuguuauuaacagaua

SEQ ID NO: 1342918 - RNA, 14 nt, Homo sapiens
caaacccuuucaua

SEQ ID NO: 1342919 - RNA, 14 nt, Homo sapiens
caaaccuccacugc

SEQ ID NO: 1342920 - RNA, 17 nt, Homo sapiens
caaaccuccacugcugc

SEQ ID NO: 1342921 - RNA, 19 nt, Homo sapiens
caaacuccagguuccugaa

SEQ ID NO: 1342922 - RNA, 13 nt, Homo sapiens
caaagacagcauc

SEQ ID NO: 1342923 - RNA, 16 nt, Homo sapiens
caaagacuuugaucca

SEQ ID NO: 1342924 - RNA, 15 nt, Homo sapiens
cucugacccagcaga

SEQ ID NO: 1342925 - RNA, 13 nt, Homo sapiens
cucugacugcuuu

SEQ ID NO: 1342926 - RNA, 18 nt, Homo sapiens
cucugacuuaagcugccu

SEQ ID NO: 1342927 - RNA, 17 nt, Homo sapiens
cucugagucaaauccag

SEQ ID NO: 1342928 - RNA, 22 nt, Homo sapiens
cucugagucagugguuauuuga

SEQ ID NO: 1342929 - RNA, 13 nt, Homo sapiens
cucugaguuugaa

SEQ ID NO: 1342930 - RNA, 18 nt, Homo sapiens
cucugcaguaaaacacau

SEQ ID NO: 1342931 - RNA, 11 nt, Homo sapiens
cucugccccag

SEQ ID NO: 1342932 - RNA, 24 nt, Homo sapiens
cucugccuuaaacacacauugcag

SEQ ID NO: 1342933 - RNA, 23 nt, Homo sapiens
cucugcgaauauacuaaacauca

SEQ ID NO: 1342934 - RNA, 17 nt, Homo sapiens
cucugcuccccugugaa

SEQ ID NO: 1342935 - RNA, 14 nt, Homo sapiens
cucugcugaaggaa

SEQ ID NO: 1342936 - RNA, 22 nt, Homo sapiens
cucuggcaucucuuucugcaaa

SEQ ID NO: 1342937 - RNA, 16 nt, Homo sapiens
cucuggcuggucuuca

SEQ ID NO: 1342938 - RNA, 23 nt, Homo sapiens
cucuggcuucccuaaacugcagc

SEQ ID NO: 1342939 - RNA, 23 nt, Homo sapiens
cucuggggguccucucugaguca

SEQ ID NO: 1342940 - RNA, 18 nt, Homo sapiens
cucuguauacaaaacccu

SEQ ID NO: 1342941 - RNA, 17 nt, Homo sapiens
cucugugccuugccaca

SEQ ID NO: 1342942 - RNA, 15 nt, Homo sapiens
cucugugucuucaaa

SEQ ID NO: 1342943 - RNA, 20 nt, Homo sapiens
cucuuaaaccacagcacuau

SEQ ID NO: 1342944 - RNA, 16 nt, Homo sapiens
cucuuagcccucacca

SEQ ID NO: 1342945 - RNA, 12 nt, Homo sapiens
cucuuagcucag

SEQ ID NO: 1342946 - RNA, 15 nt, Homo sapiens
cucuucaacugacca

SEQ ID NO: 1342947 - RNA, 21 nt, Homo sapiens
cucuucaacugaccagccucc

SEQ ID NO: 1342948 - RNA, 15 nt, Homo sapiens
cucuucccacuccag

SEQ ID NO: 1342949 - RNA, 13 nt, Homo sapiens
cucuucuacacag

SEQ ID NO: 1342950 - RNA, 22 nt, Homo sapiens
cucuucugaauaaagcaauuag

SEQ ID NO: 1342951 - RNA, 16 nt, Homo sapiens
cucuugaguuccucug

SEQ ID NO: 1342952 - RNA, 19 nt, Homo sapiens
cucuugaguuccucugcag

SEQ ID NO: 1342953 - RNA, 21 nt, Homo sapiens
cucuugccugcuccaucucau

SEQ ID NO: 1342954 - RNA, 19 nt, Homo sapiens
cucuuggcuccacugggau

SEQ ID NO: 1342955 - RNA, 20 nt, Homo sapiens
cucuuggguucaagugauuc

SEQ ID NO: 1342956 - RNA, 17 nt, Homo sapiens
cuuagaguguagcugua

SEQ ID NO: 1342957 - RNA, 20 nt, Homo sapiens
cuuauacuuuucucaauauu

SEQ ID NO: 1342958 - RNA, 18 nt, Homo sapiens
cuuauauaauaacaauug

SEQ ID NO: 1342959 - RNA, 20 nt, Homo sapiens
cuuauauuuaaaacuugccu

SEQ ID NO: 1342960 - RNA, 18 nt, Homo sapiens
cuuaucuccaagaccaga

SEQ ID NO: 1342961 - RNA, 16 nt, Homo sapiens
cuuaugauacuugagg

SEQ ID NO: 1342962 - RNA, 22 nt, Homo sapiens
cuuaugauagcaaauggccuca

SEQ ID NO: 1342963 - RNA, 21 nt, Homo sapiens
cuucaaaauaaaaaguaauga

SEQ ID NO: 1342964 - RNA, 17 nt, Homo sapiens
cuucaaagcaaagcucu

SEQ ID NO: 1342965 - RNA, 18 nt, Homo sapiens
cuucaagagccucuggca

SEQ ID NO: 1342966 - RNA, 13 nt, Homo sapiens
cuucaccaaagag

SEQ ID NO: 1342967 - RNA, 14 nt, Homo sapiens
cuucacucuuugaa

SEQ ID NO: 1342968 - RNA, 23 nt, Homo sapiens
cuucacuuacaagaaaggccuga

SEQ ID NO: 1342969 - RNA, 23 nt, Homo sapiens
cuucagaccccaaaggagucaga

SEQ ID NO: 1342970 - RNA, 20 nt, Homo sapiens
cuucagaugcugagccaacu

SEQ ID NO: 1342971 - RNA, 22 nt, Homo sapiens
cuucagcucuucuugacaucaa

SEQ ID NO: 1342972 - RNA, 16 nt, Homo sapiens
cuucagugugguacaa

SEQ ID NO: 1342973 - RNA, 15 nt, Homo sapiens
cuucauccaauguga

SEQ ID NO: 1342974 - RNA, 14 nt, Homo sapiens
cuucauuaccucag

SEQ ID NO: 1342975 - RNA, 17 nt, Homo sapiens
cuucauucacauucaga

SEQ ID NO: 1342976 - RNA, 19 nt, Homo sapiens
cuuccaacccgaggcaaua

SEQ ID NO: 1342977 - RNA, 20 nt, Homo sapiens
cuuccaacccgaggcaauaa

SEQ ID NO: 1342978 - RNA, 14 nt, Homo sapiens
cuuccagagucauc

SEQ ID NO: 1342979 - RNA, 15 nt, Homo sapiens
cuuccaugugccuuu

SEQ ID NO: 1342980 - RNA, 16 nt, Homo sapiens
cuuccaugugccuuuc

SEQ ID NO: 1342981 - RNA, 17 nt, Homo sapiens
cuucccagcaauuauua

SEQ ID NO: 1342982 - RNA, 18 nt, Homo sapiens
cuucccauuucucuacac

SEQ ID NO: 1342983 - RNA, 13 nt, Homo sapiens
cuuccccuaccca

SEQ ID NO: 1342984 - RNA, 15 nt, Homo sapiens
cuucccugacucuuc

SEQ ID NO: 1342985 - RNA, 15 nt, Homo sapiens
gguuucuggggucca

SEQ ID NO: 1342986 - RNA, 22 nt, Homo sapiens
gguuugccuauaauuuauuaac

SEQ ID NO: 1342987 - RNA, 23 nt, Homo sapiens
guaaaaagcccagcacuugaauu

SEQ ID NO: 1342988 - RNA, 14 nt, Homo sapiens
guaaaacauuacuu

SEQ ID NO: 1342989 - RNA, 16 nt, Homo sapiens
guaaaaccacagcagu

SEQ ID NO: 1342990 - RNA, 21 nt, Homo sapiens
guaaaacugaacuucagagca

SEQ ID NO: 1342991 - RNA, 17 nt, Homo sapiens
guaaaaugcuggugaaa

SEQ ID NO: 1342992 - RNA, 13 nt, Homo sapiens
guaaaccuugaag

SEQ ID NO: 1342993 - RNA, 19 nt, Homo sapiens
guaaagcguuugcauuugc

SEQ ID NO: 1342994 - RNA, 15 nt, Homo sapiens
guaaaguugccuuua

SEQ ID NO: 1342995 - RNA, 18 nt, Homo sapiens
guaaaucaggacaggugg

SEQ ID NO: 1342996 - RNA, 17 nt, Homo sapiens
guaaauuuuuaggcaaa

SEQ ID NO: 1342997 - RNA, 16 nt, Homo sapiens
guuuccacagccugca

SEQ ID NO: 1342998 - RNA, 21 nt, Homo sapiens
guuucccaucagacugucaag

SEQ ID NO: 1342999 - RNA, 21 nt, Homo sapiens
guuuccucagugauggaauau

SEQ ID NO: 1343000 - RNA, 14 nt, Homo sapiens
guuucugcuucauu

SEQ ID NO: 1343001 - RNA, 21 nt, Homo sapiens
guuucuggucuucgcagccua

SEQ ID NO: 1343002 - RNA, 18 nt, Homo sapiens
guuugaagauuauaugaa

SEQ ID NO: 1343003 - RNA, 17 nt, Homo sapiens
guuugaaucuacauuca

SEQ ID NO: 1343004 - RNA, 10 nt, Homo sapiens
guuugacaac

SEQ ID NO: 1343005 - RNA, 17 nt, Homo sapiens
guuugacaccuuagaga

SEQ ID NO: 1343006 - RNA, 14 nt, Homo sapiens
guuugauauggaga

SEQ ID NO: 1343007 - RNA, 17 nt, Homo sapiens
guuugucauggugaaau

SEQ ID NO: 1343008 - RNA, 23 nt, Homo sapiens
guuuguuaaaagaaaacacuguc

SEQ ID NO: 1343009 - RNA, 17 nt, Homo sapiens
guuuuaacuuccagugg

SEQ ID NO: 1343010 - RNA, 15 nt, Homo sapiens
guuuuaaggucuauc

SEQ ID NO: 1343011 - RNA, 22 nt, Homo sapiens
guuuuaauccuuaacacauuca

SEQ ID NO: 1343012 - RNA, 20 nt, Homo sapiens
guuuucaucauuucagccaa

SEQ ID NO: 1343013 - RNA, 14 nt, Homo sapiens
guuuucauuaucuc

SEQ ID NO: 1343014 - RNA, 20 nt, Homo sapiens
guuuuccucccuucugcuac

SEQ ID NO: 1343015 - RNA, 19 nt, Homo sapiens
guuuugcauggaguauuau

SEQ ID NO: 1343016 - RNA, 15 nt, Homo sapiens
guuuuuaacuuuuaa

SEQ ID NO: 1343017 - RNA, 16 nt, Homo sapiens
guuuuuccaguucaca

SEQ ID NO: 1343018 - RNA, 16 nt, Homo sapiens
guuuuuuaaauguaua

SEQ ID NO: 1343019 - RNA, 23 nt, Homo sapiens
uaaaaaaaaaaaaaaaagugaug

SEQ ID NO: 1343020 - RNA, 18 nt, Homo sapiens
aacuuuuaucacuguugc

SEQ ID NO: 1343021 - RNA, 19 nt, Homo sapiens
aagaaaaaaaaagucuuug

SEQ ID NO: 1343022 - RNA, 16 nt, Homo sapiens
aagaaaaacaccgcuu

SEQ ID NO: 1343023 - RNA, 15 nt, Homo sapiens
aagaaaacacuguca

SEQ ID NO: 1343024 - RNA, 15 nt, Homo sapiens
aagaaaagcugccau

SEQ ID NO: 1343025 - RNA, 15 nt, Homo sapiens
aagaaaauagucagu

SEQ ID NO: 1343026 - RNA, 22 nt, Homo sapiens
aagaaaccaccgaaaucccuca

SEQ ID NO: 1343027 - RNA, 17 nt, Homo sapiens
aagaaauacagacugga

SEQ ID NO: 1343028 - RNA, 21 nt, Homo sapiens
aagaacaauauugacuuuguc

SEQ ID NO: 1343029 - RNA, 21 nt, Homo sapiens
aagaacaugauuuuacaagua

SEQ ID NO: 1343030 - RNA, 12 nt, Homo sapiens
aagaaccuggaa

SEQ ID NO: 1343031 - RNA, 22 nt, Homo sapiens
aagaacuauugugcucagagac

SEQ ID NO: 1343032 - RNA, 14 nt, Homo sapiens
aagaagagaggcau

SEQ ID NO: 1343033 - RNA, 19 nt, Homo sapiens
aagaagcacugggugacca

SEQ ID NO: 1343034 - RNA, 15 nt, Homo sapiens
aagaaggacuuguuu

SEQ ID NO: 1343035 - RNA, 16 nt, Homo sapiens
aagaauagcauuguaa

SEQ ID NO: 1343036 - RNA, 12 nt, Homo sapiens
aagaaucugcuc

SEQ ID NO: 1343037 - RNA, 13 nt, Homo sapiens
aagaaucugcucu

SEQ ID NO: 1343038 - RNA, 11 nt, Homo sapiens
aagaauggagg

SEQ ID NO: 1343039 - RNA, 17 nt, Homo sapiens
aagacaccguucauuca

SEQ ID NO: 1343040 - RNA, 14 nt, Homo sapiens
aagacacugaagcu

SEQ ID NO: 1343041 - RNA, 15 nt, Homo sapiens
aagacaucagucucc

SEQ ID NO: 1343042 - RNA, 19 nt, Homo sapiens
aagaccaguuuccauuuau

SEQ ID NO: 1343043 - RNA, 17 nt, Homo sapiens
aagacccaaaacagcuu

SEQ ID NO: 1343044 - RNA, 20 nt, Homo sapiens
aagacuauucaaacagucuc

SEQ ID NO: 1343045 - RNA, 18 nt, Homo sapiens
aagacuuguuucugaucu

SEQ ID NO: 1343046 - RNA, 18 nt, Homo sapiens
aagacuuuaaaccaccua

SEQ ID NO: 1343047 - RNA, 21 nt, Homo sapiens
aagagaaaagggagucaugca

SEQ ID NO: 1343048 - RNA, 16 nt, Homo sapiens
aagagaagagggccca

SEQ ID NO: 1343049 - RNA, 18 nt, Homo sapiens
aagagagggacaggcacu

SEQ ID NO: 1343050 - RNA, 23 nt, Homo sapiens
aagagaucuuucuuuccaaaaca

SEQ ID NO: 1343051 - RNA, 16 nt, Homo sapiens
aagagccaaguuccaa

SEQ ID NO: 1343052 - RNA, 21 nt, Homo sapiens
aagagcugccuggaugagaaa

SEQ ID NO: 1343053 - RNA, 17 nt, Homo sapiens
aagagcuguuaugcugu

SEQ ID NO: 1343054 - RNA, 13 nt, Homo sapiens
aagaggugggagc

SEQ ID NO: 1343055 - RNA, 15 nt, Homo sapiens
aagaugcaguucaaa

SEQ ID NO: 1343056 - RNA, 12 nt, Homo sapiens
aagauggcauaa

SEQ ID NO: 1343057 - RNA, 17 nt, Homo sapiens
aagauuauaggaacuga

SEQ ID NO: 1343058 - RNA, 16 nt, Homo sapiens
aagauucuauguuaau

SEQ ID NO: 1343059 - RNA, 20 nt, Homo sapiens
aagauucuggggcuguguua

SEQ ID NO: 1343060 - RNA, 21 nt, Homo sapiens
aagauugccaauuuucuucau

SEQ ID NO: 1343061 - RNA, 18 nt, Homo sapiens
aagauuuuuuuugucaga

SEQ ID NO: 1343062 - RNA, 14 nt, Homo sapiens
aagcaaaacagacu

SEQ ID NO: 1343063 - RNA, 14 nt, Homo sapiens
aagcaaauuuugua

SEQ ID NO: 1343064 - RNA, 12 nt, Homo sapiens
aagcaacuguga

SEQ ID NO: 1343065 - RNA, 18 nt, Homo sapiens
aagcaaugguugaugaua

SEQ ID NO: 1343066 - RNA, 20 nt, Homo sapiens
aagcaauucuccugccuuag

SEQ ID NO: 1343067 - RNA, 14 nt, Homo sapiens
aagcaauuuacuga

SEQ ID NO: 1343068 - RNA, 18 nt, Homo sapiens
aagcacaagugcauggca

SEQ ID NO: 1343069 - RNA, 11 nt, Homo sapiens
aagcacacuca

SEQ ID NO: 1343070 - RNA, 19 nt, Homo sapiens
aagcacagauguucuucaa

SEQ ID NO: 1343071 - RNA, 21 nt, Homo sapiens
aagcaccuaaaacccaaaggu

SEQ ID NO: 1343072 - RNA, 20 nt, Homo sapiens
aagcacuuuauauuuuccuc

SEQ ID NO: 1343073 - RNA, 20 nt, Homo sapiens
aagcagagccuccugggaac

SEQ ID NO: 1343074 - RNA, 19 nt, Homo sapiens
aagcagcuuuuuauucccu

SEQ ID NO: 1343075 - RNA, 12 nt, Homo sapiens
aagcaggauuuc

SEQ ID NO: 1343076 - RNA, 11 nt, Homo sapiens
aagcaggcaaa

SEQ ID NO: 1343077 - RNA, 22 nt, Homo sapiens
aagcaguucauucuaccaagcu

SEQ ID NO: 1343078 - RNA, 12 nt, Homo sapiens
aagcaucugcca

SEQ ID NO: 1343079 - RNA, 13 nt, Homo sapiens
aagcauucuucaa

SEQ ID NO: 1343080 - RNA, 20 nt, Homo sapiens
aagcauuuccagccuaucua

SEQ ID NO: 1343081 - RNA, 18 nt, Homo sapiens
aagcauuucccccaggga

SEQ ID NO: 1343082 - RNA, 14 nt, Homo sapiens
aagccaagcacuuu

SEQ ID NO: 1343083 - RNA, 16 nt, Homo sapiens
aagccacacucugggc

SEQ ID NO: 1343084 - RNA, 22 nt, Homo sapiens
aagccacguuaaguccaaggag

SEQ ID NO: 1343085 - RNA, 21 nt, Homo sapiens
aagccauguauaaaugugaua

SEQ ID NO: 1343086 - RNA, 14 nt, Homo sapiens
aagcccaguucauc

SEQ ID NO: 1343087 - RNA, 19 nt, Homo sapiens
aagcccccagggccuccag

SEQ ID NO: 1343088 - RNA, 23 nt, Homo sapiens
aagccggcuugauuuccgugaac

SEQ ID NO: 1343089 - RNA, 20 nt, Homo sapiens
aagccuccuccuuuucugaa

SEQ ID NO: 1343090 - RNA, 21 nt, Homo sapiens
aagcgcggacccuucuggguc

SEQ ID NO: 1343091 - RNA, 18 nt, Homo sapiens
aagcuaacaccagacaga

SEQ ID NO: 1343092 - RNA, 23 nt, Homo sapiens
aagcucaaugaugcaggcaauaa

SEQ ID NO: 1343093 - RNA, 22 nt, Homo sapiens
aagcucaccagcccugcgccac

SEQ ID NO: 1343094 - RNA, 21 nt, Homo sapiens
aagcucuucacugaaacuggu

SEQ ID NO: 1343095 - RNA, 12 nt, Homo sapiens
aagcugcucagg

SEQ ID NO: 1343096 - RNA, 23 nt, Homo sapiens
aagcuggugucugauuuuggcca

SEQ ID NO: 1343097 - RNA, 19 nt, Homo sapiens
aagcuguuauuucuucccu

SEQ ID NO: 1343098 - RNA, 20 nt, Homo sapiens
aagcuuccaugaugcacagu

SEQ ID NO: 1343099 - RNA, 21 nt, Homo sapiens
aagcuuccuccuccucuccag

SEQ ID NO: 1343100 - RNA, 14 nt, Homo sapiens
aaggaacacugaca

SEQ ID NO: 1343101 - RNA, 18 nt, Homo sapiens
aaggaacuaauccucacu

SEQ ID NO: 1343102 - RNA, 17 nt, Homo sapiens
aaggaagcuguguugaa

SEQ ID NO: 1343103 - RNA, 15 nt, Homo sapiens
aaggacaucagcaaa

SEQ ID NO: 1343104 - RNA, 21 nt, Homo sapiens
aaugagugugauccaguuuuu

SEQ ID NO: 1343105 - RNA, 13 nt, Homo sapiens
aaugauccugcca

SEQ ID NO: 1343106 - RNA, 14 nt, Homo sapiens
aaugaugggucagu

SEQ ID NO: 1343107 - RNA, 15 nt, Homo sapiens
aaugauuucacagug

SEQ ID NO: 1343108 - RNA, 15 nt, Homo sapiens
aaugauuuuacuuaa

SEQ ID NO: 1343109 - RNA, 13 nt, Homo sapiens
aaugcaaccauuu

SEQ ID NO: 1343110 - RNA, 21 nt, Homo sapiens
aaugcaagccaucucuaauaa

SEQ ID NO: 1343111 - RNA, 16 nt, Homo sapiens
aaugcagcagggaugc

SEQ ID NO: 1343112 - RNA, 20 nt, Homo sapiens
aaugcagcagggaugcccug

SEQ ID NO: 1343113 - RNA, 22 nt, Homo sapiens
aaugcaguacauuaauauucau

SEQ ID NO: 1343114 - RNA, 21 nt, Homo sapiens
aaugcauuauaggaucauuug

SEQ ID NO: 1343115 - RNA, 20 nt, Homo sapiens
aaugcccaguaaaauuucag

SEQ ID NO: 1343116 - RNA, 16 nt, Homo sapiens
aaugccccaguguuau

SEQ ID NO: 1343117 - RNA, 14 nt, Homo sapiens
aaugccugacucag

SEQ ID NO: 1343118 - RNA, 12 nt, Homo sapiens
aaugcugcacuu

SEQ ID NO: 1343119 - RNA, 10 nt, Homo sapiens
aaugcugcuu

SEQ ID NO: 1343120 - RNA, 21 nt, Homo sapiens
aauggaagaaauggcuaugaa

SEQ ID NO: 1343121 - RNA, 22 nt, Homo sapiens
aauggaggugacggcacuccca

SEQ ID NO: 1343122 - RNA, 13 nt, Homo sapiens
aaugggcauuucu

SEQ ID NO: 1343123 - RNA, 12 nt, Homo sapiens
aauggggccaga

SEQ ID NO: 1343124 - RNA, 20 nt, Homo sapiens
aauggugugaucucggcuca

SEQ ID NO: 1343125 - RNA, 23 nt, Homo sapiens
aaugguuucacuugcucuuugac

SEQ ID NO: 1343126 - RNA, 23 nt, Homo sapiens
aauguauaaggacuauagugauu

SEQ ID NO: 1343127 - RNA, 12 nt, Homo sapiens
aauguauaccag

SEQ ID NO: 1343128 - RNA, 16 nt, Homo sapiens
aauguaugagacuggg

SEQ ID NO: 1343129 - RNA, 14 nt, Homo sapiens
aauguaugugcaca

SEQ ID NO: 1343130 - RNA, 18 nt, Homo sapiens
aauguauugagcauguga

SEQ ID NO: 1343131 - RNA, 17 nt, Homo sapiens
aaugucaguauguggaa

SEQ ID NO: 1343132 - RNA, 15 nt, Homo sapiens
aaugucaguauuuca

SEQ ID NO: 1343133 - RNA, 23 nt, Homo sapiens
aauguccacuuaaaauacaugaa

SEQ ID NO: 1343134 - RNA, 18 nt, Homo sapiens
aaugucucuuugugcucu

SEQ ID NO: 1343135 - RNA, 14 nt, Homo sapiens
aaugucuuucaugu

SEQ ID NO: 1343136 - RNA, 20 nt, Homo sapiens
aaugugaagauggacuucau

SEQ ID NO: 1343137 - RNA, 12 nt, Homo sapiens
aaugugacucag

SEQ ID NO: 1343138 - RNA, 16 nt, Homo sapiens
aaugugcugagcauuu

SEQ ID NO: 1343139 - RNA, 13 nt, Homo sapiens
aauguguauucau

SEQ ID NO: 1343140 - RNA, 20 nt, Homo sapiens
aauguguuuuaucacuucau

SEQ ID NO: 1343141 - RNA, 14 nt, Homo sapiens
aauguuaugacuau

SEQ ID NO: 1343142 - RNA, 16 nt, Homo sapiens
aauguucuaacagauc

SEQ ID NO: 1343143 - RNA, 21 nt, Homo sapiens
aauguucuccagucauuaugu

SEQ ID NO: 1343144 - RNA, 21 nt, Homo sapiens
aauguuggagcagcaggccuc

SEQ ID NO: 1343145 - RNA, 22 nt, Homo sapiens
aauguuuuaaaguuuaaugccu

SEQ ID NO: 1343146 - RNA, 22 nt, Homo sapiens
aauguuuucuagucacuuccuc

SEQ ID NO: 1343147 - RNA, 20 nt, Homo sapiens
acacaaggauagaugcuggc

SEQ ID NO: 1343148 - RNA, 21 nt, Homo sapiens
acacaauaggucuuucucuca

SEQ ID NO: 1343149 - RNA, 13 nt, Homo sapiens
acacacacaccaa

SEQ ID NO: 1343150 - RNA, 11 nt, Homo sapiens
acacacugugc

SEQ ID NO: 1343151 - RNA, 15 nt, Homo sapiens
acacacuuccagugu

SEQ ID NO: 1343152 - RNA, 23 nt, Homo sapiens
acacagaauuguuccaguacuau

SEQ ID NO: 1343153 - RNA, 21 nt, Homo sapiens
acacagacauccucuaugcca

SEQ ID NO: 1343154 - RNA, 12 nt, Homo sapiens
acacagcaauac

SEQ ID NO: 1343155 - RNA, 11 nt, Homo sapiens
acacagcugcc

SEQ ID NO: 1343156 - RNA, 19 nt, Homo sapiens
acacagucuuggcucacug

SEQ ID NO: 1343157 - RNA, 22 nt, Homo sapiens
acacagugcuauuugcauuucu

SEQ ID NO: 1343158 - RNA, 18 nt, Homo sapiens
acacauaguggcuucucc

SEQ ID NO: 1343159 - RNA, 13 nt, Homo sapiens
acacaugugcaca

SEQ ID NO: 1343160 - RNA, 14 nt, Homo sapiens
acaccauauacugu

SEQ ID NO: 1343161 - RNA, 20 nt, Homo sapiens
acaccgugggucauuacaaa

SEQ ID NO: 1343162 - RNA, 12 nt, Homo sapiens
acaccucuccaa

SEQ ID NO: 1343163 - RNA, 13 nt, Homo sapiens
acaccugagacau

SEQ ID NO: 1343164 - RNA, 19 nt, Homo sapiens
acaccugagacaugcugaa

SEQ ID NO: 1343165 - RNA, 17 nt, Homo sapiens
acaccuggaugucuggg

SEQ ID NO: 1343166 - RNA, 15 nt, Homo sapiens
acaccuguaauccca

SEQ ID NO: 1343167 - RNA, 21 nt, Homo sapiens
acaccuguaaucccagcacuu

SEQ ID NO: 1343168 - RNA, 20 nt, Homo sapiens
acacgagcaggcuacuguca

SEQ ID NO: 1343169 - RNA, 23 nt, Homo sapiens
acacgcccccacaggcucugacc

SEQ ID NO: 1343170 - RNA, 18 nt, Homo sapiens
acacuaaauugcaguuua

SEQ ID NO: 1343171 - RNA, 14 nt, Homo sapiens
acacuaacuaugca

SEQ ID NO: 1343172 - RNA, 23 nt, Homo sapiens
acacuaacuuaauguguauucau

SEQ ID NO: 1343173 - RNA, 17 nt, Homo sapiens
acacucaaaucaagaaa

SEQ ID NO: 1343174 - RNA, 16 nt, Homo sapiens
acacucauauugcccu

SEQ ID NO: 1343175 - RNA, 18 nt, Homo sapiens
acacucauauugcccuaa

SEQ ID NO: 1343176 - RNA, 19 nt, Homo sapiens
acacucauauugcccuaau

SEQ ID NO: 1343177 - RNA, 21 nt, Homo sapiens
acacucauccccucacuugcc

SEQ ID NO: 1343178 - RNA, 15 nt, Homo sapiens
acacucauggggaag

SEQ ID NO: 1343179 - RNA, 17 nt, Homo sapiens
acacucccacuuggcau

SEQ ID NO: 1343180 - RNA, 20 nt, Homo sapiens
acacucccacuuggcaucau

SEQ ID NO: 1343181 - RNA, 14 nt, Homo sapiens
acacucuucaguga

SEQ ID NO: 1343182 - RNA, 21 nt, Homo sapiens
acacugaaaaaucuaagugau

SEQ ID NO: 1343183 - RNA, 13 nt, Homo sapiens
acacuggauccau

SEQ ID NO: 1343184 - RNA, 14 nt, Homo sapiens
acacuguggccagg

SEQ ID NO: 1343185 - RNA, 12 nt, Homo sapiens
acacuuacuguu

SEQ ID NO: 1343186 - RNA, 15 nt, Homo sapiens
acacuuugagcauuu

SEQ ID NO: 1343187 - RNA, 18 nt, Homo sapiens
acagaaaauauggugcug

SEQ ID NO: 1343188 - RNA, 23 nt, Homo sapiens
acagaaccuucaacccagugggu

SEQ ID NO: 1343189 - RNA, 22 nt, Homo sapiens
acagaagcuuaaaaucugugaa

SEQ ID NO: 1343190 - RNA, 16 nt, Homo sapiens
acagaaguguucacau

SEQ ID NO: 1343191 - RNA, 15 nt, Homo sapiens
acagaauuguuccag

SEQ ID NO: 1343192 - RNA, 22 nt, Homo sapiens
acagaccgccgucuaacucaaa

SEQ ID NO: 1343193 - RNA, 16 nt, Homo sapiens
acagaccucaguuuua

SEQ ID NO: 1343194 - RNA, 18 nt, Homo sapiens
acagagaggaggggacca

SEQ ID NO: 1343195 - RNA, 16 nt, Homo sapiens
acagaggagaugccac

SEQ ID NO: 1343196 - RNA, 22 nt, Homo sapiens
acagaggagaugccacuucuca

SEQ ID NO: 1343197 - RNA, 19 nt, Homo sapiens
acagagggaagccaugugg

SEQ ID NO: 1343198 - RNA, 23 nt, Homo sapiens
acagaguaacugaccuucauuuc

SEQ ID NO: 1343199 - RNA, 18 nt, Homo sapiens
acagaugccacacaagga

SEQ ID NO: 1343200 - RNA, 16 nt, Homo sapiens
acagaugcguucagca

SEQ ID NO: 1343201 - RNA, 18 nt, Homo sapiens
acagcagggacaagauac

SEQ ID NO: 1343202 - RNA, 23 nt, Homo sapiens
acagcaguggaguaaguauuuag

SEQ ID NO: 1343203 - RNA, 18 nt, Homo sapiens
acagcaugaauaaaacac

SEQ ID NO: 1343204 - RNA, 22 nt, Homo sapiens
acagcaugggccucaccuccuc

SEQ ID NO: 1343205 - RNA, 16 nt, Homo sapiens
acagcaugguaaugaa

SEQ ID NO: 1343206 - RNA, 14 nt, Homo sapiens
acagccauuuucca

SEQ ID NO: 1343207 - RNA, 18 nt, Homo sapiens
acagcccuuaugcgguua

SEQ ID NO: 1343208 - RNA, 21 nt, Homo sapiens
acagccuccaaaaauggcagu

SEQ ID NO: 1343209 - RNA, 16 nt, Homo sapiens
acagccuuaccaaagc

SEQ ID NO: 1343210 - RNA, 19 nt, Homo sapiens
acagccuucuaaauuccca

SEQ ID NO: 1343211 - RNA, 20 nt, Homo sapiens
acagccuucuagcacacuuu

SEQ ID NO: 1343212 - RNA, 14 nt, Homo sapiens
acagccuuugccca

SEQ ID NO: 1343213 - RNA, 19 nt, Homo sapiens
acagcucacugcagccuca

SEQ ID NO: 1343214 - RNA, 15 nt, Homo sapiens
acagcugcccuagcu

SEQ ID NO: 1343215 - RNA, 21 nt, Homo sapiens
acagcugccugugugggacug

SEQ ID NO: 1343216 - RNA, 14 nt, Homo sapiens
acagcugcuccuag

SEQ ID NO: 1343217 - RNA, 13 nt, Homo sapiens
acagcuuccucac

SEQ ID NO: 1343218 - RNA, 23 nt, Homo sapiens
acagcuugucugguaaguggcuu

SEQ ID NO: 1343219 - RNA, 20 nt, Homo sapiens
acagcuuugcugcugaaggc

SEQ ID NO: 1343220 - RNA, 13 nt, Homo sapiens
acaggacucugcc

SEQ ID NO: 1343221 - RNA, 12 nt, Homo sapiens
acaggagccuag

SEQ ID NO: 1343222 - RNA, 19 nt, Homo sapiens
acaggauuauuggaaauuu

SEQ ID NO: 1343223 - RNA, 12 nt, Homo sapiens
acaggcacucca

SEQ ID NO: 1343224 - RNA, 22 nt, Homo sapiens
acaggcccuuccucuccacugc

SEQ ID NO: 1343225 - RNA, 15 nt, Homo sapiens
acaggcgugagccac

SEQ ID NO: 1343226 - RNA, 15 nt, Homo sapiens
acaggcucugaccag

SEQ ID NO: 1343227 - RNA, 18 nt, Homo sapiens
acagggacugaaaaccuc

SEQ ID NO: 1343228 - RNA, 15 nt, Homo sapiens
acagggcaguccuua

SEQ ID NO: 1343229 - RNA, 17 nt, Homo sapiens
acagggccacaacugcc

SEQ ID NO: 1343230 - RNA, 18 nt, Homo sapiens
acaggugcgguuccucau

SEQ ID NO: 1343231 - RNA, 15 nt, Homo sapiens
acagguggugcaaau

SEQ ID NO: 1343232 - RNA, 14 nt, Homo sapiens
acagguuaaugugg

SEQ ID NO: 1343233 - RNA, 19 nt, Homo sapiens
acagguuaaugugguguua

SEQ ID NO: 1343234 - RNA, 18 nt, Homo sapiens
acaguaccggauucucuc

SEQ ID NO: 1343235 - RNA, 13 nt, Homo sapiens
acaguagcuugaa

SEQ ID NO: 1343236 - RNA, 18 nt, Homo sapiens
acaguccuggacuccugc

SEQ ID NO: 1343237 - RNA, 19 nt, Homo sapiens
acagucuucccagcaauua

SEQ ID NO: 1343238 - RNA, 14 nt, Homo sapiens
acagugcccagggc

SEQ ID NO: 1343239 - RNA, 13 nt, Homo sapiens
acaguggacaaag

SEQ ID NO: 1343240 - RNA, 22 nt, Homo sapiens
acaguggacaaaguuaccagug

SEQ ID NO: 1343241 - RNA, 20 nt, Homo sapiens
acaguggcucaugccuguaa

SEQ ID NO: 1343242 - RNA, 13 nt, Homo sapiens
acauaaggaugaa

SEQ ID NO: 1343243 - RNA, 22 nt, Homo sapiens
acauacaccucgucaagagcau

SEQ ID NO: 1343244 - RNA, 18 nt, Homo sapiens
acauacauauuaucucau

SEQ ID NO: 1343245 - RNA, 17 nt, Homo sapiens
acauacccucacuuaaa

SEQ ID NO: 1343246 - RNA, 23 nt, Homo sapiens
acauaccuggcccugugccuugg

SEQ ID NO: 1343247 - RNA, 19 nt, Homo sapiens
acauacuugaagggccaga

SEQ ID NO: 1343248 - RNA, 14 nt, Homo sapiens
acauagcugugcua

SEQ ID NO: 1343249 - RNA, 17 nt, Homo sapiens
acauagugauaccccau

SEQ ID NO: 1343250 - RNA, 19 nt, Homo sapiens
acauagugauaccccaucu

SEQ ID NO: 1343251 - RNA, 17 nt, Homo sapiens
acauaucacaugucagc

SEQ ID NO: 1343252 - RNA, 17 nt, Homo sapiens
acauauguaaacauaag

SEQ ID NO: 1343253 - RNA, 15 nt, Homo sapiens
acauaugugcuggaa

SEQ ID NO: 1343254 - RNA, 20 nt, Homo sapiens
acaucacuuguacaaaauaa

SEQ ID NO: 1343255 - RNA, 13 nt, Homo sapiens
acaucauggacug

SEQ ID NO: 1343256 - RNA, 20 nt, Homo sapiens
acauccacacagccaaucca

SEQ ID NO: 1343257 - RNA, 18 nt, Homo sapiens
acauccagcagauuucca

SEQ ID NO: 1343258 - RNA, 15 nt, Homo sapiens
acauccauguuccga

SEQ ID NO: 1343259 - RNA, 16 nt, Homo sapiens
acauccccuucugcaa

SEQ ID NO: 1343260 - RNA, 22 nt, Homo sapiens
acauccuaugaaauacuuuaua

SEQ ID NO: 1343261 - RNA, 21 nt, Homo sapiens
acaucuccuguggucucugac

SEQ ID NO: 1343262 - RNA, 20 nt, Homo sapiens
acaucuggcugcacaggcug

SEQ ID NO: 1343263 - RNA, 18 nt, Homo sapiens
acaucuuggucagauuug

SEQ ID NO: 1343264 - RNA, 23 nt, Homo sapiens
acaucuuggucagauuugaacuc

SEQ ID NO: 1343265 - RNA, 21 nt, Homo sapiens
acaugacauucuuagcuguaa

SEQ ID NO: 1343266 - RNA, 19 nt, Homo sapiens
acaugaguggaaauacacu

SEQ ID NO: 1343267 - RNA, 18 nt, Homo sapiens
acaugauuuuacaaguau

SEQ ID NO: 1343268 - RNA, 13 nt, Homo sapiens
acaugcauucaca

SEQ ID NO: 1343269 - RNA, 22 nt, Homo sapiens
acaugcuuuucugccacuccau

SEQ ID NO: 1343270 - RNA, 23 nt, Homo sapiens
acauggcucucauguacuuuuaa

SEQ ID NO: 1343271 - RNA, 23 nt, Homo sapiens
acaugguggaaaacgaagcucau

SEQ ID NO: 1343272 - RNA, 12 nt, Homo sapiens
acauguauugca

SEQ ID NO: 1343273 - RNA, 18 nt, Homo sapiens
acaugucagccacuguga

SEQ ID NO: 1343274 - RNA, 17 nt, Homo sapiens
acaugucuugcuaacag

SEQ ID NO: 1343275 - RNA, 19 nt, Homo sapiens
acauuaaaauaaaccaaau

SEQ ID NO: 1343276 - RNA, 20 nt, Homo sapiens
acauuaaaauaaaccaaaua

SEQ ID NO: 1343277 - RNA, 16 nt, Homo sapiens
acauuaacggugcuaa

SEQ ID NO: 1343278 - RNA, 15 nt, Homo sapiens
acauuccaucuuaca

SEQ ID NO: 1343279 - RNA, 15 nt, Homo sapiens
acauucuugcuaauu

SEQ ID NO: 1343280 - RNA, 19 nt, Homo sapiens
acauugaauggaucaauac

SEQ ID NO: 1343281 - RNA, 22 nt, Homo sapiens
acuacucucuuccuccacuuca

SEQ ID NO: 1343282 - RNA, 15 nt, Homo sapiens
acuacugcagucuuu

SEQ ID NO: 1343283 - RNA, 17 nt, Homo sapiens
acuagaagcaacuagga

SEQ ID NO: 1343284 - RNA, 14 nt, Homo sapiens
acuaggaaauucca

SEQ ID NO: 1343285 - RNA, 22 nt, Homo sapiens
acuaucgaaaugacgguguuaa

SEQ ID NO: 1343286 - RNA, 20 nt, Homo sapiens
acuaucugugccagagguaa

SEQ ID NO: 1343287 - RNA, 15 nt, Homo sapiens
acuaucuuugcugca

SEQ ID NO: 1343288 - RNA, 18 nt, Homo sapiens
acuaucuuuguguugcag

SEQ ID NO: 1343289 - RNA, 14 nt, Homo sapiens
acuaugauuauuaa

SEQ ID NO: 1343290 - RNA, 23 nt, Homo sapiens
acuaugauuuaauuugaaauaug

SEQ ID NO: 1343291 - RNA, 22 nt, Homo sapiens
acuaugcauggugccccaggac

SEQ ID NO: 1343292 - RNA, 17 nt, Homo sapiens
acuauggagugcucaca

SEQ ID NO: 1343293 - RNA, 14 nt, Homo sapiens
acuauugcauuuau

SEQ ID NO: 1343294 - RNA, 19 nt, Homo sapiens
acucaaauggggccagauc

SEQ ID NO: 1343295 - RNA, 21 nt, Homo sapiens
acucaaauggggccagaucca

SEQ ID NO: 1343296 - RNA, 14 nt, Homo sapiens
acucaaucauuucu

SEQ ID NO: 1343297 - RNA, 13 nt, Homo sapiens
acucacaccugua

SEQ ID NO: 1343298 - RNA, 19 nt, Homo sapiens
acucacccugggagccagu

SEQ ID NO: 1343299 - RNA, 15 nt, Homo sapiens
acucacucaguuuau

SEQ ID NO: 1343300 - RNA, 15 nt, Homo sapiens
acucagcucuuggcu

SEQ ID NO: 1343301 - RNA, 13 nt, Homo sapiens
acucaggacaucc

SEQ ID NO: 1343302 - RNA, 17 nt, Homo sapiens
acucagggagcauuuaa

SEQ ID NO: 1343303 - RNA, 20 nt, Homo sapiens
acucaguaauuucaaaauac

SEQ ID NO: 1343304 - RNA, 18 nt, Homo sapiens
acucagucuuuaaucuga

SEQ ID NO: 1343305 - RNA, 14 nt, Homo sapiens
acucauauguggaa

SEQ ID NO: 1343306 - RNA, 16 nt, Homo sapiens
acucauauguggaauc

SEQ ID NO: 1343307 - RNA, 21 nt, Homo sapiens
acucaugcugguggcauuguu

SEQ ID NO: 1343308 - RNA, 23 nt, Homo sapiens
acucauuuccauaccauugugga

SEQ ID NO: 1343309 - RNA, 23 nt, Homo sapiens
acuccacccguucccacugcccu

SEQ ID NO: 1343310 - RNA, 20 nt, Homo sapiens
acuccaccgaccaacugccc

SEQ ID NO: 1343311 - RNA, 22 nt, Homo sapiens
acuccacuacucucuuccucca

SEQ ID NO: 1343312 - RNA, 23 nt, Homo sapiens
acucccagugcuugcaagauucc

SEQ ID NO: 1343313 - RNA, 15 nt, Homo sapiens
acucccauuccugaa

SEQ ID NO: 1343314 - RNA, 21 nt, Homo sapiens
acucccucguuaaucacagga

SEQ ID NO: 1343315 - RNA, 15 nt, Homo sapiens
acuccuguugccaug

SEQ ID NO: 1343316 - RNA, 21 nt, Homo sapiens
acucgggaccaauacuacuga

SEQ ID NO: 1343317 - RNA, 21 nt, Homo sapiens
acucuaaagucuguugauuaa

SEQ ID NO: 1343318 - RNA, 14 nt, Homo sapiens
acucugggcuccag

SEQ ID NO: 1343319 - RNA, 18 nt, Homo sapiens
acucuguugguagcaauu

SEQ ID NO: 1343320 - RNA, 18 nt, Homo sapiens
acucuguuuccuggucag

SEQ ID NO: 1343321 - RNA, 14 nt, Homo sapiens
acucuuaucuacau

SEQ ID NO: 1343322 - RNA, 15 nt, Homo sapiens
acucuuauucuuggc

SEQ ID NO: 1343323 - RNA, 18 nt, Homo sapiens
acucuucgaagccuugcc

SEQ ID NO: 1343324 - RNA, 15 nt, Homo sapiens
acucuuuugggcaac

SEQ ID NO: 1343325 - RNA, 23 nt, Homo sapiens
acugaaaaaugguaauuguugcu

SEQ ID NO: 1343326 - RNA, 20 nt, Homo sapiens
acugaaccacauucagggaa

SEQ ID NO: 1343327 - RNA, 18 nt, Homo sapiens
acugacauuccuccaugu

SEQ ID NO: 1343328 - RNA, 20 nt, Homo sapiens
acugacccucaggcacaccu

SEQ ID NO: 1343329 - RNA, 19 nt, Homo sapiens
acugagaugugaacacauc

SEQ ID NO: 1343330 - RNA, 18 nt, Homo sapiens
acugagcagggaucugcc

SEQ ID NO: 1343331 - RNA, 16 nt, Homo sapiens
acugagcuauaacuua

SEQ ID NO: 1343332 - RNA, 20 nt, Homo sapiens
acugaugagagaauguggaa

SEQ ID NO: 1343333 - RNA, 20 nt, Homo sapiens
acugauuacguuuacauucu

SEQ ID NO: 1343334 - RNA, 19 nt, Homo sapiens
acugcaaacacaccuugga

SEQ ID NO: 1343335 - RNA, 17 nt, Homo sapiens
acugcaaacccuuucau

SEQ ID NO: 1343336 - RNA, 12 nt, Homo sapiens
acugcaaccucc

SEQ ID NO: 1343337 - RNA, 20 nt, Homo sapiens
acugcccuuucaaagcacuu

SEQ ID NO: 1343338 - RNA, 16 nt, Homo sapiens
acugccuccugugacg

SEQ ID NO: 1343339 - RNA, 20 nt, Homo sapiens
acugccucuuccucccucau

SEQ ID NO: 1343340 - RNA, 11 nt, Homo sapiens
acugcgcucuu

SEQ ID NO: 1343341 - RNA, 19 nt, Homo sapiens
acugcugcccagccuccaa

SEQ ID NO: 1343342 - RNA, 13 nt, Homo sapiens
acugcugcugcug

SEQ ID NO: 1343343 - RNA, 18 nt, Homo sapiens
acugcuggaguccagugc

SEQ ID NO: 1343344 - RNA, 15 nt, Homo sapiens
acuggaaagcacaag

SEQ ID NO: 1343345 - RNA, 13 nt, Homo sapiens
acuggaagcuuug

SEQ ID NO: 1343346 - RNA, 17 nt, Homo sapiens
acuggacaauguccaaa

SEQ ID NO: 1343347 - RNA, 15 nt, Homo sapiens
acuggccacccaagg

SEQ ID NO: 1343348 - RNA, 18 nt, Homo sapiens
acuggccuauuuaucuga

SEQ ID NO: 1343349 - RNA, 19 nt, Homo sapiens
acuggcuucucuugaguca

SEQ ID NO: 1343350 - RNA, 21 nt, Homo sapiens
acuggcuucucuugagucaca

SEQ ID NO: 1343351 - RNA, 21 nt, Homo sapiens
acugggagagcugguggugca

SEQ ID NO: 1343352 - RNA, 13 nt, Homo sapiens
acuggggccucag

SEQ ID NO: 1343353 - RNA, 13 nt, Homo sapiens
acuggugcaugac

SEQ ID NO: 1343354 - RNA, 23 nt, Homo sapiens
acuggugcaugacaaguacugua

SEQ ID NO: 1343355 - RNA, 13 nt, Homo sapiens
acuggugggccau

SEQ ID NO: 1343356 - RNA, 17 nt, Homo sapiens
acuguaccgacuuugau

SEQ ID NO: 1343357 - RNA, 14 nt, Homo sapiens
acuguauuuuccaa

SEQ ID NO: 1343358 - RNA, 17 nt, Homo sapiens
acugucauccucaaaga

SEQ ID NO: 1343359 - RNA, 17 nt, Homo sapiens
acugucaugcugucagu

SEQ ID NO: 1343360 - RNA, 20 nt, Homo sapiens
acuguccuauuauauucauu

SEQ ID NO: 1343361 - RNA, 14 nt, Homo sapiens
acugugcuuggcca

SEQ ID NO: 1343362 - RNA, 13 nt, Homo sapiens
acugugguagcca

SEQ ID NO: 1343363 - RNA, 17 nt, Homo sapiens
acuguguaccucaugga

SEQ ID NO: 1343364 - RNA, 19 nt, Homo sapiens
acuguguaccucauggaug

SEQ ID NO: 1343365 - RNA, 23 nt, Homo sapiens
acuguguuuuaaaaggcaaguca

SEQ ID NO: 1343366 - RNA, 18 nt, Homo sapiens
acuguugggacagccauu

SEQ ID NO: 1343367 - RNA, 21 nt, Homo sapiens
acuguuuuauaaacugcugua

SEQ ID NO: 1343368 - RNA, 13 nt, Homo sapiens
acuuaacuauuaa

SEQ ID NO: 1343369 - RNA, 14 nt, Homo sapiens
acuuaucaacauuu

SEQ ID NO: 1343370 - RNA, 15 nt, Homo sapiens
acuuauuuagauuca

SEQ ID NO: 1343371 - RNA, 21 nt, Homo sapiens
acuuauuucagguuaaauuaa

SEQ ID NO: 1343372 - RNA, 19 nt, Homo sapiens
acuucaaggcucaaugcua

SEQ ID NO: 1343373 - RNA, 16 nt, Homo sapiens
acuucaauaaagcuau

SEQ ID NO: 1343374 - RNA, 23 nt, Homo sapiens
acuucaauguauugagcauguga

SEQ ID NO: 1343375 - RNA, 18 nt, Homo sapiens
acuucacgcccuuggcca

SEQ ID NO: 1343376 - RNA, 13 nt, Homo sapiens
acuucauacaucc

SEQ ID NO: 1343377 - RNA, 16 nt, Homo sapiens
acuuccugccauggau

SEQ ID NO: 1343378 - RNA, 15 nt, Homo sapiens
acuuccugugccuuu

SEQ ID NO: 1343379 - RNA, 17 nt, Homo sapiens
acuucucaccagcaguc

SEQ ID NO: 1343380 - RNA, 15 nt, Homo sapiens
acuucucuuucuuau

SEQ ID NO: 1343381 - RNA, 15 nt, Homo sapiens
acuucugucuucaca

SEQ ID NO: 1343382 - RNA, 21 nt, Homo sapiens
acuucugucuucacaacagau

SEQ ID NO: 1343383 - RNA, 22 nt, Homo sapiens
acuucugucuucacaacagauu

SEQ ID NO: 1343384 - RNA, 13 nt, Homo sapiens
cugcaccaugcug

SEQ ID NO: 1343385 - RNA, 20 nt, Homo sapiens
cugcaccaugcugcugggga

SEQ ID NO: 1343386 - RNA, 13 nt, Homo sapiens
cugcacugaggau

SEQ ID NO: 1343387 - RNA, 15 nt, Homo sapiens
cugcacugaugcugc

SEQ ID NO: 1343388 - RNA, 22 nt, Homo sapiens
cugcacugaugcugccccucau

SEQ ID NO: 1343389 - RNA, 18 nt, Homo sapiens
cugcaggccaggccagcu

SEQ ID NO: 1343390 - RNA, 22 nt, Homo sapiens
cugcagggggugugucugcuca

SEQ ID NO: 1343391 - RNA, 13 nt, Homo sapiens
cugcaguagugca

SEQ ID NO: 1343392 - RNA, 20 nt, Homo sapiens
cugcaguagugcaccaucuc

SEQ ID NO: 1343393 - RNA, 21 nt, Homo sapiens
cugcaguagugcaccaucuca

SEQ ID NO: 1343394 - RNA, 14 nt, Homo sapiens
cugcagucccacac

SEQ ID NO: 1343395 - RNA, 16 nt, Homo sapiens
cugcagucuggcugag

SEQ ID NO: 1343396 - RNA, 16 nt, Homo sapiens
cugcauuugccuguca

SEQ ID NO: 1343397 - RNA, 21 nt, Homo sapiens
cugcauuugccugucaugcgc

SEQ ID NO: 1343398 - RNA, 15 nt, Homo sapiens
cugccaaaaugcucu

SEQ ID NO: 1343399 - RNA, 12 nt, Homo sapiens
cugccauggaag

SEQ ID NO: 1343400 - RNA, 11 nt, Homo sapiens
cugccauuucc

SEQ ID NO: 1343401 - RNA, 16 nt, Homo sapiens
cugccccagccuccuc

SEQ ID NO: 1343402 - RNA, 16 nt, Homo sapiens
cugccccugccugaca

SEQ ID NO: 1343403 - RNA, 16 nt, Homo sapiens
cugccccuuaaacaca

SEQ ID NO: 1343404 - RNA, 14 nt, Homo sapiens
cugcccgccuaaga

SEQ ID NO: 1343405 - RNA, 21 nt, Homo sapiens
cugccggucgggcagccagca

SEQ ID NO: 1343406 - RNA, 17 nt, Homo sapiens
cugccuauuaucuguca

SEQ ID NO: 1343407 - RNA, 14 nt, Homo sapiens
cugccucagccucc

SEQ ID NO: 1343408 - RNA, 13 nt, Homo sapiens
cugccucaggacc

SEQ ID NO: 1343409 - RNA, 20 nt, Homo sapiens
cugccugugugggacugaga

SEQ ID NO: 1343410 - RNA, 16 nt, Homo sapiens
cugcgagaagcacaga

SEQ ID NO: 1343411 - RNA, 18 nt, Homo sapiens
cugcggccccgucugugg

SEQ ID NO: 1343412 - RNA, 19 nt, Homo sapiens
cugcggggggcaccagagg

SEQ ID NO: 1343413 - RNA, 23 nt, Homo sapiens
cugcuagcaaauggcagaaccaa

SEQ ID NO: 1343414 - RNA, 16 nt, Homo sapiens
cugcuccaacuccaua

SEQ ID NO: 1343415 - RNA, 15 nt, Homo sapiens
cugcuccagaccuga

SEQ ID NO: 1343416 - RNA, 18 nt, Homo sapiens
cugcuccccuaaagccag

SEQ ID NO: 1343417 - RNA, 19 nt, Homo sapiens
cugcuccccuaaagccagg

SEQ ID NO: 1343418 - RNA, 21 nt, Homo sapiens
cugcucguucaacagugugag

SEQ ID NO: 1343419 - RNA, 14 nt, Homo sapiens
cugcucuuguucua

SEQ ID NO: 1343420 - RNA, 18 nt, Homo sapiens
cugcugaaagacucgaga

SEQ ID NO: 1343421 - RNA, 15 nt, Homo sapiens
cugcugauacugggu

SEQ ID NO: 1343422 - RNA, 17 nt, Homo sapiens
cugcugcugcuacugcu

SEQ ID NO: 1343423 - RNA, 16 nt, Homo sapiens
cugcuggaaaugcuga

SEQ ID NO: 1343424 - RNA, 21 nt, Homo sapiens
cugcuggagugaaggggccaa

SEQ ID NO: 1343425 - RNA, 17 nt, Homo sapiens
cugcuguucuucagucc

SEQ ID NO: 1343426 - RNA, 18 nt, Homo sapiens
cugcuucauccaauguga

SEQ ID NO: 1343427 - RNA, 16 nt, Homo sapiens
cugcuucugauaugca

SEQ ID NO: 1343428 - RNA, 19 nt, Homo sapiens
cugcuuggacagcagccag

SEQ ID NO: 1343429 - RNA, 15 nt, Homo sapiens
cugcuuguauuccaa

SEQ ID NO: 1343430 - RNA, 16 nt, Homo sapiens
cuggaaaaagacugau

SEQ ID NO: 1343431 - RNA, 13 nt, Homo sapiens
cuggaaagcacaa

SEQ ID NO: 1343432 - RNA, 15 nt, Homo sapiens
cuggaaauugaaaua

SEQ ID NO: 1343433 - RNA, 12 nt, Homo sapiens
cuggaacccaga

SEQ ID NO: 1343434 - RNA, 21 nt, Homo sapiens
cuggaacguuucacugcaaac

SEQ ID NO: 1343435 - RNA, 14 nt, Homo sapiens
cuggaaggggccac

SEQ ID NO: 1343436 - RNA, 15 nt, Homo sapiens
cuggaauuacaggcg

SEQ ID NO: 1343437 - RNA, 15 nt, Homo sapiens
cuggaauucuaacaa

SEQ ID NO: 1343438 - RNA, 18 nt, Homo sapiens
cuggaauucuucugcaac

SEQ ID NO: 1343439 - RNA, 20 nt, Homo sapiens
cuggagaacuagagaaggac

SEQ ID NO: 1343440 - RNA, 18 nt, Homo sapiens
cuggagacaaggugcuaa

SEQ ID NO: 1343441 - RNA, 13 nt, Homo sapiens
cuggagauaugaa

SEQ ID NO: 1343442 - RNA, 20 nt, Homo sapiens
cuggagauaugaaggauuac

SEQ ID NO: 1343443 - RNA, 17 nt, Homo sapiens
cuggagcagucugagga

SEQ ID NO: 1343444 - RNA, 22 nt, Homo sapiens
cuggaggacggccggcucucua

SEQ ID NO: 1343445 - RNA, 22 nt, Homo sapiens
cuggaggcccaguucacccuga

SEQ ID NO: 1343446 - RNA, 19 nt, Homo sapiens
cuggaggcuccucuaggcc

SEQ ID NO: 1343447 - RNA, 17 nt, Homo sapiens
cuggaggggcaguggag

SEQ ID NO: 1343448 - RNA, 14 nt, Homo sapiens
cuggagugcaaugg

SEQ ID NO: 1343449 - RNA, 15 nt, Homo sapiens
cuggagugcaauggu

SEQ ID NO: 1343450 - RNA, 22 nt, Homo sapiens
cuggaguugaucuggaacccag

SEQ ID NO: 1343451 - RNA, 13 nt, Homo sapiens
cuggauauuucaa

SEQ ID NO: 1343452 - RNA, 20 nt, Homo sapiens
cuggaucugugaggggcucu

SEQ ID NO: 1343453 - RNA, 13 nt, Homo sapiens
cuggaugucucca

SEQ ID NO: 1343454 - RNA, 14 nt, Homo sapiens
cuggaugucuccau

SEQ ID NO: 1343455 - RNA, 23 nt, Homo sapiens
cuggauuauaaguucuauuuuac

SEQ ID NO: 1343456 - RNA, 22 nt, Homo sapiens
cuggcaacagagcgagauucca

SEQ ID NO: 1343457 - RNA, 19 nt, Homo sapiens
cuggcacaauguuggagca

SEQ ID NO: 1343458 - RNA, 19 nt, Homo sapiens
cuggcagacucgggaccaa

SEQ ID NO: 1343459 - RNA, 17 nt, Homo sapiens
cuggcccugugccuugg

SEQ ID NO: 1343460 - RNA, 17 nt, Homo sapiens
cuggcgccccuuccuag

SEQ ID NO: 1343461 - RNA, 18 nt, Homo sapiens
cuggcucaagcccugaau

SEQ ID NO: 1343462 - RNA, 13 nt, Homo sapiens
cuggcucaucucu

SEQ ID NO: 1343463 - RNA, 15 nt, Homo sapiens
cuggcucuuuuacca

SEQ ID NO: 1343464 - RNA, 16 nt, Homo sapiens
cuggcucuuuuaccag

SEQ ID NO: 1343465 - RNA, 14 nt, Homo sapiens
cuggcugugcacuu

SEQ ID NO: 1343466 - RNA, 19 nt, Homo sapiens
cuggcuucaaaaagccaca

SEQ ID NO: 1343467 - RNA, 21 nt, Homo sapiens
accuuccagcccggggccagc

SEQ ID NO: 1343468 - RNA, 17 nt, Homo sapiens
accuugaccgacaugaa

SEQ ID NO: 1343469 - RNA, 14 nt, Homo sapiens
accuugcacagguc

SEQ ID NO: 1343470 - RNA, 17 nt, Homo sapiens
accuugggggaagacuu

SEQ ID NO: 1343471 - RNA, 14 nt, Homo sapiens
accuuuauauuugg

SEQ ID NO: 1343472 - RNA, 21 nt, Homo sapiens
accuuucacgaacaugggcau

SEQ ID NO: 1343473 - RNA, 18 nt, Homo sapiens
accuuuggcugguagcag

SEQ ID NO: 1343474 - RNA, 20 nt, Homo sapiens
acgaaacuccaucucaaaac

SEQ ID NO: 1343475 - RNA, 22 nt, Homo sapiens
acgaauuaauuaccuggcacca

SEQ ID NO: 1343476 - RNA, 14 nt, Homo sapiens
acgacccaaggaau

SEQ ID NO: 1343477 - RNA, 14 nt, Homo sapiens
acgacucugaccuc

SEQ ID NO: 1343478 - RNA, 19 nt, Homo sapiens
acgacucugaccucuuggc

SEQ ID NO: 1343479 - RNA, 17 nt, Homo sapiens
acgagcaggcauuucug

SEQ ID NO: 1343480 - RNA, 15 nt, Homo sapiens
acgagugaaacuccg

SEQ ID NO: 1343481 - RNA, 22 nt, Homo sapiens
acgaguggccaguucauugugg

SEQ ID NO: 1343482 - RNA, 19 nt, Homo sapiens
acgauugaccuguccucuu

SEQ ID NO: 1343483 - RNA, 20 nt, Homo sapiens
acgcuguggcccugccuggc

SEQ ID NO: 1343484 - RNA, 16 nt, Homo sapiens
acggacugucaguucu

SEQ ID NO: 1343485 - RNA, 21 nt, Homo sapiens
acggaucugcugggcucugcc

SEQ ID NO: 1343486 - RNA, 16 nt, Homo sapiens
acggaugguugaauga

SEQ ID NO: 1343487 - RNA, 17 nt, Homo sapiens
acggcagggaaauguau

SEQ ID NO: 1343488 - RNA, 21 nt, Homo sapiens
acggcgugccuggacacugua

SEQ ID NO: 1343489 - RNA, 20 nt, Homo sapiens
acgggucuguguucgacuca

SEQ ID NO: 1343490 - RNA, 17 nt, Homo sapiens
acgucuccccuucucug

SEQ ID NO: 1343491 - RNA, 14 nt, Homo sapiens
acgugagaacaauc

SEQ ID NO: 1343492 - RNA, 23 nt, Homo sapiens
acguggauuguauuuaagacaua

SEQ ID NO: 1343493 - RNA, 17 nt, Homo sapiens
acguuaaguccaaggag

SEQ ID NO: 1343494 - RNA, 18 nt, Homo sapiens
acguugccucuacuuuau

SEQ ID NO: 1343495 - RNA, 13 nt, Homo sapiens
acguuugucauuc

SEQ ID NO: 1343496 - RNA, 13 nt, Homo sapiens
acuaaaaauugug

SEQ ID NO: 1343497 - RNA, 18 nt, Homo sapiens
acuaaaaguugcauuuua

SEQ ID NO: 1343498 - RNA, 12 nt, Homo sapiens
acuaaacucaac

SEQ ID NO: 1343499 - RNA, 12 nt, Homo sapiens
acuaaacuccau

SEQ ID NO: 1343500 - RNA, 19 nt, Homo sapiens
acuaacuaugcauggugcc

SEQ ID NO: 1343501 - RNA, 17 nt, Homo sapiens
acuaauccucucugcaa

SEQ ID NO: 1343502 - RNA, 11 nt, Homo sapiens
acuacacagcu

SEQ ID NO: 1343503 - RNA, 17 nt, Homo sapiens
acuacaguaacugugac

SEQ ID NO: 1343504 - RNA, 15 nt, Homo sapiens
acuacaucugggacu

SEQ ID NO: 1343505 - RNA, 20 nt, Homo sapiens
acuagacuacucaauauuaa

SEQ ID NO: 1343506 - RNA, 19 nt, Homo sapiens
acuaggaaaagaccaucug

SEQ ID NO: 1343507 - RNA, 18 nt, Homo sapiens
acuagguccccuucccuc

SEQ ID NO: 1343508 - RNA, 16 nt, Homo sapiens
acuagugugacuccuu

SEQ ID NO: 1343509 - RNA, 13 nt, Homo sapiens
acuaucaguuccc

SEQ ID NO: 1343510 - RNA, 21 nt, Homo sapiens
acuauggagcugagcaggugu

SEQ ID NO: 1343511 - RNA, 15 nt, Homo sapiens
acuauggagugcuca

SEQ ID NO: 1343512 - RNA, 14 nt, Homo sapiens
acuauguacugccu

SEQ ID NO: 1343513 - RNA, 15 nt, Homo sapiens
acuauucaaacaguc

SEQ ID NO: 1343514 - RNA, 18 nt, Homo sapiens
acuauuucaauacuuaca

SEQ ID NO: 1343515 - RNA, 15 nt, Homo sapiens
acucaaaugcucaga

SEQ ID NO: 1343516 - RNA, 16 nt, Homo sapiens
acucacaagugcucau

SEQ ID NO: 1343517 - RNA, 19 nt, Homo sapiens
acucacauccauucuuccc

SEQ ID NO: 1343518 - RNA, 19 nt, Homo sapiens
agacauuugcuaugagcug

SEQ ID NO: 1343519 - RNA, 16 nt, Homo sapiens
agaccagccugggcaa

SEQ ID NO: 1343520 - RNA, 13 nt, Homo sapiens
agaccugacaauu

SEQ ID NO: 1343521 - RNA, 20 nt, Homo sapiens
agaccuggagcaauaaaaga

SEQ ID NO: 1343522 - RNA, 22 nt, Homo sapiens
agaccuugcuuugagacuccuc

SEQ ID NO: 1343523 - RNA, 21 nt, Homo sapiens
agacuaaccucuaccagcaca

SEQ ID NO: 1343524 - RNA, 19 nt, Homo sapiens
agacuagauguaguauuuu

SEQ ID NO: 1343525 - RNA, 17 nt, Homo sapiens
agacuauucaaacaguc

SEQ ID NO: 1343526 - RNA, 18 nt, Homo sapiens
agacucaagagaauuuau

SEQ ID NO: 1343527 - RNA, 15 nt, Homo sapiens
agacucaaugugcuc

SEQ ID NO: 1343528 - RNA, 17 nt, Homo sapiens
agacucaaugugcucug

SEQ ID NO: 1343529 - RNA, 11 nt, Homo sapiens
agacuccucag

SEQ ID NO: 1343530 - RNA, 21 nt, Homo sapiens
agacuguugggacagccauuu

SEQ ID NO: 1343531 - RNA, 18 nt, Homo sapiens
agacuucucccauagcaa

SEQ ID NO: 1343532 - RNA, 22 nt, Homo sapiens
agacuucucccauagcaaagag

SEQ ID NO: 1343533 - RNA, 16 nt, Homo sapiens
agacuuguauauucua

SEQ ID NO: 1343534 - RNA, 20 nt, Homo sapiens
agacuuuguguucauuucau

SEQ ID NO: 1343535 - RNA, 21 nt, Homo sapiens
agagaaagugacaugcauuca

SEQ ID NO: 1343536 - RNA, 17 nt, Homo sapiens
agagaaauuucucauca

SEQ ID NO: 1343537 - RNA, 14 nt, Homo sapiens
agagacagaauuca

SEQ ID NO: 1343538 - RNA, 23 nt, Homo sapiens
agagaccauaagagaaaccugcc

SEQ ID NO: 1343539 - RNA, 16 nt, Homo sapiens
agagacccaagcugcc

SEQ ID NO: 1343540 - RNA, 14 nt, Homo sapiens
agagagaagccagc

SEQ ID NO: 1343541 - RNA, 17 nt, Homo sapiens
agagaggaggggaccaa

SEQ ID NO: 1343542 - RNA, 14 nt, Homo sapiens
agagagugcuauug

SEQ ID NO: 1343543 - RNA, 21 nt, Homo sapiens
agagauauugauauugaagga

SEQ ID NO: 1343544 - RNA, 20 nt, Homo sapiens
agagaucagcgacccugagg

SEQ ID NO: 1343545 - RNA, 18 nt, Homo sapiens
agagaugacucugucuca

SEQ ID NO: 1343546 - RNA, 16 nt, Homo sapiens
agagauugauggguua

SEQ ID NO: 1343547 - RNA, 15 nt, Homo sapiens
agagcaugcacaugc

SEQ ID NO: 1343548 - RNA, 20 nt, Homo sapiens
agagccccuacugugggcaa

SEQ ID NO: 1343549 - RNA, 17 nt, Homo sapiens
agagcccugugucugua

SEQ ID NO: 1343550 - RNA, 13 nt, Homo sapiens
agagccucugggc

SEQ ID NO: 1343551 - RNA, 15 nt, Homo sapiens
agagcuaggaacccu

SEQ ID NO: 1343552 - RNA, 22 nt, Homo sapiens
agagcucuuuaccaaggaugaa

SEQ ID NO: 1343553 - RNA, 15 nt, Homo sapiens
agagcuuuuugcaug

SEQ ID NO: 1343554 - RNA, 16 nt, Homo sapiens
agaggacucacuugcc

SEQ ID NO: 1343555 - RNA, 16 nt, Homo sapiens
agaggagaaaguggaa

SEQ ID NO: 1343556 - RNA, 20 nt, Homo sapiens
agaggagccaccaguucuca

SEQ ID NO: 1343557 - RNA, 16 nt, Homo sapiens
agaggaggggaaaguc

SEQ ID NO: 1343558 - RNA, 22 nt, Homo sapiens
agaggcuauuauuuucacugua

SEQ ID NO: 1343559 - RNA, 13 nt, Homo sapiens
agaggcucugaga

SEQ ID NO: 1343560 - RNA, 13 nt, Homo sapiens
agaggcuggccaa

SEQ ID NO: 1343561 - RNA, 23 nt, Homo sapiens
agaggcuuauucaguucuuacac

SEQ ID NO: 1343562 - RNA, 18 nt, Homo sapiens
agaggcuucuccaaaggg

SEQ ID NO: 1343563 - RNA, 13 nt, Homo sapiens
agagggaugcuug

SEQ ID NO: 1343564 - RNA, 17 nt, Homo sapiens
agagggcccagcccaga

SEQ ID NO: 1343565 - RNA, 20 nt, Homo sapiens
agaguaaaccuugaagggcu

SEQ ID NO: 1343566 - RNA, 17 nt, Homo sapiens
agaguagcaacaaaagg

SEQ ID NO: 1343567 - RNA, 22 nt, Homo sapiens
agcaucucccaguucauaauca

SEQ ID NO: 1343568 - RNA, 22 nt, Homo sapiens
agcaucugagcuaacuuauauu

SEQ ID NO: 1343569 - RNA, 17 nt, Homo sapiens
agcaugaauaaaacacu

SEQ ID NO: 1343570 - RNA, 15 nt, Homo sapiens
agcauguacuccccu

SEQ ID NO: 1343571 - RNA, 21 nt, Homo sapiens
agcaugugaugggcuguuuaa

SEQ ID NO: 1343572 - RNA, 23 nt, Homo sapiens
agcauuacccuccucucucccca

SEQ ID NO: 1343573 - RNA, 18 nt, Homo sapiens
agcauuguaaaugugcuu

SEQ ID NO: 1343574 - RNA, 14 nt, Homo sapiens
agccaaaccacuga

SEQ ID NO: 1343575 - RNA, 12 nt, Homo sapiens
agccaaacccac

SEQ ID NO: 1343576 - RNA, 14 nt, Homo sapiens
agccaagaggcagu

SEQ ID NO: 1343577 - RNA, 13 nt, Homo sapiens
agccaagggaugg

SEQ ID NO: 1343578 - RNA, 17 nt, Homo sapiens
agccaagggauggacau

SEQ ID NO: 1343579 - RNA, 22 nt, Homo sapiens
agccacacucugggcuccagag

SEQ ID NO: 1343580 - RNA, 14 nt, Homo sapiens
agccaccaguucuc

SEQ ID NO: 1343581 - RNA, 14 nt, Homo sapiens
agccagacuggcac

SEQ ID NO: 1343582 - RNA, 17 nt, Homo sapiens
agccagaggucuggccc

SEQ ID NO: 1343583 - RNA, 14 nt, Homo sapiens
agccagcaaccagc

SEQ ID NO: 1343584 - RNA, 22 nt, Homo sapiens
agccagcauccccaacugcgac

SEQ ID NO: 1343585 - RNA, 19 nt, Homo sapiens
agccaggccaacagcaccu

SEQ ID NO: 1343586 - RNA, 10 nt, Homo sapiens
agccauaaau

SEQ ID NO: 1343587 - RNA, 23 nt, Homo sapiens
agccauaggugcaguuugcuucu

SEQ ID NO: 1343588 - RNA, 20 nt, Homo sapiens
agccaucccuuuuuuuacau

SEQ ID NO: 1343589 - RNA, 13 nt, Homo sapiens
agccaucucuaau

SEQ ID NO: 1343590 - RNA, 15 nt, Homo sapiens
agccaucucuaauaa

SEQ ID NO: 1343591 - RNA, 17 nt, Homo sapiens
agccauugaucauaaac

SEQ ID NO: 1343592 - RNA, 19 nt, Homo sapiens
agcccagcaccccuuccuc

SEQ ID NO: 1343593 - RNA, 16 nt, Homo sapiens
agcccagcacuugaau

SEQ ID NO: 1343594 - RNA, 14 nt, Homo sapiens
agcccaggcagcua

SEQ ID NO: 1343595 - RNA, 20 nt, Homo sapiens
agccccaggguuuacaugaa

SEQ ID NO: 1343596 - RNA, 14 nt, Homo sapiens
agccccuccaaagg

SEQ ID NO: 1343597 - RNA, 23 nt, Homo sapiens
agccccuccaaaggucugauguc

SEQ ID NO: 1343598 - RNA, 20 nt, Homo sapiens
agcccgacagugccaucccc

SEQ ID NO: 1343599 - RNA, 23 nt, Homo sapiens
agcccgggucaucuguaccucug

SEQ ID NO: 1343600 - RNA, 19 nt, Homo sapiens
agcccuaaguggcugccuu

SEQ ID NO: 1343601 - RNA, 19 nt, Homo sapiens
agcccuccucucccaguga

SEQ ID NO: 1343602 - RNA, 19 nt, Homo sapiens
agcccuccucugcacuccc

SEQ ID NO: 1343603 - RNA, 18 nt, Homo sapiens
agcccugcgccaccucac

SEQ ID NO: 1343604 - RNA, 19 nt, Homo sapiens
agcccugcgccaccucacu

SEQ ID NO: 1343605 - RNA, 12 nt, Homo sapiens
agcccuguaaca

SEQ ID NO: 1343606 - RNA, 23 nt, Homo sapiens
agcccugugcagcagcuucccuu

SEQ ID NO: 1343607 - RNA, 19 nt, Homo sapiens
agcccugugucuguauaca

SEQ ID NO: 1343608 - RNA, 16 nt, Homo sapiens
agcccuucuauaccca

SEQ ID NO: 1343609 - RNA, 15 nt, Homo sapiens
agccguauuuuacau

SEQ ID NO: 1343610 - RNA, 13 nt, Homo sapiens
agccuacauucac

SEQ ID NO: 1343611 - RNA, 18 nt, Homo sapiens
agccuaccaaugccaaaa

SEQ ID NO: 1343612 - RNA, 15 nt, Homo sapiens
agccuagcggagccc

SEQ ID NO: 1343613 - RNA, 18 nt, Homo sapiens
agccuagcggagcccagc

SEQ ID NO: 1343614 - RNA, 22 nt, Homo sapiens
agccuauuccaucaacugugaa

SEQ ID NO: 1343615 - RNA, 23 nt, Homo sapiens
aggaauuuuuuuaacuuaaggga

SEQ ID NO: 1343616 - RNA, 18 nt, Homo sapiens
aggacaggacccucagga

SEQ ID NO: 1343617 - RNA, 11 nt, Homo sapiens
aggacccugaa

SEQ ID NO: 1343618 - RNA, 15 nt, Homo sapiens
aggacccuguccugc

SEQ ID NO: 1343619 - RNA, 18 nt, Homo sapiens
aggacgccuccaagcccg

SEQ ID NO: 1343620 - RNA, 16 nt, Homo sapiens
aggacuccauuucuuu

SEQ ID NO: 1343621 - RNA, 21 nt, Homo sapiens
aggacugguucugaggccaga

SEQ ID NO: 1343622 - RNA, 21 nt, Homo sapiens
aggacuguuuuauaaacugcu

SEQ ID NO: 1343623 - RNA, 21 nt, Homo sapiens
aggacuuguuucccuuuccug

SEQ ID NO: 1343624 - RNA, 15 nt, Homo sapiens
aggagaagcaauggg

SEQ ID NO: 1343625 - RNA, 15 nt, Homo sapiens
aggagauuccuuucc

SEQ ID NO: 1343626 - RNA, 19 nt, Homo sapiens
aggagcauccuuggcagug

SEQ ID NO: 1343627 - RNA, 18 nt, Homo sapiens
aggagccaccaguucuca

SEQ ID NO: 1343628 - RNA, 16 nt, Homo sapiens
aggagccuacuccaag

SEQ ID NO: 1343629 - RNA, 22 nt, Homo sapiens
aggagccucuggcuucccuaaa

SEQ ID NO: 1343630 - RNA, 18 nt, Homo sapiens
aggagcuagaacauucca

SEQ ID NO: 1343631 - RNA, 18 nt, Homo sapiens
aggagggcagaucacuuc

SEQ ID NO: 1343632 - RNA, 21 nt, Homo sapiens
aggaggugggauaucacuucc

SEQ ID NO: 1343633 - RNA, 22 nt, Homo sapiens
aggagguuauaccaggauuuau

SEQ ID NO: 1343634 - RNA, 14 nt, Homo sapiens
aggagucgggagca

SEQ ID NO: 1343635 - RNA, 19 nt, Homo sapiens
aggagucgggagcacagcu

SEQ ID NO: 1343636 - RNA, 20 nt, Homo sapiens
aggauaaaugucuuuccaaa

SEQ ID NO: 1343637 - RNA, 15 nt, Homo sapiens
aggauaacuugcuuu

SEQ ID NO: 1343638 - RNA, 17 nt, Homo sapiens
aggauauccucccucca

SEQ ID NO: 1343639 - RNA, 18 nt, Homo sapiens
aggauccagugacaugau

SEQ ID NO: 1343640 - RNA, 20 nt, Homo sapiens
aggauccagugacaugauuc

SEQ ID NO: 1343641 - RNA, 20 nt, Homo sapiens
aggaucugugauuggcuggu

SEQ ID NO: 1343642 - RNA, 19 nt, Homo sapiens
aggaugggaaucaggcaug

SEQ ID NO: 1343643 - RNA, 14 nt, Homo sapiens
aggauuauugucaa

SEQ ID NO: 1343644 - RNA, 20 nt, Homo sapiens
aggauuguuaauguuugcau

SEQ ID NO: 1343645 - RNA, 22 nt, Homo sapiens
aggauuucucaacuuugauacu

SEQ ID NO: 1343646 - RNA, 21 nt, Homo sapiens
aggauuugaaccaugaaguca

SEQ ID NO: 1343647 - RNA, 23 nt, Homo sapiens
aggcaaggaguuugagaccagcu

SEQ ID NO: 1343648 - RNA, 14 nt, Homo sapiens
aggcacaccuugca

SEQ ID NO: 1343649 - RNA, 18 nt, Homo sapiens
aggcacacuuucuggcaa

SEQ ID NO: 1343650 - RNA, 16 nt, Homo sapiens
aggcagcgcagggcug

SEQ ID NO: 1343651 - RNA, 16 nt, Homo sapiens
aggcaggagaaucacu

SEQ ID NO: 1343652 - RNA, 18 nt, Homo sapiens
aggcaggagaaucacuug

SEQ ID NO: 1343653 - RNA, 15 nt, Homo sapiens
aggcagggcaagaac

SEQ ID NO: 1343654 - RNA, 14 nt, Homo sapiens
aggcaguaaccaug

SEQ ID NO: 1343655 - RNA, 15 nt, Homo sapiens
aggcaguaaugccuu

SEQ ID NO: 1343656 - RNA, 20 nt, Homo sapiens
aggcaucauacuaaacuuca

SEQ ID NO: 1343657 - RNA, 18 nt, Homo sapiens
aggcaugagccacugugc

SEQ ID NO: 1343658 - RNA, 23 nt, Homo sapiens
aggcauucucccagcucuagccu

SEQ ID NO: 1343659 - RNA, 15 nt, Homo sapiens
aggccaacagcaccu

SEQ ID NO: 1343660 - RNA, 14 nt, Homo sapiens
aggccacagugggg

SEQ ID NO: 1343661 - RNA, 16 nt, Homo sapiens
aggccagcaagcucuu

SEQ ID NO: 1343662 - RNA, 18 nt, Homo sapiens
aggcccaggagaccucca

SEQ ID NO: 1343663 - RNA, 21 nt, Homo sapiens
aggcccgcuugcuggguaccu

SEQ ID NO: 1343664 - RNA, 18 nt, Homo sapiens
aggcccugugagcacaaa

SEQ ID NO: 1343665 - RNA, 19 nt, Homo sapiens
aggcccuuauuuucaagaa

SEQ ID NO: 1343666 - RNA, 23 nt, Homo sapiens
aggcccuuccucuccacugccuu

SEQ ID NO: 1343667 - RNA, 18 nt, Homo sapiens
aggccugcccugaugcuc

SEQ ID NO: 1343668 - RNA, 12 nt, Homo sapiens
aggccugccugu

SEQ ID NO: 1343669 - RNA, 16 nt, Homo sapiens
aggccuuacaucuggc

SEQ ID NO: 1343670 - RNA, 17 nt, Homo sapiens
aggccuugcucacagcu

SEQ ID NO: 1343671 - RNA, 16 nt, Homo sapiens
aggcgcacagugugag

SEQ ID NO: 1343672 - RNA, 19 nt, Homo sapiens
aggcgggauuuaugugcac

SEQ ID NO: 1343673 - RNA, 24 nt, Homo sapiens
aggcucagagagguagcacucuca

SEQ ID NO: 1343674 - RNA, 18 nt, Homo sapiens
aggcuccaguugggcuga

SEQ ID NO: 1343675 - RNA, 23 nt, Homo sapiens
aggcuccgggcaccaggggccaa

SEQ ID NO: 1343676 - RNA, 23 nt, Homo sapiens
aggcucuuaagcagcauggaaaa

SEQ ID NO: 1343677 - RNA, 16 nt, Homo sapiens
aggcugacagacucac

SEQ ID NO: 1343678 - RNA, 18 nt, Homo sapiens
aggcugaucccugagauc

SEQ ID NO: 1343679 - RNA, 18 nt, Homo sapiens
aggcugcccacucuccau

SEQ ID NO: 1343680 - RNA, 16 nt, Homo sapiens
aggcuggaaaugguuu

SEQ ID NO: 1343681 - RNA, 22 nt, Homo sapiens
aggcuggaaaugguuucacuug

SEQ ID NO: 1343682 - RNA, 18 nt, Homo sapiens
aggcuggagugcaauggu

SEQ ID NO: 1343683 - RNA, 20 nt, Homo sapiens
aggcuggagugcaauggugu

SEQ ID NO: 1343684 - RNA, 12 nt, Homo sapiens
aggcugggagac

SEQ ID NO: 1343685 - RNA, 21 nt, Homo sapiens
aggcuguuauaaaagcaauaa

SEQ ID NO: 1343686 - RNA, 23 nt, Homo sapiens
aggcuucucacggcgaccaauaa

SEQ ID NO: 1343687 - RNA, 18 nt, Homo sapiens
aggcuucuccaaagggag

SEQ ID NO: 1343688 - RNA, 23 nt, Homo sapiens
agggaagaacuauugugcucaga

SEQ ID NO: 1343689 - RNA, 13 nt, Homo sapiens
agggaaucucuug

SEQ ID NO: 1343690 - RNA, 17 nt, Homo sapiens
agggacacuaggaauca

SEQ ID NO: 1343691 - RNA, 16 nt, Homo sapiens
agggagcagaugcaau

SEQ ID NO: 1343692 - RNA, 21 nt, Homo sapiens
agggaggcaggggaggggugc

SEQ ID NO: 1343693 - RNA, 14 nt, Homo sapiens
agggaggugguccu

SEQ ID NO: 1343694 - RNA, 20 nt, Homo sapiens
agggaggugguccuccuauc

SEQ ID NO: 1343695 - RNA, 21 nt, Homo sapiens
agggauccccaggaggccugg

SEQ ID NO: 1343696 - RNA, 17 nt, Homo sapiens
agggcaguggcuucuuu

SEQ ID NO: 1343697 - RNA, 17 nt, Homo sapiens
agggcaguucugagugu

SEQ ID NO: 1343698 - RNA, 20 nt, Homo sapiens
agggcaguucugaguguuua

SEQ ID NO: 1343699 - RNA, 12 nt, Homo sapiens
agggcugaccca

SEQ ID NO: 1343700 - RNA, 14 nt, Homo sapiens
aggggagugcucug

SEQ ID NO: 1343701 - RNA, 21 nt, Homo sapiens
aggggcagcgcaugugugcau

SEQ ID NO: 1343702 - RNA, 15 nt, Homo sapiens
aggggccccauggca

SEQ ID NO: 1343703 - RNA, 14 nt, Homo sapiens
aggggcucucucau

SEQ ID NO: 1343704 - RNA, 23 nt, Homo sapiens
aggggcuguugaauuucccacau

SEQ ID NO: 1343705 - RNA, 17 nt, Homo sapiens
agggggacccuggugcu

SEQ ID NO: 1343706 - RNA, 20 nt, Homo sapiens
agggggacccuggugcucau

SEQ ID NO: 1343707 - RNA, 23 nt, Homo sapiens
agggggugggggugcugcucucu

SEQ ID NO: 1343708 - RNA, 18 nt, Homo sapiens
agggggugugucugcuca

SEQ ID NO: 1343709 - RNA, 13 nt, Homo sapiens
aggggucauucau

SEQ ID NO: 1343710 - RNA, 14 nt, Homo sapiens
aggggucauucaug

SEQ ID NO: 1343711 - RNA, 18 nt, Homo sapiens
agggguuauagcuucagg

SEQ ID NO: 1343712 - RNA, 22 nt, Homo sapiens
agggucucacucuguugcccag

SEQ ID NO: 1343713 - RNA, 13 nt, Homo sapiens
agggugagugcaa

SEQ ID NO: 1343714 - RNA, 15 nt, Homo sapiens
agggugagugcaagg

SEQ ID NO: 1343715 - RNA, 15 nt, Homo sapiens
agggugauggaacaa

SEQ ID NO: 1343716 - RNA, 11 nt, Homo sapiens
agguacaggag

SEQ ID NO: 1343717 - RNA, 14 nt, Homo sapiens
agguacccaugaau

SEQ ID NO: 1343718 - RNA, 20 nt, Homo sapiens
aggucacuuuaccucugugg

SEQ ID NO: 1343719 - RNA, 14 nt, Homo sapiens
aggucagccuggaa

SEQ ID NO: 1343720 - RNA, 14 nt, Homo sapiens
agguccaaauucac

SEQ ID NO: 1343721 - RNA, 15 nt, Homo sapiens
agguccuugcccuuu

SEQ ID NO: 1343722 - RNA, 14 nt, Homo sapiens
aggucuaaucagug

SEQ ID NO: 1343723 - RNA, 15 nt, Homo sapiens
aggucuaaucaguga

SEQ ID NO: 1343724 - RNA, 17 nt, Homo sapiens
aggucuaggugcuuuaa

SEQ ID NO: 1343725 - RNA, 15 nt, Homo sapiens
aggucuaguguuccu

SEQ ID NO: 1343726 - RNA, 21 nt, Homo sapiens
aggugaaaagggguguggcaa

SEQ ID NO: 1343727 - RNA, 17 nt, Homo sapiens
aggugaacugggagcag

SEQ ID NO: 1343728 - RNA, 21 nt, Homo sapiens
aggugcagaccuugggggaag

SEQ ID NO: 1343729 - RNA, 20 nt, Homo sapiens
aggugcuacaaaaacacagc

SEQ ID NO: 1343730 - RNA, 22 nt, Homo sapiens
agguggagaaagcauaucccac

SEQ ID NO: 1343731 - RNA, 16 nt, Homo sapiens
agguggcaggugagca

SEQ ID NO: 1343732 - RNA, 15 nt, Homo sapiens
agguggccacuccag

SEQ ID NO: 1343733 - RNA, 16 nt, Homo sapiens
aggugggagcaucucc

SEQ ID NO: 1343734 - RNA, 21 nt, Homo sapiens
aggugggggaacacugagaaa

SEQ ID NO: 1343735 - RNA, 22 nt, Homo sapiens
aggugugaggagagaggaggaa

SEQ ID NO: 1343736 - RNA, 20 nt, Homo sapiens
agguuacuuaauucaacuua

SEQ ID NO: 1343737 - RNA, 22 nt, Homo sapiens
agguucauugcgugauucaaug

SEQ ID NO: 1343738 - RNA, 18 nt, Homo sapiens
agguuccacagaggacac

SEQ ID NO: 1343739 - RNA, 22 nt, Homo sapiens
agguucuucagaagucacacau

SEQ ID NO: 1343740 - RNA, 13 nt, Homo sapiens
agguuucuauucg

SEQ ID NO: 1343741 - RNA, 18 nt, Homo sapiens
agguuucuuugacuucaa

SEQ ID NO: 1343742 - RNA, 15 nt, Homo sapiens
agguuugaaggagaa

SEQ ID NO: 1343743 - RNA, 18 nt, Homo sapiens
aguaaaaccacagcaguu

SEQ ID NO: 1343744 - RNA, 16 nt, Homo sapiens
aguaaaagcuacuaug

SEQ ID NO: 1343745 - RNA, 18 nt, Homo sapiens
aguaaaagucccaguuaa

SEQ ID NO: 1343746 - RNA, 20 nt, Homo sapiens
aguaaaggcaguaaugccuu

SEQ ID NO: 1343747 - RNA, 14 nt, Homo sapiens
aguaaauuaggcag

SEQ ID NO: 1343748 - RNA, 22 nt, Homo sapiens
auacugggucugcgaugcagcg

SEQ ID NO: 1343749 - RNA, 20 nt, Homo sapiens
auacugucucuccagugaaa

SEQ ID NO: 1343750 - RNA, 15 nt, Homo sapiens
auacuuaaugcauau

SEQ ID NO: 1343751 - RNA, 17 nt, Homo sapiens
auacuuacauaucugac

SEQ ID NO: 1343752 - RNA, 13 nt, Homo sapiens
auacuuagauuag

SEQ ID NO: 1343753 - RNA, 16 nt, Homo sapiens
auacuucuacaacuuu

SEQ ID NO: 1343754 - RNA, 18 nt, Homo sapiens
auacuugguucucuccac

SEQ ID NO: 1343755 - RNA, 22 nt, Homo sapiens
auacuugguucucuccaccagg

SEQ ID NO: 1343756 - RNA, 21 nt, Homo sapiens
auagaagaauaagucauggag

SEQ ID NO: 1343757 - RNA, 17 nt, Homo sapiens
auagaagguuugcagau

SEQ ID NO: 1343758 - RNA, 18 nt, Homo sapiens
auagaauaaaggcaguuu

SEQ ID NO: 1343759 - RNA, 15 nt, Homo sapiens
auagacauucucaca

SEQ ID NO: 1343760 - RNA, 17 nt, Homo sapiens
auagagccaaguccaaa

SEQ ID NO: 1343761 - RNA, 23 nt, Homo sapiens
auagagcuuuuaaaaauguccug

SEQ ID NO: 1343762 - RNA, 16 nt, Homo sapiens
auagaggguacuugaa

SEQ ID NO: 1343763 - RNA, 20 nt, Homo sapiens
auagcaaagaggcuguuaua

SEQ ID NO: 1343764 - RNA, 16 nt, Homo sapiens
auagcaaauggccuca

SEQ ID NO: 1343765 - RNA, 20 nt, Homo sapiens
auagcaacagagcacuugag

SEQ ID NO: 1343766 - RNA, 20 nt, Homo sapiens
auagcaccuccacauaccug

SEQ ID NO: 1343767 - RNA, 16 nt, Homo sapiens
auagccauugaucaua

SEQ ID NO: 1343768 - RNA, 19 nt, Homo sapiens
auagcuaaguacacaauaa

SEQ ID NO: 1343769 - RNA, 12 nt, Homo sapiens
auagcuucagga

SEQ ID NO: 1343770 - RNA, 13 nt, Homo sapiens
auaggacucugga

SEQ ID NO: 1343771 - RNA, 16 nt, Homo sapiens
auaggccugucccuug

SEQ ID NO: 1343772 - RNA, 12 nt, Homo sapiens
auaggugcaguu

SEQ ID NO: 1343773 - RNA, 15 nt, Homo sapiens
auagucuccuacgca

SEQ ID NO: 1343774 - RNA, 15 nt, Homo sapiens
auagugacaugcagu

SEQ ID NO: 1343775 - RNA, 16 nt, Homo sapiens
auagugacaugcaguu

SEQ ID NO: 1343776 - RNA, 19 nt, Homo sapiens
auagugauaccccaucucu

SEQ ID NO: 1343777 - RNA, 20 nt, Homo sapiens
auagugauagagugcaguga

SEQ ID NO: 1343778 - RNA, 17 nt, Homo sapiens
auagugaugaugaucuc

SEQ ID NO: 1343779 - RNA, 17 nt, Homo sapiens
auaguguucugcuccug

SEQ ID NO: 1343780 - RNA, 19 nt, Homo sapiens
auauaaaaauggguguuau

SEQ ID NO: 1343781 - RNA, 23 nt, Homo sapiens
auauaaaccccucagacaguuug

SEQ ID NO: 1343782 - RNA, 16 nt, Homo sapiens
auauaaauuuguguuc

SEQ ID NO: 1343783 - RNA, 19 nt, Homo sapiens
auauacuugguucucucca

SEQ ID NO: 1343784 - RNA, 16 nt, Homo sapiens
auauagacauucucac

SEQ ID NO: 1343785 - RNA, 22 nt, Homo sapiens
auauagaccaauugaagcauga

SEQ ID NO: 1343786 - RNA, 16 nt, Homo sapiens
auauagcaagauccca

SEQ ID NO: 1343787 - RNA, 15 nt, Homo sapiens
auauagccauugauc

SEQ ID NO: 1343788 - RNA, 16 nt, Homo sapiens
auauauaaguguacau

SEQ ID NO: 1343789 - RNA, 16 nt, Homo sapiens
auauaugcaggaaaga

SEQ ID NO: 1343790 - RNA, 18 nt, Homo sapiens
auauaugccuucccccac

SEQ ID NO: 1343791 - RNA, 15 nt, Homo sapiens
auauauuccaccagg

SEQ ID NO: 1343792 - RNA, 22 nt, Homo sapiens
auauauuggccaaacuggugca

SEQ ID NO: 1343793 - RNA, 17 nt, Homo sapiens
auaucacuuccaugaca

SEQ ID NO: 1343794 - RNA, 20 nt, Homo sapiens
auauccuuaaccauucuguc

SEQ ID NO: 1343795 - RNA, 13 nt, Homo sapiens
auaucuaccccag

SEQ ID NO: 1343796 - RNA, 21 nt, Homo sapiens
auaucuauguuuuaccaagcc

SEQ ID NO: 1343797 - RNA, 13 nt, Homo sapiens
auaucucuugccc

SEQ ID NO: 1343798 - RNA, 14 nt, Homo sapiens
auaucugcuuauca

SEQ ID NO: 1343799 - RNA, 21 nt, Homo sapiens
auaucuuagguaagacauaua

SEQ ID NO: 1343800 - RNA, 16 nt, Homo sapiens
auaucuucuacaugca

SEQ ID NO: 1343801 - RNA, 20 nt, Homo sapiens
auaucuuuaugggcucuguu

SEQ ID NO: 1343802 - RNA, 14 nt, Homo sapiens
auaugaagaaucug

SEQ ID NO: 1343803 - RNA, 22 nt, Homo sapiens
auaugaggcuguugucuuuucc

SEQ ID NO: 1343804 - RNA, 19 nt, Homo sapiens
auaugcaaaccaggauuuc

SEQ ID NO: 1343805 - RNA, 14 nt, Homo sapiens
auaugcaagcagcu

SEQ ID NO: 1343806 - RNA, 19 nt, Homo sapiens
auaugcugacagcucuuca

SEQ ID NO: 1343807 - RNA, 20 nt, Homo sapiens
auaugucucaggucccugca

SEQ ID NO: 1343808 - RNA, 17 nt, Homo sapiens
auauguugaaacuuuaa

SEQ ID NO: 1343809 - RNA, 20 nt, Homo sapiens
auauguuuggaauauuccac

SEQ ID NO: 1343810 - RNA, 22 nt, Homo sapiens
auauuaauuuuccaaugcacag

SEQ ID NO: 1343811 - RNA, 12 nt, Homo sapiens
auauuacuugcc

SEQ ID NO: 1343812 - RNA, 20 nt, Homo sapiens
auauuacuugccuaucugac

SEQ ID NO: 1343813 - RNA, 19 nt, Homo sapiens
auauuagucgcacauguau

SEQ ID NO: 1343814 - RNA, 13 nt, Homo sapiens
auauuccugcauu

SEQ ID NO: 1343815 - RNA, 14 nt, Homo sapiens
auauucucuaguca

SEQ ID NO: 1343816 - RNA, 20 nt, Homo sapiens
auauugccuguguuugccac

SEQ ID NO: 1343817 - RNA, 17 nt, Homo sapiens
auauuggccaaacuggu

SEQ ID NO: 1343818 - RNA, 14 nt, Homo sapiens
auauugugccccau

SEQ ID NO: 1343819 - RNA, 14 nt, Homo sapiens
auauuguuuuacaa

SEQ ID NO: 1343820 - RNA, 20 nt, Homo sapiens
auauuucucauuuagcauug

SEQ ID NO: 1343821 - RNA, 22 nt, Homo sapiens
auauuuguaucacaaaucuuaa

SEQ ID NO: 1343822 - RNA, 15 nt, Homo sapiens
auauuuuauguguaa

SEQ ID NO: 1343823 - RNA, 11 nt, Homo sapiens
auauuuugcua

SEQ ID NO: 1343824 - RNA, 17 nt, Homo sapiens
auauuuugcuaacuggu

SEQ ID NO: 1343825 - RNA, 13 nt, Homo sapiens
aucaaaaggccca

SEQ ID NO: 1343826 - RNA, 19 nt, Homo sapiens
aucaaaccacuguuauuaa

SEQ ID NO: 1343827 - RNA, 22 nt, Homo sapiens
aucaaauaucccuccauacagu

SEQ ID NO: 1343828 - RNA, 20 nt, Homo sapiens
aucaaauaugcaaagcacug

SEQ ID NO: 1343829 - RNA, 16 nt, Homo sapiens
aucaagagaaacuuca

SEQ ID NO: 1343830 - RNA, 17 nt, Homo sapiens
aucaauaaauguugcaa

SEQ ID NO: 1343831 - RNA, 13 nt, Homo sapiens
aucacuccagugc

SEQ ID NO: 1343832 - RNA, 17 nt, Homo sapiens
aucacucuaauucggau

SEQ ID NO: 1343833 - RNA, 15 nt, Homo sapiens
aucacuucauucaca

SEQ ID NO: 1343834 - RNA, 15 nt, Homo sapiens
aucagaaauacaaaa

SEQ ID NO: 1343835 - RNA, 13 nt, Homo sapiens
aucagaccaugaa

SEQ ID NO: 1343836 - RNA, 24 nt, Homo sapiens
aucagagagcugcccuucagcgau

SEQ ID NO: 1343837 - RNA, 15 nt, Homo sapiens
auccgagugugauuu

SEQ ID NO: 1343838 - RNA, 15 nt, Homo sapiens
auccuagacuugaaa

SEQ ID NO: 1343839 - RNA, 18 nt, Homo sapiens
auccuaugaaauacuuua

SEQ ID NO: 1343840 - RNA, 23 nt, Homo sapiens
auccucaggcagguaaccccaga

SEQ ID NO: 1343841 - RNA, 20 nt, Homo sapiens
auccuuaacacauucaauag

SEQ ID NO: 1343842 - RNA, 14 nt, Homo sapiens
auccuuacauuuca

SEQ ID NO: 1343843 - RNA, 22 nt, Homo sapiens
auccuucuuucuaguucagcug

SEQ ID NO: 1343844 - RNA, 22 nt, Homo sapiens
auccuugauuacuuccacugag

SEQ ID NO: 1343845 - RNA, 24 nt, Homo sapiens
auccuuggaaauuggaagagcaca

SEQ ID NO: 1343846 - RNA, 18 nt, Homo sapiens
auccuuguagcaaagcac

SEQ ID NO: 1343847 - RNA, 15 nt, Homo sapiens
aucgaggagcuagaa

SEQ ID NO: 1343848 - RNA, 14 nt, Homo sapiens
aucgcaguguucaa

SEQ ID NO: 1343849 - RNA, 23 nt, Homo sapiens
aucgccugaguugcuuuuacuuc

SEQ ID NO: 1343850 - RNA, 15 nt, Homo sapiens
aucgcuccucuccag

SEQ ID NO: 1343851 - RNA, 15 nt, Homo sapiens
aucuaacguguucca

SEQ ID NO: 1343852 - RNA, 12 nt, Homo sapiens
aucuacauucac

SEQ ID NO: 1343853 - RNA, 19 nt, Homo sapiens
aucuauaauuuaccuaaga

SEQ ID NO: 1343854 - RNA, 18 nt, Homo sapiens
aucuauagcuaaguacac

SEQ ID NO: 1343855 - RNA, 19 nt, Homo sapiens
aucuauagcuaaguacaca

SEQ ID NO: 1343856 - RNA, 14 nt, Homo sapiens
aucucacugcagua

SEQ ID NO: 1343857 - RNA, 19 nt, Homo sapiens
aucucacuuaguccuuuau

SEQ ID NO: 1343858 - RNA, 12 nt, Homo sapiens
aucucagggaac

SEQ ID NO: 1343859 - RNA, 16 nt, Homo sapiens
aucucagggaacugac

SEQ ID NO: 1343860 - RNA, 15 nt, Homo sapiens
aucuccaagaccaga

SEQ ID NO: 1343861 - RNA, 17 nt, Homo sapiens
aucucccacaugccagg

SEQ ID NO: 1343862 - RNA, 14 nt, Homo sapiens
aucucccuccucca

SEQ ID NO: 1343863 - RNA, 18 nt, Homo sapiens
aucucuccccauauauaa

SEQ ID NO: 1343864 - RNA, 16 nt, Homo sapiens
aucucugaggccucag

SEQ ID NO: 1343865 - RNA, 12 nt, Homo sapiens
aucucuugccug

SEQ ID NO: 1343866 - RNA, 14 nt, Homo sapiens
aucucuuuaccucc

SEQ ID NO: 1343867 - RNA, 15 nt, Homo sapiens
aucucuuuaccuccu

SEQ ID NO: 1343868 - RNA, 13 nt, Homo sapiens
aucugacauauua

SEQ ID NO: 1343869 - RNA, 13 nt, Homo sapiens
aucugacccagug

SEQ ID NO: 1343870 - RNA, 16 nt, Homo sapiens
aucugacuucauacau

SEQ ID NO: 1343871 - RNA, 17 nt, Homo sapiens
aucugagaggccacagu

SEQ ID NO: 1343872 - RNA, 15 nt, Homo sapiens
aucugaggcaaucua

SEQ ID NO: 1343873 - RNA, 16 nt, Homo sapiens
aucugaggcaaucuaa

SEQ ID NO: 1343874 - RNA, 15 nt, Homo sapiens
aucugccaucugcuu

SEQ ID NO: 1343875 - RNA, 12 nt, Homo sapiens
aucugcugucuu

SEQ ID NO: 1343876 - RNA, 18 nt, Homo sapiens
aucugcuuaucagugugc

SEQ ID NO: 1343877 - RNA, 17 nt, Homo sapiens
aucugggggaguggaau

SEQ ID NO: 1343878 - RNA, 22 nt, Homo sapiens
aucugguauauguaaguguuca

SEQ ID NO: 1343879 - RNA, 17 nt, Homo sapiens
aucugguccaacaugaa

SEQ ID NO: 1343880 - RNA, 19 nt, Homo sapiens
aucugguuuaagaguaaca

SEQ ID NO: 1343881 - RNA, 14 nt, Homo sapiens
aucuguaacagggu

SEQ ID NO: 1343882 - RNA, 13 nt, Homo sapiens
aucuguaccucug

SEQ ID NO: 1343883 - RNA, 19 nt, Homo sapiens
aucugucucggcucugcau

SEQ ID NO: 1343884 - RNA, 17 nt, Homo sapiens
aucugugaugacauucc

SEQ ID NO: 1343885 - RNA, 14 nt, Homo sapiens
aucuguuugauaca

SEQ ID NO: 1343886 - RNA, 15 nt, Homo sapiens
aucuuagguaagaca

SEQ ID NO: 1343887 - RNA, 18 nt, Homo sapiens
aucuucauguccagugag

SEQ ID NO: 1343888 - RNA, 15 nt, Homo sapiens
aucuucccacagugg

SEQ ID NO: 1343889 - RNA, 19 nt, Homo sapiens
aucuuccccaagagggacu

SEQ ID NO: 1343890 - RNA, 19 nt, Homo sapiens
aucuuggagaaugugagaa

SEQ ID NO: 1343891 - RNA, 17 nt, Homo sapiens
aucuuuagagaaguaua

SEQ ID NO: 1343892 - RNA, 23 nt, Homo sapiens
aucuuucaaaagccuuaccuuga

SEQ ID NO: 1343893 - RNA, 19 nt, Homo sapiens
aucuuucaugucuugucau

SEQ ID NO: 1343894 - RNA, 18 nt, Homo sapiens
aucuuugccuuuaucucu

SEQ ID NO: 1343895 - RNA, 15 nt, Homo sapiens
augaaaauagcaaua

SEQ ID NO: 1343896 - RNA, 18 nt, Homo sapiens
augaaaguauuggcauuc

SEQ ID NO: 1343897 - RNA, 22 nt, Homo sapiens
augaaauccugcuucaguguau

SEQ ID NO: 1343898 - RNA, 20 nt, Homo sapiens
augaaaucuucccaguauua

SEQ ID NO: 1343899 - RNA, 14 nt, Homo sapiens
augaaaugcauauu

SEQ ID NO: 1343900 - RNA, 19 nt, Homo sapiens
augaaauggaggaucucua

SEQ ID NO: 1343901 - RNA, 22 nt, Homo sapiens
augaacccauccgguuugccau

SEQ ID NO: 1343902 - RNA, 20 nt, Homo sapiens
augaaggauuacucuccaua

SEQ ID NO: 1343903 - RNA, 15 nt, Homo sapiens
augaauaaacaguua

SEQ ID NO: 1343904 - RNA, 15 nt, Homo sapiens
augacaguagucaca

SEQ ID NO: 1343905 - RNA, 21 nt, Homo sapiens
augacaugcacucagcucuug

SEQ ID NO: 1343906 - RNA, 19 nt, Homo sapiens
augacauucccugcuaaua

SEQ ID NO: 1343907 - RNA, 22 nt, Homo sapiens
augacccagaggacagcacaga

SEQ ID NO: 1343908 - RNA, 23 nt, Homo sapiens
augacccccaaccaaguggcucc

SEQ ID NO: 1343909 - RNA, 22 nt, Homo sapiens
augacgguguuaauuuugcuaa

SEQ ID NO: 1343910 - RNA, 13 nt, Homo sapiens
augagaagcagaa

SEQ ID NO: 1343911 - RNA, 13 nt, Homo sapiens
augagagcauaau

SEQ ID NO: 1343912 - RNA, 17 nt, Homo sapiens
augagcacccauuccaa

SEQ ID NO: 1343913 - RNA, 22 nt, Homo sapiens
augaggacuugugucucugugc

SEQ ID NO: 1343914 - RNA, 20 nt, Homo sapiens
augaggagaaaggggcccca

SEQ ID NO: 1343915 - RNA, 23 nt, Homo sapiens
augaggcaacccgugcucagcug

SEQ ID NO: 1343916 - RNA, 21 nt, Homo sapiens
augagguuucuuugacuucaa

SEQ ID NO: 1343917 - RNA, 22 nt, Homo sapiens
augagguuucuuugacuucaau

SEQ ID NO: 1343918 - RNA, 19 nt, Homo sapiens
augaguagcuuauacaauu

SEQ ID NO: 1343919 - RNA, 15 nt, Homo sapiens
augauacaguugcau

SEQ ID NO: 1343920 - RNA, 19 nt, Homo sapiens
augaucagaagaacaugau

SEQ ID NO: 1343921 - RNA, 16 nt, Homo sapiens
augauccugccaaucu

SEQ ID NO: 1343922 - RNA, 20 nt, Homo sapiens
augaugaaaacuaaggauuu

SEQ ID NO: 1343923 - RNA, 19 nt, Homo sapiens
augaugcacaguaucugcu

SEQ ID NO: 1343924 - RNA, 17 nt, Homo sapiens
augauugcuagccagca

SEQ ID NO: 1343925 - RNA, 19 nt, Homo sapiens
augauuucagaaauguuaa

SEQ ID NO: 1343926 - RNA, 14 nt, Homo sapiens
augcaaaagcacau

SEQ ID NO: 1343927 - RNA, 18 nt, Homo sapiens
cacuuuaccucuguggac

SEQ ID NO: 1343928 - RNA, 19 nt, Homo sapiens
cacuuuauauuuuccucuu

SEQ ID NO: 1343929 - RNA, 19 nt, Homo sapiens
cacuuugggaggccgaggu

SEQ ID NO: 1343930 - RNA, 18 nt, Homo sapiens
cacuuuugcuugaauuua

SEQ ID NO: 1343931 - RNA, 15 nt, Homo sapiens
cagaaacuacauuuc

SEQ ID NO: 1343932 - RNA, 16 nt, Homo sapiens
cagaaacugaugccaa

SEQ ID NO: 1343933 - RNA, 16 nt, Homo sapiens
cagaaagcaucccuca

SEQ ID NO: 1343934 - RNA, 13 nt, Homo sapiens
cagaaagguguga

SEQ ID NO: 1343935 - RNA, 17 nt, Homo sapiens
cagaaccgcagaagccu

SEQ ID NO: 1343936 - RNA, 21 nt, Homo sapiens
cagaaccucuaagugcugcug

SEQ ID NO: 1343937 - RNA, 20 nt, Homo sapiens
cagaacguggugaccuuuca

SEQ ID NO: 1343938 - RNA, 18 nt, Homo sapiens
cagaacucaaaugagccc

SEQ ID NO: 1343939 - RNA, 13 nt, Homo sapiens
cagaacucuuccu

SEQ ID NO: 1343940 - RNA, 19 nt, Homo sapiens
cagaagaugcuuagcugua

SEQ ID NO: 1343941 - RNA, 18 nt, Homo sapiens
cagaagccuccccagcuc

SEQ ID NO: 1343942 - RNA, 20 nt, Homo sapiens
cagaagccuccccagcucac

SEQ ID NO: 1343943 - RNA, 17 nt, Homo sapiens
cagaaggccccagagag

SEQ ID NO: 1343944 - RNA, 14 nt, Homo sapiens
cagaagucuuucag

SEQ ID NO: 1343945 - RNA, 18 nt, Homo sapiens
cagaaguguucacauggc

SEQ ID NO: 1343946 - RNA, 22 nt, Homo sapiens
cagaauccuaguuuaugcacau

SEQ ID NO: 1343947 - RNA, 14 nt, Homo sapiens
cagaaucuuuucaa

SEQ ID NO: 1343948 - RNA, 12 nt, Homo sapiens
cagacaacacug

SEQ ID NO: 1343949 - RNA, 19 nt, Homo sapiens
cagacaacacugggaaaca

SEQ ID NO: 1343950 - RNA, 14 nt, Homo sapiens
cagacacccaggac

SEQ ID NO: 1343951 - RNA, 22 nt, Homo sapiens
cagacagcccuggcaaaugccu

SEQ ID NO: 1343952 - RNA, 19 nt, Homo sapiens
cagacauccuagcauuugu

SEQ ID NO: 1343953 - RNA, 18 nt, Homo sapiens
cagacauggaacagugua

SEQ ID NO: 1343954 - RNA, 14 nt, Homo sapiens
cagacucccauucc

SEQ ID NO: 1343955 - RNA, 18 nt, Homo sapiens
cagacucgggaccaauac

SEQ ID NO: 1343956 - RNA, 16 nt, Homo sapiens
cagacugucaagaaga

SEQ ID NO: 1343957 - RNA, 19 nt, Homo sapiens
cagacuuuguguucauuuc

SEQ ID NO: 1343958 - RNA, 22 nt, Homo sapiens
cagagaaagcaaaggugcacuc

SEQ ID NO: 1343959 - RNA, 13 nt, Homo sapiens
cagagaagguaag

SEQ ID NO: 1343960 - RNA, 17 nt, Homo sapiens
cagagacacuguugaua

SEQ ID NO: 1343961 - RNA, 17 nt, Homo sapiens
cagagacauacuugaag

SEQ ID NO: 1343962 - RNA, 23 nt, Homo sapiens
cagagaccagcccaccccugugc

SEQ ID NO: 1343963 - RNA, 18 nt, Homo sapiens
cagagaggaggggaccaa

SEQ ID NO: 1343964 - RNA, 17 nt, Homo sapiens
cagagaggcucugagaa

SEQ ID NO: 1343965 - RNA, 17 nt, Homo sapiens
cagagcccugugucugu

SEQ ID NO: 1343966 - RNA, 19 nt, Homo sapiens
cagagcucuuuaccaagga

SEQ ID NO: 1343967 - RNA, 18 nt, Homo sapiens
cagaggagaagcaauggg

SEQ ID NO: 1343968 - RNA, 21 nt, Homo sapiens
cagaggagccaccaguucuca

SEQ ID NO: 1343969 - RNA, 17 nt, Homo sapiens
cagaggaggccggugaa

SEQ ID NO: 1343970 - RNA, 23 nt, Homo sapiens
cagaggaggggaaaguccagggc

SEQ ID NO: 1343971 - RNA, 20 nt, Homo sapiens
cagagguaauguuaguaaau

SEQ ID NO: 1343972 - RNA, 19 nt, Homo sapiens
cagaguauggaaguagcuc

SEQ ID NO: 1343973 - RNA, 21 nt, Homo sapiens
cagagucucgcucuguugccc

SEQ ID NO: 1343974 - RNA, 11 nt, Homo sapiens
cagagugcaag

SEQ ID NO: 1343975 - RNA, 24 nt, Homo sapiens
cagaguggggaugacaugcacuca

SEQ ID NO: 1343976 - RNA, 14 nt, Homo sapiens
cagauaacuuugac

SEQ ID NO: 1343977 - RNA, 20 nt, Homo sapiens
cagauacugucucuuucaug

SEQ ID NO: 1343978 - RNA, 22 nt, Homo sapiens
cagauacuuugaagugcagcuc

SEQ ID NO: 1343979 - RNA, 17 nt, Homo sapiens
cagauauucucuaguca

SEQ ID NO: 1343980 - RNA, 19 nt, Homo sapiens
cagaugcaagccuguauca

SEQ ID NO: 1343981 - RNA, 22 nt, Homo sapiens
cagaugcauauagacacacaua

SEQ ID NO: 1343982 - RNA, 20 nt, Homo sapiens
cagauggcagguuugcaauc

SEQ ID NO: 1343983 - RNA, 22 nt, Homo sapiens
cagauuauaacuguugucauau

SEQ ID NO: 1343984 - RNA, 16 nt, Homo sapiens
cagauucaugcacugu

SEQ ID NO: 1343985 - RNA, 15 nt, Homo sapiens
cagauucccagagca

SEQ ID NO: 1343986 - RNA, 19 nt, Homo sapiens
cagauuuaaagaaaaccac

SEQ ID NO: 1343987 - RNA, 22 nt, Homo sapiens
cagcaaaaaucucccagugaca

SEQ ID NO: 1343988 - RNA, 18 nt, Homo sapiens
cagcacgaguggccaguu

SEQ ID NO: 1343989 - RNA, 17 nt, Homo sapiens
cagcacucuuaucuaca

SEQ ID NO: 1343990 - RNA, 18 nt, Homo sapiens
cagcacuuguguugucug

SEQ ID NO: 1343991 - RNA, 19 nt, Homo sapiens
cagcaggagagacugagca

SEQ ID NO: 1343992 - RNA, 16 nt, Homo sapiens
cagcagggaugcccug

SEQ ID NO: 1343993 - RNA, 21 nt, Homo sapiens
cagcaguugaaaagacuccaa

SEQ ID NO: 1343994 - RNA, 20 nt, Homo sapiens
cagcaguugaucagacugaa

SEQ ID NO: 1343995 - RNA, 12 nt, Homo sapiens
cagcaguuucca

SEQ ID NO: 1343996 - RNA, 22 nt, Homo sapiens
cagcauuuacuaugcacaacag

SEQ ID NO: 1343997 - RNA, 16 nt, Homo sapiens
cagccaacccuuucau

SEQ ID NO: 1343998 - RNA, 14 nt, Homo sapiens
cagccacaacugca

SEQ ID NO: 1343999 - RNA, 15 nt, Homo sapiens
cagcccaagugaaaa

SEQ ID NO: 1344000 - RNA, 16 nt, Homo sapiens
cagcccaccccugugc

SEQ ID NO: 1344001 - RNA, 18 nt, Homo sapiens
cagcccgggucaucugua

SEQ ID NO: 1344002 - RNA, 19 nt, Homo sapiens
cagcccugcaccaugcugc

SEQ ID NO: 1344003 - RNA, 15 nt, Homo sapiens
cagccguauuuuaca

SEQ ID NO: 1344004 - RNA, 14 nt, Homo sapiens
cagccuacauucac

SEQ ID NO: 1344005 - RNA, 19 nt, Homo sapiens
cagccuagauaugaagaau

SEQ ID NO: 1344006 - RNA, 22 nt, Homo sapiens
cagccuagauaugaagaaucug

SEQ ID NO: 1344007 - RNA, 20 nt, Homo sapiens
cagccucaagucacucccaa

SEQ ID NO: 1344008 - RNA, 17 nt, Homo sapiens
cagccucagggacgacu

SEQ ID NO: 1344009 - RNA, 23 nt, Homo sapiens
cagccuccccaguagcugggauu

SEQ ID NO: 1344010 - RNA, 18 nt, Homo sapiens
cagccucccugaagccuu

SEQ ID NO: 1344011 - RNA, 15 nt, Homo sapiens
cagccuuaccaaagc

SEQ ID NO: 1344012 - RNA, 19 nt, Homo sapiens
cagccuucuugauguauuu

SEQ ID NO: 1344013 - RNA, 23 nt, Homo sapiens
cagccuugccagagauccaaaag

SEQ ID NO: 1344014 - RNA, 22 nt, Homo sapiens
cagccuuucuaaaaguugcaug

SEQ ID NO: 1344015 - RNA, 14 nt, Homo sapiens
cagcgaacagccuu

SEQ ID NO: 1344016 - RNA, 18 nt, Homo sapiens
cagcgaaugaaugcugua

SEQ ID NO: 1344017 - RNA, 15 nt, Homo sapiens
cagcgaccccaggac

SEQ ID NO: 1344018 - RNA, 18 nt, Homo sapiens
cagcgccagugacaguca

SEQ ID NO: 1344019 - RNA, 18 nt, Homo sapiens
ccaucagagaugacucug

SEQ ID NO: 1344020 - RNA, 17 nt, Homo sapiens
ccaucauacacuuccuu

SEQ ID NO: 1344021 - RNA, 14 nt, Homo sapiens
ccauccagccagac

SEQ ID NO: 1344022 - RNA, 16 nt, Homo sapiens
ccauccccaggcaccu

SEQ ID NO: 1344023 - RNA, 17 nt, Homo sapiens
ccaucccuuuuuuuaca

SEQ ID NO: 1344024 - RNA, 22 nt, Homo sapiens
ccaucccuuuuuuuacauuuca

SEQ ID NO: 1344025 - RNA, 20 nt, Homo sapiens
ccaucguuuucuucacuguc

SEQ ID NO: 1344026 - RNA, 13 nt, Homo sapiens
ccaucucacugca

SEQ ID NO: 1344027 - RNA, 16 nt, Homo sapiens
ccaucucuuuaccucc

SEQ ID NO: 1344028 - RNA, 13 nt, Homo sapiens
ccaucugagcugg

SEQ ID NO: 1344029 - RNA, 16 nt, Homo sapiens
ccaucuguuugauaca

SEQ ID NO: 1344030 - RNA, 15 nt, Homo sapiens
ccaucuuugcugcca

SEQ ID NO: 1344031 - RNA, 22 nt, Homo sapiens
ccaucuuugcugccagcucuca

SEQ ID NO: 1344032 - RNA, 12 nt, Homo sapiens
ccaugaacauca

SEQ ID NO: 1344033 - RNA, 11 nt, Homo sapiens
ccaugaaguca

SEQ ID NO: 1344034 - RNA, 23 nt, Homo sapiens
ccaugcacccucauacacagaaa

SEQ ID NO: 1344035 - RNA, 20 nt, Homo sapiens
ccaugcugggccacugggga

SEQ ID NO: 1344036 - RNA, 19 nt, Homo sapiens
ccaugcuugccugaagcuu

SEQ ID NO: 1344037 - RNA, 13 nt, Homo sapiens
ccauggacgggaa

SEQ ID NO: 1344038 - RNA, 17 nt, Homo sapiens
ccauguuguaaugcugc

SEQ ID NO: 1344039 - RNA, 19 nt, Homo sapiens
ccauguuguaaugcugcac

SEQ ID NO: 1344040 - RNA, 22 nt, Homo sapiens
ccauguuguaaugcugcacuuc

SEQ ID NO: 1344041 - RNA, 16 nt, Homo sapiens
ccauuaggucacuuaa

SEQ ID NO: 1344042 - RNA, 21 nt, Homo sapiens
ccauucuacauacuauggaau

SEQ ID NO: 1344043 - RNA, 11 nt, Homo sapiens
ccauucucuga

SEQ ID NO: 1344044 - RNA, 21 nt, Homo sapiens
ccauucuucagacaucaguca

SEQ ID NO: 1344045 - RNA, 15 nt, Homo sapiens
ccauugguguugaca

SEQ ID NO: 1344046 - RNA, 15 nt, Homo sapiens
ccauuuacaauugca

SEQ ID NO: 1344047 - RNA, 16 nt, Homo sapiens
ccauuucaggacucuc

SEQ ID NO: 1344048 - RNA, 18 nt, Homo sapiens
ccauuuugugaauuguga

SEQ ID NO: 1344049 - RNA, 14 nt, Homo sapiens
cccaaaacagcuuu

SEQ ID NO: 1344050 - RNA, 14 nt, Homo sapiens
cccaaaacugucau

SEQ ID NO: 1344051 - RNA, 23 nt, Homo sapiens
cccaaaggaacacugacaucaau

SEQ ID NO: 1344052 - RNA, 16 nt, Homo sapiens
cccaaauuucauaccu

SEQ ID NO: 1344053 - RNA, 15 nt, Homo sapiens
cccaaccuacauucc

SEQ ID NO: 1344054 - RNA, 17 nt, Homo sapiens
cccaacgugcaaagcca

SEQ ID NO: 1344055 - RNA, 22 nt, Homo sapiens
cccaaggcgauauaagcaaaau

SEQ ID NO: 1344056 - RNA, 22 nt, Homo sapiens
cccaagggagacugaccaucau

SEQ ID NO: 1344057 - RNA, 22 nt, Homo sapiens
cccaagucccugucauuugaac

SEQ ID NO: 1344058 - RNA, 15 nt, Homo sapiens
cccaaucaccuuucc

SEQ ID NO: 1344059 - RNA, 13 nt, Homo sapiens
cccaaugcugcuu

SEQ ID NO: 1344060 - RNA, 18 nt, Homo sapiens
cccacaaaacuucagugu

SEQ ID NO: 1344061 - RNA, 19 nt, Homo sapiens
cccacaaaacuucagugug

SEQ ID NO: 1344062 - RNA, 14 nt, Homo sapiens
cccacaaacuccag

SEQ ID NO: 1344063 - RNA, 19 nt, Homo sapiens
cccacaauugaacuuccag

SEQ ID NO: 1344064 - RNA, 22 nt, Homo sapiens
cccacacugaccuguguucccu

SEQ ID NO: 1344065 - RNA, 15 nt, Homo sapiens
cccacccaacuaauu

SEQ ID NO: 1344066 - RNA, 13 nt, Homo sapiens
cccaccccaucca

SEQ ID NO: 1344067 - RNA, 17 nt, Homo sapiens
cccaccuggugugacuu

SEQ ID NO: 1344068 - RNA, 14 nt, Homo sapiens
cccacucaggggac

SEQ ID NO: 1344069 - RNA, 19 nt, Homo sapiens
cccacuuggcaucauucac

SEQ ID NO: 1344070 - RNA, 20 nt, Homo sapiens
cccagacaauuccauucaau

SEQ ID NO: 1344071 - RNA, 15 nt, Homo sapiens
cccagacuacuauuu

SEQ ID NO: 1344072 - RNA, 17 nt, Homo sapiens
cccagacuagauguagu

SEQ ID NO: 1344073 - RNA, 18 nt, Homo sapiens
cccagacuagauguagua

SEQ ID NO: 1344074 - RNA, 21 nt, Homo sapiens
cccagcaggacagugacccca

SEQ ID NO: 1344075 - RNA, 19 nt, Homo sapiens
cccagcaucccuggagcag

SEQ ID NO: 1344076 - RNA, 16 nt, Homo sapiens
cccagccagggcucaa

SEQ ID NO: 1344077 - RNA, 16 nt, Homo sapiens
cccagcuaacucugac

SEQ ID NO: 1344078 - RNA, 18 nt, Homo sapiens
cccagcuaagaaccugga

SEQ ID NO: 1344079 - RNA, 18 nt, Homo sapiens
cccagcuaccucaaccaa

SEQ ID NO: 1344080 - RNA, 19 nt, Homo sapiens
cccagcucuagccucugga

SEQ ID NO: 1344081 - RNA, 14 nt, Homo sapiens
cccaggaccagcuc

SEQ ID NO: 1344082 - RNA, 19 nt, Homo sapiens
cccaggcuagagugcaaug

SEQ ID NO: 1344083 - RNA, 19 nt, Homo sapiens
cccaggcuggagugcaaug

SEQ ID NO: 1344084 - RNA, 15 nt, Homo sapiens
cccagucccauuccu

SEQ ID NO: 1344085 - RNA, 19 nt, Homo sapiens
cccagucgaccccaaagga

SEQ ID NO: 1344086 - RNA, 17 nt, Homo sapiens
cccagugacaacaucgc

SEQ ID NO: 1344087 - RNA, 21 nt, Homo sapiens
cccagugcuugcaagauucca

SEQ ID NO: 1344088 - RNA, 22 nt, Homo sapiens
cccaguucugaauaacuugaag

SEQ ID NO: 1344089 - RNA, 16 nt, Homo sapiens
cccaucauacacuucc

SEQ ID NO: 1344090 - RNA, 15 nt, Homo sapiens
cccauccagccagac

SEQ ID NO: 1344091 - RNA, 17 nt, Homo sapiens
cccaugcacugugaagg

SEQ ID NO: 1344092 - RNA, 13 nt, Homo sapiens
cccaugcaucuuc

SEQ ID NO: 1344093 - RNA, 23 nt, Homo sapiens
cccauggagacagaaaguagaau

SEQ ID NO: 1344094 - RNA, 16 nt, Homo sapiens
cccauucuucacucuu

SEQ ID NO: 1344095 - RNA, 12 nt, Homo sapiens
cccauuugggca

SEQ ID NO: 1344096 - RNA, 22 nt, Homo sapiens
ccccaaugacacccaugccaga

SEQ ID NO: 1344097 - RNA, 23 nt, Homo sapiens
ccccacagaaccuucaacccagu

SEQ ID NO: 1344098 - RNA, 15 nt, Homo sapiens
ccccacccaggagua

SEQ ID NO: 1344099 - RNA, 16 nt, Homo sapiens
ccccacugcugagcug

SEQ ID NO: 1344100 - RNA, 14 nt, Homo sapiens
ccccagagcucuuu

SEQ ID NO: 1344101 - RNA, 14 nt, Homo sapiens
ccccagcccagaga

SEQ ID NO: 1344102 - RNA, 12 nt, Homo sapiens
ccccagcucacc

SEQ ID NO: 1344103 - RNA, 21 nt, Homo sapiens
ccccagggggcaacugacauu

SEQ ID NO: 1344104 - RNA, 11 nt, Homo sapiens
ccccaggguuu

SEQ ID NO: 1344105 - RNA, 12 nt, Homo sapiens
ccccagucccag

SEQ ID NO: 1344106 - RNA, 15 nt, Homo sapiens
ccccauccagccaga

SEQ ID NO: 1344107 - RNA, 13 nt, Homo sapiens
ccccaugcacugu

SEQ ID NO: 1344108 - RNA, 15 nt, Homo sapiens
cccccacucagugcc

SEQ ID NO: 1344109 - RNA, 22 nt, Homo sapiens
cccccaguccuguccuaucacu

SEQ ID NO: 1344110 - RNA, 19 nt, Homo sapiens
cccccaugggcuguguccu

SEQ ID NO: 1344111 - RNA, 11 nt, Homo sapiens
cccccuagugg

SEQ ID NO: 1344112 - RNA, 13 nt, Homo sapiens
cccccuucaggag

SEQ ID NO: 1344113 - RNA, 16 nt, Homo sapiens
cccccuuguuguaaaa

SEQ ID NO: 1344114 - RNA, 22 nt, Homo sapiens
cccccuuuccaucuguuugaua

SEQ ID NO: 1344115 - RNA, 22 nt, Homo sapiens
ccccgauugaaagaaccagaga

SEQ ID NO: 1344116 - RNA, 23 nt, Homo sapiens
cccugcccaccaagaagcacugg

SEQ ID NO: 1344117 - RNA, 23 nt, Homo sapiens
cccugcgccaccucacugcagua

SEQ ID NO: 1344118 - RNA, 13 nt, Homo sapiens
cccugcucaggag

SEQ ID NO: 1344119 - RNA, 17 nt, Homo sapiens
cccugcuccaacuccau

SEQ ID NO: 1344120 - RNA, 20 nt, Homo sapiens
cccuggaaaccuuccaccca

SEQ ID NO: 1344121 - RNA, 18 nt, Homo sapiens
cccuguaacaggcuugaa

SEQ ID NO: 1344122 - RNA, 21 nt, Homo sapiens
cccuguggccaacugcaaaaa

SEQ ID NO: 1344123 - RNA, 18 nt, Homo sapiens
cccuguggcccuggccac

SEQ ID NO: 1344124 - RNA, 18 nt, Homo sapiens
cccuuacagccucugacu

SEQ ID NO: 1344125 - RNA, 14 nt, Homo sapiens
cccuuagugaauua

SEQ ID NO: 1344126 - RNA, 16 nt, Homo sapiens
cccuuauuuucaagaa

SEQ ID NO: 1344127 - RNA, 17 nt, Homo sapiens
cccuuccaugugccuuu

SEQ ID NO: 1344128 - RNA, 11 nt, Homo sapiens
cccuuccccag

SEQ ID NO: 1344129 - RNA, 13 nt, Homo sapiens
cccuuccuggaaa

SEQ ID NO: 1344130 - RNA, 20 nt, Homo sapiens
cccuucuauacccacccaga

SEQ ID NO: 1344131 - RNA, 17 nt, Homo sapiens
cccuucuggacacugag

SEQ ID NO: 1344132 - RNA, 21 nt, Homo sapiens
cccuucuucacacagacacua

SEQ ID NO: 1344133 - RNA, 17 nt, Homo sapiens
cccuuggaaaaacagga

SEQ ID NO: 1344134 - RNA, 18 nt, Homo sapiens
cccuuggacauuuuaugu

SEQ ID NO: 1344135 - RNA, 19 nt, Homo sapiens
cccuuggugagaaagggau

SEQ ID NO: 1344136 - RNA, 16 nt, Homo sapiens
cccuuucacacuggau

SEQ ID NO: 1344137 - RNA, 22 nt, Homo sapiens
cccuuucauaaagucuugccuu

SEQ ID NO: 1344138 - RNA, 12 nt, Homo sapiens
cccuuugcuaaa

SEQ ID NO: 1344139 - RNA, 13 nt, Homo sapiens
cccuuugugacuu

SEQ ID NO: 1344140 - RNA, 18 nt, Homo sapiens
cccuuuuuuuacauuuca

SEQ ID NO: 1344141 - RNA, 21 nt, Homo sapiens
ccgagucagacuuuguguuca

SEQ ID NO: 1344142 - RNA, 15 nt, Homo sapiens
ccgagucucuucucc

SEQ ID NO: 1344143 - RNA, 13 nt, Homo sapiens
ccgcagggcgggg

SEQ ID NO: 1344144 - RNA, 19 nt, Homo sapiens
ccgccacugggccugucac

SEQ ID NO: 1344145 - RNA, 14 nt, Homo sapiens
ccgcuaaggugaaa

SEQ ID NO: 1344146 - RNA, 12 nt, Homo sapiens
ccgcucucucug

SEQ ID NO: 1344147 - RNA, 14 nt, Homo sapiens
ccgcugucucugag

SEQ ID NO: 1344148 - RNA, 19 nt, Homo sapiens
ccggaaggaaugucagggc

SEQ ID NO: 1344149 - RNA, 19 nt, Homo sapiens
ccggagggcccugagcuga

SEQ ID NO: 1344150 - RNA, 21 nt, Homo sapiens
ccgggagggugcggcugugca

SEQ ID NO: 1344151 - RNA, 15 nt, Homo sapiens
ccgggcuggagaaag

SEQ ID NO: 1344152 - RNA, 15 nt, Homo sapiens
ccggggaaaggcaag

SEQ ID NO: 1344153 - RNA, 17 nt, Homo sapiens
ccgguucuuaaauccau

SEQ ID NO: 1344154 - RNA, 12 nt, Homo sapiens
ccguagauuccc

SEQ ID NO: 1344155 - RNA, 22 nt, Homo sapiens
ccgucuguggcuuucagccucu

SEQ ID NO: 1344156 - RNA, 23 nt, Homo sapiens
ccgugauaauuggcuacuuuucc

SEQ ID NO: 1344157 - RNA, 11 nt, Homo sapiens
ccgugccuuca

SEQ ID NO: 1344158 - RNA, 16 nt, Homo sapiens
ccgugcucacuaccaa

SEQ ID NO: 1344159 - RNA, 15 nt, Homo sapiens
ccguuccacauccac

SEQ ID NO: 1344160 - RNA, 18 nt, Homo sapiens
ccuaaaaagauugccaau

SEQ ID NO: 1344161 - RNA, 15 nt, Homo sapiens
ccuaaaacuggcaaa

SEQ ID NO: 1344162 - RNA, 22 nt, Homo sapiens
ccuaaaugaugccuuugucugu

SEQ ID NO: 1344163 - RNA, 11 nt, Homo sapiens
ccuaacacauu

SEQ ID NO: 1344164 - RNA, 12 nt, Homo sapiens
ccuacauguauu

SEQ ID NO: 1344165 - RNA, 14 nt, Homo sapiens
ccuacauuaucuca

SEQ ID NO: 1344166 - RNA, 19 nt, Homo sapiens
ccuaccaaugccaaaagga

SEQ ID NO: 1344167 - RNA, 15 nt, Homo sapiens
ccuacccuaaccaag

SEQ ID NO: 1344168 - RNA, 22 nt, Homo sapiens
ccuacuaauccucucugcaagu

SEQ ID NO: 1344169 - RNA, 23 nt, Homo sapiens
ccuagagguggaguucuuagcua

SEQ ID NO: 1344170 - RNA, 16 nt, Homo sapiens
ccuagauagcuauuaa

SEQ ID NO: 1344171 - RNA, 19 nt, Homo sapiens
ccuagccucgcucuuggca

SEQ ID NO: 1344172 - RNA, 17 nt, Homo sapiens
ccuaggucaugccuccu

SEQ ID NO: 1344173 - RNA, 15 nt, Homo sapiens
ccuauaucuuaggua

SEQ ID NO: 1344174 - RNA, 17 nt, Homo sapiens
ccuauccuuacauuuca

SEQ ID NO: 1344175 - RNA, 17 nt, Homo sapiens
ccuaucugacuucauac

SEQ ID NO: 1344176 - RNA, 20 nt, Homo sapiens
ccucaaccaaugccaaaaaa

SEQ ID NO: 1344177 - RNA, 18 nt, Homo sapiens
ccucaacuccgugcuuaa

SEQ ID NO: 1344178 - RNA, 21 nt, Homo sapiens
ccucaagccccauuuccucac

SEQ ID NO: 1344179 - RNA, 12 nt, Homo sapiens
ccucacacugca

SEQ ID NO: 1344180 - RNA, 13 nt, Homo sapiens
ccucacauacccu

SEQ ID NO: 1344181 - RNA, 15 nt, Homo sapiens
ccucaccacagccuu

SEQ ID NO: 1344182 - RNA, 22 nt, Homo sapiens
ccucaccuggucgccaauccau

SEQ ID NO: 1344183 - RNA, 21 nt, Homo sapiens
ccucaccuuggcaccagacac

SEQ ID NO: 1344184 - RNA, 22 nt, Homo sapiens
ccucacucuguuuccuggucag

SEQ ID NO: 1344185 - RNA, 22 nt, Homo sapiens
ccucacugcuguagacauuugc

SEQ ID NO: 1344186 - RNA, 20 nt, Homo sapiens
ccucagaaggccccagagag

SEQ ID NO: 1344187 - RNA, 14 nt, Homo sapiens
ccucagagugcaag

SEQ ID NO: 1344188 - RNA, 20 nt, Homo sapiens
ccucaggugaaacuccagau

SEQ ID NO: 1344189 - RNA, 16 nt, Homo sapiens
ccucagugagaagcca

SEQ ID NO: 1344190 - RNA, 13 nt, Homo sapiens
ccucauuccauaa

SEQ ID NO: 1344191 - RNA, 16 nt, Homo sapiens
ccucauuuugugaugu

SEQ ID NO: 1344192 - RNA, 13 nt, Homo sapiens
ccuccaagcauuu

SEQ ID NO: 1344193 - RNA, 22 nt, Homo sapiens
ccuccacaugcugccuggcaca

SEQ ID NO: 1344194 - RNA, 16 nt, Homo sapiens
ccuccagacucagcag

SEQ ID NO: 1344195 - RNA, 13 nt, Homo sapiens
ccuccagauauac

SEQ ID NO: 1344196 - RNA, 22 nt, Homo sapiens
ccuccaggaaccacaccacauc

SEQ ID NO: 1344197 - RNA, 17 nt, Homo sapiens
ccuccaguuuugccuga

SEQ ID NO: 1344198 - RNA, 11 nt, Homo sapiens
ccuccaugcac

SEQ ID NO: 1344199 - RNA, 21 nt, Homo sapiens
ccucccaaagugcugggauua

SEQ ID NO: 1344200 - RNA, 21 nt, Homo sapiens
ccucccagagugcugggauua

SEQ ID NO: 1344201 - RNA, 16 nt, Homo sapiens
ccucccagguucacac

SEQ ID NO: 1344202 - RNA, 21 nt, Homo sapiens
ccuccccaguagcugggauua

SEQ ID NO: 1344203 - RNA, 15 nt, Homo sapiens
ccucccccaugggcu

SEQ ID NO: 1344204 - RNA, 20 nt, Homo sapiens
ccucccccuuucacacugga

SEQ ID NO: 1344205 - RNA, 13 nt, Homo sapiens
ccucccuccagau

SEQ ID NO: 1344206 - RNA, 20 nt, Homo sapiens
ccuccgccuuccggguucaa

SEQ ID NO: 1344207 - RNA, 15 nt, Homo sapiens
ccuccugucccucau

SEQ ID NO: 1344208 - RNA, 15 nt, Homo sapiens
ccucgcccuccacaa

SEQ ID NO: 1344209 - RNA, 16 nt, Homo sapiens
ccucgcccuccacaaa

SEQ ID NO: 1344210 - RNA, 21 nt, Homo sapiens
ccucgcuguugucacaucuca

SEQ ID NO: 1344211 - RNA, 13 nt, Homo sapiens
ccucggcacacac

SEQ ID NO: 1344212 - RNA, 23 nt, Homo sapiens
ccucgguucaaaaccuugcacag

SEQ ID NO: 1344213 - RNA, 14 nt, Homo sapiens
ccucuaguaguaua

SEQ ID NO: 1344214 - RNA, 16 nt, Homo sapiens
ccugcgagacgcacac

SEQ ID NO: 1344215 - RNA, 20 nt, Homo sapiens
ccugcgccaccgcccagaga

SEQ ID NO: 1344216 - RNA, 22 nt, Homo sapiens
ccugcgccaccucacugcagua

SEQ ID NO: 1344217 - RNA, 24 nt, Homo sapiens
ccugcucagcccugcaccaugcug

SEQ ID NO: 1344218 - RNA, 18 nt, Homo sapiens
ccugcucuccucuugcca

SEQ ID NO: 1344219 - RNA, 20 nt, Homo sapiens
ccugcuggccccuucugggg

SEQ ID NO: 1344220 - RNA, 12 nt, Homo sapiens
ccugcugugcug

SEQ ID NO: 1344221 - RNA, 16 nt, Homo sapiens
ccuggagaguacauuu

SEQ ID NO: 1344222 - RNA, 14 nt, Homo sapiens
ccuggauccagcac

SEQ ID NO: 1344223 - RNA, 13 nt, Homo sapiens
ccuggaugagaaa

SEQ ID NO: 1344224 - RNA, 19 nt, Homo sapiens
ccuggaugucugggugacc

SEQ ID NO: 1344225 - RNA, 21 nt, Homo sapiens
ccuggcaaaugccugacucag

SEQ ID NO: 1344226 - RNA, 20 nt, Homo sapiens
ccuggcacccccacaagcug

SEQ ID NO: 1344227 - RNA, 14 nt, Homo sapiens
ccuggccauuucca

SEQ ID NO: 1344228 - RNA, 14 nt, Homo sapiens
ccuggcuuugccuc

SEQ ID NO: 1344229 - RNA, 22 nt, Homo sapiens
ccugggauucuagaacugugaa

SEQ ID NO: 1344230 - RNA, 13 nt, Homo sapiens
ccugggcacaaac

SEQ ID NO: 1344231 - RNA, 21 nt, Homo sapiens
ccuggggagugguuaggcagc

SEQ ID NO: 1344232 - RNA, 21 nt, Homo sapiens
ccugggggacccaucuuccac

SEQ ID NO: 1344233 - RNA, 17 nt, Homo sapiens
ccugggggcuuuugcca

SEQ ID NO: 1344234 - RNA, 16 nt, Homo sapiens
ccuggggugaauacuu

SEQ ID NO: 1344235 - RNA, 17 nt, Homo sapiens
ccuggggugaauacuua

SEQ ID NO: 1344236 - RNA, 23 nt, Homo sapiens
ccuggucauacauaggaugacaa

SEQ ID NO: 1344237 - RNA, 20 nt, Homo sapiens
ccuggucgccaauccaugcu

SEQ ID NO: 1344238 - RNA, 20 nt, Homo sapiens
ccuggugcacgcaggcacag

SEQ ID NO: 1344239 - RNA, 17 nt, Homo sapiens
ccuguaaucucagcacu

SEQ ID NO: 1344240 - RNA, 20 nt, Homo sapiens
ccuguaccccagcacuugug

SEQ ID NO: 1344241 - RNA, 17 nt, Homo sapiens
ccuguagcagucacuga

SEQ ID NO: 1344242 - RNA, 20 nt, Homo sapiens
ccuguaucagaaucugaaaa

SEQ ID NO: 1344243 - RNA, 21 nt, Homo sapiens
ccugucccacccacacagcug

SEQ ID NO: 1344244 - RNA, 15 nt, Homo sapiens
ccugucccuugccuc

SEQ ID NO: 1344245 - RNA, 14 nt, Homo sapiens
ccugucuccagcug

SEQ ID NO: 1344246 - RNA, 21 nt, Homo sapiens
ccugucuuaauuuucuuucac

SEQ ID NO: 1344247 - RNA, 21 nt, Homo sapiens
ccugucuuggggccacuuuca

SEQ ID NO: 1344248 - RNA, 14 nt, Homo sapiens
ccugugaaauacca

SEQ ID NO: 1344249 - RNA, 18 nt, Homo sapiens
ccuguggucucugaccag

SEQ ID NO: 1344250 - RNA, 14 nt, Homo sapiens
ccuguguacugccu

SEQ ID NO: 1344251 - RNA, 18 nt, Homo sapiens
ccugugugggacugagau

SEQ ID NO: 1344252 - RNA, 21 nt, Homo sapiens
ccuguguguccaaaacugccu

SEQ ID NO: 1344253 - RNA, 14 nt, Homo sapiens
ccuguucacucuac

SEQ ID NO: 1344254 - RNA, 19 nt, Homo sapiens
ccuguuccuuuaaccccaa

SEQ ID NO: 1344255 - RNA, 22 nt, Homo sapiens
ccuguugucaagaauagcauug

SEQ ID NO: 1344256 - RNA, 21 nt, Homo sapiens
ccuguuuuauaaugaacccau

SEQ ID NO: 1344257 - RNA, 20 nt, Homo sapiens
ccuuaaacuugcaguaucuc

SEQ ID NO: 1344258 - RNA, 16 nt, Homo sapiens
ccuuaaugacaacacu

SEQ ID NO: 1344259 - RNA, 22 nt, Homo sapiens
ccuuagcuggcauuacagcugg

SEQ ID NO: 1344260 - RNA, 18 nt, Homo sapiens
ccuuaucugaaaggccag

SEQ ID NO: 1344261 - RNA, 23 nt, Homo sapiens
ccuuauuuugugugcuuucccag

SEQ ID NO: 1344262 - RNA, 20 nt, Homo sapiens
ccuucaaaauaaaaaguaau

SEQ ID NO: 1344263 - RNA, 20 nt, Homo sapiens
ccuucacaaagcccaaggga

SEQ ID NO: 1344264 - RNA, 14 nt, Homo sapiens
ccuucagauuugcc

SEQ ID NO: 1344265 - RNA, 16 nt, Homo sapiens
ccuucaguccaccaca

SEQ ID NO: 1344266 - RNA, 18 nt, Homo sapiens
ccuucccucucaugacuu

SEQ ID NO: 1344267 - RNA, 22 nt, Homo sapiens
ccuucgcuuaagccagcacuca

SEQ ID NO: 1344268 - RNA, 12 nt, Homo sapiens
ccuucuaccucu

SEQ ID NO: 1344269 - RNA, 19 nt, Homo sapiens
ccuucugacuuugccaaaa

SEQ ID NO: 1344270 - RNA, 19 nt, Homo sapiens
ccuugauuacuuccacuga

SEQ ID NO: 1344271 - RNA, 14 nt, Homo sapiens
ccuugcagaaggca

SEQ ID NO: 1344272 - RNA, 15 nt, Homo sapiens
ccuugccacauuaaa

SEQ ID NO: 1344273 - RNA, 11 nt, Homo sapiens
ccuugcucccc

SEQ ID NO: 1344274 - RNA, 15 nt, Homo sapiens
ccuuggugugcugua

SEQ ID NO: 1344275 - RNA, 21 nt, Homo sapiens
ccuuguaccucaaucuauucu

SEQ ID NO: 1344276 - RNA, 13 nt, Homo sapiens
ccuugugaaggaa

SEQ ID NO: 1344277 - RNA, 15 nt, Homo sapiens
ccuuuaagaaccuua

SEQ ID NO: 1344278 - RNA, 14 nt, Homo sapiens
ccuuuaucucugag

SEQ ID NO: 1344279 - RNA, 17 nt, Homo sapiens
ccuuucgagcucugcag

SEQ ID NO: 1344280 - RNA, 14 nt, Homo sapiens
ccuuucuaguucaa

SEQ ID NO: 1344281 - RNA, 21 nt, Homo sapiens
ccuuugggugcuguuuugcca

SEQ ID NO: 1344282 - RNA, 14 nt, Homo sapiens
ccuuuguacuuugu

SEQ ID NO: 1344283 - RNA, 20 nt, Homo sapiens
ccuuuuacaauuguugaaau

SEQ ID NO: 1344284 - RNA, 14 nt, Homo sapiens
ccuuuuauaccugc

SEQ ID NO: 1344285 - RNA, 17 nt, Homo sapiens
ccuuuuccuauccuuau

SEQ ID NO: 1344286 - RNA, 16 nt, Homo sapiens
ccuuuugccaaucuca

SEQ ID NO: 1344287 - RNA, 22 nt, Homo sapiens
ccuuuuucuucacuuacaagaa

SEQ ID NO: 1344288 - RNA, 20 nt, Homo sapiens
ccuuuuugucaccucaauau

SEQ ID NO: 1344289 - RNA, 18 nt, Homo sapiens
ccuuuuuuuacauuucau

SEQ ID NO: 1344290 - RNA, 16 nt, Homo sapiens
cgaauagccacugcau

SEQ ID NO: 1344291 - RNA, 13 nt, Homo sapiens
cgagcagucagca

SEQ ID NO: 1344292 - RNA, 19 nt, Homo sapiens
cgagugaaacuccgucuca

SEQ ID NO: 1344293 - RNA, 15 nt, Homo sapiens
cgagugcacugcauu

SEQ ID NO: 1344294 - RNA, 16 nt, Homo sapiens
cgaguggucacuguca

SEQ ID NO: 1344295 - RNA, 15 nt, Homo sapiens
cgauuccucagggcc

SEQ ID NO: 1344296 - RNA, 16 nt, Homo sapiens
cgauugaaagaaccag

SEQ ID NO: 1344297 - RNA, 16 nt, Homo sapiens
cgcaaauuuucuucca

SEQ ID NO: 1344298 - RNA, 18 nt, Homo sapiens
cgcacagagggaagccau

SEQ ID NO: 1344299 - RNA, 23 nt, Homo sapiens
cgcacauguauugcuguuuuucu

SEQ ID NO: 1344300 - RNA, 17 nt, Homo sapiens
cgcagugugcacuaagg

SEQ ID NO: 1344301 - RNA, 16 nt, Homo sapiens
cgccaaaacaagccaa

SEQ ID NO: 1344302 - RNA, 18 nt, Homo sapiens
cgccaccucacugcagua

SEQ ID NO: 1344303 - RNA, 16 nt, Homo sapiens
cgccacggccuggcug

SEQ ID NO: 1344304 - RNA, 13 nt, Homo sapiens
cgccagcugggag

SEQ ID NO: 1344305 - RNA, 23 nt, Homo sapiens
cgcccagugcagucggugguacc

SEQ ID NO: 1344306 - RNA, 21 nt, Homo sapiens
cgccugugggcgcauacuaca

SEQ ID NO: 1344307 - RNA, 19 nt, Homo sapiens
cgcgcucgcccagcaggag

SEQ ID NO: 1344308 - RNA, 19 nt, Homo sapiens
cgcuaaagggaccaucugc

SEQ ID NO: 1344309 - RNA, 16 nt, Homo sapiens
cgcuagcaguacuaau

SEQ ID NO: 1344310 - RNA, 16 nt, Homo sapiens
cgcuggcuggugggcc

SEQ ID NO: 1344311 - RNA, 21 nt, Homo sapiens
gaaaagaaagugaaaguuuua

SEQ ID NO: 1344312 - RNA, 22 nt, Homo sapiens
gaaaagauacccaaaggucaag

SEQ ID NO: 1344313 - RNA, 15 nt, Homo sapiens
gaaaagcugccauuu

SEQ ID NO: 1344314 - RNA, 18 nt, Homo sapiens
gaaaagcugccauuuccc

SEQ ID NO: 1344315 - RNA, 17 nt, Homo sapiens
gaaaaggccuucuuccc

SEQ ID NO: 1344316 - RNA, 18 nt, Homo sapiens
gaaaaggggacaguuuuu

SEQ ID NO: 1344317 - RNA, 19 nt, Homo sapiens
gaaaagucaaaguguugcu

SEQ ID NO: 1344318 - RNA, 16 nt, Homo sapiens
gaaaauaaaauuuaac

SEQ ID NO: 1344319 - RNA, 12 nt, Homo sapiens
gaaaauccagaa

SEQ ID NO: 1344320 - RNA, 22 nt, Homo sapiens
gaaaauccucgcacacacuggc

SEQ ID NO: 1344321 - RNA, 13 nt, Homo sapiens
gaaaauucagguc

SEQ ID NO: 1344322 - RNA, 22 nt, Homo sapiens
gaaacauccuaugaaauacuuu

SEQ ID NO: 1344323 - RNA, 18 nt, Homo sapiens
gaaaccacacagacuugg

SEQ ID NO: 1344324 - RNA, 18 nt, Homo sapiens
gaaaccacagucuuccca

SEQ ID NO: 1344325 - RNA, 20 nt, Homo sapiens
gaaaccccccagagcucuuu

SEQ ID NO: 1344326 - RNA, 22 nt, Homo sapiens
gaaacuacauuucuacuaugau

SEQ ID NO: 1344327 - RNA, 17 nt, Homo sapiens
gaaacugcgaggccagu

SEQ ID NO: 1344328 - RNA, 16 nt, Homo sapiens
gaaacuguucccaccu

SEQ ID NO: 1344329 - RNA, 21 nt, Homo sapiens
gaaagaaaacuuuuaugcaag

SEQ ID NO: 1344330 - RNA, 17 nt, Homo sapiens
gaaagaaggacccagaa

SEQ ID NO: 1344331 - RNA, 16 nt, Homo sapiens
gaaagaauaaacuuac

SEQ ID NO: 1344332 - RNA, 15 nt, Homo sapiens
gaaagaggcagggac

SEQ ID NO: 1344333 - RNA, 11 nt, Homo sapiens
gaaagcacaag

SEQ ID NO: 1344334 - RNA, 16 nt, Homo sapiens
gaaagcauaucccacc

SEQ ID NO: 1344335 - RNA, 17 nt, Homo sapiens
gaaagcgacuucagguc

SEQ ID NO: 1344336 - RNA, 14 nt, Homo sapiens
gaaagcuuucauga

SEQ ID NO: 1344337 - RNA, 14 nt, Homo sapiens
gaaaggagcaauga

SEQ ID NO: 1344338 - RNA, 11 nt, Homo sapiens
gaaaggccagc

SEQ ID NO: 1344339 - RNA, 13 nt, Homo sapiens
gaaaggggcccca

SEQ ID NO: 1344340 - RNA, 20 nt, Homo sapiens
gaaaggguuugauauggaga

SEQ ID NO: 1344341 - RNA, 17 nt, Homo sapiens
gaaaguaagcauuucca

SEQ ID NO: 1344342 - RNA, 13 nt, Homo sapiens
gaaauacuuugua

SEQ ID NO: 1344343 - RNA, 21 nt, Homo sapiens
gaaauauauuaugauugcaua

SEQ ID NO: 1344344 - RNA, 17 nt, Homo sapiens
gaaauccauuccauuuu

SEQ ID NO: 1344345 - RNA, 17 nt, Homo sapiens
gaaaugcauauuugcaa

SEQ ID NO: 1344346 - RNA, 16 nt, Homo sapiens
gaaauuauuucucuca

SEQ ID NO: 1344347 - RNA, 19 nt, Homo sapiens
gaaauugcauuuccugaca

SEQ ID NO: 1344348 - RNA, 19 nt, Homo sapiens
gaaauuuaaauaagauuua

SEQ ID NO: 1344349 - RNA, 22 nt, Homo sapiens
gaacacagugcuauuugcauuu

SEQ ID NO: 1344350 - RNA, 11 nt, Homo sapiens
gaacacugaga

SEQ ID NO: 1344351 - RNA, 21 nt, Homo sapiens
gaacagcauuacccuccucuc

SEQ ID NO: 1344352 - RNA, 16 nt, Homo sapiens
gaacagcuaauuguac

SEQ ID NO: 1344353 - RNA, 15 nt, Homo sapiens
gaacagggcaguuua

SEQ ID NO: 1344354 - RNA, 20 nt, Homo sapiens
gaacauaaaaaggacaucag

SEQ ID NO: 1344355 - RNA, 21 nt, Homo sapiens
gaacaugauuuuacaaguaua

SEQ ID NO: 1344356 - RNA, 18 nt, Homo sapiens
gaacauugguucuuucau

SEQ ID NO: 1344357 - RNA, 15 nt, Homo sapiens
gaaccaaccagggaa

SEQ ID NO: 1344358 - RNA, 21 nt, Homo sapiens
gaaccacaccacaucuaagcc

SEQ ID NO: 1344359 - RNA, 15 nt, Homo sapiens
gaaccacauucaggg

SEQ ID NO: 1344360 - RNA, 22 nt, Homo sapiens
gaaccacauucagggaaauggc

SEQ ID NO: 1344361 - RNA, 12 nt, Homo sapiens
gaaccacuccca

SEQ ID NO: 1344362 - RNA, 14 nt, Homo sapiens
gaaccagaguuucu

SEQ ID NO: 1344363 - RNA, 21 nt, Homo sapiens
gaaccagcuucugauaaacac

SEQ ID NO: 1344364 - RNA, 17 nt, Homo sapiens
gaaccagggcucuucuc

SEQ ID NO: 1344365 - RNA, 21 nt, Homo sapiens
gaaccugcccugcucccacag

SEQ ID NO: 1344366 - RNA, 14 nt, Homo sapiens
gaaccuuaaugaca

SEQ ID NO: 1344367 - RNA, 15 nt, Homo sapiens
gaacuagagaaggac

SEQ ID NO: 1344368 - RNA, 12 nt, Homo sapiens
gaacuaggcucu

SEQ ID NO: 1344369 - RNA, 13 nt, Homo sapiens
gaacucagaucca

SEQ ID NO: 1344370 - RNA, 20 nt, Homo sapiens
gaacuccaccgaccaacugc

SEQ ID NO: 1344371 - RNA, 21 nt, Homo sapiens
gaacuccugaccucaagugau

SEQ ID NO: 1344372 - RNA, 21 nt, Homo sapiens
gaacucuucaaucucuugcac

SEQ ID NO: 1344373 - RNA, 22 nt, Homo sapiens
gaacugaaagaccagagggaca

SEQ ID NO: 1344374 - RNA, 18 nt, Homo sapiens
gaacuucuccuacuguag

SEQ ID NO: 1344375 - RNA, 22 nt, Homo sapiens
gaacuucuccuacuguagcaac

SEQ ID NO: 1344376 - RNA, 18 nt, Homo sapiens
gaagaaaagcugccauuu

SEQ ID NO: 1344377 - RNA, 20 nt, Homo sapiens
gaagaaaagcugccauuucc

SEQ ID NO: 1344378 - RNA, 15 nt, Homo sapiens
gaagaauaaauucua

SEQ ID NO: 1344379 - RNA, 19 nt, Homo sapiens
gaagaccccuuccucuuca

SEQ ID NO: 1344380 - RNA, 19 nt, Homo sapiens
gaagacuuuaaaccaccua

SEQ ID NO: 1344381 - RNA, 13 nt, Homo sapiens
gaagagaagggca

SEQ ID NO: 1344382 - RNA, 16 nt, Homo sapiens
gaagaggccuucccau

SEQ ID NO: 1344383 - RNA, 13 nt, Homo sapiens
gaagagggucccu

SEQ ID NO: 1344384 - RNA, 16 nt, Homo sapiens
gaagaguuauaaagua

SEQ ID NO: 1344385 - RNA, 13 nt, Homo sapiens
gaagaugccuuga

SEQ ID NO: 1344386 - RNA, 16 nt, Homo sapiens
gaagcagcagaccucc

SEQ ID NO: 1344387 - RNA, 22 nt, Homo sapiens
gaagcagucaauuuucacauca

SEQ ID NO: 1344388 - RNA, 20 nt, Homo sapiens
gaagcaucgcuccucuccag

SEQ ID NO: 1344389 - RNA, 17 nt, Homo sapiens
gaagccagccacagacc

SEQ ID NO: 1344390 - RNA, 14 nt, Homo sapiens
gaagccccgucucu

SEQ ID NO: 1344391 - RNA, 14 nt, Homo sapiens
gaagcuuccaugau

SEQ ID NO: 1344392 - RNA, 17 nt, Homo sapiens
gaaggaagcuguguuga

SEQ ID NO: 1344393 - RNA, 12 nt, Homo sapiens
gaaggcaaauga

SEQ ID NO: 1344394 - RNA, 23 nt, Homo sapiens
gaaggccuggaagagcugagacc

SEQ ID NO: 1344395 - RNA, 14 nt, Homo sapiens
gaaggcuaugggga

SEQ ID NO: 1344396 - RNA, 19 nt, Homo sapiens
gaagggguuuucuugauaa

SEQ ID NO: 1344397 - RNA, 19 nt, Homo sapiens
gaaggguggucaguaguuu

SEQ ID NO: 1344398 - RNA, 17 nt, Homo sapiens
gaagguggcuacaaaga

SEQ ID NO: 1344399 - RNA, 13 nt, Homo sapiens
gaaguacuucccu

SEQ ID NO: 1344400 - RNA, 20 nt, Homo sapiens
gaagucuucuccuccaugaa

SEQ ID NO: 1344401 - RNA, 11 nt, Homo sapiens
gaagugaaaac

SEQ ID NO: 1344402 - RNA, 22 nt, Homo sapiens
gaagugugucacccuuaggcca

SEQ ID NO: 1344403 - RNA, 13 nt, Homo sapiens
gaaguguucacau

SEQ ID NO: 1344404 - RNA, 15 nt, Homo sapiens
gaaguuaagaaccug

SEQ ID NO: 1344405 - RNA, 21 nt, Homo sapiens
gaaguuguugcuauacauguu

SEQ ID NO: 1344406 - RNA, 18 nt, Homo sapiens
gaaguuugcuuuguacug

SEQ ID NO: 1344407 - RNA, 17 nt, Homo sapiens
gaauaaaaacuuuugag

SEQ ID NO: 1344408 - RNA, 14 nt, Homo sapiens
gaauaaaauacucu

SEQ ID NO: 1344409 - RNA, 13 nt, Homo sapiens
gaauaaagccuuu

SEQ ID NO: 1344410 - RNA, 17 nt, Homo sapiens
gaauaaaggcaguuuuc

SEQ ID NO: 1344411 - RNA, 14 nt, Homo sapiens
gaauaaauucccaa

SEQ ID NO: 1344412 - RNA, 17 nt, Homo sapiens
gaauaaauugcuccuug

SEQ ID NO: 1344413 - RNA, 19 nt, Homo sapiens
gaauaauaagcuacuugcc

SEQ ID NO: 1344414 - RNA, 14 nt, Homo sapiens
gaauaccaccuaau

SEQ ID NO: 1344415 - RNA, 13 nt, Homo sapiens
gaauagacacuuc

SEQ ID NO: 1344416 - RNA, 21 nt, Homo sapiens
gaauagacacuucaccaaaga

SEQ ID NO: 1344417 - RNA, 17 nt, Homo sapiens
gaauauacuaaacauca

SEQ ID NO: 1344418 - RNA, 22 nt, Homo sapiens
gaauauacuaaacaucauugau

SEQ ID NO: 1344419 - RNA, 15 nt, Homo sapiens
gaauauuauacuucu

SEQ ID NO: 1344420 - RNA, 13 nt, Homo sapiens
gaaucacuugaac

SEQ ID NO: 1344421 - RNA, 20 nt, Homo sapiens
gaauccagaaggaagcucgc

SEQ ID NO: 1344422 - RNA, 18 nt, Homo sapiens
gagcuguaaaaauguuac

SEQ ID NO: 1344423 - RNA, 15 nt, Homo sapiens
gagcuucucccagug

SEQ ID NO: 1344424 - RNA, 22 nt, Homo sapiens
gaggaaaaggccccugcaaugu

SEQ ID NO: 1344425 - RNA, 14 nt, Homo sapiens
gaggaaaccuagca

SEQ ID NO: 1344426 - RNA, 22 nt, Homo sapiens
gaggacugguucugaggccaga

SEQ ID NO: 1344427 - RNA, 16 nt, Homo sapiens
gaggagccugcaacau

SEQ ID NO: 1344428 - RNA, 14 nt, Homo sapiens
gaggaggggaccaa

SEQ ID NO: 1344429 - RNA, 18 nt, Homo sapiens
gaggcagagguugcagug

SEQ ID NO: 1344430 - RNA, 12 nt, Homo sapiens
gaggccaucuca

SEQ ID NO: 1344431 - RNA, 16 nt, Homo sapiens
gaggcuaccucaccug

SEQ ID NO: 1344432 - RNA, 19 nt, Homo sapiens
gaggcuccucucaggcugg

SEQ ID NO: 1344433 - RNA, 18 nt, Homo sapiens
gaggcuccugcuuauuua

SEQ ID NO: 1344434 - RNA, 17 nt, Homo sapiens
gaggcugaggcacuggc

SEQ ID NO: 1344435 - RNA, 22 nt, Homo sapiens
gaggcugaggcagaaggauuac

SEQ ID NO: 1344436 - RNA, 16 nt, Homo sapiens
gcaagucccuuuguga

SEQ ID NO: 1344437 - RNA, 19 nt, Homo sapiens
gcaaguccggcggaauuca

SEQ ID NO: 1344438 - RNA, 16 nt, Homo sapiens
gcaaugcaugauacua

SEQ ID NO: 1344439 - RNA, 17 nt, Homo sapiens
gcaauuuuguaaauuga

SEQ ID NO: 1344440 - RNA, 14 nt, Homo sapiens
gcacaaaacuacuu

SEQ ID NO: 1344441 - RNA, 15 nt, Homo sapiens
gcacacuggccucca

SEQ ID NO: 1344442 - RNA, 11 nt, Homo sapiens
gcacacuuugc

SEQ ID NO: 1344443 - RNA, 17 nt, Homo sapiens
gcacaguaucugcuguu

SEQ ID NO: 1344444 - RNA, 24 nt, Homo sapiens
gcacaugagucgcacauguauugc

SEQ ID NO: 1344445 - RNA, 23 nt, Homo sapiens
gcaccaaagacaucagucuccaa

SEQ ID NO: 1344446 - RNA, 16 nt, Homo sapiens
gcaccaucagccuguu

SEQ ID NO: 1344447 - RNA, 13 nt, Homo sapiens
gcaccaucucuga

SEQ ID NO: 1344448 - RNA, 12 nt, Homo sapiens
gcaccccagugg

SEQ ID NO: 1344449 - RNA, 20 nt, Homo sapiens
gcacccccugcuccaccagc

SEQ ID NO: 1344450 - RNA, 20 nt, Homo sapiens
gcacucacgcccuaagcgca

SEQ ID NO: 1344451 - RNA, 13 nt, Homo sapiens
gcacucagauuua

SEQ ID NO: 1344452 - RNA, 17 nt, Homo sapiens
gcacucagggagcauuu

SEQ ID NO: 1344453 - RNA, 14 nt, Homo sapiens
gcacugaaccacau

SEQ ID NO: 1344454 - RNA, 20 nt, Homo sapiens
gcacugagcagggaucugcc

SEQ ID NO: 1344455 - RNA, 20 nt, Homo sapiens
gcacugaugcugccccucau

SEQ ID NO: 1344456 - RNA, 17 nt, Homo sapiens
gcacuggccacccaagg

SEQ ID NO: 1344457 - RNA, 20 nt, Homo sapiens
gcagaaauuaaaucuuaaua

SEQ ID NO: 1344458 - RNA, 17 nt, Homo sapiens
gcagaaggcaaggcccu

SEQ ID NO: 1344459 - RNA, 18 nt, Homo sapiens
gcagaccccucuaccucc

SEQ ID NO: 1344460 - RNA, 18 nt, Homo sapiens
gcagaugcuguugugaag

SEQ ID NO: 1344461 - RNA, 11 nt, Homo sapiens
gcagcacuccc

SEQ ID NO: 1344462 - RNA, 21 nt, Homo sapiens
gcagcaggcagcuucuacucc

SEQ ID NO: 1344463 - RNA, 16 nt, Homo sapiens
gcagcaggccagagaa

SEQ ID NO: 1344464 - RNA, 21 nt, Homo sapiens
gcagccuacaacugaauagca

SEQ ID NO: 1344465 - RNA, 16 nt, Homo sapiens
gcagccuagauaugaa

SEQ ID NO: 1344466 - RNA, 13 nt, Homo sapiens
gcagccucaaaac

SEQ ID NO: 1344467 - RNA, 19 nt, Homo sapiens
gcagccucaaaacggguca

SEQ ID NO: 1344468 - RNA, 15 nt, Homo sapiens
gcagcgccagugaca

SEQ ID NO: 1344469 - RNA, 14 nt, Homo sapiens
gcagcuccacaggg

SEQ ID NO: 1344470 - RNA, 14 nt, Homo sapiens
gcagcuccugaccu

SEQ ID NO: 1344471 - RNA, 23 nt, Homo sapiens
gcagcucuccccucagagugcaa

SEQ ID NO: 1344472 - RNA, 13 nt, Homo sapiens
gcagcugcagggg

SEQ ID NO: 1344473 - RNA, 15 nt, Homo sapiens
gcaggaaaaguugau

SEQ ID NO: 1344474 - RNA, 13 nt, Homo sapiens
gcaggaaagccac

SEQ ID NO: 1344475 - RNA, 24 nt, Homo sapiens
gcaggauuucuucacaccucuccu

SEQ ID NO: 1344476 - RNA, 16 nt, Homo sapiens
gcaggcccacucccca

SEQ ID NO: 1344477 - RNA, 23 nt, Homo sapiens
gcaggccuccaacgccccugugg

SEQ ID NO: 1344478 - RNA, 22 nt, Homo sapiens
gcaggcuguggggcagcugagc

SEQ ID NO: 1344479 - RNA, 14 nt, Homo sapiens
gcagggauucuucc

SEQ ID NO: 1344480 - RNA, 15 nt, Homo sapiens
gcagguaaccccaga

SEQ ID NO: 1344481 - RNA, 19 nt, Homo sapiens
gcagguaaccccagauuca

SEQ ID NO: 1344482 - RNA, 18 nt, Homo sapiens
gcaggugcucaugcugcu

SEQ ID NO: 1344483 - RNA, 18 nt, Homo sapiens
gcaguagugcaccaucuc

SEQ ID NO: 1344484 - RNA, 21 nt, Homo sapiens
gcaguagugcaccaucucacu

SEQ ID NO: 1344485 - RNA, 21 nt, Homo sapiens
gcaguaucucccauaaacaaa

SEQ ID NO: 1344486 - RNA, 14 nt, Homo sapiens
gcagugacucccca

SEQ ID NO: 1344487 - RNA, 18 nt, Homo sapiens
gcaguggcuucuuuccag

SEQ ID NO: 1344488 - RNA, 17 nt, Homo sapiens
gcaguggucccaauagg

SEQ ID NO: 1344489 - RNA, 16 nt, Homo sapiens
gcaguuuacaguauuu

SEQ ID NO: 1344490 - RNA, 17 nt, Homo sapiens
gcauaagcuaucaccua

SEQ ID NO: 1344491 - RNA, 11 nt, Homo sapiens
gcauacuacag

SEQ ID NO: 1344492 - RNA, 22 nt, Homo sapiens
gcauaugucacuagaauggaua

SEQ ID NO: 1344493 - RNA, 20 nt, Homo sapiens
gcaucaagggagacaccagu

SEQ ID NO: 1344494 - RNA, 17 nt, Homo sapiens
gcaucaauacaaccagc

SEQ ID NO: 1344495 - RNA, 18 nt, Homo sapiens
gcaucaauacaaccagcc

SEQ ID NO: 1344496 - RNA, 19 nt, Homo sapiens
gcaucaauacaaccagccc

SEQ ID NO: 1344497 - RNA, 23 nt, Homo sapiens
gcaucacggauggugcaugggcu

SEQ ID NO: 1344498 - RNA, 16 nt, Homo sapiens
gcaucucccagcaaga

SEQ ID NO: 1344499 - RNA, 15 nt, Homo sapiens
gcaucugcaguacag

SEQ ID NO: 1344500 - RNA, 19 nt, Homo sapiens
gcaugagcuggcaaccagc

SEQ ID NO: 1344501 - RNA, 23 nt, Homo sapiens
gcauggaaaaaugguugauggaa

SEQ ID NO: 1344502 - RNA, 14 nt, Homo sapiens
gcauggaguauuau

SEQ ID NO: 1344503 - RNA, 15 nt, Homo sapiens
gcauggguccagggc

SEQ ID NO: 1344504 - RNA, 15 nt, Homo sapiens
gcaugguaaugaagg

SEQ ID NO: 1344505 - RNA, 14 nt, Homo sapiens
gcaugguagcucau

SEQ ID NO: 1344506 - RNA, 13 nt, Homo sapiens
gcauguagacugu

SEQ ID NO: 1344507 - RNA, 19 nt, Homo sapiens
gcauucucuauagagccaa

SEQ ID NO: 1344508 - RNA, 16 nt, Homo sapiens
gcauuugcagugcauc

SEQ ID NO: 1344509 - RNA, 20 nt, Homo sapiens
gcauuuuaaguaaaagucua

SEQ ID NO: 1344510 - RNA, 14 nt, Homo sapiens
gccaaaacccagcu

SEQ ID NO: 1344511 - RNA, 18 nt, Homo sapiens
gccaaacuggugcaugac

SEQ ID NO: 1344512 - RNA, 22 nt, Homo sapiens
gccaaccagcccgacagugcca

SEQ ID NO: 1344513 - RNA, 22 nt, Homo sapiens
gccaacugcuuggacagcagcc

SEQ ID NO: 1344514 - RNA, 16 nt, Homo sapiens
gccaagggauggacau

SEQ ID NO: 1344515 - RNA, 14 nt, Homo sapiens
gccaauuagcaauu

SEQ ID NO: 1344516 - RNA, 16 nt, Homo sapiens
gccacagacaauaugg

SEQ ID NO: 1344517 - RNA, 15 nt, Homo sapiens
gccacagagaaguuu

SEQ ID NO: 1344518 - RNA, 22 nt, Homo sapiens
gccacagaggacucacuugccc

SEQ ID NO: 1344519 - RNA, 13 nt, Homo sapiens
gccaccaguucuc

SEQ ID NO: 1344520 - RNA, 16 nt, Homo sapiens
gccaccgcccagagac

SEQ ID NO: 1344521 - RNA, 17 nt, Homo sapiens
gccaccggugggcagug

SEQ ID NO: 1344522 - RNA, 21 nt, Homo sapiens
gccacuagcccuccucuccca

SEQ ID NO: 1344523 - RNA, 20 nt, Homo sapiens
gccacuccagaccccuggcu

SEQ ID NO: 1344524 - RNA, 22 nt, Homo sapiens
gccacugagaagugcacuuuaa

SEQ ID NO: 1344525 - RNA, 12 nt, Homo sapiens
gccacuucucac

SEQ ID NO: 1344526 - RNA, 15 nt, Homo sapiens
gccagacaugccaca

SEQ ID NO: 1344527 - RNA, 22 nt, Homo sapiens
gccagagaaagcaaaggugcac

SEQ ID NO: 1344528 - RNA, 24 nt, Homo sapiens
gccagcaccugcgggagcugcacu

SEQ ID NO: 1344529 - RNA, 20 nt, Homo sapiens
gccagcagggcaucuuggaa

SEQ ID NO: 1344530 - RNA, 19 nt, Homo sapiens
gccagcccauuugggcaga

SEQ ID NO: 1344531 - RNA, 23 nt, Homo sapiens
gccagccucagaaggccccagag

SEQ ID NO: 1344532 - RNA, 20 nt, Homo sapiens
gccagcugggagcacuggug

SEQ ID NO: 1344533 - RNA, 22 nt, Homo sapiens
gccaggaacuguguguguugca

SEQ ID NO: 1344534 - RNA, 19 nt, Homo sapiens
gccaggccuuacaucuggc

SEQ ID NO: 1344535 - RNA, 14 nt, Homo sapiens
gccagucagacgcc

SEQ ID NO: 1344536 - RNA, 23 nt, Homo sapiens
gccaguuuuccgaagucucugau

SEQ ID NO: 1344537 - RNA, 22 nt, Homo sapiens
gccaucugacugccaagccaga

SEQ ID NO: 1344538 - RNA, 14 nt, Homo sapiens
gccaugauguauau

SEQ ID NO: 1344539 - RNA, 15 nt, Homo sapiens
gccaugauguauauc

SEQ ID NO: 1344540 - RNA, 16 nt, Homo sapiens
gccaugccaguaacug

SEQ ID NO: 1344541 - RNA, 17 nt, Homo sapiens
gccauuuuccuuuacac

SEQ ID NO: 1344542 - RNA, 15 nt, Homo sapiens
gccauuuuugugcuu

SEQ ID NO: 1344543 - RNA, 14 nt, Homo sapiens
gcccaagaauagau

SEQ ID NO: 1344544 - RNA, 20 nt, Homo sapiens
gcccaaguaccacgcagugc

SEQ ID NO: 1344545 - RNA, 12 nt, Homo sapiens
gcccacuggccg

SEQ ID NO: 1344546 - RNA, 23 nt, Homo sapiens
gcccagagagggaagaugaccug

SEQ ID NO: 1344547 - RNA, 15 nt, Homo sapiens
gcccagagcccagcu

SEQ ID NO: 1344548 - RNA, 17 nt, Homo sapiens
gcccagagcccagcucc

SEQ ID NO: 1344549 - RNA, 16 nt, Homo sapiens
gcccagaggguggcaa

SEQ ID NO: 1344550 - RNA, 17 nt, Homo sapiens
gcccagccuacauucac

SEQ ID NO: 1344551 - RNA, 19 nt, Homo sapiens
gcccaggcuagagugcaau

SEQ ID NO: 1344552 - RNA, 18 nt, Homo sapiens
gcccaggcuggagugcaa

SEQ ID NO: 1344553 - RNA, 21 nt, Homo sapiens
gcccaggcuggagugcaaugg

SEQ ID NO: 1344554 - RNA, 19 nt, Homo sapiens
gcccaggcuggagugcagu

SEQ ID NO: 1344555 - RNA, 22 nt, Homo sapiens
gcccagguucgagacccaaacc

SEQ ID NO: 1344556 - RNA, 12 nt, Homo sapiens
gcccagugcaaa

SEQ ID NO: 1344557 - RNA, 13 nt, Homo sapiens
gcccagugcaaac

SEQ ID NO: 1344558 - RNA, 20 nt, Homo sapiens
gcccauaauucauagugaua

SEQ ID NO: 1344559 - RNA, 19 nt, Homo sapiens
gcccaugaugagaagcaga

SEQ ID NO: 1344560 - RNA, 16 nt, Homo sapiens
gccccaacuccagggg

SEQ ID NO: 1344561 - RNA, 19 nt, Homo sapiens
gcucucugacugcuuugga

SEQ ID NO: 1344562 - RNA, 20 nt, Homo sapiens
gcucugagaaaccucgggaa

SEQ ID NO: 1344563 - RNA, 18 nt, Homo sapiens
gcucugcgucgguccugg

SEQ ID NO: 1344564 - RNA, 10 nt, Homo sapiens
gcucugggaa

SEQ ID NO: 1344565 - RNA, 13 nt, Homo sapiens
gcucugggccuga

SEQ ID NO: 1344566 - RNA, 17 nt, Homo sapiens
gcugaaauucaccaaga

SEQ ID NO: 1344567 - RNA, 20 nt, Homo sapiens
gcugaauuucccucucucau

SEQ ID NO: 1344568 - RNA, 19 nt, Homo sapiens
gcugauacugggucugcga

SEQ ID NO: 1344569 - RNA, 13 nt, Homo sapiens
gcugauauuuaaa

SEQ ID NO: 1344570 - RNA, 22 nt, Homo sapiens
gcugaugccuguguacugccuu

SEQ ID NO: 1344571 - RNA, 22 nt, Homo sapiens
gcugcaaagcaaaacagacugu

SEQ ID NO: 1344572 - RNA, 16 nt, Homo sapiens
gcugcaagguacucug

SEQ ID NO: 1344573 - RNA, 17 nt, Homo sapiens
gcugcacugaugcugcc

SEQ ID NO: 1344574 - RNA, 14 nt, Homo sapiens
gcugccuggcacag

SEQ ID NO: 1344575 - RNA, 17 nt, Homo sapiens
gcugccuggcacagacc

SEQ ID NO: 1344576 - RNA, 19 nt, Homo sapiens
gcugcuccccuaaagccag

SEQ ID NO: 1344577 - RNA, 19 nt, Homo sapiens
gcugcuuccugucugagua

SEQ ID NO: 1344578 - RNA, 19 nt, Homo sapiens
gcuggaauucuaacaaguc

SEQ ID NO: 1344579 - RNA, 15 nt, Homo sapiens
gcuggacgugcgcga

SEQ ID NO: 1344580 - RNA, 20 nt, Homo sapiens
gcuggagcauaguggcaaga

SEQ ID NO: 1344581 - RNA, 15 nt, Homo sapiens
gcuggagugcaaugg

SEQ ID NO: 1344582 - RNA, 20 nt, Homo sapiens
gcuggccggggcucugggug

SEQ ID NO: 1344583 - RNA, 18 nt, Homo sapiens
gcuggccuccuaugccuc

SEQ ID NO: 1344584 - RNA, 21 nt, Homo sapiens
gcuggccuccuaugccucauc

SEQ ID NO: 1344585 - RNA, 15 nt, Homo sapiens
gcuggcugggccuuc

SEQ ID NO: 1344586 - RNA, 19 nt, Homo sapiens
gcugggaauaagugccagg

SEQ ID NO: 1344587 - RNA, 13 nt, Homo sapiens
gcugggauuacag

SEQ ID NO: 1344588 - RNA, 19 nt, Homo sapiens
gcuguagacauuugcuaug

SEQ ID NO: 1344589 - RNA, 17 nt, Homo sapiens
gcuguauccauccaugg

SEQ ID NO: 1344590 - RNA, 13 nt, Homo sapiens
gcuguaugugagc

SEQ ID NO: 1344591 - RNA, 21 nt, Homo sapiens
gcugucacagguuuucagaga

SEQ ID NO: 1344592 - RNA, 16 nt, Homo sapiens
gcugucaguucccaau

SEQ ID NO: 1344593 - RNA, 19 nt, Homo sapiens
gcugucguuguuguggaag

SEQ ID NO: 1344594 - RNA, 19 nt, Homo sapiens
gcugucuuuucuuugccau

SEQ ID NO: 1344595 - RNA, 18 nt, Homo sapiens
gcuguggcagaguuacag

SEQ ID NO: 1344596 - RNA, 22 nt, Homo sapiens
gcuguggcccugccuggcuagu

SEQ ID NO: 1344597 - RNA, 17 nt, Homo sapiens
gcuguggggaacacagc

SEQ ID NO: 1344598 - RNA, 18 nt, Homo sapiens
gcuguuaacuguuaacua

SEQ ID NO: 1344599 - RNA, 23 nt, Homo sapiens
gcuguucacagccagacuggcac

SEQ ID NO: 1344600 - RNA, 21 nt, Homo sapiens
gcuguuccauuacaccacagc

SEQ ID NO: 1344601 - RNA, 15 nt, Homo sapiens
gcuguugagggccaa

SEQ ID NO: 1344602 - RNA, 22 nt, Homo sapiens
gcuguugcgcucccaccucagc

SEQ ID NO: 1344603 - RNA, 16 nt, Homo sapiens
gcuuaaaaucugugaa

SEQ ID NO: 1344604 - RNA, 17 nt, Homo sapiens
gcuuaaaaucugugaag

SEQ ID NO: 1344605 - RNA, 23 nt, Homo sapiens
gcuuaguuuuuucaguugcagua

SEQ ID NO: 1344606 - RNA, 21 nt, Homo sapiens
gcuuauacacuuacacuuuau

SEQ ID NO: 1344607 - RNA, 13 nt, Homo sapiens
gcuucacauucau

SEQ ID NO: 1344608 - RNA, 22 nt, Homo sapiens
gcuucagccaggucugacucca

SEQ ID NO: 1344609 - RNA, 15 nt, Homo sapiens
gcuucaguucagcuu

SEQ ID NO: 1344610 - RNA, 23 nt, Homo sapiens
gcuucuaaauggugcugcagauu

SEQ ID NO: 1344611 - RNA, 16 nt, Homo sapiens
gcuucuccaaagggag

SEQ ID NO: 1344612 - RNA, 20 nt, Homo sapiens
gcuucuccuucuccuuccca

SEQ ID NO: 1344613 - RNA, 22 nt, Homo sapiens
gcuucuccuucuccuucccauu

SEQ ID NO: 1344614 - RNA, 21 nt, Homo sapiens
gcuucugaagcugcugcagcu

SEQ ID NO: 1344615 - RNA, 14 nt, Homo sapiens
gcuugaaccuggga

SEQ ID NO: 1344616 - RNA, 16 nt, Homo sapiens
gcuugcaagauuccaa

SEQ ID NO: 1344617 - RNA, 13 nt, Homo sapiens
gcuugcuggguac

SEQ ID NO: 1344618 - RNA, 15 nt, Homo sapiens
gcuugguacuguaau

SEQ ID NO: 1344619 - RNA, 23 nt, Homo sapiens
gcuuuaaugagugcaccugccuc

SEQ ID NO: 1344620 - RNA, 11 nt, Homo sapiens
gcuuuaugcaa

SEQ ID NO: 1344621 - RNA, 16 nt, Homo sapiens
gcuuuaugcaaauaca

SEQ ID NO: 1344622 - RNA, 20 nt, Homo sapiens
gcuuuaugcaaauacaauca

SEQ ID NO: 1344623 - RNA, 17 nt, Homo sapiens
gcuuucauaaaucaugu

SEQ ID NO: 1344624 - RNA, 13 nt, Homo sapiens
gcuuuccaaaacc

SEQ ID NO: 1344625 - RNA, 12 nt, Homo sapiens
gcuuucucugag

SEQ ID NO: 1344626 - RNA, 21 nt, Homo sapiens
gcuuugcaauauuuauuacac

SEQ ID NO: 1344627 - RNA, 16 nt, Homo sapiens
gcuuuggcaaugccca

SEQ ID NO: 1344628 - RNA, 23 nt, Homo sapiens
gcuuuguauucaaaaauuaucua

SEQ ID NO: 1344629 - RNA, 16 nt, Homo sapiens
gcuuuguugugagaau

SEQ ID NO: 1344630 - RNA, 19 nt, Homo sapiens
gcuuuuacugaagccuuuc

SEQ ID NO: 1344631 - RNA, 23 nt, Homo sapiens
gcuuuugaaauccagaaguuuua

SEQ ID NO: 1344632 - RNA, 14 nt, Homo sapiens
gcuuuugugcccaa

SEQ ID NO: 1344633 - RNA, 14 nt, Homo sapiens
gcuuuuugucaugu

SEQ ID NO: 1344634 - RNA, 17 nt, Homo sapiens
ggaaaagaaaccugggg

SEQ ID NO: 1344635 - RNA, 20 nt, Homo sapiens
ggaaaaguugaugguauuca

SEQ ID NO: 1344636 - RNA, 16 nt, Homo sapiens
ggaaaauauccauccu

SEQ ID NO: 1344637 - RNA, 19 nt, Homo sapiens
ggaaaaugaccucaaggaa

SEQ ID NO: 1344638 - RNA, 20 nt, Homo sapiens
ggaaacacugauuuuguaaa

SEQ ID NO: 1344639 - RNA, 16 nt, Homo sapiens
ggaaacccagcucaca

SEQ ID NO: 1344640 - RNA, 21 nt, Homo sapiens
ggaaagcacaagacuggccca

SEQ ID NO: 1344641 - RNA, 16 nt, Homo sapiens
ggaaaggagcaaugaa

SEQ ID NO: 1344642 - RNA, 21 nt, Homo sapiens
ggaaaggauuuuaccaaagca

SEQ ID NO: 1344643 - RNA, 12 nt, Homo sapiens
ggaaagucacag

SEQ ID NO: 1344644 - RNA, 18 nt, Homo sapiens
ggaaauccauuccauuuu

SEQ ID NO: 1344645 - RNA, 18 nt, Homo sapiens
ggaaauguaaaagcacau

SEQ ID NO: 1344646 - RNA, 21 nt, Homo sapiens
ggaacacaucuggcugcacag

SEQ ID NO: 1344647 - RNA, 12 nt, Homo sapiens
ggaacacugaga

SEQ ID NO: 1344648 - RNA, 18 nt, Homo sapiens
ggaacccaagauguggcc

SEQ ID NO: 1344649 - RNA, 16 nt, Homo sapiens
ggaacccagacucaga

SEQ ID NO: 1344650 - RNA, 22 nt, Homo sapiens
ggaacuccagagaugagugucu

SEQ ID NO: 1344651 - RNA, 19 nt, Homo sapiens
ggaagaaaagcugccauuu

SEQ ID NO: 1344652 - RNA, 18 nt, Homo sapiens
ggaagaaauggcuaugaa

SEQ ID NO: 1344653 - RNA, 16 nt, Homo sapiens
ggaagauggagacacc

SEQ ID NO: 1344654 - RNA, 14 nt, Homo sapiens
ggaagauggcauaa

SEQ ID NO: 1344655 - RNA, 13 nt, Homo sapiens
ggaagccagguac

SEQ ID NO: 1344656 - RNA, 21 nt, Homo sapiens
ggaagcuuccaugaugcacag

SEQ ID NO: 1344657 - RNA, 17 nt, Homo sapiens
ggaagggagccaaggga

SEQ ID NO: 1344658 - RNA, 13 nt, Homo sapiens
ggaaggggcccca

SEQ ID NO: 1344659 - RNA, 20 nt, Homo sapiens
ggaagucacagcaugugaau

SEQ ID NO: 1344660 - RNA, 18 nt, Homo sapiens
ggaagugaaaacuuugua

SEQ ID NO: 1344661 - RNA, 20 nt, Homo sapiens
ggaagugcccucgagcacug

SEQ ID NO: 1344662 - RNA, 22 nt, Homo sapiens
ggaagugcccucgagcacugaa

SEQ ID NO: 1344663 - RNA, 17 nt, Homo sapiens
ggaauauaaccucccac

SEQ ID NO: 1344664 - RNA, 23 nt, Homo sapiens
ggaaucagaacucaaauggggcc

SEQ ID NO: 1344665 - RNA, 15 nt, Homo sapiens
ggaauccucuguguc

SEQ ID NO: 1344666 - RNA, 12 nt, Homo sapiens
ggaaucuagccc

SEQ ID NO: 1344667 - RNA, 17 nt, Homo sapiens
ggaauggcccucauuca

SEQ ID NO: 1344668 - RNA, 11 nt, Homo sapiens
ggaauggugua

SEQ ID NO: 1344669 - RNA, 21 nt, Homo sapiens
ggacaaaauaaaccguguauu

SEQ ID NO: 1344670 - RNA, 15 nt, Homo sapiens
ggacaggcacuccaa

SEQ ID NO: 1344671 - RNA, 16 nt, Homo sapiens
ggacaugaaaauagca

SEQ ID NO: 1344672 - RNA, 19 nt, Homo sapiens
ggacaugcuuuucugccac

SEQ ID NO: 1344673 - RNA, 19 nt, Homo sapiens
ggaccaucugcugcaguua

SEQ ID NO: 1344674 - RNA, 20 nt, Homo sapiens
ggacccuguugaggguccuc

SEQ ID NO: 1344675 - RNA, 21 nt, Homo sapiens
ggacccuucuggguccaggga

SEQ ID NO: 1344676 - RNA, 15 nt, Homo sapiens
ggaccucgugccacc

SEQ ID NO: 1344677 - RNA, 21 nt, Homo sapiens
ggaccugagagcaucucagga

SEQ ID NO: 1344678 - RNA, 15 nt, Homo sapiens
ggacgggaugaccuc

SEQ ID NO: 1344679 - RNA, 15 nt, Homo sapiens
ggacguuagacuguu

SEQ ID NO: 1344680 - RNA, 16 nt, Homo sapiens
ggacuacacagcuccu

SEQ ID NO: 1344681 - RNA, 23 nt, Homo sapiens
ggacuaccucugugccuugccac

SEQ ID NO: 1344682 - RNA, 19 nt, Homo sapiens
ggacuagagggaccucucc

SEQ ID NO: 1344683 - RNA, 16 nt, Homo sapiens
ggacuccaucgcuaaa

SEQ ID NO: 1344684 - RNA, 22 nt, Homo sapiens
ggacuccauuucuuucuuccau

SEQ ID NO: 1344685 - RNA, 11 nt, Homo sapiens
ggacugagaug

SEQ ID NO: 1344686 - RNA, 17 nt, Homo sapiens
ggacuguugaugccuuu

SEQ ID NO: 1344687 - RNA, 18 nt, Homo sapiens
ggacuuccuguccagcuc

SEQ ID NO: 1344688 - RNA, 21 nt, Homo sapiens
ggagaaacaaaauccucagga

SEQ ID NO: 1344689 - RNA, 14 nt, Homo sapiens
ggagaacuagagaa

SEQ ID NO: 1344690 - RNA, 16 nt, Homo sapiens
ggagacaaggugcuaa

SEQ ID NO: 1344691 - RNA, 22 nt, Homo sapiens
ggagacacccucuggggguccu

SEQ ID NO: 1344692 - RNA, 17 nt, Homo sapiens
uaugcccauuuccuuga

SEQ ID NO: 1344693 - RNA, 19 nt, Homo sapiens
uaugccugacuaauuuugu

SEQ ID NO: 1344694 - RNA, 14 nt, Homo sapiens
uaugcugugcuaaa

SEQ ID NO: 1344695 - RNA, 15 nt, Homo sapiens
uauggauaaucugag

SEQ ID NO: 1344696 - RNA, 15 nt, Homo sapiens
uaugguucucaggcc

SEQ ID NO: 1344697 - RNA, 17 nt, Homo sapiens
uaugguucucucgcaag

SEQ ID NO: 1344698 - RNA, 18 nt, Homo sapiens
uauguaacuuccugugga

SEQ ID NO: 1344699 - RNA, 22 nt, Homo sapiens
uauguaauuuuauuuacauucu

SEQ ID NO: 1344700 - RNA, 12 nt, Homo sapiens
uauguaccauau

SEQ ID NO: 1344701 - RNA, 16 nt, Homo sapiens
uauguacugccuuagu

SEQ ID NO: 1344702 - RNA, 16 nt, Homo sapiens
uauguauaacuuuaac

SEQ ID NO: 1344703 - RNA, 19 nt, Homo sapiens
uauguauaacuuuaacuuc

SEQ ID NO: 1344704 - RNA, 15 nt, Homo sapiens
uaugucaguccaaua

SEQ ID NO: 1344705 - RNA, 13 nt, Homo sapiens
uaugugugccuuu

SEQ ID NO: 1344706 - RNA, 15 nt, Homo sapiens
uauguuauuugcucu

SEQ ID NO: 1344707 - RNA, 17 nt, Homo sapiens
uauguuauuugcucuaa

SEQ ID NO: 1344708 - RNA, 16 nt, Homo sapiens
uauguucccucuuguc

SEQ ID NO: 1344709 - RNA, 23 nt, Homo sapiens
uauguuguucuuacaaaccauac

SEQ ID NO: 1344710 - RNA, 20 nt, Homo sapiens
uauuaagauacuuagauuag

SEQ ID NO: 1344711 - RNA, 15 nt, Homo sapiens
uauuaaucauacaaa

SEQ ID NO: 1344712 - RNA, 20 nt, Homo sapiens
uauuaauuuuccaaugcaca

SEQ ID NO: 1344713 - RNA, 22 nt, Homo sapiens
uauuacacaaagaacuugcugc

SEQ ID NO: 1344714 - RNA, 18 nt, Homo sapiens
uauuagagcugccugugc

SEQ ID NO: 1344715 - RNA, 21 nt, Homo sapiens
uauuagagcugccugugccuu

SEQ ID NO: 1344716 - RNA, 15 nt, Homo sapiens
uauuagccaacuguu

SEQ ID NO: 1344717 - RNA, 19 nt, Homo sapiens
uauuauugauucacuuacu

SEQ ID NO: 1344718 - RNA, 21 nt, Homo sapiens
uauuauuuuauuauauugccu

SEQ ID NO: 1344719 - RNA, 17 nt, Homo sapiens
uauucacuaaggacuua

SEQ ID NO: 1344720 - RNA, 15 nt, Homo sapiens
uauucagauugggaa

SEQ ID NO: 1344721 - RNA, 18 nt, Homo sapiens
uauucucuuccucaucca

SEQ ID NO: 1344722 - RNA, 14 nt, Homo sapiens
uauucugggggccc

SEQ ID NO: 1344723 - RNA, 21 nt, Homo sapiens
uauuggccaaacuggugcaug

SEQ ID NO: 1344724 - RNA, 17 nt, Homo sapiens
uauuguaaagauccuau

SEQ ID NO: 1344725 - RNA, 14 nt, Homo sapiens
uauuguugcugaaa

SEQ ID NO: 1344726 - RNA, 16 nt, Homo sapiens
uauuuaagcagcuuga

SEQ ID NO: 1344727 - RNA, 23 nt, Homo sapiens
uauuuaagccuuauaaaccaauc

SEQ ID NO: 1344728 - RNA, 22 nt, Homo sapiens
uauuuaauauaguaacacacuu

SEQ ID NO: 1344729 - RNA, 22 nt, Homo sapiens
uauuuaauuuuuuaguuucccc

SEQ ID NO: 1344730 - RNA, 18 nt, Homo sapiens
uauuuaccuucuaccucu

SEQ ID NO: 1344731 - RNA, 16 nt, Homo sapiens
uauuuagucaacauau

SEQ ID NO: 1344732 - RNA, 13 nt, Homo sapiens
uauuuaugcuaua

SEQ ID NO: 1344733 - RNA, 14 nt, Homo sapiens
uauuuauuagccaa

SEQ ID NO: 1344734 - RNA, 20 nt, Homo sapiens
uauuuauugauguuuucaca

SEQ ID NO: 1344735 - RNA, 23 nt, Homo sapiens
uauuuauuucuuuuuugccaaau

SEQ ID NO: 1344736 - RNA, 16 nt, Homo sapiens
uauuuauuugagguca

SEQ ID NO: 1344737 - RNA, 20 nt, Homo sapiens
uauuucaauacuuacauauc

SEQ ID NO: 1344738 - RNA, 20 nt, Homo sapiens
uauuucugucaacuuguauu

SEQ ID NO: 1344739 - RNA, 13 nt, Homo sapiens
uauuugcacuaug

SEQ ID NO: 1344740 - RNA, 14 nt, Homo sapiens
uauuuguaucuguu

SEQ ID NO: 1344741 - RNA, 17 nt, Homo sapiens
uauuuucacacugguaa

SEQ ID NO: 1344742 - RNA, 12 nt, Homo sapiens
uauuuuuacuaa

SEQ ID NO: 1344743 - RNA, 17 nt, Homo sapiens
uauuuuuuaauaaacug

SEQ ID NO: 1344744 - RNA, 17 nt, Homo sapiens
ucaaaacaaacauuucu

SEQ ID NO: 1344745 - RNA, 11 nt, Homo sapiens
ucaaaacugaa

SEQ ID NO: 1344746 - RNA, 17 nt, Homo sapiens
ucaaaacugcacuguca

SEQ ID NO: 1344747 - RNA, 22 nt, Homo sapiens
ucaaaacuuucguuguuauuau

SEQ ID NO: 1344748 - RNA, 18 nt, Homo sapiens
ucaaaagccuuaccuuga

SEQ ID NO: 1344749 - RNA, 21 nt, Homo sapiens
ucaaacccaaguuaguucaau

SEQ ID NO: 1344750 - RNA, 17 nt, Homo sapiens
ucaaacugcaugauuca

SEQ ID NO: 1344751 - RNA, 14 nt, Homo sapiens
ucaaagaaagugua

SEQ ID NO: 1344752 - RNA, 17 nt, Homo sapiens
ucaaagacuuccucugg

SEQ ID NO: 1344753 - RNA, 21 nt, Homo sapiens
ucaaagcuuuuuccagaggcu

SEQ ID NO: 1344754 - RNA, 13 nt, Homo sapiens
ucaaauaccacau

SEQ ID NO: 1344755 - RNA, 16 nt, Homo sapiens
ucaaauguuguucucu

SEQ ID NO: 1344756 - RNA, 23 nt, Homo sapiens
ucaaauuaauguuccaguuugaa

SEQ ID NO: 1344757 - RNA, 14 nt, Homo sapiens
ucaacacaaacugg

SEQ ID NO: 1344758 - RNA, 21 nt, Homo sapiens
ucaacagagaggggcagggaa

SEQ ID NO: 1344759 - RNA, 20 nt, Homo sapiens
ucaacagugugagcauuugu

SEQ ID NO: 1344760 - RNA, 22 nt, Homo sapiens
ucaacaucuuggucagauuuga

SEQ ID NO: 1344761 - RNA, 18 nt, Homo sapiens
ucaaccaacaacaaugug

SEQ ID NO: 1344762 - RNA, 19 nt, Homo sapiens
ucaacuguuuuugucuaca

SEQ ID NO: 1344763 - RNA, 14 nt, Homo sapiens
ucaagaauagcauu

SEQ ID NO: 1344764 - RNA, 17 nt, Homo sapiens
ucaagaauagcauugua

SEQ ID NO: 1344765 - RNA, 23 nt, Homo sapiens
ucaagagaucuuucuuuccaaaa

SEQ ID NO: 1344766 - RNA, 16 nt, Homo sapiens
ucaagagcaugcacau

SEQ ID NO: 1344767 - RNA, 19 nt, Homo sapiens
ucaagaugaugaugaucuu

SEQ ID NO: 1344768 - RNA, 20 nt, Homo sapiens
ucaagcaauccuccuaccuc

SEQ ID NO: 1344769 - RNA, 21 nt, Homo sapiens
ucaagcucuccaaaggcucag

SEQ ID NO: 1344770 - RNA, 18 nt, Homo sapiens
ucaagcugguggccucug

SEQ ID NO: 1344771 - RNA, 23 nt, Homo sapiens
ucaagggucagggugagacguga

SEQ ID NO: 1344772 - RNA, 16 nt, Homo sapiens
ucaauaauccaugaaa

SEQ ID NO: 1344773 - RNA, 15 nt, Homo sapiens
ucaauacaaccagcc

SEQ ID NO: 1344774 - RNA, 21 nt, Homo sapiens
ucaauauuuacuauuucaaua

SEQ ID NO: 1344775 - RNA, 12 nt, Homo sapiens
ucaaucucuggg

SEQ ID NO: 1344776 - RNA, 13 nt, Homo sapiens
ucaauuucuagua

SEQ ID NO: 1344777 - RNA, 14 nt, Homo sapiens
ucacaaaauaucac

SEQ ID NO: 1344778 - RNA, 16 nt, Homo sapiens
ucacaaaccaugcaaa

SEQ ID NO: 1344779 - RNA, 15 nt, Homo sapiens
ucacaacagugaaaa

SEQ ID NO: 1344780 - RNA, 19 nt, Homo sapiens
ucacaaugaguuugggcau

SEQ ID NO: 1344781 - RNA, 17 nt, Homo sapiens
ucacaauuaugugcaaa

SEQ ID NO: 1344782 - RNA, 12 nt, Homo sapiens
ucacacauucag

SEQ ID NO: 1344783 - RNA, 22 nt, Homo sapiens
ucacagcugauugggcaccuga

SEQ ID NO: 1344784 - RNA, 21 nt, Homo sapiens
ucacagguuaaugugguguua

SEQ ID NO: 1344785 - RNA, 14 nt, Homo sapiens
ucacaucucaggga

SEQ ID NO: 1344786 - RNA, 15 nt, Homo sapiens
ucacaugagucaaaa

SEQ ID NO: 1344787 - RNA, 17 nt, Homo sapiens
ucacaugguuacauauc

SEQ ID NO: 1344788 - RNA, 16 nt, Homo sapiens
ucacauucauugcagu

SEQ ID NO: 1344789 - RNA, 16 nt, Homo sapiens
ucacauuuauuuggua

SEQ ID NO: 1344790 - RNA, 23 nt, Homo sapiens
ucacauuugggguuuguguuuga

SEQ ID NO: 1344791 - RNA, 17 nt, Homo sapiens
ucaccaaacacaagaaa

SEQ ID NO: 1344792 - RNA, 16 nt, Homo sapiens
ucaccagagacuuuag

SEQ ID NO: 1344793 - RNA, 22 nt, Homo sapiens
ucacccaccucuggguccuugg

SEQ ID NO: 1344794 - RNA, 19 nt, Homo sapiens
ucacccaggcuggaguaca

SEQ ID NO: 1344795 - RNA, 17 nt, Homo sapiens
ucaccuacauuaucuca

SEQ ID NO: 1344796 - RNA, 21 nt, Homo sapiens
ucaccuacauuugagaauuau

SEQ ID NO: 1344797 - RNA, 18 nt, Homo sapiens
ucaccucaauauuuacua

SEQ ID NO: 1344798 - RNA, 22 nt, Homo sapiens
ucaccucaauauuuacuauuuc

SEQ ID NO: 1344799 - RNA, 19 nt, Homo sapiens
ucaccuccaagcauuucau

SEQ ID NO: 1344800 - RNA, 18 nt, Homo sapiens
ucaccuccucugugauuu

SEQ ID NO: 1344801 - RNA, 20 nt, Homo sapiens
ucaccuggucgccaauccau

SEQ ID NO: 1344802 - RNA, 13 nt, Homo sapiens
ucaccuucuaguu

SEQ ID NO: 1344803 - RNA, 18 nt, Homo sapiens
ucaccuuggcaccagaca

SEQ ID NO: 1344804 - RNA, 22 nt, Homo sapiens
ucaccuuggcaccagacaccca

SEQ ID NO: 1344805 - RNA, 15 nt, Homo sapiens
ucacgcaggagccau

SEQ ID NO: 1344806 - RNA, 21 nt, Homo sapiens
ucacguuuggugcuucucaga

SEQ ID NO: 1344807 - RNA, 16 nt, Homo sapiens
ucacuaaggacuuaaa

SEQ ID NO: 1344808 - RNA, 18 nt, Homo sapiens
ucacucugggccugggga

SEQ ID NO: 1344809 - RNA, 17 nt, Homo sapiens
ucacugcaaacacaccu

SEQ ID NO: 1344810 - RNA, 18 nt, Homo sapiens
ucacugcaacuucugccu

SEQ ID NO: 1344811 - RNA, 21 nt, Homo sapiens
ucacugccccagacacagugc

SEQ ID NO: 1344812 - RNA, 16 nt, Homo sapiens
ucacugcuguagacau

SEQ ID NO: 1344813 - RNA, 20 nt, Homo sapiens
ucacuggccugccaugccag

SEQ ID NO: 1344814 - RNA, 14 nt, Homo sapiens
ucacuguccuccaa

SEQ ID NO: 1344815 - RNA, 11 nt, Homo sapiens
ucacuguguuu

SEQ ID NO: 1344816 - RNA, 21 nt, Homo sapiens
ucacuguguuuuaaaaggcaa

SEQ ID NO: 1344817 - RNA, 15 nt, Homo sapiens
ucacuuaaacuuuua

SEQ ID NO: 1344818 - RNA, 15 nt, Homo sapiens
ucacuucauagcuca

SEQ ID NO: 1344819 - RNA, 19 nt, Homo sapiens
ucacuucauagcucaccag

SEQ ID NO: 1344820 - RNA, 19 nt, Homo sapiens
ucacuucauucacauucag

SEQ ID NO: 1344821 - RNA, 11 nt, Homo sapiens
ucacuugccca

SEQ ID NO: 1344822 - RNA, 15 nt, Homo sapiens
ucacuugcucuuuga

SEQ ID NO: 1344823 - RNA, 13 nt, Homo sapiens
ucagaaauguuaa

SEQ ID NO: 1344824 - RNA, 13 nt, Homo sapiens
ucagaacaugaaa

SEQ ID NO: 1344825 - RNA, 13 nt, Homo sapiens
ucagaacugcccu

SEQ ID NO: 1344826 - RNA, 23 nt, Homo sapiens
ucagaagcaucgcuccucuccag

SEQ ID NO: 1344827 - RNA, 20 nt, Homo sapiens
ucagaaggccccagagagac

SEQ ID NO: 1344828 - RNA, 20 nt, Homo sapiens
ucagaaguauauuuuugcag

SEQ ID NO: 1344829 - RNA, 18 nt, Homo sapiens
ucagaagucaucuugcua

SEQ ID NO: 1344830 - RNA, 18 nt, Homo sapiens
ucagaaguucaagcuaaa

SEQ ID NO: 1344831 - RNA, 15 nt, Homo sapiens
ucagaaucuuuucaa

SEQ ID NO: 1344832 - RNA, 18 nt, Homo sapiens
ucagaauugcucaaagaa

SEQ ID NO: 1344833 - RNA, 20 nt, Homo sapiens
ucagacuugauuuacaauuu

SEQ ID NO: 1344834 - RNA, 21 nt, Homo sapiens
ucagacuuuguguucauuuca

SEQ ID NO: 1344835 - RNA, 22 nt, Homo sapiens
ucagacuuuguguucauuucau

SEQ ID NO: 1344836 - RNA, 14 nt, Homo sapiens
ucagagaacauccc

SEQ ID NO: 1344837 - RNA, 15 nt, Homo sapiens
ucagagccaccccua

SEQ ID NO: 1344838 - RNA, 23 nt, Homo sapiens
ucagaggccugcugccagugcag

SEQ ID NO: 1344839 - RNA, 12 nt, Homo sapiens
ucagagugcaag

SEQ ID NO: 1344840 - RNA, 13 nt, Homo sapiens
ucagagugcaagc

SEQ ID NO: 1344841 - RNA, 15 nt, Homo sapiens
ucagauaaauuguau

SEQ ID NO: 1344842 - RNA, 13 nt, Homo sapiens
ucagaucaugccc

SEQ ID NO: 1344843 - RNA, 16 nt, Homo sapiens
ucagaugcugagccaa

SEQ ID NO: 1344844 - RNA, 14 nt, Homo sapiens
ucagcccagugcaa

SEQ ID NO: 1344845 - RNA, 15 nt, Homo sapiens
ucagcccagugcaaa

SEQ ID NO: 1344846 - RNA, 22 nt, Homo sapiens
ucagccuggccagacacaggcc

SEQ ID NO: 1344847 - RNA, 18 nt, Homo sapiens
ucagccuugccagagauc

SEQ ID NO: 1344848 - RNA, 21 nt, Homo sapiens
ucagcuagauuuguguccaca

SEQ ID NO: 1344849 - RNA, 19 nt, Homo sapiens
ucagcucuggagaacagug

SEQ ID NO: 1344850 - RNA, 15 nt, Homo sapiens
ucagcugccuccugc

SEQ ID NO: 1344851 - RNA, 22 nt, Homo sapiens
ucaggaaaucaaauaugcaaag

SEQ ID NO: 1344852 - RNA, 22 nt, Homo sapiens
ucaggagaguagcaacaaaagg

SEQ ID NO: 1344853 - RNA, 13 nt, Homo sapiens
ucaggauucuguu

SEQ ID NO: 1344854 - RNA, 19 nt, Homo sapiens
ucaggauucuguuccuuag

SEQ ID NO: 1344855 - RNA, 12 nt, Homo sapiens
ucaggcaccugc

SEQ ID NO: 1344856 - RNA, 21 nt, Homo sapiens
ucagggacuugaaugcacuuu

SEQ ID NO: 1344857 - RNA, 20 nt, Homo sapiens
ucaggggcggggagggugac

SEQ ID NO: 1344858 - RNA, 11 nt, Homo sapiens
ucaguaugugg

SEQ ID NO: 1344859 - RNA, 16 nt, Homo sapiens
ucaguauuucaacuga

SEQ ID NO: 1344860 - RNA, 16 nt, Homo sapiens
ucaguccacugcugag

SEQ ID NO: 1344861 - RNA, 18 nt, Homo sapiens
ucagucuuuaaucugaga

SEQ ID NO: 1344862 - RNA, 20 nt, Homo sapiens
ucagugccuucaacaacgug

SEQ ID NO: 1344863 - RNA, 20 nt, Homo sapiens
ucaguucuuacacauuccau

SEQ ID NO: 1344864 - RNA, 21 nt, Homo sapiens
ucaguugauauaaaacucugg

SEQ ID NO: 1344865 - RNA, 13 nt, Homo sapiens
ucaguugcacuuc

SEQ ID NO: 1344866 - RNA, 15 nt, Homo sapiens
ucauaauuuugcaaa

SEQ ID NO: 1344867 - RNA, 17 nt, Homo sapiens
ucauacacaugugcaca

SEQ ID NO: 1344868 - RNA, 18 nt, Homo sapiens
ucauacacaugugcacac

SEQ ID NO: 1344869 - RNA, 18 nt, Homo sapiens
ucauacuaaacuucaccu

SEQ ID NO: 1344870 - RNA, 11 nt, Homo sapiens
ucauagcucau

SEQ ID NO: 1344871 - RNA, 12 nt, Homo sapiens
ucauagugauag

SEQ ID NO: 1344872 - RNA, 20 nt, Homo sapiens
ucauagugauagagugcagu

SEQ ID NO: 1344873 - RNA, 18 nt, Homo sapiens
ucauauacaauugucaug

SEQ ID NO: 1344874 - RNA, 19 nt, Homo sapiens
ucaucaacuaccauucuau

SEQ ID NO: 1344875 - RNA, 21 nt, Homo sapiens
ucaucagccuugggauagcaa

SEQ ID NO: 1344876 - RNA, 14 nt, Homo sapiens
ucaucaggugcaua

SEQ ID NO: 1344877 - RNA, 18 nt, Homo sapiens
ucaucaggugcauagcaa

SEQ ID NO: 1344878 - RNA, 20 nt, Homo sapiens
ucauccacguccugucuguu

SEQ ID NO: 1344879 - RNA, 21 nt, Homo sapiens
ucauccgcaaauuuucuucca

SEQ ID NO: 1344880 - RNA, 18 nt, Homo sapiens
ucauccugcuugacugua

SEQ ID NO: 1344881 - RNA, 16 nt, Homo sapiens
ucaucucucugcccaa

SEQ ID NO: 1344882 - RNA, 18 nt, Homo sapiens
ucaucugggaacuuguca

SEQ ID NO: 1344883 - RNA, 19 nt, Homo sapiens
ucaucugggggaguggaau

SEQ ID NO: 1344884 - RNA, 16 nt, Homo sapiens
ucaucuguuguagauu

SEQ ID NO: 1344885 - RNA, 20 nt, Homo sapiens
ucaucuugcagcauuuacua

SEQ ID NO: 1344886 - RNA, 23 nt, Homo sapiens
ucaucuuuugaagagcaaaggga

SEQ ID NO: 1344887 - RNA, 15 nt, Homo sapiens
ucaugacugcaugac

SEQ ID NO: 1344888 - RNA, 13 nt, Homo sapiens
ucaugauaauuca

SEQ ID NO: 1344889 - RNA, 14 nt, Homo sapiens
ucaugaugaugaua

SEQ ID NO: 1344890 - RNA, 15 nt, Homo sapiens
ucaugcgcaacugga

SEQ ID NO: 1344891 - RNA, 16 nt, Homo sapiens
ucaugcgcaacuggag

SEQ ID NO: 1344892 - RNA, 23 nt, Homo sapiens
ucaugcugcuccccuaaagccag

SEQ ID NO: 1344893 - RNA, 21 nt, Homo sapiens
ucauguccagugagcaguguu

SEQ ID NO: 1344894 - RNA, 12 nt, Homo sapiens
ucaugugcauua

SEQ ID NO: 1344895 - RNA, 18 nt, Homo sapiens
ucauguuaugcagugaac

SEQ ID NO: 1344896 - RNA, 22 nt, Homo sapiens
ucauguuugaaucuacauucac

SEQ ID NO: 1344897 - RNA, 14 nt, Homo sapiens
ucauuaacagugcu

SEQ ID NO: 1344898 - RNA, 14 nt, Homo sapiens
ucauuagugacuuc

SEQ ID NO: 1344899 - RNA, 19 nt, Homo sapiens
ucauuauuuuucacugccc

SEQ ID NO: 1344900 - RNA, 16 nt, Homo sapiens
ucauucagaagaugcu

SEQ ID NO: 1344901 - RNA, 13 nt, Homo sapiens
ucauucaguucua

SEQ ID NO: 1344902 - RNA, 17 nt, Homo sapiens
ucauucaguucuaggcc

SEQ ID NO: 1344903 - RNA, 13 nt, Homo sapiens
ucauucaucauga

SEQ ID NO: 1344904 - RNA, 15 nt, Homo sapiens
ucauucaucaugaaa

SEQ ID NO: 1344905 - RNA, 19 nt, Homo sapiens
ucauucauuggugaaguaa

SEQ ID NO: 1344906 - RNA, 17 nt, Homo sapiens
ucauuccaccuucccau

SEQ ID NO: 1344907 - RNA, 12 nt, Homo sapiens
ucauucuuuaua

SEQ ID NO: 1344908 - RNA, 16 nt, Homo sapiens
ucauugcaagcucaag

SEQ ID NO: 1344909 - RNA, 13 nt, Homo sapiens
ucauuuagcuuuu

SEQ ID NO: 1344910 - RNA, 17 nt, Homo sapiens
ucauuucagauauucca

SEQ ID NO: 1344911 - RNA, 14 nt, Homo sapiens
ucauuucauuucag

SEQ ID NO: 1344912 - RNA, 15 nt, Homo sapiens
ucauuuguaaucuag

SEQ ID NO: 1344913 - RNA, 13 nt, Homo sapiens
ucauuuguuaaua

SEQ ID NO: 1344914 - RNA, 14 nt, Homo sapiens
ucauuuugaugaua

SEQ ID NO: 1344915 - RNA, 14 nt, Homo sapiens
ucauuuugcacuga

SEQ ID NO: 1344916 - RNA, 14 nt, Homo sapiens
ucauuuugcucaac

SEQ ID NO: 1344917 - RNA, 18 nt, Homo sapiens
uccaaaaauggcagugac

SEQ ID NO: 1344918 - RNA, 19 nt, Homo sapiens
uccaaaccuccacugcugc

SEQ ID NO: 1344919 - RNA, 18 nt, Homo sapiens
uccaaagccggcuugauu

SEQ ID NO: 1344920 - RNA, 11 nt, Homo sapiens
uccaaagggag

SEQ ID NO: 1344921 - RNA, 18 nt, Homo sapiens
uccaacccgccggucuca

SEQ ID NO: 1344922 - RNA, 17 nt, Homo sapiens
uccaacgccccuguggc

SEQ ID NO: 1344923 - RNA, 20 nt, Homo sapiens
uccaagcagaguguuuuauu

SEQ ID NO: 1344924 - RNA, 19 nt, Homo sapiens
uccaagcugcucauuucac

SEQ ID NO: 1344925 - RNA, 21 nt, Homo sapiens
uccaaugacugagcagcaucc

SEQ ID NO: 1344926 - RNA, 13 nt, Homo sapiens
uccacacagccaa

SEQ ID NO: 1344927 - RNA, 15 nt, Homo sapiens
uccacaccugggcau

SEQ ID NO: 1344928 - RNA, 17 nt, Homo sapiens
uccacaccugggcauuu

SEQ ID NO: 1344929 - RNA, 14 nt, Homo sapiens
uccacacgcauuaa

SEQ ID NO: 1344930 - RNA, 13 nt, Homo sapiens
uccaccagcagca

SEQ ID NO: 1344931 - RNA, 16 nt, Homo sapiens
uccacccagugcugaa

SEQ ID NO: 1344932 - RNA, 16 nt, Homo sapiens
uccaccgccacugggc

SEQ ID NO: 1344933 - RNA, 21 nt, Homo sapiens
uccacuccagauuuuuuacag

SEQ ID NO: 1344934 - RNA, 19 nt, Homo sapiens
uccacugccuccugugacg

SEQ ID NO: 1344935 - RNA, 15 nt, Homo sapiens
uccacugucaggguu

SEQ ID NO: 1344936 - RNA, 11 nt, Homo sapiens
uccacuuagaa

SEQ ID NO: 1344937 - RNA, 16 nt, Homo sapiens
uccacuuggagcuaaa

SEQ ID NO: 1344938 - RNA, 17 nt, Homo sapiens
uccacuuggagcuaaaa

SEQ ID NO: 1344939 - RNA, 18 nt, Homo sapiens
uccacuuuaugugcaucu

SEQ ID NO: 1344940 - RNA, 17 nt, Homo sapiens
uccagaacucaaaugag

SEQ ID NO: 1344941 - RNA, 18 nt, Homo sapiens
uccagauaacuuagcuua

SEQ ID NO: 1344942 - RNA, 17 nt, Homo sapiens
uccagcccugcagcuau

SEQ ID NO: 1344943 - RNA, 15 nt, Homo sapiens
uccagcugacagcca

SEQ ID NO: 1344944 - RNA, 10 nt, Homo sapiens
uccagcugcc

SEQ ID NO: 1344945 - RNA, 15 nt, Homo sapiens
uccaggcagauccag

SEQ ID NO: 1344946 - RNA, 15 nt, Homo sapiens
uccaggccugaaguc

SEQ ID NO: 1344947 - RNA, 21 nt, Homo sapiens
uccagggcuauagggugugau

SEQ ID NO: 1344948 - RNA, 14 nt, Homo sapiens
uccaguacuaugga

SEQ ID NO: 1344949 - RNA, 14 nt, Homo sapiens
uccaguauugaaaa

SEQ ID NO: 1344950 - RNA, 21 nt, Homo sapiens
uccaguauugaaaacuucaaa

SEQ ID NO: 1344951 - RNA, 20 nt, Homo sapiens
uccauaaagacaaucacugc

SEQ ID NO: 1344952 - RNA, 23 nt, Homo sapiens
uccauaaagacaaucacugccaa

SEQ ID NO: 1344953 - RNA, 17 nt, Homo sapiens
uccauacacacgcugcc

SEQ ID NO: 1344954 - RNA, 15 nt, Homo sapiens
uccauacaguguacu

SEQ ID NO: 1344955 - RNA, 18 nt, Homo sapiens
uccauauaacaauucagu

SEQ ID NO: 1344956 - RNA, 15 nt, Homo sapiens
uccaucaacucccaa

SEQ ID NO: 1344957 - RNA, 13 nt, Homo sapiens
uccaucaauaaau

SEQ ID NO: 1344958 - RNA, 23 nt, Homo sapiens
uccaucgcaguguucaaggccau

SEQ ID NO: 1344959 - RNA, 21 nt, Homo sapiens
uccaugaacaucauggacuga

SEQ ID NO: 1344960 - RNA, 14 nt, Homo sapiens
uccaugaugcacag

SEQ ID NO: 1344961 - RNA, 23 nt, Homo sapiens
uccaugcaacuggaguuccuuau

SEQ ID NO: 1344962 - RNA, 16 nt, Homo sapiens
uccaugcugccuccag

SEQ ID NO: 1344963 - RNA, 22 nt, Homo sapiens
uccaugucgccucugcauucag

SEQ ID NO: 1344964 - RNA, 20 nt, Homo sapiens
uccauguuugauguaucuga

SEQ ID NO: 1344965 - RNA, 22 nt, Homo sapiens
uccauucacaagccuccuguac

SEQ ID NO: 1344966 - RNA, 13 nt, Homo sapiens
uccauucucugag

SEQ ID NO: 1344967 - RNA, 15 nt, Homo sapiens
uccauucucugaguc

SEQ ID NO: 1344968 - RNA, 21 nt, Homo sapiens
ucccaaauuucauaccuauca

SEQ ID NO: 1344969 - RNA, 17 nt, Homo sapiens
ucccaagggagacugac

SEQ ID NO: 1344970 - RNA, 13 nt, Homo sapiens
ucccaauacaaaa

SEQ ID NO: 1344971 - RNA, 22 nt, Homo sapiens
ucccaauaggagacaaaggaga

SEQ ID NO: 1344972 - RNA, 15 nt, Homo sapiens
ucccaaucuuucuau

SEQ ID NO: 1344973 - RNA, 22 nt, Homo sapiens
ucccaauuucagacucccauuc

SEQ ID NO: 1344974 - RNA, 16 nt, Homo sapiens
ucccacaggcccuucc

SEQ ID NO: 1344975 - RNA, 16 nt, Homo sapiens
ucccacaugaggccau

SEQ ID NO: 1344976 - RNA, 19 nt, Homo sapiens
ucccacccugcaaagggaa

SEQ ID NO: 1344977 - RNA, 21 nt, Homo sapiens
ucccacugcccccuccacugg

SEQ ID NO: 1344978 - RNA, 20 nt, Homo sapiens
ucccagaggagccaccaguu

SEQ ID NO: 1344979 - RNA, 17 nt, Homo sapiens
ucccagcaagaccucau

SEQ ID NO: 1344980 - RNA, 18 nt, Homo sapiens
ucccagcuacaccuuucu

SEQ ID NO: 1344981 - RNA, 17 nt, Homo sapiens
ucccagcugaaggcagu

SEQ ID NO: 1344982 - RNA, 18 nt, Homo sapiens
ucccaggacccugaaggg

SEQ ID NO: 1344983 - RNA, 18 nt, Homo sapiens
ucccaucuccccgcugaa

SEQ ID NO: 1344984 - RNA, 15 nt, Homo sapiens
ucccauucuugcaug

SEQ ID NO: 1344985 - RNA, 12 nt, Homo sapiens
ucccauucuugg

SEQ ID NO: 1344986 - RNA, 21 nt, Homo sapiens
ucccauuuuucucuugccauu

SEQ ID NO: 1344987 - RNA, 20 nt, Homo sapiens
uccccaaggcugcaaagcaa

SEQ ID NO: 1344988 - RNA, 18 nt, Homo sapiens
uccccacaaaacaaagca

SEQ ID NO: 1344989 - RNA, 14 nt, Homo sapiens
uccccacacugacc

SEQ ID NO: 1344990 - RNA, 22 nt, Homo sapiens
uccccagacuucucuuucuuau

SEQ ID NO: 1344991 - RNA, 18 nt, Homo sapiens
uccccaugggcacagugg

SEQ ID NO: 1344992 - RNA, 14 nt, Homo sapiens
uccccccauguugu

SEQ ID NO: 1344993 - RNA, 17 nt, Homo sapiens
uccccuaaaccaaaaac

SEQ ID NO: 1344994 - RNA, 13 nt, Homo sapiens
uccccucaaccca

SEQ ID NO: 1344995 - RNA, 18 nt, Homo sapiens
uccccucucagcauuucc

SEQ ID NO: 1344996 - RNA, 22 nt, Homo sapiens
uccccugacagggccagugcag

SEQ ID NO: 1344997 - RNA, 22 nt, Homo sapiens
uccccuggggacgccaaggagg

SEQ ID NO: 1344998 - RNA, 18 nt, Homo sapiens
uccccuggguucacagau

SEQ ID NO: 1344999 - RNA, 15 nt, Homo sapiens
uccccuucucugccu

SEQ ID NO: 1345000 - RNA, 22 nt, Homo sapiens
uccccuuguguuugaacagggc

SEQ ID NO: 1345001 - RNA, 18 nt, Homo sapiens
ucccgucagcuggaaaag

SEQ ID NO: 1345002 - RNA, 19 nt, Homo sapiens
ucccguggacuacacagcu

SEQ ID NO: 1345003 - RNA, 13 nt, Homo sapiens
ucccuacauguau

SEQ ID NO: 1345004 - RNA, 22 nt, Homo sapiens
ucccuagauagcuauuaagaua

SEQ ID NO: 1345005 - RNA, 23 nt, Homo sapiens
ucccucccagaggagccaccagu

SEQ ID NO: 1345006 - RNA, 18 nt, Homo sapiens
ucccucccccccaugcac

SEQ ID NO: 1345007 - RNA, 21 nt, Homo sapiens
ucccuccgcaucccgucagcu

SEQ ID NO: 1345008 - RNA, 12 nt, Homo sapiens
ucccucuguaua

SEQ ID NO: 1345009 - RNA, 18 nt, Homo sapiens
ucccugaagagaagggca

SEQ ID NO: 1345010 - RNA, 22 nt, Homo sapiens
ucccugccugaauaaaguaaug

SEQ ID NO: 1345011 - RNA, 17 nt, Homo sapiens
ucccugccuguuucccg

SEQ ID NO: 1345012 - RNA, 15 nt, Homo sapiens
ucccugcuuugcauc

SEQ ID NO: 1345013 - RNA, 14 nt, Homo sapiens
ucccuggggucacc

SEQ ID NO: 1345014 - RNA, 16 nt, Homo sapiens
ucccugucauuugaac

SEQ ID NO: 1345015 - RNA, 21 nt, Homo sapiens
ucccuucccagcgcugcuggu

SEQ ID NO: 1345016 - RNA, 14 nt, Homo sapiens
uccgaaaugcuguc

SEQ ID NO: 1345017 - RNA, 20 nt, Homo sapiens
uccgcaggcaguuaccaagu

SEQ ID NO: 1345018 - RNA, 18 nt, Homo sapiens
uccgcuagcaguacuaau

SEQ ID NO: 1345019 - RNA, 23 nt, Homo sapiens
uccggcgggugacagcuccggga

SEQ ID NO: 1345020 - RNA, 22 nt, Homo sapiens
uccgggagggugcggcugugca

SEQ ID NO: 1345021 - RNA, 20 nt, Homo sapiens
uccguagcucugcugcugau

SEQ ID NO: 1345022 - RNA, 13 nt, Homo sapiens
uccuaauacuguc

SEQ ID NO: 1345023 - RNA, 16 nt, Homo sapiens
uccuacagggccacaa

SEQ ID NO: 1345024 - RNA, 19 nt, Homo sapiens
uccuagcuguguuauuccu

SEQ ID NO: 1345025 - RNA, 21 nt, Homo sapiens
uccuauaaagugccucggaca

SEQ ID NO: 1345026 - RNA, 17 nt, Homo sapiens
uccucagaucauuauca

SEQ ID NO: 1345027 - RNA, 15 nt, Homo sapiens
uccucaguccacugc

SEQ ID NO: 1345028 - RNA, 22 nt, Homo sapiens
uccucauauacuugaauauuau

SEQ ID NO: 1345029 - RNA, 22 nt, Homo sapiens
uccuccuuuaccuuucagugca

SEQ ID NO: 1345030 - RNA, 13 nt, Homo sapiens
uccucgcauuaaa

SEQ ID NO: 1345031 - RNA, 14 nt, Homo sapiens
uccucuaguaguau

SEQ ID NO: 1345032 - RNA, 12 nt, Homo sapiens
uccucuccagcu

SEQ ID NO: 1345033 - RNA, 13 nt, Homo sapiens
uccucucugcaag

SEQ ID NO: 1345034 - RNA, 21 nt, Homo sapiens
uccucucugugucccugcugc

SEQ ID NO: 1345035 - RNA, 19 nt, Homo sapiens
uccugaccccgccaugcau

SEQ ID NO: 1345036 - RNA, 18 nt, Homo sapiens
uccugaccucaaguaauc

SEQ ID NO: 1345037 - RNA, 21 nt, Homo sapiens
uccugaguagcugggaugaca

SEQ ID NO: 1345038 - RNA, 18 nt, Homo sapiens
uccugcagauacuuugaa

SEQ ID NO: 1345039 - RNA, 15 nt, Homo sapiens
uccugcagucuggcu

SEQ ID NO: 1345040 - RNA, 14 nt, Homo sapiens
uccugccacaugga

SEQ ID NO: 1345041 - RNA, 14 nt, Homo sapiens
uccugggaacacau

SEQ ID NO: 1345042 - RNA, 21 nt, Homo sapiens
uccugggcauggguccagggc

SEQ ID NO: 1345043 - RNA, 14 nt, Homo sapiens
uccuguccagcucc

SEQ ID NO: 1345044 - RNA, 23 nt, Homo sapiens
uccuguccagcuccaaccugcaa

SEQ ID NO: 1345045 - RNA, 22 nt, Homo sapiens
uccugucuguuuccucuguaua

SEQ ID NO: 1345046 - RNA, 23 nt, Homo sapiens
uccuguugccuuuauauccaaaa

SEQ ID NO: 1345047 - RNA, 19 nt, Homo sapiens
uccuuaaaucguuuagcau

SEQ ID NO: 1345048 - RNA, 21 nt, Homo sapiens
uccuuauuuugugugcuuucc

SEQ ID NO: 1345049 - RNA, 22 nt, Homo sapiens
uccuucaggcagcugaaauuca

SEQ ID NO: 1345050 - RNA, 19 nt, Homo sapiens
uccuucaguccaccacagc

SEQ ID NO: 1345051 - RNA, 22 nt, Homo sapiens
uccuucccacccccaguccugu

SEQ ID NO: 1345052 - RNA, 17 nt, Homo sapiens
uccuugacuucuuugag

SEQ ID NO: 1345053 - RNA, 23 nt, Homo sapiens
uccuugagaagugggagcacccu

SEQ ID NO: 1345054 - RNA, 20 nt, Homo sapiens
uccuuggagggacaugacua

SEQ ID NO: 1345055 - RNA, 16 nt, Homo sapiens
uccuuggcuuuuacug

SEQ ID NO: 1345056 - RNA, 21 nt, Homo sapiens
uccuugugccuucuuuguaua

SEQ ID NO: 1345057 - RNA, 15 nt, Homo sapiens
uccuuucacaaccuu

SEQ ID NO: 1345058 - RNA, 17 nt, Homo sapiens
uccuuuccccucccuca

SEQ ID NO: 1345059 - RNA, 18 nt, Homo sapiens
uccuuuccccucccucag

SEQ ID NO: 1345060 - RNA, 14 nt, Homo sapiens
uccuuuguuacuuc

SEQ ID NO: 1345061 - RNA, 16 nt, Homo sapiens
uccuuuuaacugccaa

SEQ ID NO: 1345062 - RNA, 22 nt, Homo sapiens
uccuuuuuucaauaugcaagca

SEQ ID NO: 1345063 - RNA, 21 nt, Homo sapiens
ucgacaaaagcaguggagaag

SEQ ID NO: 1345064 - RNA, 15 nt, Homo sapiens
ucgacucagccucag

SEQ ID NO: 1345065 - RNA, 12 nt, Homo sapiens
ucgagcacugaa

SEQ ID NO: 1345066 - RNA, 21 nt, Homo sapiens
ucgaggagcuagaacauucca

SEQ ID NO: 1345067 - RNA, 23 nt, Homo sapiens
ucgauauuaauguauccaaugaa

SEQ ID NO: 1345068 - RNA, 21 nt, Homo sapiens
ucgcaaacguuucuugaacaa

SEQ ID NO: 1345069 - RNA, 20 nt, Homo sapiens
ucgcuguugucacaucucag

SEQ ID NO: 1345070 - RNA, 10 nt, Homo sapiens
ucgcuuuaug

SEQ ID NO: 1345071 - RNA, 12 nt, Homo sapiens
ucggauaugauu

SEQ ID NO: 1345072 - RNA, 20 nt, Homo sapiens
ucggauuugccauagccuug

SEQ ID NO: 1345073 - RNA, 14 nt, Homo sapiens
ucggcacacacugu

SEQ ID NO: 1345074 - RNA, 15 nt, Homo sapiens
ucggcacacacugug

SEQ ID NO: 1345075 - RNA, 16 nt, Homo sapiens
ucggcacacacugugc

SEQ ID NO: 1345076 - RNA, 22 nt, Homo sapiens
ucggcagccuuaaggcccucau

SEQ ID NO: 1345077 - RNA, 21 nt, Homo sapiens
ucggcugccaggggcucugug

SEQ ID NO: 1345078 - RNA, 15 nt, Homo sapiens
ucggugguaccugag

SEQ ID NO: 1345079 - RNA, 14 nt, Homo sapiens
ucguauacccugga

SEQ ID NO: 1345080 - RNA, 14 nt, Homo sapiens
ucgucugggcuccc

SEQ ID NO: 1345081 - RNA, 12 nt, Homo sapiens
ucuccagugaaa

SEQ ID NO: 1345082 - RNA, 18 nt, Homo sapiens
ucuccaucucugucucaa

SEQ ID NO: 1345083 - RNA, 22 nt, Homo sapiens
ucuccauguuugauguaucuga

SEQ ID NO: 1345084 - RNA, 23 nt, Homo sapiens
ucuccccuccugcacacagggca

SEQ ID NO: 1345085 - RNA, 20 nt, Homo sapiens
ucuccucacucugucccugu

SEQ ID NO: 1345086 - RNA, 18 nt, Homo sapiens
ucuccuuggccacagacu

SEQ ID NO: 1345087 - RNA, 13 nt, Homo sapiens
ucuccuuuuccua

SEQ ID NO: 1345088 - RNA, 19 nt, Homo sapiens
ucucgaacuccugaccuca

SEQ ID NO: 1345089 - RNA, 23 nt, Homo sapiens
ucucuauaacagauccuuucaaa

SEQ ID NO: 1345090 - RNA, 14 nt, Homo sapiens
ucucuauguaucaa

SEQ ID NO: 1345091 - RNA, 17 nt, Homo sapiens
ucucuauuucuggauga

SEQ ID NO: 1345092 - RNA, 13 nt, Homo sapiens
ucucucaugacca

SEQ ID NO: 1345093 - RNA, 17 nt, Homo sapiens
ucucuccagcugacuaa

SEQ ID NO: 1345094 - RNA, 16 nt, Homo sapiens
ucucucccagguccca

SEQ ID NO: 1345095 - RNA, 19 nt, Homo sapiens
ucucuccccagaugugacu

SEQ ID NO: 1345096 - RNA, 16 nt, Homo sapiens
ucucuccgaggggugg

SEQ ID NO: 1345097 - RNA, 13 nt, Homo sapiens
ucucugaaagugu

SEQ ID NO: 1345098 - RNA, 19 nt, Homo sapiens
ucucugacugcuuuggaua

SEQ ID NO: 1345099 - RNA, 19 nt, Homo sapiens
ucucugagcaauuguaggg

SEQ ID NO: 1345100 - RNA, 21 nt, Homo sapiens
ucucuuaaaccacagcacuau

SEQ ID NO: 1345101 - RNA, 22 nt, Homo sapiens
ucucuuaaaccacagcacuauu

SEQ ID NO: 1345102 - RNA, 19 nt, Homo sapiens
ucucuucuacacagcaaua

SEQ ID NO: 1345103 - RNA, 19 nt, Homo sapiens
ucucuugccauuuguagcu

SEQ ID NO: 1345104 - RNA, 16 nt, Homo sapiens
ucucuugccugcucca

SEQ ID NO: 1345105 - RNA, 24 nt, Homo sapiens
ucucuugggcccaggacuguugau

SEQ ID NO: 1345106 - RNA, 12 nt, Homo sapiens
ucucuugugcau

SEQ ID NO: 1345107 - RNA, 15 nt, Homo sapiens
ucucuuuaccuccua

SEQ ID NO: 1345108 - RNA, 14 nt, Homo sapiens
ucucuuugugcucu

SEQ ID NO: 1345109 - RNA, 17 nt, Homo sapiens
ucugaagucacugcaca

SEQ ID NO: 1345110 - RNA, 14 nt, Homo sapiens
ucugacaacuguga

SEQ ID NO: 1345111 - RNA, 13 nt, Homo sapiens
ucugaccagcagc

SEQ ID NO: 1345112 - RNA, 14 nt, Homo sapiens
ucugacgucucuuu

SEQ ID NO: 1345113 - RNA, 18 nt, Homo sapiens
ucugacugccaagccaga

SEQ ID NO: 1345114 - RNA, 17 nt, Homo sapiens
ucugagggggugggggu

SEQ ID NO: 1345115 - RNA, 18 nt, Homo sapiens
ucugagggggugggggug

SEQ ID NO: 1345116 - RNA, 20 nt, Homo sapiens
ucugaguaagcccucaggag

SEQ ID NO: 1345117 - RNA, 12 nt, Homo sapiens
ucugaguuugaa

SEQ ID NO: 1345118 - RNA, 18 nt, Homo sapiens
ucugauaaaagauggcca

SEQ ID NO: 1345119 - RNA, 18 nt, Homo sapiens
ucugauucugauugcuau

SEQ ID NO: 1345120 - RNA, 20 nt, Homo sapiens
ucugauuuuggccaucagga

SEQ ID NO: 1345121 - RNA, 14 nt, Homo sapiens
ucugcacaccuacu

SEQ ID NO: 1345122 - RNA, 13 nt, Homo sapiens
ucugcacugagga

SEQ ID NO: 1345123 - RNA, 23 nt, Homo sapiens
ucugcagggggugugucugcuca

SEQ ID NO: 1345124 - RNA, 17 nt, Homo sapiens
ucugcaguacagucuua

SEQ ID NO: 1345125 - RNA, 19 nt, Homo sapiens
ucugccaaaggaugugaua

SEQ ID NO: 1345126 - RNA, 20 nt, Homo sapiens
ucugccaaaggaugugauau

SEQ ID NO: 1345127 - RNA, 20 nt, Homo sapiens
ucugccacaccucuccaaag

SEQ ID NO: 1345128 - RNA, 15 nt, Homo sapiens
ucugccuucugcuga

SEQ ID NO: 1345129 - RNA, 16 nt, Homo sapiens
ucugccuucugcugaa

SEQ ID NO: 1345130 - RNA, 20 nt, Homo sapiens
ucugcuccccuaaagccuca

SEQ ID NO: 1345131 - RNA, 13 nt, Homo sapiens
ucugcuccugcuu

SEQ ID NO: 1345132 - RNA, 16 nt, Homo sapiens
ucugcucuauacugug

SEQ ID NO: 1345133 - RNA, 16 nt, Homo sapiens
ucugcucucauauaag

SEQ ID NO: 1345134 - RNA, 22 nt, Homo sapiens
ucugcugucuuuucuuugccau

SEQ ID NO: 1345135 - RNA, 22 nt, Homo sapiens
ucugcuuguauuccaagcauau

SEQ ID NO: 1345136 - RNA, 20 nt, Homo sapiens
ucugcuuuucccauugccau

SEQ ID NO: 1345137 - RNA, 16 nt, Homo sapiens
ucuggaauacaugaaa

SEQ ID NO: 1345138 - RNA, 15 nt, Homo sapiens
ucuggacacugagag

SEQ ID NO: 1345139 - RNA, 19 nt, Homo sapiens
ucuggacuggaaagcacaa

SEQ ID NO: 1345140 - RNA, 16 nt, Homo sapiens
ucuggaugcugugaag

SEQ ID NO: 1345141 - RNA, 12 nt, Homo sapiens
ucuggcaaaaag

SEQ ID NO: 1345142 - RNA, 19 nt, Homo sapiens
ucuggcaccaucagccugu

SEQ ID NO: 1345143 - RNA, 13 nt, Homo sapiens
ucuggcaucucuu

SEQ ID NO: 1345144 - RNA, 22 nt, Homo sapiens
ucuggcccuaacuccuauaaag

SEQ ID NO: 1345145 - RNA, 18 nt, Homo sapiens
ucuggccuguacccagua

SEQ ID NO: 1345146 - RNA, 18 nt, Homo sapiens
ucuggcucuaauucacag

SEQ ID NO: 1345147 - RNA, 13 nt, Homo sapiens
ucuggcuggaaag

SEQ ID NO: 1345148 - RNA, 18 nt, Homo sapiens
ucuggcuucaaaaagcca

SEQ ID NO: 1345149 - RNA, 15 nt, Homo sapiens
ucugggcaccaccuc

SEQ ID NO: 1345150 - RNA, 18 nt, Homo sapiens
ucuggguacuucuugaag

SEQ ID NO: 1345151 - RNA, 15 nt, Homo sapiens
ucugggugaccucac

SEQ ID NO: 1345152 - RNA, 22 nt, Homo sapiens
ucuggguggaagugugugccaa

SEQ ID NO: 1345153 - RNA, 19 nt, Homo sapiens
ucugguacugcaggaccuc

SEQ ID NO: 1345154 - RNA, 13 nt, Homo sapiens
ucuguaacagggu

SEQ ID NO: 1345155 - RNA, 23 nt, Homo sapiens
ucuguauuaaaauuagaaucuga

SEQ ID NO: 1345156 - RNA, 19 nt, Homo sapiens
ucuguccccgcuccccuaa

SEQ ID NO: 1345157 - RNA, 14 nt, Homo sapiens
ucugucucauugac

SEQ ID NO: 1345158 - RNA, 20 nt, Homo sapiens
ucugucuuuaagaacuaauu

SEQ ID NO: 1345159 - RNA, 17 nt, Homo sapiens
ucugugaugacauuccc

SEQ ID NO: 1345160 - RNA, 14 nt, Homo sapiens
ucuuuauaaaccau

SEQ ID NO: 1345161 - RNA, 16 nt, Homo sapiens
ucuuuauucacaguau

SEQ ID NO: 1345162 - RNA, 17 nt, Homo sapiens
ucuuucaaacuuggggu

SEQ ID NO: 1345163 - RNA, 21 nt, Homo sapiens
ucuuucaagucaguucuguga

SEQ ID NO: 1345164 - RNA, 13 nt, Homo sapiens
ucuuuccaaaaca

SEQ ID NO: 1345165 - RNA, 18 nt, Homo sapiens
ucuuucuaaugugugaau

SEQ ID NO: 1345166 - RNA, 22 nt, Homo sapiens
ucuuucuuaaccacuuucagcc

SEQ ID NO: 1345167 - RNA, 13 nt, Homo sapiens
ucuuucuuuccaa

SEQ ID NO: 1345168 - RNA, 20 nt, Homo sapiens
ucuuucuuugcaccaaagac

SEQ ID NO: 1345169 - RNA, 20 nt, Homo sapiens
ucuuugaagcgagcagucag

SEQ ID NO: 1345170 - RNA, 21 nt, Homo sapiens
ucuuugacauuuuugccaaaa

SEQ ID NO: 1345171 - RNA, 22 nt, Homo sapiens
ucuuugggccagacaugccaca

SEQ ID NO: 1345172 - RNA, 15 nt, Homo sapiens
ucuuuuauccuggga

SEQ ID NO: 1345173 - RNA, 16 nt, Homo sapiens
ucuuuugaacccagga

SEQ ID NO: 1345174 - RNA, 14 nt, Homo sapiens
ucuuuugucccaga

SEQ ID NO: 1345175 - RNA, 13 nt, Homo sapiens
ucuuuuugcuuca

SEQ ID NO: 1345176 - RNA, 23 nt, Homo sapiens
ucuuuuuuuuuaaggugaaccaa

SEQ ID NO: 1345177 - RNA, 15 nt, Homo sapiens
ugaaaaagacauaaa

SEQ ID NO: 1345178 - RNA, 14 nt, Homo sapiens
ugaaaaaucuaagu

SEQ ID NO: 1345179 - RNA, 18 nt, Homo sapiens
ugaaaaaucuaagugaua

SEQ ID NO: 1345180 - RNA, 21 nt, Homo sapiens
ugaaaaaugguaauuguugcu

SEQ ID NO: 1345181 - RNA, 24 nt, Homo sapiens
ugaaaacaauucuuauugacucau

SEQ ID NO: 1345182 - RNA, 16 nt, Homo sapiens
ugaaaaccucuccuca

SEQ ID NO: 1345183 - RNA, 14 nt, Homo sapiens
ugaaaacuucaaag

SEQ ID NO: 1345184 - RNA, 18 nt, Homo sapiens
ugaaaagaauagaagcua

SEQ ID NO: 1345185 - RNA, 19 nt, Homo sapiens
ugaaaagcaggcaaaagac

SEQ ID NO: 1345186 - RNA, 18 nt, Homo sapiens
ugaaaauauagacauucu

SEQ ID NO: 1345187 - RNA, 21 nt, Homo sapiens
ugaaaauauagacauucucac

SEQ ID NO: 1345188 - RNA, 13 nt, Homo sapiens
ugaaaaugcaacu

SEQ ID NO: 1345189 - RNA, 19 nt, Homo sapiens
ugaaaauuauauauaccug

SEQ ID NO: 1345190 - RNA, 16 nt, Homo sapiens
ugaaacaaucuuccaa

SEQ ID NO: 1345191 - RNA, 15 nt, Homo sapiens
ugaaacuccgucuca

SEQ ID NO: 1345192 - RNA, 13 nt, Homo sapiens
ugaaacugcauaa

SEQ ID NO: 1345193 - RNA, 22 nt, Homo sapiens
ugaaacuuuaauucuuuuauca

SEQ ID NO: 1345194 - RNA, 15 nt, Homo sapiens
ugaaagaaccagaga

SEQ ID NO: 1345195 - RNA, 16 nt, Homo sapiens
ugaaaggaagaguuau

SEQ ID NO: 1345196 - RNA, 19 nt, Homo sapiens
ugaaaggcagggcaagaac

SEQ ID NO: 1345197 - RNA, 14 nt, Homo sapiens
ugaaaggguuugau

SEQ ID NO: 1345198 - RNA, 23 nt, Homo sapiens
ugaaauaccaaccugaagacacc

SEQ ID NO: 1345199 - RNA, 12 nt, Homo sapiens
ugaaaugcauau

SEQ ID NO: 1345200 - RNA, 22 nt, Homo sapiens
ugaaauuaugugacauuuuaca

SEQ ID NO: 1345201 - RNA, 20 nt, Homo sapiens
ugaaauuuaauuacaaacaa

SEQ ID NO: 1345202 - RNA, 14 nt, Homo sapiens
ugaaauuugauaaa

SEQ ID NO: 1345203 - RNA, 21 nt, Homo sapiens
ugaaauuuguuauacuucaaa

SEQ ID NO: 1345204 - RNA, 23 nt, Homo sapiens
ugaacagguucucuuccuggcau

SEQ ID NO: 1345205 - RNA, 11 nt, Homo sapiens
ugaaccaaauu

SEQ ID NO: 1345206 - RNA, 17 nt, Homo sapiens
ugaaccacauucaggga

SEQ ID NO: 1345207 - RNA, 19 nt, Homo sapiens
ugaacuauuagagcugccu

SEQ ID NO: 1345208 - RNA, 18 nt, Homo sapiens
ugaacucuucaaucucuu

SEQ ID NO: 1345209 - RNA, 13 nt, Homo sapiens
ugaacuuccagga

SEQ ID NO: 1345210 - RNA, 12 nt, Homo sapiens
ugaagaaucugc

SEQ ID NO: 1345211 - RNA, 23 nt, Homo sapiens
ugaagaccucuugggcaggggcu

SEQ ID NO: 1345212 - RNA, 23 nt, Homo sapiens
ugaagagagggacaggcacucca

SEQ ID NO: 1345213 - RNA, 22 nt, Homo sapiens
ugaagauuggggacacucauau

SEQ ID NO: 1345214 - RNA, 15 nt, Homo sapiens
ugaagcuggcugugc

SEQ ID NO: 1345215 - RNA, 22 nt, Homo sapiens
ugaaggaugcggcaggugcucu

SEQ ID NO: 1345216 - RNA, 14 nt, Homo sapiens
ugaagggcuuuauu

SEQ ID NO: 1345217 - RNA, 15 nt, Homo sapiens
ugaaggggaggucac

SEQ ID NO: 1345218 - RNA, 20 nt, Homo sapiens
ugaagggguuuucuugauaa

SEQ ID NO: 1345219 - RNA, 19 nt, Homo sapiens
ugaagguagaauguuuuca

SEQ ID NO: 1345220 - RNA, 21 nt, Homo sapiens
ugaaguagacucauucuucac

SEQ ID NO: 1345221 - RNA, 15 nt, Homo sapiens
ugaaguaugccuuga

SEQ ID NO: 1345222 - RNA, 22 nt, Homo sapiens
ugaaguuauggcuucacauuca

SEQ ID NO: 1345223 - RNA, 23 nt, Homo sapiens
ugaaguuauggcuucacauucau

SEQ ID NO: 1345224 - RNA, 18 nt, Homo sapiens
ugaaguucacucagaggg

SEQ ID NO: 1345225 - RNA, 20 nt, Homo sapiens
ugaaguucacucagagggaa

SEQ ID NO: 1345226 - RNA, 16 nt, Homo sapiens
ugaaguucaucuugca

SEQ ID NO: 1345227 - RNA, 15 nt, Homo sapiens
ugaauagacacuuca

SEQ ID NO: 1345228 - RNA, 22 nt, Homo sapiens
ugaauauaaauuuguguucuca

SEQ ID NO: 1345229 - RNA, 15 nt, Homo sapiens
ugaauauuauacuuc

SEQ ID NO: 1345230 - RNA, 15 nt, Homo sapiens
ugaaucuauuucacu

SEQ ID NO: 1345231 - RNA, 13 nt, Homo sapiens
ugaaugccuaccu

SEQ ID NO: 1345232 - RNA, 21 nt, Homo sapiens
ugaaugccucgcucccuucaa

SEQ ID NO: 1345233 - RNA, 16 nt, Homo sapiens
ugaauguacauuuaau

SEQ ID NO: 1345234 - RNA, 23 nt, Homo sapiens
ugagcaauggaguggcugccaug

SEQ ID NO: 1345235 - RNA, 20 nt, Homo sapiens
ugagcacacccgugugcaca

SEQ ID NO: 1345236 - RNA, 16 nt, Homo sapiens
ugagcacccauuccaa

SEQ ID NO: 1345237 - RNA, 23 nt, Homo sapiens
ugagcacuuagcaggcaccgcca

SEQ ID NO: 1345238 - RNA, 15 nt, Homo sapiens
ugagcagguguucuu

SEQ ID NO: 1345239 - RNA, 13 nt, Homo sapiens
ugagcaugugaug

SEQ ID NO: 1345240 - RNA, 15 nt, Homo sapiens
ugagccacugugcuu

SEQ ID NO: 1345241 - RNA, 16 nt, Homo sapiens
ugagccuuugugcuuu

SEQ ID NO: 1345242 - RNA, 15 nt, Homo sapiens
ugagcggcacccugg

SEQ ID NO: 1345243 - RNA, 18 nt, Homo sapiens
ugagcuggaaggggccac

SEQ ID NO: 1345244 - RNA, 20 nt, Homo sapiens
ugagcuggggaugucucuca

SEQ ID NO: 1345245 - RNA, 15 nt, Homo sapiens
ugaggaaacaacagc

SEQ ID NO: 1345246 - RNA, 23 nt, Homo sapiens
ugaggaaguggcugucccugugg

SEQ ID NO: 1345247 - RNA, 13 nt, Homo sapiens
ugaggcaggagaa

SEQ ID NO: 1345248 - RNA, 17 nt, Homo sapiens
ugaggccaucucaggag

SEQ ID NO: 1345249 - RNA, 19 nt, Homo sapiens
ugaggccaucucaggagau

SEQ ID NO: 1345250 - RNA, 21 nt, Homo sapiens
ugaggcccauucuucacucug

SEQ ID NO: 1345251 - RNA, 15 nt, Homo sapiens
ugagggcaguucuga

SEQ ID NO: 1345252 - RNA, 12 nt, Homo sapiens
ugaggggucccc

SEQ ID NO: 1345253 - RNA, 14 nt, Homo sapiens
ugaggggucucgga

SEQ ID NO: 1345254 - RNA, 20 nt, Homo sapiens
ugagggugacuauggagcug

SEQ ID NO: 1345255 - RNA, 18 nt, Homo sapiens
ugaggugaacuccaggca

SEQ ID NO: 1345256 - RNA, 22 nt, Homo sapiens
ugaguaacgacauggaacugaa

SEQ ID NO: 1345257 - RNA, 13 nt, Homo sapiens
ugaguaauugagg

SEQ ID NO: 1345258 - RNA, 23 nt, Homo sapiens
ugaguagcucuccugacuuuuaa

SEQ ID NO: 1345259 - RNA, 23 nt, Homo sapiens
ugagucauuuaaauguguacaau

SEQ ID NO: 1345260 - RNA, 23 nt, Homo sapiens
ugagugcaccugccuccaccagc

SEQ ID NO: 1345261 - RNA, 16 nt, Homo sapiens
ugagugucuagcaaag

SEQ ID NO: 1345262 - RNA, 15 nt, Homo sapiens
ugaguuuuguauuca

SEQ ID NO: 1345263 - RNA, 17 nt, Homo sapiens
ugauaaaugauagacaa

SEQ ID NO: 1345264 - RNA, 23 nt, Homo sapiens
ugauacauuuaagguauauugcu

SEQ ID NO: 1345265 - RNA, 13 nt, Homo sapiens
ugauacuuacuca

SEQ ID NO: 1345266 - RNA, 15 nt, Homo sapiens
ugauacuuccucaua

SEQ ID NO: 1345267 - RNA, 20 nt, Homo sapiens
ugauagauuucuacacugag

SEQ ID NO: 1345268 - RNA, 19 nt, Homo sapiens
ugauauaucaugagugaau

SEQ ID NO: 1345269 - RNA, 20 nt, Homo sapiens
ugauauauuccaccaggaua

SEQ ID NO: 1345270 - RNA, 19 nt, Homo sapiens
ugauaucaacagcuucccu

SEQ ID NO: 1345271 - RNA, 18 nt, Homo sapiens
ugaucaaagccacacucu

SEQ ID NO: 1345272 - RNA, 17 nt, Homo sapiens
ugaucucuguuacaaaa

SEQ ID NO: 1345273 - RNA, 17 nt, Homo sapiens
ugaucuugugcuaugaa

SEQ ID NO: 1345274 - RNA, 14 nt, Homo sapiens
ugaugaaccagagu

SEQ ID NO: 1345275 - RNA, 18 nt, Homo sapiens
ugaugaauaaaaugaagg

SEQ ID NO: 1345276 - RNA, 13 nt, Homo sapiens
ugaugacauuccc

SEQ ID NO: 1345277 - RNA, 12 nt, Homo sapiens
ugaugcuaaaac

SEQ ID NO: 1345278 - RNA, 22 nt, Homo sapiens
ugaugcugccaggccugggacc

SEQ ID NO: 1345279 - RNA, 16 nt, Homo sapiens
ugauggaagcaccuaa

SEQ ID NO: 1345280 - RNA, 17 nt, Homo sapiens
ugauggcaacagaucug

SEQ ID NO: 1345281 - RNA, 11 nt, Homo sapiens
ugauguugcug

SEQ ID NO: 1345282 - RNA, 19 nt, Homo sapiens
ugauguuugccauuugcug

SEQ ID NO: 1345283 - RNA, 17 nt, Homo sapiens
ugauuaagccuccuccu

SEQ ID NO: 1345284 - RNA, 16 nt, Homo sapiens
ugauuacuuccacuga

SEQ ID NO: 1345285 - RNA, 12 nt, Homo sapiens
ugauucuugccu

SEQ ID NO: 1345286 - RNA, 18 nt, Homo sapiens
ugauugcuaucagcaaug

SEQ ID NO: 1345287 - RNA, 20 nt, Homo sapiens
ugauugucaacacaaacugg

SEQ ID NO: 1345288 - RNA, 23 nt, Homo sapiens
ugauugucaacacaaacuggcuu

SEQ ID NO: 1345289 - RNA, 16 nt, Homo sapiens
ugauugugccuacgaa

SEQ ID NO: 1345290 - RNA, 18 nt, Homo sapiens
ugauuuuuuuacuaauga

SEQ ID NO: 1345291 - RNA, 14 nt, Homo sapiens
ugcaaaaaaagccu

SEQ ID NO: 1345292 - RNA, 22 nt, Homo sapiens
ugcaaacaguaacgugugcgca

SEQ ID NO: 1345293 - RNA, 14 nt, Homo sapiens
ugcaaauacaauca

SEQ ID NO: 1345294 - RNA, 19 nt, Homo sapiens
ugcaaaucaaacauauucu

SEQ ID NO: 1345295 - RNA, 21 nt, Homo sapiens
ugcaacuucuuacuucccuaa

SEQ ID NO: 1345296 - RNA, 16 nt, Homo sapiens
ugcaaggauuacagaa

SEQ ID NO: 1345297 - RNA, 20 nt, Homo sapiens
ugcaagggauuguagauaac

SEQ ID NO: 1345298 - RNA, 21 nt, Homo sapiens
ugcaauccucccuaccguccu

SEQ ID NO: 1345299 - RNA, 20 nt, Homo sapiens
ugcaaugacucaggacaucc

SEQ ID NO: 1345300 - RNA, 12 nt, Homo sapiens
ugcaauuuagaa

SEQ ID NO: 1345301 - RNA, 17 nt, Homo sapiens
ugcacaaagcccuucca

SEQ ID NO: 1345302 - RNA, 22 nt, Homo sapiens
ugcacacuaguuuaugcuaccu

SEQ ID NO: 1345303 - RNA, 15 nt, Homo sapiens
ugcacaggagccaaa

SEQ ID NO: 1345304 - RNA, 17 nt, Homo sapiens
cguguauaguaucugua

SEQ ID NO: 1345305 - RNA, 14 nt, Homo sapiens
cguucccacugccc

SEQ ID NO: 1345306 - RNA, 17 nt, Homo sapiens
cguugggagccuagcuc

SEQ ID NO: 1345307 - RNA, 16 nt, Homo sapiens
cguuugaacucaggga

SEQ ID NO: 1345308 - RNA, 18 nt, Homo sapiens
cuaaaaaugaaaauucua

SEQ ID NO: 1345309 - RNA, 23 nt, Homo sapiens
cuaaaauuaaugcagauuucucu

SEQ ID NO: 1345310 - RNA, 16 nt, Homo sapiens
cuaaaauuuaaugcau

SEQ ID NO: 1345311 - RNA, 12 nt, Homo sapiens
cuaaaccaaaaa

SEQ ID NO: 1345312 - RNA, 11 nt, Homo sapiens
cuaaacugcag

SEQ ID NO: 1345313 - RNA, 20 nt, Homo sapiens
cuaaagcagggaagugacag

SEQ ID NO: 1345314 - RNA, 20 nt, Homo sapiens
cuaaagccaggcucaggaga

SEQ ID NO: 1345315 - RNA, 13 nt, Homo sapiens
cuaaagugcaaaa

SEQ ID NO: 1345316 - RNA, 20 nt, Homo sapiens
cuaaauuuucugaaacugca

SEQ ID NO: 1345317 - RNA, 21 nt, Homo sapiens
cuaaauuuucugaaacugcau

SEQ ID NO: 1345318 - RNA, 15 nt, Homo sapiens
cuaacaacauuguag

SEQ ID NO: 1345319 - RNA, 22 nt, Homo sapiens
cuaacagcccuccucugcacuc

SEQ ID NO: 1345320 - RNA, 17 nt, Homo sapiens
cuaacauguaauugcag

SEQ ID NO: 1345321 - RNA, 20 nt, Homo sapiens
cuaacauguaauugcagaua

SEQ ID NO: 1345322 - RNA, 19 nt, Homo sapiens
cuaacuuaauguguauuca

SEQ ID NO: 1345323 - RNA, 16 nt, Homo sapiens
cuaagaagaaggccag

SEQ ID NO: 1345324 - RNA, 14 nt, Homo sapiens
cuaagaagggaaaa

SEQ ID NO: 1345325 - RNA, 18 nt, Homo sapiens
cuaagguuuagauaaaua

SEQ ID NO: 1345326 - RNA, 20 nt, Homo sapiens
cuaaguccuuccaccugcca

SEQ ID NO: 1345327 - RNA, 12 nt, Homo sapiens
cuaagugcugcu

SEQ ID NO: 1345328 - RNA, 16 nt, Homo sapiens
cuaauaacaugugaaa

SEQ ID NO: 1345329 - RNA, 23 nt, Homo sapiens
cuaauauuaguuggcuuucauaa

SEQ ID NO: 1345330 - RNA, 16 nt, Homo sapiens
cuaaucagcauucuca

SEQ ID NO: 1345331 - RNA, 17 nt, Homo sapiens
cuaaucagcauucucac

SEQ ID NO: 1345332 - RNA, 13 nt, Homo sapiens
cuaaucucuacaa

SEQ ID NO: 1345333 - RNA, 15 nt, Homo sapiens
cuaauguuauuuucc

SEQ ID NO: 1345334 - RNA, 18 nt, Homo sapiens
cuaauuaaaaacugugau

SEQ ID NO: 1345335 - RNA, 19 nt, Homo sapiens
cuaauuaaaaacugugauu

SEQ ID NO: 1345336 - RNA, 17 nt, Homo sapiens
cuaauuauuaagauaug

SEQ ID NO: 1345337 - RNA, 17 nt, Homo sapiens
cuaauuccacacccuca

SEQ ID NO: 1345338 - RNA, 13 nt, Homo sapiens
cuacaaaaacaca

SEQ ID NO: 1345339 - RNA, 22 nt, Homo sapiens
cuacaauaaacugguaugaaua

SEQ ID NO: 1345340 - RNA, 19 nt, Homo sapiens
cuacagggacacuaucacu

SEQ ID NO: 1345341 - RNA, 19 nt, Homo sapiens
cuacaguaacugugacuga

SEQ ID NO: 1345342 - RNA, 13 nt, Homo sapiens
cuacaguauauaa

SEQ ID NO: 1345343 - RNA, 14 nt, Homo sapiens
cuacauguauugca

SEQ ID NO: 1345344 - RNA, 18 nt, Homo sapiens
cuacauguauugcacauu

SEQ ID NO: 1345345 - RNA, 16 nt, Homo sapiens
cuaccaagauauaccu

SEQ ID NO: 1345346 - RNA, 15 nt, Homo sapiens
cuaccagcacauuaa

SEQ ID NO: 1345347 - RNA, 13 nt, Homo sapiens
cuaccuagucucc

SEQ ID NO: 1345348 - RNA, 21 nt, Homo sapiens
cuaccucaaccaaugccaaaa

SEQ ID NO: 1345349 - RNA, 16 nt, Homo sapiens
cuaccucaccugggca

SEQ ID NO: 1345350 - RNA, 13 nt, Homo sapiens
cuaccucuuggcu

SEQ ID NO: 1345351 - RNA, 19 nt, Homo sapiens
cuaccugaguccugaagcu

SEQ ID NO: 1345352 - RNA, 13 nt, Homo sapiens
cuacuaaggggcu

SEQ ID NO: 1345353 - RNA, 18 nt, Homo sapiens
cuacuaauccucucugca

SEQ ID NO: 1345354 - RNA, 19 nt, Homo sapiens
cuacuauguacugccuuag

SEQ ID NO: 1345355 - RNA, 21 nt, Homo sapiens
cuacuccccuuaaucuaaucu

SEQ ID NO: 1345356 - RNA, 12 nt, Homo sapiens
cuacugacgucc

SEQ ID NO: 1345357 - RNA, 23 nt, Homo sapiens
cuacugcaagagccaaguuccaa

SEQ ID NO: 1345358 - RNA, 14 nt, Homo sapiens
cuacugcagucuuu

SEQ ID NO: 1345359 - RNA, 20 nt, Homo sapiens
cuacugcucuccuccaccuc

SEQ ID NO: 1345360 - RNA, 15 nt, Homo sapiens
cuacuguacuauuua

SEQ ID NO: 1345361 - RNA, 14 nt, Homo sapiens
cuacuugggagcac

SEQ ID NO: 1345362 - RNA, 16 nt, Homo sapiens
cuacuuuaucaauuaa

SEQ ID NO: 1345363 - RNA, 22 nt, Homo sapiens
cuagaaagcugcacuggugcua

SEQ ID NO: 1345364 - RNA, 14 nt, Homo sapiens
cuagaacauuccau

SEQ ID NO: 1345365 - RNA, 19 nt, Homo sapiens
cuagacuacucaauauuaa

SEQ ID NO: 1345366 - RNA, 16 nt, Homo sapiens
cuagacuagcuguaaa

SEQ ID NO: 1345367 - RNA, 21 nt, Homo sapiens
cuagacuggugcuaaugucaa

SEQ ID NO: 1345368 - RNA, 20 nt, Homo sapiens
cuagauaugaagaaucugcu

SEQ ID NO: 1345369 - RNA, 20 nt, Homo sapiens
cuagcacuuugggaggccaa

SEQ ID NO: 1345370 - RNA, 16 nt, Homo sapiens
cuagcucucacagaca

SEQ ID NO: 1345371 - RNA, 17 nt, Homo sapiens
cuagcugggcacagugg

SEQ ID NO: 1345372 - RNA, 18 nt, Homo sapiens
cuaggaaauccauucaca

SEQ ID NO: 1345373 - RNA, 23 nt, Homo sapiens
cuaggcagaucacguugcaaugg

SEQ ID NO: 1345374 - RNA, 13 nt, Homo sapiens
cuaggcccuguga

SEQ ID NO: 1345375 - RNA, 19 nt, Homo sapiens
cuaggcccugugagcacaa

SEQ ID NO: 1345376 - RNA, 14 nt, Homo sapiens
cuagucaagcuccu

SEQ ID NO: 1345377 - RNA, 22 nt, Homo sapiens
cuagugaaagaggcagcuugaa

SEQ ID NO: 1345378 - RNA, 21 nt, Homo sapiens
cuaguucuccccgauggggca

SEQ ID NO: 1345379 - RNA, 19 nt, Homo sapiens
cuauaacuaugaccaugcu

SEQ ID NO: 1345380 - RNA, 11 nt, Homo sapiens
cuauagcucuu

SEQ ID NO: 1345381 - RNA, 23 nt, Homo sapiens
cuauaggugcuacaaaaacacag

SEQ ID NO: 1345382 - RNA, 20 nt, Homo sapiens
cuauagugaugaugaucuca

SEQ ID NO: 1345383 - RNA, 21 nt, Homo sapiens
cuauagugaugaugaucucau

SEQ ID NO: 1345384 - RNA, 13 nt, Homo sapiens
cuauaugauuuca

SEQ ID NO: 1345385 - RNA, 19 nt, Homo sapiens
cuaucauaauucagcacuu

SEQ ID NO: 1345386 - RNA, 20 nt, Homo sapiens
cuaucauaauucagcacuua

SEQ ID NO: 1345387 - RNA, 18 nt, Homo sapiens
cuaucugacuucauacau

SEQ ID NO: 1345388 - RNA, 19 nt, Homo sapiens
cuaucugacuucauacauc

SEQ ID NO: 1345389 - RNA, 23 nt, Homo sapiens
cuaugaaauacuuuauagcacau

SEQ ID NO: 1345390 - RNA, 24 nt, Homo sapiens
cuaugaacagaaacuacauuucua

SEQ ID NO: 1345391 - RNA, 14 nt, Homo sapiens
cuaugcccauuucc

SEQ ID NO: 1345392 - RNA, 16 nt, Homo sapiens
cuauggagugcucaca

SEQ ID NO: 1345393 - RNA, 14 nt, Homo sapiens
cuauguacugccuu

SEQ ID NO: 1345394 - RNA, 22 nt, Homo sapiens
cuauguacugccuuagugcuga

SEQ ID NO: 1345395 - RNA, 22 nt, Homo sapiens
cuauuccauggcuaacuggcga

SEQ ID NO: 1345396 - RNA, 12 nt, Homo sapiens
cuauuccugcug

SEQ ID NO: 1345397 - RNA, 18 nt, Homo sapiens
cuauucuuggaaccacga

SEQ ID NO: 1345398 - RNA, 18 nt, Homo sapiens
cuauuuaucugaucaaga

SEQ ID NO: 1345399 - RNA, 21 nt, Homo sapiens
cuauuuauuuauuuauucauu

SEQ ID NO: 1345400 - RNA, 20 nt, Homo sapiens
cuauuugagauugaugacaa

SEQ ID NO: 1345401 - RNA, 18 nt, Homo sapiens
cucaaaacugcacuguca

SEQ ID NO: 1345402 - RNA, 13 nt, Homo sapiens
cucaaacuaucug

SEQ ID NO: 1345403 - RNA, 19 nt, Homo sapiens
cucaaaguuuuauuauaaa

SEQ ID NO: 1345404 - RNA, 14 nt, Homo sapiens
ccuucagacuggcc

SEQ ID NO: 1345405 - RNA, 16 nt, Homo sapiens
ccuucagcgauuauuu

SEQ ID NO: 1345406 - RNA, 11 nt, Homo sapiens
ccuucaggcag

SEQ ID NO: 1345407 - RNA, 24 nt, Homo sapiens
ccuuccuaugcuguucacuggaca

SEQ ID NO: 1345408 - RNA, 21 nt, Homo sapiens
ccuucuauguauuagugucaa

SEQ ID NO: 1345409 - RNA, 12 nt, Homo sapiens
ccuucugcugaa

SEQ ID NO: 1345410 - RNA, 20 nt, Homo sapiens
ccuucugugcuucagcucuu

SEQ ID NO: 1345411 - RNA, 14 nt, Homo sapiens
ccuucuguggcuca

SEQ ID NO: 1345412 - RNA, 16 nt, Homo sapiens
ccuucuugucauugaa

SEQ ID NO: 1345413 - RNA, 16 nt, Homo sapiens
ccuugacuucuuugag

SEQ ID NO: 1345414 - RNA, 16 nt, Homo sapiens
ccuugagaagugggag

SEQ ID NO: 1345415 - RNA, 18 nt, Homo sapiens
ccuugcuuucggagcucc

SEQ ID NO: 1345416 - RNA, 17 nt, Homo sapiens
ccuugcuuugagacucc

SEQ ID NO: 1345417 - RNA, 17 nt, Homo sapiens
ccuuggaaauacuguau

SEQ ID NO: 1345418 - RNA, 22 nt, Homo sapiens
ccuuggccaugggucccauucu

SEQ ID NO: 1345419 - RNA, 17 nt, Homo sapiens
ccuuggcuuuaugcaaa

SEQ ID NO: 1345420 - RNA, 19 nt, Homo sapiens
ccuuggcuuuaugcaaaua

SEQ ID NO: 1345421 - RNA, 21 nt, Homo sapiens
ccuuggcuuuaugcaaauaca

SEQ ID NO: 1345422 - RNA, 13 nt, Homo sapiens
ccuugguucucau

SEQ ID NO: 1345423 - RNA, 16 nt, Homo sapiens
ccuuguagcaaagcac

SEQ ID NO: 1345424 - RNA, 20 nt, Homo sapiens
ccuugucccccgugaucucc

SEQ ID NO: 1345425 - RNA, 22 nt, Homo sapiens
ccuugucccgucuggaccuggg

SEQ ID NO: 1345426 - RNA, 17 nt, Homo sapiens
ccuuguggccuaugaaa

SEQ ID NO: 1345427 - RNA, 15 nt, Homo sapiens
ccuuucacacuggau

SEQ ID NO: 1345428 - RNA, 18 nt, Homo sapiens
ccuuucagaaucuuuuca

SEQ ID NO: 1345429 - RNA, 20 nt, Homo sapiens
ccuuucauaaagucuugccu

SEQ ID NO: 1345430 - RNA, 18 nt, Homo sapiens
ccuuucccucuucccuga

SEQ ID NO: 1345431 - RNA, 17 nt, Homo sapiens
ccuuugaagaaggcaag

SEQ ID NO: 1345432 - RNA, 21 nt, Homo sapiens
ccuuugauugcugagagccau

SEQ ID NO: 1345433 - RNA, 18 nt, Homo sapiens
ccuuugccucaaggacuu

SEQ ID NO: 1345434 - RNA, 15 nt, Homo sapiens
ccuuuggaauggugu

SEQ ID NO: 1345435 - RNA, 15 nt, Homo sapiens
ccuuuguacuuugug

SEQ ID NO: 1345436 - RNA, 14 nt, Homo sapiens
ccuuugucccagaa

SEQ ID NO: 1345437 - RNA, 14 nt, Homo sapiens
ccuuuuaaaacacu

SEQ ID NO: 1345438 - RNA, 15 nt, Homo sapiens
ccuuuuaacugccaa

SEQ ID NO: 1345439 - RNA, 16 nt, Homo sapiens
ccuuuuaauggauggu

SEQ ID NO: 1345440 - RNA, 21 nt, Homo sapiens
ccuuuuaauggaugguugaau

SEQ ID NO: 1345441 - RNA, 18 nt, Homo sapiens
ccuuuuccccagucccag

SEQ ID NO: 1345442 - RNA, 18 nt, Homo sapiens
ccuuuucugaaagcauuu

SEQ ID NO: 1345443 - RNA, 19 nt, Homo sapiens
ccuuuuuuauacaggaaaa

SEQ ID NO: 1345444 - RNA, 16 nt, Homo sapiens
ccuuuuuuguuauuau

SEQ ID NO: 1345445 - RNA, 20 nt, Homo sapiens
cgaccccgucacagccucaa

SEQ ID NO: 1345446 - RNA, 15 nt, Homo sapiens
cgagaacccugagca

SEQ ID NO: 1345447 - RNA, 15 nt, Homo sapiens
cgagccaccaugcuu

SEQ ID NO: 1345448 - RNA, 23 nt, Homo sapiens
cgaggaaaagaacaaacaaaacu

SEQ ID NO: 1345449 - RNA, 23 nt, Homo sapiens
cgaggaaaggauuuuaccaaagc

SEQ ID NO: 1345450 - RNA, 14 nt, Homo sapiens
cgaguaacuccccu

SEQ ID NO: 1345451 - RNA, 15 nt, Homo sapiens
cgagugugauuugaa

SEQ ID NO: 1345452 - RNA, 19 nt, Homo sapiens
cgauugaaagaaccagaga

SEQ ID NO: 1345453 - RNA, 17 nt, Homo sapiens
cgcaaauuuucuuccau

SEQ ID NO: 1345454 - RNA, 12 nt, Homo sapiens
cgcacccggcuc

SEQ ID NO: 1345455 - RNA, 23 nt, Homo sapiens
cgcacgcggaugcuacuacugca

SEQ ID NO: 1345456 - RNA, 18 nt, Homo sapiens
cgcaguggcucacaccug

SEQ ID NO: 1345457 - RNA, 17 nt, Homo sapiens
cgccaacccuuccugaa

SEQ ID NO: 1345458 - RNA, 14 nt, Homo sapiens
cgccaucaugucuu

SEQ ID NO: 1345459 - RNA, 20 nt, Homo sapiens
cgcccaggcuggagugcagu

SEQ ID NO: 1345460 - RNA, 12 nt, Homo sapiens
cgcccucaggcu

SEQ ID NO: 1345461 - RNA, 15 nt, Homo sapiens
cgccgccggagucca

SEQ ID NO: 1345462 - RNA, 12 nt, Homo sapiens
cgcgcucgccca

SEQ ID NO: 1345463 - RNA, 13 nt, Homo sapiens
cgcggcucuccag

SEQ ID NO: 1345464 - RNA, 23 nt, Homo sapiens
cgcgugaucaaagccacacucug

SEQ ID NO: 1345465 - RNA, 19 nt, Homo sapiens
cgcuacccaccuccaggga

SEQ ID NO: 1345466 - RNA, 14 nt, Homo sapiens
cgcucaaugcccag

SEQ ID NO: 1345467 - RNA, 19 nt, Homo sapiens
cgcuggaauccagaaggaa

SEQ ID NO: 1345468 - RNA, 19 nt, Homo sapiens
cgcugucucugaggggugg

SEQ ID NO: 1345469 - RNA, 23 nt, Homo sapiens
cggaagcugucgacuucaugaca

SEQ ID NO: 1345470 - RNA, 18 nt, Homo sapiens
cggaaggucccucagaca

SEQ ID NO: 1345471 - RNA, 17 nt, Homo sapiens
cggacugcccccagaaa

SEQ ID NO: 1345472 - RNA, 22 nt, Homo sapiens
cggagaagagcuguucacagcc

SEQ ID NO: 1345473 - RNA, 15 nt, Homo sapiens
cggauacacacucga

SEQ ID NO: 1345474 - RNA, 16 nt, Homo sapiens
cggccccaucucucau

SEQ ID NO: 1345475 - RNA, 18 nt, Homo sapiens
cggccuccugucccucau

SEQ ID NO: 1345476 - RNA, 14 nt, Homo sapiens
cggcuccugcaaaa

SEQ ID NO: 1345477 - RNA, 18 nt, Homo sapiens
cggcugcggggggcacca

SEQ ID NO: 1345478 - RNA, 22 nt, Homo sapiens
cgggaaugcgcccaccaaggcc

SEQ ID NO: 1345479 - RNA, 18 nt, Homo sapiens
cgggaccaauacuacuga

SEQ ID NO: 1345480 - RNA, 23 nt, Homo sapiens
cgggagcccuagcccugcuccaa

SEQ ID NO: 1345481 - RNA, 21 nt, Homo sapiens
cgggcaaaauaaagugacaga

SEQ ID NO: 1345482 - RNA, 22 nt, Homo sapiens
cggugaugaggaaggacuugac

SEQ ID NO: 1345483 - RNA, 17 nt, Homo sapiens
cgguggcugccccggcc

SEQ ID NO: 1345484 - RNA, 17 nt, Homo sapiens
cguaucuuuccuaggca

SEQ ID NO: 1345485 - RNA, 16 nt, Homo sapiens
cguauuuuacaugaag

SEQ ID NO: 1345486 - RNA, 20 nt, Homo sapiens
cguccagggagcauuuuccu

SEQ ID NO: 1345487 - RNA, 21 nt, Homo sapiens
cguguaaaggaaaauaauguu

SEQ ID NO: 1345488 - RNA, 11 nt, Homo sapiens
cguuccagugg

SEQ ID NO: 1345489 - RNA, 23 nt, Homo sapiens
cguuccuguuagcauaaugugag

SEQ ID NO: 1345490 - RNA, 15 nt, Homo sapiens
cguucucccaaagau

SEQ ID NO: 1345491 - RNA, 17 nt, Homo sapiens
cguuuagaaaaaacaau

SEQ ID NO: 1345492 - RNA, 18 nt, Homo sapiens
cguuuuuccaguucacau

SEQ ID NO: 1345493 - RNA, 18 nt, Homo sapiens
cuaaaagcacacucaucc

SEQ ID NO: 1345494 - RNA, 19 nt, Homo sapiens
cuaaaaucuaaaauuucau

SEQ ID NO: 1345495 - RNA, 12 nt, Homo sapiens
cuaaagccucaa

SEQ ID NO: 1345496 - RNA, 21 nt, Homo sapiens
cuaaauaaauguaauagccaa

SEQ ID NO: 1345497 - RNA, 19 nt, Homo sapiens
cuaaauaucccuuggacau

SEQ ID NO: 1345498 - RNA, 22 nt, Homo sapiens
cuaaauggugcugcagauuuga

SEQ ID NO: 1345499 - RNA, 17 nt, Homo sapiens
cuaaauuuaaugcugcc

SEQ ID NO: 1345500 - RNA, 20 nt, Homo sapiens
cuaacagaucagaacaugaa

SEQ ID NO: 1345501 - RNA, 15 nt, Homo sapiens
cuaacaguggacaaa

SEQ ID NO: 1345502 - RNA, 22 nt, Homo sapiens
cuaacccaagacaugacauucu

SEQ ID NO: 1345503 - RNA, 14 nt, Homo sapiens
cuaagacccugugu

SEQ ID NO: 1345504 - RNA, 17 nt, Homo sapiens
cuaagagacacauacag

SEQ ID NO: 1345505 - RNA, 22 nt, Homo sapiens
cuaagguuuagauaaauauuga

SEQ ID NO: 1345506 - RNA, 18 nt, Homo sapiens
cuaaguaaaaccacagca

SEQ ID NO: 1345507 - RNA, 22 nt, Homo sapiens
cuaaguaaaaccacagcaguug

SEQ ID NO: 1345508 - RNA, 23 nt, Homo sapiens
cuaaguuaaacagucaguaugca

SEQ ID NO: 1345509 - RNA, 22 nt, Homo sapiens
cuaauagaauaaaggcaguuuu

SEQ ID NO: 1345510 - RNA, 15 nt, Homo sapiens
cuaauauacuuguaa

SEQ ID NO: 1345511 - RNA, 21 nt, Homo sapiens
cuaaucuucuuaugcaauuuc

SEQ ID NO: 1345512 - RNA, 17 nt, Homo sapiens
cuaaugauacuuacaag

SEQ ID NO: 1345513 - RNA, 16 nt, Homo sapiens
cuaauguuauuuuccu

SEQ ID NO: 1345514 - RNA, 15 nt, Homo sapiens
cuaauuacauuucac

SEQ ID NO: 1345515 - RNA, 17 nt, Homo sapiens
cuaauucggauuugcca

SEQ ID NO: 1345516 - RNA, 23 nt, Homo sapiens
cuaauucggauuugccauagccu

SEQ ID NO: 1345517 - RNA, 18 nt, Homo sapiens
cuaauucugggaagggag

SEQ ID NO: 1345518 - RNA, 23 nt, Homo sapiens
cuaauugucuuuguucugugauu

SEQ ID NO: 1345519 - RNA, 18 nt, Homo sapiens
cuacaacccuacccuggc

SEQ ID NO: 1345520 - RNA, 17 nt, Homo sapiens
cuacaagugauccucag

SEQ ID NO: 1345521 - RNA, 19 nt, Homo sapiens
cuacaauaaacugguauga

SEQ ID NO: 1345522 - RNA, 13 nt, Homo sapiens
cuacacugaugca

SEQ ID NO: 1345523 - RNA, 14 nt, Homo sapiens
cuacacugaugcaa

SEQ ID NO: 1345524 - RNA, 22 nt, Homo sapiens
cuacaugcaauuuagaacuaga

SEQ ID NO: 1345525 - RNA, 15 nt, Homo sapiens
cuacauguauugcac

SEQ ID NO: 1345526 - RNA, 18 nt, Homo sapiens
cuacauuccacccuguua

SEQ ID NO: 1345527 - RNA, 21 nt, Homo sapiens
cuaccaaagcaccuuagcugg

SEQ ID NO: 1345528 - RNA, 14 nt, Homo sapiens
cuaccaaugccaaa

SEQ ID NO: 1345529 - RNA, 17 nt, Homo sapiens
cuaccaaugccaaaagg

SEQ ID NO: 1345530 - RNA, 14 nt, Homo sapiens
cuacccuaaccaag

SEQ ID NO: 1345531 - RNA, 19 nt, Homo sapiens
cuacccuuccagugcccua

SEQ ID NO: 1345532 - RNA, 23 nt, Homo sapiens
cuacccuuccagugcccuaggcc

SEQ ID NO: 1345533 - RNA, 23 nt, Homo sapiens
cuaccgagucucuucuccacugg

SEQ ID NO: 1345534 - RNA, 15 nt, Homo sapiens
cuaccguaaaugucc

SEQ ID NO: 1345535 - RNA, 12 nt, Homo sapiens
cuaccuguaacu

SEQ ID NO: 1345536 - RNA, 22 nt, Homo sapiens
cuaccuguaggaucagggucua

SEQ ID NO: 1345537 - RNA, 19 nt, Homo sapiens
cuacgggcacaacuggaag

SEQ ID NO: 1345538 - RNA, 18 nt, Homo sapiens
cagggaaauguaugugug

SEQ ID NO: 1345539 - RNA, 22 nt, Homo sapiens
cagggaagugacaggacuuuca

SEQ ID NO: 1345540 - RNA, 14 nt, Homo sapiens
cagggaauggagcu

SEQ ID NO: 1345541 - RNA, 17 nt, Homo sapiens
cagggaccguccagggg

SEQ ID NO: 1345542 - RNA, 15 nt, Homo sapiens
cagggagaaacccac

SEQ ID NO: 1345543 - RNA, 13 nt, Homo sapiens
cagggaucugccc

SEQ ID NO: 1345544 - RNA, 20 nt, Homo sapiens
cagggaugauggcagagcca

SEQ ID NO: 1345545 - RNA, 14 nt, Homo sapiens
cagggccguugccc

SEQ ID NO: 1345546 - RNA, 15 nt, Homo sapiens
cagggccuccagggc

SEQ ID NO: 1345547 - RNA, 12 nt, Homo sapiens
cagggcucccug

SEQ ID NO: 1345548 - RNA, 13 nt, Homo sapiens
cagggcugauaag

SEQ ID NO: 1345549 - RNA, 14 nt, Homo sapiens
caggggaggggugc

SEQ ID NO: 1345550 - RNA, 18 nt, Homo sapiens
caggggccaaccucaggc

SEQ ID NO: 1345551 - RNA, 14 nt, Homo sapiens
caggggccugcaga

SEQ ID NO: 1345552 - RNA, 23 nt, Homo sapiens
caggggggcugugccaaccuguu

SEQ ID NO: 1345553 - RNA, 14 nt, Homo sapiens
caggggggcugugg

SEQ ID NO: 1345554 - RNA, 13 nt, Homo sapiens
caggguaccucaa

SEQ ID NO: 1345555 - RNA, 14 nt, Homo sapiens
cagggucauagcau

SEQ ID NO: 1345556 - RNA, 14 nt, Homo sapiens
cagggugucccagg

SEQ ID NO: 1345557 - RNA, 21 nt, Homo sapiens
caggguuucaccauguuggcc

SEQ ID NO: 1345558 - RNA, 19 nt, Homo sapiens
cagguaccucuuucagggu

SEQ ID NO: 1345559 - RNA, 13 nt, Homo sapiens
caggucccacugc

SEQ ID NO: 1345560 - RNA, 15 nt, Homo sapiens
caggucggagugccu

SEQ ID NO: 1345561 - RNA, 13 nt, Homo sapiens
caggugaucugcc

SEQ ID NO: 1345562 - RNA, 18 nt, Homo sapiens
caggugggagauuuggaa

SEQ ID NO: 1345563 - RNA, 14 nt, Homo sapiens
cagguggugcaaau

SEQ ID NO: 1345564 - RNA, 21 nt, Homo sapiens
cagguguucuucauuaccuca

SEQ ID NO: 1345565 - RNA, 17 nt, Homo sapiens
cagguuuugucccugcu

SEQ ID NO: 1345566 - RNA, 16 nt, Homo sapiens
caguaacugugacuga

SEQ ID NO: 1345567 - RNA, 21 nt, Homo sapiens
caguaacugugacugaugacu

SEQ ID NO: 1345568 - RNA, 13 nt, Homo sapiens
caguaacugugcu

SEQ ID NO: 1345569 - RNA, 16 nt, Homo sapiens
caguagcuccaacacu

SEQ ID NO: 1345570 - RNA, 14 nt, Homo sapiens
caguaguaaugugc

SEQ ID NO: 1345571 - RNA, 16 nt, Homo sapiens
caguaguaucaaauga

SEQ ID NO: 1345572 - RNA, 18 nt, Homo sapiens
caguagugcaccaucuca

SEQ ID NO: 1345573 - RNA, 18 nt, Homo sapiens
caguauuucuacauuaca

SEQ ID NO: 1345574 - RNA, 22 nt, Homo sapiens
cagucaaacccauggagacaga

SEQ ID NO: 1345575 - RNA, 15 nt, Homo sapiens
caguccacugcugag

SEQ ID NO: 1345576 - RNA, 13 nt, Homo sapiens
caguccauuuccu

SEQ ID NO: 1345577 - RNA, 16 nt, Homo sapiens
caguccauuuccuaau

SEQ ID NO: 1345578 - RNA, 14 nt, Homo sapiens
cagucccacacugu

SEQ ID NO: 1345579 - RNA, 17 nt, Homo sapiens
cagucccagacaauucc

SEQ ID NO: 1345580 - RNA, 22 nt, Homo sapiens
cagucccagcuaacucugaccu

SEQ ID NO: 1345581 - RNA, 17 nt, Homo sapiens
cagucggccccaucucu

SEQ ID NO: 1345582 - RNA, 20 nt, Homo sapiens
cagucugacccuuacagccu

SEQ ID NO: 1345583 - RNA, 19 nt, Homo sapiens
cagucuucccagcaauuau

SEQ ID NO: 1345584 - RNA, 19 nt, Homo sapiens
cagucuuggcucacugcaa

SEQ ID NO: 1345585 - RNA, 15 nt, Homo sapiens
cagugaaagcuuuca

SEQ ID NO: 1345586 - RNA, 13 nt, Homo sapiens
cagugaacuauuu

SEQ ID NO: 1345587 - RNA, 16 nt, Homo sapiens
cagugacagugcccag

SEQ ID NO: 1345588 - RNA, 16 nt, Homo sapiens
cagugacgcugcugac

SEQ ID NO: 1345589 - RNA, 18 nt, Homo sapiens
cagugaugacuauucuca

SEQ ID NO: 1345590 - RNA, 22 nt, Homo sapiens
cagugcaguuucuuuucacauu

SEQ ID NO: 1345591 - RNA, 17 nt, Homo sapiens
cagugcaucauuacugu

SEQ ID NO: 1345592 - RNA, 16 nt, Homo sapiens
cagugcccucauuuua

SEQ ID NO: 1345593 - RNA, 22 nt, Homo sapiens
cagugcuccccaauuauaucuc

SEQ ID NO: 1345594 - RNA, 23 nt, Homo sapiens
caguggaucuucagaacugcccu

SEQ ID NO: 1345595 - RNA, 18 nt, Homo sapiens
cagugguaaaaguauuug

SEQ ID NO: 1345596 - RNA, 20 nt, Homo sapiens
cagugugagcauuugucucu

SEQ ID NO: 1345597 - RNA, 20 nt, Homo sapiens
cagugugcaauacuguguac

SEQ ID NO: 1345598 - RNA, 19 nt, Homo sapiens
caguguuauuuauucccca

SEQ ID NO: 1345599 - RNA, 17 nt, Homo sapiens
caguucaaaaacaagac

SEQ ID NO: 1345600 - RNA, 12 nt, Homo sapiens
caguucaucacc

SEQ ID NO: 1345601 - RNA, 15 nt, Homo sapiens
caguuccaaaagaga

SEQ ID NO: 1345602 - RNA, 17 nt, Homo sapiens
caguugaucagacugaa

SEQ ID NO: 1345603 - RNA, 23 nt, Homo sapiens
caguugguuuggauuuuuggacc

SEQ ID NO: 1345604 - RNA, 22 nt, Homo sapiens
caguuguagcagaaaccaacaa

SEQ ID NO: 1345605 - RNA, 23 nt, Homo sapiens
caguuguuaaaaugagcauugau

SEQ ID NO: 1345606 - RNA, 14 nt, Homo sapiens
caguuuacaguauu

SEQ ID NO: 1345607 - RNA, 18 nt, Homo sapiens
caguuucuaggcaccuca

SEQ ID NO: 1345608 - RNA, 17 nt, Homo sapiens
caguuuuagauacucau

SEQ ID NO: 1345609 - RNA, 14 nt, Homo sapiens
caguuuugccugag

SEQ ID NO: 1345610 - RNA, 20 nt, Homo sapiens
cauaaaaugauccugccaau

SEQ ID NO: 1345611 - RNA, 15 nt, Homo sapiens
cauaaacacauuucc

SEQ ID NO: 1345612 - RNA, 21 nt, Homo sapiens
cauaaagacaaucacugccaa

SEQ ID NO: 1345613 - RNA, 17 nt, Homo sapiens
cauaaauaaaguuucag

SEQ ID NO: 1345614 - RNA, 14 nt, Homo sapiens
cauaacauggguac

SEQ ID NO: 1345615 - RNA, 22 nt, Homo sapiens
cauaacggaaaaauaauugcca

SEQ ID NO: 1345616 - RNA, 21 nt, Homo sapiens
cauaagugaaaaucuuacaac

SEQ ID NO: 1345617 - RNA, 18 nt, Homo sapiens
cauaaguuaacuuccaau

SEQ ID NO: 1345618 - RNA, 20 nt, Homo sapiens
cauaauaaaucacacauuca

SEQ ID NO: 1345619 - RNA, 14 nt, Homo sapiens
cauaauucagcacu

SEQ ID NO: 1345620 - RNA, 15 nt, Homo sapiens
cauaauucagcacuu

SEQ ID NO: 1345621 - RNA, 22 nt, Homo sapiens
cauaauucugaaacaacuugcc

SEQ ID NO: 1345622 - RNA, 13 nt, Homo sapiens
cauacaccagcau

SEQ ID NO: 1345623 - RNA, 21 nt, Homo sapiens
cauaccuggcccugugccuug

SEQ ID NO: 1345624 - RNA, 12 nt, Homo sapiens
cauacuaugaaa

SEQ ID NO: 1345625 - RNA, 13 nt, Homo sapiens
cauacugcuggag

SEQ ID NO: 1345626 - RNA, 21 nt, Homo sapiens
cauacugcuggaguccagugc

SEQ ID NO: 1345627 - RNA, 21 nt, Homo sapiens
cauagaaauuacacccaaaga

SEQ ID NO: 1345628 - RNA, 15 nt, Homo sapiens
cauagaaucugugac

SEQ ID NO: 1345629 - RNA, 21 nt, Homo sapiens
cauaggugcaguuugcuucua

SEQ ID NO: 1345630 - RNA, 20 nt, Homo sapiens
cauagugauagagugcagug

SEQ ID NO: 1345631 - RNA, 11 nt, Homo sapiens
cauaguguacc

SEQ ID NO: 1345632 - RNA, 22 nt, Homo sapiens
cauauaauuuucacuucugucu

SEQ ID NO: 1345633 - RNA, 22 nt, Homo sapiens
cauauauaaauuauuacuuuaa

SEQ ID NO: 1345634 - RNA, 16 nt, Homo sapiens
cauaucccuuccucuc

SEQ ID NO: 1345635 - RNA, 11 nt, Homo sapiens
cauaucugacu

SEQ ID NO: 1345636 - RNA, 23 nt, Homo sapiens
cauaucugcuuaucagugugcaa

SEQ ID NO: 1345637 - RNA, 18 nt, Homo sapiens
cauaugaucuguuuugua

SEQ ID NO: 1345638 - RNA, 16 nt, Homo sapiens
cauauguaucuauaca

SEQ ID NO: 1345639 - RNA, 12 nt, Homo sapiens
cauauguggaau

SEQ ID NO: 1345640 - RNA, 22 nt, Homo sapiens
cauauguuguguuugguucaau

SEQ ID NO: 1345641 - RNA, 17 nt, Homo sapiens
cauauugggacucguau

SEQ ID NO: 1345642 - RNA, 16 nt, Homo sapiens
cauauuuaaugaugau

SEQ ID NO: 1345643 - RNA, 18 nt, Homo sapiens
cauauuugaaaaccauau

SEQ ID NO: 1345644 - RNA, 23 nt, Homo sapiens
cauauuuugguuuguguauccau

SEQ ID NO: 1345645 - RNA, 21 nt, Homo sapiens
caucaaaaaaacaaguuuaga

SEQ ID NO: 1345646 - RNA, 21 nt, Homo sapiens
caucaauaaauguugcaaugc

SEQ ID NO: 1345647 - RNA, 15 nt, Homo sapiens
caucacuguauccau

SEQ ID NO: 1345648 - RNA, 23 nt, Homo sapiens
caucagccccacaggacuuugau

SEQ ID NO: 1345649 - RNA, 20 nt, Homo sapiens
caucagcugcugaaacaaca

SEQ ID NO: 1345650 - RNA, 20 nt, Homo sapiens
caucagcuugcccuguuaaa

SEQ ID NO: 1345651 - RNA, 13 nt, Homo sapiens
caucaggacucug

SEQ ID NO: 1345652 - RNA, 15 nt, Homo sapiens
caucaggacucugac

SEQ ID NO: 1345653 - RNA, 14 nt, Homo sapiens
caucagucaacaga

SEQ ID NO: 1345654 - RNA, 21 nt, Homo sapiens
caucaugcccucucucgggag

SEQ ID NO: 1345655 - RNA, 22 nt, Homo sapiens
caucauuacuguuccagauucc

SEQ ID NO: 1345656 - RNA, 12 nt, Homo sapiens
caucauuucagc

SEQ ID NO: 1345657 - RNA, 16 nt, Homo sapiens
cauccaaggcuguuac

SEQ ID NO: 1345658 - RNA, 18 nt, Homo sapiens
cauccaaggcuguuacca

SEQ ID NO: 1345659 - RNA, 23 nt, Homo sapiens
cauccaaggcuguuaccauuuua

SEQ ID NO: 1345660 - RNA, 17 nt, Homo sapiens
cauccaguucaugagaa

SEQ ID NO: 1345661 - RNA, 23 nt, Homo sapiens
cauccaugcugugcuguguuauu

SEQ ID NO: 1345662 - RNA, 12 nt, Homo sapiens
cauccauucuuc

SEQ ID NO: 1345663 - RNA, 18 nt, Homo sapiens
cauccauucuucccuuga

SEQ ID NO: 1345664 - RNA, 16 nt, Homo sapiens
caucccacugcucccc

SEQ ID NO: 1345665 - RNA, 22 nt, Homo sapiens
cauccgaagaugguggccacag

SEQ ID NO: 1345666 - RNA, 20 nt, Homo sapiens
cauccucagguggucaggcg

SEQ ID NO: 1345667 - RNA, 23 nt, Homo sapiens
cauccuuaaaacaauucugugac

SEQ ID NO: 1345668 - RNA, 24 nt, Homo sapiens
cauccuuggaaauuggaagagcac

SEQ ID NO: 1345669 - RNA, 20 nt, Homo sapiens
caucgcaggaugacagcucc

SEQ ID NO: 1345670 - RNA, 17 nt, Homo sapiens
caucgccgggacuccag

SEQ ID NO: 1345671 - RNA, 18 nt, Homo sapiens
caucggucuaaagcuuug

SEQ ID NO: 1345672 - RNA, 18 nt, Homo sapiens
cacuugccuaugauacug

SEQ ID NO: 1345673 - RNA, 20 nt, Homo sapiens
cacuuggagcuaaaacuggc

SEQ ID NO: 1345674 - RNA, 21 nt, Homo sapiens
cacuuggagcuaaaacuggcc

SEQ ID NO: 1345675 - RNA, 21 nt, Homo sapiens
cacuuuauauuuuccucuuag

SEQ ID NO: 1345676 - RNA, 17 nt, Homo sapiens
cacuuugggaggccaag

SEQ ID NO: 1345677 - RNA, 22 nt, Homo sapiens
cagaaaaaaauaaauguucuaa

SEQ ID NO: 1345678 - RNA, 18 nt, Homo sapiens
cagaaaaauaagucaaaa

SEQ ID NO: 1345679 - RNA, 20 nt, Homo sapiens
cagaaaguagaauagugguu

SEQ ID NO: 1345680 - RNA, 21 nt, Homo sapiens
cagaacacagcaauuccucag

SEQ ID NO: 1345681 - RNA, 22 nt, Homo sapiens
cagaacagugguggcaacauuc

SEQ ID NO: 1345682 - RNA, 17 nt, Homo sapiens
cagaaccccuacaugaa

SEQ ID NO: 1345683 - RNA, 16 nt, Homo sapiens
cagaagaugccagcuu

SEQ ID NO: 1345684 - RNA, 19 nt, Homo sapiens
cagaagcagcagaccuccu

SEQ ID NO: 1345685 - RNA, 13 nt, Homo sapiens
cagaagcuuaaaa

SEQ ID NO: 1345686 - RNA, 13 nt, Homo sapiens
cagaaggacucag

SEQ ID NO: 1345687 - RNA, 20 nt, Homo sapiens
cagaaggauuaccugaggca

SEQ ID NO: 1345688 - RNA, 15 nt, Homo sapiens
cagaagguugcucua

SEQ ID NO: 1345689 - RNA, 21 nt, Homo sapiens
cagaaguugaaguagcuuuua

SEQ ID NO: 1345690 - RNA, 13 nt, Homo sapiens
cagaaucuuuuca

SEQ ID NO: 1345691 - RNA, 12 nt, Homo sapiens
cagaauugcuca

SEQ ID NO: 1345692 - RNA, 13 nt, Homo sapiens
cagaauuuuccau

SEQ ID NO: 1345693 - RNA, 16 nt, Homo sapiens
cagaauuuuccauuua

SEQ ID NO: 1345694 - RNA, 15 nt, Homo sapiens
cagacaacacuggga

SEQ ID NO: 1345695 - RNA, 16 nt, Homo sapiens
cagacaacacugggaa

SEQ ID NO: 1345696 - RNA, 21 nt, Homo sapiens
cagacaacacugggaaacaga

SEQ ID NO: 1345697 - RNA, 13 nt, Homo sapiens
cagacaauuccau

SEQ ID NO: 1345698 - RNA, 18 nt, Homo sapiens
cagaccugcauugaacag

SEQ ID NO: 1345699 - RNA, 21 nt, Homo sapiens
cagacuagaaguuccuaguga

SEQ ID NO: 1345700 - RNA, 14 nt, Homo sapiens
cagacucgggacca

SEQ ID NO: 1345701 - RNA, 19 nt, Homo sapiens
cagacucuggggguggaca

SEQ ID NO: 1345702 - RNA, 23 nt, Homo sapiens
cagagaaaggggagcccacuguc

SEQ ID NO: 1345703 - RNA, 15 nt, Homo sapiens
cagagaaccaaaggg

SEQ ID NO: 1345704 - RNA, 19 nt, Homo sapiens
cagagaacugccuuaaaaa

SEQ ID NO: 1345705 - RNA, 21 nt, Homo sapiens
cagagaagauucuuguauuua

SEQ ID NO: 1345706 - RNA, 21 nt, Homo sapiens
cagagagcugcccuucagcga

SEQ ID NO: 1345707 - RNA, 17 nt, Homo sapiens
cagagaggggcagggaa

SEQ ID NO: 1345708 - RNA, 16 nt, Homo sapiens
cagagagguagcacuc

SEQ ID NO: 1345709 - RNA, 20 nt, Homo sapiens
cagagagguggggauccugc

SEQ ID NO: 1345710 - RNA, 22 nt, Homo sapiens
cagagccguggccacccaggaa

SEQ ID NO: 1345711 - RNA, 12 nt, Homo sapiens
cagagcucccuc

SEQ ID NO: 1345712 - RNA, 17 nt, Homo sapiens
cagaggaacuccagaga

SEQ ID NO: 1345713 - RNA, 19 nt, Homo sapiens
cagaggagccaccaguucu

SEQ ID NO: 1345714 - RNA, 23 nt, Homo sapiens
cagagggccccgcccagugcagu

SEQ ID NO: 1345715 - RNA, 12 nt, Homo sapiens
cagagugcaagc

SEQ ID NO: 1345716 - RNA, 19 nt, Homo sapiens
cagaucugcaccaccaugc

SEQ ID NO: 1345717 - RNA, 21 nt, Homo sapiens
cagaucuuucuccuugaauau

SEQ ID NO: 1345718 - RNA, 20 nt, Homo sapiens
cagaugcugagccaacugcu

SEQ ID NO: 1345719 - RNA, 15 nt, Homo sapiens
cagauggcagguuug

SEQ ID NO: 1345720 - RNA, 20 nt, Homo sapiens
cagauuaguucuuuuugcca

SEQ ID NO: 1345721 - RNA, 19 nt, Homo sapiens
cagauucuucacuguguuu

SEQ ID NO: 1345722 - RNA, 20 nt, Homo sapiens
cagcaauuuaaauguuauga

SEQ ID NO: 1345723 - RNA, 20 nt, Homo sapiens
cagcaccugcgggagcugca

SEQ ID NO: 1345724 - RNA, 13 nt, Homo sapiens
cagcacuggugaa

SEQ ID NO: 1345725 - RNA, 16 nt, Homo sapiens
cagcacuuguguuguc

SEQ ID NO: 1345726 - RNA, 18 nt, Homo sapiens
cagcagacugguuugcag

SEQ ID NO: 1345727 - RNA, 22 nt, Homo sapiens
cagcagaggcguacuacccagc

SEQ ID NO: 1345728 - RNA, 22 nt, Homo sapiens
cagcagaugcuguugugaagcu

SEQ ID NO: 1345729 - RNA, 16 nt, Homo sapiens
cagcagccccaggaga

SEQ ID NO: 1345730 - RNA, 21 nt, Homo sapiens
cagcagccccccuugccccac

SEQ ID NO: 1345731 - RNA, 19 nt, Homo sapiens
cagcaggcucaggcacaua

SEQ ID NO: 1345732 - RNA, 12 nt, Homo sapiens
cagcaugaauaa

SEQ ID NO: 1345733 - RNA, 17 nt, Homo sapiens
cagcauucucacuccua

SEQ ID NO: 1345734 - RNA, 13 nt, Homo sapiens
cagccauuuucca

SEQ ID NO: 1345735 - RNA, 13 nt, Homo sapiens
cagcccagagcca

SEQ ID NO: 1345736 - RNA, 21 nt, Homo sapiens
cagcccagccccuccaaaggu

SEQ ID NO: 1345737 - RNA, 16 nt, Homo sapiens
cagccccuccaaaggu

SEQ ID NO: 1345738 - RNA, 13 nt, Homo sapiens
cagcccugcacca

SEQ ID NO: 1345739 - RNA, 19 nt, Homo sapiens
cagcccugcgccaccucac

SEQ ID NO: 1345740 - RNA, 23 nt, Homo sapiens
cagcccugcgccaccucacugca

SEQ ID NO: 1345741 - RNA, 15 nt, Homo sapiens
cagccuagauaugaa

SEQ ID NO: 1345742 - RNA, 17 nt, Homo sapiens
cagccuagauaugaaga

SEQ ID NO: 1345743 - RNA, 13 nt, Homo sapiens
cagccucaaguca

SEQ ID NO: 1345744 - RNA, 20 nt, Homo sapiens
cagccuccugaguagcugga

SEQ ID NO: 1345745 - RNA, 14 nt, Homo sapiens
cagccucugccagc

SEQ ID NO: 1345746 - RNA, 22 nt, Homo sapiens
cagccucugggucugagucaug

SEQ ID NO: 1345747 - RNA, 13 nt, Homo sapiens
cagccugccuuua

SEQ ID NO: 1345748 - RNA, 20 nt, Homo sapiens
cagccugggcaacauaguga

SEQ ID NO: 1345749 - RNA, 14 nt, Homo sapiens
cagccuugccagag

SEQ ID NO: 1345750 - RNA, 22 nt, Homo sapiens
cagccuuugcccaaaacuguca

SEQ ID NO: 1345751 - RNA, 18 nt, Homo sapiens
cagcgcaugugugcaugu

SEQ ID NO: 1345752 - RNA, 20 nt, Homo sapiens
cagcggguacuuauuucuca

SEQ ID NO: 1345753 - RNA, 23 nt, Homo sapiens
cagcuaccucaaccaaugccaaa

SEQ ID NO: 1345754 - RNA, 24 nt, Homo sapiens
cagcuacuuggaaggcugaggcag

SEQ ID NO: 1345755 - RNA, 20 nt, Homo sapiens
cagcuagaaaaggccuucuu

SEQ ID NO: 1345756 - RNA, 21 nt, Homo sapiens
cagcuauuuagaagcaucauc

SEQ ID NO: 1345757 - RNA, 19 nt, Homo sapiens
cagcucagggacuggcaca

SEQ ID NO: 1345758 - RNA, 18 nt, Homo sapiens
cagcuccaaccugcaaag

SEQ ID NO: 1345759 - RNA, 13 nt, Homo sapiens
cagcucuggagaa

SEQ ID NO: 1345760 - RNA, 19 nt, Homo sapiens
cagcucuuccgaaaaccag

SEQ ID NO: 1345761 - RNA, 22 nt, Homo sapiens
cagcucuuggcuccacugggau

SEQ ID NO: 1345762 - RNA, 23 nt, Homo sapiens
cagcugauugggcaccugaccac

SEQ ID NO: 1345763 - RNA, 15 nt, Homo sapiens
cagcugugcacuuuc

SEQ ID NO: 1345764 - RNA, 16 nt, Homo sapiens
cagcuucaacuuuucu

SEQ ID NO: 1345765 - RNA, 19 nt, Homo sapiens
cagcuucucucuccagggu

SEQ ID NO: 1345766 - RNA, 17 nt, Homo sapiens
cagcuucuucacaggca

SEQ ID NO: 1345767 - RNA, 19 nt, Homo sapiens
cagcuuugcuaccaaagca

SEQ ID NO: 1345768 - RNA, 21 nt, Homo sapiens
cagcuuuuuauucccugccca

SEQ ID NO: 1345769 - RNA, 20 nt, Homo sapiens
caggaaagugugaagaccca

SEQ ID NO: 1345770 - RNA, 17 nt, Homo sapiens
caggaaauacuuuguaa

SEQ ID NO: 1345771 - RNA, 19 nt, Homo sapiens
caggaaaucaaauaugcaa

SEQ ID NO: 1345772 - RNA, 12 nt, Homo sapiens
caggaaauuacu

SEQ ID NO: 1345773 - RNA, 15 nt, Homo sapiens
caggaaggaccccac

SEQ ID NO: 1345774 - RNA, 19 nt, Homo sapiens
caggaagggagaacuugaa

SEQ ID NO: 1345775 - RNA, 23 nt, Homo sapiens
caggacguuagacuguugggaca

SEQ ID NO: 1345776 - RNA, 19 nt, Homo sapiens
caggacucugacgucucuu

SEQ ID NO: 1345777 - RNA, 14 nt, Homo sapiens
caggagacaguuca

SEQ ID NO: 1345778 - RNA, 19 nt, Homo sapiens
caggaguauccucuugcca

SEQ ID NO: 1345779 - RNA, 13 nt, Homo sapiens
caggagucccugc

SEQ ID NO: 1345780 - RNA, 21 nt, Homo sapiens
caggaguucagggucauagca

SEQ ID NO: 1345781 - RNA, 17 nt, Homo sapiens
caggauaagagggauua

SEQ ID NO: 1345782 - RNA, 22 nt, Homo sapiens
caggauacaggugacagugaag

SEQ ID NO: 1345783 - RNA, 16 nt, Homo sapiens
caggauccagugacau

SEQ ID NO: 1345784 - RNA, 15 nt, Homo sapiens
caggauguacaaaga

SEQ ID NO: 1345785 - RNA, 16 nt, Homo sapiens
caggauuaacuaaaga

SEQ ID NO: 1345786 - RNA, 18 nt, Homo sapiens
caggcaacgcacaaaaca

SEQ ID NO: 1345787 - RNA, 17 nt, Homo sapiens
caggcacacaggucuca

SEQ ID NO: 1345788 - RNA, 14 nt, Homo sapiens
caggcacuccugga

SEQ ID NO: 1345789 - RNA, 15 nt, Homo sapiens
caggcacugcugccc

SEQ ID NO: 1345790 - RNA, 15 nt, Homo sapiens
caggcagauccagga

SEQ ID NO: 1345791 - RNA, 18 nt, Homo sapiens
caggcagccugccuuuaa

SEQ ID NO: 1345792 - RNA, 14 nt, Homo sapiens
caggcagcugccug

SEQ ID NO: 1345793 - RNA, 22 nt, Homo sapiens
caggcaugugccacccacccaa

SEQ ID NO: 1345794 - RNA, 12 nt, Homo sapiens
caggccagagaa

SEQ ID NO: 1345795 - RNA, 16 nt, Homo sapiens
caggccagcaagcucu

SEQ ID NO: 1345796 - RNA, 15 nt, Homo sapiens
caggccaggccagcu

SEQ ID NO: 1345797 - RNA, 18 nt, Homo sapiens
caggccauugucccugaa

SEQ ID NO: 1345798 - RNA, 16 nt, Homo sapiens
caggccccaccggcca

SEQ ID NO: 1345799 - RNA, 18 nt, Homo sapiens
caggccuuaccgcucugu

SEQ ID NO: 1345800 - RNA, 23 nt, Homo sapiens
caggcugagaacucguucaccuc

SEQ ID NO: 1345801 - RNA, 19 nt, Homo sapiens
caggcuggaaguacuuggc

SEQ ID NO: 1345802 - RNA, 20 nt, Homo sapiens
caggcuggagugcaaugaca

SEQ ID NO: 1345803 - RNA, 20 nt, Homo sapiens
caggcuugaaucaaagaacu

SEQ ID NO: 1345804 - RNA, 14 nt, Homo sapiens
caggcuuggcaaag

SEQ ID NO: 1345805 - RNA, 20 nt, Homo sapiens
caauccuccuaccucagccu

SEQ ID NO: 1345806 - RNA, 14 nt, Homo sapiens
caaucuauucugua

SEQ ID NO: 1345807 - RNA, 21 nt, Homo sapiens
caaucugcaaaaaaaugugca

SEQ ID NO: 1345808 - RNA, 15 nt, Homo sapiens
caaucuuucaugucu

SEQ ID NO: 1345809 - RNA, 20 nt, Homo sapiens
caaucuuucaugucuuguca

SEQ ID NO: 1345810 - RNA, 23 nt, Homo sapiens
caaucuuucaugucuugucauac

SEQ ID NO: 1345811 - RNA, 17 nt, Homo sapiens
caaugacacccaugcca

SEQ ID NO: 1345812 - RNA, 19 nt, Homo sapiens
caaugacugagcagcaucc

SEQ ID NO: 1345813 - RNA, 17 nt, Homo sapiens
caaugagaucauuguga

SEQ ID NO: 1345814 - RNA, 13 nt, Homo sapiens
caaugccaaaagg

SEQ ID NO: 1345815 - RNA, 21 nt, Homo sapiens
caauggaguggcugccaugga

SEQ ID NO: 1345816 - RNA, 15 nt, Homo sapiens
caaugguugaugaua

SEQ ID NO: 1345817 - RNA, 21 nt, Homo sapiens
caauguaguuuuauuacacau

SEQ ID NO: 1345818 - RNA, 20 nt, Homo sapiens
caauguccaaacccacucau

SEQ ID NO: 1345819 - RNA, 18 nt, Homo sapiens
caaugucucuuugugcuc

SEQ ID NO: 1345820 - RNA, 16 nt, Homo sapiens
caauucaugguucaag

SEQ ID NO: 1345821 - RNA, 23 nt, Homo sapiens
caauucugcccgcuccauggaaa

SEQ ID NO: 1345822 - RNA, 12 nt, Homo sapiens
caauucugugac

SEQ ID NO: 1345823 - RNA, 20 nt, Homo sapiens
caauucugugacauacauau

SEQ ID NO: 1345824 - RNA, 13 nt, Homo sapiens
caauuuagacaaa

SEQ ID NO: 1345825 - RNA, 22 nt, Homo sapiens
caauuucgggagccuugucagu

SEQ ID NO: 1345826 - RNA, 14 nt, Homo sapiens
caauuuucuauuua

SEQ ID NO: 1345827 - RNA, 23 nt, Homo sapiens
caauuuucuuuuuuauacucaau

SEQ ID NO: 1345828 - RNA, 18 nt, Homo sapiens
cacaaagcccuuccaugu

SEQ ID NO: 1345829 - RNA, 13 nt, Homo sapiens
cacaacagugaaa

SEQ ID NO: 1345830 - RNA, 21 nt, Homo sapiens
cacaacuccuacaugauguua

SEQ ID NO: 1345831 - RNA, 21 nt, Homo sapiens
cacaagacuggcccagugcca

SEQ ID NO: 1345832 - RNA, 22 nt, Homo sapiens
cacaagcgaaucucugccuuuc

SEQ ID NO: 1345833 - RNA, 16 nt, Homo sapiens
cacaaggacuuccugu

SEQ ID NO: 1345834 - RNA, 22 nt, Homo sapiens
cacaauaggucuuucucucagu

SEQ ID NO: 1345835 - RNA, 16 nt, Homo sapiens
cacaauugaacuucca

SEQ ID NO: 1345836 - RNA, 15 nt, Homo sapiens
cacacacacagaugu

SEQ ID NO: 1345837 - RNA, 20 nt, Homo sapiens
cacacaccaaguaccaguau

SEQ ID NO: 1345838 - RNA, 16 nt, Homo sapiens
cacacagccaauccaa

SEQ ID NO: 1345839 - RNA, 15 nt, Homo sapiens
cacacaggucucauu

SEQ ID NO: 1345840 - RNA, 16 nt, Homo sapiens
cacaccacaaauggga

SEQ ID NO: 1345841 - RNA, 19 nt, Homo sapiens
cacacccgugugcacacuc

SEQ ID NO: 1345842 - RNA, 19 nt, Homo sapiens
cacaccucuccuuugugac

SEQ ID NO: 1345843 - RNA, 17 nt, Homo sapiens
cacaccugaacuugccu

SEQ ID NO: 1345844 - RNA, 22 nt, Homo sapiens
cacaccugggcauuuggugaga

SEQ ID NO: 1345845 - RNA, 13 nt, Homo sapiens
cacacgcacucuc

SEQ ID NO: 1345846 - RNA, 20 nt, Homo sapiens
cacacuaguuuaugcuaccu

SEQ ID NO: 1345847 - RNA, 23 nt, Homo sapiens
cacacugguaaauguuaccucua

SEQ ID NO: 1345848 - RNA, 20 nt, Homo sapiens
cacagaacacagcaauuccu

SEQ ID NO: 1345849 - RNA, 22 nt, Homo sapiens
cacagaauuguuccaguacuau

SEQ ID NO: 1345850 - RNA, 21 nt, Homo sapiens
cacagacauccucuaugccag

SEQ ID NO: 1345851 - RNA, 15 nt, Homo sapiens
cacagacugaccccc

SEQ ID NO: 1345852 - RNA, 16 nt, Homo sapiens
cacagacugcgauuug

SEQ ID NO: 1345853 - RNA, 15 nt, Homo sapiens
cacagaggacucacu

SEQ ID NO: 1345854 - RNA, 16 nt, Homo sapiens
cacagauaaaguuuuc

SEQ ID NO: 1345855 - RNA, 15 nt, Homo sapiens
cacagaucccgggga

SEQ ID NO: 1345856 - RNA, 15 nt, Homo sapiens
cacagggacugaaaa

SEQ ID NO: 1345857 - RNA, 24 nt, Homo sapiens
cacagguguguuucccaucccacu

SEQ ID NO: 1345858 - RNA, 15 nt, Homo sapiens
cacagucuuggcuca

SEQ ID NO: 1345859 - RNA, 15 nt, Homo sapiens
cacagugcaucucag

SEQ ID NO: 1345860 - RNA, 21 nt, Homo sapiens
cacagugcuauuugcauuucu

SEQ ID NO: 1345861 - RNA, 15 nt, Homo sapiens
cacaguggcuucaca

SEQ ID NO: 1345862 - RNA, 17 nt, Homo sapiens
cacauaacuacaccuga

SEQ ID NO: 1345863 - RNA, 19 nt, Homo sapiens
cacauaagcccaguucauc

SEQ ID NO: 1345864 - RNA, 22 nt, Homo sapiens
cacauacccucacuuaaacuuu

SEQ ID NO: 1345865 - RNA, 23 nt, Homo sapiens
cacauaccuggcccugugccuug

SEQ ID NO: 1345866 - RNA, 15 nt, Homo sapiens
cacaucucagggaac

SEQ ID NO: 1345867 - RNA, 22 nt, Homo sapiens
cacaucuccuguggucucugac

SEQ ID NO: 1345868 - RNA, 21 nt, Homo sapiens
cacaugauuuuacucauaugu

SEQ ID NO: 1345869 - RNA, 13 nt, Homo sapiens
cacaugcccauga

SEQ ID NO: 1345870 - RNA, 15 nt, Homo sapiens
cacaugcuacaagac

SEQ ID NO: 1345871 - RNA, 21 nt, Homo sapiens
cacaugguuacauaucaaaac

SEQ ID NO: 1345872 - RNA, 16 nt, Homo sapiens
cacauguuuaacuuua

SEQ ID NO: 1345873 - RNA, 18 nt, Homo sapiens
cacauuaaauguggaagg

SEQ ID NO: 1345874 - RNA, 19 nt, Homo sapiens
cacauucaauagcauauca

SEQ ID NO: 1345875 - RNA, 19 nt, Homo sapiens
cacauucaugugggcauuu

SEQ ID NO: 1345876 - RNA, 23 nt, Homo sapiens
caccaagcaggcaaauagcuuua

SEQ ID NO: 1345877 - RNA, 17 nt, Homo sapiens
caccaauaucaguccuc

SEQ ID NO: 1345878 - RNA, 17 nt, Homo sapiens
caccaaucauaguguac

SEQ ID NO: 1345879 - RNA, 21 nt, Homo sapiens
caccaccucugugggcacugg

SEQ ID NO: 1345880 - RNA, 23 nt, Homo sapiens
caccacuaacaugcccuguucag

SEQ ID NO: 1345881 - RNA, 17 nt, Homo sapiens
caccaguguuccugaag

SEQ ID NO: 1345882 - RNA, 11 nt, Homo sapiens
caccaguucuc

SEQ ID NO: 1345883 - RNA, 21 nt, Homo sapiens
caccaugacccucuuccucau

SEQ ID NO: 1345884 - RNA, 15 nt, Homo sapiens
caccauuaggucacu

SEQ ID NO: 1345885 - RNA, 20 nt, Homo sapiens
caccauuaggucacuuaaga

SEQ ID NO: 1345886 - RNA, 14 nt, Homo sapiens
cacccacucugcac

SEQ ID NO: 1345887 - RNA, 20 nt, Homo sapiens
cacccaggcuggaguacagc

SEQ ID NO: 1345888 - RNA, 16 nt, Homo sapiens
cacccaugccagagag

SEQ ID NO: 1345889 - RNA, 19 nt, Homo sapiens
caccccaucuuugcugcca

SEQ ID NO: 1345890 - RNA, 14 nt, Homo sapiens
cacccccgugucca

SEQ ID NO: 1345891 - RNA, 16 nt, Homo sapiens
cacccccuuguuguaa

SEQ ID NO: 1345892 - RNA, 16 nt, Homo sapiens
caccccgagggcugag

SEQ ID NO: 1345893 - RNA, 20 nt, Homo sapiens
cacccucauucuacugaaaa

SEQ ID NO: 1345894 - RNA, 19 nt, Homo sapiens
cacccuggaugcuguugag

SEQ ID NO: 1345895 - RNA, 14 nt, Homo sapiens
caccuaucaacaga

SEQ ID NO: 1345896 - RNA, 23 nt, Homo sapiens
caccucccccuuucacacuggau

SEQ ID NO: 1345897 - RNA, 21 nt, Homo sapiens
caccucugugggcacuggugg

SEQ ID NO: 1345898 - RNA, 22 nt, Homo sapiens
caccugagacaugcugaaauua

SEQ ID NO: 1345899 - RNA, 14 nt, Homo sapiens
caccugcuccagaa

SEQ ID NO: 1345900 - RNA, 20 nt, Homo sapiens
caccuggagaguacauuugc

SEQ ID NO: 1345901 - RNA, 21 nt, Homo sapiens
caccuggaugucugggugacc

SEQ ID NO: 1345902 - RNA, 18 nt, Homo sapiens
caccuggucgccaaucca

SEQ ID NO: 1345903 - RNA, 23 nt, Homo sapiens
caccugguggauaccugguugag

SEQ ID NO: 1345904 - RNA, 22 nt, Homo sapiens
cacggaguggcuugagcuucug

SEQ ID NO: 1345905 - RNA, 20 nt, Homo sapiens
cacuaaccaaaucucucaaa

SEQ ID NO: 1345906 - RNA, 20 nt, Homo sapiens
cacuacaucugggacugacu

SEQ ID NO: 1345907 - RNA, 16 nt, Homo sapiens
cacuaccguaaauguc

SEQ ID NO: 1345908 - RNA, 12 nt, Homo sapiens
cacuaugccuga

SEQ ID NO: 1345909 - RNA, 16 nt, Homo sapiens
cacuaugccugacuaa

SEQ ID NO: 1345910 - RNA, 20 nt, Homo sapiens
cacucagcucuuggcuccac

SEQ ID NO: 1345911 - RNA, 12 nt, Homo sapiens
cacucagucucu

SEQ ID NO: 1345912 - RNA, 17 nt, Homo sapiens
cacucauacacaugugc

SEQ ID NO: 1345913 - RNA, 14 nt, Homo sapiens
cacucauauugccc

SEQ ID NO: 1345914 - RNA, 19 nt, Homo sapiens
cacucccaugugcugacuc

SEQ ID NO: 1345915 - RNA, 23 nt, Homo sapiens
cacuccguccauccgacugcccc

SEQ ID NO: 1345916 - RNA, 16 nt, Homo sapiens
cacuccgucugcucca

SEQ ID NO: 1345917 - RNA, 22 nt, Homo sapiens
cacucuuaucuacauaaggaug

SEQ ID NO: 1345918 - RNA, 23 nt, Homo sapiens
cacugaaaaaucuaagugauaua

SEQ ID NO: 1345919 - RNA, 14 nt, Homo sapiens
cacugaagcuaaaa

SEQ ID NO: 1345920 - RNA, 16 nt, Homo sapiens
cacugaagucaccauu

SEQ ID NO: 1345921 - RNA, 17 nt, Homo sapiens
cacugaggaccagccau

SEQ ID NO: 1345922 - RNA, 23 nt, Homo sapiens
cacugcaguagugcaccaucuca

SEQ ID NO: 1345923 - RNA, 11 nt, Homo sapiens
cacugcuguua

SEQ ID NO: 1345924 - RNA, 16 nt, Homo sapiens
cacuggaccucagucc

SEQ ID NO: 1345925 - RNA, 15 nt, Homo sapiens
cacuggccggaguca

SEQ ID NO: 1345926 - RNA, 17 nt, Homo sapiens
cacugggccugucacug

SEQ ID NO: 1345927 - RNA, 20 nt, Homo sapiens
cacuggggcguuuccuacug

SEQ ID NO: 1345928 - RNA, 21 nt, Homo sapiens
cacugggugagagaggaauaa

SEQ ID NO: 1345929 - RNA, 18 nt, Homo sapiens
cacuguaccgacuuugau

SEQ ID NO: 1345930 - RNA, 17 nt, Homo sapiens
cacugucaugcugucag

SEQ ID NO: 1345931 - RNA, 16 nt, Homo sapiens
cacugugucauucugu

SEQ ID NO: 1345932 - RNA, 13 nt, Homo sapiens
cacuuaauagcaa

SEQ ID NO: 1345933 - RNA, 20 nt, Homo sapiens
cacuuacugacuuugcauuu

SEQ ID NO: 1345934 - RNA, 17 nt, Homo sapiens
cacuuauaccaugagug

SEQ ID NO: 1345935 - RNA, 21 nt, Homo sapiens
cacuucaaggcucaaugcuau

SEQ ID NO: 1345936 - RNA, 15 nt, Homo sapiens
cacuuccugagccag

SEQ ID NO: 1345937 - RNA, 16 nt, Homo sapiens
cacuugaggccaguga

SEQ ID NO: 1345938 - RNA, 22 nt, Homo sapiens
caaacaaugcauaggauuccaa

SEQ ID NO: 1345939 - RNA, 13 nt, Homo sapiens
caaacacuugagg

SEQ ID NO: 1345940 - RNA, 22 nt, Homo sapiens
caaacugcuuccuuucuugauu

SEQ ID NO: 1345941 - RNA, 12 nt, Homo sapiens
caaacuggcuua

SEQ ID NO: 1345942 - RNA, 14 nt, Homo sapiens
caaacuucccugac

SEQ ID NO: 1345943 - RNA, 14 nt, Homo sapiens
caaacuuguucaaa

SEQ ID NO: 1345944 - RNA, 22 nt, Homo sapiens
caaagaaaaugaaaugcauauu

SEQ ID NO: 1345945 - RNA, 14 nt, Homo sapiens
caaagaaaguguau

SEQ ID NO: 1345946 - RNA, 17 nt, Homo sapiens
caaagaacuucuccuac

SEQ ID NO: 1345947 - RNA, 17 nt, Homo sapiens
caaagaggcuguuauaa

SEQ ID NO: 1345948 - RNA, 22 nt, Homo sapiens
caaagaucuguccucagccuug

SEQ ID NO: 1345949 - RNA, 16 nt, Homo sapiens
caaagaugacugugga

SEQ ID NO: 1345950 - RNA, 20 nt, Homo sapiens
caaagcaaaacagacugugu

SEQ ID NO: 1345951 - RNA, 14 nt, Homo sapiens
caaagccacacucu

SEQ ID NO: 1345952 - RNA, 16 nt, Homo sapiens
caaaggaacacugaca

SEQ ID NO: 1345953 - RNA, 16 nt, Homo sapiens
caaaggagccuacucc

SEQ ID NO: 1345954 - RNA, 23 nt, Homo sapiens
caaaggccuaauucuaugccugu

SEQ ID NO: 1345955 - RNA, 21 nt, Homo sapiens
caaagggaaaaaagaguuuaa

SEQ ID NO: 1345956 - RNA, 17 nt, Homo sapiens
caaaguccuccuuucau

SEQ ID NO: 1345957 - RNA, 19 nt, Homo sapiens
caaagugcuggaauuacag

SEQ ID NO: 1345958 - RNA, 19 nt, Homo sapiens
caaaguguggucucuggaa

SEQ ID NO: 1345959 - RNA, 11 nt, Homo sapiens
caaaguucucu

SEQ ID NO: 1345960 - RNA, 16 nt, Homo sapiens
caaauaaacuuacaga

SEQ ID NO: 1345961 - RNA, 15 nt, Homo sapiens
caaauaaagaccuga

SEQ ID NO: 1345962 - RNA, 21 nt, Homo sapiens
caaauaaagaccugagaaccu

SEQ ID NO: 1345963 - RNA, 22 nt, Homo sapiens
caaauaaauguucaauggaugc

SEQ ID NO: 1345964 - RNA, 17 nt, Homo sapiens
caaauaauuccauucca

SEQ ID NO: 1345965 - RNA, 12 nt, Homo sapiens
caaauacaauca

SEQ ID NO: 1345966 - RNA, 12 nt, Homo sapiens
caaauacauucc

SEQ ID NO: 1345967 - RNA, 13 nt, Homo sapiens
caaauacauuccu

SEQ ID NO: 1345968 - RNA, 15 nt, Homo sapiens
caaauaugcaaacca

SEQ ID NO: 1345969 - RNA, 17 nt, Homo sapiens
caaauauguucucugaa

SEQ ID NO: 1345970 - RNA, 17 nt, Homo sapiens
caaauauuauucuuaau

SEQ ID NO: 1345971 - RNA, 17 nt, Homo sapiens
caaaucaaaacucacaa

SEQ ID NO: 1345972 - RNA, 17 nt, Homo sapiens
caaaucaaacauauucu

SEQ ID NO: 1345973 - RNA, 12 nt, Homo sapiens
caaauccagugg

SEQ ID NO: 1345974 - RNA, 17 nt, Homo sapiens
caaaucccucucacaag

SEQ ID NO: 1345975 - RNA, 20 nt, Homo sapiens
caaaucuagaagaugcaguu

SEQ ID NO: 1345976 - RNA, 15 nt, Homo sapiens
caaaucugacauauu

SEQ ID NO: 1345977 - RNA, 20 nt, Homo sapiens
caaaucuugaauuucugcca

SEQ ID NO: 1345978 - RNA, 13 nt, Homo sapiens
caaaugaaaguga

SEQ ID NO: 1345979 - RNA, 14 nt, Homo sapiens
caaaugaacuugca

SEQ ID NO: 1345980 - RNA, 16 nt, Homo sapiens
caaaugccugacucag

SEQ ID NO: 1345981 - RNA, 16 nt, Homo sapiens
caaaugcucucucaaa

SEQ ID NO: 1345982 - RNA, 16 nt, Homo sapiens
caaauggcagaaccaa

SEQ ID NO: 1345983 - RNA, 17 nt, Homo sapiens
caaauggggccagaucc

SEQ ID NO: 1345984 - RNA, 17 nt, Homo sapiens
caaaugugauacauuua

SEQ ID NO: 1345985 - RNA, 20 nt, Homo sapiens
caaauguuuuaaaguuuaau

SEQ ID NO: 1345986 - RNA, 21 nt, Homo sapiens
caaauguuuuucauccauucc

SEQ ID NO: 1345987 - RNA, 16 nt, Homo sapiens
caaauucauggugcac

SEQ ID NO: 1345988 - RNA, 21 nt, Homo sapiens
caaauucauggugcacugagc

SEQ ID NO: 1345989 - RNA, 14 nt, Homo sapiens
caaauugcacugaa

SEQ ID NO: 1345990 - RNA, 21 nt, Homo sapiens
caaauugggaaauccauucca

SEQ ID NO: 1345991 - RNA, 14 nt, Homo sapiens
caacaaacacuuga

SEQ ID NO: 1345992 - RNA, 22 nt, Homo sapiens
caacacgagcaggcuacuguca

SEQ ID NO: 1345993 - RNA, 20 nt, Homo sapiens
caacacuuuuuauguuauau

SEQ ID NO: 1345994 - RNA, 15 nt, Homo sapiens
caacagaaaccagaa

SEQ ID NO: 1345995 - RNA, 23 nt, Homo sapiens
caacagaaaccagaaaagcaaua

SEQ ID NO: 1345996 - RNA, 21 nt, Homo sapiens
caacagagaggggcagggaag

SEQ ID NO: 1345997 - RNA, 19 nt, Homo sapiens
caacagagcgagauuccau

SEQ ID NO: 1345998 - RNA, 19 nt, Homo sapiens
caacaggcuuaugaauaua

SEQ ID NO: 1345999 - RNA, 13 nt, Homo sapiens
caacaucuacaaa

SEQ ID NO: 1346000 - RNA, 18 nt, Homo sapiens
caacauuuguuccaugag

SEQ ID NO: 1346001 - RNA, 19 nt, Homo sapiens
caacccugcccugccccac

SEQ ID NO: 1346002 - RNA, 20 nt, Homo sapiens
caacccuuucauuagaacuu

SEQ ID NO: 1346003 - RNA, 13 nt, Homo sapiens
caaccuccagugu

SEQ ID NO: 1346004 - RNA, 14 nt, Homo sapiens
caaccugaagacac

SEQ ID NO: 1346005 - RNA, 23 nt, Homo sapiens
caaccuggucacaggacucugcc

SEQ ID NO: 1346006 - RNA, 19 nt, Homo sapiens
caacgagugaaacuccguc

SEQ ID NO: 1346007 - RNA, 20 nt, Homo sapiens
caacuacuagugugacuccu

SEQ ID NO: 1346008 - RNA, 14 nt, Homo sapiens
caacuacuauucaa

SEQ ID NO: 1346009 - RNA, 23 nt, Homo sapiens
caacucuaaagccaagcacuuua

SEQ ID NO: 1346010 - RNA, 14 nt, Homo sapiens
caacugaauagcaa

SEQ ID NO: 1346011 - RNA, 10 nt, Homo sapiens
caacugacca

SEQ ID NO: 1346012 - RNA, 17 nt, Homo sapiens
caacugcaaaaaaagcc

SEQ ID NO: 1346013 - RNA, 21 nt, Homo sapiens
caacugcccccgccacaaccc

SEQ ID NO: 1346014 - RNA, 15 nt, Homo sapiens
caacugcgacuguga

SEQ ID NO: 1346015 - RNA, 12 nt, Homo sapiens
caacugcuccau

SEQ ID NO: 1346016 - RNA, 15 nt, Homo sapiens
caacuggaagcuuug

SEQ ID NO: 1346017 - RNA, 20 nt, Homo sapiens
caacuguuucccugcugaau

SEQ ID NO: 1346018 - RNA, 19 nt, Homo sapiens
caacuuuaaaacugcucau

SEQ ID NO: 1346019 - RNA, 18 nt, Homo sapiens
caagaagaggaaagggag

SEQ ID NO: 1346020 - RNA, 13 nt, Homo sapiens
caagaauagcauu

SEQ ID NO: 1346021 - RNA, 13 nt, Homo sapiens
caagaaugcuuua

SEQ ID NO: 1346022 - RNA, 13 nt, Homo sapiens
caagaaugugcag

SEQ ID NO: 1346023 - RNA, 13 nt, Homo sapiens
caagacaagagcu

SEQ ID NO: 1346024 - RNA, 16 nt, Homo sapiens
caagagaaguacuauc

SEQ ID NO: 1346025 - RNA, 20 nt, Homo sapiens
caagagcgcaccauugcacu

SEQ ID NO: 1346026 - RNA, 17 nt, Homo sapiens
caagaggcagugguuug

SEQ ID NO: 1346027 - RNA, 18 nt, Homo sapiens
caagaugugggcagugau

SEQ ID NO: 1346028 - RNA, 16 nt, Homo sapiens
caagcaauucuccugc

SEQ ID NO: 1346029 - RNA, 18 nt, Homo sapiens
caagcaggugaacuggga

SEQ ID NO: 1346030 - RNA, 20 nt, Homo sapiens
caagcauaccaacacgagca

SEQ ID NO: 1346031 - RNA, 19 nt, Homo sapiens
caagcauauguuagcauua

SEQ ID NO: 1346032 - RNA, 12 nt, Homo sapiens
caagcauuucau

SEQ ID NO: 1346033 - RNA, 16 nt, Homo sapiens
caagccccugcuccag

SEQ ID NO: 1346034 - RNA, 20 nt, Homo sapiens
caagcccgcucccugcucag

SEQ ID NO: 1346035 - RNA, 18 nt, Homo sapiens
caagcccuguugacacag

SEQ ID NO: 1346036 - RNA, 18 nt, Homo sapiens
caagccugucuucagaga

SEQ ID NO: 1346037 - RNA, 12 nt, Homo sapiens
caagcucaagug

SEQ ID NO: 1346038 - RNA, 18 nt, Homo sapiens
caagcucacccuucguca

SEQ ID NO: 1346039 - RNA, 15 nt, Homo sapiens
caagcugugcaggca

SEQ ID NO: 1346040 - RNA, 21 nt, Homo sapiens
caaggaaccucaagucaugcu

SEQ ID NO: 1346041 - RNA, 15 nt, Homo sapiens
caaggcagaaagaua

SEQ ID NO: 1346042 - RNA, 18 nt, Homo sapiens
caaggcccccacugccug

SEQ ID NO: 1346043 - RNA, 22 nt, Homo sapiens
caaggcgauauaagcaaaauca

SEQ ID NO: 1346044 - RNA, 15 nt, Homo sapiens
caaggcuccacaagc

SEQ ID NO: 1346045 - RNA, 16 nt, Homo sapiens
caagggagacugacca

SEQ ID NO: 1346046 - RNA, 15 nt, Homo sapiens
caagguagaacaaag

SEQ ID NO: 1346047 - RNA, 14 nt, Homo sapiens
caaggucuuugguu

SEQ ID NO: 1346048 - RNA, 18 nt, Homo sapiens
caaguaaaagaaaagccg

SEQ ID NO: 1346049 - RNA, 20 nt, Homo sapiens
caaguauuuuugacauuuac

SEQ ID NO: 1346050 - RNA, 14 nt, Homo sapiens
caagucaaauacca

SEQ ID NO: 1346051 - RNA, 17 nt, Homo sapiens
caagucacagacuggga

SEQ ID NO: 1346052 - RNA, 21 nt, Homo sapiens
caagucaggcccuuauuuuca

SEQ ID NO: 1346053 - RNA, 18 nt, Homo sapiens
caaguccaagcauaccaa

SEQ ID NO: 1346054 - RNA, 19 nt, Homo sapiens
caagugaucuguccaccuc

SEQ ID NO: 1346055 - RNA, 20 nt, Homo sapiens
caagugccccaccacucccc

SEQ ID NO: 1346056 - RNA, 21 nt, Homo sapiens
caagugccccaccacucccca

SEQ ID NO: 1346057 - RNA, 19 nt, Homo sapiens
caagugcucaucuguugua

SEQ ID NO: 1346058 - RNA, 23 nt, Homo sapiens
caaguuuuggcagccaugauaau

SEQ ID NO: 1346059 - RNA, 19 nt, Homo sapiens
caauaaacugguaugaaua

SEQ ID NO: 1346060 - RNA, 23 nt, Homo sapiens
caauaaauggcccggacaugucu

SEQ ID NO: 1346061 - RNA, 13 nt, Homo sapiens
caauaacuagcuu

SEQ ID NO: 1346062 - RNA, 20 nt, Homo sapiens
caauacuguuuccauuuuaa

SEQ ID NO: 1346063 - RNA, 14 nt, Homo sapiens
caauagauauuuac

SEQ ID NO: 1346064 - RNA, 21 nt, Homo sapiens
caauagugaaaugccacaccu

SEQ ID NO: 1346065 - RNA, 21 nt, Homo sapiens
caauauuuacuauuucaauac

SEQ ID NO: 1346066 - RNA, 22 nt, Homo sapiens
caaucaauucauaucuauuuau

SEQ ID NO: 1346067 - RNA, 13 nt, Homo sapiens
caaucacugccaa

SEQ ID NO: 1346068 - RNA, 16 nt, Homo sapiens
caaucagcccagugca

SEQ ID NO: 1346069 - RNA, 18 nt, Homo sapiens
caaucagcccagugcaaa

SEQ ID NO: 1346070 - RNA, 16 nt, Homo sapiens
caaucaggaauugaaa

SEQ ID NO: 1346071 - RNA, 21 nt, Homo sapiens
caaucaucaacuaccauucua

SEQ ID NO: 1346072 - RNA, 18 nt, Homo sapiens
caaucauguaaaucuaua

SEQ ID NO: 1346073 - RNA, 20 nt, Homo sapiens
auugcaccuaucucagccau

SEQ ID NO: 1346074 - RNA, 19 nt, Homo sapiens
auugcaguuuacaguauuu

SEQ ID NO: 1346075 - RNA, 18 nt, Homo sapiens
auugccacaaguccagcu

SEQ ID NO: 1346076 - RNA, 20 nt, Homo sapiens
auugccacuuaaagaaauaa

SEQ ID NO: 1346077 - RNA, 12 nt, Homo sapiens
auugccagcaaa

SEQ ID NO: 1346078 - RNA, 15 nt, Homo sapiens
auugcccccacauug

SEQ ID NO: 1346079 - RNA, 21 nt, Homo sapiens
auugccccuggcuuugccucu

SEQ ID NO: 1346080 - RNA, 17 nt, Homo sapiens
auugccuguaacacaua

SEQ ID NO: 1346081 - RNA, 20 nt, Homo sapiens
auugcgccauugcacuccag

SEQ ID NO: 1346082 - RNA, 16 nt, Homo sapiens
auugcgugauucaaug

SEQ ID NO: 1346083 - RNA, 16 nt, Homo sapiens
auugcuaagaagggaa

SEQ ID NO: 1346084 - RNA, 13 nt, Homo sapiens
auugcuccaugau

SEQ ID NO: 1346085 - RNA, 16 nt, Homo sapiens
auugcuuacacggaug

SEQ ID NO: 1346086 - RNA, 18 nt, Homo sapiens
auugcuuaccugaucuca

SEQ ID NO: 1346087 - RNA, 18 nt, Homo sapiens
auuggaaauuuguuauaa

SEQ ID NO: 1346088 - RNA, 14 nt, Homo sapiens
auuggaagagcaca

SEQ ID NO: 1346089 - RNA, 22 nt, Homo sapiens
auuggagccugggcauccucag

SEQ ID NO: 1346090 - RNA, 22 nt, Homo sapiens
auuggauuuccuaauacuguca

SEQ ID NO: 1346091 - RNA, 23 nt, Homo sapiens
auuggcaccccuuucuaguucaa

SEQ ID NO: 1346092 - RNA, 13 nt, Homo sapiens
auugggcaccuga

SEQ ID NO: 1346093 - RNA, 20 nt, Homo sapiens
auugggcuugugauuuccau

SEQ ID NO: 1346094 - RNA, 14 nt, Homo sapiens
auugguacacgugu

SEQ ID NO: 1346095 - RNA, 22 nt, Homo sapiens
auugguuuuccaaucauuugac

SEQ ID NO: 1346096 - RNA, 18 nt, Homo sapiens
auuguagauaacacugac

SEQ ID NO: 1346097 - RNA, 12 nt, Homo sapiens
auuguagccuca

SEQ ID NO: 1346098 - RNA, 17 nt, Homo sapiens
auugucgguuaccucug

SEQ ID NO: 1346099 - RNA, 15 nt, Homo sapiens
auugugccccaugcu

SEQ ID NO: 1346100 - RNA, 17 nt, Homo sapiens
auugugucccccauaaa

SEQ ID NO: 1346101 - RNA, 18 nt, Homo sapiens
auuguuccaguacuaugg

SEQ ID NO: 1346102 - RNA, 14 nt, Homo sapiens
auuuaaaacuugcc

SEQ ID NO: 1346103 - RNA, 17 nt, Homo sapiens
auuuaaagaaaaccaca

SEQ ID NO: 1346104 - RNA, 13 nt, Homo sapiens
auuuaacuucuga

SEQ ID NO: 1346105 - RNA, 12 nt, Homo sapiens
auuuaagacaua

SEQ ID NO: 1346106 - RNA, 15 nt, Homo sapiens
auuuaaugcacuaaa

SEQ ID NO: 1346107 - RNA, 21 nt, Homo sapiens
auuuagacuuacuauuacaua

SEQ ID NO: 1346108 - RNA, 15 nt, Homo sapiens
auuuagucaugugac

SEQ ID NO: 1346109 - RNA, 15 nt, Homo sapiens
auuuaguuggaauau

SEQ ID NO: 1346110 - RNA, 20 nt, Homo sapiens
auuuauacaccagcaauuua

SEQ ID NO: 1346111 - RNA, 22 nt, Homo sapiens
auuuaucuucauguccagugag

SEQ ID NO: 1346112 - RNA, 13 nt, Homo sapiens
auuuaugugcacu

SEQ ID NO: 1346113 - RNA, 21 nt, Homo sapiens
auuuauuccccagugacucca

SEQ ID NO: 1346114 - RNA, 19 nt, Homo sapiens
auuuauuccuuuguuacuu

SEQ ID NO: 1346115 - RNA, 17 nt, Homo sapiens
auuuauugaaaugauuu

SEQ ID NO: 1346116 - RNA, 17 nt, Homo sapiens
auuuauuugguagccca

SEQ ID NO: 1346117 - RNA, 13 nt, Homo sapiens
auuucaagaccuc

SEQ ID NO: 1346118 - RNA, 13 nt, Homo sapiens
auuucacagugug

SEQ ID NO: 1346119 - RNA, 23 nt, Homo sapiens
auuucagguuaaauuaaaccaag

SEQ ID NO: 1346120 - RNA, 22 nt, Homo sapiens
auuucauacaacagaaaccaga

SEQ ID NO: 1346121 - RNA, 21 nt, Homo sapiens
auuucauaccuaucaucuuaa

SEQ ID NO: 1346122 - RNA, 18 nt, Homo sapiens
auuuccaaaccuccacug

SEQ ID NO: 1346123 - RNA, 19 nt, Homo sapiens
auuuccaaaccuccacugc

SEQ ID NO: 1346124 - RNA, 12 nt, Homo sapiens
auuucccaggac

SEQ ID NO: 1346125 - RNA, 19 nt, Homo sapiens
auuucccaggacccugaag

SEQ ID NO: 1346126 - RNA, 15 nt, Homo sapiens
auuucccccagggaa

SEQ ID NO: 1346127 - RNA, 21 nt, Homo sapiens
auuuccgugaacucuggugcu

SEQ ID NO: 1346128 - RNA, 17 nt, Homo sapiens
auuuccuaauacuguca

SEQ ID NO: 1346129 - RNA, 23 nt, Homo sapiens
auuuccuauagcuacauguucuu

SEQ ID NO: 1346130 - RNA, 21 nt, Homo sapiens
auuuccugacagaaggacuca

SEQ ID NO: 1346131 - RNA, 17 nt, Homo sapiens
auuuccuugacuucuuu

SEQ ID NO: 1346132 - RNA, 18 nt, Homo sapiens
auuucuaaaauguuaaaa

SEQ ID NO: 1346133 - RNA, 19 nt, Homo sapiens
auuucuaguaccugugacu

SEQ ID NO: 1346134 - RNA, 16 nt, Homo sapiens
auuucucaacuuugau

SEQ ID NO: 1346135 - RNA, 16 nt, Homo sapiens
auuucuccaaagccuu

SEQ ID NO: 1346136 - RNA, 17 nt, Homo sapiens
auuucucuuuacuugaa

SEQ ID NO: 1346137 - RNA, 22 nt, Homo sapiens
auuucugaggagccugcaacau

SEQ ID NO: 1346138 - RNA, 15 nt, Homo sapiens
auuucugauucugau

SEQ ID NO: 1346139 - RNA, 15 nt, Homo sapiens
auuucugcaucagcu

SEQ ID NO: 1346140 - RNA, 21 nt, Homo sapiens
auuucuugaagaauaaauucu

SEQ ID NO: 1346141 - RNA, 21 nt, Homo sapiens
auuugaaaccaggacauuaaa

SEQ ID NO: 1346142 - RNA, 16 nt, Homo sapiens
auuugaaauauggucu

SEQ ID NO: 1346143 - RNA, 20 nt, Homo sapiens
auuugaguuuaggguucugg

SEQ ID NO: 1346144 - RNA, 16 nt, Homo sapiens
auuugauaaacugaau

SEQ ID NO: 1346145 - RNA, 21 nt, Homo sapiens
auuugggggaacuggacacaa

SEQ ID NO: 1346146 - RNA, 16 nt, Homo sapiens
auuugugauacuuccu

SEQ ID NO: 1346147 - RNA, 17 nt, Homo sapiens
auuugugggcaagcaga

SEQ ID NO: 1346148 - RNA, 19 nt, Homo sapiens
auuuguuacuguauccuca

SEQ ID NO: 1346149 - RNA, 16 nt, Homo sapiens
auuuguuauacuucaa

SEQ ID NO: 1346150 - RNA, 17 nt, Homo sapiens
auuuguuauacuucaaa

SEQ ID NO: 1346151 - RNA, 18 nt, Homo sapiens
auuuguuucuuucucuga

SEQ ID NO: 1346152 - RNA, 16 nt, Homo sapiens
auuuuaaacagaggau

SEQ ID NO: 1346153 - RNA, 18 nt, Homo sapiens
auuuuaaguaaaagucua

SEQ ID NO: 1346154 - RNA, 16 nt, Homo sapiens
auuuuaauguuuccuu

SEQ ID NO: 1346155 - RNA, 17 nt, Homo sapiens
auuuuacacaaagggaa

SEQ ID NO: 1346156 - RNA, 18 nt, Homo sapiens
auuuuaccaaagcaucaa

SEQ ID NO: 1346157 - RNA, 19 nt, Homo sapiens
auuuuaccaaagcaucaau

SEQ ID NO: 1346158 - RNA, 21 nt, Homo sapiens
auuuuacuuuuuccuggcuca

SEQ ID NO: 1346159 - RNA, 16 nt, Homo sapiens
auuuuagugacagagu

SEQ ID NO: 1346160 - RNA, 17 nt, Homo sapiens
auuuuaugccaguuguu

SEQ ID NO: 1346161 - RNA, 19 nt, Homo sapiens
auuuucaagaaacugagga

SEQ ID NO: 1346162 - RNA, 19 nt, Homo sapiens
auuuucagugcaucauuac

SEQ ID NO: 1346163 - RNA, 15 nt, Homo sapiens
auuuucauucauuca

SEQ ID NO: 1346164 - RNA, 13 nt, Homo sapiens
auuuuccaaugca

SEQ ID NO: 1346165 - RNA, 17 nt, Homo sapiens
auuuuccagauaacuua

SEQ ID NO: 1346166 - RNA, 19 nt, Homo sapiens
auuuuccaggacuguuuca

SEQ ID NO: 1346167 - RNA, 21 nt, Homo sapiens
auuuuccuguugucaagaaua

SEQ ID NO: 1346168 - RNA, 17 nt, Homo sapiens
auuuucuuuuuauacua

SEQ ID NO: 1346169 - RNA, 20 nt, Homo sapiens
auuuuggagaguuuccugaa

SEQ ID NO: 1346170 - RNA, 21 nt, Homo sapiens
auuuuguaauaauaaagaaua

SEQ ID NO: 1346171 - RNA, 18 nt, Homo sapiens
auuuuguauaaaugggaa

SEQ ID NO: 1346172 - RNA, 24 nt, Homo sapiens
auuuugugaauuugggacauaaua

SEQ ID NO: 1346173 - RNA, 23 nt, Homo sapiens
auuuugugaucuguaacagggua

SEQ ID NO: 1346174 - RNA, 17 nt, Homo sapiens
auuuuguguaagaaaua

SEQ ID NO: 1346175 - RNA, 19 nt, Homo sapiens
auuuuguuuuaauccuuaa

SEQ ID NO: 1346176 - RNA, 23 nt, Homo sapiens
auuuuuaaggucuaaucagugau

SEQ ID NO: 1346177 - RNA, 18 nt, Homo sapiens
auuuuugaagcaaagaag

SEQ ID NO: 1346178 - RNA, 15 nt, Homo sapiens
auuuuugccaaaaua

SEQ ID NO: 1346179 - RNA, 21 nt, Homo sapiens
auuuuuguuagcaaagauuaa

SEQ ID NO: 1346180 - RNA, 22 nt, Homo sapiens
auuuuuguuuucauuaucucaa

SEQ ID NO: 1346181 - RNA, 19 nt, Homo sapiens
auuuuuuacguagcuauuu

SEQ ID NO: 1346182 - RNA, 23 nt, Homo sapiens
auuuuuucucuguaaacuuccaa

SEQ ID NO: 1346183 - RNA, 18 nt, Homo sapiens
auuuuuugggcagcaauu

SEQ ID NO: 1346184 - RNA, 13 nt, Homo sapiens
auuuuuuuuacau

SEQ ID NO: 1346185 - RNA, 21 nt, Homo sapiens
auuuuuuuuuuuaacagucag

SEQ ID NO: 1346186 - RNA, 23 nt, Homo sapiens
auuuuuuuuuuuaacagucagaa

SEQ ID NO: 1346187 - RNA, 22 nt, Homo sapiens
caaaaacauucuuacauuuuac

SEQ ID NO: 1346188 - RNA, 15 nt, Homo sapiens
caaaaaccuauucca

SEQ ID NO: 1346189 - RNA, 17 nt, Homo sapiens
caaaaauggcagugacu

SEQ ID NO: 1346190 - RNA, 22 nt, Homo sapiens
caaaaauggcagugacucccca

SEQ ID NO: 1346191 - RNA, 17 nt, Homo sapiens
caaaacagaaaaugaag

SEQ ID NO: 1346192 - RNA, 19 nt, Homo sapiens
caaaacccaugcauuucau

SEQ ID NO: 1346193 - RNA, 14 nt, Homo sapiens
caaaacuacugaca

SEQ ID NO: 1346194 - RNA, 19 nt, Homo sapiens
caaaagccauaacuugaaa

SEQ ID NO: 1346195 - RNA, 19 nt, Homo sapiens
caaaagccuuaccuugaaa

SEQ ID NO: 1346196 - RNA, 14 nt, Homo sapiens
caaaauaaugaagu

SEQ ID NO: 1346197 - RNA, 15 nt, Homo sapiens
caaaauaaugaaguu

SEQ ID NO: 1346198 - RNA, 19 nt, Homo sapiens
caaaauaccaugccauuua

SEQ ID NO: 1346199 - RNA, 19 nt, Homo sapiens
caaaaucacuggauuauaa

SEQ ID NO: 1346200 - RNA, 13 nt, Homo sapiens
caaaaugccaaaa

SEQ ID NO: 1346201 - RNA, 20 nt, Homo sapiens
caaaauucauuugcuugcaa

SEQ ID NO: 1346202 - RNA, 14 nt, Homo sapiens
caaaauugagcuua

SEQ ID NO: 1346203 - RNA, 16 nt, Homo sapiens
caaacaaacaaugcau

SEQ ID NO: 1346204 - RNA, 21 nt, Homo sapiens
caaacaauauugcuccaugau

SEQ ID NO: 1346205 - RNA, 19 nt, Homo sapiens
caaacaaugcauaggauuc

SEQ ID NO: 1346206 - RNA, 19 nt, Homo sapiens
agaaaaugaaaugcauauu

SEQ ID NO: 1346207 - RNA, 22 nt, Homo sapiens
agaaaauucuaaaucaauuauu

SEQ ID NO: 1346208 - RNA, 19 nt, Homo sapiens
agaaacaaaauccucagga

SEQ ID NO: 1346209 - RNA, 16 nt, Homo sapiens
agaaacaagcugugca

SEQ ID NO: 1346210 - RNA, 18 nt, Homo sapiens
agaaaccugccaaggagc

SEQ ID NO: 1346211 - RNA, 23 nt, Homo sapiens
agaaaccuggggugaauacuuau

SEQ ID NO: 1346212 - RNA, 20 nt, Homo sapiens
agaaagaaaccaagugcgcu

SEQ ID NO: 1346213 - RNA, 23 nt, Homo sapiens
agaaagacuauucaaacagucuc

SEQ ID NO: 1346214 - RNA, 22 nt, Homo sapiens
agaaagacuuaucaacauuugu

SEQ ID NO: 1346215 - RNA, 16 nt, Homo sapiens
agaaagauucaauuaa

SEQ ID NO: 1346216 - RNA, 17 nt, Homo sapiens
agaaagguuuuauucua

SEQ ID NO: 1346217 - RNA, 16 nt, Homo sapiens
agaaagugacaugcau

SEQ ID NO: 1346218 - RNA, 15 nt, Homo sapiens
agaaauaacgugcau

SEQ ID NO: 1346219 - RNA, 22 nt, Homo sapiens
agaaauugcauuuccugacaga

SEQ ID NO: 1346220 - RNA, 19 nt, Homo sapiens
agaacacagugauuuuauu

SEQ ID NO: 1346221 - RNA, 17 nt, Homo sapiens
agaacauuccauuugcu

SEQ ID NO: 1346222 - RNA, 20 nt, Homo sapiens
agaaccagagaggcucugag

SEQ ID NO: 1346223 - RNA, 15 nt, Homo sapiens
agaacccuugcacua

SEQ ID NO: 1346224 - RNA, 18 nt, Homo sapiens
agaacccuuggagccaau

SEQ ID NO: 1346225 - RNA, 20 nt, Homo sapiens
agaaccuuaaugacaacacu

SEQ ID NO: 1346226 - RNA, 22 nt, Homo sapiens
agaaccuuaaugacaacacuua

SEQ ID NO: 1346227 - RNA, 17 nt, Homo sapiens
agaaccuucaacccagu

SEQ ID NO: 1346228 - RNA, 12 nt, Homo sapiens
agaacucaaggc

SEQ ID NO: 1346229 - RNA, 20 nt, Homo sapiens
agaacuccaguuuucaaauc

SEQ ID NO: 1346230 - RNA, 18 nt, Homo sapiens
agaacucuugacuuccug

SEQ ID NO: 1346231 - RNA, 14 nt, Homo sapiens
agaagagcuguuca

SEQ ID NO: 1346232 - RNA, 20 nt, Homo sapiens
agaagaugcaguucaaaaac

SEQ ID NO: 1346233 - RNA, 13 nt, Homo sapiens
agaagccagcuuu

SEQ ID NO: 1346234 - RNA, 20 nt, Homo sapiens
agaagcuuaaaaucugugaa

SEQ ID NO: 1346235 - RNA, 16 nt, Homo sapiens
agaagggauaucuacu

SEQ ID NO: 1346236 - RNA, 22 nt, Homo sapiens
agaagggcagcuccacagggca

SEQ ID NO: 1346237 - RNA, 19 nt, Homo sapiens
agaaggucauaagggagca

SEQ ID NO: 1346238 - RNA, 15 nt, Homo sapiens
agaagugaguggugu

SEQ ID NO: 1346239 - RNA, 15 nt, Homo sapiens
agaaguguucacaug

SEQ ID NO: 1346240 - RNA, 19 nt, Homo sapiens
agaauaccaccuaauccuu

SEQ ID NO: 1346241 - RNA, 18 nt, Homo sapiens
agaauauaaaaauaaagc

SEQ ID NO: 1346242 - RNA, 16 nt, Homo sapiens
agaauccacacuuccu

SEQ ID NO: 1346243 - RNA, 14 nt, Homo sapiens
agaaucugcucuga

SEQ ID NO: 1346244 - RNA, 20 nt, Homo sapiens
agaaucugugaccucugaca

SEQ ID NO: 1346245 - RNA, 13 nt, Homo sapiens
agaaucuuuucaa

SEQ ID NO: 1346246 - RNA, 19 nt, Homo sapiens
agaaugguguuugcaagug

SEQ ID NO: 1346247 - RNA, 15 nt, Homo sapiens
agaaugucaguugau

SEQ ID NO: 1346248 - RNA, 19 nt, Homo sapiens
agaauguucagaaagccua

SEQ ID NO: 1346249 - RNA, 13 nt, Homo sapiens
agaauguuuucaa

SEQ ID NO: 1346250 - RNA, 19 nt, Homo sapiens
agaauuaucucaaguaaaa

SEQ ID NO: 1346251 - RNA, 21 nt, Homo sapiens
agaauuguuccaguacuaugg

SEQ ID NO: 1346252 - RNA, 20 nt, Homo sapiens
agacaaacuuguucaaaaga

SEQ ID NO: 1346253 - RNA, 19 nt, Homo sapiens
agacacaaagagacaaagc

SEQ ID NO: 1346254 - RNA, 19 nt, Homo sapiens
agacacccaggacuuauuu

SEQ ID NO: 1346255 - RNA, 15 nt, Homo sapiens
agacacccucugggg

SEQ ID NO: 1346256 - RNA, 21 nt, Homo sapiens
agacagaaccccuacaugaaa

SEQ ID NO: 1346257 - RNA, 13 nt, Homo sapiens
agacagaagcuua

SEQ ID NO: 1346258 - RNA, 14 nt, Homo sapiens
agacagaagcuuaa

SEQ ID NO: 1346259 - RNA, 19 nt, Homo sapiens
agacagauucuucacugug

SEQ ID NO: 1346260 - RNA, 22 nt, Homo sapiens
agacagauucuucacuguguuu

SEQ ID NO: 1346261 - RNA, 21 nt, Homo sapiens
agacagcccuggcaaaugccu

SEQ ID NO: 1346262 - RNA, 21 nt, Homo sapiens
agacagcgcaugcuggugcag

SEQ ID NO: 1346263 - RNA, 16 nt, Homo sapiens
agacagggucuugcua

SEQ ID NO: 1346264 - RNA, 16 nt, Homo sapiens
agacaguuugcuuauu

SEQ ID NO: 1346265 - RNA, 14 nt, Homo sapiens
agacaugugacauu

SEQ ID NO: 1346266 - RNA, 17 nt, Homo sapiens
agacaugugacauuuau

SEQ ID NO: 1346267 - RNA, 18 nt, Homo sapiens
agacauuggcaccuaauc

SEQ ID NO: 1346268 - RNA, 18 nt, Homo sapiens
agacauuugcuaugagcu

SEQ ID NO: 1346269 - RNA, 17 nt, Homo sapiens
agacccuguguccucca

SEQ ID NO: 1346270 - RNA, 19 nt, Homo sapiens
agaccucuuuuucuuacca

SEQ ID NO: 1346271 - RNA, 18 nt, Homo sapiens
agaccugacaccuuucau

SEQ ID NO: 1346272 - RNA, 14 nt, Homo sapiens
agaccugauccugg

SEQ ID NO: 1346273 - RNA, 23 nt, Homo sapiens
agaccuugcuuugagacuccuca

SEQ ID NO: 1346274 - RNA, 19 nt, Homo sapiens
agaccuugggggaagacuu

SEQ ID NO: 1346275 - RNA, 17 nt, Homo sapiens
agacucaaaugcucaga

SEQ ID NO: 1346276 - RNA, 22 nt, Homo sapiens
agacucaaugugcucuguaaca

SEQ ID NO: 1346277 - RNA, 19 nt, Homo sapiens
agacucagacauuggcacc

SEQ ID NO: 1346278 - RNA, 22 nt, Homo sapiens
agacucggaaucuauuuucuca

SEQ ID NO: 1346279 - RNA, 14 nt, Homo sapiens
agacugauagacac

SEQ ID NO: 1346280 - RNA, 20 nt, Homo sapiens
agacugcaaacccuuucaua

SEQ ID NO: 1346281 - RNA, 22 nt, Homo sapiens
agacuggcagggacgaggacaa

SEQ ID NO: 1346282 - RNA, 16 nt, Homo sapiens
agacugguuugggcaa

SEQ ID NO: 1346283 - RNA, 19 nt, Homo sapiens
agacugucucaagagggca

SEQ ID NO: 1346284 - RNA, 15 nt, Homo sapiens
agacuuucuucucua

SEQ ID NO: 1346285 - RNA, 14 nt, Homo sapiens
agagaaacgugaaa

SEQ ID NO: 1346286 - RNA, 17 nt, Homo sapiens
agagaaagugacaugca

SEQ ID NO: 1346287 - RNA, 18 nt, Homo sapiens
agagaacacagugcuauu

SEQ ID NO: 1346288 - RNA, 16 nt, Homo sapiens
agagaaguacuaucuu

SEQ ID NO: 1346289 - RNA, 14 nt, Homo sapiens
agagaaugaugaua

SEQ ID NO: 1346290 - RNA, 23 nt, Homo sapiens
agagaauguguguguguggcagg

SEQ ID NO: 1346291 - RNA, 13 nt, Homo sapiens
agagacagaauuc

SEQ ID NO: 1346292 - RNA, 23 nt, Homo sapiens
agagacuucucccauagcaaaga

SEQ ID NO: 1346293 - RNA, 15 nt, Homo sapiens
agagaggcucugaga

SEQ ID NO: 1346294 - RNA, 19 nt, Homo sapiens
agagaucagcgacccugag

SEQ ID NO: 1346295 - RNA, 19 nt, Homo sapiens
agagaucgagaccauccug

SEQ ID NO: 1346296 - RNA, 19 nt, Homo sapiens
agagaucuuucuuuccaaa

SEQ ID NO: 1346297 - RNA, 19 nt, Homo sapiens
agagauuacuuugcugccu

SEQ ID NO: 1346298 - RNA, 12 nt, Homo sapiens
agagcagcagca

SEQ ID NO: 1346299 - RNA, 23 nt, Homo sapiens
agagccaggggggugaggagcug

SEQ ID NO: 1346300 - RNA, 13 nt, Homo sapiens
agagcccagcucc

SEQ ID NO: 1346301 - RNA, 18 nt, Homo sapiens
agagccucuggcaucucu

SEQ ID NO: 1346302 - RNA, 16 nt, Homo sapiens
agagcuauauccuuaa

SEQ ID NO: 1346303 - RNA, 20 nt, Homo sapiens
agagcuuuuaaaaauguccu

SEQ ID NO: 1346304 - RNA, 20 nt, Homo sapiens
agaggaauuuuuucuuuuga

SEQ ID NO: 1346305 - RNA, 14 nt, Homo sapiens
agaggacaguauuu

SEQ ID NO: 1346306 - RNA, 23 nt, Homo sapiens
agaggacugguucugaggccaga

SEQ ID NO: 1346307 - RNA, 17 nt, Homo sapiens
agaggagccaccaguuc

SEQ ID NO: 1346308 - RNA, 19 nt, Homo sapiens
agaggagccaccaguucuc

SEQ ID NO: 1346309 - RNA, 15 nt, Homo sapiens
agaggaggggaccaa

SEQ ID NO: 1346310 - RNA, 20 nt, Homo sapiens
agaggcuccucucaggcugg

SEQ ID NO: 1346311 - RNA, 15 nt, Homo sapiens
cuacuaaaacauaca

SEQ ID NO: 1346312 - RNA, 19 nt, Homo sapiens
cuacucaggaggcugaggc

SEQ ID NO: 1346313 - RNA, 14 nt, Homo sapiens
cuacuuaugaaaug

SEQ ID NO: 1346314 - RNA, 17 nt, Homo sapiens
cuacuucuuuugcucuu

SEQ ID NO: 1346315 - RNA, 18 nt, Homo sapiens
cuagaaagagaaacaguu

SEQ ID NO: 1346316 - RNA, 17 nt, Homo sapiens
cuagaauccacacuucc

SEQ ID NO: 1346317 - RNA, 16 nt, Homo sapiens
cuagacauaguaccga

SEQ ID NO: 1346318 - RNA, 12 nt, Homo sapiens
cuagacuugaaa

SEQ ID NO: 1346319 - RNA, 19 nt, Homo sapiens
cuagagaaggacccggagg

SEQ ID NO: 1346320 - RNA, 23 nt, Homo sapiens
cuagagacgcugauccauaaaga

SEQ ID NO: 1346321 - RNA, 13 nt, Homo sapiens
cuagagugcaaug

SEQ ID NO: 1346322 - RNA, 15 nt, Homo sapiens
cuagagugcaauggu

SEQ ID NO: 1346323 - RNA, 15 nt, Homo sapiens
cuagauagcuauuaa

SEQ ID NO: 1346324 - RNA, 19 nt, Homo sapiens
cuagcagaggaaaguguaa

SEQ ID NO: 1346325 - RNA, 22 nt, Homo sapiens
cuagcauuucccaacacaaaga

SEQ ID NO: 1346326 - RNA, 15 nt, Homo sapiens
cuagcccugcuccaa

SEQ ID NO: 1346327 - RNA, 21 nt, Homo sapiens
cuagcugggcacaguggcuca

SEQ ID NO: 1346328 - RNA, 17 nt, Homo sapiens
cuaggaaaagaccaucu

SEQ ID NO: 1346329 - RNA, 19 nt, Homo sapiens
cuaggaaaaucacuugcca

SEQ ID NO: 1346330 - RNA, 18 nt, Homo sapiens
cuaggagcaggcuugugg

SEQ ID NO: 1346331 - RNA, 22 nt, Homo sapiens
cuaggcaccucagaccaaucau

SEQ ID NO: 1346332 - RNA, 12 nt, Homo sapiens
cuaggccccaga

SEQ ID NO: 1346333 - RNA, 17 nt, Homo sapiens
cuaggccuuuccucugc

SEQ ID NO: 1346334 - RNA, 17 nt, Homo sapiens
cuagucucuacccagua

SEQ ID NO: 1346335 - RNA, 16 nt, Homo sapiens
cuagugguauggggcu

SEQ ID NO: 1346336 - RNA, 22 nt, Homo sapiens
cuaguguuccugcaccaaaccu

SEQ ID NO: 1346337 - RNA, 16 nt, Homo sapiens
cuaguuucucuuagaa

SEQ ID NO: 1346338 - RNA, 14 nt, Homo sapiens
cuauaaagaucaua

SEQ ID NO: 1346339 - RNA, 13 nt, Homo sapiens
cuauaaccaaaug

SEQ ID NO: 1346340 - RNA, 20 nt, Homo sapiens
cuauagggugugaugaaguc

SEQ ID NO: 1346341 - RNA, 21 nt, Homo sapiens
cuauagggugugaugaaguca

SEQ ID NO: 1346342 - RNA, 16 nt, Homo sapiens
cuauauagaaugcugc

SEQ ID NO: 1346343 - RNA, 15 nt, Homo sapiens
cuauauauuggccaa

SEQ ID NO: 1346344 - RNA, 18 nt, Homo sapiens
cuauauugcuuaccugau

SEQ ID NO: 1346345 - RNA, 18 nt, Homo sapiens
cuaucccugcggccucca

SEQ ID NO: 1346346 - RNA, 22 nt, Homo sapiens
cuaucuaauuuuacacucugua

SEQ ID NO: 1346347 - RNA, 13 nt, Homo sapiens
cuaugaaaggcag

SEQ ID NO: 1346348 - RNA, 14 nt, Homo sapiens
cuaugagccaggca

SEQ ID NO: 1346349 - RNA, 22 nt, Homo sapiens
cuaugcgggggugccuaaggag

SEQ ID NO: 1346350 - RNA, 18 nt, Homo sapiens
cuauggagugcucacaaa

SEQ ID NO: 1346351 - RNA, 15 nt, Homo sapiens
cuaugggggcacuga

SEQ ID NO: 1346352 - RNA, 17 nt, Homo sapiens
cuauguaauggugguca

SEQ ID NO: 1346353 - RNA, 14 nt, Homo sapiens
cuauguauaucuuc

SEQ ID NO: 1346354 - RNA, 15 nt, Homo sapiens
cuauuauauucauuc

SEQ ID NO: 1346355 - RNA, 17 nt, Homo sapiens
cuauucaaacagucuca

SEQ ID NO: 1346356 - RNA, 19 nt, Homo sapiens
cuauucccuggggcugcug

SEQ ID NO: 1346357 - RNA, 13 nt, Homo sapiens
cuauuuaucugau

SEQ ID NO: 1346358 - RNA, 22 nt, Homo sapiens
cuauuuauuuauuuauucauua

SEQ ID NO: 1346359 - RNA, 16 nt, Homo sapiens
cuauuucuccaaagcc

SEQ ID NO: 1346360 - RNA, 12 nt, Homo sapiens
cuauuuugugaa

SEQ ID NO: 1346361 - RNA, 17 nt, Homo sapiens
cuauuuuguuggaugac

SEQ ID NO: 1346362 - RNA, 16 nt, Homo sapiens
cucaaaacugcacugu

SEQ ID NO: 1346363 - RNA, 13 nt, Homo sapiens
cucaaaguuuuau

SEQ ID NO: 1346364 - RNA, 20 nt, Homo sapiens
cucaaauauuugcuaugaag

SEQ ID NO: 1346365 - RNA, 20 nt, Homo sapiens
cucaaauggggccagaucca

SEQ ID NO: 1346366 - RNA, 20 nt, Homo sapiens
cucaaauucauggugcacug

SEQ ID NO: 1346367 - RNA, 20 nt, Homo sapiens
cucaacaaaacccaugcauu

SEQ ID NO: 1346368 - RNA, 14 nt, Homo sapiens
cucaagaaaucaaa

SEQ ID NO: 1346369 - RNA, 15 nt, Homo sapiens
cucaagaaaucaaaa

SEQ ID NO: 1346370 - RNA, 15 nt, Homo sapiens
cucaaguaaaacaaa

SEQ ID NO: 1346371 - RNA, 20 nt, Homo sapiens
cucaauauuuacuauuucaa

SEQ ID NO: 1346372 - RNA, 13 nt, Homo sapiens
cucacaccacuaa

SEQ ID NO: 1346373 - RNA, 19 nt, Homo sapiens
cucacaccuguaaucccag

SEQ ID NO: 1346374 - RNA, 21 nt, Homo sapiens
cucacaggcgccuaaagucau

SEQ ID NO: 1346375 - RNA, 16 nt, Homo sapiens
cucacauccauucuuc

SEQ ID NO: 1346376 - RNA, 20 nt, Homo sapiens
cucacucuguugccauuaaa

SEQ ID NO: 1346377 - RNA, 14 nt, Homo sapiens
cucacuguauccag

SEQ ID NO: 1346378 - RNA, 16 nt, Homo sapiens
cucacuuaguccuuua

SEQ ID NO: 1346379 - RNA, 17 nt, Homo sapiens
cucagaaggccccagag

SEQ ID NO: 1346380 - RNA, 19 nt, Homo sapiens
cucagaaggccccagagag

SEQ ID NO: 1346381 - RNA, 20 nt, Homo sapiens
cucagacacaaauaaaggaa

SEQ ID NO: 1346382 - RNA, 14 nt, Homo sapiens
cucagccucaggga

SEQ ID NO: 1346383 - RNA, 14 nt, Homo sapiens
cucagccucugcca

SEQ ID NO: 1346384 - RNA, 23 nt, Homo sapiens
cucagccugcuuuccugcagcag

SEQ ID NO: 1346385 - RNA, 20 nt, Homo sapiens
cucagccuugggaccgugcc

SEQ ID NO: 1346386 - RNA, 15 nt, Homo sapiens
cucagcuucuucaca

SEQ ID NO: 1346387 - RNA, 15 nt, Homo sapiens
cucaggauccaguga

SEQ ID NO: 1346388 - RNA, 15 nt, Homo sapiens
cucaggcucuugacu

SEQ ID NO: 1346389 - RNA, 16 nt, Homo sapiens
cucagggaacugaccc

SEQ ID NO: 1346390 - RNA, 16 nt, Homo sapiens
cucaggugaucugccc

SEQ ID NO: 1346391 - RNA, 24 nt, Homo sapiens
cucaguccacugcugaggacacuc

SEQ ID NO: 1346392 - RNA, 14 nt, Homo sapiens
cucagugaccagug

SEQ ID NO: 1346393 - RNA, 14 nt, Homo sapiens
cucauacacagaaa

SEQ ID NO: 1346394 - RNA, 12 nt, Homo sapiens
cucaucaaugug

SEQ ID NO: 1346395 - RNA, 13 nt, Homo sapiens
cucaucacuagga

SEQ ID NO: 1346396 - RNA, 12 nt, Homo sapiens
cucaugccugua

SEQ ID NO: 1346397 - RNA, 16 nt, Homo sapiens
cucaugccuuaccuaa

SEQ ID NO: 1346398 - RNA, 22 nt, Homo sapiens
cucauggggaagcuuccaugau

SEQ ID NO: 1346399 - RNA, 10 nt, Homo sapiens
cucauuccac

SEQ ID NO: 1346400 - RNA, 13 nt, Homo sapiens
cucauuccaccuu

SEQ ID NO: 1346401 - RNA, 22 nt, Homo sapiens
cuccaaagaaauguaagggaaa

SEQ ID NO: 1346402 - RNA, 21 nt, Homo sapiens
aacauauacuauuuagucuca

SEQ ID NO: 1346403 - RNA, 19 nt, Homo sapiens
aacaucccaauucuuuagu

SEQ ID NO: 1346404 - RNA, 16 nt, Homo sapiens
aacaucuguuaucaaa

SEQ ID NO: 1346405 - RNA, 17 nt, Homo sapiens
aacaugcuugcauuaua

SEQ ID NO: 1346406 - RNA, 11 nt, Homo sapiens
aacauggccau

SEQ ID NO: 1346407 - RNA, 21 nt, Homo sapiens
aacaugguggaaaacgaagcu

SEQ ID NO: 1346408 - RNA, 20 nt, Homo sapiens
aacauguaagcauaacuuau

SEQ ID NO: 1346409 - RNA, 11 nt, Homo sapiens
aacauguaauu

SEQ ID NO: 1346410 - RNA, 15 nt, Homo sapiens
aacauuacuaacaau

SEQ ID NO: 1346411 - RNA, 18 nt, Homo sapiens
aacauuacuuauuuaacu

SEQ ID NO: 1346412 - RNA, 19 nt, Homo sapiens
aacauuauuaaguaacuua

SEQ ID NO: 1346413 - RNA, 13 nt, Homo sapiens
aacauugugauca

SEQ ID NO: 1346414 - RNA, 16 nt, Homo sapiens
aaccaaauugcacuga

SEQ ID NO: 1346415 - RNA, 20 nt, Homo sapiens
aaccaauagugaaaugccac

SEQ ID NO: 1346416 - RNA, 14 nt, Homo sapiens
aaccacaguuauua

SEQ ID NO: 1346417 - RNA, 17 nt, Homo sapiens
aaccacuccacuggccu

SEQ ID NO: 1346418 - RNA, 14 nt, Homo sapiens
aaccagaguuucuu

SEQ ID NO: 1346419 - RNA, 20 nt, Homo sapiens
aaccaguccccccacccuca

SEQ ID NO: 1346420 - RNA, 16 nt, Homo sapiens
aaccauccacuuacau

SEQ ID NO: 1346421 - RNA, 18 nt, Homo sapiens
aaccaucgguccacaccu

SEQ ID NO: 1346422 - RNA, 18 nt, Homo sapiens
aaccauuuuuaggaagcu

SEQ ID NO: 1346423 - RNA, 21 nt, Homo sapiens
aaccauuuuuaggaagcuaga

SEQ ID NO: 1346424 - RNA, 12 nt, Homo sapiens
aacccagacuca

SEQ ID NO: 1346425 - RNA, 18 nt, Homo sapiens
aacccagagaugccugau

SEQ ID NO: 1346426 - RNA, 19 nt, Homo sapiens
aacccaggaguucaggguc

SEQ ID NO: 1346427 - RNA, 14 nt, Homo sapiens
aacccagucuuucu

SEQ ID NO: 1346428 - RNA, 23 nt, Homo sapiens
aacccugacuccucuuugugcag

SEQ ID NO: 1346429 - RNA, 20 nt, Homo sapiens
aacccugggcuauugcugcu

SEQ ID NO: 1346430 - RNA, 18 nt, Homo sapiens
aacccuggugguugcugu

SEQ ID NO: 1346431 - RNA, 13 nt, Homo sapiens
aaccgggauggga

SEQ ID NO: 1346432 - RNA, 20 nt, Homo sapiens
aaccuagauugcaccauugc

SEQ ID NO: 1346433 - RNA, 12 nt, Homo sapiens
aaccuauuccac

SEQ ID NO: 1346434 - RNA, 22 nt, Homo sapiens
aaccucacauacccucacuuaa

SEQ ID NO: 1346435 - RNA, 15 nt, Homo sapiens
aaccuccacugcugc

SEQ ID NO: 1346436 - RNA, 18 nt, Homo sapiens
aaccuccuggguucaagc

SEQ ID NO: 1346437 - RNA, 15 nt, Homo sapiens
aaccuucaacccagu

SEQ ID NO: 1346438 - RNA, 13 nt, Homo sapiens
aaccuuccaccca

SEQ ID NO: 1346439 - RNA, 12 nt, Homo sapiens
aacgcacaaaac

SEQ ID NO: 1346440 - RNA, 20 nt, Homo sapiens
aacgugcaacuacuauucaa

SEQ ID NO: 1346441 - RNA, 14 nt, Homo sapiens
aacuacuaguguga

SEQ ID NO: 1346442 - RNA, 22 nt, Homo sapiens
aacuaugagcuugcucauuaau

SEQ ID NO: 1346443 - RNA, 14 nt, Homo sapiens
aacuauuacagugu

SEQ ID NO: 1346444 - RNA, 14 nt, Homo sapiens
aacucaaaugagcc

SEQ ID NO: 1346445 - RNA, 19 nt, Homo sapiens
aacucacaggugacucuaa

SEQ ID NO: 1346446 - RNA, 23 nt, Homo sapiens
aacucagauccagggacagaggc

SEQ ID NO: 1346447 - RNA, 11 nt, Homo sapiens
aacucagggag

SEQ ID NO: 1346448 - RNA, 17 nt, Homo sapiens
aacuccauacuccacuc

SEQ ID NO: 1346449 - RNA, 11 nt, Homo sapiens
aacuccugacu

SEQ ID NO: 1346450 - RNA, 16 nt, Homo sapiens
aacucuaccugcacac

SEQ ID NO: 1346451 - RNA, 22 nt, Homo sapiens
aacucucaccaugaugugaaga

SEQ ID NO: 1346452 - RNA, 12 nt, Homo sapiens
aacucuggugcu

SEQ ID NO: 1346453 - RNA, 23 nt, Homo sapiens
aacucuggugcuccugcaucuca

SEQ ID NO: 1346454 - RNA, 21 nt, Homo sapiens
aacucuucgaagccuugccua

SEQ ID NO: 1346455 - RNA, 20 nt, Homo sapiens
aacugaccagccuccaugcu

SEQ ID NO: 1346456 - RNA, 15 nt, Homo sapiens
aacugagguuuacau

SEQ ID NO: 1346457 - RNA, 18 nt, Homo sapiens
aacugaguauguguaaca

SEQ ID NO: 1346458 - RNA, 14 nt, Homo sapiens
aacugauuuaucua

SEQ ID NO: 1346459 - RNA, 23 nt, Homo sapiens
aacugcauaagugaaaaucuuac

SEQ ID NO: 1346460 - RNA, 19 nt, Homo sapiens
aacugccaggcugccuccu

SEQ ID NO: 1346461 - RNA, 21 nt, Homo sapiens
aacugcucauuucaugaagca

SEQ ID NO: 1346462 - RNA, 17 nt, Homo sapiens
aacuguagguaugaucu

SEQ ID NO: 1346463 - RNA, 19 nt, Homo sapiens
aacuguaguaauuguuaca

SEQ ID NO: 1346464 - RNA, 13 nt, Homo sapiens
aacuguaugcuca

SEQ ID NO: 1346465 - RNA, 18 nt, Homo sapiens
aacugugauuuuuaucac

SEQ ID NO: 1346466 - RNA, 18 nt, Homo sapiens
aacugugcuguacugagc

SEQ ID NO: 1346467 - RNA, 14 nt, Homo sapiens
aacuuacgaucucu

SEQ ID NO: 1346468 - RNA, 21 nt, Homo sapiens
aacuuccaggaaagugugaag

SEQ ID NO: 1346469 - RNA, 19 nt, Homo sapiens
aacuucuccuacuguagca

SEQ ID NO: 1346470 - RNA, 12 nt, Homo sapiens
aacuucugccuc

SEQ ID NO: 1346471 - RNA, 17 nt, Homo sapiens
aacuucuuccugugaag

SEQ ID NO: 1346472 - RNA, 22 nt, Homo sapiens
aacuugauggcuaacuuacaaa

SEQ ID NO: 1346473 - RNA, 22 nt, Homo sapiens
aacuuggcugcauuugccuguc

SEQ ID NO: 1346474 - RNA, 14 nt, Homo sapiens
aacuuuacuuucag

SEQ ID NO: 1346475 - RNA, 18 nt, Homo sapiens
aacuuugauacuuacuca

SEQ ID NO: 1346476 - RNA, 18 nt, Homo sapiens
aacuuuuuuuucucucuu

SEQ ID NO: 1346477 - RNA, 16 nt, Homo sapiens
aagaaacuuuucugaa

SEQ ID NO: 1346478 - RNA, 18 nt, Homo sapiens
aagaaaguaaacuguaau

SEQ ID NO: 1346479 - RNA, 23 nt, Homo sapiens
aagaaauguaagggaaacugcca

SEQ ID NO: 1346480 - RNA, 21 nt, Homo sapiens
aagaaccacuccuucauguuu

SEQ ID NO: 1346481 - RNA, 12 nt, Homo sapiens
aagaaccagaga

SEQ ID NO: 1346482 - RNA, 22 nt, Homo sapiens
aagaaccagagaggcucugaga

SEQ ID NO: 1346483 - RNA, 16 nt, Homo sapiens
aagaagcccuggccaa

SEQ ID NO: 1346484 - RNA, 20 nt, Homo sapiens
aagaaggccagcaacauugg

SEQ ID NO: 1346485 - RNA, 21 nt, Homo sapiens
aagaagggauaucuacugugg

SEQ ID NO: 1346486 - RNA, 19 nt, Homo sapiens
aagaaguuuuguucugucc

SEQ ID NO: 1346487 - RNA, 18 nt, Homo sapiens
aagaauaaaauauguagu

SEQ ID NO: 1346488 - RNA, 13 nt, Homo sapiens
aagaauaugcauc

SEQ ID NO: 1346489 - RNA, 17 nt, Homo sapiens
aagaauaugcaucuuaa

SEQ ID NO: 1346490 - RNA, 14 nt, Homo sapiens
aagaaucugcucug

SEQ ID NO: 1346491 - RNA, 14 nt, Homo sapiens
aagaaugcauucaa

SEQ ID NO: 1346492 - RNA, 19 nt, Homo sapiens
aagaauuuuguauuuucau

SEQ ID NO: 1346493 - RNA, 14 nt, Homo sapiens
aagacaaucacugc

SEQ ID NO: 1346494 - RNA, 18 nt, Homo sapiens
aagacagaaaagugccug

SEQ ID NO: 1346495 - RNA, 18 nt, Homo sapiens
aagacauugacagcaauu

SEQ ID NO: 1346496 - RNA, 20 nt, Homo sapiens
aagacauugacagcaauuca

SEQ ID NO: 1346497 - RNA, 20 nt, Homo sapiens
aagaccagagggacacuagg

SEQ ID NO: 1346498 - RNA, 23 nt, Homo sapiens
aagacguugccuauaacagugac

SEQ ID NO: 1346499 - RNA, 17 nt, Homo sapiens
aagacuuaucaacauuu

SEQ ID NO: 1346500 - RNA, 22 nt, Homo sapiens
aagagagcaacauuuuacccac

SEQ ID NO: 1346501 - RNA, 18 nt, Homo sapiens
aagagcaaagggaaauca

SEQ ID NO: 1346502 - RNA, 14 nt, Homo sapiens
aagagcuacuccca

SEQ ID NO: 1346503 - RNA, 15 nt, Homo sapiens
aagagcuacucccac

SEQ ID NO: 1346504 - RNA, 15 nt, Homo sapiens
aagaggagaaaaaga

SEQ ID NO: 1346505 - RNA, 16 nt, Homo sapiens
aagaggcagcuugaaa

SEQ ID NO: 1346506 - RNA, 19 nt, Homo sapiens
aagagggacaggcugaaga

SEQ ID NO: 1346507 - RNA, 18 nt, Homo sapiens
aagaguccucugaaugaa

SEQ ID NO: 1346508 - RNA, 15 nt, Homo sapiens
aagaguuaugcuuua

SEQ ID NO: 1346509 - RNA, 14 nt, Homo sapiens
aagauaaaaaucac

SEQ ID NO: 1346510 - RNA, 16 nt, Homo sapiens
aagauaaauuggcuaa

SEQ ID NO: 1346511 - RNA, 22 nt, Homo sapiens
aagauacagugucugacuauaa

SEQ ID NO: 1346512 - RNA, 16 nt, Homo sapiens
aagauagaagaaccac

SEQ ID NO: 1346513 - RNA, 15 nt, Homo sapiens
aagauagcagggcau

SEQ ID NO: 1346514 - RNA, 18 nt, Homo sapiens
aagauaguugauucuugc

SEQ ID NO: 1346515 - RNA, 17 nt, Homo sapiens
aagaucguucucugccu

SEQ ID NO: 1346516 - RNA, 21 nt, Homo sapiens
aagaugacgaguaacuccccu

SEQ ID NO: 1346517 - RNA, 22 nt, Homo sapiens
aagaugugcagcauuucacuua

SEQ ID NO: 1346518 - RNA, 19 nt, Homo sapiens
aagauguggccuuuagcaa

SEQ ID NO: 1346519 - RNA, 23 nt, Homo sapiens
aagauuauuuuuuaaaaagguaa

SEQ ID NO: 1346520 - RNA, 14 nt, Homo sapiens
aagcaaauggccaa

SEQ ID NO: 1346521 - RNA, 21 nt, Homo sapiens
aagcaacuagcugggcacagu

SEQ ID NO: 1346522 - RNA, 13 nt, Homo sapiens
aagcaacugugaa

SEQ ID NO: 1346523 - RNA, 16 nt, Homo sapiens
aagcaauacuguuucc

SEQ ID NO: 1346524 - RNA, 19 nt, Homo sapiens
aagcacaaaggaaugaacu

SEQ ID NO: 1346525 - RNA, 23 nt, Homo sapiens
aagcagcauggaaaaaugguuga

SEQ ID NO: 1346526 - RNA, 17 nt, Homo sapiens
aagcaggugaacuggga

SEQ ID NO: 1346527 - RNA, 21 nt, Homo sapiens
aagcauuuccagccuaucuaa

SEQ ID NO: 1346528 - RNA, 19 nt, Homo sapiens
aagccaaagagccucccac

SEQ ID NO: 1346529 - RNA, 12 nt, Homo sapiens
aagccacaucuu

SEQ ID NO: 1346530 - RNA, 16 nt, Homo sapiens
aagccagcuuuccuca

SEQ ID NO: 1346531 - RNA, 14 nt, Homo sapiens
aagcccaacugggg

SEQ ID NO: 1346532 - RNA, 23 nt, Homo sapiens
aagcccaacugggguugcgucug

SEQ ID NO: 1346533 - RNA, 22 nt, Homo sapiens
aagcccagcacuugaauuguua

SEQ ID NO: 1346534 - RNA, 15 nt, Homo sapiens
cauuugcagugcauc

SEQ ID NO: 1346535 - RNA, 15 nt, Homo sapiens
cauuugccugucaug

SEQ ID NO: 1346536 - RNA, 20 nt, Homo sapiens
cauuuggggcuagacaguuc

SEQ ID NO: 1346537 - RNA, 22 nt, Homo sapiens
cauuuguuuucggcagccuuaa

SEQ ID NO: 1346538 - RNA, 18 nt, Homo sapiens
cauuuuaaaaaauggaac

SEQ ID NO: 1346539 - RNA, 18 nt, Homo sapiens
cauuuuagaaacuacaaa

SEQ ID NO: 1346540 - RNA, 16 nt, Homo sapiens
cauuuuagaaugucaa

SEQ ID NO: 1346541 - RNA, 15 nt, Homo sapiens
cauuuuagacauuca

SEQ ID NO: 1346542 - RNA, 17 nt, Homo sapiens
cauuuuaugucauuaaa

SEQ ID NO: 1346543 - RNA, 15 nt, Homo sapiens
cauuuugacacaaaa

SEQ ID NO: 1346544 - RNA, 17 nt, Homo sapiens
cauuuugugaauuguga

SEQ ID NO: 1346545 - RNA, 23 nt, Homo sapiens
cauuuuuagaacuccaguuuuca

SEQ ID NO: 1346546 - RNA, 22 nt, Homo sapiens
cauuuuuaggaagcuagacuag

SEQ ID NO: 1346547 - RNA, 18 nt, Homo sapiens
cauuuuucucuugccauu

SEQ ID NO: 1346548 - RNA, 17 nt, Homo sapiens
cauuuuugugcuuuuau

SEQ ID NO: 1346549 - RNA, 19 nt, Homo sapiens
cauuuuuuaaaaaagcaag

SEQ ID NO: 1346550 - RNA, 16 nt, Homo sapiens
ccaaaaauacagccua

SEQ ID NO: 1346551 - RNA, 19 nt, Homo sapiens
ccaaaaauggcagugacuc

SEQ ID NO: 1346552 - RNA, 13 nt, Homo sapiens
ccaaaacauuucu

SEQ ID NO: 1346553 - RNA, 13 nt, Homo sapiens
ccaaaagaagccc

SEQ ID NO: 1346554 - RNA, 16 nt, Homo sapiens
ccaaaagcugcucagg

SEQ ID NO: 1346555 - RNA, 14 nt, Homo sapiens
ccaaaccacuccac

SEQ ID NO: 1346556 - RNA, 23 nt, Homo sapiens
ccaaaccacugacauuccuccau

SEQ ID NO: 1346557 - RNA, 17 nt, Homo sapiens
ccaaaccuccacugcug

SEQ ID NO: 1346558 - RNA, 20 nt, Homo sapiens
ccaaaccugucuuggggcca

SEQ ID NO: 1346559 - RNA, 23 nt, Homo sapiens
ccaaaccuucugacuuugccaaa

SEQ ID NO: 1346560 - RNA, 14 nt, Homo sapiens
ccaaaguagggaug

SEQ ID NO: 1346561 - RNA, 15 nt, Homo sapiens
ccaaauuuggcuaaa

SEQ ID NO: 1346562 - RNA, 23 nt, Homo sapiens
ccaacaacaauguguuguaaaaa

SEQ ID NO: 1346563 - RNA, 21 nt, Homo sapiens
ccaacaugaaaacaauucuua

SEQ ID NO: 1346564 - RNA, 21 nt, Homo sapiens
ccaacauuaaaagccaccccc

SEQ ID NO: 1346565 - RNA, 21 nt, Homo sapiens
ccaaccacagcaucgggagca

SEQ ID NO: 1346566 - RNA, 15 nt, Homo sapiens
ccaacggcaacagca

SEQ ID NO: 1346567 - RNA, 14 nt, Homo sapiens
ccaacucauccacg

SEQ ID NO: 1346568 - RNA, 13 nt, Homo sapiens
ccaacuccagggg

SEQ ID NO: 1346569 - RNA, 21 nt, Homo sapiens
ccaacuccauacuccacucca

SEQ ID NO: 1346570 - RNA, 23 nt, Homo sapiens
ccaacugcuuggacagcagccag

SEQ ID NO: 1346571 - RNA, 19 nt, Homo sapiens
ccaagaaaauggccaguga

SEQ ID NO: 1346572 - RNA, 19 nt, Homo sapiens
ccaagaacagucaaaccca

SEQ ID NO: 1346573 - RNA, 15 nt, Homo sapiens
ccaagacaugacauu

SEQ ID NO: 1346574 - RNA, 12 nt, Homo sapiens
ccaagcauuuca

SEQ ID NO: 1346575 - RNA, 15 nt, Homo sapiens
ccaagcccccuccuu

SEQ ID NO: 1346576 - RNA, 18 nt, Homo sapiens
ccaaggcagcgaccccag

SEQ ID NO: 1346577 - RNA, 16 nt, Homo sapiens
ccaaggcucugagcaa

SEQ ID NO: 1346578 - RNA, 14 nt, Homo sapiens
ccaagggagacuga

SEQ ID NO: 1346579 - RNA, 22 nt, Homo sapiens
ccaagggauggacaucuuguca

SEQ ID NO: 1346580 - RNA, 20 nt, Homo sapiens
ccaaggggaaucagaacuca

SEQ ID NO: 1346581 - RNA, 17 nt, Homo sapiens
ccaauagcaaggcugug

SEQ ID NO: 1346582 - RNA, 18 nt, Homo sapiens
ccaauaguugguuucaaa

SEQ ID NO: 1346583 - RNA, 18 nt, Homo sapiens
ccaaucagaucaacucug

SEQ ID NO: 1346584 - RNA, 19 nt, Homo sapiens
ccaaucuuaaacauaauaa

SEQ ID NO: 1346585 - RNA, 18 nt, Homo sapiens
ccaaugccaaaaggauaa

SEQ ID NO: 1346586 - RNA, 12 nt, Homo sapiens
ccaaugcugcuu

SEQ ID NO: 1346587 - RNA, 23 nt, Homo sapiens
ccaaugcugucugguugcgccau

SEQ ID NO: 1346588 - RNA, 23 nt, Homo sapiens
ccaauuggugucuguacucagcc

SEQ ID NO: 1346589 - RNA, 14 nt, Homo sapiens
ccacaaacuccagg

SEQ ID NO: 1346590 - RNA, 17 nt, Homo sapiens
ccacaauugaacuucca

SEQ ID NO: 1346591 - RNA, 11 nt, Homo sapiens
ccacacaagcg

SEQ ID NO: 1346592 - RNA, 12 nt, Homo sapiens
ccacagcaguug

SEQ ID NO: 1346593 - RNA, 23 nt, Homo sapiens
ccacagcaguugaaaagacucca

SEQ ID NO: 1346594 - RNA, 19 nt, Homo sapiens
ccacagccugcaagucagu

SEQ ID NO: 1346595 - RNA, 20 nt, Homo sapiens
ccacagccuuaccaaagcag

SEQ ID NO: 1346596 - RNA, 22 nt, Homo sapiens
ccacagccuuaccaaagcagac

SEQ ID NO: 1346597 - RNA, 15 nt, Homo sapiens
ccacaguguggggca

SEQ ID NO: 1346598 - RNA, 11 nt, Homo sapiens
ccacaucuugc

SEQ ID NO: 1346599 - RNA, 18 nt, Homo sapiens
ccacauuggcugccuuau

SEQ ID NO: 1346600 - RNA, 13 nt, Homo sapiens
ccaccaaaauuau

SEQ ID NO: 1346601 - RNA, 18 nt, Homo sapiens
ccaccaacauucuuggca

SEQ ID NO: 1346602 - RNA, 17 nt, Homo sapiens
ccaccaagaagcacugg

SEQ ID NO: 1346603 - RNA, 23 nt, Homo sapiens
ccaccagcgaacucucagaaaua

SEQ ID NO: 1346604 - RNA, 21 nt, Homo sapiens
ccaccccagcaggacagugac

SEQ ID NO: 1346605 - RNA, 17 nt, Homo sapiens
ccaccccuaaagagaua

SEQ ID NO: 1346606 - RNA, 17 nt, Homo sapiens
ccacccgguccccacuu

SEQ ID NO: 1346607 - RNA, 22 nt, Homo sapiens
ccacccucauucuacugaaaag

SEQ ID NO: 1346608 - RNA, 14 nt, Homo sapiens
ccaccgcccagaga

SEQ ID NO: 1346609 - RNA, 16 nt, Homo sapiens
ccaccuccacaccagg

SEQ ID NO: 1346610 - RNA, 19 nt, Homo sapiens
ccaccucggcacacacugu

SEQ ID NO: 1346611 - RNA, 22 nt, Homo sapiens
ccaccucggcacacacugugcc

SEQ ID NO: 1346612 - RNA, 13 nt, Homo sapiens
ccacgagggugcc

SEQ ID NO: 1346613 - RNA, 14 nt, Homo sapiens
ccacggugccucca

SEQ ID NO: 1346614 - RNA, 14 nt, Homo sapiens
ccacuacauucuga

SEQ ID NO: 1346615 - RNA, 20 nt, Homo sapiens
ccacuagaagcaacuaggaa

SEQ ID NO: 1346616 - RNA, 19 nt, Homo sapiens
ccacucaggggucauucau

SEQ ID NO: 1346617 - RNA, 15 nt, Homo sapiens
ccacuccagcuccuu

SEQ ID NO: 1346618 - RNA, 17 nt, Homo sapiens
ccacucugggcaaagcc

SEQ ID NO: 1346619 - RNA, 21 nt, Homo sapiens
ccacugagaagugcacuuuaa

SEQ ID NO: 1346620 - RNA, 15 nt, Homo sapiens
ccacugcugagcugg

SEQ ID NO: 1346621 - RNA, 20 nt, Homo sapiens
ccacuguuauuaacagauaa

SEQ ID NO: 1346622 - RNA, 13 nt, Homo sapiens
ccacuuacauaua

SEQ ID NO: 1346623 - RNA, 17 nt, Homo sapiens
ccacuuggcaucauuca

SEQ ID NO: 1346624 - RNA, 14 nt, Homo sapiens
ccacuuuauugcca

SEQ ID NO: 1346625 - RNA, 17 nt, Homo sapiens
ccagaaaagcaguggcu

SEQ ID NO: 1346626 - RNA, 13 nt, Homo sapiens
ccagaaacuguuc

SEQ ID NO: 1346627 - RNA, 18 nt, Homo sapiens
ccagaaccgcagaagccu

SEQ ID NO: 1346628 - RNA, 23 nt, Homo sapiens
ccagaaguuuuaacuuccagugg

SEQ ID NO: 1346629 - RNA, 18 nt, Homo sapiens
ccagaaugccuccugcag

SEQ ID NO: 1346630 - RNA, 15 nt, Homo sapiens
ccagacucagacauu

SEQ ID NO: 1346631 - RNA, 12 nt, Homo sapiens
ccagacucuggg

SEQ ID NO: 1346632 - RNA, 16 nt, Homo sapiens
ccagacuggcacaguu

SEQ ID NO: 1346633 - RNA, 20 nt, Homo sapiens
ccagagacauacuugaaggg

SEQ ID NO: 1346634 - RNA, 14 nt, Homo sapiens
ccagagcaaaauaa

SEQ ID NO: 1346635 - RNA, 20 nt, Homo sapiens
ccagaggaagggacaccaag

SEQ ID NO: 1346636 - RNA, 18 nt, Homo sapiens
ccagaggcuucuccaaag

SEQ ID NO: 1346637 - RNA, 21 nt, Homo sapiens
ccagaggcuucuccaaaggga

SEQ ID NO: 1346638 - RNA, 21 nt, Homo sapiens
ccagagguaauguuaguaaau

SEQ ID NO: 1346639 - RNA, 13 nt, Homo sapiens
ccagauaacuuag

SEQ ID NO: 1346640 - RNA, 12 nt, Homo sapiens
ccagauccagcc

SEQ ID NO: 1346641 - RNA, 16 nt, Homo sapiens
ccagcaagcucuucac

SEQ ID NO: 1346642 - RNA, 15 nt, Homo sapiens
ccagcaggacaguga

SEQ ID NO: 1346643 - RNA, 16 nt, Homo sapiens
ccagcaggacagugac

SEQ ID NO: 1346644 - RNA, 14 nt, Homo sapiens
ccagccacugugau

SEQ ID NO: 1346645 - RNA, 20 nt, Homo sapiens
ccagccagggcucaaucucu

SEQ ID NO: 1346646 - RNA, 17 nt, Homo sapiens
ccagccguauuuuacau

SEQ ID NO: 1346647 - RNA, 15 nt, Homo sapiens
ccagccuacauucac

SEQ ID NO: 1346648 - RNA, 14 nt, Homo sapiens
ccagccuccaugcu

SEQ ID NO: 1346649 - RNA, 18 nt, Homo sapiens
ccagcucaaugcaauggc

SEQ ID NO: 1346650 - RNA, 13 nt, Homo sapiens
ccagcucacagga

SEQ ID NO: 1346651 - RNA, 16 nt, Homo sapiens
ccagcuccaaggggaa

SEQ ID NO: 1346652 - RNA, 12 nt, Homo sapiens
ccagcuccgugu

SEQ ID NO: 1346653 - RNA, 23 nt, Homo sapiens
ccagcugacacgcucaguugaaa

SEQ ID NO: 1346654 - RNA, 20 nt, Homo sapiens
ccagcuucucucuccagggu

SEQ ID NO: 1346655 - RNA, 17 nt, Homo sapiens
ccagcuuuccucaucag

SEQ ID NO: 1346656 - RNA, 20 nt, Homo sapiens
ccaggaaagguuuuccuuau

SEQ ID NO: 1346657 - RNA, 19 nt, Homo sapiens
ccaggaauauaugucagug

SEQ ID NO: 1346658 - RNA, 13 nt, Homo sapiens
ccaggacccugaa

SEQ ID NO: 1346659 - RNA, 20 nt, Homo sapiens
ccaggacuguugaugccuuu

SEQ ID NO: 1346660 - RNA, 18 nt, Homo sapiens
ccaggagaaugcugcaau

SEQ ID NO: 1346661 - RNA, 14 nt, Homo sapiens
ccaggagaccucca

SEQ ID NO: 1346662 - RNA, 17 nt, Homo sapiens
ccaggccugggugaucu

SEQ ID NO: 1346663 - RNA, 16 nt, Homo sapiens
ccaggcuagagugcaa

SEQ ID NO: 1346664 - RNA, 22 nt, Homo sapiens
ccaggcugccuggucacugccc

SEQ ID NO: 1346665 - RNA, 17 nt, Homo sapiens
ccaggcuggagugcaau

SEQ ID NO: 1346666 - RNA, 23 nt, Homo sapiens
cguggauuguauuuaagacauaa

SEQ ID NO: 1346667 - RNA, 18 nt, Homo sapiens
cguggugaccuuucacga

SEQ ID NO: 1346668 - RNA, 20 nt, Homo sapiens
cgugguuacucacaccugua

SEQ ID NO: 1346669 - RNA, 14 nt, Homo sapiens
cgugugcacacuca

SEQ ID NO: 1346670 - RNA, 18 nt, Homo sapiens
cguuagggugaagcauua

SEQ ID NO: 1346671 - RNA, 17 nt, Homo sapiens
cguugcccccagacuuc

SEQ ID NO: 1346672 - RNA, 13 nt, Homo sapiens
cuaaaaccugaaa

SEQ ID NO: 1346673 - RNA, 14 nt, Homo sapiens
cuaaaacuggcaaa

SEQ ID NO: 1346674 - RNA, 17 nt, Homo sapiens
cuaaaacuggcccuguu

SEQ ID NO: 1346675 - RNA, 12 nt, Homo sapiens
cuaaacugcagc

SEQ ID NO: 1346676 - RNA, 18 nt, Homo sapiens
cuaaagaagaggagaaaa

SEQ ID NO: 1346677 - RNA, 19 nt, Homo sapiens
cuaaagccucaaaacaaag

SEQ ID NO: 1346678 - RNA, 12 nt, Homo sapiens
cuaaagggacua

SEQ ID NO: 1346679 - RNA, 19 nt, Homo sapiens
cuaaaguacagacauccua

SEQ ID NO: 1346680 - RNA, 16 nt, Homo sapiens
cuaaaguauaacaugu

SEQ ID NO: 1346681 - RNA, 18 nt, Homo sapiens
cuaaagucuguugauuaa

SEQ ID NO: 1346682 - RNA, 12 nt, Homo sapiens
cuaaaugaugcc

SEQ ID NO: 1346683 - RNA, 20 nt, Homo sapiens
cuaaauggguauuuguucaa

SEQ ID NO: 1346684 - RNA, 16 nt, Homo sapiens
cuaaaugucagcuguu

SEQ ID NO: 1346685 - RNA, 14 nt, Homo sapiens
cuaacauagauuua

SEQ ID NO: 1346686 - RNA, 16 nt, Homo sapiens
cuaacaucuaaaaaua

SEQ ID NO: 1346687 - RNA, 16 nt, Homo sapiens
cuaacauguaauugca

SEQ ID NO: 1346688 - RNA, 21 nt, Homo sapiens
cuaacuaugcauggugcccca

SEQ ID NO: 1346689 - RNA, 20 nt, Homo sapiens
cuaacuuacaaagauucucu

SEQ ID NO: 1346690 - RNA, 16 nt, Homo sapiens
cuaagauacugaugac

SEQ ID NO: 1346691 - RNA, 18 nt, Homo sapiens
cuaagcccccacuacaag

SEQ ID NO: 1346692 - RNA, 21 nt, Homo sapiens
cuaagcccccacuacaaguga

SEQ ID NO: 1346693 - RNA, 15 nt, Homo sapiens
cuaagcgcacauuca

SEQ ID NO: 1346694 - RNA, 16 nt, Homo sapiens
cuaaggagccuggaaa

SEQ ID NO: 1346695 - RNA, 13 nt, Homo sapiens
cuaaggugaaaag

SEQ ID NO: 1346696 - RNA, 23 nt, Homo sapiens
cuaaguaauuuagaagauauuau

SEQ ID NO: 1346697 - RNA, 18 nt, Homo sapiens
cuaaguguggguuuauau

SEQ ID NO: 1346698 - RNA, 12 nt, Homo sapiens
cuaaucagugau

SEQ ID NO: 1346699 - RNA, 16 nt, Homo sapiens
cuaaucugugcuguuu

SEQ ID NO: 1346700 - RNA, 18 nt, Homo sapiens
cuaaucugugcuguuuca

SEQ ID NO: 1346701 - RNA, 23 nt, Homo sapiens
cuaaugacaaguauuuucuacua

SEQ ID NO: 1346702 - RNA, 15 nt, Homo sapiens
cuaaugauguucucu

SEQ ID NO: 1346703 - RNA, 15 nt, Homo sapiens
cuaauuccacacccu

SEQ ID NO: 1346704 - RNA, 21 nt, Homo sapiens
cuaauuuauccugaaauuuca

SEQ ID NO: 1346705 - RNA, 18 nt, Homo sapiens
cuaauuuuuuauccuuuu

SEQ ID NO: 1346706 - RNA, 22 nt, Homo sapiens
cuaauuuuuucccagacuacua

SEQ ID NO: 1346707 - RNA, 13 nt, Homo sapiens
cuacaacuuuaaa

SEQ ID NO: 1346708 - RNA, 18 nt, Homo sapiens
cuacagcgagcugcauua

SEQ ID NO: 1346709 - RNA, 12 nt, Homo sapiens
cuacaugcaauu

SEQ ID NO: 1346710 - RNA, 12 nt, Homo sapiens
cuacauguucuu

SEQ ID NO: 1346711 - RNA, 13 nt, Homo sapiens
cuacauucacuuc

SEQ ID NO: 1346712 - RNA, 18 nt, Homo sapiens
cuacauuucuacuaugau

SEQ ID NO: 1346713 - RNA, 15 nt, Homo sapiens
cuaccaaauagugau

SEQ ID NO: 1346714 - RNA, 17 nt, Homo sapiens
cuaccaggaagaaggac

SEQ ID NO: 1346715 - RNA, 9 nt, Homo sapiens
cuaccccag

SEQ ID NO: 1346716 - RNA, 15 nt, Homo sapiens
cuaccuaccaagaua

SEQ ID NO: 1346717 - RNA, 14 nt, Homo sapiens
cuaccucagccucc

SEQ ID NO: 1346718 - RNA, 20 nt, Homo sapiens
cuaccuuagaaaacaaguau

SEQ ID NO: 1346719 - RNA, 20 nt, Homo sapiens
cuacucaggaggcugaggca

SEQ ID NO: 1346720 - RNA, 23 nt, Homo sapiens
cuacucuaggcagugacagugcc

SEQ ID NO: 1346721 - RNA, 15 nt, Homo sapiens
cuacugcaagagcca

SEQ ID NO: 1346722 - RNA, 16 nt, Homo sapiens
cuacugcaagagccaa

SEQ ID NO: 1346723 - RNA, 13 nt, Homo sapiens
cuacugcuucaau

SEQ ID NO: 1346724 - RNA, 19 nt, Homo sapiens
cuacuuccugugacuucag

SEQ ID NO: 1346725 - RNA, 18 nt, Homo sapiens
cuagacugcuccugggca

SEQ ID NO: 1346726 - RNA, 15 nt, Homo sapiens
cuagagggggucuca

SEQ ID NO: 1346727 - RNA, 14 nt, Homo sapiens
cuagaguguagccu

SEQ ID NO: 1346728 - RNA, 22 nt, Homo sapiens
cuagauaugaagaaucugcucu

SEQ ID NO: 1346729 - RNA, 15 nt, Homo sapiens
cuagauggcuccucu

SEQ ID NO: 1346730 - RNA, 17 nt, Homo sapiens
cuagauuuaacucaguu

SEQ ID NO: 1346731 - RNA, 18 nt, Homo sapiens
cuagcccucucacauuua

SEQ ID NO: 1346732 - RNA, 18 nt, Homo sapiens
cuagcuaaucucuacaaa

SEQ ID NO: 1346733 - RNA, 14 nt, Homo sapiens
cuagcugggcacag

SEQ ID NO: 1346734 - RNA, 18 nt, Homo sapiens
cuaggaaaagaccaucug

SEQ ID NO: 1346735 - RNA, 21 nt, Homo sapiens
cuaggaaaaucacuugccaaa

SEQ ID NO: 1346736 - RNA, 14 nt, Homo sapiens
cuaggaaccagcca

SEQ ID NO: 1346737 - RNA, 17 nt, Homo sapiens
cuaggcauacuuuucaa

SEQ ID NO: 1346738 - RNA, 13 nt, Homo sapiens
cuaguaccuguga

SEQ ID NO: 1346739 - RNA, 15 nt, Homo sapiens
cuagucaccagagac

SEQ ID NO: 1346740 - RNA, 16 nt, Homo sapiens
cuagucauucuucccu

SEQ ID NO: 1346741 - RNA, 15 nt, Homo sapiens
cuagucucuacccag

SEQ ID NO: 1346742 - RNA, 16 nt, Homo sapiens
cuauaacuuacuucug

SEQ ID NO: 1346743 - RNA, 22 nt, Homo sapiens
cuauaauuuauuaacuauuuau

SEQ ID NO: 1346744 - RNA, 17 nt, Homo sapiens
cuauacaguagcuugaa

SEQ ID NO: 1346745 - RNA, 22 nt, Homo sapiens
cuauacccacccagaaugagac

SEQ ID NO: 1346746 - RNA, 12 nt, Homo sapiens
cuauagagccaa

SEQ ID NO: 1346747 - RNA, 20 nt, Homo sapiens
cuauagcuaaguacacaaua

SEQ ID NO: 1346748 - RNA, 18 nt, Homo sapiens
cuauaggccaaugcauga

SEQ ID NO: 1346749 - RNA, 18 nt, Homo sapiens
cuauagggugugaugaag

SEQ ID NO: 1346750 - RNA, 12 nt, Homo sapiens
cuaucagcaaug

SEQ ID NO: 1346751 - RNA, 13 nt, Homo sapiens
cuaucaguucccu

SEQ ID NO: 1346752 - RNA, 19 nt, Homo sapiens
cuaugaggggguuuggcac

SEQ ID NO: 1346753 - RNA, 23 nt, Homo sapiens
cuaugauacugucucuccaguga

SEQ ID NO: 1346754 - RNA, 11 nt, Homo sapiens
cuaugguucuc

SEQ ID NO: 1346755 - RNA, 21 nt, Homo sapiens
cuauguuaauauuuuaugugu

SEQ ID NO: 1346756 - RNA, 18 nt, Homo sapiens
cuauuaagauacuuagau

SEQ ID NO: 1346757 - RNA, 22 nt, Homo sapiens
cuauuaagauacuuagauuaga

SEQ ID NO: 1346758 - RNA, 14 nt, Homo sapiens
cuauuacaguguug

SEQ ID NO: 1346759 - RNA, 14 nt, Homo sapiens
cuauuauauucauu

SEQ ID NO: 1346760 - RNA, 14 nt, Homo sapiens
cuauucacaaaaua

SEQ ID NO: 1346761 - RNA, 20 nt, Homo sapiens
cuauucccucucucucccag

SEQ ID NO: 1346762 - RNA, 18 nt, Homo sapiens
cuauucugagcauacuca

SEQ ID NO: 1346763 - RNA, 20 nt, Homo sapiens
cuauuucaauacuuacauau

SEQ ID NO: 1346764 - RNA, 21 nt, Homo sapiens
cuauuucaauacuuacauauc

SEQ ID NO: 1346765 - RNA, 13 nt, Homo sapiens
cuauuucuugaua

SEQ ID NO: 1346766 - RNA, 21 nt, Homo sapiens
cuauuugccuccagugcaguc

SEQ ID NO: 1346767 - RNA, 19 nt, Homo sapiens
cuauuuuuauacacuguaa

SEQ ID NO: 1346768 - RNA, 18 nt, Homo sapiens
cucaaaauaccaugccau

SEQ ID NO: 1346769 - RNA, 18 nt, Homo sapiens
cucaaacccccagccuca

SEQ ID NO: 1346770 - RNA, 22 nt, Homo sapiens
cucaaacuccugaccucaggug

SEQ ID NO: 1346771 - RNA, 18 nt, Homo sapiens
cucaaccaaugccaaaaa

SEQ ID NO: 1346772 - RNA, 15 nt, Homo sapiens
cucaagaccaacaga

SEQ ID NO: 1346773 - RNA, 22 nt, Homo sapiens
cucaagugauccuccugacuca

SEQ ID NO: 1346774 - RNA, 19 nt, Homo sapiens
cucaaucgagugagacaga

SEQ ID NO: 1346775 - RNA, 14 nt, Homo sapiens
cucaaugcccagua

SEQ ID NO: 1346776 - RNA, 18 nt, Homo sapiens
cucacaaaccaugcaaau

SEQ ID NO: 1346777 - RNA, 22 nt, Homo sapiens
cucacaggcgccuaaagucauu

SEQ ID NO: 1346778 - RNA, 14 nt, Homo sapiens
cucacauaagccca

SEQ ID NO: 1346779 - RNA, 15 nt, Homo sapiens
cucaccacagccuuc

SEQ ID NO: 1346780 - RNA, 20 nt, Homo sapiens
cucacccagucuucuacaca

SEQ ID NO: 1346781 - RNA, 19 nt, Homo sapiens
cucacgcccuaagcgcaca

SEQ ID NO: 1346782 - RNA, 15 nt, Homo sapiens
cucacucuguuuccu

SEQ ID NO: 1346783 - RNA, 17 nt, Homo sapiens
cucacuggccugccaug

SEQ ID NO: 1346784 - RNA, 23 nt, Homo sapiens
cucagacagaaccccuacaugaa

SEQ ID NO: 1346785 - RNA, 14 nt, Homo sapiens
cucagacauccaca

SEQ ID NO: 1346786 - RNA, 13 nt, Homo sapiens
cucagagugcaag

SEQ ID NO: 1346787 - RNA, 23 nt, Homo sapiens
cucagaucauuaucagccugugc

SEQ ID NO: 1346788 - RNA, 19 nt, Homo sapiens
cucagccuggccagacaca

SEQ ID NO: 1346789 - RNA, 14 nt, Homo sapiens
cucagcucuuggcu

SEQ ID NO: 1346790 - RNA, 19 nt, Homo sapiens
cucagcucuuggcuccacu

SEQ ID NO: 1346791 - RNA, 22 nt, Homo sapiens
cucaggcaaagaaaaugaaaug

SEQ ID NO: 1346792 - RNA, 14 nt, Homo sapiens
cucaggcacaccuu

SEQ ID NO: 1346793 - RNA, 13 nt, Homo sapiens
cucaggcaccugc

SEQ ID NO: 1346794 - RNA, 22 nt, Homo sapiens
cucaggccacaccggccuugca

SEQ ID NO: 1346795 - RNA, 21 nt, Homo sapiens
cucagggacuggcacacuggc

SEQ ID NO: 1346796 - RNA, 13 nt, Homo sapiens
cucaguaccccau

SEQ ID NO: 1346797 - RNA, 15 nt, Homo sapiens
cucaguggaucuuca

SEQ ID NO: 1346798 - RNA, 21 nt, Homo sapiens
cucaguguccaguugcagcug

SEQ ID NO: 1346799 - RNA, 19 nt, Homo sapiens
ucaagaagaggaaagggag

SEQ ID NO: 1346800 - RNA, 18 nt, Homo sapiens
ucaagagaucgagaccau

SEQ ID NO: 1346801 - RNA, 18 nt, Homo sapiens
ucaaggagcaagaaauga

SEQ ID NO: 1346802 - RNA, 18 nt, Homo sapiens
ucaaggucccuucaugcg

SEQ ID NO: 1346803 - RNA, 18 nt, Homo sapiens
ucaaguaauaggcauuuu

SEQ ID NO: 1346804 - RNA, 21 nt, Homo sapiens
ucaaguaauccaccugccucg

SEQ ID NO: 1346805 - RNA, 14 nt, Homo sapiens
ucaagucacuccca

SEQ ID NO: 1346806 - RNA, 15 nt, Homo sapiens
ucaagucaguucugu

SEQ ID NO: 1346807 - RNA, 20 nt, Homo sapiens
ucaaguucagcccaccaucu

SEQ ID NO: 1346808 - RNA, 15 nt, Homo sapiens
ucaauaaauuugcuu

SEQ ID NO: 1346809 - RNA, 22 nt, Homo sapiens
ucaauacgugaucucuguuaca

SEQ ID NO: 1346810 - RNA, 13 nt, Homo sapiens
ucaauacuuacau

SEQ ID NO: 1346811 - RNA, 18 nt, Homo sapiens
ucaauauccuuugccuca

SEQ ID NO: 1346812 - RNA, 17 nt, Homo sapiens
ucaaucuggauucauau

SEQ ID NO: 1346813 - RNA, 21 nt, Homo sapiens
ucaaucuuuggaggcuuuuaa

SEQ ID NO: 1346814 - RNA, 15 nt, Homo sapiens
ucaauuccugugauu

SEQ ID NO: 1346815 - RNA, 20 nt, Homo sapiens
ucaauuucuaguaccuguga

SEQ ID NO: 1346816 - RNA, 22 nt, Homo sapiens
ucaauuuuaucccucaccugua

SEQ ID NO: 1346817 - RNA, 21 nt, Homo sapiens
ucaauuuucacaucaaagaca

SEQ ID NO: 1346818 - RNA, 16 nt, Homo sapiens
ucacaaauccuucaaa

SEQ ID NO: 1346819 - RNA, 23 nt, Homo sapiens
ucacaaaucuuaacuugaaggag

SEQ ID NO: 1346820 - RNA, 13 nt, Homo sapiens
ucacaacagugaa

SEQ ID NO: 1346821 - RNA, 16 nt, Homo sapiens
ucacaauuaugugcaa

SEQ ID NO: 1346822 - RNA, 23 nt, Homo sapiens
ucacacacacccccccacaagga

SEQ ID NO: 1346823 - RNA, 17 nt, Homo sapiens
ucacacauuacaaaguu

SEQ ID NO: 1346824 - RNA, 13 nt, Homo sapiens
ucacaccuguaau

SEQ ID NO: 1346825 - RNA, 14 nt, Homo sapiens
ucacacuuugccau

SEQ ID NO: 1346826 - RNA, 16 nt, Homo sapiens
ucacagacccacaaga

SEQ ID NO: 1346827 - RNA, 18 nt, Homo sapiens
ucacagccucaagucacu

SEQ ID NO: 1346828 - RNA, 19 nt, Homo sapiens
ucacaggacucugccuccu

SEQ ID NO: 1346829 - RNA, 20 nt, Homo sapiens
ucacaggagcuuaaacagcu

SEQ ID NO: 1346830 - RNA, 17 nt, Homo sapiens
ucacaggccccaggaaa

SEQ ID NO: 1346831 - RNA, 19 nt, Homo sapiens
ucacaggcgccuaaaguca

SEQ ID NO: 1346832 - RNA, 16 nt, Homo sapiens
ucacaggugacucuaa

SEQ ID NO: 1346833 - RNA, 23 nt, Homo sapiens
ucacaguucuuugggccagacau

SEQ ID NO: 1346834 - RNA, 14 nt, Homo sapiens
ucacaugacucuca

SEQ ID NO: 1346835 - RNA, 15 nt, Homo sapiens
ucacaugguuacaua

SEQ ID NO: 1346836 - RNA, 16 nt, Homo sapiens
ucacauguuuaacuuu

SEQ ID NO: 1346837 - RNA, 14 nt, Homo sapiens
ucaccaaaaaccua

SEQ ID NO: 1346838 - RNA, 21 nt, Homo sapiens
ucaccaaucauaguguaccca

SEQ ID NO: 1346839 - RNA, 16 nt, Homo sapiens
ucaccacuaccagcca

SEQ ID NO: 1346840 - RNA, 23 nt, Homo sapiens
ucaccagcccugcgccaccucac

SEQ ID NO: 1346841 - RNA, 12 nt, Homo sapiens
ucaccaggggag

SEQ ID NO: 1346842 - RNA, 14 nt, Homo sapiens
ucaccaggggagga

SEQ ID NO: 1346843 - RNA, 19 nt, Homo sapiens
ucaccaguuaaaagcauuu

SEQ ID NO: 1346844 - RNA, 21 nt, Homo sapiens
ucaccauuaggucacuuaaga

SEQ ID NO: 1346845 - RNA, 15 nt, Homo sapiens
ucaccuccucuguga

SEQ ID NO: 1346846 - RNA, 19 nt, Homo sapiens
ucaccuuggcaccagacac

SEQ ID NO: 1346847 - RNA, 14 nt, Homo sapiens
ucacucagagggaa

SEQ ID NO: 1346848 - RNA, 17 nt, Homo sapiens
ucacucuguugccauua

SEQ ID NO: 1346849 - RNA, 18 nt, Homo sapiens
ucacucuguugccauuaa

SEQ ID NO: 1346850 - RNA, 13 nt, Homo sapiens
ucacugaacucca

SEQ ID NO: 1346851 - RNA, 14 nt, Homo sapiens
ucacugacaguuaa

SEQ ID NO: 1346852 - RNA, 13 nt, Homo sapiens
ucacugcaguagu

SEQ ID NO: 1346853 - RNA, 17 nt, Homo sapiens
ucacugccccucucuca

SEQ ID NO: 1346854 - RNA, 18 nt, Homo sapiens
ucacugcuggcugccuua

SEQ ID NO: 1346855 - RNA, 14 nt, Homo sapiens
ucacuggugguuuu

SEQ ID NO: 1346856 - RNA, 18 nt, Homo sapiens
ucacuguauccauucuac

SEQ ID NO: 1346857 - RNA, 11 nt, Homo sapiens
ucacugucagu

SEQ ID NO: 1346858 - RNA, 13 nt, Homo sapiens
ucacuguccucca

SEQ ID NO: 1346859 - RNA, 13 nt, Homo sapiens
ucacuuccaugac

SEQ ID NO: 1346860 - RNA, 23 nt, Homo sapiens
ucacuugccaaaauccaaggcaa

SEQ ID NO: 1346861 - RNA, 13 nt, Homo sapiens
ucacuuguacaaa

SEQ ID NO: 1346862 - RNA, 17 nt, Homo sapiens
ucacuugucgggggccc

SEQ ID NO: 1346863 - RNA, 20 nt, Homo sapiens
ucacuuuaauagaagggcaa

SEQ ID NO: 1346864 - RNA, 21 nt, Homo sapiens
ucagaacagaugcugagccau

SEQ ID NO: 1346865 - RNA, 18 nt, Homo sapiens
ucagaaggccccagagag

SEQ ID NO: 1346866 - RNA, 17 nt, Homo sapiens
ucagaauccuaguuuau

SEQ ID NO: 1346867 - RNA, 20 nt, Homo sapiens
ucagaauggcaguccuggag

SEQ ID NO: 1346868 - RNA, 14 nt, Homo sapiens
ucagagcacagcag

SEQ ID NO: 1346869 - RNA, 15 nt, Homo sapiens
ucagauccagggaca

SEQ ID NO: 1346870 - RNA, 22 nt, Homo sapiens
ucagcaagcauuuucguuacau

SEQ ID NO: 1346871 - RNA, 20 nt, Homo sapiens
ucagcagaugcuguugugaa

SEQ ID NO: 1346872 - RNA, 13 nt, Homo sapiens
ucagccacuguga

SEQ ID NO: 1346873 - RNA, 14 nt, Homo sapiens
ucagccacugugau

SEQ ID NO: 1346874 - RNA, 16 nt, Homo sapiens
ucagccauaggugcag

SEQ ID NO: 1346875 - RNA, 18 nt, Homo sapiens
ucagccauaggugcaguu

SEQ ID NO: 1346876 - RNA, 18 nt, Homo sapiens
ucagcccugcaccaugcu

SEQ ID NO: 1346877 - RNA, 20 nt, Homo sapiens
ucagccucugccagcgccaa

SEQ ID NO: 1346878 - RNA, 22 nt, Homo sapiens
ucagccugcuuuccugcagcag

SEQ ID NO: 1346879 - RNA, 16 nt, Homo sapiens
ucagccuggccagaca

SEQ ID NO: 1346880 - RNA, 13 nt, Homo sapiens
ucagcucuuggcu

SEQ ID NO: 1346881 - RNA, 22 nt, Homo sapiens
ucagcuggaaaaggccuguggc

SEQ ID NO: 1346882 - RNA, 18 nt, Homo sapiens
ucagcuggucaaacaaac

SEQ ID NO: 1346883 - RNA, 16 nt, Homo sapiens
ucagcugugccuuccc

SEQ ID NO: 1346884 - RNA, 18 nt, Homo sapiens
ucagcuuaaaauccaaag

SEQ ID NO: 1346885 - RNA, 14 nt, Homo sapiens
ucaggaauugaaaa

SEQ ID NO: 1346886 - RNA, 18 nt, Homo sapiens
ucaggacagaugccacac

SEQ ID NO: 1346887 - RNA, 18 nt, Homo sapiens
ucaggagcagcacucuua

SEQ ID NO: 1346888 - RNA, 18 nt, Homo sapiens
ucaggaguucgagaccag

SEQ ID NO: 1346889 - RNA, 14 nt, Homo sapiens
ucaggauccaguga

SEQ ID NO: 1346890 - RNA, 15 nt, Homo sapiens
ucaggcuagcugugc

SEQ ID NO: 1346891 - RNA, 15 nt, Homo sapiens
ucagggagcauuuaa

SEQ ID NO: 1346892 - RNA, 19 nt, Homo sapiens
ucagguuaaauuaaaccaa

SEQ ID NO: 1346893 - RNA, 12 nt, Homo sapiens
ucaguaccccau

SEQ ID NO: 1346894 - RNA, 12 nt, Homo sapiens
ucaguaugugga

SEQ ID NO: 1346895 - RNA, 17 nt, Homo sapiens
ucaguccaauaaauuau

SEQ ID NO: 1346896 - RNA, 15 nt, Homo sapiens
ucagugauggaauau

SEQ ID NO: 1346897 - RNA, 15 nt, Homo sapiens
ucaguuccauggcaa

SEQ ID NO: 1346898 - RNA, 21 nt, Homo sapiens
ucaguuccugaaguucacuca

SEQ ID NO: 1346899 - RNA, 16 nt, Homo sapiens
ucaguugcaguaguau

SEQ ID NO: 1346900 - RNA, 17 nt, Homo sapiens
ucaguuucuaggcaccu

SEQ ID NO: 1346901 - RNA, 17 nt, Homo sapiens
ucauaauucagcacuua

SEQ ID NO: 1346902 - RNA, 16 nt, Homo sapiens
ucauaccuaucaucuu

SEQ ID NO: 1346903 - RNA, 20 nt, Homo sapiens
ucauagcaccuaacaacauu

SEQ ID NO: 1346904 - RNA, 18 nt, Homo sapiens
ucauagcucauugcaagc

SEQ ID NO: 1346905 - RNA, 15 nt, Homo sapiens
ucauaggcuaaguca

SEQ ID NO: 1346906 - RNA, 23 nt, Homo sapiens
ucauagggauggcagugauucug

SEQ ID NO: 1346907 - RNA, 14 nt, Homo sapiens
ucauauacaauugu

SEQ ID NO: 1346908 - RNA, 13 nt, Homo sapiens
ucauauguggaau

SEQ ID NO: 1346909 - RNA, 18 nt, Homo sapiens
ucauauuugaaaaccaua

SEQ ID NO: 1346910 - RNA, 20 nt, Homo sapiens
ucaucacgacacauuugccu

SEQ ID NO: 1346911 - RNA, 12 nt, Homo sapiens
ucaucaggccau

SEQ ID NO: 1346912 - RNA, 12 nt, Homo sapiens
ucauccaggcau

SEQ ID NO: 1346913 - RNA, 23 nt, Homo sapiens
ucauccuuaaaacaauucuguga

SEQ ID NO: 1346914 - RNA, 15 nt, Homo sapiens
ucaucuguaccucug

SEQ ID NO: 1346915 - RNA, 16 nt, Homo sapiens
ucaugaaagcaucuga

SEQ ID NO: 1346916 - RNA, 23 nt, Homo sapiens
ucaugaagugcacaggagccaaa

SEQ ID NO: 1346917 - RNA, 13 nt, Homo sapiens
ucaugacgugcau

SEQ ID NO: 1346918 - RNA, 11 nt, Homo sapiens
ucaugcacugu

SEQ ID NO: 1346919 - RNA, 18 nt, Homo sapiens
ucaugcccucucucggga

SEQ ID NO: 1346920 - RNA, 15 nt, Homo sapiens
ucaugcgcacagagg

SEQ ID NO: 1346921 - RNA, 18 nt, Homo sapiens
ucaugcucgacacuuacc

SEQ ID NO: 1346922 - RNA, 13 nt, Homo sapiens
ucaugcugucagu

SEQ ID NO: 1346923 - RNA, 15 nt, Homo sapiens
ucaugcuuuugcuau

SEQ ID NO: 1346924 - RNA, 20 nt, Homo sapiens
ucauggaugcuuuggcaaug

SEQ ID NO: 1346925 - RNA, 20 nt, Homo sapiens
ucauggaugggggaacucag

SEQ ID NO: 1346926 - RNA, 20 nt, Homo sapiens
ucauggggaagcuuccauga

SEQ ID NO: 1346927 - RNA, 21 nt, Homo sapiens
ucauggggaagcuuccaugau

SEQ ID NO: 1346928 - RNA, 13 nt, Homo sapiens
ucauguccaguga

SEQ ID NO: 1346929 - RNA, 18 nt, Homo sapiens
ucaugugaccacucuguc

SEQ ID NO: 1346930 - RNA, 22 nt, Homo sapiens
ucauuacuguuccagauuccua

SEQ ID NO: 1346931 - RNA, 19 nt, Homo sapiens
ucauuaucucaaaacugca

SEQ ID NO: 1346932 - RNA, 16 nt, Homo sapiens
ucuggccuguggcuaa

SEQ ID NO: 1346933 - RNA, 19 nt, Homo sapiens
ucuggcuggaaagcagagc

SEQ ID NO: 1346934 - RNA, 15 nt, Homo sapiens
ucugggacccacaga

SEQ ID NO: 1346935 - RNA, 17 nt, Homo sapiens
ucugggggaguggaaua

SEQ ID NO: 1346936 - RNA, 16 nt, Homo sapiens
ucugguaauauugacu

SEQ ID NO: 1346937 - RNA, 21 nt, Homo sapiens
ucuggucuucgcagccuagau

SEQ ID NO: 1346938 - RNA, 13 nt, Homo sapiens
ucugguguugacu

SEQ ID NO: 1346939 - RNA, 16 nt, Homo sapiens
ucugguguuugucaug

SEQ ID NO: 1346940 - RNA, 15 nt, Homo sapiens
ucuguaaacuuccaa

SEQ ID NO: 1346941 - RNA, 14 nt, Homo sapiens
ucugucagcugcaa

SEQ ID NO: 1346942 - RNA, 23 nt, Homo sapiens
ucugugacauacauauuaucuca

SEQ ID NO: 1346943 - RNA, 16 nt, Homo sapiens
ucuguggugcagugug

SEQ ID NO: 1346944 - RNA, 19 nt, Homo sapiens
ucuguguguguguaugugg

SEQ ID NO: 1346945 - RNA, 12 nt, Homo sapiens
ucuguguguuga

SEQ ID NO: 1346946 - RNA, 23 nt, Homo sapiens
ucuguucuguuggaugacuuuga

SEQ ID NO: 1346947 - RNA, 15 nt, Homo sapiens
ucuguugccauuaaa

SEQ ID NO: 1346948 - RNA, 21 nt, Homo sapiens
ucuguuuccuggucagcaugu

SEQ ID NO: 1346949 - RNA, 19 nt, Homo sapiens
ucuguuugauacaguauua

SEQ ID NO: 1346950 - RNA, 20 nt, Homo sapiens
ucuguuuugcauggaguauu

SEQ ID NO: 1346951 - RNA, 19 nt, Homo sapiens
ucuuaaauuugauuuacau

SEQ ID NO: 1346952 - RNA, 19 nt, Homo sapiens
ucuuaccagugacgcugcu

SEQ ID NO: 1346953 - RNA, 19 nt, Homo sapiens
ucuuacccuguacauaugu

SEQ ID NO: 1346954 - RNA, 19 nt, Homo sapiens
ucuuaccuguaugucucca

SEQ ID NO: 1346955 - RNA, 17 nt, Homo sapiens
ucuuagaaaagcuaaga

SEQ ID NO: 1346956 - RNA, 16 nt, Homo sapiens
ucuuagauauucacua

SEQ ID NO: 1346957 - RNA, 17 nt, Homo sapiens
ucuuagcugucugcuca

SEQ ID NO: 1346958 - RNA, 18 nt, Homo sapiens
ucuuauuaaucauacaaa

SEQ ID NO: 1346959 - RNA, 19 nt, Homo sapiens
ucuucaaagcaaagcucuu

SEQ ID NO: 1346960 - RNA, 20 nt, Homo sapiens
ucuucauguccagugagcag

SEQ ID NO: 1346961 - RNA, 15 nt, Homo sapiens
ucuucccagcaauua

SEQ ID NO: 1346962 - RNA, 21 nt, Homo sapiens
ucuucccuggguuuucugccc

SEQ ID NO: 1346963 - RNA, 15 nt, Homo sapiens
ucuuccuccucccaa

SEQ ID NO: 1346964 - RNA, 20 nt, Homo sapiens
ucuuccugucuccuuugaag

SEQ ID NO: 1346965 - RNA, 19 nt, Homo sapiens
ucuuccuuuuauauaaaua

SEQ ID NO: 1346966 - RNA, 14 nt, Homo sapiens
ucuucgcagccuag

SEQ ID NO: 1346967 - RNA, 21 nt, Homo sapiens
ucuucgcagccuagauaugaa

SEQ ID NO: 1346968 - RNA, 13 nt, Homo sapiens
ucuucuccacugg

SEQ ID NO: 1346969 - RNA, 18 nt, Homo sapiens
ucuucucuauuucuggau

SEQ ID NO: 1346970 - RNA, 23 nt, Homo sapiens
ucuucuggagauggaagcuuguu

SEQ ID NO: 1346971 - RNA, 14 nt, Homo sapiens
ucuucuuugcugca

SEQ ID NO: 1346972 - RNA, 23 nt, Homo sapiens
ucuugaguauaagaaaugcauau

SEQ ID NO: 1346973 - RNA, 18 nt, Homo sapiens
ucuugaguuccucugcag

SEQ ID NO: 1346974 - RNA, 19 nt, Homo sapiens
ucuugcuuucuaugcuguu

SEQ ID NO: 1346975 - RNA, 21 nt, Homo sapiens
ucuuggccaucuaaacaucau

SEQ ID NO: 1346976 - RNA, 21 nt, Homo sapiens
ucuugggcccaggacuguuga

SEQ ID NO: 1346977 - RNA, 16 nt, Homo sapiens
ucuuggguucccaaau

SEQ ID NO: 1346978 - RNA, 19 nt, Homo sapiens
ucuugguucgauaccugga

SEQ ID NO: 1346979 - RNA, 18 nt, Homo sapiens
ucuuguaggucauugcac

SEQ ID NO: 1346980 - RNA, 12 nt, Homo sapiens
ucuuuaccuccu

SEQ ID NO: 1346981 - RNA, 13 nt, Homo sapiens
ucuuuauaauucu

SEQ ID NO: 1346982 - RNA, 22 nt, Homo sapiens
ucuuucaagucaguucugugau

SEQ ID NO: 1346983 - RNA, 12 nt, Homo sapiens
ucuuucacuuca

SEQ ID NO: 1346984 - RNA, 21 nt, Homo sapiens
ucuuucuaaugcugauaugau

SEQ ID NO: 1346985 - RNA, 23 nt, Homo sapiens
ucuuucuauauaaaauguauuca

SEQ ID NO: 1346986 - RNA, 19 nt, Homo sapiens
ucuuucuuugcaccaaaga

SEQ ID NO: 1346987 - RNA, 23 nt, Homo sapiens
ucuuugaagcgagcagucagcau

SEQ ID NO: 1346988 - RNA, 14 nt, Homo sapiens
ucuuugcaccaaag

SEQ ID NO: 1346989 - RNA, 20 nt, Homo sapiens
ucuuugcaccaaagacauca

SEQ ID NO: 1346990 - RNA, 17 nt, Homo sapiens
ucuuuggaggcuuuuaa

SEQ ID NO: 1346991 - RNA, 14 nt, Homo sapiens
ucuuuuaacagccu

SEQ ID NO: 1346992 - RNA, 18 nt, Homo sapiens
ugaaaaaggaacuaccua

SEQ ID NO: 1346993 - RNA, 13 nt, Homo sapiens
ugaaaacuucaaa

SEQ ID NO: 1346994 - RNA, 13 nt, Homo sapiens
ugaaaacuuugua

SEQ ID NO: 1346995 - RNA, 16 nt, Homo sapiens
ugaaaagacuccaaag

SEQ ID NO: 1346996 - RNA, 18 nt, Homo sapiens
ugaaaagcaggcaaaaga

SEQ ID NO: 1346997 - RNA, 17 nt, Homo sapiens
ugaaaagggacugugag

SEQ ID NO: 1346998 - RNA, 22 nt, Homo sapiens
ugaaaagggguguggcaaagga

SEQ ID NO: 1346999 - RNA, 21 nt, Homo sapiens
ugaaaauaacugaaccaaauu

SEQ ID NO: 1347000 - RNA, 17 nt, Homo sapiens
ugaaacauccuaugaaa

SEQ ID NO: 1347001 - RNA, 17 nt, Homo sapiens
ugaaaccaggacauuaa

SEQ ID NO: 1347002 - RNA, 17 nt, Homo sapiens
ugaaacuccagaugcca

SEQ ID NO: 1347003 - RNA, 23 nt, Homo sapiens
ugaaacugagaugugaacacauc

SEQ ID NO: 1347004 - RNA, 15 nt, Homo sapiens
ugaaagaagcaagac

SEQ ID NO: 1347005 - RNA, 18 nt, Homo sapiens
ugaaagcgacuucagguc

SEQ ID NO: 1347006 - RNA, 17 nt, Homo sapiens
ugaaaguauaaugcagu

SEQ ID NO: 1347007 - RNA, 17 nt, Homo sapiens
ugaaaguauguuuuacu

SEQ ID NO: 1347008 - RNA, 18 nt, Homo sapiens
ugaaaugccacugggaca

SEQ ID NO: 1347009 - RNA, 20 nt, Homo sapiens
ugaaauggcaggauucuaaa

SEQ ID NO: 1347010 - RNA, 23 nt, Homo sapiens
ugaaaugggggcaggaaagccac

SEQ ID NO: 1347011 - RNA, 14 nt, Homo sapiens
ugaaauguguuucc

SEQ ID NO: 1347012 - RNA, 13 nt, Homo sapiens
ugaaauuaacuca

SEQ ID NO: 1347013 - RNA, 18 nt, Homo sapiens
ugaaauuauuucucucac

SEQ ID NO: 1347014 - RNA, 22 nt, Homo sapiens
ugaaauuuaauuacaaacaaua

SEQ ID NO: 1347015 - RNA, 15 nt, Homo sapiens
ugaaauuuggcaaag

SEQ ID NO: 1347016 - RNA, 20 nt, Homo sapiens
ugaaauuuguuauacuucaa

SEQ ID NO: 1347017 - RNA, 15 nt, Homo sapiens
ugaacagaaacuaca

SEQ ID NO: 1347018 - RNA, 14 nt, Homo sapiens
ugaacagcuguuca

SEQ ID NO: 1347019 - RNA, 10 nt, Homo sapiens
ugaacagggc

SEQ ID NO: 1347020 - RNA, 12 nt, Homo sapiens
ugaaccaaagaa

SEQ ID NO: 1347021 - RNA, 15 nt, Homo sapiens
ugaaccaugaaguca

SEQ ID NO: 1347022 - RNA, 18 nt, Homo sapiens
ugaacuauuuuuaagguc

SEQ ID NO: 1347023 - RNA, 21 nt, Homo sapiens
ugaagaacaggcuuggcaaag

SEQ ID NO: 1347024 - RNA, 17 nt, Homo sapiens
ugaagaccaaucaaaua

SEQ ID NO: 1347025 - RNA, 19 nt, Homo sapiens
ugaagaguccucugaauga

SEQ ID NO: 1347026 - RNA, 19 nt, Homo sapiens
ugaagcaacugugaauuca

SEQ ID NO: 1347027 - RNA, 19 nt, Homo sapiens
ugaaggaguccuugcauca

SEQ ID NO: 1347028 - RNA, 20 nt, Homo sapiens
ugaaggcaguggcaggggag

SEQ ID NO: 1347029 - RNA, 17 nt, Homo sapiens
ugaagggguuuucuuga

SEQ ID NO: 1347030 - RNA, 20 nt, Homo sapiens
ugaaguuaagaaccugaaua

SEQ ID NO: 1347031 - RNA, 15 nt, Homo sapiens
ugaauaaaugucacu

SEQ ID NO: 1347032 - RNA, 17 nt, Homo sapiens
ugaauauuauacuucuu

SEQ ID NO: 1347033 - RNA, 22 nt, Homo sapiens
ugaauauuuuucuguaguguga

SEQ ID NO: 1347034 - RNA, 15 nt, Homo sapiens
ugaaucuacauucac

SEQ ID NO: 1347035 - RNA, 14 nt, Homo sapiens
ugaaucugucuauc

SEQ ID NO: 1347036 - RNA, 18 nt, Homo sapiens
ugaaugcacuuuugcuca

SEQ ID NO: 1347037 - RNA, 15 nt, Homo sapiens
ugaauucauaucgcc

SEQ ID NO: 1347038 - RNA, 12 nt, Homo sapiens
ugacaacaucgc

SEQ ID NO: 1347039 - RNA, 16 nt, Homo sapiens
ugacaacaucgcaaua

SEQ ID NO: 1347040 - RNA, 20 nt, Homo sapiens
ugacaauaaaggaacuaauc

SEQ ID NO: 1347041 - RNA, 22 nt, Homo sapiens
ugacaauaaaggaacuaauccu

SEQ ID NO: 1347042 - RNA, 23 nt, Homo sapiens
ugacacagacauccucuaugcca

SEQ ID NO: 1347043 - RNA, 20 nt, Homo sapiens
ugacaccgugggucauuaca

SEQ ID NO: 1347044 - RNA, 21 nt, Homo sapiens
ugacaccgugggucauuacaa

SEQ ID NO: 1347045 - RNA, 15 nt, Homo sapiens
ugacaccugcugaga

SEQ ID NO: 1347046 - RNA, 15 nt, Homo sapiens
ugacacugcucuaac

SEQ ID NO: 1347047 - RNA, 19 nt, Homo sapiens
ugacagauauuuuaucuau

SEQ ID NO: 1347048 - RNA, 19 nt, Homo sapiens
ugacagcucccgggucccc

SEQ ID NO: 1347049 - RNA, 15 nt, Homo sapiens
ugacagcucuucaca

SEQ ID NO: 1347050 - RNA, 19 nt, Homo sapiens
ugacagcuuugcugcugaa

SEQ ID NO: 1347051 - RNA, 14 nt, Homo sapiens
ugacaggacuuuca

SEQ ID NO: 1347052 - RNA, 15 nt, Homo sapiens
ugacagggccagugc

SEQ ID NO: 1347053 - RNA, 15 nt, Homo sapiens
ugacauaaguaacuu

SEQ ID NO: 1347054 - RNA, 15 nt, Homo sapiens
ugacauaagugcuau

SEQ ID NO: 1347055 - RNA, 19 nt, Homo sapiens
ugacauacauauuaucuca

SEQ ID NO: 1347056 - RNA, 15 nt, Homo sapiens
ugacauaucacaugu

SEQ ID NO: 1347057 - RNA, 16 nt, Homo sapiens
ugacaugcauucacau

SEQ ID NO: 1347058 - RNA, 20 nt, Homo sapiens
ugacauuuauauauugaauu

SEQ ID NO: 1347059 - RNA, 23 nt, Homo sapiens
ugaccccuguccccacacugacc

SEQ ID NO: 1347060 - RNA, 14 nt, Homo sapiens
ugaccgacaugaac

SEQ ID NO: 1347061 - RNA, 12 nt, Homo sapiens
ugaccucaagga

SEQ ID NO: 1347062 - RNA, 18 nt, Homo sapiens
ugaccuucagauucccca

SEQ ID NO: 1347063 - RNA, 14 nt, Homo sapiens
ugaccuugcugaug

SEQ ID NO: 1347064 - RNA, 13 nt, Homo sapiens
cagccuccugggu

SEQ ID NO: 1347065 - RNA, 20 nt, Homo sapiens
cagccucugggucugaguca

SEQ ID NO: 1347066 - RNA, 13 nt, Homo sapiens
cagccuggaaggg

SEQ ID NO: 1347067 - RNA, 14 nt, Homo sapiens
cagccuggccagac

SEQ ID NO: 1347068 - RNA, 21 nt, Homo sapiens
cagccugguuucugggugcua

SEQ ID NO: 1347069 - RNA, 18 nt, Homo sapiens
cagccuguccuugucacg

SEQ ID NO: 1347070 - RNA, 12 nt, Homo sapiens
cagccuuucuaa

SEQ ID NO: 1347071 - RNA, 13 nt, Homo sapiens
cagcgaacagccu

SEQ ID NO: 1347072 - RNA, 17 nt, Homo sapiens
cagcgaaugaaugcugu

SEQ ID NO: 1347073 - RNA, 22 nt, Homo sapiens
cagcgcaugugugcaugugcug

SEQ ID NO: 1347074 - RNA, 21 nt, Homo sapiens
cagcgcgucaugacgugcaug

SEQ ID NO: 1347075 - RNA, 13 nt, Homo sapiens
cagcuaaauuuuc

SEQ ID NO: 1347076 - RNA, 24 nt, Homo sapiens
cagcuacucaggaggcugaggcag

SEQ ID NO: 1347077 - RNA, 16 nt, Homo sapiens
cagcucuucacagucc

SEQ ID NO: 1347078 - RNA, 15 nt, Homo sapiens
cagcugagcagcuuu

SEQ ID NO: 1347079 - RNA, 14 nt, Homo sapiens
cagcugcccugugu

SEQ ID NO: 1347080 - RNA, 13 nt, Homo sapiens
cagcugggagcac

SEQ ID NO: 1347081 - RNA, 14 nt, Homo sapiens
cagcugggcugugg

SEQ ID NO: 1347082 - RNA, 14 nt, Homo sapiens
cagcugggugcaga

SEQ ID NO: 1347083 - RNA, 21 nt, Homo sapiens
cagcuggucaaacaaacucuc

SEQ ID NO: 1347084 - RNA, 21 nt, Homo sapiens
cagcugguugcuccauuugag

SEQ ID NO: 1347085 - RNA, 14 nt, Homo sapiens
cagcugugcacuuu

SEQ ID NO: 1347086 - RNA, 19 nt, Homo sapiens
cagcuucaacuuuucucuu

SEQ ID NO: 1347087 - RNA, 21 nt, Homo sapiens
cagcuucugauaaacacaauc

SEQ ID NO: 1347088 - RNA, 21 nt, Homo sapiens
cagcuuugucuccaaagaaga

SEQ ID NO: 1347089 - RNA, 22 nt, Homo sapiens
caggaaaccuuggccucugcua

SEQ ID NO: 1347090 - RNA, 16 nt, Homo sapiens
caggaagaaggacuug

SEQ ID NO: 1347091 - RNA, 20 nt, Homo sapiens
caggaaggaacaaagacagg

SEQ ID NO: 1347092 - RNA, 15 nt, Homo sapiens
caggacagguggugc

SEQ ID NO: 1347093 - RNA, 19 nt, Homo sapiens
caggacagguggugcaaau

SEQ ID NO: 1347094 - RNA, 19 nt, Homo sapiens
caggacaguugauggagcc

SEQ ID NO: 1347095 - RNA, 17 nt, Homo sapiens
caggaccagcucaggac

SEQ ID NO: 1347096 - RNA, 14 nt, Homo sapiens
caggacccucagga

SEQ ID NO: 1347097 - RNA, 19 nt, Homo sapiens
caggacuauauuugggccu

SEQ ID NO: 1347098 - RNA, 14 nt, Homo sapiens
caggacuccuggca

SEQ ID NO: 1347099 - RNA, 21 nt, Homo sapiens
caggacuucucaccagcaguc

SEQ ID NO: 1347100 - RNA, 22 nt, Homo sapiens
caggacuuucauuguucuuggc

SEQ ID NO: 1347101 - RNA, 17 nt, Homo sapiens
caggagaaucacuugaa

SEQ ID NO: 1347102 - RNA, 15 nt, Homo sapiens
caggagauggggaau

SEQ ID NO: 1347103 - RNA, 21 nt, Homo sapiens
caggaggcugaggcaggagaa

SEQ ID NO: 1347104 - RNA, 17 nt, Homo sapiens
caggaggggcagcgcau

SEQ ID NO: 1347105 - RNA, 12 nt, Homo sapiens
caggauucucug

SEQ ID NO: 1347106 - RNA, 15 nt, Homo sapiens
caggauugaucauuc

SEQ ID NO: 1347107 - RNA, 23 nt, Homo sapiens
caggcaccugcacuuacaggccu

SEQ ID NO: 1347108 - RNA, 19 nt, Homo sapiens
caggcacuccaaaccuguc

SEQ ID NO: 1347109 - RNA, 20 nt, Homo sapiens
caggcagccuccgggcgugu

SEQ ID NO: 1347110 - RNA, 22 nt, Homo sapiens
caggcagguaaccccagauuca

SEQ ID NO: 1347111 - RNA, 20 nt, Homo sapiens
caggccauugucccugaaga

SEQ ID NO: 1347112 - RNA, 17 nt, Homo sapiens
caggcccaaugcugcuu

SEQ ID NO: 1347113 - RNA, 21 nt, Homo sapiens
caggcccuuccucuccacugc

SEQ ID NO: 1347114 - RNA, 20 nt, Homo sapiens
caggcgugagccaccgcgcc

SEQ ID NO: 1347115 - RNA, 17 nt, Homo sapiens
caggcuacugucagcuc

SEQ ID NO: 1347116 - RNA, 16 nt, Homo sapiens
caggcuagagugcaau

SEQ ID NO: 1347117 - RNA, 22 nt, Homo sapiens
caggcuagagugcaauggugca

SEQ ID NO: 1347118 - RNA, 13 nt, Homo sapiens
caggcucugacca

SEQ ID NO: 1347119 - RNA, 20 nt, Homo sapiens
caggcucuugacuacuugga

SEQ ID NO: 1347120 - RNA, 15 nt, Homo sapiens
caggcuggagugcaa

SEQ ID NO: 1347121 - RNA, 16 nt, Homo sapiens
caggcuggagugcaau

SEQ ID NO: 1347122 - RNA, 17 nt, Homo sapiens
caggcuggagugcaaug

SEQ ID NO: 1347123 - RNA, 18 nt, Homo sapiens
caggcuggagugcaaugg

SEQ ID NO: 1347124 - RNA, 19 nt, Homo sapiens
caggcuggagugcaauggc

SEQ ID NO: 1347125 - RNA, 20 nt, Homo sapiens
caggcuggucucaaacuccu

SEQ ID NO: 1347126 - RNA, 18 nt, Homo sapiens
caggcuggucuugaacuc

SEQ ID NO: 1347127 - RNA, 14 nt, Homo sapiens
caggcuuaugaaua

SEQ ID NO: 1347128 - RNA, 15 nt, Homo sapiens
caggcuuaugaauau

SEQ ID NO: 1347129 - RNA, 15 nt, Homo sapiens
caggcuuguggcagc

SEQ ID NO: 1347130 - RNA, 13 nt, Homo sapiens
cagggaacugacc

SEQ ID NO: 1347131 - RNA, 20 nt, Homo sapiens
acuauugagugaaacauuga

SEQ ID NO: 1347132 - RNA, 16 nt, Homo sapiens
acuauuuaaagaaaua

SEQ ID NO: 1347133 - RNA, 21 nt, Homo sapiens
acucaaaugcucagaccagcu

SEQ ID NO: 1347134 - RNA, 17 nt, Homo sapiens
acucaaauggggccaga

SEQ ID NO: 1347135 - RNA, 15 nt, Homo sapiens
acucaccaaacacaa

SEQ ID NO: 1347136 - RNA, 21 nt, Homo sapiens
acucaccacuaccagccagcc

SEQ ID NO: 1347137 - RNA, 21 nt, Homo sapiens
acucagauuuaagccuuacaa

SEQ ID NO: 1347138 - RNA, 18 nt, Homo sapiens
acucagcucuuggcucca

SEQ ID NO: 1347139 - RNA, 14 nt, Homo sapiens
acucaggggucauu

SEQ ID NO: 1347140 - RNA, 17 nt, Homo sapiens
acucaggggucauucau

SEQ ID NO: 1347141 - RNA, 18 nt, Homo sapiens
acucagucucucuucucu

SEQ ID NO: 1347142 - RNA, 16 nt, Homo sapiens
acucaguuucuaggca

SEQ ID NO: 1347143 - RNA, 20 nt, Homo sapiens
acucauacacaugugcacac

SEQ ID NO: 1347144 - RNA, 21 nt, Homo sapiens
acucaucuuggcccuccucag

SEQ ID NO: 1347145 - RNA, 19 nt, Homo sapiens
acucauuagugacuucaaa

SEQ ID NO: 1347146 - RNA, 12 nt, Homo sapiens
acucauugcucu

SEQ ID NO: 1347147 - RNA, 23 nt, Homo sapiens
acucauuuuuguuuucauuaucu

SEQ ID NO: 1347148 - RNA, 22 nt, Homo sapiens
acuccaaagaaauguaagggaa

SEQ ID NO: 1347149 - RNA, 15 nt, Homo sapiens
acuccaagagggaau

SEQ ID NO: 1347150 - RNA, 21 nt, Homo sapiens
acuccaagugccccaccacuc

SEQ ID NO: 1347151 - RNA, 23 nt, Homo sapiens
acuccaccgaccaacugcccuaa

SEQ ID NO: 1347152 - RNA, 20 nt, Homo sapiens
acuccacuggccuccuggca

SEQ ID NO: 1347153 - RNA, 14 nt, Homo sapiens
acuccagaugccac

SEQ ID NO: 1347154 - RNA, 18 nt, Homo sapiens
acuccaguuuucaaauca

SEQ ID NO: 1347155 - RNA, 19 nt, Homo sapiens
acuccaucucaaaacaaaa

SEQ ID NO: 1347156 - RNA, 19 nt, Homo sapiens
acuccccuuaaucuaaucu

SEQ ID NO: 1347157 - RNA, 19 nt, Homo sapiens
acucccggccugucauuca

SEQ ID NO: 1347158 - RNA, 19 nt, Homo sapiens
acuccgugcuuaaccaaag

SEQ ID NO: 1347159 - RNA, 17 nt, Homo sapiens
acucuaggcagugacag

SEQ ID NO: 1347160 - RNA, 13 nt, Homo sapiens
acucuauaaccaa

SEQ ID NO: 1347161 - RNA, 20 nt, Homo sapiens
acucucagaaauaaaucaca

SEQ ID NO: 1347162 - RNA, 13 nt, Homo sapiens
acucuccugccuc

SEQ ID NO: 1347163 - RNA, 16 nt, Homo sapiens
acucucuuaugcauua

SEQ ID NO: 1347164 - RNA, 14 nt, Homo sapiens
acucugcugucuaa

SEQ ID NO: 1347165 - RNA, 13 nt, Homo sapiens
acucugggcucca

SEQ ID NO: 1347166 - RNA, 18 nt, Homo sapiens
acucuggugcuccugcau

SEQ ID NO: 1347167 - RNA, 21 nt, Homo sapiens
acucugucucauugaccuuca

SEQ ID NO: 1347168 - RNA, 17 nt, Homo sapiens
acucugugaucuugcuc

SEQ ID NO: 1347169 - RNA, 16 nt, Homo sapiens
acucuuaucuacauaa

SEQ ID NO: 1347170 - RNA, 13 nt, Homo sapiens
acugaaccaaauu

SEQ ID NO: 1347171 - RNA, 23 nt, Homo sapiens
acugacauuccuccauguccuca

SEQ ID NO: 1347172 - RNA, 19 nt, Homo sapiens
acugaccagccuccaugcu

SEQ ID NO: 1347173 - RNA, 22 nt, Homo sapiens
acugacccucaggcacaccuug

SEQ ID NO: 1347174 - RNA, 15 nt, Homo sapiens
acugacugaacugua

SEQ ID NO: 1347175 - RNA, 18 nt, Homo sapiens
acugagcugggcaggaag

SEQ ID NO: 1347176 - RNA, 17 nt, Homo sapiens
acugaggacacagaucc

SEQ ID NO: 1347177 - RNA, 22 nt, Homo sapiens
acugaguagcucuccugacuuu

SEQ ID NO: 1347178 - RNA, 16 nt, Homo sapiens
acugcaaacacaccuu

SEQ ID NO: 1347179 - RNA, 16 nt, Homo sapiens
acugcaacuucugccu

SEQ ID NO: 1347180 - RNA, 16 nt, Homo sapiens
acugcaggaccuccag

SEQ ID NO: 1347181 - RNA, 20 nt, Homo sapiens
acugcagggacugccagucc

SEQ ID NO: 1347182 - RNA, 22 nt, Homo sapiens
acugcaguagugcaccaucuca

SEQ ID NO: 1347183 - RNA, 23 nt, Homo sapiens
acugcaguagugcaccaucucac

SEQ ID NO: 1347184 - RNA, 16 nt, Homo sapiens
acugcaugacggagcc

SEQ ID NO: 1347185 - RNA, 17 nt, Homo sapiens
acugccaggcuguuuca

SEQ ID NO: 1347186 - RNA, 19 nt, Homo sapiens
acugccccagacacagugc

SEQ ID NO: 1347187 - RNA, 13 nt, Homo sapiens
acugcgacuguga

SEQ ID NO: 1347188 - RNA, 14 nt, Homo sapiens
acugcgacugugac

SEQ ID NO: 1347189 - RNA, 12 nt, Homo sapiens
acugcugagcug

SEQ ID NO: 1347190 - RNA, 22 nt, Homo sapiens
acugcugcccagccuccaagcu

SEQ ID NO: 1347191 - RNA, 17 nt, Homo sapiens
acugcugggcuuggcag

SEQ ID NO: 1347192 - RNA, 16 nt, Homo sapiens
acuggagccaucucuu

SEQ ID NO: 1347193 - RNA, 15 nt, Homo sapiens
acuggaguuccuuau

SEQ ID NO: 1347194 - RNA, 13 nt, Homo sapiens
acuggauguacca

SEQ ID NO: 1347195 - RNA, 22 nt, Homo sapiens
acuggcaaacauuuuuccagua

SEQ ID NO: 1347196 - RNA, 22 nt, Homo sapiens
acuggcacaguuuucugagaaa

SEQ ID NO: 1347197 - RNA, 17 nt, Homo sapiens
acuggcuucucuugagu

SEQ ID NO: 1347198 - RNA, 16 nt, Homo sapiens
acugguagaaaaaccc

SEQ ID NO: 1347199 - RNA, 16 nt, Homo sapiens
acugguccagcucuga

SEQ ID NO: 1347200 - RNA, 18 nt, Homo sapiens
acugguccagcucugaca

SEQ ID NO: 1347201 - RNA, 22 nt, Homo sapiens
acugguccagcucugacauccc

SEQ ID NO: 1347202 - RNA, 21 nt, Homo sapiens
acuggucuuguggaauuggga

SEQ ID NO: 1347203 - RNA, 13 nt, Homo sapiens
acuguaaugcugc

SEQ ID NO: 1347204 - RNA, 21 nt, Homo sapiens
acuguagcaaccugaaauuaa

SEQ ID NO: 1347205 - RNA, 16 nt, Homo sapiens
acuguauacagaauga

SEQ ID NO: 1347206 - RNA, 19 nt, Homo sapiens
acuguauggaaacacugau

SEQ ID NO: 1347207 - RNA, 23 nt, Homo sapiens
acugucaagaagaggaaagggag

SEQ ID NO: 1347208 - RNA, 13 nt, Homo sapiens
acugucaguucuc

SEQ ID NO: 1347209 - RNA, 19 nt, Homo sapiens
acuguccuguccugcucau

SEQ ID NO: 1347210 - RNA, 19 nt, Homo sapiens
acugugaaggaacucugca

SEQ ID NO: 1347211 - RNA, 20 nt, Homo sapiens
acugugaaggaacucugcag

SEQ ID NO: 1347212 - RNA, 12 nt, Homo sapiens
acugugacagac

SEQ ID NO: 1347213 - RNA, 21 nt, Homo sapiens
acugugaccuagagacuucac

SEQ ID NO: 1347214 - RNA, 14 nt, Homo sapiens
acugugacugauau

SEQ ID NO: 1347215 - RNA, 19 nt, Homo sapiens
acugugggcaaaguccucc

SEQ ID NO: 1347216 - RNA, 21 nt, Homo sapiens
acugugggcaaaguccuccuu

SEQ ID NO: 1347217 - RNA, 17 nt, Homo sapiens
acuguuaacuaugacag

SEQ ID NO: 1347218 - RNA, 17 nt, Homo sapiens
acuguuauuaacagaua

SEQ ID NO: 1347219 - RNA, 20 nt, Homo sapiens
acuguuuagaugaaugucag

SEQ ID NO: 1347220 - RNA, 19 nt, Homo sapiens
acuguuuuucucuaaugcu

SEQ ID NO: 1347221 - RNA, 17 nt, Homo sapiens
acuuaaaagaacaugua

SEQ ID NO: 1347222 - RNA, 19 nt, Homo sapiens
acuuaaacuuuuaucacug

SEQ ID NO: 1347223 - RNA, 18 nt, Homo sapiens
acuuaacuauuaaggccu

SEQ ID NO: 1347224 - RNA, 19 nt, Homo sapiens
acuuaauugccagcaaaua

SEQ ID NO: 1347225 - RNA, 19 nt, Homo sapiens
acuuacaggccuugcucac

SEQ ID NO: 1347226 - RNA, 18 nt, Homo sapiens
acuuacgaucucuugaca

SEQ ID NO: 1347227 - RNA, 17 nt, Homo sapiens
acuuagaucaucaguca

SEQ ID NO: 1347228 - RNA, 17 nt, Homo sapiens
acuuagauugugcuccu

SEQ ID NO: 1347229 - RNA, 23 nt, Homo sapiens
acuuagcaguaaauuauagcuca

SEQ ID NO: 1347230 - RNA, 18 nt, Homo sapiens
acuuauaccugcuaucag

SEQ ID NO: 1347231 - RNA, 17 nt, Homo sapiens
acuuauuuucagugcau

SEQ ID NO: 1347232 - RNA, 19 nt, Homo sapiens
acuucaagagccucuggca

SEQ ID NO: 1347233 - RNA, 14 nt, Homo sapiens
acuucaccuacauu

SEQ ID NO: 1347234 - RNA, 20 nt, Homo sapiens
acuucaccuacauuaucuca

SEQ ID NO: 1347235 - RNA, 18 nt, Homo sapiens
acuucagagcaugaaaau

SEQ ID NO: 1347236 - RNA, 21 nt, Homo sapiens
acuucaggucagguggcugug

SEQ ID NO: 1347237 - RNA, 16 nt, Homo sapiens
caaacagucucaggaa

SEQ ID NO: 1347238 - RNA, 21 nt, Homo sapiens
caaacauguaagcauaacuua

SEQ ID NO: 1347239 - RNA, 17 nt, Homo sapiens
caaaccaggauuuccuu

SEQ ID NO: 1347240 - RNA, 21 nt, Homo sapiens
caaaccaggauuuccuugacu

SEQ ID NO: 1347241 - RNA, 23 nt, Homo sapiens
caaaccuucugacuuugccaaaa

SEQ ID NO: 1347242 - RNA, 15 nt, Homo sapiens
caaacucagauccuu

SEQ ID NO: 1347243 - RNA, 17 nt, Homo sapiens
caaacuccugaccucaa

SEQ ID NO: 1347244 - RNA, 16 nt, Homo sapiens
caaagauuaaaugugu

SEQ ID NO: 1347245 - RNA, 18 nt, Homo sapiens
caaagcacauagagccag

SEQ ID NO: 1347246 - RNA, 23 nt, Homo sapiens
caaagccacacucugggcuccag

SEQ ID NO: 1347247 - RNA, 20 nt, Homo sapiens
caaagccccucacacugcaa

SEQ ID NO: 1347248 - RNA, 22 nt, Homo sapiens
caaagcccucccuaccuaccaa

SEQ ID NO: 1347249 - RNA, 17 nt, Homo sapiens
caaagcuugucaaagau

SEQ ID NO: 1347250 - RNA, 13 nt, Homo sapiens
caaaggaacacug

SEQ ID NO: 1347251 - RNA, 14 nt, Homo sapiens
caaaggaugugaua

SEQ ID NO: 1347252 - RNA, 21 nt, Homo sapiens
caaaggaugugauauauaagu

SEQ ID NO: 1347253 - RNA, 18 nt, Homo sapiens
caaagggagggugacaug

SEQ ID NO: 1347254 - RNA, 22 nt, Homo sapiens
caaaguagggaugcggauccug

SEQ ID NO: 1347255 - RNA, 18 nt, Homo sapiens
caaagugacaaagcaauu

SEQ ID NO: 1347256 - RNA, 16 nt, Homo sapiens
caaaguguugauggua

SEQ ID NO: 1347257 - RNA, 14 nt, Homo sapiens
caaauaaacuuaca

SEQ ID NO: 1347258 - RNA, 21 nt, Homo sapiens
caaauacaaucagcccagugc

SEQ ID NO: 1347259 - RNA, 16 nt, Homo sapiens
caaauaccacaugauu

SEQ ID NO: 1347260 - RNA, 12 nt, Homo sapiens
caaauagcuuua

SEQ ID NO: 1347261 - RNA, 15 nt, Homo sapiens
caaauaugcaaagca

SEQ ID NO: 1347262 - RNA, 17 nt, Homo sapiens
caaauauuuauaagcua

SEQ ID NO: 1347263 - RNA, 19 nt, Homo sapiens
caaaucaauaaauucccaa

SEQ ID NO: 1347264 - RNA, 16 nt, Homo sapiens
caaaucagaaaaccca

SEQ ID NO: 1347265 - RNA, 20 nt, Homo sapiens
caaaucguguaucugacaaa

SEQ ID NO: 1347266 - RNA, 18 nt, Homo sapiens
caaaugcuggcaaaucca

SEQ ID NO: 1347267 - RNA, 13 nt, Homo sapiens
caaauggggccag

SEQ ID NO: 1347268 - RNA, 19 nt, Homo sapiens
caaauggggccagauccag

SEQ ID NO: 1347269 - RNA, 13 nt, Homo sapiens
caaauugcacuga

SEQ ID NO: 1347270 - RNA, 16 nt, Homo sapiens
caaauugggaaaucca

SEQ ID NO: 1347271 - RNA, 23 nt, Homo sapiens
caaauugggaaauccauuccauu

SEQ ID NO: 1347272 - RNA, 15 nt, Homo sapiens
caacaaauauguucu

SEQ ID NO: 1347273 - RNA, 20 nt, Homo sapiens
caacacaucucccuuuucca

SEQ ID NO: 1347274 - RNA, 10 nt, Homo sapiens
caacacuuaa

SEQ ID NO: 1347275 - RNA, 16 nt, Homo sapiens
caacagagcacuugag

SEQ ID NO: 1347276 - RNA, 17 nt, Homo sapiens
caacagagcgagauucc

SEQ ID NO: 1347277 - RNA, 17 nt, Homo sapiens
caacauccaaguggccu

SEQ ID NO: 1347278 - RNA, 18 nt, Homo sapiens
caacaugccagccacugu

SEQ ID NO: 1347279 - RNA, 16 nt, Homo sapiens
caacauuguagccuca

SEQ ID NO: 1347280 - RNA, 21 nt, Homo sapiens
caaccccugaccuaccccagc

SEQ ID NO: 1347281 - RNA, 22 nt, Homo sapiens
caacccuuccugcugcugcuac

SEQ ID NO: 1347282 - RNA, 14 nt, Homo sapiens
caaccgccucaaaa

SEQ ID NO: 1347283 - RNA, 22 nt, Homo sapiens
caaccuacuaauccucucugca

SEQ ID NO: 1347284 - RNA, 18 nt, Homo sapiens
caaccucauuuuaacuca

SEQ ID NO: 1347285 - RNA, 17 nt, Homo sapiens
caaccugaaauuaacuc

SEQ ID NO: 1347286 - RNA, 20 nt, Homo sapiens
caaccugcucuccucuugcc

SEQ ID NO: 1347287 - RNA, 22 nt, Homo sapiens
caacgagugaaacuccgucuca

SEQ ID NO: 1347288 - RNA, 16 nt, Homo sapiens
caacgugcaaagccaa

SEQ ID NO: 1347289 - RNA, 14 nt, Homo sapiens
caacuccauacucc

SEQ ID NO: 1347290 - RNA, 21 nt, Homo sapiens
caacucuaaagccaagcacuu

SEQ ID NO: 1347291 - RNA, 17 nt, Homo sapiens
caacucuaacucugaga

SEQ ID NO: 1347292 - RNA, 16 nt, Homo sapiens
caacucuucgaagccu

SEQ ID NO: 1347293 - RNA, 12 nt, Homo sapiens
caacugcaaaaa

SEQ ID NO: 1347294 - RNA, 15 nt, Homo sapiens
caagaaaaacaacuu

SEQ ID NO: 1347295 - RNA, 18 nt, Homo sapiens
caagaaaauggccaguga

SEQ ID NO: 1347296 - RNA, 19 nt, Homo sapiens
caagaagguggaaggcagu

SEQ ID NO: 1347297 - RNA, 15 nt, Homo sapiens
caagaauacuacuua

SEQ ID NO: 1347298 - RNA, 15 nt, Homo sapiens
uacucacaccuguaa

SEQ ID NO: 1347299 - RNA, 19 nt, Homo sapiens
uacucaggaggcugaggca

SEQ ID NO: 1347300 - RNA, 17 nt, Homo sapiens
uacucauauguggaauc

SEQ ID NO: 1347301 - RNA, 15 nt, Homo sapiens
uacucauuagugacu

SEQ ID NO: 1347302 - RNA, 21 nt, Homo sapiens
uacucccccaccacucaggcc

SEQ ID NO: 1347303 - RNA, 20 nt, Homo sapiens
uacucuaggcagugacagug

SEQ ID NO: 1347304 - RNA, 20 nt, Homo sapiens
uacucuuucuaaugcugaua

SEQ ID NO: 1347305 - RNA, 21 nt, Homo sapiens
uacugcaggaccuccagcuga

SEQ ID NO: 1347306 - RNA, 16 nt, Homo sapiens
uacugcccacuuguca

SEQ ID NO: 1347307 - RNA, 11 nt, Homo sapiens
uacugccuuaa

SEQ ID NO: 1347308 - RNA, 16 nt, Homo sapiens
uacugcucuccuccac

SEQ ID NO: 1347309 - RNA, 20 nt, Homo sapiens
uacugggucugcgaugcagc

SEQ ID NO: 1347310 - RNA, 17 nt, Homo sapiens
uacugucucuccaguga

SEQ ID NO: 1347311 - RNA, 17 nt, Homo sapiens
uacugucucuuucauga

SEQ ID NO: 1347312 - RNA, 16 nt, Homo sapiens
uacuucuggagucuau

SEQ ID NO: 1347313 - RNA, 18 nt, Homo sapiens
uacuucuuauacauuuga

SEQ ID NO: 1347314 - RNA, 12 nt, Homo sapiens
uacuucuuuauu

SEQ ID NO: 1347315 - RNA, 23 nt, Homo sapiens
uacuugaaggucuaggugcuuua

SEQ ID NO: 1347316 - RNA, 13 nt, Homo sapiens
uacuugggucaca

SEQ ID NO: 1347317 - RNA, 15 nt, Homo sapiens
uacuuugugcuugua

SEQ ID NO: 1347318 - RNA, 14 nt, Homo sapiens
uacuuuuacagguu

SEQ ID NO: 1347319 - RNA, 23 nt, Homo sapiens
uagaaaaugacuuauuucugcuc

SEQ ID NO: 1347320 - RNA, 15 nt, Homo sapiens
uggccuguggcuaau

SEQ ID NO: 1347321 - RNA, 23 nt, Homo sapiens
uggcuaauggaggugacggcacu

SEQ ID NO: 1347322 - RNA, 19 nt, Homo sapiens
uggcuacuuuuccauuguu

SEQ ID NO: 1347323 - RNA, 18 nt, Homo sapiens
uggcucaaacaacauucc

SEQ ID NO: 1347324 - RNA, 12 nt, Homo sapiens
uggcucacuggc

SEQ ID NO: 1347325 - RNA, 14 nt, Homo sapiens
uggcucuuuuacca

SEQ ID NO: 1347326 - RNA, 18 nt, Homo sapiens
uggcucuuuuaccaguau

SEQ ID NO: 1347327 - RNA, 20 nt, Homo sapiens
uggcucuuuuaccaguauga

SEQ ID NO: 1347328 - RNA, 20 nt, Homo sapiens
uggcugauggaagcaccuaa

SEQ ID NO: 1347329 - RNA, 14 nt, Homo sapiens
uggcugccuuagaa

SEQ ID NO: 1347330 - RNA, 12 nt, Homo sapiens
uggcugccuugu

SEQ ID NO: 1347331 - RNA, 15 nt, Homo sapiens
uggcuggaucuguga

SEQ ID NO: 1347332 - RNA, 18 nt, Homo sapiens
uggcuucaaaaagccaca

SEQ ID NO: 1347333 - RNA, 19 nt, Homo sapiens
uggcuucccuaaacugcag

SEQ ID NO: 1347334 - RNA, 14 nt, Homo sapiens
uggcuuuaugcaaa

SEQ ID NO: 1347335 - RNA, 15 nt, Homo sapiens
uggcuuuaugcaaau

SEQ ID NO: 1347336 - RNA, 19 nt, Homo sapiens
uggcuuuaugcaaauacaa

SEQ ID NO: 1347337 - RNA, 16 nt, Homo sapiens
uggcuuucagagccag

SEQ ID NO: 1347338 - RNA, 19 nt, Homo sapiens
uggcuuugcuuagcuuguu

SEQ ID NO: 1347339 - RNA, 13 nt, Homo sapiens
ugggaaaggggag

SEQ ID NO: 1347340 - RNA, 15 nt, Homo sapiens
ugggaacacaucugg

SEQ ID NO: 1347341 - RNA, 20 nt, Homo sapiens
ugggaacacaucuggcugca

SEQ ID NO: 1347342 - RNA, 20 nt, Homo sapiens
ugggaagaaagauucaauua

SEQ ID NO: 1347343 - RNA, 20 nt, Homo sapiens
ugggaagagaagagggccca

SEQ ID NO: 1347344 - RNA, 18 nt, Homo sapiens
ugggaauguucuuucugc

SEQ ID NO: 1347345 - RNA, 13 nt, Homo sapiens
ugggacccacaga

SEQ ID NO: 1347346 - RNA, 13 nt, Homo sapiens
ugggacugagaug

SEQ ID NO: 1347347 - RNA, 18 nt, Homo sapiens
ugggagacaugugacauu

SEQ ID NO: 1347348 - RNA, 20 nt, Homo sapiens
ugggagaguaaaccuugaag

SEQ ID NO: 1347349 - RNA, 20 nt, Homo sapiens
ugggagauuuggaauacaca

SEQ ID NO: 1347350 - RNA, 22 nt, Homo sapiens
ugggagccaguccuccacucga

SEQ ID NO: 1347351 - RNA, 17 nt, Homo sapiens
ugggauaucacuuccau

SEQ ID NO: 1347352 - RNA, 23 nt, Homo sapiens
ugggauaucacuuccaugacaua

SEQ ID NO: 1347353 - RNA, 13 nt, Homo sapiens
ugggauuacaggc

SEQ ID NO: 1347354 - RNA, 14 nt, Homo sapiens
ugggauuacaggga

SEQ ID NO: 1347355 - RNA, 13 nt, Homo sapiens
ugggcaagcagac

SEQ ID NO: 1347356 - RNA, 15 nt, Homo sapiens
ugggcacacgcugcu

SEQ ID NO: 1347357 - RNA, 22 nt, Homo sapiens
ugggcacaguggcucaugccug

SEQ ID NO: 1347358 - RNA, 14 nt, Homo sapiens
ugggcagguaguuu

SEQ ID NO: 1347359 - RNA, 19 nt, Homo sapiens
ugggccagacaugccacaa

SEQ ID NO: 1347360 - RNA, 16 nt, Homo sapiens
ugggccagugcaccuu

SEQ ID NO: 1347361 - RNA, 21 nt, Homo sapiens
ugggccggcugaguggcagca

SEQ ID NO: 1347362 - RNA, 18 nt, Homo sapiens
ugggcuacagaaaccaca

SEQ ID NO: 1347363 - RNA, 13 nt, Homo sapiens
ugggcuggggccu

SEQ ID NO: 1347364 - RNA, 15 nt, Homo sapiens
uggggaagacagugg

SEQ ID NO: 1347365 - RNA, 17 nt, Homo sapiens
uggggagacuucuuggc

SEQ ID NO: 1347366 - RNA, 21 nt, Homo sapiens
uggggagaggugugugacguu

SEQ ID NO: 1347367 - RNA, 15 nt, Homo sapiens
uggggaggacaggga

SEQ ID NO: 1347368 - RNA, 16 nt, Homo sapiens
uggggcaggucacuuu

SEQ ID NO: 1347369 - RNA, 22 nt, Homo sapiens
uggggcaggucacuuuaccucu

SEQ ID NO: 1347370 - RNA, 11 nt, Homo sapiens
uggggccauaa

SEQ ID NO: 1347371 - RNA, 13 nt, Homo sapiens
uggggccucaggc

SEQ ID NO: 1347372 - RNA, 15 nt, Homo sapiens
uggggcucucucuuc

SEQ ID NO: 1347373 - RNA, 21 nt, Homo sapiens
uggggcuggaugucuccaucu

SEQ ID NO: 1347374 - RNA, 14 nt, Homo sapiens
ugggggaacacuga

SEQ ID NO: 1347375 - RNA, 22 nt, Homo sapiens
ugggggaagacuuuaaaccacc

SEQ ID NO: 1347376 - RNA, 14 nt, Homo sapiens
ugggggacacccgg

SEQ ID NO: 1347377 - RNA, 14 nt, Homo sapiens
ugggggauuucaaa

SEQ ID NO: 1347378 - RNA, 18 nt, Homo sapiens
ugggggugccgcugucuc

SEQ ID NO: 1347379 - RNA, 18 nt, Homo sapiens
ugggggugcucucucuga

SEQ ID NO: 1347380 - RNA, 18 nt, Homo sapiens
ugggggugcugcucucuc

SEQ ID NO: 1347381 - RNA, 15 nt, Homo sapiens
uggggucaugcccuc

SEQ ID NO: 1347382 - RNA, 18 nt, Homo sapiens
ugggguggggauagggag

SEQ ID NO: 1347383 - RNA, 16 nt, Homo sapiens
uuaaauuuuuuuuaca

SEQ ID NO: 1347384 - RNA, 17 nt, Homo sapiens
uuaacaaacccaacuaa

SEQ ID NO: 1347385 - RNA, 13 nt, Homo sapiens
uuaacacauucaa

SEQ ID NO: 1347386 - RNA, 14 nt, Homo sapiens
uuaacagugcugua

SEQ ID NO: 1347387 - RNA, 13 nt, Homo sapiens
uuaaccugcaaaa

SEQ ID NO: 1347388 - RNA, 15 nt, Homo sapiens
uuaacggugcuaaaa

SEQ ID NO: 1347389 - RNA, 17 nt, Homo sapiens
uuaacggugcuaaaaau

SEQ ID NO: 1347390 - RNA, 17 nt, Homo sapiens
uuaacguauauugcugu

SEQ ID NO: 1347391 - RNA, 15 nt, Homo sapiens
uuaacugcauccagc

SEQ ID NO: 1347392 - RNA, 15 nt, Homo sapiens
uuaacugccaagaaa

SEQ ID NO: 1347393 - RNA, 18 nt, Homo sapiens
uuaacuuauugcuagaua

SEQ ID NO: 1347394 - RNA, 18 nt, Homo sapiens
uuaacuuccaauuuacau

SEQ ID NO: 1347395 - RNA, 22 nt, Homo sapiens
uuaagaacuagggagggggaaa

SEQ ID NO: 1347396 - RNA, 15 nt, Homo sapiens
uuaagccagcacuca

SEQ ID NO: 1347397 - RNA, 20 nt, Homo sapiens
uuaagccuuauaaaccaauc

SEQ ID NO: 1347398 - RNA, 14 nt, Homo sapiens
uuaaggucauaaaa

SEQ ID NO: 1347399 - RNA, 20 nt, Homo sapiens
uuaaggucuaaucagugauu

SEQ ID NO: 1347400 - RNA, 17 nt, Homo sapiens
uuaaggugaaccaaaga

SEQ ID NO: 1347401 - RNA, 16 nt, Homo sapiens
uuaagugaauacauua

SEQ ID NO: 1347402 - RNA, 16 nt, Homo sapiens
uuaauaaagacagggu

SEQ ID NO: 1347403 - RNA, 15 nt, Homo sapiens
uuaauaacagguuua

SEQ ID NO: 1347404 - RNA, 22 nt, Homo sapiens
uuaauagcaacagagcacuuga

SEQ ID NO: 1347405 - RNA, 18 nt, Homo sapiens
uuaauauuuacucuauaa

SEQ ID NO: 1347406 - RNA, 15 nt, Homo sapiens
uuaauauuucugagg

SEQ ID NO: 1347407 - RNA, 23 nt, Homo sapiens
uuaaucaaaccacuguuauuaac

SEQ ID NO: 1347408 - RNA, 18 nt, Homo sapiens
uuaauccuguaccaaauc

SEQ ID NO: 1347409 - RNA, 18 nt, Homo sapiens
uuaaucugagaggccaca

SEQ ID NO: 1347410 - RNA, 21 nt, Homo sapiens
uuaaucuuaguguaugauuac

SEQ ID NO: 1347411 - RNA, 18 nt, Homo sapiens
uuaaugugcugagcauuu

SEQ ID NO: 1347412 - RNA, 15 nt, Homo sapiens
uuaauguguauucau

SEQ ID NO: 1347413 - RNA, 20 nt, Homo sapiens
uuacaacaguagagagggaa

SEQ ID NO: 1347414 - RNA, 12 nt, Homo sapiens
uuacaagccuaa

SEQ ID NO: 1347415 - RNA, 17 nt, Homo sapiens
uuacaaguuucuagcuc

SEQ ID NO: 1347416 - RNA, 22 nt, Homo sapiens
uuacaaugaucaccgacugaaa

SEQ ID NO: 1347417 - RNA, 12 nt, Homo sapiens
uuacacauaccc

SEQ ID NO: 1347418 - RNA, 13 nt, Homo sapiens
uuacacauuccau

SEQ ID NO: 1347419 - RNA, 17 nt, Homo sapiens
uuacacugugucauucu

SEQ ID NO: 1347420 - RNA, 20 nt, Homo sapiens
uuacacuuuuuggaagugaa

SEQ ID NO: 1347421 - RNA, 23 nt, Homo sapiens
uuacagcugugcuccacacucag

SEQ ID NO: 1347422 - RNA, 18 nt, Homo sapiens
uuacauguuuuuucauuu

SEQ ID NO: 1347423 - RNA, 21 nt, Homo sapiens
uuacauuuuuugggcagcaau

SEQ ID NO: 1347424 - RNA, 21 nt, Homo sapiens
uuaccaaagagauauugauau

SEQ ID NO: 1347425 - RNA, 10 nt, Homo sapiens
uuaccaaagc

SEQ ID NO: 1347426 - RNA, 18 nt, Homo sapiens
uuaccaagcccaccacau

SEQ ID NO: 1347427 - RNA, 19 nt, Homo sapiens
uuaccaaggaugaaagagg

SEQ ID NO: 1347428 - RNA, 15 nt, Homo sapiens
uuaccccucacaauc

SEQ ID NO: 1347429 - RNA, 13 nt, Homo sapiens
uuaccuaagagaa

SEQ ID NO: 1347430 - RNA, 15 nt, Homo sapiens
uuaccuucuuucuaa

SEQ ID NO: 1347431 - RNA, 22 nt, Homo sapiens
uuaccuuuuauuuuaauguuuc

SEQ ID NO: 1347432 - RNA, 15 nt, Homo sapiens
uuacuaauugucuac

SEQ ID NO: 1347433 - RNA, 16 nt, Homo sapiens
uuacucauauguggaa

SEQ ID NO: 1347434 - RNA, 18 nt, Homo sapiens
uuacucauauguggaauc

SEQ ID NO: 1347435 - RNA, 20 nt, Homo sapiens
uuacucccuacacugaugca

SEQ ID NO: 1347436 - RNA, 23 nt, Homo sapiens
uuacucuauaaccaaaugaaaua

SEQ ID NO: 1347437 - RNA, 13 nt, Homo sapiens
uuacuuaacucau

SEQ ID NO: 1347438 - RNA, 17 nt, Homo sapiens
uuacuuaauugccagca

SEQ ID NO: 1347439 - RNA, 11 nt, Homo sapiens
uuacuugauaa

SEQ ID NO: 1347440 - RNA, 23 nt, Homo sapiens
uuacuuuuuccuggcucaucucu

SEQ ID NO: 1347441 - RNA, 17 nt, Homo sapiens
uuagaaaauagagcuuu

SEQ ID NO: 1347442 - RNA, 20 nt, Homo sapiens
uuagaaaugucaguugcugc

SEQ ID NO: 1347443 - RNA, 16 nt, Homo sapiens
uuagaacuccaguuuu

SEQ ID NO: 1347444 - RNA, 17 nt, Homo sapiens
uuagagaaaaccuuaaa

SEQ ID NO: 1347445 - RNA, 23 nt, Homo sapiens
uuagagaaaaccuuaaaaguaau

SEQ ID NO: 1347446 - RNA, 20 nt, Homo sapiens
uuagagcugccugugccuuu

SEQ ID NO: 1347447 - RNA, 17 nt, Homo sapiens
uuagaguaaugaaaugg

SEQ ID NO: 1347448 - RNA, 16 nt, Homo sapiens
uuagaguguagcugua

SEQ ID NO: 1347449 - RNA, 13 nt, Homo sapiens
uuagcaaggcaga

SEQ ID NO: 1347450 - RNA, 17 nt, Homo sapiens
uuagcaauaacauacau

SEQ ID NO: 1347451 - RNA, 21 nt, Homo sapiens
uuagcaguuuccucagugaug

SEQ ID NO: 1347452 - RNA, 22 nt, Homo sapiens
uuagcauauguuaguaggcuua

SEQ ID NO: 1347453 - RNA, 15 nt, Homo sapiens
uucugacgcugacaa

SEQ ID NO: 1347454 - RNA, 17 nt, Homo sapiens
uucugacuuugccaaaa

SEQ ID NO: 1347455 - RNA, 20 nt, Homo sapiens
uucugauaaaagauggccau

SEQ ID NO: 1347456 - RNA, 17 nt, Homo sapiens
uucugaugaaucucaaa

SEQ ID NO: 1347457 - RNA, 16 nt, Homo sapiens
uucugccccugcugac

SEQ ID NO: 1347458 - RNA, 18 nt, Homo sapiens
uucugcgcuguguacaau

SEQ ID NO: 1347459 - RNA, 13 nt, Homo sapiens
uucugcucuggaa

SEQ ID NO: 1347460 - RNA, 21 nt, Homo sapiens
uucuggagauggaagcuuguu

SEQ ID NO: 1347461 - RNA, 17 nt, Homo sapiens
uucuggccucccacaga

SEQ ID NO: 1347462 - RNA, 22 nt, Homo sapiens
uucugggaagggagaguucuuu

SEQ ID NO: 1347463 - RNA, 22 nt, Homo sapiens
uucugguuuaagaguaacaguu

SEQ ID NO: 1347464 - RNA, 17 nt, Homo sapiens
uucugucaacuuguauu

SEQ ID NO: 1347465 - RNA, 23 nt, Homo sapiens
uucuguuccauauggguaguuau

SEQ ID NO: 1347466 - RNA, 19 nt, Homo sapiens
uucuguuggaugacuuuga

SEQ ID NO: 1347467 - RNA, 20 nt, Homo sapiens
uucuuauuuuguaauaaacu

SEQ ID NO: 1347468 - RNA, 23 nt, Homo sapiens
uucuucaaaaaauguuuaauuaa

SEQ ID NO: 1347469 - RNA, 12 nt, Homo sapiens
uucuucuauggg

SEQ ID NO: 1347470 - RNA, 13 nt, Homo sapiens
uucuucuauucca

SEQ ID NO: 1347471 - RNA, 12 nt, Homo sapiens
uucuucugcaac

SEQ ID NO: 1347472 - RNA, 15 nt, Homo sapiens
uucuugauagccuca

SEQ ID NO: 1347473 - RNA, 15 nt, Homo sapiens
uucuuggcccaggau

SEQ ID NO: 1347474 - RNA, 23 nt, Homo sapiens
uucuuuaagcagcgccagugaca

SEQ ID NO: 1347475 - RNA, 21 nt, Homo sapiens
uucuuucuaauacaagcauau

SEQ ID NO: 1347476 - RNA, 12 nt, Homo sapiens
uucuuucugucu

SEQ ID NO: 1347477 - RNA, 20 nt, Homo sapiens
uucuuucuuaaccacuuuca

SEQ ID NO: 1347478 - RNA, 13 nt, Homo sapiens
uucuuucuuccac

SEQ ID NO: 1347479 - RNA, 17 nt, Homo sapiens
uucuuugggccagacau

SEQ ID NO: 1347480 - RNA, 13 nt, Homo sapiens
uucuuugugccuu

SEQ ID NO: 1347481 - RNA, 13 nt, Homo sapiens
uucuuuuugccaa

SEQ ID NO: 1347482 - RNA, 16 nt, Homo sapiens
uugaaaaaaguacaua

SEQ ID NO: 1347483 - RNA, 15 nt, Homo sapiens
uugaaaaugggcuca

SEQ ID NO: 1347484 - RNA, 14 nt, Homo sapiens
uugaaaauguucag

SEQ ID NO: 1347485 - RNA, 11 nt, Homo sapiens
uugaacagggc

SEQ ID NO: 1347486 - RNA, 14 nt, Homo sapiens
uugaacucagggag

SEQ ID NO: 1347487 - RNA, 22 nt, Homo sapiens
uugaacuuccaggaaaguguga

SEQ ID NO: 1347488 - RNA, 18 nt, Homo sapiens
uugaagaaaauagucagu

SEQ ID NO: 1347489 - RNA, 15 nt, Homo sapiens
uugaagcaacuguga

SEQ ID NO: 1347490 - RNA, 13 nt, Homo sapiens
uugaagggcuuua

SEQ ID NO: 1347491 - RNA, 19 nt, Homo sapiens
uugaaggguggucaguagu

SEQ ID NO: 1347492 - RNA, 20 nt, Homo sapiens
uugaaggugcugacggccag

SEQ ID NO: 1347493 - RNA, 23 nt, Homo sapiens
uugaauauuuuauauuguuauau

SEQ ID NO: 1347494 - RNA, 22 nt, Homo sapiens
uugaauuaauaucccuacaugu

SEQ ID NO: 1347495 - RNA, 19 nt, Homo sapiens
uugacagcuuugcugcuga

SEQ ID NO: 1347496 - RNA, 18 nt, Homo sapiens
uugacaguauuaacacua

SEQ ID NO: 1347497 - RNA, 16 nt, Homo sapiens
uugacccuagccagag

SEQ ID NO: 1347498 - RNA, 21 nt, Homo sapiens
uugaccuuugagagauauaau

SEQ ID NO: 1347499 - RNA, 15 nt, Homo sapiens
uugacugucagcaag

SEQ ID NO: 1347500 - RNA, 19 nt, Homo sapiens
uugacuuccugccauggau

SEQ ID NO: 1347501 - RNA, 14 nt, Homo sapiens
uugagagcuuucug

SEQ ID NO: 1347502 - RNA, 15 nt, Homo sapiens
uugagggguggaccc

SEQ ID NO: 1347503 - RNA, 22 nt, Homo sapiens
uugaggguccucaguccacugc

SEQ ID NO: 1347504 - RNA, 16 nt, Homo sapiens
uugagugucaagcuga

SEQ ID NO: 1347505 - RNA, 23 nt, Homo sapiens
uugauacauucccaagguuacuu

SEQ ID NO: 1347506 - RNA, 21 nt, Homo sapiens
uugauagauuucuacacugag

SEQ ID NO: 1347507 - RNA, 18 nt, Homo sapiens
uugauauaaaacucuggg

SEQ ID NO: 1347508 - RNA, 13 nt, Homo sapiens
uugaucagacuga

SEQ ID NO: 1347509 - RNA, 22 nt, Homo sapiens
uugaucauaaacugacuaucau

SEQ ID NO: 1347510 - RNA, 24 nt, Homo sapiens
uugaucuguuuuggauguugcuau

SEQ ID NO: 1347511 - RNA, 13 nt, Homo sapiens
caagggagaguga

SEQ ID NO: 1347512 - RNA, 18 nt, Homo sapiens
caagggauuuuuacaucc

SEQ ID NO: 1347513 - RNA, 19 nt, Homo sapiens
caaggugaggugaacucca

SEQ ID NO: 1347514 - RNA, 21 nt, Homo sapiens
caaggugggcggaucaccuga

SEQ ID NO: 1347515 - RNA, 14 nt, Homo sapiens
caaguaaguaugaa

SEQ ID NO: 1347516 - RNA, 16 nt, Homo sapiens
caaguauuaagcaguu

SEQ ID NO: 1347517 - RNA, 21 nt, Homo sapiens
caaguauugucgguuaccucu

SEQ ID NO: 1347518 - RNA, 16 nt, Homo sapiens
caaguauuuucuacua

SEQ ID NO: 1347519 - RNA, 13 nt, Homo sapiens
caagucaaauacc

SEQ ID NO: 1347520 - RNA, 16 nt, Homo sapiens
caagucaaauaccaca

SEQ ID NO: 1347521 - RNA, 14 nt, Homo sapiens
caagucacagacug

SEQ ID NO: 1347522 - RNA, 14 nt, Homo sapiens
caagucaguucugu

SEQ ID NO: 1347523 - RNA, 13 nt, Homo sapiens
caagucccuguca

SEQ ID NO: 1347524 - RNA, 16 nt, Homo sapiens
caagucccuuugugac

SEQ ID NO: 1347525 - RNA, 20 nt, Homo sapiens
caaguccuuaggcuacugua

SEQ ID NO: 1347526 - RNA, 19 nt, Homo sapiens
caagugacucuccugccuc

SEQ ID NO: 1347527 - RNA, 18 nt, Homo sapiens
caagugauccucaggcag

SEQ ID NO: 1347528 - RNA, 22 nt, Homo sapiens
caaguggggugcucuggucuga

SEQ ID NO: 1347529 - RNA, 21 nt, Homo sapiens
caaguucaugcagcuguggca

SEQ ID NO: 1347530 - RNA, 15 nt, Homo sapiens
caaguucucaccucu

SEQ ID NO: 1347531 - RNA, 16 nt, Homo sapiens
caauaaaguuugccca

SEQ ID NO: 1347532 - RNA, 18 nt, Homo sapiens
caauaaauguugcaaugc

SEQ ID NO: 1347533 - RNA, 22 nt, Homo sapiens
caauaaauuuuuuuuggucaaa

SEQ ID NO: 1347534 - RNA, 21 nt, Homo sapiens
caauaacuagcuucuuauaau

SEQ ID NO: 1347535 - RNA, 15 nt, Homo sapiens
caauaauauauugua

SEQ ID NO: 1347536 - RNA, 23 nt, Homo sapiens
caauacaaaaauaccuacugcug

SEQ ID NO: 1347537 - RNA, 16 nt, Homo sapiens
caauacuuacauaucu

SEQ ID NO: 1347538 - RNA, 20 nt, Homo sapiens
caauacuuacauaucugacu

SEQ ID NO: 1347539 - RNA, 15 nt, Homo sapiens
caauagcauaucaca

SEQ ID NO: 1347540 - RNA, 22 nt, Homo sapiens
caauaggucuuucucucaguga

SEQ ID NO: 1347541 - RNA, 18 nt, Homo sapiens
caauauagcaagauccca

SEQ ID NO: 1347542 - RNA, 18 nt, Homo sapiens
caauaugcaagcagcuuu

SEQ ID NO: 1347543 - RNA, 15 nt, Homo sapiens
caauauugacuuugu

SEQ ID NO: 1347544 - RNA, 21 nt, Homo sapiens
caauauugauuaagccuccuc

SEQ ID NO: 1347545 - RNA, 22 nt, Homo sapiens
caauauugauuaagccuccucc

SEQ ID NO: 1347546 - RNA, 17 nt, Homo sapiens
caaucagcccagugcaa

SEQ ID NO: 1347547 - RNA, 17 nt, Homo sapiens
caauccaauuaaucaaa

SEQ ID NO: 1347548 - RNA, 19 nt, Homo sapiens
caaucccaacuacguaaua

SEQ ID NO: 1347549 - RNA, 19 nt, Homo sapiens
caaucugugaugacauucc

SEQ ID NO: 1347550 - RNA, 13 nt, Homo sapiens
caaucuuugccuu

SEQ ID NO: 1347551 - RNA, 20 nt, Homo sapiens
caaucuuugccuuuaucucu

SEQ ID NO: 1347552 - RNA, 15 nt, Homo sapiens
caaugaaccacaaaa

SEQ ID NO: 1347553 - RNA, 16 nt, Homo sapiens
caaugacugagcagca

SEQ ID NO: 1347554 - RNA, 14 nt, Homo sapiens
agccacuaagcaga

SEQ ID NO: 1347555 - RNA, 17 nt, Homo sapiens
agccacuggcuuggaac

SEQ ID NO: 1347556 - RNA, 18 nt, Homo sapiens
agccagcaaccagcacau

SEQ ID NO: 1347557 - RNA, 19 nt, Homo sapiens
agccagugucuaggcacug

SEQ ID NO: 1347558 - RNA, 11 nt, Homo sapiens
agccauccagg

SEQ ID NO: 1347559 - RNA, 23 nt, Homo sapiens
agccaucccuuuuuuuacauuuc

SEQ ID NO: 1347560 - RNA, 15 nt, Homo sapiens
agccaucuugaauau

SEQ ID NO: 1347561 - RNA, 14 nt, Homo sapiens
agcccaaguucaug

SEQ ID NO: 1347562 - RNA, 11 nt, Homo sapiens
agcccagagac

SEQ ID NO: 1347563 - RNA, 20 nt, Homo sapiens
agcccagagacauacuugaa

SEQ ID NO: 1347564 - RNA, 14 nt, Homo sapiens
agcccagccuggga

SEQ ID NO: 1347565 - RNA, 15 nt, Homo sapiens
agcccauucccaagg

SEQ ID NO: 1347566 - RNA, 22 nt, Homo sapiens
agcccccagcuaagaaccugga

SEQ ID NO: 1347567 - RNA, 12 nt, Homo sapiens
agccccgucucu

SEQ ID NO: 1347568 - RNA, 14 nt, Homo sapiens
agccccuacugugg

SEQ ID NO: 1347569 - RNA, 18 nt, Homo sapiens
agccccucacacugcaag

SEQ ID NO: 1347570 - RNA, 14 nt, Homo sapiens
agcccggggccagc

SEQ ID NO: 1347571 - RNA, 16 nt, Homo sapiens
agcccuauuucuugau

SEQ ID NO: 1347572 - RNA, 15 nt, Homo sapiens
agcccucccuaccua

SEQ ID NO: 1347573 - RNA, 15 nt, Homo sapiens
agcccuccucuccca

SEQ ID NO: 1347574 - RNA, 23 nt, Homo sapiens
agcccuccucucccagugacaac

SEQ ID NO: 1347575 - RNA, 19 nt, Homo sapiens
agcccugcaccaugcugcu

SEQ ID NO: 1347576 - RNA, 13 nt, Homo sapiens
agcccugcagcua

SEQ ID NO: 1347577 - RNA, 21 nt, Homo sapiens
agcccugcgccaccucacugc

SEQ ID NO: 1347578 - RNA, 22 nt, Homo sapiens
agcccugcgccaccucacugca

SEQ ID NO: 1347579 - RNA, 23 nt, Homo sapiens
agcccugggggauuccugagcug

SEQ ID NO: 1347580 - RNA, 23 nt, Homo sapiens
agccgagauugcgccauugcacu

SEQ ID NO: 1347581 - RNA, 16 nt, Homo sapiens
agccuaccaaugccaa

SEQ ID NO: 1347582 - RNA, 18 nt, Homo sapiens
agccuacugguagaaaaa

SEQ ID NO: 1347583 - RNA, 14 nt, Homo sapiens
agccuagauaugaa

SEQ ID NO: 1347584 - RNA, 16 nt, Homo sapiens
agccuagcggagccca

SEQ ID NO: 1347585 - RNA, 14 nt, Homo sapiens
agccucaaccaaca

SEQ ID NO: 1347586 - RNA, 13 nt, Homo sapiens
agccucaaccucc

SEQ ID NO: 1347587 - RNA, 18 nt, Homo sapiens
agccucaagucacuccca

SEQ ID NO: 1347588 - RNA, 12 nt, Homo sapiens
agccucaucucu

SEQ ID NO: 1347589 - RNA, 21 nt, Homo sapiens
agccuggcacagggcaguggg

SEQ ID NO: 1347590 - RNA, 21 nt, Homo sapiens
augcccuccacuccacugccu

SEQ ID NO: 1347591 - RNA, 15 nt, Homo sapiens
augccuguaaucuca

SEQ ID NO: 1347592 - RNA, 16 nt, Homo sapiens
augccuuaaaauggaa

SEQ ID NO: 1347593 - RNA, 14 nt, Homo sapiens
augccuugaugauu

SEQ ID NO: 1347594 - RNA, 15 nt, Homo sapiens
augcggauccugcug

SEQ ID NO: 1347595 - RNA, 13 nt, Homo sapiens
augcuaaaaccug

SEQ ID NO: 1347596 - RNA, 17 nt, Homo sapiens
augcugauaaacugauu

SEQ ID NO: 1347597 - RNA, 14 nt, Homo sapiens
augcugauaugauc

SEQ ID NO: 1347598 - RNA, 15 nt, Homo sapiens
augcugccuggcaca

SEQ ID NO: 1347599 - RNA, 22 nt, Homo sapiens
augcugcuccccuaaagccagg

SEQ ID NO: 1347600 - RNA, 22 nt, Homo sapiens
augcugcuggggaagacagugg

SEQ ID NO: 1347601 - RNA, 19 nt, Homo sapiens
augcugugauugugccuac

SEQ ID NO: 1347602 - RNA, 23 nt, Homo sapiens
augcuugauuuagguagccuugu

SEQ ID NO: 1347603 - RNA, 21 nt, Homo sapiens
augcuugguacuguaauguua

SEQ ID NO: 1347604 - RNA, 22 nt, Homo sapiens
augcuuuaaugucuaaccaaga

SEQ ID NO: 1347605 - RNA, 18 nt, Homo sapiens
augcuuuuaaacugauua

SEQ ID NO: 1347606 - RNA, 19 nt, Homo sapiens
auggaaaauaaacaucagu

SEQ ID NO: 1347607 - RNA, 17 nt, Homo sapiens
auggaacaagagaagua

SEQ ID NO: 1347608 - RNA, 14 nt, Homo sapiens
auggaacaauaaaa

SEQ ID NO: 1347609 - RNA, 17 nt, Homo sapiens
auggaacacagaacuga

SEQ ID NO: 1347610 - RNA, 20 nt, Homo sapiens
auggaauuucucccagucau

SEQ ID NO: 1347611 - RNA, 16 nt, Homo sapiens
auggacaucuugucau

SEQ ID NO: 1347612 - RNA, 19 nt, Homo sapiens
auggaguggcugccaugga

SEQ ID NO: 1347613 - RNA, 22 nt, Homo sapiens
auggauaaaauaaugcugcaaa

SEQ ID NO: 1347614 - RNA, 18 nt, Homo sapiens
auggaugcuuuggcaaug

SEQ ID NO: 1347615 - RNA, 18 nt, Homo sapiens
auggaugggggaacucag

SEQ ID NO: 1347616 - RNA, 15 nt, Homo sapiens
auggcagaaccaaag

SEQ ID NO: 1347617 - RNA, 17 nt, Homo sapiens
auggcagcugguugcuc

SEQ ID NO: 1347618 - RNA, 18 nt, Homo sapiens
auggcauauauguucaaa

SEQ ID NO: 1347619 - RNA, 13 nt, Homo sapiens
auggggccagauc

SEQ ID NO: 1347620 - RNA, 17 nt, Homo sapiens
augggggaacucagauc

SEQ ID NO: 1347621 - RNA, 13 nt, Homo sapiens
auggguccagggc

SEQ ID NO: 1347622 - RNA, 18 nt, Homo sapiens
augguacuauguuagccc

SEQ ID NO: 1347623 - RNA, 15 nt, Homo sapiens
auggugcacugagcu

SEQ ID NO: 1347624 - RNA, 16 nt, Homo sapiens
auggugccccaggacc

SEQ ID NO: 1347625 - RNA, 22 nt, Homo sapiens
auggugccccaggaccagcuca

SEQ ID NO: 1347626 - RNA, 13 nt, Homo sapiens
augguuacauauc

SEQ ID NO: 1347627 - RNA, 14 nt, Homo sapiens
auguaaaagcacau

SEQ ID NO: 1347628 - RNA, 13 nt, Homo sapiens
auguaaacauaag

SEQ ID NO: 1347629 - RNA, 18 nt, Homo sapiens
auguaacuuccuguggau

SEQ ID NO: 1347630 - RNA, 17 nt, Homo sapiens
auguacagggguaguuu

SEQ ID NO: 1347631 - RNA, 15 nt, Homo sapiens
auguacugccuuagu

SEQ ID NO: 1347632 - RNA, 14 nt, Homo sapiens
auguacuucucacc

SEQ ID NO: 1347633 - RNA, 23 nt, Homo sapiens
auguagaauaggcagggggcccu

SEQ ID NO: 1347634 - RNA, 21 nt, Homo sapiens
auguagccagcugugcacuuu

SEQ ID NO: 1347635 - RNA, 19 nt, Homo sapiens
auguauuccuaugacaaaa

SEQ ID NO: 1347636 - RNA, 14 nt, Homo sapiens
augucaagagucgc

SEQ ID NO: 1347637 - RNA, 15 nt, Homo sapiens
augucccaacuugua

SEQ ID NO: 1347638 - RNA, 20 nt, Homo sapiens
augucgauguucgaugcuga

SEQ ID NO: 1347639 - RNA, 13 nt, Homo sapiens
augucucucauga

SEQ ID NO: 1347640 - RNA, 16 nt, Homo sapiens
augucugguguuuguc

SEQ ID NO: 1347641 - RNA, 17 nt, Homo sapiens
augucugguguuuguca

SEQ ID NO: 1347642 - RNA, 18 nt, Homo sapiens
augugaagucucugggug

SEQ ID NO: 1347643 - RNA, 17 nt, Homo sapiens
augugacaccccggggg

SEQ ID NO: 1347644 - RNA, 23 nt, Homo sapiens
cagggaauggagcucagguccca

SEQ ID NO: 1347645 - RNA, 21 nt, Homo sapiens
cagggaggggucccugcaaaa

SEQ ID NO: 1347646 - RNA, 22 nt, Homo sapiens
cagggccacguuaccacagacc

SEQ ID NO: 1347647 - RNA, 13 nt, Homo sapiens
cagggccagucuu

SEQ ID NO: 1347648 - RNA, 22 nt, Homo sapiens
cagggcucuaaugugucucuca

SEQ ID NO: 1347649 - RNA, 20 nt, Homo sapiens
cagggcuggcacgugacagg

SEQ ID NO: 1347650 - RNA, 20 nt, Homo sapiens
caggggcuagcuaagccaag

SEQ ID NO: 1347651 - RNA, 15 nt, Homo sapiens
caggggcucuguggc

SEQ ID NO: 1347652 - RNA, 20 nt, Homo sapiens
cagggggugugucugcucag

SEQ ID NO: 1347653 - RNA, 21 nt, Homo sapiens
cagggucucacucuguugccc

SEQ ID NO: 1347654 - RNA, 14 nt, Homo sapiens
cagggucugggaca

SEQ ID NO: 1347655 - RNA, 20 nt, Homo sapiens
caggguuucaccauguuggc

SEQ ID NO: 1347656 - RNA, 14 nt, Homo sapiens
cagguacccaugaa

SEQ ID NO: 1347657 - RNA, 20 nt, Homo sapiens
cagguccaccgagccccuga

SEQ ID NO: 1347658 - RNA, 15 nt, Homo sapiens
caggugacagugaag

SEQ ID NO: 1347659 - RNA, 14 nt, Homo sapiens
caggugcauagcaa

SEQ ID NO: 1347660 - RNA, 18 nt, Homo sapiens
caggugcucaugcugcuc

SEQ ID NO: 1347661 - RNA, 20 nt, Homo sapiens
caggugcuguuuuuguucua

SEQ ID NO: 1347662 - RNA, 21 nt, Homo sapiens
caggugcuuuuauuuucacag

SEQ ID NO: 1347663 - RNA, 20 nt, Homo sapiens
cagguuaacuuagcuacuuu

SEQ ID NO: 1347664 - RNA, 15 nt, Homo sapiens
cagguucccccagca

SEQ ID NO: 1347665 - RNA, 19 nt, Homo sapiens
cagguuuaugaaugacagu

SEQ ID NO: 1347666 - RNA, 15 nt, Homo sapiens
cagguuuuucaauua

SEQ ID NO: 1347667 - RNA, 12 nt, Homo sapiens
caguaaaccuua

SEQ ID NO: 1347668 - RNA, 20 nt, Homo sapiens
caguaaauauuuacuauuua

SEQ ID NO: 1347669 - RNA, 19 nt, Homo sapiens
caguaacugugacugauga

SEQ ID NO: 1347670 - RNA, 14 nt, Homo sapiens
caguagaugccacc

SEQ ID NO: 1347671 - RNA, 14 nt, Homo sapiens
caguagugcaccau

SEQ ID NO: 1347672 - RNA, 19 nt, Homo sapiens
caguagugcaccaucucac

SEQ ID NO: 1347673 - RNA, 23 nt, Homo sapiens
caguauuuagaagccaacuauga

SEQ ID NO: 1347674 - RNA, 18 nt, Homo sapiens
cagucacgcaccaagcag

SEQ ID NO: 1347675 - RNA, 21 nt, Homo sapiens
cagucagacgccaggcaccac

SEQ ID NO: 1347676 - RNA, 23 nt, Homo sapiens
cagucauagcaagcuuuugcuca

SEQ ID NO: 1347677 - RNA, 11 nt, Homo sapiens
caguccacugc

SEQ ID NO: 1347678 - RNA, 14 nt, Homo sapiens
caguccacugcuga

SEQ ID NO: 1347679 - RNA, 22 nt, Homo sapiens
caguccaggaugcuaacaucua

SEQ ID NO: 1347680 - RNA, 18 nt, Homo sapiens
cagucuaauuacauuuca

SEQ ID NO: 1347681 - RNA, 18 nt, Homo sapiens
cagucuccuccccuacuc

SEQ ID NO: 1347682 - RNA, 15 nt, Homo sapiens
cagugacuccagggu

SEQ ID NO: 1347683 - RNA, 16 nt, Homo sapiens
cagugagaucaaugug

SEQ ID NO: 1347684 - RNA, 22 nt, Homo sapiens
cagugauguuugccauuugcug

SEQ ID NO: 1347685 - RNA, 21 nt, Homo sapiens
cagugauucuguuugccuuuu

SEQ ID NO: 1347686 - RNA, 19 nt, Homo sapiens
cagugcaguccauuuccua

SEQ ID NO: 1347687 - RNA, 13 nt, Homo sapiens
cagugcaguuucu

SEQ ID NO: 1347688 - RNA, 19 nt, Homo sapiens
cagugccuuaaacucuguu

SEQ ID NO: 1347689 - RNA, 15 nt, Homo sapiens
cagugcuaaagccug

SEQ ID NO: 1347690 - RNA, 14 nt, Homo sapiens
caguggaucuucag

SEQ ID NO: 1347691 - RNA, 18 nt, Homo sapiens
caguggcuggaucuguga

SEQ ID NO: 1347692 - RNA, 16 nt, Homo sapiens
caguggucccaauagg

SEQ ID NO: 1347693 - RNA, 18 nt, Homo sapiens
cagugugagauacugugu

SEQ ID NO: 1347694 - RNA, 14 nt, Homo sapiens
cagugugagcauuu

SEQ ID NO: 1347695 - RNA, 19 nt, Homo sapiens
caguuaacuauugcauuua

SEQ ID NO: 1347696 - RNA, 12 nt, Homo sapiens
caguuaagugaa

SEQ ID NO: 1347697 - RNA, 20 nt, Homo sapiens
caguuaauaaaccuuugcaa

SEQ ID NO: 1347698 - RNA, 19 nt, Homo sapiens
caguuacucccuacacuga

SEQ ID NO: 1347699 - RNA, 20 nt, Homo sapiens
caguuacucccuacacugau

SEQ ID NO: 1347700 - RNA, 11 nt, Homo sapiens
caguucagcuu

SEQ ID NO: 1347701 - RNA, 15 nt, Homo sapiens
caguucugggcaaag

SEQ ID NO: 1347702 - RNA, 15 nt, Homo sapiens
caguuuacaguauuu

SEQ ID NO: 1347703 - RNA, 10 nt, Homo sapiens
caguuugaua

SEQ ID NO: 1347704 - RNA, 20 nt, Homo sapiens
caguuugcuuuguaugcacu

SEQ ID NO: 1347705 - RNA, 23 nt, Homo sapiens
caguuuuauauuuauaagccuua

SEQ ID NO: 1347706 - RNA, 15 nt, Homo sapiens
cauaaaaagaagccu

SEQ ID NO: 1347707 - RNA, 20 nt, Homo sapiens
cauaaacgguuccuggugac

SEQ ID NO: 1347708 - RNA, 16 nt, Homo sapiens
cauaaagacaaucacu

SEQ ID NO: 1347709 - RNA, 14 nt, Homo sapiens
cauaacucugugau

SEQ ID NO: 1347710 - RNA, 16 nt, Homo sapiens
cauaagugaaaaucuu

SEQ ID NO: 1347711 - RNA, 13 nt, Homo sapiens
cccuagcugaccc

SEQ ID NO: 1347712 - RNA, 16 nt, Homo sapiens
cccucaaauacaguau

SEQ ID NO: 1347713 - RNA, 23 nt, Homo sapiens
cccucacacuuugccauuugcuu

SEQ ID NO: 1347714 - RNA, 21 nt, Homo sapiens
cccucaccuuggcaccagaca

SEQ ID NO: 1347715 - RNA, 17 nt, Homo sapiens
cccucagagugcaagcc

SEQ ID NO: 1347716 - RNA, 18 nt, Homo sapiens
cccucagagugcaagccc

SEQ ID NO: 1347717 - RNA, 17 nt, Homo sapiens
cccucauucuacugaaa

SEQ ID NO: 1347718 - RNA, 20 nt, Homo sapiens
cccucccuguuccccagaga

SEQ ID NO: 1347719 - RNA, 13 nt, Homo sapiens
cccucuauuuauu

SEQ ID NO: 1347720 - RNA, 16 nt, Homo sapiens
cccucucucaguguca

SEQ ID NO: 1347721 - RNA, 15 nt, Homo sapiens
cccucugaguuugaa

SEQ ID NO: 1347722 - RNA, 17 nt, Homo sapiens
cccucuuucacuucaua

SEQ ID NO: 1347723 - RNA, 19 nt, Homo sapiens
cccucuuuguuucugcuuc

SEQ ID NO: 1347724 - RNA, 18 nt, Homo sapiens
cccugacagggccagugc

SEQ ID NO: 1347725 - RNA, 21 nt, Homo sapiens
cccugacagggccagugcagu

SEQ ID NO: 1347726 - RNA, 17 nt, Homo sapiens
cccugacuggccaaacc

SEQ ID NO: 1347727 - RNA, 15 nt, Homo sapiens
cccugcaaagggaau

SEQ ID NO: 1347728 - RNA, 15 nt, Homo sapiens
cccugcccugaccuc

SEQ ID NO: 1347729 - RNA, 16 nt, Homo sapiens
cccugcgccuccagag

SEQ ID NO: 1347730 - RNA, 11 nt, Homo sapiens
cccugcuccac

SEQ ID NO: 1347731 - RNA, 23 nt, Homo sapiens
cccugcugacacagacauccucu

SEQ ID NO: 1347732 - RNA, 17 nt, Homo sapiens
cccugcuuugcaucuuu

SEQ ID NO: 1347733 - RNA, 14 nt, Homo sapiens
cccugggaaccacu

SEQ ID NO: 1347734 - RNA, 21 nt, Homo sapiens
cccugggcuacagaaaccaca

SEQ ID NO: 1347735 - RNA, 14 nt, Homo sapiens
cccuggugguggau

SEQ ID NO: 1347736 - RNA, 16 nt, Homo sapiens
cccugugagcacaaag

SEQ ID NO: 1347737 - RNA, 20 nt, Homo sapiens
cccuguggccaacugcaaaa

SEQ ID NO: 1347738 - RNA, 22 nt, Homo sapiens
cccuguggccaacugcaaaaaa

SEQ ID NO: 1347739 - RNA, 20 nt, Homo sapiens
cccuguguauucaccaccaa

SEQ ID NO: 1347740 - RNA, 18 nt, Homo sapiens
cccuucccuguccuugcc

SEQ ID NO: 1347741 - RNA, 22 nt, Homo sapiens
cccuuccuggaaacagcaugaa

SEQ ID NO: 1347742 - RNA, 14 nt, Homo sapiens
cccuuccuguuuca

SEQ ID NO: 1347743 - RNA, 15 nt, Homo sapiens
cccuuccuguuucag

SEQ ID NO: 1347744 - RNA, 14 nt, Homo sapiens
cccuucguguuucc

SEQ ID NO: 1347745 - RNA, 15 nt, Homo sapiens
cccuuggacauuuua

SEQ ID NO: 1347746 - RNA, 16 nt, Homo sapiens
ccgaagaugguggcca

SEQ ID NO: 1347747 - RNA, 17 nt, Homo sapiens
ccgagccaggaacugug

SEQ ID NO: 1347748 - RNA, 13 nt, Homo sapiens
ccgagugcacugc

SEQ ID NO: 1347749 - RNA, 15 nt, Homo sapiens
ccgauggccauguaa

SEQ ID NO: 1347750 - RNA, 23 nt, Homo sapiens
ccgcgugaucaaagccacacucu

SEQ ID NO: 1347751 - RNA, 14 nt, Homo sapiens
ccgcuuucucugag

SEQ ID NO: 1347752 - RNA, 15 nt, Homo sapiens
ccgcuuucucugagg

SEQ ID NO: 1347753 - RNA, 18 nt, Homo sapiens
ccgcuuugaaagaagcaa

SEQ ID NO: 1347754 - RNA, 16 nt, Homo sapiens
ccggaaggaaugucag

SEQ ID NO: 1347755 - RNA, 21 nt, Homo sapiens
ccggaaggaggccaaccagcc

SEQ ID NO: 1347756 - RNA, 12 nt, Homo sapiens
ccggacaugucu

SEQ ID NO: 1347757 - RNA, 19 nt, Homo sapiens
ccggccuccugucccucau

SEQ ID NO: 1347758 - RNA, 18 nt, Homo sapiens
ccggcgcugauuccucgu

SEQ ID NO: 1347759 - RNA, 20 nt, Homo sapiens
ccgggcugggagcucugcag

SEQ ID NO: 1347760 - RNA, 13 nt, Homo sapiens
ccggggguccagg

SEQ ID NO: 1347761 - RNA, 13 nt, Homo sapiens
ccggugaagugca

SEQ ID NO: 1347762 - RNA, 13 nt, Homo sapiens
ccgguuugccaug

SEQ ID NO: 1347763 - RNA, 13 nt, Homo sapiens
ccgucacagccuc

SEQ ID NO: 1347764 - RNA, 21 nt, Homo sapiens
ccgucggacugcccccagaaa

SEQ ID NO: 1347765 - RNA, 15 nt, Homo sapiens
ccgugaacucuggug

SEQ ID NO: 1347766 - RNA, 23 nt, Homo sapiens
ccguuucauuuagucaugugacc

SEQ ID NO: 1347767 - RNA, 23 nt, Homo sapiens
ccuaaaacccaaagguggcagcu

SEQ ID NO: 1347768 - RNA, 17 nt, Homo sapiens
ccuguguacugccuuaa

SEQ ID NO: 1347769 - RNA, 12 nt, Homo sapiens
ccugugugaccc

SEQ ID NO: 1347770 - RNA, 22 nt, Homo sapiens
ccugugugggacugaguggcaa

SEQ ID NO: 1347771 - RNA, 14 nt, Homo sapiens
ccuguucaccuggg

SEQ ID NO: 1347772 - RNA, 16 nt, Homo sapiens
ccuguucagcuacucc

SEQ ID NO: 1347773 - RNA, 18 nt, Homo sapiens
ccuguucauuugaagaaa

SEQ ID NO: 1347774 - RNA, 12 nt, Homo sapiens
ccuguuccagaa

SEQ ID NO: 1347775 - RNA, 15 nt, Homo sapiens
ccuuaaaacaauucu

SEQ ID NO: 1347776 - RNA, 17 nt, Homo sapiens
ccuuaaaaugcauugaa

SEQ ID NO: 1347777 - RNA, 13 nt, Homo sapiens
ccuuaacuguaua

SEQ ID NO: 1347778 - RNA, 13 nt, Homo sapiens
ccuuacauuucac

SEQ ID NO: 1347779 - RNA, 14 nt, Homo sapiens
ccuuaccgcucugu

SEQ ID NO: 1347780 - RNA, 13 nt, Homo sapiens
ccuuaccuugaaa

SEQ ID NO: 1347781 - RNA, 19 nt, Homo sapiens
ccuuagaaaacaaguauug

SEQ ID NO: 1347782 - RNA, 23 nt, Homo sapiens
ccuuagcuauucccagggaaccc

SEQ ID NO: 1347783 - RNA, 15 nt, Homo sapiens
ccuuagcuggcauua

SEQ ID NO: 1347784 - RNA, 17 nt, Homo sapiens
ccuuccaagcuguguua

SEQ ID NO: 1347785 - RNA, 17 nt, Homo sapiens
ccuuccccagacuucuc

SEQ ID NO: 1347786 - RNA, 23 nt, Homo sapiens
ccuuccggugcgugugaagccac

SEQ ID NO: 1347787 - RNA, 18 nt, Homo sapiens
ccuuccuaugcuguucac

SEQ ID NO: 1347788 - RNA, 16 nt, Homo sapiens
ccuuccucucaggcuc

SEQ ID NO: 1347789 - RNA, 14 nt, Homo sapiens
ccuuccucuucaga

SEQ ID NO: 1347790 - RNA, 15 nt, Homo sapiens
ccuuccugcugcugc

SEQ ID NO: 1347791 - RNA, 21 nt, Homo sapiens
ccuucgggcugugcccgggga

SEQ ID NO: 1347792 - RNA, 13 nt, Homo sapiens
ccuucucaccuca

SEQ ID NO: 1347793 - RNA, 21 nt, Homo sapiens
ccuucuggacacugagagggc

SEQ ID NO: 1347794 - RNA, 21 nt, Homo sapiens
ccuucuugaguugaagaucuu

SEQ ID NO: 1347795 - RNA, 22 nt, Homo sapiens
ccuugcaagcuaauucuuugac

SEQ ID NO: 1347796 - RNA, 16 nt, Homo sapiens
ccuugccaguuuuccg

SEQ ID NO: 1347797 - RNA, 22 nt, Homo sapiens
ccuugccuaaauuuaaugcugc

SEQ ID NO: 1347798 - RNA, 20 nt, Homo sapiens
ccuugcucuccucaucucca

SEQ ID NO: 1347799 - RNA, 22 nt, Homo sapiens
ccuugcugauggugacauugca

SEQ ID NO: 1347800 - RNA, 19 nt, Homo sapiens
ccuuggagggacaugacua

SEQ ID NO: 1347801 - RNA, 17 nt, Homo sapiens
ccuuggcaccagacacc

SEQ ID NO: 1347802 - RNA, 14 nt, Homo sapiens
ccuuggcuuuaugc

SEQ ID NO: 1347803 - RNA, 22 nt, Homo sapiens
ccuuggcuuuuacugaagccuu

SEQ ID NO: 1347804 - RNA, 16 nt, Homo sapiens
ccuugggggaagacuu

SEQ ID NO: 1347805 - RNA, 23 nt, Homo sapiens
ccuuggugugcuguauccaucca

SEQ ID NO: 1347806 - RNA, 18 nt, Homo sapiens
ccuuuacuccuggcucaa

SEQ ID NO: 1347807 - RNA, 17 nt, Homo sapiens
ccuuuaucauccuuaaa

SEQ ID NO: 1347808 - RNA, 14 nt, Homo sapiens
ccuuucaaagcacu

SEQ ID NO: 1347809 - RNA, 16 nt, Homo sapiens
ccuuucaaagcacuua

SEQ ID NO: 1347810 - RNA, 17 nt, Homo sapiens
ccuuuccccucccucag

SEQ ID NO: 1347811 - RNA, 13 nt, Homo sapiens
ccuuucgagcucu

SEQ ID NO: 1347812 - RNA, 11 nt, Homo sapiens
ccuuucuaguu

SEQ ID NO: 1347813 - RNA, 22 nt, Homo sapiens
ccuuugaaguagacucauucuu

SEQ ID NO: 1347814 - RNA, 22 nt, Homo sapiens
ccuuugaguuuuguauucaaua

SEQ ID NO: 1347815 - RNA, 23 nt, Homo sapiens
ccuuugcuaaaauauaauuuuca

SEQ ID NO: 1347816 - RNA, 22 nt, Homo sapiens
ccuuuggagggagggcugaccc

SEQ ID NO: 1347817 - RNA, 14 nt, Homo sapiens
ccuuuuaacugcca

SEQ ID NO: 1347818 - RNA, 14 nt, Homo sapiens
ccuuuuauguauuu

SEQ ID NO: 1347819 - RNA, 14 nt, Homo sapiens
cgaaauaucuaugu

SEQ ID NO: 1347820 - RNA, 15 nt, Homo sapiens
cgaacauguagcaug

SEQ ID NO: 1347821 - RNA, 24 nt, Homo sapiens
cgaagcucauucccaacgugcaaa

SEQ ID NO: 1347822 - RNA, 19 nt, Homo sapiens
cgaagucgccacguggccu

SEQ ID NO: 1347823 - RNA, 17 nt, Homo sapiens
cgaauuaauuaccuggc

SEQ ID NO: 1347824 - RNA, 15 nt, Homo sapiens
cgaccaacugcccua

SEQ ID NO: 1347825 - RNA, 22 nt, Homo sapiens
cgaccuaauugucuuuguucug

SEQ ID NO: 1347826 - RNA, 22 nt, Homo sapiens
cgaccuccccacccgcucccac

SEQ ID NO: 1347827 - RNA, 14 nt, Homo sapiens
cgacucugaccucu

SEQ ID NO: 1347828 - RNA, 14 nt, Homo sapiens
cgacugaaacugga

SEQ ID NO: 1347829 - RNA, 19 nt, Homo sapiens
cgagaccagccuggccaac

SEQ ID NO: 1347830 - RNA, 16 nt, Homo sapiens
cgagcagucagcauuc

SEQ ID NO: 1347831 - RNA, 14 nt, Homo sapiens
cgagccaggaacug

SEQ ID NO: 1347832 - RNA, 14 nt, Homo sapiens
cgagcccuggagag

SEQ ID NO: 1347833 - RNA, 14 nt, Homo sapiens
cgaggaaaagaaca

SEQ ID NO: 1347834 - RNA, 19 nt, Homo sapiens
cgaggacauuugugggcaa

SEQ ID NO: 1347835 - RNA, 19 nt, Homo sapiens
cgaguaacuccccucaggg

SEQ ID NO: 1347836 - RNA, 14 nt, Homo sapiens
cgagucucuucucc

SEQ ID NO: 1347837 - RNA, 23 nt, Homo sapiens
cgaguggucacugucagugggaa

SEQ ID NO: 1347838 - RNA, 13 nt, Homo sapiens
cgaucacucuggu

SEQ ID NO: 1347839 - RNA, 19 nt, Homo sapiens
cgauugcaggagucccugc

SEQ ID NO: 1347840 - RNA, 11 nt, Homo sapiens
cgcacagugug

SEQ ID NO: 1347841 - RNA, 17 nt, Homo sapiens
cgcagccuagauaugaa

SEQ ID NO: 1347842 - RNA, 18 nt, Homo sapiens
cgccauuuuugugcuuuu

SEQ ID NO: 1347843 - RNA, 10 nt, Homo sapiens
cgccccagag

SEQ ID NO: 1347844 - RNA, 14 nt, Homo sapiens
cgcccccaccucca

SEQ ID NO: 1347845 - RNA, 20 nt, Homo sapiens
cgcccugugcccgacugacu

SEQ ID NO: 1347846 - RNA, 14 nt, Homo sapiens
cgccgccgcugccc

SEQ ID NO: 1347847 - RNA, 23 nt, Homo sapiens
cgccuggaggagacgcuggacuu

SEQ ID NO: 1347848 - RNA, 22 nt, Homo sapiens
cgccuguggacagccugaguca

SEQ ID NO: 1347849 - RNA, 18 nt, Homo sapiens
caugcacccucauacaca

SEQ ID NO: 1347850 - RNA, 21 nt, Homo sapiens
caugcagcuguggcagaguua

SEQ ID NO: 1347851 - RNA, 19 nt, Homo sapiens
caugcaucuuccacuggaa

SEQ ID NO: 1347852 - RNA, 12 nt, Homo sapiens
caugcauucaca

SEQ ID NO: 1347853 - RNA, 17 nt, Homo sapiens
caugcauuggucuuaga

SEQ ID NO: 1347854 - RNA, 16 nt, Homo sapiens
caugccacaaggacuu

SEQ ID NO: 1347855 - RNA, 23 nt, Homo sapiens
caugcccuggauccaucaggcca

SEQ ID NO: 1347856 - RNA, 13 nt, Homo sapiens
caugcccuguuca

SEQ ID NO: 1347857 - RNA, 15 nt, Homo sapiens
caugcugcuggggaa

SEQ ID NO: 1347858 - RNA, 18 nt, Homo sapiens
caugcuggcuuuugugcc

SEQ ID NO: 1347859 - RNA, 14 nt, Homo sapiens
caugcuuuucugcc

SEQ ID NO: 1347860 - RNA, 18 nt, Homo sapiens
cauggagacagcaguuuc

SEQ ID NO: 1347861 - RNA, 18 nt, Homo sapiens
cauggccauuucugugga

SEQ ID NO: 1347862 - RNA, 12 nt, Homo sapiens
caugggagaccc

SEQ ID NO: 1347863 - RNA, 17 nt, Homo sapiens
cauggguucaauuggac

SEQ ID NO: 1347864 - RNA, 21 nt, Homo sapiens
caugguaaugaaggacaguga

SEQ ID NO: 1347865 - RNA, 13 nt, Homo sapiens
cauggugcacuga

SEQ ID NO: 1347866 - RNA, 15 nt, Homo sapiens
cauggugcacugagc

SEQ ID NO: 1347867 - RNA, 22 nt, Homo sapiens
cauggugccccaggaccagcuc

SEQ ID NO: 1347868 - RNA, 15 nt, Homo sapiens
cauguaauugcagau

SEQ ID NO: 1347869 - RNA, 13 nt, Homo sapiens
cauguagcauaua

SEQ ID NO: 1347870 - RNA, 20 nt, Homo sapiens
cauguaucucaguaccccau

SEQ ID NO: 1347871 - RNA, 18 nt, Homo sapiens
caugucagccacugugau

SEQ ID NO: 1347872 - RNA, 20 nt, Homo sapiens
caugucccaaaccagacacc

SEQ ID NO: 1347873 - RNA, 15 nt, Homo sapiens
caugucuugucauac

SEQ ID NO: 1347874 - RNA, 22 nt, Homo sapiens
caugugaaacucuacccugaag

SEQ ID NO: 1347875 - RNA, 13 nt, Homo sapiens
caugugacauuua

SEQ ID NO: 1347876 - RNA, 17 nt, Homo sapiens
cauguguacauucugcc

SEQ ID NO: 1347877 - RNA, 23 nt, Homo sapiens
cauguguagagccccuacugugg

SEQ ID NO: 1347878 - RNA, 16 nt, Homo sapiens
cauguuguaaugcugc

SEQ ID NO: 1347879 - RNA, 12 nt, Homo sapiens
cauguuuccauc

SEQ ID NO: 1347880 - RNA, 16 nt, Homo sapiens
cauguuuccaucauuu

SEQ ID NO: 1347881 - RNA, 19 nt, Homo sapiens
cauguuugcaccugugcau

SEQ ID NO: 1347882 - RNA, 20 nt, Homo sapiens
cauguuuuauacugcucuau

SEQ ID NO: 1347883 - RNA, 19 nt, Homo sapiens
cauuaaaauaaaccaaaua

SEQ ID NO: 1347884 - RNA, 23 nt, Homo sapiens
cauuaaaauaaaccaaauauguu

SEQ ID NO: 1347885 - RNA, 16 nt, Homo sapiens
cauuaaaguucuaggc

SEQ ID NO: 1347886 - RNA, 13 nt, Homo sapiens
cauuaacaaugac

SEQ ID NO: 1347887 - RNA, 12 nt, Homo sapiens
cauuaacagugc

SEQ ID NO: 1347888 - RNA, 16 nt, Homo sapiens
cauuagugauuccauc

SEQ ID NO: 1347889 - RNA, 13 nt, Homo sapiens
cauuaucuuauca

SEQ ID NO: 1347890 - RNA, 17 nt, Homo sapiens
cauuauuaaguaacuua

SEQ ID NO: 1347891 - RNA, 19 nt, Homo sapiens
cauuauuuuucacugcccc

SEQ ID NO: 1347892 - RNA, 19 nt, Homo sapiens
cauucaauagcauaucaca

SEQ ID NO: 1347893 - RNA, 13 nt, Homo sapiens
cauucacauaucu

SEQ ID NO: 1347894 - RNA, 13 nt, Homo sapiens
cauucacauucag

SEQ ID NO: 1347895 - RNA, 19 nt, Homo sapiens
cauucaugugggcauuucu

SEQ ID NO: 1347896 - RNA, 12 nt, Homo sapiens
cauucauugcag

SEQ ID NO: 1347897 - RNA, 14 nt, Homo sapiens
cauuccauuugcuu

SEQ ID NO: 1347898 - RNA, 19 nt, Homo sapiens
cauuccugaagaaccaguc

SEQ ID NO: 1347899 - RNA, 16 nt, Homo sapiens
cauucgcuacuaugau

SEQ ID NO: 1347900 - RNA, 14 nt, Homo sapiens
cauucuauucucca

SEQ ID NO: 1347901 - RNA, 13 nt, Homo sapiens
cauucucacauaa

SEQ ID NO: 1347902 - RNA, 16 nt, Homo sapiens
cauugaaauaauaaua

SEQ ID NO: 1347903 - RNA, 16 nt, Homo sapiens
cauugccgcuguauaa

SEQ ID NO: 1347904 - RNA, 16 nt, Homo sapiens
cauugggagucuguag

SEQ ID NO: 1347905 - RNA, 14 nt, Homo sapiens
cauugggauauucu

SEQ ID NO: 1347906 - RNA, 15 nt, Homo sapiens
cauuggugaaguaaa

SEQ ID NO: 1347907 - RNA, 12 nt, Homo sapiens
cauugguguuga

SEQ ID NO: 1347908 - RNA, 20 nt, Homo sapiens
cauuguaaaagcauuuugua

SEQ ID NO: 1347909 - RNA, 15 nt, Homo sapiens
cauuguaggauguug

SEQ ID NO: 1347910 - RNA, 17 nt, Homo sapiens
cauuuaaauguguacaa

SEQ ID NO: 1347911 - RNA, 14 nt, Homo sapiens
cauuuaauguauau

SEQ ID NO: 1347912 - RNA, 15 nt, Homo sapiens
cauuuauauauugaa

SEQ ID NO: 1347913 - RNA, 15 nt, Homo sapiens
cauuucaaacagucu

SEQ ID NO: 1347914 - RNA, 16 nt, Homo sapiens
cauuucagauauucca

SEQ ID NO: 1347915 - RNA, 17 nt, Homo sapiens
cauuucaugaagcaaga

SEQ ID NO: 1347916 - RNA, 20 nt, Homo sapiens
cauuucucuacacuaagggg

SEQ ID NO: 1347917 - RNA, 20 nt, Homo sapiens
cauuucucuuccccuuagaa

SEQ ID NO: 1347918 - RNA, 17 nt, Homo sapiens
cauuugcuugcaaucua

SEQ ID NO: 1347919 - RNA, 19 nt, Homo sapiens
cauuugggagacaugugac

SEQ ID NO: 1347920 - RNA, 20 nt, Homo sapiens
cgccuuaugccucagucuau

SEQ ID NO: 1347921 - RNA, 23 nt, Homo sapiens
cgccuuaugccucagucuauucu

SEQ ID NO: 1347922 - RNA, 15 nt, Homo sapiens
cgccuucucccacau

SEQ ID NO: 1347923 - RNA, 19 nt, Homo sapiens
cgcggcccgcgcagcugcc

SEQ ID NO: 1347924 - RNA, 12 nt, Homo sapiens
cgcuaaggugaa

SEQ ID NO: 1347925 - RNA, 21 nt, Homo sapiens
cgcuaaggugaaaaggggugu

SEQ ID NO: 1347926 - RNA, 14 nt, Homo sapiens
cgcuagcaguacua

SEQ ID NO: 1347927 - RNA, 19 nt, Homo sapiens
cgcugaagcgccuccccca

SEQ ID NO: 1347928 - RNA, 16 nt, Homo sapiens
cgcuguauaaagcaug

SEQ ID NO: 1347929 - RNA, 22 nt, Homo sapiens
cgcuguugucacaucucaggga

SEQ ID NO: 1347930 - RNA, 20 nt, Homo sapiens
cgcuucugccuuuucacugu

SEQ ID NO: 1347931 - RNA, 22 nt, Homo sapiens
cgcuugcaccacuuccguccca

SEQ ID NO: 1347932 - RNA, 21 nt, Homo sapiens
cggaaguacuucccucaggcc

SEQ ID NO: 1347933 - RNA, 17 nt, Homo sapiens
cggacugucaguucucu

SEQ ID NO: 1347934 - RNA, 20 nt, Homo sapiens
cggagaagagcuguucacag

SEQ ID NO: 1347935 - RNA, 14 nt, Homo sapiens
cggaggccagagag

SEQ ID NO: 1347936 - RNA, 15 nt, Homo sapiens
cggagugccuggagu

SEQ ID NO: 1347937 - RNA, 22 nt, Homo sapiens
cggauaguaagaaaacaaacag

SEQ ID NO: 1347938 - RNA, 12 nt, Homo sapiens
cggauccugcug

SEQ ID NO: 1347939 - RNA, 12 nt, Homo sapiens
cggauggugcau

SEQ ID NO: 1347940 - RNA, 13 nt, Homo sapiens
cggcacagccuuc

SEQ ID NO: 1347941 - RNA, 21 nt, Homo sapiens
cggcagcgggcggaggggauc

SEQ ID NO: 1347942 - RNA, 17 nt, Homo sapiens
cggccugcccagucgac

SEQ ID NO: 1347943 - RNA, 14 nt, Homo sapiens
cggcuugauuuccg

SEQ ID NO: 1347944 - RNA, 15 nt, Homo sapiens
cggcuuuaagugugc

SEQ ID NO: 1347945 - RNA, 13 nt, Homo sapiens
cgggagcacagcu

SEQ ID NO: 1347946 - RNA, 14 nt, Homo sapiens
cgggagcugcacua

SEQ ID NO: 1347947 - RNA, 21 nt, Homo sapiens
cgggccuggagaacuagagaa

SEQ ID NO: 1347948 - RNA, 13 nt, Homo sapiens
cggggaguuuccg

SEQ ID NO: 1347949 - RNA, 13 nt, Homo sapiens
cggguugggucac

SEQ ID NO: 1347950 - RNA, 15 nt, Homo sapiens
cgguguauccuggcc

SEQ ID NO: 1347951 - RNA, 15 nt, Homo sapiens
cgguuaccucugcau

SEQ ID NO: 1347952 - RNA, 14 nt, Homo sapiens
cguaaacaccaaau

SEQ ID NO: 1347953 - RNA, 17 nt, Homo sapiens
cguaucuuuuaaugauc

SEQ ID NO: 1347954 - RNA, 14 nt, Homo sapiens
cgucacagccucaa

SEQ ID NO: 1347955 - RNA, 15 nt, Homo sapiens
cgucugggcucccug

SEQ ID NO: 1347956 - RNA, 15 nt, Homo sapiens
cgugagaacaaucau

SEQ ID NO: 1347957 - RNA, 16 nt, Homo sapiens
cgugaucaaagccaca

SEQ ID NO: 1347958 - RNA, 19 nt, Homo sapiens
cgugaugaaaacuuucuaa

SEQ ID NO: 1347959 - RNA, 15 nt, Homo sapiens
cgugaugcuaugaug

SEQ ID NO: 1347960 - RNA, 20 nt, Homo sapiens
cgugauucaaugaaccacaa

SEQ ID NO: 1347961 - RNA, 15 nt, Homo sapiens
cgugcaauguuuuaa

SEQ ID NO: 1347962 - RNA, 13 nt, Homo sapiens
cgugcugugcucu

SEQ ID NO: 1347963 - RNA, 16 nt, Homo sapiens
cgugggucauuacaaa

SEQ ID NO: 1347964 - RNA, 14 nt, Homo sapiens
cguggguugcacug

SEQ ID NO: 1347965 - RNA, 15 nt, Homo sapiens
cguggguugcacugg

SEQ ID NO: 1347966 - RNA, 20 nt, Homo sapiens
cguucaccuccaagcauuuc

SEQ ID NO: 1347967 - RNA, 16 nt, Homo sapiens
cguuccacauccacac

SEQ ID NO: 1347968 - RNA, 15 nt, Homo sapiens
cguuucacugcaaac

SEQ ID NO: 1347969 - RNA, 21 nt, Homo sapiens
cguuugcauuugcagugcauc

SEQ ID NO: 1347970 - RNA, 14 nt, Homo sapiens
cguuuuccaaagag

SEQ ID NO: 1347971 - RNA, 17 nt, Homo sapiens
cuauccugggcauccuu

SEQ ID NO: 1347972 - RNA, 23 nt, Homo sapiens
cuaucucagccauaggugcaguu

SEQ ID NO: 1347973 - RNA, 17 nt, Homo sapiens
cuaucugacuucauaca

SEQ ID NO: 1347974 - RNA, 19 nt, Homo sapiens
cuaucugccuggaggcaaa

SEQ ID NO: 1347975 - RNA, 19 nt, Homo sapiens
cuaugagauggccaugcuc

SEQ ID NO: 1347976 - RNA, 18 nt, Homo sapiens
cuaugaggggguuuggca

SEQ ID NO: 1347977 - RNA, 14 nt, Homo sapiens
cuaugauacugucu

SEQ ID NO: 1347978 - RNA, 13 nt, Homo sapiens
cuaugccuugaaa

SEQ ID NO: 1347979 - RNA, 16 nt, Homo sapiens
cuaugcuguucacugg

SEQ ID NO: 1347980 - RNA, 16 nt, Homo sapiens
cuauguacugccuuag

SEQ ID NO: 1347981 - RNA, 23 nt, Homo sapiens
cuauuagagcugccugugccuuu

SEQ ID NO: 1347982 - RNA, 13 nt, Homo sapiens
cuauuauauucau

SEQ ID NO: 1347983 - RNA, 19 nt, Homo sapiens
cuauuccaucaacugugaa

SEQ ID NO: 1347984 - RNA, 20 nt, Homo sapiens
cuauucuaacuaaugacaag

SEQ ID NO: 1347985 - RNA, 20 nt, Homo sapiens
cuauucugaaaaagacauaa

SEQ ID NO: 1347986 - RNA, 23 nt, Homo sapiens
cuauucugagcauacucaacaaa

SEQ ID NO: 1347987 - RNA, 21 nt, Homo sapiens
cuauuuauuugugagacugua

SEQ ID NO: 1347988 - RNA, 23 nt, Homo sapiens
cuauuuauuuuuucuaagugugg

SEQ ID NO: 1347989 - RNA, 18 nt, Homo sapiens
cuauuucaauacuuacau

SEQ ID NO: 1347990 - RNA, 17 nt, Homo sapiens
cuauuucuccaaagccu

SEQ ID NO: 1347991 - RNA, 15 nt, Homo sapiens
cuauuucuugaagaa

SEQ ID NO: 1347992 - RNA, 22 nt, Homo sapiens
cucaaaauaccaugccauuuaa

SEQ ID NO: 1347993 - RNA, 14 nt, Homo sapiens
cucaaagaaagugu

SEQ ID NO: 1347994 - RNA, 17 nt, Homo sapiens
cucaaagagaauuguau

SEQ ID NO: 1347995 - RNA, 20 nt, Homo sapiens
cucaaaugcuggcaaaucca

SEQ ID NO: 1347996 - RNA, 23 nt, Homo sapiens
cucaaauugucagcaauuuaacu

SEQ ID NO: 1347997 - RNA, 21 nt, Homo sapiens
cucaagucuggcagacuuucu

SEQ ID NO: 1347998 - RNA, 16 nt, Homo sapiens
cucaauauuaaagggu

SEQ ID NO: 1347999 - RNA, 19 nt, Homo sapiens
cucaauauuuacuauuuca

SEQ ID NO: 1348000 - RNA, 23 nt, Homo sapiens
cucaaugcaauggcucaucagau

SEQ ID NO: 1348001 - RNA, 13 nt, Homo sapiens
cucacaccuguaa

SEQ ID NO: 1348002 - RNA, 20 nt, Homo sapiens
cucacaccuguaaucccagc

SEQ ID NO: 1348003 - RNA, 13 nt, Homo sapiens
cucacacugcaag

SEQ ID NO: 1348004 - RNA, 15 nt, Homo sapiens
cucacacuuugccau

SEQ ID NO: 1348005 - RNA, 20 nt, Homo sapiens
cucacauaagcccaguucau

SEQ ID NO: 1348006 - RNA, 15 nt, Homo sapiens
cucaccacuaccagc

SEQ ID NO: 1348007 - RNA, 17 nt, Homo sapiens
cucaccaugaugugaag

SEQ ID NO: 1348008 - RNA, 12 nt, Homo sapiens
cucacugcagua

SEQ ID NO: 1348009 - RNA, 16 nt, Homo sapiens
cucacugcaguagugc

SEQ ID NO: 1348010 - RNA, 15 nt, Homo sapiens
cucacugccauggaa

SEQ ID NO: 1348011 - RNA, 18 nt, Homo sapiens
cucacugggaagcuccca

SEQ ID NO: 1348012 - RNA, 23 nt, Homo sapiens
cucagaaaugucauguggcuacc

SEQ ID NO: 1348013 - RNA, 12 nt, Homo sapiens
cucagaaccaaa

SEQ ID NO: 1348014 - RNA, 17 nt, Homo sapiens
cucagaccaaucaucaa

SEQ ID NO: 1348015 - RNA, 14 nt, Homo sapiens
cucagaggccugcu

SEQ ID NO: 1348016 - RNA, 15 nt, Homo sapiens
cucagaucauuauca

SEQ ID NO: 1348017 - RNA, 19 nt, Homo sapiens
cucagccauaggugcaguu

SEQ ID NO: 1348018 - RNA, 17 nt, Homo sapiens
gaauaaauaauucuucc

SEQ ID NO: 1348019 - RNA, 18 nt, Homo sapiens
gaauaaaugucacuuuuu

SEQ ID NO: 1348020 - RNA, 16 nt, Homo sapiens
gaauaaauucuaccuc

SEQ ID NO: 1348021 - RNA, 22 nt, Homo sapiens
gaauaauaagcuacuugccuug

SEQ ID NO: 1348022 - RNA, 22 nt, Homo sapiens
gaauagacacuucaccaaagag

SEQ ID NO: 1348023 - RNA, 13 nt, Homo sapiens
gaauagcuuuaau

SEQ ID NO: 1348024 - RNA, 18 nt, Homo sapiens
gaauauaugucagugaug

SEQ ID NO: 1348025 - RNA, 15 nt, Homo sapiens
gaauauugugcccca

SEQ ID NO: 1348026 - RNA, 13 nt, Homo sapiens
gaauccacacuuc

SEQ ID NO: 1348027 - RNA, 17 nt, Homo sapiens
gaaucuauuucacuuau

SEQ ID NO: 1348028 - RNA, 23 nt, Homo sapiens
gaaugaaaauaacugaaccaaau

SEQ ID NO: 1348029 - RNA, 19 nt, Homo sapiens
gaaugccgcugucucugag

SEQ ID NO: 1348030 - RNA, 14 nt, Homo sapiens
gaauggcagcugcc

SEQ ID NO: 1348031 - RNA, 16 nt, Homo sapiens
gaaugggcauuucuaa

SEQ ID NO: 1348032 - RNA, 14 nt, Homo sapiens
gaaugguguaggaa

SEQ ID NO: 1348033 - RNA, 17 nt, Homo sapiens
gaaugucaguuguuauu

SEQ ID NO: 1348034 - RNA, 19 nt, Homo sapiens
gaauuaaaucaucccuuaa

SEQ ID NO: 1348035 - RNA, 21 nt, Homo sapiens
gaauucaaguggguauucugg

SEQ ID NO: 1348036 - RNA, 17 nt, Homo sapiens
gaauucaccaguguucc

SEQ ID NO: 1348037 - RNA, 17 nt, Homo sapiens
gaauucagugccuucaa

SEQ ID NO: 1348038 - RNA, 17 nt, Homo sapiens
gaauucugucauuucaa

SEQ ID NO: 1348039 - RNA, 17 nt, Homo sapiens
gaauuguuccaguacua

SEQ ID NO: 1348040 - RNA, 13 nt, Homo sapiens
gaauuuucuugaa

SEQ ID NO: 1348041 - RNA, 13 nt, Homo sapiens
gaauuuuguugcu

SEQ ID NO: 1348042 - RNA, 14 nt, Homo sapiens
gacaacacugggaa

SEQ ID NO: 1348043 - RNA, 13 nt, Homo sapiens
gacaacaucgcaa

SEQ ID NO: 1348044 - RNA, 16 nt, Homo sapiens
gacaaccuccauucua

SEQ ID NO: 1348045 - RNA, 21 nt, Homo sapiens
gacaagagcuguuaugcuguu

SEQ ID NO: 1348046 - RNA, 15 nt, Homo sapiens
gacaaggucuugcua

SEQ ID NO: 1348047 - RNA, 19 nt, Homo sapiens
gacaaggucuugcuauguu

SEQ ID NO: 1348048 - RNA, 14 nt, Homo sapiens
gacaaucacugcca

SEQ ID NO: 1348049 - RNA, 17 nt, Homo sapiens
gacaauuugugauaucu

SEQ ID NO: 1348050 - RNA, 16 nt, Homo sapiens
gacacaaauaaaggaa

SEQ ID NO: 1348051 - RNA, 22 nt, Homo sapiens
gacacaacagcagucuccuuca

SEQ ID NO: 1348052 - RNA, 14 nt, Homo sapiens
gacacagcucuuca

SEQ ID NO: 1348053 - RNA, 15 nt, Homo sapiens
gacaccagccuagcc

SEQ ID NO: 1348054 - RNA, 18 nt, Homo sapiens
gacacccaugccagagag

SEQ ID NO: 1348055 - RNA, 19 nt, Homo sapiens
gacacccucuggggguccu

SEQ ID NO: 1348056 - RNA, 20 nt, Homo sapiens
gacaccugagacaugcugaa

SEQ ID NO: 1348057 - RNA, 16 nt, Homo sapiens
gacacugaaaaaucua

SEQ ID NO: 1348058 - RNA, 20 nt, Homo sapiens
gacacuucaccaaagagcau

SEQ ID NO: 1348059 - RNA, 10 nt, Homo sapiens
gacagaauuc

SEQ ID NO: 1348060 - RNA, 15 nt, Homo sapiens
gacagccauuuucca

SEQ ID NO: 1348061 - RNA, 16 nt, Homo sapiens
gacagccauuuuccaa

SEQ ID NO: 1348062 - RNA, 14 nt, Homo sapiens
gacagccugaguca

SEQ ID NO: 1348063 - RNA, 13 nt, Homo sapiens
gacagccuugcaa

SEQ ID NO: 1348064 - RNA, 14 nt, Homo sapiens
gacagcuuccucac

SEQ ID NO: 1348065 - RNA, 14 nt, Homo sapiens
gacaggacuuucau

SEQ ID NO: 1348066 - RNA, 18 nt, Homo sapiens
gacagggccagugcaguu

SEQ ID NO: 1348067 - RNA, 16 nt, Homo sapiens
gacagugaccccaguc

SEQ ID NO: 1348068 - RNA, 21 nt, Homo sapiens
gacauaaugggguccuggcca

SEQ ID NO: 1348069 - RNA, 17 nt, Homo sapiens
gacauacauauuaucuc

SEQ ID NO: 1348070 - RNA, 16 nt, Homo sapiens
gacauauuaugccuga

SEQ ID NO: 1348071 - RNA, 20 nt, Homo sapiens
gacauccccccgccaaaagc

SEQ ID NO: 1348072 - RNA, 19 nt, Homo sapiens
gacauuaaaaauguuagua

SEQ ID NO: 1348073 - RNA, 22 nt, Homo sapiens
gacauuugggagacaugugaca

SEQ ID NO: 1348074 - RNA, 19 nt, Homo sapiens
gacauuuuagaaugucaau

SEQ ID NO: 1348075 - RNA, 18 nt, Homo sapiens
gacauuuuaugucuuucu

SEQ ID NO: 1348076 - RNA, 17 nt, Homo sapiens
gaccacugggcaaugau

SEQ ID NO: 1348077 - RNA, 24 nt, Homo sapiens
gaccacugggcaaugauggcaauu

SEQ ID NO: 1348078 - RNA, 14 nt, Homo sapiens
gaccaucaugcccu

SEQ ID NO: 1348079 - RNA, 23 nt, Homo sapiens
gaccaucugcccggcacugggga

SEQ ID NO: 1348080 - RNA, 14 nt, Homo sapiens
gaccauuuggucag

SEQ ID NO: 1348081 - RNA, 19 nt, Homo sapiens
gacccaaaacagcuuuguc

SEQ ID NO: 1348082 - RNA, 17 nt, Homo sapiens
gacccaucuuccaccuc

SEQ ID NO: 1348083 - RNA, 13 nt, Homo sapiens
gaccccacucccc

SEQ ID NO: 1348084 - RNA, 18 nt, Homo sapiens
gaccccgcacccggcucg

SEQ ID NO: 1348085 - RNA, 13 nt, Homo sapiens
gaccccucuaccu

SEQ ID NO: 1348086 - RNA, 16 nt, Homo sapiens
gacccugcaagaccac

SEQ ID NO: 1348087 - RNA, 12 nt, Homo sapiens
gaccgacugcac

SEQ ID NO: 1348088 - RNA, 13 nt, Homo sapiens
gaccguccagggg

SEQ ID NO: 1348089 - RNA, 13 nt, Homo sapiens
gaccuaaagggac

SEQ ID NO: 1348090 - RNA, 15 nt, Homo sapiens
gaccuagagacuuca

SEQ ID NO: 1348091 - RNA, 15 nt, Homo sapiens
gaccucccacugccc

SEQ ID NO: 1348092 - RNA, 15 nt, Homo sapiens
gaccugacaccuuuc

SEQ ID NO: 1348093 - RNA, 15 nt, Homo sapiens
gaccugauccuggag

SEQ ID NO: 1348094 - RNA, 13 nt, Homo sapiens
gaccuuaaaugca

SEQ ID NO: 1348095 - RNA, 22 nt, Homo sapiens
gacggcgugccuggacacugua

SEQ ID NO: 1348096 - RNA, 23 nt, Homo sapiens
gacgggcaaaauaaagugacaga

SEQ ID NO: 1348097 - RNA, 20 nt, Homo sapiens
gacguccucccugaucccac

SEQ ID NO: 1348098 - RNA, 16 nt, Homo sapiens
gacguggguugcacug

SEQ ID NO: 1348099 - RNA, 18 nt, Homo sapiens
gacguuaggccaggccuu

SEQ ID NO: 1348100 - RNA, 11 nt, Homo sapiens
gacguugccua

SEQ ID NO: 1348101 - RNA, 13 nt, Homo sapiens
gacuaaacuuaau

SEQ ID NO: 1348102 - RNA, 12 nt, Homo sapiens
gacuacacagcu

SEQ ID NO: 1348103 - RNA, 22 nt, Homo sapiens
gacuaccucugugccuugccac

SEQ ID NO: 1348104 - RNA, 19 nt, Homo sapiens
gacuacuuggaacuaggcu

SEQ ID NO: 1348105 - RNA, 16 nt, Homo sapiens
gacucaggacaucccc

SEQ ID NO: 1348106 - RNA, 17 nt, Homo sapiens
gacucaggauccaguga

SEQ ID NO: 1348107 - RNA, 16 nt, Homo sapiens
gacucagggaccuaag

SEQ ID NO: 1348108 - RNA, 22 nt, Homo sapiens
gacucaucuuggcccuccucag

SEQ ID NO: 1348109 - RNA, 17 nt, Homo sapiens
gacucugucucauugac

SEQ ID NO: 1348110 - RNA, 22 nt, Homo sapiens
gacucuuuaauaaauugcuuac

SEQ ID NO: 1348111 - RNA, 13 nt, Homo sapiens
gacugauagacac

SEQ ID NO: 1348112 - RNA, 17 nt, Homo sapiens
gacugccccugccuuuu

SEQ ID NO: 1348113 - RNA, 16 nt, Homo sapiens
gacuggaaagcacaag

SEQ ID NO: 1348114 - RNA, 14 nt, Homo sapiens
gacuggcacacugg

SEQ ID NO: 1348115 - RNA, 15 nt, Homo sapiens
gacugggcacugggg

SEQ ID NO: 1348116 - RNA, 16 nt, Homo sapiens
gacuggggauggcgca

SEQ ID NO: 1348117 - RNA, 14 nt, Homo sapiens
gacuguacuccucc

SEQ ID NO: 1348118 - RNA, 15 nt, Homo sapiens
gacuguauuuuccaa

SEQ ID NO: 1348119 - RNA, 20 nt, Homo sapiens
gacuuagaggcaacaggauu

SEQ ID NO: 1348120 - RNA, 18 nt, Homo sapiens
gacuuauuuaaacucugu

SEQ ID NO: 1348121 - RNA, 18 nt, Homo sapiens
gacuuccuuggaaaucaa

SEQ ID NO: 1348122 - RNA, 17 nt, Homo sapiens
gacuucugucuucacaa

SEQ ID NO: 1348123 - RNA, 20 nt, Homo sapiens
gacuugaauagacacuucac

SEQ ID NO: 1348124 - RNA, 18 nt, Homo sapiens
gacuugaaugcacuuuug

SEQ ID NO: 1348125 - RNA, 22 nt, Homo sapiens
gacuugugauuggcugcaggaa

SEQ ID NO: 1348126 - RNA, 18 nt, Homo sapiens
acuuuaugugcaucuuau

SEQ ID NO: 1348127 - RNA, 16 nt, Homo sapiens
acuuugaagugcagcu

SEQ ID NO: 1348128 - RNA, 13 nt, Homo sapiens
acuuugacuuucu

SEQ ID NO: 1348129 - RNA, 12 nt, Homo sapiens
acuuugccaaaa

SEQ ID NO: 1348130 - RNA, 18 nt, Homo sapiens
acuuugggaggccaagga

SEQ ID NO: 1348131 - RNA, 14 nt, Homo sapiens
acuuuguguauuaa

SEQ ID NO: 1348132 - RNA, 17 nt, Homo sapiens
acuuuguguucauuuca

SEQ ID NO: 1348133 - RNA, 15 nt, Homo sapiens
acuuuuaaauuauac

SEQ ID NO: 1348134 - RNA, 23 nt, Homo sapiens
acuuuuauuuuuugguggugaaa

SEQ ID NO: 1348135 - RNA, 15 nt, Homo sapiens
agaaaaaaagggauc

SEQ ID NO: 1348136 - RNA, 14 nt, Homo sapiens
agaaaaacaacuuu

SEQ ID NO: 1348137 - RNA, 17 nt, Homo sapiens
agaaaaacaccgcuucu

SEQ ID NO: 1348138 - RNA, 19 nt, Homo sapiens
agaaaaagucaauguacuu

SEQ ID NO: 1348139 - RNA, 23 nt, Homo sapiens
agaaaaaucuuuguuacucugua

SEQ ID NO: 1348140 - RNA, 23 nt, Homo sapiens
agaaaaccuaguacauuacuaaa

SEQ ID NO: 1348141 - RNA, 13 nt, Homo sapiens
agaaaagauucuu

SEQ ID NO: 1348142 - RNA, 19 nt, Homo sapiens
agaaaagcaauacuguuuc

SEQ ID NO: 1348143 - RNA, 15 nt, Homo sapiens
agaaaagccucucca

SEQ ID NO: 1348144 - RNA, 19 nt, Homo sapiens
agaaaagcugccauuuccc

SEQ ID NO: 1348145 - RNA, 21 nt, Homo sapiens
agaaaauaaaauuuaacucac

SEQ ID NO: 1348146 - RNA, 20 nt, Homo sapiens
agaaaauaugaccagaucag

SEQ ID NO: 1348147 - RNA, 21 nt, Homo sapiens
agaaaauauuuuuguggacau

SEQ ID NO: 1348148 - RNA, 16 nt, Homo sapiens
agaaaauggccaguga

SEQ ID NO: 1348149 - RNA, 13 nt, Homo sapiens
agaaaauucuaaa

SEQ ID NO: 1348150 - RNA, 19 nt, Homo sapiens
agaaaccagaaaagcaaua

SEQ ID NO: 1348151 - RNA, 13 nt, Homo sapiens
agaaaccucggga

SEQ ID NO: 1348152 - RNA, 17 nt, Homo sapiens
agaaacuugcugaucca

SEQ ID NO: 1348153 - RNA, 14 nt, Homo sapiens
agaaagaauguuca

SEQ ID NO: 1348154 - RNA, 16 nt, Homo sapiens
agaaagccuauuccau

SEQ ID NO: 1348155 - RNA, 17 nt, Homo sapiens
agaaaguaaacuguaau

SEQ ID NO: 1348156 - RNA, 23 nt, Homo sapiens
agaaagugacaugcauucacaua

SEQ ID NO: 1348157 - RNA, 14 nt, Homo sapiens
agaaaguguauuug

SEQ ID NO: 1348158 - RNA, 14 nt, Homo sapiens
agaaauacuguauu

SEQ ID NO: 1348159 - RNA, 16 nt, Homo sapiens
agaaaugccccagugu

SEQ ID NO: 1348160 - RNA, 15 nt, Homo sapiens
agaaaugucaugugg

SEQ ID NO: 1348161 - RNA, 23 nt, Homo sapiens
agaaauuaaacauauucaaggag

SEQ ID NO: 1348162 - RNA, 23 nt, Homo sapiens
agaacagaaguguucacauggcu

SEQ ID NO: 1348163 - RNA, 19 nt, Homo sapiens
agaaccagggcucuucuca

SEQ ID NO: 1348164 - RNA, 18 nt, Homo sapiens
agaacccaccaaccagaa

SEQ ID NO: 1348165 - RNA, 19 nt, Homo sapiens
agaaccucuaagugcugcu

SEQ ID NO: 1348166 - RNA, 15 nt, Homo sapiens
agaaccuucaaccca

SEQ ID NO: 1348167 - RNA, 20 nt, Homo sapiens
agaacguggugaccuuucac

SEQ ID NO: 1348168 - RNA, 21 nt, Homo sapiens
agaacuauugugcucagagac

SEQ ID NO: 1348169 - RNA, 19 nt, Homo sapiens
agaacucaaauggggccag

SEQ ID NO: 1348170 - RNA, 20 nt, Homo sapiens
agaacuucuccuacuguagc

SEQ ID NO: 1348171 - RNA, 16 nt, Homo sapiens
agaagaggaaagggag

SEQ ID NO: 1348172 - RNA, 17 nt, Homo sapiens
agaagagugcugucauu

SEQ ID NO: 1348173 - RNA, 14 nt, Homo sapiens
agaagaugccagcu

SEQ ID NO: 1348174 - RNA, 13 nt, Homo sapiens
agaagcaagacac

SEQ ID NO: 1348175 - RNA, 15 nt, Homo sapiens
agaagccgugggaag

SEQ ID NO: 1348176 - RNA, 16 nt, Homo sapiens
agaagcugucagggac

SEQ ID NO: 1348177 - RNA, 21 nt, Homo sapiens
agaagcugucagggacccagg

SEQ ID NO: 1348178 - RNA, 15 nt, Homo sapiens
agaaggcuaugggga

SEQ ID NO: 1348179 - RNA, 20 nt, Homo sapiens
agaaggggcuuugugaccag

SEQ ID NO: 1348180 - RNA, 20 nt, Homo sapiens
agaaggucauaagggagcau

SEQ ID NO: 1348181 - RNA, 11 nt, Homo sapiens
agaaggucugu

SEQ ID NO: 1348182 - RNA, 20 nt, Homo sapiens
agaaggucuguggugcagug

SEQ ID NO: 1348183 - RNA, 14 nt, Homo sapiens
agaaguaauuugaa

SEQ ID NO: 1348184 - RNA, 22 nt, Homo sapiens
agaaguacuaucuuuguguugc

SEQ ID NO: 1348185 - RNA, 17 nt, Homo sapiens
agaaguugagagagcaa

SEQ ID NO: 1348186 - RNA, 14 nt, Homo sapiens
agaauaaauuccca

SEQ ID NO: 1348187 - RNA, 22 nt, Homo sapiens
agaauaaauucccaacuucucu

SEQ ID NO: 1348188 - RNA, 19 nt, Homo sapiens
agaauacccuaaaguauaa

SEQ ID NO: 1348189 - RNA, 15 nt, Homo sapiens
agaaucugcucugaa

SEQ ID NO: 1348190 - RNA, 20 nt, Homo sapiens
agaaugagcacccauuccaa

SEQ ID NO: 1348191 - RNA, 21 nt, Homo sapiens
agaaugguugaguuacauuaa

SEQ ID NO: 1348192 - RNA, 14 nt, Homo sapiens
agacaacacuggga

SEQ ID NO: 1348193 - RNA, 15 nt, Homo sapiens
agacaagagcuguua

SEQ ID NO: 1348194 - RNA, 13 nt, Homo sapiens
agacaaggugcua

SEQ ID NO: 1348195 - RNA, 18 nt, Homo sapiens
agacaauauggucccaaa

SEQ ID NO: 1348196 - RNA, 18 nt, Homo sapiens
agacaccagccuagccug

SEQ ID NO: 1348197 - RNA, 17 nt, Homo sapiens
agacacuucaccaaaga

SEQ ID NO: 1348198 - RNA, 21 nt, Homo sapiens
agacagacuagaaguuccuag

SEQ ID NO: 1348199 - RNA, 11 nt, Homo sapiens
agacagcaguu

SEQ ID NO: 1348200 - RNA, 22 nt, Homo sapiens
agacaggcaaauguacuucuca

SEQ ID NO: 1348201 - RNA, 20 nt, Homo sapiens
agacaguccuuucccaccau

SEQ ID NO: 1348202 - RNA, 17 nt, Homo sapiens
agacauaaacaaagaca

SEQ ID NO: 1348203 - RNA, 21 nt, Homo sapiens
agacauauaacgcagucuaau

SEQ ID NO: 1348204 - RNA, 22 nt, Homo sapiens
agacaucagucuccaacauguu

SEQ ID NO: 1348205 - RNA, 21 nt, Homo sapiens
agacauccacauaacccuguc

SEQ ID NO: 1348206 - RNA, 16 nt, Homo sapiens
agacauggaacagugu

SEQ ID NO: 1348207 - RNA, 13 nt, Homo sapiens
agacauucucaca

SEQ ID NO: 1348208 - RNA, 22 nt, Homo sapiens
agacauuuuaaaaaauggucac

SEQ ID NO: 1348209 - RNA, 12 nt, Homo sapiens
agaccaaaauaa

SEQ ID NO: 1348210 - RNA, 14 nt, Homo sapiens
agacccgcccuccc

SEQ ID NO: 1348211 - RNA, 23 nt, Homo sapiens
agacccuugacaccugcugagaa

SEQ ID NO: 1348212 - RNA, 22 nt, Homo sapiens
agaccuaacccaccauagucaa

SEQ ID NO: 1348213 - RNA, 19 nt, Homo sapiens
agaccucuaggaggagcua

SEQ ID NO: 1348214 - RNA, 16 nt, Homo sapiens
agaccucugugcacuu

SEQ ID NO: 1348215 - RNA, 19 nt, Homo sapiens
agaccugacaccuuucaua

SEQ ID NO: 1348216 - RNA, 15 nt, Homo sapiens
agaccugagaaccuu

SEQ ID NO: 1348217 - RNA, 23 nt, Homo sapiens
agacgggcaaaauaaagugacag

SEQ ID NO: 1348218 - RNA, 20 nt, Homo sapiens
agacgucuccccuucucugc

SEQ ID NO: 1348219 - RNA, 21 nt, Homo sapiens
agacgugaugggcuaggccuc

SEQ ID NO: 1348220 - RNA, 15 nt, Homo sapiens
agacucauucuucac

SEQ ID NO: 1348221 - RNA, 16 nt, Homo sapiens
agacuccaucucuucu

SEQ ID NO: 1348222 - RNA, 17 nt, Homo sapiens
agacucuggaggucauc

SEQ ID NO: 1348223 - RNA, 21 nt, Homo sapiens
agacucuggaggucaucuggc

SEQ ID NO: 1348224 - RNA, 17 nt, Homo sapiens
agacuggcucuuuuacc

SEQ ID NO: 1348225 - RNA, 12 nt, Homo sapiens
agacuggcuuua

SEQ ID NO: 1348226 - RNA, 19 nt, Homo sapiens
agacuguugggacagccau

SEQ ID NO: 1348227 - RNA, 20 nt, Homo sapiens
agacuugaauagacacuuca

SEQ ID NO: 1348228 - RNA, 14 nt, Homo sapiens
agacuugauuuaca

SEQ ID NO: 1348229 - RNA, 16 nt, Homo sapiens
agacuuuaucaugugu

SEQ ID NO: 1348230 - RNA, 20 nt, Homo sapiens
agagaaaccugccaaggagc

SEQ ID NO: 1348231 - RNA, 9 nt, Homo sapiens
agagaagau

SEQ ID NO: 1348232 - RNA, 13 nt, Homo sapiens
agagaagcugaug

SEQ ID NO: 1348233 - RNA, 20 nt, Homo sapiens
agagaauucucuuauccaac

SEQ ID NO: 1348234 - RNA, 22 nt, Homo sapiens
agagaccucaucagccuuggga

SEQ ID NO: 1348235 - RNA, 21 nt, Homo sapiens
agagacgggguuucuccaugu

SEQ ID NO: 1348236 - RNA, 13 nt, Homo sapiens
agagaguggcucc

SEQ ID NO: 1348237 - RNA, 21 nt, Homo sapiens
agagaucuuucuuuccaaaac

SEQ ID NO: 1348238 - RNA, 16 nt, Homo sapiens
agagcacucauuccuu

SEQ ID NO: 1348239 - RNA, 17 nt, Homo sapiens
agagccccuacuguggg

SEQ ID NO: 1348240 - RNA, 17 nt, Homo sapiens
agagcccgggagcugcu

SEQ ID NO: 1348241 - RNA, 19 nt, Homo sapiens
agagccucuggcaucucuu

SEQ ID NO: 1348242 - RNA, 19 nt, Homo sapiens
agagcugagaccuugcuuu

SEQ ID NO: 1348243 - RNA, 23 nt, Homo sapiens
agagcugccugugccuuuugcca

SEQ ID NO: 1348244 - RNA, 22 nt, Homo sapiens
agagcuguuaugcuguuuccua

SEQ ID NO: 1348245 - RNA, 23 nt, Homo sapiens
agagcuguuuggauacagcugcu

SEQ ID NO: 1348246 - RNA, 23 nt, Homo sapiens
agagcuuguaauaaauacugcag

SEQ ID NO: 1348247 - RNA, 19 nt, Homo sapiens
agagcuuuuaccuguuauu

SEQ ID NO: 1348248 - RNA, 20 nt, Homo sapiens
agaggaccaaugcuugcaug

SEQ ID NO: 1348249 - RNA, 14 nt, Homo sapiens
agaggagaaaaaga

SEQ ID NO: 1348250 - RNA, 20 nt, Homo sapiens
agagggaaaaucuucacuuu

SEQ ID NO: 1348251 - RNA, 15 nt, Homo sapiens
agagggaagaucugg

SEQ ID NO: 1348252 - RNA, 15 nt, Homo sapiens
agaggguacuugaau

SEQ ID NO: 1348253 - RNA, 16 nt, Homo sapiens
agagguggaguucuua

SEQ ID NO: 1348254 - RNA, 18 nt, Homo sapiens
agagucagacugauagac

SEQ ID NO: 1348255 - RNA, 14 nt, Homo sapiens
agaguccucugaau

SEQ ID NO: 1348256 - RNA, 20 nt, Homo sapiens
agagucuuguuuuuuauuca

SEQ ID NO: 1348257 - RNA, 19 nt, Homo sapiens
agagugcuuggcugcugua

SEQ ID NO: 1348258 - RNA, 21 nt, Homo sapiens
agagugggguagguugggaga

SEQ ID NO: 1348259 - RNA, 15 nt, Homo sapiens
agaguuacaguucug

SEQ ID NO: 1348260 - RNA, 23 nt, Homo sapiens
aaagcuacuauguacugccuuag

SEQ ID NO: 1348261 - RNA, 12 nt, Homo sapiens
aaagcugcucag

SEQ ID NO: 1348262 - RNA, 13 nt, Homo sapiens
aaagcugcucagg

SEQ ID NO: 1348263 - RNA, 14 nt, Homo sapiens
aaagcugcucaggg

SEQ ID NO: 1348264 - RNA, 13 nt, Homo sapiens
aaaggaaccaccu

SEQ ID NO: 1348265 - RNA, 16 nt, Homo sapiens
aaaggaucagagauuc

SEQ ID NO: 1348266 - RNA, 15 nt, Homo sapiens
aaaggaugugauaua

SEQ ID NO: 1348267 - RNA, 21 nt, Homo sapiens
aaaggauuguuaauguuugca

SEQ ID NO: 1348268 - RNA, 16 nt, Homo sapiens
aaaggccccugcaaug

SEQ ID NO: 1348269 - RNA, 13 nt, Homo sapiens
aaaggcuguuaaa

SEQ ID NO: 1348270 - RNA, 16 nt, Homo sapiens
aaagggaccaucugcu

SEQ ID NO: 1348271 - RNA, 19 nt, Homo sapiens
aaaggucaagaacacagug

SEQ ID NO: 1348272 - RNA, 22 nt, Homo sapiens
aaaggucaagaacacagugauu

SEQ ID NO: 1348273 - RNA, 16 nt, Homo sapiens
aaagguugagauguaa

SEQ ID NO: 1348274 - RNA, 14 nt, Homo sapiens
aaagguuuuccuua

SEQ ID NO: 1348275 - RNA, 15 nt, Homo sapiens
aaaguaucaugaaag

SEQ ID NO: 1348276 - RNA, 22 nt, Homo sapiens
aaaguauuggcauucaaaaaga

SEQ ID NO: 1348277 - RNA, 22 nt, Homo sapiens
aaagucacaggucacacgaggg

SEQ ID NO: 1348278 - RNA, 17 nt, Homo sapiens
aaagugacaaagcaauu

SEQ ID NO: 1348279 - RNA, 17 nt, Homo sapiens
aaagugcuggaauuaca

SEQ ID NO: 1348280 - RNA, 21 nt, Homo sapiens
aaagugcuggaauuacaggcg

SEQ ID NO: 1348281 - RNA, 15 nt, Homo sapiens
aaaguggcaaucuca

SEQ ID NO: 1348282 - RNA, 21 nt, Homo sapiens
aaagugucauauuuacugguc

SEQ ID NO: 1348283 - RNA, 23 nt, Homo sapiens
aaaguucccuacuuccugugacu

SEQ ID NO: 1348284 - RNA, 16 nt, Homo sapiens
aaaguucucauugaau

SEQ ID NO: 1348285 - RNA, 22 nt, Homo sapiens
aaaguugcauguuaugugaguc

SEQ ID NO: 1348286 - RNA, 15 nt, Homo sapiens
aaauaaaucacagau

SEQ ID NO: 1348287 - RNA, 23 nt, Homo sapiens
aaauaacagaaagccugggugac

SEQ ID NO: 1348288 - RNA, 20 nt, Homo sapiens
aaauaagauuuaauucacau

SEQ ID NO: 1348289 - RNA, 23 nt, Homo sapiens
aaauacacagugcugaccagaca

SEQ ID NO: 1348290 - RNA, 17 nt, Homo sapiens
aaauacacuugugauua

SEQ ID NO: 1348291 - RNA, 22 nt, Homo sapiens
aaauaccaaaccuucugacuuu

SEQ ID NO: 1348292 - RNA, 18 nt, Homo sapiens
aaauaccacuaguggaaa

SEQ ID NO: 1348293 - RNA, 19 nt, Homo sapiens
aaauacuuuauagcacaug

SEQ ID NO: 1348294 - RNA, 20 nt, Homo sapiens
aaauacuuuauagcacaugg

SEQ ID NO: 1348295 - RNA, 16 nt, Homo sapiens
aaauagcccuguaaca

SEQ ID NO: 1348296 - RNA, 22 nt, Homo sapiens
aaauaguugcugucauccacuu

SEQ ID NO: 1348297 - RNA, 14 nt, Homo sapiens
aaauauaacaggug

SEQ ID NO: 1348298 - RNA, 14 nt, Homo sapiens
aaauauaauugaca

SEQ ID NO: 1348299 - RNA, 16 nt, Homo sapiens
aaauauuuagauguaa

SEQ ID NO: 1348300 - RNA, 11 nt, Homo sapiens
aaaucaaggau

SEQ ID NO: 1348301 - RNA, 22 nt, Homo sapiens
aaaucaaucuggugcuaauggu

SEQ ID NO: 1348302 - RNA, 21 nt, Homo sapiens
aaaucacagaugcauauagac

SEQ ID NO: 1348303 - RNA, 13 nt, Homo sapiens
aaaucacuugcca

SEQ ID NO: 1348304 - RNA, 17 nt, Homo sapiens
aaaucagaaaacccacg

SEQ ID NO: 1348305 - RNA, 24 nt, Homo sapiens
aaaucaucaucaugaugaugauaa

SEQ ID NO: 1348306 - RNA, 14 nt, Homo sapiens
aaauccagaacuca

SEQ ID NO: 1348307 - RNA, 16 nt, Homo sapiens
aaauccagaacucaaa

SEQ ID NO: 1348308 - RNA, 14 nt, Homo sapiens
aaaucccucucaca

SEQ ID NO: 1348309 - RNA, 16 nt, Homo sapiens
aaaucuaagugauaua

SEQ ID NO: 1348310 - RNA, 12 nt, Homo sapiens
aaaucugaauaa

SEQ ID NO: 1348311 - RNA, 19 nt, Homo sapiens
aaaucugcuuguauuccaa

SEQ ID NO: 1348312 - RNA, 12 nt, Homo sapiens
aaaucuguaaau

SEQ ID NO: 1348313 - RNA, 20 nt, Homo sapiens
aaaucuuuaagaauaguucu

SEQ ID NO: 1348314 - RNA, 16 nt, Homo sapiens
aaaugaaaucuuccca

SEQ ID NO: 1348315 - RNA, 12 nt, Homo sapiens
aaaugagcauug

SEQ ID NO: 1348316 - RNA, 15 nt, Homo sapiens
aaaugauagacaauu

SEQ ID NO: 1348317 - RNA, 23 nt, Homo sapiens
aaaugcaagccaucucuaauaau

SEQ ID NO: 1348318 - RNA, 22 nt, Homo sapiens
aaaugcauauuugcaaagugua

SEQ ID NO: 1348319 - RNA, 17 nt, Homo sapiens
aaaugcucagaccagcu

SEQ ID NO: 1348320 - RNA, 20 nt, Homo sapiens
aaaugcuggugaaaugcugu

SEQ ID NO: 1348321 - RNA, 23 nt, Homo sapiens
aaaugcuguugguaaagcacaug

SEQ ID NO: 1348322 - RNA, 13 nt, Homo sapiens
aaaugcuuuuccu

SEQ ID NO: 1348323 - RNA, 16 nt, Homo sapiens
aaaugcuuuuccucaa

SEQ ID NO: 1348324 - RNA, 20 nt, Homo sapiens
aaauggcccggacaugucuu

SEQ ID NO: 1348325 - RNA, 23 nt, Homo sapiens
aaauggcccggacaugucuugcu

SEQ ID NO: 1348326 - RNA, 13 nt, Homo sapiens
aaaugguauguca

SEQ ID NO: 1348327 - RNA, 14 nt, Homo sapiens
aaaugugccuucau

SEQ ID NO: 1348328 - RNA, 18 nt, Homo sapiens
aaauuaaacaaauaugca

SEQ ID NO: 1348329 - RNA, 16 nt, Homo sapiens
aaauuaaacauauuca

SEQ ID NO: 1348330 - RNA, 20 nt, Homo sapiens
aaauuaaacauauucaagga

SEQ ID NO: 1348331 - RNA, 19 nt, Homo sapiens
aaauuaucuuuuuucuucc

SEQ ID NO: 1348332 - RNA, 19 nt, Homo sapiens
aaauuccaaugaagccaua

SEQ ID NO: 1348333 - RNA, 18 nt, Homo sapiens
aaauucuaguguccauaa

SEQ ID NO: 1348334 - RNA, 17 nt, Homo sapiens
aaauugcuuacugauau

SEQ ID NO: 1348335 - RNA, 20 nt, Homo sapiens
aaauuggcuaaucaguauac

SEQ ID NO: 1348336 - RNA, 17 nt, Homo sapiens
aaauugggaaaacucca

SEQ ID NO: 1348337 - RNA, 19 nt, Homo sapiens
aacaaagaaauaauggucu

SEQ ID NO: 1348338 - RNA, 23 nt, Homo sapiens
aacaaauaugcaaaccaggauuu

SEQ ID NO: 1348339 - RNA, 16 nt, Homo sapiens
aacaagaaaguggucu

SEQ ID NO: 1348340 - RNA, 17 nt, Homo sapiens
aacaagaagcaauguua

SEQ ID NO: 1348341 - RNA, 22 nt, Homo sapiens
aacaagcauuucccccagggaa

SEQ ID NO: 1348342 - RNA, 15 nt, Homo sapiens
aacacauaguggcuu

SEQ ID NO: 1348343 - RNA, 23 nt, Homo sapiens
aacacauuuccauucauggauau

SEQ ID NO: 1348344 - RNA, 23 nt, Homo sapiens
aacaccagacagacaacacuggg

SEQ ID NO: 1348345 - RNA, 19 nt, Homo sapiens
aacaccgcuucugccuuuu

SEQ ID NO: 1348346 - RNA, 16 nt, Homo sapiens
aacacuuugagcauuu

SEQ ID NO: 1348347 - RNA, 13 nt, Homo sapiens
aacagacaauauu

SEQ ID NO: 1348348 - RNA, 20 nt, Homo sapiens
aacagaguaacugaccuuca

SEQ ID NO: 1348349 - RNA, 14 nt, Homo sapiens
aacagaguccaauu

SEQ ID NO: 1348350 - RNA, 13 nt, Homo sapiens
aacagaucuggaa

SEQ ID NO: 1348351 - RNA, 14 nt, Homo sapiens
aacagcaccucccc

SEQ ID NO: 1348352 - RNA, 15 nt, Homo sapiens
aacagcaguggagua

SEQ ID NO: 1348353 - RNA, 22 nt, Homo sapiens
aacagcauuacccuccucucuc

SEQ ID NO: 1348354 - RNA, 18 nt, Homo sapiens
aacagcccuccucugcac

SEQ ID NO: 1348355 - RNA, 14 nt, Homo sapiens
aacaggauacaggu

SEQ ID NO: 1348356 - RNA, 20 nt, Homo sapiens
aacaggaucucaaacuugau

SEQ ID NO: 1348357 - RNA, 19 nt, Homo sapiens
aacagucagaaccacuaau

SEQ ID NO: 1348358 - RNA, 23 nt, Homo sapiens
aacauaauaaaucacacauucag

SEQ ID NO: 1348359 - RNA, 16 nt, Homo sapiens
aacauacaugagauaa

SEQ ID NO: 1348360 - RNA, 20 nt, Homo sapiens
aacauagauuuaagugaaua

SEQ ID NO: 1348361 - RNA, 14 nt, Homo sapiens
aacauauuauuuca

SEQ ID NO: 1348362 - RNA, 18 nt, Homo sapiens
aacaucauggacugagcu

SEQ ID NO: 1348363 - RNA, 18 nt, Homo sapiens
aacaucccaauucuuuag

SEQ ID NO: 1348364 - RNA, 15 nt, Homo sapiens
aacaugaaaacaauu

SEQ ID NO: 1348365 - RNA, 15 nt, Homo sapiens
aacaugaaaugcccu

SEQ ID NO: 1348366 - RNA, 16 nt, Homo sapiens
aacaugcuugcauuau

SEQ ID NO: 1348367 - RNA, 16 nt, Homo sapiens
aacauguaauugcaga

SEQ ID NO: 1348368 - RNA, 19 nt, Homo sapiens
aaccaaguggcucccacac

SEQ ID NO: 1348369 - RNA, 16 nt, Homo sapiens
aaccacauucagggaa

SEQ ID NO: 1348370 - RNA, 21 nt, Homo sapiens
aaccacgaaugagguaggcac

SEQ ID NO: 1348371 - RNA, 13 nt, Homo sapiens
aaccagagaggcu

SEQ ID NO: 1348372 - RNA, 23 nt, Homo sapiens
aaccagcuucugauaaacacaau

SEQ ID NO: 1348373 - RNA, 19 nt, Homo sapiens
aaccaggauuuccuugacu

SEQ ID NO: 1348374 - RNA, 13 nt, Homo sapiens
aaccauagcauua

SEQ ID NO: 1348375 - RNA, 20 nt, Homo sapiens
aacccaacuaaagugcuuga

SEQ ID NO: 1348376 - RNA, 21 nt, Homo sapiens
aacccacucaugacugcauga

SEQ ID NO: 1348377 - RNA, 18 nt, Homo sapiens
aacccagcucacaggagc

SEQ ID NO: 1348378 - RNA, 18 nt, Homo sapiens
aaccccugaccuacccca

SEQ ID NO: 1348379 - RNA, 14 nt, Homo sapiens
aaccccuucuuuac

SEQ ID NO: 1348380 - RNA, 20 nt, Homo sapiens
aacccuucagauuugccuua

SEQ ID NO: 1348381 - RNA, 20 nt, Homo sapiens
aaccuaggcaaagaguauau

SEQ ID NO: 1348382 - RNA, 20 nt, Homo sapiens
aaccuauggaaguuguugcu

SEQ ID NO: 1348383 - RNA, 23 nt, Homo sapiens
aaccucccacccugcaaagggaa

SEQ ID NO: 1348384 - RNA, 20 nt, Homo sapiens
aaccuccgccuuccggguuc

SEQ ID NO: 1348385 - RNA, 19 nt, Homo sapiens
aaccucuguggucacccau

SEQ ID NO: 1348386 - RNA, 21 nt, Homo sapiens
aaggaacaaaaauuacaaaga

SEQ ID NO: 1348387 - RNA, 14 nt, Homo sapiens
aaggaacucugcag

SEQ ID NO: 1348388 - RNA, 15 nt, Homo sapiens
aaggaacucugcagu

SEQ ID NO: 1348389 - RNA, 23 nt, Homo sapiens
aaggaagaaaagcugccauuucc

SEQ ID NO: 1348390 - RNA, 18 nt, Homo sapiens
aaggacacuagaagauuu

SEQ ID NO: 1348391 - RNA, 16 nt, Homo sapiens
aaggacgccuccaagc

SEQ ID NO: 1348392 - RNA, 20 nt, Homo sapiens
aaggacuuccuguccagcuc

SEQ ID NO: 1348393 - RNA, 14 nt, Homo sapiens
aaggagagcauagg

SEQ ID NO: 1348394 - RNA, 18 nt, Homo sapiens
aaggaggcccuugcuugg

SEQ ID NO: 1348395 - RNA, 20 nt, Homo sapiens
aaggagggcagaucacuuca

SEQ ID NO: 1348396 - RNA, 21 nt, Homo sapiens
aaggaugcggcaggugcucug

SEQ ID NO: 1348397 - RNA, 18 nt, Homo sapiens
aaggauuugaaccaugaa

SEQ ID NO: 1348398 - RNA, 14 nt, Homo sapiens
aaggcaaaugaugc

SEQ ID NO: 1348399 - RNA, 19 nt, Homo sapiens
aaggcaggaggaucacuug

SEQ ID NO: 1348400 - RNA, 20 nt, Homo sapiens
aaggcagggcaagaacagaa

SEQ ID NO: 1348401 - RNA, 18 nt, Homo sapiens
aaggcccugcccugccca

SEQ ID NO: 1348402 - RNA, 23 nt, Homo sapiens
aaggcucagacugggcacugggg

SEQ ID NO: 1348403 - RNA, 22 nt, Homo sapiens
aaggcugacagacucacuggga

SEQ ID NO: 1348404 - RNA, 21 nt, Homo sapiens
aagggagaacuugaaacagau

SEQ ID NO: 1348405 - RNA, 20 nt, Homo sapiens
aagggauggacaucuuguca

SEQ ID NO: 1348406 - RNA, 22 nt, Homo sapiens
aagggauggacaucuugucauu

SEQ ID NO: 1348407 - RNA, 14 nt, Homo sapiens
aagggauggcaaga

SEQ ID NO: 1348408 - RNA, 22 nt, Homo sapiens
aagggauuguagauaacacuga

SEQ ID NO: 1348409 - RNA, 18 nt, Homo sapiens
aagggggcugcugcuccu

SEQ ID NO: 1348410 - RNA, 18 nt, Homo sapiens
aagggguagaaguggcau

SEQ ID NO: 1348411 - RNA, 21 nt, Homo sapiens
aagggugccuaguugacuuac

SEQ ID NO: 1348412 - RNA, 14 nt, Homo sapiens
aagguaacuguaca

SEQ ID NO: 1348413 - RNA, 14 nt, Homo sapiens
aaggucaaaacuga

SEQ ID NO: 1348414 - RNA, 16 nt, Homo sapiens
aaggucaaaacugaag

SEQ ID NO: 1348415 - RNA, 19 nt, Homo sapiens
aaggucaagaacacaguga

SEQ ID NO: 1348416 - RNA, 21 nt, Homo sapiens
aaggucauaagggagcaugau

SEQ ID NO: 1348417 - RNA, 19 nt, Homo sapiens
aaggucuguggugcagugu

SEQ ID NO: 1348418 - RNA, 14 nt, Homo sapiens
aaggugaaccaaag

SEQ ID NO: 1348419 - RNA, 13 nt, Homo sapiens
aaguaaaaccaca

SEQ ID NO: 1348420 - RNA, 16 nt, Homo sapiens
aaguaaauuaggcagu

SEQ ID NO: 1348421 - RNA, 24 nt, Homo sapiens
aaguaagccuuuuugucaccucaa

SEQ ID NO: 1348422 - RNA, 15 nt, Homo sapiens
aaguaaggcaugguu

SEQ ID NO: 1348423 - RNA, 18 nt, Homo sapiens
aaguaagugaacuaccau

SEQ ID NO: 1348424 - RNA, 17 nt, Homo sapiens
aaguacuaucuuugugu

SEQ ID NO: 1348425 - RNA, 23 nt, Homo sapiens
aaguagaaguuacuuaauugcca

SEQ ID NO: 1348426 - RNA, 15 nt, Homo sapiens
aaguagaauaguggu

SEQ ID NO: 1348427 - RNA, 15 nt, Homo sapiens
aaguauuggcauuca

SEQ ID NO: 1348428 - RNA, 10 nt, Homo sapiens
aaguauuuaa

SEQ ID NO: 1348429 - RNA, 22 nt, Homo sapiens
aaguauuugcuuaaaauuguga

SEQ ID NO: 1348430 - RNA, 18 nt, Homo sapiens
aagucccuucaauuucua

SEQ ID NO: 1348431 - RNA, 17 nt, Homo sapiens
aagucccuuugugacuu

SEQ ID NO: 1348432 - RNA, 16 nt, Homo sapiens
aagucugagcccauuu

SEQ ID NO: 1348433 - RNA, 20 nt, Homo sapiens
aagucuuaaucauuugugac

SEQ ID NO: 1348434 - RNA, 22 nt, Homo sapiens
aagucuugccuugcugaacucc

SEQ ID NO: 1348435 - RNA, 22 nt, Homo sapiens
aagugaaaagcaggcaaaagac

SEQ ID NO: 1348436 - RNA, 16 nt, Homo sapiens
aagugacaugcauuca

SEQ ID NO: 1348437 - RNA, 23 nt, Homo sapiens
aagugauccucacgccuuggccu

SEQ ID NO: 1348438 - RNA, 13 nt, Homo sapiens
aagugcacuuuaa

SEQ ID NO: 1348439 - RNA, 12 nt, Homo sapiens
aagugcagucag

SEQ ID NO: 1348440 - RNA, 15 nt, Homo sapiens
aaguuaaaagcacaa

SEQ ID NO: 1348441 - RNA, 16 nt, Homo sapiens
aaguuauuuaugcuau

SEQ ID NO: 1348442 - RNA, 17 nt, Homo sapiens
aaguuauuucaugcgca

SEQ ID NO: 1348443 - RNA, 20 nt, Homo sapiens
aaguuccaaaauaaagcaua

SEQ ID NO: 1348444 - RNA, 21 nt, Homo sapiens
aaguucuauuuauuugugaga

SEQ ID NO: 1348445 - RNA, 20 nt, Homo sapiens
aaguuguugcuauacauguu

SEQ ID NO: 1348446 - RNA, 18 nt, Homo sapiens
aaguuuuccaguauugaa

SEQ ID NO: 1348447 - RNA, 12 nt, Homo sapiens
aauaaaccaaau

SEQ ID NO: 1348448 - RNA, 13 nt, Homo sapiens
aauaaaccaaaua

SEQ ID NO: 1348449 - RNA, 15 nt, Homo sapiens
aauaaacccuuccug

SEQ ID NO: 1348450 - RNA, 17 nt, Homo sapiens
aauaaacugguaugaau

SEQ ID NO: 1348451 - RNA, 12 nt, Homo sapiens
aauaaacuuaca

SEQ ID NO: 1348452 - RNA, 12 nt, Homo sapiens
aauaaagacagg

SEQ ID NO: 1348453 - RNA, 14 nt, Homo sapiens
aauaaagcauaaaa

SEQ ID NO: 1348454 - RNA, 17 nt, Homo sapiens
aauaaauaauucuuccu

SEQ ID NO: 1348455 - RNA, 14 nt, Homo sapiens
aauaaauacugcag

SEQ ID NO: 1348456 - RNA, 16 nt, Homo sapiens
aauaaaugucuugccu

SEQ ID NO: 1348457 - RNA, 22 nt, Homo sapiens
aauaaauuauuuaacuaauuaa

SEQ ID NO: 1348458 - RNA, 20 nt, Homo sapiens
aauaaauuauuuguuacugu

SEQ ID NO: 1348459 - RNA, 15 nt, Homo sapiens
aauaacugaaccaaa

SEQ ID NO: 1348460 - RNA, 16 nt, Homo sapiens
aauaacugaaccaaau

SEQ ID NO: 1348461 - RNA, 12 nt, Homo sapiens
aauaagauuuaa

SEQ ID NO: 1348462 - RNA, 12 nt, Homo sapiens
aauaagugccag

SEQ ID NO: 1348463 - RNA, 21 nt, Homo sapiens
aauaauaaagaauagcuuuaa

SEQ ID NO: 1348464 - RNA, 12 nt, Homo sapiens
aauaaugaagua

SEQ ID NO: 1348465 - RNA, 18 nt, Homo sapiens
aauaauggguuucuuuca

SEQ ID NO: 1348466 - RNA, 21 nt, Homo sapiens
aauacaaucagcccagugcaa

SEQ ID NO: 1348467 - RNA, 22 nt, Homo sapiens
aauacaaucagcccagugcaaa

SEQ ID NO: 1348468 - RNA, 15 nt, Homo sapiens
aauaccuacugcuga

SEQ ID NO: 1348469 - RNA, 17 nt, Homo sapiens
aauacgucgugcucgag

SEQ ID NO: 1348470 - RNA, 20 nt, Homo sapiens
aauacugauguuccuaguga

SEQ ID NO: 1348471 - RNA, 17 nt, Homo sapiens
aauacuuuauagcacau

SEQ ID NO: 1348472 - RNA, 20 nt, Homo sapiens
aauagaauacccuaaaguau

SEQ ID NO: 1348473 - RNA, 22 nt, Homo sapiens
aauagacuuaaaucucauugcu

SEQ ID NO: 1348474 - RNA, 17 nt, Homo sapiens
aauagauugaguuauua

SEQ ID NO: 1348475 - RNA, 13 nt, Homo sapiens
aauagcaguggua

SEQ ID NO: 1348476 - RNA, 14 nt, Homo sapiens
aauaggcaucucca

SEQ ID NO: 1348477 - RNA, 15 nt, Homo sapiens
aauagugaaaugcca

SEQ ID NO: 1348478 - RNA, 19 nt, Homo sapiens
aauauaauagaauacccua

SEQ ID NO: 1348479 - RNA, 21 nt, Homo sapiens
aauauagcuaauaacauguga

SEQ ID NO: 1348480 - RNA, 18 nt, Homo sapiens
aauauaguuuaggaguaa

SEQ ID NO: 1348481 - RNA, 13 nt, Homo sapiens
aauauauaauuga

SEQ ID NO: 1348482 - RNA, 15 nt, Homo sapiens
aauauccauccugaa

SEQ ID NO: 1348483 - RNA, 23 nt, Homo sapiens
aauaucccuuggacauuuuaugu

SEQ ID NO: 1348484 - RNA, 15 nt, Homo sapiens
aauauguauucugua

SEQ ID NO: 1348485 - RNA, 18 nt, Homo sapiens
aauauguuguuuaccuga

SEQ ID NO: 1348486 - RNA, 17 nt, Homo sapiens
aauauuaguuaauggau

SEQ ID NO: 1348487 - RNA, 14 nt, Homo sapiens
aauauuauacuucu

SEQ ID NO: 1348488 - RNA, 19 nt, Homo sapiens
aauauuccuuuauuuugcu

SEQ ID NO: 1348489 - RNA, 14 nt, Homo sapiens
aauauugugcccca

SEQ ID NO: 1348490 - RNA, 20 nt, Homo sapiens
aauauuuaagacacugaaaa

SEQ ID NO: 1348491 - RNA, 15 nt, Homo sapiens
aauauuugcuaugaa

SEQ ID NO: 1348492 - RNA, 19 nt, Homo sapiens
aauauuuuauauuguuaua

SEQ ID NO: 1348493 - RNA, 15 nt, Homo sapiens
aauauuuuaucuuuc

SEQ ID NO: 1348494 - RNA, 19 nt, Homo sapiens
aauauuuuguuuugugcag

SEQ ID NO: 1348495 - RNA, 20 nt, Homo sapiens
aauauuuuucuguaguguga

SEQ ID NO: 1348496 - RNA, 15 nt, Homo sapiens
aaucaaaacucacaa

SEQ ID NO: 1348497 - RNA, 23 nt, Homo sapiens
aaucaaaacucacaagugcucau

SEQ ID NO: 1348498 - RNA, 17 nt, Homo sapiens
aaucaaagaacuucucc

SEQ ID NO: 1348499 - RNA, 20 nt, Homo sapiens
aaucaaauaugcaaagcacu

SEQ ID NO: 1348500 - RNA, 21 nt, Homo sapiens
aaucaagacugcaaacccuuu

SEQ ID NO: 1348501 - RNA, 19 nt, Homo sapiens
aaucacuugccaaaaucca

SEQ ID NO: 1348502 - RNA, 14 nt, Homo sapiens
aaucagcauucuca

SEQ ID NO: 1348503 - RNA, 17 nt, Homo sapiens
aaucagcauucucacuc

SEQ ID NO: 1348504 - RNA, 16 nt, Homo sapiens
aaucagcccagugcaa

SEQ ID NO: 1348505 - RNA, 18 nt, Homo sapiens
aaucagcccagugcaaac

SEQ ID NO: 1348506 - RNA, 19 nt, Homo sapiens
aaucagcuuaaaauccaaa

SEQ ID NO: 1348507 - RNA, 21 nt, Homo sapiens
aaucagcuuaaaauccaaagu

SEQ ID NO: 1348508 - RNA, 13 nt, Homo sapiens
aaucauaaaggau

SEQ ID NO: 1348509 - RNA, 19 nt, Homo sapiens
aaucauauagaccaauuga

SEQ ID NO: 1348510 - RNA, 15 nt, Homo sapiens
aaucauuuuaaauuc

SEQ ID NO: 1348511 - RNA, 23 nt, Homo sapiens
aauccaagaaaauggccagugag

SEQ ID NO: 1348512 - RNA, 17 nt, Homo sapiens
aauccaagcugcucauu

SEQ ID NO: 1348513 - RNA, 20 nt, Homo sapiens
aauccaggcagauccaggac

SEQ ID NO: 1348514 - RNA, 15 nt, Homo sapiens
aauccaguggugggu

SEQ ID NO: 1348515 - RNA, 20 nt, Homo sapiens
aauccauuuacccuacaggu

SEQ ID NO: 1348516 - RNA, 17 nt, Homo sapiens
aauccauuucaggacuc

SEQ ID NO: 1348517 - RNA, 23 nt, Homo sapiens
aaucccagauaugguugcacaaa

SEQ ID NO: 1348518 - RNA, 23 nt, Homo sapiens
ugguacuuagaguuucuguuuga

SEQ ID NO: 1348519 - RNA, 21 nt, Homo sapiens
ugguaguuuuacaguguuucu

SEQ ID NO: 1348520 - RNA, 19 nt, Homo sapiens
ugguaugggggauuucaaa

SEQ ID NO: 1348521 - RNA, 16 nt, Homo sapiens
uguugaggguccucag

SEQ ID NO: 1348522 - RNA, 16 nt, Homo sapiens
uguugauacauuccca

SEQ ID NO: 1348523 - RNA, 20 nt, Homo sapiens
uguugcaaugcaugauacua

SEQ ID NO: 1348524 - RNA, 17 nt, Homo sapiens
uguugcgcucccaccuc

SEQ ID NO: 1348525 - RNA, 17 nt, Homo sapiens
uguuggugugaauuugc

SEQ ID NO: 1348526 - RNA, 16 nt, Homo sapiens
uguuguuggguggcag

SEQ ID NO: 1348527 - RNA, 14 nt, Homo sapiens
uguuguuuaccuga

SEQ ID NO: 1348528 - RNA, 21 nt, Homo sapiens
ccucuauuuuaauuacugcua

SEQ ID NO: 1348529 - RNA, 15 nt, Homo sapiens
ccucucaguacuuug

SEQ ID NO: 1348530 - RNA, 21 nt, Homo sapiens
ccucucaguuguugaaacacu

SEQ ID NO: 1348531 - RNA, 13 nt, Homo sapiens
ccucucaugacuu

SEQ ID NO: 1348532 - RNA, 16 nt, Homo sapiens
ccucucaugacuugca

SEQ ID NO: 1348533 - RNA, 20 nt, Homo sapiens
ccucucugagucaaauccag

SEQ ID NO: 1348534 - RNA, 21 nt, Homo sapiens
ccucugacuuaagcugccuca

SEQ ID NO: 1348535 - RNA, 22 nt, Homo sapiens
ccucugcauggaacagcauuac

SEQ ID NO: 1348536 - RNA, 14 nt, Homo sapiens
ccucugcauuuaca

SEQ ID NO: 1348537 - RNA, 20 nt, Homo sapiens
ccucugccugggcucuggaa

SEQ ID NO: 1348538 - RNA, 23 nt, Homo sapiens
ccucuggacuggaaagcacaaga

SEQ ID NO: 1348539 - RNA, 15 nt, Homo sapiens
ccucuggagaaggcc

SEQ ID NO: 1348540 - RNA, 14 nt, Homo sapiens
ccucuguccaggca

SEQ ID NO: 1348541 - RNA, 17 nt, Homo sapiens
ccucugugccuugccac

SEQ ID NO: 1348542 - RNA, 15 nt, Homo sapiens
ccucuucugcucuuu

SEQ ID NO: 1348543 - RNA, 22 nt, Homo sapiens
ccucuuggccacagaggacuca

SEQ ID NO: 1348544 - RNA, 14 nt, Homo sapiens
ccugaaagccacag

SEQ ID NO: 1348545 - RNA, 16 nt, Homo sapiens
ccugaaauuaacucag

SEQ ID NO: 1348546 - RNA, 23 nt, Homo sapiens
ccugacaauuugugauaucuaau

SEQ ID NO: 1348547 - RNA, 17 nt, Homo sapiens
ccugacacggacugugc

SEQ ID NO: 1348548 - RNA, 16 nt, Homo sapiens
ccugacagggccagug

SEQ ID NO: 1348549 - RNA, 19 nt, Homo sapiens
ccugacauucacacagaga

SEQ ID NO: 1348550 - RNA, 15 nt, Homo sapiens
ccugaccaacaggcc

SEQ ID NO: 1348551 - RNA, 16 nt, Homo sapiens
ccugaccuaccccagc

SEQ ID NO: 1348552 - RNA, 21 nt, Homo sapiens
ccugacuguauacagaaugaa

SEQ ID NO: 1348553 - RNA, 21 nt, Homo sapiens
ccugaguagcugggaugacag

SEQ ID NO: 1348554 - RNA, 14 nt, Homo sapiens
ccugagucccuuaa

SEQ ID NO: 1348555 - RNA, 19 nt, Homo sapiens
ccugauuuaggagaagcca

SEQ ID NO: 1348556 - RNA, 20 nt, Homo sapiens
ccugauuuccauuugcaaca

SEQ ID NO: 1348557 - RNA, 13 nt, Homo sapiens
ccugcaaaaucug

SEQ ID NO: 1348558 - RNA, 23 nt, Homo sapiens
ccugcaaagggaaucucuugccu

SEQ ID NO: 1348559 - RNA, 18 nt, Homo sapiens
ccugcaauguggugacac

SEQ ID NO: 1348560 - RNA, 23 nt, Homo sapiens
ccugccaggcccuuugcacugag

SEQ ID NO: 1348561 - RNA, 20 nt, Homo sapiens
ccugccccaccccauccagc

SEQ ID NO: 1348562 - RNA, 18 nt, Homo sapiens
ccugccugucugaagcca

SEQ ID NO: 1348563 - RNA, 22 nt, Homo sapiens
ccugccuuuuaacguagauaua

SEQ ID NO: 1348564 - RNA, 15 nt, Homo sapiens
gacuuuaaaccaccu

SEQ ID NO: 1348565 - RNA, 16 nt, Homo sapiens
gacuuuaaaccaccua

SEQ ID NO: 1348566 - RNA, 22 nt, Homo sapiens
gacuuuccagaaugaccuugag

SEQ ID NO: 1348567 - RNA, 20 nt, Homo sapiens
gacuuucucuucuacacagc

SEQ ID NO: 1348568 - RNA, 11 nt, Homo sapiens
gagaaaaccuu

SEQ ID NO: 1348569 - RNA, 15 nt, Homo sapiens
gagaaacccagagau

SEQ ID NO: 1348570 - RNA, 15 nt, Homo sapiens
gagaaagacuauuca

SEQ ID NO: 1348571 - RNA, 21 nt, Homo sapiens
gagaaaguggaaaaugaccuc

SEQ ID NO: 1348572 - RNA, 21 nt, Homo sapiens
gagaagccagcuuuccucauc

SEQ ID NO: 1348573 - RNA, 20 nt, Homo sapiens
gagaagccaggaauuuccca

SEQ ID NO: 1348574 - RNA, 16 nt, Homo sapiens
gagaaguacuaucuuu

SEQ ID NO: 1348575 - RNA, 18 nt, Homo sapiens
gagaauggcauggcagga

SEQ ID NO: 1348576 - RNA, 19 nt, Homo sapiens
gagaaugugagaagccagc

SEQ ID NO: 1348577 - RNA, 13 nt, Homo sapiens
gagaauuaucuca

SEQ ID NO: 1348578 - RNA, 21 nt, Homo sapiens
gagacacccucuggggguccu

SEQ ID NO: 1348579 - RNA, 17 nt, Homo sapiens
gagacccaagcugccuc

SEQ ID NO: 1348580 - RNA, 17 nt, Homo sapiens
gagacugaccaucaugc

SEQ ID NO: 1348581 - RNA, 22 nt, Homo sapiens
gagacuucucccauagcaaaga

SEQ ID NO: 1348582 - RNA, 14 nt, Homo sapiens
gagagagugccaug

SEQ ID NO: 1348583 - RNA, 14 nt, Homo sapiens
gagagagugcuauu

SEQ ID NO: 1348584 - RNA, 19 nt, Homo sapiens
gagaggccacagugcaauu

SEQ ID NO: 1348585 - RNA, 11 nt, Homo sapiens
gagaguacucu

SEQ ID NO: 1348586 - RNA, 16 nt, Homo sapiens
gagauaggaaacugaa

SEQ ID NO: 1348587 - RNA, 21 nt, Homo sapiens
gagaucuuucuuuccaaaaca

SEQ ID NO: 1348588 - RNA, 19 nt, Homo sapiens
gagaugaccucuaacugau

SEQ ID NO: 1348589 - RNA, 13 nt, Homo sapiens
gagaugacucugu

SEQ ID NO: 1348590 - RNA, 21 nt, Homo sapiens
gagaugcaggauuucuucaca

SEQ ID NO: 1348591 - RNA, 21 nt, Homo sapiens
gagauugcgccauugcacucc

SEQ ID NO: 1348592 - RNA, 20 nt, Homo sapiens
gagcaaacucugcugucuaa

SEQ ID NO: 1348593 - RNA, 18 nt, Homo sapiens
gagcaaauguggcuccug

SEQ ID NO: 1348594 - RNA, 15 nt, Homo sapiens
gagcaagaaaugaac

SEQ ID NO: 1348595 - RNA, 20 nt, Homo sapiens
gagcacacccgugugcacac

SEQ ID NO: 1348596 - RNA, 16 nt, Homo sapiens
gagcacccuacaggga

SEQ ID NO: 1348597 - RNA, 18 nt, Homo sapiens
gagcacucauuccuuccc

SEQ ID NO: 1348598 - RNA, 17 nt, Homo sapiens
gagcaggcuacugucag

SEQ ID NO: 1348599 - RNA, 14 nt, Homo sapiens
gagcaucucaggag

SEQ ID NO: 1348600 - RNA, 14 nt, Homo sapiens
gagcaugcacaugc

SEQ ID NO: 1348601 - RNA, 20 nt, Homo sapiens
gagcauggagacagcaguuu

SEQ ID NO: 1348602 - RNA, 20 nt, Homo sapiens
gagccaccacgccuggcugg

SEQ ID NO: 1348603 - RNA, 20 nt, Homo sapiens
gagccaguccuccacucgac

SEQ ID NO: 1348604 - RNA, 17 nt, Homo sapiens
gagccuagcuccugcca

SEQ ID NO: 1348605 - RNA, 13 nt, Homo sapiens
gagccuccagucc

SEQ ID NO: 1348606 - RNA, 13 nt, Homo sapiens
gagcgagauucca

SEQ ID NO: 1348607 - RNA, 14 nt, Homo sapiens
gagcuaaaacuggc

SEQ ID NO: 1348608 - RNA, 17 nt, Homo sapiens
gagcuccuuagccuuug

SEQ ID NO: 1348609 - RNA, 14 nt, Homo sapiens
gagcugagcuggaa

SEQ ID NO: 1348610 - RNA, 16 nt, Homo sapiens
gagcuggggaucccuc

SEQ ID NO: 1348611 - RNA, 12 nt, Homo sapiens
gagcuucugggg

SEQ ID NO: 1348612 - RNA, 20 nt, Homo sapiens
gagcuuuuaaaaauguccug

SEQ ID NO: 1348613 - RNA, 16 nt, Homo sapiens
gaggagccaccaguuc

SEQ ID NO: 1348614 - RNA, 20 nt, Homo sapiens
gaggcaggagaaucacuuga

SEQ ID NO: 1348615 - RNA, 16 nt, Homo sapiens
gaggcgcacaguguga

SEQ ID NO: 1348616 - RNA, 13 nt, Homo sapiens
gaggcuaccucac

SEQ ID NO: 1348617 - RNA, 22 nt, Homo sapiens
gaggcuauggaggguccuccuc

SEQ ID NO: 1348618 - RNA, 20 nt, Homo sapiens
gaggcucccacuucuuggga

SEQ ID NO: 1348619 - RNA, 17 nt, Homo sapiens
gagggacaggcacucca

SEQ ID NO: 1348620 - RNA, 21 nt, Homo sapiens
gagggagcgacacuugaaugu

SEQ ID NO: 1348621 - RNA, 16 nt, Homo sapiens
gagggaggagaaugag

SEQ ID NO: 1348622 - RNA, 20 nt, Homo sapiens
gagggagggcugacccagau

SEQ ID NO: 1348623 - RNA, 11 nt, Homo sapiens
gagggcagcug

SEQ ID NO: 1348624 - RNA, 22 nt, Homo sapiens
gagggcgaccccgucacagccu

SEQ ID NO: 1348625 - RNA, 21 nt, Homo sapiens
gaggggcagcgcaugugugca

SEQ ID NO: 1348626 - RNA, 12 nt, Homo sapiens
gaggguacuuga

SEQ ID NO: 1348627 - RNA, 23 nt, Homo sapiens
gaggguccucaguccacugcuga

SEQ ID NO: 1348628 - RNA, 18 nt, Homo sapiens
gagggugauggaacaaga

SEQ ID NO: 1348629 - RNA, 18 nt, Homo sapiens
gagguaggcacaaauaca

SEQ ID NO: 1348630 - RNA, 20 nt, Homo sapiens
gagguaggcacaaauacauu

SEQ ID NO: 1348631 - RNA, 22 nt, Homo sapiens
gagguggaaguggagcccagug

SEQ ID NO: 1348632 - RNA, 20 nt, Homo sapiens
gaggugugacuaacuaugca

SEQ ID NO: 1348633 - RNA, 14 nt, Homo sapiens
gagguuaggaguag

SEQ ID NO: 1348634 - RNA, 13 nt, Homo sapiens
gagguugcaguga

SEQ ID NO: 1348635 - RNA, 22 nt, Homo sapiens
gaguaggugggggaacacugag

SEQ ID NO: 1348636 - RNA, 23 nt, Homo sapiens
gaguaggugggggaacacugaga

SEQ ID NO: 1348637 - RNA, 14 nt, Homo sapiens
gaguauccuuguag

SEQ ID NO: 1348638 - RNA, 22 nt, Homo sapiens
gagucagaucuuucuccuugaa

SEQ ID NO: 1348639 - RNA, 23 nt, Homo sapiens
gaguccacucccagugcuugcaa

SEQ ID NO: 1348640 - RNA, 17 nt, Homo sapiens
gaguccaggaguuugag

SEQ ID NO: 1348641 - RNA, 21 nt, Homo sapiens
gagucgcacauguauugcugu

SEQ ID NO: 1348642 - RNA, 14 nt, Homo sapiens
gagucgcugugcca

SEQ ID NO: 1348643 - RNA, 16 nt, Homo sapiens
gagucgcugugccaca

SEQ ID NO: 1348644 - RNA, 15 nt, Homo sapiens
gagucucugccaguu

SEQ ID NO: 1348645 - RNA, 18 nt, Homo sapiens
gagucuucacuaaccuuu

SEQ ID NO: 1348646 - RNA, 20 nt, Homo sapiens
gagucuuguuuuuuacucaa

SEQ ID NO: 1348647 - RNA, 18 nt, Homo sapiens
gagugaaacauugaacuc

SEQ ID NO: 1348648 - RNA, 19 nt, Homo sapiens
gagugcaauggugugaucu

SEQ ID NO: 1348649 - RNA, 14 nt, Homo sapiens
gagugcucugaaga

SEQ ID NO: 1348650 - RNA, 22 nt, Homo sapiens
gagugggccccgggcuggagaa

SEQ ID NO: 1348651 - RNA, 17 nt, Homo sapiens
gaguggucacugucagu

SEQ ID NO: 1348652 - RNA, 13 nt, Homo sapiens
gaguguagcugua

SEQ ID NO: 1348653 - RNA, 21 nt, Homo sapiens
gaguuauuuuuauuuauuuaa

SEQ ID NO: 1348654 - RNA, 13 nt, Homo sapiens
gaguugaucugga

SEQ ID NO: 1348655 - RNA, 21 nt, Homo sapiens
gaguugcagccagggccagug

SEQ ID NO: 1348656 - RNA, 23 nt, Homo sapiens
gaguuuuuaguggaagcuucuaa

SEQ ID NO: 1348657 - RNA, 23 nt, Homo sapiens
gauaaacugauuuaucuauuuaa

SEQ ID NO: 1348658 - RNA, 16 nt, Homo sapiens
gauaaaugauagacaa

SEQ ID NO: 1348659 - RNA, 13 nt, Homo sapiens
gauaaauuguaua

SEQ ID NO: 1348660 - RNA, 13 nt, Homo sapiens
gauaacacugacu

SEQ ID NO: 1348661 - RNA, 12 nt, Homo sapiens
gauaauucucag

SEQ ID NO: 1348662 - RNA, 13 nt, Homo sapiens
gauacaguauuau

SEQ ID NO: 1348663 - RNA, 22 nt, Homo sapiens
gauaccauucuauucuccagac

SEQ ID NO: 1348664 - RNA, 19 nt, Homo sapiens
gauacccaaaggucaagaa

SEQ ID NO: 1348665 - RNA, 22 nt, Homo sapiens
gauacuugaaggucuaggugcu

SEQ ID NO: 1348666 - RNA, 14 nt, Homo sapiens
gauagaugcuggcc

SEQ ID NO: 1348667 - RNA, 14 nt, Homo sapiens
gauagcaaacucca

SEQ ID NO: 1348668 - RNA, 17 nt, Homo sapiens
gauagcaaauggccuca

SEQ ID NO: 1348669 - RNA, 18 nt, Homo sapiens
gauagcaaauggccucau

SEQ ID NO: 1348670 - RNA, 21 nt, Homo sapiens
gauagcuucaccccaauccca

SEQ ID NO: 1348671 - RNA, 17 nt, Homo sapiens
gauauauuuaagccuua

SEQ ID NO: 1348672 - RNA, 15 nt, Homo sapiens
gauaugaaggauuac

SEQ ID NO: 1348673 - RNA, 23 nt, Homo sapiens
gauaugccaccagcgaacucuca

SEQ ID NO: 1348674 - RNA, 17 nt, Homo sapiens
gauauuuucacacuggu

SEQ ID NO: 1348675 - RNA, 15 nt, Homo sapiens
gaucacuccagugca

SEQ ID NO: 1348676 - RNA, 19 nt, Homo sapiens
gaucauagcucauugcaag

SEQ ID NO: 1348677 - RNA, 23 nt, Homo sapiens
gaucauuaucagccugugccacg

SEQ ID NO: 1348678 - RNA, 13 nt, Homo sapiens
gaucauugugaag

SEQ ID NO: 1348679 - RNA, 14 nt, Homo sapiens
gaucugcugcugag

SEQ ID NO: 1348680 - RNA, 15 nt, Homo sapiens
gaucuguaacagggu

SEQ ID NO: 1348681 - RNA, 14 nt, Homo sapiens
gaucuguccaccuc

SEQ ID NO: 1348682 - RNA, 16 nt, Homo sapiens
gaucuugagaaccuuu

SEQ ID NO: 1348683 - RNA, 18 nt, Homo sapiens
gaucuugcucucggugcu

SEQ ID NO: 1348684 - RNA, 17 nt, Homo sapiens
gaucuuucuuuccaaaa

SEQ ID NO: 1348685 - RNA, 18 nt, Homo sapiens
gaugaaaguacauuggga

SEQ ID NO: 1348686 - RNA, 17 nt, Homo sapiens
gaugaauaaaaugaagg

SEQ ID NO: 1348687 - RNA, 22 nt, Homo sapiens
gaugacgugcuccguagcucug

SEQ ID NO: 1348688 - RNA, 17 nt, Homo sapiens
gaugacuuugagauuau

SEQ ID NO: 1348689 - RNA, 21 nt, Homo sapiens
gaugagcuuugucuacuucaa

SEQ ID NO: 1348690 - RNA, 18 nt, Homo sapiens
gaugaggucaccagggga

SEQ ID NO: 1348691 - RNA, 23 nt, Homo sapiens
gaugcacacacacagaugucuua

SEQ ID NO: 1348692 - RNA, 21 nt, Homo sapiens
gaugcaguucaaaaacaagac

SEQ ID NO: 1348693 - RNA, 20 nt, Homo sapiens
gaugccaaggggcugaguga

SEQ ID NO: 1348694 - RNA, 23 nt, Homo sapiens
gaugcccgcccggggaguuuccg

SEQ ID NO: 1348695 - RNA, 19 nt, Homo sapiens
gaugccuguguacugccuu

SEQ ID NO: 1348696 - RNA, 22 nt, Homo sapiens
gaugccuguuaauuuauaaugu

SEQ ID NO: 1348697 - RNA, 17 nt, Homo sapiens
gaugcggccucagagag

SEQ ID NO: 1348698 - RNA, 21 nt, Homo sapiens
ccagguacaggagaggcagca

SEQ ID NO: 1348699 - RNA, 22 nt, Homo sapiens
ccagguuuaaccguugcgucac

SEQ ID NO: 1348700 - RNA, 14 nt, Homo sapiens
ccaguagaugccac

SEQ ID NO: 1348701 - RNA, 20 nt, Homo sapiens
ccaguauugaaaacuucaaa

SEQ ID NO: 1348702 - RNA, 15 nt, Homo sapiens
ccagucccacacugu

SEQ ID NO: 1348703 - RNA, 18 nt, Homo sapiens
ccagucgaccccaaagga

SEQ ID NO: 1348704 - RNA, 14 nt, Homo sapiens
ccagugacaacauc

SEQ ID NO: 1348705 - RNA, 17 nt, Homo sapiens
ccagugacaaccaaaag

SEQ ID NO: 1348706 - RNA, 15 nt, Homo sapiens
ccagugagacugugu

SEQ ID NO: 1348707 - RNA, 18 nt, Homo sapiens
ccagugucaggguccagg

SEQ ID NO: 1348708 - RNA, 22 nt, Homo sapiens
ccaguguuccugaagcugcugu

SEQ ID NO: 1348709 - RNA, 14 nt, Homo sapiens
ccaguucuuuauaa

SEQ ID NO: 1348710 - RNA, 11 nt, Homo sapiens
ccaguuuauau

SEQ ID NO: 1348711 - RNA, 20 nt, Homo sapiens
ccauaaacgguuccugguga

SEQ ID NO: 1348712 - RNA, 20 nt, Homo sapiens
ccauaaagacaaucacugcc

SEQ ID NO: 1348713 - RNA, 18 nt, Homo sapiens
ccauacaaauuaucuuuu

SEQ ID NO: 1348714 - RNA, 14 nt, Homo sapiens
ccauaggugcaguu

SEQ ID NO: 1348715 - RNA, 19 nt, Homo sapiens
ccauaucccuuccucucag

SEQ ID NO: 1348716 - RNA, 16 nt, Homo sapiens
ccaucucacugcagua

SEQ ID NO: 1348717 - RNA, 15 nt, Homo sapiens
ccaucuguuugauac

SEQ ID NO: 1348718 - RNA, 23 nt, Homo sapiens
ccaucuguuugauacaguauuau

SEQ ID NO: 1348719 - RNA, 17 nt, Homo sapiens
ccaugaacaucauggac

SEQ ID NO: 1348720 - RNA, 15 nt, Homo sapiens
ccaugagugugccac

SEQ ID NO: 1348721 - RNA, 21 nt, Homo sapiens
ccaugaugugaagaguuucac

SEQ ID NO: 1348722 - RNA, 17 nt, Homo sapiens
ccaugcguccuggucaa

SEQ ID NO: 1348723 - RNA, 13 nt, Homo sapiens
ccaugcugugcug

SEQ ID NO: 1348724 - RNA, 22 nt, Homo sapiens
ccauggaaggaagaaaagcugc

SEQ ID NO: 1348725 - RNA, 21 nt, Homo sapiens
ccauggugaaaggguuugaua

SEQ ID NO: 1348726 - RNA, 19 nt, Homo sapiens
ccaugucgccucugcauuc

SEQ ID NO: 1348727 - RNA, 15 nt, Homo sapiens
ccaugucugcauuuc

SEQ ID NO: 1348728 - RNA, 15 nt, Homo sapiens
ccauguggccauuaa

SEQ ID NO: 1348729 - RNA, 16 nt, Homo sapiens
ccaugugucuuuacac

SEQ ID NO: 1348730 - RNA, 19 nt, Homo sapiens
ccauuaacaaugaccuuua

SEQ ID NO: 1348731 - RNA, 17 nt, Homo sapiens
ccauuaggucacuuaag

SEQ ID NO: 1348732 - RNA, 19 nt, Homo sapiens
ccauuauauuuauuguuua

SEQ ID NO: 1348733 - RNA, 17 nt, Homo sapiens
ccauuccagacugcuuc

SEQ ID NO: 1348734 - RNA, 23 nt, Homo sapiens
ccauucccaagggagacugacca

SEQ ID NO: 1348735 - RNA, 15 nt, Homo sapiens
ccauuucauugcuca

SEQ ID NO: 1348736 - RNA, 23 nt, Homo sapiens
ccauuuccaaaccuccacugcug

SEQ ID NO: 1348737 - RNA, 21 nt, Homo sapiens
ccauuugcuggacaaccaaca

SEQ ID NO: 1348738 - RNA, 14 nt, Homo sapiens
ccauuugugauacu

SEQ ID NO: 1348739 - RNA, 16 nt, Homo sapiens
ccauuugugauacuuc

SEQ ID NO: 1348740 - RNA, 13 nt, Homo sapiens
cccaaacccuuaa

SEQ ID NO: 1348741 - RNA, 22 nt, Homo sapiens
cccaaccucuguggucacccau

SEQ ID NO: 1348742 - RNA, 16 nt, Homo sapiens
cccaaccuucuuguca

SEQ ID NO: 1348743 - RNA, 19 nt, Homo sapiens
cccaaggcugcaaagcaaa

SEQ ID NO: 1348744 - RNA, 21 nt, Homo sapiens
cccaagggagacugaccauca

SEQ ID NO: 1348745 - RNA, 15 nt, Homo sapiens
cccaagucccuguca

SEQ ID NO: 1348746 - RNA, 18 nt, Homo sapiens
cccaaucaccuuuccugu

SEQ ID NO: 1348747 - RNA, 18 nt, Homo sapiens
cccaaucuuucuauauaa

SEQ ID NO: 1348748 - RNA, 19 nt, Homo sapiens
cccaaugacacccaugcca

SEQ ID NO: 1348749 - RNA, 15 nt, Homo sapiens
cccacacuguggcca

SEQ ID NO: 1348750 - RNA, 15 nt, Homo sapiens
cccacagaaccuuca

SEQ ID NO: 1348751 - RNA, 16 nt, Homo sapiens
cccacaggacuuugau

SEQ ID NO: 1348752 - RNA, 17 nt, Homo sapiens
cccacagguguguuucc

SEQ ID NO: 1348753 - RNA, 21 nt, Homo sapiens
cccacauccuucucacugcca

SEQ ID NO: 1348754 - RNA, 17 nt, Homo sapiens
cccacgaccuguccugu

SEQ ID NO: 1348755 - RNA, 23 nt, Homo sapiens
cccacgugggccuuuugcucagu

SEQ ID NO: 1348756 - RNA, 21 nt, Homo sapiens
cccacuagaagcaacuaggaa

SEQ ID NO: 1348757 - RNA, 16 nt, Homo sapiens
aauuuggguucugccu

SEQ ID NO: 1348758 - RNA, 14 nt, Homo sapiens
aauuuguguucuca

SEQ ID NO: 1348759 - RNA, 15 nt, Homo sapiens
aauuuuacacucugu

SEQ ID NO: 1348760 - RNA, 17 nt, Homo sapiens
aauuuucacuucugucu

SEQ ID NO: 1348761 - RNA, 15 nt, Homo sapiens
aauuuucaguucuau

SEQ ID NO: 1348762 - RNA, 19 nt, Homo sapiens
aauuuucaguucuauuuaa

SEQ ID NO: 1348763 - RNA, 22 nt, Homo sapiens
aauuuucccccuuagugaauua

SEQ ID NO: 1348764 - RNA, 12 nt, Homo sapiens
acaaaacaaaca

SEQ ID NO: 1348765 - RNA, 19 nt, Homo sapiens
acaaaaucuuguaggucau

SEQ ID NO: 1348766 - RNA, 12 nt, Homo sapiens
acaaacauuucu

SEQ ID NO: 1348767 - RNA, 21 nt, Homo sapiens
acaaacucagauccuugguac

SEQ ID NO: 1348768 - RNA, 19 nt, Homo sapiens
acaaaggauacuuuuacag

SEQ ID NO: 1348769 - RNA, 21 nt, Homo sapiens
acaaaggauacuuuuacaggu

SEQ ID NO: 1348770 - RNA, 19 nt, Homo sapiens
acaaagggaaaaaagaguu

SEQ ID NO: 1348771 - RNA, 18 nt, Homo sapiens
acaaagggaaagccucug

SEQ ID NO: 1348772 - RNA, 22 nt, Homo sapiens
acaaagggccaucguucaucca

SEQ ID NO: 1348773 - RNA, 16 nt, Homo sapiens
acaaauacauuccuuu

SEQ ID NO: 1348774 - RNA, 22 nt, Homo sapiens
acaaaugagugagagaguucag

SEQ ID NO: 1348775 - RNA, 22 nt, Homo sapiens
acaaaugccuccaaaguauugu

SEQ ID NO: 1348776 - RNA, 18 nt, Homo sapiens
acaacaaauauguucucu

SEQ ID NO: 1348777 - RNA, 17 nt, Homo sapiens
acaacaaccuggucaca

SEQ ID NO: 1348778 - RNA, 13 nt, Homo sapiens
acaacaauguguu

SEQ ID NO: 1348779 - RNA, 18 nt, Homo sapiens
acaacgccgagugcacug

SEQ ID NO: 1348780 - RNA, 16 nt, Homo sapiens
acaacuuaguguaaua

SEQ ID NO: 1348781 - RNA, 17 nt, Homo sapiens
acaagaaaaucaaauau

SEQ ID NO: 1348782 - RNA, 17 nt, Homo sapiens
acaagagaagcugaugg

SEQ ID NO: 1348783 - RNA, 20 nt, Homo sapiens
acaagagcuguuaugcuguu

SEQ ID NO: 1348784 - RNA, 21 nt, Homo sapiens
acaagagcuguuaugcuguuu

SEQ ID NO: 1348785 - RNA, 18 nt, Homo sapiens
acaaggauagaugcuggc

SEQ ID NO: 1348786 - RNA, 14 nt, Homo sapiens
acaaguccagcugg

SEQ ID NO: 1348787 - RNA, 14 nt, Homo sapiens
acaagugaugcuaa

SEQ ID NO: 1348788 - RNA, 12 nt, Homo sapiens
acaagugguggu

SEQ ID NO: 1348789 - RNA, 15 nt, Homo sapiens
acaauaaagaucgcc

SEQ ID NO: 1348790 - RNA, 14 nt, Homo sapiens
acaauaaagcaaua

SEQ ID NO: 1348791 - RNA, 14 nt, Homo sapiens
acaauaguucugug

SEQ ID NO: 1348792 - RNA, 14 nt, Homo sapiens
acaaucacugccaa

SEQ ID NO: 1348793 - RNA, 18 nt, Homo sapiens
acaaucagcccagugcaa

SEQ ID NO: 1348794 - RNA, 15 nt, Homo sapiens
acaaugauacaguug

SEQ ID NO: 1348795 - RNA, 19 nt, Homo sapiens
acaauuccuccucuggcca

SEQ ID NO: 1348796 - RNA, 22 nt, Homo sapiens
acaauugcauucguaaacacca

SEQ ID NO: 1348797 - RNA, 17 nt, Homo sapiens
acaauugucauguaugu

SEQ ID NO: 1348798 - RNA, 19 nt, Homo sapiens
acaauuuaaugcacuaaaa

SEQ ID NO: 1348799 - RNA, 14 nt, Homo sapiens
acacacaauuacua

SEQ ID NO: 1348800 - RNA, 15 nt, Homo sapiens
acacacagaugucuu

SEQ ID NO: 1348801 - RNA, 18 nt, Homo sapiens
acacaggcaaaauccuug

SEQ ID NO: 1348802 - RNA, 15 nt, Homo sapiens
acacaguucugggca

SEQ ID NO: 1348803 - RNA, 17 nt, Homo sapiens
acacauacagagugggc

SEQ ID NO: 1348804 - RNA, 18 nt, Homo sapiens
acacauacauaaugguac

SEQ ID NO: 1348805 - RNA, 10 nt, Homo sapiens
acacauucca

SEQ ID NO: 1348806 - RNA, 20 nt, Homo sapiens
acacauuuccauucauggau

SEQ ID NO: 1348807 - RNA, 19 nt, Homo sapiens
acaccaaguaccaguauaa

SEQ ID NO: 1348808 - RNA, 13 nt, Homo sapiens
acaccaccaacau

SEQ ID NO: 1348809 - RNA, 18 nt, Homo sapiens
acaccaguguuagcuuaa

SEQ ID NO: 1348810 - RNA, 23 nt, Homo sapiens
acacccaaguugaagacuuuguu

SEQ ID NO: 1348811 - RNA, 13 nt, Homo sapiens
acacccaguggga

SEQ ID NO: 1348812 - RNA, 21 nt, Homo sapiens
acacccagugggaagagugug

SEQ ID NO: 1348813 - RNA, 14 nt, Homo sapiens
acacccuggaugcu

SEQ ID NO: 1348814 - RNA, 24 nt, Homo sapiens
acaccucccccuuucacacuggau

SEQ ID NO: 1348815 - RNA, 17 nt, Homo sapiens
acaccuguaaucccagc

SEQ ID NO: 1348816 - RNA, 14 nt, Homo sapiens
acacgcucaguuga

SEQ ID NO: 1348817 - RNA, 15 nt, Homo sapiens
acacggacugugcau

SEQ ID NO: 1348818 - RNA, 17 nt, Homo sapiens
acacuaggaaucaaaac

SEQ ID NO: 1348819 - RNA, 21 nt, Homo sapiens
acacucauggggaagcuucca

SEQ ID NO: 1348820 - RNA, 16 nt, Homo sapiens
acacugaaaugaaauc

SEQ ID NO: 1348821 - RNA, 20 nt, Homo sapiens
acacugaaaugaaaucuucc

SEQ ID NO: 1348822 - RNA, 24 nt, Homo sapiens
acacugaacuccuauuugaccaga

SEQ ID NO: 1348823 - RNA, 23 nt, Homo sapiens
acacugagagggcaaucuuugcc

SEQ ID NO: 1348824 - RNA, 13 nt, Homo sapiens
acacugaugcaag

SEQ ID NO: 1348825 - RNA, 21 nt, Homo sapiens
acacugcacagggaaaauugc

SEQ ID NO: 1348826 - RNA, 16 nt, Homo sapiens
acacuggagccaucuc

SEQ ID NO: 1348827 - RNA, 22 nt, Homo sapiens
acacuguaccgacuuugauaga

SEQ ID NO: 1348828 - RNA, 15 nt, Homo sapiens
acacugucuucugau

SEQ ID NO: 1348829 - RNA, 15 nt, Homo sapiens
acacuuacacuuuau

SEQ ID NO: 1348830 - RNA, 12 nt, Homo sapiens
acacuuugccau

SEQ ID NO: 1348831 - RNA, 12 nt, Homo sapiens
acacuuuugcuu

SEQ ID NO: 1348832 - RNA, 20 nt, Homo sapiens
acacuuuuuggaagugaaaa

SEQ ID NO: 1348833 - RNA, 14 nt, Homo sapiens
acagaaacugaugc

SEQ ID NO: 1348834 - RNA, 15 nt, Homo sapiens
acagaaacugaugcc

SEQ ID NO: 1348835 - RNA, 21 nt, Homo sapiens
acagaaagccugggugacauu

SEQ ID NO: 1348836 - RNA, 19 nt, Homo sapiens
acagagaggggcagggaag

SEQ ID NO: 1348837 - RNA, 20 nt, Homo sapiens
acagagcgagauuccaucuc

SEQ ID NO: 1348838 - RNA, 18 nt, Homo sapiens
acagaggagaagcaaugg

SEQ ID NO: 1348839 - RNA, 14 nt, Homo sapiens
acagaggcagagau

SEQ ID NO: 1348840 - RNA, 21 nt, Homo sapiens
acagagugccaacuucuuuca

SEQ ID NO: 1348841 - RNA, 18 nt, Homo sapiens
acagaucuggaaccucag

SEQ ID NO: 1348842 - RNA, 17 nt, Homo sapiens
acagauucuucacugug

SEQ ID NO: 1348843 - RNA, 18 nt, Homo sapiens
acagauucuucacugugu

SEQ ID NO: 1348844 - RNA, 13 nt, Homo sapiens
acagcaaaggaac

SEQ ID NO: 1348845 - RNA, 23 nt, Homo sapiens
acagcaaauguguguagauuuca

SEQ ID NO: 1348846 - RNA, 20 nt, Homo sapiens
acagcaagggugaugggaaa

SEQ ID NO: 1348847 - RNA, 13 nt, Homo sapiens
acagcaguggagu

SEQ ID NO: 1348848 - RNA, 20 nt, Homo sapiens
acagccagacuggcacaguu

SEQ ID NO: 1348849 - RNA, 23 nt, Homo sapiens
acagccccacccuggugggccaa

SEQ ID NO: 1348850 - RNA, 15 nt, Homo sapiens
acagccuccaaaaau

SEQ ID NO: 1348851 - RNA, 20 nt, Homo sapiens
acagccuccaaaaauggcag

SEQ ID NO: 1348852 - RNA, 18 nt, Homo sapiens
acagccuggcacagggca

SEQ ID NO: 1348853 - RNA, 16 nt, Homo sapiens
acagccuugcaaccca

SEQ ID NO: 1348854 - RNA, 15 nt, Homo sapiens
acagccuuugcccaa

SEQ ID NO: 1348855 - RNA, 23 nt, Homo sapiens
acagccuuugcccaaaacuguca

SEQ ID NO: 1348856 - RNA, 18 nt, Homo sapiens
acagcgcaugcuggugca

SEQ ID NO: 1348857 - RNA, 18 nt, Homo sapiens
acagcucacugcagccuc

SEQ ID NO: 1348858 - RNA, 18 nt, Homo sapiens
acaggagcuuaaacagcu

SEQ ID NO: 1348859 - RNA, 15 nt, Homo sapiens
acaggcaaauguacu

SEQ ID NO: 1348860 - RNA, 18 nt, Homo sapiens
acaggcacacaggucuca

SEQ ID NO: 1348861 - RNA, 16 nt, Homo sapiens
acaggcccuuccucuc

SEQ ID NO: 1348862 - RNA, 14 nt, Homo sapiens
acaggcucugacca

SEQ ID NO: 1348863 - RNA, 20 nt, Homo sapiens
acaggcugagaacucguuca

SEQ ID NO: 1348864 - RNA, 16 nt, Homo sapiens
acaggucacacgaggg

SEQ ID NO: 1348865 - RNA, 16 nt, Homo sapiens
acaggugacagugaag

SEQ ID NO: 1348866 - RNA, 13 nt, Homo sapiens
acaguaacuguga

SEQ ID NO: 1348867 - RNA, 12 nt, Homo sapiens
acaguaccugau

SEQ ID NO: 1348868 - RNA, 13 nt, Homo sapiens
acaguaucugcug

SEQ ID NO: 1348869 - RNA, 16 nt, Homo sapiens
acagugcuauuugcau

SEQ ID NO: 1348870 - RNA, 18 nt, Homo sapiens
acaguggggcugcaggca

SEQ ID NO: 1348871 - RNA, 19 nt, Homo sapiens
acaguguugaaaauguuca

SEQ ID NO: 1348872 - RNA, 21 nt, Homo sapiens
acaguucugacgcugacaaua

SEQ ID NO: 1348873 - RNA, 17 nt, Homo sapiens
acaguucugggcaaaga

SEQ ID NO: 1348874 - RNA, 18 nt, Homo sapiens
acaguugcauguuauauu

SEQ ID NO: 1348875 - RNA, 15 nt, Homo sapiens
acaguuuauugauau

SEQ ID NO: 1348876 - RNA, 12 nt, Homo sapiens
acaguuugauau

SEQ ID NO: 1348877 - RNA, 16 nt, Homo sapiens
acaguuuucugagaaa

SEQ ID NO: 1348878 - RNA, 13 nt, Homo sapiens
acaguuuucuuca

SEQ ID NO: 1348879 - RNA, 17 nt, Homo sapiens
acauacauauuaucuca

SEQ ID NO: 1348880 - RNA, 15 nt, Homo sapiens
acauacauccaacau

SEQ ID NO: 1348881 - RNA, 16 nt, Homo sapiens
acauaccugguuugcu

SEQ ID NO: 1348882 - RNA, 14 nt, Homo sapiens
acauagagccagcu

SEQ ID NO: 1348883 - RNA, 14 nt, Homo sapiens
acauauuaucucau

SEQ ID NO: 1348884 - RNA, 14 nt, Homo sapiens
acauauucaaggag

SEQ ID NO: 1348885 - RNA, 17 nt, Homo sapiens
acaucagcaaacaggau

SEQ ID NO: 1348886 - RNA, 12 nt, Homo sapiens
acaucauggacu

SEQ ID NO: 1348887 - RNA, 19 nt, Homo sapiens
acauccauaacucuguauc

SEQ ID NO: 1348888 - RNA, 15 nt, Homo sapiens
acauccuagcauuug

SEQ ID NO: 1348889 - RNA, 20 nt, Homo sapiens
acauccuuauucagccuuau

SEQ ID NO: 1348890 - RNA, 15 nt, Homo sapiens
agacuaucaguuccc

SEQ ID NO: 1348891 - RNA, 16 nt, Homo sapiens
agacucaaaugcucag

SEQ ID NO: 1348892 - RNA, 13 nt, Homo sapiens
agacuccaaagaa

SEQ ID NO: 1348893 - RNA, 13 nt, Homo sapiens
agacuccucagca

SEQ ID NO: 1348894 - RNA, 17 nt, Homo sapiens
agacugaagauggcuuu

SEQ ID NO: 1348895 - RNA, 12 nt, Homo sapiens
agacugauuucu

SEQ ID NO: 1348896 - RNA, 21 nt, Homo sapiens
agacuucucccauagcaaaga

SEQ ID NO: 1348897 - RNA, 13 nt, Homo sapiens
agacuucuuggcu

SEQ ID NO: 1348898 - RNA, 17 nt, Homo sapiens
agacuuuaaaccaccua

SEQ ID NO: 1348899 - RNA, 17 nt, Homo sapiens
agacuuugauccaugua

SEQ ID NO: 1348900 - RNA, 23 nt, Homo sapiens
agagaacacagugcuauuugcau

SEQ ID NO: 1348901 - RNA, 14 nt, Homo sapiens
agagaaccaaaggg

SEQ ID NO: 1348902 - RNA, 20 nt, Homo sapiens
agagaagauagcagggcaug

SEQ ID NO: 1348903 - RNA, 14 nt, Homo sapiens
agagaaguacuauc

SEQ ID NO: 1348904 - RNA, 15 nt, Homo sapiens
agagaauuaucucaa

SEQ ID NO: 1348905 - RNA, 22 nt, Homo sapiens
agagaucuuucuuuccaaaaca

SEQ ID NO: 1348906 - RNA, 23 nt, Homo sapiens
agagcacuugagaaccagucucc

SEQ ID NO: 1348907 - RNA, 22 nt, Homo sapiens
agagcaugaaaaucacacuguc

SEQ ID NO: 1348908 - RNA, 17 nt, Homo sapiens
agagccaggaugcccag

SEQ ID NO: 1348909 - RNA, 17 nt, Homo sapiens
agagccaggcuguugga

SEQ ID NO: 1348910 - RNA, 17 nt, Homo sapiens
agagcgaggaaaggauu

SEQ ID NO: 1348911 - RNA, 18 nt, Homo sapiens
agagcgaggaaaggauuu

SEQ ID NO: 1348912 - RNA, 22 nt, Homo sapiens
agagcgaucucggcucacugca

SEQ ID NO: 1348913 - RNA, 17 nt, Homo sapiens
agagcugaacuauuaga

SEQ ID NO: 1348914 - RNA, 22 nt, Homo sapiens
agagcuuguaauaaauacugca

SEQ ID NO: 1348915 - RNA, 19 nt, Homo sapiens
agaggaauuuauaccucaa

SEQ ID NO: 1348916 - RNA, 18 nt, Homo sapiens
agaggacucacuugccca

SEQ ID NO: 1348917 - RNA, 14 nt, Homo sapiens
agaggaggggacca

SEQ ID NO: 1348918 - RNA, 15 nt, Homo sapiens
agaggcucugagaaa

SEQ ID NO: 1348919 - RNA, 16 nt, Homo sapiens
agaggcuuucuccagg

SEQ ID NO: 1348920 - RNA, 14 nt, Homo sapiens
agagggaagccaug

SEQ ID NO: 1348921 - RNA, 17 nt, Homo sapiens
agagggggucucagaaa

SEQ ID NO: 1348922 - RNA, 21 nt, Homo sapiens
agagggugauggaacaagaga

SEQ ID NO: 1348923 - RNA, 20 nt, Homo sapiens
agaguacacccuuuccagga

SEQ ID NO: 1348924 - RNA, 16 nt, Homo sapiens
agagucaucuaccuga

SEQ ID NO: 1348925 - RNA, 17 nt, Homo sapiens
agagucgcugugccaca

SEQ ID NO: 1348926 - RNA, 12 nt, Homo sapiens
agagugcaaugg

SEQ ID NO: 1348927 - RNA, 11 nt, Homo sapiens
agagugcagug

SEQ ID NO: 1348928 - RNA, 17 nt, Homo sapiens
agaguggaccccgucau

SEQ ID NO: 1348929 - RNA, 14 nt, Homo sapiens
agaguguagcugua

SEQ ID NO: 1348930 - RNA, 16 nt, Homo sapiens
agaguuuaaacaaaaa

SEQ ID NO: 1348931 - RNA, 18 nt, Homo sapiens
agauaacaaacacugaac

SEQ ID NO: 1348932 - RNA, 13 nt, Homo sapiens
agauaacacugac

SEQ ID NO: 1348933 - RNA, 17 nt, Homo sapiens
agauaacucaagaaauc

SEQ ID NO: 1348934 - RNA, 15 nt, Homo sapiens
agauagaccugacaa

SEQ ID NO: 1348935 - RNA, 20 nt, Homo sapiens
agaucaguauuucacugaua

SEQ ID NO: 1348936 - RNA, 15 nt, Homo sapiens
agaucaugggucaag

SEQ ID NO: 1348937 - RNA, 19 nt, Homo sapiens
agaucaugggucaagagau

SEQ ID NO: 1348938 - RNA, 19 nt, Homo sapiens
agauccccccacaaagugg

SEQ ID NO: 1348939 - RNA, 22 nt, Homo sapiens
agaucucucgaaugcugagaag

SEQ ID NO: 1348940 - RNA, 19 nt, Homo sapiens
agaucuggaaccucagccu

SEQ ID NO: 1348941 - RNA, 14 nt, Homo sapiens
agaugaaugucagu

SEQ ID NO: 1348942 - RNA, 14 nt, Homo sapiens
agaugacaaccucc

SEQ ID NO: 1348943 - RNA, 14 nt, Homo sapiens
agaugagugucugg

SEQ ID NO: 1348944 - RNA, 18 nt, Homo sapiens
agaugcauauagacacac

SEQ ID NO: 1348945 - RNA, 16 nt, Homo sapiens
agaugccagcuucucu

SEQ ID NO: 1348946 - RNA, 23 nt, Homo sapiens
agaugccgcggaaggucccucag

SEQ ID NO: 1348947 - RNA, 18 nt, Homo sapiens
agauggacucaggaucca

SEQ ID NO: 1348948 - RNA, 22 nt, Homo sapiens
agauggacucaggauccaguga

SEQ ID NO: 1348949 - RNA, 17 nt, Homo sapiens
agauggagacacccucu

SEQ ID NO: 1348950 - RNA, 19 nt, Homo sapiens
agauggcagguuugcaauc

SEQ ID NO: 1348951 - RNA, 12 nt, Homo sapiens
agauggccauau

SEQ ID NO: 1348952 - RNA, 16 nt, Homo sapiens
agauggcugugccucu

SEQ ID NO: 1348953 - RNA, 17 nt, Homo sapiens
agauguucccggagcag

SEQ ID NO: 1348954 - RNA, 14 nt, Homo sapiens
agauuauaugaagu

SEQ ID NO: 1348955 - RNA, 22 nt, Homo sapiens
agauucaauuaaguuauuaaca

SEQ ID NO: 1348956 - RNA, 15 nt, Homo sapiens
agauucaugcacugu

SEQ ID NO: 1348957 - RNA, 21 nt, Homo sapiens
agauucccuuccggugcgugu

SEQ ID NO: 1348958 - RNA, 16 nt, Homo sapiens
agauuccuaugaugga

SEQ ID NO: 1348959 - RNA, 18 nt, Homo sapiens
agauugaaccugaauauu

SEQ ID NO: 1348960 - RNA, 18 nt, Homo sapiens
agauuuaaagaaaaccac

SEQ ID NO: 1348961 - RNA, 16 nt, Homo sapiens
agauuugauauuugca

SEQ ID NO: 1348962 - RNA, 20 nt, Homo sapiens
agauuuggaggcuaccucac

SEQ ID NO: 1348963 - RNA, 19 nt, Homo sapiens
agcaaaaucagaaguauau

SEQ ID NO: 1348964 - RNA, 17 nt, Homo sapiens
agcaaauaaagaccuga

SEQ ID NO: 1348965 - RNA, 15 nt, Homo sapiens
agcaaauguggcucc

SEQ ID NO: 1348966 - RNA, 16 nt, Homo sapiens
agcaacagagcacuug

SEQ ID NO: 1348967 - RNA, 20 nt, Homo sapiens
agcaacccuacaguauauaa

SEQ ID NO: 1348968 - RNA, 20 nt, Homo sapiens
agcaacccuuccugcugcug

SEQ ID NO: 1348969 - RNA, 13 nt, Homo sapiens
agcaacuagcugg

SEQ ID NO: 1348970 - RNA, 19 nt, Homo sapiens
agcaagaucccaucucuuu

SEQ ID NO: 1348971 - RNA, 22 nt, Homo sapiens
agcaagcuuugguuuaugguuu

SEQ ID NO: 1348972 - RNA, 22 nt, Homo sapiens
agcaaguguucacaacagugaa

SEQ ID NO: 1348973 - RNA, 14 nt, Homo sapiens
agcaauaacauaca

SEQ ID NO: 1348974 - RNA, 21 nt, Homo sapiens
agcaauaacauacaugagaua

SEQ ID NO: 1348975 - RNA, 18 nt, Homo sapiens
agcaauccuccuaccuca

SEQ ID NO: 1348976 - RNA, 15 nt, Homo sapiens
agcaauggaguggcu

SEQ ID NO: 1348977 - RNA, 19 nt, Homo sapiens
agcaauucuccugccuuag

SEQ ID NO: 1348978 - RNA, 15 nt, Homo sapiens
agcacacgaaaagac

SEQ ID NO: 1348979 - RNA, 17 nt, Homo sapiens
agcaccacacccagugg

SEQ ID NO: 1348980 - RNA, 20 nt, Homo sapiens
agcaccuccccgcugggaag

SEQ ID NO: 1348981 - RNA, 21 nt, Homo sapiens
agcaccugcgggagcugcacu

SEQ ID NO: 1348982 - RNA, 19 nt, Homo sapiens
agcacgcccuccugggccg

SEQ ID NO: 1348983 - RNA, 21 nt, Homo sapiens
agcacggacugucaguucucu

SEQ ID NO: 1348984 - RNA, 17 nt, Homo sapiens
agcacugaagucaccau

SEQ ID NO: 1348985 - RNA, 19 nt, Homo sapiens
agcacuggugaacugagcu

SEQ ID NO: 1348986 - RNA, 22 nt, Homo sapiens
agcagaaaguaagcauuuccag

SEQ ID NO: 1348987 - RNA, 17 nt, Homo sapiens
agcagacaaaaugaaag

SEQ ID NO: 1348988 - RNA, 12 nt, Homo sapiens
agcagaccuccu

SEQ ID NO: 1348989 - RNA, 17 nt, Homo sapiens
agcagauccucaauaaa

SEQ ID NO: 1348990 - RNA, 18 nt, Homo sapiens
agcagcagaccuccuagc

SEQ ID NO: 1348991 - RNA, 13 nt, Homo sapiens
agcagcagcacca

SEQ ID NO: 1348992 - RNA, 23 nt, Homo sapiens
agcagccagccaacccuuucauu

SEQ ID NO: 1348993 - RNA, 14 nt, Homo sapiens
agcagcgccaguga

SEQ ID NO: 1348994 - RNA, 16 nt, Homo sapiens
agcagcugaugcugua

SEQ ID NO: 1348995 - RNA, 18 nt, Homo sapiens
agcaggagagacugagca

SEQ ID NO: 1348996 - RNA, 18 nt, Homo sapiens
agcaggcaaauagcuuua

SEQ ID NO: 1348997 - RNA, 22 nt, Homo sapiens
agcaggcagcuucuacuccugc

SEQ ID NO: 1348998 - RNA, 16 nt, Homo sapiens
agcaggcuacugucag

SEQ ID NO: 1348999 - RNA, 17 nt, Homo sapiens
agcaggggggcugugcc

SEQ ID NO: 1349000 - RNA, 19 nt, Homo sapiens
agcaggggggcugugccaa

SEQ ID NO: 1349001 - RNA, 15 nt, Homo sapiens
agcagucgccugccu

SEQ ID NO: 1349002 - RNA, 18 nt, Homo sapiens
agcaguuuccucagugau

SEQ ID NO: 1349003 - RNA, 13 nt, Homo sapiens
agcauaguggcaa

SEQ ID NO: 1349004 - RNA, 14 nt, Homo sapiens
agcaucgggagcac

SEQ ID NO: 1349005 - RNA, 22 nt, Homo sapiens
agcaucgggagcacccagagca

SEQ ID NO: 1349006 - RNA, 21 nt, Homo sapiens
agcaucucuggccuguaccca

SEQ ID NO: 1349007 - RNA, 16 nt, Homo sapiens
agcaucuggcucuaau

SEQ ID NO: 1349008 - RNA, 13 nt, Homo sapiens
agcaucuugcauc

SEQ ID NO: 1349009 - RNA, 18 nt, Homo sapiens
agcaucuugcauccaaac

SEQ ID NO: 1349010 - RNA, 22 nt, Homo sapiens
agcaugauaggauuuggggcag

SEQ ID NO: 1349011 - RNA, 12 nt, Homo sapiens
agcaugcacaug

SEQ ID NO: 1349012 - RNA, 21 nt, Homo sapiens
agcaugcugugauugugccua

SEQ ID NO: 1349013 - RNA, 17 nt, Homo sapiens
agcauuguaaaugugcu

SEQ ID NO: 1349014 - RNA, 20 nt, Homo sapiens
agccaacuguuucccugcug

SEQ ID NO: 1349015 - RNA, 18 nt, Homo sapiens
agccaagcuggcacaaaa

SEQ ID NO: 1349016 - RNA, 19 nt, Homo sapiens
agccaaggcagcgacccca

SEQ ID NO: 1349017 - RNA, 20 nt, Homo sapiens
agccaagggauggacaucuu

SEQ ID NO: 1349018 - RNA, 13 nt, Homo sapiens
agccaaugcuguc

SEQ ID NO: 1349019 - RNA, 15 nt, Homo sapiens
agccacaacugcagu

SEQ ID NO: 1349020 - RNA, 12 nt, Homo sapiens
agccacacucug

SEQ ID NO: 1349021 - RNA, 16 nt, Homo sapiens
agccaccaguucucau

SEQ ID NO: 1349022 - RNA, 14 nt, Homo sapiens
auaaagucuugccu

SEQ ID NO: 1349023 - RNA, 13 nt, Homo sapiens
auaaagugacaga

SEQ ID NO: 1349024 - RNA, 19 nt, Homo sapiens
auaaauagugucucuucaa

SEQ ID NO: 1349025 - RNA, 21 nt, Homo sapiens
auaaauauuauuagauuuauu

SEQ ID NO: 1349026 - RNA, 19 nt, Homo sapiens
auaaaugcccaucagauau

SEQ ID NO: 1349027 - RNA, 16 nt, Homo sapiens
auaaaugucuuuccaa

SEQ ID NO: 1349028 - RNA, 23 nt, Homo sapiens
auaaauuucugggauauuuaacu

SEQ ID NO: 1349029 - RNA, 17 nt, Homo sapiens
auaacaagauuuucuua

SEQ ID NO: 1349030 - RNA, 13 nt, Homo sapiens
auaacagguuuaa

SEQ ID NO: 1349031 - RNA, 14 nt, Homo sapiens
auaacagguuuaaa

SEQ ID NO: 1349032 - RNA, 16 nt, Homo sapiens
auaacaguaguguuac

SEQ ID NO: 1349033 - RNA, 22 nt, Homo sapiens
auaacuaggaaauccauucaca

SEQ ID NO: 1349034 - RNA, 16 nt, Homo sapiens
auaacuauuacagugu

SEQ ID NO: 1349035 - RNA, 17 nt, Homo sapiens
auaacuccugucccuuu

SEQ ID NO: 1349036 - RNA, 15 nt, Homo sapiens
auaacucugugaucu

SEQ ID NO: 1349037 - RNA, 14 nt, Homo sapiens
auaacugaaccaaa

SEQ ID NO: 1349038 - RNA, 20 nt, Homo sapiens
auaagaacaaauacaauaca

SEQ ID NO: 1349039 - RNA, 19 nt, Homo sapiens
auaagcaaaaacaaaaaga

SEQ ID NO: 1349040 - RNA, 19 nt, Homo sapiens
auaagcaaaaucagaagua

SEQ ID NO: 1349041 - RNA, 23 nt, Homo sapiens
auaagcagucauccucagaucau

SEQ ID NO: 1349042 - RNA, 14 nt, Homo sapiens
auaagcccaguuca

SEQ ID NO: 1349043 - RNA, 13 nt, Homo sapiens
auaaggcccagag

SEQ ID NO: 1349044 - RNA, 12 nt, Homo sapiens
auaaguuucaua

SEQ ID NO: 1349045 - RNA, 14 nt, Homo sapiens
auaauaaacauaau

SEQ ID NO: 1349046 - RNA, 14 nt, Homo sapiens
auaauaacagcagu

SEQ ID NO: 1349047 - RNA, 17 nt, Homo sapiens
auaauaaugaugaugau

SEQ ID NO: 1349048 - RNA, 18 nt, Homo sapiens
auaaucacaacccuucag

SEQ ID NO: 1349049 - RNA, 24 nt, Homo sapiens
auaaugauuuuuuuacuaaugaua

SEQ ID NO: 1349050 - RNA, 14 nt, Homo sapiens
auaaugucuauaua

SEQ ID NO: 1349051 - RNA, 17 nt, Homo sapiens
auaauguuuugggaaac

SEQ ID NO: 1349052 - RNA, 15 nt, Homo sapiens
auaauucagcacuua

SEQ ID NO: 1349053 - RNA, 22 nt, Homo sapiens
auaauucagcacuuaacuauga

SEQ ID NO: 1349054 - RNA, 16 nt, Homo sapiens
auaauuuaccuaagau

SEQ ID NO: 1349055 - RNA, 18 nt, Homo sapiens
auaauuuauuaacuauuu

SEQ ID NO: 1349056 - RNA, 12 nt, Homo sapiens
auacaaccagcc

SEQ ID NO: 1349057 - RNA, 15 nt, Homo sapiens
auacaagauuauaca

SEQ ID NO: 1349058 - RNA, 18 nt, Homo sapiens
auacaaucagcccagugc

SEQ ID NO: 1349059 - RNA, 21 nt, Homo sapiens
auacaaucagcccagugcaaa

SEQ ID NO: 1349060 - RNA, 19 nt, Homo sapiens
auacaauuaugaagauuua

SEQ ID NO: 1349061 - RNA, 13 nt, Homo sapiens
auacaauugucau

SEQ ID NO: 1349062 - RNA, 16 nt, Homo sapiens
auacacacgcugccuu

SEQ ID NO: 1349063 - RNA, 15 nt, Homo sapiens
auacacagugcugac

SEQ ID NO: 1349064 - RNA, 15 nt, Homo sapiens
auacacaugugcaca

SEQ ID NO: 1349065 - RNA, 14 nt, Homo sapiens
auacacuaaccaaa

SEQ ID NO: 1349066 - RNA, 15 nt, Homo sapiens
auacacuuacacuuu

SEQ ID NO: 1349067 - RNA, 21 nt, Homo sapiens
auacaguagcuugaaauugau

SEQ ID NO: 1349068 - RNA, 12 nt, Homo sapiens
auacaguauuau

SEQ ID NO: 1349069 - RNA, 16 nt, Homo sapiens
auacaguguacucuua

SEQ ID NO: 1349070 - RNA, 17 nt, Homo sapiens
auacauaggaugacaaa

SEQ ID NO: 1349071 - RNA, 15 nt, Homo sapiens
auacauauuaucuca

SEQ ID NO: 1349072 - RNA, 17 nt, Homo sapiens
auacauauuaucucauu

SEQ ID NO: 1349073 - RNA, 13 nt, Homo sapiens
auacaucccucag

SEQ ID NO: 1349074 - RNA, 13 nt, Homo sapiens
auacaugcauaua

SEQ ID NO: 1349075 - RNA, 15 nt, Homo sapiens
auacauuugauaaag

SEQ ID NO: 1349076 - RNA, 22 nt, Homo sapiens
auaccaaccugaagacaccguu

SEQ ID NO: 1349077 - RNA, 13 nt, Homo sapiens
auaccacaugauu

SEQ ID NO: 1349078 - RNA, 18 nt, Homo sapiens
auaccaggcagugugcca

SEQ ID NO: 1349079 - RNA, 15 nt, Homo sapiens
auaccaucugguacu

SEQ ID NO: 1349080 - RNA, 15 nt, Homo sapiens
auaccauuauauguu

SEQ ID NO: 1349081 - RNA, 15 nt, Homo sapiens
auaccugauauauuc

SEQ ID NO: 1349082 - RNA, 22 nt, Homo sapiens
auaccugcucuuguucuacuga

SEQ ID NO: 1349083 - RNA, 16 nt, Homo sapiens
auacgcccucuuucau

SEQ ID NO: 1349084 - RNA, 17 nt, Homo sapiens
auacgucgugcucgagu

SEQ ID NO: 1349085 - RNA, 14 nt, Homo sapiens
auacuaaacaucau

SEQ ID NO: 1349086 - RNA, 21 nt, Homo sapiens
auacugagucuuuacucuuga

SEQ ID NO: 1349087 - RNA, 13 nt, Homo sapiens
auacuguuuccau

SEQ ID NO: 1349088 - RNA, 21 nt, Homo sapiens
auacuucuuuauucacaguau

SEQ ID NO: 1349089 - RNA, 22 nt, Homo sapiens
auacuuugcagcacagcugaga

SEQ ID NO: 1349090 - RNA, 16 nt, Homo sapiens
auacuuuucucaauau

SEQ ID NO: 1349091 - RNA, 16 nt, Homo sapiens
auagaagugauugaau

SEQ ID NO: 1349092 - RNA, 19 nt, Homo sapiens
auagacacuucaccaaaga

SEQ ID NO: 1349093 - RNA, 13 nt, Homo sapiens
auagacauucuca

SEQ ID NO: 1349094 - RNA, 22 nt, Homo sapiens
auagaggguacuugaaucuuca

SEQ ID NO: 1349095 - RNA, 12 nt, Homo sapiens
auagagugcagu

SEQ ID NO: 1349096 - RNA, 19 nt, Homo sapiens
auagauuucuacacugagg

SEQ ID NO: 1349097 - RNA, 20 nt, Homo sapiens
auagauuucuacacugaggu

SEQ ID NO: 1349098 - RNA, 14 nt, Homo sapiens
auagcaagugaaag

SEQ ID NO: 1349099 - RNA, 15 nt, Homo sapiens
auagcaagugaaagc

SEQ ID NO: 1349100 - RNA, 15 nt, Homo sapiens
auagcaccuccacau

SEQ ID NO: 1349101 - RNA, 20 nt, Homo sapiens
auagcagccucacacuggcg

SEQ ID NO: 1349102 - RNA, 14 nt, Homo sapiens
auagcccuguaaca

SEQ ID NO: 1349103 - RNA, 16 nt, Homo sapiens
auagcuauuaagauac

SEQ ID NO: 1349104 - RNA, 19 nt, Homo sapiens
auagcuauuaagauacuua

SEQ ID NO: 1349105 - RNA, 13 nt, Homo sapiens
auagcuucaggag

SEQ ID NO: 1349106 - RNA, 22 nt, Homo sapiens
auaggaaaccacacagacuugg

SEQ ID NO: 1349107 - RNA, 21 nt, Homo sapiens
auaggccugucccuugccucu

SEQ ID NO: 1349108 - RNA, 21 nt, Homo sapiens
auaggcuucucacggcgacca

SEQ ID NO: 1349109 - RNA, 19 nt, Homo sapiens
auaggugcuacaaaaacac

SEQ ID NO: 1349110 - RNA, 13 nt, Homo sapiens
auagucacacuuu

SEQ ID NO: 1349111 - RNA, 23 nt, Homo sapiens
auagucaccugcuguuggaugca

SEQ ID NO: 1349112 - RNA, 22 nt, Homo sapiens
auagucccauuuuucucuugcc

SEQ ID NO: 1349113 - RNA, 18 nt, Homo sapiens
auagugaugaugaucuca

SEQ ID NO: 1349114 - RNA, 18 nt, Homo sapiens
auagugauuguaacaaau

SEQ ID NO: 1349115 - RNA, 15 nt, Homo sapiens
auaguuacuguguaa

SEQ ID NO: 1349116 - RNA, 18 nt, Homo sapiens
auaguuggucaucuagca

SEQ ID NO: 1349117 - RNA, 17 nt, Homo sapiens
auaguuuuuuacuucuc

SEQ ID NO: 1349118 - RNA, 16 nt, Homo sapiens
auauaaagucagugac

SEQ ID NO: 1349119 - RNA, 21 nt, Homo sapiens
auauaaccucccacccugcaa

SEQ ID NO: 1349120 - RNA, 13 nt, Homo sapiens
auauacagaggaa

SEQ ID NO: 1349121 - RNA, 15 nt, Homo sapiens
auauauacuaaacaa

SEQ ID NO: 1349122 - RNA, 16 nt, Homo sapiens
auauauuauuuaguca

SEQ ID NO: 1349123 - RNA, 17 nt, Homo sapiens
auauauuccaccaggau

SEQ ID NO: 1349124 - RNA, 16 nt, Homo sapiens
auaucaaaacauccca

SEQ ID NO: 1349125 - RNA, 16 nt, Homo sapiens
auaucacuuccaugac

SEQ ID NO: 1349126 - RNA, 14 nt, Homo sapiens
auaucagaguaugu

SEQ ID NO: 1349127 - RNA, 18 nt, Homo sapiens
auaucagaguaugucagu

SEQ ID NO: 1349128 - RNA, 19 nt, Homo sapiens
auauccuuugccucaagga

SEQ ID NO: 1349129 - RNA, 18 nt, Homo sapiens
auaucucccccacuccac

SEQ ID NO: 1349130 - RNA, 17 nt, Homo sapiens
auaugaaggauuacucu

SEQ ID NO: 1349131 - RNA, 20 nt, Homo sapiens
auaugcauaccuggauuucc

SEQ ID NO: 1349132 - RNA, 20 nt, Homo sapiens
auaugcuuauacacuuacac

SEQ ID NO: 1349133 - RNA, 11 nt, Homo sapiens
auauguggaau

SEQ ID NO: 1349134 - RNA, 19 nt, Homo sapiens
auauguuguguuugguuca

SEQ ID NO: 1349135 - RNA, 21 nt, Homo sapiens
auauguuuggaauauuccacu

SEQ ID NO: 1349136 - RNA, 19 nt, Homo sapiens
auauuaacgguggugaaaa

SEQ ID NO: 1349137 - RNA, 13 nt, Homo sapiens
auauuaugccuga

SEQ ID NO: 1349138 - RNA, 12 nt, Homo sapiens
auauugcuccau

SEQ ID NO: 1349139 - RNA, 17 nt, Homo sapiens
auauuuaagcaacaucu

SEQ ID NO: 1349140 - RNA, 13 nt, Homo sapiens
auauuuacuaccu

SEQ ID NO: 1349141 - RNA, 15 nt, Homo sapiens
auauuucaucaugau

SEQ ID NO: 1349142 - RNA, 21 nt, Homo sapiens
auauuucuguaauuauaucua

SEQ ID NO: 1349143 - RNA, 19 nt, Homo sapiens
auauuugggccugcuccag

SEQ ID NO: 1349144 - RNA, 14 nt, Homo sapiens
aucaaaacauccca

SEQ ID NO: 1349145 - RNA, 16 nt, Homo sapiens
aucaaagccacacucu

SEQ ID NO: 1349146 - RNA, 18 nt, Homo sapiens
aucaacaucuuggucaga

SEQ ID NO: 1349147 - RNA, 13 nt, Homo sapiens
aucaacucugucu

SEQ ID NO: 1349148 - RNA, 23 nt, Homo sapiens
aucaagacugcaaacccuuucau

SEQ ID NO: 1349149 - RNA, 20 nt, Homo sapiens
aucaagguagaacaaagaaa

SEQ ID NO: 1349150 - RNA, 16 nt, Homo sapiens
aucaaggucccuucau

SEQ ID NO: 1349151 - RNA, 15 nt, Homo sapiens
aucaauaaauguugc

SEQ ID NO: 1349152 - RNA, 18 nt, Homo sapiens
aucaaucaagacugcaaa

SEQ ID NO: 1349153 - RNA, 13 nt, Homo sapiens
aucacaaaaccac

SEQ ID NO: 1349154 - RNA, 18 nt, Homo sapiens
aucacaaauuucacuuau

SEQ ID NO: 1349155 - RNA, 21 nt, Homo sapiens
caauuaaucaaaccacuguua

SEQ ID NO: 1349156 - RNA, 22 nt, Homo sapiens
caauuauaucucccccacucca

SEQ ID NO: 1349157 - RNA, 14 nt, Homo sapiens
caauuaugugcaaa

SEQ ID NO: 1349158 - RNA, 18 nt, Homo sapiens
caauuauugaaacaggau

SEQ ID NO: 1349159 - RNA, 16 nt, Homo sapiens
caauucuccugccuua

SEQ ID NO: 1349160 - RNA, 18 nt, Homo sapiens
caauucuggacagacaga

SEQ ID NO: 1349161 - RNA, 20 nt, Homo sapiens
caauugacugucacuguucc

SEQ ID NO: 1349162 - RNA, 22 nt, Homo sapiens
caauugagggcauuaguacuuu

SEQ ID NO: 1349163 - RNA, 18 nt, Homo sapiens
caauuuaaggaacacaga

SEQ ID NO: 1349164 - RNA, 14 nt, Homo sapiens
caauuucagacucc

SEQ ID NO: 1349165 - RNA, 22 nt, Homo sapiens
cacaaaaauagagaaaauucag

SEQ ID NO: 1349166 - RNA, 12 nt, Homo sapiens
cacaaaacagaa

SEQ ID NO: 1349167 - RNA, 14 nt, Homo sapiens
cacaaaauucuuau

SEQ ID NO: 1349168 - RNA, 17 nt, Homo sapiens
cacaaacccccacucca

SEQ ID NO: 1349169 - RNA, 17 nt, Homo sapiens
cacaaaggauacuuuua

SEQ ID NO: 1349170 - RNA, 15 nt, Homo sapiens
cacaaauacauuccu

SEQ ID NO: 1349171 - RNA, 14 nt, Homo sapiens
cacaaaucuuaacu

SEQ ID NO: 1349172 - RNA, 14 nt, Homo sapiens
cacaacagugaaaa

SEQ ID NO: 1349173 - RNA, 15 nt, Homo sapiens
cacaagaaugugcag

SEQ ID NO: 1349174 - RNA, 23 nt, Homo sapiens
cacaagccuccuguaccucagug

SEQ ID NO: 1349175 - RNA, 15 nt, Homo sapiens
cacaaggggcuccac

SEQ ID NO: 1349176 - RNA, 16 nt, Homo sapiens
cacaauccuugccaca

SEQ ID NO: 1349177 - RNA, 17 nt, Homo sapiens
cacaauuaugugcaaag

SEQ ID NO: 1349178 - RNA, 21 nt, Homo sapiens
cacaauuauuggcaaaguuua

SEQ ID NO: 1349179 - RNA, 18 nt, Homo sapiens
cacaccauuuuguaaaug

SEQ ID NO: 1349180 - RNA, 15 nt, Homo sapiens
cacaccuggccuuaa

SEQ ID NO: 1349181 - RNA, 13 nt, Homo sapiens
cacacgaaaagac

SEQ ID NO: 1349182 - RNA, 21 nt, Homo sapiens
cacacuaguuuaugcuaccua

SEQ ID NO: 1349183 - RNA, 13 nt, Homo sapiens
cacacucuucagu

SEQ ID NO: 1349184 - RNA, 18 nt, Homo sapiens
cacacuggcugguggaga

SEQ ID NO: 1349185 - RNA, 13 nt, Homo sapiens
cacacuuugcacu

SEQ ID NO: 1349186 - RNA, 16 nt, Homo sapiens
cacagacccacaagag

SEQ ID NO: 1349187 - RNA, 14 nt, Homo sapiens
cacagaggacacag

SEQ ID NO: 1349188 - RNA, 13 nt, Homo sapiens
cacagaugcacac

SEQ ID NO: 1349189 - RNA, 20 nt, Homo sapiens
cacagaugcauauagacaca

SEQ ID NO: 1349190 - RNA, 23 nt, Homo sapiens
cacagcaucgggagcacccagag

SEQ ID NO: 1349191 - RNA, 12 nt, Homo sapiens
cacaggucccac

SEQ ID NO: 1349192 - RNA, 18 nt, Homo sapiens
cacaguaccggauucucu

SEQ ID NO: 1349193 - RNA, 13 nt, Homo sapiens
cacagugcaucuc

SEQ ID NO: 1349194 - RNA, 18 nt, Homo sapiens
cacagugcuauuugcauu

SEQ ID NO: 1349195 - RNA, 21 nt, Homo sapiens
cacaguggcucaugccuguaa

SEQ ID NO: 1349196 - RNA, 18 nt, Homo sapiens
cacauacccucacuuaaa

SEQ ID NO: 1349197 - RNA, 21 nt, Homo sapiens
cacauaucugcuuaucagugu

SEQ ID NO: 1349198 - RNA, 14 nt, Homo sapiens
cacauccaucagca

SEQ ID NO: 1349199 - RNA, 14 nt, Homo sapiens
cacaucucagggaa

SEQ ID NO: 1349200 - RNA, 12 nt, Homo sapiens
cacaugacucuc

SEQ ID NO: 1349201 - RNA, 14 nt, Homo sapiens
cacaugaggccauc

SEQ ID NO: 1349202 - RNA, 16 nt, Homo sapiens
cacaugcccaugauga

SEQ ID NO: 1349203 - RNA, 23 nt, Homo sapiens
cacauuaaauugauaacauggaa

SEQ ID NO: 1349204 - RNA, 16 nt, Homo sapiens
cacauuggcugccuua

SEQ ID NO: 1349205 - RNA, 15 nt, Homo sapiens
caccaaagacaucag

SEQ ID NO: 1349206 - RNA, 16 nt, Homo sapiens
caccaaccuccagugu

SEQ ID NO: 1349207 - RNA, 20 nt, Homo sapiens
caccaagcucuguccaauca

SEQ ID NO: 1349208 - RNA, 15 nt, Homo sapiens
caccaaguaccagua

SEQ ID NO: 1349209 - RNA, 13 nt, Homo sapiens
caccaccaaaauu

SEQ ID NO: 1349210 - RNA, 21 nt, Homo sapiens
caccacucaggccacaguggg

SEQ ID NO: 1349211 - RNA, 23 nt, Homo sapiens
caccacuuccgucccauccuugc

SEQ ID NO: 1349212 - RNA, 15 nt, Homo sapiens
caccagacacccagg

SEQ ID NO: 1349213 - RNA, 19 nt, Homo sapiens
caccaucucacugcaguag

SEQ ID NO: 1349214 - RNA, 15 nt, Homo sapiens
caccaucugcugucu

SEQ ID NO: 1349215 - RNA, 22 nt, Homo sapiens
caccauuuugucaggugggaga

SEQ ID NO: 1349216 - RNA, 22 nt, Homo sapiens
cacccagccccagccagggcuc

SEQ ID NO: 1349217 - RNA, 21 nt, Homo sapiens
cacccccugcuccaccagcag

SEQ ID NO: 1349218 - RNA, 21 nt, Homo sapiens
caccccgucguauacccugga

SEQ ID NO: 1349219 - RNA, 16 nt, Homo sapiens
caccccugacuuuuau

SEQ ID NO: 1349220 - RNA, 14 nt, Homo sapiens
cacccugggagcca

SEQ ID NO: 1349221 - RNA, 14 nt, Homo sapiens
cacccuuuccagga

SEQ ID NO: 1349222 - RNA, 17 nt, Homo sapiens
caccgugaaauagguga

SEQ ID NO: 1349223 - RNA, 16 nt, Homo sapiens
caccuacauuaucuca

SEQ ID NO: 1349224 - RNA, 17 nt, Homo sapiens
caccuacauuaucucac

SEQ ID NO: 1349225 - RNA, 20 nt, Homo sapiens
caccucacaggccccaggaa

SEQ ID NO: 1349226 - RNA, 21 nt, Homo sapiens
caccucggcacacacugugcc

SEQ ID NO: 1349227 - RNA, 18 nt, Homo sapiens
caccugacacaccaggcg

SEQ ID NO: 1349228 - RNA, 18 nt, Homo sapiens
caccugagacaugcugaa

SEQ ID NO: 1349229 - RNA, 20 nt, Homo sapiens
caccugagacaugcugaaau

SEQ ID NO: 1349230 - RNA, 19 nt, Homo sapiens
caccuggauguacuaucca

SEQ ID NO: 1349231 - RNA, 14 nt, Homo sapiens
caccuguggauguu

SEQ ID NO: 1349232 - RNA, 20 nt, Homo sapiens
caccuguucauuugaagaaa

SEQ ID NO: 1349233 - RNA, 16 nt, Homo sapiens
caccuuggcaccagac

SEQ ID NO: 1349234 - RNA, 23 nt, Homo sapiens
caccuuucauaaucuuugcuuua

SEQ ID NO: 1349235 - RNA, 20 nt, Homo sapiens
cacgcagugcggauccggga

SEQ ID NO: 1349236 - RNA, 16 nt, Homo sapiens
cacgcggaugcuacua

SEQ ID NO: 1349237 - RNA, 18 nt, Homo sapiens
cacggcuuguaaauguga

SEQ ID NO: 1349238 - RNA, 22 nt, Homo sapiens
cacgguggagagaaagugacau

SEQ ID NO: 1349239 - RNA, 15 nt, Homo sapiens
cacguggccucguga

SEQ ID NO: 1349240 - RNA, 22 nt, Homo sapiens
cacuaacuuaauguguauucau

SEQ ID NO: 1349241 - RNA, 22 nt, Homo sapiens
cacuaagggguauguucccucu

SEQ ID NO: 1349242 - RNA, 14 nt, Homo sapiens
cacuacauucugaa

SEQ ID NO: 1349243 - RNA, 13 nt, Homo sapiens
cacuaccaaaaga

SEQ ID NO: 1349244 - RNA, 22 nt, Homo sapiens
cacuagcccuccucucccagug

SEQ ID NO: 1349245 - RNA, 12 nt, Homo sapiens
cacucagauuua

SEQ ID NO: 1349246 - RNA, 13 nt, Homo sapiens
cacucagcucuug

SEQ ID NO: 1349247 - RNA, 17 nt, Homo sapiens
cacucaggggaccccac

SEQ ID NO: 1349248 - RNA, 22 nt, Homo sapiens
cacucaguuuaugcugugcuaa

SEQ ID NO: 1349249 - RNA, 18 nt, Homo sapiens
cacucauccccucacuug

SEQ ID NO: 1349250 - RNA, 11 nt, Homo sapiens
cacuccagugc

SEQ ID NO: 1349251 - RNA, 15 nt, Homo sapiens
cacucccagugcuug

SEQ ID NO: 1349252 - RNA, 21 nt, Homo sapiens
cacuccccaaccccucuccag

SEQ ID NO: 1349253 - RNA, 16 nt, Homo sapiens
cacucuguugccauua

SEQ ID NO: 1349254 - RNA, 21 nt, Homo sapiens
cacucuuaucuacauaaggau

SEQ ID NO: 1349255 - RNA, 22 nt, Homo sapiens
cacugaaaaaucuaagugauau

SEQ ID NO: 1349256 - RNA, 20 nt, Homo sapiens
cacugaaaauuuaacaguau

SEQ ID NO: 1349257 - RNA, 21 nt, Homo sapiens
cacugaaacugguugaagggu

SEQ ID NO: 1349258 - RNA, 21 nt, Homo sapiens
cacugaaccacauucagggaa

SEQ ID NO: 1349259 - RNA, 23 nt, Homo sapiens
cacugaacuccaccgaccaacug

SEQ ID NO: 1349260 - RNA, 15 nt, Homo sapiens
cacugagagggcaau

SEQ ID NO: 1349261 - RNA, 21 nt, Homo sapiens
cacugcaguagugcaccaucu

SEQ ID NO: 1349262 - RNA, 19 nt, Homo sapiens
cacugcauaccaaccuggg

SEQ ID NO: 1349263 - RNA, 19 nt, Homo sapiens
cacugccccagacacagug

SEQ ID NO: 1349264 - RNA, 20 nt, Homo sapiens
cacugccccagacacagugc

SEQ ID NO: 1349265 - RNA, 19 nt, Homo sapiens
cacugccggcaggaugcag

SEQ ID NO: 1349266 - RNA, 11 nt, Homo sapiens
cacugcuguag

SEQ ID NO: 1349267 - RNA, 14 nt, Homo sapiens
cacugcuguuauau

SEQ ID NO: 1349268 - RNA, 13 nt, Homo sapiens
cacuggacacuuc

SEQ ID NO: 1349269 - RNA, 14 nt, Homo sapiens
cacuggcaggugug

SEQ ID NO: 1349270 - RNA, 15 nt, Homo sapiens
cacugggaaacagag

SEQ ID NO: 1349271 - RNA, 21 nt, Homo sapiens
cacuggugggccauuagauuu

SEQ ID NO: 1349272 - RNA, 18 nt, Homo sapiens
cacugucacuacggugau

SEQ ID NO: 1349273 - RNA, 13 nt, Homo sapiens
cacugucaugcug

SEQ ID NO: 1349274 - RNA, 16 nt, Homo sapiens
cacuuaaaauacauga

SEQ ID NO: 1349275 - RNA, 16 nt, Homo sapiens
cacuuaaggggccaag

SEQ ID NO: 1349276 - RNA, 18 nt, Homo sapiens
cacuuacacuuuaugcac

SEQ ID NO: 1349277 - RNA, 13 nt, Homo sapiens
cacuucauucaca

SEQ ID NO: 1349278 - RNA, 17 nt, Homo sapiens
cacuucauucacauuca

SEQ ID NO: 1349279 - RNA, 12 nt, Homo sapiens
cacuuccagugu

SEQ ID NO: 1349280 - RNA, 20 nt, Homo sapiens
cacuucccagagcaucuugc

SEQ ID NO: 1349281 - RNA, 19 nt, Homo sapiens
cacuuggagcuaaaacugg

SEQ ID NO: 1349282 - RNA, 20 nt, Homo sapiens
cacuuuaccucuguggaccu

SEQ ID NO: 1349283 - RNA, 22 nt, Homo sapiens
cacuuucauuggacccugacug

SEQ ID NO: 1349284 - RNA, 22 nt, Homo sapiens
cacuuugcacugauauaucaug

SEQ ID NO: 1349285 - RNA, 17 nt, Homo sapiens
cagaaaaccucuccuga

SEQ ID NO: 1349286 - RNA, 22 nt, Homo sapiens
cagaaaagcaauacuguuucca

SEQ ID NO: 1349287 - RNA, 21 nt, Homo sapiens
cuuacuaaaaaguauaaaaua

SEQ ID NO: 1349288 - RNA, 21 nt, Homo sapiens
cuuacuucccuaaugaaguua

SEQ ID NO: 1349289 - RNA, 19 nt, Homo sapiens
cuuagaauuugggggaaaa

SEQ ID NO: 1349290 - RNA, 15 nt, Homo sapiens
cuuagcgggacaaag

SEQ ID NO: 1349291 - RNA, 19 nt, Homo sapiens
cuuagguaagacauauaac

SEQ ID NO: 1349292 - RNA, 19 nt, Homo sapiens
cuuaguaguggguuucuau

SEQ ID NO: 1349293 - RNA, 12 nt, Homo sapiens
cuuaguuuccac

SEQ ID NO: 1349294 - RNA, 15 nt, Homo sapiens
cuuauacaauuauga

SEQ ID NO: 1349295 - RNA, 14 nt, Homo sapiens
cuuauacauuugau

SEQ ID NO: 1349296 - RNA, 12 nt, Homo sapiens
cuuauacuguag

SEQ ID NO: 1349297 - RNA, 13 nt, Homo sapiens
cuuauacuuuucu

SEQ ID NO: 1349298 - RNA, 18 nt, Homo sapiens
cuuaucccucucuucccc

SEQ ID NO: 1349299 - RNA, 24 nt, Homo sapiens
cuuauuuuguaauaaacucucuag

SEQ ID NO: 1349300 - RNA, 20 nt, Homo sapiens
cuuauuuugugaucuguaac

SEQ ID NO: 1349301 - RNA, 14 nt, Homo sapiens
cuucaaaaagccac

SEQ ID NO: 1349302 - RNA, 22 nt, Homo sapiens
cuucaaaagccauaacuugaaa

SEQ ID NO: 1349303 - RNA, 19 nt, Homo sapiens
cuucaaaguuaaugggaug

SEQ ID NO: 1349304 - RNA, 14 nt, Homo sapiens
cuucaacccagugg

SEQ ID NO: 1349305 - RNA, 21 nt, Homo sapiens
cuucaacugaccagccuccau

SEQ ID NO: 1349306 - RNA, 21 nt, Homo sapiens
cuucaagaacccugacuccuc

SEQ ID NO: 1349307 - RNA, 22 nt, Homo sapiens
cuucaauguauugagcauguga

SEQ ID NO: 1349308 - RNA, 12 nt, Homo sapiens
cuucaccaaaga

SEQ ID NO: 1349309 - RNA, 19 nt, Homo sapiens
cuucacuguccuccaagcc

SEQ ID NO: 1349310 - RNA, 14 nt, Homo sapiens
cuucagaacugccc

SEQ ID NO: 1349311 - RNA, 22 nt, Homo sapiens
cuucagaacugcccuugcugcc

SEQ ID NO: 1349312 - RNA, 17 nt, Homo sapiens
cuucagacuggcccuua

SEQ ID NO: 1349313 - RNA, 14 nt, Homo sapiens
cuucagauuugccu

SEQ ID NO: 1349314 - RNA, 17 nt, Homo sapiens
cuucagcucuucuugac

SEQ ID NO: 1349315 - RNA, 21 nt, Homo sapiens
cuucagcucuucuugacauca

SEQ ID NO: 1349316 - RNA, 18 nt, Homo sapiens
cuucaggcagcugaaauu

SEQ ID NO: 1349317 - RNA, 14 nt, Homo sapiens
cuucaguccuuugu

SEQ ID NO: 1349318 - RNA, 15 nt, Homo sapiens
cuucagugugguaca

SEQ ID NO: 1349319 - RNA, 13 nt, Homo sapiens
cuucauuaccuca

SEQ ID NO: 1349320 - RNA, 16 nt, Homo sapiens
cuucauucacauucag

SEQ ID NO: 1349321 - RNA, 20 nt, Homo sapiens
cuuccaacccgccggucuca

SEQ ID NO: 1349322 - RNA, 21 nt, Homo sapiens
cuuccaauuuacauacucugc

SEQ ID NO: 1349323 - RNA, 21 nt, Homo sapiens
cuuccagcccggggccagcuu

SEQ ID NO: 1349324 - RNA, 22 nt, Homo sapiens
cuuccaugacauaagugcuauu

SEQ ID NO: 1349325 - RNA, 13 nt, Homo sapiens
cuucccacagugg

SEQ ID NO: 1349326 - RNA, 13 nt, Homo sapiens
cuucccagcaauu

SEQ ID NO: 1349327 - RNA, 13 nt, Homo sapiens
cuucccaguauua

SEQ ID NO: 1349328 - RNA, 20 nt, Homo sapiens
cuuccccuuagaaacacugc

SEQ ID NO: 1349329 - RNA, 16 nt, Homo sapiens
cuucccuaaucuucca

SEQ ID NO: 1349330 - RNA, 15 nt, Homo sapiens
cuucccuguucuccc

SEQ ID NO: 1349331 - RNA, 20 nt, Homo sapiens
cuucccuugcuucuuggacu

SEQ ID NO: 1349332 - RNA, 21 nt, Homo sapiens
cuuccucucaggcucuugacu

SEQ ID NO: 1349333 - RNA, 15 nt, Homo sapiens
cuuccucuccacugc

SEQ ID NO: 1349334 - RNA, 16 nt, Homo sapiens
cuuccugugacuucag

SEQ ID NO: 1349335 - RNA, 18 nt, Homo sapiens
cuucgcagccuagauaug

SEQ ID NO: 1349336 - RNA, 22 nt, Homo sapiens
cuucgggcugugcccggggaaa

SEQ ID NO: 1349337 - RNA, 23 nt, Homo sapiens
cuucuaccucuuggcugccuugu

SEQ ID NO: 1349338 - RNA, 22 nt, Homo sapiens
cuucuaguugcccccauuccca

SEQ ID NO: 1349339 - RNA, 13 nt, Homo sapiens
cuucuauuaauca

SEQ ID NO: 1349340 - RNA, 14 nt, Homo sapiens
cuucuauuaaucaa

SEQ ID NO: 1349341 - RNA, 12 nt, Homo sapiens
cuucuccaaagg

SEQ ID NO: 1349342 - RNA, 15 nt, Homo sapiens
cuucuccaaagggag

SEQ ID NO: 1349343 - RNA, 16 nt, Homo sapiens
cuucuccuccaugaac

SEQ ID NO: 1349344 - RNA, 19 nt, Homo sapiens
cuucucuauuucuggauga

SEQ ID NO: 1349345 - RNA, 13 nt, Homo sapiens
cuucucugccuca

SEQ ID NO: 1349346 - RNA, 17 nt, Homo sapiens
cuucugaaaaaguaucc

SEQ ID NO: 1349347 - RNA, 18 nt, Homo sapiens
cuucugaauaaagcaauu

SEQ ID NO: 1349348 - RNA, 18 nt, Homo sapiens
cuucugccuucucaggaa

SEQ ID NO: 1349349 - RNA, 16 nt, Homo sapiens
cuucuggggguggugg

SEQ ID NO: 1349350 - RNA, 16 nt, Homo sapiens
cuucuuauuaaucaua

SEQ ID NO: 1349351 - RNA, 18 nt, Homo sapiens
cuucuugacaucaaggcu

SEQ ID NO: 1349352 - RNA, 15 nt, Homo sapiens
cuucuuugugccuuu

SEQ ID NO: 1349353 - RNA, 18 nt, Homo sapiens
cuugaaaguuuuccagua

SEQ ID NO: 1349354 - RNA, 16 nt, Homo sapiens
cuugaaggugcugacg

SEQ ID NO: 1349355 - RNA, 20 nt, Homo sapiens
cuugaaugcacuuuugcuca

SEQ ID NO: 1349356 - RNA, 18 nt, Homo sapiens
cuugaauuaguauuucag

SEQ ID NO: 1349357 - RNA, 13 nt, Homo sapiens
cuugacugcauug

SEQ ID NO: 1349358 - RNA, 13 nt, Homo sapiens
cuugacuggggau

SEQ ID NO: 1349359 - RNA, 17 nt, Homo sapiens
cuugagauauaaaggaa

SEQ ID NO: 1349360 - RNA, 20 nt, Homo sapiens
cuugagccacagucacugga

SEQ ID NO: 1349361 - RNA, 16 nt, Homo sapiens
cuugaggcuaccucua

SEQ ID NO: 1349362 - RNA, 14 nt, Homo sapiens
cuugauucauucug

SEQ ID NO: 1349363 - RNA, 23 nt, Homo sapiens
cuugcagcauuuacuaugcacaa

SEQ ID NO: 1349364 - RNA, 13 nt, Homo sapiens
cuugcaguaucuc

SEQ ID NO: 1349365 - RNA, 18 nt, Homo sapiens
cuugcauugccugccugg

SEQ ID NO: 1349366 - RNA, 20 nt, Homo sapiens
cuugccauuuguagcuuugc

SEQ ID NO: 1349367 - RNA, 21 nt, Homo sapiens
cuugccuaaauuuaaugcugc

SEQ ID NO: 1349368 - RNA, 14 nt, Homo sapiens
cuugccuaucugac

SEQ ID NO: 1349369 - RNA, 15 nt, Homo sapiens
cuugccuaucugacu

SEQ ID NO: 1349370 - RNA, 17 nt, Homo sapiens
cuugcuaccaguauuua

SEQ ID NO: 1349371 - RNA, 22 nt, Homo sapiens
cuugcuuaugacaucacuugua

SEQ ID NO: 1349372 - RNA, 19 nt, Homo sapiens
cuuggcagcccgggucauc

SEQ ID NO: 1349373 - RNA, 15 nt, Homo sapiens
cuuggcccuccucag

SEQ ID NO: 1349374 - RNA, 17 nt, Homo sapiens
cuuggcuccacugggau

SEQ ID NO: 1349375 - RNA, 13 nt, Homo sapiens
cuuggcugcauuu

SEQ ID NO: 1349376 - RNA, 22 nt, Homo sapiens
cuuggcugcauuugccugucau

SEQ ID NO: 1349377 - RNA, 14 nt, Homo sapiens
cuuggcuuuaugca

SEQ ID NO: 1349378 - RNA, 15 nt, Homo sapiens
cuuggcuuuaugcaa

SEQ ID NO: 1349379 - RNA, 22 nt, Homo sapiens
cuuggcuuuaugcaaauacaau

SEQ ID NO: 1349380 - RNA, 12 nt, Homo sapiens
cuuggguccuga

SEQ ID NO: 1349381 - RNA, 15 nt, Homo sapiens
cuugguucucuccac

SEQ ID NO: 1349382 - RNA, 12 nt, Homo sapiens
cuuguaccucaa

SEQ ID NO: 1349383 - RNA, 23 nt, Homo sapiens
cuuguauagcaugaaauaaaaua

SEQ ID NO: 1349384 - RNA, 12 nt, Homo sapiens
cuugucagugug

SEQ ID NO: 1349385 - RNA, 15 nt, Homo sapiens
cuugucccucuguau

SEQ ID NO: 1349386 - RNA, 18 nt, Homo sapiens
cuugucccucuguauacu

SEQ ID NO: 1349387 - RNA, 16 nt, Homo sapiens
cuugucccuuucccua

SEQ ID NO: 1349388 - RNA, 15 nt, Homo sapiens
cuuguuagcuguuuc

SEQ ID NO: 1349389 - RNA, 15 nt, Homo sapiens
cuuguuccugaaaug

SEQ ID NO: 1349390 - RNA, 16 nt, Homo sapiens
cuuguuguaaaaagcc

SEQ ID NO: 1349391 - RNA, 18 nt, Homo sapiens
cuuuaaccucacauaccc

SEQ ID NO: 1349392 - RNA, 15 nt, Homo sapiens
cuuuaagaacuaaaa

SEQ ID NO: 1349393 - RNA, 19 nt, Homo sapiens
cuuuaagcagcgccaguga

SEQ ID NO: 1349394 - RNA, 15 nt, Homo sapiens
cuuuaagccaaagaa

SEQ ID NO: 1349395 - RNA, 20 nt, Homo sapiens
cuuuaaugauaugcuuguaa

SEQ ID NO: 1349396 - RNA, 19 nt, Homo sapiens
cuuuaauuuuuuacuauuu

SEQ ID NO: 1349397 - RNA, 22 nt, Homo sapiens
cuuuacaacuaaauaacacaga

SEQ ID NO: 1349398 - RNA, 15 nt, Homo sapiens
cuuuacuccguaaca

SEQ ID NO: 1349399 - RNA, 22 nt, Homo sapiens
cuuuagcaguuuccucagugau

SEQ ID NO: 1349400 - RNA, 15 nt, Homo sapiens
cuuuaugcaaauaca

SEQ ID NO: 1349401 - RNA, 19 nt, Homo sapiens
cuuuaugcaaauacaauca

SEQ ID NO: 1349402 - RNA, 17 nt, Homo sapiens
cuuuauuaauaaaaccu

SEQ ID NO: 1349403 - RNA, 15 nt, Homo sapiens
cuuucacacuggauc

SEQ ID NO: 1349404 - RNA, 15 nt, Homo sapiens
cuuucacccauccua

SEQ ID NO: 1349405 - RNA, 15 nt, Homo sapiens
cuuucagagccagcc

SEQ ID NO: 1349406 - RNA, 19 nt, Homo sapiens
cuuucaggguuuucuaacc

SEQ ID NO: 1349407 - RNA, 23 nt, Homo sapiens
cuuucauuacccuacagacagcu

SEQ ID NO: 1349408 - RNA, 18 nt, Homo sapiens
cuuucccaaccccaggaa

SEQ ID NO: 1349409 - RNA, 14 nt, Homo sapiens
cuuucccaguccca

SEQ ID NO: 1349410 - RNA, 16 nt, Homo sapiens
cuuuccucaucaggcc

SEQ ID NO: 1349411 - RNA, 16 nt, Homo sapiens
cuuuccugcagcaguc

SEQ ID NO: 1349412 - RNA, 14 nt, Homo sapiens
cuuuccugcucugg

SEQ ID NO: 1349413 - RNA, 22 nt, Homo sapiens
cuuuccuuuacuccuggcucaa

SEQ ID NO: 1349414 - RNA, 20 nt, Homo sapiens
cuuucuaaugcugauaugau

SEQ ID NO: 1349415 - RNA, 17 nt, Homo sapiens
cuuucucucuaauucag

SEQ ID NO: 1349416 - RNA, 14 nt, Homo sapiens
cuuucucugagggg

SEQ ID NO: 1349417 - RNA, 15 nt, Homo sapiens
cuuucugucuuuaag

SEQ ID NO: 1349418 - RNA, 18 nt, Homo sapiens
cuuucuuugcaccaaaga

SEQ ID NO: 1349419 - RNA, 18 nt, Homo sapiens
cuuugaagugcagcucau

SEQ ID NO: 1349420 - RNA, 15 nt, Homo sapiens
gacugaugacuuuau

SEQ ID NO: 1349421 - RNA, 19 nt, Homo sapiens
gacugcauugccgcuguau

SEQ ID NO: 1349422 - RNA, 23 nt, Homo sapiens
gacuguugaugccuuugaguuuu

SEQ ID NO: 1349423 - RNA, 18 nt, Homo sapiens
gacuucauacaucccuca

SEQ ID NO: 1349424 - RNA, 22 nt, Homo sapiens
gacuucaugacaagcauuuugu

SEQ ID NO: 1349425 - RNA, 20 nt, Homo sapiens
gacuucugucuucacaacag

SEQ ID NO: 1349426 - RNA, 15 nt, Homo sapiens
gacuugauuuacaau

SEQ ID NO: 1349427 - RNA, 20 nt, Homo sapiens
gacuuguuuuaaacuugccu

SEQ ID NO: 1349428 - RNA, 15 nt, Homo sapiens
gacuuuaucaugugu

SEQ ID NO: 1349429 - RNA, 13 nt, Homo sapiens
gacuuuguguuca

SEQ ID NO: 1349430 - RNA, 18 nt, Homo sapiens
gacuuuguguucauuuca

SEQ ID NO: 1349431 - RNA, 12 nt, Homo sapiens
gagaaaacaugc

SEQ ID NO: 1349432 - RNA, 14 nt, Homo sapiens
gagaaaagccucuc

SEQ ID NO: 1349433 - RNA, 17 nt, Homo sapiens
gagaaaagccucuccag

SEQ ID NO: 1349434 - RNA, 21 nt, Homo sapiens
gagaacacagugcuauuugca

SEQ ID NO: 1349435 - RNA, 22 nt, Homo sapiens
gagaagaaaaccucaaguaaua

SEQ ID NO: 1349436 - RNA, 22 nt, Homo sapiens
gagaagagcuguucacagccag

SEQ ID NO: 1349437 - RNA, 17 nt, Homo sapiens
gagaagcgggaguggcu

SEQ ID NO: 1349438 - RNA, 18 nt, Homo sapiens
gagaagcuccucucccca

SEQ ID NO: 1349439 - RNA, 16 nt, Homo sapiens
gagaagcugucaggga

SEQ ID NO: 1349440 - RNA, 14 nt, Homo sapiens
gagaaggccuggaa

SEQ ID NO: 1349441 - RNA, 13 nt, Homo sapiens
gagaaguauacau

SEQ ID NO: 1349442 - RNA, 18 nt, Homo sapiens
gagaaguggcaucaguca

SEQ ID NO: 1349443 - RNA, 13 nt, Homo sapiens
gagaaugucagua

SEQ ID NO: 1349444 - RNA, 17 nt, Homo sapiens
gagacaaacuuguucaa

SEQ ID NO: 1349445 - RNA, 16 nt, Homo sapiens
gagacaccaagcucac

SEQ ID NO: 1349446 - RNA, 14 nt, Homo sapiens
gagacaguucaaga

SEQ ID NO: 1349447 - RNA, 11 nt, Homo sapiens
gagacauguga

SEQ ID NO: 1349448 - RNA, 13 nt, Homo sapiens
gagacaugugaca

SEQ ID NO: 1349449 - RNA, 17 nt, Homo sapiens
gagacgggguuucucca

SEQ ID NO: 1349450 - RNA, 22 nt, Homo sapiens
gagaggcccucuggaguggcca

SEQ ID NO: 1349451 - RNA, 23 nt, Homo sapiens
gagagggacauagaaucugugac

SEQ ID NO: 1349452 - RNA, 16 nt, Homo sapiens
gagaguaaaccuugaa

SEQ ID NO: 1349453 - RNA, 16 nt, Homo sapiens
gagaguggcuccuccc

SEQ ID NO: 1349454 - RNA, 14 nt, Homo sapiens
gagaucgagaccau

SEQ ID NO: 1349455 - RNA, 16 nt, Homo sapiens
gagaucgagaccaucc

SEQ ID NO: 1349456 - RNA, 15 nt, Homo sapiens
gagaugaccagggau

SEQ ID NO: 1349457 - RNA, 18 nt, Homo sapiens
gagaugccacuucucacu

SEQ ID NO: 1349458 - RNA, 22 nt, Homo sapiens
gagaugccacuucucacucacc

SEQ ID NO: 1349459 - RNA, 20 nt, Homo sapiens
gagauugcgccauugcacuc

SEQ ID NO: 1349460 - RNA, 19 nt, Homo sapiens
gagcaaauaaagaccugag

SEQ ID NO: 1349461 - RNA, 21 nt, Homo sapiens
gagcaaauaaagaccugagaa

SEQ ID NO: 1349462 - RNA, 22 nt, Homo sapiens
gagcaacagccuaaaggccugc

SEQ ID NO: 1349463 - RNA, 13 nt, Homo sapiens
gagcaagcaccaa

SEQ ID NO: 1349464 - RNA, 22 nt, Homo sapiens
gagcaauggaguggcugccaug

SEQ ID NO: 1349465 - RNA, 21 nt, Homo sapiens
gagcacccugcccaccaagaa

SEQ ID NO: 1349466 - RNA, 20 nt, Homo sapiens
gagcacugcguuuuccuagc

SEQ ID NO: 1349467 - RNA, 16 nt, Homo sapiens
gagcacuugagaacca

SEQ ID NO: 1349468 - RNA, 22 nt, Homo sapiens
gagcagaugcaaugacucagga

SEQ ID NO: 1349469 - RNA, 14 nt, Homo sapiens
gagcaggcuacugu

SEQ ID NO: 1349470 - RNA, 14 nt, Homo sapiens
gagcagucugagga

SEQ ID NO: 1349471 - RNA, 23 nt, Homo sapiens
gagcaucaggcuaagacccugug

SEQ ID NO: 1349472 - RNA, 20 nt, Homo sapiens
gagcauccuuggcaguggga

SEQ ID NO: 1349473 - RNA, 14 nt, Homo sapiens
gagccaaguccaaa

SEQ ID NO: 1349474 - RNA, 21 nt, Homo sapiens
gagccuuacuucaaagugccu

SEQ ID NO: 1349475 - RNA, 16 nt, Homo sapiens
gagcuagcuaaucucu

SEQ ID NO: 1349476 - RNA, 12 nt, Homo sapiens
gagcuauaacuu

SEQ ID NO: 1349477 - RNA, 22 nt, Homo sapiens
gagcuccagcuccguucccaag

SEQ ID NO: 1349478 - RNA, 22 nt, Homo sapiens
gagcuggggaugucucucauga

SEQ ID NO: 1349479 - RNA, 22 nt, Homo sapiens
gagcuuccaacccgaggcaaua

SEQ ID NO: 1349480 - RNA, 12 nt, Homo sapiens
gaggaaagggag

SEQ ID NO: 1349481 - RNA, 12 nt, Homo sapiens
gaggaagggaca

SEQ ID NO: 1349482 - RNA, 22 nt, Homo sapiens
gaggacaagggaaaugucaggg

SEQ ID NO: 1349483 - RNA, 19 nt, Homo sapiens
gaggacuugugucucugug

SEQ ID NO: 1349484 - RNA, 15 nt, Homo sapiens
gaggagaagcaaugg

SEQ ID NO: 1349485 - RNA, 17 nt, Homo sapiens
gaggagauauggaguga

SEQ ID NO: 1349486 - RNA, 19 nt, Homo sapiens
gaggaggggagugcucuga

SEQ ID NO: 1349487 - RNA, 13 nt, Homo sapiens
gaggaugccuagg

SEQ ID NO: 1349488 - RNA, 22 nt, Homo sapiens
gaggauggacuaaaugaucucu

SEQ ID NO: 1349489 - RNA, 20 nt, Homo sapiens
gaggcagagguugcagugaa

SEQ ID NO: 1349490 - RNA, 22 nt, Homo sapiens
gaggcaggagaaucgcuugaac

SEQ ID NO: 1349491 - RNA, 14 nt, Homo sapiens
gaggccagacccac

SEQ ID NO: 1349492 - RNA, 23 nt, Homo sapiens
gaggccuggcccgcuaaggugaa

SEQ ID NO: 1349493 - RNA, 15 nt, Homo sapiens
gaggcgcacagugug

SEQ ID NO: 1349494 - RNA, 23 nt, Homo sapiens
gaggcuaucuaauuuuacacucu

SEQ ID NO: 1349495 - RNA, 12 nt, Homo sapiens
gaggcucagaga

SEQ ID NO: 1349496 - RNA, 13 nt, Homo sapiens
gaggcucagagag

SEQ ID NO: 1349497 - RNA, 22 nt, Homo sapiens
gaggcuggagagaacacagugc

SEQ ID NO: 1349498 - RNA, 22 nt, Homo sapiens
gaggcuuauucaguucuuacac

SEQ ID NO: 1349499 - RNA, 21 nt, Homo sapiens
gagggacauagaaucugugac

SEQ ID NO: 1349500 - RNA, 18 nt, Homo sapiens
gagggccccgcccagugc

SEQ ID NO: 1349501 - RNA, 14 nt, Homo sapiens
gagggggcgcugga

SEQ ID NO: 1349502 - RNA, 19 nt, Homo sapiens
gagggggucugggccagug

SEQ ID NO: 1349503 - RNA, 13 nt, Homo sapiens
gaggguccaccug

SEQ ID NO: 1349504 - RNA, 17 nt, Homo sapiens
gaggguuggagugcucu

SEQ ID NO: 1349505 - RNA, 23 nt, Homo sapiens
gaguaagcccucaggagccucug

SEQ ID NO: 1349506 - RNA, 12 nt, Homo sapiens
gaguagcuggau

SEQ ID NO: 1349507 - RNA, 16 nt, Homo sapiens
gaguauaaauuuacuu

SEQ ID NO: 1349508 - RNA, 16 nt, Homo sapiens
gagucagacugauaga

SEQ ID NO: 1349509 - RNA, 16 nt, Homo sapiens
gagucagaucuuucuc

SEQ ID NO: 1349510 - RNA, 22 nt, Homo sapiens
gagucagugccagguccuugcc

SEQ ID NO: 1349511 - RNA, 20 nt, Homo sapiens
gagucauuauguagcugucg

SEQ ID NO: 1349512 - RNA, 23 nt, Homo sapiens
gaguccaggacaggagaugcugu

SEQ ID NO: 1349513 - RNA, 18 nt, Homo sapiens
gagucgggagcacagcug

SEQ ID NO: 1349514 - RNA, 13 nt, Homo sapiens
gagugacagauca

SEQ ID NO: 1349515 - RNA, 21 nt, Homo sapiens
gagugagcacacccgugugca

SEQ ID NO: 1349516 - RNA, 15 nt, Homo sapiens
gagugagcacucacg

SEQ ID NO: 1349517 - RNA, 20 nt, Homo sapiens
gagugggguagguugggaga

SEQ ID NO: 1349518 - RNA, 16 nt, Homo sapiens
gaguggucacugucag

SEQ ID NO: 1349519 - RNA, 15 nt, Homo sapiens
gagugucaagcugac

SEQ ID NO: 1349520 - RNA, 21 nt, Homo sapiens
gagugucaugaagugcacagg

SEQ ID NO: 1349521 - RNA, 14 nt, Homo sapiens
gaguuacaguucug

SEQ ID NO: 1349522 - RNA, 16 nt, Homo sapiens
gaguuccucugcaguu

SEQ ID NO: 1349523 - RNA, 17 nt, Homo sapiens
gaguuccucugcaguuu

SEQ ID NO: 1349524 - RNA, 23 nt, Homo sapiens
gaguucucucaucggaggcccau

SEQ ID NO: 1349525 - RNA, 20 nt, Homo sapiens
gaguugcagccagggccagu

SEQ ID NO: 1349526 - RNA, 16 nt, Homo sapiens
gauaaaugucuuucca

SEQ ID NO: 1349527 - RNA, 18 nt, Homo sapiens
gauaacuaggaaauccau

SEQ ID NO: 1349528 - RNA, 12 nt, Homo sapiens
gauaacuuugac

SEQ ID NO: 1349529 - RNA, 11 nt, Homo sapiens
gauacaguauu

SEQ ID NO: 1349530 - RNA, 15 nt, Homo sapiens
gauacauaccugguu

SEQ ID NO: 1349531 - RNA, 23 nt, Homo sapiens
gauaccauucuauucuccagaca

SEQ ID NO: 1349532 - RNA, 22 nt, Homo sapiens
gauacugucucuccagugaaau

SEQ ID NO: 1349533 - RNA, 23 nt, Homo sapiens
gauagcucucugacugcuuugga

SEQ ID NO: 1349534 - RNA, 17 nt, Homo sapiens
gauaguccuuccuggca

SEQ ID NO: 1349535 - RNA, 11 nt, Homo sapiens
gauaguguucu

SEQ ID NO: 1349536 - RNA, 19 nt, Homo sapiens
gauaguugauucuugccuu

SEQ ID NO: 1349537 - RNA, 14 nt, Homo sapiens
gauaguuucuuccc

SEQ ID NO: 1349538 - RNA, 13 nt, Homo sapiens
gauauaagcaaaa

SEQ ID NO: 1349539 - RNA, 16 nt, Homo sapiens
gauauaagcaaaauca

SEQ ID NO: 1349540 - RNA, 15 nt, Homo sapiens
gauauaaguaaguga

SEQ ID NO: 1349541 - RNA, 21 nt, Homo sapiens
gauauacuugguucucuccac

SEQ ID NO: 1349542 - RNA, 22 nt, Homo sapiens
gauaucugcagggacagagcau

SEQ ID NO: 1349543 - RNA, 14 nt, Homo sapiens
gauauggcaggacu

SEQ ID NO: 1349544 - RNA, 14 nt, Homo sapiens
gauauuuuaucuau

SEQ ID NO: 1349545 - RNA, 15 nt, Homo sapiens
gaucaagaacauguc

SEQ ID NO: 1349546 - RNA, 16 nt, Homo sapiens
gaucacguugcaaugg

SEQ ID NO: 1349547 - RNA, 12 nt, Homo sapiens
gaucacuccugg

SEQ ID NO: 1349548 - RNA, 11 nt, Homo sapiens
gaucacuugag

SEQ ID NO: 1349549 - RNA, 13 nt, Homo sapiens
gaucaucagucac

SEQ ID NO: 1349550 - RNA, 20 nt, Homo sapiens
gaucaucuuuccuguuccag

SEQ ID NO: 1349551 - RNA, 21 nt, Homo sapiens
gaucauuuguuggaaugaauu

SEQ ID NO: 1349552 - RNA, 18 nt, Homo sapiens
gcuuuacauggguucaau

SEQ ID NO: 1349553 - RNA, 13 nt, Homo sapiens
gcuuuaugcaaau

SEQ ID NO: 1349554 - RNA, 14 nt, Homo sapiens
gcuuuaugcaaaua

SEQ ID NO: 1349555 - RNA, 15 nt, Homo sapiens
gcuuuaugcaaauac

SEQ ID NO: 1349556 - RNA, 22 nt, Homo sapiens
gcuuuaugcaaauacaaucagc

SEQ ID NO: 1349557 - RNA, 18 nt, Homo sapiens
gcuuucgaugcguguguu

SEQ ID NO: 1349558 - RNA, 18 nt, Homo sapiens
gcuuucuagaaagaauaa

SEQ ID NO: 1349559 - RNA, 23 nt, Homo sapiens
gcuuucuaugcuguuuguaguga

SEQ ID NO: 1349560 - RNA, 18 nt, Homo sapiens
gcuuugaaagaagcaaga

SEQ ID NO: 1349561 - RNA, 16 nt, Homo sapiens
gcuuugcccaccccuc

SEQ ID NO: 1349562 - RNA, 12 nt, Homo sapiens
gcuuugcccauu

SEQ ID NO: 1349563 - RNA, 15 nt, Homo sapiens
gcuuugucuacuuca

SEQ ID NO: 1349564 - RNA, 15 nt, Homo sapiens
gcuuuguugugagaa

SEQ ID NO: 1349565 - RNA, 17 nt, Homo sapiens
ggaaaauaaacaucagu

SEQ ID NO: 1349566 - RNA, 18 nt, Homo sapiens
ggaaaaucacuugccaaa

SEQ ID NO: 1349567 - RNA, 14 nt, Homo sapiens
ggaaacaacagcuu

SEQ ID NO: 1349568 - RNA, 18 nt, Homo sapiens
ggaaacagcaugaauaaa

SEQ ID NO: 1349569 - RNA, 14 nt, Homo sapiens
ggaacaaaauugaa

SEQ ID NO: 1349570 - RNA, 15 nt, Homo sapiens
ggaacacaucuggcu

SEQ ID NO: 1349571 - RNA, 20 nt, Homo sapiens
ggaaccacaccacaucuaag

SEQ ID NO: 1349572 - RNA, 18 nt, Homo sapiens
ggaacccagacucagaca

SEQ ID NO: 1349573 - RNA, 20 nt, Homo sapiens
ggaaccucagccuggccaga

SEQ ID NO: 1349574 - RNA, 22 nt, Homo sapiens
ggaaccucagccuggccagaca

SEQ ID NO: 1349575 - RNA, 16 nt, Homo sapiens
ggaacuccuggccuuu

SEQ ID NO: 1349576 - RNA, 17 nt, Homo sapiens
ggaagaauccaguauua

SEQ ID NO: 1349577 - RNA, 11 nt, Homo sapiens
ggaagcucucc

SEQ ID NO: 1349578 - RNA, 17 nt, Homo sapiens
ggaaggacauccauguu

SEQ ID NO: 1349579 - RNA, 18 nt, Homo sapiens
ggaaggugccucuggaug

SEQ ID NO: 1349580 - RNA, 14 nt, Homo sapiens
ggaaguugacuuau

SEQ ID NO: 1349581 - RNA, 22 nt, Homo sapiens
ggaauaaauugcuccuugacau

SEQ ID NO: 1349582 - RNA, 14 nt, Homo sapiens
ggaaucuagcccaa

SEQ ID NO: 1349583 - RNA, 22 nt, Homo sapiens
ggaaucuauuuucucauugcuc

SEQ ID NO: 1349584 - RNA, 15 nt, Homo sapiens
ggaaugccgcugucu

SEQ ID NO: 1349585 - RNA, 16 nt, Homo sapiens
ggaauggagauuucau

SEQ ID NO: 1349586 - RNA, 17 nt, Homo sapiens
ggaauguaugugcacau

SEQ ID NO: 1349587 - RNA, 20 nt, Homo sapiens
ggaauguucuuucugcucua

SEQ ID NO: 1349588 - RNA, 16 nt, Homo sapiens
ggaauuacgugcucug

SEQ ID NO: 1349589 - RNA, 20 nt, Homo sapiens
ggaauuacgugcucuguggg

SEQ ID NO: 1349590 - RNA, 12 nt, Homo sapiens
ggaauucagugc

SEQ ID NO: 1349591 - RNA, 18 nt, Homo sapiens
ggaauuucuuaacuucuu

SEQ ID NO: 1349592 - RNA, 15 nt, Homo sapiens
ggacccaucuuccac

SEQ ID NO: 1349593 - RNA, 21 nt, Homo sapiens
ggaccccacuccccucacaca

SEQ ID NO: 1349594 - RNA, 17 nt, Homo sapiens
ggacguggguugcacug

SEQ ID NO: 1349595 - RNA, 17 nt, Homo sapiens
ggacuaaaugaucucug

SEQ ID NO: 1349596 - RNA, 23 nt, Homo sapiens
ggacuauagugauuuaaacucau

SEQ ID NO: 1349597 - RNA, 19 nt, Homo sapiens
ggacuauauuugggccugc

SEQ ID NO: 1349598 - RNA, 16 nt, Homo sapiens
ggacuuaaacugcuga

SEQ ID NO: 1349599 - RNA, 22 nt, Homo sapiens
ggagaaauaugguacucauuaa

SEQ ID NO: 1349600 - RNA, 13 nt, Homo sapiens
ggagaacuagaga

SEQ ID NO: 1349601 - RNA, 18 nt, Homo sapiens
ggagaagccagugucuag

SEQ ID NO: 1349602 - RNA, 15 nt, Homo sapiens
ggagacaccaagcuc

SEQ ID NO: 1349603 - RNA, 16 nt, Homo sapiens
ggagaggggaggucac

SEQ ID NO: 1349604 - RNA, 21 nt, Homo sapiens
ggagauauuuuccaacagcuu

SEQ ID NO: 1349605 - RNA, 23 nt, Homo sapiens
ggagaugccacuucucacucacc

SEQ ID NO: 1349606 - RNA, 20 nt, Homo sapiens
ggagaugcugcaguuccaaa

SEQ ID NO: 1349607 - RNA, 15 nt, Homo sapiens
ggagcagucugagga

SEQ ID NO: 1349608 - RNA, 22 nt, Homo sapiens
ggagcauccuuggcagugggaa

SEQ ID NO: 1349609 - RNA, 12 nt, Homo sapiens
ggagcccaguga

SEQ ID NO: 1349610 - RNA, 15 nt, Homo sapiens
ggagccccgccaggu

SEQ ID NO: 1349611 - RNA, 19 nt, Homo sapiens
ggagcccuagcccugcucc

SEQ ID NO: 1349612 - RNA, 13 nt, Homo sapiens
ggagcuaaaacug

SEQ ID NO: 1349613 - RNA, 16 nt, Homo sapiens
ggagcuaaaacuggcc

SEQ ID NO: 1349614 - RNA, 19 nt, Homo sapiens
ggagcucuggggacagcuu

SEQ ID NO: 1349615 - RNA, 18 nt, Homo sapiens
ggagcugcuggguggcag

SEQ ID NO: 1349616 - RNA, 15 nt, Homo sapiens
ggagcuuaaacagcu

SEQ ID NO: 1349617 - RNA, 16 nt, Homo sapiens
ggagcuuaaacagcug

SEQ ID NO: 1349618 - RNA, 22 nt, Homo sapiens
ggaggaaaaggccccugcaaug

SEQ ID NO: 1349619 - RNA, 13 nt, Homo sapiens
ggaggacagggag

SEQ ID NO: 1349620 - RNA, 23 nt, Homo sapiens
ggaggaggccguaugaagacaga

SEQ ID NO: 1349621 - RNA, 18 nt, Homo sapiens
ggaggauucgagcaucag

SEQ ID NO: 1349622 - RNA, 22 nt, Homo sapiens
ggaggcagagguugcagugaac

SEQ ID NO: 1349623 - RNA, 15 nt, Homo sapiens
ggaggcgguggcaga

SEQ ID NO: 1349624 - RNA, 17 nt, Homo sapiens
ggagggaagggagccaa

SEQ ID NO: 1349625 - RNA, 18 nt, Homo sapiens
ggagggaagggagccaag

SEQ ID NO: 1349626 - RNA, 19 nt, Homo sapiens
ggaggggucccugcaaaac

SEQ ID NO: 1349627 - RNA, 14 nt, Homo sapiens
ggaggucucuguaa

SEQ ID NO: 1349628 - RNA, 19 nt, Homo sapiens
ggagguuguggggccucag

SEQ ID NO: 1349629 - RNA, 23 nt, Homo sapiens
ggaguaggugggggaacacugag

SEQ ID NO: 1349630 - RNA, 17 nt, Homo sapiens
ggagugacgcaucucca

SEQ ID NO: 1349631 - RNA, 12 nt, Homo sapiens
ggagugcucuga

SEQ ID NO: 1349632 - RNA, 21 nt, Homo sapiens
ggaguuuucuggagugagcac

SEQ ID NO: 1349633 - RNA, 15 nt, Homo sapiens
ggauacgacacaugc

SEQ ID NO: 1349634 - RNA, 18 nt, Homo sapiens
ggauaucacuuccaugac

SEQ ID NO: 1349635 - RNA, 20 nt, Homo sapiens
ggauauccucccuccagaua

SEQ ID NO: 1349636 - RNA, 14 nt, Homo sapiens
ggauccuuugcugc

SEQ ID NO: 1349637 - RNA, 17 nt, Homo sapiens
ggauccuuugcugcuga

SEQ ID NO: 1349638 - RNA, 13 nt, Homo sapiens
ggaucuucccaca

SEQ ID NO: 1349639 - RNA, 18 nt, Homo sapiens
ggaucuuggagaauguga

SEQ ID NO: 1349640 - RNA, 15 nt, Homo sapiens
ggaugaccuccagaa

SEQ ID NO: 1349641 - RNA, 21 nt, Homo sapiens
ggaugcaaauagauucagaga

SEQ ID NO: 1349642 - RNA, 19 nt, Homo sapiens
ggaugcuguugagggccaa

SEQ ID NO: 1349643 - RNA, 18 nt, Homo sapiens
ggauggacaucuugucau

SEQ ID NO: 1349644 - RNA, 15 nt, Homo sapiens
ggaugucucucauga

SEQ ID NO: 1349645 - RNA, 13 nt, Homo sapiens
ggaugucugccac

SEQ ID NO: 1349646 - RNA, 18 nt, Homo sapiens
ggauguugcuauagugac

SEQ ID NO: 1349647 - RNA, 23 nt, Homo sapiens
ggauuaaagugcccagcacaaag

SEQ ID NO: 1349648 - RNA, 21 nt, Homo sapiens
ggauuaagaaaccuugcucuc

SEQ ID NO: 1349649 - RNA, 14 nt, Homo sapiens
ggauuccugagcug

SEQ ID NO: 1349650 - RNA, 19 nt, Homo sapiens
ggauugacuuugcugucaa

SEQ ID NO: 1349651 - RNA, 13 nt, Homo sapiens
ggauugggguccc

SEQ ID NO: 1349652 - RNA, 17 nt, Homo sapiens
ggauuguuaauguuugc

SEQ ID NO: 1349653 - RNA, 20 nt, Homo sapiens
ggauuguuguuuaacuugua

SEQ ID NO: 1349654 - RNA, 17 nt, Homo sapiens
ggauuuuaccaaagcau

SEQ ID NO: 1349655 - RNA, 17 nt, Homo sapiens
ggcaaaauaaagugaca

SEQ ID NO: 1349656 - RNA, 17 nt, Homo sapiens
ggcaaaugccugacuca

SEQ ID NO: 1349657 - RNA, 20 nt, Homo sapiens
ggcaacagagcgagauucca

SEQ ID NO: 1349658 - RNA, 16 nt, Homo sapiens
ggcaagaaugcuuuaa

SEQ ID NO: 1349659 - RNA, 21 nt, Homo sapiens
ggcaagccugucuucagagaa

SEQ ID NO: 1349660 - RNA, 13 nt, Homo sapiens
ggcaaucuuugcc

SEQ ID NO: 1349661 - RNA, 19 nt, Homo sapiens
ggcaauuuaacaaugucug

SEQ ID NO: 1349662 - RNA, 13 nt, Homo sapiens
ggcacaacuggaa

SEQ ID NO: 1349663 - RNA, 12 nt, Homo sapiens
ggcacagccuuu

SEQ ID NO: 1349664 - RNA, 19 nt, Homo sapiens
ggcacagccuuugcccaaa

SEQ ID NO: 1349665 - RNA, 12 nt, Homo sapiens
ggcaccagacac

SEQ ID NO: 1349666 - RNA, 18 nt, Homo sapiens
ggcaccagacacccagga

SEQ ID NO: 1349667 - RNA, 18 nt, Homo sapiens
ggcacucagggagcauuu

SEQ ID NO: 1349668 - RNA, 16 nt, Homo sapiens
ggcagacuuucuucuc

SEQ ID NO: 1349669 - RNA, 21 nt, Homo sapiens
ggcagauacugucucuuucau

SEQ ID NO: 1349670 - RNA, 12 nt, Homo sapiens
ggcagauccagg

SEQ ID NO: 1349671 - RNA, 14 nt, Homo sapiens
ggcaggaaagccac

SEQ ID NO: 1349672 - RNA, 17 nt, Homo sapiens
ggcaggacuccuggcag

SEQ ID NO: 1349673 - RNA, 20 nt, Homo sapiens
ggcaggagaaucacuugaac

SEQ ID NO: 1349674 - RNA, 12 nt, Homo sapiens
ggcaggcagcug

SEQ ID NO: 1349675 - RNA, 18 nt, Homo sapiens
ggcagggaccuaaaggga

SEQ ID NO: 1349676 - RNA, 18 nt, Homo sapiens
ggcaggggaggccaucug

SEQ ID NO: 1349677 - RNA, 15 nt, Homo sapiens
ggcaggucacuuuac

SEQ ID NO: 1349678 - RNA, 15 nt, Homo sapiens
ggcaguggcagggga

SEQ ID NO: 1349679 - RNA, 14 nt, Homo sapiens
ggcaguguuccuug

SEQ ID NO: 1349680 - RNA, 22 nt, Homo sapiens
ggcaucaagggagacaccagug

SEQ ID NO: 1349681 - RNA, 17 nt, Homo sapiens
ggcauccaaggcaaaca

SEQ ID NO: 1349682 - RNA, 15 nt, Homo sapiens
ggccaacugcaaaaa

SEQ ID NO: 1349683 - RNA, 18 nt, Homo sapiens
ggccaagcaccuagccuc

SEQ ID NO: 1349684 - RNA, 22 nt, Homo sapiens
ggccagagagggcgugggcgcu

SEQ ID NO: 1349685 - RNA, 17 nt, Homo sapiens
gucucuacccaguagau

SEQ ID NO: 1349686 - RNA, 22 nt, Homo sapiens
gucucuacccaguagaugccac

SEQ ID NO: 1349687 - RNA, 16 nt, Homo sapiens
gucucucuccagguca

SEQ ID NO: 1349688 - RNA, 19 nt, Homo sapiens
gucucugauuaguugacag

SEQ ID NO: 1349689 - RNA, 15 nt, Homo sapiens
gucugauaaacugac

SEQ ID NO: 1349690 - RNA, 15 nt, Homo sapiens
gucugggcaccaccu

SEQ ID NO: 1349691 - RNA, 16 nt, Homo sapiens
gucugggcaccaccuc

SEQ ID NO: 1349692 - RNA, 19 nt, Homo sapiens
gucugggcucagacaucca

SEQ ID NO: 1349693 - RNA, 21 nt, Homo sapiens
gucugggcucccugcgccuga

SEQ ID NO: 1349694 - RNA, 22 nt, Homo sapiens
gucugguaauaaaugugacuca

SEQ ID NO: 1349695 - RNA, 18 nt, Homo sapiens
gucugguguuugucaugg

SEQ ID NO: 1349696 - RNA, 16 nt, Homo sapiens
gucugguugcuaauga

SEQ ID NO: 1349697 - RNA, 18 nt, Homo sapiens
gucugugggaaggcaaau

SEQ ID NO: 1349698 - RNA, 19 nt, Homo sapiens
gucuuuccuaaggcugcaa

SEQ ID NO: 1349699 - RNA, 19 nt, Homo sapiens
gucuuucuuugucauucag

SEQ ID NO: 1349700 - RNA, 12 nt, Homo sapiens
gugaaaauaugu

SEQ ID NO: 1349701 - RNA, 13 nt, Homo sapiens
gugaaacauacaa

SEQ ID NO: 1349702 - RNA, 16 nt, Homo sapiens
gugaaaucccugccuc

SEQ ID NO: 1349703 - RNA, 21 nt, Homo sapiens
gugaacauugguucuuucauu

SEQ ID NO: 1349704 - RNA, 12 nt, Homo sapiens
gugaaccaaaga

SEQ ID NO: 1349705 - RNA, 19 nt, Homo sapiens
gugaacuagggaagcucag

SEQ ID NO: 1349706 - RNA, 19 nt, Homo sapiens
gugaagaguuucacaaauc

SEQ ID NO: 1349707 - RNA, 17 nt, Homo sapiens
gugaagcuggcugugca

SEQ ID NO: 1349708 - RNA, 23 nt, Homo sapiens
gugaagucucuggguggaagugu

SEQ ID NO: 1349709 - RNA, 23 nt, Homo sapiens
gugaaucuuugucagcaguuccc

SEQ ID NO: 1349710 - RNA, 20 nt, Homo sapiens
gugaaugacacuaaacucca

SEQ ID NO: 1349711 - RNA, 11 nt, Homo sapiens
gugaauuguga

SEQ ID NO: 1349712 - RNA, 17 nt, Homo sapiens
gugacagacuuuggaca

SEQ ID NO: 1349713 - RNA, 21 nt, Homo sapiens
gugacauuugggagacaugug

SEQ ID NO: 1349714 - RNA, 17 nt, Homo sapiens
gugaccaaaaugccaaa

SEQ ID NO: 1349715 - RNA, 19 nt, Homo sapiens
gugacucagcaucacccac

SEQ ID NO: 1349716 - RNA, 14 nt, Homo sapiens
gugaggggcaagcu

SEQ ID NO: 1349717 - RNA, 14 nt, Homo sapiens
gugaggggcucucu

SEQ ID NO: 1349718 - RNA, 22 nt, Homo sapiens
gugaguuuaccuuguauacugu

SEQ ID NO: 1349719 - RNA, 16 nt, Homo sapiens
gugauaccccaucucu

SEQ ID NO: 1349720 - RNA, 22 nt, Homo sapiens
gugauauuguguggucugguuc

SEQ ID NO: 1349721 - RNA, 22 nt, Homo sapiens
gugaugacauucccugcuaaua

SEQ ID NO: 1349722 - RNA, 13 nt, Homo sapiens
gugauucaaugaa

SEQ ID NO: 1349723 - RNA, 23 nt, Homo sapiens
gugauugacagcuuugcugcuga

SEQ ID NO: 1349724 - RNA, 18 nt, Homo sapiens
gugauuucuuucuuugca

SEQ ID NO: 1349725 - RNA, 20 nt, Homo sapiens
gugcaaaagugaaacauaca

SEQ ID NO: 1349726 - RNA, 12 nt, Homo sapiens
gugcaccaucuc

SEQ ID NO: 1349727 - RNA, 13 nt, Homo sapiens
gugcaccaucuca

SEQ ID NO: 1349728 - RNA, 22 nt, Homo sapiens
gugcaugcuuuaaaaaacacag

SEQ ID NO: 1349729 - RNA, 14 nt, Homo sapiens
gugcaugugcugug

SEQ ID NO: 1349730 - RNA, 19 nt, Homo sapiens
gugccagaggccagaccca

SEQ ID NO: 1349731 - RNA, 21 nt, Homo sapiens
gugcccagggcucuaaugugu

SEQ ID NO: 1349732 - RNA, 17 nt, Homo sapiens
gugccgcugucucugag

SEQ ID NO: 1349733 - RNA, 13 nt, Homo sapiens
gugccuaucugcc

SEQ ID NO: 1349734 - RNA, 12 nt, Homo sapiens
gugccuccagau

SEQ ID NO: 1349735 - RNA, 22 nt, Homo sapiens
gugccucugggacuggacaauu

SEQ ID NO: 1349736 - RNA, 14 nt, Homo sapiens
gugccuugccacau

SEQ ID NO: 1349737 - RNA, 18 nt, Homo sapiens
gugccuuggugugcugua

SEQ ID NO: 1349738 - RNA, 15 nt, Homo sapiens
gugcggcggucccag

SEQ ID NO: 1349739 - RNA, 13 nt, Homo sapiens
gugcuacaaaaac

SEQ ID NO: 1349740 - RNA, 14 nt, Homo sapiens
gugcucacaaagga

SEQ ID NO: 1349741 - RNA, 23 nt, Homo sapiens
gugcugcagauuugauauuugca

SEQ ID NO: 1349742 - RNA, 19 nt, Homo sapiens
gugcuggaauuacaggcgu

SEQ ID NO: 1349743 - RNA, 15 nt, Homo sapiens
gugcuggggcacggc

SEQ ID NO: 1349744 - RNA, 15 nt, Homo sapiens
gugcuguuuugccag

SEQ ID NO: 1349745 - RNA, 22 nt, Homo sapiens
gugcuuucccagucccauuccu

SEQ ID NO: 1349746 - RNA, 19 nt, Homo sapiens
guggaaaacgaagcucauu

SEQ ID NO: 1349747 - RNA, 12 nt, Homo sapiens
guggaaagucag

SEQ ID NO: 1349748 - RNA, 15 nt, Homo sapiens
guggaagcuucuaaa

SEQ ID NO: 1349749 - RNA, 22 nt, Homo sapiens
guggaaugccgcugucucugag

SEQ ID NO: 1349750 - RNA, 14 nt, Homo sapiens
guggacacaacagc

SEQ ID NO: 1349751 - RNA, 15 nt, Homo sapiens
guggaccuggacaaa

SEQ ID NO: 1349752 - RNA, 20 nt, Homo sapiens
guggacguggguugcacugg

SEQ ID NO: 1349753 - RNA, 14 nt, Homo sapiens
guggacugugcugg

SEQ ID NO: 1349754 - RNA, 21 nt, Homo sapiens
guggagagaaagugacaugca

SEQ ID NO: 1349755 - RNA, 18 nt, Homo sapiens
guggagggcucugccuau

SEQ ID NO: 1349756 - RNA, 21 nt, Homo sapiens
guggauauuaaaaaucuguaa

SEQ ID NO: 1349757 - RNA, 23 nt, Homo sapiens
guggccaaggagcugcuauagcc

SEQ ID NO: 1349758 - RNA, 14 nt, Homo sapiens
guggccacuaagca

SEQ ID NO: 1349759 - RNA, 21 nt, Homo sapiens
guggcccugccuggcuagucc

SEQ ID NO: 1349760 - RNA, 20 nt, Homo sapiens
guggccucugcaggccuagg

SEQ ID NO: 1349761 - RNA, 20 nt, Homo sapiens
guggcugccccggccuccuc

SEQ ID NO: 1349762 - RNA, 22 nt, Homo sapiens
guggcuggaucugugaggggcu

SEQ ID NO: 1349763 - RNA, 15 nt, Homo sapiens
guggcuucacagacc

SEQ ID NO: 1349764 - RNA, 23 nt, Homo sapiens
gugggggugccgcuuucucugag

SEQ ID NO: 1349765 - RNA, 20 nt, Homo sapiens
gugggggugcucucucugag

SEQ ID NO: 1349766 - RNA, 15 nt, Homo sapiens
guggguaauuguaca

SEQ ID NO: 1349767 - RNA, 18 nt, Homo sapiens
guggucaguaguuucauu

SEQ ID NO: 1349768 - RNA, 20 nt, Homo sapiens
guggugcagugugugaaaau

SEQ ID NO: 1349769 - RNA, 23 nt, Homo sapiens
guggugggcccugaugcugccag

SEQ ID NO: 1349770 - RNA, 22 nt, Homo sapiens
gugguuaggcagcaagcuuugg

SEQ ID NO: 1349771 - RNA, 12 nt, Homo sapiens
guguacaaugug

SEQ ID NO: 1349772 - RNA, 16 nt, Homo sapiens
guguacacgugacaga

SEQ ID NO: 1349773 - RNA, 12 nt, Homo sapiens
guguacugccuu

SEQ ID NO: 1349774 - RNA, 13 nt, Homo sapiens
guguagauuucau

SEQ ID NO: 1349775 - RNA, 13 nt, Homo sapiens
guguauccaugca

SEQ ID NO: 1349776 - RNA, 23 nt, Homo sapiens
gugucaccccucacugugacuga

SEQ ID NO: 1349777 - RNA, 18 nt, Homo sapiens
gugucauauacaauuguc

SEQ ID NO: 1349778 - RNA, 21 nt, Homo sapiens
gugugaucuuaauauauuuga

SEQ ID NO: 1349779 - RNA, 22 nt, Homo sapiens
gugugcaugaagaaaagacacu

SEQ ID NO: 1349780 - RNA, 16 nt, Homo sapiens
gugugggaguguguaa

SEQ ID NO: 1349781 - RNA, 19 nt, Homo sapiens
guguguccaaaacugccuc

SEQ ID NO: 1349782 - RNA, 17 nt, Homo sapiens
guguuaauuuugcuaac

SEQ ID NO: 1349783 - RNA, 15 nt, Homo sapiens
guuaaaaaaauggaa

SEQ ID NO: 1349784 - RNA, 18 nt, Homo sapiens
guuaaauauuuugcuaac

SEQ ID NO: 1349785 - RNA, 15 nt, Homo sapiens
guuaaauucaaugua

SEQ ID NO: 1349786 - RNA, 22 nt, Homo sapiens
guuaaauugaauaaaauacucu

SEQ ID NO: 1349787 - RNA, 14 nt, Homo sapiens
guuaaucacaggau

SEQ ID NO: 1349788 - RNA, 14 nt, Homo sapiens
guuacagaccucag

SEQ ID NO: 1349789 - RNA, 14 nt, Homo sapiens
guuaccucugcaug

SEQ ID NO: 1349790 - RNA, 16 nt, Homo sapiens
guuaccucugcaugga

SEQ ID NO: 1349791 - RNA, 13 nt, Homo sapiens
guuacuuaauuca

SEQ ID NO: 1349792 - RNA, 23 nt, Homo sapiens
guuaguucaauccugauucauau

SEQ ID NO: 1349793 - RNA, 22 nt, Homo sapiens
guuauaauaauguuaacaugga

SEQ ID NO: 1349794 - RNA, 15 nt, Homo sapiens
guuauauuacuugcc

SEQ ID NO: 1349795 - RNA, 13 nt, Homo sapiens
guuaucuaaugau

SEQ ID NO: 1349796 - RNA, 14 nt, Homo sapiens
guuauuuaugcuau

SEQ ID NO: 1349797 - RNA, 19 nt, Homo sapiens
guuauuuauuccccaguga

SEQ ID NO: 1349798 - RNA, 23 nt, Homo sapiens
guuauuugaaaauuugauuuuga

SEQ ID NO: 1349799 - RNA, 18 nt, Homo sapiens
guucacuggacacuucac

SEQ ID NO: 1349800 - RNA, 14 nt, Homo sapiens
guucagcugcccca

SEQ ID NO: 1349801 - RNA, 14 nt, Homo sapiens
guucagggucauag

SEQ ID NO: 1349802 - RNA, 22 nt, Homo sapiens
guucccagcaggaauuucuuuu

SEQ ID NO: 1349803 - RNA, 14 nt, Homo sapiens
guucccugugucau

SEQ ID NO: 1349804 - RNA, 16 nt, Homo sapiens
guuccuggugacuccu

SEQ ID NO: 1349805 - RNA, 12 nt, Homo sapiens
guuccuuauaua

SEQ ID NO: 1349806 - RNA, 15 nt, Homo sapiens
guucuaggcauacuu

SEQ ID NO: 1349807 - RNA, 19 nt, Homo sapiens
guucucauaacucugugau

SEQ ID NO: 1349808 - RNA, 20 nt, Homo sapiens
guucucauaacucugugauc

SEQ ID NO: 1349809 - RNA, 15 nt, Homo sapiens
guucuguuggaugac

SEQ ID NO: 1349810 - RNA, 16 nt, Homo sapiens
guucuuacaaaccaua

SEQ ID NO: 1349811 - RNA, 13 nt, Homo sapiens
guucuuagagugu

SEQ ID NO: 1349812 - RNA, 15 nt, Homo sapiens
guucuuucaucuccc

SEQ ID NO: 1349813 - RNA, 20 nt, Homo sapiens
guucuuucaucucccuccuc

SEQ ID NO: 1349814 - RNA, 18 nt, Homo sapiens
guucuuugucacagggac

SEQ ID NO: 1349815 - RNA, 16 nt, Homo sapiens
guugaauuucccacau

SEQ ID NO: 1349816 - RNA, 23 nt, Homo sapiens
guugaauuucccacauacccucc

SEQ ID NO: 1349817 - RNA, 21 nt, Homo sapiens
uggguauuuuucaaaugcuuu

SEQ ID NO: 1349818 - RNA, 14 nt, Homo sapiens
ugggucaguuguau

SEQ ID NO: 1349819 - RNA, 22 nt, Homo sapiens
uggguccucgcugcuggcugcu

SEQ ID NO: 1349820 - RNA, 17 nt, Homo sapiens
uggguuggacaaccuca

SEQ ID NO: 1349821 - RNA, 15 nt, Homo sapiens
ugguaaaaguauuug

SEQ ID NO: 1349822 - RNA, 16 nt, Homo sapiens
ugguaaggcuggugag

SEQ ID NO: 1349823 - RNA, 20 nt, Homo sapiens
ugguaauaaaugugacucag

SEQ ID NO: 1349824 - RNA, 20 nt, Homo sapiens
ugguacuccacauauuucag

SEQ ID NO: 1349825 - RNA, 19 nt, Homo sapiens
ugguacucccaaacugaca

SEQ ID NO: 1349826 - RNA, 20 nt, Homo sapiens
ugguacucccaaacugacaa

SEQ ID NO: 1349827 - RNA, 18 nt, Homo sapiens
ugguacuguagcagggga

SEQ ID NO: 1349828 - RNA, 12 nt, Homo sapiens
ugguauucauua

SEQ ID NO: 1349829 - RNA, 12 nt, Homo sapiens
uggucacuguca

SEQ ID NO: 1349830 - RNA, 14 nt, Homo sapiens
uggucacugucagu

SEQ ID NO: 1349831 - RNA, 14 nt, Homo sapiens
ugguccucagggga

SEQ ID NO: 1349832 - RNA, 19 nt, Homo sapiens
uggucugccuucugcugaa

SEQ ID NO: 1349833 - RNA, 20 nt, Homo sapiens
uggucuguggaucagcauuu

SEQ ID NO: 1349834 - RNA, 14 nt, Homo sapiens
uggugacauugcac

SEQ ID NO: 1349835 - RNA, 16 nt, Homo sapiens
uggugaccuuucacga

SEQ ID NO: 1349836 - RNA, 19 nt, Homo sapiens
uggugauauuguguggucu

SEQ ID NO: 1349837 - RNA, 17 nt, Homo sapiens
uggugcaaucacagcuc

SEQ ID NO: 1349838 - RNA, 13 nt, Homo sapiens
uggugcacugagc

SEQ ID NO: 1349839 - RNA, 23 nt, Homo sapiens
uggugcucaucuucucuugucau

SEQ ID NO: 1349840 - RNA, 20 nt, Homo sapiens
ugguggcaacauucauugcc

SEQ ID NO: 1349841 - RNA, 19 nt, Homo sapiens
uggugggcccccaaugaca

SEQ ID NO: 1349842 - RNA, 18 nt, Homo sapiens
ugguggugacucauuucc

SEQ ID NO: 1349843 - RNA, 23 nt, Homo sapiens
ugguguucuguuucaauguauaa

SEQ ID NO: 1349844 - RNA, 21 nt, Homo sapiens
ugguuaaaaaccaacugugaa

SEQ ID NO: 1349845 - RNA, 17 nt, Homo sapiens
ugguuaaacauuaauau

SEQ ID NO: 1349846 - RNA, 21 nt, Homo sapiens
ugguuacauaucaaaacaucc

SEQ ID NO: 1349847 - RNA, 20 nt, Homo sapiens
ugguuaggcagcaagcuuug

SEQ ID NO: 1349848 - RNA, 23 nt, Homo sapiens
ugguuucacaugguuacauauca

SEQ ID NO: 1349849 - RNA, 21 nt, Homo sapiens
ugguuugccugaggcuguaac

SEQ ID NO: 1349850 - RNA, 19 nt, Homo sapiens
uguaaaaauguuacgugaa

SEQ ID NO: 1349851 - RNA, 21 nt, Homo sapiens
uguaaauccuagacuugaaag

SEQ ID NO: 1349852 - RNA, 12 nt, Homo sapiens
uguaacaaugua

SEQ ID NO: 1349853 - RNA, 15 nt, Homo sapiens
uguaacuuccugcug

SEQ ID NO: 1349854 - RNA, 23 nt, Homo sapiens
uguaagaucguucucugccucac

SEQ ID NO: 1349855 - RNA, 16 nt, Homo sapiens
uguaauaaacucucua

SEQ ID NO: 1349856 - RNA, 16 nt, Homo sapiens
uguaaucucagcacuu

SEQ ID NO: 1349857 - RNA, 13 nt, Homo sapiens
uguacacagaauu

SEQ ID NO: 1349858 - RNA, 22 nt, Homo sapiens
uguacugagcacugaaccacau

SEQ ID NO: 1349859 - RNA, 13 nt, Homo sapiens
uguacugccuuaa

SEQ ID NO: 1349860 - RNA, 19 nt, Homo sapiens
uguagagccccuacugugg

SEQ ID NO: 1349861 - RNA, 14 nt, Homo sapiens
uguagauaacacug

SEQ ID NO: 1349862 - RNA, 17 nt, Homo sapiens
uguagaugacaaccucc

SEQ ID NO: 1349863 - RNA, 23 nt, Homo sapiens
uguagcaaagcacauagagccag

SEQ ID NO: 1349864 - RNA, 13 nt, Homo sapiens
uguagccagguac

SEQ ID NO: 1349865 - RNA, 17 nt, Homo sapiens
uguagcuguaagggcag

SEQ ID NO: 1349866 - RNA, 15 nt, Homo sapiens
uguagcuuugcucuu

SEQ ID NO: 1349867 - RNA, 23 nt, Homo sapiens
uguagcuuugcucuuugguagaa

SEQ ID NO: 1349868 - RNA, 12 nt, Homo sapiens
uguaggccucag

SEQ ID NO: 1349869 - RNA, 17 nt, Homo sapiens
uguaguccgugcugaca

SEQ ID NO: 1349870 - RNA, 14 nt, Homo sapiens
uguauacagaauga

SEQ ID NO: 1349871 - RNA, 22 nt, Homo sapiens
uguauauccauauaacaauuca

SEQ ID NO: 1349872 - RNA, 18 nt, Homo sapiens
uguauauuuuuauauugu

SEQ ID NO: 1349873 - RNA, 14 nt, Homo sapiens
uguaucaaacugua

SEQ ID NO: 1349874 - RNA, 18 nt, Homo sapiens
uguauugcucuuuaucug

SEQ ID NO: 1349875 - RNA, 22 nt, Homo sapiens
uguauuuucuuacacuguguca

SEQ ID NO: 1349876 - RNA, 20 nt, Homo sapiens
ugucaagaauagcauuguaa

SEQ ID NO: 1349877 - RNA, 19 nt, Homo sapiens
ugucaagacaaggucuugc

SEQ ID NO: 1349878 - RNA, 12 nt, Homo sapiens
ugucacagggac

SEQ ID NO: 1349879 - RNA, 16 nt, Homo sapiens
ugucagccacugugau

SEQ ID NO: 1349880 - RNA, 17 nt, Homo sapiens
ugucagccacugugaua

SEQ ID NO: 1349881 - RNA, 13 nt, Homo sapiens
ugucaguauuuca

SEQ ID NO: 1349882 - RNA, 11 nt, Homo sapiens
ugucaguucuc

SEQ ID NO: 1349883 - RNA, 17 nt, Homo sapiens
ugucauauacaauuguc

SEQ ID NO: 1349884 - RNA, 15 nt, Homo sapiens
ugucaugcugucagu

SEQ ID NO: 1349885 - RNA, 17 nt, Homo sapiens
ugucauguuaugcagug

SEQ ID NO: 1349886 - RNA, 19 nt, Homo sapiens
ugucauguuaugcagugaa

SEQ ID NO: 1349887 - RNA, 20 nt, Homo sapiens
uguccaggcuggagugcaau

SEQ ID NO: 1349888 - RNA, 17 nt, Homo sapiens
uguccagugagcagugu

SEQ ID NO: 1349889 - RNA, 15 nt, Homo sapiens
uguccaguugcagcu

SEQ ID NO: 1349890 - RNA, 18 nt, Homo sapiens
ugucccagaaugccuccu

SEQ ID NO: 1349891 - RNA, 12 nt, Homo sapiens
ugucccuaguaa

SEQ ID NO: 1349892 - RNA, 15 nt, Homo sapiens
ugucccucauccaua

SEQ ID NO: 1349893 - RNA, 16 nt, Homo sapiens
ugucccucuguauacu

SEQ ID NO: 1349894 - RNA, 23 nt, Homo sapiens
uguccucacggcuggauuucucu

SEQ ID NO: 1349895 - RNA, 15 nt, Homo sapiens
uguccuccaagccag

SEQ ID NO: 1349896 - RNA, 18 nt, Homo sapiens
uguccucuuugugauaau

SEQ ID NO: 1349897 - RNA, 22 nt, Homo sapiens
uguccugggccugccccugugu

SEQ ID NO: 1349898 - RNA, 16 nt, Homo sapiens
ugucgccucugcauuc

SEQ ID NO: 1349899 - RNA, 19 nt, Homo sapiens
ugucucaggccacaccggc

SEQ ID NO: 1349900 - RNA, 18 nt, Homo sapiens
ugucuccacggccugccc

SEQ ID NO: 1349901 - RNA, 23 nt, Homo sapiens
ugucuccuuugaaguagacucau

SEQ ID NO: 1349902 - RNA, 14 nt, Homo sapiens
ugucucuccaguga

SEQ ID NO: 1349903 - RNA, 17 nt, Homo sapiens
ugucugauuuuggccau

SEQ ID NO: 1349904 - RNA, 17 nt, Homo sapiens
ugucugcucaguaauuu

SEQ ID NO: 1349905 - RNA, 21 nt, Homo sapiens
ugucuuaauuaaaagaauauu

SEQ ID NO: 1349906 - RNA, 22 nt, Homo sapiens
ugucuugucauacaaauuuaua

SEQ ID NO: 1349907 - RNA, 17 nt, Homo sapiens
ugugaaaugcuuuuaua

SEQ ID NO: 1349908 - RNA, 21 nt, Homo sapiens
ugugaaaugcuuuuauauucu

SEQ ID NO: 1349909 - RNA, 15 nt, Homo sapiens
ugugaacacaucagc

SEQ ID NO: 1349910 - RNA, 20 nt, Homo sapiens
ugugaaggcaggggaaugua

SEQ ID NO: 1349911 - RNA, 18 nt, Homo sapiens
ugugaaguucaucuugca

SEQ ID NO: 1349912 - RNA, 17 nt, Homo sapiens
ugugaauuaggcuguaa

SEQ ID NO: 1349913 - RNA, 11 nt, Homo sapiens
ugugacauuua

SEQ ID NO: 1349914 - RNA, 18 nt, Homo sapiens
ugugacauuuuacauuaa

SEQ ID NO: 1349915 - RNA, 20 nt, Homo sapiens
ugugaccagucugacccuua

SEQ ID NO: 1349916 - RNA, 21 nt, Homo sapiens
ugugacguuuuuccaguucac

SEQ ID NO: 1349917 - RNA, 15 nt, Homo sapiens
ugugacucagcauca

SEQ ID NO: 1349918 - RNA, 23 nt, Homo sapiens
ugugacuccuuaucucuuuccac

SEQ ID NO: 1349919 - RNA, 14 nt, Homo sapiens
ugugagacuguaag

SEQ ID NO: 1349920 - RNA, 13 nt, Homo sapiens
ugugagcacaaag

SEQ ID NO: 1349921 - RNA, 15 nt, Homo sapiens
ugugagcacaaagaa

SEQ ID NO: 1349922 - RNA, 17 nt, Homo sapiens
ugugaguuuccacugca

SEQ ID NO: 1349923 - RNA, 20 nt, Homo sapiens
ugugauauauaaguguacau

SEQ ID NO: 1349924 - RNA, 12 nt, Homo sapiens
ugugauaugauu

SEQ ID NO: 1349925 - RNA, 17 nt, Homo sapiens
ugugauuuuuaucacaa

SEQ ID NO: 1349926 - RNA, 15 nt, Homo sapiens
ugugcaccuuuacac

SEQ ID NO: 1349927 - RNA, 21 nt, Homo sapiens
ugugccaagagcuacucccac

SEQ ID NO: 1349928 - RNA, 18 nt, Homo sapiens
ugugcucaauguguaaau

SEQ ID NO: 1349929 - RNA, 22 nt, Homo sapiens
ugugcuccuccuacccuuccag

SEQ ID NO: 1349930 - RNA, 20 nt, Homo sapiens
ugugcucuggcaccaucagc

SEQ ID NO: 1349931 - RNA, 21 nt, Homo sapiens
uguggaacauaaaaaggacau

SEQ ID NO: 1349932 - RNA, 21 nt, Homo sapiens
uguggcacucagggagcauuu

SEQ ID NO: 1349933 - RNA, 19 nt, Homo sapiens
uguggccaacugcaaaaaa

SEQ ID NO: 1349934 - RNA, 22 nt, Homo sapiens
uguggccaggccuuacaucugg

SEQ ID NO: 1349935 - RNA, 14 nt, Homo sapiens
uguggccaucugcu

SEQ ID NO: 1349936 - RNA, 13 nt, Homo sapiens
ugugggacugaga

SEQ ID NO: 1349937 - RNA, 14 nt, Homo sapiens
ugugggacugagug

SEQ ID NO: 1349938 - RNA, 23 nt, Homo sapiens
uguggggccucaggcuccgggca

SEQ ID NO: 1349939 - RNA, 14 nt, Homo sapiens
uguggguaccugua

SEQ ID NO: 1349940 - RNA, 18 nt, Homo sapiens
uguggguguacauuuugu

SEQ ID NO: 1349941 - RNA, 20 nt, Homo sapiens
ugugguccacugagcuauaa

SEQ ID NO: 1349942 - RNA, 14 nt, Homo sapiens
uguggugaggggcu

SEQ ID NO: 1349943 - RNA, 13 nt, Homo sapiens
ugugguuguaaau

SEQ ID NO: 1349944 - RNA, 19 nt, Homo sapiens
uguguaagaaauacagacu

SEQ ID NO: 1349945 - RNA, 21 nt, Homo sapiens
uguguauagaacuggauuuuc

SEQ ID NO: 1349946 - RNA, 23 nt, Homo sapiens
uguguauccaugcaccuaccuua

SEQ ID NO: 1349947 - RNA, 17 nt, Homo sapiens
uguguauugagauuuac

SEQ ID NO: 1349948 - RNA, 16 nt, Homo sapiens
ugugugcaugugcugu

SEQ ID NO: 1349949 - RNA, 21 nt, Homo sapiens
uucuguuggaugacuuugaga

SEQ ID NO: 1349950 - RNA, 12 nt, Homo sapiens
uucuuacacugu

SEQ ID NO: 1349951 - RNA, 16 nt, Homo sapiens
uucuuagaguguagcu

SEQ ID NO: 1349952 - RNA, 21 nt, Homo sapiens
uucuucugaagaucagaacau

SEQ ID NO: 1349953 - RNA, 19 nt, Homo sapiens
uucuugucccucuguauac

SEQ ID NO: 1349954 - RNA, 22 nt, Homo sapiens
uucuugucccucuguauacuga

SEQ ID NO: 1349955 - RNA, 15 nt, Homo sapiens
uucuuuaaccaaaca

SEQ ID NO: 1349956 - RNA, 19 nt, Homo sapiens
uucuuuaaccaaacaauau

SEQ ID NO: 1349957 - RNA, 17 nt, Homo sapiens
uucuuuaagucaguuca

SEQ ID NO: 1349958 - RNA, 17 nt, Homo sapiens
uucuuucuuaaccacuu

SEQ ID NO: 1349959 - RNA, 16 nt, Homo sapiens
uucuuugcaccaaaga

SEQ ID NO: 1349960 - RNA, 11 nt, Homo sapiens
uucuuugccau

SEQ ID NO: 1349961 - RNA, 12 nt, Homo sapiens
uucuuugccucu

SEQ ID NO: 1349962 - RNA, 17 nt, Homo sapiens
uugaaaaaagcugaauu

SEQ ID NO: 1349963 - RNA, 13 nt, Homo sapiens
uugaaaaugggcu

SEQ ID NO: 1349964 - RNA, 13 nt, Homo sapiens
uugaaagaaccag

SEQ ID NO: 1349965 - RNA, 14 nt, Homo sapiens
uugaaagaaccaga

SEQ ID NO: 1349966 - RNA, 15 nt, Homo sapiens
uugaaagaaccagag

SEQ ID NO: 1349967 - RNA, 14 nt, Homo sapiens
uugaaauccaggaa

SEQ ID NO: 1349968 - RNA, 12 nt, Homo sapiens
uugaaaugucaa

SEQ ID NO: 1349969 - RNA, 21 nt, Homo sapiens
uugaacaagaugugggccuug

SEQ ID NO: 1349970 - RNA, 13 nt, Homo sapiens
uugaagauucuau

SEQ ID NO: 1349971 - RNA, 22 nt, Homo sapiens
uugaaggguguugcacccuuuu

SEQ ID NO: 1349972 - RNA, 18 nt, Homo sapiens
uugaagguggcuacaaag

SEQ ID NO: 1349973 - RNA, 16 nt, Homo sapiens
uugaauucauuucacu

SEQ ID NO: 1349974 - RNA, 19 nt, Homo sapiens
uugaauuucugccaggcau

SEQ ID NO: 1349975 - RNA, 13 nt, Homo sapiens
uugacaacauguu

SEQ ID NO: 1349976 - RNA, 12 nt, Homo sapiens
uugacugcauug

SEQ ID NO: 1349977 - RNA, 20 nt, Homo sapiens
uugacuuagaauaaugaagg

SEQ ID NO: 1349978 - RNA, 15 nt, Homo sapiens
uugacuuuccagaau

SEQ ID NO: 1349979 - RNA, 11 nt, Homo sapiens
uugacuuuguc

SEQ ID NO: 1349980 - RNA, 20 nt, Homo sapiens
uugagaaccagucuccucac

SEQ ID NO: 1349981 - RNA, 18 nt, Homo sapiens
uugagagauaaaaagcua

SEQ ID NO: 1349982 - RNA, 14 nt, Homo sapiens
uugagaucagucuu

SEQ ID NO: 1349983 - RNA, 13 nt, Homo sapiens
uugagauggaguu

SEQ ID NO: 1349984 - RNA, 17 nt, Homo sapiens
uugagcuguggcuguga

SEQ ID NO: 1349985 - RNA, 14 nt, Homo sapiens
uugagcuucugggg

SEQ ID NO: 1349986 - RNA, 18 nt, Homo sapiens
uugaggaaacaacagcuu

SEQ ID NO: 1349987 - RNA, 21 nt, Homo sapiens
uugaggacaaccauuccagac

SEQ ID NO: 1349988 - RNA, 18 nt, Homo sapiens
uugaggggcccuggccag

SEQ ID NO: 1349989 - RNA, 16 nt, Homo sapiens
uugaggguccucaguc

SEQ ID NO: 1349990 - RNA, 21 nt, Homo sapiens
uugagggugggggugcucucu

SEQ ID NO: 1349991 - RNA, 16 nt, Homo sapiens
uugaggugaaaugggg

SEQ ID NO: 1349992 - RNA, 13 nt, Homo sapiens
uugaggugcaagg

SEQ ID NO: 1349993 - RNA, 22 nt, Homo sapiens
uugaguuaaugugcugagcauu

SEQ ID NO: 1349994 - RNA, 19 nt, Homo sapiens
uugauaggauguggauuaa

SEQ ID NO: 1349995 - RNA, 16 nt, Homo sapiens
uugauauuugcauuga

SEQ ID NO: 1349996 - RNA, 21 nt, Homo sapiens
uugaucuggaacccagacuca

SEQ ID NO: 1349997 - RNA, 15 nt, Homo sapiens
uugauguuuucacaa

SEQ ID NO: 1349998 - RNA, 17 nt, Homo sapiens
uugauuaaccuuuucaa

SEQ ID NO: 1349999 - RNA, 23 nt, Homo sapiens
uugauuaaccuuuucaaauuaau

SEQ ID NO: 1350000 - RNA, 12 nt, Homo sapiens
uugauucuugcc

SEQ ID NO: 1350001 - RNA, 17 nt, Homo sapiens
uugauuuguacagauuc

SEQ ID NO: 1350002 - RNA, 19 nt, Homo sapiens
uugauuuuaauccuguaua

SEQ ID NO: 1350003 - RNA, 21 nt, Homo sapiens
uugcaagauuccaaguucuca

SEQ ID NO: 1350004 - RNA, 18 nt, Homo sapiens
uugcacaggucccacugc

SEQ ID NO: 1350005 - RNA, 18 nt, Homo sapiens
uugcaccaaagacaucag

SEQ ID NO: 1350006 - RNA, 17 nt, Homo sapiens
uugcagauaacuuugac

SEQ ID NO: 1350007 - RNA, 18 nt, Homo sapiens
uugcagccagggccagug

SEQ ID NO: 1350008 - RNA, 16 nt, Homo sapiens
uugcaguuuacaguau

SEQ ID NO: 1350009 - RNA, 18 nt, Homo sapiens
uugcaguuuacaguauuu

SEQ ID NO: 1350010 - RNA, 20 nt, Homo sapiens
uugcauucguaaacaccaaa

SEQ ID NO: 1350011 - RNA, 16 nt, Homo sapiens
uugcauuuccucaggu

SEQ ID NO: 1350012 - RNA, 20 nt, Homo sapiens
uugcccaggcuagagugcaa

SEQ ID NO: 1350013 - RNA, 18 nt, Homo sapiens
uugccuaacuaacuggca

SEQ ID NO: 1350014 - RNA, 21 nt, Homo sapiens
uugccucuucuuugugccuuu

SEQ ID NO: 1350015 - RNA, 16 nt, Homo sapiens
uugcuaaaauauaauu

SEQ ID NO: 1350016 - RNA, 14 nt, Homo sapiens
uugcucaguuccau

SEQ ID NO: 1350017 - RNA, 13 nt, Homo sapiens
uugcucuuuggua

SEQ ID NO: 1350018 - RNA, 20 nt, Homo sapiens
uugcugccuuaaugacauuc

SEQ ID NO: 1350019 - RNA, 17 nt, Homo sapiens
uugcuuaaaauugugag

SEQ ID NO: 1350020 - RNA, 17 nt, Homo sapiens
uugcuugggacauugca

SEQ ID NO: 1350021 - RNA, 18 nt, Homo sapiens
uugcuugggacauugcaa

SEQ ID NO: 1350022 - RNA, 14 nt, Homo sapiens
uugcuuuaaaacaa

SEQ ID NO: 1350023 - RNA, 17 nt, Homo sapiens
uuggaaagacuucucaa

SEQ ID NO: 1350024 - RNA, 14 nt, Homo sapiens
uuggaagauggcau

SEQ ID NO: 1350025 - RNA, 20 nt, Homo sapiens
uuggaagugaaaacuuugua

SEQ ID NO: 1350026 - RNA, 19 nt, Homo sapiens
uuggaauacacaugcagga

SEQ ID NO: 1350027 - RNA, 15 nt, Homo sapiens
uuggaauauuccacu

SEQ ID NO: 1350028 - RNA, 19 nt, Homo sapiens
uuggaauggcugagcaaau

SEQ ID NO: 1350029 - RNA, 19 nt, Homo sapiens
uuggagcuaaaacuggccc

SEQ ID NO: 1350030 - RNA, 12 nt, Homo sapiens
uuggaguuuucu

SEQ ID NO: 1350031 - RNA, 20 nt, Homo sapiens
uuggauacauacaccagcau

SEQ ID NO: 1350032 - RNA, 17 nt, Homo sapiens
uuggauguaaaacugaa

SEQ ID NO: 1350033 - RNA, 15 nt, Homo sapiens
uuggauugggguccc

SEQ ID NO: 1350034 - RNA, 23 nt, Homo sapiens
uuggcaauaaauaaagcuuggga

SEQ ID NO: 1350035 - RNA, 16 nt, Homo sapiens
uuggcagcucuacucu

SEQ ID NO: 1350036 - RNA, 23 nt, Homo sapiens
uuggcagcucuacucuggagguu

SEQ ID NO: 1350037 - RNA, 22 nt, Homo sapiens
uuggcauugcugcauauuugac

SEQ ID NO: 1350038 - RNA, 17 nt, Homo sapiens
uuggcuccauaucauuu

SEQ ID NO: 1350039 - RNA, 23 nt, Homo sapiens
uuggcucccgggggccccaccuc

SEQ ID NO: 1350040 - RNA, 18 nt, Homo sapiens
uuggcuuuaugcaaauac

SEQ ID NO: 1350041 - RNA, 22 nt, Homo sapiens
uugggaaaaccuucugccucau

SEQ ID NO: 1350042 - RNA, 15 nt, Homo sapiens
uugggacagccauuu

SEQ ID NO: 1350043 - RNA, 15 nt, Homo sapiens
uugggauaguguucu

SEQ ID NO: 1350044 - RNA, 21 nt, Homo sapiens
uugggauauucugaaacuuga

SEQ ID NO: 1350045 - RNA, 13 nt, Homo sapiens
uugggauuuuucu

SEQ ID NO: 1350046 - RNA, 16 nt, Homo sapiens
uugggccagacaugcc

SEQ ID NO: 1350047 - RNA, 14 nt, Homo sapiens
uugggcccaggacu

SEQ ID NO: 1350048 - RNA, 21 nt, Homo sapiens
uugggcguuugaacucaggga

SEQ ID NO: 1350049 - RNA, 23 nt, Homo sapiens
uuggguucacagcgugcuaaaau

SEQ ID NO: 1350050 - RNA, 13 nt, Homo sapiens
uuggguucacuca

SEQ ID NO: 1350051 - RNA, 23 nt, Homo sapiens
uugguagcaauuggcagcccuau

SEQ ID NO: 1350052 - RNA, 18 nt, Homo sapiens
uuggugacaaaauucauu

SEQ ID NO: 1350053 - RNA, 17 nt, Homo sapiens
uugguuucaaauccuuu

SEQ ID NO: 1350054 - RNA, 13 nt, Homo sapiens
uuguaaaaagccc

SEQ ID NO: 1350055 - RNA, 20 nt, Homo sapiens
uuguaaaaagcccagcacuu

SEQ ID NO: 1350056 - RNA, 22 nt, Homo sapiens
uuguacaggaacugcauugacu

SEQ ID NO: 1350057 - RNA, 14 nt, Homo sapiens
uuguagccagguac

SEQ ID NO: 1350058 - RNA, 18 nt, Homo sapiens
uuguagccagguacugca

SEQ ID NO: 1350059 - RNA, 16 nt, Homo sapiens
uuguauuuaccuucua

SEQ ID NO: 1350060 - RNA, 17 nt, Homo sapiens
uugucagcaauuuaacu

SEQ ID NO: 1350061 - RNA, 21 nt, Homo sapiens
uuguccaggcuggagugcaau

SEQ ID NO: 1350062 - RNA, 14 nt, Homo sapiens
uugucccucugccc

SEQ ID NO: 1350063 - RNA, 16 nt, Homo sapiens
uugucgguuaccucug

SEQ ID NO: 1350064 - RNA, 23 nt, Homo sapiens
uugucuaauuaaaacacuuucaa

SEQ ID NO: 1350065 - RNA, 23 nt, Homo sapiens
uugucuacuucuggagucuauaa

SEQ ID NO: 1350066 - RNA, 17 nt, Homo sapiens
uugucugagucuugggu

SEQ ID NO: 1350067 - RNA, 18 nt, Homo sapiens
uugugaauuaggcuguaa

SEQ ID NO: 1350068 - RNA, 17 nt, Homo sapiens
uugugaguuuaccuugu

SEQ ID NO: 1350069 - RNA, 20 nt, Homo sapiens
uugugaguuuaccuuguaua

SEQ ID NO: 1350070 - RNA, 22 nt, Homo sapiens
uugugauuuauuucacuuuuaa

SEQ ID NO: 1350071 - RNA, 19 nt, Homo sapiens
uugugucuuuuaaacugga

SEQ ID NO: 1350072 - RNA, 13 nt, Homo sapiens
uuguguucucaaa

SEQ ID NO: 1350073 - RNA, 14 nt, Homo sapiens
uuguguucugcucc

SEQ ID NO: 1350074 - RNA, 18 nt, Homo sapiens
uuguguuugaacagggca

SEQ ID NO: 1350075 - RNA, 12 nt, Homo sapiens
uuguuagguuuu

SEQ ID NO: 1350076 - RNA, 17 nt, Homo sapiens
uuguuccaguacuaugg

SEQ ID NO: 1350077 - RNA, 22 nt, Homo sapiens
uuguucguggagucucauggga

SEQ ID NO: 1350078 - RNA, 14 nt, Homo sapiens
uuguucuacugaga

SEQ ID NO: 1350079 - RNA, 20 nt, Homo sapiens
uuguucuuuggaaauacaca

SEQ ID NO: 1350080 - RNA, 17 nt, Homo sapiens
uuguugaaagaaaguau

SEQ ID NO: 1350081 - RNA, 13 nt, Homo sapiens
aaaaaaacuucau

SEQ ID NO: 1350082 - RNA, 12 nt, Homo sapiens
aaaaaaugacaa

SEQ ID NO: 1350083 - RNA, 23 nt, Homo sapiens
aaaaacuagacuucguacuguga

SEQ ID NO: 1350084 - RNA, 14 nt, Homo sapiens
aaaaagacagggcu

SEQ ID NO: 1350085 - RNA, 20 nt, Homo sapiens
aaaaagaugaggacucagaa

SEQ ID NO: 1350086 - RNA, 12 nt, Homo sapiens
aaaaagcaacac

SEQ ID NO: 1350087 - RNA, 13 nt, Homo sapiens
aaaaagcugcuuc

SEQ ID NO: 1350088 - RNA, 16 nt, Homo sapiens
aaaaauauauaugcau

SEQ ID NO: 1350089 - RNA, 20 nt, Homo sapiens
aaaaaugcaagccaucucua

SEQ ID NO: 1350090 - RNA, 21 nt, Homo sapiens
aaaaaugcaagccaucucuaa

SEQ ID NO: 1350091 - RNA, 11 nt, Homo sapiens
aaaaaugcacu

SEQ ID NO: 1350092 - RNA, 15 nt, Homo sapiens
aaaaauggaaauacc

SEQ ID NO: 1350093 - RNA, 15 nt, Homo sapiens
aaaaauggcagugac

SEQ ID NO: 1350094 - RNA, 12 nt, Homo sapiens
aaaaaugguacu

SEQ ID NO: 1350095 - RNA, 20 nt, Homo sapiens
aaaaaugguugauggaaaau

SEQ ID NO: 1350096 - RNA, 14 nt, Homo sapiens
aaaaauuaucuaua

SEQ ID NO: 1350097 - RNA, 13 nt, Homo sapiens
aaaaauugucauu

SEQ ID NO: 1350098 - RNA, 20 nt, Homo sapiens
aaaaauuuuagcucuuccca

SEQ ID NO: 1350099 - RNA, 11 nt, Homo sapiens
aaaacaaagca

SEQ ID NO: 1350100 - RNA, 23 nt, Homo sapiens
aaaacaggaaaggagcaaugaag

SEQ ID NO: 1350101 - RNA, 11 nt, Homo sapiens
aaaacauuucu

SEQ ID NO: 1350102 - RNA, 20 nt, Homo sapiens
aaaaccccaucucuacuaaa

SEQ ID NO: 1350103 - RNA, 13 nt, Homo sapiens
aaaacccuuucug

SEQ ID NO: 1350104 - RNA, 17 nt, Homo sapiens
aaaaccuauuccacuua

SEQ ID NO: 1350105 - RNA, 17 nt, Homo sapiens
aaaaccugaaauuccaa

SEQ ID NO: 1350106 - RNA, 11 nt, Homo sapiens
aaaacugccuc

SEQ ID NO: 1350107 - RNA, 18 nt, Homo sapiens
aaaagacaacauaacuca

SEQ ID NO: 1350108 - RNA, 15 nt, Homo sapiens
aaaagaccaguccau

SEQ ID NO: 1350109 - RNA, 12 nt, Homo sapiens
aaauaccacaug

SEQ ID NO: 1350110 - RNA, 19 nt, Homo sapiens
aaauagggaagauggagac

SEQ ID NO: 1350111 - RNA, 21 nt, Homo sapiens
aaauaguauuccaaucacugu

SEQ ID NO: 1350112 - RNA, 23 nt, Homo sapiens
aaauaguauuccaaucacugugc

SEQ ID NO: 1350113 - RNA, 23 nt, Homo sapiens
aaauaguugcugucauccacuuu

SEQ ID NO: 1350114 - RNA, 15 nt, Homo sapiens
aaauauauacuaaac

SEQ ID NO: 1350115 - RNA, 18 nt, Homo sapiens
aaauaucaaagucauuaa

SEQ ID NO: 1350116 - RNA, 19 nt, Homo sapiens
aaauauguuuggaauauuc

SEQ ID NO: 1350117 - RNA, 22 nt, Homo sapiens
aaauauguuuggaauauuccac

SEQ ID NO: 1350118 - RNA, 16 nt, Homo sapiens
aaauauuuacuauuua

SEQ ID NO: 1350119 - RNA, 12 nt, Homo sapiens
aaauauuuugcu

SEQ ID NO: 1350120 - RNA, 18 nt, Homo sapiens
aaaucaaggauaaauauc

SEQ ID NO: 1350121 - RNA, 16 nt, Homo sapiens
aaaucaaucuggugcu

SEQ ID NO: 1350122 - RNA, 22 nt, Homo sapiens
aaaucagaagucaucuugcuac

SEQ ID NO: 1350123 - RNA, 23 nt, Homo sapiens
aaaucaggacagguggugcaaau

SEQ ID NO: 1350124 - RNA, 17 nt, Homo sapiens
aaaucauauagaccaau

SEQ ID NO: 1350125 - RNA, 23 nt, Homo sapiens
aaauccaggcugguguucugucu

SEQ ID NO: 1350126 - RNA, 15 nt, Homo sapiens
aaauccagugguggg

SEQ ID NO: 1350127 - RNA, 17 nt, Homo sapiens
aaauccugaacuuucuc

SEQ ID NO: 1350128 - RNA, 14 nt, Homo sapiens
aaaucguccaggga

SEQ ID NO: 1350129 - RNA, 18 nt, Homo sapiens
aaaucuagaagaugcagu

SEQ ID NO: 1350130 - RNA, 23 nt, Homo sapiens
aaaucugaauaaauaauucuucc

SEQ ID NO: 1350131 - RNA, 23 nt, Homo sapiens
aaaucugaauaaauaauucuuuc

SEQ ID NO: 1350132 - RNA, 15 nt, Homo sapiens
aaaucugacccagug

SEQ ID NO: 1350133 - RNA, 18 nt, Homo sapiens
aaaugaaauuuaauuaca

SEQ ID NO: 1350134 - RNA, 12 nt, Homo sapiens
aaaugaacauau

SEQ ID NO: 1350135 - RNA, 15 nt, Homo sapiens
aaaugaccucaagga

SEQ ID NO: 1350136 - RNA, 23 nt, Homo sapiens
aaaugacgguguuaauuuugcua

SEQ ID NO: 1350137 - RNA, 19 nt, Homo sapiens
aaaugagccccuucauccg

SEQ ID NO: 1350138 - RNA, 20 nt, Homo sapiens
aaaugagugagagaguucag

SEQ ID NO: 1350139 - RNA, 20 nt, Homo sapiens
aaaugaugccccagagcucu

SEQ ID NO: 1350140 - RNA, 17 nt, Homo sapiens
aaaugcaagccaucucu

SEQ ID NO: 1350141 - RNA, 15 nt, Homo sapiens
aaaugccugacucag

SEQ ID NO: 1350142 - RNA, 18 nt, Homo sapiens
aaaugcucaauuucagca

SEQ ID NO: 1350143 - RNA, 18 nt, Homo sapiens
aaaugcuggcaaauccag

SEQ ID NO: 1350144 - RNA, 12 nt, Homo sapiens
aaaugcugucuu

SEQ ID NO: 1350145 - RNA, 18 nt, Homo sapiens
aaaugcuguuaguaaauu

SEQ ID NO: 1350146 - RNA, 15 nt, Homo sapiens
aaauggcagaaccaa

SEQ ID NO: 1350147 - RNA, 20 nt, Homo sapiens
aaaugggggcaggaaagcca

SEQ ID NO: 1350148 - RNA, 21 nt, Homo sapiens
aaaugggggcaggaaagccac

SEQ ID NO: 1350149 - RNA, 23 nt, Homo sapiens
aaauggguauuuguucaaaauaa

SEQ ID NO: 1350150 - RNA, 14 nt, Homo sapiens
aaauggugcugcag

SEQ ID NO: 1350151 - RNA, 15 nt, Homo sapiens
aaaugguuucacuug

SEQ ID NO: 1350152 - RNA, 15 nt, Homo sapiens
aaauguacauuucca

SEQ ID NO: 1350153 - RNA, 17 nt, Homo sapiens
aaauguauacuauagua

SEQ ID NO: 1350154 - RNA, 17 nt, Homo sapiens
aaauguaugcuuuguac

SEQ ID NO: 1350155 - RNA, 21 nt, Homo sapiens
aaaugucauguggcuaccugu

SEQ ID NO: 1350156 - RNA, 19 nt, Homo sapiens
aaauguccauuuauaucau

SEQ ID NO: 1350157 - RNA, 21 nt, Homo sapiens
aaaugugaagauggacuucau

SEQ ID NO: 1350158 - RNA, 21 nt, Homo sapiens
aaaugugucauuggaagccau

SEQ ID NO: 1350159 - RNA, 14 nt, Homo sapiens
aaauguuaugacua

SEQ ID NO: 1350160 - RNA, 16 nt, Homo sapiens
aaauuaaaucugaaua

SEQ ID NO: 1350161 - RNA, 13 nt, Homo sapiens
aaauuaaauggau

SEQ ID NO: 1350162 - RNA, 22 nt, Homo sapiens
aaauuaaugguuuauucuuugc

SEQ ID NO: 1350163 - RNA, 12 nt, Homo sapiens
aaauuacauguu

SEQ ID NO: 1350164 - RNA, 19 nt, Homo sapiens
aaauuacguuuauguacua

SEQ ID NO: 1350165 - RNA, 17 nt, Homo sapiens
aacuuuguaguaugaua

SEQ ID NO: 1350166 - RNA, 19 nt, Homo sapiens
aacuuuuuuuucucucuuu

SEQ ID NO: 1350167 - RNA, 21 nt, Homo sapiens
aagaaaaacaccgcuucugcc

SEQ ID NO: 1350168 - RNA, 11 nt, Homo sapiens
aagaaaacacu

SEQ ID NO: 1350169 - RNA, 19 nt, Homo sapiens
aagaaaauggccagugaga

SEQ ID NO: 1350170 - RNA, 17 nt, Homo sapiens
aagaaacaccaguguua

SEQ ID NO: 1350171 - RNA, 12 nt, Homo sapiens
aagaaaguguau

SEQ ID NO: 1350172 - RNA, 22 nt, Homo sapiens
aagaaaugaaacauccuaugaa

SEQ ID NO: 1350173 - RNA, 18 nt, Homo sapiens
aagaacuaaaauguucua

SEQ ID NO: 1350174 - RNA, 21 nt, Homo sapiens
aagaacuucuccuacuguagc

SEQ ID NO: 1350175 - RNA, 15 nt, Homo sapiens
aagaagaaggccaga

SEQ ID NO: 1350176 - RNA, 21 nt, Homo sapiens
aagaaggaaaagauacccaaa

SEQ ID NO: 1350177 - RNA, 22 nt, Homo sapiens
aagaagguggaaggcaguguua

SEQ ID NO: 1350178 - RNA, 17 nt, Homo sapiens
aagaauaaauucuaccu

SEQ ID NO: 1350179 - RNA, 15 nt, Homo sapiens
aagaaucugcucuga

SEQ ID NO: 1350180 - RNA, 23 nt, Homo sapiens
aagaauuaaugacuuacuuuaau

SEQ ID NO: 1350181 - RNA, 23 nt, Homo sapiens
aagaauuagaucgguucugugcc

SEQ ID NO: 1350182 - RNA, 23 nt, Homo sapiens
aagaauuuuaauuuauucaucuu

SEQ ID NO: 1350183 - RNA, 13 nt, Homo sapiens
aagacaagagcug

SEQ ID NO: 1350184 - RNA, 15 nt, Homo sapiens
aagacaagugaugcu

SEQ ID NO: 1350185 - RNA, 17 nt, Homo sapiens
aagacaaucacugccaa

SEQ ID NO: 1350186 - RNA, 14 nt, Homo sapiens
aagacacagacugc

SEQ ID NO: 1350187 - RNA, 21 nt, Homo sapiens
aagacagauucuucacugugu

SEQ ID NO: 1350188 - RNA, 16 nt, Homo sapiens
aagacagcagaacugc

SEQ ID NO: 1350189 - RNA, 15 nt, Homo sapiens
aagacaugacauucu

SEQ ID NO: 1350190 - RNA, 23 nt, Homo sapiens
aagacccuuucagaaucuuuuca

SEQ ID NO: 1350191 - RNA, 20 nt, Homo sapiens
aagaccugacaccuuucaua

SEQ ID NO: 1350192 - RNA, 20 nt, Homo sapiens
aagaccuggcagcucuggac

SEQ ID NO: 1350193 - RNA, 14 nt, Homo sapiens
aagacuauucaaac

SEQ ID NO: 1350194 - RNA, 14 nt, Homo sapiens
aagacuggcuuuag

SEQ ID NO: 1350195 - RNA, 19 nt, Homo sapiens
aagacuuugauccauguau

SEQ ID NO: 1350196 - RNA, 22 nt, Homo sapiens
aagagcagugguaagaauagua

SEQ ID NO: 1350197 - RNA, 23 nt, Homo sapiens
aagaggcagcuugaaacugagau

SEQ ID NO: 1350198 - RNA, 14 nt, Homo sapiens
aagaggcuguuaua

SEQ ID NO: 1350199 - RNA, 21 nt, Homo sapiens
aagagggucuuccuaagaaga

SEQ ID NO: 1350200 - RNA, 18 nt, Homo sapiens
aagaguuugacuuagaau

SEQ ID NO: 1350201 - RNA, 14 nt, Homo sapiens
aagauaacuaggaa

SEQ ID NO: 1350202 - RNA, 21 nt, Homo sapiens
aagauacaguaccccucuagc

SEQ ID NO: 1350203 - RNA, 17 nt, Homo sapiens
aagauagcuucacccca

SEQ ID NO: 1350204 - RNA, 16 nt, Homo sapiens
aagaugaugaugaucu

SEQ ID NO: 1350205 - RNA, 17 nt, Homo sapiens
aagaugaugaugaucuu

SEQ ID NO: 1350206 - RNA, 21 nt, Homo sapiens
aagauggcauaaccugucuca

SEQ ID NO: 1350207 - RNA, 14 nt, Homo sapiens
aagauuaaaugugu

SEQ ID NO: 1350208 - RNA, 13 nt, Homo sapiens
aagauuauacaau

SEQ ID NO: 1350209 - RNA, 21 nt, Homo sapiens
aagauucauauuuacuucuua

SEQ ID NO: 1350210 - RNA, 23 nt, Homo sapiens
aagauucugaccuuaaaugcaac

SEQ ID NO: 1350211 - RNA, 20 nt, Homo sapiens
aagauucuuaaaaauugaau

SEQ ID NO: 1350212 - RNA, 11 nt, Homo sapiens
aagauucuucu

SEQ ID NO: 1350213 - RNA, 20 nt, Homo sapiens
aagauuggggacacucauau

SEQ ID NO: 1350214 - RNA, 20 nt, Homo sapiens
aagcaaaucagaaaacccac

SEQ ID NO: 1350215 - RNA, 12 nt, Homo sapiens
aagcaaccacac

SEQ ID NO: 1350216 - RNA, 19 nt, Homo sapiens
aagcaauucuccugccuua

SEQ ID NO: 1350217 - RNA, 15 nt, Homo sapiens
aagcacaaguacuuu

SEQ ID NO: 1350218 - RNA, 17 nt, Homo sapiens
aagcacaaguacuuuug

SEQ ID NO: 1350219 - RNA, 17 nt, Homo sapiens
aagcaccuaaaugaugc

SEQ ID NO: 1350220 - RNA, 18 nt, Homo sapiens
aagcaccuaaaugaugcc

SEQ ID NO: 1350221 - RNA, 23 nt, Homo sapiens
aagcaccuagccucgcucuuggc

SEQ ID NO: 1350222 - RNA, 20 nt, Homo sapiens
aagcagacccaccucccagc

SEQ ID NO: 1350223 - RNA, 12 nt, Homo sapiens
aagcagcuugaa

SEQ ID NO: 1350224 - RNA, 17 nt, Homo sapiens
aagcaucccucacccau

SEQ ID NO: 1350225 - RNA, 20 nt, Homo sapiens
aagcaucugagcuaacuuau

SEQ ID NO: 1350226 - RNA, 11 nt, Homo sapiens
aagccaaagaa

SEQ ID NO: 1350227 - RNA, 15 nt, Homo sapiens
aagccacacucuggg

SEQ ID NO: 1350228 - RNA, 21 nt, Homo sapiens
aagccacaucuugcucugcau

SEQ ID NO: 1350229 - RNA, 20 nt, Homo sapiens
aagccagcacucacaccacu

SEQ ID NO: 1350230 - RNA, 14 nt, Homo sapiens
aagcccagcacuug

SEQ ID NO: 1350231 - RNA, 22 nt, Homo sapiens
aagcccaggggccggccagugg

SEQ ID NO: 1350232 - RNA, 12 nt, Homo sapiens
aagcccaguuca

SEQ ID NO: 1350233 - RNA, 18 nt, Homo sapiens
aagccccauuuccucaca

SEQ ID NO: 1350234 - RNA, 19 nt, Homo sapiens
aagcccccacuacaaguga

SEQ ID NO: 1350235 - RNA, 18 nt, Homo sapiens
aagccccgacacacgggg

SEQ ID NO: 1350236 - RNA, 23 nt, Homo sapiens
aagcccuggccaaauuuugaucc

SEQ ID NO: 1350237 - RNA, 21 nt, Homo sapiens
aagccgaccuucccuccgccu

SEQ ID NO: 1350238 - RNA, 18 nt, Homo sapiens
aagccucuccagcaauaa

SEQ ID NO: 1350239 - RNA, 16 nt, Homo sapiens
aagccugggugacauu

SEQ ID NO: 1350240 - RNA, 18 nt, Homo sapiens
aagccuuaaaaugcauug

SEQ ID NO: 1350241 - RNA, 16 nt, Homo sapiens
aagccuuaagcaaauu

SEQ ID NO: 1350242 - RNA, 16 nt, Homo sapiens
aagccuuaccuugaaa

SEQ ID NO: 1350243 - RNA, 14 nt, Homo sapiens
aagcgggaguggcu

SEQ ID NO: 1350244 - RNA, 16 nt, Homo sapiens
acuguauuuucuuuca

SEQ ID NO: 1350245 - RNA, 12 nt, Homo sapiens
acugucacuguu

SEQ ID NO: 1350246 - RNA, 16 nt, Homo sapiens
acugucucuccaguga

SEQ ID NO: 1350247 - RNA, 17 nt, Homo sapiens
acugucucuccagugaa

SEQ ID NO: 1350248 - RNA, 21 nt, Homo sapiens
acugugaaggaacucugcagu

SEQ ID NO: 1350249 - RNA, 18 nt, Homo sapiens
acugugauuuuuaucaca

SEQ ID NO: 1350250 - RNA, 20 nt, Homo sapiens
acugugcagacccaguccca

SEQ ID NO: 1350251 - RNA, 22 nt, Homo sapiens
acugugcuguacugagcacuga

SEQ ID NO: 1350252 - RNA, 14 nt, Homo sapiens
acuguuaccagaua

SEQ ID NO: 1350253 - RNA, 19 nt, Homo sapiens
acuguuuauuugcacuaug

SEQ ID NO: 1350254 - RNA, 15 nt, Homo sapiens
acuuaaaaguauuca

SEQ ID NO: 1350255 - RNA, 14 nt, Homo sapiens
acuuaaagaaauaa

SEQ ID NO: 1350256 - RNA, 23 nt, Homo sapiens
acuuaaagaaauaacgugcaugc

SEQ ID NO: 1350257 - RNA, 13 nt, Homo sapiens
acuuaacuaugag

SEQ ID NO: 1350258 - RNA, 21 nt, Homo sapiens
acuuaagcaucuggcucuaau

SEQ ID NO: 1350259 - RNA, 22 nt, Homo sapiens
acuuagaaauugcauuuccuga

SEQ ID NO: 1350260 - RNA, 23 nt, Homo sapiens
acuuagaucaucagucaccgaag

SEQ ID NO: 1350261 - RNA, 17 nt, Homo sapiens
acuuagcaugucccuac

SEQ ID NO: 1350262 - RNA, 23 nt, Homo sapiens
acuuagcuauauucugagacuuu

SEQ ID NO: 1350263 - RNA, 12 nt, Homo sapiens
acuuaggggugc

SEQ ID NO: 1350264 - RNA, 23 nt, Homo sapiens
acuuaguccuuuaucauccuuaa

SEQ ID NO: 1350265 - RNA, 15 nt, Homo sapiens
acuuauaguacauga

SEQ ID NO: 1350266 - RNA, 18 nt, Homo sapiens
acuuauggcaugacucuu

SEQ ID NO: 1350267 - RNA, 21 nt, Homo sapiens
acuuauuauuaauaaugaagu

SEQ ID NO: 1350268 - RNA, 19 nt, Homo sapiens
acuuauuuagauucacuua

SEQ ID NO: 1350269 - RNA, 22 nt, Homo sapiens
acuucaaaagccauaacuugaa

SEQ ID NO: 1350270 - RNA, 23 nt, Homo sapiens
acuucaagaacccugacuccucu

SEQ ID NO: 1350271 - RNA, 16 nt, Homo sapiens
acuucauucacauuca

SEQ ID NO: 1350272 - RNA, 23 nt, Homo sapiens
acuuccaagcuggcuuuucccau

SEQ ID NO: 1350273 - RNA, 11 nt, Homo sapiens
acuuccagugg

SEQ ID NO: 1350274 - RNA, 16 nt, Homo sapiens
acuuccaugacauaag

SEQ ID NO: 1350275 - RNA, 18 nt, Homo sapiens
acuucccagagcaucuug

SEQ ID NO: 1350276 - RNA, 20 nt, Homo sapiens
acuucccagagcaucuugca

SEQ ID NO: 1350277 - RNA, 14 nt, Homo sapiens
acuucccuaaugaa

SEQ ID NO: 1350278 - RNA, 16 nt, Homo sapiens
acuucccuaaugaagu

SEQ ID NO: 1350279 - RNA, 14 nt, Homo sapiens
acuucccucaggcc

SEQ ID NO: 1350280 - RNA, 20 nt, Homo sapiens
acuucccucaggccuaugca

SEQ ID NO: 1350281 - RNA, 21 nt, Homo sapiens
acuuccuuggacucauuuuaa

SEQ ID NO: 1350282 - RNA, 21 nt, Homo sapiens
acuuccuuuuaacugccaaga

SEQ ID NO: 1350283 - RNA, 19 nt, Homo sapiens
acuucuaaguaaaaccaca

SEQ ID NO: 1350284 - RNA, 20 nt, Homo sapiens
acuucuaaguaaaaccacag

SEQ ID NO: 1350285 - RNA, 12 nt, Homo sapiens
acuucuaggauu

SEQ ID NO: 1350286 - RNA, 18 nt, Homo sapiens
acuucucuuaaguggucu

SEQ ID NO: 1350287 - RNA, 11 nt, Homo sapiens
acuucuuggcu

SEQ ID NO: 1350288 - RNA, 17 nt, Homo sapiens
acuugaaacagauucag

SEQ ID NO: 1350289 - RNA, 22 nt, Homo sapiens
acuugaaacagauucaggccag

SEQ ID NO: 1350290 - RNA, 15 nt, Homo sapiens
acuugaggccaguga

SEQ ID NO: 1350291 - RNA, 14 nt, Homo sapiens
acuugagggccugu

SEQ ID NO: 1350292 - RNA, 13 nt, Homo sapiens
acuugauugccaa

SEQ ID NO: 1350293 - RNA, 14 nt, Homo sapiens
acuugauugccaag

SEQ ID NO: 1350294 - RNA, 13 nt, Homo sapiens
agaguaugucagu

SEQ ID NO: 1350295 - RNA, 15 nt, Homo sapiens
agagucaucuaccug

SEQ ID NO: 1350296 - RNA, 15 nt, Homo sapiens
agagucaugggagag

SEQ ID NO: 1350297 - RNA, 16 nt, Homo sapiens
agagucgcugugccac

SEQ ID NO: 1350298 - RNA, 22 nt, Homo sapiens
agagugcaagccccugcuccag

SEQ ID NO: 1350299 - RNA, 19 nt, Homo sapiens
agaguggggaugacaugca

SEQ ID NO: 1350300 - RNA, 18 nt, Homo sapiens
agauaagguggcuucuca

SEQ ID NO: 1350301 - RNA, 15 nt, Homo sapiens
agauacuuaauuccc

SEQ ID NO: 1350302 - RNA, 12 nt, Homo sapiens
agauagcucucu

SEQ ID NO: 1350303 - RNA, 23 nt, Homo sapiens
agauaggaaacugaagcauaaag

SEQ ID NO: 1350304 - RNA, 23 nt, Homo sapiens
agauaguggggagacuucuuggc

SEQ ID NO: 1350305 - RNA, 19 nt, Homo sapiens
agauauucacuaaggacuu

SEQ ID NO: 1350306 - RNA, 14 nt, Homo sapiens
agaucaacucuguc

SEQ ID NO: 1350307 - RNA, 16 nt, Homo sapiens
agaucacguugcaaug

SEQ ID NO: 1350308 - RNA, 22 nt, Homo sapiens
agaucacuucaggucaggaguu

SEQ ID NO: 1350309 - RNA, 18 nt, Homo sapiens
agaucagaacauucagcu

SEQ ID NO: 1350310 - RNA, 16 nt, Homo sapiens
agaucaggagugacag

SEQ ID NO: 1350311 - RNA, 21 nt, Homo sapiens
agaucaguauuucacugauac

SEQ ID NO: 1350312 - RNA, 17 nt, Homo sapiens
agauccgagugugauuu

SEQ ID NO: 1350313 - RNA, 19 nt, Homo sapiens
agaucguucucugccucac

SEQ ID NO: 1350314 - RNA, 17 nt, Homo sapiens
agaucuguccucagccu

SEQ ID NO: 1350315 - RNA, 22 nt, Homo sapiens
agaugaaauuugauaaacugaa

SEQ ID NO: 1350316 - RNA, 21 nt, Homo sapiens
agaugacucugucucauugac

SEQ ID NO: 1350317 - RNA, 23 nt, Homo sapiens
agaugacucugucucauugaccu

SEQ ID NO: 1350318 - RNA, 14 nt, Homo sapiens
agaugaugaugauc

SEQ ID NO: 1350319 - RNA, 20 nt, Homo sapiens
agaugccacccaguugugac

SEQ ID NO: 1350320 - RNA, 15 nt, Homo sapiens
agaugccacuucuca

SEQ ID NO: 1350321 - RNA, 14 nt, Homo sapiens
agaugcuggcccag

SEQ ID NO: 1350322 - RNA, 20 nt, Homo sapiens
agauggcauaaccugucuca

SEQ ID NO: 1350323 - RNA, 22 nt, Homo sapiens
agauggcugugccucugccugu

SEQ ID NO: 1350324 - RNA, 14 nt, Homo sapiens
agauggcuuuuccu

SEQ ID NO: 1350325 - RNA, 17 nt, Homo sapiens
agaugucuuaaaagacu

SEQ ID NO: 1350326 - RNA, 19 nt, Homo sapiens
agaugugaacacaucagcu

SEQ ID NO: 1350327 - RNA, 22 nt, Homo sapiens
agaugugggcagugaugucacu

SEQ ID NO: 1350328 - RNA, 19 nt, Homo sapiens
agauguucuggauaccauu

SEQ ID NO: 1350329 - RNA, 14 nt, Homo sapiens
agauguugggaaca

SEQ ID NO: 1350330 - RNA, 15 nt, Homo sapiens
agauguugggaacag

SEQ ID NO: 1350331 - RNA, 16 nt, Homo sapiens
agauuagaaacuacca

SEQ ID NO: 1350332 - RNA, 22 nt, Homo sapiens
agauucugaccuuaaaugcaac

SEQ ID NO: 1350333 - RNA, 18 nt, Homo sapiens
agauucuucccucugagu

SEQ ID NO: 1350334 - RNA, 19 nt, Homo sapiens
agauugauaaccauagcau

SEQ ID NO: 1350335 - RNA, 19 nt, Homo sapiens
agauuuaaagaaaaccaca

SEQ ID NO: 1350336 - RNA, 21 nt, Homo sapiens
agauuuaagugaauacauuaa

SEQ ID NO: 1350337 - RNA, 17 nt, Homo sapiens
agauuuggaauacacau

SEQ ID NO: 1350338 - RNA, 22 nt, Homo sapiens
agauuuuuuccucugcauuuac

SEQ ID NO: 1350339 - RNA, 19 nt, Homo sapiens
agcaaaacuggacaauguc

SEQ ID NO: 1350340 - RNA, 18 nt, Homo sapiens
agcaaaagaugugcaaaa

SEQ ID NO: 1350341 - RNA, 18 nt, Homo sapiens
agcaaaaucagaaguaua

SEQ ID NO: 1350342 - RNA, 20 nt, Homo sapiens
agcaaauaaacuuacagauc

SEQ ID NO: 1350343 - RNA, 18 nt, Homo sapiens
agcaaauggcagaaccaa

SEQ ID NO: 1350344 - RNA, 14 nt, Homo sapiens
agcaaauggccuca

SEQ ID NO: 1350345 - RNA, 15 nt, Homo sapiens
agcaacacagaggaa

SEQ ID NO: 1350346 - RNA, 11 nt, Homo sapiens
agcaacuguga

SEQ ID NO: 1350347 - RNA, 18 nt, Homo sapiens
agcaagaucccaucucuu

SEQ ID NO: 1350348 - RNA, 18 nt, Homo sapiens
agcaagcucuucacugaa

SEQ ID NO: 1350349 - RNA, 15 nt, Homo sapiens
agcaaguguucacaa

SEQ ID NO: 1350350 - RNA, 13 nt, Homo sapiens
agcaauaaaagac

SEQ ID NO: 1350351 - RNA, 20 nt, Homo sapiens
agcaaugucucuuugugcuc

SEQ ID NO: 1350352 - RNA, 19 nt, Homo sapiens
agcaauucaugguucaagu

SEQ ID NO: 1350353 - RNA, 14 nt, Homo sapiens
agcaauucuccugc

SEQ ID NO: 1350354 - RNA, 23 nt, Homo sapiens
agcaauuuagacaaagccuuaag

SEQ ID NO: 1350355 - RNA, 20 nt, Homo sapiens
agcacagcagccccugcaca

SEQ ID NO: 1350356 - RNA, 13 nt, Homo sapiens
agcaccaaccucc

SEQ ID NO: 1350357 - RNA, 13 nt, Homo sapiens
agcacccauucca

SEQ ID NO: 1350358 - RNA, 14 nt, Homo sapiens
agcacccauuccaa

SEQ ID NO: 1350359 - RNA, 15 nt, Homo sapiens
agcacccuacaggga

SEQ ID NO: 1350360 - RNA, 14 nt, Homo sapiens
agcacggacuguca

SEQ ID NO: 1350361 - RNA, 17 nt, Homo sapiens
agcacguguggccuguu

SEQ ID NO: 1350362 - RNA, 19 nt, Homo sapiens
agcacugacugaacuguaa

SEQ ID NO: 1350363 - RNA, 15 nt, Homo sapiens
agcacugggugacca

SEQ ID NO: 1350364 - RNA, 17 nt, Homo sapiens
agcacugggugaccagc

SEQ ID NO: 1350365 - RNA, 19 nt, Homo sapiens
agcacugggugaccagcug

SEQ ID NO: 1350366 - RNA, 12 nt, Homo sapiens
agcacuucccac

SEQ ID NO: 1350367 - RNA, 15 nt, Homo sapiens
agcacuugagaacca

SEQ ID NO: 1350368 - RNA, 21 nt, Homo sapiens
agcagaacucuugacuuccug

SEQ ID NO: 1350369 - RNA, 19 nt, Homo sapiens
agcagaggcguacuaccca

SEQ ID NO: 1350370 - RNA, 20 nt, Homo sapiens
agcagcaccaaccacagcau

SEQ ID NO: 1350371 - RNA, 18 nt, Homo sapiens
agcagccgccagcuggga

SEQ ID NO: 1350372 - RNA, 15 nt, Homo sapiens
agcagcucugugacu

SEQ ID NO: 1350373 - RNA, 17 nt, Homo sapiens
agcaggcccaugggagg

SEQ ID NO: 1350374 - RNA, 13 nt, Homo sapiens
agcaucaauacaa

SEQ ID NO: 1350375 - RNA, 21 nt, Homo sapiens
agcaucccuagucucuaccca

SEQ ID NO: 1350376 - RNA, 19 nt, Homo sapiens
agcauccuuggcaguggga

SEQ ID NO: 1350377 - RNA, 12 nt, Homo sapiens
agcaucuaagaa

SEQ ID NO: 1350378 - RNA, 14 nt, Homo sapiens
agcaucuccagugc

SEQ ID NO: 1350379 - RNA, 21 nt, Homo sapiens
agccuauuuuauaugcacaaa

SEQ ID NO: 1350380 - RNA, 23 nt, Homo sapiens
agccucagaaggacccuguugag

SEQ ID NO: 1350381 - RNA, 22 nt, Homo sapiens
agccucagaaggccccagagag

SEQ ID NO: 1350382 - RNA, 15 nt, Homo sapiens
agccucagggacgac

SEQ ID NO: 1350383 - RNA, 13 nt, Homo sapiens
agccucaucucuu

SEQ ID NO: 1350384 - RNA, 22 nt, Homo sapiens
agccuccccagcucaccccugg

SEQ ID NO: 1350385 - RNA, 21 nt, Homo sapiens
agccucugacuuaagcugccu

SEQ ID NO: 1350386 - RNA, 20 nt, Homo sapiens
agccucuggccgucacacgu

SEQ ID NO: 1350387 - RNA, 11 nt, Homo sapiens
agccucuggcu

SEQ ID NO: 1350388 - RNA, 15 nt, Homo sapiens
agccucugggucuga

SEQ ID NO: 1350389 - RNA, 18 nt, Homo sapiens
agccugagucaccugcag

SEQ ID NO: 1350390 - RNA, 12 nt, Homo sapiens
agccugccuuuc

SEQ ID NO: 1350391 - RNA, 14 nt, Homo sapiens
agccuggccagaca

SEQ ID NO: 1350392 - RNA, 20 nt, Homo sapiens
agccuggccagacacaggcc

SEQ ID NO: 1350393 - RNA, 19 nt, Homo sapiens
agccuggcugggacuggga

SEQ ID NO: 1350394 - RNA, 20 nt, Homo sapiens
agccugguucagacacagcu

SEQ ID NO: 1350395 - RNA, 23 nt, Homo sapiens
agccugugcgucccagcugaagg

SEQ ID NO: 1350396 - RNA, 19 nt, Homo sapiens
agccuuaaagauacuugaa

SEQ ID NO: 1350397 - RNA, 12 nt, Homo sapiens
agccuuacaaag

SEQ ID NO: 1350398 - RNA, 22 nt, Homo sapiens
agccuuaccuugaaaugcuguu

SEQ ID NO: 1350399 - RNA, 20 nt, Homo sapiens
agccuuauaaaccaaucuua

SEQ ID NO: 1350400 - RNA, 17 nt, Homo sapiens
agccuuggcucuacccu

SEQ ID NO: 1350401 - RNA, 18 nt, Homo sapiens
agccuuggcucuacccug

SEQ ID NO: 1350402 - RNA, 22 nt, Homo sapiens
agccuugggauagcaaacucca

SEQ ID NO: 1350403 - RNA, 21 nt, Homo sapiens
agcgcagggcuggcacgugac

SEQ ID NO: 1350404 - RNA, 21 nt, Homo sapiens
agcgccaaaacaagccaaaga

SEQ ID NO: 1350405 - RNA, 17 nt, Homo sapiens
agcgcuacccaccucca

SEQ ID NO: 1350406 - RNA, 17 nt, Homo sapiens
agcgggcggaggggauc

SEQ ID NO: 1350407 - RNA, 20 nt, Homo sapiens
agcguuuuuuaaauguauac

SEQ ID NO: 1350408 - RNA, 13 nt, Homo sapiens
agcuaacaccaga

SEQ ID NO: 1350409 - RNA, 13 nt, Homo sapiens
agcuaaguacaca

SEQ ID NO: 1350410 - RNA, 17 nt, Homo sapiens
agcuaaguacacaauaa

SEQ ID NO: 1350411 - RNA, 20 nt, Homo sapiens
agcuaaguacacaauaagca

SEQ ID NO: 1350412 - RNA, 19 nt, Homo sapiens
agcuaauaacaugugaaaa

SEQ ID NO: 1350413 - RNA, 17 nt, Homo sapiens
agcuaccucaaccaaug

SEQ ID NO: 1350414 - RNA, 13 nt, Homo sapiens
agcuacuugccuu

SEQ ID NO: 1350415 - RNA, 16 nt, Homo sapiens
agcuagaacauuccau

SEQ ID NO: 1350416 - RNA, 15 nt, Homo sapiens
agcuauaacuuacuu

SEQ ID NO: 1350417 - RNA, 13 nt, Homo sapiens
agcuaucaccuag

SEQ ID NO: 1350418 - RNA, 20 nt, Homo sapiens
agcucaggucccaggccagc

SEQ ID NO: 1350419 - RNA, 22 nt, Homo sapiens
agcucauucccaacgugcaaag

SEQ ID NO: 1350420 - RNA, 20 nt, Homo sapiens
agcucccaccccacucaggg

SEQ ID NO: 1350421 - RNA, 14 nt, Homo sapiens
agcucccuccucag

SEQ ID NO: 1350422 - RNA, 23 nt, Homo sapiens
agcuccucagcggcuccagcuca

SEQ ID NO: 1350423 - RNA, 15 nt, Homo sapiens
agcucuccccucaga

SEQ ID NO: 1350424 - RNA, 22 nt, Homo sapiens
agcucuccccucagagugcaag

SEQ ID NO: 1350425 - RNA, 19 nt, Homo sapiens
agcucuguuuuacaauaaa

SEQ ID NO: 1350426 - RNA, 20 nt, Homo sapiens
agcucuuggcuccacuggga

SEQ ID NO: 1350427 - RNA, 16 nt, Homo sapiens
agcugagggcauugcu

SEQ ID NO: 1350428 - RNA, 21 nt, Homo sapiens
agcugauugggcaccugacca

SEQ ID NO: 1350429 - RNA, 19 nt, Homo sapiens
agcugcacugaugcugccc

SEQ ID NO: 1350430 - RNA, 18 nt, Homo sapiens
agcugcccuagcugaccc

SEQ ID NO: 1350431 - RNA, 15 nt, Homo sapiens
agcugcuuugagcua

SEQ ID NO: 1350432 - RNA, 15 nt, Homo sapiens
agcugggaagacccu

SEQ ID NO: 1350433 - RNA, 14 nt, Homo sapiens
agcugggagccugg

SEQ ID NO: 1350434 - RNA, 16 nt, Homo sapiens
agcugggcagaccccu

SEQ ID NO: 1350435 - RNA, 15 nt, Homo sapiens
agcugucgacuucau

SEQ ID NO: 1350436 - RNA, 17 nt, Homo sapiens
agcuuaaaaucugugaa

SEQ ID NO: 1350437 - RNA, 20 nt, Homo sapiens
agcuuacaagccagcuggag

SEQ ID NO: 1350438 - RNA, 15 nt, Homo sapiens
agcuuacaaucgcaa

SEQ ID NO: 1350439 - RNA, 23 nt, Homo sapiens
agcuuaccagggucuuugcagau

SEQ ID NO: 1350440 - RNA, 18 nt, Homo sapiens
agcuuaccugggcacaaa

SEQ ID NO: 1350441 - RNA, 20 nt, Homo sapiens
agcuuccaacccgaggcaau

SEQ ID NO: 1350442 - RNA, 15 nt, Homo sapiens
agcuucccuugccuc

SEQ ID NO: 1350443 - RNA, 16 nt, Homo sapiens
agcuucuucacaggca

SEQ ID NO: 1350444 - RNA, 23 nt, Homo sapiens
agcuugaucuuuuucugccauga

SEQ ID NO: 1350445 - RNA, 22 nt, Homo sapiens
agcuuggaguucucuauacuca

SEQ ID NO: 1350446 - RNA, 14 nt, Homo sapiens
agcuugucaaagau

SEQ ID NO: 1350447 - RNA, 19 nt, Homo sapiens
agcuuuccucaucaggcca

SEQ ID NO: 1350448 - RNA, 12 nt, Homo sapiens
agcuuugcucuu

SEQ ID NO: 1350449 - RNA, 12 nt, Homo sapiens
agcuuugcugcu

SEQ ID NO: 1350450 - RNA, 18 nt, Homo sapiens
agcuuuuaaaaauguccu

SEQ ID NO: 1350451 - RNA, 17 nt, Homo sapiens
aggaaaaauugaugaau

SEQ ID NO: 1350452 - RNA, 14 nt, Homo sapiens
aggaaaagcaagaa

SEQ ID NO: 1350453 - RNA, 19 nt, Homo sapiens
aggaaaagcggacaucagc

SEQ ID NO: 1350454 - RNA, 20 nt, Homo sapiens
aggaaaagcggacaucagcu

SEQ ID NO: 1350455 - RNA, 20 nt, Homo sapiens
aggaaacccagcucacagga

SEQ ID NO: 1350456 - RNA, 12 nt, Homo sapiens
aggaaaggcccu

SEQ ID NO: 1350457 - RNA, 17 nt, Homo sapiens
aggaacuagaaagaagg

SEQ ID NO: 1350458 - RNA, 19 nt, Homo sapiens
aggaaggaaaacuauguau

SEQ ID NO: 1350459 - RNA, 13 nt, Homo sapiens
aggaaggacuuga

SEQ ID NO: 1350460 - RNA, 19 nt, Homo sapiens
aggaaggggccccauggca

SEQ ID NO: 1350461 - RNA, 17 nt, Homo sapiens
aggaaugccgcuagucu

SEQ ID NO: 1350462 - RNA, 15 nt, Homo sapiens
aggaauggcccucau

SEQ ID NO: 1350463 - RNA, 22 nt, Homo sapiens
aggaauuacgugcucugugggu

SEQ ID NO: 1350464 - RNA, 13 nt, Homo sapiens
aggaauucagugc

SEQ ID NO: 1350465 - RNA, 21 nt, Homo sapiens
aaaagauacccaaaggucaag

SEQ ID NO: 1350466 - RNA, 18 nt, Homo sapiens
aaaagaugaggacucaga

SEQ ID NO: 1350467 - RNA, 16 nt, Homo sapiens
aaaagcaauacuguuu

SEQ ID NO: 1350468 - RNA, 18 nt, Homo sapiens
aaaagcacacucaucccc

SEQ ID NO: 1350469 - RNA, 12 nt, Homo sapiens
aaaagcagugga

SEQ ID NO: 1350470 - RNA, 19 nt, Homo sapiens
aaaagcccagcacuugaau

SEQ ID NO: 1350471 - RNA, 14 nt, Homo sapiens
aaaagccucuuucu

SEQ ID NO: 1350472 - RNA, 23 nt, Homo sapiens
aaaagcgcucccccgucgugcuu

SEQ ID NO: 1350473 - RNA, 20 nt, Homo sapiens
aaaaggaauccucugugucu

SEQ ID NO: 1350474 - RNA, 22 nt, Homo sapiens
aaaaggcaagucaaauaccaca

SEQ ID NO: 1350475 - RNA, 14 nt, Homo sapiens
aaaaggcuccaguu

SEQ ID NO: 1350476 - RNA, 10 nt, Homo sapiens
aaaagugaug

SEQ ID NO: 1350477 - RNA, 12 nt, Homo sapiens
aaaagugcagua

SEQ ID NO: 1350478 - RNA, 15 nt, Homo sapiens
aaaaguuaugguacu

SEQ ID NO: 1350479 - RNA, 14 nt, Homo sapiens
aaaauaaaccaaau

SEQ ID NO: 1350480 - RNA, 15 nt, Homo sapiens
aaaauaaaccaaaua

SEQ ID NO: 1350481 - RNA, 22 nt, Homo sapiens
aaaauaaauauaucuaccccag

SEQ ID NO: 1350482 - RNA, 13 nt, Homo sapiens
aaaauaccuucua

SEQ ID NO: 1350483 - RNA, 20 nt, Homo sapiens
aaaauagcuuugcagugaaa

SEQ ID NO: 1350484 - RNA, 16 nt, Homo sapiens
aaaauauagacauucu

SEQ ID NO: 1350485 - RNA, 15 nt, Homo sapiens
aaaauauuugcaaau

SEQ ID NO: 1350486 - RNA, 19 nt, Homo sapiens
aaaaucaccaucuuuguca

SEQ ID NO: 1350487 - RNA, 22 nt, Homo sapiens
aaaauccaagcugcucauuuca

SEQ ID NO: 1350488 - RNA, 24 nt, Homo sapiens
aaaauccuauucugaugaaucuca

SEQ ID NO: 1350489 - RNA, 18 nt, Homo sapiens
aaaauccugaacuuucuc

SEQ ID NO: 1350490 - RNA, 21 nt, Homo sapiens
aaaaucucccagugacaacau

SEQ ID NO: 1350491 - RNA, 14 nt, Homo sapiens
aaaaucuguucuaa

SEQ ID NO: 1350492 - RNA, 14 nt, Homo sapiens
aaaaugcaaaagca

SEQ ID NO: 1350493 - RNA, 22 nt, Homo sapiens
aaaauguuuuuaaacaguguca

SEQ ID NO: 1350494 - RNA, 20 nt, Homo sapiens
aaaauuauuuauuguuacag

SEQ ID NO: 1350495 - RNA, 14 nt, Homo sapiens
aaaauuugucuuaa

SEQ ID NO: 1350496 - RNA, 15 nt, Homo sapiens
aaaauuugucuuaaa

SEQ ID NO: 1350497 - RNA, 15 nt, Homo sapiens
aaaauuuuagcucuu

SEQ ID NO: 1350498 - RNA, 16 nt, Homo sapiens
aaacaaaugugauaca

SEQ ID NO: 1350499 - RNA, 17 nt, Homo sapiens
aaacagcuuugucucca

SEQ ID NO: 1350500 - RNA, 16 nt, Homo sapiens
aaacaggguaccucaa

SEQ ID NO: 1350501 - RNA, 23 nt, Homo sapiens
aaacauaauaaaucacacauuca

SEQ ID NO: 1350502 - RNA, 12 nt, Homo sapiens
aaacaucaucaa

SEQ ID NO: 1350503 - RNA, 21 nt, Homo sapiens
aaacauuaaaauauaaucucu

SEQ ID NO: 1350504 - RNA, 19 nt, Homo sapiens
aaaccaagccguggcuucc

SEQ ID NO: 1350505 - RNA, 17 nt, Homo sapiens
aaaccacagucuuccca

SEQ ID NO: 1350506 - RNA, 17 nt, Homo sapiens
aaacccacaauugaacu

SEQ ID NO: 1350507 - RNA, 16 nt, Homo sapiens
aaacccauggagacag

SEQ ID NO: 1350508 - RNA, 23 nt, Homo sapiens
aaaccgaacugggcauauuucua

SEQ ID NO: 1350509 - RNA, 18 nt, Homo sapiens
aaaccuccacugcugcuc

SEQ ID NO: 1350510 - RNA, 15 nt, Homo sapiens
aaaccuccagccucc

SEQ ID NO: 1350511 - RNA, 14 nt, Homo sapiens
aaaccucuccucau

SEQ ID NO: 1350512 - RNA, 12 nt, Homo sapiens
aaaccuguaacc

SEQ ID NO: 1350513 - RNA, 23 nt, Homo sapiens
aaacuaaccuugaauaaggccca

SEQ ID NO: 1350514 - RNA, 15 nt, Homo sapiens
aaacuaccaauccca

SEQ ID NO: 1350515 - RNA, 13 nt, Homo sapiens
aaacucaaaauau

SEQ ID NO: 1350516 - RNA, 16 nt, Homo sapiens
aaacuccagaugccac

SEQ ID NO: 1350517 - RNA, 13 nt, Homo sapiens
aaacuccgucuca

SEQ ID NO: 1350518 - RNA, 20 nt, Homo sapiens
aaacucuguuacacuuuuug

SEQ ID NO: 1350519 - RNA, 22 nt, Homo sapiens
aaacugauuacguuuacauucu

SEQ ID NO: 1350520 - RNA, 19 nt, Homo sapiens
aaacugcacugucaagaug

SEQ ID NO: 1350521 - RNA, 16 nt, Homo sapiens
aaacugcucauuucau

SEQ ID NO: 1350522 - RNA, 14 nt, Homo sapiens
aaacuggcccuguu

SEQ ID NO: 1350523 - RNA, 14 nt, Homo sapiens
aaacugguuuauaa

SEQ ID NO: 1350524 - RNA, 13 nt, Homo sapiens
cacgaacuggccu

SEQ ID NO: 1350525 - RNA, 16 nt, Homo sapiens
cacgguggcggcugca

SEQ ID NO: 1350526 - RNA, 20 nt, Homo sapiens
cacguaggacgcaugaaggu

SEQ ID NO: 1350527 - RNA, 13 nt, Homo sapiens
cacuaaagcuuca

SEQ ID NO: 1350528 - RNA, 19 nt, Homo sapiens
cacuacaagugauccucag

SEQ ID NO: 1350529 - RNA, 21 nt, Homo sapiens
cacuaccguaaauguccauuu

SEQ ID NO: 1350530 - RNA, 17 nt, Homo sapiens
cacuacucucuuccucc

SEQ ID NO: 1350531 - RNA, 22 nt, Homo sapiens
cacuaguuuaugcuaccuaguc

SEQ ID NO: 1350532 - RNA, 16 nt, Homo sapiens
cacucagggagcauuu

SEQ ID NO: 1350533 - RNA, 16 nt, Homo sapiens
cacucagugccuccac

SEQ ID NO: 1350534 - RNA, 17 nt, Homo sapiens
cacucauauugcccuaa

SEQ ID NO: 1350535 - RNA, 22 nt, Homo sapiens
cacuccacugccuuuggaaggg

SEQ ID NO: 1350536 - RNA, 14 nt, Homo sapiens
cacuccagcuccuu

SEQ ID NO: 1350537 - RNA, 23 nt, Homo sapiens
cacucccaccugacacaccaggc

SEQ ID NO: 1350538 - RNA, 21 nt, Homo sapiens
cacuccccagagcugugccag

SEQ ID NO: 1350539 - RNA, 17 nt, Homo sapiens
cacuccgucugcuccaa

SEQ ID NO: 1350540 - RNA, 18 nt, Homo sapiens
cacucuguauugaaaaug

SEQ ID NO: 1350541 - RNA, 14 nt, Homo sapiens
cacugaaucauuaa

SEQ ID NO: 1350542 - RNA, 15 nt, Homo sapiens
cacugacaguuaaua

SEQ ID NO: 1350543 - RNA, 17 nt, Homo sapiens
cacugacugaacuguaa

SEQ ID NO: 1350544 - RNA, 20 nt, Homo sapiens
cacugagcuauaacuuacuu

SEQ ID NO: 1350545 - RNA, 20 nt, Homo sapiens
cacugcacagugcaucucag

SEQ ID NO: 1350546 - RNA, 13 nt, Homo sapiens
cacugcauaccaa

SEQ ID NO: 1350547 - RNA, 14 nt, Homo sapiens
cacugcauaccaac

SEQ ID NO: 1350548 - RNA, 16 nt, Homo sapiens
cacugcccacuggccg

SEQ ID NO: 1350549 - RNA, 18 nt, Homo sapiens
cacugcccccuccacugg

SEQ ID NO: 1350550 - RNA, 17 nt, Homo sapiens
cacugccccucucucag

SEQ ID NO: 1350551 - RNA, 22 nt, Homo sapiens
cacuggauugacuuugcuguca

SEQ ID NO: 1350552 - RNA, 17 nt, Homo sapiens
cacuggcuuuacauggg

SEQ ID NO: 1350553 - RNA, 20 nt, Homo sapiens
cacuggggacuuaggggugc

SEQ ID NO: 1350554 - RNA, 17 nt, Homo sapiens
cacugggugaccagcug

SEQ ID NO: 1350555 - RNA, 14 nt, Homo sapiens
cacuguauccauuc

SEQ ID NO: 1350556 - RNA, 21 nt, Homo sapiens
cacuguccugggccugcagaa

SEQ ID NO: 1350557 - RNA, 15 nt, Homo sapiens
cacugugccccacaa

SEQ ID NO: 1350558 - RNA, 12 nt, Homo sapiens
cacuuaauagca

SEQ ID NO: 1350559 - RNA, 12 nt, Homo sapiens
cacuuacuauug

SEQ ID NO: 1350560 - RNA, 19 nt, Homo sapiens
cacuuaguccuuuaucauc

SEQ ID NO: 1350561 - RNA, 18 nt, Homo sapiens
cacuucauucacauucag

SEQ ID NO: 1350562 - RNA, 12 nt, Homo sapiens
cacuucuuaggg

SEQ ID NO: 1350563 - RNA, 15 nt, Homo sapiens
cacuugaacccagga

SEQ ID NO: 1350564 - RNA, 13 nt, Homo sapiens
cacuugcucuuug

SEQ ID NO: 1350565 - RNA, 16 nt, Homo sapiens
cacuuggagcuaaaac

SEQ ID NO: 1350566 - RNA, 21 nt, Homo sapiens
cagcuaacucugaccugggag

SEQ ID NO: 1350567 - RNA, 18 nt, Homo sapiens
cagcuaccucaaccaaug

SEQ ID NO: 1350568 - RNA, 15 nt, Homo sapiens
cagcuagugccuuua

SEQ ID NO: 1350569 - RNA, 14 nt, Homo sapiens
cagcucagccagug

SEQ ID NO: 1350570 - RNA, 20 nt, Homo sapiens
cagcucuucuugacaucaag

SEQ ID NO: 1350571 - RNA, 15 nt, Homo sapiens
cagcugacagccaca

SEQ ID NO: 1350572 - RNA, 22 nt, Homo sapiens
cagcugauugggcaccugacca

SEQ ID NO: 1350573 - RNA, 15 nt, Homo sapiens
cagcuguccugucag

SEQ ID NO: 1350574 - RNA, 13 nt, Homo sapiens
cagcugugcucca

SEQ ID NO: 1350575 - RNA, 20 nt, Homo sapiens
cagcuguggcagaguuacag

SEQ ID NO: 1350576 - RNA, 13 nt, Homo sapiens
cagcuuguaugca

SEQ ID NO: 1350577 - RNA, 11 nt, Homo sapiens
cagcuuugucu

SEQ ID NO: 1350578 - RNA, 23 nt, Homo sapiens
caggaaaaguugaugguauucau

SEQ ID NO: 1350579 - RNA, 20 nt, Homo sapiens
caggaaagaauagaagugau

SEQ ID NO: 1350580 - RNA, 20 nt, Homo sapiens
caggaaagcuggugucugau

SEQ ID NO: 1350581 - RNA, 16 nt, Homo sapiens
caggaaauacuuugua

SEQ ID NO: 1350582 - RNA, 14 nt, Homo sapiens
caggaaaucaaaua

SEQ ID NO: 1350583 - RNA, 22 nt, Homo sapiens
caggaaauuagauaaauaaaaa

SEQ ID NO: 1350584 - RNA, 17 nt, Homo sapiens
caggaagggagaacuug

SEQ ID NO: 1350585 - RNA, 20 nt, Homo sapiens
caggaagggagaacuugaaa

SEQ ID NO: 1350586 - RNA, 21 nt, Homo sapiens
caggaauaauguuuugggaaa

SEQ ID NO: 1350587 - RNA, 19 nt, Homo sapiens
caggacagaugccacacaa

SEQ ID NO: 1350588 - RNA, 22 nt, Homo sapiens
caggacuguuuuauaaacugcu

SEQ ID NO: 1350589 - RNA, 18 nt, Homo sapiens
caggagaaucacuugaac

SEQ ID NO: 1350590 - RNA, 18 nt, Homo sapiens
caggagacagaccacuug

SEQ ID NO: 1350591 - RNA, 18 nt, Homo sapiens
caggagccuggccaggca

SEQ ID NO: 1350592 - RNA, 17 nt, Homo sapiens
caggagcuuaaacagcu

SEQ ID NO: 1350593 - RNA, 14 nt, Homo sapiens
caggaggaagugag

SEQ ID NO: 1350594 - RNA, 23 nt, Homo sapiens
caggaggaggaggggagugcucu

SEQ ID NO: 1350595 - RNA, 18 nt, Homo sapiens
caggagucccugccauca

SEQ ID NO: 1350596 - RNA, 20 nt, Homo sapiens
caggauacaggugacaguga

SEQ ID NO: 1350597 - RNA, 22 nt, Homo sapiens
caggaucaaaccccgaccaccu

SEQ ID NO: 1350598 - RNA, 14 nt, Homo sapiens
caggauccagugac

SEQ ID NO: 1350599 - RNA, 19 nt, Homo sapiens
caggauuauugucaaagaa

SEQ ID NO: 1350600 - RNA, 16 nt, Homo sapiens
caggcaaauagcuuua

SEQ ID NO: 1350601 - RNA, 15 nt, Homo sapiens
caggcaacgcacaaa

SEQ ID NO: 1350602 - RNA, 16 nt, Homo sapiens
caggcagcuauuucag

SEQ ID NO: 1350603 - RNA, 20 nt, Homo sapiens
caggcaugugucccuuccaa

SEQ ID NO: 1350604 - RNA, 18 nt, Homo sapiens
caggcaugugucuggccc

SEQ ID NO: 1350605 - RNA, 14 nt, Homo sapiens
caggccagcugccu

SEQ ID NO: 1350606 - RNA, 16 nt, Homo sapiens
cauagcugugcuauga

SEQ ID NO: 1350607 - RNA, 21 nt, Homo sapiens
cauagcugugcuaugagguuu

SEQ ID NO: 1350608 - RNA, 21 nt, Homo sapiens
cauaggguccugaauguuuca

SEQ ID NO: 1350609 - RNA, 13 nt, Homo sapiens
cauaggugcaguu

SEQ ID NO: 1350610 - RNA, 22 nt, Homo sapiens
cauaguaccgaauuuaguucau

SEQ ID NO: 1350611 - RNA, 23 nt, Homo sapiens
cauauaacaauucaguaacaaag

SEQ ID NO: 1350612 - RNA, 18 nt, Homo sapiens
cauauaccaguugugaua

SEQ ID NO: 1350613 - RNA, 15 nt, Homo sapiens
cauauacuauuuagu

SEQ ID NO: 1350614 - RNA, 15 nt, Homo sapiens
cauaucaaaacaucc

SEQ ID NO: 1350615 - RNA, 17 nt, Homo sapiens
cauaucaaaacauccca

SEQ ID NO: 1350616 - RNA, 18 nt, Homo sapiens
cauaucacaugucagcca

SEQ ID NO: 1350617 - RNA, 21 nt, Homo sapiens
cauaucccuuccucucaggcu

SEQ ID NO: 1350618 - RNA, 14 nt, Homo sapiens
cauaucucuugccc

SEQ ID NO: 1350619 - RNA, 16 nt, Homo sapiens
cauauggagaacaugu

SEQ ID NO: 1350620 - RNA, 20 nt, Homo sapiens
caucaagggagacaccagug

SEQ ID NO: 1350621 - RNA, 20 nt, Homo sapiens
caucacaguuguucugcaaa

SEQ ID NO: 1350622 - RNA, 12 nt, Homo sapiens
caucagcaaaca

SEQ ID NO: 1350623 - RNA, 17 nt, Homo sapiens
cauccaaaccuguaacc

SEQ ID NO: 1350624 - RNA, 19 nt, Homo sapiens
cauccaacauuaaaagcca

SEQ ID NO: 1350625 - RNA, 17 nt, Homo sapiens
cauccaaggcacuguca

SEQ ID NO: 1350626 - RNA, 24 nt, Homo sapiens
cauccauguuccgagaagaacaga

SEQ ID NO: 1350627 - RNA, 19 nt, Homo sapiens
caucccgucagcuggaaaa

SEQ ID NO: 1350628 - RNA, 15 nt, Homo sapiens
caucccuggaaggac

SEQ ID NO: 1350629 - RNA, 19 nt, Homo sapiens
cauccgguuugccauguug

SEQ ID NO: 1350630 - RNA, 20 nt, Homo sapiens
cauccuucuguguaccacuu

SEQ ID NO: 1350631 - RNA, 20 nt, Homo sapiens
caucgcaauaguuuuuuacu

SEQ ID NO: 1350632 - RNA, 21 nt, Homo sapiens
caucgcaguguucaaggccau

SEQ ID NO: 1350633 - RNA, 18 nt, Homo sapiens
caucguccgucacuuaua

SEQ ID NO: 1350634 - RNA, 13 nt, Homo sapiens
caucguucaucca

SEQ ID NO: 1350635 - RNA, 20 nt, Homo sapiens
caucuaccuuuucuggcaaa

SEQ ID NO: 1350636 - RNA, 16 nt, Homo sapiens
caucucugagcaauug

SEQ ID NO: 1350637 - RNA, 15 nt, Homo sapiens
caucucugucucaaa

SEQ ID NO: 1350638 - RNA, 14 nt, Homo sapiens
caucugaccagcag

SEQ ID NO: 1350639 - RNA, 20 nt, Homo sapiens
caucugacugccaagccaga

SEQ ID NO: 1350640 - RNA, 19 nt, Homo sapiens
caucugggaacuugucaca

SEQ ID NO: 1350641 - RNA, 14 nt, Homo sapiens
caucuguaccucug

SEQ ID NO: 1350642 - RNA, 11 nt, Homo sapiens
caucuguggag

SEQ ID NO: 1350643 - RNA, 19 nt, Homo sapiens
caucuguuugauacaguau

SEQ ID NO: 1350644 - RNA, 19 nt, Homo sapiens
caucuuccaccucaccucu

SEQ ID NO: 1350645 - RNA, 18 nt, Homo sapiens
caucuucccacaguggcu

SEQ ID NO: 1350646 - RNA, 18 nt, Homo sapiens
ccagcucugacaucccuu

SEQ ID NO: 1350647 - RNA, 15 nt, Homo sapiens
ccagcugcaccccuu

SEQ ID NO: 1350648 - RNA, 13 nt, Homo sapiens
ccagcugcacuga

SEQ ID NO: 1350649 - RNA, 16 nt, Homo sapiens
ccagcugugcacuuuc

SEQ ID NO: 1350650 - RNA, 21 nt, Homo sapiens
ccagcuugggcagaucuccca

SEQ ID NO: 1350651 - RNA, 22 nt, Homo sapiens
ccaggagacagaccacuugcca

SEQ ID NO: 1350652 - RNA, 16 nt, Homo sapiens
ccaggagagagccagg

SEQ ID NO: 1350653 - RNA, 22 nt, Homo sapiens
ccaggaugcccagaugaacuga

SEQ ID NO: 1350654 - RNA, 14 nt, Homo sapiens
ccaggcacugcugc

SEQ ID NO: 1350655 - RNA, 13 nt, Homo sapiens
ccaggcagaucca

SEQ ID NO: 1350656 - RNA, 17 nt, Homo sapiens
ccaggcuagagugcaau

SEQ ID NO: 1350657 - RNA, 19 nt, Homo sapiens
ccaggcuagagugcaaugg

SEQ ID NO: 1350658 - RNA, 19 nt, Homo sapiens
ccaggcuggagugcaaugg

SEQ ID NO: 1350659 - RNA, 20 nt, Homo sapiens
ccaggcuggagugcaauggc

SEQ ID NO: 1350660 - RNA, 20 nt, Homo sapiens
ccaggcuggagugcaauggu

SEQ ID NO: 1350661 - RNA, 17 nt, Homo sapiens
ccaggcuggagugcagu

SEQ ID NO: 1350662 - RNA, 17 nt, Homo sapiens
ccagggagaagcuccuc

SEQ ID NO: 1350663 - RNA, 20 nt, Homo sapiens
ccagggagcacccugcccac

SEQ ID NO: 1350664 - RNA, 23 nt, Homo sapiens
ccagggaggggucccugcaaaac

SEQ ID NO: 1350665 - RNA, 21 nt, Homo sapiens
ccagggcagcaggccagagaa

SEQ ID NO: 1350666 - RNA, 16 nt, Homo sapiens
ccagggccuccagggc

SEQ ID NO: 1350667 - RNA, 18 nt, Homo sapiens
ccagggcucuaauguguc

SEQ ID NO: 1350668 - RNA, 23 nt, Homo sapiens
ccagggcucuaaugugucucuca

SEQ ID NO: 1350669 - RNA, 13 nt, Homo sapiens
ccaguaguucuca

SEQ ID NO: 1350670 - RNA, 21 nt, Homo sapiens
ccagucccagacaauuccauu

SEQ ID NO: 1350671 - RNA, 14 nt, Homo sapiens
ccagucgaccccaa

SEQ ID NO: 1350672 - RNA, 18 nt, Homo sapiens
ccagugagaucaauguga

SEQ ID NO: 1350673 - RNA, 11 nt, Homo sapiens
ccagugcaguc

SEQ ID NO: 1350674 - RNA, 21 nt, Homo sapiens
ccaguggcuggaucugugagg

SEQ ID NO: 1350675 - RNA, 23 nt, Homo sapiens
ccagugguggguaauuguacaau

SEQ ID NO: 1350676 - RNA, 11 nt, Homo sapiens
ccagugucugu

SEQ ID NO: 1350677 - RNA, 19 nt, Homo sapiens
ccaguugugauacaauaaa

SEQ ID NO: 1350678 - RNA, 19 nt, Homo sapiens
ccaguuguuaaaaugagca

SEQ ID NO: 1350679 - RNA, 15 nt, Homo sapiens
ccauaaagacaauca

SEQ ID NO: 1350680 - RNA, 22 nt, Homo sapiens
ccauaggagccgacucuuugau

SEQ ID NO: 1350681 - RNA, 23 nt, Homo sapiens
ccauauaacaauucaguaacaaa

SEQ ID NO: 1350682 - RNA, 20 nt, Homo sapiens
ccauauggaggacugugaca

SEQ ID NO: 1350683 - RNA, 22 nt, Homo sapiens
ccauauuuuauuguauuuugau

SEQ ID NO: 1350684 - RNA, 16 nt, Homo sapiens
ccccgcccagugcagu

SEQ ID NO: 1350685 - RNA, 12 nt, Homo sapiens
ccccggcccacc

SEQ ID NO: 1350686 - RNA, 14 nt, Homo sapiens
ccccuaaaccaaaa

SEQ ID NO: 1350687 - RNA, 13 nt, Homo sapiens
ccccuacaugaaa

SEQ ID NO: 1350688 - RNA, 12 nt, Homo sapiens
ccccuacugugg

SEQ ID NO: 1350689 - RNA, 17 nt, Homo sapiens
ccccucacacuuugcca

SEQ ID NO: 1350690 - RNA, 16 nt, Homo sapiens
ccccucagacaguuug

SEQ ID NO: 1350691 - RNA, 23 nt, Homo sapiens
ccccucagccuugggaccgugcc

SEQ ID NO: 1350692 - RNA, 23 nt, Homo sapiens
ccccucauccgauuccccuguag

SEQ ID NO: 1350693 - RNA, 21 nt, Homo sapiens
ccccuccaguuuugccugaga

SEQ ID NO: 1350694 - RNA, 16 nt, Homo sapiens
ccccugccuaaugcug

SEQ ID NO: 1350695 - RNA, 14 nt, Homo sapiens
ccccugcuccagaa

SEQ ID NO: 1350696 - RNA, 14 nt, Homo sapiens
ccccuggcuuuuca

SEQ ID NO: 1350697 - RNA, 23 nt, Homo sapiens
ccccuucccuguccuugcccuuu

SEQ ID NO: 1350698 - RNA, 16 nt, Homo sapiens
ccccuuucacacugga

SEQ ID NO: 1350699 - RNA, 19 nt, Homo sapiens
cccggcucguguauuuauu

SEQ ID NO: 1350700 - RNA, 15 nt, Homo sapiens
cccgucgugcuuccu

SEQ ID NO: 1350701 - RNA, 12 nt, Homo sapiens
cccuaaagccag

SEQ ID NO: 1350702 - RNA, 12 nt, Homo sapiens
cccuaaccaagu

SEQ ID NO: 1350703 - RNA, 14 nt, Homo sapiens
cccuaugcugguag

SEQ ID NO: 1350704 - RNA, 21 nt, Homo sapiens
cccucaccuguagcagccagu

SEQ ID NO: 1350705 - RNA, 14 nt, Homo sapiens
cccucagacauccc

SEQ ID NO: 1350706 - RNA, 15 nt, Homo sapiens
cccucagagugcaag

SEQ ID NO: 1350707 - RNA, 20 nt, Homo sapiens
cccuccaaaggaacucuaga

SEQ ID NO: 1350708 - RNA, 16 nt, Homo sapiens
cccuccagacaaugcc

SEQ ID NO: 1350709 - RNA, 15 nt, Homo sapiens
cccuccauacagugu

SEQ ID NO: 1350710 - RNA, 21 nt, Homo sapiens
cccucccuguauaagacacuu

SEQ ID NO: 1350711 - RNA, 17 nt, Homo sapiens
cccuccucucccaguga

SEQ ID NO: 1350712 - RNA, 19 nt, Homo sapiens
cccucgggccccauccuca

SEQ ID NO: 1350713 - RNA, 21 nt, Homo sapiens
cccucgucaucaggugcauag

SEQ ID NO: 1350714 - RNA, 22 nt, Homo sapiens
cccucuggaguggccacuaagc

SEQ ID NO: 1350715 - RNA, 13 nt, Homo sapiens
cccucuucccuga

SEQ ID NO: 1350716 - RNA, 13 nt, Homo sapiens
cccugacuguaua

SEQ ID NO: 1350717 - RNA, 15 nt, Homo sapiens
cccugcaccaugcug

SEQ ID NO: 1350718 - RNA, 18 nt, Homo sapiens
cccugcaccaugcugcug

SEQ ID NO: 1350719 - RNA, 18 nt, Homo sapiens
cccugcagggccaagcac

SEQ ID NO: 1350720 - RNA, 21 nt, Homo sapiens
cccugcccaaccucugugguc

SEQ ID NO: 1350721 - RNA, 19 nt, Homo sapiens
cgcuucugccuuuucacug

SEQ ID NO: 1350722 - RNA, 16 nt, Homo sapiens
cggaaacaacguugcu

SEQ ID NO: 1350723 - RNA, 18 nt, Homo sapiens
cggaagcugucgacuuca

SEQ ID NO: 1350724 - RNA, 17 nt, Homo sapiens
cggcaagcgagcacagu

SEQ ID NO: 1350725 - RNA, 16 nt, Homo sapiens
cggcagggaaauguau

SEQ ID NO: 1350726 - RNA, 21 nt, Homo sapiens
cggcagggugucccaggagcc

SEQ ID NO: 1350727 - RNA, 20 nt, Homo sapiens
cggccacggugccuccagau

SEQ ID NO: 1350728 - RNA, 16 nt, Homo sapiens
cggccagccaugucug

SEQ ID NO: 1350729 - RNA, 23 nt, Homo sapiens
cggcgcaugccugcaaucccagc

SEQ ID NO: 1350730 - RNA, 19 nt, Homo sapiens
cggcuacugguuaccugga

SEQ ID NO: 1350731 - RNA, 16 nt, Homo sapiens
cggcuuguaaauguga

SEQ ID NO: 1350732 - RNA, 16 nt, Homo sapiens
cgggauuuaugugcac

SEQ ID NO: 1350733 - RNA, 16 nt, Homo sapiens
cgggccccauccucau

SEQ ID NO: 1350734 - RNA, 18 nt, Homo sapiens
cgggcugggagcucugca

SEQ ID NO: 1350735 - RNA, 17 nt, Homo sapiens
cgggcugugcccgggga

SEQ ID NO: 1350736 - RNA, 21 nt, Homo sapiens
cggggacguagggcuaaggga

SEQ ID NO: 1350737 - RNA, 16 nt, Homo sapiens
cgggguuucuccaugu

SEQ ID NO: 1350738 - RNA, 14 nt, Homo sapiens
cgguuaccucugca

SEQ ID NO: 1350739 - RNA, 17 nt, Homo sapiens
cgguuaccucugcaugg

SEQ ID NO: 1350740 - RNA, 23 nt, Homo sapiens
cguaacagauuuuguuggcauag

SEQ ID NO: 1350741 - RNA, 23 nt, Homo sapiens
cguaaugcauugccuguaacaau

SEQ ID NO: 1350742 - RNA, 11 nt, Homo sapiens
cgucacagccu

SEQ ID NO: 1350743 - RNA, 15 nt, Homo sapiens
cgucagccaccuggg

SEQ ID NO: 1350744 - RNA, 11 nt, Homo sapiens
cguccacaggg

SEQ ID NO: 1350745 - RNA, 13 nt, Homo sapiens
cguccacagggca

SEQ ID NO: 1350746 - RNA, 12 nt, Homo sapiens
cguccuggucaa

SEQ ID NO: 1350747 - RNA, 16 nt, Homo sapiens
cgucgguccuggugcc

SEQ ID NO: 1350748 - RNA, 13 nt, Homo sapiens
cgucuacugcaag

SEQ ID NO: 1350749 - RNA, 18 nt, Homo sapiens
cgucuacugcaagagcca

SEQ ID NO: 1350750 - RNA, 19 nt, Homo sapiens
cgucugcuccaaugacuga

SEQ ID NO: 1350751 - RNA, 18 nt, Homo sapiens
cgucuucagaugcugagc

SEQ ID NO: 1350752 - RNA, 15 nt, Homo sapiens
cgugaucaaagccac

SEQ ID NO: 1350753 - RNA, 19 nt, Homo sapiens
cgugcaccuggcagcuuuu

SEQ ID NO: 1350754 - RNA, 15 nt, Homo sapiens
cgugcgcgugcacag

SEQ ID NO: 1350755 - RNA, 19 nt, Homo sapiens
cgugggcucgauuccucag

SEQ ID NO: 1350756 - RNA, 19 nt, Homo sapiens
gacacaggcccucccuguu

SEQ ID NO: 1350757 - RNA, 18 nt, Homo sapiens
gacagacaacacugggaa

SEQ ID NO: 1350758 - RNA, 14 nt, Homo sapiens
gacagaucacaggg

SEQ ID NO: 1350759 - RNA, 17 nt, Homo sapiens
gacagaucacaggguga

SEQ ID NO: 1350760 - RNA, 19 nt, Homo sapiens
gacagaugccacacaagga

SEQ ID NO: 1350761 - RNA, 13 nt, Homo sapiens
gacagccuggcac

SEQ ID NO: 1350762 - RNA, 15 nt, Homo sapiens
gacagugaccccagu

SEQ ID NO: 1350763 - RNA, 23 nt, Homo sapiens
gacaguugauggagccccagggu

SEQ ID NO: 1350764 - RNA, 22 nt, Homo sapiens
gacauaauaacagcaguggagu

SEQ ID NO: 1350765 - RNA, 15 nt, Homo sapiens
gacauacuuaaugca

SEQ ID NO: 1350766 - RNA, 14 nt, Homo sapiens
gacaugugacauuu

SEQ ID NO: 1350767 - RNA, 19 nt, Homo sapiens
gacauuagagaaaaccuua

SEQ ID NO: 1350768 - RNA, 16 nt, Homo sapiens
gacauucacacagaga

SEQ ID NO: 1350769 - RNA, 13 nt, Homo sapiens
gacauuccaccau

SEQ ID NO: 1350770 - RNA, 16 nt, Homo sapiens
gacauucggggugauc

SEQ ID NO: 1350771 - RNA, 19 nt, Homo sapiens
gacauuggcaccuaaucca

SEQ ID NO: 1350772 - RNA, 13 nt, Homo sapiens
gacauuucuuugg

SEQ ID NO: 1350773 - RNA, 20 nt, Homo sapiens
gaccaaaugcuuuuccucaa

SEQ ID NO: 1350774 - RNA, 13 nt, Homo sapiens
gaccaauacuacu

SEQ ID NO: 1350775 - RNA, 22 nt, Homo sapiens
gaccacagaaguggaauuugaa

SEQ ID NO: 1350776 - RNA, 20 nt, Homo sapiens
gaccagaucagggacuugaa

SEQ ID NO: 1350777 - RNA, 17 nt, Homo sapiens
gaccagcccaccccugu

SEQ ID NO: 1350778 - RNA, 21 nt, Homo sapiens
gaccagcucacguaaugcauu

SEQ ID NO: 1350779 - RNA, 21 nt, Homo sapiens
gaccaggguuggcaccuuccc

SEQ ID NO: 1350780 - RNA, 15 nt, Homo sapiens
gaccaucaugcccuc

SEQ ID NO: 1350781 - RNA, 17 nt, Homo sapiens
gaccaucugcugcaguu

SEQ ID NO: 1350782 - RNA, 15 nt, Homo sapiens
gacccagucccacac

SEQ ID NO: 1350783 - RNA, 18 nt, Homo sapiens
gacccagucccacacugu

SEQ ID NO: 1350784 - RNA, 15 nt, Homo sapiens
gacccccaucugagc

SEQ ID NO: 1350785 - RNA, 18 nt, Homo sapiens
gaccccgagaagugcucu

SEQ ID NO: 1350786 - RNA, 15 nt, Homo sapiens
gaccccgccaugcau

SEQ ID NO: 1350787 - RNA, 23 nt, Homo sapiens
gacccucgggccccauccucauc

SEQ ID NO: 1350788 - RNA, 20 nt, Homo sapiens
gaccuaaagggacuaccucu

SEQ ID NO: 1350789 - RNA, 19 nt, Homo sapiens
gaccucaucagccuuggga

SEQ ID NO: 1350790 - RNA, 21 nt, Homo sapiens
gaccuccagcuaaacaccaac

SEQ ID NO: 1350791 - RNA, 22 nt, Homo sapiens
gaccucccaacucuaaagccaa

SEQ ID NO: 1350792 - RNA, 16 nt, Homo sapiens
gaccucccacugcccc

SEQ ID NO: 1350793 - RNA, 17 nt, Homo sapiens
gaccugacaccuuucau

SEQ ID NO: 1350794 - RNA, 22 nt, Homo sapiens
gaccuugcugauggugacauug

SEQ ID NO: 1350795 - RNA, 22 nt, Homo sapiens
gaccuugcuuugagacuccuca

SEQ ID NO: 1350796 - RNA, 15 nt, Homo sapiens
gacgacucugaccuc

SEQ ID NO: 1350797 - RNA, 20 nt, Homo sapiens
gacgacucugaccucuuggc

SEQ ID NO: 1350798 - RNA, 20 nt, Homo sapiens
gacgccaggcaccacagccu

SEQ ID NO: 1350799 - RNA, 12 nt, Homo sapiens
gacgcugcugac

SEQ ID NO: 1350800 - RNA, 22 nt, Homo sapiens
gacgggcaaaauaaagugacag

SEQ ID NO: 1350801 - RNA, 19 nt, Homo sapiens
gacguccucccugauccca

SEQ ID NO: 1350802 - RNA, 17 nt, Homo sapiens
gacgugaggcccauucu

SEQ ID NO: 1350803 - RNA, 17 nt, Homo sapiens
gacguggguugcacugg

SEQ ID NO: 1350804 - RNA, 21 nt, Homo sapiens
gacguuuuuccaguucacauu

SEQ ID NO: 1350805 - RNA, 15 nt, Homo sapiens
gacuacuauuuucuu

SEQ ID NO: 1350806 - RNA, 12 nt, Homo sapiens
gacuauggagcu

SEQ ID NO: 1350807 - RNA, 15 nt, Homo sapiens
gacucaaugugcucu

SEQ ID NO: 1350808 - RNA, 21 nt, Homo sapiens
gacucauuuuaaaaaauggaa

SEQ ID NO: 1350809 - RNA, 14 nt, Homo sapiens
gacucucagcagcu

SEQ ID NO: 1350810 - RNA, 18 nt, Homo sapiens
gacugaccaucaugcccu

SEQ ID NO: 1350811 - RNA, 14 nt, Homo sapiens
gacugauagacacc

SEQ ID NO: 1350812 - RNA, 15 nt, Homo sapiens
gacugccaagccaga

SEQ ID NO: 1350813 - RNA, 17 nt, Homo sapiens
gacuggauguaccacca

SEQ ID NO: 1350814 - RNA, 20 nt, Homo sapiens
gacugggcaucucugagcaa

SEQ ID NO: 1350815 - RNA, 22 nt, Homo sapiens
gacugugcauacuuucccucau

SEQ ID NO: 1350816 - RNA, 17 nt, Homo sapiens
gacugugguagccagca

SEQ ID NO: 1350817 - RNA, 14 nt, Homo sapiens
gacuuaaacugcug

SEQ ID NO: 1350818 - RNA, 19 nt, Homo sapiens
gacuuagaauaaugaaggu

SEQ ID NO: 1350819 - RNA, 19 nt, Homo sapiens
gacuuaguacaaaguuuca

SEQ ID NO: 1350820 - RNA, 12 nt, Homo sapiens
gacuuaucaaca

SEQ ID NO: 1350821 - RNA, 17 nt, Homo sapiens
gacuucuaggauuuauu

SEQ ID NO: 1350822 - RNA, 20 nt, Homo sapiens
gacuucucaaagagaauugu

SEQ ID NO: 1350823 - RNA, 21 nt, Homo sapiens
gacuugaaaguuuuccaguau

SEQ ID NO: 1350824 - RNA, 18 nt, Homo sapiens
gacuuucaguaaacauaa

SEQ ID NO: 1350825 - RNA, 16 nt, Homo sapiens
gacuuucucuucuaca

SEQ ID NO: 1350826 - RNA, 17 nt, Homo sapiens
gacuuugauagauuucu

SEQ ID NO: 1350827 - RNA, 18 nt, Homo sapiens
gacuuugauccauguaug

SEQ ID NO: 1350828 - RNA, 17 nt, Homo sapiens
gacuuugcagauggaaa

SEQ ID NO: 1350829 - RNA, 13 nt, Homo sapiens
gacuuugccaaaa

SEQ ID NO: 1350830 - RNA, 11 nt, Homo sapiens
gagaaaaccug

SEQ ID NO: 1350831 - RNA, 17 nt, Homo sapiens
gagaaaauauuugcaaa

SEQ ID NO: 1350832 - RNA, 12 nt, Homo sapiens
gagaaacccaga

SEQ ID NO: 1350833 - RNA, 19 nt, Homo sapiens
gagaaagagagaagccagc

SEQ ID NO: 1350834 - RNA, 16 nt, Homo sapiens
gagaaagugacaugca

SEQ ID NO: 1350835 - RNA, 19 nt, Homo sapiens
gagaaaugccccaguguua

SEQ ID NO: 1350836 - RNA, 17 nt, Homo sapiens
gagaacacagugcuauu

SEQ ID NO: 1350837 - RNA, 16 nt, Homo sapiens
gagaacccuugcacua

SEQ ID NO: 1350838 - RNA, 15 nt, Homo sapiens
gagaagauucuugua

SEQ ID NO: 1350839 - RNA, 17 nt, Homo sapiens
gagaagcugucagggac

SEQ ID NO: 1350840 - RNA, 21 nt, Homo sapiens
gagaaguuuguagccagguac

SEQ ID NO: 1350841 - RNA, 15 nt, Homo sapiens
gagacaggagccuag

SEQ ID NO: 1350842 - RNA, 23 nt, Homo sapiens
gagacauacuugaagggccagag

SEQ ID NO: 1350843 - RNA, 16 nt, Homo sapiens
gagacaugugacauuu

SEQ ID NO: 1350844 - RNA, 15 nt, Homo sapiens
gagacgcacacagcu

SEQ ID NO: 1350845 - RNA, 22 nt, Homo sapiens
gagacggagucuugcucuguca

SEQ ID NO: 1350846 - RNA, 17 nt, Homo sapiens
gagacugggcaucucug

SEQ ID NO: 1350847 - RNA, 20 nt, Homo sapiens
gagacuguaaguuacaugaa

SEQ ID NO: 1350848 - RNA, 13 nt, Homo sapiens
gagacuucuccca

SEQ ID NO: 1350849 - RNA, 21 nt, Homo sapiens
gagacuucucccauagcaaag

SEQ ID NO: 1350850 - RNA, 20 nt, Homo sapiens
gagagcaaauaaagaccuga

SEQ ID NO: 1350851 - RNA, 13 nt, Homo sapiens
gagagcagcagca

SEQ ID NO: 1350852 - RNA, 15 nt, Homo sapiens
gagaggcucugagaa

SEQ ID NO: 1350853 - RNA, 12 nt, Homo sapiens
gagagggcugcu

SEQ ID NO: 1350854 - RNA, 20 nt, Homo sapiens
gagaguccugguccucaggg

SEQ ID NO: 1350855 - RNA, 18 nt, Homo sapiens
gagaucuguguggcuccu

SEQ ID NO: 1350856 - RNA, 13 nt, Homo sapiens
gagcacacccgug

SEQ ID NO: 1350857 - RNA, 14 nt, Homo sapiens
gagcacccugccca

SEQ ID NO: 1350858 - RNA, 20 nt, Homo sapiens
gagcagaaaguaagcauuuc

SEQ ID NO: 1350859 - RNA, 20 nt, Homo sapiens
gagcaggcuacugucagcuc

SEQ ID NO: 1350860 - RNA, 21 nt, Homo sapiens
gagcaucuccagugcucccca

SEQ ID NO: 1350861 - RNA, 14 nt, Homo sapiens
gagcaucugcagua

SEQ ID NO: 1350862 - RNA, 15 nt, Homo sapiens
gagccaaguuccaaa

SEQ ID NO: 1350863 - RNA, 17 nt, Homo sapiens
gagccaccccuaaagag

SEQ ID NO: 1350864 - RNA, 12 nt, Homo sapiens
gagcccagugaa

SEQ ID NO: 1350865 - RNA, 17 nt, Homo sapiens
gagcccuauugcugcua

SEQ ID NO: 1350866 - RNA, 16 nt, Homo sapiens
gagccgcgucccggca

SEQ ID NO: 1350867 - RNA, 19 nt, Homo sapiens
gagccuccugggaacacau

SEQ ID NO: 1350868 - RNA, 17 nt, Homo sapiens
gagccuugucagugugu

SEQ ID NO: 1350869 - RNA, 14 nt, Homo sapiens
gagcggcuggagaa

SEQ ID NO: 1350870 - RNA, 16 nt, Homo sapiens
gagcuccgaugcccgc

SEQ ID NO: 1350871 - RNA, 20 nt, Homo sapiens
gagcugggggaagaagggau

SEQ ID NO: 1350872 - RNA, 20 nt, Homo sapiens
gcaaauguguguagauuuca

SEQ ID NO: 1350873 - RNA, 21 nt, Homo sapiens
gcaacaggauugaucauucuu

SEQ ID NO: 1350874 - RNA, 17 nt, Homo sapiens
gcaacauuuuaaggcaa

SEQ ID NO: 1350875 - RNA, 13 nt, Homo sapiens
gcaaccagcacau

SEQ ID NO: 1350876 - RNA, 21 nt, Homo sapiens
gcaacuagcugggcacagugg

SEQ ID NO: 1350877 - RNA, 18 nt, Homo sapiens
gcaagaucccaucucuuu

SEQ ID NO: 1350878 - RNA, 19 nt, Homo sapiens
gcaagauuccaaguucuca

SEQ ID NO: 1350879 - RNA, 16 nt, Homo sapiens
gcaaggauuacagaaa

SEQ ID NO: 1350880 - RNA, 23 nt, Homo sapiens
gcaaggauuacagaaacugaugc

SEQ ID NO: 1350881 - RNA, 19 nt, Homo sapiens
gcccccagggccuccaggg

SEQ ID NO: 1350882 - RNA, 22 nt, Homo sapiens
gcccccuccaggagagagccag

SEQ ID NO: 1350883 - RNA, 14 nt, Homo sapiens
gccccucacacugc

SEQ ID NO: 1350884 - RNA, 13 nt, Homo sapiens
gccccuccaaacc

SEQ ID NO: 1350885 - RNA, 15 nt, Homo sapiens
gcccuaaaagcacac

SEQ ID NO: 1350886 - RNA, 15 nt, Homo sapiens
gcccugcaccaugcu

SEQ ID NO: 1350887 - RNA, 18 nt, Homo sapiens
gcccugcaccaugcugcu

SEQ ID NO: 1350888 - RNA, 17 nt, Homo sapiens
gcccugccccaccccau

SEQ ID NO: 1350889 - RNA, 14 nt, Homo sapiens
gcccuggauccauc

SEQ ID NO: 1350890 - RNA, 19 nt, Homo sapiens
gcccugggaaccacuccca

SEQ ID NO: 1350891 - RNA, 15 nt, Homo sapiens
gcccuggugcugcca

SEQ ID NO: 1350892 - RNA, 15 nt, Homo sapiens
gcccuguaacaggcu

SEQ ID NO: 1350893 - RNA, 18 nt, Homo sapiens
gcccuuccaugugccuuu

SEQ ID NO: 1350894 - RNA, 23 nt, Homo sapiens
gcccuuggggagaggugauucuc

SEQ ID NO: 1350895 - RNA, 17 nt, Homo sapiens
gcccuuucaaagcacuu

SEQ ID NO: 1350896 - RNA, 16 nt, Homo sapiens
gccgcagagaaaugcc

SEQ ID NO: 1350897 - RNA, 18 nt, Homo sapiens
gccgccggaguccacucc

SEQ ID NO: 1350898 - RNA, 15 nt, Homo sapiens
gccgcucucucugag

SEQ ID NO: 1350899 - RNA, 20 nt, Homo sapiens
gccggaaggaaugucagggc

SEQ ID NO: 1350900 - RNA, 18 nt, Homo sapiens
gccgggcaugguggcaca

SEQ ID NO: 1350901 - RNA, 22 nt, Homo sapiens
gccuaaauuuaaugcugccuuu

SEQ ID NO: 1350902 - RNA, 16 nt, Homo sapiens
gccuaacuaacuggca

SEQ ID NO: 1350903 - RNA, 22 nt, Homo sapiens
gccuaagaagaaggccagagag

SEQ ID NO: 1350904 - RNA, 13 nt, Homo sapiens
gccuaaugcugcg

SEQ ID NO: 1350905 - RNA, 22 nt, Homo sapiens
gccuaccgcuggcccugccguu

SEQ ID NO: 1350906 - RNA, 20 nt, Homo sapiens
gccuacuccaagaauggagg

SEQ ID NO: 1350907 - RNA, 13 nt, Homo sapiens
gccuagauaugaa

SEQ ID NO: 1350908 - RNA, 21 nt, Homo sapiens
gccuagcuccugccacaugga

SEQ ID NO: 1350909 - RNA, 10 nt, Homo sapiens
gccuaugaaa

SEQ ID NO: 1350910 - RNA, 17 nt, Homo sapiens
gccucaagucacuccca

SEQ ID NO: 1350911 - RNA, 13 nt, Homo sapiens
gccucauuucacu

SEQ ID NO: 1350912 - RNA, 11 nt, Homo sapiens
gccuccagggc

SEQ ID NO: 1350913 - RNA, 17 nt, Homo sapiens
gccucccaaagugcugg

SEQ ID NO: 1350914 - RNA, 18 nt, Homo sapiens
gccucccugaagccuuug

SEQ ID NO: 1350915 - RNA, 23 nt, Homo sapiens
gccuccugggaacacaucuggcu

SEQ ID NO: 1350916 - RNA, 13 nt, Homo sapiens
gccuccugugacg

SEQ ID NO: 1350917 - RNA, 13 nt, Homo sapiens
gccucuacuuuau

SEQ ID NO: 1350918 - RNA, 14 nt, Homo sapiens
gccucuacuuuauc

SEQ ID NO: 1350919 - RNA, 17 nt, Homo sapiens
gccucuggaugcuguga

SEQ ID NO: 1350920 - RNA, 19 nt, Homo sapiens
gccucuucuuugugccuuu

SEQ ID NO: 1350921 - RNA, 12 nt, Homo sapiens
gccugacauuca

SEQ ID NO: 1350922 - RNA, 17 nt, Homo sapiens
gccugacuuggggacaa

SEQ ID NO: 1350923 - RNA, 15 nt, Homo sapiens
gccugcuccaucuca

SEQ ID NO: 1350924 - RNA, 20 nt, Homo sapiens
gccugcuugacuuuccagaa

SEQ ID NO: 1350925 - RNA, 17 nt, Homo sapiens
gccuggccagcacccca

SEQ ID NO: 1350926 - RNA, 15 nt, Homo sapiens
gccugggagcccaga

SEQ ID NO: 1350927 - RNA, 23 nt, Homo sapiens
gccugggcaacgagugaaacucc

SEQ ID NO: 1350928 - RNA, 16 nt, Homo sapiens
gccugggggauguacc

SEQ ID NO: 1350929 - RNA, 21 nt, Homo sapiens
gccuggucccacgagggugcc

SEQ ID NO: 1350930 - RNA, 12 nt, Homo sapiens
gccuguacccag

SEQ ID NO: 1350931 - RNA, 22 nt, Homo sapiens
gccuguacccaguagaugccac

SEQ ID NO: 1350932 - RNA, 12 nt, Homo sapiens
gccugugccagc

SEQ ID NO: 1350933 - RNA, 23 nt, Homo sapiens
gccuguggguuugguccuugaac

SEQ ID NO: 1350934 - RNA, 14 nt, Homo sapiens
gccuguguacugcc

SEQ ID NO: 1350935 - RNA, 18 nt, Homo sapiens
gccuuaaugacauucccc

SEQ ID NO: 1350936 - RNA, 13 nt, Homo sapiens
gccuuacaucugg

SEQ ID NO: 1350937 - RNA, 15 nt, Homo sapiens
gccuuacaucuggcu

SEQ ID NO: 1350938 - RNA, 14 nt, Homo sapiens
gccuuaccaggaga

SEQ ID NO: 1350939 - RNA, 15 nt, Homo sapiens
gccuuauuggcagcu

SEQ ID NO: 1350940 - RNA, 16 nt, Homo sapiens
gccuucuccacuggcc

SEQ ID NO: 1350941 - RNA, 16 nt, Homo sapiens
gccuucuccacuuugg

SEQ ID NO: 1350942 - RNA, 18 nt, Homo sapiens
gccuugccagagauccaa

SEQ ID NO: 1350943 - RNA, 23 nt, Homo sapiens
gccuugccuaaauuuaaugcugc

SEQ ID NO: 1350944 - RNA, 18 nt, Homo sapiens
gccuugggcuccugauga

SEQ ID NO: 1350945 - RNA, 20 nt, Homo sapiens
gccuuguacagucugcuccu

SEQ ID NO: 1350946 - RNA, 13 nt, Homo sapiens
gccuugucagugu

SEQ ID NO: 1350947 - RNA, 15 nt, Homo sapiens
gccuuuaagaaccuu

SEQ ID NO: 1350948 - RNA, 18 nt, Homo sapiens
gccuuuauuugcuguuaa

SEQ ID NO: 1350949 - RNA, 14 nt, Homo sapiens
gccuuuuauguaaa

SEQ ID NO: 1350950 - RNA, 18 nt, Homo sapiens
gcgaacucucagaaauaa

SEQ ID NO: 1350951 - RNA, 19 nt, Homo sapiens
gcgcacagagggaagccau

SEQ ID NO: 1350952 - RNA, 17 nt, Homo sapiens
gcgcagggcuggcacgu

SEQ ID NO: 1350953 - RNA, 15 nt, Homo sapiens
gcgccacccgggcaa

SEQ ID NO: 1350954 - RNA, 19 nt, Homo sapiens
gcgcccagccuacauucac

SEQ ID NO: 1350955 - RNA, 22 nt, Homo sapiens
gcgccugacauucacacagaga

SEQ ID NO: 1350956 - RNA, 14 nt, Homo sapiens
gcgcggugucucug

SEQ ID NO: 1350957 - RNA, 16 nt, Homo sapiens
gcgcugcuugguguga

SEQ ID NO: 1350958 - RNA, 19 nt, Homo sapiens
gcgcuucaguucagcuuua

SEQ ID NO: 1350959 - RNA, 23 nt, Homo sapiens
gcgguuccucaucugagaggcuc

SEQ ID NO: 1350960 - RNA, 15 nt, Homo sapiens
gcgucgguccuggug

SEQ ID NO: 1350961 - RNA, 17 nt, Homo sapiens
gcgugggcgcuugcacc

SEQ ID NO: 1350962 - RNA, 17 nt, Homo sapiens
gcguuugaacucaggga

SEQ ID NO: 1350963 - RNA, 14 nt, Homo sapiens
gcuaaaacuggccc

SEQ ID NO: 1350964 - RNA, 19 nt, Homo sapiens
gcuaaaauaacagauuucu

SEQ ID NO: 1350965 - RNA, 14 nt, Homo sapiens
gcuaacucugaccu

SEQ ID NO: 1350966 - RNA, 15 nt, Homo sapiens
gcuaacugguuaaac

SEQ ID NO: 1350967 - RNA, 17 nt, Homo sapiens
gcuaacugguuaaacau

SEQ ID NO: 1350968 - RNA, 13 nt, Homo sapiens
gcuaagaaccugg

SEQ ID NO: 1350969 - RNA, 15 nt, Homo sapiens
gcuaauauacuugua

SEQ ID NO: 1350970 - RNA, 13 nt, Homo sapiens
gcuaaugucacaa

SEQ ID NO: 1350971 - RNA, 16 nt, Homo sapiens
gcuacaaaaacacagc

SEQ ID NO: 1350972 - RNA, 19 nt, Homo sapiens
gcuaccccucaaacugcac

SEQ ID NO: 1350973 - RNA, 16 nt, Homo sapiens
gcuacuauguacugcc

SEQ ID NO: 1350974 - RNA, 18 nt, Homo sapiens
gcuacuauguacugccuu

SEQ ID NO: 1350975 - RNA, 18 nt, Homo sapiens
gcuacugcuucaaucuca

SEQ ID NO: 1350976 - RNA, 15 nt, Homo sapiens
gcuagaaaacauuuu

SEQ ID NO: 1350977 - RNA, 22 nt, Homo sapiens
gcuagaaaaggccuucuuccca

SEQ ID NO: 1350978 - RNA, 22 nt, Homo sapiens
gcuagacaguucuuuguuugga

SEQ ID NO: 1350979 - RNA, 14 nt, Homo sapiens
gcuagagugcaaug

SEQ ID NO: 1350980 - RNA, 20 nt, Homo sapiens
gcuagcaccauggcaugcgc

SEQ ID NO: 1350981 - RNA, 13 nt, Homo sapiens
gcuagcaguacua

SEQ ID NO: 1350982 - RNA, 15 nt, Homo sapiens
gcuaggaacuuggga

SEQ ID NO: 1350983 - RNA, 15 nt, Homo sapiens
gcuagggaauaucaa

SEQ ID NO: 1350984 - RNA, 20 nt, Homo sapiens
gcuaguauaaacaaacaaau

SEQ ID NO: 1350985 - RNA, 17 nt, Homo sapiens
gcuagucccugccugaa

SEQ ID NO: 1350986 - RNA, 12 nt, Homo sapiens
gcuagugccuuu

SEQ ID NO: 1350987 - RNA, 13 nt, Homo sapiens
gcuauaggugcua

SEQ ID NO: 1350988 - RNA, 21 nt, Homo sapiens
gcuauggaggguccuccucca

SEQ ID NO: 1350989 - RNA, 19 nt, Homo sapiens
gcuauucccuggggcugcu

SEQ ID NO: 1350990 - RNA, 17 nt, Homo sapiens
gcucaaacaacauucca

SEQ ID NO: 1350991 - RNA, 20 nt, Homo sapiens
gcucagacugggcacugggg

SEQ ID NO: 1350992 - RNA, 17 nt, Homo sapiens
gcucagauuguaauaug

SEQ ID NO: 1350993 - RNA, 21 nt, Homo sapiens
gcucagcccugcaccaugcug

SEQ ID NO: 1350994 - RNA, 22 nt, Homo sapiens
gcucagcuucuccugugugauu

SEQ ID NO: 1350995 - RNA, 15 nt, Homo sapiens
gcucaggcacauaca

SEQ ID NO: 1350996 - RNA, 19 nt, Homo sapiens
gcucagucgcuagcauuuc

SEQ ID NO: 1350997 - RNA, 19 nt, Homo sapiens
gcucaugccuguaaucuca

SEQ ID NO: 1350998 - RNA, 16 nt, Homo sapiens
gcuccaaccugcaaag

SEQ ID NO: 1350999 - RNA, 20 nt, Homo sapiens
gcuccaccagcagcauggca

SEQ ID NO: 1351000 - RNA, 18 nt, Homo sapiens
gcuccauacacacgcugc

SEQ ID NO: 1351001 - RNA, 14 nt, Homo sapiens
gcucccggguccug

SEQ ID NO: 1351002 - RNA, 18 nt, Homo sapiens
gcucccugcgccugacau

SEQ ID NO: 1351003 - RNA, 13 nt, Homo sapiens
gcucccugcucag

SEQ ID NO: 1351004 - RNA, 13 nt, Homo sapiens
gcuccuccucacc

SEQ ID NO: 1351005 - RNA, 21 nt, Homo sapiens
gcuccucuccccagcccagag

SEQ ID NO: 1351006 - RNA, 16 nt, Homo sapiens
gcuccugagugucaug

SEQ ID NO: 1351007 - RNA, 16 nt, Homo sapiens
gcucgacacuuaccac

SEQ ID NO: 1351008 - RNA, 14 nt, Homo sapiens
gcucgauuccucag

SEQ ID NO: 1351009 - RNA, 17 nt, Homo sapiens
gcucuccuccaccucaa

SEQ ID NO: 1351010 - RNA, 18 nt, Homo sapiens
gcucucuauagcaccagg

SEQ ID NO: 1351011 - RNA, 12 nt, Homo sapiens
gcucucucugag

SEQ ID NO: 1351012 - RNA, 16 nt, Homo sapiens
ggagacaugugacauu

SEQ ID NO: 1351013 - RNA, 21 nt, Homo sapiens
ggagacugaccaucaugcccu

SEQ ID NO: 1351014 - RNA, 17 nt, Homo sapiens
ggagauaaucuagaaca

SEQ ID NO: 1351015 - RNA, 16 nt, Homo sapiens
ggagcacggacuguca

SEQ ID NO: 1351016 - RNA, 18 nt, Homo sapiens
ggagccccgccacagccu

SEQ ID NO: 1351017 - RNA, 18 nt, Homo sapiens
ggagcccuauugcugcua

SEQ ID NO: 1351018 - RNA, 13 nt, Homo sapiens
ggagcgcuaccca

SEQ ID NO: 1351019 - RNA, 13 nt, Homo sapiens
ggaggacaugggg

SEQ ID NO: 1351020 - RNA, 19 nt, Homo sapiens
ggaggcacacuuucuggca

SEQ ID NO: 1351021 - RNA, 19 nt, Homo sapiens
ggaggcggccuccaugcac

SEQ ID NO: 1351022 - RNA, 15 nt, Homo sapiens
ggagggagguggucc

SEQ ID NO: 1351023 - RNA, 17 nt, Homo sapiens
ggagggcucagggcagu

SEQ ID NO: 1351024 - RNA, 20 nt, Homo sapiens
ggagggcucgggguguguca

SEQ ID NO: 1351025 - RNA, 16 nt, Homo sapiens
ggaggugacggcacuc

SEQ ID NO: 1351026 - RNA, 23 nt, Homo sapiens
ggagugaggaugucugggccacu

SEQ ID NO: 1351027 - RNA, 12 nt, Homo sapiens
ggagugaugaac

SEQ ID NO: 1351028 - RNA, 15 nt, Homo sapiens
ggaguggccacuaag

SEQ ID NO: 1351029 - RNA, 14 nt, Homo sapiens
ggaguggcugccau

SEQ ID NO: 1351030 - RNA, 18 nt, Homo sapiens
ggaguguaaaauguauau

SEQ ID NO: 1351031 - RNA, 15 nt, Homo sapiens
ggauaaauaucuuac

SEQ ID NO: 1351032 - RNA, 21 nt, Homo sapiens
ggauaaguuucuauucuguca

SEQ ID NO: 1351033 - RNA, 19 nt, Homo sapiens
ggauacaggugacagugaa

SEQ ID NO: 1351034 - RNA, 19 nt, Homo sapiens
ggauagaggguacuugaau

SEQ ID NO: 1351035 - RNA, 15 nt, Homo sapiens
ggauaguuucuuccc

SEQ ID NO: 1351036 - RNA, 19 nt, Homo sapiens
ggauaucacuuccaugaca

SEQ ID NO: 1351037 - RNA, 19 nt, Homo sapiens
ggauauccucccuccagau

SEQ ID NO: 1351038 - RNA, 18 nt, Homo sapiens
ggaucaaucugcaaaaaa

SEQ ID NO: 1351039 - RNA, 23 nt, Homo sapiens
ggaucagcaacccuuccugcugc

SEQ ID NO: 1351040 - RNA, 22 nt, Homo sapiens
ggaucaguuaacuauugcauuu

SEQ ID NO: 1351041 - RNA, 12 nt, Homo sapiens
ggauccagcacu

SEQ ID NO: 1351042 - RNA, 15 nt, Homo sapiens
ggauccuccacagag

SEQ ID NO: 1351043 - RNA, 12 nt, Homo sapiens
ggaucugaggga

SEQ ID NO: 1351044 - RNA, 24 nt, Homo sapiens
ggaucuugcaaaagaugucugauc

SEQ ID NO: 1351045 - RNA, 10 nt, Homo sapiens
ggaugggagc

SEQ ID NO: 1351046 - RNA, 20 nt, Homo sapiens
ggauggggugggcuuagggg

SEQ ID NO: 1351047 - RNA, 14 nt, Homo sapiens
ggaugguugaauga

SEQ ID NO: 1351048 - RNA, 15 nt, Homo sapiens
ggaugguugaaugag

SEQ ID NO: 1351049 - RNA, 16 nt, Homo sapiens
ggauguaccagcaucu

SEQ ID NO: 1351050 - RNA, 12 nt, Homo sapiens
ggaugucucuca

SEQ ID NO: 1351051 - RNA, 23 nt, Homo sapiens
ggaugucugccacaccucuccaa

SEQ ID NO: 1351052 - RNA, 13 nt, Homo sapiens
ggauguugcuaua

SEQ ID NO: 1351053 - RNA, 13 nt, Homo sapiens
ggauuacaggcau

SEQ ID NO: 1351054 - RNA, 23 nt, Homo sapiens
ggauuaccagggacuaucuuugc

SEQ ID NO: 1351055 - RNA, 19 nt, Homo sapiens
ggauucuagaacugugaau

SEQ ID NO: 1351056 - RNA, 21 nt, Homo sapiens
ggauuguauuuaagacauaaa

SEQ ID NO: 1351057 - RNA, 15 nt, Homo sapiens
ggauuuuaccaaagc

SEQ ID NO: 1351058 - RNA, 24 nt, Homo sapiens
ggcaaagaaaaugaaaugcauauu

SEQ ID NO: 1351059 - RNA, 20 nt, Homo sapiens
ggcaaagugacaaagcaauu

SEQ ID NO: 1351060 - RNA, 18 nt, Homo sapiens
ggcaaaugccugacucag

SEQ ID NO: 1351061 - RNA, 19 nt, Homo sapiens
ggcaacauucauugccaag

SEQ ID NO: 1351062 - RNA, 18 nt, Homo sapiens
ggcaauauagcaagaucc

SEQ ID NO: 1351063 - RNA, 16 nt, Homo sapiens
ggcaaucucagaugca

SEQ ID NO: 1351064 - RNA, 17 nt, Homo sapiens
ggcaaucuuugccuuua

SEQ ID NO: 1351065 - RNA, 17 nt, Homo sapiens
ggcacaaauacauuccu

SEQ ID NO: 1351066 - RNA, 12 nt, Homo sapiens
ggcacacacugu

SEQ ID NO: 1351067 - RNA, 15 nt, Homo sapiens
ggcacacacugugcc

SEQ ID NO: 1351068 - RNA, 20 nt, Homo sapiens
ggcacagccuucuccacugg

SEQ ID NO: 1351069 - RNA, 22 nt, Homo sapiens
ggcacauacaccucgucaagag

SEQ ID NO: 1351070 - RNA, 15 nt, Homo sapiens
ggcacccccaugcug

SEQ ID NO: 1351071 - RNA, 13 nt, Homo sapiens
ggcaccugaccac

SEQ ID NO: 1351072 - RNA, 14 nt, Homo sapiens
ggcacucagucucu

SEQ ID NO: 1351073 - RNA, 15 nt, Homo sapiens
ggcagaaccaaagcu

SEQ ID NO: 1351074 - RNA, 17 nt, Homo sapiens
ggcagacucgggaccaa

SEQ ID NO: 1351075 - RNA, 18 nt, Homo sapiens
ggcagagguugcagugaa

SEQ ID NO: 1351076 - RNA, 18 nt, Homo sapiens
ggcagccacaacugcagu

SEQ ID NO: 1351077 - RNA, 20 nt, Homo sapiens
ggcagccucuccgacucugc

SEQ ID NO: 1351078 - RNA, 16 nt, Homo sapiens
ggcagcuagugccuuu

SEQ ID NO: 1351079 - RNA, 18 nt, Homo sapiens
ggcaggaaauacuuugua

SEQ ID NO: 1351080 - RNA, 21 nt, Homo sapiens
ggcagggagagaguagcugca

SEQ ID NO: 1351081 - RNA, 16 nt, Homo sapiens
ggcagggaugauggca

SEQ ID NO: 1351082 - RNA, 17 nt, Homo sapiens
ggcagggcccacgugua

SEQ ID NO: 1351083 - RNA, 11 nt, Homo sapiens
ggcagugcacg

SEQ ID NO: 1351084 - RNA, 17 nt, Homo sapiens
ggcaguggaugggugcu

SEQ ID NO: 1351085 - RNA, 17 nt, Homo sapiens
ggcauagcucuggggug

SEQ ID NO: 1351086 - RNA, 15 nt, Homo sapiens
ggcaucucugagcaa

SEQ ID NO: 1351087 - RNA, 17 nt, Homo sapiens
ggcaucucugagcaauu

SEQ ID NO: 1351088 - RNA, 18 nt, Homo sapiens
ggcauggccagguggcca

SEQ ID NO: 1351089 - RNA, 14 nt, Homo sapiens
ggcaugguggcaca

SEQ ID NO: 1351090 - RNA, 12 nt, Homo sapiens
ggccaacaaaga

SEQ ID NO: 1351091 - RNA, 22 nt, Homo sapiens
ggccaaggagggugagugcaag

SEQ ID NO: 1351092 - RNA, 23 nt, Homo sapiens
ggccaaggugccaccacccugcc

SEQ ID NO: 1351093 - RNA, 15 nt, Homo sapiens
ggccacacccaggaa

SEQ ID NO: 1351094 - RNA, 23 nt, Homo sapiens
ggccacccaaggaugucugccac

SEQ ID NO: 1351095 - RNA, 20 nt, Homo sapiens
ggccaccugcaggacccugu

SEQ ID NO: 1351096 - RNA, 16 nt, Homo sapiens
ggccacgggucugugu

SEQ ID NO: 1351097 - RNA, 13 nt, Homo sapiens
ggccagauccagc

SEQ ID NO: 1351098 - RNA, 14 nt, Homo sapiens
ggccagcccagcca

SEQ ID NO: 1351099 - RNA, 12 nt, Homo sapiens
ggccaguggccu

SEQ ID NO: 1351100 - RNA, 13 nt, Homo sapiens
ggccauauuaccc

SEQ ID NO: 1351101 - RNA, 23 nt, Homo sapiens
ggccaucugacugccaagccaga

SEQ ID NO: 1351102 - RNA, 18 nt, Homo sapiens
ggcccaguucacccugau

SEQ ID NO: 1351103 - RNA, 23 nt, Homo sapiens
ggcccccaaugacacccaugcca

SEQ ID NO: 1351104 - RNA, 17 nt, Homo sapiens
ggccccuaggugcccag

SEQ ID NO: 1351105 - RNA, 21 nt, Homo sapiens
ggcccugcccugcccaaccuc

SEQ ID NO: 1351106 - RNA, 18 nt, Homo sapiens
ggcccugccguuuccccu

SEQ ID NO: 1351107 - RNA, 20 nt, Homo sapiens
ggcccuuggaaaaacaggaa

SEQ ID NO: 1351108 - RNA, 18 nt, Homo sapiens
ggccggagucagugccag

SEQ ID NO: 1351109 - RNA, 16 nt, Homo sapiens
ggccgugagggguccc

SEQ ID NO: 1351110 - RNA, 13 nt, Homo sapiens
ggccguggcacag

SEQ ID NO: 1351111 - RNA, 15 nt, Homo sapiens
ggccuauuccugcug

SEQ ID NO: 1351112 - RNA, 22 nt, Homo sapiens
ggccucccaaagugcugggauu

SEQ ID NO: 1351113 - RNA, 14 nt, Homo sapiens
ggccugccaugcca

SEQ ID NO: 1351114 - RNA, 20 nt, Homo sapiens
ggccugcccagucgacccca

SEQ ID NO: 1351115 - RNA, 19 nt, Homo sapiens
ggccuguacccaguagaug

SEQ ID NO: 1351116 - RNA, 21 nt, Homo sapiens
ggccuuaucuccaagaccaga

SEQ ID NO: 1351117 - RNA, 22 nt, Homo sapiens
ggcgaccccgucacagccucaa

SEQ ID NO: 1351118 - RNA, 14 nt, Homo sapiens
ggcggaucaccuga

SEQ ID NO: 1351119 - RNA, 16 nt, Homo sapiens
ggcgucccuuccaacc

SEQ ID NO: 1351120 - RNA, 13 nt, Homo sapiens
ggcgugggcgcuu

SEQ ID NO: 1351121 - RNA, 12 nt, Homo sapiens
ggcuaauggagg

SEQ ID NO: 1351122 - RNA, 15 nt, Homo sapiens
ggcuagagugcaaug

SEQ ID NO: 1351123 - RNA, 20 nt, Homo sapiens
ggcuagagugcaauggugca

SEQ ID NO: 1351124 - RNA, 19 nt, Homo sapiens
ggcucagauuguaauaugu

SEQ ID NO: 1351125 - RNA, 18 nt, Homo sapiens
ggcucccacuucuuggga

SEQ ID NO: 1351126 - RNA, 17 nt, Homo sapiens
ggcucccaugucaagag

SEQ ID NO: 1351127 - RNA, 22 nt, Homo sapiens
ggcuccuccucacccaccucug

SEQ ID NO: 1351128 - RNA, 21 nt, Homo sapiens
ggcucuaauucacagugcucu

SEQ ID NO: 1351129 - RNA, 16 nt, Homo sapiens
ggcucucaacagggga

SEQ ID NO: 1351130 - RNA, 20 nt, Homo sapiens
ggcucucuugugcauuguag

SEQ ID NO: 1351131 - RNA, 14 nt, Homo sapiens
ggcugcacaggcug

SEQ ID NO: 1351132 - RNA, 19 nt, Homo sapiens
ggcugcacaggcugaaaua

SEQ ID NO: 1351133 - RNA, 11 nt, Homo sapiens
ggcugccuugu

SEQ ID NO: 1351134 - RNA, 13 nt, Homo sapiens
ggcugcugaccau

SEQ ID NO: 1351135 - RNA, 20 nt, Homo sapiens
ggcuggagccuggggugucc

SEQ ID NO: 1351136 - RNA, 15 nt, Homo sapiens
ggcuggagugcaaug

SEQ ID NO: 1351137 - RNA, 22 nt, Homo sapiens
ggcuggagugugaggguccugc

SEQ ID NO: 1351138 - RNA, 11 nt, Homo sapiens
ggcugggagac

SEQ ID NO: 1351139 - RNA, 13 nt, Homo sapiens
ggcugggugguau

SEQ ID NO: 1351140 - RNA, 22 nt, Homo sapiens
ggcuguaaauccuagacuugaa

SEQ ID NO: 1351141 - RNA, 17 nt, Homo sapiens
ggcuguguuaugaaaau

SEQ ID NO: 1351142 - RNA, 13 nt, Homo sapiens
ggcuucacauuca

SEQ ID NO: 1351143 - RNA, 19 nt, Homo sapiens
ggcuuccccagguggccug

SEQ ID NO: 1351144 - RNA, 16 nt, Homo sapiens
ggcuucuccaaaggga

SEQ ID NO: 1351145 - RNA, 14 nt, Homo sapiens
ggcuuuaaagcuga

SEQ ID NO: 1351146 - RNA, 14 nt, Homo sapiens
ggcuuuaacauccu

SEQ ID NO: 1351147 - RNA, 23 nt, Homo sapiens
ggcuuuacauggguucaauugga

SEQ ID NO: 1351148 - RNA, 9 nt, Homo sapiens
ggcuuuaug

SEQ ID NO: 1351149 - RNA, 23 nt, Homo sapiens
ggcuuuaugcaaauacaaucagc

SEQ ID NO: 1351150 - RNA, 18 nt, Homo sapiens
ucgugggguaacaucugu

SEQ ID NO: 1351151 - RNA, 22 nt, Homo sapiens
ucgugggucccagagaccucau

SEQ ID NO: 1351152 - RNA, 12 nt, Homo sapiens
ucguuacauugu

SEQ ID NO: 1351153 - RNA, 15 nt, Homo sapiens
ucguucucugccuca

SEQ ID NO: 1351154 - RNA, 22 nt, Homo sapiens
ucuaaaaaaggaauccucugug

SEQ ID NO: 1351155 - RNA, 20 nt, Homo sapiens
ucuaaagauacagugucuga

SEQ ID NO: 1351156 - RNA, 14 nt, Homo sapiens
ucuaaauacugaga

SEQ ID NO: 1351157 - RNA, 20 nt, Homo sapiens
ucuaaauggugcugcagauu

SEQ ID NO: 1351158 - RNA, 21 nt, Homo sapiens
ucuaacugauagaacguuacu

SEQ ID NO: 1351159 - RNA, 12 nt, Homo sapiens
ucuaaguauuua

SEQ ID NO: 1351160 - RNA, 13 nt, Homo sapiens
ucuaagugauaua

SEQ ID NO: 1351161 - RNA, 14 nt, Homo sapiens
ucuaagugcugcug

SEQ ID NO: 1351162 - RNA, 17 nt, Homo sapiens
ucuaaguguggguuuau

SEQ ID NO: 1351163 - RNA, 19 nt, Homo sapiens
ucuaaguuaaacagucagu

SEQ ID NO: 1351164 - RNA, 23 nt, Homo sapiens
ucuaaugauguucucugacccag

SEQ ID NO: 1351165 - RNA, 18 nt, Homo sapiens
ucuaauuuuacacucugu

SEQ ID NO: 1351166 - RNA, 21 nt, Homo sapiens
ucuacaaacucccacuuguca

SEQ ID NO: 1351167 - RNA, 16 nt, Homo sapiens
ucuacauacuauggaa

SEQ ID NO: 1351168 - RNA, 18 nt, Homo sapiens
ucuaccaagcugucacag

SEQ ID NO: 1351169 - RNA, 10 nt, Homo sapiens
ucuaccccag

SEQ ID NO: 1351170 - RNA, 20 nt, Homo sapiens
ucuaccucuuggcugccuug

SEQ ID NO: 1351171 - RNA, 15 nt, Homo sapiens
ucuacuuuaucaauu

SEQ ID NO: 1351172 - RNA, 13 nt, Homo sapiens
ucuagcacacuuu

SEQ ID NO: 1351173 - RNA, 14 nt, Homo sapiens
ucuaguugucaaua

SEQ ID NO: 1351174 - RNA, 13 nt, Homo sapiens
ucuauaaagauca

SEQ ID NO: 1351175 - RNA, 18 nt, Homo sapiens
ucuauaugaaugcuauuu

SEQ ID NO: 1351176 - RNA, 12 nt, Homo sapiens
ucuauguuaaua

SEQ ID NO: 1351177 - RNA, 17 nt, Homo sapiens
ucuauguuuuaccaagc

SEQ ID NO: 1351178 - RNA, 19 nt, Homo sapiens
ucuauucuuggaaccacga

SEQ ID NO: 1351179 - RNA, 13 nt, Homo sapiens
ucuauuugagauu

SEQ ID NO: 1351180 - RNA, 20 nt, Homo sapiens
ucuauuuuaauuacugcuau

SEQ ID NO: 1351181 - RNA, 13 nt, Homo sapiens
ucuauuuugugaa

SEQ ID NO: 1351182 - RNA, 22 nt, Homo sapiens
ucucaaauucauggugcacuga

SEQ ID NO: 1351183 - RNA, 15 nt, Homo sapiens
ucucaagaccaacag

SEQ ID NO: 1351184 - RNA, 16 nt, Homo sapiens
ucucaagaccaacaga

SEQ ID NO: 1351185 - RNA, 17 nt, Homo sapiens
ucucacauauacaagua

SEQ ID NO: 1351186 - RNA, 20 nt, Homo sapiens
ucucacggcuuguaaaugug

SEQ ID NO: 1351187 - RNA, 19 nt, Homo sapiens
ucucagaguguuuugacca

SEQ ID NO: 1351188 - RNA, 22 nt, Homo sapiens
ucucaggaccgugcccucguca

SEQ ID NO: 1351189 - RNA, 18 nt, Homo sapiens
ucucaggccugacucuca

SEQ ID NO: 1351190 - RNA, 15 nt, Homo sapiens
ucucauaacucugug

SEQ ID NO: 1351191 - RNA, 18 nt, Homo sapiens
ucucauaacucugugauc

SEQ ID NO: 1351192 - RNA, 20 nt, Homo sapiens
ucucauaggcuaagucagcu

SEQ ID NO: 1351193 - RNA, 18 nt, Homo sapiens
ucucauauaagacaaaua

SEQ ID NO: 1351194 - RNA, 17 nt, Homo sapiens
ucucaugauagaaggcu

SEQ ID NO: 1351195 - RNA, 13 nt, Homo sapiens
ucucauucagaag

SEQ ID NO: 1351196 - RNA, 19 nt, Homo sapiens
ucucauuucgggugaaucu

SEQ ID NO: 1351197 - RNA, 13 nt, Homo sapiens
ucuccaaagggag

SEQ ID NO: 1351198 - RNA, 18 nt, Homo sapiens
ucuccaaggcagggacca

SEQ ID NO: 1351199 - RNA, 17 nt, Homo sapiens
ucuccacuuucucaaug

SEQ ID NO: 1351200 - RNA, 20 nt, Homo sapiens
ucuccagcaauaauguuuuc

SEQ ID NO: 1351201 - RNA, 21 nt, Homo sapiens
ucuguggagggagggcagcug

SEQ ID NO: 1351202 - RNA, 13 nt, Homo sapiens
ucuguggcuuuca

SEQ ID NO: 1351203 - RNA, 17 nt, Homo sapiens
ucuguggugcagugugu

SEQ ID NO: 1351204 - RNA, 23 nt, Homo sapiens
ucuguggugcagugugugaaaau

SEQ ID NO: 1351205 - RNA, 23 nt, Homo sapiens
ucuguguguguguaugugggggu

SEQ ID NO: 1351206 - RNA, 14 nt, Homo sapiens
ucuguguguugacu

SEQ ID NO: 1351207 - RNA, 16 nt, Homo sapiens
ucuguuaauaaucuca

SEQ ID NO: 1351208 - RNA, 19 nt, Homo sapiens
ucuuaacccccuagaaaga

SEQ ID NO: 1351209 - RNA, 23 nt, Homo sapiens
ucuuacaacaggcuuaugaauau

SEQ ID NO: 1351210 - RNA, 15 nt, Homo sapiens
ucuuacauuagcagu

SEQ ID NO: 1351211 - RNA, 15 nt, Homo sapiens
ucuuacauuagugau

SEQ ID NO: 1351212 - RNA, 22 nt, Homo sapiens
ucuuaccagugacgcugcugac

SEQ ID NO: 1351213 - RNA, 14 nt, Homo sapiens
ucuuacuaaaaagu

SEQ ID NO: 1351214 - RNA, 20 nt, Homo sapiens
ucuuacuucccuaaugaagu

SEQ ID NO: 1351215 - RNA, 22 nt, Homo sapiens
ucuuagaguccagacacaaaga

SEQ ID NO: 1351216 - RNA, 20 nt, Homo sapiens
ucuuagauauucacuaagga

SEQ ID NO: 1351217 - RNA, 19 nt, Homo sapiens
ucuuagcccucaccacagc

SEQ ID NO: 1351218 - RNA, 15 nt, Homo sapiens
ucuuaguguaugauu

SEQ ID NO: 1351219 - RNA, 20 nt, Homo sapiens
ucuuagugugccaagaguuc

SEQ ID NO: 1351220 - RNA, 21 nt, Homo sapiens
ucuuauccaacaucaacaucu

SEQ ID NO: 1351221 - RNA, 12 nt, Homo sapiens
ucuuauggggcc

SEQ ID NO: 1351222 - RNA, 16 nt, Homo sapiens
ucuuaugugugccuuu

SEQ ID NO: 1351223 - RNA, 20 nt, Homo sapiens
ucuuauuaagacuggcuuua

SEQ ID NO: 1351224 - RNA, 16 nt, Homo sapiens
ucuuauugacucauac

SEQ ID NO: 1351225 - RNA, 20 nt, Homo sapiens
ucuuauuucauuucuuugag

SEQ ID NO: 1351226 - RNA, 14 nt, Homo sapiens
ucuucauacuuaaa

SEQ ID NO: 1351227 - RNA, 20 nt, Homo sapiens
ucuucauuaccucagugaga

SEQ ID NO: 1351228 - RNA, 20 nt, Homo sapiens
ucuuccaaagaacuguauaa

SEQ ID NO: 1351229 - RNA, 20 nt, Homo sapiens
ucuuccacccacaaacucca

SEQ ID NO: 1351230 - RNA, 14 nt, Homo sapiens
ucuucccugaccuc

SEQ ID NO: 1351231 - RNA, 21 nt, Homo sapiens
ucuuccucccucauuccaccu

SEQ ID NO: 1351232 - RNA, 12 nt, Homo sapiens
ucuuccugucuc

SEQ ID NO: 1351233 - RNA, 22 nt, Homo sapiens
ucuucuaagaauuuuaucuguu

SEQ ID NO: 1351234 - RNA, 13 nt, Homo sapiens
ucuucuacacagc

SEQ ID NO: 1351235 - RNA, 17 nt, Homo sapiens
ucuucuacacagcaaua

SEQ ID NO: 1351236 - RNA, 19 nt, Homo sapiens
ucuucuacaugcaauuuag

SEQ ID NO: 1351237 - RNA, 22 nt, Homo sapiens
ucuucuauggguuggacaaccu

SEQ ID NO: 1351238 - RNA, 14 nt, Homo sapiens
ucuucuccacugga

SEQ ID NO: 1351239 - RNA, 15 nt, Homo sapiens
ucuucucguuuucac

SEQ ID NO: 1351240 - RNA, 21 nt, Homo sapiens
ucuucugcaagccucaugcca

SEQ ID NO: 1351241 - RNA, 21 nt, Homo sapiens
ucuucuuucuuccacccacaa

SEQ ID NO: 1351242 - RNA, 13 nt, Homo sapiens
ucuugaaacugug

SEQ ID NO: 1351243 - RNA, 14 nt, Homo sapiens
ucuugaaggugcug

SEQ ID NO: 1351244 - RNA, 13 nt, Homo sapiens
ucuugaguuccuc

SEQ ID NO: 1351245 - RNA, 20 nt, Homo sapiens
ucuugccugcuccaucucau

SEQ ID NO: 1351246 - RNA, 16 nt, Homo sapiens
ucuugcuaauucucag

SEQ ID NO: 1351247 - RNA, 17 nt, Homo sapiens
ucuugcucugcauuuau

SEQ ID NO: 1351248 - RNA, 17 nt, Homo sapiens
ucuuggaaaaggaacuc

SEQ ID NO: 1351249 - RNA, 18 nt, Homo sapiens
ucuuggccgacucaggga

SEQ ID NO: 1351250 - RNA, 13 nt, Homo sapiens
ucuuggcugagga

SEQ ID NO: 1351251 - RNA, 20 nt, Homo sapiens
ucuugggcccaggacuguug

SEQ ID NO: 1351252 - RNA, 16 nt, Homo sapiens
ucuugggggugguuuu

SEQ ID NO: 1351253 - RNA, 18 nt, Homo sapiens
ucuuggguucaagugauu

SEQ ID NO: 1351254 - RNA, 22 nt, Homo sapiens
ucuuguuuuuuuuuuccacuua

SEQ ID NO: 1351255 - RNA, 12 nt, Homo sapiens
ucuuuacuuucc

SEQ ID NO: 1351256 - RNA, 21 nt, Homo sapiens
ugaauuauguuauuugcucua

SEQ ID NO: 1351257 - RNA, 13 nt, Homo sapiens
ugaauucaccgug

SEQ ID NO: 1351258 - RNA, 13 nt, Homo sapiens
ugaauuuaauaca

SEQ ID NO: 1351259 - RNA, 16 nt, Homo sapiens
ugaauuucccacauac

SEQ ID NO: 1351260 - RNA, 13 nt, Homo sapiens
ugacaaccaaaag

SEQ ID NO: 1351261 - RNA, 19 nt, Homo sapiens
ugacaaccaaaagucuuca

SEQ ID NO: 1351262 - RNA, 14 nt, Homo sapiens
ugacaacugugaag

SEQ ID NO: 1351263 - RNA, 13 nt, Homo sapiens
ugacaaguacugu

SEQ ID NO: 1351264 - RNA, 20 nt, Homo sapiens
ugacaaguauuuucuacuaa

SEQ ID NO: 1351265 - RNA, 19 nt, Homo sapiens
ugacacccaugccagagag

SEQ ID NO: 1351266 - RNA, 22 nt, Homo sapiens
ugacacccuggccugaacugag

SEQ ID NO: 1351267 - RNA, 23 nt, Homo sapiens
ugacagagugccaacuucuuuca

SEQ ID NO: 1351268 - RNA, 20 nt, Homo sapiens
ugacagcaugguaaugaagg

SEQ ID NO: 1351269 - RNA, 13 nt, Homo sapiens
ugacagccuuccc

SEQ ID NO: 1351270 - RNA, 14 nt, Homo sapiens
ugacagggccagug

SEQ ID NO: 1351271 - RNA, 22 nt, Homo sapiens
ugacaguuaauaaaccuuugca

SEQ ID NO: 1351272 - RNA, 14 nt, Homo sapiens
ugacaucacuugua

SEQ ID NO: 1351273 - RNA, 15 nt, Homo sapiens
ugacaugcacucagc

SEQ ID NO: 1351274 - RNA, 23 nt, Homo sapiens
ugacaugggccuuuaagaaccuu

SEQ ID NO: 1351275 - RNA, 17 nt, Homo sapiens
ugacauucuuagcugua

SEQ ID NO: 1351276 - RNA, 19 nt, Homo sapiens
ugacauucuuagcuguaac

SEQ ID NO: 1351277 - RNA, 18 nt, Homo sapiens
ugacauuuauauauugaa

SEQ ID NO: 1351278 - RNA, 17 nt, Homo sapiens
ugaccaaaaugccaaaa

SEQ ID NO: 1351279 - RNA, 20 nt, Homo sapiens
ugaccacagccuuaccaaag

SEQ ID NO: 1351280 - RNA, 15 nt, Homo sapiens
ugaccaucaugcccu

SEQ ID NO: 1351281 - RNA, 17 nt, Homo sapiens
ugacccagcaucuccca

SEQ ID NO: 1351282 - RNA, 22 nt, Homo sapiens
ugaccccuguccccacacugac

SEQ ID NO: 1351283 - RNA, 11 nt, Homo sapiens
ugaccuacccc

SEQ ID NO: 1351284 - RNA, 17 nt, Homo sapiens
ugaccuaccccagccag

SEQ ID NO: 1351285 - RNA, 18 nt, Homo sapiens
ugaccucccaacucuaaa

SEQ ID NO: 1351286 - RNA, 22 nt, Homo sapiens
ugaccuugcugauggugacauu

SEQ ID NO: 1351287 - RNA, 21 nt, Homo sapiens
ugacguuuuuccaguucacau

SEQ ID NO: 1351288 - RNA, 22 nt, Homo sapiens
ugacuccccccaucccugccac

SEQ ID NO: 1351289 - RNA, 22 nt, Homo sapiens
ugacucuccugccucagccucc

SEQ ID NO: 1351290 - RNA, 19 nt, Homo sapiens
ugacugcauugccgcugua

SEQ ID NO: 1351291 - RNA, 12 nt, Homo sapiens
ugacugugguag

SEQ ID NO: 1351292 - RNA, 17 nt, Homo sapiens
ugacuuacugacaaaag

SEQ ID NO: 1351293 - RNA, 13 nt, Homo sapiens
ugacuuauggcau

SEQ ID NO: 1351294 - RNA, 15 nt, Homo sapiens
ugacuuccccuuauu

SEQ ID NO: 1351295 - RNA, 14 nt, Homo sapiens
ugacuuccugccau

SEQ ID NO: 1351296 - RNA, 20 nt, Homo sapiens
ugacuuucaguaaacauaaa

SEQ ID NO: 1351297 - RNA, 21 nt, Homo sapiens
ugacuuugggaaagagggacc

SEQ ID NO: 1351298 - RNA, 15 nt, Homo sapiens
ugacuuuuaauguca

SEQ ID NO: 1351299 - RNA, 12 nt, Homo sapiens
ugagaaaaccug

SEQ ID NO: 1351300 - RNA, 23 nt, Homo sapiens
ugagaaaaccuguucuaccaagc

SEQ ID NO: 1351301 - RNA, 18 nt, Homo sapiens
ugagaaaagccucuccag

SEQ ID NO: 1351302 - RNA, 12 nt, Homo sapiens
ugagaaagggau

SEQ ID NO: 1351303 - RNA, 13 nt, Homo sapiens
ugagaacaaucau

SEQ ID NO: 1351304 - RNA, 15 nt, Homo sapiens
ugagaagaaaaucag

SEQ ID NO: 1351305 - RNA, 13 nt, Homo sapiens
ugagaagaucuga

SEQ ID NO: 1351306 - RNA, 16 nt, Homo sapiens
ugagaagugcacuuua

SEQ ID NO: 1351307 - RNA, 19 nt, Homo sapiens
ugagaccagccugggcaac

SEQ ID NO: 1351308 - RNA, 17 nt, Homo sapiens
ugagacuccucagcacc

SEQ ID NO: 1351309 - RNA, 19 nt, Homo sapiens
ugagacugggcaucucuga

SEQ ID NO: 1351310 - RNA, 13 nt, Homo sapiens
ugagacuguguug

SEQ ID NO: 1351311 - RNA, 22 nt, Homo sapiens
ugagagaaagagagaagccagc

SEQ ID NO: 1351312 - RNA, 16 nt, Homo sapiens
ugagaggaacaagaag

SEQ ID NO: 1351313 - RNA, 22 nt, Homo sapiens
ugagaugcaggauuucuucaca

SEQ ID NO: 1351314 - RNA, 19 nt, Homo sapiens
ugagauguugagaggaaca

SEQ ID NO: 1351315 - RNA, 18 nt, Homo sapiens
ugagcaagacauacuuaa

SEQ ID NO: 1351316 - RNA, 20 nt, Homo sapiens
ugcacaguugccacauuuag

SEQ ID NO: 1351317 - RNA, 21 nt, Homo sapiens
ugcacaugaguggaaauacac

SEQ ID NO: 1351318 - RNA, 13 nt, Homo sapiens
ugcaccaaagaca

SEQ ID NO: 1351319 - RNA, 15 nt, Homo sapiens
ugcaccaccaugccc

SEQ ID NO: 1351320 - RNA, 12 nt, Homo sapiens
ugcaccaucuca

SEQ ID NO: 1351321 - RNA, 15 nt, Homo sapiens
ugcaccaugcugcug

SEQ ID NO: 1351322 - RNA, 15 nt, Homo sapiens
ugcaccuggauguac

SEQ ID NO: 1351323 - RNA, 20 nt, Homo sapiens
ugcaccuuccagcccggggc

SEQ ID NO: 1351324 - RNA, 15 nt, Homo sapiens
ugcacgcugggcaau

SEQ ID NO: 1351325 - RNA, 11 nt, Homo sapiens
ugcacuccaga

SEQ ID NO: 1351326 - RNA, 15 nt, Homo sapiens
ugcacucccaccuga

SEQ ID NO: 1351327 - RNA, 16 nt, Homo sapiens
ugcacugaaguuuuug

SEQ ID NO: 1351328 - RNA, 13 nt, Homo sapiens
ugcacugcauucc

SEQ ID NO: 1351329 - RNA, 15 nt, Homo sapiens
ugcacugugaaggac

SEQ ID NO: 1351330 - RNA, 21 nt, Homo sapiens
ugcacuuuauccucauuccau

SEQ ID NO: 1351331 - RNA, 23 nt, Homo sapiens
ugcagaaaacagggucugggaca

SEQ ID NO: 1351332 - RNA, 17 nt, Homo sapiens
ugcagaaauugaccuga

SEQ ID NO: 1351333 - RNA, 16 nt, Homo sapiens
ugcagaagaaaucaua

SEQ ID NO: 1351334 - RNA, 13 nt, Homo sapiens
ugcagcagucgcc

SEQ ID NO: 1351335 - RNA, 13 nt, Homo sapiens
ugcagccacuggc

SEQ ID NO: 1351336 - RNA, 12 nt, Homo sapiens
ugcagccuaaga

SEQ ID NO: 1351337 - RNA, 12 nt, Homo sapiens
ugcagccuucau

SEQ ID NO: 1351338 - RNA, 20 nt, Homo sapiens
ugcagcggcuccugcaaaag

SEQ ID NO: 1351339 - RNA, 21 nt, Homo sapiens
ugcagcucccuccucagggau

SEQ ID NO: 1351340 - RNA, 20 nt, Homo sapiens
ugcaggccaggccagcugcc

SEQ ID NO: 1351341 - RNA, 19 nt, Homo sapiens
ugcaggggggcaguaacuc

SEQ ID NO: 1351342 - RNA, 13 nt, Homo sapiens
ugcaggugcuuuu

SEQ ID NO: 1351343 - RNA, 14 nt, Homo sapiens
ugcaggugcuuuua

SEQ ID NO: 1351344 - RNA, 20 nt, Homo sapiens
ugcaguacaacaguuuuaga

SEQ ID NO: 1351345 - RNA, 19 nt, Homo sapiens
ugcaguagugcaccaucuc

SEQ ID NO: 1351346 - RNA, 17 nt, Homo sapiens
ugcagucccacacugug

SEQ ID NO: 1351347 - RNA, 18 nt, Homo sapiens
ugcagugauguuugccau

SEQ ID NO: 1351348 - RNA, 13 nt, Homo sapiens
ugcaguuuugaca

SEQ ID NO: 1351349 - RNA, 21 nt, Homo sapiens
ugcauacuuucccucauccau

SEQ ID NO: 1351350 - RNA, 20 nt, Homo sapiens
ugcauauagacacacauaca

SEQ ID NO: 1351351 - RNA, 21 nt, Homo sapiens
ugcaucacggauggugcaugg

SEQ ID NO: 1351352 - RNA, 15 nt, Homo sapiens
ugcaucagcugcuga

SEQ ID NO: 1351353 - RNA, 16 nt, Homo sapiens
ugcaucugaccagcag

SEQ ID NO: 1351354 - RNA, 17 nt, Homo sapiens
ugcaucuuauuucuguc

SEQ ID NO: 1351355 - RNA, 14 nt, Homo sapiens
ugcaucuucccaca

SEQ ID NO: 1351356 - RNA, 21 nt, Homo sapiens
ugcaucuuuguuacuuccuua

SEQ ID NO: 1351357 - RNA, 17 nt, Homo sapiens
ugcaugacaaguacugu

SEQ ID NO: 1351358 - RNA, 16 nt, Homo sapiens
ugcaugauacuaucug

SEQ ID NO: 1351359 - RNA, 11 nt, Homo sapiens
ugcaugggcuc

SEQ ID NO: 1351360 - RNA, 16 nt, Homo sapiens
ugcauugaaagaauua

SEQ ID NO: 1351361 - RNA, 12 nt, Homo sapiens
ugcauugaacag

SEQ ID NO: 1351362 - RNA, 20 nt, Homo sapiens
ugccaaaauccaaggcaauu

SEQ ID NO: 1351363 - RNA, 14 nt, Homo sapiens
ugccaaaaugcucu

SEQ ID NO: 1351364 - RNA, 19 nt, Homo sapiens
ugccacccaguugugacaa

SEQ ID NO: 1351365 - RNA, 18 nt, Homo sapiens
ugccacuuaauguauguu

SEQ ID NO: 1351366 - RNA, 20 nt, Homo sapiens
ugccaguuguuaaaaugagc

SEQ ID NO: 1351367 - RNA, 23 nt, Homo sapiens
ugccauuugcuggacaaccaaca

SEQ ID NO: 1351368 - RNA, 14 nt, Homo sapiens
ugcccaggagacag

SEQ ID NO: 1351369 - RNA, 20 nt, Homo sapiens
ugcccaggcuagagugcaau

SEQ ID NO: 1351370 - RNA, 20 nt, Homo sapiens
ugcccaggcuggagugcaau

SEQ ID NO: 1351371 - RNA, 21 nt, Homo sapiens
ugcccaggcuggagugcaaug

SEQ ID NO: 1351372 - RNA, 19 nt, Homo sapiens
ugcccagugagacuguguu

SEQ ID NO: 1351373 - RNA, 21 nt, Homo sapiens
ugcccagugagacuguguugu

SEQ ID NO: 1351374 - RNA, 22 nt, Homo sapiens
ugcccauuguaacuuauuucag

SEQ ID NO: 1351375 - RNA, 23 nt, Homo sapiens
ugccccaccccaccucacagcua

SEQ ID NO: 1351376 - RNA, 20 nt, Homo sapiens
ugccccaccccauccagcca

SEQ ID NO: 1351377 - RNA, 17 nt, Homo sapiens
ugccccagacacagugc

SEQ ID NO: 1351378 - RNA, 14 nt, Homo sapiens
ugccccagccuguc

SEQ ID NO: 1351379 - RNA, 15 nt, Homo sapiens
ugcccccuccacugg

SEQ ID NO: 1351380 - RNA, 12 nt, Homo sapiens
ugccccugccuu

SEQ ID NO: 1351381 - RNA, 17 nt, Homo sapiens
ugcccugcccaugggag

SEQ ID NO: 1351382 - RNA, 17 nt, Homo sapiens
ugcccuggauccaucag

SEQ ID NO: 1351383 - RNA, 17 nt, Homo sapiens
ugccgcucucucugagg

SEQ ID NO: 1351384 - RNA, 17 nt, Homo sapiens
ugccgcugucucugagg

SEQ ID NO: 1351385 - RNA, 21 nt, Homo sapiens
ugccguuuccccuccuuggcu

SEQ ID NO: 1351386 - RNA, 16 nt, Homo sapiens
ugccuaaccugggacc

SEQ ID NO: 1351387 - RNA, 22 nt, Homo sapiens
ugccuacgaauagccacugcau

SEQ ID NO: 1351388 - RNA, 22 nt, Homo sapiens
ugccuaucugccuggaggcaaa

SEQ ID NO: 1351389 - RNA, 14 nt, Homo sapiens
ugccucaccugguc

SEQ ID NO: 1351390 - RNA, 20 nt, Homo sapiens
ugccucaggccaagggacca

SEQ ID NO: 1351391 - RNA, 20 nt, Homo sapiens
ugccucuucuuugugccuuu

SEQ ID NO: 1351392 - RNA, 21 nt, Homo sapiens
ugccugaaaugcuucuguuuu

SEQ ID NO: 1351393 - RNA, 17 nt, Homo sapiens
ugccugacucagugacc

SEQ ID NO: 1351394 - RNA, 14 nt, Homo sapiens
ugccuguaaucuca

SEQ ID NO: 1351395 - RNA, 22 nt, Homo sapiens
ugccuguaaucucagcacuuug

SEQ ID NO: 1351396 - RNA, 16 nt, Homo sapiens
ugccuguuaauuuaua

SEQ ID NO: 1351397 - RNA, 15 nt, Homo sapiens
ugccuuaaaauggaa

SEQ ID NO: 1351398 - RNA, 13 nt, Homo sapiens
ugccuuaccuaag

SEQ ID NO: 1351399 - RNA, 15 nt, Homo sapiens
ugccuucucaggaaa

SEQ ID NO: 1351400 - RNA, 18 nt, Homo sapiens
ugccuuuaagccaaagaa

SEQ ID NO: 1351401 - RNA, 15 nt, Homo sapiens
ugccuuuauuugcug

SEQ ID NO: 1351402 - RNA, 21 nt, Homo sapiens
ugccuuuuaucuauuugagau

SEQ ID NO: 1351403 - RNA, 14 nt, Homo sapiens
ugcgagaagcacag

SEQ ID NO: 1351404 - RNA, 14 nt, Homo sapiens
ugcgcaacuggagc

SEQ ID NO: 1351405 - RNA, 23 nt, Homo sapiens
ugcgccugacauucacacagaga

SEQ ID NO: 1351406 - RNA, 13 nt, Homo sapiens
ugcgcucuuggga

SEQ ID NO: 1351407 - RNA, 13 nt, Homo sapiens
ugcgguuccucau

SEQ ID NO: 1351408 - RNA, 18 nt, Homo sapiens
ugcgugaaugcuggucag

SEQ ID NO: 1351409 - RNA, 11 nt, Homo sapiens
ugcuaacuggu

SEQ ID NO: 1351410 - RNA, 18 nt, Homo sapiens
ugcuacaaaaacacagca

SEQ ID NO: 1351411 - RNA, 22 nt, Homo sapiens
ugcuagcaaauggcagaaccaa

SEQ ID NO: 1351412 - RNA, 13 nt, Homo sapiens
ugcuauagugaca

SEQ ID NO: 1351413 - RNA, 19 nt, Homo sapiens
ugcuauuguagagccagag

SEQ ID NO: 1351414 - RNA, 16 nt, Homo sapiens
ugcucacaaaggauac

SEQ ID NO: 1351415 - RNA, 17 nt, Homo sapiens
ugcucagacccaacagc

SEQ ID NO: 1351416 - RNA, 20 nt, Homo sapiens
ugcucagcccugcaccaugc

SEQ ID NO: 1351417 - RNA, 22 nt, Homo sapiens
ugcucagcccugcaccaugcug

SEQ ID NO: 1351418 - RNA, 16 nt, Homo sapiens
ugcucagggaaaagca

SEQ ID NO: 1351419 - RNA, 13 nt, Homo sapiens
ugcucaugcugcu

SEQ ID NO: 1351420 - RNA, 14 nt, Homo sapiens
ugcucaugcugcuc

SEQ ID NO: 1351421 - RNA, 22 nt, Homo sapiens
ugcucauuucaugaagcaagaa

SEQ ID NO: 1351422 - RNA, 20 nt, Homo sapiens
ugcuccaaccgggaugggag

SEQ ID NO: 1351423 - RNA, 14 nt, Homo sapiens
ugcuccaucucaua

SEQ ID NO: 1351424 - RNA, 13 nt, Homo sapiens
ugcucccacagaa

SEQ ID NO: 1351425 - RNA, 18 nt, Homo sapiens
ugcuccccuaaagccagg

SEQ ID NO: 1351426 - RNA, 20 nt, Homo sapiens
ugcuccccuaaagccucaaa

SEQ ID NO: 1351427 - RNA, 17 nt, Homo sapiens
ugcucccggguccugcu

SEQ ID NO: 1351428 - RNA, 16 nt, Homo sapiens
ugcucccugacugggg

SEQ ID NO: 1351429 - RNA, 16 nt, Homo sapiens
ugcuccuccuacccuu

SEQ ID NO: 1351430 - RNA, 13 nt, Homo sapiens
ugcuccugggcau

SEQ ID NO: 1351431 - RNA, 18 nt, Homo sapiens
ugcucgacacuuaccacu

SEQ ID NO: 1351432 - RNA, 16 nt, Homo sapiens
ugcucucucugagggg

SEQ ID NO: 1351433 - RNA, 21 nt, Homo sapiens
ugcucuguuaauaaucucaca

SEQ ID NO: 1351434 - RNA, 15 nt, Homo sapiens
ugcucuuagcugucu

SEQ ID NO: 1351435 - RNA, 16 nt, Homo sapiens
ugcucuuggcugaccc

SEQ ID NO: 1351436 - RNA, 15 nt, Homo sapiens
ugcugaaacaacaaa

SEQ ID NO: 1351437 - RNA, 17 nt, Homo sapiens
ugcugaauucaccugug

SEQ ID NO: 1351438 - RNA, 18 nt, Homo sapiens
ugcugaccagacagccuc

SEQ ID NO: 1351439 - RNA, 20 nt, Homo sapiens
ugcugauacugggucugcga

SEQ ID NO: 1351440 - RNA, 22 nt, Homo sapiens
ugcugauguauuucaagucucu

SEQ ID NO: 1351441 - RNA, 16 nt, Homo sapiens
ugcugcaaguuaugaa

SEQ ID NO: 1351442 - RNA, 15 nt, Homo sapiens
ugcugccagcacagu

SEQ ID NO: 1351443 - RNA, 20 nt, Homo sapiens
ugcugcuccucucuugggua

SEQ ID NO: 1351444 - RNA, 22 nt, Homo sapiens
ugcuggcucugcuguccuugcc

SEQ ID NO: 1351445 - RNA, 15 nt, Homo sapiens
ugcugggcuuggcag

SEQ ID NO: 1351446 - RNA, 14 nt, Homo sapiens
uuccuucucugggu

SEQ ID NO: 1351447 - RNA, 19 nt, Homo sapiens
uuccuugacuucuuugaga

SEQ ID NO: 1351448 - RNA, 18 nt, Homo sapiens
uuccuuuguuacuucucu

SEQ ID NO: 1351449 - RNA, 18 nt, Homo sapiens
uuccuuuuucuucacuua

SEQ ID NO: 1351450 - RNA, 19 nt, Homo sapiens
uucgcgcuggaauccagaa

SEQ ID NO: 1351451 - RNA, 14 nt, Homo sapiens
uucggauuugccau

SEQ ID NO: 1351452 - RNA, 15 nt, Homo sapiens
uucgugaugacauau

SEQ ID NO: 1351453 - RNA, 20 nt, Homo sapiens
uucuaaaaauaaaaguauug

SEQ ID NO: 1351454 - RNA, 19 nt, Homo sapiens
uucuacauacuauggaauu

SEQ ID NO: 1351455 - RNA, 20 nt, Homo sapiens
uucuaccucuuggcugccuu

SEQ ID NO: 1351456 - RNA, 18 nt, Homo sapiens
uucuacuaaaccagaaau

SEQ ID NO: 1351457 - RNA, 15 nt, Homo sapiens
uucuacuaugaucag

SEQ ID NO: 1351458 - RNA, 23 nt, Homo sapiens
uucuaugcuguuuguagugaaau

SEQ ID NO: 1351459 - RNA, 18 nt, Homo sapiens
uucucauaacucugugau

SEQ ID NO: 1351460 - RNA, 17 nt, Homo sapiens
uucucccauagcaaaga

SEQ ID NO: 1351461 - RNA, 14 nt, Homo sapiens
uucuccugccuuag

SEQ ID NO: 1351462 - RNA, 17 nt, Homo sapiens
uucuccugugugauuga

SEQ ID NO: 1351463 - RNA, 16 nt, Homo sapiens
uucucuauacucaggu

SEQ ID NO: 1351464 - RNA, 19 nt, Homo sapiens
uucucuauuucuggaugaa

SEQ ID NO: 1351465 - RNA, 14 nt, Homo sapiens
uucucuccaccagg

SEQ ID NO: 1351466 - RNA, 15 nt, Homo sapiens
uucucucuccagggu

SEQ ID NO: 1351467 - RNA, 21 nt, Homo sapiens
uucucuuaaguggucuaguca

SEQ ID NO: 1351468 - RNA, 14 nt, Homo sapiens
uucucuuuacuuga

SEQ ID NO: 1351469 - RNA, 17 nt, Homo sapiens
uucugagaaagacuauu

SEQ ID NO: 1351470 - RNA, 15 nt, Homo sapiens
uucugagccugccuu

SEQ ID NO: 1351471 - RNA, 19 nt, Homo sapiens
uucugagguccuuaugucc

SEQ ID NO: 1351472 - RNA, 19 nt, Homo sapiens
uucugaguagagcuuguaa

SEQ ID NO: 1351473 - RNA, 14 nt, Homo sapiens
uucugccacuccau

SEQ ID NO: 1351474 - RNA, 18 nt, Homo sapiens
uucugcccgcuccaugga

SEQ ID NO: 1351475 - RNA, 17 nt, Homo sapiens
uucugccuucucaggaa

SEQ ID NO: 1351476 - RNA, 16 nt, Homo sapiens
uucuggacagacagau

SEQ ID NO: 1351477 - RNA, 14 nt, Homo sapiens
uucuggauaccauu

SEQ ID NO: 1351478 - RNA, 21 nt, Homo sapiens
uucuggcaaacguuucucaaa

SEQ ID NO: 1351479 - RNA, 13 nt, Homo sapiens
uucuguaccaguu

SEQ ID NO: 1351480 - RNA, 20 nt, Homo sapiens
uucugucugggcucagacau

SEQ ID NO: 1351481 - RNA, 23 nt, Homo sapiens
uucugucugggcucagacaucca

SEQ ID NO: 1351482 - RNA, 22 nt, Homo sapiens
uucuguggagggagggcagcug

SEQ ID NO: 1351483 - RNA, 19 nt, Homo sapiens
uucuuaacuaucauuauuu

SEQ ID NO: 1351484 - RNA, 22 nt, Homo sapiens
uucuucaagaaugguguuugca

SEQ ID NO: 1351485 - RNA, 19 nt, Homo sapiens
uucuucacauguuuaacuu

SEQ ID NO: 1351486 - RNA, 11 nt, Homo sapiens
uucuucacucu

SEQ ID NO: 1351487 - RNA, 11 nt, Homo sapiens
uucuucacuua

SEQ ID NO: 1351488 - RNA, 16 nt, Homo sapiens
uucuucauuaccucag

SEQ ID NO: 1351489 - RNA, 20 nt, Homo sapiens
uucuugaagaauaaauucua

SEQ ID NO: 1351490 - RNA, 16 nt, Homo sapiens
uucuugcuaauucuca

SEQ ID NO: 1351491 - RNA, 15 nt, Homo sapiens
uucuuguaaggcaua

SEQ ID NO: 1351492 - RNA, 22 nt, Homo sapiens
uucuuuaagcagcgccagugac

SEQ ID NO: 1351493 - RNA, 22 nt, Homo sapiens
uucuuucaucucccuccuccag

SEQ ID NO: 1351494 - RNA, 13 nt, Homo sapiens
uucuuucuuccau

SEQ ID NO: 1351495 - RNA, 22 nt, Homo sapiens
uucuuugcaccaaagacaucag

SEQ ID NO: 1351496 - RNA, 18 nt, Homo sapiens
uucuuuuugaaaugucaa

SEQ ID NO: 1351497 - RNA, 21 nt, Homo sapiens
uugaaaaaaacuucauucucg

SEQ ID NO: 1351498 - RNA, 14 nt, Homo sapiens
uugaaaaaggugau

SEQ ID NO: 1351499 - RNA, 15 nt, Homo sapiens
uugaaaacaacaaaa

SEQ ID NO: 1351500 - RNA, 20 nt, Homo sapiens
uugaaaacaacaaaacacua

SEQ ID NO: 1351501 - RNA, 16 nt, Homo sapiens
uugaaagaaccagaga

SEQ ID NO: 1351502 - RNA, 13 nt, Homo sapiens
uugaaagaauuag

SEQ ID NO: 1351503 - RNA, 20 nt, Homo sapiens
uugaaaguuuuccaguauug

SEQ ID NO: 1351504 - RNA, 17 nt, Homo sapiens
uugaaaugauuucacag

SEQ ID NO: 1351505 - RNA, 15 nt, Homo sapiens
uugaaaugcuguuag

SEQ ID NO: 1351506 - RNA, 14 nt, Homo sapiens
uugaagagauuuua

SEQ ID NO: 1351507 - RNA, 12 nt, Homo sapiens
uugaagagcaaa

SEQ ID NO: 1351508 - RNA, 21 nt, Homo sapiens
uugaaggguggucaguaguuu

SEQ ID NO: 1351509 - RNA, 23 nt, Homo sapiens
uugaauagacacuucaccaaaga

SEQ ID NO: 1351510 - RNA, 21 nt, Homo sapiens
uugagauuauucuuuguuucc

SEQ ID NO: 1351511 - RNA, 13 nt, Homo sapiens
uugagcagcaucu

SEQ ID NO: 1351512 - RNA, 16 nt, Homo sapiens
uugaggcuaccucuac

SEQ ID NO: 1351513 - RNA, 14 nt, Homo sapiens
uugauaacauggaa

SEQ ID NO: 1351514 - RNA, 20 nt, Homo sapiens
uugauauuuaagcagcuuga

SEQ ID NO: 1351515 - RNA, 15 nt, Homo sapiens
uugauggagccccag

SEQ ID NO: 1351516 - RNA, 14 nt, Homo sapiens
uugauucaacacuu

SEQ ID NO: 1351517 - RNA, 22 nt, Homo sapiens
uugauuuacaauuuaaugcacu

SEQ ID NO: 1351518 - RNA, 21 nt, Homo sapiens
uugauuuuauuuuuucucugu

SEQ ID NO: 1351519 - RNA, 13 nt, Homo sapiens
uugcaagauucca

SEQ ID NO: 1351520 - RNA, 18 nt, Homo sapiens
uugcacugaggauauuca

SEQ ID NO: 1351521 - RNA, 22 nt, Homo sapiens
uugcacuucuaagacuuuacuu

SEQ ID NO: 1351522 - RNA, 17 nt, Homo sapiens
uugcagcuggacuucuc

SEQ ID NO: 1351523 - RNA, 21 nt, Homo sapiens
uugcauauaccaguugugaua

SEQ ID NO: 1351524 - RNA, 18 nt, Homo sapiens
uugcauucguaaacacca

SEQ ID NO: 1351525 - RNA, 13 nt, Homo sapiens
uugccacauuuag

SEQ ID NO: 1351526 - RNA, 18 nt, Homo sapiens
uugccaggggcauccaag

SEQ ID NO: 1351527 - RNA, 16 nt, Homo sapiens
uugcccaaaacuguca

SEQ ID NO: 1351528 - RNA, 22 nt, Homo sapiens
uugcccaggcuagagugcaaug

SEQ ID NO: 1351529 - RNA, 20 nt, Homo sapiens
uugcccaggcuggagugcaa

SEQ ID NO: 1351530 - RNA, 21 nt, Homo sapiens
uugcccaggcuggagugcaau

SEQ ID NO: 1351531 - RNA, 19 nt, Homo sapiens
uugccccuggcuuugccuc

SEQ ID NO: 1351532 - RNA, 23 nt, Homo sapiens
uugcccuaauuaaaaacugugau

SEQ ID NO: 1351533 - RNA, 18 nt, Homo sapiens
uugcccuuccuacuccuc

SEQ ID NO: 1351534 - RNA, 13 nt, Homo sapiens
uugccuucuccac

SEQ ID NO: 1351535 - RNA, 20 nt, Homo sapiens
uugcgagccucgcagccucc

SEQ ID NO: 1351536 - RNA, 15 nt, Homo sapiens
uugcgugauucaaug

SEQ ID NO: 1351537 - RNA, 15 nt, Homo sapiens
uugcuaacaggauau

SEQ ID NO: 1351538 - RNA, 13 nt, Homo sapiens
uugcuaccaguau

SEQ ID NO: 1351539 - RNA, 14 nt, Homo sapiens
uugcuaugaagcgu

SEQ ID NO: 1351540 - RNA, 15 nt, Homo sapiens
uugcucacagcugau

SEQ ID NO: 1351541 - RNA, 18 nt, Homo sapiens
uugcucucggugcuucca

SEQ ID NO: 1351542 - RNA, 19 nt, Homo sapiens
uugcucucggugcuuccaa

SEQ ID NO: 1351543 - RNA, 16 nt, Homo sapiens
uugcugauccaugaga

SEQ ID NO: 1351544 - RNA, 17 nt, Homo sapiens
uugcugugugucugucc

SEQ ID NO: 1351545 - RNA, 15 nt, Homo sapiens
uugcuguuaaucuga

SEQ ID NO: 1351546 - RNA, 16 nt, Homo sapiens
uugcuguuuuucuggu

SEQ ID NO: 1351547 - RNA, 20 nt, Homo sapiens
uugcuguuuuucugguuuaa

SEQ ID NO: 1351548 - RNA, 19 nt, Homo sapiens
uugcuuggaagccagguac

SEQ ID NO: 1351549 - RNA, 18 nt, Homo sapiens
uugcuuuaaaacaaaggg

SEQ ID NO: 1351550 - RNA, 21 nt, Homo sapiens
uugcuuuccugcaucucugug

SEQ ID NO: 1351551 - RNA, 20 nt, Homo sapiens
uuggaaagacuucucaaaga

SEQ ID NO: 1351552 - RNA, 21 nt, Homo sapiens
uuggagagucagaucuuucuc

SEQ ID NO: 1351553 - RNA, 13 nt, Homo sapiens
uuggcaccagaca

SEQ ID NO: 1351554 - RNA, 22 nt, Homo sapiens
uuggcaccagacacccaggacu

SEQ ID NO: 1351555 - RNA, 18 nt, Homo sapiens
uuggcagccuaccaaugc

SEQ ID NO: 1351556 - RNA, 12 nt, Homo sapiens
uuggccacagac

SEQ ID NO: 1351557 - RNA, 23 nt, Homo sapiens
uuggccaugggucccauucuugg

SEQ ID NO: 1351558 - RNA, 17 nt, Homo sapiens
uuggccucugcuaaggu

SEQ ID NO: 1351559 - RNA, 14 nt, Homo sapiens
uuggcucaccauaa

SEQ ID NO: 1351560 - RNA, 16 nt, Homo sapiens
uuggcucaccauaacc

SEQ ID NO: 1351561 - RNA, 14 nt, Homo sapiens
uuggcuuacguaag

SEQ ID NO: 1351562 - RNA, 16 nt, Homo sapiens
uuggcuuuaugcaaau

SEQ ID NO: 1351563 - RNA, 20 nt, Homo sapiens
uuggcuuuaugcaaauacaa

SEQ ID NO: 1351564 - RNA, 12 nt, Homo sapiens
uuggcuuucaua

SEQ ID NO: 1351565 - RNA, 14 nt, Homo sapiens
uuggcuuuuacuga

SEQ ID NO: 1351566 - RNA, 20 nt, Homo sapiens
uugggacauugcaauuugca

SEQ ID NO: 1351567 - RNA, 16 nt, Homo sapiens
uugggagacaugugac

SEQ ID NO: 1351568 - RNA, 21 nt, Homo sapiens
uugggagcaccgccugugaaa

SEQ ID NO: 1351569 - RNA, 15 nt, Homo sapiens
uugggccugcuccag

SEQ ID NO: 1351570 - RNA, 13 nt, Homo sapiens
uuggggucucuuu

SEQ ID NO: 1351571 - RNA, 14 nt, Homo sapiens
uuggguuuucucca

SEQ ID NO: 1351572 - RNA, 14 nt, Homo sapiens
uugguaaagcacau

SEQ ID NO: 1351573 - RNA, 15 nt, Homo sapiens
uugguaaauggcaaa

SEQ ID NO: 1351574 - RNA, 23 nt, Homo sapiens
uuggugaaucgguuguucuuucc

SEQ ID NO: 1351575 - RNA, 16 nt, Homo sapiens
uuggugucuguacuca

SEQ ID NO: 1351576 - RNA, 18 nt, Homo sapiens
uuggugucuguacucagc

SEQ ID NO: 1351577 - RNA, 22 nt, Homo sapiens
uugguucucauaacucugugau

SEQ ID NO: 1351578 - RNA, 14 nt, Homo sapiens
uugguucucuccac

SEQ ID NO: 1351579 - RNA, 19 nt, Homo sapiens
uugguucuguuccugauaa

SEQ ID NO: 1351580 - RNA, 16 nt, Homo sapiens
uugguuuugcuguuga

SEQ ID NO: 1351581 - RNA, 18 nt, Homo sapiens
uuguaaaugaaacuuaag

SEQ ID NO: 1351582 - RNA, 20 nt, Homo sapiens
uuguaacgaagacacagacu

SEQ ID NO: 1351583 - RNA, 24 nt, Homo sapiens
uuguaacuguaaagaugaauguca

SEQ ID NO: 1351584 - RNA, 14 nt, Homo sapiens
uuguaauaaauacu

SEQ ID NO: 1351585 - RNA, 23 nt, Homo sapiens
uuguaauaaauacugcagcuuga

SEQ ID NO: 1351586 - RNA, 13 nt, Homo sapiens
uuguaaugcugca

SEQ ID NO: 1351587 - RNA, 17 nt, Homo sapiens
uuguaauguaucaaaua

SEQ ID NO: 1351588 - RNA, 16 nt, Homo sapiens
uuguaucuuuuauccu

SEQ ID NO: 1351589 - RNA, 20 nt, Homo sapiens
uuguauuuaccuucuaccuc

SEQ ID NO: 1351590 - RNA, 20 nt, Homo sapiens
uuguauuuuuuuucuuguau

SEQ ID NO: 1351591 - RNA, 22 nt, Homo sapiens
uugucaacacaaacuggcuuaa

SEQ ID NO: 1351592 - RNA, 23 nt, Homo sapiens
uugucaauaaauggcccggacau

SEQ ID NO: 1351593 - RNA, 19 nt, Homo sapiens
uugucacagggacugaaaa

SEQ ID NO: 1351594 - RNA, 12 nt, Homo sapiens
uugucagugugu

SEQ ID NO: 1351595 - RNA, 14 nt, Homo sapiens
uugucccucuguau

SEQ ID NO: 1351596 - RNA, 15 nt, Homo sapiens
uugucugguuucccu

SEQ ID NO: 1351597 - RNA, 16 nt, Homo sapiens
uugucuuaaggucaua

SEQ ID NO: 1351598 - RNA, 13 nt, Homo sapiens
uugugaauuguga

SEQ ID NO: 1351599 - RNA, 20 nt, Homo sapiens
uugugaucuguaacagggua

SEQ ID NO: 1351600 - RNA, 10 nt, Homo sapiens
uugugcaaac

SEQ ID NO: 1351601 - RNA, 14 nt, Homo sapiens
uugugguaacuuga

SEQ ID NO: 1351602 - RNA, 20 nt, Homo sapiens
uuguguccaggauguacaaa

SEQ ID NO: 1351603 - RNA, 14 nt, Homo sapiens
uuguucaaauguuc

SEQ ID NO: 1351604 - RNA, 18 nt, Homo sapiens
uuguucaaguuugcugca

SEQ ID NO: 1351605 - RNA, 12 nt, Homo sapiens
uuguucuacucu

SEQ ID NO: 1351606 - RNA, 23 nt, Homo sapiens
uuguuggguggcagcugcuccuu

SEQ ID NO: 1351607 - RNA, 18 nt, Homo sapiens
uuguuguaaaaagcccag

SEQ ID NO: 1351608 - RNA, 13 nt, Homo sapiens
uuguuuccuccuu

SEQ ID NO: 1351609 - RNA, 12 nt, Homo sapiens
uuguuugcuuac

SEQ ID NO: 1351610 - RNA, 14 nt, Homo sapiens
uuguuuuuuacuca

SEQ ID NO: 1351611 - RNA, 13 nt, Homo sapiens
uuuaaaaacacaa

SEQ ID NO: 1351612 - RNA, 13 nt, Homo sapiens
uuuaaaaggcaag

SEQ ID NO: 1351613 - RNA, 21 nt, Homo sapiens
uuuaaaaucauuucugcauca

SEQ ID NO: 1351614 - RNA, 21 nt, Homo sapiens
uuuaaaccaccuaguucuccc

SEQ ID NO: 1351615 - RNA, 14 nt, Homo sapiens
uuuaaaguggcaau

SEQ ID NO: 1351616 - RNA, 17 nt, Homo sapiens
uuuaaauguauuuuaca

SEQ ID NO: 1351617 - RNA, 15 nt, Homo sapiens
uuuaaauucuagugu

SEQ ID NO: 1351618 - RNA, 18 nt, Homo sapiens
uuuaaccaauaacuagcu

SEQ ID NO: 1351619 - RNA, 21 nt, Homo sapiens
uuuaaggcaaugguuucacau

SEQ ID NO: 1351620 - RNA, 23 nt, Homo sapiens
uuuaaggcaaugguuucacaugg

SEQ ID NO: 1351621 - RNA, 20 nt, Homo sapiens
uuuaaggucuaaucagugau

SEQ ID NO: 1351622 - RNA, 20 nt, Homo sapiens
uuuaaguaaaagucuaccug

SEQ ID NO: 1351623 - RNA, 15 nt, Homo sapiens
uuuaaguacuacaca

SEQ ID NO: 1351624 - RNA, 23 nt, Homo sapiens
uuuaaucagcuuaaaauccaaag

SEQ ID NO: 1351625 - RNA, 23 nt, Homo sapiens
uuuaauccauuucaggacucucu

SEQ ID NO: 1351626 - RNA, 21 nt, Homo sapiens
uuuaauccuuaacacauucaa

SEQ ID NO: 1351627 - RNA, 19 nt, Homo sapiens
uuuaaucucuaacagugga

SEQ ID NO: 1351628 - RNA, 18 nt, Homo sapiens
uuuaauguuaaauucaau

SEQ ID NO: 1351629 - RNA, 16 nt, Homo sapiens
uuuaauguuuccuuua

SEQ ID NO: 1351630 - RNA, 17 nt, Homo sapiens
uuuaauguuuccuuuaa

SEQ ID NO: 1351631 - RNA, 15 nt, Homo sapiens
uuuaauucacaucaa

SEQ ID NO: 1351632 - RNA, 19 nt, Homo sapiens
uuuaauugcaaagcuguca

SEQ ID NO: 1351633 - RNA, 16 nt, Homo sapiens
uuuacaaugugcaaua

SEQ ID NO: 1351634 - RNA, 16 nt, Homo sapiens
uuuacauuucauacaa

SEQ ID NO: 1351635 - RNA, 18 nt, Homo sapiens
uuuacucauaaguaaaag

SEQ ID NO: 1351636 - RNA, 23 nt, Homo sapiens
uuuacuugaaauuaaauuuggcu

SEQ ID NO: 1351637 - RNA, 14 nt, Homo sapiens
uuuagaaacuacaa

SEQ ID NO: 1351638 - RNA, 14 nt, Homo sapiens
uuuagagaaguaua

SEQ ID NO: 1351639 - RNA, 17 nt, Homo sapiens
uuuaguccuguacugua

SEQ ID NO: 1351640 - RNA, 12 nt, Homo sapiens
uuuagucuugau

SEQ ID NO: 1351641 - RNA, 13 nt, Homo sapiens
uuuauagcacaug

SEQ ID NO: 1351642 - RNA, 23 nt, Homo sapiens
uuuauauauauaaagucagugac

SEQ ID NO: 1351643 - RNA, 22 nt, Homo sapiens
uuuauauuguuuuuauauauua

SEQ ID NO: 1351644 - RNA, 19 nt, Homo sapiens
uuuaucaaguguauuugaa

SEQ ID NO: 1351645 - RNA, 22 nt, Homo sapiens
uuuaucacuucauucacauuca

SEQ ID NO: 1351646 - RNA, 12 nt, Homo sapiens
uuuaugcaaaua

SEQ ID NO: 1351647 - RNA, 13 nt, Homo sapiens
uuuaugcacauga

SEQ ID NO: 1351648 - RNA, 12 nt, Homo sapiens
uuuaugguucuc

SEQ ID NO: 1351649 - RNA, 17 nt, Homo sapiens
uuuauucacaguaucug

SEQ ID NO: 1351650 - RNA, 21 nt, Homo sapiens
uuuauucaggggaaacuugau

SEQ ID NO: 1351651 - RNA, 20 nt, Homo sapiens
uuuauuccccagugacucca

SEQ ID NO: 1351652 - RNA, 22 nt, Homo sapiens
uuuauuccccagugacuccagg

SEQ ID NO: 1351653 - RNA, 15 nt, Homo sapiens
uuuauuuaacuauuc

SEQ ID NO: 1351654 - RNA, 14 nt, Homo sapiens
uuuauuugagguca

SEQ ID NO: 1351655 - RNA, 14 nt, Homo sapiens
uuuauuuucacagc

SEQ ID NO: 1351656 - RNA, 22 nt, Homo sapiens
uuucaaacuuaaacaaaaaacu

SEQ ID NO: 1351657 - RNA, 15 nt, Homo sapiens
uuucaaagcacuuaa

SEQ ID NO: 1351658 - RNA, 18 nt, Homo sapiens
uuucaaaguguugauggu

SEQ ID NO: 1351659 - RNA, 14 nt, Homo sapiens
uuucaaaguucucu

SEQ ID NO: 1351660 - RNA, 13 nt, Homo sapiens
uuucaacugccaa

SEQ ID NO: 1351661 - RNA, 20 nt, Homo sapiens
uuucacgccugaggcaauua

SEQ ID NO: 1351662 - RNA, 18 nt, Homo sapiens
uuucacuuuuaauuugcu

SEQ ID NO: 1351663 - RNA, 14 nt, Homo sapiens
uuucaggauauaau

SEQ ID NO: 1351664 - RNA, 15 nt, Homo sapiens
uuucaguuacuuucc

SEQ ID NO: 1351665 - RNA, 18 nt, Homo sapiens
uuucaguugcaguaguau

SEQ ID NO: 1351666 - RNA, 15 nt, Homo sapiens
uuucauccauuccua

SEQ ID NO: 1351667 - RNA, 16 nt, Homo sapiens
uuucauucaucaugaa

SEQ ID NO: 1351668 - RNA, 18 nt, Homo sapiens
uuucauugaugagcaaga

SEQ ID NO: 1351669 - RNA, 17 nt, Homo sapiens
uuucauuuaucuauaau

SEQ ID NO: 1351670 - RNA, 12 nt, Homo sapiens
uuuccaaaacau

SEQ ID NO: 1351671 - RNA, 16 nt, Homo sapiens
uuuccaauuagcuccu

SEQ ID NO: 1351672 - RNA, 15 nt, Homo sapiens
uuuccauucauggau

SEQ ID NO: 1351673 - RNA, 17 nt, Homo sapiens
uuuccauuuuaaggaua

SEQ ID NO: 1351674 - RNA, 21 nt, Homo sapiens
uuucccagucccauuccucag

SEQ ID NO: 1351675 - RNA, 23 nt, Homo sapiens
uuucccaucacuguauccauucu

SEQ ID NO: 1351676 - RNA, 19 nt, Homo sapiens
uuucccaucagacugucaa

SEQ ID NO: 1351677 - RNA, 13 nt, Homo sapiens
uuucccauugcca

SEQ ID NO: 1351678 - RNA, 19 nt, Homo sapiens
uuuccccuccuuggcuuua

SEQ ID NO: 1351679 - RNA, 21 nt, Homo sapiens
uuucccucucucauacccucc

SEQ ID NO: 1351680 - RNA, 22 nt, Homo sapiens
uuucccucuucccugaccuccc

SEQ ID NO: 1351681 - RNA, 23 nt, Homo sapiens
uuuccuagcuaggagcaggcuug

SEQ ID NO: 1351682 - RNA, 12 nt, Homo sapiens
uuuccucaguga

SEQ ID NO: 1351683 - RNA, 20 nt, Homo sapiens
uuuccuggucagcauguacu

SEQ ID NO: 1351684 - RNA, 21 nt, Homo sapiens
uuucuaauacaagcauauguu

SEQ ID NO: 1351685 - RNA, 18 nt, Homo sapiens
uuucuauauuccuccagc

SEQ ID NO: 1351686 - RNA, 18 nt, Homo sapiens
uuucucucacacuuuugc

SEQ ID NO: 1351687 - RNA, 19 nt, Homo sapiens
uuucucuguggccauuugu

SEQ ID NO: 1351688 - RNA, 21 nt, Homo sapiens
uuucucuuagaaaagcuaaga

SEQ ID NO: 1351689 - RNA, 21 nt, Homo sapiens
uuucucuuuagccuuccaaca

SEQ ID NO: 1351690 - RNA, 22 nt, Homo sapiens
uuucugagaaagacuauucaaa

SEQ ID NO: 1351691 - RNA, 14 nt, Homo sapiens
uuucugauucugau

SEQ ID NO: 1351692 - RNA, 20 nt, Homo sapiens
uuucugauucugauugcuau

SEQ ID NO: 1351693 - RNA, 19 nt, Homo sapiens
uuucugcucuauacugugg

SEQ ID NO: 1351694 - RNA, 23 nt, Homo sapiens
uuucuggacaguaccugauugua

SEQ ID NO: 1351695 - RNA, 23 nt, Homo sapiens
uuucuggaugaaugcccagugag

SEQ ID NO: 1351696 - RNA, 19 nt, Homo sapiens
uuucugggguccauucucu

SEQ ID NO: 1351697 - RNA, 16 nt, Homo sapiens
uuucuuagugugccaa

SEQ ID NO: 1351698 - RNA, 16 nt, Homo sapiens
uuucuuccccuugugu

SEQ ID NO: 1351699 - RNA, 20 nt, Homo sapiens
uuucuugaagaauaaauucu

SEQ ID NO: 1351700 - RNA, 23 nt, Homo sapiens
uuucuuguaaggcauacugccuu

SEQ ID NO: 1351701 - RNA, 18 nt, Homo sapiens
uuucuuuaaccaaacaau

SEQ ID NO: 1351702 - RNA, 14 nt, Homo sapiens
uuucuuuugcagga

SEQ ID NO: 1351703 - RNA, 12 nt, Homo sapiens
uuugaacagggc

SEQ ID NO: 1351704 - RNA, 13 nt, Homo sapiens
uuugaacuugaug

SEQ ID NO: 1351705 - RNA, 21 nt, Homo sapiens
uuugaagcgagcagucagcau

SEQ ID NO: 1351706 - RNA, 18 nt, Homo sapiens
uuugaagggggcagucga

SEQ ID NO: 1351707 - RNA, 17 nt, Homo sapiens
uuugaaucuacauucac

SEQ ID NO: 1351708 - RNA, 15 nt, Homo sapiens
uuugaauucugugau

SEQ ID NO: 1351709 - RNA, 23 nt, Homo sapiens
uuugagaauuauaaaauuaacau

SEQ ID NO: 1351710 - RNA, 15 nt, Homo sapiens
uuugagggugggggu

SEQ ID NO: 1351711 - RNA, 15 nt, Homo sapiens
uuugaggucuagaga

SEQ ID NO: 1351712 - RNA, 17 nt, Homo sapiens
uuugauauuugcauuga

SEQ ID NO: 1351713 - RNA, 18 nt, Homo sapiens
uuugauugcugagagcca

SEQ ID NO: 1351714 - RNA, 11 nt, Homo sapiens
uuugcauuucc

SEQ ID NO: 1351715 - RNA, 11 nt, Homo sapiens
uuugcauuucu

SEQ ID NO: 1351716 - RNA, 11 nt, Homo sapiens
uuugcauuugc

SEQ ID NO: 1351717 - RNA, 12 nt, Homo sapiens
uuugccauuugc

SEQ ID NO: 1351718 - RNA, 22 nt, Homo sapiens
uuugccugagaaggggcagaug

SEQ ID NO: 1351719 - RNA, 16 nt, Homo sapiens
uuugcuaauaccaaaa

SEQ ID NO: 1351720 - RNA, 23 nt, Homo sapiens
uuugcuggggaacuggcgccauc

SEQ ID NO: 1351721 - RNA, 19 nt, Homo sapiens
uuugcuuuuuuaaacuuga

SEQ ID NO: 1351722 - RNA, 21 nt, Homo sapiens
uuuggaccaccguucagucau

SEQ ID NO: 1351723 - RNA, 16 nt, Homo sapiens
uuuggaugauugucau

SEQ ID NO: 1351724 - RNA, 16 nt, Homo sapiens
uuuggauugggguccc

SEQ ID NO: 1351725 - RNA, 21 nt, Homo sapiens
uuugggagcacggacugucag

SEQ ID NO: 1351726 - RNA, 18 nt, Homo sapiens
uuugggguaauacuucca

SEQ ID NO: 1351727 - RNA, 16 nt, Homo sapiens
uuugguuucuucauuc

SEQ ID NO: 1351728 - RNA, 11 nt, Homo sapiens
uuugguuuugu

SEQ ID NO: 1351729 - RNA, 19 nt, Homo sapiens
uuuguaauaauaaagaaua

SEQ ID NO: 1351730 - RNA, 22 nt, Homo sapiens
uuuguauucucuuccucaucca

SEQ ID NO: 1351731 - RNA, 22 nt, Homo sapiens
uuugucauguuaugcagugaac

SEQ ID NO: 1351732 - RNA, 19 nt, Homo sapiens
uuuguucaaguuugcugca

SEQ ID NO: 1351733 - RNA, 13 nt, Homo sapiens
uuuguuccaugag

SEQ ID NO: 1351734 - RNA, 20 nt, Homo sapiens
uuuguuggaaaguaucauga

SEQ ID NO: 1351735 - RNA, 22 nt, Homo sapiens
uuuguuguuugauucagcaaaa

SEQ ID NO: 1351736 - RNA, 16 nt, Homo sapiens
uuuuaaaaauugucau

SEQ ID NO: 1351737 - RNA, 18 nt, Homo sapiens
uuuuaaaugaaaguauug

SEQ ID NO: 1351738 - RNA, 18 nt, Homo sapiens
uuuuaaauguauacuaua

SEQ ID NO: 1351739 - RNA, 22 nt, Homo sapiens
uuuuaacagucagaaccacuaa

SEQ ID NO: 1351740 - RNA, 17 nt, Homo sapiens
uuuuaacggaugguuga

SEQ ID NO: 1351741 - RNA, 13 nt, Homo sapiens
uuuuaauggaugg

SEQ ID NO: 1351742 - RNA, 19 nt, Homo sapiens
uuuuaauuacugcuauaaa

SEQ ID NO: 1351743 - RNA, 17 nt, Homo sapiens
uuuuacccacacacaga

SEQ ID NO: 1351744 - RNA, 18 nt, Homo sapiens
uuuuagccauaaauugcu

SEQ ID NO: 1351745 - RNA, 12 nt, Homo sapiens
uuuuaggcaaag

SEQ ID NO: 1351746 - RNA, 15 nt, Homo sapiens
uuuuaguggaagcuu

SEQ ID NO: 1351747 - RNA, 22 nt, Homo sapiens
uuuuaucacuucauucacauuc

SEQ ID NO: 1351748 - RNA, 20 nt, Homo sapiens
uuuuauccuagucauucuuc

SEQ ID NO: 1351749 - RNA, 14 nt, Homo sapiens
uuuuauucuauauu

SEQ ID NO: 1351750 - RNA, 21 nt, Homo sapiens
uuuucaaaauauuacucaguu

SEQ ID NO: 1351751 - RNA, 20 nt, Homo sapiens
uuuucacaaagaacaggaaa

SEQ ID NO: 1351752 - RNA, 17 nt, Homo sapiens
uuuuccaaaucaaggau

SEQ ID NO: 1351753 - RNA, 23 nt, Homo sapiens
uuuucggccccauguaucucagu

SEQ ID NO: 1351754 - RNA, 11 nt, Homo sapiens
uuuucuaagug

SEQ ID NO: 1351755 - RNA, 15 nt, Homo sapiens
uuuucucugcauuua

SEQ ID NO: 1351756 - RNA, 20 nt, Homo sapiens
uuuugagaugggggucucac

SEQ ID NO: 1351757 - RNA, 20 nt, Homo sapiens
uuuugagauguugagaggaa

SEQ ID NO: 1351758 - RNA, 15 nt, Homo sapiens
uuuugaguaauucaa

SEQ ID NO: 1351759 - RNA, 15 nt, Homo sapiens
uuuugccaaucucaa

SEQ ID NO: 1351760 - RNA, 23 nt, Homo sapiens
uuuuggcaaugacucaaagucug

SEQ ID NO: 1351761 - RNA, 18 nt, Homo sapiens
uuuuguuccacaaguuaa

SEQ ID NO: 1351762 - RNA, 19 nt, Homo sapiens
uuuuuaaaguuucuugcau

SEQ ID NO: 1351763 - RNA, 14 nt, Homo sapiens
uuuuuaacagucag

SEQ ID NO: 1351764 - RNA, 21 nt, Homo sapiens
uuuuuauauauauaaagucag

SEQ ID NO: 1351765 - RNA, 13 nt, Homo sapiens
uuuuucaguauuu

SEQ ID NO: 1351766 - RNA, 14 nt, Homo sapiens
uuuuucaugcuuua

SEQ ID NO: 1351767 - RNA, 17 nt, Homo sapiens
uuuuucccagacuacua

SEQ ID NO: 1351768 - RNA, 16 nt, Homo sapiens
uuuuucccccaugaaa

SEQ ID NO: 1351769 - RNA, 18 nt, Homo sapiens
uuuuucuagggucccuga

SEQ ID NO: 1351770 - RNA, 18 nt, Homo sapiens
uuuuugggggaaggucag

SEQ ID NO: 1351771 - RNA, 20 nt, Homo sapiens
accaucucuuuaccuccuaa

SEQ ID NO: 1351772 - RNA, 17 nt, Homo sapiens
accaucugcugcaguua

SEQ ID NO: 1351773 - RNA, 12 nt, Homo sapiens
accaugaaguca

SEQ ID NO: 1351774 - RNA, 14 nt, Homo sapiens
accaugccauuuaa

SEQ ID NO: 1351775 - RNA, 12 nt, Homo sapiens
accaugcugcug

SEQ ID NO: 1351776 - RNA, 23 nt, Homo sapiens
accaugcugcuggggaagacagu

SEQ ID NO: 1351777 - RNA, 18 nt, Homo sapiens
accauguggccauuaaca

SEQ ID NO: 1351778 - RNA, 20 nt, Homo sapiens
accauuaggucacuuaagaa

SEQ ID NO: 1351779 - RNA, 22 nt, Homo sapiens
accauuccugccuuuaagccaa

SEQ ID NO: 1351780 - RNA, 14 nt, Homo sapiens
accauuccuuucau

SEQ ID NO: 1351781 - RNA, 24 nt, Homo sapiens
accauuuuuaggaagcuagacuag

SEQ ID NO: 1351782 - RNA, 10 nt, Homo sapiens
acccaaagau

SEQ ID NO: 1351783 - RNA, 23 nt, Homo sapiens
acccacaauugaacuuccaggaa

SEQ ID NO: 1351784 - RNA, 19 nt, Homo sapiens
acccacucaugacugcaug

SEQ ID NO: 1351785 - RNA, 13 nt, Homo sapiens
acccacucugcac

SEQ ID NO: 1351786 - RNA, 19 nt, Homo sapiens
acccagaaugagacaucca

SEQ ID NO: 1351787 - RNA, 14 nt, Homo sapiens
acccagcucacagg

SEQ ID NO: 1351788 - RNA, 16 nt, Homo sapiens
acccaguagaugccac

SEQ ID NO: 1351789 - RNA, 12 nt, Homo sapiens
acccagucccac

SEQ ID NO: 1351790 - RNA, 20 nt, Homo sapiens
acccagucuucuacacagau

SEQ ID NO: 1351791 - RNA, 23 nt, Homo sapiens
acccaguucugaauaacuugaag

SEQ ID NO: 1351792 - RNA, 21 nt, Homo sapiens
acccauccgguuugccauguu

SEQ ID NO: 1351793 - RNA, 12 nt, Homo sapiens
acccaugccaga

SEQ ID NO: 1351794 - RNA, 22 nt, Homo sapiens
acccauuuucgcuauaaauaaa

SEQ ID NO: 1351795 - RNA, 13 nt, Homo sapiens
accccaacccugg

SEQ ID NO: 1351796 - RNA, 23 nt, Homo sapiens
accccaagggggcugcugcuccu

SEQ ID NO: 1351797 - RNA, 12 nt, Homo sapiens
accccagauuca

SEQ ID NO: 1351798 - RNA, 16 nt, Homo sapiens
accccagccauccagg

SEQ ID NO: 1351799 - RNA, 22 nt, Homo sapiens
accccagccccaacuccagggg

SEQ ID NO: 1351800 - RNA, 15 nt, Homo sapiens
acccccucuggagaa

SEQ ID NO: 1351801 - RNA, 21 nt, Homo sapiens
acccccugcuccaccagcagc

SEQ ID NO: 1351802 - RNA, 19 nt, Homo sapiens
accccucaaacugcacauc

SEQ ID NO: 1351803 - RNA, 21 nt, Homo sapiens
accccucaaacugcacaucua

SEQ ID NO: 1351804 - RNA, 21 nt, Homo sapiens
accccucuuucgucuacugca

SEQ ID NO: 1351805 - RNA, 17 nt, Homo sapiens
acccgggggagcccagu

SEQ ID NO: 1351806 - RNA, 20 nt, Homo sapiens
acccgggggagcccagugaa

SEQ ID NO: 1351807 - RNA, 19 nt, Homo sapiens
acccuaaaguauaacaugu

SEQ ID NO: 1351808 - RNA, 18 nt, Homo sapiens
acccuagccagagaauag

SEQ ID NO: 1351809 - RNA, 18 nt, Homo sapiens
acccucacuuaaacuuuu

SEQ ID NO: 1351810 - RNA, 21 nt, Homo sapiens
acccugacacggacugugcau

SEQ ID NO: 1351811 - RNA, 19 nt, Homo sapiens
acccugacuguauacagaa

SEQ ID NO: 1351812 - RNA, 14 nt, Homo sapiens
acccugcaaaggga

SEQ ID NO: 1351813 - RNA, 15 nt, Homo sapiens
acccugcaagaccac

SEQ ID NO: 1351814 - RNA, 15 nt, Homo sapiens
acccugcgccuccag

SEQ ID NO: 1351815 - RNA, 21 nt, Homo sapiens
acccugggagccaguccucca

SEQ ID NO: 1351816 - RNA, 18 nt, Homo sapiens
acccuuagcgggacaaag

SEQ ID NO: 1351817 - RNA, 13 nt, Homo sapiens
acccuucccucac

SEQ ID NO: 1351818 - RNA, 20 nt, Homo sapiens
acccuuccugaaacuucaga

SEQ ID NO: 1351819 - RNA, 21 nt, Homo sapiens
acccuuggaaagaaauguaga

SEQ ID NO: 1351820 - RNA, 14 nt, Homo sapiens
acccuuucauaaag

SEQ ID NO: 1351821 - RNA, 22 nt, Homo sapiens
acccuuucauaaagucuugccu

SEQ ID NO: 1351822 - RNA, 22 nt, Homo sapiens
acccuuuucccccuucccauuu

SEQ ID NO: 1351823 - RNA, 15 nt, Homo sapiens
accgaaaucccucag

SEQ ID NO: 1351824 - RNA, 12 nt, Homo sapiens
accgaacacuac

SEQ ID NO: 1351825 - RNA, 22 nt, Homo sapiens
accgaauuuaguucaugcauug

SEQ ID NO: 1351826 - RNA, 16 nt, Homo sapiens
accgagucucuucucc

SEQ ID NO: 1351827 - RNA, 23 nt, Homo sapiens
accgcuucugccuuuucacugug

SEQ ID NO: 1351828 - RNA, 15 nt, Homo sapiens
accgggcugggagcu

SEQ ID NO: 1351829 - RNA, 20 nt, Homo sapiens
accgucacacucuucaguga

SEQ ID NO: 1351830 - RNA, 14 nt, Homo sapiens
accuaaaugaugcc

SEQ ID NO: 1351831 - RNA, 14 nt, Homo sapiens
accuaccccagcca

SEQ ID NO: 1351832 - RNA, 12 nt, Homo sapiens
accuacugcuga

SEQ ID NO: 1351833 - RNA, 22 nt, Homo sapiens
accuauucugaaaaagacauaa

SEQ ID NO: 1351834 - RNA, 14 nt, Homo sapiens
accucaauauuuac

SEQ ID NO: 1351835 - RNA, 14 nt, Homo sapiens
accucacauacccu

SEQ ID NO: 1351836 - RNA, 21 nt, Homo sapiens
accucaccugggcagggauga

SEQ ID NO: 1351837 - RNA, 19 nt, Homo sapiens
accucacuggccugccaug

SEQ ID NO: 1351838 - RNA, 20 nt, Homo sapiens
accucagccuggccagacac

SEQ ID NO: 1351839 - RNA, 21 nt, Homo sapiens
accucaucuguggagcugcca

SEQ ID NO: 1351840 - RNA, 23 nt, Homo sapiens
accuccagcuaaacaccaacccc

SEQ ID NO: 1351841 - RNA, 15 nt, Homo sapiens
accuccagggagcac

SEQ ID NO: 1351842 - RNA, 17 nt, Homo sapiens
accuccagugucagggu

SEQ ID NO: 1351843 - RNA, 21 nt, Homo sapiens
accucccccuuucacacugga

SEQ ID NO: 1351844 - RNA, 13 nt, Homo sapiens
accuccucuguga

SEQ ID NO: 1351845 - RNA, 22 nt, Homo sapiens
accucgucaagagcaugcacau

SEQ ID NO: 1351846 - RNA, 13 nt, Homo sapiens
accucgugccacc

SEQ ID NO: 1351847 - RNA, 15 nt, Homo sapiens
accucuacauugaaa

SEQ ID NO: 1351848 - RNA, 19 nt, Homo sapiens
accucuaccagcacauuaa

SEQ ID NO: 1351849 - RNA, 12 nt, Homo sapiens
accucuguggac

SEQ ID NO: 1351850 - RNA, 18 nt, Homo sapiens
accucugugggcacuggu

SEQ ID NO: 1351851 - RNA, 23 nt, Homo sapiens
accucuuggccacagaggacuca

SEQ ID NO: 1351852 - RNA, 17 nt, Homo sapiens
accucuuggcugccuug

SEQ ID NO: 1351853 - RNA, 17 nt, Homo sapiens
accugaaauuaacucag

SEQ ID NO: 1351854 - RNA, 14 nt, Homo sapiens
accugagauggagg

SEQ ID NO: 1351855 - RNA, 17 nt, Homo sapiens
accugcacuuacaggcc

SEQ ID NO: 1351856 - RNA, 16 nt, Homo sapiens
accugcgggagcugca

SEQ ID NO: 1351857 - RNA, 19 nt, Homo sapiens
accugcucuccucuugcca

SEQ ID NO: 1351858 - RNA, 23 nt, Homo sapiens
accugcugagaaaacaugccucu

SEQ ID NO: 1351859 - RNA, 20 nt, Homo sapiens
accuggagcuucagccaggu

SEQ ID NO: 1351860 - RNA, 12 nt, Homo sapiens
accuggauccag

SEQ ID NO: 1351861 - RNA, 19 nt, Homo sapiens
accuggcagccacaacugc

SEQ ID NO: 1351862 - RNA, 18 nt, Homo sapiens
accuggcccugugccuug

SEQ ID NO: 1351863 - RNA, 16 nt, Homo sapiens
accuggcgugcucaga

SEQ ID NO: 1351864 - RNA, 13 nt, Homo sapiens
accugggcaggga

SEQ ID NO: 1351865 - RNA, 19 nt, Homo sapiens
accuguaaucccagcacuu

SEQ ID NO: 1351866 - RNA, 14 nt, Homo sapiens
accuguccucuuug

SEQ ID NO: 1351867 - RNA, 23 nt, Homo sapiens
accugugugagagaauuuaucac

SEQ ID NO: 1351868 - RNA, 16 nt, Homo sapiens
accuucccaugcccug

SEQ ID NO: 1351869 - RNA, 15 nt, Homo sapiens
uuuagaugaauguca

SEQ ID NO: 1351870 - RNA, 14 nt, Homo sapiens
uuuagcaaaacugg

SEQ ID NO: 1351871 - RNA, 20 nt, Homo sapiens
uuuagcaguuuccucaguga

SEQ ID NO: 1351872 - RNA, 23 nt, Homo sapiens
uuuaggaagcuagacuagcugua

SEQ ID NO: 1351873 - RNA, 15 nt, Homo sapiens
uuuagucaugugacc

SEQ ID NO: 1351874 - RNA, 12 nt, Homo sapiens
uuuaguccugua

SEQ ID NO: 1351875 - RNA, 17 nt, Homo sapiens
uuuauaaauguauugau

SEQ ID NO: 1351876 - RNA, 13 nt, Homo sapiens
uuuauaauaaaca

SEQ ID NO: 1351877 - RNA, 12 nt, Homo sapiens
uuuauacaggaa

SEQ ID NO: 1351878 - RNA, 19 nt, Homo sapiens
uuuauaggagaaagcaaaa

SEQ ID NO: 1351879 - RNA, 22 nt, Homo sapiens
uuuauauauauaaagucaguga

SEQ ID NO: 1351880 - RNA, 14 nt, Homo sapiens
uuuaucaaucccag

SEQ ID NO: 1351881 - RNA, 18 nt, Homo sapiens
uuuaucacuucauucaca

SEQ ID NO: 1351882 - RNA, 19 nt, Homo sapiens
uuuaucacuucauucacau

SEQ ID NO: 1351883 - RNA, 23 nt, Homo sapiens
uuuaucacuucauucacauucag

SEQ ID NO: 1351884 - RNA, 20 nt, Homo sapiens
uuuaucugguucuauaugaa

SEQ ID NO: 1351885 - RNA, 14 nt, Homo sapiens
uuuauguacuaaau

SEQ ID NO: 1351886 - RNA, 14 nt, Homo sapiens
uuuauuaacuauuu

SEQ ID NO: 1351887 - RNA, 15 nt, Homo sapiens
uuuauuaacuauuua

SEQ ID NO: 1351888 - RNA, 17 nt, Homo sapiens
uacuuugaagugcagcu

SEQ ID NO: 1351889 - RNA, 22 nt, Homo sapiens
uacuuuuuccuggcucaucucu

SEQ ID NO: 1351890 - RNA, 20 nt, Homo sapiens
uagaaaauaaaacugagcua

SEQ ID NO: 1351891 - RNA, 13 nt, Homo sapiens
uagaaacuacaaa

SEQ ID NO: 1351892 - RNA, 17 nt, Homo sapiens
uagaaagagaaacaguu

SEQ ID NO: 1351893 - RNA, 13 nt, Homo sapiens
uagaacauuccau

SEQ ID NO: 1351894 - RNA, 17 nt, Homo sapiens
uagaacuccaguuuuca

SEQ ID NO: 1351895 - RNA, 20 nt, Homo sapiens
uagaagaaaguaaacuguaa

SEQ ID NO: 1351896 - RNA, 15 nt, Homo sapiens
uagaagaagcuuugc

SEQ ID NO: 1351897 - RNA, 12 nt, Homo sapiens
uagaagggcaaa

SEQ ID NO: 1351898 - RNA, 16 nt, Homo sapiens
uagaauaaauucccaa

SEQ ID NO: 1351899 - RNA, 12 nt, Homo sapiens
uagaauucugaa

SEQ ID NO: 1351900 - RNA, 15 nt, Homo sapiens
uagacacacauacau

SEQ ID NO: 1351901 - RNA, 15 nt, Homo sapiens
uagacuacucaauau

SEQ ID NO: 1351902 - RNA, 15 nt, Homo sapiens
uagacucauucuuca

SEQ ID NO: 1351903 - RNA, 15 nt, Homo sapiens
uagacugugccagag

SEQ ID NO: 1351904 - RNA, 20 nt, Homo sapiens
uagagaguccugguccucag

SEQ ID NO: 1351905 - RNA, 16 nt, Homo sapiens
uagagccccuacugug

SEQ ID NO: 1351906 - RNA, 22 nt, Homo sapiens
uagagcuaagauacugaugaca

SEQ ID NO: 1351907 - RNA, 17 nt, Homo sapiens
uagagcucuuguguuca

SEQ ID NO: 1351908 - RNA, 14 nt, Homo sapiens
uagagcugccugug

SEQ ID NO: 1351909 - RNA, 15 nt, Homo sapiens
uagagggggucucag

SEQ ID NO: 1351910 - RNA, 12 nt, Homo sapiens
uagagugcaaug

SEQ ID NO: 1351911 - RNA, 14 nt, Homo sapiens
uagaguguagccua

SEQ ID NO: 1351912 - RNA, 20 nt, Homo sapiens
uagauaugaagaaucugcuc

SEQ ID NO: 1351913 - RNA, 21 nt, Homo sapiens
uagauaugaagaaucugcucu

SEQ ID NO: 1351914 - RNA, 23 nt, Homo sapiens
uagauauggaaaauagugaugaa

SEQ ID NO: 1351915 - RNA, 21 nt, Homo sapiens
uguuuaaaaucauuucugcau

SEQ ID NO: 1351916 - RNA, 15 nt, Homo sapiens
uguuuaaaguggcaa

SEQ ID NO: 1351917 - RNA, 19 nt, Homo sapiens
uguuuacagaggacaguau

SEQ ID NO: 1351918 - RNA, 16 nt, Homo sapiens
uguuuauuugcacuau

SEQ ID NO: 1351919 - RNA, 14 nt, Homo sapiens
uguuugaacagggc

SEQ ID NO: 1351920 - RNA, 15 nt, Homo sapiens
uguuugaacagggca

SEQ ID NO: 1351921 - RNA, 16 nt, Homo sapiens
uguuuggaauauucca

SEQ ID NO: 1351922 - RNA, 16 nt, Homo sapiens
uguuuggacagcugau

SEQ ID NO: 1351923 - RNA, 17 nt, Homo sapiens
uguuuguuucuguagaa

SEQ ID NO: 1351924 - RNA, 14 nt, Homo sapiens
uguuuuaguucuug

SEQ ID NO: 1351925 - RNA, 16 nt, Homo sapiens
uguuuuugacagccuu

SEQ ID NO: 1351926 - RNA, 18 nt, Homo sapiens
uuaaaaaccaacugugaa

SEQ ID NO: 1351927 - RNA, 16 nt, Homo sapiens
uuaaaaaucuguaaau

SEQ ID NO: 1351928 - RNA, 17 nt, Homo sapiens
uuaaaaccaggcuuucu

SEQ ID NO: 1351929 - RNA, 14 nt, Homo sapiens
uuaaaagcccuuuu

SEQ ID NO: 1351930 - RNA, 22 nt, Homo sapiens
uuaaaaggaaauguaaaagcac

SEQ ID NO: 1351931 - RNA, 13 nt, Homo sapiens
uuaaaauacauga

SEQ ID NO: 1351932 - RNA, 14 nt, Homo sapiens
uuaaaaucugugaa

SEQ ID NO: 1351933 - RNA, 15 nt, Homo sapiens
uuaaaaugagcauug

SEQ ID NO: 1351934 - RNA, 16 nt, Homo sapiens
uuaaacaaaaaaccca

SEQ ID NO: 1351935 - RNA, 17 nt, Homo sapiens
uuaaacaaauaauuuag

SEQ ID NO: 1351936 - RNA, 17 nt, Homo sapiens
uuaaacaaucuuucaug

SEQ ID NO: 1351937 - RNA, 21 nt, Homo sapiens
uuaaacuaguguuauacuuga

SEQ ID NO: 1351938 - RNA, 16 nt, Homo sapiens
uuaaacucaucaaugu

SEQ ID NO: 1351939 - RNA, 11 nt, Homo sapiens
uuaaacucugu

SEQ ID NO: 1351940 - RNA, 17 nt, Homo sapiens
uuaaacuugcaguaucu

SEQ ID NO: 1351941 - RNA, 20 nt, Homo sapiens
uuaaagcuuauuaaaacuca

SEQ ID NO: 1351942 - RNA, 17 nt, Homo sapiens
uuaaaguggcaaucuca

SEQ ID NO: 1351943 - RNA, 15 nt, Homo sapiens
uuaaauaguggguaa

SEQ ID NO: 1351944 - RNA, 20 nt, Homo sapiens
uuaaaugaaaguauuggcau

SEQ ID NO: 1351945 - RNA, 14 nt, Homo sapiens
uuaaauguauacua

SEQ ID NO: 1351946 - RNA, 18 nt, Homo sapiens
uuaacauggacaugaucu

SEQ ID NO: 1351947 - RNA, 16 nt, Homo sapiens
uuaacucagacacaaa

SEQ ID NO: 1351948 - RNA, 11 nt, Homo sapiens
uuaacugccaa

SEQ ID NO: 1351949 - RNA, 23 nt, Homo sapiens
uuaacuguauuuucuuucacuuu

SEQ ID NO: 1351950 - RNA, 15 nt, Homo sapiens
uuaacuuacgaucuc

SEQ ID NO: 1351951 - RNA, 16 nt, Homo sapiens
uuaagaaccugaauau

SEQ ID NO: 1351952 - RNA, 14 nt, Homo sapiens
uuaagaacuaugac

SEQ ID NO: 1351953 - RNA, 18 nt, Homo sapiens
uuaagaccuggcagcucu

SEQ ID NO: 1351954 - RNA, 12 nt, Homo sapiens
uuaagacuaaaa

SEQ ID NO: 1351955 - RNA, 19 nt, Homo sapiens
uuaagacuaaaaguugcau

SEQ ID NO: 1351956 - RNA, 16 nt, Homo sapiens
uuaagacuggcuuuag

SEQ ID NO: 1351957 - RNA, 13 nt, Homo sapiens
uuaaggcacagug

SEQ ID NO: 1351958 - RNA, 16 nt, Homo sapiens
uuaaggcccucauucu

SEQ ID NO: 1351959 - RNA, 18 nt, Homo sapiens
uuaaggugaaccaaagaa

SEQ ID NO: 1351960 - RNA, 17 nt, Homo sapiens
uuaaguacaugugccag

SEQ ID NO: 1351961 - RNA, 15 nt, Homo sapiens
uuaagugaagccuac

SEQ ID NO: 1351962 - RNA, 16 nt, Homo sapiens
uuaaguuuucaugaau

SEQ ID NO: 1351963 - RNA, 13 nt, Homo sapiens
uuaauaaauugcu

SEQ ID NO: 1351964 - RNA, 12 nt, Homo sapiens
uuaauaacaggu

SEQ ID NO: 1351965 - RNA, 13 nt, Homo sapiens
uuaauaaucucac

SEQ ID NO: 1351966 - RNA, 19 nt, Homo sapiens
uuaauaucccuacauguau

SEQ ID NO: 1351967 - RNA, 18 nt, Homo sapiens
uuaauccuuaacacauuc

SEQ ID NO: 1351968 - RNA, 21 nt, Homo sapiens
uuaauguuugcauuuccucag

SEQ ID NO: 1351969 - RNA, 19 nt, Homo sapiens
uuaauuaaagaaaauuaau

SEQ ID NO: 1351970 - RNA, 13 nt, Homo sapiens
uuaauuacaaaca

SEQ ID NO: 1351971 - RNA, 20 nt, Homo sapiens
uuaauuuaauauuuacucua

SEQ ID NO: 1351972 - RNA, 17 nt, Homo sapiens
uuaauuuuccaaugcac

SEQ ID NO: 1351973 - RNA, 19 nt, Homo sapiens
uuacaauuuaaugcacuaa

SEQ ID NO: 1351974 - RNA, 21 nt, Homo sapiens
uuacaauuuaaugcacuaaaa

SEQ ID NO: 1351975 - RNA, 11 nt, Homo sapiens
uuacagcugcc

SEQ ID NO: 1351976 - RNA, 17 nt, Homo sapiens
uuacaggcgugagccac

SEQ ID NO: 1351977 - RNA, 14 nt, Homo sapiens
uuacauaucugacu

SEQ ID NO: 1351978 - RNA, 20 nt, Homo sapiens
uuacauccuugauuacuucc

SEQ ID NO: 1351979 - RNA, 12 nt, Homo sapiens
uuacaucuggcu

SEQ ID NO: 1351980 - RNA, 17 nt, Homo sapiens
uuacaugaagcuguaua

SEQ ID NO: 1351981 - RNA, 22 nt, Homo sapiens
uuacauuaaaauaaaccaaaua

SEQ ID NO: 1351982 - RNA, 18 nt, Homo sapiens
uuacauuucauacaacag

SEQ ID NO: 1351983 - RNA, 19 nt, Homo sapiens
uuaccaaagcaucaauaca

SEQ ID NO: 1351984 - RNA, 20 nt, Homo sapiens
uuaccaaggaugaaagagga

SEQ ID NO: 1351985 - RNA, 17 nt, Homo sapiens
uuaccacagcaacugac

SEQ ID NO: 1351986 - RNA, 14 nt, Homo sapiens
uuaccuauucugaa

SEQ ID NO: 1351987 - RNA, 14 nt, Homo sapiens
uuaccuccuaucag

SEQ ID NO: 1351988 - RNA, 20 nt, Homo sapiens
uuaccuucuaccucuuggcu

SEQ ID NO: 1351989 - RNA, 14 nt, Homo sapiens
uuaccuuguauacu

SEQ ID NO: 1351990 - RNA, 17 nt, Homo sapiens
uuacuaaaguacagaca

SEQ ID NO: 1351991 - RNA, 13 nt, Homo sapiens
uuacuaaucuuuc

SEQ ID NO: 1351992 - RNA, 16 nt, Homo sapiens
uuacuaucauaauuca

SEQ ID NO: 1351993 - RNA, 19 nt, Homo sapiens
uuacugagggccaccaaau

SEQ ID NO: 1351994 - RNA, 21 nt, Homo sapiens
uuacuggaauucuucugcaac

SEQ ID NO: 1351995 - RNA, 14 nt, Homo sapiens
uuacuguggauaaa

SEQ ID NO: 1351996 - RNA, 15 nt, Homo sapiens
uuacuuaauucaacu

SEQ ID NO: 1351997 - RNA, 16 nt, Homo sapiens
uuacuucccuaaugaa

SEQ ID NO: 1351998 - RNA, 19 nt, Homo sapiens
uuacuuuuuccuggcucau

SEQ ID NO: 1351999 - RNA, 18 nt, Homo sapiens
uuagaagccaacuaugau

SEQ ID NO: 1352000 - RNA, 19 nt, Homo sapiens
uuagaaugguugaguuaca

SEQ ID NO: 1352001 - RNA, 15 nt, Homo sapiens
uuagaauguugaaaa

SEQ ID NO: 1352002 - RNA, 20 nt, Homo sapiens
uuagaauguugaaaaguaau

SEQ ID NO: 1352003 - RNA, 16 nt, Homo sapiens
uuagaguaaugaaaug

SEQ ID NO: 1352004 - RNA, 15 nt, Homo sapiens
uuagcaaaacuggac

SEQ ID NO: 1352005 - RNA, 15 nt, Homo sapiens
uuagcugucugcuca

SEQ ID NO: 1352006 - RNA, 15 nt, Homo sapiens
uuaggugaaaauaau

SEQ ID NO: 1352007 - RNA, 16 nt, Homo sapiens
uuaguauuuuaauccu

SEQ ID NO: 1352008 - RNA, 21 nt, Homo sapiens
uuagucuguuguucuugaaaa

SEQ ID NO: 1352009 - RNA, 13 nt, Homo sapiens
uuagugauuccau

SEQ ID NO: 1352010 - RNA, 23 nt, Homo sapiens
uuaguggggacccaaagauucua

SEQ ID NO: 1352011 - RNA, 21 nt, Homo sapiens
uuagugucaacuuuuaacuuu

SEQ ID NO: 1352012 - RNA, 23 nt, Homo sapiens
uuaguguucuguuugaaacuaau

SEQ ID NO: 1352013 - RNA, 14 nt, Homo sapiens
uuauaaaaguuuau

SEQ ID NO: 1352014 - RNA, 14 nt, Homo sapiens
uuauaagcauuugu

SEQ ID NO: 1352015 - RNA, 13 nt, Homo sapiens
uuauacauuugau

SEQ ID NO: 1352016 - RNA, 23 nt, Homo sapiens
uuauaccugcucuuguucuacug

SEQ ID NO: 1352017 - RNA, 13 nt, Homo sapiens
uuauaguacauga

SEQ ID NO: 1352018 - RNA, 15 nt, Homo sapiens
uuauaguuacugugu

SEQ ID NO: 1352019 - RNA, 21 nt, Homo sapiens
uuauaucucccccacuccacu

SEQ ID NO: 1352020 - RNA, 21 nt, Homo sapiens
uuauauggauaaucugagcag

SEQ ID NO: 1352021 - RNA, 14 nt, Homo sapiens
uuauauuauuacua

SEQ ID NO: 1352022 - RNA, 16 nt, Homo sapiens
uuauauuauugauuca

SEQ ID NO: 1352023 - RNA, 14 nt, Homo sapiens
uuauauucuaauag

SEQ ID NO: 1352024 - RNA, 19 nt, Homo sapiens
uuauauuuuccucuuagau

SEQ ID NO: 1352025 - RNA, 20 nt, Homo sapiens
uuaucaauguucuaguucug

SEQ ID NO: 1352026 - RNA, 14 nt, Homo sapiens
uuaucagccugugc

SEQ ID NO: 1352027 - RNA, 13 nt, Homo sapiens
uuaucagugugca

SEQ ID NO: 1352028 - RNA, 16 nt, Homo sapiens
uuaucucaaaacugca

SEQ ID NO: 1352029 - RNA, 21 nt, Homo sapiens
uuaugaaaauauagacauucu

SEQ ID NO: 1352030 - RNA, 12 nt, Homo sapiens
uuaugaaugaca

SEQ ID NO: 1352031 - RNA, 13 nt, Homo sapiens
uuaugacuguugu

SEQ ID NO: 1352032 - RNA, 15 nt, Homo sapiens
uuaugcaaauacaau

SEQ ID NO: 1352033 - RNA, 20 nt, Homo sapiens
uuauguaugaaaauuauucu

SEQ ID NO: 1352034 - RNA, 15 nt, Homo sapiens
uuauguauuuuccaa

SEQ ID NO: 1352035 - RNA, 22 nt, Homo sapiens
uuauuaaguaacuuauuuauga

SEQ ID NO: 1352036 - RNA, 13 nt, Homo sapiens
uuauuaauuugaa

SEQ ID NO: 1352037 - RNA, 15 nt, Homo sapiens
uuauucagauuggga

SEQ ID NO: 1352038 - RNA, 17 nt, Homo sapiens
uuauuccugguuuaauu

SEQ ID NO: 1352039 - RNA, 16 nt, Homo sapiens
uuauugacucauacac

SEQ ID NO: 1352040 - RNA, 20 nt, Homo sapiens
uugaaacagauucaggccag

SEQ ID NO: 1352041 - RNA, 15 nt, Homo sapiens
uugaaacugagaugu

SEQ ID NO: 1352042 - RNA, 13 nt, Homo sapiens
uugaaauccagaa

SEQ ID NO: 1352043 - RNA, 20 nt, Homo sapiens
uugaaccauccacuuacaua

SEQ ID NO: 1352044 - RNA, 18 nt, Homo sapiens
uugaagaaaguagcagaa

SEQ ID NO: 1352045 - RNA, 17 nt, Homo sapiens
uugaagauuauaugaag

SEQ ID NO: 1352046 - RNA, 20 nt, Homo sapiens
uugaaggaguccuugcauca

SEQ ID NO: 1352047 - RNA, 13 nt, Homo sapiens
uugaagggccaga

SEQ ID NO: 1352048 - RNA, 16 nt, Homo sapiens
uugaaucuacauucac

SEQ ID NO: 1352049 - RNA, 20 nt, Homo sapiens
uugaaucuacauucacuuuu

SEQ ID NO: 1352050 - RNA, 19 nt, Homo sapiens
uugaaucuauuucacuuau

SEQ ID NO: 1352051 - RNA, 14 nt, Homo sapiens
uugaaugcacuuuu

SEQ ID NO: 1352052 - RNA, 21 nt, Homo sapiens
uugaauugugucccccauaaa

SEQ ID NO: 1352053 - RNA, 14 nt, Homo sapiens
uugacaacacagcc

SEQ ID NO: 1352054 - RNA, 11 nt, Homo sapiens
uugacaccugc

SEQ ID NO: 1352055 - RNA, 15 nt, Homo sapiens
uugacacugcucuaa

SEQ ID NO: 1352056 - RNA, 19 nt, Homo sapiens
ugaagguggaacaagcaca

SEQ ID NO: 1352057 - RNA, 23 nt, Homo sapiens
ugaagucaccccuuucuguccca

SEQ ID NO: 1352058 - RNA, 17 nt, Homo sapiens
ugaagucugagcccauu

SEQ ID NO: 1352059 - RNA, 17 nt, Homo sapiens
ugaagucuucuccucca

SEQ ID NO: 1352060 - RNA, 21 nt, Homo sapiens
ugaagugccuuaaauauagca

SEQ ID NO: 1352061 - RNA, 14 nt, Homo sapiens
ugaauaaaugucac

SEQ ID NO: 1352062 - RNA, 21 nt, Homo sapiens
ugaauagacacuucaccaaag

SEQ ID NO: 1352063 - RNA, 17 nt, Homo sapiens
ugcacaggucccacugc

SEQ ID NO: 1352064 - RNA, 19 nt, Homo sapiens
ugcacaguugccacauuua

SEQ ID NO: 1352065 - RNA, 11 nt, Homo sapiens
ugcaccaaaga

SEQ ID NO: 1352066 - RNA, 12 nt, Homo sapiens
ugcaccaaagac

SEQ ID NO: 1352067 - RNA, 18 nt, Homo sapiens
ugcaccaaagacaucagu

SEQ ID NO: 1352068 - RNA, 14 nt, Homo sapiens
ugcaccaccaugcc

SEQ ID NO: 1352069 - RNA, 19 nt, Homo sapiens
ugcaccaucucacugcagu

SEQ ID NO: 1352070 - RNA, 13 nt, Homo sapiens
ugcaccaugcugc

SEQ ID NO: 1352071 - RNA, 15 nt, Homo sapiens
ugcaccauugcacuc

SEQ ID NO: 1352072 - RNA, 19 nt, Homo sapiens
ugcacuacagcccuggccu

SEQ ID NO: 1352073 - RNA, 16 nt, Homo sapiens
ugcacuaugagccuau

SEQ ID NO: 1352074 - RNA, 12 nt, Homo sapiens
ugcacugaacag

SEQ ID NO: 1352075 - RNA, 19 nt, Homo sapiens
ugcagaggccaccuggauu

SEQ ID NO: 1352076 - RNA, 23 nt, Homo sapiens
ugcagauacuuugaagugcagcu

SEQ ID NO: 1352077 - RNA, 13 nt, Homo sapiens
ugcagauauucuc

SEQ ID NO: 1352078 - RNA, 15 nt, Homo sapiens
ugcagcacucuuauc

SEQ ID NO: 1352079 - RNA, 17 nt, Homo sapiens
ugcagcagcuucccuug

SEQ ID NO: 1352080 - RNA, 15 nt, Homo sapiens
ugcagcauuuacuau

SEQ ID NO: 1352081 - RNA, 22 nt, Homo sapiens
ugcagccacuggcuuggaacac

SEQ ID NO: 1352082 - RNA, 16 nt, Homo sapiens
ugcagccucaaccucc

SEQ ID NO: 1352083 - RNA, 23 nt, Homo sapiens
ugcaggaaagaauagaagugauu

SEQ ID NO: 1352084 - RNA, 13 nt, Homo sapiens
ugcaggaagggaa

SEQ ID NO: 1352085 - RNA, 21 nt, Homo sapiens
ugcaggagucccugccaucau

SEQ ID NO: 1352086 - RNA, 14 nt, Homo sapiens
ugcagggacugcca

SEQ ID NO: 1352087 - RNA, 22 nt, Homo sapiens
ugcagguguccugagcaccaca

SEQ ID NO: 1352088 - RNA, 19 nt, Homo sapiens
ugcaguacauuaauauuca

SEQ ID NO: 1352089 - RNA, 20 nt, Homo sapiens
ugcagucggugguaccugag

SEQ ID NO: 1352090 - RNA, 21 nt, Homo sapiens
ugcagucggugguaccugaga

SEQ ID NO: 1352091 - RNA, 18 nt, Homo sapiens
ugcaguuccaaaagagaa

SEQ ID NO: 1352092 - RNA, 16 nt, Homo sapiens
ugcaguuuacaguauu

SEQ ID NO: 1352093 - RNA, 17 nt, Homo sapiens
ugcaguuucuuuucaca

SEQ ID NO: 1352094 - RNA, 20 nt, Homo sapiens
ugcauacuuucccucaucca

SEQ ID NO: 1352095 - RNA, 17 nt, Homo sapiens
ugcauagcaagugaaag

SEQ ID NO: 1352096 - RNA, 17 nt, Homo sapiens
ugcauaugucacuagaa

SEQ ID NO: 1352097 - RNA, 14 nt, Homo sapiens
ugcauauuugcaaa

SEQ ID NO: 1352098 - RNA, 18 nt, Homo sapiens
ugcaucuucccacagugg

SEQ ID NO: 1352099 - RNA, 19 nt, Homo sapiens
ugcauguaucuucuaagaa

SEQ ID NO: 1352100 - RNA, 15 nt, Homo sapiens
ugcauucacauaucu

SEQ ID NO: 1352101 - RNA, 20 nt, Homo sapiens
ugcauucucuauagagccaa

SEQ ID NO: 1352102 - RNA, 14 nt, Homo sapiens
ugcauucucuccca

SEQ ID NO: 1352103 - RNA, 23 nt, Homo sapiens
ugcauugccuguaacaauguaau

SEQ ID NO: 1352104 - RNA, 23 nt, Homo sapiens
ugcauuguaggauguugagcagc

SEQ ID NO: 1352105 - RNA, 19 nt, Homo sapiens
ugcauuuauuauucucaaa

SEQ ID NO: 1352106 - RNA, 22 nt, Homo sapiens
ugcauuucauaaacuaauagaa

SEQ ID NO: 1352107 - RNA, 18 nt, Homo sapiens
ugcauuugcagugcauca

SEQ ID NO: 1352108 - RNA, 20 nt, Homo sapiens
ugcauuuggauugggguccc

SEQ ID NO: 1352109 - RNA, 17 nt, Homo sapiens
ugcauuuuuuauuuagu

SEQ ID NO: 1352110 - RNA, 22 nt, Homo sapiens
ugccaaaaggauaaaugucuuu

SEQ ID NO: 1352111 - RNA, 17 nt, Homo sapiens
ugccaaccuguucuuag

SEQ ID NO: 1352112 - RNA, 18 nt, Homo sapiens
ugccaauugagggcauua

SEQ ID NO: 1352113 - RNA, 20 nt, Homo sapiens
ugccacccaguugugacaau

SEQ ID NO: 1352114 - RNA, 14 nt, Homo sapiens
ugccacugccucuu

SEQ ID NO: 1352115 - RNA, 17 nt, Homo sapiens
ugccagagguaauguua

SEQ ID NO: 1352116 - RNA, 19 nt, Homo sapiens
ugccagauggaacaauaaa

SEQ ID NO: 1352117 - RNA, 15 nt, Homo sapiens
ugcccaaaucuuuag

SEQ ID NO: 1352118 - RNA, 19 nt, Homo sapiens
ugcccaggcuagagugcaa

SEQ ID NO: 1352119 - RNA, 14 nt, Homo sapiens
ugcccaggggagcc

SEQ ID NO: 1352120 - RNA, 22 nt, Homo sapiens
ugcccagucgaccccaaaggaa

SEQ ID NO: 1352121 - RNA, 15 nt, Homo sapiens
ugcccauugucuuau

SEQ ID NO: 1352122 - RNA, 19 nt, Homo sapiens
ugccccaccccaccucaca

SEQ ID NO: 1352123 - RNA, 14 nt, Homo sapiens
ugcccgcccgggga

SEQ ID NO: 1352124 - RNA, 21 nt, Homo sapiens
ugcccuccacuccacugccuu

SEQ ID NO: 1352125 - RNA, 15 nt, Homo sapiens
ugcccuuacaggaac

SEQ ID NO: 1352126 - RNA, 12 nt, Homo sapiens
ugccgcucucuc

SEQ ID NO: 1352127 - RNA, 15 nt, Homo sapiens
ugccgcucucucuga

SEQ ID NO: 1352128 - RNA, 19 nt, Homo sapiens
ugccgcucucucugagggg

SEQ ID NO: 1352129 - RNA, 19 nt, Homo sapiens
ugccgcuuucucugagggg

SEQ ID NO: 1352130 - RNA, 15 nt, Homo sapiens
ugccuaucugacuuc

SEQ ID NO: 1352131 - RNA, 23 nt, Homo sapiens
ugccuaucugacuucauacaucc

SEQ ID NO: 1352132 - RNA, 14 nt, Homo sapiens
ugccuccaccagca

SEQ ID NO: 1352133 - RNA, 19 nt, Homo sapiens
ugccucugaguagggcaau

SEQ ID NO: 1352134 - RNA, 13 nt, Homo sapiens
ugccucuggaugc
